United States Patent 7,374,927 (METHODS OF ANALYSIS OF DEGRADED NUCLEIC ACID SAMPLES) - sequence listing, part 3

SEQ ID NO: 79791 - DNA, 25 bp, Homo sapien
cgtatctaaggagctgaggtaatac

SEQ ID NO: 79792 - DNA, 25 bp, Homo sapien
tccagccccataaagagtgtcatgt

SEQ ID NO: 79793 - DNA, 25 bp, Homo sapien
gccccataaagagtgtcatgttagc

SEQ ID NO: 79794 - DNA, 25 bp, Homo sapien
agagtgtcatgttagctgagtcacc

SEQ ID NO: 79795 - DNA, 25 bp, Homo sapien
gtgtcatgttagctgagtcaccatt

SEQ ID NO: 79796 - DNA, 25 bp, Homo sapien
gtcatgttagctgagtcaccatttg

SEQ ID NO: 79797 - DNA, 25 bp, Homo sapien
tgagtcaccatttggcttcggcctg

SEQ ID NO: 79798 - DNA, 25 bp, Homo sapien
tcaccatttggcttcggcctggaaa

SEQ ID NO: 79799 - DNA, 25 bp, Homo sapien
accatttggcttcggcctggaaata

SEQ ID NO: 79800 - DNA, 25 bp, Homo sapien
agaacactgatcgtgtgcgaggcca

SEQ ID NO: 79801 - DNA, 25 bp, Homo sapien
acactgatcgtgtgcgaggccagga

SEQ ID NO: 79802 - DNA, 25 bp, Homo sapien
tgatcgtgtgcgaggccaggagatc

SEQ ID NO: 79803 - DNA, 25 bp, Homo sapien
cagcagtcgcagaatgagcacctgg

SEQ ID NO: 79804 - DNA, 25 bp, Homo sapien
agcagtcgcagaatgagcacctggc

SEQ ID NO: 79805 - DNA, 25 bp, Homo sapien
gcagtcgcagaatgagcacctggca

SEQ ID NO: 79806 - DNA, 25 bp, Homo sapien
cagtcgcagaatgagcacctggcag

SEQ ID NO: 79807 - DNA, 25 bp, Homo sapien
agtcgcagaatgagcacctggcagg

SEQ ID NO: 79808 - DNA, 25 bp, Homo sapien
gtcgcagaatgagcacctggcaggg

SEQ ID NO: 79809 - DNA, 25 bp, Homo sapien
tcgcagaatgagcacctggcagggt

SEQ ID NO: 79810 - DNA, 25 bp, Homo sapien
cgcagaatgagcacctggcagggtg

SEQ ID NO: 79811 - DNA, 25 bp, Homo sapien
gcagaatgagcacctggcagggtgg

SEQ ID NO: 79812 - DNA, 25 bp, Homo sapien
cagaatgagcacctggcagggtggg

SEQ ID NO: 79813 - DNA, 25 bp, Homo sapien
cctgggatgatcattgctagaactg

SEQ ID NO: 79814 - DNA, 25 bp, Homo sapien
ttgctagaactgagagaccagcctg

SEQ ID NO: 79815 - DNA, 25 bp, Homo sapien
cagcagccttccctctcagaggata

SEQ ID NO: 79816 - DNA, 25 bp, Homo sapien
ccctctcagaggatacatttgtaac

SEQ ID NO: 79817 - DNA, 25 bp, Homo sapien
atttgtaaccattacacagtcatca

SEQ ID NO: 79818 - DNA, 25 bp, Homo sapien
caccgtgattggacttgcgaatagc

SEQ ID NO: 79819 - DNA, 25 bp, Homo sapien
gtgattggacttgcgaatagccact

SEQ ID NO: 79820 - DNA, 25 bp, Homo sapien
tgcactgcggcctggacgacgtagt

SEQ ID NO: 79821 - DNA, 25 bp, Homo sapien
ggacgacgtagtgataccctgactc

SEQ ID NO: 79822 - DNA, 25 bp, Homo sapien
gacgtagtgataccctgactcttat

SEQ ID NO: 79823 - DNA, 25 bp, Homo sapien
gtgataccctgactcttataaataa

SEQ ID NO: 79824 - DNA, 25 bp, Homo sapien
agtctggcttgattttcagccgtca

SEQ ID NO: 79825 - DNA, 25 bp, Homo sapien
agccgtcatcattgggttctgtttt

SEQ ID NO: 79826 - DNA, 25 bp, Homo sapien
gttctgttttgacagctctgctgtc

SEQ ID NO: 79827 - DNA, 25 bp, Homo sapien
acagctctgctgtcccatagggact

SEQ ID NO: 79828 - DNA, 25 bp, Homo sapien
cccatagggactgcgactgggacca

SEQ ID NO: 79829 - DNA, 25 bp, Homo sapien
tgggaccaggtcaaccacgccaggg

SEQ ID NO: 79830 - DNA, 25 bp, Homo sapien
accattggcatcatcgtttcttttc

SEQ ID NO: 79831 - DNA, 25 bp, Homo sapien
catatcagcaatagtctgctctccc

SEQ ID NO: 79832 - DNA, 25 bp, Homo sapien
aatagtctgctctccccgggaatct

SEQ ID NO: 79833 - DNA, 25 bp, Homo sapien
ccgggaatctctaacatgctctgtt

SEQ ID NO: 79834 - DNA, 25 bp, Homo sapien
aacatgctctgtttacatcgataaa

SEQ ID NO: 79835 - DNA, 25 bp, Homo sapien
gaagtttacaagtttgtgcctggtc

SEQ ID NO: 79836 - DNA, 25 bp, Homo sapien
ttacaagtttgtgcctggtcgcctc

SEQ ID NO: 79837 - DNA, 25 bp, Homo sapien
tggtcgcctcctcagatctgcaagc

SEQ ID NO: 79838 - DNA, 25 bp, Homo sapien
gacaaatagaaacaggtcccctggg

SEQ ID NO: 79839 - DNA, 25 bp, Homo sapien
aaacaggtcccctgggagtgctgag

SEQ ID NO: 79840 - DNA, 25 bp, Homo sapien
aggtcccctgggagtgctgagtcac

SEQ ID NO: 79841 - DNA, 25 bp, Homo sapien
gaaggccgggcgattttaccctgtg

SEQ ID NO: 79842 - DNA, 25 bp, Homo sapien
gcgattttaccctgtgccctgtgaa

SEQ ID NO: 79843 - DNA, 25 bp, Homo sapien
gaggaaaaactcttgtcagatggga

SEQ ID NO: 79844 - DNA, 25 bp, Homo sapien
aactcttgtcagatgggaaaaatgc

SEQ ID NO: 79845 - DNA, 25 bp, Homo sapien
aaaatgctcatgacataatgtgaca

SEQ ID NO: 79846 - DNA, 25 bp, Homo sapien
aacacaatcagctctttctgcatgt

SEQ ID NO: 79847 - DNA, 25 bp, Homo sapien
tttctgcatgtgctggtcaaatcca

SEQ ID NO: 79848 - DNA, 25 bp, Homo sapien
tctgcatgtgctggtcaaatccaaa

SEQ ID NO: 79849 - DNA, 25 bp, Homo sapien
tgcatgtgctggtcaaatccaaacc

SEQ ID NO: 79850 - DNA, 25 bp, Homo sapien
aacccagagaacagaagcgctttct

SEQ ID NO: 79851 - DNA, 25 bp, Homo sapien
cagagaacagaagcgctttctaaga

SEQ ID NO: 79852 - DNA, 25 bp, Homo sapien
acagaagcgctttctaagaatgaac

SEQ ID NO: 79853 - DNA, 25 bp, Homo sapien
aaagcattcttgttacatactggtc

SEQ ID NO: 79854 - DNA, 25 bp, Homo sapien
gttacatactggtcaatttgtgata

SEQ ID NO: 79855 - DNA, 25 bp, Homo sapien
gtcaatttgtgatatgttttaactt

SEQ ID NO: 79856 - DNA, 25 bp, Homo sapien
atatgttttaacttaatgtctgtgt

SEQ ID NO: 79857 - DNA, 25 bp, Homo sapien
gattcggttatggaccatcatttcc

SEQ ID NO: 79858 - DNA, 25 bp, Homo sapien
atggaccatcatttccggaagccag

SEQ ID NO: 79859 - DNA, 25 bp, Homo sapien
ccatcatttccggaagccagcaaat

SEQ ID NO: 79860 - DNA, 25 bp, Homo sapien
tttccggaagccagcaaatgatata

SEQ ID NO: 79861 - DNA, 25 bp, Homo sapien
aatgatataacgtctcagctggaga

SEQ ID NO: 79862 - DNA, 25 bp, Homo sapien
taacgtctcagctggagatcaattt

SEQ ID NO: 79863 - DNA, 25 bp, Homo sapien
gctggagatcaattttggagacctt

SEQ ID NO: 79864 - DNA, 25 bp, Homo sapien
ttggagaccttggccgcccaggacg

SEQ ID NO: 79865 - DNA, 25 bp, Homo sapien
aaaccgtggcagcaggaccgacaag

SEQ ID NO: 79866 - DNA, 25 bp, Homo sapien
gaccgacaagtcaagtgcttctgct

SEQ ID NO: 79867 - DNA, 25 bp, Homo sapien
atgtggatgacccagaggcattccc

SEQ ID NO: 79868 - DNA, 25 bp, Homo sapien
gaggacagtgcttccaagtacatct

SEQ ID NO: 79869 - DNA, 25 bp, Homo sapien
ttccaagtacatcttctcccagatt

SEQ ID NO: 79870 - DNA, 25 bp, Homo sapien
tcccagattctctggcctttttaat

SEQ ID NO: 79871 - DNA, 25 bp, Homo sapien
tggcctttttaatgagctattgtta

SEQ ID NO: 79872 - DNA, 25 bp, Homo sapien
accaacagggtagtttatcttacat

SEQ ID NO: 79873 - DNA, 25 bp, Homo sapien
gtagtttatcttacatcagaccctt

SEQ ID NO: 79874 - DNA, 25 bp, Homo sapien
acatcagacccttttctggtagagg

SEQ ID NO: 79875 - DNA, 25 bp, Homo sapien
tatggtaacacctaactgagcctca

SEQ ID NO: 79876 - DNA, 25 bp, Homo sapien
acctaactgagcctcactcacatta

SEQ ID NO: 79877 - DNA, 25 bp, Homo sapien
acactttcctacttatgtaaattat

SEQ ID NO: 79878 - DNA, 25 bp, Homo sapien
tatagatcctaaattcacgcacccc

SEQ ID NO: 79879 - DNA, 25 bp, Homo sapien
tgtggcctacctggctatacatctt

SEQ ID NO: 79880 - DNA, 25 bp, Homo sapien
tacctggctatacatcttcatccct

SEQ ID NO: 79881 - DNA, 25 bp, Homo sapien
gtgtggccaggcagttatagattaa

SEQ ID NO: 79882 - DNA, 25 bp, Homo sapien
aaaggcctgtgagtactgctgagct

SEQ ID NO: 79883 - DNA, 25 bp, Homo sapien
gcctgtgagtactgctgagcttggt

SEQ ID NO: 79884 - DNA, 25 bp, Homo sapien
gaaggcctggcctaggatcctagat

SEQ ID NO: 79885 - DNA, 25 bp, Homo sapien
cctaggatcctagataagcaggtga

SEQ ID NO: 79886 - DNA, 25 bp, Homo sapien
agcaggtgaaatttaggcttcagaa

SEQ ID NO: 79887 - DNA, 25 bp, Homo sapien
taggcttcagaatatatccgagagg

SEQ ID NO: 79888 - DNA, 25 bp, Homo sapien
ggtcccttggaagctggtgaagtcc

SEQ ID NO: 79889 - DNA, 25 bp, Homo sapien
ggtgaagtcctgttcttattatgaa

SEQ ID NO: 79890 - DNA, 25 bp, Homo sapien
ccgcgtggtgtctgggcgcttccca

SEQ ID NO: 79891 - DNA, 25 bp, Homo sapien
acctggcagcctgtgaccgcggttg

SEQ ID NO: 79892 - DNA, 25 bp, Homo sapien
cctggaccgagtatgggcttatgat

SEQ ID NO: 79893 - DNA, 25 bp, Homo sapien
atgggcttatgatgttcctgagggt

SEQ ID NO: 79894 - DNA, 25 bp, Homo sapien
ggccttatttctcaggccagctgag

SEQ ID NO: 79895 - DNA, 25 bp, Homo sapien
gccttatttctcaggccagctgagt

SEQ ID NO: 79896 - DNA, 25 bp, Homo sapien
ccttatttctcaggccagctgagta

SEQ ID NO: 79897 - DNA, 25 bp, Homo sapien
tatttctcaggccagctgagtatta

SEQ ID NO: 79898 - DNA, 25 bp, Homo sapien
atttctcaggccagctgagtattag

SEQ ID NO: 79899 - DNA, 25 bp, Homo sapien
tcaggccagctgagtattagacacg

SEQ ID NO: 79900 - DNA, 25 bp, Homo sapien
aggccagctgagtattagacacgat

SEQ ID NO: 79901 - DNA, 25 bp, Homo sapien
tccctgggacaaaagttggtggccg

SEQ ID NO: 79902 - DNA, 25 bp, Homo sapien
gacaaaagttggtggccgcctacgt

SEQ ID NO: 79903 - DNA, 25 bp, Homo sapien
ttggtggccgcctacgtcttgggcc

SEQ ID NO: 79904 - DNA, 25 bp, Homo sapien
acgtcttgggcctcctcaccatggt

SEQ ID NO: 79905 - DNA, 25 bp, Homo sapien
accatggtgttcctccggacctgag

SEQ ID NO: 79906 - DNA, 25 bp, Homo sapien
tccctgggcagggtcttgaggcagc

SEQ ID NO: 79907 - DNA, 25 bp, Homo sapien
tgaggcagccactgtgatgctcata

SEQ ID NO: 79908 - DNA, 25 bp, Homo sapien
cagccactgtgatgctcatacctta

SEQ ID NO: 79909 - DNA, 25 bp, Homo sapien
actgtgatgctcataccttaccttg

SEQ ID NO: 79910 - DNA, 25 bp, Homo sapien
aaacacccagggatttgtactcatt

SEQ ID NO: 79911 - DNA, 25 bp, Homo sapien
cccagggatttgtactcattttcca

SEQ ID NO: 79912 - DNA, 25 bp, Homo sapien
ttatcttgctttccctaggagttga

SEQ ID NO: 79913 - DNA, 25 bp, Homo sapien
taggagttgaatccttctccctgcc

SEQ ID NO: 79914 - DNA, 25 bp, Homo sapien
atgaccatgtagtggcaagcagcct

SEQ ID NO: 79915 - DNA, 25 bp, Homo sapien
aagcagccttttactcttctgttag

SEQ ID NO: 79916 - DNA, 25 bp, Homo sapien
ttttactcttctgttagctctggac

SEQ ID NO: 79917 - DNA, 25 bp, Homo sapien
tagctctggactcttaacacttaag

SEQ ID NO: 79918 - DNA, 25 bp, Homo sapien
aacacttaagttactcttctgaaat

SEQ ID NO: 79919 - DNA, 25 bp, Homo sapien
ttctgaaattgctaggaccattggg

SEQ ID NO: 79920 - DNA, 25 bp, Homo sapien
atgtccgacctgtgatcgtggtaca

SEQ ID NO: 79921 - DNA, 25 bp, Homo sapien
tgtgatcgtggtacagcattagctg

SEQ ID NO: 79922 - DNA, 25 bp, Homo sapien
gcattagctgaaatttacccttgtt

SEQ ID NO: 79923 - DNA, 25 bp, Homo sapien
gggaaacatacaccccttgtctcac

SEQ ID NO: 79924 - DNA, 25 bp, Homo sapien
accaccaaccttgcttgtgtagtca

SEQ ID NO: 79925 - DNA, 25 bp, Homo sapien
aaggactcactgcatgtacccggac

SEQ ID NO: 79926 - DNA, 25 bp, Homo sapien
ggacccctaggcctggcctttgcag

SEQ ID NO: 79927 - DNA, 25 bp, Homo sapien
gcctttgcagcatagttgggagctt

SEQ ID NO: 79928 - DNA, 25 bp, Homo sapien
ggcctgagactgctggatacaatgt

SEQ ID NO: 79929 - DNA, 25 bp, Homo sapien
gactgctggatacaatgttgggcaa

SEQ ID NO: 79930 - DNA, 25 bp, Homo sapien
aatgttgggcaacaactcagccagc

SEQ ID NO: 79931 - DNA, 25 bp, Homo sapien
aacaactcagccagcctgatggcag

SEQ ID NO: 79932 - DNA, 25 bp, Homo sapien
agcctcagaggcttactctaaccca

SEQ ID NO: 79933 - DNA, 25 bp, Homo sapien
ttactctaacccatcccagaataaa

SEQ ID NO: 79934 - DNA, 25 bp, Homo sapien
gtatttatacgttaagacctctatg

SEQ ID NO: 79935 - DNA, 25 bp, Homo sapien
agacctctatgaatgaatgtatcag

SEQ ID NO: 79936 - DNA, 25 bp, Homo sapien
gagaatgtctttgtaactgtttaat

SEQ ID NO: 79937 - DNA, 25 bp, Homo sapien
aatctaactaactaactcatttatt

SEQ ID NO: 79938 - DNA, 25 bp, Homo sapien
atccttgctgcactgttgcagtcat

SEQ ID NO: 79939 - DNA, 25 bp, Homo sapien
gcagtcattctgaaaggacctttcc

SEQ ID NO: 79940 - DNA, 25 bp, Homo sapien
cattctgaaaggacctttccctgta

SEQ ID NO: 79941 - DNA, 25 bp, Homo sapien
aacatgcttcaatcttatcaacgct

SEQ ID NO: 79942 - DNA, 25 bp, Homo sapien
tgcttcaatcttatcaacgctacat

SEQ ID NO: 79943 - DNA, 25 bp, Homo sapien
tcttatcaacgctacattttgtatt

SEQ ID NO: 79944 - DNA, 25 bp, Homo sapien
ttcaaacaagtataaattctgcaat

SEQ ID NO: 79945 - DNA, 25 bp, Homo sapien
atgtgatgttcatgcttgccattct

SEQ ID NO: 79946 - DNA, 25 bp, Homo sapien
atgttcatgcttgccattcttctga

SEQ ID NO: 79947 - DNA, 25 bp, Homo sapien
attcttccacccctttctggtatat

SEQ ID NO: 79948 - DNA, 25 bp, Homo sapien
acccctttctggtatatcgggaatg

SEQ ID NO: 79949 - DNA, 25 bp, Homo sapien
tcgggaatgccgtacttggaaagaa

SEQ ID NO: 79950 - DNA, 25 bp, Homo sapien
aagaaagtccctctgcaattgcata

SEQ ID NO: 79951 - DNA, 25 bp, Homo sapien
ttgcatagttcagaagccctcactt

SEQ ID NO: 79952 - DNA, 25 bp, Homo sapien
gatggttttgttcatcttccaccac

SEQ ID NO: 79953 - DNA, 25 bp, Homo sapien
gttcatcttccaccacctttgagga

SEQ ID NO: 79954 - DNA, 25 bp, Homo sapien
gaggacctcgtgtcccaaaagactt

SEQ ID NO: 79955 - DNA, 25 bp, Homo sapien
aaaagactttgcctatcccagcaaa

SEQ ID NO: 79956 - DNA, 25 bp, Homo sapien
ggcattatggctcctccacctggta

SEQ ID NO: 79957 - DNA, 25 bp, Homo sapien
gcattatggctcctccacctggtat

SEQ ID NO: 79958 - DNA, 25 bp, Homo sapien
cattatggctcctccacctggtatg

SEQ ID NO: 79959 - DNA, 25 bp, Homo sapien
attatggctcctccacctggtatga

SEQ ID NO: 79960 - DNA, 25 bp, Homo sapien
ttatggctcctccacctggtatgag

SEQ ID NO: 79961 - DNA, 25 bp, Homo sapien
tatggctcctccacctggtatgaga

SEQ ID NO: 79962 - DNA, 25 bp, Homo sapien
atggctcctccacctggtatgagac

SEQ ID NO: 79963 - DNA, 25 bp, Homo sapien
ggctcctccacctggtatgagacca

SEQ ID NO: 79964 - DNA, 25 bp, Homo sapien
gctcctccacctggtatgagaccac

SEQ ID NO: 79965 - DNA, 25 bp, Homo sapien
ccacctggtatgagaccacccatgg

SEQ ID NO: 79966 - DNA, 25 bp, Homo sapien
cacctggtatgagaccacccatggg

SEQ ID NO: 79967 - DNA, 25 bp, Homo sapien
ctaccaaaggtagacattgcttctg

SEQ ID NO: 79968 - DNA, 25 bp, Homo sapien
caaaggtagacattgcttctgcaga

SEQ ID NO: 79969 - DNA, 25 bp, Homo sapien
aggtagacattgcttctgcagaaag

SEQ ID NO: 79970 - DNA, 25 bp, Homo sapien
gacattgcttctgcagaaagcagca

SEQ ID NO: 79971 - DNA, 25 bp, Homo sapien
tgcttctgcagaaagcagcatttaa

SEQ ID NO: 79972 - DNA, 25 bp, Homo sapien
agcatttaaatgctgatgcgtgaca

SEQ ID NO: 79973 - DNA, 25 bp, Homo sapien
tgctgatgcgtgacatagcttcctc

SEQ ID NO: 79974 - DNA, 25 bp, Homo sapien
tttttctgaagtgatctgctggaat

SEQ ID NO: 79975 - DNA, 25 bp, Homo sapien
tctgaagtgatctgctggaattcca

SEQ ID NO: 79976 - DNA, 25 bp, Homo sapien
gaattccaaacagaagttccatata

SEQ ID NO: 79977 - DNA, 25 bp, Homo sapien
aacagaagttccatatatacaaata

SEQ ID NO: 79978 - DNA, 25 bp, Homo sapien
ttagaggatcataggtctggacact

SEQ ID NO: 79979 - DNA, 25 bp, Homo sapien
gtctggacactccatccttgccaaa

SEQ ID NO: 79980 - DNA, 25 bp, Homo sapien
cttgccaaacctctacccaaaagtg

SEQ ID NO: 79981 - DNA, 25 bp, Homo sapien
aaagtggccttaagcaccggaatgc

SEQ ID NO: 79982 - DNA, 25 bp, Homo sapien
gcaccggaatgccaattaactagag

SEQ ID NO: 79983 - DNA, 25 bp, Homo sapien
tgccaattaactagagaccctccag

SEQ ID NO: 79984 - DNA, 25 bp, Homo sapien
agaacctgaggttttgccatccaca

SEQ ID NO: 79985 - DNA, 25 bp, Homo sapien
tgaggttttgccatccacaatccct

SEQ ID NO: 79986 - DNA, 25 bp, Homo sapien
gagtgcaacaaatgcttctattcca

SEQ ID NO: 79987 - DNA, 25 bp, Homo sapien
gcttctattccatagctacggcatt

SEQ ID NO: 79988 - DNA, 25 bp, Homo sapien
gctacggcattgctcagtaagttga

SEQ ID NO: 79989 - DNA, 25 bp, Homo sapien
gttaccatcctaatgtaaatactgg

SEQ ID NO: 79990 - DNA, 25 bp, Homo sapien
atttttctgtcatttagcaccatgc

SEQ ID NO: 79991 - DNA, 25 bp, Homo sapien
ttttctgtcatttagcaccatgctg

SEQ ID NO: 79992 - DNA, 25 bp, Homo sapien
tgtcatttagcaccatgctgcttct

SEQ ID NO: 79993 - DNA, 25 bp, Homo sapien
catttagcaccatgctgcttctgtc

SEQ ID NO: 79994 - DNA, 25 bp, Homo sapien
gcttctgtctgtcttaatgctggca

SEQ ID NO: 79995 - DNA, 25 bp, Homo sapien
tctgtctgtcttaatgctggcatta

SEQ ID NO: 79996 - DNA, 25 bp, Homo sapien
ctccattaaaacttgccttaagcta

SEQ ID NO: 79997 - DNA, 25 bp, Homo sapien
aaacttgccttaagctaccagattg

SEQ ID NO: 79998 - DNA, 25 bp, Homo sapien
tgccttaagctaccagattgctttt

SEQ ID NO: 79999 - DNA, 25 bp, Homo sapien
gccaccattggccatactgtgtgtt

SEQ ID NO: 80000 - DNA, 25 bp, Homo sapien
aaggcgggagcgatctcgatcccga

SEQ ID NO: 80001 - DNA, 25 bp, Homo sapien
tctcgatcccgagaaagacactggg

SEQ ID NO: 80002 - DNA, 25 bp, Homo sapien
gagaaagacactgggactcgaggac

SEQ ID NO: 80003 - DNA, 25 bp, Homo sapien
gatggcaagaaagagagccgaccag

SEQ ID NO: 80004 - DNA, 25 bp, Homo sapien
gggtgtggcccgacaatgactggga

SEQ ID NO: 80005 - DNA, 25 bp, Homo sapien
gagggacttcagagatgacaggatc

SEQ ID NO: 80006 - DNA, 25 bp, Homo sapien
aagaggcaagtagaggcccaacagc

SEQ ID NO: 80007 - DNA, 25 bp, Homo sapien
tagaggcccaacagcagaaccccaa

SEQ ID NO: 80008 - DNA, 25 bp, Homo sapien
agaaccccaaagtgaagttacagtg

SEQ ID NO: 80009 - DNA, 25 bp, Homo sapien
gggattgtctttcaacgcagcgtga

SEQ ID NO: 80010 - DNA, 25 bp, Homo sapien
gattgtctttcaacgcagcgtgagt

SEQ ID NO: 80011 - DNA, 25 bp, Homo sapien
gtggcattttagatgccctcacgaa

SEQ ID NO: 80012 - DNA, 25 bp, Homo sapien
gatgccctcacgaatatgaagctta

SEQ ID NO: 80013 - DNA, 25 bp, Homo sapien
tatgaagcttagcacagctctagtt

SEQ ID NO: 80014 - DNA, 25 bp, Homo sapien
gcacagctctagttacattcttatg

SEQ ID NO: 80015 - DNA, 25 bp, Homo sapien
taataggtccttccactttttggag

SEQ ID NO: 80016 - DNA, 25 bp, Homo sapien
ggtccttccactttttggagagtag

SEQ ID NO: 80017 - DNA, 25 bp, Homo sapien
ggagagtagcaaatctagctttttt

SEQ ID NO: 80018 - DNA, 25 bp, Homo sapien
atctagcttttttgtacagacttag

SEQ ID NO: 80019 - DNA, 25 bp, Homo sapien
agatttcatctttttacctcatatt

SEQ ID NO: 80020 - DNA, 25 bp, Homo sapien
tggctcaagcaacatgtatatcagt

SEQ ID NO: 80021 - DNA, 25 bp, Homo sapien
gactttttctttcttagatctagtt

SEQ ID NO: 80022 - DNA, 25 bp, Homo sapien
gggaccttattgatgaaagaaaccg

SEQ ID NO: 80023 - DNA, 25 bp, Homo sapien
tgaaagaaaccgtctttgcgttaca

SEQ ID NO: 80024 - DNA, 25 bp, Homo sapien
gtctttgcgttacacccgagtctgc

SEQ ID NO: 80025 - DNA, 25 bp, Homo sapien
ttacacccgagtctgcctctcggag

SEQ ID NO: 80026 - DNA, 25 bp, Homo sapien
accttccgcgacgtgttctgagggt

SEQ ID NO: 80027 - DNA, 25 bp, Homo sapien
gtgttctgagggtctgcatcttagg

SEQ ID NO: 80028 - DNA, 25 bp, Homo sapien
gggcaaatcgccacctgtgcctttc

SEQ ID NO: 80029 - DNA, 25 bp, Homo sapien
ggaaagcgggaagcgctcgctccct

SEQ ID NO: 80030 - DNA, 25 bp, Homo sapien
cccattagtgctctctctgcctgga

SEQ ID NO: 80031 - DNA, 25 bp, Homo sapien
cctggatcccggcagaagctatgaa

SEQ ID NO: 80032 - DNA, 25 bp, Homo sapien
ggatcccggcagaagctatgaaagg

SEQ ID NO: 80033 - DNA, 25 bp, Homo sapien
tttgttgaagagtcactttcctcaa

SEQ ID NO: 80034 - DNA, 25 bp, Homo sapien
gagtcactttcctcaaccatttttt

SEQ ID NO: 80035 - DNA, 25 bp, Homo sapien
aatccatccaactttaacacaacat

SEQ ID NO: 80036 - DNA, 25 bp, Homo sapien
aacacaacatttctcagtgtagaaa

SEQ ID NO: 80037 - DNA, 25 bp, Homo sapien
gaaatcatgtcttcttaattgctga

SEQ ID NO: 80038 - DNA, 25 bp, Homo sapien
gctgaaccttactgcaaaaacttgt

SEQ ID NO: 80039 - DNA, 25 bp, Homo sapien
atttgtatggtgtggcagtggtcta

SEQ ID NO: 80040 - DNA, 25 bp, Homo sapien
tggtgtggcagtggtctattcctaa

SEQ ID NO: 80041 - DNA, 25 bp, Homo sapien
ggcagtggtctattcctaaggaact

SEQ ID NO: 80042 - DNA, 25 bp, Homo sapien
aatgtttatttaactcagcttgaga

SEQ ID NO: 80043 - DNA, 25 bp, Homo sapien
actcagcttgagactgtactacagt

SEQ ID NO: 80044 - DNA, 25 bp, Homo sapien
gcctgacgcatctgtctgaggagcg

SEQ ID NO: 80045 - DNA, 25 bp, Homo sapien
cctgacgcatctgtctgaggagcgg

SEQ ID NO: 80046 - DNA, 25 bp, Homo sapien
ctgacgcatctgtctgaggagcggt

SEQ ID NO: 80047 - DNA, 25 bp, Homo sapien
gacgcatctgtctgaggagcggtca

SEQ ID NO: 80048 - DNA, 25 bp, Homo sapien
acgcatctgtctgaggagcggtcag

SEQ ID NO: 80049 - DNA, 25 bp, Homo sapien
cgcatctgtctgaggagcggtcagt

SEQ ID NO: 80050 - DNA, 25 bp, Homo sapien
gcatctgtctgaggagcggtcagtg

SEQ ID NO: 80051 - DNA, 25 bp, Homo sapien
catctgtctgaggagcggtcagtga

SEQ ID NO: 80052 - DNA, 25 bp, Homo sapien
atctgtctgaggagcggtcagtgac

SEQ ID NO: 80053 - DNA, 25 bp, Homo sapien
tctgtctgaggagcggtcagtgacg

SEQ ID NO: 80054 - DNA, 25 bp, Homo sapien
tgtctgaggagcggtcagtgacgcg

SEQ ID NO: 80055 - DNA, 25 bp, Homo sapien
atcagagctccataatgtaccccac

SEQ ID NO: 80056 - DNA, 25 bp, Homo sapien
aatgtaccccacttactggtatcac

SEQ ID NO: 80057 - DNA, 25 bp, Homo sapien
actggtatcacgaccctagaacctt

SEQ ID NO: 80058 - DNA, 25 bp, Homo sapien
cagctcagtgccgatgatatccaaa

SEQ ID NO: 80059 - DNA, 25 bp, Homo sapien
aatgttcatctgacataccttaatg

SEQ ID NO: 80060 - DNA, 25 bp, Homo sapien
ggacttattcaacctgtcctttcag

SEQ ID NO: 80061 - DNA, 25 bp, Homo sapien
tcaacctgtcctttcagggagttta

SEQ ID NO: 80062 - DNA, 25 bp, Homo sapien
ctgaaagcactagagcagccttggg

SEQ ID NO: 80063 - DNA, 25 bp, Homo sapien
gaagccctaaagaatgcaacctagt

SEQ ID NO: 80064 - DNA, 25 bp, Homo sapien
aacctagtcaggttagctgaaccga

SEQ ID NO: 80065 - DNA, 25 bp, Homo sapien
tgaaccgacactcaaaacgctactg

SEQ ID NO: 80066 - DNA, 25 bp, Homo sapien
aatctgcattttaactagtcgcggg

SEQ ID NO: 80067 - DNA, 25 bp, Homo sapien
gcagtagctggctgtttcgtggcat

SEQ ID NO: 80068 - DNA, 25 bp, Homo sapien
ttcgtggcatttctgtggctctgca

SEQ ID NO: 80069 - DNA, 25 bp, Homo sapien
catttctgtggctctgcagtgttcc

SEQ ID NO: 80070 - DNA, 25 bp, Homo sapien
tccaccccaggaccaatatgttcag

SEQ ID NO: 80071 - DNA, 25 bp, Homo sapien
aggaccaatatgttcaggccacacc

SEQ ID NO: 80072 - DNA, 25 bp, Homo sapien
atatgttcaggccacaccgatggcc

SEQ ID NO: 80073 - DNA, 25 bp, Homo sapien
cgatggcctgaaccccatgggtaga

SEQ ID NO: 80074 - DNA, 25 bp, Homo sapien
cacttcctaagttgctgtccagcct

SEQ ID NO: 80075 - DNA, 25 bp, Homo sapien
taagttgctgtccagcctcagtgac

SEQ ID NO: 80076 - DNA, 25 bp, Homo sapien
gctgtgggcggctgtcccagcaacc

SEQ ID NO: 80077 - DNA, 25 bp, Homo sapien
catgaaggaactcaaggcccgaaag

SEQ ID NO: 80078 - DNA, 25 bp, Homo sapien
tgaaggaactcaaggcccgaaagat

SEQ ID NO: 80079 - DNA, 25 bp, Homo sapien
tcaaggcccgaaagatccccatcat

SEQ ID NO: 80080 - DNA, 25 bp, Homo sapien
agatccccatcatcattcgccgtta

SEQ ID NO: 80081 - DNA, 25 bp, Homo sapien
atcattcgccgttacctgccagatg

SEQ ID NO: 80082 - DNA, 25 bp, Homo sapien
cattcgccgttacctgccagatggg

SEQ ID NO: 80083 - DNA, 25 bp, Homo sapien
ctgccagatgggagctatgaagact

SEQ ID NO: 80084 - DNA, 25 bp, Homo sapien
tcatcatcaccgactgagctggagt

SEQ ID NO: 80085 - DNA, 25 bp, Homo sapien
catcatcaccgactgagctggagtc

SEQ ID NO: 80086 - DNA, 25 bp, Homo sapien
tgcccaattttcattctcactttat

SEQ ID NO: 80087 - DNA, 25 bp, Homo sapien
ccaattttcattctcactttatatg

SEQ ID NO: 80088 - DNA, 25 bp, Homo sapien
gtaacaataatacccaaaatctgat

SEQ ID NO: 80089 - DNA, 25 bp, Homo sapien
aaatctgattggtcatatttttcca

SEQ ID NO: 80090 - DNA, 25 bp, Homo sapien
ccaaagagtaatgcagtctggatat

SEQ ID NO: 80091 - DNA, 25 bp, Homo sapien
atgtattttctgtcttccttataag

SEQ ID NO: 80092 - DNA, 25 bp, Homo sapien
gtattttctgtcttccttataaggg

SEQ ID NO: 80093 - DNA, 25 bp, Homo sapien
gggattctcccagctgctaaattta

SEQ ID NO: 80094 - DNA, 25 bp, Homo sapien
acagtaaatatcacattttgtcatt

SEQ ID NO: 80095 - DNA, 25 bp, Homo sapien
tcactgaaggttcattgtttttcct

SEQ ID NO: 80096 - DNA, 25 bp, Homo sapien
acatggagaagaatgtgcccagaaa

SEQ ID NO: 80097 - DNA, 25 bp, Homo sapien
aaataagagctttagttgatcacca

SEQ ID NO: 80098 - DNA, 25 bp, Homo sapien
tagttgatcaccatgatgcagaggt

SEQ ID NO: 80099 - DNA, 25 bp, Homo sapien
atgtgcttgatgtcaatgatcattt

SEQ ID NO: 80100 - DNA, 25 bp, Homo sapien
aatatagtttgggtccccacatagt

SEQ ID NO: 80101 - DNA, 25 bp, Homo sapien
gtttgggtccccacatagtgaaagt

SEQ ID NO: 80102 - DNA, 25 bp, Homo sapien
tagtgaaagtactctggtttctgtt

SEQ ID NO: 80103 - DNA, 25 bp, Homo sapien
ctctggtttctgtttgattcagaaa

SEQ ID NO: 80104 - DNA, 25 bp, Homo sapien
tgattcagaaatttggtgggttttt

SEQ ID NO: 80105 - DNA, 25 bp, Homo sapien
gtttgtgtgagtgtagttcttcaat

SEQ ID NO: 80106 - DNA, 25 bp, Homo sapien
gttcttcaatagagagggagcgtaa

SEQ ID NO: 80107 - DNA, 25 bp, Homo sapien
gagcgtaaagctattttcactagat

SEQ ID NO: 80108 - DNA, 25 bp, Homo sapien
cactagattgattttttgtttagac

SEQ ID NO: 80109 - DNA, 25 bp, Homo sapien
aatggctaccattatgtctttatat

SEQ ID NO: 80110 - DNA, 25 bp, Homo sapien
caaatgcacccaagagacaagccat

SEQ ID NO: 80111 - DNA, 25 bp, Homo sapien
gagacaagccatttacatacagata

SEQ ID NO: 80112 - DNA, 25 bp, Homo sapien
tacagatattcacagtcacacatag

SEQ ID NO: 80113 - DNA, 25 bp, Homo sapien
gtcacacatagaaacacccacatgg

SEQ ID NO: 80114 - DNA, 25 bp, Homo sapien
tggacacaaggaatgttgctgcaga

SEQ ID NO: 80115 - DNA, 25 bp, Homo sapien
ttgctgcagagactgaatgacatgc

SEQ ID NO: 80116 - DNA, 25 bp, Homo sapien
ttatacgttatacacaaggccaggt

SEQ ID NO: 80117 - DNA, 25 bp, Homo sapien
acacaaggccaggtaagcgctcata

SEQ ID NO: 80118 - DNA, 25 bp, Homo sapien
ggtaagcgctcataattcacacata

SEQ ID NO: 80119 - DNA, 25 bp, Homo sapien
aacatctaggtttcattcctttgac

SEQ ID NO: 80120 - DNA, 25 bp, Homo sapien
aggtttcattcctttgacatgttta

SEQ ID NO: 80121 - DNA, 25 bp, Homo sapien
agagcccatctacgcccaacacaga

SEQ ID NO: 80122 - DNA, 25 bp, Homo sapien
aacacagagctcacacaggtcactg

SEQ ID NO: 80123 - DNA, 25 bp, Homo sapien
acaggtcactgctctctaggcggac

SEQ ID NO: 80124 - DNA, 25 bp, Homo sapien
gtcactgctctctaggcggacacac

SEQ ID NO: 80125 - DNA, 25 bp, Homo sapien
gcggacacaccctgggccctgagca

SEQ ID NO: 80126 - DNA, 25 bp, Homo sapien
cctgagcatccagagcctgggatgg

SEQ ID NO: 80127 - DNA, 25 bp, Homo sapien
agcctgggatgggcttttccctgtg

SEQ ID NO: 80128 - DNA, 25 bp, Homo sapien
gtgggccagggatgctcggtcccag

SEQ ID NO: 80129 - DNA, 25 bp, Homo sapien
atgctcggtcccagaggaggaccta

SEQ ID NO: 80130 - DNA, 25 bp, Homo sapien
tcccagaggaggacctagtgacatc

SEQ ID NO: 80131 - DNA, 25 bp, Homo sapien
ccagaggaggacctagtgacatcat

SEQ ID NO: 80132 - DNA, 25 bp, Homo sapien
gttctgcaagaggagctattctgat

SEQ ID NO: 80133 - DNA, 25 bp, Homo sapien
ggaagactttgacccagcacctgta

SEQ ID NO: 80134 - DNA, 25 bp, Homo sapien
gagcaaatttgattctcttgacttt

SEQ ID NO: 80135 - DNA, 25 bp, Homo sapien
gcaaatttgattctcttgactttga

SEQ ID NO: 80136 - DNA, 25 bp, Homo sapien
cttgactttgacacattgttgaaac

SEQ ID NO: 80137 - DNA, 25 bp, Homo sapien
gacacattgttgaaacaggcccaga

SEQ ID NO: 80138 - DNA, 25 bp, Homo sapien
attgttgaaacaggcccagaagaac

SEQ ID NO: 80139 - DNA, 25 bp, Homo sapien
aggcccagaagaacctcaggaggta

SEQ ID NO: 80140 - DNA, 25 bp, Homo sapien
gaagaacctcaggaggtaaccttgg

SEQ ID NO: 80141 - DNA, 25 bp, Homo sapien
cctgctatcctttttctcctttgga

SEQ ID NO: 80142 - DNA, 25 bp, Homo sapien
tttctcctttggaggtgcccaacct

SEQ ID NO: 80143 - DNA, 25 bp, Homo sapien
gggctgcctttgtggtgggcgctgg

SEQ ID NO: 80144 - DNA, 25 bp, Homo sapien
gaagtacgtcccagcggcctcaggg

SEQ ID NO: 80145 - DNA, 25 bp, Homo sapien
tcccagcggcctcagggtctaagga

SEQ ID NO: 80146 - DNA, 25 bp, Homo sapien
tcagggtctaaggagcgctagtgcc

SEQ ID NO: 80147 - DNA, 25 bp, Homo sapien
taaggagcgctagtgccttgcccac

SEQ ID NO: 80148 - DNA, 25 bp, Homo sapien
agtgccttgcccacaggtgcgggac

SEQ ID NO: 80149 - DNA, 25 bp, Homo sapien
ccacaggtgcgggaccatctgatgt

SEQ ID NO: 80150 - DNA, 25 bp, Homo sapien
tgcgggaccatctgatgtgatgtga

SEQ ID NO: 80151 - DNA, 25 bp, Homo sapien
gatgtgatgtgaatactcttcccac

SEQ ID NO: 80152 - DNA, 25 bp, Homo sapien
gaatactcttcccacatacattaaa

SEQ ID NO: 80153 - DNA, 25 bp, Homo sapien
ttcccacatacattaaacacactta

SEQ ID NO: 80154 - DNA, 25 bp, Homo sapien
ttacagcaaaaagatacagattagg

SEQ ID NO: 80155 - DNA, 25 bp, Homo sapien
tacagcaaaaagatacagattagga

SEQ ID NO: 80156 - DNA, 25 bp, Homo sapien
acagcaaaaagatacagattaggat

SEQ ID NO: 80157 - DNA, 25 bp, Homo sapien
cagcaaaaagatacagattaggatg

SEQ ID NO: 80158 - DNA, 25 bp, Homo sapien
agcaaaaagatacagattaggatgg

SEQ ID NO: 80159 - DNA, 25 bp, Homo sapien
gcaaaaagatacagattaggatggg

SEQ ID NO: 80160 - DNA, 25 bp, Homo sapien
caaaaagatacagattaggatgggt

SEQ ID NO: 80161 - DNA, 25 bp, Homo sapien
aaaaagatacagattaggatgggtg

SEQ ID NO: 80162 - DNA, 25 bp, Homo sapien
aaaagatacagattaggatgggtgc

SEQ ID NO: 80163 - DNA, 25 bp, Homo sapien
aaagatacagattaggatgggtgcg

SEQ ID NO: 80164 - DNA, 25 bp, Homo sapien
aaggacatggacaaggtcgagacat

SEQ ID NO: 80165 - DNA, 25 bp, Homo sapien
aggacatggacaaggtcgagacatt

SEQ ID NO: 80166 - DNA, 25 bp, Homo sapien
ggacatggacaaggtcgagacattc

SEQ ID NO: 80167 - DNA, 25 bp, Homo sapien
gacatggacaaggtcgagacattcc

SEQ ID NO: 80168 - DNA, 25 bp, Homo sapien
acatggacaaggtcgagacattcct

SEQ ID NO: 80169 - DNA, 25 bp, Homo sapien
catggacaaggtcgagacattcctg

SEQ ID NO: 80170 - DNA, 25 bp, Homo sapien
atggacaaggtcgagacattcctgc

SEQ ID NO: 80171 - DNA, 25 bp, Homo sapien
tggacaaggtcgagacattcctgcg

SEQ ID NO: 80172 - DNA, 25 bp, Homo sapien
ggacaaggtcgagacattcctgcgc

SEQ ID NO: 80173 - DNA, 25 bp, Homo sapien
gacaaggtcgagacattcctgcgca

SEQ ID NO: 80174 - DNA, 25 bp, Homo sapien
acaaggtcgagacattcctgcgcat

SEQ ID NO: 80175 - DNA, 25 bp, Homo sapien
acccctcgagatgacggcgagctag

SEQ ID NO: 80176 - DNA, 25 bp, Homo sapien
acggcgagctaggagggaacttcct

SEQ ID NO: 80177 - DNA, 25 bp, Homo sapien
agctaggagggaacttcctccactc

SEQ ID NO: 80178 - DNA, 25 bp, Homo sapien
ctccactcctttcagaacgacaatt

SEQ ID NO: 80179 - DNA, 25 bp, Homo sapien
gaacgacaattattctccaagcatg

SEQ ID NO: 80180 - DNA, 25 bp, Homo sapien
gacaattattctccaagcatgacga

SEQ ID NO: 80181 - DNA, 25 bp, Homo sapien
aattattctccaagcatgacgatga

SEQ ID NO: 80182 - DNA, 25 bp, Homo sapien
gcatgacgatgagtgtgtgatcccc

SEQ ID NO: 80183 - DNA, 25 bp, Homo sapien
agacgctgagagagcaggcattgca

SEQ ID NO: 80184 - DNA, 25 bp, Homo sapien
gagcaggcattgcaggcgggaagat

SEQ ID NO: 80185 - DNA, 25 bp, Homo sapien
aagaagtgaggtgtcattatccagg

SEQ ID NO: 80186 - DNA, 25 bp, Homo sapien
ctcatcaaaggctcccttcagaatg

SEQ ID NO: 80187 - DNA, 25 bp, Homo sapien
atcaaaggctcccttcagaatgacc

SEQ ID NO: 80188 - DNA, 25 bp, Homo sapien
aaaggctcccttcagaatgacccat

SEQ ID NO: 80189 - DNA, 25 bp, Homo sapien
aggctcccttcagaatgacccattt

SEQ ID NO: 80190 - DNA, 25 bp, Homo sapien
gctcccttcagaatgacccatttta

SEQ ID NO: 80191 - DNA, 25 bp, Homo sapien
ctcccttcagaatgacccattttac

SEQ ID NO: 80192 - DNA, 25 bp, Homo sapien
ccttcagaatgacccattttacgtg

SEQ ID NO: 80193 - DNA, 25 bp, Homo sapien
tcagaatgacccattttacgtgaat

SEQ ID NO: 80194 - DNA, 25 bp, Homo sapien
gaatgacccattttacgtgaatgtg

SEQ ID NO: 80195 - DNA, 25 bp, Homo sapien
gacccattttacgtgaatgtgatgt

SEQ ID NO: 80196 - DNA, 25 bp, Homo sapien
cccattttacgtgaatgtgatgttc

SEQ ID NO: 80197 - DNA, 25 bp, Homo sapien
aggattctaggttggctgctgtgtc

SEQ ID NO: 80198 - DNA, 25 bp, Homo sapien
ggctgctgtgtcatctttgaagtca

SEQ ID NO: 80199 - DNA, 25 bp, Homo sapien
gaagtcaagacaaagctgggctcga

SEQ ID NO: 80200 - DNA, 25 bp, Homo sapien
aaagctgggctcgaccttcaagggt

SEQ ID NO: 80201 - DNA, 25 bp, Homo sapien
gaccttcaagggtcctcgttttgat

SEQ ID NO: 80202 - DNA, 25 bp, Homo sapien
gggtcctcgttttgataatacttca

SEQ ID NO: 80203 - DNA, 25 bp, Homo sapien
aatagggaactcatgtgaatactac

SEQ ID NO: 80204 - DNA, 25 bp, Homo sapien
taaaacctagaccttgagcgaacat

SEQ ID NO: 80205 - DNA, 25 bp, Homo sapien
gaccttgagcgaacatctgtatatt

SEQ ID NO: 80206 - DNA, 25 bp, Homo sapien
acgatagtggtaaccattgatcccc

SEQ ID NO: 80207 - DNA, 25 bp, Homo sapien
ttttgcaacgaatatggataccaca

SEQ ID NO: 80208 - DNA, 25 bp, Homo sapien
acaacacctacaaaccagcacatgg

SEQ ID NO: 80209 - DNA, 25 bp, Homo sapien
ggcccactggacagaaaacagcctg

SEQ ID NO: 80210 - DNA, 25 bp, Homo sapien
caccactatctctgaaccttatata

SEQ ID NO: 80211 - DNA, 25 bp, Homo sapien
gaaccttatataattcagacccata

SEQ ID NO: 80212 - DNA, 25 bp, Homo sapien
tatataattcagacccataccaagg

SEQ ID NO: 80213 - DNA, 25 bp, Homo sapien
ggacaaggtacaggaaactcaaata

SEQ ID NO: 80214 - DNA, 25 bp, Homo sapien
ggaaactcaaatatgactcccctcc

SEQ ID NO: 80215 - DNA, 25 bp, Homo sapien
gcacacaaagacagcaacttttgta

SEQ ID NO: 80216 - DNA, 25 bp, Homo sapien
gacagcaacttttgtacagagtggg

SEQ ID NO: 80217 - DNA, 25 bp, Homo sapien
gtggggagagactttttcttgtata

SEQ ID NO: 80218 - DNA, 25 bp, Homo sapien
atatattaagtctatgggctggtta

SEQ ID NO: 80219 - DNA, 25 bp, Homo sapien
attgagccgaataatgaattttctt

SEQ ID NO: 80220 - DNA, 25 bp, Homo sapien
agtgccctgggagcaatagctggaa

SEQ ID NO: 80221 - DNA, 25 bp, Homo sapien
atagctggaatcattctcctcacat

SEQ ID NO: 80222 - DNA, 25 bp, Homo sapien
gaatcattctcctcacatttggttt

SEQ ID NO: 80223 - DNA, 25 bp, Homo sapien
cattctcctcacatttggtttcatc

SEQ ID NO: 80224 - DNA, 25 bp, Homo sapien
tttggtttcatcctagatcaaaact

SEQ ID NO: 80225 - DNA, 25 bp, Homo sapien
aactacatttgtggttattctcacc

SEQ ID NO: 80226 - DNA, 25 bp, Homo sapien
cagtgtaaggctgttactgtcctgt

SEQ ID NO: 80227 - DNA, 25 bp, Homo sapien
gggaattttgattacattgatgact

SEQ ID NO: 80228 - DNA, 25 bp, Homo sapien
cattgatgactttcagcattattga

SEQ ID NO: 80229 - DNA, 25 bp, Homo sapien
gtgaacaatgttgttgactagcact

SEQ ID NO: 80230 - DNA, 25 bp, Homo sapien
ctttggcatgtgagccttgcctaag

SEQ ID NO: 80231 - DNA, 25 bp, Homo sapien
gggcatatctgggtccctagaaggc

SEQ ID NO: 80232 - DNA, 25 bp, Homo sapien
atatctgggtccctagaaggcccta

SEQ ID NO: 80233 - DNA, 25 bp, Homo sapien
gggtccctagaaggccctagatgtg

SEQ ID NO: 80234 - DNA, 25 bp, Homo sapien
tgccatacccgcacatgacaatgga

SEQ ID NO: 80235 - DNA, 25 bp, Homo sapien
tacccgcacatgacaatggaccaaa

SEQ ID NO: 80236 - DNA, 25 bp, Homo sapien
gtgccacacgctcgctcttttttac

SEQ ID NO: 80237 - DNA, 25 bp, Homo sapien
ttttttacacccagtgcctctgact

SEQ ID NO: 80238 - DNA, 25 bp, Homo sapien
tgactctgtccccatgggctggtct

SEQ ID NO: 80239 - DNA, 25 bp, Homo sapien
atgggctggtctccaaagctctttc

SEQ ID NO: 80240 - DNA, 25 bp, Homo sapien
ggttctgagcaataaagtttcttag

SEQ ID NO: 80241 - DNA, 25 bp, Homo sapien
gtctctttaactgacatgttcccca

SEQ ID NO: 80242 - DNA, 25 bp, Homo sapien
atgttccccagtgctgtttgaactg

SEQ ID NO: 80243 - DNA, 25 bp, Homo sapien
gaactgttgagtttccgttgctggc

SEQ ID NO: 80244 - DNA, 25 bp, Homo sapien
gagtgcgttttgtccttcacgtaac

SEQ ID NO: 80245 - DNA, 25 bp, Homo sapien
tcacgtaaccttcgctggtaaaaat

SEQ ID NO: 80246 - DNA, 25 bp, Homo sapien
ataagcccatgtgatgtccaccagt

SEQ ID NO: 80247 - DNA, 25 bp, Homo sapien
gatgaatgctggaccgagagcccta

SEQ ID NO: 80248 - DNA, 25 bp, Homo sapien
gagagccctagcttctggatccagg

SEQ ID NO: 80249 - DNA, 25 bp, Homo sapien
tggatccaggtctaggcccttcatc

SEQ ID NO: 80250 - DNA, 25 bp, Homo sapien
tggcccagggcaggtttgcttgacc

SEQ ID NO: 80251 - DNA, 25 bp, Homo sapien
tgcctcagttctcgactctaaagga

SEQ ID NO: 80252 - DNA, 25 bp, Homo sapien
aaccctttcttctatggatgtctca

SEQ ID NO: 80253 - DNA, 25 bp, Homo sapien
ctatggatgtctcaaccggcagatc

SEQ ID NO: 80254 - DNA, 25 bp, Homo sapien
ggagctcagcaagcagtttgtctgc

SEQ ID NO: 80255 - DNA, 25 bp, Homo sapien
gcagtttgtctgcttcttcaagcca

SEQ ID NO: 80256 - DNA, 25 bp, Homo sapien
tcttcaagccagctccagaggagga

SEQ ID NO: 80257 - DNA, 25 bp, Homo sapien
tgcctagccgggagggctccattga

SEQ ID NO: 80258 - DNA, 25 bp, Homo sapien
gagaacttcctgcagttccttcagg

SEQ ID NO: 80259 - DNA, 25 bp, Homo sapien
actggctgtccttctgagtcctggg

SEQ ID NO: 80260 - DNA, 25 bp, Homo sapien
agccacctgctgttgactttcgaat

SEQ ID NO: 80261 - DNA, 25 bp, Homo sapien
agtgtggtcacctggattggctact

SEQ ID NO: 80262 - DNA, 25 bp, Homo sapien
tggattggctacttttgcttcactt

SEQ ID NO: 80263 - DNA, 25 bp, Homo sapien
cagctaaccattcatcagatgccgt

SEQ ID NO: 80264 - DNA, 25 bp, Homo sapien
gggctgggctctagccctaactaat

SEQ ID NO: 80265 - DNA, 25 bp, Homo sapien
gggctctagccctaactaatgtgat

SEQ ID NO: 80266 - DNA, 25 bp, Homo sapien
ctgcaagttatgtctaaggctagga

SEQ ID NO: 80267 - DNA, 25 bp, Homo sapien
gaactatcaggtgtctataattgta

SEQ ID NO: 80268 - DNA, 25 bp, Homo sapien
ggtgtctataattgtagcacatgga

SEQ ID NO: 80269 - DNA, 25 bp, Homo sapien
taattgtagcacatggagaaagcaa

SEQ ID NO: 80270 - DNA, 25 bp, Homo sapien
taaccattttaactctccagtgcac

SEQ ID NO: 80271 - DNA, 25 bp, Homo sapien
ttaactctccagtgcactttgccat

SEQ ID NO: 80272 - DNA, 25 bp, Homo sapien
tctccagtgcactttgccattaaag

SEQ ID NO: 80273 - DNA, 25 bp, Homo sapien
taaagtctcttcacattgatttgtt

SEQ ID NO: 80274 - DNA, 25 bp, Homo sapien
aacagtagaattttacttgggcaat

SEQ ID NO: 80275 - DNA, 25 bp, Homo sapien
gcaatatttgcccattctggtgtaa

SEQ ID NO: 80276 - DNA, 25 bp, Homo sapien
ttctggtgtaacttatgtgactcta

SEQ ID NO: 80277 - DNA, 25 bp, Homo sapien
atgtgactctagtgcttaacagctg

SEQ ID NO: 80278 - DNA, 25 bp, Homo sapien
tagtgcttaacagctgccgttgaag

SEQ ID NO: 80279 - DNA, 25 bp, Homo sapien
gaattcacttttgtgccatttttgt

SEQ ID NO: 80280 - DNA, 25 bp, Homo sapien
ggtcacatatttcaaacacaactag

SEQ ID NO: 80281 - DNA, 25 bp, Homo sapien
gggctctgaaagatttgtatctctg

SEQ ID NO: 80282 - DNA, 25 bp, Homo sapien
gatttgtatctctgtgcttgaactt

SEQ ID NO: 80283 - DNA, 25 bp, Homo sapien
ctgtgcttgaacttgaatggcctta

SEQ ID NO: 80284 - DNA, 25 bp, Homo sapien
cttgaatggccttaaacctgtttca

SEQ ID NO: 80285 - DNA, 25 bp, Homo sapien
gaagagcgttctgtggttagttcgt

SEQ ID NO: 80286 - DNA, 25 bp, Homo sapien
cgttctgtggttagttcgtgtctag

SEQ ID NO: 80287 - DNA, 25 bp, Homo sapien
agttcgtgtctaggatttgagtgcc

SEQ ID NO: 80288 - DNA, 25 bp, Homo sapien
ctaggatttgagtgccttactgaat

SEQ ID NO: 80289 - DNA, 25 bp, Homo sapien
gtgccttactgaatgcatttaccag

SEQ ID NO: 80290 - DNA, 25 bp, Homo sapien
gcatttaccagcaaacatgtagcaa

SEQ ID NO: 80291 - DNA, 25 bp, Homo sapien
acatgtagcaatctgttctctcatt

SEQ ID NO: 80292 - DNA, 25 bp, Homo sapien
agcaatctgttctctcattgtgatt

SEQ ID NO: 80293 - DNA, 25 bp, Homo sapien
gtgattgtggaagaagctcatgtaa

SEQ ID NO: 80294 - DNA, 25 bp, Homo sapien
aggaagtatggcgtggtacttattc

SEQ ID NO: 80295 - DNA, 25 bp, Homo sapien
gtaagttcagagtatgctgagtgtt

SEQ ID NO: 80296 - DNA, 25 bp, Homo sapien
gataagacttgaggatttttcgaaa

SEQ ID NO: 80297 - DNA, 25 bp, Homo sapien
atgttgctgcgggagtcaagactaa

SEQ ID NO: 80298 - DNA, 25 bp, Homo sapien
agttggagagcttctcatgttcttc

SEQ ID NO: 80299 - DNA, 25 bp, Homo sapien
gcatacgtacaaaacccaggacttt

SEQ ID NO: 80300 - DNA, 25 bp, Homo sapien
ccaggactttaatgactttaagagg

SEQ ID NO: 80301 - DNA, 25 bp, Homo sapien
gggcagaattgcatctcttggaagt

SEQ ID NO: 80302 - DNA, 25 bp, Homo sapien
gcatctcttggaagttaacagactc

SEQ ID NO: 80303 - DNA, 25 bp, Homo sapien
gttaacagactcatgtgaactggaa

SEQ ID NO: 80304 - DNA, 25 bp, Homo sapien
actggaatgtacgttgtggccctca

SEQ ID NO: 80305 - DNA, 25 bp, Homo sapien
tgtggccctcacaattgattttaat

SEQ ID NO: 80306 - DNA, 25 bp, Homo sapien
ttatttgcaaagtcctttctgtttc

SEQ ID NO: 80307 - DNA, 25 bp, Homo sapien
acggagagtcagaagacgaagagca

SEQ ID NO: 80308 - DNA, 25 bp, Homo sapien
gaagacgaagagcaaatgaccctga

SEQ ID NO: 80309 - DNA, 25 bp, Homo sapien
agacgaagagcaaatgaccctgacg

SEQ ID NO: 80310 - DNA, 25 bp, Homo sapien
cgaagagcaaatgaccctgacgccg

SEQ ID NO: 80311 - DNA, 25 bp, Homo sapien
gaagagcaaatgaccctgacgccgc

SEQ ID NO: 80312 - DNA, 25 bp, Homo sapien
aagagcaaatgaccctgacgccgcc

SEQ ID NO: 80313 - DNA, 25 bp, Homo sapien
aaatgaccctgacgccgccctcagg

SEQ ID NO: 80314 - DNA, 25 bp, Homo sapien
gcaaaggcccttttcatggtcgtcc

SEQ ID NO: 80315 - DNA, 25 bp, Homo sapien
aggcccttttcatggtcgtcccgca

SEQ ID NO: 80316 - DNA, 25 bp, Homo sapien
cccttttcatggtcgtcccgcaatg

SEQ ID NO: 80317 - DNA, 25 bp, Homo sapien
ttttcatggtcgtcccgcaatgctt

SEQ ID NO: 80318 - DNA, 25 bp, Homo sapien
atgaccaagtacgagcgagcccgcg

SEQ ID NO: 80319 - DNA, 25 bp, Homo sapien
acccgagcgctccagattgcgatgt

SEQ ID NO: 80320 - DNA, 25 bp, Homo sapien
gattgcgatgtgtgcccctgtgatg

SEQ ID NO: 80321 - DNA, 25 bp, Homo sapien
atgaaggaactcaaggcccgaaaga

SEQ ID NO: 80322 - DNA, 25 bp, Homo sapien
tcaaggcccgaaagatccccatcat

SEQ ID NO: 80323 - DNA, 25 bp, Homo sapien
agatccccatcatcattcgccgtta

SEQ ID NO: 80324 - DNA, 25 bp, Homo sapien
cattcgccgttacctgccagatggg

SEQ ID NO: 80325 - DNA, 25 bp, Homo sapien
ctgccagatgggagctatgaagact

SEQ ID NO: 80326 - DNA, 25 bp, Homo sapien
tcatcatcaccgactgagctggagt

SEQ ID NO: 80327 - DNA, 25 bp, Homo sapien
ccgactgagctggagtcatcttcct

SEQ ID NO: 80328 - DNA, 25 bp, Homo sapien
tgcccaattttcattctcactttat

SEQ ID NO: 80329 - DNA, 25 bp, Homo sapien
cacaagggcgaaccacctgaacaaa

SEQ ID NO: 80330 - DNA, 25 bp, Homo sapien
gaaccacctgaacaaactggccgag

SEQ ID NO: 80331 - DNA, 25 bp, Homo sapien
atccgtgtgggccagagcatgaaca

SEQ ID NO: 80332 - DNA, 25 bp, Homo sapien
gagcatgaacatgggcagtgacttt

SEQ ID NO: 80333 - DNA, 25 bp, Homo sapien
gcagtgactttgacgtctttgccca

SEQ ID NO: 80334 - DNA, 25 bp, Homo sapien
gactttgacgtctttgcccacatca

SEQ ID NO: 80335 - DNA, 25 bp, Homo sapien
atcaccaacaacaccgctgaggagt

SEQ ID NO: 80336 - DNA, 25 bp, Homo sapien
aacaccgctgaggagtacgtctgcc

SEQ ID NO: 80337 - DNA, 25 bp, Homo sapien
tgaggagtacgtctgccgcctcctg

SEQ ID NO: 80338 - DNA, 25 bp, Homo sapien
gcaccgtcagctacaatgggatctt

SEQ ID NO: 80339 - DNA, 25 bp, Homo sapien
gggcccgagtgtggcaccaagtacc

SEQ ID NO: 80340 - DNA, 25 bp, Homo sapien
ggccctttacctcctgtgggtgaat

SEQ ID NO: 80341 - DNA, 25 bp, Homo sapien
tacctcctgtgggtgaatgtgctgg

SEQ ID NO: 80342 - DNA, 25 bp, Homo sapien
tgggcccctggttcactgcagacag

SEQ ID NO: 80343 - DNA, 25 bp, Homo sapien
ttcactgcagacagtggcaccccag

SEQ ID NO: 80344 - DNA, 25 bp, Homo sapien
agcacaatgagaaacggcagcgccg

SEQ ID NO: 80345 - DNA, 25 bp, Homo sapien
tgaagcggttatagccattgacatt

SEQ ID NO: 80346 - DNA, 25 bp, Homo sapien
gtggctctgtcagggtgcacagccc

SEQ ID NO: 80347 - DNA, 25 bp, Homo sapien
tcatgcctggagcaatgagggtcta

SEQ ID NO: 80348 - DNA, 25 bp, Homo sapien
gcagtctgaggtattgggtatactt

SEQ ID NO: 80349 - DNA, 25 bp, Homo sapien
gggtatacttatactctatagggtc

SEQ ID NO: 80350 - DNA, 25 bp, Homo sapien
atactctatagggtcgttgaataaa

SEQ ID NO: 80351 - DNA, 25 bp, Homo sapien
gggcccgaggtgtccgcgaaggtgg

SEQ ID NO: 80352 - DNA, 25 bp, Homo sapien
gtgtccgcgaaggtggcgcagccat

SEQ ID NO: 80353 - DNA, 25 bp, Homo sapien
atggctcagcggatggtctgggtgg

SEQ ID NO: 80354 - DNA, 25 bp, Homo sapien
ctggagatgacaggattggacattg

SEQ ID NO: 80355 - DNA, 25 bp, Homo sapien
ggacattgagaaggaccagattatt

SEQ ID NO: 80356 - DNA, 25 bp, Homo sapien
accagattattgagatggcctgtct

SEQ ID NO: 80357 - DNA, 25 bp, Homo sapien
gatggcctgtctgataactgactct

SEQ ID NO: 80358 - DNA, 25 bp, Homo sapien
gtctgataactgactctgatctcaa

SEQ ID NO: 80359 - DNA, 25 bp, Homo sapien
gactctgatctcaacattttggctg

SEQ ID NO: 80360 - DNA, 25 bp, Homo sapien
ctgatctcaacattttggctgaagg

SEQ ID NO: 80361 - DNA, 25 bp, Homo sapien
tgtaggtgggagtcacggacggttc

SEQ ID NO: 80362 - DNA, 25 bp, Homo sapien
aagcccacagaggagttaaaagtgt

SEQ ID NO: 80363 - DNA, 25 bp, Homo sapien
aagtgtgatcactttcttcctactc

SEQ ID NO: 80364 - DNA, 25 bp, Homo sapien
ttcttcctactctatgccattttct

SEQ ID NO: 80365 - DNA, 25 bp, Homo sapien
cttttttcatatcagtttggacctc

SEQ ID NO: 80366 - DNA, 25 bp, Homo sapien
cagtttggacctctgaaaggttgga

SEQ ID NO: 80367 - DNA, 25 bp, Homo sapien
cccaggtgatgggaatggcttatcc

SEQ ID NO: 80368 - DNA, 25 bp, Homo sapien
tgggaatggcttatccttcatgtca

SEQ ID NO: 80369 - DNA, 25 bp, Homo sapien
tccttcatgtcactcatgtgttctg

SEQ ID NO: 80370 - DNA, 25 bp, Homo sapien
tctctgtcagtgctactgtggctga

SEQ ID NO: 80371 - DNA, 25 bp, Homo sapien
cagtgctactgtggctgaggtacat

SEQ ID NO: 80372 - DNA, 25 bp, Homo sapien
ggagccctcaggtcacaaagaattt

SEQ ID NO: 80373 - DNA, 25 bp, Homo sapien
gagggaggacacatctggaggaaat

SEQ ID NO: 80374 - DNA, 25 bp, Homo sapien
aaaacacaaaacctcacaactgcct

SEQ ID NO: 80375 - DNA, 25 bp, Homo sapien
aaaacctcacaactgcctggcaagc

SEQ ID NO: 80376 - DNA, 25 bp, Homo sapien
ctggcaagcccagtatcacttgttt

SEQ ID NO: 80377 - DNA, 25 bp, Homo sapien
agtatcacttgtttgggccctagcg

SEQ ID NO: 80378 - DNA, 25 bp, Homo sapien
gtttgggccctagcgggactccaag

SEQ ID NO: 80379 - DNA, 25 bp, Homo sapien
cacacgcccctcctggaagggtgtg

SEQ ID NO: 80380 - DNA, 25 bp, Homo sapien
ggctggtgtgtgaatatctataaat

SEQ ID NO: 80381 - DNA, 25 bp, Homo sapien
aagtctgtacatattggagctctgg

SEQ ID NO: 80382 - DNA, 25 bp, Homo sapien
tgtacatattggagctctgggagat

SEQ ID NO: 80383 - DNA, 25 bp, Homo sapien
gctctgggagatgctggaataaaag

SEQ ID NO: 80384 - DNA, 25 bp, Homo sapien
aagttcgacacaaactcacacaacg

SEQ ID NO: 80385 - DNA, 25 bp, Homo sapien
gttcgacacaaactcacacaacgat

SEQ ID NO: 80386 - DNA, 25 bp, Homo sapien
ttcgacacaaactcacacaacgatg

SEQ ID NO: 80387 - DNA, 25 bp, Homo sapien
tcgacacaaactcacacaacgatga

SEQ ID NO: 80388 - DNA, 25 bp, Homo sapien
tagctgcccgggtggcatccctgtg

SEQ ID NO: 80389 - DNA, 25 bp, Homo sapien
agctgcccgggtggcatccctgtga

SEQ ID NO: 80390 - DNA, 25 bp, Homo sapien
ctgcccgggtggcatccctgtgacc

SEQ ID NO: 80391 - DNA, 25 bp, Homo sapien
tgcccgggtggcatccctgtgaccc

SEQ ID NO: 80392 - DNA, 25 bp, Homo sapien
cccgggtggcatccctgtgacccct

SEQ ID NO: 80393 - DNA, 25 bp, Homo sapien
gcctctcctggccttggaagttgcc

SEQ ID NO: 80394 - DNA, 25 bp, Homo sapien
ctctcctggccttggaagttgccac

SEQ ID NO: 80395 - DNA, 25 bp, Homo sapien
gatagtttccgagtaagaccttaag

SEQ ID NO: 80396 - DNA, 25 bp, Homo sapien
gaccttaaggacacagccaaatctt

SEQ ID NO: 80397 - DNA, 25 bp, Homo sapien
gccaaatcttaagtactgtgtgacc

SEQ ID NO: 80398 - DNA, 25 bp, Homo sapien
ctgtgtgaccactcttgttgttatc

SEQ ID NO: 80399 - DNA, 25 bp, Homo sapien
gaccactcttgttgttatcacatag

SEQ ID NO: 80400 - DNA, 25 bp, Homo sapien
gttatcacatagtcatacttggttg

SEQ ID NO: 80401 - DNA, 25 bp, Homo sapien
gatggttaacctgtagcttataaat

SEQ ID NO: 80402 - DNA, 25 bp, Homo sapien
attcttttactcatttactcagtca

SEQ ID NO: 80403 - DNA, 25 bp, Homo sapien
gaatctgttttaggtgacagcacaa

SEQ ID NO: 80404 - DNA, 25 bp, Homo sapien
aggtgacagcacaatggacattaag

SEQ ID NO: 80405 - DNA, 25 bp, Homo sapien
tttcctaataacacaatcagattgg

SEQ ID NO: 80406 - DNA, 25 bp, Homo sapien
gtggcagttctgtttataaggaagc

SEQ ID NO: 80407 - DNA, 25 bp, Homo sapien
gcagttctgtttataaggaagccat

SEQ ID NO: 80408 - DNA, 25 bp, Homo sapien
tataaggaagccatgaatcacccag

SEQ ID NO: 80409 - DNA, 25 bp, Homo sapien
ggaagccatgaatcacccaggccat

SEQ ID NO: 80410 - DNA, 25 bp, Homo sapien
catgaatcacccaggccatcttaaa

SEQ ID NO: 80411 - DNA, 25 bp, Homo sapien
aatcacccaggccatcttaaactat

SEQ ID NO: 80412 - DNA, 25 bp, Homo sapien
tcacccaggccatcttaaactattt

SEQ ID NO: 80413 - DNA, 25 bp, Homo sapien
ccaggccatcttaaactatttgtga

SEQ ID NO: 80414 - DNA, 25 bp, Homo sapien
ggccatcttaaactatttgtgacaa

SEQ ID NO: 80415 - DNA, 25 bp, Homo sapien
ttgtgacaaggatcatgcaagactt

SEQ ID NO: 80416 - DNA, 25 bp, Homo sapien
gacaaggatcatgcaagactttgaa

SEQ ID NO: 80417 - DNA, 25 bp, Homo sapien
gagaacccgtgtttcctcaagggct

SEQ ID NO: 80418 - DNA, 25 bp, Homo sapien
gcccttggtgtggtgctcgcacaag

SEQ ID NO: 80419 - DNA, 25 bp, Homo sapien
ggtgctcgcacaagaaagcctgggt

SEQ ID NO: 80420 - DNA, 25 bp, Homo sapien
aataagctctggctggtgttcacca

SEQ ID NO: 80421 - DNA, 25 bp, Homo sapien
tgttcaccatgaataagcccaggtt

SEQ ID NO: 80422 - DNA, 25 bp, Homo sapien
ataagcccaggttcctctgtaagcg

SEQ ID NO: 80423 - DNA, 25 bp, Homo sapien
aagcgcctgccgagaggacgttcat

SEQ ID NO: 80424 - DNA, 25 bp, Homo sapien
gagaggacgttcattttcctgtgga

SEQ ID NO: 80425 - DNA, 25 bp, Homo sapien
tcctgtggaagatgagtcggcccct

SEQ ID NO: 80426 - DNA, 25 bp, Homo sapien
atgagtcggcccctgggtcaaagcc

SEQ ID NO: 80427 - DNA, 25 bp, Homo sapien
gaccctattgctcggtggcaacgca

SEQ ID NO: 80428 - DNA, 25 bp, Homo sapien
gcaaagggatattccccaacctgtc

SEQ ID NO: 80429 - DNA, 25 bp, Homo sapien
acaggaagcatagggcactgcagat

SEQ ID NO: 80430 - DNA, 25 bp, Homo sapien
ttggcagtgactcggtggcttccca

SEQ ID NO: 80431 - DNA, 25 bp, Homo sapien
ggtggcttcccaagcaggagtgtca

SEQ ID NO: 80432 - DNA, 25 bp, Homo sapien
accatgagagagagtctaggagcca

SEQ ID NO: 80433 - DNA, 25 bp, Homo sapien
agtctaggagccaaacacatcacca

SEQ ID NO: 80434 - DNA, 25 bp, Homo sapien
atcaccaccctgagcagatacagga

SEQ ID NO: 80435 - DNA, 25 bp, Homo sapien
gtaactcagtgagtggcttccaggg

SEQ ID NO: 80436 - DNA, 25 bp, Homo sapien
gccctacagcttccctaggcagtaa

SEQ ID NO: 80437 - DNA, 25 bp, Homo sapien
gtaagtaaaaacattctcctagcat

SEQ ID NO: 80438 - DNA, 25 bp, Homo sapien
attctcctagcattaaaatggtttc

SEQ ID NO: 80439 - DNA, 25 bp, Homo sapien
tgccccgctggcgagctgtagttgc

SEQ ID NO: 80440 - DNA, 25 bp, Homo sapien
tgtagttgcggcttgcgtgcctcgc

SEQ ID NO: 80441 - DNA, 25 bp, Homo sapien
tcgcggcccactacagggctgcaga

SEQ ID NO: 80442 - DNA, 25 bp, Homo sapien
acagggctgcagacaatcgaggcga

SEQ ID NO: 80443 - DNA, 25 bp, Homo sapien
tcatgtggtcgctcctcgagggttt

SEQ ID NO: 80444 - DNA, 25 bp, Homo sapien
tggtcgctcctcgagggtttcgttt

SEQ ID NO: 80445 - DNA, 25 bp, Homo sapien
tcgagggtttcgtttttgttctgct

SEQ ID NO: 80446 - DNA, 25 bp, Homo sapien
agactggaatcaagcttacatgtaa

SEQ ID NO: 80447 - DNA, 25 bp, Homo sapien
caagcttacatgtaaactattggta

SEQ ID NO: 80448 - DNA, 25 bp, Homo sapien
tccttttgtgtcattcagtgtaaaa

SEQ ID NO: 80449 - DNA, 25 bp, Homo sapien
cagtgtaaaactgtctaatttgaaa

SEQ ID NO: 80450 - DNA, 25 bp, Homo sapien
atttctggcctcagaaacagccctg

SEQ ID NO: 80451 - DNA, 25 bp, Homo sapien
gaaacagccctgagacctgtccgaa

SEQ ID NO: 80452 - DNA, 25 bp, Homo sapien
acctgtccgaaaatcaagtgtcatt

SEQ ID NO: 80453 - DNA, 25 bp, Homo sapien
ttttgttccacatatgaaagagcag

SEQ ID NO: 80454 - DNA, 25 bp, Homo sapien
agagcagaaccacagacacaacttg

SEQ ID NO: 80455 - DNA, 25 bp, Homo sapien
gaaagtaaaactcatctgccttggt

SEQ ID NO: 80456 - DNA, 25 bp, Homo sapien
ctgccttggtttttataatgcctga

SEQ ID NO: 80457 - DNA, 25 bp, Homo sapien
taaaacctgttaagatactagcaaa

SEQ ID NO: 80458 - DNA, 25 bp, Homo sapien
aaagctttctcaattttgatgagct

SEQ ID NO: 80459 - DNA, 25 bp, Homo sapien
tactgactaatatcttcatctgcaa

SEQ ID NO: 80460 - DNA, 25 bp, Homo sapien
tgttgtgtgtaatctgtctagataa

SEQ ID NO: 80461 - DNA, 25 bp, Homo sapien
ccccacctggcagcctgtgaccgcg

SEQ ID NO: 80462 - DNA, 25 bp, Homo sapien
cacctggcagcctgtgaccgcggtt

SEQ ID NO: 80463 - DNA, 25 bp, Homo sapien
acctggcagcctgtgaccgcggttg

SEQ ID NO: 80464 - DNA, 25 bp, Homo sapien
cctggcagcctgtgaccgcggttgg

SEQ ID NO: 80465 - DNA, 25 bp, Homo sapien
ggccttatttctcaggccagctgag

SEQ ID NO: 80466 - DNA, 25 bp, Homo sapien
gccttatttctcaggccagctgagt

SEQ ID NO: 80467 - DNA, 25 bp, Homo sapien
ccttatttctcaggccagctgagta

SEQ ID NO: 80468 - DNA, 25 bp, Homo sapien
cttatttctcaggccagctgagtat

SEQ ID NO: 80469 - DNA, 25 bp, Homo sapien
ttatttctcaggccagctgagtatt

SEQ ID NO: 80470 - DNA, 25 bp, Homo sapien
tatttctcaggccagctgagtatta

SEQ ID NO: 80471 - DNA, 25 bp, Homo sapien
atttctcaggccagctgagtattag

SEQ ID NO: 80472 - DNA, 25 bp, Homo sapien
aggaatgacctgttcttgttctaca

SEQ ID NO: 80473 - DNA, 25 bp, Homo sapien
gacctgttcttgttctacagagaat

SEQ ID NO: 80474 - DNA, 25 bp, Homo sapien
gaaattggaagtcaaacaccctttg

SEQ ID NO: 80475 - DNA, 25 bp, Homo sapien
tcaaacaccctttgtattccaaaat

SEQ ID NO: 80476 - DNA, 25 bp, Homo sapien
ttccaaaatagggtctcaaacattt

SEQ ID NO: 80477 - DNA, 25 bp, Homo sapien
aaattgttaggaggcttggagctat

SEQ ID NO: 80478 - DNA, 25 bp, Homo sapien
ggcttggagctattagttaatctat

SEQ ID NO: 80479 - DNA, 25 bp, Homo sapien
gttaatctatcttccaatacactgt

SEQ ID NO: 80480 - DNA, 25 bp, Homo sapien
tacactgtttaatatagcactgaat

SEQ ID NO: 80481 - DNA, 25 bp, Homo sapien
gcaagttgtcaatggatgagtgatc

SEQ ID NO: 80482 - DNA, 25 bp, Homo sapien
gatgagtgatcaactaatagctctg

SEQ ID NO: 80483 - DNA, 25 bp, Homo sapien
cctctttctccttggctgcagtggg

SEQ ID NO: 80484 - DNA, 25 bp, Homo sapien
ggcctttatccagtgccagggagga

SEQ ID NO: 80485 - DNA, 25 bp, Homo sapien
gccagggaggaacaacatagttaat

SEQ ID NO: 80486 - DNA, 25 bp, Homo sapien
ttttttctaaccttgccactttgag

SEQ ID NO: 80487 - DNA, 25 bp, Homo sapien
tctaaccttgccactttgagggaag

SEQ ID NO: 80488 - DNA, 25 bp, Homo sapien
accttgccactttgagggaaggaag

SEQ ID NO: 80489 - DNA, 25 bp, Homo sapien
agggcaagctttatgggaccctggt

SEQ ID NO: 80490 - DNA, 25 bp, Homo sapien
tggcctttcactccagttctgggtg

SEQ ID NO: 80491 - DNA, 25 bp, Homo sapien
ttcactccagttctgggtgaggcag

SEQ ID NO: 80492 - DNA, 25 bp, Homo sapien
ggaagtgtctgcctttatgtccttt

SEQ ID NO: 80493 - DNA, 25 bp, Homo sapien
aagtgtctgcctttatgtcctttct

SEQ ID NO: 80494 - DNA, 25 bp, Homo sapien
cttgttttggggtcctgactgaaga

SEQ ID NO: 80495 - DNA, 25 bp, Homo sapien
agggccaagcactggggtgcctcct

SEQ ID NO: 80496 - DNA, 25 bp, Homo sapien
gggcacccctcaaactcagtcatgt

SEQ ID NO: 80497 - DNA, 25 bp, Homo sapien
acccctcaaactcagtcatgtggtt

SEQ ID NO: 80498 - DNA, 25 bp, Homo sapien
ctcaaactcagtcatgtggttccaa

SEQ ID NO: 80499 - DNA, 25 bp, Homo sapien
aaactcagtcatgtggttccaaact

SEQ ID NO: 80500 - DNA, 25 bp, Homo sapien
actcagtcatgtggttccaaactac

SEQ ID NO: 80501 - DNA, 25 bp, Homo sapien
agtcatgtggttccaaactacccca

SEQ ID NO: 80502 - DNA, 25 bp, Homo sapien
tcatgtggttccaaactaccccatt

SEQ ID NO: 80503 - DNA, 25 bp, Homo sapien
catgtggttccaaactaccccattc

SEQ ID NO: 80504 - DNA, 25 bp, Homo sapien
tccagactctgacccagcctcagtc

SEQ ID NO: 80505 - DNA, 25 bp, Homo sapien
attctcttaagcacccggtggccct

SEQ ID NO: 80506 - DNA, 25 bp, Homo sapien
aggcctggcggaatggtggtgccca

SEQ ID NO: 80507 - DNA, 25 bp, Homo sapien
ttgggcaagggctcaccaggacctc

SEQ ID NO: 80508 - DNA, 25 bp, Homo sapien
tcaccaggacctcaacgggcaaagt

SEQ ID NO: 80509 - DNA, 25 bp, Homo sapien
aacgggcaaagttgtgcacactaaa

SEQ ID NO: 80510 - DNA, 25 bp, Homo sapien
tttctaaagaaagctgtgttcttct

SEQ ID NO: 80511 - DNA, 25 bp, Homo sapien
gtgttcttctgttgacccagacgaa

SEQ ID NO: 80512 - DNA, 25 bp, Homo sapien
gttgacccagacgaatagggcacag

SEQ ID NO: 80513 - DNA, 25 bp, Homo sapien
tagggcacagccctgtaactgcacg

SEQ ID NO: 80514 - DNA, 25 bp, Homo sapien
tgtaactgcacgtgccttctgtcat

SEQ ID NO: 80515 - DNA, 25 bp, Homo sapien
acgtgccttctgtcattgggaatga

SEQ ID NO: 80516 - DNA, 25 bp, Homo sapien
gacagggatggccatgcggatccgt

SEQ ID NO: 80517 - DNA, 25 bp, Homo sapien
acagggatggccatgcggatccgtg

SEQ ID NO: 80518 - DNA, 25 bp, Homo sapien
cagggatggccatgcggatccgtgt

SEQ ID NO: 80519 - DNA, 25 bp, Homo sapien
agggatggccatgcggatccgtgtg

SEQ ID NO: 80520 - DNA, 25 bp, Homo sapien
gatggccatgcggatccgtgtgggc

SEQ ID NO: 80521 - DNA, 25 bp, Homo sapien
atggccatgcggatccgtgtgggcc

SEQ ID NO: 80522 - DNA, 25 bp, Homo sapien
tggccatgcggatccgtgtgggcca

SEQ ID NO: 80523 - DNA, 25 bp, Homo sapien
ggccatgcggatccgtgtgggccag

SEQ ID NO: 80524 - DNA, 25 bp, Homo sapien
ggaaacgtgtttcaatcaaaactga

SEQ ID NO: 80525 - DNA, 25 bp, Homo sapien
caaaactgaccatgagataaaggaa

SEQ ID NO: 80526 - DNA, 25 bp, Homo sapien
gatgtggcttttgtgatattctatc

SEQ ID NO: 80527 - DNA, 25 bp, Homo sapien
tgatattctatcacaaacacttatt

SEQ ID NO: 80528 - DNA, 25 bp, Homo sapien
caaacacttattgtatctctgtaaa

SEQ ID NO: 80529 - DNA, 25 bp, Homo sapien
aagtgtttttgtcctaatgttgcta

SEQ ID NO: 80530 - DNA, 25 bp, Homo sapien
ttttgtcctaatgttgctactccca

SEQ ID NO: 80531 - DNA, 25 bp, Homo sapien
tgtcctaatgttgctactcccatgg

SEQ ID NO: 80532 - DNA, 25 bp, Homo sapien
taatgttgctactcccatggcaaag

SEQ ID NO: 80533 - DNA, 25 bp, Homo sapien
attcaaatctgctttctaccctcat

SEQ ID NO: 80534 - DNA, 25 bp, Homo sapien
atctgctttctaccctcattaacaa

SEQ ID NO: 80535 - DNA, 25 bp, Homo sapien
ccaccctgctgtttgagcggcagca

SEQ ID NO: 80536 - DNA, 25 bp, Homo sapien
cgcgacctgcgcagagctctggaca

SEQ ID NO: 80537 - DNA, 25 bp, Homo sapien
tggccaaggagcagcatttgcagaa

SEQ ID NO: 80538 - DNA, 25 bp, Homo sapien
aagtctatacaaatcaacccacggg

SEQ ID NO: 80539 - DNA, 25 bp, Homo sapien
aacccacgggagactatttcacaca

SEQ ID NO: 80540 - DNA, 25 bp, Homo sapien
ccacgggagactatttcacacaatt

SEQ ID NO: 80541 - DNA, 25 bp, Homo sapien
tcacacaatttaatacaggaagtcg

SEQ ID NO: 80542 - DNA, 25 bp, Homo sapien
gaagtcgataatgaggaacacaccc

SEQ ID NO: 80543 - DNA, 25 bp, Homo sapien
atgaggaacacacccttgttcccgt

SEQ ID NO: 80544 - DNA, 25 bp, Homo sapien
cttgttcccgtcattcacgtataaa

SEQ ID NO: 80545 - DNA, 25 bp, Homo sapien
ttcacgtataaagagtggctacctt

SEQ ID NO: 80546 - DNA, 25 bp, Homo sapien
tggcacacgggccaaggtacccaca

SEQ ID NO: 80547 - DNA, 25 bp, Homo sapien
acacgggccaaggtacccacaggat

SEQ ID NO: 80548 - DNA, 25 bp, Homo sapien
cccggaggtgagaacaggaagccat

SEQ ID NO: 80549 - DNA, 25 bp, Homo sapien
tgagaacaggaagccattcacctcc

SEQ ID NO: 80550 - DNA, 25 bp, Homo sapien
gaacaggaagccattcacctccgct

SEQ ID NO: 80551 - DNA, 25 bp, Homo sapien
attcacctccgctccttgagcgtga

SEQ ID NO: 80552 - DNA, 25 bp, Homo sapien
cttgagcgtgagtgtttccaggacc

SEQ ID NO: 80553 - DNA, 25 bp, Homo sapien
gtgagggtcacctgttgtcgggagg

SEQ ID NO: 80554 - DNA, 25 bp, Homo sapien
ttgtcgggaggggagccactccttc

SEQ ID NO: 80555 - DNA, 25 bp, Homo sapien
tgcctgtggcccgttgaaatgttgg

SEQ ID NO: 80556 - DNA, 25 bp, Homo sapien
cctgtggcccgttgaaatgttggtg

SEQ ID NO: 80557 - DNA, 25 bp, Homo sapien
cccgggatcattttctaggttcatt

SEQ ID NO: 80558 - DNA, 25 bp, Homo sapien
tttctctggaacatttgctgtagca

SEQ ID NO: 80559 - DNA, 25 bp, Homo sapien
ttgctgtagcatctggtctcacgga

SEQ ID NO: 80560 - DNA, 25 bp, Homo sapien
ctggtctcacggactctgaggagga

SEQ ID NO: 80561 - DNA, 25 bp, Homo sapien
gagggaactgagacgccagcttaaa

SEQ ID NO: 80562 - DNA, 25 bp, Homo sapien
ccagcttaaattggctcttgcagag

SEQ ID NO: 80563 - DNA, 25 bp, Homo sapien
tagtttcgatgagctagtgacacat

SEQ ID NO: 80564 - DNA, 25 bp, Homo sapien
aagatgcaaagatcctcctggcggc

SEQ ID NO: 80565 - DNA, 25 bp, Homo sapien
tcctggcggcagtagccttgacaag

SEQ ID NO: 80566 - DNA, 25 bp, Homo sapien
aagggccacctcttcacaggatgca

SEQ ID NO: 80567 - DNA, 25 bp, Homo sapien
agtctgtctgtgcaccaaactcttc

SEQ ID NO: 80568 - DNA, 25 bp, Homo sapien
agtgtgagggctgcctcataagctc

SEQ ID NO: 80569 - DNA, 25 bp, Homo sapien
ataagctcccaatctcagacactgg

SEQ ID NO: 80570 - DNA, 25 bp, Homo sapien
gacactggcagtcagggagaatcaa

SEQ ID NO: 80571 - DNA, 25 bp, Homo sapien
gagaatcaaactgcctgtctccctg

SEQ ID NO: 80572 - DNA, 25 bp, Homo sapien
cctggtcctgccatattcatagggt

SEQ ID NO: 80573 - DNA, 25 bp, Homo sapien
attcatagggtgtccatgcacacat

SEQ ID NO: 80574 - DNA, 25 bp, Homo sapien
atgcacacatggtgtcccagatcta

SEQ ID NO: 80575 - DNA, 25 bp, Homo sapien
ggtgtcccagatctaggcaggccta

SEQ ID NO: 80576 - DNA, 25 bp, Homo sapien
tgtctccattctaacctgactggca

SEQ ID NO: 80577 - DNA, 25 bp, Homo sapien
tgactggcacatctcagcctaacca

SEQ ID NO: 80578 - DNA, 25 bp, Homo sapien
gactctatttggatcctggatttgt

SEQ ID NO: 80579 - DNA, 25 bp, Homo sapien
gaataacttacctttgtgctccact

SEQ ID NO: 80580 - DNA, 25 bp, Homo sapien
tttgtgctccacttaaaccagatgt

SEQ ID NO: 80581 - DNA, 25 bp, Homo sapien
gtgctccacttaaaccagatgtgtt

SEQ ID NO: 80582 - DNA, 25 bp, Homo sapien
cagatgtgttgcagctttcctgaca

SEQ ID NO: 80583 - DNA, 25 bp, Homo sapien
gcagctttcctgacatgcaaggatc

SEQ ID NO: 80584 - DNA, 25 bp, Homo sapien
gcaaggatctactttaattccacac

SEQ ID NO: 80585 - DNA, 25 bp, Homo sapien
aaagggaatgttttggcacctgata

SEQ ID NO: 80586 - DNA, 25 bp, Homo sapien
ggcacctgatataatctgccaggct

SEQ ID NO: 80587 - DNA, 25 bp, Homo sapien
atggtttcccctaacaagcccaatg

SEQ ID NO: 80588 - DNA, 25 bp, Homo sapien
taacaagcccaatgcactggtctga

SEQ ID NO: 80589 - DNA, 25 bp, Homo sapien
gcccaatgcactggtctgactttat

SEQ ID NO: 80590 - DNA, 25 bp, Homo sapien
gtttttcctgaactccaaccagaat

SEQ ID NO: 80591 - DNA, 25 bp, Homo sapien
tttttcctgaactccaaccagaatc

SEQ ID NO: 80592 - DNA, 25 bp, Homo sapien
ttttcctgaactccaaccagaatcc

SEQ ID NO: 80593 - DNA, 25 bp, Homo sapien
tttcctgaactccaaccagaatcca

SEQ ID NO: 80594 - DNA, 25 bp, Homo sapien
ttcctgaactccaaccagaatccaa

SEQ ID NO: 80595 - DNA, 25 bp, Homo sapien
tcctgaactccaaccagaatccaaa

SEQ ID NO: 80596 - DNA, 25 bp, Homo sapien
tgaactccaaccagaatccaaattg

SEQ ID NO: 80597 - DNA, 25 bp, Homo sapien
gaactccaaccagaatccaaattgg

SEQ ID NO: 80598 - DNA, 25 bp, Homo sapien
aactccaaccagaatccaaattggt

SEQ ID NO: 80599 - DNA, 25 bp, Homo sapien
tccaaccagaatccaaattggttag

SEQ ID NO: 80600 - DNA, 25 bp, Homo sapien
accagaatccaaattggttagatga

SEQ ID NO: 80601 - DNA, 25 bp, Homo sapien
tttgcgttgcaggtgggaaaatctc

SEQ ID NO: 80602 - DNA, 25 bp, Homo sapien
attcttctaaggtcaccacctctta

SEQ ID NO: 80603 - DNA, 25 bp, Homo sapien
ccacctcttagagggtctcttattt

SEQ ID NO: 80604 - DNA, 25 bp, Homo sapien
ttctttcagagatcaaatgcacagt

SEQ ID NO: 80605 - DNA, 25 bp, Homo sapien
tgcacagttatgctgtacaactaaa

SEQ ID NO: 80606 - DNA, 25 bp, Homo sapien
gtacaactaaattctgcagtcttgg

SEQ ID NO: 80607 - DNA, 25 bp, Homo sapien
ttctgcagtcttgggaatccttacg

SEQ ID NO: 80608 - DNA, 25 bp, Homo sapien
gggaatccttacgagtaccaactat

SEQ ID NO: 80609 - DNA, 25 bp, Homo sapien
gagtaccaactattagtcacttttt

SEQ ID NO: 80610 - DNA, 25 bp, Homo sapien
gtggaagcagtgtttggttcttact

SEQ ID NO: 80611 - DNA, 25 bp, Homo sapien
tggttcttactttacccaaactgtg

SEQ ID NO: 80612 - DNA, 25 bp, Homo sapien
taacctgtgtctgcgaagtcctatg

SEQ ID NO: 80613 - DNA, 25 bp, Homo sapien
tgcgaagtcctatggaaacccgagg

SEQ ID NO: 80614 - DNA, 25 bp, Homo sapien
gaaacccgagggttgattaaggcag

SEQ ID NO: 80615 - DNA, 25 bp, Homo sapien
attgtggagccttttaactgtgcaa

SEQ ID NO: 80616 - DNA, 25 bp, Homo sapien
ggcatgtgcaggtactttttattat

SEQ ID NO: 80617 - DNA, 25 bp, Homo sapien
cattcaacagatatacttcaggcac

SEQ ID NO: 80618 - DNA, 25 bp, Homo sapien
agatatacttcaggcacaactctgt

SEQ ID NO: 80619 - DNA, 25 bp, Homo sapien
aggcacaactctgtgcaaatcattt

SEQ ID NO: 80620 - DNA, 25 bp, Homo sapien
tggcaattattgttctagtggctgg

SEQ ID NO: 80621 - DNA, 25 bp, Homo sapien
ggctgggtacagcaatgaacaatgt

SEQ ID NO: 80622 - DNA, 25 bp, Homo sapien
gaacaatgtagatacaactttctgc

SEQ ID NO: 80623 - DNA, 25 bp, Homo sapien
gaatgctttgcaagtttgactgtat

SEQ ID NO: 80624 - DNA, 25 bp, Homo sapien
atgctttgcaagtttgactgtatgc

SEQ ID NO: 80625 - DNA, 25 bp, Homo sapien
gcaagtttgactgtatgcaggttta

SEQ ID NO: 80626 - DNA, 25 bp, Homo sapien
gactgtatgcaggtttatatcagaa

SEQ ID NO: 80627 - DNA, 25 bp, Homo sapien
gtatgcaggtttatatcagaaggtg

SEQ ID NO: 80628 - DNA, 25 bp, Homo sapien
gtgagattgaataatgcttgatgca

SEQ ID NO: 80629 - DNA, 25 bp, Homo sapien
gcttgatgcagaatcgaaacttctc

SEQ ID NO: 80630 - DNA, 25 bp, Homo sapien
gatgcagaatcgaaacttctcattt

SEQ ID NO: 80631 - DNA, 25 bp, Homo sapien
gaatcgaaacttctcatttatctgt

SEQ ID NO: 80632 - DNA, 25 bp, Homo sapien
cgaaacttctcatttatctgtatat

SEQ ID NO: 80633 - DNA, 25 bp, Homo sapien
aacttctcatttatctgtatattat

SEQ ID NO: 80634 - DNA, 25 bp, Homo sapien
acctaacctgtgtctgcgaagtcct

SEQ ID NO: 80635 - DNA, 25 bp, Homo sapien
taacctgtgtctgcgaagtcctatg

SEQ ID NO: 80636 - DNA, 25 bp, Homo sapien
cctgtgtctgcgaagtcctatggaa

SEQ ID NO: 80637 - DNA, 25 bp, Homo sapien
gtctgcgaagtcctatggaaacccg

SEQ ID NO: 80638 - DNA, 25 bp, Homo sapien
gcgaagtcctatggaaacccgaggg

SEQ ID NO: 80639 - DNA, 25 bp, Homo sapien
gaaacccgagggttgattaaggcag

SEQ ID NO: 80640 - DNA, 25 bp, Homo sapien
ggcagtacaaattgtggagcctttt

SEQ ID NO: 80641 - DNA, 25 bp, Homo sapien
aaattgtggagccttttaactgtgc

SEQ ID NO: 80642 - DNA, 25 bp, Homo sapien
ttgtggagccttttaactgtgcaat

SEQ ID NO: 80643 - DNA, 25 bp, Homo sapien
tttggcatgtgcaggtactttttat

SEQ ID NO: 80644 - DNA, 25 bp, Homo sapien
gcatgtgcaggtactttttattatt

SEQ ID NO: 80645 - DNA, 25 bp, Homo sapien
aagcattcagccgaagttccattct

SEQ ID NO: 80646 - DNA, 25 bp, Homo sapien
gcattcagccgaagttccattcttg

SEQ ID NO: 80647 - DNA, 25 bp, Homo sapien
attcagccgaagttccattcttgtg

SEQ ID NO: 80648 - DNA, 25 bp, Homo sapien
tcagccgaagttccattcttgtgca

SEQ ID NO: 80649 - DNA, 25 bp, Homo sapien
agccgaagttccattcttgtgcaac

SEQ ID NO: 80650 - DNA, 25 bp, Homo sapien
gccgaagttccattcttgtgcaaca

SEQ ID NO: 80651 - DNA, 25 bp, Homo sapien
ccgaagttccattcttgtgcaacac

SEQ ID NO: 80652 - DNA, 25 bp, Homo sapien
gaagttccattcttgtgcaacacca

SEQ ID NO: 80653 - DNA, 25 bp, Homo sapien
aagttccattcttgtgcaacaccag

SEQ ID NO: 80654 - DNA, 25 bp, Homo sapien
tgcagaaaaacttctgaatgttgtg

SEQ ID NO: 80655 - DNA, 25 bp, Homo sapien
aaaccttatggatgtgttgagtgtg

SEQ ID NO: 80656 - DNA, 25 bp, Homo sapien
cccatctgtgaataagccattctga

SEQ ID NO: 80657 - DNA, 25 bp, Homo sapien
gaataagccattctgactcatatcc

SEQ ID NO: 80658 - DNA, 25 bp, Homo sapien
attctgactcatatcccctatttaa

SEQ ID NO: 80659 - DNA, 25 bp, Homo sapien
atatcccctatttaacagggtctct

SEQ ID NO: 80660 - DNA, 25 bp, Homo sapien
aacagggtctctagtgctgtgaaaa

SEQ ID NO: 80661 - DNA, 25 bp, Homo sapien
aatgactttattgcatctgggtagc

SEQ ID NO: 80662 - DNA, 25 bp, Homo sapien
catctgggtagctgtaaggcatgaa

SEQ ID NO: 80663 - DNA, 25 bp, Homo sapien
gaaactaggtctgatattcaaatgg

SEQ ID NO: 80664 - DNA, 25 bp, Homo sapien
ggacaaactgccagttttgtttcct

SEQ ID NO: 80665 - DNA, 25 bp, Homo sapien
tttgtttcctttcactggccacagt

SEQ ID NO: 80666 - DNA, 25 bp, Homo sapien
ggccacagttgtttgatgcattaaa

SEQ ID NO: 80667 - DNA, 25 bp, Homo sapien
cttaacacttcttacgcaatgcttc

SEQ ID NO: 80668 - DNA, 25 bp, Homo sapien
tctagagttttatagcctggactgc

SEQ ID NO: 80669 - DNA, 25 bp, Homo sapien
ctggactgctacctttcaaagcttg

SEQ ID NO: 80670 - DNA, 25 bp, Homo sapien
gaagccgtgaattcagttggttcgt

SEQ ID NO: 80671 - DNA, 25 bp, Homo sapien
agttggttcgttctgtactgttact

SEQ ID NO: 80672 - DNA, 25 bp, Homo sapien
tgtactgttactgggccctgagtct

SEQ ID NO: 80673 - DNA, 25 bp, Homo sapien
tgcttgcctgcagggccatggctca

SEQ ID NO: 80674 - DNA, 25 bp, Homo sapien
atggtggccagaggtgtcacccaaa

SEQ ID NO: 80675 - DNA, 25 bp, Homo sapien
acccaaaccggcaggtgcgattttg

SEQ ID NO: 80676 - DNA, 25 bp, Homo sapien
gcgattttgttaacccagcgacgaa

SEQ ID NO: 80677 - DNA, 25 bp, Homo sapien
ataaagacacctggttgctaacctg

SEQ ID NO: 80678 - DNA, 25 bp, Homo sapien
ctccatcacggacaacctgctgcag

SEQ ID NO: 80679 - DNA, 25 bp, Homo sapien
ggcgcaaagcttcggacttctttta

SEQ ID NO: 80680 - DNA, 25 bp, Homo sapien
aagcttcggacttcttttagagcca

SEQ ID NO: 80681 - DNA, 25 bp, Homo sapien
ttcggacttcttttagagccaggcc

SEQ ID NO: 80682 - DNA, 25 bp, Homo sapien
gacttcttttagagccaggcctggg

SEQ ID NO: 80683 - DNA, 25 bp, Homo sapien
ctgggctgggctcatagacgcttca

SEQ ID NO: 80684 - DNA, 25 bp, Homo sapien
ctgggctcatagacgcttcacagag

SEQ ID NO: 80685 - DNA, 25 bp, Homo sapien
gctcatagacgcttcacagagcctg

SEQ ID NO: 80686 - DNA, 25 bp, Homo sapien
gccagactggcacaaggcactcgtg

SEQ ID NO: 80687 - DNA, 25 bp, Homo sapien
agggccttgccaagctgtttgctgt

SEQ ID NO: 80688 - DNA, 25 bp, Homo sapien
agctgtttgctgtttaattggcccc

SEQ ID NO: 80689 - DNA, 25 bp, Homo sapien
cttcaaccccagactttgactgtat

SEQ ID NO: 80690 - DNA, 25 bp, Homo sapien
gtgtcagttgattttggtgtgactt

SEQ ID NO: 80691 - DNA, 25 bp, Homo sapien
gacttgtgtaaatggttcatggcaa

SEQ ID NO: 80692 - DNA, 25 bp, Homo sapien
aatgacgttgggttgcttcctaggc

SEQ ID NO: 80693 - DNA, 25 bp, Homo sapien
tgggttgcttcctaggcctggctga

SEQ ID NO: 80694 - DNA, 25 bp, Homo sapien
ctaggcctggctgagttgtgcctaa

SEQ ID NO: 80695 - DNA, 25 bp, Homo sapien
tgtgcctaagggtggctgaaatact

SEQ ID NO: 80696 - DNA, 25 bp, Homo sapien
actaaaacacttatcttacagcaag

SEQ ID NO: 80697 - DNA, 25 bp, Homo sapien
tcccctccacagatgcactttaaaa

SEQ ID NO: 80698 - DNA, 25 bp, Homo sapien
tgcactttaaaaagccactcatgct

SEQ ID NO: 80699 - DNA, 25 bp, Homo sapien
cactcatgctttggcttaaactgta

SEQ ID NO: 80700 - DNA, 25 bp, Homo sapien
aagaattgctacctcttgtatggag

SEQ ID NO: 80701 - DNA, 25 bp, Homo sapien
ggtacaaaagactgacctcttacat

SEQ ID NO: 80702 - DNA, 25 bp, Homo sapien
aagactgacctcttacatcaaggaa

SEQ ID NO: 80703 - DNA, 25 bp, Homo sapien
gacctcttacatcaaggaacttcct

SEQ ID NO: 80704 - DNA, 25 bp, Homo sapien
tcccagagctcctcatggaatcaag

SEQ ID NO: 80705 - DNA, 25 bp, Homo sapien
gctcctcatggaatcaagctgaagt

SEQ ID NO: 80706 - DNA, 25 bp, Homo sapien
aagctgaagtcagtcttcttctgag

SEQ ID NO: 80707 - DNA, 25 bp, Homo sapien
gtcttcttctgagagcacattctta

SEQ ID NO: 80708 - DNA, 25 bp, Homo sapien
gagagcacattcttactcagttttt

SEQ ID NO: 80709 - DNA, 25 bp, Homo sapien
ttttttcctctgtcctacgctgctt

SEQ ID NO: 80710 - DNA, 25 bp, Homo sapien
tcctaagagcactccatcaataaac

SEQ ID NO: 80711 - DNA, 25 bp, Homo sapien
aaggacatggacaaggtcgagacat

SEQ ID NO: 80712 - DNA, 25 bp, Homo sapien
aggacatggacaaggtcgagacatt

SEQ ID NO: 80713 - DNA, 25 bp, Homo sapien
ggacatggacaaggtcgagacattc

SEQ ID NO: 80714 - DNA, 25 bp, Homo sapien
gacatggacaaggtcgagacattcc

SEQ ID NO: 80715 - DNA, 25 bp, Homo sapien
acatggacaaggtcgagacattcct

SEQ ID NO: 80716 - DNA, 25 bp, Homo sapien
catggacaaggtcgagacattcctg

SEQ ID NO: 80717 - DNA, 25 bp, Homo sapien
atggacaaggtcgagacattcctgc

SEQ ID NO: 80718 - DNA, 25 bp, Homo sapien
tggacaaggtcgagacattcctgcg

SEQ ID NO: 80719 - DNA, 25 bp, Homo sapien
ggacaaggtcgagacattcctgcgc

SEQ ID NO: 80720 - DNA, 25 bp, Homo sapien
gacaaggtcgagacattcctgcgca

SEQ ID NO: 80721 - DNA, 25 bp, Homo sapien
acaaggtcgagacattcctgcgcat

SEQ ID NO: 80722 - DNA, 25 bp, Homo sapien
ggcagccccatcgagctggactgaa

SEQ ID NO: 80723 - DNA, 25 bp, Homo sapien
gagctggactgaactggccaggcca

SEQ ID NO: 80724 - DNA, 25 bp, Homo sapien
ggagacaccacggtcgacgacggct

SEQ ID NO: 80725 - DNA, 25 bp, Homo sapien
acgacggctggagggacgtttcaga

SEQ ID NO: 80726 - DNA, 25 bp, Homo sapien
gcgagtcctgggtggctcctcgcct

SEQ ID NO: 80727 - DNA, 25 bp, Homo sapien
atgccggcgcgtgtctgtttctgtg

SEQ ID NO: 80728 - DNA, 25 bp, Homo sapien
gtgtctgtttctgtgcggcggctca

SEQ ID NO: 80729 - DNA, 25 bp, Homo sapien
tggcgcggctgctgctcactgtgct

SEQ ID NO: 80730 - DNA, 25 bp, Homo sapien
cactgtgctgctgggacccaagagt

SEQ ID NO: 80731 - DNA, 25 bp, Homo sapien
ccccgagattgacccacaataaagc

SEQ ID NO: 80732 - DNA, 25 bp, Homo sapien
ttgacccacaataaagcacaggcct

SEQ ID NO: 80733 - DNA, 25 bp, Homo sapien
tatgaaactttgctatgggccctgc

SEQ ID NO: 80734 - DNA, 25 bp, Homo sapien
aaactttgctatgggccctgcactt

SEQ ID NO: 80735 - DNA, 25 bp, Homo sapien
tatgggccctgcacttcctttgctt

SEQ ID NO: 80736 - DNA, 25 bp, Homo sapien
tttgcttcctcctgttcaccctggt

SEQ ID NO: 80737 - DNA, 25 bp, Homo sapien
ctgttcaccctggtggtgtacggat

SEQ ID NO: 80738 - DNA, 25 bp, Homo sapien
ttcaccctggtggtgtacggatgag

SEQ ID NO: 80739 - DNA, 25 bp, Homo sapien
gtgggacccccaaacatatatcagc

SEQ ID NO: 80740 - DNA, 25 bp, Homo sapien
aaaaaatggcgtcatgaatatgaac

SEQ ID NO: 80741 - DNA, 25 bp, Homo sapien
aatatgaacagcattgtcagatgaa

SEQ ID NO: 80742 - DNA, 25 bp, Homo sapien
cagcattgtcagatgaattagttga

SEQ ID NO: 80743 - DNA, 25 bp, Homo sapien
taatggattaatgtgtcttgtatat

SEQ ID NO: 80744 - DNA, 25 bp, Homo sapien
tatcactcagcctgtccttaaacgg

SEQ ID NO: 80745 - DNA, 25 bp, Homo sapien
aaacggcctcgccatgtgcattgtc

SEQ ID NO: 80746 - DNA, 25 bp, Homo sapien
atgtgcattgtcacttgtgctgtcc

SEQ ID NO: 80747 - DNA, 25 bp, Homo sapien
tgtgctgtccagatgggcacatgca

SEQ ID NO: 80748 - DNA, 25 bp, Homo sapien
tgcagcatgctgtgctcacagcccg

SEQ ID NO: 80749 - DNA, 25 bp, Homo sapien
ggtgtgaccaaaatcagtgggatgt

SEQ ID NO: 80750 - DNA, 25 bp, Homo sapien
caaaatcagtgggatgtggcaggaa

SEQ ID NO: 80751 - DNA, 25 bp, Homo sapien
gccagcatctgttcccacagggatt

SEQ ID NO: 80752 - DNA, 25 bp, Homo sapien
gcatctgttcccacagggatttgta

SEQ ID NO: 80753 - DNA, 25 bp, Homo sapien
gatttgtatcgttgtgcccgtgtca

SEQ ID NO: 80754 - DNA, 25 bp, Homo sapien
gggagatcttttacctgtgcttact

SEQ ID NO: 80755 - DNA, 25 bp, Homo sapien
gtttctctccaggatagtagagatt

SEQ ID NO: 80756 - DNA, 25 bp, Homo sapien
gagatttctctatttcacctcaacc

SEQ ID NO: 80757 - DNA, 25 bp, Homo sapien
atttctctatttcacctcaacctaa

SEQ ID NO: 80758 - DNA, 25 bp, Homo sapien
aatgacttaatattatccttttcta

SEQ ID NO: 80759 - DNA, 25 bp, Homo sapien
tatccttttctaatagtctcatgta

SEQ ID NO: 80760 - DNA, 25 bp, Homo sapien
gtctcatgtaaaatatgccgctatt

SEQ ID NO: 80761 - DNA, 25 bp, Homo sapien
atgccgctattacaacttacaacta

SEQ ID NO: 80762 - DNA, 25 bp, Homo sapien
caactaattgaatgagatgttaact

SEQ ID NO: 80763 - DNA, 25 bp, Homo sapien
gtttgatttttacctgacagtgttt

SEQ ID NO: 80764 - DNA, 25 bp, Homo sapien
tacctgacagtgtttgtcaaattta

SEQ ID NO: 80765 - DNA, 25 bp, Homo sapien
ttgccaaagacagatataaattacc

SEQ ID NO: 80766 - DNA, 25 bp, Homo sapien
gtatgtgcccagtcatcttttttca

SEQ ID NO: 80767 - DNA, 25 bp, Homo sapien
agttaaggtcattggctgctctact

SEQ ID NO: 80768 - DNA, 25 bp, Homo sapien
aggtcattggctgctctactctgtc

SEQ ID NO: 80769 - DNA, 25 bp, Homo sapien
tggtcacctagtgatagccccagtg

SEQ ID NO: 80770 - DNA, 25 bp, Homo sapien
atagccccagtggagatactgtcca

SEQ ID NO: 80771 - DNA, 25 bp, Homo sapien
atactgtccatacaaggtcttccca

SEQ ID NO: 80772 - DNA, 25 bp, Homo sapien
aggtcttcccagaggctggatacca

SEQ ID NO: 80773 - DNA, 25 bp, Homo sapien
tcccagaggctggataccacagtaa

SEQ ID NO: 80774 - DNA, 25 bp, Homo sapien
gtaggagactatggagatcttacct

SEQ ID NO: 80775 - DNA, 25 bp, Homo sapien
gagatcttacctcctgataaatgtg

SEQ ID NO: 80776 - DNA, 25 bp, Homo sapien
ttacctcctgataaatgtgctacac

SEQ ID NO: 80777 - DNA, 25 bp, Homo sapien
gggttggcacagcattctgatttac

SEQ ID NO: 80778 - DNA, 25 bp, Homo sapien
gttggcacagcattctgatttacca

SEQ ID NO: 80779 - DNA, 25 bp, Homo sapien
ggcacagcattctgatttaccaaac

SEQ ID NO: 80780 - DNA, 25 bp, Homo sapien
cagcattctgatttaccaaaccctc

SEQ ID NO: 80781 - DNA, 25 bp, Homo sapien
attctgatttaccaaaccctccaag

SEQ ID NO: 80782 - DNA, 25 bp, Homo sapien
tgatttaccaaaccctccaagtgat

SEQ ID NO: 80783 - DNA, 25 bp, Homo sapien
ttaccaaaccctccaagtgattttg

SEQ ID NO: 80784 - DNA, 25 bp, Homo sapien
aaaccctccaagtgattttgatgta

SEQ ID NO: 80785 - DNA, 25 bp, Homo sapien
ctccaagtgattttgatgtattcta

SEQ ID NO: 80786 - DNA, 25 bp, Homo sapien
attctaattttgagaccatctctag

SEQ ID NO: 80787 - DNA, 25 bp, Homo sapien
aattttgagaccatctctagaaaag

SEQ ID NO: 80788 - DNA, 25 bp, Homo sapien
agtgtggtcaccgagtgaggaccct

SEQ ID NO: 80789 - DNA, 25 bp, Homo sapien
tgcctccacctgagagttgctaggg

SEQ ID NO: 80790 - DNA, 25 bp, Homo sapien
ggttcttgtcgagatcatgtcatca

SEQ ID NO: 80791 - DNA, 25 bp, Homo sapien
atgtcatcagcacccctaagtcaag

SEQ ID NO: 80792 - DNA, 25 bp, Homo sapien
ctaagtcaagtcacgggtttccata

SEQ ID NO: 80793 - DNA, 25 bp, Homo sapien
acgggtttccatagccaggcagttg

SEQ ID NO: 80794 - DNA, 25 bp, Homo sapien
tagccaggcagttggtatgtacaat

SEQ ID NO: 80795 - DNA, 25 bp, Homo sapien
gtatgtacaattcagttcagcgtat

SEQ ID NO: 80796 - DNA, 25 bp, Homo sapien
tcagcgtatgaacttgtatctctaa

SEQ ID NO: 80797 - DNA, 25 bp, Homo sapien
gtatctctaatctgatgtccatttt

SEQ ID NO: 80798 - DNA, 25 bp, Homo sapien
aactgagcacaatgaaatcctttct

SEQ ID NO: 80799 - DNA, 25 bp, Homo sapien
agggccgtgcccttgcccttggagc

SEQ ID NO: 80800 - DNA, 25 bp, Homo sapien
agctgccgtgcctgtgtcctgatgg

SEQ ID NO: 80801 - DNA, 25 bp, Homo sapien
ctgatggcccaaatgtcagggttct

SEQ ID NO: 80802 - DNA, 25 bp, Homo sapien
aaatgtcagggttctgctcggcttc

SEQ ID NO: 80803 - DNA, 25 bp, Homo sapien
ttctgctcggcttcttggaccatgg

SEQ ID NO: 80804 - DNA, 25 bp, Homo sapien
gcttcttggaccatggcgcttagtc

SEQ ID NO: 80805 - DNA, 25 bp, Homo sapien
gcgcttagtccccatcccgggtttg

SEQ ID NO: 80806 - DNA, 25 bp, Homo sapien
agagctgctatgctaaacctcctgc

SEQ ID NO: 80807 - DNA, 25 bp, Homo sapien
tgcctcccaataccagcaggaggtt

SEQ ID NO: 80808 - DNA, 25 bp, Homo sapien
tgctgccccagcgtcttgacgggag

SEQ ID NO: 80809 - DNA, 25 bp, Homo sapien
ggaagcctgccgaaaacaggagcaa

SEQ ID NO: 80810 - DNA, 25 bp, Homo sapien
ctgcctgtctttgtcacaaaatttc

SEQ ID NO: 80811 - DNA, 25 bp, Homo sapien
ttcatttttctcatagttaatttca

SEQ ID NO: 80812 - DNA, 25 bp, Homo sapien
gttaatttcatctctccggtaagat

SEQ ID NO: 80813 - DNA, 25 bp, Homo sapien
tctccggtaagattttattggtgtt

SEQ ID NO: 80814 - DNA, 25 bp, Homo sapien
taactttgcagttcttacaccgttt

SEQ ID NO: 80815 - DNA, 25 bp, Homo sapien
tttgcagttcttacaccgtttggtg

SEQ ID NO: 80816 - DNA, 25 bp, Homo sapien
caccgtttggtgattttcatgtttc

SEQ ID NO: 80817 - DNA, 25 bp, Homo sapien
aagtcttttaagtacatgagtgctt

SEQ ID NO: 80818 - DNA, 25 bp, Homo sapien
catgagtgcttagaaatgtacataa

SEQ ID NO: 80819 - DNA, 25 bp, Homo sapien
tttatatacacttatgccttacatt

SEQ ID NO: 80820 - DNA, 25 bp, Homo sapien
atgccttacattaaagtccaatatg

SEQ ID NO: 80821 - DNA, 25 bp, Homo sapien
gtgcctagccaaggatgagattttt

SEQ ID NO: 80822 - DNA, 25 bp, Homo sapien
gtttcagttctgtgtcatggttgga

SEQ ID NO: 80823 - DNA, 25 bp, Homo sapien
agaggtgattcatggctctgtgaat

SEQ ID NO: 80824 - DNA, 25 bp, Homo sapien
catggctctgtgaatttgaggtgaa

SEQ ID NO: 80825 - DNA, 25 bp, Homo sapien
gaggtgaatggttccttattgtcta

SEQ ID NO: 80826 - DNA, 25 bp, Homo sapien
atatgagtcagttattgccagcctt

SEQ ID NO: 80827 - DNA, 25 bp, Homo sapien
gtcagttattgccagccttggaatt

SEQ ID NO: 80828 - DNA, 25 bp, Homo sapien
aatttacttctctagcttacaatgg

SEQ ID NO: 80829 - DNA, 25 bp, Homo sapien
gcttacaatggaccttttgaactgg

SEQ ID NO: 80830 - DNA, 25 bp, Homo sapien
gaactggaaaacaccttgtctgcat

SEQ ID NO: 80831 - DNA, 25 bp, Homo sapien
gaaaacaccttgtctgcattcactt

SEQ ID NO: 80832 - DNA, 25 bp, Homo sapien
aaggacatggacaaggtcgagacat

SEQ ID NO: 80833 - DNA, 25 bp, Homo sapien
aggacatggacaaggtcgagacatt

SEQ ID NO: 80834 - DNA, 25 bp, Homo sapien
ggacatggacaaggtcgagacattc

SEQ ID NO: 80835 - DNA, 25 bp, Homo sapien
gacatggacaaggtcgagacattcc

SEQ ID NO: 80836 - DNA, 25 bp, Homo sapien
acatggacaaggtcgagacattcct

SEQ ID NO: 80837 - DNA, 25 bp, Homo sapien
catggacaaggtcgagacattcctg

SEQ ID NO: 80838 - DNA, 25 bp, Homo sapien
atggacaaggtcgagacattcctgc

SEQ ID NO: 80839 - DNA, 25 bp, Homo sapien
tggacaaggtcgagacattcctgcg

SEQ ID NO: 80840 - DNA, 25 bp, Homo sapien
ggacaaggtcgagacattcctgcgc

SEQ ID NO: 80841 - DNA, 25 bp, Homo sapien
gacaaggtcgagacattcctgcgca

SEQ ID NO: 80842 - DNA, 25 bp, Homo sapien
acaaggtcgagacattcctgcgcat

SEQ ID NO: 80843 - DNA, 25 bp, Homo sapien
gagctccaagcctggaagagcccag

SEQ ID NO: 80844 - DNA, 25 bp, Homo sapien
aagagcccaggagctgatctgttac

SEQ ID NO: 80845 - DNA, 25 bp, Homo sapien
tgatctgttacaagtcctgaccaaa

SEQ ID NO: 80846 - DNA, 25 bp, Homo sapien
gaccaaagcagtcaagagtgccgaa

SEQ ID NO: 80847 - DNA, 25 bp, Homo sapien
caagagtgccgaagctgcagccgag

SEQ ID NO: 80848 - DNA, 25 bp, Homo sapien
ggagccggaagagccagttatatca

SEQ ID NO: 80849 - DNA, 25 bp, Homo sapien
gttatatcagctcagcacggctgga

SEQ ID NO: 80850 - DNA, 25 bp, Homo sapien
tccgggccatcttggaggtcttgca

SEQ ID NO: 80851 - DNA, 25 bp, Homo sapien
gctagggtgtgtgactgcctccctt

SEQ ID NO: 80852 - DNA, 25 bp, Homo sapien
tcctctcactgctgtgctgaggtgg

SEQ ID NO: 80853 - DNA, 25 bp, Homo sapien
tgctgaggtggcctttgtcacttcc

SEQ ID NO: 80854 - DNA, 25 bp, Homo sapien
gaaattttaagctatttaatcttgg

SEQ ID NO: 80855 - DNA, 25 bp, Homo sapien
ctgaagccagtcatgtaaacatact

SEQ ID NO: 80856 - DNA, 25 bp, Homo sapien
gtcatgtaaacatactataccaatc

SEQ ID NO: 80857 - DNA, 25 bp, Homo sapien
ctataccaatctagtccctaacagt

SEQ ID NO: 80858 - DNA, 25 bp, Homo sapien
caatctagtccctaacagtgttttt

SEQ ID NO: 80859 - DNA, 25 bp, Homo sapien
tctagtccctaacagtgttttttct

SEQ ID NO: 80860 - DNA, 25 bp, Homo sapien
gttttttctcttgtggcagaaagaa

SEQ ID NO: 80861 - DNA, 25 bp, Homo sapien
tctttggaatctccttcccagacac

SEQ ID NO: 80862 - DNA, 25 bp, Homo sapien
cacagtaaagggaggccaaccacta

SEQ ID NO: 80863 - DNA, 25 bp, Homo sapien
ggccaaccactactaacaagttcta

SEQ ID NO: 80864 - DNA, 25 bp, Homo sapien
taggatcttctatagtaggttaatg

SEQ ID NO: 80865 - DNA, 25 bp, Homo sapien
aaatctgtttgttcaggcagagagc

SEQ ID NO: 80866 - DNA, 25 bp, Homo sapien
gttcaggcagagagctatatttgga

SEQ ID NO: 80867 - DNA, 25 bp, Homo sapien
aggcagagagctatatttggaggaa

SEQ ID NO: 80868 - DNA, 25 bp, Homo sapien
tttggaggaagcattacagaacgaa

SEQ ID NO: 80869 - DNA, 25 bp, Homo sapien
gatgtactccaagtaaagctccagt

SEQ ID NO: 80870 - DNA, 25 bp, Homo sapien
tccaagtaaagctccagtgactaat

SEQ ID NO: 80871 - DNA, 25 bp, Homo sapien
ctccagtgactaatatgtataaatg

SEQ ID NO: 80872 - DNA, 25 bp, Homo sapien
gaatggctaaagcaattcatccaag

SEQ ID NO: 80873 - DNA, 25 bp, Homo sapien
aaagcaattcatccaagggccaccg

SEQ ID NO: 80874 - DNA, 25 bp, Homo sapien
tcatccaagggccaccggaagtaat

SEQ ID NO: 80875 - DNA, 25 bp, Homo sapien
caagggccaccggaagtaattagag

SEQ ID NO: 80876 - DNA, 25 bp, Homo sapien
gtgggaagccagcactagctctcat

SEQ ID NO: 80877 - DNA, 25 bp, Homo sapien
atccgggagataccaccagtcctgg

SEQ ID NO: 80878 - DNA, 25 bp, Homo sapien
aaggctacaggacccctgcttctga

SEQ ID NO: 80879 - DNA, 25 bp, Homo sapien
ctgcttctgacacagtgagcaacaa

SEQ ID NO: 80880 - DNA, 25 bp, Homo sapien
tgagcaacaagcctgggtttccctg

SEQ ID NO: 80881 - DNA, 25 bp, Homo sapien
ggtttccctgctggcagacggcaga

SEQ ID NO: 80882 - DNA, 25 bp, Homo sapien
tggcagacggcagatccctcaggaa

SEQ ID NO: 80883 - DNA, 25 bp, Homo sapien
gacggcagatccctcaggaaacctg

SEQ ID NO: 80884 - DNA, 25 bp, Homo sapien
aggaaacctgctccacttgtcaggg

SEQ ID NO: 80885 - DNA, 25 bp, Homo sapien
tgtcagggtctcttcggagacccag

SEQ ID NO: 80886 - DNA, 25 bp, Homo sapien
ggatttagggtcacatgctgcaggc

SEQ ID NO: 80887 - DNA, 25 bp, Homo sapien
gttcgacacaaactcacacaacgat

SEQ ID NO: 80888 - DNA, 25 bp, Homo sapien
tagctgcccgggtggcatccctgtg

SEQ ID NO: 80889 - DNA, 25 bp, Homo sapien
agctgcccgggtggcatccctgtga

SEQ ID NO: 80890 - DNA, 25 bp, Homo sapien
cgctcacctagctgcaatggctaca

SEQ ID NO: 80891 - DNA, 25 bp, Homo sapien
tcacctagctgcaatggctacagag

SEQ ID NO: 80892 - DNA, 25 bp, Homo sapien
cacctagctgcaatggctacagagg

SEQ ID NO: 80893 - DNA, 25 bp, Homo sapien
acctagctgcaatggctacagaggc

SEQ ID NO: 80894 - DNA, 25 bp, Homo sapien
cctagctgcaatggctacagaggct

SEQ ID NO: 80895 - DNA, 25 bp, Homo sapien
agctgcaatggctacagaggctgga

SEQ ID NO: 80896 - DNA, 25 bp, Homo sapien
tgcaatggctacagaggctggaaga

SEQ ID NO: 80897 - DNA, 25 bp, Homo sapien
gcaatggctacagaggctggaagat

SEQ ID NO: 80898 - DNA, 25 bp, Homo sapien
ttttgggcacctgaatcccaggaac

SEQ ID NO: 80899 - DNA, 25 bp, Homo sapien
tgggcacctgaatcccaggaaccct

SEQ ID NO: 80900 - DNA, 25 bp, Homo sapien
aactcccatgttgttttgtgaagat

SEQ ID NO: 80901 - DNA, 25 bp, Homo sapien
tctcacaagacatggggcatttcca

SEQ ID NO: 80902 - DNA, 25 bp, Homo sapien
agacatggggcatttccacaaattt

SEQ ID NO: 80903 - DNA, 25 bp, Homo sapien
gacatggggcatttccacaaattta

SEQ ID NO: 80904 - DNA, 25 bp, Homo sapien
ggcatttccacaaatttaagttcct

SEQ ID NO: 80905 - DNA, 25 bp, Homo sapien
catttccacaaatttaagttcctgt

SEQ ID NO: 80906 - DNA, 25 bp, Homo sapien
gttcctgtccatttggaaatttgtt

SEQ ID NO: 80907 - DNA, 25 bp, Homo sapien
tatgtgtacagtttgtcagagaaaa

SEQ ID NO: 80908 - DNA, 25 bp, Homo sapien
atacagaatgtgatttacgcaagaa

SEQ ID NO: 80909 - DNA, 25 bp, Homo sapien
aaggaaaagtagtctttgccctcat

SEQ ID NO: 80910 - DNA, 25 bp, Homo sapien
tttgccctcatgactgattggttta

SEQ ID NO: 80911 - DNA, 25 bp, Homo sapien
aattagcactaatctggcactttat

SEQ ID NO: 80912 - DNA, 25 bp, Homo sapien
ataaattgtgatgtagcctcgctag

SEQ ID NO: 80913 - DNA, 25 bp, Homo sapien
gtagcctcgctagtcaagctgtgaa

SEQ ID NO: 80914 - DNA, 25 bp, Homo sapien
ttgtttgcacttaatccttaactgt

SEQ ID NO: 80915 - DNA, 25 bp, Homo sapien
ccttaactgtattaacgttcagctt

SEQ ID NO: 80916 - DNA, 25 bp, Homo sapien
agcttactaaactgactgcctcaag

SEQ ID NO: 80917 - DNA, 25 bp, Homo sapien
gcctcaagtccaggcaagttacaat

SEQ ID NO: 80918 - DNA, 25 bp, Homo sapien
agttacaatgccttgttgtgcctca

SEQ ID NO: 80919 - DNA, 25 bp, Homo sapien
aatgccttgttgtgcctcaataaaa

SEQ ID NO: 80920 - DNA, 25 bp, Homo sapien
tcatcttgaataactttgtcctaaa

SEQ ID NO: 80921 - DNA, 25 bp, Homo sapien
tagactttagaatttggacttacct

SEQ ID NO: 80922 - DNA, 25 bp, Homo sapien
gaatttggacttacctaacaagagt

SEQ ID NO: 80923 - DNA, 25 bp, Homo sapien
ttgacttgggttgcaagcactgagc

SEQ ID NO: 80924 - DNA, 25 bp, Homo sapien
agcactgagcactgttacttctatc

SEQ ID NO: 80925 - DNA, 25 bp, Homo sapien
gagcactgttacttctatcacgtct

SEQ ID NO: 80926 - DNA, 25 bp, Homo sapien
tatcacgtctctcttttatttctgg

SEQ ID NO: 80927 - DNA, 25 bp, Homo sapien
cccaagggcagagcaaggaatatct

SEQ ID NO: 80928 - DNA, 25 bp, Homo sapien
aggaatatctggtgtttcttgtgat

SEQ ID NO: 80929 - DNA, 25 bp, Homo sapien
ttaattttaaatatccctccctcat

SEQ ID NO: 80930 - DNA, 25 bp, Homo sapien
tatccctccctcatacaagtgtatg

SEQ ID NO: 80931 - DNA, 25 bp, Homo sapien
atacagcaggagtggccatgtggtc

SEQ ID NO: 80932 - DNA, 25 bp, Homo sapien
ggccatgtggtccacggctttttac

SEQ ID NO: 80933 - DNA, 25 bp, Homo sapien
tcttgggctgaatttagactctctc

SEQ ID NO: 80934 - DNA, 25 bp, Homo sapien
atttagactctctcacagaggtggc

SEQ ID NO: 80935 - DNA, 25 bp, Homo sapien
gatggcagatggtgcagccaacaat

SEQ ID NO: 80936 - DNA, 25 bp, Homo sapien
agccaacaatgctgaccggtgctta

SEQ ID NO: 80937 - DNA, 25 bp, Homo sapien
tgctgaccggtgcttatcctctaag

SEQ ID NO: 80938 - DNA, 25 bp, Homo sapien
ctctaagccctgatccacaataaaa

SEQ ID NO: 80939 - DNA, 25 bp, Homo sapien
aaataagtcattctccctagcagag

SEQ ID NO: 80940 - DNA, 25 bp, Homo sapien
agccacttgggtctcctgcatggaa

SEQ ID NO: 80941 - DNA, 25 bp, Homo sapien
acacttgggcaggtgttcagtgact

SEQ ID NO: 80942 - DNA, 25 bp, Homo sapien
tatgccaaagcataggaagctggga

SEQ ID NO: 80943 - DNA, 25 bp, Homo sapien
ctgatatagtcagcaaatttggata

SEQ ID NO: 80944 - DNA, 25 bp, Homo sapien
atttggatagtctctagggctcatc

SEQ ID NO: 80945 - DNA, 25 bp, Homo sapien
agtctctagggctcatcatttttca

SEQ ID NO: 80946 - DNA, 25 bp, Homo sapien
gggctcatcatttttcatactacct

SEQ ID NO: 80947 - DNA, 25 bp, Homo sapien
ttttcatactacctctctcttctgg

SEQ ID NO: 80948 - DNA, 25 bp, Homo sapien
ggcctgtgtctaaggaattgtacaa

SEQ ID NO: 80949 - DNA, 25 bp, Homo sapien
aattgtacaacataggccagggcca

SEQ ID NO: 80950 - DNA, 25 bp, Homo sapien
ggtggacacattttcatgttcatta

SEQ ID NO: 80951 - DNA, 25 bp, Homo sapien
cagtacatactatttggtttcagga

SEQ ID NO: 80952 - DNA, 25 bp, Homo sapien
tctttccatttctctatcaagcatt

SEQ ID NO: 80953 - DNA, 25 bp, Homo sapien
agctgtacacccagcagaggactcc

SEQ ID NO: 80954 - DNA, 25 bp, Homo sapien
tgtacacccagcagaggactccagc

SEQ ID NO: 80955 - DNA, 25 bp, Homo sapien
agcagaggactccagccttctcggg

SEQ ID NO: 80956 - DNA, 25 bp, Homo sapien
cagaagctgttgaccataccaggag

SEQ ID NO: 80957 - DNA, 25 bp, Homo sapien
agaagctgttgaccataccaggagt

SEQ ID NO: 80958 - DNA, 25 bp, Homo sapien
gaagctgttgaccataccaggagtc

SEQ ID NO: 80959 - DNA, 25 bp, Homo sapien
aagctgttgaccataccaggagtca

SEQ ID NO: 80960 - DNA, 25 bp, Homo sapien
agctgttgaccataccaggagtcac

SEQ ID NO: 80961 - DNA, 25 bp, Homo sapien
gctgttgaccataccaggagtcact

SEQ ID NO: 80962 - DNA, 25 bp, Homo sapien
ctgttgaccataccaggagtcactg

SEQ ID NO: 80963 - DNA, 25 bp, Homo sapien
tgttgaccataccaggagtcactgg

SEQ ID NO: 80964 - DNA, 25 bp, Homo sapien
aagttcgacacaaactcacacaacg

SEQ ID NO: 80965 - DNA, 25 bp, Homo sapien
gttcgacacaaactcacacaacgat

SEQ ID NO: 80966 - DNA, 25 bp, Homo sapien
ttcgacacaaactcacacaacgatg

SEQ ID NO: 80967 - DNA, 25 bp, Homo sapien
tcgacacaaactcacacaacgatga

SEQ ID NO: 80968 - DNA, 25 bp, Homo sapien
tagctgcccgggtggcatccctgtg

SEQ ID NO: 80969 - DNA, 25 bp, Homo sapien
agctgcccgggtggcatccctgtga

SEQ ID NO: 80970 - DNA, 25 bp, Homo sapien
ctgcccgggtggcatccctgtgacc

SEQ ID NO: 80971 - DNA, 25 bp, Homo sapien
tgcccgggtggcatccctgtgaccc

SEQ ID NO: 80972 - DNA, 25 bp, Homo sapien
cccgggtggcatccctgtgacccct

SEQ ID NO: 80973 - DNA, 25 bp, Homo sapien
gcctctcctggccttggaagttgcc

SEQ ID NO: 80974 - DNA, 25 bp, Homo sapien
ctctcctggccttggaagttgccac

SEQ ID NO: 80975 - DNA, 25 bp, Homo sapien
tttccatccttccttcaacaaaggg

SEQ ID NO: 80976 - DNA, 25 bp, Homo sapien
gggctggtccacaggccgaattgcc

SEQ ID NO: 80977 - DNA, 25 bp, Homo sapien
gaattgcccacatcccgctgtactt

SEQ ID NO: 80978 - DNA, 25 bp, Homo sapien
acatcccgctgtactttgtcaatgc

SEQ ID NO: 80979 - DNA, 25 bp, Homo sapien
tcccgctgtactttgtcaatgccca

SEQ ID NO: 80980 - DNA, 25 bp, Homo sapien
gtcaatgcccagtttccacgtttta

SEQ ID NO: 80981 - DNA, 25 bp, Homo sapien
caatgcccagtttccacgttttagc

SEQ ID NO: 80982 - DNA, 25 bp, Homo sapien
agtttccacgttttagcccagtgct

SEQ ID NO: 80983 - DNA, 25 bp, Homo sapien
ttccacgttttagcccagtgcttgg

SEQ ID NO: 80984 - DNA, 25 bp, Homo sapien
agcccagtgcttgggcgggcccagg

SEQ ID NO: 80985 - DNA, 25 bp, Homo sapien
ggtggaggctctattcatgacctgc

SEQ ID NO: 80986 - DNA, 25 bp, Homo sapien
ttcctgtccaacatgctgttcttca

SEQ ID NO: 80987 - DNA, 25 bp, Homo sapien
ctgtccaacatgctgttcttcacag

SEQ ID NO: 80988 - DNA, 25 bp, Homo sapien
tcttcacagatttcatgggccagat

SEQ ID NO: 80989 - DNA, 25 bp, Homo sapien
tcatgggccagattgtgtaccgcgg

SEQ ID NO: 80990 - DNA, 25 bp, Homo sapien
gggatccctatagtgcacacaactc

SEQ ID NO: 80991 - DNA, 25 bp, Homo sapien
acacaactccacagagtttctcatc

SEQ ID NO: 80992 - DNA, 25 bp, Homo sapien
actccacagagtttctcatctacga

SEQ ID NO: 80993 - DNA, 25 bp, Homo sapien
gagtttctcatctacgaaagaggag

SEQ ID NO: 80994 - DNA, 25 bp, Homo sapien
catctacgaaagaggagtcgaggtt

SEQ ID NO: 80995 - DNA, 25 bp, Homo sapien
gcttctgcatcaactccgtgttttc

SEQ ID NO: 80996 - DNA, 25 bp, Homo sapien
gcatcaactccgtgttttcctcact

SEQ ID NO: 80997 - DNA, 25 bp, Homo sapien
aaaatccattcttcgcagtgtggcc

SEQ ID NO: 80998 - DNA, 25 bp, Homo sapien
cattcttcgcagtgtggccaccaca

SEQ ID NO: 80999 - DNA, 25 bp, Homo sapien
atgatgccccagtgcggccggtgct

SEQ ID NO: 81000 - DNA, 25 bp, Homo sapien
tgacaccgtcttactctacctcaga

SEQ ID NO: 81001 - DNA, 25 bp, Homo sapien
gtcttactctacctcagacatgagg

SEQ ID NO: 81002 - DNA, 25 bp, Homo sapien
tgaggaggccctccattcctggttt

SEQ ID NO: 81003 - DNA, 25 bp, Homo sapien
cattcctggtttctgtagcttgcat

SEQ ID NO: 81004 - DNA, 25 bp, Homo sapien
ttctgtagcttgcattcttgttgtc

SEQ ID NO: 81005 - DNA, 25 bp, Homo sapien
tgatgcatgccctgccagttagtac

SEQ ID NO: 81006 - DNA, 25 bp, Homo sapien
tgccctgccagttagtactgtattt

SEQ ID NO: 81007 - DNA, 25 bp, Homo sapien
ttcattaataaaagacaccggtgga

SEQ ID NO: 81008 - DNA, 25 bp, Homo sapien
gaagatacatgatacactttgtaca

SEQ ID NO: 81009 - DNA, 25 bp, Homo sapien
acactttgtacaactatcctgcagc

SEQ ID NO: 81010 - DNA, 25 bp, Homo sapien
atcctgcagcccattggttgcttat

SEQ ID NO: 81011 - DNA, 25 bp, Homo sapien
gttgcttatatttatcgcttggctc

SEQ ID NO: 81012 - DNA, 25 bp, Homo sapien
tgccctttggagaaatactgagcaa

SEQ ID NO: 81013 - DNA, 25 bp, Homo sapien
agcaagtctttcattctctgtgtga

SEQ ID NO: 81014 - DNA, 25 bp, Homo sapien
tttcattctctgtgtgacagccctc

SEQ ID NO: 81015 - DNA, 25 bp, Homo sapien
gacagccctctgaatatttgaagtt

SEQ ID NO: 81016 - DNA, 25 bp, Homo sapien
aaggttataacagcccttagttcat

SEQ ID NO: 81017 - DNA, 25 bp, Homo sapien
agcccttagttcatttactctgcat

SEQ ID NO: 81018 - DNA, 25 bp, Homo sapien
gttcatttactctgcatttgttcaa

SEQ ID NO: 81019 - DNA, 25 bp, Homo sapien
aagccggtggagagcagcaccttta

SEQ ID NO: 81020 - DNA, 25 bp, Homo sapien
acccacagggagaagcacaatcagg

SEQ ID NO: 81021 - DNA, 25 bp, Homo sapien
atcaggaacagtgagtgctcctcgc

SEQ ID NO: 81022 - DNA, 25 bp, Homo sapien
gtgctcctcgcccttctgatgtggg

SEQ ID NO: 81023 - DNA, 25 bp, Homo sapien
aggctggagctccatgcacgtagtc

SEQ ID NO: 81024 - DNA, 25 bp, Homo sapien
catgcacgtagtccagatgcctggg

SEQ ID NO: 81025 - DNA, 25 bp, Homo sapien
gtccagatgcctgggaaggaacatc

SEQ ID NO: 81026 - DNA, 25 bp, Homo sapien
gggaaggaacatctcccttccagca

SEQ ID NO: 81027 - DNA, 25 bp, Homo sapien
ttccagcatctgctggtagcaggct

SEQ ID NO: 81028 - DNA, 25 bp, Homo sapien
tggtagcaggctgggacagtccctt

SEQ ID NO: 81029 - DNA, 25 bp, Homo sapien
tgaaaccctgctctattgcaattcc

SEQ ID NO: 81030 - DNA, 25 bp, Homo sapien
ggtgaaggagcttagcttgtcttct

SEQ ID NO: 81031 - DNA, 25 bp, Homo sapien
gtgaaggagcttagcttgtcttctt

SEQ ID NO: 81032 - DNA, 25 bp, Homo sapien
aaggagcttagcttgtcttcttggc

SEQ ID NO: 81033 - DNA, 25 bp, Homo sapien
aggagcttagcttgtcttcttggca

SEQ ID NO: 81034 - DNA, 25 bp, Homo sapien
ggagcttagcttgtcttcttggcaa

SEQ ID NO: 81035 - DNA, 25 bp, Homo sapien
gagcttagcttgtcttcttggcaat

SEQ ID NO: 81036 - DNA, 25 bp, Homo sapien
agcttagcttgtcttcttggcaatt

SEQ ID NO: 81037 - DNA, 25 bp, Homo sapien
gcttagcttgtcttcttggcaattc

SEQ ID NO: 81038 - DNA, 25 bp, Homo sapien
cttagcttgtcttcttggcaattca

SEQ ID NO: 81039 - DNA, 25 bp, Homo sapien
ctggagcgtcccctatggtctcctg

SEQ ID NO: 81040 - DNA, 25 bp, Homo sapien
cccattaaagctctgccactcaaaa

SEQ ID NO: 81041 - DNA, 25 bp, Homo sapien
aagaatttatgagatgccagcggca

SEQ ID NO: 81042 - DNA, 25 bp, Homo sapien
gatgccagcggcatagcccttcaca

SEQ ID NO: 81043 - DNA, 25 bp, Homo sapien
tcctttctcattagccccttttaat

SEQ ID NO: 81044 - DNA, 25 bp, Homo sapien
ttgtttttccttttgactcctgctc

SEQ ID NO: 81045 - DNA, 25 bp, Homo sapien
gctcccattaggagcaggaatggca

SEQ ID NO: 81046 - DNA, 25 bp, Homo sapien
atttcttttcctcagaggaagcctg

SEQ ID NO: 81047 - DNA, 25 bp, Homo sapien
ggaagcctgagtgctcacttaaaca

SEQ ID NO: 81048 - DNA, 25 bp, Homo sapien
cctcagactccctgtgtgaggcctg

SEQ ID NO: 81049 - DNA, 25 bp, Homo sapien
gaggcctgcagaggccctgaatgca

SEQ ID NO: 81050 - DNA, 25 bp, Homo sapien
cctgaatgcacaaatgggaaaccaa

SEQ ID NO: 81051 - DNA, 25 bp, Homo sapien
caaggcacagagaggctctcctctc

SEQ ID NO: 81052 - DNA, 25 bp, Homo sapien
ttacagcaaaaagatacagattagg

SEQ ID NO: 81053 - DNA, 25 bp, Homo sapien
tacagcaaaaagatacagattagga

SEQ ID NO: 81054 - DNA, 25 bp, Homo sapien
acagcaaaaagatacagattaggat

SEQ ID NO: 81055 - DNA, 25 bp, Homo sapien
cagcaaaaagatacagattaggatg

SEQ ID NO: 81056 - DNA, 25 bp, Homo sapien
aaaagatacagattaggatgggtgc

SEQ ID NO: 81057 - DNA, 25 bp, Homo sapien
aaagatacagattaggatgggtgcg

SEQ ID NO: 81058 - DNA, 25 bp, Homo sapien
agatacagattaggatgggtgcggt

SEQ ID NO: 81059 - DNA, 25 bp, Homo sapien
gatacagattaggatgggtgcggtg

SEQ ID NO: 81060 - DNA, 25 bp, Homo sapien
atacagattaggatgggtgcggtgg

SEQ ID NO: 81061 - DNA, 25 bp, Homo sapien
gcacagattgcaatgagcctagatt

SEQ ID NO: 81062 - DNA, 25 bp, Homo sapien
cacagattgcaatgagcctagattg

SEQ ID NO: 81063 - DNA, 25 bp, Homo sapien
tgtggcttcttctcaacctgtatct

SEQ ID NO: 81064 - DNA, 25 bp, Homo sapien
tcttctgagatgtatagggatccat

SEQ ID NO: 81065 - DNA, 25 bp, Homo sapien
aattctgaacttggtctgcagacca

SEQ ID NO: 81066 - DNA, 25 bp, Homo sapien
tggtctgcagaccatccagaggaat

SEQ ID NO: 81067 - DNA, 25 bp, Homo sapien
aaagctgatagccagacacgttctg

SEQ ID NO: 81068 - DNA, 25 bp, Homo sapien
acacgttctgatttctgcccttgtt

SEQ ID NO: 81069 - DNA, 25 bp, Homo sapien
cttgttccagctttgacgtattatc

SEQ ID NO: 81070 - DNA, 25 bp, Homo sapien
gacgtattatctgttgccttatttc

SEQ ID NO: 81071 - DNA, 25 bp, Homo sapien
ttctcattgcctcttctacttgtaa

SEQ ID NO: 81072 - DNA, 25 bp, Homo sapien
tttcactttctgtctaggttaaagc

SEQ ID NO: 81073 - DNA, 25 bp, Homo sapien
aagctaaactgaatctatggcttta

SEQ ID NO: 81074 - DNA, 25 bp, Homo sapien
gaattgtgacaaataacagcagtgg

SEQ ID NO: 81075 - DNA, 25 bp, Homo sapien
aattgtgacaaataacagcagtgga

SEQ ID NO: 81076 - DNA, 25 bp, Homo sapien
cagtggaaaaagtatgtgcttagaa

SEQ ID NO: 81077 - DNA, 25 bp, Homo sapien
aaagtatgtgcttagaattgtgaaa

SEQ ID NO: 81078 - DNA, 25 bp, Homo sapien
gtatgtgcttagaattgtgaaagaa

SEQ ID NO: 81079 - DNA, 25 bp, Homo sapien
gagataaagacctcaagaagttaaa

SEQ ID NO: 81080 - DNA, 25 bp, Homo sapien
gataaagacctcaagaagttaaaag

SEQ ID NO: 81081 - DNA, 25 bp, Homo sapien
taaagacctcaagaagttaaaagat

SEQ ID NO: 81082 - DNA, 25 bp, Homo sapien
cctcactctattctgtaaatttgaa

SEQ ID NO: 81083 - DNA, 25 bp, Homo sapien
aaaaaagcatggatacctggatatc

SEQ ID NO: 81084 - DNA, 25 bp, Homo sapien
catggatacctggatatccttggct

SEQ ID NO: 81085 - DNA, 25 bp, Homo sapien
ggtggggccgtagctctctacctct

SEQ ID NO: 81086 - DNA, 25 bp, Homo sapien
tccaccccaggcttagaggacagaa

SEQ ID NO: 81087 - DNA, 25 bp, Homo sapien
ccaccccaggcttagaggacagaaa

SEQ ID NO: 81088 - DNA, 25 bp, Homo sapien
caccccaggcttagaggacagaaaa

SEQ ID NO: 81089 - DNA, 25 bp, Homo sapien
ccccaggcttagaggacagaaaaat

SEQ ID NO: 81090 - DNA, 25 bp, Homo sapien
ccaggcttagaggacagaaaaatgt

SEQ ID NO: 81091 - DNA, 25 bp, Homo sapien
aaatgtgaagagacgccccacccac

SEQ ID NO: 81092 - DNA, 25 bp, Homo sapien
cagtctcctttcctaggcttttttg

SEQ ID NO: 81093 - DNA, 25 bp, Homo sapien
gcagtcaccccagagggcagggcta

SEQ ID NO: 81094 - DNA, 25 bp, Homo sapien
agagggcagggctaggcgagagcct

SEQ ID NO: 81095 - DNA, 25 bp, Homo sapien
aagggagggaggtctgttctatctg

SEQ ID NO: 81096 - DNA, 25 bp, Homo sapien
atgaacctcatcctcatgcaggcgg

SEQ ID NO: 81097 - DNA, 25 bp, Homo sapien
caaggagcagcggtccgactactac

SEQ ID NO: 81098 - DNA, 25 bp, Homo sapien
cgactactaccacgtgttggaagct

SEQ ID NO: 81099 - DNA, 25 bp, Homo sapien
agggcgacgtgaggcctttcattcg

SEQ ID NO: 81100 - DNA, 25 bp, Homo sapien
ttcattcgcttcatcgccaagtgta

SEQ ID NO: 81101 - DNA, 25 bp, Homo sapien
ccaagtgtactgagaccaccctgga

SEQ ID NO: 81102 - DNA, 25 bp, Homo sapien
gctttttgccacaactgagtactcg

SEQ ID NO: 81103 - DNA, 25 bp, Homo sapien
tgagtactcggtggcactgccagaa

SEQ ID NO: 81104 - DNA, 25 bp, Homo sapien
acccaaccactctgggttcaaggag

SEQ ID NO: 81105 - DNA, 25 bp, Homo sapien
aaggagacgcttcctgtgaagccct

SEQ ID NO: 81106 - DNA, 25 bp, Homo sapien
gtgaagccctaaccctagaaatcct

SEQ ID NO: 81107 - DNA, 25 bp, Homo sapien
ttacttaaagttcagattccagcat

SEQ ID NO: 81108 - DNA, 25 bp, Homo sapien
tattgagatgaatattccctggtta

SEQ ID NO: 81109 - DNA, 25 bp, Homo sapien
attccctggttatactttgtcaata

SEQ ID NO: 81110 - DNA, 25 bp, Homo sapien
agttttctcattgctacagtgtatt

SEQ ID NO: 81111 - DNA, 25 bp, Homo sapien
aaagacattggattacctttggatc

SEQ ID NO: 81112 - DNA, 25 bp, Homo sapien
gattacctttggatccatttgtcaa

SEQ ID NO: 81113 - DNA, 25 bp, Homo sapien
catttgtcaactggaagtgctgctt

SEQ ID NO: 81114 - DNA, 25 bp, Homo sapien
tggaagtgctgcttcattccactta

SEQ ID NO: 81115 - DNA, 25 bp, Homo sapien
gcttcattccacttacaattcctaa

SEQ ID NO: 81116 - DNA, 25 bp, Homo sapien
ttacaattcctaatcttgagcaaat

SEQ ID NO: 81117 - DNA, 25 bp, Homo sapien
gttacagctgtcataagatcataat

SEQ ID NO: 81118 - DNA, 25 bp, Homo sapien
aggctgagtactgcatcgcgcggat

SEQ ID NO: 81119 - DNA, 25 bp, Homo sapien
ctgagtactgcatcgcgcggatggc

SEQ ID NO: 81120 - DNA, 25 bp, Homo sapien
gactccgtgccaggtgctctggact

SEQ ID NO: 81121 - DNA, 25 bp, Homo sapien
tgccaggtgctctggactacatgtc

SEQ ID NO: 81122 - DNA, 25 bp, Homo sapien
aggtgctctggactacatgtccttc

SEQ ID NO: 81123 - DNA, 25 bp, Homo sapien
gtgctctggactacatgtccttctc

SEQ ID NO: 81124 - DNA, 25 bp, Homo sapien
ggactacatgtccttctccacggcg

SEQ ID NO: 81125 - DNA, 25 bp, Homo sapien
ttctccacggcgctgtacggcgaga

SEQ ID NO: 81126 - DNA, 25 bp, Homo sapien
cgctgtacggcgagagtgacctcta

SEQ ID NO: 81127 - DNA, 25 bp, Homo sapien
tacggcgagagtgacctctaatcca

SEQ ID NO: 81128 - DNA, 25 bp, Homo sapien
ggcgagagtgacctctaatccaccc

SEQ ID NO: 81129 - DNA, 25 bp, Homo sapien
cctctcctggtcgtggaaggtgcta

SEQ ID NO: 81130 - DNA, 25 bp, Homo sapien
ctctcctggtcgtggaaggtgctac

SEQ ID NO: 81131 - DNA, 25 bp, Homo sapien
tctcctggtcgtggaaggtgctact

SEQ ID NO: 81132 - DNA, 25 bp, Homo sapien
ctcctggtcgtggaaggtgctactc

SEQ ID NO: 81133 - DNA, 25 bp, Homo sapien
tcctggtcgtggaaggtgctactcc

SEQ ID NO: 81134 - DNA, 25 bp, Homo sapien
cctggtcgtggaaggtgctactcca

SEQ ID NO: 81135 - DNA, 25 bp, Homo sapien
tggtcgtggaaggtgctactccagt

SEQ ID NO: 81136 - DNA, 25 bp, Homo sapien
gtcgtggaaggtgctactccagtgc

SEQ ID NO: 81137 - DNA, 25 bp, Homo sapien
tcgtggaaggtgctactccagtgcc

SEQ ID NO: 81138 - DNA, 25 bp, Homo sapien
cttcaatcagtcctacagcaagttt

SEQ ID NO: 81139 - DNA, 25 bp, Homo sapien
ttcaatcagtcctacagcaagtttg

SEQ ID NO: 81140 - DNA, 25 bp, Homo sapien
gaaggcacaatatgggcactttaaa

SEQ ID NO: 81141 - DNA, 25 bp, Homo sapien
taattcttcacctaagtctctgtga

SEQ ID NO: 81142 - DNA, 25 bp, Homo sapien
ttgaaatgttcgttttctcctgcct

SEQ ID NO: 81143 - DNA, 25 bp, Homo sapien
gtgactcgagtcacactcaagggaa

SEQ ID NO: 81144 - DNA, 25 bp, Homo sapien
gagcgtgaatctgtatcttgccggt

SEQ ID NO: 81145 - DNA, 25 bp, Homo sapien
gtatcttgccggtcatttttatgtt

SEQ ID NO: 81146 - DNA, 25 bp, Homo sapien
aaatgggctgctgcttagcttgcac

SEQ ID NO: 81147 - DNA, 25 bp, Homo sapien
ttagcttgcaccttgtcacatagag

SEQ ID NO: 81148 - DNA, 25 bp, Homo sapien
tcacatagagtgatctttcccaaga

SEQ ID NO: 81149 - DNA, 25 bp, Homo sapien
ggaagcactcgtgtgcaacagacaa

SEQ ID NO: 81150 - DNA, 25 bp, Homo sapien
caagtgactgtatctgtgtagacta

SEQ ID NO: 81151 - DNA, 25 bp, Homo sapien
tgtgtcttattccatctatgagctt

SEQ ID NO: 81152 - DNA, 25 bp, Homo sapien
gtcttattccatctatgagctttgt

SEQ ID NO: 81153 - DNA, 25 bp, Homo sapien
tattccatctatgagctttgtcagt

SEQ ID NO: 81154 - DNA, 25 bp, Homo sapien
atctatgagctttgtcagtgcgcgt

SEQ ID NO: 81155 - DNA, 25 bp, Homo sapien
atgagctttgtcagtgcgcgtagat

SEQ ID NO: 81156 - DNA, 25 bp, Homo sapien
agctttgtcagtgcgcgtagatgtc

SEQ ID NO: 81157 - DNA, 25 bp, Homo sapien
tgtcagtgcgcgtagatgtcaataa

SEQ ID NO: 81158 - DNA, 25 bp, Homo sapien
gtgcgcgtagatgtcaataaatgtt

SEQ ID NO: 81159 - DNA, 25 bp, Homo sapien
tcacccttttttattgcagttggtt

SEQ ID NO: 81160 - DNA, 25 bp, Homo sapien
ggtttttgaatgtctttcactcctt

SEQ ID NO: 81161 - DNA, 25 bp, Homo sapien
tttgaatgtctttcactccttttat

SEQ ID NO: 81162 - DNA, 25 bp, Homo sapien
tcaaacttcctctccataggctgag

SEQ ID NO: 81163 - DNA, 25 bp, Homo sapien
ttcctctccataggctgagcagaga

SEQ ID NO: 81164 - DNA, 25 bp, Homo sapien
agcagagatgtggtcagagtgaact

SEQ ID NO: 81165 - DNA, 25 bp, Homo sapien
tgaactcacattggaacagtacact

SEQ ID NO: 81166 - DNA, 25 bp, Homo sapien
attggaacagtacactcacggcacc

SEQ ID NO: 81167 - DNA, 25 bp, Homo sapien
acactcacggcaccctggagaggag

SEQ ID NO: 81168 - DNA, 25 bp, Homo sapien
gttgctgagtgaattaaccgaatgt

SEQ ID NO: 81169 - DNA, 25 bp, Homo sapien
tgaattaaccgaatgtttgctgctt

SEQ ID NO: 81170 - DNA, 25 bp, Homo sapien
agttcattattcctccagcatgcct

SEQ ID NO: 81171 - DNA, 25 bp, Homo sapien
tccagcatgcctaggcagtggagag

SEQ ID NO: 81172 - DNA, 25 bp, Homo sapien
ggagagaatgtattttgcccaataa

SEQ ID NO: 81173 - DNA, 25 bp, Homo sapien
ccacactatgctccagcgtgccagg

SEQ ID NO: 81174 - DNA, 25 bp, Homo sapien
gagtgtcaggttagcatgctgccag

SEQ ID NO: 81175 - DNA, 25 bp, Homo sapien
gtcaggttagcatgctgccagcagg

SEQ ID NO: 81176 - DNA, 25 bp, Homo sapien
aggttagcatgctgccagcagggct

SEQ ID NO: 81177 - DNA, 25 bp, Homo sapien
ctcagactggagtggtccgttctca

SEQ ID NO: 81178 - DNA, 25 bp, Homo sapien
agactggagtggtccgttctcacca

SEQ ID NO: 81179 - DNA, 25 bp, Homo sapien
ggagtggtccgttctcaccaccctt

SEQ ID NO: 81180 - DNA, 25 bp, Homo sapien
ccttcagcttgggtacacacacaga

SEQ ID NO: 81181 - DNA, 25 bp, Homo sapien
tcagcttgggtacacacacagagga

SEQ ID NO: 81182 - DNA, 25 bp, Homo sapien
ggagacctcagcctcacaccagaaa

SEQ ID NO: 81183 - DNA, 25 bp, Homo sapien
tcagcctcacaccagaaatattatt

SEQ ID NO: 81184 - DNA, 25 bp, Homo sapien
aatcagaatttcaatccacattaga

SEQ ID NO: 81185 - DNA, 25 bp, Homo sapien
atgggcaactttatgcgaaatccaa

SEQ ID NO: 81186 - DNA, 25 bp, Homo sapien
atccaaatcaacacaatgcactctg

SEQ ID NO: 81187 - DNA, 25 bp, Homo sapien
atgcactctgcagttagacaccatt

SEQ ID NO: 81188 - DNA, 25 bp, Homo sapien
gaagcagattgatccgtttgatttt

SEQ ID NO: 81189 - DNA, 25 bp, Homo sapien
tttgatttttatttccaggaggaag

SEQ ID NO: 81190 - DNA, 25 bp, Homo sapien
gaagactagtggtggattccatgac

SEQ ID NO: 81191 - DNA, 25 bp, Homo sapien
ggtggattccatgacatatattgta

SEQ ID NO: 81192 - DNA, 25 bp, Homo sapien
caagcaatggcttttgtggccatca

SEQ ID NO: 81193 - DNA, 25 bp, Homo sapien
gcttttgtggccatcatttggccat

SEQ ID NO: 81194 - DNA, 25 bp, Homo sapien
catttggccatcatttgttataata

SEQ ID NO: 81195 - DNA, 25 bp, Homo sapien
gcttccatttctttaacgtctgttc

SEQ ID NO: 81196 - DNA, 25 bp, Homo sapien
gtctgttcccttaacatcgctgaaa

SEQ ID NO: 81197 - DNA, 25 bp, Homo sapien
ctgttgaagagatgccttgcggtgt

SEQ ID NO: 81198 - DNA, 25 bp, Homo sapien
aagcagctggcagtgttaggacatt

SEQ ID NO: 81199 - DNA, 25 bp, Homo sapien
ggacattagtccaccttcagcgcag

SEQ ID NO: 81200 - DNA, 25 bp, Homo sapien
tctctggccgggtctgactcagaaa

SEQ ID NO: 81201 - DNA, 25 bp, Homo sapien
gtctgactcagaaaccttggtactc

SEQ ID NO: 81202 - DNA, 25 bp, Homo sapien
tggctcctgcattaacccagaaata

SEQ ID NO: 81203 - DNA, 25 bp, Homo sapien
gaaatacctcgcttctatctgtgca

SEQ ID NO: 81204 - DNA, 25 bp, Homo sapien
atctgtgcacttagctgggaactta

SEQ ID NO: 81205 - DNA, 25 bp, Homo sapien
gaacttacccactgtaatcacctaa

SEQ ID NO: 81206 - DNA, 25 bp, Homo sapien
ggccagacgaagaacattgtgtcct

SEQ ID NO: 81207 - DNA, 25 bp, Homo sapien
cattgtgtcctaatggtaggcagga

SEQ ID NO: 81208 - DNA, 25 bp, Homo sapien
agcagaaggcttgccttcctgggag

SEQ ID NO: 81209 - DNA, 25 bp, Homo sapien
gttttagagcagtgagccctaccat

SEQ ID NO: 81210 - DNA, 25 bp, Homo sapien
cagtgagccctaccattacatcctg

SEQ ID NO: 81211 - DNA, 25 bp, Homo sapien
gggcttctgaaggtctgtgctggga

SEQ ID NO: 81212 - DNA, 25 bp, Homo sapien
agagtggcttagctatttacccgct

SEQ ID NO: 81213 - DNA, 25 bp, Homo sapien
cttagctatttacccgctctttggg

SEQ ID NO: 81214 - DNA, 25 bp, Homo sapien
gggacagggcaaactaaatgcatcc

SEQ ID NO: 81215 - DNA, 25 bp, Homo sapien
taaatgcatcccttcttacctaact

SEQ ID NO: 81216 - DNA, 25 bp, Homo sapien
cctgggctgaggcatatgaatgcta

SEQ ID NO: 81217 - DNA, 25 bp, Homo sapien
gacaaaaagcccatggcggcaatgg

SEQ ID NO: 81218 - DNA, 25 bp, Homo sapien
caaaaagcccatggcggcaatggag

SEQ ID NO: 81219 - DNA, 25 bp, Homo sapien
ggcatcttctcaggcagaggtgcaa

SEQ ID NO: 81220 - DNA, 25 bp, Homo sapien
atcttctcaggcagaggtgcaacct

SEQ ID NO: 81221 - DNA, 25 bp, Homo sapien
agaggtgcaacctgtcggccaaaca

SEQ ID NO: 81222 - DNA, 25 bp, Homo sapien
ctgtcggccaaacactggctagtga

SEQ ID NO: 81223 - DNA, 25 bp, Homo sapien
tcaagaagtccttgcaagagccatt

SEQ ID NO: 81224 - DNA, 25 bp, Homo sapien
caatatactagctttaaaatgcctt

SEQ ID NO: 81225 - DNA, 25 bp, Homo sapien
aaaatgcctttctcctccctgaatg

SEQ ID NO: 81226 - DNA, 25 bp, Homo sapien
atgcctttctcctccctgaatggag

SEQ ID NO: 81227 - DNA, 25 bp, Homo sapien
gaatggagggctgagttactatttt

SEQ ID NO: 81228 - DNA, 25 bp, Homo sapien
gagttgttactttgtttcttcgatg

SEQ ID NO: 81229 - DNA, 25 bp, Homo sapien
gttactttgtttcttcgatgtcata

SEQ ID NO: 81230 - DNA, 25 bp, Homo sapien
tgtttcttcgatgtcatattttatg

SEQ ID NO: 81231 - DNA, 25 bp, Homo sapien
gtaaagggccattcttaagttctct

SEQ ID NO: 81232 - DNA, 25 bp, Homo sapien
ggccattcttaagttctctccttaa

SEQ ID NO: 81233 - DNA, 25 bp, Homo sapien
ccttaaacttaatgctgtcaagtgt

SEQ ID NO: 81234 - DNA, 25 bp, Homo sapien
gctgtcaagtgttagatgtgtgcat

SEQ ID NO: 81235 - DNA, 25 bp, Homo sapien
gcatgtgaacttgttgcactgcaga

SEQ ID NO: 81236 - DNA, 25 bp, Homo sapien
gttgcactgcagaaacatattcaga

SEQ ID NO: 81237 - DNA, 25 bp, Homo sapien
agtttttgtgatgtaagcttaattg

SEQ ID NO: 81238 - DNA, 25 bp, Homo sapien
gcttaattgatattctgttcagaac

SEQ ID NO: 81239 - DNA, 25 bp, Homo sapien
aaatctgacatgtcaatgtggctag

SEQ ID NO: 81240 - DNA, 25 bp, Homo sapien
gttttgcattatgtgtatggcctga

SEQ ID NO: 81241 - DNA, 25 bp, Homo sapien
tatggcctgaagtgttggacttgca

SEQ ID NO: 81242 - DNA, 25 bp, Homo sapien
ggcctgaagtgttggacttgcaaaa

SEQ ID NO: 81243 - DNA, 25 bp, Homo sapien
gggaagaaaggaattgcgaatacat

SEQ ID NO: 81244 - DNA, 25 bp, Homo sapien
tgtcaccagacatttgtattatttt

SEQ ID NO: 81245 - DNA, 25 bp, Homo sapien
aaatactcttattttgaatgcacaa

SEQ ID NO: 81246 - DNA, 25 bp, Homo sapien
tgacttaaaccattcatatcatgtt

SEQ ID NO: 81247 - DNA, 25 bp, Homo sapien
atatcatgtttcctttgcgttcagc

SEQ ID NO: 81248 - DNA, 25 bp, Homo sapien
ttcctttgcgttcagccaatttcaa

SEQ ID NO: 81249 - DNA, 25 bp, Homo sapien
gcgttcagccaatttcaattaaaat

SEQ ID NO: 81250 - DNA, 25 bp, Homo sapien
atctaactttgcactctttgataat

SEQ ID NO: 81251 - DNA, 25 bp, Homo sapien
gataatgtcgtaatccaaattggta

SEQ ID NO: 81252 - DNA, 25 bp, Homo sapien
aattggtattgtagcctctgttaac

SEQ ID NO: 81253 - DNA, 25 bp, Homo sapien
ggtattgtagcctctgttaacacag

SEQ ID NO: 81254 - DNA, 25 bp, Homo sapien
gtagcctctgttaacacagacagta

SEQ ID NO: 81255 - DNA, 25 bp, Homo sapien
tttagacccaaacttgtggaagtat

SEQ ID NO: 81256 - DNA, 25 bp, Homo sapien
gacccaaacttgtggaagtatcatg

SEQ ID NO: 81257 - DNA, 25 bp, Homo sapien
gtatcatgtgttaagttctctgtct

SEQ ID NO: 81258 - DNA, 25 bp, Homo sapien
atgtgttaagttctctgtctctgtt

SEQ ID NO: 81259 - DNA, 25 bp, Homo sapien
ctgtctctgtttctttgttcattta

SEQ ID NO: 81260 - DNA, 25 bp, Homo sapien
ctctgtttctttgttcatttattac

SEQ ID NO: 81261 - DNA, 25 bp, Homo sapien
tgtcaccccggctgactgttttgca

SEQ ID NO: 81262 - DNA, 25 bp, Homo sapien
ggctgactgttttgcacacttcctg

SEQ ID NO: 81263 - DNA, 25 bp, Homo sapien
gttttgcacacttcctgcttttgtt

SEQ ID NO: 81264 - DNA, 25 bp, Homo sapien
tttgttcccacttcctatctaggca

SEQ ID NO: 81265 - DNA, 25 bp, Homo sapien
tatctaggcaggatcatagcagaga

SEQ ID NO: 81266 - DNA, 25 bp, Homo sapien
attccagtgatcttagttctgcctt

SEQ ID NO: 81267 - DNA, 25 bp, Homo sapien
agtgatcttagttctgcctttcttc

SEQ ID NO: 81268 - DNA, 25 bp, Homo sapien
tcttcccacgggtggccaaggaaca

SEQ ID NO: 81269 - DNA, 25 bp, Homo sapien
gtggccaaggaacagcctgctcttt

SEQ ID NO: 81270 - DNA, 25 bp, Homo sapien
cagcctgctctttctgtgtgttgga

SEQ ID NO: 81271 - DNA, 25 bp, Homo sapien
gagtatagtagcatgtccccacaaa

SEQ ID NO: 81272 - DNA, 25 bp, Homo sapien
gggacaagctctaccatcccgagtg

SEQ ID NO: 81273 - DNA, 25 bp, Homo sapien
atcccgagtgcttcatgtgcagtga

SEQ ID NO: 81274 - DNA, 25 bp, Homo sapien
agtgcttcatgtgcagtgactgcgg

SEQ ID NO: 81275 - DNA, 25 bp, Homo sapien
agtgactgcggcctgaacctcaagc

SEQ ID NO: 81276 - DNA, 25 bp, Homo sapien
cggcctgaacctcaagcagcgtggt

SEQ ID NO: 81277 - DNA, 25 bp, Homo sapien
tggttacttctttctggacgagcgg

SEQ ID NO: 81278 - DNA, 25 bp, Homo sapien
acttctttctggacgagcggctcta

SEQ ID NO: 81279 - DNA, 25 bp, Homo sapien
ctttctggacgagcggctctactgt

SEQ ID NO: 81280 - DNA, 25 bp, Homo sapien
tctactgtgagagccacgccaaggc

SEQ ID NO: 81281 - DNA, 25 bp, Homo sapien
agagccacgccaaggcgcgcgtgaa

SEQ ID NO: 81282 - DNA, 25 bp, Homo sapien
tgaagccgcccgagggctacgacgt

SEQ ID NO: 81283 - DNA, 25 bp, Homo sapien
aaaaaggacagtggtgcttgacaga

SEQ ID NO: 81284 - DNA, 25 bp, Homo sapien
gcttgacagagcaggactgaagttt

SEQ ID NO: 81285 - DNA, 25 bp, Homo sapien
aggactgaagttttcattcctctac

SEQ ID NO: 81286 - DNA, 25 bp, Homo sapien
gccttggtcaagtcctaaaagcttt

SEQ ID NO: 81287 - DNA, 25 bp, Homo sapien
taaaagctttccaggtctgtaactg

SEQ ID NO: 81288 - DNA, 25 bp, Homo sapien
ggtctgtaactggttttgtctgtaa

SEQ ID NO: 81289 - DNA, 25 bp, Homo sapien
aaaaggttaccttttctgccacatg

SEQ ID NO: 81290 - DNA, 25 bp, Homo sapien
ccacatgaagtagctggctggtgaa

SEQ ID NO: 81291 - DNA, 25 bp, Homo sapien
ggctggtgaaatgatgtcatactac

SEQ ID NO: 81292 - DNA, 25 bp, Homo sapien
gtcatactacgatgtgtttcattaa

SEQ ID NO: 81293 - DNA, 25 bp, Homo sapien
cattaactgttggagattatcacat

SEQ ID NO: 81294 - DNA, 25 bp, Homo sapien
cctttctttgcatccacaatgtggg

SEQ ID NO: 81295 - DNA, 25 bp, Homo sapien
ggagtgggaagcctcttccttgtgt

SEQ ID NO: 81296 - DNA, 25 bp, Homo sapien
ttgtgtctttcgctccacttttagc

SEQ ID NO: 81297 - DNA, 25 bp, Homo sapien
cacttttagctcatcgcaccaatat

SEQ ID NO: 81298 - DNA, 25 bp, Homo sapien
aagcataagcttcccatttcacaaa

SEQ ID NO: 81299 - DNA, 25 bp, Homo sapien
gcataagcttcccatttcacaaagg

SEQ ID NO: 81300 - DNA, 25 bp, Homo sapien
tcttctcatcgcttggcctatgaca

SEQ ID NO: 81301 - DNA, 25 bp, Homo sapien
tcatcgcttggcctatgacaggtca

SEQ ID NO: 81302 - DNA, 25 bp, Homo sapien
ggcctatgacaggtcaccgtgtgta

SEQ ID NO: 81303 - DNA, 25 bp, Homo sapien
gtcaccgtgtgtaaatctttcccaa

SEQ ID NO: 81304 - DNA, 25 bp, Homo sapien
gtgtaaatctttcccaataaagtgt

SEQ ID NO: 81305 - DNA, 25 bp, Homo sapien
gtgttcctctgcttgaagacagtga

SEQ ID NO: 81306 - DNA, 25 bp, Homo sapien
ttgactcttgatcagccacaagata

SEQ ID NO: 81307 - DNA, 25 bp, Homo sapien
taccaaaggtagacattgcttctgc

SEQ ID NO: 81308 - DNA, 25 bp, Homo sapien
aaggtagacattgcttctgcagaaa

SEQ ID NO: 81309 - DNA, 25 bp, Homo sapien
tgcttctgcagaaagcagcatttaa

SEQ ID NO: 81310 - DNA, 25 bp, Homo sapien
agcatttaaatgctgatgcgtgaca

SEQ ID NO: 81311 - DNA, 25 bp, Homo sapien
tgctgatgcgtgacatagcttcctc

SEQ ID NO: 81312 - DNA, 25 bp, Homo sapien
tgatgcgtgacatagcttcctcatt

SEQ ID NO: 81313 - DNA, 25 bp, Homo sapien
tttttctgaagtgatctgctggaat

SEQ ID NO: 81314 - DNA, 25 bp, Homo sapien
tctgaagtgatctgctggaattcca

SEQ ID NO: 81315 - DNA, 25 bp, Homo sapien
gaattccaaacagaagttccatata

SEQ ID NO: 81316 - DNA, 25 bp, Homo sapien
gaatctccggcctcgagtcaaactc

SEQ ID NO: 81317 - DNA, 25 bp, Homo sapien
tcgcatcccctgccgtgaaacagat

SEQ ID NO: 81318 - DNA, 25 bp, Homo sapien
agatgccccgctagaagccgggagt

SEQ ID NO: 81319 - DNA, 25 bp, Homo sapien
ctctccatagaattggagtgctcat

SEQ ID NO: 81320 - DNA, 25 bp, Homo sapien
gaattggagtgctcattagtggcaa

SEQ ID NO: 81321 - DNA, 25 bp, Homo sapien
gtgctcattagtggcaagaatccta

SEQ ID NO: 81322 - DNA, 25 bp, Homo sapien
tagtggcaagaatcctaaggcgaac

SEQ ID NO: 81323 - DNA, 25 bp, Homo sapien
gaatcctaaggcgaactttgcctgt

SEQ ID NO: 81324 - DNA, 25 bp, Homo sapien
ggcgaactttgcctgtttaagtgga

SEQ ID NO: 81325 - DNA, 25 bp, Homo sapien
actttgcctgtttaagtggaggaga

SEQ ID NO: 81326 - DNA, 25 bp, Homo sapien
ggaggagattagtcactgagataat

SEQ ID NO: 81327 - DNA, 25 bp, Homo sapien
ggtggttactaacatcaacttgtga

SEQ ID NO: 81328 - DNA, 25 bp, Homo sapien
gtgacatctagaactagggctctta

SEQ ID NO: 81329 - DNA, 25 bp, Homo sapien
ggctcttagtgtttagtgggccact

SEQ ID NO: 81330 - DNA, 25 bp, Homo sapien
gtgggccacttctctgatgtcagat

SEQ ID NO: 81331 - DNA, 25 bp, Homo sapien
gtcagatgcatgcagacctgtactc

SEQ ID NO: 81332 - DNA, 25 bp, Homo sapien
agtgtgataactgagcggtcgcatg

SEQ ID NO: 81333 - DNA, 25 bp, Homo sapien
acaagtgccctctagggcagccagg

SEQ ID NO: 81334 - DNA, 25 bp, Homo sapien
gaatactattgttcgatacctggga

SEQ ID NO: 81335 - DNA, 25 bp, Homo sapien
gatacctgggatttgactttgtcaa

SEQ ID NO: 81336 - DNA, 25 bp, Homo sapien
tttgtcaaacagctctttgtgcccc

SEQ ID NO: 81337 - DNA, 25 bp, Homo sapien
tttgtgcccctatctttgttttgtc

SEQ ID NO: 81338 - DNA, 25 bp, Homo sapien
gagactccaacacagaagctcatgt

SEQ ID NO: 81339 - DNA, 25 bp, Homo sapien
gttttgatatctttcatcatcctct

SEQ ID NO: 81340 - DNA, 25 bp, Homo sapien
catcatcctctttatcttgtatttt

SEQ ID NO: 81341 - DNA, 25 bp, Homo sapien
cttgtattttataggcatggccata

SEQ ID NO: 81342 - DNA, 25 bp, Homo sapien
aaatatcatgttttactgtgcgaga

SEQ ID NO: 81343 - DNA, 25 bp, Homo sapien
gtgcgagaaaacaaactgctgctta

SEQ ID NO: 81344 - DNA, 25 bp, Homo sapien
aactgctgcttatgtttggaatgac

SEQ ID NO: 81345 - DNA, 25 bp, Homo sapien
cactcatttatcttaattctaggaa

SEQ ID NO: 81346 - DNA, 25 bp, Homo sapien
acagcaagctaaagcaagcctcttt

SEQ ID NO: 81347 - DNA, 25 bp, Homo sapien
aagcctctttgagggtactgcagca

SEQ ID NO: 81348 - DNA, 25 bp, Homo sapien
agggtactgcagcaattgaagtgct

SEQ ID NO: 81349 - DNA, 25 bp, Homo sapien
atcccctgggactgcgatgcggcgt

SEQ ID NO: 81350 - DNA, 25 bp, Homo sapien
tgggactgcgagtgctgacgccacc

SEQ ID NO: 81351 - DNA, 25 bp, Homo sapien
gccaccttcctgctgaggtgggact

SEQ ID NO: 81352 - DNA, 25 bp, Homo sapien
tctgtcctcattgtttggcctcatg

SEQ ID NO: 81353 - DNA, 25 bp, Homo sapien
cattgtttggcctcatgggaccgag

SEQ ID NO: 81354 - DNA, 25 bp, Homo sapien
agctgttccagcagcttgtctggcg

SEQ ID NO: 81355 - DNA, 25 bp, Homo sapien
agcagcttgtctggcgtcaactggc

SEQ ID NO: 81356 - DNA, 25 bp, Homo sapien
ggcgtcaactggctttcagagtgct

SEQ ID NO: 81357 - DNA, 25 bp, Homo sapien
ggctttcagagtgctgacccctcat

SEQ ID NO: 81358 - DNA, 25 bp, Homo sapien
gggatcattctctctgagggcagat

SEQ ID NO: 81359 - DNA, 25 bp, Homo sapien
gatgaggcgcaggaaaatagtcttg

SEQ ID NO: 81360 - DNA, 25 bp, Homo sapien
gataaagtgatttcaggaatagcaa

SEQ ID NO: 81361 - DNA, 25 bp, Homo sapien
ataaagtgatttcaggaatagcaag

SEQ ID NO: 81362 - DNA, 25 bp, Homo sapien
taaagtgatttcaggaatagcaaga

SEQ ID NO: 81363 - DNA, 25 bp, Homo sapien
aaagtgatttcaggaatagcaagag

SEQ ID NO: 81364 - DNA, 25 bp, Homo sapien
aagtgatttcaggaatagcaagaga

SEQ ID NO: 81365 - DNA, 25 bp, Homo sapien
agtgatttcaggaatagcaagagaa

SEQ ID NO: 81366 - DNA, 25 bp, Homo sapien
gtgatttcaggaatagcaagagaaa

SEQ ID NO: 81367 - DNA, 25 bp, Homo sapien
ggaatagcaagagaaaaactaccaa

SEQ ID NO: 81368 - DNA, 25 bp, Homo sapien
gaatagcaagagaaaaactaccaaa

SEQ ID NO: 81369 - DNA, 25 bp, Homo sapien
atagcaagagaaaaactaccaaagg

SEQ ID NO: 81370 - DNA, 25 bp, Homo sapien
tagcaagagaaaaactaccaaaggt

SEQ ID NO: 81371 - DNA, 25 bp, Homo sapien
tcatacgtagaccagtttcctcttg

SEQ ID NO: 81372 - DNA, 25 bp, Homo sapien
tacgtagaccagtttcctcttggtt

SEQ ID NO: 81373 - DNA, 25 bp, Homo sapien
tggtttcttcagttaagtcaaaaca

SEQ ID NO: 81374 - DNA, 25 bp, Homo sapien
taagtcaaaacaacacgttcctctt

SEQ ID NO: 81375 - DNA, 25 bp, Homo sapien
aacacgttcctctttccccatatat

SEQ ID NO: 81376 - DNA, 25 bp, Homo sapien
tcatatatttttgctcgttagtgta

SEQ ID NO: 81377 - DNA, 25 bp, Homo sapien
atatttttgctcgttagtgtatttc

SEQ ID NO: 81378 - DNA, 25 bp, Homo sapien
ttttgctcgttagtgtatttcttga

SEQ ID NO: 81379 - DNA, 25 bp, Homo sapien
tcgttagtgtatttcttgagctgtt

SEQ ID NO: 81380 - DNA, 25 bp, Homo sapien
agtgtatttcttgagctgttttcat

SEQ ID NO: 81381 - DNA, 25 bp, Homo sapien
gtatttcttgagctgttttcatgtt

SEQ ID NO: 81382 - DNA, 25 bp, Homo sapien
gcatcccttctcgtgagcgcttaga

SEQ ID NO: 81383 - DNA, 25 bp, Homo sapien
gtgagcgcttagacctttttctatt

SEQ ID NO: 81384 - DNA, 25 bp, Homo sapien
attttgcttttgtatgaacactcag

SEQ ID NO: 81385 - DNA, 25 bp, Homo sapien
gcttttgtatgaacactcagcagaa

SEQ ID NO: 81386 - DNA, 25 bp, Homo sapien
cactcagcagaaaagtacttacttc

SEQ ID NO: 81387 - DNA, 25 bp, Homo sapien
cttacttcttgccagttatctatta

SEQ ID NO: 81388 - DNA, 25 bp, Homo sapien
ttcttgccagttatctattaaccaa

SEQ ID NO: 81389 - DNA, 25 bp, Homo sapien
taaagattaaccctcaaagttctct

SEQ ID NO: 81390 - DNA, 25 bp, Homo sapien
agttctcttcataactgccttgaca

SEQ ID NO: 81391 - DNA, 25 bp, Homo sapien
aactgccttgacattttgggttgtt

SEQ ID NO: 81392 - DNA, 25 bp, Homo sapien
gacattttgggttgttctgttctgt

SEQ ID NO: 81393 - DNA, 25 bp, Homo sapien
gacatgctggctggctgcaccctta

SEQ ID NO: 81394 - DNA, 25 bp, Homo sapien
acatgctggctggctgcacccttat

SEQ ID NO: 81395 - DNA, 25 bp, Homo sapien
catgctggctggctgcacccttatc

SEQ ID NO: 81396 - DNA, 25 bp, Homo sapien
atgctggctggctgcacccttatcc

SEQ ID NO: 81397 - DNA, 25 bp, Homo sapien
ctgcacccttatccctgacaaaaag

SEQ ID NO: 81398 - DNA, 25 bp, Homo sapien
gtgaaggggtttaacctggcatctt

SEQ ID NO: 81399 - DNA, 25 bp, Homo sapien
tgaaggggtttaacctggcatcttc

SEQ ID NO: 81400 - DNA, 25 bp, Homo sapien
gaaggggtttaacctggcatcttct

SEQ ID NO: 81401 - DNA, 25 bp, Homo sapien
aggggtttaacctggcatcttctca

SEQ ID NO: 81402 - DNA, 25 bp, Homo sapien
ggggtttaacctggcatcttctcag

SEQ ID NO: 81403 - DNA, 25 bp, Homo sapien
ggtttaacctggcatcttctcaggc

SEQ ID NO: 81404 - DNA, 25 bp, Homo sapien
gggtatcttggagctcctcagagcc

SEQ ID NO: 81405 - DNA, 25 bp, Homo sapien
ttggagctcctcagagcccttcttc

SEQ ID NO: 81406 - DNA, 25 bp, Homo sapien
cttcttcccatcaaaaaggtatcaa

SEQ ID NO: 81407 - DNA, 25 bp, Homo sapien
tatcaaatgccttggaagctccctg

SEQ ID NO: 81408 - DNA, 25 bp, Homo sapien
aagctccctgatcctacaaaacaaa

SEQ ID NO: 81409 - DNA, 25 bp, Homo sapien
aaatgcttatttttaccactgtgag

SEQ ID NO: 81410 - DNA, 25 bp, Homo sapien
atttttaccactgtgaggcaagctg

SEQ ID NO: 81411 - DNA, 25 bp, Homo sapien
gaggcaagctgaggtgaacatttaa

SEQ ID NO: 81412 - DNA, 25 bp, Homo sapien
aaaggctatttcaagacgaggtgcg

SEQ ID NO: 81413 - DNA, 25 bp, Homo sapien
gacgaggtgcggtggctataatcct

SEQ ID NO: 81414 - DNA, 25 bp, Homo sapien
aggtgcggtggctataatcctagca

SEQ ID NO: 81415 - DNA, 25 bp, Homo sapien
agaagcccatgtgagagccctgaaa

SEQ ID NO: 81416 - DNA, 25 bp, Homo sapien
gagccctgaaagctgtcatttcctt

SEQ ID NO: 81417 - DNA, 25 bp, Homo sapien
tattgcctactatttgtcctttctc

SEQ ID NO: 81418 - DNA, 25 bp, Homo sapien
atttgtcctttctcattgccacctc

SEQ ID NO: 81419 - DNA, 25 bp, Homo sapien
attgccacctccagctactttatgc

SEQ ID NO: 81420 - DNA, 25 bp, Homo sapien
ctttatgccagagacggaattagct

SEQ ID NO: 81421 - DNA, 25 bp, Homo sapien
gatttttggtgagtccatagctcta

SEQ ID NO: 81422 - DNA, 25 bp, Homo sapien
gtgagtccatagctctaatctaccc

SEQ ID NO: 81423 - DNA, 25 bp, Homo sapien
taatctacccctcaagtcattcatt

SEQ ID NO: 81424 - DNA, 25 bp, Homo sapien
acccctcaagtcattcatttatcct

SEQ ID NO: 81425 - DNA, 25 bp, Homo sapien
aagacatgcatctctaaaggtgatt

SEQ ID NO: 81426 - DNA, 25 bp, Homo sapien
agtgtagacacctctgtctgcccca

SEQ ID NO: 81427 - DNA, 25 bp, Homo sapien
acaggcatgggtgtgtctggcctca

SEQ ID NO: 81428 - DNA, 25 bp, Homo sapien
catgggtgtgtctggcctcattctg

SEQ ID NO: 81429 - DNA, 25 bp, Homo sapien
tggcctcattctgtatcagtccagt

SEQ ID NO: 81430 - DNA, 25 bp, Homo sapien
atcagtccagtgtgttcctgtcata

SEQ ID NO: 81431 - DNA, 25 bp, Homo sapien
gtgttcctgtcatagtttgtgtctc

SEQ ID NO: 81432 - DNA, 25 bp, Homo sapien
gtcatagtttgtgtctcccaggcag

SEQ ID NO: 81433 - DNA, 25 bp, Homo sapien
gggtgaggagagctcccctgttttc

SEQ ID NO: 81434 - DNA, 25 bp, Homo sapien
tctgtttaattgatgagcctgggaa

SEQ ID NO: 81435 - DNA, 25 bp, Homo sapien
cctgggaaaggagtgtgttctgcct

SEQ ID NO: 81436 - DNA, 25 bp, Homo sapien
tgtgttctgcctgcccgttacagtg

SEQ ID NO: 81437 - DNA, 25 bp, Homo sapien
aaatggtaactttacaactggcagt

SEQ ID NO: 81438 - DNA, 25 bp, Homo sapien
acaactggcagtggcctccttttgg

SEQ ID NO: 81439 - DNA, 25 bp, Homo sapien
ctccttttggttcctcacatattat

SEQ ID NO: 81440 - DNA, 25 bp, Homo sapien
gagaggaaatgttgactggccaaaa

SEQ ID NO: 81441 - DNA, 25 bp, Homo sapien
agtcagatttgtataaggaaagcca

SEQ ID NO: 81442 - DNA, 25 bp, Homo sapien
aaggattgcttaaggtactctggac

SEQ ID NO: 81443 - DNA, 25 bp, Homo sapien
tgcttaaggtactctggactttctc

SEQ ID NO: 81444 - DNA, 25 bp, Homo sapien
ctggactttctcttggacattgtaa

SEQ ID NO: 81445 - DNA, 25 bp, Homo sapien
gacattgtaaacgtattttgatcag

SEQ ID NO: 81446 - DNA, 25 bp, Homo sapien
aagggtatcctgtgctatgctggac

SEQ ID NO: 81447 - DNA, 25 bp, Homo sapien
atcctgtgctatgctggacattaac

SEQ ID NO: 81448 - DNA, 25 bp, Homo sapien
ccacatcccgggacgcagcaggagg

SEQ ID NO: 81449 - DNA, 25 bp, Homo sapien
agccctgtggatgagccctcagaac

SEQ ID NO: 81450 - DNA, 25 bp, Homo sapien
gtggatgagccctcagaacccttgg

SEQ ID NO: 81451 - DNA, 25 bp, Homo sapien
ccttggcttgcccacgtggaaaagg

SEQ ID NO: 81452 - DNA, 25 bp, Homo sapien
tatagatggtcacgcacctgggtgt

SEQ ID NO: 81453 - DNA, 25 bp, Homo sapien
cgcacctgggtgttacaaagttgta

SEQ ID NO: 81454 - DNA, 25 bp, Homo sapien
tgcccacacaggttcacgtgcagct

SEQ ID NO: 81455 - DNA, 25 bp, Homo sapien
acgtgcagctcaaggaaaggcctga

SEQ ID NO: 81456 - DNA, 25 bp, Homo sapien
aaaggcctgaaaggagcccttatct

SEQ ID NO: 81457 - DNA, 25 bp, Homo sapien
aaggagcccttatctgtgctcagga

SEQ ID NO: 81458 - DNA, 25 bp, Homo sapien
ctgtgctcaggactcagaagcctct

SEQ ID NO: 81459 - DNA, 25 bp, Homo sapien
gtatgactttaattccactccatgg

SEQ ID NO: 81460 - DNA, 25 bp, Homo sapien
cactccatggctcaatcattcacat

SEQ ID NO: 81461 - DNA, 25 bp, Homo sapien
catgaggtgagcttcagcctgagat

SEQ ID NO: 81462 - DNA, 25 bp, Homo sapien
aggcgacagacttcttgcgtttcaa

SEQ ID NO: 81463 - DNA, 25 bp, Homo sapien
ttgcgtttcaaaactgccatgcccc

SEQ ID NO: 81464 - DNA, 25 bp, Homo sapien
ccctgtgatgctcccgtgaaggaat

SEQ ID NO: 81465 - DNA, 25 bp, Homo sapien
tcccgtgaaggaatgcactttgcct

SEQ ID NO: 81466 - DNA, 25 bp, Homo sapien
cactttgccttgtaagttcctggga

SEQ ID NO: 81467 - DNA, 25 bp, Homo sapien
caggtgcagccagatctcacaaagt

SEQ ID NO: 81468 - DNA, 25 bp, Homo sapien
cttgtttataatggtcactcactgt

SEQ ID NO: 81469 - DNA, 25 bp, Homo sapien
cactcactgtgtttggttactgtca

SEQ ID NO: 81470 - DNA, 25 bp, Homo sapien
aaggacatggacaaggtcgagacat

SEQ ID NO: 81471 - DNA, 25 bp, Homo sapien
aggacatggacaaggtcgagacatt

SEQ ID NO: 81472 - DNA, 25 bp, Homo sapien
ggacatggacaaggtcgagacattc

SEQ ID NO: 81473 - DNA, 25 bp, Homo sapien
gacatggacaaggtcgagacattcc

SEQ ID NO: 81474 - DNA, 25 bp, Homo sapien
acatggacaaggtcgagacattcct

SEQ ID NO: 81475 - DNA, 25 bp, Homo sapien
catggacaaggtcgagacattcctg

SEQ ID NO: 81476 - DNA, 25 bp, Homo sapien
atggacaaggtcgagacattcctgc

SEQ ID NO: 81477 - DNA, 25 bp, Homo sapien
tggacaaggtcgagacattcctgcg

SEQ ID NO: 81478 - DNA, 25 bp, Homo sapien
ggacaaggtcgagacattcctgcgc

SEQ ID NO: 81479 - DNA, 25 bp, Homo sapien
gacaaggtcgagacattcctgcgca

SEQ ID NO: 81480 - DNA, 25 bp, Homo sapien
acaaggtcgagacattcctgcgcat

SEQ ID NO: 81481 - DNA, 25 bp, Homo sapien
aaccaaaccagcactgggttctact

SEQ ID NO: 81482 - DNA, 25 bp, Homo sapien
aaccagcactgggttctactgctgt

SEQ ID NO: 81483 - DNA, 25 bp, Homo sapien
ccagcactgggttctactgctgtgg

SEQ ID NO: 81484 - DNA, 25 bp, Homo sapien
gggtaaactaactcagtggaatagg

SEQ ID NO: 81485 - DNA, 25 bp, Homo sapien
actcagtggaatagggctggttact

SEQ ID NO: 81486 - DNA, 25 bp, Homo sapien
ggctggttactttgggctgtccaac

SEQ ID NO: 81487 - DNA, 25 bp, Homo sapien
gttactttgggctgtccaactcata

SEQ ID NO: 81488 - DNA, 25 bp, Homo sapien
tactttgggctgtccaactcataag

SEQ ID NO: 81489 - DNA, 25 bp, Homo sapien
ttgggctgtccaactcataagtttg

SEQ ID NO: 81490 - DNA, 25 bp, Homo sapien
ggctgtccaactcataagtttggct

SEQ ID NO: 81491 - DNA, 25 bp, Homo sapien
aactcataagtttggctgcattttg

SEQ ID NO: 81492 - DNA, 25 bp, Homo sapien
agagaccccaggaccaaggtccata

SEQ ID NO: 81493 - DNA, 25 bp, Homo sapien
aggtccatacaaatgccttgaaaat

SEQ ID NO: 81494 - DNA, 25 bp, Homo sapien
ttgaaaattgtgatctcattccttt

SEQ ID NO: 81495 - DNA, 25 bp, Homo sapien
gctagtttctttctatgtgttctca

SEQ ID NO: 81496 - DNA, 25 bp, Homo sapien
gtgttctcatatcatggatttctga

SEQ ID NO: 81497 - DNA, 25 bp, Homo sapien
cagtgatctacatgctttgtgagac

SEQ ID NO: 81498 - DNA, 25 bp, Homo sapien
agacgattggagtcttctctccttc

SEQ ID NO: 81499 - DNA, 25 bp, Homo sapien
tcctttcttctgattctaggaaacg

SEQ ID NO: 81500 - DNA, 25 bp, Homo sapien
ggaaacgctaagttaagacaggcct

SEQ ID NO: 81501 - DNA, 25 bp, Homo sapien
aagacaggcctttcttttggtggca

SEQ ID NO: 81502 - DNA, 25 bp, Homo sapien
ggcctttcttttggtggcagctaag

SEQ ID NO: 81503 - DNA, 25 bp, Homo sapien
tcttgcatctgattaactagaatat

SEQ ID NO: 81504 - DNA, 25 bp, Homo sapien
ttatgtgtaggagcactacaccatt

SEQ ID NO: 81505 - DNA, 25 bp, Homo sapien
ggagcactacaccattggtttccaa

SEQ ID NO: 81506 - DNA, 25 bp, Homo sapien
attggtttccaatactgcacacata

SEQ ID NO: 81507 - DNA, 25 bp, Homo sapien
actgcacacataagatacatacttg

SEQ ID NO: 81508 - DNA, 25 bp, Homo sapien
gtgtgcagaaagtatcttcctccag

SEQ ID NO: 81509 - DNA, 25 bp, Homo sapien
tgcagaaagtatcttcctccaggct

SEQ ID NO: 81510 - DNA, 25 bp, Homo sapien
tcttcctccaggcttgtaataccct

SEQ ID NO: 81511 - DNA, 25 bp, Homo sapien
aggcttgtaatacccttcacatgga

SEQ ID NO: 81512 - DNA, 25 bp, Homo sapien
gtaatacccttcacatggaagatta

SEQ ID NO: 81513 - DNA, 25 bp, Homo sapien
aatgagggaaatctttatattctgt

SEQ ID NO: 81514 - DNA, 25 bp, Homo sapien
gtgagcttcgatgagccagagtgat

SEQ ID NO: 81515 - DNA, 25 bp, Homo sapien
gccagagtgatatcataaccaccag

SEQ ID NO: 81516 - DNA, 25 bp, Homo sapien
aaccaccagaaatcatactctcctt

SEQ ID NO: 81517 - DNA, 25 bp, Homo sapien
aaatcatactctcctttcttagtca

SEQ ID NO: 81518 - DNA, 25 bp, Homo sapien
tctcctttcttagtcacaacaaaat

SEQ ID NO: 81519 - DNA, 25 bp, Homo sapien
atcacacatgtcatctttgtcaagg

SEQ ID NO: 81520 - DNA, 25 bp, Homo sapien
atgtcatctttgtcaagggcataaa

SEQ ID NO: 81521 - DNA, 25 bp, Homo sapien
gaaattggtgttgggcatattagca

SEQ ID NO: 81522 - DNA, 25 bp, Homo sapien
tattcttaatttgtggactcgattc

SEQ ID NO: 81523 - DNA, 25 bp, Homo sapien
ggactcgattcttttttactacata

SEQ ID NO: 81524 - DNA, 25 bp, Homo sapien
tactacatatttcccaagttatctt

SEQ ID NO: 81525 - DNA, 25 bp, Homo sapien
cccatccctgctagatgagcttggg

SEQ ID NO: 81526 - DNA, 25 bp, Homo sapien
gcagagggcgaagctgacctgcacc

SEQ ID NO: 81527 - DNA, 25 bp, Homo sapien
cacccctgatgtggcatatggagcc

SEQ ID NO: 81528 - DNA, 25 bp, Homo sapien
aatgccaccctcatctttgacgtgg

SEQ ID NO: 81529 - DNA, 25 bp, Homo sapien
atctttgacgtggagctgctcaact

SEQ ID NO: 81530 - DNA, 25 bp, Homo sapien
agctgctcaacttagagtgaaggca

SEQ ID NO: 81531 - DNA, 25 bp, Homo sapien
ggagatggctgctgctcaccctcct

SEQ ID NO: 81532 - DNA, 25 bp, Homo sapien
cactgggacggctcctgcttttggg

SEQ ID NO: 81533 - DNA, 25 bp, Homo sapien
gggctcttgatcagtgtgctaacct

SEQ ID NO: 81534 - DNA, 25 bp, Homo sapien
agtgtgctaacctcactgcctcatg

SEQ ID NO: 81535 - DNA, 25 bp, Homo sapien
tgcctcatggcatcatccattctct

SEQ ID NO: 81536 - DNA, 25 bp, Homo sapien
gaggactgcttcaccttcctgggca

SEQ ID NO: 81537 - DNA, 25 bp, Homo sapien
ttgggttcatttgctgttttgcctt

SEQ ID NO: 81538 - DNA, 25 bp, Homo sapien
catttgctgttttgccttgaggaag

SEQ ID NO: 81539 - DNA, 25 bp, Homo sapien
ttgaggaagcgacgatgccccaact

SEQ ID NO: 81540 - DNA, 25 bp, Homo sapien
gacgatgccccaactgtggagccac

SEQ ID NO: 81541 - DNA, 25 bp, Homo sapien
gtggagccaccttcgcttaaaggga

SEQ ID NO: 81542 - DNA, 25 bp, Homo sapien
tcgcttaaagggaacaccaggcccg

SEQ ID NO: 81543 - DNA, 25 bp, Homo sapien
acccagctctctttttctaatgtaa

SEQ ID NO: 81544 - DNA, 25 bp, Homo sapien
tatttgattaagcttcaggactgtt

SEQ ID NO: 81545 - DNA, 25 bp, Homo sapien
ttttgtaaagcgaggtgggaccgat

SEQ ID NO: 81546 - DNA, 25 bp, Homo sapien
tgggaccgatgtggcacacgccagc

SEQ ID NO: 81547 - DNA, 25 bp, Homo sapien
ttaacttttctagaatccaccctct

SEQ ID NO: 81548 - DNA, 25 bp, Homo sapien
ttttctagaatccaccctcttgtgc

SEQ ID NO: 81549 - DNA, 25 bp, Homo sapien
cctcttgtgcccttaagcattactt

SEQ ID NO: 81550 - DNA, 25 bp, Homo sapien
taactggtagggaacgccagaactt

SEQ ID NO: 81551 - DNA, 25 bp, Homo sapien
ggaacgccagaacttttaagtccag

SEQ ID NO: 81552 - DNA, 25 bp, Homo sapien
gaacttttaagtccagctattcatt

SEQ ID NO: 81553 - DNA, 25 bp, Homo sapien
aagtccagctattcattagatagta

SEQ ID NO: 81554 - DNA, 25 bp, Homo sapien
gtctctttagtatggttttcagtgc

SEQ ID NO: 81555 - DNA, 25 bp, Homo sapien
ttttcagtgcaattaaaccgagaga

SEQ ID NO: 81556 - DNA, 25 bp, Homo sapien
ttaaaccgagagatgtcttgttttt

SEQ ID NO: 81557 - DNA, 25 bp, Homo sapien
gatcattttgcacatagctttatca

SEQ ID NO: 81558 - DNA, 25 bp, Homo sapien
gcagagggcgaagctgacctgcacc

SEQ ID NO: 81559 - DNA, 25 bp, Homo sapien
agagggcgaagctgacctgcacccc

SEQ ID NO: 81560 - DNA, 25 bp, Homo sapien
gaagctgacctgcacccctgatgtg

SEQ ID NO: 81561 - DNA, 25 bp, Homo sapien
cacccctgatgtggcatatggagcc

SEQ ID NO: 81562 - DNA, 25 bp, Homo sapien
tgtggcatatggagccacgggccac

SEQ ID NO: 81563 - DNA, 25 bp, Homo sapien
aatgccaccctcatctttgacgtgg

SEQ ID NO: 81564 - DNA, 25 bp, Homo sapien
tgccaccctcatctttgacgtggag

SEQ ID NO: 81565 - DNA, 25 bp, Homo sapien
caccctcatctttgacgtggagctg

SEQ ID NO: 81566 - DNA, 25 bp, Homo sapien
cgtggagctgctcaacttagagtga

SEQ ID NO: 81567 - DNA, 25 bp, Homo sapien
agctgctcaacttagagtgaaggca

SEQ ID NO: 81568 - DNA, 25 bp, Homo sapien
gctcaacttagagtgaaggcaggaa

SEQ ID NO: 81569 - DNA, 25 bp, Homo sapien
aaataaccactatttgagttgtggc

SEQ ID NO: 81570 - DNA, 25 bp, Homo sapien
gaggatgataaagcacgcggcccct

SEQ ID NO: 81571 - DNA, 25 bp, Homo sapien
cccaaaggagcccttgagctaggga

SEQ ID NO: 81572 - DNA, 25 bp, Homo sapien
tgcagtcagcctcgctctcaacgtg

SEQ ID NO: 81573 - DNA, 25 bp, Homo sapien
gaatgaccacccagagggatgagct

SEQ ID NO: 81574 - DNA, 25 bp, Homo sapien
acccagagggatgagctagcctgta

SEQ ID NO: 81575 - DNA, 25 bp, Homo sapien
ggctggctcagctaagtggcacgat

SEQ ID NO: 81576 - DNA, 25 bp, Homo sapien
gctaagtggcacgatgacgcatgaa

SEQ ID NO: 81577 - DNA, 25 bp, Homo sapien
gcacgatgacgcatgaaggagatta

SEQ ID NO: 81578 - DNA, 25 bp, Homo sapien
gattatgttgtgctctttattgcca

SEQ ID NO: 81579 - DNA, 25 bp, Homo sapien
gttgtgctctttattgccaaaaata

SEQ ID NO: 81580 - DNA, 25 bp, Homo sapien
gaaaacacaccacattgaaaatcct

SEQ ID NO: 81581 - DNA, 25 bp, Homo sapien
acattgaaaatcctgccacagcagc

SEQ ID NO: 81582 - DNA, 25 bp, Homo sapien
aacagcagcgctgttagtgagctaa

SEQ ID NO: 81583 - DNA, 25 bp, Homo sapien
gtgagctaagtaagcactgacttcg

SEQ ID NO: 81584 - DNA, 25 bp, Homo sapien
gagctaagtaagcactgacttcgta

SEQ ID NO: 81585 - DNA, 25 bp, Homo sapien
gctaagtaagcactgacttcgtaga

SEQ ID NO: 81586 - DNA, 25 bp, Homo sapien
gtaagcactgacttcgtagaaaacc

SEQ ID NO: 81587 - DNA, 25 bp, Homo sapien
gcactgacttcgtagaaaaccataa

SEQ ID NO: 81588 - DNA, 25 bp, Homo sapien
gaaaaccataacatcggccatcttg

SEQ ID NO: 81589 - DNA, 25 bp, Homo sapien
aaaccataacatcggccatcttgga

SEQ ID NO: 81590 - DNA, 25 bp, Homo sapien
cataacatcggccatcttggaaaag

SEQ ID NO: 81591 - DNA, 25 bp, Homo sapien
gtcaggtcttggtaggtgcctgcat

SEQ ID NO: 81592 - DNA, 25 bp, Homo sapien
gtcttggtaggtgcctgcatctgtc

SEQ ID NO: 81593 - DNA, 25 bp, Homo sapien
gggtattcttcatgcaggagacccc

SEQ ID NO: 81594 - DNA, 25 bp, Homo sapien
cctggaggctgcaacatacctcaat

SEQ ID NO: 81595 - DNA, 25 bp, Homo sapien
aggctgcaacatacctcaatcctgt

SEQ ID NO: 81596 - DNA, 25 bp, Homo sapien
aggccggatcctcctgaagcccttt

SEQ ID NO: 81597 - DNA, 25 bp, Homo sapien
tgaagcccttttcgcagcactgcta

SEQ ID NO: 81598 - DNA, 25 bp, Homo sapien
ttcgcagcactgctatcctccaaag

SEQ ID NO: 81599 - DNA, 25 bp, Homo sapien
ctccaaagccattgtaaatgtgtgt

SEQ ID NO: 81600 - DNA, 25 bp, Homo sapien
gtacagtgtgtataaaccttcttct

SEQ ID NO: 81601 - DNA, 25 bp, Homo sapien
agtgtgtataaaccttcttcttctt

SEQ ID NO: 81602 - DNA, 25 bp, Homo sapien
tactgtcctggaacctgtctccatt

SEQ ID NO: 81603 - DNA, 25 bp, Homo sapien
gaacctgtctccattgtgtgatcca

SEQ ID NO: 81604 - DNA, 25 bp, Homo sapien
tccattgtgtgatccagccctggtt

SEQ ID NO: 81605 - DNA, 25 bp, Homo sapien
ggttttgtgtgtttaggcctcattt

SEQ ID NO: 81606 - DNA, 25 bp, Homo sapien
gtttaggcctcatttctttgtcttt

SEQ ID NO: 81607 - DNA, 25 bp, Homo sapien
tactccgttcctggcatttgctgat

SEQ ID NO: 81608 - DNA, 25 bp, Homo sapien
gctgatttctagtgtatactctgta

SEQ ID NO: 81609 - DNA, 25 bp, Homo sapien
atactctgtagtctcagttcgtgtt

SEQ ID NO: 81610 - DNA, 25 bp, Homo sapien
agttcgtgtttgattccattccatg

SEQ ID NO: 81611 - DNA, 25 bp, Homo sapien
tatgttgtacatactgccgaagaat

SEQ ID NO: 81612 - DNA, 25 bp, Homo sapien
gccgaagaattgtcttgcaagttaa

SEQ ID NO: 81613 - DNA, 25 bp, Homo sapien
tcacttttgctcctagcacgattat

SEQ ID NO: 81614 - DNA, 25 bp, Homo sapien
gcacgattatatttcacctgggaca

SEQ ID NO: 81615 - DNA, 25 bp, Homo sapien
tatttcacctgggacatgctgctat

SEQ ID NO: 81616 - DNA, 25 bp, Homo sapien
ctgggacatgctgctatgctgggac

SEQ ID NO: 81617 - DNA, 25 bp, Homo sapien
atgctgggactcatgtatgtctact

SEQ ID NO: 81618 - DNA, 25 bp, Homo sapien
gtatgtctactggactcagctcaac

SEQ ID NO: 81619 - DNA, 25 bp, Homo sapien
actggactcagctcaacatgttcca

SEQ ID NO: 81620 - DNA, 25 bp, Homo sapien
caacatgttccagaccttgaagtac

SEQ ID NO: 81621 - DNA, 25 bp, Homo sapien
ttccagaccttgaagtacctggcca

SEQ ID NO: 81622 - DNA, 25 bp, Homo sapien
agtgtgacgtttctggctggcaatc

SEQ ID NO: 81623 - DNA, 25 bp, Homo sapien
aaggagtcaagaacaattcacagta

SEQ ID NO: 81624 - DNA, 25 bp, Homo sapien
aaataaaactctatgctaccggcag

SEQ ID NO: 81625 - DNA, 25 bp, Homo sapien
tatgctaccggcagtagagacccca

SEQ ID NO: 81626 - DNA, 25 bp, Homo sapien
taccggcagtagagaccccagcaca

SEQ ID NO: 81627 - DNA, 25 bp, Homo sapien
acagaagttcatgtgagagccatta

SEQ ID NO: 81628 - DNA, 25 bp, Homo sapien
gagagccattaaaactatgacttca

SEQ ID NO: 81629 - DNA, 25 bp, Homo sapien
atgacctttagctatcttatgacaa

SEQ ID NO: 81630 - DNA, 25 bp, Homo sapien
acaagttagctgtggagtttggaga

SEQ ID NO: 81631 - DNA, 25 bp, Homo sapien
agattgcagcaattctctacccctt

SEQ ID NO: 81632 - DNA, 25 bp, Homo sapien
taccccttgggtcactcacttattt

SEQ ID NO: 81633 - DNA, 25 bp, Homo sapien
ggcagacatttgtcagaatgctgac

SEQ ID NO: 81634 - DNA, 25 bp, Homo sapien
tgtagaaaaattgcctgcatgatat

SEQ ID NO: 81635 - DNA, 25 bp, Homo sapien
tggacatcacatgtgaatgcatgat

SEQ ID NO: 81636 - DNA, 25 bp, Homo sapien
tacagtttctactgttctctgcaag

SEQ ID NO: 81637 - DNA, 25 bp, Homo sapien
gtttctactgttctctgcaagtaaa

SEQ ID NO: 81638 - DNA, 25 bp, Homo sapien
caagttgagctctggtaactgatct

SEQ ID NO: 81639 - DNA, 25 bp, Homo sapien
gagctctggtaactgatcttaatag

SEQ ID NO: 81640 - DNA, 25 bp, Homo sapien
ggtaactgatcttaatagctaaaat

SEQ ID NO: 81641 - DNA, 25 bp, Homo sapien
atttgggaagtctgaaatgaggtct

SEQ ID NO: 81642 - DNA, 25 bp, Homo sapien
tggtgtgcccttaatgcctgtgaca

SEQ ID NO: 81643 - DNA, 25 bp, Homo sapien
tgtgcccttaatgcctgtgacagtt

SEQ ID NO: 81644 - DNA, 25 bp, Homo sapien
gttggcctctgtgaatattggtata

SEQ ID NO: 81645 - DNA, 25 bp, Homo sapien
ggcctctgtgaatattggtataatt

SEQ ID NO: 81646 - DNA, 25 bp, Homo sapien
aaggacatggacaaggtcgagacat

SEQ ID NO: 81647 - DNA, 25 bp, Homo sapien
aggacatggacaaggtcgagacatt

SEQ ID NO: 81648 - DNA, 25 bp, Homo sapien
ggacatggacaaggtcgagacattc

SEQ ID NO: 81649 - DNA, 25 bp, Homo sapien
gacatggacaaggtcgagacattcc

SEQ ID NO: 81650 - DNA, 25 bp, Homo sapien
acatggacaaggtcgagacattcct

SEQ ID NO: 81651 - DNA, 25 bp, Homo sapien
catggacaaggtcgagacattcctg

SEQ ID NO: 81652 - DNA, 25 bp, Homo sapien
atggacaaggtcgagacattcctgc

SEQ ID NO: 81653 - DNA, 25 bp, Homo sapien
tggacaaggtcgagacattcctgcg

SEQ ID NO: 81654 - DNA, 25 bp, Homo sapien
ggacaaggtcgagacattcctgcgc

SEQ ID NO: 81655 - DNA, 25 bp, Homo sapien
gacaaggtcgagacattcctgcgca

SEQ ID NO: 81656 - DNA, 25 bp, Homo sapien
acaaggtcgagacattcctgcgcat

SEQ ID NO: 81657 - DNA, 25 bp, Homo sapien
gaaagttctcattacattggacatt

SEQ ID NO: 81658 - DNA, 25 bp, Homo sapien
gtttccttgaacaaagagaagcttc

SEQ ID NO: 81659 - DNA, 25 bp, Homo sapien
gagaagcttctttaaaagctgctat

SEQ ID NO: 81660 - DNA, 25 bp, Homo sapien
agctgctattgataactctctttta

SEQ ID NO: 81661 - DNA, 25 bp, Homo sapien
atttcactaaccttttcatcatcac

SEQ ID NO: 81662 - DNA, 25 bp, Homo sapien
cactaaccttttcatcatcactttg

SEQ ID NO: 81663 - DNA, 25 bp, Homo sapien
gaacaaactagttagcttcttgacc

SEQ ID NO: 81664 - DNA, 25 bp, Homo sapien
actagttagcttcttgacctaataa

SEQ ID NO: 81665 - DNA, 25 bp, Homo sapien
aaggaatattatagccacttaggct

SEQ ID NO: 81666 - DNA, 25 bp, Homo sapien
aagcatactagtcaaaattggtgat

SEQ ID NO: 81667 - DNA, 25 bp, Homo sapien
ttgatatagatacttcataaacctc

SEQ ID NO: 81668 - DNA, 25 bp, Homo sapien
gggaagttgattatgacacagcaga

SEQ ID NO: 81669 - DNA, 25 bp, Homo sapien
cacagcagagactagatcacagagg

SEQ ID NO: 81670 - DNA, 25 bp, Homo sapien
agactagatcacagagggaaccaga

SEQ ID NO: 81671 - DNA, 25 bp, Homo sapien
gagggaaccagataattctagaaat

SEQ ID NO: 81672 - DNA, 25 bp, Homo sapien
ctagtcttagttatttagtgtttat

SEQ ID NO: 81673 - DNA, 25 bp, Homo sapien
gataattgaagccagtggtttttta

SEQ ID NO: 81674 - DNA, 25 bp, Homo sapien
atgttatgtatcagaatcacctcac

SEQ ID NO: 81675 - DNA, 25 bp, Homo sapien
atcagaatcacctcacaaagcttct

SEQ ID NO: 81676 - DNA, 25 bp, Homo sapien
aaagcttctgaaaaatacaccacaa

SEQ ID NO: 81677 - DNA, 25 bp, Homo sapien
tacaccacaaagtgtggctcaccca

SEQ ID NO: 81678 - DNA, 25 bp, Homo sapien
gtgtggctcacccaccacactttgg

SEQ ID NO: 81679 - DNA, 25 bp, Homo sapien
gactcagacccatcttctagcaaaa

SEQ ID NO: 81680 - DNA, 25 bp, Homo sapien
agacccatcttctagcaaaacaagg

SEQ ID NO: 81681 - DNA, 25 bp, Homo sapien
gcaaaacaaggcagatcatctccac

SEQ ID NO: 81682 - DNA, 25 bp, Homo sapien
atccggacgcagaatcttcccaact

SEQ ID NO: 81683 - DNA, 25 bp, Homo sapien
agaatcttcccaactgtcagctgat

SEQ ID NO: 81684 - DNA, 25 bp, Homo sapien
gtcagctgatttcccgaagccacta

SEQ ID NO: 81685 - DNA, 25 bp, Homo sapien
acctgtcgtttgtcatgcttttggc

SEQ ID NO: 81686 - DNA, 25 bp, Homo sapien
tgtcatgcttttggctgccctgagc

SEQ ID NO: 81687 - DNA, 25 bp, Homo sapien
agctggcagtacctgaccactctct

SEQ ID NO: 81688 - DNA, 25 bp, Homo sapien
tttgtccatagctgaagtccaccat

SEQ ID NO: 81689 - DNA, 25 bp, Homo sapien
catagctgaagtccaccataaagtg

SEQ ID NO: 81690 - DNA, 25 bp, Homo sapien
ctaccaggagtttaggctggaagat

SEQ ID NO: 81691 - DNA, 25 bp, Homo sapien
aagttcgacacaaactcacacaacg

SEQ ID NO: 81692 - DNA, 25 bp, Homo sapien
gttcgacacaaactcacacaacgat

SEQ ID NO: 81693 - DNA, 25 bp, Homo sapien
tcgacacaaactcacacaacgatga

SEQ ID NO: 81694 - DNA, 25 bp, Homo sapien
tagctgcccgggtggcatccctgtg

SEQ ID NO: 81695 - DNA, 25 bp, Homo sapien
agctgcccgggtggcatccctgtga

SEQ ID NO: 81696 - DNA, 25 bp, Homo sapien
ctgcccgggtggcatccctgtgacc

SEQ ID NO: 81697 - DNA, 25 bp, Homo sapien
tgcccgggtggcatccctgtgaccc

SEQ ID NO: 81698 - DNA, 25 bp, Homo sapien
cccgggtggcatccctgtgacccct

SEQ ID NO: 81699 - DNA, 25 bp, Homo sapien
gcctctcctggccttggaagttgcc

SEQ ID NO: 81700 - DNA, 25 bp, Homo sapien
ctctcctggccttggaagttgccac

SEQ ID NO: 81701 - DNA, 25 bp, Homo sapien
aggataccctcactttgcatgagga

SEQ ID NO: 81702 - DNA, 25 bp, Homo sapien
ggataccctcactttgcatgaggag

SEQ ID NO: 81703 - DNA, 25 bp, Homo sapien
gataccctcactttgcatgaggagc

SEQ ID NO: 81704 - DNA, 25 bp, Homo sapien
ataccctcactttgcatgaggagct

SEQ ID NO: 81705 - DNA, 25 bp, Homo sapien
taccctcactttgcatgaggagctg

SEQ ID NO: 81706 - DNA, 25 bp, Homo sapien
accctcactttgcatgaggagctga

SEQ ID NO: 81707 - DNA, 25 bp, Homo sapien
tcactttgcatgaggagctgaaact

SEQ ID NO: 81708 - DNA, 25 bp, Homo sapien
actttgcatgaggagctgaaactga

SEQ ID NO: 81709 - DNA, 25 bp, Homo sapien
tttgcatgaggagctgaaactgacc

SEQ ID NO: 81710 - DNA, 25 bp, Homo sapien
atacatacctgtgattaagtttatg

SEQ ID NO: 81711 - DNA, 25 bp, Homo sapien
catacctgtgattaagtttatgaat

SEQ ID NO: 81712 - DNA, 25 bp, Homo sapien
ggtggggccgtagctctctacctct

SEQ ID NO: 81713 - DNA, 25 bp, Homo sapien
ctccaccccaggcttagaggacaga

SEQ ID NO: 81714 - DNA, 25 bp, Homo sapien
tccaccccaggcttagaggacagaa

SEQ ID NO: 81715 - DNA, 25 bp, Homo sapien
ccaccccaggcttagaggacagaaa

SEQ ID NO: 81716 - DNA, 25 bp, Homo sapien
caccccaggcttagaggacagaaaa

SEQ ID NO: 81717 - DNA, 25 bp, Homo sapien
ccccaggcttagaggacagaaaaat

SEQ ID NO: 81718 - DNA, 25 bp, Homo sapien
ccaggcttagaggacagaaaaatgt

SEQ ID NO: 81719 - DNA, 25 bp, Homo sapien
aaatgtgaagagacgccccacccac

SEQ ID NO: 81720 - DNA, 25 bp, Homo sapien
gggcctaacccacgcagtcacccca

SEQ ID NO: 81721 - DNA, 25 bp, Homo sapien
agagggcagggctaggcgagagcct

SEQ ID NO: 81722 - DNA, 25 bp, Homo sapien
aagggagggaggtctgttctatctg

SEQ ID NO: 81723 - DNA, 25 bp, Homo sapien
tcatcattgcaaatcatggtgacag

SEQ ID NO: 81724 - DNA, 25 bp, Homo sapien
gtgacagaattgatatcccacctgg

SEQ ID NO: 81725 - DNA, 25 bp, Homo sapien
gaattgatatcccacctggagcagt

SEQ ID NO: 81726 - DNA, 25 bp, Homo sapien
atcccacctggagcagtattagaga

SEQ ID NO: 81727 - DNA, 25 bp, Homo sapien
tgtctggaaaccttcgcatcttgga

SEQ ID NO: 81728 - DNA, 25 bp, Homo sapien
ttcgcatcttggaccactgaaatga

SEQ ID NO: 81729 - DNA, 25 bp, Homo sapien
ataatgggctagtttcttacaatga

SEQ ID NO: 81730 - DNA, 25 bp, Homo sapien
tactttactatgttactgtaccctg

SEQ ID NO: 81731 - DNA, 25 bp, Homo sapien
gttactgtaccctgcagtgttgatt

SEQ ID NO: 81732 - DNA, 25 bp, Homo sapien
ctgtaccctgcagtgttgattttta

SEQ ID NO: 81733 - DNA, 25 bp, Homo sapien
aaaatagagttttctgcagtatgct

SEQ ID NO: 81734 - DNA, 25 bp, Homo sapien
ctgcatgctacagggttcagagacc

SEQ ID NO: 81735 - DNA, 25 bp, Homo sapien
gttcagagaccccagtacagaggcc

SEQ ID NO: 81736 - DNA, 25 bp, Homo sapien
aaggcagtgatcatctttctgctcc

SEQ ID NO: 81737 - DNA, 25 bp, Homo sapien
tcatcgtgtactacccagtctttct

SEQ ID NO: 81738 - DNA, 25 bp, Homo sapien
cagtctttcttgttatgacctctag

SEQ ID NO: 81739 - DNA, 25 bp, Homo sapien
ttgttatgacctctagcgctctgat

SEQ ID NO: 81740 - DNA, 25 bp, Homo sapien
tagcgctctgattcctcagggaaaa

SEQ ID NO: 81741 - DNA, 25 bp, Homo sapien
tgtcattttcccatcaagccattca

SEQ ID NO: 81742 - DNA, 25 bp, Homo sapien
gagggaagcttttctgaagatgtta

SEQ ID NO: 81743 - DNA, 25 bp, Homo sapien
aagatttgtgaagtgtttccttaga

SEQ ID NO: 81744 - DNA, 25 bp, Homo sapien
gaagaagaaagccttttgttccata

SEQ ID NO: 81745 - DNA, 25 bp, Homo sapien
ttgtgctcgcctcataggtgtctat

SEQ ID NO: 81746 - DNA, 25 bp, Homo sapien
aggtgtctatttggactctaagctc

SEQ ID NO: 81747 - DNA, 25 bp, Homo sapien
ggactctaagctctacgggtgacag

SEQ ID NO: 81748 - DNA, 25 bp, Homo sapien
cgggtgacagatcttgtttctgaag

SEQ ID NO: 81749 - DNA, 25 bp, Homo sapien
gtgacagatcttgtttctgaagatg

SEQ ID NO: 81750 - DNA, 25 bp, Homo sapien
taagttatagcttcttaaacgaaag

SEQ ID NO: 81751 - DNA, 25 bp, Homo sapien
ttttatatttggcccttccacccat

SEQ ID NO: 81752 - DNA, 25 bp, Homo sapien
gcccttccacccatttttaattgtg

SEQ ID NO: 81753 - DNA, 25 bp, Homo sapien
gagatttgtcaccaatcatcactgg

SEQ ID NO: 81754 - DNA, 25 bp, Homo sapien
ttgtcaccaatcatcactggttcct

SEQ ID NO: 81755 - DNA, 25 bp, Homo sapien
accaatcatcactggttcctcctta

SEQ ID NO: 81756 - DNA, 25 bp, Homo sapien
aggagtagactctgcgaccagtaca

SEQ ID NO: 81757 - DNA, 25 bp, Homo sapien
tgcgaccagtacagaccctgtcctg

SEQ ID NO: 81758 - DNA, 25 bp, Homo sapien
gaagagacacatgctccacttggga

SEQ ID NO: 81759 - DNA, 25 bp, Homo sapien
caccacgcaactcagggctcaagat

SEQ ID NO: 81760 - DNA, 25 bp, Homo sapien
gagagatttgagtccaagcatacat

SEQ ID NO: 81761 - DNA, 25 bp, Homo sapien
catttatattcagtgttgtgccatt

SEQ ID NO: 81762 - DNA, 25 bp, Homo sapien
cagtgttgtgccattgagttcccat

SEQ ID NO: 81763 - DNA, 25 bp, Homo sapien
gtgccattgagttcccatgtggatc

SEQ ID NO: 81764 - DNA, 25 bp, Homo sapien
atcattctgaaggtgatctccacaa

SEQ ID NO: 81765 - DNA, 25 bp, Homo sapien
gtgatctccacaagagggtgtgtgt

SEQ ID NO: 81766 - DNA, 25 bp, Homo sapien
ggatacatcactgaagctattgata

SEQ ID NO: 81767 - DNA, 25 bp, Homo sapien
gaattgtgacaaataacagcagtgg

SEQ ID NO: 81768 - DNA, 25 bp, Homo sapien
aattgtgacaaataacagcagtgga

SEQ ID NO: 81769 - DNA, 25 bp, Homo sapien
cagtggaaaaagtatgtgcttagaa

SEQ ID NO: 81770 - DNA, 25 bp, Homo sapien
aaaagtatgtgcttagaattgtgaa

SEQ ID NO: 81771 - DNA, 25 bp, Homo sapien
aagtatgtgcttagaattgtgaaag

SEQ ID NO: 81772 - DNA, 25 bp, Homo sapien
gtatgtgcttagaattgtgaaagaa

SEQ ID NO: 81773 - DNA, 25 bp, Homo sapien
gagataaagacctcaagaagttaaa

SEQ ID NO: 81774 - DNA, 25 bp, Homo sapien
gataaagacctcaagaagttaaaag

SEQ ID NO: 81775 - DNA, 25 bp, Homo sapien
taaagacctcaagaagttaaaagat

SEQ ID NO: 81776 - DNA, 25 bp, Homo sapien
cctcactctattctgtaaatttgaa

SEQ ID NO: 81777 - DNA, 25 bp, Homo sapien
gaaaaaaaagcatggatacctggat

SEQ ID NO: 81778 - DNA, 25 bp, Homo sapien
gtagccctttttgtactgatataat

SEQ ID NO: 81779 - DNA, 25 bp, Homo sapien
caagtttgtggcttatggattcata

SEQ ID NO: 81780 - DNA, 25 bp, Homo sapien
taggccagagttgcaaagatctttt

SEQ ID NO: 81781 - DNA, 25 bp, Homo sapien
aagatcttttccagagtatgcaact

SEQ ID NO: 81782 - DNA, 25 bp, Homo sapien
atgcaactctgacgttgatcccaga

SEQ ID NO: 81783 - DNA, 25 bp, Homo sapien
gcttcagtgacaaacatatcctttc

SEQ ID NO: 81784 - DNA, 25 bp, Homo sapien
agacaggagacatgagtctttgccg

SEQ ID NO: 81785 - DNA, 25 bp, Homo sapien
gtctttgccggaggaaaagcagctc

SEQ ID NO: 81786 - DNA, 25 bp, Homo sapien
acacatgtgcagtcactggtgtcac

SEQ ID NO: 81787 - DNA, 25 bp, Homo sapien
actggtgtcaccctggataggcaag

SEQ ID NO: 81788 - DNA, 25 bp, Homo sapien
ggcaagggataactcttctaacaca

SEQ ID NO: 81789 - DNA, 25 bp, Homo sapien
tctcaggtcccttttggttctcagt

SEQ ID NO: 81790 - DNA, 25 bp, Homo sapien
tggttctcagtttcattggttcctc

SEQ ID NO: 81791 - DNA, 25 bp, Homo sapien
ttctcagtttcattggttcctcttt

SEQ ID NO: 81792 - DNA, 25 bp, Homo sapien
gtttcattggttcctctttctgttc

SEQ ID NO: 81793 - DNA, 25 bp, Homo sapien
ttctgttcccccattgacttctgtg

SEQ ID NO: 81794 - DNA, 25 bp, Homo sapien
ttttccataaccttaggtattcagt

SEQ ID NO: 81795 - DNA, 25 bp, Homo sapien
ttttgtatttttgaggattcctgta

SEQ ID NO: 81796 - DNA, 25 bp, Homo sapien
tgtattctgtatcctctcctcgcat

SEQ ID NO: 81797 - DNA, 25 bp, Homo sapien
ctcgcatctcctcacatggaaagaa

SEQ ID NO: 81798 - DNA, 25 bp, Homo sapien
aacaagtggtcccaggtatccccat

SEQ ID NO: 81799 - DNA, 25 bp, Homo sapien
ggtcccaggtatccccatttccaag

SEQ ID NO: 81800 - DNA, 25 bp, Homo sapien
cacaggctgtcatggtggctcttgc

SEQ ID NO: 81801 - DNA, 25 bp, Homo sapien
ttcctgagctgacctgacctcactg

SEQ ID NO: 81802 - DNA, 25 bp, Homo sapien
ccacctcttgcattgggatcctgag

SEQ ID NO: 81803 - DNA, 25 bp, Homo sapien
ggtgaaggagcttagcttgtcttct

SEQ ID NO: 81804 - DNA, 25 bp, Homo sapien
aggagcttagcttgtcttcttggca

SEQ ID NO: 81805 - DNA, 25 bp, Homo sapien
gagcttagcttgtcttcttggcaat

SEQ ID NO: 81806 - DNA, 25 bp, Homo sapien
cttagcttgtcttcttggcaattca

SEQ ID NO: 81807 - DNA, 25 bp, Homo sapien
gcttgtcttcttggcaattcacaat

SEQ ID NO: 81808 - DNA, 25 bp, Homo sapien
taaaactggagcgtcccctatggtc

SEQ ID NO: 81809 - DNA, 25 bp, Homo sapien
ctggagcgtcccctatggtctcctg

SEQ ID NO: 81810 - DNA, 25 bp, Homo sapien
cccattaaagctctgccactcaaaa

SEQ ID NO: 81811 - DNA, 25 bp, Homo sapien
tggagatgttgccttgaccagcctt

SEQ ID NO: 81812 - DNA, 25 bp, Homo sapien
agccttggctggactttaccaggca

SEQ ID NO: 81813 - DNA, 25 bp, Homo sapien
gcatgcagaagcctgtaccaacaca

SEQ ID NO: 81814 - DNA, 25 bp, Homo sapien
aacacagactacagcacccaggagg

SEQ ID NO: 81815 - DNA, 25 bp, Homo sapien
agtgtggctgctcagcggttataac

SEQ ID NO: 81816 - DNA, 25 bp, Homo sapien
gcggttataacaggcctgactgcat

SEQ ID NO: 81817 - DNA, 25 bp, Homo sapien
gactgcattgttcaccggattataa

SEQ ID NO: 81818 - DNA, 25 bp, Homo sapien
tgagccaaaatgtttcccggtgttt

SEQ ID NO: 81819 - DNA, 25 bp, Homo sapien
atatagcagattaaccaccctcctt

SEQ ID NO: 81820 - DNA, 25 bp, Homo sapien
gggcttaatggtttcctggtgattc

SEQ ID NO: 81821 - DNA, 25 bp, Homo sapien
ctggtgattcttaccaatccacaat

SEQ ID NO: 81822 - DNA, 25 bp, Homo sapien
aagttcgacacaaactcacacaacg

SEQ ID NO: 81823 - DNA, 25 bp, Homo sapien
gttcgacacaaactcacacaacgat

SEQ ID NO: 81824 - DNA, 25 bp, Homo sapien
ttcgacacaaactcacacaacgatg

SEQ ID NO: 81825 - DNA, 25 bp, Homo sapien
tcgacacaaactcacacaacgatga

SEQ ID NO: 81826 - DNA, 25 bp, Homo sapien
tagctgcccgggtggcatccctgtg

SEQ ID NO: 81827 - DNA, 25 bp, Homo sapien
agctgcccgggtggcatccctgtga

SEQ ID NO: 81828 - DNA, 25 bp, Homo sapien
ctgcccgggtggcatccctgtgacc

SEQ ID NO: 81829 - DNA, 25 bp, Homo sapien
tgcccgggtggcatccctgtgaccc

SEQ ID NO: 81830 - DNA, 25 bp, Homo sapien
cccgggtggcatccctgtgacccct

SEQ ID NO: 81831 - DNA, 25 bp, Homo sapien
gcctctcctggccttggaagttgcc

SEQ ID NO: 81832 - DNA, 25 bp, Homo sapien
ctctcctggccttggaagttgccac

SEQ ID NO: 81833 - DNA, 25 bp, Homo sapien
ttccttcaacaaaggggccctgctc

SEQ ID NO: 81834 - DNA, 25 bp, Homo sapien
gggctggtccacaggccgaattgcc

SEQ ID NO: 81835 - DNA, 25 bp, Homo sapien
gaattgcccacatcccgctgtactt

SEQ ID NO: 81836 - DNA, 25 bp, Homo sapien
acatcccgctgtactttgtcaatgc

SEQ ID NO: 81837 - DNA, 25 bp, Homo sapien
tcccgctgtactttgtcaatgccca

SEQ ID NO: 81838 - DNA, 25 bp, Homo sapien
gtcaatgcccagtttccacgtttta

SEQ ID NO: 81839 - DNA, 25 bp, Homo sapien
caatgcccagtttccacgttttagc

SEQ ID NO: 81840 - DNA, 25 bp, Homo sapien
agtttccacgttttagcccagtgct

SEQ ID NO: 81841 - DNA, 25 bp, Homo sapien
ttccacgttttagcccagtgcttgg

SEQ ID NO: 81842 - DNA, 25 bp, Homo sapien
agcccagtgcttgggcgggcccagg

SEQ ID NO: 81843 - DNA, 25 bp, Homo sapien
ccctctttactgagacatccccaac

SEQ ID NO: 81844 - DNA, 25 bp, Homo sapien
tgttcctggcccctagcgtgctccc

SEQ ID NO: 81845 - DNA, 25 bp, Homo sapien
gggcccgcgtggtgtctgggcgctt

SEQ ID NO: 81846 - DNA, 25 bp, Homo sapien
gttggcgagggcctggaccgagtat

SEQ ID NO: 81847 - DNA, 25 bp, Homo sapien
gcctggaccgagtatgggcttatga

SEQ ID NO: 81848 - DNA, 25 bp, Homo sapien
cctggaccgagtatgggcttatgat

SEQ ID NO: 81849 - DNA, 25 bp, Homo sapien
tggaccgagtatgggcttatgatgt

SEQ ID NO: 81850 - DNA, 25 bp, Homo sapien
ccgagtatgggcttatgatgttcct

SEQ ID NO: 81851 - DNA, 25 bp, Homo sapien
gagtatgggcttatgatgttcctga

SEQ ID NO: 81852 - DNA, 25 bp, Homo sapien
gtatgggcttatgatgttcctgagg

SEQ ID NO: 81853 - DNA, 25 bp, Homo sapien
tatgggcttatgatgttcctgaggg

SEQ ID NO: 81854 - DNA, 25 bp, Homo sapien
atgggcttatgatgttcctgagggt

SEQ ID NO: 81855 - DNA, 25 bp, Homo sapien
aggtgtaagggctcccacatccgtg

SEQ ID NO: 81856 - DNA, 25 bp, Homo sapien
acatccgtgagcctgtgtccgcagc

SEQ ID NO: 81857 - DNA, 25 bp, Homo sapien
cgtgagcctgtgtccgcagctgctg

SEQ ID NO: 81858 - DNA, 25 bp, Homo sapien
tgctccagcctgcaacttagtggaa

SEQ ID NO: 81859 - DNA, 25 bp, Homo sapien
cagcctgcaacttagtggaaggaat

SEQ ID NO: 81860 - DNA, 25 bp, Homo sapien
tagggatgggccagcctcccgtctc

SEQ ID NO: 81861 - DNA, 25 bp, Homo sapien
cagcctcccgtctcagctgttggga

SEQ ID NO: 81862 - DNA, 25 bp, Homo sapien
agtggcccagagcactcctggaagt

SEQ ID NO: 81863 - DNA, 25 bp, Homo sapien
cactcctggaagtgggactcccctg

SEQ ID NO: 81864 - DNA, 25 bp, Homo sapien
tgggactcccctgccttgcaaatgt

SEQ ID NO: 81865 - DNA, 25 bp, Homo sapien
ttgcaaatgtgcctctccagactgc

SEQ ID NO: 81866 - DNA, 25 bp, Homo sapien
gaagggagacactctatctgtaatc

SEQ ID NO: 81867 - DNA, 25 bp, Homo sapien
gagacactctatctgtaatccaaga

SEQ ID NO: 81868 - DNA, 25 bp, Homo sapien
gtaatccaagatggttggctctaca

SEQ ID NO: 81869 - DNA, 25 bp, Homo sapien
ggttggctctacaaataccattgga

SEQ ID NO: 81870 - DNA, 25 bp, Homo sapien
gtgcctgtgctctcaagacaaactg

SEQ ID NO: 81871 - DNA, 25 bp, Homo sapien
aactgaaaagcacaagacctatgaa

SEQ ID NO: 81872 - DNA, 25 bp, Homo sapien
atgaagaattatcttccatcacata

SEQ ID NO: 81873 - DNA, 25 bp, Homo sapien
tttacaattgcattcgaaaacacca

SEQ ID NO: 81874 - DNA, 25 bp, Homo sapien
gaaaacaccaaataccgagggatca

SEQ ID NO: 81875 - DNA, 25 bp, Homo sapien
aataccgagggatcaatctgcaaaa

SEQ ID NO: 81876 - DNA, 25 bp, Homo sapien
gtgcatgacctctacattgaaaaca

SEQ ID NO: 81877 - DNA, 25 bp, Homo sapien
taaagaggctgttatcaggcttaac

SEQ ID NO: 81878 - DNA, 25 bp, Homo sapien
ataaccctcaagatctgcttgacag

SEQ ID NO: 81879 - DNA, 25 bp, Homo sapien
ttaaatccttagctcacatccattc

SEQ ID NO: 81880 - DNA, 25 bp, Homo sapien
tttcgggctccttaggcccaaggat

SEQ ID NO: 81881 - DNA, 25 bp, Homo sapien
gatggcatgtgactggtccctgcaa

SEQ ID NO: 81882 - DNA, 25 bp, Homo sapien
tgcaagggtcctttctttgtcacca

SEQ ID NO: 81883 - DNA, 25 bp, Homo sapien
accagccaaggcattgataaccaag

SEQ ID NO: 81884 - DNA, 25 bp, Homo sapien
gataaccaagtagccattttcctct

SEQ ID NO: 81885 - DNA, 25 bp, Homo sapien
caagtagccattttcctcttaaggt

SEQ ID NO: 81886 - DNA, 25 bp, Homo sapien
gactttcatgattatcctcagggac

SEQ ID NO: 81887 - DNA, 25 bp, Homo sapien
gattggaggcattgagcgtgtttat

SEQ ID NO: 81888 - DNA, 25 bp, Homo sapien
tggtggctcttgccacacttccctt

SEQ ID NO: 81889 - DNA, 25 bp, Homo sapien
tgccacacttcccttcctgagctga

SEQ ID NO: 81890 - DNA, 25 bp, Homo sapien
ttcctgagctgacctgacctcactg

SEQ ID NO: 81891 - DNA, 25 bp, Homo sapien
tcctgagctgacctgacctcactgc

SEQ ID NO: 81892 - DNA, 25 bp, Homo sapien
tgagctgacctgacctcactgccac

SEQ ID NO: 81893 - DNA, 25 bp, Homo sapien
agctgacctgacctcactgccacct

SEQ ID NO: 81894 - DNA, 25 bp, Homo sapien
tgacctgacctcactgccacctctt

SEQ ID NO: 81895 - DNA, 25 bp, Homo sapien
ccacctcttgcattgggatcctgag

SEQ ID NO: 81896 - DNA, 25 bp, Homo sapien
cacctcttgcattgggatcctgagg

SEQ ID NO: 81897 - DNA, 25 bp, Homo sapien
acctcttgcattgggatcctgaggg

SEQ ID NO: 81898 - DNA, 25 bp, Homo sapien
tgggatcctgagggctggcccctgc

SEQ ID NO: 81899 - DNA, 25 bp, Homo sapien
catgtcctcccctgtacatagtctt

SEQ ID NO: 81900 - DNA, 25 bp, Homo sapien
acatagtcttcgtgtctttctggac

SEQ ID NO: 81901 - DNA, 25 bp, Homo sapien
ccttgtcctgctgcatgcctgttgg

SEQ ID NO: 81902 - DNA, 25 bp, Homo sapien
atgcctgttggctactgggctcatc

SEQ ID NO: 81903 - DNA, 25 bp, Homo sapien
gtgtgtgtacgtgaccacgttctat

SEQ ID NO: 81904 - DNA, 25 bp, Homo sapien
gaccacgttctatctgttcatttgt

SEQ ID NO: 81905 - DNA, 25 bp, Homo sapien
ctatctgttcatttgtctgggtata

SEQ ID NO: 81906 - DNA, 25 bp, Homo sapien
gtctgggtatagtcactcctggtga

SEQ ID NO: 81907 - DNA, 25 bp, Homo sapien
cactcctggtgatgatatgggctga

SEQ ID NO: 81908 - DNA, 25 bp, Homo sapien
tatgggctgaaatgtctccacgtct

SEQ ID NO: 81909 - DNA, 25 bp, Homo sapien
acgtctctttgtgtcttgttgaaaa

SEQ ID NO: 81910 - DNA, 25 bp, Homo sapien
aaaaaaccttcagctgtgctaaaca

SEQ ID NO: 81911 - DNA, 25 bp, Homo sapien
tgtgctaaacagtatattacctctg

SEQ ID NO: 81912 - DNA, 25 bp, Homo sapien
attacctctgtataaaattcttcag

SEQ ID NO: 81913 - DNA, 25 bp, Homo sapien
aaattcttcagggagtgtcacctca

SEQ ID NO: 81914 - DNA, 25 bp, Homo sapien
ttcttcagggagtgtcacctcaaat

SEQ ID NO: 81915 - DNA, 25 bp, Homo sapien
tcagggagtgtcacctcaaatgcaa

SEQ ID NO: 81916 - DNA, 25 bp, Homo sapien
aatgcaatactttgggttggtttct

SEQ ID NO: 81917 - DNA, 25 bp, Homo sapien
atgggtacccatttgataagagaaa

SEQ ID NO: 81918 - DNA, 25 bp, Homo sapien
taaattctccattatgttcgtggtg

SEQ ID NO: 81919 - DNA, 25 bp, Homo sapien
tctccattatgttcgtggtgtaaag

SEQ ID NO: 81920 - DNA, 25 bp, Homo sapien
atgttcgtggtgtaaagtttagagc

SEQ ID NO: 81921 - DNA, 25 bp, Homo sapien
acttgttgcggaaacgacgagaaca

SEQ ID NO: 81922 - DNA, 25 bp, Homo sapien
gaaacacaaacttgaacagctacgg

SEQ ID NO: 81923 - DNA, 25 bp, Homo sapien
gaacagctacggaactcttgtgcgt

SEQ ID NO: 81924 - DNA, 25 bp, Homo sapien
cggaactcttgtgcgtaaggaaaag

SEQ ID NO: 81925 - DNA, 25 bp, Homo sapien
gaaatgtcctgagcaatcacctatg

SEQ ID NO: 81926 - DNA, 25 bp, Homo sapien
gagcaatcacctatgaacttgtttc

SEQ ID NO: 81927 - DNA, 25 bp, Homo sapien
aacttgtttcaaatgcatgatcaaa

SEQ ID NO: 81928 - DNA, 25 bp, Homo sapien
tgatcaaatgcaacctcacaacctt

SEQ ID NO: 81929 - DNA, 25 bp, Homo sapien
acaaccttggctgagtcttgagact

SEQ ID NO: 81930 - DNA, 25 bp, Homo sapien
gagactgaaagatttagccataatg

SEQ ID NO: 81931 - DNA, 25 bp, Homo sapien
aatgtaaactgcctcaaattggact

SEQ ID NO: 81932 - DNA, 25 bp, Homo sapien
tttcctagtttacctcgcgtgtgtt

SEQ ID NO: 81933 - DNA, 25 bp, Homo sapien
ttacctcgcgtgtgtttacctatat

SEQ ID NO: 81934 - DNA, 25 bp, Homo sapien
gtttacctatatggagtagctcgca

SEQ ID NO: 81935 - DNA, 25 bp, Homo sapien
tggagtagctcgcagagatcacaga

SEQ ID NO: 81936 - DNA, 25 bp, Homo sapien
gcctaaggcagggttttcagaccgt

SEQ ID NO: 81937 - DNA, 25 bp, Homo sapien
gaaatcaattagcaagtggtcacca

SEQ ID NO: 81938 - DNA, 25 bp, Homo sapien
gtggtcaccagcattacacagcaat

SEQ ID NO: 81939 - DNA, 25 bp, Homo sapien
gtaggccagaatgcatcatgtagta

SEQ ID NO: 81940 - DNA, 25 bp, Homo sapien
gtgaaacttttcacccatacatcta

SEQ ID NO: 81941 - DNA, 25 bp, Homo sapien
gagaactggttgcaatgtaagacat

SEQ ID NO: 81942 - DNA, 25 bp, Homo sapien
aagacatttcttgctgggaagttgt

SEQ ID NO: 81943 - DNA, 25 bp, Homo sapien
aacatgtgccccagatctggaaggg

SEQ ID NO: 81944 - DNA, 25 bp, Homo sapien
cctctctgccagtgtttgggtgggt

SEQ ID NO: 81945 - DNA, 25 bp, Homo sapien
tgtggagtcgaggagccaaccccag

SEQ ID NO: 81946 - DNA, 25 bp, Homo sapien
tgccaggatcacctcggcggtcaca

SEQ ID NO: 81947 - DNA, 25 bp, Homo sapien
ggcggtcacactccagccaaatagt

SEQ ID NO: 81948 - DNA, 25 bp, Homo sapien
actccagccaaatagtgttctcggg

SEQ ID NO: 81949 - DNA, 25 bp, Homo sapien
tatgtttctctggagattcctgcaa

SEQ ID NO: 81950 - DNA, 25 bp, Homo sapien
ctggagattcctgcaacctcaagag

SEQ ID NO: 81951 - DNA, 25 bp, Homo sapien
aacctcaagagacttcccaggcgct

SEQ ID NO: 81952 - DNA, 25 bp, Homo sapien
aggcgctcaggcctggatcttgctc

SEQ ID NO: 81953 - DNA, 25 bp, Homo sapien
cctggatcttgctcctctgtgagga

SEQ ID NO: 81954 - DNA, 25 bp, Homo sapien
tttctttcatcccatttatcccctt

SEQ ID NO: 81955 - DNA, 25 bp, Homo sapien
gtttacaattggtagatctgtctat

SEQ ID NO: 81956 - DNA, 25 bp, Homo sapien
aaatcacctaaatctgctttattag

SEQ ID NO: 81957 - DNA, 25 bp, Homo sapien
gctttattagactacagttcactta

SEQ ID NO: 81958 - DNA, 25 bp, Homo sapien
gactacagttcacttattgcataga

SEQ ID NO: 81959 - DNA, 25 bp, Homo sapien
ttgcatagaaactggacttggcttt

SEQ ID NO: 81960 - DNA, 25 bp, Homo sapien
ggacttggctttacattcttaatgt

SEQ ID NO: 81961 - DNA, 25 bp, Homo sapien
cttttcctcaagatatgaacttact

SEQ ID NO: 81962 - DNA, 25 bp, Homo sapien
gatatgaacttactctcttgaagct

SEQ ID NO: 81963 - DNA, 25 bp, Homo sapien
tgaacttactctcttgaagctgaat

SEQ ID NO: 81964 - DNA, 25 bp, Homo sapien
aaatcatttatgtatatctggtaaa

SEQ ID NO: 81965 - DNA, 25 bp, Homo sapien
ggaccctgtacagccgcagtatggg

SEQ ID NO: 81966 - DNA, 25 bp, Homo sapien
tggaccgtgcccaggtgaaggcttt

SEQ ID NO: 81967 - DNA, 25 bp, Homo sapien
ctcagcatctgctgcgaatctccgg

SEQ ID NO: 81968 - DNA, 25 bp, Homo sapien
gaatctccggcctcgagtcaaactc

SEQ ID NO: 81969 - DNA, 25 bp, Homo sapien
agatgccccgctagaagccgggagt

SEQ ID NO: 81970 - DNA, 25 bp, Homo sapien
gaagccgggagtggacagcatcctc

SEQ ID NO: 81971 - DNA, 25 bp, Homo sapien
gaattggagtgctcattagtggcaa

SEQ ID NO: 81972 - DNA, 25 bp, Homo sapien
gtgctcattagtggcaagaatccta

SEQ ID NO: 81973 - DNA, 25 bp, Homo sapien
gaatcctaaggcgaactttgcctgt

SEQ ID NO: 81974 - DNA, 25 bp, Homo sapien
ggcgaactttgcctgtttaagtgga

SEQ ID NO: 81975 - DNA, 25 bp, Homo sapien
ggaggagattagtcactgagataat

SEQ ID NO: 81976 - DNA, 25 bp, Homo sapien
atgcttacaaatttgacttccacgg

SEQ ID NO: 81977 - DNA, 25 bp, Homo sapien
acaaatttgacttccacggcattgc

SEQ ID NO: 81978 - DNA, 25 bp, Homo sapien
tgacttccacggcattgcccaggct

SEQ ID NO: 81979 - DNA, 25 bp, Homo sapien
gaccgagtcgtccatgtacaagtac

SEQ ID NO: 81980 - DNA, 25 bp, Homo sapien
tgtacaagtacccttctgacatctc

SEQ ID NO: 81981 - DNA, 25 bp, Homo sapien
gtacccttctgacatctcctacatg

SEQ ID NO: 81982 - DNA, 25 bp, Homo sapien
taccatgcccaccagcagaaggtga

SEQ ID NO: 81983 - DNA, 25 bp, Homo sapien
gaaggtgaactttgtccctccccat

SEQ ID NO: 81984 - DNA, 25 bp, Homo sapien
agcttctttggagccgcatcacaat

SEQ ID NO: 81985 - DNA, 25 bp, Homo sapien
ggagccgcatcacaatactggacct

SEQ ID NO: 81986 - DNA, 25 bp, Homo sapien
ttcacacttaggcagctactactag

SEQ ID NO: 81987 - DNA, 25 bp, Homo sapien
tccccggatcccaaggtggtctgtt

SEQ ID NO: 81988 - DNA, 25 bp, Homo sapien
ccggatcccaaggtggtctgttgct

SEQ ID NO: 81989 - DNA, 25 bp, Homo sapien
ggatcccaaggtggtctgttgctct

SEQ ID NO: 81990 - DNA, 25 bp, Homo sapien
atcccaaggtggtctgttgctctgg

SEQ ID NO: 81991 - DNA, 25 bp, Homo sapien
tcccaaggtggtctgttgctctggc

SEQ ID NO: 81992 - DNA, 25 bp, Homo sapien
tttcattgtcttaggccttcatgga

SEQ ID NO: 81993 - DNA, 25 bp, Homo sapien
ttcattgtcttaggccttcatggag

SEQ ID NO: 81994 - DNA, 25 bp, Homo sapien
ctgtttttgtgcctgtttgaagcta

SEQ ID NO: 81995 - DNA, 25 bp, Homo sapien
gtttttgtgcctgtttgaagctact

SEQ ID NO: 81996 - DNA, 25 bp, Homo sapien
tttgtgcctgtttgaagctactgct

SEQ ID NO: 81997 - DNA, 25 bp, Homo sapien
ttgtgcctgtttgaagctactgctg

SEQ ID NO: 81998 - DNA, 25 bp, Homo sapien
aacagccatggtgattgataccaca

SEQ ID NO: 81999 - DNA, 25 bp, Homo sapien
gataccacaggccatggttctgtag

SEQ ID NO: 82000 - DNA, 25 bp, Homo sapien
actttagggtcttcaggagccaagg

SEQ ID NO: 82001 - DNA, 25 bp, Homo sapien
ggtggctcggccaacaagcagtgaa

SEQ ID NO: 82002 - DNA, 25 bp, Homo sapien
gaagttgacagatttagcccctccg

SEQ ID NO: 82003 - DNA, 25 bp, Homo sapien
ggcagtgttgttcccttgacagaga

SEQ ID NO: 82004 - DNA, 25 bp, Homo sapien
agagccagaagtgagtctcctggga

SEQ ID NO: 82005 - DNA, 25 bp, Homo sapien
atggatgagcctaagcaacccagct

SEQ ID NO: 82006 - DNA, 25 bp, Homo sapien
aacccagctcccaggtatggagttg

SEQ ID NO: 82007 - DNA, 25 bp, Homo sapien
atttagaactgctttggtggttgga

SEQ ID NO: 82008 - DNA, 25 bp, Homo sapien
ttggaggaattgctactgtgtatga

SEQ ID NO: 82009 - DNA, 25 bp, Homo sapien
gcagtctactagattgtgatccctt

SEQ ID NO: 82010 - DNA, 25 bp, Homo sapien
actagattgtgatcccttgagatat

SEQ ID NO: 82011 - DNA, 25 bp, Homo sapien
cttgagatatggaaggatgcctttt

SEQ ID NO: 82012 - DNA, 25 bp, Homo sapien
gatgcctttttttctctgcatttaa

SEQ ID NO: 82013 - DNA, 25 bp, Homo sapien
cccacagtgcctattgatacttggg

SEQ ID NO: 82014 - DNA, 25 bp, Homo sapien
gagggtgcttggcacttattgaata

SEQ ID NO: 82015 - DNA, 25 bp, Homo sapien
cttattgaatatatgatcggccatc

SEQ ID NO: 82016 - DNA, 25 bp, Homo sapien
atcggccatcaagggaagaactatt

SEQ ID NO: 82017 - DNA, 25 bp, Homo sapien
gggaagaactattgtgctcagagac

SEQ ID NO: 82018 - DNA, 25 bp, Homo sapien
attgtgctcagagacactgttgata

SEQ ID NO: 82019 - DNA, 25 bp, Homo sapien
gacactgttgataaaaactcaggca

SEQ ID NO: 82020 - DNA, 25 bp, Homo sapien
gccccagcctctcagatggctgtga

SEQ ID NO: 82021 - DNA, 25 bp, Homo sapien
actgcactggccttcattgtctttt

SEQ ID NO: 82022 - DNA, 25 bp, Homo sapien
tgcactggccttcattgtctttttg

SEQ ID NO: 82023 - DNA, 25 bp, Homo sapien
actggccttcattgtctttttgctg

SEQ ID NO: 82024 - DNA, 25 bp, Homo sapien
tggccttcattgtctttttgctgca

SEQ ID NO: 82025 - DNA, 25 bp, Homo sapien
gccttcattgtctttttgctgcaca

SEQ ID NO: 82026 - DNA, 25 bp, Homo sapien
cttcattgtctttttgctgcacaac

SEQ ID NO: 82027 - DNA, 25 bp, Homo sapien
cattgtctttttgctgcacaaccta

SEQ ID NO: 82028 - DNA, 25 bp, Homo sapien
ttgtctttttgctgcacaacctaaa

SEQ ID NO: 82029 - DNA, 25 bp, Homo sapien
gtctttttgctgcacaacctaaaaa

SEQ ID NO: 82030 - DNA, 25 bp, Homo sapien
ttttgctgcacaacctaaaaaacca

SEQ ID NO: 82031 - DNA, 25 bp, Homo sapien
cggaccctgtacagccgcagtatgg

SEQ ID NO: 82032 - DNA, 25 bp, Homo sapien
ggaccctgtacagccgcagtatggg

SEQ ID NO: 82033 - DNA, 25 bp, Homo sapien
cctgtacagccgcagtatggggcat

SEQ ID NO: 82034 - DNA, 25 bp, Homo sapien
ctgtacagccgcagtatggggcatg

SEQ ID NO: 82035 - DNA, 25 bp, Homo sapien
cagccgcagtatggggcatggctca

SEQ ID NO: 82036 - DNA, 25 bp, Homo sapien
tggaccgtgcccaggtgaaggcttt

SEQ ID NO: 82037 - DNA, 25 bp, Homo sapien
ctcagcatctgctgcgaatctccgg

SEQ ID NO: 82038 - DNA, 25 bp, Homo sapien
tcagcatctgctgcgaatctccggc

SEQ ID NO: 82039 - DNA, 25 bp, Homo sapien
agcatctgctgcgaatctccggcct

SEQ ID NO: 82040 - DNA, 25 bp, Homo sapien
gcatctgctgcgaatctccggcctc

SEQ ID NO: 82041 - DNA, 25 bp, Homo sapien
catctgctgcgaatctccggcctcg

SEQ ID NO: 82042 - DNA, 25 bp, Homo sapien
gtgcatctgccctgcgccgggacgt

SEQ ID NO: 82043 - DNA, 25 bp, Homo sapien
gtgtctgaccgcgtgcgcagcattg

SEQ ID NO: 82044 - DNA, 25 bp, Homo sapien
tgaccgcgtgcgcagcattgccaag

SEQ ID NO: 82045 - DNA, 25 bp, Homo sapien
gcgtgcgcagcattgccaaggacgt

SEQ ID NO: 82046 - DNA, 25 bp, Homo sapien
cagcattgccaaggacgtggccctg

SEQ ID NO: 82047 - DNA, 25 bp, Homo sapien
gtggccctggcctgcaagacctctg

SEQ ID NO: 82048 - DNA, 25 bp, Homo sapien
ggcctgcaagacctctgagacggta

SEQ ID NO: 82049 - DNA, 25 bp, Homo sapien
aagacctctgagacggtaccgcggc

SEQ ID NO: 82050 - DNA, 25 bp, Homo sapien
tctgagacggtaccgcggcccgcat

SEQ ID NO: 82051 - DNA, 25 bp, Homo sapien
taccgcggcccgcatgactaggcgt

SEQ ID NO: 82052 - DNA, 25 bp, Homo sapien
atgactaggcgtggacctgcccatg

SEQ ID NO: 82053 - DNA, 25 bp, Homo sapien
gatacagcagttacccccttatcca

SEQ ID NO: 82054 - DNA, 25 bp, Homo sapien
gggatacagtggatatctaaaacca

SEQ ID NO: 82055 - DNA, 25 bp, Homo sapien
ggatacagtggatatctaaaaccag

SEQ ID NO: 82056 - DNA, 25 bp, Homo sapien
gatacagtggatatctaaaaccaga

SEQ ID NO: 82057 - DNA, 25 bp, Homo sapien
tacagtggatatctaaaaccagacc

SEQ ID NO: 82058 - DNA, 25 bp, Homo sapien
acagtggatatctaaaaccagaccc

SEQ ID NO: 82059 - DNA, 25 bp, Homo sapien
cagtggatatctaaaaccagacccc

SEQ ID NO: 82060 - DNA, 25 bp, Homo sapien
gtggatatctaaaaccagaccccca

SEQ ID NO: 82061 - DNA, 25 bp, Homo sapien
ggatatctaaaaccagacccccagt

SEQ ID NO: 82062 - DNA, 25 bp, Homo sapien
atatctaaaaccagacccccagtgg

SEQ ID NO: 82063 - DNA, 25 bp, Homo sapien
atctaaaaccagacccccagtggat

SEQ ID NO: 82064 - DNA, 25 bp, Homo sapien
ctggctgcctgctaagggcccatgt

SEQ ID NO: 82065 - DNA, 25 bp, Homo sapien
ggctgcctgctaagggcccatgtga

SEQ ID NO: 82066 - DNA, 25 bp, Homo sapien
gctgcctgctaagggcccatgtgat

SEQ ID NO: 82067 - DNA, 25 bp, Homo sapien
ctgctaagggcccatgtgatctgcc

SEQ ID NO: 82068 - DNA, 25 bp, Homo sapien
tgctaagggcccatgtgatctgcct

SEQ ID NO: 82069 - DNA, 25 bp, Homo sapien
gctaagggcccatgtgatctgcctg

SEQ ID NO: 82070 - DNA, 25 bp, Homo sapien
ggccaatgcccttgctgtgagaagt

SEQ ID NO: 82071 - DNA, 25 bp, Homo sapien
gccaatgcccttgctgtgagaagtc

SEQ ID NO: 82072 - DNA, 25 bp, Homo sapien
gagacctgatctggctgtgccagat

SEQ ID NO: 82073 - DNA, 25 bp, Homo sapien
acctgatctggctgtgccagatgga

SEQ ID NO: 82074 - DNA, 25 bp, Homo sapien
tctggctgtgccagatggacactga

SEQ ID NO: 82075 - DNA, 25 bp, Homo sapien
gctttaattgtgctgtcgttcatga

SEQ ID NO: 82076 - DNA, 25 bp, Homo sapien
ttaattgtgctgtcgttcatgaaac

SEQ ID NO: 82077 - DNA, 25 bp, Homo sapien
tcgttcatgaaacagagctgctctg

SEQ ID NO: 82078 - DNA, 25 bp, Homo sapien
gaaacagagctgctctgcttttctg

SEQ ID NO: 82079 - DNA, 25 bp, Homo sapien
tctgcttttctgtcagagatggcaa

SEQ ID NO: 82080 - DNA, 25 bp, Homo sapien
ttctgtcagagatggcaagggcttt

SEQ ID NO: 82081 - DNA, 25 bp, Homo sapien
gtcagagatggcaagggctttttca

SEQ ID NO: 82082 - DNA, 25 bp, Homo sapien
aagggctttttcagcatctcgttta

SEQ ID NO: 82083 - DNA, 25 bp, Homo sapien
ggctttttcagcatctcgtttatgt

SEQ ID NO: 82084 - DNA, 25 bp, Homo sapien
ttcagcatctcgtttatgtgtggaa

SEQ ID NO: 82085 - DNA, 25 bp, Homo sapien
gcatctcgtttatgtgtggaattta

SEQ ID NO: 82086 - DNA, 25 bp, Homo sapien
gaatccgagagaaaaaagagtagtc

SEQ ID NO: 82087 - DNA, 25 bp, Homo sapien
aatccgagagaaaaaagagtagtca

SEQ ID NO: 82088 - DNA, 25 bp, Homo sapien
atccgagagaaaaaagagtagtcat

SEQ ID NO: 82089 - DNA, 25 bp, Homo sapien
tccgagagaaaaaagagtagtcata

SEQ ID NO: 82090 - DNA, 25 bp, Homo sapien
ccgagagaaaaaagagtagtcatag

SEQ ID NO: 82091 - DNA, 25 bp, Homo sapien
cgagagaaaaaagagtagtcatagg

SEQ ID NO: 82092 - DNA, 25 bp, Homo sapien
gaaataggcaccgcagctgggacca

SEQ ID NO: 82093 - DNA, 25 bp, Homo sapien
gcagctgggaccagggccgccggag

SEQ ID NO: 82094 - DNA, 25 bp, Homo sapien
cagctgggaccagggccgccggagc

SEQ ID NO: 82095 - DNA, 25 bp, Homo sapien
agctgggaccagggccgccggagcc

SEQ ID NO: 82096 - DNA, 25 bp, Homo sapien
gctgggaccagggccgccggagcca

SEQ ID NO: 82097 - DNA, 25 bp, Homo sapien
tgtccccagcaaactgaatccggtt

SEQ ID NO: 82098 - DNA, 25 bp, Homo sapien
ttcctctccacttttcaatactgaa

SEQ ID NO: 82099 - DNA, 25 bp, Homo sapien
agggagcagagcttttccctagcac

SEQ ID NO: 82100 - DNA, 25 bp, Homo sapien
cagtctctgcagaagccccagagaa

SEQ ID NO: 82101 - DNA, 25 bp, Homo sapien
gagaatctaactcatgcctgtccag

SEQ ID NO: 82102 - DNA, 25 bp, Homo sapien
atgcctgtccagtctacagcaaaaa

SEQ ID NO: 82103 - DNA, 25 bp, Homo sapien
ttattgagtgcctgttgcatacagg

SEQ ID NO: 82104 - DNA, 25 bp, Homo sapien
aggcacaatcctaggcaccggcaaa

SEQ ID NO: 82105 - DNA, 25 bp, Homo sapien
taggcaccggcaaatacagacaata

SEQ ID NO: 82106 - DNA, 25 bp, Homo sapien
tacagacaatagaccaaagtccctg

SEQ ID NO: 82107 - DNA, 25 bp, Homo sapien
gccctcgaggagctttcattctgat

SEQ ID NO: 82108 - DNA, 25 bp, Homo sapien
ctgaaggcccgtcaggtttgccctg

SEQ ID NO: 82109 - DNA, 25 bp, Homo sapien
aggtttgccctgcaaggccttctag

SEQ ID NO: 82110 - DNA, 25 bp, Homo sapien
tgcaaggccttctagcattctgctt

SEQ ID NO: 82111 - DNA, 25 bp, Homo sapien
gccttctagcattctgcttcctggg

SEQ ID NO: 82112 - DNA, 25 bp, Homo sapien
ggagaaggccctccttgctatctgg

SEQ ID NO: 82113 - DNA, 25 bp, Homo sapien
tccttgctatctgggctgagtggcc

SEQ ID NO: 82114 - DNA, 25 bp, Homo sapien
gtgcccaactgtagcccttctaggg

SEQ ID NO: 82115 - DNA, 25 bp, Homo sapien
gggctcattggcagcacttgcagct

SEQ ID NO: 82116 - DNA, 25 bp, Homo sapien
gcacttgcagcttgctggcacttaa

SEQ ID NO: 82117 - DNA, 25 bp, Homo sapien
agcttgctggcacttaaaagtcatt

SEQ ID NO: 82118 - DNA, 25 bp, Homo sapien
aaagtcattagtgcggttactgaga

SEQ ID NO: 82119 - DNA, 25 bp, Homo sapien
aagaacaagatgagtgacggcaaga

SEQ ID NO: 82120 - DNA, 25 bp, Homo sapien
gtgacggcaagaaggaggagctcca

SEQ ID NO: 82121 - DNA, 25 bp, Homo sapien
ggagctccagaagagcttaaacatc

SEQ ID NO: 82122 - DNA, 25 bp, Homo sapien
gctccagaagagcttaaacatcctg

SEQ ID NO: 82123 - DNA, 25 bp, Homo sapien
agaagagcttaaacatcctgactgc

SEQ ID NO: 82124 - DNA, 25 bp, Homo sapien
aagagcttaaacatcctgactgcct

SEQ ID NO: 82125 - DNA, 25 bp, Homo sapien
agagcttaaacatcctgactgcctt

SEQ ID NO: 82126 - DNA, 25 bp, Homo sapien
gagcttaaacatcctgactgccttc

SEQ ID NO: 82127 - DNA, 25 bp, Homo sapien
gagttaacctgctggctgtgagtcc

SEQ ID NO: 82128 - DNA, 25 bp, Homo sapien
gctgtgagtcccttgtggaatataa

SEQ ID NO: 82129 - DNA, 25 bp, Homo sapien
tgtgagtcccttgtggaatataagg

SEQ ID NO: 82130 - DNA, 25 bp, Homo sapien
ggatacgtccatctttttaagggat

SEQ ID NO: 82131 - DNA, 25 bp, Homo sapien
gggattgctttcatctaattctggc

SEQ ID NO: 82132 - DNA, 25 bp, Homo sapien
atctaattctggcaggacctcacca

SEQ ID NO: 82133 - DNA, 25 bp, Homo sapien
aggacctcaccaaaagatccagcct

SEQ ID NO: 82134 - DNA, 25 bp, Homo sapien
aaaagatccagcctcatacctacat

SEQ ID NO: 82135 - DNA, 25 bp, Homo sapien
agcctcatacctacatcagacaaaa

SEQ ID NO: 82136 - DNA, 25 bp, Homo sapien
aaaatatcgccgttgttccttctgt

SEQ ID NO: 82137 - DNA, 25 bp, Homo sapien
gccgttgttccttctgtactaaagt

SEQ ID NO: 82138 - DNA, 25 bp, Homo sapien
gttttgctttggaaacacccactca

SEQ ID NO: 82139 - DNA, 25 bp, Homo sapien
acccactcactttgcaatagccgtg

SEQ ID NO: 82140 - DNA, 25 bp, Homo sapien
gaatgcagattacactgatcttatg

SEQ ID NO: 82141 - DNA, 25 bp, Homo sapien
gtggaacagaataacttatctgatc

SEQ ID NO: 82142 - DNA, 25 bp, Homo sapien
ttatctgatctcataaaagtggtga

SEQ ID NO: 82143 - DNA, 25 bp, Homo sapien
aagacactcctgatggatgctctta

SEQ ID NO: 82144 - DNA, 25 bp, Homo sapien
actcctgatggatgctcttaaagaa

SEQ ID NO: 82145 - DNA, 25 bp, Homo sapien
taatctatgacttttgcatgtgcaa

SEQ ID NO: 82146 - DNA, 25 bp, Homo sapien
attggaagccaagggagtaaactca

SEQ ID NO: 82147 - DNA, 25 bp, Homo sapien
gggagtaaactcacgaaatcctcga

SEQ ID NO: 82148 - DNA, 25 bp, Homo sapien
aactcacgaaatcctcgaagacctc

SEQ ID NO: 82149 - DNA, 25 bp, Homo sapien
gaagacctccgcctagttctgttaa

SEQ ID NO: 82150 - DNA, 25 bp, Homo sapien
gacctccgcctagttctgttaatac

SEQ ID NO: 82151 - DNA, 25 bp, Homo sapien
tctgttaatacaggagactcgcttg

SEQ ID NO: 82152 - DNA, 25 bp, Homo sapien
tgttctctgcgcatttcagacacag

SEQ ID NO: 82153 - DNA, 25 bp, Homo sapien
tgcgcatttcagacacagcctgtgt

SEQ ID NO: 82154 - DNA, 25 bp, Homo sapien
tcagacacagcctgtgtggcgagga

SEQ ID NO: 82155 - DNA, 25 bp, Homo sapien
gtgacggcaggagccacgggtgcaa

SEQ ID NO: 82156 - DNA, 25 bp, Homo sapien
ggtgcaagcccgtgtgtctggcctc

SEQ ID NO: 82157 - DNA, 25 bp, Homo sapien
tggcctctttcctcgtgaagacgat

SEQ ID NO: 82158 - DNA, 25 bp, Homo sapien
tgaagacgatgtgtccccgccagaa

SEQ ID NO: 82159 - DNA, 25 bp, Homo sapien
ccgccagaaaaagtgggctccttct

SEQ ID NO: 82160 - DNA, 25 bp, Homo sapien
tgagcccaggctgcgtagtgaccac

SEQ ID NO: 82161 - DNA, 25 bp, Homo sapien
ggctgcgtagtgaccacaagcttat

SEQ ID NO: 82162 - DNA, 25 bp, Homo sapien
tgggggtgtctaaatttcctttcat

SEQ ID NO: 82163 - DNA, 25 bp, Homo sapien
gggacaccaacaaatctaagccctc

SEQ ID NO: 82164 - DNA, 25 bp, Homo sapien
taagccctccctagctgcttggtaa

SEQ ID NO: 82165 - DNA, 25 bp, Homo sapien
tagctgcttggtaactgtgtcatga

SEQ ID NO: 82166 - DNA, 25 bp, Homo sapien
taactgtgtcatgaagctgccggac

SEQ ID NO: 82167 - DNA, 25 bp, Homo sapien
aagctgccggacagacacacgtggc

SEQ ID NO: 82168 - DNA, 25 bp, Homo sapien
gacagacacacgtggcatctccctg

SEQ ID NO: 82169 - DNA, 25 bp, Homo sapien
tgcagcatgggtcctgttcccgtgt

SEQ ID NO: 82170 - DNA, 25 bp, Homo sapien
agtggctgcacctggcactagggct

SEQ ID NO: 82171 - DNA, 25 bp, Homo sapien
cacctggcactagggctgctctgtg

SEQ ID NO: 82172 - DNA, 25 bp, Homo sapien
ttcctgcacatagacctgcagttag

SEQ ID NO: 82173 - DNA, 25 bp, Homo sapien
tgcagttagtaaatcataagcccaa

SEQ ID NO: 82174 - DNA, 25 bp, Homo sapien
aggaactgaaagagcctctccataa

SEQ ID NO: 82175 - DNA, 25 bp, Homo sapien
gagcctctccataaagcattgcaaa

SEQ ID NO: 82176 - DNA, 25 bp, Homo sapien
aagcattgcaaatgctcctgagcca

SEQ ID NO: 82177 - DNA, 25 bp, Homo sapien
gcctctggttttgctacgacaaatg

SEQ ID NO: 82178 - DNA, 25 bp, Homo sapien
gtcaagaacctttgagcgcactgct

SEQ ID NO: 82179 - DNA, 25 bp, Homo sapien
aacctttgagcgcactgctgcagtt

SEQ ID NO: 82180 - DNA, 25 bp, Homo sapien
actgctgcagtttggcgtgacatac

SEQ ID NO: 82181 - DNA, 25 bp, Homo sapien
tttggcgtgacatacctggaggact

SEQ ID NO: 82182 - DNA, 25 bp, Homo sapien
catacctggaggactattcggcaga

SEQ ID NO: 82183 - DNA, 25 bp, Homo sapien
aggactattcggcagagtacatcat

SEQ ID NO: 82184 - DNA, 25 bp, Homo sapien
gagtacatcattcagcaaggtggct

SEQ ID NO: 82185 - DNA, 25 bp, Homo sapien
tcggatgtgccctagaaaatactcg

SEQ ID NO: 82186 - DNA, 25 bp, Homo sapien
aaatactcgggactgcgaacgcagc

SEQ ID NO: 82187 - DNA, 25 bp, Homo sapien
gcgaacgcagctgccgatgatcaaa

SEQ ID NO: 82188 - DNA, 25 bp, Homo sapien
gatgatcaaaactcccgccttacct

SEQ ID NO: 82189 - DNA, 25 bp, Homo sapien
tgcggtggcagcactgacatgcctg

SEQ ID NO: 82190 - DNA, 25 bp, Homo sapien
gcgggagtttttgcatgtcgacctg

SEQ ID NO: 82191 - DNA, 25 bp, Homo sapien
ttgcatgtcgacctgtgcgcagcca

SEQ ID NO: 82192 - DNA, 25 bp, Homo sapien
ggccgcgcacaatgacgtgacgtga

SEQ ID NO: 82193 - DNA, 25 bp, Homo sapien
gacgaaaatcgtcacttgccgcgac

SEQ ID NO: 82194 - DNA, 25 bp, Homo sapien
ccgcgactgccgcacataatgatcg

SEQ ID NO: 82195 - DNA, 25 bp, Homo sapien
taatgatcgccccagaaccgaaacg

SEQ ID NO: 82196 - DNA, 25 bp, Homo sapien
tttctgcaaaacagccaatgctgtg

SEQ ID NO: 82197 - DNA, 25 bp, Homo sapien
caatgctgtgacaaagtggcagctt

SEQ ID NO: 82198 - DNA, 25 bp, Homo sapien
gcagcttggtgattatccacagaag

SEQ ID NO: 82199 - DNA, 25 bp, Homo sapien
accccattgcagcagccatactttt

SEQ ID NO: 82200 - DNA, 25 bp, Homo sapien
agcagccatacttttgaccatccta

SEQ ID NO: 82201 - DNA, 25 bp, Homo sapien
ttttgaccatcctagccctgtgtgc

SEQ ID NO: 82202 - DNA, 25 bp, Homo sapien
ccccaggctgaaaatcggaggcaat

SEQ ID NO: 82203 - DNA, 25 bp, Homo sapien
gatgaagtttctggccctacctgga

SEQ ID NO: 82204 - DNA, 25 bp, Homo sapien
tacctggacccagcagaatcaaagt

SEQ ID NO: 82205 - DNA, 25 bp, Homo sapien
aagtggatccagtgtcagctccagc

SEQ ID NO: 82206 - DNA, 25 bp, Homo sapien
gctccagcctattcaatttcaattt

SEQ ID NO: 82207 - DNA, 25 bp, Homo sapien
tccttggcacctagaggaattagcc

SEQ ID NO: 82208 - DNA, 25 bp, Homo sapien
ggaattagccattctcttccttatg

SEQ ID NO: 82209 - DNA, 25 bp, Homo sapien
agccattctcttccttatgcaaaga

SEQ ID NO: 82210 - DNA, 25 bp, Homo sapien
atataaagaagagaagtccccagat

SEQ ID NO: 82211 - DNA, 25 bp, Homo sapien
gaagtccccagatggtagagagcag

SEQ ID NO: 82212 - DNA, 25 bp, Homo sapien
agagagcagtcatatcttaccccta

SEQ ID NO: 82213 - DNA, 25 bp, Homo sapien
atatcttacccctagatgttcatcc

SEQ ID NO: 82214 - DNA, 25 bp, Homo sapien
aggattcttcagaggttagcctggt

SEQ ID NO: 82215 - DNA, 25 bp, Homo sapien
aggttagcctggtactttctcatca

SEQ ID NO: 82216 - DNA, 25 bp, Homo sapien
tggtactttctcatcagacactagc

SEQ ID NO: 82217 - DNA, 25 bp, Homo sapien
atcagacactagcttgaagtaagag

SEQ ID NO: 82218 - DNA, 25 bp, Homo sapien
ttttgtgtagcaataggtagctgac

SEQ ID NO: 82219 - DNA, 25 bp, Homo sapien
agcaataggtagctgacaatgcaca

SEQ ID NO: 82220 - DNA, 25 bp, Homo sapien
gataattaaccctaatgctagtttc

SEQ ID NO: 82221 - DNA, 25 bp, Homo sapien
taatgctagtttcattcatccatca

SEQ ID NO: 82222 - DNA, 25 bp, Homo sapien
gtgatattctacttctgtcttcctt

SEQ ID NO: 82223 - DNA, 25 bp, Homo sapien
atattctacttctgtcttccttcat

SEQ ID NO: 82224 - DNA, 25 bp, Homo sapien
tctacttctgtcttccttcattatt

SEQ ID NO: 82225 - DNA, 25 bp, Homo sapien
gttccttcattaactctttggtcat

SEQ ID NO: 82226 - DNA, 25 bp, Homo sapien
aactctttggtcatgttgaggtaca

SEQ ID NO: 82227 - DNA, 25 bp, Homo sapien
ggtcatgttgaggtacagtttgcat

SEQ ID NO: 82228 - DNA, 25 bp, Homo sapien
tgttgaggtacagtttgcataggaa

SEQ ID NO: 82229 - DNA, 25 bp, Homo sapien
cagaggtcaaactccaaagtgggaa

SEQ ID NO: 82230 - DNA, 25 bp, Homo sapien
agtagggaacctgaacctgcggctg

SEQ ID NO: 82231 - DNA, 25 bp, Homo sapien
ggccgaggagtcagcaactgtctca

SEQ ID NO: 82232 - DNA, 25 bp, Homo sapien
cccatgagccccacaagaagacgag

SEQ ID NO: 82233 - DNA, 25 bp, Homo sapien
agaagacgagccctggaccattatc

SEQ ID NO: 82234 - DNA, 25 bp, Homo sapien
tggaccattatctcacccttcgaag

SEQ ID NO: 82235 - DNA, 25 bp, Homo sapien
acccttcgaagctctggatggatcc

SEQ ID NO: 82236 - DNA, 25 bp, Homo sapien
tggatcccagatggacgaggtcgat

SEQ ID NO: 82237 - DNA, 25 bp, Homo sapien
atgaggaggaaccacctgatctccc

SEQ ID NO: 82238 - DNA, 25 bp, Homo sapien
cttggactgatacccttttcccatt

SEQ ID NO: 82239 - DNA, 25 bp, Homo sapien
cccttttcccattcattcacaaata

SEQ ID NO: 82240 - DNA, 25 bp, Homo sapien
catctccccatctgcggccgacgtg

SEQ ID NO: 82241 - DNA, 25 bp, Homo sapien
gtgctggtggccaggtacatgtcca

SEQ ID NO: 82242 - DNA, 25 bp, Homo sapien
tgctggtggccaggtacatgtccag

SEQ ID NO: 82243 - DNA, 25 bp, Homo sapien
ggtacatgtccagggccgccgggtc

SEQ ID NO: 82244 - DNA, 25 bp, Homo sapien
cctgcacctaagtctgagccagctg

SEQ ID NO: 82245 - DNA, 25 bp, Homo sapien
tgagcccatcccagggacggcccag

SEQ ID NO: 82246 - DNA, 25 bp, Homo sapien
cggcccagcccgtgaagaggagcct

SEQ ID NO: 82247 - DNA, 25 bp, Homo sapien
gcccagcccgtgaagaggagcctgg

SEQ ID NO: 82248 - DNA, 25 bp, Homo sapien
gggcaaggtgcccaagtggctgaag

SEQ ID NO: 82249 - DNA, 25 bp, Homo sapien
agcaagaggtgagagctgccagcct

SEQ ID NO: 82250 - DNA, 25 bp, Homo sapien
acctcctctgccagcaggaataaag

SEQ ID NO: 82251 - DNA, 25 bp, Homo sapien
aatatcatatcactgtatcttctca

SEQ ID NO: 82252 - DNA, 25 bp, Homo sapien
gtatcttctcagtcatttctgaatc

SEQ ID NO: 82253 - DNA, 25 bp, Homo sapien
ttctgaatctttccacattatatta

SEQ ID NO: 82254 - DNA, 25 bp, Homo sapien
tggaaatgtcagtttatctcccctc

SEQ ID NO: 82255 - DNA, 25 bp, Homo sapien
tcccctcctcagtatatctgatttg

SEQ ID NO: 82256 - DNA, 25 bp, Homo sapien
tgagcttctctctacaacatttcta

SEQ ID NO: 82257 - DNA, 25 bp, Homo sapien
tgtttaactgtttgactcttatgat

SEQ ID NO: 82258 - DNA, 25 bp, Homo sapien
gactcttatgatacttcttggaaac

SEQ ID NO: 82259 - DNA, 25 bp, Homo sapien
tagacttttgcctaagtggcttagc

SEQ ID NO: 82260 - DNA, 25 bp, Homo sapien
ttagctgggtctttcatagccaaac

SEQ ID NO: 82261 - DNA, 25 bp, Homo sapien
gggtctttcatagccaaacttgtat

SEQ ID NO: 82262 - DNA, 25 bp, Homo sapien
gtctcacgccgtgtttgagatcacc

SEQ ID NO: 82263 - DNA, 25 bp, Homo sapien
agatcaccgcctcatcagtatgcat

SEQ ID NO: 82264 - DNA, 25 bp, Homo sapien
gtacctgggtaagagacttgctttc

SEQ ID NO: 82265 - DNA, 25 bp, Homo sapien
ttgctttccaggttcgcactttcag

SEQ ID NO: 82266 - DNA, 25 bp, Homo sapien
aggttcgcactttcaggtgtagctg

SEQ ID NO: 82267 - DNA, 25 bp, Homo sapien
gtcgaattgttttagtaggtcctca

SEQ ID NO: 82268 - DNA, 25 bp, Homo sapien
ggaataaccacacagctgtttgttt

SEQ ID NO: 82269 - DNA, 25 bp, Homo sapien
gtttgtttaaatgctactgtaccta

SEQ ID NO: 82270 - DNA, 25 bp, Homo sapien
gctactgtacctatcaaaactattg

SEQ ID NO: 82271 - DNA, 25 bp, Homo sapien
gtatttttatacactgctaatctaa

SEQ ID NO: 82272 - DNA, 25 bp, Homo sapien
gtatttcagattgtgcctgtcataa

SEQ ID NO: 82273 - DNA, 25 bp, Homo sapien
actgcaacttttgtattcacaggca

SEQ ID NO: 82274 - DNA, 25 bp, Homo sapien
gcaacttttgtattcacaggcatcc

SEQ ID NO: 82275 - DNA, 25 bp, Homo sapien
aacttttgtattcacaggcatccca

SEQ ID NO: 82276 - DNA, 25 bp, Homo sapien
acttttgtattcacaggcatcccat

SEQ ID NO: 82277 - DNA, 25 bp, Homo sapien
cttttgtattcacaggcatcccatc

SEQ ID NO: 82278 - DNA, 25 bp, Homo sapien
ttttgtattcacaggcatcccatct

SEQ ID NO: 82279 - DNA, 25 bp, Homo sapien
tttgtattcacaggcatcccatctc

SEQ ID NO: 82280 - DNA, 25 bp, Homo sapien
tgtattcacaggcatcccatctcca

SEQ ID NO: 82281 - DNA, 25 bp, Homo sapien
gtattcacaggcatcccatctccat

SEQ ID NO: 82282 - DNA, 25 bp, Homo sapien
aaatcttaggagataaacacattca

SEQ ID NO: 82283 - DNA, 25 bp, Homo sapien
ggagataaacacattcaaaaaggaa

SEQ ID NO: 82284 - DNA, 25 bp, Homo sapien
ggtgaccttggctgtgtacgtccca

SEQ ID NO: 82285 - DNA, 25 bp, Homo sapien
gtgaccttggctgtgtacgtcccag

SEQ ID NO: 82286 - DNA, 25 bp, Homo sapien
accttggctgtgtacgtcccagcaa

SEQ ID NO: 82287 - DNA, 25 bp, Homo sapien
cttggctgtgtacgtcccagcaaaa

SEQ ID NO: 82288 - DNA, 25 bp, Homo sapien
ttggctgtgtacgtcccagcaaaag

SEQ ID NO: 82289 - DNA, 25 bp, Homo sapien
ggctgtgtacgtcccagcaaaagag

SEQ ID NO: 82290 - DNA, 25 bp, Homo sapien
ctgtgtacgtcccagcaaaagagct

SEQ ID NO: 82291 - DNA, 25 bp, Homo sapien
tgtgtacgtcccagcaaaagagctc

SEQ ID NO: 82292 - DNA, 25 bp, Homo sapien
aaagagctctggcccgcatctcgct

SEQ ID NO: 82293 - DNA, 25 bp, Homo sapien
ccgcatctcgctgtgccctgaaggg

SEQ ID NO: 82294 - DNA, 25 bp, Homo sapien
agggtagggaccgtgtacagcttga

SEQ ID NO: 82295 - DNA, 25 bp, Homo sapien
tagaagaggcacactggacagacct

SEQ ID NO: 82296 - DNA, 25 bp, Homo sapien
cctgctggagacctgatcctcagtg

SEQ ID NO: 82297 - DNA, 25 bp, Homo sapien
ctgctggagacctgatcctcagtgt

SEQ ID NO: 82298 - DNA, 25 bp, Homo sapien
tgctggagacctgatcctcagtgtc

SEQ ID NO: 82299 - DNA, 25 bp, Homo sapien
gctggagacctgatcctcagtgtcc

SEQ ID NO: 82300 - DNA, 25 bp, Homo sapien
tggagacctgatcctcagtgtcctt

SEQ ID NO: 82301 - DNA, 25 bp, Homo sapien
ggagacctgatcctcagtgtcctta

SEQ ID NO: 82302 - DNA, 25 bp, Homo sapien
gagacctgatcctcagtgtccttac

SEQ ID NO: 82303 - DNA, 25 bp, Homo sapien
agacctgatcctcagtgtccttacc

SEQ ID NO: 82304 - DNA, 25 bp, Homo sapien
acctcttttctgtgccacctgctgt

SEQ ID NO: 82305 - DNA, 25 bp, Homo sapien
attagaagaggcacactggacagac

SEQ ID NO: 82306 - DNA, 25 bp, Homo sapien
cagaggacaccctgcagtcgctggt

SEQ ID NO: 82307 - DNA, 25 bp, Homo sapien
tgcagtcgctggtccacatcaaagc

SEQ ID NO: 82308 - DNA, 25 bp, Homo sapien
aaagccacactcgagtatgacctgg

SEQ ID NO: 82309 - DNA, 25 bp, Homo sapien
gtatgacctggctgtcaaagccaat

SEQ ID NO: 82310 - DNA, 25 bp, Homo sapien
aattccctgtacatcgaccaggaaa

SEQ ID NO: 82311 - DNA, 25 bp, Homo sapien
tgagcatgcgcaagagctaccccaa

SEQ ID NO: 82312 - DNA, 25 bp, Homo sapien
tggtcggcttctgctagggacccca

SEQ ID NO: 82313 - DNA, 25 bp, Homo sapien
ttttgatacccctaagttaaggctg

SEQ ID NO: 82314 - DNA, 25 bp, Homo sapien
agttaaggctgagccagagcactgt

SEQ ID NO: 82315 - DNA, 25 bp, Homo sapien
gcactgtctcagcatttgaaccgaa

SEQ ID NO: 82316 - DNA, 25 bp, Homo sapien
gaaccgaatgctaatatagtcactt

SEQ ID NO: 82317 - DNA, 25 bp, Homo sapien
ggaagtctcgtccacagctaccaag

SEQ ID NO: 82318 - DNA, 25 bp, Homo sapien
cgccagcgcgtctgatggctctgtg

SEQ ID NO: 82319 - DNA, 25 bp, Homo sapien
gtgtgttctggatctgtgaaagtaa

SEQ ID NO: 82320 - DNA, 25 bp, Homo sapien
gggttgcagctctgttcaaacacaa

SEQ ID NO: 82321 - DNA, 25 bp, Homo sapien
gttcaaacacaattctatcagctcc

SEQ ID NO: 82322 - DNA, 25 bp, Homo sapien
aattctatcagctccaaaatgtgtg

SEQ ID NO: 82323 - DNA, 25 bp, Homo sapien
gctccaaaatgtgtgaacttgactt

SEQ ID NO: 82324 - DNA, 25 bp, Homo sapien
acttgacttgtgttagagtatattc

SEQ ID NO: 82325 - DNA, 25 bp, Homo sapien
gtatattctgaaaccaacttgtccc

SEQ ID NO: 82326 - DNA, 25 bp, Homo sapien
attctgaaaccaacttgtcccaggc

SEQ ID NO: 82327 - DNA, 25 bp, Homo sapien
gaaaccaacttgtcccaggccacag

SEQ ID NO: 82328 - DNA, 25 bp, Homo sapien
tgcagagtccaggatcccccaggaa

SEQ ID NO: 82329 - DNA, 25 bp, Homo sapien
caggaacttccactgattgctacct

SEQ ID NO: 82330 - DNA, 25 bp, Homo sapien
ttccactgattgctacctgttacca

SEQ ID NO: 82331 - DNA, 25 bp, Homo sapien
agaagaattgcccaagccacaagaa

SEQ ID NO: 82332 - DNA, 25 bp, Homo sapien
caagaaaaagccaccttgaccactt

SEQ ID NO: 82333 - DNA, 25 bp, Homo sapien
gccaccttgaccacttttgtggtga

SEQ ID NO: 82334 - DNA, 25 bp, Homo sapien
gaagaccactggagattgcactact

SEQ ID NO: 82335 - DNA, 25 bp, Homo sapien
gagattgcactactgaccaccaaga

SEQ ID NO: 82336 - DNA, 25 bp, Homo sapien
gacagagacacaatagcgaatctag

SEQ ID NO: 82337 - DNA, 25 bp, Homo sapien
gcagctgttaagatgtctgggaata

SEQ ID NO: 82338 - DNA, 25 bp, Homo sapien
gggaatagacacacaaactctctct

SEQ ID NO: 82339 - DNA, 25 bp, Homo sapien
ttgcaaaattcctgacgagataagc

SEQ ID NO: 82340 - DNA, 25 bp, Homo sapien
gataagcagttatgtgacctcacgt

SEQ ID NO: 82341 - DNA, 25 bp, Homo sapien
tatgtgacctcacgtgcaaagccac

SEQ ID NO: 82342 - DNA, 25 bp, Homo sapien
gccaccaacagccactcagaaaaga

SEQ ID NO: 82343 - DNA, 25 bp, Homo sapien
agaaaagacgcaccagcccagaagt

SEQ ID NO: 82344 - DNA, 25 bp, Homo sapien
ctgcagtcactgcacgttttcatct

SEQ ID NO: 82345 - DNA, 25 bp, Homo sapien
tacttccaagacttattttcacatg

SEQ ID NO: 82346 - DNA, 25 bp, Homo sapien
ggaatgactcgtttaaggcctattt

SEQ ID NO: 82347 - DNA, 25 bp, Homo sapien
gcatttggtgcttgacgtattattg

SEQ ID NO: 82348 - DNA, 25 bp, Homo sapien
acgtattattgtcctttgattccaa

SEQ ID NO: 82349 - DNA, 25 bp, Homo sapien
ccaaataatatgtttccttccctca

SEQ ID NO: 82350 - DNA, 25 bp, Homo sapien
actctccctctgtgtgtaattggag

SEQ ID NO: 82351 - DNA, 25 bp, Homo sapien
ctctgtgtgtaattggaggagacca

SEQ ID NO: 82352 - DNA, 25 bp, Homo sapien
ggaggagaccacaagctgttgtttt

SEQ ID NO: 82353 - DNA, 25 bp, Homo sapien
caagctgttgttttgggtgactgaa

SEQ ID NO: 82354 - DNA, 25 bp, Homo sapien
ctgttgttttgggtgactgaagtat

SEQ ID NO: 82355 - DNA, 25 bp, Homo sapien
aagtgttttctgtaccttagattca

SEQ ID NO: 82356 - DNA, 25 bp, Homo sapien
gtaccttagattcacaaactttgta

SEQ ID NO: 82357 - DNA, 25 bp, Homo sapien
taccgtatactttagaaaatgtctc

SEQ ID NO: 82358 - DNA, 25 bp, Homo sapien
gaaaatgtctcagttgcttttatta

SEQ ID NO: 82359 - DNA, 25 bp, Homo sapien
aaattcatcatttaggacaccctca

SEQ ID NO: 82360 - DNA, 25 bp, Homo sapien
atcatttaggacaccctcagcccat

SEQ ID NO: 82361 - DNA, 25 bp, Homo sapien
ctatctcagaaaataaagacagaat

SEQ ID NO: 82362 - DNA, 25 bp, Homo sapien
acagaatgaaagagcccggcgcggt

SEQ ID NO: 82363 - DNA, 25 bp, Homo sapien
cagaatgaaagagcccggcgcggtg

SEQ ID NO: 82364 - DNA, 25 bp, Homo sapien
agaatgaaagagcccggcgcggtgg

SEQ ID NO: 82365 - DNA, 25 bp, Homo sapien
gaatgaaagagcccggcgcggtggc

SEQ ID NO: 82366 - DNA, 25 bp, Homo sapien
atgaaagagcccggcgcggtggctt

SEQ ID NO: 82367 - DNA, 25 bp, Homo sapien
tgaaagagcccggcgcggtggctta

SEQ ID NO: 82368 - DNA, 25 bp, Homo sapien
gaaagagcccggcgcggtggcttac

SEQ ID NO: 82369 - DNA, 25 bp, Homo sapien
aaagagcccggcgcggtggcttacg

SEQ ID NO: 82370 - DNA, 25 bp, Homo sapien
aagagcccggcgcggtggcttacgc

SEQ ID NO: 82371 - DNA, 25 bp, Homo sapien
tggccgacatggcgaaaccccctaa

SEQ ID NO: 82372 - DNA, 25 bp, Homo sapien
agggcagcagctgcgtcagcctaag

SEQ ID NO: 82373 - DNA, 25 bp, Homo sapien
agcagctgcgtcagcctaagacaga

SEQ ID NO: 82374 - DNA, 25 bp, Homo sapien
agctgcgtcagcctaagacagagac

SEQ ID NO: 82375 - DNA, 25 bp, Homo sapien
tgcgtcagcctaagacagagacatt

SEQ ID NO: 82376 - DNA, 25 bp, Homo sapien
gacagagacatttgaacagggcctt

SEQ ID NO: 82377 - DNA, 25 bp, Homo sapien
gagacatttgaacagggccttgaag

SEQ ID NO: 82378 - DNA, 25 bp, Homo sapien
ggccttgaagggtgtgcaggagttc

SEQ ID NO: 82379 - DNA, 25 bp, Homo sapien
gtgtgcaggagttcgccagcaaagc

SEQ ID NO: 82380 - DNA, 25 bp, Homo sapien
caggagttcgccagcaaagccaggc

SEQ ID NO: 82381 - DNA, 25 bp, Homo sapien
ccaggcaggccaagacttgagttgg

SEQ ID NO: 82382 - DNA, 25 bp, Homo sapien
aggcaggccaagacttgagttggca

SEQ ID NO: 82383 - DNA, 25 bp, Homo sapien
tgtcattcaatcattcttcctccag

SEQ ID NO: 82384 - DNA, 25 bp, Homo sapien
gccactgagggacgtgatagtccaa

SEQ ID NO: 82385 - DNA, 25 bp, Homo sapien
gatagtccaaagcactcagctaaaa

SEQ ID NO: 82386 - DNA, 25 bp, Homo sapien
acggaattgcaaacatggtacccac

SEQ ID NO: 82387 - DNA, 25 bp, Homo sapien
catggtacccacaactttggtttct

SEQ ID NO: 82388 - DNA, 25 bp, Homo sapien
gtatatctgcatgtagtctgtctct

SEQ ID NO: 82389 - DNA, 25 bp, Homo sapien
gtagtctgtctctgatttagggttt

SEQ ID NO: 82390 - DNA, 25 bp, Homo sapien
tgatttagggtttaggttcctctgt

SEQ ID NO: 82391 - DNA, 25 bp, Homo sapien
tcatgaggaggtgatgcattcatct

SEQ ID NO: 82392 - DNA, 25 bp, Homo sapien
atgcattcatctgctgggaggtgtc

SEQ ID NO: 82393 - DNA, 25 bp, Homo sapien
attccattcctatcctgtcattcaa

SEQ ID NO: 82394 - DNA, 25 bp, Homo sapien
aaagtcctgggtgacatccacacca

SEQ ID NO: 82395 - DNA, 25 bp, Homo sapien
tgtcggccgtcatccccaatgcttt

SEQ ID NO: 82396 - DNA, 25 bp, Homo sapien
tccccaatgctttccggctggtcaa

SEQ ID NO: 82397 - DNA, 25 bp, Homo sapien
aatgctttccggctggtcaagagga

SEQ ID NO: 82398 - DNA, 25 bp, Homo sapien
ctccctgggtgggatgggctacttt

SEQ ID NO: 82399 - DNA, 25 bp, Homo sapien
atgggctactttgcctactggtacc

SEQ ID NO: 82400 - DNA, 25 bp, Homo sapien
gggaagatggcagccggcccaacct

SEQ ID NO: 82401 - DNA, 25 bp, Homo sapien
cccaacctgcagtccttctttgaga

SEQ ID NO: 82402 - DNA, 25 bp, Homo sapien
tgcagtccttctttgagagggtcca

SEQ ID NO: 82403 - DNA, 25 bp, Homo sapien
cagagacgctttgccttccggaaag

SEQ ID NO: 82404 - DNA, 25 bp, Homo sapien
cttccggaaagtcctgggtgacatc

SEQ ID NO: 82405 - DNA, 25 bp, Homo sapien
tggtataggcgatcctgttacctgc

SEQ ID NO: 82406 - DNA, 25 bp, Homo sapien
gttacctgccttaagagtggagcca

SEQ ID NO: 82407 - DNA, 25 bp, Homo sapien
ggagccatatgtcatccagtctttt

SEQ ID NO: 82408 - DNA, 25 bp, Homo sapien
atccagtcttttgccctagaaggta

SEQ ID NO: 82409 - DNA, 25 bp, Homo sapien
taaacaaattggcacctgtggtctc

SEQ ID NO: 82410 - DNA, 25 bp, Homo sapien
ggtctccctggaacaaaatgctgca

SEQ ID NO: 82411 - DNA, 25 bp, Homo sapien
gcggattcagaaagggctccctcat

SEQ ID NO: 82412 - DNA, 25 bp, Homo sapien
tccctcatcagagacgtgcgacatg

SEQ ID NO: 82413 - DNA, 25 bp, Homo sapien
agccatcagccatgagggtcttgta

SEQ ID NO: 82414 - DNA, 25 bp, Homo sapien
tcgttcctcttcatattcctgatgc

SEQ ID NO: 82415 - DNA, 25 bp, Homo sapien
tgatgcctcttccaggtgtttttgg

SEQ ID NO: 82416 - DNA, 25 bp, Homo sapien
ccagggccatggaaggacccttagg

SEQ ID NO: 82417 - DNA, 25 bp, Homo sapien
aggacccttaggagttcgatgagag

SEQ ID NO: 82418 - DNA, 25 bp, Homo sapien
aggagttcgatgagagagaccatga

SEQ ID NO: 82419 - DNA, 25 bp, Homo sapien
gtcatccccttactttaattcttgg

SEQ ID NO: 82420 - DNA, 25 bp, Homo sapien
taattcttgggcctccaataagtgt

SEQ ID NO: 82421 - DNA, 25 bp, Homo sapien
gggcctccaataagtgtcccatagg

SEQ ID NO: 82422 - DNA, 25 bp, Homo sapien
aagtgtcccataggtgtctggccag

SEQ ID NO: 82423 - DNA, 25 bp, Homo sapien
tcccataggtgtctggccaggccca

SEQ ID NO: 82424 - DNA, 25 bp, Homo sapien
tgtgagtgacagttaccccatttca

SEQ ID NO: 82425 - DNA, 25 bp, Homo sapien
gacagttaccccatttcagtcattt

SEQ ID NO: 82426 - DNA, 25 bp, Homo sapien
atttcagtcatttcctgctgcaact

SEQ ID NO: 82427 - DNA, 25 bp, Homo sapien
agcccacagaatcagttccccagtc

SEQ ID NO: 82428 - DNA, 25 bp, Homo sapien
agttccccagtctcacagccatgga

SEQ ID NO: 82429 - DNA, 25 bp, Homo sapien
agccatggaaacaagccctggccat

SEQ ID NO: 82430 - DNA, 25 bp, Homo sapien
agcagccactgcacaatgcctctgg

SEQ ID NO: 82431 - DNA, 25 bp, Homo sapien
agccactgcacaatgcctctggtgg

SEQ ID NO: 82432 - DNA, 25 bp, Homo sapien
actgcacaatgcctctggtggaaga

SEQ ID NO: 82433 - DNA, 25 bp, Homo sapien
ctgcacaatgcctctggtggaagac

SEQ ID NO: 82434 - DNA, 25 bp, Homo sapien
tgttcacctcctcattaggtgtggc

SEQ ID NO: 82435 - DNA, 25 bp, Homo sapien
tcacctcctcattaggtgtggcttt

SEQ ID NO: 82436 - DNA, 25 bp, Homo sapien
ctcctcattaggtgtggctttagta

SEQ ID NO: 82437 - DNA, 25 bp, Homo sapien
cctcattaggtgtggctttagtagt

SEQ ID NO: 82438 - DNA, 25 bp, Homo sapien
caccacaaggccgtgggaaatcttg

SEQ ID NO: 82439 - DNA, 25 bp, Homo sapien
aaatcttggaggttctgtgcctttc

SEQ ID NO: 82440 - DNA, 25 bp, Homo sapien
tttctgtcacctctactttttgcag

SEQ ID NO: 82441 - DNA, 25 bp, Homo sapien
acctctactttttgcagctgtgatt

SEQ ID NO: 82442 - DNA, 25 bp, Homo sapien
tgattgcactgtcccgcacatgtga

SEQ ID NO: 82443 - DNA, 25 bp, Homo sapien
gtcccgcacatgtgactacaagcat

SEQ ID NO: 82444 - DNA, 25 bp, Homo sapien
aagcatcactggcaaggacccttta

SEQ ID NO: 82445 - DNA, 25 bp, Homo sapien
gatgaatagcaataagtggaccttt

SEQ ID NO: 82446 - DNA, 25 bp, Homo sapien
gtggacctttgttactcttctgagt

SEQ ID NO: 82447 - DNA, 25 bp, Homo sapien
tagtacactctgaacaaagcttatt

SEQ ID NO: 82448 - DNA, 25 bp, Homo sapien
ggtgttcagaaagcaacctgacaat

SEQ ID NO: 82449 - DNA, 25 bp, Homo sapien
gaaacacattttctggctagcagaa

SEQ ID NO: 82450 - DNA, 25 bp, Homo sapien
tctttcttgctttgagagtgtacag

SEQ ID NO: 82451 - DNA, 25 bp, Homo sapien
gctttaattgtgctgtcgttcatga

SEQ ID NO: 82452 - DNA, 25 bp, Homo sapien
ttaattgtgctgtcgttcatgaaac

SEQ ID NO: 82453 - DNA, 25 bp, Homo sapien
tcgttcatgaaacagagctgctctg

SEQ ID NO: 82454 - DNA, 25 bp, Homo sapien
gaaacagagctgctctgcttttctg

SEQ ID NO: 82455 - DNA, 25 bp, Homo sapien
tctgcttttctgtcagagatggcaa

SEQ ID NO: 82456 - DNA, 25 bp, Homo sapien
ttctgtcagagatggcaagggcttt

SEQ ID NO: 82457 - DNA, 25 bp, Homo sapien
caagggctttttcagcatctcgttt

SEQ ID NO: 82458 - DNA, 25 bp, Homo sapien
ggctttttcagcatctcgtttatgt

SEQ ID NO: 82459 - DNA, 25 bp, Homo sapien
cagcatctcgtttatgtgtggaatt

SEQ ID NO: 82460 - DNA, 25 bp, Homo sapien
tactgtccaatcatgctgtggtgca

SEQ ID NO: 82461 - DNA, 25 bp, Homo sapien
gctgtggtgcattcctttgaagatc

SEQ ID NO: 82462 - DNA, 25 bp, Homo sapien
ggtgcattcctttgaagatcatgaa

SEQ ID NO: 82463 - DNA, 25 bp, Homo sapien
gaagaatagccaaacttgtctttga

SEQ ID NO: 82464 - DNA, 25 bp, Homo sapien
aaacttgtctttgagggtgaatttg

SEQ ID NO: 82465 - DNA, 25 bp, Homo sapien
gagggtgaatttgacactttaaaat

SEQ ID NO: 82466 - DNA, 25 bp, Homo sapien
gagacccaaagctagtgaataattc

SEQ ID NO: 82467 - DNA, 25 bp, Homo sapien
gtgactaagctagatacttgaggat

SEQ ID NO: 82468 - DNA, 25 bp, Homo sapien
tacttgaggatgatagagcaacact

SEQ ID NO: 82469 - DNA, 25 bp, Homo sapien
gagcaacactaaactaaagcaatga

SEQ ID NO: 82470 - DNA, 25 bp, Homo sapien
atgatttatacaatgactccaaagg

SEQ ID NO: 82471 - DNA, 25 bp, Homo sapien
ggagcagcgggctcacccaggcacc

SEQ ID NO: 82472 - DNA, 25 bp, Homo sapien
caggcacctgtctgccaggaggcca

SEQ ID NO: 82473 - DNA, 25 bp, Homo sapien
gcacctgtctgccaggaggccacgt

SEQ ID NO: 82474 - DNA, 25 bp, Homo sapien
caggaggccacgtgtgtcctgccca

SEQ ID NO: 82475 - DNA, 25 bp, Homo sapien
gggagctgtattttggcagcacccc

SEQ ID NO: 82476 - DNA, 25 bp, Homo sapien
ggagctgtattttggcagcacccca

SEQ ID NO: 82477 - DNA, 25 bp, Homo sapien
gagctgtattttggcagcaccccac

SEQ ID NO: 82478 - DNA, 25 bp, Homo sapien
gtattttggcagcaccccacgcttg

SEQ ID NO: 82479 - DNA, 25 bp, Homo sapien
gcaccccacgcttgctgcccgaggg

SEQ ID NO: 82480 - DNA, 25 bp, Homo sapien
cgagggcctcttggggcacctaaga

SEQ ID NO: 82481 - DNA, 25 bp, Homo sapien
tcttggggcacctaagacagcaccc

SEQ ID NO: 82482 - DNA, 25 bp, Homo sapien
gagctaggattgtgagtgacctgca

SEQ ID NO: 82483 - DNA, 25 bp, Homo sapien
gagtgacctgcaggccattatcagt

SEQ ID NO: 82484 - DNA, 25 bp, Homo sapien
ggccattatcagtgcctcatctgtg

SEQ ID NO: 82485 - DNA, 25 bp, Homo sapien
gcctcatctgtgcagaagtggcagc

SEQ ID NO: 82486 - DNA, 25 bp, Homo sapien
gggaccatccaaatacctaagagaa

SEQ ID NO: 82487 - DNA, 25 bp, Homo sapien
gacctagtcaggatatgaatttgtt

SEQ ID NO: 82488 - DNA, 25 bp, Homo sapien
ttgtttcagctgttcccaaaggcct

SEQ ID NO: 82489 - DNA, 25 bp, Homo sapien
agctgttcccaaaggcctgggagct

SEQ ID NO: 82490 - DNA, 25 bp, Homo sapien
tcccaaaggcctgggagctttttga

SEQ ID NO: 82491 - DNA, 25 bp, Homo sapien
gaattgtttttaccaagagtctatg

SEQ ID NO: 82492 - DNA, 25 bp, Homo sapien
cttgattcacccttcatccattggc

SEQ ID NO: 82493 - DNA, 25 bp, Homo sapien
tcctggctcctcagtaggacagaca

SEQ ID NO: 82494 - DNA, 25 bp, Homo sapien
ggtacttgtggcattttcctgtatt

SEQ ID NO: 82495 - DNA, 25 bp, Homo sapien
gcattttcctgtattgtcttggaca

SEQ ID NO: 82496 - DNA, 25 bp, Homo sapien
tagcatcatttctccctgttgggtt

SEQ ID NO: 82497 - DNA, 25 bp, Homo sapien
tttagccagtttgccagcaagcgca

SEQ ID NO: 82498 - DNA, 25 bp, Homo sapien
gccagcaagcgcatcctagcagggt

SEQ ID NO: 82499 - DNA, 25 bp, Homo sapien
tccccgagcagcaggttgtgtggat

SEQ ID NO: 82500 - DNA, 25 bp, Homo sapien
tgaagggacaggcacttgcatccag

SEQ ID NO: 82501 - DNA, 25 bp, Homo sapien
acttgcatccagctgatctaggtca

SEQ ID NO: 82502 - DNA, 25 bp, Homo sapien
gatctaggtcacacctggctcttgg

SEQ ID NO: 82503 - DNA, 25 bp, Homo sapien
gtggcttattaacagcttccagtgg

SEQ ID NO: 82504 - DNA, 25 bp, Homo sapien
gacatttctaaacttgcctgagttt

SEQ ID NO: 82505 - DNA, 25 bp, Homo sapien
ctaaacttgcctgagtttgaaaatt

SEQ ID NO: 82506 - DNA, 25 bp, Homo sapien
taaagcatcaaattggtgttcgcca

SEQ ID NO: 82507 - DNA, 25 bp, Homo sapien
attggtgttcgccaaggcattatga

SEQ ID NO: 82508 - DNA, 25 bp, Homo sapien
gttcgccaaggcattatgagactct

SEQ ID NO: 82509 - DNA, 25 bp, Homo sapien
ggcattatgagactctactgtgtta

SEQ ID NO: 82510 - DNA, 25 bp, Homo sapien
gactctactgtgttagggtatattc

SEQ ID NO: 82511 - DNA, 25 bp, Homo sapien
tactgtatagttgttcagctaaact

SEQ ID NO: 82512 - DNA, 25 bp, Homo sapien
atgtctcatgaggtatcaaactatg

SEQ ID NO: 82513 - DNA, 25 bp, Homo sapien
aactatgtaattttgtccttgttat

SEQ ID NO: 82514 - DNA, 25 bp, Homo sapien
tgtaattttgtccttgttatttttg

SEQ ID NO: 82515 - DNA, 25 bp, Homo sapien
gctgttccaggcggggcgatccggg

SEQ ID NO: 82516 - DNA, 25 bp, Homo sapien
attcgtaccccactgcgctgtggcg

SEQ ID NO: 82517 - DNA, 25 bp, Homo sapien
ttcgtaccccactgcgctgtggcgt

SEQ ID NO: 82518 - DNA, 25 bp, Homo sapien
tcgtaccccactgcgctgtggcgtc

SEQ ID NO: 82519 - DNA, 25 bp, Homo sapien
cgtaccccactgcgctgtggcgtcc

SEQ ID NO: 82520 - DNA, 25 bp, Homo sapien
gtaccccactgcgctgtggcgtcca

SEQ ID NO: 82521 - DNA, 25 bp, Homo sapien
taccccactgcgctgtggcgtccac

SEQ ID NO: 82522 - DNA, 25 bp, Homo sapien
accccactgcgctgtggcgtccacc

SEQ ID NO: 82523 - DNA, 25 bp, Homo sapien
ccccactgcgctgtggcgtccaccc

SEQ ID NO: 82524 - DNA, 25 bp, Homo sapien
cccactgcgctgtggcgtccacccg

SEQ ID NO: 82525 - DNA, 25 bp, Homo sapien
tccacccgggcccaggcaccttcct

SEQ ID NO: 82526 - DNA, 25 bp, Homo sapien
cttcctgaatcatcagctgtgggca

SEQ ID NO: 82527 - DNA, 25 bp, Homo sapien
ctggcttaggctcccgcaatgggaa

SEQ ID NO: 82528 - DNA, 25 bp, Homo sapien
gaaaacaaccggagggccagagctt

SEQ ID NO: 82529 - DNA, 25 bp, Homo sapien
gagggccagagcttagtccagacct

SEQ ID NO: 82530 - DNA, 25 bp, Homo sapien
agagcttagtccagacctaccttgt

SEQ ID NO: 82531 - DNA, 25 bp, Homo sapien
agacctaccttgtacgcacatagac

SEQ ID NO: 82532 - DNA, 25 bp, Homo sapien
tgtacgcacatagacattttcatat

SEQ ID NO: 82533 - DNA, 25 bp, Homo sapien
cattttcatatgcactggatggagt

SEQ ID NO: 82534 - DNA, 25 bp, Homo sapien
aaagaatttgccatactgtactcag

SEQ ID NO: 82535 - DNA, 25 bp, Homo sapien
tcagaatcacgacattccttcccta

SEQ ID NO: 82536 - DNA, 25 bp, Homo sapien
ctaccaaggccacttctattttttg

SEQ ID NO: 82537 - DNA, 25 bp, Homo sapien
atgctctcccctcctcggaggatga

SEQ ID NO: 82538 - DNA, 25 bp, Homo sapien
gaaagaaacagataacaccaaacca

SEQ ID NO: 82539 - DNA, 25 bp, Homo sapien
gtagctccatattggacatccccag

SEQ ID NO: 82540 - DNA, 25 bp, Homo sapien
attggacatccccagaaaagatgga

SEQ ID NO: 82541 - DNA, 25 bp, Homo sapien
aaaagaaattgcatgcagtgccggc

SEQ ID NO: 82542 - DNA, 25 bp, Homo sapien
atgcagtgccggctgccaagacagt

SEQ ID NO: 82543 - DNA, 25 bp, Homo sapien
gacagtgaagttcaaatgcccttcc

SEQ ID NO: 82544 - DNA, 25 bp, Homo sapien
aaacctgaccacagaattggaggct

SEQ ID NO: 82545 - DNA, 25 bp, Homo sapien
ggaggctacaaggtccgttatgcca

SEQ ID NO: 82546 - DNA, 25 bp, Homo sapien
aaggtccgttatgccacctggagca

SEQ ID NO: 82547 - DNA, 25 bp, Homo sapien
acctggagcatcataatggactctg

SEQ ID NO: 82548 - DNA, 25 bp, Homo sapien
cccgtctgtaagttccaggtggtga

SEQ ID NO: 82549 - DNA, 25 bp, Homo sapien
gttccaggtggtgattccgaaatcc

SEQ ID NO: 82550 - DNA, 25 bp, Homo sapien
ggtgattccgaaatcctaagcctgc

SEQ ID NO: 82551 - DNA, 25 bp, Homo sapien
gtggtcttgggaatcccaggcccta

SEQ ID NO: 82552 - DNA, 25 bp, Homo sapien
acatttgctcaggaagtgggtatca

SEQ ID NO: 82553 - DNA, 25 bp, Homo sapien
tcccagctgcggtcaggactgtggt

SEQ ID NO: 82554 - DNA, 25 bp, Homo sapien
tcaggactgtggtgggattcccgcc

SEQ ID NO: 82555 - DNA, 25 bp, Homo sapien
tgggattcccgcctcggcagcgtca

SEQ ID NO: 82556 - DNA, 25 bp, Homo sapien
tcggcagcgtcactgcccagtagct

SEQ ID NO: 82557 - DNA, 25 bp, Homo sapien
tcactgcccagtagctgctcaataa

SEQ ID NO: 82558 - DNA, 25 bp, Homo sapien
gctgctcaataaaggctgtgtgtgt

SEQ ID NO: 82559 - DNA, 25 bp, Homo sapien
ggtgaccttggctgtgtacgtccca

SEQ ID NO: 82560 - DNA, 25 bp, Homo sapien
accttggctgtgtacgtcccagcaa

SEQ ID NO: 82561 - DNA, 25 bp, Homo sapien
cttggctgtgtacgtcccagcaaaa

SEQ ID NO: 82562 - DNA, 25 bp, Homo sapien
tggctgtgtacgtcccagcaaaaga

SEQ ID NO: 82563 - DNA, 25 bp, Homo sapien
tgtgtacgtcccagcaaaagagctc

SEQ ID NO: 82564 - DNA, 25 bp, Homo sapien
agcaaaagagctctggcccgcatct

SEQ ID NO: 82565 - DNA, 25 bp, Homo sapien
ccgcatctcgctgtgccctgaaggg

SEQ ID NO: 82566 - DNA, 25 bp, Homo sapien
tgctgcactgcatgctgggactgct

SEQ ID NO: 82567 - DNA, 25 bp, Homo sapien
agagtggtgaattgcgctgcccgaa

SEQ ID NO: 82568 - DNA, 25 bp, Homo sapien
agggtagggaccgtgtacagcttga

SEQ ID NO: 82569 - DNA, 25 bp, Homo sapien
gaccgtgtacagcttgataaccctt

SEQ ID NO: 82570 - DNA, 25 bp, Homo sapien
atctctgccctgcacttgtgcagaa

SEQ ID NO: 82571 - DNA, 25 bp, Homo sapien
gaaagtcagggatacggcaagcatg

SEQ ID NO: 82572 - DNA, 25 bp, Homo sapien
tagagttgtgtgaaacccctagcat

SEQ ID NO: 82573 - DNA, 25 bp, Homo sapien
gaaacccctagcatagagacagaca

SEQ ID NO: 82574 - DNA, 25 bp, Homo sapien
gcagaaccagacagagaaccccaca

SEQ ID NO: 82575 - DNA, 25 bp, Homo sapien
acagactttccactccaagcacagg

SEQ ID NO: 82576 - DNA, 25 bp, Homo sapien
acggctgctgcttgggccaaaaaca

SEQ ID NO: 82577 - DNA, 25 bp, Homo sapien
aaacatacagaggtgcatggctggc

SEQ ID NO: 82578 - DNA, 25 bp, Homo sapien
catggctggcagtcttgaaattgtc

SEQ ID NO: 82579 - DNA, 25 bp, Homo sapien
gaaattgtcactcgcttactggatc

SEQ ID NO: 82580 - DNA, 25 bp, Homo sapien
ttactggatccaagcgtctcgagga

SEQ ID NO: 82581 - DNA, 25 bp, Homo sapien
aataaggttcatctcctcacagcaa

SEQ ID NO: 82582 - DNA, 25 bp, Homo sapien
gggagaacccgaatagccacgcagg

SEQ ID NO: 82583 - DNA, 25 bp, Homo sapien
agggccttgcaccatcaagggtgac

SEQ ID NO: 82584 - DNA, 25 bp, Homo sapien
aagggtgacacctgcgacgcaagta

SEQ ID NO: 82585 - DNA, 25 bp, Homo sapien
agtaccaggaggacataaccgctgt

SEQ ID NO: 82586 - DNA, 25 bp, Homo sapien
cataaccgctgtggcctgttggaga

SEQ ID NO: 82587 - DNA, 25 bp, Homo sapien
gagaacagccagtagccttggtaat

SEQ ID NO: 82588 - DNA, 25 bp, Homo sapien
gggccagaagatgatttcacttgca

SEQ ID NO: 82589 - DNA, 25 bp, Homo sapien
aaaactgcttcaagtcttgacccct

SEQ ID NO: 82590 - DNA, 25 bp, Homo sapien
gacccctttgtgtctaatagctaaa

SEQ ID NO: 82591 - DNA, 25 bp, Homo sapien
gaaacgaataaaaagtccctcatgt

SEQ ID NO: 82592 - DNA, 25 bp, Homo sapien
tgccatctttgacacttgcaagcta

SEQ ID NO: 82593 - DNA, 25 bp, Homo sapien
attaatcgttctgcacttcagcttc

SEQ ID NO: 82594 - DNA, 25 bp, Homo sapien
acttcagcttccttgtctatcaaat

SEQ ID NO: 82595 - DNA, 25 bp, Homo sapien
tctctgtctcagcaggtgatgacgg

SEQ ID NO: 82596 - DNA, 25 bp, Homo sapien
gtgcctctgagacccattctcgtgt

SEQ ID NO: 82597 - DNA, 25 bp, Homo sapien
attctcgtgtttccctgttgtacct

SEQ ID NO: 82598 - DNA, 25 bp, Homo sapien
gtttccctgttgtaccttttgcctg

SEQ ID NO: 82599 - DNA, 25 bp, Homo sapien
gcagggcagagagatctggtttcta

SEQ ID NO: 82600 - DNA, 25 bp, Homo sapien
tggtttctagcaaattcccagtagg

SEQ ID NO: 82601 - DNA, 25 bp, Homo sapien
aggatgtcatgtaagttccttcccc

SEQ ID NO: 82602 - DNA, 25 bp, Homo sapien
cccctcttagagattgaaggctgta

SEQ ID NO: 82603 - DNA, 25 bp, Homo sapien
agttccaggtggtgattccgaaatc

SEQ ID NO: 82604 - DNA, 25 bp, Homo sapien
gttccaggtggtgattccgaaatcc

SEQ ID NO: 82605 - DNA, 25 bp, Homo sapien
ttccaggtggtgattccgaaatcct

SEQ ID NO: 82606 - DNA, 25 bp, Homo sapien
ccaggtggtgattccgaaatcctaa

SEQ ID NO: 82607 - DNA, 25 bp, Homo sapien
ggtggtgattccgaaatcctaagcc

SEQ ID NO: 82608 - DNA, 25 bp, Homo sapien
gtggtgattccgaaatcctaagcct

SEQ ID NO: 82609 - DNA, 25 bp, Homo sapien
ggtgattccgaaatcctaagcctgc

SEQ ID NO: 82610 - DNA, 25 bp, Homo sapien
atttgctcaggaagtgggtatcaaa

SEQ ID NO: 82611 - DNA, 25 bp, Homo sapien
tgctcaggaagtgggtatcaaattg

SEQ ID NO: 82612 - DNA, 25 bp, Homo sapien
caggaagtgggtatcaaattgaggt

SEQ ID NO: 82613 - DNA, 25 bp, Homo sapien
tcccagctgcggtcaggactgtggt

SEQ ID NO: 82614 - DNA, 25 bp, Homo sapien
tccacgggaagcctccgtcaggaga

SEQ ID NO: 82615 - DNA, 25 bp, Homo sapien
gaagcctccgtcaggagagacgcag

SEQ ID NO: 82616 - DNA, 25 bp, Homo sapien
tccgtcaggagagacgcagccctgg

SEQ ID NO: 82617 - DNA, 25 bp, Homo sapien
aagggtgggaagcttgctggcttct

SEQ ID NO: 82618 - DNA, 25 bp, Homo sapien
ctggcttctgttgcgccactgagac

SEQ ID NO: 82619 - DNA, 25 bp, Homo sapien
tctgttgcgccactgagacggcaga

SEQ ID NO: 82620 - DNA, 25 bp, Homo sapien
actgagacggcagagaccccaggat

SEQ ID NO: 82621 - DNA, 25 bp, Homo sapien
agatcctctgctgactccatatgga

SEQ ID NO: 82622 - DNA, 25 bp, Homo sapien
atcctctgctgactccatatggagg

SEQ ID NO: 82623 - DNA, 25 bp, Homo sapien
ctctgctgactccatatggaggcct

SEQ ID NO: 82624 - DNA, 25 bp, Homo sapien
gctgactccatatggaggcctcaca

SEQ ID NO: 82625 - DNA, 25 bp, Homo sapien
gacacaagctctaagaactctggat

SEQ ID NO: 82626 - DNA, 25 bp, Homo sapien
agaactctggatacaacgggaactt

SEQ ID NO: 82627 - DNA, 25 bp, Homo sapien
tggatggatacagtctgggcctgct

SEQ ID NO: 82628 - DNA, 25 bp, Homo sapien
ggcaagcagcctgtcttgcacattg

SEQ ID NO: 82629 - DNA, 25 bp, Homo sapien
ttgcacattgcaactgactggctta

SEQ ID NO: 82630 - DNA, 25 bp, Homo sapien
aactgactggcttaatctacggcaa

SEQ ID NO: 82631 - DNA, 25 bp, Homo sapien
aatctacggcaagagtccttcagct

SEQ ID NO: 82632 - DNA, 25 bp, Homo sapien
ttcagctccgtcacagagtactctc

SEQ ID NO: 82633 - DNA, 25 bp, Homo sapien
cagagtactctccaatgtgttatag

SEQ ID NO: 82634 - DNA, 25 bp, Homo sapien
gttatccttaaagctcttcaattca

SEQ ID NO: 82635 - DNA, 25 bp, Homo sapien
aggtatgtcacctggatggttgttg

SEQ ID NO: 82636 - DNA, 25 bp, Homo sapien
tagaaagcattttaggccagccatg

SEQ ID NO: 82637 - DNA, 25 bp, Homo sapien
agaaagcattttaggccagccatgg

SEQ ID NO: 82638 - DNA, 25 bp, Homo sapien
gaaagcattttaggccagccatggt

SEQ ID NO: 82639 - DNA, 25 bp, Homo sapien
aaagcattttaggccagccatggtg

SEQ ID NO: 82640 - DNA, 25 bp, Homo sapien
aagcattttaggccagccatggtgg

SEQ ID NO: 82641 - DNA, 25 bp, Homo sapien
agcattttaggccagccatggtggc

SEQ ID NO: 82642 - DNA, 25 bp, Homo sapien
gcattttaggccagccatggtggct

SEQ ID NO: 82643 - DNA, 25 bp, Homo sapien
cattttaggccagccatggtggctc

SEQ ID NO: 82644 - DNA, 25 bp, Homo sapien
aggccagccatggtggctcacgtct

SEQ ID NO: 82645 - DNA, 25 bp, Homo sapien
ggccagccatggtggctcacgtctg

SEQ ID NO: 82646 - DNA, 25 bp, Homo sapien
gccagccatggtggctcacgtctgt

SEQ ID NO: 82647 - DNA, 25 bp, Homo sapien
tctttctacagctcacttctatcag

SEQ ID NO: 82648 - DNA, 25 bp, Homo sapien
tctacagctcacttctatcagaggc

SEQ ID NO: 82649 - DNA, 25 bp, Homo sapien
ctcacttctatcagaggcccaggtg

SEQ ID NO: 82650 - DNA, 25 bp, Homo sapien
gcccaggtgcctcagagccacattg

SEQ ID NO: 82651 - DNA, 25 bp, Homo sapien
cagagccacattgagttgctttttc

SEQ ID NO: 82652 - DNA, 25 bp, Homo sapien
cacattgagttgctttttctgggat

SEQ ID NO: 82653 - DNA, 25 bp, Homo sapien
cattgagttgctttttctgggatga

SEQ ID NO: 82654 - DNA, 25 bp, Homo sapien
gaggctcctgacaggtgccctttgt

SEQ ID NO: 82655 - DNA, 25 bp, Homo sapien
ctcctgacaggtgccctttgtcaga

SEQ ID NO: 82656 - DNA, 25 bp, Homo sapien
cacagcctggataggcagccacatt

SEQ ID NO: 82657 - DNA, 25 bp, Homo sapien
cttgctcggcactccgtggtggtcc

SEQ ID NO: 82658 - DNA, 25 bp, Homo sapien
tcccttttacattttgatgtgtcaa

SEQ ID NO: 82659 - DNA, 25 bp, Homo sapien
tacattttgatgtgtcaaaggcttt

SEQ ID NO: 82660 - DNA, 25 bp, Homo sapien
tgtcaaaggcttttggagtgaccaa

SEQ ID NO: 82661 - DNA, 25 bp, Homo sapien
gagtgaccaaaagcacagaggcagc

SEQ ID NO: 82662 - DNA, 25 bp, Homo sapien
accaaaagcacagaggcagcgggtg

SEQ ID NO: 82663 - DNA, 25 bp, Homo sapien
tgggtggtccccaaggtcgctgcca

SEQ ID NO: 82664 - DNA, 25 bp, Homo sapien
aagcccacatatgctgtgacgctgg

SEQ ID NO: 82665 - DNA, 25 bp, Homo sapien
agcccacatatgctgtgacgctggc

SEQ ID NO: 82666 - DNA, 25 bp, Homo sapien
acatatgctgtgacgctggccacct

SEQ ID NO: 82667 - DNA, 25 bp, Homo sapien
tatgctgtgacgctggccacctttt

SEQ ID NO: 82668 - DNA, 25 bp, Homo sapien
ccgtggcccctgtgcctgttcggtg

SEQ ID NO: 82669 - DNA, 25 bp, Homo sapien
atcttactcatgttactattcacca

SEQ ID NO: 82670 - DNA, 25 bp, Homo sapien
gtatttcgtcactgaagactttatt

SEQ ID NO: 82671 - DNA, 25 bp, Homo sapien
gatggaaactttctacctgcttggc

SEQ ID NO: 82672 - DNA, 25 bp, Homo sapien
gggcctctggaagtctgctgtgaat

SEQ ID NO: 82673 - DNA, 25 bp, Homo sapien
gtctgctgtgaatttgtattccctt

SEQ ID NO: 82674 - DNA, 25 bp, Homo sapien
tattccctttcacctcctggaaggt

SEQ ID NO: 82675 - DNA, 25 bp, Homo sapien
gaaggtgaagtaccccttcatccct

SEQ ID NO: 82676 - DNA, 25 bp, Homo sapien
ttcatccctttgttactaacctcag

SEQ ID NO: 82677 - DNA, 25 bp, Homo sapien
ctaacctcagtgtattgtgcagtag

SEQ ID NO: 82678 - DNA, 25 bp, Homo sapien
taggcgtcacatatgcttggttcaa

SEQ ID NO: 82679 - DNA, 25 bp, Homo sapien
gtattgattgactctgctattggca

SEQ ID NO: 82680 - DNA, 25 bp, Homo sapien
ggagcagcgggctcacccaggcacc

SEQ ID NO: 82681 - DNA, 25 bp, Homo sapien
acccaggcacctgtctgccaggagg

SEQ ID NO: 82682 - DNA, 25 bp, Homo sapien
gggagctgtattttggcagcacccc

SEQ ID NO: 82683 - DNA, 25 bp, Homo sapien
ggagctgtattttggcagcacccca

SEQ ID NO: 82684 - DNA, 25 bp, Homo sapien
gagctgtattttggcagcaccccac

SEQ ID NO: 82685 - DNA, 25 bp, Homo sapien
agctgtattttggcagcaccccacg

SEQ ID NO: 82686 - DNA, 25 bp, Homo sapien
gcaccccacgcttgctgcccgaggg

SEQ ID NO: 82687 - DNA, 25 bp, Homo sapien
cgagggcctcttggggcacctaaga

SEQ ID NO: 82688 - DNA, 25 bp, Homo sapien
tcttggggcacctaagacagcaccc

SEQ ID NO: 82689 - DNA, 25 bp, Homo sapien
agacagcaccccctctcaggggaga

SEQ ID NO: 82690 - DNA, 25 bp, Homo sapien
agaccatggtggccccggccgcacc

SEQ ID NO: 82691 - DNA, 25 bp, Homo sapien
tgggctgccccttctcatggcttcg

SEQ ID NO: 82692 - DNA, 25 bp, Homo sapien
catggcttcgtgctgactccataaa

SEQ ID NO: 82693 - DNA, 25 bp, Homo sapien
gtgctgactccataaacattctctg

SEQ ID NO: 82694 - DNA, 25 bp, Homo sapien
ttgaggatgtccagtcagggcttga

SEQ ID NO: 82695 - DNA, 25 bp, Homo sapien
ccagtcagggcttgacaggcccagg

SEQ ID NO: 82696 - DNA, 25 bp, Homo sapien
gaaggttccctgcagtgccagtgct

SEQ ID NO: 82697 - DNA, 25 bp, Homo sapien
acactcactcttgcagagcctgtgt

SEQ ID NO: 82698 - DNA, 25 bp, Homo sapien
gcagagcctgtgtctttaagcagct

SEQ ID NO: 82699 - DNA, 25 bp, Homo sapien
taagcagctggcgtgttacatctcc

SEQ ID NO: 82700 - DNA, 25 bp, Homo sapien
agctggcgtgttacatctccattta

SEQ ID NO: 82701 - DNA, 25 bp, Homo sapien
acatctccatttaaggtttcctttg

SEQ ID NO: 82702 - DNA, 25 bp, Homo sapien
gaaaaacacgtctcaccactgtggt

SEQ ID NO: 82703 - DNA, 25 bp, Homo sapien
aaagctctccaaccatgtctggcgt

SEQ ID NO: 82704 - DNA, 25 bp, Homo sapien
accatgtctggcgttgagaagccaa

SEQ ID NO: 82705 - DNA, 25 bp, Homo sapien
gagaagccaagagtctctgtcaact

SEQ ID NO: 82706 - DNA, 25 bp, Homo sapien
aagagtctctgtcaactctctcatt

SEQ ID NO: 82707 - DNA, 25 bp, Homo sapien
aactctctcattgcccagtggtgac

SEQ ID NO: 82708 - DNA, 25 bp, Homo sapien
ccacactgttgggaggtaatgctgc

SEQ ID NO: 82709 - DNA, 25 bp, Homo sapien
taatgctgccccacgtgctggtgca

SEQ ID NO: 82710 - DNA, 25 bp, Homo sapien
ggtgcaggtcagtatcctgggactt

SEQ ID NO: 82711 - DNA, 25 bp, Homo sapien
aagctggcaggatttgccgggtaaa

SEQ ID NO: 82712 - DNA, 25 bp, Homo sapien
gccgggtaaagctgtatgccatcat

SEQ ID NO: 82713 - DNA, 25 bp, Homo sapien
aagtagaggcgactcgccgagctct

SEQ ID NO: 82714 - DNA, 25 bp, Homo sapien
gccgagctctgattgaccgaatggt

SEQ ID NO: 82715 - DNA, 25 bp, Homo sapien
gattgaccgaatggtgaatctgcac

SEQ ID NO: 82716 - DNA, 25 bp, Homo sapien
gtgaatctgcaccaagcatgaacaa

SEQ ID NO: 82717 - DNA, 25 bp, Homo sapien
tgaacaattgggagcatcagtcccc

SEQ ID NO: 82718 - DNA, 25 bp, Homo sapien
cacctttcccagaagtggctactga

SEQ ID NO: 82719 - DNA, 25 bp, Homo sapien
agaagtggctactgactaccctctc

SEQ ID NO: 82720 - DNA, 25 bp, Homo sapien
tctcactagtgccaatgatgtgacc

SEQ ID NO: 82721 - DNA, 25 bp, Homo sapien
atgatgtgaccctcaatcccacata

SEQ ID NO: 82722 - DNA, 25 bp, Homo sapien
ggaaaggtctcagcttgtatataga

SEQ ID NO: 82723 - DNA, 25 bp, Homo sapien
atttattactgtccctatctattaa

SEQ ID NO: 82724 - DNA, 25 bp, Homo sapien
tgtgaagtcgccaccattgtcccct

SEQ ID NO: 82725 - DNA, 25 bp, Homo sapien
attgtcccctgttggaactactcca

SEQ ID NO: 82726 - DNA, 25 bp, Homo sapien
gttggaactactccagtgaagttaa

SEQ ID NO: 82727 - DNA, 25 bp, Homo sapien
tgaagttaaagagagctgctcctaa

SEQ ID NO: 82728 - DNA, 25 bp, Homo sapien
tgctcctaaagaagaggcagaggcc

SEQ ID NO: 82729 - DNA, 25 bp, Homo sapien
tgaagcccccacaagcaaaaaggaa

SEQ ID NO: 82730 - DNA, 25 bp, Homo sapien
gatacaacatgttacttggccctga

SEQ ID NO: 82731 - DNA, 25 bp, Homo sapien
aacatgttacttggccctgaagaaa

SEQ ID NO: 82732 - DNA, 25 bp, Homo sapien
atatactgtaactgtagtttttcaa

SEQ ID NO: 82733 - DNA, 25 bp, Homo sapien
cagaaatcctgattattgtggaatt

SEQ ID NO: 82734 - DNA, 25 bp, Homo sapien
tgtggaattttcttaagaggtttca

SEQ ID NO: 82735 - DNA, 25 bp, Homo sapien
cctggtttttattctcagtacctca

SEQ ID NO: 82736 - DNA, 25 bp, Homo sapien
gtttttattctcagtacctcaggct

SEQ ID NO: 82737 - DNA, 25 bp, Homo sapien
tttttattctcagtacctcaggctc

SEQ ID NO: 82738 - DNA, 25 bp, Homo sapien
tttattctcagtacctcaggctccc

SEQ ID NO: 82739 - DNA, 25 bp, Homo sapien
ggcagggagccctttcctcggttct

SEQ ID NO: 82740 - DNA, 25 bp, Homo sapien
cagggagccctttcctcggttctgg

SEQ ID NO: 82741 - DNA, 25 bp, Homo sapien
ggagccctttcctcggttctggcct

SEQ ID NO: 82742 - DNA, 25 bp, Homo sapien
caacaggtgctcacagccaccgagg

SEQ ID NO: 82743 - DNA, 25 bp, Homo sapien
acaggtgctcacagccaccgaggca

SEQ ID NO: 82744 - DNA, 25 bp, Homo sapien
gccacccactgggagtcttgttttt

SEQ ID NO: 82745 - DNA, 25 bp, Homo sapien
cacccactgggagtcttgtttttat

SEQ ID NO: 82746 - DNA, 25 bp, Homo sapien
gctgcaacccctgaagaacatctgt

SEQ ID NO: 82747 - DNA, 25 bp, Homo sapien
gaacatctgtcttaaaagacctcaa

SEQ ID NO: 82748 - DNA, 25 bp, Homo sapien
aagacctcaaatcagaacattctca

SEQ ID NO: 82749 - DNA, 25 bp, Homo sapien
agaacattctcattggcctcttcag

SEQ ID NO: 82750 - DNA, 25 bp, Homo sapien
attggcctcttcagtgatccccatg

SEQ ID NO: 82751 - DNA, 25 bp, Homo sapien
ttcagtgatccccatggagctaaga

SEQ ID NO: 82752 - DNA, 25 bp, Homo sapien
gatccccatggagctaagagtccgt

SEQ ID NO: 82753 - DNA, 25 bp, Homo sapien
tggagctaagagtccgtaacctaaa

SEQ ID NO: 82754 - DNA, 25 bp, Homo sapien
taaaggccttaccatagccatcttc

SEQ ID NO: 82755 - DNA, 25 bp, Homo sapien
tgattgctcaactgccccagaaggg

SEQ ID NO: 82756 - DNA, 25 bp, Homo sapien
gaaaagaagcattaaggaccaggtg

SEQ ID NO: 82757 - DNA, 25 bp, Homo sapien
gcaacaggtgccgcgcagccgagtg

SEQ ID NO: 82758 - DNA, 25 bp, Homo sapien
gcgcagccgagtggcgggctagcat

SEQ ID NO: 82759 - DNA, 25 bp, Homo sapien
agtggcgggctagcataccgcctgc

SEQ ID NO: 82760 - DNA, 25 bp, Homo sapien
agcataccgcctgcccgcaattcgg

SEQ ID NO: 82761 - DNA, 25 bp, Homo sapien
gcaattcggccaggcctcgagcctg

SEQ ID NO: 82762 - DNA, 25 bp, Homo sapien
aattcggccaggcctcgagcctgct

SEQ ID NO: 82763 - DNA, 25 bp, Homo sapien
gggaaacgccgccacgggctgcatg

SEQ ID NO: 82764 - DNA, 25 bp, Homo sapien
ggaaacgccgccacgggctgcatgg

SEQ ID NO: 82765 - DNA, 25 bp, Homo sapien
ggagccgtccagtcttcgaatccca

SEQ ID NO: 82766 - DNA, 25 bp, Homo sapien
gagccgtccagtcttcgaatcccag

SEQ ID NO: 82767 - DNA, 25 bp, Homo sapien
agtcttcgaatcccagcttggtggc

SEQ ID NO: 82768 - DNA, 25 bp, Homo sapien
ctgcctcggcctccaggagtgggag

SEQ ID NO: 82769 - DNA, 25 bp, Homo sapien
ttgatgcctggatacaggagctctg

SEQ ID NO: 82770 - DNA, 25 bp, Homo sapien
gagtgagacaaaacacagggtcctg

SEQ ID NO: 82771 - DNA, 25 bp, Homo sapien
gggaccaagcaatgtcctctggtga

SEQ ID NO: 82772 - DNA, 25 bp, Homo sapien
ggaccaagcaatgtcctctggtgaa

SEQ ID NO: 82773 - DNA, 25 bp, Homo sapien
gaccaagcaatgtcctctggtgaaa

SEQ ID NO: 82774 - DNA, 25 bp, Homo sapien
caagcaatgtcctctggtgaaaaaa

SEQ ID NO: 82775 - DNA, 25 bp, Homo sapien
tgtcctctggtgaaaaaaatcctgg

SEQ ID NO: 82776 - DNA, 25 bp, Homo sapien
aaaaatcctggacttgctggcagaa

SEQ ID NO: 82777 - DNA, 25 bp, Homo sapien
acttgctggcagaagatttgcctct

SEQ ID NO: 82778 - DNA, 25 bp, Homo sapien
agatttgcctcttactcgccatgtg

SEQ ID NO: 82779 - DNA, 25 bp, Homo sapien
caagttttattgtcatgaacatgaa

SEQ ID NO: 82780 - DNA, 25 bp, Homo sapien
tgaaatacaaacacgatggcttcga

SEQ ID NO: 82781 - DNA, 25 bp, Homo sapien
aatacaaacacgatggcttcgaaat

SEQ ID NO: 82782 - DNA, 25 bp, Homo sapien
tacaaacacgatggcttcgaaatgt

SEQ ID NO: 82783 - DNA, 25 bp, Homo sapien
caaacacgatggcttcgaaatgtct

SEQ ID NO: 82784 - DNA, 25 bp, Homo sapien
aacacgatggcttcgaaatgtcttt

SEQ ID NO: 82785 - DNA, 25 bp, Homo sapien
cacgatggcttcgaaatgtctttca

SEQ ID NO: 82786 - DNA, 25 bp, Homo sapien
acgatggcttcgaaatgtctttcaa

SEQ ID NO: 82787 - DNA, 25 bp, Homo sapien
cgatggcttcgaaatgtctttcaat

SEQ ID NO: 82788 - DNA, 25 bp, Homo sapien
gatggcttcgaaatgtctttcaata

SEQ ID NO: 82789 - DNA, 25 bp, Homo sapien
atggcttcgaaatgtctttcaataa

SEQ ID NO: 82790 - DNA, 25 bp, Homo sapien
gtgtgaaatttatactatccctgct

SEQ ID NO: 82791 - DNA, 25 bp, Homo sapien
gaaatttatactatccctgcttaaa

SEQ ID NO: 82792 - DNA, 25 bp, Homo sapien
tattgtgggaagattcctcctctgt

SEQ ID NO: 82793 - DNA, 25 bp, Homo sapien
agattcctcctctgtgatatcatac

SEQ ID NO: 82794 - DNA, 25 bp, Homo sapien
ctctgtgatatcatacagcatctga

SEQ ID NO: 82795 - DNA, 25 bp, Homo sapien
gaaagtgaacagtatcccaaagcag

SEQ ID NO: 82796 - DNA, 25 bp, Homo sapien
tgaacagtatcccaaagcagttcca

SEQ ID NO: 82797 - DNA, 25 bp, Homo sapien
aagaaggttgactattgtatggcca

SEQ ID NO: 82798 - DNA, 25 bp, Homo sapien
tgactattgtatggccaaggatggc

SEQ ID NO: 82799 - DNA, 25 bp, Homo sapien
ggcagtatgtaatccagaagcaaac

SEQ ID NO: 82800 - DNA, 25 bp, Homo sapien
gaagcaaacttgtattaattgttct

SEQ ID NO: 82801 - DNA, 25 bp, Homo sapien
actaccaccctgaggtgtccaaagc

SEQ ID NO: 82802 - DNA, 25 bp, Homo sapien
gaggtgtccaaagccgccagcgtca

SEQ ID NO: 82803 - DNA, 25 bp, Homo sapien
tgaggtcagcatcgcgccactgctg

SEQ ID NO: 82804 - DNA, 25 bp, Homo sapien
ggagctcacggcctacgagatcttt

SEQ ID NO: 82805 - DNA, 25 bp, Homo sapien
acgagatctttgagcgggacctgaa

SEQ ID NO: 82806 - DNA, 25 bp, Homo sapien
gagccggtgccactggagtttatcc

SEQ ID NO: 82807 - DNA, 25 bp, Homo sapien
tggagtttatcccagcccagggcct

SEQ ID NO: 82808 - DNA, 25 bp, Homo sapien
gacggccgggtgaactctgtgccca

SEQ ID NO: 82809 - DNA, 25 bp, Homo sapien
ggccgggtgaactctgtgcccagca

SEQ ID NO: 82810 - DNA, 25 bp, Homo sapien
gaccctggcccacctgtgaataaat

SEQ ID NO: 82811 - DNA, 25 bp, Homo sapien
gtgaataaatctcagctgaccccag

SEQ ID NO: 82812 - DNA, 25 bp, Homo sapien
cagaaaatgccatactctgttttgg

SEQ ID NO: 82813 - DNA, 25 bp, Homo sapien
cccctggtacacttggaagactctt

SEQ ID NO: 82814 - DNA, 25 bp, Homo sapien
ggaagactcttatccatctgtgaaa

SEQ ID NO: 82815 - DNA, 25 bp, Homo sapien
atctgtgaaaccctatgttgtcatc

SEQ ID NO: 82816 - DNA, 25 bp, Homo sapien
atgttgtcatcacttggtccatgaa

SEQ ID NO: 82817 - DNA, 25 bp, Homo sapien
ggtccatgaaatattacctggccaa

SEQ ID NO: 82818 - DNA, 25 bp, Homo sapien
tattacctggccaatatcccaccat

SEQ ID NO: 82819 - DNA, 25 bp, Homo sapien
ctctgtatgctgtcacacctatatt

SEQ ID NO: 82820 - DNA, 25 bp, Homo sapien
ttgcattgtaattacttcctgacct

SEQ ID NO: 82821 - DNA, 25 bp, Homo sapien
attacttcctgacctttgtatctac

SEQ ID NO: 82822 - DNA, 25 bp, Homo sapien
gacctttgtatctactcttttagta

SEQ ID NO: 82823 - DNA, 25 bp, Homo sapien
agcccatggctagtggctcatcccc

SEQ ID NO: 82824 - DNA, 25 bp, Homo sapien
attctccccctgacacagagaaggg

SEQ ID NO: 82825 - DNA, 25 bp, Homo sapien
ggttgcagggactgtggtctctcct

SEQ ID NO: 82826 - DNA, 25 bp, Homo sapien
ttgcagggactgtggtctctcctgg

SEQ ID NO: 82827 - DNA, 25 bp, Homo sapien
gggacccgcctggtctttcagccat

SEQ ID NO: 82828 - DNA, 25 bp, Homo sapien
agccatgctgatgaccacaccccgt

SEQ ID NO: 82829 - DNA, 25 bp, Homo sapien
tcgtggtggccccagatctctgtaa

SEQ ID NO: 82830 - DNA, 25 bp, Homo sapien
cagatctctgtaattttatgtagag

SEQ ID NO: 82831 - DNA, 25 bp, Homo sapien
ttttatgtagagtttgagctgaagc

SEQ ID NO: 82832 - DNA, 25 bp, Homo sapien
gctgaagccccgtatatttaattta

SEQ ID NO: 82833 - DNA, 25 bp, Homo sapien
tgaagccccgtatatttaatttatt

SEQ ID NO: 82834 - DNA, 25 bp, Homo sapien
gggaccaagcaatgtcctctggtga

SEQ ID NO: 82835 - DNA, 25 bp, Homo sapien
ggaccaagcaatgtcctctggtgaa

SEQ ID NO: 82836 - DNA, 25 bp, Homo sapien
gaccaagcaatgtcctctggtgaaa

SEQ ID NO: 82837 - DNA, 25 bp, Homo sapien
accaagcaatgtcctctggtgaaaa

SEQ ID NO: 82838 - DNA, 25 bp, Homo sapien
ccaagcaatgtcctctggtgaaaaa

SEQ ID NO: 82839 - DNA, 25 bp, Homo sapien
caagcaatgtcctctggtgaaaaaa

SEQ ID NO: 82840 - DNA, 25 bp, Homo sapien
agcaatgtcctctggtgaaaaaaat

SEQ ID NO: 82841 - DNA, 25 bp, Homo sapien
gcaatgtcctctggtgaaaaaaatc

SEQ ID NO: 82842 - DNA, 25 bp, Homo sapien
aatgtcctctggtgaaaaaaatcct

SEQ ID NO: 82843 - DNA, 25 bp, Homo sapien
atgtcctctggtgaaaaaaatcctg

SEQ ID NO: 82844 - DNA, 25 bp, Homo sapien
tgtcctctggtgaaaaaaatcctgg

SEQ ID NO: 82845 - DNA, 25 bp, Homo sapien
gtgtgctgctggatgtttacctgga

SEQ ID NO: 82846 - DNA, 25 bp, Homo sapien
agaccgagagccatgacgacagtgt

SEQ ID NO: 82847 - DNA, 25 bp, Homo sapien
agaagatgtgtctgcggctcttcag

SEQ ID NO: 82848 - DNA, 25 bp, Homo sapien
gggtcctagcaggatgaagccattt

SEQ ID NO: 82849 - DNA, 25 bp, Homo sapien
ttaaatacaaccatcctcagggatt

SEQ ID NO: 82850 - DNA, 25 bp, Homo sapien
tcagggattcttcagccatcgctga

SEQ ID NO: 82851 - DNA, 25 bp, Homo sapien
tgatctcccgcgcagaccgttgttt

SEQ ID NO: 82852 - DNA, 25 bp, Homo sapien
accctgagcactgggcttctgcttt

SEQ ID NO: 82853 - DNA, 25 bp, Homo sapien
tctggcccacatgtgactcttgata

SEQ ID NO: 82854 - DNA, 25 bp, Homo sapien
atgtgactcttgatattctccaaag

SEQ ID NO: 82855 - DNA, 25 bp, Homo sapien
ttctccaaagacaccagccaattaa

SEQ ID NO: 82856 - DNA, 25 bp, Homo sapien
tcctttcccttcacgtggtctgcag

SEQ ID NO: 82857 - DNA, 25 bp, Homo sapien
tccaccagggtaccctgtcttggtg

SEQ ID NO: 82858 - DNA, 25 bp, Homo sapien
tttcctttgaggctctagtggaggt

SEQ ID NO: 82859 - DNA, 25 bp, Homo sapien
ctagtggaggtggatgtccttctct

SEQ ID NO: 82860 - DNA, 25 bp, Homo sapien
tggatgtccttctctgccaggcttg

SEQ ID NO: 82861 - DNA, 25 bp, Homo sapien
gccaggcttggcacatgatgtgaag

SEQ ID NO: 82862 - DNA, 25 bp, Homo sapien
aaatgcccaattcttactgttcagg

SEQ ID NO: 82863 - DNA, 25 bp, Homo sapien
tactgttcaggtttgatgtggaatc

SEQ ID NO: 82864 - DNA, 25 bp, Homo sapien
tttgatgtggaatcacagctgcagt

SEQ ID NO: 82865 - DNA, 25 bp, Homo sapien
ttatcagtgcttggttggttttaaa

SEQ ID NO: 82866 - DNA, 25 bp, Homo sapien
taaagtgcacgctattttattatct

SEQ ID NO: 82867 - DNA, 25 bp, Homo sapien
gtgtgtatgtggcactttacaaggc

SEQ ID NO: 82868 - DNA, 25 bp, Homo sapien
gtggcactttacaaggcattctgaa

SEQ ID NO: 82869 - DNA, 25 bp, Homo sapien
cactttacaaggcattctgaagaaa

SEQ ID NO: 82870 - DNA, 25 bp, Homo sapien
gattacctaatatagtggaaagcac

SEQ ID NO: 82871 - DNA, 25 bp, Homo sapien
gtggaaagcacactgctcaaagtca

SEQ ID NO: 82872 - DNA, 25 bp, Homo sapien
cactgctcaaagtcaggacacctgg

SEQ ID NO: 82873 - DNA, 25 bp, Homo sapien
ggacacctgggctctacacctagtt

SEQ ID NO: 82874 - DNA, 25 bp, Homo sapien
cacctgggctctacacctagttttt

SEQ ID NO: 82875 - DNA, 25 bp, Homo sapien
tttttctaacttggctaactgactt

SEQ ID NO: 82876 - DNA, 25 bp, Homo sapien
taactgacttggactgattaccctc

SEQ ID NO: 82877 - DNA, 25 bp, Homo sapien
acttggactgattaccctccctagg

SEQ ID NO: 82878 - DNA, 25 bp, Homo sapien
aaggttctcaagcactcggggataa

SEQ ID NO: 82879 - DNA, 25 bp, Homo sapien
gggataaatagttccaatgcagaag

SEQ ID NO: 82880 - DNA, 25 bp, Homo sapien
ctggctctgttcaatgtgaccgagg

SEQ ID NO: 82881 - DNA, 25 bp, Homo sapien
gctctgttcaatgtgaccgaggcgg

SEQ ID NO: 82882 - DNA, 25 bp, Homo sapien
gaatatatatgtaaggtctccaatt

SEQ ID NO: 82883 - DNA, 25 bp, Homo sapien
gtaaggtctccaattatatagggca

SEQ ID NO: 82884 - DNA, 25 bp, Homo sapien
tctccaattatatagggcaggccaa

SEQ ID NO: 82885 - DNA, 25 bp, Homo sapien
ttatatagggcaggccaaccagtct

SEQ ID NO: 82886 - DNA, 25 bp, Homo sapien
tagggcaggccaaccagtctgcctg

SEQ ID NO: 82887 - DNA, 25 bp, Homo sapien
tgcctggctcactgtcctgccaaaa

SEQ ID NO: 82888 - DNA, 25 bp, Homo sapien
ggctcactgtcctgccaaaacagca

SEQ ID NO: 82889 - DNA, 25 bp, Homo sapien
gctacttacaatcccgacctgttag

SEQ ID NO: 82890 - DNA, 25 bp, Homo sapien
cgacctgttagtcccagtagttttg

SEQ ID NO: 82891 - DNA, 25 bp, Homo sapien
agatgacttctgttgtagactcaca

SEQ ID NO: 82892 - DNA, 25 bp, Homo sapien
tgtagactcacaagtttaactgttg

SEQ ID NO: 82893 - DNA, 25 bp, Homo sapien
cagtattacatgtcaacggtgtggt

SEQ ID NO: 82894 - DNA, 25 bp, Homo sapien
caacggtgtggttatgacctttatt

SEQ ID NO: 82895 - DNA, 25 bp, Homo sapien
tttagtcaatttaccgtgtcttaat

SEQ ID NO: 82896 - DNA, 25 bp, Homo sapien
aatttaatctttgtacaccttccat

SEQ ID NO: 82897 - DNA, 25 bp, Homo sapien
tgtacaccttccatttttaagtgct

SEQ ID NO: 82898 - DNA, 25 bp, Homo sapien
gcttaaatgagtactatattgcaat

SEQ ID NO: 82899 - DNA, 25 bp, Homo sapien
gtagtgatataattaaccagccatt

SEQ ID NO: 82900 - DNA, 25 bp, Homo sapien
agatgacacggatcgccaggctgat

SEQ ID NO: 82901 - DNA, 25 bp, Homo sapien
aagaacaagatgagtgacggcaaga

SEQ ID NO: 82902 - DNA, 25 bp, Homo sapien
gtgacggcaagaaggaggagctcca

SEQ ID NO: 82903 - DNA, 25 bp, Homo sapien
gctccagaagagcttaaacatcctg

SEQ ID NO: 82904 - DNA, 25 bp, Homo sapien
agagcttaaacatcctgactgcctt

SEQ ID NO: 82905 - DNA, 25 bp, Homo sapien
gagcttaaacatcctgactgccttc

SEQ ID NO: 82906 - DNA, 25 bp, Homo sapien
tcctgactgccttccagaagaaggg

SEQ ID NO: 82907 - DNA, 25 bp, Homo sapien
taaaaaggctgtctgtgattttcca

SEQ ID NO: 82908 - DNA, 25 bp, Homo sapien
gagttaacctgctggctgtgagtcc

SEQ ID NO: 82909 - DNA, 25 bp, Homo sapien
gctgtgagtcccttgtggaatataa

SEQ ID NO: 82910 - DNA, 25 bp, Homo sapien
cagtggtactaacccacgattctga

SEQ ID NO: 82911 - DNA, 25 bp, Homo sapien
ccacacgatatcctttggtatcagt

SEQ ID NO: 82912 - DNA, 25 bp, Homo sapien
tggtatcagtcaatgaggctccata

SEQ ID NO: 82913 - DNA, 25 bp, Homo sapien
tgaggctccatatcgtaacatgcta

SEQ ID NO: 82914 - DNA, 25 bp, Homo sapien
tatcgtaacatgctaccagcaggca

SEQ ID NO: 82915 - DNA, 25 bp, Homo sapien
aacccgtggttgcaaatgcctacga

SEQ ID NO: 82916 - DNA, 25 bp, Homo sapien
gcaaatgcctacgatcgctgataga

SEQ ID NO: 82917 - DNA, 25 bp, Homo sapien
gctgatagatcagctgcccctcatt

SEQ ID NO: 82918 - DNA, 25 bp, Homo sapien
tcaaccatcaccactggacaaatat

SEQ ID NO: 82919 - DNA, 25 bp, Homo sapien
cactggacaaatatcaccctaatta

SEQ ID NO: 82920 - DNA, 25 bp, Homo sapien
accctaattacaactgatctgccat

SEQ ID NO: 82921 - DNA, 25 bp, Homo sapien
gacaacagagactaacatttacatt

SEQ ID NO: 82922 - DNA, 25 bp, Homo sapien
agatttgggaacacttggaggattt

SEQ ID NO: 82923 - DNA, 25 bp, Homo sapien
gggaacacttggaggatttgctaaa

SEQ ID NO: 82924 - DNA, 25 bp, Homo sapien
ggatttgctaaaatgagcctcagaa

SEQ ID NO: 82925 - DNA, 25 bp, Homo sapien
tggttttctaacctgtgactttttg

SEQ ID NO: 82926 - DNA, 25 bp, Homo sapien
gaattattcctttcagtctttattt

SEQ ID NO: 82927 - DNA, 25 bp, Homo sapien
gaaacaatgtgtattgaagtaccta

SEQ ID NO: 82928 - DNA, 25 bp, Homo sapien
tcctttttcaatgaacatattctga

SEQ ID NO: 82929 - DNA, 25 bp, Homo sapien
atgtggtttctgtcttagaccagga

SEQ ID NO: 82930 - DNA, 25 bp, Homo sapien
tagaccaggaggacagagtttgctt

SEQ ID NO: 82931 - DNA, 25 bp, Homo sapien
ggaggacagagtttgctttcatatt

SEQ ID NO: 82932 - DNA, 25 bp, Homo sapien
ttccctgtaagtaagagggcttatt

SEQ ID NO: 82933 - DNA, 25 bp, Homo sapien
cactgttgccttgagaattgaagac

SEQ ID NO: 82934 - DNA, 25 bp, Homo sapien
attgaagacatgtaggtgactcaca

SEQ ID NO: 82935 - DNA, 25 bp, Homo sapien
aggtgactcacaaacttcttggaaa

SEQ ID NO: 82936 - DNA, 25 bp, Homo sapien
cttcttggaaagagaccctgtgtga

SEQ ID NO: 82937 - DNA, 25 bp, Homo sapien
gaaagagaccctgtgtgaatgtaaa

SEQ ID NO: 82938 - DNA, 25 bp, Homo sapien
tttggaccacagatacccaagtcag

SEQ ID NO: 82939 - DNA, 25 bp, Homo sapien
gatacccaagtcagtcagtttcaga

SEQ ID NO: 82940 - DNA, 25 bp, Homo sapien
gtcagtttcagagtattggccagtg

SEQ ID NO: 82941 - DNA, 25 bp, Homo sapien
gagtattggccagtgtactttcctt

SEQ ID NO: 82942 - DNA, 25 bp, Homo sapien
attggccagtgtactttccttcttc

SEQ ID NO: 82943 - DNA, 25 bp, Homo sapien
tccatcacttcttcccttaagttaa

SEQ ID NO: 82944 - DNA, 25 bp, Homo sapien
ataagaggcgtcctgagccttcagc

SEQ ID NO: 82945 - DNA, 25 bp, Homo sapien
ccaggcctgggatatcgggttcaga

SEQ ID NO: 82946 - DNA, 25 bp, Homo sapien
gtggctccacccatgaggctggtga

SEQ ID NO: 82947 - DNA, 25 bp, Homo sapien
gtgacactgacgctggcttggctaa

SEQ ID NO: 82948 - DNA, 25 bp, Homo sapien
cgctggcttggctaagttggctcaa

SEQ ID NO: 82949 - DNA, 25 bp, Homo sapien
ggctaagttggctcaagccgggtct

SEQ ID NO: 82950 - DNA, 25 bp, Homo sapien
gctcaagccgggtctggcctgacag

SEQ ID NO: 82951 - DNA, 25 bp, Homo sapien
gacagggtgcagtcacaccaggagc

SEQ ID NO: 82952 - DNA, 25 bp, Homo sapien
gtgatgcctctcttgccgggtaggg

SEQ ID NO: 82953 - DNA, 25 bp, Homo sapien
ctgcagcactgtgggcgccagagca

SEQ ID NO: 82954 - DNA, 25 bp, Homo sapien
tgtgggcgccagagcacagattaaa

SEQ ID NO: 82955 - DNA, 25 bp, Homo sapien
gctgctgaatggtcctatctgctgg

SEQ ID NO: 82956 - DNA, 25 bp, Homo sapien
tgaatggtcctatctgctggctctc

SEQ ID NO: 82957 - DNA, 25 bp, Homo sapien
tctcccctgagatctggacagagga

SEQ ID NO: 82958 - DNA, 25 bp, Homo sapien
aagatgggagggtgctcatcacccc

SEQ ID NO: 82959 - DNA, 25 bp, Homo sapien
agcataatgatcagcctccttccta

SEQ ID NO: 82960 - DNA, 25 bp, Homo sapien
atgatcagcctccttcctagagaca

SEQ ID NO: 82961 - DNA, 25 bp, Homo sapien
tcctagagacagactcatgcagatt

SEQ ID NO: 82962 - DNA, 25 bp, Homo sapien
gcagattgagatcaaaagtccctct

SEQ ID NO: 82963 - DNA, 25 bp, Homo sapien
caaaagtccctctgcttgggatcaa

SEQ ID NO: 82964 - DNA, 25 bp, Homo sapien
agtccctctgcttgggatcaaatta

SEQ ID NO: 82965 - DNA, 25 bp, Homo sapien
atgtttgacagagctggccaggcgt

SEQ ID NO: 82966 - DNA, 25 bp, Homo sapien
ttcgcttgatatcactgtgccaaag

SEQ ID NO: 82967 - DNA, 25 bp, Homo sapien
gcttgatatcactgtgccaaagatt

SEQ ID NO: 82968 - DNA, 25 bp, Homo sapien
gtccagaagtaacatgagtgttgcc

SEQ ID NO: 82969 - DNA, 25 bp, Homo sapien
taacatgagtgttgccagaagcgat

SEQ ID NO: 82970 - DNA, 25 bp, Homo sapien
gtgttgccagaagcgatgatactct

SEQ ID NO: 82971 - DNA, 25 bp, Homo sapien
atgatactctggatgaggaagactc

SEQ ID NO: 82972 - DNA, 25 bp, Homo sapien
agactcctttgtgatgaaagccatc

SEQ ID NO: 82973 - DNA, 25 bp, Homo sapien
tgaaagccatcatccatgccatcaa

SEQ ID NO: 82974 - DNA, 25 bp, Homo sapien
agccatcatccatgccatcaacgat

SEQ ID NO: 82975 - DNA, 25 bp, Homo sapien
gccatcaacgatgacaatgtcccag

SEQ ID NO: 82976 - DNA, 25 bp, Homo sapien
cgatgacaatgtcccaggcctgcag

SEQ ID NO: 82977 - DNA, 25 bp, Homo sapien
ttgaagtccacttgttctgtacttg

SEQ ID NO: 82978 - DNA, 25 bp, Homo sapien
tgaagtccacttgttctgtacttgt

SEQ ID NO: 82979 - DNA, 25 bp, Homo sapien
gaagtccacttgttctgtacttgta

SEQ ID NO: 82980 - DNA, 25 bp, Homo sapien
aagtccacttgttctgtacttgtaa

SEQ ID NO: 82981 - DNA, 25 bp, Homo sapien
agtccacttgttctgtacttgtaaa

SEQ ID NO: 82982 - DNA, 25 bp, Homo sapien
gtccacttgttctgtacttgtaaaa

SEQ ID NO: 82983 - DNA, 25 bp, Homo sapien
tccacttgttctgtacttgtaaaag

SEQ ID NO: 82984 - DNA, 25 bp, Homo sapien
cacttgttctgtacttgtaaaaggg

SEQ ID NO: 82985 - DNA, 25 bp, Homo sapien
attagctgtgcatagtggttggcac

SEQ ID NO: 82986 - DNA, 25 bp, Homo sapien
gctgtgcatagtggttggcacctgt

SEQ ID NO: 82987 - DNA, 25 bp, Homo sapien
tgaggcaagctaactgcttgaaccc

SEQ ID NO: 82988 - DNA, 25 bp, Homo sapien
tgaaggaccacaggccccggatggt

SEQ ID NO: 82989 - DNA, 25 bp, Homo sapien
aggtctcagagcacttcttcgagta

SEQ ID NO: 82990 - DNA, 25 bp, Homo sapien
ctcagagcacttcttcgagtacaag

SEQ ID NO: 82991 - DNA, 25 bp, Homo sapien
tcgagtacaagaagagccgcagtgg

SEQ ID NO: 82992 - DNA, 25 bp, Homo sapien
gcagtgggaggcacgtcgtcttcta

SEQ ID NO: 82993 - DNA, 25 bp, Homo sapien
gccagggcctggactacttctacga

SEQ ID NO: 82994 - DNA, 25 bp, Homo sapien
acgacctgctctaggtgggcattgc

SEQ ID NO: 82995 - DNA, 25 bp, Homo sapien
tctaggtgggcattgcggcctccgc

SEQ ID NO: 82996 - DNA, 25 bp, Homo sapien
tccgcggtggacgtgttcttttcta

SEQ ID NO: 82997 - DNA, 25 bp, Homo sapien
gacgtgttcttttctaagccatgga

SEQ ID NO: 82998 - DNA, 25 bp, Homo sapien
ttctaagccatggagtgagtgagca

SEQ ID NO: 82999 - DNA, 25 bp, Homo sapien
gactgttcctcccaatgtggccccc

SEQ ID NO: 83000 - DNA, 25 bp, Homo sapien
actgttcctcccaatgtggccccca

SEQ ID NO: 83001 - DNA, 25 bp, Homo sapien
ctgttcctcccaatgtggcccccag

SEQ ID NO: 83002 - DNA, 25 bp, Homo sapien
tgttcctcccaatgtggcccccagc

SEQ ID NO: 83003 - DNA, 25 bp, Homo sapien
gttcctcccaatgtggcccccagcc

SEQ ID NO: 83004 - DNA, 25 bp, Homo sapien
ttcctcccaatgtggcccccagccc

SEQ ID NO: 83005 - DNA, 25 bp, Homo sapien
tcctcccaatgtggcccccagccct

SEQ ID NO: 83006 - DNA, 25 bp, Homo sapien
cccagccctgatgtgggccccctgc

SEQ ID NO: 83007 - DNA, 25 bp, Homo sapien
ccgattgaagacgtgttgctgtcct

SEQ ID NO: 83008 - DNA, 25 bp, Homo sapien
gattgaagacgtgttgctgtcctca

SEQ ID NO: 83009 - DNA, 25 bp, Homo sapien
tgttgctgtcctcagtgcggcgctc

SEQ ID NO: 83010 - DNA, 25 bp, Homo sapien
agtgcggcgctctgtcctcatgaag

SEQ ID NO: 83011 - DNA, 25 bp, Homo sapien
tgcggcgctctgtcctcatgaagag

SEQ ID NO: 83012 - DNA, 25 bp, Homo sapien
gcgctctgtcctcatgaagagggac

SEQ ID NO: 83013 - DNA, 25 bp, Homo sapien
gagggtgactgaggctacagcttct

SEQ ID NO: 83014 - DNA, 25 bp, Homo sapien
gaggctacagcttctatcacatgcc

SEQ ID NO: 83015 - DNA, 25 bp, Homo sapien
acagcttctatcacatgccgaactt

SEQ ID NO: 83016 - DNA, 25 bp, Homo sapien
acatgccgaactttcttgtgacaaa

SEQ ID NO: 83017 - DNA, 25 bp, Homo sapien
ggaaataatcattgctggagattct

SEQ ID NO: 83018 - DNA, 25 bp, Homo sapien
tggcgtggctagtggccatgcacaa

SEQ ID NO: 83019 - DNA, 25 bp, Homo sapien
tgccaagctcctctatgaatctcgg

SEQ ID NO: 83020 - DNA, 25 bp, Homo sapien
cctctatgaatctcgggaccagtaa

SEQ ID NO: 83021 - DNA, 25 bp, Homo sapien
tgagcttggagtacgtgtggtcacc

SEQ ID NO: 83022 - DNA, 25 bp, Homo sapien
tgtggtcaccaggactgagtcgctt

SEQ ID NO: 83023 - DNA, 25 bp, Homo sapien
gtcgcttggaacagcagagcctgct

SEQ ID NO: 83024 - DNA, 25 bp, Homo sapien
gctccttgcgtaccacagggattaa

SEQ ID NO: 83025 - DNA, 25 bp, Homo sapien
ggattaatcctgcttgtgctgggaa

SEQ ID NO: 83026 - DNA, 25 bp, Homo sapien
gtgctgggaaatgcaactcactcat

SEQ ID NO: 83027 - DNA, 25 bp, Homo sapien
gcaactcactcatgtatttggagaa

SEQ ID NO: 83028 - DNA, 25 bp, Homo sapien
ggagtgttcacttatctagtgcaat

SEQ ID NO: 83029 - DNA, 25 bp, Homo sapien
cttccctcctttactgtattagcaa

SEQ ID NO: 83030 - DNA, 25 bp, Homo sapien
ttagcaacaagctgtccatgggtgg

SEQ ID NO: 83031 - DNA, 25 bp, Homo sapien
ctgtgtgttagcctgtacgtagcac

SEQ ID NO: 83032 - DNA, 25 bp, Homo sapien
gcctgtacgtagcacatgggacttt

SEQ ID NO: 83033 - DNA, 25 bp, Homo sapien
gtagcacatgggactttccacatag

SEQ ID NO: 83034 - DNA, 25 bp, Homo sapien
tgggactttccacatagtagatatt

SEQ ID NO: 83035 - DNA, 25 bp, Homo sapien
caaacttgccctttgaaagactaag

SEQ ID NO: 83036 - DNA, 25 bp, Homo sapien
tattgttcccttcagtttgaaaaat

SEQ ID NO: 83037 - DNA, 25 bp, Homo sapien
aaatcatcgatatttgaaactggga

SEQ ID NO: 83038 - DNA, 25 bp, Homo sapien
gaaactgggatacgcttggtagctt

SEQ ID NO: 83039 - DNA, 25 bp, Homo sapien
ctgggatacgcttggtagctttttt

SEQ ID NO: 83040 - DNA, 25 bp, Homo sapien
gtcaccgtcccaatgagaaacaaga

SEQ ID NO: 83041 - DNA, 25 bp, Homo sapien
gaaggagcaccctccacatggactc

SEQ ID NO: 83042 - DNA, 25 bp, Homo sapien
cacctgcaagtggacagcgacattc

SEQ ID NO: 83043 - DNA, 25 bp, Homo sapien
gacagcgacattcagtcctgcactg

SEQ ID NO: 83044 - DNA, 25 bp, Homo sapien
gcactgctcacctgggtttactgat

SEQ ID NO: 83045 - DNA, 25 bp, Homo sapien
accatcctctctgatctgtgagaaa

SEQ ID NO: 83046 - DNA, 25 bp, Homo sapien
taagctgctgtgacttccctttagg

SEQ ID NO: 83047 - DNA, 25 bp, Homo sapien
gtaaatctttgaaggacacaccgaa

SEQ ID NO: 83048 - DNA, 25 bp, Homo sapien
gacacaccgaagacctttatactgt

SEQ ID NO: 83049 - DNA, 25 bp, Homo sapien
tatactgtgatcttttacccctttc

SEQ ID NO: 83050 - DNA, 25 bp, Homo sapien
cactcttggctttcttatgttgctt

SEQ ID NO: 83051 - DNA, 25 bp, Homo sapien
gacaggtgaagttgctggaacccat

SEQ ID NO: 83052 - DNA, 25 bp, Homo sapien
aacccattctccattcagcagattg

SEQ ID NO: 83053 - DNA, 25 bp, Homo sapien
agcagattgtatcctcaccccatgt

SEQ ID NO: 83054 - DNA, 25 bp, Homo sapien
tcaccccatgtgaccttattgctgc

SEQ ID NO: 83055 - DNA, 25 bp, Homo sapien
attgctgctcagactctatgttcca

SEQ ID NO: 83056 - DNA, 25 bp, Homo sapien
agaagtgcatccctcatgatgtgaa

SEQ ID NO: 83057 - DNA, 25 bp, Homo sapien
aagcatgtgcgcagctgggaaccaa

SEQ ID NO: 83058 - DNA, 25 bp, Homo sapien
gggaaccaaattcgagagctcacag

SEQ ID NO: 83059 - DNA, 25 bp, Homo sapien
agctgtgaccgctatgaggcccgtg

SEQ ID NO: 83060 - DNA, 25 bp, Homo sapien
gaggcccgtgatgacagctattaag

SEQ ID NO: 83061 - DNA, 25 bp, Homo sapien
gctattaagggagactcaccaccaa

SEQ ID NO: 83062 - DNA, 25 bp, Homo sapien
gcagatcttcaacctctttaccaca

SEQ ID NO: 83063 - DNA, 25 bp, Homo sapien
cagatcttcaacctctttaccacaa

SEQ ID NO: 83064 - DNA, 25 bp, Homo sapien
agatcttcaacctctttaccacaaa

SEQ ID NO: 83065 - DNA, 25 bp, Homo sapien
gatcttcaacctctttaccacaaaa

SEQ ID NO: 83066 - DNA, 25 bp, Homo sapien
atcttcaacctctttaccacaaaag

SEQ ID NO: 83067 - DNA, 25 bp, Homo sapien
tcttcaacctctttaccacaaaaga

SEQ ID NO: 83068 - DNA, 25 bp, Homo sapien
cttcaacctctttaccacaaaagat

SEQ ID NO: 83069 - DNA, 25 bp, Homo sapien
ttaccacaaaagattcatctgctgc

SEQ ID NO: 83070 - DNA, 25 bp, Homo sapien
catggtcaaggaggcaatcaattct

SEQ ID NO: 83071 - DNA, 25 bp, Homo sapien
aataaggtttaattctgtgacagag

SEQ ID NO: 83072 - DNA, 25 bp, Homo sapien
gttatgtgcagaggtacctgagcaa

SEQ ID NO: 83073 - DNA, 25 bp, Homo sapien
attgtcccaaagatgggttccctgt

SEQ ID NO: 83074 - DNA, 25 bp, Homo sapien
ggttccctgtaccagcaaacattat

SEQ ID NO: 83075 - DNA, 25 bp, Homo sapien
agatggaactatttttcacccacac

SEQ ID NO: 83076 - DNA, 25 bp, Homo sapien
tatttttcacccacactcaggactg

SEQ ID NO: 83077 - DNA, 25 bp, Homo sapien
ctcaggactgtgtcttagtgcttat

SEQ ID NO: 83078 - DNA, 25 bp, Homo sapien
gtcttagtgcttatcggacaccgga

SEQ ID NO: 83079 - DNA, 25 bp, Homo sapien
tgcttatcggacaccggagggccga

SEQ ID NO: 83080 - DNA, 25 bp, Homo sapien
gagggccgacctgatgtacaaatga

SEQ ID NO: 83081 - DNA, 25 bp, Homo sapien
caaaaactgtttccgatgtgcaaag

SEQ ID NO: 83082 - DNA, 25 bp, Homo sapien
ctgtttccgatgtgcaaagtgtggg

SEQ ID NO: 83083 - DNA, 25 bp, Homo sapien
gtcttgaatcaacaactctgactga

SEQ ID NO: 83084 - DNA, 25 bp, Homo sapien
tctattgtaaaggatgctatgcaaa

SEQ ID NO: 83085 - DNA, 25 bp, Homo sapien
ctttgggcccaagggatttggctat

SEQ ID NO: 83086 - DNA, 25 bp, Homo sapien
gggctcttgttcatgcccagtaaga

SEQ ID NO: 83087 - DNA, 25 bp, Homo sapien
atgcccagtaagatgtaaaccctga

SEQ ID NO: 83088 - DNA, 25 bp, Homo sapien
gtaaaccctgaactaaacatcacac

SEQ ID NO: 83089 - DNA, 25 bp, Homo sapien
aacatcacacactgagaatctcttc

SEQ ID NO: 83090 - DNA, 25 bp, Homo sapien
gaatctcttcataatctaggcacag

SEQ ID NO: 83091 - DNA, 25 bp, Homo sapien
aatctaggcacagataatctttaac

SEQ ID NO: 83092 - DNA, 25 bp, Homo sapien
tgcaggaccccttgaatttacattg

SEQ ID NO: 83093 - DNA, 25 bp, Homo sapien
atttacattgaattccatccccagc

SEQ ID NO: 83094 - DNA, 25 bp, Homo sapien
ccagccgagcaggtgcttaaagtca

SEQ ID NO: 83095 - DNA, 25 bp, Homo sapien
gggacactccattttcttggaattt

SEQ ID NO: 83096 - DNA, 25 bp, Homo sapien
ggaatttcattctggcaaagagggt

SEQ ID NO: 83097 - DNA, 25 bp, Homo sapien
gaagaaccaaccaaactcaggagct

SEQ ID NO: 83098 - DNA, 25 bp, Homo sapien
aactcaggagctaccaggctgcttg

SEQ ID NO: 83099 - DNA, 25 bp, Homo sapien
accaggctgcttgtttctgtgaaaa

SEQ ID NO: 83100 - DNA, 25 bp, Homo sapien
gaaaatgttgtgagtgttggatgtc

SEQ ID NO: 83101 - DNA, 25 bp, Homo sapien
tgtgtgtgtgccattgtgtgcttag

SEQ ID NO: 83102 - DNA, 25 bp, Homo sapien
gtgtgtttgcctttaactggagtct

SEQ ID NO: 83103 - DNA, 25 bp, Homo sapien
tgtcacccttgccttgggtgtccct

SEQ ID NO: 83104 - DNA, 25 bp, Homo sapien
tcctgcctcagcttaattttagagg

SEQ ID NO: 83105 - DNA, 25 bp, Homo sapien
ttagaggatattgggcctggttttc

SEQ ID NO: 83106 - DNA, 25 bp, Homo sapien
gatattgggcctggttttcttgtcc

SEQ ID NO: 83107 - DNA, 25 bp, Homo sapien
ggcctggttttcttgtcccttcata

SEQ ID NO: 83108 - DNA, 25 bp, Homo sapien
ttttcttgtcccttcataccctagt

SEQ ID NO: 83109 - DNA, 25 bp, Homo sapien
ataccctagtccctggacagctgag

SEQ ID NO: 83110 - DNA, 25 bp, Homo sapien
ggagatgaaaggagccacaccacaa

SEQ ID NO: 83111 - DNA, 25 bp, Homo sapien
aggagccacaccacaacaatggcgg

SEQ ID NO: 83112 - DNA, 25 bp, Homo sapien
gggagaagcacgctcaggcttcctc

SEQ ID NO: 83113 - DNA, 25 bp, Homo sapien
gcacgctcaggcttcctctgctttg

SEQ ID NO: 83114 - DNA, 25 bp, Homo sapien
gcccacagaggagcatatactgaaa

SEQ ID NO: 83115 - DNA, 25 bp, Homo sapien
tgaaaagaaggcagtatcacagaat

SEQ ID NO: 83116 - DNA, 25 bp, Homo sapien
aagggcagggtaggccacttggcct

SEQ ID NO: 83117 - DNA, 25 bp, Homo sapien
gccacttggcctatttactttcaaa

SEQ ID NO: 83118 - DNA, 25 bp, Homo sapien
gcatttagagtgtttcgcatcagaa

SEQ ID NO: 83119 - DNA, 25 bp, Homo sapien
gtttcgcatcagaataacatgagta

SEQ ID NO: 83120 - DNA, 25 bp, Homo sapien
acatgagtaagatgaactggaacac

SEQ ID NO: 83121 - DNA, 25 bp, Homo sapien
tggaacacaaaattttcagctcttt

SEQ ID NO: 83122 - DNA, 25 bp, Homo sapien
aaattttcagctctttggtcaaaag

SEQ ID NO: 83123 - DNA, 25 bp, Homo sapien
atgtattcgatttaagcatggctta

SEQ ID NO: 83124 - DNA, 25 bp, Homo sapien
aaacaactaatgctctttgaagaat

SEQ ID NO: 83125 - DNA, 25 bp, Homo sapien
tgttcatcaccattctaaaatactg

SEQ ID NO: 83126 - DNA, 25 bp, Homo sapien
taaaatactgttcttccaaccctat

SEQ ID NO: 83127 - DNA, 25 bp, Homo sapien
aatactgttcttccaaccctatctt

SEQ ID NO: 83128 - DNA, 25 bp, Homo sapien
aaccctatcttcaatgaccagtcca

SEQ ID NO: 83129 - DNA, 25 bp, Homo sapien
ccctatcttcaatgaccagtccaga

SEQ ID NO: 83130 - DNA, 25 bp, Homo sapien
atcttcaatgaccagtccagaaggg

SEQ ID NO: 83131 - DNA, 25 bp, Homo sapien
gggttaagctggattcatttgctct

SEQ ID NO: 83132 - DNA, 25 bp, Homo sapien
aagctggattcatttgctctggcat

SEQ ID NO: 83133 - DNA, 25 bp, Homo sapien
tggcatgtgcattcccagcagggtg

SEQ ID NO: 83134 - DNA, 25 bp, Homo sapien
tttctcccagtctttgcataggaga

SEQ ID NO: 83135 - DNA, 25 bp, Homo sapien
gactttgtattgagttctttttgaa

SEQ ID NO: 83136 - DNA, 25 bp, Homo sapien
gagtccagtgaaatgatatattctg

SEQ ID NO: 83137 - DNA, 25 bp, Homo sapien
agtccagtgaaatgatatattctgg

SEQ ID NO: 83138 - DNA, 25 bp, Homo sapien
gtccagtgaaatgatatattctggc

SEQ ID NO: 83139 - DNA, 25 bp, Homo sapien
tccagtgaaatgatatattctggct

SEQ ID NO: 83140 - DNA, 25 bp, Homo sapien
ccagtgaaatgatatattctggctg

SEQ ID NO: 83141 - DNA, 25 bp, Homo sapien
cagtgaaatgatatattctggctgg

SEQ ID NO: 83142 - DNA, 25 bp, Homo sapien
agtgaaatgatatattctggctggg

SEQ ID NO: 83143 - DNA, 25 bp, Homo sapien
gtgaaatgatatattctggctgggc

SEQ ID NO: 83144 - DNA, 25 bp, Homo sapien
ttctctgcaggaccccttgaattta

SEQ ID NO: 83145 - DNA, 25 bp, Homo sapien
tgcaggaccccttgaatttacattg

SEQ ID NO: 83146 - DNA, 25 bp, Homo sapien
aggaccccttgaatttacattgaat

SEQ ID NO: 83147 - DNA, 25 bp, Homo sapien
atttacattgaattccatccccagc

SEQ ID NO: 83148 - DNA, 25 bp, Homo sapien
ccagccgagcaggtgcttaaagtca

SEQ ID NO: 83149 - DNA, 25 bp, Homo sapien
cgagcaggtgcttaaagtcaacagg

SEQ ID NO: 83150 - DNA, 25 bp, Homo sapien
gggacactccattttcttggaattt

SEQ ID NO: 83151 - DNA, 25 bp, Homo sapien
gacactccattttcttggaatttca

SEQ ID NO: 83152 - DNA, 25 bp, Homo sapien
ttcttggaatttcattctggcaaag

SEQ ID NO: 83153 - DNA, 25 bp, Homo sapien
ggaatttcattctggcaaagagggt

SEQ ID NO: 83154 - DNA, 25 bp, Homo sapien
cattctggcaaagagggtgtgagca

SEQ ID NO: 83155 - DNA, 25 bp, Homo sapien
ttttcatggctgttgtcatggctga

SEQ ID NO: 83156 - DNA, 25 bp, Homo sapien
tcaatgcagagaacgcttttagata

SEQ ID NO: 83157 - DNA, 25 bp, Homo sapien
atcagaactctccttaaaatgcatt

SEQ ID NO: 83158 - DNA, 25 bp, Homo sapien
tcaatcagaagcaaagtacacccat

SEQ ID NO: 83159 - DNA, 25 bp, Homo sapien
acacccattatttatgcagacatgt

SEQ ID NO: 83160 - DNA, 25 bp, Homo sapien
gcaatgagtagtataagccacctat

SEQ ID NO: 83161 - DNA, 25 bp, Homo sapien
cacctatttttacttccttctctga

SEQ ID NO: 83162 - DNA, 25 bp, Homo sapien
attccagttaactcagcttgggttc

SEQ ID NO: 83163 - DNA, 25 bp, Homo sapien
tcagcttgggttctgtgctcctcct

SEQ ID NO: 83164 - DNA, 25 bp, Homo sapien
tcctctcttcctatagaacactgtg

SEQ ID NO: 83165 - DNA, 25 bp, Homo sapien
gaacactgtgcataccttgaataaa

SEQ ID NO: 83166 - DNA, 25 bp, Homo sapien
aaggaataacatctggtccaacatg

SEQ ID NO: 83167 - DNA, 25 bp, Homo sapien
tctggtccaacatgaaaacaattct

SEQ ID NO: 83168 - DNA, 25 bp, Homo sapien
aattcttattgactcatacaccagg

SEQ ID NO: 83169 - DNA, 25 bp, Homo sapien
attgactcatacaccaggtcacgct

SEQ ID NO: 83170 - DNA, 25 bp, Homo sapien
atacaccaggtcacgctttcatgaa

SEQ ID NO: 83171 - DNA, 25 bp, Homo sapien
ggtcacgctttcatgaattctgtca

SEQ ID NO: 83172 - DNA, 25 bp, Homo sapien
tttcaaagactctcacccctgctat

SEQ ID NO: 83173 - DNA, 25 bp, Homo sapien
tcacccctgctataactatgaccat

SEQ ID NO: 83174 - DNA, 25 bp, Homo sapien
ccctgctataactatgaccatgctg

SEQ ID NO: 83175 - DNA, 25 bp, Homo sapien
aactatgaccatgctgataaactga

SEQ ID NO: 83176 - DNA, 25 bp, Homo sapien
atgaccatgctgataaactgattta

SEQ ID NO: 83177 - DNA, 25 bp, Homo sapien
gtgctggtctacctcatctgggtgt

SEQ ID NO: 83178 - DNA, 25 bp, Homo sapien
ctggtctacctcatctgggtgttga

SEQ ID NO: 83179 - DNA, 25 bp, Homo sapien
catctgggtgttgatttcacgagta

SEQ ID NO: 83180 - DNA, 25 bp, Homo sapien
ggtgttgatttcacgagtattgtca

SEQ ID NO: 83181 - DNA, 25 bp, Homo sapien
acgagtattgtcagtttgtttccag

SEQ ID NO: 83182 - DNA, 25 bp, Homo sapien
attgtcagtttgtttccagactccc

SEQ ID NO: 83183 - DNA, 25 bp, Homo sapien
aaaccacctaaacaagagcagagag

SEQ ID NO: 83184 - DNA, 25 bp, Homo sapien
caagagcagagaggccatttggtca

SEQ ID NO: 83185 - DNA, 25 bp, Homo sapien
gcagagaggccatttggtcaaagtt

SEQ ID NO: 83186 - DNA, 25 bp, Homo sapien
caaagtttgcaaaggagtcagccat

SEQ ID NO: 83187 - DNA, 25 bp, Homo sapien
aggagtcagccatgattgcttgtat

SEQ ID NO: 83188 - DNA, 25 bp, Homo sapien
gggtcttgctcttccttagcactcc

SEQ ID NO: 83189 - DNA, 25 bp, Homo sapien
ttagcactcctttctccttgtgaga

SEQ ID NO: 83190 - DNA, 25 bp, Homo sapien
tgagatctctcctcagctggaatga

SEQ ID NO: 83191 - DNA, 25 bp, Homo sapien
ggaatgtagtccatctaaactgctt

SEQ ID NO: 83192 - DNA, 25 bp, Homo sapien
gtccatctaaactgcttgctaggct

SEQ ID NO: 83193 - DNA, 25 bp, Homo sapien
ttgctaggctcaattaccacttctg

SEQ ID NO: 83194 - DNA, 25 bp, Homo sapien
accacttctgtttgctttgtggatc

SEQ ID NO: 83195 - DNA, 25 bp, Homo sapien
ggatcctgggataacatgtatatgt

SEQ ID NO: 83196 - DNA, 25 bp, Homo sapien
tacacatgcctattctgccatttct

SEQ ID NO: 83197 - DNA, 25 bp, Homo sapien
gtatgtatcatatgccttctaccat

SEQ ID NO: 83198 - DNA, 25 bp, Homo sapien
tctccctgcgtaagacttgacctgg

SEQ ID NO: 83199 - DNA, 25 bp, Homo sapien
aaggcatcacacacagctttctggc

SEQ ID NO: 83200 - DNA, 25 bp, Homo sapien
acacacagctttctggcacgaatca

SEQ ID NO: 83201 - DNA, 25 bp, Homo sapien
gctttctggcacgaatcacattttg

SEQ ID NO: 83202 - DNA, 25 bp, Homo sapien
cacattttgtggaagtgactactca

SEQ ID NO: 83203 - DNA, 25 bp, Homo sapien
ggaagtgactactcaggtttgtata

SEQ ID NO: 83204 - DNA, 25 bp, Homo sapien
gactactcaggtttgtatattttag

SEQ ID NO: 83205 - DNA, 25 bp, Homo sapien
gaattgcacaggtttgaataggaaa

SEQ ID NO: 83206 - DNA, 25 bp, Homo sapien
gaatcatagtaaaatcagtcatggt

SEQ ID NO: 83207 - DNA, 25 bp, Homo sapien
aaaatagctatcaagaacaagttct

SEQ ID NO: 83208 - DNA, 25 bp, Homo sapien
cttggaattatctgttgtatctgtg

SEQ ID NO: 83209 - DNA, 25 bp, Homo sapien
tgtatctgtgataggaaaccatttt

SEQ ID NO: 83210 - DNA, 25 bp, Homo sapien
aggagccctgtaaggactgaggccc

SEQ ID NO: 83211 - DNA, 25 bp, Homo sapien
agccctgtaaggactgaggccccgg

SEQ ID NO: 83212 - DNA, 25 bp, Homo sapien
cctgggcctcttacccacttggttg

SEQ ID NO: 83213 - DNA, 25 bp, Homo sapien
tctgtctatctacttgtctgtctgg

SEQ ID NO: 83214 - DNA, 25 bp, Homo sapien
tatctacttgtctgtctgggccact

SEQ ID NO: 83215 - DNA, 25 bp, Homo sapien
tgggccactcctgcctgtgtgttgg

SEQ ID NO: 83216 - DNA, 25 bp, Homo sapien
cctgtgtgttggtctattcctggga

SEQ ID NO: 83217 - DNA, 25 bp, Homo sapien
tgtgttggtctattcctgggaagct

SEQ ID NO: 83218 - DNA, 25 bp, Homo sapien
tattcctgggaagctcatcactaca

SEQ ID NO: 83219 - DNA, 25 bp, Homo sapien
ggaagctcatcactacaggccctgg

SEQ ID NO: 83220 - DNA, 25 bp, Homo sapien
ctgtcccatactgttacccataaaa

SEQ ID NO: 83221 - DNA, 25 bp, Homo sapien
atccttcgctcgtttatccaataaa

SEQ ID NO: 83222 - DNA, 25 bp, Homo sapien
accgttctttggagcattgttctaa

SEQ ID NO: 83223 - DNA, 25 bp, Homo sapien
cgaggcggcttttcggagcatgcat

SEQ ID NO: 83224 - DNA, 25 bp, Homo sapien
cggcttttcggagcatgcatgttta

SEQ ID NO: 83225 - DNA, 25 bp, Homo sapien
gcatgcatgtttatagctccagcca

SEQ ID NO: 83226 - DNA, 25 bp, Homo sapien
gcatgtttatagctccagccaggcc

SEQ ID NO: 83227 - DNA, 25 bp, Homo sapien
cagaccgagggctgctgcataagcc

SEQ ID NO: 83228 - DNA, 25 bp, Homo sapien
gctgctgcataagccctgcttggtg

SEQ ID NO: 83229 - DNA, 25 bp, Homo sapien
cagagtgtgggcttaggtttgggac

SEQ ID NO: 83230 - DNA, 25 bp, Homo sapien
gctttggcaactatggtgctcaggt

SEQ ID NO: 83231 - DNA, 25 bp, Homo sapien
tcaggtgattatccttcgctcgttt

SEQ ID NO: 83232 - DNA, 25 bp, Homo sapien
ttcacttttaccttgaagttcaatc

SEQ ID NO: 83233 - DNA, 25 bp, Homo sapien
aagttcaatctgtctctgggaaaga

SEQ ID NO: 83234 - DNA, 25 bp, Homo sapien
atggaaaagccaagagcgtcaggtg

SEQ ID NO: 83235 - DNA, 25 bp, Homo sapien
agcgtcaggtggcaaaagtccttct

SEQ ID NO: 83236 - DNA, 25 bp, Homo sapien
aagtccttctgttactcaagaaaat

SEQ ID NO: 83237 - DNA, 25 bp, Homo sapien
tgtaaagattaactccacctcacca

SEQ ID NO: 83238 - DNA, 25 bp, Homo sapien
accacaatgaggtatttttctcagc

SEQ ID NO: 83239 - DNA, 25 bp, Homo sapien
tttctcagcaattgacacctgttta

SEQ ID NO: 83240 - DNA, 25 bp, Homo sapien
tgacacctgtttactcagttactcc

SEQ ID NO: 83241 - DNA, 25 bp, Homo sapien
ctgtttactcagttactccctgtaa

SEQ ID NO: 83242 - DNA, 25 bp, Homo sapien
actccctgtaactatgttatgctgt

SEQ ID NO: 83243 - DNA, 25 bp, Homo sapien
gatgaccagaaatcagtgcaaacac

SEQ ID NO: 83244 - DNA, 25 bp, Homo sapien
atcagtgcaaacacatcttctgtta

SEQ ID NO: 83245 - DNA, 25 bp, Homo sapien
acatcttctgttaaacccattggta

SEQ ID NO: 83246 - DNA, 25 bp, Homo sapien
aaacccattggtatacacagaatat

SEQ ID NO: 83247 - DNA, 25 bp, Homo sapien
gtatacacagaatattcctgtgccc

SEQ ID NO: 83248 - DNA, 25 bp, Homo sapien
tcctgtgcccacacttaatgtcaat

SEQ ID NO: 83249 - DNA, 25 bp, Homo sapien
gtgcccacacttaatgtcaatctat

SEQ ID NO: 83250 - DNA, 25 bp, Homo sapien
aaccatttatccaagattctactaa

SEQ ID NO: 83251 - DNA, 25 bp, Homo sapien
tgatatttatatcttgcatcctata

SEQ ID NO: 83252 - DNA, 25 bp, Homo sapien
tatcttgcatcctatatcatgtcaa

SEQ ID NO: 83253 - DNA, 25 bp, Homo sapien
gtagagggtgatatataccatgtaa

SEQ ID NO: 83254 - DNA, 25 bp, Homo sapien
gcagagtccagtgaaatgatatatt

SEQ ID NO: 83255 - DNA, 25 bp, Homo sapien
cagagtccagtgaaatgatatattc

SEQ ID NO: 83256 - DNA, 25 bp, Homo sapien
agagtccagtgaaatgatatattct

SEQ ID NO: 83257 - DNA, 25 bp, Homo sapien
gagtccagtgaaatgatatattctg

SEQ ID NO: 83258 - DNA, 25 bp, Homo sapien
gtccagtgaaatgatatattctggc

SEQ ID NO: 83259 - DNA, 25 bp, Homo sapien
tccagtgaaatgatatattctggct

SEQ ID NO: 83260 - DNA, 25 bp, Homo sapien
cagtgaaatgatatattctggctgg

SEQ ID NO: 83261 - DNA, 25 bp, Homo sapien
agtgaaatgatatattctggctggg

SEQ ID NO: 83262 - DNA, 25 bp, Homo sapien
gtgaaatgatatattctggctgggc

SEQ ID NO: 83263 - DNA, 25 bp, Homo sapien
gaaatgatatattctggctgggcac

SEQ ID NO: 83264 - DNA, 25 bp, Homo sapien
aaatgatatattctggctgggcaca

SEQ ID NO: 83265 - DNA, 25 bp, Homo sapien
ggatacttttatgcaaccataagac

SEQ ID NO: 83266 - DNA, 25 bp, Homo sapien
tgcaaccataagacaaactcctgaa

SEQ ID NO: 83267 - DNA, 25 bp, Homo sapien
aactcctgaaatgccaagtgcctgc

SEQ ID NO: 83268 - DNA, 25 bp, Homo sapien
tcctgaaatgccaagtgcctgctta

SEQ ID NO: 83269 - DNA, 25 bp, Homo sapien
tgaaatgccaagtgcctgcttagta

SEQ ID NO: 83270 - DNA, 25 bp, Homo sapien
aagtgcctgcttagtagctttggaa

SEQ ID NO: 83271 - DNA, 25 bp, Homo sapien
agtagctttggaaaggtgcccttat

SEQ ID NO: 83272 - DNA, 25 bp, Homo sapien
aaggtgcccttattgaacattctag

SEQ ID NO: 83273 - DNA, 25 bp, Homo sapien
gtgcccttattgaacattctagaag

SEQ ID NO: 83274 - DNA, 25 bp, Homo sapien
tgggtcttcaaggatctcctgtttt

SEQ ID NO: 83275 - DNA, 25 bp, Homo sapien
tctgttttcgtaccttcccactggc

SEQ ID NO: 83276 - DNA, 25 bp, Homo sapien
ttttttaagagtccttcatagagct

SEQ ID NO: 83277 - DNA, 25 bp, Homo sapien
aagagtccttcatagagctcagtca

SEQ ID NO: 83278 - DNA, 25 bp, Homo sapien
gagtccttcatagagctcagtcagg

SEQ ID NO: 83279 - DNA, 25 bp, Homo sapien
gtccttcatagagctcagtcaggaa

SEQ ID NO: 83280 - DNA, 25 bp, Homo sapien
aagccaagcccccagcattgggagc

SEQ ID NO: 83281 - DNA, 25 bp, Homo sapien
tgctcccgtagtcctcaggctgtaa

SEQ ID NO: 83282 - DNA, 25 bp, Homo sapien
tcctcaggctgtaagcaagagacag

SEQ ID NO: 83283 - DNA, 25 bp, Homo sapien
ctgcccaactccaaggactgggtat

SEQ ID NO: 83284 - DNA, 25 bp, Homo sapien
ccaactccaaggactgggtatggat

SEQ ID NO: 83285 - DNA, 25 bp, Homo sapien
tattggagggtcagtgtctgtgact

SEQ ID NO: 83286 - DNA, 25 bp, Homo sapien
gggtcagtgtctgtgactgaataaa

SEQ ID NO: 83287 - DNA, 25 bp, Homo sapien
caggaaaaatgaattgcttggtatt

SEQ ID NO: 83288 - DNA, 25 bp, Homo sapien
attgcttggtattcattacttcatg

SEQ ID NO: 83289 - DNA, 25 bp, Homo sapien
ttacttcatgtatatcaagcacagc

SEQ ID NO: 83290 - DNA, 25 bp, Homo sapien
tcatgtatatcaagcacagcagtaa

SEQ ID NO: 83291 - DNA, 25 bp, Homo sapien
gtatatcaagcacagcagtaaaaca

SEQ ID NO: 83292 - DNA, 25 bp, Homo sapien
gcacagcagtaaaacaaaaacccat

SEQ ID NO: 83293 - DNA, 25 bp, Homo sapien
tacttgcctaacatgcatgtgctgt

SEQ ID NO: 83294 - DNA, 25 bp, Homo sapien
ttgcctaacatgcatgtgctgtaaa

SEQ ID NO: 83295 - DNA, 25 bp, Homo sapien
catgcatgtgctgtaaaaatagtta

SEQ ID NO: 83296 - DNA, 25 bp, Homo sapien
ttttcatgaacaatccaagcataat

SEQ ID NO: 83297 - DNA, 25 bp, Homo sapien
taagaacacgtgtattaaattcatg

SEQ ID NO: 83298 - DNA, 25 bp, Homo sapien
aaaagtacacatgctggatcaaaat

SEQ ID NO: 83299 - DNA, 25 bp, Homo sapien
aagaactgcatttcctaccaaaaag

SEQ ID NO: 83300 - DNA, 25 bp, Homo sapien
gcatttcctaccaaaaagaagtggg

SEQ ID NO: 83301 - DNA, 25 bp, Homo sapien
aagtgggaaagtgggcactgcttaa

SEQ ID NO: 83302 - DNA, 25 bp, Homo sapien
gtgggcactgcttaaaagacagaaa

SEQ ID NO: 83303 - DNA, 25 bp, Homo sapien
agaaatgaaccctgccatataattc

SEQ ID NO: 83304 - DNA, 25 bp, Homo sapien
gaaccctgccatataattcaaatat

SEQ ID NO: 83305 - DNA, 25 bp, Homo sapien
actggaattagccaatacactatat

SEQ ID NO: 83306 - DNA, 25 bp, Homo sapien
tggtatatgtcttccactttccatc

SEQ ID NO: 83307 - DNA, 25 bp, Homo sapien
ccactttccatcatgtatgtaaaat

SEQ ID NO: 83308 - DNA, 25 bp, Homo sapien
gtaaaacttcctgatagtttcaata

SEQ ID NO: 83309 - DNA, 25 bp, Homo sapien
ccatgggctgtaagttgtacttctt

SEQ ID NO: 83310 - DNA, 25 bp, Homo sapien
atgggctgtaagttgtacttcttcc

SEQ ID NO: 83311 - DNA, 25 bp, Homo sapien
gggctgtaagttgtacttcttccag

SEQ ID NO: 83312 - DNA, 25 bp, Homo sapien
ggctgtaagttgtacttcttccagt

SEQ ID NO: 83313 - DNA, 25 bp, Homo sapien
gctgtaagttgtacttcttccagtc

SEQ ID NO: 83314 - DNA, 25 bp, Homo sapien
tgtaagttgtacttcttccagtcgc

SEQ ID NO: 83315 - DNA, 25 bp, Homo sapien
gtaagttgtacttcttccagtcgct

SEQ ID NO: 83316 - DNA, 25 bp, Homo sapien
taagttgtacttcttccagtcgctg

SEQ ID NO: 83317 - DNA, 25 bp, Homo sapien
aagttgtacttcttccagtcgctgc

SEQ ID NO: 83318 - DNA, 25 bp, Homo sapien
agttgtacttcttccagtcgctgcc

SEQ ID NO: 83319 - DNA, 25 bp, Homo sapien
ttgtacttcttccagtcgctgcctc

SEQ ID NO: 83320 - DNA, 25 bp, Homo sapien
agccacatcggagcagtatgagttg

SEQ ID NO: 83321 - DNA, 25 bp, Homo sapien
gcagtatgagttgcgcttcaggctg

SEQ ID NO: 83322 - DNA, 25 bp, Homo sapien
gagttgcgcttcaggctgctggacc

SEQ ID NO: 83323 - DNA, 25 bp, Homo sapien
ctggacccgcggacacagcaggagt

SEQ ID NO: 83324 - DNA, 25 bp, Homo sapien
gacacagcaggagtgcgcccagtgt

SEQ ID NO: 83325 - DNA, 25 bp, Homo sapien
cagtgtggcgtcatccccgtggctg

SEQ ID NO: 83326 - DNA, 25 bp, Homo sapien
tgctgcccaaccgatcctataagtt

SEQ ID NO: 83327 - DNA, 25 bp, Homo sapien
caaccgatcctataagttcaccatc

SEQ ID NO: 83328 - DNA, 25 bp, Homo sapien
aagttcaccatcaagagggccgaga

SEQ ID NO: 83329 - DNA, 25 bp, Homo sapien
aagagggccgagacctccacgctgg

SEQ ID NO: 83330 - DNA, 25 bp, Homo sapien
ccgagacctccacgctggtgtacga

SEQ ID NO: 83331 - DNA, 25 bp, Homo sapien
tataccaataagaatgagcctgaat

SEQ ID NO: 83332 - DNA, 25 bp, Homo sapien
aatgagcctgaatgttggtggtttt

SEQ ID NO: 83333 - DNA, 25 bp, Homo sapien
aatcctgacttggaggtaaacctgg

SEQ ID NO: 83334 - DNA, 25 bp, Homo sapien
taaatatgcaggcttttaggactga

SEQ ID NO: 83335 - DNA, 25 bp, Homo sapien
gcttttaggactgagtagccttgaa

SEQ ID NO: 83336 - DNA, 25 bp, Homo sapien
gggccttcatctaggaaatacagca

SEQ ID NO: 83337 - DNA, 25 bp, Homo sapien
agcattttccagaagcttctttgaa

SEQ ID NO: 83338 - DNA, 25 bp, Homo sapien
tgaaagggaatcctggttttgttgc

SEQ ID NO: 83339 - DNA, 25 bp, Homo sapien
ttgttgccaaaatgaaacgcccggg

SEQ ID NO: 83340 - DNA, 25 bp, Homo sapien
ggcgctgaatcccacaactgtgtga

SEQ ID NO: 83341 - DNA, 25 bp, Homo sapien
gtgtgatttgcttgttgagtttttt

SEQ ID NO: 83342 - DNA, 25 bp, Homo sapien
gggaagaaatctcacaaacgcacat

SEQ ID NO: 83343 - DNA, 25 bp, Homo sapien
ggaagaaatctcacaaacgcacatc

SEQ ID NO: 83344 - DNA, 25 bp, Homo sapien
aagaaatctcacaaacgcacatcaa

SEQ ID NO: 83345 - DNA, 25 bp, Homo sapien
gaaatctcacaaacgcacatcaaag

SEQ ID NO: 83346 - DNA, 25 bp, Homo sapien
atctcacaaacgcacatcaaagagt

SEQ ID NO: 83347 - DNA, 25 bp, Homo sapien
tcacaaacgcacatcaaagagtcgg

SEQ ID NO: 83348 - DNA, 25 bp, Homo sapien
aaacgcacatcaaagagtcgggaga

SEQ ID NO: 83349 - DNA, 25 bp, Homo sapien
tcaaagagtcgggagaggcacaatt

SEQ ID NO: 83350 - DNA, 25 bp, Homo sapien
aagagtcgggagaggcacaattcac

SEQ ID NO: 83351 - DNA, 25 bp, Homo sapien
gcagccggagccaaagttcctctag

SEQ ID NO: 83352 - DNA, 25 bp, Homo sapien
agccggagccaaagttcctctaggt

SEQ ID NO: 83353 - DNA, 25 bp, Homo sapien
cctctgtgaagggtggaggctcact

SEQ ID NO: 83354 - DNA, 25 bp, Homo sapien
gctcactgagtagagggctgttgtc

SEQ ID NO: 83355 - DNA, 25 bp, Homo sapien
gagggctgttgtctaaactgagaaa

SEQ ID NO: 83356 - DNA, 25 bp, Homo sapien
gaaaatggcctatgcttaagaggaa

SEQ ID NO: 83357 - DNA, 25 bp, Homo sapien
aagcagagtttcattacctgtattg

SEQ ID NO: 83358 - DNA, 25 bp, Homo sapien
attacctgtattgtagccccaatgt

SEQ ID NO: 83359 - DNA, 25 bp, Homo sapien
gtagccccaatgtcattatgtaatt

SEQ ID NO: 83360 - DNA, 25 bp, Homo sapien
ccagaattgctcttccataaagctt

SEQ ID NO: 83361 - DNA, 25 bp, Homo sapien
gctcttccataaagcttgtgccttt

SEQ ID NO: 83362 - DNA, 25 bp, Homo sapien
ttgtgcctttgtccaagctatacaa

SEQ ID NO: 83363 - DNA, 25 bp, Homo sapien
gacagagcccagaccatggtgccag

SEQ ID NO: 83364 - DNA, 25 bp, Homo sapien
tggtggaatcggctatccataccct

SEQ ID NO: 83365 - DNA, 25 bp, Homo sapien
ttcctggccgtggtagttactcaaa

SEQ ID NO: 83366 - DNA, 25 bp, Homo sapien
actacaacagaggtggaatgcccaa

SEQ ID NO: 83367 - DNA, 25 bp, Homo sapien
gtggaatgcccaacagagggaacta

SEQ ID NO: 83368 - DNA, 25 bp, Homo sapien
gagggaactacaaccagaacttcag

SEQ ID NO: 83369 - DNA, 25 bp, Homo sapien
aaccagaacttcagaggacgaggaa

SEQ ID NO: 83370 - DNA, 25 bp, Homo sapien
gaggaaacaatcgtggctacaaaaa

SEQ ID NO: 83371 - DNA, 25 bp, Homo sapien
aatctcagggctacaaccagtggca

SEQ ID NO: 83372 - DNA, 25 bp, Homo sapien
aaccagtggcagcagggtcaattct

SEQ ID NO: 83373 - DNA, 25 bp, Homo sapien
gggtcagaagccatggagtcagcat

SEQ ID NO: 83374 - DNA, 25 bp, Homo sapien
ggagtcagcattatcaccaaggata

SEQ ID NO: 83375 - DNA, 25 bp, Homo sapien
aacaccctggccttctcaatggatg

SEQ ID NO: 83376 - DNA, 25 bp, Homo sapien
accctggccttctcaatggatgtgg

SEQ ID NO: 83377 - DNA, 25 bp, Homo sapien
ccctggccttctcaatggatgtggg

SEQ ID NO: 83378 - DNA, 25 bp, Homo sapien
cttctcaatggatgtggggccttct

SEQ ID NO: 83379 - DNA, 25 bp, Homo sapien
ccttctcaatggatgtggggccagt

SEQ ID NO: 83380 - DNA, 25 bp, Homo sapien
gaccagctggagaccacggagttca

SEQ ID NO: 83381 - DNA, 25 bp, Homo sapien
accagctggagaccacggagttcat

SEQ ID NO: 83382 - DNA, 25 bp, Homo sapien
agctggagaccacggagttcatcat

SEQ ID NO: 83383 - DNA, 25 bp, Homo sapien
ctggagaccacggagttcatcatct

SEQ ID NO: 83384 - DNA, 25 bp, Homo sapien
ggagaccacggagttcatcatctcg

SEQ ID NO: 83385 - DNA, 25 bp, Homo sapien
gagaccacggagttcatcatctcgg

SEQ ID NO: 83386 - DNA, 25 bp, Homo sapien
atctgcagtgagatgtaactttcta

SEQ ID NO: 83387 - DNA, 25 bp, Homo sapien
gagatgtaactttctaggaacaaca

SEQ ID NO: 83388 - DNA, 25 bp, Homo sapien
gtaatctagatttcccattataaaa

SEQ ID NO: 83389 - DNA, 25 bp, Homo sapien
aatgatgtcctagtgaaccttgtgc

SEQ ID NO: 83390 - DNA, 25 bp, Homo sapien
gtgaaccttgtgctttctttagctg

SEQ ID NO: 83391 - DNA, 25 bp, Homo sapien
ttagctgtaatctggcaatggaaat

SEQ ID NO: 83392 - DNA, 25 bp, Homo sapien
tttatggaagagacagtgcagcgca

SEQ ID NO: 83393 - DNA, 25 bp, Homo sapien
gtgcagcgcaataacagagtactct

SEQ ID NO: 83394 - DNA, 25 bp, Homo sapien
aacagagtactctcatgctgtttct

SEQ ID NO: 83395 - DNA, 25 bp, Homo sapien
atgctgtttctctgtttgctctgaa

SEQ ID NO: 83396 - DNA, 25 bp, Homo sapien
tgctctgaatcaacagccatgatgt

SEQ ID NO: 83397 - DNA, 25 bp, Homo sapien
tagaaaaacatatccacggtaaccg

SEQ ID NO: 83398 - DNA, 25 bp, Homo sapien
ggtaaccggtccctggcaattctgt

SEQ ID NO: 83399 - DNA, 25 bp, Homo sapien
taaccggtccctggcaattctgttt

SEQ ID NO: 83400 - DNA, 25 bp, Homo sapien
ggtccctggcaattctgtttacatg

SEQ ID NO: 83401 - DNA, 25 bp, Homo sapien
tctcctggtttccacacctcagaca

SEQ ID NO: 83402 - DNA, 25 bp, Homo sapien
tcagacacgcacagttcaccaagtg

SEQ ID NO: 83403 - DNA, 25 bp, Homo sapien
cacagttcaccaagtgccttctgta

SEQ ID NO: 83404 - DNA, 25 bp, Homo sapien
gtgccttctgtagtcacatgaattg

SEQ ID NO: 83405 - DNA, 25 bp, Homo sapien
gccttctgtagtcacatgaattgaa

SEQ ID NO: 83406 - DNA, 25 bp, Homo sapien
attgaaaaggagacgctgctcccac

SEQ ID NO: 83407 - DNA, 25 bp, Homo sapien
aaaggagacgctgctcccacggagg

SEQ ID NO: 83408 - DNA, 25 bp, Homo sapien
tttctctccacaaagtccgtggtgc

SEQ ID NO: 83409 - DNA, 25 bp, Homo sapien
aaagtccgtggtgccttcctggtgg

SEQ ID NO: 83410 - DNA, 25 bp, Homo sapien
ctggtgggctgcagacactaatggt

SEQ ID NO: 83411 - DNA, 25 bp, Homo sapien
gggtcttggaacagcttctctatgt

SEQ ID NO: 83412 - DNA, 25 bp, Homo sapien
gcttctctatgtgtggattcgtgta

SEQ ID NO: 83413 - DNA, 25 bp, Homo sapien
tcgtgtaaatgcgaagagttcacat

SEQ ID NO: 83414 - DNA, 25 bp, Homo sapien
gattatattgatttggtacacagta

SEQ ID NO: 83415 - DNA, 25 bp, Homo sapien
gactctaatgacttgtaaagactct

SEQ ID NO: 83416 - DNA, 25 bp, Homo sapien
atgaactaaaccacctgtaattttg

SEQ ID NO: 83417 - DNA, 25 bp, Homo sapien
aaccacctgtaattttgtaccatat

SEQ ID NO: 83418 - DNA, 25 bp, Homo sapien
gtaccatatgtgtctttccatcaaa

SEQ ID NO: 83419 - DNA, 25 bp, Homo sapien
tttttccttttccatgagctgtgtt

SEQ ID NO: 83420 - DNA, 25 bp, Homo sapien
gagctgtgttaattctatctccagt

SEQ ID NO: 83421 - DNA, 25 bp, Homo sapien
gttaattctatctccagtaggccta

SEQ ID NO: 83422 - DNA, 25 bp, Homo sapien
tctccagtaggcctaatgcttgaaa

SEQ ID NO: 83423 - DNA, 25 bp, Homo sapien
attttcatgctcagaatttcaggtt

SEQ ID NO: 83424 - DNA, 25 bp, Homo sapien
tttcaggtttttgtactccagcata

SEQ ID NO: 83425 - DNA, 25 bp, Homo sapien
ggtttttgtactccagcatagcttg

SEQ ID NO: 83426 - DNA, 25 bp, Homo sapien
tccagcatagcttggtcttatttct

SEQ ID NO: 83427 - DNA, 25 bp, Homo sapien
gtgatttaattcatgggtactttta

SEQ ID NO: 83428 - DNA, 25 bp, Homo sapien
tcatgggtacttttagaacctgata

SEQ ID NO: 83429 - DNA, 25 bp, Homo sapien
gatagataatcccattgcctttatt

SEQ ID NO: 83430 - DNA, 25 bp, Homo sapien
caacatgtgcctctgctcaaaaaga

SEQ ID NO: 83431 - DNA, 25 bp, Homo sapien
gtgcctctgctcaaaaagaccctgg

SEQ ID NO: 83432 - DNA, 25 bp, Homo sapien
gaccctggaacttttagtttgcaga

SEQ ID NO: 83433 - DNA, 25 bp, Homo sapien
agtcaaagctatgctcactctcaac

SEQ ID NO: 83434 - DNA, 25 bp, Homo sapien
acaattgtagagaggctttctggct

SEQ ID NO: 83435 - DNA, 25 bp, Homo sapien
ttctggctgggcaatctaaaaaacc

SEQ ID NO: 83436 - DNA, 25 bp, Homo sapien
caatctaaaaaaccgggacttgcag

SEQ ID NO: 83437 - DNA, 25 bp, Homo sapien
gagattaagtcccaaaattcccagg

SEQ ID NO: 83438 - DNA, 25 bp, Homo sapien
gtcatcccaggcctccaagagcaaa

SEQ ID NO: 83439 - DNA, 25 bp, Homo sapien
ggcctccaagagcaaagccactgag

SEQ ID NO: 83440 - DNA, 25 bp, Homo sapien
ttatgatgactctgattagacccca

SEQ ID NO: 83441 - DNA, 25 bp, Homo sapien
atgccatctccccatctgcggccga

SEQ ID NO: 83442 - DNA, 25 bp, Homo sapien
atctccccatctgcggccgacgtgc

SEQ ID NO: 83443 - DNA, 25 bp, Homo sapien
gtgctggtggccaggtacatgtcca

SEQ ID NO: 83444 - DNA, 25 bp, Homo sapien
tgctggtggccaggtacatgtccag

SEQ ID NO: 83445 - DNA, 25 bp, Homo sapien
ggtacatgtccagggccgccgggtc

SEQ ID NO: 83446 - DNA, 25 bp, Homo sapien
cagggacggcccagcccgtgaagag

SEQ ID NO: 83447 - DNA, 25 bp, Homo sapien
agggacggcccagcccgtgaagagg

SEQ ID NO: 83448 - DNA, 25 bp, Homo sapien
cggcccagcccgtgaagaggagcct

SEQ ID NO: 83449 - DNA, 25 bp, Homo sapien
ggcccagcccgtgaagaggagcctg

SEQ ID NO: 83450 - DNA, 25 bp, Homo sapien
gcccagcccgtgaagaggagcctgg

SEQ ID NO: 83451 - DNA, 25 bp, Homo sapien
cccagcccgtgaagaggagcctggg

SEQ ID NO: 83452 - DNA, 25 bp, Homo sapien
ttgctcagcctgctccggccccggt

SEQ ID NO: 83453 - DNA, 25 bp, Homo sapien
agctccgggcacttgtggcagacga

SEQ ID NO: 83454 - DNA, 25 bp, Homo sapien
ctccgggcacttgtggcagacgagc

SEQ ID NO: 83455 - DNA, 25 bp, Homo sapien
tccgggcacttgtggcagacgagcc

SEQ ID NO: 83456 - DNA, 25 bp, Homo sapien
agctgggccagggactcaacaatgg

SEQ ID NO: 83457 - DNA, 25 bp, Homo sapien
gctgggccagggactcaacaatggg

SEQ ID NO: 83458 - DNA, 25 bp, Homo sapien
cagggactcaacaatggggacagaa

SEQ ID NO: 83459 - DNA, 25 bp, Homo sapien
gggacagaagtcccccagtgcctgc

SEQ ID NO: 83460 - DNA, 25 bp, Homo sapien
gcctggagtggaggttcaggaccaa

SEQ ID NO: 83461 - DNA, 25 bp, Homo sapien
ctggagtggaggttcaggaccaagg

SEQ ID NO: 83462 - DNA, 25 bp, Homo sapien
gaggttcaggaccaaggggcttctg

SEQ ID NO: 83463 - DNA, 25 bp, Homo sapien
tgcacagccatactgtcggtggaga

SEQ ID NO: 83464 - DNA, 25 bp, Homo sapien
agaggctcaacttcacactgagaca

SEQ ID NO: 83465 - DNA, 25 bp, Homo sapien
acttcacactgagacacttggacgt

SEQ ID NO: 83466 - DNA, 25 bp, Homo sapien
gacacttggacgtcacatgtgaagc

SEQ ID NO: 83467 - DNA, 25 bp, Homo sapien
atgtgaagcctacgatcacttccgc

SEQ ID NO: 83468 - DNA, 25 bp, Homo sapien
gctcacagatggcaagctgcgcttc

SEQ ID NO: 83469 - DNA, 25 bp, Homo sapien
gtttacgagcgcctccagcagctgg

SEQ ID NO: 83470 - DNA, 25 bp, Homo sapien
gctggagctctggaagatcatcgca

SEQ ID NO: 83471 - DNA, 25 bp, Homo sapien
gaagatcatcgcagaaccagtaaca

SEQ ID NO: 83472 - DNA, 25 bp, Homo sapien
agaaccagtaacatgacccatcgcc

SEQ ID NO: 83473 - DNA, 25 bp, Homo sapien
gcggcgtctcgactgttcttagagt

SEQ ID NO: 83474 - DNA, 25 bp, Homo sapien
ttgacccctgattccagtgaggact

SEQ ID NO: 83475 - DNA, 25 bp, Homo sapien
tgaggagtccttgcagacctgctgc

SEQ ID NO: 83476 - DNA, 25 bp, Homo sapien
tggccttgtgacagctccccaagtg

SEQ ID NO: 83477 - DNA, 25 bp, Homo sapien
tccccaagtgttctccggtggagaa

SEQ ID NO: 83478 - DNA, 25 bp, Homo sapien
tctccggtggagaaactgcagagga

SEQ ID NO: 83479 - DNA, 25 bp, Homo sapien
atcaccatcctgtgtacaatggctg

SEQ ID NO: 83480 - DNA, 25 bp, Homo sapien
gtagacttgtatatggctcctttaa

SEQ ID NO: 83481 - DNA, 25 bp, Homo sapien
gatgctgatgtacaattgtcgtgca

SEQ ID NO: 83482 - DNA, 25 bp, Homo sapien
ttgtcgtgcatttgtgtgaacacat

SEQ ID NO: 83483 - DNA, 25 bp, Homo sapien
gtgtgaacacattgcgttcccagtc

SEQ ID NO: 83484 - DNA, 25 bp, Homo sapien
gcgttcccagtccatgccataaatg

SEQ ID NO: 83485 - DNA, 25 bp, Homo sapien
atcaatctaggagtattcactgtaa

SEQ ID NO: 83486 - DNA, 25 bp, Homo sapien
gaacattttcacaatctcataggag

SEQ ID NO: 83487 - DNA, 25 bp, Homo sapien
gaaatctactttttgacttacatgg

SEQ ID NO: 83488 - DNA, 25 bp, Homo sapien
ctttttgacttacatgggtttgctg

SEQ ID NO: 83489 - DNA, 25 bp, Homo sapien
gggtttgctgtaattaagtgcccaa

SEQ ID NO: 83490 - DNA, 25 bp, Homo sapien
aagtgcccaatattgaaaggctgca

SEQ ID NO: 83491 - DNA, 25 bp, Homo sapien
aaggctgcaagtactttgtaatcac

SEQ ID NO: 83492 - DNA, 25 bp, Homo sapien
ttgtaatcactctttggcatgggta

SEQ ID NO: 83493 - DNA, 25 bp, Homo sapien
attgaaatatagtgctcttgctttg

SEQ ID NO: 83494 - DNA, 25 bp, Homo sapien
ggataactgtaaagggacccatgct

SEQ ID NO: 83495 - DNA, 25 bp, Homo sapien
gggacccatgctgatagactggaaa

SEQ ID NO: 83496 - DNA, 25 bp, Homo sapien
ttctaaggactttcaaaacagcaaa

SEQ ID NO: 83497 - DNA, 25 bp, Homo sapien
aacagcaaagtaggagcagctgcta

SEQ ID NO: 83498 - DNA, 25 bp, Homo sapien
aagtaggagcagctgctacctctag

SEQ ID NO: 83499 - DNA, 25 bp, Homo sapien
aggagcagctgctacctctagggat

SEQ ID NO: 83500 - DNA, 25 bp, Homo sapien
agcagctgctacctctagggatgag

SEQ ID NO: 83501 - DNA, 25 bp, Homo sapien
agctgctacctctagggatgaggga

SEQ ID NO: 83502 - DNA, 25 bp, Homo sapien
agctaacctaaccactaatgacgca

SEQ ID NO: 83503 - DNA, 25 bp, Homo sapien
aacctaaccactaatgacgcaagag

SEQ ID NO: 83504 - DNA, 25 bp, Homo sapien
taaccactaatgacgcaagagacaa

SEQ ID NO: 83505 - DNA, 25 bp, Homo sapien
gacgcaagagacaattctaaggact

SEQ ID NO: 83506 - DNA, 25 bp, Homo sapien
gagacaattctaaggactttcaaaa

SEQ ID NO: 83507 - DNA, 25 bp, Homo sapien
gtatctacaaaccagagttcttcat

SEQ ID NO: 83508 - DNA, 25 bp, Homo sapien
aatattacttcatgttcctcctttc

SEQ ID NO: 83509 - DNA, 25 bp, Homo sapien
acttcatgttcctcctttctaaatt

SEQ ID NO: 83510 - DNA, 25 bp, Homo sapien
taacttttgttatactggtactgat

SEQ ID NO: 83511 - DNA, 25 bp, Homo sapien
gttatactggtactgatattttgtc

SEQ ID NO: 83512 - DNA, 25 bp, Homo sapien
atttcactctcttctcatacgtgag

SEQ ID NO: 83513 - DNA, 25 bp, Homo sapien
ctctcttctcatacgtgagtactta

SEQ ID NO: 83514 - DNA, 25 bp, Homo sapien
taagaatatgtacattcttgctctg

SEQ ID NO: 83515 - DNA, 25 bp, Homo sapien
cttgctctgcactgtatgtgtgagc

SEQ ID NO: 83516 - DNA, 25 bp, Homo sapien
gcactgtatgtgtgagctatatggt

SEQ ID NO: 83517 - DNA, 25 bp, Homo sapien
gtgagctatatggtattgtgtaaat

SEQ ID NO: 83518 - DNA, 25 bp, Homo sapien
taagttacccagtccaaggtactgt

SEQ ID NO: 83519 - DNA, 25 bp, Homo sapien
tccaaggtactgtgttatagcatca

SEQ ID NO: 83520 - DNA, 25 bp, Homo sapien
ggaacatactgagatggcatattta

SEQ ID NO: 83521 - DNA, 25 bp, Homo sapien
ggaaattttggtcctcatacttaat

SEQ ID NO: 83522 - DNA, 25 bp, Homo sapien
atgggcttcaagtatttcgttagtt

SEQ ID NO: 83523 - DNA, 25 bp, Homo sapien
acagggctcctcctttacaattgat

SEQ ID NO: 83524 - DNA, 25 bp, Homo sapien
gctcctcctttacaattgatctcat

SEQ ID NO: 83525 - DNA, 25 bp, Homo sapien
ttagcttttacaacatagaactgga

SEQ ID NO: 83526 - DNA, 25 bp, Homo sapien
tactcagacctctagagtgtcctag

SEQ ID NO: 83527 - DNA, 25 bp, Homo sapien
agagtgtcctagattttgtggcaga

SEQ ID NO: 83528 - DNA, 25 bp, Homo sapien
ttgtggcagaatcactatggataat

SEQ ID NO: 83529 - DNA, 25 bp, Homo sapien
gacacaatccattacctcattgggt

SEQ ID NO: 83530 - DNA, 25 bp, Homo sapien
cattacctcattgggttcaaaaggc

SEQ ID NO: 83531 - DNA, 25 bp, Homo sapien
aaggcaattgtgaactactgtggag

SEQ ID NO: 83532 - DNA, 25 bp, Homo sapien
gcaatgaggtaatcaaggatactgt

SEQ ID NO: 83533 - DNA, 25 bp, Homo sapien
aggatactgttgacaatctagctta

SEQ ID NO: 83534 - DNA, 25 bp, Homo sapien
gttgacaatctagcttatcctatgg

SEQ ID NO: 83535 - DNA, 25 bp, Homo sapien
aattgaaactaatggaggcgaggct

SEQ ID NO: 83536 - DNA, 25 bp, Homo sapien
gcgaggctggtaaaacaatagggtt

SEQ ID NO: 83537 - DNA, 25 bp, Homo sapien
gggtttgagacaattctgtggcatt

SEQ ID NO: 83538 - DNA, 25 bp, Homo sapien
tgggaataccacaaaagacactttt

SEQ ID NO: 83539 - DNA, 25 bp, Homo sapien
acacttttgtgatggaaatccttaa

SEQ ID NO: 83540 - DNA, 25 bp, Homo sapien
agcaccttctacctcgacgcggtgc

SEQ ID NO: 83541 - DNA, 25 bp, Homo sapien
accttctacctcgacgcggtgcagc

SEQ ID NO: 83542 - DNA, 25 bp, Homo sapien
tcctcttcctctacacgggagactt

SEQ ID NO: 83543 - DNA, 25 bp, Homo sapien
tcttcctctacacgggagacttctt

SEQ ID NO: 83544 - DNA, 25 bp, Homo sapien
tctacacgggagacttcttcctcca

SEQ ID NO: 83545 - DNA, 25 bp, Homo sapien
tacacgggagacttcttcctccaca

SEQ ID NO: 83546 - DNA, 25 bp, Homo sapien
acacgggagacttcttcctccacat

SEQ ID NO: 83547 - DNA, 25 bp, Homo sapien
gggagacttcttcctccacatccgg

SEQ ID NO: 83548 - DNA, 25 bp, Homo sapien
ggagacttcttcctccacatccggt

SEQ ID NO: 83549 - DNA, 25 bp, Homo sapien
gagacttcttcctccacatccggtt

SEQ ID NO: 83550 - DNA, 25 bp, Homo sapien
gcgcaggcctgagcccgcctacttc

SEQ ID NO: 83551 - DNA, 25 bp, Homo sapien
gcctaccggagcttgtgaagaaatg

SEQ ID NO: 83552 - DNA, 25 bp, Homo sapien
aagtcactcacctctccaagaggag

SEQ ID NO: 83553 - DNA, 25 bp, Homo sapien
actcacctctccaagaggaggataa

SEQ ID NO: 83554 - DNA, 25 bp, Homo sapien
gtgtgttggttcacacctgttgtaa

SEQ ID NO: 83555 - DNA, 25 bp, Homo sapien
gtgttggttcacacctgttgtaatc

SEQ ID NO: 83556 - DNA, 25 bp, Homo sapien
aaaacgccaatcttagaatggagta

SEQ ID NO: 83557 - DNA, 25 bp, Homo sapien
gaatggagtaacaaccagggtcaca

SEQ ID NO: 83558 - DNA, 25 bp, Homo sapien
gtaacaaccagggtcacacaaggag

SEQ ID NO: 83559 - DNA, 25 bp, Homo sapien
ggtcacacaaggaggtcaagattca

SEQ ID NO: 83560 - DNA, 25 bp, Homo sapien
acacaaggaggtcaagattcattaa

SEQ ID NO: 83561 - DNA, 25 bp, Homo sapien
aaaggagcagtcatccctagggcag

SEQ ID NO: 83562 - DNA, 25 bp, Homo sapien
atcttaacctatcaactttctgccc

SEQ ID NO: 83563 - DNA, 25 bp, Homo sapien
tcaaggcccagtataaatgccacct

SEQ ID NO: 83564 - DNA, 25 bp, Homo sapien
agtataaatgccacctcctccatga

SEQ ID NO: 83565 - DNA, 25 bp, Homo sapien
acaatatttcaacgcttctgcaatg

SEQ ID NO: 83566 - DNA, 25 bp, Homo sapien
atagttgtagtacttagcctaccta

SEQ ID NO: 83567 - DNA, 25 bp, Homo sapien
gcaagcattcatttttagctcgctc

SEQ ID NO: 83568 - DNA, 25 bp, Homo sapien
tagctcgctcattttttaccatgtt

SEQ ID NO: 83569 - DNA, 25 bp, Homo sapien
tttaccatgttttccagtctgttta

SEQ ID NO: 83570 - DNA, 25 bp, Homo sapien
agtctgtttaacttctgcagtgcct

SEQ ID NO: 83571 - DNA, 25 bp, Homo sapien
tttaacttctgcagtgccttcacta

SEQ ID NO: 83572 - DNA, 25 bp, Homo sapien
ccttcactacactgccttacataaa

SEQ ID NO: 83573 - DNA, 25 bp, Homo sapien
aacatcctgtctttccatcaggaac

SEQ ID NO: 83574 - DNA, 25 bp, Homo sapien
tttccatcaggaactggcttctctt

SEQ ID NO: 83575 - DNA, 25 bp, Homo sapien
ggaactggcttctcttatgccaaag

SEQ ID NO: 83576 - DNA, 25 bp, Homo sapien
ggcttctcttatgccaaaggaataa

SEQ ID NO: 83577 - DNA, 25 bp, Homo sapien
ggaataaccccattgagttgattgt

SEQ ID NO: 83578 - DNA, 25 bp, Homo sapien
tgagttgattgtggccagaatgtcc

SEQ ID NO: 83579 - DNA, 25 bp, Homo sapien
gccagaatgtccacaggcctggcct

SEQ ID NO: 83580 - DNA, 25 bp, Homo sapien
tgtgtctagagctctgggcctcagg

SEQ ID NO: 83581 - DNA, 25 bp, Homo sapien
ggaaggaagccagcctttcagcacc

SEQ ID NO: 83582 - DNA, 25 bp, Homo sapien
tccacagttctgtgatttctgtcct

SEQ ID NO: 83583 - DNA, 25 bp, Homo sapien
aaagtgcccaactctttgggatgac

SEQ ID NO: 83584 - DNA, 25 bp, Homo sapien
gagcagtttcataaagttgaatctc

SEQ ID NO: 83585 - DNA, 25 bp, Homo sapien
gaataagctaaatcatctcctcact

SEQ ID NO: 83586 - DNA, 25 bp, Homo sapien
agctaaatcatctcctcactgatat

SEQ ID NO: 83587 - DNA, 25 bp, Homo sapien
catctcctcactgatattcttgctg

SEQ ID NO: 83588 - DNA, 25 bp, Homo sapien
atattcttgctgatgtgaagacaaa

SEQ ID NO: 83589 - DNA, 25 bp, Homo sapien
gaaactcaatcaaagattaaggctg

SEQ ID NO: 83590 - DNA, 25 bp, Homo sapien
gattaaggctgttagtcttgaagat

SEQ ID NO: 83591 - DNA, 25 bp, Homo sapien
gaaaattactgaaaactgaatcttt

SEQ ID NO: 83592 - DNA, 25 bp, Homo sapien
ctgaatctttattacgtgtcctctt

SEQ ID NO: 83593 - DNA, 25 bp, Homo sapien
tctttattacgtgtcctcttttatt

SEQ ID NO: 83594 - DNA, 25 bp, Homo sapien
tgtcctcttttatttattagaagac

SEQ ID NO: 83595 - DNA, 25 bp, Homo sapien
tctgactttattcctgaaagaggct

SEQ ID NO: 83596 - DNA, 25 bp, Homo sapien
tgtgtgcaagaattgagtcccaggg

SEQ ID NO: 83597 - DNA, 25 bp, Homo sapien
tctggtgaatgtgtgggaccgcatc

SEQ ID NO: 83598 - DNA, 25 bp, Homo sapien
tgaatgtgtgggaccgcatccaccc

SEQ ID NO: 83599 - DNA, 25 bp, Homo sapien
tttatctgatgttatggctgctcaa

SEQ ID NO: 83600 - DNA, 25 bp, Homo sapien
tatggctgctcaaagtatctgtccc

SEQ ID NO: 83601 - DNA, 25 bp, Homo sapien
gctgctcaaagtatctgtcccaaaa

SEQ ID NO: 83602 - DNA, 25 bp, Homo sapien
gagtgacgtgaaggtcctgctcagc

SEQ ID NO: 83603 - DNA, 25 bp, Homo sapien
ggtcctgctcagctaggaactgaat

SEQ ID NO: 83604 - DNA, 25 bp, Homo sapien
actgctagtgtttctccatgggatg

SEQ ID NO: 83605 - DNA, 25 bp, Homo sapien
tctccatgggatgtacactggagaa

SEQ ID NO: 83606 - DNA, 25 bp, Homo sapien
tcttctgattgattggatttcctta

SEQ ID NO: 83607 - DNA, 25 bp, Homo sapien
aatcggaagcaaggttaggctgagt

SEQ ID NO: 83608 - DNA, 25 bp, Homo sapien
gagagagaactgctcggaagacatt

SEQ ID NO: 83609 - DNA, 25 bp, Homo sapien
gagaactgctcggaagacattggta

SEQ ID NO: 83610 - DNA, 25 bp, Homo sapien
actgctcggaagacattggtagatg

SEQ ID NO: 83611 - DNA, 25 bp, Homo sapien
gatggaccataaaaacagagttagt

SEQ ID NO: 83612 - DNA, 25 bp, Homo sapien
gagttagttctctttatgacattaa

SEQ ID NO: 83613 - DNA, 25 bp, Homo sapien
atttttaatggttcacaatttcatt

SEQ ID NO: 83614 - DNA, 25 bp, Homo sapien
agtttcctattgttagacatttgtt

SEQ ID NO: 83615 - DNA, 25 bp, Homo sapien
cctattgttagacatttgtttccag

SEQ ID NO: 83616 - DNA, 25 bp, Homo sapien
catttgtttccagtttcttactatt

SEQ ID NO: 83617 - DNA, 25 bp, Homo sapien
tctcactgactaccttgtcattttg

SEQ ID NO: 83618 - DNA, 25 bp, Homo sapien
gactaccttgtcattttggtataag

SEQ ID NO: 83619 - DNA, 25 bp, Homo sapien
tttgtgttatttgataggccgggca

SEQ ID NO: 83620 - DNA, 25 bp, Homo sapien
ttgtgttatttgataggccgggcat

SEQ ID NO: 83621 - DNA, 25 bp, Homo sapien
tgtgttatttgataggccgggcatg

SEQ ID NO: 83622 - DNA, 25 bp, Homo sapien
gtgttatttgataggccgggcatgg

SEQ ID NO: 83623 - DNA, 25 bp, Homo sapien
aattcaaaaattacctaggcgtcat

SEQ ID NO: 83624 - DNA, 25 bp, Homo sapien
attcaaaaattacctaggcgtcatg

SEQ ID NO: 83625 - DNA, 25 bp, Homo sapien
ttcaaaaattacctaggcgtcatgg

SEQ ID NO: 83626 - DNA, 25 bp, Homo sapien
tcaaaaattacctaggcgtcatggg

SEQ ID NO: 83627 - DNA, 25 bp, Homo sapien
attacctaggcgtcatggggcatgc

SEQ ID NO: 83628 - DNA, 25 bp, Homo sapien
tatgtggatgcaactaacctcactc

SEQ ID NO: 83629 - DNA, 25 bp, Homo sapien
aagattatggcctcgggcaagtgct

SEQ ID NO: 83630 - DNA, 25 bp, Homo sapien
ctgttggtgagagactctggagttc

SEQ ID NO: 83631 - DNA, 25 bp, Homo sapien
gactctggagttccaaagatgtcag

SEQ ID NO: 83632 - DNA, 25 bp, Homo sapien
cagagatatggatgacgcctatgac

SEQ ID NO: 83633 - DNA, 25 bp, Homo sapien
ggatgacgcctatgacagactgaca

SEQ ID NO: 83634 - DNA, 25 bp, Homo sapien
acagactgacaaggcaccgctgcag

SEQ ID NO: 83635 - DNA, 25 bp, Homo sapien
gatggtcgaacgtggaatagctgca

SEQ ID NO: 83636 - DNA, 25 bp, Homo sapien
tggaatagctgcacaacctctttat

SEQ ID NO: 83637 - DNA, 25 bp, Homo sapien
aacctctttatgctggatattgtaa

SEQ ID NO: 83638 - DNA, 25 bp, Homo sapien
aatctgtactacaatcaactttatt

SEQ ID NO: 83639 - DNA, 25 bp, Homo sapien
gtgtgagcttttaatctctggctga

SEQ ID NO: 83640 - DNA, 25 bp, Homo sapien
atctctggctgatcttaacccacat

SEQ ID NO: 83641 - DNA, 25 bp, Homo sapien
tcagcctaagcttgggatgattact

SEQ ID NO: 83642 - DNA, 25 bp, Homo sapien
ggatgattactcttgaccctttttt

SEQ ID NO: 83643 - DNA, 25 bp, Homo sapien
ttcagtgattagcaaatctccccac

SEQ ID NO: 83644 - DNA, 25 bp, Homo sapien
atctccccacaacccaggtgtggag

SEQ ID NO: 83645 - DNA, 25 bp, Homo sapien
ggtagaatggtgctagtttcctatt

SEQ ID NO: 83646 - DNA, 25 bp, Homo sapien
ttttgtggtaactgtacagcacttt

SEQ ID NO: 83647 - DNA, 25 bp, Homo sapien
tatctcccttaaaaagcctgagctg

SEQ ID NO: 83648 - DNA, 25 bp, Homo sapien
aatctggatgtgactctgttaccct

SEQ ID NO: 83649 - DNA, 25 bp, Homo sapien
tgttacccttttcccacaagatagg

SEQ ID NO: 83650 - DNA, 25 bp, Homo sapien
gcagacgagcccgaggacctggaca

SEQ ID NO: 83651 - DNA, 25 bp, Homo sapien
cagacgagcccgaggacctggacac

SEQ ID NO: 83652 - DNA, 25 bp, Homo sapien
agacgagcccgaggacctggacacg

SEQ ID NO: 83653 - DNA, 25 bp, Homo sapien
acgagcccgaggacctggacacgga

SEQ ID NO: 83654 - DNA, 25 bp, Homo sapien
cgagcccgaggacctggacacggag

SEQ ID NO: 83655 - DNA, 25 bp, Homo sapien
gacacggaggacgagggcctcatca

SEQ ID NO: 83656 - DNA, 25 bp, Homo sapien
acacggaggacgagggcctcatcag

SEQ ID NO: 83657 - DNA, 25 bp, Homo sapien
cacggaggacgagggcctcatcagc

SEQ ID NO: 83658 - DNA, 25 bp, Homo sapien
acggaggacgagggcctcatcagct

SEQ ID NO: 83659 - DNA, 25 bp, Homo sapien
cggaggacgagggcctcatcagctt

SEQ ID NO: 83660 - DNA, 25 bp, Homo sapien
ggaggacgagggcctcatcagcttc

SEQ ID NO: 83661 - DNA, 25 bp, Homo sapien
ctggctcactggcacagggcaggtg

SEQ ID NO: 83662 - DNA, 25 bp, Homo sapien
ggacattgccatgggacggaagtct

SEQ ID NO: 83663 - DNA, 25 bp, Homo sapien
ccatgggacggaagtctgcttggca

SEQ ID NO: 83664 - DNA, 25 bp, Homo sapien
gtctgcttggcagtggctttgataa

SEQ ID NO: 83665 - DNA, 25 bp, Homo sapien
gcagtggctttgataagcgatgctt

SEQ ID NO: 83666 - DNA, 25 bp, Homo sapien
ccaccctgcccgaggatgtacagag

SEQ ID NO: 83667 - DNA, 25 bp, Homo sapien
gaggatgtacagagccgtgcccaca

SEQ ID NO: 83668 - DNA, 25 bp, Homo sapien
tgtacagagccgtgcccacacattt

SEQ ID NO: 83669 - DNA, 25 bp, Homo sapien
cacacatttccttgcaacttgatca

SEQ ID NO: 83670 - DNA, 25 bp, Homo sapien
acatttccttgcaacttgatcaaat

SEQ ID NO: 83671 - DNA, 25 bp, Homo sapien
gcaacttgatcaaatttcttaaagc

SEQ ID NO: 83672 - DNA, 25 bp, Homo sapien
tttgtgttatttgataggccgggca

SEQ ID NO: 83673 - DNA, 25 bp, Homo sapien
ttgtgttatttgataggccgggcat

SEQ ID NO: 83674 - DNA, 25 bp, Homo sapien
tgtgttatttgataggccgggcatg

SEQ ID NO: 83675 - DNA, 25 bp, Homo sapien
gtgttatttgataggccgggcatgg

SEQ ID NO: 83676 - DNA, 25 bp, Homo sapien
aattcaaaaattacctaggcgtcat

SEQ ID NO: 83677 - DNA, 25 bp, Homo sapien
attcaaaaattacctaggcgtcatg

SEQ ID NO: 83678 - DNA, 25 bp, Homo sapien
ttcaaaaattacctaggcgtcatgg

SEQ ID NO: 83679 - DNA, 25 bp, Homo sapien
tcaaaaattacctaggcgtcatggg

SEQ ID NO: 83680 - DNA, 25 bp, Homo sapien
aattacctaggcgtcatggggcatg

SEQ ID NO: 83681 - DNA, 25 bp, Homo sapien
attacctaggcgtcatggggcatgc

SEQ ID NO: 83682 - DNA, 25 bp, Homo sapien
tacctaggcgtcatggggcatgcct

SEQ ID NO: 83683 - DNA, 25 bp, Homo sapien
ggcgtgcaccagctcaaacatgcag

SEQ ID NO: 83684 - DNA, 25 bp, Homo sapien
atgcaggctggaacgtgcacacgct

SEQ ID NO: 83685 - DNA, 25 bp, Homo sapien
tgcacacgctcacattggtaccagg

SEQ ID NO: 83686 - DNA, 25 bp, Homo sapien
gctcacattggtaccagggaaactg

SEQ ID NO: 83687 - DNA, 25 bp, Homo sapien
gtgtctacaccaatactcagatgaa

SEQ ID NO: 83688 - DNA, 25 bp, Homo sapien
gatgaaccttaatgctcagccacat

SEQ ID NO: 83689 - DNA, 25 bp, Homo sapien
ctggacacacacagaaggtcccctg

SEQ ID NO: 83690 - DNA, 25 bp, Homo sapien
agaaggtcccctgccatttaattga

SEQ ID NO: 83691 - DNA, 25 bp, Homo sapien
tcccctgccatttaattgatcgtct

SEQ ID NO: 83692 - DNA, 25 bp, Homo sapien
gccatttaattgatcgtctacagtg

SEQ ID NO: 83693 - DNA, 25 bp, Homo sapien
gatcgtctacagtgggatttatttt

SEQ ID NO: 83694 - DNA, 25 bp, Homo sapien
gtgcagggtctttagagctcagctt

SEQ ID NO: 83695 - DNA, 25 bp, Homo sapien
tagagctcagctttctgaggccctg

SEQ ID NO: 83696 - DNA, 25 bp, Homo sapien
ctgagcattcttggttttccgacat

SEQ ID NO: 83697 - DNA, 25 bp, Homo sapien
tttccgacatcgtgaacctgttctg

SEQ ID NO: 83698 - DNA, 25 bp, Homo sapien
gaacctgttctgtgttgcaagatat

SEQ ID NO: 83699 - DNA, 25 bp, Homo sapien
gatatcactcaagccagtgttgctt

SEQ ID NO: 83700 - DNA, 25 bp, Homo sapien
gtgttgcttaataccatctctttgt

SEQ ID NO: 83701 - DNA, 25 bp, Homo sapien
aatgggagcctttccaatgaaggaa

SEQ ID NO: 83702 - DNA, 25 bp, Homo sapien
gaaacatcagctttccttgttagaa

SEQ ID NO: 83703 - DNA, 25 bp, Homo sapien
aaactacccatgtctttctggaaag

SEQ ID NO: 83704 - DNA, 25 bp, Homo sapien
aacattgccatgtaactatgtatca

SEQ ID NO: 83705 - DNA, 25 bp, Homo sapien
gagactacgtcttcatgaggtggaa

SEQ ID NO: 83706 - DNA, 25 bp, Homo sapien
ttctggtcccagatcacacgatcaa

SEQ ID NO: 83707 - DNA, 25 bp, Homo sapien
atcagtggtgcttcttttgccgggt

SEQ ID NO: 83708 - DNA, 25 bp, Homo sapien
ttcttttgccgggttctactacatc

SEQ ID NO: 83709 - DNA, 25 bp, Homo sapien
gggttctactacatctgctttcaga

SEQ ID NO: 83710 - DNA, 25 bp, Homo sapien
gagggctactactaccataggagtt

SEQ ID NO: 83711 - DNA, 25 bp, Homo sapien
gaatggtatcagtccctcaatctaa

SEQ ID NO: 83712 - DNA, 25 bp, Homo sapien
tcaatctaacccatgttcctgaaca

SEQ ID NO: 83713 - DNA, 25 bp, Homo sapien
tgaacacagtgcacccatctatgaa

SEQ ID NO: 83714 - DNA, 25 bp, Homo sapien
cccatctatgaattccggtgacaac

SEQ ID NO: 83715 - DNA, 25 bp, Homo sapien
ttccggtgacaacggttcagaacag

SEQ ID NO: 83716 - DNA, 25 bp, Homo sapien
tgctccaagggatgagcctcgtggg

SEQ ID NO: 83717 - DNA, 25 bp, Homo sapien
ctggaagagagtgtggtgtgatgga

SEQ ID NO: 83718 - DNA, 25 bp, Homo sapien
gagagtgtggtgtgatggacgggca

SEQ ID NO: 83719 - DNA, 25 bp, Homo sapien
agagtgtggtgtgatggacgggcag

SEQ ID NO: 83720 - DNA, 25 bp, Homo sapien
gagtgtggtgtgatggacgggcagc

SEQ ID NO: 83721 - DNA, 25 bp, Homo sapien
agtgtggtgtgatggacgggcagct

SEQ ID NO: 83722 - DNA, 25 bp, Homo sapien
gtgtggtgtgatggacgggcagctt

SEQ ID NO: 83723 - DNA, 25 bp, Homo sapien
tgtggtgtgatggacgggcagcttc

SEQ ID NO: 83724 - DNA, 25 bp, Homo sapien
gtggtgtgatggacgggcagcttcc

SEQ ID NO: 83725 - DNA, 25 bp, Homo sapien
tggacgggcagcttcctgtgtgctc

SEQ ID NO: 83726 - DNA, 25 bp, Homo sapien
ggacgggcagcttcctgtgtgctcc

SEQ ID NO: 83727 - DNA, 25 bp, Homo sapien
cacttaaataagcacgtggaggtta

SEQ ID NO: 83728 - DNA, 25 bp, Homo sapien
gagtaaaaggaagctccatctgagc

SEQ ID NO: 83729 - DNA, 25 bp, Homo sapien
gctccatctgagcaagtacaccaaa

SEQ ID NO: 83730 - DNA, 25 bp, Homo sapien
agtacaccaaatgatctcagccctg

SEQ ID NO: 83731 - DNA, 25 bp, Homo sapien
tgcaacttgacccaggtagggccac

SEQ ID NO: 83732 - DNA, 25 bp, Homo sapien
ccaaccacagagagtttgacaagtt

SEQ ID NO: 83733 - DNA, 25 bp, Homo sapien
gtttgtgttatgatgttggcttggc

SEQ ID NO: 83734 - DNA, 25 bp, Homo sapien
tgatgttggcttggctttgtatttt

SEQ ID NO: 83735 - DNA, 25 bp, Homo sapien
ttagtggttttgtcatataactgtc

SEQ ID NO: 83736 - DNA, 25 bp, Homo sapien
tataactgtctgagtttggtaggta

SEQ ID NO: 83737 - DNA, 25 bp, Homo sapien
ttactagtgtggtcctccgggtaga

SEQ ID NO: 83738 - DNA, 25 bp, Homo sapien
aaagcaaacgagctgcccacagttc

SEQ ID NO: 83739 - DNA, 25 bp, Homo sapien
aaacgagctgcccacagttctctgc

SEQ ID NO: 83740 - DNA, 25 bp, Homo sapien
aggccacagtgtatagactggtaag

SEQ ID NO: 83741 - DNA, 25 bp, Homo sapien
agactggtaagccagacaggcctcc

SEQ ID NO: 83742 - DNA, 25 bp, Homo sapien
aagctgctaccttgctttcacctgt

SEQ ID NO: 83743 - DNA, 25 bp, Homo sapien
gagcccagaagagacactgaggaca

SEQ ID NO: 83744 - DNA, 25 bp, Homo sapien
gaagagacactgaggacaagagatc

SEQ ID NO: 83745 - DNA, 25 bp, Homo sapien
ggacaagagatcacaccagagtaca

SEQ ID NO: 83746 - DNA, 25 bp, Homo sapien
agagatcacaccagagtacatgtct

SEQ ID NO: 83747 - DNA, 25 bp, Homo sapien
cagagtacatgtctctgcctctgtt

SEQ ID NO: 83748 - DNA, 25 bp, Homo sapien
aggttttccaatacacaagtgctag

SEQ ID NO: 83749 - DNA, 25 bp, Homo sapien
tgtgagagttttaaaggttaatcaa

SEQ ID NO: 83750 - DNA, 25 bp, Homo sapien
tttctcttcttcagggcaaacttga

SEQ ID NO: 83751 - DNA, 25 bp, Homo sapien
ttctcttcttcagggcaaacttgaa

SEQ ID NO: 83752 - DNA, 25 bp, Homo sapien
tttacactatttctagaaagtcagc

SEQ ID NO: 83753 - DNA, 25 bp, Homo sapien
cactatttctagaaagtcagcatgt

SEQ ID NO: 83754 - DNA, 25 bp, Homo sapien
agtcagcatgtatttttggctcgaa

SEQ ID NO: 83755 - DNA, 25 bp, Homo sapien
gtcagcatgtatttttggctcgaag

SEQ ID NO: 83756 - DNA, 25 bp, Homo sapien
gctcgaagtttctctagtgttttct

SEQ ID NO: 83757 - DNA, 25 bp, Homo sapien
ctcgaagtttctctagtgttttctg

SEQ ID NO: 83758 - DNA, 25 bp, Homo sapien
cgaagtttctctagtgttttctgtg

SEQ ID NO: 83759 - DNA, 25 bp, Homo sapien
aagtttctctagtgttttctgtgga

SEQ ID NO: 83760 - DNA, 25 bp, Homo sapien
ccgattgaagacgtgttgctgtcct

SEQ ID NO: 83761 - DNA, 25 bp, Homo sapien
cgattgaagacgtgttgctgtcctc

SEQ ID NO: 83762 - DNA, 25 bp, Homo sapien
gattgaagacgtgttgctgtcctca

SEQ ID NO: 83763 - DNA, 25 bp, Homo sapien
gctgtcctcagtgcggcgctctgtc

SEQ ID NO: 83764 - DNA, 25 bp, Homo sapien
ctcagtgcggcgctctgtcctcatg

SEQ ID NO: 83765 - DNA, 25 bp, Homo sapien
cagtgcggcgctctgtcctcatgaa

SEQ ID NO: 83766 - DNA, 25 bp, Homo sapien
agtgcggcgctctgtcctcatgaag

SEQ ID NO: 83767 - DNA, 25 bp, Homo sapien
gtgcggcgctctgtcctcatgaaga

SEQ ID NO: 83768 - DNA, 25 bp, Homo sapien
tgcggcgctctgtcctcatgaagag

SEQ ID NO: 83769 - DNA, 25 bp, Homo sapien
gcggcgctctgtcctcatgaagagg

SEQ ID NO: 83770 - DNA, 25 bp, Homo sapien
cggcgctctgtcctcatgaagaggg

SEQ ID NO: 83771 - DNA, 25 bp, Homo sapien
gggcatggtctccaaccgggacacc

SEQ ID NO: 83772 - DNA, 25 bp, Homo sapien
gacaccctcatcaggaattgcgatg

SEQ ID NO: 83773 - DNA, 25 bp, Homo sapien
caggaattgcgatgctgaggtaccg

SEQ ID NO: 83774 - DNA, 25 bp, Homo sapien
caggaggaggtctgctaggtcacat

SEQ ID NO: 83775 - DNA, 25 bp, Homo sapien
aggtctgctaggtcacatggaagaa

SEQ ID NO: 83776 - DNA, 25 bp, Homo sapien
aagaaagaccatggcatgggcctgt

SEQ ID NO: 83777 - DNA, 25 bp, Homo sapien
ctctgtgatggagccagccagatca

SEQ ID NO: 83778 - DNA, 25 bp, Homo sapien
gaagtctgcctttcaaggagtgcct

SEQ ID NO: 83779 - DNA, 25 bp, Homo sapien
tcaaggagtgcctttgggaccttaa

SEQ ID NO: 83780 - DNA, 25 bp, Homo sapien
ggatgacgtacctaattaactgctg

SEQ ID NO: 83781 - DNA, 25 bp, Homo sapien
gtacctaattaactgctgggaaaga

SEQ ID NO: 83782 - DNA, 25 bp, Homo sapien
atgtgtcagaaacccattgggccgg

SEQ ID NO: 83783 - DNA, 25 bp, Homo sapien
tgtgtcagaaacccattgggccggg

SEQ ID NO: 83784 - DNA, 25 bp, Homo sapien
gtgtcagaaacccattgggccgggc

SEQ ID NO: 83785 - DNA, 25 bp, Homo sapien
tgtcagaaacccattgggccgggcg

SEQ ID NO: 83786 - DNA, 25 bp, Homo sapien
gtcagaaacccattgggccgggcgt

SEQ ID NO: 83787 - DNA, 25 bp, Homo sapien
tcagaaacccattgggccgggcgtg

SEQ ID NO: 83788 - DNA, 25 bp, Homo sapien
cagaaacccattgggccgggcgtgg

SEQ ID NO: 83789 - DNA, 25 bp, Homo sapien
gaaacccattgggccgggcgtggtg

SEQ ID NO: 83790 - DNA, 25 bp, Homo sapien
caggaggcggatcttgtagtgagcc

SEQ ID NO: 83791 - DNA, 25 bp, Homo sapien
aggaggcggatcttgtagtgagccg

SEQ ID NO: 83792 - DNA, 25 bp, Homo sapien
cggatcttgtagtgagccgagatca

SEQ ID NO: 83793 - DNA, 25 bp, Homo sapien
caggtcatcactcagtcactggtag

SEQ ID NO: 83794 - DNA, 25 bp, Homo sapien
atcactcagtcactggtaggcccag

SEQ ID NO: 83795 - DNA, 25 bp, Homo sapien
gtaaatggcctagcattagctgaat

SEQ ID NO: 83796 - DNA, 25 bp, Homo sapien
caggcttatcctgagtatttaatta

SEQ ID NO: 83797 - DNA, 25 bp, Homo sapien
taattacttaccagattatgaggcc

SEQ ID NO: 83798 - DNA, 25 bp, Homo sapien
gcctgaaggtatggtcgatggataa

SEQ ID NO: 83799 - DNA, 25 bp, Homo sapien
taagaaactaattccactgaaccta

SEQ ID NO: 83800 - DNA, 25 bp, Homo sapien
atcaaagcagcagtggcctctacgt

SEQ ID NO: 83801 - DNA, 25 bp, Homo sapien
agcagtggcctctacgttttactcc

SEQ ID NO: 83802 - DNA, 25 bp, Homo sapien
aaaaaaatcatcttgcccacaggcc

SEQ ID NO: 83803 - DNA, 25 bp, Homo sapien
cccacaggcctgtggcaaaaggata

SEQ ID NO: 83804 - DNA, 25 bp, Homo sapien
acaggtgccgcgcagccgagtggcg

SEQ ID NO: 83805 - DNA, 25 bp, Homo sapien
agtggcgggctagcataccgcctgc

SEQ ID NO: 83806 - DNA, 25 bp, Homo sapien
agcataccgcctgcccgcaattcgg

SEQ ID NO: 83807 - DNA, 25 bp, Homo sapien
aattcggccaggcctcgagcctgct

SEQ ID NO: 83808 - DNA, 25 bp, Homo sapien
ggaaacgccgccacgggctgcatgg

SEQ ID NO: 83809 - DNA, 25 bp, Homo sapien
ggagccgtccagtcttcgaatccca

SEQ ID NO: 83810 - DNA, 25 bp, Homo sapien
gagccgtccagtcttcgaatcccag

SEQ ID NO: 83811 - DNA, 25 bp, Homo sapien
cagtcttcgaatcccagcttggtgg

SEQ ID NO: 83812 - DNA, 25 bp, Homo sapien
tcgaatcccagcttggtggcatgca

SEQ ID NO: 83813 - DNA, 25 bp, Homo sapien
cttggtggcatgcatgtttagtccc

SEQ ID NO: 83814 - DNA, 25 bp, Homo sapien
gactagcctgcacaacatactgaga

SEQ ID NO: 83815 - DNA, 25 bp, Homo sapien
atatgcataatatacatgaccatgt

SEQ ID NO: 83816 - DNA, 25 bp, Homo sapien
atgagatacagacaccatggcttct

SEQ ID NO: 83817 - DNA, 25 bp, Homo sapien
agacaccatggcttctgtccattgg

SEQ ID NO: 83818 - DNA, 25 bp, Homo sapien
tgtccattggctcattcgcctggtc

SEQ ID NO: 83819 - DNA, 25 bp, Homo sapien
tcattcgcctggtcgcatgttcact

SEQ ID NO: 83820 - DNA, 25 bp, Homo sapien
gtcgcatgttcactccatgaggtta

SEQ ID NO: 83821 - DNA, 25 bp, Homo sapien
tccatgaggttaggacactgcgggt

SEQ ID NO: 83822 - DNA, 25 bp, Homo sapien
aggtgtcgctgtgatctctgtattt

SEQ ID NO: 83823 - DNA, 25 bp, Homo sapien
cgctgtgatctctgtatttgctaac

SEQ ID NO: 83824 - DNA, 25 bp, Homo sapien
actagtcttgttttgatttctaacg

SEQ ID NO: 83825 - DNA, 25 bp, Homo sapien
gatttctaacggtctagtggagtac

SEQ ID NO: 83826 - DNA, 25 bp, Homo sapien
gctgcccaatgcctgattgacggaa

SEQ ID NO: 83827 - DNA, 25 bp, Homo sapien
ctgcccaatgcctgattgacggaat

SEQ ID NO: 83828 - DNA, 25 bp, Homo sapien
gcccaatgcctgattgacggaatgt

SEQ ID NO: 83829 - DNA, 25 bp, Homo sapien
aatgcctgattgacggaatgtgcaa

SEQ ID NO: 83830 - DNA, 25 bp, Homo sapien
gcctgattgacggaatgtgcaaagt

SEQ ID NO: 83831 - DNA, 25 bp, Homo sapien
gacggaatgtgcaaagtagcaatta

SEQ ID NO: 83832 - DNA, 25 bp, Homo sapien
gtagcaattaactggtctggagggt

SEQ ID NO: 83833 - DNA, 25 bp, Homo sapien
aattaactggtctggagggtggcat

SEQ ID NO: 83834 - DNA, 25 bp, Homo sapien
ttaactggtctggagggtggcatca

SEQ ID NO: 83835 - DNA, 25 bp, Homo sapien
taactggtctggagggtggcatcat

SEQ ID NO: 83836 - DNA, 25 bp, Homo sapien
ctggagggtggcatcatgcaaagaa

SEQ ID NO: 83837 - DNA, 25 bp, Homo sapien
ccacaagcttatgtgcagcactgct

SEQ ID NO: 83838 - DNA, 25 bp, Homo sapien
caagcttatgtgcagcactgctcag

SEQ ID NO: 83839 - DNA, 25 bp, Homo sapien
agcttatgtgcagcactgctcaggg

SEQ ID NO: 83840 - DNA, 25 bp, Homo sapien
gggaggctgtcaggaattcccctca

SEQ ID NO: 83841 - DNA, 25 bp, Homo sapien
ggaggctgtcaggaattcccctcac

SEQ ID NO: 83842 - DNA, 25 bp, Homo sapien
aggctgtcaggaattcccctcacct

SEQ ID NO: 83843 - DNA, 25 bp, Homo sapien
caggaattcccctcacctcggaaag

SEQ ID NO: 83844 - DNA, 25 bp, Homo sapien
cctcacctcggaaaggaacttctca

SEQ ID NO: 83845 - DNA, 25 bp, Homo sapien
cacctcggaaaggaacttctcagtt

SEQ ID NO: 83846 - DNA, 25 bp, Homo sapien
tcggaaaggaacttctcagttttat

SEQ ID NO: 83847 - DNA, 25 bp, Homo sapien
gaaaggaacttctcagttttattgg

SEQ ID NO: 83848 - DNA, 25 bp, Homo sapien
aacattttcgctgaactagggccct

SEQ ID NO: 83849 - DNA, 25 bp, Homo sapien
ttcgctgaactagggccctggcagg

SEQ ID NO: 83850 - DNA, 25 bp, Homo sapien
caaggaggtaggacctatgcccacg

SEQ ID NO: 83851 - DNA, 25 bp, Homo sapien
tatgcccacggagctaagagacagg

SEQ ID NO: 83852 - DNA, 25 bp, Homo sapien
cccagtgctgtgtcatgacctgaaa

SEQ ID NO: 83853 - DNA, 25 bp, Homo sapien
aggccagacccaaatggaaagcaaa

SEQ ID NO: 83854 - DNA, 25 bp, Homo sapien
gcaaggctatattaacccagtggaa

SEQ ID NO: 83855 - DNA, 25 bp, Homo sapien
aacccagtggaacacttagtgacta

SEQ ID NO: 83856 - DNA, 25 bp, Homo sapien
tagtgactatcacagccgaggccgg

SEQ ID NO: 83857 - DNA, 25 bp, Homo sapien
agccgaggccgggagtcagaaattc

SEQ ID NO: 83858 - DNA, 25 bp, Homo sapien
gtcagaaattcaggagccagtgagc

SEQ ID NO: 83859 - DNA, 25 bp, Homo sapien
gggacttccatgtgagtcatctcct

SEQ ID NO: 83860 - DNA, 25 bp, Homo sapien
agtcatctccttgcaggctgccaag

SEQ ID NO: 83861 - DNA, 25 bp, Homo sapien
ggctgccaaggtcctgtacagcaga

SEQ ID NO: 83862 - DNA, 25 bp, Homo sapien
caaaccctcttagcagtcttcagag

SEQ ID NO: 83863 - DNA, 25 bp, Homo sapien
cagtcttcagagtcagctatgtgta

SEQ ID NO: 83864 - DNA, 25 bp, Homo sapien
atgtgtacaggaggcattaccatat

SEQ ID NO: 83865 - DNA, 25 bp, Homo sapien
gaaatggtatccagttcttacgtat

SEQ ID NO: 83866 - DNA, 25 bp, Homo sapien
cttacgtatttgttttgcaggcttc

SEQ ID NO: 83867 - DNA, 25 bp, Homo sapien
tttgcaggcttcttggttcagcaga

SEQ ID NO: 83868 - DNA, 25 bp, Homo sapien
gttcagcagacagaggccattggga

SEQ ID NO: 83869 - DNA, 25 bp, Homo sapien
tgcagggtgctgtttcctgaaggaa

SEQ ID NO: 83870 - DNA, 25 bp, Homo sapien
agtgcacacagacagtgcacacggt

SEQ ID NO: 83871 - DNA, 25 bp, Homo sapien
gcacacagacagtgcacacggtgca

SEQ ID NO: 83872 - DNA, 25 bp, Homo sapien
acagacagtgcacacggtgcactct

SEQ ID NO: 83873 - DNA, 25 bp, Homo sapien
agacagtgcacacggtgcactctac

SEQ ID NO: 83874 - DNA, 25 bp, Homo sapien
acagtgcacacggtgcactctacaa

SEQ ID NO: 83875 - DNA, 25 bp, Homo sapien
gtgcacacggtgcactctacaagtg

SEQ ID NO: 83876 - DNA, 25 bp, Homo sapien
tgcacacggtgcactctacaagtga

SEQ ID NO: 83877 - DNA, 25 bp, Homo sapien
gcacacggtgcactctacaagtgac

SEQ ID NO: 83878 - DNA, 25 bp, Homo sapien
acacggtgcactctacaagtgacca

SEQ ID NO: 83879 - DNA, 25 bp, Homo sapien
cacggtgcactctacaagtgaccat

SEQ ID NO: 83880 - DNA, 25 bp, Homo sapien
acggtgcactctacaagtgaccatt

SEQ ID NO: 83881 - DNA, 25 bp, Homo sapien
tccgcttagccattgcgctgggtga

SEQ ID NO: 83882 - DNA, 25 bp, Homo sapien
ttgcgctgggtgatgcggtcaacca

SEQ ID NO: 83883 - DNA, 25 bp, Homo sapien
tgggtgatgcggtcaaccatccgac

SEQ ID NO: 83884 - DNA, 25 bp, Homo sapien
gtgatgcggtcaaccatccgactcc

SEQ ID NO: 83885 - DNA, 25 bp, Homo sapien
aggtgtacaaaagagccaaggcgct

SEQ ID NO: 83886 - DNA, 25 bp, Homo sapien
caaaagagccaaggcgctggaccag

SEQ ID NO: 83887 - DNA, 25 bp, Homo sapien
tgggagttcattctggaccagccca

SEQ ID NO: 83888 - DNA, 25 bp, Homo sapien
gttcattctggaccagcccacctat

SEQ ID NO: 83889 - DNA, 25 bp, Homo sapien
tacagactttgagacttgccatcag

SEQ ID NO: 83890 - DNA, 25 bp, Homo sapien
tttgagacttgccatcagcacagca

SEQ ID NO: 83891 - DNA, 25 bp, Homo sapien
agacttgccatcagcacagcacaca

SEQ ID NO: 83892 - DNA, 25 bp, Homo sapien
gaatgaactcactctggagagaaga

SEQ ID NO: 83893 - DNA, 25 bp, Homo sapien
agagaagaagctgcatgaaaattac

SEQ ID NO: 83894 - DNA, 25 bp, Homo sapien
gagaagaagctgcatgaaaattact

SEQ ID NO: 83895 - DNA, 25 bp, Homo sapien
agaagaagctgcatgaaaattactt

SEQ ID NO: 83896 - DNA, 25 bp, Homo sapien
gaagaagctgcatgaaaattactta

SEQ ID NO: 83897 - DNA, 25 bp, Homo sapien
aagaagctgcatgaaaattacttaa

SEQ ID NO: 83898 - DNA, 25 bp, Homo sapien
gaagctgcatgaaaattacttaatt

SEQ ID NO: 83899 - DNA, 25 bp, Homo sapien
aagctgcatgaaaattacttaattc

SEQ ID NO: 83900 - DNA, 25 bp, Homo sapien
agctgcatgaaaattacttaattcc

SEQ ID NO: 83901 - DNA, 25 bp, Homo sapien
gctgcatgaaaattacttaattcct

SEQ ID NO: 83902 - DNA, 25 bp, Homo sapien
tgaaaattacttaattcctgtaatc

SEQ ID NO: 83903 - DNA, 25 bp, Homo sapien
gacaggagaagtcatgcagaatcta

SEQ ID NO: 83904 - DNA, 25 bp, Homo sapien
tagaacacatctaggctcttttccc

SEQ ID NO: 83905 - DNA, 25 bp, Homo sapien
gatgatggagcatatagatctggct

SEQ ID NO: 83906 - DNA, 25 bp, Homo sapien
agatctggctcaaattcagcctcca

SEQ ID NO: 83907 - DNA, 25 bp, Homo sapien
ttaccagtcaggaaccctggcgata

SEQ ID NO: 83908 - DNA, 25 bp, Homo sapien
ggaaccctggcgatatcactttaac

SEQ ID NO: 83909 - DNA, 25 bp, Homo sapien
gatatcactttaactttctgaacct

SEQ ID NO: 83910 - DNA, 25 bp, Homo sapien
gaacctcagagtcttcacctataag

SEQ ID NO: 83911 - DNA, 25 bp, Homo sapien
aataataccaccctttcaagattgt

SEQ ID NO: 83912 - DNA, 25 bp, Homo sapien
gtaaagcttagttctggccacagtg

SEQ ID NO: 83913 - DNA, 25 bp, Homo sapien
ttctggccacagtgtagctactcaa

SEQ ID NO: 83914 - DNA, 25 bp, Homo sapien
tcagaattattgctctggctagcat

SEQ ID NO: 83915 - DNA, 25 bp, Homo sapien
accctttgcagaagattcccttgta

SEQ ID NO: 83916 - DNA, 25 bp, Homo sapien
aagattcccttgtaaatggccctgt

SEQ ID NO: 83917 - DNA, 25 bp, Homo sapien
aaatggccctgtggcatgcccagta

SEQ ID NO: 83918 - DNA, 25 bp, Homo sapien
atgcccagtatctgcaatgttctag

SEQ ID NO: 83919 - DNA, 25 bp, Homo sapien
caaacctctctgtttgccaagcctg

SEQ ID NO: 83920 - DNA, 25 bp, Homo sapien
gtttgccaagcctgcagagttgaac

SEQ ID NO: 83921 - DNA, 25 bp, Homo sapien
gcctgcagagttgaacatgtccata

SEQ ID NO: 83922 - DNA, 25 bp, Homo sapien
gtatacaatctgaccctgttttttg

SEQ ID NO: 83923 - DNA, 25 bp, Homo sapien
tgttttttggccctgtttctggaca

SEQ ID NO: 83924 - DNA, 25 bp, Homo sapien
gtttctggacactgtagctgaccaa

SEQ ID NO: 83925 - DNA, 25 bp, Homo sapien
acaacagcacagtcagcgggtgaat

SEQ ID NO: 83926 - DNA, 25 bp, Homo sapien
gtcagcgggtgaattacaggtgcct

SEQ ID NO: 83927 - DNA, 25 bp, Homo sapien
gcctacctgggtaatctgatcttgt

SEQ ID NO: 83928 - DNA, 25 bp, Homo sapien
aatctgatcttgtctgtatcgccgt

SEQ ID NO: 83929 - DNA, 25 bp, Homo sapien
gtatcgccgtgtgctcatcactgaa

SEQ ID NO: 83930 - DNA, 25 bp, Homo sapien
agaattgcaggccactcatgtcagt

SEQ ID NO: 83931 - DNA, 25 bp, Homo sapien
aggccactcatgtcagtgaccagat

SEQ ID NO: 83932 - DNA, 25 bp, Homo sapien
catgtcagtgaccagatttgtggct

SEQ ID NO: 83933 - DNA, 25 bp, Homo sapien
ggatcttgtaaacagggcatatcaa

SEQ ID NO: 83934 - DNA, 25 bp, Homo sapien
gatgaccttataatatgtacccgaa

SEQ ID NO: 83935 - DNA, 25 bp, Homo sapien
gtacccgaatatacagttcaagaat

SEQ ID NO: 83936 - DNA, 25 bp, Homo sapien
ttgatgctgctgcacttccggttcc

SEQ ID NO: 83937 - DNA, 25 bp, Homo sapien
gatgctgctgcacttccggttcctg

SEQ ID NO: 83938 - DNA, 25 bp, Homo sapien
tgcacttccggttcctgccagacca

SEQ ID NO: 83939 - DNA, 25 bp, Homo sapien
cctgaatgtaggcttgcagtgactt

SEQ ID NO: 83940 - DNA, 25 bp, Homo sapien
taggcttgcagtgactttctgaccc

SEQ ID NO: 83941 - DNA, 25 bp, Homo sapien
aggcttgcagtgactttctgaccca

SEQ ID NO: 83942 - DNA, 25 bp, Homo sapien
ggcttgcagtgactttctgacccat

SEQ ID NO: 83943 - DNA, 25 bp, Homo sapien
gcttgcagtgactttctgacccatc

SEQ ID NO: 83944 - DNA, 25 bp, Homo sapien
ttgcagtgactttctgacccatcca

SEQ ID NO: 83945 - DNA, 25 bp, Homo sapien
agtgactttctgacccatccacctg

SEQ ID NO: 83946 - DNA, 25 bp, Homo sapien
tttctgacccatccacctgtttttt

SEQ ID NO: 83947 - DNA, 25 bp, Homo sapien
ggaagagcaagagggtttttaccat

SEQ ID NO: 83948 - DNA, 25 bp, Homo sapien
gcaagagggtttttaccatatgttg

SEQ ID NO: 83949 - DNA, 25 bp, Homo sapien
ccatatgttggtatggtcaccataa

SEQ ID NO: 83950 - DNA, 25 bp, Homo sapien
gtatggtcaccataataatgaatga

SEQ ID NO: 83951 - DNA, 25 bp, Homo sapien
gactatccaaaattcaagtatgctc

SEQ ID NO: 83952 - DNA, 25 bp, Homo sapien
attcaagtatgctcttttggctgta

SEQ ID NO: 83953 - DNA, 25 bp, Homo sapien
gctcttttggctgtaatgggtgcat

SEQ ID NO: 83954 - DNA, 25 bp, Homo sapien
atgggtgcatatgtgttactaaaac

SEQ ID NO: 83955 - DNA, 25 bp, Homo sapien
ttactaaaacgtgaatcctaaaatg

SEQ ID NO: 83956 - DNA, 25 bp, Homo sapien
tatatttgagatgttccattttctg

SEQ ID NO: 83957 - DNA, 25 bp, Homo sapien
tgttccattttctgtataaaaggga

SEQ ID NO: 83958 - DNA, 25 bp, Homo sapien
tgaggcccacgatagaccagctgta

SEQ ID NO: 83959 - DNA, 25 bp, Homo sapien
aggcccacgatagaccagctgtagc

SEQ ID NO: 83960 - DNA, 25 bp, Homo sapien
actgcatcccatcctgaatatcctt

SEQ ID NO: 83961 - DNA, 25 bp, Homo sapien
atcccatcctgaatatcctttgcaa

SEQ ID NO: 83962 - DNA, 25 bp, Homo sapien
atcctgaatatcctttgcaactccc

SEQ ID NO: 83963 - DNA, 25 bp, Homo sapien
tttgcaactccccaagagtgcttat

SEQ ID NO: 83964 - DNA, 25 bp, Homo sapien
gcaactccccaagagtgcttattta

SEQ ID NO: 83965 - DNA, 25 bp, Homo sapien
tccccaagagtgcttatttaagtgt

SEQ ID NO: 83966 - DNA, 25 bp, Homo sapien
taagagaactgcgacgattaattgt

SEQ ID NO: 83967 - DNA, 25 bp, Homo sapien
gcgacgattaattgtggatctcccc

SEQ ID NO: 83968 - DNA, 25 bp, Homo sapien
acgattaattgtggatctccccctg

SEQ ID NO: 83969 - DNA, 25 bp, Homo sapien
tttgtgggtgtctcgtgctcagcca

SEQ ID NO: 83970 - DNA, 25 bp, Homo sapien
agctgggttggatcttctctccatt

SEQ ID NO: 83971 - DNA, 25 bp, Homo sapien
cattcccctttctagctttaactag

SEQ ID NO: 83972 - DNA, 25 bp, Homo sapien
gatgtaggcagattggtggtttttt

SEQ ID NO: 83973 - DNA, 25 bp, Homo sapien
aagctgcaacacagctggtgatgag

SEQ ID NO: 83974 - DNA, 25 bp, Homo sapien
agctggtgatgagaggcttcctcag

SEQ ID NO: 83975 - DNA, 25 bp, Homo sapien
atgagaggcttcctcagtccagtcg

SEQ ID NO: 83976 - DNA, 25 bp, Homo sapien
agtccagtcgctccttagcaccagg

SEQ ID NO: 83977 - DNA, 25 bp, Homo sapien
ttagcaccaggcaccgtgggtcctg

SEQ ID NO: 83978 - DNA, 25 bp, Homo sapien
gggaactgcaagcagcctctcagct

SEQ ID NO: 83979 - DNA, 25 bp, Homo sapien
tgcaagcagcctctcagctgatggc

SEQ ID NO: 83980 - DNA, 25 bp, Homo sapien
gctggaaggcgagagctccgcacct

SEQ ID NO: 83981 - DNA, 25 bp, Homo sapien
aaggtggcgcggaccgacagcccag

SEQ ID NO: 83982 - DNA, 25 bp, Homo sapien
gacagcccagacatgcacgaggaca

SEQ ID NO: 83983 - DNA, 25 bp, Homo sapien
gcccagacatgcacgaggacactta

SEQ ID NO: 83984 - DNA, 25 bp, Homo sapien
gaggacacttaagactctcaactcc

SEQ ID NO: 83985 - DNA, 25 bp, Homo sapien
acacttaagactctcaactccacag

SEQ ID NO: 83986 - DNA, 25 bp, Homo sapien
aacctcataggagccgatgtattta

SEQ ID NO: 83987 - DNA, 25 bp, Homo sapien
taggagccgatgtatttattttcct

SEQ ID NO: 83988 - DNA, 25 bp, Homo sapien
gtttttatttatgctgtaacctgta

SEQ ID NO: 83989 - DNA, 25 bp, Homo sapien
tgctgtaacctgtatcaagcgttgg

SEQ ID NO: 83990 - DNA, 25 bp, Homo sapien
aacctgtatcaagcgttggttaaag

SEQ ID NO: 83991 - DNA, 25 bp, Homo sapien
tgtgtatgtgaacagcttgggccct

SEQ ID NO: 83992 - DNA, 25 bp, Homo sapien
tgtgaacagcttgggccctgcaaac

SEQ ID NO: 83993 - DNA, 25 bp, Homo sapien
tgcaaacacaaccatctacacacat

SEQ ID NO: 83994 - DNA, 25 bp, Homo sapien
aagcacacacacatggtccgtgcca

SEQ ID NO: 83995 - DNA, 25 bp, Homo sapien
gtgccatgtcacctccatagggaaa

SEQ ID NO: 83996 - DNA, 25 bp, Homo sapien
tccatagggaaaggcttctctccaa

SEQ ID NO: 83997 - DNA, 25 bp, Homo sapien
ttctctccaagtgtgccaggccagg

SEQ ID NO: 83998 - DNA, 25 bp, Homo sapien
agtgtgccaggccaggacagccctc

SEQ ID NO: 83999 - DNA, 25 bp, Homo sapien
cagccatgaatccttactcagctac

SEQ ID NO: 84000 - DNA, 25 bp, Homo sapien
tccttactcagctacctcgggttgg

SEQ ID NO: 84001 - DNA, 25 bp, Homo sapien
ctgcctggctctgtctgaacagaag

SEQ ID NO: 84002 - DNA, 25 bp, Homo sapien
gttaacttttcatactaacaaacag

SEQ ID NO: 84003 - DNA, 25 bp, Homo sapien
gatttatagtatctacttctggtac

SEQ ID NO: 84004 - DNA, 25 bp, Homo sapien
ctggtactaatatacacaaaaggcc

SEQ ID NO: 84005 - DNA, 25 bp, Homo sapien
ggccaaaaccatgcctattctgcag

SEQ ID NO: 84006 - DNA, 25 bp, Homo sapien
aaaccatgcctattctgcaggtgta

SEQ ID NO: 84007 - DNA, 25 bp, Homo sapien
atgcctattctgcaggtgtagcttc

SEQ ID NO: 84008 - DNA, 25 bp, Homo sapien
cctattctgcaggtgtagcttcggt

SEQ ID NO: 84009 - DNA, 25 bp, Homo sapien
attctgcaggtgtagcttcggtgct

SEQ ID NO: 84010 - DNA, 25 bp, Homo sapien
gcaggtgtagcttcggtgctctcct

SEQ ID NO: 84011 - DNA, 25 bp, Homo sapien
agcttcggtgctctcctgttcaggg

SEQ ID NO: 84012 - DNA, 25 bp, Homo sapien
gggcaggctcactgcccgcttcttt

SEQ ID NO: 84013 - DNA, 25 bp, Homo sapien
ggaaagtcctgggtgacatccacac

SEQ ID NO: 84014 - DNA, 25 bp, Homo sapien
aagtcctgggtgacatccacaccac

SEQ ID NO: 84015 - DNA, 25 bp, Homo sapien
tgtcggccgtcatccccaatgcttt

SEQ ID NO: 84016 - DNA, 25 bp, Homo sapien
ccccaatgctttccggctggtcaag

SEQ ID NO: 84017 - DNA, 25 bp, Homo sapien
ctccctgggtgggatgggctacttt

SEQ ID NO: 84018 - DNA, 25 bp, Homo sapien
gaagatggcagccggcccaacctgc

SEQ ID NO: 84019 - DNA, 25 bp, Homo sapien
cccaacctgcagtccttctttgaga

SEQ ID NO: 84020 - DNA, 25 bp, Homo sapien
tgcagtccttctttgagagggtcca

SEQ ID NO: 84021 - DNA, 25 bp, Homo sapien
cagagacgctttgccttccggaaag

SEQ ID NO: 84022 - DNA, 25 bp, Homo sapien
gagacgctttgccttccggaaagtc

SEQ ID NO: 84023 - DNA, 25 bp, Homo sapien
cttccggaaagtcctgggtgacatc

SEQ ID NO: 84024 - DNA, 25 bp, Homo sapien
ccaacagggcaactgtagaaggcca

SEQ ID NO: 84025 - DNA, 25 bp, Homo sapien
aaaggtgaatgttgagggcccttca

SEQ ID NO: 84026 - DNA, 25 bp, Homo sapien
gggcccttcacttccatcacaagaa

SEQ ID NO: 84027 - DNA, 25 bp, Homo sapien
aaagtcattagacggtaccaattca

SEQ ID NO: 84028 - DNA, 25 bp, Homo sapien
gtaccaattcagtgtctgttcctgg

SEQ ID NO: 84029 - DNA, 25 bp, Homo sapien
gtgtctgttcctggcatctatttcc

SEQ ID NO: 84030 - DNA, 25 bp, Homo sapien
tggcatctatttcctctgtgcaaag

SEQ ID NO: 84031 - DNA, 25 bp, Homo sapien
tcctctgtgcaaagggaaccatgta

SEQ ID NO: 84032 - DNA, 25 bp, Homo sapien
gggaaccatgtatatgagcttataa

SEQ ID NO: 84033 - DNA, 25 bp, Homo sapien
aatacatttttgtcagagtgcacag

SEQ ID NO: 84034 - DNA, 25 bp, Homo sapien
gagtgcacagataagtaggccattt

SEQ ID NO: 84035 - DNA, 25 bp, Homo sapien
cccatctctctttctaatgagaagg

SEQ ID NO: 84036 - DNA, 25 bp, Homo sapien
aatgagaaggactttgtggtacggc

SEQ ID NO: 84037 - DNA, 25 bp, Homo sapien
aagagagtttgcgtagcagccctca

SEQ ID NO: 84038 - DNA, 25 bp, Homo sapien
gcagccctcacaaaaaggccttgta

SEQ ID NO: 84039 - DNA, 25 bp, Homo sapien
ggagacccgtcctgaacgggcgact

SEQ ID NO: 84040 - DNA, 25 bp, Homo sapien
gaacgggcgactgtgtcttgactac

SEQ ID NO: 84041 - DNA, 25 bp, Homo sapien
cgactgtgtcttgactacctttcaa

SEQ ID NO: 84042 - DNA, 25 bp, Homo sapien
gtcttgactacctttcaaaaccagc

SEQ ID NO: 84043 - DNA, 25 bp, Homo sapien
agcactgtgtgggaatgtccgccag

SEQ ID NO: 84044 - DNA, 25 bp, Homo sapien
gaatgtccgccaggcagagctcgga

SEQ ID NO: 84045 - DNA, 25 bp, Homo sapien
agagctcggagcctcattgagacag

SEQ ID NO: 84046 - DNA, 25 bp, Homo sapien
tgtggaatatccaacccctagcatt

SEQ ID NO: 84047 - DNA, 25 bp, Homo sapien
atccaacccctagcatttcatggaa

SEQ ID NO: 84048 - DNA, 25 bp, Homo sapien
gcatttcatggaatgtactgaccaa

SEQ ID NO: 84049 - DNA, 25 bp, Homo sapien
gttcttattaaacaatgccatttct

SEQ ID NO: 84050 - DNA, 25 bp, Homo sapien
aacaatgccatttcttgaccacttc

SEQ ID NO: 84051 - DNA, 25 bp, Homo sapien
tgccatttcttgaccacttctgttt

SEQ ID NO: 84052 - DNA, 25 bp, Homo sapien
ttcttgaccacttctgtttttagga

SEQ ID NO: 84053 - DNA, 25 bp, Homo sapien
taggaattgtggtatctgagtcatg

SEQ ID NO: 84054 - DNA, 25 bp, Homo sapien
ctgagtcatggtgattagaagtact

SEQ ID NO: 84055 - DNA, 25 bp, Homo sapien
catatagtagggagatgtctgtgaa

SEQ ID NO: 84056 - DNA, 25 bp, Homo sapien
actggtacagattttgtgtttataa

SEQ ID NO: 84057 - DNA, 25 bp, Homo sapien
gtggaatttcgggacagcagccttc

SEQ ID NO: 84058 - DNA, 25 bp, Homo sapien
ggaatttcgggacagcagccttcct

SEQ ID NO: 84059 - DNA, 25 bp, Homo sapien
acagcagccttcctcgatcacgaag

SEQ ID NO: 84060 - DNA, 25 bp, Homo sapien
agccttcctcgatcacgaagaccgt

SEQ ID NO: 84061 - DNA, 25 bp, Homo sapien
tcgatcacgaagaccgtcccgtggg

SEQ ID NO: 84062 - DNA, 25 bp, Homo sapien
agaaacagtagatcgggagcagccc

SEQ ID NO: 84063 - DNA, 25 bp, Homo sapien
agtagatcgggagcagccccactgg

SEQ ID NO: 84064 - DNA, 25 bp, Homo sapien
gagcagccccactggacctaggtgc

SEQ ID NO: 84065 - DNA, 25 bp, Homo sapien
acctaggtgccccatctgttggtca

SEQ ID NO: 84066 - DNA, 25 bp, Homo sapien
atctgttggtcatccatcctgaagg

SEQ ID NO: 84067 - DNA, 25 bp, Homo sapien
ttggtcatccatcctgaagggacag

SEQ ID NO: 84068 - DNA, 25 bp, Homo sapien
tggcacagggaacagcatgccccct

SEQ ID NO: 84069 - DNA, 25 bp, Homo sapien
acccagagactgtcgctgtctatgg

SEQ ID NO: 84070 - DNA, 25 bp, Homo sapien
cagagactgtcgctgtctatggccc

SEQ ID NO: 84071 - DNA, 25 bp, Homo sapien
agactgtcgctgtctatggccccaa

SEQ ID NO: 84072 - DNA, 25 bp, Homo sapien
tgtcgctgtctatggccccaactca

SEQ ID NO: 84073 - DNA, 25 bp, Homo sapien
acttgtccacacagctacccacgta

SEQ ID NO: 84074 - DNA, 25 bp, Homo sapien
tacccacgtacgacatcgtcctggc

SEQ ID NO: 84075 - DNA, 25 bp, Homo sapien
tccccagagtatcttcccactgaga

SEQ ID NO: 84076 - DNA, 25 bp, Homo sapien
agagtatcttcccactgagacacgc

SEQ ID NO: 84077 - DNA, 25 bp, Homo sapien
agtcacccctttttaagcaccatga

SEQ ID NO: 84078 - DNA, 25 bp, Homo sapien
cacccctttttaagcaccatgagct

SEQ ID NO: 84079 - DNA, 25 bp, Homo sapien
gtaccatgtggccacaactgctgtg

SEQ ID NO: 84080 - DNA, 25 bp, Homo sapien
accatgtggccacaactgctgtggc

SEQ ID NO: 84081 - DNA, 25 bp, Homo sapien
gtccccaagacacttccccttgtct

SEQ ID NO: 84082 - DNA, 25 bp, Homo sapien
ttgtctccctggttgcctctcttgc

SEQ ID NO: 84083 - DNA, 25 bp, Homo sapien
gtcctgaagcccagcgacacagaag

SEQ ID NO: 84084 - DNA, 25 bp, Homo sapien
gggccctctatgctggcttttcacc

SEQ ID NO: 84085 - DNA, 25 bp, Homo sapien
tctatgctggcttttcaccccagag

SEQ ID NO: 84086 - DNA, 25 bp, Homo sapien
tcaccccagaggacacaggcagctt

SEQ ID NO: 84087 - DNA, 25 bp, Homo sapien
gacacaggcagcttccaaaatatat

SEQ ID NO: 84088 - DNA, 25 bp, Homo sapien
acacaggcagcttccaaaatatatt

SEQ ID NO: 84089 - DNA, 25 bp, Homo sapien
tatatttatcttcttcacgggaaaa

SEQ ID NO: 84090 - DNA, 25 bp, Homo sapien
gctagaactgtgagcttcgttgatg

SEQ ID NO: 84091 - DNA, 25 bp, Homo sapien
gaactgtgagcttcgttgatgttag

SEQ ID NO: 84092 - DNA, 25 bp, Homo sapien
gttgatgttagtcaaagctccccta

SEQ ID NO: 84093 - DNA, 25 bp, Homo sapien
gatgttagtcaaagctcccctatat

SEQ ID NO: 84094 - DNA, 25 bp, Homo sapien
gttagtcaaagctcccctatataca

SEQ ID NO: 84095 - DNA, 25 bp, Homo sapien
gtcaaagctcccctatatacaccat

SEQ ID NO: 84096 - DNA, 25 bp, Homo sapien
tctttttctgtattctcctctgacc

SEQ ID NO: 84097 - DNA, 25 bp, Homo sapien
tttctgtattctcctctgaccagag

SEQ ID NO: 84098 - DNA, 25 bp, Homo sapien
gccttatcaaacaggacaaataggt

SEQ ID NO: 84099 - DNA, 25 bp, Homo sapien
caggacaaataggttcggttttatg

SEQ ID NO: 84100 - DNA, 25 bp, Homo sapien
ataggttcggttttatgtcttgaat

SEQ ID NO: 84101 - DNA, 25 bp, Homo sapien
gatgcaggagccctatacccctaca

SEQ ID NO: 84102 - DNA, 25 bp, Homo sapien
ctactcctttgctccatagtgttaa

SEQ ID NO: 84103 - DNA, 25 bp, Homo sapien
atagtgttaacctactctcggagct

SEQ ID NO: 84104 - DNA, 25 bp, Homo sapien
gagctgcctccatgggcacagtaaa

SEQ ID NO: 84105 - DNA, 25 bp, Homo sapien
cgatacatcgacaaccaggtagtga

SEQ ID NO: 84106 - DNA, 25 bp, Homo sapien
aagatgtgcggaaccctgaggccga

SEQ ID NO: 84107 - DNA, 25 bp, Homo sapien
gaaggccacatacatcaacctcaag

SEQ ID NO: 84108 - DNA, 25 bp, Homo sapien
agccagaaagtaccgcttccattga

SEQ ID NO: 84109 - DNA, 25 bp, Homo sapien
aaagtaccgcttccattgaggcact

SEQ ID NO: 84110 - DNA, 25 bp, Homo sapien
cattgaggcactcgccggactctgc

SEQ ID NO: 84111 - DNA, 25 bp, Homo sapien
ttctaggctcagatcccagagggat

SEQ ID NO: 84112 - DNA, 25 bp, Homo sapien
atgtcacttgcattctagatccagt

SEQ ID NO: 84113 - DNA, 25 bp, Homo sapien
gatgtcacaattcttactgagggca

SEQ ID NO: 84114 - DNA, 25 bp, Homo sapien
gtcatatcttttacaggttggccca

SEQ ID NO: 84115 - DNA, 25 bp, Homo sapien
caggttggcccaagtagatgtcaaa

SEQ ID NO: 84116 - DNA, 25 bp, Homo sapien
gtagatgtcaaaaacccctatggat

SEQ ID NO: 84117 - DNA, 25 bp, Homo sapien
caataccacacatctcttgttttca

SEQ ID NO: 84118 - DNA, 25 bp, Homo sapien
aggagagttgcctgcattcatctgt

SEQ ID NO: 84119 - DNA, 25 bp, Homo sapien
gatgaaagtccttactgtcagccaa

SEQ ID NO: 84120 - DNA, 25 bp, Homo sapien
tactgtcagccaagtgtgcatatga

SEQ ID NO: 84121 - DNA, 25 bp, Homo sapien
aatttcctctgtttgctaaccacta

SEQ ID NO: 84122 - DNA, 25 bp, Homo sapien
ttatgacactctctattcaacccaa

SEQ ID NO: 84123 - DNA, 25 bp, Homo sapien
gttttctcaaaacactgttcattgg

SEQ ID NO: 84124 - DNA, 25 bp, Homo sapien
aacactgttcattggttgcaagaat

SEQ ID NO: 84125 - DNA, 25 bp, Homo sapien
tactgacttcagaactcaaacaatg

SEQ ID NO: 84126 - DNA, 25 bp, Homo sapien
tgcatttttatggaactcagtatta

SEQ ID NO: 84127 - DNA, 25 bp, Homo sapien
atgtgaattagccactttgcagaat

SEQ ID NO: 84128 - DNA, 25 bp, Homo sapien
ttagccactttgcagaatatgttct

SEQ ID NO: 84129 - DNA, 25 bp, Homo sapien
gaatatgttctagactggtgatctg

SEQ ID NO: 84130 - DNA, 25 bp, Homo sapien
gactggtgatctgaaagcatctgta

SEQ ID NO: 84131 - DNA, 25 bp, Homo sapien
aagcatctgtagttttccttatact

SEQ ID NO: 84132 - DNA, 25 bp, Homo sapien
actagtgtcatagatactttttgta

SEQ ID NO: 84133 - DNA, 25 bp, Homo sapien
caaacaattgatcatgtgctgtaaa

SEQ ID NO: 84134 - DNA, 25 bp, Homo sapien
gagagagaagtgtttttctatcata

SEQ ID NO: 84135 - DNA, 25 bp, Homo sapien
ggagagcttaaaggtgtttcaatta

SEQ ID NO: 84136 - DNA, 25 bp, Homo sapien
ctgacacaggctgttgagaattctt

SEQ ID NO: 84137 - DNA, 25 bp, Homo sapien
tggtcccctttctcttgatgtggaa

SEQ ID NO: 84138 - DNA, 25 bp, Homo sapien
ggtcccctttctcttgatgtggaaa

SEQ ID NO: 84139 - DNA, 25 bp, Homo sapien
tgatgtggaaagtctgaatgcagta

SEQ ID NO: 84140 - DNA, 25 bp, Homo sapien
gaatgcagtatttatagacttctaa

SEQ ID NO: 84141 - DNA, 25 bp, Homo sapien
gcagtatttatagacttctaaggtt

SEQ ID NO: 84142 - DNA, 25 bp, Homo sapien
taaggttttaaaatccagtatcaag

SEQ ID NO: 84143 - DNA, 25 bp, Homo sapien
aatccagtatcaagaagaaaatcag

SEQ ID NO: 84144 - DNA, 25 bp, Homo sapien
cagaaatactggttggtgaaataaa

SEQ ID NO: 84145 - DNA, 25 bp, Homo sapien
aatcaaaatctgagtctgagacata

SEQ ID NO: 84146 - DNA, 25 bp, Homo sapien
tgagacatacacactttccagcaag

SEQ ID NO: 84147 - DNA, 25 bp, Homo sapien
tttccagcaagatgggtcctgactc

SEQ ID NO: 84148 - DNA, 25 bp, Homo sapien
gcaagatgggtcctgactcaaaacc

SEQ ID NO: 84149 - DNA, 25 bp, Homo sapien
ggatgtttttccaggacaagtgaag

SEQ ID NO: 84150 - DNA, 25 bp, Homo sapien
actagaatattcaactccatatgga

SEQ ID NO: 84151 - DNA, 25 bp, Homo sapien
ggaaaatcatatccatggatctctt

SEQ ID NO: 84152 - DNA, 25 bp, Homo sapien
tccttggagaggaagtaatcaacct

SEQ ID NO: 84153 - DNA, 25 bp, Homo sapien
taatcaacctttacttcccaagctg

SEQ ID NO: 84154 - DNA, 25 bp, Homo sapien
ccaagctgtttgttctccacaatag

SEQ ID NO: 84155 - DNA, 25 bp, Homo sapien
gttctccacaataggctctcaacaa

SEQ ID NO: 84156 - DNA, 25 bp, Homo sapien
tagccatgcaagaaactcagccggt

SEQ ID NO: 84157 - DNA, 25 bp, Homo sapien
aactcagccggtcatgttgaacaaa

SEQ ID NO: 84158 - DNA, 25 bp, Homo sapien
ctaagagtgccaggaagttaatgtc

SEQ ID NO: 84159 - DNA, 25 bp, Homo sapien
gggcagttagattccccagcttcct

SEQ ID NO: 84160 - DNA, 25 bp, Homo sapien
ttcctcgctcctctgctgggttaag

SEQ ID NO: 84161 - DNA, 25 bp, Homo sapien
ctgctgggttaagcctgcaacatat

SEQ ID NO: 84162 - DNA, 25 bp, Homo sapien
gcaacatattcatcatctcccagag

SEQ ID NO: 84163 - DNA, 25 bp, Homo sapien
atcatctcccagagtgctgcccggg

SEQ ID NO: 84164 - DNA, 25 bp, Homo sapien
gctcagtgtggtgacctgctcatgt

SEQ ID NO: 84165 - DNA, 25 bp, Homo sapien
ggtgacctgctcatgtcagcttctt

SEQ ID NO: 84166 - DNA, 25 bp, Homo sapien
tttcctgtcttgtttcgcacccaca

SEQ ID NO: 84167 - DNA, 25 bp, Homo sapien
ggctgtgtcggcagcaagagccttt

SEQ ID NO: 84168 - DNA, 25 bp, Homo sapien
cagcaagagcctttctggatgttcc

SEQ ID NO: 84169 - DNA, 25 bp, Homo sapien
gctcttctctgggagtctagaacat

SEQ ID NO: 84170 - DNA, 25 bp, Homo sapien
agtctagaacatcctcctacctttc

SEQ ID NO: 84171 - DNA, 25 bp, Homo sapien
gattccaggttttcgaacactacat

SEQ ID NO: 84172 - DNA, 25 bp, Homo sapien
tatgttcttccttgtttcaaagcac

SEQ ID NO: 84173 - DNA, 25 bp, Homo sapien
gtttcaaagcacttattggctgtgt

SEQ ID NO: 84174 - DNA, 25 bp, Homo sapien
gttacctattttcacactgtgagct

SEQ ID NO: 84175 - DNA, 25 bp, Homo sapien
ttcacactgtgagcttcccgagaat

SEQ ID NO: 84176 - DNA, 25 bp, Homo sapien
attcatctgttttctacagggttta

SEQ ID NO: 84177 - DNA, 25 bp, Homo sapien
acagggtttaagtctcaggaggtct

SEQ ID NO: 84178 - DNA, 25 bp, Homo sapien
tctaggtcacgggtcaggaaacatt

SEQ ID NO: 84179 - DNA, 25 bp, Homo sapien
caggaaacatttgggcagctgctcc

SEQ ID NO: 84180 - DNA, 25 bp, Homo sapien
tgctcccttggcaggctgtggtctc

SEQ ID NO: 84181 - DNA, 25 bp, Homo sapien
ccatctgctgaggtggcaaaactat

SEQ ID NO: 84182 - DNA, 25 bp, Homo sapien
actataatttattcctggttggcta

SEQ ID NO: 84183 - DNA, 25 bp, Homo sapien
ttattcctggttggctagaactggg

SEQ ID NO: 84184 - DNA, 25 bp, Homo sapien
tgggtgaccaacagctatgaaacaa

SEQ ID NO: 84185 - DNA, 25 bp, Homo sapien
tctttaagaatgagcttcgtccttg

SEQ ID NO: 84186 - DNA, 25 bp, Homo sapien
gtccttgcctctactcggtcattct

SEQ ID NO: 84187 - DNA, 25 bp, Homo sapien
cattaccccttagccattgagacta

SEQ ID NO: 84188 - DNA, 25 bp, Homo sapien
aattacttcatctctaggtcacggg

SEQ ID NO: 84189 - DNA, 25 bp, Homo sapien
gcatccatttgcatcgtgaagactg

SEQ ID NO: 84190 - DNA, 25 bp, Homo sapien
gactggcattttgatacttcagctg

SEQ ID NO: 84191 - DNA, 25 bp, Homo sapien
acttcagctgtttgttcctgggaga

SEQ ID NO: 84192 - DNA, 25 bp, Homo sapien
gagcacagattccagaggtcacagt

SEQ ID NO: 84193 - DNA, 25 bp, Homo sapien
gaggtcacagtaagccttgcagctt

SEQ ID NO: 84194 - DNA, 25 bp, Homo sapien
gcagcttgagctgaaagatgccaga

SEQ ID NO: 84195 - DNA, 25 bp, Homo sapien
atgccagagccggagatgtctgctg

SEQ ID NO: 84196 - DNA, 25 bp, Homo sapien
cagcaggcagggttcattctggtga

SEQ ID NO: 84197 - DNA, 25 bp, Homo sapien
ggttcattctggtgacacagcaaca

SEQ ID NO: 84198 - DNA, 25 bp, Homo sapien
agggatttcacctccaccagtgaga

SEQ ID NO: 84199 - DNA, 25 bp, Homo sapien
ggagtcagagctctagagtcgacct

SEQ ID NO: 84200 - DNA, 25 bp, Homo sapien
aagggtagaaccacagactgaggac

SEQ ID NO: 84201 - DNA, 25 bp, Homo sapien
gaaccacagactgaggacgacctct

SEQ ID NO: 84202 - DNA, 25 bp, Homo sapien
tcttcccttgtacttgccataggaa

SEQ ID NO: 84203 - DNA, 25 bp, Homo sapien
agatgaactctgatatgcaaaataa

SEQ ID NO: 84204 - DNA, 25 bp, Homo sapien
taatggtgctctgaagactcttctt

SEQ ID NO: 84205 - DNA, 25 bp, Homo sapien
ggtgctctgaagactcttcttaact

SEQ ID NO: 84206 - DNA, 25 bp, Homo sapien
tttaagtattaattccatggacaat

SEQ ID NO: 84207 - DNA, 25 bp, Homo sapien
gattgtttgcagtatgaagacacat

SEQ ID NO: 84208 - DNA, 25 bp, Homo sapien
gaagacacatttctacttatgcagt

SEQ ID NO: 84209 - DNA, 25 bp, Homo sapien
tatgcagtattctcatgactgtact

SEQ ID NO: 84210 - DNA, 25 bp, Homo sapien
gtattctcatgactgtactttaaag

SEQ ID NO: 84211 - DNA, 25 bp, Homo sapien
cggcatgcattgtgaaagctttcca

SEQ ID NO: 84212 - DNA, 25 bp, Homo sapien
gcattgtgaaagctttccataccct

SEQ ID NO: 84213 - DNA, 25 bp, Homo sapien
tgtgaaagctttccatacccttggc

SEQ ID NO: 84214 - DNA, 25 bp, Homo sapien
aaagctttccatacccttggccatt

SEQ ID NO: 84215 - DNA, 25 bp, Homo sapien
aaccccatttatgcaggaagggact

SEQ ID NO: 84216 - DNA, 25 bp, Homo sapien
gaagggactgctaacaagaacgctt

SEQ ID NO: 84217 - DNA, 25 bp, Homo sapien
gggactgctaacaagaacgcttcca

SEQ ID NO: 84218 - DNA, 25 bp, Homo sapien
tgctaacaagaacgcttccatctca

SEQ ID NO: 84219 - DNA, 25 bp, Homo sapien
agaacgcttccatctcaaacctttt

SEQ ID NO: 84220 - DNA, 25 bp, Homo sapien
tcaaaccttttctctgcctgggaaa

SEQ ID NO: 84221 - DNA, 25 bp, Homo sapien
caaaccttttctctgcctgggaaat

SEQ ID NO: 84222 - DNA, 25 bp, Homo sapien
tgggatgggaataatcattgagaca

SEQ ID NO: 84223 - DNA, 25 bp, Homo sapien
gacagagtcactgtctttcgggatc

SEQ ID NO: 84224 - DNA, 25 bp, Homo sapien
gagtcactgtctttcgggatcctct

SEQ ID NO: 84225 - DNA, 25 bp, Homo sapien
agtcactgtctttcgggatcctctt

SEQ ID NO: 84226 - DNA, 25 bp, Homo sapien
actgtctttcgggatcctctttgga

SEQ ID NO: 84227 - DNA, 25 bp, Homo sapien
ctgtctttcgggatcctctttggac

SEQ ID NO: 84228 - DNA, 25 bp, Homo sapien
gtctttcgggatcctctttggacca

SEQ ID NO: 84229 - DNA, 25 bp, Homo sapien
tctttcgggatcctctttggaccac

SEQ ID NO: 84230 - DNA, 25 bp, Homo sapien
gtgttagagaagaccttcttcccat

SEQ ID NO: 84231 - DNA, 25 bp, Homo sapien
gttagagaagaccttcttcccataa

SEQ ID NO: 84232 - DNA, 25 bp, Homo sapien
tagagaagaccttcttcccataaaa

SEQ ID NO: 84233 - DNA, 25 bp, Homo sapien
tacggattaaaaccaccaacattat

SEQ ID NO: 84234 - DNA, 25 bp, Homo sapien
gaaagcagactgaccctctttttaa

SEQ ID NO: 84235 - DNA, 25 bp, Homo sapien
gacactgtcatgaactgtgttgaat

SEQ ID NO: 84236 - DNA, 25 bp, Homo sapien
tgaactgtgttgaatggtggaaatc

SEQ ID NO: 84237 - DNA, 25 bp, Homo sapien
tttctgtttgtggtgttgttatttg

SEQ ID NO: 84238 - DNA, 25 bp, Homo sapien
gttgttatttgttacatctgtttca

SEQ ID NO: 84239 - DNA, 25 bp, Homo sapien
gttacatctgtttcatgtctaggtg

SEQ ID NO: 84240 - DNA, 25 bp, Homo sapien
aaggaagtttgcagtcttgcagctt

SEQ ID NO: 84241 - DNA, 25 bp, Homo sapien
tgcagtcttgcagcttttattccct

SEQ ID NO: 84242 - DNA, 25 bp, Homo sapien
gcagcttttattccctgtgcaacaa

SEQ ID NO: 84243 - DNA, 25 bp, Homo sapien
attccctgtgcaacaaaagattaga

SEQ ID NO: 84244 - DNA, 25 bp, Homo sapien
ccatgtatctacctcactattcaag

SEQ ID NO: 84245 - DNA, 25 bp, Homo sapien
ttgctgctggtaatttgtatctgaa

SEQ ID NO: 84246 - DNA, 25 bp, Homo sapien
ttcctacacccttggacttgaggat

SEQ ID NO: 84247 - DNA, 25 bp, Homo sapien
agtatctcggacctttcagctgtga

SEQ ID NO: 84248 - DNA, 25 bp, Homo sapien
tcagctgtgaacatggactcttccc

SEQ ID NO: 84249 - DNA, 25 bp, Homo sapien
cactcctcttatttgctcacacggg

SEQ ID NO: 84250 - DNA, 25 bp, Homo sapien
gagcagcttcagttgttttcccgag

SEQ ID NO: 84251 - DNA, 25 bp, Homo sapien
tgttttcccgagcaaaggtctaaag

SEQ ID NO: 84252 - DNA, 25 bp, Homo sapien
aatgtttgaccatgccttcattgca

SEQ ID NO: 84253 - DNA, 25 bp, Homo sapien
cttcattgcacctgtttgtccaaaa

SEQ ID NO: 84254 - DNA, 25 bp, Homo sapien
tgtttgtccaaaaccccttgactgg

SEQ ID NO: 84255 - DNA, 25 bp, Homo sapien
accagatctgggtgccttgggagaa

SEQ ID NO: 84256 - DNA, 25 bp, Homo sapien
gggtgccttgggagaaccagtcctt

SEQ ID NO: 84257 - DNA, 25 bp, Homo sapien
tgccttgggagaaccagtccttcct

SEQ ID NO: 84258 - DNA, 25 bp, Homo sapien
ccttttgacccaccccaggaagatg

SEQ ID NO: 84259 - DNA, 25 bp, Homo sapien
atggagtgctcttttctaggcccat

SEQ ID NO: 84260 - DNA, 25 bp, Homo sapien
tgctcttttctaggcccatgttctg

SEQ ID NO: 84261 - DNA, 25 bp, Homo sapien
atgttctgccagcaaccgggatgcg

SEQ ID NO: 84262 - DNA, 25 bp, Homo sapien
cagcaaccgggatgcgtgggcaact

SEQ ID NO: 84263 - DNA, 25 bp, Homo sapien
atgcgtgggcaactggactctgcac

SEQ ID NO: 84264 - DNA, 25 bp, Homo sapien
ggttggtcacaatgagaacctcggg

SEQ ID NO: 84265 - DNA, 25 bp, Homo sapien
gtggccatgggcagacagccgaaag

SEQ ID NO: 84266 - DNA, 25 bp, Homo sapien
ggatgaggagtagccagcagctccc

SEQ ID NO: 84267 - DNA, 25 bp, Homo sapien
ttcttggcctaactcttccagttag

SEQ ID NO: 84268 - DNA, 25 bp, Homo sapien
aactcttccagttaggatctagaac

SEQ ID NO: 84269 - DNA, 25 bp, Homo sapien
taggatctagaactttgcctttttt

SEQ ID NO: 84270 - DNA, 25 bp, Homo sapien
gctattcacagatgcgaacatagta

SEQ ID NO: 84271 - DNA, 25 bp, Homo sapien
gatgcgaacatagtacactgcagcc

SEQ ID NO: 84272 - DNA, 25 bp, Homo sapien
gattacaagcatgcgccgacgatgc

SEQ ID NO: 84273 - DNA, 25 bp, Homo sapien
aagcatgcgccgacgatgcccagaa

SEQ ID NO: 84274 - DNA, 25 bp, Homo sapien
gacgatgcccagaatccagaacttt

SEQ ID NO: 84275 - DNA, 25 bp, Homo sapien
atgcccagaatccagaactttgtct

SEQ ID NO: 84276 - DNA, 25 bp, Homo sapien
tatcactctccccaacaacctagat

SEQ ID NO: 84277 - DNA, 25 bp, Homo sapien
aggagacacaggttattgtcccaca

SEQ ID NO: 84278 - DNA, 25 bp, Homo sapien
acaggttattgtcccacacgtgaaa

SEQ ID NO: 84279 - DNA, 25 bp, Homo sapien
gttattgtcccacacgtgaaaccag

SEQ ID NO: 84280 - DNA, 25 bp, Homo sapien
tgtcccacacgtgaaaccagcatgt

SEQ ID NO: 84281 - DNA, 25 bp, Homo sapien
accagcatgtgacttagttacaaaa

SEQ ID NO: 84282 - DNA, 25 bp, Homo sapien
ttaaaaatgcggttaataatgcctg

SEQ ID NO: 84283 - DNA, 25 bp, Homo sapien
gttaataatgcctgtgaactaaaaa

SEQ ID NO: 84284 - DNA, 25 bp, Homo sapien
gaagccctccccaaaaaaagtgcat

SEQ ID NO: 84285 - DNA, 25 bp, Homo sapien
tttgcatggcatgaacagtttagct

SEQ ID NO: 84286 - DNA, 25 bp, Homo sapien
atggcatgaacagtttagcttaagt

SEQ ID NO: 84287 - DNA, 25 bp, Homo sapien
gtttaaataatgagtcaagactgca

SEQ ID NO: 84288 - DNA, 25 bp, Homo sapien
gacttcattgggttttatagtggct

SEQ ID NO: 84289 - DNA, 25 bp, Homo sapien
tttatagtggctttctgatttttgg

SEQ ID NO: 84290 - DNA, 25 bp, Homo sapien
tgttgtatactgttaacgattgtct

SEQ ID NO: 84291 - DNA, 25 bp, Homo sapien
tgttaacgattgtctgcccatgttc

SEQ ID NO: 84292 - DNA, 25 bp, Homo sapien
gttctgcctgaaataccatgattgt

SEQ ID NO: 84293 - DNA, 25 bp, Homo sapien
gctggatacagtttggcttggaaaa

SEQ ID NO: 84294 - DNA, 25 bp, Homo sapien
acttcctgaaagtcagggtcggctt

SEQ ID NO: 84295 - DNA, 25 bp, Homo sapien
ctgaaagtcagggtcggcttgtgaa

SEQ ID NO: 84296 - DNA, 25 bp, Homo sapien
cagggtcggcttgtgaaaagttgtt

SEQ ID NO: 84297 - DNA, 25 bp, Homo sapien
atgtgaaatgtcaaccctcactcta

SEQ ID NO: 84298 - DNA, 25 bp, Homo sapien
aatgtcaaccctcactctaaacttt

SEQ ID NO: 84299 - DNA, 25 bp, Homo sapien
ttctgccaccacttcattagctgta

SEQ ID NO: 84300 - DNA, 25 bp, Homo sapien
ttagctgtattctccatagtatggt

SEQ ID NO: 84301 - DNA, 25 bp, Homo sapien
aatagcaggtgcgtcttctagttta

SEQ ID NO: 84302 - DNA, 25 bp, Homo sapien
tgcgtcttctagtttattcctcctg

SEQ ID NO: 84303 - DNA, 25 bp, Homo sapien
ccccgcaagggaatggtcagcctaa

SEQ ID NO: 84304 - DNA, 25 bp, Homo sapien
gtcagcctaagggtaatgtacagcc

SEQ ID NO: 84305 - DNA, 25 bp, Homo sapien
gtacagcccgtgcttggagaaccat

SEQ ID NO: 84306 - DNA, 25 bp, Homo sapien
ggagaaccatggaagctacacccct

SEQ ID NO: 84307 - DNA, 25 bp, Homo sapien
tacacccctacaggtgcatactgtt

SEQ ID NO: 84308 - DNA, 25 bp, Homo sapien
tgcatactgttctgcttttccaata

SEQ ID NO: 84309 - DNA, 25 bp, Homo sapien
cttttccaataaatacgagcggcga

SEQ ID NO: 84310 - DNA, 25 bp, Homo sapien
gtggcagatgatattacctgaagaa

SEQ ID NO: 84311 - DNA, 25 bp, Homo sapien
gatattacctgaagaagggacgaat

SEQ ID NO: 84312 - DNA, 25 bp, Homo sapien
ctgggcaggacaaagcatcagctgt

SEQ ID NO: 84313 - DNA, 25 bp, Homo sapien
acaaagcatcagctgtccagttcag

SEQ ID NO: 84314 - DNA, 25 bp, Homo sapien
agcatcagctgtccagttcaggcct

SEQ ID NO: 84315 - DNA, 25 bp, Homo sapien
aatctctcattactcctggtcttgg

SEQ ID NO: 84316 - DNA, 25 bp, Homo sapien
ctggtcttgggagttgccttctgag

SEQ ID NO: 84317 - DNA, 25 bp, Homo sapien
cttgggagttgccttctgaggatac

SEQ ID NO: 84318 - DNA, 25 bp, Homo sapien
agttgccttctgaggatactccact

SEQ ID NO: 84319 - DNA, 25 bp, Homo sapien
tgccttctgaggatactccactggg

SEQ ID NO: 84320 - DNA, 25 bp, Homo sapien
tacctgagcctggattagagggcag

SEQ ID NO: 84321 - DNA, 25 bp, Homo sapien
atcctctttaactgcttctaaaata

SEQ ID NO: 84322 - DNA, 25 bp, Homo sapien
tcctctttaactgcttctaaaatat

SEQ ID NO: 84323 - DNA, 25 bp, Homo sapien
ctttaactgcttctaaaatatctct

SEQ ID NO: 84324 - DNA, 25 bp, Homo sapien
gtgctccaagcgctttttgtttcta

SEQ ID NO: 84325 - DNA, 25 bp, Homo sapien
tgctccaagcgctttttgtttctaa

SEQ ID NO: 84326 - DNA, 25 bp, Homo sapien
gctccaagcgctttttgtttctaag

SEQ ID NO: 84327 - DNA, 25 bp, Homo sapien
tttttgtttctaagttgagtgcttg

SEQ ID NO: 84328 - DNA, 25 bp, Homo sapien
ttttgtttctaagttgagtgcttgg

SEQ ID NO: 84329 - DNA, 25 bp, Homo sapien
tttgtttctaagttgagtgcttggg

SEQ ID NO: 84330 - DNA, 25 bp, Homo sapien
taagttgagtgcttggggtttgaca

SEQ ID NO: 84331 - DNA, 25 bp, Homo sapien
ttaacttgttaaatacagtgaaaag

SEQ ID NO: 84332 - DNA, 25 bp, Homo sapien
gtagcaattggagtccttgtgtctc

SEQ ID NO: 84333 - DNA, 25 bp, Homo sapien
gcaattggagtccttgtgtctcttt

SEQ ID NO: 84334 - DNA, 25 bp, Homo sapien
aattggagtccttgtgtctcttttc

SEQ ID NO: 84335 - DNA, 25 bp, Homo sapien
ggagtccttgtgtctcttttccacc

SEQ ID NO: 84336 - DNA, 25 bp, Homo sapien
agatggcactagtcccccgataatt

SEQ ID NO: 84337 - DNA, 25 bp, Homo sapien
ccccgataatttatgtctcgttgaa

SEQ ID NO: 84338 - DNA, 25 bp, Homo sapien
gataatttatgtctcgttgaaataa

SEQ ID NO: 84339 - DNA, 25 bp, Homo sapien
aattttgtatatcattctagtcctg

SEQ ID NO: 84340 - DNA, 25 bp, Homo sapien
gtatatcattctagtcctgaaatat

SEQ ID NO: 84341 - DNA, 25 bp, Homo sapien
aatggtatgaataagctaacaggaa

SEQ ID NO: 84342 - DNA, 25 bp, Homo sapien
taagctaacaggaatagtatctaaa

SEQ ID NO: 84343 - DNA, 25 bp, Homo sapien
gctgtgttgaactcttcactctgct

SEQ ID NO: 84344 - DNA, 25 bp, Homo sapien
ttcactctgctgaagctcctaatgg

SEQ ID NO: 84345 - DNA, 25 bp, Homo sapien
ctctgctgaagctcctaatggaaaa

SEQ ID NO: 84346 - DNA, 25 bp, Homo sapien
gaaaaagctttcttctgactgtgac

SEQ ID NO: 84347 - DNA, 25 bp, Homo sapien
ctgactgtgaccctcttgaactgaa

SEQ ID NO: 84348 - DNA, 25 bp, Homo sapien
caagctcggcatctgttggttacaa

SEQ ID NO: 84349 - DNA, 25 bp, Homo sapien
aagatccagacttgggccgagcggt

SEQ ID NO: 84350 - DNA, 25 bp, Homo sapien
agtcttgaggccctggtgccgcact

SEQ ID NO: 84351 - DNA, 25 bp, Homo sapien
cctggtgccgcacttctagcatgtt

SEQ ID NO: 84352 - DNA, 25 bp, Homo sapien
acttctagcatgttggtctccttta

SEQ ID NO: 84353 - DNA, 25 bp, Homo sapien
gaaaatctgttctttccagcatgaa

SEQ ID NO: 84354 - DNA, 25 bp, Homo sapien
acacagccgcatcgtaaggtagaag

SEQ ID NO: 84355 - DNA, 25 bp, Homo sapien
cagccgcatcgtaaggtagaaggaa

SEQ ID NO: 84356 - DNA, 25 bp, Homo sapien
tctccccaaaagaaccgacaatcag

SEQ ID NO: 84357 - DNA, 25 bp, Homo sapien
gctccgagttcgactcgatcagcaa

SEQ ID NO: 84358 - DNA, 25 bp, Homo sapien
aacacatgggctcctgctcctgaca

SEQ ID NO: 84359 - DNA, 25 bp, Homo sapien
tgctcctgacacatgggctcctgct

SEQ ID NO: 84360 - DNA, 25 bp, Homo sapien
tgacacatgggctcctgctcctgac

SEQ ID NO: 84361 - DNA, 25 bp, Homo sapien
tgctcctgaccaaactgagcaagac

SEQ ID NO: 84362 - DNA, 25 bp, Homo sapien
tgaccaaactgagcaagaccagaat

SEQ ID NO: 84363 - DNA, 25 bp, Homo sapien
ctgagcaagaccagaatagactgtc

SEQ ID NO: 84364 - DNA, 25 bp, Homo sapien
gcagtcacgcaaacaacttatcagt

SEQ ID NO: 84365 - DNA, 25 bp, Homo sapien
ttttttgtaggcatttttctgtcag

SEQ ID NO: 84366 - DNA, 25 bp, Homo sapien
tataaaatgcaccaagcaattatgg

SEQ ID NO: 84367 - DNA, 25 bp, Homo sapien
gcaattatggtggacctattaccct

SEQ ID NO: 84368 - DNA, 25 bp, Homo sapien
tggtggacctattaccctatgggta

SEQ ID NO: 84369 - DNA, 25 bp, Homo sapien
tgacatcggatgtttcagcaactgt

SEQ ID NO: 84370 - DNA, 25 bp, Homo sapien
catcggatgtttcagcaactgttct

SEQ ID NO: 84371 - DNA, 25 bp, Homo sapien
tttgatcacaccactcagtgtgata

SEQ ID NO: 84372 - DNA, 25 bp, Homo sapien
caccactcagtgtgataattgtgtc

SEQ ID NO: 84373 - DNA, 25 bp, Homo sapien
gtgtctacagctaaaatggaaatag

SEQ ID NO: 84374 - DNA, 25 bp, Homo sapien
tctgtacagttgtgcaagatatgaa

SEQ ID NO: 84375 - DNA, 25 bp, Homo sapien
aagatatgaatggtttcacactcaa

SEQ ID NO: 84376 - DNA, 25 bp, Homo sapien
tcttcactctgctgaagctcctaat

SEQ ID NO: 84377 - DNA, 25 bp, Homo sapien
ttcactctgctgaagctcctaatgg

SEQ ID NO: 84378 - DNA, 25 bp, Homo sapien
tcactctgctgaagctcctaatgga

SEQ ID NO: 84379 - DNA, 25 bp, Homo sapien
cactctgctgaagctcctaatggaa

SEQ ID NO: 84380 - DNA, 25 bp, Homo sapien
actctgctgaagctcctaatggaaa

SEQ ID NO: 84381 - DNA, 25 bp, Homo sapien
ctctgctgaagctcctaatggaaaa

SEQ ID NO: 84382 - DNA, 25 bp, Homo sapien
tctgctgaagctcctaatggaaaaa

SEQ ID NO: 84383 - DNA, 25 bp, Homo sapien
gctgaagctcctaatggaaaaagct

SEQ ID NO: 84384 - DNA, 25 bp, Homo sapien
agtcttgaggccctggtgccgcact

SEQ ID NO: 84385 - DNA, 25 bp, Homo sapien
tgaggccctggtgccgcacttctag

SEQ ID NO: 84386 - DNA, 25 bp, Homo sapien
cctggtgccgcacttctagcatgtt

SEQ ID NO: 84387 - DNA, 25 bp, Homo sapien
ggcccccctggaatattgtgaatga

SEQ ID NO: 84388 - DNA, 25 bp, Homo sapien
cccctggaatattgtgaatgactag

SEQ ID NO: 84389 - DNA, 25 bp, Homo sapien
gggtagagcactctccgtcctgctg

SEQ ID NO: 84390 - DNA, 25 bp, Homo sapien
gaacagtggctgtctgcgatcaggt

SEQ ID NO: 84391 - DNA, 25 bp, Homo sapien
acagtggctgtctgcgatcaggtct

SEQ ID NO: 84392 - DNA, 25 bp, Homo sapien
tggctgtctgcgatcaggtctggca

SEQ ID NO: 84393 - DNA, 25 bp, Homo sapien
gcagtggctggatttctgcccaaga

SEQ ID NO: 84394 - DNA, 25 bp, Homo sapien
agtggctggatttctgcccaagacc

SEQ ID NO: 84395 - DNA, 25 bp, Homo sapien
ggctggatttctgcccaagaccaga

SEQ ID NO: 84396 - DNA, 25 bp, Homo sapien
ggatttctgcccaagaccagaggag

SEQ ID NO: 84397 - DNA, 25 bp, Homo sapien
ttctgcccaagaccagaggagtgtg

SEQ ID NO: 84398 - DNA, 25 bp, Homo sapien
agccctggccggaattctgttgaca

SEQ ID NO: 84399 - DNA, 25 bp, Homo sapien
gaattctgttgacagcgtcctgtga

SEQ ID NO: 84400 - DNA, 25 bp, Homo sapien
gacagcgtcctgtgaaatgggacca

SEQ ID NO: 84401 - DNA, 25 bp, Homo sapien
actccattggtcactcttgctgctt

SEQ ID NO: 84402 - DNA, 25 bp, Homo sapien
actcttgctgcttacctatgaggga

SEQ ID NO: 84403 - DNA, 25 bp, Homo sapien
aacagcctcatacctcattagtgtg

SEQ ID NO: 84404 - DNA, 25 bp, Homo sapien
cattagtgtgggtctttcccttgga

SEQ ID NO: 84405 - DNA, 25 bp, Homo sapien
ggaaggccaagcttcttagtgccgc

SEQ ID NO: 84406 - DNA, 25 bp, Homo sapien
ttagtgccgccattctggaacgcag

SEQ ID NO: 84407 - DNA, 25 bp, Homo sapien
tggaacgcagtcttcaccatttctt

SEQ ID NO: 84408 - DNA, 25 bp, Homo sapien
ttttcctcttcacaagacagacctc

SEQ ID NO: 84409 - DNA, 25 bp, Homo sapien
tatttcattgactaacccaggacag

SEQ ID NO: 84410 - DNA, 25 bp, Homo sapien
ctaacccaggacagtttcagtgatg

SEQ ID NO: 84411 - DNA, 25 bp, Homo sapien
tgcaaattgtgtgccctctggttca

SEQ ID NO: 84412 - DNA, 25 bp, Homo sapien
tgtgtgccctctggttcagctgaaa

SEQ ID NO: 84413 - DNA, 25 bp, Homo sapien
ttcagctgaaacagtcctggacttt

SEQ ID NO: 84414 - DNA, 25 bp, Homo sapien
accttgaataagtctcccacagttg

SEQ ID NO: 84415 - DNA, 25 bp, Homo sapien
aagtctcccacagttgtataaattg

SEQ ID NO: 84416 - DNA, 25 bp, Homo sapien
aactttagatgatcatttggttcca

SEQ ID NO: 84417 - DNA, 25 bp, Homo sapien
gatgatcatttggttccatttttat

SEQ ID NO: 84418 - DNA, 25 bp, Homo sapien
ttttgttaatgcaaacaggacttaa

SEQ ID NO: 84419 - DNA, 25 bp, Homo sapien
ggacttaaatgaactttgatctctg

SEQ ID NO: 84420 - DNA, 25 bp, Homo sapien
tgtttccttttatctccttccacgg

SEQ ID NO: 84421 - DNA, 25 bp, Homo sapien
actggccttgtgacggtttattctg

SEQ ID NO: 84422 - DNA, 25 bp, Homo sapien
ttctgattgagaactgggcggactc

SEQ ID NO: 84423 - DNA, 25 bp, Homo sapien
cgaaagagtccccttttccgcacag

SEQ ID NO: 84424 - DNA, 25 bp, Homo sapien
ccgcacagctgtgttgactttttaa

SEQ ID NO: 84425 - DNA, 25 bp, Homo sapien
gatgtatggctaagatttcacttta

SEQ ID NO: 84426 - DNA, 25 bp, Homo sapien
aagcagtcgtgaactgtgcgagcac

SEQ ID NO: 84427 - DNA, 25 bp, Homo sapien
ctgtgcgagcactgtggtttacaat

SEQ ID NO: 84428 - DNA, 25 bp, Homo sapien
ggtttacaattatactttgcatcga

SEQ ID NO: 84429 - DNA, 25 bp, Homo sapien
gaagctgagcgtgttcttagctcgg

SEQ ID NO: 84430 - DNA, 25 bp, Homo sapien
ttagctcggcctcactttgtctctg

SEQ ID NO: 84431 - DNA, 25 bp, Homo sapien
gcaggcgaggccgacagacctacag

SEQ ID NO: 84432 - DNA, 25 bp, Homo sapien
ggcgaggccgacagacctacagccg

SEQ ID NO: 84433 - DNA, 25 bp, Homo sapien
tatctgactcgtaagcggcgaatcg

SEQ ID NO: 84434 - DNA, 25 bp, Homo sapien
taagcggcgaatcgaggtatcgcac

SEQ ID NO: 84435 - DNA, 25 bp, Homo sapien
atcgaggtatcgcacgccctgggac

SEQ ID NO: 84436 - DNA, 25 bp, Homo sapien
gcacgccctgggactgacagagaga

SEQ ID NO: 84437 - DNA, 25 bp, Homo sapien
aacaaagacaagttccccagcagca

SEQ ID NO: 84438 - DNA, 25 bp, Homo sapien
agacaagttccccagcagcaaatgc

SEQ ID NO: 84439 - DNA, 25 bp, Homo sapien
gttccccagcagcaaatgcgagcag

SEQ ID NO: 84440 - DNA, 25 bp, Homo sapien
tggagcgggccccagaggcggcgga

SEQ ID NO: 84441 - DNA, 25 bp, Homo sapien
agggcgacgcgcagaagggcgacaa

SEQ ID NO: 84442 - DNA, 25 bp, Homo sapien
tttcttggtgaaaggcacctccttt

SEQ ID NO: 84443 - DNA, 25 bp, Homo sapien
tgaaaggcacctcctttcctgataa

SEQ ID NO: 84444 - DNA, 25 bp, Homo sapien
accaggctacagtgacagagcagct

SEQ ID NO: 84445 - DNA, 25 bp, Homo sapien
gctccgaaggacacgcttgcacaaa

SEQ ID NO: 84446 - DNA, 25 bp, Homo sapien
ttgcacaaactctcggccagacggg

SEQ ID NO: 84447 - DNA, 25 bp, Homo sapien
gaagagcgagtccaaggcttcctgc

SEQ ID NO: 84448 - DNA, 25 bp, Homo sapien
gagcgagtccaaggcttcctgcagg

SEQ ID NO: 84449 - DNA, 25 bp, Homo sapien
gccttggaactcaagcgagctgact

SEQ ID NO: 84450 - DNA, 25 bp, Homo sapien
aactcaagcgagctgactggctggc

SEQ ID NO: 84451 - DNA, 25 bp, Homo sapien
aagcgagctgactggctggcccgtc

SEQ ID NO: 84452 - DNA, 25 bp, Homo sapien
ggctggcccgtctgggcactgcatc

SEQ ID NO: 84453 - DNA, 25 bp, Homo sapien
taaccctttgactgctgcggcaacc

SEQ ID NO: 84454 - DNA, 25 bp, Homo sapien
tgcggcaacctttaaccacacaaat

SEQ ID NO: 84455 - DNA, 25 bp, Homo sapien
taaccacacaaatgtcacaagctag

SEQ ID NO: 84456 - DNA, 25 bp, Homo sapien
aagctagaatcatcagcatggttct

SEQ ID NO: 84457 - DNA, 25 bp, Homo sapien
agcatggttcttgccatggcaatca

SEQ ID NO: 84458 - DNA, 25 bp, Homo sapien
caatcaaagagttaagggctgtgca

SEQ ID NO: 84459 - DNA, 25 bp, Homo sapien
agggctgtgcagtgatttgttttgt

SEQ ID NO: 84460 - DNA, 25 bp, Homo sapien
gggcagtttttgtctgctgtaagtg

SEQ ID NO: 84461 - DNA, 25 bp, Homo sapien
gctgtaagtgtcttaacctagggaa

SEQ ID NO: 84462 - DNA, 25 bp, Homo sapien
actattgcatcttctgtatttacca

SEQ ID NO: 84463 - DNA, 25 bp, Homo sapien
ctgtatttaccatcaattcattgtg

SEQ ID NO: 84464 - DNA, 25 bp, Homo sapien
tgccagggaggctctggttgtctga

SEQ ID NO: 84465 - DNA, 25 bp, Homo sapien
gccagggaggctctggttgtctgag

SEQ ID NO: 84466 - DNA, 25 bp, Homo sapien
ccagggaggctctggttgtctgagc

SEQ ID NO: 84467 - DNA, 25 bp, Homo sapien
cagggaggctctggttgtctgagca

SEQ ID NO: 84468 - DNA, 25 bp, Homo sapien
agggaggctctggttgtctgagcac

SEQ ID NO: 84469 - DNA, 25 bp, Homo sapien
ggaggctctggttgtctgagcacca

SEQ ID NO: 84470 - DNA, 25 bp, Homo sapien
gaggctctggttgtctgagcaccat

SEQ ID NO: 84471 - DNA, 25 bp, Homo sapien
ggttgtctgagcaccatgggggccc

SEQ ID NO: 84472 - DNA, 25 bp, Homo sapien
gttgtctgagcaccatgggggcccc

SEQ ID NO: 84473 - DNA, 25 bp, Homo sapien
ttgtctgagcaccatgggggccccc

SEQ ID NO: 84474 - DNA, 25 bp, Homo sapien
gggtcctcgcttcatgctcacacag

SEQ ID NO: 84475 - DNA, 25 bp, Homo sapien
tcccgcgaagacctgtaatgtgccg

SEQ ID NO: 84476 - DNA, 25 bp, Homo sapien
tgtaatgtgccggacttacccttta

SEQ ID NO: 84477 - DNA, 25 bp, Homo sapien
atgtcccgtggaaaatgtggccctg

SEQ ID NO: 84478 - DNA, 25 bp, Homo sapien
aaatgtggccctgaggatgccgtct

SEQ ID NO: 84479 - DNA, 25 bp, Homo sapien
gatgccgtctcctgcagtggacagc

SEQ ID NO: 84480 - DNA, 25 bp, Homo sapien
ggctgcctgctctctaacggttgat

SEQ ID NO: 84481 - DNA, 25 bp, Homo sapien
taacggttgattctcatttgtccct

SEQ ID NO: 84482 - DNA, 25 bp, Homo sapien
ctcatttgtcccttaaacagctgca

SEQ ID NO: 84483 - DNA, 25 bp, Homo sapien
aacagctgcatttcttggttgttct

SEQ ID NO: 84484 - DNA, 25 bp, Homo sapien
aagatgcctgtgtgccgccggcaga

SEQ ID NO: 84485 - DNA, 25 bp, Homo sapien
ggagaaagcccgacacagctgccct

SEQ ID NO: 84486 - DNA, 25 bp, Homo sapien
ggacaatgccttgggagagattttg

SEQ ID NO: 84487 - DNA, 25 bp, Homo sapien
ccttgggagagattttgtcgggaca

SEQ ID NO: 84488 - DNA, 25 bp, Homo sapien
aggtttgaaagatacggttgtctag

SEQ ID NO: 84489 - DNA, 25 bp, Homo sapien
tacggttgtctagaggtgagaccaa

SEQ ID NO: 84490 - DNA, 25 bp, Homo sapien
ggtgagaccaaaggatccagagact

SEQ ID NO: 84491 - DNA, 25 bp, Homo sapien
acagtggatgacgtgaagccacagg

SEQ ID NO: 84492 - DNA, 25 bp, Homo sapien
acgcgctcaatcatgagtacctcaa

SEQ ID NO: 84493 - DNA, 25 bp, Homo sapien
gtacctcaaaggattgttgggcttg

SEQ ID NO: 84494 - DNA, 25 bp, Homo sapien
gattcctgggcaagaacctaaagta

SEQ ID NO: 84495 - DNA, 25 bp, Homo sapien
gaacctaaagtagcaggactcggaa

SEQ ID NO: 84496 - DNA, 25 bp, Homo sapien
ggactcggaattctcgggaaattat

SEQ ID NO: 84497 - DNA, 25 bp, Homo sapien
ggatccaaaggcacgttttacgaca

SEQ ID NO: 84498 - DNA, 25 bp, Homo sapien
gcacgttttacgacagaagaagcct

SEQ ID NO: 84499 - DNA, 25 bp, Homo sapien
cttaagacacccgtggcttcaggat

SEQ ID NO: 84500 - DNA, 25 bp, Homo sapien
tttcaagatcttctgtctgaggaaa

SEQ ID NO: 84501 - DNA, 25 bp, Homo sapien
atgaatccacagctctaccccaggt

SEQ ID NO: 84502 - DNA, 25 bp, Homo sapien
gcccagccttctactagtcgaaagc

SEQ ID NO: 84503 - DNA, 25 bp, Homo sapien
tactagtcgaaagcggccccgtgaa

SEQ ID NO: 84504 - DNA, 25 bp, Homo sapien
gaagccgagggtgccgagaccacaa

SEQ ID NO: 84505 - DNA, 25 bp, Homo sapien
cacaaagcgcccagctgtgtgtgct

SEQ ID NO: 84506 - DNA, 25 bp, Homo sapien
tgtgtgctgctgtgttgtgaactcc

SEQ ID NO: 84507 - DNA, 25 bp, Homo sapien
gttgtgaactccgtggtttgaacac

SEQ ID NO: 84508 - DNA, 25 bp, Homo sapien
catcatcctagtgggaactaaactt

SEQ ID NO: 84509 - DNA, 25 bp, Homo sapien
atccgcagggtctagccatggctaa

SEQ ID NO: 84510 - DNA, 25 bp, Homo sapien
atggctaaggagattggtgctgtaa

SEQ ID NO: 84511 - DNA, 25 bp, Homo sapien
tggtgctgtaaaatacctggagtgc

SEQ ID NO: 84512 - DNA, 25 bp, Homo sapien
atacctggagtgctcggcgctcaca

SEQ ID NO: 84513 - DNA, 25 bp, Homo sapien
agtgctcggcgctcacacagcgagg

SEQ ID NO: 84514 - DNA, 25 bp, Homo sapien
ttgacgaagcgatccgagcagtcct

SEQ ID NO: 84515 - DNA, 25 bp, Homo sapien
gcccgcctcccgtgaagaagaggaa

SEQ ID NO: 84516 - DNA, 25 bp, Homo sapien
aaatgcctgctgttgtaaatgtctc

SEQ ID NO: 84517 - DNA, 25 bp, Homo sapien
gttgtaaatgtctcagcccctcgtt

SEQ ID NO: 84518 - DNA, 25 bp, Homo sapien
tggtcctgtcccttggaacctttgt

SEQ ID NO: 84519 - DNA, 25 bp, Homo sapien
ggatcatcgcgcctgaaggctacgc

SEQ ID NO: 84520 - DNA, 25 bp, Homo sapien
gctacgccgcctactactgtgaggg

SEQ ID NO: 84521 - DNA, 25 bp, Homo sapien
ttccctctgaactcctacatgaacg

SEQ ID NO: 84522 - DNA, 25 bp, Homo sapien
tgaactcctacatgaacgccaccaa

SEQ ID NO: 84523 - DNA, 25 bp, Homo sapien
accacgccatcgtgcagacgctggt

SEQ ID NO: 84524 - DNA, 25 bp, Homo sapien
cgctggtgggtgtcacgccatcttg

SEQ ID NO: 84525 - DNA, 25 bp, Homo sapien
gggtgtggtcacctgggccgggcag

SEQ ID NO: 84526 - DNA, 25 bp, Homo sapien
tgagtagatgtcagcccattgccat

SEQ ID NO: 84527 - DNA, 25 bp, Homo sapien
atgtcagcccattgccatgtcatga

SEQ ID NO: 84528 - DNA, 25 bp, Homo sapien
agcccattgccatgtcatgactttt

SEQ ID NO: 84529 - DNA, 25 bp, Homo sapien
aattgtactttatgactggtttggt

SEQ ID NO: 84530 - DNA, 25 bp, Homo sapien
agtcttaattccacacaatgcatgc

SEQ ID NO: 84531 - DNA, 25 bp, Homo sapien
taattccacacaatgcatgcacatg

SEQ ID NO: 84532 - DNA, 25 bp, Homo sapien
gcatgcacatgcagtagcttctctg

SEQ ID NO: 84533 - DNA, 25 bp, Homo sapien
acatgcagtagcttctctgcttgag

SEQ ID NO: 84534 - DNA, 25 bp, Homo sapien
gtagcttctctgcttgagtgagctg

SEQ ID NO: 84535 - DNA, 25 bp, Homo sapien
gagctggtgtgattaggttttctaa

SEQ ID NO: 84536 - DNA, 25 bp, Homo sapien
gtgattaggttttctaaacatgcac

SEQ ID NO: 84537 - DNA, 25 bp, Homo sapien
aaacatgcacattggccttgctact

SEQ ID NO: 84538 - DNA, 25 bp, Homo sapien
attggccttgctacttgtcctttta

SEQ ID NO: 84539 - DNA, 25 bp, Homo sapien
ggccttgctacttgtccttttattc

SEQ ID NO: 84540 - DNA, 25 bp, Homo sapien
ttattcccttcccacagaccataaa

SEQ ID NO: 84541 - DNA, 25 bp, Homo sapien
gctacgccgcctactactgtgaggg

SEQ ID NO: 84542 - DNA, 25 bp, Homo sapien
ctacgccgcctactactgtgagggg

SEQ ID NO: 84543 - DNA, 25 bp, Homo sapien
tacgccgcctactactgtgaggggg

SEQ ID NO: 84544 - DNA, 25 bp, Homo sapien
acgccgcctactactgtgaggggga

SEQ ID NO: 84545 - DNA, 25 bp, Homo sapien
cgccgcctactactgtgagggggag

SEQ ID NO: 84546 - DNA, 25 bp, Homo sapien
ttccctctgaactcctacatgaacg

SEQ ID NO: 84547 - DNA, 25 bp, Homo sapien
tccctctgaactcctacatgaacgc

SEQ ID NO: 84548 - DNA, 25 bp, Homo sapien
tgaactcctacatgaacgccaccaa

SEQ ID NO: 84549 - DNA, 25 bp, Homo sapien
gaactcctacatgaacgccaccaac

SEQ ID NO: 84550 - DNA, 25 bp, Homo sapien
aactcctacatgaacgccaccaacc

SEQ ID NO: 84551 - DNA, 25 bp, Homo sapien
accacgccatcgtgcagacgctggt

SEQ ID NO: 84552 - DNA, 25 bp, Homo sapien
atattttccaatagtaccccttgtg

SEQ ID NO: 84553 - DNA, 25 bp, Homo sapien
aaacaagcccttcagtactggttag

SEQ ID NO: 84554 - DNA, 25 bp, Homo sapien
gcccttcagtactggttagcaggaa

SEQ ID NO: 84555 - DNA, 25 bp, Homo sapien
gaaatgtcctacaaaagacgagtct

SEQ ID NO: 84556 - DNA, 25 bp, Homo sapien
agacgagtctgtcaacctagtgcct

SEQ ID NO: 84557 - DNA, 25 bp, Homo sapien
gagtctgtcaacctagtgcctgtgt

SEQ ID NO: 84558 - DNA, 25 bp, Homo sapien
ctgtgttctgtacagggcttattta

SEQ ID NO: 84559 - DNA, 25 bp, Homo sapien
ggagaccttaagaattttgacacag

SEQ ID NO: 84560 - DNA, 25 bp, Homo sapien
gaacactttcggaaattgctaagca

SEQ ID NO: 84561 - DNA, 25 bp, Homo sapien
attgctaagcatgttcaggtttact

SEQ ID NO: 84562 - DNA, 25 bp, Homo sapien
gacatcagatgtcttgagaaagcta

SEQ ID NO: 84563 - DNA, 25 bp, Homo sapien
gtctcacaggcaaagcacggcacag

SEQ ID NO: 84564 - DNA, 25 bp, Homo sapien
cacaggcaaagcacggcacagcggg

SEQ ID NO: 84565 - DNA, 25 bp, Homo sapien
gaccgagaacgaagcggtgccccag

SEQ ID NO: 84566 - DNA, 25 bp, Homo sapien
agcggtgccccagtctaggctgcgg

SEQ ID NO: 84567 - DNA, 25 bp, Homo sapien
acctgtccttgctcagcttggctgt

SEQ ID NO: 84568 - DNA, 25 bp, Homo sapien
tgtagcccagcctgcacctaggtgt

SEQ ID NO: 84569 - DNA, 25 bp, Homo sapien
acctaggtgtgcctaccgcatgttg

SEQ ID NO: 84570 - DNA, 25 bp, Homo sapien
gcatgttgccgctgctgtttctgct

SEQ ID NO: 84571 - DNA, 25 bp, Homo sapien
gctgtttctgctgggacgtctgact

SEQ ID NO: 84572 - DNA, 25 bp, Homo sapien
gggacgtctgactccagttccttct

SEQ ID NO: 84573 - DNA, 25 bp, Homo sapien
gtgacaaggtcatttacaacttaca

SEQ ID NO: 84574 - DNA, 25 bp, Homo sapien
gttgaatctcatttgccatctttag

SEQ ID NO: 84575 - DNA, 25 bp, Homo sapien
gttttcttatggaggtttatactct

SEQ ID NO: 84576 - DNA, 25 bp, Homo sapien
aacagttctgatgtaatttctcaac

SEQ ID NO: 84577 - DNA, 25 bp, Homo sapien
gtggcttttagcctgtcagtgatct

SEQ ID NO: 84578 - DNA, 25 bp, Homo sapien
gcctgtcagtgatctattggaccaa

SEQ ID NO: 84579 - DNA, 25 bp, Homo sapien
tattggaccaaaccttctgcacact

SEQ ID NO: 84580 - DNA, 25 bp, Homo sapien
aaaccttctgcacactcggccagtt

SEQ ID NO: 84581 - DNA, 25 bp, Homo sapien
aatgtccggtgccatctttcctgac

SEQ ID NO: 84582 - DNA, 25 bp, Homo sapien
tttcctgacctttgtttctttctgt

SEQ ID NO: 84583 - DNA, 25 bp, Homo sapien
tttctgttcaggaaccatcagtccc

SEQ ID NO: 84584 - DNA, 25 bp, Homo sapien
catcagtccccttgtaataaaggtg

SEQ ID NO: 84585 - DNA, 25 bp, Homo sapien
caaaggttattcatatgttagcata

SEQ ID NO: 84586 - DNA, 25 bp, Homo sapien
tttctttgcacccactatttatgtc

SEQ ID NO: 84587 - DNA, 25 bp, Homo sapien
gcacccactatttatgtctgaatca

SEQ ID NO: 84588 - DNA, 25 bp, Homo sapien
atgtctgaatcatttgtcacaagag

SEQ ID NO: 84589 - DNA, 25 bp, Homo sapien
tcatttgtcacaagagagtgtgtgc

SEQ ID NO: 84590 - DNA, 25 bp, Homo sapien
gtatgcatttcattgctgtctacag

SEQ ID NO: 84591 - DNA, 25 bp, Homo sapien
gctgtctacaggtttctttcagatt

SEQ ID NO: 84592 - DNA, 25 bp, Homo sapien
gattatgttcatgggtttgtgtgta

SEQ ID NO: 84593 - DNA, 25 bp, Homo sapien
aagtaattgtgctgtatttatgttt

SEQ ID NO: 84594 - DNA, 25 bp, Homo sapien
atttatgtttattcaccagtctttg

SEQ ID NO: 84595 - DNA, 25 bp, Homo sapien
gtttattcaccagtctttgattaaa

SEQ ID NO: 84596 - DNA, 25 bp, Homo sapien
gaaagactcttaatgcagactcttc

SEQ ID NO: 84597 - DNA, 25 bp, Homo sapien
aagactcttaatgcagactcttctt

SEQ ID NO: 84598 - DNA, 25 bp, Homo sapien
tgcagactcttcttaagtgttaata

SEQ ID NO: 84599 - DNA, 25 bp, Homo sapien
gcagactcttcttaagtgttaatag

SEQ ID NO: 84600 - DNA, 25 bp, Homo sapien
cagactcttcttaagtgttaatagg

SEQ ID NO: 84601 - DNA, 25 bp, Homo sapien
gactcttcttaagtgttaataggga

SEQ ID NO: 84602 - DNA, 25 bp, Homo sapien
ttcccaaacctaattcttgtagatg

SEQ ID NO: 84603 - DNA, 25 bp, Homo sapien
aattcttgtagatgcattagtgttg

SEQ ID NO: 84604 - DNA, 25 bp, Homo sapien
cttgtagatgcattagtgttgaacc

SEQ ID NO: 84605 - DNA, 25 bp, Homo sapien
ttgtagatgcattagtgttgaacca

SEQ ID NO: 84606 - DNA, 25 bp, Homo sapien
atgcattagtgttgaaccaatgctt

SEQ ID NO: 84607 - DNA, 25 bp, Homo sapien
acaaaggaggccgtgaggtcctggc

SEQ ID NO: 84608 - DNA, 25 bp, Homo sapien
cacctggccagggtcaaggtcattt

SEQ ID NO: 84609 - DNA, 25 bp, Homo sapien
ggccagggtcaaggtcatttgccac

SEQ ID NO: 84610 - DNA, 25 bp, Homo sapien
agggtcaaggtcatttgccaccctt

SEQ ID NO: 84611 - DNA, 25 bp, Homo sapien
tcaaggtcatttgccacccttggct

SEQ ID NO: 84612 - DNA, 25 bp, Homo sapien
ggtcatttgccacccttggcttcag

SEQ ID NO: 84613 - DNA, 25 bp, Homo sapien
gcttcagggagggaaactgtgtctc

SEQ ID NO: 84614 - DNA, 25 bp, Homo sapien
gagggaaactgtgtctcccacagcc

SEQ ID NO: 84615 - DNA, 25 bp, Homo sapien
acagccccagtgacttcaagcgggc

SEQ ID NO: 84616 - DNA, 25 bp, Homo sapien
cagtgacttcaagcgggcctgggct

SEQ ID NO: 84617 - DNA, 25 bp, Homo sapien
ttcaagcgggcctgggctccaggaa

SEQ ID NO: 84618 - DNA, 25 bp, Homo sapien
aagaggagtgagctttgtaaatacc

SEQ ID NO: 84619 - DNA, 25 bp, Homo sapien
gtaaataccacgttagctggcctgc

SEQ ID NO: 84620 - DNA, 25 bp, Homo sapien
gttagctggcctgctgtggaacaga

SEQ ID NO: 84621 - DNA, 25 bp, Homo sapien
gcctgctgtggaacagaatgcctat

SEQ ID NO: 84622 - DNA, 25 bp, Homo sapien
gatgaacactgatctgagagcctgt

SEQ ID NO: 84623 - DNA, 25 bp, Homo sapien
gtcatctagacctttgatacgcaaa

SEQ ID NO: 84624 - DNA, 25 bp, Homo sapien
gatacgcaaagtgtgattcctggac

SEQ ID NO: 84625 - DNA, 25 bp, Homo sapien
attcctggacagatgtattggcttt

SEQ ID NO: 84626 - DNA, 25 bp, Homo sapien
atgtattggctttacctggcagctt

SEQ ID NO: 84627 - DNA, 25 bp, Homo sapien
tttacctggcagcttgttggaaatg

SEQ ID NO: 84628 - DNA, 25 bp, Homo sapien
ttggaaatgtaaaacctcaggcctc

SEQ ID NO: 84629 - DNA, 25 bp, Homo sapien
ggatccaaagagactcccactcaga

SEQ ID NO: 84630 - DNA, 25 bp, Homo sapien
tccaaagagactcccactcagattc

SEQ ID NO: 84631 - DNA, 25 bp, Homo sapien
gaattctattaaagaatagccccag

SEQ ID NO: 84632 - DNA, 25 bp, Homo sapien
atagccccagatataaattctcttg

SEQ ID NO: 84633 - DNA, 25 bp, Homo sapien
gccccagatataaattctcttgaaa

SEQ ID NO: 84634 - DNA, 25 bp, Homo sapien
tctcttgaaagcaatgttcataaat

SEQ ID NO: 84635 - DNA, 25 bp, Homo sapien
ttttctattaaatgccctgagtgat

SEQ ID NO: 84636 - DNA, 25 bp, Homo sapien
ttaaatgccctgagtgataaaacca

SEQ ID NO: 84637 - DNA, 25 bp, Homo sapien
atgccctgagtgataaaaccagttg

SEQ ID NO: 84638 - DNA, 25 bp, Homo sapien
gagtgataaaaccagttggcaataa

SEQ ID NO: 84639 - DNA, 25 bp, Homo sapien
cactctgattgaatctggggttcca

SEQ ID NO: 84640 - DNA, 25 bp, Homo sapien
tgtgcctgagccttgtatcttttat

SEQ ID NO: 84641 - DNA, 25 bp, Homo sapien
tgaggaaatgaatgctctttcaggc

SEQ ID NO: 84642 - DNA, 25 bp, Homo sapien
tctgcacctcctatggcaagcgatg

SEQ ID NO: 84643 - DNA, 25 bp, Homo sapien
tatggcaagcgatgctgttcctggc

SEQ ID NO: 84644 - DNA, 25 bp, Homo sapien
agcgatgctgttcctggccaagaag

SEQ ID NO: 84645 - DNA, 25 bp, Homo sapien
aacccacggaggtagaagatggcac

SEQ ID NO: 84646 - DNA, 25 bp, Homo sapien
tgcagacagggatgaaaaggacttc

SEQ ID NO: 84647 - DNA, 25 bp, Homo sapien
ggacttcaggaatcctggccaggaa

SEQ ID NO: 84648 - DNA, 25 bp, Homo sapien
ggaaactagacctgccagtgctgtt

SEQ ID NO: 84649 - DNA, 25 bp, Homo sapien
agtgctgttcccaaacagacttggt

SEQ ID NO: 84650 - DNA, 25 bp, Homo sapien
caaacagacttggttttgagttcaa

SEQ ID NO: 84651 - DNA, 25 bp, Homo sapien
gggcagtctgcatctatttcaggtt

SEQ ID NO: 84652 - DNA, 25 bp, Homo sapien
tatttcaggttgtggctcttggttc

SEQ ID NO: 84653 - DNA, 25 bp, Homo sapien
ttggttctaggactcttacttctct

SEQ ID NO: 84654 - DNA, 25 bp, Homo sapien
ttacttctctggctaagggctcagc

SEQ ID NO: 84655 - DNA, 25 bp, Homo sapien
agggctcagcttcttgggacttcaa

SEQ ID NO: 84656 - DNA, 25 bp, Homo sapien
tgggacttcaaccatcttctttctg

SEQ ID NO: 84657 - DNA, 25 bp, Homo sapien
taacgtgaggactgccaagtatggc

SEQ ID NO: 84658 - DNA, 25 bp, Homo sapien
atggctttgtccctatgactcagag

SEQ ID NO: 84659 - DNA, 25 bp, Homo sapien
tttgtcgggcaaattcaggtggatg

SEQ ID NO: 84660 - DNA, 25 bp, Homo sapien
tgtgcgtggactgggatatcatctc

SEQ ID NO: 84661 - DNA, 25 bp, Homo sapien
gatatcatctctacagcctgcaaat

SEQ ID NO: 84662 - DNA, 25 bp, Homo sapien
aaagggaacccagctctaatacatt

SEQ ID NO: 84663 - DNA, 25 bp, Homo sapien
ccagctctaatacattccaactcgt

SEQ ID NO: 84664 - DNA, 25 bp, Homo sapien
ttccaactcgtatagcatgcatctg

SEQ ID NO: 84665 - DNA, 25 bp, Homo sapien
gcatgcatctgtttattctatagtt

SEQ ID NO: 84666 - DNA, 25 bp, Homo sapien
ctggaaaataatactgctgagatac

SEQ ID NO: 84667 - DNA, 25 bp, Homo sapien
tactgtaactgattacacttggtaa

SEQ ID NO: 84668 - DNA, 25 bp, Homo sapien
ggtaattgtactaaagccaaacata

SEQ ID NO: 84669 - DNA, 25 bp, Homo sapien
ggtgcattacgtgggcattgtcttt

SEQ ID NO: 84670 - DNA, 25 bp, Homo sapien
ttacgtgggcattgtctttttagat

SEQ ID NO: 84671 - DNA, 25 bp, Homo sapien
ttgtctttttagatgcccaaatcct

SEQ ID NO: 84672 - DNA, 25 bp, Homo sapien
tttagatgcccaaatccttagatct

SEQ ID NO: 84673 - DNA, 25 bp, Homo sapien
tcagctctgtgtaaagattctctag

SEQ ID NO: 84674 - DNA, 25 bp, Homo sapien
agctctgtgtaaagattctctagcg

SEQ ID NO: 84675 - DNA, 25 bp, Homo sapien
ctctgtgtaaagattctctagcggg

SEQ ID NO: 84676 - DNA, 25 bp, Homo sapien
tctgtgtaaagattctctagcgggc

SEQ ID NO: 84677 - DNA, 25 bp, Homo sapien
ctgtgtaaagattctctagcgggct

SEQ ID NO: 84678 - DNA, 25 bp, Homo sapien
gtgtaaagattctctagcgggctgc

SEQ ID NO: 84679 - DNA, 25 bp, Homo sapien
tgtaaagattctctagcgggctgcg

SEQ ID NO: 84680 - DNA, 25 bp, Homo sapien
gtaaagattctctagcgggctgcgc

SEQ ID NO: 84681 - DNA, 25 bp, Homo sapien
taaagattctctagcgggctgcgct

SEQ ID NO: 84682 - DNA, 25 bp, Homo sapien
aaagattctctagcgggctgcgctc

SEQ ID NO: 84683 - DNA, 25 bp, Homo sapien
tctctagcgggctgcgctcccaagt

SEQ ID NO: 84684 - DNA, 25 bp, Homo sapien
tcagtcaatcttcacaaggcacaag

SEQ ID NO: 84685 - DNA, 25 bp, Homo sapien
cacaaggcacaagagagttcatacg

SEQ ID NO: 84686 - DNA, 25 bp, Homo sapien
tttcggcacgaggtcatctctttct

SEQ ID NO: 84687 - DNA, 25 bp, Homo sapien
tcatctctttcttcgcactatagca

SEQ ID NO: 84688 - DNA, 25 bp, Homo sapien
ttcgcactatagcattcatacaggg

SEQ ID NO: 84689 - DNA, 25 bp, Homo sapien
gggagtacccttacgaatgccacga

SEQ ID NO: 84690 - DNA, 25 bp, Homo sapien
tacccttacgaatgccacgattgtg

SEQ ID NO: 84691 - DNA, 25 bp, Homo sapien
ggaggtcgaatctgacacagcacat

SEQ ID NO: 84692 - DNA, 25 bp, Homo sapien
gacacagcacataagaactcatact

SEQ ID NO: 84693 - DNA, 25 bp, Homo sapien
tgggaaatcctttaccaatagcttt

SEQ ID NO: 84694 - DNA, 25 bp, Homo sapien
tagcttttctcttacaattcacagg

SEQ ID NO: 84695 - DNA, 25 bp, Homo sapien
tgctcacagtggtcagggcccctca

SEQ ID NO: 84696 - DNA, 25 bp, Homo sapien
tcacagtggtcagggcccctcaggg

SEQ ID NO: 84697 - DNA, 25 bp, Homo sapien
gctctggaaggactgttcagcccta

SEQ ID NO: 84698 - DNA, 25 bp, Homo sapien
tctggaaggactgttcagccctatg

SEQ ID NO: 84699 - DNA, 25 bp, Homo sapien
tggaaggactgttcagccctatgcc

SEQ ID NO: 84700 - DNA, 25 bp, Homo sapien
aaggactgttcagccctatgcctaa

SEQ ID NO: 84701 - DNA, 25 bp, Homo sapien
gactgttcagccctatgcctaagac

SEQ ID NO: 84702 - DNA, 25 bp, Homo sapien
ctatgcctaagacccctatgctggg

SEQ ID NO: 84703 - DNA, 25 bp, Homo sapien
tatgctggggacactacaggcacac

SEQ ID NO: 84704 - DNA, 25 bp, Homo sapien
cactacaggcacacagaggaatagc

SEQ ID NO: 84705 - DNA, 25 bp, Homo sapien
caggcacacagaggaatagcagggc

SEQ ID NO: 84706 - DNA, 25 bp, Homo sapien
gcgcctacagcaaccacggcaagta

SEQ ID NO: 84707 - DNA, 25 bp, Homo sapien
ctacagcaaccacggcaagtacatc

SEQ ID NO: 84708 - DNA, 25 bp, Homo sapien
gcaaccacggcaagtacatcacctt

SEQ ID NO: 84709 - DNA, 25 bp, Homo sapien
acggcaagtacatcaccttctccgg

SEQ ID NO: 84710 - DNA, 25 bp, Homo sapien
gcaagtacatcaccttctccggctt

SEQ ID NO: 84711 - DNA, 25 bp, Homo sapien
ggcctcggagctactgtgagccccg

SEQ ID NO: 84712 - DNA, 25 bp, Homo sapien
ccgaggctcgaaagtcccgcgcgag

SEQ ID NO: 84713 - DNA, 25 bp, Homo sapien
gggcgcgcctggactctgccaataa

SEQ ID NO: 84714 - DNA, 25 bp, Homo sapien
gcgcctggactctgccaataaagcg

SEQ ID NO: 84715 - DNA, 25 bp, Homo sapien
tggactctgccaataaagcggaaag

SEQ ID NO: 84716 - DNA, 25 bp, Homo sapien
ataaagcggaaagcgggcacgcgca

SEQ ID NO: 84717 - DNA, 25 bp, Homo sapien
atagctgaaatttcgttctgtaggc

SEQ ID NO: 84718 - DNA, 25 bp, Homo sapien
gctgaaatttcgttctgtaggcgga

SEQ ID NO: 84719 - DNA, 25 bp, Homo sapien
ctgaaatttcgttctgtaggcggag

SEQ ID NO: 84720 - DNA, 25 bp, Homo sapien
tgggatatggcatgtaccacctgtc

SEQ ID NO: 84721 - DNA, 25 bp, Homo sapien
ggatatggcatgtaccacctgtcct

SEQ ID NO: 84722 - DNA, 25 bp, Homo sapien
gtaccacctgtcctaaggaagacca

SEQ ID NO: 84723 - DNA, 25 bp, Homo sapien
ccacctgtcctaaggaagaccagat

SEQ ID NO: 84724 - DNA, 25 bp, Homo sapien
gaagaccagatcaatagactccatg

SEQ ID NO: 84725 - DNA, 25 bp, Homo sapien
gaccagatcaatagactccatgatg

SEQ ID NO: 84726 - DNA, 25 bp, Homo sapien
cagatcaatagactccatgatggat

SEQ ID NO: 84727 - DNA, 25 bp, Homo sapien
tagactccatgatggatgcttgttt

SEQ ID NO: 84728 - DNA, 25 bp, Homo sapien
gggacttggaccttcctgggctagt

SEQ ID NO: 84729 - DNA, 25 bp, Homo sapien
ttggaccttcctgggctagtgcaaa

SEQ ID NO: 84730 - DNA, 25 bp, Homo sapien
tcctgggctagtgcaaatagcggca

SEQ ID NO: 84731 - DNA, 25 bp, Homo sapien
ggtagaggtcgtcatgtacgctcct

SEQ ID NO: 84732 - DNA, 25 bp, Homo sapien
gtcatgtacgctcctttacacgata

SEQ ID NO: 84733 - DNA, 25 bp, Homo sapien
gtacgctcctttacacgataaaaat

SEQ ID NO: 84734 - DNA, 25 bp, Homo sapien
gtatatgaacatttcacgaggacaa

SEQ ID NO: 84735 - DNA, 25 bp, Homo sapien
gaaggaccaatttagacttagcagt

SEQ ID NO: 84736 - DNA, 25 bp, Homo sapien
gacttagcagttatctggagacatc

SEQ ID NO: 84737 - DNA, 25 bp, Homo sapien
gttatctggagacatctgagagaat

SEQ ID NO: 84738 - DNA, 25 bp, Homo sapien
gaaagcagaatttgtttgataccta

SEQ ID NO: 84739 - DNA, 25 bp, Homo sapien
gacctggttccagccgtttgcaggg

SEQ ID NO: 84740 - DNA, 25 bp, Homo sapien
ggcggctccgagaggcgtgtgcttt

SEQ ID NO: 84741 - DNA, 25 bp, Homo sapien
gcggctccgagaggcgtgtgctttc

SEQ ID NO: 84742 - DNA, 25 bp, Homo sapien
cggctccgagaggcgtgtgctttcc

SEQ ID NO: 84743 - DNA, 25 bp, Homo sapien
gctccgagaggcgtgtgctttccgt

SEQ ID NO: 84744 - DNA, 25 bp, Homo sapien
ctccgagaggcgtgtgctttccgtg

SEQ ID NO: 84745 - DNA, 25 bp, Homo sapien
gactggacctgggtctgcctgacct

SEQ ID NO: 84746 - DNA, 25 bp, Homo sapien
actggacctgggtctgcctgacctc

SEQ ID NO: 84747 - DNA, 25 bp, Homo sapien
ctggacctgggtctgcctgacctca

SEQ ID NO: 84748 - DNA, 25 bp, Homo sapien
tggacctgggtctgcctgacctcag

SEQ ID NO: 84749 - DNA, 25 bp, Homo sapien
ggacctgggtctgcctgacctcaga

SEQ ID NO: 84750 - DNA, 25 bp, Homo sapien
acatgttcttagtctggtcccagac

SEQ ID NO: 84751 - DNA, 25 bp, Homo sapien
ttagtctggtcccagaccaaggagc

SEQ ID NO: 84752 - DNA, 25 bp, Homo sapien
aaggagctggtcagacggccctttc

SEQ ID NO: 84753 - DNA, 25 bp, Homo sapien
ggccctttctaatcctacatgttga

SEQ ID NO: 84754 - DNA, 25 bp, Homo sapien
ttctaatcctacatgttgagcttat

SEQ ID NO: 84755 - DNA, 25 bp, Homo sapien
tcttacccacaaaccattactactt

SEQ ID NO: 84756 - DNA, 25 bp, Homo sapien
aactcgccaagtgtaaaggctaaag

SEQ ID NO: 84757 - DNA, 25 bp, Homo sapien
gaagcagtttgacggaccttgtgat

SEQ ID NO: 84758 - DNA, 25 bp, Homo sapien
ggaccttgtgatttgtactgtttgc

SEQ ID NO: 84759 - DNA, 25 bp, Homo sapien
atttgtactgtttgctgcggagcta

SEQ ID NO: 84760 - DNA, 25 bp, Homo sapien
ttgctgcggagctatttaaagattt

SEQ ID NO: 84761 - DNA, 25 bp, Homo sapien
agcaccagtggcagtttaacctgct

SEQ ID NO: 84762 - DNA, 25 bp, Homo sapien
tttaacctgctgacccatgtggaat

SEQ ID NO: 84763 - DNA, 25 bp, Homo sapien
tgctgacccatgtggaatctcttca

SEQ ID NO: 84764 - DNA, 25 bp, Homo sapien
ttcaggatgaagttacgcacaggat

SEQ ID NO: 84765 - DNA, 25 bp, Homo sapien
gttacgcacaggatggactccattg

SEQ ID NO: 84766 - DNA, 25 bp, Homo sapien
cttccgcagctcaagcattgtatca

SEQ ID NO: 84767 - DNA, 25 bp, Homo sapien
gctcaagcattgtatcaagcagctg

SEQ ID NO: 84768 - DNA, 25 bp, Homo sapien
aagcagctgctgatggacctgggca

SEQ ID NO: 84769 - DNA, 25 bp, Homo sapien
ggcaaggtgcagcagatcgccctct

SEQ ID NO: 84770 - DNA, 25 bp, Homo sapien
tctgctgctcaacatgaaactgggc

SEQ ID NO: 84771 - DNA, 25 bp, Homo sapien
aaactgggcacccaaaactcatggg

SEQ ID NO: 84772 - DNA, 25 bp, Homo sapien
ctgtgtcctctttaatgcctaaagc

SEQ ID NO: 84773 - DNA, 25 bp, Homo sapien
ctctttaatgcctaaagctgtgcct

SEQ ID NO: 84774 - DNA, 25 bp, Homo sapien
aagctgtgcctagaaatttcatctg

SEQ ID NO: 84775 - DNA, 25 bp, Homo sapien
gtgcctagaaatttcatctgtctta

SEQ ID NO: 84776 - DNA, 25 bp, Homo sapien
aaatatacttcatgctgtttatgct

SEQ ID NO: 84777 - DNA, 25 bp, Homo sapien
gctgtttatgctattagtttctgta

SEQ ID NO: 84778 - DNA, 25 bp, Homo sapien
gtttctgtactgctattctatattt

SEQ ID NO: 84779 - DNA, 25 bp, Homo sapien
acatgaattcatggtatcctggtta

SEQ ID NO: 84780 - DNA, 25 bp, Homo sapien
gaattcatggtatcctggttatttt

SEQ ID NO: 84781 - DNA, 25 bp, Homo sapien
tgcagtttcacaatcagttcttcat

SEQ ID NO: 84782 - DNA, 25 bp, Homo sapien
gtttcacaatcagttcttcatttca

SEQ ID NO: 84783 - DNA, 25 bp, Homo sapien
aaatgcaaacctttcaattcccacg

SEQ ID NO: 84784 - DNA, 25 bp, Homo sapien
cctttcaattcccacgtgtatacaa

SEQ ID NO: 84785 - DNA, 25 bp, Homo sapien
ttcccacgtgtatacaagctaatgt

SEQ ID NO: 84786 - DNA, 25 bp, Homo sapien
aatccaacgggtgcattttcattca

SEQ ID NO: 84787 - DNA, 25 bp, Homo sapien
aacgggtgcattttcattcatatga

SEQ ID NO: 84788 - DNA, 25 bp, Homo sapien
gaaagacttctcatagtactttttt

SEQ ID NO: 84789 - DNA, 25 bp, Homo sapien
tgttacatgtgatgggcattgagcc

SEQ ID NO: 84790 - DNA, 25 bp, Homo sapien
tgatgggcattgagccacacctctt

SEQ ID NO: 84791 - DNA, 25 bp, Homo sapien
gccacacctcttcttagactgaata

SEQ ID NO: 84792 - DNA, 25 bp, Homo sapien
tgttgagtggcaaaaagtccgtcag

SEQ ID NO: 84793 - DNA, 25 bp, Homo sapien
agtccgtcagacatcatagcaagaa

SEQ ID NO: 84794 - DNA, 25 bp, Homo sapien
cttcaaggaccccagcgactacgtg

SEQ ID NO: 84795 - DNA, 25 bp, Homo sapien
ttcaaggaccccagcgactacgtgc

SEQ ID NO: 84796 - DNA, 25 bp, Homo sapien
tacgtgcgcgccatgcgtgagatga

SEQ ID NO: 84797 - DNA, 25 bp, Homo sapien
aatgggaagtatgtgggctcgcgcc

SEQ ID NO: 84798 - DNA, 25 bp, Homo sapien
aagtatgtgggctcgcgccccatca

SEQ ID NO: 84799 - DNA, 25 bp, Homo sapien
agtatgtgggctcgcgccccatcaa

SEQ ID NO: 84800 - DNA, 25 bp, Homo sapien
gccccatcaagcttcgcaagagcat

SEQ ID NO: 84801 - DNA, 25 bp, Homo sapien
cccatcaagcttcgcaagagcatgt

SEQ ID NO: 84802 - DNA, 25 bp, Homo sapien
catcaagcttcgcaagagcatgtgg

SEQ ID NO: 84803 - DNA, 25 bp, Homo sapien
caagcttcgcaagagcatgtggaag

SEQ ID NO: 84804 - DNA, 25 bp, Homo sapien
ggctcctccctcagttctctttgga

SEQ ID NO: 84805 - DNA, 25 bp, Homo sapien
gatggtgctcaggaatctaactctc

SEQ ID NO: 84806 - DNA, 25 bp, Homo sapien
atcctctttaactgcttctaaaata

SEQ ID NO: 84807 - DNA, 25 bp, Homo sapien
ctttaactgcttctaaaatatctct

SEQ ID NO: 84808 - DNA, 25 bp, Homo sapien
taaaatatctctgttggcctttctt

SEQ ID NO: 84809 - DNA, 25 bp, Homo sapien
gttggcctttcttagcctttttctg

SEQ ID NO: 84810 - DNA, 25 bp, Homo sapien
tttcttagcctttttctgtttccat

SEQ ID NO: 84811 - DNA, 25 bp, Homo sapien
tccattcagtgctccaagcgctttt

SEQ ID NO: 84812 - DNA, 25 bp, Homo sapien
gtgctccaagcgctttttgtttcta

SEQ ID NO: 84813 - DNA, 25 bp, Homo sapien
tgctccaagcgctttttgtttctaa

SEQ ID NO: 84814 - DNA, 25 bp, Homo sapien
gctccaagcgctttttgtttctaag

SEQ ID NO: 84815 - DNA, 25 bp, Homo sapien
tttgtttctaagttgagtgcttggg

SEQ ID NO: 84816 - DNA, 25 bp, Homo sapien
aggacccagttttggctgctggttc

SEQ ID NO: 84817 - DNA, 25 bp, Homo sapien
gggatatacagtggctgcaccaaat

SEQ ID NO: 84818 - DNA, 25 bp, Homo sapien
acagtggctgcaccaaattggaggt

SEQ ID NO: 84819 - DNA, 25 bp, Homo sapien
caaattggaggtgtgggttcctcca

SEQ ID NO: 84820 - DNA, 25 bp, Homo sapien
gggttcctccaacacaatttgcttc

SEQ ID NO: 84821 - DNA, 25 bp, Homo sapien
gttcctccaacacaatttgcttctg

SEQ ID NO: 84822 - DNA, 25 bp, Homo sapien
aacacaatttgcttctgcccgttgt

SEQ ID NO: 84823 - DNA, 25 bp, Homo sapien
acaatttgcttctgcccgttgtctt

SEQ ID NO: 84824 - DNA, 25 bp, Homo sapien
aggatttctccgtgtgggggctaca

SEQ ID NO: 84825 - DNA, 25 bp, Homo sapien
tccctgactttagaggctggtgctg

SEQ ID NO: 84826 - DNA, 25 bp, Homo sapien
gaggctggtgctgtgtcgggaggaa

SEQ ID NO: 84827 - DNA, 25 bp, Homo sapien
tgggtgccttgggagaaccagtcct

SEQ ID NO: 84828 - DNA, 25 bp, Homo sapien
tgccttgggagaaccagtccttcct

SEQ ID NO: 84829 - DNA, 25 bp, Homo sapien
ccttttgacccaccccaggaagatg

SEQ ID NO: 84830 - DNA, 25 bp, Homo sapien
atggagtgctcttttctaggcccat

SEQ ID NO: 84831 - DNA, 25 bp, Homo sapien
gagtgctcttttctaggcccatgtt

SEQ ID NO: 84832 - DNA, 25 bp, Homo sapien
tgctcttttctaggcccatgttctg

SEQ ID NO: 84833 - DNA, 25 bp, Homo sapien
atgttctgccagcaaccgggatgcg

SEQ ID NO: 84834 - DNA, 25 bp, Homo sapien
cagcaaccgggatgcgtgggcaact

SEQ ID NO: 84835 - DNA, 25 bp, Homo sapien
aactggactctgcacgggggtctac

SEQ ID NO: 84836 - DNA, 25 bp, Homo sapien
acaggttgagggaggttggtcacaa

SEQ ID NO: 84837 - DNA, 25 bp, Homo sapien
gtggccatgggcagacagccgaaag

SEQ ID NO: 84838 - DNA, 25 bp, Homo sapien
gtggcctagagccttcagtcactgg

SEQ ID NO: 84839 - DNA, 25 bp, Homo sapien
aaagcagggaagcagtgtgaactct

SEQ ID NO: 84840 - DNA, 25 bp, Homo sapien
gcagggaagcagtgtgaactcttta

SEQ ID NO: 84841 - DNA, 25 bp, Homo sapien
gggaagcagtgtgaactctttattc

SEQ ID NO: 84842 - DNA, 25 bp, Homo sapien
gcagtgtgaactctttattcactcc

SEQ ID NO: 84843 - DNA, 25 bp, Homo sapien
tgtcctgtggcctgtcccactgtgt

SEQ ID NO: 84844 - DNA, 25 bp, Homo sapien
tgtggcctgtcccactgtgtgcact

SEQ ID NO: 84845 - DNA, 25 bp, Homo sapien
ggcctgtcccactgtgtgcacttgc

SEQ ID NO: 84846 - DNA, 25 bp, Homo sapien
cacttgctgttttccctgtccacat

SEQ ID NO: 84847 - DNA, 25 bp, Homo sapien
tgctgttttccctgtccacatccat

SEQ ID NO: 84848 - DNA, 25 bp, Homo sapien
tttccctgtccacatccatgctgta

SEQ ID NO: 84849 - DNA, 25 bp, Homo sapien
actggccttacatgtccatccagtg

SEQ ID NO: 84850 - DNA, 25 bp, Homo sapien
tacatgtccatccagtgctcctaga

SEQ ID NO: 84851 - DNA, 25 bp, Homo sapien
agtgctcctagaccttgggcgcttc

SEQ ID NO: 84852 - DNA, 25 bp, Homo sapien
tagagactcagaggacccacctggg

SEQ ID NO: 84853 - DNA, 25 bp, Homo sapien
gacaccgggaagtgcagcgggccag

SEQ ID NO: 84854 - DNA, 25 bp, Homo sapien
ccacccagcagaaatacaatccgag

SEQ ID NO: 84855 - DNA, 25 bp, Homo sapien
acaatccgagctacaaagcatggga

SEQ ID NO: 84856 - DNA, 25 bp, Homo sapien
gactcttttaggatcagatctgtga

SEQ ID NO: 84857 - DNA, 25 bp, Homo sapien
atcagatctgtgagcacgttggcga

SEQ ID NO: 84858 - DNA, 25 bp, Homo sapien
atctgtgagcacgttggcgaggaaa

SEQ ID NO: 84859 - DNA, 25 bp, Homo sapien
gagcacgttggcgaggaaaaacaaa

SEQ ID NO: 84860 - DNA, 25 bp, Homo sapien
tgctcttgcctgaaccagttattgg

SEQ ID NO: 84861 - DNA, 25 bp, Homo sapien
cagttattggctgtggtttcgaaat

SEQ ID NO: 84862 - DNA, 25 bp, Homo sapien
ctgtggtttcgaaatggctgatcat

SEQ ID NO: 84863 - DNA, 25 bp, Homo sapien
ggaagagtctgatccgacacttgga

SEQ ID NO: 84864 - DNA, 25 bp, Homo sapien
tgcaggtggtcttttggtgccttaa

SEQ ID NO: 84865 - DNA, 25 bp, Homo sapien
gaagcagccttcagcgtgggagcca

SEQ ID NO: 84866 - DNA, 25 bp, Homo sapien
ggagccactggcgtcataacggatt

SEQ ID NO: 84867 - DNA, 25 bp, Homo sapien
ataacggattatcccacagccctgc

SEQ ID NO: 84868 - DNA, 25 bp, Homo sapien
tgcggcactacctggacaaccatgg

SEQ ID NO: 84869 - DNA, 25 bp, Homo sapien
gacaaccatggaccagctgcccgga

SEQ ID NO: 84870 - DNA, 25 bp, Homo sapien
tgcccggacctcctaagtccagaag

SEQ ID NO: 84871 - DNA, 25 bp, Homo sapien
acaagattcaagttactcgtaagca

SEQ ID NO: 84872 - DNA, 25 bp, Homo sapien
cttttagatagagttggtcctgtta

SEQ ID NO: 84873 - DNA, 25 bp, Homo sapien
ttggtcctgttaggaggagactctt

SEQ ID NO: 84874 - DNA, 25 bp, Homo sapien
ggagactcttgatgtcaccttcagt

SEQ ID NO: 84875 - DNA, 25 bp, Homo sapien
cttgatgtcaccttcagtatcttga

SEQ ID NO: 84876 - DNA, 25 bp, Homo sapien
tcagtatcttgaaagcgggtcccct

SEQ ID NO: 84877 - DNA, 25 bp, Homo sapien
ctccccgaggctcttaattctttga

SEQ ID NO: 84878 - DNA, 25 bp, Homo sapien
ttgaaaacttgatgctgtttcagct

SEQ ID NO: 84879 - DNA, 25 bp, Homo sapien
gactttcagttgttgttctgtatca

SEQ ID NO: 84880 - DNA, 25 bp, Homo sapien
ttgaatttttgtgctcttttccctg

SEQ ID NO: 84881 - DNA, 25 bp, Homo sapien
gctcttttccctgtgtacgtggtgg

SEQ ID NO: 84882 - DNA, 25 bp, Homo sapien
tgtgaatgtgcctcgttcatccctg

SEQ ID NO: 84883 - DNA, 25 bp, Homo sapien
atccctggtgcttgagcccctcaag

SEQ ID NO: 84884 - DNA, 25 bp, Homo sapien
aagctccagtcaatgatccagtcct

SEQ ID NO: 84885 - DNA, 25 bp, Homo sapien
ttcccctttgaagttttctgctcta

SEQ ID NO: 84886 - DNA, 25 bp, Homo sapien
ttctgctctactttccttggcagca

SEQ ID NO: 84887 - DNA, 25 bp, Homo sapien
actttccttggcagcagcctgtgaa

SEQ ID NO: 84888 - DNA, 25 bp, Homo sapien
gaactactcaaaagagtccccttgg

SEQ ID NO: 84889 - DNA, 25 bp, Homo sapien
cttgggtttggaattatcagtggct

SEQ ID NO: 84890 - DNA, 25 bp, Homo sapien
gatcttcggcaagtaacctaaccta

SEQ ID NO: 84891 - DNA, 25 bp, Homo sapien
acctagggacatcagtttactcatc

SEQ ID NO: 84892 - DNA, 25 bp, Homo sapien
aaacctacctcagggttgcttcaag

SEQ ID NO: 84893 - DNA, 25 bp, Homo sapien
gccggagagccggacagcaggcagc

SEQ ID NO: 84894 - DNA, 25 bp, Homo sapien
ggcagacgagcccacggcgccgtgg

SEQ ID NO: 84895 - DNA, 25 bp, Homo sapien
cccagcagcagggttgtcagtcgga

SEQ ID NO: 84896 - DNA, 25 bp, Homo sapien
gcagggttgtcagtcggagcatcct

SEQ ID NO: 84897 - DNA, 25 bp, Homo sapien
ccgtctgtgaggtaggcgcagtacc

SEQ ID NO: 84898 - DNA, 25 bp, Homo sapien
aggtaggcgcagtaccgtgtatcgt

SEQ ID NO: 84899 - DNA, 25 bp, Homo sapien
aggcgcagtaccgtgtatcgtaggt

SEQ ID NO: 84900 - DNA, 25 bp, Homo sapien
gcagtaccgtgtatcgtaggtagca

SEQ ID NO: 84901 - DNA, 25 bp, Homo sapien
gtgtatcgtaggtagcagtaggaac

SEQ ID NO: 84902 - DNA, 25 bp, Homo sapien
ccctgcagccgctcatggcggtgag

SEQ ID NO: 84903 - DNA, 25 bp, Homo sapien
ctcatggcggtgaggtgtgtgccaa

SEQ ID NO: 84904 - DNA, 25 bp, Homo sapien
ccggtgtttgcggacatcagcaaag

SEQ ID NO: 84905 - DNA, 25 bp, Homo sapien
gtgtttgcggacatcagcaaagacc

SEQ ID NO: 84906 - DNA, 25 bp, Homo sapien
atgatggttaagaggagagactact

SEQ ID NO: 84907 - DNA, 25 bp, Homo sapien
gagagactacttggaccttgcggcg

SEQ ID NO: 84908 - DNA, 25 bp, Homo sapien
gactacttggaccttgcggcgtcca

SEQ ID NO: 84909 - DNA, 25 bp, Homo sapien
tctgactccctgatttatgacgacg

SEQ ID NO: 84910 - DNA, 25 bp, Homo sapien
gactccctgatttatgacgacggcc

SEQ ID NO: 84911 - DNA, 25 bp, Homo sapien
gatttatgacgacggcctctcagag

SEQ ID NO: 84912 - DNA, 25 bp, Homo sapien
aggagacaccgctggtggactgtaa

SEQ ID NO: 84913 - DNA, 25 bp, Homo sapien
accgctggtggactgtaataatgcc

SEQ ID NO: 84914 - DNA, 25 bp, Homo sapien
tcccttccacatggattgaaaacaa

SEQ ID NO: 84915 - DNA, 25 bp, Homo sapien
gacctggttccagccgtttgcaggg

SEQ ID NO: 84916 - DNA, 25 bp, Homo sapien
gctccgagaggcgtgtgctttccgt

SEQ ID NO: 84917 - DNA, 25 bp, Homo sapien
tgggccccttccagccgtgggcaaa

SEQ ID NO: 84918 - DNA, 25 bp, Homo sapien
ccagccgtgggcaaaccctgaagac

SEQ ID NO: 84919 - DNA, 25 bp, Homo sapien
agccgtgggcaaaccctgaagacac

SEQ ID NO: 84920 - DNA, 25 bp, Homo sapien
gccgtgggcaaaccctgaagacacc

SEQ ID NO: 84921 - DNA, 25 bp, Homo sapien
gtgggcaaaccctgaagacacccct

SEQ ID NO: 84922 - DNA, 25 bp, Homo sapien
gggcaaaccctgaagacacccctgc

SEQ ID NO: 84923 - DNA, 25 bp, Homo sapien
gactggacctgggtctgcctgacct

SEQ ID NO: 84924 - DNA, 25 bp, Homo sapien
ggacctgggtctgcctgacctcaga

SEQ ID NO: 84925 - DNA, 25 bp, Homo sapien
ctgacctcagagtgtccaggggctt

SEQ ID NO: 84926 - DNA, 25 bp, Homo sapien
gagttttatgtagctttagacttta

SEQ ID NO: 84927 - DNA, 25 bp, Homo sapien
atttgaaaaaattatgcctctggtt

SEQ ID NO: 84928 - DNA, 25 bp, Homo sapien
ggtgattacacactctttctcttac

SEQ ID NO: 84929 - DNA, 25 bp, Homo sapien
actctttctcttacccttgtgtatt

SEQ ID NO: 84930 - DNA, 25 bp, Homo sapien
cccttgtgtattgaactatgtccat

SEQ ID NO: 84931 - DNA, 25 bp, Homo sapien
atcaagttgatgtggatcctgaaaa

SEQ ID NO: 84932 - DNA, 25 bp, Homo sapien
tatgaacatctgattggtatttgtc

SEQ ID NO: 84933 - DNA, 25 bp, Homo sapien
gaacacttcaaagctgtcagtgtgt

SEQ ID NO: 84934 - DNA, 25 bp, Homo sapien
tgtcagtgtgtattggtttcaccaa

SEQ ID NO: 84935 - DNA, 25 bp, Homo sapien
gtttcaccaataaccactgcttgat

SEQ ID NO: 84936 - DNA, 25 bp, Homo sapien
accaataaccactgcttgatcctta

SEQ ID NO: 84937 - DNA, 25 bp, Homo sapien
agaaggtccgcgttaaatgcaacac

SEQ ID NO: 84938 - DNA, 25 bp, Homo sapien
aaatgcaacacggatgataccatcg

SEQ ID NO: 84939 - DNA, 25 bp, Homo sapien
gggaccttaagaagctgattgcagc

SEQ ID NO: 84940 - DNA, 25 bp, Homo sapien
ttgcagcccaaactggtacccgttg

SEQ ID NO: 84941 - DNA, 25 bp, Homo sapien
ccgttggaacaagattgtcctgaag

SEQ ID NO: 84942 - DNA, 25 bp, Homo sapien
ttgtcctgaagaagtggtacacgat

SEQ ID NO: 84943 - DNA, 25 bp, Homo sapien
gatttttaaggaccacgtgtctctg

SEQ ID NO: 84944 - DNA, 25 bp, Homo sapien
gggactatgaaatccacgatgggat

SEQ ID NO: 84945 - DNA, 25 bp, Homo sapien
cacgatgggatgaacctggagcttt

SEQ ID NO: 84946 - DNA, 25 bp, Homo sapien
gaacctggagctttattatcaatag

SEQ ID NO: 84947 - DNA, 25 bp, Homo sapien
cactgggatagatgcttgtttgtaa

SEQ ID NO: 84948 - DNA, 25 bp, Homo sapien
aatcatttccagacaacctcttact

SEQ ID NO: 84949 - DNA, 25 bp, Homo sapien
gacaacctcttactttctgtgtagt

SEQ ID NO: 84950 - DNA, 25 bp, Homo sapien
gttttaaacagaagcacatgacata

SEQ ID NO: 84951 - DNA, 25 bp, Homo sapien
acatgacatatgaaagcctgcagga

SEQ ID NO: 84952 - DNA, 25 bp, Homo sapien
aagcctgcaggactggtcgtttttt

SEQ ID NO: 84953 - DNA, 25 bp, Homo sapien
ttttttggcaattcttccacgtggg

SEQ ID NO: 84954 - DNA, 25 bp, Homo sapien
aattcttccacgtgggacttgtcca

SEQ ID NO: 84955 - DNA, 25 bp, Homo sapien
ttccacgtgggacttgtccacaaga

SEQ ID NO: 84956 - DNA, 25 bp, Homo sapien
atgcaaaagtttttcttgtagagaa

SEQ ID NO: 84957 - DNA, 25 bp, Homo sapien
cagtctgttcttccagagtccagag

SEQ ID NO: 84958 - DNA, 25 bp, Homo sapien
gttcttccagagtccagagacattg

SEQ ID NO: 84959 - DNA, 25 bp, Homo sapien
aaagacattttggaatttcctggat

SEQ ID NO: 84960 - DNA, 25 bp, Homo sapien
agacattttggaatttcctggatga

SEQ ID NO: 84961 - DNA, 25 bp, Homo sapien
gacattttggaatttcctggatgag

SEQ ID NO: 84962 - DNA, 25 bp, Homo sapien
acattttggaatttcctggatgaga

SEQ ID NO: 84963 - DNA, 25 bp, Homo sapien
cattttggaatttcctggatgagaa

SEQ ID NO: 84964 - DNA, 25 bp, Homo sapien
ttttggaatttcctggatgagaagg

SEQ ID NO: 84965 - DNA, 25 bp, Homo sapien
aatttcctggatgagaaggaagtct

SEQ ID NO: 84966 - DNA, 25 bp, Homo sapien
tgagaaggaagtctgggctgggcat

SEQ ID NO: 84967 - DNA, 25 bp, Homo sapien
cctagcactttaggaaatcgaggcg

SEQ ID NO: 84968 - DNA, 25 bp, Homo sapien
gcactttaggaaatcgaggcgagtg

SEQ ID NO: 84969 - DNA, 25 bp, Homo sapien
tttaggaaatcgaggcgagtggatc

SEQ ID NO: 84970 - DNA, 25 bp, Homo sapien
gacaactttgtgaagatctaattac

SEQ ID NO: 84971 - DNA, 25 bp, Homo sapien
atattcttttatttctgttaaactg

SEQ ID NO: 84972 - DNA, 25 bp, Homo sapien
aactgaatatacaattgttccctag

SEQ ID NO: 84973 - DNA, 25 bp, Homo sapien
gaatatacaattgttccctaggcaa

SEQ ID NO: 84974 - DNA, 25 bp, Homo sapien
atatacaattgttccctaggcaacc

SEQ ID NO: 84975 - DNA, 25 bp, Homo sapien
ccctaggcaaccaacttttgcttat

SEQ ID NO: 84976 - DNA, 25 bp, Homo sapien
ggcaaccaacttttgcttataacta

SEQ ID NO: 84977 - DNA, 25 bp, Homo sapien
accaacttttgcttataactacaat

SEQ ID NO: 84978 - DNA, 25 bp, Homo sapien
actacaatttaatttcacgttgaca

SEQ ID NO: 84979 - DNA, 25 bp, Homo sapien
taatttcacgttgacaaaacacagt

SEQ ID NO: 84980 - DNA, 25 bp, Homo sapien
aaaacacagtgaaaagacaactttg

SEQ ID NO: 84981 - DNA, 25 bp, Homo sapien
gtagctggggccaggcttctctccc

SEQ ID NO: 84982 - DNA, 25 bp, Homo sapien
accacctgcagatttcttgctgctt

SEQ ID NO: 84983 - DNA, 25 bp, Homo sapien
acctgcagatttcttgctgcttcca

SEQ ID NO: 84984 - DNA, 25 bp, Homo sapien
tgcagatttcttgctgcttccactg

SEQ ID NO: 84985 - DNA, 25 bp, Homo sapien
gcagatttcttgctgcttccactga

SEQ ID NO: 84986 - DNA, 25 bp, Homo sapien
agatttcttgctgcttccactgata

SEQ ID NO: 84987 - DNA, 25 bp, Homo sapien
gatttcttgctgcttccactgatac

SEQ ID NO: 84988 - DNA, 25 bp, Homo sapien
atttcttgctgcttccactgatacc

SEQ ID NO: 84989 - DNA, 25 bp, Homo sapien
ttgctgcttccactgataccctttt

SEQ ID NO: 84990 - DNA, 25 bp, Homo sapien
gctgcttccactgatacccttttga

SEQ ID NO: 84991 - DNA, 25 bp, Homo sapien
ctgcttccactgatacccttttgac

SEQ ID NO: 84992 - DNA, 25 bp, Homo sapien
ttgcagatggcaagtcacacaccct

SEQ ID NO: 84993 - DNA, 25 bp, Homo sapien
aagggaagctacacgggccaaatcg

SEQ ID NO: 84994 - DNA, 25 bp, Homo sapien
tcctctccctttcctactataatag

SEQ ID NO: 84995 - DNA, 25 bp, Homo sapien
gtatttaagacatatcagctccaga

SEQ ID NO: 84996 - DNA, 25 bp, Homo sapien
atatcagctccagagatgagtcctg

SEQ ID NO: 84997 - DNA, 25 bp, Homo sapien
gagtcctggagccttgaattttgtt

SEQ ID NO: 84998 - DNA, 25 bp, Homo sapien
tctctctgtaataacaacgctggaa

SEQ ID NO: 84999 - DNA, 25 bp, Homo sapien
gctggaaaggccgagaacctctttt

SEQ ID NO: 85000 - DNA, 25 bp, Homo sapien
gaacctcttttatgctcatgtcttg

SEQ ID NO: 85001 - DNA, 25 bp, Homo sapien
tgtttctcatgcctttatgttcctt

SEQ ID NO: 85002 - DNA, 25 bp, Homo sapien
atgcctttatgttccttcatgtaag

SEQ ID NO: 85003 - DNA, 25 bp, Homo sapien
attttggaatttcctggatgagaag

SEQ ID NO: 85004 - DNA, 25 bp, Homo sapien
cctggatgagaaggaagtctgggct

SEQ ID NO: 85005 - DNA, 25 bp, Homo sapien
ctggatgagaaggaagtctgggctg

SEQ ID NO: 85006 - DNA, 25 bp, Homo sapien
tggatgagaaggaagtctgggctgg

SEQ ID NO: 85007 - DNA, 25 bp, Homo sapien
ggatgagaaggaagtctgggctggg

SEQ ID NO: 85008 - DNA, 25 bp, Homo sapien
gatgagaaggaagtctgggctgggc

SEQ ID NO: 85009 - DNA, 25 bp, Homo sapien
atgagaaggaagtctgggctgggca

SEQ ID NO: 85010 - DNA, 25 bp, Homo sapien
tgagaaggaagtctgggctgggcat

SEQ ID NO: 85011 - DNA, 25 bp, Homo sapien
acagaggtgctctggggccaccgat

SEQ ID NO: 85012 - DNA, 25 bp, Homo sapien
gcttctatgaggtggactacaacac

SEQ ID NO: 85013 - DNA, 25 bp, Homo sapien
tatgaggtggactacaacaccttcc

SEQ ID NO: 85014 - DNA, 25 bp, Homo sapien
atgatacctatgagaccaacacacc

SEQ ID NO: 85015 - DNA, 25 bp, Homo sapien
atacctatgagaccaacacacccag

SEQ ID NO: 85016 - DNA, 25 bp, Homo sapien
aacacacccagctgctgtgccaagg

SEQ ID NO: 85017 - DNA, 25 bp, Homo sapien
acacccagctgctgtgccaaggagc

SEQ ID NO: 85018 - DNA, 25 bp, Homo sapien
ctgctgtgccaaggagctggcagaa

SEQ ID NO: 85019 - DNA, 25 bp, Homo sapien
aaatgaagagggaaggccggctcct

SEQ ID NO: 85020 - DNA, 25 bp, Homo sapien
gggaaggccggctcctccagtacct

SEQ ID NO: 85021 - DNA, 25 bp, Homo sapien
agcagaatgaagaagatgagcccaa

SEQ ID NO: 85022 - DNA, 25 bp, Homo sapien
ggcgccaatctcaagggcgaccggt

SEQ ID NO: 85023 - DNA, 25 bp, Homo sapien
aagggcgaccggtcgcgactgctcc

SEQ ID NO: 85024 - DNA, 25 bp, Homo sapien
gggacctgcgcgtggacaccaagtc

SEQ ID NO: 85025 - DNA, 25 bp, Homo sapien
gtgggctcgccttctgcaagagcac

SEQ ID NO: 85026 - DNA, 25 bp, Homo sapien
aagagcaccccaacgcgcgcaaata

SEQ ID NO: 85027 - DNA, 25 bp, Homo sapien
acgcgcgcaaatacaaaggagccaa

SEQ ID NO: 85028 - DNA, 25 bp, Homo sapien
aggagccaacaagaagggcttgtcc

SEQ ID NO: 85029 - DNA, 25 bp, Homo sapien
aagggcttgtccaagggctgcttcg

SEQ ID NO: 85030 - DNA, 25 bp, Homo sapien
tgcttcggcctcaagctggaccgaa

SEQ ID NO: 85031 - DNA, 25 bp, Homo sapien
aagctggaccgaatcggctccatga

SEQ ID NO: 85032 - DNA, 25 bp, Homo sapien
aatcggctccatgagcggcctggga

SEQ ID NO: 85033 - DNA, 25 bp, Homo sapien
attattaaccatagttgccatgcta

SEQ ID NO: 85034 - DNA, 25 bp, Homo sapien
gttgccatgctatacattagggctc

SEQ ID NO: 85035 - DNA, 25 bp, Homo sapien
tgctatacattagggctccagaact

SEQ ID NO: 85036 - DNA, 25 bp, Homo sapien
gaacttattcatttcataacttcaa

SEQ ID NO: 85037 - DNA, 25 bp, Homo sapien
agtcacgataaaagtttgtgccttt

SEQ ID NO: 85038 - DNA, 25 bp, Homo sapien
ttgtgccttttgcaagtttgtacct

SEQ ID NO: 85039 - DNA, 25 bp, Homo sapien
gcaagtttgtaccttttgatgaaca

SEQ ID NO: 85040 - DNA, 25 bp, Homo sapien
tgatgaacatcttcccatatcttcc

SEQ ID NO: 85041 - DNA, 25 bp, Homo sapien
tgcacctggaaaccacccttctaaa

SEQ ID NO: 85042 - DNA, 25 bp, Homo sapien
gagttcaccttttttcagattccac

SEQ ID NO: 85043 - DNA, 25 bp, Homo sapien
gatcatgcagtgcttgtgtttctgt

SEQ ID NO: 85044 - DNA, 25 bp, Homo sapien
tagaggtagaaatttgccttgctgc

SEQ ID NO: 85045 - DNA, 25 bp, Homo sapien
tctccaggcagggtagtaagctgac

SEQ ID NO: 85046 - DNA, 25 bp, Homo sapien
gcagggtagtaagctgacactaaat

SEQ ID NO: 85047 - DNA, 25 bp, Homo sapien
gtattgaagcaacaaatatttcctg

SEQ ID NO: 85048 - DNA, 25 bp, Homo sapien
aatatttcctgaagatccaccctgg

SEQ ID NO: 85049 - DNA, 25 bp, Homo sapien
ttcctgaagatccaccctgggtgag

SEQ ID NO: 85050 - DNA, 25 bp, Homo sapien
caccctgggtgaggctttgagctga

SEQ ID NO: 85051 - DNA, 25 bp, Homo sapien
aggctttgagctgactttagagatc

SEQ ID NO: 85052 - DNA, 25 bp, Homo sapien
agctgactttagagatcactgtggg

SEQ ID NO: 85053 - DNA, 25 bp, Homo sapien
gggtcaagaatgtcttacatgtttt

SEQ ID NO: 85054 - DNA, 25 bp, Homo sapien
gtcttacatgttttattcatcattc

SEQ ID NO: 85055 - DNA, 25 bp, Homo sapien
gtgtatattgtataggggcaactgt

SEQ ID NO: 85056 - DNA, 25 bp, Homo sapien
gtatattgtataggggcaactgtat

SEQ ID NO: 85057 - DNA, 25 bp, Homo sapien
tattgtataggggcaactgtatgaa

SEQ ID NO: 85058 - DNA, 25 bp, Homo sapien
attgtataggggcaactgtatgaaa

SEQ ID NO: 85059 - DNA, 25 bp, Homo sapien
tgtataggggcaactgtatgaaaaa

SEQ ID NO: 85060 - DNA, 25 bp, Homo sapien
gtataggggcaactgtatgaaaaat

SEQ ID NO: 85061 - DNA, 25 bp, Homo sapien
tataggggcaactgtatgaaaaatt

SEQ ID NO: 85062 - DNA, 25 bp, Homo sapien
aggagggggccgggcgcggtgctca

SEQ ID NO: 85063 - DNA, 25 bp, Homo sapien
ggagggggccgggcgcggtgctcac

SEQ ID NO: 85064 - DNA, 25 bp, Homo sapien
gagggggccgggcgcggtgctcacg

SEQ ID NO: 85065 - DNA, 25 bp, Homo sapien
caagttttaaatgctgaatgtttct

SEQ ID NO: 85066 - DNA, 25 bp, Homo sapien
aatgctgaatgtttcttgatgccaa

SEQ ID NO: 85067 - DNA, 25 bp, Homo sapien
gctgaatgtttcttgatgccaaagg

SEQ ID NO: 85068 - DNA, 25 bp, Homo sapien
gtttcttgatgccaaaggagcaatc

SEQ ID NO: 85069 - DNA, 25 bp, Homo sapien
gatgccaaaggagcaatcagttcca

SEQ ID NO: 85070 - DNA, 25 bp, Homo sapien
aggagcaatcagttccaaacccaga

SEQ ID NO: 85071 - DNA, 25 bp, Homo sapien
gagcaatcagttccaaacccagaaa

SEQ ID NO: 85072 - DNA, 25 bp, Homo sapien
gcaatcagttccaaacccagaaaaa

SEQ ID NO: 85073 - DNA, 25 bp, Homo sapien
atcagttccaaacccagaaaaagat

SEQ ID NO: 85074 - DNA, 25 bp, Homo sapien
aaaagatactgaatacaccctatat

SEQ ID NO: 85075 - DNA, 25 bp, Homo sapien
gatactgaatacaccctatataaaa

SEQ ID NO: 85076 - DNA, 25 bp, Homo sapien
gctgtttgtccaagactcagtgtcc

SEQ ID NO: 85077 - DNA, 25 bp, Homo sapien
gtttgtccaagactcagtgtcccga

SEQ ID NO: 85078 - DNA, 25 bp, Homo sapien
aagactcagtgtcccgacccttgtt

SEQ ID NO: 85079 - DNA, 25 bp, Homo sapien
cgacccttgttctcgccgtgaatgt

SEQ ID NO: 85080 - DNA, 25 bp, Homo sapien
tgttctcgccgtgaatgtcaatggg

SEQ ID NO: 85081 - DNA, 25 bp, Homo sapien
ccgtgaatgtcaatgggccaatcct

SEQ ID NO: 85082 - DNA, 25 bp, Homo sapien
atgtcaatgggccaatcctctctgt

SEQ ID NO: 85083 - DNA, 25 bp, Homo sapien
ggccaatcctctctgtcctttcaga

SEQ ID NO: 85084 - DNA, 25 bp, Homo sapien
actgctgctgctatcaacgccagaa

SEQ ID NO: 85085 - DNA, 25 bp, Homo sapien
tgctgctatcaacgccagaataaac

SEQ ID NO: 85086 - DNA, 25 bp, Homo sapien
aacgccagaataaacacactctgtg

SEQ ID NO: 85087 - DNA, 25 bp, Homo sapien
aggctttgagctgactttagagatc

SEQ ID NO: 85088 - DNA, 25 bp, Homo sapien
ggctttgagctgactttagagatca

SEQ ID NO: 85089 - DNA, 25 bp, Homo sapien
ctttgagctgactttagagatcact

SEQ ID NO: 85090 - DNA, 25 bp, Homo sapien
ttgagctgactttagagatcactgt

SEQ ID NO: 85091 - DNA, 25 bp, Homo sapien
gagctgactttagagatcactgtgg

SEQ ID NO: 85092 - DNA, 25 bp, Homo sapien
agctgactttagagatcactgtggg

SEQ ID NO: 85093 - DNA, 25 bp, Homo sapien
cactgtggggtcaagaatgtcttac

SEQ ID NO: 85094 - DNA, 25 bp, Homo sapien
gggtcaagaatgtcttacatgtttt

SEQ ID NO: 85095 - DNA, 25 bp, Homo sapien
gaatgtcttacatgttttattcatc

SEQ ID NO: 85096 - DNA, 25 bp, Homo sapien
atgtcttacatgttttattcatcat

SEQ ID NO: 85097 - DNA, 25 bp, Homo sapien
gtcttacatgttttattcatcattc

SEQ ID NO: 85098 - DNA, 25 bp, Homo sapien
gaaatatttgtatccccttacactg

SEQ ID NO: 85099 - DNA, 25 bp, Homo sapien
ataaacatgtccatcttgcccgtat

SEQ ID NO: 85100 - DNA, 25 bp, Homo sapien
gcccgtattgggaattatcatctgg

SEQ ID NO: 85101 - DNA, 25 bp, Homo sapien
gcatcgtgtttcagttggcatttca

SEQ ID NO: 85102 - DNA, 25 bp, Homo sapien
atttcactgacttctagcacggttg

SEQ ID NO: 85103 - DNA, 25 bp, Homo sapien
ctagcacggttgaacatctttcatg

SEQ ID NO: 85104 - DNA, 25 bp, Homo sapien
tctttcatgtggagcgattgtattt

SEQ ID NO: 85105 - DNA, 25 bp, Homo sapien
gattgtatttcctcctttgtggatt

SEQ ID NO: 85106 - DNA, 25 bp, Homo sapien
tgtggattgtcagtgtcctttgctc

SEQ ID NO: 85107 - DNA, 25 bp, Homo sapien
agtgtcctttgctctatcttctggg

SEQ ID NO: 85108 - DNA, 25 bp, Homo sapien
gataaatttgtatgagctcggtata

SEQ ID NO: 85109 - DNA, 25 bp, Homo sapien
ccggccctttgcacaggtgagggaa

SEQ ID NO: 85110 - DNA, 25 bp, Homo sapien
gtgagggaactaaacctgtgcaaga

SEQ ID NO: 85111 - DNA, 25 bp, Homo sapien
aactaaacctgtgcaagatgggaga

SEQ ID NO: 85112 - DNA, 25 bp, Homo sapien
ggactggtccaaagcgccacgatcc

SEQ ID NO: 85113 - DNA, 25 bp, Homo sapien
aaagcgccacgatccttgacgggca

SEQ ID NO: 85114 - DNA, 25 bp, Homo sapien
gatccttgacgggcacagccagaag

SEQ ID NO: 85115 - DNA, 25 bp, Homo sapien
agaagctgcacctggccgagaacgc

SEQ ID NO: 85116 - DNA, 25 bp, Homo sapien
acctggccgagaacgccgagcctga

SEQ ID NO: 85117 - DNA, 25 bp, Homo sapien
agcctgaggagcagtccgctgcgta

SEQ ID NO: 85118 - DNA, 25 bp, Homo sapien
ctcattctcttcaaactgtgacttt

SEQ ID NO: 85119 - DNA, 25 bp, Homo sapien
gtgactttttacagactcgggcggg

SEQ ID NO: 85120 - DNA, 25 bp, Homo sapien
aaactctatggtagaatttcccatg

SEQ ID NO: 85121 - DNA, 25 bp, Homo sapien
ggtagaatttcccatgcatttacta

SEQ ID NO: 85122 - DNA, 25 bp, Homo sapien
gtagaatttcccatgcatttactag

SEQ ID NO: 85123 - DNA, 25 bp, Homo sapien
agaatttcccatgcatttactagat

SEQ ID NO: 85124 - DNA, 25 bp, Homo sapien
atttcccatgcatttactagattct

SEQ ID NO: 85125 - DNA, 25 bp, Homo sapien
ttcccatgcatttactagattctag

SEQ ID NO: 85126 - DNA, 25 bp, Homo sapien
gcatttactagattctagcaccgct

SEQ ID NO: 85127 - DNA, 25 bp, Homo sapien
ttactagattctagcaccgctgtcc

SEQ ID NO: 85128 - DNA, 25 bp, Homo sapien
tgcactatccttcctctctgtgatg

SEQ ID NO: 85129 - DNA, 25 bp, Homo sapien
actatccttcctctctgtgatgctt

SEQ ID NO: 85130 - DNA, 25 bp, Homo sapien
atccttcctctctgtgatgcttttt

SEQ ID NO: 85131 - DNA, 25 bp, Homo sapien
tgaggacccacggggagcctgggcc

SEQ ID NO: 85132 - DNA, 25 bp, Homo sapien
ttccagccgtgggcaaaccctgaag

SEQ ID NO: 85133 - DNA, 25 bp, Homo sapien
tccagccgtgggcaaaccctgaaga

SEQ ID NO: 85134 - DNA, 25 bp, Homo sapien
ccagccgtgggcaaaccctgaagac

SEQ ID NO: 85135 - DNA, 25 bp, Homo sapien
agccgtgggcaaaccctgaagacac

SEQ ID NO: 85136 - DNA, 25 bp, Homo sapien
gccgtgggcaaaccctgaagacacc

SEQ ID NO: 85137 - DNA, 25 bp, Homo sapien
gtgggcaaaccctgaagacacccct

SEQ ID NO: 85138 - DNA, 25 bp, Homo sapien
tgggcaaaccctgaagacacccctg

SEQ ID NO: 85139 - DNA, 25 bp, Homo sapien
gggcaaaccctgaagacacccctgc

SEQ ID NO: 85140 - DNA, 25 bp, Homo sapien
ggcaaaccctgaagacacccctgcc

SEQ ID NO: 85141 - DNA, 25 bp, Homo sapien
gcaaaccctgaagacacccctgccc

SEQ ID NO: 85142 - DNA, 25 bp, Homo sapien
cataatccggtctatgccttctgca

SEQ ID NO: 85143 - DNA, 25 bp, Homo sapien
taatccggtctatgccttctgcacc

SEQ ID NO: 85144 - DNA, 25 bp, Homo sapien
acatgcaagggcgtctgacacacag

SEQ ID NO: 85145 - DNA, 25 bp, Homo sapien
caagggcgtctgacacacagaggga

SEQ ID NO: 85146 - DNA, 25 bp, Homo sapien
gtctgacacacagagggagtgccct

SEQ ID NO: 85147 - DNA, 25 bp, Homo sapien
gtaaatatgtgtcctccccactgag

SEQ ID NO: 85148 - DNA, 25 bp, Homo sapien
tccccactgagctttgttttctgtt

SEQ ID NO: 85149 - DNA, 25 bp, Homo sapien
ttttctgtttcattatgtccattgt

SEQ ID NO: 85150 - DNA, 25 bp, Homo sapien
tcattatgtccattgttttcttata

SEQ ID NO: 85151 - DNA, 25 bp, Homo sapien
gtgttgctgttcttccaataaacga

SEQ ID NO: 85152 - DNA, 25 bp, Homo sapien
gctgttcttccaataaacgatcatc

SEQ ID NO: 85153 - DNA, 25 bp, Homo sapien
ggggactgatctcaaaattccagaa

SEQ ID NO: 85154 - DNA, 25 bp, Homo sapien
ttccagaattccctgtacatctgtt

SEQ ID NO: 85155 - DNA, 25 bp, Homo sapien
agaattccctgtacatctgttcacg

SEQ ID NO: 85156 - DNA, 25 bp, Homo sapien
aattccctgtacatctgttcacgtg

SEQ ID NO: 85157 - DNA, 25 bp, Homo sapien
tgtacatctgttcacgtgcttgtgt

SEQ ID NO: 85158 - DNA, 25 bp, Homo sapien
atctgttcacgtgcttgtgtccagg

SEQ ID NO: 85159 - DNA, 25 bp, Homo sapien
tcacgtgcttgtgtccaggtgtgac

SEQ ID NO: 85160 - DNA, 25 bp, Homo sapien
gcttgtgtccaggtgtgacttgtaa

SEQ ID NO: 85161 - DNA, 25 bp, Homo sapien
gtccaggtgtgacttgtaaactgtc

SEQ ID NO: 85162 - DNA, 25 bp, Homo sapien
gtgtgacttgtaaactgtctagtgt

SEQ ID NO: 85163 - DNA, 25 bp, Homo sapien
actgtctagtgtttgcattaaataa

SEQ ID NO: 85164 - DNA, 25 bp, Homo sapien
gccagcacggtggtgaggcagttga

SEQ ID NO: 85165 - DNA, 25 bp, Homo sapien
ggtgaggcagttgagaaaatttgaa

SEQ ID NO: 85166 - DNA, 25 bp, Homo sapien
gttgtagtttataaaagactgtctt

SEQ ID NO: 85167 - DNA, 25 bp, Homo sapien
ttgcatacttaagcatttaggaatg

SEQ ID NO: 85168 - DNA, 25 bp, Homo sapien
gaatgaagtgttagagtgtcttaaa

SEQ ID NO: 85169 - DNA, 25 bp, Homo sapien
tgttagagtgtcttaaaatgtttca

SEQ ID NO: 85170 - DNA, 25 bp, Homo sapien
tgtggcaaaatgttacagaatctaa

SEQ ID NO: 85171 - DNA, 25 bp, Homo sapien
tggtggacatggctgttcattgtac

SEQ ID NO: 85172 - DNA, 25 bp, Homo sapien
gtggacatggctgttcattgtactg

SEQ ID NO: 85173 - DNA, 25 bp, Homo sapien
ggacatggctgttcattgtactgtt

SEQ ID NO: 85174 - DNA, 25 bp, Homo sapien
acatggctgttcattgtactgtttt

SEQ ID NO: 85175 - DNA, 25 bp, Homo sapien
aattcagactttactaaagcacagt

SEQ ID NO: 85176 - DNA, 25 bp, Homo sapien
taaagcacagttagacccaaggcct

SEQ ID NO: 85177 - DNA, 25 bp, Homo sapien
agttagacccaaggcctatgctgag

SEQ ID NO: 85178 - DNA, 25 bp, Homo sapien
aaggcctatgctgaggtctaaacct

SEQ ID NO: 85179 - DNA, 25 bp, Homo sapien
tatgctgaggtctaaacctctgaaa

SEQ ID NO: 85180 - DNA, 25 bp, Homo sapien
gtatagtatcgagtacccgttccct

SEQ ID NO: 85181 - DNA, 25 bp, Homo sapien
ggagtaactgctggtagtgccttct

SEQ ID NO: 85182 - DNA, 25 bp, Homo sapien
aactgctggtagtgccttctttggt

SEQ ID NO: 85183 - DNA, 25 bp, Homo sapien
agtgccttctttggttgtgttgctc

SEQ ID NO: 85184 - DNA, 25 bp, Homo sapien
tctttggttgtgttgctcagtgtgt

SEQ ID NO: 85185 - DNA, 25 bp, Homo sapien
gtgtgtaagtgtttgtttccaggat

SEQ ID NO: 85186 - DNA, 25 bp, Homo sapien
ttcagcagaaaacatgtcaacttta

SEQ ID NO: 85187 - DNA, 25 bp, Homo sapien
gaatcttagcacaaacaggactgtt

SEQ ID NO: 85188 - DNA, 25 bp, Homo sapien
caggactgttgtactagatgttctt

SEQ ID NO: 85189 - DNA, 25 bp, Homo sapien
actgttgtactagatgttcttagga

SEQ ID NO: 85190 - DNA, 25 bp, Homo sapien
gatgttcttaggaaatatctcagaa

SEQ ID NO: 85191 - DNA, 25 bp, Homo sapien
aagaattatttcagtatttacctgt

SEQ ID NO: 85192 - DNA, 25 bp, Homo sapien
tttattcttgaagttggccaacaga

SEQ ID NO: 85193 - DNA, 25 bp, Homo sapien
gaagttggccaacagagttgtgaat

SEQ ID NO: 85194 - DNA, 25 bp, Homo sapien
gccaacagagttgtgaatgtgtgtg

SEQ ID NO: 85195 - DNA, 25 bp, Homo sapien
aaggcctttgaatgtaaagctgcat

SEQ ID NO: 85196 - DNA, 25 bp, Homo sapien
gctgcataagctgttaggttttgtt

SEQ ID NO: 85197 - DNA, 25 bp, Homo sapien
gggaggagacgctgcttaccgatcc

SEQ ID NO: 85198 - DNA, 25 bp, Homo sapien
ggagacgctgcttaccgatcccggg

SEQ ID NO: 85199 - DNA, 25 bp, Homo sapien
tgagaggccgccactgagcatctct

SEQ ID NO: 85200 - DNA, 25 bp, Homo sapien
tgagcatctctatctgtcattcctt

SEQ ID NO: 85201 - DNA, 25 bp, Homo sapien
atctctatctgtcattcctttagct

SEQ ID NO: 85202 - DNA, 25 bp, Homo sapien
ctatctgtcattcctttagctattt

SEQ ID NO: 85203 - DNA, 25 bp, Homo sapien
aggaccaaactttttattgcagatg

SEQ ID NO: 85204 - DNA, 25 bp, Homo sapien
gcagatgtgtagctctatgtcaaat

SEQ ID NO: 85205 - DNA, 25 bp, Homo sapien
cctgcctcatggctgttcttgaaac

SEQ ID NO: 85206 - DNA, 25 bp, Homo sapien
tgttcttgaaacagcttagagcgat

SEQ ID NO: 85207 - DNA, 25 bp, Homo sapien
acagcttagagcgattctatgaaaa

SEQ ID NO: 85208 - DNA, 25 bp, Homo sapien
atacttgcagattctaagattacat

SEQ ID NO: 85209 - DNA, 25 bp, Homo sapien
gattacattgtgaaattccaggttt

SEQ ID NO: 85210 - DNA, 25 bp, Homo sapien
tggatatttaatccttacttgggaa

SEQ ID NO: 85211 - DNA, 25 bp, Homo sapien
atcagcatctaggtaaattattatt

SEQ ID NO: 85212 - DNA, 25 bp, Homo sapien
taagaactcttaaattgccaacctc

SEQ ID NO: 85213 - DNA, 25 bp, Homo sapien
gaactcttaaattgccaacctctga

SEQ ID NO: 85214 - DNA, 25 bp, Homo sapien
ttaaattgccaacctctgagaggtg

SEQ ID NO: 85215 - DNA, 25 bp, Homo sapien
cctctgagaggtgaaaagctatgta

SEQ ID NO: 85216 - DNA, 25 bp, Homo sapien
atagtagaagtgatagtgccgtgaa

SEQ ID NO: 85217 - DNA, 25 bp, Homo sapien
gatagtgccgtgaatgtattctact

SEQ ID NO: 85218 - DNA, 25 bp, Homo sapien
gccgtgaatgtattctactggaaat

SEQ ID NO: 85219 - DNA, 25 bp, Homo sapien
gtgacagtgaagattcagagctgat

SEQ ID NO: 85220 - DNA, 25 bp, Homo sapien
gagctgatgtatcagccaaaggctc

SEQ ID NO: 85221 - DNA, 25 bp, Homo sapien
gccaaaggctccagaaatcaacatt

SEQ ID NO: 85222 - DNA, 25 bp, Homo sapien
catttctgtgaattagctggagtag

SEQ ID NO: 85223 - DNA, 25 bp, Homo sapien
tgtgaattagctggagtaggagtct

SEQ ID NO: 85224 - DNA, 25 bp, Homo sapien
ggactgaagggcagctgccaagacc

SEQ ID NO: 85225 - DNA, 25 bp, Homo sapien
agagtggcaggaagcaagcatgttt

SEQ ID NO: 85226 - DNA, 25 bp, Homo sapien
agcatgtttgctgtgcacttaggaa

SEQ ID NO: 85227 - DNA, 25 bp, Homo sapien
tgcacttaggaaaggctggtgagcc

SEQ ID NO: 85228 - DNA, 25 bp, Homo sapien
agccagagggactgatcaggcccca

SEQ ID NO: 85229 - DNA, 25 bp, Homo sapien
gagggactgatcaggccccattcac

SEQ ID NO: 85230 - DNA, 25 bp, Homo sapien
tgtgctgcgccttctcatggctgac

SEQ ID NO: 85231 - DNA, 25 bp, Homo sapien
ctctcccattatcctttagctttag

SEQ ID NO: 85232 - DNA, 25 bp, Homo sapien
ccattatcctttagctttaggccaa

SEQ ID NO: 85233 - DNA, 25 bp, Homo sapien
gctttaggccaagagcgttgctcag

SEQ ID NO: 85234 - DNA, 25 bp, Homo sapien
aagagcgttgctcagggcagcttct

SEQ ID NO: 85235 - DNA, 25 bp, Homo sapien
gactgagcaggatggattttctttt

SEQ ID NO: 85236 - DNA, 25 bp, Homo sapien
gagtcgatgcctgaaagagaaacca

SEQ ID NO: 85237 - DNA, 25 bp, Homo sapien
gtaaggaacttgctggacgcacatt

SEQ ID NO: 85238 - DNA, 25 bp, Homo sapien
ttgctggacgcacattaaagaataa

SEQ ID NO: 85239 - DNA, 25 bp, Homo sapien
gaataaagctcctgtttctaggctc

SEQ ID NO: 85240 - DNA, 25 bp, Homo sapien
aagctcctgtttctaggctcctaaa

SEQ ID NO: 85241 - DNA, 25 bp, Homo sapien
ggaatttttcacagtgtccaggttt

SEQ ID NO: 85242 - DNA, 25 bp, Homo sapien
gtccaggtttgtatacttgaaggcc

SEQ ID NO: 85243 - DNA, 25 bp, Homo sapien
cttgaaggcctactttctaagaata

SEQ ID NO: 85244 - DNA, 25 bp, Homo sapien
gaataatttcgtgcgcaggtggtca

SEQ ID NO: 85245 - DNA, 25 bp, Homo sapien
aggtggtcagggaagcccaagactt

SEQ ID NO: 85246 - DNA, 25 bp, Homo sapien
ctacaaaacgacaggcttttctggg

SEQ ID NO: 85247 - DNA, 25 bp, Homo sapien
aagagagatcccttgggtggacaat

SEQ ID NO: 85248 - DNA, 25 bp, Homo sapien
gatcccttgggtggacaattggcca

SEQ ID NO: 85249 - DNA, 25 bp, Homo sapien
acaattggccactgtgtccggtgtg

SEQ ID NO: 85250 - DNA, 25 bp, Homo sapien
tgtccggtgtgcacacggtggaatt

SEQ ID NO: 85251 - DNA, 25 bp, Homo sapien
ggtgtgcacacggtggaattccacg

SEQ ID NO: 85252 - DNA, 25 bp, Homo sapien
ttggtgagcatgtgctctctcttga

SEQ ID NO: 85253 - DNA, 25 bp, Homo sapien
gcatgtgctctctcttgagattagg

SEQ ID NO: 85254 - DNA, 25 bp, Homo sapien
ctctcttgagattaggagcttcctt

SEQ ID NO: 85255 - DNA, 25 bp, Homo sapien
gattaggagcttccttactgctcct

SEQ ID NO: 85256 - DNA, 25 bp, Homo sapien
ttactgctcctctgggtgatccaag

SEQ ID NO: 85257 - DNA, 25 bp, Homo sapien
gctcctctgggtgatccaagtgtag

SEQ ID NO: 85258 - DNA, 25 bp, Homo sapien
ggtgatccaagtgtagtgggacccc

SEQ ID NO: 85259 - DNA, 25 bp, Homo sapien
caagtgtagtgggaccccctactag

SEQ ID NO: 85260 - DNA, 25 bp, Homo sapien
agtggacactaacatctgtgcaggt

SEQ ID NO: 85261 - DNA, 25 bp, Homo sapien
acatctgtgcaggtgttgacttgaa

SEQ ID NO: 85262 - DNA, 25 bp, Homo sapien
atctgtgcaggtgttgacttgaaaa

SEQ ID NO: 85263 - DNA, 25 bp, Homo sapien
gcatgaacatcagcgcccggcgctt

SEQ ID NO: 85264 - DNA, 25 bp, Homo sapien
gcgcttcaccctctgctgaggaaca

SEQ ID NO: 85265 - DNA, 25 bp, Homo sapien
ggaggaggaacattcaggtttctga

SEQ ID NO: 85266 - DNA, 25 bp, Homo sapien
gaacattcaggtttctgagagctga

SEQ ID NO: 85267 - DNA, 25 bp, Homo sapien
ctgagagctgaattccaagagtgca

SEQ ID NO: 85268 - DNA, 25 bp, Homo sapien
gaattccaagagtgcaaaaccccag

SEQ ID NO: 85269 - DNA, 25 bp, Homo sapien
tccaagagtgcaaaaccccagcatc

SEQ ID NO: 85270 - DNA, 25 bp, Homo sapien
tgtttcctctgctgacccagctggg

SEQ ID NO: 85271 - DNA, 25 bp, Homo sapien
ttcctctgctgacccagctgggagg

SEQ ID NO: 85272 - DNA, 25 bp, Homo sapien
ggaggagctcacaccctcaaactcc

SEQ ID NO: 85273 - DNA, 25 bp, Homo sapien
aactcctcaataaacgctttctctg

SEQ ID NO: 85274 - DNA, 25 bp, Homo sapien
gtatttgcattctaccttttgtcca

SEQ ID NO: 85275 - DNA, 25 bp, Homo sapien
ggaattcattgacaatctcctaata

SEQ ID NO: 85276 - DNA, 25 bp, Homo sapien
ttgacaaattgtcctccaacatcct

SEQ ID NO: 85277 - DNA, 25 bp, Homo sapien
ccacctctttgacttcaggacattt

SEQ ID NO: 85278 - DNA, 25 bp, Homo sapien
ggacatttattcatcatgcctaagg

SEQ ID NO: 85279 - DNA, 25 bp, Homo sapien
aaggaatttgaagattgcctccatc

SEQ ID NO: 85280 - DNA, 25 bp, Homo sapien
attgcctccatcatttgtagggcca

SEQ ID NO: 85281 - DNA, 25 bp, Homo sapien
tttgtagggccacagatcttaaagc

SEQ ID NO: 85282 - DNA, 25 bp, Homo sapien
gatcttaaagcctccaaccttgaag

SEQ ID NO: 85283 - DNA, 25 bp, Homo sapien
ccaaccttgaagtccagtgaagtct

SEQ ID NO: 85284 - DNA, 25 bp, Homo sapien
gtgaagtctctctcttaaagtcttt

SEQ ID NO: 85285 - DNA, 25 bp, Homo sapien
atctaacaccaaagcagtggaagtt

SEQ ID NO: 85286 - DNA, 25 bp, Homo sapien
gtggaagttccagcctttgcctcct

SEQ ID NO: 85287 - DNA, 25 bp, Homo sapien
aactccaatgatgtctttctgctgc

SEQ ID NO: 85288 - DNA, 25 bp, Homo sapien
tccaatgatgtctttctgctgcgaa

SEQ ID NO: 85289 - DNA, 25 bp, Homo sapien
aatgatgtctttctgctgcgaactc

SEQ ID NO: 85290 - DNA, 25 bp, Homo sapien
atgtctttctgctgcgaactcaggc

SEQ ID NO: 85291 - DNA, 25 bp, Homo sapien
tctttctgctgcgaactcaggcaga

SEQ ID NO: 85292 - DNA, 25 bp, Homo sapien
tgcgaactcaggcagagcactacct

SEQ ID NO: 85293 - DNA, 25 bp, Homo sapien
tcaggcagagcactacctgtggtat

SEQ ID NO: 85294 - DNA, 25 bp, Homo sapien
gcagagcactacctgtggtatggca

SEQ ID NO: 85295 - DNA, 25 bp, Homo sapien
gagcactacctgtggtatggcaagg

SEQ ID NO: 85296 - DNA, 25 bp, Homo sapien
ctgctgtcccttcattctcacactc

SEQ ID NO: 85297 - DNA, 25 bp, Homo sapien
tgctgtcccttcattctcacactca

SEQ ID NO: 85298 - DNA, 25 bp, Homo sapien
gctgtcccttcattctcacactcac

SEQ ID NO: 85299 - DNA, 25 bp, Homo sapien
ctgtcccttcattctcacactcaca

SEQ ID NO: 85300 - DNA, 25 bp, Homo sapien
tgtcccttcattctcacactcacag

SEQ ID NO: 85301 - DNA, 25 bp, Homo sapien
gtcccttcattctcacactcacagg

SEQ ID NO: 85302 - DNA, 25 bp, Homo sapien
tcccttcattctcacactcacagga

SEQ ID NO: 85303 - DNA, 25 bp, Homo sapien
cccttcattctcacactcacaggaa

SEQ ID NO: 85304 - DNA, 25 bp, Homo sapien
ccttcattctcacactcacaggaat

SEQ ID NO: 85305 - DNA, 25 bp, Homo sapien
tattatcacttataggattttgtgg

SEQ ID NO: 85306 - DNA, 25 bp, Homo sapien
attatcacttataggattttgtggg

SEQ ID NO: 85307 - DNA, 25 bp, Homo sapien
tacctatgaagagtaatgggcaaac

SEQ ID NO: 85308 - DNA, 25 bp, Homo sapien
gggcaaactgtagccacataattgt

SEQ ID NO: 85309 - DNA, 25 bp, Homo sapien
gtagccacataattgtaaaattcag

SEQ ID NO: 85310 - DNA, 25 bp, Homo sapien
gatattcatttataccacattgttt

SEQ ID NO: 85311 - DNA, 25 bp, Homo sapien
ccacattgttttataggtaatttct

SEQ ID NO: 85312 - DNA, 25 bp, Homo sapien
aggtaatttctatcacaaaccagtg

SEQ ID NO: 85313 - DNA, 25 bp, Homo sapien
cacaaaccagtgacatttcctgaaa

SEQ ID NO: 85314 - DNA, 25 bp, Homo sapien
atttcctgaaatcaagcctggtaac

SEQ ID NO: 85315 - DNA, 25 bp, Homo sapien
gcctggtaacacctgatgtttatat

SEQ ID NO: 85316 - DNA, 25 bp, Homo sapien
ggacttttaccttactgatttcatg

SEQ ID NO: 85317 - DNA, 25 bp, Homo sapien
gatttcatggagcttttgaagtttg

SEQ ID NO: 85318 - DNA, 25 bp, Homo sapien
cttctgctcagaggctcactcagta

SEQ ID NO: 85319 - DNA, 25 bp, Homo sapien
ggctcactcagtaacgttgtttaat

SEQ ID NO: 85320 - DNA, 25 bp, Homo sapien
taacgttgtttaattctctgccctg

SEQ ID NO: 85321 - DNA, 25 bp, Homo sapien
ggatggattgagagaatgtctttct

SEQ ID NO: 85322 - DNA, 25 bp, Homo sapien
ctctcctaagtctttgctttccctg

SEQ ID NO: 85323 - DNA, 25 bp, Homo sapien
ctttccctgatttcttgatttgatc

SEQ ID NO: 85324 - DNA, 25 bp, Homo sapien
gatcttcaaaggtgggcaaagttcc

SEQ ID NO: 85325 - DNA, 25 bp, Homo sapien
ccactccccatcttactgatttaat

SEQ ID NO: 85326 - DNA, 25 bp, Homo sapien
taatttaatttttcactccccagag

SEQ ID NO: 85327 - DNA, 25 bp, Homo sapien
tttcactccccagagtctaatatgg

SEQ ID NO: 85328 - DNA, 25 bp, Homo sapien
gtctaatatggattctgactcttaa

SEQ ID NO: 85329 - DNA, 25 bp, Homo sapien
gagtctctagaggtagaaatttgcc

SEQ ID NO: 85330 - DNA, 25 bp, Homo sapien
tagaggtagaaatttgccttgctgc

SEQ ID NO: 85331 - DNA, 25 bp, Homo sapien
tctccaggcagggtagtaagctgac

SEQ ID NO: 85332 - DNA, 25 bp, Homo sapien
ggcagggtagtaagctgacactaaa

SEQ ID NO: 85333 - DNA, 25 bp, Homo sapien
ggtagtaagctgacactaaatattt

SEQ ID NO: 85334 - DNA, 25 bp, Homo sapien
gtattgaagcaacaaatatttcctg

SEQ ID NO: 85335 - DNA, 25 bp, Homo sapien
aatatttcctgaagatccaccctgg

SEQ ID NO: 85336 - DNA, 25 bp, Homo sapien
tatttcctgaagatccaccctgggt

SEQ ID NO: 85337 - DNA, 25 bp, Homo sapien
ttcctgaagatccaccctgggtgag

SEQ ID NO: 85338 - DNA, 25 bp, Homo sapien
gaagatccaccctgggtgaggcttt

SEQ ID NO: 85339 - DNA, 25 bp, Homo sapien
caccctgggtgaggctttgagctga

SEQ ID NO: 85340 - DNA, 25 bp, Homo sapien
gccttccgtttcttcttccagggtg

SEQ ID NO: 85341 - DNA, 25 bp, Homo sapien
gggtggcctggtgttcccctagcct

SEQ ID NO: 85342 - DNA, 25 bp, Homo sapien
tagccttccaaacccaggtggcctg

SEQ ID NO: 85343 - DNA, 25 bp, Homo sapien
tccgcccattggtgctcatgcagac

SEQ ID NO: 85344 - DNA, 25 bp, Homo sapien
cattggtgctcatgcagactctggg

SEQ ID NO: 85345 - DNA, 25 bp, Homo sapien
agccgtggctccatggccagatgac

SEQ ID NO: 85346 - DNA, 25 bp, Homo sapien
ggctccatggccagatgacggaaac

SEQ ID NO: 85347 - DNA, 25 bp, Homo sapien
gatgacggaaacagggtctgaccaa

SEQ ID NO: 85348 - DNA, 25 bp, Homo sapien
gaaacagggtctgaccaagtgccag

SEQ ID NO: 85349 - DNA, 25 bp, Homo sapien
aagacctgtgctataaaccaccctg

SEQ ID NO: 85350 - DNA, 25 bp, Homo sapien
tgtgctataaaccaccctgcctgat

SEQ ID NO: 85351 - DNA, 25 bp, Homo sapien
gggagtgatccaagatccttcccac

SEQ ID NO: 85352 - DNA, 25 bp, Homo sapien
aagatccttcccactgtggtatgag

SEQ ID NO: 85353 - DNA, 25 bp, Homo sapien
tcccactgtggtatgaggaggcttt

SEQ ID NO: 85354 - DNA, 25 bp, Homo sapien
agagagagcccaggacagaattgcc

SEQ ID NO: 85355 - DNA, 25 bp, Homo sapien
ggacagaattgccaccacagatgat

SEQ ID NO: 85356 - DNA, 25 bp, Homo sapien
gatgatactactgccatggccagtg

SEQ ID NO: 85357 - DNA, 25 bp, Homo sapien
atggccagtgcaagttctagcgcta

SEQ ID NO: 85358 - DNA, 25 bp, Homo sapien
gttctagcgctacaggtagcttctc

SEQ ID NO: 85359 - DNA, 25 bp, Homo sapien
tagcttctcctaccctgaataaagt

SEQ ID NO: 85360 - DNA, 25 bp, Homo sapien
gtaagacagattcttcactgtgttt

SEQ ID NO: 85361 - DNA, 25 bp, Homo sapien
gtcaaataccacatgattttactca

SEQ ID NO: 85362 - DNA, 25 bp, Homo sapien
cagggataatggtggcattcttaca

SEQ ID NO: 85363 - DNA, 25 bp, Homo sapien
caaactgctcgggaaatagaatgac

SEQ ID NO: 85364 - DNA, 25 bp, Homo sapien
tagaatgacgggaacacttttaggg

SEQ ID NO: 85365 - DNA, 25 bp, Homo sapien
tttagggagcccaggaagttaccag

SEQ ID NO: 85366 - DNA, 25 bp, Homo sapien
gttaccagggacattggtgtcgccg

SEQ ID NO: 85367 - DNA, 25 bp, Homo sapien
gcagcgtacgcttttcaaagatcat

SEQ ID NO: 85368 - DNA, 25 bp, Homo sapien
gatcattgagttgtcttagaatttg

SEQ ID NO: 85369 - DNA, 25 bp, Homo sapien
gaagctgtgtaatgacaatgtcacc

SEQ ID NO: 85370 - DNA, 25 bp, Homo sapien
acaatgtcacctggagttcgtctcc

SEQ ID NO: 85371 - DNA, 25 bp, Homo sapien
gagttcgtctccatttcttaacttt

SEQ ID NO: 85372 - DNA, 25 bp, Homo sapien
tttgttgcacaagtatttggacaga

SEQ ID NO: 85373 - DNA, 25 bp, Homo sapien
ccatgtgggacagttgggctttgtt

SEQ ID NO: 85374 - DNA, 25 bp, Homo sapien
gggctttgttcattctagccacggg

SEQ ID NO: 85375 - DNA, 25 bp, Homo sapien
ggatcttttgcattgcagagatttt

SEQ ID NO: 85376 - DNA, 25 bp, Homo sapien
atatattttgtttgtaatgagccat

SEQ ID NO: 85377 - DNA, 25 bp, Homo sapien
tctcaagactcatctgcctagggag

SEQ ID NO: 85378 - DNA, 25 bp, Homo sapien
actcatctgcctagggagggtcaca

SEQ ID NO: 85379 - DNA, 25 bp, Homo sapien
acagaggcaggatgtaagacacact

SEQ ID NO: 85380 - DNA, 25 bp, Homo sapien
agacacactgtgttgcattcttgca

SEQ ID NO: 85381 - DNA, 25 bp, Homo sapien
attcttgcacaagtcatgaaaatgg

SEQ ID NO: 85382 - DNA, 25 bp, Homo sapien
catgaaaatggagccagagagcctg

SEQ ID NO: 85383 - DNA, 25 bp, Homo sapien
agcacagcacctgaagccatgtggg

SEQ ID NO: 85384 - DNA, 25 bp, Homo sapien
aaggctgatgccaagttgtttgaga

SEQ ID NO: 85385 - DNA, 25 bp, Homo sapien
ctgacatctctgcaatcttctcaga

SEQ ID NO: 85386 - DNA, 25 bp, Homo sapien
tctctgcaatcttctcagaaggcaa

SEQ ID NO: 85387 - DNA, 25 bp, Homo sapien
tcagaaggcaaatgactttggacca

SEQ ID NO: 85388 - DNA, 25 bp, Homo sapien
tgactttggaccataaccccggaag

SEQ ID NO: 85389 - DNA, 25 bp, Homo sapien
gaagccaaacctctgtgagcatcac

SEQ ID NO: 85390 - DNA, 25 bp, Homo sapien
tgagcatcacaaagttttgggttgc

SEQ ID NO: 85391 - DNA, 25 bp, Homo sapien
tttgggttgctttaacatcatcagt

SEQ ID NO: 85392 - DNA, 25 bp, Homo sapien
aatcgcttttgataatcaactgggc

SEQ ID NO: 85393 - DNA, 25 bp, Homo sapien
tcaactgggctgaacaactccaatt

SEQ ID NO: 85394 - DNA, 25 bp, Homo sapien
gggctgaacaactccaattaaggat

SEQ ID NO: 85395 - DNA, 25 bp, Homo sapien
cctggaaaacggagtgagagtgtct

SEQ ID NO: 85396 - DNA, 25 bp, Homo sapien
ggaaaacggagtgagagtgtcttaa

SEQ ID NO: 85397 - DNA, 25 bp, Homo sapien
acggagtgagagtgtcttaaagaaa

SEQ ID NO: 85398 - DNA, 25 bp, Homo sapien
gggccctagagagttctctggtacc

SEQ ID NO: 85399 - DNA, 25 bp, Homo sapien
ggccctagagagttctctggtaccc

SEQ ID NO: 85400 - DNA, 25 bp, Homo sapien
gccctagagagttctctggtaccct

SEQ ID NO: 85401 - DNA, 25 bp, Homo sapien
cctagagagttctctggtaccctgg

SEQ ID NO: 85402 - DNA, 25 bp, Homo sapien
ctagagagttctctggtaccctggt

SEQ ID NO: 85403 - DNA, 25 bp, Homo sapien
tagagagttctctggtaccctggtt

SEQ ID NO: 85404 - DNA, 25 bp, Homo sapien
agagagttctctggtaccctggttt

SEQ ID NO: 85405 - DNA, 25 bp, Homo sapien
gagagttctctggtaccctggtttc

SEQ ID NO: 85406 - DNA, 25 bp, Homo sapien
ctggagaagccctgtcacctgtgca

SEQ ID NO: 85407 - DNA, 25 bp, Homo sapien
agaagccctgtcacctgtgcacatc

SEQ ID NO: 85408 - DNA, 25 bp, Homo sapien
tgtgcacatcttgctggtggaggca

SEQ ID NO: 85409 - DNA, 25 bp, Homo sapien
tttcggctcccacactgatgattct

SEQ ID NO: 85410 - DNA, 25 bp, Homo sapien
cgggcctggcgctacgtactcaggc

SEQ ID NO: 85411 - DNA, 25 bp, Homo sapien
ccagctctcgtgtcctggaggaaga

SEQ ID NO: 85412 - DNA, 25 bp, Homo sapien
gaagagctagctccagacatgggtt

SEQ ID NO: 85413 - DNA, 25 bp, Homo sapien
agctccagacatgggttgatcacct

SEQ ID NO: 85414 - DNA, 25 bp, Homo sapien
tgggttgatcacctagaggagctct

SEQ ID NO: 85415 - DNA, 25 bp, Homo sapien
gatcacctagaggagctctggctaa

SEQ ID NO: 85416 - DNA, 25 bp, Homo sapien
ggctaaggcacagttttctagaaat

SEQ ID NO: 85417 - DNA, 25 bp, Homo sapien
gaaatggttgggaatcgctgttaga

SEQ ID NO: 85418 - DNA, 25 bp, Homo sapien
gggaatcgctgttagaactctagaa

SEQ ID NO: 85419 - DNA, 25 bp, Homo sapien
gaaattctaatctgactttgccact

SEQ ID NO: 85420 - DNA, 25 bp, Homo sapien
cccagagggtagagtgcctcctgtg

SEQ ID NO: 85421 - DNA, 25 bp, Homo sapien
gttagaaagaaccaacagctgcccc

SEQ ID NO: 85422 - DNA, 25 bp, Homo sapien
tgagacaggttctcaaggctcaggg

SEQ ID NO: 85423 - DNA, 25 bp, Homo sapien
gggaagatgcatacctcctatgtaa

SEQ ID NO: 85424 - DNA, 25 bp, Homo sapien
ctcctatgtaagaatgctcttccct

SEQ ID NO: 85425 - DNA, 25 bp, Homo sapien
tcttcccttgctgttattcatacac

SEQ ID NO: 85426 - DNA, 25 bp, Homo sapien
ttattcatacacactttccacttca

SEQ ID NO: 85427 - DNA, 25 bp, Homo sapien
tcatacacactttccacttcaaata

SEQ ID NO: 85428 - DNA, 25 bp, Homo sapien
tcaccttccagaccacagcagatgt

SEQ ID NO: 85429 - DNA, 25 bp, Homo sapien
atgtgggacacacagcctcctgact

SEQ ID NO: 85430 - DNA, 25 bp, Homo sapien
gactccaggaagagccagagctgtg

SEQ ID NO: 85431 - DNA, 25 bp, Homo sapien
ccccacacctagactcagtaaggaa

SEQ ID NO: 85432 - DNA, 25 bp, Homo sapien
tcagtaaggaagtcgggttggacct

SEQ ID NO: 85433 - DNA, 25 bp, Homo sapien
gtcgggttggaccttaacatctgca

SEQ ID NO: 85434 - DNA, 25 bp, Homo sapien
ggaccttaacatctgcattggacaa

SEQ ID NO: 85435 - DNA, 25 bp, Homo sapien
tcctacgtgtccagggcttgggccg

SEQ ID NO: 85436 - DNA, 25 bp, Homo sapien
tgtccagggcttgggccgtgactta

SEQ ID NO: 85437 - DNA, 25 bp, Homo sapien
tagctgcccctttgccaggttaata

SEQ ID NO: 85438 - DNA, 25 bp, Homo sapien
gcccctttgccaggttaataaagca

SEQ ID NO: 85439 - DNA, 25 bp, Homo sapien
agcgaagcctccacaacagaatggg

SEQ ID NO: 85440 - DNA, 25 bp, Homo sapien
agggcagccgggactccctgtctca

SEQ ID NO: 85441 - DNA, 25 bp, Homo sapien
tgtctcacctacattaacccatgca

SEQ ID NO: 85442 - DNA, 25 bp, Homo sapien
aactcactttggtatatccgcgtca

SEQ ID NO: 85443 - DNA, 25 bp, Homo sapien
gtatatccgcgtcacatgcagagag

SEQ ID NO: 85444 - DNA, 25 bp, Homo sapien
agagaggaactctgcgacgtcaaag

SEQ ID NO: 85445 - DNA, 25 bp, Homo sapien
tctgcgacgtcaaagtgttgcttct

SEQ ID NO: 85446 - DNA, 25 bp, Homo sapien
tttcattattggcaactagagggtt

SEQ ID NO: 85447 - DNA, 25 bp, Homo sapien
accaggtgggcaaacctttgcttat

SEQ ID NO: 85448 - DNA, 25 bp, Homo sapien
tttgcttatatacatgcggcctcac

SEQ ID NO: 85449 - DNA, 25 bp, Homo sapien
tgcggcctcacctggaagagaaata

SEQ ID NO: 85450 - DNA, 25 bp, Homo sapien
gatgctaatttttgcacgtttatga

SEQ ID NO: 85451 - DNA, 25 bp, Homo sapien
gcacgtttatgatatttgcaatctt

SEQ ID NO: 85452 - DNA, 25 bp, Homo sapien
tgatatttgcaatctttcatttttg

SEQ ID NO: 85453 - DNA, 25 bp, Homo sapien
atttttgtagcagattatactcaaa

SEQ ID NO: 85454 - DNA, 25 bp, Homo sapien
gaacttggcccctattcttttatca

SEQ ID NO: 85455 - DNA, 25 bp, Homo sapien
gcccctattcttttatcagcacttt

SEQ ID NO: 85456 - DNA, 25 bp, Homo sapien
tatcagcactttaacttgtaaactg

SEQ ID NO: 85457 - DNA, 25 bp, Homo sapien
aaagtttaccatcatctgtatgaca

SEQ ID NO: 85458 - DNA, 25 bp, Homo sapien
atctgtatgacatcctaatgaggtt

SEQ ID NO: 85459 - DNA, 25 bp, Homo sapien
ggtataactgtatccaggtttccac

SEQ ID NO: 85460 - DNA, 25 bp, Homo sapien
ataactgtatccaggtttccacagc

SEQ ID NO: 85461 - DNA, 25 bp, Homo sapien
atgtgggacacacagcctcctgact

SEQ ID NO: 85462 - DNA, 25 bp, Homo sapien
tgtgggacacacagcctcctgactc

SEQ ID NO: 85463 - DNA, 25 bp, Homo sapien
gggacacacagcctcctgactccag

SEQ ID NO: 85464 - DNA, 25 bp, Homo sapien
cctgcccgcctacactcctacgtgt

SEQ ID NO: 85465 - DNA, 25 bp, Homo sapien
ctcctacgtgtccagggcttgggcc

SEQ ID NO: 85466 - DNA, 25 bp, Homo sapien
tcctacgtgtccagggcttgggccg

SEQ ID NO: 85467 - DNA, 25 bp, Homo sapien
cctacgtgtccagggcttgggccgt

SEQ ID NO: 85468 - DNA, 25 bp, Homo sapien
tgtccagggcttgggccgtgactta

SEQ ID NO: 85469 - DNA, 25 bp, Homo sapien
agggcttgggccgtgacttaggcag

SEQ ID NO: 85470 - DNA, 25 bp, Homo sapien
gggcttgggccgtgacttaggcaga

SEQ ID NO: 85471 - DNA, 25 bp, Homo sapien
ggcttgggccgtgacttaggcagag

SEQ ID NO: 85472 - DNA, 25 bp, Homo sapien
ttaagagccaatcactgatccccaa

SEQ ID NO: 85473 - DNA, 25 bp, Homo sapien
tgatccccaagtgttccttgagcat

SEQ ID NO: 85474 - DNA, 25 bp, Homo sapien
agtgttccttgagcatctggtctgg

SEQ ID NO: 85475 - DNA, 25 bp, Homo sapien
tttgatcggacccacccttggaaag

SEQ ID NO: 85476 - DNA, 25 bp, Homo sapien
tcggacccacccttggaaagctcag

SEQ ID NO: 85477 - DNA, 25 bp, Homo sapien
gtaggcccaggtgggatgctcaccc

SEQ ID NO: 85478 - DNA, 25 bp, Homo sapien
ggatgctcaccctgtcactgagggt

SEQ ID NO: 85479 - DNA, 25 bp, Homo sapien
gtcactgagggttttggttggcatc

SEQ ID NO: 85480 - DNA, 25 bp, Homo sapien
ttttggttggcatcgttgtttttga

SEQ ID NO: 85481 - DNA, 25 bp, Homo sapien
gcatcgttgtttttgaatgtagcac

SEQ ID NO: 85482 - DNA, 25 bp, Homo sapien
gtagcacaagcgatgagcaaactct

SEQ ID NO: 85483 - DNA, 25 bp, Homo sapien
atatggcgggcttcgcaccttttgt

SEQ ID NO: 85484 - DNA, 25 bp, Homo sapien
accttttgtcaacctgcaggtctga

SEQ ID NO: 85485 - DNA, 25 bp, Homo sapien
ggtctgacccgcctgccaatcggag

SEQ ID NO: 85486 - DNA, 25 bp, Homo sapien
gccaatcggagcacagctggactgt

SEQ ID NO: 85487 - DNA, 25 bp, Homo sapien
ggcctgacactgagctgtagggaaa

SEQ ID NO: 85488 - DNA, 25 bp, Homo sapien
gaaactgaactgtgaggacctctgg

SEQ ID NO: 85489 - DNA, 25 bp, Homo sapien
acctctggtgagaggccagtgccct

SEQ ID NO: 85490 - DNA, 25 bp, Homo sapien
tgcgggtgcggcactgccaccatgt

SEQ ID NO: 85491 - DNA, 25 bp, Homo sapien
ccatgtggcggagtccagcctgagc

SEQ ID NO: 85492 - DNA, 25 bp, Homo sapien
agtccagcctgagccgcttgcggaa

SEQ ID NO: 85493 - DNA, 25 bp, Homo sapien
acatcgacgtggagccgccgctgca

SEQ ID NO: 85494 - DNA, 25 bp, Homo sapien
cttttcctcggcaatttcttcacca

SEQ ID NO: 85495 - DNA, 25 bp, Homo sapien
aatttcttcaccaccctgagggttg

SEQ ID NO: 85496 - DNA, 25 bp, Homo sapien
caccctgagggttgtgcaccacaag

SEQ ID NO: 85497 - DNA, 25 bp, Homo sapien
tgcaccacaagtttcacagtcagcg

SEQ ID NO: 85498 - DNA, 25 bp, Homo sapien
aagtttcacagtcagcggcacggga

SEQ ID NO: 85499 - DNA, 25 bp, Homo sapien
acagtcagcggcacgggagcaagaa

SEQ ID NO: 85500 - DNA, 25 bp, Homo sapien
caagaaggattgaggctgggccttc

SEQ ID NO: 85501 - DNA, 25 bp, Homo sapien
gcccctcgagtgtgcgtgtatcagg

SEQ ID NO: 85502 - DNA, 25 bp, Homo sapien
ttctattctcccttgggttttatgg

SEQ ID NO: 85503 - DNA, 25 bp, Homo sapien
tcccttgggttttatgggcgctgtg

SEQ ID NO: 85504 - DNA, 25 bp, Homo sapien
agtgccctcaataaagagaggccca

SEQ ID NO: 85505 - DNA, 25 bp, Homo sapien
catcaacgcagtggccacgctagag

SEQ ID NO: 85506 - DNA, 25 bp, Homo sapien
agtggccacgctagagaaagtcatc

SEQ ID NO: 85507 - DNA, 25 bp, Homo sapien
gccacgctagagaaagtcatcgaga

SEQ ID NO: 85508 - DNA, 25 bp, Homo sapien
gtcatcgagatccagagcaaacact

SEQ ID NO: 85509 - DNA, 25 bp, Homo sapien
gcaaacactggagctgtgtgcagaa

SEQ ID NO: 85510 - DNA, 25 bp, Homo sapien
gtgtgcagaagttcgccgctggtct

SEQ ID NO: 85511 - DNA, 25 bp, Homo sapien
gtgagaccgaggaggccgagactgt

SEQ ID NO: 85512 - DNA, 25 bp, Homo sapien
ccgagactgtgagcgccatggcctt

SEQ ID NO: 85513 - DNA, 25 bp, Homo sapien
tgtgagcgccatggccttgctgtcg

SEQ ID NO: 85514 - DNA, 25 bp, Homo sapien
gaacacagccccaggccggcagagg

SEQ ID NO: 85515 - DNA, 25 bp, Homo sapien
catggagcaggagcctgccctgtga

SEQ ID NO: 85516 - DNA, 25 bp, Homo sapien
gaagtcctgggtgttaatattttgc

SEQ ID NO: 85517 - DNA, 25 bp, Homo sapien
gatctgttttccatgatgtgttgac

SEQ ID NO: 85518 - DNA, 25 bp, Homo sapien
gtgttgacatctacaatttcactaa

SEQ ID NO: 85519 - DNA, 25 bp, Homo sapien
tctattgagattctggagcctaggg

SEQ ID NO: 85520 - DNA, 25 bp, Homo sapien
gagcctagggagctatgtgttcttt

SEQ ID NO: 85521 - DNA, 25 bp, Homo sapien
ttgttcatttcgttcttacttccct

SEQ ID NO: 85522 - DNA, 25 bp, Homo sapien
aagagactatatggccttcagtgca

SEQ ID NO: 85523 - DNA, 25 bp, Homo sapien
ggccttcagtgcaaagacttcagac

SEQ ID NO: 85524 - DNA, 25 bp, Homo sapien
gacttcagaccaattctttgtatta

SEQ ID NO: 85525 - DNA, 25 bp, Homo sapien
tttgtattacacttggttgcctctt

SEQ ID NO: 85526 - DNA, 25 bp, Homo sapien
ttgcctcttggctatataacttctg

SEQ ID NO: 85527 - DNA, 25 bp, Homo sapien
ttcttactattcaacaaactctcag

SEQ ID NO: 85528 - DNA, 25 bp, Homo sapien
attcaacaaactctcagttggcccc

SEQ ID NO: 85529 - DNA, 25 bp, Homo sapien
cccctacagcagtctggtgttgaag

SEQ ID NO: 85530 - DNA, 25 bp, Homo sapien
cagcagtctggtgttgaagtttctt

SEQ ID NO: 85531 - DNA, 25 bp, Homo sapien
gtgttgaagtttctttgaacgaact

SEQ ID NO: 85532 - DNA, 25 bp, Homo sapien
gaacgaactaaatatactcatttta

SEQ ID NO: 85533 - DNA, 25 bp, Homo sapien
aatgcaaaattctaaattccatgaa

SEQ ID NO: 85534 - DNA, 25 bp, Homo sapien
gaaacatggaatttatgacaccaaa

SEQ ID NO: 85535 - DNA, 25 bp, Homo sapien
atttatgacaccaaaatcaatggag

SEQ ID NO: 85536 - DNA, 25 bp, Homo sapien
gagtaagcagcagcaaactgagaat

SEQ ID NO: 85537 - DNA, 25 bp, Homo sapien
ctgagaattatccagcatatgaata

SEQ ID NO: 85538 - DNA, 25 bp, Homo sapien
ttttccctcgcccatgtgggtcagt

SEQ ID NO: 85539 - DNA, 25 bp, Homo sapien
tgggagctgcaggtgtcagcttttc

SEQ ID NO: 85540 - DNA, 25 bp, Homo sapien
caggtgtcagcttttcgtctagtaa

SEQ ID NO: 85541 - DNA, 25 bp, Homo sapien
gtcagcttttcgtctagtaacttaa

SEQ ID NO: 85542 - DNA, 25 bp, Homo sapien
gcttttcgtctagtaacttaagtga

SEQ ID NO: 85543 - DNA, 25 bp, Homo sapien
agagaaagggcagcgccacagaagc

SEQ ID NO: 85544 - DNA, 25 bp, Homo sapien
agggcagcgccacagaagcccctaa

SEQ ID NO: 85545 - DNA, 25 bp, Homo sapien
ggactgtgactacagcgctcccggc

SEQ ID NO: 85546 - DNA, 25 bp, Homo sapien
gtgactacagcgctcccggctgagc

SEQ ID NO: 85547 - DNA, 25 bp, Homo sapien
cccgtaatgccctcatgtgaatgtt

SEQ ID NO: 85548 - DNA, 25 bp, Homo sapien
aatgttcttcgggaaatatttctgc

SEQ ID NO: 85549 - DNA, 25 bp, Homo sapien
ggatttttgagcacacaattatgca

SEQ ID NO: 85550 - DNA, 25 bp, Homo sapien
gcacacaattatgcaaatattttaa

SEQ ID NO: 85551 - DNA, 25 bp, Homo sapien
attaatgtttacagtggaattgtga

SEQ ID NO: 85552 - DNA, 25 bp, Homo sapien
gaataagttttcagtggactatctt

SEQ ID NO: 85553 - DNA, 25 bp, Homo sapien
agttttcagtggactatcttatccc

SEQ ID NO: 85554 - DNA, 25 bp, Homo sapien
ttttcagtggactatcttatccctt

SEQ ID NO: 85555 - DNA, 25 bp, Homo sapien
ttcagtggactatcttatcccttga

SEQ ID NO: 85556 - DNA, 25 bp, Homo sapien
cagtggactatcttatcccttgaca

SEQ ID NO: 85557 - DNA, 25 bp, Homo sapien
gtggactatcttatcccttgacaaa

SEQ ID NO: 85558 - DNA, 25 bp, Homo sapien
ggactatcttatcccttgacaaaaa

SEQ ID NO: 85559 - DNA, 25 bp, Homo sapien
actatcttatcccttgacaaaaata

SEQ ID NO: 85560 - DNA, 25 bp, Homo sapien
gatcagacatgtgggctccccgaag

SEQ ID NO: 85561 - DNA, 25 bp, Homo sapien
aagcccagccagagactgccgtgct

SEQ ID NO: 85562 - DNA, 25 bp, Homo sapien
cagccgggtgaggactctgtcctgt

SEQ ID NO: 85563 - DNA, 25 bp, Homo sapien
gggtgaggactctgtcctgtgtcac

SEQ ID NO: 85564 - DNA, 25 bp, Homo sapien
gtgtccagctgtctcatgccttttt

SEQ ID NO: 85565 - DNA, 25 bp, Homo sapien
tcagctctccgtgtggtcagcgaaa

SEQ ID NO: 85566 - DNA, 25 bp, Homo sapien
tctccgtgtggtcagcgaaaccatt

SEQ ID NO: 85567 - DNA, 25 bp, Homo sapien
gtcagcgaaaccattgttttctgtt

SEQ ID NO: 85568 - DNA, 25 bp, Homo sapien
gttttctgttaggactcagttgcaa

SEQ ID NO: 85569 - DNA, 25 bp, Homo sapien
tctgttaggactcagttgcaagaac

SEQ ID NO: 85570 - DNA, 25 bp, Homo sapien
aagtttattgatgggtggttgcaaa

SEQ ID NO: 85571 - DNA, 25 bp, Homo sapien
caggtagaaacgtgggttaagctct

SEQ ID NO: 85572 - DNA, 25 bp, Homo sapien
tagaaacgtgggttaagctcttcct

SEQ ID NO: 85573 - DNA, 25 bp, Homo sapien
agaaacgtgggttaagctcttcctg

SEQ ID NO: 85574 - DNA, 25 bp, Homo sapien
gaaacgtgggttaagctcttcctgc

SEQ ID NO: 85575 - DNA, 25 bp, Homo sapien
agctcttcctgccccgttcagcttc

SEQ ID NO: 85576 - DNA, 25 bp, Homo sapien
gctcttcctgccccgttcagcttca

SEQ ID NO: 85577 - DNA, 25 bp, Homo sapien
tcttcctgccccgttcagcttcact

SEQ ID NO: 85578 - DNA, 25 bp, Homo sapien
cttcctgccccgttcagcttcactc

SEQ ID NO: 85579 - DNA, 25 bp, Homo sapien
ttcctgccccgttcagcttcactcc

SEQ ID NO: 85580 - DNA, 25 bp, Homo sapien
cctgccccgttcagcttcactccca

SEQ ID NO: 85581 - DNA, 25 bp, Homo sapien
ctgccccgttcagcttcactcccac

SEQ ID NO: 85582 - DNA, 25 bp, Homo sapien
gttccaaagtagttacgaggcttgt

SEQ ID NO: 85583 - DNA, 25 bp, Homo sapien
attccccaggcctatttccatagat

SEQ ID NO: 85584 - DNA, 25 bp, Homo sapien
gtttgtttccaacgaagctgctgtt

SEQ ID NO: 85585 - DNA, 25 bp, Homo sapien
tgagaaaaactttgccccggaatag

SEQ ID NO: 85586 - DNA, 25 bp, Homo sapien
gccccggaatagcactttaatagtc

SEQ ID NO: 85587 - DNA, 25 bp, Homo sapien
aaatgtgtttacctgtctgattgag

SEQ ID NO: 85588 - DNA, 25 bp, Homo sapien
acctgtctgattgagtgagcctttt

SEQ ID NO: 85589 - DNA, 25 bp, Homo sapien
gagccttttggtgagctcagctgag

SEQ ID NO: 85590 - DNA, 25 bp, Homo sapien
gttaaatatacccacaccacccatg

SEQ ID NO: 85591 - DNA, 25 bp, Homo sapien
acaccacccatgaaagtcactgttt

SEQ ID NO: 85592 - DNA, 25 bp, Homo sapien
gtttaagttacatcatcctccaaat

SEQ ID NO: 85593 - DNA, 25 bp, Homo sapien
ggcagcaaaggcgtgtccccttctg

SEQ ID NO: 85594 - DNA, 25 bp, Homo sapien
aggcgtgtccccttctgtcagacag

SEQ ID NO: 85595 - DNA, 25 bp, Homo sapien
ctgtcagacagcttcacagagtgtg

SEQ ID NO: 85596 - DNA, 25 bp, Homo sapien
ttcaccagtcagagggagcagtccg

SEQ ID NO: 85597 - DNA, 25 bp, Homo sapien
gagaggcaagatgaccccaccggga

SEQ ID NO: 85598 - DNA, 25 bp, Homo sapien
agagcctcctccttactaacaagga

SEQ ID NO: 85599 - DNA, 25 bp, Homo sapien
gggagtgccagcaacaggcctgtcc

SEQ ID NO: 85600 - DNA, 25 bp, Homo sapien
gtcccctggcaagttggccacggaa

SEQ ID NO: 85601 - DNA, 25 bp, Homo sapien
acggaacccaccatgcactgcaagg

SEQ ID NO: 85602 - DNA, 25 bp, Homo sapien
accatgcactgcaaggctgtgacag

SEQ ID NO: 85603 - DNA, 25 bp, Homo sapien
tgcttctcctctgcttgtacggttc

SEQ ID NO: 85604 - DNA, 25 bp, Homo sapien
gctggagaattacaggaatcttctc

SEQ ID NO: 85605 - DNA, 25 bp, Homo sapien
gaattacaggaatcttctctcattg

SEQ ID NO: 85606 - DNA, 25 bp, Homo sapien
aattacaggaatcttctctcattgg

SEQ ID NO: 85607 - DNA, 25 bp, Homo sapien
attacaggaatcttctctcattggg

SEQ ID NO: 85608 - DNA, 25 bp, Homo sapien
ttacaggaatcttctctcattgggt

SEQ ID NO: 85609 - DNA, 25 bp, Homo sapien
tacaggaatcttctctcattgggtc

SEQ ID NO: 85610 - DNA, 25 bp, Homo sapien
acaggaatcttctctcattgggtca

SEQ ID NO: 85611 - DNA, 25 bp, Homo sapien
caggaatcttctctcattgggtcag

SEQ ID NO: 85612 - DNA, 25 bp, Homo sapien
aggaatcttctctcattgggtcagg

SEQ ID NO: 85613 - DNA, 25 bp, Homo sapien
ggaatcttctctcattgggtcagga

SEQ ID NO: 85614 - DNA, 25 bp, Homo sapien
gaatcttctctcattgggtcaggag

SEQ ID NO: 85615 - DNA, 25 bp, Homo sapien
gttcactaacgaaggaccaacggct

SEQ ID NO: 85616 - DNA, 25 bp, Homo sapien
gtaccttccttcttgcgacttggat

SEQ ID NO: 85617 - DNA, 25 bp, Homo sapien
gcgacttggatcctggaacgtcatt

SEQ ID NO: 85618 - DNA, 25 bp, Homo sapien
tggaacgtcattatgtttgtgtgct

SEQ ID NO: 85619 - DNA, 25 bp, Homo sapien
gcagactatggactgtgccacataa

SEQ ID NO: 85620 - DNA, 25 bp, Homo sapien
tgccacttggtgtcggctcttatcg

SEQ ID NO: 85621 - DNA, 25 bp, Homo sapien
ggctcttatcgctggattttgcgca

SEQ ID NO: 85622 - DNA, 25 bp, Homo sapien
gattttgcgcaacagctatgtcctc

SEQ ID NO: 85623 - DNA, 25 bp, Homo sapien
atgtcctccccggtggatgtagtaa

SEQ ID NO: 85624 - DNA, 25 bp, Homo sapien
ttctccaccaggacagtacaaaagt

SEQ ID NO: 85625 - DNA, 25 bp, Homo sapien
aaagtgtgcccaactgtgcaatgaa

SEQ ID NO: 85626 - DNA, 25 bp, Homo sapien
gacaggaagtattgtttcagtcaca

SEQ ID NO: 85627 - DNA, 25 bp, Homo sapien
tgtttcagtcacagaaagcttttct

SEQ ID NO: 85628 - DNA, 25 bp, Homo sapien
ttctgggtacctctggttagcactt

SEQ ID NO: 85629 - DNA, 25 bp, Homo sapien
gggtacctctggttagcactttcta

SEQ ID NO: 85630 - DNA, 25 bp, Homo sapien
gtacctctggttagcactttctact

SEQ ID NO: 85631 - DNA, 25 bp, Homo sapien
tggttagcactttctactctctgat

SEQ ID NO: 85632 - DNA, 25 bp, Homo sapien
gttagcactttctactctctgatat

SEQ ID NO: 85633 - DNA, 25 bp, Homo sapien
agcactttctactctctgatatttc

SEQ ID NO: 85634 - DNA, 25 bp, Homo sapien
actttctactctctgatatttccta

SEQ ID NO: 85635 - DNA, 25 bp, Homo sapien
tcagaataatgagacaacttgttaa

SEQ ID NO: 85636 - DNA, 25 bp, Homo sapien
gacaacttgttaatctctttaatac

SEQ ID NO: 85637 - DNA, 25 bp, Homo sapien
acttttagtcacttagacaggcttt

SEQ ID NO: 85638 - DNA, 25 bp, Homo sapien
gacaggcttttagatgaatctgcac

SEQ ID NO: 85639 - DNA, 25 bp, Homo sapien
gaaattacacttttcttgtctgcgt

SEQ ID NO: 85640 - DNA, 25 bp, Homo sapien
acttttcttgtctgcgtgtaatgtt

SEQ ID NO: 85641 - DNA, 25 bp, Homo sapien
ctgcgtgtaatgtttgcctggatcc

SEQ ID NO: 85642 - DNA, 25 bp, Homo sapien
gcctggatccaataatttacttttt

SEQ ID NO: 85643 - DNA, 25 bp, Homo sapien
actttttcatgtgtaggtcattttc

SEQ ID NO: 85644 - DNA, 25 bp, Homo sapien
ggtcattttcaagaaggctgttcaa

SEQ ID NO: 85645 - DNA, 25 bp, Homo sapien
gaaagcatcagatcactgcaaagtg

SEQ ID NO: 85646 - DNA, 25 bp, Homo sapien
gaagatcggaagttcgcatatatta

SEQ ID NO: 85647 - DNA, 25 bp, Homo sapien
acactgatgtgtaggccttttattg

SEQ ID NO: 85648 - DNA, 25 bp, Homo sapien
aaatctgttcagtttgcattggtac

SEQ ID NO: 85649 - DNA, 25 bp, Homo sapien
tgttcagtttgcattggtacttact

SEQ ID NO: 85650 - DNA, 25 bp, Homo sapien
ggtacttactgtggacttcatagct

SEQ ID NO: 85651 - DNA, 25 bp, Homo sapien
ttactgtggacttcatagcttactg

SEQ ID NO: 85652 - DNA, 25 bp, Homo sapien
ggacttcatagcttactgacagata

SEQ ID NO: 85653 - DNA, 25 bp, Homo sapien
tattgacagactttgcagccttgct

SEQ ID NO: 85654 - DNA, 25 bp, Homo sapien
aacttctacaaaactctagtatggg

SEQ ID NO: 85655 - DNA, 25 bp, Homo sapien
aaactctagtatgggcttctgactt

SEQ ID NO: 85656 - DNA, 25 bp, Homo sapien
ttctgactttttccagggtgtagaa

SEQ ID NO: 85657 - DNA, 25 bp, Homo sapien
tccagggtgtagaatttgactcaaa

SEQ ID NO: 85658 - DNA, 25 bp, Homo sapien
gttttagtatattctactttcatta

SEQ ID NO: 85659 - DNA, 25 bp, Homo sapien
tataattacatatttcattcccaat

SEQ ID NO: 85660 - DNA, 25 bp, Homo sapien
tttgggaaaccaagtctataagaca

SEQ ID NO: 85661 - DNA, 25 bp, Homo sapien
gtctataagacatcttgtgatttct

SEQ ID NO: 85662 - DNA, 25 bp, Homo sapien
gacatcttgtgatttcttaatgttt

SEQ ID NO: 85663 - DNA, 25 bp, Homo sapien
tgtttttcaaagatatcactgtcct

SEQ ID NO: 85664 - DNA, 25 bp, Homo sapien
aagatatcactgtcctttatcatgt

SEQ ID NO: 85665 - DNA, 25 bp, Homo sapien
tatcactgtcctttatcatgttttg

SEQ ID NO: 85666 - DNA, 25 bp, Homo sapien
tcactgtcctttatcatgttttgaa

SEQ ID NO: 85667 - DNA, 25 bp, Homo sapien
attttcctaaattaatgtgcaagta

SEQ ID NO: 85668 - DNA, 25 bp, Homo sapien
atgttttgaggatatcggtgtttta

SEQ ID NO: 85669 - DNA, 25 bp, Homo sapien
gaggatatcggtgttttatattaaa

SEQ ID NO: 85670 - DNA, 25 bp, Homo sapien
atacagcagccggtttggtctcttc

SEQ ID NO: 85671 - DNA, 25 bp, Homo sapien
tggtctcttccacgttgattttgaa

SEQ ID NO: 85672 - DNA, 25 bp, Homo sapien
cacgttgattttgaagacccagcta

SEQ ID NO: 85673 - DNA, 25 bp, Homo sapien
agtcccttacacatcggccaaggaa

SEQ ID NO: 85674 - DNA, 25 bp, Homo sapien
ggaatatgccaagatcatccgaaac

SEQ ID NO: 85675 - DNA, 25 bp, Homo sapien
gatcatccgaaacaatggccttgaa

SEQ ID NO: 85676 - DNA, 25 bp, Homo sapien
gccttgaagcacatctgtaggcaag

SEQ ID NO: 85677 - DNA, 25 bp, Homo sapien
acaggagaggcgtctgcttttggaa

SEQ ID NO: 85678 - DNA, 25 bp, Homo sapien
aatctgctttggtgatgatctttca

SEQ ID NO: 85679 - DNA, 25 bp, Homo sapien
gtgatgatctttcaggcaatctcaa

SEQ ID NO: 85680 - DNA, 25 bp, Homo sapien
ggtctgaatatgtaatgcctcgtga

SEQ ID NO: 85681 - DNA, 25 bp, Homo sapien
gagaaaggcttccccaccacacttt

SEQ ID NO: 85682 - DNA, 25 bp, Homo sapien
tttccgctttcacttcctcgctaga

SEQ ID NO: 85683 - DNA, 25 bp, Homo sapien
ttcctcgctagagtctccagacagg

SEQ ID NO: 85684 - DNA, 25 bp, Homo sapien
gctagagtctccagacagggttcat

SEQ ID NO: 85685 - DNA, 25 bp, Homo sapien
gagtctccagacagggttcattgaa

SEQ ID NO: 85686 - DNA, 25 bp, Homo sapien
agtctccagacagggttcattgaaa

SEQ ID NO: 85687 - DNA, 25 bp, Homo sapien
ttcattgaaaacttagtctgtggag

SEQ ID NO: 85688 - DNA, 25 bp, Homo sapien
gaaaacttagtctgtggagaaccag

SEQ ID NO: 85689 - DNA, 25 bp, Homo sapien
ggagaaccagaagggctaactcagt

SEQ ID NO: 85690 - DNA, 25 bp, Homo sapien
aaccagaagggctaactcagtttgt

SEQ ID NO: 85691 - DNA, 25 bp, Homo sapien
tattttccgggatagagtcttgctc

SEQ ID NO: 85692 - DNA, 25 bp, Homo sapien
gtacaaccagttgaaatttccagta

SEQ ID NO: 85693 - DNA, 25 bp, Homo sapien
ttccagtaaagcctgctgatcttaa

SEQ ID NO: 85694 - DNA, 25 bp, Homo sapien
ccagtaaagcctgctgatcttaaga

SEQ ID NO: 85695 - DNA, 25 bp, Homo sapien
gtaaagcctgctgatcttaagaaga

SEQ ID NO: 85696 - DNA, 25 bp, Homo sapien
aaagcctgctgatcttaagaagaga

SEQ ID NO: 85697 - DNA, 25 bp, Homo sapien
gcctgctgatcttaagaagagaata

SEQ ID NO: 85698 - DNA, 25 bp, Homo sapien
accgggactacatggaaagagataa

SEQ ID NO: 85699 - DNA, 25 bp, Homo sapien
gaaaatccaaaccagtacaactata

SEQ ID NO: 85700 - DNA, 25 bp, Homo sapien
aaaccagtacaactatattgcatag

SEQ ID NO: 85701 - DNA, 25 bp, Homo sapien
gcatagaatgttggccttgcagcat

SEQ ID NO: 85702 - DNA, 25 bp, Homo sapien
tagaatgttggccttgcagcatttg

SEQ ID NO: 85703 - DNA, 25 bp, Homo sapien
gaataccattcgagacgtttcgttg

SEQ ID NO: 85704 - DNA, 25 bp, Homo sapien
gacgtttcgttgaaaattgcagtaa

SEQ ID NO: 85705 - DNA, 25 bp, Homo sapien
aagatggccactgtttatcctgaac

SEQ ID NO: 85706 - DNA, 25 bp, Homo sapien
caaagaagaatttgtctcctcccag

SEQ ID NO: 85707 - DNA, 25 bp, Homo sapien
gatgtacagcactaattatgaccag

SEQ ID NO: 85708 - DNA, 25 bp, Homo sapien
gcactaattatgaccagatcctacc

SEQ ID NO: 85709 - DNA, 25 bp, Homo sapien
gatcctacctgattgttatccgtgg

SEQ ID NO: 85710 - DNA, 25 bp, Homo sapien
attgttatccgtggcctgcagaagt

SEQ ID NO: 85711 - DNA, 25 bp, Homo sapien
aagtcaaccagtaacgcaacagcta

SEQ ID NO: 85712 - DNA, 25 bp, Homo sapien
acgcaacagctaggatttttaactt

SEQ ID NO: 85713 - DNA, 25 bp, Homo sapien
catgatctttaagggtcagaatctt

SEQ ID NO: 85714 - DNA, 25 bp, Homo sapien
gtgtatattgtataggggcaactgt

SEQ ID NO: 85715 - DNA, 25 bp, Homo sapien
gtatattgtataggggcaactgtat

SEQ ID NO: 85716 - DNA, 25 bp, Homo sapien
atattgtataggggcaactgtatga

SEQ ID NO: 85717 - DNA, 25 bp, Homo sapien
tattgtataggggcaactgtatgaa

SEQ ID NO: 85718 - DNA, 25 bp, Homo sapien
attgtataggggcaactgtatgaaa

SEQ ID NO: 85719 - DNA, 25 bp, Homo sapien
ttgtataggggcaactgtatgaaaa

SEQ ID NO: 85720 - DNA, 25 bp, Homo sapien
tgtataggggcaactgtatgaaaaa

SEQ ID NO: 85721 - DNA, 25 bp, Homo sapien
gtataggggcaactgtatgaaaaat

SEQ ID NO: 85722 - DNA, 25 bp, Homo sapien
tataggggcaactgtatgaaaaatt

SEQ ID NO: 85723 - DNA, 25 bp, Homo sapien
gtgagtttcggggtcagtgtcccac

SEQ ID NO: 85724 - DNA, 25 bp, Homo sapien
cttcacttcccgagggcgggtgagt

SEQ ID NO: 85725 - DNA, 25 bp, Homo sapien
gcagctgtggacagatgtgcttcct

SEQ ID NO: 85726 - DNA, 25 bp, Homo sapien
cagatgtgcttcctgagcatgggtt

SEQ ID NO: 85727 - DNA, 25 bp, Homo sapien
tgtgcttcctgagcatgggttgtgc

SEQ ID NO: 85728 - DNA, 25 bp, Homo sapien
gcttcctgagcatgggttgtgcctc

SEQ ID NO: 85729 - DNA, 25 bp, Homo sapien
tgagcatgggttgtgcctcccatca

SEQ ID NO: 85730 - DNA, 25 bp, Homo sapien
ggttgtgcctcccatcagtaaaaaa

SEQ ID NO: 85731 - DNA, 25 bp, Homo sapien
aatgtttagttcacttccttaattg

SEQ ID NO: 85732 - DNA, 25 bp, Homo sapien
gtttagttcacttccttaattgtat

SEQ ID NO: 85733 - DNA, 25 bp, Homo sapien
agttcacttccttaattgtataatt

SEQ ID NO: 85734 - DNA, 25 bp, Homo sapien
agggatgctgtgttcacccttcttg

SEQ ID NO: 85735 - DNA, 25 bp, Homo sapien
gtgttcacccttcttggtagaagct

SEQ ID NO: 85736 - DNA, 25 bp, Homo sapien
ggaccccagaagtcctttatctgtg

SEQ ID NO: 85737 - DNA, 25 bp, Homo sapien
agaagtcctttatctgtgctctctg

SEQ ID NO: 85738 - DNA, 25 bp, Homo sapien
ccgccagtgccttacaatttgcaaa

SEQ ID NO: 85739 - DNA, 25 bp, Homo sapien
atttgcaaacgtgtatagcctcagt

SEQ ID NO: 85740 - DNA, 25 bp, Homo sapien
tagcctcagtgactcattcgctgaa

SEQ ID NO: 85741 - DNA, 25 bp, Homo sapien
tcattcgctgaaatccttcgcttta

SEQ ID NO: 85742 - DNA, 25 bp, Homo sapien
atccttcgctttaccaaatctagac

SEQ ID NO: 85743 - DNA, 25 bp, Homo sapien
atgtgagtccgcttgatgaattcta

SEQ ID NO: 85744 - DNA, 25 bp, Homo sapien
gcttgatgaattctaatgctttgct

SEQ ID NO: 85745 - DNA, 25 bp, Homo sapien
cgctggtgggtgtcacgccatcttg

SEQ ID NO: 85746 - DNA, 25 bp, Homo sapien
gtcacgccatcttggggtgtggtca

SEQ ID NO: 85747 - DNA, 25 bp, Homo sapien
gggtgtggtcacctgggccgggcag

SEQ ID NO: 85748 - DNA, 25 bp, Homo sapien
ggcctgagtagatgtcagcccattg

SEQ ID NO: 85749 - DNA, 25 bp, Homo sapien
tgagtagatgtcagcccattgccat

SEQ ID NO: 85750 - DNA, 25 bp, Homo sapien
tagatgtcagcccattgccatgtca

SEQ ID NO: 85751 - DNA, 25 bp, Homo sapien
atgtcagcccattgccatgtcatga

SEQ ID NO: 85752 - DNA, 25 bp, Homo sapien
tcagcccattgccatgtcatgactt

SEQ ID NO: 85753 - DNA, 25 bp, Homo sapien
agcccattgccatgtcatgactttt

SEQ ID NO: 85754 - DNA, 25 bp, Homo sapien
aattgtactttatgactggtttggt

SEQ ID NO: 85755 - DNA, 25 bp, Homo sapien
gtactttatgactggtttggtataa

SEQ ID NO: 85756 - DNA, 25 bp, Homo sapien
ggaaacatcacaaaactgagcactc

SEQ ID NO: 85757 - DNA, 25 bp, Homo sapien
aactgagcactcttctgtgcactag

SEQ ID NO: 85758 - DNA, 25 bp, Homo sapien
ttctgtgcactagccatagctggtg

SEQ ID NO: 85759 - DNA, 25 bp, Homo sapien
tagccatagctggtgacaaacagat

SEQ ID NO: 85760 - DNA, 25 bp, Homo sapien
caaacagatggttgctcagggacaa

SEQ ID NO: 85761 - DNA, 25 bp, Homo sapien
ttgctcagggacaaggtgccttcca

SEQ ID NO: 85762 - DNA, 25 bp, Homo sapien
aggtgccttccaatggaaatgcgaa

SEQ ID NO: 85763 - DNA, 25 bp, Homo sapien
ggaaatgcgaagtagttgctatagc

SEQ ID NO: 85764 - DNA, 25 bp, Homo sapien
tgggaactgggatataagtcataat

SEQ ID NO: 85765 - DNA, 25 bp, Homo sapien
gattggtttgtaacattccttaagt

SEQ ID NO: 85766 - DNA, 25 bp, Homo sapien
aagttcacattcatacatttattta

SEQ ID NO: 85767 - DNA, 25 bp, Homo sapien
catgggaaaggagttgtggccaaaa

SEQ ID NO: 85768 - DNA, 25 bp, Homo sapien
gagttgtggccaaaatccccatctt

SEQ ID NO: 85769 - DNA, 25 bp, Homo sapien
tgtggccaaaatccccatcttcttg

SEQ ID NO: 85770 - DNA, 25 bp, Homo sapien
atcttcttgcacctcaacgtctgtg

SEQ ID NO: 85771 - DNA, 25 bp, Homo sapien
ttgcacctcaacgtctgtggctcag

SEQ ID NO: 85772 - DNA, 25 bp, Homo sapien
acctcaacgtctgtggctcagggct

SEQ ID NO: 85773 - DNA, 25 bp, Homo sapien
tccccagcccagtcttggcttcttg

SEQ ID NO: 85774 - DNA, 25 bp, Homo sapien
tccactctgactctgactatggcag

SEQ ID NO: 85775 - DNA, 25 bp, Homo sapien
actctgactctgactatggcagcag

SEQ ID NO: 85776 - DNA, 25 bp, Homo sapien
tctgactctgactatggcagcagaa

SEQ ID NO: 85777 - DNA, 25 bp, Homo sapien
gactctgactatggcagcagaacac

SEQ ID NO: 85778 - DNA, 25 bp, Homo sapien
gaagatgccttctgtgttgtgggaa

SEQ ID NO: 85779 - DNA, 25 bp, Homo sapien
aacaatgattgatctttacccaaga

SEQ ID NO: 85780 - DNA, 25 bp, Homo sapien
gaattttgtctttggacaggcctct

SEQ ID NO: 85781 - DNA, 25 bp, Homo sapien
tttggacaggcctctttgacagatg

SEQ ID NO: 85782 - DNA, 25 bp, Homo sapien
gatgatgaatcttctggcacacctg

SEQ ID NO: 85783 - DNA, 25 bp, Homo sapien
gaatcttctggcacacctggagcaa

SEQ ID NO: 85784 - DNA, 25 bp, Homo sapien
ggagcaactccagaacacagtcgtg

SEQ ID NO: 85785 - DNA, 25 bp, Homo sapien
cacagtcgtgaggataatgggaatt

SEQ ID NO: 85786 - DNA, 25 bp, Homo sapien
tactgaaacccgtggaaggaagcct

SEQ ID NO: 85787 - DNA, 25 bp, Homo sapien
aaatgcctgactgttctccaaaaat

SEQ ID NO: 85788 - DNA, 25 bp, Homo sapien
aggaccttcaaataggagtgattga

SEQ ID NO: 85789 - DNA, 25 bp, Homo sapien
ggccttgctcttgtcggccagccca

SEQ ID NO: 85790 - DNA, 25 bp, Homo sapien
gccttgctcttgtcggccagcccac

SEQ ID NO: 85791 - DNA, 25 bp, Homo sapien
ccttgctcttgtcggccagcccact

SEQ ID NO: 85792 - DNA, 25 bp, Homo sapien
cttgctcttgtcggccagcccactc

SEQ ID NO: 85793 - DNA, 25 bp, Homo sapien
ttgctcttgtcggccagcccactcc

SEQ ID NO: 85794 - DNA, 25 bp, Homo sapien
tgctcttgtcggccagcccactccc

SEQ ID NO: 85795 - DNA, 25 bp, Homo sapien
gctcttgtcggccagcccactcccc

SEQ ID NO: 85796 - DNA, 25 bp, Homo sapien
ctcttgtcggccagcccactcccca

SEQ ID NO: 85797 - DNA, 25 bp, Homo sapien
ccttctgtgttgtgggaataacaat

SEQ ID NO: 85798 - DNA, 25 bp, Homo sapien
taacaatgattgatctttacccaag

SEQ ID NO: 85799 - DNA, 25 bp, Homo sapien
acaatgattgatctttacccaagag

SEQ ID NO: 85800 - DNA, 25 bp, Homo sapien
gaattttgtctttggacaggcctct

SEQ ID NO: 85801 - DNA, 25 bp, Homo sapien
attttgtctttggacaggcctcttt

SEQ ID NO: 85802 - DNA, 25 bp, Homo sapien
ttgtctttggacaggcctctttgac

SEQ ID NO: 85803 - DNA, 25 bp, Homo sapien
ctttggacaggcctctttgacagat

SEQ ID NO: 85804 - DNA, 25 bp, Homo sapien
ttggacaggcctctttgacagatgg

SEQ ID NO: 85805 - DNA, 25 bp, Homo sapien
gaggtggattgatgatgaatcttct

SEQ ID NO: 85806 - DNA, 25 bp, Homo sapien
cctggagcaactccagaacacagtc

SEQ ID NO: 85807 - DNA, 25 bp, Homo sapien
aggaccttcaaataggagtgattga

SEQ ID NO: 85808 - DNA, 25 bp, Homo sapien
gagcccaccagtgaggattactgat

SEQ ID NO: 85809 - DNA, 25 bp, Homo sapien
atttttagcatctttattcaaggag

SEQ ID NO: 85810 - DNA, 25 bp, Homo sapien
atggacttcaatttgtctatcaaac

SEQ ID NO: 85811 - DNA, 25 bp, Homo sapien
aaaggcctctagatgattagcaatc

SEQ ID NO: 85812 - DNA, 25 bp, Homo sapien
agaggcctagtaatgttcttttgag

SEQ ID NO: 85813 - DNA, 25 bp, Homo sapien
tgaggttagaaatccttgctgctag

SEQ ID NO: 85814 - DNA, 25 bp, Homo sapien
cttgctgctaggacagtctctgtga

SEQ ID NO: 85815 - DNA, 25 bp, Homo sapien
gacagtctctgtgacaggttgcgtt

SEQ ID NO: 85816 - DNA, 25 bp, Homo sapien
ggttgcgttgaatgatgtcttcctt

SEQ ID NO: 85817 - DNA, 25 bp, Homo sapien
atgatgtcttccttatcaatggtga

SEQ ID NO: 85818 - DNA, 25 bp, Homo sapien
ttatcaatggtgagcccaccagtga

SEQ ID NO: 85819 - DNA, 25 bp, Homo sapien
tgaaggcccaggtgcctggctcctc

SEQ ID NO: 85820 - DNA, 25 bp, Homo sapien
gcctgccgcgcctgagtgcaaggtc

SEQ ID NO: 85821 - DNA, 25 bp, Homo sapien
gcgcctgagtgcaaggtcctgacag

SEQ ID NO: 85822 - DNA, 25 bp, Homo sapien
ctgagtgcaaggtcctgacagctgc

SEQ ID NO: 85823 - DNA, 25 bp, Homo sapien
aaggtcctgacagctgcaggcaaca

SEQ ID NO: 85824 - DNA, 25 bp, Homo sapien
gtcctgacagctgcaggcaacagct

SEQ ID NO: 85825 - DNA, 25 bp, Homo sapien
gcaacagctgccgggtggatgtctt

SEQ ID NO: 85826 - DNA, 25 bp, Homo sapien
tggatgtcttcaccaacctgggtta

SEQ ID NO: 85827 - DNA, 25 bp, Homo sapien
gtcttcaccaacctgggttaccgag

SEQ ID NO: 85828 - DNA, 25 bp, Homo sapien
agccagctcagggttttagagtgtt

SEQ ID NO: 85829 - DNA, 25 bp, Homo sapien
ccagctcagggttttagagtgtttt

SEQ ID NO: 85830 - DNA, 25 bp, Homo sapien
cgctcatccatgaagcctggctttg

SEQ ID NO: 85831 - DNA, 25 bp, Homo sapien
cctggctttgtatgactcctggcag

SEQ ID NO: 85832 - DNA, 25 bp, Homo sapien
ttgtatgactcctggcagcaggcgt

SEQ ID NO: 85833 - DNA, 25 bp, Homo sapien
actcctggcagcaggcgtgggcttc

SEQ ID NO: 85834 - DNA, 25 bp, Homo sapien
tgctctttctccactgcatgccaga

SEQ ID NO: 85835 - DNA, 25 bp, Homo sapien
actgcatgccagaggcccatttact

SEQ ID NO: 85836 - DNA, 25 bp, Homo sapien
tgccagaggcccatttactcctggg

SEQ ID NO: 85837 - DNA, 25 bp, Homo sapien
aggtcgtcctcaccatagccaaggc

SEQ ID NO: 85838 - DNA, 25 bp, Homo sapien
tcctcaccatagccaaggccttggg

SEQ ID NO: 85839 - DNA, 25 bp, Homo sapien
ctgcctctttgtactttgctcttta

SEQ ID NO: 85840 - DNA, 25 bp, Homo sapien
ctttgtactttgctctttatagaaa

SEQ ID NO: 85841 - DNA, 25 bp, Homo sapien
cgaggtatagacatgccacggcggt

SEQ ID NO: 85842 - DNA, 25 bp, Homo sapien
aggcagggaacaagcttctggactt

SEQ ID NO: 85843 - DNA, 25 bp, Homo sapien
gcaagaccccacaactgtaggctgg

SEQ ID NO: 85844 - DNA, 25 bp, Homo sapien
gtcgagtgagcggttctagcctcag

SEQ ID NO: 85845 - DNA, 25 bp, Homo sapien
atcctggctctcaagcagggtgacg

SEQ ID NO: 85846 - DNA, 25 bp, Homo sapien
aagtttggctgcagatcttctactc

SEQ ID NO: 85847 - DNA, 25 bp, Homo sapien
agcagaacgggctcttctatgaccc

SEQ ID NO: 85848 - DNA, 25 bp, Homo sapien
tctatgacccttactggacagacag

SEQ ID NO: 85849 - DNA, 25 bp, Homo sapien
tctttacgggcttcctaatctatgc

SEQ ID NO: 85850 - DNA, 25 bp, Homo sapien
taatctatgccgaccaggatgaccc

SEQ ID NO: 85851 - DNA, 25 bp, Homo sapien
ccaggatgaccccaacgaggtatag

SEQ ID NO: 85852 - DNA, 25 bp, Homo sapien
ccctgatctatacggctttcaacaa

SEQ ID NO: 85853 - DNA, 25 bp, Homo sapien
acaagaactacaacagcgccttcaa

SEQ ID NO: 85854 - DNA, 25 bp, Homo sapien
aacagcgccttcaagaacttctttt

SEQ ID NO: 85855 - DNA, 25 bp, Homo sapien
gccttcaagaacttcttttctaggc

SEQ ID NO: 85856 - DNA, 25 bp, Homo sapien
gggccgccctcatggtgggcatcct

SEQ ID NO: 85857 - DNA, 25 bp, Homo sapien
tgggcatcctcattggcgtgttcgt

SEQ ID NO: 85858 - DNA, 25 bp, Homo sapien
tgctctgctggatccccttctttct

SEQ ID NO: 85859 - DNA, 25 bp, Homo sapien
tgacatccccgccatctggaaaagc

SEQ ID NO: 85860 - DNA, 25 bp, Homo sapien
ctggaaaagcatcttcctgtggctt

SEQ ID NO: 85861 - DNA, 25 bp, Homo sapien
ttcctgtggcttggctactccaact

SEQ ID NO: 85862 - DNA, 25 bp, Homo sapien
ttggctactccaactccttctttaa

SEQ ID NO: 85863 - DNA, 25 bp, Homo sapien
gggacaattaccgagcctatgaaga

SEQ ID NO: 85864 - DNA, 25 bp, Homo sapien
gcctatgaagatgagtacagctact

SEQ ID NO: 85865 - DNA, 25 bp, Homo sapien
caaggctacgatggctatgatggtc

SEQ ID NO: 85866 - DNA, 25 bp, Homo sapien
aagggcacctcgaagacaacaacct

SEQ ID NO: 85867 - DNA, 25 bp, Homo sapien
ctcgaagacaacaacctctccaaat

SEQ ID NO: 85868 - DNA, 25 bp, Homo sapien
ctctccaaatggtgggtttgaacct

SEQ ID NO: 85869 - DNA, 25 bp, Homo sapien
tacaaccccaccacaagtctataga

SEQ ID NO: 85870 - DNA, 25 bp, Homo sapien
acaagtctatagaaccacttcccca

SEQ ID NO: 85871 - DNA, 25 bp, Homo sapien
gaaaaccaccaccgttgaatacgag

SEQ ID NO: 85872 - DNA, 25 bp, Homo sapien
gggagtacgaatacacgggcgtcaa

SEQ ID NO: 85873 - DNA, 25 bp, Homo sapien
acacgggcgtcaatgaatacgacaa

SEQ ID NO: 85874 - DNA, 25 bp, Homo sapien
tttactataactctagcatccccat

SEQ ID NO: 85875 - DNA, 25 bp, Homo sapien
ggcaagggttcttcttgcatgtggg

SEQ ID NO: 85876 - DNA, 25 bp, Homo sapien
cctcccctgatgaatacagagtggt

SEQ ID NO: 85877 - DNA, 25 bp, Homo sapien
gttatcatcagaaggtggtctcccc

SEQ ID NO: 85878 - DNA, 25 bp, Homo sapien
atcatcagaaggtggtctcccctca

SEQ ID NO: 85879 - DNA, 25 bp, Homo sapien
aggacgtgggcccagccacatgcca

SEQ ID NO: 85880 - DNA, 25 bp, Homo sapien
cacatgccaactcatgtccaatact

SEQ ID NO: 85881 - DNA, 25 bp, Homo sapien
cccaacacagcttctgtggctgact

SEQ ID NO: 85882 - DNA, 25 bp, Homo sapien
aatactgtacaactgtttctgacca

SEQ ID NO: 85883 - DNA, 25 bp, Homo sapien
aactgtttctgaccattaaatgctg

SEQ ID NO: 85884 - DNA, 25 bp, Homo sapien
ttctgaccattaaatgctgttgtac

SEQ ID NO: 85885 - DNA, 25 bp, Homo sapien
tccactgcagctgctagttagaaag

SEQ ID NO: 85886 - DNA, 25 bp, Homo sapien
ctgcagctgctagttagaaaggttt

SEQ ID NO: 85887 - DNA, 25 bp, Homo sapien
gggagcaggaattgcactcagacat

SEQ ID NO: 85888 - DNA, 25 bp, Homo sapien
agcaggaattgcactcagacatgac

SEQ ID NO: 85889 - DNA, 25 bp, Homo sapien
caggaattgcactcagacatgacat

SEQ ID NO: 85890 - DNA, 25 bp, Homo sapien
ggaattgcactcagacatgacattt

SEQ ID NO: 85891 - DNA, 25 bp, Homo sapien
attgcactcagacatgacatttcaa

SEQ ID NO: 85892 - DNA, 25 bp, Homo sapien
gcactcagacatgacatttcaattc

SEQ ID NO: 85893 - DNA, 25 bp, Homo sapien
gacatgacatttcaattcatctctg

SEQ ID NO: 85894 - DNA, 25 bp, Homo sapien
tgtgtgtcagttctgtcagctgcaa

SEQ ID NO: 85895 - DNA, 25 bp, Homo sapien
gtgtgtcagttctgtcagctgcaag

SEQ ID NO: 85896 - DNA, 25 bp, Homo sapien
acgggacccggagctgtcccaactg

SEQ ID NO: 85897 - DNA, 25 bp, Homo sapien
ggagctgtcccaactgccgccgctc

SEQ ID NO: 85898 - DNA, 25 bp, Homo sapien
cctggctttgtatgactcctggcag

SEQ ID NO: 85899 - DNA, 25 bp, Homo sapien
ctgcctctttgtactttgctcttta

SEQ ID NO: 85900 - DNA, 25 bp, Homo sapien
tgcctctttgtactttgctctttat

SEQ ID NO: 85901 - DNA, 25 bp, Homo sapien
gcctctttgtactttgctctttata

SEQ ID NO: 85902 - DNA, 25 bp, Homo sapien
cctctttgtactttgctctttatag

SEQ ID NO: 85903 - DNA, 25 bp, Homo sapien
ctctttgtactttgctctttataga

SEQ ID NO: 85904 - DNA, 25 bp, Homo sapien
tctttgtactttgctctttatagaa

SEQ ID NO: 85905 - DNA, 25 bp, Homo sapien
ctttgtactttgctctttatagaaa

SEQ ID NO: 85906 - DNA, 25 bp, Homo sapien
tttgtactttgctctttatagaaaa

SEQ ID NO: 85907 - DNA, 25 bp, Homo sapien
aaaggattctgcctctttagtcctc

SEQ ID NO: 85908 - DNA, 25 bp, Homo sapien
ttctgcctctttagtcctcactgtt

SEQ ID NO: 85909 - DNA, 25 bp, Homo sapien
ctagatcattagaaaagcactggta

SEQ ID NO: 85910 - DNA, 25 bp, Homo sapien
aaagcactggtagttgtacaatatc

SEQ ID NO: 85911 - DNA, 25 bp, Homo sapien
gtagttgtacaatatcagtgttgac

SEQ ID NO: 85912 - DNA, 25 bp, Homo sapien
gtgttgactttgaacttctttaacg

SEQ ID NO: 85913 - DNA, 25 bp, Homo sapien
gaacttctttaacgagatcatgaat

SEQ ID NO: 85914 - DNA, 25 bp, Homo sapien
gatcatgaattcttttcccttagcc

SEQ ID NO: 85915 - DNA, 25 bp, Homo sapien
gttgtctctaaaagttttgtaatca

SEQ ID NO: 85916 - DNA, 25 bp, Homo sapien
gagttagatatatgtcatctcctat

SEQ ID NO: 85917 - DNA, 25 bp, Homo sapien
tgtcatctcctattcattgctttta

SEQ ID NO: 85918 - DNA, 25 bp, Homo sapien
gggcttctttcttttcgaatgtggc

SEQ ID NO: 85919 - DNA, 25 bp, Homo sapien
ctttcttttcgaatgtggctaccgt

SEQ ID NO: 85920 - DNA, 25 bp, Homo sapien
tttcgaatgtggctaccgtgggtca

SEQ ID NO: 85921 - DNA, 25 bp, Homo sapien
aatgtggctaccgtgggtcaacctg

SEQ ID NO: 85922 - DNA, 25 bp, Homo sapien
tggctaccgtgggtcaacctgggat

SEQ ID NO: 85923 - DNA, 25 bp, Homo sapien
gagtacagatgtaaatgccacaaag

SEQ ID NO: 85924 - DNA, 25 bp, Homo sapien
tctgcctttggagccggcttctgtg

SEQ ID NO: 85925 - DNA, 25 bp, Homo sapien
tggacgtggtgaagacccggtatat

SEQ ID NO: 85926 - DNA, 25 bp, Homo sapien
acccggtatatgaactcacctccag

SEQ ID NO: 85927 - DNA, 25 bp, Homo sapien
agccccctcgactgtatgataaaga

SEQ ID NO: 85928 - DNA, 25 bp, Homo sapien
tgtatgataaagatggtggcccagg

SEQ ID NO: 85929 - DNA, 25 bp, Homo sapien
acacagccgcatcgtaaggtagaag

SEQ ID NO: 85930 - DNA, 25 bp, Homo sapien
cacagccgcatcgtaaggtagaagg

SEQ ID NO: 85931 - DNA, 25 bp, Homo sapien
cagccgcatcgtaaggtagaaggaa

SEQ ID NO: 85932 - DNA, 25 bp, Homo sapien
tctccccaaaagaaccgacaatcag

SEQ ID NO: 85933 - DNA, 25 bp, Homo sapien
tgctcctgacacatgggctcctgct

SEQ ID NO: 85934 - DNA, 25 bp, Homo sapien
ctgacacatgggctcctgctcctga

SEQ ID NO: 85935 - DNA, 25 bp, Homo sapien
tgctcctgaccaaactgagcaagac

SEQ ID NO: 85936 - DNA, 25 bp, Homo sapien
tcctgaccaaactgagcaagaccag

SEQ ID NO: 85937 - DNA, 25 bp, Homo sapien
ctgaccaaactgagcaagaccagaa

SEQ ID NO: 85938 - DNA, 25 bp, Homo sapien
gaccaaactgagcaagaccagaata

SEQ ID NO: 85939 - DNA, 25 bp, Homo sapien
ctgagcaagaccagaatagactgtc

SEQ ID NO: 85940 - DNA, 25 bp, Homo sapien
tccatagggccaggcatttttttct

SEQ ID NO: 85941 - DNA, 25 bp, Homo sapien
ttttttctggattcaaacaggcaac

SEQ ID NO: 85942 - DNA, 25 bp, Homo sapien
ttctggattcaaacaggcaacaatg

SEQ ID NO: 85943 - DNA, 25 bp, Homo sapien
gattcaaacaggcaacaatgacctt

SEQ ID NO: 85944 - DNA, 25 bp, Homo sapien
ggcaacaatgaccttttattttctg

SEQ ID NO: 85945 - DNA, 25 bp, Homo sapien
ccacctcccttgatcatacagtgag

SEQ ID NO: 85946 - DNA, 25 bp, Homo sapien
ctcccttgatcatacagtgaggcta

SEQ ID NO: 85947 - DNA, 25 bp, Homo sapien
tgatcatacagtgaggctacagtga

SEQ ID NO: 85948 - DNA, 25 bp, Homo sapien
cttcccagaccctcatgcagttggt

SEQ ID NO: 85949 - DNA, 25 bp, Homo sapien
cagttggttgtaaattctcccagga

SEQ ID NO: 85950 - DNA, 25 bp, Homo sapien
agttggttgtaaattctcccaggag

SEQ ID NO: 85951 - DNA, 25 bp, Homo sapien
cagcagtaaattcttctctactcgg

SEQ ID NO: 85952 - DNA, 25 bp, Homo sapien
agcagtaaattcttctctactcggc

SEQ ID NO: 85953 - DNA, 25 bp, Homo sapien
gcagtaaattcttctctactcggcc

SEQ ID NO: 85954 - DNA, 25 bp, Homo sapien
cagtaaattcttctctactcggcca

SEQ ID NO: 85955 - DNA, 25 bp, Homo sapien
agtaaattcttctctactcggccag

SEQ ID NO: 85956 - DNA, 25 bp, Homo sapien
gtaaattcttctctactcggccagg

SEQ ID NO: 85957 - DNA, 25 bp, Homo sapien
taaattcttctctactcggccaggc

SEQ ID NO: 85958 - DNA, 25 bp, Homo sapien
aaattcttctctactcggccaggcg

SEQ ID NO: 85959 - DNA, 25 bp, Homo sapien
aattcttctctactcggccaggcgc

SEQ ID NO: 85960 - DNA, 25 bp, Homo sapien
attcttctctactcggccaggcgca

SEQ ID NO: 85961 - DNA, 25 bp, Homo sapien
ttcttctctactcggccaggcgcag

SEQ ID NO: 85962 - DNA, 25 bp, Homo sapien
ttgaacccacgcctgaatattaaag

SEQ ID NO: 85963 - DNA, 25 bp, Homo sapien
aaattcttttcttcaggagtcctgg

SEQ ID NO: 85964 - DNA, 25 bp, Homo sapien
ccatttagtcctgggatgtactttg

SEQ ID NO: 85965 - DNA, 25 bp, Homo sapien
gtcctgggatgtactttgagatgat

SEQ ID NO: 85966 - DNA, 25 bp, Homo sapien
ttcaaggttgcagtaaatggcgtac

SEQ ID NO: 85967 - DNA, 25 bp, Homo sapien
aatggcgtacacagcctggagtaca

SEQ ID NO: 85968 - DNA, 25 bp, Homo sapien
aaagagctcagcagtattgacacgc

SEQ ID NO: 85969 - DNA, 25 bp, Homo sapien
agcagtattgacacgctggaaatta

SEQ ID NO: 85970 - DNA, 25 bp, Homo sapien
aatggagacatccacttactggaag

SEQ ID NO: 85971 - DNA, 25 bp, Homo sapien
aagtaaggagctggtagcctaccta

SEQ ID NO: 85972 - DNA, 25 bp, Homo sapien
tggtagcctacctacacagctgcta

SEQ ID NO: 85973 - DNA, 25 bp, Homo sapien
ttaacctgcctcgactgtgctgagg

SEQ ID NO: 85974 - DNA, 25 bp, Homo sapien
gtgctgagggcaacaaaggccatct

SEQ ID NO: 85975 - DNA, 25 bp, Homo sapien
aaggccatctcaccaaaggattatt

SEQ ID NO: 85976 - DNA, 25 bp, Homo sapien
atgccattaaatcatcccgtgacct

SEQ ID NO: 85977 - DNA, 25 bp, Homo sapien
gagtccatggcctttgcccagggca

SEQ ID NO: 85978 - DNA, 25 bp, Homo sapien
aaagatctatgactgggttccaaag

SEQ ID NO: 85979 - DNA, 25 bp, Homo sapien
gactgggttccaaagttgaggccta

SEQ ID NO: 85980 - DNA, 25 bp, Homo sapien
gaggcctaggtttttgctgggattt

SEQ ID NO: 85981 - DNA, 25 bp, Homo sapien
gatttagatattttcaggcaccatt

SEQ ID NO: 85982 - DNA, 25 bp, Homo sapien
caggcaccattttgacagcattcag

SEQ ID NO: 85983 - DNA, 25 bp, Homo sapien
aacggttattgaccccatagactag

SEQ ID NO: 85984 - DNA, 25 bp, Homo sapien
tctgcctttggagccggcttctgtg

SEQ ID NO: 85985 - DNA, 25 bp, Homo sapien
acagtggtggcctccccggtggacg

SEQ ID NO: 85986 - DNA, 25 bp, Homo sapien
tggcctccccggtggacgtggtgaa

SEQ ID NO: 85987 - DNA, 25 bp, Homo sapien
tggacgtggtgaagacccggtatat

SEQ ID NO: 85988 - DNA, 25 bp, Homo sapien
gacgtggtgaagacccggtatatga

SEQ ID NO: 85989 - DNA, 25 bp, Homo sapien
gaagacccggtatatgaactcacct

SEQ ID NO: 85990 - DNA, 25 bp, Homo sapien
agacccggtatatgaactcacctcc

SEQ ID NO: 85991 - DNA, 25 bp, Homo sapien
cccggtatatgaactcacctccagg

SEQ ID NO: 85992 - DNA, 25 bp, Homo sapien
tcacctccaggccagtacttcagcc

SEQ ID NO: 85993 - DNA, 25 bp, Homo sapien
agccccctcgactgtatgataaaga

SEQ ID NO: 85994 - DNA, 25 bp, Homo sapien
tgtatgataaagatggtggcccagg

SEQ ID NO: 85995 - DNA, 25 bp, Homo sapien
gctgcgccgccttcggcgtttgctg

SEQ ID NO: 85996 - DNA, 25 bp, Homo sapien
gccttcggcgtttgctgcaacgacg

SEQ ID NO: 85997 - DNA, 25 bp, Homo sapien
ttcggcgtttgctgcaacgacgaga

SEQ ID NO: 85998 - DNA, 25 bp, Homo sapien
tcggcgtttgctgcaacgacgagag

SEQ ID NO: 85999 - DNA, 25 bp, Homo sapien
ggcgtttgctgcaacgacgagagct

SEQ ID NO: 86000 - DNA, 25 bp, Homo sapien
tttgctgcaacgacgagagctgcgt

SEQ ID NO: 86001 - DNA, 25 bp, Homo sapien
acgagagctgcgtgaccgagcccga

SEQ ID NO: 86002 - DNA, 25 bp, Homo sapien
agagctgcgtgaccgagcccgagtg

SEQ ID NO: 86003 - DNA, 25 bp, Homo sapien
tgccgcgagggctttcaccgccgcg

SEQ ID NO: 86004 - DNA, 25 bp, Homo sapien
accggagcaacgccacgcagctgga

SEQ ID NO: 86005 - DNA, 25 bp, Homo sapien
ccgcccctgcagcacggacaataaa

SEQ ID NO: 86006 - DNA, 25 bp, Homo sapien
gagtatatatatcttcagggctgtg

SEQ ID NO: 86007 - DNA, 25 bp, Homo sapien
cagggctgtgaattccatactagtt

SEQ ID NO: 86008 - DNA, 25 bp, Homo sapien
ggctgtgaattccatactagttatc

SEQ ID NO: 86009 - DNA, 25 bp, Homo sapien
gtgaattccatactagttatcaata

SEQ ID NO: 86010 - DNA, 25 bp, Homo sapien
attatgcaagcaaactaggaggaga

SEQ ID NO: 86011 - DNA, 25 bp, Homo sapien
gaatgtgcaattttgagggatacct

SEQ ID NO: 86012 - DNA, 25 bp, Homo sapien
tgagggatacctaatttgcattcgg

SEQ ID NO: 86013 - DNA, 25 bp, Homo sapien
ggatacctaatttgcattcggttag

SEQ ID NO: 86014 - DNA, 25 bp, Homo sapien
gggtgtgtttatgaacttgttaatg

SEQ ID NO: 86015 - DNA, 25 bp, Homo sapien
aatcatgcagatttccaatcagtgt

SEQ ID NO: 86016 - DNA, 25 bp, Homo sapien
tccaatcagtgtattgctcatttac

SEQ ID NO: 86017 - DNA, 25 bp, Homo sapien
tttcatctgcgcaaacagattcagg

SEQ ID NO: 86018 - DNA, 25 bp, Homo sapien
gattcaggaactttgtaatttacat

SEQ ID NO: 86019 - DNA, 25 bp, Homo sapien
ggtcacattcatcctaattcacaaa

SEQ ID NO: 86020 - DNA, 25 bp, Homo sapien
agatttcacacctattcctttttct

SEQ ID NO: 86021 - DNA, 25 bp, Homo sapien
tctttccagtgcctgtgctttttct

SEQ ID NO: 86022 - DNA, 25 bp, Homo sapien
tgtgctttttctctcataccaagga

SEQ ID NO: 86023 - DNA, 25 bp, Homo sapien
gtaaatagcctaattttgcaactaa

SEQ ID NO: 86024 - DNA, 25 bp, Homo sapien
ttgcaactaatacaaatggcgctgt

SEQ ID NO: 86025 - DNA, 25 bp, Homo sapien
aatggcgctgtacttctttggtgat

SEQ ID NO: 86026 - DNA, 25 bp, Homo sapien
gcgctgtacttctttggtgatggta

SEQ ID NO: 86027 - DNA, 25 bp, Homo sapien
gaaccactgaaaaggcatttagttt

SEQ ID NO: 86028 - DNA, 25 bp, Homo sapien
agggaatgccagtccgaaacactgg

SEQ ID NO: 86029 - DNA, 25 bp, Homo sapien
aacactgggagtccaaagtctgcag

SEQ ID NO: 86030 - DNA, 25 bp, Homo sapien
tctgcagtgaagacccgccaagctt

SEQ ID NO: 86031 - DNA, 25 bp, Homo sapien
tttcttccttcatactacatatttc

SEQ ID NO: 86032 - DNA, 25 bp, Homo sapien
tcacaaaatttgctcgtcaggtctg

SEQ ID NO: 86033 - DNA, 25 bp, Homo sapien
gtcaggtctgcaaaaataccctccg

SEQ ID NO: 86034 - DNA, 25 bp, Homo sapien
caaaaataccctccggctgcggcag

SEQ ID NO: 86035 - DNA, 25 bp, Homo sapien
caagacggccgtttgttgctattaa

SEQ ID NO: 86036 - DNA, 25 bp, Homo sapien
ttgttgctattaattatgctgccat

SEQ ID NO: 86037 - DNA, 25 bp, Homo sapien
accttatatgttgtgcttctgacca

SEQ ID NO: 86038 - DNA, 25 bp, Homo sapien
atgttgtgcttctgaccattttctc

SEQ ID NO: 86039 - DNA, 25 bp, Homo sapien
gaagtggctctgggcaccagcctgt

SEQ ID NO: 86040 - DNA, 25 bp, Homo sapien
gggctaaagacttgacagctagctc

SEQ ID NO: 86041 - DNA, 25 bp, Homo sapien
acttgacagctagctctggagcagc

SEQ ID NO: 86042 - DNA, 25 bp, Homo sapien
agctctggagcagccggcttcctgg

SEQ ID NO: 86043 - DNA, 25 bp, Homo sapien
aaaacctccaggtttcgcataccag

SEQ ID NO: 86044 - DNA, 25 bp, Homo sapien
gtttcgcataccagggatggcccct

SEQ ID NO: 86045 - DNA, 25 bp, Homo sapien
ggtgaacctgcccagatttatcagt

SEQ ID NO: 86046 - DNA, 25 bp, Homo sapien
atttatcagtagaggctggactccc

SEQ ID NO: 86047 - DNA, 25 bp, Homo sapien
tcctgcccatggttgcagcagccat

SEQ ID NO: 86048 - DNA, 25 bp, Homo sapien
atggttgcagcagccatgggcctat

SEQ ID NO: 86049 - DNA, 25 bp, Homo sapien
agccatgggcctatgagcggtctaa

SEQ ID NO: 86050 - DNA, 25 bp, Homo sapien
tatgcccactgccttttagaatcgt

SEQ ID NO: 86051 - DNA, 25 bp, Homo sapien
cactgccttttagaatcgtttgttt

SEQ ID NO: 86052 - DNA, 25 bp, Homo sapien
ttgtcccttctcttcatctggtctt

SEQ ID NO: 86053 - DNA, 25 bp, Homo sapien
ttctcttcatctggtcttgggtcaa

SEQ ID NO: 86054 - DNA, 25 bp, Homo sapien
tcatctggtcttgggtcaagaacat

SEQ ID NO: 86055 - DNA, 25 bp, Homo sapien
ttaatggctgccgacaatgaactgt

SEQ ID NO: 86056 - DNA, 25 bp, Homo sapien
tgccgacaatgaactgtctgtctga

SEQ ID NO: 86057 - DNA, 25 bp, Homo sapien
gtctgtctgagtctaaaaccaagct

SEQ ID NO: 86058 - DNA, 25 bp, Homo sapien
aagctcaggtttctaagccacatga

SEQ ID NO: 86059 - DNA, 25 bp, Homo sapien
gtttctaagccacatgaccttgatt

SEQ ID NO: 86060 - DNA, 25 bp, Homo sapien
agccacatgaccttgattgttaaat

SEQ ID NO: 86061 - DNA, 25 bp, Homo sapien
agggaatgccagtccgaaacactgg

SEQ ID NO: 86062 - DNA, 25 bp, Homo sapien
aatgccagtccgaaacactgggagt

SEQ ID NO: 86063 - DNA, 25 bp, Homo sapien
agtccgaaacactgggagtccaaag

SEQ ID NO: 86064 - DNA, 25 bp, Homo sapien
aacactgggagtccaaagtctgcag

SEQ ID NO: 86065 - DNA, 25 bp, Homo sapien
tgggagtccaaagtctgcagtgaag

SEQ ID NO: 86066 - DNA, 25 bp, Homo sapien
tctgcagtgaagacccgccaagctt

SEQ ID NO: 86067 - DNA, 25 bp, Homo sapien
gaagacccgccaagctttcttcctt

SEQ ID NO: 86068 - DNA, 25 bp, Homo sapien
tttcttccttcatactacatatttc

SEQ ID NO: 86069 - DNA, 25 bp, Homo sapien
ttccttcatactacatatttcacaa

SEQ ID NO: 86070 - DNA, 25 bp, Homo sapien
tcacaaaatttgctcgtcaggtctg

SEQ ID NO: 86071 - DNA, 25 bp, Homo sapien
acaaaatttgctcgtcaggtctgca

SEQ ID NO: 86072 - DNA, 25 bp, Homo sapien
tcagagctcacacatccacgaacaa

SEQ ID NO: 86073 - DNA, 25 bp, Homo sapien
gagctcacacatccacgaacaaatg

SEQ ID NO: 86074 - DNA, 25 bp, Homo sapien
acacatccacgaacaaatgaaggct

SEQ ID NO: 86075 - DNA, 25 bp, Homo sapien
tgaaggctgaggaggtttctaaacc

SEQ ID NO: 86076 - DNA, 25 bp, Homo sapien
ggtttctaaacctaaagtccatgag

SEQ ID NO: 86077 - DNA, 25 bp, Homo sapien
aaacctaaagtccatgagtgtgcac

SEQ ID NO: 86078 - DNA, 25 bp, Homo sapien
gtccatgagtgtgcacttcaatcca

SEQ ID NO: 86079 - DNA, 25 bp, Homo sapien
atgagtgtgcacttcaatccaggaa

SEQ ID NO: 86080 - DNA, 25 bp, Homo sapien
gtgtgcacttcaatccaggaaggtc

SEQ ID NO: 86081 - DNA, 25 bp, Homo sapien
ttcaatccaggaaggtcgggacttc

SEQ ID NO: 86082 - DNA, 25 bp, Homo sapien
caggaaggtcgggacttccttcagt

SEQ ID NO: 86083 - DNA, 25 bp, Homo sapien
aaaactacatctgttacctccaact

SEQ ID NO: 86084 - DNA, 25 bp, Homo sapien
gttacctccaacttgtcagtcatga

SEQ ID NO: 86085 - DNA, 25 bp, Homo sapien
tgatcaatcatcaaaccttgggcag

SEQ ID NO: 86086 - DNA, 25 bp, Homo sapien
accttgggcagatctgctggttcaa

SEQ ID NO: 86087 - DNA, 25 bp, Homo sapien
gctggttcaaccaagaaagagctat

SEQ ID NO: 86088 - DNA, 25 bp, Homo sapien
ggagattgacacttatattactcat

SEQ ID NO: 86089 - DNA, 25 bp, Homo sapien
tatattactcattacttcagcagtt

SEQ ID NO: 86090 - DNA, 25 bp, Homo sapien
gtaagtctggtctttaatgaccatt

SEQ ID NO: 86091 - DNA, 25 bp, Homo sapien
gaccattgtgtctacatcaagttca

SEQ ID NO: 86092 - DNA, 25 bp, Homo sapien
acttttcacctttacaatctgcttg

SEQ ID NO: 86093 - DNA, 25 bp, Homo sapien
atagacagcctagagtgagaagtta

SEQ ID NO: 86094 - DNA, 25 bp, Homo sapien
gctgaagaaggcgaatcccgaccta

SEQ ID NO: 86095 - DNA, 25 bp, Homo sapien
aatccgcgaatgctccgatgtgcag

SEQ ID NO: 86096 - DNA, 25 bp, Homo sapien
gcccgctacgcatttggccaagaga

SEQ ID NO: 86097 - DNA, 25 bp, Homo sapien
ggccaagagacgaatgtccctttga

SEQ ID NO: 86098 - DNA, 25 bp, Homo sapien
gtccctttgaacaacttcagtgctg

SEQ ID NO: 86099 - DNA, 25 bp, Homo sapien
gtgctgatcaggtaaccagagccct

SEQ ID NO: 86100 - DNA, 25 bp, Homo sapien
agagccctggagaacgttctaagtg

SEQ ID NO: 86101 - DNA, 25 bp, Homo sapien
ggattaagagcaacagccccagagc

SEQ ID NO: 86102 - DNA, 25 bp, Homo sapien
ctgggctctgctggacttagtataa

SEQ ID NO: 86103 - DNA, 25 bp, Homo sapien
aaatgtgttctcctattcctcataa

SEQ ID NO: 86104 - DNA, 25 bp, Homo sapien
ctattcctcataaagcttgtgctgt

SEQ ID NO: 86105 - DNA, 25 bp, Homo sapien
ccttcattctcacactcacaggaat

SEQ ID NO: 86106 - DNA, 25 bp, Homo sapien
gaatgctatgtgatggccagctgct

SEQ ID NO: 86107 - DNA, 25 bp, Homo sapien
gctgcttcccttcttggttatccac

SEQ ID NO: 86108 - DNA, 25 bp, Homo sapien
tgcttcccttcttggttatccactg

SEQ ID NO: 86109 - DNA, 25 bp, Homo sapien
ttcccttcttggttatccactgcag

SEQ ID NO: 86110 - DNA, 25 bp, Homo sapien
tcccttcttggttatccactgcagc

SEQ ID NO: 86111 - DNA, 25 bp, Homo sapien
aggtttgcagggatgacttttagta

SEQ ID NO: 86112 - DNA, 25 bp, Homo sapien
attatcacttataggattttgtggg

SEQ ID NO: 86113 - DNA, 25 bp, Homo sapien
tgacatttcaattcatctctgcaaa

SEQ ID NO: 86114 - DNA, 25 bp, Homo sapien
caaatgaaaagggttcttcctcttg

SEQ ID NO: 86115 - DNA, 25 bp, Homo sapien
atctgtgtgtcagttctgtcagctg

SEQ ID NO: 86116 - DNA, 25 bp, Homo sapien
tccccacctttcgtgtaaggtgcta

SEQ ID NO: 86117 - DNA, 25 bp, Homo sapien
ctttcgtgtaaggtgctactgaaca

SEQ ID NO: 86118 - DNA, 25 bp, Homo sapien
gctactgaacatgacagcttcttgt

SEQ ID NO: 86119 - DNA, 25 bp, Homo sapien
gtcatgacaggaaacttgcatcagt

SEQ ID NO: 86120 - DNA, 25 bp, Homo sapien
acttgcatcagttggatatcctttt

SEQ ID NO: 86121 - DNA, 25 bp, Homo sapien
ggatatccttttgagaaactgaatt

SEQ ID NO: 86122 - DNA, 25 bp, Homo sapien
aactgaattttgcaaagggccaaat

SEQ ID NO: 86123 - DNA, 25 bp, Homo sapien
atttccccaaactgaacgggctcag

SEQ ID NO: 86124 - DNA, 25 bp, Homo sapien
gttcctttacactcagaacattcta

SEQ ID NO: 86125 - DNA, 25 bp, Homo sapien
ttcctcagggatttcccttttctct

SEQ ID NO: 86126 - DNA, 25 bp, Homo sapien
cccttttctctgtattggtcagtgt

SEQ ID NO: 86127 - DNA, 25 bp, Homo sapien
tctccaagcaattcgtgcagtggga

SEQ ID NO: 86128 - DNA, 25 bp, Homo sapien
ttcgtgcagtgggatgagctacttt

SEQ ID NO: 86129 - DNA, 25 bp, Homo sapien
gagctactttgccagctagaggccg

SEQ ID NO: 86130 - DNA, 25 bp, Homo sapien
ctagaggccgccacgcaagtgaagc

SEQ ID NO: 86131 - DNA, 25 bp, Homo sapien
gcagaggagtgatagctgctcccca

SEQ ID NO: 86132 - DNA, 25 bp, Homo sapien
gggcagtcaggctccagggccctat

SEQ ID NO: 86133 - DNA, 25 bp, Homo sapien
atgccaacctgcctttgttacaagg

SEQ ID NO: 86134 - DNA, 25 bp, Homo sapien
gtatttattggcttcaaggcccacc

SEQ ID NO: 86135 - DNA, 25 bp, Homo sapien
tgtactctgggctctaaagttggag

SEQ ID NO: 86136 - DNA, 25 bp, Homo sapien
gtttgcaatttgcaacacccaccct

SEQ ID NO: 86137 - DNA, 25 bp, Homo sapien
tcagtgttcttatttcagtgacaat

SEQ ID NO: 86138 - DNA, 25 bp, Homo sapien
tcgcacttaactcaacggctctcgg

SEQ ID NO: 86139 - DNA, 25 bp, Homo sapien
cgcacttaactcaacggctctcggg

SEQ ID NO: 86140 - DNA, 25 bp, Homo sapien
tcaggtgtctcacgtctgggctgca

SEQ ID NO: 86141 - DNA, 25 bp, Homo sapien
aggtgtctcacgtctgggctgcacc

SEQ ID NO: 86142 - DNA, 25 bp, Homo sapien
ggtgtctcacgtctgggctgcacca

SEQ ID NO: 86143 - DNA, 25 bp, Homo sapien
gtgtctcacgtctgggctgcaccag

SEQ ID NO: 86144 - DNA, 25 bp, Homo sapien
tgtctcacgtctgggctgcaccagg

SEQ ID NO: 86145 - DNA, 25 bp, Homo sapien
gctgcaccaggcgaagagagaaatt

SEQ ID NO: 86146 - DNA, 25 bp, Homo sapien
tgcaccaggcgaagagagaaattaa

SEQ ID NO: 86147 - DNA, 25 bp, Homo sapien
gcaccaggcgaagagagaaattaaa

SEQ ID NO: 86148 - DNA, 25 bp, Homo sapien
caccaggcgaagagagaaattaaag

SEQ ID NO: 86149 - DNA, 25 bp, Homo sapien
acatctgtggcttcaccaaaccctg

SEQ ID NO: 86150 - DNA, 25 bp, Homo sapien
ttcccaccgagtgtcgggacgatga

SEQ ID NO: 86151 - DNA, 25 bp, Homo sapien
cgggacgatgaagcttgtggcatca

SEQ ID NO: 86152 - DNA, 25 bp, Homo sapien
ggcatcagtattggcacttcaggaa

SEQ ID NO: 86153 - DNA, 25 bp, Homo sapien
gaaaaagctgcctctcaagggccca

SEQ ID NO: 86154 - DNA, 25 bp, Homo sapien
tctgccaggctatgccacctactgg

SEQ ID NO: 86155 - DNA, 25 bp, Homo sapien
ggctgcactcctacactctgtggca

SEQ ID NO: 86156 - DNA, 25 bp, Homo sapien
tctgtggcaccactgctgcgagcag

SEQ ID NO: 86157 - DNA, 25 bp, Homo sapien
actgctgcgagcaggacctgtgcaa

SEQ ID NO: 86158 - DNA, 25 bp, Homo sapien
aggacctgtgcaacatagccgcttc

SEQ ID NO: 86159 - DNA, 25 bp, Homo sapien
cagcttcgctgggagaggacacctc

SEQ ID NO: 86160 - DNA, 25 bp, Homo sapien
aaggagctgatgttgcacctaaaca

SEQ ID NO: 86161 - DNA, 25 bp, Homo sapien
gttgcacctaaacattccaaccctt

SEQ ID NO: 86162 - DNA, 25 bp, Homo sapien
ttgcacctaaacattccaaccctta

SEQ ID NO: 86163 - DNA, 25 bp, Homo sapien
tgcacctaaacattccaacccttaa

SEQ ID NO: 86164 - DNA, 25 bp, Homo sapien
ataattgtatggcaaaaggctatgt

SEQ ID NO: 86165 - DNA, 25 bp, Homo sapien
aattgtatggcaaaaggctatgtaa

SEQ ID NO: 86166 - DNA, 25 bp, Homo sapien
tgtatggcaaaaggctatgtaaaaa

SEQ ID NO: 86167 - DNA, 25 bp, Homo sapien
tatggcaaaaggctatgtaaaaaca

SEQ ID NO: 86168 - DNA, 25 bp, Homo sapien
atggcaaaaggctatgtaaaaacaa

SEQ ID NO: 86169 - DNA, 25 bp, Homo sapien
aaatcttgcatcttaagacaaatat

SEQ ID NO: 86170 - DNA, 25 bp, Homo sapien
cttgcatcttaagacaaatattctt

SEQ ID NO: 86171 - DNA, 25 bp, Homo sapien
tatggtgtggcagcttccaggtgac

SEQ ID NO: 86172 - DNA, 25 bp, Homo sapien
tggcagcttccaggtgacgacaggc

SEQ ID NO: 86173 - DNA, 25 bp, Homo sapien
ttccaggtgacgacaggcctgcagg

SEQ ID NO: 86174 - DNA, 25 bp, Homo sapien
gtgacgacaggcctgcaggtcccca

SEQ ID NO: 86175 - DNA, 25 bp, Homo sapien
tgcaggtccccagtgctgtgcgctg

SEQ ID NO: 86176 - DNA, 25 bp, Homo sapien
gtgctgtgcgctgcctgcaaaagcg

SEQ ID NO: 86177 - DNA, 25 bp, Homo sapien
ctgcaaaagcgaggcagtgctacca

SEQ ID NO: 86178 - DNA, 25 bp, Homo sapien
acttgctgcttggagccttaactcc

SEQ ID NO: 86179 - DNA, 25 bp, Homo sapien
gcttggagccttaactccagatggg

SEQ ID NO: 86180 - DNA, 25 bp, Homo sapien
gtcaccaagagggagtgggcaccct

SEQ ID NO: 86181 - DNA, 25 bp, Homo sapien
cacctcacctcttaataaaggtcag

SEQ ID NO: 86182 - DNA, 25 bp, Homo sapien
aagcgccaaaaaggcattgtatagt

SEQ ID NO: 86183 - DNA, 25 bp, Homo sapien
ggtggcttatggcttctttatcctc

SEQ ID NO: 86184 - DNA, 25 bp, Homo sapien
tatcctctgattctagcactttcaa

SEQ ID NO: 86185 - DNA, 25 bp, Homo sapien
gcactttcaagtgagctgttgcgta

SEQ ID NO: 86186 - DNA, 25 bp, Homo sapien
gagctgttgcgtactgtatcatatt

SEQ ID NO: 86187 - DNA, 25 bp, Homo sapien
gtatcatattgtagctattagggaa

SEQ ID NO: 86188 - DNA, 25 bp, Homo sapien
gaaagaacatcaccattgattttaa

SEQ ID NO: 86189 - DNA, 25 bp, Homo sapien
acaagtagcagggtattgcctttga

SEQ ID NO: 86190 - DNA, 25 bp, Homo sapien
gcagggtattgcctttgattcaact

SEQ ID NO: 86191 - DNA, 25 bp, Homo sapien
gattcaactgttttaagtcctcatt

SEQ ID NO: 86192 - DNA, 25 bp, Homo sapien
tttctcaaactaagtgcttgctgtt

SEQ ID NO: 86193 - DNA, 25 bp, Homo sapien
aagaggtaacagcactgggatccaa

SEQ ID NO: 86194 - DNA, 25 bp, Homo sapien
gagaaattcgagaccattttgcaag

SEQ ID NO: 86195 - DNA, 25 bp, Homo sapien
aagactgtgcccttctcctcaggac

SEQ ID NO: 86196 - DNA, 25 bp, Homo sapien
ggctcagttcttgaaaaacggtgtc

SEQ ID NO: 86197 - DNA, 25 bp, Homo sapien
aaaaacggtgtcatatttagtcaga

SEQ ID NO: 86198 - DNA, 25 bp, Homo sapien
ggatgaaggcacaggcgtctccaac

SEQ ID NO: 86199 - DNA, 25 bp, Homo sapien
gcacaggcgtctccaacctcagagg

SEQ ID NO: 86200 - DNA, 25 bp, Homo sapien
gagggagactgatgcaggcctacca

SEQ ID NO: 86201 - DNA, 25 bp, Homo sapien
actgatgcaggcctaccagtccctg

SEQ ID NO: 86202 - DNA, 25 bp, Homo sapien
accagtccctggctttttgtctggg

SEQ ID NO: 86203 - DNA, 25 bp, Homo sapien
tggaataaagaggtgccttcagctg

SEQ ID NO: 86204 - DNA, 25 bp, Homo sapien
cagagctgggctctaccccaaaagg

SEQ ID NO: 86205 - DNA, 25 bp, Homo sapien
ccaaaaggcttcaggccagctgcca

SEQ ID NO: 86206 - DNA, 25 bp, Homo sapien
cagctggaagcagaggccttcgtag

SEQ ID NO: 86207 - DNA, 25 bp, Homo sapien
gatggcctgcatgttgtaactaccc

SEQ ID NO: 86208 - DNA, 25 bp, Homo sapien
gaacagctcagctaaagccctcggg

SEQ ID NO: 86209 - DNA, 25 bp, Homo sapien
gggttccatccgtttaaatctgtgg

SEQ ID NO: 86210 - DNA, 25 bp, Homo sapien
tgtggcattttcagagcctcatctg

SEQ ID NO: 86211 - DNA, 25 bp, Homo sapien
tcatctgtcagccttaatgtcagtg

SEQ ID NO: 86212 - DNA, 25 bp, Homo sapien
gtggcaggaagtcataactccagct

SEQ ID NO: 86213 - DNA, 25 bp, Homo sapien
gtaaagttccctgattcttaatgtg

SEQ ID NO: 86214 - DNA, 25 bp, Homo sapien
aatgtgtaatgtctgccctatgtgt

SEQ ID NO: 86215 - DNA, 25 bp, Homo sapien
cagtcaccatatccagtgttgtgta

SEQ ID NO: 86216 - DNA, 25 bp, Homo sapien
gagactggccaacaggaccaaccaa

SEQ ID NO: 86217 - DNA, 25 bp, Homo sapien
ccatacaagatgaccctctgagctt

SEQ ID NO: 86218 - DNA, 25 bp, Homo sapien
gatgaccctctgagcttttcattta

SEQ ID NO: 86219 - DNA, 25 bp, Homo sapien
tattcaagctctgtggtacagcctt

SEQ ID NO: 86220 - DNA, 25 bp, Homo sapien
cactgactgcaaaactgcctgatgc

SEQ ID NO: 86221 - DNA, 25 bp, Homo sapien
tgcctgatgcagttgggttcctcct

SEQ ID NO: 86222 - DNA, 25 bp, Homo sapien
ttttgttacaaccacccttgcctgt

SEQ ID NO: 86223 - DNA, 25 bp, Homo sapien
ccacccttgcctgtttacattaatt

SEQ ID NO: 86224 - DNA, 25 bp, Homo sapien
aaggagcataacgtacaggctgtat

SEQ ID NO: 86225 - DNA, 25 bp, Homo sapien
ggctgtatgtacaatcctgggcatt

SEQ ID NO: 86226 - DNA, 25 bp, Homo sapien
ctgaccacatggagaaatcccgtct

SEQ ID NO: 86227 - DNA, 25 bp, Homo sapien
tgaccacatggagaaatcccgtctc

SEQ ID NO: 86228 - DNA, 25 bp, Homo sapien
gaccacatggagaaatcccgtctct

SEQ ID NO: 86229 - DNA, 25 bp, Homo sapien
accacatggagaaatcccgtctcta

SEQ ID NO: 86230 - DNA, 25 bp, Homo sapien
aaaactagccgggcttgttggcgca

SEQ ID NO: 86231 - DNA, 25 bp, Homo sapien
gcaggagaatcgcttcaacctgcaa

SEQ ID NO: 86232 - DNA, 25 bp, Homo sapien
caggagaatcgcttcaacctgcaag

SEQ ID NO: 86233 - DNA, 25 bp, Homo sapien
aggagaatcgcttcaacctgcaagg

SEQ ID NO: 86234 - DNA, 25 bp, Homo sapien
agaatcgcttcaacctgcaaggcag

SEQ ID NO: 86235 - DNA, 25 bp, Homo sapien
gaatcgcttcaacctgcaaggcaga

SEQ ID NO: 86236 - DNA, 25 bp, Homo sapien
aatcgcttcaacctgcaaggcagag

SEQ ID NO: 86237 - DNA, 25 bp, Homo sapien
atcccaggcccgtgtagctataaga

SEQ ID NO: 86238 - DNA, 25 bp, Homo sapien
ggcccgtgtagctataagaattctg

SEQ ID NO: 86239 - DNA, 25 bp, Homo sapien
aagaattctggcctggatcccaggt

SEQ ID NO: 86240 - DNA, 25 bp, Homo sapien
ggatcccaggtgtacaactatggac

SEQ ID NO: 86241 - DNA, 25 bp, Homo sapien
acaactatggacaagatatgggcct

SEQ ID NO: 86242 - DNA, 25 bp, Homo sapien
aagatatgggcctctactttctcct

SEQ ID NO: 86243 - DNA, 25 bp, Homo sapien
ggatgaaatgtcagctagggccatt

SEQ ID NO: 86244 - DNA, 25 bp, Homo sapien
tagggccattttggctgctgaggct

SEQ ID NO: 86245 - DNA, 25 bp, Homo sapien
ctgggatttggtttagttactgaat

SEQ ID NO: 86246 - DNA, 25 bp, Homo sapien
caagtggttggatcctgtttttgtt

SEQ ID NO: 86247 - DNA, 25 bp, Homo sapien
gtggtacatgtgtctttccaagaga

SEQ ID NO: 86248 - DNA, 25 bp, Homo sapien
aggatggctggatccgagtctccag

SEQ ID NO: 86249 - DNA, 25 bp, Homo sapien
ccgagtctccagtgacaatgtggct

SEQ ID NO: 86250 - DNA, 25 bp, Homo sapien
atgagaagtatagtggctctacccc

SEQ ID NO: 86251 - DNA, 25 bp, Homo sapien
gggtgactgtcattggtaatacgga

SEQ ID NO: 86252 - DNA, 25 bp, Homo sapien
taatacggacacagtgacccatcct

SEQ ID NO: 86253 - DNA, 25 bp, Homo sapien
cccatcctccatcctatttatagtg

SEQ ID NO: 86254 - DNA, 25 bp, Homo sapien
gaagggccttcaattgtatcagtac

SEQ ID NO: 86255 - DNA, 25 bp, Homo sapien
taagctctggcacattgacctctat

SEQ ID NO: 86256 - DNA, 25 bp, Homo sapien
gacctctatgtgttaccagtcatta

SEQ ID NO: 86257 - DNA, 25 bp, Homo sapien
accagtcattaatgagctgctgcag

SEQ ID NO: 86258 - DNA, 25 bp, Homo sapien
gctgctgcagaggtgactatttgtt

SEQ ID NO: 86259 - DNA, 25 bp, Homo sapien
tggccaggctgcacacattcttatt

SEQ ID NO: 86260 - DNA, 25 bp, Homo sapien
aggctgcacacattcttattagatt

SEQ ID NO: 86261 - DNA, 25 bp, Homo sapien
attcttattagattccaccttgttc

SEQ ID NO: 86262 - DNA, 25 bp, Homo sapien
ttattagattccaccttgttctggt

SEQ ID NO: 86263 - DNA, 25 bp, Homo sapien
gattccaccttgttctggtgttgta

SEQ ID NO: 86264 - DNA, 25 bp, Homo sapien
ccttgttctggtgttgtagagatgt

SEQ ID NO: 86265 - DNA, 25 bp, Homo sapien
gagatgtgattaggtatttagtgaa

SEQ ID NO: 86266 - DNA, 25 bp, Homo sapien
tgaattcaccaagtgaggagagaat

SEQ ID NO: 86267 - DNA, 25 bp, Homo sapien
gaaaagaaaacacaacctgcctggc

SEQ ID NO: 86268 - DNA, 25 bp, Homo sapien
aagaaaacacaacctgcctggccag

SEQ ID NO: 86269 - DNA, 25 bp, Homo sapien
aacacaacctgcctggccaggcgtg

SEQ ID NO: 86270 - DNA, 25 bp, Homo sapien
ccagtgtgccacattaaatacccgt

SEQ ID NO: 86271 - DNA, 25 bp, Homo sapien
ttaaatacccgtgcaggcgcggaga

SEQ ID NO: 86272 - DNA, 25 bp, Homo sapien
caggcgcggagaagcaaccggcacc

SEQ ID NO: 86273 - DNA, 25 bp, Homo sapien
aaagccctccctgcaagaaggtgtg

SEQ ID NO: 86274 - DNA, 25 bp, Homo sapien
atctgggttctagagggcatgtgat

SEQ ID NO: 86275 - DNA, 25 bp, Homo sapien
ctagagggcatgtgatgactgtaaa

SEQ ID NO: 86276 - DNA, 25 bp, Homo sapien
gactgtaaatgttcactgggtgggt

SEQ ID NO: 86277 - DNA, 25 bp, Homo sapien
gtagggagtggtatccagtgttcaa

SEQ ID NO: 86278 - DNA, 25 bp, Homo sapien
gtggtatccagtgttcaagtgcaga

SEQ ID NO: 86279 - DNA, 25 bp, Homo sapien
tctttggctttgctaccagttccat

SEQ ID NO: 86280 - DNA, 25 bp, Homo sapien
tggctttgctaccagttccatatga

SEQ ID NO: 86281 - DNA, 25 bp, Homo sapien
aagcaagggtttttggccaggcgtg

SEQ ID NO: 86282 - DNA, 25 bp, Homo sapien
agcaagggtttttggccaggcgtgg

SEQ ID NO: 86283 - DNA, 25 bp, Homo sapien
gcaagggtttttggccaggcgtggt

SEQ ID NO: 86284 - DNA, 25 bp, Homo sapien
caagggtttttggccaggcgtggtg

SEQ ID NO: 86285 - DNA, 25 bp, Homo sapien
ggccgaggccggcaaatcacctaag

SEQ ID NO: 86286 - DNA, 25 bp, Homo sapien
gccgaggccggcaaatcacctaagg

SEQ ID NO: 86287 - DNA, 25 bp, Homo sapien
ccgaggccggcaaatcacctaaggt

SEQ ID NO: 86288 - DNA, 25 bp, Homo sapien
cgaggccggcaaatcacctaaggtc

SEQ ID NO: 86289 - DNA, 25 bp, Homo sapien
gaggccggcaaatcacctaaggtca

SEQ ID NO: 86290 - DNA, 25 bp, Homo sapien
aggccggcaaatcacctaaggtcag

SEQ ID NO: 86291 - DNA, 25 bp, Homo sapien
agcccggtgtggtggcaagtgcctg

SEQ ID NO: 86292 - DNA, 25 bp, Homo sapien
gcaggcgaggccgacagacctacag

SEQ ID NO: 86293 - DNA, 25 bp, Homo sapien
gagttcctatttaatccctatctga

SEQ ID NO: 86294 - DNA, 25 bp, Homo sapien
tatctgactcgtaagcggcgaatcg

SEQ ID NO: 86295 - DNA, 25 bp, Homo sapien
taagcggcgaatcgaggtatcgcac

SEQ ID NO: 86296 - DNA, 25 bp, Homo sapien
atcgaggtatcgcacgccctgggac

SEQ ID NO: 86297 - DNA, 25 bp, Homo sapien
gcacgccctgggactgacagagaga

SEQ ID NO: 86298 - DNA, 25 bp, Homo sapien
aacaaagacaagttccccagcagca

SEQ ID NO: 86299 - DNA, 25 bp, Homo sapien
agacaagttccccagcagcaaatgc

SEQ ID NO: 86300 - DNA, 25 bp, Homo sapien
gttccccagcagcaaatgcgagcag

SEQ ID NO: 86301 - DNA, 25 bp, Homo sapien
gaaacagaagctggagcgggcccca

SEQ ID NO: 86302 - DNA, 25 bp, Homo sapien
agggcgacgcgcagaagggcgacaa

SEQ ID NO: 86303 - DNA, 25 bp, Homo sapien
tctgattcccaccccacataggaat

SEQ ID NO: 86304 - DNA, 25 bp, Homo sapien
ctgattcccaccccacataggaata

SEQ ID NO: 86305 - DNA, 25 bp, Homo sapien
cccacataggaatagcctgactgag

SEQ ID NO: 86306 - DNA, 25 bp, Homo sapien
ccacataggaatagcctgactgagg

SEQ ID NO: 86307 - DNA, 25 bp, Homo sapien
cacataggaatagcctgactgaggg

SEQ ID NO: 86308 - DNA, 25 bp, Homo sapien
acataggaatagcctgactgagggg

SEQ ID NO: 86309 - DNA, 25 bp, Homo sapien
cataggaatagcctgactgaggggg

SEQ ID NO: 86310 - DNA, 25 bp, Homo sapien
ataggaatagcctgactgaggggga

SEQ ID NO: 86311 - DNA, 25 bp, Homo sapien
taggaatagcctgactgagggggaa

SEQ ID NO: 86312 - DNA, 25 bp, Homo sapien
aggaatagcctgactgagggggaag

SEQ ID NO: 86313 - DNA, 25 bp, Homo sapien
tgtcatcagcttctgaggaatctgt

SEQ ID NO: 86314 - DNA, 25 bp, Homo sapien
tgaggaatctgtgctttctgtccca

SEQ ID NO: 86315 - DNA, 25 bp, Homo sapien
gctttctgtcccagaactccaggtg

SEQ ID NO: 86316 - DNA, 25 bp, Homo sapien
gaatattctcaagtatttcgtggac

SEQ ID NO: 86317 - DNA, 25 bp, Homo sapien
tcaagtatttcgtggactcagtaat

SEQ ID NO: 86318 - DNA, 25 bp, Homo sapien
ggactcagtaatatgtatcacttat

SEQ ID NO: 86319 - DNA, 25 bp, Homo sapien
tcacttattgatatgccacctgctt

SEQ ID NO: 86320 - DNA, 25 bp, Homo sapien
tattgatatgccacctgcttgcttg

SEQ ID NO: 86321 - DNA, 25 bp, Homo sapien
ctgcttgcttgctgcactatggata

SEQ ID NO: 86322 - DNA, 25 bp, Homo sapien
gcttgctgcactatggatagtccta

SEQ ID NO: 86323 - DNA, 25 bp, Homo sapien
ttgatttgtgaatgcattatgggac

SEQ ID NO: 86324 - DNA, 25 bp, Homo sapien
catcgaggcgatgggcaaggcagag

SEQ ID NO: 86325 - DNA, 25 bp, Homo sapien
agcggatgaagctcaaggcagaagc

SEQ ID NO: 86326 - DNA, 25 bp, Homo sapien
ggatgaagctcaaggcagaagccta

SEQ ID NO: 86327 - DNA, 25 bp, Homo sapien
gaagctcaaggcagaagcctaccag

SEQ ID NO: 86328 - DNA, 25 bp, Homo sapien
gctcaaggcagaagcctaccagaaa

SEQ ID NO: 86329 - DNA, 25 bp, Homo sapien
aaggcagaagcctaccagaaatacg

SEQ ID NO: 86330 - DNA, 25 bp, Homo sapien
ggcagaagcctaccagaaatacggg

SEQ ID NO: 86331 - DNA, 25 bp, Homo sapien
ccagattgctgccaaaatcgctgcc

SEQ ID NO: 86332 - DNA, 25 bp, Homo sapien
agattgctgccaaaatcgctgcccc

SEQ ID NO: 86333 - DNA, 25 bp, Homo sapien
gattgctgccaaaatcgctgcccca

SEQ ID NO: 86334 - DNA, 25 bp, Homo sapien
actgcctgtcccttctggtaaaata

SEQ ID NO: 86335 - DNA, 25 bp, Homo sapien
ggtctggagccgtttctctctaggg

SEQ ID NO: 86336 - DNA, 25 bp, Homo sapien
tctcaggactctccgagggtcaagg

SEQ ID NO: 86337 - DNA, 25 bp, Homo sapien
ctccgagggtcaaggatggatgcct

SEQ ID NO: 86338 - DNA, 25 bp, Homo sapien
tggatgcctccccatcgagggccaa

SEQ ID NO: 86339 - DNA, 25 bp, Homo sapien
catcgagggccaaacaaactgacaa

SEQ ID NO: 86340 - DNA, 25 bp, Homo sapien
aaactgacaaatcgagtgggcaaac

SEQ ID NO: 86341 - DNA, 25 bp, Homo sapien
gtgggcaaacggcttactcaaaggc

SEQ ID NO: 86342 - DNA, 25 bp, Homo sapien
aacggcttactcaaaggccaggagc

SEQ ID NO: 86343 - DNA, 25 bp, Homo sapien
aaggccaggagcagctacccgatga

SEQ ID NO: 86344 - DNA, 25 bp, Homo sapien
ccatcctttgatgggtggcctgtta

SEQ ID NO: 86345 - DNA, 25 bp, Homo sapien
ggtggcctgttacacgtttggaaat

SEQ ID NO: 86346 - DNA, 25 bp, Homo sapien
tgggaggcttttggtggtccccaca

SEQ ID NO: 86347 - DNA, 25 bp, Homo sapien
tcctgtcccttcttgggatgagaat

SEQ ID NO: 86348 - DNA, 25 bp, Homo sapien
agcttaggctgcttattggaccaga

SEQ ID NO: 86349 - DNA, 25 bp, Homo sapien
ggaccagaagtcctatcgactttat

SEQ ID NO: 86350 - DNA, 25 bp, Homo sapien
gtcctatcgactttatacagaactg

SEQ ID NO: 86351 - DNA, 25 bp, Homo sapien
agaggtgacccaatgctcctggagg

SEQ ID NO: 86352 - DNA, 25 bp, Homo sapien
gggcaagcctgtatagacagcactt

SEQ ID NO: 86353 - DNA, 25 bp, Homo sapien
tagacagcacttggctccttaggaa

SEQ ID NO: 86354 - DNA, 25 bp, Homo sapien
ggctccttaggaacagctcttcact

SEQ ID NO: 86355 - DNA, 25 bp, Homo sapien
ccacattggacttccttggtttgga

SEQ ID NO: 86356 - DNA, 25 bp, Homo sapien
ttggtttggacacagtgctccagct

SEQ ID NO: 86357 - DNA, 25 bp, Homo sapien
aagcccctgtgggaggcggacagca

SEQ ID NO: 86358 - DNA, 25 bp, Homo sapien
gggaggcggacagcagtgaccacct

SEQ ID NO: 86359 - DNA, 25 bp, Homo sapien
cttcttttggactgcgacctccttc

SEQ ID NO: 86360 - DNA, 25 bp, Homo sapien
cctgggagagccctgtgacctgcat

SEQ ID NO: 86361 - DNA, 25 bp, Homo sapien
tgacctgcatgctactcttaactgt

SEQ ID NO: 86362 - DNA, 25 bp, Homo sapien
gcatgctactcttaactgttctatt

SEQ ID NO: 86363 - DNA, 25 bp, Homo sapien
gctactcttaactgttctattcaag

SEQ ID NO: 86364 - DNA, 25 bp, Homo sapien
cttaactgttctattcaagactgaa

SEQ ID NO: 86365 - DNA, 25 bp, Homo sapien
tagaagtatttcagtcttgcagagg

SEQ ID NO: 86366 - DNA, 25 bp, Homo sapien
gaggaaatgctcagagctccgaggt

SEQ ID NO: 86367 - DNA, 25 bp, Homo sapien
cggctgtggtcgagaaccgggtgct

SEQ ID NO: 86368 - DNA, 25 bp, Homo sapien
tcccgggtgtggctttgattccctc

SEQ ID NO: 86369 - DNA, 25 bp, Homo sapien
gggtgtggctttgattccctcctcc

SEQ ID NO: 86370 - DNA, 25 bp, Homo sapien
tttgattccctcctccgggcactgt

SEQ ID NO: 86371 - DNA, 25 bp, Homo sapien
cgggcactgtccctgatacaaaaaa

SEQ ID NO: 86372 - DNA, 25 bp, Homo sapien
cagaggcagtgtgggctgatgatgt

SEQ ID NO: 86373 - DNA, 25 bp, Homo sapien
atgatgtgctttggccttctcggga

SEQ ID NO: 86374 - DNA, 25 bp, Homo sapien
atgtgctttggccttctcgggactg

SEQ ID NO: 86375 - DNA, 25 bp, Homo sapien
gctttggccttctcgggactgtcct

SEQ ID NO: 86376 - DNA, 25 bp, Homo sapien
cctcctcgctacagtgatgggctca

SEQ ID NO: 86377 - DNA, 25 bp, Homo sapien
agtgatgggctcaccccgccacagg

SEQ ID NO: 86378 - DNA, 25 bp, Homo sapien
gccacaggtatgcatgcgcccctgg

SEQ ID NO: 86379 - DNA, 25 bp, Homo sapien
cccatcttcttctttcagatcatta

SEQ ID NO: 86380 - DNA, 25 bp, Homo sapien
catcttcttctttcagatcattaat

SEQ ID NO: 86381 - DNA, 25 bp, Homo sapien
aggtccggaagcaaatcgagtccat

SEQ ID NO: 86382 - DNA, 25 bp, Homo sapien
gtccggaagcaaatcgagtccatat

SEQ ID NO: 86383 - DNA, 25 bp, Homo sapien
gcaaatcgagtccatatagctacat

SEQ ID NO: 86384 - DNA, 25 bp, Homo sapien
aaatcgagtccatatagctacattc

SEQ ID NO: 86385 - DNA, 25 bp, Homo sapien
tatagctacattccacccttgtatc

SEQ ID NO: 86386 - DNA, 25 bp, Homo sapien
ctacattccacccttgtatcctggg

SEQ ID NO: 86387 - DNA, 25 bp, Homo sapien
gtatcctgggtcttagagaccctat

SEQ ID NO: 86388 - DNA, 25 bp, Homo sapien
tgaaatggactgatttgcactcttg

SEQ ID NO: 86389 - DNA, 25 bp, Homo sapien
tggtggaatccccttttccccatct

SEQ ID NO: 86390 - DNA, 25 bp, Homo sapien
cgcctgcggccgaggtacagtgtcc

SEQ ID NO: 86391 - DNA, 25 bp, Homo sapien
tgcggccgaggtacagtgtccctgc

SEQ ID NO: 86392 - DNA, 25 bp, Homo sapien
gccgaggtacagtgtccctgccatt

SEQ ID NO: 86393 - DNA, 25 bp, Homo sapien
tctccccagtgccttgagagtttca

SEQ ID NO: 86394 - DNA, 25 bp, Homo sapien
cccagtgccttgagagtttcacctg

SEQ ID NO: 86395 - DNA, 25 bp, Homo sapien
cagtgccttgagagtttcacctggg

SEQ ID NO: 86396 - DNA, 25 bp, Homo sapien
gtgccttgagagtttcacctgggct

SEQ ID NO: 86397 - DNA, 25 bp, Homo sapien
tcacctgggctaggtcagttcggaa

SEQ ID NO: 86398 - DNA, 25 bp, Homo sapien
ctgggctaggtcagttcggaaactt

SEQ ID NO: 86399 - DNA, 25 bp, Homo sapien
ggctaggtcagttcggaaacttgaa

SEQ ID NO: 86400 - DNA, 25 bp, Homo sapien
taggtcagttcggaaacttgaaata

SEQ ID NO: 86401 - DNA, 25 bp, Homo sapien
tcattcccaggcactctcttttggt

SEQ ID NO: 86402 - DNA, 25 bp, Homo sapien
aggaaaaggcttgagtctggataat

SEQ ID NO: 86403 - DNA, 25 bp, Homo sapien
ggcttgagtctggataatttgtata

SEQ ID NO: 86404 - DNA, 25 bp, Homo sapien
aatttgtataagatgctgctgagca

SEQ ID NO: 86405 - DNA, 25 bp, Homo sapien
atgctgctgagcacatctcttcatg

SEQ ID NO: 86406 - DNA, 25 bp, Homo sapien
tgagcacatctcttcatgcgcagtc

SEQ ID NO: 86407 - DNA, 25 bp, Homo sapien
atgcgcagtccccaggtatctgatg

SEQ ID NO: 86408 - DNA, 25 bp, Homo sapien
gtccccaggtatctgatgatgttct

SEQ ID NO: 86409 - DNA, 25 bp, Homo sapien
atttacttggaatttgcttagcctt

SEQ ID NO: 86410 - DNA, 25 bp, Homo sapien
ggaatttgcttagcctttaataggc

SEQ ID NO: 86411 - DNA, 25 bp, Homo sapien
ttaataggcttgtgtaatttcctgc

SEQ ID NO: 86412 - DNA, 25 bp, Homo sapien
cgcctgtcggcccgtagatttatca

SEQ ID NO: 86413 - DNA, 25 bp, Homo sapien
atttatcaagggtgttatgggccca

SEQ ID NO: 86414 - DNA, 25 bp, Homo sapien
tttatcaagggtgttatgggcccag

SEQ ID NO: 86415 - DNA, 25 bp, Homo sapien
ttatcaagggtgttatgggcccagc

SEQ ID NO: 86416 - DNA, 25 bp, Homo sapien
tatcaagggtgttatgggcccagct

SEQ ID NO: 86417 - DNA, 25 bp, Homo sapien
atcaagggtgttatgggcccagctt

SEQ ID NO: 86418 - DNA, 25 bp, Homo sapien
tcaagggtgttatgggcccagcttt

SEQ ID NO: 86419 - DNA, 25 bp, Homo sapien
caagggtgttatgggcccagctttg

SEQ ID NO: 86420 - DNA, 25 bp, Homo sapien
ccagtcccgatgcactttgaggggt

SEQ ID NO: 86421 - DNA, 25 bp, Homo sapien
gccctggggctgtttttaccatgtt

SEQ ID NO: 86422 - DNA, 25 bp, Homo sapien
ctggggctgtttttaccatgtttgt

SEQ ID NO: 86423 - DNA, 25 bp, Homo sapien
catgtctcaattctttgtatatgca

SEQ ID NO: 86424 - DNA, 25 bp, Homo sapien
atgtctcaattctttgtatatgcat

SEQ ID NO: 86425 - DNA, 25 bp, Homo sapien
tgtctcaattctttgtatatgcatt

SEQ ID NO: 86426 - DNA, 25 bp, Homo sapien
gtctcaattctttgtatatgcattc

SEQ ID NO: 86427 - DNA, 25 bp, Homo sapien
tctcaattctttgtatatgcattct

SEQ ID NO: 86428 - DNA, 25 bp, Homo sapien
ctcaattctttgtatatgcattctt

SEQ ID NO: 86429 - DNA, 25 bp, Homo sapien
tcaattctttgtatatgcattcttt

SEQ ID NO: 86430 - DNA, 25 bp, Homo sapien
caattctttgtatatgcattctttt

SEQ ID NO: 86431 - DNA, 25 bp, Homo sapien
aattctttgtatatgcattcttttc

SEQ ID NO: 86432 - DNA, 25 bp, Homo sapien
attctttgtatatgcattcttttca

SEQ ID NO: 86433 - DNA, 25 bp, Homo sapien
caaaggttcttctgtcccaagtact

SEQ ID NO: 86434 - DNA, 25 bp, Homo sapien
tgtcccaagtactcggtgtcagagc

SEQ ID NO: 86435 - DNA, 25 bp, Homo sapien
gcagatggtcgcctgtgttcacagt

SEQ ID NO: 86436 - DNA, 25 bp, Homo sapien
gtgttcacagtggtcatttccatac

SEQ ID NO: 86437 - DNA, 25 bp, Homo sapien
atactgtttgcctcctcgtctgagt

SEQ ID NO: 86438 - DNA, 25 bp, Homo sapien
tgagtctcctgtagcatctggttca

SEQ ID NO: 86439 - DNA, 25 bp, Homo sapien
tagcatctggttcagtgtttccctg

SEQ ID NO: 86440 - DNA, 25 bp, Homo sapien
agttaattgttcatcttgccccttt

SEQ ID NO: 86441 - DNA, 25 bp, Homo sapien
gcccctttagttctcatgcacagaa

SEQ ID NO: 86442 - DNA, 25 bp, Homo sapien
agaattcctccatagcaggctgttg

SEQ ID NO: 86443 - DNA, 25 bp, Homo sapien
agaacctcttcttgtgtcgcatttt

SEQ ID NO: 86444 - DNA, 25 bp, Homo sapien
ggctctgggagggacccttctaaga

SEQ ID NO: 86445 - DNA, 25 bp, Homo sapien
tgggagggacccttctaagaagatt

SEQ ID NO: 86446 - DNA, 25 bp, Homo sapien
tctaagaagattgggcagttgggtt

SEQ ID NO: 86447 - DNA, 25 bp, Homo sapien
cagttgggtttctggcttgagatga

SEQ ID NO: 86448 - DNA, 25 bp, Homo sapien
ggtttctggcttgagatgaatccaa

SEQ ID NO: 86449 - DNA, 25 bp, Homo sapien
aaaactggggtgcactcagctctca

SEQ ID NO: 86450 - DNA, 25 bp, Homo sapien
actcagctctcacaggggtaatcat

SEQ ID NO: 86451 - DNA, 25 bp, Homo sapien
gggtaatcatctcaagtggtatttg

SEQ ID NO: 86452 - DNA, 25 bp, Homo sapien
tctcaagtggtatttgtagccaagt

SEQ ID NO: 86453 - DNA, 25 bp, Homo sapien
gtagccaagtgggagctattttctt

SEQ ID NO: 86454 - DNA, 25 bp, Homo sapien
tcttttttgtgcatatagatatttc

SEQ ID NO: 86455 - DNA, 25 bp, Homo sapien
aatggagcgatgatagcccaggctg

SEQ ID NO: 86456 - DNA, 25 bp, Homo sapien
gatgtttcgggctggacacaggacc

SEQ ID NO: 86457 - DNA, 25 bp, Homo sapien
acaggaccccactcagtgattctgg

SEQ ID NO: 86458 - DNA, 25 bp, Homo sapien
ggttacacagaggtatcggacagat

SEQ ID NO: 86459 - DNA, 25 bp, Homo sapien
gtgacctggagggactaataagatc

SEQ ID NO: 86460 - DNA, 25 bp, Homo sapien
cagagtagatagttccttaatcgga

SEQ ID NO: 86461 - DNA, 25 bp, Homo sapien
tgcctcaatctctatcctgatgtca

SEQ ID NO: 86462 - DNA, 25 bp, Homo sapien
atcctgatgtcatgggagtcctagc

SEQ ID NO: 86463 - DNA, 25 bp, Homo sapien
gggagtcctagcaaagctatagact

SEQ ID NO: 86464 - DNA, 25 bp, Homo sapien
agctatagactccaagcaaggcttg

SEQ ID NO: 86465 - DNA, 25 bp, Homo sapien
gattctgtattgacaatggagcgat

SEQ ID NO: 86466 - DNA, 25 bp, Homo sapien
aaagttacagccatatgcaggacgg

SEQ ID NO: 86467 - DNA, 25 bp, Homo sapien
gcaggacggcagtactcagcatggt

SEQ ID NO: 86468 - DNA, 25 bp, Homo sapien
acggcagtactcagcatggtcttat

SEQ ID NO: 86469 - DNA, 25 bp, Homo sapien
catggtcttatgcacaggaactaaa

SEQ ID NO: 86470 - DNA, 25 bp, Homo sapien
accacaacttcgcaggatctaacaa

SEQ ID NO: 86471 - DNA, 25 bp, Homo sapien
acaagattgctgagatcctatgtaa

SEQ ID NO: 86472 - DNA, 25 bp, Homo sapien
tcctatgtaaggacctgtggcgcaa

SEQ ID NO: 86473 - DNA, 25 bp, Homo sapien
acctgtggcgcaatcccctgcaata

SEQ ID NO: 86474 - DNA, 25 bp, Homo sapien
tgcaatactacaagaggatgaagcc

SEQ ID NO: 86475 - DNA, 25 bp, Homo sapien
gggactcccagttgttgagttgaat

SEQ ID NO: 86476 - DNA, 25 bp, Homo sapien
ggagcatcagattttacctaataca

SEQ ID NO: 86477 - DNA, 25 bp, Homo sapien
cttgatgtagctaagctgcttcagt

SEQ ID NO: 86478 - DNA, 25 bp, Homo sapien
taagctgcttcagtgatcttcacat

SEQ ID NO: 86479 - DNA, 25 bp, Homo sapien
cagtgatcttcacatttgcactcca

SEQ ID NO: 86480 - DNA, 25 bp, Homo sapien
cttcacatttgcactccagtttttt

SEQ ID NO: 86481 - DNA, 25 bp, Homo sapien
aaaaagcggtttctacctctctatg

SEQ ID NO: 86482 - DNA, 25 bp, Homo sapien
tctacctctctatgtgcctgagtga

SEQ ID NO: 86483 - DNA, 25 bp, Homo sapien
gtgcctgagtgatgatacaatcgct

SEQ ID NO: 86484 - DNA, 25 bp, Homo sapien
gatacaatcgctgtttagttactag

SEQ ID NO: 86485 - DNA, 25 bp, Homo sapien
aatcgctgtttagttactagatgaa

SEQ ID NO: 86486 - DNA, 25 bp, Homo sapien
gatttgcttgcaatgaccttataag

SEQ ID NO: 86487 - DNA, 25 bp, Homo sapien
gcttgcaatgaccttataagtgaca

SEQ ID NO: 86488 - DNA, 25 bp, Homo sapien
tgcatggtagcatttttgcttgctg

SEQ ID NO: 86489 - DNA, 25 bp, Homo sapien
ttgctgtgttttccatacttaagaa

SEQ ID NO: 86490 - DNA, 25 bp, Homo sapien
gaaaaagaggtttcagttggctgat

SEQ ID NO: 86491 - DNA, 25 bp, Homo sapien
cagttggctgatagaatatctttta

SEQ ID NO: 86492 - DNA, 25 bp, Homo sapien
gaatatcttttatgtaggacaaaac

SEQ ID NO: 86493 - DNA, 25 bp, Homo sapien
ggacaaaacttttctgtgaagagtg

SEQ ID NO: 86494 - DNA, 25 bp, Homo sapien
acttttctgtgaagagtgttgaggg

SEQ ID NO: 86495 - DNA, 25 bp, Homo sapien
gttctaaacgtatttggtatgccta

SEQ ID NO: 86496 - DNA, 25 bp, Homo sapien
aaaatgggtttgtatgctgtttaat

SEQ ID NO: 86497 - DNA, 25 bp, Homo sapien
gtatgctgtttaatgtgcactgaac

SEQ ID NO: 86498 - DNA, 25 bp, Homo sapien
gctgtttaatgtgcactgaacattt

SEQ ID NO: 86499 - DNA, 25 bp, Homo sapien
aggtgaggggatccggaacgcgaga

SEQ ID NO: 86500 - DNA, 25 bp, Homo sapien
gatccggaacgcgagaccggaggcg

SEQ ID NO: 86501 - DNA, 25 bp, Homo sapien
atccggaacgcgagaccggaggcgg

SEQ ID NO: 86502 - DNA, 25 bp, Homo sapien
cggaacgcgagaccggaggcggcca

SEQ ID NO: 86503 - DNA, 25 bp, Homo sapien
aacgcgagaccggaggcggccagca

SEQ ID NO: 86504 - DNA, 25 bp, Homo sapien
acgcgagaccggaggcggccagcat

SEQ ID NO: 86505 - DNA, 25 bp, Homo sapien
accggaggcggccagcatcgccggg

SEQ ID NO: 86506 - DNA, 25 bp, Homo sapien
aggcggccagcatcgccgggaggtg

SEQ ID NO: 86507 - DNA, 25 bp, Homo sapien
ggcggccagcatcgccgggaggtgt

SEQ ID NO: 86508 - DNA, 25 bp, Homo sapien
gccagcatcgccgggaggtgtttgg

SEQ ID NO: 86509 - DNA, 25 bp, Homo sapien
ccagcatcgccgggaggtgtttggg

SEQ ID NO: 86510 - DNA, 25 bp, Homo sapien
gggagaattccaggtgccttaatat

SEQ ID NO: 86511 - DNA, 25 bp, Homo sapien
aattccaggtgccttaatataaagt

SEQ ID NO: 86512 - DNA, 25 bp, Homo sapien
taaagtttgaagcttcatccaccaa

SEQ ID NO: 86513 - DNA, 25 bp, Homo sapien
gaagcttcatccaccaaagttaaat

SEQ ID NO: 86514 - DNA, 25 bp, Homo sapien
tcatccaccaaagttaaatagagct

SEQ ID NO: 86515 - DNA, 25 bp, Homo sapien
tgcactttatttgtactctgtgtgg

SEQ ID NO: 86516 - DNA, 25 bp, Homo sapien
tttgtttgctgaatggatgaaacca

SEQ ID NO: 86517 - DNA, 25 bp, Homo sapien
gatgaaaccattgcattcttgtaca

SEQ ID NO: 86518 - DNA, 25 bp, Homo sapien
aaaccattgcattcttgtacactga

SEQ ID NO: 86519 - DNA, 25 bp, Homo sapien
attgcattcttgtacactgatttga

SEQ ID NO: 86520 - DNA, 25 bp, Homo sapien
tatgtcccaatttgtattgattctc

SEQ ID NO: 86521 - DNA, 25 bp, Homo sapien
agcattctaaactattcacccatgg

SEQ ID NO: 86522 - DNA, 25 bp, Homo sapien
gcattctaaactattcacccatggg

SEQ ID NO: 86523 - DNA, 25 bp, Homo sapien
attctaaactattcacccatgggtt

SEQ ID NO: 86524 - DNA, 25 bp, Homo sapien
actttcagggctcaccaggcactgg

SEQ ID NO: 86525 - DNA, 25 bp, Homo sapien
accaggcactggcagggagggtaag

SEQ ID NO: 86526 - DNA, 25 bp, Homo sapien
agggtaagggctggctccagatacc

SEQ ID NO: 86527 - DNA, 25 bp, Homo sapien
taagggctggctccagatacccctc

SEQ ID NO: 86528 - DNA, 25 bp, Homo sapien
ccccacagattcctagcaatgaaaa

SEQ ID NO: 86529 - DNA, 25 bp, Homo sapien
gattcctagcaatgaaaatctaata

SEQ ID NO: 86530 - DNA, 25 bp, Homo sapien
cagccacatcccttggttttgtatt

SEQ ID NO: 86531 - DNA, 25 bp, Homo sapien
gccacatcccttggttttgtatttt

SEQ ID NO: 86532 - DNA, 25 bp, Homo sapien
aatcaagcacgtctttttagtgaga

SEQ ID NO: 86533 - DNA, 25 bp, Homo sapien
gataaaatctgagctcttctgtaga

SEQ ID NO: 86534 - DNA, 25 bp, Homo sapien
gaaaaatcaatctctaccagtagaa

SEQ ID NO: 86535 - DNA, 25 bp, Homo sapien
aatgccagggcttgatggaagagct

SEQ ID NO: 86536 - DNA, 25 bp, Homo sapien
ggaagagctgtgtagccctttctat

SEQ ID NO: 86537 - DNA, 25 bp, Homo sapien
tagccctttctatgccaaagccagg

SEQ ID NO: 86538 - DNA, 25 bp, Homo sapien
ggcaggaggaggttctcagaatcca

SEQ ID NO: 86539 - DNA, 25 bp, Homo sapien
agtctgtatctttgctgtatgccaa

SEQ ID NO: 86540 - DNA, 25 bp, Homo sapien
gtatgccaaactgaaaccactggga

SEQ ID NO: 86541 - DNA, 25 bp, Homo sapien
aaaaatcttctgtacttcactccaa

SEQ ID NO: 86542 - DNA, 25 bp, Homo sapien
ttcactccaaggtacatttgcttac

SEQ ID NO: 86543 - DNA, 25 bp, Homo sapien
tgcgtctgagatcaatgtacggagc

SEQ ID NO: 86544 - DNA, 25 bp, Homo sapien
gcgtctgagatcaatgtacggagct

SEQ ID NO: 86545 - DNA, 25 bp, Homo sapien
cgtctgagatcaatgtacggagctc

SEQ ID NO: 86546 - DNA, 25 bp, Homo sapien
gtctgagatcaatgtacggagctca

SEQ ID NO: 86547 - DNA, 25 bp, Homo sapien
tctgagatcaatgtacggagctcat

SEQ ID NO: 86548 - DNA, 25 bp, Homo sapien
ctgagatcaatgtacggagctcata

SEQ ID NO: 86549 - DNA, 25 bp, Homo sapien
gagatcaatgtacggagctcataag

SEQ ID NO: 86550 - DNA, 25 bp, Homo sapien
gatcaatgtacggagctcataagta

SEQ ID NO: 86551 - DNA, 25 bp, Homo sapien
tcaatgtacggagctcataagtacc

SEQ ID NO: 86552 - DNA, 25 bp, Homo sapien
aatgtacggagctcataagtaccag

SEQ ID NO: 86553 - DNA, 25 bp, Homo sapien
atgtacggagctcataagtaccagg

SEQ ID NO: 86554 - DNA, 25 bp, Homo sapien
tcctttagagatctggatatttttc

SEQ ID NO: 86555 - DNA, 25 bp, Homo sapien
tcaaagacttgctttttacgcacat

SEQ ID NO: 86556 - DNA, 25 bp, Homo sapien
gacttgctttttacgcacattgtga

SEQ ID NO: 86557 - DNA, 25 bp, Homo sapien
tacgcacattgtgatagagcatctt

SEQ ID NO: 86558 - DNA, 25 bp, Homo sapien
ttttgttgactcacgtaacctccat

SEQ ID NO: 86559 - DNA, 25 bp, Homo sapien
ttgactcacgtaacctccatgtgtg

SEQ ID NO: 86560 - DNA, 25 bp, Homo sapien
aacctccatgtgtgggtcctttgtt

SEQ ID NO: 86561 - DNA, 25 bp, Homo sapien
tgtgtgggtcctttgttttattaga

SEQ ID NO: 86562 - DNA, 25 bp, Homo sapien
ctgggccatcagtatgtgttgcaga

SEQ ID NO: 86563 - DNA, 25 bp, Homo sapien
agtatgtgttgcagagctcacagcc

SEQ ID NO: 86564 - DNA, 25 bp, Homo sapien
ctataaatcaccagtttttggcatt

SEQ ID NO: 86565 - DNA, 25 bp, Homo sapien
gcaggttaacctcaatgatagcagt

SEQ ID NO: 86566 - DNA, 25 bp, Homo sapien
tgttctatcttatgtatttctttta

SEQ ID NO: 86567 - DNA, 25 bp, Homo sapien
ttaccattatggtgctactgagcgt

SEQ ID NO: 86568 - DNA, 25 bp, Homo sapien
cattatggtgctactgagcgttttc

SEQ ID NO: 86569 - DNA, 25 bp, Homo sapien
aagaaaaatgccatgggctgcagtc

SEQ ID NO: 86570 - DNA, 25 bp, Homo sapien
tttccctaccaggtccattaatatg

SEQ ID NO: 86571 - DNA, 25 bp, Homo sapien
atatgcttataacactagtgccagt

SEQ ID NO: 86572 - DNA, 25 bp, Homo sapien
actagtgccagttattttatttgat

SEQ ID NO: 86573 - DNA, 25 bp, Homo sapien
gataatgcttatggtatttgtatat

SEQ ID NO: 86574 - DNA, 25 bp, Homo sapien
atttgtttgcattccaattttgttt

SEQ ID NO: 86575 - DNA, 25 bp, Homo sapien
gagtgtgtaaactgcatacgttaaa

SEQ ID NO: 86576 - DNA, 25 bp, Homo sapien
ccctcagagtactaggaccacagaa

SEQ ID NO: 86577 - DNA, 25 bp, Homo sapien
agaagccctgttgctcactgacctg

SEQ ID NO: 86578 - DNA, 25 bp, Homo sapien
gttgctcactgacctgtgaccaggt

SEQ ID NO: 86579 - DNA, 25 bp, Homo sapien
tgacctgtgaccaggtccaatgtgg

SEQ ID NO: 86580 - DNA, 25 bp, Homo sapien
aaggaggtagcagccctgggttctc

SEQ ID NO: 86581 - DNA, 25 bp, Homo sapien
agccctgggttctcctcagtgaggg

SEQ ID NO: 86582 - DNA, 25 bp, Homo sapien
tgggttctcctcagtgagggatccc

SEQ ID NO: 86583 - DNA, 25 bp, Homo sapien
tgcaccagcaccctgagatggagct

SEQ ID NO: 86584 - DNA, 25 bp, Homo sapien
gagatggagctgagactttatttat

SEQ ID NO: 86585 - DNA, 25 bp, Homo sapien
aggaggtccctccaacatgtttgga

SEQ ID NO: 86586 - DNA, 25 bp, Homo sapien
ctgcccagaaccaagtgccatttct

SEQ ID NO: 86587 - DNA, 25 bp, Homo sapien
gtggactaaatacggatccctgctg

SEQ ID NO: 86588 - DNA, 25 bp, Homo sapien
tacggatccctgctgaatccacagg

SEQ ID NO: 86589 - DNA, 25 bp, Homo sapien
gtaactgcaaatctaatttcatcct

SEQ ID NO: 86590 - DNA, 25 bp, Homo sapien
taatttcatcctcctttcctgaggc

SEQ ID NO: 86591 - DNA, 25 bp, Homo sapien
aggacgattcttatttccactgcgg

SEQ ID NO: 86592 - DNA, 25 bp, Homo sapien
atttccactgcggttacttttgtgg

SEQ ID NO: 86593 - DNA, 25 bp, Homo sapien
ttcttcttcccgtttgtttgacaat

SEQ ID NO: 86594 - DNA, 25 bp, Homo sapien
gtttgtttgacaatgctcagatgca

SEQ ID NO: 86595 - DNA, 25 bp, Homo sapien
tgctcagatgcatcagttccttaat

SEQ ID NO: 86596 - DNA, 25 bp, Homo sapien
gcatcagttccttaatatacacgtg

SEQ ID NO: 86597 - DNA, 25 bp, Homo sapien
gaaaactgtacattcggtgagatta

SEQ ID NO: 86598 - DNA, 25 bp, Homo sapien
ggtggatcacgaggtaggagttaaa

SEQ ID NO: 86599 - DNA, 25 bp, Homo sapien
gtggatcacgaggtaggagttaaag

SEQ ID NO: 86600 - DNA, 25 bp, Homo sapien
tggatcacgaggtaggagttaaaga

SEQ ID NO: 86601 - DNA, 25 bp, Homo sapien
ggatcacgaggtaggagttaaagac

SEQ ID NO: 86602 - DNA, 25 bp, Homo sapien
gatcacgaggtaggagttaaagacc

SEQ ID NO: 86603 - DNA, 25 bp, Homo sapien
atcacgaggtaggagttaaagacca

SEQ ID NO: 86604 - DNA, 25 bp, Homo sapien
tcacgaggtaggagttaaagaccag

SEQ ID NO: 86605 - DNA, 25 bp, Homo sapien
atggcaaaaccctactaaagataca

SEQ ID NO: 86606 - DNA, 25 bp, Homo sapien
tggcaaaaccctactaaagatacaa

SEQ ID NO: 86607 - DNA, 25 bp, Homo sapien
ccttcttgtttggagatgagaactt

SEQ ID NO: 86608 - DNA, 25 bp, Homo sapien
cttcttgtttggagatgagaacttc

SEQ ID NO: 86609 - DNA, 25 bp, Homo sapien
ttcttgtttggagatgagaacttct

SEQ ID NO: 86610 - DNA, 25 bp, Homo sapien
tcttgtttggagatgagaacttctc

SEQ ID NO: 86611 - DNA, 25 bp, Homo sapien
cttgtttggagatgagaacttctcc

SEQ ID NO: 86612 - DNA, 25 bp, Homo sapien
ttgtttggagatgagaacttctcct

SEQ ID NO: 86613 - DNA, 25 bp, Homo sapien
tgtttggagatgagaacttctcctg

SEQ ID NO: 86614 - DNA, 25 bp, Homo sapien
gtttggagatgagaacttctcctgg

SEQ ID NO: 86615 - DNA, 25 bp, Homo sapien
tggagatgagaacttctcctggaag

SEQ ID NO: 86616 - DNA, 25 bp, Homo sapien
gtgaagccaccccaagcagtacgct

SEQ ID NO: 86617 - DNA, 25 bp, Homo sapien
gcagtacgcttgctggtctaagtct

SEQ ID NO: 86618 - DNA, 25 bp, Homo sapien
agtacgcttgctggtctaagtctta

SEQ ID NO: 86619 - DNA, 25 bp, Homo sapien
gtacgcttgctggtctaagtcttaa

SEQ ID NO: 86620 - DNA, 25 bp, Homo sapien
tacgcttgctggtctaagtcttaac

SEQ ID NO: 86621 - DNA, 25 bp, Homo sapien
cgcttgctggtctaagtcttaaccc

SEQ ID NO: 86622 - DNA, 25 bp, Homo sapien
gagtcacactgagacagtcaactgt

SEQ ID NO: 86623 - DNA, 25 bp, Homo sapien
gtcacactgagacagtcaactgtgt

SEQ ID NO: 86624 - DNA, 25 bp, Homo sapien
actgagacagtcaactgtgtgtgac

SEQ ID NO: 86625 - DNA, 25 bp, Homo sapien
acaatcaggaaggtgggccacttcc

SEQ ID NO: 86626 - DNA, 25 bp, Homo sapien
aggtgggccacttcctgatgagcct

SEQ ID NO: 86627 - DNA, 25 bp, Homo sapien
ctgagatggagctgagactttattt

SEQ ID NO: 86628 - DNA, 25 bp, Homo sapien
tgagatggagctgagactttattta

SEQ ID NO: 86629 - DNA, 25 bp, Homo sapien
gagatggagctgagactttatttat

SEQ ID NO: 86630 - DNA, 25 bp, Homo sapien
aggaggtccctccaacatgtttgga

SEQ ID NO: 86631 - DNA, 25 bp, Homo sapien
ggaggtccctccaacatgtttggac

SEQ ID NO: 86632 - DNA, 25 bp, Homo sapien
gaggtccctccaacatgtttggacc

SEQ ID NO: 86633 - DNA, 25 bp, Homo sapien
ggtccctccaacatgtttggaccca

SEQ ID NO: 86634 - DNA, 25 bp, Homo sapien
gtccctccaacatgtttggacccag

SEQ ID NO: 86635 - DNA, 25 bp, Homo sapien
tccaacatgtttggacccagctcct

SEQ ID NO: 86636 - DNA, 25 bp, Homo sapien
ccaacatgtttggacccagctcctt

SEQ ID NO: 86637 - DNA, 25 bp, Homo sapien
ctgcccagaaccaagtgccatttct

SEQ ID NO: 86638 - DNA, 25 bp, Homo sapien
gtggccccatcaaagtgaaaactga

SEQ ID NO: 86639 - DNA, 25 bp, Homo sapien
aaaactgaacccacagaagattctg

SEQ ID NO: 86640 - DNA, 25 bp, Homo sapien
agaagattctggcatttccctggaa

SEQ ID NO: 86641 - DNA, 25 bp, Homo sapien
ccctggaaatggcagctgtgacagt

SEQ ID NO: 86642 - DNA, 25 bp, Homo sapien
atataacattcaaggaagccaccat

SEQ ID NO: 86643 - DNA, 25 bp, Homo sapien
agccaccattcttcagagggcaatg

SEQ ID NO: 86644 - DNA, 25 bp, Homo sapien
aaaaagagattgcatattttccact

SEQ ID NO: 86645 - DNA, 25 bp, Homo sapien
gcatattttccactatttgttgtat

SEQ ID NO: 86646 - DNA, 25 bp, Homo sapien
gattctattatccttaaaacacctt

SEQ ID NO: 86647 - DNA, 25 bp, Homo sapien
tattatccttaaaacaccttatttg

SEQ ID NO: 86648 - DNA, 25 bp, Homo sapien
tggaaataaaaggtgattcccttgg

SEQ ID NO: 86649 - DNA, 25 bp, Homo sapien
gtggccccatcaaagtgaaaactga

SEQ ID NO: 86650 - DNA, 25 bp, Homo sapien
ggccccatcaaagtgaaaactgaac

SEQ ID NO: 86651 - DNA, 25 bp, Homo sapien
atcaaagtgaaaactgaacccacag

SEQ ID NO: 86652 - DNA, 25 bp, Homo sapien
ctgaacccacagaagattctggcat

SEQ ID NO: 86653 - DNA, 25 bp, Homo sapien
gaacccacagaagattctggcattt

SEQ ID NO: 86654 - DNA, 25 bp, Homo sapien
cccacagaagattctggcatttccc

SEQ ID NO: 86655 - DNA, 25 bp, Homo sapien
cagctgtgacagtaaaggaagaatc

SEQ ID NO: 86656 - DNA, 25 bp, Homo sapien
cagaagatcctgattattatcaata

SEQ ID NO: 86657 - DNA, 25 bp, Homo sapien
gaagatcctgattattatcaatata

SEQ ID NO: 86658 - DNA, 25 bp, Homo sapien
agagggcaatgaaggcacagaaatg

SEQ ID NO: 86659 - DNA, 25 bp, Homo sapien
cacagaaatggaagtaccagcagaa

SEQ ID NO: 86660 - DNA, 25 bp, Homo sapien
gcttcggtggagacagttatggaat

SEQ ID NO: 86661 - DNA, 25 bp, Homo sapien
ggtaggtcccccagcaagaaagagg

SEQ ID NO: 86662 - DNA, 25 bp, Homo sapien
agaaagagggacaggagcaccccag

SEQ ID NO: 86663 - DNA, 25 bp, Homo sapien
acaggagcaccccaggcaggaccaa

SEQ ID NO: 86664 - DNA, 25 bp, Homo sapien
aggagcaccccaggcaggaccaagg

SEQ ID NO: 86665 - DNA, 25 bp, Homo sapien
caaggagtcgggaggcccctgcctt

SEQ ID NO: 86666 - DNA, 25 bp, Homo sapien
gtgagggcacagatgtctccccaga

SEQ ID NO: 86667 - DNA, 25 bp, Homo sapien
tgagggcacagatgtctccccagag

SEQ ID NO: 86668 - DNA, 25 bp, Homo sapien
agggcacagatgtctccccagagcc

SEQ ID NO: 86669 - DNA, 25 bp, Homo sapien
gcgctggcagaatggattctgctcc

SEQ ID NO: 86670 - DNA, 25 bp, Homo sapien
tggcagaatggattctgctcctggc

SEQ ID NO: 86671 - DNA, 25 bp, Homo sapien
ggcagtttgcgctggccatgcccga

SEQ ID NO: 86672 - DNA, 25 bp, Homo sapien
gacagaagcagtacaacatccacgt

SEQ ID NO: 86673 - DNA, 25 bp, Homo sapien
aagcagtacaacatccacgtgggaa

SEQ ID NO: 86674 - DNA, 25 bp, Homo sapien
acaacatccacgtgggaactgctgg

SEQ ID NO: 86675 - DNA, 25 bp, Homo sapien
cacgtgggaactgctggatcaaagg

SEQ ID NO: 86676 - DNA, 25 bp, Homo sapien
aagaccaaaaatcagcgggctgagg

SEQ ID NO: 86677 - DNA, 25 bp, Homo sapien
tggagcacagccatgaacctgctca

SEQ ID NO: 86678 - DNA, 25 bp, Homo sapien
agccatgaacctgctcacgacaaga

SEQ ID NO: 86679 - DNA, 25 bp, Homo sapien
atgaacctgctcacgacaagacgca

SEQ ID NO: 86680 - DNA, 25 bp, Homo sapien
aagacgcacccatgcttctcagggt

SEQ ID NO: 86681 - DNA, 25 bp, Homo sapien
acccatgcttctcagggtcaaggct

SEQ ID NO: 86682 - DNA, 25 bp, Homo sapien
ctgcatccgcaaaggggcttcggaa

SEQ ID NO: 86683 - DNA, 25 bp, Homo sapien
ttctcgcttgggaacgccggtctca

SEQ ID NO: 86684 - DNA, 25 bp, Homo sapien
tctcgcttgggaacgccggtctcac

SEQ ID NO: 86685 - DNA, 25 bp, Homo sapien
ggactgccctgctctcggatgaaaa

SEQ ID NO: 86686 - DNA, 25 bp, Homo sapien
gactgccctgctctcggatgaaaac

SEQ ID NO: 86687 - DNA, 25 bp, Homo sapien
actgccctgctctcggatgaaaaca

SEQ ID NO: 86688 - DNA, 25 bp, Homo sapien
ctgccctgctctcggatgaaaacag

SEQ ID NO: 86689 - DNA, 25 bp, Homo sapien
tgggaacgccggtctcacctcggct

SEQ ID NO: 86690 - DNA, 25 bp, Homo sapien
gggaacgccggtctcacctcggctt

SEQ ID NO: 86691 - DNA, 25 bp, Homo sapien
tcctgcgccgctggaggctcctacg

SEQ ID NO: 86692 - DNA, 25 bp, Homo sapien
gccgctggaggctcctacgcctgcg

SEQ ID NO: 86693 - DNA, 25 bp, Homo sapien
ggagatcattcccagtgaccccttc

SEQ ID NO: 86694 - DNA, 25 bp, Homo sapien
agtgaccccttctgggtgccaacta

SEQ ID NO: 86695 - DNA, 25 bp, Homo sapien
cttctgggtgccaactactgaggag

SEQ ID NO: 86696 - DNA, 25 bp, Homo sapien
tactgaggaggaatacttgcacttt

SEQ ID NO: 86697 - DNA, 25 bp, Homo sapien
gggagaaggctgactctgagaacca

SEQ ID NO: 86698 - DNA, 25 bp, Homo sapien
gactctgagaaccaagcccggaagt

SEQ ID NO: 86699 - DNA, 25 bp, Homo sapien
aagcccggaagtacatgaacgcagt

SEQ ID NO: 86700 - DNA, 25 bp, Homo sapien
gaaaagattgtggagcatgcagaaa

SEQ ID NO: 86701 - DNA, 25 bp, Homo sapien
gaaaagcagaggacactcagcaaaa

SEQ ID NO: 86702 - DNA, 25 bp, Homo sapien
agctacctactactggtggattctt

SEQ ID NO: 86703 - DNA, 25 bp, Homo sapien
ctactggtggattcttttccttata

SEQ ID NO: 86704 - DNA, 25 bp, Homo sapien
cacttgctgtccatagttagacaaa

SEQ ID NO: 86705 - DNA, 25 bp, Homo sapien
aaaaaccaatttccactgcactagt

SEQ ID NO: 86706 - DNA, 25 bp, Homo sapien
caatttccactgcactagtaccaaa

SEQ ID NO: 86707 - DNA, 25 bp, Homo sapien
gcactagtaccaaaatactacttta

SEQ ID NO: 86708 - DNA, 25 bp, Homo sapien
aaagctgctggaatgtcatgattca

SEQ ID NO: 86709 - DNA, 25 bp, Homo sapien
agatttctgctaaaatcctctccct

SEQ ID NO: 86710 - DNA, 25 bp, Homo sapien
catttgatcatcagcacttgttagc

SEQ ID NO: 86711 - DNA, 25 bp, Homo sapien
gatcatcagcacttgttagcaggat

SEQ ID NO: 86712 - DNA, 25 bp, Homo sapien
agcacttgttagcaggatttccttt

SEQ ID NO: 86713 - DNA, 25 bp, Homo sapien
tctttagcccacaaatagtactcag

SEQ ID NO: 86714 - DNA, 25 bp, Homo sapien
atagtactcagcatactttcattaa

SEQ ID NO: 86715 - DNA, 25 bp, Homo sapien
gtacatgtatctggcgcaggagctc

SEQ ID NO: 86716 - DNA, 25 bp, Homo sapien
tctggcgcaggagctcttggttgat

SEQ ID NO: 86717 - DNA, 25 bp, Homo sapien
tcttggttgatccagaatggccacc

SEQ ID NO: 86718 - DNA, 25 bp, Homo sapien
gaatggccaccaaaacctcagacaa

SEQ ID NO: 86719 - DNA, 25 bp, Homo sapien
aaacctcagacaaccacagaagcta

SEQ ID NO: 86720 - DNA, 25 bp, Homo sapien
ggatcatgtcaaatcatcaccataa

SEQ ID NO: 86721 - DNA, 25 bp, Homo sapien
gaatcagtctcagtggtattgctga

SEQ ID NO: 86722 - DNA, 25 bp, Homo sapien
taggagtttctgatcctgtgtgtca

SEQ ID NO: 86723 - DNA, 25 bp, Homo sapien
gatcctgtgtgtcagaatggcacta

SEQ ID NO: 86724 - DNA, 25 bp, Homo sapien
aatggcactagttcagtttatgtcc

SEQ ID NO: 86725 - DNA, 25 bp, Homo sapien
gtttatgtcccttctgatatagtag

SEQ ID NO: 86726 - DNA, 25 bp, Homo sapien
aactattatcagctcacacatataa

SEQ ID NO: 86727 - DNA, 25 bp, Homo sapien
gctcacacatataaaaactggtcac

SEQ ID NO: 86728 - DNA, 25 bp, Homo sapien
aaaaactggtcactgagatgacagc

SEQ ID NO: 86729 - DNA, 25 bp, Homo sapien
aatgcccaaaatgcaaatgaactag

SEQ ID NO: 86730 - DNA, 25 bp, Homo sapien
tgaactagacatgccaacagcttgg

SEQ ID NO: 86731 - DNA, 25 bp, Homo sapien
gggaagagaattccatactgaaaga

SEQ ID NO: 86732 - DNA, 25 bp, Homo sapien
gaagagcaaatacaaaagcctgaag

SEQ ID NO: 86733 - DNA, 25 bp, Homo sapien
ccagaagactggaacataatatgca

SEQ ID NO: 86734 - DNA, 25 bp, Homo sapien
caagattggtaaacaggcaggagcc

SEQ ID NO: 86735 - DNA, 25 bp, Homo sapien
gtgctgtgtatggattttacttcta

SEQ ID NO: 86736 - DNA, 25 bp, Homo sapien
tttacttctaagagcaaaggaaagc

SEQ ID NO: 86737 - DNA, 25 bp, Homo sapien
cttgccttctgccatccatataaga

SEQ ID NO: 86738 - DNA, 25 bp, Homo sapien
atataagacgtgacttgctcctccg

SEQ ID NO: 86739 - DNA, 25 bp, Homo sapien
ataaattacccactctcggatatat

SEQ ID NO: 86740 - DNA, 25 bp, Homo sapien
aattacccactctcggatatatctt

SEQ ID NO: 86741 - DNA, 25 bp, Homo sapien
tacccactctcggatatatctttat

SEQ ID NO: 86742 - DNA, 25 bp, Homo sapien
ccactctcggatatatctttattag

SEQ ID NO: 86743 - DNA, 25 bp, Homo sapien
ctcggatatatctttattagcagtg

SEQ ID NO: 86744 - DNA, 25 bp, Homo sapien
ttattagcagtgtgacagcagacta

SEQ ID NO: 86745 - DNA, 25 bp, Homo sapien
agcagtgtgacagcagactaataga

SEQ ID NO: 86746 - DNA, 25 bp, Homo sapien
gtgtgacagcagactaatagaggga

SEQ ID NO: 86747 - DNA, 25 bp, Homo sapien
gacagcagactaatagagggattaa

SEQ ID NO: 86748 - DNA, 25 bp, Homo sapien
aggatgtgggtctctagtgccttgc

SEQ ID NO: 86749 - DNA, 25 bp, Homo sapien
gtgggtctctagtgccttgccctgg

SEQ ID NO: 86750 - DNA, 25 bp, Homo sapien
ttgccctggcttagctgcaggagaa

SEQ ID NO: 86751 - DNA, 25 bp, Homo sapien
tgctccctctgagcctggtcttttg

SEQ ID NO: 86752 - DNA, 25 bp, Homo sapien
tttggtctccaagatgaatgctcat

SEQ ID NO: 86753 - DNA, 25 bp, Homo sapien
gaatgctcatctttggagggtgcca

SEQ ID NO: 86754 - DNA, 25 bp, Homo sapien
atgctcatctttggagggtgccagg

SEQ ID NO: 86755 - DNA, 25 bp, Homo sapien
tgtcttctctctccaggtttcacct

SEQ ID NO: 86756 - DNA, 25 bp, Homo sapien
ctctccaggtttcaccttccagtgt

SEQ ID NO: 86757 - DNA, 25 bp, Homo sapien
gggcagtgccttacacatgcttgat

SEQ ID NO: 86758 - DNA, 25 bp, Homo sapien
tacacatgcttgattcccacgctac

SEQ ID NO: 86759 - DNA, 25 bp, Homo sapien
agcccctggaactcatggtctcagc

SEQ ID NO: 86760 - DNA, 25 bp, Homo sapien
atggtctcagcctcacacgccaagg

SEQ ID NO: 86761 - DNA, 25 bp, Homo sapien
tggtctcagcctcacacgccaagga

SEQ ID NO: 86762 - DNA, 25 bp, Homo sapien
ggtctcagcctcacacgccaaggat

SEQ ID NO: 86763 - DNA, 25 bp, Homo sapien
gtctcagcctcacacgccaaggatt

SEQ ID NO: 86764 - DNA, 25 bp, Homo sapien
tctcagcctcacacgccaaggatta

SEQ ID NO: 86765 - DNA, 25 bp, Homo sapien
agcctcacacgccaaggattacaca

SEQ ID NO: 86766 - DNA, 25 bp, Homo sapien
tctcatccgcatgggcatggcaggc

SEQ ID NO: 86767 - DNA, 25 bp, Homo sapien
catggcaggcttggtcctggtgttc

SEQ ID NO: 86768 - DNA, 25 bp, Homo sapien
atggcaggcttggtcctggtgttcc

SEQ ID NO: 86769 - DNA, 25 bp, Homo sapien
ccagagaaacccccaagatgcagca

SEQ ID NO: 86770 - DNA, 25 bp, Homo sapien
ttggtgtggttgtggagcctgtccc

SEQ ID NO: 86771 - DNA, 25 bp, Homo sapien
ttgtggagcctgtccctgcgcgcct

SEQ ID NO: 86772 - DNA, 25 bp, Homo sapien
agccacgctgtctggtgggtgattc

SEQ ID NO: 86773 - DNA, 25 bp, Homo sapien
gctgtctggtgggtgattctctgcc

SEQ ID NO: 86774 - DNA, 25 bp, Homo sapien
tctctttttagacacaacagccgca

SEQ ID NO: 86775 - DNA, 25 bp, Homo sapien
tttagacacaacagccgcagtttgg

SEQ ID NO: 86776 - DNA, 25 bp, Homo sapien
acacaacagccgcagtttggccagc

SEQ ID NO: 86777 - DNA, 25 bp, Homo sapien
taagtcccaccagctgaggtccgag

SEQ ID NO: 86778 - DNA, 25 bp, Homo sapien
caccagctgaggtccgaggaaagcg

SEQ ID NO: 86779 - DNA, 25 bp, Homo sapien
gaaagcggggtgactcatttccctt

SEQ ID NO: 86780 - DNA, 25 bp, Homo sapien
tttcccttgtccagggcccgaggag

SEQ ID NO: 86781 - DNA, 25 bp, Homo sapien
tttggcgcgctgatttgcctctgag

SEQ ID NO: 86782 - DNA, 25 bp, Homo sapien
ttggcgcgctgatttgcctctgagc

SEQ ID NO: 86783 - DNA, 25 bp, Homo sapien
tggcgcgctgatttgcctctgagcg

SEQ ID NO: 86784 - DNA, 25 bp, Homo sapien
gcgcgctgatttgcctctgagcgga

SEQ ID NO: 86785 - DNA, 25 bp, Homo sapien
cgctgatttgcctctgagcggatga

SEQ ID NO: 86786 - DNA, 25 bp, Homo sapien
gctgatttgcctctgagcggatgaa

SEQ ID NO: 86787 - DNA, 25 bp, Homo sapien
ctgatttgcctctgagcggatgaag

SEQ ID NO: 86788 - DNA, 25 bp, Homo sapien
ctgagcggatgaaggttgagccatg

SEQ ID NO: 86789 - DNA, 25 bp, Homo sapien
gagcggatgaaggttgagccatggc

SEQ ID NO: 86790 - DNA, 25 bp, Homo sapien
ggatgaaggttgagccatggcgggc

SEQ ID NO: 86791 - DNA, 25 bp, Homo sapien
gatgaaggttgagccatggcgggcg

SEQ ID NO: 86792 - DNA, 25 bp, Homo sapien
gcagctcagctgcagatgcttttct

SEQ ID NO: 86793 - DNA, 25 bp, Homo sapien
gctgcagatgcttttctcaaacttt

SEQ ID NO: 86794 - DNA, 25 bp, Homo sapien
tcctgcgggcaagctaaaccagttc

SEQ ID NO: 86795 - DNA, 25 bp, Homo sapien
gggcaagctaaaccagttccggaag

SEQ ID NO: 86796 - DNA, 25 bp, Homo sapien
gctaaaccagttccggaagaacctg

SEQ ID NO: 86797 - DNA, 25 bp, Homo sapien
atggacacataactcctgggccaga

SEQ ID NO: 86798 - DNA, 25 bp, Homo sapien
ggccagaggctataaaaccccagga

SEQ ID NO: 86799 - DNA, 25 bp, Homo sapien
gcagcttcttcttggagtctcaggg

SEQ ID NO: 86800 - DNA, 25 bp, Homo sapien
cagggcaaaccctttcgagcagcac

SEQ ID NO: 86801 - DNA, 25 bp, Homo sapien
atgacagcagtggtactgcctggta

SEQ ID NO: 86802 - DNA, 25 bp, Homo sapien
cagtggtactgcctggtaaaagaat

SEQ ID NO: 86803 - DNA, 25 bp, Homo sapien
ggtaattaaattctgtggcatcggt

SEQ ID NO: 86804 - DNA, 25 bp, Homo sapien
aattctgtggcatcggtagttggca

SEQ ID NO: 86805 - DNA, 25 bp, Homo sapien
ctgtggcatcggtagttggcaagac

SEQ ID NO: 86806 - DNA, 25 bp, Homo sapien
ggtagttggcaagactaatctgcaa

SEQ ID NO: 86807 - DNA, 25 bp, Homo sapien
gttggcaagactaatctgcaaaata

SEQ ID NO: 86808 - DNA, 25 bp, Homo sapien
taattccagaaaagtgaggcaaact

SEQ ID NO: 86809 - DNA, 25 bp, Homo sapien
gtgaggcaaactagaaacattaact

SEQ ID NO: 86810 - DNA, 25 bp, Homo sapien
ttatttgccaggattcttaaaaatg

SEQ ID NO: 86811 - DNA, 25 bp, Homo sapien
actaagtcacatatgctggtaaaat

SEQ ID NO: 86812 - DNA, 25 bp, Homo sapien
gtcacatatgctggtaaaattcaaa

SEQ ID NO: 86813 - DNA, 25 bp, Homo sapien
attcaaatgttgatgtatcctaaaa

SEQ ID NO: 86814 - DNA, 25 bp, Homo sapien
ctcacatgaaagaccccatcggtga

SEQ ID NO: 86815 - DNA, 25 bp, Homo sapien
tgaaagaccccatcggtgacagctt

SEQ ID NO: 86816 - DNA, 25 bp, Homo sapien
cggtgacagcttccaaaacgacaag

SEQ ID NO: 86817 - DNA, 25 bp, Homo sapien
aaaacgacaagctggtggtctggga

SEQ ID NO: 86818 - DNA, 25 bp, Homo sapien
gcaaagccggcctggaggagtgtct

SEQ ID NO: 86819 - DNA, 25 bp, Homo sapien
aggagtgtctggtgactgaagtaca

SEQ ID NO: 86820 - DNA, 25 bp, Homo sapien
tggtgactgaagtacaggtcgtgca

SEQ ID NO: 86821 - DNA, 25 bp, Homo sapien
gtacaggtcgtgcagaaaacttgag

SEQ ID NO: 86822 - DNA, 25 bp, Homo sapien
aggcgcctgcacagactggctgctg

SEQ ID NO: 86823 - DNA, 25 bp, Homo sapien
gcacgcagcccaggaatggacattc

SEQ ID NO: 86824 - DNA, 25 bp, Homo sapien
aatggacattcctaacgggtggtgg

SEQ ID NO: 86825 - DNA, 25 bp, Homo sapien
cttagtcattttgatcatgagggtt

SEQ ID NO: 86826 - DNA, 25 bp, Homo sapien
atatggatacttgaaggactttata

SEQ ID NO: 86827 - DNA, 25 bp, Homo sapien
taaaatgaacgctatttgaggactc

SEQ ID NO: 86828 - DNA, 25 bp, Homo sapien
gaggactctggttgaaggagattta

SEQ ID NO: 86829 - DNA, 25 bp, Homo sapien
gccacaggaaataagactgctgaat

SEQ ID NO: 86830 - DNA, 25 bp, Homo sapien
atgtctgagagaaccagagttgttc

SEQ ID NO: 86831 - DNA, 25 bp, Homo sapien
agagttgttctcgtccaaggtagaa

SEQ ID NO: 86832 - DNA, 25 bp, Homo sapien
ttctcgtccaaggtagaaaggtacg

SEQ ID NO: 86833 - DNA, 25 bp, Homo sapien
ggtacgaagatacaatactgttatt

SEQ ID NO: 86834 - DNA, 25 bp, Homo sapien
tcatttatcctgtacaatcatctgt

SEQ ID NO: 86835 - DNA, 25 bp, Homo sapien
gtacaatcatctgtgaagtggtggt

SEQ ID NO: 86836 - DNA, 25 bp, Homo sapien
tagctctgaccctacagggactcca

SEQ ID NO: 86837 - DNA, 25 bp, Homo sapien
agggactccagatctcaacctgttc

SEQ ID NO: 86838 - DNA, 25 bp, Homo sapien
acctgttccctggaagtagggcctg

SEQ ID NO: 86839 - DNA, 25 bp, Homo sapien
agtagggcctgctctccatcccagt

SEQ ID NO: 86840 - DNA, 25 bp, Homo sapien
ccttgcatttcttggtatctctcag

SEQ ID NO: 86841 - DNA, 25 bp, Homo sapien
atttcttggtatctctcagcttttc

SEQ ID NO: 86842 - DNA, 25 bp, Homo sapien
tatctctcagcttttcctcttgcag

SEQ ID NO: 86843 - DNA, 25 bp, Homo sapien
gggtcgctttctcctggattgcaaa

SEQ ID NO: 86844 - DNA, 25 bp, Homo sapien
tttctcctggattgcaaatgcctct

SEQ ID NO: 86845 - DNA, 25 bp, Homo sapien
aaatgcctcttcagtttggactcag

SEQ ID NO: 86846 - DNA, 25 bp, Homo sapien
tcagtttggactcagctctgacagc

SEQ ID NO: 86847 - DNA, 25 bp, Homo sapien
cacttctcatcccaaacccagtttc

SEQ ID NO: 86848 - DNA, 25 bp, Homo sapien
cctgacgctgctgattcgggctgtg

SEQ ID NO: 86849 - DNA, 25 bp, Homo sapien
gctgattcgggctgtggcctccacg

SEQ ID NO: 86850 - DNA, 25 bp, Homo sapien
tgtggcctccacgtatttatgcagt

SEQ ID NO: 86851 - DNA, 25 bp, Homo sapien
tggcctccacgtatttatgcagtac

SEQ ID NO: 86852 - DNA, 25 bp, Homo sapien
gcctccacgtatttatgcagtacag

SEQ ID NO: 86853 - DNA, 25 bp, Homo sapien
ccacgtatttatgcagtacagtctg

SEQ ID NO: 86854 - DNA, 25 bp, Homo sapien
ttatgcagtacagtctgcctgacgc

SEQ ID NO: 86855 - DNA, 25 bp, Homo sapien
tgcagtacagtctgcctgacgccag

SEQ ID NO: 86856 - DNA, 25 bp, Homo sapien
gaggagggggcatctcccaacttct

SEQ ID NO: 86857 - DNA, 25 bp, Homo sapien
agctccctgccttttaataaactgg

SEQ ID NO: 86858 - DNA, 25 bp, Homo sapien
catggtctcagcctcacacgccaag

SEQ ID NO: 86859 - DNA, 25 bp, Homo sapien
atggtctcagcctcacacgccaagg

SEQ ID NO: 86860 - DNA, 25 bp, Homo sapien
tggtctcagcctcacacgccaagga

SEQ ID NO: 86861 - DNA, 25 bp, Homo sapien
ggtctcagcctcacacgccaaggat

SEQ ID NO: 86862 - DNA, 25 bp, Homo sapien
gtctcagcctcacacgccaaggatt

SEQ ID NO: 86863 - DNA, 25 bp, Homo sapien
tctcagcctcacacgccaaggatta

SEQ ID NO: 86864 - DNA, 25 bp, Homo sapien
tcagcctcacacgccaaggattaca

SEQ ID NO: 86865 - DNA, 25 bp, Homo sapien
ggcatggcaggcttggtcctggtgt

SEQ ID NO: 86866 - DNA, 25 bp, Homo sapien
gcatggcaggcttggtcctggtgtt

SEQ ID NO: 86867 - DNA, 25 bp, Homo sapien
catggcaggcttggtcctggtgttc

SEQ ID NO: 86868 - DNA, 25 bp, Homo sapien
ccagagaaacccccaagatgcagca

SEQ ID NO: 86869 - DNA, 25 bp, Homo sapien
aggacaggctgaacaggttggataa

SEQ ID NO: 86870 - DNA, 25 bp, Homo sapien
actaccattagtcttgaaacagcac

SEQ ID NO: 86871 - DNA, 25 bp, Homo sapien
gaaacagcacgtgcagaccatccga

SEQ ID NO: 86872 - DNA, 25 bp, Homo sapien
agaccatccgaagcctgtaactgtg

SEQ ID NO: 86873 - DNA, 25 bp, Homo sapien
tccgaagcctgtaactgtgaaacca

SEQ ID NO: 86874 - DNA, 25 bp, Homo sapien
gtaacaacggaacctagtccagatc

SEQ ID NO: 86875 - DNA, 25 bp, Homo sapien
agtccagatctgaacgatgccgtgt

SEQ ID NO: 86876 - DNA, 25 bp, Homo sapien
aacgatgccgtgtccagtttgcgaa

SEQ ID NO: 86877 - DNA, 25 bp, Homo sapien
tgtccagtttgcgaagtcctattcc

SEQ ID NO: 86878 - DNA, 25 bp, Homo sapien
ctgtcgcgtgcctttgttcaggtgg

SEQ ID NO: 86879 - DNA, 25 bp, Homo sapien
ctgctatgactctttggatgggagt

SEQ ID NO: 86880 - DNA, 25 bp, Homo sapien
gggttctcagaaaactcagtttctt

SEQ ID NO: 86881 - DNA, 25 bp, Homo sapien
tctcccaactactgttactggttat

SEQ ID NO: 86882 - DNA, 25 bp, Homo sapien
actggttatagaggtctttggactc

SEQ ID NO: 86883 - DNA, 25 bp, Homo sapien
tctaaagaccaatgtttggccacta

SEQ ID NO: 86884 - DNA, 25 bp, Homo sapien
tggccactaactggactaatatgta

SEQ ID NO: 86885 - DNA, 25 bp, Homo sapien
ggactaatatgtatctttctgtgat

SEQ ID NO: 86886 - DNA, 25 bp, Homo sapien
gtgatttcatcatagaggtctgttt

SEQ ID NO: 86887 - DNA, 25 bp, Homo sapien
aatcttaatgggaggctgggtgacc

SEQ ID NO: 86888 - DNA, 25 bp, Homo sapien
ggctgggtgacctggattatctaca

SEQ ID NO: 86889 - DNA, 25 bp, Homo sapien
ggattatctacagtgagcagactta

SEQ ID NO: 86890 - DNA, 25 bp, Homo sapien
ggaacagaagtttatgtgtccaaat

SEQ ID NO: 86891 - DNA, 25 bp, Homo sapien
cccctaatcctgctcaacagagaga

SEQ ID NO: 86892 - DNA, 25 bp, Homo sapien
caacagagagaacaggagaccccaa

SEQ ID NO: 86893 - DNA, 25 bp, Homo sapien
gggcagatgaacttcctctagaacc

SEQ ID NO: 86894 - DNA, 25 bp, Homo sapien
gatgaacttcctctagaacccaggg

SEQ ID NO: 86895 - DNA, 25 bp, Homo sapien
ccttgttcagtctgctgtagattct

SEQ ID NO: 86896 - DNA, 25 bp, Homo sapien
tgttcagtctgctgtagattctggg

SEQ ID NO: 86897 - DNA, 25 bp, Homo sapien
ggtttctgtgaaagtgagggaacca

SEQ ID NO: 86898 - DNA, 25 bp, Homo sapien
aaccagaggctggtcacgggagctt

SEQ ID NO: 86899 - DNA, 25 bp, Homo sapien
aaacctgcccaatcatcacagtcat

SEQ ID NO: 86900 - DNA, 25 bp, Homo sapien
atttggaagcttatttctccggcat

SEQ ID NO: 86901 - DNA, 25 bp, Homo sapien
aagcttatttctccggcatcttata

SEQ ID NO: 86902 - DNA, 25 bp, Homo sapien
aggtgggccggaagatcccacgatt

SEQ ID NO: 86903 - DNA, 25 bp, Homo sapien
ggaagatcccacgattccgatcgac

SEQ ID NO: 86904 - DNA, 25 bp, Homo sapien
acgattccgatcgactgccaagcag

SEQ ID NO: 86905 - DNA, 25 bp, Homo sapien
attccgatcgactgccaagcagcag

SEQ ID NO: 86906 - DNA, 25 bp, Homo sapien
gggctgcgtctgacatcctgacctc

SEQ ID NO: 86907 - DNA, 25 bp, Homo sapien
tgacatcctgacctcctggactgta

SEQ ID NO: 86908 - DNA, 25 bp, Homo sapien
atcctgacctcctggactgtaggac

SEQ ID NO: 86909 - DNA, 25 bp, Homo sapien
gacctcctggactgtaggactatat

SEQ ID NO: 86910 - DNA, 25 bp, Homo sapien
ggactgtaggactatataaagtact

SEQ ID NO: 86911 - DNA, 25 bp, Homo sapien
gtactactgtagaactgcaatttcc

SEQ ID NO: 86912 - DNA, 25 bp, Homo sapien
tgtagaactgcaatttccattcttt

SEQ ID NO: 86913 - DNA, 25 bp, Homo sapien
gactgttctgacaatctaacctggg

SEQ ID NO: 86914 - DNA, 25 bp, Homo sapien
tctgacaatctaacctgggattact

SEQ ID NO: 86915 - DNA, 25 bp, Homo sapien
tgggattactaactgttgagccatc

SEQ ID NO: 86916 - DNA, 25 bp, Homo sapien
ttactaactgttgagccatcttccc

SEQ ID NO: 86917 - DNA, 25 bp, Homo sapien
gcagggaaaccactggtctctgact

SEQ ID NO: 86918 - DNA, 25 bp, Homo sapien
cagcacaaatgctaggcctctgttg

SEQ ID NO: 86919 - DNA, 25 bp, Homo sapien
aaatgctaggcctctgttgcatggc

SEQ ID NO: 86920 - DNA, 25 bp, Homo sapien
ggcctctgttgcatggctgtacaaa

SEQ ID NO: 86921 - DNA, 25 bp, Homo sapien
aaagatctagggtcctgggtctctt

SEQ ID NO: 86922 - DNA, 25 bp, Homo sapien
agggtcctgggtctcttgcatttat

SEQ ID NO: 86923 - DNA, 25 bp, Homo sapien
cctgggtctcttgcatttatatgtc

SEQ ID NO: 86924 - DNA, 25 bp, Homo sapien
tctgtctcaactttacgtgtactga

SEQ ID NO: 86925 - DNA, 25 bp, Homo sapien
actttacgtgtactgagctgcaact

SEQ ID NO: 86926 - DNA, 25 bp, Homo sapien
ctttacgtgtactgagctgcaactt

SEQ ID NO: 86927 - DNA, 25 bp, Homo sapien
cgtgtactgagctgcaacttcttac

SEQ ID NO: 86928 - DNA, 25 bp, Homo sapien
tactgagctgcaacttcttacttcc

SEQ ID NO: 86929 - DNA, 25 bp, Homo sapien
atttgctatgagaggttgatggatt

SEQ ID NO: 86930 - DNA, 25 bp, Homo sapien
gctatgagaggttgatggattaatt

SEQ ID NO: 86931 - DNA, 25 bp, Homo sapien
ttaaataagtcaatccctggaagtt

SEQ ID NO: 86932 - DNA, 25 bp, Homo sapien
aagtcaatccctggaagttgagaga

SEQ ID NO: 86933 - DNA, 25 bp, Homo sapien
caatccctggaagttgagagagcaa

SEQ ID NO: 86934 - DNA, 25 bp, Homo sapien
tccctggaagttgagagagcaaata

SEQ ID NO: 86935 - DNA, 25 bp, Homo sapien
agttaagtgggcactgaaaggtagg

SEQ ID NO: 86936 - DNA, 25 bp, Homo sapien
gttaagtgggcactgaaaggtaggc

SEQ ID NO: 86937 - DNA, 25 bp, Homo sapien
ttaagtgggcactgaaaggtaggcc

SEQ ID NO: 86938 - DNA, 25 bp, Homo sapien
taagtgggcactgaaaggtaggcca

SEQ ID NO: 86939 - DNA, 25 bp, Homo sapien
aagtgggcactgaaaggtaggccag

SEQ ID NO: 86940 - DNA, 25 bp, Homo sapien
agtgggcactgaaaggtaggccagg

SEQ ID NO: 86941 - DNA, 25 bp, Homo sapien
gtgggcactgaaaggtaggccaggc

SEQ ID NO: 86942 - DNA, 25 bp, Homo sapien
tgggcactgaaaggtaggccaggca

SEQ ID NO: 86943 - DNA, 25 bp, Homo sapien
gggcactgaaaggtaggccaggcat

SEQ ID NO: 86944 - DNA, 25 bp, Homo sapien
ggcactgaaaggtaggccaggcatg

SEQ ID NO: 86945 - DNA, 25 bp, Homo sapien
gcagaggaacctgtagttttttcca

SEQ ID NO: 86946 - DNA, 25 bp, Homo sapien
tttcttcagaaccaaagtatgtatc

SEQ ID NO: 86947 - DNA, 25 bp, Homo sapien
actcctcatgctcacagggattgac

SEQ ID NO: 86948 - DNA, 25 bp, Homo sapien
gggattgacaggagagaattcacca

SEQ ID NO: 86949 - DNA, 25 bp, Homo sapien
agaattcaccaggatcttagctcaa

SEQ ID NO: 86950 - DNA, 25 bp, Homo sapien
ctcaaaagacacagcctcagaatgg

SEQ ID NO: 86951 - DNA, 25 bp, Homo sapien
cagaatggccagatggattgcacga

SEQ ID NO: 86952 - DNA, 25 bp, Homo sapien
tggattgcacgaaacctgacttgga

SEQ ID NO: 86953 - DNA, 25 bp, Homo sapien
gaaacctgacttggattcaccatct

SEQ ID NO: 86954 - DNA, 25 bp, Homo sapien
ttcctcctgccataaggctgtgctc

SEQ ID NO: 86955 - DNA, 25 bp, Homo sapien
gaagctccagggaagctttccaaga

SEQ ID NO: 86956 - DNA, 25 bp, Homo sapien
gtctctgtgatggtgagttgtagaa

SEQ ID NO: 86957 - DNA, 25 bp, Homo sapien
ctgtgatggtgagttgtagaattat

SEQ ID NO: 86958 - DNA, 25 bp, Homo sapien
ttgaatcgtcctgaaaccatccctc

SEQ ID NO: 86959 - DNA, 25 bp, Homo sapien
attgtgttccgcgaaaccggtctct

SEQ ID NO: 86960 - DNA, 25 bp, Homo sapien
ttgtgttccgcgaaaccggtctctg

SEQ ID NO: 86961 - DNA, 25 bp, Homo sapien
tgtgttccgcgaaaccggtctctgg

SEQ ID NO: 86962 - DNA, 25 bp, Homo sapien
gtgttccgcgaaaccggtctctggt

SEQ ID NO: 86963 - DNA, 25 bp, Homo sapien
tgttccgcgaaaccggtctctggtg

SEQ ID NO: 86964 - DNA, 25 bp, Homo sapien
aaggcaagaaaacgcattctctccc

SEQ ID NO: 86965 - DNA, 25 bp, Homo sapien
gcaagaaaacgcattctctccctca

SEQ ID NO: 86966 - DNA, 25 bp, Homo sapien
aagaaaacgcattctctccctcagc

SEQ ID NO: 86967 - DNA, 25 bp, Homo sapien
tgtcaaacagctacccaaaaccaga

SEQ ID NO: 86968 - DNA, 25 bp, Homo sapien
agctacccaaaaccagatctggcaa

SEQ ID NO: 86969 - DNA, 25 bp, Homo sapien
gatcagctttatctgccattgtcaa

SEQ ID NO: 86970 - DNA, 25 bp, Homo sapien
gccattgtcaatggcaagccataca

SEQ ID NO: 86971 - DNA, 25 bp, Homo sapien
ggcaagccatacaagataacttcta

SEQ ID NO: 86972 - DNA, 25 bp, Homo sapien
ttctacaattgaagaccccagcatt

SEQ ID NO: 86973 - DNA, 25 bp, Homo sapien
accccagcatttttggccacgtaga

SEQ ID NO: 86974 - DNA, 25 bp, Homo sapien
tttggccacgtagaagaaatgctga

SEQ ID NO: 86975 - DNA, 25 bp, Homo sapien
gctgaagcaagcataatgagtttgt

SEQ ID NO: 86976 - DNA, 25 bp, Homo sapien
aatgagtttgtcttattcctatttt

SEQ ID NO: 86977 - DNA, 25 bp, Homo sapien
aacttggcctaaacaaatctaatga

SEQ ID NO: 86978 - DNA, 25 bp, Homo sapien
tgagccacaccaaaaggaatgccaa

SEQ ID NO: 86979 - DNA, 25 bp, Homo sapien
aaggaatgccaagggctctctaaat

SEQ ID NO: 86980 - DNA, 25 bp, Homo sapien
ttagccagtaggaagctactgctct

SEQ ID NO: 86981 - DNA, 25 bp, Homo sapien
ctgctctcctggcaaggattaattg

SEQ ID NO: 86982 - DNA, 25 bp, Homo sapien
gcaaggattaattggcacattctgt

SEQ ID NO: 86983 - DNA, 25 bp, Homo sapien
ggcacattctgttaagatatccctc

SEQ ID NO: 86984 - DNA, 25 bp, Homo sapien
aagatatccctcatgacagttgccc

SEQ ID NO: 86985 - DNA, 25 bp, Homo sapien
tgacagttgccctttcaaagcagga

SEQ ID NO: 86986 - DNA, 25 bp, Homo sapien
tttcatcatttctgttagggtagga

SEQ ID NO: 86987 - DNA, 25 bp, Homo sapien
agtagatagaagtctctcatttaaa

SEQ ID NO: 86988 - DNA, 25 bp, Homo sapien
caatcttgatgtaatgcacttttta

SEQ ID NO: 86989 - DNA, 25 bp, Homo sapien
tatttctgctgcttggcacattttt

SEQ ID NO: 86990 - DNA, 25 bp, Homo sapien
ggcacatttttgagttttcccacat

SEQ ID NO: 86991 - DNA, 25 bp, Homo sapien
gttttcccacattatttgtctccat

SEQ ID NO: 86992 - DNA, 25 bp, Homo sapien
atttgtctccatgataccactcaag

SEQ ID NO: 86993 - DNA, 25 bp, Homo sapien
accactcaagcagtgtgctggacct

SEQ ID NO: 86994 - DNA, 25 bp, Homo sapien
gtgctggacctaaaatactgacttt

SEQ ID NO: 86995 - DNA, 25 bp, Homo sapien
actgactttagttagtatccttgga

SEQ ID NO: 86996 - DNA, 25 bp, Homo sapien
ggatttttagattccccagtgtcta

SEQ ID NO: 86997 - DNA, 25 bp, Homo sapien
cccagtgtctaattccctgttataa

SEQ ID NO: 86998 - DNA, 25 bp, Homo sapien
gttatgataatctttctccactgtt

SEQ ID NO: 86999 - DNA, 25 bp, Homo sapien
atctctgttgaaggcttttgatcct

SEQ ID NO: 87000 - DNA, 25 bp, Homo sapien
cccagctggtgggtacagcttgaga

SEQ ID NO: 87001 - DNA, 25 bp, Homo sapien
tcaggctaagctactgcccttcact

SEQ ID NO: 87002 - DNA, 25 bp, Homo sapien
ggctaagctactgcccttcactggg

SEQ ID NO: 87003 - DNA, 25 bp, Homo sapien
cctttctactcaacgggtgtagcca

SEQ ID NO: 87004 - DNA, 25 bp, Homo sapien
ctactcaacgggtgtagccactggt

SEQ ID NO: 87005 - DNA, 25 bp, Homo sapien
ggtgtagccactggtgctttgaagc

SEQ ID NO: 87006 - DNA, 25 bp, Homo sapien
tgtagccactggtgctttgaagcct

SEQ ID NO: 87007 - DNA, 25 bp, Homo sapien
caggttctcttttcactgggacctt

SEQ ID NO: 87008 - DNA, 25 bp, Homo sapien
ttctcttttcactgggaccttgcaa

SEQ ID NO: 87009 - DNA, 25 bp, Homo sapien
tcttttcactgggaccttgcaagga

SEQ ID NO: 87010 - DNA, 25 bp, Homo sapien
ttttcactgggaccttgcaaggagg

SEQ ID NO: 87011 - DNA, 25 bp, Homo sapien
cattctactcccacatgaagtttca

SEQ ID NO: 87012 - DNA, 25 bp, Homo sapien
attctactcccacatgaagtttcat

SEQ ID NO: 87013 - DNA, 25 bp, Homo sapien
gaagtttcatgaagactactagccc

SEQ ID NO: 87014 - DNA, 25 bp, Homo sapien
tttcatgaagactactagccctgcc

SEQ ID NO: 87015 - DNA, 25 bp, Homo sapien
tcatgaagactactagccctgccag

SEQ ID NO: 87016 - DNA, 25 bp, Homo sapien
tgaagactactagccctgccaggca

SEQ ID NO: 87017 - DNA, 25 bp, Homo sapien
agactactagccctgccaggcacaa

SEQ ID NO: 87018 - DNA, 25 bp, Homo sapien
tactagccctgccaggcacaatgac

SEQ ID NO: 87019 - DNA, 25 bp, Homo sapien
actcaggaggtcgaggtggcgggat

SEQ ID NO: 87020 - DNA, 25 bp, Homo sapien
gaggtggcgggatggtttgagcaca

SEQ ID NO: 87021 - DNA, 25 bp, Homo sapien
agatcgccccactgcttttcaacct

SEQ ID NO: 87022 - DNA, 25 bp, Homo sapien
agctttttgttctatcttgtacaga

SEQ ID NO: 87023 - DNA, 25 bp, Homo sapien
acagtaatggaatcactcatgttca

SEQ ID NO: 87024 - DNA, 25 bp, Homo sapien
ggaatcactcatgttcagaaccttg

SEQ ID NO: 87025 - DNA, 25 bp, Homo sapien
agaaccttgtaaatatgtctgtaat

SEQ ID NO: 87026 - DNA, 25 bp, Homo sapien
atgtctgtaatattaatgcttccct

SEQ ID NO: 87027 - DNA, 25 bp, Homo sapien
taatgcttccctttattaagacaaa

SEQ ID NO: 87028 - DNA, 25 bp, Homo sapien
acattttcttttcaccctaatctat

SEQ ID NO: 87029 - DNA, 25 bp, Homo sapien
agattcatacttattgagacgggaa

SEQ ID NO: 87030 - DNA, 25 bp, Homo sapien
ttgagacgggaaaaactcgctgtaa

SEQ ID NO: 87031 - DNA, 25 bp, Homo sapien
aaaaactcgctgtaaaataatgcca

SEQ ID NO: 87032 - DNA, 25 bp, Homo sapien
ataatgccaacctagataatgctat

SEQ ID NO: 87033 - DNA, 25 bp, Homo sapien
aggcttatagtcagaatcactttag

SEQ ID NO: 87034 - DNA, 25 bp, Homo sapien
ttagtaatcgtcttctggtccttgg

SEQ ID NO: 87035 - DNA, 25 bp, Homo sapien
ggtgttgccaatctagtctgatatc

SEQ ID NO: 87036 - DNA, 25 bp, Homo sapien
gtctgatatcattgttgacctgtac

SEQ ID NO: 87037 - DNA, 25 bp, Homo sapien
gttgacctgtacttactttgtggat

SEQ ID NO: 87038 - DNA, 25 bp, Homo sapien
gggttgcactggcacaaacagagcc

SEQ ID NO: 87039 - DNA, 25 bp, Homo sapien
cagagccagaacactggactttcaa

SEQ ID NO: 87040 - DNA, 25 bp, Homo sapien
aaagaccattttgacttctacagtg

SEQ ID NO: 87041 - DNA, 25 bp, Homo sapien
ttttgacttctacagtgtccacaca

SEQ ID NO: 87042 - DNA, 25 bp, Homo sapien
gtgtccacacacatgaatttaaatg

SEQ ID NO: 87043 - DNA, 25 bp, Homo sapien
taaatgcacttgtaactggttaatt

SEQ ID NO: 87044 - DNA, 25 bp, Homo sapien
caaattttagccatctgtttgtgat

SEQ ID NO: 87045 - DNA, 25 bp, Homo sapien
gtttgtgatttctgtcataagcatt

SEQ ID NO: 87046 - DNA, 25 bp, Homo sapien
ttctgtcataagcattttgttgttt

SEQ ID NO: 87047 - DNA, 25 bp, Homo sapien
ggagatttaagataagacccaataa

SEQ ID NO: 87048 - DNA, 25 bp, Homo sapien
atctcctgagaataacgaagaaggt

SEQ ID NO: 87049 - DNA, 25 bp, Homo sapien
attgccatgatgttgtactagtaca

SEQ ID NO: 87050 - DNA, 25 bp, Homo sapien
gaattatcagaaaacccagaagcca

SEQ ID NO: 87051 - DNA, 25 bp, Homo sapien
aacccagaagccagtttaggctaga

SEQ ID NO: 87052 - DNA, 25 bp, Homo sapien
gaggaaaaaactactgtatcattta

SEQ ID NO: 87053 - DNA, 25 bp, Homo sapien
gtatcatttatcctaaagaacagag

SEQ ID NO: 87054 - DNA, 25 bp, Homo sapien
gaacagagatgaggtcaatttcaaa

SEQ ID NO: 87055 - DNA, 25 bp, Homo sapien
gtctctgtgatggtgagttgtagaa

SEQ ID NO: 87056 - DNA, 25 bp, Homo sapien
ctgtgatggtgagttgtagaattat

SEQ ID NO: 87057 - DNA, 25 bp, Homo sapien
cttgaatcgtcctgaaaccatccct

SEQ ID NO: 87058 - DNA, 25 bp, Homo sapien
attgtgttccgcgaaaccggtctct

SEQ ID NO: 87059 - DNA, 25 bp, Homo sapien
tgtgttccgcgaaaccggtctctgg

SEQ ID NO: 87060 - DNA, 25 bp, Homo sapien
tgttccgcgaaaccggtctctggtg

SEQ ID NO: 87061 - DNA, 25 bp, Homo sapien
aaggcaagaaaacgcattctctccc

SEQ ID NO: 87062 - DNA, 25 bp, Homo sapien
gcaagaaaacgcattctctccctca

SEQ ID NO: 87063 - DNA, 25 bp, Homo sapien
aagaaaacgcattctctccctcagc

SEQ ID NO: 87064 - DNA, 25 bp, Homo sapien
gcctctggaaggaaccagcactgtg

SEQ ID NO: 87065 - DNA, 25 bp, Homo sapien
ccagcactgtgggactaatttacat

SEQ ID NO: 87066 - DNA, 25 bp, Homo sapien
gtgcccggcccacaattaattttag

SEQ ID NO: 87067 - DNA, 25 bp, Homo sapien
tgcccggcccacaattaattttaga

SEQ ID NO: 87068 - DNA, 25 bp, Homo sapien
aaccctgcacccattagcagtccct

SEQ ID NO: 87069 - DNA, 25 bp, Homo sapien
accctgcacccattagcagtccctc

SEQ ID NO: 87070 - DNA, 25 bp, Homo sapien
cctgcacccattagcagtccctcca

SEQ ID NO: 87071 - DNA, 25 bp, Homo sapien
ctgcacccattagcagtccctccac

SEQ ID NO: 87072 - DNA, 25 bp, Homo sapien
tgcacccattagcagtccctccaca

SEQ ID NO: 87073 - DNA, 25 bp, Homo sapien
gcacccattagcagtccctccacat

SEQ ID NO: 87074 - DNA, 25 bp, Homo sapien
cacccattagcagtccctccacatt

SEQ ID NO: 87075 - DNA, 25 bp, Homo sapien
ccctccacatttccccctagcctgc

SEQ ID NO: 87076 - DNA, 25 bp, Homo sapien
cagccctggcaactgctaatctact

SEQ ID NO: 87077 - DNA, 25 bp, Homo sapien
ttatgcggctggtgcacacccagga

SEQ ID NO: 87078 - DNA, 25 bp, Homo sapien
tgcggctggtgcacacccaggagcc

SEQ ID NO: 87079 - DNA, 25 bp, Homo sapien
agtggctggaactcttgctggagcc

SEQ ID NO: 87080 - DNA, 25 bp, Homo sapien
tggaactcttgctggagccgggctc

SEQ ID NO: 87081 - DNA, 25 bp, Homo sapien
gttatgacttctcccatgagatcct

SEQ ID NO: 87082 - DNA, 25 bp, Homo sapien
gacttctcccatgagatccttcggg

SEQ ID NO: 87083 - DNA, 25 bp, Homo sapien
tctcccatgagatccttcgggatga

SEQ ID NO: 87084 - DNA, 25 bp, Homo sapien
gatccttcgggatgaagagtccttc

SEQ ID NO: 87085 - DNA, 25 bp, Homo sapien
tcgggatgaagagtccttctttggg

SEQ ID NO: 87086 - DNA, 25 bp, Homo sapien
gggccggcgcatctccgtgatctgc

SEQ ID NO: 87087 - DNA, 25 bp, Homo sapien
ctacagacaccagatttgtgaataa

SEQ ID NO: 87088 - DNA, 25 bp, Homo sapien
agagcagccacgacagccacagtgt

SEQ ID NO: 87089 - DNA, 25 bp, Homo sapien
cagtgtgtgcactcgatgatgcggc

SEQ ID NO: 87090 - DNA, 25 bp, Homo sapien
ccctgcacactcacatatgtggcaa

SEQ ID NO: 87091 - DNA, 25 bp, Homo sapien
tatgtggcaaccctcccacgaagga

SEQ ID NO: 87092 - DNA, 25 bp, Homo sapien
tgccaccatgccatatagggacaca

SEQ ID NO: 87093 - DNA, 25 bp, Homo sapien
tagggacacacctcagaaacccttc

SEQ ID NO: 87094 - DNA, 25 bp, Homo sapien
gaaacccttccttgacagctctgga

SEQ ID NO: 87095 - DNA, 25 bp, Homo sapien
gaaaatttggctccctcatgaaggt

SEQ ID NO: 87096 - DNA, 25 bp, Homo sapien
gaaccagctgctgttgacaccgagg

SEQ ID NO: 87097 - DNA, 25 bp, Homo sapien
tgacaccgaggttacatctgtatgt

SEQ ID NO: 87098 - DNA, 25 bp, Homo sapien
atgttctgcaaatccaacacacgtt

SEQ ID NO: 87099 - DNA, 25 bp, Homo sapien
accagtttcaggcttatgcacttac

SEQ ID NO: 87100 - DNA, 25 bp, Homo sapien
aggcttatgcacttacgtggctcat

SEQ ID NO: 87101 - DNA, 25 bp, Homo sapien
acgtggctcatgcactttatgtata

SEQ ID NO: 87102 - DNA, 25 bp, Homo sapien
aaatctggcttaaaaatactggtat

SEQ ID NO: 87103 - DNA, 25 bp, Homo sapien
atgaatttctgttctgtgtctctct

SEQ ID NO: 87104 - DNA, 25 bp, Homo sapien
gtgtctctctgttttatgttatgaa

SEQ ID NO: 87105 - DNA, 25 bp, Homo sapien
gaagccattcgctcatatacaataa

SEQ ID NO: 87106 - DNA, 25 bp, Homo sapien
ggactttaatcatacttgttccaaa

SEQ ID NO: 87107 - DNA, 25 bp, Homo sapien
ttgttccaaagagtagtaaccggat

SEQ ID NO: 87108 - DNA, 25 bp, Homo sapien
gtaaccggatggaattctggtattt

SEQ ID NO: 87109 - DNA, 25 bp, Homo sapien
tctggtatttacaggcattggtgct

SEQ ID NO: 87110 - DNA, 25 bp, Homo sapien
acaccttgctatacataatataatt

SEQ ID NO: 87111 - DNA, 25 bp, Homo sapien
gtggcaaagctaacctatcatcaac

SEQ ID NO: 87112 - DNA, 25 bp, Homo sapien
gcaaagctaacctatcatcaaccct

SEQ ID NO: 87113 - DNA, 25 bp, Homo sapien
aaagctaacctatcatcaaccctta

SEQ ID NO: 87114 - DNA, 25 bp, Homo sapien
aagctaacctatcatcaacccttac

SEQ ID NO: 87115 - DNA, 25 bp, Homo sapien
tatcatcaacccttactccacataa

SEQ ID NO: 87116 - DNA, 25 bp, Homo sapien
gaatgtggcaatgcttgtaactaaa

SEQ ID NO: 87117 - DNA, 25 bp, Homo sapien
gtggcaatgcttgtaactaaatctc

SEQ ID NO: 87118 - DNA, 25 bp, Homo sapien
aatgcttgtaactaaatctcaaact

SEQ ID NO: 87119 - DNA, 25 bp, Homo sapien
tgcttgtaactaaatctcaaacttt

SEQ ID NO: 87120 - DNA, 25 bp, Homo sapien
ctaaatctcaaactttactaaacat

SEQ ID NO: 87121 - DNA, 25 bp, Homo sapien
ggagtctgaggctgtgaatagttta

SEQ ID NO: 87122 - DNA, 25 bp, Homo sapien
gagtctgaggctgtgaatagtttat

SEQ ID NO: 87123 - DNA, 25 bp, Homo sapien
gtctgaggctgtgaatagtttatgg

SEQ ID NO: 87124 - DNA, 25 bp, Homo sapien
ctgaggctgtgaatagtttatggtt

SEQ ID NO: 87125 - DNA, 25 bp, Homo sapien
aggctgtgaatagtttatggttttg

SEQ ID NO: 87126 - DNA, 25 bp, Homo sapien
gaaaggctgatggtgaagcctcctg

SEQ ID NO: 87127 - DNA, 25 bp, Homo sapien
aaggctgatggtgaagcctcctgac

SEQ ID NO: 87128 - DNA, 25 bp, Homo sapien
aggctgatggtgaagcctcctgacc

SEQ ID NO: 87129 - DNA, 25 bp, Homo sapien
gctgatggtgaagcctcctgaccct

SEQ ID NO: 87130 - DNA, 25 bp, Homo sapien
tgatggtgaagcctcctgaccctcc

SEQ ID NO: 87131 - DNA, 25 bp, Homo sapien
tgaccctccccgctgtggttggcag

SEQ ID NO: 87132 - DNA, 25 bp, Homo sapien
ggaattcagcagtgagagcatgtct

SEQ ID NO: 87133 - DNA, 25 bp, Homo sapien
aaatctctttgggatactcgccctc

SEQ ID NO: 87134 - DNA, 25 bp, Homo sapien
tccctgggaaccagagttctggctc

SEQ ID NO: 87135 - DNA, 25 bp, Homo sapien
gttctggctctaacattgagcagct

SEQ ID NO: 87136 - DNA, 25 bp, Homo sapien
gagcagctatgcactagttccagag

SEQ ID NO: 87137 - DNA, 25 bp, Homo sapien
gctatgcactagttccagagaagcc

SEQ ID NO: 87138 - DNA, 25 bp, Homo sapien
cagagaagccactaacaggctgcca

SEQ ID NO: 87139 - DNA, 25 bp, Homo sapien
ggctgccatgtgtagatgtaggttc

SEQ ID NO: 87140 - DNA, 25 bp, Homo sapien
gtaggttcttaagagatcacaggct

SEQ ID NO: 87141 - DNA, 25 bp, Homo sapien
gagatcacaggctgggtcatctgat

SEQ ID NO: 87142 - DNA, 25 bp, Homo sapien
caggctgggtcatctgatcactgga

SEQ ID NO: 87143 - DNA, 25 bp, Homo sapien
gccttggtgggcagtcctattatct

SEQ ID NO: 87144 - DNA, 25 bp, Homo sapien
cttggtgggcagtcctattatctgg

SEQ ID NO: 87145 - DNA, 25 bp, Homo sapien
atggctcaggtggatgcttggaaac

SEQ ID NO: 87146 - DNA, 25 bp, Homo sapien
ggatgcttggaaacaactccagact

SEQ ID NO: 87147 - DNA, 25 bp, Homo sapien
ggaaacaactccagactttcttcca

SEQ ID NO: 87148 - DNA, 25 bp, Homo sapien
acaactccagactttcttccacaaa

SEQ ID NO: 87149 - DNA, 25 bp, Homo sapien
ttcttccacaaacacttgggtggcc

SEQ ID NO: 87150 - DNA, 25 bp, Homo sapien
tgatcatgtggcctctctgttgcta

SEQ ID NO: 87151 - DNA, 25 bp, Homo sapien
atcatgtggcctctctgttgctaat

SEQ ID NO: 87152 - DNA, 25 bp, Homo sapien
ctctctgttgctaatctctcctgga

SEQ ID NO: 87153 - DNA, 25 bp, Homo sapien
acatctgccacatttagtgtgtgta

SEQ ID NO: 87154 - DNA, 25 bp, Homo sapien
acagccagtctgaagtatccattac

SEQ ID NO: 87155 - DNA, 25 bp, Homo sapien
gtatccattactcaagtcccaaggt

SEQ ID NO: 87156 - DNA, 25 bp, Homo sapien
ttactcaagtcccaaggtgacctct

SEQ ID NO: 87157 - DNA, 25 bp, Homo sapien
tcagatttccttcttggccctgtgc

SEQ ID NO: 87158 - DNA, 25 bp, Homo sapien
ctgcactttcttcactgtgttcaag

SEQ ID NO: 87159 - DNA, 25 bp, Homo sapien
gttcaagtgtcatagctatcaggcc

SEQ ID NO: 87160 - DNA, 25 bp, Homo sapien
gctatcaggccactatcatggatat

SEQ ID NO: 87161 - DNA, 25 bp, Homo sapien
gatatcatgtatccttcctggtgct

SEQ ID NO: 87162 - DNA, 25 bp, Homo sapien
acacctgtcaccttgtaaaacacgg

SEQ ID NO: 87163 - DNA, 25 bp, Homo sapien
gtgtgaacacaggacagcttcgctc

SEQ ID NO: 87164 - DNA, 25 bp, Homo sapien
gccctagctcttggttggtttatat

SEQ ID NO: 87165 - DNA, 25 bp, Homo sapien
attcccctgcagcagtcgaggactg

SEQ ID NO: 87166 - DNA, 25 bp, Homo sapien
aaggtgttcagccagtcgtttgtaa

SEQ ID NO: 87167 - DNA, 25 bp, Homo sapien
agtcgtttgtaaggcgctcgtcggc

SEQ ID NO: 87168 - DNA, 25 bp, Homo sapien
gcgctcgtcggcacctgctgaaacg

SEQ ID NO: 87169 - DNA, 25 bp, Homo sapien
ccccatcctcaaagactgtcttaat

SEQ ID NO: 87170 - DNA, 25 bp, Homo sapien
aagactgtcttaattactcatggca

SEQ ID NO: 87171 - DNA, 25 bp, Homo sapien
actcatggcaggttctagagactta

SEQ ID NO: 87172 - DNA, 25 bp, Homo sapien
ggaaaagctgctttcaaggccacca

SEQ ID NO: 87173 - DNA, 25 bp, Homo sapien
gctttcaaggccaccacatgtctgt

SEQ ID NO: 87174 - DNA, 25 bp, Homo sapien
agctctatctgccttgtgttcattt

SEQ ID NO: 87175 - DNA, 25 bp, Homo sapien
gtgacgtgagactgcaaagaccaat

SEQ ID NO: 87176 - DNA, 25 bp, Homo sapien
tgaccttcaaatgcccatgttggcc

SEQ ID NO: 87177 - DNA, 25 bp, Homo sapien
ccatgttggccttttacagcagtgc

SEQ ID NO: 87178 - DNA, 25 bp, Homo sapien
agtgccacggcaccaagcgagctgc

SEQ ID NO: 87179 - DNA, 25 bp, Homo sapien
gccacatctcacactctaaagggtt

SEQ ID NO: 87180 - DNA, 25 bp, Homo sapien
tatatcgtctgtcttgcgtgtgtca

SEQ ID NO: 87181 - DNA, 25 bp, Homo sapien
gtcttgcgtgtgtcagaactgggtt

SEQ ID NO: 87182 - DNA, 25 bp, Homo sapien
ggaggttcagagcaggcaacaccat

SEQ ID NO: 87183 - DNA, 25 bp, Homo sapien
taagttgctctcagatccttgttct

SEQ ID NO: 87184 - DNA, 25 bp, Homo sapien
cattcttggttatctgtacttctgt

SEQ ID NO: 87185 - DNA, 25 bp, Homo sapien
gtacttctgtagctggtgtgatgct

SEQ ID NO: 87186 - DNA, 25 bp, Homo sapien
attgtatgtaccacacatctccaga

SEQ ID NO: 87187 - DNA, 25 bp, Homo sapien
gtgtgtttcgccagttaagcacctg

SEQ ID NO: 87188 - DNA, 25 bp, Homo sapien
gtgtttcgccagttaagcacctgtg

SEQ ID NO: 87189 - DNA, 25 bp, Homo sapien
gtttcgccagttaagcacctgtgac

SEQ ID NO: 87190 - DNA, 25 bp, Homo sapien
ttcgccagttaagcacctgtgactc

SEQ ID NO: 87191 - DNA, 25 bp, Homo sapien
gccagttaagcacctgtgactccag

SEQ ID NO: 87192 - DNA, 25 bp, Homo sapien
agttaagcacctgtgactccagtac

SEQ ID NO: 87193 - DNA, 25 bp, Homo sapien
taagcacctgtgactccagtaccta

SEQ ID NO: 87194 - DNA, 25 bp, Homo sapien
gcacctgtgactccagtacctacta

SEQ ID NO: 87195 - DNA, 25 bp, Homo sapien
tgtgactccagtacctactactggt

SEQ ID NO: 87196 - DNA, 25 bp, Homo sapien
gactccagtacctactactggtttt

SEQ ID NO: 87197 - DNA, 25 bp, Homo sapien
ctccagtacctactactggttttgg

SEQ ID NO: 87198 - DNA, 25 bp, Homo sapien
gggtcacaaacgttgagtggctgct

SEQ ID NO: 87199 - DNA, 25 bp, Homo sapien
tggatgctctgtacgggaaggtcct

SEQ ID NO: 87200 - DNA, 25 bp, Homo sapien
tctgtacgggaaggtcctgacggat

SEQ ID NO: 87201 - DNA, 25 bp, Homo sapien
acccaagcaagatgcggaagctctt

SEQ ID NO: 87202 - DNA, 25 bp, Homo sapien
atgcggaagctcttcagtttcacac

SEQ ID NO: 87203 - DNA, 25 bp, Homo sapien
agtttcacaccagcctggaactgga

SEQ ID NO: 87204 - DNA, 25 bp, Homo sapien
ggaactggacctgcaaggacttgct

SEQ ID NO: 87205 - DNA, 25 bp, Homo sapien
acttgctcctccaggccctaaggga

SEQ ID NO: 87206 - DNA, 25 bp, Homo sapien
aagggagtcccagtcctacctggtg

SEQ ID NO: 87207 - DNA, 25 bp, Homo sapien
gagctgaggctccttcccagcaaca

SEQ ID NO: 87208 - DNA, 25 bp, Homo sapien
accaaatcatcctgaatctgatctt

SEQ ID NO: 87209 - DNA, 25 bp, Homo sapien
agcacccgaacctgtaattgccaag

SEQ ID NO: 87210 - DNA, 25 bp, Homo sapien
gtaattgccaagtccctaaggtact

SEQ ID NO: 87211 - DNA, 25 bp, Homo sapien
ggtactaatttgtagctgctctgaa

SEQ ID NO: 87212 - DNA, 25 bp, Homo sapien
aagtaaggatttcggattcagctgg

SEQ ID NO: 87213 - DNA, 25 bp, Homo sapien
aaagactctgtcacctgctgtcttc

SEQ ID NO: 87214 - DNA, 25 bp, Homo sapien
gttcaaatccatgtggtgacattgc

SEQ ID NO: 87215 - DNA, 25 bp, Homo sapien
tgacattgcattagtctccctttca

SEQ ID NO: 87216 - DNA, 25 bp, Homo sapien
tcactgttttcttattctgtaattg

SEQ ID NO: 87217 - DNA, 25 bp, Homo sapien
gtcttgatcactaagcaaagctgct

SEQ ID NO: 87218 - DNA, 25 bp, Homo sapien
gcaaagctgctagtggcattctata

SEQ ID NO: 87219 - DNA, 25 bp, Homo sapien
ggcattctatatttcgtgtcatctt

SEQ ID NO: 87220 - DNA, 25 bp, Homo sapien
ttgatcggccggaggtactgcggaa

SEQ ID NO: 87221 - DNA, 25 bp, Homo sapien
agaagcctgggtcattgttcgcagc

SEQ ID NO: 87222 - DNA, 25 bp, Homo sapien
ttgttcgcagccctcatggccacag

SEQ ID NO: 87223 - DNA, 25 bp, Homo sapien
cttcttcactgagataaggagatgt

SEQ ID NO: 87224 - DNA, 25 bp, Homo sapien
agcttcgaggcccacagtctgcgac

SEQ ID NO: 87225 - DNA, 25 bp, Homo sapien
aggcccacagtctgcgaccttcttg

SEQ ID NO: 87226 - DNA, 25 bp, Homo sapien
gattgctggatggaaaccctggaat

SEQ ID NO: 87227 - DNA, 25 bp, Homo sapien
gaaaccctggaataggctacttgat

SEQ ID NO: 87228 - DNA, 25 bp, Homo sapien
ggaataggctacttgatggctctca

SEQ ID NO: 87229 - DNA, 25 bp, Homo sapien
gatggctctcaagaccttagaaccc

SEQ ID NO: 87230 - DNA, 25 bp, Homo sapien
caagaccttagaaccccagaaccat

SEQ ID NO: 87231 - DNA, 25 bp, Homo sapien
actgctatccgccagaccccaaggg

SEQ ID NO: 87232 - DNA, 25 bp, Homo sapien
gcgtcctcggtttctcgcctgtcat

SEQ ID NO: 87233 - DNA, 25 bp, Homo sapien
tcggtttctcgcctgtcatcatcga

SEQ ID NO: 87234 - DNA, 25 bp, Homo sapien
gggggctctgacagaccctggaccc

SEQ ID NO: 87235 - DNA, 25 bp, Homo sapien
tgccactcaaccaaagagtcctcga

SEQ ID NO: 87236 - DNA, 25 bp, Homo sapien
tcaaccaaagagtcctcgagccggc

SEQ ID NO: 87237 - DNA, 25 bp, Homo sapien
aaccaaagagtcctcgagccggcct

SEQ ID NO: 87238 - DNA, 25 bp, Homo sapien
aaagagtcctcgagccggcctgcca

SEQ ID NO: 87239 - DNA, 25 bp, Homo sapien
aaacacaccttcaccttacaaggtg

SEQ ID NO: 87240 - DNA, 25 bp, Homo sapien
accttacaaggtgctgaccatatta

SEQ ID NO: 87241 - DNA, 25 bp, Homo sapien
acaaggtgctgaccatattaaatgt

SEQ ID NO: 87242 - DNA, 25 bp, Homo sapien
gtaccaatgaacacatccagctgat

SEQ ID NO: 87243 - DNA, 25 bp, Homo sapien
agctgatcccaaaagctgttttcag

SEQ ID NO: 87244 - DNA, 25 bp, Homo sapien
gagacaagtgacgacagccattccc

SEQ ID NO: 87245 - DNA, 25 bp, Homo sapien
cctttgcagctatctactgtagtga

SEQ ID NO: 87246 - DNA, 25 bp, Homo sapien
actgtagtgacagccatttcttggt

SEQ ID NO: 87247 - DNA, 25 bp, Homo sapien
aattacactggcctttgtttttctg

SEQ ID NO: 87248 - DNA, 25 bp, Homo sapien
gtttttctggaaatgccgaccatgg

SEQ ID NO: 87249 - DNA, 25 bp, Homo sapien
atgccgaccatggagatgctttaga

SEQ ID NO: 87250 - DNA, 25 bp, Homo sapien
gagtcttctcaaatagcttagatgt

SEQ ID NO: 87251 - DNA, 25 bp, Homo sapien
tgttgtaatgaggttagctttgctt

SEQ ID NO: 87252 - DNA, 25 bp, Homo sapien
ggccctcagaagttctccttaaatt

SEQ ID NO: 87253 - DNA, 25 bp, Homo sapien
gtgaagccaccccaagcagtacgct

SEQ ID NO: 87254 - DNA, 25 bp, Homo sapien
gaagccaccccaagcagtacgcttg

SEQ ID NO: 87255 - DNA, 25 bp, Homo sapien
gcagtacgcttgctggtctaagtct

SEQ ID NO: 87256 - DNA, 25 bp, Homo sapien
agtacgcttgctggtctaagtctta

SEQ ID NO: 87257 - DNA, 25 bp, Homo sapien
gtacgcttgctggtctaagtcttaa

SEQ ID NO: 87258 - DNA, 25 bp, Homo sapien
tacgcttgctggtctaagtcttaac

SEQ ID NO: 87259 - DNA, 25 bp, Homo sapien
acgcttgctggtctaagtcttaacc

SEQ ID NO: 87260 - DNA, 25 bp, Homo sapien
cgcttgctggtctaagtcttaaccc

SEQ ID NO: 87261 - DNA, 25 bp, Homo sapien
gagtcacactgagacagtcaactgt

SEQ ID NO: 87262 - DNA, 25 bp, Homo sapien
gtcacactgagacagtcaactgtgt

SEQ ID NO: 87263 - DNA, 25 bp, Homo sapien
actgagacagtcaactgtgtgtgac

SEQ ID NO: 87264 - DNA, 25 bp, Homo sapien
gtgtcccgcatgagatgtctgcaga

SEQ ID NO: 87265 - DNA, 25 bp, Homo sapien
atgagacttacagtgcgctgagccc

SEQ ID NO: 87266 - DNA, 25 bp, Homo sapien
tgcgctgagccctggcaaaagtgag

SEQ ID NO: 87267 - DNA, 25 bp, Homo sapien
aggacgttgtgcttcgatggagcca

SEQ ID NO: 87268 - DNA, 25 bp, Homo sapien
gagccaggagttcagcaccttgact

SEQ ID NO: 87269 - DNA, 25 bp, Homo sapien
accttgactctaggccagttcggat

SEQ ID NO: 87270 - DNA, 25 bp, Homo sapien
agttcggatgagctggcgtctattc

SEQ ID NO: 87271 - DNA, 25 bp, Homo sapien
tgcccacgttctctattgttttgag

SEQ ID NO: 87272 - DNA, 25 bp, Homo sapien
ttttgagaccccattgctttcaggc

SEQ ID NO: 87273 - DNA, 25 bp, Homo sapien
tcacatttccttgggttggagcaac

SEQ ID NO: 87274 - DNA, 25 bp, Homo sapien
aacagtcccagagagggccacggtg

SEQ ID NO: 87275 - DNA, 25 bp, Homo sapien
gtggcaaagctaacctatcatcaac

SEQ ID NO: 87276 - DNA, 25 bp, Homo sapien
tggcaaagctaacctatcatcaacc

SEQ ID NO: 87277 - DNA, 25 bp, Homo sapien
ggcaaagctaacctatcatcaaccc

SEQ ID NO: 87278 - DNA, 25 bp, Homo sapien
gcaaagctaacctatcatcaaccct

SEQ ID NO: 87279 - DNA, 25 bp, Homo sapien
caaagctaacctatcatcaaccctt

SEQ ID NO: 87280 - DNA, 25 bp, Homo sapien
aaagctaacctatcatcaaccctta

SEQ ID NO: 87281 - DNA, 25 bp, Homo sapien
aagctaacctatcatcaacccttac

SEQ ID NO: 87282 - DNA, 25 bp, Homo sapien
aatgcttgtaactaaatctcaaact

SEQ ID NO: 87283 - DNA, 25 bp, Homo sapien
tgcttgtaactaaatctcaaacttt

SEQ ID NO: 87284 - DNA, 25 bp, Homo sapien
tgtaactaaatctcaaactttacta

SEQ ID NO: 87285 - DNA, 25 bp, Homo sapien
ctaaatctcaaactttactaaacat

SEQ ID NO: 87286 - DNA, 25 bp, Homo sapien
ttcgaggccctctccctcagtaaat

SEQ ID NO: 87287 - DNA, 25 bp, Homo sapien
gaggccctctccctcagtaaattca

SEQ ID NO: 87288 - DNA, 25 bp, Homo sapien
tccctcagtaaattcacattttcct

SEQ ID NO: 87289 - DNA, 25 bp, Homo sapien
acattttccttcctcctgttacatt

SEQ ID NO: 87290 - DNA, 25 bp, Homo sapien
ctcctgttacattttcccaatatct

SEQ ID NO: 87291 - DNA, 25 bp, Homo sapien
gttacattttcccaatatcttttct

SEQ ID NO: 87292 - DNA, 25 bp, Homo sapien
ttcccaatatcttttctattccttg

SEQ ID NO: 87293 - DNA, 25 bp, Homo sapien
tttctattccttggaccaatcagag

SEQ ID NO: 87294 - DNA, 25 bp, Homo sapien
tattccttggaccaatcagagatgc

SEQ ID NO: 87295 - DNA, 25 bp, Homo sapien
taatgtaactttttccacaggaggt

SEQ ID NO: 87296 - DNA, 25 bp, Homo sapien
ttggtcctgagtattttgcaaatgc

SEQ ID NO: 87297 - DNA, 25 bp, Homo sapien
tgagtgcagccccacacgactgagc

SEQ ID NO: 87298 - DNA, 25 bp, Homo sapien
tcggccagctggacccacatgaggg

SEQ ID NO: 87299 - DNA, 25 bp, Homo sapien
acatgagggccacctctggaacctt

SEQ ID NO: 87300 - DNA, 25 bp, Homo sapien
tgagggccacctctggaaccttctt

SEQ ID NO: 87301 - DNA, 25 bp, Homo sapien
gccacctctggaaccttcttcgagg

SEQ ID NO: 87302 - DNA, 25 bp, Homo sapien
catctgcccagcctcggagggtggg

SEQ ID NO: 87303 - DNA, 25 bp, Homo sapien
gcaacctggtgcttcccgggtggac

SEQ ID NO: 87304 - DNA, 25 bp, Homo sapien
gtgcttcccgggtggacacacagga

SEQ ID NO: 87305 - DNA, 25 bp, Homo sapien
tggacacacaggaccactcagtggg

SEQ ID NO: 87306 - DNA, 25 bp, Homo sapien
gtgtgggcgccgagacctgggtgtc

SEQ ID NO: 87307 - DNA, 25 bp, Homo sapien
gggcctcccaactatgaataaagct

SEQ ID NO: 87308 - DNA, 25 bp, Homo sapien
tttagtctctggaacatccaaaacc

SEQ ID NO: 87309 - DNA, 25 bp, Homo sapien
ggaacatccaaaaccaagcaaaggg

SEQ ID NO: 87310 - DNA, 25 bp, Homo sapien
ccaagcaaagggatgtgactatttt

SEQ ID NO: 87311 - DNA, 25 bp, Homo sapien
aatgaatcagaatgtcaacttgtgt

SEQ ID NO: 87312 - DNA, 25 bp, Homo sapien
atgtcaacttgtgtgtacactatat

SEQ ID NO: 87313 - DNA, 25 bp, Homo sapien
tacactatatctacacttactcatt

SEQ ID NO: 87314 - DNA, 25 bp, Homo sapien
aaatctagatcaattcttcaatttg

SEQ ID NO: 87315 - DNA, 25 bp, Homo sapien
gaactgttcagccttttcaagattt

SEQ ID NO: 87316 - DNA, 25 bp, Homo sapien
ctgttcagccttttcaagatttctt

SEQ ID NO: 87317 - DNA, 25 bp, Homo sapien
tgtacattcttctcactgactttgg

SEQ ID NO: 87318 - DNA, 25 bp, Homo sapien
gaatgatgtgtttctatctgtaata

SEQ ID NO: 87319 - DNA, 25 bp, Homo sapien
taactctcctgtgaaccctgggctt

SEQ ID NO: 87320 - DNA, 25 bp, Homo sapien
tgtttaacattctggtttcctcctt

SEQ ID NO: 87321 - DNA, 25 bp, Homo sapien
tgtggccctcttcaaggtcctacct

SEQ ID NO: 87322 - DNA, 25 bp, Homo sapien
ttctttgtggttctgtacagattga

SEQ ID NO: 87323 - DNA, 25 bp, Homo sapien
ggttctgtacagattgatgcaatta

SEQ ID NO: 87324 - DNA, 25 bp, Homo sapien
catctacttgtattgtgaaaaacca

SEQ ID NO: 87325 - DNA, 25 bp, Homo sapien
agctcttcagttatggtcttttcat

SEQ ID NO: 87326 - DNA, 25 bp, Homo sapien
agaatgtgaaacttatgctgtgtgc

SEQ ID NO: 87327 - DNA, 25 bp, Homo sapien
cccctccttttatgtggcgaacaca

SEQ ID NO: 87328 - DNA, 25 bp, Homo sapien
tttatgtggcgaacacaacctgccc

SEQ ID NO: 87329 - DNA, 25 bp, Homo sapien
aacctgccccgtatggtgcctaact

SEQ ID NO: 87330 - DNA, 25 bp, Homo sapien
acaacaaaacttcctaggccagatg

SEQ ID NO: 87331 - DNA, 25 bp, Homo sapien
caacaaaacttcctaggccagatgt

SEQ ID NO: 87332 - DNA, 25 bp, Homo sapien
aacaaaacttcctaggccagatgtg

SEQ ID NO: 87333 - DNA, 25 bp, Homo sapien
acaaaacttcctaggccagatgtgg

SEQ ID NO: 87334 - DNA, 25 bp, Homo sapien
caaaacttcctaggccagatgtggt

SEQ ID NO: 87335 - DNA, 25 bp, Homo sapien
tggtggctcatatgtataatcttag

SEQ ID NO: 87336 - DNA, 25 bp, Homo sapien
gtaatcccaaatacgcggtaggctg

SEQ ID NO: 87337 - DNA, 25 bp, Homo sapien
taatcccaaatacgcggtaggctga

SEQ ID NO: 87338 - DNA, 25 bp, Homo sapien
atcccaaatacgcggtaggctgagg

SEQ ID NO: 87339 - DNA, 25 bp, Homo sapien
tcccaaatacgcggtaggctgaggc

SEQ ID NO: 87340 - DNA, 25 bp, Homo sapien
cccaaatacgcggtaggctgaggct

SEQ ID NO: 87341 - DNA, 25 bp, Homo sapien
gcacacaacagccacatagccgggt

SEQ ID NO: 87342 - DNA, 25 bp, Homo sapien
cccgccagtgccttggatatttctg

SEQ ID NO: 87343 - DNA, 25 bp, Homo sapien
ctgggccacctttctggagacaggg

SEQ ID NO: 87344 - DNA, 25 bp, Homo sapien
ggccacctttctggagacagggagg

SEQ ID NO: 87345 - DNA, 25 bp, Homo sapien
gtgggaaggctgatgatctgtctcc

SEQ ID NO: 87346 - DNA, 25 bp, Homo sapien
aaggctgatgatctgtctccagccc

SEQ ID NO: 87347 - DNA, 25 bp, Homo sapien
ttccctctgggcaactggacagatc

SEQ ID NO: 87348 - DNA, 25 bp, Homo sapien
ctctgggcaactggacagatctggg

SEQ ID NO: 87349 - DNA, 25 bp, Homo sapien
tgtggctggccagagacacctccag

SEQ ID NO: 87350 - DNA, 25 bp, Homo sapien
gtggctggccagagacacctccagg

SEQ ID NO: 87351 - DNA, 25 bp, Homo sapien
agagacacctccaggccgtagcctg

SEQ ID NO: 87352 - DNA, 25 bp, Homo sapien
ccctgggccacctttctggagacag

SEQ ID NO: 87353 - DNA, 25 bp, Homo sapien
cctgggccacctttctggagacagg

SEQ ID NO: 87354 - DNA, 25 bp, Homo sapien
ctgggccacctttctggagacaggg

SEQ ID NO: 87355 - DNA, 25 bp, Homo sapien
tgggccacctttctggagacaggga

SEQ ID NO: 87356 - DNA, 25 bp, Homo sapien
gggccacctttctggagacagggag

SEQ ID NO: 87357 - DNA, 25 bp, Homo sapien
ggccacctttctggagacagggagg

SEQ ID NO: 87358 - DNA, 25 bp, Homo sapien
gtgggaaggctgatgatctgtctcc

SEQ ID NO: 87359 - DNA, 25 bp, Homo sapien
tgtggctggccagagacacctccag

SEQ ID NO: 87360 - DNA, 25 bp, Homo sapien
gtggctggccagagacacctccagg

SEQ ID NO: 87361 - DNA, 25 bp, Homo sapien
tggctggccagagacacctccaggc

SEQ ID NO: 87362 - DNA, 25 bp, Homo sapien
atgcatactcttgggaagcagcttc

SEQ ID NO: 87363 - DNA, 25 bp, Homo sapien
gcagcttcctgggagattagaaatt

SEQ ID NO: 87364 - DNA, 25 bp, Homo sapien
agaaattctacttccctgactggag

SEQ ID NO: 87365 - DNA, 25 bp, Homo sapien
ggagctaaatcccaccagccaggac

SEQ ID NO: 87366 - DNA, 25 bp, Homo sapien
gacccaaactctccttaccgagaag

SEQ ID NO: 87367 - DNA, 25 bp, Homo sapien
ttaccgagaaggaccccagctcttg

SEQ ID NO: 87368 - DNA, 25 bp, Homo sapien
ctcttgaagggctgagtggcctgct

SEQ ID NO: 87369 - DNA, 25 bp, Homo sapien
tgggagggtgtctttactatgtcct

SEQ ID NO: 87370 - DNA, 25 bp, Homo sapien
atgtcctaggtttcgtagatgcccc

SEQ ID NO: 87371 - DNA, 25 bp, Homo sapien
ccctctttcctgtctgtgtaaattg

SEQ ID NO: 87372 - DNA, 25 bp, Homo sapien
gtaaattgttccgtgaagccgcgct

SEQ ID NO: 87373 - DNA, 25 bp, Homo sapien
atctatcacgtgttccacagcagaa

SEQ ID NO: 87374 - DNA, 25 bp, Homo sapien
aaggactgtgcagacccctgtgact

SEQ ID NO: 87375 - DNA, 25 bp, Homo sapien
tgccaccatgcctgagtgcctgcag

SEQ ID NO: 87376 - DNA, 25 bp, Homo sapien
acaccggtacactcgtggacaccta

SEQ ID NO: 87377 - DNA, 25 bp, Homo sapien
tggacacctacacactccataggag

SEQ ID NO: 87378 - DNA, 25 bp, Homo sapien
actccataggagatcctggctttcc

SEQ ID NO: 87379 - DNA, 25 bp, Homo sapien
agatcctggctttccagggtgggca

SEQ ID NO: 87380 - DNA, 25 bp, Homo sapien
ggagcaggcttggagccagggacca

SEQ ID NO: 87381 - DNA, 25 bp, Homo sapien
ggctgtagggtaagcccctgagcct

SEQ ID NO: 87382 - DNA, 25 bp, Homo sapien
tgagcctgggacctacatgtggttt

SEQ ID NO: 87383 - DNA, 25 bp, Homo sapien
gggacctacatgtggtttgcgtaat

SEQ ID NO: 87384 - DNA, 25 bp, Homo sapien
gaagaaacacatagagcagaagcaa

SEQ ID NO: 87385 - DNA, 25 bp, Homo sapien
gatatgctatataagatgctctcag

SEQ ID NO: 87386 - DNA, 25 bp, Homo sapien
gttggatgccagtgagatccaggtg

SEQ ID NO: 87387 - DNA, 25 bp, Homo sapien
gaaaccatcttcctgctggagtctt

SEQ ID NO: 87388 - DNA, 25 bp, Homo sapien
catcttcctgctggagtcttacatt

SEQ ID NO: 87389 - DNA, 25 bp, Homo sapien
gagtcttacattgagtgcaccatga

SEQ ID NO: 87390 - DNA, 25 bp, Homo sapien
gtcttacattgagtgcaccatgaag

SEQ ID NO: 87391 - DNA, 25 bp, Homo sapien
attgagtgcaccatgaagagacagt

SEQ ID NO: 87392 - DNA, 25 bp, Homo sapien
tgcaccatgaagagacagtgatcca

SEQ ID NO: 87393 - DNA, 25 bp, Homo sapien
gaagcatcttcctcagaagatctgg

SEQ ID NO: 87394 - DNA, 25 bp, Homo sapien
agcaaaataaaggaggtgcctggat

SEQ ID NO: 87395 - DNA, 25 bp, Homo sapien
tataaattacccactctcggatata

SEQ ID NO: 87396 - DNA, 25 bp, Homo sapien
taaattacccactctcggatatatc

SEQ ID NO: 87397 - DNA, 25 bp, Homo sapien
aattacccactctcggatatatctt

SEQ ID NO: 87398 - DNA, 25 bp, Homo sapien
tacccactctcggatatatctttat

SEQ ID NO: 87399 - DNA, 25 bp, Homo sapien
cccactctcggatatatctttatta

SEQ ID NO: 87400 - DNA, 25 bp, Homo sapien
cactctcggatatatctttattagc

SEQ ID NO: 87401 - DNA, 25 bp, Homo sapien
ctcggatatatctttattagcagtg

SEQ ID NO: 87402 - DNA, 25 bp, Homo sapien
ttattagcagtgtgacagcagacta

SEQ ID NO: 87403 - DNA, 25 bp, Homo sapien
agcagtgtgacagcagactaataga

SEQ ID NO: 87404 - DNA, 25 bp, Homo sapien
gtgtgacagcagactaatagaggga

SEQ ID NO: 87405 - DNA, 25 bp, Homo sapien
gacagcagactaatagagggattaa

SEQ ID NO: 87406 - DNA, 25 bp, Homo sapien
tgttattggccttttctattcctgt

SEQ ID NO: 87407 - DNA, 25 bp, Homo sapien
ggccttttctattcctgtaatgaaa

SEQ ID NO: 87408 - DNA, 25 bp, Homo sapien
gaaagctgtttgtcgtaacttgaaa

SEQ ID NO: 87409 - DNA, 25 bp, Homo sapien
ttatcttttactatgggagtcacta

SEQ ID NO: 87410 - DNA, 25 bp, Homo sapien
tatgggagtcactatttattattgc

SEQ ID NO: 87411 - DNA, 25 bp, Homo sapien
attattgcttatgtgccctgttcaa

SEQ ID NO: 87412 - DNA, 25 bp, Homo sapien
gcttatgtgccctgttcaaaacaga

SEQ ID NO: 87413 - DNA, 25 bp, Homo sapien
tatttgtttctggtctttgttaagt

SEQ ID NO: 87414 - DNA, 25 bp, Homo sapien
ctggtctttgttaagttctattgga

SEQ ID NO: 87415 - DNA, 25 bp, Homo sapien
ttggaaaaaccactgtctgtgtttt

SEQ ID NO: 87416 - DNA, 25 bp, Homo sapien
ggcagttgtctgcattaacctgttc

SEQ ID NO: 87417 - DNA, 25 bp, Homo sapien
tgaaaacacagaaccgttaattcct

SEQ ID NO: 87418 - DNA, 25 bp, Homo sapien
aattccttggtttaagcagttgcta

SEQ ID NO: 87419 - DNA, 25 bp, Homo sapien
gaggcccataggaggttttaagatt

SEQ ID NO: 87420 - DNA, 25 bp, Homo sapien
tatgtttagtccgataggtgaggtc

SEQ ID NO: 87421 - DNA, 25 bp, Homo sapien
aggtgaggtctttgatattttgaat

SEQ ID NO: 87422 - DNA, 25 bp, Homo sapien
taactccttttatgatacatcacag

SEQ ID NO: 87423 - DNA, 25 bp, Homo sapien
atcacagtaacctcatttttgaagt

SEQ ID NO: 87424 - DNA, 25 bp, Homo sapien
tgaagtctttctttgtactttaatg

SEQ ID NO: 87425 - DNA, 25 bp, Homo sapien
gtactttaatgttctctctgttcta

SEQ ID NO: 87426 - DNA, 25 bp, Homo sapien
atgttctctctgttctaatagttga

SEQ ID NO: 87427 - DNA, 25 bp, Homo sapien
gtaactattataaactgttgctgaa

SEQ ID NO: 87428 - DNA, 25 bp, Homo sapien
gccttcagcctagatggtgcaaagc

SEQ ID NO: 87429 - DNA, 25 bp, Homo sapien
tcagcctagatggtgcaaagctggg

SEQ ID NO: 87430 - DNA, 25 bp, Homo sapien
ccagacttcacacagtattctcccc

SEQ ID NO: 87431 - DNA, 25 bp, Homo sapien
accaaaggcccctgccaggtgtggg

SEQ ID NO: 87432 - DNA, 25 bp, Homo sapien
atgtgtgaaagcaacgtagcgcccc

SEQ ID NO: 87433 - DNA, 25 bp, Homo sapien
gtgtgaaagcaacgtagcgccccgc

SEQ ID NO: 87434 - DNA, 25 bp, Homo sapien
tgtgaaagcaacgtagcgccccgcg

SEQ ID NO: 87435 - DNA, 25 bp, Homo sapien
tgaaagcaacgtagcgccccgcgga

SEQ ID NO: 87436 - DNA, 25 bp, Homo sapien
cgccccgcggactgcagtgcgctta

SEQ ID NO: 87437 - DNA, 25 bp, Homo sapien
tcccttctcttagcccaagcctgtc

SEQ ID NO: 87438 - DNA, 25 bp, Homo sapien
tggtggggcccagtgtactgaaata

SEQ ID NO: 87439 - DNA, 25 bp, Homo sapien
tacaaggattggtctaggtgcccgg

SEQ ID NO: 87440 - DNA, 25 bp, Homo sapien
acaaggattggtctaggtgcccggg

SEQ ID NO: 87441 - DNA, 25 bp, Homo sapien
caaggattggtctaggtgcccgggc

SEQ ID NO: 87442 - DNA, 25 bp, Homo sapien
aaggattggtctaggtgcccgggcg

SEQ ID NO: 87443 - DNA, 25 bp, Homo sapien
aggattggtctaggtgcccgggcgc

SEQ ID NO: 87444 - DNA, 25 bp, Homo sapien
ggattggtctaggtgcccgggcgcg

SEQ ID NO: 87445 - DNA, 25 bp, Homo sapien
gattggtctaggtgcccgggcgcgg

SEQ ID NO: 87446 - DNA, 25 bp, Homo sapien
attggtctaggtgcccgggcgcggt

SEQ ID NO: 87447 - DNA, 25 bp, Homo sapien
ttggtctaggtgcccgggcgcggtg

SEQ ID NO: 87448 - DNA, 25 bp, Homo sapien
tggtctaggtgcccgggcgcggtgg

SEQ ID NO: 87449 - DNA, 25 bp, Homo sapien
gataacatttactctaagtacccag

SEQ ID NO: 87450 - DNA, 25 bp, Homo sapien
taacatttactctaagtacccagtt

SEQ ID NO: 87451 - DNA, 25 bp, Homo sapien
ttcaacacttactttgtcattttgt

SEQ ID NO: 87452 - DNA, 25 bp, Homo sapien
gtttttgatactgatattttcctat

SEQ ID NO: 87453 - DNA, 25 bp, Homo sapien
gatactgatattttcctatgctgaa

SEQ ID NO: 87454 - DNA, 25 bp, Homo sapien
ttcctatgctgaatagttttcttac

SEQ ID NO: 87455 - DNA, 25 bp, Homo sapien
tgaatagttttcttactttcaggga

SEQ ID NO: 87456 - DNA, 25 bp, Homo sapien
gttacttatgtaacattcatatttt

SEQ ID NO: 87457 - DNA, 25 bp, Homo sapien
tgatatttgtaacatactgtatgct

SEQ ID NO: 87458 - DNA, 25 bp, Homo sapien
aacatactgtatgctttctacttgt

SEQ ID NO: 87459 - DNA, 25 bp, Homo sapien
tactgtatgctttctacttgtaaat

SEQ ID NO: 87460 - DNA, 25 bp, Homo sapien
gaggacctggtctggatcggtcacc

SEQ ID NO: 87461 - DNA, 25 bp, Homo sapien
tctggatcggtcaccgctgggtgcc

SEQ ID NO: 87462 - DNA, 25 bp, Homo sapien
gcctgagctccgcatggagcctgca

SEQ ID NO: 87463 - DNA, 25 bp, Homo sapien
gcctgcagcctttgtttaacttata

SEQ ID NO: 87464 - DNA, 25 bp, Homo sapien
cagtcaagaagaacatgccccaagt

SEQ ID NO: 87465 - DNA, 25 bp, Homo sapien
catgccccaagttattcgtcagtga

SEQ ID NO: 87466 - DNA, 25 bp, Homo sapien
gttattcgtcagtgaggcggaaatt

SEQ ID NO: 87467 - DNA, 25 bp, Homo sapien
aattgtggtgtacttgttccagacc

SEQ ID NO: 87468 - DNA, 25 bp, Homo sapien
gtacttgttccagaccaactatgaa

SEQ ID NO: 87469 - DNA, 25 bp, Homo sapien
aactatgaagataggatgcccatcc

SEQ ID NO: 87470 - DNA, 25 bp, Homo sapien
taggatgcccatccagaagaacggg

SEQ ID NO: 87471 - DNA, 25 bp, Homo sapien
gttggcattctaagttaataaacac

SEQ ID NO: 87472 - DNA, 25 bp, Homo sapien
ggatccctgggagtgttcgagaagc

SEQ ID NO: 87473 - DNA, 25 bp, Homo sapien
tgttcgagaagcaccgagaaggctt

SEQ ID NO: 87474 - DNA, 25 bp, Homo sapien
aagcaccgagaaggcttctgtggct

SEQ ID NO: 87475 - DNA, 25 bp, Homo sapien
ttctgtggctggagccggccagctg

SEQ ID NO: 87476 - DNA, 25 bp, Homo sapien
agagccaagggaggctttaagccca

SEQ ID NO: 87477 - DNA, 25 bp, Homo sapien
gggtctgaaaacgaaaagcactcac

SEQ ID NO: 87478 - DNA, 25 bp, Homo sapien
agcactcacagtccttgaacattgg

SEQ ID NO: 87479 - DNA, 25 bp, Homo sapien
actcacagtccttgaacattggaaa

SEQ ID NO: 87480 - DNA, 25 bp, Homo sapien
acagtccttgaacattggaaagaga

SEQ ID NO: 87481 - DNA, 25 bp, Homo sapien
gaatttttgaagagtagcccttctt

SEQ ID NO: 87482 - DNA, 25 bp, Homo sapien
cctggcagactgtggctagaacggt

SEQ ID NO: 87483 - DNA, 25 bp, Homo sapien
gatcagagcagtgggtcacgtgacc

SEQ ID NO: 87484 - DNA, 25 bp, Homo sapien
agggcaatccgtgtgctcagatttc

SEQ ID NO: 87485 - DNA, 25 bp, Homo sapien
aattacagagcgagctgccaacctg

SEQ ID NO: 87486 - DNA, 25 bp, Homo sapien
gccaacctgctgtgctgagactgtg

SEQ ID NO: 87487 - DNA, 25 bp, Homo sapien
gagactgtggcctggtcttggtcct

SEQ ID NO: 87488 - DNA, 25 bp, Homo sapien
cttggtcctggtgtcctagggctga

SEQ ID NO: 87489 - DNA, 25 bp, Homo sapien
gtcctagggctgatgactgaccaca

SEQ ID NO: 87490 - DNA, 25 bp, Homo sapien
atgactgaccacagcctttgtgctt

SEQ ID NO: 87491 - DNA, 25 bp, Homo sapien
tgcttttgaagcctatttgactata

SEQ ID NO: 87492 - DNA, 25 bp, Homo sapien
ttgactatagtccttgtgtgcaact

SEQ ID NO: 87493 - DNA, 25 bp, Homo sapien
tctgtgttcaaaggcttgatggcag

SEQ ID NO: 87494 - DNA, 25 bp, Homo sapien
gatgggagccaattgctccaggaga

SEQ ID NO: 87495 - DNA, 25 bp, Homo sapien
gccaattgctccaggagatttactc

SEQ ID NO: 87496 - DNA, 25 bp, Homo sapien
ttactcccagttccttttcgtgcct

SEQ ID NO: 87497 - DNA, 25 bp, Homo sapien
ttcgtgcctgaacgttgtcacataa

SEQ ID NO: 87498 - DNA, 25 bp, Homo sapien
acgttgtcacataaaccccaaggca

SEQ ID NO: 87499 - DNA, 25 bp, Homo sapien
accccaaggcagcacgtccaaaatg

SEQ ID NO: 87500 - DNA, 25 bp, Homo sapien
aaaatgctgtaaaaccatcttccca

SEQ ID NO: 87501 - DNA, 25 bp, Homo sapien
gtgagtccccagttccgtccatgta

SEQ ID NO: 87502 - DNA, 25 bp, Homo sapien
ccatagcattggattctcggaggat

SEQ ID NO: 87503 - DNA, 25 bp, Homo sapien
ttctcggaggattttttgtctgttt

SEQ ID NO: 87504 - DNA, 25 bp, Homo sapien
atccccacctcagcgtgaggataat

SEQ ID NO: 87505 - DNA, 25 bp, Homo sapien
gaggataattgatttccagctgcaa

SEQ ID NO: 87506 - DNA, 25 bp, Homo sapien
ctgcaataagccgtgcctcattata

SEQ ID NO: 87507 - DNA, 25 bp, Homo sapien
gtgcctcattatagccacactgtgg

SEQ ID NO: 87508 - DNA, 25 bp, Homo sapien
ccacactgtggctagattatacttc

SEQ ID NO: 87509 - DNA, 25 bp, Homo sapien
gattatacttctttgggtgctgtgc

SEQ ID NO: 87510 - DNA, 25 bp, Homo sapien
tgggtgctgtgctaagaatgtcaat

SEQ ID NO: 87511 - DNA, 25 bp, Homo sapien
tggaaaaagccgatctcagattttg

SEQ ID NO: 87512 - DNA, 25 bp, Homo sapien
tgaagttaacatgcctgacacagac

SEQ ID NO: 87513 - DNA, 25 bp, Homo sapien
ataaaatactgccttctgcctttgg

SEQ ID NO: 87514 - DNA, 25 bp, Homo sapien
ttctgcctttgggaccatgattaaa

SEQ ID NO: 87515 - DNA, 25 bp, Homo sapien
agccgggaccctcacggaagatgac

SEQ ID NO: 87516 - DNA, 25 bp, Homo sapien
gccgggaccctcacggaagatgacc

SEQ ID NO: 87517 - DNA, 25 bp, Homo sapien
cctcacggaagatgaccttgtacag

SEQ ID NO: 87518 - DNA, 25 bp, Homo sapien
ctcacggaagatgaccttgtacaga

SEQ ID NO: 87519 - DNA, 25 bp, Homo sapien
tcacggaagatgaccttgtacagaa

SEQ ID NO: 87520 - DNA, 25 bp, Homo sapien
ccgtgtcagccgtgcttgatcctgg

SEQ ID NO: 87521 - DNA, 25 bp, Homo sapien
cgtgtcagccgtgcttgatcctggg

SEQ ID NO: 87522 - DNA, 25 bp, Homo sapien
gccgtgcttgatcctgggacccacg

SEQ ID NO: 87523 - DNA, 25 bp, Homo sapien
cgtgcttgatcctgggacccacgag

SEQ ID NO: 87524 - DNA, 25 bp, Homo sapien
gtgcttgatcctgggacccacgagc

SEQ ID NO: 87525 - DNA, 25 bp, Homo sapien
ttgatcctgggacccacgagcccca

SEQ ID NO: 87526 - DNA, 25 bp, Homo sapien
tggtccagctggactgcgagccctg

SEQ ID NO: 87527 - DNA, 25 bp, Homo sapien
acgaacctgtgggaccctagccagg

SEQ ID NO: 87528 - DNA, 25 bp, Homo sapien
ggccccacggacagcaggacccgga

SEQ ID NO: 87529 - DNA, 25 bp, Homo sapien
tgggacctggcctcaaactcaccaa

SEQ ID NO: 87530 - DNA, 25 bp, Homo sapien
ggacctggcctcaaactcaccaaat

SEQ ID NO: 87531 - DNA, 25 bp, Homo sapien
ctcaaactcaccaaatcgctcatgg

SEQ ID NO: 87532 - DNA, 25 bp, Homo sapien
aaactcaccaaatcgctcatggttt

SEQ ID NO: 87533 - DNA, 25 bp, Homo sapien
ctcaccaaatcgctcatggttttta

SEQ ID NO: 87534 - DNA, 25 bp, Homo sapien
gaaagtcctatttttccaagcttgg

SEQ ID NO: 87535 - DNA, 25 bp, Homo sapien
agtcctatttttccaagcttgggcg

SEQ ID NO: 87536 - DNA, 25 bp, Homo sapien
tcctatttttccaagcttgggcgaa

SEQ ID NO: 87537 - DNA, 25 bp, Homo sapien
ccctcttggaaatactccgatgatg

SEQ ID NO: 87538 - DNA, 25 bp, Homo sapien
aatactccgatgatgaaccagagca

SEQ ID NO: 87539 - DNA, 25 bp, Homo sapien
aacatagggatgtccgctgctggga

SEQ ID NO: 87540 - DNA, 25 bp, Homo sapien
ctgggatgggcttgacaggcacaat

SEQ ID NO: 87541 - DNA, 25 bp, Homo sapien
gcacaatgggaatgggcatgcccaa

SEQ ID NO: 87542 - DNA, 25 bp, Homo sapien
atgggcatgcccaacatagccatga

SEQ ID NO: 87543 - DNA, 25 bp, Homo sapien
atgcccaacatagccatgacttctg

SEQ ID NO: 87544 - DNA, 25 bp, Homo sapien
gcaaatttcgccaattttagcaaat

SEQ ID NO: 87545 - DNA, 25 bp, Homo sapien
atgaagaatttttagctgtgcagat

SEQ ID NO: 87546 - DNA, 25 bp, Homo sapien
ttagctgtgcagataggtgatgttg

SEQ ID NO: 87547 - DNA, 25 bp, Homo sapien
ggaaaatgctaatcaactacccttt

SEQ ID NO: 87548 - DNA, 25 bp, Homo sapien
aggaacactggagcctgcaataagg

SEQ ID NO: 87549 - DNA, 25 bp, Homo sapien
gaacactggagcctgcaataaggga

SEQ ID NO: 87550 - DNA, 25 bp, Homo sapien
acactggagcctgcaataagggagg

SEQ ID NO: 87551 - DNA, 25 bp, Homo sapien
tttggactaaagaatatattgggcg

SEQ ID NO: 87552 - DNA, 25 bp, Homo sapien
tggactaaagaatatattgggcgaa

SEQ ID NO: 87553 - DNA, 25 bp, Homo sapien
gactaaagaatatattgggcgaaga

SEQ ID NO: 87554 - DNA, 25 bp, Homo sapien
ctaaagaatatattgggcgaagaat

SEQ ID NO: 87555 - DNA, 25 bp, Homo sapien
aatatattgggcgaagaatagaggg

SEQ ID NO: 87556 - DNA, 25 bp, Homo sapien
agggggagcttgcaggaaccagcaa

SEQ ID NO: 87557 - DNA, 25 bp, Homo sapien
aaaccagagttagaactgttggata

SEQ ID NO: 87558 - DNA, 25 bp, Homo sapien
aaacagcagctccactaccgacccc

SEQ ID NO: 87559 - DNA, 25 bp, Homo sapien
gggagttcacccctcaaatcctggg

SEQ ID NO: 87560 - DNA, 25 bp, Homo sapien
ctccgaaggcccagggaacatacct

SEQ ID NO: 87561 - DNA, 25 bp, Homo sapien
ccaaccaactgagaagctgctccct

SEQ ID NO: 87562 - DNA, 25 bp, Homo sapien
cagcgccaggtgctcttgccttttc

SEQ ID NO: 87563 - DNA, 25 bp, Homo sapien
cttttcccactgagagaaggctgct

SEQ ID NO: 87564 - DNA, 25 bp, Homo sapien
ttcccactgagagaaggctgctctt

SEQ ID NO: 87565 - DNA, 25 bp, Homo sapien
cccactgagagaaggctgctctttt

SEQ ID NO: 87566 - DNA, 25 bp, Homo sapien
ctgagagaaggctgctcttttgtac

SEQ ID NO: 87567 - DNA, 25 bp, Homo sapien
gagaaggctgctcttttgtactgcc

SEQ ID NO: 87568 - DNA, 25 bp, Homo sapien
agaaggctgctcttttgtactgccc

SEQ ID NO: 87569 - DNA, 25 bp, Homo sapien
gaaggctgctcttttgtactgcccc

SEQ ID NO: 87570 - DNA, 25 bp, Homo sapien
ttaagtgggcactgaaaggtaggcc

SEQ ID NO: 87571 - DNA, 25 bp, Homo sapien
taagtgggcactgaaaggtaggcca

SEQ ID NO: 87572 - DNA, 25 bp, Homo sapien
aagtgggcactgaaaggtaggccag

SEQ ID NO: 87573 - DNA, 25 bp, Homo sapien
agtgggcactgaaaggtaggccagg

SEQ ID NO: 87574 - DNA, 25 bp, Homo sapien
gtgggcactgaaaggtaggccaggc

SEQ ID NO: 87575 - DNA, 25 bp, Homo sapien
tgggcactgaaaggtaggccaggca

SEQ ID NO: 87576 - DNA, 25 bp, Homo sapien
gggcactgaaaggtaggccaggcat

SEQ ID NO: 87577 - DNA, 25 bp, Homo sapien
ggcactgaaaggtaggccaggcatg

SEQ ID NO: 87578 - DNA, 25 bp, Homo sapien
gcactgaaaggtaggccaggcatgg

SEQ ID NO: 87579 - DNA, 25 bp, Homo sapien
ttgcagtgagtggaggttgtaccac

SEQ ID NO: 87580 - DNA, 25 bp, Homo sapien
tgagtggaggttgtaccactgcact

SEQ ID NO: 87581 - DNA, 25 bp, Homo sapien
gatccagagcgcacagggagtgcac

SEQ ID NO: 87582 - DNA, 25 bp, Homo sapien
gggagtgcacatatccaggcaccag

SEQ ID NO: 87583 - DNA, 25 bp, Homo sapien
tatccaggcaccaggactagggctg

SEQ ID NO: 87584 - DNA, 25 bp, Homo sapien
tcaattaccttctattggtctccct

SEQ ID NO: 87585 - DNA, 25 bp, Homo sapien
tcccttctctacactcttgtaataa

SEQ ID NO: 87586 - DNA, 25 bp, Homo sapien
gtacacaacaatccttctattctag

SEQ ID NO: 87587 - DNA, 25 bp, Homo sapien
tctattctagcctgcattgagcttg

SEQ ID NO: 87588 - DNA, 25 bp, Homo sapien
gcattgagcttgcatgcttgcataa

SEQ ID NO: 87589 - DNA, 25 bp, Homo sapien
gcttgcatgcttgcataagagctta

SEQ ID NO: 87590 - DNA, 25 bp, Homo sapien
taagagcttaagaaccattgattta

SEQ ID NO: 87591 - DNA, 25 bp, Homo sapien
acccaggtatccaaaaatgtgtaag

SEQ ID NO: 87592 - DNA, 25 bp, Homo sapien
agagacgagagggactcctgctcct

SEQ ID NO: 87593 - DNA, 25 bp, Homo sapien
ttcctggtgcagatgtgctggccta

SEQ ID NO: 87594 - DNA, 25 bp, Homo sapien
atgtgctggcctaggagttagaagc

SEQ ID NO: 87595 - DNA, 25 bp, Homo sapien
gttagaagcatcaccgagttccagc

SEQ ID NO: 87596 - DNA, 25 bp, Homo sapien
atcaccgagttccagctgcttctgc

SEQ ID NO: 87597 - DNA, 25 bp, Homo sapien
ctgtgcacactcctttagtacagtg

SEQ ID NO: 87598 - DNA, 25 bp, Homo sapien
cagtgttgaaaactcccttgcttct

SEQ ID NO: 87599 - DNA, 25 bp, Homo sapien
ttgaaaactcccttgcttctgtatt

SEQ ID NO: 87600 - DNA, 25 bp, Homo sapien
ttgcttctgtattccctgttggaaa

SEQ ID NO: 87601 - DNA, 25 bp, Homo sapien
atagggattatgacacctgtctacc

SEQ ID NO: 87602 - DNA, 25 bp, Homo sapien
cctgtctacccctgtcagggaaaat

SEQ ID NO: 87603 - DNA, 25 bp, Homo sapien
ctcttggtctcctgagtgtacccag

SEQ ID NO: 87604 - DNA, 25 bp, Homo sapien
tttgccccacgtctggctgtgacct

SEQ ID NO: 87605 - DNA, 25 bp, Homo sapien
acgtctggctgtgacctcggtgaaa

SEQ ID NO: 87606 - DNA, 25 bp, Homo sapien
gctgtgacctcggtgaaagccgaca

SEQ ID NO: 87607 - DNA, 25 bp, Homo sapien
gacctcggtgaaagccgacaggaga

SEQ ID NO: 87608 - DNA, 25 bp, Homo sapien
atgggaccctcctcctcagtagtgg

SEQ ID NO: 87609 - DNA, 25 bp, Homo sapien
agtagtggctgccagtccctcgttg

SEQ ID NO: 87610 - DNA, 25 bp, Homo sapien
ggctgccagtccctcgttgcaggac

SEQ ID NO: 87611 - DNA, 25 bp, Homo sapien
ttgcaggacagggtcatcataacca

SEQ ID NO: 87612 - DNA, 25 bp, Homo sapien
ggacagggtcatcataaccataaat

SEQ ID NO: 87613 - DNA, 25 bp, Homo sapien
gtcatcataaccataaataaccctt

SEQ ID NO: 87614 - DNA, 25 bp, Homo sapien
gtgctgcaagggctcctgccccatt

SEQ ID NO: 87615 - DNA, 25 bp, Homo sapien
cttccctctccttgtctcatgttga

SEQ ID NO: 87616 - DNA, 25 bp, Homo sapien
tgtctcatgttgaccggagggtagg

SEQ ID NO: 87617 - DNA, 25 bp, Homo sapien
tggtcttcctggtaggttttgtaca

SEQ ID NO: 87618 - DNA, 25 bp, Homo sapien
tcctggtaggttttgtacacatatt

SEQ ID NO: 87619 - DNA, 25 bp, Homo sapien
catattttgctactgtgtggatcca

SEQ ID NO: 87620 - DNA, 25 bp, Homo sapien
attttgctactgtgtggatccattt

SEQ ID NO: 87621 - DNA, 25 bp, Homo sapien
tttattgtggagtgtatacaacagg

SEQ ID NO: 87622 - DNA, 25 bp, Homo sapien
gtgaagaagccagaaggctcctggg

SEQ ID NO: 87623 - DNA, 25 bp, Homo sapien
ccccagtggtacctcaggacccagg

SEQ ID NO: 87624 - DNA, 25 bp, Homo sapien
acccagggctgcagacacaggctgg

SEQ ID NO: 87625 - DNA, 25 bp, Homo sapien
catttctaccagcttatgcttgtcc

SEQ ID NO: 87626 - DNA, 25 bp, Homo sapien
taccagcttatgcttgtccacgatt

SEQ ID NO: 87627 - DNA, 25 bp, Homo sapien
agcttatgcttgtccacgattttta

SEQ ID NO: 87628 - DNA, 25 bp, Homo sapien
gcttgtccacgatttttaagaattc

SEQ ID NO: 87629 - DNA, 25 bp, Homo sapien
actattgaagcatcagttggtggaa

SEQ ID NO: 87630 - DNA, 25 bp, Homo sapien
tcagttggtggaagatggatttaat

SEQ ID NO: 87631 - DNA, 25 bp, Homo sapien
atttctgaaccactttacttcatgg

SEQ ID NO: 87632 - DNA, 25 bp, Homo sapien
accactttacttcatggataacttg

SEQ ID NO: 87633 - DNA, 25 bp, Homo sapien
aaagtcttatgttctactgaccagg

SEQ ID NO: 87634 - DNA, 25 bp, Homo sapien
tatgttctactgaccagggaacttt

SEQ ID NO: 87635 - DNA, 25 bp, Homo sapien
gaccagggaactttatgatcaaata

SEQ ID NO: 87636 - DNA, 25 bp, Homo sapien
gcttcggtggagacagttatggaat

SEQ ID NO: 87637 - DNA, 25 bp, Homo sapien
cacacgactattatgttggccttga

SEQ ID NO: 87638 - DNA, 25 bp, Homo sapien
gactattatgttggccttgaacggg

SEQ ID NO: 87639 - DNA, 25 bp, Homo sapien
agtttgtctcccttgttcctctgtg

SEQ ID NO: 87640 - DNA, 25 bp, Homo sapien
ggtaggtcccccagcaagaaagagg

SEQ ID NO: 87641 - DNA, 25 bp, Homo sapien
agaaagagggacaggagcaccccag

SEQ ID NO: 87642 - DNA, 25 bp, Homo sapien
aggagcaccccaggcaggaccaagg

SEQ ID NO: 87643 - DNA, 25 bp, Homo sapien
caaggagtcgggaggcccctgcctt

SEQ ID NO: 87644 - DNA, 25 bp, Homo sapien
gtgagggcacagatgtctccccaga

SEQ ID NO: 87645 - DNA, 25 bp, Homo sapien
gcccagcgctggcagaatggattct

SEQ ID NO: 87646 - DNA, 25 bp, Homo sapien
aatggattctgctcctggctttgct

SEQ ID NO: 87647 - DNA, 25 bp, Homo sapien
ggtggtgaatctttccagagcagct

SEQ ID NO: 87648 - DNA, 25 bp, Homo sapien
gtgaatctttccagagcagctgaaa

SEQ ID NO: 87649 - DNA, 25 bp, Homo sapien
gaaaatctcagcatggagacagtaa

SEQ ID NO: 87650 - DNA, 25 bp, Homo sapien
ataagactctgccaccgtgtcacac

SEQ ID NO: 87651 - DNA, 25 bp, Homo sapien
gtcacactagcataggaggctgcac

SEQ ID NO: 87652 - DNA, 25 bp, Homo sapien
ggaggctgcacgttcatttgttgtt

SEQ ID NO: 87653 - DNA, 25 bp, Homo sapien
ttgccaacctccgttctatttatgt

SEQ ID NO: 87654 - DNA, 25 bp, Homo sapien
acctccgttctatttatgtgcaagc

SEQ ID NO: 87655 - DNA, 25 bp, Homo sapien
tatgtgcaagcagtttggattcaag

SEQ ID NO: 87656 - DNA, 25 bp, Homo sapien
caagttcttgtatctgtctgttctg

SEQ ID NO: 87657 - DNA, 25 bp, Homo sapien
gtatctgtctgttctgggacctggg

SEQ ID NO: 87658 - DNA, 25 bp, Homo sapien
gccacacgactattatgttggcctt

SEQ ID NO: 87659 - DNA, 25 bp, Homo sapien
cacacgactattatgttggccttga

SEQ ID NO: 87660 - DNA, 25 bp, Homo sapien
acacgactattatgttggccttgaa

SEQ ID NO: 87661 - DNA, 25 bp, Homo sapien
cacgactattatgttggccttgaac

SEQ ID NO: 87662 - DNA, 25 bp, Homo sapien
acgactattatgttggccttgaacg

SEQ ID NO: 87663 - DNA, 25 bp, Homo sapien
gactattatgttggccttgaacggg

SEQ ID NO: 87664 - DNA, 25 bp, Homo sapien
atgttggccttgaacggggactgca

SEQ ID NO: 87665 - DNA, 25 bp, Homo sapien
aacggggactgcagagccctcagtt

SEQ ID NO: 87666 - DNA, 25 bp, Homo sapien
ctcagtttgtctcccttgttcctct

SEQ ID NO: 87667 - DNA, 25 bp, Homo sapien
agtttgtctcccttgttcctctgtg

SEQ ID NO: 87668 - DNA, 25 bp, Homo sapien
ttgtctcccttgttcctctgtggct

SEQ ID NO: 87669 - DNA, 25 bp, Homo sapien
agggctccccaactataggcctggg

SEQ ID NO: 87670 - DNA, 25 bp, Homo sapien
ggctgctcgtacgagtgtagacact

SEQ ID NO: 87671 - DNA, 25 bp, Homo sapien
gtacgagtgtagacactgggcccat

SEQ ID NO: 87672 - DNA, 25 bp, Homo sapien
agtgtagacactgggcccattggac

SEQ ID NO: 87673 - DNA, 25 bp, Homo sapien
agacactgggcccattggacgtgct

SEQ ID NO: 87674 - DNA, 25 bp, Homo sapien
tgggcccattggacgtgctgttaac

SEQ ID NO: 87675 - DNA, 25 bp, Homo sapien
ggcccattggacgtgctgttaacta

SEQ ID NO: 87676 - DNA, 25 bp, Homo sapien
ccattggacgtgctgttaactacta

SEQ ID NO: 87677 - DNA, 25 bp, Homo sapien
ggacgtgctgttaactactatcttc

SEQ ID NO: 87678 - DNA, 25 bp, Homo sapien
gtgctgttaactactatcttcattt

SEQ ID NO: 87679 - DNA, 25 bp, Homo sapien
tgttaactactatcttcatttccca

SEQ ID NO: 87680 - DNA, 25 bp, Homo sapien
aaaagactcgtgtctcaggcagact

SEQ ID NO: 87681 - DNA, 25 bp, Homo sapien
caggcagactcttactctggttact

SEQ ID NO: 87682 - DNA, 25 bp, Homo sapien
ctctggttactaagatcatctgtgc

SEQ ID NO: 87683 - DNA, 25 bp, Homo sapien
gaggagtcgtgaatggttctcacca

SEQ ID NO: 87684 - DNA, 25 bp, Homo sapien
gaatggttctcaccaggacctgaat

SEQ ID NO: 87685 - DNA, 25 bp, Homo sapien
accaggacctgaatcgttgcttgtg

SEQ ID NO: 87686 - DNA, 25 bp, Homo sapien
aggacctgaatcgttgcttgtgttt

SEQ ID NO: 87687 - DNA, 25 bp, Homo sapien
gcttgtgtttgagaattggaggaat

SEQ ID NO: 87688 - DNA, 25 bp, Homo sapien
gaatgagtcagcaggcgtggctcat

SEQ ID NO: 87689 - DNA, 25 bp, Homo sapien
agtcagcaggcgtggctcatggccc

SEQ ID NO: 87690 - DNA, 25 bp, Homo sapien
gtgcaggatcaattgtaggaggaaa

SEQ ID NO: 87691 - DNA, 25 bp, Homo sapien
tcatggatttcatcctactactgtt

SEQ ID NO: 87692 - DNA, 25 bp, Homo sapien
cctactactgtttgcaagatcccta

SEQ ID NO: 87693 - DNA, 25 bp, Homo sapien
aagatccctagtgggtgtagtctga

SEQ ID NO: 87694 - DNA, 25 bp, Homo sapien
tttgctcagttattggcacagtctg

SEQ ID NO: 87695 - DNA, 25 bp, Homo sapien
gcacagtctgtgaaccatggatttg

SEQ ID NO: 87696 - DNA, 25 bp, Homo sapien
gagacagtctatgagcttacaaaaa

SEQ ID NO: 87697 - DNA, 25 bp, Homo sapien
tgtgtactatacgtatgagctttgt

SEQ ID NO: 87698 - DNA, 25 bp, Homo sapien
agcagaataccaccgccaggatgtt

SEQ ID NO: 87699 - DNA, 25 bp, Homo sapien
ataccaccgccaggatgttactagc

SEQ ID NO: 87700 - DNA, 25 bp, Homo sapien
gattgagatacatctgcacggcccc

SEQ ID NO: 87701 - DNA, 25 bp, Homo sapien
gttcttactcaaatgggttcacctc

SEQ ID NO: 87702 - DNA, 25 bp, Homo sapien
agcttagacacctccaagaaccagg

SEQ ID NO: 87703 - DNA, 25 bp, Homo sapien
gccccgctgatgcaagatggcagat

SEQ ID NO: 87704 - DNA, 25 bp, Homo sapien
tgatacccattagagccccgagaat

SEQ ID NO: 87705 - DNA, 25 bp, Homo sapien
agccccgagaattcctcttctggat

SEQ ID NO: 87706 - DNA, 25 bp, Homo sapien
ttctggatcccagtttgcagcaaac

SEQ ID NO: 87707 - DNA, 25 bp, Homo sapien
aagcaaacagtgtcccttctggctg

SEQ ID NO: 87708 - DNA, 25 bp, Homo sapien
ttctggctgtgttggagcctcccca

SEQ ID NO: 87709 - DNA, 25 bp, Homo sapien
ttacctctttcccaaacctggagca

SEQ ID NO: 87710 - DNA, 25 bp, Homo sapien
gagcatttatgcctaggcttgtcaa

SEQ ID NO: 87711 - DNA, 25 bp, Homo sapien
tgtcaagaatctgttcagtccctct

SEQ ID NO: 87712 - DNA, 25 bp, Homo sapien
agtccctctccttctcaataaaagc

SEQ ID NO: 87713 - DNA, 25 bp, Homo sapien
gtagctggaatgtgcctatgtgacc

SEQ ID NO: 87714 - DNA, 25 bp, Homo sapien
tatgtgaccagctcacttgcagaca

SEQ ID NO: 87715 - DNA, 25 bp, Homo sapien
cttgcagacaccctgccggaagcag

SEQ ID NO: 87716 - DNA, 25 bp, Homo sapien
agcagagcttaatcttcctaggact

SEQ ID NO: 87717 - DNA, 25 bp, Homo sapien
aggactgaggtcttagcacatgtac

SEQ ID NO: 87718 - DNA, 25 bp, Homo sapien
agcacatgtactggtggagtttcca

SEQ ID NO: 87719 - DNA, 25 bp, Homo sapien
ggagtttccagaccaccagtatgaa

SEQ ID NO: 87720 - DNA, 25 bp, Homo sapien
aaagaactgtgagcctcagatcttt

SEQ ID NO: 87721 - DNA, 25 bp, Homo sapien
gcctcagatctttggacctttccaa

SEQ ID NO: 87722 - DNA, 25 bp, Homo sapien
ggacctttccaatgcgtctctttct

SEQ ID NO: 87723 - DNA, 25 bp, Homo sapien
tctttctcctgttattgctgcaatg

SEQ ID NO: 87724 - DNA, 25 bp, Homo sapien
tatgcatggtagcatttttgcttgc

SEQ ID NO: 87725 - DNA, 25 bp, Homo sapien
tgcatggtagcatttttgcttgctg

SEQ ID NO: 87726 - DNA, 25 bp, Homo sapien
gaaaaagaggtttcagttggctgat

SEQ ID NO: 87727 - DNA, 25 bp, Homo sapien
aagaggtttcagttggctgatagaa

SEQ ID NO: 87728 - DNA, 25 bp, Homo sapien
cagttggctgatagaatatctttta

SEQ ID NO: 87729 - DNA, 25 bp, Homo sapien
gaatatcttttatgtaggacaaaac

SEQ ID NO: 87730 - DNA, 25 bp, Homo sapien
acttttctgtgaagagtgttgaggg

SEQ ID NO: 87731 - DNA, 25 bp, Homo sapien
aaaatgggtttgtatgctgtttaat

SEQ ID NO: 87732 - DNA, 25 bp, Homo sapien
atgggtttgtatgctgtttaatgtg

SEQ ID NO: 87733 - DNA, 25 bp, Homo sapien
gtatgctgtttaatgtgcactgaac

SEQ ID NO: 87734 - DNA, 25 bp, Homo sapien
gctgtttaatgtgcactgaacattt

SEQ ID NO: 87735 - DNA, 25 bp, Homo sapien
taactatatcacagaaaatgggatt

SEQ ID NO: 87736 - DNA, 25 bp, Homo sapien
aactatatcacagaaaatgggattg

SEQ ID NO: 87737 - DNA, 25 bp, Homo sapien
actatatcacagaaaatgggattga

SEQ ID NO: 87738 - DNA, 25 bp, Homo sapien
ctatatcacagaaaatgggattgag

SEQ ID NO: 87739 - DNA, 25 bp, Homo sapien
atatcacagaaaatgggattgagtt

SEQ ID NO: 87740 - DNA, 25 bp, Homo sapien
tatcacagaaaatgggattgagtta

SEQ ID NO: 87741 - DNA, 25 bp, Homo sapien
atcacagaaaatgggattgagttaa

SEQ ID NO: 87742 - DNA, 25 bp, Homo sapien
cacagaaaatgggattgagttaaaa

SEQ ID NO: 87743 - DNA, 25 bp, Homo sapien
cagaaaatgggattgagttaaaact

SEQ ID NO: 87744 - DNA, 25 bp, Homo sapien
gaaaatgggattgagttaaaactat

SEQ ID NO: 87745 - DNA, 25 bp, Homo sapien
ttatatttctaaacattttatgatg

SEQ ID NO: 87746 - DNA, 25 bp, Homo sapien
catgggtagcccacgccgtcctttc

SEQ ID NO: 87747 - DNA, 25 bp, Homo sapien
tgtggtttcaggactgcaaggactc

SEQ ID NO: 87748 - DNA, 25 bp, Homo sapien
tggtttcaggactgcaaggactcca

SEQ ID NO: 87749 - DNA, 25 bp, Homo sapien
gtttcaggactgcaaggactccagt

SEQ ID NO: 87750 - DNA, 25 bp, Homo sapien
ttcaggactgcaaggactccagtgt

SEQ ID NO: 87751 - DNA, 25 bp, Homo sapien
aggactgcaaggactccagtgtgaa

SEQ ID NO: 87752 - DNA, 25 bp, Homo sapien
tgcaaggactccagtgtgaactcag

SEQ ID NO: 87753 - DNA, 25 bp, Homo sapien
gcaaggactccagtgtgaactcagg

SEQ ID NO: 87754 - DNA, 25 bp, Homo sapien
tccccaacagggtactaggactgca

SEQ ID NO: 87755 - DNA, 25 bp, Homo sapien
aacagggtactaggactgcagcccc

SEQ ID NO: 87756 - DNA, 25 bp, Homo sapien
gtactaggactgcagccccctgtag

SEQ ID NO: 87757 - DNA, 25 bp, Homo sapien
atccccaatgttggtgctgcctccg

SEQ ID NO: 87758 - DNA, 25 bp, Homo sapien
tgggcctagggcacaaggagtccca

SEQ ID NO: 87759 - DNA, 25 bp, Homo sapien
aggagtcccagccacattcgggtga

SEQ ID NO: 87760 - DNA, 25 bp, Homo sapien
agccacattcgggtgagcgtcctgg

SEQ ID NO: 87761 - DNA, 25 bp, Homo sapien
acattcgggtgagcgtcctggcctg

SEQ ID NO: 87762 - DNA, 25 bp, Homo sapien
cactcttgggccctggttttgttat

SEQ ID NO: 87763 - DNA, 25 bp, Homo sapien
tcttgggccctggttttgttatgat

SEQ ID NO: 87764 - DNA, 25 bp, Homo sapien
ttttgttatgatttggatgccccgc

SEQ ID NO: 87765 - DNA, 25 bp, Homo sapien
ttatgatttggatgccccgctctca

SEQ ID NO: 87766 - DNA, 25 bp, Homo sapien
tggatgccccgctctcagttgagag

SEQ ID NO: 87767 - DNA, 25 bp, Homo sapien
aacctgacatgttggtgcttggaaa

SEQ ID NO: 87768 - DNA, 25 bp, Homo sapien
tgagtttcttggctgcatgaaggtt

SEQ ID NO: 87769 - DNA, 25 bp, Homo sapien
gagtttcttggctgcatgaaggttt

SEQ ID NO: 87770 - DNA, 25 bp, Homo sapien
gtttcttggctgcatgaaggttttc

SEQ ID NO: 87771 - DNA, 25 bp, Homo sapien
ttcttggctgcatgaaggttttctt

SEQ ID NO: 87772 - DNA, 25 bp, Homo sapien
gaatcagaattgtagccagtttctt

SEQ ID NO: 87773 - DNA, 25 bp, Homo sapien
atcagaattgtagccagtttctttg

SEQ ID NO: 87774 - DNA, 25 bp, Homo sapien
gaattgtagccagtttctttggcca

SEQ ID NO: 87775 - DNA, 25 bp, Homo sapien
aattgtagccagtttctttggccag

SEQ ID NO: 87776 - DNA, 25 bp, Homo sapien
attgtagccagtttctttggccaga

SEQ ID NO: 87777 - DNA, 25 bp, Homo sapien
ttgtagccagtttctttggccagaa

SEQ ID NO: 87778 - DNA, 25 bp, Homo sapien
gtagccagtttctttggccagaagg

SEQ ID NO: 87779 - DNA, 25 bp, Homo sapien
acagcaactgatcaaagggagtcca

SEQ ID NO: 87780 - DNA, 25 bp, Homo sapien
aagggagtccagtcaacgtgagcaa

SEQ ID NO: 87781 - DNA, 25 bp, Homo sapien
ccagtcaacgtgagcaagcgtgatt

SEQ ID NO: 87782 - DNA, 25 bp, Homo sapien
agcgtgattatgatgaggaagcccc

SEQ ID NO: 87783 - DNA, 25 bp, Homo sapien
ctgctttaatccacacaaggaacgt

SEQ ID NO: 87784 - DNA, 25 bp, Homo sapien
gttaaccaatctgctgtgtctacta

SEQ ID NO: 87785 - DNA, 25 bp, Homo sapien
tgtctactatgctgtttccttgttc

SEQ ID NO: 87786 - DNA, 25 bp, Homo sapien
cctgctagtgctgctttacaaatgc

SEQ ID NO: 87787 - DNA, 25 bp, Homo sapien
gctttacaaatgcagaccattctat

SEQ ID NO: 87788 - DNA, 25 bp, Homo sapien
tattttgtaggctggatgctaccca

SEQ ID NO: 87789 - DNA, 25 bp, Homo sapien
gatgctacccagttcatgaatcgct

SEQ ID NO: 87790 - DNA, 25 bp, Homo sapien
tccccaatgctgaccctaggatttt

SEQ ID NO: 87791 - DNA, 25 bp, Homo sapien
aatgctgaccctaggattttccttc

SEQ ID NO: 87792 - DNA, 25 bp, Homo sapien
tgaccctaggattttccttccctgc

SEQ ID NO: 87793 - DNA, 25 bp, Homo sapien
ctgccctcacctgcaaatgagttaa

SEQ ID NO: 87794 - DNA, 25 bp, Homo sapien
aaggcaggatggaactcggcctcat

SEQ ID NO: 87795 - DNA, 25 bp, Homo sapien
atggaactcggcctcatccccgagg

SEQ ID NO: 87796 - DNA, 25 bp, Homo sapien
cgaggccccagttcctatatcgggc

SEQ ID NO: 87797 - DNA, 25 bp, Homo sapien
agccaccatgttacactggactcta

SEQ ID NO: 87798 - DNA, 25 bp, Homo sapien
accatgttacactggactctaagcc

SEQ ID NO: 87799 - DNA, 25 bp, Homo sapien
gttacactggactctaagccacttc

SEQ ID NO: 87800 - DNA, 25 bp, Homo sapien
taagccacttcttactccagtagta

SEQ ID NO: 87801 - DNA, 25 bp, Homo sapien
tgaggccgccaagagcaactctgca

SEQ ID NO: 87802 - DNA, 25 bp, Homo sapien
caagagcaactctgcagggtctgct

SEQ ID NO: 87803 - DNA, 25 bp, Homo sapien
tgcagggtctgctccaagaggcaga

SEQ ID NO: 87804 - DNA, 25 bp, Homo sapien
cccaccgtccttggcaaaatggaga

SEQ ID NO: 87805 - DNA, 25 bp, Homo sapien
attggtctgagggttccatgaggca

SEQ ID NO: 87806 - DNA, 25 bp, Homo sapien
accctcccctgcagaagtcaggaag

SEQ ID NO: 87807 - DNA, 25 bp, Homo sapien
gaaggtctttgagcttgttctgaga

SEQ ID NO: 87808 - DNA, 25 bp, Homo sapien
gcttgttctgagaggaaaacccatt

SEQ ID NO: 87809 - DNA, 25 bp, Homo sapien
gaaaacccattctctgggtagagga

SEQ ID NO: 87810 - DNA, 25 bp, Homo sapien
gggttcgctttgtgtgatactgata

SEQ ID NO: 87811 - DNA, 25 bp, Homo sapien
atactgatatggttactgaaaggct

SEQ ID NO: 87812 - DNA, 25 bp, Homo sapien
tggtcccagcctggattggcctcat

SEQ ID NO: 87813 - DNA, 25 bp, Homo sapien
ggattggcctcatccaggatctttg

SEQ ID NO: 87814 - DNA, 25 bp, Homo sapien
tggcctcatccaggatctttggtca

SEQ ID NO: 87815 - DNA, 25 bp, Homo sapien
tcatccaggatctttggtcacccca

SEQ ID NO: 87816 - DNA, 25 bp, Homo sapien
aggatctttggtcaccccacgctgc

SEQ ID NO: 87817 - DNA, 25 bp, Homo sapien
atcttgcctgctgttccagttctgg

SEQ ID NO: 87818 - DNA, 25 bp, Homo sapien
gttccagttctggtcaagggccttg

SEQ ID NO: 87819 - DNA, 25 bp, Homo sapien
aggccttctagagcagcaccagtct

SEQ ID NO: 87820 - DNA, 25 bp, Homo sapien
gggcatcacagagctgatggtccaa

SEQ ID NO: 87821 - DNA, 25 bp, Homo sapien
atcacagagctgatggtccaataag

SEQ ID NO: 87822 - DNA, 25 bp, Homo sapien
cccgcacctgccttggatgttttca

SEQ ID NO: 87823 - DNA, 25 bp, Homo sapien
gtacacatacccctgcccaatttat

SEQ ID NO: 87824 - DNA, 25 bp, Homo sapien
atacccctgcccaatttatatagct

SEQ ID NO: 87825 - DNA, 25 bp, Homo sapien
cccctgcccaatttatatagctctt

SEQ ID NO: 87826 - DNA, 25 bp, Homo sapien
gcccaatttatatagctctttgtgg

SEQ ID NO: 87827 - DNA, 25 bp, Homo sapien
atagctctttgtggagataattagg

SEQ ID NO: 87828 - DNA, 25 bp, Homo sapien
gcagtttgaaggagtaagcctggtt

SEQ ID NO: 87829 - DNA, 25 bp, Homo sapien
gaaggagtaagcctggttttatact

SEQ ID NO: 87830 - DNA, 25 bp, Homo sapien
tgacagtttattttctacacttccc

SEQ ID NO: 87831 - DNA, 25 bp, Homo sapien
tttgtatcacctttgctatcttggg

SEQ ID NO: 87832 - DNA, 25 bp, Homo sapien
agtgcaaaggacaaacatctcaatt

SEQ ID NO: 87833 - DNA, 25 bp, Homo sapien
caaacatctcaattgtatgaaggga

SEQ ID NO: 87834 - DNA, 25 bp, Homo sapien
tacaaggattggtctaggtgcccgg

SEQ ID NO: 87835 - DNA, 25 bp, Homo sapien
acaaggattggtctaggtgcccggg

SEQ ID NO: 87836 - DNA, 25 bp, Homo sapien
caaggattggtctaggtgcccgggc

SEQ ID NO: 87837 - DNA, 25 bp, Homo sapien
aaggattggtctaggtgcccgggcg

SEQ ID NO: 87838 - DNA, 25 bp, Homo sapien
aggattggtctaggtgcccgggcgc

SEQ ID NO: 87839 - DNA, 25 bp, Homo sapien
ggattggtctaggtgcccgggcgcg

SEQ ID NO: 87840 - DNA, 25 bp, Homo sapien
gattggtctaggtgcccgggcgcgg

SEQ ID NO: 87841 - DNA, 25 bp, Homo sapien
attggtctaggtgcccgggcgcggt

SEQ ID NO: 87842 - DNA, 25 bp, Homo sapien
ttggtctaggtgcccgggcgcggtg

SEQ ID NO: 87843 - DNA, 25 bp, Homo sapien
tggtctaggtgcccgggcgcggtgg

SEQ ID NO: 87844 - DNA, 25 bp, Homo sapien
ggtctaggtgcccgggcgcggtggc

SEQ ID NO: 87845 - DNA, 25 bp, Homo sapien
tccgtaaaagcgtgtaacaagggtg

SEQ ID NO: 87846 - DNA, 25 bp, Homo sapien
tttttatacctgttgtgagacccga

SEQ ID NO: 87847 - DNA, 25 bp, Homo sapien
ttatacctgttgtgagacccgaggg

SEQ ID NO: 87848 - DNA, 25 bp, Homo sapien
gcggcgcggttttttatggtgacac

SEQ ID NO: 87849 - DNA, 25 bp, Homo sapien
ggcgcggttttttatggtgacacaa

SEQ ID NO: 87850 - DNA, 25 bp, Homo sapien
gcggttttttatggtgacacaaatg

SEQ ID NO: 87851 - DNA, 25 bp, Homo sapien
tttgctaacagcaattccaggctca

SEQ ID NO: 87852 - DNA, 25 bp, Homo sapien
tgccttacccgatggcttgtgacgc

SEQ ID NO: 87853 - DNA, 25 bp, Homo sapien
tacccgatggcttgtgacgcggaga

SEQ ID NO: 87854 - DNA, 25 bp, Homo sapien
gcttgtgacgcggagagaaccgatt

SEQ ID NO: 87855 - DNA, 25 bp, Homo sapien
tgacgcggagagaaccgattaaaac

SEQ ID NO: 87856 - DNA, 25 bp, Homo sapien
acagatgtgtcattttctcctgact

SEQ ID NO: 87857 - DNA, 25 bp, Homo sapien
ctcctgacttttaaactgtaaacat

SEQ ID NO: 87858 - DNA, 25 bp, Homo sapien
aaaccatcaataacactggcaacct

SEQ ID NO: 87859 - DNA, 25 bp, Homo sapien
tggcaacctaacacttttacctaag

SEQ ID NO: 87860 - DNA, 25 bp, Homo sapien
ttttacctaagagctacccattttg

SEQ ID NO: 87861 - DNA, 25 bp, Homo sapien
taagagctacccattttgatttatc

SEQ ID NO: 87862 - DNA, 25 bp, Homo sapien
atctgatgcgcagttttcattgctg

SEQ ID NO: 87863 - DNA, 25 bp, Homo sapien
tgctctgccgggtctgtggcgaccc

SEQ ID NO: 87864 - DNA, 25 bp, Homo sapien
tgccttttcagcctaatcaccagag

SEQ ID NO: 87865 - DNA, 25 bp, Homo sapien
agcctaatcaccagagaagccacag

SEQ ID NO: 87866 - DNA, 25 bp, Homo sapien
aagaacaggctgattttgtacagat

SEQ ID NO: 87867 - DNA, 25 bp, Homo sapien
aggaactgtctttctggttcaatag

SEQ ID NO: 87868 - DNA, 25 bp, Homo sapien
tttctggttcaatagactgccccga

SEQ ID NO: 87869 - DNA, 25 bp, Homo sapien
tggttcaatagactgccccgacagt

SEQ ID NO: 87870 - DNA, 25 bp, Homo sapien
tagactgccccgacagtctacaagc

SEQ ID NO: 87871 - DNA, 25 bp, Homo sapien
gggcagctttaacctgggcatgttt

SEQ ID NO: 87872 - DNA, 25 bp, Homo sapien
ccaggaggtggctctggctcagagc

SEQ ID NO: 87873 - DNA, 25 bp, Homo sapien
ctcagagccgtcagtgtggctgaat

SEQ ID NO: 87874 - DNA, 25 bp, Homo sapien
tcagtgtggctgaataaaggctctc

SEQ ID NO: 87875 - DNA, 25 bp, Homo sapien
atcagggcccccttcaaaaagcctg

SEQ ID NO: 87876 - DNA, 25 bp, Homo sapien
aaaaagcctgctggagacacaatat

SEQ ID NO: 87877 - DNA, 25 bp, Homo sapien
gcctgctggagacacaatatcaaaa

SEQ ID NO: 87878 - DNA, 25 bp, Homo sapien
gcagggaagtcctgttccagaagta

SEQ ID NO: 87879 - DNA, 25 bp, Homo sapien
gttccagaagtaccaggctgtagat

SEQ ID NO: 87880 - DNA, 25 bp, Homo sapien
tgcagtagaccgaaaccatccaaaa

SEQ ID NO: 87881 - DNA, 25 bp, Homo sapien
tccaaaacctgtttagcttcttcct

SEQ ID NO: 87882 - DNA, 25 bp, Homo sapien
ttagcttcttcctccattggagttt

SEQ ID NO: 87883 - DNA, 25 bp, Homo sapien
agccagccattgtctccagtacttg

SEQ ID NO: 87884 - DNA, 25 bp, Homo sapien
tacttgcctcattctcatcatccaa

SEQ ID NO: 87885 - DNA, 25 bp, Homo sapien
tgaacatttgtatcccaagcagaaa

SEQ ID NO: 87886 - DNA, 25 bp, Homo sapien
gactgcactgcgtatacatgttgaa

SEQ ID NO: 87887 - DNA, 25 bp, Homo sapien
gaattcttcatttttgccatcttta

SEQ ID NO: 87888 - DNA, 25 bp, Homo sapien
gccatctttaactgtcatcactggg

SEQ ID NO: 87889 - DNA, 25 bp, Homo sapien
accaggctgttgaggacctgccaga

SEQ ID NO: 87890 - DNA, 25 bp, Homo sapien
tgcccgcagggagttctatctctca

SEQ ID NO: 87891 - DNA, 25 bp, Homo sapien
cagggagttctatctctcagactct

SEQ ID NO: 87892 - DNA, 25 bp, Homo sapien
tctcagactctgacttccaagatat

SEQ ID NO: 87893 - DNA, 25 bp, Homo sapien
gactctgacttccaagatatctttg

SEQ ID NO: 87894 - DNA, 25 bp, Homo sapien
aaatccaaggaggaattctacagca

SEQ ID NO: 87895 - DNA, 25 bp, Homo sapien
tacagcatggccacgtggaggcagc

SEQ ID NO: 87896 - DNA, 25 bp, Homo sapien
ttccactcccctcagaggcttttgg

SEQ ID NO: 87897 - DNA, 25 bp, Homo sapien
agaggcttttggtcatcctctgcgt

SEQ ID NO: 87898 - DNA, 25 bp, Homo sapien
tggtcatcctctgcgtgtcagtaaa

SEQ ID NO: 87899 - DNA, 25 bp, Homo sapien
gtgtcagtaaaagcaggcagcccat

SEQ ID NO: 87900 - DNA, 25 bp, Homo sapien
gtattcaagcagaggaattccctaa

SEQ ID NO: 87901 - DNA, 25 bp, Homo sapien
aagcagaggaattccctaacactga

SEQ ID NO: 87902 - DNA, 25 bp, Homo sapien
cagaggaattccctaacactgaccc

SEQ ID NO: 87903 - DNA, 25 bp, Homo sapien
taatattcaggctgttttatatgcc

SEQ ID NO: 87904 - DNA, 25 bp, Homo sapien
tcaggctgttttatatgcctaaatt

SEQ ID NO: 87905 - DNA, 25 bp, Homo sapien
gtttaaattcacataaggcaatgag

SEQ ID NO: 87906 - DNA, 25 bp, Homo sapien
aggcaatgagatatggaaagatgac

SEQ ID NO: 87907 - DNA, 25 bp, Homo sapien
aaattattctaatgcaaatcttgta

SEQ ID NO: 87908 - DNA, 25 bp, Homo sapien
gcaaatcttgtataaagaacccatg

SEQ ID NO: 87909 - DNA, 25 bp, Homo sapien
gtataaagaacccatgatgttttgt

SEQ ID NO: 87910 - DNA, 25 bp, Homo sapien
catgatgttttgtaactttctaatt

SEQ ID NO: 87911 - DNA, 25 bp, Homo sapien
tgcctcggccttgcgcctgtgtagg

SEQ ID NO: 87912 - DNA, 25 bp, Homo sapien
cagctcggcctctggtcgccttggg

SEQ ID NO: 87913 - DNA, 25 bp, Homo sapien
aaaagtcggacaggaaacatctggt

SEQ ID NO: 87914 - DNA, 25 bp, Homo sapien
aacatctggtgctattatctgggac

SEQ ID NO: 87915 - DNA, 25 bp, Homo sapien
tatctgggacttggcctgaccgtgg

SEQ ID NO: 87916 - DNA, 25 bp, Homo sapien
tctctggtttcggaggtctttgaac

SEQ ID NO: 87917 - DNA, 25 bp, Homo sapien
tcggaggtctttgaacccctctggg

SEQ ID NO: 87918 - DNA, 25 bp, Homo sapien
gggtggtcctggactgccgtcctca

SEQ ID NO: 87919 - DNA, 25 bp, Homo sapien
gactgccgtcctcagtgagaggtca

SEQ ID NO: 87920 - DNA, 25 bp, Homo sapien
ctcagtgagaggtcacaggtcagca

SEQ ID NO: 87921 - DNA, 25 bp, Homo sapien
gtcacaggtcagcaaaaacagtcaa

SEQ ID NO: 87922 - DNA, 25 bp, Homo sapien
agcactcctttcctggttgcagata

SEQ ID NO: 87923 - DNA, 25 bp, Homo sapien
ttcctggttgcagataacgaactaa

SEQ ID NO: 87924 - DNA, 25 bp, Homo sapien
aaagggcagatctgccctctccatg

SEQ ID NO: 87925 - DNA, 25 bp, Homo sapien
tccatgtcttcgtcctggcaaacag

SEQ ID NO: 87926 - DNA, 25 bp, Homo sapien
aattatgcgctaattctgtatggga

SEQ ID NO: 87927 - DNA, 25 bp, Homo sapien
aattctgtatgggagcactcaaaag

SEQ ID NO: 87928 - DNA, 25 bp, Homo sapien
gggagcactcaaaaggcattactta

SEQ ID NO: 87929 - DNA, 25 bp, Homo sapien
gattgaaatttcaaactatctctag

SEQ ID NO: 87930 - DNA, 25 bp, Homo sapien
actatctctagtttttcaatggaaa

SEQ ID NO: 87931 - DNA, 25 bp, Homo sapien
gaaatatatcagctagggaaaaacc

SEQ ID NO: 87932 - DNA, 25 bp, Homo sapien
gggaaaaaccatcaagctcattatt

SEQ ID NO: 87933 - DNA, 25 bp, Homo sapien
tatacatgagtaatagcttcctaaa

SEQ ID NO: 87934 - DNA, 25 bp, Homo sapien
gagtaatagcttcctaaagtttata

SEQ ID NO: 87935 - DNA, 25 bp, Homo sapien
taggttacataaagattaccaagta

SEQ ID NO: 87936 - DNA, 25 bp, Homo sapien
gattaccaagtaagactcaaaattg

SEQ ID NO: 87937 - DNA, 25 bp, Homo sapien
gaaaaatccaactgaaaataacact

SEQ ID NO: 87938 - DNA, 25 bp, Homo sapien
gaatgtccattttggtatttggtta

SEQ ID NO: 87939 - DNA, 25 bp, Homo sapien
ggtatttggttacattatcatattt

SEQ ID NO: 87940 - DNA, 25 bp, Homo sapien
acattatcatatttactagtcacta

SEQ ID NO: 87941 - DNA, 25 bp, Homo sapien
tactagtcactatcagcacaattag

SEQ ID NO: 87942 - DNA, 25 bp, Homo sapien
gtcactatcagcacaattaggttaa

SEQ ID NO: 87943 - DNA, 25 bp, Homo sapien
taggttaataaagaagtgggtcatt

SEQ ID NO: 87944 - DNA, 25 bp, Homo sapien
gatcgaagcaattgaagtatcatgg

SEQ ID NO: 87945 - DNA, 25 bp, Homo sapien
gtatcatggattggattgttactga

SEQ ID NO: 87946 - DNA, 25 bp, Homo sapien
ggattggattgttactgatttcagt

SEQ ID NO: 87947 - DNA, 25 bp, Homo sapien
gatttcagtaaagtatgttttgcca

SEQ ID NO: 87948 - DNA, 25 bp, Homo sapien
cagtaaagtatgttttgccaattag

SEQ ID NO: 87949 - DNA, 25 bp, Homo sapien
gttttgccaattagatacatatata

SEQ ID NO: 87950 - DNA, 25 bp, Homo sapien
aaaatactgcttcattgggctgatt

SEQ ID NO: 87951 - DNA, 25 bp, Homo sapien
tatgtccacagaatgagagtcatat

SEQ ID NO: 87952 - DNA, 25 bp, Homo sapien
gagagtcatatgttgttatattcta

SEQ ID NO: 87953 - DNA, 25 bp, Homo sapien
cattaaatattcatgtcaccttgag

SEQ ID NO: 87954 - DNA, 25 bp, Homo sapien
atattcatgtcaccttgagttgtca

SEQ ID NO: 87955 - DNA, 25 bp, Homo sapien
ccagtgtttggccagacattaaggt

SEQ ID NO: 87956 - DNA, 25 bp, Homo sapien
aaggtgtcgtgagagtccctttcat

SEQ ID NO: 87957 - DNA, 25 bp, Homo sapien
gagagtccctttcatgcctttctta

SEQ ID NO: 87958 - DNA, 25 bp, Homo sapien
aagcaagggtctttgatgggcacgt

SEQ ID NO: 87959 - DNA, 25 bp, Homo sapien
gatgggcacgtgtttacagcgctgc

SEQ ID NO: 87960 - DNA, 25 bp, Homo sapien
ttacagcgctgctgcatagtcttgt

SEQ ID NO: 87961 - DNA, 25 bp, Homo sapien
gtcacatcaactgaaggtcaatact

SEQ ID NO: 87962 - DNA, 25 bp, Homo sapien
tactaagagccacaggttgtacctg

SEQ ID NO: 87963 - DNA, 25 bp, Homo sapien
gggcgtgtggtttcctgttgtctca

SEQ ID NO: 87964 - DNA, 25 bp, Homo sapien
tgtctcacctttaattgtcaacctc

SEQ ID NO: 87965 - DNA, 25 bp, Homo sapien
ttgtcaacctccagtgttgactcta

SEQ ID NO: 87966 - DNA, 25 bp, Homo sapien
tcggtttctcgcctgtcatcatcga

SEQ ID NO: 87967 - DNA, 25 bp, Homo sapien
tcatcgacagacatgtcagccgcta

SEQ ID NO: 87968 - DNA, 25 bp, Homo sapien
atgtcagccgctacctgctggcctt

SEQ ID NO: 87969 - DNA, 25 bp, Homo sapien
ggccttcctggcagatgacctaggg

SEQ ID NO: 87970 - DNA, 25 bp, Homo sapien
tgccactcaaccaaagagtcctcga

SEQ ID NO: 87971 - DNA, 25 bp, Homo sapien
tcaaccaaagagtcctcgagccggc

SEQ ID NO: 87972 - DNA, 25 bp, Homo sapien
aaagagtcctcgagccggcctgcca

SEQ ID NO: 87973 - DNA, 25 bp, Homo sapien
gactgctgcttctttttctaaatgc

SEQ ID NO: 87974 - DNA, 25 bp, Homo sapien
aaacacaccttcaccttacaaggtg

SEQ ID NO: 87975 - DNA, 25 bp, Homo sapien
accttacaaggtgctgaccatatta

SEQ ID NO: 87976 - DNA, 25 bp, Homo sapien
acaaggtgctgaccatattaaatgt

SEQ ID NO: 87977 - DNA, 25 bp, Homo sapien
aaatctatcatgagtctggtagaaa

SEQ ID NO: 87978 - DNA, 25 bp, Homo sapien
ctatcatgagtctggtagaaaagta

SEQ ID NO: 87979 - DNA, 25 bp, Homo sapien
atactgtttattgttctaatgtaca

SEQ ID NO: 87980 - DNA, 25 bp, Homo sapien
gttctaatgtacaactaactatttg

SEQ ID NO: 87981 - DNA, 25 bp, Homo sapien
aaatgtgtatgtgtccttgtaaatg

SEQ ID NO: 87982 - DNA, 25 bp, Homo sapien
ttctatcaagcaagaatgccacgta

SEQ ID NO: 87983 - DNA, 25 bp, Homo sapien
aagcaagaatgccacgtactcagag

SEQ ID NO: 87984 - DNA, 25 bp, Homo sapien
gcaagaatgccacgtactcagagta

SEQ ID NO: 87985 - DNA, 25 bp, Homo sapien
caagaatgccacgtactcagagtat

SEQ ID NO: 87986 - DNA, 25 bp, Homo sapien
agaatgccacgtactcagagtataa

SEQ ID NO: 87987 - DNA, 25 bp, Homo sapien
atgccacgtactcagagtataacaa

SEQ ID NO: 87988 - DNA, 25 bp, Homo sapien
aagccttagctaaactttgatgagt

SEQ ID NO: 87989 - DNA, 25 bp, Homo sapien
ggtcttaccgagaattcagctgcca

SEQ ID NO: 87990 - DNA, 25 bp, Homo sapien
tgccaaaaccctcctctgagtgttc

SEQ ID NO: 87991 - DNA, 25 bp, Homo sapien
ctgagtgttcctcttataagggcac

SEQ ID NO: 87992 - DNA, 25 bp, Homo sapien
taagggcacttagcactaggacctc

SEQ ID NO: 87993 - DNA, 25 bp, Homo sapien
gcactaggacctcccaaggtattgt

SEQ ID NO: 87994 - DNA, 25 bp, Homo sapien
aagccttatcagaactttttgtagt

SEQ ID NO: 87995 - DNA, 25 bp, Homo sapien
tgaagccttaagacacacaccataa

SEQ ID NO: 87996 - DNA, 25 bp, Homo sapien
agctgatctgtaaacccttacccct

SEQ ID NO: 87997 - DNA, 25 bp, Homo sapien
ttaccccttgctgttcagagagcta

SEQ ID NO: 87998 - DNA, 25 bp, Homo sapien
cagagagctactctttgtagtgttc

SEQ ID NO: 87999 - DNA, 25 bp, Homo sapien
tgaaggccccgtgcttgagctcggc

SEQ ID NO: 88000 - DNA, 25 bp, Homo sapien
aggccccgtgcttgagctcggcagt

SEQ ID NO: 88001 - DNA, 25 bp, Homo sapien
cgtgcttgagctcggcagtcctgct

SEQ ID NO: 88002 - DNA, 25 bp, Homo sapien
ttgagctcggcagtcctgctccttg

SEQ ID NO: 88003 - DNA, 25 bp, Homo sapien
ggcagtcctgctccttgcagtgaag

SEQ ID NO: 88004 - DNA, 25 bp, Homo sapien
tccttgcagtgaagccaccatgggt

SEQ ID NO: 88005 - DNA, 25 bp, Homo sapien
caccatgggtgaccgtccagcctca

SEQ ID NO: 88006 - DNA, 25 bp, Homo sapien
cctgcacagtgagggaagggcttca

SEQ ID NO: 88007 - DNA, 25 bp, Homo sapien
ggaagggcttcagggccatctgctc

SEQ ID NO: 88008 - DNA, 25 bp, Homo sapien
gggcttcagggccatctgctcccag

SEQ ID NO: 88009 - DNA, 25 bp, Homo sapien
ttcagggccatctgctcccagggca

SEQ ID NO: 88010 - DNA, 25 bp, Homo sapien
ttcaaagggactcatacaatttgag

SEQ ID NO: 88011 - DNA, 25 bp, Homo sapien
aagggactcatacaatttgagaaaa

SEQ ID NO: 88012 - DNA, 25 bp, Homo sapien
gaaaaaacagtcaacctgatttgag

SEQ ID NO: 88013 - DNA, 25 bp, Homo sapien
aacagtcaacctgatttgagaaatt

SEQ ID NO: 88014 - DNA, 25 bp, Homo sapien
atttgagaaattaaccagtatggct

SEQ ID NO: 88015 - DNA, 25 bp, Homo sapien
accagtatggctaactatatcacag

SEQ ID NO: 88016 - DNA, 25 bp, Homo sapien
aactatatcacagaaaatgggattg

SEQ ID NO: 88017 - DNA, 25 bp, Homo sapien
gaaaatgggattgagttaaaactat

SEQ ID NO: 88018 - DNA, 25 bp, Homo sapien
aatatacattttaaagcagttcttt

SEQ ID NO: 88019 - DNA, 25 bp, Homo sapien
ttatacacacacttcaagagccacc

SEQ ID NO: 88020 - DNA, 25 bp, Homo sapien
tatacacacacttcaagagccaccg

SEQ ID NO: 88021 - DNA, 25 bp, Homo sapien
gataatgtgatactgtctctttgaa

SEQ ID NO: 88022 - DNA, 25 bp, Homo sapien
tgtctctttgaagcaccctgtaaac

SEQ ID NO: 88023 - DNA, 25 bp, Homo sapien
gcaccctgtaaaccttttagagatt

SEQ ID NO: 88024 - DNA, 25 bp, Homo sapien
gagatttgaagttgggtcttgactc

SEQ ID NO: 88025 - DNA, 25 bp, Homo sapien
gggtcttgactcttaatgcatgtgg

SEQ ID NO: 88026 - DNA, 25 bp, Homo sapien
atgcatgtggacagtcgcgagcgtt

SEQ ID NO: 88027 - DNA, 25 bp, Homo sapien
agtcgcgagcgtttatgctgtcggt

SEQ ID NO: 88028 - DNA, 25 bp, Homo sapien
ttatgctgtcggtgtgtctgtgttg

SEQ ID NO: 88029 - DNA, 25 bp, Homo sapien
gtacattctacattccgttcatggg

SEQ ID NO: 88030 - DNA, 25 bp, Homo sapien
gactaagttgtaaacctatgcacat

SEQ ID NO: 88031 - DNA, 25 bp, Homo sapien
tgcacatcccttgcattttgggcaa

SEQ ID NO: 88032 - DNA, 25 bp, Homo sapien
ttcaaagggactcatacaatttgag

SEQ ID NO: 88033 - DNA, 25 bp, Homo sapien
aaagggactcatacaatttgagaaa

SEQ ID NO: 88034 - DNA, 25 bp, Homo sapien
agggactcatacaatttgagaaaaa

SEQ ID NO: 88035 - DNA, 25 bp, Homo sapien
gagaaaaaacagtcaacctgatttg

SEQ ID NO: 88036 - DNA, 25 bp, Homo sapien
gaaaaaacagtcaacctgatttgag

SEQ ID NO: 88037 - DNA, 25 bp, Homo sapien
aaaaacagtcaacctgatttgagaa

SEQ ID NO: 88038 - DNA, 25 bp, Homo sapien
aaacagtcaacctgatttgagaaat

SEQ ID NO: 88039 - DNA, 25 bp, Homo sapien
aacagtcaacctgatttgagaaatt

SEQ ID NO: 88040 - DNA, 25 bp, Homo sapien
acagtcaacctgatttgagaaatta

SEQ ID NO: 88041 - DNA, 25 bp, Homo sapien
aaccagtatggctaactatatcaca

SEQ ID NO: 88042 - DNA, 25 bp, Homo sapien
accagtatggctaactatatcacag

SEQ ID NO: 88043 - DNA, 25 bp, Homo sapien
agcccgtcgcagctttgacatcttg

SEQ ID NO: 88044 - DNA, 25 bp, Homo sapien
acatcttggtgtactcatgtcgctt

SEQ ID NO: 88045 - DNA, 25 bp, Homo sapien
actcatgtcgcttctccttgtgtta

SEQ ID NO: 88046 - DNA, 25 bp, Homo sapien
agtattaccatttgcccctcacctg

SEQ ID NO: 88047 - DNA, 25 bp, Homo sapien
ctgcccttggtgagccttttagtgc

SEQ ID NO: 88048 - DNA, 25 bp, Homo sapien
gtgagccttttagtgcaagacagat

SEQ ID NO: 88049 - DNA, 25 bp, Homo sapien
cccacctctgagtagttggaggtca

SEQ ID NO: 88050 - DNA, 25 bp, Homo sapien
ttattgcccttttctgcctctgaat

SEQ ID NO: 88051 - DNA, 25 bp, Homo sapien
tgcctctgaatgttcatctctcgtc

SEQ ID NO: 88052 - DNA, 25 bp, Homo sapien
gtcctcctttgtgcaggcgaggaag

SEQ ID NO: 88053 - DNA, 25 bp, Homo sapien
gggccgacactagtatgatgcagtg

SEQ ID NO: 88054 - DNA, 25 bp, Homo sapien
ttcgaggccctctccctcagtaaat

SEQ ID NO: 88055 - DNA, 25 bp, Homo sapien
gaggccctctccctcagtaaattca

SEQ ID NO: 88056 - DNA, 25 bp, Homo sapien
ctccctcagtaaattcacattttcc

SEQ ID NO: 88057 - DNA, 25 bp, Homo sapien
cctcagtaaattcacattttccttc

SEQ ID NO: 88058 - DNA, 25 bp, Homo sapien
acattttccttcctcctgttacatt

SEQ ID NO: 88059 - DNA, 25 bp, Homo sapien
gttacattttcccaatatcttttct

SEQ ID NO: 88060 - DNA, 25 bp, Homo sapien
tacattttcccaatatcttttctat

SEQ ID NO: 88061 - DNA, 25 bp, Homo sapien
ttcccaatatcttttctattccttg

SEQ ID NO: 88062 - DNA, 25 bp, Homo sapien
ttttctattccttggaccaatcaga

SEQ ID NO: 88063 - DNA, 25 bp, Homo sapien
ttctattccttggaccaatcagaga

SEQ ID NO: 88064 - DNA, 25 bp, Homo sapien
tattccttggaccaatcagagatgc

SEQ ID NO: 88065 - DNA, 25 bp, Homo sapien
gaagtggtataaggaagtacattct

SEQ ID NO: 88066 - DNA, 25 bp, Homo sapien
cagtaagccgagttcactccattgt

SEQ ID NO: 88067 - DNA, 25 bp, Homo sapien
agtaagccgagttcactccattgta

SEQ ID NO: 88068 - DNA, 25 bp, Homo sapien
gtaagccgagttcactccattgtac

SEQ ID NO: 88069 - DNA, 25 bp, Homo sapien
taagccgagttcactccattgtact

SEQ ID NO: 88070 - DNA, 25 bp, Homo sapien
aagccgagttcactccattgtactc

SEQ ID NO: 88071 - DNA, 25 bp, Homo sapien
gccgagttcactccattgtactcta

SEQ ID NO: 88072 - DNA, 25 bp, Homo sapien
ccgagttcactccattgtactctag

SEQ ID NO: 88073 - DNA, 25 bp, Homo sapien
cgagttcactccattgtactctagc

SEQ ID NO: 88074 - DNA, 25 bp, Homo sapien
ccagctgggcatttcacctgctgtc

SEQ ID NO: 88075 - DNA, 25 bp, Homo sapien
ggcagggccagacgctgtaccatca

SEQ ID NO: 88076 - DNA, 25 bp, Homo sapien
gggtccctgagctcatgtggtgccc

SEQ ID NO: 88077 - DNA, 25 bp, Homo sapien
ccctttccttgtctgagtggctgag

SEQ ID NO: 88078 - DNA, 25 bp, Homo sapien
ttccttgtctgagtggctgaggctg

SEQ ID NO: 88079 - DNA, 25 bp, Homo sapien
agtggctgaggctgatacccctgac

SEQ ID NO: 88080 - DNA, 25 bp, Homo sapien
ctgatacccctgacctatctgcagt

SEQ ID NO: 88081 - DNA, 25 bp, Homo sapien
ccccagcacacaaggaagaccagat

SEQ ID NO: 88082 - DNA, 25 bp, Homo sapien
gaccagatgtagctacaggatgatg

SEQ ID NO: 88083 - DNA, 25 bp, Homo sapien
catggtttcaaacgagttctttctt

SEQ ID NO: 88084 - DNA, 25 bp, Homo sapien
tcaaacgagttctttcttgttactt

SEQ ID NO: 88085 - DNA, 25 bp, Homo sapien
gccaataggctataaagagacattt

SEQ ID NO: 88086 - DNA, 25 bp, Homo sapien
aaagagacatttagcacttttttct

SEQ ID NO: 88087 - DNA, 25 bp, Homo sapien
gaagggtgctaaaagataatacgtt

SEQ ID NO: 88088 - DNA, 25 bp, Homo sapien
agataatacgtttatttattcacac

SEQ ID NO: 88089 - DNA, 25 bp, Homo sapien
acacttgaattgcatttgtgatcaa

SEQ ID NO: 88090 - DNA, 25 bp, Homo sapien
gaaagatgaaggaccaaaaggccaa

SEQ ID NO: 88091 - DNA, 25 bp, Homo sapien
cttgcggacttctctgcctggtttt

SEQ ID NO: 88092 - DNA, 25 bp, Homo sapien
gcctggttttgtgtgttctgttatt

SEQ ID NO: 88093 - DNA, 25 bp, Homo sapien
ttgtgtgttctgttattcaaacaat

SEQ ID NO: 88094 - DNA, 25 bp, Homo sapien
aagctggtggaacttactctttctt

SEQ ID NO: 88095 - DNA, 25 bp, Homo sapien
gctggtggaacttactctttctttt

SEQ ID NO: 88096 - DNA, 25 bp, Homo sapien
ccttttgaggccttcgaggagtgtc

SEQ ID NO: 88097 - DNA, 25 bp, Homo sapien
aggccttcgaggagtgtcttcgaca

SEQ ID NO: 88098 - DNA, 25 bp, Homo sapien
tgtcttcgacagaacgaggcagctg

SEQ ID NO: 88099 - DNA, 25 bp, Homo sapien
ctgtgggcaactgtgcagagcatat

SEQ ID NO: 88100 - DNA, 25 bp, Homo sapien
aactgtgcagagcatatgcgccgct

SEQ ID NO: 88101 - DNA, 25 bp, Homo sapien
tgcagagcatatgcgccgcttcctg

SEQ ID NO: 88102 - DNA, 25 bp, Homo sapien
gccgcttcctgcagtgcgctgagca

SEQ ID NO: 88103 - DNA, 25 bp, Homo sapien
gccacgctcacctgcaactgtggag

SEQ ID NO: 88104 - DNA, 25 bp, Homo sapien
tgaggactcctctgacggcaggaaa

SEQ ID NO: 88105 - DNA, 25 bp, Homo sapien
ctctgacggcaggaaaactggacat

SEQ ID NO: 88106 - DNA, 25 bp, Homo sapien
tgagccctggacatgggcccggctt

SEQ ID NO: 88107 - DNA, 25 bp, Homo sapien
aaatctatcatgagtctggtagaaa

SEQ ID NO: 88108 - DNA, 25 bp, Homo sapien
gtaaaagtaaaagctgcacacgtta

SEQ ID NO: 88109 - DNA, 25 bp, Homo sapien
atactgtttattgttctaatgtaca

SEQ ID NO: 88110 - DNA, 25 bp, Homo sapien
gttctaatgtacaactaactatttg

SEQ ID NO: 88111 - DNA, 25 bp, Homo sapien
atttcttgtgcgaactggtcattta

SEQ ID NO: 88112 - DNA, 25 bp, Homo sapien
aaatgtgtatgtgtccttgtaaatg

SEQ ID NO: 88113 - DNA, 25 bp, Homo sapien
ttctatcaagcaagaatgccacgta

SEQ ID NO: 88114 - DNA, 25 bp, Homo sapien
aagcaagaatgccacgtactcagag

SEQ ID NO: 88115 - DNA, 25 bp, Homo sapien
caagaatgccacgtactcagagtat

SEQ ID NO: 88116 - DNA, 25 bp, Homo sapien
agaatgccacgtactcagagtataa

SEQ ID NO: 88117 - DNA, 25 bp, Homo sapien
atgccacgtactcagagtataacaa

SEQ ID NO: 88118 - DNA, 25 bp, Homo sapien
aatatgtggcattacggtgttaaaa

SEQ ID NO: 88119 - DNA, 25 bp, Homo sapien
tgtcctaattcccaatttcagagtt

SEQ ID NO: 88120 - DNA, 25 bp, Homo sapien
tttcagagtttctccagacctccaa

SEQ ID NO: 88121 - DNA, 25 bp, Homo sapien
aatctgggctctgaccccataattg

SEQ ID NO: 88122 - DNA, 25 bp, Homo sapien
tgaccccataattgtgtgcagctga

SEQ ID NO: 88123 - DNA, 25 bp, Homo sapien
agctgagctgctgacaagtccacac

SEQ ID NO: 88124 - DNA, 25 bp, Homo sapien
aagtccacacatattctgaagtcac

SEQ ID NO: 88125 - DNA, 25 bp, Homo sapien
gggctccaaggactcacaaagagga

SEQ ID NO: 88126 - DNA, 25 bp, Homo sapien
ttttaatccctgcttgttccgtcaa

SEQ ID NO: 88127 - DNA, 25 bp, Homo sapien
ttgttccgtcaactagttcaccggt

SEQ ID NO: 88128 - DNA, 25 bp, Homo sapien
tagttcaccggttaaaccctgattg

SEQ ID NO: 88129 - DNA, 25 bp, Homo sapien
tgtttctctcctgacccagggttca

SEQ ID NO: 88130 - DNA, 25 bp, Homo sapien
tgtggtttcaggactgcaaggactc

SEQ ID NO: 88131 - DNA, 25 bp, Homo sapien
gtttcaggactgcaaggactccagt

SEQ ID NO: 88132 - DNA, 25 bp, Homo sapien
ttcaggactgcaaggactccagtgt

SEQ ID NO: 88133 - DNA, 25 bp, Homo sapien
aggactgcaaggactccagtgtgaa

SEQ ID NO: 88134 - DNA, 25 bp, Homo sapien
gcaaggactccagtgtgaactcagg

SEQ ID NO: 88135 - DNA, 25 bp, Homo sapien
tccccaacagggtactaggactgca

SEQ ID NO: 88136 - DNA, 25 bp, Homo sapien
aacagggtactaggactgcagcccc

SEQ ID NO: 88137 - DNA, 25 bp, Homo sapien
gtactaggactgcagccccctgtag

SEQ ID NO: 88138 - DNA, 25 bp, Homo sapien
tgtggacaccttgcactctgcctgg

SEQ ID NO: 88139 - DNA, 25 bp, Homo sapien
ttcccagagcccaaagagtaaaaat

SEQ ID NO: 88140 - DNA, 25 bp, Homo sapien
cgacagccctgtttcggtcaccaga

SEQ ID NO: 88141 - DNA, 25 bp, Homo sapien
tgtttcggtcaccagactctgaaca

SEQ ID NO: 88142 - DNA, 25 bp, Homo sapien
agactctgaacatgctacatcctgc

SEQ ID NO: 88143 - DNA, 25 bp, Homo sapien
tctgaacatgctacatcctgcccaa

SEQ ID NO: 88144 - DNA, 25 bp, Homo sapien
tgcccaagactgcacctctggaggt

SEQ ID NO: 88145 - DNA, 25 bp, Homo sapien
tgcagggcacccttgagaagcccct

SEQ ID NO: 88146 - DNA, 25 bp, Homo sapien
aggagtcccctccatgtacacacac

SEQ ID NO: 88147 - DNA, 25 bp, Homo sapien
gaaggaggtcctgggactccaagtt

SEQ ID NO: 88148 - DNA, 25 bp, Homo sapien
gactccaagttcagcgctccaggtc

SEQ ID NO: 88149 - DNA, 25 bp, Homo sapien
gacagggcctgcatgcagtcaggct

SEQ ID NO: 88150 - DNA, 25 bp, Homo sapien
cagtggcgcggtacagggagggaac

SEQ ID NO: 88151 - DNA, 25 bp, Homo sapien
agaagccctgttgctcactgacctg

SEQ ID NO: 88152 - DNA, 25 bp, Homo sapien
agccctgttgctcactgacctgtga

SEQ ID NO: 88153 - DNA, 25 bp, Homo sapien
gttgctcactgacctgtgaccaggt

SEQ ID NO: 88154 - DNA, 25 bp, Homo sapien
tcactgacctgtgaccaggtccaat

SEQ ID NO: 88155 - DNA, 25 bp, Homo sapien
gacctgtgaccaggtccaatgtggg

SEQ ID NO: 88156 - DNA, 25 bp, Homo sapien
aaggaggtagcagccctgggttctc

SEQ ID NO: 88157 - DNA, 25 bp, Homo sapien
aggtagcagccctgggttctcctca

SEQ ID NO: 88158 - DNA, 25 bp, Homo sapien
agcagccctgggttctcctcagtga

SEQ ID NO: 88159 - DNA, 25 bp, Homo sapien
agccctgggttctcctcagtgaggg

SEQ ID NO: 88160 - DNA, 25 bp, Homo sapien
tgggttctcctcagtgagggatccc

SEQ ID NO: 88161 - DNA, 25 bp, Homo sapien
gccctgcaccagcaccctgagatgg

SEQ ID NO: 88162 - DNA, 25 bp, Homo sapien
aggacgagtggatcaagtccatcca

SEQ ID NO: 88163 - DNA, 25 bp, Homo sapien
atcaagtccatccaggcggctgtga

SEQ ID NO: 88164 - DNA, 25 bp, Homo sapien
gcggctgtgagtgtggaccccttct

SEQ ID NO: 88165 - DNA, 25 bp, Homo sapien
agtgtggaccccttctatgagatgc

SEQ ID NO: 88166 - DNA, 25 bp, Homo sapien
cttctatgagatgctggcagcgaga

SEQ ID NO: 88167 - DNA, 25 bp, Homo sapien
ctggcagcgagaaagaagcggattt

SEQ ID NO: 88168 - DNA, 25 bp, Homo sapien
agaagcggatttcagtcaagaagaa

SEQ ID NO: 88169 - DNA, 25 bp, Homo sapien
ccattatttattacggagctgcccc

SEQ ID NO: 88170 - DNA, 25 bp, Homo sapien
ggaaaattcaccacctctagctcct

SEQ ID NO: 88171 - DNA, 25 bp, Homo sapien
gttctttgtaattaacacgctgttg

SEQ ID NO: 88172 - DNA, 25 bp, Homo sapien
aacacgctgttggtaatcttattaa

SEQ ID NO: 88173 - DNA, 25 bp, Homo sapien
ggaaaaatcagcttatggactttag

SEQ ID NO: 88174 - DNA, 25 bp, Homo sapien
agcttatggactttagcagttgctg

SEQ ID NO: 88175 - DNA, 25 bp, Homo sapien
gggtcatttgatcttcacttaatct

SEQ ID NO: 88176 - DNA, 25 bp, Homo sapien
cacttaatctaagtctgtgaattac

SEQ ID NO: 88177 - DNA, 25 bp, Homo sapien
ttattttgaaatactccttgcagta

SEQ ID NO: 88178 - DNA, 25 bp, Homo sapien
tactccttgcagtatattggcatga

SEQ ID NO: 88179 - DNA, 25 bp, Homo sapien
ggcatgatacagtaaaagcattttc

SEQ ID NO: 88180 - DNA, 25 bp, Homo sapien
agcattttccacagattgttatcac

SEQ ID NO: 88181 - DNA, 25 bp, Homo sapien
agattgttatcaccttctttaaaag

SEQ ID NO: 88182 - DNA, 25 bp, Homo sapien
acaatagcacgttgttggtgtcata

SEQ ID NO: 88183 - DNA, 25 bp, Homo sapien
ggtgtcatattcaataacatttcca

SEQ ID NO: 88184 - DNA, 25 bp, Homo sapien
gttttctattgaacacctatagaga

SEQ ID NO: 88185 - DNA, 25 bp, Homo sapien
gttttctattgaacacctattcaga

SEQ ID NO: 88186 - DNA, 25 bp, Homo sapien
cctggactgaattttctgagtctga

SEQ ID NO: 88187 - DNA, 25 bp, Homo sapien
cttccccagcccagacattgagaaa

SEQ ID NO: 88188 - DNA, 25 bp, Homo sapien
tccccagcccagacattgagaaact

SEQ ID NO: 88189 - DNA, 25 bp, Homo sapien
cccagcccagacattgagaaacttg

SEQ ID NO: 88190 - DNA, 25 bp, Homo sapien
cagacattgagaaacttgggaagaa

SEQ ID NO: 88191 - DNA, 25 bp, Homo sapien
gaagagagaaacctcaagctcccaa

SEQ ID NO: 88192 - DNA, 25 bp, Homo sapien
gagagaaacctcaagctcccaaaca

SEQ ID NO: 88193 - DNA, 25 bp, Homo sapien
agaaacctcaagctcccaaacagca

SEQ ID NO: 88194 - DNA, 25 bp, Homo sapien
caagctcccaaacagcacgttgcgg

SEQ ID NO: 88195 - DNA, 25 bp, Homo sapien
tgttcacggccttcgtcatcagcaa

SEQ ID NO: 88196 - DNA, 25 bp, Homo sapien
ccgcagaggaccattctggcttttg

SEQ ID NO: 88197 - DNA, 25 bp, Homo sapien
tctggcatcttcttcatactatcgg

SEQ ID NO: 88198 - DNA, 25 bp, Homo sapien
atcttcttcatactatcgggcctct

SEQ ID NO: 88199 - DNA, 25 bp, Homo sapien
ggtggtgggcttggttctttacatc

SEQ ID NO: 88200 - DNA, 25 bp, Homo sapien
gcttggttctttacatctccagcat

SEQ ID NO: 88201 - DNA, 25 bp, Homo sapien
ctccagcatcaacgacgaggtcatg

SEQ ID NO: 88202 - DNA, 25 bp, Homo sapien
gaggtcatgaacaggcccagcagct

SEQ ID NO: 88203 - DNA, 25 bp, Homo sapien
gagcagtattttcattatcgctacg

SEQ ID NO: 88204 - DNA, 25 bp, Homo sapien
tatcgctacgggtggtcttttgcct

SEQ ID NO: 88205 - DNA, 25 bp, Homo sapien
tcctactcaaagaggtgacgtccgt

SEQ ID NO: 88206 - DNA, 25 bp, Homo sapien
atgaggaaggatgacggtgcccacc

SEQ ID NO: 88207 - DNA, 25 bp, Homo sapien
ccaagctggcactcacgggtgggca

SEQ ID NO: 88208 - DNA, 25 bp, Homo sapien
ccaagtgcacttgaagccggaatgc

SEQ ID NO: 88209 - DNA, 25 bp, Homo sapien
gaagccggaatgcaagacatccgat

SEQ ID NO: 88210 - DNA, 25 bp, Homo sapien
gacatccgatggtatacttactcga

SEQ ID NO: 88211 - DNA, 25 bp, Homo sapien
tggtatacttactcgaacccgtcct

SEQ ID NO: 88212 - DNA, 25 bp, Homo sapien
aacagccgcgggatccgctttcttt

SEQ ID NO: 88213 - DNA, 25 bp, Homo sapien
gatccgctttctttggctgactgct

SEQ ID NO: 88214 - DNA, 25 bp, Homo sapien
tcccttttcctgtgaccccattaga

SEQ ID NO: 88215 - DNA, 25 bp, Homo sapien
ctgtgaccccattagacgccatggg

SEQ ID NO: 88216 - DNA, 25 bp, Homo sapien
gctttttacccttgagctgttgaaa

SEQ ID NO: 88217 - DNA, 25 bp, Homo sapien
gggatcgtggttgaccctctgtttg

SEQ ID NO: 88218 - DNA, 25 bp, Homo sapien
tcgtggttgaccctctgtttgtact

SEQ ID NO: 88219 - DNA, 25 bp, Homo sapien
tggttgaccctctgtttgtactgga

SEQ ID NO: 88220 - DNA, 25 bp, Homo sapien
ttgaccctctgtttgtactggacaa

SEQ ID NO: 88221 - DNA, 25 bp, Homo sapien
tgaccctctgtttgtactggacaac

SEQ ID NO: 88222 - DNA, 25 bp, Homo sapien
accctctgtttgtactggacaaccg

SEQ ID NO: 88223 - DNA, 25 bp, Homo sapien
tgtttgtactggacaaccgggccca

SEQ ID NO: 88224 - DNA, 25 bp, Homo sapien
tgtactggacaaccgggcccagtcc

SEQ ID NO: 88225 - DNA, 25 bp, Homo sapien
ctgacggcagaaatgtaccaggctg

SEQ ID NO: 88226 - DNA, 25 bp, Homo sapien
acggcagaaatgtaccaggctgtgt

SEQ ID NO: 88227 - DNA, 25 bp, Homo sapien
tggaggctctgatcacctggccaac

SEQ ID NO: 88228 - DNA, 25 bp, Homo sapien
atcattcctctctgtagatgctagg

SEQ ID NO: 88229 - DNA, 25 bp, Homo sapien
ctctctgtagatgctaggatatata

SEQ ID NO: 88230 - DNA, 25 bp, Homo sapien
aatgtcagtgtttctatgattgtaa

SEQ ID NO: 88231 - DNA, 25 bp, Homo sapien
ttttcctattaaagtacagatctaa

SEQ ID NO: 88232 - DNA, 25 bp, Homo sapien
gtattattaagttgatagccctcta

SEQ ID NO: 88233 - DNA, 25 bp, Homo sapien
aagttgatagccctctagtcagtta

SEQ ID NO: 88234 - DNA, 25 bp, Homo sapien
gatagccctctagtcagttatattg

SEQ ID NO: 88235 - DNA, 25 bp, Homo sapien
gccctctagtcagttatattgctat

SEQ ID NO: 88236 - DNA, 25 bp, Homo sapien
ctattgtaaattcttgtttgttgag

SEQ ID NO: 88237 - DNA, 25 bp, Homo sapien
aaatactatatgtatctcatgtaca

SEQ ID NO: 88238 - DNA, 25 bp, Homo sapien
gtatctcatgtacaaagttgacata

SEQ ID NO: 88239 - DNA, 25 bp, Homo sapien
tatttgaaaattctccagaaggaat

SEQ ID NO: 88240 - DNA, 25 bp, Homo sapien
gatatgtaggttcgtcagttgttaa

SEQ ID NO: 88241 - DNA, 25 bp, Homo sapien
cagttgttaacaaatgtatccctct

SEQ ID NO: 88242 - DNA, 25 bp, Homo sapien
gaggtgtatgggacatctctgtacc

SEQ ID NO: 88243 - DNA, 25 bp, Homo sapien
tatgggacatctctgtaccttctaa

SEQ ID NO: 88244 - DNA, 25 bp, Homo sapien
gacatctctgtaccttctaatcaat

SEQ ID NO: 88245 - DNA, 25 bp, Homo sapien
taccttctaatcaattttgctatga

SEQ ID NO: 88246 - DNA, 25 bp, Homo sapien
gtaaagataggctaatttctgaaat

SEQ ID NO: 88247 - DNA, 25 bp, Homo sapien
gccgagaggaaattgctagtttatt

SEQ ID NO: 88248 - DNA, 25 bp, Homo sapien
attgctagtttattcctggtagagg

SEQ ID NO: 88249 - DNA, 25 bp, Homo sapien
cctggtagaggaatttctgtatttg

SEQ ID NO: 88250 - DNA, 25 bp, Homo sapien
tgagtgcagccccacacgactgagc

SEQ ID NO: 88251 - DNA, 25 bp, Homo sapien
acatgagggccacctctggaacctt

SEQ ID NO: 88252 - DNA, 25 bp, Homo sapien
tgagggccacctctggaaccttctt

SEQ ID NO: 88253 - DNA, 25 bp, Homo sapien
gccacctctggaaccttcttcgagg

SEQ ID NO: 88254 - DNA, 25 bp, Homo sapien
catctgcccagcctcggagggtggg

SEQ ID NO: 88255 - DNA, 25 bp, Homo sapien
gcaacctggtgcttcccgggtggac

SEQ ID NO: 88256 - DNA, 25 bp, Homo sapien
gtgcttcccgggtggacacacagga

SEQ ID NO: 88257 - DNA, 25 bp, Homo sapien
tggacacacaggaccactcagtggg

SEQ ID NO: 88258 - DNA, 25 bp, Homo sapien
tgtgtgggcgccgagacctgggtgt

SEQ ID NO: 88259 - DNA, 25 bp, Homo sapien
ggcgccgagacctgggtgtctggga

SEQ ID NO: 88260 - DNA, 25 bp, Homo sapien
cacggggcctcccaactatgaataa

SEQ ID NO: 88261 - DNA, 25 bp, Homo sapien
gaagtggtataaggaagtacattct

SEQ ID NO: 88262 - DNA, 25 bp, Homo sapien
ggaagtacattctggccaggcacga

SEQ ID NO: 88263 - DNA, 25 bp, Homo sapien
gaagtacattctggccaggcacgat

SEQ ID NO: 88264 - DNA, 25 bp, Homo sapien
cagtaagccgagttcactccattgt

SEQ ID NO: 88265 - DNA, 25 bp, Homo sapien
agtaagccgagttcactccattgta

SEQ ID NO: 88266 - DNA, 25 bp, Homo sapien
gtaagccgagttcactccattgtac

SEQ ID NO: 88267 - DNA, 25 bp, Homo sapien
taagccgagttcactccattgtact

SEQ ID NO: 88268 - DNA, 25 bp, Homo sapien
aagccgagttcactccattgtactc

SEQ ID NO: 88269 - DNA, 25 bp, Homo sapien
gccgagttcactccattgtactcta

SEQ ID NO: 88270 - DNA, 25 bp, Homo sapien
ccgagttcactccattgtactctag

SEQ ID NO: 88271 - DNA, 25 bp, Homo sapien
cgagttcactccattgtactctagc

SEQ ID NO: 88272 - DNA, 25 bp, Homo sapien
atagttgcatagcagtatatgttaa

SEQ ID NO: 88273 - DNA, 25 bp, Homo sapien
gtgtttttagctgtgacacaactgt

SEQ ID NO: 88274 - DNA, 25 bp, Homo sapien
cacaactgtgtgattaaaaggtata

SEQ ID NO: 88275 - DNA, 25 bp, Homo sapien
gacatttataactcaaggatacctt

SEQ ID NO: 88276 - DNA, 25 bp, Homo sapien
actcaaggataccttcttatttaat

SEQ ID NO: 88277 - DNA, 25 bp, Homo sapien
tatcatgaatgcttttagtgtgtgc

SEQ ID NO: 88278 - DNA, 25 bp, Homo sapien
ttagtgtgtgcataatagctacagt

SEQ ID NO: 88279 - DNA, 25 bp, Homo sapien
agctacagtgcatagttgtagacaa

SEQ ID NO: 88280 - DNA, 25 bp, Homo sapien
aacatttatatgtagcctttactgt

SEQ ID NO: 88281 - DNA, 25 bp, Homo sapien
tagcctttactgtttgatataccaa

SEQ ID NO: 88282 - DNA, 25 bp, Homo sapien
ctcattacttatactgggacaccat

SEQ ID NO: 88283 - DNA, 25 bp, Homo sapien
aagtgtgacagtgtccagccggttc

SEQ ID NO: 88284 - DNA, 25 bp, Homo sapien
tgacagtgtccagccggttctgcag

SEQ ID NO: 88285 - DNA, 25 bp, Homo sapien
tctccgtctggcctaaaggtgatgt

SEQ ID NO: 88286 - DNA, 25 bp, Homo sapien
gtatttggtgtttggccctgcagtc

SEQ ID NO: 88287 - DNA, 25 bp, Homo sapien
agtccccactcttgaggcttaaggc

SEQ ID NO: 88288 - DNA, 25 bp, Homo sapien
ggcttaaggcgcatgtggcacacca

SEQ ID NO: 88289 - DNA, 25 bp, Homo sapien
tccttccagcagtagtcgctttact

SEQ ID NO: 88290 - DNA, 25 bp, Homo sapien
agtcgctttactgttacctgtttag

SEQ ID NO: 88291 - DNA, 25 bp, Homo sapien
tactgttacctgtttaggcctagaa

SEQ ID NO: 88292 - DNA, 25 bp, Homo sapien
gtgatttaaaatctaagccatgaat

SEQ ID NO: 88293 - DNA, 25 bp, Homo sapien
ccagttcttctgaaagtgtgacagt

SEQ ID NO: 88294 - DNA, 25 bp, Homo sapien
aagtatcagagatgggattcaaacc

SEQ ID NO: 88295 - DNA, 25 bp, Homo sapien
ccagatcctctggtccaagttgtat

SEQ ID NO: 88296 - DNA, 25 bp, Homo sapien
ctctggtccaagttgtatgtgcact

SEQ ID NO: 88297 - DNA, 25 bp, Homo sapien
ggtccaagttgtatgtgcactgaac

SEQ ID NO: 88298 - DNA, 25 bp, Homo sapien
gtgcactgaactaatcaggcaggaa

SEQ ID NO: 88299 - DNA, 25 bp, Homo sapien
ggcaggaaaaaagcccagccactgt

SEQ ID NO: 88300 - DNA, 25 bp, Homo sapien
cagccactgtctcacagattgtttt

SEQ ID NO: 88301 - DNA, 25 bp, Homo sapien
ttgtatattgtagcaaaatcctgaa

SEQ ID NO: 88302 - DNA, 25 bp, Homo sapien
gtccttccagtctcatcatacaaaa

SEQ ID NO: 88303 - DNA, 25 bp, Homo sapien
cagtctcatcatacaaaatggcaat

SEQ ID NO: 88304 - DNA, 25 bp, Homo sapien
caaaatggcaatcttggctgggtgc

SEQ ID NO: 88305 - DNA, 25 bp, Homo sapien
gatgagcgactcagatgtagaggcc

SEQ ID NO: 88306 - DNA, 25 bp, Homo sapien
tgagcgactcagatgtagaggccga

SEQ ID NO: 88307 - DNA, 25 bp, Homo sapien
cgactcagatgtagaggccgaggac

SEQ ID NO: 88308 - DNA, 25 bp, Homo sapien
cagaggaggtggtccgcatgggcgt

SEQ ID NO: 88309 - DNA, 25 bp, Homo sapien
gcatgggcgtactggcctcctaact

SEQ ID NO: 88310 - DNA, 25 bp, Homo sapien
tcagcccagtcacaactgccatttc

SEQ ID NO: 88311 - DNA, 25 bp, Homo sapien
tgctgagtgtcccagaccctcgagg

SEQ ID NO: 88312 - DNA, 25 bp, Homo sapien
tgagtgtcccagaccctcgaggctg

SEQ ID NO: 88313 - DNA, 25 bp, Homo sapien
tcgaggctgccactccgtcgtggtt

SEQ ID NO: 88314 - DNA, 25 bp, Homo sapien
ggctgccactccgtcgtggttttat

SEQ ID NO: 88315 - DNA, 25 bp, Homo sapien
tgccactccgtcgtggttttatttt

SEQ ID NO: 88316 - DNA, 25 bp, Homo sapien
tccttttcagagcacttcatccact

SEQ ID NO: 88317 - DNA, 25 bp, Homo sapien
ttttcagagcacttcatccacttgc

SEQ ID NO: 88318 - DNA, 25 bp, Homo sapien
ttcagagcacttcatccacttgctc

SEQ ID NO: 88319 - DNA, 25 bp, Homo sapien
tctaccctcggcaccctgggtggga

SEQ ID NO: 88320 - DNA, 25 bp, Homo sapien
gccacttaataaggagtcagaccta

SEQ ID NO: 88321 - DNA, 25 bp, Homo sapien
gggacattttcttacctcacccaag

SEQ ID NO: 88322 - DNA, 25 bp, Homo sapien
gacattttcttacctcacccaagaa

SEQ ID NO: 88323 - DNA, 25 bp, Homo sapien
cattttcttacctcacccaagaaag

SEQ ID NO: 88324 - DNA, 25 bp, Homo sapien
gaaagaggtcgtcacttttgctgtg

SEQ ID NO: 88325 - DNA, 25 bp, Homo sapien
gtacaataatttaacacggttgcct

SEQ ID NO: 88326 - DNA, 25 bp, Homo sapien
caataatttaacacggttgcctgaa

SEQ ID NO: 88327 - DNA, 25 bp, Homo sapien
aacagagtggtgacgagtgagtaat

SEQ ID NO: 88328 - DNA, 25 bp, Homo sapien
agcaatatgtaatccaactcacctc

SEQ ID NO: 88329 - DNA, 25 bp, Homo sapien
caactcacctccatgttcaaggatg

SEQ ID NO: 88330 - DNA, 25 bp, Homo sapien
gttcaaggatgtccctctgactgca

SEQ ID NO: 88331 - DNA, 25 bp, Homo sapien
gagcatgttctccaagatgaatctt

SEQ ID NO: 88332 - DNA, 25 bp, Homo sapien
gaatcttcaagaaataccacctttg

SEQ ID NO: 88333 - DNA, 25 bp, Homo sapien
aataccacctttggtctatcagctt

SEQ ID NO: 88334 - DNA, 25 bp, Homo sapien
tggtctatcagcttctggttctctc

SEQ ID NO: 88335 - DNA, 25 bp, Homo sapien
aggaatcatagccttcttcagtgca

SEQ ID NO: 88336 - DNA, 25 bp, Homo sapien
atagccttcttcagtgcactagata

SEQ ID NO: 88337 - DNA, 25 bp, Homo sapien
tcttcagtgcactagataagcagca

SEQ ID NO: 88338 - DNA, 25 bp, Homo sapien
ggagtgtgtattgttcccagtgaca

SEQ ID NO: 88339 - DNA, 25 bp, Homo sapien
gttcccagtgacacttcagagagct

SEQ ID NO: 88340 - DNA, 25 bp, Homo sapien
tagtagcatgttgagccaggcctgg

SEQ ID NO: 88341 - DNA, 25 bp, Homo sapien
tttctccttagtcttctcatagcat

SEQ ID NO: 88342 - DNA, 25 bp, Homo sapien
agcattaactaatctattgggttca

SEQ ID NO: 88343 - DNA, 25 bp, Homo sapien
cattattggaattaacctggtgctg

SEQ ID NO: 88344 - DNA, 25 bp, Homo sapien
aacctggtgctggatattttcaaat

SEQ ID NO: 88345 - DNA, 25 bp, Homo sapien
tttcaaattgtatctagtgcagctg

SEQ ID NO: 88346 - DNA, 25 bp, Homo sapien
acaataactactgtgttcctggcaa

SEQ ID NO: 88347 - DNA, 25 bp, Homo sapien
gttcctggcaatagtgtgttctgat

SEQ ID NO: 88348 - DNA, 25 bp, Homo sapien
gatacgactttattttctggtagat

SEQ ID NO: 88349 - DNA, 25 bp, Homo sapien
tgctcagtaaaggtgcagagttcct

SEQ ID NO: 88350 - DNA, 25 bp, Homo sapien
ctcagtaaaggtgcagagttcctgc

SEQ ID NO: 88351 - DNA, 25 bp, Homo sapien
agtaaaggtgcagagttcctgctcc

SEQ ID NO: 88352 - DNA, 25 bp, Homo sapien
gtaaaggtgcagagttcctgctccg

SEQ ID NO: 88353 - DNA, 25 bp, Homo sapien
taaaggtgcagagttcctgctccga

SEQ ID NO: 88354 - DNA, 25 bp, Homo sapien
gttcctgctccgagttggagccgtc

SEQ ID NO: 88355 - DNA, 25 bp, Homo sapien
ctccgagttggagccgtctgctttg

SEQ ID NO: 88356 - DNA, 25 bp, Homo sapien
cgagttggagccgtctgctttggcc

SEQ ID NO: 88357 - DNA, 25 bp, Homo sapien
gagttggagccgtctgctttggcct

SEQ ID NO: 88358 - DNA, 25 bp, Homo sapien
agttggagccgtctgctttggcctc

SEQ ID NO: 88359 - DNA, 25 bp, Homo sapien
ttggagccgtctgctttggcctctc

SEQ ID NO: 88360 - DNA, 25 bp, Homo sapien
gactgtcttccaggaacaaacgttg

SEQ ID NO: 88361 - DNA, 25 bp, Homo sapien
tttggaatctgaagacctgatcccc

SEQ ID NO: 88362 - DNA, 25 bp, Homo sapien
tagagtctgctctgaacaaaagtga

SEQ ID NO: 88363 - DNA, 25 bp, Homo sapien
tgagccctttctaacctggctgtaa

SEQ ID NO: 88364 - DNA, 25 bp, Homo sapien
aacctggctgtaatcactaccattg

SEQ ID NO: 88365 - DNA, 25 bp, Homo sapien
taccattgtaacttggatgtagcca

SEQ ID NO: 88366 - DNA, 25 bp, Homo sapien
gtagccatgaccttacatttcctgg

SEQ ID NO: 88367 - DNA, 25 bp, Homo sapien
catttcctgggcctcttggaaaaag

SEQ ID NO: 88368 - DNA, 25 bp, Homo sapien
tgctccctcctttttatgttgccag

SEQ ID NO: 88369 - DNA, 25 bp, Homo sapien
atgttgccagtttaatcattgcctg

SEQ ID NO: 88370 - DNA, 25 bp, Homo sapien
attgcctggttttgattgagagtaa

SEQ ID NO: 88371 - DNA, 25 bp, Homo sapien
tgtcactgactttccttctggagca

SEQ ID NO: 88372 - DNA, 25 bp, Homo sapien
cactgactttccttctggagcaggt

SEQ ID NO: 88373 - DNA, 25 bp, Homo sapien
aggaaagaaaggctcctgtttctca

SEQ ID NO: 88374 - DNA, 25 bp, Homo sapien
tgtttctcatttgtgaggccagcct

SEQ ID NO: 88375 - DNA, 25 bp, Homo sapien
ttctcatttgtgaggccagcctctg

SEQ ID NO: 88376 - DNA, 25 bp, Homo sapien
agcctctggcttttctgccgtggat

SEQ ID NO: 88377 - DNA, 25 bp, Homo sapien
tctggcttttctgccgtggattctc

SEQ ID NO: 88378 - DNA, 25 bp, Homo sapien
gctggatgctaacttgatactaacc

SEQ ID NO: 88379 - DNA, 25 bp, Homo sapien
gatactaaccatcagattgtacagt

SEQ ID NO: 88380 - DNA, 25 bp, Homo sapien
gtacagtttggttgttgctgtaaat

SEQ ID NO: 88381 - DNA, 25 bp, Homo sapien
aatatggtagcgttttgttgttgtt

SEQ ID NO: 88382 - DNA, 25 bp, Homo sapien
atgatatccataatcaaatgagatt

SEQ ID NO: 88383 - DNA, 25 bp, Homo sapien
gattattttaccacataaatgtttt

SEQ ID NO: 88384 - DNA, 25 bp, Homo sapien
tatgcattgaatttggagtactacc

SEQ ID NO: 88385 - DNA, 25 bp, Homo sapien
gcattgaatttggagtactaccaac

SEQ ID NO: 88386 - DNA, 25 bp, Homo sapien
gaatttggagtactaccaacaatga

SEQ ID NO: 88387 - DNA, 25 bp, Homo sapien
ggagtactaccaacaatgaatgaat

SEQ ID NO: 88388 - DNA, 25 bp, Homo sapien
gagtactaccaacaatgaatgaatt

SEQ ID NO: 88389 - DNA, 25 bp, Homo sapien
cattttattggtcattgtcacagat

SEQ ID NO: 88390 - DNA, 25 bp, Homo sapien
ttttattggtcattgtcacagatag

SEQ ID NO: 88391 - DNA, 25 bp, Homo sapien
tattggtcattgtcacagatagtaa

SEQ ID NO: 88392 - DNA, 25 bp, Homo sapien
gtcattgtcacagatagtaaatact

SEQ ID NO: 88393 - DNA, 25 bp, Homo sapien
gtcacaattattaccatctctccag

SEQ ID NO: 88394 - DNA, 25 bp, Homo sapien
taccatctctccagctagcaaaatt

SEQ ID NO: 88395 - DNA, 25 bp, Homo sapien
agcaaaattactaccagagccgtta

SEQ ID NO: 88396 - DNA, 25 bp, Homo sapien
accagagccgttactacacacaaag

SEQ ID NO: 88397 - DNA, 25 bp, Homo sapien
aggctattgaccgagcacataccat

SEQ ID NO: 88398 - DNA, 25 bp, Homo sapien
ttcaatctttacacaatgtcacggg

SEQ ID NO: 88399 - DNA, 25 bp, Homo sapien
tgtcacgggaccagtattgtttacc

SEQ ID NO: 88400 - DNA, 25 bp, Homo sapien
taaggacactgaagcttagaggagt

SEQ ID NO: 88401 - DNA, 25 bp, Homo sapien
gttttgagtgttatttcagagagca

SEQ ID NO: 88402 - DNA, 25 bp, Homo sapien
aaagactggatccaaacccatcttc

SEQ ID NO: 88403 - DNA, 25 bp, Homo sapien
aaacccatcttcctggacctgaagt

SEQ ID NO: 88404 - DNA, 25 bp, Homo sapien
tgtaacacctacaccattatcttgg

SEQ ID NO: 88405 - DNA, 25 bp, Homo sapien
acctacaccattatcttggaaagaa

SEQ ID NO: 88406 - DNA, 25 bp, Homo sapien
ttatcttggaaagaaacaaccgttg

SEQ ID NO: 88407 - DNA, 25 bp, Homo sapien
aaacataaccattacagggagctgg

SEQ ID NO: 88408 - DNA, 25 bp, Homo sapien
aaccattacagggagctgggacact

SEQ ID NO: 88409 - DNA, 25 bp, Homo sapien
cagggagctgggacacttaacagat

SEQ ID NO: 88410 - DNA, 25 bp, Homo sapien
ctgggacacttaacagatgcaatgt

SEQ ID NO: 88411 - DNA, 25 bp, Homo sapien
gatgcaatgtgctactgattgtttc

SEQ ID NO: 88412 - DNA, 25 bp, Homo sapien
gtgctactgattgtttcattgcgaa

SEQ ID NO: 88413 - DNA, 25 bp, Homo sapien
gattgtttcattgcgaatctttttt

SEQ ID NO: 88414 - DNA, 25 bp, Homo sapien
attgcgaatcttttttagcataaaa

SEQ ID NO: 88415 - DNA, 25 bp, Homo sapien
cttccccagcccagacattgagaaa

SEQ ID NO: 88416 - DNA, 25 bp, Homo sapien
tccccagcccagacattgagaaact

SEQ ID NO: 88417 - DNA, 25 bp, Homo sapien
ccccagcccagacattgagaaactt

SEQ ID NO: 88418 - DNA, 25 bp, Homo sapien
cccagcccagacattgagaaacttg

SEQ ID NO: 88419 - DNA, 25 bp, Homo sapien
gaagagagaaacctcaagctcccaa

SEQ ID NO: 88420 - DNA, 25 bp, Homo sapien
aagagagaaacctcaagctcccaaa

SEQ ID NO: 88421 - DNA, 25 bp, Homo sapien
gagagaaacctcaagctcccaaaca

SEQ ID NO: 88422 - DNA, 25 bp, Homo sapien
agagaaacctcaagctcccaaacag

SEQ ID NO: 88423 - DNA, 25 bp, Homo sapien
agaaacctcaagctcccaaacagca

SEQ ID NO: 88424 - DNA, 25 bp, Homo sapien
tcaagctcccaaacagcacgttgcg

SEQ ID NO: 88425 - DNA, 25 bp, Homo sapien
caagctcccaaacagcacgttgcgg

SEQ ID NO: 88426 - DNA, 25 bp, Homo sapien
aatagatcagttaaagcccggagga

SEQ ID NO: 88427 - DNA, 25 bp, Homo sapien
gttaaagcccggaggaagattgata

SEQ ID NO: 88428 - DNA, 25 bp, Homo sapien
gaagattgatattgcctgttggtcc

SEQ ID NO: 88429 - DNA, 25 bp, Homo sapien
attgatattgcctgttggtcctgca

SEQ ID NO: 88430 - DNA, 25 bp, Homo sapien
ctgttggtcctgcaggcggaaacca

SEQ ID NO: 88431 - DNA, 25 bp, Homo sapien
gtcctgcaggcggaaaccaaatgtt

SEQ ID NO: 88432 - DNA, 25 bp, Homo sapien
atgttggagcagtatgacaagctac

SEQ ID NO: 88433 - DNA, 25 bp, Homo sapien
cagtatgacaagctacaagatggca

SEQ ID NO: 88434 - DNA, 25 bp, Homo sapien
ggcagcatcaaaatgaagcctctga

SEQ ID NO: 88435 - DNA, 25 bp, Homo sapien
gggtgatatacgtgcctttaacaga

SEQ ID NO: 88436 - DNA, 25 bp, Homo sapien
agataaagaaaagcagtggtccagg

SEQ ID NO: 88437 - DNA, 25 bp, Homo sapien
ttattgcgagtgttgctgtccgcat

SEQ ID NO: 88438 - DNA, 25 bp, Homo sapien
acgtggctcctgtgctctagatcat

SEQ ID NO: 88439 - DNA, 25 bp, Homo sapien
tgtgctctagatcatggtgactccc

SEQ ID NO: 88440 - DNA, 25 bp, Homo sapien
cgccctgtggttggaatcgatgcca

SEQ ID NO: 88441 - DNA, 25 bp, Homo sapien
atcgatgccacggattgcaggccaa

SEQ ID NO: 88442 - DNA, 25 bp, Homo sapien
gccaaatttcagatcgtgtttccaa

SEQ ID NO: 88443 - DNA, 25 bp, Homo sapien
cttgctgtgccctttaatgggattg

SEQ ID NO: 88444 - DNA, 25 bp, Homo sapien
ttgaaagcacttttaccacatggag

SEQ ID NO: 88445 - DNA, 25 bp, Homo sapien
gatgcttttctacaaggtccactat

SEQ ID NO: 88446 - DNA, 25 bp, Homo sapien
aggtccactattcctgagtttaatg

SEQ ID NO: 88447 - DNA, 25 bp, Homo sapien
gtgtttccaacacttaaggagactc

SEQ ID NO: 88448 - DNA, 25 bp, Homo sapien
accttcctcaagtcatagctgcttg

SEQ ID NO: 88449 - DNA, 25 bp, Homo sapien
gcttgcagcaacttgatttccccaa

SEQ ID NO: 88450 - DNA, 25 bp, Homo sapien
atttccccaagtcctgtgcaatagc

SEQ ID NO: 88451 - DNA, 25 bp, Homo sapien
aatagccccaggattggattccttc

SEQ ID NO: 88452 - DNA, 25 bp, Homo sapien
gattccttccaaccttttagcatat

SEQ ID NO: 88453 - DNA, 25 bp, Homo sapien
agcatatctccaaccttgcaatttg

SEQ ID NO: 88454 - DNA, 25 bp, Homo sapien
ataatcactccggtttgctttctag

SEQ ID NO: 88455 - DNA, 25 bp, Homo sapien
tttctaggtcctcaagtgctcgtga

SEQ ID NO: 88456 - DNA, 25 bp, Homo sapien
tgctcgtgacacataatcattccat

SEQ ID NO: 88457 - DNA, 25 bp, Homo sapien
attccatccaatgatcgcctttgct

SEQ ID NO: 88458 - DNA, 25 bp, Homo sapien
ttgctttaccactctttccttttat

SEQ ID NO: 88459 - DNA, 25 bp, Homo sapien
tgactgccaataacattcttcgatc

SEQ ID NO: 88460 - DNA, 25 bp, Homo sapien
ataacattcttcgatctctgggatt

SEQ ID NO: 88461 - DNA, 25 bp, Homo sapien
gatctctgggatttatgctcatgaa

SEQ ID NO: 88462 - DNA, 25 bp, Homo sapien
ctgggatttatgctcatgaactaaa

SEQ ID NO: 88463 - DNA, 25 bp, Homo sapien
gctcattaagaagtgcagcaggtta

SEQ ID NO: 88464 - DNA, 25 bp, Homo sapien
agaagtgcagcaggttaagaatttt

SEQ ID NO: 88465 - DNA, 25 bp, Homo sapien
gaattttttcctaaagactgtatat

SEQ ID NO: 88466 - DNA, 25 bp, Homo sapien
gaattttgcattgcagtcatagaag

SEQ ID NO: 88467 - DNA, 25 bp, Homo sapien
aaagtatgcttgttaattttattca

SEQ ID NO: 88468 - DNA, 25 bp, Homo sapien
tttattcaagaatgccagtagaaaa

SEQ ID NO: 88469 - DNA, 25 bp, Homo sapien
aaattcataacgtgtatctttaaga

SEQ ID NO: 88470 - DNA, 25 bp, Homo sapien
cgtgccagcccttcttttgtgtctg

SEQ ID NO: 88471 - DNA, 25 bp, Homo sapien
tgtctgaaaccggttttaaaatgtg

SEQ ID NO: 88472 - DNA, 25 bp, Homo sapien
gaagaagccgctggctgtatgaaac

SEQ ID NO: 88473 - DNA, 25 bp, Homo sapien
ggctgtatgaaacttgacggcgctt

SEQ ID NO: 88474 - DNA, 25 bp, Homo sapien
gtatgaaacttgacggcgcttttgt

SEQ ID NO: 88475 - DNA, 25 bp, Homo sapien
acttgacggcgcttttgtaaggtgc

SEQ ID NO: 88476 - DNA, 25 bp, Homo sapien
gacggcgcttttgtaaggtgccacc

SEQ ID NO: 88477 - DNA, 25 bp, Homo sapien
ttcatcctccagatgtagctattga

SEQ ID NO: 88478 - DNA, 25 bp, Homo sapien
gtagctattgatgtacacttcgcaa

SEQ ID NO: 88479 - DNA, 25 bp, Homo sapien
attgatgtacacttcgcaacggagt

SEQ ID NO: 88480 - DNA, 25 bp, Homo sapien
gtacacttcgcaacggagtgtctga

SEQ ID NO: 88481 - DNA, 25 bp, Homo sapien
gaagggaacacattgtatactgcct

SEQ ID NO: 88482 - DNA, 25 bp, Homo sapien
ttaggtttctcttccatcgggtgac

SEQ ID NO: 88483 - DNA, 25 bp, Homo sapien
aagttttagttagcttcaacatcta

SEQ ID NO: 88484 - DNA, 25 bp, Homo sapien
agcttcaacatctaagtgtatggat

SEQ ID NO: 88485 - DNA, 25 bp, Homo sapien
gtatggatgatactgaccacacatg

SEQ ID NO: 88486 - DNA, 25 bp, Homo sapien
tgatactgaccacacatgttgtttt

SEQ ID NO: 88487 - DNA, 25 bp, Homo sapien
tgcttatccatttcaagtgcaagtg

SEQ ID NO: 88488 - DNA, 25 bp, Homo sapien
agtgcaagtgtttgccattttgtaa

SEQ ID NO: 88489 - DNA, 25 bp, Homo sapien
attttgggaaatcttccatcttgct

SEQ ID NO: 88490 - DNA, 25 bp, Homo sapien
tcttccatcttgctgtgatttgcaa

SEQ ID NO: 88491 - DNA, 25 bp, Homo sapien
gctgtgatttgcaataggtattttc

SEQ ID NO: 88492 - DNA, 25 bp, Homo sapien
acaggagcaactgtctcagggagga

SEQ ID NO: 88493 - DNA, 25 bp, Homo sapien
ggctcaaagacaaatcccacatgtt

SEQ ID NO: 88494 - DNA, 25 bp, Homo sapien
gacaaatcccacatgttctcaaggc

SEQ ID NO: 88495 - DNA, 25 bp, Homo sapien
ccacatgttctcaaggccgttaagt

SEQ ID NO: 88496 - DNA, 25 bp, Homo sapien
caaggccgttaagttccagtcctgg

SEQ ID NO: 88497 - DNA, 25 bp, Homo sapien
tggccagtcattccctgattggtat

SEQ ID NO: 88498 - DNA, 25 bp, Homo sapien
attccctgattggtatctggagaca

SEQ ID NO: 88499 - DNA, 25 bp, Homo sapien
cctacaaaggaagcagtctctggag

SEQ ID NO: 88500 - DNA, 25 bp, Homo sapien
aaagccttctttttcactaggccag

SEQ ID NO: 88501 - DNA, 25 bp, Homo sapien
cttctttttcactaggccaggacta

SEQ ID NO: 88502 - DNA, 25 bp, Homo sapien
ctaggccaggactacattgagagat

SEQ ID NO: 88503 - DNA, 25 bp, Homo sapien
tcccctcttcctcaagggtagatga

SEQ ID NO: 88504 - DNA, 25 bp, Homo sapien
ggttggctgtgggtcctgggtacca

SEQ ID NO: 88505 - DNA, 25 bp, Homo sapien
tttgcctcaggagtgtgaggactac

SEQ ID NO: 88506 - DNA, 25 bp, Homo sapien
gaggactacactagtgaaagcgcct

SEQ ID NO: 88507 - DNA, 25 bp, Homo sapien
acactagtgaaagcgcctggcgggc

SEQ ID NO: 88508 - DNA, 25 bp, Homo sapien
ggcagccggcgatgcccaataaatg

SEQ ID NO: 88509 - DNA, 25 bp, Homo sapien
ggacatgaagatctggcactgagct

SEQ ID NO: 88510 - DNA, 25 bp, Homo sapien
agatctggcactgagctttttgtca

SEQ ID NO: 88511 - DNA, 25 bp, Homo sapien
ctggcactgagctttttgtcactga

SEQ ID NO: 88512 - DNA, 25 bp, Homo sapien
cactgagctttttgtcactgaacct

SEQ ID NO: 88513 - DNA, 25 bp, Homo sapien
ttgtcactgaaccttcccgatgcca

SEQ ID NO: 88514 - DNA, 25 bp, Homo sapien
acaggagattctctttcttcgctga

SEQ ID NO: 88515 - DNA, 25 bp, Homo sapien
attctctttcttcgctgaagtgtga

SEQ ID NO: 88516 - DNA, 25 bp, Homo sapien
tgaagtgtgactacctccactcatg

SEQ ID NO: 88517 - DNA, 25 bp, Homo sapien
tacctccactcatgtcccattttag

SEQ ID NO: 88518 - DNA, 25 bp, Homo sapien
agccaagcttatttaagatcacagt

SEQ ID NO: 88519 - DNA, 25 bp, Homo sapien
agatcacagtgaacttagtcctgtt

SEQ ID NO: 88520 - DNA, 25 bp, Homo sapien
gaacttagtcctgttatagacgaga

SEQ ID NO: 88521 - DNA, 25 bp, Homo sapien
agacgagaatcgaggtgctgtttta

SEQ ID NO: 88522 - DNA, 25 bp, Homo sapien
ggtgctgttttagacatttatttct

SEQ ID NO: 88523 - DNA, 25 bp, Homo sapien
cagaaactctgccaacactgaggat

SEQ ID NO: 88524 - DNA, 25 bp, Homo sapien
ttgaggttgaatctcctggtgagat

SEQ ID NO: 88525 - DNA, 25 bp, Homo sapien
acagtagacttatagtagggttggg

SEQ ID NO: 88526 - DNA, 25 bp, Homo sapien
gggtagcccatgttatgtgactatc

SEQ ID NO: 88527 - DNA, 25 bp, Homo sapien
gcccatgttatgtgactatctttat

SEQ ID NO: 88528 - DNA, 25 bp, Homo sapien
taaagtggttctggatatcttttaa

SEQ ID NO: 88529 - DNA, 25 bp, Homo sapien
agccaaaatacttctgagaccttgt

SEQ ID NO: 88530 - DNA, 25 bp, Homo sapien
aaaatacttctgagaccttgtttca

SEQ ID NO: 88531 - DNA, 25 bp, Homo sapien
tttgctgtatatcccctcaaaatcc

SEQ ID NO: 88532 - DNA, 25 bp, Homo sapien
agttattaatcttatgtgttttctt

SEQ ID NO: 88533 - DNA, 25 bp, Homo sapien
taatggttcaaatgagttcaacttt

SEQ ID NO: 88534 - DNA, 25 bp, Homo sapien
gttcaactttgagggacgatctttg

SEQ ID NO: 88535 - DNA, 25 bp, Homo sapien
ggacgatctttgaatatacttacct

SEQ ID NO: 88536 - DNA, 25 bp, Homo sapien
gctgcttccctccttggttatcatc

SEQ ID NO: 88537 - DNA, 25 bp, Homo sapien
tgcttccctccttggttatcatcca

SEQ ID NO: 88538 - DNA, 25 bp, Homo sapien
ttccctccttggttatcatccactg

SEQ ID NO: 88539 - DNA, 25 bp, Homo sapien
tattttcacttttgggattttgtgg

SEQ ID NO: 88540 - DNA, 25 bp, Homo sapien
cttgtataatgaagtcaatgccatc

SEQ ID NO: 88541 - DNA, 25 bp, Homo sapien
ataatgaagtcaatgccatcaggcc

SEQ ID NO: 88542 - DNA, 25 bp, Homo sapien
agtcaatgccatcaggccaaggaaa

SEQ ID NO: 88543 - DNA, 25 bp, Homo sapien
gtcaatgccatcaggccaaggaaat

SEQ ID NO: 88544 - DNA, 25 bp, Homo sapien
tcaatgccatcaggccaaggaaata

SEQ ID NO: 88545 - DNA, 25 bp, Homo sapien
atgccatcaggccaaggaaataaaa

SEQ ID NO: 88546 - DNA, 25 bp, Homo sapien
gccatcaggccaaggaaataaaata

SEQ ID NO: 88547 - DNA, 25 bp, Homo sapien
aacccctccctactgttggatgtat

SEQ ID NO: 88548 - DNA, 25 bp, Homo sapien
cctactgttggatgtatgtgtgaca

SEQ ID NO: 88549 - DNA, 25 bp, Homo sapien
gtgtgacaagtgtgtctcctgtgct

SEQ ID NO: 88550 - DNA, 25 bp, Homo sapien
aagtgtgtctcctgtgctgcgatgg

SEQ ID NO: 88551 - DNA, 25 bp, Homo sapien
tcagcagggcagttgtcgggcagtc

SEQ ID NO: 88552 - DNA, 25 bp, Homo sapien
gtcctgagtgggtgttgcacagact

SEQ ID NO: 88553 - DNA, 25 bp, Homo sapien
ttgcacagactggtccacagggctc

SEQ ID NO: 88554 - DNA, 25 bp, Homo sapien
cagactggtccacagggctcctgaa

SEQ ID NO: 88555 - DNA, 25 bp, Homo sapien
gagggtggcctcaagaaacaatgtc

SEQ ID NO: 88556 - DNA, 25 bp, Homo sapien
gggacaggcctttctggcctgctat

SEQ ID NO: 88557 - DNA, 25 bp, Homo sapien
ctgctatgtcttcccaatgtttatt

SEQ ID NO: 88558 - DNA, 25 bp, Homo sapien
cttcagagccagggctagaggatgc

SEQ ID NO: 88559 - DNA, 25 bp, Homo sapien
ttcagagccagggctagaggatgca

SEQ ID NO: 88560 - DNA, 25 bp, Homo sapien
cagagccagggctagaggatgcacg

SEQ ID NO: 88561 - DNA, 25 bp, Homo sapien
agagccagggctagaggatgcacgg

SEQ ID NO: 88562 - DNA, 25 bp, Homo sapien
gagccagggctagaggatgcacggt

SEQ ID NO: 88563 - DNA, 25 bp, Homo sapien
agccagggctagaggatgcacggtg

SEQ ID NO: 88564 - DNA, 25 bp, Homo sapien
cagggctagaggatgcacggtggct

SEQ ID NO: 88565 - DNA, 25 bp, Homo sapien
agggctagaggatgcacggtggcta

SEQ ID NO: 88566 - DNA, 25 bp, Homo sapien
gggctagaggatgcacggtggctag

SEQ ID NO: 88567 - DNA, 25 bp, Homo sapien
ggctagaggatgcacggtggctaga

SEQ ID NO: 88568 - DNA, 25 bp, Homo sapien
gctagaggatgcacggtggctagag

SEQ ID NO: 88569 - DNA, 25 bp, Homo sapien
aataaatttgttttggaatgcatac

SEQ ID NO: 88570 - DNA, 25 bp, Homo sapien
gaatgcataccacatcatctggctc

SEQ ID NO: 88571 - DNA, 25 bp, Homo sapien
acatcatctggctctagaaacgtat

SEQ ID NO: 88572 - DNA, 25 bp, Homo sapien
tctggctctagaaacgtattttgtg

SEQ ID NO: 88573 - DNA, 25 bp, Homo sapien
ttttgtgtagctcccctagcaagaa

SEQ ID NO: 88574 - DNA, 25 bp, Homo sapien
gcgtaaatttaattcctggctctat

SEQ ID NO: 88575 - DNA, 25 bp, Homo sapien
tcattcccactttacgttgtttcaa

SEQ ID NO: 88576 - DNA, 25 bp, Homo sapien
gttgtttcaaataacctagtttgtg

SEQ ID NO: 88577 - DNA, 25 bp, Homo sapien
tttgtgtatccctgtaagtcatttt

SEQ ID NO: 88578 - DNA, 25 bp, Homo sapien
gtatccctgtaagtcattttggtat

SEQ ID NO: 88579 - DNA, 25 bp, Homo sapien
taggttataagtgtacatgcgaaaa

SEQ ID NO: 88580 - DNA, 25 bp, Homo sapien
catgtttcagtttgtccttcctgac

SEQ ID NO: 88581 - DNA, 25 bp, Homo sapien
agtttgtccttcctgactgttaatg

SEQ ID NO: 88582 - DNA, 25 bp, Homo sapien
gtccttcctgactgttaatgactac

SEQ ID NO: 88583 - DNA, 25 bp, Homo sapien
ctgttaatgactacctttggttggg

SEQ ID NO: 88584 - DNA, 25 bp, Homo sapien
tgttctcttaaacatttctttgcat

SEQ ID NO: 88585 - DNA, 25 bp, Homo sapien
gcatttggtttttgtgttcctgaac

SEQ ID NO: 88586 - DNA, 25 bp, Homo sapien
gggaaagtgtctaacttcatggcta

SEQ ID NO: 88587 - DNA, 25 bp, Homo sapien
gtgtctaacttcatggctatggcct

SEQ ID NO: 88588 - DNA, 25 bp, Homo sapien
aacttcatggctatggccttttgga

SEQ ID NO: 88589 - DNA, 25 bp, Homo sapien
gccttttggagtctcatctgacata

SEQ ID NO: 88590 - DNA, 25 bp, Homo sapien
ggagtctcatctgacataatgaaaa

SEQ ID NO: 88591 - DNA, 25 bp, Homo sapien
aaagccacactgatgcagaagcctt

SEQ ID NO: 88592 - DNA, 25 bp, Homo sapien
cagaagcctttagtgctgcacggga

SEQ ID NO: 88593 - DNA, 25 bp, Homo sapien
gtgaccaaggaagcctcaatgccgt

SEQ ID NO: 88594 - DNA, 25 bp, Homo sapien
aatgccgtccctgggaaagccagag

SEQ ID NO: 88595 - DNA, 25 bp, Homo sapien
gatttttggcacaacttgcgagtgt

SEQ ID NO: 88596 - DNA, 25 bp, Homo sapien
gtgactttaggactggcgcaaaacc

SEQ ID NO: 88597 - DNA, 25 bp, Homo sapien
gcaaaacctccagggtgctcaactt

SEQ ID NO: 88598 - DNA, 25 bp, Homo sapien
ttaaccactcaccttgttctaaaat

SEQ ID NO: 88599 - DNA, 25 bp, Homo sapien
aggttatttcagtgtcccagtcaaa

SEQ ID NO: 88600 - DNA, 25 bp, Homo sapien
gtcccagtcaaattcctattctaac

SEQ ID NO: 88601 - DNA, 25 bp, Homo sapien
gtcaactatgtgattctttccaagc

SEQ ID NO: 88602 - DNA, 25 bp, Homo sapien
tgatggcatcgtccctgaaacgtgg

SEQ ID NO: 88603 - DNA, 25 bp, Homo sapien
tgaaacgtggattgatggccccaaa

SEQ ID NO: 88604 - DNA, 25 bp, Homo sapien
atggccccaaagacacatcagtgga

SEQ ID NO: 88605 - DNA, 25 bp, Homo sapien
gacacatcagtggaagatgctttag

SEQ ID NO: 88606 - DNA, 25 bp, Homo sapien
gaaagaacctatgtgccctgtctaa

SEQ ID NO: 88607 - DNA, 25 bp, Homo sapien
ggatcaaggagacccggaaatacaa

SEQ ID NO: 88608 - DNA, 25 bp, Homo sapien
gaaggtctattggtattgagcctgg

SEQ ID NO: 88609 - DNA, 25 bp, Homo sapien
aacttctgtcccagccttgaaggct

SEQ ID NO: 88610 - DNA, 25 bp, Homo sapien
gaaggctgaggcacttctttttcag

SEQ ID NO: 88611 - DNA, 25 bp, Homo sapien
gctgaggcacttctttttcagatgc

SEQ ID NO: 88612 - DNA, 25 bp, Homo sapien
ttcagatgccaataaagagcacttt

SEQ ID NO: 88613 - DNA, 25 bp, Homo sapien
agaactctcaccaggttggcgcctg

SEQ ID NO: 88614 - DNA, 25 bp, Homo sapien
ccaggttggcgcctgaatgccttac

SEQ ID NO: 88615 - DNA, 25 bp, Homo sapien
tactctcagcagtcagaggcttgct

SEQ ID NO: 88616 - DNA, 25 bp, Homo sapien
agcagtcagaggcttgcttgctctg

SEQ ID NO: 88617 - DNA, 25 bp, Homo sapien
ccctaggctggttgggacctctaca

SEQ ID NO: 88618 - DNA, 25 bp, Homo sapien
ttgggacctctacagcttcattctt

SEQ ID NO: 88619 - DNA, 25 bp, Homo sapien
agcttcattctttcacattaaatag

SEQ ID NO: 88620 - DNA, 25 bp, Homo sapien
gcatctgtgtgatggttccattgat

SEQ ID NO: 88621 - DNA, 25 bp, Homo sapien
gttccattgatgtgggatttcccta

SEQ ID NO: 88622 - DNA, 25 bp, Homo sapien
gatttccctacttgctgtattctca

SEQ ID NO: 88623 - DNA, 25 bp, Homo sapien
tacttgctgtattctcagtttctaa

SEQ ID NO: 88624 - DNA, 25 bp, Homo sapien
aatacacaagttatcctgaccctat

SEQ ID NO: 88625 - DNA, 25 bp, Homo sapien
tcctgaccctatattgttgatgaaa

SEQ ID NO: 88626 - DNA, 25 bp, Homo sapien
tggactctattccatctatcaaggg

SEQ ID NO: 88627 - DNA, 25 bp, Homo sapien
gtttctgtaacaaatgagcacttga

SEQ ID NO: 88628 - DNA, 25 bp, Homo sapien
tgagcacttgatagacatggaccat

SEQ ID NO: 88629 - DNA, 25 bp, Homo sapien
ggaccatgaagccagttttttcggg

SEQ ID NO: 88630 - DNA, 25 bp, Homo sapien
gcctttttagttggctaactgacct

SEQ ID NO: 88631 - DNA, 25 bp, Homo sapien
ttagttggctaactgacctggaaag

SEQ ID NO: 88632 - DNA, 25 bp, Homo sapien
aaaagcaataacctcaaagtgacta

SEQ ID NO: 88633 - DNA, 25 bp, Homo sapien
aaagtgactattcagttttcaggat

SEQ ID NO: 88634 - DNA, 25 bp, Homo sapien
cagttttcaggatgatacactatga

SEQ ID NO: 88635 - DNA, 25 bp, Homo sapien
ggtatggtttgttatggtcgtgtca

SEQ ID NO: 88636 - DNA, 25 bp, Homo sapien
tggtcgtgtcatagatactggagaa

SEQ ID NO: 88637 - DNA, 25 bp, Homo sapien
agcgatttgtgggtagtgtctcatg

SEQ ID NO: 88638 - DNA, 25 bp, Homo sapien
tctcatggtacagtggaaacagctc

SEQ ID NO: 88639 - DNA, 25 bp, Homo sapien
gaaacagctcagtcacagggtgtga

SEQ ID NO: 88640 - DNA, 25 bp, Homo sapien
tgtgaatttgagtcctggctctgct

SEQ ID NO: 88641 - DNA, 25 bp, Homo sapien
ctctgctttgtgactgggcttgaga

SEQ ID NO: 88642 - DNA, 25 bp, Homo sapien
ggcttgagaactctgggctgaccta

SEQ ID NO: 88643 - DNA, 25 bp, Homo sapien
gggctgacctataaaaacctgacat

SEQ ID NO: 88644 - DNA, 25 bp, Homo sapien
aaccagtgggtttgtccccatgaga

SEQ ID NO: 88645 - DNA, 25 bp, Homo sapien
gaagtcatggctaaactatgcatag

SEQ ID NO: 88646 - DNA, 25 bp, Homo sapien
ccatctttctccacttcccccaggt

SEQ ID NO: 88647 - DNA, 25 bp, Homo sapien
catctttctccacttcccccaggtc

SEQ ID NO: 88648 - DNA, 25 bp, Homo sapien
cccaggtcttggttttgagaaacag

SEQ ID NO: 88649 - DNA, 25 bp, Homo sapien
ccaggtcttggttttgagaaacagc

SEQ ID NO: 88650 - DNA, 25 bp, Homo sapien
caggtcttggttttgagaaacagca

SEQ ID NO: 88651 - DNA, 25 bp, Homo sapien
ttgagaaacagcaggcatggctgag

SEQ ID NO: 88652 - DNA, 25 bp, Homo sapien
tgagaaacagcaggcatggctgagt

SEQ ID NO: 88653 - DNA, 25 bp, Homo sapien
gagaaacagcaggcatggctgagtg

SEQ ID NO: 88654 - DNA, 25 bp, Homo sapien
gcatttattcgtttaatgactactg

SEQ ID NO: 88655 - DNA, 25 bp, Homo sapien
atgactactgatacgaatctcaagc

SEQ ID NO: 88656 - DNA, 25 bp, Homo sapien
gaatctcaagcagatttcttgctct

SEQ ID NO: 88657 - DNA, 25 bp, Homo sapien
gcagatttcttgctcttaaaagtta

SEQ ID NO: 88658 - DNA, 25 bp, Homo sapien
gttatgtttcactgagttctggttt

SEQ ID NO: 88659 - DNA, 25 bp, Homo sapien
gagttctggttttgtgtagctatat

SEQ ID NO: 88660 - DNA, 25 bp, Homo sapien
tatagctagatattcctcacagtga

SEQ ID NO: 88661 - DNA, 25 bp, Homo sapien
ataatttcagattattgcacgtctg

SEQ ID NO: 88662 - DNA, 25 bp, Homo sapien
tgcacgtctgtgatttgagaggtga

SEQ ID NO: 88663 - DNA, 25 bp, Homo sapien
ttaagaggccagttttcaggacatg

SEQ ID NO: 88664 - DNA, 25 bp, Homo sapien
gaattgtaaacctgttatctctgtg

SEQ ID NO: 88665 - DNA, 25 bp, Homo sapien
caggccatcccgagggtcatcatgg

SEQ ID NO: 88666 - DNA, 25 bp, Homo sapien
catcccgagggtcatcatggccatt

SEQ ID NO: 88667 - DNA, 25 bp, Homo sapien
atcccgagggtcatcatggccattc

SEQ ID NO: 88668 - DNA, 25 bp, Homo sapien
tcccgagggtcatcatggccattcg

SEQ ID NO: 88669 - DNA, 25 bp, Homo sapien
cgagggtcatcatggccattcgcca

SEQ ID NO: 88670 - DNA, 25 bp, Homo sapien
gagggtcatcatggccattcgccag

SEQ ID NO: 88671 - DNA, 25 bp, Homo sapien
ggtcatcatggccattcgccagtgt

SEQ ID NO: 88672 - DNA, 25 bp, Homo sapien
gtcatcatggccattcgccagtgtt

SEQ ID NO: 88673 - DNA, 25 bp, Homo sapien
tcatcatggccattcgccagtgttt

SEQ ID NO: 88674 - DNA, 25 bp, Homo sapien
atcatggccattcgccagtgttttg

SEQ ID NO: 88675 - DNA, 25 bp, Homo sapien
catggccattcgccagtgttttggg

SEQ ID NO: 88676 - DNA, 25 bp, Homo sapien
actgcacacgtgtacagcggagtac

SEQ ID NO: 88677 - DNA, 25 bp, Homo sapien
gtacgaaaaggaacgttgtccacag

SEQ ID NO: 88678 - DNA, 25 bp, Homo sapien
gggatttatggatacaacagcaaac

SEQ ID NO: 88679 - DNA, 25 bp, Homo sapien
aaactatgcacatgcattacacaca

SEQ ID NO: 88680 - DNA, 25 bp, Homo sapien
acacatgtgcaaacatagccacttt

SEQ ID NO: 88681 - DNA, 25 bp, Homo sapien
catagccacttttttgtcaagagtt

SEQ ID NO: 88682 - DNA, 25 bp, Homo sapien
gggctccttaaaccagaatgggagt

SEQ ID NO: 88683 - DNA, 25 bp, Homo sapien
gagagatcatactccagctgaagtt

SEQ ID NO: 88684 - DNA, 25 bp, Homo sapien
ctccagctgaagtttgttgaccctt

SEQ ID NO: 88685 - DNA, 25 bp, Homo sapien
gctgaagtttgttgacccttttcta

SEQ ID NO: 88686 - DNA, 25 bp, Homo sapien
cagggagatgagactcttttaatct

SEQ ID NO: 88687 - DNA, 25 bp, Homo sapien
caaagagatcctccgagtaattggt

SEQ ID NO: 88688 - DNA, 25 bp, Homo sapien
atcctccgagtaattggtgatcaaa

SEQ ID NO: 88689 - DNA, 25 bp, Homo sapien
attggtgatcaaactgctactggtt

SEQ ID NO: 88690 - DNA, 25 bp, Homo sapien
gctactggttaaaggaccaccattt

SEQ ID NO: 88691 - DNA, 25 bp, Homo sapien
acatgattcgaaagccttcctcggg

SEQ ID NO: 88692 - DNA, 25 bp, Homo sapien
tcgaaagccttcctcgggttcaaag

SEQ ID NO: 88693 - DNA, 25 bp, Homo sapien
agccttcctcgggttcaaagctgga

SEQ ID NO: 88694 - DNA, 25 bp, Homo sapien
tcctcgggttcaaagctggattttg

SEQ ID NO: 88695 - DNA, 25 bp, Homo sapien
ttagtatttctaagtatctcattaa

SEQ ID NO: 88696 - DNA, 25 bp, Homo sapien
ttatcaattgtagggttatggaatc

SEQ ID NO: 88697 - DNA, 25 bp, Homo sapien
tttcaacagcacttaaactgaagtt

SEQ ID NO: 88698 - DNA, 25 bp, Homo sapien
taatgataccttaaattactcagga

SEQ ID NO: 88699 - DNA, 25 bp, Homo sapien
tactcaggacttaatgtagcattgc

SEQ ID NO: 88700 - DNA, 25 bp, Homo sapien
taatgtagcattgcacttctgtgta

SEQ ID NO: 88701 - DNA, 25 bp, Homo sapien
tgcacttctgtgtacagtaaaactg

SEQ ID NO: 88702 - DNA, 25 bp, Homo sapien
gtgtacagtaaaactgctttgtttt

SEQ ID NO: 88703 - DNA, 25 bp, Homo sapien
gtatacattctgtacagtagttcca

SEQ ID NO: 88704 - DNA, 25 bp, Homo sapien
cattctgtacagtagttccatcaaa

SEQ ID NO: 88705 - DNA, 25 bp, Homo sapien
tgtacagtagttccatcaaaatatg

SEQ ID NO: 88706 - DNA, 25 bp, Homo sapien
atatgtaataattcacaccaatttt

SEQ ID NO: 88707 - DNA, 25 bp, Homo sapien
caaaatttaaattgagctgctatca

SEQ ID NO: 88708 - DNA, 25 bp, Homo sapien
ttgagctgctatcaatattaaatga

SEQ ID NO: 88709 - DNA, 25 bp, Homo sapien
gacttgcgcaagcatgaacgcaccc

SEQ ID NO: 88710 - DNA, 25 bp, Homo sapien
tggtggctttgctaggaatgcctga

SEQ ID NO: 88711 - DNA, 25 bp, Homo sapien
ggctttgctaggaatgcctgaagag

SEQ ID NO: 88712 - DNA, 25 bp, Homo sapien
gcttcctgtacctccttttgcctgg

SEQ ID NO: 88713 - DNA, 25 bp, Homo sapien
ttttgcctggctctgctctttagac

SEQ ID NO: 88714 - DNA, 25 bp, Homo sapien
tggctctgctctttagactccagat

SEQ ID NO: 88715 - DNA, 25 bp, Homo sapien
tgctctttagactccagatccctac

SEQ ID NO: 88716 - DNA, 25 bp, Homo sapien
tagctcccctgtcggccagctaaga

SEQ ID NO: 88717 - DNA, 25 bp, Homo sapien
ccctgtcggccagctaagagagctg

SEQ ID NO: 88718 - DNA, 25 bp, Homo sapien
gcagaagctgagacgtgactgtcta

SEQ ID NO: 88719 - DNA, 25 bp, Homo sapien
agacgtgactgtctaggagtaacac

SEQ ID NO: 88720 - DNA, 25 bp, Homo sapien
ttgttcctcttatttcctctatgta

SEQ ID NO: 88721 - DNA, 25 bp, Homo sapien
cctctatgtaggaagttgtgtctta

SEQ ID NO: 88722 - DNA, 25 bp, Homo sapien
tgtgtcttaggcaactttatcagta

SEQ ID NO: 88723 - DNA, 25 bp, Homo sapien
aggcactacaatgaaatggcaggat

SEQ ID NO: 88724 - DNA, 25 bp, Homo sapien
ggcaggatgccaatatgagatattt

SEQ ID NO: 88725 - DNA, 25 bp, Homo sapien
caagaaagttttcaacgacagtgat

SEQ ID NO: 88726 - DNA, 25 bp, Homo sapien
acgacagtgatagtgttcatttgta

SEQ ID NO: 88727 - DNA, 25 bp, Homo sapien
gagttctagaacttcgatgtccagt

SEQ ID NO: 88728 - DNA, 25 bp, Homo sapien
acttcgatgtccagtgcagtagcca

SEQ ID NO: 88729 - DNA, 25 bp, Homo sapien
gcagtagccactacccatatgtagc

SEQ ID NO: 88730 - DNA, 25 bp, Homo sapien
tacccatatgtagctgttgagcatt

SEQ ID NO: 88731 - DNA, 25 bp, Homo sapien
cagtctctgggtcacccgaattttc

SEQ ID NO: 88732 - DNA, 25 bp, Homo sapien
tcttgagcaagttgggacttgggct

SEQ ID NO: 88733 - DNA, 25 bp, Homo sapien
caggaggcccggaccagttgggagg

SEQ ID NO: 88734 - DNA, 25 bp, Homo sapien
ttgggaggagtgagcaggccccggg

SEQ ID NO: 88735 - DNA, 25 bp, Homo sapien
ggatgagcgcagtttgctcgctttc

SEQ ID NO: 88736 - DNA, 25 bp, Homo sapien
tgagcgcagtttgctcgctttcctc

SEQ ID NO: 88737 - DNA, 25 bp, Homo sapien
acacacactcgggacgtcttcattg

SEQ ID NO: 88738 - DNA, 25 bp, Homo sapien
acacactcgggacgtcttcattgaa

SEQ ID NO: 88739 - DNA, 25 bp, Homo sapien
acactcgggacgtcttcattgaaga

SEQ ID NO: 88740 - DNA, 25 bp, Homo sapien
actcgggacgtcttcattgaagatt

SEQ ID NO: 88741 - DNA, 25 bp, Homo sapien
gtcttcattgaagattcacttacaa

SEQ ID NO: 88742 - DNA, 25 bp, Homo sapien
catctttctccacttcccccaggtc

SEQ ID NO: 88743 - DNA, 25 bp, Homo sapien
cccaggtcttggttttgagaaacag

SEQ ID NO: 88744 - DNA, 25 bp, Homo sapien
ccaggtcttggttttgagaaacagc

SEQ ID NO: 88745 - DNA, 25 bp, Homo sapien
caggtcttggttttgagaaacagca

SEQ ID NO: 88746 - DNA, 25 bp, Homo sapien
aggtcttggttttgagaaacagcag

SEQ ID NO: 88747 - DNA, 25 bp, Homo sapien
ttgagaaacagcaggcatggctgag

SEQ ID NO: 88748 - DNA, 25 bp, Homo sapien
tgagaaacagcaggcatggctgagt

SEQ ID NO: 88749 - DNA, 25 bp, Homo sapien
agaaacagcaggcatggctgagtgc

SEQ ID NO: 88750 - DNA, 25 bp, Homo sapien
aaacagcaggcatggctgagtgcgg

SEQ ID NO: 88751 - DNA, 25 bp, Homo sapien
aacagcaggcatggctgagtgcggt

SEQ ID NO: 88752 - DNA, 25 bp, Homo sapien
cagcaggcatggctgagtgcggtgg

SEQ ID NO: 88753 - DNA, 25 bp, Homo sapien
aacagaaactctgaggatggccttt

SEQ ID NO: 88754 - DNA, 25 bp, Homo sapien
agaaactctgaggatggcctttatg

SEQ ID NO: 88755 - DNA, 25 bp, Homo sapien
aactctgaggatggcctttatgagg

SEQ ID NO: 88756 - DNA, 25 bp, Homo sapien
tgaggatggcctttatgagggagct

SEQ ID NO: 88757 - DNA, 25 bp, Homo sapien
tgtacccgtcgaatggagttttgat

SEQ ID NO: 88758 - DNA, 25 bp, Homo sapien
tacccgtcgaatggagttttgatct

SEQ ID NO: 88759 - DNA, 25 bp, Homo sapien
cgtcgaatggagttttgatctcgct

SEQ ID NO: 88760 - DNA, 25 bp, Homo sapien
ggaaaggagtggtcttggttcaaat

SEQ ID NO: 88761 - DNA, 25 bp, Homo sapien
agtggtcttggttcaaatgtgactc

SEQ ID NO: 88762 - DNA, 25 bp, Homo sapien
ggtcttggttcaaatgtgactcact

SEQ ID NO: 88763 - DNA, 25 bp, Homo sapien
tcttggttcaaatgtgactcacttt

SEQ ID NO: 88764 - DNA, 25 bp, Homo sapien
agaacccacatccactcaatgtgaa

SEQ ID NO: 88765 - DNA, 25 bp, Homo sapien
aatgtgaactctactaccacgacct

SEQ ID NO: 88766 - DNA, 25 bp, Homo sapien
ttttgcacaggttaaggccagttat

SEQ ID NO: 88767 - DNA, 25 bp, Homo sapien
gccagttatggcctttttgaaatct

SEQ ID NO: 88768 - DNA, 25 bp, Homo sapien
ttgaaatctgtaatagctccccttt

SEQ ID NO: 88769 - DNA, 25 bp, Homo sapien
tctaaagcctagaccttaaacctgt

SEQ ID NO: 88770 - DNA, 25 bp, Homo sapien
gaccttaaacctgttcctagagcta

SEQ ID NO: 88771 - DNA, 25 bp, Homo sapien
aaacctgttcctagagctatgcaca

SEQ ID NO: 88772 - DNA, 25 bp, Homo sapien
agggcctccgtgacactccatgaaa

SEQ ID NO: 88773 - DNA, 25 bp, Homo sapien
gacactccatgaaaagaagttcttg

SEQ ID NO: 88774 - DNA, 25 bp, Homo sapien
gaagttcttgcataccggaaagttg

SEQ ID NO: 88775 - DNA, 25 bp, Homo sapien
tggcagcacagatatacctcatttt

SEQ ID NO: 88776 - DNA, 25 bp, Homo sapien
gatattctctctaaaattatgtgca

SEQ ID NO: 88777 - DNA, 25 bp, Homo sapien
tgttaaacacattttggcagtgtgc

SEQ ID NO: 88778 - DNA, 25 bp, Homo sapien
aagtgttgtgtcaaagctttctagt

SEQ ID NO: 88779 - DNA, 25 bp, Homo sapien
aaagctttctagtgacggtcagtcc

SEQ ID NO: 88780 - DNA, 25 bp, Homo sapien
ctagtgacggtcagtcctactgcag

SEQ ID NO: 88781 - DNA, 25 bp, Homo sapien
gcagtatgtcaggtttgctcacaat

SEQ ID NO: 88782 - DNA, 25 bp, Homo sapien
gctcacaatgaggtattcccacata

SEQ ID NO: 88783 - DNA, 25 bp, Homo sapien
taacaatgcatgtattacccagaat

SEQ ID NO: 88784 - DNA, 25 bp, Homo sapien
acccagaatttaatgttgcgtacct

SEQ ID NO: 88785 - DNA, 25 bp, Homo sapien
tgttgcgtaccttatgttcaatgag

SEQ ID NO: 88786 - DNA, 25 bp, Homo sapien
aatcatagcctaacagaacactttg

SEQ ID NO: 88787 - DNA, 25 bp, Homo sapien
agaacactttgaaagctcttttatt

SEQ ID NO: 88788 - DNA, 25 bp, Homo sapien
ttacatcctttgaagggagtgcttc

SEQ ID NO: 88789 - DNA, 25 bp, Homo sapien
tatatttatgcatagcaagccttca

SEQ ID NO: 88790 - DNA, 25 bp, Homo sapien
atagcaagccttcatgaacggaagt

SEQ ID NO: 88791 - DNA, 25 bp, Homo sapien
gaacggaagtgacacactctggatt

SEQ ID NO: 88792 - DNA, 25 bp, Homo sapien
gacacactctggattgaataatact

SEQ ID NO: 88793 - DNA, 25 bp, Homo sapien
taatactgtagcctcattcatatgt

SEQ ID NO: 88794 - DNA, 25 bp, Homo sapien
gcctcattcatatgtagttattcaa

SEQ ID NO: 88795 - DNA, 25 bp, Homo sapien
caaattggattaatgtctgtgtgag

SEQ ID NO: 88796 - DNA, 25 bp, Homo sapien
aatgtctgtgtgagtttatttgaac

SEQ ID NO: 88797 - DNA, 25 bp, Homo sapien
acattattttcaggctattcttaga

SEQ ID NO: 88798 - DNA, 25 bp, Homo sapien
attattttcaggctattcttagata

SEQ ID NO: 88799 - DNA, 25 bp, Homo sapien
ttattttcaggctattcttagatat

SEQ ID NO: 88800 - DNA, 25 bp, Homo sapien
attttcaggctattcttagatatac

SEQ ID NO: 88801 - DNA, 25 bp, Homo sapien
ttttcaggctattcttagatataca

SEQ ID NO: 88802 - DNA, 25 bp, Homo sapien
ttcaggctattcttagatatacaag

SEQ ID NO: 88803 - DNA, 25 bp, Homo sapien
caggctattcttagatatacaagtt

SEQ ID NO: 88804 - DNA, 25 bp, Homo sapien
ggctattcttagatatacaagttgt

SEQ ID NO: 88805 - DNA, 25 bp, Homo sapien
atatacaagttgttaggccaggtgc

SEQ ID NO: 88806 - DNA, 25 bp, Homo sapien
tatacaagttgttaggccaggtgca

SEQ ID NO: 88807 - DNA, 25 bp, Homo sapien
atacaagttgttaggccaggtgcaa

SEQ ID NO: 88808 - DNA, 25 bp, Homo sapien
tttcttactctgaatttagatctcc

SEQ ID NO: 88809 - DNA, 25 bp, Homo sapien
tgaatttagatctccagaccctgcc

SEQ ID NO: 88810 - DNA, 25 bp, Homo sapien
cctgcctggccacaattcaaattaa

SEQ ID NO: 88811 - DNA, 25 bp, Homo sapien
tataccttccatgaagcacacacag

SEQ ID NO: 88812 - DNA, 25 bp, Homo sapien
gaagcacacacagacttttgaaagc

SEQ ID NO: 88813 - DNA, 25 bp, Homo sapien
atgactgcttgaattgaggccttga

SEQ ID NO: 88814 - DNA, 25 bp, Homo sapien
tgcttgaattgaggccttgaggaat

SEQ ID NO: 88815 - DNA, 25 bp, Homo sapien
ccacactcttcatgtgttaaccact

SEQ ID NO: 88816 - DNA, 25 bp, Homo sapien
tcttcatgtgttaaccactgccttc

SEQ ID NO: 88817 - DNA, 25 bp, Homo sapien
agccacggtgactgtattacatgtt

SEQ ID NO: 88818 - DNA, 25 bp, Homo sapien
gattttagagttctgatcgttcaag

SEQ ID NO: 88819 - DNA, 25 bp, Homo sapien
gtaacaagaaaacagtctctcccat

SEQ ID NO: 88820 - DNA, 25 bp, Homo sapien
gtctctcccattctctagtactgct

SEQ ID NO: 88821 - DNA, 25 bp, Homo sapien
gtcacttccagttcattcagctatt

SEQ ID NO: 88822 - DNA, 25 bp, Homo sapien
gtgcttatatgactcttgcttgata

SEQ ID NO: 88823 - DNA, 25 bp, Homo sapien
ttagacattacctgttgactccctg

SEQ ID NO: 88824 - DNA, 25 bp, Homo sapien
gttgactccctgttgtcatacatga

SEQ ID NO: 88825 - DNA, 25 bp, Homo sapien
tgtcatacatgaggctttagctctc

SEQ ID NO: 88826 - DNA, 25 bp, Homo sapien
gctttagctctcttttgtcagcaac

SEQ ID NO: 88827 - DNA, 25 bp, Homo sapien
gattactatttctattactatgtga

SEQ ID NO: 88828 - DNA, 25 bp, Homo sapien
atgtgaaagttaactgcggagccaa

SEQ ID NO: 88829 - DNA, 25 bp, Homo sapien
actgcggagccaagagttggactat

SEQ ID NO: 88830 - DNA, 25 bp, Homo sapien
gatgctttttaactattgcttttta

SEQ ID NO: 88831 - DNA, 25 bp, Homo sapien
actattgctttttaacttgctgaga

SEQ ID NO: 88832 - DNA, 25 bp, Homo sapien
gctttttaacttgctgagatttaga

SEQ ID NO: 88833 - DNA, 25 bp, Homo sapien
taacttgctgagatttagaaatact

SEQ ID NO: 88834 - DNA, 25 bp, Homo sapien
tttctgtattgtatcttcatgggac

SEQ ID NO: 88835 - DNA, 25 bp, Homo sapien
attgtatcttcatgggacattaggg

SEQ ID NO: 88836 - DNA, 25 bp, Homo sapien
taggggttttctatggtaagcacac

SEQ ID NO: 88837 - DNA, 25 bp, Homo sapien
aatatatatccagacggttcttccc

SEQ ID NO: 88838 - DNA, 25 bp, Homo sapien
aacaagtctttacacctgataaaat

SEQ ID NO: 88839 - DNA, 25 bp, Homo sapien
attttgcgaagagaggtgttctttt

SEQ ID NO: 88840 - DNA, 25 bp, Homo sapien
cttactggtgctgaaaggaaggatg

SEQ ID NO: 88841 - DNA, 25 bp, Homo sapien
actgcctgagtgcaccatagtgtcc

SEQ ID NO: 88842 - DNA, 25 bp, Homo sapien
cagtatgtgctgtgggcatcctgag

SEQ ID NO: 88843 - DNA, 25 bp, Homo sapien
gtgggcatcctgagaagcctgaaaa

SEQ ID NO: 88844 - DNA, 25 bp, Homo sapien
taggcttgggtgagctgctttctgc

SEQ ID NO: 88845 - DNA, 25 bp, Homo sapien
ttctgccttcttggtacacacagta

SEQ ID NO: 88846 - DNA, 25 bp, Homo sapien
cagtggagaggcgtgttacaccgta

SEQ ID NO: 88847 - DNA, 25 bp, Homo sapien
gcgtgttacaccgtatctgttctat

SEQ ID NO: 88848 - DNA, 25 bp, Homo sapien
gtatctgttctatcctcatctaaat

SEQ ID NO: 88849 - DNA, 25 bp, Homo sapien
tcatctaaatactgagaggctagtt

SEQ ID NO: 88850 - DNA, 25 bp, Homo sapien
ggctagttgggatagtaaatctttc

SEQ ID NO: 88851 - DNA, 25 bp, Homo sapien
aaatctttcttactacatatgcatt

SEQ ID NO: 88852 - DNA, 25 bp, Homo sapien
gggccttcatcaaagagaagaccat

SEQ ID NO: 88853 - DNA, 25 bp, Homo sapien
ttcatcaaagagaagaccatgttgg

SEQ ID NO: 88854 - DNA, 25 bp, Homo sapien
tcatcaaagagaagaccatgttggc

SEQ ID NO: 88855 - DNA, 25 bp, Homo sapien
catcaaagagaagaccatgttggcc

SEQ ID NO: 88856 - DNA, 25 bp, Homo sapien
atcaaagagaagaccatgttggccg

SEQ ID NO: 88857 - DNA, 25 bp, Homo sapien
tcaaagagaagaccatgttggccgg

SEQ ID NO: 88858 - DNA, 25 bp, Homo sapien
caaagagaagaccatgttggccggg

SEQ ID NO: 88859 - DNA, 25 bp, Homo sapien
gtggctcacgcttatgtagtcccag

SEQ ID NO: 88860 - DNA, 25 bp, Homo sapien
ggctcacgcttatgtagtcccagtt

SEQ ID NO: 88861 - DNA, 25 bp, Homo sapien
gctcacgcttatgtagtcccagtta

SEQ ID NO: 88862 - DNA, 25 bp, Homo sapien
ctcacgcttatgtagtcccagttac

SEQ ID NO: 88863 - DNA, 25 bp, Homo sapien
atccttttccaagcgtctgccagga

SEQ ID NO: 88864 - DNA, 25 bp, Homo sapien
aacctcactacccacagaaagttgt

SEQ ID NO: 88865 - DNA, 25 bp, Homo sapien
ctacccacagaaagttgttcagatg

SEQ ID NO: 88866 - DNA, 25 bp, Homo sapien
cagatgagtctgacagtgagctgag

SEQ ID NO: 88867 - DNA, 25 bp, Homo sapien
gacagtgagctgagccagaagctag

SEQ ID NO: 88868 - DNA, 25 bp, Homo sapien
ttctttggaagtgaaggctaagcct

SEQ ID NO: 88869 - DNA, 25 bp, Homo sapien
gaaggctaagcctgcttctggccta

SEQ ID NO: 88870 - DNA, 25 bp, Homo sapien
gcttctggcctagatggtaatttca

SEQ ID NO: 88871 - DNA, 25 bp, Homo sapien
ggtaatttcaatagcatccgaatgg

SEQ ID NO: 88872 - DNA, 25 bp, Homo sapien
gtgaagacaggatcccgtgcttaaa

SEQ ID NO: 88873 - DNA, 25 bp, Homo sapien
ctaatatccttttccaagcgtctgc

SEQ ID NO: 88874 - DNA, 25 bp, Homo sapien
gaaaggatagctacagtgagatacc

SEQ ID NO: 88875 - DNA, 25 bp, Homo sapien
gtgagatacctgtacttggaaactg

SEQ ID NO: 88876 - DNA, 25 bp, Homo sapien
gatacctgtacttggaaactgtaaa

SEQ ID NO: 88877 - DNA, 25 bp, Homo sapien
aatgctaaatgctcaggaagagaca

SEQ ID NO: 88878 - DNA, 25 bp, Homo sapien
gagacagagacacaccagcttcaag

SEQ ID NO: 88879 - DNA, 25 bp, Homo sapien
ccagcttcaaggatagtggtggcct

SEQ ID NO: 88880 - DNA, 25 bp, Homo sapien
atgacaaaatatgaacccctggtaa

SEQ ID NO: 88881 - DNA, 25 bp, Homo sapien
gaacccctggtaaatctgggcaatg

SEQ ID NO: 88882 - DNA, 25 bp, Homo sapien
aaatctgggcaatgagttccccaat

SEQ ID NO: 88883 - DNA, 25 bp, Homo sapien
tgggcaatgagttccccaatgtcta

SEQ ID NO: 88884 - DNA, 25 bp, Homo sapien
caatgtctactatattattttctac

SEQ ID NO: 88885 - DNA, 25 bp, Homo sapien
gtccttgtggatgggtattctccca

SEQ ID NO: 88886 - DNA, 25 bp, Homo sapien
ttctcccaacagaaatgagccctta

SEQ ID NO: 88887 - DNA, 25 bp, Homo sapien
gcccttaactgggaattctgacctt

SEQ ID NO: 88888 - DNA, 25 bp, Homo sapien
tgtcatcttcatcggcttggcagga

SEQ ID NO: 88889 - DNA, 25 bp, Homo sapien
tgggactcatcacatgcctgatctg

SEQ ID NO: 88890 - DNA, 25 bp, Homo sapien
acatgcctgatctgcggtgtcctgg

SEQ ID NO: 88891 - DNA, 25 bp, Homo sapien
gagaatacaacgtccagcaacagtg

SEQ ID NO: 88892 - DNA, 25 bp, Homo sapien
acagtgcccaggctactaccagtca

SEQ ID NO: 88893 - DNA, 25 bp, Homo sapien
cagtcacacctagacctggaggatc

SEQ ID NO: 88894 - DNA, 25 bp, Homo sapien
acctggaggatctgcaatgactgga

SEQ ID NO: 88895 - DNA, 25 bp, Homo sapien
aatgactggaacttgccggtgcctg

SEQ ID NO: 88896 - DNA, 25 bp, Homo sapien
aaaacctgttctgcagtgagagatt

SEQ ID NO: 88897 - DNA, 25 bp, Homo sapien
actgttctcatagttagttgactca

SEQ ID NO: 88898 - DNA, 25 bp, Homo sapien
atagttagttgactcatatggtaga

SEQ ID NO: 88899 - DNA, 25 bp, Homo sapien
tagagaggactttacatgaaatcag

SEQ ID NO: 88900 - DNA, 25 bp, Homo sapien
atagttttttagatacccagaagct

SEQ ID NO: 88901 - DNA, 25 bp, Homo sapien
tttttagatacccagaagcttgttc

SEQ ID NO: 88902 - DNA, 25 bp, Homo sapien
ttctgggagaagctagggcgggtca

SEQ ID NO: 88903 - DNA, 25 bp, Homo sapien
gtcagagtagacctgatgggtaact

SEQ ID NO: 88904 - DNA, 25 bp, Homo sapien
atgggtaactcaggtaaagatgctt

SEQ ID NO: 88905 - DNA, 25 bp, Homo sapien
tttcttttatctgaactacttaatg

SEQ ID NO: 88906 - DNA, 25 bp, Homo sapien
gaactacttaatgattgctttactt

SEQ ID NO: 88907 - DNA, 25 bp, Homo sapien
tgcaaaacatcgaagaattcatagt

SEQ ID NO: 88908 - DNA, 25 bp, Homo sapien
gcaaaacatcgaagaattcatagtg

SEQ ID NO: 88909 - DNA, 25 bp, Homo sapien
caaaacatcgaagaattcatagtgg

SEQ ID NO: 88910 - DNA, 25 bp, Homo sapien
aaaacatcgaagaattcatagtgga

SEQ ID NO: 88911 - DNA, 25 bp, Homo sapien
aaacatcgaagaattcatagtggat

SEQ ID NO: 88912 - DNA, 25 bp, Homo sapien
aacatcgaagaattcatagtggata

SEQ ID NO: 88913 - DNA, 25 bp, Homo sapien
acatcgaagaattcatagtggatag

SEQ ID NO: 88914 - DNA, 25 bp, Homo sapien
catcgaagaattcatagtggataga

SEQ ID NO: 88915 - DNA, 25 bp, Homo sapien
atcgaagaattcatagtggatagaa

SEQ ID NO: 88916 - DNA, 25 bp, Homo sapien
gatagaaaccttacaaaggacgccg

SEQ ID NO: 88917 - DNA, 25 bp, Homo sapien
cttacaaaggacgccgggcgtggtg

SEQ ID NO: 88918 - DNA, 25 bp, Homo sapien
tgtgtgtggagacaaggctttgcca

SEQ ID NO: 88919 - DNA, 25 bp, Homo sapien
gagctaccacgcctatccaatttct

SEQ ID NO: 88920 - DNA, 25 bp, Homo sapien
ccacgcctatccaatttctggttta

SEQ ID NO: 88921 - DNA, 25 bp, Homo sapien
ttctggtttatttactttcgatggt

SEQ ID NO: 88922 - DNA, 25 bp, Homo sapien
actttcgatggttaaatgcctcctt

SEQ ID NO: 88923 - DNA, 25 bp, Homo sapien
ggttaaatgcctccttattcaaata

SEQ ID NO: 88924 - DNA, 25 bp, Homo sapien
gcctccttattcaaatatcctgtat

SEQ ID NO: 88925 - DNA, 25 bp, Homo sapien
tatcctgtatatatactggcgtttc

SEQ ID NO: 88926 - DNA, 25 bp, Homo sapien
tatatactggcgtttctgtcctgat

SEQ ID NO: 88927 - DNA, 25 bp, Homo sapien
ggcgtttctgtcctgatgtcaagtc

SEQ ID NO: 88928 - DNA, 25 bp, Homo sapien
ctgtcctgatgtcaagtctcgagag

SEQ ID NO: 88929 - DNA, 25 bp, Homo sapien
agccctgctgagaaaggacctccga

SEQ ID NO: 88930 - DNA, 25 bp, Homo sapien
aaaggacctccgatgcttgggagac

SEQ ID NO: 88931 - DNA, 25 bp, Homo sapien
tccgatgcttgggagacgctgctcc

SEQ ID NO: 88932 - DNA, 25 bp, Homo sapien
tgcagccccggaagtttgtccatgg

SEQ ID NO: 88933 - DNA, 25 bp, Homo sapien
gctcatggaactgcgagacccggga

SEQ ID NO: 88934 - DNA, 25 bp, Homo sapien
atggaactgcgagacccgggaccct

SEQ ID NO: 88935 - DNA, 25 bp, Homo sapien
gggcatggcgtgacttctcgtgcac

SEQ ID NO: 88936 - DNA, 25 bp, Homo sapien
tgacttctcgtgcacagggctggtt

SEQ ID NO: 88937 - DNA, 25 bp, Homo sapien
cacagggctggtttggttatgagac

SEQ ID NO: 88938 - DNA, 25 bp, Homo sapien
gctggtttggttatgagacgatctc

SEQ ID NO: 88939 - DNA, 25 bp, Homo sapien
tatgagacgatctcgctgggaccgc

SEQ ID NO: 88940 - DNA, 25 bp, Homo sapien
tctggatatattgggcctcttagta

SEQ ID NO: 88941 - DNA, 25 bp, Homo sapien
atattgggcctcttagtattttttg

SEQ ID NO: 88942 - DNA, 25 bp, Homo sapien
tgggcctcttagtattttttggagt

SEQ ID NO: 88943 - DNA, 25 bp, Homo sapien
aatgattgcttgtttatgtccagac

SEQ ID NO: 88944 - DNA, 25 bp, Homo sapien
atgtccagacagacttattttttat

SEQ ID NO: 88945 - DNA, 25 bp, Homo sapien
tattctaatgatggtagcaccactg

SEQ ID NO: 88946 - DNA, 25 bp, Homo sapien
gatggtagcaccactgatcttggat

SEQ ID NO: 88947 - DNA, 25 bp, Homo sapien
gcaccactgatcttggatgtacatt

SEQ ID NO: 88948 - DNA, 25 bp, Homo sapien
ttgtaatttcccacatttgtacatg

SEQ ID NO: 88949 - DNA, 25 bp, Homo sapien
ttcccacatttgtacatgtgctttt

SEQ ID NO: 88950 - DNA, 25 bp, Homo sapien
ggtgtacataaagcttcaaatggca

SEQ ID NO: 88951 - DNA, 25 bp, Homo sapien
gaattgccatggacttgatactgaa

SEQ ID NO: 88952 - DNA, 25 bp, Homo sapien
ggcagattcccagcgttttagacag

SEQ ID NO: 88953 - DNA, 25 bp, Homo sapien
agacagtttatcttgctcacacctc

SEQ ID NO: 88954 - DNA, 25 bp, Homo sapien
ttgctcacacctcaaagcatgagtt

SEQ ID NO: 88955 - DNA, 25 bp, Homo sapien
gagttcacttccatccagtaaactg

SEQ ID NO: 88956 - DNA, 25 bp, Homo sapien
gaattctccgaatgtctgatcctga

SEQ ID NO: 88957 - DNA, 25 bp, Homo sapien
gaggacaaactacattgcctttcag

SEQ ID NO: 88958 - DNA, 25 bp, Homo sapien
ttgcctttcagacctgtgactcaag

SEQ ID NO: 88959 - DNA, 25 bp, Homo sapien
gtaacttaacatgccttgtcctgat

SEQ ID NO: 88960 - DNA, 25 bp, Homo sapien
acatgccttgtcctgatgttgaagg

SEQ ID NO: 88961 - DNA, 25 bp, Homo sapien
aaaattctggactctttgatataat

SEQ ID NO: 88962 - DNA, 25 bp, Homo sapien
atgtctttctggctgtctctatgtt

SEQ ID NO: 88963 - DNA, 25 bp, Homo sapien
tgtctctatgttcctcttctcttat

SEQ ID NO: 88964 - DNA, 25 bp, Homo sapien
tatgttcctcttctcttatcctcaa

SEQ ID NO: 88965 - DNA, 25 bp, Homo sapien
tcttctcttatcctcaactttctgt

SEQ ID NO: 88966 - DNA, 25 bp, Homo sapien
cctccttggtctccttttcgatatg

SEQ ID NO: 88967 - DNA, 25 bp, Homo sapien
tggtctccttttcgatatgccaaac

SEQ ID NO: 88968 - DNA, 25 bp, Homo sapien
tctccttttcgatatgccaaaccaa

SEQ ID NO: 88969 - DNA, 25 bp, Homo sapien
ttttcgatatgccaaaccaattttg

SEQ ID NO: 88970 - DNA, 25 bp, Homo sapien
aaccaattttgggtcgagtgcattt

SEQ ID NO: 88971 - DNA, 25 bp, Homo sapien
ggtcgagtgcatttaacgagaacaa

SEQ ID NO: 88972 - DNA, 25 bp, Homo sapien
aaggctcataacaacaagaacgttt

SEQ ID NO: 88973 - DNA, 25 bp, Homo sapien
tccccaaaatgggtgtatctggttt

SEQ ID NO: 88974 - DNA, 25 bp, Homo sapien
ttggtttcccaattctgtttgccat

SEQ ID NO: 88975 - DNA, 25 bp, Homo sapien
ataattgtgggtttgcacatggcca

SEQ ID NO: 88976 - DNA, 25 bp, Homo sapien
gccagcacatgccaaacagaagtag

SEQ ID NO: 88977 - DNA, 25 bp, Homo sapien
tagacaaaggtctcactctgtaagt

SEQ ID NO: 88978 - DNA, 25 bp, Homo sapien
ggtctcactctgtaagtgggacctt

SEQ ID NO: 88979 - DNA, 25 bp, Homo sapien
ggagctgcctccatcataaagggag

SEQ ID NO: 88980 - DNA, 25 bp, Homo sapien
aaatggtctcttaagcctgttcctg

SEQ ID NO: 88981 - DNA, 25 bp, Homo sapien
agcctgttcctgctacagttataga

SEQ ID NO: 88982 - DNA, 25 bp, Homo sapien
ttatagaggttgctcagaaccttct

SEQ ID NO: 88983 - DNA, 25 bp, Homo sapien
gaaccttctcagcaaatatagcagt

SEQ ID NO: 88984 - DNA, 25 bp, Homo sapien
ttcagtcattccttgtaggatatgg

SEQ ID NO: 88985 - DNA, 25 bp, Homo sapien
ttccttgtaggatatggtttagctg

SEQ ID NO: 88986 - DNA, 25 bp, Homo sapien
gtgcccccacctaaaatatcatctt

SEQ ID NO: 88987 - DNA, 25 bp, Homo sapien
ttgtaatccctataatccccacatc

SEQ ID NO: 88988 - DNA, 25 bp, Homo sapien
aatccctataatccccacatcaagg

SEQ ID NO: 88989 - DNA, 25 bp, Homo sapien
tttataagtttgatagttcctcctg

SEQ ID NO: 88990 - DNA, 25 bp, Homo sapien
ataagtttgatagttcctcctgtgt

SEQ ID NO: 88991 - DNA, 25 bp, Homo sapien
aagtttgatagttcctcctgtgttc

SEQ ID NO: 88992 - DNA, 25 bp, Homo sapien
gtttgatagttcctcctgtgttcat

SEQ ID NO: 88993 - DNA, 25 bp, Homo sapien
ttgatagttcctcctgtgttcattc

SEQ ID NO: 88994 - DNA, 25 bp, Homo sapien
gatagttcctcctgtgttcattctc

SEQ ID NO: 88995 - DNA, 25 bp, Homo sapien
atcctcataactcttccatgaatgg

SEQ ID NO: 88996 - DNA, 25 bp, Homo sapien
tcataactcttccatgaatggcaag

SEQ ID NO: 88997 - DNA, 25 bp, Homo sapien
aaatgtgttagattggacttgttca

SEQ ID NO: 88998 - DNA, 25 bp, Homo sapien
tttgttctatgctaaatgcatcgtt

SEQ ID NO: 88999 - DNA, 25 bp, Homo sapien
gtagtggtaaatattccagaatcca

SEQ ID NO: 89000 - DNA, 25 bp, Homo sapien
aaaacactgaaaactgtgtccaata

SEQ ID NO: 89001 - DNA, 25 bp, Homo sapien
gtgtccaatatcgttcagtttcctg

SEQ ID NO: 89002 - DNA, 25 bp, Homo sapien
aatatcgttcagtttcctgggtctt

SEQ ID NO: 89003 - DNA, 25 bp, Homo sapien
tcctgggtctttttcttattagcac

SEQ ID NO: 89004 - DNA, 25 bp, Homo sapien
gggtctttttcttattagcacattt

SEQ ID NO: 89005 - DNA, 25 bp, Homo sapien
tcctttcctttattgtagtaaatct

SEQ ID NO: 89006 - DNA, 25 bp, Homo sapien
atcttttctgaaaactaatgctatc

SEQ ID NO: 89007 - DNA, 25 bp, Homo sapien
actaatgctatcaaagtcctccttt

SEQ ID NO: 89008 - DNA, 25 bp, Homo sapien
ggcattcagtgatagtgtacaccaa

SEQ ID NO: 89009 - DNA, 25 bp, Homo sapien
taaaagaccttgactggtgggcttt

SEQ ID NO: 89010 - DNA, 25 bp, Homo sapien
tgactggtgggctttttacgtgtaa

SEQ ID NO: 89011 - DNA, 25 bp, Homo sapien
aagaagtaggactctgcttgtttca

SEQ ID NO: 89012 - DNA, 25 bp, Homo sapien
aggactctgcttgtttcagtagccc

SEQ ID NO: 89013 - DNA, 25 bp, Homo sapien
gcttgtttcagtagcccatgtacta

SEQ ID NO: 89014 - DNA, 25 bp, Homo sapien
gtagcccatgtactaaaataggaac

SEQ ID NO: 89015 - DNA, 25 bp, Homo sapien
aatgcagagattagcacagcccctg

SEQ ID NO: 89016 - DNA, 25 bp, Homo sapien
aattcatgaagcgttagagacaaaa

SEQ ID NO: 89017 - DNA, 25 bp, Homo sapien
ctgggtgggaattggctgagccaag

SEQ ID NO: 89018 - DNA, 25 bp, Homo sapien
tcagactgtgggacacggactcgca

SEQ ID NO: 89019 - DNA, 25 bp, Homo sapien
agactgtgggacacggactcgcaga

SEQ ID NO: 89020 - DNA, 25 bp, Homo sapien
tgtgggacacggactcgcagaataa

SEQ ID NO: 89021 - DNA, 25 bp, Homo sapien
gacacggactcgcagaataaacata

SEQ ID NO: 89022 - DNA, 25 bp, Homo sapien
cggactcgcagaataaacatatatg

SEQ ID NO: 89023 - DNA, 25 bp, Homo sapien
ccatccctggatcccaagagtggtg

SEQ ID NO: 89024 - DNA, 25 bp, Homo sapien
gatcccaagagtggtgcgatccacc

SEQ ID NO: 89025 - DNA, 25 bp, Homo sapien
aagagtggtgcgatccaccaggagt

SEQ ID NO: 89026 - DNA, 25 bp, Homo sapien
agggtgctgccttcccattggacag

SEQ ID NO: 89027 - DNA, 25 bp, Homo sapien
cagctgctcccggaaatgcaaatga

SEQ ID NO: 89028 - DNA, 25 bp, Homo sapien
tgtaatactgtgtgaattcagacta

SEQ ID NO: 89029 - DNA, 25 bp, Homo sapien
tcagactattaaaaacatcattcag

SEQ ID NO: 89030 - DNA, 25 bp, Homo sapien
actttataatcgtcattgttcaatc

SEQ ID NO: 89031 - DNA, 25 bp, Homo sapien
aatatattccttacaaattacttgg

SEQ ID NO: 89032 - DNA, 25 bp, Homo sapien
ggaaattcaatgtttgtgcagagtt

SEQ ID NO: 89033 - DNA, 25 bp, Homo sapien
gagttgagacaactttattgtttct

SEQ ID NO: 89034 - DNA, 25 bp, Homo sapien
aaatgatttactttatggcactaga

SEQ ID NO: 89035 - DNA, 25 bp, Homo sapien
tttatggcactagaaaatttactgt

SEQ ID NO: 89036 - DNA, 25 bp, Homo sapien
aatttactgtggcttttctgatcta

SEQ ID NO: 89037 - DNA, 25 bp, Homo sapien
gtggcttttctgatctaacttctag

SEQ ID NO: 89038 - DNA, 25 bp, Homo sapien
taacttctagctaaaattgtatcat

SEQ ID NO: 89039 - DNA, 25 bp, Homo sapien
gaaccagctctagaggacaggtagg

SEQ ID NO: 89040 - DNA, 25 bp, Homo sapien
ggacaggtaggatttagacaggtaa

SEQ ID NO: 89041 - DNA, 25 bp, Homo sapien
ggcatagaatctaaggtaatggcaa

SEQ ID NO: 89042 - DNA, 25 bp, Homo sapien
atggcaagagcaaaggtgtggaacc

SEQ ID NO: 89043 - DNA, 25 bp, Homo sapien
caggaatgcagtgcttggagcccct

SEQ ID NO: 89044 - DNA, 25 bp, Homo sapien
tcctgaacacgcattaactcctgaa

SEQ ID NO: 89045 - DNA, 25 bp, Homo sapien
gagtaggccaagatacccagtctca

SEQ ID NO: 89046 - DNA, 25 bp, Homo sapien
tacccagtctcacctaacttagact

SEQ ID NO: 89047 - DNA, 25 bp, Homo sapien
gtctcacctaacttagactgtcatt

SEQ ID NO: 89048 - DNA, 25 bp, Homo sapien
tagagagaaagatccattgccaaac

SEQ ID NO: 89049 - DNA, 25 bp, Homo sapien
agatccattgccaaacagtgccatg

SEQ ID NO: 89050 - DNA, 25 bp, Homo sapien
gacgaacgaatgtaactccatgttt

SEQ ID NO: 89051 - DNA, 25 bp, Homo sapien
gtaactccatgtttactgctaaaaa

SEQ ID NO: 89052 - DNA, 25 bp, Homo sapien
tttactgctaaaaaccaaagctttg

SEQ ID NO: 89053 - DNA, 25 bp, Homo sapien
taggaaagcctgtacctgtctgttt

SEQ ID NO: 89054 - DNA, 25 bp, Homo sapien
gaaagcctgtacctgtctgtttttt

SEQ ID NO: 89055 - DNA, 25 bp, Homo sapien
tggttgattttgctgtactgggtac

SEQ ID NO: 89056 - DNA, 25 bp, Homo sapien
gattttgctgtactgggtacttcct

SEQ ID NO: 89057 - DNA, 25 bp, Homo sapien
tgtactgggtacttcctttcccatt

SEQ ID NO: 89058 - DNA, 25 bp, Homo sapien
tacttcctttcccattttctaatca

SEQ ID NO: 89059 - DNA, 25 bp, Homo sapien
tcctttcccattttctaatcatttt

SEQ ID NO: 89060 - DNA, 25 bp, Homo sapien
ttttaacacaagctgactcttccct

SEQ ID NO: 89061 - DNA, 25 bp, Homo sapien
tatttttctcttaccgttacagtat

SEQ ID NO: 89062 - DNA, 25 bp, Homo sapien
ttctcttaccgttacagtattctga

SEQ ID NO: 89063 - DNA, 25 bp, Homo sapien
tctgattatattactgacacagtca

SEQ ID NO: 89064 - DNA, 25 bp, Homo sapien
actgacacagtcaaaatgattaact

SEQ ID NO: 89065 - DNA, 25 bp, Homo sapien
aatgattaactgtacaacctgtatc

SEQ ID NO: 89066 - DNA, 25 bp, Homo sapien
aactgtacaacctgtatctgctggg

SEQ ID NO: 89067 - DNA, 25 bp, Homo sapien
gtacaacctgtatctgctgggtgtt

SEQ ID NO: 89068 - DNA, 25 bp, Homo sapien
caacctgtatctgctgggtgttctt

SEQ ID NO: 89069 - DNA, 25 bp, Homo sapien
tgctgggtgttcttgttatcatatt

SEQ ID NO: 89070 - DNA, 25 bp, Homo sapien
gggtgttcttgttatcatattgtaa

SEQ ID NO: 89071 - DNA, 25 bp, Homo sapien
gttatcatattgtaaaacagcttta

SEQ ID NO: 89072 - DNA, 25 bp, Homo sapien
attcactccctcaagagaatcaata

SEQ ID NO: 89073 - DNA, 25 bp, Homo sapien
gaatcaatactcagaaggttacaaa

SEQ ID NO: 89074 - DNA, 25 bp, Homo sapien
atcaatcattccatctaaaacctta

SEQ ID NO: 89075 - DNA, 25 bp, Homo sapien
aaatctctacaggactacataacat

SEQ ID NO: 89076 - DNA, 25 bp, Homo sapien
tactgccagtttataaacgattgcc

SEQ ID NO: 89077 - DNA, 25 bp, Homo sapien
aacgattgcctatctgaatttttat

SEQ ID NO: 89078 - DNA, 25 bp, Homo sapien
tgaatttttatacctaccactactt

SEQ ID NO: 89079 - DNA, 25 bp, Homo sapien
gcaaattagcaacccagtaagtaca

SEQ ID NO: 89080 - DNA, 25 bp, Homo sapien
ggaaactatatccatatcgcttttg

SEQ ID NO: 89081 - DNA, 25 bp, Homo sapien
atcgcttttggtgtcagattgtatc

SEQ ID NO: 89082 - DNA, 25 bp, Homo sapien
gattgtatctgtgcatctaaaaata

SEQ ID NO: 89083 - DNA, 25 bp, Homo sapien
tggcccagaggcttctccaaaggga

SEQ ID NO: 89084 - DNA, 25 bp, Homo sapien
ggcttttgtgcccaagctcaccagc

SEQ ID NO: 89085 - DNA, 25 bp, Homo sapien
tgcgccacctcactgcagtagtgca

SEQ ID NO: 89086 - DNA, 25 bp, Homo sapien
actgcagtagtgcaccatctcactg

SEQ ID NO: 89087 - DNA, 25 bp, Homo sapien
gtagtgcaccatctcactgcagtag

SEQ ID NO: 89088 - DNA, 25 bp, Homo sapien
tgcaccatctcactgcagtagcacg

SEQ ID NO: 89089 - DNA, 25 bp, Homo sapien
cgtctggcctgtggctaatggaggt

SEQ ID NO: 89090 - DNA, 25 bp, Homo sapien
ctaatggaggtgacggcactcccat

SEQ ID NO: 89091 - DNA, 25 bp, Homo sapien
aggtgacggcactcccatgtgctga

SEQ ID NO: 89092 - DNA, 25 bp, Homo sapien
tgacggcactcccatgtgctgactc

SEQ ID NO: 89093 - DNA, 25 bp, Homo sapien
tgcctggctagtccctgcctgaata

SEQ ID NO: 89094 - DNA, 25 bp, Homo sapien
agaagaatggatcagcttggcctat

SEQ ID NO: 89095 - DNA, 25 bp, Homo sapien
agcttggcctatagaccattccttg

SEQ ID NO: 89096 - DNA, 25 bp, Homo sapien
gaccattccttgatgcttctagatc

SEQ ID NO: 89097 - DNA, 25 bp, Homo sapien
ttcaaagctgctgcgggcattctat

SEQ ID NO: 89098 - DNA, 25 bp, Homo sapien
attctatgtccccttcctgtcagat

SEQ ID NO: 89099 - DNA, 25 bp, Homo sapien
gtacgtaaactacaccatcctcaaa

SEQ ID NO: 89100 - DNA, 25 bp, Homo sapien
tcaaaccccggaaagcaaagcaaat

SEQ ID NO: 89101 - DNA, 25 bp, Homo sapien
ggaggttagcaacacacctgtggcc

SEQ ID NO: 89102 - DNA, 25 bp, Homo sapien
tggccccaaaggacaaccatcttgt

SEQ ID NO: 89103 - DNA, 25 bp, Homo sapien
tattgattccagtgacctgactccc

SEQ ID NO: 89104 - DNA, 25 bp, Homo sapien
actccctgcaagtcatcgcctgtaa

SEQ ID NO: 89105 - DNA, 25 bp, Homo sapien
ggaaatcgcaagtatagaagccttt

SEQ ID NO: 89106 - DNA, 25 bp, Homo sapien
tcgcaagtatagaagccttttgaaa

SEQ ID NO: 89107 - DNA, 25 bp, Homo sapien
gaaaataatactgactcgtgtggat

SEQ ID NO: 89108 - DNA, 25 bp, Homo sapien
tactgactcgtgtggatggtgctta

SEQ ID NO: 89109 - DNA, 25 bp, Homo sapien
gatggtgcttattgaaaaacagctg

SEQ ID NO: 89110 - DNA, 25 bp, Homo sapien
aggagctctgtgatgaggttccagc

SEQ ID NO: 89111 - DNA, 25 bp, Homo sapien
tgatgaggttccagcttacttctat

SEQ ID NO: 89112 - DNA, 25 bp, Homo sapien
tgaggttccagcttacttctattcg

SEQ ID NO: 89113 - DNA, 25 bp, Homo sapien
ttccagcttacttctattcgccagt

SEQ ID NO: 89114 - DNA, 25 bp, Homo sapien
agcttacttctattcgccagtgtcc

SEQ ID NO: 89115 - DNA, 25 bp, Homo sapien
gccagtgtccctgtaatgctttctg

SEQ ID NO: 89116 - DNA, 25 bp, Homo sapien
gtgcaacgaactgagactaatggac

SEQ ID NO: 89117 - DNA, 25 bp, Homo sapien
atggacagtgtcatcactcagctta

SEQ ID NO: 89118 - DNA, 25 bp, Homo sapien
actcagcttactgggctgaggcgtc

SEQ ID NO: 89119 - DNA, 25 bp, Homo sapien
ggttccgtcgtgtcgggtgtcactt

SEQ ID NO: 89120 - DNA, 25 bp, Homo sapien
ggtgtcacttcaccttctgtttggc

SEQ ID NO: 89121 - DNA, 25 bp, Homo sapien
tctgtttggccgctcgatgaggtct

SEQ ID NO: 89122 - DNA, 25 bp, Homo sapien
cgctcgatgaggtctcgtgttgaga

SEQ ID NO: 89123 - DNA, 25 bp, Homo sapien
ttgagatattgtgtgccacaacccc

SEQ ID NO: 89124 - DNA, 25 bp, Homo sapien
ccgtgtgtgatgaaacttcccgtgg

SEQ ID NO: 89125 - DNA, 25 bp, Homo sapien
gaaacttcccgtggacagccaataa

SEQ ID NO: 89126 - DNA, 25 bp, Homo sapien
agccaataaaatgacgtcctctgtt

SEQ ID NO: 89127 - DNA, 25 bp, Homo sapien
gtgagtggcttcatgcagggcaacc

SEQ ID NO: 89128 - DNA, 25 bp, Homo sapien
agggcaaccccactgcaaagaatgt

SEQ ID NO: 89129 - DNA, 25 bp, Homo sapien
aaagaatgtgagcatcagctaggct

SEQ ID NO: 89130 - DNA, 25 bp, Homo sapien
aggcccctcattccatcagtttctt

SEQ ID NO: 89131 - DNA, 25 bp, Homo sapien
tctttcagcatgtttccatgttttc

SEQ ID NO: 89132 - DNA, 25 bp, Homo sapien
attgattttcaatgtgtttcccttt

SEQ ID NO: 89133 - DNA, 25 bp, Homo sapien
ttcaatgtgtttccctttggttatt

SEQ ID NO: 89134 - DNA, 25 bp, Homo sapien
tctcttaaaatctctgttgttggta

SEQ ID NO: 89135 - DNA, 25 bp, Homo sapien
atctctgttgttggtactgtttgtt

SEQ ID NO: 89136 - DNA, 25 bp, Homo sapien
ttggaactgttgtgatcccccacca

SEQ ID NO: 89137 - DNA, 25 bp, Homo sapien
aagcagattaaaaggtataccacat

SEQ ID NO: 89138 - DNA, 25 bp, Homo sapien
gaggcctcagacaggtccctgaagg

SEQ ID NO: 89139 - DNA, 25 bp, Homo sapien
gtccctgaaggagtctgaggctcca

SEQ ID NO: 89140 - DNA, 25 bp, Homo sapien
tgaggctccagaggatgtcatatgg

SEQ ID NO: 89141 - DNA, 25 bp, Homo sapien
ggtctggctaggattgaagccatct

SEQ ID NO: 89142 - DNA, 25 bp, Homo sapien
gaagccatctggaccttttctagat

SEQ ID NO: 89143 - DNA, 25 bp, Homo sapien
ggaccttttctagatatgactccag

SEQ ID NO: 89144 - DNA, 25 bp, Homo sapien
atgactccaggacccttgagtgtaa

SEQ ID NO: 89145 - DNA, 25 bp, Homo sapien
aggacccttgagtgtaatgcaaaaa

SEQ ID NO: 89146 - DNA, 25 bp, Homo sapien
gcaaaaatttggagaccagctatgc

SEQ ID NO: 89147 - DNA, 25 bp, Homo sapien
gccctctgtgggtgccttagcattg

SEQ ID NO: 89148 - DNA, 25 bp, Homo sapien
cttggtcaccgttgcatttgttata

SEQ ID NO: 89149 - DNA, 25 bp, Homo sapien
gtggactgcacacgacagcagattc

SEQ ID NO: 89150 - DNA, 25 bp, Homo sapien
gctgtcccctcgttggaggcgaatg

SEQ ID NO: 89151 - DNA, 25 bp, Homo sapien
ggcggcgcccctgataaaaggccga

SEQ ID NO: 89152 - DNA, 25 bp, Homo sapien
taaaaggccgaggattcgcgatcag

SEQ ID NO: 89153 - DNA, 25 bp, Homo sapien
gattcgcgatcagggtgcaacttca

SEQ ID NO: 89154 - DNA, 25 bp, Homo sapien
gtggccgttcacatcacgcgcttca

SEQ ID NO: 89155 - DNA, 25 bp, Homo sapien
taagcctcctatcactagtaacctt

SEQ ID NO: 89156 - DNA, 25 bp, Homo sapien
agtaaccttccagcgcattgtttaa

SEQ ID NO: 89157 - DNA, 25 bp, Homo sapien
aaagcagtttctgtccctttctgta

SEQ ID NO: 89158 - DNA, 25 bp, Homo sapien
ttctgtagttcctttaagttcagga

SEQ ID NO: 89159 - DNA, 25 bp, Homo sapien
caggatgtaagcgaagccttccatt

SEQ ID NO: 89160 - DNA, 25 bp, Homo sapien
gaaggaaaaggctgcggtaaaatca

SEQ ID NO: 89161 - DNA, 25 bp, Homo sapien
aaggctgcggtaaaatcagtaaagt

SEQ ID NO: 89162 - DNA, 25 bp, Homo sapien
taagagcacaaagggatccaatttt

SEQ ID NO: 89163 - DNA, 25 bp, Homo sapien
gatccaatttttccaactcggaagt

SEQ ID NO: 89164 - DNA, 25 bp, Homo sapien
actcggaagtggcaattggtttgtc

SEQ ID NO: 89165 - DNA, 25 bp, Homo sapien
ggcaattggtttgtctccttacacc

SEQ ID NO: 89166 - DNA, 25 bp, Homo sapien
caattggtttgtctccttacacctt

SEQ ID NO: 89167 - DNA, 25 bp, Homo sapien
ctttccccagaagaggcttttccat

SEQ ID NO: 89168 - DNA, 25 bp, Homo sapien
ttccccagaagaggcttttccatgt

SEQ ID NO: 89169 - DNA, 25 bp, Homo sapien
cccagaagaggcttttccatgttgc

SEQ ID NO: 89170 - DNA, 25 bp, Homo sapien
agaaaacatcacctaggccggtgtg

SEQ ID NO: 89171 - DNA, 25 bp, Homo sapien
ggctccagggccagtgttacagtgt

SEQ ID NO: 89172 - DNA, 25 bp, Homo sapien
gtgttaccctgtaaggtgttagcct

SEQ ID NO: 89173 - DNA, 25 bp, Homo sapien
gtgttagccttaaaccaccgagcag

SEQ ID NO: 89174 - DNA, 25 bp, Homo sapien
aaaccaccgagcagcgttctcttga

SEQ ID NO: 89175 - DNA, 25 bp, Homo sapien
agcgttctcttgatgccagtgcaga

SEQ ID NO: 89176 - DNA, 25 bp, Homo sapien
gagaccagagtcagatgcccgagga

SEQ ID NO: 89177 - DNA, 25 bp, Homo sapien
tttcatcaacaaatggacctatggc

SEQ ID NO: 89178 - DNA, 25 bp, Homo sapien
ggacctatggcatcatggctttaga

SEQ ID NO: 89179 - DNA, 25 bp, Homo sapien
gctggtacatttactgagctgatgg

SEQ ID NO: 89180 - DNA, 25 bp, Homo sapien
gctgatggacagtggccttctaaaa

SEQ ID NO: 89181 - DNA, 25 bp, Homo sapien
tatgcactgtacttaaggattctta

SEQ ID NO: 89182 - DNA, 25 bp, Homo sapien
gtgaatatagtcaaagcgtggcatt

SEQ ID NO: 89183 - DNA, 25 bp, Homo sapien
agcgtggcattgagataattggact

SEQ ID NO: 89184 - DNA, 25 bp, Homo sapien
agaccagtttgatgagaagctttta

SEQ ID NO: 89185 - DNA, 25 bp, Homo sapien
tttgttgccagttccatatttttac

SEQ ID NO: 89186 - DNA, 25 bp, Homo sapien
ccttccttaagagatgttttactct

SEQ ID NO: 89187 - DNA, 25 bp, Homo sapien
atttttatgctctttgattatctaa

SEQ ID NO: 89188 - DNA, 25 bp, Homo sapien
gattatctaataaggccagtatttc

SEQ ID NO: 89189 - DNA, 25 bp, Homo sapien
aggccagtatttcaaaagctgttct

SEQ ID NO: 89190 - DNA, 25 bp, Homo sapien
aaaagctgttctgaatttatccaca

SEQ ID NO: 89191 - DNA, 25 bp, Homo sapien
gaatttatccacagtaatatagtct

SEQ ID NO: 89192 - DNA, 25 bp, Homo sapien
ttacttaacttatccttggaaatat

SEQ ID NO: 89193 - DNA, 25 bp, Homo sapien
tgtcttgggtgcctgtgcctacacc

SEQ ID NO: 89194 - DNA, 25 bp, Homo sapien
cctcctcaccctagagacggaagat

SEQ ID NO: 89195 - DNA, 25 bp, Homo sapien
accctagagacggaagatgtgcaaa

SEQ ID NO: 89196 - DNA, 25 bp, Homo sapien
gaaggaagggcaactgcattccagc

SEQ ID NO: 89197 - DNA, 25 bp, Homo sapien
attccagccccacactgtgatgact

SEQ ID NO: 89198 - DNA, 25 bp, Homo sapien
tgagcctgtcctttccctccttgag

SEQ ID NO: 89199 - DNA, 25 bp, Homo sapien
tccttgagcctgtcttgcttgtccc

SEQ ID NO: 89200 - DNA, 25 bp, Homo sapien
ctgtcttgcttgtcccctgtaaaat

SEQ ID NO: 89201 - DNA, 25 bp, Homo sapien
tgtaaaatgaacagtccccctctcc

SEQ ID NO: 89202 - DNA, 25 bp, Homo sapien
atacatgtttcaaagggtgaccatt

SEQ ID NO: 89203 - DNA, 25 bp, Homo sapien
aagggtgaccatttataaagcatat

SEQ ID NO: 89204 - DNA, 25 bp, Homo sapien
gggctcactgcctgttgacaaggct

SEQ ID NO: 89205 - DNA, 25 bp, Homo sapien
cactgcctgttgacaaggctcagga

SEQ ID NO: 89206 - DNA, 25 bp, Homo sapien
ggagctccaggctgtactgggcctc

SEQ ID NO: 89207 - DNA, 25 bp, Homo sapien
tactgggcctctcctagactgcagg

SEQ ID NO: 89208 - DNA, 25 bp, Homo sapien
tcctagactgcaggctgcagccagt

SEQ ID NO: 89209 - DNA, 25 bp, Homo sapien
gtccagagagaatagagcctgccca

SEQ ID NO: 89210 - DNA, 25 bp, Homo sapien
agttctgccttaccaaagattttga

SEQ ID NO: 89211 - DNA, 25 bp, Homo sapien
ctgccttaccaaagattttgagact

SEQ ID NO: 89212 - DNA, 25 bp, Homo sapien
attttgagactcatacccatttgga

SEQ ID NO: 89213 - DNA, 25 bp, Homo sapien
gttacaaatgagtcatgacatcata

SEQ ID NO: 89214 - DNA, 25 bp, Homo sapien
gagtcatgacatcatactgtaataa

SEQ ID NO: 89215 - DNA, 25 bp, Homo sapien
ctgcctgactggagctggccgctgt

SEQ ID NO: 89216 - DNA, 25 bp, Homo sapien
gccgctgtggtggactcaggaacca

SEQ ID NO: 89217 - DNA, 25 bp, Homo sapien
ggaaccacttttaatactgcaactg

SEQ ID NO: 89218 - DNA, 25 bp, Homo sapien
ttaatactgcaactgctcccttttg

SEQ ID NO: 89219 - DNA, 25 bp, Homo sapien
ccttttgcccagtcagggaaagctg

SEQ ID NO: 89220 - DNA, 25 bp, Homo sapien
gaaagctgactgtaagtcccacctc

SEQ ID NO: 89221 - DNA, 25 bp, Homo sapien
acccttctagtggtttctctgagag

SEQ ID NO: 89222 - DNA, 25 bp, Homo sapien
agaggtttctctgcttcggctgtgc

SEQ ID NO: 89223 - DNA, 25 bp, Homo sapien
ggctgtgcttgaagtggcatgcctc

SEQ ID NO: 89224 - DNA, 25 bp, Homo sapien
aagtggcatgcctcctctgctgcag

SEQ ID NO: 89225 - DNA, 25 bp, Homo sapien
cccacacggcctctaaagatgttta

SEQ ID NO: 89226 - DNA, 25 bp, Homo sapien
agaggtcagcggagggctggcctca

SEQ ID NO: 89227 - DNA, 25 bp, Homo sapien
tgggtgcctggcttggcaactgcta

SEQ ID NO: 89228 - DNA, 25 bp, Homo sapien
cctggcttggcaactgctagagcag

SEQ ID NO: 89229 - DNA, 25 bp, Homo sapien
ttacctaattagagtgggttagctt

SEQ ID NO: 89230 - DNA, 25 bp, Homo sapien
gggttagcttagattggtagctgct

SEQ ID NO: 89231 - DNA, 25 bp, Homo sapien
ttggtagctgctgaaactctcgttg

SEQ ID NO: 89232 - DNA, 25 bp, Homo sapien
gtagctgctgaaactctcgttgagt

SEQ ID NO: 89233 - DNA, 25 bp, Homo sapien
gctgctgaaactctcgttgagtcag

SEQ ID NO: 89234 - DNA, 25 bp, Homo sapien
gaaactctcgttgagtcaggagcgg

SEQ ID NO: 89235 - DNA, 25 bp, Homo sapien
tctcgttgagtcaggagcgggtaaa

SEQ ID NO: 89236 - DNA, 25 bp, Homo sapien
ctttggagcccctgagtttgagttc

SEQ ID NO: 89237 - DNA, 25 bp, Homo sapien
gattttgaaattgaacactagaact

SEQ ID NO: 89238 - DNA, 25 bp, Homo sapien
gaagagcttattgggaattatatat

SEQ ID NO: 89239 - DNA, 25 bp, Homo sapien
tacatgggggcctgaatgtcagcca

SEQ ID NO: 89240 - DNA, 25 bp, Homo sapien
aatgtcagccatctttatactatag

SEQ ID NO: 89241 - DNA, 25 bp, Homo sapien
gaatggtcatgctttggagatcaaa

SEQ ID NO: 89242 - DNA, 25 bp, Homo sapien
ggtcatgctttggagatcaaatatt

SEQ ID NO: 89243 - DNA, 25 bp, Homo sapien
caaatattggttgaatgcctatgta

SEQ ID NO: 89244 - DNA, 25 bp, Homo sapien
tgaatgcctatgtatgtcaggccct

SEQ ID NO: 89245 - DNA, 25 bp, Homo sapien
atgcctatgtatgtcaggccctgtg

SEQ ID NO: 89246 - DNA, 25 bp, Homo sapien
gccctgtgctgagccatgaggatta

SEQ ID NO: 89247 - DNA, 25 bp, Homo sapien
aacatatcttgtttaggaaatggat

SEQ ID NO: 89248 - DNA, 25 bp, Homo sapien
gttttattatgtatgctaccattcg

SEQ ID NO: 89249 - DNA, 25 bp, Homo sapien
gtatgctaccattcgaactgagagt

SEQ ID NO: 89250 - DNA, 25 bp, Homo sapien
aactgagagtattcggtggctaatt

SEQ ID NO: 89251 - DNA, 25 bp, Homo sapien
ttcggtggctaattccaggacaaga

SEQ ID NO: 89252 - DNA, 25 bp, Homo sapien
acatgtggagtagtgatggtctgaa

SEQ ID NO: 89253 - DNA, 25 bp, Homo sapien
ggaacttcaatccttcgtttcagaa

SEQ ID NO: 89254 - DNA, 25 bp, Homo sapien
ttcgtttcagaaattagtgctacag

SEQ ID NO: 89255 - DNA, 25 bp, Homo sapien
tagtgctacagtttcatacattttc

SEQ ID NO: 89256 - DNA, 25 bp, Homo sapien
acattttctccagtgacgtgttgac

SEQ ID NO: 89257 - DNA, 25 bp, Homo sapien
gacgtgttgacttgaaacttcaggc

SEQ ID NO: 89258 - DNA, 25 bp, Homo sapien
actggtgttttaactagtattgcaa

SEQ ID NO: 89259 - DNA, 25 bp, Homo sapien
ggagccacttcacctttgtattagt

SEQ ID NO: 89260 - DNA, 25 bp, Homo sapien
gagccacttcacctttgtattagtt

SEQ ID NO: 89261 - DNA, 25 bp, Homo sapien
agccacttcacctttgtattagtta

SEQ ID NO: 89262 - DNA, 25 bp, Homo sapien
gccacttcacctttgtattagttat

SEQ ID NO: 89263 - DNA, 25 bp, Homo sapien
ccacttcacctttgtattagttatt

SEQ ID NO: 89264 - DNA, 25 bp, Homo sapien
cacttcacctttgtattagttatta

SEQ ID NO: 89265 - DNA, 25 bp, Homo sapien
aaaatataatttgggctgggcgcag

SEQ ID NO: 89266 - DNA, 25 bp, Homo sapien
aaatataatttgggctgggcgcagt

SEQ ID NO: 89267 - DNA, 25 bp, Homo sapien
aatataatttgggctgggcgcagtg

SEQ ID NO: 89268 - DNA, 25 bp, Homo sapien
ggagtccgaggcatgcggatcactt

SEQ ID NO: 89269 - DNA, 25 bp, Homo sapien
tggcggttgcagtgagcacagatca

SEQ ID NO: 89270 - DNA, 25 bp, Homo sapien
agctctccttttgctcggggaaatg

SEQ ID NO: 89271 - DNA, 25 bp, Homo sapien
gggaaatgtatttggtgagcctcca

SEQ ID NO: 89272 - DNA, 25 bp, Homo sapien
atttggtgagcctccaactgaactt

SEQ ID NO: 89273 - DNA, 25 bp, Homo sapien
gtgagcctccaactgaacttcagat

SEQ ID NO: 89274 - DNA, 25 bp, Homo sapien
actgaacttcagattaaacagcaag

SEQ ID NO: 89275 - DNA, 25 bp, Homo sapien
caagaattttcttcgtttccagatt

SEQ ID NO: 89276 - DNA, 25 bp, Homo sapien
attttcttcgtttccagattgagga

SEQ ID NO: 89277 - DNA, 25 bp, Homo sapien
gaagaaagacggcttgcagaacaga

SEQ ID NO: 89278 - DNA, 25 bp, Homo sapien
acggcttgcagaacagagggcacga

SEQ ID NO: 89279 - DNA, 25 bp, Homo sapien
gagggcacgaattcagcaggagtat

SEQ ID NO: 89280 - DNA, 25 bp, Homo sapien
gaagagcatattcggttagctgaag

SEQ ID NO: 89281 - DNA, 25 bp, Homo sapien
actgtagtgtggctggttctaccac

SEQ ID NO: 89282 - DNA, 25 bp, Homo sapien
tgtagtgtggctggttctaccacta

SEQ ID NO: 89283 - DNA, 25 bp, Homo sapien
gtagtgtggctggttctaccactat

SEQ ID NO: 89284 - DNA, 25 bp, Homo sapien
tagtgtggctggttctaccactatg

SEQ ID NO: 89285 - DNA, 25 bp, Homo sapien
gtgtggctggttctaccactatgac

SEQ ID NO: 89286 - DNA, 25 bp, Homo sapien
tgtggctggttctaccactatgact

SEQ ID NO: 89287 - DNA, 25 bp, Homo sapien
tggctggttctaccactatgacttt

SEQ ID NO: 89288 - DNA, 25 bp, Homo sapien
gtcagggagaaatgtaatgttctat

SEQ ID NO: 89289 - DNA, 25 bp, Homo sapien
gtaatgttctatatgaaattccttt

SEQ ID NO: 89290 - DNA, 25 bp, Homo sapien
gttctatatgaaattcctttttcaa

SEQ ID NO: 89291 - DNA, 25 bp, Homo sapien
ttcaagtttgttcattaataacagt

SEQ ID NO: 89292 - DNA, 25 bp, Homo sapien
atcagagctaaaaatgttgcacaga

SEQ ID NO: 89293 - DNA, 25 bp, Homo sapien
atcctttaaaacatcattcagagag

SEQ ID NO: 89294 - DNA, 25 bp, Homo sapien
gaaaactttatcaaggaaacactgg

SEQ ID NO: 89295 - DNA, 25 bp, Homo sapien
gaaacactggtcatctgtacaggat

SEQ ID NO: 89296 - DNA, 25 bp, Homo sapien
gttcaagttttgctaataccagtag

SEQ ID NO: 89297 - DNA, 25 bp, Homo sapien
accagtagtaaattcaggcatttgc

SEQ ID NO: 89298 - DNA, 25 bp, Homo sapien
ttcaggcatttgctaagtaacgatg

SEQ ID NO: 89299 - DNA, 25 bp, Homo sapien
tgctaagtaacgatggatatccatt

SEQ ID NO: 89300 - DNA, 25 bp, Homo sapien
gatatccattcaaatgagagaccta

SEQ ID NO: 89301 - DNA, 25 bp, Homo sapien
tttgaagttcaatttaccatatttt

SEQ ID NO: 89302 - DNA, 25 bp, Homo sapien
aaattgcgcattctgcacagtgaaa

SEQ ID NO: 89303 - DNA, 25 bp, Homo sapien
tttttactgtcatataatcttagtg

SEQ ID NO: 89304 - DNA, 25 bp, Homo sapien
ttttactgtcatataatcttagtga

SEQ ID NO: 89305 - DNA, 25 bp, Homo sapien
tttactgtcatataatcttagtgat

SEQ ID NO: 89306 - DNA, 25 bp, Homo sapien
ttactgtcatataatcttagtgata

SEQ ID NO: 89307 - DNA, 25 bp, Homo sapien
aaattggctcatctggctttttgaa

SEQ ID NO: 89308 - DNA, 25 bp, Homo sapien
aattggctcatctggctttttgaaa

SEQ ID NO: 89309 - DNA, 25 bp, Homo sapien
gatgttgattaggtatatctacaaa

SEQ ID NO: 89310 - DNA, 25 bp, Homo sapien
atgttgattaggtatatctacaaat

SEQ ID NO: 89311 - DNA, 25 bp, Homo sapien
tgttgattaggtatatctacaaatt

SEQ ID NO: 89312 - DNA, 25 bp, Homo sapien
gttgattaggtatatctacaaatta

SEQ ID NO: 89313 - DNA, 25 bp, Homo sapien
ttgattaggtatatctacaaattaa

SEQ ID NO: 89314 - DNA, 25 bp, Homo sapien
gaaacaagcttgtgctaagatggaa

SEQ ID NO: 89315 - DNA, 25 bp, Homo sapien
cttgtgctaagatggaaagggctgc

SEQ ID NO: 89316 - DNA, 25 bp, Homo sapien
acagatgtggtttgttgctttagtt

SEQ ID NO: 89317 - DNA, 25 bp, Homo sapien
ttatgtttatgttatcaccccacca

SEQ ID NO: 89318 - DNA, 25 bp, Homo sapien
tgtttatgttatcaccccaccacta

SEQ ID NO: 89319 - DNA, 25 bp, Homo sapien
tacctccatggttgttcatttagga

SEQ ID NO: 89320 - DNA, 25 bp, Homo sapien
tttaggatgcttctaattcagccac

SEQ ID NO: 89321 - DNA, 25 bp, Homo sapien
tcagccactgtgaaccattataaag

SEQ ID NO: 89322 - DNA, 25 bp, Homo sapien
gaagatttactattattccagccat

SEQ ID NO: 89323 - DNA, 25 bp, Homo sapien
tactattattccagccatgtaaaaa

SEQ ID NO: 89324 - DNA, 25 bp, Homo sapien
atatgtgcacatatggatgtatgtt

SEQ ID NO: 89325 - DNA, 25 bp, Homo sapien
agcccatccataaggctctcagatg

SEQ ID NO: 89326 - DNA, 25 bp, Homo sapien
gctctcagatgggacattgtaggaa

SEQ ID NO: 89327 - DNA, 25 bp, Homo sapien
gggagacacaagtagacctcaggta

SEQ ID NO: 89328 - DNA, 25 bp, Homo sapien
ctcaggtagaacgacaccgggcgga

SEQ ID NO: 89329 - DNA, 25 bp, Homo sapien
ctcccagggagtgctcgaggcgcat

SEQ ID NO: 89330 - DNA, 25 bp, Homo sapien
cgaggcgcatcaggcccgtttttta

SEQ ID NO: 89331 - DNA, 25 bp, Homo sapien
gcatcaggcccgttttttaccagtt

SEQ ID NO: 89332 - DNA, 25 bp, Homo sapien
tttaccagtttatatcacggtcttc

SEQ ID NO: 89333 - DNA, 25 bp, Homo sapien
gtttatatcacggtcttcattttta

SEQ ID NO: 89334 - DNA, 25 bp, Homo sapien
gtaacgctaactttgtacggacgat

SEQ ID NO: 89335 - DNA, 25 bp, Homo sapien
gtacggacgatgtctcatggattaa

SEQ ID NO: 89336 - DNA, 25 bp, Homo sapien
ttttttgggttctacgacattgaag

SEQ ID NO: 89337 - DNA, 25 bp, Homo sapien
gggttctacgacattgaagttggac

SEQ ID NO: 89338 - DNA, 25 bp, Homo sapien
aagttggactagtgatttatttgaa

SEQ ID NO: 89339 - DNA, 25 bp, Homo sapien
taacaggggtcctctatgggaaaat

SEQ ID NO: 89340 - DNA, 25 bp, Homo sapien
tgtttcccagaaattgttaagtgat

SEQ ID NO: 89341 - DNA, 25 bp, Homo sapien
tttacatgtaaagtgaattccctga

SEQ ID NO: 89342 - DNA, 25 bp, Homo sapien
acatgtaaagtgaattccctgaaaa

SEQ ID NO: 89343 - DNA, 25 bp, Homo sapien
ggatttaaaaagcattctccttcaa

SEQ ID NO: 89344 - DNA, 25 bp, Homo sapien
aaagcattctccttcaatgtgcctt

SEQ ID NO: 89345 - DNA, 25 bp, Homo sapien
agcattctccttcaatgtgccttta

SEQ ID NO: 89346 - DNA, 25 bp, Homo sapien
tctccttcaatgtgcctttaccttg

SEQ ID NO: 89347 - DNA, 25 bp, Homo sapien
tgtttgcagccttcgaagatgtaac

SEQ ID NO: 89348 - DNA, 25 bp, Homo sapien
gatgtaacaatctcgttggaaacat

SEQ ID NO: 89349 - DNA, 25 bp, Homo sapien
ggaaacataagacatacatcacatt

SEQ ID NO: 89350 - DNA, 25 bp, Homo sapien
gtatgatatgtacaactgagtggta

SEQ ID NO: 89351 - DNA, 25 bp, Homo sapien
tgagtggtacagatatgacatggaa

SEQ ID NO: 89352 - DNA, 25 bp, Homo sapien
gttcaaggaaggcaccacaccagaa

SEQ ID NO: 89353 - DNA, 25 bp, Homo sapien
caccagaaatgggacctaaattaag

SEQ ID NO: 89354 - DNA, 25 bp, Homo sapien
aagaatgagcatggccacactgtca

SEQ ID NO: 89355 - DNA, 25 bp, Homo sapien
gagcatggccacactgtcagtgagt

SEQ ID NO: 89356 - DNA, 25 bp, Homo sapien
gtcagtgagtgttctttaggtggta

SEQ ID NO: 89357 - DNA, 25 bp, Homo sapien
ggtaggactatggttgatatttttc

SEQ ID NO: 89358 - DNA, 25 bp, Homo sapien
gagaaaagggtgaaatatgtaaagt

SEQ ID NO: 89359 - DNA, 25 bp, Homo sapien
aaagggtgaaatatgtaaagtgttg

SEQ ID NO: 89360 - DNA, 25 bp, Homo sapien
aagggtgaaatatgtaaagtgttga

SEQ ID NO: 89361 - DNA, 25 bp, Homo sapien
agggtgaaatatgtaaagtgttgaa

SEQ ID NO: 89362 - DNA, 25 bp, Homo sapien
gggtgaaatatgtaaagtgttgaaa

SEQ ID NO: 89363 - DNA, 25 bp, Homo sapien
ggtgaaatatgtaaagtgttgaaag

SEQ ID NO: 89364 - DNA, 25 bp, Homo sapien
gaaatatgtaaagtgttgaaagaga

SEQ ID NO: 89365 - DNA, 25 bp, Homo sapien
gagaaaactggctgggcaagtggct

SEQ ID NO: 89366 - DNA, 25 bp, Homo sapien
agaaaactggctgggcaagtggctc

SEQ ID NO: 89367 - DNA, 25 bp, Homo sapien
gaaaactggctgggcaagtggctca

SEQ ID NO: 89368 - DNA, 25 bp, Homo sapien
aaaactggctgggcaagtggctcat

SEQ ID NO: 89369 - DNA, 25 bp, Homo sapien
tgtgaaaggcactagctgtctaata

SEQ ID NO: 89370 - DNA, 25 bp, Homo sapien
ggcactagctgtctaatagtttcat

SEQ ID NO: 89371 - DNA, 25 bp, Homo sapien
gctgtctaatagtttcatgtatcat

SEQ ID NO: 89372 - DNA, 25 bp, Homo sapien
atgtatcttaatgtagtctatgtag

SEQ ID NO: 89373 - DNA, 25 bp, Homo sapien
tgtaggtttttatcagaaagtgtac

SEQ ID NO: 89374 - DNA, 25 bp, Homo sapien
gaaagtgtacctttctatggtttat

SEQ ID NO: 89375 - DNA, 25 bp, Homo sapien
ttatattctggtgccttttatctca

SEQ ID NO: 89376 - DNA, 25 bp, Homo sapien
ctggtgccttttatctcagatataa

SEQ ID NO: 89377 - DNA, 25 bp, Homo sapien
atctcagatataaaccatgaacagt

SEQ ID NO: 89378 - DNA, 25 bp, Homo sapien
accatgaacagtaatgatagtcact

SEQ ID NO: 89379 - DNA, 25 bp, Homo sapien
atagtcactgacatataaatcttag

SEQ ID NO: 89380 - DNA, 25 bp, Homo sapien
cttaacacaatggtgccctctggtg

SEQ ID NO: 89381 - DNA, 25 bp, Homo sapien
ggtgccctctggtggagtagtaaca

SEQ ID NO: 89382 - DNA, 25 bp, Homo sapien
agtaacagtggaaagcactcctgcc

SEQ ID NO: 89383 - DNA, 25 bp, Homo sapien
ctgcccgattagtaggaggacctct

SEQ ID NO: 89384 - DNA, 25 bp, Homo sapien
agtaggaggacctctggttgatacg

SEQ ID NO: 89385 - DNA, 25 bp, Homo sapien
ggttgatacggatattgctcttaaa

SEQ ID NO: 89386 - DNA, 25 bp, Homo sapien
aaaactgcccattcgaggaggagcc

SEQ ID NO: 89387 - DNA, 25 bp, Homo sapien
cccattcgaggaggagccttgcaga

SEQ ID NO: 89388 - DNA, 25 bp, Homo sapien
gccttgcagagggtgaaagcagtta

SEQ ID NO: 89389 - DNA, 25 bp, Homo sapien
gcagttaaaattgtggatgcaccaa

SEQ ID NO: 89390 - DNA, 25 bp, Homo sapien
gcaccaaaaaagagtattcctacgt

SEQ ID NO: 89391 - DNA, 25 bp, Homo sapien
gtcccgcttctgctgggttccgctt

SEQ ID NO: 89392 - DNA, 25 bp, Homo sapien
ttttttctgtgtgcgtgcgaatggt

SEQ ID NO: 89393 - DNA, 25 bp, Homo sapien
ttttctgtgtgcgtgcgaatggtgc

SEQ ID NO: 89394 - DNA, 25 bp, Homo sapien
tgtgcgtgcgaatggtgcggcccct

SEQ ID NO: 89395 - DNA, 25 bp, Homo sapien
cctctcaccgtggttaacgtgacga

SEQ ID NO: 89396 - DNA, 25 bp, Homo sapien
caccgtggttaacgtgacgaaggca

SEQ ID NO: 89397 - DNA, 25 bp, Homo sapien
gtgacgaaggcacgattcctgtaaa

SEQ ID NO: 89398 - DNA, 25 bp, Homo sapien
acgaaggcacgattcctgtaaatgt

SEQ ID NO: 89399 - DNA, 25 bp, Homo sapien
ttttatgaacagcagactctatgta

SEQ ID NO: 89400 - DNA, 25 bp, Homo sapien
agcagactctatgtaaaggcatttt

SEQ ID NO: 89401 - DNA, 25 bp, Homo sapien
gtaaaggcattttagtatcaaattt

SEQ ID NO: 89402 - DNA, 25 bp, Homo sapien
gcacagtgttgttatgaaggagcct

SEQ ID NO: 89403 - DNA, 25 bp, Homo sapien
ggagcctgtttacctgtgttcaaaa

SEQ ID NO: 89404 - DNA, 25 bp, Homo sapien
aaaatctggcaccattcccttgagc

SEQ ID NO: 89405 - DNA, 25 bp, Homo sapien
aggagggaccaggtctgccagtttc

SEQ ID NO: 89406 - DNA, 25 bp, Homo sapien
aggtctgccagtttctgtgcctgca

SEQ ID NO: 89407 - DNA, 25 bp, Homo sapien
gcagagagacgaagccccacgagcc

SEQ ID NO: 89408 - DNA, 25 bp, Homo sapien
gggaagaatctattttgctgttttg

SEQ ID NO: 89409 - DNA, 25 bp, Homo sapien
gttttggaaagcacacagccgacct

SEQ ID NO: 89410 - DNA, 25 bp, Homo sapien
aaacctcctgtgatggtgtttcttc

SEQ ID NO: 89411 - DNA, 25 bp, Homo sapien
gatggtgtttcttcggatgtgtaaa

SEQ ID NO: 89412 - DNA, 25 bp, Homo sapien
aaggctttatttgtcaattccgctg

SEQ ID NO: 89413 - DNA, 25 bp, Homo sapien
aaatggcttgagaagaaccacatcc

SEQ ID NO: 89414 - DNA, 25 bp, Homo sapien
catcactgaacagggagacgctcca

SEQ ID NO: 89415 - DNA, 25 bp, Homo sapien
tcctgactatagacccaccatatgg

SEQ ID NO: 89416 - DNA, 25 bp, Homo sapien
tagacccaccatatggtccagcaaa

SEQ ID NO: 89417 - DNA, 25 bp, Homo sapien
ggtccagcaaaattgcagcagctct

SEQ ID NO: 89418 - DNA, 25 bp, Homo sapien
cagcagctctaatgagattattctg

SEQ ID NO: 89419 - DNA, 25 bp, Homo sapien
atgagattattctgtcgcgtgttca

SEQ ID NO: 89420 - DNA, 25 bp, Homo sapien
attctgtcgcgtgttcaggatctta

SEQ ID NO: 89421 - DNA, 25 bp, Homo sapien
aaggacatcttacagcttcccaatg

SEQ ID NO: 89422 - DNA, 25 bp, Homo sapien
agcttcccaatgagaggccaggaag

SEQ ID NO: 89423 - DNA, 25 bp, Homo sapien
agaggccaggaagtgtgaacatact

SEQ ID NO: 89424 - DNA, 25 bp, Homo sapien
attgttgctaccaagcttcctgtgg

SEQ ID NO: 89425 - DNA, 25 bp, Homo sapien
caagcttcctgtggtcaaagagccc

SEQ ID NO: 89426 - DNA, 25 bp, Homo sapien
ttgaggaagcaagctccacggccac

SEQ ID NO: 89427 - DNA, 25 bp, Homo sapien
aagctccacggccaccatagataac

SEQ ID NO: 89428 - DNA, 25 bp, Homo sapien
ccaccatagataacccattcctgaa

SEQ ID NO: 89429 - DNA, 25 bp, Homo sapien
tagataacccattcctgaaagtttt

SEQ ID NO: 89430 - DNA, 25 bp, Homo sapien
tataagcagcttacacatgtagaaa

SEQ ID NO: 89431 - DNA, 25 bp, Homo sapien
tgtagaaaatgatcctccagcccac

SEQ ID NO: 89432 - DNA, 25 bp, Homo sapien
accacatagtaatcactgacactgt

SEQ ID NO: 89433 - DNA, 25 bp, Homo sapien
tgacactgtgaggtgtctcagctgg

SEQ ID NO: 89434 - DNA, 25 bp, Homo sapien
gtatggtttctgttcagctcttttc

SEQ ID NO: 89435 - DNA, 25 bp, Homo sapien
gcagcccgacagcagcctggagatc

SEQ ID NO: 89436 - DNA, 25 bp, Homo sapien
gcagcctggagatcctgcccgagga

SEQ ID NO: 89437 - DNA, 25 bp, Homo sapien
gaggacgagggcgccgactcctaac

SEQ ID NO: 89438 - DNA, 25 bp, Homo sapien
gccaggcagcctcgttctgcacagg

SEQ ID NO: 89439 - DNA, 25 bp, Homo sapien
agcctcgttctgcacaggcacttta

SEQ ID NO: 89440 - DNA, 25 bp, Homo sapien
ttctgcacaggcactttagcccgag

SEQ ID NO: 89441 - DNA, 25 bp, Homo sapien
tgcacaggcactttagcccgagcca

SEQ ID NO: 89442 - DNA, 25 bp, Homo sapien
cacaggcactttagcccgagccagg

SEQ ID NO: 89443 - DNA, 25 bp, Homo sapien
tagcccgagccaggcacacctgcga

SEQ ID NO: 89444 - DNA, 25 bp, Homo sapien
gccgccctgctgataagctggcttc

SEQ ID NO: 89445 - DNA, 25 bp, Homo sapien
ctgctgataagctggcttcattaaa

SEQ ID NO: 89446 - DNA, 25 bp, Homo sapien
taaagtttcccattttccaatacag

SEQ ID NO: 89447 - DNA, 25 bp, Homo sapien
tttccaatacagtttcacatttgaa

SEQ ID NO: 89448 - DNA, 25 bp, Homo sapien
tgaacagccctaattgatacaactt

SEQ ID NO: 89449 - DNA, 25 bp, Homo sapien
gttttagtgtgtgagtgggatccaa

SEQ ID NO: 89450 - DNA, 25 bp, Homo sapien
caaaacactcaatcctgtaaaaggg

SEQ ID NO: 89451 - DNA, 25 bp, Homo sapien
aagggtacagtcctattgtatgtta

SEQ ID NO: 89452 - DNA, 25 bp, Homo sapien
aacacactgatgatgtgagcctgtg

SEQ ID NO: 89453 - DNA, 25 bp, Homo sapien
gagatgagccaatcaccagttgtta

SEQ ID NO: 89454 - DNA, 25 bp, Homo sapien
gttgttatgttcgaatctgctttgt

SEQ ID NO: 89455 - DNA, 25 bp, Homo sapien
atctgctttgtgttgggacgcttta

SEQ ID NO: 89456 - DNA, 25 bp, Homo sapien
tgggacgctttaatgtagggtttca

SEQ ID NO: 89457 - DNA, 25 bp, Homo sapien
tgatgagactgctgacctcctcaga

SEQ ID NO: 89458 - DNA, 25 bp, Homo sapien
gctgacctcctcagaatgttgacct

SEQ ID NO: 89459 - DNA, 25 bp, Homo sapien
ttgacctcttctagagagactgcct

SEQ ID NO: 89460 - DNA, 25 bp, Homo sapien
gagactgcctcccagtgtttaagtg

SEQ ID NO: 89461 - DNA, 25 bp, Homo sapien
gtgtttaagtggctcattgctcctt

SEQ ID NO: 89462 - DNA, 25 bp, Homo sapien
attgctccttctgactctgtaaaat

SEQ ID NO: 89463 - DNA, 25 bp, Homo sapien
aaatggctctggaggacagctcaca

SEQ ID NO: 89464 - DNA, 25 bp, Homo sapien
gacagctcacaggaattctgattgc

SEQ ID NO: 89465 - DNA, 25 bp, Homo sapien
attgagagctgttcaccatgtgtgc

SEQ ID NO: 89466 - DNA, 25 bp, Homo sapien
gttcaccatgtgtgcagcctgtgct

SEQ ID NO: 89467 - DNA, 25 bp, Homo sapien
gtgctccccttctatggatatgtgt

SEQ ID NO: 89468 - DNA, 25 bp, Homo sapien
tacatttatgttaagtttgagggaa

SEQ ID NO: 89469 - DNA, 25 bp, Homo sapien
gagggaattggtagttcaagtataa

SEQ ID NO: 89470 - DNA, 25 bp, Homo sapien
attaaggccattttatttctaagtg

SEQ ID NO: 89471 - DNA, 25 bp, Homo sapien
aagttagaatcatttgcattttcat

SEQ ID NO: 89472 - DNA, 25 bp, Homo sapien
gatgctattattttaactctattag

SEQ ID NO: 89473 - DNA, 25 bp, Homo sapien
aactctattagcttaagtaatgtca

SEQ ID NO: 89474 - DNA, 25 bp, Homo sapien
gaaaacacaagcatttgaccaaatg

SEQ ID NO: 89475 - DNA, 25 bp, Homo sapien
tgaccaaatgagatccattcagcga

SEQ ID NO: 89476 - DNA, 25 bp, Homo sapien
gatccattcagcgactaactggcaa

SEQ ID NO: 89477 - DNA, 25 bp, Homo sapien
gcgactaactggcaaggcactcaaa

SEQ ID NO: 89478 - DNA, 25 bp, Homo sapien
ggcaaggcactcaaaacatgtcatt

SEQ ID NO: 89479 - DNA, 25 bp, Homo sapien
caaaagccatcttcacaaaagggaa

SEQ ID NO: 89480 - DNA, 25 bp, Homo sapien
gggaacattgattctttaagcttta

SEQ ID NO: 89481 - DNA, 25 bp, Homo sapien
taaatcaaacatgtggtcagtctac

SEQ ID NO: 89482 - DNA, 25 bp, Homo sapien
tgtggtcagtctacatttgaaatgt

SEQ ID NO: 89483 - DNA, 25 bp, Homo sapien
agttatgttgttgatgtcactgaaa

SEQ ID NO: 89484 - DNA, 25 bp, Homo sapien
tgtgtaaaagcagcactgtgcatct

SEQ ID NO: 89485 - DNA, 25 bp, Homo sapien
gcagcactgtgcatcttttaaagta

SEQ ID NO: 89486 - DNA, 25 bp, Homo sapien
taaaacagagtattcttttgacaac

SEQ ID NO: 89487 - DNA, 25 bp, Homo sapien
gaaagttcacttttccagtggctca

SEQ ID NO: 89488 - DNA, 25 bp, Homo sapien
ttcacttttccagtggctcaaaaat

SEQ ID NO: 89489 - DNA, 25 bp, Homo sapien
ggctcaaaaatttgttttaggtcag

SEQ ID NO: 89490 - DNA, 25 bp, Homo sapien
aacattttcagtactaacattaaag

SEQ ID NO: 89491 - DNA, 25 bp, Homo sapien
agtactaacattaaagtgccatatg

SEQ ID NO: 89492 - DNA, 25 bp, Homo sapien
aacacacaaacatcaagaggctatt

SEQ ID NO: 89493 - DNA, 25 bp, Homo sapien
acatcaagaggctatttatacaaat

SEQ ID NO: 89494 - DNA, 25 bp, Homo sapien
ttccactagggaaagtgcattactg

SEQ ID NO: 89495 - DNA, 25 bp, Homo sapien
gtgcattactggtgaaggtattatc

SEQ ID NO: 89496 - DNA, 25 bp, Homo sapien
gaaggtattatcaatttattctact

SEQ ID NO: 89497 - DNA, 25 bp, Homo sapien
tattctacttgcttataatgttaca

SEQ ID NO: 89498 - DNA, 25 bp, Homo sapien
cagtgaatgttctggcttactctgc

SEQ ID NO: 89499 - DNA, 25 bp, Homo sapien
gaatgttctggcttactctgcctca

SEQ ID NO: 89500 - DNA, 25 bp, Homo sapien
gttctggcttactctgcctcacttt

SEQ ID NO: 89501 - DNA, 25 bp, Homo sapien
aaggctgaccccttagatggcccag

SEQ ID NO: 89502 - DNA, 25 bp, Homo sapien
ggctgaccccttagatggcccagga

SEQ ID NO: 89503 - DNA, 25 bp, Homo sapien
gctgaccccttagatggcccaggaa

SEQ ID NO: 89504 - DNA, 25 bp, Homo sapien
ctgaccccttagatggcccaggaat

SEQ ID NO: 89505 - DNA, 25 bp, Homo sapien
tgaccccttagatggcccaggaatg

SEQ ID NO: 89506 - DNA, 25 bp, Homo sapien
gaccccttagatggcccaggaatgg

SEQ ID NO: 89507 - DNA, 25 bp, Homo sapien
atggcccaggaatggcaggtgctac

SEQ ID NO: 89508 - DNA, 25 bp, Homo sapien
tgctacaaaaatggtacccacgtgg

SEQ ID NO: 89509 - DNA, 25 bp, Homo sapien
agggctcatcagcacccgctcaggg

SEQ ID NO: 89510 - DNA, 25 bp, Homo sapien
ggctcatcagcacccgctcagggag

SEQ ID NO: 89511 - DNA, 25 bp, Homo sapien
atcagcacccgctcagggagcctgt

SEQ ID NO: 89512 - DNA, 25 bp, Homo sapien
attttgatatgtaaagctctacaca

SEQ ID NO: 89513 - DNA, 25 bp, Homo sapien
ttttgatatgtaaagctctacacaa

SEQ ID NO: 89514 - DNA, 25 bp, Homo sapien
ttgatatgtaaagctctacacaaag

SEQ ID NO: 89515 - DNA, 25 bp, Homo sapien
tgatatgtaaagctctacacaaagc

SEQ ID NO: 89516 - DNA, 25 bp, Homo sapien
gatatgtaaagctctacacaaagct

SEQ ID NO: 89517 - DNA, 25 bp, Homo sapien
atatgtaaagctctacacaaagcta

SEQ ID NO: 89518 - DNA, 25 bp, Homo sapien
tatgtaaagctctacacaaagctaa

SEQ ID NO: 89519 - DNA, 25 bp, Homo sapien
atgtaaagctctacacaaagctaaa

SEQ ID NO: 89520 - DNA, 25 bp, Homo sapien
ataatgtttacactaataagcaaat

SEQ ID NO: 89521 - DNA, 25 bp, Homo sapien
gtttacactaataagcaaatatgtt

SEQ ID NO: 89522 - DNA, 25 bp, Homo sapien
ataatcttagtgatatgcctattaa

SEQ ID NO: 89523 - DNA, 25 bp, Homo sapien
cttcctattccatgttgaggtttgt

SEQ ID NO: 89524 - DNA, 25 bp, Homo sapien
ttccatgttgaggtttgtgggcccc

SEQ ID NO: 89525 - DNA, 25 bp, Homo sapien
ggcccctctagaggagggctagttc

SEQ ID NO: 89526 - DNA, 25 bp, Homo sapien
tctatacttaaattgattcccaggg

SEQ ID NO: 89527 - DNA, 25 bp, Homo sapien
gggtgtctacggttaagcaacagat

SEQ ID NO: 89528 - DNA, 25 bp, Homo sapien
cagatacctccttccctttgtaaat

SEQ ID NO: 89529 - DNA, 25 bp, Homo sapien
gtatttttatacttcatcctcgcct

SEQ ID NO: 89530 - DNA, 25 bp, Homo sapien
tcgcctctcaggctttagatacgaa

SEQ ID NO: 89531 - DNA, 25 bp, Homo sapien
ggctttagatacgaaatctccagaa

SEQ ID NO: 89532 - DNA, 25 bp, Homo sapien
gattttctgttcctccctggagtgg

SEQ ID NO: 89533 - DNA, 25 bp, Homo sapien
ttctgttcctccctggagtgggtga

SEQ ID NO: 89534 - DNA, 25 bp, Homo sapien
gtcttctaggaagaaccatctcatc

SEQ ID NO: 89535 - DNA, 25 bp, Homo sapien
ccatctcatctaggtacaaaaggaa

SEQ ID NO: 89536 - DNA, 25 bp, Homo sapien
aaaaaacccttgatccgtgatcatt

SEQ ID NO: 89537 - DNA, 25 bp, Homo sapien
atccgtgatcatttcagagcaccaa

SEQ ID NO: 89538 - DNA, 25 bp, Homo sapien
aacttcatcaccttcaggcttcagt

SEQ ID NO: 89539 - DNA, 25 bp, Homo sapien
accttcaggcttcagtgtactgggt

SEQ ID NO: 89540 - DNA, 25 bp, Homo sapien
tgtactgggtaacactgaccatgtc

SEQ ID NO: 89541 - DNA, 25 bp, Homo sapien
actgaccatgtcgttctgcttgaga

SEQ ID NO: 89542 - DNA, 25 bp, Homo sapien
catgtcgttctgcttgagacagata

SEQ ID NO: 89543 - DNA, 25 bp, Homo sapien
ggatctttcatctgagttctttttc

SEQ ID NO: 89544 - DNA, 25 bp, Homo sapien
gtcagtatcctgtttgttattgtta

SEQ ID NO: 89545 - DNA, 25 bp, Homo sapien
tgtgcccctgaaaactacctattgt

SEQ ID NO: 89546 - DNA, 25 bp, Homo sapien
gaaaactacctattgtcacaatgac

SEQ ID NO: 89547 - DNA, 25 bp, Homo sapien
gtcacaatgacagtgacctcactgg

SEQ ID NO: 89548 - DNA, 25 bp, Homo sapien
tgtggtgactgcacacagctcgcaa

SEQ ID NO: 89549 - DNA, 25 bp, Homo sapien
acacagctcgcaaaactgtctttgg

SEQ ID NO: 89550 - DNA, 25 bp, Homo sapien
aactggcgtatacaagatgacttct

SEQ ID NO: 89551 - DNA, 25 bp, Homo sapien
gacttctgatatcatgtttgccatg

SEQ ID NO: 89552 - DNA, 25 bp, Homo sapien
ggttcttaagaactcataggtgact

SEQ ID NO: 89553 - DNA, 25 bp, Homo sapien
gtgactttctgatgactgaatgtct

SEQ ID NO: 89554 - DNA, 25 bp, Homo sapien
gaatgtctgtttcagagacgcttcg

SEQ ID NO: 89555 - DNA, 25 bp, Homo sapien
ttcagagacgcttcgggccttttta

SEQ ID NO: 89556 - DNA, 25 bp, Homo sapien
gtaaggatgaggtactttcttctca

SEQ ID NO: 89557 - DNA, 25 bp, Homo sapien
atgaggtactttcttctcatttact

SEQ ID NO: 89558 - DNA, 25 bp, Homo sapien
gaatgttaaggagactctagccata

SEQ ID NO: 89559 - DNA, 25 bp, Homo sapien
gagactctagccatagtattttgga

SEQ ID NO: 89560 - DNA, 25 bp, Homo sapien
taatgacttgatttattgttctgag

SEQ ID NO: 89561 - DNA, 25 bp, Homo sapien
tgagtctctctgctatgttttgtgc

SEQ ID NO: 89562 - DNA, 25 bp, Homo sapien
atgttttgtgctcagatttacccga

SEQ ID NO: 89563 - DNA, 25 bp, Homo sapien
tgtgctcagatttacccgagcctca

SEQ ID NO: 89564 - DNA, 25 bp, Homo sapien
ctcaccacctcttgtaggagctata

SEQ ID NO: 89565 - DNA, 25 bp, Homo sapien
ggagctataattggtaatgttttga

SEQ ID NO: 89566 - DNA, 25 bp, Homo sapien
gcttgctttacatcgccataataaa

SEQ ID NO: 89567 - DNA, 25 bp, Homo sapien
tgtcttctgacactgagtccacgga

SEQ ID NO: 89568 - DNA, 25 bp, Homo sapien
aacccaagactacggctattcaagg

SEQ ID NO: 89569 - DNA, 25 bp, Homo sapien
gaaaaggctgcggtaaaatcagtaa

SEQ ID NO: 89570 - DNA, 25 bp, Homo sapien
taagagcacaaagggatccaatttt

SEQ ID NO: 89571 - DNA, 25 bp, Homo sapien
gatccaatttttccaactcggaagt

SEQ ID NO: 89572 - DNA, 25 bp, Homo sapien
actcggaagtggcaattggtttgtc

SEQ ID NO: 89573 - DNA, 25 bp, Homo sapien
caattggtttgtctccttacacctt

SEQ ID NO: 89574 - DNA, 25 bp, Homo sapien
tttccccagaagaggcttttccatg

SEQ ID NO: 89575 - DNA, 25 bp, Homo sapien
cccagaagaggcttttccatgttgc

SEQ ID NO: 89576 - DNA, 25 bp, Homo sapien
agaaaacatcacctaggccggtgtg

SEQ ID NO: 89577 - DNA, 25 bp, Homo sapien
tgtgtgcctggcagaacactgcact

SEQ ID NO: 89578 - DNA, 25 bp, Homo sapien
tagctatgcctatactattatgcaa

SEQ ID NO: 89579 - DNA, 25 bp, Homo sapien
gtttacttccctctaagcaaatatg

SEQ ID NO: 89580 - DNA, 25 bp, Homo sapien
aatatgcttgacatgcctaacacag

SEQ ID NO: 89581 - DNA, 25 bp, Homo sapien
ttgacatgcctaacacagcattccc

SEQ ID NO: 89582 - DNA, 25 bp, Homo sapien
gcattcccttaaacattttgcacaa

SEQ ID NO: 89583 - DNA, 25 bp, Homo sapien
atgctgtgtgatgtataatgttgta

SEQ ID NO: 89584 - DNA, 25 bp, Homo sapien
ctttaatctgttgttgcagtgtatc

SEQ ID NO: 89585 - DNA, 25 bp, Homo sapien
gttgttgcagtgtatctttttgtaa

SEQ ID NO: 89586 - DNA, 25 bp, Homo sapien
gtatctttttgtaaagtttgcaaca

SEQ ID NO: 89587 - DNA, 25 bp, Homo sapien
aagtttgcaacaatcctcaatcaag

SEQ ID NO: 89588 - DNA, 25 bp, Homo sapien
gcaacaatcctcaatcaagtctatg

SEQ ID NO: 89589 - DNA, 25 bp, Homo sapien
tggccactgcagaccccggaaggtc

SEQ ID NO: 89590 - DNA, 25 bp, Homo sapien
agaccccggaaggtcaaggctgaca

SEQ ID NO: 89591 - DNA, 25 bp, Homo sapien
caaggctgacatcccatccttggaa

SEQ ID NO: 89592 - DNA, 25 bp, Homo sapien
acatcccatccttggaaccagaggg

SEQ ID NO: 89593 - DNA, 25 bp, Homo sapien
agcctcttagcaggaggctctcctt

SEQ ID NO: 89594 - DNA, 25 bp, Homo sapien
tttcttattgtcttgccctgcatct

SEQ ID NO: 89595 - DNA, 25 bp, Homo sapien
gagcaggcaatatctgaaggtgcaa

SEQ ID NO: 89596 - DNA, 25 bp, Homo sapien
ctgttccctgcacaactctcatggt

SEQ ID NO: 89597 - DNA, 25 bp, Homo sapien
catggttttaattgtaccccatctt

SEQ ID NO: 89598 - DNA, 25 bp, Homo sapien
ccatcttccacatctttaaagctca

SEQ ID NO: 89599 - DNA, 25 bp, Homo sapien
aaagctcatgtgaaaaatgctgcat

SEQ ID NO: 89600 - DNA, 25 bp, Homo sapien
tccagtgccccaaaatttgcaaaac

SEQ ID NO: 89601 - DNA, 25 bp, Homo sapien
ctgcccttggaatgcaccaaaagaa

SEQ ID NO: 89602 - DNA, 25 bp, Homo sapien
agaaacacttattcaaaagcccaag

SEQ ID NO: 89603 - DNA, 25 bp, Homo sapien
caaaagcccaagtcagcaggagaaa

SEQ ID NO: 89604 - DNA, 25 bp, Homo sapien
gaaaataggtgacgtgtgccacgaa

SEQ ID NO: 89605 - DNA, 25 bp, Homo sapien
gtgccacgaaaactcaaatcccttg

SEQ ID NO: 89606 - DNA, 25 bp, Homo sapien
aaatcccttggagaatcaacatttc

SEQ ID NO: 89607 - DNA, 25 bp, Homo sapien
tcaacatttcattggttcagaagac

SEQ ID NO: 89608 - DNA, 25 bp, Homo sapien
ggataacatacaaaccggtgtggaa

SEQ ID NO: 89609 - DNA, 25 bp, Homo sapien
ggaaaatgttgtcctttgagtggca

SEQ ID NO: 89610 - DNA, 25 bp, Homo sapien
gttgtcctttgagtggcaagaatta

SEQ ID NO: 89611 - DNA, 25 bp, Homo sapien
ttcagtgttgaatcgtaaatagtct

SEQ ID NO: 89612 - DNA, 25 bp, Homo sapien
tagtctgaagcaggccagtgttcct

SEQ ID NO: 89613 - DNA, 25 bp, Homo sapien
aggccagtgttccttttggctgcca

SEQ ID NO: 89614 - DNA, 25 bp, Homo sapien
tttggctgccagtcttggattagta

SEQ ID NO: 89615 - DNA, 25 bp, Homo sapien
ttcagattccctggttctttgccac

SEQ ID NO: 89616 - DNA, 25 bp, Homo sapien
tggttctttgccactcagagtattg

SEQ ID NO: 89617 - DNA, 25 bp, Homo sapien
gccactcagagtattgtacttttga

SEQ ID NO: 89618 - DNA, 25 bp, Homo sapien
atttttatatactagctctttcatg

SEQ ID NO: 89619 - DNA, 25 bp, Homo sapien
actagctctttcatgtataaaacag

SEQ ID NO: 89620 - DNA, 25 bp, Homo sapien
gttatttttctgcacaaatgtcttg

SEQ ID NO: 89621 - DNA, 25 bp, Homo sapien
gttgaaacactgttacagttccata

SEQ ID NO: 89622 - DNA, 25 bp, Homo sapien
ggttccctctcacttttagatcgga

SEQ ID NO: 89623 - DNA, 25 bp, Homo sapien
gatcggaagccagtttctacacact

SEQ ID NO: 89624 - DNA, 25 bp, Homo sapien
ctcaccggccgaagaggagaaactc

SEQ ID NO: 89625 - DNA, 25 bp, Homo sapien
ggagaaactcattgaaatcctggaa

SEQ ID NO: 89626 - DNA, 25 bp, Homo sapien
cagctggctcagacatttaaatagg

SEQ ID NO: 89627 - DNA, 25 bp, Homo sapien
atttaaataggccaacccagacaca

SEQ ID NO: 89628 - DNA, 25 bp, Homo sapien
agtgcggtaccagaattgccttaga

SEQ ID NO: 89629 - DNA, 25 bp, Homo sapien
gaattgccttagaagataccagaag

SEQ ID NO: 89630 - DNA, 25 bp, Homo sapien
ataccagaaggtgcggtctagggac

SEQ ID NO: 89631 - DNA, 25 bp, Homo sapien
tcaacttcccctcgaagacgttgtg

SEQ ID NO: 89632 - DNA, 25 bp, Homo sapien
cgaggcctacaagggatgggaactt

SEQ ID NO: 89633 - DNA, 25 bp, Homo sapien
ctgggtgggaattggctgagccaag

SEQ ID NO: 89634 - DNA, 25 bp, Homo sapien
tcagactgtgggacacggactcgca

SEQ ID NO: 89635 - DNA, 25 bp, Homo sapien
agactgtgggacacggactcgcaga

SEQ ID NO: 89636 - DNA, 25 bp, Homo sapien
ctgtgggacacggactcgcagaata

SEQ ID NO: 89637 - DNA, 25 bp, Homo sapien
gtgggacacggactcgcagaataaa

SEQ ID NO: 89638 - DNA, 25 bp, Homo sapien
gacacggactcgcagaataaacata

SEQ ID NO: 89639 - DNA, 25 bp, Homo sapien
cggactcgcagaataaacatatatg

SEQ ID NO: 89640 - DNA, 25 bp, Homo sapien
gatcccaagagtggtgcgatccacc

SEQ ID NO: 89641 - DNA, 25 bp, Homo sapien
aagagtggtgcgatccaccaggagt

SEQ ID NO: 89642 - DNA, 25 bp, Homo sapien
ggtgcgatccaccaggagtgccgcc

SEQ ID NO: 89643 - DNA, 25 bp, Homo sapien
cagctgctcccggaaatgcaaatga

SEQ ID NO: 89644 - DNA, 25 bp, Homo sapien
gggaactgtactactcgcagtgata

SEQ ID NO: 89645 - DNA, 25 bp, Homo sapien
actactcgcagtgataggtttgcag

SEQ ID NO: 89646 - DNA, 25 bp, Homo sapien
gctgtggcagcctagcttggagaac

SEQ ID NO: 89647 - DNA, 25 bp, Homo sapien
agcctagcttggagaacgctgctgt

SEQ ID NO: 89648 - DNA, 25 bp, Homo sapien
gatggtctcaagtcagagggaagca

SEQ ID NO: 89649 - DNA, 25 bp, Homo sapien
agggaagcagagacgcgcgtctcaa

SEQ ID NO: 89650 - DNA, 25 bp, Homo sapien
cactcactgcactggcagggtgcaa

SEQ ID NO: 89651 - DNA, 25 bp, Homo sapien
tttgtaacaggcttttcggtgctcc

SEQ ID NO: 89652 - DNA, 25 bp, Homo sapien
taacaggcttttcggtgctcctcac

SEQ ID NO: 89653 - DNA, 25 bp, Homo sapien
acctttttgcctcaaggtctctgta

SEQ ID NO: 89654 - DNA, 25 bp, Homo sapien
tgcctcaaggtctctgtaaatgaaa

SEQ ID NO: 89655 - DNA, 25 bp, Homo sapien
aacaagtagtcctgtttgccactaa

SEQ ID NO: 89656 - DNA, 25 bp, Homo sapien
gtagtcctgtttgccactaaaaaca

SEQ ID NO: 89657 - DNA, 25 bp, Homo sapien
tcaaagaggttatctctgccagtca

SEQ ID NO: 89658 - DNA, 25 bp, Homo sapien
gttatctctgccagtcacaagtgtg

SEQ ID NO: 89659 - DNA, 25 bp, Homo sapien
tcacaagtgtggctggtgtcattct

SEQ ID NO: 89660 - DNA, 25 bp, Homo sapien
tgtcattctgggtctgactggagcc

SEQ ID NO: 89661 - DNA, 25 bp, Homo sapien
tgactggagccctcctggactgttt

SEQ ID NO: 89662 - DNA, 25 bp, Homo sapien
ctcctggactgtttctttaatttca

SEQ ID NO: 89663 - DNA, 25 bp, Homo sapien
aagccctgcagacatagtacctggt

SEQ ID NO: 89664 - DNA, 25 bp, Homo sapien
gtacctggtcagaactatgcctcgg

SEQ ID NO: 89665 - DNA, 25 bp, Homo sapien
agaactatgcctcggtttatttatc

SEQ ID NO: 89666 - DNA, 25 bp, Homo sapien
gggagctttctgtcatccccatggc

SEQ ID NO: 89667 - DNA, 25 bp, Homo sapien
tccccatggctcaaggataacctac

SEQ ID NO: 89668 - DNA, 25 bp, Homo sapien
gataacctacctgcctgcagagaag

SEQ ID NO: 89669 - DNA, 25 bp, Homo sapien
agagcgaaggtcttgctggatgact

SEQ ID NO: 89670 - DNA, 25 bp, Homo sapien
ttgctggatgacttttcacccgcac

SEQ ID NO: 89671 - DNA, 25 bp, Homo sapien
caggagcaggctcccaagtgaagaa

SEQ ID NO: 89672 - DNA, 25 bp, Homo sapien
aggctcccaagtgaagaaaccacca

SEQ ID NO: 89673 - DNA, 25 bp, Homo sapien
ccagaagtaatgactctcaaacctg

SEQ ID NO: 89674 - DNA, 25 bp, Homo sapien
aggctctatgctttctgtaattgtg

SEQ ID NO: 89675 - DNA, 25 bp, Homo sapien
aattgtgtctcgtttgtgtgcacgc

SEQ ID NO: 89676 - DNA, 25 bp, Homo sapien
tgtgtgcacgcaggtttgttttatg

SEQ ID NO: 89677 - DNA, 25 bp, Homo sapien
ttctagtcactcacccaagtcaaat

SEQ ID NO: 89678 - DNA, 25 bp, Homo sapien
agtcactcacccaagtcaaatatgt

SEQ ID NO: 89679 - DNA, 25 bp, Homo sapien
tcacccaagtcaaatatgtggcaca

SEQ ID NO: 89680 - DNA, 25 bp, Homo sapien
atgtggcacaggcattgtcttttct

SEQ ID NO: 89681 - DNA, 25 bp, Homo sapien
ggcacaggcattgtcttttctttga

SEQ ID NO: 89682 - DNA, 25 bp, Homo sapien
acaggcattgtcttttctttgaaat

SEQ ID NO: 89683 - DNA, 25 bp, Homo sapien
gaaataaactttcaagactcagaat

SEQ ID NO: 89684 - DNA, 25 bp, Homo sapien
ctttcaagactcagaatcttaagga

SEQ ID NO: 89685 - DNA, 25 bp, Homo sapien
gcatattcttttggtatcttgattt

SEQ ID NO: 89686 - DNA, 25 bp, Homo sapien
ggtatcttgattttgatccattgca

SEQ ID NO: 89687 - DNA, 25 bp, Homo sapien
tcttgattttgatccattgcatcaa

SEQ ID NO: 89688 - DNA, 25 bp, Homo sapien
tgatatgtaaagctctacacaaagc

SEQ ID NO: 89689 - DNA, 25 bp, Homo sapien
ttttactgtcatataatcttagtga

SEQ ID NO: 89690 - DNA, 25 bp, Homo sapien
ttactgtcatataatcttagtgata

SEQ ID NO: 89691 - DNA, 25 bp, Homo sapien
tataatcttagtgatatgcctatta

SEQ ID NO: 89692 - DNA, 25 bp, Homo sapien
aaattggctcatctggctttttgaa

SEQ ID NO: 89693 - DNA, 25 bp, Homo sapien
aattggctcatctggctttttgaaa

SEQ ID NO: 89694 - DNA, 25 bp, Homo sapien
ggctcatctggctttttgaaaattt

SEQ ID NO: 89695 - DNA, 25 bp, Homo sapien
attttgaaattcttacagatgttga

SEQ ID NO: 89696 - DNA, 25 bp, Homo sapien
gatgttgattaggtatatctacaaa

SEQ ID NO: 89697 - DNA, 25 bp, Homo sapien
gttgattaggtatatctacaaatta

SEQ ID NO: 89698 - DNA, 25 bp, Homo sapien
gtatttttcttgtgtatgtatacaa

SEQ ID NO: 89699 - DNA, 25 bp, Homo sapien
aagaagtccaagttccgcttgtcca

SEQ ID NO: 89700 - DNA, 25 bp, Homo sapien
gttccgcttgtccaagatctggtca

SEQ ID NO: 89701 - DNA, 25 bp, Homo sapien
agcccctcccagtagtagccagtag

SEQ ID NO: 89702 - DNA, 25 bp, Homo sapien
ctcccagtagtagccagtagggccg

SEQ ID NO: 89703 - DNA, 25 bp, Homo sapien
acctggcatccggatttggactcgg

SEQ ID NO: 89704 - DNA, 25 bp, Homo sapien
cggacccggcattcggacttggact

SEQ ID NO: 89705 - DNA, 25 bp, Homo sapien
cggcattcggacttggactcgggaa

SEQ ID NO: 89706 - DNA, 25 bp, Homo sapien
ttggactcgggaagggcctcctgtc

SEQ ID NO: 89707 - DNA, 25 bp, Homo sapien
tggacagcagggacctgcgctaccg

SEQ ID NO: 89708 - DNA, 25 bp, Homo sapien
tgcgctaccgtctgtggtctcaata

SEQ ID NO: 89709 - DNA, 25 bp, Homo sapien
taccgtctgtggtctcaataaagaa

SEQ ID NO: 89710 - DNA, 25 bp, Homo sapien
tgaccccagctcctgacacacagaa

SEQ ID NO: 89711 - DNA, 25 bp, Homo sapien
ggggatgtccaatactaccctgctt

SEQ ID NO: 89712 - DNA, 25 bp, Homo sapien
tatttgtaatgatctttaactgcct

SEQ ID NO: 89713 - DNA, 25 bp, Homo sapien
atctttaactgcctgctgttaagat

SEQ ID NO: 89714 - DNA, 25 bp, Homo sapien
aactgcctgctgttaagatattagg

SEQ ID NO: 89715 - DNA, 25 bp, Homo sapien
gcctgctgttaagatattaggccaa

SEQ ID NO: 89716 - DNA, 25 bp, Homo sapien
gaaatattttaatgctaacttgtta

SEQ ID NO: 89717 - DNA, 25 bp, Homo sapien
taacttgttagttttcctcagaaag

SEQ ID NO: 89718 - DNA, 25 bp, Homo sapien
gttttcctcagaaagctagtatttg

SEQ ID NO: 89719 - DNA, 25 bp, Homo sapien
cagaaagctagtatttgaagccatt

SEQ ID NO: 89720 - DNA, 25 bp, Homo sapien
gagtttaagatgctctaatttcaat

SEQ ID NO: 89721 - DNA, 25 bp, Homo sapien
gaccacacgcacttcagggtggaag

SEQ ID NO: 89722 - DNA, 25 bp, Homo sapien
gcgctccgctttgctttgggattaa

SEQ ID NO: 89723 - DNA, 25 bp, Homo sapien
gggattaatttattctgcatctgct

SEQ ID NO: 89724 - DNA, 25 bp, Homo sapien
atttattctgcatctgctgagaggg

SEQ ID NO: 89725 - DNA, 25 bp, Homo sapien
cccagccatatcttacactttggta

SEQ ID NO: 89726 - DNA, 25 bp, Homo sapien
aaatatccacaatattccttgagtg

SEQ ID NO: 89727 - DNA, 25 bp, Homo sapien
acaatattccttgagtgagtcagaa

SEQ ID NO: 89728 - DNA, 25 bp, Homo sapien
gtgagtcagaatctatagccggtta

SEQ ID NO: 89729 - DNA, 25 bp, Homo sapien
ctatagccggttagtgatggtttca

SEQ ID NO: 89730 - DNA, 25 bp, Homo sapien
aatcgtgttcgtgtctgttttgctc

SEQ ID NO: 89731 - DNA, 25 bp, Homo sapien
tgttcgtgtctgttttgctcgattc

SEQ ID NO: 89732 - DNA, 25 bp, Homo sapien
cctgggagtcaggttcacgggtaca

SEQ ID NO: 89733 - DNA, 25 bp, Homo sapien
agaagatgaatctcagatgtcactc

SEQ ID NO: 89734 - DNA, 25 bp, Homo sapien
gatgtcactcaacctgagccgtcat

SEQ ID NO: 89735 - DNA, 25 bp, Homo sapien
gagccgtcattctctgtggcagggc

SEQ ID NO: 89736 - DNA, 25 bp, Homo sapien
gggtttctcttactcaatccctgga

SEQ ID NO: 89737 - DNA, 25 bp, Homo sapien
actcaatccctggagtgtaagcatt

SEQ ID NO: 89738 - DNA, 25 bp, Homo sapien
gtgcccacaccttactgagtattga

SEQ ID NO: 89739 - DNA, 25 bp, Homo sapien
gtattgagttttagagctttcgctt

SEQ ID NO: 89740 - DNA, 25 bp, Homo sapien
gctttcgcttgatgtgcttgaccaa

SEQ ID NO: 89741 - DNA, 25 bp, Homo sapien
gtgcttgaccaagagacttcttttg

SEQ ID NO: 89742 - DNA, 25 bp, Homo sapien
agagacttcttttgtatccttttct

SEQ ID NO: 89743 - DNA, 25 bp, Homo sapien
gattaggttagtgatgttttgcctt

SEQ ID NO: 89744 - DNA, 25 bp, Homo sapien
ttttgcctttaaacagattcatcat

SEQ ID NO: 89745 - DNA, 25 bp, Homo sapien
aacagattcatcattattcctaaag

SEQ ID NO: 89746 - DNA, 25 bp, Homo sapien
tgctgtattaatactgtcttctaga

SEQ ID NO: 89747 - DNA, 25 bp, Homo sapien
ttctagaaagtatccaccagtgcct

SEQ ID NO: 89748 - DNA, 25 bp, Homo sapien
cagtgcctacttttcttcgatatca

SEQ ID NO: 89749 - DNA, 25 bp, Homo sapien
gatatcattagctgtttttcgaaac

SEQ ID NO: 89750 - DNA, 25 bp, Homo sapien
gaatttgctcttcagagatttctca

SEQ ID NO: 89751 - DNA, 25 bp, Homo sapien
gagatttctcatatgtttgcgtata

SEQ ID NO: 89752 - DNA, 25 bp, Homo sapien
gtttgcgtataaggaactactggta

SEQ ID NO: 89753 - DNA, 25 bp, Homo sapien
ggaggtgcagagaacatgctgaaac

SEQ ID NO: 89754 - DNA, 25 bp, Homo sapien
agctatggtgggaagcctggcattt

SEQ ID NO: 89755 - DNA, 25 bp, Homo sapien
gggtgctccttgcaacgtcttaagc

SEQ ID NO: 89756 - DNA, 25 bp, Homo sapien
tgcaacgtcttaagcaagcgacccc

SEQ ID NO: 89757 - DNA, 25 bp, Homo sapien
aggtggcaacccatggaggcagaaa

SEQ ID NO: 89758 - DNA, 25 bp, Homo sapien
aaagaaggacgccagcctgaccctt

SEQ ID NO: 89759 - DNA, 25 bp, Homo sapien
acccttatctgaaacgtcctaagca

SEQ ID NO: 89760 - DNA, 25 bp, Homo sapien
gcagagttaatcctggctgctcagg

SEQ ID NO: 89761 - DNA, 25 bp, Homo sapien
ggctgctcaggagaggcgacacatt

SEQ ID NO: 89762 - DNA, 25 bp, Homo sapien
gcgacacatttcaaatctccacgag

SEQ ID NO: 89763 - DNA, 25 bp, Homo sapien
gagacttaatcatgcctatggcttt

SEQ ID NO: 89764 - DNA, 25 bp, Homo sapien
gcctatggctttgaataatcttatg

SEQ ID NO: 89765 - DNA, 25 bp, Homo sapien
acatcggcttcgactggcccggagt

SEQ ID NO: 89766 - DNA, 25 bp, Homo sapien
tcggcttcgactggcccggagtctg

SEQ ID NO: 89767 - DNA, 25 bp, Homo sapien
ccggagtctgggtccacctggacat

SEQ ID NO: 89768 - DNA, 25 bp, Homo sapien
gagtctgggtccacctggacattgc

SEQ ID NO: 89769 - DNA, 25 bp, Homo sapien
tgggtccacctggacattgctgcac

SEQ ID NO: 89770 - DNA, 25 bp, Homo sapien
acctggacattgctgcaccggtgca

SEQ ID NO: 89771 - DNA, 25 bp, Homo sapien
ggacattgctgcaccggtgcatgct

SEQ ID NO: 89772 - DNA, 25 bp, Homo sapien
ttgctgcaccggtgcatgctggtga

SEQ ID NO: 89773 - DNA, 25 bp, Homo sapien
cggtgcatgctggtgagcgagccac

SEQ ID NO: 89774 - DNA, 25 bp, Homo sapien
tgctgaacctggtgtccccactggg

SEQ ID NO: 89775 - DNA, 25 bp, Homo sapien
acctggtgtccccactgggctgtga

SEQ ID NO: 89776 - DNA, 25 bp, Homo sapien
ataatatatttgagcagtccctgct

SEQ ID NO: 89777 - DNA, 25 bp, Homo sapien
cttttatataggtcacattgcacat

SEQ ID NO: 89778 - DNA, 25 bp, Homo sapien
ggtcacattgcacatgagtgagttt

SEQ ID NO: 89779 - DNA, 25 bp, Homo sapien
acatgagtgagtttactgtaagctg

SEQ ID NO: 89780 - DNA, 25 bp, Homo sapien
ttactaggttaagatatgtgcattt

SEQ ID NO: 89781 - DNA, 25 bp, Homo sapien
ttttgatagatattggcaagttgcc

SEQ ID NO: 89782 - DNA, 25 bp, Homo sapien
ggcaagttgccatctataaggattg

SEQ ID NO: 89783 - DNA, 25 bp, Homo sapien
gccatctataaggattgtgccagtt

SEQ ID NO: 89784 - DNA, 25 bp, Homo sapien
tataaggattgtgccagtttacagt

SEQ ID NO: 89785 - DNA, 25 bp, Homo sapien
acccacaatgcatgagagtgcctat

SEQ ID NO: 89786 - DNA, 25 bp, Homo sapien
tgagagtgcctattaaatctttgta

SEQ ID NO: 89787 - DNA, 25 bp, Homo sapien
gttgtgccataagatatcatagaaa

SEQ ID NO: 89788 - DNA, 25 bp, Homo sapien
agtggttgtgattttcttagaaagt

SEQ ID NO: 89789 - DNA, 25 bp, Homo sapien
gaaagttgagggtatttcacgtaag

SEQ ID NO: 89790 - DNA, 25 bp, Homo sapien
ttcacgtaaggatgagctcccgcaa

SEQ ID NO: 89791 - DNA, 25 bp, Homo sapien
gagctcccgcaagaagaggtactta

SEQ ID NO: 89792 - DNA, 25 bp, Homo sapien
gactctcaaatccattacctcaatt

SEQ ID NO: 89793 - DNA, 25 bp, Homo sapien
gtattttacgttgtctataatcatt

SEQ ID NO: 89794 - DNA, 25 bp, Homo sapien
ataatcattaaatcactccctgtgt

SEQ ID NO: 89795 - DNA, 25 bp, Homo sapien
ccctgtgtaatttgtgagaaccatc

SEQ ID NO: 89796 - DNA, 25 bp, Homo sapien
taatttgtgagaaccatctagtagc

SEQ ID NO: 89797 - DNA, 25 bp, Homo sapien
accatctagtagctcgaaataaaat

SEQ ID NO: 89798 - DNA, 25 bp, Homo sapien
gaaaagtcttcggtccagtgttaca

SEQ ID NO: 89799 - DNA, 25 bp, Homo sapien
ggtccagtgttacaccttatagtgt

SEQ ID NO: 89800 - DNA, 25 bp, Homo sapien
gtgtaattcagtccctaagcacaga

SEQ ID NO: 89801 - DNA, 25 bp, Homo sapien
gaatgaatgtctggcctgcatatgg

SEQ ID NO: 89802 - DNA, 25 bp, Homo sapien
gttacagtgtaacctctggctgcag

SEQ ID NO: 89803 - DNA, 25 bp, Homo sapien
aggacaaccctaacagcctagtctt

SEQ ID NO: 89804 - DNA, 25 bp, Homo sapien
cagcctagtcttgtatggtgtaaat

SEQ ID NO: 89805 - DNA, 25 bp, Homo sapien
tagcaacaatgccaactcaggagag

SEQ ID NO: 89806 - DNA, 25 bp, Homo sapien
actcaggagagcagacggccgattt

SEQ ID NO: 89807 - DNA, 25 bp, Homo sapien
cggccgatttcagtgaagtctggta

SEQ ID NO: 89808 - DNA, 25 bp, Homo sapien
gttatttcagtctcagtgcatctcc

SEQ ID NO: 89809 - DNA, 25 bp, Homo sapien
aaaaggaagtctggattctgaggac

SEQ ID NO: 89810 - DNA, 25 bp, Homo sapien
gaggaccacgtctcacccagggtga

SEQ ID NO: 89811 - DNA, 25 bp, Homo sapien
tcacccagggtgacatcaggaatgg

SEQ ID NO: 89812 - DNA, 25 bp, Homo sapien
tcaggaatggtgctagcctctgcaa

SEQ ID NO: 89813 - DNA, 25 bp, Homo sapien
tggtgctagcctctgcaacacgaca

SEQ ID NO: 89814 - DNA, 25 bp, Homo sapien
acacgacacccagtttgaagagctc

SEQ ID NO: 89815 - DNA, 25 bp, Homo sapien
gaagagctctatacaggtactaaga

SEQ ID NO: 89816 - DNA, 25 bp, Homo sapien
gggacaccaagactctgcacaacca

SEQ ID NO: 89817 - DNA, 25 bp, Homo sapien
gactctgcacaaccagattgcttgt

SEQ ID NO: 89818 - DNA, 25 bp, Homo sapien
tgtgcagagggccacaataagtgta

SEQ ID NO: 89819 - DNA, 25 bp, Homo sapien
ataatacactcacatgtttccacac

SEQ ID NO: 89820 - DNA, 25 bp, Homo sapien
gattttgaaattgaacactagaact

SEQ ID NO: 89821 - DNA, 25 bp, Homo sapien
gaagagcttattgggaattatatat

SEQ ID NO: 89822 - DNA, 25 bp, Homo sapien
atgggggcctgaatgtcagccatct

SEQ ID NO: 89823 - DNA, 25 bp, Homo sapien
agccatctttatactatagaaaaag

SEQ ID NO: 89824 - DNA, 25 bp, Homo sapien
atgaatggtcatgctttggagatca

SEQ ID NO: 89825 - DNA, 25 bp, Homo sapien
gaatggtcatgctttggagatcaaa

SEQ ID NO: 89826 - DNA, 25 bp, Homo sapien
ggtcatgctttggagatcaaatatt

SEQ ID NO: 89827 - DNA, 25 bp, Homo sapien
caaatattggttgaatgcctatgta

SEQ ID NO: 89828 - DNA, 25 bp, Homo sapien
tattggttgaatgcctatgtatgtc

SEQ ID NO: 89829 - DNA, 25 bp, Homo sapien
tgaatgcctatgtatgtcaggccct

SEQ ID NO: 89830 - DNA, 25 bp, Homo sapien
aacatatcttgtttaggaaatggat

SEQ ID NO: 89831 - DNA, 25 bp, Homo sapien
tccagggcagggtgccttccagtag

SEQ ID NO: 89832 - DNA, 25 bp, Homo sapien
gggtgccttccagtagccaagggaa

SEQ ID NO: 89833 - DNA, 25 bp, Homo sapien
agggaagcctccagagagcacagat

SEQ ID NO: 89834 - DNA, 25 bp, Homo sapien
gagcacagatgtgaaccctcagcag

SEQ ID NO: 89835 - DNA, 25 bp, Homo sapien
tgtgaaccctcagcagcaggcatca

SEQ ID NO: 89836 - DNA, 25 bp, Homo sapien
ggccaccagtagcatcttctagatg

SEQ ID NO: 89837 - DNA, 25 bp, Homo sapien
gtgtggctttaggtgagccttcacc

SEQ ID NO: 89838 - DNA, 25 bp, Homo sapien
agccttcaccttttggtgccttcgt

SEQ ID NO: 89839 - DNA, 25 bp, Homo sapien
ggtgccttcgtttcctcatttagca

SEQ ID NO: 89840 - DNA, 25 bp, Homo sapien
atttagcacctacctcctagagctg

SEQ ID NO: 89841 - DNA, 25 bp, Homo sapien
cctacctcctagagctgttttggga

SEQ ID NO: 89842 - DNA, 25 bp, Homo sapien
gctgtgtgcacggatgttatataat

SEQ ID NO: 89843 - DNA, 25 bp, Homo sapien
ggagcagacacgaacacacggaact

SEQ ID NO: 89844 - DNA, 25 bp, Homo sapien
atgaaggacaaaccccattggctgt

SEQ ID NO: 89845 - DNA, 25 bp, Homo sapien
aaaccccattggctgtttcaataag

SEQ ID NO: 89846 - DNA, 25 bp, Homo sapien
gtatttctggaagtagtcgaccatg

SEQ ID NO: 89847 - DNA, 25 bp, Homo sapien
gtcgaccatgtttggatttcttaca

SEQ ID NO: 89848 - DNA, 25 bp, Homo sapien
atttgcatcttctgaggagcttaat

SEQ ID NO: 89849 - DNA, 25 bp, Homo sapien
gtttttgcaacttaagatgactaga

SEQ ID NO: 89850 - DNA, 25 bp, Homo sapien
taatcattcctataaccactgcttg

SEQ ID NO: 89851 - DNA, 25 bp, Homo sapien
aaccactgcttggtaagcgatgcct

SEQ ID NO: 89852 - DNA, 25 bp, Homo sapien
taagcgatgcctcattcttctgaaa

SEQ ID NO: 89853 - DNA, 25 bp, Homo sapien
taaacagaaccattcttatcctggt

SEQ ID NO: 89854 - DNA, 25 bp, Homo sapien
accattcttatcctggttttaggag

SEQ ID NO: 89855 - DNA, 25 bp, Homo sapien
aaatgctttttccaagtgagtatta

SEQ ID NO: 89856 - DNA, 25 bp, Homo sapien
gaaaaacacctttcaagatgaacat

SEQ ID NO: 89857 - DNA, 25 bp, Homo sapien
gaacatgatgggattctgtgaagaa

SEQ ID NO: 89858 - DNA, 25 bp, Homo sapien
aagtggagtgctgtatcttttgcat

SEQ ID NO: 89859 - DNA, 25 bp, Homo sapien
gtatcttttgcattgcttggtagag

SEQ ID NO: 89860 - DNA, 25 bp, Homo sapien
gcattgcttggtagagttttaacac

SEQ ID NO: 89861 - DNA, 25 bp, Homo sapien
gcttggtagagttttaacacgtagg

SEQ ID NO: 89862 - DNA, 25 bp, Homo sapien
gtattgagaagcgttcttcctccct

SEQ ID NO: 89863 - DNA, 25 bp, Homo sapien
tccctcctttgcaagcgcaattaaa

SEQ ID NO: 89864 - DNA, 25 bp, Homo sapien
gacagtttctagttagagccttggc

SEQ ID NO: 89865 - DNA, 25 bp, Homo sapien
gagccttggctccatttttggatga

SEQ ID NO: 89866 - DNA, 25 bp, Homo sapien
ttttggatgatttagccccgagttc

SEQ ID NO: 89867 - DNA, 25 bp, Homo sapien
ctgagtctattttatgccccttacg

SEQ ID NO: 89868 - DNA, 25 bp, Homo sapien
atgccccttacgtactttgatagaa

SEQ ID NO: 89869 - DNA, 25 bp, Homo sapien
acattttacgttgcttttacttctg

SEQ ID NO: 89870 - DNA, 25 bp, Homo sapien
acttctgtagtgtagattgccccgg

SEQ ID NO: 89871 - DNA, 25 bp, Homo sapien
tagcatctgtgatagcttctgtccc

SEQ ID NO: 89872 - DNA, 25 bp, Homo sapien
cttcatcggttcatgtcacagggat

SEQ ID NO: 89873 - DNA, 25 bp, Homo sapien
tttctttcccaggaagcggacacgg

SEQ ID NO: 89874 - DNA, 25 bp, Homo sapien
gcggacacggagagtcagccctaat

SEQ ID NO: 89875 - DNA, 25 bp, Homo sapien
ccacagctgtttattcttgtttgac

SEQ ID NO: 89876 - DNA, 25 bp, Homo sapien
acaaagtcactttaaatctgctgca

SEQ ID NO: 89877 - DNA, 25 bp, Homo sapien
ataaagcacctagccctttggatgg

SEQ ID NO: 89878 - DNA, 25 bp, Homo sapien
ctttggatggactcctgcaggcgtg

SEQ ID NO: 89879 - DNA, 25 bp, Homo sapien
ctggcccacttttaattctttggag

SEQ ID NO: 89880 - DNA, 25 bp, Homo sapien
ggctcttctgtgtaaatcagctgct

SEQ ID NO: 89881 - DNA, 25 bp, Homo sapien
tcagctgctgggtgcgttcggtcac

SEQ ID NO: 89882 - DNA, 25 bp, Homo sapien
ggccagcctagtttgtatcagcaga

SEQ ID NO: 89883 - DNA, 25 bp, Homo sapien
gaacagtagtggactcgactcaggt

SEQ ID NO: 89884 - DNA, 25 bp, Homo sapien
gactcaggtcgtaagccttatattt

SEQ ID NO: 89885 - DNA, 25 bp, Homo sapien
gacaattaaatcttggctgctgttg

SEQ ID NO: 89886 - DNA, 25 bp, Homo sapien
aattaagctgtggtttccctctgag

SEQ ID NO: 89887 - DNA, 25 bp, Homo sapien
ggtttccctctgagtagtgggaata

SEQ ID NO: 89888 - DNA, 25 bp, Homo sapien
tccctctgagtagtgggaatagaga

SEQ ID NO: 89889 - DNA, 25 bp, Homo sapien
attttccatacctattttcaactga

SEQ ID NO: 89890 - DNA, 25 bp, Homo sapien
tttccatacctattttcaactgaag

SEQ ID NO: 89891 - DNA, 25 bp, Homo sapien
tacctattttcaactgaaggcaact

SEQ ID NO: 89892 - DNA, 25 bp, Homo sapien
gaaggcaacttgtaagatttaactc

SEQ ID NO: 89893 - DNA, 25 bp, Homo sapien
ggcaacttgtaagatttaactcagt

SEQ ID NO: 89894 - DNA, 25 bp, Homo sapien
gtaagatttaactcagtcaataaca

SEQ ID NO: 89895 - DNA, 25 bp, Homo sapien
gtcaataacatactggttttactca

SEQ ID NO: 89896 - DNA, 25 bp, Homo sapien
acatactggttttactcatctcccc

SEQ ID NO: 89897 - DNA, 25 bp, Homo sapien
ggcatctttgtctcatgtgaattta

SEQ ID NO: 89898 - DNA, 25 bp, Homo sapien
cttctcccagattccatgaatggga

SEQ ID NO: 89899 - DNA, 25 bp, Homo sapien
attgctggcagctgtaaggttctac

SEQ ID NO: 89900 - DNA, 25 bp, Homo sapien
gctggcagctgtaaggttctacttt

SEQ ID NO: 89901 - DNA, 25 bp, Homo sapien
cagctgtaaggttctacttttctcc

SEQ ID NO: 89902 - DNA, 25 bp, Homo sapien
tcccctaaaggagaattcaagagaa

SEQ ID NO: 89903 - DNA, 25 bp, Homo sapien
gtacaatgagaccttttcttccttc

SEQ ID NO: 89904 - DNA, 25 bp, Homo sapien
ggaagatgctagtgccatcttgcat

SEQ ID NO: 89905 - DNA, 25 bp, Homo sapien
gatgctagtgccatcttgcatatga

SEQ ID NO: 89906 - DNA, 25 bp, Homo sapien
gctagtgccatcttgcatatgaaaa

SEQ ID NO: 89907 - DNA, 25 bp, Homo sapien
gtaagaggtatataaaggctatcaa

SEQ ID NO: 89908 - DNA, 25 bp, Homo sapien
aaggtgggatgcaagccccttgcca

SEQ ID NO: 89909 - DNA, 25 bp, Homo sapien
aggcattcgccctttgtgtgttaac

SEQ ID NO: 89910 - DNA, 25 bp, Homo sapien
gtgtgttaacactgtagctctaatc

SEQ ID NO: 89911 - DNA, 25 bp, Homo sapien
tagctctaatcgtgcctggtgttct

SEQ ID NO: 89912 - DNA, 25 bp, Homo sapien
tggtgttctgaagcaggctcctctt

SEQ ID NO: 89913 - DNA, 25 bp, Homo sapien
gcactcgcatgcattgcggattcag

SEQ ID NO: 89914 - DNA, 25 bp, Homo sapien
gcggattcagcacttaagccctagt

SEQ ID NO: 89915 - DNA, 25 bp, Homo sapien
gtgtaaatgacttggatctccctcc

SEQ ID NO: 89916 - DNA, 25 bp, Homo sapien
tggcagactgtgaccctcagcacag

SEQ ID NO: 89917 - DNA, 25 bp, Homo sapien
ggctctgtcttagtcagctctgtgg

SEQ ID NO: 89918 - DNA, 25 bp, Homo sapien
ggcctggtacacaattggtgctcat

SEQ ID NO: 89919 - DNA, 25 bp, Homo sapien
agatatacaaatctccctgtaggaa

SEQ ID NO: 89920 - DNA, 25 bp, Homo sapien
aaatctccctgtaggaaatgtgaaa

SEQ ID NO: 89921 - DNA, 25 bp, Homo sapien
tgttcatttgcttgcttttatgatt

SEQ ID NO: 89922 - DNA, 25 bp, Homo sapien
ggtttgttttaatatcaggtggatt

SEQ ID NO: 89923 - DNA, 25 bp, Homo sapien
ggatttttgtttctaagcaatatat

SEQ ID NO: 89924 - DNA, 25 bp, Homo sapien
aaatcaaccaacatatctgaaaagg

SEQ ID NO: 89925 - DNA, 25 bp, Homo sapien
tctgaaaaggatcatgaaacctgag

SEQ ID NO: 89926 - DNA, 25 bp, Homo sapien
aacctgagaaatgctaatggagatt

SEQ ID NO: 89927 - DNA, 25 bp, Homo sapien
gctaatggagatttgctggtacata

SEQ ID NO: 89928 - DNA, 25 bp, Homo sapien
atttgctggtacataggaatctagc

SEQ ID NO: 89929 - DNA, 25 bp, Homo sapien
aatctagcaaattcaggaaccaagg

SEQ ID NO: 89930 - DNA, 25 bp, Homo sapien
tcttcatcgcctcacacatcggctt

SEQ ID NO: 89931 - DNA, 25 bp, Homo sapien
ctgctggcgctcttcggccgtgcct

SEQ ID NO: 89932 - DNA, 25 bp, Homo sapien
ggactccaagagacgcaggcttgtg

SEQ ID NO: 89933 - DNA, 25 bp, Homo sapien
ctccaagagacgcaggcttgtgtga

SEQ ID NO: 89934 - DNA, 25 bp, Homo sapien
agagacgcaggcttgtgtgagcctc

SEQ ID NO: 89935 - DNA, 25 bp, Homo sapien
gacgcaggcttgtgtgagcctcctg

SEQ ID NO: 89936 - DNA, 25 bp, Homo sapien
gcaggcttgtgtgagcctcctgcct

SEQ ID NO: 89937 - DNA, 25 bp, Homo sapien
tgcctcggccctgacaaacggggat

SEQ ID NO: 89938 - DNA, 25 bp, Homo sapien
gggatcttttacctcactttgcact

SEQ ID NO: 89939 - DNA, 25 bp, Homo sapien
gatcttttacctcactttgcactga

SEQ ID NO: 89940 - DNA, 25 bp, Homo sapien
atcttttacctcactttgcactgat

SEQ ID NO: 89941 - DNA, 25 bp, Homo sapien
accctcgcctgctcgtggaaggagt

SEQ ID NO: 89942 - DNA, 25 bp, Homo sapien
ctcgcctgctcgtggaaggagtctg

SEQ ID NO: 89943 - DNA, 25 bp, Homo sapien
ggagtctgggccagcagtgacccat

SEQ ID NO: 89944 - DNA, 25 bp, Homo sapien
gcagtgacccatgcgctagggtctc

SEQ ID NO: 89945 - DNA, 25 bp, Homo sapien
ccatgcgctagggtctctgctgagg

SEQ ID NO: 89946 - DNA, 25 bp, Homo sapien
gccctggccccgtagtgagtgtggg

SEQ ID NO: 89947 - DNA, 25 bp, Homo sapien
acctgtgccctcatgggcagctgaa

SEQ ID NO: 89948 - DNA, 25 bp, Homo sapien
ctgtgccctcatgggcagctgaagg

SEQ ID NO: 89949 - DNA, 25 bp, Homo sapien
ttccttactgaaaagtcttgagcaa

SEQ ID NO: 89950 - DNA, 25 bp, Homo sapien
tgaaaagtcttgagcaaacagttgc

SEQ ID NO: 89951 - DNA, 25 bp, Homo sapien
aagaaaatgttatctgtgtgctggg

SEQ ID NO: 89952 - DNA, 25 bp, Homo sapien
gtgtaacaaacactttgaccctggg

SEQ ID NO: 89953 - DNA, 25 bp, Homo sapien
ctgggaactgggtatacctctcttc

SEQ ID NO: 89954 - DNA, 25 bp, Homo sapien
atacctctcttccagtggagccaga

SEQ ID NO: 89955 - DNA, 25 bp, Homo sapien
gagccagatgccgagaccgagtgtc

SEQ ID NO: 89956 - DNA, 25 bp, Homo sapien
tctgcgctttgccaaagtcgcttct

SEQ ID NO: 89957 - DNA, 25 bp, Homo sapien
aagtcgcttctctgccatagctgca

SEQ ID NO: 89958 - DNA, 25 bp, Homo sapien
atagctgcacagaccttaaaccctg

SEQ ID NO: 89959 - DNA, 25 bp, Homo sapien
tgggtcttcagctcagtgctactct

SEQ ID NO: 89960 - DNA, 25 bp, Homo sapien
gtgctactctgaatacaatactgct

SEQ ID NO: 89961 - DNA, 25 bp, Homo sapien
actgctgaccacatttggctacttc

SEQ ID NO: 89962 - DNA, 25 bp, Homo sapien
atttggctacttcagcttaaatgta

SEQ ID NO: 89963 - DNA, 25 bp, Homo sapien
gaaaaactacatgctggccgccgtg

SEQ ID NO: 89964 - DNA, 25 bp, Homo sapien
atgctggccgccgtgaggttttact

SEQ ID NO: 89965 - DNA, 25 bp, Homo sapien
gcgggtcttcgtcctaaactgagaa

SEQ ID NO: 89966 - DNA, 25 bp, Homo sapien
aaagcattcctgtttgatcaccgcc

SEQ ID NO: 89967 - DNA, 25 bp, Homo sapien
accgccttagttaccagttctggat

SEQ ID NO: 89968 - DNA, 25 bp, Homo sapien
gtcagtgtttctgcatggaataaca

SEQ ID NO: 89969 - DNA, 25 bp, Homo sapien
gttctgccctttcatctttgtaaga

SEQ ID NO: 89970 - DNA, 25 bp, Homo sapien
gtaagagattcttgcctctagcaat

SEQ ID NO: 89971 - DNA, 25 bp, Homo sapien
gcctctagcaatgacaacctgtgat

SEQ ID NO: 89972 - DNA, 25 bp, Homo sapien
gtgatgtctcacagtagagcactta

SEQ ID NO: 89973 - DNA, 25 bp, Homo sapien
cacttagtgcagaatcaggtcccca

SEQ ID NO: 89974 - DNA, 25 bp, Homo sapien
ttggcctctctgagggtctctctgt

SEQ ID NO: 89975 - DNA, 25 bp, Homo sapien
gcctctctgagggtctctctgtgca

SEQ ID NO: 89976 - DNA, 25 bp, Homo sapien
tgtgcatctttttaggaatctcgct

SEQ ID NO: 89977 - DNA, 25 bp, Homo sapien
tctttttaggaatctcgctctcact

SEQ ID NO: 89978 - DNA, 25 bp, Homo sapien
tttttaggaatctcgctctcactct

SEQ ID NO: 89979 - DNA, 25 bp, Homo sapien
acccctgaactcctgagcgacagaa

SEQ ID NO: 89980 - DNA, 25 bp, Homo sapien
actcctgagcgacagaagccccagg

SEQ ID NO: 89981 - DNA, 25 bp, Homo sapien
accagccttgaacccttgcaaaggg

SEQ ID NO: 89982 - DNA, 25 bp, Homo sapien
ttgctctgagggttcggagcttccc

SEQ ID NO: 89983 - DNA, 25 bp, Homo sapien
ttcggagcttccctctgggactaaa

SEQ ID NO: 89984 - DNA, 25 bp, Homo sapien
gagcttccctctgggactaaaggag

SEQ ID NO: 89985 - DNA, 25 bp, Homo sapien
atgtgcctataggaagactagtctc

SEQ ID NO: 89986 - DNA, 25 bp, Homo sapien
ataggaagactagtctcatgctgtt

SEQ ID NO: 89987 - DNA, 25 bp, Homo sapien
gttttgcaaagaagttatggcctac

SEQ ID NO: 89988 - DNA, 25 bp, Homo sapien
gttatggcctacttagaatctaaaa

SEQ ID NO: 89989 - DNA, 25 bp, Homo sapien
gttaaatagcatcagtttgtccaat

SEQ ID NO: 89990 - DNA, 25 bp, Homo sapien
gcatcagtttgtccaatagttttaa

SEQ ID NO: 89991 - DNA, 25 bp, Homo sapien
gtccaatagttttaaaggccataat

SEQ ID NO: 89992 - DNA, 25 bp, Homo sapien
aggccataatcatcttttctggtta

SEQ ID NO: 89993 - DNA, 25 bp, Homo sapien
catcttttctggttaatatcttgag

SEQ ID NO: 89994 - DNA, 25 bp, Homo sapien
atgttgacaccttaatcggtcccag

SEQ ID NO: 89995 - DNA, 25 bp, Homo sapien
atcggtcccaggtatgagctataat

SEQ ID NO: 89996 - DNA, 25 bp, Homo sapien
tgctcaacctgtatacagaaatgtc

SEQ ID NO: 89997 - DNA, 25 bp, Homo sapien
gggagatgtttactgttatatttag

SEQ ID NO: 89998 - DNA, 25 bp, Homo sapien
ttaggtgacaggtacatggcaattc

SEQ ID NO: 89999 - DNA, 25 bp, Homo sapien
atggcaattcattataccctcctat

SEQ ID NO: 90000 - DNA, 25 bp, Homo sapien
gcaattcattataccctcctatttt

SEQ ID NO: 90001 - DNA, 25 bp, Homo sapien
attataccctcctattttcctatgt

SEQ ID NO: 90002 - DNA, 25 bp, Homo sapien
tataccctcctattttcctatgttt

SEQ ID NO: 90003 - DNA, 25 bp, Homo sapien
aaaagctattttctatatgtgccaa

SEQ ID NO: 90004 - DNA, 25 bp, Homo sapien
gctattttctatatgtgccaatctt

SEQ ID NO: 90005 - DNA, 25 bp, Homo sapien
ttttctatatgtgccaatctttaaa

SEQ ID NO: 90006 - DNA, 25 bp, Homo sapien
ataacaagggtatttatcacattaa

SEQ ID NO: 90007 - DNA, 25 bp, Homo sapien
ctggagaggaagctgaccgacatct

SEQ ID NO: 90008 - DNA, 25 bp, Homo sapien
aagctgaccgacatctgggaggagc

SEQ ID NO: 90009 - DNA, 25 bp, Homo sapien
acacgcagacgcagacctactgagg

SEQ ID NO: 90010 - DNA, 25 bp, Homo sapien
agggaccgcggcctgacctggctgg

SEQ ID NO: 90011 - DNA, 25 bp, Homo sapien
acgtccttgcacacgactttgggaa

SEQ ID NO: 90012 - DNA, 25 bp, Homo sapien
cttgcacacgactttgggaaacgcg

SEQ ID NO: 90013 - DNA, 25 bp, Homo sapien
gcacacgactttgggaaacgcgaga

SEQ ID NO: 90014 - DNA, 25 bp, Homo sapien
aacgcgagaaagtaaactctgccta

SEQ ID NO: 90015 - DNA, 25 bp, Homo sapien
gaaagtaaactctgcctagcacggc

SEQ ID NO: 90016 - DNA, 25 bp, Homo sapien
gtaaactctgcctagcacggcaaaa

SEQ ID NO: 90017 - DNA, 25 bp, Homo sapien
aaactctgcctagcacggcaaaaaa

SEQ ID NO: 90018 - DNA, 25 bp, Homo sapien
atgaggacatcctatgggaccccag

SEQ ID NO: 90019 - DNA, 25 bp, Homo sapien
tcgggacctatgactacccttcagg

SEQ ID NO: 90020 - DNA, 25 bp, Homo sapien
ctatgactacccttcaggcatcaga

SEQ ID NO: 90021 - DNA, 25 bp, Homo sapien
aacactcagggcctggaggcttgct

SEQ ID NO: 90022 - DNA, 25 bp, Homo sapien
actggaggcttgcttggacagttcc

SEQ ID NO: 90023 - DNA, 25 bp, Homo sapien
caggaaatcatttctaggacacagt

SEQ ID NO: 90024 - DNA, 25 bp, Homo sapien
acacagtgatcagggaagggtgcct

SEQ ID NO: 90025 - DNA, 25 bp, Homo sapien
cctgggacttggagggtcccatgta

SEQ ID NO: 90026 - DNA, 25 bp, Homo sapien
tcccatgtatggacctgtgtatgca

SEQ ID NO: 90027 - DNA, 25 bp, Homo sapien
tatgcaatactgttctgtcatctgg

SEQ ID NO: 90028 - DNA, 25 bp, Homo sapien
ggagctatttttaagatgtgtgtgt

SEQ ID NO: 90029 - DNA, 25 bp, Homo sapien
accctaacctactggcggacagcga

SEQ ID NO: 90030 - DNA, 25 bp, Homo sapien
ggacagcgatcccagtttgccttgc

SEQ ID NO: 90031 - DNA, 25 bp, Homo sapien
ttgccttgccaaataaactctgttt

SEQ ID NO: 90032 - DNA, 25 bp, Homo sapien
ctgggagatttcctatatcagagag

SEQ ID NO: 90033 - DNA, 25 bp, Homo sapien
gagagtttcaaacattcacatgata

SEQ ID NO: 90034 - DNA, 25 bp, Homo sapien
attaaactaacctttgtatgcaatt

SEQ ID NO: 90035 - DNA, 25 bp, Homo sapien
gaaatgattgagtatgaaccacagc

SEQ ID NO: 90036 - DNA, 25 bp, Homo sapien
aaccacagctgtgttttcaaatatg

SEQ ID NO: 90037 - DNA, 25 bp, Homo sapien
tttggttgttgtaccctgctcactc

SEQ ID NO: 90038 - DNA, 25 bp, Homo sapien
cagaacctttcatttattgtacaac

SEQ ID NO: 90039 - DNA, 25 bp, Homo sapien
tattgtacaacatcacactcaccct

SEQ ID NO: 90040 - DNA, 25 bp, Homo sapien
ttgtggcatgtctgcatgtctcatc

SEQ ID NO: 90041 - DNA, 25 bp, Homo sapien
gtctcatccatctattgtttttggt

SEQ ID NO: 90042 - DNA, 25 bp, Homo sapien
gggttgacattggaatcagcctctc

SEQ ID NO: 90043 - DNA, 25 bp, Homo sapien
atcagcctctcctttgagcttattt

SEQ ID NO: 90044 - DNA, 25 bp, Homo sapien
aacagtttataccaaagggcagcct

SEQ ID NO: 90045 - DNA, 25 bp, Homo sapien
agcctgtgcctgtttatggatcctc

SEQ ID NO: 90046 - DNA, 25 bp, Homo sapien
ttatggatcctctctgcctttgtac

SEQ ID NO: 90047 - DNA, 25 bp, Homo sapien
gcctttgtacttgaagagcgcattt

SEQ ID NO: 90048 - DNA, 25 bp, Homo sapien
attttacatttccagtcctttcaca

SEQ ID NO: 90049 - DNA, 25 bp, Homo sapien
agacaggagctccaaccttacgatg

SEQ ID NO: 90050 - DNA, 25 bp, Homo sapien
aaacttgcttgtatttccactttgt

SEQ ID NO: 90051 - DNA, 25 bp, Homo sapien
ttcacccttaaagtttgaggaggat

SEQ ID NO: 90052 - DNA, 25 bp, Homo sapien
ggaggatcttgatatgttttaacat

SEQ ID NO: 90053 - DNA, 25 bp, Homo sapien
ttggttttttatcaagaacaacact

SEQ ID NO: 90054 - DNA, 25 bp, Homo sapien
gaacaacacttatcgttatgtattg

SEQ ID NO: 90055 - DNA, 25 bp, Homo sapien
gtgttagttatattgccagtctgtt

SEQ ID NO: 90056 - DNA, 25 bp, Homo sapien
gttatattgccagtctgttgcgact

SEQ ID NO: 90057 - DNA, 25 bp, Homo sapien
gtctgttgcgactgactcaaaaagt

SEQ ID NO: 90058 - DNA, 25 bp, Homo sapien
gattatgagcatcgcaaactttgtt

SEQ ID NO: 90059 - DNA, 25 bp, Homo sapien
tgagcatcgcaaactttgtttctga

SEQ ID NO: 90060 - DNA, 25 bp, Homo sapien
actttgtttctgacccattttgaca

SEQ ID NO: 90061 - DNA, 25 bp, Homo sapien
gtttctgacccattttgacagtttt

SEQ ID NO: 90062 - DNA, 25 bp, Homo sapien
tacgaccgcgaggccgacaagtgga

SEQ ID NO: 90063 - DNA, 25 bp, Homo sapien
tgcccaaggccatcgctggcgggtc

SEQ ID NO: 90064 - DNA, 25 bp, Homo sapien
ggtccgcctgtgtctgcgccctgga

SEQ ID NO: 90065 - DNA, 25 bp, Homo sapien
agccacggccagaggacaagaagaa

SEQ ID NO: 90066 - DNA, 25 bp, Homo sapien
gcaaaggcaagaggcaccaggaccg

SEQ ID NO: 90067 - DNA, 25 bp, Homo sapien
gtgaccctagctgcgcctcttggga

SEQ ID NO: 90068 - DNA, 25 bp, Homo sapien
agggctctgtagaccagcagcaact

SEQ ID NO: 90069 - DNA, 25 bp, Homo sapien
gtagaccagcagcaacttcttagta

SEQ ID NO: 90070 - DNA, 25 bp, Homo sapien
agtattccggaaacattatgtacaa

SEQ ID NO: 90071 - DNA, 25 bp, Homo sapien
ttatgtacaacttagcagctttttt

SEQ ID NO: 90072 - DNA, 25 bp, Homo sapien
attcttggtatttctatgatatcac

SEQ ID NO: 90073 - DNA, 25 bp, Homo sapien
agtgctttgcctcccgatatgccag

SEQ ID NO: 90074 - DNA, 25 bp, Homo sapien
gatatgccagagcttgtggtccaaa

SEQ ID NO: 90075 - DNA, 25 bp, Homo sapien
tggtccaaagcccattcctgtgtgt

SEQ ID NO: 90076 - DNA, 25 bp, Homo sapien
cgtcctgccatttagccacagaagg

SEQ ID NO: 90077 - DNA, 25 bp, Homo sapien
gcaagcaggattttctggtgccaac

SEQ ID NO: 90078 - DNA, 25 bp, Homo sapien
tggtgccaacactcattcatcattc

SEQ ID NO: 90079 - DNA, 25 bp, Homo sapien
tcattcatcattcccgatcaactag

SEQ ID NO: 90080 - DNA, 25 bp, Homo sapien
ggatgaatttaagactgtgctacca

SEQ ID NO: 90081 - DNA, 25 bp, Homo sapien
gactgtgctaccatgtgttctcaag

SEQ ID NO: 90082 - DNA, 25 bp, Homo sapien
catgtgttctcaagtggtagtttaa

SEQ ID NO: 90083 - DNA, 25 bp, Homo sapien
ttcaattgtctgtgaacgtctaaag

SEQ ID NO: 90084 - DNA, 25 bp, Homo sapien
gggaatgtactgcagtcagtaaaca

SEQ ID NO: 90085 - DNA, 25 bp, Homo sapien
acagatgctttatggcacctgctca

SEQ ID NO: 90086 - DNA, 25 bp, Homo sapien
tgctcaagcccgtgactgtacagaa

SEQ ID NO: 90087 - DNA, 25 bp, Homo sapien
tacagaaggatcctggttgctacca

SEQ ID NO: 90088 - DNA, 25 bp, Homo sapien
gttgctaccagtgggtgctgattca

SEQ ID NO: 90089 - DNA, 25 bp, Homo sapien
gtgctgattcagcatcacaagtgac

SEQ ID NO: 90090 - DNA, 25 bp, Homo sapien
atcacaagtgactgaaattggctgt

SEQ ID NO: 90091 - DNA, 25 bp, Homo sapien
ctgtggatctgttctttgtgaaaga

SEQ ID NO: 90092 - DNA, 25 bp, Homo sapien
gtgaaagaattcctgatttctccat

SEQ ID NO: 90093 - DNA, 25 bp, Homo sapien
tccatggagcatgtacacaacaatt

SEQ ID NO: 90094 - DNA, 25 bp, Homo sapien
ttgatcatattaactgtacttcagt

SEQ ID NO: 90095 - DNA, 25 bp, Homo sapien
ccctcactcctagaggaagggagca

SEQ ID NO: 90096 - DNA, 25 bp, Homo sapien
ctcctagaggaagggagcaccgcga

SEQ ID NO: 90097 - DNA, 25 bp, Homo sapien
ggagcaccgcgaggctcacggcagg

SEQ ID NO: 90098 - DNA, 25 bp, Homo sapien
ggaagccgcctggaggacgtgctgt

SEQ ID NO: 90099 - DNA, 25 bp, Homo sapien
tgcaggaggtctccaacctgtcaga

SEQ ID NO: 90100 - DNA, 25 bp, Homo sapien
aggaggtctccaacctgtcagagtg

SEQ ID NO: 90101 - DNA, 25 bp, Homo sapien
aggtctccaacctgtcagagtggct

SEQ ID NO: 90102 - DNA, 25 bp, Homo sapien
aagcgcccaccgatccggaggctgc

SEQ ID NO: 90103 - DNA, 25 bp, Homo sapien
aggctgcgggcagccgttatcccgt

SEQ ID NO: 90104 - DNA, 25 bp, Homo sapien
ggcagccgttatcccgtggtttaat

SEQ ID NO: 90105 - DNA, 25 bp, Homo sapien
gttatcccgtggtttaataaagctg

SEQ ID NO: 90106 - DNA, 25 bp, Homo sapien
gataccaaaattcagtctttgctgt

SEQ ID NO: 90107 - DNA, 25 bp, Homo sapien
ttgctgtcactttctgagagcagta

SEQ ID NO: 90108 - DNA, 25 bp, Homo sapien
aagcaacatgtcatcacactaccgt

SEQ ID NO: 90109 - DNA, 25 bp, Homo sapien
atgtcatcacactaccgtggtcaaa

SEQ ID NO: 90110 - DNA, 25 bp, Homo sapien
cactaccgtggtcaaagagtactta

SEQ ID NO: 90111 - DNA, 25 bp, Homo sapien
gattatttgttcattactgtttcca

SEQ ID NO: 90112 - DNA, 25 bp, Homo sapien
tgtttccattttgtacccagagtaa

SEQ ID NO: 90113 - DNA, 25 bp, Homo sapien
gtaaccaagtgattacctatccaag

SEQ ID NO: 90114 - DNA, 25 bp, Homo sapien
gtgattacctatccaagtgctggag

SEQ ID NO: 90115 - DNA, 25 bp, Homo sapien
gtgctggagattttgattactaatg

SEQ ID NO: 90116 - DNA, 25 bp, Homo sapien
atgtctttgatgtttcaaggctaca

SEQ ID NO: 90117 - DNA, 25 bp, Homo sapien
gataaacagctgtaattcggacaaa

SEQ ID NO: 90118 - DNA, 25 bp, Homo sapien
gctgtaattcggacaaacatgacaa

SEQ ID NO: 90119 - DNA, 25 bp, Homo sapien
acacagtgaagccaactatcccata

SEQ ID NO: 90120 - DNA, 25 bp, Homo sapien
gtgaagccaactatcccataaaatg

SEQ ID NO: 90121 - DNA, 25 bp, Homo sapien
gaacactgacatacttgttttaatt

SEQ ID NO: 90122 - DNA, 25 bp, Homo sapien
atactcctaacaaaaccagtgattt

SEQ ID NO: 90123 - DNA, 25 bp, Homo sapien
tttctccaatatacttgcatccacc

SEQ ID NO: 90124 - DNA, 25 bp, Homo sapien
caatatacttgcatccacctacaaa

SEQ ID NO: 90125 - DNA, 25 bp, Homo sapien
tgcatccacctacaaatataacctt

SEQ ID NO: 90126 - DNA, 25 bp, Homo sapien
gatttcaatagtcaaactgctgtgt

SEQ ID NO: 90127 - DNA, 25 bp, Homo sapien
gatgttttgaatggctagatggtaa

SEQ ID NO: 90128 - DNA, 25 bp, Homo sapien
tcctgtcagaagactgatggatctt

SEQ ID NO: 90129 - DNA, 25 bp, Homo sapien
ggatctttttcattccaaccatctc

SEQ ID NO: 90130 - DNA, 25 bp, Homo sapien
cccgatgaatgcaataaaactctgt

SEQ ID NO: 90131 - DNA, 25 bp, Homo sapien
aaaactctgtgacaccagcaaccat

SEQ ID NO: 90132 - DNA, 25 bp, Homo sapien
acaccagcaaccattgctctttaga

SEQ ID NO: 90133 - DNA, 25 bp, Homo sapien
cattgctctttagaaatgggttttc

SEQ ID NO: 90134 - DNA, 25 bp, Homo sapien
atgggttttctgatcatatggctga

SEQ ID NO: 90135 - DNA, 25 bp, Homo sapien
catatggctgatgtgttatgggcag

SEQ ID NO: 90136 - DNA, 25 bp, Homo sapien
gttatgggcagtatggatgtcttca

SEQ ID NO: 90137 - DNA, 25 bp, Homo sapien
aatttatgtatttgctcctgttact

SEQ ID NO: 90138 - DNA, 25 bp, Homo sapien
tttgctcctgttactataataatac

SEQ ID NO: 90139 - DNA, 25 bp, Homo sapien
tcagaaagccaggagaagtgctttg

SEQ ID NO: 90140 - DNA, 25 bp, Homo sapien
cagaaagccaggagaagtgctttgt

SEQ ID NO: 90141 - DNA, 25 bp, Homo sapien
agaaagccaggagaagtgctttgtg

SEQ ID NO: 90142 - DNA, 25 bp, Homo sapien
aaagccaggagaagtgctttgtggt

SEQ ID NO: 90143 - DNA, 25 bp, Homo sapien
ccaggagaagtgctttgtggtgcca

SEQ ID NO: 90144 - DNA, 25 bp, Homo sapien
caggagaagtgctttgtggtgccag

SEQ ID NO: 90145 - DNA, 25 bp, Homo sapien
aggagaagtgctttgtggtgccaga

SEQ ID NO: 90146 - DNA, 25 bp, Homo sapien
ggagaagtgctttgtggtgccagag

SEQ ID NO: 90147 - DNA, 25 bp, Homo sapien
gagaagtgctttgtggtgccagagg

SEQ ID NO: 90148 - DNA, 25 bp, Homo sapien
agaagtgctttgtggtgccagagga

SEQ ID NO: 90149 - DNA, 25 bp, Homo sapien
aagtgctttgtggtgccagaggagc

SEQ ID NO: 90150 - DNA, 25 bp, Homo sapien
ggagagccacctcatcaaatgaaag

SEQ ID NO: 90151 - DNA, 25 bp, Homo sapien
aagaccttagaagtctgggaagcca

SEQ ID NO: 90152 - DNA, 25 bp, Homo sapien
tctccctgggaaatcttgctgtcta

SEQ ID NO: 90153 - DNA, 25 bp, Homo sapien
ggaaatcttgctgtctactgaataa

SEQ ID NO: 90154 - DNA, 25 bp, Homo sapien
aaatgcaccttctctgtatgcagtg

SEQ ID NO: 90155 - DNA, 25 bp, Homo sapien
gtgcttctgtgggagaccatatccc

SEQ ID NO: 90156 - DNA, 25 bp, Homo sapien
tgcacctgggttatggtaagcacta

SEQ ID NO: 90157 - DNA, 25 bp, Homo sapien
ggtaagcactagtccatgagcctgc

SEQ ID NO: 90158 - DNA, 25 bp, Homo sapien
atgagcctgcttggaatcacactgg

SEQ ID NO: 90159 - DNA, 25 bp, Homo sapien
gaatcacactggatgtctccgtttt

SEQ ID NO: 90160 - DNA, 25 bp, Homo sapien
gtctccgttttgtcttgtaaatgcc

SEQ ID NO: 90161 - DNA, 25 bp, Homo sapien
gagaaaagggtgaaatatgtaaagt

SEQ ID NO: 90162 - DNA, 25 bp, Homo sapien
agaaaagggtgaaatatgtaaagtg

SEQ ID NO: 90163 - DNA, 25 bp, Homo sapien
gaaaagggtgaaatatgtaaagtgt

SEQ ID NO: 90164 - DNA, 25 bp, Homo sapien
aaagggtgaaatatgtaaagtgttg

SEQ ID NO: 90165 - DNA, 25 bp, Homo sapien
aagggtgaaatatgtaaagtgttga

SEQ ID NO: 90166 - DNA, 25 bp, Homo sapien
agggtgaaatatgtaaagtgttgaa

SEQ ID NO: 90167 - DNA, 25 bp, Homo sapien
gggtgaaatatgtaaagtgttgaaa

SEQ ID NO: 90168 - DNA, 25 bp, Homo sapien
ggtgaaatatgtaaagtgttgaaag

SEQ ID NO: 90169 - DNA, 25 bp, Homo sapien
gaaatatgtaaagtgttgaaagaga

SEQ ID NO: 90170 - DNA, 25 bp, Homo sapien
ccaaaattgcagaatggggggccag

SEQ ID NO: 90171 - DNA, 25 bp, Homo sapien
aaattgcagaatggggggccaggcc

SEQ ID NO: 90172 - DNA, 25 bp, Homo sapien
aattgcagaatggggggccaggcct

SEQ ID NO: 90173 - DNA, 25 bp, Homo sapien
attgcagaatggggggccaggcctg

SEQ ID NO: 90174 - DNA, 25 bp, Homo sapien
ttgcagaatggggggccaggcctgt

SEQ ID NO: 90175 - DNA, 25 bp, Homo sapien
gaatggggggccaggcctgtgtggt

SEQ ID NO: 90176 - DNA, 25 bp, Homo sapien
aatggggggccaggcctgtgtggtg

SEQ ID NO: 90177 - DNA, 25 bp, Homo sapien
atggggggccaggcctgtgtggtgg

SEQ ID NO: 90178 - DNA, 25 bp, Homo sapien
ggggggccaggcctgtgtggtggct

SEQ ID NO: 90179 - DNA, 25 bp, Homo sapien
gtaggaggatcacgtgaggtcggga

SEQ ID NO: 90180 - DNA, 25 bp, Homo sapien
taggaggatcacgtgaggtcgggag

SEQ ID NO: 90181 - DNA, 25 bp, Homo sapien
aggacagcatcggagatcgcactgc

SEQ ID NO: 90182 - DNA, 25 bp, Homo sapien
ggagatcgcactgcttcacagaggg

SEQ ID NO: 90183 - DNA, 25 bp, Homo sapien
tcgcactgcttcacagagggatctt

SEQ ID NO: 90184 - DNA, 25 bp, Homo sapien
gggccacccttcctaagacagagag

SEQ ID NO: 90185 - DNA, 25 bp, Homo sapien
ttcctaagacagagagtccccaggg

SEQ ID NO: 90186 - DNA, 25 bp, Homo sapien
gccaggaggcacctgggaacccaaa

SEQ ID NO: 90187 - DNA, 25 bp, Homo sapien
tccacagaatacacgagcctccaaa

SEQ ID NO: 90188 - DNA, 25 bp, Homo sapien
taaaaagtagactcaggcccagagt

SEQ ID NO: 90189 - DNA, 25 bp, Homo sapien
ggacatatcagaaaagctttgagag

SEQ ID NO: 90190 - DNA, 25 bp, Homo sapien
agtgtcctgattccctgcaaagcct

SEQ ID NO: 90191 - DNA, 25 bp, Homo sapien
ctgattccctgcaaagcctttaata

SEQ ID NO: 90192 - DNA, 25 bp, Homo sapien
acagtgactccagcatttaccttcg

SEQ ID NO: 90193 - DNA, 25 bp, Homo sapien
tccagcatttaccttcgacgacata

SEQ ID NO: 90194 - DNA, 25 bp, Homo sapien
cgacgacatactcataggtcttcgg

SEQ ID NO: 90195 - DNA, 25 bp, Homo sapien
aggaacgcagcagatctggatgaca

SEQ ID NO: 90196 - DNA, 25 bp, Homo sapien
tattaaccaggaaggccaacagctc

SEQ ID NO: 90197 - DNA, 25 bp, Homo sapien
aaggccaacagctcaggagaagcca

SEQ ID NO: 90198 - DNA, 25 bp, Homo sapien
agagtgactccctgacacagcttgt

SEQ ID NO: 90199 - DNA, 25 bp, Homo sapien
gacacagcttgtccagcagccggat

SEQ ID NO: 90200 - DNA, 25 bp, Homo sapien
ccagcagccggatatgatgtatttt

SEQ ID NO: 90201 - DNA, 25 bp, Homo sapien
atgtattttattctcttcctgtggc

SEQ ID NO: 90202 - DNA, 25 bp, Homo sapien
acaactggatgttagcaggctctga

SEQ ID NO: 90203 - DNA, 25 bp, Homo sapien
gctcgtcctgccctaaacctttgtt

SEQ ID NO: 90204 - DNA, 25 bp, Homo sapien
ctgcctgtctgtgacttgaatttga

SEQ ID NO: 90205 - DNA, 25 bp, Homo sapien
tgtgacttgaatttgactggtgaac

SEQ ID NO: 90206 - DNA, 25 bp, Homo sapien
gactggtgaacaaactaaatatttt

SEQ ID NO: 90207 - DNA, 25 bp, Homo sapien
aatatttttccctgtaattgagaca

SEQ ID NO: 90208 - DNA, 25 bp, Homo sapien
tttgatgatacccatccctccttca

SEQ ID NO: 90209 - DNA, 25 bp, Homo sapien
tggtggtggtagtttttaatcagta

SEQ ID NO: 90210 - DNA, 25 bp, Homo sapien
aatcagtaaacccagcaaatatcat

SEQ ID NO: 90211 - DNA, 25 bp, Homo sapien
gcaaatatcatgattctttcctggt

SEQ ID NO: 90212 - DNA, 25 bp, Homo sapien
taaagtgtatctttttatctccctc

SEQ ID NO: 90213 - DNA, 25 bp, Homo sapien
agtgtatctttttatctccctccca

SEQ ID NO: 90214 - DNA, 25 bp, Homo sapien
ttgcctattcgctgaggccgagtcg

SEQ ID NO: 90215 - DNA, 25 bp, Homo sapien
gccgctgcgggctctgattgagatg

SEQ ID NO: 90216 - DNA, 25 bp, Homo sapien
tggtggcaagggagccctctgcctc

SEQ ID NO: 90217 - DNA, 25 bp, Homo sapien
gatgcattgcgggtgctgtccaagc

SEQ ID NO: 90218 - DNA, 25 bp, Homo sapien
tgctgtccaagcttggctcatctgg

SEQ ID NO: 90219 - DNA, 25 bp, Homo sapien
atctggggtttgctgggcttaacac

SEQ ID NO: 90220 - DNA, 25 bp, Homo sapien
attgtactgctggaccctgagcctg

SEQ ID NO: 90221 - DNA, 25 bp, Homo sapien
gggtatggcccatggcactactcga

SEQ ID NO: 90222 - DNA, 25 bp, Homo sapien
tactcgacacctggccgcaagatat

SEQ ID NO: 90223 - DNA, 25 bp, Homo sapien
acctggccgcaagatatgggctgcc

SEQ ID NO: 90224 - DNA, 25 bp, Homo sapien
tggtccacctttgcctattcgctga

SEQ ID NO: 90225 - DNA, 25 bp, Homo sapien
aaggcagatccacatcaccgaagct

SEQ ID NO: 90226 - DNA, 25 bp, Homo sapien
cacatcaccgaagctccctagaggg

SEQ ID NO: 90227 - DNA, 25 bp, Homo sapien
caaaagatggagtgagccacaggaa

SEQ ID NO: 90228 - DNA, 25 bp, Homo sapien
cgtggtgagttggaatgatacgtcc

SEQ ID NO: 90229 - DNA, 25 bp, Homo sapien
gttggaatgatacgtccatttctct

SEQ ID NO: 90230 - DNA, 25 bp, Homo sapien
ggaatgatacgtccatttctctatg

SEQ ID NO: 90231 - DNA, 25 bp, Homo sapien
atgatacgtccatttctctatgaaa

SEQ ID NO: 90232 - DNA, 25 bp, Homo sapien
gatacgtccatttctctatgaaata

SEQ ID NO: 90233 - DNA, 25 bp, Homo sapien
gaaatatttgctactagactgttca

SEQ ID NO: 90234 - DNA, 25 bp, Homo sapien
ttgctactagactgttcatttctct

SEQ ID NO: 90235 - DNA, 25 bp, Homo sapien
ctagactgttcatttctctctgaca

SEQ ID NO: 90236 - DNA, 25 bp, Homo sapien
aaaggtcagtttgcacatttgtaaa

SEQ ID NO: 90237 - DNA, 25 bp, Homo sapien
gtatttatccttaccgaattacatg

SEQ ID NO: 90238 - DNA, 25 bp, Homo sapien
attacatgtcagtctgttgccacct

SEQ ID NO: 90239 - DNA, 25 bp, Homo sapien
ttctttcatgcacattcctctttgg

SEQ ID NO: 90240 - DNA, 25 bp, Homo sapien
gcacattcctctttggccaaactgg

SEQ ID NO: 90241 - DNA, 25 bp, Homo sapien
atcccatacttttagcctgtgtcaa

SEQ ID NO: 90242 - DNA, 25 bp, Homo sapien
agcctgtgtcaaatgtaagtcccaa

SEQ ID NO: 90243 - DNA, 25 bp, Homo sapien
atgtaagtcccaagtatttccagca

SEQ ID NO: 90244 - DNA, 25 bp, Homo sapien
caggaagtaatgtcttcctcagcct

SEQ ID NO: 90245 - DNA, 25 bp, Homo sapien
tcaaccagggaccaaccggctgctt

SEQ ID NO: 90246 - DNA, 25 bp, Homo sapien
aaccggctgcttacttttgcaaata

SEQ ID NO: 90247 - DNA, 25 bp, Homo sapien
ttctgataaagacccacctctagtg

SEQ ID NO: 90248 - DNA, 25 bp, Homo sapien
cccacctctagtgagattcatcttt

SEQ ID NO: 90249 - DNA, 25 bp, Homo sapien
ttgtttgtgtgactatattccatag

SEQ ID NO: 90250 - DNA, 25 bp, Homo sapien
gatgggatagctcaacttcattata

SEQ ID NO: 90251 - DNA, 25 bp, Homo sapien
gatagctcaacttcattatatacca

SEQ ID NO: 90252 - DNA, 25 bp, Homo sapien
aaacacatgccaaatgatgactaca

SEQ ID NO: 90253 - DNA, 25 bp, Homo sapien
cattttaccaacatatttagacgag

SEQ ID NO: 90254 - DNA, 25 bp, Homo sapien
ttagacgagtattcttgactagtgt

SEQ ID NO: 90255 - DNA, 25 bp, Homo sapien
attcttgactagtgtttactatcta

SEQ ID NO: 90256 - DNA, 25 bp, Homo sapien
ttttctgttctaattgtcagggaca

SEQ ID NO: 90257 - DNA, 25 bp, Homo sapien
gtcagggacatatgtagtggctata

SEQ ID NO: 90258 - DNA, 25 bp, Homo sapien
ggccaagggtgtcccacattcccaa

SEQ ID NO: 90259 - DNA, 25 bp, Homo sapien
tctgatcaccatgggaatctttgga

SEQ ID NO: 90260 - DNA, 25 bp, Homo sapien
ccatgggaatctttggactcaggac

SEQ ID NO: 90261 - DNA, 25 bp, Homo sapien
ttggactcaggacagggccaggtgc

SEQ ID NO: 90262 - DNA, 25 bp, Homo sapien
gtggcactgagctatgagtcccggg

SEQ ID NO: 90263 - DNA, 25 bp, Homo sapien
acagacagagccaccctaggagtga

SEQ ID NO: 90264 - DNA, 25 bp, Homo sapien
ccaccctaggagtgagtatagtgct

SEQ ID NO: 90265 - DNA, 25 bp, Homo sapien
gtatagtgctggtgactgtgtttca

SEQ ID NO: 90266 - DNA, 25 bp, Homo sapien
tggtgactgtgtttcatagccccag

SEQ ID NO: 90267 - DNA, 25 bp, Homo sapien
actgtgtttcatagccccagtccag

SEQ ID NO: 90268 - DNA, 25 bp, Homo sapien
ccagtccagggctgtctaagaaata

SEQ ID NO: 90269 - DNA, 25 bp, Homo sapien
actccacggagatcattatcaccac

SEQ ID NO: 90270 - DNA, 25 bp, Homo sapien
attatcaccacaagttcttcagaca

SEQ ID NO: 90271 - DNA, 25 bp, Homo sapien
cttcagacaggtgtggaggttttct

SEQ ID NO: 90272 - DNA, 25 bp, Homo sapien
attttctggattgcaattttgttta

SEQ ID NO: 90273 - DNA, 25 bp, Homo sapien
gtgaggatcaactactttgaggatt

SEQ ID NO: 90274 - DNA, 25 bp, Homo sapien
aaattgcacaaatatgacggcatat

SEQ ID NO: 90275 - DNA, 25 bp, Homo sapien
gacggcatatttatatctgcctgca

SEQ ID NO: 90276 - DNA, 25 bp, Homo sapien
tatatctgcctgcatttgtgaaaac

SEQ ID NO: 90277 - DNA, 25 bp, Homo sapien
acttgtcaaggagcttatttctgga

SEQ ID NO: 90278 - DNA, 25 bp, Homo sapien
tttctggaaagggtcaatgattcta

SEQ ID NO: 90279 - DNA, 25 bp, Homo sapien
gataaatatgagacccttcagtaaa

SEQ ID NO: 90280 - DNA, 25 bp, Homo sapien
atttacttagcattttagattctag

SEQ ID NO: 90281 - DNA, 25 bp, Homo sapien
gcattttagattctagagacatgga

SEQ ID NO: 90282 - DNA, 25 bp, Homo sapien
attttatgtctagagtaggtcctga

SEQ ID NO: 90283 - DNA, 25 bp, Homo sapien
gagtaggtcctgaagtttggcttta

SEQ ID NO: 90284 - DNA, 25 bp, Homo sapien
ggtcctgaagtttggctttacatta

SEQ ID NO: 90285 - DNA, 25 bp, Homo sapien
ggctttacattaagtttagcactgt

SEQ ID NO: 90286 - DNA, 25 bp, Homo sapien
agtttagcactgtatcagaatgaag

SEQ ID NO: 90287 - DNA, 25 bp, Homo sapien
ttttatatagtaatatccccatttt

SEQ ID NO: 90288 - DNA, 25 bp, Homo sapien
tgttagacttttatcatacctgtaa

SEQ ID NO: 90289 - DNA, 25 bp, Homo sapien
gacttttatcatacctgtaagttaa

SEQ ID NO: 90290 - DNA, 25 bp, Homo sapien
gtcatattgtgacaaattgatcact

SEQ ID NO: 90291 - DNA, 25 bp, Homo sapien
tgtttacatccagatatggccatct

SEQ ID NO: 90292 - DNA, 25 bp, Homo sapien
agatatggccatctgtgaaacagaa

SEQ ID NO: 90293 - DNA, 25 bp, Homo sapien
agaagggaagatcgccattggttat

SEQ ID NO: 90294 - DNA, 25 bp, Homo sapien
gatcgccattggttatacataacag

SEQ ID NO: 90295 - DNA, 25 bp, Homo sapien
gttatacataacagcaattcatttt

SEQ ID NO: 90296 - DNA, 25 bp, Homo sapien
ttttttcctctgaagttgaacatgc

SEQ ID NO: 90297 - DNA, 25 bp, Homo sapien
aagaacatgaccattaagtgctgtt

SEQ ID NO: 90298 - DNA, 25 bp, Homo sapien
atatatgcacatatgcaccctaata

SEQ ID NO: 90299 - DNA, 25 bp, Homo sapien
tgcacatatgcaccctaataacata

SEQ ID NO: 90300 - DNA, 25 bp, Homo sapien
tggaatataagacttaacctttctg

SEQ ID NO: 90301 - DNA, 25 bp, Homo sapien
tctggaaacgtaataaaccatgtta

SEQ ID NO: 90302 - DNA, 25 bp, Homo sapien
ggcagagtcttctttcagacccaac

SEQ ID NO: 90303 - DNA, 25 bp, Homo sapien
ttctttcagacccaactcttagagg

SEQ ID NO: 90304 - DNA, 25 bp, Homo sapien
ctcttagagggcacatcaccaggct

SEQ ID NO: 90305 - DNA, 25 bp, Homo sapien
accaggctccacatcacgggaagtg

SEQ ID NO: 90306 - DNA, 25 bp, Homo sapien
tcacgggaagtgagatggatttctt

SEQ ID NO: 90307 - DNA, 25 bp, Homo sapien
ggatttcttgggtaacaactcatta

SEQ ID NO: 90308 - DNA, 25 bp, Homo sapien
ggaatacttttagtttgacagcctt

SEQ ID NO: 90309 - DNA, 25 bp, Homo sapien
gtttgacagccttatatgacatgaa

SEQ ID NO: 90310 - DNA, 25 bp, Homo sapien
tgacatgaatgaaaactgctgtttt

SEQ ID NO: 90311 - DNA, 25 bp, Homo sapien
agtggtttattatgttccatggaag

SEQ ID NO: 90312 - DNA, 25 bp, Homo sapien
gaaactggtcttattgaatgcattg

SEQ ID NO: 90313 - DNA, 25 bp, Homo sapien
caaaactagtgagtggattgccgaa

SEQ ID NO: 90314 - DNA, 25 bp, Homo sapien
gtggattgccgaagaggagctccca

SEQ ID NO: 90315 - DNA, 25 bp, Homo sapien
aattgcaataacatcttaacagaag

SEQ ID NO: 90316 - DNA, 25 bp, Homo sapien
acagaggcatcagcctgctgttgat

SEQ ID NO: 90317 - DNA, 25 bp, Homo sapien
aggcatcagcctgctgttgatcaca

SEQ ID NO: 90318 - DNA, 25 bp, Homo sapien
aagaccaaaagaatgtgacctattt

SEQ ID NO: 90319 - DNA, 25 bp, Homo sapien
gacctatttgaaactttctgtctta

SEQ ID NO: 90320 - DNA, 25 bp, Homo sapien
actttctgtcttaagatgcttcttg

SEQ ID NO: 90321 - DNA, 25 bp, Homo sapien
gatgcttcttgacatgctgcataac

SEQ ID NO: 90322 - DNA, 25 bp, Homo sapien
gcataactacataaacagcagaggt

SEQ ID NO: 90323 - DNA, 25 bp, Homo sapien
gcagaggtgtttaagagcccagaaa

SEQ ID NO: 90324 - DNA, 25 bp, Homo sapien
agcactttgtagaaatatccctcac

SEQ ID NO: 90325 - DNA, 25 bp, Homo sapien
gtatcgtgtaattcagatttcccag

SEQ ID NO: 90326 - DNA, 25 bp, Homo sapien
gatttcccagtttgaatggaactct

SEQ ID NO: 90327 - DNA, 25 bp, Homo sapien
gaatggaactctatggcactgtcaa

SEQ ID NO: 90328 - DNA, 25 bp, Homo sapien
gaactctatggcactgtcaacaaag

SEQ ID NO: 90329 - DNA, 25 bp, Homo sapien
aaggatgctcggatggactacctga

SEQ ID NO: 90330 - DNA, 25 bp, Homo sapien
ggactacctgagagaatgtatattt

SEQ ID NO: 90331 - DNA, 25 bp, Homo sapien
ggagaagtcaagtcatgtttgtagt

SEQ ID NO: 90332 - DNA, 25 bp, Homo sapien
gttatcgtgtgttacatttggacct

SEQ ID NO: 90333 - DNA, 25 bp, Homo sapien
gtgttacatttggacctattttaat

SEQ ID NO: 90334 - DNA, 25 bp, Homo sapien
ataaagtggcctgtctcaattaaaa

SEQ ID NO: 90335 - DNA, 25 bp, Homo sapien
ctcagcgctggagtggtggaccaac

SEQ ID NO: 90336 - DNA, 25 bp, Homo sapien
ggtggaccaacatgaaactcactga

SEQ ID NO: 90337 - DNA, 25 bp, Homo sapien
ggaaaagggctcttcctcataacct

SEQ ID NO: 90338 - DNA, 25 bp, Homo sapien
ttcctcataacctcgatccgaatac

SEQ ID NO: 90339 - DNA, 25 bp, Homo sapien
acctcgatccgaatacactggcaaa

SEQ ID NO: 90340 - DNA, 25 bp, Homo sapien
gaatacactggcaaaggcaacactt

SEQ ID NO: 90341 - DNA, 25 bp, Homo sapien
tccccagttctgataccactaagaa

SEQ ID NO: 90342 - DNA, 25 bp, Homo sapien
aactccagatttcttacatggcatc

SEQ ID NO: 90343 - DNA, 25 bp, Homo sapien
acatggcatctccagaatggctctg

SEQ ID NO: 90344 - DNA, 25 bp, Homo sapien
ggtattaatgaatctagtgcctttt

SEQ ID NO: 90345 - DNA, 25 bp, Homo sapien
tatcccacgttttgttccctaccat

SEQ ID NO: 90346 - DNA, 25 bp, Homo sapien
ccagagctgtgttgttgcacacctg

SEQ ID NO: 90347 - DNA, 25 bp, Homo sapien
gctgtgttgttgcacacctgcaaaa

SEQ ID NO: 90348 - DNA, 25 bp, Homo sapien
tgcacacctgcaaaacaaggcacat

SEQ ID NO: 90349 - DNA, 25 bp, Homo sapien
aagccaaagagagatcactgccaaa

SEQ ID NO: 90350 - DNA, 25 bp, Homo sapien
gatcactgccaaagtgggagcacta

SEQ ID NO: 90351 - DNA, 25 bp, Homo sapien
tgtttttcttccaaggttcgtagct

SEQ ID NO: 90352 - DNA, 25 bp, Homo sapien
ttttcttccaaggttcgtagctcct

SEQ ID NO: 90353 - DNA, 25 bp, Homo sapien
ttccaaggttcgtagctcctctctg

SEQ ID NO: 90354 - DNA, 25 bp, Homo sapien
cttccaagcctgtaacctcggagga

SEQ ID NO: 90355 - DNA, 25 bp, Homo sapien
acctcggaggactatcttttgttct

SEQ ID NO: 90356 - DNA, 25 bp, Homo sapien
ctgataagcaaatggcaagttttta

SEQ ID NO: 90357 - DNA, 25 bp, Homo sapien
gccgaggcggcaacaaaaattttga

SEQ ID NO: 90358 - DNA, 25 bp, Homo sapien
attttgacagaattgcgccgccttg

SEQ ID NO: 90359 - DNA, 25 bp, Homo sapien
aattgcgccgccttgctgatgatgg

SEQ ID NO: 90360 - DNA, 25 bp, Homo sapien
tggcggcagcccatccttgagagag

SEQ ID NO: 90361 - DNA, 25 bp, Homo sapien
catccttgagagagctgcgggcacg

SEQ ID NO: 90362 - DNA, 25 bp, Homo sapien
cacggatggttgctgcagcaaacga

SEQ ID NO: 90363 - DNA, 25 bp, Homo sapien
gttgctgcagcaaacgagattgcta

SEQ ID NO: 90364 - DNA, 25 bp, Homo sapien
gttaatcgtgttgcaacccattcct

SEQ ID NO: 90365 - DNA, 25 bp, Homo sapien
tgttgcaacccattcctcaaatata

SEQ ID NO: 90366 - DNA, 25 bp, Homo sapien
aaccagtaatcgatggatccatgct

SEQ ID NO: 90367 - DNA, 25 bp, Homo sapien
cgatggatccatgcttaaaaatgac

SEQ ID NO: 90368 - DNA, 25 bp, Homo sapien
aatgtctctgagctgttcacgttga

SEQ ID NO: 90369 - DNA, 25 bp, Homo sapien
ttcacgttgatgcttcttggttggc

SEQ ID NO: 90370 - DNA, 25 bp, Homo sapien
gggtgtagacatgaaaccatcttac

SEQ ID NO: 90371 - DNA, 25 bp, Homo sapien
atcaagcgtattccgttttcttcct

SEQ ID NO: 90372 - DNA, 25 bp, Homo sapien
ttttcttcctgcatgatccctgggc

SEQ ID NO: 90373 - DNA, 25 bp, Homo sapien
cctcccgcaggctgagcaagtctgt

SEQ ID NO: 90374 - DNA, 25 bp, Homo sapien
gcaagtctgtaaactgattctggga

SEQ ID NO: 90375 - DNA, 25 bp, Homo sapien
aaccaagctgctggccatagggtgt

SEQ ID NO: 90376 - DNA, 25 bp, Homo sapien
tagggtgtccttgggtacatccagg

SEQ ID NO: 90377 - DNA, 25 bp, Homo sapien
gtacatccaggagtcttcattgctt

SEQ ID NO: 90378 - DNA, 25 bp, Homo sapien
ttcattgcttctgttattaccccgt

SEQ ID NO: 90379 - DNA, 25 bp, Homo sapien
acatacgtatctatagagctggcat

SEQ ID NO: 90380 - DNA, 25 bp, Homo sapien
acgtatctatagagctggcatgtaa

SEQ ID NO: 90381 - DNA, 25 bp, Homo sapien
agctggcatgtaattcttcctctat

SEQ ID NO: 90382 - DNA, 25 bp, Homo sapien
ctggcatgtaattcttcctctataa

SEQ ID NO: 90383 - DNA, 25 bp, Homo sapien
ggcatgtaattcttcctctataaag

SEQ ID NO: 90384 - DNA, 25 bp, Homo sapien
aaatggagggatatccccttggatt

SEQ ID NO: 90385 - DNA, 25 bp, Homo sapien
agggatatccccttggatttcactt

SEQ ID NO: 90386 - DNA, 25 bp, Homo sapien
tttcacttgcattgtgcaataagca

SEQ ID NO: 90387 - DNA, 25 bp, Homo sapien
gaagggttgataaaagttcttgatc

SEQ ID NO: 90388 - DNA, 25 bp, Homo sapien
gaaaccagaattttagacagcaagc

SEQ ID NO: 90389 - DNA, 25 bp, Homo sapien
aaaattgcactatattaggttaagt

SEQ ID NO: 90390 - DNA, 25 bp, Homo sapien
gcttctcaggttctgatgcagtcag

SEQ ID NO: 90391 - DNA, 25 bp, Homo sapien
ctgatgcagtcagctgagttccctg

SEQ ID NO: 90392 - DNA, 25 bp, Homo sapien
tgagttccctgcctattcttgcaag

SEQ ID NO: 90393 - DNA, 25 bp, Homo sapien
cctgcctattcttgcaagcactagg

SEQ ID NO: 90394 - DNA, 25 bp, Homo sapien
tattcttgcaagcactaggaggagg

SEQ ID NO: 90395 - DNA, 25 bp, Homo sapien
tgctgggaacagcaccgagcgccct

SEQ ID NO: 90396 - DNA, 25 bp, Homo sapien
ggatactttaatccggaggccgtga

SEQ ID NO: 90397 - DNA, 25 bp, Homo sapien
gccccgagacgagctgaatccaaat

SEQ ID NO: 90398 - DNA, 25 bp, Homo sapien
gagacgagctgaatccaaatacgga

SEQ ID NO: 90399 - DNA, 25 bp, Homo sapien
aaatacggatctaggcttgagcttg

SEQ ID NO: 90400 - DNA, 25 bp, Homo sapien
acggatctaggcttgagcttggttg

SEQ ID NO: 90401 - DNA, 25 bp, Homo sapien
tgagcccactgtggtgctcctgcag

SEQ ID NO: 90402 - DNA, 25 bp, Homo sapien
aggctgagccacaactgctggacac

SEQ ID NO: 90403 - DNA, 25 bp, Homo sapien
gttgttgaggtcaccatttcagaaa

SEQ ID NO: 90404 - DNA, 25 bp, Homo sapien
cccagcctggtgctaatccataagg

SEQ ID NO: 90405 - DNA, 25 bp, Homo sapien
aaggacatgggcctcggcgcctggg

SEQ ID NO: 90406 - DNA, 25 bp, Homo sapien
ggacatgggcctcggcgcctgggca

SEQ ID NO: 90407 - DNA, 25 bp, Homo sapien
tggagatgggcacctgacagctttg

SEQ ID NO: 90408 - DNA, 25 bp, Homo sapien
gagatgggcacctgacagctttgcc

SEQ ID NO: 90409 - DNA, 25 bp, Homo sapien
agatgggcacctgacagctttgcct

SEQ ID NO: 90410 - DNA, 25 bp, Homo sapien
gatgggcacctgacagctttgcctt

SEQ ID NO: 90411 - DNA, 25 bp, Homo sapien
atgggcacctgacagctttgccttt

SEQ ID NO: 90412 - DNA, 25 bp, Homo sapien
gaggagtcctcaccagtgccttgaa

SEQ ID NO: 90413 - DNA, 25 bp, Homo sapien
agtgccttgaatgtcagctgcctgg

SEQ ID NO: 90414 - DNA, 25 bp, Homo sapien
agctgcctggcgaaggtcactgacg

SEQ ID NO: 90415 - DNA, 25 bp, Homo sapien
gacggcttcacccaaggacatatag

SEQ ID NO: 90416 - DNA, 25 bp, Homo sapien
cagatcagagaatccggcggcaaat

SEQ ID NO: 90417 - DNA, 25 bp, Homo sapien
attcataaacctctcactgcagttg

SEQ ID NO: 90418 - DNA, 25 bp, Homo sapien
ctgcagttgagtttattacggcgat

SEQ ID NO: 90419 - DNA, 25 bp, Homo sapien
gcgataaccagcatgaatccagtgt

SEQ ID NO: 90420 - DNA, 25 bp, Homo sapien
gagagctttaagaactggtatgcca

SEQ ID NO: 90421 - DNA, 25 bp, Homo sapien
ggtatgccaaaactcctctgggtaa

SEQ ID NO: 90422 - DNA, 25 bp, Homo sapien
aaaacgtgccttggcgataacagga

SEQ ID NO: 90423 - DNA, 25 bp, Homo sapien
cctggccatgtgatcgtgttggtga

SEQ ID NO: 90424 - DNA, 25 bp, Homo sapien
gccatgtgatcgtgttggtgacaga

SEQ ID NO: 90425 - DNA, 25 bp, Homo sapien
tgtgatcgtgttggtgacagaccct

SEQ ID NO: 90426 - DNA, 25 bp, Homo sapien
gatcgtgttggtgacagaccctgat

SEQ ID NO: 90427 - DNA, 25 bp, Homo sapien
tcgtgttggtgacagaccctgatgt

SEQ ID NO: 90428 - DNA, 25 bp, Homo sapien
tgttggtgacagaccctgatgtgct

SEQ ID NO: 90429 - DNA, 25 bp, Homo sapien
gtgacagaccctgatgtgctggtgc

SEQ ID NO: 90430 - DNA, 25 bp, Homo sapien
gacagaccctgatgtgctggtgctg

SEQ ID NO: 90431 - DNA, 25 bp, Homo sapien
agaccctgatgtgctggtgctgtgt

SEQ ID NO: 90432 - DNA, 25 bp, Homo sapien
tgatgtgctggtgctgtgtccccaa

SEQ ID NO: 90433 - DNA, 25 bp, Homo sapien
atgtgctggtgctgtgtccccaaaa

SEQ ID NO: 90434 - DNA, 25 bp, Homo sapien
atcaccatcgccttcagctgcaacc

SEQ ID NO: 90435 - DNA, 25 bp, Homo sapien
gcatcgaggacccagcgttcccgta

SEQ ID NO: 90436 - DNA, 25 bp, Homo sapien
gaggacccagcgttcccgtagccag

SEQ ID NO: 90437 - DNA, 25 bp, Homo sapien
cagcagccgggccaaggtaacttca

SEQ ID NO: 90438 - DNA, 25 bp, Homo sapien
gcagccgggccaaggtaacttcagg

SEQ ID NO: 90439 - DNA, 25 bp, Homo sapien
agccgggccaaggtaacttcaggag

SEQ ID NO: 90440 - DNA, 25 bp, Homo sapien
caaggtaacttcaggagggcccgtg

SEQ ID NO: 90441 - DNA, 25 bp, Homo sapien
acctacaccgcgtggagaaggtcca

SEQ ID NO: 90442 - DNA, 25 bp, Homo sapien
ctacaccgcgtggagaaggtccact

SEQ ID NO: 90443 - DNA, 25 bp, Homo sapien
acaccgcgtggagaaggtccactgg

SEQ ID NO: 90444 - DNA, 25 bp, Homo sapien
gggcacccgttacgccatcaccatc

SEQ ID NO: 90445 - DNA, 25 bp, Homo sapien
tggtcgacgcggcactcgctacgca

SEQ ID NO: 90446 - DNA, 25 bp, Homo sapien
tcgctacgcacgtgccggacctgag

SEQ ID NO: 90447 - DNA, 25 bp, Homo sapien
acgtgccggacctgaggcggatctc

SEQ ID NO: 90448 - DNA, 25 bp, Homo sapien
acctgaggcggatctcccatccggg

SEQ ID NO: 90449 - DNA, 25 bp, Homo sapien
gggctccgggatagtcttcaaggtc

SEQ ID NO: 90450 - DNA, 25 bp, Homo sapien
tccgggatagtcttcaaggtctcaa

SEQ ID NO: 90451 - DNA, 25 bp, Homo sapien
ggatagtcttcaaggtctcaacgaa

SEQ ID NO: 90452 - DNA, 25 bp, Homo sapien
gtcttcaaggtctcaacgaaggcgt

SEQ ID NO: 90453 - DNA, 25 bp, Homo sapien
aacgaaggcgttggccaaggcattt

SEQ ID NO: 90454 - DNA, 25 bp, Homo sapien
gccaaggcatttggttccgcggccg

SEQ ID NO: 90455 - DNA, 25 bp, Homo sapien
aggcatttggttccgcggccgcctt

SEQ ID NO: 90456 - DNA, 25 bp, Homo sapien
aaatacatgtttccagtttacttat

SEQ ID NO: 90457 - DNA, 25 bp, Homo sapien
tacatgtttccagtttacttattca

SEQ ID NO: 90458 - DNA, 25 bp, Homo sapien
cttattcaacagattcttacttggg

SEQ ID NO: 90459 - DNA, 25 bp, Homo sapien
ttcaacagattcttacttgggattg

SEQ ID NO: 90460 - DNA, 25 bp, Homo sapien
aacagattcttacttgggattgact

SEQ ID NO: 90461 - DNA, 25 bp, Homo sapien
agattcttacttgggattgactgaa

SEQ ID NO: 90462 - DNA, 25 bp, Homo sapien
cttacttgggattgactgaagaaaa

SEQ ID NO: 90463 - DNA, 25 bp, Homo sapien
aaacatttatgctatatgatgcatt

SEQ ID NO: 90464 - DNA, 25 bp, Homo sapien
tttgtttctgtgaatatggagagaa

SEQ ID NO: 90465 - DNA, 25 bp, Homo sapien
gagaataaattagctctttgctgaa

SEQ ID NO: 90466 - DNA, 25 bp, Homo sapien
ataaattagctctttgctgaattca

SEQ ID NO: 90467 - DNA, 25 bp, Homo sapien
tgtagcagcacacttgttcaggttt

SEQ ID NO: 90468 - DNA, 25 bp, Homo sapien
acacttgttcaggtttgcatggtat

SEQ ID NO: 90469 - DNA, 25 bp, Homo sapien
aatagattcatgaaaccttggccat

SEQ ID NO: 90470 - DNA, 25 bp, Homo sapien
cttggccatgaggtttgtttcacaa

SEQ ID NO: 90471 - DNA, 25 bp, Homo sapien
gtttcacaaggttcttagaccgagt

SEQ ID NO: 90472 - DNA, 25 bp, Homo sapien
tagaccgagttgtgcaggtaagtgc

SEQ ID NO: 90473 - DNA, 25 bp, Homo sapien
ggtaatctgcactgtttgtttgatg

SEQ ID NO: 90474 - DNA, 25 bp, Homo sapien
ctctgggaattgtgtgggtattaat

SEQ ID NO: 90475 - DNA, 25 bp, Homo sapien
ggtattaatgtttccatgttcccaa

SEQ ID NO: 90476 - DNA, 25 bp, Homo sapien
tgtttccatgttcccaactatgttg

SEQ ID NO: 90477 - DNA, 25 bp, Homo sapien
ccaggttctagatgggtgaatcagt

SEQ ID NO: 90478 - DNA, 25 bp, Homo sapien
gtattggagccaaacgactgtctcg

SEQ ID NO: 90479 - DNA, 25 bp, Homo sapien
acgactgtctcggaacatgtgtgtg

SEQ ID NO: 90480 - DNA, 25 bp, Homo sapien
acatgtgtgtgttatctcggttcat

SEQ ID NO: 90481 - DNA, 25 bp, Homo sapien
atctcggttcatatcaagtccaaag

SEQ ID NO: 90482 - DNA, 25 bp, Homo sapien
gtccaaagctaatggagccttcccc

SEQ ID NO: 90483 - DNA, 25 bp, Homo sapien
tccagggaggaacaccaggaccccg

SEQ ID NO: 90484 - DNA, 25 bp, Homo sapien
taaagttgcattgacgttttcctcc

SEQ ID NO: 90485 - DNA, 25 bp, Homo sapien
tccccttccttttgtgcaagttgga

SEQ ID NO: 90486 - DNA, 25 bp, Homo sapien
caagttggaagtagcagtgttttaa

SEQ ID NO: 90487 - DNA, 25 bp, Homo sapien
gatggtttgacgtttttgctgttgt

SEQ ID NO: 90488 - DNA, 25 bp, Homo sapien
taaaaatgtatctgctttgtgtttg

SEQ ID NO: 90489 - DNA, 25 bp, Homo sapien
tgggatgtctgcttagttggcaggg

SEQ ID NO: 90490 - DNA, 25 bp, Homo sapien
ataaacctccactatcctttatagc

SEQ ID NO: 90491 - DNA, 25 bp, Homo sapien
ctccactatcctttatagccaggga

SEQ ID NO: 90492 - DNA, 25 bp, Homo sapien
ctatcctttatagccagggactttt

SEQ ID NO: 90493 - DNA, 25 bp, Homo sapien
taattatacccataacacctttatt

SEQ ID NO: 90494 - DNA, 25 bp, Homo sapien
atttaaatccagtgttctccgcagc

SEQ ID NO: 90495 - DNA, 25 bp, Homo sapien
taaatccagtgttctccgcagcctt

SEQ ID NO: 90496 - DNA, 25 bp, Homo sapien
gttctccgcagccttttgtctattt

SEQ ID NO: 90497 - DNA, 25 bp, Homo sapien
gtctatttatatgtgtaccaagtgt

SEQ ID NO: 90498 - DNA, 25 bp, Homo sapien
atgtgtaccaagtgttaaacataat

SEQ ID NO: 90499 - DNA, 25 bp, Homo sapien
atgctgctattaaacatatttgtaa

SEQ ID NO: 90500 - DNA, 25 bp, Homo sapien
aatccaagtctgaaactctgcgctc

SEQ ID NO: 90501 - DNA, 25 bp, Homo sapien
tctgcgctctagtactgctgttaag

SEQ ID NO: 90502 - DNA, 25 bp, Homo sapien
gatacacaacttgtttcttagttca

SEQ ID NO: 90503 - DNA, 25 bp, Homo sapien
ttcttagttcatataatctcgggat

SEQ ID NO: 90504 - DNA, 25 bp, Homo sapien
tataatctcgggatacacacacaca

SEQ ID NO: 90505 - DNA, 25 bp, Homo sapien
aaatatacctgatgccagatttttt

SEQ ID NO: 90506 - DNA, 25 bp, Homo sapien
tttcataaatattctgcctactgta

SEQ ID NO: 90507 - DNA, 25 bp, Homo sapien
cctactgtaaatatgggttcctctg

SEQ ID NO: 90508 - DNA, 25 bp, Homo sapien
atatgggttcctctgagttgtttta

SEQ ID NO: 90509 - DNA, 25 bp, Homo sapien
ggaaatttcatggtcttacctacaa

SEQ ID NO: 90510 - DNA, 25 bp, Homo sapien
tggtcttacctacaataacttttat

SEQ ID NO: 90511 - DNA, 25 bp, Homo sapien
tcaggcgggcgctaatattgacacc

SEQ ID NO: 90512 - DNA, 25 bp, Homo sapien
gcgctaatattgacacctgctcaga

SEQ ID NO: 90513 - DNA, 25 bp, Homo sapien
tgctcagaagaccagaggaccccgt

SEQ ID NO: 90514 - DNA, 25 bp, Homo sapien
agaggaccccgttgatggaagcagc

SEQ ID NO: 90515 - DNA, 25 bp, Homo sapien
ggaagcagccgaaaacaaccatctg

SEQ ID NO: 90516 - DNA, 25 bp, Homo sapien
aacaaccatctggaagcagtgaagt

SEQ ID NO: 90517 - DNA, 25 bp, Homo sapien
agtgaagtacctcatcaaggctggg

SEQ ID NO: 90518 - DNA, 25 bp, Homo sapien
ggtggatcccaagatacagaaaact

SEQ ID NO: 90519 - DNA, 25 bp, Homo sapien
gtttatacggagtctcaagagaccc

SEQ ID NO: 90520 - DNA, 25 bp, Homo sapien
ggagaactcacacttgctgatttca

SEQ ID NO: 90521 - DNA, 25 bp, Homo sapien
aaaacttactatatacggccacagt

SEQ ID NO: 90522 - DNA, 25 bp, Homo sapien
tgtgctttacctccttgcccttgtg

SEQ ID NO: 90523 - DNA, 25 bp, Homo sapien
gctttacctccttgcccttgtgtct

SEQ ID NO: 90524 - DNA, 25 bp, Homo sapien
ttgtgtctcaggtgtggtccctgcc

SEQ ID NO: 90525 - DNA, 25 bp, Homo sapien
ccctgcctgcttgatgaagttgctc

SEQ ID NO: 90526 - DNA, 25 bp, Homo sapien
gaagttgctctgttcaagcctttgg

SEQ ID NO: 90527 - DNA, 25 bp, Homo sapien
caagcctttggtgggatcatgtgtt

SEQ ID NO: 90528 - DNA, 25 bp, Homo sapien
ggtaggacatttcccagcaagggct

SEQ ID NO: 90529 - DNA, 25 bp, Homo sapien
ggaggagttgccgtgccttcagcct

SEQ ID NO: 90530 - DNA, 25 bp, Homo sapien
gtgccttcagcctgaatcgaatgtc

SEQ ID NO: 90531 - DNA, 25 bp, Homo sapien
atcgaatgtcagaaccagccagcgg

SEQ ID NO: 90532 - DNA, 25 bp, Homo sapien
atgtcagaaccagccagcggtgctt

SEQ ID NO: 90533 - DNA, 25 bp, Homo sapien
tagcatttatgtttcaactgcaagg

SEQ ID NO: 90534 - DNA, 25 bp, Homo sapien
aactgcaaggcatccatccgtggag

SEQ ID NO: 90535 - DNA, 25 bp, Homo sapien
atccatccgtggaggacattccaaa

SEQ ID NO: 90536 - DNA, 25 bp, Homo sapien
tatctctctcagtgagctgattcat

SEQ ID NO: 90537 - DNA, 25 bp, Homo sapien
gctgattcatagatcaaagtctgaa

SEQ ID NO: 90538 - DNA, 25 bp, Homo sapien
acacatggtgatcataatttctctt

SEQ ID NO: 90539 - DNA, 25 bp, Homo sapien
tttctagttttatcagccaattcct

SEQ ID NO: 90540 - DNA, 25 bp, Homo sapien
ttatcagccaattcctagaacaata

SEQ ID NO: 90541 - DNA, 25 bp, Homo sapien
tgcaagctacataaaatcctaaaga

SEQ ID NO: 90542 - DNA, 25 bp, Homo sapien
gtcattataattcaaactgctactt

SEQ ID NO: 90543 - DNA, 25 bp, Homo sapien
ctgctacttgtcaatatattcacca

SEQ ID NO: 90544 - DNA, 25 bp, Homo sapien
catttggatggccagagtgccctga

SEQ ID NO: 90545 - DNA, 25 bp, Homo sapien
tggatggccagagtgccctgaagca

SEQ ID NO: 90546 - DNA, 25 bp, Homo sapien
agagtgccctgaagcaccactacca

SEQ ID NO: 90547 - DNA, 25 bp, Homo sapien
ctcctctcaaagagcctctgattgt

SEQ ID NO: 90548 - DNA, 25 bp, Homo sapien
caaagagcctctgattgtgtcacca

SEQ ID NO: 90549 - DNA, 25 bp, Homo sapien
aagagcctctgattgtgtcaccaag

SEQ ID NO: 90550 - DNA, 25 bp, Homo sapien
gagcctctgattgtgtcaccaaggg

SEQ ID NO: 90551 - DNA, 25 bp, Homo sapien
gggctcacatcttatgtctgccatg

SEQ ID NO: 90552 - DNA, 25 bp, Homo sapien
tcacatcttatgtctgccatgccag

SEQ ID NO: 90553 - DNA, 25 bp, Homo sapien
acatcttatgtctgccatgccaggg

SEQ ID NO: 90554 - DNA, 25 bp, Homo sapien
tgtgttggaagcttcccctcctgcc

SEQ ID NO: 90555 - DNA, 25 bp, Homo sapien
ctgtgctttacctccttgcccttgt

SEQ ID NO: 90556 - DNA, 25 bp, Homo sapien
tgtgctttacctccttgcccttgtg

SEQ ID NO: 90557 - DNA, 25 bp, Homo sapien
gtgctttacctccttgcccttgtgt

SEQ ID NO: 90558 - DNA, 25 bp, Homo sapien
tgctttacctccttgcccttgtgtc

SEQ ID NO: 90559 - DNA, 25 bp, Homo sapien
gctttacctccttgcccttgtgtct

SEQ ID NO: 90560 - DNA, 25 bp, Homo sapien
ctttacctccttgcccttgtgtctc

SEQ ID NO: 90561 - DNA, 25 bp, Homo sapien
tttacctccttgcccttgtgtctca

SEQ ID NO: 90562 - DNA, 25 bp, Homo sapien
gggacccagctgcactggggcactg

SEQ ID NO: 90563 - DNA, 25 bp, Homo sapien
gctggtggtctgcttaccacagaat

SEQ ID NO: 90564 - DNA, 25 bp, Homo sapien
gtctgcttaccacagaatcctaagg

SEQ ID NO: 90565 - DNA, 25 bp, Homo sapien
ggagccttgcagtcagttgtgtttg

SEQ ID NO: 90566 - DNA, 25 bp, Homo sapien
caagtgcaacagtcaggctgctgat

SEQ ID NO: 90567 - DNA, 25 bp, Homo sapien
aggctgctgattcctgtggcatgca

SEQ ID NO: 90568 - DNA, 25 bp, Homo sapien
gattcctgtggcatgcaggctgtag

SEQ ID NO: 90569 - DNA, 25 bp, Homo sapien
catgcaggctgtagaggttgacaaa

SEQ ID NO: 90570 - DNA, 25 bp, Homo sapien
gagggtgagccctagttgatttttt

SEQ ID NO: 90571 - DNA, 25 bp, Homo sapien
ttcaactccctgtagccctttggga

SEQ ID NO: 90572 - DNA, 25 bp, Homo sapien
ctgtagccctttgggactttgcggt

SEQ ID NO: 90573 - DNA, 25 bp, Homo sapien
tgggactttgcggtcccctaagtag

SEQ ID NO: 90574 - DNA, 25 bp, Homo sapien
agccattggctccacgaattctacc

SEQ ID NO: 90575 - DNA, 25 bp, Homo sapien
ttggctccacgaattctaccaaacc

SEQ ID NO: 90576 - DNA, 25 bp, Homo sapien
aattctaccaaaccctctagcagct

SEQ ID NO: 90577 - DNA, 25 bp, Homo sapien
agcagtggcagtgagttcccccttc

SEQ ID NO: 90578 - DNA, 25 bp, Homo sapien
ttcagtcttcgaactgctccagcag

SEQ ID NO: 90579 - DNA, 25 bp, Homo sapien
agcaacactgttccagacttctgcg

SEQ ID NO: 90580 - DNA, 25 bp, Homo sapien
actgttccagacttctgcgcttcct

SEQ ID NO: 90581 - DNA, 25 bp, Homo sapien
tcctgtgctgtttgctccttactaa

SEQ ID NO: 90582 - DNA, 25 bp, Homo sapien
gtgctgtttgctccttactaaattc

SEQ ID NO: 90583 - DNA, 25 bp, Homo sapien
ttccaaataggagtaattgtactgc

SEQ ID NO: 90584 - DNA, 25 bp, Homo sapien
gtaattgtactgcaataatttttca

SEQ ID NO: 90585 - DNA, 25 bp, Homo sapien
attacaagctattgccttctatgaa

SEQ ID NO: 90586 - DNA, 25 bp, Homo sapien
attgccttctatgaattagcagtgt

SEQ ID NO: 90587 - DNA, 25 bp, Homo sapien
aattagcagtgtttgactctcagcc

SEQ ID NO: 90588 - DNA, 25 bp, Homo sapien
ttgactctcagccttagaattctga

SEQ ID NO: 90589 - DNA, 25 bp, Homo sapien
agaattctgaggttaacgtgctaaa

SEQ ID NO: 90590 - DNA, 25 bp, Homo sapien
ttagctctaacgtaacaccaactgt

SEQ ID NO: 90591 - DNA, 25 bp, Homo sapien
accaactgttgtgaacatccatgtt

SEQ ID NO: 90592 - DNA, 25 bp, Homo sapien
tgacttttggctattaaatggttta

SEQ ID NO: 90593 - DNA, 25 bp, Homo sapien
tacacaataagccaagaccaaatca

SEQ ID NO: 90594 - DNA, 25 bp, Homo sapien
aatagttcactacagacagatgttt

SEQ ID NO: 90595 - DNA, 25 bp, Homo sapien
gatgtttttatctactgaactacaa

SEQ ID NO: 90596 - DNA, 25 bp, Homo sapien
gggataatggtaccgacctcttagg

SEQ ID NO: 90597 - DNA, 25 bp, Homo sapien
aatggtaccgacctcttaggcttgg

SEQ ID NO: 90598 - DNA, 25 bp, Homo sapien
taccgacctcttaggcttggtgtga

SEQ ID NO: 90599 - DNA, 25 bp, Homo sapien
tcttaggcttggtgtgaggatgaaa

SEQ ID NO: 90600 - DNA, 25 bp, Homo sapien
gtacatgcaatatgcttgaaactag

SEQ ID NO: 90601 - DNA, 25 bp, Homo sapien
atgagttcttccttctgctcaaaaa

SEQ ID NO: 90602 - DNA, 25 bp, Homo sapien
gttcttccttctgctcaaaaatatt

SEQ ID NO: 90603 - DNA, 25 bp, Homo sapien
tgaatttcttgtccttgtgctctgt

SEQ ID NO: 90604 - DNA, 25 bp, Homo sapien
tccttgtgctctgtgaaacattgaa

SEQ ID NO: 90605 - DNA, 25 bp, Homo sapien
gaaacattgaacagccccatttaga

SEQ ID NO: 90606 - DNA, 25 bp, Homo sapien
ctctgccctcatagaatcctaattg

SEQ ID NO: 90607 - DNA, 25 bp, Homo sapien
caggtgaacaccctacgacgttata

SEQ ID NO: 90608 - DNA, 25 bp, Homo sapien
aaacgacactacaagttgcagacca

SEQ ID NO: 90609 - DNA, 25 bp, Homo sapien
ttgcagaccagaccaggcttcaata

SEQ ID NO: 90610 - DNA, 25 bp, Homo sapien
aggcttcaataaggcccagttagca

SEQ ID NO: 90611 - DNA, 25 bp, Homo sapien
aaactgtgagtcgacacttcaggaa

SEQ ID NO: 90612 - DNA, 25 bp, Homo sapien
gagtcgacacttcaggaacatacct

SEQ ID NO: 90613 - DNA, 25 bp, Homo sapien
gaaaaagagacccttgcctacttca

SEQ ID NO: 90614 - DNA, 25 bp, Homo sapien
cccttgcctacttcatctacatggt

SEQ ID NO: 90615 - DNA, 25 bp, Homo sapien
gtgtaatgcttgatgcacaggtgat

SEQ ID NO: 90616 - DNA, 25 bp, Homo sapien
acattcctgaggttgatctgttcca

SEQ ID NO: 90617 - DNA, 25 bp, Homo sapien
gttgatctgttccagctgcaggtga

SEQ ID NO: 90618 - DNA, 25 bp, Homo sapien
ggatgtggctccatgtccatggtgc

SEQ ID NO: 90619 - DNA, 25 bp, Homo sapien
aaggctgaccccttagatggcccag

SEQ ID NO: 90620 - DNA, 25 bp, Homo sapien
gctgaccccttagatggcccaggaa

SEQ ID NO: 90621 - DNA, 25 bp, Homo sapien
gaccccttagatggcccaggaatgg

SEQ ID NO: 90622 - DNA, 25 bp, Homo sapien
atggcccaggaatggcaggtgctac

SEQ ID NO: 90623 - DNA, 25 bp, Homo sapien
cccaggaatggcaggtgctacaaaa

SEQ ID NO: 90624 - DNA, 25 bp, Homo sapien
tgctacaaaaatggtacccacgtgg

SEQ ID NO: 90625 - DNA, 25 bp, Homo sapien
agggctcatcagcacccgctcaggg

SEQ ID NO: 90626 - DNA, 25 bp, Homo sapien
atcagcacccgctcagggagcctgt

SEQ ID NO: 90627 - DNA, 25 bp, Homo sapien
tcagggagcctgtccctttatgttc

SEQ ID NO: 90628 - DNA, 25 bp, Homo sapien
ggagcctgtccctttatgttcccaa

SEQ ID NO: 90629 - DNA, 25 bp, Homo sapien
ccccatgtcccaaaggtggaataca

SEQ ID NO: 90630 - DNA, 25 bp, Homo sapien
ggtggaatacaaccagaggtctcat

SEQ ID NO: 90631 - DNA, 25 bp, Homo sapien
gaggtctcatctctgaactttcttg

SEQ ID NO: 90632 - DNA, 25 bp, Homo sapien
gaactttcttgcgtactgattacat

SEQ ID NO: 90633 - DNA, 25 bp, Homo sapien
tgattacatgagtctttggagtcgg

SEQ ID NO: 90634 - DNA, 25 bp, Homo sapien
aggttctgcccctgtgaggtgttat

SEQ ID NO: 90635 - DNA, 25 bp, Homo sapien
gtgaggtgttatacatgaccatcaa

SEQ ID NO: 90636 - DNA, 25 bp, Homo sapien
accatcaaagtcctacgtcaagcta

SEQ ID NO: 90637 - DNA, 25 bp, Homo sapien
aagtcctacgtcaagctagctttgc

SEQ ID NO: 90638 - DNA, 25 bp, Homo sapien
taccccaccgtgatgacttgaaata

SEQ ID NO: 90639 - DNA, 25 bp, Homo sapien
acttgaaatataatcagcgctggca

SEQ ID NO: 90640 - DNA, 25 bp, Homo sapien
acttagaatatttgggtgtgcatat

SEQ ID NO: 90641 - DNA, 25 bp, Homo sapien
gggtgtgcatattaagtctgtgaat

SEQ ID NO: 90642 - DNA, 25 bp, Homo sapien
gtctgtgaatttctgtgacttccac

SEQ ID NO: 90643 - DNA, 25 bp, Homo sapien
gaatttctgtgacttccacatgcca

SEQ ID NO: 90644 - DNA, 25 bp, Homo sapien
gtgacttccacatgccaaaattaaa

SEQ ID NO: 90645 - DNA, 25 bp, Homo sapien
gacaaaatatgttatcagtaggaaa

SEQ ID NO: 90646 - DNA, 25 bp, Homo sapien
ttggtttgctttgtggcatgtgcac

SEQ ID NO: 90647 - DNA, 25 bp, Homo sapien
aaaagtacgctttgctgaataaaag

SEQ ID NO: 90648 - DNA, 25 bp, Homo sapien
accacatcccagacaaacatgtctt

SEQ ID NO: 90649 - DNA, 25 bp, Homo sapien
catgtcttcacatttattgtcattc

SEQ ID NO: 90650 - DNA, 25 bp, Homo sapien
tattgtcattctaacttgaactaat

SEQ ID NO: 90651 - DNA, 25 bp, Homo sapien
tcagtgccttgctgggcagtcccat

SEQ ID NO: 90652 - DNA, 25 bp, Homo sapien
agtcccatgggcagcgagcagacac

SEQ ID NO: 90653 - DNA, 25 bp, Homo sapien
agcagacacggctggacctggagca

SEQ ID NO: 90654 - DNA, 25 bp, Homo sapien
cagctgctgaccatggagaccaagc

SEQ ID NO: 90655 - DNA, 25 bp, Homo sapien
atggagaccaagctgcgtctgctgg

SEQ ID NO: 90656 - DNA, 25 bp, Homo sapien
ttcaacttctgctatgactgcagca

SEQ ID NO: 90657 - DNA, 25 bp, Homo sapien
ctgctatgactgcagcatcgctgaa

SEQ ID NO: 90658 - DNA, 25 bp, Homo sapien
tgcagcatcgctgaaccttgacagt

SEQ ID NO: 90659 - DNA, 25 bp, Homo sapien
cgctgaaccttgacagtgtggctgg

SEQ ID NO: 90660 - DNA, 25 bp, Homo sapien
tagaggagtgcaggcaccctgacca

SEQ ID NO: 90661 - DNA, 25 bp, Homo sapien
aggcaccctgaccagcagagattgc

SEQ ID NO: 90662 - DNA, 25 bp, Homo sapien
gtttcatttttacacatctctatgt

SEQ ID NO: 90663 - DNA, 25 bp, Homo sapien
acatctctatgtctctatataagta

SEQ ID NO: 90664 - DNA, 25 bp, Homo sapien
tgattcacagttaaaaagacttttt

SEQ ID NO: 90665 - DNA, 25 bp, Homo sapien
agactttttcaatatcacccttagc

SEQ ID NO: 90666 - DNA, 25 bp, Homo sapien
ctttttcaatatcacccttagctac

SEQ ID NO: 90667 - DNA, 25 bp, Homo sapien
aatatcacccttagctactattgta

SEQ ID NO: 90668 - DNA, 25 bp, Homo sapien
cacccttagctactattgtatataa

SEQ ID NO: 90669 - DNA, 25 bp, Homo sapien
ttttttcaccagccaagtgttttgc

SEQ ID NO: 90670 - DNA, 25 bp, Homo sapien
ctgtgatgtaccaactttacagttg

SEQ ID NO: 90671 - DNA, 25 bp, Homo sapien
aactttacagttgtgttgccattta

SEQ ID NO: 90672 - DNA, 25 bp, Homo sapien
tacagttgtgttgccatttaaacct

SEQ ID NO: 90673 - DNA, 25 bp, Homo sapien
cattctctttgccaaacaaacagat

SEQ ID NO: 90674 - DNA, 25 bp, Homo sapien
ttgccaaacaaacagattgccttct

SEQ ID NO: 90675 - DNA, 25 bp, Homo sapien
aacagattgccttctggtaggagac

SEQ ID NO: 90676 - DNA, 25 bp, Homo sapien
ttgccttctggtaggagacagtgat

SEQ ID NO: 90677 - DNA, 25 bp, Homo sapien
acaggtttctgtgtatgaactgaga

SEQ ID NO: 90678 - DNA, 25 bp, Homo sapien
gaaatatgcctactgttttggaaac

SEQ ID NO: 90679 - DNA, 25 bp, Homo sapien
gatataatggatactttgcttggat

SEQ ID NO: 90680 - DNA, 25 bp, Homo sapien
gatactttgcttggatccaagtcaa

SEQ ID NO: 90681 - DNA, 25 bp, Homo sapien
ccaagtcaaaccaatcagcataatt

SEQ ID NO: 90682 - DNA, 25 bp, Homo sapien
caatcagcataattcatcattccta

SEQ ID NO: 90683 - DNA, 25 bp, Homo sapien
catcattcctaatatttttcttgta

SEQ ID NO: 90684 - DNA, 25 bp, Homo sapien
gattgcacgtgcattatttaatcac

SEQ ID NO: 90685 - DNA, 25 bp, Homo sapien
atttaatcacatagacaagtcagga

SEQ ID NO: 90686 - DNA, 25 bp, Homo sapien
caagtcaggattgaaggatagttct

SEQ ID NO: 90687 - DNA, 25 bp, Homo sapien
aggatagttctgtcgaagaactcaa

SEQ ID NO: 90688 - DNA, 25 bp, Homo sapien
aaagatacggtggttgatttccatt

SEQ ID NO: 90689 - DNA, 25 bp, Homo sapien
acggtggttgatttccatttttgct

SEQ ID NO: 90690 - DNA, 25 bp, Homo sapien
ttttctactgaaagtgttttgcttt

SEQ ID NO: 90691 - DNA, 25 bp, Homo sapien
atatagcaggaaaggactatctttg

SEQ ID NO: 90692 - DNA, 25 bp, Homo sapien
aggactatctttgaacataagttaa

SEQ ID NO: 90693 - DNA, 25 bp, Homo sapien
aggtgaattgtgatttaactagtga

SEQ ID NO: 90694 - DNA, 25 bp, Homo sapien
tattcaagtgaactctgtttttctg

SEQ ID NO: 90695 - DNA, 25 bp, Homo sapien
ttccattatgccaaacttgggatgg

SEQ ID NO: 90696 - DNA, 25 bp, Homo sapien
ggatgggattttcgaagcagacaac

SEQ ID NO: 90697 - DNA, 25 bp, Homo sapien
gaagcagacaacactatttcatcgt

SEQ ID NO: 90698 - DNA, 25 bp, Homo sapien
tcatcgtgtttcaaattggaacctt

SEQ ID NO: 90699 - DNA, 25 bp, Homo sapien
gaaccttgaggctagttagtatcac

SEQ ID NO: 90700 - DNA, 25 bp, Homo sapien
agttagtatcacactcaggccacac

SEQ ID NO: 90701 - DNA, 25 bp, Homo sapien
gtttactgccttgtattctagttat

SEQ ID NO: 90702 - DNA, 25 bp, Homo sapien
tccctcactagattatacgctcctt

SEQ ID NO: 90703 - DNA, 25 bp, Homo sapien
tagattatacgctccttgtgggcag

SEQ ID NO: 90704 - DNA, 25 bp, Homo sapien
tgctttgcacatagtagtcactcag

SEQ ID NO: 90705 - DNA, 25 bp, Homo sapien
catagtagtcactcagtgtttgtta

SEQ ID NO: 90706 - DNA, 25 bp, Homo sapien
tggaagccagaaaatcaggttgaac

SEQ ID NO: 90707 - DNA, 25 bp, Homo sapien
ggttgaacatgaatgctaggctcta

SEQ ID NO: 90708 - DNA, 25 bp, Homo sapien
atctgcttctcatttgtttctgcac

SEQ ID NO: 90709 - DNA, 25 bp, Homo sapien
gtttctgcactatgtcaaagaggac

SEQ ID NO: 90710 - DNA, 25 bp, Homo sapien
gaggaacattgagcacagtgggaaa

SEQ ID NO: 90711 - DNA, 25 bp, Homo sapien
aaattggactggttgatctggtcac

SEQ ID NO: 90712 - DNA, 25 bp, Homo sapien
actggttgatctggtcactggagca

SEQ ID NO: 90713 - DNA, 25 bp, Homo sapien
actggagcaggacttgggttcttct

SEQ ID NO: 90714 - DNA, 25 bp, Homo sapien
gttcttctggccagattttgactcc

SEQ ID NO: 90715 - DNA, 25 bp, Homo sapien
ttttgactcccagattcctttacaa

SEQ ID NO: 90716 - DNA, 25 bp, Homo sapien
gattcctttacaaaacgcactcatt

SEQ ID NO: 90717 - DNA, 25 bp, Homo sapien
gaggacgagggcgccgactcctaac

SEQ ID NO: 90718 - DNA, 25 bp, Homo sapien
gccaggcagcctcgttctgcacagg

SEQ ID NO: 90719 - DNA, 25 bp, Homo sapien
aggcagcctcgttctgcacaggcac

SEQ ID NO: 90720 - DNA, 25 bp, Homo sapien
agcctcgttctgcacaggcacttta

SEQ ID NO: 90721 - DNA, 25 bp, Homo sapien
gttctgcacaggcactttagcccga

SEQ ID NO: 90722 - DNA, 25 bp, Homo sapien
ttctgcacaggcactttagcccgag

SEQ ID NO: 90723 - DNA, 25 bp, Homo sapien
tgcacaggcactttagcccgagcca

SEQ ID NO: 90724 - DNA, 25 bp, Homo sapien
cacaggcactttagcccgagccagg

SEQ ID NO: 90725 - DNA, 25 bp, Homo sapien
tagcccgagccaggcacacctgcga

SEQ ID NO: 90726 - DNA, 25 bp, Homo sapien
gccgccctgctgataagctggcttc

SEQ ID NO: 90727 - DNA, 25 bp, Homo sapien
ctgctgataagctggcttcattaaa

SEQ ID NO: 90728 - DNA, 25 bp, Homo sapien
gagtgaaatccccaggagatgcaga

SEQ ID NO: 90729 - DNA, 25 bp, Homo sapien
aagtgcagctaactgaggcctcagg

SEQ ID NO: 90730 - DNA, 25 bp, Homo sapien
gcccatcaggatgagagctatgtct

SEQ ID NO: 90731 - DNA, 25 bp, Homo sapien
tgtctttctccagtgatgactctgc

SEQ ID NO: 90732 - DNA, 25 bp, Homo sapien
gactctgcttctatgaggtcaccag

SEQ ID NO: 90733 - DNA, 25 bp, Homo sapien
gaggtcaccagcagtagaaccatat

SEQ ID NO: 90734 - DNA, 25 bp, Homo sapien
gaaccatatcttgctggcatacact

SEQ ID NO: 90735 - DNA, 25 bp, Homo sapien
cttgctggcatacacttgggatggc

SEQ ID NO: 90736 - DNA, 25 bp, Homo sapien
tggacttccatctgtcatcaggaga

SEQ ID NO: 90737 - DNA, 25 bp, Homo sapien
gagtcagtacagatcatcaatcctt

SEQ ID NO: 90738 - DNA, 25 bp, Homo sapien
atcatcaatccttccacatatacaa

SEQ ID NO: 90739 - DNA, 25 bp, Homo sapien
aggaacaccatctatagcaccctgg

SEQ ID NO: 90740 - DNA, 25 bp, Homo sapien
tatagcaccctggtcacctgtgtga

SEQ ID NO: 90741 - DNA, 25 bp, Homo sapien
tcacctgtgtgacatttgtggccac

SEQ ID NO: 90742 - DNA, 25 bp, Homo sapien
gcctgtgctctacatgctattcaaa

SEQ ID NO: 90743 - DNA, 25 bp, Homo sapien
gctattcaaagccagctaacccctg

SEQ ID NO: 90744 - DNA, 25 bp, Homo sapien
agggtctgaggcaatagctgtgaat

SEQ ID NO: 90745 - DNA, 25 bp, Homo sapien
tcgtagcaatgaagcgagcctttgg

SEQ ID NO: 90746 - DNA, 25 bp, Homo sapien
gggcatgtacaacctcaatctgaag

SEQ ID NO: 90747 - DNA, 25 bp, Homo sapien
agcagtatctgtgtggctcaccagc

SEQ ID NO: 90748 - DNA, 25 bp, Homo sapien
gtgtggctcaccagcaggcatgctt

SEQ ID NO: 90749 - DNA, 25 bp, Homo sapien
aggcatgcttcgctttgtagacaag

SEQ ID NO: 90750 - DNA, 25 bp, Homo sapien
gattgggccacggttgccaaggtaa

SEQ ID NO: 90751 - DNA, 25 bp, Homo sapien
ggagctggagctaacttccttcttt

SEQ ID NO: 90752 - DNA, 25 bp, Homo sapien
ttccttctttcatcctttccaattt

SEQ ID NO: 90753 - DNA, 25 bp, Homo sapien
aataatgcattctgtactacatcct

SEQ ID NO: 90754 - DNA, 25 bp, Homo sapien
acatcctgccttttgaaacctaaat

SEQ ID NO: 90755 - DNA, 25 bp, Homo sapien
acctaaatgagttttcgttgatgaa

SEQ ID NO: 90756 - DNA, 25 bp, Homo sapien
cacaaaactgtggtggttctgacca

SEQ ID NO: 90757 - DNA, 25 bp, Homo sapien
gtggttctgaccacctgtgacgagg

SEQ ID NO: 90758 - DNA, 25 bp, Homo sapien
gggtcataatacttccagtgatcct

SEQ ID NO: 90759 - DNA, 25 bp, Homo sapien
ccagtgatccttttaatttagcaaa

SEQ ID NO: 90760 - DNA, 25 bp, Homo sapien
gcaaaatatttgtcggtggagggaa

SEQ ID NO: 90761 - DNA, 25 bp, Homo sapien
caccggcctgggtcttgctggacga

SEQ ID NO: 90762 - DNA, 25 bp, Homo sapien
tcttgctggacgagtgtggcctaga

SEQ ID NO: 90763 - DNA, 25 bp, Homo sapien
aggacactccccacgtgtgctggga

SEQ ID NO: 90764 - DNA, 25 bp, Homo sapien
tccctggcactgctatcaggactga

SEQ ID NO: 90765 - DNA, 25 bp, Homo sapien
actgctatcaggactgagccaggag

SEQ ID NO: 90766 - DNA, 25 bp, Homo sapien
gcatggcctggcagctctccagcag

SEQ ID NO: 90767 - DNA, 25 bp, Homo sapien
tggcagctctccagcagggcagagt

SEQ ID NO: 90768 - DNA, 25 bp, Homo sapien
agggcagagtgtttgcccaccagct

SEQ ID NO: 90769 - DNA, 25 bp, Homo sapien
tagccctaggaaggccaggagccca

SEQ ID NO: 90770 - DNA, 25 bp, Homo sapien
cagtagccatgtggccagtctacca

SEQ ID NO: 90771 - DNA, 25 bp, Homo sapien
agccatgtggccagtctaccatggg

SEQ ID NO: 90772 - DNA, 25 bp, Homo sapien
gtctgcctcagactagatttgactt

SEQ ID NO: 90773 - DNA, 25 bp, Homo sapien
ttgacttgagttctttatgacccag

SEQ ID NO: 90774 - DNA, 25 bp, Homo sapien
agttctttatgacccaggactctgg

SEQ ID NO: 90775 - DNA, 25 bp, Homo sapien
ccaggactctggataatgtgaattt

SEQ ID NO: 90776 - DNA, 25 bp, Homo sapien
gataatgtgaatttgctttcctatt

SEQ ID NO: 90777 - DNA, 25 bp, Homo sapien
tgctttcctatttaactagaagata

SEQ ID NO: 90778 - DNA, 25 bp, Homo sapien
catgtactatagatcattgtctcat

SEQ ID NO: 90779 - DNA, 25 bp, Homo sapien
gtctcattttagtgattgttcctta

SEQ ID NO: 90780 - DNA, 25 bp, Homo sapien
gattgttccttaaactagtgaaact

SEQ ID NO: 90781 - DNA, 25 bp, Homo sapien
tagtgaaactagtggatttctcttc

SEQ ID NO: 90782 - DNA, 25 bp, Homo sapien
gcatgttaaatgtgaaccttagtgt

SEQ ID NO: 90783 - DNA, 25 bp, Homo sapien
cctggccatgtgatcgtgttggtga

SEQ ID NO: 90784 - DNA, 25 bp, Homo sapien
gccatgtgatcgtgttggtgacaga

SEQ ID NO: 90785 - DNA, 25 bp, Homo sapien
gatcgtgttggtgacagaccctgat

SEQ ID NO: 90786 - DNA, 25 bp, Homo sapien
tgttggtgacagaccctgatgtgct

SEQ ID NO: 90787 - DNA, 25 bp, Homo sapien
gtgacagaccctgatgtgctggtgc

SEQ ID NO: 90788 - DNA, 25 bp, Homo sapien
gacagaccctgatgtgctggtgctg

SEQ ID NO: 90789 - DNA, 25 bp, Homo sapien
agaccctgatgtgctggtgctgtgt

SEQ ID NO: 90790 - DNA, 25 bp, Homo sapien
tgatgtgctggtgctgtgtccccaa

SEQ ID NO: 90791 - DNA, 25 bp, Homo sapien
atgtgctggtgctgtgtccccaaaa

SEQ ID NO: 90792 - DNA, 25 bp, Homo sapien
cagttcacggttgctcctgggagct

SEQ ID NO: 90793 - DNA, 25 bp, Homo sapien
acccgtcacatcagaaccttggaag

SEQ ID NO: 90794 - DNA, 25 bp, Homo sapien
caaggagattccaagtacacgaaga

SEQ ID NO: 90795 - DNA, 25 bp, Homo sapien
gtacacgaagaacttggcagttatg

SEQ ID NO: 90796 - DNA, 25 bp, Homo sapien
aaaaacagaagcgtcacaggcgtcg

SEQ ID NO: 90797 - DNA, 25 bp, Homo sapien
gcgtcacaggcgtcgccacaaaaaa

SEQ ID NO: 90798 - DNA, 25 bp, Homo sapien
agaaagatgcagtccctaaaccacc

SEQ ID NO: 90799 - DNA, 25 bp, Homo sapien
tctcgcctcgcaaactaagcatcgt

SEQ ID NO: 90800 - DNA, 25 bp, Homo sapien
caaactaagcatcgtcagagagtgt

SEQ ID NO: 90801 - DNA, 25 bp, Homo sapien
gagtgtttgtatgacagaatagcac

SEQ ID NO: 90802 - DNA, 25 bp, Homo sapien
aactgaaattgcacagagactctcc

SEQ ID NO: 90803 - DNA, 25 bp, Homo sapien
tccaaagtcaacaagtacatctgtg

SEQ ID NO: 90804 - DNA, 25 bp, Homo sapien
gtacatctgtgaaaaaatcatggat

SEQ ID NO: 90805 - DNA, 25 bp, Homo sapien
gcttctcttcagcagtaaatgggag

SEQ ID NO: 90806 - DNA, 25 bp, Homo sapien
gcagaaagaaatcaaacagctccca

SEQ ID NO: 90807 - DNA, 25 bp, Homo sapien
ccagatctgcctgcagagctaaaat

SEQ ID NO: 90808 - DNA, 25 bp, Homo sapien
ggagagagccactgctaagcagcag

SEQ ID NO: 90809 - DNA, 25 bp, Homo sapien
cagcttcccactaaattacaacctt

SEQ ID NO: 90810 - DNA, 25 bp, Homo sapien
aattacaaccttgggctggtatgct

SEQ ID NO: 90811 - DNA, 25 bp, Homo sapien
gtatgctttatgttattgccctcag

SEQ ID NO: 90812 - DNA, 25 bp, Homo sapien
tatgttattgccctcagaattgatg

SEQ ID NO: 90813 - DNA, 25 bp, Homo sapien
ttgccctcagaattgatgggtgaag

SEQ ID NO: 90814 - DNA, 25 bp, Homo sapien
ctgaagagtcatgagcaggctccat

SEQ ID NO: 90815 - DNA, 25 bp, Homo sapien
agcaggctccattaaagctcttttc

SEQ ID NO: 90816 - DNA, 25 bp, Homo sapien
aaatgacaagtaaatattcttctct

SEQ ID NO: 90817 - DNA, 25 bp, Homo sapien
ttctctctttttgagtctgtgtcat

SEQ ID NO: 90818 - DNA, 25 bp, Homo sapien
gagtctgtgtcatattcagcactgt

SEQ ID NO: 90819 - DNA, 25 bp, Homo sapien
tattcagcactgtgaacccttacca

SEQ ID NO: 90820 - DNA, 25 bp, Homo sapien
gtgaacccttaccagcaagtgacta

SEQ ID NO: 90821 - DNA, 25 bp, Homo sapien
gcaagtgactatttttgagttacag

SEQ ID NO: 90822 - DNA, 25 bp, Homo sapien
gccatgtggctaaagaaagctcctt

SEQ ID NO: 90823 - DNA, 25 bp, Homo sapien
ggctaaagaaagctccttaactagg

SEQ ID NO: 90824 - DNA, 25 bp, Homo sapien
ccttaactaggacatatgggaagca

SEQ ID NO: 90825 - DNA, 25 bp, Homo sapien
attctacattctttcacattctttg

SEQ ID NO: 90826 - DNA, 25 bp, Homo sapien
gtgttgaaataaacttctagcttat

SEQ ID NO: 90827 - DNA, 25 bp, Homo sapien
ggcaggggctgctatcacgtcacca

SEQ ID NO: 90828 - DNA, 25 bp, Homo sapien
aggggctgctatcacgtcaccagca

SEQ ID NO: 90829 - DNA, 25 bp, Homo sapien
ggggctgctatcacgtcaccagcag

SEQ ID NO: 90830 - DNA, 25 bp, Homo sapien
ccaaagcgggctgcaggaactcggc

SEQ ID NO: 90831 - DNA, 25 bp, Homo sapien
caaagcgggctgcaggaactcggct

SEQ ID NO: 90832 - DNA, 25 bp, Homo sapien
aaagcgggctgcaggaactcggctg

SEQ ID NO: 90833 - DNA, 25 bp, Homo sapien
aagcgggctgcaggaactcggctgg

SEQ ID NO: 90834 - DNA, 25 bp, Homo sapien
agcgggctgcaggaactcggctggg

SEQ ID NO: 90835 - DNA, 25 bp, Homo sapien
aggaactcggctggggcacctgagg

SEQ ID NO: 90836 - DNA, 25 bp, Homo sapien
aggccccacattagcacaagcccag

SEQ ID NO: 90837 - DNA, 25 bp, Homo sapien
ccccacattagcacaagcccaggca

SEQ ID NO: 90838 - DNA, 25 bp, Homo sapien
tcaaaacagaccacttgactctctg

SEQ ID NO: 90839 - DNA, 25 bp, Homo sapien
caaaacagaccacttgactctctgt

SEQ ID NO: 90840 - DNA, 25 bp, Homo sapien
aaaacagaccacttgactctctgta

SEQ ID NO: 90841 - DNA, 25 bp, Homo sapien
aaacagaccacttgactctctgtaa

SEQ ID NO: 90842 - DNA, 25 bp, Homo sapien
aacagaccacttgactctctgtaaa

SEQ ID NO: 90843 - DNA, 25 bp, Homo sapien
acagaccacttgactctctgtaaaa

SEQ ID NO: 90844 - DNA, 25 bp, Homo sapien
cagaccacttgactctctgtaaaat

SEQ ID NO: 90845 - DNA, 25 bp, Homo sapien
agaccacttgactctctgtaaaatg

SEQ ID NO: 90846 - DNA, 25 bp, Homo sapien
gaccacttgactctctgtaaaatgg

SEQ ID NO: 90847 - DNA, 25 bp, Homo sapien
accacttgactctctgtaaaatgga

SEQ ID NO: 90848 - DNA, 25 bp, Homo sapien
ccacttgactctctgtaaaatggac

SEQ ID NO: 90849 - DNA, 25 bp, Homo sapien
ggatttaaaagggtggctcactccg

SEQ ID NO: 90850 - DNA, 25 bp, Homo sapien
gatttaaaagggtggctcactccgt

SEQ ID NO: 90851 - DNA, 25 bp, Homo sapien
ggctcactccgtaattccggcactt

SEQ ID NO: 90852 - DNA, 25 bp, Homo sapien
cccagaagtttcagactaggctggg

SEQ ID NO: 90853 - DNA, 25 bp, Homo sapien
agtttcagactaggctgggcaacaa

SEQ ID NO: 90854 - DNA, 25 bp, Homo sapien
tggtggtgtgctcctatagctccag

SEQ ID NO: 90855 - DNA, 25 bp, Homo sapien
ggtggtgtgctcctatagctccagc

SEQ ID NO: 90856 - DNA, 25 bp, Homo sapien
ggtgtgctcctatagctccagctac

SEQ ID NO: 90857 - DNA, 25 bp, Homo sapien
gtgtgctcctatagctccagctact

SEQ ID NO: 90858 - DNA, 25 bp, Homo sapien
tgtgctcctatagctccagctactc

SEQ ID NO: 90859 - DNA, 25 bp, Homo sapien
gtgctcctatagctccagctactca

SEQ ID NO: 90860 - DNA, 25 bp, Homo sapien
gaggtgataaacaactttgcagcat

SEQ ID NO: 90861 - DNA, 25 bp, Homo sapien
aacaactttgcagcattaatgtaac

SEQ ID NO: 90862 - DNA, 25 bp, Homo sapien
caaaaagtttcagtatttgtcagga

SEQ ID NO: 90863 - DNA, 25 bp, Homo sapien
aaagctattctattttggtaagttg

SEQ ID NO: 90864 - DNA, 25 bp, Homo sapien
gtaagagtgcattaaatcaaataca

SEQ ID NO: 90865 - DNA, 25 bp, Homo sapien
aaattggtttttcaatgcatcatta

SEQ ID NO: 90866 - DNA, 25 bp, Homo sapien
ggtttttcaatgcatcattatttat

SEQ ID NO: 90867 - DNA, 25 bp, Homo sapien
tgccataacaaattgtttggtccaa

SEQ ID NO: 90868 - DNA, 25 bp, Homo sapien
tgtttggtccaaaatgaaagctata

SEQ ID NO: 90869 - DNA, 25 bp, Homo sapien
agctatattcagaaggtttgcacct

SEQ ID NO: 90870 - DNA, 25 bp, Homo sapien
gaaggtttgcacctcaaaattgagt

SEQ ID NO: 90871 - DNA, 25 bp, Homo sapien
ggtgctgttatacattgaccaggct

SEQ ID NO: 90872 - DNA, 25 bp, Homo sapien
attgaccaggcttaagaatatctct

SEQ ID NO: 90873 - DNA, 25 bp, Homo sapien
gaatatctctttaaagtgtgtcgac

SEQ ID NO: 90874 - DNA, 25 bp, Homo sapien
gtgtgtcgacatttaattgaccttt

SEQ ID NO: 90875 - DNA, 25 bp, Homo sapien
attgacctttggaagttcattctgt

SEQ ID NO: 90876 - DNA, 25 bp, Homo sapien
gttcattctgttaatcatactcaaa

SEQ ID NO: 90877 - DNA, 25 bp, Homo sapien
aagctatggttgactgctctggtgt

SEQ ID NO: 90878 - DNA, 25 bp, Homo sapien
ggttgactgctctggtgtttttata

SEQ ID NO: 90879 - DNA, 25 bp, Homo sapien
ttatattcattcgtgctttagcata

SEQ ID NO: 90880 - DNA, 25 bp, Homo sapien
gttgtgcttgtatttttgtgtcttt

SEQ ID NO: 90881 - DNA, 25 bp, Homo sapien
ttaaactttgcttcaggctgggtag

SEQ ID NO: 90882 - DNA, 25 bp, Homo sapien
tgaatctgcatgtgctgtttggatc

SEQ ID NO: 90883 - DNA, 25 bp, Homo sapien
gaatctgcatgtgctgtttggatca

SEQ ID NO: 90884 - DNA, 25 bp, Homo sapien
tattttaaaatcacaatctggcttg

SEQ ID NO: 90885 - DNA, 25 bp, Homo sapien
aaaatcacaatctggcttgaatggc

SEQ ID NO: 90886 - DNA, 25 bp, Homo sapien
atcacaatctggcttgaatggcata

SEQ ID NO: 90887 - DNA, 25 bp, Homo sapien
cacaatctggcttgaatggcatact

SEQ ID NO: 90888 - DNA, 25 bp, Homo sapien
caatctggcttgaatggcatacttc

SEQ ID NO: 90889 - DNA, 25 bp, Homo sapien
aatctggcttgaatggcatacttca

SEQ ID NO: 90890 - DNA, 25 bp, Homo sapien
tctggcttgaatggcatacttcaat

SEQ ID NO: 90891 - DNA, 25 bp, Homo sapien
ggcttgaatggcatacttcaatttt

SEQ ID NO: 90892 - DNA, 25 bp, Homo sapien
cttgaatggcatacttcaattttgt

SEQ ID NO: 90893 - DNA, 25 bp, Homo sapien
ggaccgcaggcacacatcactgtgc

SEQ ID NO: 90894 - DNA, 25 bp, Homo sapien
caggctggttgaactcccgtgagct

SEQ ID NO: 90895 - DNA, 25 bp, Homo sapien
gctggttgaactcccgtgagctcaa

SEQ ID NO: 90896 - DNA, 25 bp, Homo sapien
tggttgaactcccgtgagctcaagt

SEQ ID NO: 90897 - DNA, 25 bp, Homo sapien
cagtgcctggcctgattcatgattg

SEQ ID NO: 90898 - DNA, 25 bp, Homo sapien
gtgcctggcctgattcatgattgaa

SEQ ID NO: 90899 - DNA, 25 bp, Homo sapien
gcctggcctgattcatgattgaagt

SEQ ID NO: 90900 - DNA, 25 bp, Homo sapien
gcctgattcatgattgaagtaccat

SEQ ID NO: 90901 - DNA, 25 bp, Homo sapien
catgattgaagtaccattaccataa

SEQ ID NO: 90902 - DNA, 25 bp, Homo sapien
gaagtaccattaccataaatgctat

SEQ ID NO: 90903 - DNA, 25 bp, Homo sapien
gtaccattaccataaatgctataca

SEQ ID NO: 90904 - DNA, 25 bp, Homo sapien
gccttacggacatccttttgaatta

SEQ ID NO: 90905 - DNA, 25 bp, Homo sapien
tacggacatccttttgaattatctt

SEQ ID NO: 90906 - DNA, 25 bp, Homo sapien
cggacatccttttgaattatctttt

SEQ ID NO: 90907 - DNA, 25 bp, Homo sapien
atctttttcactcatagaatatgaa

SEQ ID NO: 90908 - DNA, 25 bp, Homo sapien
tagactttttctagaactttcctgt

SEQ ID NO: 90909 - DNA, 25 bp, Homo sapien
ttttctagaactttcctgttttcat

SEQ ID NO: 90910 - DNA, 25 bp, Homo sapien
tcatgtctttgcttcatctggaatt

SEQ ID NO: 90911 - DNA, 25 bp, Homo sapien
cttcatctggaattggcttaacacc

SEQ ID NO: 90912 - DNA, 25 bp, Homo sapien
tgtaaaatttccattgtgacatcaa

SEQ ID NO: 90913 - DNA, 25 bp, Homo sapien
atttccattgtgacatcaatacgca

SEQ ID NO: 90914 - DNA, 25 bp, Homo sapien
gtgacatcaatacgcaatatatttt

SEQ ID NO: 90915 - DNA, 25 bp, Homo sapien
gcccacgaatggcatcccaacagag

SEQ ID NO: 90916 - DNA, 25 bp, Homo sapien
cccacgaatggcatcccaacagagt

SEQ ID NO: 90917 - DNA, 25 bp, Homo sapien
ccacgaatggcatcccaacagagtt

SEQ ID NO: 90918 - DNA, 25 bp, Homo sapien
cacgaatggcatcccaacagagtta

SEQ ID NO: 90919 - DNA, 25 bp, Homo sapien
cgaatggcatcccaacagagttaaa

SEQ ID NO: 90920 - DNA, 25 bp, Homo sapien
gaatggcatcccaacagagttaaag

SEQ ID NO: 90921 - DNA, 25 bp, Homo sapien
aatggcatcccaacagagttaaaga

SEQ ID NO: 90922 - DNA, 25 bp, Homo sapien
atggcatcccaacagagttaaagaa

SEQ ID NO: 90923 - DNA, 25 bp, Homo sapien
acagagttaaagaaactgcttgcag

SEQ ID NO: 90924 - DNA, 25 bp, Homo sapien
cagagttaaagaaactgcttgcagg

SEQ ID NO: 90925 - DNA, 25 bp, Homo sapien
agagttaaagaaactgcttgcaggg

SEQ ID NO: 90926 - DNA, 25 bp, Homo sapien
cctttgatcatttcctggccaccat

SEQ ID NO: 90927 - DNA, 25 bp, Homo sapien
ggctcagatgtgtcttgtgcccacc

SEQ ID NO: 90928 - DNA, 25 bp, Homo sapien
cttgtgcccacctcttcctgagaag

SEQ ID NO: 90929 - DNA, 25 bp, Homo sapien
ggaagtggagctgtgactagtacaa

SEQ ID NO: 90930 - DNA, 25 bp, Homo sapien
tgtgactagtacaagcagcccaaga

SEQ ID NO: 90931 - DNA, 25 bp, Homo sapien
aactctgaacgggacccaatggagg

SEQ ID NO: 90932 - DNA, 25 bp, Homo sapien
acccaatggaggcaaacttgagcaa

SEQ ID NO: 90933 - DNA, 25 bp, Homo sapien
taatcccaactgtttgaaagttcga

SEQ ID NO: 90934 - DNA, 25 bp, Homo sapien
agaggggcattcttttctggtacat

SEQ ID NO: 90935 - DNA, 25 bp, Homo sapien
gtacatggtgagagttcaggctcca

SEQ ID NO: 90936 - DNA, 25 bp, Homo sapien
ccagagactcaaaacggaatggttt

SEQ ID NO: 90937 - DNA, 25 bp, Homo sapien
ttttcactccagtttaatctgtgat

SEQ ID NO: 90938 - DNA, 25 bp, Homo sapien
atctgtgatacagggctctgtttta

SEQ ID NO: 90939 - DNA, 25 bp, Homo sapien
tgctctttaagcctcaaggtcagag

SEQ ID NO: 90940 - DNA, 25 bp, Homo sapien
gagacttagtctcctggctgaacag

SEQ ID NO: 90941 - DNA, 25 bp, Homo sapien
gtctcctggctgaacagagtgccat

SEQ ID NO: 90942 - DNA, 25 bp, Homo sapien
agagtgccatagtctgtgaccctgt

SEQ ID NO: 90943 - DNA, 25 bp, Homo sapien
gtgaccctgtatgatcctagtagca

SEQ ID NO: 90944 - DNA, 25 bp, Homo sapien
attttggacttatctggtgcctttc

SEQ ID NO: 90945 - DNA, 25 bp, Homo sapien
gctcagagtacttttatgcaattta

SEQ ID NO: 90946 - DNA, 25 bp, Homo sapien
atgcaatttactgactttaaggaaa

SEQ ID NO: 90947 - DNA, 25 bp, Homo sapien
ttagcattttatggcattgtctcct

SEQ ID NO: 90948 - DNA, 25 bp, Homo sapien
tgaatgcttcttgctaaccaggccg

SEQ ID NO: 90949 - DNA, 25 bp, Homo sapien
ttcttgctaaccaggccgagaggcc

SEQ ID NO: 90950 - DNA, 25 bp, Homo sapien
atccccacaaaccaggtaatgccag

SEQ ID NO: 90951 - DNA, 25 bp, Homo sapien
gtttgccagcagctatttgcctata

SEQ ID NO: 90952 - DNA, 25 bp, Homo sapien
ttgcctatagagatgagtctgtcct

SEQ ID NO: 90953 - DNA, 25 bp, Homo sapien
gagtctgtcctggtcataactgtgt

SEQ ID NO: 90954 - DNA, 25 bp, Homo sapien
gtcctggtcataactgtgtgctcaa

SEQ ID NO: 90955 - DNA, 25 bp, Homo sapien
gtgtgctcaaggtgtccaggctttt

SEQ ID NO: 90956 - DNA, 25 bp, Homo sapien
gggcctatctgggtgcattatggat

SEQ ID NO: 90957 - DNA, 25 bp, Homo sapien
gttagactttgggaagccaccttca

SEQ ID NO: 90958 - DNA, 25 bp, Homo sapien
gaagccaccttcaatgttttctgga

SEQ ID NO: 90959 - DNA, 25 bp, Homo sapien
agaaaaaaacgtgcgctgcctgggt

SEQ ID NO: 90960 - DNA, 25 bp, Homo sapien
aaaaaacgtgcgctgcctgggtgtg

SEQ ID NO: 90961 - DNA, 25 bp, Homo sapien
aaaaacgtgcgctgcctgggtgtgg

SEQ ID NO: 90962 - DNA, 25 bp, Homo sapien
aaaacgtgcgctgcctgggtgtggt

SEQ ID NO: 90963 - DNA, 25 bp, Homo sapien
aggccaaggtgtgtgaatcattcga

SEQ ID NO: 90964 - DNA, 25 bp, Homo sapien
ggccaaggtgtgtgaatcattcgag

SEQ ID NO: 90965 - DNA, 25 bp, Homo sapien
gccaaggtgtgtgaatcattcgagg

SEQ ID NO: 90966 - DNA, 25 bp, Homo sapien
ccaaggtgtgtgaatcattcgaggt

SEQ ID NO: 90967 - DNA, 25 bp, Homo sapien
caaggtgtgtgaatcattcgaggtc

SEQ ID NO: 90968 - DNA, 25 bp, Homo sapien
aaggtgtgtgaatcattcgaggtca

SEQ ID NO: 90969 - DNA, 25 bp, Homo sapien
gtgtgtgaatcattcgaggtcagga

SEQ ID NO: 90970 - DNA, 25 bp, Homo sapien
aggctcaactattggaatacatcta

SEQ ID NO: 90971 - DNA, 25 bp, Homo sapien
ggaatacatctaccatgtctcctat

SEQ ID NO: 90972 - DNA, 25 bp, Homo sapien
ctaccatgtctcctatgaaacttgc

SEQ ID NO: 90973 - DNA, 25 bp, Homo sapien
ttctccaggccaatcatccttactt

SEQ ID NO: 90974 - DNA, 25 bp, Homo sapien
caggccaatcatccttacttcctta

SEQ ID NO: 90975 - DNA, 25 bp, Homo sapien
ccatgcccattccacaaatacaagt

SEQ ID NO: 90976 - DNA, 25 bp, Homo sapien
aaactacatctatttggtgatcatt

SEQ ID NO: 90977 - DNA, 25 bp, Homo sapien
taatgtcttatgtttcctcccagat

SEQ ID NO: 90978 - DNA, 25 bp, Homo sapien
tatgtttcctcccagattgttttct

SEQ ID NO: 90979 - DNA, 25 bp, Homo sapien
gttttctgcatgaataataaccaac

SEQ ID NO: 90980 - DNA, 25 bp, Homo sapien
gaataataaccaacaatgtgtgtgt

SEQ ID NO: 90981 - DNA, 25 bp, Homo sapien
actaatggccttcactgcgtcgcag

SEQ ID NO: 90982 - DNA, 25 bp, Homo sapien
ttccctacggacttctttgaagctc

SEQ ID NO: 90983 - DNA, 25 bp, Homo sapien
tcttccttttgcacatacggctttt

SEQ ID NO: 90984 - DNA, 25 bp, Homo sapien
tttttgtcctattacctcctctgag

SEQ ID NO: 90985 - DNA, 25 bp, Homo sapien
tcctctgagcgcaaatcactggcta

SEQ ID NO: 90986 - DNA, 25 bp, Homo sapien
gcaaatcactggctacaagggactt

SEQ ID NO: 90987 - DNA, 25 bp, Homo sapien
acaagggacttaccagtctggattc

SEQ ID NO: 90988 - DNA, 25 bp, Homo sapien
gtctggattcagcagtttcttttct

SEQ ID NO: 90989 - DNA, 25 bp, Homo sapien
atttgggtgactcagcagccgcatc

SEQ ID NO: 90990 - DNA, 25 bp, Homo sapien
gcatctgctacctgattttatcctg

SEQ ID NO: 90991 - DNA, 25 bp, Homo sapien
cagtgcaatatttctctttgattat

SEQ ID NO: 90992 - DNA, 25 bp, Homo sapien
actgcgaatcagtggcgatcatgtg

SEQ ID NO: 90993 - DNA, 25 bp, Homo sapien
atcagtggcgatcatgtgatttcta

SEQ ID NO: 90994 - DNA, 25 bp, Homo sapien
tcatgtgatttctatttctgcccca

SEQ ID NO: 90995 - DNA, 25 bp, Homo sapien
tgatttctatttctgccccacaggg

SEQ ID NO: 90996 - DNA, 25 bp, Homo sapien
tatttctgccccacagggtaaggga

SEQ ID NO: 90997 - DNA, 25 bp, Homo sapien
ttctgccccacagggtaagggacga

SEQ ID NO: 90998 - DNA, 25 bp, Homo sapien
aagggacgagtcttctggaaggctc

SEQ ID NO: 90999 - DNA, 25 bp, Homo sapien
gagtcttctggaaggctctgccatg

SEQ ID NO: 91000 - DNA, 25 bp, Homo sapien
tctggaaggctctgccatggacatt

SEQ ID NO: 91001 - DNA, 25 bp, Homo sapien
aaggctctgccatggacatttgtcc

SEQ ID NO: 91002 - DNA, 25 bp, Homo sapien
tggacatttgtcctcgggctcagag

SEQ ID NO: 91003 - DNA, 25 bp, Homo sapien
agatgctttgaggagcattcctcta

SEQ ID NO: 91004 - DNA, 25 bp, Homo sapien
ggagcattcctctagattgcacaag

SEQ ID NO: 91005 - DNA, 25 bp, Homo sapien
gggacagtgcctttaaccaagcgag

SEQ ID NO: 91006 - DNA, 25 bp, Homo sapien
tttaaccaagcgaggagtccaaagc

SEQ ID NO: 91007 - DNA, 25 bp, Homo sapien
ggagtccaaagctcaggacctgact

SEQ ID NO: 91008 - DNA, 25 bp, Homo sapien
aggacctgactaccctgagggcacg

SEQ ID NO: 91009 - DNA, 25 bp, Homo sapien
tggcatctcctcatcacgttctgtg

SEQ ID NO: 91010 - DNA, 25 bp, Homo sapien
acgttctgtgccgtccttgggaaag

SEQ ID NO: 91011 - DNA, 25 bp, Homo sapien
cttgggaaaggcctgcattctgatc

SEQ ID NO: 91012 - DNA, 25 bp, Homo sapien
aggcctgcattctgatccttccagg

SEQ ID NO: 91013 - DNA, 25 bp, Homo sapien
cttccaggcccttcgagcatggagg

SEQ ID NO: 91014 - DNA, 25 bp, Homo sapien
tgccactgcgcattttcagaaaaaa

SEQ ID NO: 91015 - DNA, 25 bp, Homo sapien
tgaatggatgtttgttcctcctgat

SEQ ID NO: 91016 - DNA, 25 bp, Homo sapien
ttctcttttctcttcgtggcgactt

SEQ ID NO: 91017 - DNA, 25 bp, Homo sapien
ttttctcttcgtggcgacttagagt

SEQ ID NO: 91018 - DNA, 25 bp, Homo sapien
ggcgacttagagttggcggatattc

SEQ ID NO: 91019 - DNA, 25 bp, Homo sapien
agagttggcggatattcggaactgt

SEQ ID NO: 91020 - DNA, 25 bp, Homo sapien
tcggaactgtgaatgtacatagcgt

SEQ ID NO: 91021 - DNA, 25 bp, Homo sapien
gtacatagcgttgagttaaacccct

SEQ ID NO: 91022 - DNA, 25 bp, Homo sapien
gcgttgagttaaaccccttgtgtgt

SEQ ID NO: 91023 - DNA, 25 bp, Homo sapien
gttaaaccccttgtgtgtgagacag

SEQ ID NO: 91024 - DNA, 25 bp, Homo sapien
gtgtgagacaggacgcagcgggccc

SEQ ID NO: 91025 - DNA, 25 bp, Homo sapien
ttagttaagagatttgtagtaggca

SEQ ID NO: 91026 - DNA, 25 bp, Homo sapien
gttaagagatttgtagtaggcattt

SEQ ID NO: 91027 - DNA, 25 bp, Homo sapien
ttaagagatttgtagtaggcatttt

SEQ ID NO: 91028 - DNA, 25 bp, Homo sapien
gtaggcattttttagaaagttgcat

SEQ ID NO: 91029 - DNA, 25 bp, Homo sapien
tagaaagttgcattgagggctaggt

SEQ ID NO: 91030 - DNA, 25 bp, Homo sapien
agaaagttgcattgagggctaggta

SEQ ID NO: 91031 - DNA, 25 bp, Homo sapien
gaaagttgcattgagggctaggtac

SEQ ID NO: 91032 - DNA, 25 bp, Homo sapien
aaagttgcattgagggctaggtacg

SEQ ID NO: 91033 - DNA, 25 bp, Homo sapien
tgcattgagggctaggtacggtggc

SEQ ID NO: 91034 - DNA, 25 bp, Homo sapien
cattgagggctaggtacggtggctc

SEQ ID NO: 91035 - DNA, 25 bp, Homo sapien
attgagggctaggtacggtggctca

SEQ ID NO: 91036 - DNA, 25 bp, Homo sapien
tgttgcccagattgttccccacaaa

SEQ ID NO: 91037 - DNA, 25 bp, Homo sapien
gttgcccagattgttccccacaaaa

SEQ ID NO: 91038 - DNA, 25 bp, Homo sapien
ttgcccagattgttccccacaaaat

SEQ ID NO: 91039 - DNA, 25 bp, Homo sapien
tgcccagattgttccccacaaaatc

SEQ ID NO: 91040 - DNA, 25 bp, Homo sapien
gcccagattgttccccacaaaatca

SEQ ID NO: 91041 - DNA, 25 bp, Homo sapien
cagattgttccccacaaaatcacaa

SEQ ID NO: 91042 - DNA, 25 bp, Homo sapien
gattgttccccacaaaatcacaaaa

SEQ ID NO: 91043 - DNA, 25 bp, Homo sapien
ttgttccccacaaaatcacaaaaga

SEQ ID NO: 91044 - DNA, 25 bp, Homo sapien
gttaagaggttcctggccggacgcg

SEQ ID NO: 91045 - DNA, 25 bp, Homo sapien
taagaggttcctggccggacgcggt

SEQ ID NO: 91046 - DNA, 25 bp, Homo sapien
ggttcctggccggacgcggtgactc

SEQ ID NO: 91047 - DNA, 25 bp, Homo sapien
gatcatgctacactctcaaaagaaa

SEQ ID NO: 91048 - DNA, 25 bp, Homo sapien
catgctacactctcaaaagaaaatt

SEQ ID NO: 91049 - DNA, 25 bp, Homo sapien
aaatcattcagatcatccccccttt

SEQ ID NO: 91050 - DNA, 25 bp, Homo sapien
ccctttttaagtagtgtgaattgca

SEQ ID NO: 91051 - DNA, 25 bp, Homo sapien
tttactgtcagttgcggtttattta

SEQ ID NO: 91052 - DNA, 25 bp, Homo sapien
ctgtcagttgcggtttatttattct

SEQ ID NO: 91053 - DNA, 25 bp, Homo sapien
tcagttgcggtttatttattcttta

SEQ ID NO: 91054 - DNA, 25 bp, Homo sapien
gtatctgtgtgtgatttgctattta

SEQ ID NO: 91055 - DNA, 25 bp, Homo sapien
tctgtgtgtgatttgctatttatta

SEQ ID NO: 91056 - DNA, 25 bp, Homo sapien
aaagcatgtttgaagtcttgtgtat

SEQ ID NO: 91057 - DNA, 25 bp, Homo sapien
tgaagtcttgtgtatttgtctgtgt

SEQ ID NO: 91058 - DNA, 25 bp, Homo sapien
atccaggcagagctccgcatcaggg

SEQ ID NO: 91059 - DNA, 25 bp, Homo sapien
cgcatcagggaaggctcaggttact

SEQ ID NO: 91060 - DNA, 25 bp, Homo sapien
aggttacttcttcctcaacaccagc

SEQ ID NO: 91061 - DNA, 25 bp, Homo sapien
caccagcaccgcagatgttgtcaag

SEQ ID NO: 91062 - DNA, 25 bp, Homo sapien
gtgtcgccatggtaagcttgggcca

SEQ ID NO: 91063 - DNA, 25 bp, Homo sapien
tgggccatcggtccccactgttggt

SEQ ID NO: 91064 - DNA, 25 bp, Homo sapien
ttcattccttatctgggctgttgtg

SEQ ID NO: 91065 - DNA, 25 bp, Homo sapien
ggctgttgtgtggttaattgattga

SEQ ID NO: 91066 - DNA, 25 bp, Homo sapien
gattgatcattttgaaagctagcac

SEQ ID NO: 91067 - DNA, 25 bp, Homo sapien
gaaagctagcacttgactcacactc

SEQ ID NO: 91068 - DNA, 25 bp, Homo sapien
ttgactcacactcggaatcccagaa

SEQ ID NO: 91069 - DNA, 25 bp, Homo sapien
tggatttaaaagggtggctcactcc

SEQ ID NO: 91070 - DNA, 25 bp, Homo sapien
ggatttaaaagggtggctcactccg

SEQ ID NO: 91071 - DNA, 25 bp, Homo sapien
gatttaaaagggtggctcactccgt

SEQ ID NO: 91072 - DNA, 25 bp, Homo sapien
ggctcactccgtaattccggcactt

SEQ ID NO: 91073 - DNA, 25 bp, Homo sapien
tggtggtgtgctcctatagctccag

SEQ ID NO: 91074 - DNA, 25 bp, Homo sapien
ggtggtgtgctcctatagctccagc

SEQ ID NO: 91075 - DNA, 25 bp, Homo sapien
ggtgtgctcctatagctccagctac

SEQ ID NO: 91076 - DNA, 25 bp, Homo sapien
gtgtgctcctatagctccagctact

SEQ ID NO: 91077 - DNA, 25 bp, Homo sapien
tgtgctcctatagctccagctactc

SEQ ID NO: 91078 - DNA, 25 bp, Homo sapien
aattcacttgtagcctggaagcttc

SEQ ID NO: 91079 - DNA, 25 bp, Homo sapien
ttcacttgtagcctggaagcttccc

SEQ ID NO: 91080 - DNA, 25 bp, Homo sapien
tcacttgtagcctggaagcttccct

SEQ ID NO: 91081 - DNA, 25 bp, Homo sapien
cacttgtagcctggaagcttccctc

SEQ ID NO: 91082 - DNA, 25 bp, Homo sapien
acttgtagcctggaagcttccctcc

SEQ ID NO: 91083 - DNA, 25 bp, Homo sapien
cttgtagcctggaagcttccctccc

SEQ ID NO: 91084 - DNA, 25 bp, Homo sapien
gtagcctggaagcttccctcccctg

SEQ ID NO: 91085 - DNA, 25 bp, Homo sapien
tcccctgctccgacctttgagttgt

SEQ ID NO: 91086 - DNA, 25 bp, Homo sapien
cccctgctccgacctttgagttgtc

SEQ ID NO: 91087 - DNA, 25 bp, Homo sapien
ccctgctccgacctttgagttgtcc

SEQ ID NO: 91088 - DNA, 25 bp, Homo sapien
ctgctccgacctttgagttgtcccg

SEQ ID NO: 91089 - DNA, 25 bp, Homo sapien
gacatccttgatctacatatttaac

SEQ ID NO: 91090 - DNA, 25 bp, Homo sapien
ggcatatacatgcataaaccatctt

SEQ ID NO: 91091 - DNA, 25 bp, Homo sapien
gtaacagtcatatcaggcatcatcg

SEQ ID NO: 91092 - DNA, 25 bp, Homo sapien
gtcatatcaggcatcatcgattttt

SEQ ID NO: 91093 - DNA, 25 bp, Homo sapien
aggcatcatcgatttttcttttctt

SEQ ID NO: 91094 - DNA, 25 bp, Homo sapien
tttcttttcttagctcctgtattct

SEQ ID NO: 91095 - DNA, 25 bp, Homo sapien
tagctcctgtattcttagaaccaga

SEQ ID NO: 91096 - DNA, 25 bp, Homo sapien
accagattgctgaagcatgtttgca

SEQ ID NO: 91097 - DNA, 25 bp, Homo sapien
ttttcctccatctttttatcacctt

SEQ ID NO: 91098 - DNA, 25 bp, Homo sapien
tccatctttttatcaccttgttcag

SEQ ID NO: 91099 - DNA, 25 bp, Homo sapien
ttttatcaccttgttcagaatgaca

SEQ ID NO: 91100 - DNA, 25 bp, Homo sapien
acagaatatctctttatccttgatt

SEQ ID NO: 91101 - DNA, 25 bp, Homo sapien
atccttgatttaccaaatagctccc

SEQ ID NO: 91102 - DNA, 25 bp, Homo sapien
aatagctcccaatatctggctttgc

SEQ ID NO: 91103 - DNA, 25 bp, Homo sapien
gctttgcctttcatatcattccata

SEQ ID NO: 91104 - DNA, 25 bp, Homo sapien
atcattccatacctagacttttccc

SEQ ID NO: 91105 - DNA, 25 bp, Homo sapien
tagacttttccctgtggttcttcat

SEQ ID NO: 91106 - DNA, 25 bp, Homo sapien
gtggttcttcattctcagagtagtt

SEQ ID NO: 91107 - DNA, 25 bp, Homo sapien
gtagtttttgtcacatacacataca

SEQ ID NO: 91108 - DNA, 25 bp, Homo sapien
aataaatctcattggaccttccctc

SEQ ID NO: 91109 - DNA, 25 bp, Homo sapien
gccctgatccggaattggcagatat

SEQ ID NO: 91110 - DNA, 25 bp, Homo sapien
tgttattgctgggttttgaccccaa

SEQ ID NO: 91111 - DNA, 25 bp, Homo sapien
ggaggtatcctcattagttctttct

SEQ ID NO: 91112 - DNA, 25 bp, Homo sapien
cattagttctttcttcaggcttgtg

SEQ ID NO: 91113 - DNA, 25 bp, Homo sapien
aggcttgtgtctttagttgcgtggc

SEQ ID NO: 91114 - DNA, 25 bp, Homo sapien
tgtgtctttagttgcgtggctgcgc

SEQ ID NO: 91115 - DNA, 25 bp, Homo sapien
ggctgcgcaggcctgccatatgatt

SEQ ID NO: 91116 - DNA, 25 bp, Homo sapien
gcctgccatatgatttaagccatct

SEQ ID NO: 91117 - DNA, 25 bp, Homo sapien
taagccatctcttttcattaaatgt

SEQ ID NO: 91118 - DNA, 25 bp, Homo sapien
gtttctcttcctgtgagacttacta

SEQ ID NO: 91119 - DNA, 25 bp, Homo sapien
gacaatgagctgaatatatggtttt

SEQ ID NO: 91120 - DNA, 25 bp, Homo sapien
gtagacatccacttgcaaaatgttt

SEQ ID NO: 91121 - DNA, 25 bp, Homo sapien
gatgtaatgttaaagcgcaatgtgc

SEQ ID NO: 91122 - DNA, 25 bp, Homo sapien
gattgatttcaagtaccatactgta

SEQ ID NO: 91123 - DNA, 25 bp, Homo sapien
tgtagtacagataagtggctcagtt

SEQ ID NO: 91124 - DNA, 25 bp, Homo sapien
ggctcagttgagcacagctatattt

SEQ ID NO: 91125 - DNA, 25 bp, Homo sapien
tgagcacagctatattttaacatct

SEQ ID NO: 91126 - DNA, 25 bp, Homo sapien
ttttaacatctctttgttcccctag

SEQ ID NO: 91127 - DNA, 25 bp, Homo sapien
catctctttgttcccctagtttagt

SEQ ID NO: 91128 - DNA, 25 bp, Homo sapien
ctagtttagtaaattgacccagagg

SEQ ID NO: 91129 - DNA, 25 bp, Homo sapien
agtaaattgacccagaggtgaccat

SEQ ID NO: 91130 - DNA, 25 bp, Homo sapien
ccagaggtgaccatttgtaaaaaat

SEQ ID NO: 91131 - DNA, 25 bp, Homo sapien
acgtttagtttttcttgtgatacat

SEQ ID NO: 91132 - DNA, 25 bp, Homo sapien
gatacattttgttaacctgtgtaaa

SEQ ID NO: 91133 - DNA, 25 bp, Homo sapien
gtcctggaggttgttatgacacaaa

SEQ ID NO: 91134 - DNA, 25 bp, Homo sapien
gtggcagatatctacctagcatctc

SEQ ID NO: 91135 - DNA, 25 bp, Homo sapien
ctagcatctcagtacacatcctatg

SEQ ID NO: 91136 - DNA, 25 bp, Homo sapien
atcctatgccataagtggtcccaca

SEQ ID NO: 91137 - DNA, 25 bp, Homo sapien
gtggtcccacagtacaaggtggcct

SEQ ID NO: 91138 - DNA, 25 bp, Homo sapien
gtggcctccctgtttttcgctggga

SEQ ID NO: 91139 - DNA, 25 bp, Homo sapien
gctgggaccgtttcaacaaaactct

SEQ ID NO: 91140 - DNA, 25 bp, Homo sapien
aactctacatcagggcatgccagag

SEQ ID NO: 91141 - DNA, 25 bp, Homo sapien
gggcatgccagaggtctacaacttt

SEQ ID NO: 91142 - DNA, 25 bp, Homo sapien
gataccaaaggcactattttagcta

SEQ ID NO: 91143 - DNA, 25 bp, Homo sapien
ttagctatgtttttcccatcagaat

SEQ ID NO: 91144 - DNA, 25 bp, Homo sapien
tctccctatcatgacggtgtagcca

SEQ ID NO: 91145 - DNA, 25 bp, Homo sapien
tagccaccatcctgttgtatactag

SEQ ID NO: 91146 - DNA, 25 bp, Homo sapien
taggagagaacttaacccacctggg

SEQ ID NO: 91147 - DNA, 25 bp, Homo sapien
aagagctggcaccagtaccactgat

SEQ ID NO: 91148 - DNA, 25 bp, Homo sapien
ggcaccagtaccactgatggccctg

SEQ ID NO: 91149 - DNA, 25 bp, Homo sapien
gccctgcttcctctgagtgagatgc

SEQ ID NO: 91150 - DNA, 25 bp, Homo sapien
ggacagggaccaggataccactctg

SEQ ID NO: 91151 - DNA, 25 bp, Homo sapien
aggataccactctgtcactgtgtga

SEQ ID NO: 91152 - DNA, 25 bp, Homo sapien
aagtcactaacccttggcctcattt

SEQ ID NO: 91153 - DNA, 25 bp, Homo sapien
tggcctcatttttcctgtcttgtga

SEQ ID NO: 91154 - DNA, 25 bp, Homo sapien
gacaataattcctacttctcaagat

SEQ ID NO: 91155 - DNA, 25 bp, Homo sapien
tccatagtgtggtttactcagagca

SEQ ID NO: 91156 - DNA, 25 bp, Homo sapien
ccatagtgtggtttactcagagcag

SEQ ID NO: 91157 - DNA, 25 bp, Homo sapien
atagtgtggtttactcagagcaggt

SEQ ID NO: 91158 - DNA, 25 bp, Homo sapien
agtgtggtttactcagagcaggtga

SEQ ID NO: 91159 - DNA, 25 bp, Homo sapien
gtggtttactcagagcaggtgacaa

SEQ ID NO: 91160 - DNA, 25 bp, Homo sapien
ggtttactcagagcaggtgacaaaa

SEQ ID NO: 91161 - DNA, 25 bp, Homo sapien
agcaggtgacaaaaggatgaatttc

SEQ ID NO: 91162 - DNA, 25 bp, Homo sapien
gttgcggtaagctgcgagcatgcca

SEQ ID NO: 91163 - DNA, 25 bp, Homo sapien
ttgcggtaagctgcgagcatgccac

SEQ ID NO: 91164 - DNA, 25 bp, Homo sapien
gcggtaagctgcgagcatgccactg

SEQ ID NO: 91165 - DNA, 25 bp, Homo sapien
ggtaagctgcgagcatgccactgta

SEQ ID NO: 91166 - DNA, 25 bp, Homo sapien
ttcaggcgggctttgctcttccaaa

SEQ ID NO: 91167 - DNA, 25 bp, Homo sapien
gggctttgctcttccaaaaatgtaa

SEQ ID NO: 91168 - DNA, 25 bp, Homo sapien
aagaacgcagattggacagaagccc

SEQ ID NO: 91169 - DNA, 25 bp, Homo sapien
gaagcccagtaaatgcgaaaaatgt

SEQ ID NO: 91170 - DNA, 25 bp, Homo sapien
cagttgtcccaaagcctttcaaggt

SEQ ID NO: 91171 - DNA, 25 bp, Homo sapien
cctttcaaggtcatgtgagaagtca

SEQ ID NO: 91172 - DNA, 25 bp, Homo sapien
ggaaagaaatcctgtacatctaagt

SEQ ID NO: 91173 - DNA, 25 bp, Homo sapien
aaatcctgtacatctaagtaatggg

SEQ ID NO: 91174 - DNA, 25 bp, Homo sapien
gggaaaacctgtgcaaattaattca

SEQ ID NO: 91175 - DNA, 25 bp, Homo sapien
gcaaattaattcacatacatggttc

SEQ ID NO: 91176 - DNA, 25 bp, Homo sapien
ttcagaaaattcacagcaggagggc

SEQ ID NO: 91177 - DNA, 25 bp, Homo sapien
gtcctataatcagagtgacccacgc

SEQ ID NO: 91178 - DNA, 25 bp, Homo sapien
gtgacccacgcaaatatgatccatt

SEQ ID NO: 91179 - DNA, 25 bp, Homo sapien
aatatgatccattcacttgcccaac

SEQ ID NO: 91180 - DNA, 25 bp, Homo sapien
acttgcccaactctgacaggatacg

SEQ ID NO: 91181 - DNA, 25 bp, Homo sapien
gacaggatacggatagtctataaat

SEQ ID NO: 91182 - DNA, 25 bp, Homo sapien
agggacttctagcaaacctgcagga

SEQ ID NO: 91183 - DNA, 25 bp, Homo sapien
aacgaacagtcggtccagaagctga

SEQ ID NO: 91184 - DNA, 25 bp, Homo sapien
gaattagatagactttccaccgaaa

SEQ ID NO: 91185 - DNA, 25 bp, Homo sapien
agactttccaccgaaacaagaatgg

SEQ ID NO: 91186 - DNA, 25 bp, Homo sapien
gaatggatagatgttccaatgtcat

SEQ ID NO: 91187 - DNA, 25 bp, Homo sapien
ccaatgtcattgtttcagtatttat

SEQ ID NO: 91188 - DNA, 25 bp, Homo sapien
agttcaggagccaccccaaaccatt

SEQ ID NO: 91189 - DNA, 25 bp, Homo sapien
ggagccaccccaaaccattctggga

SEQ ID NO: 91190 - DNA, 25 bp, Homo sapien
caccccaaaccattctgggacaggg

SEQ ID NO: 91191 - DNA, 25 bp, Homo sapien
ccaaaccattctgggacagggacac

SEQ ID NO: 91192 - DNA, 25 bp, Homo sapien
accattctgggacagggacacccct

SEQ ID NO: 91193 - DNA, 25 bp, Homo sapien
tctgggacagggacacccctttcta

SEQ ID NO: 91194 - DNA, 25 bp, Homo sapien
cctttctaccccagggcagggcagg

SEQ ID NO: 91195 - DNA, 25 bp, Homo sapien
gactagacccacctcacctgaaggg

SEQ ID NO: 91196 - DNA, 25 bp, Homo sapien
cccttgttggcagccagacaagggt

SEQ ID NO: 91197 - DNA, 25 bp, Homo sapien
agggtgacttaccaagagccaggga

SEQ ID NO: 91198 - DNA, 25 bp, Homo sapien
cagcccaggcccaagtgacagcaag

SEQ ID NO: 91199 - DNA, 25 bp, Homo sapien
agaacagaggatggccacagctgcg

SEQ ID NO: 91200 - DNA, 25 bp, Homo sapien
gatggccacagctgcggagcaagca

SEQ ID NO: 91201 - DNA, 25 bp, Homo sapien
gagtagatggagaggctctgcccat

SEQ ID NO: 91202 - DNA, 25 bp, Homo sapien
aaaagcattggcacgcaacgcagca

SEQ ID NO: 91203 - DNA, 25 bp, Homo sapien
gcaacgcagcatgtggcttcattga

SEQ ID NO: 91204 - DNA, 25 bp, Homo sapien
ggagttaaaccatctgctcttctgc

SEQ ID NO: 91205 - DNA, 25 bp, Homo sapien
tctgctcttctgctacttcaacatt

SEQ ID NO: 91206 - DNA, 25 bp, Homo sapien
caacattttctagcttttccgtgta

SEQ ID NO: 91207 - DNA, 25 bp, Homo sapien
tctagcttttccgtgtatctaaaca

SEQ ID NO: 91208 - DNA, 25 bp, Homo sapien
gtatctaaacacaatttgctacaca

SEQ ID NO: 91209 - DNA, 25 bp, Homo sapien
acaatttgctacacaagtcactgtt

SEQ ID NO: 91210 - DNA, 25 bp, Homo sapien
tagcatcatttgaggcctggaaggc

SEQ ID NO: 91211 - DNA, 25 bp, Homo sapien
catttgaggcctggaaggctatgaa

SEQ ID NO: 91212 - DNA, 25 bp, Homo sapien
aatagctgccaaaaagaggcttgaa

SEQ ID NO: 91213 - DNA, 25 bp, Homo sapien
actgaagaagaaaatgctgcaagaa

SEQ ID NO: 91214 - DNA, 25 bp, Homo sapien
gctgcaagaaaaggagaagcactac

SEQ ID NO: 91215 - DNA, 25 bp, Homo sapien
ggagaagcactacaagcttttgaaa

SEQ ID NO: 91216 - DNA, 25 bp, Homo sapien
agaaagaggaggaaactgttgccga

SEQ ID NO: 91217 - DNA, 25 bp, Homo sapien
agaggaggaaactgttgccgagaaa

SEQ ID NO: 91218 - DNA, 25 bp, Homo sapien
gaggaaactgttgccgagaaaaaga

SEQ ID NO: 91219 - DNA, 25 bp, Homo sapien
agaaagataatttaactgctgttga

SEQ ID NO: 91220 - DNA, 25 bp, Homo sapien
gataatttaactgctgttgagaaat

SEQ ID NO: 91221 - DNA, 25 bp, Homo sapien
tctgttcggttctcattacggaccc

SEQ ID NO: 91222 - DNA, 25 bp, Homo sapien
ttcggttctcattacggaccctcta

SEQ ID NO: 91223 - DNA, 25 bp, Homo sapien
cggttctcattacggaccctctagg

SEQ ID NO: 91224 - DNA, 25 bp, Homo sapien
gtttctgtgttgttcaggaagggct

SEQ ID NO: 91225 - DNA, 25 bp, Homo sapien
tgtgttgttcaggaagggcttcttt

SEQ ID NO: 91226 - DNA, 25 bp, Homo sapien
gttgttcaggaagggcttctttgat

SEQ ID NO: 91227 - DNA, 25 bp, Homo sapien
caggaagggcttctttgataaagaa

SEQ ID NO: 91228 - DNA, 25 bp, Homo sapien
gataaagaagtaggcccagtgtggt

SEQ ID NO: 91229 - DNA, 25 bp, Homo sapien
ccagtgtggtggcttgtacccgtaa

SEQ ID NO: 91230 - DNA, 25 bp, Homo sapien
cagtgtggtggcttgtacccgtaat

SEQ ID NO: 91231 - DNA, 25 bp, Homo sapien
ggccaacacggtgaggctttgtctc

SEQ ID NO: 91232 - DNA, 25 bp, Homo sapien
tggcttctctttacagctttgtttc

SEQ ID NO: 91233 - DNA, 25 bp, Homo sapien
gctttgtttctgcatcagttcactg

SEQ ID NO: 91234 - DNA, 25 bp, Homo sapien
agttcactgctgcatgttgtttgga

SEQ ID NO: 91235 - DNA, 25 bp, Homo sapien
gttgtttggaatttatcaccttaag

SEQ ID NO: 91236 - DNA, 25 bp, Homo sapien
tagaaacactttctcacttacaggg

SEQ ID NO: 91237 - DNA, 25 bp, Homo sapien
aatgcagggcacatgatctggccct

SEQ ID NO: 91238 - DNA, 25 bp, Homo sapien
ggccctccccagaacaatctggatt

SEQ ID NO: 91239 - DNA, 25 bp, Homo sapien
ggatttcacggagacagcaaccaga

SEQ ID NO: 91240 - DNA, 25 bp, Homo sapien
atgcatctggctactttttcatgta

SEQ ID NO: 91241 - DNA, 25 bp, Homo sapien
agaaactaatccttactatcctatt

SEQ ID NO: 91242 - DNA, 25 bp, Homo sapien
ttaggataccacttttcattgcaaa

SEQ ID NO: 91243 - DNA, 25 bp, Homo sapien
ggatgctatcagatcactgttctag

SEQ ID NO: 91244 - DNA, 25 bp, Homo sapien
gggctgctatcacgtcaccagcagg

SEQ ID NO: 91245 - DNA, 25 bp, Homo sapien
tgctatcacgtcaccagcaggcaaa

SEQ ID NO: 91246 - DNA, 25 bp, Homo sapien
ctatcacgtcaccagcaggcaaaga

SEQ ID NO: 91247 - DNA, 25 bp, Homo sapien
gtcaccagcaggcaaagaaaacagc

SEQ ID NO: 91248 - DNA, 25 bp, Homo sapien
ccaaagcgggctgcaggaactcggc

SEQ ID NO: 91249 - DNA, 25 bp, Homo sapien
agcgggctgcaggaactcggctggg

SEQ ID NO: 91250 - DNA, 25 bp, Homo sapien
ttgcccagtctgagggagatgccca

SEQ ID NO: 91251 - DNA, 25 bp, Homo sapien
aggccccacattagcacaagcccag

SEQ ID NO: 91252 - DNA, 25 bp, Homo sapien
cacattagcacaagcccaggcatgg

SEQ ID NO: 91253 - DNA, 25 bp, Homo sapien
cccaggcatgggagaaacagctgct

SEQ ID NO: 91254 - DNA, 25 bp, Homo sapien
tgtggctgctttcaaagtccttcac

SEQ ID NO: 91255 - DNA, 25 bp, Homo sapien
ttcaaagtccttcacatcgtataga

SEQ ID NO: 91256 - DNA, 25 bp, Homo sapien
gacaacatttgataggaaggagacc

SEQ ID NO: 91257 - DNA, 25 bp, Homo sapien
aaagaaacaccaaccaccttctctg

SEQ ID NO: 91258 - DNA, 25 bp, Homo sapien
accaccttctctgcgttgagagtaa

SEQ ID NO: 91259 - DNA, 25 bp, Homo sapien
gcgttgagagtaatggcctatgatt

SEQ ID NO: 91260 - DNA, 25 bp, Homo sapien
atgattatcatctatctgccgtcca

SEQ ID NO: 91261 - DNA, 25 bp, Homo sapien
tgccgtccacggtttgctttctgca

SEQ ID NO: 91262 - DNA, 25 bp, Homo sapien
ggatttaaaatatgaggcccaattg

SEQ ID NO: 91263 - DNA, 25 bp, Homo sapien
ggcccaattggattatggtgccata

SEQ ID NO: 91264 - DNA, 25 bp, Homo sapien
ggtgccatattttactttctaggaa

SEQ ID NO: 91265 - DNA, 25 bp, Homo sapien
catgtttgcttgtaaatatcgctcg

SEQ ID NO: 91266 - DNA, 25 bp, Homo sapien
gtttgcttgtaaatatcgctcggta

SEQ ID NO: 91267 - DNA, 25 bp, Homo sapien
atatcgctcggtattatagggccaa

SEQ ID NO: 91268 - DNA, 25 bp, Homo sapien
atcgctcggtattatagggccaata

SEQ ID NO: 91269 - DNA, 25 bp, Homo sapien
gctcggtattatagggccaatattt

SEQ ID NO: 91270 - DNA, 25 bp, Homo sapien
gatttatacctgtgtttaattggaa

SEQ ID NO: 91271 - DNA, 25 bp, Homo sapien
ggaattttacacattgtacattact

SEQ ID NO: 91272 - DNA, 25 bp, Homo sapien
acacattgtacattacttagctatt

SEQ ID NO: 91273 - DNA, 25 bp, Homo sapien
cattacttagctatttagaggtttg

SEQ ID NO: 91274 - DNA, 25 bp, Homo sapien
caattttgtatatacttgactggta

SEQ ID NO: 91275 - DNA, 25 bp, Homo sapien
gtatatacttgactggtaatgttta

SEQ ID NO: 91276 - DNA, 25 bp, Homo sapien
tgtctggctccttcattaggtgatg

SEQ ID NO: 91277 - DNA, 25 bp, Homo sapien
ttaggtgatggcttcgccgattcac

SEQ ID NO: 91278 - DNA, 25 bp, Homo sapien
attcactctcacttgctctcctttt

SEQ ID NO: 91279 - DNA, 25 bp, Homo sapien
ggccacctgaccaaaagattgcttt

SEQ ID NO: 91280 - DNA, 25 bp, Homo sapien
aagattgctttatgtgatgtgattc

SEQ ID NO: 91281 - DNA, 25 bp, Homo sapien
atgtgattcatgtaacaagtgcttc

SEQ ID NO: 91282 - DNA, 25 bp, Homo sapien
aagtgcttctgccttaaacccagag

SEQ ID NO: 91283 - DNA, 25 bp, Homo sapien
ttaaacccagagtctgtgccttggc

SEQ ID NO: 91284 - DNA, 25 bp, Homo sapien
agagtctgtgccttggctcacgcct

SEQ ID NO: 91285 - DNA, 25 bp, Homo sapien
cctgtgatcctaacatttcaagagg

SEQ ID NO: 91286 - DNA, 25 bp, Homo sapien
aacatttcaagaggcccaggctaga

SEQ ID NO: 91287 - DNA, 25 bp, Homo sapien
cagggttttctgcagctcaacccat

SEQ ID NO: 91288 - DNA, 25 bp, Homo sapien
ttttctgcagctcaacccatcaggg

SEQ ID NO: 91289 - DNA, 25 bp, Homo sapien
gtctaggtgatgactgggatttcta

SEQ ID NO: 91290 - DNA, 25 bp, Homo sapien
ttttctgccaaaaggctctctcagc

SEQ ID NO: 91291 - DNA, 25 bp, Homo sapien
aaaaggctctctcagccgagacttg

SEQ ID NO: 91292 - DNA, 25 bp, Homo sapien
agccgagacttgctggcacggatat

SEQ ID NO: 91293 - DNA, 25 bp, Homo sapien
ttgctggcacggatattgcccctgc

SEQ ID NO: 91294 - DNA, 25 bp, Homo sapien
gctggcgtgagttgtctgcgcctcc

SEQ ID NO: 91295 - DNA, 25 bp, Homo sapien
ttgtctgcgcctccctgaaggcaga

SEQ ID NO: 91296 - DNA, 25 bp, Homo sapien
gctgtgatgggctagctgcggtgag

SEQ ID NO: 91297 - DNA, 25 bp, Homo sapien
tcggccttgcccagggcctcaaagg

SEQ ID NO: 91298 - DNA, 25 bp, Homo sapien
ccatgcctggccatcagaacttgta

SEQ ID NO: 91299 - DNA, 25 bp, Homo sapien
catgcctggccatcagaacttgtaa

SEQ ID NO: 91300 - DNA, 25 bp, Homo sapien
atgcctggccatcagaacttgtaat

SEQ ID NO: 91301 - DNA, 25 bp, Homo sapien
tgcctggccatcagaacttgtaatc

SEQ ID NO: 91302 - DNA, 25 bp, Homo sapien
gcctggccatcagaacttgtaatca

SEQ ID NO: 91303 - DNA, 25 bp, Homo sapien
cctggccatcagaacttgtaatcaa

SEQ ID NO: 91304 - DNA, 25 bp, Homo sapien
ctggccatcagaacttgtaatcaag

SEQ ID NO: 91305 - DNA, 25 bp, Homo sapien
tggccatcagaacttgtaatcaaga

SEQ ID NO: 91306 - DNA, 25 bp, Homo sapien
ggccatcagaacttgtaatcaagac

SEQ ID NO: 91307 - DNA, 25 bp, Homo sapien
atcagaacttgtaatcaagacagta

SEQ ID NO: 91308 - DNA, 25 bp, Homo sapien
agacagtatgttgagaaattctaac

SEQ ID NO: 91309 - DNA, 25 bp, Homo sapien
acaacgtatgtttccagtgaagtca

SEQ ID NO: 91310 - DNA, 25 bp, Homo sapien
aggtctgatccttatgttaacacaa

SEQ ID NO: 91311 - DNA, 25 bp, Homo sapien
gtttacttcatcaaggaacacagca

SEQ ID NO: 91312 - DNA, 25 bp, Homo sapien
ggaacacagcatcattatgcaatat

SEQ ID NO: 91313 - DNA, 25 bp, Homo sapien
gcaatatgaaaccagccaactgctt

SEQ ID NO: 91314 - DNA, 25 bp, Homo sapien
agccaactgctttttgtgcggtctc

SEQ ID NO: 91315 - DNA, 25 bp, Homo sapien
ttgtgcggtctcctataggaagtat

SEQ ID NO: 91316 - DNA, 25 bp, Homo sapien
agtatcgcaattgtcttgttttcat

SEQ ID NO: 91317 - DNA, 25 bp, Homo sapien
tgtagtctaacccttttaatgcctt

SEQ ID NO: 91318 - DNA, 25 bp, Homo sapien
aatgcctttacctcaagttgcttgg

SEQ ID NO: 91319 - DNA, 25 bp, Homo sapien
gcttggcagcacaactatctttgca

SEQ ID NO: 91320 - DNA, 25 bp, Homo sapien
ggttttgttgatgcttttctaagaa

SEQ ID NO: 91321 - DNA, 25 bp, Homo sapien
cttttctaagaatggagtactcgtt

SEQ ID NO: 91322 - DNA, 25 bp, Homo sapien
gtactcgttttcaagagatttgtcc

SEQ ID NO: 91323 - DNA, 25 bp, Homo sapien
attatattttccagcgggtacttat

SEQ ID NO: 91324 - DNA, 25 bp, Homo sapien
tttccagcgggtacttatgccaagt

SEQ ID NO: 91325 - DNA, 25 bp, Homo sapien
gcgggtacttatgccaagtattgat

SEQ ID NO: 91326 - DNA, 25 bp, Homo sapien
tcagaccttaactatcaacggcaat

SEQ ID NO: 91327 - DNA, 25 bp, Homo sapien
tatcaacggcaatgaatgaacatct

SEQ ID NO: 91328 - DNA, 25 bp, Homo sapien
gaatgaacatctaaagtttccaatt

SEQ ID NO: 91329 - DNA, 25 bp, Homo sapien
aagtaaagaactggctgggtacagc

SEQ ID NO: 91330 - DNA, 25 bp, Homo sapien
actggctgggtacagcagttcacgc

SEQ ID NO: 91331 - DNA, 25 bp, Homo sapien
gatcatgctacactctcaaaagaaa

SEQ ID NO: 91332 - DNA, 25 bp, Homo sapien
aaatcattcagatcatccccccttt

SEQ ID NO: 91333 - DNA, 25 bp, Homo sapien
ccctttttaagtagtgtgaattgca

SEQ ID NO: 91334 - DNA, 25 bp, Homo sapien
tttactgtcagttgcggtttattta

SEQ ID NO: 91335 - DNA, 25 bp, Homo sapien
gtcagttgcggtttatttattcttt

SEQ ID NO: 91336 - DNA, 25 bp, Homo sapien
gtatctgtgtgtgatttgctattta

SEQ ID NO: 91337 - DNA, 25 bp, Homo sapien
agtactttgctgaatgtcattttaa

SEQ ID NO: 91338 - DNA, 25 bp, Homo sapien
aaagcatgtttgaagtcttgtgtat

SEQ ID NO: 91339 - DNA, 25 bp, Homo sapien
tgaagtcttgtgtatttgtctgtgt

SEQ ID NO: 91340 - DNA, 25 bp, Homo sapien
ctgtgttaatgctgtcaggaggaac

SEQ ID NO: 91341 - DNA, 25 bp, Homo sapien
caggaggaactgactaagatgtttt

SEQ ID NO: 91342 - DNA, 25 bp, Homo sapien
ctggacttggatcaataaaatgcta

SEQ ID NO: 91343 - DNA, 25 bp, Homo sapien
aatgctatgaatgtcgtatatatgg

SEQ ID NO: 91344 - DNA, 25 bp, Homo sapien
gtcgtatatatggatttcagcctag

SEQ ID NO: 91345 - DNA, 25 bp, Homo sapien
gaaggtgaaatatggcctatcagta

SEQ ID NO: 91346 - DNA, 25 bp, Homo sapien
tatggcctatcagtaaggacagcaa

SEQ ID NO: 91347 - DNA, 25 bp, Homo sapien
aaatgcactggacctcttggtggtg

SEQ ID NO: 91348 - DNA, 25 bp, Homo sapien
ttggtggtggtgaacagcctcctat

SEQ ID NO: 91349 - DNA, 25 bp, Homo sapien
agcctcctattccttgtctaggtta

SEQ ID NO: 91350 - DNA, 25 bp, Homo sapien
gtctaggttattgtcaggttgattc

SEQ ID NO: 91351 - DNA, 25 bp, Homo sapien
gattctgtaataatctctggtctcc

SEQ ID NO: 91352 - DNA, 25 bp, Homo sapien
tctcccaccgactccttatttttag

SEQ ID NO: 91353 - DNA, 25 bp, Homo sapien
tttccaatttttaaagcttcagaat

SEQ ID NO: 91354 - DNA, 25 bp, Homo sapien
agttgcttttgatactcagctgtca

SEQ ID NO: 91355 - DNA, 25 bp, Homo sapien
gatactcagctgtcatgtttataat

SEQ ID NO: 91356 - DNA, 25 bp, Homo sapien
tcagctgtcatgtttataattcaaa

SEQ ID NO: 91357 - DNA, 25 bp, Homo sapien
ttggagatgttgcagctcaaatttc

SEQ ID NO: 91358 - DNA, 25 bp, Homo sapien
agctcaaatttcagtccacatatga

SEQ ID NO: 91359 - DNA, 25 bp, Homo sapien
gtattttccataaagtgattcgggc

SEQ ID NO: 91360 - DNA, 25 bp, Homo sapien
ttccataaagtgattcgggcatatt

SEQ ID NO: 91361 - DNA, 25 bp, Homo sapien
cgggcatatttgtgtgaaaacctca

SEQ ID NO: 91362 - DNA, 25 bp, Homo sapien
gaaaacctcagttctgtcacttctt

SEQ ID NO: 91363 - DNA, 25 bp, Homo sapien
ttctgtcacttcttacctctataaa

SEQ ID NO: 91364 - DNA, 25 bp, Homo sapien
tgttgcccagattgttccccacaaa

SEQ ID NO: 91365 - DNA, 25 bp, Homo sapien
gttgcccagattgttccccacaaaa

SEQ ID NO: 91366 - DNA, 25 bp, Homo sapien
ttgcccagattgttccccacaaaat

SEQ ID NO: 91367 - DNA, 25 bp, Homo sapien
gcccagattgttccccacaaaatca

SEQ ID NO: 91368 - DNA, 25 bp, Homo sapien
cagattgttccccacaaaatcacaa

SEQ ID NO: 91369 - DNA, 25 bp, Homo sapien
gattgttccccacaaaatcacaaaa

SEQ ID NO: 91370 - DNA, 25 bp, Homo sapien
ttgttccccacaaaatcacaaaaga

SEQ ID NO: 91371 - DNA, 25 bp, Homo sapien
tcacaaaagaagttaagaggttcct

SEQ ID NO: 91372 - DNA, 25 bp, Homo sapien
gttaagaggttcctggccggacgcg

SEQ ID NO: 91373 - DNA, 25 bp, Homo sapien
taagaggttcctggccggacgcggt

SEQ ID NO: 91374 - DNA, 25 bp, Homo sapien
ggttcctggccggacgcggtgactc

SEQ ID NO: 91375 - DNA, 25 bp, Homo sapien
gtttggcataatagtgttttgtgtt

SEQ ID NO: 91376 - DNA, 25 bp, Homo sapien
tttttcccgagcctgctagggcgag

SEQ ID NO: 91377 - DNA, 25 bp, Homo sapien
aataatgcagcccttgtttttcacc

SEQ ID NO: 91378 - DNA, 25 bp, Homo sapien
taatgcagcccttgtttttcacctg

SEQ ID NO: 91379 - DNA, 25 bp, Homo sapien
tttcacctgtagaatatgagaacat

SEQ ID NO: 91380 - DNA, 25 bp, Homo sapien
gaacattttaacagcacctctctta

SEQ ID NO: 91381 - DNA, 25 bp, Homo sapien
acagcacctctcttatcttgcagat

SEQ ID NO: 91382 - DNA, 25 bp, Homo sapien
gatatattccaagatgctacatgca

SEQ ID NO: 91383 - DNA, 25 bp, Homo sapien
gatgctacatgcagcagacagctgt

SEQ ID NO: 91384 - DNA, 25 bp, Homo sapien
agctgtgagcttgcatacacacaca

SEQ ID NO: 91385 - DNA, 25 bp, Homo sapien
acacagaatgcagtactagttaagt

SEQ ID NO: 91386 - DNA, 25 bp, Homo sapien
tggcatctctctttggcctgaggtt

SEQ ID NO: 91387 - DNA, 25 bp, Homo sapien
tctctttggcctgaggttctgtatt

SEQ ID NO: 91388 - DNA, 25 bp, Homo sapien
gcctgaggttctgtattctgggaaa

SEQ ID NO: 91389 - DNA, 25 bp, Homo sapien
gcagagaggtcgtcgtcgtcgccca

SEQ ID NO: 91390 - DNA, 25 bp, Homo sapien
gctgcaaaatagtagaactcgtggt

SEQ ID NO: 91391 - DNA, 25 bp, Homo sapien
gaactcgtggttgctttggacaggt

SEQ ID NO: 91392 - DNA, 25 bp, Homo sapien
tggacaggtgtgatttgtgcaagcc

SEQ ID NO: 91393 - DNA, 25 bp, Homo sapien
atttgtgcaagccaggttcaaccct

SEQ ID NO: 91394 - DNA, 25 bp, Homo sapien
agccaggttcaacccttgcctcaag

SEQ ID NO: 91395 - DNA, 25 bp, Homo sapien
ggaccaatttagtgtccttccacct

SEQ ID NO: 91396 - DNA, 25 bp, Homo sapien
gaggacatctatcgtattcttgtgt

SEQ ID NO: 91397 - DNA, 25 bp, Homo sapien
gactggactactgcctgacgttgtc

SEQ ID NO: 91398 - DNA, 25 bp, Homo sapien
ctggactactgcctgacgttgtcag

SEQ ID NO: 91399 - DNA, 25 bp, Homo sapien
tggactactgcctgacgttgtcagt

SEQ ID NO: 91400 - DNA, 25 bp, Homo sapien
gactactgcctgacgttgtcagtca

SEQ ID NO: 91401 - DNA, 25 bp, Homo sapien
ctactgcctgacgttgtcagtcaag

SEQ ID NO: 91402 - DNA, 25 bp, Homo sapien
actgcctgacgttgtcagtcaagac

SEQ ID NO: 91403 - DNA, 25 bp, Homo sapien
gacgttgtcagtcaagaccagcctt

SEQ ID NO: 91404 - DNA, 25 bp, Homo sapien
acgttgtcagtcaagaccagccttg

SEQ ID NO: 91405 - DNA, 25 bp, Homo sapien
atagtgaaaccgtctccacaaataa

SEQ ID NO: 91406 - DNA, 25 bp, Homo sapien
gtgaaaccgtctccacaaataattt

SEQ ID NO: 91407 - DNA, 25 bp, Homo sapien
tgaaaccgtctccacaaataatttt

SEQ ID NO: 91408 - DNA, 25 bp, Homo sapien
gctgcggcgccacgcgggcggcctg

SEQ ID NO: 91409 - DNA, 25 bp, Homo sapien
gaggccgagggctacttccgcaaga

SEQ ID NO: 91410 - DNA, 25 bp, Homo sapien
aggccgagggctacttccgcaagat

SEQ ID NO: 91411 - DNA, 25 bp, Homo sapien
gccgagggctacttccgcaagatgc

SEQ ID NO: 91412 - DNA, 25 bp, Homo sapien
ccgagggctacttccgcaagatgca

SEQ ID NO: 91413 - DNA, 25 bp, Homo sapien
cgagggctacttccgcaagatgcag

SEQ ID NO: 91414 - DNA, 25 bp, Homo sapien
gagggctacttccgcaagatgcagg

SEQ ID NO: 91415 - DNA, 25 bp, Homo sapien
aagatgcaggcgcgccgcttccccg

SEQ ID NO: 91416 - DNA, 25 bp, Homo sapien
gcaggcgcgccgcttccccgactag

SEQ ID NO: 91417 - DNA, 25 bp, Homo sapien
aggcgcgccgcttccccgactagcg

SEQ ID NO: 91418 - DNA, 25 bp, Homo sapien
gccgcttccccgactagcgcggcgg

SEQ ID NO: 91419 - DNA, 25 bp, Homo sapien
aggcaagactctaggttccacacta

SEQ ID NO: 91420 - DNA, 25 bp, Homo sapien
taagtgggtcagtaccaacaatgaa

SEQ ID NO: 91421 - DNA, 25 bp, Homo sapien
gaacacattatttcctggtctactg

SEQ ID NO: 91422 - DNA, 25 bp, Homo sapien
ttatttcctggtctactggtacaag

SEQ ID NO: 91423 - DNA, 25 bp, Homo sapien
tactggtacaagtcagctctgctac

SEQ ID NO: 91424 - DNA, 25 bp, Homo sapien
tacctgggagcctttggaagcttag

SEQ ID NO: 91425 - DNA, 25 bp, Homo sapien
ggaagcttagagtcctttgaactgc

SEQ ID NO: 91426 - DNA, 25 bp, Homo sapien
gagtcctttgaactgctgagtcact

SEQ ID NO: 91427 - DNA, 25 bp, Homo sapien
gctgagtcacttctaggtgggattt

SEQ ID NO: 91428 - DNA, 25 bp, Homo sapien
gtaccggaagtagaaaacagcacat

SEQ ID NO: 91429 - DNA, 25 bp, Homo sapien
cccatgtctacattttttacactga

SEQ ID NO: 91430 - DNA, 25 bp, Homo sapien
cccgccagtgcctgatggttactga

SEQ ID NO: 91431 - DNA, 25 bp, Homo sapien
cgccagtgcctgatggttactgaga

SEQ ID NO: 91432 - DNA, 25 bp, Homo sapien
gtgcctgatggttactgagactggt

SEQ ID NO: 91433 - DNA, 25 bp, Homo sapien
cctgatggttactgagactggtgtt

SEQ ID NO: 91434 - DNA, 25 bp, Homo sapien
atggttactgagactggtgtttgct

SEQ ID NO: 91435 - DNA, 25 bp, Homo sapien
ttactgagactggtgtttgctagac

SEQ ID NO: 91436 - DNA, 25 bp, Homo sapien
ctgagactggtgtttgctagaccct

SEQ ID NO: 91437 - DNA, 25 bp, Homo sapien
agactggtgtttgctagaccctttc

SEQ ID NO: 91438 - DNA, 25 bp, Homo sapien
actggtgtttgctagaccctttctc

SEQ ID NO: 91439 - DNA, 25 bp, Homo sapien
ggtgtttgctagaccctttctcaaa

SEQ ID NO: 91440 - DNA, 25 bp, Homo sapien
aaaatgagtcaaggcagggcacagt

SEQ ID NO: 91441 - DNA, 25 bp, Homo sapien
gcccacgaatggcatcccaacagag

SEQ ID NO: 91442 - DNA, 25 bp, Homo sapien
cccacgaatggcatcccaacagagt

SEQ ID NO: 91443 - DNA, 25 bp, Homo sapien
ccacgaatggcatcccaacagagtt

SEQ ID NO: 91444 - DNA, 25 bp, Homo sapien
cacgaatggcatcccaacagagtta

SEQ ID NO: 91445 - DNA, 25 bp, Homo sapien
acgaatggcatcccaacagagttaa

SEQ ID NO: 91446 - DNA, 25 bp, Homo sapien
cgaatggcatcccaacagagttaaa

SEQ ID NO: 91447 - DNA, 25 bp, Homo sapien
gaatggcatcccaacagagttaaag

SEQ ID NO: 91448 - DNA, 25 bp, Homo sapien
aatggcatcccaacagagttaaaga

SEQ ID NO: 91449 - DNA, 25 bp, Homo sapien
acagagttaaagaaactgcttgcag

SEQ ID NO: 91450 - DNA, 25 bp, Homo sapien
cagagttaaagaaactgcttgcagg

SEQ ID NO: 91451 - DNA, 25 bp, Homo sapien
agagttaaagaaactgcttgcaggg

SEQ ID NO: 91452 - DNA, 25 bp, Homo sapien
agccagaaacagacaaacattgcat

SEQ ID NO: 91453 - DNA, 25 bp, Homo sapien
aattatttgcgggatctaaaagtca

SEQ ID NO: 91454 - DNA, 25 bp, Homo sapien
attatttgcgggatctaaaagtcaa

SEQ ID NO: 91455 - DNA, 25 bp, Homo sapien
ggatggttactagtggctgggaaaa

SEQ ID NO: 91456 - DNA, 25 bp, Homo sapien
gatggttactagtggctgggaaaag

SEQ ID NO: 91457 - DNA, 25 bp, Homo sapien
atggttactagtggctgggaaaagg

SEQ ID NO: 91458 - DNA, 25 bp, Homo sapien
tggttactagtggctgggaaaaggg

SEQ ID NO: 91459 - DNA, 25 bp, Homo sapien
gggaactggggatgcttaatgtgta

SEQ ID NO: 91460 - DNA, 25 bp, Homo sapien
accgggtgagtatagtcaataatag

SEQ ID NO: 91461 - DNA, 25 bp, Homo sapien
ccgggtgagtatagtcaataatagc

SEQ ID NO: 91462 - DNA, 25 bp, Homo sapien
cgggtgagtatagtcaataatagct

SEQ ID NO: 91463 - DNA, 25 bp, Homo sapien
atgggttagttgtaggtccctagat

SEQ ID NO: 91464 - DNA, 25 bp, Homo sapien
gattcaccccatttttaggatcctt

SEQ ID NO: 91465 - DNA, 25 bp, Homo sapien
ttttaggatccttctggcagatagt

SEQ ID NO: 91466 - DNA, 25 bp, Homo sapien
gtatgccaaatggtatctgtacctt

SEQ ID NO: 91467 - DNA, 25 bp, Homo sapien
atctgtacctttcttagcttgtcgg

SEQ ID NO: 91468 - DNA, 25 bp, Homo sapien
ggtgtcttgcttttaattctctggg

SEQ ID NO: 91469 - DNA, 25 bp, Homo sapien
ggcttgtaagttacagccccaattt

SEQ ID NO: 91470 - DNA, 25 bp, Homo sapien
ttacagccccaatttctttactttg

SEQ ID NO: 91471 - DNA, 25 bp, Homo sapien
tttactttgctctctaaggtagtga

SEQ ID NO: 91472 - DNA, 25 bp, Homo sapien
tgttttgcttgtttctccctaataa

SEQ ID NO: 91473 - DNA, 25 bp, Homo sapien
ttttcctcccagcatctagtggaga

SEQ ID NO: 91474 - DNA, 25 bp, Homo sapien
gaattgcctctggactatcatcaat

SEQ ID NO: 91475 - DNA, 25 bp, Homo sapien
gttgtacctaaaatccaggaccaag

SEQ ID NO: 91476 - DNA, 25 bp, Homo sapien
aggaccaagactcccctagagaaca

SEQ ID NO: 91477 - DNA, 25 bp, Homo sapien
agcatatcaaactaccctcatcttt

SEQ ID NO: 91478 - DNA, 25 bp, Homo sapien
gaggaaatactcctggagtgccatt

SEQ ID NO: 91479 - DNA, 25 bp, Homo sapien
gagtgccattggcttatgataggta

SEQ ID NO: 91480 - DNA, 25 bp, Homo sapien
agcactgaattccaagctccactgg

SEQ ID NO: 91481 - DNA, 25 bp, Homo sapien
aagctccactggcatttcagtctga

SEQ ID NO: 91482 - DNA, 25 bp, Homo sapien
aaagagcgtcaaaagcagtacctga

SEQ ID NO: 91483 - DNA, 25 bp, Homo sapien
gcagtacctgagacatagacgactt

SEQ ID NO: 91484 - DNA, 25 bp, Homo sapien
gacatagacgacttttcatggatat

SEQ ID NO: 91485 - DNA, 25 bp, Homo sapien
acatcattattaagatccagtaggt

SEQ ID NO: 91486 - DNA, 25 bp, Homo sapien
cagtaggtaggacatttattggatt

SEQ ID NO: 91487 - DNA, 25 bp, Homo sapien
gaagcatttatctatgtctttaggt

SEQ ID NO: 91488 - DNA, 25 bp, Homo sapien
catttatctatgtctttaggtgtca

SEQ ID NO: 91489 - DNA, 25 bp, Homo sapien
ttaggtgtcattgttccctttctga

SEQ ID NO: 91490 - DNA, 25 bp, Homo sapien
tccctttctgaattagctgtacata

SEQ ID NO: 91491 - DNA, 25 bp, Homo sapien
ctgtacatataagccttcctttggt

SEQ ID NO: 91492 - DNA, 25 bp, Homo sapien
agagggactgtttaccattcttcca

SEQ ID NO: 91493 - DNA, 25 bp, Homo sapien
gactgtttaccattcttccactgtg

SEQ ID NO: 91494 - DNA, 25 bp, Homo sapien
accattcttccactgtgctgttata

SEQ ID NO: 91495 - DNA, 25 bp, Homo sapien
tccactgtgctgttataaagttgta

SEQ ID NO: 91496 - DNA, 25 bp, Homo sapien
gatggaagaagggcctggacctccc

SEQ ID NO: 91497 - DNA, 25 bp, Homo sapien
accttctcctaaggagcttgccctg

SEQ ID NO: 91498 - DNA, 25 bp, Homo sapien
gagcttgccctgcagtaagccccaa

SEQ ID NO: 91499 - DNA, 25 bp, Homo sapien
ttgccctgcagtaagccccaacttt

SEQ ID NO: 91500 - DNA, 25 bp, Homo sapien
ttcctcttttccctctatcagagtc

SEQ ID NO: 91501 - DNA, 25 bp, Homo sapien
ttttccctctatcagagtcgtcgcc

SEQ ID NO: 91502 - DNA, 25 bp, Homo sapien
aagccgagggcgacggagatcccca

SEQ ID NO: 91503 - DNA, 25 bp, Homo sapien
gagggcgacggagatccccagctta

SEQ ID NO: 91504 - DNA, 25 bp, Homo sapien
gacggagatccccagcttagtaaga

SEQ ID NO: 91505 - DNA, 25 bp, Homo sapien
cggagatccccagcttagtaagaaa

SEQ ID NO: 91506 - DNA, 25 bp, Homo sapien
gatccccagcttagtaagaaaagta

SEQ ID NO: 91507 - DNA, 25 bp, Homo sapien
gatcccattaccattatataatgcc

SEQ ID NO: 91508 - DNA, 25 bp, Homo sapien
tcccattaccattatataatgccct

SEQ ID NO: 91509 - DNA, 25 bp, Homo sapien
cattaccattatataatgcccttct

SEQ ID NO: 91510 - DNA, 25 bp, Homo sapien
attaccattatataatgcccttctt

SEQ ID NO: 91511 - DNA, 25 bp, Homo sapien
tgcttgataaatattcctgtatccc

SEQ ID NO: 91512 - DNA, 25 bp, Homo sapien
gcttgataaatattcctgtatccct

SEQ ID NO: 91513 - DNA, 25 bp, Homo sapien
cttgataaatattcctgtatccctt

SEQ ID NO: 91514 - DNA, 25 bp, Homo sapien
ttgataaatattcctgtatcccttt

SEQ ID NO: 91515 - DNA, 25 bp, Homo sapien
tgataaatattcctgtatcccttta

SEQ ID NO: 91516 - DNA, 25 bp, Homo sapien
gataaatattcctgtatccctttat

SEQ ID NO: 91517 - DNA, 25 bp, Homo sapien
ataaatattcctgtatccctttatt

SEQ ID NO: 91518 - DNA, 25 bp, Homo sapien
gagtaagaagattcaccatcccatg

SEQ ID NO: 91519 - DNA, 25 bp, Homo sapien
accatcccatgtgatctgtgtggaa

SEQ ID NO: 91520 - DNA, 25 bp, Homo sapien
accatgtcctcttggtggaagacat

SEQ ID NO: 91521 - DNA, 25 bp, Homo sapien
gtgcaagagggaccttcctgctcaa

SEQ ID NO: 91522 - DNA, 25 bp, Homo sapien
aaggcccgcccaggcagcggaatag

SEQ ID NO: 91523 - DNA, 25 bp, Homo sapien
agtgcttggctgcagaaaccctttg

SEQ ID NO: 91524 - DNA, 25 bp, Homo sapien
ttgtccctcacctatatatacacgg

SEQ ID NO: 91525 - DNA, 25 bp, Homo sapien
cggacagtcaagtttgttgctctaa

SEQ ID NO: 91526 - DNA, 25 bp, Homo sapien
gttgctctaacgtaaggcacagcgt

SEQ ID NO: 91527 - DNA, 25 bp, Homo sapien
gcacagcgttaatcctgtatggcca

SEQ ID NO: 91528 - DNA, 25 bp, Homo sapien
tgagtagactcctgtgtaaccctgt

SEQ ID NO: 91529 - DNA, 25 bp, Homo sapien
gactggcctgtccacatgggagtca

SEQ ID NO: 91530 - DNA, 25 bp, Homo sapien
gagtcaggtgtcatggctgccctga

SEQ ID NO: 91531 - DNA, 25 bp, Homo sapien
ggctgacattacatttagtttgctc

SEQ ID NO: 91532 - DNA, 25 bp, Homo sapien
atttagtttgctctcactccatctg

SEQ ID NO: 91533 - DNA, 25 bp, Homo sapien
actccatctggctaagtgatcttga

SEQ ID NO: 91534 - DNA, 25 bp, Homo sapien
gtgatcttgaaataccacctctcag

SEQ ID NO: 91535 - DNA, 25 bp, Homo sapien
cacctctcaggtgaagaaccgtcag

SEQ ID NO: 91536 - DNA, 25 bp, Homo sapien
aagaaccgtcaggaattcccatctc

SEQ ID NO: 91537 - DNA, 25 bp, Homo sapien
ggaattcccatctcacaggctgtgg

SEQ ID NO: 91538 - DNA, 25 bp, Homo sapien
aatgcttagatcttattgatgacag

SEQ ID NO: 91539 - DNA, 25 bp, Homo sapien
gagtgtatcctaatggtttgttcat

SEQ ID NO: 91540 - DNA, 25 bp, Homo sapien
gagctgtctgattccatgatgtctg

SEQ ID NO: 91541 - DNA, 25 bp, Homo sapien
tgctgatggcagtgttggtaactaa

SEQ ID NO: 91542 - DNA, 25 bp, Homo sapien
ggtaactaattgactgatctcactt

SEQ ID NO: 91543 - DNA, 25 bp, Homo sapien
ttccgatccaagcaccagttccagt

SEQ ID NO: 91544 - DNA, 25 bp, Homo sapien
caccagttccagtgggacgggagat

SEQ ID NO: 91545 - DNA, 25 bp, Homo sapien
gtgtctttgcctcccactgttctct

SEQ ID NO: 91546 - DNA, 25 bp, Homo sapien
gttctctccactctctccaggaaaa

SEQ ID NO: 91547 - DNA, 25 bp, Homo sapien
caggaaaaagagtcccaagaggctg

SEQ ID NO: 91548 - DNA, 25 bp, Homo sapien
tcccaagaggctggagctgacaaac

SEQ ID NO: 91549 - DNA, 25 bp, Homo sapien
ggagctgacaaacccaatacccttt

SEQ ID NO: 91550 - DNA, 25 bp, Homo sapien
gctgacaaacccaataccctttatt

SEQ ID NO: 91551 - DNA, 25 bp, Homo sapien
aggttgctgtaagttgagatcgcca

SEQ ID NO: 91552 - DNA, 25 bp, Homo sapien
ggttgctgtaagttgagatcgccac

SEQ ID NO: 91553 - DNA, 25 bp, Homo sapien
gttgctgtaagttgagatcgccact

SEQ ID NO: 91554 - DNA, 25 bp, Homo sapien
ttgctgtaagttgagatcgccactg

SEQ ID NO: 91555 - DNA, 25 bp, Homo sapien
agcctgggaaatagagtgagcaaga

SEQ ID NO: 91556 - DNA, 25 bp, Homo sapien
gcctgggaaatagagtgagcaagac

SEQ ID NO: 91557 - DNA, 25 bp, Homo sapien
cctgggaaatagagtgagcaagact

SEQ ID NO: 91558 - DNA, 25 bp, Homo sapien
atagagtgagcaagactcagtgccc

SEQ ID NO: 91559 - DNA, 25 bp, Homo sapien
tagagtgagcaagactcagtgcccc

SEQ ID NO: 91560 - DNA, 25 bp, Homo sapien
gagtgagcaagactcagtgccccct

SEQ ID NO: 91561 - DNA, 25 bp, Homo sapien
gtgagcaagactcagtgccccctac

SEQ ID NO: 91562 - DNA, 25 bp, Homo sapien
gtgaccctgctgagtcgtgagcgga

SEQ ID NO: 91563 - DNA, 25 bp, Homo sapien
gtgagcggaggaagggcccagcccc

SEQ ID NO: 91564 - DNA, 25 bp, Homo sapien
gccctgaacgcccagcagagtggtg

SEQ ID NO: 91565 - DNA, 25 bp, Homo sapien
gctggtgggcaaacattgggcccat

SEQ ID NO: 91566 - DNA, 25 bp, Homo sapien
aaacattgggcccatgcagacacac

SEQ ID NO: 91567 - DNA, 25 bp, Homo sapien
gggcccatgcagacacacgcctgtg

SEQ ID NO: 91568 - DNA, 25 bp, Homo sapien
accctggcctgcaggaacaaggcag

SEQ ID NO: 91569 - DNA, 25 bp, Homo sapien
tgtggaggacctcagccctgccctg

SEQ ID NO: 91570 - DNA, 25 bp, Homo sapien
gccctcctcatgaatagtgtgcaga

SEQ ID NO: 91571 - DNA, 25 bp, Homo sapien
tcctcatgaatagtgtgcagactca

SEQ ID NO: 91572 - DNA, 25 bp, Homo sapien
gtgcagactcacagataataaagct

SEQ ID NO: 91573 - DNA, 25 bp, Homo sapien
gatcctagttacaggactctgccag

SEQ ID NO: 91574 - DNA, 25 bp, Homo sapien
gccagctttgttaaactgtccgtga

SEQ ID NO: 91575 - DNA, 25 bp, Homo sapien
tgtccgtgagacaagaaagccattg

SEQ ID NO: 91576 - DNA, 25 bp, Homo sapien
attgcctgaaattcttactccgttc

SEQ ID NO: 91577 - DNA, 25 bp, Homo sapien
ttactccgttccaagtgctgttcct

SEQ ID NO: 91578 - DNA, 25 bp, Homo sapien
caggaaatcaaaggccagggtcctt

SEQ ID NO: 91579 - DNA, 25 bp, Homo sapien
cagggtccttatggccgtggagcct

SEQ ID NO: 91580 - DNA, 25 bp, Homo sapien
gaccacagagccaacttgtgaagca

SEQ ID NO: 91581 - DNA, 25 bp, Homo sapien
ttgtgaagcacacagctctgcagcc

SEQ ID NO: 91582 - DNA, 25 bp, Homo sapien
gctcttcaccacgttcctggagagt

SEQ ID NO: 91583 - DNA, 25 bp, Homo sapien
ttcctggagagtccggccaacctgt

SEQ ID NO: 91584 - DNA, 25 bp, Homo sapien
gctcagcaacagatgctctcacgct

SEQ ID NO: 91585 - DNA, 25 bp, Homo sapien
tcagcaacagatgctctcacgcttg

SEQ ID NO: 91586 - DNA, 25 bp, Homo sapien
agcaacagatgctctcacgcttgtt

SEQ ID NO: 91587 - DNA, 25 bp, Homo sapien
caacagatgctctcacgcttgttaa

SEQ ID NO: 91588 - DNA, 25 bp, Homo sapien
acagatgctctcacgcttgttaaaa

SEQ ID NO: 91589 - DNA, 25 bp, Homo sapien
cagatgctctcacgcttgttaaaag

SEQ ID NO: 91590 - DNA, 25 bp, Homo sapien
gatgctctcacgcttgttaaaagta

SEQ ID NO: 91591 - DNA, 25 bp, Homo sapien
atgctctcacgcttgttaaaagtaa

SEQ ID NO: 91592 - DNA, 25 bp, Homo sapien
gctctcacgcttgttaaaagtaaaa

SEQ ID NO: 91593 - DNA, 25 bp, Homo sapien
atcacgccatagcaattgcactccg

SEQ ID NO: 91594 - DNA, 25 bp, Homo sapien
tcacgccatagcaattgcactccgg

SEQ ID NO: 91595 - DNA, 25 bp, Homo sapien
tttgcctcccactgttctctccact

SEQ ID NO: 91596 - DNA, 25 bp, Homo sapien
ttgcctcccactgttctctccactc

SEQ ID NO: 91597 - DNA, 25 bp, Homo sapien
tgcctcccactgttctctccactct

SEQ ID NO: 91598 - DNA, 25 bp, Homo sapien
tcccactgttctctccactctctcc

SEQ ID NO: 91599 - DNA, 25 bp, Homo sapien
ccaggaaaaagagtcccaagaggct

SEQ ID NO: 91600 - DNA, 25 bp, Homo sapien
caggaaaaagagtcccaagaggctg

SEQ ID NO: 91601 - DNA, 25 bp, Homo sapien
aggaaaaagagtcccaagaggctgg

SEQ ID NO: 91602 - DNA, 25 bp, Homo sapien
ggagctgacaaacccaatacccttt

SEQ ID NO: 91603 - DNA, 25 bp, Homo sapien
gagctgacaaacccaatacccttta

SEQ ID NO: 91604 - DNA, 25 bp, Homo sapien
agctgacaaacccaataccctttat

SEQ ID NO: 91605 - DNA, 25 bp, Homo sapien
gctgacaaacccaataccctttatt

SEQ ID NO: 91606 - DNA, 25 bp, Homo sapien
gctgtatataagttgcctgctttgt

SEQ ID NO: 91607 - DNA, 25 bp, Homo sapien
ttttgaaatctctgcatcactcatt

SEQ ID NO: 91608 - DNA, 25 bp, Homo sapien
cactcattggaagtgcttctgaaga

SEQ ID NO: 91609 - DNA, 25 bp, Homo sapien
agagctgctctgtgttcagttgact

SEQ ID NO: 91610 - DNA, 25 bp, Homo sapien
cagttgactggttttgtgtcctgtt

SEQ ID NO: 91611 - DNA, 25 bp, Homo sapien
gtaaggcaggctactatgcgttata

SEQ ID NO: 91612 - DNA, 25 bp, Homo sapien
gtcaatatggtcttggcaatcatct

SEQ ID NO: 91613 - DNA, 25 bp, Homo sapien
gcaatcatctgtgcattactctggt

SEQ ID NO: 91614 - DNA, 25 bp, Homo sapien
aagcctgtgtgtgaacttactgtaa

SEQ ID NO: 91615 - DNA, 25 bp, Homo sapien
atgttttatttcaaggttctgcgaa

SEQ ID NO: 91616 - DNA, 25 bp, Homo sapien
taattgggcaggttaattgtgtacc

SEQ ID NO: 91617 - DNA, 25 bp, Homo sapien
gctcgtcggtcagcgacgtggacca

SEQ ID NO: 91618 - DNA, 25 bp, Homo sapien
gtcggtcagcgacgtggaccaggag

SEQ ID NO: 91619 - DNA, 25 bp, Homo sapien
tcagcgacgtggaccaggaggagcc

SEQ ID NO: 91620 - DNA, 25 bp, Homo sapien
ggaccaggaggagccgcggttcggg

SEQ ID NO: 91621 - DNA, 25 bp, Homo sapien
tggccaccgtcaacctggccacggg

SEQ ID NO: 91622 - DNA, 25 bp, Homo sapien
caccgtcaacctggccacgggcgag

SEQ ID NO: 91623 - DNA, 25 bp, Homo sapien
gggcagccgggagtccacgctgcgg

SEQ ID NO: 91624 - DNA, 25 bp, Homo sapien
gaggccgagggctacttccgcaaga

SEQ ID NO: 91625 - DNA, 25 bp, Homo sapien
cgagggctacttccgcaagatgcag

SEQ ID NO: 91626 - DNA, 25 bp, Homo sapien
gctacttccgcaagatgcaggcgcg

SEQ ID NO: 91627 - DNA, 25 bp, Homo sapien
tccgcaagatgcaggcgcgccgctt

SEQ ID NO: 91628 - DNA, 25 bp, Homo sapien
aaagtgttttgaagattagttggat

SEQ ID NO: 91629 - DNA, 25 bp, Homo sapien
aagtgttttgaagattagttggata

SEQ ID NO: 91630 - DNA, 25 bp, Homo sapien
agtgttttgaagattagttggataa

SEQ ID NO: 91631 - DNA, 25 bp, Homo sapien
gtgttttgaagattagttggataaa

SEQ ID NO: 91632 - DNA, 25 bp, Homo sapien
gattagttggataaaaatggagtta

SEQ ID NO: 91633 - DNA, 25 bp, Homo sapien
gttaaagaaaattgaccaggcgtgg

SEQ ID NO: 91634 - DNA, 25 bp, Homo sapien
ttaaagaaaattgaccaggcgtggt

SEQ ID NO: 91635 - DNA, 25 bp, Homo sapien
taaagaaaattgaccaggcgtggtg

SEQ ID NO: 91636 - DNA, 25 bp, Homo sapien
aagaaaattgaccaggcgtggtggc

SEQ ID NO: 91637 - DNA, 25 bp, Homo sapien
agaaaattgaccaggcgtggtggct

SEQ ID NO: 91638 - DNA, 25 bp, Homo sapien
gaaaattgaccaggcgtggtggctc

SEQ ID NO: 91639 - DNA, 25 bp, Homo sapien
aggttgctgtaagttgagatcgcca

SEQ ID NO: 91640 - DNA, 25 bp, Homo sapien
ggttgctgtaagttgagatcgccac

SEQ ID NO: 91641 - DNA, 25 bp, Homo sapien
gttgctgtaagttgagatcgccact

SEQ ID NO: 91642 - DNA, 25 bp, Homo sapien
agcctgggaaatagagtgagcaaga

SEQ ID NO: 91643 - DNA, 25 bp, Homo sapien
gcctgggaaatagagtgagcaagac

SEQ ID NO: 91644 - DNA, 25 bp, Homo sapien
cctgggaaatagagtgagcaagact

SEQ ID NO: 91645 - DNA, 25 bp, Homo sapien
ctgggaaatagagtgagcaagactc

SEQ ID NO: 91646 - DNA, 25 bp, Homo sapien
tgggaaatagagtgagcaagactca

SEQ ID NO: 91647 - DNA, 25 bp, Homo sapien
gggaaatagagtgagcaagactcag

SEQ ID NO: 91648 - DNA, 25 bp, Homo sapien
ggaaatagagtgagcaagactcagt

SEQ ID NO: 91649 - DNA, 25 bp, Homo sapien
gagcaagactcagtgccccctaccc

SEQ ID NO: 91650 - DNA, 25 bp, Homo sapien
agcctttgcttctggataactcact

SEQ ID NO: 91651 - DNA, 25 bp, Homo sapien
aaagagctcttcacgtttcttgaga

SEQ ID NO: 91652 - DNA, 25 bp, Homo sapien
gagctcttcacgtttcttgagaatt

SEQ ID NO: 91653 - DNA, 25 bp, Homo sapien
gtttcttgagaattatctgaagcca

SEQ ID NO: 91654 - DNA, 25 bp, Homo sapien
atctgaagccagttgcattctgtga

SEQ ID NO: 91655 - DNA, 25 bp, Homo sapien
gccagttgcattctgtgatatcagt

SEQ ID NO: 91656 - DNA, 25 bp, Homo sapien
gatatcagttttgaaggcacatggt

SEQ ID NO: 91657 - DNA, 25 bp, Homo sapien
tctgctttagatttatcccatatgc

SEQ ID NO: 91658 - DNA, 25 bp, Homo sapien
tgctattgtttaatactggatgtat

SEQ ID NO: 91659 - DNA, 25 bp, Homo sapien
gttttactgcactgtattgaattgg

SEQ ID NO: 91660 - DNA, 25 bp, Homo sapien
aattggtgtcttttgcacagttagc

SEQ ID NO: 91661 - DNA, 25 bp, Homo sapien
atgcccttttttctatctaaagtca

SEQ ID NO: 91662 - DNA, 25 bp, Homo sapien
ttttttctatctaaagtcagcttgt

SEQ ID NO: 91663 - DNA, 25 bp, Homo sapien
aaagtcagcttgttagcctaggaat

SEQ ID NO: 91664 - DNA, 25 bp, Homo sapien
gttagcctaggaatatatgcatgtg

SEQ ID NO: 91665 - DNA, 25 bp, Homo sapien
gtgtgtataattatagtttgaccaa

SEQ ID NO: 91666 - DNA, 25 bp, Homo sapien
tgaccaaaactttattatgtctaaa

SEQ ID NO: 91667 - DNA, 25 bp, Homo sapien
ttgttttacacacacatcccacgcg

SEQ ID NO: 91668 - DNA, 25 bp, Homo sapien
caccctagaggtttaaatattcaga

SEQ ID NO: 91669 - DNA, 25 bp, Homo sapien
cagaaactacaacatttttcccctg

SEQ ID NO: 91670 - DNA, 25 bp, Homo sapien
cttcagcagaactcttgtcatgtag

SEQ ID NO: 91671 - DNA, 25 bp, Homo sapien
agaactcttgtcatgtagtgtacat

SEQ ID NO: 91672 - DNA, 25 bp, Homo sapien
gctcgtcggtcagcgacgtggacca

SEQ ID NO: 91673 - DNA, 25 bp, Homo sapien
tcgtcggtcagcgacgtggaccagg

SEQ ID NO: 91674 - DNA, 25 bp, Homo sapien
cgtcggtcagcgacgtggaccagga

SEQ ID NO: 91675 - DNA, 25 bp, Homo sapien
gtcggtcagcgacgtggaccaggag

SEQ ID NO: 91676 - DNA, 25 bp, Homo sapien
tcggtcagcgacgtggaccaggagg

SEQ ID NO: 91677 - DNA, 25 bp, Homo sapien
cggtcagcgacgtggaccaggagga

SEQ ID NO: 91678 - DNA, 25 bp, Homo sapien
ggtcagcgacgtggaccaggaggag

SEQ ID NO: 91679 - DNA, 25 bp, Homo sapien
gagccgcggttcggggccgtggcca

SEQ ID NO: 91680 - DNA, 25 bp, Homo sapien
gtggccaccgtcaacctggccacgg

SEQ ID NO: 91681 - DNA, 25 bp, Homo sapien
tggccaccgtcaacctggccacggg

SEQ ID NO: 91682 - DNA, 25 bp, Homo sapien
actactctgtgctaattgttctgcc

SEQ ID NO: 91683 - DNA, 25 bp, Homo sapien
ttgttctgccagtatgggcgcatca

SEQ ID NO: 91684 - DNA, 25 bp, Homo sapien
agtatgggcgcatcagctccatcct

SEQ ID NO: 91685 - DNA, 25 bp, Homo sapien
aaactttgtaggcaccttctgcttc

SEQ ID NO: 91686 - DNA, 25 bp, Homo sapien
tctctgcttcattgttcctgtgata

SEQ ID NO: 91687 - DNA, 25 bp, Homo sapien
gttcctgtgatagtcctgttgttat

SEQ ID NO: 91688 - DNA, 25 bp, Homo sapien
aaacagcctcacattgttacaggag

SEQ ID NO: 91689 - DNA, 25 bp, Homo sapien
ggaggcaggccaggacatcaaagtc

SEQ ID NO: 91690 - DNA, 25 bp, Homo sapien
ttatgtggcatgactcttaagaggc

SEQ ID NO: 91691 - DNA, 25 bp, Homo sapien
taagaggccattactgtatctcatg

SEQ ID NO: 91692 - DNA, 25 bp, Homo sapien
tatctcatggcctcttgatgtggaa

SEQ ID NO: 91693 - DNA, 25 bp, Homo sapien
gtttgctgacccctgttctatttaa

SEQ ID NO: 91694 - DNA, 25 bp, Homo sapien
tgctgacccctgttctatttaataa

SEQ ID NO: 91695 - DNA, 25 bp, Homo sapien
tacaaataattcattccaggtcagt

SEQ ID NO: 91696 - DNA, 25 bp, Homo sapien
taattcattccaggtcagttttaga

SEQ ID NO: 91697 - DNA, 25 bp, Homo sapien
attccaggtcagttttagatgtttt

SEQ ID NO: 91698 - DNA, 25 bp, Homo sapien
ggtttatcaaccttctctacatatc

SEQ ID NO: 91699 - DNA, 25 bp, Homo sapien
tttatcaaccttctctacatatcca

SEQ ID NO: 91700 - DNA, 25 bp, Homo sapien
acatatccactgtgatattcatgca

SEQ ID NO: 91701 - DNA, 25 bp, Homo sapien
tccactgtgatattcatgcaatgtt

SEQ ID NO: 91702 - DNA, 25 bp, Homo sapien
aatgtatctatactatattccaata

SEQ ID NO: 91703 - DNA, 25 bp, Homo sapien
gtgaaaaatctgaatgctcattaaa

SEQ ID NO: 91704 - DNA, 25 bp, Homo sapien
ttagcctctgactatattagtatac

SEQ ID NO: 91705 - DNA, 25 bp, Homo sapien
gagaccaggtgaatagtcactatca

SEQ ID NO: 91706 - DNA, 25 bp, Homo sapien
gtggagacaagcacagcacacagac

SEQ ID NO: 91707 - DNA, 25 bp, Homo sapien
ggttggaacccatcagtgatcgcat

SEQ ID NO: 91708 - DNA, 25 bp, Homo sapien
gtgatcgcatattcattgatgaggg

SEQ ID NO: 91709 - DNA, 25 bp, Homo sapien
aaatggtggctcctttctgtcttat

SEQ ID NO: 91710 - DNA, 25 bp, Homo sapien
ctgtcttatctcctagtttcttcaa

SEQ ID NO: 91711 - DNA, 25 bp, Homo sapien
tagtttcttcaatgcttacgccttg

SEQ ID NO: 91712 - DNA, 25 bp, Homo sapien
cttacgccttgttcttctcaagaga

SEQ ID NO: 91713 - DNA, 25 bp, Homo sapien
gaaagttgtaactctctggtcttca

SEQ ID NO: 91714 - DNA, 25 bp, Homo sapien
tctggtcttcatatgtccctgtgct

SEQ ID NO: 91715 - DNA, 25 bp, Homo sapien
gctcaaggatgattccttgctgctg

SEQ ID NO: 91716 - DNA, 25 bp, Homo sapien
cttgctgctgcttatgttctgttgt

SEQ ID NO: 91717 - DNA, 25 bp, Homo sapien
ctgctgcttatgttctgttgttttt

SEQ ID NO: 91718 - DNA, 25 bp, Homo sapien
ctgttgtttttaggatggagctggt

SEQ ID NO: 91719 - DNA, 25 bp, Homo sapien
ggagctggttgttattcaccaacta

SEQ ID NO: 91720 - DNA, 25 bp, Homo sapien
attcaccaactaagggaacagttag

SEQ ID NO: 91721 - DNA, 25 bp, Homo sapien
tcctcctaaccctcatcagttaagg

SEQ ID NO: 91722 - DNA, 25 bp, Homo sapien
gaagaacaagatgccataatgccta

SEQ ID NO: 91723 - DNA, 25 bp, Homo sapien
tgccataatgcctatgaagacttct

SEQ ID NO: 91724 - DNA, 25 bp, Homo sapien
gaagacttctttaacaatcttgttt

SEQ ID NO: 91725 - DNA, 25 bp, Homo sapien
tagtgttttatggtctatgttcttt

SEQ ID NO: 91726 - DNA, 25 bp, Homo sapien
ccacccaagtctcaggtagacttgt

SEQ ID NO: 91727 - DNA, 25 bp, Homo sapien
gtctcaggtagacttgtaatcccca

SEQ ID NO: 91728 - DNA, 25 bp, Homo sapien
gtggatttctcccttactgttctca

SEQ ID NO: 91729 - DNA, 25 bp, Homo sapien
cttcctctttctccggccatgtaag

SEQ ID NO: 91730 - DNA, 25 bp, Homo sapien
tctttctccggccatgtaagatatg

SEQ ID NO: 91731 - DNA, 25 bp, Homo sapien
ctttctccggccatgtaagatatgc

SEQ ID NO: 91732 - DNA, 25 bp, Homo sapien
tttctccggccatgtaagatatgcc

SEQ ID NO: 91733 - DNA, 25 bp, Homo sapien
ttctccggccatgtaagatatgcct

SEQ ID NO: 91734 - DNA, 25 bp, Homo sapien
tctccggccatgtaagatatgcctc

SEQ ID NO: 91735 - DNA, 25 bp, Homo sapien
gccatgtaagatatgcctccttctc

SEQ ID NO: 91736 - DNA, 25 bp, Homo sapien
tatagcctgcgggactgtgagtcaa

SEQ ID NO: 91737 - DNA, 25 bp, Homo sapien
aggaaagaagcacgttccctcagct

SEQ ID NO: 91738 - DNA, 25 bp, Homo sapien
gttccctcagctcttaaggaggctg

SEQ ID NO: 91739 - DNA, 25 bp, Homo sapien
ggaggctgacagtttaatgagaaga

SEQ ID NO: 91740 - DNA, 25 bp, Homo sapien
aagagacacatgaggctttcgagcc

SEQ ID NO: 91741 - DNA, 25 bp, Homo sapien
atgaggctttcgagccatgagccca

SEQ ID NO: 91742 - DNA, 25 bp, Homo sapien
tttcgagccatgagcccaggaagta

SEQ ID NO: 91743 - DNA, 25 bp, Homo sapien
tgagcccaggaagtaagttggtttt

SEQ ID NO: 91744 - DNA, 25 bp, Homo sapien
taagttggtttttctagtagggatg

SEQ ID NO: 91745 - DNA, 25 bp, Homo sapien
aagagctggtgaataatggagccat

SEQ ID NO: 91746 - DNA, 25 bp, Homo sapien
aatggagccatagatctgagttcaa

SEQ ID NO: 91747 - DNA, 25 bp, Homo sapien
agccatagatctgagttcaaatccc

SEQ ID NO: 91748 - DNA, 25 bp, Homo sapien
taaaaaaattcaaagaggccaggcg

SEQ ID NO: 91749 - DNA, 25 bp, Homo sapien
aaaaattcaaagaggccaggcgcag

SEQ ID NO: 91750 - DNA, 25 bp, Homo sapien
aaaattcaaagaggccaggcgcagt

SEQ ID NO: 91751 - DNA, 25 bp, Homo sapien
aaattcaaagaggccaggcgcagtg

SEQ ID NO: 91752 - DNA, 25 bp, Homo sapien
aattcaaagaggccaggcgcagtgg

SEQ ID NO: 91753 - DNA, 25 bp, Homo sapien
attcaaagaggccaggcgcagtggc

SEQ ID NO: 91754 - DNA, 25 bp, Homo sapien
aggatcatgaggtcaagggatcgag

SEQ ID NO: 91755 - DNA, 25 bp, Homo sapien
tgcattacagcctggtgcagagcaa

SEQ ID NO: 91756 - DNA, 25 bp, Homo sapien
gcattacagcctggtgcagagcaag

SEQ ID NO: 91757 - DNA, 25 bp, Homo sapien
cattacagcctggtgcagagcaaga

SEQ ID NO: 91758 - DNA, 25 bp, Homo sapien
attacagcctggtgcagagcaagac

SEQ ID NO: 91759 - DNA, 25 bp, Homo sapien
ggaagtcttcaccatccctcttacg

SEQ ID NO: 91760 - DNA, 25 bp, Homo sapien
ctcttacgctgtgtcaacctgttga

SEQ ID NO: 91761 - DNA, 25 bp, Homo sapien
cttacgctgtgtcaacctgttgatt

SEQ ID NO: 91762 - DNA, 25 bp, Homo sapien
tacgctgtgtcaacctgttgattta

SEQ ID NO: 91763 - DNA, 25 bp, Homo sapien
cgctgtgtcaacctgttgatttata

SEQ ID NO: 91764 - DNA, 25 bp, Homo sapien
tcaacctgttgatttataagatggg

SEQ ID NO: 91765 - DNA, 25 bp, Homo sapien
taagatgggtttgatggctgagcac

SEQ ID NO: 91766 - DNA, 25 bp, Homo sapien
gtttgatggctgagcacggtatctc

SEQ ID NO: 91767 - DNA, 25 bp, Homo sapien
ttgatggctgagcacggtatctcac

SEQ ID NO: 91768 - DNA, 25 bp, Homo sapien
gatggctgagcacggtatctcacgc

SEQ ID NO: 91769 - DNA, 25 bp, Homo sapien
tggctgagcacggtatctcacgcct

SEQ ID NO: 91770 - DNA, 25 bp, Homo sapien
agtatacaactaaaaatctcctgcc

SEQ ID NO: 91771 - DNA, 25 bp, Homo sapien
ttctgttacagaatttgttcctcaa

SEQ ID NO: 91772 - DNA, 25 bp, Homo sapien
tgttcctcaaagtagatgcaatgtt

SEQ ID NO: 91773 - DNA, 25 bp, Homo sapien
gaatgtcgttgaagtctattttgag

SEQ ID NO: 91774 - DNA, 25 bp, Homo sapien
ctattttgagactgctaaagctatt

SEQ ID NO: 91775 - DNA, 25 bp, Homo sapien
ctgtgtttttatgcccaaatcccag

SEQ ID NO: 91776 - DNA, 25 bp, Homo sapien
atgcccaaatcccagtatgtttatg

SEQ ID NO: 91777 - DNA, 25 bp, Homo sapien
aataatgactcttacccagcgcatg

SEQ ID NO: 91778 - DNA, 25 bp, Homo sapien
acccagcgcatgtctttatcagtgt

SEQ ID NO: 91779 - DNA, 25 bp, Homo sapien
ttatcagtgtgtactcgtgacgatt

SEQ ID NO: 91780 - DNA, 25 bp, Homo sapien
tactcgtgacgatttgtgtgaaaat

SEQ ID NO: 91781 - DNA, 25 bp, Homo sapien
ttagatgatcactctttcaaaagac

SEQ ID NO: 91782 - DNA, 25 bp, Homo sapien
aagatgttgccctttctaatgctag

SEQ ID NO: 91783 - DNA, 25 bp, Homo sapien
gttgccctttctaatgctagttaac

SEQ ID NO: 91784 - DNA, 25 bp, Homo sapien
tctaatgctagttaacagttggaaa

SEQ ID NO: 91785 - DNA, 25 bp, Homo sapien
atataattgctctttgatagcatat

SEQ ID NO: 91786 - DNA, 25 bp, Homo sapien
ctccaatttttccatagtcctaact

SEQ ID NO: 91787 - DNA, 25 bp, Homo sapien
ttccatagtcctaactacaaatgct

SEQ ID NO: 91788 - DNA, 25 bp, Homo sapien
atgttttctgacaaagcactgaatt

SEQ ID NO: 91789 - DNA, 25 bp, Homo sapien
atctctaactcagtacaatttggac

SEQ ID NO: 91790 - DNA, 25 bp, Homo sapien
caatttggactattgaactgttctt

SEQ ID NO: 91791 - DNA, 25 bp, Homo sapien
gaagtaatcccagataataaattcc

SEQ ID NO: 91792 - DNA, 25 bp, Homo sapien
ttcagaggattttatgctggaaata

SEQ ID NO: 91793 - DNA, 25 bp, Homo sapien
ggatgcctgcctggaccctgttggt

SEQ ID NO: 91794 - DNA, 25 bp, Homo sapien
tgcctggaccctgttggtggctgaa

SEQ ID NO: 91795 - DNA, 25 bp, Homo sapien
tggtggctgaagacctctggccagc

SEQ ID NO: 91796 - DNA, 25 bp, Homo sapien
tggccagctggcttccgcccttggt

SEQ ID NO: 91797 - DNA, 25 bp, Homo sapien
gcagcagaactaggttttgagccac

SEQ ID NO: 91798 - DNA, 25 bp, Homo sapien
actaggttttgagccacgggtcagg

SEQ ID NO: 91799 - DNA, 25 bp, Homo sapien
ctgctggccccactgtgtcacagag

SEQ ID NO: 91800 - DNA, 25 bp, Homo sapien
cagcccctctgcagagacacaataa

SEQ ID NO: 91801 - DNA, 25 bp, Homo sapien
ggactgagcctcagatggctggatt

SEQ ID NO: 91802 - DNA, 25 bp, Homo sapien
tcagatggctggattttctctcagg

SEQ ID NO: 91803 - DNA, 25 bp, Homo sapien
gagtcaacagatgcgttttgtgtca

SEQ ID NO: 91804 - DNA, 25 bp, Homo sapien
gcgttttgtgtcaactcaggatcca

SEQ ID NO: 91805 - DNA, 25 bp, Homo sapien
gatccagtgattcgagtaggtaacc

SEQ ID NO: 91806 - DNA, 25 bp, Homo sapien
gtaggtaaccttgttgctccaaata

SEQ ID NO: 91807 - DNA, 25 bp, Homo sapien
gagatactgctttagaactccacat

SEQ ID NO: 91808 - DNA, 25 bp, Homo sapien
agaactccacatttttggtccaatt

SEQ ID NO: 91809 - DNA, 25 bp, Homo sapien
ttttggtccaatttctacagtcttt

SEQ ID NO: 91810 - DNA, 25 bp, Homo sapien
gtcttttagatgatgccaactcccc

SEQ ID NO: 91811 - DNA, 25 bp, Homo sapien
cttacctacctgatctgcatagaca

SEQ ID NO: 91812 - DNA, 25 bp, Homo sapien
gagtcaacttttctcttggctaact

SEQ ID NO: 91813 - DNA, 25 bp, Homo sapien
tcttggctaactcttgaagctgcat

SEQ ID NO: 91814 - DNA, 25 bp, Homo sapien
accctgtttctacacaaagttagct

SEQ ID NO: 91815 - DNA, 25 bp, Homo sapien
ctgtttctacacaaagttagctggg

SEQ ID NO: 91816 - DNA, 25 bp, Homo sapien
gtttctacacaaagttagctgggtc

SEQ ID NO: 91817 - DNA, 25 bp, Homo sapien
ttctacacaaagttagctgggtctg

SEQ ID NO: 91818 - DNA, 25 bp, Homo sapien
ctacacaaagttagctgggtctggt

SEQ ID NO: 91819 - DNA, 25 bp, Homo sapien
tagctgggtctggtgcctctgtggt

SEQ ID NO: 91820 - DNA, 25 bp, Homo sapien
gggtctggtgcctctgtggttccag

SEQ ID NO: 91821 - DNA, 25 bp, Homo sapien
agtgagcttatgttcatgactctgt

SEQ ID NO: 91822 - DNA, 25 bp, Homo sapien
gtgagcttatgttcatgactctgta

SEQ ID NO: 91823 - DNA, 25 bp, Homo sapien
gagcttatgttcatgactctgtatt

SEQ ID NO: 91824 - DNA, 25 bp, Homo sapien
gcttatgttcatgactctgtattcc

SEQ ID NO: 91825 - DNA, 25 bp, Homo sapien
cacagtgccactcccttggaaggga

SEQ ID NO: 91826 - DNA, 25 bp, Homo sapien
ggcttgggaagcctgaggcgggcct

SEQ ID NO: 91827 - DNA, 25 bp, Homo sapien
ccccagcacaattggcagagatgag

SEQ ID NO: 91828 - DNA, 25 bp, Homo sapien
ctgggctgtcgtggcagggtctgca

SEQ ID NO: 91829 - DNA, 25 bp, Homo sapien
cagggtctgcacagggccatgtcct

SEQ ID NO: 91830 - DNA, 25 bp, Homo sapien
gcacagggccatgtcctggctgtaa

SEQ ID NO: 91831 - DNA, 25 bp, Homo sapien
atgtcctggctgtaacccaggcagt

SEQ ID NO: 91832 - DNA, 25 bp, Homo sapien
aggtctgcagcctggtcatggcctc

SEQ ID NO: 91833 - DNA, 25 bp, Homo sapien
tggtcatggcctccacagcaggtcc

SEQ ID NO: 91834 - DNA, 25 bp, Homo sapien
acagcaggtccctgtggacagacat

SEQ ID NO: 91835 - DNA, 25 bp, Homo sapien
aggtccctgtggacagacatatctg

SEQ ID NO: 91836 - DNA, 25 bp, Homo sapien
tagactttggaggtagacccctggt

SEQ ID NO: 91837 - DNA, 25 bp, Homo sapien
tagtttgaggaagtcacttaacctt

SEQ ID NO: 91838 - DNA, 25 bp, Homo sapien
agactctggatttaataagctgtgt

SEQ ID NO: 91839 - DNA, 25 bp, Homo sapien
taagctgtgtaactggtactcgata

SEQ ID NO: 91840 - DNA, 25 bp, Homo sapien
taactggtactcgatagttacccaa

SEQ ID NO: 91841 - DNA, 25 bp, Homo sapien
agttacccaaagttcagtctagatg

SEQ ID NO: 91842 - DNA, 25 bp, Homo sapien
agtctagatggcacaaaccacctct

SEQ ID NO: 91843 - DNA, 25 bp, Homo sapien
gcacaaaccacctctcagggaataa

SEQ ID NO: 91844 - DNA, 25 bp, Homo sapien
gggaataaaccctaagacatcactc

SEQ ID NO: 91845 - DNA, 25 bp, Homo sapien
attttgaactgttttgtcctctctg

SEQ ID NO: 91846 - DNA, 25 bp, Homo sapien
tctctggccataaaacttgacagtc

SEQ ID NO: 91847 - DNA, 25 bp, Homo sapien
acttaccctcgcctggacatagaga

SEQ ID NO: 91848 - DNA, 25 bp, Homo sapien
taccctcgcctggacatagagaaag

SEQ ID NO: 91849 - DNA, 25 bp, Homo sapien
tggactgaagctatctatccgcctt

SEQ ID NO: 91850 - DNA, 25 bp, Homo sapien
actgaagctatctatccgccttagt

SEQ ID NO: 91851 - DNA, 25 bp, Homo sapien
gaagctatctatccgccttagtctc

SEQ ID NO: 91852 - DNA, 25 bp, Homo sapien
ggattacagcgtgatctaccacacc

SEQ ID NO: 91853 - DNA, 25 bp, Homo sapien
tggccaatcccaactactctggaag

SEQ ID NO: 91854 - DNA, 25 bp, Homo sapien
aaagcacgtcttggctcagctgctg

SEQ ID NO: 91855 - DNA, 25 bp, Homo sapien
gcacgtcttggctcagctgctgatt

SEQ ID NO: 91856 - DNA, 25 bp, Homo sapien
cgtcttggctcagctgctgatttaa

SEQ ID NO: 91857 - DNA, 25 bp, Homo sapien
tggctcagctgctgatttaagctgg

SEQ ID NO: 91858 - DNA, 25 bp, Homo sapien
ttggtccctgtggagacccggtctg

SEQ ID NO: 91859 - DNA, 25 bp, Homo sapien
tgggagatgagcaaacctgctgaat

SEQ ID NO: 91860 - DNA, 25 bp, Homo sapien
ggttttggaatgtgtgttcccggct

SEQ ID NO: 91861 - DNA, 25 bp, Homo sapien
ttggaatgtgtgttcccggctgtgt

SEQ ID NO: 91862 - DNA, 25 bp, Homo sapien
gatcctgggcaagaacttgacctcc

SEQ ID NO: 91863 - DNA, 25 bp, Homo sapien
tgggcaagaacttgacctccctgga

SEQ ID NO: 91864 - DNA, 25 bp, Homo sapien
gcaagaacttgacctccctggacgc

SEQ ID NO: 91865 - DNA, 25 bp, Homo sapien
cagcggcacccctcggttattaagg

SEQ ID NO: 91866 - DNA, 25 bp, Homo sapien
caaaatagttgtaatgcgcatggca

SEQ ID NO: 91867 - DNA, 25 bp, Homo sapien
atgcgcatggcaaagtgcccagcat

SEQ ID NO: 91868 - DNA, 25 bp, Homo sapien
gcatggcaaagtgcccagcatatag

SEQ ID NO: 91869 - DNA, 25 bp, Homo sapien
gaataccagaaatgccgtttacccg

SEQ ID NO: 91870 - DNA, 25 bp, Homo sapien
cagaaatgccgtttacccggagaat

SEQ ID NO: 91871 - DNA, 25 bp, Homo sapien
ttgtttttactcaatgacaccattt

SEQ ID NO: 91872 - DNA, 25 bp, Homo sapien
tttactcaatgacaccatttttagt

SEQ ID NO: 91873 - DNA, 25 bp, Homo sapien
agttttatttcctgatagcaaaagg

SEQ ID NO: 91874 - DNA, 25 bp, Homo sapien
cccctgttgtcggtgatttgtttgt

SEQ ID NO: 91875 - DNA, 25 bp, Homo sapien
gttgtcggtgatttgtttgtctttc

SEQ ID NO: 91876 - DNA, 25 bp, Homo sapien
cggtgatttgtttgtctttctgata

SEQ ID NO: 91877 - DNA, 25 bp, Homo sapien
tttgtttgtctttctgataggttga

SEQ ID NO: 91878 - DNA, 25 bp, Homo sapien
ataaacttgatgacgctgtcaatct

SEQ ID NO: 91879 - DNA, 25 bp, Homo sapien
gacgctgtcaatcttttatactgca

SEQ ID NO: 91880 - DNA, 25 bp, Homo sapien
tcctgtttagctcttaatgtatcta

SEQ ID NO: 91881 - DNA, 25 bp, Homo sapien
gtatctaaggatgttctcatctcac

SEQ ID NO: 91882 - DNA, 25 bp, Homo sapien
tcatctcaccattctactcatttag

SEQ ID NO: 91883 - DNA, 25 bp, Homo sapien
agtgagttttctgatcttgtttagg

SEQ ID NO: 91884 - DNA, 25 bp, Homo sapien
aggtacccttgcctgcagtagttct

SEQ ID NO: 91885 - DNA, 25 bp, Homo sapien
gcagtagttctgtttcctgtagaaa

SEQ ID NO: 91886 - DNA, 25 bp, Homo sapien
gttcttactagcttgggagttacct

SEQ ID NO: 91887 - DNA, 25 bp, Homo sapien
gggagttacctgattaaccagagaa

SEQ ID NO: 91888 - DNA, 25 bp, Homo sapien
gagaaaatttttggcttacttatgg

SEQ ID NO: 91889 - DNA, 25 bp, Homo sapien
tggaacaagcattatttcttctttg

SEQ ID NO: 91890 - DNA, 25 bp, Homo sapien
agatctaaatatggtccttgacttt

SEQ ID NO: 91891 - DNA, 25 bp, Homo sapien
tgaactgggacaccattcacgtgat

SEQ ID NO: 91892 - DNA, 25 bp, Homo sapien
cattcacgtgatgggccagatgggc

SEQ ID NO: 91893 - DNA, 25 bp, Homo sapien
gtccgggtgggaacgctgtgtctgt

SEQ ID NO: 91894 - DNA, 25 bp, Homo sapien
tgtctgttggtctggtgctgcttat

SEQ ID NO: 91895 - DNA, 25 bp, Homo sapien
tggtgctgcttatgtggctggttca

SEQ ID NO: 91896 - DNA, 25 bp, Homo sapien
tatgtggctggttcaggtctgtcat

SEQ ID NO: 91897 - DNA, 25 bp, Homo sapien
tggttcaggtctgtcatccgtcaac

SEQ ID NO: 91898 - DNA, 25 bp, Homo sapien
gtcatccgtcaacctgcatatttat

SEQ ID NO: 91899 - DNA, 25 bp, Homo sapien
cctgcatatttatcactggtgcatt

SEQ ID NO: 91900 - DNA, 25 bp, Homo sapien
atcactggtgcattttcatgtatgt

SEQ ID NO: 91901 - DNA, 25 bp, Homo sapien
gcattttcatgtatgttgtacctca

SEQ ID NO: 91902 - DNA, 25 bp, Homo sapien
gagttttcagtacacatgccacagt

SEQ ID NO: 91903 - DNA, 25 bp, Homo sapien
acagtgacctctttggccagcttaa

SEQ ID NO: 91904 - DNA, 25 bp, Homo sapien
ggccagcttaaaggatttcccattc

SEQ ID NO: 91905 - DNA, 25 bp, Homo sapien
ggatttcccattcaatctactcatc

SEQ ID NO: 91906 - DNA, 25 bp, Homo sapien
tgtcctttgtcctccgattactaga

SEQ ID NO: 91907 - DNA, 25 bp, Homo sapien
tttgtcctccgattactagatagaa

SEQ ID NO: 91908 - DNA, 25 bp, Homo sapien
agcaaagcaagaaggcaatgcccca

SEQ ID NO: 91909 - DNA, 25 bp, Homo sapien
ggcaatgccccaaaagaaggccagt

SEQ ID NO: 91910 - DNA, 25 bp, Homo sapien
gaaggccagtcgatgggcattaata

SEQ ID NO: 91911 - DNA, 25 bp, Homo sapien
ggattgctgtgaaaatgcctcgagc

SEQ ID NO: 91912 - DNA, 25 bp, Homo sapien
atgcctcgagcactgagaatgcaca

SEQ ID NO: 91913 - DNA, 25 bp, Homo sapien
tgaaggtgattttaggtagaagagt

SEQ ID NO: 91914 - DNA, 25 bp, Homo sapien
gaaggtgattttaggtagaagagtt

SEQ ID NO: 91915 - DNA, 25 bp, Homo sapien
ttttaggtagaagagttttgaggct

SEQ ID NO: 91916 - DNA, 25 bp, Homo sapien
tttaggtagaagagttttgaggctg

SEQ ID NO: 91917 - DNA, 25 bp, Homo sapien
aggtagaagagttttgaggctgggc

SEQ ID NO: 91918 - DNA, 25 bp, Homo sapien
gtagaagagttttgaggctgggcgc

SEQ ID NO: 91919 - DNA, 25 bp, Homo sapien
agagttttgaggctgggcgcaatgg

SEQ ID NO: 91920 - DNA, 25 bp, Homo sapien
cctagcattttgggtgactgaggcg

SEQ ID NO: 91921 - DNA, 25 bp, Homo sapien
ctagcattttgggtgactgaggcgg

SEQ ID NO: 91922 - DNA, 25 bp, Homo sapien
cagcctgagaaataaggtgaaaccc

SEQ ID NO: 91923 - DNA, 25 bp, Homo sapien
aggctgcagtgagttctaattgcgc

SEQ ID NO: 91924 - DNA, 25 bp, Homo sapien
gaatattttcttaggattcccagaa

SEQ ID NO: 91925 - DNA, 25 bp, Homo sapien
ttttcttaggattcccagaatagtg

SEQ ID NO: 91926 - DNA, 25 bp, Homo sapien
ggattcccagaatagtgattattga

SEQ ID NO: 91927 - DNA, 25 bp, Homo sapien
gaatgttttcatagttaatggttta

SEQ ID NO: 91928 - DNA, 25 bp, Homo sapien
ttcatagttaatggtttatattgcc

SEQ ID NO: 91929 - DNA, 25 bp, Homo sapien
atattgccagattgcgttcatactc

SEQ ID NO: 91930 - DNA, 25 bp, Homo sapien
ttgccagattgcgttcatactctcc

SEQ ID NO: 91931 - DNA, 25 bp, Homo sapien
cagattgcgttcatactctccaaat

SEQ ID NO: 91932 - DNA, 25 bp, Homo sapien
gattgcgttcatactctccaaatta

SEQ ID NO: 91933 - DNA, 25 bp, Homo sapien
gcgttcatactctccaaattaatgt

SEQ ID NO: 91934 - DNA, 25 bp, Homo sapien
catactctccaaattaatgtattgg

SEQ ID NO: 91935 - DNA, 25 bp, Homo sapien
agacaggatacattcttgttcactc

SEQ ID NO: 91936 - DNA, 25 bp, Homo sapien
tcttccctgttgataggaggttttg

SEQ ID NO: 91937 - DNA, 25 bp, Homo sapien
ttgtaggttttgtgtgcagtgtttc

SEQ ID NO: 91938 - DNA, 25 bp, Homo sapien
agtgtttctattcctgctgatttct

SEQ ID NO: 91939 - DNA, 25 bp, Homo sapien
tattcctgctgatttcttagttgaa

SEQ ID NO: 91940 - DNA, 25 bp, Homo sapien
aaactggtgtaatacctcaagggat

SEQ ID NO: 91941 - DNA, 25 bp, Homo sapien
aatacctcaagggatgtagacaaat

SEQ ID NO: 91942 - DNA, 25 bp, Homo sapien
ggatgtagacaaatactcaaggtta

SEQ ID NO: 91943 - DNA, 25 bp, Homo sapien
tctgaaacttgatgagcacccaaat

SEQ ID NO: 91944 - DNA, 25 bp, Homo sapien
acttgatgagcacccaaatgccgct

SEQ ID NO: 91945 - DNA, 25 bp, Homo sapien
caaatgccgctcaaaggcaatgctc

SEQ ID NO: 91946 - DNA, 25 bp, Homo sapien
gggcgtgttccttgctatgtagcta

SEQ ID NO: 91947 - DNA, 25 bp, Homo sapien
gttccttgctatgtagctagctgca

SEQ ID NO: 91948 - DNA, 25 bp, Homo sapien
tgctatgtagctagctgcagcgtcc

SEQ ID NO: 91949 - DNA, 25 bp, Homo sapien
tgtagctagctgcagcgtccccttt

SEQ ID NO: 91950 - DNA, 25 bp, Homo sapien
gcagctgcagtcagcagggttgttt

SEQ ID NO: 91951 - DNA, 25 bp, Homo sapien
gcagggttgtttgagactatttatt

SEQ ID NO: 91952 - DNA, 25 bp, Homo sapien
ttgagactatttattggttgctgta

SEQ ID NO: 91953 - DNA, 25 bp, Homo sapien
gactatttattggttgctgtagatt

SEQ ID NO: 91954 - DNA, 25 bp, Homo sapien
ttttgaaaggccaattctgtatttt

SEQ ID NO: 91955 - DNA, 25 bp, Homo sapien
ttaagctaacaacacagatcccatg

SEQ ID NO: 91956 - DNA, 25 bp, Homo sapien
aaccgttcaggttacttgcatggag

SEQ ID NO: 91957 - DNA, 25 bp, Homo sapien
catgcctggctgtatttttggtaaa

SEQ ID NO: 91958 - DNA, 25 bp, Homo sapien
actgcgtccggtccatctgacttct

SEQ ID NO: 91959 - DNA, 25 bp, Homo sapien
cttctcaaagactttagaccttgac

SEQ ID NO: 91960 - DNA, 25 bp, Homo sapien
aagactttagaccttgacttcagtg

SEQ ID NO: 91961 - DNA, 25 bp, Homo sapien
gactttagaccttgacttcagtgat

SEQ ID NO: 91962 - DNA, 25 bp, Homo sapien
ttagaccttgacttcagtgatttgt

SEQ ID NO: 91963 - DNA, 25 bp, Homo sapien
gaccttgacttcagtgatttgttgt

SEQ ID NO: 91964 - DNA, 25 bp, Homo sapien
cagtgatttgttgtagtcttgtatg

SEQ ID NO: 91965 - DNA, 25 bp, Homo sapien
tttgttgtagtcttgtatgcttctc

SEQ ID NO: 91966 - DNA, 25 bp, Homo sapien
gttgtagtcttgtatgcttctctat

SEQ ID NO: 91967 - DNA, 25 bp, Homo sapien
tgtagtcttgtatgcttctctataa

SEQ ID NO: 91968 - DNA, 25 bp, Homo sapien
ttagttaagagatttgtagtaggca

SEQ ID NO: 91969 - DNA, 25 bp, Homo sapien
gttaagagatttgtagtaggcattt

SEQ ID NO: 91970 - DNA, 25 bp, Homo sapien
ttaagagatttgtagtaggcatttt

SEQ ID NO: 91971 - DNA, 25 bp, Homo sapien
gagatttgtagtaggcattttttag

SEQ ID NO: 91972 - DNA, 25 bp, Homo sapien
gtaggcattttttagaaagttgcat

SEQ ID NO: 91973 - DNA, 25 bp, Homo sapien
tagaaagttgcattgagggctaggt

SEQ ID NO: 91974 - DNA, 25 bp, Homo sapien
agaaagttgcattgagggctaggta

SEQ ID NO: 91975 - DNA, 25 bp, Homo sapien
gaaagttgcattgagggctaggtac

SEQ ID NO: 91976 - DNA, 25 bp, Homo sapien
aaagttgcattgagggctaggtacg

SEQ ID NO: 91977 - DNA, 25 bp, Homo sapien
cattgagggctaggtacggtggctc

SEQ ID NO: 91978 - DNA, 25 bp, Homo sapien
attgagggctaggtacggtggctca

SEQ ID NO: 91979 - DNA, 25 bp, Homo sapien
ggtgtcgatgtccagagagttccta

SEQ ID NO: 91980 - DNA, 25 bp, Homo sapien
gagagttcctagaagccgtaattga

SEQ ID NO: 91981 - DNA, 25 bp, Homo sapien
attgaagacacaatccagtcatcct

SEQ ID NO: 91982 - DNA, 25 bp, Homo sapien
gtcatcctgggaccctaaatgacct

SEQ ID NO: 91983 - DNA, 25 bp, Homo sapien
aaacctgacttgaatcacctggact

SEQ ID NO: 91984 - DNA, 25 bp, Homo sapien
cacctggactatttttctgagagag

SEQ ID NO: 91985 - DNA, 25 bp, Homo sapien
taattgggtttgacctattccaagt

SEQ ID NO: 91986 - DNA, 25 bp, Homo sapien
agttttttgggctatctgttacagt

SEQ ID NO: 91987 - DNA, 25 bp, Homo sapien
acagtgcttagcttatctcacctaa

SEQ ID NO: 91988 - DNA, 25 bp, Homo sapien
gcttatctcacctaatacagggact

SEQ ID NO: 91989 - DNA, 25 bp, Homo sapien
acagggactatgcaaccaagaaact

SEQ ID NO: 91990 - DNA, 25 bp, Homo sapien
gagagacggataagttgtcacacag

SEQ ID NO: 91991 - DNA, 25 bp, Homo sapien
attcgttcatcaaatgcacacgagg

SEQ ID NO: 91992 - DNA, 25 bp, Homo sapien
gcacacgaggcacaaatgggaatca

SEQ ID NO: 91993 - DNA, 25 bp, Homo sapien
gtgctgtgatgaagagaagtcctgc

SEQ ID NO: 91994 - DNA, 25 bp, Homo sapien
aagagaagtcctgccctgaacaagg

SEQ ID NO: 91995 - DNA, 25 bp, Homo sapien
aagtcctgccctgaacaaggtggcg

SEQ ID NO: 91996 - DNA, 25 bp, Homo sapien
ctgccctgaacaaggtggcgctgtg

SEQ ID NO: 91997 - DNA, 25 bp, Homo sapien
atcagatttgtctgcggaggtgtta

SEQ ID NO: 91998 - DNA, 25 bp, Homo sapien
atttgtctgcggaggtgttatggac

SEQ ID NO: 91999 - DNA, 25 bp, Homo sapien
tgtgttgaaggcctaacccccatgt

SEQ ID NO: 92000 - DNA, 25 bp, Homo sapien
aggcctaacccccatgtgactgtat

SEQ ID NO: 92001 - DNA, 25 bp, Homo sapien
agcctattttggatgaacaagttta

SEQ ID NO: 92002 - DNA, 25 bp, Homo sapien
gataaactgactaatgtgtcctcca

SEQ ID NO: 92003 - DNA, 25 bp, Homo sapien
aatgtgtcctccagtttagaatttc

SEQ ID NO: 92004 - DNA, 25 bp, Homo sapien
tagaatttcaccttacccgacccag

SEQ ID NO: 92005 - DNA, 25 bp, Homo sapien
gacccaggcacttcttaaaaacaca

SEQ ID NO: 92006 - DNA, 25 bp, Homo sapien
agctctgccagcatcaaggctttta

SEQ ID NO: 92007 - DNA, 25 bp, Homo sapien
tatgtagtatttaggccatttaaac

SEQ ID NO: 92008 - DNA, 25 bp, Homo sapien
ggccatttaaaccatacttattact

SEQ ID NO: 92009 - DNA, 25 bp, Homo sapien
tattactcaataacccaagaaacaa

SEQ ID NO: 92010 - DNA, 25 bp, Homo sapien
aacaattttgggttagccatctaat

SEQ ID NO: 92011 - DNA, 25 bp, Homo sapien
gggttagccatctaatatagcaaat

SEQ ID NO: 92012 - DNA, 25 bp, Homo sapien
gaggccttctctaggcgccggcgct

SEQ ID NO: 92013 - DNA, 25 bp, Homo sapien
aggccttctctaggcgccggcgctg

SEQ ID NO: 92014 - DNA, 25 bp, Homo sapien
gggaccgactgctcttggcgcccgg

SEQ ID NO: 92015 - DNA, 25 bp, Homo sapien
ggaccgactgctcttggcgcccggg

SEQ ID NO: 92016 - DNA, 25 bp, Homo sapien
accgactgctcttggcgcccggggt

SEQ ID NO: 92017 - DNA, 25 bp, Homo sapien
gggcctcgcttcagccgggcgattc

SEQ ID NO: 92018 - DNA, 25 bp, Homo sapien
agccgggcgattcttcccctcattt

SEQ ID NO: 92019 - DNA, 25 bp, Homo sapien
gccgggcgattcttcccctcatttg

SEQ ID NO: 92020 - DNA, 25 bp, Homo sapien
ccgggcgattcttcccctcatttgt

SEQ ID NO: 92021 - DNA, 25 bp, Homo sapien
cgggcgattcttcccctcatttgtt

SEQ ID NO: 92022 - DNA, 25 bp, Homo sapien
gcgattcttcccctcatttgttgca

SEQ ID NO: 92023 - DNA, 25 bp, Homo sapien
aaacaggtgattttctcagcagaac

SEQ ID NO: 92024 - DNA, 25 bp, Homo sapien
acttatgagttgatgcggtgtctgg

SEQ ID NO: 92025 - DNA, 25 bp, Homo sapien
cggtgtctggaggacttgacgtcaa

SEQ ID NO: 92026 - DNA, 25 bp, Homo sapien
gaagacctgtgcatggagaatctga

SEQ ID NO: 92027 - DNA, 25 bp, Homo sapien
gaatctgataccgagcagctccagg

SEQ ID NO: 92028 - DNA, 25 bp, Homo sapien
tgatgacatagagaccaccaaggtg

SEQ ID NO: 92029 - DNA, 25 bp, Homo sapien
atgctgagactttctctggcacgaa

SEQ ID NO: 92030 - DNA, 25 bp, Homo sapien
tggcacgaaatcttgctcgggcaat

SEQ ID NO: 92031 - DNA, 25 bp, Homo sapien
agaaggctcactggaaggttcctga

SEQ ID NO: 92032 - DNA, 25 bp, Homo sapien
ggttcctgagaactgcttcaatgtg

SEQ ID NO: 92033 - DNA, 25 bp, Homo sapien
caatgtggtatctttgtatggcaat

SEQ ID NO: 92034 - DNA, 25 bp, Homo sapien
ggaaaaggcaagactccacttcgaa

SEQ ID NO: 92035 - DNA, 25 bp, Homo sapien
ggcaagactccacttcgaaagaggt

SEQ ID NO: 92036 - DNA, 25 bp, Homo sapien
gactccacttcgaaagaggtacaac

SEQ ID NO: 92037 - DNA, 25 bp, Homo sapien
aggtacaactcccatcagatgggcc

SEQ ID NO: 92038 - DNA, 25 bp, Homo sapien
tcagatgggccagtcgaagcagttt

SEQ ID NO: 92039 - DNA, 25 bp, Homo sapien
gatgggccagtcgaagcagtttccc

SEQ ID NO: 92040 - DNA, 25 bp, Homo sapien
gtcgaagcagtttcccctcgaggaa

SEQ ID NO: 92041 - DNA, 25 bp, Homo sapien
aagcagtttcccctcgaggaaagca

SEQ ID NO: 92042 - DNA, 25 bp, Homo sapien
gtttcccctcgaggaaagcagctgt

SEQ ID NO: 92043 - DNA, 25 bp, Homo sapien
tgagaaaggctgtcaggtcaccagt

SEQ ID NO: 92044 - DNA, 25 bp, Homo sapien
aaggctgtcaggtcaccagtgagca

SEQ ID NO: 92045 - DNA, 25 bp, Homo sapien
acacatcatattaaaccatgcagaa

SEQ ID NO: 92046 - DNA, 25 bp, Homo sapien
cacatcatattaaaccatgcagaat

SEQ ID NO: 92047 - DNA, 25 bp, Homo sapien
acatcatattaaaccatgcagaatt

SEQ ID NO: 92048 - DNA, 25 bp, Homo sapien
catcatattaaaccatgcagaattg

SEQ ID NO: 92049 - DNA, 25 bp, Homo sapien
atcatattaaaccatgcagaattgg

SEQ ID NO: 92050 - DNA, 25 bp, Homo sapien
tcatattaaaccatgcagaattgga

SEQ ID NO: 92051 - DNA, 25 bp, Homo sapien
catattaaaccatgcagaattggag

SEQ ID NO: 92052 - DNA, 25 bp, Homo sapien
atattaaaccatgcagaattggagt

SEQ ID NO: 92053 - DNA, 25 bp, Homo sapien
tattaaaccatgcagaattggagta

SEQ ID NO: 92054 - DNA, 25 bp, Homo sapien
attaaaccatgcagaattggagtaa

SEQ ID NO: 92055 - DNA, 25 bp, Homo sapien
tctgatgtagttgcttaaagatctg

SEQ ID NO: 92056 - DNA, 25 bp, Homo sapien
gttgcttaaagatctgatgtgctat

SEQ ID NO: 92057 - DNA, 25 bp, Homo sapien
gcttaaagatctgatgtgctataat

SEQ ID NO: 92058 - DNA, 25 bp, Homo sapien
taaaatgctatcattctggatctga

SEQ ID NO: 92059 - DNA, 25 bp, Homo sapien
atccttccacaattagggatgcttt

SEQ ID NO: 92060 - DNA, 25 bp, Homo sapien
ccttccacaattagggatgctttta

SEQ ID NO: 92061 - DNA, 25 bp, Homo sapien
cacaattagggatgcttttatcccc

SEQ ID NO: 92062 - DNA, 25 bp, Homo sapien
tagggatgcttttatccccccatca

SEQ ID NO: 92063 - DNA, 25 bp, Homo sapien
ccccatcactaattgcagttgtttg

SEQ ID NO: 92064 - DNA, 25 bp, Homo sapien
attgcagttgtttgataccaaaata

SEQ ID NO: 92065 - DNA, 25 bp, Homo sapien
taaatttacgtagagatccttaact

SEQ ID NO: 92066 - DNA, 25 bp, Homo sapien
gtatatcaatgtctacttcaatagt

SEQ ID NO: 92067 - DNA, 25 bp, Homo sapien
gtctaaacttagactgcctttaatg

SEQ ID NO: 92068 - DNA, 25 bp, Homo sapien
tatggtccatgatctgtgagtatcc

SEQ ID NO: 92069 - DNA, 25 bp, Homo sapien
gtgagtatcctagattcaaacgcaa

SEQ ID NO: 92070 - DNA, 25 bp, Homo sapien
tcaaacgcaaatcattacagggtat

SEQ ID NO: 92071 - DNA, 25 bp, Homo sapien
ggtattgatgaaacagtgcctctct

SEQ ID NO: 92072 - DNA, 25 bp, Homo sapien
gtgcctctctgatcacttttaaaag

SEQ ID NO: 92073 - DNA, 25 bp, Homo sapien
ttagacctctctaccctagttaaca

SEQ ID NO: 92074 - DNA, 25 bp, Homo sapien
tctctaccctagttaacattccatt

SEQ ID NO: 92075 - DNA, 25 bp, Homo sapien
aacattccattcttaatttagtcac

SEQ ID NO: 92076 - DNA, 25 bp, Homo sapien
ttagtcacattttcagatttttggt

SEQ ID NO: 92077 - DNA, 25 bp, Homo sapien
ttacattaattcagtgtgcacttcg

SEQ ID NO: 92078 - DNA, 25 bp, Homo sapien
tcagtgtgcacttcgtaaggataat

SEQ ID NO: 92079 - DNA, 25 bp, Homo sapien
gtttagtattcaacagcttcctcta

SEQ ID NO: 92080 - DNA, 25 bp, Homo sapien
aacagcttcctctattcctttatat

SEQ ID NO: 92081 - DNA, 25 bp, Homo sapien
tatatgatctctgtatttaatagct

SEQ ID NO: 92082 - DNA, 25 bp, Homo sapien
agctgtggcataaagtttccaacta

SEQ ID NO: 92083 - DNA, 25 bp, Homo sapien
gtatcaagttttctttgtgatgttt

SEQ ID NO: 92084 - DNA, 25 bp, Homo sapien
ggatgacctggattgtcctagaact

SEQ ID NO: 92085 - DNA, 25 bp, Homo sapien
cctggattgtcctagaactttgttc

SEQ ID NO: 92086 - DNA, 25 bp, Homo sapien
gaactttgttccaacagattacatg

SEQ ID NO: 92087 - DNA, 25 bp, Homo sapien
acagattacatgtgttcataacgaa

SEQ ID NO: 92088 - DNA, 25 bp, Homo sapien
gcacagtgccactcccttggaaggg

SEQ ID NO: 92089 - DNA, 25 bp, Homo sapien
tgccactcccttggaagggagggaa

SEQ ID NO: 92090 - DNA, 25 bp, Homo sapien
ggcttgggaagcctgaggcgggcct

SEQ ID NO: 92091 - DNA, 25 bp, Homo sapien
ccccagcacaattggcagagatgag

SEQ ID NO: 92092 - DNA, 25 bp, Homo sapien
ctgggctgtcgtggcagggtctgca

SEQ ID NO: 92093 - DNA, 25 bp, Homo sapien
cagggtctgcacagggccatgtcct

SEQ ID NO: 92094 - DNA, 25 bp, Homo sapien
gcacagggccatgtcctggctgtaa

SEQ ID NO: 92095 - DNA, 25 bp, Homo sapien
agggccatgtcctggctgtaaccca

SEQ ID NO: 92096 - DNA, 25 bp, Homo sapien
atgtcctggctgtaacccaggcagt

SEQ ID NO: 92097 - DNA, 25 bp, Homo sapien
aggtctgcagcctggtcatggcctc

SEQ ID NO: 92098 - DNA, 25 bp, Homo sapien
tgcagcctggtcatggcctccacag

SEQ ID NO: 92099 - DNA, 25 bp, Homo sapien
tagctaggtcccgatatactcctgt

SEQ ID NO: 92100 - DNA, 25 bp, Homo sapien
gtcccgatatactcctgtcttgtga

SEQ ID NO: 92101 - DNA, 25 bp, Homo sapien
ctcctgtcttgtgagattgtcgaga

SEQ ID NO: 92102 - DNA, 25 bp, Homo sapien
tttcctccatagcaaggacgacctt

SEQ ID NO: 92103 - DNA, 25 bp, Homo sapien
atagcaaggacgaccttccctgctc

SEQ ID NO: 92104 - DNA, 25 bp, Homo sapien
tgcccagagtatagctagatccctt

SEQ ID NO: 92105 - DNA, 25 bp, Homo sapien
tccctaccctctgaatgtgtgctag

SEQ ID NO: 92106 - DNA, 25 bp, Homo sapien
aatgtgtgctagatcaggtgcccca

SEQ ID NO: 92107 - DNA, 25 bp, Homo sapien
atcaggtgccccactgtgtttcctg

SEQ ID NO: 92108 - DNA, 25 bp, Homo sapien
tgaaatccttgggagccggatctcc

SEQ ID NO: 92109 - DNA, 25 bp, Homo sapien
cccttttcttctctcagtgttgtct

SEQ ID NO: 92110 - DNA, 25 bp, Homo sapien
gatggctggatgtgctccaggccat

SEQ ID NO: 92111 - DNA, 25 bp, Homo sapien
gtgctccaggccatgctggaggtac

SEQ ID NO: 92112 - DNA, 25 bp, Homo sapien
ttctggcaccttctcaggacacaag

SEQ ID NO: 92113 - DNA, 25 bp, Homo sapien
tctcaggacacaagtggctgcccaa

SEQ ID NO: 92114 - DNA, 25 bp, Homo sapien
gcccaaccctgactcagagaatgag

SEQ ID NO: 92115 - DNA, 25 bp, Homo sapien
ggcttggacccctgggaatcaggcc

SEQ ID NO: 92116 - DNA, 25 bp, Homo sapien
gggctgagctccagagccgcaccat

SEQ ID NO: 92117 - DNA, 25 bp, Homo sapien
cgcaccatctgccacaaacagaatt

SEQ ID NO: 92118 - DNA, 25 bp, Homo sapien
gaattcgagacatacttaattttga

SEQ ID NO: 92119 - DNA, 25 bp, Homo sapien
aattttgaatttctccttgccacgt

SEQ ID NO: 92120 - DNA, 25 bp, Homo sapien
gaatttctccttgccacgttaataa

SEQ ID NO: 92121 - DNA, 25 bp, Homo sapien
gagtcttggtatccaggtattgctt

SEQ ID NO: 92122 - DNA, 25 bp, Homo sapien
ggtattgcttcaaactggtgtctga

SEQ ID NO: 92123 - DNA, 25 bp, Homo sapien
gtgtctgagatttggatccctggta

SEQ ID NO: 92124 - DNA, 25 bp, Homo sapien
ccctggtattgatttctcaggactt

SEQ ID NO: 92125 - DNA, 25 bp, Homo sapien
tttggagggctctgacaccatgctc

SEQ ID NO: 92126 - DNA, 25 bp, Homo sapien
accatgctcacagaactgggctcag

SEQ ID NO: 92127 - DNA, 25 bp, Homo sapien
ggctcagagctccattttttgcaga

SEQ ID NO: 92128 - DNA, 25 bp, Homo sapien
cattttttgcagaggtgacacaggt

SEQ ID NO: 92129 - DNA, 25 bp, Homo sapien
ggttagaagctgctgcaactgccct

SEQ ID NO: 92130 - DNA, 25 bp, Homo sapien
tttgtggtcgaaaggctcagcctct

SEQ ID NO: 92131 - DNA, 25 bp, Homo sapien
ctcagcctctctacatgaagtctgt

SEQ ID NO: 92132 - DNA, 25 bp, Homo sapien
tgaagcaagaccacacaacacagag

SEQ ID NO: 92133 - DNA, 25 bp, Homo sapien
aacagcaagcccttttcaatgcagc

SEQ ID NO: 92134 - DNA, 25 bp, Homo sapien
gcccttttcaatgcagcagtccata

SEQ ID NO: 92135 - DNA, 25 bp, Homo sapien
gcagtccatagaatacctctgtcag

SEQ ID NO: 92136 - DNA, 25 bp, Homo sapien
agactaagcttaagagttcctcgca

SEQ ID NO: 92137 - DNA, 25 bp, Homo sapien
agagttcctcgcatatatcgttgtg

SEQ ID NO: 92138 - DNA, 25 bp, Homo sapien
gcatatatcgttgtgcacaggatca

SEQ ID NO: 92139 - DNA, 25 bp, Homo sapien
aagtaacatgcttagctttccctcc

SEQ ID NO: 92140 - DNA, 25 bp, Homo sapien
ttagctttccctccttaatgtgaaa

SEQ ID NO: 92141 - DNA, 25 bp, Homo sapien
aagggcttactgacataggaacaac

SEQ ID NO: 92142 - DNA, 25 bp, Homo sapien
atgctcctggaacttcaagttgctg

SEQ ID NO: 92143 - DNA, 25 bp, Homo sapien
tccctattgtcagagccataatagt

SEQ ID NO: 92144 - DNA, 25 bp, Homo sapien
tcagagccataatagtgacattaca

SEQ ID NO: 92145 - DNA, 25 bp, Homo sapien
agagccataatagtgacattacaaa

SEQ ID NO: 92146 - DNA, 25 bp, Homo sapien
gtgacattacaaaaatgcaccttta

SEQ ID NO: 92147 - DNA, 25 bp, Homo sapien
ttacaaaaatgcacctttagaccag

SEQ ID NO: 92148 - DNA, 25 bp, Homo sapien
acaaaaatgcacctttagaccaggt

SEQ ID NO: 92149 - DNA, 25 bp, Homo sapien
aaaatgcacctttagaccaggtgca

SEQ ID NO: 92150 - DNA, 25 bp, Homo sapien
taataccaactgttcgggagggtga

SEQ ID NO: 92151 - DNA, 25 bp, Homo sapien
aataccaactgttcgggagggtgag

SEQ ID NO: 92152 - DNA, 25 bp, Homo sapien
ccaactgttcgggagggtgagtcaa

SEQ ID NO: 92153 - DNA, 25 bp, Homo sapien
aactgttcgggagggtgagtcaaga

SEQ ID NO: 92154 - DNA, 25 bp, Homo sapien
gagaaagctttccatagtgtggttt

SEQ ID NO: 92155 - DNA, 25 bp, Homo sapien
tccatagtgtggtttactcagagca

SEQ ID NO: 92156 - DNA, 25 bp, Homo sapien
atagtgtggtttactcagagcaggt

SEQ ID NO: 92157 - DNA, 25 bp, Homo sapien
tgtggtttactcagagcaggtgaca

SEQ ID NO: 92158 - DNA, 25 bp, Homo sapien
ggtttactcagagcaggtgacaaaa

SEQ ID NO: 92159 - DNA, 25 bp, Homo sapien
agcaggtgacaaaaggatgaatttc

SEQ ID NO: 92160 - DNA, 25 bp, Homo sapien
ggatgaatttctggctgggcccagt

SEQ ID NO: 92161 - DNA, 25 bp, Homo sapien
gtggtgacaggcacatgtagctact

SEQ ID NO: 92162 - DNA, 25 bp, Homo sapien
gttgcggtaagctgcgagcatgcca

SEQ ID NO: 92163 - DNA, 25 bp, Homo sapien
ttgcggtaagctgcgagcatgccac

SEQ ID NO: 92164 - DNA, 25 bp, Homo sapien
ggtaagctgcgagcatgccactgta

SEQ ID NO: 92165 - DNA, 25 bp, Homo sapien
gagtcgtctttgcaatactgtcctt

SEQ ID NO: 92166 - DNA, 25 bp, Homo sapien
gtccttataacagggccaacaggag

SEQ ID NO: 92167 - DNA, 25 bp, Homo sapien
ctgcagtgtatgcttgtgcccagga

SEQ ID NO: 92168 - DNA, 25 bp, Homo sapien
gcccaggagcttggatttaagatat

SEQ ID NO: 92169 - DNA, 25 bp, Homo sapien
tttgaagtgaatgcctcttcccagc

SEQ ID NO: 92170 - DNA, 25 bp, Homo sapien
tcttcccagcgcagtggtagacaaa

SEQ ID NO: 92171 - DNA, 25 bp, Homo sapien
ggtagacaaattctatctcagttga

SEQ ID NO: 92172 - DNA, 25 bp, Homo sapien
atctcagttgaaggaagctactcag

SEQ ID NO: 92173 - DNA, 25 bp, Homo sapien
gaagctactcagtcccatcaagtag

SEQ ID NO: 92174 - DNA, 25 bp, Homo sapien
agctactacataggcaagtcaccaa

SEQ ID NO: 92175 - DNA, 25 bp, Homo sapien
aactattttccttaagccataatgt

SEQ ID NO: 92176 - DNA, 25 bp, Homo sapien
acttaccctcgcctggacatagaga

SEQ ID NO: 92177 - DNA, 25 bp, Homo sapien
taccctcgcctggacatagagaaag

SEQ ID NO: 92178 - DNA, 25 bp, Homo sapien
tcgcctggacatagagaaagagatg

SEQ ID NO: 92179 - DNA, 25 bp, Homo sapien
tggactgaagctatctatccgcctt

SEQ ID NO: 92180 - DNA, 25 bp, Homo sapien
gactgaagctatctatccgccttag

SEQ ID NO: 92181 - DNA, 25 bp, Homo sapien
tgaagctatctatccgccttagtct

SEQ ID NO: 92182 - DNA, 25 bp, Homo sapien
gaagctatctatccgccttagtctc

SEQ ID NO: 92183 - DNA, 25 bp, Homo sapien
aaagcacgtcttggctcagctgctg

SEQ ID NO: 92184 - DNA, 25 bp, Homo sapien
gcacgtcttggctcagctgctgatt

SEQ ID NO: 92185 - DNA, 25 bp, Homo sapien
cgtcttggctcagctgctgatttaa

SEQ ID NO: 92186 - DNA, 25 bp, Homo sapien
tggctcagctgctgatttaagctgg

SEQ ID NO: 92187 - DNA, 25 bp, Homo sapien
tcttaagggtgaaataggcctattt

SEQ ID NO: 92188 - DNA, 25 bp, Homo sapien
aaatgattctatatgtgcaggtcct

SEQ ID NO: 92189 - DNA, 25 bp, Homo sapien
gattctatatgtgcaggtccttaca

SEQ ID NO: 92190 - DNA, 25 bp, Homo sapien
ggtccttacacagttttctctaaag

SEQ ID NO: 92191 - DNA, 25 bp, Homo sapien
ttaagagttaggacaatcctctggg

SEQ ID NO: 92192 - DNA, 25 bp, Homo sapien
gggagagtctagttcactgccctcc

SEQ ID NO: 92193 - DNA, 25 bp, Homo sapien
taaacagcatcatcttgattcttag

SEQ ID NO: 92194 - DNA, 25 bp, Homo sapien
gattcttagcttggacagcaccttt

SEQ ID NO: 92195 - DNA, 25 bp, Homo sapien
ttggacagcacctttaagctctacc

SEQ ID NO: 92196 - DNA, 25 bp, Homo sapien
aaatgtactttagtgccccttcacg

SEQ ID NO: 92197 - DNA, 25 bp, Homo sapien
gccccttcacggtacctcgtgtggg

SEQ ID NO: 92198 - DNA, 25 bp, Homo sapien
ttatctaggacatccacagggtaga

SEQ ID NO: 92199 - DNA, 25 bp, Homo sapien
tgtctgaggcccagtgtgtttttta

SEQ ID NO: 92200 - DNA, 25 bp, Homo sapien
tgaggcccagtgtgttttttagggt

SEQ ID NO: 92201 - DNA, 25 bp, Homo sapien
tagggttaccccatgtaaagcactt

SEQ ID NO: 92202 - DNA, 25 bp, Homo sapien
gtaaagcacttaccgctgtgcttgg

SEQ ID NO: 92203 - DNA, 25 bp, Homo sapien
acttaccgctgtgcttggaattcag

SEQ ID NO: 92204 - DNA, 25 bp, Homo sapien
ctgtgcttggaattcagcagctgtc

SEQ ID NO: 92205 - DNA, 25 bp, Homo sapien
caggcctgttttcccacaggattgt

SEQ ID NO: 92206 - DNA, 25 bp, Homo sapien
aggattgtgggctctctgcttcctt

SEQ ID NO: 92207 - DNA, 25 bp, Homo sapien
ctctctgcttccttagtcggaagtg

SEQ ID NO: 92208 - DNA, 25 bp, Homo sapien
gtcggaagtgttttcaactaatcaa

SEQ ID NO: 92209 - DNA, 25 bp, Homo sapien
atgagaacaaacattcccaggccat

SEQ ID NO: 92210 - DNA, 25 bp, Homo sapien
tgagaacaaacattcccaggccatg

SEQ ID NO: 92211 - DNA, 25 bp, Homo sapien
gagaacaaacattcccaggccatgt

SEQ ID NO: 92212 - DNA, 25 bp, Homo sapien
agaacaaacattcccaggccatgta

SEQ ID NO: 92213 - DNA, 25 bp, Homo sapien
aaacattcccaggccatgtaggata

SEQ ID NO: 92214 - DNA, 25 bp, Homo sapien
aacattcccaggccatgtaggatag

SEQ ID NO: 92215 - DNA, 25 bp, Homo sapien
acattcccaggccatgtaggatagg

SEQ ID NO: 92216 - DNA, 25 bp, Homo sapien
cattcccaggccatgtaggatagga

SEQ ID NO: 92217 - DNA, 25 bp, Homo sapien
ccagtccctcaataaagccacaaga

SEQ ID NO: 92218 - DNA, 25 bp, Homo sapien
ttttcctggtgaatttctctggtgc

SEQ ID NO: 92219 - DNA, 25 bp, Homo sapien
ggtgaatttctctggtgccctcact

SEQ ID NO: 92220 - DNA, 25 bp, Homo sapien
aagggcagcctctctaactggctcc

SEQ ID NO: 92221 - DNA, 25 bp, Homo sapien
aactggctcctagcagggaattcca

SEQ ID NO: 92222 - DNA, 25 bp, Homo sapien
agcagggaattccaggaagcctcct

SEQ ID NO: 92223 - DNA, 25 bp, Homo sapien
aggaagcctcctggtcttctagaat

SEQ ID NO: 92224 - DNA, 25 bp, Homo sapien
tggtcttctagaatcctggcaacct

SEQ ID NO: 92225 - DNA, 25 bp, Homo sapien
ctggcaaccttacaattcctctcgg

SEQ ID NO: 92226 - DNA, 25 bp, Homo sapien
ttacaattcctctcggcatttgtca

SEQ ID NO: 92227 - DNA, 25 bp, Homo sapien
atttgtcacttccatctcagctaat

SEQ ID NO: 92228 - DNA, 25 bp, Homo sapien
atggtgaaggaacttaaaccacata

SEQ ID NO: 92229 - DNA, 25 bp, Homo sapien
tggtgaaggaacttaaaccacataa

SEQ ID NO: 92230 - DNA, 25 bp, Homo sapien
ttaaaccacataaaaaggccagaca

SEQ ID NO: 92231 - DNA, 25 bp, Homo sapien
taaaccacataaaaaggccagacag

SEQ ID NO: 92232 - DNA, 25 bp, Homo sapien
aaaccacataaaaaggccagacagg

SEQ ID NO: 92233 - DNA, 25 bp, Homo sapien
aaccacataaaaaggccagacaggg

SEQ ID NO: 92234 - DNA, 25 bp, Homo sapien
accacataaaaaggccagacagggc

SEQ ID NO: 92235 - DNA, 25 bp, Homo sapien
ccacataaaaaggccagacagggcg

SEQ ID NO: 92236 - DNA, 25 bp, Homo sapien
cacataaaaaggccagacagggcgg

SEQ ID NO: 92237 - DNA, 25 bp, Homo sapien
acataaaaaggccagacagggcggg

SEQ ID NO: 92238 - DNA, 25 bp, Homo sapien
taaaaaggccagacagggcggggtg

SEQ ID NO: 92239 - DNA, 25 bp, Homo sapien
agaactacgacttgctctgtcattc

SEQ ID NO: 92240 - DNA, 25 bp, Homo sapien
gctctgtcattccagtgtcgtttaa

SEQ ID NO: 92241 - DNA, 25 bp, Homo sapien
gtgtcgtttaacctatgcagtaaga

SEQ ID NO: 92242 - DNA, 25 bp, Homo sapien
aagtagttcgtagcagaagccagga

SEQ ID NO: 92243 - DNA, 25 bp, Homo sapien
taaacgcccaaactaaactcctcat

SEQ ID NO: 92244 - DNA, 25 bp, Homo sapien
tcattcctacccttaatatttcctg

SEQ ID NO: 92245 - DNA, 25 bp, Homo sapien
acccttaatatttcctggctgtatg

SEQ ID NO: 92246 - DNA, 25 bp, Homo sapien
atgatcttggccaggtcactctcta

SEQ ID NO: 92247 - DNA, 25 bp, Homo sapien
tcactctctaaaagccccggtttct

SEQ ID NO: 92248 - DNA, 25 bp, Homo sapien
gccccggtttcttcattattatcat

SEQ ID NO: 92249 - DNA, 25 bp, Homo sapien
acagctatacctgaggtttgttttg

SEQ ID NO: 92250 - DNA, 25 bp, Homo sapien
ttttcaacatcccaaactgaaagtc

SEQ ID NO: 92251 - DNA, 25 bp, Homo sapien
ttcaacatcccaaactgaaagtctt

SEQ ID NO: 92252 - DNA, 25 bp, Homo sapien
tcaacatcccaaactgaaagtcttg

SEQ ID NO: 92253 - DNA, 25 bp, Homo sapien
aacatcccaaactgaaagtcttggc

SEQ ID NO: 92254 - DNA, 25 bp, Homo sapien
atcccaaactgaaagtcttggccag

SEQ ID NO: 92255 - DNA, 25 bp, Homo sapien
tcccaaactgaaagtcttggccagg

SEQ ID NO: 92256 - DNA, 25 bp, Homo sapien
cccaaactgaaagtcttggccaggc

SEQ ID NO: 92257 - DNA, 25 bp, Homo sapien
agatgtggtggcataagcctgcagt

SEQ ID NO: 92258 - DNA, 25 bp, Homo sapien
gatgtggtggcataagcctgcagtc

SEQ ID NO: 92259 - DNA, 25 bp, Homo sapien
atgtggtggcataagcctgcagtcc

SEQ ID NO: 92260 - DNA, 25 bp, Homo sapien
ttacagtaaaccgaaattgtgccac

SEQ ID NO: 92261 - DNA, 25 bp, Homo sapien
tgcacgccatgccttgggccacgtt

SEQ ID NO: 92262 - DNA, 25 bp, Homo sapien
gccacgttggcagtgtgacaggact

SEQ ID NO: 92263 - DNA, 25 bp, Homo sapien
gattgtgctagatgtacctgcccaa

SEQ ID NO: 92264 - DNA, 25 bp, Homo sapien
ctagatgtacctgcccaagtctgct

SEQ ID NO: 92265 - DNA, 25 bp, Homo sapien
agtctgctggtcacatttggcagca

SEQ ID NO: 92266 - DNA, 25 bp, Homo sapien
tgagacctgcccttcagaattcggt

SEQ ID NO: 92267 - DNA, 25 bp, Homo sapien
gcccttcagaattcggttcacttgg

SEQ ID NO: 92268 - DNA, 25 bp, Homo sapien
tgtggtagagactaactggccttct

SEQ ID NO: 92269 - DNA, 25 bp, Homo sapien
taactggccttctgatgtctttgtt

SEQ ID NO: 92270 - DNA, 25 bp, Homo sapien
atgtctttgttcaactgtggccagc

SEQ ID NO: 92271 - DNA, 25 bp, Homo sapien
aactgtggccagctgtggcatcagc

SEQ ID NO: 92272 - DNA, 25 bp, Homo sapien
agactcctcaagaaagagccccgcg

SEQ ID NO: 92273 - DNA, 25 bp, Homo sapien
ggttgctccggaaactcgaggcact

SEQ ID NO: 92274 - DNA, 25 bp, Homo sapien
tcgaggcactgcagctatgggcact

SEQ ID NO: 92275 - DNA, 25 bp, Homo sapien
actgcctcagcctaaagacacaggg

SEQ ID NO: 92276 - DNA, 25 bp, Homo sapien
atgctcaccccgtcataagcagaaa

SEQ ID NO: 92277 - DNA, 25 bp, Homo sapien
aagcagaaactagtgatcctggaaa

SEQ ID NO: 92278 - DNA, 25 bp, Homo sapien
tcctggaaatgagatgggccttact

SEQ ID NO: 92279 - DNA, 25 bp, Homo sapien
gggccttactctgtcgactaaatga

SEQ ID NO: 92280 - DNA, 25 bp, Homo sapien
gaatagctattttcttgtcattttt

SEQ ID NO: 92281 - DNA, 25 bp, Homo sapien
aaagtgcaactcttgcttcatgctg

SEQ ID NO: 92282 - DNA, 25 bp, Homo sapien
gcttcatgctgcttaagttaccaga

SEQ ID NO: 92283 - DNA, 25 bp, Homo sapien
cttctgtccttattagtacacttaa

SEQ ID NO: 92284 - DNA, 25 bp, Homo sapien
gagactagtatttattgatccaggc

SEQ ID NO: 92285 - DNA, 25 bp, Homo sapien
tcatgcttgggcttactttttcagt

SEQ ID NO: 92286 - DNA, 25 bp, Homo sapien
aggttaagcatatgtgcatgcatgc

SEQ ID NO: 92287 - DNA, 25 bp, Homo sapien
aaatgccttttccatatcttaaatg

SEQ ID NO: 92288 - DNA, 25 bp, Homo sapien
catatcttaaatgtccctgatgagg

SEQ ID NO: 92289 - DNA, 25 bp, Homo sapien
ggaagtgtcagtatagacccattgt

SEQ ID NO: 92290 - DNA, 25 bp, Homo sapien
gacccattgtacttaagtgctgatg

SEQ ID NO: 92291 - DNA, 25 bp, Homo sapien
agtgctgatgactgttagccagttt

SEQ ID NO: 92292 - DNA, 25 bp, Homo sapien
agtttacaactttttaccatcgatg

SEQ ID NO: 92293 - DNA, 25 bp, Homo sapien
tttttaccatcgatgtacacatttg

SEQ ID NO: 92294 - DNA, 25 bp, Homo sapien
gaaaattgttttaccactggatcag

SEQ ID NO: 92295 - DNA, 25 bp, Homo sapien
aaacttggctttatcttggagtcac

SEQ ID NO: 92296 - DNA, 25 bp, Homo sapien
ttggagtcaccagaggagattcaaa

SEQ ID NO: 92297 - DNA, 25 bp, Homo sapien
caaaagatacctttacctggctcca

SEQ ID NO: 92298 - DNA, 25 bp, Homo sapien
tccacctccagagatcgggatttta

SEQ ID NO: 92299 - DNA, 25 bp, Homo sapien
atctggattttaagagcccttctgg

SEQ ID NO: 92300 - DNA, 25 bp, Homo sapien
ttaagagcccttctggtgattcgac

SEQ ID NO: 92301 - DNA, 25 bp, Homo sapien
ggtgattcgactgtttagctaggtt

SEQ ID NO: 92302 - DNA, 25 bp, Homo sapien
tttagctaggtttgagagccactac

SEQ ID NO: 92303 - DNA, 25 bp, Homo sapien
gagccactaccctagatgagctgtc

SEQ ID NO: 92304 - DNA, 25 bp, Homo sapien
gctccagtaacattctttttctaaa

SEQ ID NO: 92305 - DNA, 25 bp, Homo sapien
tcccggaaccaaaggtgcaggctca

SEQ ID NO: 92306 - DNA, 25 bp, Homo sapien
ggaaccaaaggtgcaggctcaggcc

SEQ ID NO: 92307 - DNA, 25 bp, Homo sapien
gaaccaaaggtgcaggctcaggcct

SEQ ID NO: 92308 - DNA, 25 bp, Homo sapien
aaccaaaggtgcaggctcaggcctg

SEQ ID NO: 92309 - DNA, 25 bp, Homo sapien
gctcaggcctgcggctttctggctg

SEQ ID NO: 92310 - DNA, 25 bp, Homo sapien
ctgcggctttctggctgctgtgctg

SEQ ID NO: 92311 - DNA, 25 bp, Homo sapien
tggctgctgtgctgcctcctgggct

SEQ ID NO: 92312 - DNA, 25 bp, Homo sapien
tgcccagggcacagcggagccatgg

SEQ ID NO: 92313 - DNA, 25 bp, Homo sapien
tgccttctggtctgcatgacactaa

SEQ ID NO: 92314 - DNA, 25 bp, Homo sapien
agacctccaagcttgcacagaggca

SEQ ID NO: 92315 - DNA, 25 bp, Homo sapien
agaggcaaggccagacttttccgtc

SEQ ID NO: 92316 - DNA, 25 bp, Homo sapien
ggagtgaggaagcttccacctccat

SEQ ID NO: 92317 - DNA, 25 bp, Homo sapien
tgactaggcctgcatcctaactggg

SEQ ID NO: 92318 - DNA, 25 bp, Homo sapien
ctccccttggtcatgggatttgctg

SEQ ID NO: 92319 - DNA, 25 bp, Homo sapien
tctttgccccagagctgaagagcta

SEQ ID NO: 92320 - DNA, 25 bp, Homo sapien
gctgaagagctataggcactggtgt

SEQ ID NO: 92321 - DNA, 25 bp, Homo sapien
tataggcactggtgtggatggccca

SEQ ID NO: 92322 - DNA, 25 bp, Homo sapien
taggtctccaggtgggcctggttcc

SEQ ID NO: 92323 - DNA, 25 bp, Homo sapien
ttcccaggcagcaggtgggaaccct

SEQ ID NO: 92324 - DNA, 25 bp, Homo sapien
gggtacaggtgggttccctcatctg

SEQ ID NO: 92325 - DNA, 25 bp, Homo sapien
aggtgggttccctcatctggagttc

SEQ ID NO: 92326 - DNA, 25 bp, Homo sapien
tcaataaagcaaggtctggacctgc

SEQ ID NO: 92327 - DNA, 25 bp, Homo sapien
ggcaggagtgggagcagatgacaac

SEQ ID NO: 92328 - DNA, 25 bp, Homo sapien
caaccattttagaaggagccctctg

SEQ ID NO: 92329 - DNA, 25 bp, Homo sapien
aaccattttagaaggagccctctgg

SEQ ID NO: 92330 - DNA, 25 bp, Homo sapien
accattttagaaggagccctctggc

SEQ ID NO: 92331 - DNA, 25 bp, Homo sapien
tgtgcaatttagctggatcccatct

SEQ ID NO: 92332 - DNA, 25 bp, Homo sapien
gtgcaatttagctggatcccatctc

SEQ ID NO: 92333 - DNA, 25 bp, Homo sapien
tgcaatttagctggatcccatctcc

SEQ ID NO: 92334 - DNA, 25 bp, Homo sapien
gaaggagagcctgtgagtttgaggc

SEQ ID NO: 92335 - DNA, 25 bp, Homo sapien
aggctgcaatgagctttggtggcac

SEQ ID NO: 92336 - DNA, 25 bp, Homo sapien
ggctgcaatgagctttggtggcacc

SEQ ID NO: 92337 - DNA, 25 bp, Homo sapien
atgagctttggtggcaccactgccc

SEQ ID NO: 92338 - DNA, 25 bp, Homo sapien
aattcacttgtagcctggaagcttc

SEQ ID NO: 92339 - DNA, 25 bp, Homo sapien
attcacttgtagcctggaagcttcc

SEQ ID NO: 92340 - DNA, 25 bp, Homo sapien
ttcacttgtagcctggaagcttccc

SEQ ID NO: 92341 - DNA, 25 bp, Homo sapien
tcacttgtagcctggaagcttccct

SEQ ID NO: 92342 - DNA, 25 bp, Homo sapien
cacttgtagcctggaagcttccctc

SEQ ID NO: 92343 - DNA, 25 bp, Homo sapien
acttgtagcctggaagcttccctcc

SEQ ID NO: 92344 - DNA, 25 bp, Homo sapien
cttgtagcctggaagcttccctccc

SEQ ID NO: 92345 - DNA, 25 bp, Homo sapien
ctcccctgctccgacctttgagttg

SEQ ID NO: 92346 - DNA, 25 bp, Homo sapien
tcccctgctccgacctttgagttgt

SEQ ID NO: 92347 - DNA, 25 bp, Homo sapien
cccctgctccgacctttgagttgtc

SEQ ID NO: 92348 - DNA, 25 bp, Homo sapien
ccctgctccgacctttgagttgtcc

SEQ ID NO: 92349 - DNA, 25 bp, Homo sapien
gggcgtgttccttgctatgtagcta

SEQ ID NO: 92350 - DNA, 25 bp, Homo sapien
gcgtgttccttgctatgtagctagc

SEQ ID NO: 92351 - DNA, 25 bp, Homo sapien
gttccttgctatgtagctagctgca

SEQ ID NO: 92352 - DNA, 25 bp, Homo sapien
ttgctatgtagctagctgcagcgtc

SEQ ID NO: 92353 - DNA, 25 bp, Homo sapien
tatgtagctagctgcagcgtcccct

SEQ ID NO: 92354 - DNA, 25 bp, Homo sapien
tgtagctagctgcagcgtccccttt

SEQ ID NO: 92355 - DNA, 25 bp, Homo sapien
gcagctgcagtcagcagggttgttt

SEQ ID NO: 92356 - DNA, 25 bp, Homo sapien
gcagggttgtttgagactatttatt

SEQ ID NO: 92357 - DNA, 25 bp, Homo sapien
ttgagactatttattggttgctgta

SEQ ID NO: 92358 - DNA, 25 bp, Homo sapien
gactatttattggttgctgtagatt

SEQ ID NO: 92359 - DNA, 25 bp, Homo sapien
ttttgaaaggccaattctgtatttt

SEQ ID NO: 92360 - DNA, 25 bp, Homo sapien
gtactgggagtgttgtcctgagata

SEQ ID NO: 92361 - DNA, 25 bp, Homo sapien
ggaactgtcctaaacctggactctg

SEQ ID NO: 92362 - DNA, 25 bp, Homo sapien
gactctgttcccatcacacctagaa

SEQ ID NO: 92363 - DNA, 25 bp, Homo sapien
atcacacctagaacaggatgtcctg

SEQ ID NO: 92364 - DNA, 25 bp, Homo sapien
tgtcctgcaacgctttagcccaatg

SEQ ID NO: 92365 - DNA, 25 bp, Homo sapien
aacgctttagcccaatgatccaagt

SEQ ID NO: 92366 - DNA, 25 bp, Homo sapien
agcccaatgatccaagttgcccttg

SEQ ID NO: 92367 - DNA, 25 bp, Homo sapien
aaaacttgacagcagagggcgttca

SEQ ID NO: 92368 - DNA, 25 bp, Homo sapien
agggcgttcagggtccctcagctgc

SEQ ID NO: 92369 - DNA, 25 bp, Homo sapien
gtgggacacacaggtgagactccat

SEQ ID NO: 92370 - DNA, 25 bp, Homo sapien
acacaggtgagactccatctgccct

SEQ ID NO: 92371 - DNA, 25 bp, Homo sapien
agttcaggagccaccccaaaccatt

SEQ ID NO: 92372 - DNA, 25 bp, Homo sapien
aggagccaccccaaaccattctggg

SEQ ID NO: 92373 - DNA, 25 bp, Homo sapien
ggagccaccccaaaccattctggga

SEQ ID NO: 92374 - DNA, 25 bp, Homo sapien
caccccaaaccattctgggacaggg

SEQ ID NO: 92375 - DNA, 25 bp, Homo sapien
ccaaaccattctgggacagggacac

SEQ ID NO: 92376 - DNA, 25 bp, Homo sapien
accattctgggacagggacacccct

SEQ ID NO: 92377 - DNA, 25 bp, Homo sapien
ccattctgggacagggacacccctt

SEQ ID NO: 92378 - DNA, 25 bp, Homo sapien
gactagacccacctcacctgaaggg

SEQ ID NO: 92379 - DNA, 25 bp, Homo sapien
agacccacctcacctgaagggggtg

SEQ ID NO: 92380 - DNA, 25 bp, Homo sapien
agggtgacttaccaagagccaggga

SEQ ID NO: 92381 - DNA, 25 bp, Homo sapien
cagcccaggcccaagtgacagcaag

SEQ ID NO: 92382 - DNA, 25 bp, Homo sapien
atgcagtcaagagccctattttcac

SEQ ID NO: 92383 - DNA, 25 bp, Homo sapien
tccttccagtggtcgacatgagcac

SEQ ID NO: 92384 - DNA, 25 bp, Homo sapien
atgagcacggactcctaaacctttt

SEQ ID NO: 92385 - DNA, 25 bp, Homo sapien
taaaccttttccacgccatggaggg

SEQ ID NO: 92386 - DNA, 25 bp, Homo sapien
catggagggcatcagccaccttcac

SEQ ID NO: 92387 - DNA, 25 bp, Homo sapien
agtatgagatgcctctgtaccgcaa

SEQ ID NO: 92388 - DNA, 25 bp, Homo sapien
tgtaccgcaagtactggcccaacca

SEQ ID NO: 92389 - DNA, 25 bp, Homo sapien
gtgcttcccggcatgttcaataatg

SEQ ID NO: 92390 - DNA, 25 bp, Homo sapien
cgaagataaactgagctccattccc

SEQ ID NO: 92391 - DNA, 25 bp, Homo sapien
cattcccctggcatgaaactttcag

SEQ ID NO: 92392 - DNA, 25 bp, Homo sapien
atgaaactttcagattcccctgcct

SEQ ID NO: 92393 - DNA, 25 bp, Homo sapien
ttgctgcattgatcccattaccatt

SEQ ID NO: 92394 - DNA, 25 bp, Homo sapien
gatcccattaccattatataatgcc

SEQ ID NO: 92395 - DNA, 25 bp, Homo sapien
attaccattatataatgcccttctt

SEQ ID NO: 92396 - DNA, 25 bp, Homo sapien
gcttgataaatattcctgtatccct

SEQ ID NO: 92397 - DNA, 25 bp, Homo sapien
gataaatattcctgtatccctttat

SEQ ID NO: 92398 - DNA, 25 bp, Homo sapien
atattcctgtatccctttattttga

SEQ ID NO: 92399 - DNA, 25 bp, Homo sapien
cctgtatccctttattttgagccta

SEQ ID NO: 92400 - DNA, 25 bp, Homo sapien
tttgagcctatatgtgtctttgcac

SEQ ID NO: 92401 - DNA, 25 bp, Homo sapien
tgtctttgcacgtgaggtgggtctc

SEQ ID NO: 92402 - DNA, 25 bp, Homo sapien
aggtgggtctcctgaatacagcaca

SEQ ID NO: 92403 - DNA, 25 bp, Homo sapien
atacagcacaccgatgggttttgac

SEQ ID NO: 92404 - DNA, 25 bp, Homo sapien
agcataataaaggatggttggccac

SEQ ID NO: 92405 - DNA, 25 bp, Homo sapien
gcataataaaggatggttggccacg

SEQ ID NO: 92406 - DNA, 25 bp, Homo sapien
cataataaaggatggttggccacgt

SEQ ID NO: 92407 - DNA, 25 bp, Homo sapien
taataaaggatggttggccacgtgt

SEQ ID NO: 92408 - DNA, 25 bp, Homo sapien
aataaaggatggttggccacgtgta

SEQ ID NO: 92409 - DNA, 25 bp, Homo sapien
ataaaggatggttggccacgtgtaa

SEQ ID NO: 92410 - DNA, 25 bp, Homo sapien
taaaggatggttggccacgtgtaat

SEQ ID NO: 92411 - DNA, 25 bp, Homo sapien
atggttggccacgtgtaatggctca

SEQ ID NO: 92412 - DNA, 25 bp, Homo sapien
tggttggccacgtgtaatggctcat

SEQ ID NO: 92413 - DNA, 25 bp, Homo sapien
ggttggccacgtgtaatggctcatg

SEQ ID NO: 92414 - DNA, 25 bp, Homo sapien
gttggccacgtgtaatggctcatgc

SEQ ID NO: 92415 - DNA, 25 bp, Homo sapien
tttattcctaagactctaaaggcgt

SEQ ID NO: 92416 - DNA, 25 bp, Homo sapien
taaaggcgttgatttcaaccctcct

SEQ ID NO: 92417 - DNA, 25 bp, Homo sapien
aggcaacccacgtggtctcctgtga

SEQ ID NO: 92418 - DNA, 25 bp, Homo sapien
gtctcctgtgagaatcttctcgaca

SEQ ID NO: 92419 - DNA, 25 bp, Homo sapien
gaatcttctcgacagttacttatgg

SEQ ID NO: 92420 - DNA, 25 bp, Homo sapien
cacttgtgaacaattaactgccagg

SEQ ID NO: 92421 - DNA, 25 bp, Homo sapien
gataggatactccagactccagtca

SEQ ID NO: 92422 - DNA, 25 bp, Homo sapien
cccatccatggtttctgttactcat

SEQ ID NO: 92423 - DNA, 25 bp, Homo sapien
atggtttctgttactcatggtttca

SEQ ID NO: 92424 - DNA, 25 bp, Homo sapien
atggtttcagttactcatagccaac

SEQ ID NO: 92425 - DNA, 25 bp, Homo sapien
tagccaactgcagaccgaaaatact

SEQ ID NO: 92426 - DNA, 25 bp, Homo sapien
accctggcagaggtggccagtcacg

SEQ ID NO: 92427 - DNA, 25 bp, Homo sapien
acacatgtccccagggcagatcaag

SEQ ID NO: 92428 - DNA, 25 bp, Homo sapien
atgttccccagccaggtgaggacca

SEQ ID NO: 92429 - DNA, 25 bp, Homo sapien
tgaggaccattttcactgggaccca

SEQ ID NO: 92430 - DNA, 25 bp, Homo sapien
actgggacccaggccaaaaccatgt

SEQ ID NO: 92431 - DNA, 25 bp, Homo sapien
acaaagccaggcactgccaagtgga

SEQ ID NO: 92432 - DNA, 25 bp, Homo sapien
actgccaagtggaacatgaggttat

SEQ ID NO: 92433 - DNA, 25 bp, Homo sapien
ggttatttccaaatcatgggagcca

SEQ ID NO: 92434 - DNA, 25 bp, Homo sapien
atggaaaatcccctggagccggtca

SEQ ID NO: 92435 - DNA, 25 bp, Homo sapien
tggagccggtcaactttttgctcat

SEQ ID NO: 92436 - DNA, 25 bp, Homo sapien
aactttttgctcatggctagtgaaa

SEQ ID NO: 92437 - DNA, 25 bp, Homo sapien
gggacagcgctggaccgtacagacc

SEQ ID NO: 92438 - DNA, 25 bp, Homo sapien
tggaccgtacagacctgcctaacat

SEQ ID NO: 92439 - DNA, 25 bp, Homo sapien
agacctgcctaacatgccagcgcag

SEQ ID NO: 92440 - DNA, 25 bp, Homo sapien
aacgcttcctcaatgatcccgggca

SEQ ID NO: 92441 - DNA, 25 bp, Homo sapien
gcccagctcgggagccaagcagatt

SEQ ID NO: 92442 - DNA, 25 bp, Homo sapien
gccaagcagattccaaaccactaca

SEQ ID NO: 92443 - DNA, 25 bp, Homo sapien
agattccaaaccactacaacccttg

SEQ ID NO: 92444 - DNA, 25 bp, Homo sapien
ttcagaccgccttcctgaggagaaa

SEQ ID NO: 92445 - DNA, 25 bp, Homo sapien
ggagaaaatgcagactcagggttcc

SEQ ID NO: 92446 - DNA, 25 bp, Homo sapien
gactcagggttccagtaaccagtga

SEQ ID NO: 92447 - DNA, 25 bp, Homo sapien
gtaaccagtgatggattcaccccat

SEQ ID NO: 92448 - DNA, 25 bp, Homo sapien
agcgaaatagattatgccaaaagtt

SEQ ID NO: 92449 - DNA, 25 bp, Homo sapien
gcgaaatagattatgccaaaagttc

SEQ ID NO: 92450 - DNA, 25 bp, Homo sapien
cgaaatagattatgccaaaagttct

SEQ ID NO: 92451 - DNA, 25 bp, Homo sapien
gaaatagattatgccaaaagttctg

SEQ ID NO: 92452 - DNA, 25 bp, Homo sapien
aaatagattatgccaaaagttctga

SEQ ID NO: 92453 - DNA, 25 bp, Homo sapien
aatagattatgccaaaagttctgat

SEQ ID NO: 92454 - DNA, 25 bp, Homo sapien
atagattatgccaaaagttctgatt

SEQ ID NO: 92455 - DNA, 25 bp, Homo sapien
aatgttttattgtgggccgggcgca

SEQ ID NO: 92456 - DNA, 25 bp, Homo sapien
atgttttattgtgggccgggcgcag

SEQ ID NO: 92457 - DNA, 25 bp, Homo sapien
tgttttattgtgggccgggcgcagt

SEQ ID NO: 92458 - DNA, 25 bp, Homo sapien
attaactgggcttggtggtgcacgc

SEQ ID NO: 92459 - DNA, 25 bp, Homo sapien
agtctccagttccaaggatgggtca

SEQ ID NO: 92460 - DNA, 25 bp, Homo sapien
aaggatgggtcatctccaaccactt

SEQ ID NO: 92461 - DNA, 25 bp, Homo sapien
gatgggtcatctccaaccacttgcc

SEQ ID NO: 92462 - DNA, 25 bp, Homo sapien
gaggaactgggcaccctcgagccgt

SEQ ID NO: 92463 - DNA, 25 bp, Homo sapien
tgggcaccctcgagccgtgcatggc

SEQ ID NO: 92464 - DNA, 25 bp, Homo sapien
gggtcgcgccgcagtcttcctcaag

SEQ ID NO: 92465 - DNA, 25 bp, Homo sapien
gcagtcttcctcaagtatgcgcggc

SEQ ID NO: 92466 - DNA, 25 bp, Homo sapien
cagtcttcctcaagtatgcgcggcc

SEQ ID NO: 92467 - DNA, 25 bp, Homo sapien
tccagtctgagcctccctgagtact

SEQ ID NO: 92468 - DNA, 25 bp, Homo sapien
gtctgagcctccctgagtactggga

SEQ ID NO: 92469 - DNA, 25 bp, Homo sapien
ctccctgagtactgggactcagtca

SEQ ID NO: 92470 - DNA, 25 bp, Homo sapien
gctgcaagaaaaggagaagcactac

SEQ ID NO: 92471 - DNA, 25 bp, Homo sapien
aaggagaagcactacaagcttttga

SEQ ID NO: 92472 - DNA, 25 bp, Homo sapien
ggagaagcactacaagcttttgaaa

SEQ ID NO: 92473 - DNA, 25 bp, Homo sapien
agaaagaggaggaaactgttgccga

SEQ ID NO: 92474 - DNA, 25 bp, Homo sapien
agaggaggaaactgttgccgagaaa

SEQ ID NO: 92475 - DNA, 25 bp, Homo sapien
gaggaggaaactgttgccgagaaaa

SEQ ID NO: 92476 - DNA, 25 bp, Homo sapien
gaggaaactgttgccgagaaaaaga

SEQ ID NO: 92477 - DNA, 25 bp, Homo sapien
agaaagataatttaactgctgttga

SEQ ID NO: 92478 - DNA, 25 bp, Homo sapien
aagataatttaactgctgttgagaa

SEQ ID NO: 92479 - DNA, 25 bp, Homo sapien
gataatttaactgctgttgagaaat

SEQ ID NO: 92480 - DNA, 25 bp, Homo sapien
ataatttaactgctgttgagaaatg

SEQ ID NO: 92481 - DNA, 25 bp, Homo sapien
gagtaattgaattaatcccatagga

SEQ ID NO: 92482 - DNA, 25 bp, Homo sapien
atcccataggaataagctccttgta

SEQ ID NO: 92483 - DNA, 25 bp, Homo sapien
gctccttgtaagtaaatccatgata

SEQ ID NO: 92484 - DNA, 25 bp, Homo sapien
acagctggaaattgaagtttttgat

SEQ ID NO: 92485 - DNA, 25 bp, Homo sapien
tttgatgcctgtatactggatatga

SEQ ID NO: 92486 - DNA, 25 bp, Homo sapien
actatttgatttctagtcttctgtg

SEQ ID NO: 92487 - DNA, 25 bp, Homo sapien
cttctgtgtttagcagttgtaatat

SEQ ID NO: 92488 - DNA, 25 bp, Homo sapien
catatctttgatacttctttgtgag

SEQ ID NO: 92489 - DNA, 25 bp, Homo sapien
ctttgtgagtgagagaatgctagat

SEQ ID NO: 92490 - DNA, 25 bp, Homo sapien
agatagggtggctttgttctttgtt

SEQ ID NO: 92491 - DNA, 25 bp, Homo sapien
tcctgaatgtagttaatttatggca

SEQ ID NO: 92492 - DNA, 25 bp, Homo sapien
aactttctggacttcagttcaggtt

SEQ ID NO: 92493 - DNA, 25 bp, Homo sapien
agttcaggttgtatggcagtaggcc

SEQ ID NO: 92494 - DNA, 25 bp, Homo sapien
gtaggccatagaattggctactgcc

SEQ ID NO: 92495 - DNA, 25 bp, Homo sapien
tggctactgccatacaatctctatg

SEQ ID NO: 92496 - DNA, 25 bp, Homo sapien
caatctctatgggaaaggactgcaa

SEQ ID NO: 92497 - DNA, 25 bp, Homo sapien
attttatctctgtatgggcaaaggc

SEQ ID NO: 92498 - DNA, 25 bp, Homo sapien
tgggcaaaggctactgtcatcctgt

SEQ ID NO: 92499 - DNA, 25 bp, Homo sapien
aggctactgtcatcctgttgttggt

SEQ ID NO: 92500 - DNA, 25 bp, Homo sapien
catttgattgtgtaagggtctaacc

SEQ ID NO: 92501 - DNA, 25 bp, Homo sapien
aatcaagttcagcaaggtcacaggc

SEQ ID NO: 92502 - DNA, 25 bp, Homo sapien
ggtcacaggctagatcaatatacag

SEQ ID NO: 92503 - DNA, 25 bp, Homo sapien
ttgacgagtcgagagaaggcggctt

SEQ ID NO: 92504 - DNA, 25 bp, Homo sapien
gaaggcggcttcagacaatcggtaa

SEQ ID NO: 92505 - DNA, 25 bp, Homo sapien
ggcggcttcagacaatcggtaataa

SEQ ID NO: 92506 - DNA, 25 bp, Homo sapien
atcggtaataacaaacttctcccag

SEQ ID NO: 92507 - DNA, 25 bp, Homo sapien
cggtaataacaaacttctcccagct

SEQ ID NO: 92508 - DNA, 25 bp, Homo sapien
ttctcccagctaaaggaggatgttt

SEQ ID NO: 92509 - DNA, 25 bp, Homo sapien
aggaggatgtttgaacccatcacaa

SEQ ID NO: 92510 - DNA, 25 bp, Homo sapien
tttgaacccatcacaaagaagctta

SEQ ID NO: 92511 - DNA, 25 bp, Homo sapien
tggctaacgagaataaacagcatag

SEQ ID NO: 92512 - DNA, 25 bp, Homo sapien
gcatagataagtccataaatgacct

SEQ ID NO: 92513 - DNA, 25 bp, Homo sapien
acaagcttcagtagctgatttgatt

SEQ ID NO: 92514 - DNA, 25 bp, Homo sapien
atcccagagcactgagaggccacaa

SEQ ID NO: 92515 - DNA, 25 bp, Homo sapien
aggccacaatcgttcagccctgtgc

SEQ ID NO: 92516 - DNA, 25 bp, Homo sapien
aatcgttcagccctgtgccctgaac

SEQ ID NO: 92517 - DNA, 25 bp, Homo sapien
ctcactggagacaagcatgagcttg

SEQ ID NO: 92518 - DNA, 25 bp, Homo sapien
atgagcttgagccccatggcctggt

SEQ ID NO: 92519 - DNA, 25 bp, Homo sapien
ctgcgtgcattgaggccgcctcttt

SEQ ID NO: 92520 - DNA, 25 bp, Homo sapien
gaggccgcctctttgacgggtccat

SEQ ID NO: 92521 - DNA, 25 bp, Homo sapien
aaagggaatcgtgtgtgtgccccag

SEQ ID NO: 92522 - DNA, 25 bp, Homo sapien
gtgtgtgccccaggcacgtgtaata

SEQ ID NO: 92523 - DNA, 25 bp, Homo sapien
tgccccaggcacgtgtaataaagaa

SEQ ID NO: 92524 - DNA, 25 bp, Homo sapien
acgtgtaataaagaacccgagcaga

SEQ ID NO: 92525 - DNA, 25 bp, Homo sapien
aaatcatgtgggtattgcttaattc

SEQ ID NO: 92526 - DNA, 25 bp, Homo sapien
catgtgggtattgcttaattctgat

SEQ ID NO: 92527 - DNA, 25 bp, Homo sapien
gggtattgcttaattctgatttcat

SEQ ID NO: 92528 - DNA, 25 bp, Homo sapien
gcttaattctgatttcatatcactg

SEQ ID NO: 92529 - DNA, 25 bp, Homo sapien
gatttcatatcactgaacactgtag

SEQ ID NO: 92530 - DNA, 25 bp, Homo sapien
atcactgaacactgtagatattaaa

SEQ ID NO: 92531 - DNA, 25 bp, Homo sapien
taaaatgttcagcaggcacagttct

SEQ ID NO: 92532 - DNA, 25 bp, Homo sapien
atgttcagcaggcacagttctgtaa

SEQ ID NO: 92533 - DNA, 25 bp, Homo sapien
gttcagcaggcacagttctgtaaaa

SEQ ID NO: 92534 - DNA, 25 bp, Homo sapien
aattgttcgtgatacattaagaatg

SEQ ID NO: 92535 - DNA, 25 bp, Homo sapien
aggataacatcatcccacttttgta

SEQ ID NO: 92536 - DNA, 25 bp, Homo sapien
gatgtattcgtattgtttgggattg

SEQ ID NO: 92537 - DNA, 25 bp, Homo sapien
aacatacttaattgatttcttaccg

SEQ ID NO: 92538 - DNA, 25 bp, Homo sapien
taccgtttttggctctgttttgcta

SEQ ID NO: 92539 - DNA, 25 bp, Homo sapien
ctgttttgctatatcccctaatttg

SEQ ID NO: 92540 - DNA, 25 bp, Homo sapien
atcccctaatttgttggttgtgcta

SEQ ID NO: 92541 - DNA, 25 bp, Homo sapien
gttggttgtgctaatctttgtagaa

SEQ ID NO: 92542 - DNA, 25 bp, Homo sapien
aaagaggtcttgtatttgctgcatc

SEQ ID NO: 92543 - DNA, 25 bp, Homo sapien
gtatttgctgcatcgtaatgacatg

SEQ ID NO: 92544 - DNA, 25 bp, Homo sapien
gacatgagtactactttagttggtt

SEQ ID NO: 92545 - DNA, 25 bp, Homo sapien
ttcctttagttgattttaccctgat

SEQ ID NO: 92546 - DNA, 25 bp, Homo sapien
gattttaccctgatttcaccgagtg

SEQ ID NO: 92547 - DNA, 25 bp, Homo sapien
tctgtgccattcatctctccattgg

SEQ ID NO: 92548 - DNA, 25 bp, Homo sapien
gtttcccaaatgtggactgagcaca

SEQ ID NO: 92549 - DNA, 25 bp, Homo sapien
agcacacactgtgagtcaggcctga

SEQ ID NO: 92550 - DNA, 25 bp, Homo sapien
gagtcaggcctgagctaggttctag

SEQ ID NO: 92551 - DNA, 25 bp, Homo sapien
taggttctagggatgctactgtcaa

SEQ ID NO: 92552 - DNA, 25 bp, Homo sapien
ctagggatgctactgtcaacaagac

SEQ ID NO: 92553 - DNA, 25 bp, Homo sapien
caagacagatgaaggttcctgccct

SEQ ID NO: 92554 - DNA, 25 bp, Homo sapien
tgtgggtggacactttccagccctg

SEQ ID NO: 92555 - DNA, 25 bp, Homo sapien
cctgggtcctgaactctaccaatca

SEQ ID NO: 92556 - DNA, 25 bp, Homo sapien
atcagcaggaacctagactcctgag

SEQ ID NO: 92557 - DNA, 25 bp, Homo sapien
ggaactgggttcctgagcgcatctc

SEQ ID NO: 92558 - DNA, 25 bp, Homo sapien
gacccaatctgagtcttatcgttgt

SEQ ID NO: 92559 - DNA, 25 bp, Homo sapien
atctgagtcttatcgttgtactgat

SEQ ID NO: 92560 - DNA, 25 bp, Homo sapien
gatagaagggtcagatatccccaca

SEQ ID NO: 92561 - DNA, 25 bp, Homo sapien
gtcagatatccccacatggagttga

SEQ ID NO: 92562 - DNA, 25 bp, Homo sapien
gagattcactagagaataactcctt

SEQ ID NO: 92563 - DNA, 25 bp, Homo sapien
ataactccttagagaccaatgtctg

SEQ ID NO: 92564 - DNA, 25 bp, Homo sapien
gaccaatgtctgtagcaggtgtaca

SEQ ID NO: 92565 - DNA, 25 bp, Homo sapien
tagcaggtgtacagcatcttgtgaa

SEQ ID NO: 92566 - DNA, 25 bp, Homo sapien
gacagtttgcatgggctgagttata

SEQ ID NO: 92567 - DNA, 25 bp, Homo sapien
gagttataccagctagaccaggaat

SEQ ID NO: 92568 - DNA, 25 bp, Homo sapien
gaagaattctatacctcaggatttc

SEQ ID NO: 92569 - DNA, 25 bp, Homo sapien
gaactagcctagtccttgttacgat

SEQ ID NO: 92570 - DNA, 25 bp, Homo sapien
gtccttgttacgattagtactttgg

SEQ ID NO: 92571 - DNA, 25 bp, Homo sapien
agatgcagtcatcttgtttgacctc

SEQ ID NO: 92572 - DNA, 25 bp, Homo sapien
tttgacctcagtaaccccagacagt

SEQ ID NO: 92573 - DNA, 25 bp, Homo sapien
taagaaaacctctccttttgagctg

SEQ ID NO: 92574 - DNA, 25 bp, Homo sapien
tttgagctgatacaggttttttccc

SEQ ID NO: 92575 - DNA, 25 bp, Homo sapien
gaatccttttctggcatgtttattg

SEQ ID NO: 92576 - DNA, 25 bp, Homo sapien
ttgtatgaaataatgaggctctcca

SEQ ID NO: 92577 - DNA, 25 bp, Homo sapien
gaggctctccatggaaggatgaaca

SEQ ID NO: 92578 - DNA, 25 bp, Homo sapien
gtcaagggattgcaattctctctga

SEQ ID NO: 92579 - DNA, 25 bp, Homo sapien
gatagacttagttttcagaccttat

SEQ ID NO: 92580 - DNA, 25 bp, Homo sapien
aattaagtgtctgggtactctgcca

SEQ ID NO: 92581 - DNA, 25 bp, Homo sapien
tctgggtactctgccagtcaggaga

SEQ ID NO: 92582 - DNA, 25 bp, Homo sapien
gccagtcaggagagatgttaccaaa

SEQ ID NO: 92583 - DNA, 25 bp, Homo sapien
gtattgtcagaagagccaagttcat

SEQ ID NO: 92584 - DNA, 25 bp, Homo sapien
gagccaagttcataatcaggcccat

SEQ ID NO: 92585 - DNA, 25 bp, Homo sapien
tcaggcccataggatcaataatttg

SEQ ID NO: 92586 - DNA, 25 bp, Homo sapien
agtgtttagagcagtttcaaagatg

SEQ ID NO: 92587 - DNA, 25 bp, Homo sapien
atttcaggactgagcacatgccaag

SEQ ID NO: 92588 - DNA, 25 bp, Homo sapien
acatgccaaggcacccttttatgga

SEQ ID NO: 92589 - DNA, 25 bp, Homo sapien
ggcacccttttatggatattcaacc

SEQ ID NO: 92590 - DNA, 25 bp, Homo sapien
gggaggagtcatttacttaaaagag

SEQ ID NO: 92591 - DNA, 25 bp, Homo sapien
aggagaatcgctttaggctatgggt

SEQ ID NO: 92592 - DNA, 25 bp, Homo sapien
ggagaatcgctttaggctatgggtt

SEQ ID NO: 92593 - DNA, 25 bp, Homo sapien
gagaatcgctttaggctatgggttt

SEQ ID NO: 92594 - DNA, 25 bp, Homo sapien
agaatcgctttaggctatgggtttg

SEQ ID NO: 92595 - DNA, 25 bp, Homo sapien
aatcgctttaggctatgggtttgag

SEQ ID NO: 92596 - DNA, 25 bp, Homo sapien
atcgctttaggctatgggtttgaga

SEQ ID NO: 92597 - DNA, 25 bp, Homo sapien
cgctttaggctatgggtttgagacc

SEQ ID NO: 92598 - DNA, 25 bp, Homo sapien
gctttaggctatgggtttgagacca

SEQ ID NO: 92599 - DNA, 25 bp, Homo sapien
caaaaaaacatagccaagcgtggtg

SEQ ID NO: 92600 - DNA, 25 bp, Homo sapien
gatcgggccactgccctttagactg

SEQ ID NO: 92601 - DNA, 25 bp, Homo sapien
cgggccactgccctttagactgggc

SEQ ID NO: 92602 - DNA, 25 bp, Homo sapien
gcatgggccaaaatcacaaagcaag

SEQ ID NO: 92603 - DNA, 25 bp, Homo sapien
aaaacagtaatactcagtgaccaca

SEQ ID NO: 92604 - DNA, 25 bp, Homo sapien
acaaaagagccccagtgtctgaaga

SEQ ID NO: 92605 - DNA, 25 bp, Homo sapien
aaagagccccagtgtctgaagaaaa

SEQ ID NO: 92606 - DNA, 25 bp, Homo sapien
ggcagtgtacctgaacaatccaaaa

SEQ ID NO: 92607 - DNA, 25 bp, Homo sapien
gtacctgaacaatccaaaaacaact

SEQ ID NO: 92608 - DNA, 25 bp, Homo sapien
tactcattacaattagaaccttcat

SEQ ID NO: 92609 - DNA, 25 bp, Homo sapien
acaattagaaccttcatcatttcca

SEQ ID NO: 92610 - DNA, 25 bp, Homo sapien
aaaaggacttcatttctctctgcct

SEQ ID NO: 92611 - DNA, 25 bp, Homo sapien
gacttcatttctctctgcctcaatt

SEQ ID NO: 92612 - DNA, 25 bp, Homo sapien
tctgcctcaattcctctagtttaaa

SEQ ID NO: 92613 - DNA, 25 bp, Homo sapien
caggcattgccctagaggcagggaa

SEQ ID NO: 92614 - DNA, 25 bp, Homo sapien
gaaattgcggcagtacaggaaggta

SEQ ID NO: 92615 - DNA, 25 bp, Homo sapien
aaggtaaggtccctgtaccgcagag

SEQ ID NO: 92616 - DNA, 25 bp, Homo sapien
agagctcacagtctcatgggaagga

SEQ ID NO: 92617 - DNA, 25 bp, Homo sapien
gaaggagttcttacacaggtgaggt

SEQ ID NO: 92618 - DNA, 25 bp, Homo sapien
gggtgagccacagactactgtagac

SEQ ID NO: 92619 - DNA, 25 bp, Homo sapien
gccacagactactgtagacacggta

SEQ ID NO: 92620 - DNA, 25 bp, Homo sapien
gacacggtagcaacgtaggtctctt

SEQ ID NO: 92621 - DNA, 25 bp, Homo sapien
cgtaggtctcttaagaaagtgacac

SEQ ID NO: 92622 - DNA, 25 bp, Homo sapien
aagtgacacacaacgtaggcctaat

SEQ ID NO: 92623 - DNA, 25 bp, Homo sapien
caacgtaggcctaatcacagcactt

SEQ ID NO: 92624 - DNA, 25 bp, Homo sapien
agtagaaactctaagagaccattac

SEQ ID NO: 92625 - DNA, 25 bp, Homo sapien
gggatgtattctaaaaactgacaga

SEQ ID NO: 92626 - DNA, 25 bp, Homo sapien
gaaaagagaatctgatagtcaacac

SEQ ID NO: 92627 - DNA, 25 bp, Homo sapien
agccctgtaagccagctttcttcta

SEQ ID NO: 92628 - DNA, 25 bp, Homo sapien
cctgtaagccagctttcttctatat

SEQ ID NO: 92629 - DNA, 25 bp, Homo sapien
gctttcttctatatttataaacacg

SEQ ID NO: 92630 - DNA, 25 bp, Homo sapien
aaacacgataaatgcatgagaagat

SEQ ID NO: 92631 - DNA, 25 bp, Homo sapien
aatgcatgagaagatctgttattac

SEQ ID NO: 92632 - DNA, 25 bp, Homo sapien
gcatgagaagatctgttattacatt

SEQ ID NO: 92633 - DNA, 25 bp, Homo sapien
gaagatctgttattacattagtata

SEQ ID NO: 92634 - DNA, 25 bp, Homo sapien
atattacgttatttattatgatcct

SEQ ID NO: 92635 - DNA, 25 bp, Homo sapien
tgattttaggtagaagagttttgag

SEQ ID NO: 92636 - DNA, 25 bp, Homo sapien
gattttaggtagaagagttttgagg

SEQ ID NO: 92637 - DNA, 25 bp, Homo sapien
ttttaggtagaagagttttgaggct

SEQ ID NO: 92638 - DNA, 25 bp, Homo sapien
tttaggtagaagagttttgaggctg

SEQ ID NO: 92639 - DNA, 25 bp, Homo sapien
ttaggtagaagagttttgaggctgg

SEQ ID NO: 92640 - DNA, 25 bp, Homo sapien
taggtagaagagttttgaggctggg

SEQ ID NO: 92641 - DNA, 25 bp, Homo sapien
aggtagaagagttttgaggctgggc

SEQ ID NO: 92642 - DNA, 25 bp, Homo sapien
ggtagaagagttttgaggctgggcg

SEQ ID NO: 92643 - DNA, 25 bp, Homo sapien
gtagaagagttttgaggctgggcgc

SEQ ID NO: 92644 - DNA, 25 bp, Homo sapien
cctagcattttgggtgactgaggcg

SEQ ID NO: 92645 - DNA, 25 bp, Homo sapien
ctagcattttgggtgactgaggcgg

SEQ ID NO: 92646 - DNA, 25 bp, Homo sapien
tgaataaataaaaaaccaggccagg

SEQ ID NO: 92647 - DNA, 25 bp, Homo sapien
taaataaaaaaccaggccaggcgtg

SEQ ID NO: 92648 - DNA, 25 bp, Homo sapien
ataaaaaaccaggccaggcgtggtg

SEQ ID NO: 92649 - DNA, 25 bp, Homo sapien
taaaaaaccaggccaggcgtggtgg

SEQ ID NO: 92650 - DNA, 25 bp, Homo sapien
aaaaaccaggccaggcgtggtggct

SEQ ID NO: 92651 - DNA, 25 bp, Homo sapien
aaaaccaggccaggcgtggtggctc

SEQ ID NO: 92652 - DNA, 25 bp, Homo sapien
aaaccaggccaggcgtggtggctca

SEQ ID NO: 92653 - DNA, 25 bp, Homo sapien
aaccaggccaggcgtggtggctcac

SEQ ID NO: 92654 - DNA, 25 bp, Homo sapien
gttgagggaaagtttagacatctgc

SEQ ID NO: 92655 - DNA, 25 bp, Homo sapien
aagtttagacatctgcagagaggca

SEQ ID NO: 92656 - DNA, 25 bp, Homo sapien
ggacccgttcctcttgaaccagtca

SEQ ID NO: 92657 - DNA, 25 bp, Homo sapien
ttgaaccagtcattgcctgtggcaa

SEQ ID NO: 92658 - DNA, 25 bp, Homo sapien
gcctgtggcaaatgtgtgtatgaga

SEQ ID NO: 92659 - DNA, 25 bp, Homo sapien
atgtggagtagacagtgcgcacctc

SEQ ID NO: 92660 - DNA, 25 bp, Homo sapien
ggagtagacagtgcgcacctcaggc

SEQ ID NO: 92661 - DNA, 25 bp, Homo sapien
gggccttgagcgcaggcctcatctt

SEQ ID NO: 92662 - DNA, 25 bp, Homo sapien
ggcctcatctttctgtgccgcggga

SEQ ID NO: 92663 - DNA, 25 bp, Homo sapien
ggcctagcatggagggaatctgttc

SEQ ID NO: 92664 - DNA, 25 bp, Homo sapien
ggagggaatctgttcccaggccctg

SEQ ID NO: 92665 - DNA, 25 bp, Homo sapien
gaggccttctctaggcgccggcgct

SEQ ID NO: 92666 - DNA, 25 bp, Homo sapien
gggaccgactgctcttggcgcccgg

SEQ ID NO: 92667 - DNA, 25 bp, Homo sapien
ggaaacctcggctcccgggcgacag

SEQ ID NO: 92668 - DNA, 25 bp, Homo sapien
gggcctcgcttcagccgggcgattc

SEQ ID NO: 92669 - DNA, 25 bp, Homo sapien
agccgggcgattcttcccctcattt

SEQ ID NO: 92670 - DNA, 25 bp, Homo sapien
cgggcgattcttcccctcatttgtt

SEQ ID NO: 92671 - DNA, 25 bp, Homo sapien
gcgattcttcccctcatttgttgca

SEQ ID NO: 92672 - DNA, 25 bp, Homo sapien
cctcatttgttgcattgtttgcatt

SEQ ID NO: 92673 - DNA, 25 bp, Homo sapien
gttgcattgtttgcattaatatgaa

SEQ ID NO: 92674 - DNA, 25 bp, Homo sapien
taatatgaatatcttgttctgtttg

SEQ ID NO: 92675 - DNA, 25 bp, Homo sapien
gttctgtttgttttgtctcctgaga

SEQ ID NO: 92676 - DNA, 25 bp, Homo sapien
tgggttcctgggtcaagtttcatca

SEQ ID NO: 92677 - DNA, 25 bp, Homo sapien
aagtttcatcagaagtcaccgtgag

SEQ ID NO: 92678 - DNA, 25 bp, Homo sapien
aagtcaccgtgaggaccatggtcct

SEQ ID NO: 92679 - DNA, 25 bp, Homo sapien
aggaccatggtcctcacctgagagg

SEQ ID NO: 92680 - DNA, 25 bp, Homo sapien
atggtcctcacctgagaggcctgca

SEQ ID NO: 92681 - DNA, 25 bp, Homo sapien
ctggaggctcctgtgtgcttctgtg

SEQ ID NO: 92682 - DNA, 25 bp, Homo sapien
cctgtgtgcttctgtgactgttcct

SEQ ID NO: 92683 - DNA, 25 bp, Homo sapien
tgggagctgtgctgactcttcccgg

SEQ ID NO: 92684 - DNA, 25 bp, Homo sapien
ctgtgcatatcccaggtatcctatc

SEQ ID NO: 92685 - DNA, 25 bp, Homo sapien
ctatcccaaccttgccagcatgtat

SEQ ID NO: 92686 - DNA, 25 bp, Homo sapien
cttgccagcatgtatccaggatttt

SEQ ID NO: 92687 - DNA, 25 bp, Homo sapien
agtagtatatgatcctcagatacag

SEQ ID NO: 92688 - DNA, 25 bp, Homo sapien
gaaggacaaggcatacagcttattg

SEQ ID NO: 92689 - DNA, 25 bp, Homo sapien
aaggcatacagcttattgattagag

SEQ ID NO: 92690 - DNA, 25 bp, Homo sapien
ctcattatgtttggaattgctttct

SEQ ID NO: 92691 - DNA, 25 bp, Homo sapien
gtttggaattgctttctataagaaa

SEQ ID NO: 92692 - DNA, 25 bp, Homo sapien
gaaaattgcccactactactaactt

SEQ ID NO: 92693 - DNA, 25 bp, Homo sapien
actactactaacttgatcaacaatg

SEQ ID NO: 92694 - DNA, 25 bp, Homo sapien
ataacatcctctcaaatgtttgctg

SEQ ID NO: 92695 - DNA, 25 bp, Homo sapien
tcaaatgtttgctgatgaagtacaa

SEQ ID NO: 92696 - DNA, 25 bp, Homo sapien
ggaaaagtctgtaacctgtggatca

SEQ ID NO: 92697 - DNA, 25 bp, Homo sapien
gtctgtaacctgtggatcatatata

SEQ ID NO: 92698 - DNA, 25 bp, Homo sapien
ttggattttctgcaaattcggtaaa

SEQ ID NO: 92699 - DNA, 25 bp, Homo sapien
ttcggtaaaacccatcagtcttaat

SEQ ID NO: 92700 - DNA, 25 bp, Homo sapien
attccacataatccacttagctttt

SEQ ID NO: 92701 - DNA, 25 bp, Homo sapien
tgacagtctgacaccaaactctggt

SEQ ID NO: 92702 - DNA, 25 bp, Homo sapien
tgacaccaaactctggtctctctct

SEQ ID NO: 92703 - DNA, 25 bp, Homo sapien
gtctctctctgaccactaatcaaat

SEQ ID NO: 92704 - DNA, 25 bp, Homo sapien
aatcaaatgttctctggatggatac

SEQ ID NO: 92705 - DNA, 25 bp, Homo sapien
gatggatacatactgatttcttact

SEQ ID NO: 92706 - DNA, 25 bp, Homo sapien
attgtattggtatactgcaggcttc

SEQ ID NO: 92707 - DNA, 25 bp, Homo sapien
tgcaggcttctggtagccacttaac

SEQ ID NO: 92708 - DNA, 25 bp, Homo sapien
cacttaaccataccagcaacctatt

SEQ ID NO: 92709 - DNA, 25 bp, Homo sapien
gaaactctaagagaccattaccatt

SEQ ID NO: 92710 - DNA, 25 bp, Homo sapien
gggatgtattctaaaaactgacaga

SEQ ID NO: 92711 - DNA, 25 bp, Homo sapien
gaaaagagaatctgatagtcaacac

SEQ ID NO: 92712 - DNA, 25 bp, Homo sapien
caaatttgtcccaacagccctgtaa

SEQ ID NO: 92713 - DNA, 25 bp, Homo sapien
agccctgtaagccagctttcttcta

SEQ ID NO: 92714 - DNA, 25 bp, Homo sapien
cctgtaagccagctttcttctatat

SEQ ID NO: 92715 - DNA, 25 bp, Homo sapien
gctttcttctatatttataaacacg

SEQ ID NO: 92716 - DNA, 25 bp, Homo sapien
aaacacgataaatgcatgagaagat

SEQ ID NO: 92717 - DNA, 25 bp, Homo sapien
gcatgagaagatctgttattacatt

SEQ ID NO: 92718 - DNA, 25 bp, Homo sapien
gaagatctgttattacattagtata

SEQ ID NO: 92719 - DNA, 25 bp, Homo sapien
acgttatttattatgatcctagttg

SEQ ID NO: 92720 - DNA, 25 bp, Homo sapien
attaagagtacttgagtagtctcaa

SEQ ID NO: 92721 - DNA, 25 bp, Homo sapien
gagtagtctcaataggagtgtattt

SEQ ID NO: 92722 - DNA, 25 bp, Homo sapien
gtgtatttgtagacagcagtttccc

SEQ ID NO: 92723 - DNA, 25 bp, Homo sapien
ccctatattatttggagtcaattct

SEQ ID NO: 92724 - DNA, 25 bp, Homo sapien
gagtcaattcttacgtaatttgttg

SEQ ID NO: 92725 - DNA, 25 bp, Homo sapien
tcttcagtgaacattgtctttttct

SEQ ID NO: 92726 - DNA, 25 bp, Homo sapien
gtctttttctggcagctgaaactgc

SEQ ID NO: 92727 - DNA, 25 bp, Homo sapien
agctgaaactgcacacaactgatac

SEQ ID NO: 92728 - DNA, 25 bp, Homo sapien
gaaactgcacacaactgatacacat

SEQ ID NO: 92729 - DNA, 25 bp, Homo sapien
taatttgtattcctttgtagtaata

SEQ ID NO: 92730 - DNA, 25 bp, Homo sapien
tgtagtaatacattttaaccatgat

SEQ ID NO: 92731 - DNA, 25 bp, Homo sapien
agtccttctctagttaatcaggttc

SEQ ID NO: 92732 - DNA, 25 bp, Homo sapien
gtccttctctagttaatcaggttca

SEQ ID NO: 92733 - DNA, 25 bp, Homo sapien
cttctctagttaatcaggttcacac

SEQ ID NO: 92734 - DNA, 25 bp, Homo sapien
tctctagttaatcaggttcacactt

SEQ ID NO: 92735 - DNA, 25 bp, Homo sapien
tagttaatcaggttcacactttgca

SEQ ID NO: 92736 - DNA, 25 bp, Homo sapien
gttaatcaggttcacactttgcaac

SEQ ID NO: 92737 - DNA, 25 bp, Homo sapien
taatcaggttcacactttgcaacta

SEQ ID NO: 92738 - DNA, 25 bp, Homo sapien
atcaggttcacactttgcaactaag

SEQ ID NO: 92739 - DNA, 25 bp, Homo sapien
caggttcacactttgcaactaagaa

SEQ ID NO: 92740 - DNA, 25 bp, Homo sapien
gttcacactttgcaactaagaaaat

SEQ ID NO: 92741 - DNA, 25 bp, Homo sapien
taagaaaatagaagtgggccaggca

SEQ ID NO: 92742 - DNA, 25 bp, Homo sapien
atctcaggagcacctcagggtgtcg

SEQ ID NO: 92743 - DNA, 25 bp, Homo sapien
ctcaggagcacctcagggtgtcggt

SEQ ID NO: 92744 - DNA, 25 bp, Homo sapien
caggagcacctcagggtgtcggtta

SEQ ID NO: 92745 - DNA, 25 bp, Homo sapien
gagcacctcagggtgtcggttaaga

SEQ ID NO: 92746 - DNA, 25 bp, Homo sapien
gcacctcagggtgtcggttaagaga

SEQ ID NO: 92747 - DNA, 25 bp, Homo sapien
acctcagggtgtcggttaagagaca

SEQ ID NO: 92748 - DNA, 25 bp, Homo sapien
ggtgtcggttaagagacaggcctcc

SEQ ID NO: 92749 - DNA, 25 bp, Homo sapien
agagcctgctcttagctcccggtgc

SEQ ID NO: 92750 - DNA, 25 bp, Homo sapien
acagggcctttccctacaggacacg

SEQ ID NO: 92751 - DNA, 25 bp, Homo sapien
tacaggacacgccccagagctgtgg

SEQ ID NO: 92752 - DNA, 25 bp, Homo sapien
cagagctgtggcagattgcaggagc

SEQ ID NO: 92753 - DNA, 25 bp, Homo sapien
gacttctggattcttgaggtagtta

SEQ ID NO: 92754 - DNA, 25 bp, Homo sapien
ttttttaaaagcagggtaagccatg

SEQ ID NO: 92755 - DNA, 25 bp, Homo sapien
agcagggtaagccatgaagtgaata

SEQ ID NO: 92756 - DNA, 25 bp, Homo sapien
agccatgaagtgaatacagggtgac

SEQ ID NO: 92757 - DNA, 25 bp, Homo sapien
gtgaatacagggtgactgatgagaa

SEQ ID NO: 92758 - DNA, 25 bp, Homo sapien
tgagattaattcttttgggttttct

SEQ ID NO: 92759 - DNA, 25 bp, Homo sapien
gttttcttggttttaaggcatctcg

SEQ ID NO: 92760 - DNA, 25 bp, Homo sapien
ttaaggcatctcgaatgccccttga

SEQ ID NO: 92761 - DNA, 25 bp, Homo sapien
aggcatctcgaatgccccttgaaaa

SEQ ID NO: 92762 - DNA, 25 bp, Homo sapien
ctcgaatgccccttgaaaatgtagt

SEQ ID NO: 92763 - DNA, 25 bp, Homo sapien
gaaaatgtagttttccctggtggtg

SEQ ID NO: 92764 - DNA, 25 bp, Homo sapien
gtgttctcagtaggaaatgttcatc

SEQ ID NO: 92765 - DNA, 25 bp, Homo sapien
aatgttcatctgttacatggaaaaa

SEQ ID NO: 92766 - DNA, 25 bp, Homo sapien
ggcaggcatttaccaggccatgtgc

SEQ ID NO: 92767 - DNA, 25 bp, Homo sapien
atttaccaggccatgtgctttaacg

SEQ ID NO: 92768 - DNA, 25 bp, Homo sapien
ggccatgtgctttaacgttacggta

SEQ ID NO: 92769 - DNA, 25 bp, Homo sapien
gtaatactttactttaggcatccct

SEQ ID NO: 92770 - DNA, 25 bp, Homo sapien
tttactttaggcatccctcctgttg

SEQ ID NO: 92771 - DNA, 25 bp, Homo sapien
tttaggcatccctcctgttgctagc

SEQ ID NO: 92772 - DNA, 25 bp, Homo sapien
agcagccttttgacctatctgcaat

SEQ ID NO: 92773 - DNA, 25 bp, Homo sapien
gccttttgacctatctgcaatgcag

SEQ ID NO: 92774 - DNA, 25 bp, Homo sapien
gacctatctgcaatgcagtgttctc

SEQ ID NO: 92775 - DNA, 25 bp, Homo sapien
ctgggttggaggactcgcccgactc

SEQ ID NO: 92776 - DNA, 25 bp, Homo sapien
gactcgcccgactccgggtggagac

SEQ ID NO: 92777 - DNA, 25 bp, Homo sapien
ccgactccgggtggagactatgtct

SEQ ID NO: 92778 - DNA, 25 bp, Homo sapien
ctccgggtggagactatgtctgcgt

SEQ ID NO: 92779 - DNA, 25 bp, Homo sapien
gtggagactatgtctgcgtcttcac

SEQ ID NO: 92780 - DNA, 25 bp, Homo sapien
gagactatgtctgcgtcttcacgga

SEQ ID NO: 92781 - DNA, 25 bp, Homo sapien
tatgtctgcgtcttcacggacctct

SEQ ID NO: 92782 - DNA, 25 bp, Homo sapien
ttcacggacctctgcaccctgaggg

SEQ ID NO: 92783 - DNA, 25 bp, Homo sapien
ggctgtccccagacggtcacgaact

SEQ ID NO: 92784 - DNA, 25 bp, Homo sapien
agacggtcacgaactgccaagaggt

SEQ ID NO: 92785 - DNA, 25 bp, Homo sapien
cggtcacgaactgccaagaggtcac

SEQ ID NO: 92786 - DNA, 25 bp, Homo sapien
ccggaggcgtcatctctcttctgta

SEQ ID NO: 92787 - DNA, 25 bp, Homo sapien
atctctcttctgtaccactagaggg

SEQ ID NO: 92788 - DNA, 25 bp, Homo sapien
ttctgtaccactagagggagctctg

SEQ ID NO: 92789 - DNA, 25 bp, Homo sapien
taccactagagggagctctgatgca

SEQ ID NO: 92790 - DNA, 25 bp, Homo sapien
gatgcagctggagagcagcgctcaa

SEQ ID NO: 92791 - DNA, 25 bp, Homo sapien
gagagcagcgctcaaggctctcgcc

SEQ ID NO: 92792 - DNA, 25 bp, Homo sapien
ttcagtctccaccagcctgaagggc

SEQ ID NO: 92793 - DNA, 25 bp, Homo sapien
aagggcctcctaggggatcctcagg

SEQ ID NO: 92794 - DNA, 25 bp, Homo sapien
agggcacaccctactgtccttgtgc

SEQ ID NO: 92795 - DNA, 25 bp, Homo sapien
caccttccctttcaataaacagctg

SEQ ID NO: 92796 - DNA, 25 bp, Homo sapien
ctttcaataaacagctgggatggaa

SEQ ID NO: 92797 - DNA, 25 bp, Homo sapien
gggagtacgtgctcatgatccgcga

SEQ ID NO: 92798 - DNA, 25 bp, Homo sapien
tacgtgctcatgatccgcgacgtga

SEQ ID NO: 92799 - DNA, 25 bp, Homo sapien
ggccttcaaacacctgcgggtcgta

SEQ ID NO: 92800 - DNA, 25 bp, Homo sapien
aaacacctgcgggtcgtagcgaaga

SEQ ID NO: 92801 - DNA, 25 bp, Homo sapien
gaaggccctgaagcctcaagcagct

SEQ ID NO: 92802 - DNA, 25 bp, Homo sapien
tgaggccccgtgtccacaggaggcc

SEQ ID NO: 92803 - DNA, 25 bp, Homo sapien
cacaggaggccacctcggtgtgaat

SEQ ID NO: 92804 - DNA, 25 bp, Homo sapien
gccacctcggtgtgaatggaaggaa

SEQ ID NO: 92805 - DNA, 25 bp, Homo sapien
aatggaaggaaacgctgcctctgct

SEQ ID NO: 92806 - DNA, 25 bp, Homo sapien
ggaaacgctgcctctgcttgcgtga

SEQ ID NO: 92807 - DNA, 25 bp, Homo sapien
tgcttgcgtgactctgctccccgat

SEQ ID NO: 92808 - DNA, 25 bp, Homo sapien
agggcttccagcaggattgagtcac

SEQ ID NO: 92809 - DNA, 25 bp, Homo sapien
attgagtcaccctgacgatgaccgg

SEQ ID NO: 92810 - DNA, 25 bp, Homo sapien
agccgtgtgctcttcattattttca

SEQ ID NO: 92811 - DNA, 25 bp, Homo sapien
actgcctagggtctcatggactgta

SEQ ID NO: 92812 - DNA, 25 bp, Homo sapien
aggcagcctgccagtgaaggtcact

SEQ ID NO: 92813 - DNA, 25 bp, Homo sapien
tggactctagcctacaacatgctga

SEQ ID NO: 92814 - DNA, 25 bp, Homo sapien
tgagctacagcccagaagccagaca

SEQ ID NO: 92815 - DNA, 25 bp, Homo sapien
agccagacatgcctgtcttagctga

SEQ ID NO: 92816 - DNA, 25 bp, Homo sapien
tagctgacctgtttttggtccactt

SEQ ID NO: 92817 - DNA, 25 bp, Homo sapien
acttttgcccttccatgactaataa

SEQ ID NO: 92818 - DNA, 25 bp, Homo sapien
tcatacacacacaaggacctggatt

SEQ ID NO: 92819 - DNA, 25 bp, Homo sapien
atttgtattgattgaggcctatgaa

SEQ ID NO: 92820 - DNA, 25 bp, Homo sapien
ggcctatgaactgacctgaattgga

SEQ ID NO: 92821 - DNA, 25 bp, Homo sapien
acttagctctggatgaggctgggca

SEQ ID NO: 92822 - DNA, 25 bp, Homo sapien
ggctgggcagagatctaccatgtaa

SEQ ID NO: 92823 - DNA, 25 bp, Homo sapien
gagatctaccatgtaaaatgttgta

SEQ ID NO: 92824 - DNA, 25 bp, Homo sapien
gatagagccatataacgtcacgttt

SEQ ID NO: 92825 - DNA, 25 bp, Homo sapien
acgtcacgtttcaaaactagctcta

SEQ ID NO: 92826 - DNA, 25 bp, Homo sapien
aactagctctacagttttgcttctc

SEQ ID NO: 92827 - DNA, 25 bp, Homo sapien
ttttgcttctcctattagccatatg

SEQ ID NO: 92828 - DNA, 25 bp, Homo sapien
agccatatgataattgggctatgta

SEQ ID NO: 92829 - DNA, 25 bp, Homo sapien
ttgggctatgtagtatcaatattta

SEQ ID NO: 92830 - DNA, 25 bp, Homo sapien
actggtcttgaaccaacacatcttt

SEQ ID NO: 92831 - DNA, 25 bp, Homo sapien
tggtcttgaaccaacacatctttag

SEQ ID NO: 92832 - DNA, 25 bp, Homo sapien
gtcttgaaccaacacatctttagct

SEQ ID NO: 92833 - DNA, 25 bp, Homo sapien
ttgaaccaacacatctttagctttt

SEQ ID NO: 92834 - DNA, 25 bp, Homo sapien
tttttaaaagacagccttggccagc

SEQ ID NO: 92835 - DNA, 25 bp, Homo sapien
taaaagacagccttggccagccatg

SEQ ID NO: 92836 - DNA, 25 bp, Homo sapien
aaagacagccttggccagccatggc

SEQ ID NO: 92837 - DNA, 25 bp, Homo sapien
acagccttggccagccatggcagct

SEQ ID NO: 92838 - DNA, 25 bp, Homo sapien
acttgtaatcactgcactttcggaa

SEQ ID NO: 92839 - DNA, 25 bp, Homo sapien
ttgtaatcactgcactttcggaagc

SEQ ID NO: 92840 - DNA, 25 bp, Homo sapien
gagctgtgattacctcactgcattc

SEQ ID NO: 92841 - DNA, 25 bp, Homo sapien
taccatttaccccagcatgcttgtg

SEQ ID NO: 92842 - DNA, 25 bp, Homo sapien
agcatgcttgtgacgggcagacctc

SEQ ID NO: 92843 - DNA, 25 bp, Homo sapien
ctaaaaggtgttgtgagtggtctca

SEQ ID NO: 92844 - DNA, 25 bp, Homo sapien
tggcatggaaataatcagctttgtt

SEQ ID NO: 92845 - DNA, 25 bp, Homo sapien
aaggattctgcaaatagcctgcgga

SEQ ID NO: 92846 - DNA, 25 bp, Homo sapien
atagcctgcggagacttacctgtgt

SEQ ID NO: 92847 - DNA, 25 bp, Homo sapien
gacttacctgtgttgattgatttca

SEQ ID NO: 92848 - DNA, 25 bp, Homo sapien
gattgatttcatatgatgctcgtta

SEQ ID NO: 92849 - DNA, 25 bp, Homo sapien
tatatccaatatccaagtcacccag

SEQ ID NO: 92850 - DNA, 25 bp, Homo sapien
cctgcttcacattgctcatgataat

SEQ ID NO: 92851 - DNA, 25 bp, Homo sapien
ttgctcatgataataaaggcctgtt

SEQ ID NO: 92852 - DNA, 25 bp, Homo sapien
acaaggtcaggagtttgggaccagc

SEQ ID NO: 92853 - DNA, 25 bp, Homo sapien
ccaacatggtgaaatatacaaaaat

SEQ ID NO: 92854 - DNA, 25 bp, Homo sapien
caacatggtgaaatatacaaaaata

SEQ ID NO: 92855 - DNA, 25 bp, Homo sapien
acatggtgaaatatacaaaaataca

SEQ ID NO: 92856 - DNA, 25 bp, Homo sapien
aaattagttgggtgcggtgacatgc

SEQ ID NO: 92857 - DNA, 25 bp, Homo sapien
aattagttgggtgcggtgacatgca

SEQ ID NO: 92858 - DNA, 25 bp, Homo sapien
tagttgggtgcggtgacatgcacct

SEQ ID NO: 92859 - DNA, 25 bp, Homo sapien
agttgggtgcggtgacatgcacctg

SEQ ID NO: 92860 - DNA, 25 bp, Homo sapien
cggtgacatgcacctgtaatcccac

SEQ ID NO: 92861 - DNA, 25 bp, Homo sapien
ggtgacatgcacctgtaatcccacc

SEQ ID NO: 92862 - DNA, 25 bp, Homo sapien
gtgacatgcacctgtaatcccacct

SEQ ID NO: 92863 - DNA, 25 bp, Homo sapien
aagactttttcctcatacatctcca

SEQ ID NO: 92864 - DNA, 25 bp, Homo sapien
tttttcctcatacatctccaaattg

SEQ ID NO: 92865 - DNA, 25 bp, Homo sapien
acttactttatgagtgtttgtttag

SEQ ID NO: 92866 - DNA, 25 bp, Homo sapien
tttgtttagaagttcggaccaacag

SEQ ID NO: 92867 - DNA, 25 bp, Homo sapien
gttcggaccaacagaaaaatgcagt

SEQ ID NO: 92868 - DNA, 25 bp, Homo sapien
gatgtcatcttggaattggtttcta

SEQ ID NO: 92869 - DNA, 25 bp, Homo sapien
aaagagtaaggcatgtccctgccca

SEQ ID NO: 92870 - DNA, 25 bp, Homo sapien
tccctgcccagaaacttaggaagca

SEQ ID NO: 92871 - DNA, 25 bp, Homo sapien
caacagaaatagagggtttgtgcca

SEQ ID NO: 92872 - DNA, 25 bp, Homo sapien
aaatgctatgaacggccctttctta

SEQ ID NO: 92873 - DNA, 25 bp, Homo sapien
tatgaacggccctttcttaaagaca

SEQ ID NO: 92874 - DNA, 25 bp, Homo sapien
ctgggagtgacctggtaaagtgcaa

SEQ ID NO: 92875 - DNA, 25 bp, Homo sapien
agtgacctggtaaagtgcaacgtgc

SEQ ID NO: 92876 - DNA, 25 bp, Homo sapien
gacctggtaaagtgcaacgtgccat

SEQ ID NO: 92877 - DNA, 25 bp, Homo sapien
aaagtgcaacgtgccatgtgcatgc

SEQ ID NO: 92878 - DNA, 25 bp, Homo sapien
ctgagcaacatgacagccatcacta

SEQ ID NO: 92879 - DNA, 25 bp, Homo sapien
agcaacatgacagccatcactatgg

SEQ ID NO: 92880 - DNA, 25 bp, Homo sapien
atgacagccatcactatggcctggg

SEQ ID NO: 92881 - DNA, 25 bp, Homo sapien
gacagccatcactatggcctgggcc

SEQ ID NO: 92882 - DNA, 25 bp, Homo sapien
ctccaaggcccatgaggatatgact

SEQ ID NO: 92883 - DNA, 25 bp, Homo sapien
ccaaggcccatgaggatatgactgc

SEQ ID NO: 92884 - DNA, 25 bp, Homo sapien
gattacaaggaggtgggcatggata

SEQ ID NO: 92885 - DNA, 25 bp, Homo sapien
atctctcttctgtaccactagaggg

SEQ ID NO: 92886 - DNA, 25 bp, Homo sapien
tcttctgtaccactagagggagctc

SEQ ID NO: 92887 - DNA, 25 bp, Homo sapien
ttctgtaccactagagggagctctg

SEQ ID NO: 92888 - DNA, 25 bp, Homo sapien
gagagcagcgctcaaggctctcgcc

SEQ ID NO: 92889 - DNA, 25 bp, Homo sapien
ttcagtctccaccagcctgaagggc

SEQ ID NO: 92890 - DNA, 25 bp, Homo sapien
caccagcctgaagggcctcctaggg

SEQ ID NO: 92891 - DNA, 25 bp, Homo sapien
aagggcctcctaggggatcctcagg

SEQ ID NO: 92892 - DNA, 25 bp, Homo sapien
agggcacaccctactgtccttgtgc

SEQ ID NO: 92893 - DNA, 25 bp, Homo sapien
caccttccctttcaataaacagctg

SEQ ID NO: 92894 - DNA, 25 bp, Homo sapien
accttccctttcaataaacagctgg

SEQ ID NO: 92895 - DNA, 25 bp, Homo sapien
ctttcaataaacagctgggatggaa

SEQ ID NO: 92896 - DNA, 25 bp, Homo sapien
cttccagtagtcagctctgccgtta

SEQ ID NO: 92897 - DNA, 25 bp, Homo sapien
agtagtcagctctgccgttacttcc

SEQ ID NO: 92898 - DNA, 25 bp, Homo sapien
acttccctgcttgtaagaagatgga

SEQ ID NO: 92899 - DNA, 25 bp, Homo sapien
taagaagatggaatgtcccttctat

SEQ ID NO: 92900 - DNA, 25 bp, Homo sapien
gtcccttctatcatccaaaacattg

SEQ ID NO: 92901 - DNA, 25 bp, Homo sapien
gtaggtttaacactcaatgtacaag

SEQ ID NO: 92902 - DNA, 25 bp, Homo sapien
tgtacaagaccggactgcacattct

SEQ ID NO: 92903 - DNA, 25 bp, Homo sapien
aagaccggactgcacattctaccat

SEQ ID NO: 92904 - DNA, 25 bp, Homo sapien
attctaccatcccaccattaatgtc

SEQ ID NO: 92905 - DNA, 25 bp, Homo sapien
aatggattcgacctcaaaccagcga

SEQ ID NO: 92906 - DNA, 25 bp, Homo sapien
gtcctgcctggcagaagatcatgca

SEQ ID NO: 92907 - DNA, 25 bp, Homo sapien
tgcagctccccagtggacagtgtca

SEQ ID NO: 92908 - DNA, 25 bp, Homo sapien
ggacagtgtcattgtgcccagagtg

SEQ ID NO: 92909 - DNA, 25 bp, Homo sapien
tgtcattgtgcccagagtgctgcaa

SEQ ID NO: 92910 - DNA, 25 bp, Homo sapien
ttgtgcccagagtgctgcaaggtga

SEQ ID NO: 92911 - DNA, 25 bp, Homo sapien
gtgctgcccgcacacctgagtgcaa

SEQ ID NO: 92912 - DNA, 25 bp, Homo sapien
aaccaagcactgtgggcatggtgtt

SEQ ID NO: 92913 - DNA, 25 bp, Homo sapien
tgggcatggtgtttccctctctggg

SEQ ID NO: 92914 - DNA, 25 bp, Homo sapien
tagagtacgccctctcgctgggcaa

SEQ ID NO: 92915 - DNA, 25 bp, Homo sapien
tacgccctctcgctgggcaaagagg

SEQ ID NO: 92916 - DNA, 25 bp, Homo sapien
ggcaaagaggaagtggcacccctcc

SEQ ID NO: 92917 - DNA, 25 bp, Homo sapien
tagcatagaaatgatggccgggcgc

SEQ ID NO: 92918 - DNA, 25 bp, Homo sapien
agagacctctctaagaaggtgagca

SEQ ID NO: 92919 - DNA, 25 bp, Homo sapien
gagacctctctaagaaggtgagcac

SEQ ID NO: 92920 - DNA, 25 bp, Homo sapien
agacctctctaagaaggtgagcact

SEQ ID NO: 92921 - DNA, 25 bp, Homo sapien
gacctctctaagaaggtgagcactt

SEQ ID NO: 92922 - DNA, 25 bp, Homo sapien
acctctctaagaaggtgagcactta

SEQ ID NO: 92923 - DNA, 25 bp, Homo sapien
cctctctaagaaggtgagcacttag

SEQ ID NO: 92924 - DNA, 25 bp, Homo sapien
ctctaagaaggtgagcacttaggcc

SEQ ID NO: 92925 - DNA, 25 bp, Homo sapien
ctaagaaggtgagcacttaggccgg

SEQ ID NO: 92926 - DNA, 25 bp, Homo sapien
aagaaggtgagcacttaggccgggt

SEQ ID NO: 92927 - DNA, 25 bp, Homo sapien
gaaggtgagcacttaggccgggtgc

SEQ ID NO: 92928 - DNA, 25 bp, Homo sapien
aggtgagcacttaggccgggtgcgg

SEQ ID NO: 92929 - DNA, 25 bp, Homo sapien
gtccgtaggagggacagtacctcac

SEQ ID NO: 92930 - DNA, 25 bp, Homo sapien
agtacctcacaacaggcccagcggg

SEQ ID NO: 92931 - DNA, 25 bp, Homo sapien
ggaccacctctctgtacaattggaa

SEQ ID NO: 92932 - DNA, 25 bp, Homo sapien
tgtacaattggaacgcgttttactt

SEQ ID NO: 92933 - DNA, 25 bp, Homo sapien
ggcaaaatgtgtagcagcctgcatg

SEQ ID NO: 92934 - DNA, 25 bp, Homo sapien
cctgcatgagcacagttgttttggg

SEQ ID NO: 92935 - DNA, 25 bp, Homo sapien
agtatgatgtactcacacctgcaaa

SEQ ID NO: 92936 - DNA, 25 bp, Homo sapien
gatgtactcacacctgcaaatctga

SEQ ID NO: 92937 - DNA, 25 bp, Homo sapien
gcaaatctgagcatcgcgaggttaa

SEQ ID NO: 92938 - DNA, 25 bp, Homo sapien
agcatcgcgaggttaaacgttccac

SEQ ID NO: 92939 - DNA, 25 bp, Homo sapien
gtaatcgtcaacagcacaactattt

SEQ ID NO: 92940 - DNA, 25 bp, Homo sapien
gaatttttaccagtccacttgacct

SEQ ID NO: 92941 - DNA, 25 bp, Homo sapien
tcttccctaaccactggctcttgag

SEQ ID NO: 92942 - DNA, 25 bp, Homo sapien
ggctcttgagccagcttgggatttc

SEQ ID NO: 92943 - DNA, 25 bp, Homo sapien
gatttccctggccattgccaatacc

SEQ ID NO: 92944 - DNA, 25 bp, Homo sapien
ggccatctggcttccaatagtacag

SEQ ID NO: 92945 - DNA, 25 bp, Homo sapien
gtacagtggctactcaagttcaagc

SEQ ID NO: 92946 - DNA, 25 bp, Homo sapien
agcgaagaacttccagactctggtg

SEQ ID NO: 92947 - DNA, 25 bp, Homo sapien
agactctggtgactgttacttccca

SEQ ID NO: 92948 - DNA, 25 bp, Homo sapien
ggtgactgttacttcccagagccaa

SEQ ID NO: 92949 - DNA, 25 bp, Homo sapien
cagagccaaccactagtgcatatgt

SEQ ID NO: 92950 - DNA, 25 bp, Homo sapien
gggaatctgggcttccaacatgaat

SEQ ID NO: 92951 - DNA, 25 bp, Homo sapien
agcgataggacagctccctgcaaag

SEQ ID NO: 92952 - DNA, 25 bp, Homo sapien
ccatcttagcaactttctcactgag

SEQ ID NO: 92953 - DNA, 25 bp, Homo sapien
aagcaggattcagagctgctctccc

SEQ ID NO: 92954 - DNA, 25 bp, Homo sapien
tgactcatcttccagctggctcttc

SEQ ID NO: 92955 - DNA, 25 bp, Homo sapien
atcctgaaccatgccttgcttctaa

SEQ ID NO: 92956 - DNA, 25 bp, Homo sapien
ttgcttctaacctgcctggtcaagt

SEQ ID NO: 92957 - DNA, 25 bp, Homo sapien
acctgcctggtcaagttttgtgaaa

SEQ ID NO: 92958 - DNA, 25 bp, Homo sapien
ttgtgaaacttatcctgctgtctcg

SEQ ID NO: 92959 - DNA, 25 bp, Homo sapien
ctgtctcgggctggcacccatatgt

SEQ ID NO: 92960 - DNA, 25 bp, Homo sapien
acccatatgtgctcaccatgtgtaa

SEQ ID NO: 92961 - DNA, 25 bp, Homo sapien
gacatttccaaatgcctttgtgtga

SEQ ID NO: 92962 - DNA, 25 bp, Homo sapien
gaaatctttttcaaaggactgtagt

SEQ ID NO: 92963 - DNA, 25 bp, Homo sapien
aaggactgtagttttgtaatggact

SEQ ID NO: 92964 - DNA, 25 bp, Homo sapien
attgtttttcttccgttcactggct

SEQ ID NO: 92965 - DNA, 25 bp, Homo sapien
tcactggctccacacgtttcctggg

SEQ ID NO: 92966 - DNA, 25 bp, Homo sapien
agttgggtgcaggttttagaaagct

SEQ ID NO: 92967 - DNA, 25 bp, Homo sapien
ttagaaagctgttgctgttaacaat

SEQ ID NO: 92968 - DNA, 25 bp, Homo sapien
tgttaacaataattctcccggccat

SEQ ID NO: 92969 - DNA, 25 bp, Homo sapien
aaatgcctgaatccttgctcagagg

SEQ ID NO: 92970 - DNA, 25 bp, Homo sapien
caaaggtatcttctcgtccctttct

SEQ ID NO: 92971 - DNA, 25 bp, Homo sapien
ttctcgtccctttcttacagccatt

SEQ ID NO: 92972 - DNA, 25 bp, Homo sapien
ttacagccattttcctgcttttcca

SEQ ID NO: 92973 - DNA, 25 bp, Homo sapien
agtcgctttcctctcgggcctttcg

SEQ ID NO: 92974 - DNA, 25 bp, Homo sapien
ccgggctcctttccgcgagagaaca

SEQ ID NO: 92975 - DNA, 25 bp, Homo sapien
tcctttccgcgagagaacactgcgg

SEQ ID NO: 92976 - DNA, 25 bp, Homo sapien
aacactgcggcggagaaaagtcatt

SEQ ID NO: 92977 - DNA, 25 bp, Homo sapien
gaaaagtcattgtcaccttcaacgt

SEQ ID NO: 92978 - DNA, 25 bp, Homo sapien
gtcattgtcaccttcaacgtggatc

SEQ ID NO: 92979 - DNA, 25 bp, Homo sapien
tgtcaccttcaacgtggatccctca

SEQ ID NO: 92980 - DNA, 25 bp, Homo sapien
aactccggcgactcctcaattatgc

SEQ ID NO: 92981 - DNA, 25 bp, Homo sapien
gcgactcctcaattatgcccaggct

SEQ ID NO: 92982 - DNA, 25 bp, Homo sapien
atacacactaaacacgagcgtacca

SEQ ID NO: 92983 - DNA, 25 bp, Homo sapien
cactaaacacgagcgtaccaaagaa

SEQ ID NO: 92984 - DNA, 25 bp, Homo sapien
gggaaagcaaagcaatggcatgttt

SEQ ID NO: 92985 - DNA, 25 bp, Homo sapien
gtaaccagacttagtgtactacttg

SEQ ID NO: 92986 - DNA, 25 bp, Homo sapien
tactacttgagaggcatactgagat

SEQ ID NO: 92987 - DNA, 25 bp, Homo sapien
atggtatttcatggcaatcctaaga

SEQ ID NO: 92988 - DNA, 25 bp, Homo sapien
gaatttaagacagcaacttcctatg

SEQ ID NO: 92989 - DNA, 25 bp, Homo sapien
gacagcaacttcctatgattaaaaa

SEQ ID NO: 92990 - DNA, 25 bp, Homo sapien
gtagtctacctacatcatctcggag

SEQ ID NO: 92991 - DNA, 25 bp, Homo sapien
tacatcatctcggagcatgttggag

SEQ ID NO: 92992 - DNA, 25 bp, Homo sapien
agtcatcatgacactgtgctttcga

SEQ ID NO: 92993 - DNA, 25 bp, Homo sapien
gacactgtgctttcgagggtatttc

SEQ ID NO: 92994 - DNA, 25 bp, Homo sapien
gctttcgagggtatttctgacagag

SEQ ID NO: 92995 - DNA, 25 bp, Homo sapien
gtgccactcagggtggacccagcat

SEQ ID NO: 92996 - DNA, 25 bp, Homo sapien
tgccactcagggtggacccagcatc

SEQ ID NO: 92997 - DNA, 25 bp, Homo sapien
ccactcagggtggacccagcatctc

SEQ ID NO: 92998 - DNA, 25 bp, Homo sapien
caagaagcagctagacacacgccag

SEQ ID NO: 92999 - DNA, 25 bp, Homo sapien
aagaagcagctagacacacgccagg

SEQ ID NO: 93000 - DNA, 25 bp, Homo sapien
agaagcagctagacacacgccaggg

SEQ ID NO: 93001 - DNA, 25 bp, Homo sapien
gaagcagctagacacacgccagggc

SEQ ID NO: 93002 - DNA, 25 bp, Homo sapien
aagcagctagacacacgccagggcg

SEQ ID NO: 93003 - DNA, 25 bp, Homo sapien
agcagctagacacacgccagggcgc

SEQ ID NO: 93004 - DNA, 25 bp, Homo sapien
tagacacacgccagggcgccaagca

SEQ ID NO: 93005 - DNA, 25 bp, Homo sapien
gccaagcacggccagctccgcggac

SEQ ID NO: 93006 - DNA, 25 bp, Homo sapien
tgaagcagggccagctactcggaat

SEQ ID NO: 93007 - DNA, 25 bp, Homo sapien
agctactcggaattaggcagcctac

SEQ ID NO: 93008 - DNA, 25 bp, Homo sapien
gaattaggcagcctaccagcagcag

SEQ ID NO: 93009 - DNA, 25 bp, Homo sapien
gcgattggtggattgcagatctgtt

SEQ ID NO: 93010 - DNA, 25 bp, Homo sapien
gatctgttgtgttttctcttgttgt

SEQ ID NO: 93011 - DNA, 25 bp, Homo sapien
gttttttctctcattgtttgaagtt

SEQ ID NO: 93012 - DNA, 25 bp, Homo sapien
gaagttctgtctgttgttccattcc

SEQ ID NO: 93013 - DNA, 25 bp, Homo sapien
tgtctgttgttccattcccatggtt

SEQ ID NO: 93014 - DNA, 25 bp, Homo sapien
attcccatggttctccgtgtttcct

SEQ ID NO: 93015 - DNA, 25 bp, Homo sapien
tttgcatttgctgggcaattgcgta

SEQ ID NO: 93016 - DNA, 25 bp, Homo sapien
ttcccctgtgtaaagctgagaaata

SEQ ID NO: 93017 - DNA, 25 bp, Homo sapien
cttcctgaacccctgcaaatgaaac

SEQ ID NO: 93018 - DNA, 25 bp, Homo sapien
gaacccctgcaaatgaaaccaaacg

SEQ ID NO: 93019 - DNA, 25 bp, Homo sapien
atgaaaccaaacgtccacctgggtg

SEQ ID NO: 93020 - DNA, 25 bp, Homo sapien
aaacgtccacctgggtgtgttcatt

SEQ ID NO: 93021 - DNA, 25 bp, Homo sapien
acctgggtgtgttcattccttcctg

SEQ ID NO: 93022 - DNA, 25 bp, Homo sapien
gtccttcaaaagtacttgatagcct

SEQ ID NO: 93023 - DNA, 25 bp, Homo sapien
ttgatagcctttcataaggcctggc

SEQ ID NO: 93024 - DNA, 25 bp, Homo sapien
ataaggcctggcacatgtgtcctgg

SEQ ID NO: 93025 - DNA, 25 bp, Homo sapien
aggcctggcacatgtgtcctggttg

SEQ ID NO: 93026 - DNA, 25 bp, Homo sapien
gcacatgtgtcctggttgtgtgtgt

SEQ ID NO: 93027 - DNA, 25 bp, Homo sapien
ggtcaggtttgcgagtgttttgata

SEQ ID NO: 93028 - DNA, 25 bp, Homo sapien
gaccttccctaagccgctggaagat

SEQ ID NO: 93029 - DNA, 25 bp, Homo sapien
cctaagccgctggaagattgtattc

SEQ ID NO: 93030 - DNA, 25 bp, Homo sapien
attccagatgctagcttagaggtca

SEQ ID NO: 93031 - DNA, 25 bp, Homo sapien
aggtcaagtacagtctcctcatgag

SEQ ID NO: 93032 - DNA, 25 bp, Homo sapien
cagtctcctcatgagacatagccta

SEQ ID NO: 93033 - DNA, 25 bp, Homo sapien
gaattggaaaaattgtcccgtctgt

SEQ ID NO: 93034 - DNA, 25 bp, Homo sapien
aaaattgtcccgtctgtcacttgtt

SEQ ID NO: 93035 - DNA, 25 bp, Homo sapien
gtcccgtctgtcacttgttttgttg

SEQ ID NO: 93036 - DNA, 25 bp, Homo sapien
gttttgttgccttaataagcatctg

SEQ ID NO: 93037 - DNA, 25 bp, Homo sapien
gagaaatgcccgtattaggaggatt

SEQ ID NO: 93038 - DNA, 25 bp, Homo sapien
ctgaggtgagccatgattactccac

SEQ ID NO: 93039 - DNA, 25 bp, Homo sapien
ctgaggtctcatcacattctagagc

SEQ ID NO: 93040 - DNA, 25 bp, Homo sapien
ggtctcatcacattctagagcgctt

SEQ ID NO: 93041 - DNA, 25 bp, Homo sapien
attctagagcgcttggatgcccata

SEQ ID NO: 93042 - DNA, 25 bp, Homo sapien
gagcgcttggatgcccatattgaag

SEQ ID NO: 93043 - DNA, 25 bp, Homo sapien
ggatgcccatattgaagaactaaaa

SEQ ID NO: 93044 - DNA, 25 bp, Homo sapien
gacagtgagacaattcacagcctta

SEQ ID NO: 93045 - DNA, 25 bp, Homo sapien
cacagccttaaagtagcctcttaaa

SEQ ID NO: 93046 - DNA, 25 bp, Homo sapien
aacaccaaagagttactgtcatctg

SEQ ID NO: 93047 - DNA, 25 bp, Homo sapien
ctgtcatctgaagtagcagctcttt

SEQ ID NO: 93048 - DNA, 25 bp, Homo sapien
atgatacatctaaagcagtggtgaa

SEQ ID NO: 93049 - DNA, 25 bp, Homo sapien
tttgtttaaaggacttcttccagca

SEQ ID NO: 93050 - DNA, 25 bp, Homo sapien
ggaagtgggaagtcaccagagaaca

SEQ ID NO: 93051 - DNA, 25 bp, Homo sapien
tcaccagagaacaggagagggattt

SEQ ID NO: 93052 - DNA, 25 bp, Homo sapien
gatttgagggcgagaccccagcgct

SEQ ID NO: 93053 - DNA, 25 bp, Homo sapien
ccaggtgtgcatgggtccaaggccc

SEQ ID NO: 93054 - DNA, 25 bp, Homo sapien
tcagccccagggttcggtcgtcagc

SEQ ID NO: 93055 - DNA, 25 bp, Homo sapien
tcggtcgtcagcagtttcccaagaa

SEQ ID NO: 93056 - DNA, 25 bp, Homo sapien
gtcgtcagcagtttcccaagaacaa

SEQ ID NO: 93057 - DNA, 25 bp, Homo sapien
gcagtttcccaagaacaagatgtga

SEQ ID NO: 93058 - DNA, 25 bp, Homo sapien
acaagatgtgatggcatctgctgct

SEQ ID NO: 93059 - DNA, 25 bp, Homo sapien
tgaaaccctgatgaggaccaggccc

SEQ ID NO: 93060 - DNA, 25 bp, Homo sapien
gcaccgctgtcagcctgaggaatta

SEQ ID NO: 93061 - DNA, 25 bp, Homo sapien
tacagaatgaagatctacgacagag

SEQ ID NO: 93062 - DNA, 25 bp, Homo sapien
gtcagagctcacagacgactgtctc

SEQ ID NO: 93063 - DNA, 25 bp, Homo sapien
agacgactgtctctctgttcaggac

SEQ ID NO: 93064 - DNA, 25 bp, Homo sapien
gtctctctgttcaggaccgcttcca

SEQ ID NO: 93065 - DNA, 25 bp, Homo sapien
tcactgaaattcactccctcaatgt

SEQ ID NO: 93066 - DNA, 25 bp, Homo sapien
ccctcaatgtgctggagggcagctg

SEQ ID NO: 93067 - DNA, 25 bp, Homo sapien
tgccaaagttggctctcttagacga

SEQ ID NO: 93068 - DNA, 25 bp, Homo sapien
aagttggctctcttagacgagtcat

SEQ ID NO: 93069 - DNA, 25 bp, Homo sapien
ggctctcttagacgagtcatggatt

SEQ ID NO: 93070 - DNA, 25 bp, Homo sapien
agacgagtcatggatttgtactgaa

SEQ ID NO: 93071 - DNA, 25 bp, Homo sapien
tactgaagtatttacgttttccact

SEQ ID NO: 93072 - DNA, 25 bp, Homo sapien
ggagtcctgagaggacacttccaac

SEQ ID NO: 93073 - DNA, 25 bp, Homo sapien
gaagcactttcatacgcaggcatct

SEQ ID NO: 93074 - DNA, 25 bp, Homo sapien
gcatctcttgttacctacatctaag

SEQ ID NO: 93075 - DNA, 25 bp, Homo sapien
atctaagctgttcccgaaagagtgt

SEQ ID NO: 93076 - DNA, 25 bp, Homo sapien
aagctgttcccgaaagagtgttaca

SEQ ID NO: 93077 - DNA, 25 bp, Homo sapien
gctgttcccgaaagagtgttacaga

SEQ ID NO: 93078 - DNA, 25 bp, Homo sapien
ttcccgaaagagtgttacagaacac

SEQ ID NO: 93079 - DNA, 25 bp, Homo sapien
gaacacaacagtattgtacaatatt

SEQ ID NO: 93080 - DNA, 25 bp, Homo sapien
attcgataagcatatcttcactgca

SEQ ID NO: 93081 - DNA, 25 bp, Homo sapien
gataagcatatcttcactgcacttg

SEQ ID NO: 93082 - DNA, 25 bp, Homo sapien
aagcatatcttcactgcacttgtta

SEQ ID NO: 93083 - DNA, 25 bp, Homo sapien
aggcatttaaattctggcaagggag

SEQ ID NO: 93084 - DNA, 25 bp, Homo sapien
aggaggaagcttatagtgggtcaaa

SEQ ID NO: 93085 - DNA, 25 bp, Homo sapien
ggaggaagcttatagtgggtcaaac

SEQ ID NO: 93086 - DNA, 25 bp, Homo sapien
gaggaagcttatagtgggtcaaaca

SEQ ID NO: 93087 - DNA, 25 bp, Homo sapien
aggaagcttatagtgggtcaaacaa

SEQ ID NO: 93088 - DNA, 25 bp, Homo sapien
gaagcttatagtgggtcaaacaagg

SEQ ID NO: 93089 - DNA, 25 bp, Homo sapien
agcttatagtgggtcaaacaaggag

SEQ ID NO: 93090 - DNA, 25 bp, Homo sapien
atagtgggtcaaacaaggaggtgtc

SEQ ID NO: 93091 - DNA, 25 bp, Homo sapien
caaggaggtgtctagtgtgttgttt

SEQ ID NO: 93092 - DNA, 25 bp, Homo sapien
aggaggtgtctagtgtgttgtttaa

SEQ ID NO: 93093 - DNA, 25 bp, Homo sapien
aaagaaggcttacaattagccaggc

SEQ ID NO: 93094 - DNA, 25 bp, Homo sapien
gaatccttattgtcaaggtttgaag

SEQ ID NO: 93095 - DNA, 25 bp, Homo sapien
ttgcaaccagcatcataccttaaag

SEQ ID NO: 93096 - DNA, 25 bp, Homo sapien
atgtttggcttggtatgccatcacc

SEQ ID NO: 93097 - DNA, 25 bp, Homo sapien
tatgccatcacctattcctgcgaaa

SEQ ID NO: 93098 - DNA, 25 bp, Homo sapien
attcctgcgaaatacattgactact

SEQ ID NO: 93099 - DNA, 25 bp, Homo sapien
attgactactggacctttttgaagg

SEQ ID NO: 93100 - DNA, 25 bp, Homo sapien
tttgaaggacgcgtttggcttagag

SEQ ID NO: 93101 - DNA, 25 bp, Homo sapien
gaggaggaataaccatgccagtttt

SEQ ID NO: 93102 - DNA, 25 bp, Homo sapien
gccagttttggtcaattctctatga

SEQ ID NO: 93103 - DNA, 25 bp, Homo sapien
gatttacttctctcattttgccaca

SEQ ID NO: 93104 - DNA, 25 bp, Homo sapien
attttgccacatttactttagtaga

SEQ ID NO: 93105 - DNA, 25 bp, Homo sapien
agggcaacacaagggttccttatag

SEQ ID NO: 93106 - DNA, 25 bp, Homo sapien
acaagggttccttatagtgatggaa

SEQ ID NO: 93107 - DNA, 25 bp, Homo sapien
gtgccttgactgtggcgatgattac

SEQ ID NO: 93108 - DNA, 25 bp, Homo sapien
gactgtggcgatgattacatgaaaa

SEQ ID NO: 93109 - DNA, 25 bp, Homo sapien
ttacatgaaaactacagatgggatg

SEQ ID NO: 93110 - DNA, 25 bp, Homo sapien
gaactaccacacaatcaaaggactg

SEQ ID NO: 93111 - DNA, 25 bp, Homo sapien
gtaagatcagtggatgacatctatc

SEQ ID NO: 93112 - DNA, 25 bp, Homo sapien
agtggatgacatctatctgaatatc

SEQ ID NO: 93113 - DNA, 25 bp, Homo sapien
atatcctggttgtgacattgtggta

SEQ ID NO: 93114 - DNA, 25 bp, Homo sapien
gacattgtggtataatattgcaaga

SEQ ID NO: 93115 - DNA, 25 bp, Homo sapien
gtacacgggataattctgtattatt

SEQ ID NO: 93116 - DNA, 25 bp, Homo sapien
gtggccctattaatggtcagactgt

SEQ ID NO: 93117 - DNA, 25 bp, Homo sapien
aatggtcagactgttccagcatgag

SEQ ID NO: 93118 - DNA, 25 bp, Homo sapien
actgttccagcatgaggttcttaga

SEQ ID NO: 93119 - DNA, 25 bp, Homo sapien
taggctggcccatgtgtgatcttgt

SEQ ID NO: 93120 - DNA, 25 bp, Homo sapien
agagaatagcatgatcccacttccc

SEQ ID NO: 93121 - DNA, 25 bp, Homo sapien
taggaagcaacctttcgcctgtgca

SEQ ID NO: 93122 - DNA, 25 bp, Homo sapien
tgtgcagcggtccagcacttaactc

SEQ ID NO: 93123 - DNA, 25 bp, Homo sapien
aactctaatacatcagcatgcgtta

SEQ ID NO: 93124 - DNA, 25 bp, Homo sapien
gcatgcgttaattcagctggttggg

SEQ ID NO: 93125 - DNA, 25 bp, Homo sapien
agagggtcccttactgactgtttcg

SEQ ID NO: 93126 - DNA, 25 bp, Homo sapien
tactgactgtttcgtggccctatta

SEQ ID NO: 93127 - DNA, 25 bp, Homo sapien
tattctgcctctactagaactcagc

SEQ ID NO: 93128 - DNA, 25 bp, Homo sapien
agctagagaggacaaaacacacaca

SEQ ID NO: 93129 - DNA, 25 bp, Homo sapien
acatgcacacataggattttacttg

SEQ ID NO: 93130 - DNA, 25 bp, Homo sapien
tgtcaaatctttttcaggcactaat

SEQ ID NO: 93131 - DNA, 25 bp, Homo sapien
ttcaggcactaataacatgtaaatg

SEQ ID NO: 93132 - DNA, 25 bp, Homo sapien
gaactagaatcttctccacatacca

SEQ ID NO: 93133 - DNA, 25 bp, Homo sapien
ataccacctcccatcagaaatcatg

SEQ ID NO: 93134 - DNA, 25 bp, Homo sapien
cctcccatcagaaatcatgtccttg

SEQ ID NO: 93135 - DNA, 25 bp, Homo sapien
catgtccttgaaagtgctgttgata

SEQ ID NO: 93136 - DNA, 25 bp, Homo sapien
ttcccctattccttaatctaattat

SEQ ID NO: 93137 - DNA, 25 bp, Homo sapien
tccagaaacagctgtcattttggtt

SEQ ID NO: 93138 - DNA, 25 bp, Homo sapien
ccacatgaacacattcgaacttcga

SEQ ID NO: 93139 - DNA, 25 bp, Homo sapien
attcgaacttcgaaggccacacact

SEQ ID NO: 93140 - DNA, 25 bp, Homo sapien
taggccccacggtaagtgagttcac

SEQ ID NO: 93141 - DNA, 25 bp, Homo sapien
gagttcacacctagaacactgtcct

SEQ ID NO: 93142 - DNA, 25 bp, Homo sapien
aggacgcgtgccttggacttggtat

SEQ ID NO: 93143 - DNA, 25 bp, Homo sapien
ggacttggtattctacatgtgactg

SEQ ID NO: 93144 - DNA, 25 bp, Homo sapien
atgtgactggctttcttgccctcgt

SEQ ID NO: 93145 - DNA, 25 bp, Homo sapien
ttgccctcgtctcttgaatgtttag

SEQ ID NO: 93146 - DNA, 25 bp, Homo sapien
ttaagatcatatcctgccccaaatt

SEQ ID NO: 93147 - DNA, 25 bp, Homo sapien
gatctttgaaacctcagattctgtg

SEQ ID NO: 93148 - DNA, 25 bp, Homo sapien
cctcagattctgtggtgcaatttta

SEQ ID NO: 93149 - DNA, 25 bp, Homo sapien
gattgttcatccacaccattttata

SEQ ID NO: 93150 - DNA, 25 bp, Homo sapien
tgttcatccacaccattttatatag

SEQ ID NO: 93151 - DNA, 25 bp, Homo sapien
acagcttctactttagatgatccaa

SEQ ID NO: 93152 - DNA, 25 bp, Homo sapien
gaatacctgtacctgcagattccag

SEQ ID NO: 93153 - DNA, 25 bp, Homo sapien
tacctgtacctgcagattccagttt

SEQ ID NO: 93154 - DNA, 25 bp, Homo sapien
ctgtacctgcagattccagtttcaa

SEQ ID NO: 93155 - DNA, 25 bp, Homo sapien
gtacctgcagattccagtttcaaag

SEQ ID NO: 93156 - DNA, 25 bp, Homo sapien
ctgcagattccagtttcaaagaaat

SEQ ID NO: 93157 - DNA, 25 bp, Homo sapien
tattatttacacagttaaggaacag

SEQ ID NO: 93158 - DNA, 25 bp, Homo sapien
cattttcatttgttagaaactgatc

SEQ ID NO: 93159 - DNA, 25 bp, Homo sapien
gttagaaactgatctttctgtaata

SEQ ID NO: 93160 - DNA, 25 bp, Homo sapien
gcctggccgtgtggagcactgcact

SEQ ID NO: 93161 - DNA, 25 bp, Homo sapien
gtgtggagcactgcactcctaggaa

SEQ ID NO: 93162 - DNA, 25 bp, Homo sapien
gtggagcactgcactcctaggaagc

SEQ ID NO: 93163 - DNA, 25 bp, Homo sapien
ggagcactgcactcctaggaagcag

SEQ ID NO: 93164 - DNA, 25 bp, Homo sapien
agcactgcactcctaggaagcagga

SEQ ID NO: 93165 - DNA, 25 bp, Homo sapien
gaagcaggaaatggctgttcacagg

SEQ ID NO: 93166 - DNA, 25 bp, Homo sapien
atggctgttcacaggaacccacagg

SEQ ID NO: 93167 - DNA, 25 bp, Homo sapien
accggctccagctttgacctgggaa

SEQ ID NO: 93168 - DNA, 25 bp, Homo sapien
gctttgacctgggaagctgtttcag

SEQ ID NO: 93169 - DNA, 25 bp, Homo sapien
gaagctgtttcaggcaggtggagag

SEQ ID NO: 93170 - DNA, 25 bp, Homo sapien
gggcgctgggcagtcgggaggcgaa

SEQ ID NO: 93171 - DNA, 25 bp, Homo sapien
tggaacgacatctaaatctgtgaat

SEQ ID NO: 93172 - DNA, 25 bp, Homo sapien
tgtgaataaagcagcaggcctgtcc

SEQ ID NO: 93173 - DNA, 25 bp, Homo sapien
tgtcctggccggttggcttgactct

SEQ ID NO: 93174 - DNA, 25 bp, Homo sapien
ttgactctctcctgtcagaatgcaa

SEQ ID NO: 93175 - DNA, 25 bp, Homo sapien
atgcaacctggctttatgcacctag

SEQ ID NO: 93176 - DNA, 25 bp, Homo sapien
tttatgcacctagatgtccccagca

SEQ ID NO: 93177 - DNA, 25 bp, Homo sapien
tctgagccaggcacatcaaatgtca

SEQ ID NO: 93178 - DNA, 25 bp, Homo sapien
tgaacgaactaagagctcctggatg

SEQ ID NO: 93179 - DNA, 25 bp, Homo sapien
ctcctggatgggtccgggaactcgc

SEQ ID NO: 93180 - DNA, 25 bp, Homo sapien
actcgcctgggcacaaggtgccaaa

SEQ ID NO: 93181 - DNA, 25 bp, Homo sapien
tctgtccttgtgatttggcataaag

SEQ ID NO: 93182 - DNA, 25 bp, Homo sapien
tgccagggccttagactccacatgt

SEQ ID NO: 93183 - DNA, 25 bp, Homo sapien
gggccttagactccacatgtccatt

SEQ ID NO: 93184 - DNA, 25 bp, Homo sapien
gtccatttttgttcaggtatagctt

SEQ ID NO: 93185 - DNA, 25 bp, Homo sapien
ggtatagctttttatagcaagggct

SEQ ID NO: 93186 - DNA, 25 bp, Homo sapien
tagcaagggctgcatctagcttctt

SEQ ID NO: 93187 - DNA, 25 bp, Homo sapien
ggctgcatctagcttcttttattag

SEQ ID NO: 93188 - DNA, 25 bp, Homo sapien
gaagtgtgtgtgctaaattccttat

SEQ ID NO: 93189 - DNA, 25 bp, Homo sapien
gtgtgctaaattccttattaatgtg

SEQ ID NO: 93190 - DNA, 25 bp, Homo sapien
gtgtaatcagtttacattgttttgt

SEQ ID NO: 93191 - DNA, 25 bp, Homo sapien
tattttcagtgctacccgctagctg

SEQ ID NO: 93192 - DNA, 25 bp, Homo sapien
gctacccgctagctgattttaactt

SEQ ID NO: 93193 - DNA, 25 bp, Homo sapien
agatgaccttacattaaaattataa

SEQ ID NO: 93194 - DNA, 25 bp, Homo sapien
gatgaccttacattaaaattataag

SEQ ID NO: 93195 - DNA, 25 bp, Homo sapien
atgaccttacattaaaattataagc

SEQ ID NO: 93196 - DNA, 25 bp, Homo sapien
aattataagcaacaggctgggcagc

SEQ ID NO: 93197 - DNA, 25 bp, Homo sapien
attataagcaacaggctgggcagcg

SEQ ID NO: 93198 - DNA, 25 bp, Homo sapien
ttataagcaacaggctgggcagcgg

SEQ ID NO: 93199 - DNA, 25 bp, Homo sapien
tataagcaacaggctgggcagcggc

SEQ ID NO: 93200 - DNA, 25 bp, Homo sapien
taagcaacaggctgggcagcggctc

SEQ ID NO: 93201 - DNA, 25 bp, Homo sapien
aagcaacaggctgggcagcggctca

SEQ ID NO: 93202 - DNA, 25 bp, Homo sapien
gtggtggcaggcgcacgaaatccca

SEQ ID NO: 93203 - DNA, 25 bp, Homo sapien
tggcaggcgcacgaaatcccagcta

SEQ ID NO: 93204 - DNA, 25 bp, Homo sapien
gaaagacttcagtgggcgcacaggt

SEQ ID NO: 93205 - DNA, 25 bp, Homo sapien
agtgggcgcacaggtcttattcagc

SEQ ID NO: 93206 - DNA, 25 bp, Homo sapien
gtgtggaaggcctttccgagtaagt

SEQ ID NO: 93207 - DNA, 25 bp, Homo sapien
aaggcctttccgagtaagttcagct

SEQ ID NO: 93208 - DNA, 25 bp, Homo sapien
ctttccgagtaagttcagctcttat

SEQ ID NO: 93209 - DNA, 25 bp, Homo sapien
gaattcataccgcaaataaactcta

SEQ ID NO: 93210 - DNA, 25 bp, Homo sapien
ataccgcaaataaactctactaata

SEQ ID NO: 93211 - DNA, 25 bp, Homo sapien
acactcaggcctaactagttatcaa

SEQ ID NO: 93212 - DNA, 25 bp, Homo sapien
gaaaccttgagtttcctcaatgtgg

SEQ ID NO: 93213 - DNA, 25 bp, Homo sapien
gtttcctcaatgtggtcaaagcttc

SEQ ID NO: 93214 - DNA, 25 bp, Homo sapien
tggtcaaagcttcagtcatcattaa

SEQ ID NO: 93215 - DNA, 25 bp, Homo sapien
actcgctgaatcaggtagggacctt

SEQ ID NO: 93216 - DNA, 25 bp, Homo sapien
ctgaatcaggtagggaccttatgga

SEQ ID NO: 93217 - DNA, 25 bp, Homo sapien
ttggtggcaccccagatctcagtaa

SEQ ID NO: 93218 - DNA, 25 bp, Homo sapien
ggtggcaccccagatctcagtaatg

SEQ ID NO: 93219 - DNA, 25 bp, Homo sapien
ggcaccccagatctcagtaatgcag

SEQ ID NO: 93220 - DNA, 25 bp, Homo sapien
caccccagatctcagtaatgcaggg

SEQ ID NO: 93221 - DNA, 25 bp, Homo sapien
gggctgttgggtgcttcctgcaaat

SEQ ID NO: 93222 - DNA, 25 bp, Homo sapien
gctgttgggtgcttcctgcaaatcc

SEQ ID NO: 93223 - DNA, 25 bp, Homo sapien
gttgggtgcttcctgcaaatccctg

SEQ ID NO: 93224 - DNA, 25 bp, Homo sapien
cctgagagggcagaagatagcttct

SEQ ID NO: 93225 - DNA, 25 bp, Homo sapien
gatagcttctgttaattcattattc

SEQ ID NO: 93226 - DNA, 25 bp, Homo sapien
agttataatcatagcagatgccatt

SEQ ID NO: 93227 - DNA, 25 bp, Homo sapien
agcagatgccatttatagagtatat

SEQ ID NO: 93228 - DNA, 25 bp, Homo sapien
tatactatgtactaggccttatttt

SEQ ID NO: 93229 - DNA, 25 bp, Homo sapien
gccttattttatttaagtgctttat

SEQ ID NO: 93230 - DNA, 25 bp, Homo sapien
taagtgctttataggtattctcatt

SEQ ID NO: 93231 - DNA, 25 bp, Homo sapien
gtgctttataggtattctcatttta

SEQ ID NO: 93232 - DNA, 25 bp, Homo sapien
tctcattttaattctcttcacaacc

SEQ ID NO: 93233 - DNA, 25 bp, Homo sapien
aattctcttcacaaccttacgaggt

SEQ ID NO: 93234 - DNA, 25 bp, Homo sapien
cttcacaaccttacgaggtaggtat

SEQ ID NO: 93235 - DNA, 25 bp, Homo sapien
gaggtaggtattgttatttccattt

SEQ ID NO: 93236 - DNA, 25 bp, Homo sapien
aaaggtcaagaataggcccaggtca

SEQ ID NO: 93237 - DNA, 25 bp, Homo sapien
gatgccgtgttcaggctcatggagc

SEQ ID NO: 93238 - DNA, 25 bp, Homo sapien
tgttcaggctcatggagcagtgctg

SEQ ID NO: 93239 - DNA, 25 bp, Homo sapien
gtgctgggcctatgagcctgggcag

SEQ ID NO: 93240 - DNA, 25 bp, Homo sapien
atgagcctgggcagcggcccagctt

SEQ ID NO: 93241 - DNA, 25 bp, Homo sapien
gagctgcagagcatccgaaagcggc

SEQ ID NO: 93242 - DNA, 25 bp, Homo sapien
gagcatccgaaagcggcatcggtga

SEQ ID NO: 93243 - DNA, 25 bp, Homo sapien
atcggtgaggctgggacccccttct

SEQ ID NO: 93244 - DNA, 25 bp, Homo sapien
cttctcaagctggtggcctctgcag

SEQ ID NO: 93245 - DNA, 25 bp, Homo sapien
agcggctccagctcatatgctgaca

SEQ ID NO: 93246 - DNA, 25 bp, Homo sapien
catatgctgacagctcttcacagtc

SEQ ID NO: 93247 - DNA, 25 bp, Homo sapien
ccggcaggatgcagcgccgtgtcct

SEQ ID NO: 93248 - DNA, 25 bp, Homo sapien
agtgattcaagaactttggatctat

SEQ ID NO: 93249 - DNA, 25 bp, Homo sapien
aagaactttggatctatttcattgt

SEQ ID NO: 93250 - DNA, 25 bp, Homo sapien
actttggatctatttcattgttata

SEQ ID NO: 93251 - DNA, 25 bp, Homo sapien
atttcattgttataattagagcctt

SEQ ID NO: 93252 - DNA, 25 bp, Homo sapien
gttataattagagccttaagttgtg

SEQ ID NO: 93253 - DNA, 25 bp, Homo sapien
gttgtgggacttttattcttattat

SEQ ID NO: 93254 - DNA, 25 bp, Homo sapien
tactatataaaatttgttcatgctt

SEQ ID NO: 93255 - DNA, 25 bp, Homo sapien
ttttctgatttgtttcaatgtgggt

SEQ ID NO: 93256 - DNA, 25 bp, Homo sapien
tctgatttgtttcaatgtgggtttt

SEQ ID NO: 93257 - DNA, 25 bp, Homo sapien
tttgtttattggtacatcacaataa

SEQ ID NO: 93258 - DNA, 25 bp, Homo sapien
aatattgtctaatcaggccgggcgc

SEQ ID NO: 93259 - DNA, 25 bp, Homo sapien
ggaatcagatcctaagccatagaca

SEQ ID NO: 93260 - DNA, 25 bp, Homo sapien
atagacaggctaattgcccaccact

SEQ ID NO: 93261 - DNA, 25 bp, Homo sapien
gcccaccactcccaggaatattgaa

SEQ ID NO: 93262 - DNA, 25 bp, Homo sapien
gaatattgaaatagctacatgacca

SEQ ID NO: 93263 - DNA, 25 bp, Homo sapien
agctacatgaccataatgtgtttaa

SEQ ID NO: 93264 - DNA, 25 bp, Homo sapien
aaatgtggtatgctcttgagatatt

SEQ ID NO: 93265 - DNA, 25 bp, Homo sapien
gttttggcagtaaaatactctgttt

SEQ ID NO: 93266 - DNA, 25 bp, Homo sapien
atgtatttcattcatatttcctctc

SEQ ID NO: 93267 - DNA, 25 bp, Homo sapien
atgacttcagtatagatttgttttt

SEQ ID NO: 93268 - DNA, 25 bp, Homo sapien
gcattttttattcttaagtggtagg

SEQ ID NO: 93269 - DNA, 25 bp, Homo sapien
aagtggtaggaagcaacatccaaaa

SEQ ID NO: 93270 - DNA, 25 bp, Homo sapien
gagagagatgactaccgaggcctta

SEQ ID NO: 93271 - DNA, 25 bp, Homo sapien
aggccttatgtctgagctcactgat

SEQ ID NO: 93272 - DNA, 25 bp, Homo sapien
tgatgactgcgcctgtgttccagaa

SEQ ID NO: 93273 - DNA, 25 bp, Homo sapien
agaactgttccgtctccctgagatc

SEQ ID NO: 93274 - DNA, 25 bp, Homo sapien
agatctattccctccacgtactgga

SEQ ID NO: 93275 - DNA, 25 bp, Homo sapien
gggactacagaaggtaccacgactg

SEQ ID NO: 93276 - DNA, 25 bp, Homo sapien
gtgcagatgccaaagtcggctcttt

SEQ ID NO: 93277 - DNA, 25 bp, Homo sapien
aagtcggctctttgagacgggtcac

SEQ ID NO: 93278 - DNA, 25 bp, Homo sapien
gacgggtcaccgatttgtactaagc

SEQ ID NO: 93279 - DNA, 25 bp, Homo sapien
gtactaagctgtgcctgccttgttg

SEQ ID NO: 93280 - DNA, 25 bp, Homo sapien
tgccttgttgtgatccccatagaaa

SEQ ID NO: 93281 - DNA, 25 bp, Homo sapien
gtcatagaccacagagaagtttctg

SEQ ID NO: 93282 - DNA, 25 bp, Homo sapien
aattcattttaatcccagatttgga

SEQ ID NO: 93283 - DNA, 25 bp, Homo sapien
aatcccagatttggatcctacaaag

SEQ ID NO: 93284 - DNA, 25 bp, Homo sapien
agatttggatcctacaaagaaggac

SEQ ID NO: 93285 - DNA, 25 bp, Homo sapien
tcatatgaatactcccaaatacttt

SEQ ID NO: 93286 - DNA, 25 bp, Homo sapien
gaagttattggctgggaaaatctaa

SEQ ID NO: 93287 - DNA, 25 bp, Homo sapien
atacacatgaagaacctcaacttaa

SEQ ID NO: 93288 - DNA, 25 bp, Homo sapien
aaaaaacacatggtatctatgcagt

SEQ ID NO: 93289 - DNA, 25 bp, Homo sapien
atgcagtgggaaattacctccattt

SEQ ID NO: 93290 - DNA, 25 bp, Homo sapien
cagtgggaaattacctccatttgta

SEQ ID NO: 93291 - DNA, 25 bp, Homo sapien
acctccatttgtaaactatgttgct

SEQ ID NO: 93292 - DNA, 25 bp, Homo sapien
gtttgcagtatacttttactgagaa

SEQ ID NO: 93293 - DNA, 25 bp, Homo sapien
aaaatagattaatgtgaggtccaga

SEQ ID NO: 93294 - DNA, 25 bp, Homo sapien
aaatagattaatgtgaggtccagag

SEQ ID NO: 93295 - DNA, 25 bp, Homo sapien
gattaatgtgaggtccagagatgat

SEQ ID NO: 93296 - DNA, 25 bp, Homo sapien
atgtgaggtccagagatgatataaa

SEQ ID NO: 93297 - DNA, 25 bp, Homo sapien
aaaaataaaattgctcactgggcac

SEQ ID NO: 93298 - DNA, 25 bp, Homo sapien
aaaataaaattgctcactgggcacg

SEQ ID NO: 93299 - DNA, 25 bp, Homo sapien
aaataaaattgctcactgggcacgg

SEQ ID NO: 93300 - DNA, 25 bp, Homo sapien
aataaaattgctcactgggcacggt

SEQ ID NO: 93301 - DNA, 25 bp, Homo sapien
atggcttgagcccataatcatgcca

SEQ ID NO: 93302 - DNA, 25 bp, Homo sapien
tggcttgagcccataatcatgccac

SEQ ID NO: 93303 - DNA, 25 bp, Homo sapien
tggctgatgggtacacatgcttggt

SEQ ID NO: 93304 - DNA, 25 bp, Homo sapien
catgcttggtaagagtttctgcttt

SEQ ID NO: 93305 - DNA, 25 bp, Homo sapien
tggtaagagtttctgctttatattc

SEQ ID NO: 93306 - DNA, 25 bp, Homo sapien
aaagttctgcccagtttctgagcaa

SEQ ID NO: 93307 - DNA, 25 bp, Homo sapien
gggttcacttaagtgtatcacaatc

SEQ ID NO: 93308 - DNA, 25 bp, Homo sapien
gtatcacaatcaacaccagacggga

SEQ ID NO: 93309 - DNA, 25 bp, Homo sapien
acaccagacgggatattttaactat

SEQ ID NO: 93310 - DNA, 25 bp, Homo sapien
ttaactatcagattttcggaaatgt

SEQ ID NO: 93311 - DNA, 25 bp, Homo sapien
tcggaaatgtaaaaacctttatgtg

SEQ ID NO: 93312 - DNA, 25 bp, Homo sapien
acctttatgtgtaacttcttttgat

SEQ ID NO: 93313 - DNA, 25 bp, Homo sapien
gtaacttcttttgatattaaacttg

SEQ ID NO: 93314 - DNA, 25 bp, Homo sapien
acagttaaaactaggctgggagcag

SEQ ID NO: 93315 - DNA, 25 bp, Homo sapien
cagttaaaactaggctgggagcagt

SEQ ID NO: 93316 - DNA, 25 bp, Homo sapien
gtgtgtctgtactcccatctactgt

SEQ ID NO: 93317 - DNA, 25 bp, Homo sapien
tgtgtctgtactcccatctactgtg

SEQ ID NO: 93318 - DNA, 25 bp, Homo sapien
gtgtctgtactcccatctactgtgg

SEQ ID NO: 93319 - DNA, 25 bp, Homo sapien
tctgtactcccatctactgtggagg

SEQ ID NO: 93320 - DNA, 25 bp, Homo sapien
gatgttgaacctgggcagctgatgc

SEQ ID NO: 93321 - DNA, 25 bp, Homo sapien
atgttgaacctgggcagctgatgct

SEQ ID NO: 93322 - DNA, 25 bp, Homo sapien
tgttgaacctgggcagctgatgctg

SEQ ID NO: 93323 - DNA, 25 bp, Homo sapien
ttgaacctgggcagctgatgctgca

SEQ ID NO: 93324 - DNA, 25 bp, Homo sapien
acctgggcagctgatgctgcagtga

SEQ ID NO: 93325 - DNA, 25 bp, Homo sapien
aaatcacctccatctgtccagagtt

SEQ ID NO: 93326 - DNA, 25 bp, Homo sapien
tccagagtttggctatgaggctact

SEQ ID NO: 93327 - DNA, 25 bp, Homo sapien
gtttggctatgaggctactgagtat

SEQ ID NO: 93328 - DNA, 25 bp, Homo sapien
gctactgagtatgccaggagcccag

SEQ ID NO: 93329 - DNA, 25 bp, Homo sapien
agctgcagcagcagggtctgaaccc

SEQ ID NO: 93330 - DNA, 25 bp, Homo sapien
cgagcccagagggacagcccaaggt

SEQ ID NO: 93331 - DNA, 25 bp, Homo sapien
gagggacagcccaaggtccaccgag

SEQ ID NO: 93332 - DNA, 25 bp, Homo sapien
cgcaaaaccatgtccaaaccaggaa

SEQ ID NO: 93333 - DNA, 25 bp, Homo sapien
aaccatgtccaaaccaggaaatgga

SEQ ID NO: 93334 - DNA, 25 bp, Homo sapien
aaatggacagcataccaagacccca

SEQ ID NO: 93335 - DNA, 25 bp, Homo sapien
agaatgtttcaaaggccaggcccag

SEQ ID NO: 93336 - DNA, 25 bp, Homo sapien
ttttatgtcatatagtgtcaggatt

SEQ ID NO: 93337 - DNA, 25 bp, Homo sapien
gcaactagcaactcatcttcggaag

SEQ ID NO: 93338 - DNA, 25 bp, Homo sapien
catcttcggaagacacagccaggag

SEQ ID NO: 93339 - DNA, 25 bp, Homo sapien
ttcggaagacacagccaggagaatg

SEQ ID NO: 93340 - DNA, 25 bp, Homo sapien
atccatttgtaagcatttatcccat

SEQ ID NO: 93341 - DNA, 25 bp, Homo sapien
gtaagcatttatcccatatatttta

SEQ ID NO: 93342 - DNA, 25 bp, Homo sapien
caatactttatgtactatgtgactc

SEQ ID NO: 93343 - DNA, 25 bp, Homo sapien
gtactatgtgactcatgcttctgga

SEQ ID NO: 93344 - DNA, 25 bp, Homo sapien
gtgactcatgcttctggataaataa

SEQ ID NO: 93345 - DNA, 25 bp, Homo sapien
aagcaccaaatatgtatctgtaacc

SEQ ID NO: 93346 - DNA, 25 bp, Homo sapien
gtatctgtaaccacaatcacacata

SEQ ID NO: 93347 - DNA, 25 bp, Homo sapien
acaactctgtcaaaagctgtattct

SEQ ID NO: 93348 - DNA, 25 bp, Homo sapien
gacctgtcaccacaacaaagaggga

SEQ ID NO: 93349 - DNA, 25 bp, Homo sapien
aagtgaacagtgctatctgaacctg

SEQ ID NO: 93350 - DNA, 25 bp, Homo sapien
tctgaacctgtggtcttgggagcca

SEQ ID NO: 93351 - DNA, 25 bp, Homo sapien
cagggtgacctgatatgacatctaa

SEQ ID NO: 93352 - DNA, 25 bp, Homo sapien
aagcttctggactctgaacaagaat

SEQ ID NO: 93353 - DNA, 25 bp, Homo sapien
caagaattcggtggcctgcagagct

SEQ ID NO: 93354 - DNA, 25 bp, Homo sapien
atggaacccaggacccatccaactt

SEQ ID NO: 93355 - DNA, 25 bp, Homo sapien
atccaacttggctgcttcacatttt

SEQ ID NO: 93356 - DNA, 25 bp, Homo sapien
gctttcattttcatagccacagtga

SEQ ID NO: 93357 - DNA, 25 bp, Homo sapien
tagccacagtgatagccctaagaaa

SEQ ID NO: 93358 - DNA, 25 bp, Homo sapien
gagctggtggagtacaccatgatat

SEQ ID NO: 93359 - DNA, 25 bp, Homo sapien
gatattgatttttgcattgcccggt

SEQ ID NO: 93360 - DNA, 25 bp, Homo sapien
ttgcattgcccggtctttgtccatt

SEQ ID NO: 93361 - DNA, 25 bp, Homo sapien
attgatgctctgaccgagatccaaa

SEQ ID NO: 93362 - DNA, 25 bp, Homo sapien
ttactagctgacctccacgtgaaga

SEQ ID NO: 93363 - DNA, 25 bp, Homo sapien
gccaatggcgagagatcaggtccga

SEQ ID NO: 93364 - DNA, 25 bp, Homo sapien
atcaggtccgaaatgctgcattgct

SEQ ID NO: 93365 - DNA, 25 bp, Homo sapien
cagtttccaccactcttatacagga

SEQ ID NO: 93366 - DNA, 25 bp, Homo sapien
attatctaaagatcctcctgagaag

SEQ ID NO: 93367 - DNA, 25 bp, Homo sapien
gatcctcctgagaagcttaaaacat

SEQ ID NO: 93368 - DNA, 25 bp, Homo sapien
tacactgatgggaaacatgctcttt

SEQ ID NO: 93369 - DNA, 25 bp, Homo sapien
ttccctcatacttcagcatgggcta

SEQ ID NO: 93370 - DNA, 25 bp, Homo sapien
atgggctagacccagacccccggat

SEQ ID NO: 93371 - DNA, 25 bp, Homo sapien
cccggatctgacaaaggtgcctgct

SEQ ID NO: 93372 - DNA, 25 bp, Homo sapien
cggatctgacaaaggtgcctgcttc

SEQ ID NO: 93373 - DNA, 25 bp, Homo sapien
agatgaatacatattgtctctgaca

SEQ ID NO: 93374 - DNA, 25 bp, Homo sapien
gtctctgacaataaatgtgttctca

SEQ ID NO: 93375 - DNA, 25 bp, Homo sapien
gtgttctcactcatatcattcttcg

SEQ ID NO: 93376 - DNA, 25 bp, Homo sapien
ttctcactcatatcattcttcgtct

SEQ ID NO: 93377 - DNA, 25 bp, Homo sapien
cactcatatcattcttcgtctgtac

SEQ ID NO: 93378 - DNA, 25 bp, Homo sapien
atatcattcttcgtctgtacataaa

SEQ ID NO: 93379 - DNA, 25 bp, Homo sapien
cattcttcgtctgtacataaatatt

SEQ ID NO: 93380 - DNA, 25 bp, Homo sapien
acctctgaagccaacgtgagcaaag

SEQ ID NO: 93381 - DNA, 25 bp, Homo sapien
gaagccaacgtgagcaaagggcaga

SEQ ID NO: 93382 - DNA, 25 bp, Homo sapien
gcagttggcctatgagtgggctgat

SEQ ID NO: 93383 - DNA, 25 bp, Homo sapien
ggaagaactctttgccagataatga

SEQ ID NO: 93384 - DNA, 25 bp, Homo sapien
gttcattttagttttatgctcccat

SEQ ID NO: 93385 - DNA, 25 bp, Homo sapien
tttagttttatgctcccattgaaaa

SEQ ID NO: 93386 - DNA, 25 bp, Homo sapien
tatgctcccattgaaaaattttcca

SEQ ID NO: 93387 - DNA, 25 bp, Homo sapien
aattttccactatttttataagctg

SEQ ID NO: 93388 - DNA, 25 bp, Homo sapien
ttataagctgttaatttcttgagta

SEQ ID NO: 93389 - DNA, 25 bp, Homo sapien
cttgagtactttataacatgtctgt

SEQ ID NO: 93390 - DNA, 25 bp, Homo sapien
acatgtctgtagcttggataaacca

SEQ ID NO: 93391 - DNA, 25 bp, Homo sapien
acggcagcttgagcctgtcacgtgg

SEQ ID NO: 93392 - DNA, 25 bp, Homo sapien
ttgagcctgtcacgtggtcaaggcc

SEQ ID NO: 93393 - DNA, 25 bp, Homo sapien
aggcggcacattggcagtgtgtcac

SEQ ID NO: 93394 - DNA, 25 bp, Homo sapien
gcacattggcagtgtgtcacactga

SEQ ID NO: 93395 - DNA, 25 bp, Homo sapien
cctgtccagcaggtagtgggtgaat

SEQ ID NO: 93396 - DNA, 25 bp, Homo sapien
gtgtgaaggtcttgcctgaatccat

SEQ ID NO: 93397 - DNA, 25 bp, Homo sapien
ctgaatccatcaggacttgggaaac

SEQ ID NO: 93398 - DNA, 25 bp, Homo sapien
tccctgccagtgtttagaagagcct

SEQ ID NO: 93399 - DNA, 25 bp, Homo sapien
aagagcctgactgtgttcagtgcct

SEQ ID NO: 93400 - DNA, 25 bp, Homo sapien
gactgtgttcagtgccttggagcag

SEQ ID NO: 93401 - DNA, 25 bp, Homo sapien
ttcagtgccttggagcagaaagcca

SEQ ID NO: 93402 - DNA, 25 bp, Homo sapien
gatcaatgacattgctaactaagtt

SEQ ID NO: 93403 - DNA, 25 bp, Homo sapien
tgagtgaatctcaagtctttttcct

SEQ ID NO: 93404 - DNA, 25 bp, Homo sapien
gtctttttccttatcaagttgaact

SEQ ID NO: 93405 - DNA, 25 bp, Homo sapien
gaactggtttaggagattagtgcct

SEQ ID NO: 93406 - DNA, 25 bp, Homo sapien
gattagtgcctagagttaagagaca

SEQ ID NO: 93407 - DNA, 25 bp, Homo sapien
ttttccttttgtagccactttgagt

SEQ ID NO: 93408 - DNA, 25 bp, Homo sapien
gccactttgagtctgcagttgtcag

SEQ ID NO: 93409 - DNA, 25 bp, Homo sapien
gagtctgcagttgtcagtaagcctt

SEQ ID NO: 93410 - DNA, 25 bp, Homo sapien
tgcagttgtcagtaagcctttttaa

SEQ ID NO: 93411 - DNA, 25 bp, Homo sapien
aatttgtttacattctctggacctt

SEQ ID NO: 93412 - DNA, 25 bp, Homo sapien
tgtttacattctctggaccttttaa

SEQ ID NO: 93413 - DNA, 25 bp, Homo sapien
tccccatcccggaaaacaggcagag

SEQ ID NO: 93414 - DNA, 25 bp, Homo sapien
ccatcccggaaaacaggcagagcac

SEQ ID NO: 93415 - DNA, 25 bp, Homo sapien
ggcagagcacacacttccaggaaag

SEQ ID NO: 93416 - DNA, 25 bp, Homo sapien
ttccaggaaagaggccgccctggcg

SEQ ID NO: 93417 - DNA, 25 bp, Homo sapien
ctggcgctggactcaatgaccataa

SEQ ID NO: 93418 - DNA, 25 bp, Homo sapien
ggcgctggactcaatgaccataaaa

SEQ ID NO: 93419 - DNA, 25 bp, Homo sapien
ggactcaatgaccataaaacagcct

SEQ ID NO: 93420 - DNA, 25 bp, Homo sapien
tcaatgaccataaaacagcctctta

SEQ ID NO: 93421 - DNA, 25 bp, Homo sapien
atgaccataaaacagcctcttaagc

SEQ ID NO: 93422 - DNA, 25 bp, Homo sapien
aaaacagcctcttaagctgggtgca

SEQ ID NO: 93423 - DNA, 25 bp, Homo sapien
acagcctcttaagctgggtgcagcg

SEQ ID NO: 93424 - DNA, 25 bp, Homo sapien
gcagaggttagaagtgctaagaagc

SEQ ID NO: 93425 - DNA, 25 bp, Homo sapien
cagaggttagaagtgctaagaagca

SEQ ID NO: 93426 - DNA, 25 bp, Homo sapien
agaggttagaagtgctaagaagcag

SEQ ID NO: 93427 - DNA, 25 bp, Homo sapien
gttagaagtgctaagaagcaggccg

SEQ ID NO: 93428 - DNA, 25 bp, Homo sapien
ttagaagtgctaagaagcaggccga

SEQ ID NO: 93429 - DNA, 25 bp, Homo sapien
tagaagtgctaagaagcaggccgag

SEQ ID NO: 93430 - DNA, 25 bp, Homo sapien
aagtgctaagaagcaggccgagggt

SEQ ID NO: 93431 - DNA, 25 bp, Homo sapien
aagaagcaggccgagggtggtggct

SEQ ID NO: 93432 - DNA, 25 bp, Homo sapien
agaagcaggccgagggtggtggctc

SEQ ID NO: 93433 - DNA, 25 bp, Homo sapien
gaagcaggccgagggtggtggctca

SEQ ID NO: 93434 - DNA, 25 bp, Homo sapien
gccaaggcgggtgaatcccttaagg

SEQ ID NO: 93435 - DNA, 25 bp, Homo sapien
acaggtactgtggtatgcttagcat

SEQ ID NO: 93436 - DNA, 25 bp, Homo sapien
agcattttctaagagagttctgagt

SEQ ID NO: 93437 - DNA, 25 bp, Homo sapien
attagtatggtcttttatcttcaaa

SEQ ID NO: 93438 - DNA, 25 bp, Homo sapien
taatacttgtacttgtcaaagcaca

SEQ ID NO: 93439 - DNA, 25 bp, Homo sapien
agcacatatccatatttttggtcta

SEQ ID NO: 93440 - DNA, 25 bp, Homo sapien
aaatatggtcattgtacttacggaa

SEQ ID NO: 93441 - DNA, 25 bp, Homo sapien
gaaatgtccatcagcttcttttgaa

SEQ ID NO: 93442 - DNA, 25 bp, Homo sapien
gcattttgttgcctggacttgctct

SEQ ID NO: 93443 - DNA, 25 bp, Homo sapien
cttgctctcttttcaaactaactat

SEQ ID NO: 93444 - DNA, 25 bp, Homo sapien
caaactaactattttgcttgggaag

SEQ ID NO: 93445 - DNA, 25 bp, Homo sapien
agatggtgccacattaaatgctatt

SEQ ID NO: 93446 - DNA, 25 bp, Homo sapien
gacttttgttatacacatttgcttt

SEQ ID NO: 93447 - DNA, 25 bp, Homo sapien
gaaagatggaataagcgctagagct

SEQ ID NO: 93448 - DNA, 25 bp, Homo sapien
agcgctagagcttccaactgtatat

SEQ ID NO: 93449 - DNA, 25 bp, Homo sapien
ctagagcttccaactgtatattttt

SEQ ID NO: 93450 - DNA, 25 bp, Homo sapien
aaactatgatcctttatatgtgtgt

SEQ ID NO: 93451 - DNA, 25 bp, Homo sapien
ggagctatgataagttttatggcaa

SEQ ID NO: 93452 - DNA, 25 bp, Homo sapien
tggcaaacggttggtattgttaact

SEQ ID NO: 93453 - DNA, 25 bp, Homo sapien
tgtcatcaaaagttcataaaagtcc

SEQ ID NO: 93454 - DNA, 25 bp, Homo sapien
agtcctattaatccccatattcttc

SEQ ID NO: 93455 - DNA, 25 bp, Homo sapien
atattcttctactgcccttaactct

SEQ ID NO: 93456 - DNA, 25 bp, Homo sapien
tactgcccttaactctggtatacac

SEQ ID NO: 93457 - DNA, 25 bp, Homo sapien
aagtaagtatcttttctgagagagg

SEQ ID NO: 93458 - DNA, 25 bp, Homo sapien
attcctctgggctttattcactccc

SEQ ID NO: 93459 - DNA, 25 bp, Homo sapien
ttgtgggcctccctaatgcccaggg

SEQ ID NO: 93460 - DNA, 25 bp, Homo sapien
atgcccagggcatggatggcttcag

SEQ ID NO: 93461 - DNA, 25 bp, Homo sapien
catggatggcttcagaggagttttt

SEQ ID NO: 93462 - DNA, 25 bp, Homo sapien
tttttgaatcgaagcccagggtcct

SEQ ID NO: 93463 - DNA, 25 bp, Homo sapien
agggtccttgttgatgtttcttctc

SEQ ID NO: 93464 - DNA, 25 bp, Homo sapien
agccacacttggaggaaagttgcag

SEQ ID NO: 93465 - DNA, 25 bp, Homo sapien
agcaggcatggttctgctttgctgt

SEQ ID NO: 93466 - DNA, 25 bp, Homo sapien
ttgctgtttgtcttcctagttaagg

SEQ ID NO: 93467 - DNA, 25 bp, Homo sapien
tgtcttcctagttaaggctctttat

SEQ ID NO: 93468 - DNA, 25 bp, Homo sapien
aatctgttaaaaatctgcatttagg

SEQ ID NO: 93469 - DNA, 25 bp, Homo sapien
atctgttaaaaatctgcatttaggt

SEQ ID NO: 93470 - DNA, 25 bp, Homo sapien
tctgttaaaaatctgcatttaggtt

SEQ ID NO: 93471 - DNA, 25 bp, Homo sapien
ctgttaaaaatctgcatttaggttg

SEQ ID NO: 93472 - DNA, 25 bp, Homo sapien
tgttaaaaatctgcatttaggttgg

SEQ ID NO: 93473 - DNA, 25 bp, Homo sapien
ttaaaaatctgcatttaggttgggc

SEQ ID NO: 93474 - DNA, 25 bp, Homo sapien
taaaaatctgcatttaggttgggca

SEQ ID NO: 93475 - DNA, 25 bp, Homo sapien
aaaaatctgcatttaggttgggcac

SEQ ID NO: 93476 - DNA, 25 bp, Homo sapien
aaaatctgcatttaggttgggcacg

SEQ ID NO: 93477 - DNA, 25 bp, Homo sapien
aatctgcatttaggttgggcacggt

SEQ ID NO: 93478 - DNA, 25 bp, Homo sapien
atctgcatttaggttgggcacggtg

SEQ ID NO: 93479 - DNA, 25 bp, Homo sapien
attgtgaggccaccagtccattcat

SEQ ID NO: 93480 - DNA, 25 bp, Homo sapien
ggccaccagtccattcatttgaatt

SEQ ID NO: 93481 - DNA, 25 bp, Homo sapien
gaattctgtgaatctccaccttgcc

SEQ ID NO: 93482 - DNA, 25 bp, Homo sapien
ccaccttgcctatctttgggtagaa

SEQ ID NO: 93483 - DNA, 25 bp, Homo sapien
agctggacagtactgttgccctctt

SEQ ID NO: 93484 - DNA, 25 bp, Homo sapien
gacagtactgttgccctcttccaat

SEQ ID NO: 93485 - DNA, 25 bp, Homo sapien
tacatccctggcactggttgttttc

SEQ ID NO: 93486 - DNA, 25 bp, Homo sapien
acaggttcagttttgaactggccct

SEQ ID NO: 93487 - DNA, 25 bp, Homo sapien
cagttttgaactggccctgaggaaa

SEQ ID NO: 93488 - DNA, 25 bp, Homo sapien
aatgggtcaggagttgtattggcaa

SEQ ID NO: 93489 - DNA, 25 bp, Homo sapien
tgagagctgttggagaactgagaat

SEQ ID NO: 93490 - DNA, 25 bp, Homo sapien
ttacctgttatcttttgcacttcta

SEQ ID NO: 93491 - DNA, 25 bp, Homo sapien
tttgcacttctaacatgtagccaat

SEQ ID NO: 93492 - DNA, 25 bp, Homo sapien
agctggccgtacaaattacatttca

SEQ ID NO: 93493 - DNA, 25 bp, Homo sapien
accctaataaatccacatttccgca

SEQ ID NO: 93494 - DNA, 25 bp, Homo sapien
taaatccacatttccgcatggctca

SEQ ID NO: 93495 - DNA, 25 bp, Homo sapien
gcatggctcattcacctggaataat

SEQ ID NO: 93496 - DNA, 25 bp, Homo sapien
tattgaatatgttcttatagggcaa

SEQ ID NO: 93497 - DNA, 25 bp, Homo sapien
tatagggcaaaacactttcataagt

SEQ ID NO: 93498 - DNA, 25 bp, Homo sapien
gtcatatcggtaacatgcagctttt

SEQ ID NO: 93499 - DNA, 25 bp, Homo sapien
gcagctttttcctctcatagcattt

SEQ ID NO: 93500 - DNA, 25 bp, Homo sapien
tagcgaatgtaatatgcctcttatc

SEQ ID NO: 93501 - DNA, 25 bp, Homo sapien
catctttttgtacaccaatgtgctt

SEQ ID NO: 93502 - DNA, 25 bp, Homo sapien
atctttttgtacaccaatgtgcttt

SEQ ID NO: 93503 - DNA, 25 bp, Homo sapien
tctttttgtacaccaatgtgctttt

SEQ ID NO: 93504 - DNA, 25 bp, Homo sapien
ctttttgtacaccaatgtgcttttg

SEQ ID NO: 93505 - DNA, 25 bp, Homo sapien
tttttgtacaccaatgtgcttttgt

SEQ ID NO: 93506 - DNA, 25 bp, Homo sapien
ttttgtacaccaatgtgcttttgtt

SEQ ID NO: 93507 - DNA, 25 bp, Homo sapien
ttgtacaccaatgtgcttttgttaa

SEQ ID NO: 93508 - DNA, 25 bp, Homo sapien
gtacaccaatgtgcttttgttaatt

SEQ ID NO: 93509 - DNA, 25 bp, Homo sapien
tacaccaatgtgcttttgttaatta

SEQ ID NO: 93510 - DNA, 25 bp, Homo sapien
aaagtcggtggtggctaggcgtggt

SEQ ID NO: 93511 - DNA, 25 bp, Homo sapien
agtcggtggtggctaggcgtggtgg

SEQ ID NO: 93512 - DNA, 25 bp, Homo sapien
acagctgccccttggatgtgtccca

SEQ ID NO: 93513 - DNA, 25 bp, Homo sapien
tggatgtgtcccatgctatatgctc

SEQ ID NO: 93514 - DNA, 25 bp, Homo sapien
gtcccatgctatatgctccattgga

SEQ ID NO: 93515 - DNA, 25 bp, Homo sapien
gctccattggagacagcaaggtgtt

SEQ ID NO: 93516 - DNA, 25 bp, Homo sapien
gccagcgatgtccagacaaaggact

SEQ ID NO: 93517 - DNA, 25 bp, Homo sapien
tacaccatcaatccaaatgccttct

SEQ ID NO: 93518 - DNA, 25 bp, Homo sapien
ttgctggaccaaaagacaggcaagt

SEQ ID NO: 93519 - DNA, 25 bp, Homo sapien
acaggcaagtggaagaccctggctc

SEQ ID NO: 93520 - DNA, 25 bp, Homo sapien
agaggcactggactgtcctgcctgc

SEQ ID NO: 93521 - DNA, 25 bp, Homo sapien
tcctgcctgctgtctagccaagcta

SEQ ID NO: 93522 - DNA, 25 bp, Homo sapien
ccaagctaccttgcaagattcttca

SEQ ID NO: 93523 - DNA, 25 bp, Homo sapien
tgtcagtgctgttttccagtttggt

SEQ ID NO: 93524 - DNA, 25 bp, Homo sapien
gtcagtgctgttttccagtttggtt

SEQ ID NO: 93525 - DNA, 25 bp, Homo sapien
tcagtgctgttttccagtttggtta

SEQ ID NO: 93526 - DNA, 25 bp, Homo sapien
cagtgctgttttccagtttggttaa

SEQ ID NO: 93527 - DNA, 25 bp, Homo sapien
agtgctgttttccagtttggttaag

SEQ ID NO: 93528 - DNA, 25 bp, Homo sapien
taagaaattatacatgcggccgggc

SEQ ID NO: 93529 - DNA, 25 bp, Homo sapien
aagaaattatacatgcggccgggcg

SEQ ID NO: 93530 - DNA, 25 bp, Homo sapien
agaaattatacatgcggccgggcgc

SEQ ID NO: 93531 - DNA, 25 bp, Homo sapien
gaaattatacatgcggccgggcgcg

SEQ ID NO: 93532 - DNA, 25 bp, Homo sapien
atcgcttgaatccggcgggtggggg

SEQ ID NO: 93533 - DNA, 25 bp, Homo sapien
gagaaacgagtttgacctggacatt

SEQ ID NO: 93534 - DNA, 25 bp, Homo sapien
gaaacgagtttgacctggacattgt

SEQ ID NO: 93535 - DNA, 25 bp, Homo sapien
cctggacattgttgcagtcgtgaat

SEQ ID NO: 93536 - DNA, 25 bp, Homo sapien
gttgcagtcgtgaatgatacagtgg

SEQ ID NO: 93537 - DNA, 25 bp, Homo sapien
gatcctaattgtgagattggcctga

SEQ ID NO: 93538 - DNA, 25 bp, Homo sapien
aattgtgagattggcctgattgcag

SEQ ID NO: 93539 - DNA, 25 bp, Homo sapien
cctgattgcaggaacaggcagcaac

SEQ ID NO: 93540 - DNA, 25 bp, Homo sapien
acaggcagcaacatgtgctacatgg

SEQ ID NO: 93541 - DNA, 25 bp, Homo sapien
agcaacatgtgctacatggaggaca

SEQ ID NO: 93542 - DNA, 25 bp, Homo sapien
tggaggacatgaggaacatcgagat

SEQ ID NO: 93543 - DNA, 25 bp, Homo sapien
gggaagatgtgcatctgtttttcat

SEQ ID NO: 93544 - DNA, 25 bp, Homo sapien
tcctcataccttgctgggaagaagt

SEQ ID NO: 93545 - DNA, 25 bp, Homo sapien
gaagaagtttctagtagtcctgtga

SEQ ID NO: 93546 - DNA, 25 bp, Homo sapien
ctagtagtcctgtgaagattcattc

SEQ ID NO: 93547 - DNA, 25 bp, Homo sapien
attcttcttgctctttctcagcaga

SEQ ID NO: 93548 - DNA, 25 bp, Homo sapien
ttgctctttctcagcagaacaaagg

SEQ ID NO: 93549 - DNA, 25 bp, Homo sapien
aaaggagttcactggcttagctaca

SEQ ID NO: 93550 - DNA, 25 bp, Homo sapien
gcttagctacagtgacgcattgaaa

SEQ ID NO: 93551 - DNA, 25 bp, Homo sapien
tacagtgacgcattgaaacttgagt

SEQ ID NO: 93552 - DNA, 25 bp, Homo sapien
aaacttgagtaattcctgtaatgtc

SEQ ID NO: 93553 - DNA, 25 bp, Homo sapien
gattttacccaatttgtctgtagtg

SEQ ID NO: 93554 - DNA, 25 bp, Homo sapien
atgatgttattagctgtccagcata

SEQ ID NO: 93555 - DNA, 25 bp, Homo sapien
tacaaaacaatagcagtagggcaga

SEQ ID NO: 93556 - DNA, 25 bp, Homo sapien
atcatggtgacagtggatgggaaaa

SEQ ID NO: 93557 - DNA, 25 bp, Homo sapien
gttgtcgaagggtggattttctcct

SEQ ID NO: 93558 - DNA, 25 bp, Homo sapien
gattttctccttcagcaactacagg

SEQ ID NO: 93559 - DNA, 25 bp, Homo sapien
aactacaggagatatgatgcctcat

SEQ ID NO: 93560 - DNA, 25 bp, Homo sapien
atgatgcctcataattcggagccag

SEQ ID NO: 93561 - DNA, 25 bp, Homo sapien
tgcctcataattcggagccagaagt

SEQ ID NO: 93562 - DNA, 25 bp, Homo sapien
gctttgggtgagatatctttgcaca

SEQ ID NO: 93563 - DNA, 25 bp, Homo sapien
tctttgcacagataacatgtataca

SEQ ID NO: 93564 - DNA, 25 bp, Homo sapien
acatgtatacatcatagttcaaaac

SEQ ID NO: 93565 - DNA, 25 bp, Homo sapien
aacccagtagtcattgtttacagca

SEQ ID NO: 93566 - DNA, 25 bp, Homo sapien
gaaaagtggtgaactatatcagaaa

SEQ ID NO: 93567 - DNA, 25 bp, Homo sapien
gcaggtttctgaaggcgcaccctac

SEQ ID NO: 93568 - DNA, 25 bp, Homo sapien
ttctgaaggcgcaccctacaatgga

SEQ ID NO: 93569 - DNA, 25 bp, Homo sapien
gaaggcgcaccctacaatggaactt

SEQ ID NO: 93570 - DNA, 25 bp, Homo sapien
aggcgcaccctacaatggaacttaa

SEQ ID NO: 93571 - DNA, 25 bp, Homo sapien
gcgcaccctacaatggaacttaaga

SEQ ID NO: 93572 - DNA, 25 bp, Homo sapien
accctacaatggaacttaagacttg

SEQ ID NO: 93573 - DNA, 25 bp, Homo sapien
gaaactttgtaagtgaaagctgctt

SEQ ID NO: 93574 - DNA, 25 bp, Homo sapien
tctttccttttacctccataagaat

SEQ ID NO: 93575 - DNA, 25 bp, Homo sapien
tccttttacctccataagaataggg

SEQ ID NO: 93576 - DNA, 25 bp, Homo sapien
caagaaaaaattgaactccttccat

SEQ ID NO: 93577 - DNA, 25 bp, Homo sapien
tactgcttcctggatttctgcaatg

SEQ ID NO: 93578 - DNA, 25 bp, Homo sapien
tggatttctgcaatgaccctcaaaa

SEQ ID NO: 93579 - DNA, 25 bp, Homo sapien
aacagagggctctatactccttagt

SEQ ID NO: 93580 - DNA, 25 bp, Homo sapien
tactccttagtgtgactgcagcaaa

SEQ ID NO: 93581 - DNA, 25 bp, Homo sapien
ttcctgacttctatctgggcttggc

SEQ ID NO: 93582 - DNA, 25 bp, Homo sapien
tgggcttggccaggacttctagtcc

SEQ ID NO: 93583 - DNA, 25 bp, Homo sapien
aggacttctagtccctcataccagc

SEQ ID NO: 93584 - DNA, 25 bp, Homo sapien
tggctcttcctcttggttgacgccc

SEQ ID NO: 93585 - DNA, 25 bp, Homo sapien
tggttgacgcccttcagcacactta

SEQ ID NO: 93586 - DNA, 25 bp, Homo sapien
tcagcacacttactgctactctgta

SEQ ID NO: 93587 - DNA, 25 bp, Homo sapien
tcttgtcccctagtccctggatgtt

SEQ ID NO: 93588 - DNA, 25 bp, Homo sapien
tatggtaatgctcttacggatataa

SEQ ID NO: 93589 - DNA, 25 bp, Homo sapien
gctcttacggatataagcctcagtt

SEQ ID NO: 93590 - DNA, 25 bp, Homo sapien
atctatgggatgtgtggttctggtt

SEQ ID NO: 93591 - DNA, 25 bp, Homo sapien
ggatgtgtggttctggttaactaaa

SEQ ID NO: 93592 - DNA, 25 bp, Homo sapien
agtaaacactctgtagtaaccatta

SEQ ID NO: 93593 - DNA, 25 bp, Homo sapien
tatgccagagatgagttagtgtttc

SEQ ID NO: 93594 - DNA, 25 bp, Homo sapien
gtgtttcttgacgttggagacctat

SEQ ID NO: 93595 - DNA, 25 bp, Homo sapien
ggagacctataaatgcctcatctgt

SEQ ID NO: 93596 - DNA, 25 bp, Homo sapien
aaatgcctcatctgttgtactgaac

SEQ ID NO: 93597 - DNA, 25 bp, Homo sapien
gcctcatctgttgtactgaacaatt

SEQ ID NO: 93598 - DNA, 25 bp, Homo sapien
ttgaaactgcatgcagccataaaag

SEQ ID NO: 93599 - DNA, 25 bp, Homo sapien
gagccccacgcgcatgctaatgcgt

SEQ ID NO: 93600 - DNA, 25 bp, Homo sapien
catgctaatgcgtggagtgtatgcg

SEQ ID NO: 93601 - DNA, 25 bp, Homo sapien
gagtgtatgcgcagagtagctgtct

SEQ ID NO: 93602 - DNA, 25 bp, Homo sapien
agtagctgtctgtttgactgcttca

SEQ ID NO: 93603 - DNA, 25 bp, Homo sapien
tctgtttgactgcttcatccaggga

SEQ ID NO: 93604 - DNA, 25 bp, Homo sapien
tttgactgcttcatccagggaggga

SEQ ID NO: 93605 - DNA, 25 bp, Homo sapien
gggagaaggcttttcagcaccatct

SEQ ID NO: 93606 - DNA, 25 bp, Homo sapien
aggcttttcagcaccatctaatgtt

SEQ ID NO: 93607 - DNA, 25 bp, Homo sapien
tttcagcaccatctaatgttttaaa

SEQ ID NO: 93608 - DNA, 25 bp, Homo sapien
ctagttttaagtgtacagctcataa

SEQ ID NO: 93609 - DNA, 25 bp, Homo sapien
agctcataaattctgctgacatttt

SEQ ID NO: 93610 - DNA, 25 bp, Homo sapien
tctataatccacttgttcataaaaa

SEQ ID NO: 93611 - DNA, 25 bp, Homo sapien
attcgtctgacacctatgatatgct

SEQ ID NO: 93612 - DNA, 25 bp, Homo sapien
atggtatctgcccttgtgatgccag

SEQ ID NO: 93613 - DNA, 25 bp, Homo sapien
tgcccttgtgatgccagtaaactta

SEQ ID NO: 93614 - DNA, 25 bp, Homo sapien
gccagtaaacttaagccttcatggg

SEQ ID NO: 93615 - DNA, 25 bp, Homo sapien
gggctctctgacttcataatttcca

SEQ ID NO: 93616 - DNA, 25 bp, Homo sapien
cataatttccagaaccagagatagg

SEQ ID NO: 93617 - DNA, 25 bp, Homo sapien
ttgagaaatgtcagactgtgccaaa

SEQ ID NO: 93618 - DNA, 25 bp, Homo sapien
atgcatcaaatttccacatacatgg

SEQ ID NO: 93619 - DNA, 25 bp, Homo sapien
tacatggcctaaaatacccaagaga

SEQ ID NO: 93620 - DNA, 25 bp, Homo sapien
gaagttacaacattagaccagagat

SEQ ID NO: 93621 - DNA, 25 bp, Homo sapien
agaaacatcatcagtccttcccaag

SEQ ID NO: 93622 - DNA, 25 bp, Homo sapien
tccttcccaaggaccatggcgttta

SEQ ID NO: 93623 - DNA, 25 bp, Homo sapien
atggcgtttaatgtcttgggcaccc

SEQ ID NO: 93624 - DNA, 25 bp, Homo sapien
tgggcaccccttggaaatcacagaa

SEQ ID NO: 93625 - DNA, 25 bp, Homo sapien
gaaagtcagctgtactggccgtgtg

SEQ ID NO: 93626 - DNA, 25 bp, Homo sapien
tggccgtgtggaactctcatcccaa

SEQ ID NO: 93627 - DNA, 25 bp, Homo sapien
atcccaagacctactttgaactgag

SEQ ID NO: 93628 - DNA, 25 bp, Homo sapien
taagaaggtcattgtgcccactgca

SEQ ID NO: 93629 - DNA, 25 bp, Homo sapien
attgtgcccactgcatttgttccaa

SEQ ID NO: 93630 - DNA, 25 bp, Homo sapien
tttgttccaacttctccttgtataa

SEQ ID NO: 93631 - DNA, 25 bp, Homo sapien
ggacctcagtactaaagcctgttct

SEQ ID NO: 93632 - DNA, 25 bp, Homo sapien
cggaattaactcctctggatggaaa

SEQ ID NO: 93633 - DNA, 25 bp, Homo sapien
gaaacttccatcttacttggttaca

SEQ ID NO: 93634 - DNA, 25 bp, Homo sapien
ttacatcacggctctggttcagata

SEQ ID NO: 93635 - DNA, 25 bp, Homo sapien
acctattttacagcagttcagttct

SEQ ID NO: 93636 - DNA, 25 bp, Homo sapien
gctagtgagtagttttcctctccta

SEQ ID NO: 93637 - DNA, 25 bp, Homo sapien
aaaacctgattcatgcacagcgttt

SEQ ID NO: 93638 - DNA, 25 bp, Homo sapien
gcacagcgtttgacacacatggagt

SEQ ID NO: 93639 - DNA, 25 bp, Homo sapien
acacatggagtctgccagtgtgcct

SEQ ID NO: 93640 - DNA, 25 bp, Homo sapien
aagagatctgccatttcatgccctt

SEQ ID NO: 93641 - DNA, 25 bp, Homo sapien
atttcatgcccttgtgactacctat

SEQ ID NO: 93642 - DNA, 25 bp, Homo sapien
tgactacctatcattggccctgcaa

SEQ ID NO: 93643 - DNA, 25 bp, Homo sapien
ctctccctacttgttctgtgattga

SEQ ID NO: 93644 - DNA, 25 bp, Homo sapien
gaaccaaggactccagattcacaaa

SEQ ID NO: 93645 - DNA, 25 bp, Homo sapien
agattcacaaactgctactccacta

SEQ ID NO: 93646 - DNA, 25 bp, Homo sapien
tactccactataatttcccttcttt

SEQ ID NO: 93647 - DNA, 25 bp, Homo sapien
tctggtgccagcctgccttggcaaa

SEQ ID NO: 93648 - DNA, 25 bp, Homo sapien
atggccctattaatatgtcctctga

SEQ ID NO: 93649 - DNA, 25 bp, Homo sapien
tgggacaaggcacctgcattcacag

SEQ ID NO: 93650 - DNA, 25 bp, Homo sapien
gagcacctgggttctgactttgtcg

SEQ ID NO: 93651 - DNA, 25 bp, Homo sapien
gttctgactttgtcgcaggagctga

SEQ ID NO: 93652 - DNA, 25 bp, Homo sapien
gaacaaaagacttgctcgctgtggg

SEQ ID NO: 93653 - DNA, 25 bp, Homo sapien
ggtgacaggcctattgacctgcaat

SEQ ID NO: 93654 - DNA, 25 bp, Homo sapien
gtgcgatacctcagcccgtttccaa

SEQ ID NO: 93655 - DNA, 25 bp, Homo sapien
gcagccccatgagatcagggcttat

SEQ ID NO: 93656 - DNA, 25 bp, Homo sapien
ggcttattgtgtttgctccatgtat

SEQ ID NO: 93657 - DNA, 25 bp, Homo sapien
tccatgtatcatgagggtgcatcct

SEQ ID NO: 93658 - DNA, 25 bp, Homo sapien
agactcgcaggtgggtgcaaatgat

SEQ ID NO: 93659 - DNA, 25 bp, Homo sapien
gcaaatgatttgcagtcacagagga

SEQ ID NO: 93660 - DNA, 25 bp, Homo sapien
agccaagagctcctgacgggactaa

SEQ ID NO: 93661 - DNA, 25 bp, Homo sapien
gggactaatgaaagcatgcctcact

SEQ ID NO: 93662 - DNA, 25 bp, Homo sapien
aagcatgcctcactttagccctggg

SEQ ID NO: 93663 - DNA, 25 bp, Homo sapien
tgggcgggttcacgcctcaccttag

SEQ ID NO: 93664 - DNA, 25 bp, Homo sapien
tgccatgtgctgtttcttcatcggg

SEQ ID NO: 93665 - DNA, 25 bp, Homo sapien
tcctgatcccgctgctgggcgctgg

SEQ ID NO: 93666 - DNA, 25 bp, Homo sapien
cgctgggttggtgctcggactggga

SEQ ID NO: 93667 - DNA, 25 bp, Homo sapien
tctggtggctgcacaggcgcctgcc

SEQ ID NO: 93668 - DNA, 25 bp, Homo sapien
gattcgaccactccctagatttgct

SEQ ID NO: 93669 - DNA, 25 bp, Homo sapien
cactccctagatttgctccacttgt

SEQ ID NO: 93670 - DNA, 25 bp, Homo sapien
tttgctccacttgtgaaaaccgagc

SEQ ID NO: 93671 - DNA, 25 bp, Homo sapien
accgagccccagaggccagtaaagg

SEQ ID NO: 93672 - DNA, 25 bp, Homo sapien
ggacctggaccaggaaccgagcctg

SEQ ID NO: 93673 - DNA, 25 bp, Homo sapien
aggaaccgagcctgctctatgcgga

SEQ ID NO: 93674 - DNA, 25 bp, Homo sapien
gctctatgcggatctggaccatcta

SEQ ID NO: 93675 - DNA, 25 bp, Homo sapien
atctggaccatctagccctcagcag

SEQ ID NO: 93676 - DNA, 25 bp, Homo sapien
tggcctgggccaaccagaaccgggc

SEQ ID NO: 93677 - DNA, 25 bp, Homo sapien
agaaccgggcaccagtactcagcat

SEQ ID NO: 93678 - DNA, 25 bp, Homo sapien
tcagcatagaccctcctgtgcatga

SEQ ID NO: 93679 - DNA, 25 bp, Homo sapien
tgtgcatgaagtcgaacagggcatt

SEQ ID NO: 93680 - DNA, 25 bp, Homo sapien
gggcattgatgccaaatggtcactg

SEQ ID NO: 93681 - DNA, 25 bp, Homo sapien
caaatggtcactggcactgggcctg

SEQ ID NO: 93682 - DNA, 25 bp, Homo sapien
agcacgcaggccgtatctatttgtg

SEQ ID NO: 93683 - DNA, 25 bp, Homo sapien
aggccgtatctatttgtgcgacatt

SEQ ID NO: 93684 - DNA, 25 bp, Homo sapien
atttgtgcgacattggcattcccca

SEQ ID NO: 93685 - DNA, 25 bp, Homo sapien
gacattggcattccccagcaggtct

SEQ ID NO: 93686 - DNA, 25 bp, Homo sapien
cactcgccctttggctgcaagtttg

SEQ ID NO: 93687 - DNA, 25 bp, Homo sapien
gggattctgcctcaggtactttgat

SEQ ID NO: 93688 - DNA, 25 bp, Homo sapien
tctgcctcaggtactttgatagagt

SEQ ID NO: 93689 - DNA, 25 bp, Homo sapien
ctttggagatcagcctcaccttctc

SEQ ID NO: 93690 - DNA, 25 bp, Homo sapien
ggcttacagccagcccttacagttt

SEQ ID NO: 93691 - DNA, 25 bp, Homo sapien
agcccttacagtttcactcatgaag

SEQ ID NO: 93692 - DNA, 25 bp, Homo sapien
tcactcatgaagcaccttgatcttt

SEQ ID NO: 93693 - DNA, 25 bp, Homo sapien
catcctgggtgctgcagatactgca

SEQ ID NO: 93694 - DNA, 25 bp, Homo sapien
aacaggaatcaatcttgcctgcccc

SEQ ID NO: 93695 - DNA, 25 bp, Homo sapien
tcacactcagcgtgggaccccgaat

SEQ ID NO: 93696 - DNA, 25 bp, Homo sapien
cgtgggaccccgaatgttaagcaat

SEQ ID NO: 93697 - DNA, 25 bp, Homo sapien
ggaccccgaatgttaagcaatgata

SEQ ID NO: 93698 - DNA, 25 bp, Homo sapien
gttatcacattggatgactttgaat

SEQ ID NO: 93699 - DNA, 25 bp, Homo sapien
tagtagtgacacttgggaccaaata

SEQ ID NO: 93700 - DNA, 25 bp, Homo sapien
gtaagctgtctgctaatagagtcag

SEQ ID NO: 93701 - DNA, 25 bp, Homo sapien
atagagtcagaattcttccagattg

SEQ ID NO: 93702 - DNA, 25 bp, Homo sapien
gaattcttccagattgtttccagct

SEQ ID NO: 93703 - DNA, 25 bp, Homo sapien
gattgtttccagctgtaacaggtat

SEQ ID NO: 93704 - DNA, 25 bp, Homo sapien
aggtattgaatttccaccgtgctcc

SEQ ID NO: 93705 - DNA, 25 bp, Homo sapien
accgtgctcctatgtaacagctggg

SEQ ID NO: 93706 - DNA, 25 bp, Homo sapien
gtaacagctgggtggtgtaaaaaat

SEQ ID NO: 93707 - DNA, 25 bp, Homo sapien
gaagcgtaatgttaatatcttgtaa

SEQ ID NO: 93708 - DNA, 25 bp, Homo sapien
atcttgtaaattcgtattccctatt

SEQ ID NO: 93709 - DNA, 25 bp, Homo sapien
gctttgtacctcttttgcaggatct

SEQ ID NO: 93710 - DNA, 25 bp, Homo sapien
gagggacaagctagttccccaacct

SEQ ID NO: 93711 - DNA, 25 bp, Homo sapien
caacctcctatgactgctttctatg

SEQ ID NO: 93712 - DNA, 25 bp, Homo sapien
gctttctatgctcacagcctttttt

SEQ ID NO: 93713 - DNA, 25 bp, Homo sapien
tccccgcacatactcacggaaagga

SEQ ID NO: 93714 - DNA, 25 bp, Homo sapien
ggaaccaatggtgctatttcccctc

SEQ ID NO: 93715 - DNA, 25 bp, Homo sapien
tcctcaacctgggaatacttcagac

SEQ ID NO: 93716 - DNA, 25 bp, Homo sapien
tacttcagacatctccaaactcatc

SEQ ID NO: 93717 - DNA, 25 bp, Homo sapien
atccttgtgtatagtctcacaccct

SEQ ID NO: 93718 - DNA, 25 bp, Homo sapien
cacacccttccccataagtataaat

SEQ ID NO: 93719 - DNA, 25 bp, Homo sapien
taaatgggcccatatttaacacatt

SEQ ID NO: 93720 - DNA, 25 bp, Homo sapien
aacactgttccgagtggtctcctca

SEQ ID NO: 93721 - DNA, 25 bp, Homo sapien
ttcactctcctttttctgggtccct

SEQ ID NO: 93722 - DNA, 25 bp, Homo sapien
caggacctccattggctcctagaag

SEQ ID NO: 93723 - DNA, 25 bp, Homo sapien
attggctcctagaagggctccccac

SEQ ID NO: 93724 - DNA, 25 bp, Homo sapien
cctagaagggctccccactttgctt

SEQ ID NO: 93725 - DNA, 25 bp, Homo sapien
actttgcttcctatactctgctgtc

SEQ ID NO: 93726 - DNA, 25 bp, Homo sapien
gctgtcccctacttgaggagggatt

SEQ ID NO: 93727 - DNA, 25 bp, Homo sapien
gggcttctgtgttgtccccagtgaa

SEQ ID NO: 93728 - DNA, 25 bp, Homo sapien
agtgaaggctcccacaaggacctga

SEQ ID NO: 93729 - DNA, 25 bp, Homo sapien
ggacctgatgacctcactgtacaga

SEQ ID NO: 93730 - DNA, 25 bp, Homo sapien
tgacctcactgtacagagctgactc

SEQ ID NO: 93731 - DNA, 25 bp, Homo sapien
aaacagaattttgagggcatggccc

SEQ ID NO: 93732 - DNA, 25 bp, Homo sapien
aacagaattttgagggcatggccca

SEQ ID NO: 93733 - DNA, 25 bp, Homo sapien
gagggcatggcccaaataactcatg

SEQ ID NO: 93734 - DNA, 25 bp, Homo sapien
ggcatggcccaaataactcatgagt

SEQ ID NO: 93735 - DNA, 25 bp, Homo sapien
atggcccaaataactcatgagttcc

SEQ ID NO: 93736 - DNA, 25 bp, Homo sapien
taactcatgagttccaagttgaaac

SEQ ID NO: 93737 - DNA, 25 bp, Homo sapien
tcatgagttccaagttgaaacatgg

SEQ ID NO: 93738 - DNA, 25 bp, Homo sapien
gaaacatggttgtgcaagttggaca

SEQ ID NO: 93739 - DNA, 25 bp, Homo sapien
catggttgtgcaagttggacattac

SEQ ID NO: 93740 - DNA, 25 bp, Homo sapien
ggttgtgcaagttggacattacaat

SEQ ID NO: 93741 - DNA, 25 bp, Homo sapien
ttgtgcaagttggacattacaatgt

SEQ ID NO: 93742 - DNA, 25 bp, Homo sapien
ccggggttcagctaacactcagcac

SEQ ID NO: 93743 - DNA, 25 bp, Homo sapien
ggtttgggccaagtagtgcttagtt

SEQ ID NO: 93744 - DNA, 25 bp, Homo sapien
gggccaagtagtgcttagttttaat

SEQ ID NO: 93745 - DNA, 25 bp, Homo sapien
taataagtaaagatgctgctcagct

SEQ ID NO: 93746 - DNA, 25 bp, Homo sapien
gtaaagatgctgctcagctgtcata

SEQ ID NO: 93747 - DNA, 25 bp, Homo sapien
gatgctgctcagctgtcatatcctg

SEQ ID NO: 93748 - DNA, 25 bp, Homo sapien
tgctcagctgtcatatcctgcaagg

SEQ ID NO: 93749 - DNA, 25 bp, Homo sapien
tcagctgtcatatcctgcaaggtta

SEQ ID NO: 93750 - DNA, 25 bp, Homo sapien
agctgtcatatcctgcaaggttaga

SEQ ID NO: 93751 - DNA, 25 bp, Homo sapien
gtcatatcctgcaaggttagaggaa

SEQ ID NO: 93752 - DNA, 25 bp, Homo sapien
tagaggaaagatgtgggccgtgcgc

SEQ ID NO: 93753 - DNA, 25 bp, Homo sapien
gggacttcatggttagaaacacaag

SEQ ID NO: 93754 - DNA, 25 bp, Homo sapien
ggacttcatggttagaaacacaagc

SEQ ID NO: 93755 - DNA, 25 bp, Homo sapien
gacttcatggttagaaacacaagct

SEQ ID NO: 93756 - DNA, 25 bp, Homo sapien
acttcatggttagaaacacaagctg

SEQ ID NO: 93757 - DNA, 25 bp, Homo sapien
cttcatggttagaaacacaagctgg

SEQ ID NO: 93758 - DNA, 25 bp, Homo sapien
aaacacaagctggaggccggatgcg

SEQ ID NO: 93759 - DNA, 25 bp, Homo sapien
aacacaagctggaggccggatgcgg

SEQ ID NO: 93760 - DNA, 25 bp, Homo sapien
acacaagctggaggccggatgcggt

SEQ ID NO: 93761 - DNA, 25 bp, Homo sapien
cacaagctggaggccggatgcggtg

SEQ ID NO: 93762 - DNA, 25 bp, Homo sapien
ctgcactttgggatgcctgaggtca

SEQ ID NO: 93763 - DNA, 25 bp, Homo sapien
gcactttgggatgcctgaggtcagg

SEQ ID NO: 93764 - DNA, 25 bp, Homo sapien
ttaagagattgatcattttgaggct

SEQ ID NO: 93765 - DNA, 25 bp, Homo sapien
gagattgatcattttgaggctgggt

SEQ ID NO: 93766 - DNA, 25 bp, Homo sapien
gggcacctgtagtcacggttactgc

SEQ ID NO: 93767 - DNA, 25 bp, Homo sapien
ggcacctgtagtcacggttactgca

SEQ ID NO: 93768 - DNA, 25 bp, Homo sapien
gcacctgtagtcacggttactgcag

SEQ ID NO: 93769 - DNA, 25 bp, Homo sapien
cacctgtagtcacggttactgcaga

SEQ ID NO: 93770 - DNA, 25 bp, Homo sapien
cctgtagtcacggttactgcagagg

SEQ ID NO: 93771 - DNA, 25 bp, Homo sapien
tgtagtcacggttactgcagaggct

SEQ ID NO: 93772 - DNA, 25 bp, Homo sapien
tagtcacggttactgcagaggctga

SEQ ID NO: 93773 - DNA, 25 bp, Homo sapien
agtcacggttactgcagaggctgag

SEQ ID NO: 93774 - DNA, 25 bp, Homo sapien
cacggttactgcagaggctgaggca

SEQ ID NO: 93775 - DNA, 25 bp, Homo sapien
gcagggtctggagctgctacagcat

SEQ ID NO: 93776 - DNA, 25 bp, Homo sapien
agctgctacagcatggccaggcctg

SEQ ID NO: 93777 - DNA, 25 bp, Homo sapien
tggccaggcctggtttgaagaccat

SEQ ID NO: 93778 - DNA, 25 bp, Homo sapien
ttgaagaccatctgagggaggcaca

SEQ ID NO: 93779 - DNA, 25 bp, Homo sapien
accatctgagggaggcacagcgaca

SEQ ID NO: 93780 - DNA, 25 bp, Homo sapien
ggcccttggtgagaattttctaaca

SEQ ID NO: 93781 - DNA, 25 bp, Homo sapien
agatttacactcagagcctggtcgc

SEQ ID NO: 93782 - DNA, 25 bp, Homo sapien
cccgttagcccagattcaaaaggtg

SEQ ID NO: 93783 - DNA, 25 bp, Homo sapien
gtgaacatctgtttgcagaatctga

SEQ ID NO: 93784 - DNA, 25 bp, Homo sapien
gcagaaaggagtcacccagccaaag

SEQ ID NO: 93785 - DNA, 25 bp, Homo sapien
aggagtcacccagccaaaggaggag

SEQ ID NO: 93786 - DNA, 25 bp, Homo sapien
aatagactgttcataatttatgtaa

SEQ ID NO: 93787 - DNA, 25 bp, Homo sapien
aaaaaccttgtttcactgtcacata

SEQ ID NO: 93788 - DNA, 25 bp, Homo sapien
aaaccttgtttcactgtcacatatg

SEQ ID NO: 93789 - DNA, 25 bp, Homo sapien
accttgtttcactgtcacatatgaa

SEQ ID NO: 93790 - DNA, 25 bp, Homo sapien
cttgaatatgtttgtagagatacta

SEQ ID NO: 93791 - DNA, 25 bp, Homo sapien
aaatgtgcagaaagattccaaagga

SEQ ID NO: 93792 - DNA, 25 bp, Homo sapien
ggagaatatatatcttgtgaaaata

SEQ ID NO: 93793 - DNA, 25 bp, Homo sapien
gagatttgaaaatttgacatgatgc

SEQ ID NO: 93794 - DNA, 25 bp, Homo sapien
gacatgatgcaaatagactgataca

SEQ ID NO: 93795 - DNA, 25 bp, Homo sapien
gactgatacataatttggaaaggtt

SEQ ID NO: 93796 - DNA, 25 bp, Homo sapien
cataatttggaaaggttctttacat

SEQ ID NO: 93797 - DNA, 25 bp, Homo sapien
ctgggatcgctgcagccatgttttc

SEQ ID NO: 93798 - DNA, 25 bp, Homo sapien
gatcgctgcagccatgttttcccgg

SEQ ID NO: 93799 - DNA, 25 bp, Homo sapien
tgcagccatgttttcccggccatgc

SEQ ID NO: 93800 - DNA, 25 bp, Homo sapien
atgttttcccggccatgccggcgtt

SEQ ID NO: 93801 - DNA, 25 bp, Homo sapien
cttgtaggaacagcctttctcgaat

SEQ ID NO: 93802 - DNA, 25 bp, Homo sapien
tgtaggaacagcctttctcgaatct

SEQ ID NO: 93803 - DNA, 25 bp, Homo sapien
taggaacagcctttctcgaatctgt

SEQ ID NO: 93804 - DNA, 25 bp, Homo sapien
ggaacagcctttctcgaatctgttt

SEQ ID NO: 93805 - DNA, 25 bp, Homo sapien
cagcctttctcgaatctgttttcag

SEQ ID NO: 93806 - DNA, 25 bp, Homo sapien
gaacctcagcatgtaaagaactatt

SEQ ID NO: 93807 - DNA, 25 bp, Homo sapien
cctcagcatgtaaagaactattttt

SEQ ID NO: 93808 - DNA, 25 bp, Homo sapien
tccttgctggctataaactttactg

SEQ ID NO: 93809 - DNA, 25 bp, Homo sapien
gctataaactttactggaggaattt

SEQ ID NO: 93810 - DNA, 25 bp, Homo sapien
gaaggcaggactaccaggaaatact

SEQ ID NO: 93811 - DNA, 25 bp, Homo sapien
aggaaatactagactctcccattaa

SEQ ID NO: 93812 - DNA, 25 bp, Homo sapien
gactctcccattaaatgaatacctg

SEQ ID NO: 93813 - DNA, 25 bp, Homo sapien
gaatacctgattattattgtctcat

SEQ ID NO: 93814 - DNA, 25 bp, Homo sapien
tattgtctcattaatgttcagttat

SEQ ID NO: 93815 - DNA, 25 bp, Homo sapien
gtatactgccattttaatgtttacc

SEQ ID NO: 93816 - DNA, 25 bp, Homo sapien
ttaatgtttacctatgaatgtcttt

SEQ ID NO: 93817 - DNA, 25 bp, Homo sapien
aatgtcttttgtgttatataactga

SEQ ID NO: 93818 - DNA, 25 bp, Homo sapien
gttatataactgacagagtgctata

SEQ ID NO: 93819 - DNA, 25 bp, Homo sapien
tgatgatctggaggtatttgctgct

SEQ ID NO: 93820 - DNA, 25 bp, Homo sapien
tctggaggtatttgctgctcatgct

SEQ ID NO: 93821 - DNA, 25 bp, Homo sapien
ttgctgctcatgctggccgcaagac

SEQ ID NO: 93822 - DNA, 25 bp, Homo sapien
catgctggccgcaagactgtgaagc

SEQ ID NO: 93823 - DNA, 25 bp, Homo sapien
gcggcagggcctggtcactgaccaa

SEQ ID NO: 93824 - DNA, 25 bp, Homo sapien
tggtcactgaccaagtctcactgca

SEQ ID NO: 93825 - DNA, 25 bp, Homo sapien
aagtctcactgcacgtgctagtgga

SEQ ID NO: 93826 - DNA, 25 bp, Homo sapien
tgcacgtgctagtggagcggcacct

SEQ ID NO: 93827 - DNA, 25 bp, Homo sapien
tgctcatcccctgtgcatacagtgg

SEQ ID NO: 93828 - DNA, 25 bp, Homo sapien
ccctgtgcatacagtggcaactctg

SEQ ID NO: 93829 - DNA, 25 bp, Homo sapien
gtagtggccaggcttcaacactttc

SEQ ID NO: 93830 - DNA, 25 bp, Homo sapien
aaaatggtatctcggtgtggcttta

SEQ ID NO: 93831 - DNA, 25 bp, Homo sapien
tggctttacctcatacttgtcttaa

SEQ ID NO: 93832 - DNA, 25 bp, Homo sapien
atacttgtcttaaacgcgagcttga

SEQ ID NO: 93833 - DNA, 25 bp, Homo sapien
aacgcgagcttgacatcttttcatg

SEQ ID NO: 93834 - DNA, 25 bp, Homo sapien
ggattttctgtgctgtgacatgcca

SEQ ID NO: 93835 - DNA, 25 bp, Homo sapien
gtgacatgccagtatcttttcatcc

SEQ ID NO: 93836 - DNA, 25 bp, Homo sapien
gccagtatcttttcatccacttatt

SEQ ID NO: 93837 - DNA, 25 bp, Homo sapien
ggagctcttgatatgttactgaaac

SEQ ID NO: 93838 - DNA, 25 bp, Homo sapien
gaaaccagctttttcttggtgatga

SEQ ID NO: 93839 - DNA, 25 bp, Homo sapien
acaatagccagtttgccattatcat

SEQ ID NO: 93840 - DNA, 25 bp, Homo sapien
ccattatcatttgcctgtgttatga

SEQ ID NO: 93841 - DNA, 25 bp, Homo sapien
gaatcgaggtattggtttctccctg

SEQ ID NO: 93842 - DNA, 25 bp, Homo sapien
attggtttctccctgtcaccgtcat

SEQ ID NO: 93843 - DNA, 25 bp, Homo sapien
gtgaacttgagccatttatcgaacc

SEQ ID NO: 93844 - DNA, 25 bp, Homo sapien
gagccatttatcgaacctcacggag

SEQ ID NO: 93845 - DNA, 25 bp, Homo sapien
tcacggagccccaagtttctcatct

SEQ ID NO: 93846 - DNA, 25 bp, Homo sapien
gaatgagccctactttgtatggttg

SEQ ID NO: 93847 - DNA, 25 bp, Homo sapien
gccctactttgtatggttgtcaaga

SEQ ID NO: 93848 - DNA, 25 bp, Homo sapien
aaagcaatggacacgcagaggaagt

SEQ ID NO: 93849 - DNA, 25 bp, Homo sapien
atctccgccaacctcaagaacgtgg

SEQ ID NO: 93850 - DNA, 25 bp, Homo sapien
caacctcaagaacgtggccccgaag

SEQ ID NO: 93851 - DNA, 25 bp, Homo sapien
ggccccgaagctgttccaggaactg

SEQ ID NO: 93852 - DNA, 25 bp, Homo sapien
aagttacataccctgggcatgtcca

SEQ ID NO: 93853 - DNA, 25 bp, Homo sapien
catgtccagatgaacgaagcgtgca

SEQ ID NO: 93854 - DNA, 25 bp, Homo sapien
aaatccacgtggaacctaagtgctc

SEQ ID NO: 93855 - DNA, 25 bp, Homo sapien
agtggacaccacgtggcatgatcct

SEQ ID NO: 93856 - DNA, 25 bp, Homo sapien
ggcatgatccttgatccaatcagat

SEQ ID NO: 93857 - DNA, 25 bp, Homo sapien
agattgagccctggcgtgatccagt

SEQ ID NO: 93858 - DNA, 25 bp, Homo sapien
gatccagtcagatcaagcctcctga

SEQ ID NO: 93859 - DNA, 25 bp, Homo sapien
gaatcccctcattacaagatccaat

SEQ ID NO: 93860 - DNA, 25 bp, Homo sapien
gatccaatcatatcatgcctcacta

SEQ ID NO: 93861 - DNA, 25 bp, Homo sapien
gcctcactaccctctgtatataaaa

SEQ ID NO: 93862 - DNA, 25 bp, Homo sapien
acagatttgggccagactcctgtgt

SEQ ID NO: 93863 - DNA, 25 bp, Homo sapien
ccccgcagcccctacatcagaagct

SEQ ID NO: 93864 - DNA, 25 bp, Homo sapien
cccgcagcccctacatcagaagctt

SEQ ID NO: 93865 - DNA, 25 bp, Homo sapien
ccgcagcccctacatcagaagcttg

SEQ ID NO: 93866 - DNA, 25 bp, Homo sapien
cgcagcccctacatcagaagcttgc

SEQ ID NO: 93867 - DNA, 25 bp, Homo sapien
gcagcccctacatcagaagcttgct

SEQ ID NO: 93868 - DNA, 25 bp, Homo sapien
cagcccctacatcagaagcttgctc

SEQ ID NO: 93869 - DNA, 25 bp, Homo sapien
tcagaagcttgctcttggcgcagtg

SEQ ID NO: 93870 - DNA, 25 bp, Homo sapien
cagaagcttgctcttggcgcagtgg

SEQ ID NO: 93871 - DNA, 25 bp, Homo sapien
agaagcttgctcttggcgcagtggc

SEQ ID NO: 93872 - DNA, 25 bp, Homo sapien
gaagcttgctcttggcgcagtggct

SEQ ID NO: 93873 - DNA, 25 bp, Homo sapien
ggctcctggagctgacaagcgaccc

SEQ ID NO: 93874 - DNA, 25 bp, Homo sapien
caagcgaccccgtggtgaggagaaa

SEQ ID NO: 93875 - DNA, 25 bp, Homo sapien
gccttgatgctcaccctggttcagg

SEQ ID NO: 93876 - DNA, 25 bp, Homo sapien
ggttcaggcccagaggtccaagcta

SEQ ID NO: 93877 - DNA, 25 bp, Homo sapien
agaggtccaagctatactgtgcagg

SEQ ID NO: 93878 - DNA, 25 bp, Homo sapien
atactgtgcaggacatggccaggcc

SEQ ID NO: 93879 - DNA, 25 bp, Homo sapien
tggtggacacaggaagcctacccaa

SEQ ID NO: 93880 - DNA, 25 bp, Homo sapien
agcctacccaacacgctggtatttg

SEQ ID NO: 93881 - DNA, 25 bp, Homo sapien
actcttgcccatgggtgactcttac

SEQ ID NO: 93882 - DNA, 25 bp, Homo sapien
tgactcttacccacagctgactagg

SEQ ID NO: 93883 - DNA, 25 bp, Homo sapien
ctgactagggccagcgcaaatactg

SEQ ID NO: 93884 - DNA, 25 bp, Homo sapien
tagagacccaggacctgggcgcctg

SEQ ID NO: 93885 - DNA, 25 bp, Homo sapien
gggaaaatggaatgcaacccacatt

SEQ ID NO: 93886 - DNA, 25 bp, Homo sapien
aatggaatgcaacccacattgtaaa

SEQ ID NO: 93887 - DNA, 25 bp, Homo sapien
ccacattgtaaagccactggcatct

SEQ ID NO: 93888 - DNA, 25 bp, Homo sapien
aaagccactggcatctgattatctc

SEQ ID NO: 93889 - DNA, 25 bp, Homo sapien
aagccactggcatctgattatctcc

SEQ ID NO: 93890 - DNA, 25 bp, Homo sapien
atctgattatctccatttgaacaca

SEQ ID NO: 93891 - DNA, 25 bp, Homo sapien
gattatctccatttgaacacacagc

SEQ ID NO: 93892 - DNA, 25 bp, Homo sapien
atctccatttgaacacacagcacag

SEQ ID NO: 93893 - DNA, 25 bp, Homo sapien
aacacacagcacagaacaatcattt

SEQ ID NO: 93894 - DNA, 25 bp, Homo sapien
cacacagcacagaacaatcatttaa

SEQ ID NO: 93895 - DNA, 25 bp, Homo sapien
aagtcggagcaacacataccaacct

SEQ ID NO: 93896 - DNA, 25 bp, Homo sapien
tcggagcaacacataccaaccttga

SEQ ID NO: 93897 - DNA, 25 bp, Homo sapien
aacacataccaaccttgaccttatc

SEQ ID NO: 93898 - DNA, 25 bp, Homo sapien
gaccttatcctcaagctccagggca

SEQ ID NO: 93899 - DNA, 25 bp, Homo sapien
tgaccaacctttcccagggcggcac

SEQ ID NO: 93900 - DNA, 25 bp, Homo sapien
agcagccgtgcgtgtatctcaagga

SEQ ID NO: 93901 - DNA, 25 bp, Homo sapien
gccgtgcgtgtatctcaaggaacta

SEQ ID NO: 93902 - DNA, 25 bp, Homo sapien
gtgcgtgtatctcaaggaactaaat

SEQ ID NO: 93903 - DNA, 25 bp, Homo sapien
actaaataagatgacgctactcctc

SEQ ID NO: 93904 - DNA, 25 bp, Homo sapien
taagatgacgctactcctcatagca

SEQ ID NO: 93905 - DNA, 25 bp, Homo sapien
gatgacgctactcctcatagcacca

SEQ ID NO: 93906 - DNA, 25 bp, Homo sapien
ggccgagccggactccatcctgaaa

SEQ ID NO: 93907 - DNA, 25 bp, Homo sapien
tgaaacccgagctcctgtcagccat

SEQ ID NO: 93908 - DNA, 25 bp, Homo sapien
gagctcctgtcagccatcgagaagc

SEQ ID NO: 93909 - DNA, 25 bp, Homo sapien
gccatcgagaagctcttgtgaaata

SEQ ID NO: 93910 - DNA, 25 bp, Homo sapien
aataaaagcagggttggcctcagcc

SEQ ID NO: 93911 - DNA, 25 bp, Homo sapien
taaaagcagggttggcctcagccct

SEQ ID NO: 93912 - DNA, 25 bp, Homo sapien
agccctgtgggtctgtctcatgctc

SEQ ID NO: 93913 - DNA, 25 bp, Homo sapien
gtgggtctgtctcatgctctccctg

SEQ ID NO: 93914 - DNA, 25 bp, Homo sapien
acctctggaaatacttggctctgcc

SEQ ID NO: 93915 - DNA, 25 bp, Homo sapien
ggaaatacttggctctgccccatgg

SEQ ID NO: 93916 - DNA, 25 bp, Homo sapien
agccgtggagctgtggaattgggcc

SEQ ID NO: 93917 - DNA, 25 bp, Homo sapien
tttattcagctaaaatagtacttca

SEQ ID NO: 93918 - DNA, 25 bp, Homo sapien
tagtacttcacaggaaatataggaa

SEQ ID NO: 93919 - DNA, 25 bp, Homo sapien
taggaaaagaaacactagttcagtt

SEQ ID NO: 93920 - DNA, 25 bp, Homo sapien
atgtacttctaattatactcttgaa

SEQ ID NO: 93921 - DNA, 25 bp, Homo sapien
aaggtctgaggtgggtctgaaattc

SEQ ID NO: 93922 - DNA, 25 bp, Homo sapien
ggtgggtctgaaattcatacatgaa

SEQ ID NO: 93923 - DNA, 25 bp, Homo sapien
gaaacttagttctaccttgattaca

SEQ ID NO: 93924 - DNA, 25 bp, Homo sapien
gttctaccttgattacatatgttgt

SEQ ID NO: 93925 - DNA, 25 bp, Homo sapien
accttgattacatatgttgttacaa

SEQ ID NO: 93926 - DNA, 25 bp, Homo sapien
gtatatcttttgaataattgcttat

SEQ ID NO: 93927 - DNA, 25 bp, Homo sapien
aattgcttataatatgccttaccat

SEQ ID NO: 93928 - DNA, 25 bp, Homo sapien
aaagatggtctatattctctttatt

SEQ ID NO: 93929 - DNA, 25 bp, Homo sapien
tattctctttattgcatatacttaa

SEQ ID NO: 93930 - DNA, 25 bp, Homo sapien
aagaatgcagattctgtgtttaagc

SEQ ID NO: 93931 - DNA, 25 bp, Homo sapien
gattctgtgtttaagcacagggctg

SEQ ID NO: 93932 - DNA, 25 bp, Homo sapien
cagggctgatagttgtggttttgtt

SEQ ID NO: 93933 - DNA, 25 bp, Homo sapien
gtggttttgtttacaaatgttctgt

SEQ ID NO: 93934 - DNA, 25 bp, Homo sapien
gtatttgaatagttatgtttcactg

SEQ ID NO: 93935 - DNA, 25 bp, Homo sapien
tcactgatgctgagccagtttgtat

SEQ ID NO: 93936 - DNA, 25 bp, Homo sapien
gatgctgagccagtttgtatgtgtg

SEQ ID NO: 93937 - DNA, 25 bp, Homo sapien
atgtgaactgtaactgacaagatga

SEQ ID NO: 93938 - DNA, 25 bp, Homo sapien
gtaactgacaagatgaattactcag

SEQ ID NO: 93939 - DNA, 25 bp, Homo sapien
tctagactgggaaacatacacatac

SEQ ID NO: 93940 - DNA, 25 bp, Homo sapien
gggaaacatacacatacaagcagat

SEQ ID NO: 93941 - DNA, 25 bp, Homo sapien
aagacagtctgggataggaactata

SEQ ID NO: 93942 - DNA, 25 bp, Homo sapien
ggaactatagcagaggtgccaacag

SEQ ID NO: 93943 - DNA, 25 bp, Homo sapien
ggtgccaacagcaatagttgtgact

SEQ ID NO: 93944 - DNA, 25 bp, Homo sapien
gtgactaattgctgagcacctgctg

SEQ ID NO: 93945 - DNA, 25 bp, Homo sapien
acactagctgccctacatgaagcaa

SEQ ID NO: 93946 - DNA, 25 bp, Homo sapien
agctgccctacatgaagcaactcag

SEQ ID NO: 93947 - DNA, 25 bp, Homo sapien
agcaactcagcttatcctaacaatc

SEQ ID NO: 93948 - DNA, 25 bp, Homo sapien
tcagcttatcctaacaatcttcatg

SEQ ID NO: 93949 - DNA, 25 bp, Homo sapien
aacaatcttcatggcaggatttttt

SEQ ID NO: 93950 - DNA, 25 bp, Homo sapien
cccattttgtggttcaagtgcacta

SEQ ID NO: 93951 - DNA, 25 bp, Homo sapien
gttcaagtgcactagacagctgctg

SEQ ID NO: 93952 - DNA, 25 bp, Homo sapien
ggaagcacaggcaatgtctgcaatc

SEQ ID NO: 93953 - DNA, 25 bp, Homo sapien
aatgtctgcaatcagctgtgggaga

SEQ ID NO: 93954 - DNA, 25 bp, Homo sapien
gtgactgagaacagtctgaggcctg

SEQ ID NO: 93955 - DNA, 25 bp, Homo sapien
gaggcctggctccacttggaagtat

SEQ ID NO: 93956 - DNA, 25 bp, Homo sapien
gggtgcgatgaaatcacaattatct

SEQ ID NO: 93957 - DNA, 25 bp, Homo sapien
tatcttgaagcctaaagagggaact

SEQ ID NO: 93958 - DNA, 25 bp, Homo sapien
gagggaactacaagactgttaacta

SEQ ID NO: 93959 - DNA, 25 bp, Homo sapien
aactaagatcaatgtgggcacctaa

SEQ ID NO: 93960 - DNA, 25 bp, Homo sapien
aaatcaccatttctcaggtcaaaat

SEQ ID NO: 93961 - DNA, 25 bp, Homo sapien
aaagcctttattgctgaagctataa

SEQ ID NO: 93962 - DNA, 25 bp, Homo sapien
gaagctataatttgtctgtcagatc

SEQ ID NO: 93963 - DNA, 25 bp, Homo sapien
gtctgtcagatctaatgtcaaacaa

SEQ ID NO: 93964 - DNA, 25 bp, Homo sapien
aatctttgaaacttgccatgtgaga

SEQ ID NO: 93965 - DNA, 25 bp, Homo sapien
tgccatgtgagagtcgtgttcctga

SEQ ID NO: 93966 - DNA, 25 bp, Homo sapien
ccacgtgggcttggatctgggtcac

SEQ ID NO: 93967 - DNA, 25 bp, Homo sapien
gatctgggtcacttttaattttgcc

SEQ ID NO: 93968 - DNA, 25 bp, Homo sapien
tgcccctagggattttacatctctg

SEQ ID NO: 93969 - DNA, 25 bp, Homo sapien
ggattttacatctctgaagcccaat

SEQ ID NO: 93970 - DNA, 25 bp, Homo sapien
gaagcccaattgatttcacactcct

SEQ ID NO: 93971 - DNA, 25 bp, Homo sapien
acactcctaaatgacagacagctgg

SEQ ID NO: 93972 - DNA, 25 bp, Homo sapien
acccaagggagactgaatcacattt

SEQ ID NO: 93973 - DNA, 25 bp, Homo sapien
atcacatttaccattacaccagctt

SEQ ID NO: 93974 - DNA, 25 bp, Homo sapien
acatttaccattacaccagctttca

SEQ ID NO: 93975 - DNA, 25 bp, Homo sapien
tttgtttccatatgatcatagggac

SEQ ID NO: 93976 - DNA, 25 bp, Homo sapien
catatgatcatagggactgtattac

SEQ ID NO: 93977 - DNA, 25 bp, Homo sapien
gggactgtattactaagtatgctta

SEQ ID NO: 93978 - DNA, 25 bp, Homo sapien
aaatgctatttacagactgttccct

SEQ ID NO: 93979 - DNA, 25 bp, Homo sapien
tgctatttacagactgttccctttt

SEQ ID NO: 93980 - DNA, 25 bp, Homo sapien
aattgcctgtagaaaaccatgcctg

SEQ ID NO: 93981 - DNA, 25 bp, Homo sapien
ttgcctgtagaaaaccatgcctgag

SEQ ID NO: 93982 - DNA, 25 bp, Homo sapien
tgtagaaaaccatgcctgaggccag

SEQ ID NO: 93983 - DNA, 25 bp, Homo sapien
tagaaatttagtcctttggcctggg

SEQ ID NO: 93984 - DNA, 25 bp, Homo sapien
tatgagaacagcctaatcctggaga

SEQ ID NO: 93985 - DNA, 25 bp, Homo sapien
gcctaatcctggagaacattactag

SEQ ID NO: 93986 - DNA, 25 bp, Homo sapien
acattactagttttgtttcatcttc

SEQ ID NO: 93987 - DNA, 25 bp, Homo sapien
ttgtttcatcttcctacccaattat

SEQ ID NO: 93988 - DNA, 25 bp, Homo sapien
atcttcctacccaattatctgtact

SEQ ID NO: 93989 - DNA, 25 bp, Homo sapien
cctacccaattatctgtactttgat

SEQ ID NO: 93990 - DNA, 25 bp, Homo sapien
gtttccagattaacctgtgccattt

SEQ ID NO: 93991 - DNA, 25 bp, Homo sapien
atatgattatttccccctgcttacc

SEQ ID NO: 93992 - DNA, 25 bp, Homo sapien
tgcttaccacacagctttctattgc

SEQ ID NO: 93993 - DNA, 25 bp, Homo sapien
ccacacagctttctattgcatcaaa

SEQ ID NO: 93994 - DNA, 25 bp, Homo sapien
ttaggtatcctaggtaagagcccct

SEQ ID NO: 93995 - DNA, 25 bp, Homo sapien
gtaagagcccctaaacatcaagcaa

SEQ ID NO: 93996 - DNA, 25 bp, Homo sapien
catcaagcaatctgtgagtctgtaa

SEQ ID NO: 93997 - DNA, 25 bp, Homo sapien
attcttatctaattccacccctgtt

SEQ ID NO: 93998 - DNA, 25 bp, Homo sapien
acccctgttggaagatgatttcttt

SEQ ID NO: 93999 - DNA, 25 bp, Homo sapien
atttctttgttctttgcaactatgg

SEQ ID NO: 94000 - DNA, 25 bp, Homo sapien
gcaactatggaagctgtgaaaatca

SEQ ID NO: 94001 - DNA, 25 bp, Homo sapien
gaaaatcatcacaagtgcctctgaa

SEQ ID NO: 94002 - DNA, 25 bp, Homo sapien
caagtgcctctgaaagcgagtgtta

SEQ ID NO: 94003 - DNA, 25 bp, Homo sapien
ctgaaagcgagtgttaggttggtta

SEQ ID NO: 94004 - DNA, 25 bp, Homo sapien
ttctgcaatggtttgtaggaatttt

SEQ ID NO: 94005 - DNA, 25 bp, Homo sapien
tgtccttgttacattgaggttaaga

SEQ ID NO: 94006 - DNA, 25 bp, Homo sapien
cattggcagtgcaatctctttccag

SEQ ID NO: 94007 - DNA, 25 bp, Homo sapien
gtgcaatctctttccaggatttcgt

SEQ ID NO: 94008 - DNA, 25 bp, Homo sapien
ccaggatttcgtttgctgtggcatt

SEQ ID NO: 94009 - DNA, 25 bp, Homo sapien
ggcattggttatatcagagcacttt

SEQ ID NO: 94010 - DNA, 25 bp, Homo sapien
gaaggatgatactgtaacttgattt

SEQ ID NO: 94011 - DNA, 25 bp, Homo sapien
gcttttaattatctacagctatttt

SEQ ID NO: 94012 - DNA, 25 bp, Homo sapien
tttaattctctcctacagtactggg

SEQ ID NO: 94013 - DNA, 25 bp, Homo sapien
tctcctacagtactgggaccactgt

SEQ ID NO: 94014 - DNA, 25 bp, Homo sapien
tgggaccactgtaaacttctcagat

SEQ ID NO: 94015 - DNA, 25 bp, Homo sapien
aaacttctcagatgacttgtatttt

SEQ ID NO: 94016 - DNA, 25 bp, Homo sapien
cagaagatgaggtctaccaggccca

SEQ ID NO: 94017 - DNA, 25 bp, Homo sapien
aagatgaggtctaccaggcccagct

SEQ ID NO: 94018 - DNA, 25 bp, Homo sapien
actacctagcagtgggtgatggaca

SEQ ID NO: 94019 - DNA, 25 bp, Homo sapien
agcagtgggtgatggacacagacat

SEQ ID NO: 94020 - DNA, 25 bp, Homo sapien
gggctgttagcgtctctctgtttat

SEQ ID NO: 94021 - DNA, 25 bp, Homo sapien
tagcgtctctctgtttattcgctca

SEQ ID NO: 94022 - DNA, 25 bp, Homo sapien
tctctctgtttattcgctcacaata

SEQ ID NO: 94023 - DNA, 25 bp, Homo sapien
tcacaataatacacagcccctggat

SEQ ID NO: 94024 - DNA, 25 bp, Homo sapien
acaataatacacagcccctggatgg

SEQ ID NO: 94025 - DNA, 25 bp, Homo sapien
gggaggagacatccacttccctggc

SEQ ID NO: 94026 - DNA, 25 bp, Homo sapien
gaatgtaaacagcagcagatgaaca

SEQ ID NO: 94027 - DNA, 25 bp, Homo sapien
gtgccctgcaagaggctcatcaact

SEQ ID NO: 94028 - DNA, 25 bp, Homo sapien
aggctcatcaactgtggcgtctgca

SEQ ID NO: 94029 - DNA, 25 bp, Homo sapien
ttgcaggaaccgcaaaacgggacac

SEQ ID NO: 94030 - DNA, 25 bp, Homo sapien
aacgggacaccagatctgcaaattt

SEQ ID NO: 94031 - DNA, 25 bp, Homo sapien
aaaacctggcacttcactagagaga

SEQ ID NO: 94032 - DNA, 25 bp, Homo sapien
tagagagaacacctgttcccagcgc

SEQ ID NO: 94033 - DNA, 25 bp, Homo sapien
tgttcccagcgctgaagcattccga

SEQ ID NO: 94034 - DNA, 25 bp, Homo sapien
gaagcattccgatggttcttttaaa

SEQ ID NO: 94035 - DNA, 25 bp, Homo sapien
agcagtagtatatcttattttcaag

SEQ ID NO: 94036 - DNA, 25 bp, Homo sapien
gaagggcaaactaatgtcttgtttt

SEQ ID NO: 94037 - DNA, 25 bp, Homo sapien
aagaaactgcttagtccaccactga

SEQ ID NO: 94038 - DNA, 25 bp, Homo sapien
acactatgttagttgcatttaggtt

SEQ ID NO: 94039 - DNA, 25 bp, Homo sapien
aggttttaaagcaaagaatctgtag

SEQ ID NO: 94040 - DNA, 25 bp, Homo sapien
gaatctgtagagaaatctatgcaat

SEQ ID NO: 94041 - DNA, 25 bp, Homo sapien
atgcaatatatagtttgtccagatt

SEQ ID NO: 94042 - DNA, 25 bp, Homo sapien
gtttgtccagattagctttcatttg

SEQ ID NO: 94043 - DNA, 25 bp, Homo sapien
gggaatgaagttctgaaatatctaa

SEQ ID NO: 94044 - DNA, 25 bp, Homo sapien
gaaatatctaaagcagtttactcat

SEQ ID NO: 94045 - DNA, 25 bp, Homo sapien
aaagcagtttactcatcaattgaaa

SEQ ID NO: 94046 - DNA, 25 bp, Homo sapien
actcatcaattgaaaagtcctccaa

SEQ ID NO: 94047 - DNA, 25 bp, Homo sapien
gctaagtttacttggtgcagttaag

SEQ ID NO: 94048 - DNA, 25 bp, Homo sapien
tacttggtgcagttaagaattaaac

SEQ ID NO: 94049 - DNA, 25 bp, Homo sapien
catctgtgctctcgctgggcacgtg

SEQ ID NO: 94050 - DNA, 25 bp, Homo sapien
tgggcacgtggcttcatgtcagtaa

SEQ ID NO: 94051 - DNA, 25 bp, Homo sapien
gcacgtggcttcatgtcagtaagca

SEQ ID NO: 94052 - DNA, 25 bp, Homo sapien
cttcatgtcagtaagcaagatgctt

SEQ ID NO: 94053 - DNA, 25 bp, Homo sapien
agatgcttcttaataacccaccttc

SEQ ID NO: 94054 - DNA, 25 bp, Homo sapien
tgcttcttaataacccaccttctgc

SEQ ID NO: 94055 - DNA, 25 bp, Homo sapien
cctccatcctttattcagagtcatc

SEQ ID NO: 94056 - DNA, 25 bp, Homo sapien
gtgtttgtttgtgtgcacatgtaaa

SEQ ID NO: 94057 - DNA, 25 bp, Homo sapien
aagcagaaagtccttacctcctgta

SEQ ID NO: 94058 - DNA, 25 bp, Homo sapien
aaagtccttacctcctgtaacacat

SEQ ID NO: 94059 - DNA, 25 bp, Homo sapien
tacctcctgtaacacatcaataaag

SEQ ID NO: 94060 - DNA, 25 bp, Homo sapien
gcctggccgtgtggagcactgcact

SEQ ID NO: 94061 - DNA, 25 bp, Homo sapien
tggccgtgtggagcactgcactcct

SEQ ID NO: 94062 - DNA, 25 bp, Homo sapien
gccgtgtggagcactgcactcctag

SEQ ID NO: 94063 - DNA, 25 bp, Homo sapien
gtgtggagcactgcactcctaggaa

SEQ ID NO: 94064 - DNA, 25 bp, Homo sapien
tgtggagcactgcactcctaggaag

SEQ ID NO: 94065 - DNA, 25 bp, Homo sapien
gtggagcactgcactcctaggaagc

SEQ ID NO: 94066 - DNA, 25 bp, Homo sapien
tggagcactgcactcctaggaagca

SEQ ID NO: 94067 - DNA, 25 bp, Homo sapien
ggagcactgcactcctaggaagcag

SEQ ID NO: 94068 - DNA, 25 bp, Homo sapien
agcactgcactcctaggaagcagga

SEQ ID NO: 94069 - DNA, 25 bp, Homo sapien
gaagctgtttcaggcaggtggagag

SEQ ID NO: 94070 - DNA, 25 bp, Homo sapien
gggcgctgggcagtcgggaggcgaa

SEQ ID NO: 94071 - DNA, 25 bp, Homo sapien
tgaatgggtccataagccccgggaa

SEQ ID NO: 94072 - DNA, 25 bp, Homo sapien
taagccccgggaaatggatacaagt

SEQ ID NO: 94073 - DNA, 25 bp, Homo sapien
ggattttgctgaacaggcctatctt

SEQ ID NO: 94074 - DNA, 25 bp, Homo sapien
gctgaacaggcctatcttgaacttt

SEQ ID NO: 94075 - DNA, 25 bp, Homo sapien
aggcctatcttgaactttggtaaat

SEQ ID NO: 94076 - DNA, 25 bp, Homo sapien
cataaacctttcacgtctggacgaa

SEQ ID NO: 94077 - DNA, 25 bp, Homo sapien
gtctggacgaattaccaaatgccat

SEQ ID NO: 94078 - DNA, 25 bp, Homo sapien
aaatgccatgaattgccactgtgtg

SEQ ID NO: 94079 - DNA, 25 bp, Homo sapien
ccatgaattgccactgtgtgtttat

SEQ ID NO: 94080 - DNA, 25 bp, Homo sapien
ggtctcttcagaaaggaacctttga

SEQ ID NO: 94081 - DNA, 25 bp, Homo sapien
gaaaggaacctttgattctaaatat

SEQ ID NO: 94082 - DNA, 25 bp, Homo sapien
gtgaccaaatgctattaatttccat

SEQ ID NO: 94083 - DNA, 25 bp, Homo sapien
aatttccatcctttagcaggctggg

SEQ ID NO: 94084 - DNA, 25 bp, Homo sapien
ctttagcaggctgggccctaggcag

SEQ ID NO: 94085 - DNA, 25 bp, Homo sapien
ccctaggcaggaagctggcttctgg

SEQ ID NO: 94086 - DNA, 25 bp, Homo sapien
aacgtgcagggcctgcctagcttgc

SEQ ID NO: 94087 - DNA, 25 bp, Homo sapien
tgcctagcttgcgtgcttgaggaag

SEQ ID NO: 94088 - DNA, 25 bp, Homo sapien
gaaggtggcattccgtgcttgcctc

SEQ ID NO: 94089 - DNA, 25 bp, Homo sapien
gagggtggcattctgtgtcttctgc

SEQ ID NO: 94090 - DNA, 25 bp, Homo sapien
gtgtcttctgcttatgaagcgcctt

SEQ ID NO: 94091 - DNA, 25 bp, Homo sapien
tctgcttatgaagcgcctttcttaa

SEQ ID NO: 94092 - DNA, 25 bp, Homo sapien
gcgcctttcttaaagtttggcaata

SEQ ID NO: 94093 - DNA, 25 bp, Homo sapien
ttcatctccctgatcttccagacaa

SEQ ID NO: 94094 - DNA, 25 bp, Homo sapien
tctccctgatcttccagacaaacta

SEQ ID NO: 94095 - DNA, 25 bp, Homo sapien
gacaaactacctggatgttgccctt

SEQ ID NO: 94096 - DNA, 25 bp, Homo sapien
ctggatgttgcccttaaaccatttc

SEQ ID NO: 94097 - DNA, 25 bp, Homo sapien
aatgattgagtgatagctgagaagt

SEQ ID NO: 94098 - DNA, 25 bp, Homo sapien
tttggcaggtgctctctttcctccg

SEQ ID NO: 94099 - DNA, 25 bp, Homo sapien
ctcctctctgtaatggtatgtccag

SEQ ID NO: 94100 - DNA, 25 bp, Homo sapien
ctctctgtaatggtatgtccagcct

SEQ ID NO: 94101 - DNA, 25 bp, Homo sapien
ctccctccctggtgctgtatgcgtt

SEQ ID NO: 94102 - DNA, 25 bp, Homo sapien
atttgtgatcacatacccttctttt

SEQ ID NO: 94103 - DNA, 25 bp, Homo sapien
ttgtgatcacatacccttcttttaa

SEQ ID NO: 94104 - DNA, 25 bp, Homo sapien
ctctctctgcctgtgggaatctgga

SEQ ID NO: 94105 - DNA, 25 bp, Homo sapien
tctctctgcctgtgggaatctggac

SEQ ID NO: 94106 - DNA, 25 bp, Homo sapien
ctctctgcctgtgggaatctggaca

SEQ ID NO: 94107 - DNA, 25 bp, Homo sapien
ctctgcctgtgggaatctggacaca

SEQ ID NO: 94108 - DNA, 25 bp, Homo sapien
ctgcctgtgggaatctggacacatt

SEQ ID NO: 94109 - DNA, 25 bp, Homo sapien
gcctgtgggaatctggacacatttt

SEQ ID NO: 94110 - DNA, 25 bp, Homo sapien
tgggaggcctcccaaggctgtggga

SEQ ID NO: 94111 - DNA, 25 bp, Homo sapien
gaggcctcccaaggctgtgggacgt

SEQ ID NO: 94112 - DNA, 25 bp, Homo sapien
tgtgggacgtgcttgctctggcagc

SEQ ID NO: 94113 - DNA, 25 bp, Homo sapien
gctctggcagctgcagggttcctgt

SEQ ID NO: 94114 - DNA, 25 bp, Homo sapien
tctggcagctgcagggttcctgtct

SEQ ID NO: 94115 - DNA, 25 bp, Homo sapien
ggcttcactacaacgaagaattgaa

SEQ ID NO: 94116 - DNA, 25 bp, Homo sapien
gaaacgccacaaggcacgaacgaag

SEQ ID NO: 94117 - DNA, 25 bp, Homo sapien
gaacgaagagaagactgctgcggaa

SEQ ID NO: 94118 - DNA, 25 bp, Homo sapien
agactgctgcggaagaatcagagga

SEQ ID NO: 94119 - DNA, 25 bp, Homo sapien
agaggaagctcctctgaccggtgga

SEQ ID NO: 94120 - DNA, 25 bp, Homo sapien
gaccggtggactgcaaacccagtca

SEQ ID NO: 94121 - DNA, 25 bp, Homo sapien
aaacccagtcatgcgacccttagaa

SEQ ID NO: 94122 - DNA, 25 bp, Homo sapien
tgcgacccttagaagatgcctgctt

SEQ ID NO: 94123 - DNA, 25 bp, Homo sapien
cctgcttcacccttgcaattgtttg

SEQ ID NO: 94124 - DNA, 25 bp, Homo sapien
tgtgacgcttagaagatatctgctt

SEQ ID NO: 94125 - DNA, 25 bp, Homo sapien
tctgcttcacccttgcaattgtttg

SEQ ID NO: 94126 - DNA, 25 bp, Homo sapien
ttctaagggaacttctctaatctct

SEQ ID NO: 94127 - DNA, 25 bp, Homo sapien
atcctcatccccaaatagtgttttc

SEQ ID NO: 94128 - DNA, 25 bp, Homo sapien
tccccaaatagtgttttcttcctct

SEQ ID NO: 94129 - DNA, 25 bp, Homo sapien
cttcctctgggttcttataatgttg

SEQ ID NO: 94130 - DNA, 25 bp, Homo sapien
taatgttggtatcaatctcacagca

SEQ ID NO: 94131 - DNA, 25 bp, Homo sapien
tgcctggtgtgacagttacctgtgt

SEQ ID NO: 94132 - DNA, 25 bp, Homo sapien
gtgtgacagttacctgtgtgcatgt

SEQ ID NO: 94133 - DNA, 25 bp, Homo sapien
tgtgcaatttctaatttcccacgct

SEQ ID NO: 94134 - DNA, 25 bp, Homo sapien
atttcccacgctagactgtgagctt

SEQ ID NO: 94135 - DNA, 25 bp, Homo sapien
cttctacattgcaggcgctgaataa

SEQ ID NO: 94136 - DNA, 25 bp, Homo sapien
tcctatctacatttgatctgtcatg

SEQ ID NO: 94137 - DNA, 25 bp, Homo sapien
agagataaatttctgcaaacatatc

SEQ ID NO: 94138 - DNA, 25 bp, Homo sapien
gcaaacatatctcagtcttccctct

SEQ ID NO: 94139 - DNA, 25 bp, Homo sapien
caaacatatctcagtcttccctctg

SEQ ID NO: 94140 - DNA, 25 bp, Homo sapien
aaacatatctcagtcttccctctgt

SEQ ID NO: 94141 - DNA, 25 bp, Homo sapien
aacatatctcagtcttccctctgtt

SEQ ID NO: 94142 - DNA, 25 bp, Homo sapien
acatatctcagtcttccctctgttt

SEQ ID NO: 94143 - DNA, 25 bp, Homo sapien
catatctcagtcttccctctgtttc

SEQ ID NO: 94144 - DNA, 25 bp, Homo sapien
atatctcagtcttccctctgtttct

SEQ ID NO: 94145 - DNA, 25 bp, Homo sapien
ttctctggtgattaagaagttcctt

SEQ ID NO: 94146 - DNA, 25 bp, Homo sapien
tctctggtgattaagaagttccttt

SEQ ID NO: 94147 - DNA, 25 bp, Homo sapien
ttttaagagattgatcattttgagg

SEQ ID NO: 94148 - DNA, 25 bp, Homo sapien
tttaagagattgatcattttgaggc

SEQ ID NO: 94149 - DNA, 25 bp, Homo sapien
ttaagagattgatcattttgaggct

SEQ ID NO: 94150 - DNA, 25 bp, Homo sapien
gggcacctgtagtcacggttactgc

SEQ ID NO: 94151 - DNA, 25 bp, Homo sapien
ggcacctgtagtcacggttactgca

SEQ ID NO: 94152 - DNA, 25 bp, Homo sapien
gcacctgtagtcacggttactgcag

SEQ ID NO: 94153 - DNA, 25 bp, Homo sapien
cacctgtagtcacggttactgcaga

SEQ ID NO: 94154 - DNA, 25 bp, Homo sapien
acctgtagtcacggttactgcagag

SEQ ID NO: 94155 - DNA, 25 bp, Homo sapien
cctgtagtcacggttactgcagagg

SEQ ID NO: 94156 - DNA, 25 bp, Homo sapien
catggtggtggcacccatctgtagt

SEQ ID NO: 94157 - DNA, 25 bp, Homo sapien
atggtggtggcacccatctgtagtc

SEQ ID NO: 94158 - DNA, 25 bp, Homo sapien
agcctgagggggatgttgccgtgag

SEQ ID NO: 94159 - DNA, 25 bp, Homo sapien
tgccgtgagccaagagcttgtgact

SEQ ID NO: 94160 - DNA, 25 bp, Homo sapien
gccgtgagccaagagcttgtgactg

SEQ ID NO: 94161 - DNA, 25 bp, Homo sapien
ccgtgagccaagagcttgtgactgg

SEQ ID NO: 94162 - DNA, 25 bp, Homo sapien
cgtgagccaagagcttgtgactgga

SEQ ID NO: 94163 - DNA, 25 bp, Homo sapien
gtgagccaagagcttgtgactggac

SEQ ID NO: 94164 - DNA, 25 bp, Homo sapien
tgagccaagagcttgtgactggact

SEQ ID NO: 94165 - DNA, 25 bp, Homo sapien
gagccaagagcttgtgactggactc

SEQ ID NO: 94166 - DNA, 25 bp, Homo sapien
agccaagagcttgtgactggactcc

SEQ ID NO: 94167 - DNA, 25 bp, Homo sapien
gtgacgtcagtccagtgcgacacaa

SEQ ID NO: 94168 - DNA, 25 bp, Homo sapien
agtgcgacacaaggatctgcgctgt

SEQ ID NO: 94169 - DNA, 25 bp, Homo sapien
tctgcgctgtggagcccggacgcca

SEQ ID NO: 94170 - DNA, 25 bp, Homo sapien
ggtacacctggtcaatgatcttctc

SEQ ID NO: 94171 - DNA, 25 bp, Homo sapien
aatgatcttctccttgacctgggag

SEQ ID NO: 94172 - DNA, 25 bp, Homo sapien
ccttgacctgggagatggtgttaca

SEQ ID NO: 94173 - DNA, 25 bp, Homo sapien
gttacagttgaggaccttcaccggg

SEQ ID NO: 94174 - DNA, 25 bp, Homo sapien
ttgaggaccttcaccgggatggcgt

SEQ ID NO: 94175 - DNA, 25 bp, Homo sapien
agcagccccgtgtcgttgagagtgt

SEQ ID NO: 94176 - DNA, 25 bp, Homo sapien
gttgagagtgtacttggccttcttc

SEQ ID NO: 94177 - DNA, 25 bp, Homo sapien
ttggccttcttctgtaccgcatcca

SEQ ID NO: 94178 - DNA, 25 bp, Homo sapien
aagaaggacccctggaggaatgctt

SEQ ID NO: 94179 - DNA, 25 bp, Homo sapien
ggaggaatgcttggcctacctgact

SEQ ID NO: 94180 - DNA, 25 bp, Homo sapien
atgcccaacgctgtggagcaggcca

SEQ ID NO: 94181 - DNA, 25 bp, Homo sapien
aggctgtatacaaactcgctgaatc

SEQ ID NO: 94182 - DNA, 25 bp, Homo sapien
tcgctgaatcaggtagggaccttat

SEQ ID NO: 94183 - DNA, 25 bp, Homo sapien
ttggtggcaccccagatctcagtaa

SEQ ID NO: 94184 - DNA, 25 bp, Homo sapien
gcaccccagatctcagtaatgcagg

SEQ ID NO: 94185 - DNA, 25 bp, Homo sapien
gggctgttgggtgcttcctgcaaat

SEQ ID NO: 94186 - DNA, 25 bp, Homo sapien
gttgggtgcttcctgcaaatccctg

SEQ ID NO: 94187 - DNA, 25 bp, Homo sapien
cctgagagggcagaagatagcttct

SEQ ID NO: 94188 - DNA, 25 bp, Homo sapien
gatagcttctgttaattcattattc

SEQ ID NO: 94189 - DNA, 25 bp, Homo sapien
gtccttaccatcctgcgggatgaac

SEQ ID NO: 94190 - DNA, 25 bp, Homo sapien
tgcagtctgagcctttcccatgctg

SEQ ID NO: 94191 - DNA, 25 bp, Homo sapien
gctgccctcggcctgttcagatggg

SEQ ID NO: 94192 - DNA, 25 bp, Homo sapien
tgaactggaccaggtggcctcactg

SEQ ID NO: 94193 - DNA, 25 bp, Homo sapien
actggaccaggtggcctcactggct

SEQ ID NO: 94194 - DNA, 25 bp, Homo sapien
tcaggacaactaagcctgctggtca

SEQ ID NO: 94195 - DNA, 25 bp, Homo sapien
ctggtcagggctggctttcagcctt

SEQ ID NO: 94196 - DNA, 25 bp, Homo sapien
tttcagccttcctaaggctcctgga

SEQ ID NO: 94197 - DNA, 25 bp, Homo sapien
gggagcctttcctggctccctctgt

SEQ ID NO: 94198 - DNA, 25 bp, Homo sapien
tctgttttctctcactgtagaccaa

SEQ ID NO: 94199 - DNA, 25 bp, Homo sapien
tgttttctctcactgtagaccaaag

SEQ ID NO: 94200 - DNA, 25 bp, Homo sapien
agggatcgctggtcccctacatgcc

SEQ ID NO: 94201 - DNA, 25 bp, Homo sapien
ctacatgcccaacgctgtggagcag

SEQ ID NO: 94202 - DNA, 25 bp, Homo sapien
acatgcccaacgctgtggagcaggc

SEQ ID NO: 94203 - DNA, 25 bp, Homo sapien
atgcccaacgctgtggagcaggcca

SEQ ID NO: 94204 - DNA, 25 bp, Homo sapien
gcccaacgctgtggagcaggccagt

SEQ ID NO: 94205 - DNA, 25 bp, Homo sapien
ccaacgctgtggagcaggccagtga

SEQ ID NO: 94206 - DNA, 25 bp, Homo sapien
ggccagtgaggctgtatacaaactc

SEQ ID NO: 94207 - DNA, 25 bp, Homo sapien
gtgaggctgtatacaaactcgctga

SEQ ID NO: 94208 - DNA, 25 bp, Homo sapien
gaggctgtatacaaactcgctgaat

SEQ ID NO: 94209 - DNA, 25 bp, Homo sapien
ggctgtatacaaactcgctgaatca

SEQ ID NO: 94210 - DNA, 25 bp, Homo sapien
ctgtatacaaactcgctgaatcagg

SEQ ID NO: 94211 - DNA, 25 bp, Homo sapien
gattgttcatccacaccattttata

SEQ ID NO: 94212 - DNA, 25 bp, Homo sapien
tgttcatccacaccattttatatag

SEQ ID NO: 94213 - DNA, 25 bp, Homo sapien
gatcaaaagcttcctcttcctcagg

SEQ ID NO: 94214 - DNA, 25 bp, Homo sapien
acagcttctactttagatgatccaa

SEQ ID NO: 94215 - DNA, 25 bp, Homo sapien
gaatacctgtacctgcagattccag

SEQ ID NO: 94216 - DNA, 25 bp, Homo sapien
tacctgtacctgcagattccagttt

SEQ ID NO: 94217 - DNA, 25 bp, Homo sapien
gtacctgcagattccagtttcaaag

SEQ ID NO: 94218 - DNA, 25 bp, Homo sapien
ctgcagattccagtttcaaagaaat

SEQ ID NO: 94219 - DNA, 25 bp, Homo sapien
tattatttacacagttaaggaacag

SEQ ID NO: 94220 - DNA, 25 bp, Homo sapien
ggaacaggtgatacattttcatttg

SEQ ID NO: 94221 - DNA, 25 bp, Homo sapien
gttagaaactgatctttctgtaata

SEQ ID NO: 94222 - DNA, 25 bp, Homo sapien
ctgaggcctggtttgtcaggcaata

SEQ ID NO: 94223 - DNA, 25 bp, Homo sapien
cctggtttgtcaggcaatatgccct

SEQ ID NO: 94224 - DNA, 25 bp, Homo sapien
ggtttgtcaggcaatatgcccttga

SEQ ID NO: 94225 - DNA, 25 bp, Homo sapien
ttgtcaggcaatatgcccttgagca

SEQ ID NO: 94226 - DNA, 25 bp, Homo sapien
aggcaatatgcccttgagcaggtca

SEQ ID NO: 94227 - DNA, 25 bp, Homo sapien
ggcaatatgcccttgagcaggtcac

SEQ ID NO: 94228 - DNA, 25 bp, Homo sapien
gcaatatgcccttgagcaggtcacc

SEQ ID NO: 94229 - DNA, 25 bp, Homo sapien
aatatgcccttgagcaggtcacccc

SEQ ID NO: 94230 - DNA, 25 bp, Homo sapien
ttgagcaggtcaccccctgggaatg

SEQ ID NO: 94231 - DNA, 25 bp, Homo sapien
gggtactcatgcaccccgctttgca

SEQ ID NO: 94232 - DNA, 25 bp, Homo sapien
tttgcacaccacagagtgccctcac

SEQ ID NO: 94233 - DNA, 25 bp, Homo sapien
caaacttggagtaatgagatcagca

SEQ ID NO: 94234 - DNA, 25 bp, Homo sapien
gagatcagcatcgagttctaactct

SEQ ID NO: 94235 - DNA, 25 bp, Homo sapien
gagttctaactctgcacttttctct

SEQ ID NO: 94236 - DNA, 25 bp, Homo sapien
tctctctgactttgtacatgtcacc

SEQ ID NO: 94237 - DNA, 25 bp, Homo sapien
gactttgtacatgtcacctcaattc

SEQ ID NO: 94238 - DNA, 25 bp, Homo sapien
tgtacatgtcacctcaattctatga

SEQ ID NO: 94239 - DNA, 25 bp, Homo sapien
catgtcacctcaattctatgagttt

SEQ ID NO: 94240 - DNA, 25 bp, Homo sapien
gggacattagctgactaccaggtgt

SEQ ID NO: 94241 - DNA, 25 bp, Homo sapien
ttagctgactaccaggtgttccacc

SEQ ID NO: 94242 - DNA, 25 bp, Homo sapien
taccaggtgttccacctgaaagctc

SEQ ID NO: 94243 - DNA, 25 bp, Homo sapien
gttcagctggtattttccattttta

SEQ ID NO: 94244 - DNA, 25 bp, Homo sapien
acagttaaaactaggctgggagcag

SEQ ID NO: 94245 - DNA, 25 bp, Homo sapien
cagttaaaactaggctgggagcagt

SEQ ID NO: 94246 - DNA, 25 bp, Homo sapien
gtgtgtctgtactcccatctactgt

SEQ ID NO: 94247 - DNA, 25 bp, Homo sapien
tgtgtctgtactcccatctactgtg

SEQ ID NO: 94248 - DNA, 25 bp, Homo sapien
gtgtctgtactcccatctactgtgg

SEQ ID NO: 94249 - DNA, 25 bp, Homo sapien
aggaggatgttgaacctgggcagct

SEQ ID NO: 94250 - DNA, 25 bp, Homo sapien
ggaggatgttgaacctgggcagctg

SEQ ID NO: 94251 - DNA, 25 bp, Homo sapien
gatgttgaacctgggcagctgatgc

SEQ ID NO: 94252 - DNA, 25 bp, Homo sapien
atgttgaacctgggcagctgatgct

SEQ ID NO: 94253 - DNA, 25 bp, Homo sapien
tgttgaacctgggcagctgatgctg

SEQ ID NO: 94254 - DNA, 25 bp, Homo sapien
gttgaacctgggcagctgatgctgc

SEQ ID NO: 94255 - DNA, 25 bp, Homo sapien
cctatgagtgagaacgaaggcattt

SEQ ID NO: 94256 - DNA, 25 bp, Homo sapien
ctatgagtgagaacgaaggcatttc

SEQ ID NO: 94257 - DNA, 25 bp, Homo sapien
tatgagtgagaacgaaggcatttca

SEQ ID NO: 94258 - DNA, 25 bp, Homo sapien
atgagtgagaacgaaggcatttcat

SEQ ID NO: 94259 - DNA, 25 bp, Homo sapien
tgagtgagaacgaaggcatttcatt

SEQ ID NO: 94260 - DNA, 25 bp, Homo sapien
gagtgagaacgaaggcatttcattc

SEQ ID NO: 94261 - DNA, 25 bp, Homo sapien
agtgagaacgaaggcatttcattct

SEQ ID NO: 94262 - DNA, 25 bp, Homo sapien
aggcatttcattcttgatgatggtg

SEQ ID NO: 94263 - DNA, 25 bp, Homo sapien
atttcattcttgatgatggtggtgg

SEQ ID NO: 94264 - DNA, 25 bp, Homo sapien
ggtggtgatgatgttgatgacaatt

SEQ ID NO: 94265 - DNA, 25 bp, Homo sapien
atgatgttgatgacaattatattaa

SEQ ID NO: 94266 - DNA, 25 bp, Homo sapien
ggaccgattccaacacaggctcctc

SEQ ID NO: 94267 - DNA, 25 bp, Homo sapien
ttcccgacatcagcagaaggcagca

SEQ ID NO: 94268 - DNA, 25 bp, Homo sapien
agaaggcagcatccctgcatgccgt

SEQ ID NO: 94269 - DNA, 25 bp, Homo sapien
agcatccctgcatgccgtccatata

SEQ ID NO: 94270 - DNA, 25 bp, Homo sapien
gtccatatacaacccctctttgaaa

SEQ ID NO: 94271 - DNA, 25 bp, Homo sapien
gagaataaactcctacgaaagccct

SEQ ID NO: 94272 - DNA, 25 bp, Homo sapien
ataaactcctacgaaagccctacat

SEQ ID NO: 94273 - DNA, 25 bp, Homo sapien
aactcctacgaaagccctacattga

SEQ ID NO: 94274 - DNA, 25 bp, Homo sapien
acgaaagccctacattgagctccaa

SEQ ID NO: 94275 - DNA, 25 bp, Homo sapien
aagccctacattgagctccaatctg

SEQ ID NO: 94276 - DNA, 25 bp, Homo sapien
cctacattgagctccaatctgctcg

SEQ ID NO: 94277 - DNA, 25 bp, Homo sapien
caaagactccatagctgtgcctagg

SEQ ID NO: 94278 - DNA, 25 bp, Homo sapien
ccatagctgtgcctaggagtctagg

SEQ ID NO: 94279 - DNA, 25 bp, Homo sapien
agtgacagaggcttggcttttttac

SEQ ID NO: 94280 - DNA, 25 bp, Homo sapien
ttttacctttagttcagccaagtca

SEQ ID NO: 94281 - DNA, 25 bp, Homo sapien
agccaagtcattttcaagtcctgag

SEQ ID NO: 94282 - DNA, 25 bp, Homo sapien
gtgaattttagcctggtagcctctc

SEQ ID NO: 94283 - DNA, 25 bp, Homo sapien
tagcctggtagcctctctaaggaaa

SEQ ID NO: 94284 - DNA, 25 bp, Homo sapien
gaacttgtagcatacctggatataa

SEQ ID NO: 94285 - DNA, 25 bp, Homo sapien
gaaagggcctgggtgttacccatgt

SEQ ID NO: 94286 - DNA, 25 bp, Homo sapien
gggtgttacccatgtactgaaaatg

SEQ ID NO: 94287 - DNA, 25 bp, Homo sapien
atgaacttttaccaacatggctaaa

SEQ ID NO: 94288 - DNA, 25 bp, Homo sapien
ttccctcatacttcagcatgggcta

SEQ ID NO: 94289 - DNA, 25 bp, Homo sapien
catacttcagcatgggctagaccca

SEQ ID NO: 94290 - DNA, 25 bp, Homo sapien
cccggatctgacaaaggtgcctgct

SEQ ID NO: 94291 - DNA, 25 bp, Homo sapien
cggatctgacaaaggtgcctgcttc

SEQ ID NO: 94292 - DNA, 25 bp, Homo sapien
gtctcctcagctatgtggaactgtg

SEQ ID NO: 94293 - DNA, 25 bp, Homo sapien
agatgaatacatattgtctctgaca

SEQ ID NO: 94294 - DNA, 25 bp, Homo sapien
gtctctgacaataaatgtgttctca

SEQ ID NO: 94295 - DNA, 25 bp, Homo sapien
gtgttctcactcatatcattcttcg

SEQ ID NO: 94296 - DNA, 25 bp, Homo sapien
cactcatatcattcttcgtctgtac

SEQ ID NO: 94297 - DNA, 25 bp, Homo sapien
atatcattcttcgtctgtacataaa

SEQ ID NO: 94298 - DNA, 25 bp, Homo sapien
cattcttcgtctgtacataaatatt

SEQ ID NO: 94299 - DNA, 25 bp, Homo sapien
gatatttgtggattacaatcctcat

SEQ ID NO: 94300 - DNA, 25 bp, Homo sapien
atatttgtggattacaatcctcatt

SEQ ID NO: 94301 - DNA, 25 bp, Homo sapien
atttgtggattacaatcctcattta

SEQ ID NO: 94302 - DNA, 25 bp, Homo sapien
tttgtggattacaatcctcatttac

SEQ ID NO: 94303 - DNA, 25 bp, Homo sapien
ggacattacaatgtaaaacacattt

SEQ ID NO: 94304 - DNA, 25 bp, Homo sapien
ttacaatgtaaaacacattttcttc

SEQ ID NO: 94305 - DNA, 25 bp, Homo sapien
ttcccccaagcgttttatatttatg

SEQ ID NO: 94306 - DNA, 25 bp, Homo sapien
tcccccaagcgttttatatttatgt

SEQ ID NO: 94307 - DNA, 25 bp, Homo sapien
tttgtattcaatgtgaggcttatta

SEQ ID NO: 94308 - DNA, 25 bp, Homo sapien
gtattcaatgtgaggcttattaaaa

SEQ ID NO: 94309 - DNA, 25 bp, Homo sapien
tattcaatgtgaggcttattaaaaa

SEQ ID NO: 94310 - DNA, 25 bp, Homo sapien
ggacaaagacgaactgatccagccc

SEQ ID NO: 94311 - DNA, 25 bp, Homo sapien
gtacctggggatcatgaccaacacg

SEQ ID NO: 94312 - DNA, 25 bp, Homo sapien
gggctggctaatgtgcagtggagcg

SEQ ID NO: 94313 - DNA, 25 bp, Homo sapien
gggatgagcccctgcaaaggcccgt

SEQ ID NO: 94314 - DNA, 25 bp, Homo sapien
ggcggccacagaaacgggtacccag

SEQ ID NO: 94315 - DNA, 25 bp, Homo sapien
gggtacccagtgtaagtcagggcta

SEQ ID NO: 94316 - DNA, 25 bp, Homo sapien
ccagtgtaagtcagggctaaaggaa

SEQ ID NO: 94317 - DNA, 25 bp, Homo sapien
ggaagcgggaattgactttcttaag

SEQ ID NO: 94318 - DNA, 25 bp, Homo sapien
gcgggaattgactttcttaagcttt

SEQ ID NO: 94319 - DNA, 25 bp, Homo sapien
attgactttcttaagctttgttttg

SEQ ID NO: 94320 - DNA, 25 bp, Homo sapien
ttaagctttgttttgattacagtgt

SEQ ID NO: 94321 - DNA, 25 bp, Homo sapien
agagcagtcaccatctgatcttcat

SEQ ID NO: 94322 - DNA, 25 bp, Homo sapien
gtcaccatctgatcttcatcaaagg

SEQ ID NO: 94323 - DNA, 25 bp, Homo sapien
gttcttctgcagagtctgggagtct

SEQ ID NO: 94324 - DNA, 25 bp, Homo sapien
ggagtcttcagactggtttgcctga

SEQ ID NO: 94325 - DNA, 25 bp, Homo sapien
tgcctgaatcttttcctttaactgg

SEQ ID NO: 94326 - DNA, 25 bp, Homo sapien
aacaactgatggctgtgtagcagat

SEQ ID NO: 94327 - DNA, 25 bp, Homo sapien
agcagatgcactgggagcagccttt

SEQ ID NO: 94328 - DNA, 25 bp, Homo sapien
gcagcctttgccacaaggtcaaaag

SEQ ID NO: 94329 - DNA, 25 bp, Homo sapien
gaaattccgtggaggagcttgaaga

SEQ ID NO: 94330 - DNA, 25 bp, Homo sapien
gatgactaacacaactgaggccaat

SEQ ID NO: 94331 - DNA, 25 bp, Homo sapien
tgaggccaatggatcactcttgatt

SEQ ID NO: 94332 - DNA, 25 bp, Homo sapien
cagcgtccaaaagagcatccggcaa

SEQ ID NO: 94333 - DNA, 25 bp, Homo sapien
aagagcatccggcaacatcccggtg

SEQ ID NO: 94334 - DNA, 25 bp, Homo sapien
aacatcccggtgtccagtggcacat

SEQ ID NO: 94335 - DNA, 25 bp, Homo sapien
gtgtccagtggcacatgtgcacctg

SEQ ID NO: 94336 - DNA, 25 bp, Homo sapien
acatgtgcacctggacgttccagtg

SEQ ID NO: 94337 - DNA, 25 bp, Homo sapien
tggacgttccagtgtggtgagcttt

SEQ ID NO: 94338 - DNA, 25 bp, Homo sapien
tggtgagctttcaggcacggagcaa

SEQ ID NO: 94339 - DNA, 25 bp, Homo sapien
agatgaaggtgacgcagtactcccc

SEQ ID NO: 94340 - DNA, 25 bp, Homo sapien
cccttatagtgcctacaggccttat

SEQ ID NO: 94341 - DNA, 25 bp, Homo sapien
gtgcctacaggccttataggccaga

SEQ ID NO: 94342 - DNA, 25 bp, Homo sapien
ggccttataggccagacagatctgg

SEQ ID NO: 94343 - DNA, 25 bp, Homo sapien
aacttgccagtcagcattcagtttt

SEQ ID NO: 94344 - DNA, 25 bp, Homo sapien
gtttatgggagctattttgcagtaa

SEQ ID NO: 94345 - DNA, 25 bp, Homo sapien
gcagtaattgctggaattttcctaa

SEQ ID NO: 94346 - DNA, 25 bp, Homo sapien
gaagcatgtatattacctactcaac

SEQ ID NO: 94347 - DNA, 25 bp, Homo sapien
tacctactcaaccaaatcccagaag

SEQ ID NO: 94348 - DNA, 25 bp, Homo sapien
atcccagaaggatgtacagagccct

SEQ ID NO: 94349 - DNA, 25 bp, Homo sapien
agagccctgctccaagtgagaatcc

SEQ ID NO: 94350 - DNA, 25 bp, Homo sapien
gagaatccagatgtgtctcacccag

SEQ ID NO: 94351 - DNA, 25 bp, Homo sapien
cagatgtgtctcacccagaggaaga

SEQ ID NO: 94352 - DNA, 25 bp, Homo sapien
tcaacaaaactctaacctcatcgca

SEQ ID NO: 94353 - DNA, 25 bp, Homo sapien
tcgcaacaaacgcaacagtggcttt

SEQ ID NO: 94354 - DNA, 25 bp, Homo sapien
ggaccagtttatatatttctgcatg

SEQ ID NO: 94355 - DNA, 25 bp, Homo sapien
atttctgcatgattgttaaagtata

SEQ ID NO: 94356 - DNA, 25 bp, Homo sapien
atggtagttaacatctgggatctag

SEQ ID NO: 94357 - DNA, 25 bp, Homo sapien
aacatctgggatctaggcagtactt

SEQ ID NO: 94358 - DNA, 25 bp, Homo sapien
tgggatctaggcagtacttttgacc

SEQ ID NO: 94359 - DNA, 25 bp, Homo sapien
cagtacttttgaccatttagaggga

SEQ ID NO: 94360 - DNA, 25 bp, Homo sapien
aaaggaactggctgagtaactgggt

SEQ ID NO: 94361 - DNA, 25 bp, Homo sapien
gatgtggaaccatattactttgtat

SEQ ID NO: 94362 - DNA, 25 bp, Homo sapien
ctttgtatatcaatattgtgccatg

SEQ ID NO: 94363 - DNA, 25 bp, Homo sapien
atattgtgccatgtattgtaatact

SEQ ID NO: 94364 - DNA, 25 bp, Homo sapien
gtaatactataatggaatcaagcaa

SEQ ID NO: 94365 - DNA, 25 bp, Homo sapien
ataattctcagtatctgtagcatta

SEQ ID NO: 94366 - DNA, 25 bp, Homo sapien
cagtatctgtagcattattgttaat

SEQ ID NO: 94367 - DNA, 25 bp, Homo sapien
tgttaatgtcaatcctatagaggct

SEQ ID NO: 94368 - DNA, 25 bp, Homo sapien
gtcaatcctatagaggctggaacag

SEQ ID NO: 94369 - DNA, 25 bp, Homo sapien
gtaacttgcctaactaagtctcctt

SEQ ID NO: 94370 - DNA, 25 bp, Homo sapien
ttgcctaactaagtctccttgttga

SEQ ID NO: 94371 - DNA, 25 bp, Homo sapien
aagtctccttgttgacaataggtct

SEQ ID NO: 94372 - DNA, 25 bp, Homo sapien
ataggtcttaatgcagtgttttccg

SEQ ID NO: 94373 - DNA, 25 bp, Homo sapien
aatgcagtgttttccgaatccctcg

SEQ ID NO: 94374 - DNA, 25 bp, Homo sapien
gaatccctcgttcttacatcaaaac

SEQ ID NO: 94375 - DNA, 25 bp, Homo sapien
tacatcaaaacagaactgtggctgg

SEQ ID NO: 94376 - DNA, 25 bp, Homo sapien
aatggatgtgcctaaaagctcccct

SEQ ID NO: 94377 - DNA, 25 bp, Homo sapien
tgtgcctaaaagctcccctcaaaaa

SEQ ID NO: 94378 - DNA, 25 bp, Homo sapien
aaaactgcagattttgccttgcact

SEQ ID NO: 94379 - DNA, 25 bp, Homo sapien
gccttgcactttttgaatctctctt

SEQ ID NO: 94380 - DNA, 25 bp, Homo sapien
aatagcgtagatgcatctctgcgta

SEQ ID NO: 94381 - DNA, 25 bp, Homo sapien
gcatctctgcgtattttcaagtttt

SEQ ID NO: 94382 - DNA, 25 bp, Homo sapien
ttttttatcttgctgtgagagcata

SEQ ID NO: 94383 - DNA, 25 bp, Homo sapien
gagcatatgttgtgactgtcgttga

SEQ ID NO: 94384 - DNA, 25 bp, Homo sapien
tttactggtttctttgtgaagctga

SEQ ID NO: 94385 - DNA, 25 bp, Homo sapien
ctgaaaaggaacattaagcgggaca

SEQ ID NO: 94386 - DNA, 25 bp, Homo sapien
gcgggacaaaaaatgccgattttat

SEQ ID NO: 94387 - DNA, 25 bp, Homo sapien
acctcctcgctgtgtgatcttgaga

SEQ ID NO: 94388 - DNA, 25 bp, Homo sapien
gtgtgatcttgagaaagctccttcc

SEQ ID NO: 94389 - DNA, 25 bp, Homo sapien
aggaactttgaggtgtctgccggct

SEQ ID NO: 94390 - DNA, 25 bp, Homo sapien
gtgtctgccggctaacattgtgtca

SEQ ID NO: 94391 - DNA, 25 bp, Homo sapien
aacattgtgtcattcctggagtcca

SEQ ID NO: 94392 - DNA, 25 bp, Homo sapien
gtgtcattcctggagtccacagtac

SEQ ID NO: 94393 - DNA, 25 bp, Homo sapien
ctcaacaggcacagctctcacaaag

SEQ ID NO: 94394 - DNA, 25 bp, Homo sapien
ctcacaaagctcttcaagcatggaa

SEQ ID NO: 94395 - DNA, 25 bp, Homo sapien
gggagttgtgttgtacttcatggca

SEQ ID NO: 94396 - DNA, 25 bp, Homo sapien
gttgtacttcatggcactctgatgc

SEQ ID NO: 94397 - DNA, 25 bp, Homo sapien
gtctcagtgtttggttattatgcaa

SEQ ID NO: 94398 - DNA, 25 bp, Homo sapien
gaaaaatagattaatgtgaggtcca

SEQ ID NO: 94399 - DNA, 25 bp, Homo sapien
aaaaatagattaatgtgaggtccag

SEQ ID NO: 94400 - DNA, 25 bp, Homo sapien
aaaatagattaatgtgaggtccaga

SEQ ID NO: 94401 - DNA, 25 bp, Homo sapien
aaatagattaatgtgaggtccagag

SEQ ID NO: 94402 - DNA, 25 bp, Homo sapien
aaaaataaaattgctcactgggcac

SEQ ID NO: 94403 - DNA, 25 bp, Homo sapien
aaaataaaattgctcactgggcacg

SEQ ID NO: 94404 - DNA, 25 bp, Homo sapien
aaataaaattgctcactgggcacgg

SEQ ID NO: 94405 - DNA, 25 bp, Homo sapien
aataaaattgctcactgggcacggt

SEQ ID NO: 94406 - DNA, 25 bp, Homo sapien
atggcttgagcccataatcatgcca

SEQ ID NO: 94407 - DNA, 25 bp, Homo sapien
tggcttgagcccataatcatgccac

SEQ ID NO: 94408 - DNA, 25 bp, Homo sapien
acctagatagtaccaatgctttttg

SEQ ID NO: 94409 - DNA, 25 bp, Homo sapien
caatgctttttgctactgttttttg

SEQ ID NO: 94410 - DNA, 25 bp, Homo sapien
tttaatcctaaacctcaacaaatga

SEQ ID NO: 94411 - DNA, 25 bp, Homo sapien
gaggagctggtctttgatatgtttc

SEQ ID NO: 94412 - DNA, 25 bp, Homo sapien
gatatgtttcctttcaatttcccta

SEQ ID NO: 94413 - DNA, 25 bp, Homo sapien
tgcctcatatcaatccctgtcataa

SEQ ID NO: 94414 - DNA, 25 bp, Homo sapien
cctgtcataaaccaggcaccctggg

SEQ ID NO: 94415 - DNA, 25 bp, Homo sapien
ggcctccacgaggttccatttgaaa

SEQ ID NO: 94416 - DNA, 25 bp, Homo sapien
cacgaggttccatttgaaagttgat

SEQ ID NO: 94417 - DNA, 25 bp, Homo sapien
agttgatttggagacataggtgttt

SEQ ID NO: 94418 - DNA, 25 bp, Homo sapien
acataggtgtttgactttggagttc

SEQ ID NO: 94419 - DNA, 25 bp, Homo sapien
ggcagcattttcagatagctttttg

SEQ ID NO: 94420 - DNA, 25 bp, Homo sapien
cagcattttcagatagctttttgtt

SEQ ID NO: 94421 - DNA, 25 bp, Homo sapien
tactattatacccatcttcagtgtc

SEQ ID NO: 94422 - DNA, 25 bp, Homo sapien
actattatacccatcttcagtgtct

SEQ ID NO: 94423 - DNA, 25 bp, Homo sapien
ctattatacccatcttcagtgtctt

SEQ ID NO: 94424 - DNA, 25 bp, Homo sapien
tattatacccatcttcagtgtctta

SEQ ID NO: 94425 - DNA, 25 bp, Homo sapien
attatacccatcttcagtgtcttac

SEQ ID NO: 94426 - DNA, 25 bp, Homo sapien
ttatacccatcttcagtgtcttact

SEQ ID NO: 94427 - DNA, 25 bp, Homo sapien
tatacccatcttcagtgtcttactt

SEQ ID NO: 94428 - DNA, 25 bp, Homo sapien
atacccatcttcagtgtcttacttg

SEQ ID NO: 94429 - DNA, 25 bp, Homo sapien
tacccatcttcagtgtcttacttgt

SEQ ID NO: 94430 - DNA, 25 bp, Homo sapien
gatgtgactccgggccatgtccagg

SEQ ID NO: 94431 - DNA, 25 bp, Homo sapien
catgtccagggcactggtcacagaa

SEQ ID NO: 94432 - DNA, 25 bp, Homo sapien
ccagggcactggtcacagaaagtgt

SEQ ID NO: 94433 - DNA, 25 bp, Homo sapien
gtgtcagttcttccccgtgagctgt

SEQ ID NO: 94434 - DNA, 25 bp, Homo sapien
ttccactgtgagttgcaagctgggc

SEQ ID NO: 94435 - DNA, 25 bp, Homo sapien
gtgagttgcaagctgggcatttcat

SEQ ID NO: 94436 - DNA, 25 bp, Homo sapien
aagctgggcatttcatggtcgctgt

SEQ ID NO: 94437 - DNA, 25 bp, Homo sapien
gcatttcatggtcgctgtggatctg

SEQ ID NO: 94438 - DNA, 25 bp, Homo sapien
atggtcgctgtggatctgcgcccat

SEQ ID NO: 94439 - DNA, 25 bp, Homo sapien
tccacagagggcttagaattgcagg

SEQ ID NO: 94440 - DNA, 25 bp, Homo sapien
attgcagggcgagccaggcatggtg

SEQ ID NO: 94441 - DNA, 25 bp, Homo sapien
tttagcaagcacatatggcaacccc

SEQ ID NO: 94442 - DNA, 25 bp, Homo sapien
agaatctacaggtctccctctctgc

SEQ ID NO: 94443 - DNA, 25 bp, Homo sapien
gtctccctctctgccaatgaatgtg

SEQ ID NO: 94444 - DNA, 25 bp, Homo sapien
aatgaatgtgcctctctttcagtct

SEQ ID NO: 94445 - DNA, 25 bp, Homo sapien
gtctctctctcccagcacatgtgta

SEQ ID NO: 94446 - DNA, 25 bp, Homo sapien
agcacatgtgtatcagcctgtcctg

SEQ ID NO: 94447 - DNA, 25 bp, Homo sapien
agcctgtcctggctgatttcaggat

SEQ ID NO: 94448 - DNA, 25 bp, Homo sapien
gggtacagtttttggcattgctaga

SEQ ID NO: 94449 - DNA, 25 bp, Homo sapien
agatgcagagaacccttaggtttcc

SEQ ID NO: 94450 - DNA, 25 bp, Homo sapien
gaacccttaggtttccagcgtggat

SEQ ID NO: 94451 - DNA, 25 bp, Homo sapien
ccagcgtggattttgtggacagagc

SEQ ID NO: 94452 - DNA, 25 bp, Homo sapien
gccttggggagcagtgttatgatac

SEQ ID NO: 94453 - DNA, 25 bp, Homo sapien
gttatgataccaaatggctaacatt

SEQ ID NO: 94454 - DNA, 25 bp, Homo sapien
aatggctaacattcatgacctcagt

SEQ ID NO: 94455 - DNA, 25 bp, Homo sapien
tggctaacattcatgacctcagtat

SEQ ID NO: 94456 - DNA, 25 bp, Homo sapien
gctaacattcatgacctcagtatcc

SEQ ID NO: 94457 - DNA, 25 bp, Homo sapien
gagaaagtgtgatgtagtaaaacca

SEQ ID NO: 94458 - DNA, 25 bp, Homo sapien
catttctcatatttggtgtaagata

SEQ ID NO: 94459 - DNA, 25 bp, Homo sapien
gtttgaagaggttccatgagcccca

SEQ ID NO: 94460 - DNA, 25 bp, Homo sapien
tgaagaggttccatgagccccagac

SEQ ID NO: 94461 - DNA, 25 bp, Homo sapien
gaagaggttccatgagccccagaca

SEQ ID NO: 94462 - DNA, 25 bp, Homo sapien
gttccatgagccccagacaggataa

SEQ ID NO: 94463 - DNA, 25 bp, Homo sapien
atctaagctgttcccgaaagagtgt

SEQ ID NO: 94464 - DNA, 25 bp, Homo sapien
taagctgttcccgaaagagtgttac

SEQ ID NO: 94465 - DNA, 25 bp, Homo sapien
aagctgttcccgaaagagtgttaca

SEQ ID NO: 94466 - DNA, 25 bp, Homo sapien
gctgttcccgaaagagtgttacaga

SEQ ID NO: 94467 - DNA, 25 bp, Homo sapien
ttcccgaaagagtgttacagaacac

SEQ ID NO: 94468 - DNA, 25 bp, Homo sapien
tacagaacacaacagtattgtacaa

SEQ ID NO: 94469 - DNA, 25 bp, Homo sapien
gaacacaacagtattgtacaatatt

SEQ ID NO: 94470 - DNA, 25 bp, Homo sapien
attcgataagcatatcttcactgca

SEQ ID NO: 94471 - DNA, 25 bp, Homo sapien
gataagcatatcttcactgcacttg

SEQ ID NO: 94472 - DNA, 25 bp, Homo sapien
taagcatatcttcactgcacttgtt

SEQ ID NO: 94473 - DNA, 25 bp, Homo sapien
aagcatatcttcactgcacttgtta

SEQ ID NO: 94474 - DNA, 25 bp, Homo sapien
ttctgacacctgaaatgattcttca

SEQ ID NO: 94475 - DNA, 25 bp, Homo sapien
catccctgagaaaggtcaaagttac

SEQ ID NO: 94476 - DNA, 25 bp, Homo sapien
gctacatgagtgcatttatctttta

SEQ ID NO: 94477 - DNA, 25 bp, Homo sapien
aatgcttggcaatgttaaatgtatt

SEQ ID NO: 94478 - DNA, 25 bp, Homo sapien
gaatctctgttctaatgtgccatgt

SEQ ID NO: 94479 - DNA, 25 bp, Homo sapien
aatgtgccatgttgcagtgatctga

SEQ ID NO: 94480 - DNA, 25 bp, Homo sapien
aaaaatgtatatggctctttctatc

SEQ ID NO: 94481 - DNA, 25 bp, Homo sapien
ggctctttctatccatgcagtgata

SEQ ID NO: 94482 - DNA, 25 bp, Homo sapien
tccatgcagtgatagtgagtgtaaa

SEQ ID NO: 94483 - DNA, 25 bp, Homo sapien
tgcttacttcactattgaacactat

SEQ ID NO: 94484 - DNA, 25 bp, Homo sapien
attctgttcactatctggagtaaat

SEQ ID NO: 94485 - DNA, 25 bp, Homo sapien
gcacttgcacggataggagagctga

SEQ ID NO: 94486 - DNA, 25 bp, Homo sapien
ataactgctggtttcacaaatgagg

SEQ ID NO: 94487 - DNA, 25 bp, Homo sapien
aggaggcagaaaattccacttaatt

SEQ ID NO: 94488 - DNA, 25 bp, Homo sapien
aacaacttggattactgagctacag

SEQ ID NO: 94489 - DNA, 25 bp, Homo sapien
agctacagaacacccagactcatag

SEQ ID NO: 94490 - DNA, 25 bp, Homo sapien
tgggacttccaggtcttaccttacg

SEQ ID NO: 94491 - DNA, 25 bp, Homo sapien
ggtcttaccttacgagtgggtcaca

SEQ ID NO: 94492 - DNA, 25 bp, Homo sapien
gagtgggtcacaacactgacaaagg

SEQ ID NO: 94493 - DNA, 25 bp, Homo sapien
gggacaatatccattagccattatc

SEQ ID NO: 94494 - DNA, 25 bp, Homo sapien
agccattatcttgctgcgtatgaat

SEQ ID NO: 94495 - DNA, 25 bp, Homo sapien
gtatgaataaccctctctcacaaaa

SEQ ID NO: 94496 - DNA, 25 bp, Homo sapien
tcacaggatcagactctatgagagg

SEQ ID NO: 94497 - DNA, 25 bp, Homo sapien
ggaggactacagaggccagatgata

SEQ ID NO: 94498 - DNA, 25 bp, Homo sapien
atgatagagttcactgaggactgct

SEQ ID NO: 94499 - DNA, 25 bp, Homo sapien
cgcttccgcttcaatgaaatccact

SEQ ID NO: 94500 - DNA, 25 bp, Homo sapien
aatgaaatccactccctcaacgtgc

SEQ ID NO: 94501 - DNA, 25 bp, Homo sapien
tctacgagctgtccaactaccgagg

SEQ ID NO: 94502 - DNA, 25 bp, Homo sapien
tgtccaactaccgaggacggcagta

SEQ ID NO: 94503 - DNA, 25 bp, Homo sapien
gactataggcgctaccaggactggg

SEQ ID NO: 94504 - DNA, 25 bp, Homo sapien
acgaatgccagagtgggctctctga

SEQ ID NO: 94505 - DNA, 25 bp, Homo sapien
gagagtcatagatttctcctgaaat

SEQ ID NO: 94506 - DNA, 25 bp, Homo sapien
tctcctgaaatatgtcctcctttgt

SEQ ID NO: 94507 - DNA, 25 bp, Homo sapien
tttgcagccatatgtgtcatgtaga

SEQ ID NO: 94508 - DNA, 25 bp, Homo sapien
catgtagaagatgcctagccctggg

SEQ ID NO: 94509 - DNA, 25 bp, Homo sapien
gggaccttgtgaaatacgcaggaac

SEQ ID NO: 94510 - DNA, 25 bp, Homo sapien
tacgcaggaaccagggataccatct

SEQ ID NO: 94511 - DNA, 25 bp, Homo sapien
gataccatctggtccagtggttttt

SEQ ID NO: 94512 - DNA, 25 bp, Homo sapien
aaacaaagctgcttagcacctggaa

SEQ ID NO: 94513 - DNA, 25 bp, Homo sapien
ttagcacctggaattccctggtcag

SEQ ID NO: 94514 - DNA, 25 bp, Homo sapien
gggcattgcagcttggaatctattt

SEQ ID NO: 94515 - DNA, 25 bp, Homo sapien
ggaatctattttatgtcaccagttg

SEQ ID NO: 94516 - DNA, 25 bp, Homo sapien
atgtcaccagttggtcctcatcaaa

SEQ ID NO: 94517 - DNA, 25 bp, Homo sapien
ttccttaggagtgcagagggctcat

SEQ ID NO: 94518 - DNA, 25 bp, Homo sapien
gatcttaatattcatgaccactggc

SEQ ID NO: 94519 - DNA, 25 bp, Homo sapien
cttaatattcatgaccactggccag

SEQ ID NO: 94520 - DNA, 25 bp, Homo sapien
ttaatattcatgaccactggccagg

SEQ ID NO: 94521 - DNA, 25 bp, Homo sapien
aatattcatgaccactggccaggcg

SEQ ID NO: 94522 - DNA, 25 bp, Homo sapien
atattcatgaccactggccaggcga

SEQ ID NO: 94523 - DNA, 25 bp, Homo sapien
tattcatgaccactggccaggcgag

SEQ ID NO: 94524 - DNA, 25 bp, Homo sapien
attcatgaccactggccaggcgagg

SEQ ID NO: 94525 - DNA, 25 bp, Homo sapien
ttcatgaccactggccaggcgaggt

SEQ ID NO: 94526 - DNA, 25 bp, Homo sapien
aaaatagaagcattagccgagcctg

SEQ ID NO: 94527 - DNA, 25 bp, Homo sapien
aaatagaagcattagccgagcctgg

SEQ ID NO: 94528 - DNA, 25 bp, Homo sapien
atagaagcattagccgagcctggtg

SEQ ID NO: 94529 - DNA, 25 bp, Homo sapien
gcagcccctacatcagaagcttgct

SEQ ID NO: 94530 - DNA, 25 bp, Homo sapien
agcccctacatcagaagcttgctct

SEQ ID NO: 94531 - DNA, 25 bp, Homo sapien
cccctacatcagaagcttgctcttg

SEQ ID NO: 94532 - DNA, 25 bp, Homo sapien
ccctacatcagaagcttgctcttgg

SEQ ID NO: 94533 - DNA, 25 bp, Homo sapien
cctacatcagaagcttgctcttggc

SEQ ID NO: 94534 - DNA, 25 bp, Homo sapien
ctacatcagaagcttgctcttggcg

SEQ ID NO: 94535 - DNA, 25 bp, Homo sapien
tacatcagaagcttgctcttggcgc

SEQ ID NO: 94536 - DNA, 25 bp, Homo sapien
acatcagaagcttgctcttggcgca

SEQ ID NO: 94537 - DNA, 25 bp, Homo sapien
tcagaagcttgctcttggcgcagtg

SEQ ID NO: 94538 - DNA, 25 bp, Homo sapien
agaagcttgctcttggcgcagtggc

SEQ ID NO: 94539 - DNA, 25 bp, Homo sapien
gaagcttgctcttggcgcagtggct

SEQ ID NO: 94540 - DNA, 25 bp, Homo sapien
catggtggtggcacccatctgtagt

SEQ ID NO: 94541 - DNA, 25 bp, Homo sapien
agcctgagggggatgttgccgtgag

SEQ ID NO: 94542 - DNA, 25 bp, Homo sapien
tgccgtgagccaagagcttgtgact

SEQ ID NO: 94543 - DNA, 25 bp, Homo sapien
gccgtgagccaagagcttgtgactg

SEQ ID NO: 94544 - DNA, 25 bp, Homo sapien
ccgtgagccaagagcttgtgactgg

SEQ ID NO: 94545 - DNA, 25 bp, Homo sapien
cgtgagccaagagcttgtgactgga

SEQ ID NO: 94546 - DNA, 25 bp, Homo sapien
gtgagccaagagcttgtgactggac

SEQ ID NO: 94547 - DNA, 25 bp, Homo sapien
tgagccaagagcttgtgactggact

SEQ ID NO: 94548 - DNA, 25 bp, Homo sapien
gagccaagagcttgtgactggactc

SEQ ID NO: 94549 - DNA, 25 bp, Homo sapien
agccaagagcttgtgactggactcc

SEQ ID NO: 94550 - DNA, 25 bp, Homo sapien
gtgagtggtccagagctttaagcta

SEQ ID NO: 94551 - DNA, 25 bp, Homo sapien
tacttttccagtagtttgccacttt

SEQ ID NO: 94552 - DNA, 25 bp, Homo sapien
tagtttgccactttctccgaggtag

SEQ ID NO: 94553 - DNA, 25 bp, Homo sapien
actttctccgaggtagtttggctgc

SEQ ID NO: 94554 - DNA, 25 bp, Homo sapien
tttggctgctctttcagtgatgcta

SEQ ID NO: 94555 - DNA, 25 bp, Homo sapien
tcagtgatgctaattgtgtgtcaaa

SEQ ID NO: 94556 - DNA, 25 bp, Homo sapien
gtgtgtcaaattttgtctacaacag

SEQ ID NO: 94557 - DNA, 25 bp, Homo sapien
aagttggttgaatgtctccagcact

SEQ ID NO: 94558 - DNA, 25 bp, Homo sapien
ttgaatgtctccagcactatgcatc

SEQ ID NO: 94559 - DNA, 25 bp, Homo sapien
atgcatccctattttctatttattg

SEQ ID NO: 94560 - DNA, 25 bp, Homo sapien
ttgtgtacactcactttcagtaatg

SEQ ID NO: 94561 - DNA, 25 bp, Homo sapien
gtgtgtcggctccagcagtaaccgt

SEQ ID NO: 94562 - DNA, 25 bp, Homo sapien
gccacgcactcctctgtagatgtgt

SEQ ID NO: 94563 - DNA, 25 bp, Homo sapien
actcctctgtagatgtgtgcccagt

SEQ ID NO: 94564 - DNA, 25 bp, Homo sapien
tgtgcccagtgggagttccttccag

SEQ ID NO: 94565 - DNA, 25 bp, Homo sapien
gagtgccaggtgcatccaagacttt

SEQ ID NO: 94566 - DNA, 25 bp, Homo sapien
tcccttccagaaggcactgactgaa

SEQ ID NO: 94567 - DNA, 25 bp, Homo sapien
atggatcatgcggagccggctgaaa

SEQ ID NO: 94568 - DNA, 25 bp, Homo sapien
gagccggctgaaatgctccaacttt

SEQ ID NO: 94569 - DNA, 25 bp, Homo sapien
ctttttcaaagtgtgggtggtccag

SEQ ID NO: 94570 - DNA, 25 bp, Homo sapien
ggtccagtttggactgatgggaatc

SEQ ID NO: 94571 - DNA, 25 bp, Homo sapien
gatgggaatcttcttgtcattcttt

SEQ ID NO: 94572 - DNA, 25 bp, Homo sapien
agcagttatggacagcactttccat

SEQ ID NO: 94573 - DNA, 25 bp, Homo sapien
agcactttccatgtggtgcttccga

SEQ ID NO: 94574 - DNA, 25 bp, Homo sapien
tccgaccctggctgtcagagtgaaa

SEQ ID NO: 94575 - DNA, 25 bp, Homo sapien
gctctgtacagttttgccatttcac

SEQ ID NO: 94576 - DNA, 25 bp, Homo sapien
gccatttcactgttctgctttaagc

SEQ ID NO: 94577 - DNA, 25 bp, Homo sapien
agcttagcttattagaactcttggt

SEQ ID NO: 94578 - DNA, 25 bp, Homo sapien
aactcttggtggagggtgcgtacac

SEQ ID NO: 94579 - DNA, 25 bp, Homo sapien
gagggtgcgtacacacattccagaa

SEQ ID NO: 94580 - DNA, 25 bp, Homo sapien
aaaaggcttcactcgctgggaacgt

SEQ ID NO: 94581 - DNA, 25 bp, Homo sapien
ggaacgtcaacccagcgagaaagga

SEQ ID NO: 94582 - DNA, 25 bp, Homo sapien
aaatgcacaatctttttcccattga

SEQ ID NO: 94583 - DNA, 25 bp, Homo sapien
gccttggggagcagtgttatgatac

SEQ ID NO: 94584 - DNA, 25 bp, Homo sapien
gttatgataccaaatggctaacatt

SEQ ID NO: 94585 - DNA, 25 bp, Homo sapien
aatggctaacattcatgacctcagt

SEQ ID NO: 94586 - DNA, 25 bp, Homo sapien
ggctaacattcatgacctcagtatc

SEQ ID NO: 94587 - DNA, 25 bp, Homo sapien
acattcatgacctcagtatcctgga

SEQ ID NO: 94588 - DNA, 25 bp, Homo sapien
catgacctcagtatcctggaagaaa

SEQ ID NO: 94589 - DNA, 25 bp, Homo sapien
gagaaagtgtgatgtagtaaaacca

SEQ ID NO: 94590 - DNA, 25 bp, Homo sapien
gaaacatttctcatatttggtgtaa

SEQ ID NO: 94591 - DNA, 25 bp, Homo sapien
gtttgaagaggttccatgagcccca

SEQ ID NO: 94592 - DNA, 25 bp, Homo sapien
gaagaggttccatgagccccagaca

SEQ ID NO: 94593 - DNA, 25 bp, Homo sapien
gttccatgagccccagacaggataa

SEQ ID NO: 94594 - DNA, 25 bp, Homo sapien
gtgggcaagttgattttgccacact

SEQ ID NO: 94595 - DNA, 25 bp, Homo sapien
tttgccacactgtagggcccaggtg

SEQ ID NO: 94596 - DNA, 25 bp, Homo sapien
aggtggtcccattgccaccgtgaag

SEQ ID NO: 94597 - DNA, 25 bp, Homo sapien
attgccaccgtgaagccaaattcta

SEQ ID NO: 94598 - DNA, 25 bp, Homo sapien
gaagccaaattctagcccaagtctg

SEQ ID NO: 94599 - DNA, 25 bp, Homo sapien
aattctagcccaagtctggtagagc

SEQ ID NO: 94600 - DNA, 25 bp, Homo sapien
ccaagtctggtagagcagtcgggca

SEQ ID NO: 94601 - DNA, 25 bp, Homo sapien
gacagaggacctcagtggcctatta

SEQ ID NO: 94602 - DNA, 25 bp, Homo sapien
agtggcctattacggagccctcttc

SEQ ID NO: 94603 - DNA, 25 bp, Homo sapien
agccctcttcccagactaaattcat

SEQ ID NO: 94604 - DNA, 25 bp, Homo sapien
actaaattcatagccgagagctcgg

SEQ ID NO: 94605 - DNA, 25 bp, Homo sapien
aataatgctaaacctgtcaatattt

SEQ ID NO: 94606 - DNA, 25 bp, Homo sapien
ttttccagtaacattaagcaccata

SEQ ID NO: 94607 - DNA, 25 bp, Homo sapien
taagcaccatactgcatgggagaga

SEQ ID NO: 94608 - DNA, 25 bp, Homo sapien
gtgagtgatatttctttcgtaatgc

SEQ ID NO: 94609 - DNA, 25 bp, Homo sapien
gatatttctttcgtaatgctataaa

SEQ ID NO: 94610 - DNA, 25 bp, Homo sapien
aaagatgtcctaaaagcatctgatc

SEQ ID NO: 94611 - DNA, 25 bp, Homo sapien
gcatctgatcccagtaataactaat

SEQ ID NO: 94612 - DNA, 25 bp, Homo sapien
aactaatggatgtcatctagagcag

SEQ ID NO: 94613 - DNA, 25 bp, Homo sapien
atctagagcagtgggtgttaatgaa

SEQ ID NO: 94614 - DNA, 25 bp, Homo sapien
aaatttctgtttgatatcctgcata

SEQ ID NO: 94615 - DNA, 25 bp, Homo sapien
gtttgatatcctgcatagaatttga

SEQ ID NO: 94616 - DNA, 25 bp, Homo sapien
ctttggatattatatgtttctggga

SEQ ID NO: 94617 - DNA, 25 bp, Homo sapien
aatacttcacctattgggatgccaa

SEQ ID NO: 94618 - DNA, 25 bp, Homo sapien
tctgttgtatttctataatgggttt

SEQ ID NO: 94619 - DNA, 25 bp, Homo sapien
gaagctcaagaacagatgtctattg

SEQ ID NO: 94620 - DNA, 25 bp, Homo sapien
gatgtctattgagtagaaccaagtt

SEQ ID NO: 94621 - DNA, 25 bp, Homo sapien
ataatgtttcccatagtgtttcttc

SEQ ID NO: 94622 - DNA, 25 bp, Homo sapien
gtttcccatagtgtttcttctataa

SEQ ID NO: 94623 - DNA, 25 bp, Homo sapien
gtttcttctataacttgacgttggt

SEQ ID NO: 94624 - DNA, 25 bp, Homo sapien
gacgttggtgagcttatatttccct

SEQ ID NO: 94625 - DNA, 25 bp, Homo sapien
ttatatttcccttggaagagagcat

SEQ ID NO: 94626 - DNA, 25 bp, Homo sapien
ccttggaagagagcatttgtggtac

SEQ ID NO: 94627 - DNA, 25 bp, Homo sapien
atgttggatggtaatttcttgatat

SEQ ID NO: 94628 - DNA, 25 bp, Homo sapien
ttatcatcattacatgacaggaatg

SEQ ID NO: 94629 - DNA, 25 bp, Homo sapien
gcagagtatgctgcacagtggtact

SEQ ID NO: 94630 - DNA, 25 bp, Homo sapien
tatgctgcacagtggtactctactt

SEQ ID NO: 94631 - DNA, 25 bp, Homo sapien
gcacagtggtactctacttgtcaag

SEQ ID NO: 94632 - DNA, 25 bp, Homo sapien
agtggtactctacttgtcaagactc

SEQ ID NO: 94633 - DNA, 25 bp, Homo sapien
ctacttgtcaagactctaggttgta

SEQ ID NO: 94634 - DNA, 25 bp, Homo sapien
gtcaagactctaggttgtaaatgaa

SEQ ID NO: 94635 - DNA, 25 bp, Homo sapien
aaggcctaaattacaaagagctatt

SEQ ID NO: 94636 - DNA, 25 bp, Homo sapien
gaaagggcaaggagtgaatctgaat

SEQ ID NO: 94637 - DNA, 25 bp, Homo sapien
aaaagagctatcatgatgccaaaaa

SEQ ID NO: 94638 - DNA, 25 bp, Homo sapien
gtgcattagtctgaagagtatacat

SEQ ID NO: 94639 - DNA, 25 bp, Homo sapien
tttgtttctccaaatctttccgcct

SEQ ID NO: 94640 - DNA, 25 bp, Homo sapien
aatctttccgccttatttagcttga

SEQ ID NO: 94641 - DNA, 25 bp, Homo sapien
ccgccttatttagcttgagatcttt

SEQ ID NO: 94642 - DNA, 25 bp, Homo sapien
tgagatctttgcagcttggttcatg

SEQ ID NO: 94643 - DNA, 25 bp, Homo sapien
ttggttcatggattctagccttgcc

SEQ ID NO: 94644 - DNA, 25 bp, Homo sapien
atggattctagccttgcccgttgcg

SEQ ID NO: 94645 - DNA, 25 bp, Homo sapien
ttgcccgttgcgcagtatatactga

SEQ ID NO: 94646 - DNA, 25 bp, Homo sapien
atactgatccagatgataaaccagt

SEQ ID NO: 94647 - DNA, 25 bp, Homo sapien
gaactatgtcaaaagcactctcaat

SEQ ID NO: 94648 - DNA, 25 bp, Homo sapien
aagcactctcaatattacatttgac

SEQ ID NO: 94649 - DNA, 25 bp, Homo sapien
tggagcggaacaacggctccctgga

SEQ ID NO: 94650 - DNA, 25 bp, Homo sapien
acatgtccaagagccttctaaagat

SEQ ID NO: 94651 - DNA, 25 bp, Homo sapien
tgtccaagagccttctaaagattct

SEQ ID NO: 94652 - DNA, 25 bp, Homo sapien
gagccttctaaagattctgggcaag

SEQ ID NO: 94653 - DNA, 25 bp, Homo sapien
aggaagaagtgacagctccggccct

SEQ ID NO: 94654 - DNA, 25 bp, Homo sapien
gaagaagtgacagctccggccctga

SEQ ID NO: 94655 - DNA, 25 bp, Homo sapien
agaagtgacagctccggccctgatc

SEQ ID NO: 94656 - DNA, 25 bp, Homo sapien
gctccggccctgatccaggactgca

SEQ ID NO: 94657 - DNA, 25 bp, Homo sapien
tcacttcgccttacaggtctccatt

SEQ ID NO: 94658 - DNA, 25 bp, Homo sapien
cttcgccttacaggtctccattttg

SEQ ID NO: 94659 - DNA, 25 bp, Homo sapien
gccttacaggtctccattttgtggt

SEQ ID NO: 94660 - DNA, 25 bp, Homo sapien
cggctgtacgagagggaagaccaca

SEQ ID NO: 94661 - DNA, 25 bp, Homo sapien
ggaagaccacaaaggcctcatgatg

SEQ ID NO: 94662 - DNA, 25 bp, Homo sapien
accacaaaggcctcatgatggagct

SEQ ID NO: 94663 - DNA, 25 bp, Homo sapien
agctgagtgaagactgccccagcat

SEQ ID NO: 94664 - DNA, 25 bp, Homo sapien
agatccgttccctccacgtgctgga

SEQ ID NO: 94665 - DNA, 25 bp, Homo sapien
aatacctgctgaggccccaagagta

SEQ ID NO: 94666 - DNA, 25 bp, Homo sapien
ccccaagagtacaggcggtgccagg

SEQ ID NO: 94667 - DNA, 25 bp, Homo sapien
ccatggatgctaaggcaggctcttt

SEQ ID NO: 94668 - DNA, 25 bp, Homo sapien
gatgctaaggcaggctctttgcgga

SEQ ID NO: 94669 - DNA, 25 bp, Homo sapien
cggagagtggtggatttgtattaaa

SEQ ID NO: 94670 - DNA, 25 bp, Homo sapien
agcttaacactaccaatttcccatt

SEQ ID NO: 94671 - DNA, 25 bp, Homo sapien
aaagtggacagcacttcatcctgga

SEQ ID NO: 94672 - DNA, 25 bp, Homo sapien
aacagggatgtgaccatgttcttcc

SEQ ID NO: 94673 - DNA, 25 bp, Homo sapien
agggatgtgaccatgttcttccaga

SEQ ID NO: 94674 - DNA, 25 bp, Homo sapien
gatgtgaccatgttcttccagaaga

SEQ ID NO: 94675 - DNA, 25 bp, Homo sapien
gattgtaagatgtggcttgaagaat

SEQ ID NO: 94676 - DNA, 25 bp, Homo sapien
aagaatttttgatgtactgggaaca

SEQ ID NO: 94677 - DNA, 25 bp, Homo sapien
tgatgtactgggaacaaatgctgga

SEQ ID NO: 94678 - DNA, 25 bp, Homo sapien
atgctggatccaacaaaaccaccct

SEQ ID NO: 94679 - DNA, 25 bp, Homo sapien
ctggagccttctcatcatcttcctc

SEQ ID NO: 94680 - DNA, 25 bp, Homo sapien
cctctgcttcattctagctggcaga

SEQ ID NO: 94681 - DNA, 25 bp, Homo sapien
ctgcttcattctagctggcagatga

SEQ ID NO: 94682 - DNA, 25 bp, Homo sapien
tagaggaagcaggagtagacacaat

SEQ ID NO: 94683 - DNA, 25 bp, Homo sapien
aggagtagacacaatgagagcacat

SEQ ID NO: 94684 - DNA, 25 bp, Homo sapien
agagcacattagaaacaggcacaat

SEQ ID NO: 94685 - DNA, 25 bp, Homo sapien
aacaggcacaatcacagatggaagc

SEQ ID NO: 94686 - DNA, 25 bp, Homo sapien
gccccaaggaggaattgcctcgggt

SEQ ID NO: 94687 - DNA, 25 bp, Homo sapien
agacttcccagctaaggcttggagc

SEQ ID NO: 94688 - DNA, 25 bp, Homo sapien
tggagcacaggtaggagttcatttg

SEQ ID NO: 94689 - DNA, 25 bp, Homo sapien
ggagttcatttggtgctaatagtag

SEQ ID NO: 94690 - DNA, 25 bp, Homo sapien
tagtagaagtcgtggccaggtgcag

SEQ ID NO: 94691 - DNA, 25 bp, Homo sapien
caagaccagcatggcttacatgcta

SEQ ID NO: 94692 - DNA, 25 bp, Homo sapien
gcttacatgctaaaacccagtctct

SEQ ID NO: 94693 - DNA, 25 bp, Homo sapien
tccccatcccggaaaacaggcagag

SEQ ID NO: 94694 - DNA, 25 bp, Homo sapien
ccatcccggaaaacaggcagagcac

SEQ ID NO: 94695 - DNA, 25 bp, Homo sapien
ttccaggaaagaggccgccctggcg

SEQ ID NO: 94696 - DNA, 25 bp, Homo sapien
ctggcgctggactcaatgaccataa

SEQ ID NO: 94697 - DNA, 25 bp, Homo sapien
ggcgctggactcaatgaccataaaa

SEQ ID NO: 94698 - DNA, 25 bp, Homo sapien
ggactcaatgaccataaaacagcct

SEQ ID NO: 94699 - DNA, 25 bp, Homo sapien
tcaatgaccataaaacagcctctta

SEQ ID NO: 94700 - DNA, 25 bp, Homo sapien
atgaccataaaacagcctcttaagc

SEQ ID NO: 94701 - DNA, 25 bp, Homo sapien
aaaacagcctcttaagctgggtgca

SEQ ID NO: 94702 - DNA, 25 bp, Homo sapien
aacagcctcttaagctgggtgcagc

SEQ ID NO: 94703 - DNA, 25 bp, Homo sapien
acagcctcttaagctgggtgcagcg

SEQ ID NO: 94704 - DNA, 25 bp, Homo sapien
gcagaggttagaagtgctaagaagc

SEQ ID NO: 94705 - DNA, 25 bp, Homo sapien
cagaggttagaagtgctaagaagca

SEQ ID NO: 94706 - DNA, 25 bp, Homo sapien
agaggttagaagtgctaagaagcag

SEQ ID NO: 94707 - DNA, 25 bp, Homo sapien
gaggttagaagtgctaagaagcagg

SEQ ID NO: 94708 - DNA, 25 bp, Homo sapien
aggttagaagtgctaagaagcaggc

SEQ ID NO: 94709 - DNA, 25 bp, Homo sapien
gctaagaagcaggccgagggtggtg

SEQ ID NO: 94710 - DNA, 25 bp, Homo sapien
ctaagaagcaggccgagggtggtgg

SEQ ID NO: 94711 - DNA, 25 bp, Homo sapien
taagaagcaggccgagggtggtggc

SEQ ID NO: 94712 - DNA, 25 bp, Homo sapien
aagaagcaggccgagggtggtggct

SEQ ID NO: 94713 - DNA, 25 bp, Homo sapien
agaagcaggccgagggtggtggctc

SEQ ID NO: 94714 - DNA, 25 bp, Homo sapien
gaagcaggccgagggtggtggctca

SEQ ID NO: 94715 - DNA, 25 bp, Homo sapien
tctcgcttctaacacagggcacctg

SEQ ID NO: 94716 - DNA, 25 bp, Homo sapien
ctcgcttctaacacagggcacctgc

SEQ ID NO: 94717 - DNA, 25 bp, Homo sapien
tcttcccaagcctcccgggactggg

SEQ ID NO: 94718 - DNA, 25 bp, Homo sapien
cccaagcctcccgggactgggacat

SEQ ID NO: 94719 - DNA, 25 bp, Homo sapien
caagcctcccgggactgggacatgt

SEQ ID NO: 94720 - DNA, 25 bp, Homo sapien
aagcctcccgggactgggacatgtt

SEQ ID NO: 94721 - DNA, 25 bp, Homo sapien
gactgggacatgtttgcaataaagg

SEQ ID NO: 94722 - DNA, 25 bp, Homo sapien
actgggacatgtttgcaataaagga

SEQ ID NO: 94723 - DNA, 25 bp, Homo sapien
tgcgcctgtggaggcaccatgccag

SEQ ID NO: 94724 - DNA, 25 bp, Homo sapien
accatgccaggtgggtacctaggct

SEQ ID NO: 94725 - DNA, 25 bp, Homo sapien
ggacacaaaggccacccaggtcatc

SEQ ID NO: 94726 - DNA, 25 bp, Homo sapien
ctgaatgcacatggacaggtgggca

SEQ ID NO: 94727 - DNA, 25 bp, Homo sapien
agagcgcaccgaggagtctacttag

SEQ ID NO: 94728 - DNA, 25 bp, Homo sapien
tctacttaggactgtggctctctga

SEQ ID NO: 94729 - DNA, 25 bp, Homo sapien
tggctctctgatgggtttgtgctca

SEQ ID NO: 94730 - DNA, 25 bp, Homo sapien
atgggtttgtgctcagccttttaaa

SEQ ID NO: 94731 - DNA, 25 bp, Homo sapien
aggcagcaccacttgagatttccag

SEQ ID NO: 94732 - DNA, 25 bp, Homo sapien
gagatttccagaggacccagacctt

SEQ ID NO: 94733 - DNA, 25 bp, Homo sapien
ggacccagacctttgttcattctaa

SEQ ID NO: 94734 - DNA, 25 bp, Homo sapien
gagaatgtggacaacggttcatcct

SEQ ID NO: 94735 - DNA, 25 bp, Homo sapien
tggacaacggttcatcctggagcca

SEQ ID NO: 94736 - DNA, 25 bp, Homo sapien
caacggttcatcctggagccagaaa

SEQ ID NO: 94737 - DNA, 25 bp, Homo sapien
tgacaaggttgtggccatgtccttc

SEQ ID NO: 94738 - DNA, 25 bp, Homo sapien
atgtccttccattacttctcaatgg

SEQ ID NO: 94739 - DNA, 25 bp, Homo sapien
attacttctcaatgggagactgtat

SEQ ID NO: 94740 - DNA, 25 bp, Homo sapien
agactgtataggatggcttgaggac

SEQ ID NO: 94741 - DNA, 25 bp, Homo sapien
gatgggcatggacagcaccctggag

SEQ ID NO: 94742 - DNA, 25 bp, Homo sapien
cagcaccctggagccaagtgcagga

SEQ ID NO: 94743 - DNA, 25 bp, Homo sapien
aagtgcaggagcaccactcgccatg

SEQ ID NO: 94744 - DNA, 25 bp, Homo sapien
tcaggcacaacccaactcagggcca

SEQ ID NO: 94745 - DNA, 25 bp, Homo sapien
ttctcatttggctaagcatcaaaat

SEQ ID NO: 94746 - DNA, 25 bp, Homo sapien
aagcatcaaaatcacctagggagcc

SEQ ID NO: 94747 - DNA, 25 bp, Homo sapien
aaatcacctagggagccggtgcaaa

SEQ ID NO: 94748 - DNA, 25 bp, Homo sapien
gccggtgcaaaacaaaatatcccag

SEQ ID NO: 94749 - DNA, 25 bp, Homo sapien
gggccaggagtctgttcctaaatat

SEQ ID NO: 94750 - DNA, 25 bp, Homo sapien
gagtctgttcctaaatattccaggt

SEQ ID NO: 94751 - DNA, 25 bp, Homo sapien
attccaggtagttctggtgcaggta

SEQ ID NO: 94752 - DNA, 25 bp, Homo sapien
tggccctgagacagtatgttgggaa

SEQ ID NO: 94753 - DNA, 25 bp, Homo sapien
gtatgttgggaaatgctgacgtaaa

SEQ ID NO: 94754 - DNA, 25 bp, Homo sapien
tgctgacgtaaaggtatcagggccg

SEQ ID NO: 94755 - DNA, 25 bp, Homo sapien
agctgtttgagaggccaatgcagga

SEQ ID NO: 94756 - DNA, 25 bp, Homo sapien
gagttttgccaaccatgaacaacaa

SEQ ID NO: 94757 - DNA, 25 bp, Homo sapien
agttttgccaaccatgaacaacaac

SEQ ID NO: 94758 - DNA, 25 bp, Homo sapien
gttttgccaaccatgaacaacaaca

SEQ ID NO: 94759 - DNA, 25 bp, Homo sapien
ttttgccaaccatgaacaacaacaa

SEQ ID NO: 94760 - DNA, 25 bp, Homo sapien
tttgccaaccatgaacaacaacaac

SEQ ID NO: 94761 - DNA, 25 bp, Homo sapien
ttgccaaccatgaacaacaacaaca

SEQ ID NO: 94762 - DNA, 25 bp, Homo sapien
tgccaaccatgaacaacaacaacaa

SEQ ID NO: 94763 - DNA, 25 bp, Homo sapien
aaaagaaatagttggccgggtgcag

SEQ ID NO: 94764 - DNA, 25 bp, Homo sapien
gcgtggtaaagcacgcctgtactcc

SEQ ID NO: 94765 - DNA, 25 bp, Homo sapien
cgtggtaaagcacgcctgtactccc

SEQ ID NO: 94766 - DNA, 25 bp, Homo sapien
tggtaaagcacgcctgtactcccag

SEQ ID NO: 94767 - DNA, 25 bp, Homo sapien
tatgcacacttttaggtatccccag

SEQ ID NO: 94768 - DNA, 25 bp, Homo sapien
gtatccccagattagaatgtgttta

SEQ ID NO: 94769 - DNA, 25 bp, Homo sapien
tggagtatcactgactgtggcctct

SEQ ID NO: 94770 - DNA, 25 bp, Homo sapien
tggcctctctgacttcaagtgcttg

SEQ ID NO: 94771 - DNA, 25 bp, Homo sapien
gtgcttggtgtaattcacatgccat

SEQ ID NO: 94772 - DNA, 25 bp, Homo sapien
tgtgaagcctccttgtttctcccag

SEQ ID NO: 94773 - DNA, 25 bp, Homo sapien
actccattttgtgcgtgctttcact

SEQ ID NO: 94774 - DNA, 25 bp, Homo sapien
actctagcacttgccataccaaagg

SEQ ID NO: 94775 - DNA, 25 bp, Homo sapien
gggcaattatttatctacctatctg

SEQ ID NO: 94776 - DNA, 25 bp, Homo sapien
tatctacctatctgtatctccttgt

SEQ ID NO: 94777 - DNA, 25 bp, Homo sapien
ttgtgctccacaaaccaaagactgt

SEQ ID NO: 94778 - DNA, 25 bp, Homo sapien
tctcgcttctaacacagggcacctg

SEQ ID NO: 94779 - DNA, 25 bp, Homo sapien
atgttagggacgagttccagccctg

SEQ ID NO: 94780 - DNA, 25 bp, Homo sapien
tggaccctcagtggctgtcccatgg

SEQ ID NO: 94781 - DNA, 25 bp, Homo sapien
tgtcccatggctacatcctgtgggt

SEQ ID NO: 94782 - DNA, 25 bp, Homo sapien
ctcgacaggacagcaggacggtttg

SEQ ID NO: 94783 - DNA, 25 bp, Homo sapien
cggtttgttttcagtggaatcccat

SEQ ID NO: 94784 - DNA, 25 bp, Homo sapien
tttcagtggaatcccatccctgggt

SEQ ID NO: 94785 - DNA, 25 bp, Homo sapien
caagcctcccgggactgggacatgt

SEQ ID NO: 94786 - DNA, 25 bp, Homo sapien
aagcctcccgggactgggacatgtt

SEQ ID NO: 94787 - DNA, 25 bp, Homo sapien
gactgggacatgtttgcaataaagg

SEQ ID NO: 94788 - DNA, 25 bp, Homo sapien
actgggacatgtttgcaataaagga

SEQ ID NO: 94789 - DNA, 25 bp, Homo sapien
gccgggtgtggtggggtgcgcttgt

SEQ ID NO: 94790 - DNA, 25 bp, Homo sapien
ccgggtgtggtggggtgcgcttgta

SEQ ID NO: 94791 - DNA, 25 bp, Homo sapien
cgggtgtggtggggtgcgcttgtaa

SEQ ID NO: 94792 - DNA, 25 bp, Homo sapien
ggtgtggtggggtgcgcttgtaatc

SEQ ID NO: 94793 - DNA, 25 bp, Homo sapien
cagagcaagacaccgtcttaaaacc

SEQ ID NO: 94794 - DNA, 25 bp, Homo sapien
agagcaagacaccgtcttaaaacca

SEQ ID NO: 94795 - DNA, 25 bp, Homo sapien
gagcaagacaccgtcttaaaaccaa

SEQ ID NO: 94796 - DNA, 25 bp, Homo sapien
tgggaggtggaggccaagattgtac

SEQ ID NO: 94797 - DNA, 25 bp, Homo sapien
gggaggtggaggccaagattgtacc

SEQ ID NO: 94798 - DNA, 25 bp, Homo sapien
ggaggtggaggccaagattgtacca

SEQ ID NO: 94799 - DNA, 25 bp, Homo sapien
gtggaggccaagattgtaccactgt

SEQ ID NO: 94800 - DNA, 25 bp, Homo sapien
tggattgtcttctttttgtataatg

SEQ ID NO: 94801 - DNA, 25 bp, Homo sapien
ggattgtcttctttttgtataatga

SEQ ID NO: 94802 - DNA, 25 bp, Homo sapien
gattgtcttctttttgtataatgaa

SEQ ID NO: 94803 - DNA, 25 bp, Homo sapien
tctttttgtataatgaatggccgtt

SEQ ID NO: 94804 - DNA, 25 bp, Homo sapien
ctttttgtataatgaatggccgttt

SEQ ID NO: 94805 - DNA, 25 bp, Homo sapien
tttttgtataatgaatggccgtttg

SEQ ID NO: 94806 - DNA, 25 bp, Homo sapien
ttttgtataatgaatggccgtttgt

SEQ ID NO: 94807 - DNA, 25 bp, Homo sapien
tttgtataatgaatggccgtttgtt

SEQ ID NO: 94808 - DNA, 25 bp, Homo sapien
ttgtataatgaatggccgtttgttg

SEQ ID NO: 94809 - DNA, 25 bp, Homo sapien
tgtataatgaatggccgtttgttga

SEQ ID NO: 94810 - DNA, 25 bp, Homo sapien
tataatgaatggccgtttgttgatt

SEQ ID NO: 94811 - DNA, 25 bp, Homo sapien
tctttctctaaagcttgtttgatga

SEQ ID NO: 94812 - DNA, 25 bp, Homo sapien
ctttctctaaagcttgtttgatgaa

SEQ ID NO: 94813 - DNA, 25 bp, Homo sapien
ttctctaaagcttgtttgatgaaac

SEQ ID NO: 94814 - DNA, 25 bp, Homo sapien
tctaaagcttgtttgatgaaactgg

SEQ ID NO: 94815 - DNA, 25 bp, Homo sapien
ttgatgaaactggttggtcctttca

SEQ ID NO: 94816 - DNA, 25 bp, Homo sapien
tgatgaaactggttggtcctttcag

SEQ ID NO: 94817 - DNA, 25 bp, Homo sapien
gatgaaactggttggtcctttcagt

SEQ ID NO: 94818 - DNA, 25 bp, Homo sapien
atgaaactggttggtcctttcagtg

SEQ ID NO: 94819 - DNA, 25 bp, Homo sapien
tgaaactggttggtcctttcagtga

SEQ ID NO: 94820 - DNA, 25 bp, Homo sapien
gaaactggttggtcctttcagtgaa

SEQ ID NO: 94821 - DNA, 25 bp, Homo sapien
aactggttggtcctttcagtgaaca

SEQ ID NO: 94822 - DNA, 25 bp, Homo sapien
gaacagtgaacattcggactcgaga

SEQ ID NO: 94823 - DNA, 25 bp, Homo sapien
gactcgagataatcgtcgccttggg

SEQ ID NO: 94824 - DNA, 25 bp, Homo sapien
gagctacagaacacgagggtcccaa

SEQ ID NO: 94825 - DNA, 25 bp, Homo sapien
gagggtcccaaatgccgaagaaatt

SEQ ID NO: 94826 - DNA, 25 bp, Homo sapien
gccgaagaaattttctgagcctttg

SEQ ID NO: 94827 - DNA, 25 bp, Homo sapien
gaggcaaaaacctgcgagtgccatc

SEQ ID NO: 94828 - DNA, 25 bp, Homo sapien
gggagaccccaacccagctgacaat

SEQ ID NO: 94829 - DNA, 25 bp, Homo sapien
aacccagctgacaatgtggagcccc

SEQ ID NO: 94830 - DNA, 25 bp, Homo sapien
aacttcagaactgtgtggaggcaca

SEQ ID NO: 94831 - DNA, 25 bp, Homo sapien
actgtgtggaggcacatgtctgctc

SEQ ID NO: 94832 - DNA, 25 bp, Homo sapien
gcacatgtctgctctcctgaaaaga

SEQ ID NO: 94833 - DNA, 25 bp, Homo sapien
gattggtccattcacatcagcatca

SEQ ID NO: 94834 - DNA, 25 bp, Homo sapien
atcagcatcactttgttacctgtgc

SEQ ID NO: 94835 - DNA, 25 bp, Homo sapien
ttacctgtgcctgcctcaaagatgt

SEQ ID NO: 94836 - DNA, 25 bp, Homo sapien
tcaaagatgtgactactgggcaaga

SEQ ID NO: 94837 - DNA, 25 bp, Homo sapien
aggccatttacagcttcttcattga

SEQ ID NO: 94838 - DNA, 25 bp, Homo sapien
ttcttcattgaacactgtatctctt

SEQ ID NO: 94839 - DNA, 25 bp, Homo sapien
tggcacacaattcccaatttcacaa

SEQ ID NO: 94840 - DNA, 25 bp, Homo sapien
atttcacaaattcctcatgtctttg

SEQ ID NO: 94841 - DNA, 25 bp, Homo sapien
gcatcacttgcaaaaacgatctcaa

SEQ ID NO: 94842 - DNA, 25 bp, Homo sapien
aacgatctcaaaagtgtcagcctta

SEQ ID NO: 94843 - DNA, 25 bp, Homo sapien
gtgtcagccttagataaacgtcagc

SEQ ID NO: 94844 - DNA, 25 bp, Homo sapien
gtttcagaacaaattaactcttggc

SEQ ID NO: 94845 - DNA, 25 bp, Homo sapien
taactcttggcattatacgtctccc

SEQ ID NO: 94846 - DNA, 25 bp, Homo sapien
ttggcattatacgtctccctttttc

SEQ ID NO: 94847 - DNA, 25 bp, Homo sapien
tatacgtctccctttttctttacag

SEQ ID NO: 94848 - DNA, 25 bp, Homo sapien
gtacactttctgattttaacttcac

SEQ ID NO: 94849 - DNA, 25 bp, Homo sapien
acttcactaatgtaattactctctc

SEQ ID NO: 94850 - DNA, 25 bp, Homo sapien
gtaattactctctcaagaagctttt

SEQ ID NO: 94851 - DNA, 25 bp, Homo sapien
aagccaacatttgttctctcaccaa

SEQ ID NO: 94852 - DNA, 25 bp, Homo sapien
atttgttctctcaccaaaccccatg

SEQ ID NO: 94853 - DNA, 25 bp, Homo sapien
atcatgaagaaagctcagcataagt

SEQ ID NO: 94854 - DNA, 25 bp, Homo sapien
caaatactgcttataattttagagg

SEQ ID NO: 94855 - DNA, 25 bp, Homo sapien
ttttcactctattctgatgtttttt

SEQ ID NO: 94856 - DNA, 25 bp, Homo sapien
gatgttttttcagaatggcctgaac

SEQ ID NO: 94857 - DNA, 25 bp, Homo sapien
gaatggcctgaacatctgtggaata

SEQ ID NO: 94858 - DNA, 25 bp, Homo sapien
gaacatctgtggaataatttagcaa

SEQ ID NO: 94859 - DNA, 25 bp, Homo sapien
aatttagcaatgtttttcagttagc

SEQ ID NO: 94860 - DNA, 25 bp, Homo sapien
gcaatgtttttcagttagcaagtga

SEQ ID NO: 94861 - DNA, 25 bp, Homo sapien
gcaagtgaatattgaaccttaaata

SEQ ID NO: 94862 - DNA, 25 bp, Homo sapien
taagaagtgcttttaatgtgaacaa

SEQ ID NO: 94863 - DNA, 25 bp, Homo sapien
atgtgaacaaccttatatgactcca

SEQ ID NO: 94864 - DNA, 25 bp, Homo sapien
caaccttatatgactccactatttt

SEQ ID NO: 94865 - DNA, 25 bp, Homo sapien
aaaacttttatgctggctgggcgcg

SEQ ID NO: 94866 - DNA, 25 bp, Homo sapien
atgtttatgatttcatgaattctgc

SEQ ID NO: 94867 - DNA, 25 bp, Homo sapien
gaattctgcattttcaccaattgta

SEQ ID NO: 94868 - DNA, 25 bp, Homo sapien
gcattttcaccaattgtaattctta

SEQ ID NO: 94869 - DNA, 25 bp, Homo sapien
ttgcaataattttacctattttgct

SEQ ID NO: 94870 - DNA, 25 bp, Homo sapien
ttttgctaaatataagagtggctac

SEQ ID NO: 94871 - DNA, 25 bp, Homo sapien
aagagtggctacaaaatatgtttga

SEQ ID NO: 94872 - DNA, 25 bp, Homo sapien
tatgtttgaatgaatcctccctgtt

SEQ ID NO: 94873 - DNA, 25 bp, Homo sapien
tgaatgaatcctccctgtttaatgt

SEQ ID NO: 94874 - DNA, 25 bp, Homo sapien
gaatcctccctgtttaatgtttata

SEQ ID NO: 94875 - DNA, 25 bp, Homo sapien
tcctccctgtttaatgtttatataa

SEQ ID NO: 94876 - DNA, 25 bp, Homo sapien
tcttacctgtaagatttctctttat

SEQ ID NO: 94877 - DNA, 25 bp, Homo sapien
aagacagtcaaatgagatgaaacaa

SEQ ID NO: 94878 - DNA, 25 bp, Homo sapien
agacagtcaaatgagatgaaacaaa

SEQ ID NO: 94879 - DNA, 25 bp, Homo sapien
gacagtcaaatgagatgaaacaaaa

SEQ ID NO: 94880 - DNA, 25 bp, Homo sapien
tcaaatgagatgaaacaaaaaggcc

SEQ ID NO: 94881 - DNA, 25 bp, Homo sapien
caaatgagatgaaacaaaaaggcca

SEQ ID NO: 94882 - DNA, 25 bp, Homo sapien
aaatgagatgaaacaaaaaggccaa

SEQ ID NO: 94883 - DNA, 25 bp, Homo sapien
tgagatgaaacaaaaaggccaaaag

SEQ ID NO: 94884 - DNA, 25 bp, Homo sapien
gagatgaaacaaaaaggccaaaagg

SEQ ID NO: 94885 - DNA, 25 bp, Homo sapien
ggccaaaaggtagccgggtgtagtg

SEQ ID NO: 94886 - DNA, 25 bp, Homo sapien
gccaaaaggtagccgggtgtagtgg

SEQ ID NO: 94887 - DNA, 25 bp, Homo sapien
cagcatttgggaggctgatgtgggt

SEQ ID NO: 94888 - DNA, 25 bp, Homo sapien
acatagagtatgaggcactaaaaac

SEQ ID NO: 94889 - DNA, 25 bp, Homo sapien
attctcagcttacaaatttggagag

SEQ ID NO: 94890 - DNA, 25 bp, Homo sapien
gagaaagtggcaacaccttgagcaa

SEQ ID NO: 94891 - DNA, 25 bp, Homo sapien
gtggcaacaccttgagcaaaataat

SEQ ID NO: 94892 - DNA, 25 bp, Homo sapien
attcatagcaaccaagagtcaagag

SEQ ID NO: 94893 - DNA, 25 bp, Homo sapien
caagagagtgattaccagccaatta

SEQ ID NO: 94894 - DNA, 25 bp, Homo sapien
aaccatcgtggatgctttacatagc

SEQ ID NO: 94895 - DNA, 25 bp, Homo sapien
gctttacatagcaccagcggaaact

SEQ ID NO: 94896 - DNA, 25 bp, Homo sapien
cggaaactgagtttaagtccactga

SEQ ID NO: 94897 - DNA, 25 bp, Homo sapien
ttaagtccactgaaagtctctaagg

SEQ ID NO: 94898 - DNA, 25 bp, Homo sapien
gaaagtctctaaggaagtatcctct

SEQ ID NO: 94899 - DNA, 25 bp, Homo sapien
aaacacattcctaggtggagactta

SEQ ID NO: 94900 - DNA, 25 bp, Homo sapien
cagttagtgcacatgtgcacccaga

SEQ ID NO: 94901 - DNA, 25 bp, Homo sapien
tgcacccagaagaccactcaaaaca

SEQ ID NO: 94902 - DNA, 25 bp, Homo sapien
agaccactcaaaacatgcttacact

SEQ ID NO: 94903 - DNA, 25 bp, Homo sapien
tgcttacactaacacttctttccac

SEQ ID NO: 94904 - DNA, 25 bp, Homo sapien
ttccaccttcttatgaataatcgtg

SEQ ID NO: 94905 - DNA, 25 bp, Homo sapien
cagaaggagggtttctccagtaaca

SEQ ID NO: 94906 - DNA, 25 bp, Homo sapien
tgtctcactcttatgagcagcctgc

SEQ ID NO: 94907 - DNA, 25 bp, Homo sapien
ggaatctctttctcagaatgtaccg

SEQ ID NO: 94908 - DNA, 25 bp, Homo sapien
gaatgtaccgtctattctgcactta

SEQ ID NO: 94909 - DNA, 25 bp, Homo sapien
gtaccgtctattctgcacttaattt

SEQ ID NO: 94910 - DNA, 25 bp, Homo sapien
acatgtccaagagccttctaaagat

SEQ ID NO: 94911 - DNA, 25 bp, Homo sapien
tgtccaagagccttctaaagattct

SEQ ID NO: 94912 - DNA, 25 bp, Homo sapien
aggaagaagtgacagctccggccct

SEQ ID NO: 94913 - DNA, 25 bp, Homo sapien
gaagaagtgacagctccggccctga

SEQ ID NO: 94914 - DNA, 25 bp, Homo sapien
aagaagtgacagctccggccctgat

SEQ ID NO: 94915 - DNA, 25 bp, Homo sapien
agaagtgacagctccggccctgatc

SEQ ID NO: 94916 - DNA, 25 bp, Homo sapien
gaagtgacagctccggccctgatcc

SEQ ID NO: 94917 - DNA, 25 bp, Homo sapien
gctccggccctgatccaggactgca

SEQ ID NO: 94918 - DNA, 25 bp, Homo sapien
tcacttcgccttacaggtctccatt

SEQ ID NO: 94919 - DNA, 25 bp, Homo sapien
acttcgccttacaggtctccatttt

SEQ ID NO: 94920 - DNA, 25 bp, Homo sapien
cttcgccttacaggtctccattttg

SEQ ID NO: 94921 - DNA, 25 bp, Homo sapien
tggaaagctatccagctcagcctga

SEQ ID NO: 94922 - DNA, 25 bp, Homo sapien
gctcagcctgatgggtttcctagtt

SEQ ID NO: 94923 - DNA, 25 bp, Homo sapien
atgggtttcctagttatccttcagc

SEQ ID NO: 94924 - DNA, 25 bp, Homo sapien
tagttatccttcagcgccaggaaca

SEQ ID NO: 94925 - DNA, 25 bp, Homo sapien
aggaacaccattttctttgcaacca

SEQ ID NO: 94926 - DNA, 25 bp, Homo sapien
attttctttgcaaccaagcctgtcc

SEQ ID NO: 94927 - DNA, 25 bp, Homo sapien
gcaacatcagaattgcctgagaact

SEQ ID NO: 94928 - DNA, 25 bp, Homo sapien
gaactgcaatgaacaatctgacaaa

SEQ ID NO: 94929 - DNA, 25 bp, Homo sapien
aatctgacaaatgtgaagctggcca

SEQ ID NO: 94930 - DNA, 25 bp, Homo sapien
tgaagctggccaaaagtcggaaaat

SEQ ID NO: 94931 - DNA, 25 bp, Homo sapien
aagtgtgaacactcccctatgtaaa

SEQ ID NO: 94932 - DNA, 25 bp, Homo sapien
atatccttcacccattttttgaaga

SEQ ID NO: 94933 - DNA, 25 bp, Homo sapien
gtattataagcagctgtatcccctt

SEQ ID NO: 94934 - DNA, 25 bp, Homo sapien
taagcagctgtatcccctttgccat

SEQ ID NO: 94935 - DNA, 25 bp, Homo sapien
cccctttgccatggtgatagcagac

SEQ ID NO: 94936 - DNA, 25 bp, Homo sapien
gccatggtgatagcagaccattcac

SEQ ID NO: 94937 - DNA, 25 bp, Homo sapien
gaccattcacatgggagcttctggt

SEQ ID NO: 94938 - DNA, 25 bp, Homo sapien
atgggagcttctggtctctttgtaa

SEQ ID NO: 94939 - DNA, 25 bp, Homo sapien
gcttctggtctctttgtaataataa

SEQ ID NO: 94940 - DNA, 25 bp, Homo sapien
aataagagccacattaccagtactt

SEQ ID NO: 94941 - DNA, 25 bp, Homo sapien
gccacattaccagtacttagagtat

SEQ ID NO: 94942 - DNA, 25 bp, Homo sapien
aacacattgtatcattaaatcttca

SEQ ID NO: 94943 - DNA, 25 bp, Homo sapien
ggcgccctgtgaacctgatgggaac

SEQ ID NO: 94944 - DNA, 25 bp, Homo sapien
tctgtgacaccctccgtgttcttgc

SEQ ID NO: 94945 - DNA, 25 bp, Homo sapien
catcttctccgcttttgggatgaag

SEQ ID NO: 94946 - DNA, 25 bp, Homo sapien
agatgatagccagggctgttgtttt

SEQ ID NO: 94947 - DNA, 25 bp, Homo sapien
ttcaaggcaaaagaccaggctgact

SEQ ID NO: 94948 - DNA, 25 bp, Homo sapien
ggaagcggcacctgatggtgatctt

SEQ ID NO: 94949 - DNA, 25 bp, Homo sapien
tgatggtgatcttggcactctccat

SEQ ID NO: 94950 - DNA, 25 bp, Homo sapien
ggcactctccatgttctctacaaga

SEQ ID NO: 94951 - DNA, 25 bp, Homo sapien
ttctctacaagaagctgtggtgatt

SEQ ID NO: 94952 - DNA, 25 bp, Homo sapien
aggcgaaaaccacagattctccttc

SEQ ID NO: 94953 - DNA, 25 bp, Homo sapien
gaaaaccacagattctccttctagt

SEQ ID NO: 94954 - DNA, 25 bp, Homo sapien
gcaccagtgccctgcttgagaaccc

SEQ ID NO: 94955 - DNA, 25 bp, Homo sapien
ttgagaaccccgacacgggctctgt

SEQ ID NO: 94956 - DNA, 25 bp, Homo sapien
gagaaccccgacacgggctctgtgt

SEQ ID NO: 94957 - DNA, 25 bp, Homo sapien
gacacgggctctgtgtatgtgctgc

SEQ ID NO: 94958 - DNA, 25 bp, Homo sapien
cacgggctctgtgtatgtgctgcgt

SEQ ID NO: 94959 - DNA, 25 bp, Homo sapien
atgtgctgcgtgtccgcggctgcaa

SEQ ID NO: 94960 - DNA, 25 bp, Homo sapien
tccgcggctgcaacaaggccggcta

SEQ ID NO: 94961 - DNA, 25 bp, Homo sapien
aacaaggccggctacggcgaataca

SEQ ID NO: 94962 - DNA, 25 bp, Homo sapien
gccggctacggcgaatacagtgaag

SEQ ID NO: 94963 - DNA, 25 bp, Homo sapien
cggctacggcgaatacagtgaagat

SEQ ID NO: 94964 - DNA, 25 bp, Homo sapien
tacagtgaagatgtgcacctgcaca

SEQ ID NO: 94965 - DNA, 25 bp, Homo sapien
tctacctgccctacttcgagaagtg

SEQ ID NO: 94966 - DNA, 25 bp, Homo sapien
tacttcgagaagtgatcgcggcgca

SEQ ID NO: 94967 - DNA, 25 bp, Homo sapien
tgatcgcggcgcagcgtggacccct

SEQ ID NO: 94968 - DNA, 25 bp, Homo sapien
agcgtggaccccttgcgcccatggg

SEQ ID NO: 94969 - DNA, 25 bp, Homo sapien
gttcccctcatctcaagggaagagg

SEQ ID NO: 94970 - DNA, 25 bp, Homo sapien
gaagaggccctccaggaccctcgaa

SEQ ID NO: 94971 - DNA, 25 bp, Homo sapien
cagcccctagggagtttgctcagga

SEQ ID NO: 94972 - DNA, 25 bp, Homo sapien
tgctctgtgccttaacttattctcg

SEQ ID NO: 94973 - DNA, 25 bp, Homo sapien
cttaacttattctcgggccgtgcgg

SEQ ID NO: 94974 - DNA, 25 bp, Homo sapien
ccgtgcggctgctaggttgctgtta

SEQ ID NO: 94975 - DNA, 25 bp, Homo sapien
ggttgctgttattttgtgctaataa

SEQ ID NO: 94976 - DNA, 25 bp, Homo sapien
ttcccgcaggcatttgagctttgtg

SEQ ID NO: 94977 - DNA, 25 bp, Homo sapien
atgggaagatgttccacgctgcctc

SEQ ID NO: 94978 - DNA, 25 bp, Homo sapien
tcctcgagttttcctcggaaacact

SEQ ID NO: 94979 - DNA, 25 bp, Homo sapien
tttcctcggaaacacttttgaatgt

SEQ ID NO: 94980 - DNA, 25 bp, Homo sapien
ttgagtgagggtcctgcttagcttt

SEQ ID NO: 94981 - DNA, 25 bp, Homo sapien
tgcttagctttttggcctgtgagat

SEQ ID NO: 94982 - DNA, 25 bp, Homo sapien
tttggcctgtgagatgctttgaaaa

SEQ ID NO: 94983 - DNA, 25 bp, Homo sapien
gtttgtagcggtaattgcctcacat

SEQ ID NO: 94984 - DNA, 25 bp, Homo sapien
tcacattaaactgtcgccgactgca

SEQ ID NO: 94985 - DNA, 25 bp, Homo sapien
agtgactgctgaatgtaccctgtgt

SEQ ID NO: 94986 - DNA, 25 bp, Homo sapien
accctgtgtggcgacttggaatcaa

SEQ ID NO: 94987 - DNA, 25 bp, Homo sapien
cctatgagtgagaacgaaggcattt

SEQ ID NO: 94988 - DNA, 25 bp, Homo sapien
ctatgagtgagaacgaaggcatttc

SEQ ID NO: 94989 - DNA, 25 bp, Homo sapien
tatgagtgagaacgaaggcatttca

SEQ ID NO: 94990 - DNA, 25 bp, Homo sapien
atgagtgagaacgaaggcatttcat

SEQ ID NO: 94991 - DNA, 25 bp, Homo sapien
tgagtgagaacgaaggcatttcatt

SEQ ID NO: 94992 - DNA, 25 bp, Homo sapien
gagtgagaacgaaggcatttcattc

SEQ ID NO: 94993 - DNA, 25 bp, Homo sapien
agtgagaacgaaggcatttcattct

SEQ ID NO: 94994 - DNA, 25 bp, Homo sapien
aggcatttcattcttgatgatggtg

SEQ ID NO: 94995 - DNA, 25 bp, Homo sapien
atgatgttgatgacaattatattaa

SEQ ID NO: 94996 - DNA, 25 bp, Homo sapien
tgatgttgatgacaattatattaat

SEQ ID NO: 94997 - DNA, 25 bp, Homo sapien
gatgttgatgacaattatattaata

SEQ ID NO: 94998 - DNA, 25 bp, Homo sapien
agccatgccttgtcttttgttctca

SEQ ID NO: 94999 - DNA, 25 bp, Homo sapien
gccatgccttgtcttttgttctcat

SEQ ID NO: 95000 - DNA, 25 bp, Homo sapien
ccatgccttgtcttttgttctcata

SEQ ID NO: 95001 - DNA, 25 bp, Homo sapien
catgccttgtcttttgttctcataa

SEQ ID NO: 95002 - DNA, 25 bp, Homo sapien
atgccttgtcttttgttctcataaa

SEQ ID NO: 95003 - DNA, 25 bp, Homo sapien
tgccttgtcttttgttctcataaat

SEQ ID NO: 95004 - DNA, 25 bp, Homo sapien
gccttgtcttttgttctcataaata

SEQ ID NO: 95005 - DNA, 25 bp, Homo sapien
ccttgtcttttgttctcataaatag

SEQ ID NO: 95006 - DNA, 25 bp, Homo sapien
gtcttttgttctcataaatagtcac

SEQ ID NO: 95007 - DNA, 25 bp, Homo sapien
tttgttctcataaatagtcactggg

SEQ ID NO: 95008 - DNA, 25 bp, Homo sapien
ctcataaatagtcactggggccggg

SEQ ID NO: 95009 - DNA, 25 bp, Homo sapien
aggtggtggccgctgctctatcccc

SEQ ID NO: 95010 - DNA, 25 bp, Homo sapien
ggaacccaagggtgaaactgagagt

SEQ ID NO: 95011 - DNA, 25 bp, Homo sapien
gtcagaaagtctcagtctcaaggca

SEQ ID NO: 95012 - DNA, 25 bp, Homo sapien
tctcttcgctccacaggtctataaa

SEQ ID NO: 95013 - DNA, 25 bp, Homo sapien
cacaggtctataaatgggccacagt

SEQ ID NO: 95014 - DNA, 25 bp, Homo sapien
taaatgggccacagtaggcacccct

SEQ ID NO: 95015 - DNA, 25 bp, Homo sapien
cagtaggcacccctttttaaatctg

SEQ ID NO: 95016 - DNA, 25 bp, Homo sapien
atccccaaatccattaaaagtgact

SEQ ID NO: 95017 - DNA, 25 bp, Homo sapien
aaaagtgacttcagaggtcccagat

SEQ ID NO: 95018 - DNA, 25 bp, Homo sapien
tgacttcagaggtcccagataggga

SEQ ID NO: 95019 - DNA, 25 bp, Homo sapien
cccagatagggaccaacatttgttt

SEQ ID NO: 95020 - DNA, 25 bp, Homo sapien
tactgcattcaagctggggcagcag

SEQ ID NO: 95021 - DNA, 25 bp, Homo sapien
actgcattcaagctggggcagcaga

SEQ ID NO: 95022 - DNA, 25 bp, Homo sapien
tgcattcaagctggggcagcagagt

SEQ ID NO: 95023 - DNA, 25 bp, Homo sapien
cattcaagctggggcagcagagtga

SEQ ID NO: 95024 - DNA, 25 bp, Homo sapien
attcaagctggggcagcagagtgag

SEQ ID NO: 95025 - DNA, 25 bp, Homo sapien
aggttgcagtgttcgcgcaattgca

SEQ ID NO: 95026 - DNA, 25 bp, Homo sapien
ggttgcagtgttcgcgcaattgcac

SEQ ID NO: 95027 - DNA, 25 bp, Homo sapien
gttgcagtgttcgcgcaattgcact

SEQ ID NO: 95028 - DNA, 25 bp, Homo sapien
ttgcagtgttcgcgcaattgcactc

SEQ ID NO: 95029 - DNA, 25 bp, Homo sapien
tgcagtgttcgcgcaattgcactcc

SEQ ID NO: 95030 - DNA, 25 bp, Homo sapien
gcagtgttcgcgcaattgcactcca

SEQ ID NO: 95031 - DNA, 25 bp, Homo sapien
ctgggatcgctgcagccatgttttc

SEQ ID NO: 95032 - DNA, 25 bp, Homo sapien
gatcgctgcagccatgttttcccgg

SEQ ID NO: 95033 - DNA, 25 bp, Homo sapien
tgcagccatgttttcccggccatgc

SEQ ID NO: 95034 - DNA, 25 bp, Homo sapien
tttcccggccatgccggcgttgtaa

SEQ ID NO: 95035 - DNA, 25 bp, Homo sapien
cttgtaggaacagcctttctcgaat

SEQ ID NO: 95036 - DNA, 25 bp, Homo sapien
gtaggaacagcctttctcgaatctg

SEQ ID NO: 95037 - DNA, 25 bp, Homo sapien
ggaacagcctttctcgaatctgttt

SEQ ID NO: 95038 - DNA, 25 bp, Homo sapien
cagcctttctcgaatctgttttcag

SEQ ID NO: 95039 - DNA, 25 bp, Homo sapien
ctcgaatctgttttcagctcttgca

SEQ ID NO: 95040 - DNA, 25 bp, Homo sapien
tgttttcagctcttgcattgcatag

SEQ ID NO: 95041 - DNA, 25 bp, Homo sapien
gaacctcagcatgtaaagaactatt

SEQ ID NO: 95042 - DNA, 25 bp, Homo sapien
gtcttttgttctcataaatagtcac

SEQ ID NO: 95043 - DNA, 25 bp, Homo sapien
tcttttgttctcataaatagtcact

SEQ ID NO: 95044 - DNA, 25 bp, Homo sapien
cttttgttctcataaatagtcactg

SEQ ID NO: 95045 - DNA, 25 bp, Homo sapien
ttttgttctcataaatagtcactgg

SEQ ID NO: 95046 - DNA, 25 bp, Homo sapien
tttgttctcataaatagtcactggg

SEQ ID NO: 95047 - DNA, 25 bp, Homo sapien
ttgttctcataaatagtcactgggg

SEQ ID NO: 95048 - DNA, 25 bp, Homo sapien
tgttctcataaatagtcactggggc

SEQ ID NO: 95049 - DNA, 25 bp, Homo sapien
gttctcataaatagtcactggggcc

SEQ ID NO: 95050 - DNA, 25 bp, Homo sapien
ttctcataaatagtcactggggccg

SEQ ID NO: 95051 - DNA, 25 bp, Homo sapien
tctcataaatagtcactggggccgg

SEQ ID NO: 95052 - DNA, 25 bp, Homo sapien
ctcataaatagtcactggggccggg

SEQ ID NO: 95053 - DNA, 25 bp, Homo sapien
ttggtctttccctgaggatctagga

SEQ ID NO: 95054 - DNA, 25 bp, Homo sapien
tgaggatctaggactttgggcccct

SEQ ID NO: 95055 - DNA, 25 bp, Homo sapien
tctgtgctacctccaaggaatcagt

SEQ ID NO: 95056 - DNA, 25 bp, Homo sapien
ctccaaggaatcagtcacctctgtt

SEQ ID NO: 95057 - DNA, 25 bp, Homo sapien
acctctgttctgctgagtctggaga

SEQ ID NO: 95058 - DNA, 25 bp, Homo sapien
gcatacacagtgctagagtacagaa

SEQ ID NO: 95059 - DNA, 25 bp, Homo sapien
gtacagaatgcagtaagtgatccat

SEQ ID NO: 95060 - DNA, 25 bp, Homo sapien
gagagcaaggtaccgcatgatcaga

SEQ ID NO: 95061 - DNA, 25 bp, Homo sapien
agagagaactagtgctaccgccttg

SEQ ID NO: 95062 - DNA, 25 bp, Homo sapien
ccgccttgcttgtctagtacattaa

SEQ ID NO: 95063 - DNA, 25 bp, Homo sapien
aaaacttacaagtcatgttcacaaa

SEQ ID NO: 95064 - DNA, 25 bp, Homo sapien
tctgtccagagtttggctatgaggc

SEQ ID NO: 95065 - DNA, 25 bp, Homo sapien
tccagagtttggctatgaggctact

SEQ ID NO: 95066 - DNA, 25 bp, Homo sapien
gtttggctatgaggctactgagtat

SEQ ID NO: 95067 - DNA, 25 bp, Homo sapien
ggctatgaggctactgagtatgcca

SEQ ID NO: 95068 - DNA, 25 bp, Homo sapien
gctactgagtatgccaggagcccag

SEQ ID NO: 95069 - DNA, 25 bp, Homo sapien
agagggacagcccaaggtccaccga

SEQ ID NO: 95070 - DNA, 25 bp, Homo sapien
agggacagcccaaggtccaccgagc

SEQ ID NO: 95071 - DNA, 25 bp, Homo sapien
cgcaaaaccatgtccaaaccaggaa

SEQ ID NO: 95072 - DNA, 25 bp, Homo sapien
aaccatgtccaaaccaggaaatgga

SEQ ID NO: 95073 - DNA, 25 bp, Homo sapien
aaatggacagcataccaagacccca

SEQ ID NO: 95074 - DNA, 25 bp, Homo sapien
ctgtaatcccgtactttctggggag

SEQ ID NO: 95075 - DNA, 25 bp, Homo sapien
aggcgtctcctgtcaatccgtcctg

SEQ ID NO: 95076 - DNA, 25 bp, Homo sapien
agcagctgccacctggaagttctcc

SEQ ID NO: 95077 - DNA, 25 bp, Homo sapien
ctgccacctggaagttctccttcaa

SEQ ID NO: 95078 - DNA, 25 bp, Homo sapien
tccttcaagtctaacctaaggccgc

SEQ ID NO: 95079 - DNA, 25 bp, Homo sapien
agtctaacctaaggccgccctgtga

SEQ ID NO: 95080 - DNA, 25 bp, Homo sapien
ccctgtgacggctctcgggtcagtt

SEQ ID NO: 95081 - DNA, 25 bp, Homo sapien
gctctcgggtcagttccttctgtga

SEQ ID NO: 95082 - DNA, 25 bp, Homo sapien
cttctgtgacctcggcaccgtggat

SEQ ID NO: 95083 - DNA, 25 bp, Homo sapien
accgtggatgcccatgaatgctgat

SEQ ID NO: 95084 - DNA, 25 bp, Homo sapien
ggatgcccatgaatgctgatctcgg

SEQ ID NO: 95085 - DNA, 25 bp, Homo sapien
atgaatgctgatctcggctgttccc

SEQ ID NO: 95086 - DNA, 25 bp, Homo sapien
gaaactgaaaactgtgcttaagatt

SEQ ID NO: 95087 - DNA, 25 bp, Homo sapien
aactgtgcttaagatttcacataga

SEQ ID NO: 95088 - DNA, 25 bp, Homo sapien
gtattgttattttgggctaagctgg

SEQ ID NO: 95089 - DNA, 25 bp, Homo sapien
gagacttgtctgagttagaactcta

SEQ ID NO: 95090 - DNA, 25 bp, Homo sapien
tatgtgtacatcattggaagtagcc

SEQ ID NO: 95091 - DNA, 25 bp, Homo sapien
tggaagtagcctaatccaaggtttt

SEQ ID NO: 95092 - DNA, 25 bp, Homo sapien
tatgagcctttaagattcaaatttg

SEQ ID NO: 95093 - DNA, 25 bp, Homo sapien
gattcaaatttgtactgagcatctt

SEQ ID NO: 95094 - DNA, 25 bp, Homo sapien
tgtactgagcatcttaaacccctaa

SEQ ID NO: 95095 - DNA, 25 bp, Homo sapien
ttaaacccctaaacaatgaaatgct

SEQ ID NO: 95096 - DNA, 25 bp, Homo sapien
aatgtcaatgttattagcctgatta

SEQ ID NO: 95097 - DNA, 25 bp, Homo sapien
agaaatgtgctcaaagtttacaagg

SEQ ID NO: 95098 - DNA, 25 bp, Homo sapien
gaaggaacatcagcggtagagaatt

SEQ ID NO: 95099 - DNA, 25 bp, Homo sapien
agtgcatgtggttccaaacagaatg

SEQ ID NO: 95100 - DNA, 25 bp, Homo sapien
ttccaaacagaatgtgcccaggctt

SEQ ID NO: 95101 - DNA, 25 bp, Homo sapien
atgtgcccaggcttataaagcaatg

SEQ ID NO: 95102 - DNA, 25 bp, Homo sapien
gaagcacttaagaaatgtcatgaga

SEQ ID NO: 95103 - DNA, 25 bp, Homo sapien
atcactgatgaccagtttgactttc

SEQ ID NO: 95104 - DNA, 25 bp, Homo sapien
tgaggaagattacccttagatcata

SEQ ID NO: 95105 - DNA, 25 bp, Homo sapien
acccttagatcatatgtggacttat

SEQ ID NO: 95106 - DNA, 25 bp, Homo sapien
atgtacttcgacagcatccatttta

SEQ ID NO: 95107 - DNA, 25 bp, Homo sapien
agcatccattttacttcaaggcagc

SEQ ID NO: 95108 - DNA, 25 bp, Homo sapien
catctttttgtacaccaatgtgctt

SEQ ID NO: 95109 - DNA, 25 bp, Homo sapien
atctttttgtacaccaatgtgcttt

SEQ ID NO: 95110 - DNA, 25 bp, Homo sapien
tctttttgtacaccaatgtgctttt

SEQ ID NO: 95111 - DNA, 25 bp, Homo sapien
ctttttgtacaccaatgtgcttttg

SEQ ID NO: 95112 - DNA, 25 bp, Homo sapien
tttttgtacaccaatgtgcttttgt

SEQ ID NO: 95113 - DNA, 25 bp, Homo sapien
ttttgtacaccaatgtgcttttgtt

SEQ ID NO: 95114 - DNA, 25 bp, Homo sapien
aaagtcggtggtggctaggcgtggt

SEQ ID NO: 95115 - DNA, 25 bp, Homo sapien
aagtcggtggtggctaggcgtggtg

SEQ ID NO: 95116 - DNA, 25 bp, Homo sapien
agtcggtggtggctaggcgtggtgg

SEQ ID NO: 95117 - DNA, 25 bp, Homo sapien
atccattcttattcactcctttgcc

SEQ ID NO: 95118 - DNA, 25 bp, Homo sapien
tgcctcccaaatatgtctgtatgtt

SEQ ID NO: 95119 - DNA, 25 bp, Homo sapien
attttgatatcaggtcgcagacact

SEQ ID NO: 95120 - DNA, 25 bp, Homo sapien
caggtcgcagacactcaaaacatcc

SEQ ID NO: 95121 - DNA, 25 bp, Homo sapien
caaaacatccttcaccatgcaatta

SEQ ID NO: 95122 - DNA, 25 bp, Homo sapien
taaacggatttttctgtatggttct

SEQ ID NO: 95123 - DNA, 25 bp, Homo sapien
ggttctgtggcaagagatttcataa

SEQ ID NO: 95124 - DNA, 25 bp, Homo sapien
aatttctactgcacttacattcaac

SEQ ID NO: 95125 - DNA, 25 bp, Homo sapien
actgcacttacattcaacacttgat

SEQ ID NO: 95126 - DNA, 25 bp, Homo sapien
aacacttgatgattcactattatag

SEQ ID NO: 95127 - DNA, 25 bp, Homo sapien
atgcctcataacctcaatttttaag

SEQ ID NO: 95128 - DNA, 25 bp, Homo sapien
gcccaagccggtagatccgaggcct

SEQ ID NO: 95129 - DNA, 25 bp, Homo sapien
caagccggtagatccgaggcctcca

SEQ ID NO: 95130 - DNA, 25 bp, Homo sapien
aagccggtagatccgaggcctccag

SEQ ID NO: 95131 - DNA, 25 bp, Homo sapien
tagatccgaggcctccagcgccgcg

SEQ ID NO: 95132 - DNA, 25 bp, Homo sapien
ggcccttggccctgcgctgcaccag

SEQ ID NO: 95133 - DNA, 25 bp, Homo sapien
ccccagtgcaccagggccaccctag

SEQ ID NO: 95134 - DNA, 25 bp, Homo sapien
ctagcccgcgctgcgcatggtcccc

SEQ ID NO: 95135 - DNA, 25 bp, Homo sapien
accgccgcctcacagacaagacggg

SEQ ID NO: 95136 - DNA, 25 bp, Homo sapien
tcacagacaagacggggcgcccaag

SEQ ID NO: 95137 - DNA, 25 bp, Homo sapien
gccgcccgctttctggagaccttgg

SEQ ID NO: 95138 - DNA, 25 bp, Homo sapien
cgctttctggagaccttggccctga

SEQ ID NO: 95139 - DNA, 25 bp, Homo sapien
ctcaggatcttgaccttaggacttt

SEQ ID NO: 95140 - DNA, 25 bp, Homo sapien
ttaggactttcgtcaaccccagctt

SEQ ID NO: 95141 - DNA, 25 bp, Homo sapien
tctccagggctcacctggaactgaa

SEQ ID NO: 95142 - DNA, 25 bp, Homo sapien
cacctggaactgaatgagtcggcct

SEQ ID NO: 95143 - DNA, 25 bp, Homo sapien
gctggaggtcccagattcagcggcc

SEQ ID NO: 95144 - DNA, 25 bp, Homo sapien
tcagcggccccggattccgtggtga

SEQ ID NO: 95145 - DNA, 25 bp, Homo sapien
ccccggattccgtggtgatggtgac

SEQ ID NO: 95146 - DNA, 25 bp, Homo sapien
tcatgctttcctccggctcctggta

SEQ ID NO: 95147 - DNA, 25 bp, Homo sapien
agccccgcaggtgaggaactactac

SEQ ID NO: 95148 - DNA, 25 bp, Homo sapien
ggaactactactttccatcacaggg

SEQ ID NO: 95149 - DNA, 25 bp, Homo sapien
actttccatcacagggaccggcaca

SEQ ID NO: 95150 - DNA, 25 bp, Homo sapien
gccaagagccagttctctcgttcct

SEQ ID NO: 95151 - DNA, 25 bp, Homo sapien
tcctccaaagcccacaatcagaaga

SEQ ID NO: 95152 - DNA, 25 bp, Homo sapien
agtagctgatgcaacttccaccttg

SEQ ID NO: 95153 - DNA, 25 bp, Homo sapien
accttgctctcaggtggaacagagg

SEQ ID NO: 95154 - DNA, 25 bp, Homo sapien
gaggtattttgggtctctctagcct

SEQ ID NO: 95155 - DNA, 25 bp, Homo sapien
tgggtctctctagcctgaaatgtca

SEQ ID NO: 95156 - DNA, 25 bp, Homo sapien
gaaatgtcatcctcaactgctactg

SEQ ID NO: 95157 - DNA, 25 bp, Homo sapien
gtcatcctcaactgctactgagttt

SEQ ID NO: 95158 - DNA, 25 bp, Homo sapien
gtcttgacagacatcactgcattgc

SEQ ID NO: 95159 - DNA, 25 bp, Homo sapien
ttatcccagtgtttgaggtacaagt

SEQ ID NO: 95160 - DNA, 25 bp, Homo sapien
ggctgaccagcacctgtaacactga

SEQ ID NO: 95161 - DNA, 25 bp, Homo sapien
agccccgctgggtggattagtctta

SEQ ID NO: 95162 - DNA, 25 bp, Homo sapien
gtggattagtcttagctccctagag

SEQ ID NO: 95163 - DNA, 25 bp, Homo sapien
ttagtcttagctccctagagcctga

SEQ ID NO: 95164 - DNA, 25 bp, Homo sapien
tagagcctgagcctttggcctcgga

SEQ ID NO: 95165 - DNA, 25 bp, Homo sapien
tttggcctcggaggctcgggaccta

SEQ ID NO: 95166 - DNA, 25 bp, Homo sapien
ggaggctcgggacctacccatagct

SEQ ID NO: 95167 - DNA, 25 bp, Homo sapien
ggacctacccatagctttgacctag

SEQ ID NO: 95168 - DNA, 25 bp, Homo sapien
tacccatagctttgacctaggcccg

SEQ ID NO: 95169 - DNA, 25 bp, Homo sapien
agtcccgccccgtgtgcagtgtatt

SEQ ID NO: 95170 - DNA, 25 bp, Homo sapien
tgtgcagtgtattgcccaccccgca

SEQ ID NO: 95171 - DNA, 25 bp, Homo sapien
cccgcacagcctgagtttgcaataa

SEQ ID NO: 95172 - DNA, 25 bp, Homo sapien
ccatatagcctgtttgtgtagtagg

SEQ ID NO: 95173 - DNA, 25 bp, Homo sapien
gtgtagtaggctttatcttctaggg

SEQ ID NO: 95174 - DNA, 25 bp, Homo sapien
cttctagggttgtgtaagtactctc

SEQ ID NO: 95175 - DNA, 25 bp, Homo sapien
agtactctctattttgttagcacaa

SEQ ID NO: 95176 - DNA, 25 bp, Homo sapien
caatgcatttcgcaggatgtatccc

SEQ ID NO: 95177 - DNA, 25 bp, Homo sapien
ggatgtatccctgtcgttaagtgat

SEQ ID NO: 95178 - DNA, 25 bp, Homo sapien
atccctgtcgttaagtgatgcagac

SEQ ID NO: 95179 - DNA, 25 bp, Homo sapien
gatgcagactgtttgtggaaatcaa

SEQ ID NO: 95180 - DNA, 25 bp, Homo sapien
gtggaaatcaaacatcatacttctg

SEQ ID NO: 95181 - DNA, 25 bp, Homo sapien
catcatacttctgaacatccaatag

SEQ ID NO: 95182 - DNA, 25 bp, Homo sapien
acttaccaaaacttacgtgatgcag

SEQ ID NO: 95183 - DNA, 25 bp, Homo sapien
cctcacctcctggacagggtggctg

SEQ ID NO: 95184 - DNA, 25 bp, Homo sapien
tcctggacagggtggctggccgggt

SEQ ID NO: 95185 - DNA, 25 bp, Homo sapien
cctggacagggtggctggccgggtg

SEQ ID NO: 95186 - DNA, 25 bp, Homo sapien
ctggacagggtggctggccgggtgg

SEQ ID NO: 95187 - DNA, 25 bp, Homo sapien
tggacagggtggctggccgggtggg

SEQ ID NO: 95188 - DNA, 25 bp, Homo sapien
tcccagacgcggtggctggccgggt

SEQ ID NO: 95189 - DNA, 25 bp, Homo sapien
cccagacgcggtggctggccgggtg

SEQ ID NO: 95190 - DNA, 25 bp, Homo sapien
ccagacgcggtggctggccgggtgg

SEQ ID NO: 95191 - DNA, 25 bp, Homo sapien
cagacgcggtggctggccgggtggg

SEQ ID NO: 95192 - DNA, 25 bp, Homo sapien
tgacctccccgcctccctcccggat

SEQ ID NO: 95193 - DNA, 25 bp, Homo sapien
gacctccccgcctccctcccggatg

SEQ ID NO: 95194 - DNA, 25 bp, Homo sapien
cctagggacaggtgcctcgagtgcc

SEQ ID NO: 95195 - DNA, 25 bp, Homo sapien
acaggtgcctcgagtgcccgtgcct

SEQ ID NO: 95196 - DNA, 25 bp, Homo sapien
ttcttcatctcaggaatctctcgga

SEQ ID NO: 95197 - DNA, 25 bp, Homo sapien
ttcatctcaggaatctctcggaccg

SEQ ID NO: 95198 - DNA, 25 bp, Homo sapien
ctcaggaatctctcggaccgcggat

SEQ ID NO: 95199 - DNA, 25 bp, Homo sapien
gaatctctcggaccgcggatcctca

SEQ ID NO: 95200 - DNA, 25 bp, Homo sapien
gagcagagcagaggtgatccggccc

SEQ ID NO: 95201 - DNA, 25 bp, Homo sapien
agtgtgggcggagatctgctccttc

SEQ ID NO: 95202 - DNA, 25 bp, Homo sapien
caaggaggcctctgtcattttaaag

SEQ ID NO: 95203 - DNA, 25 bp, Homo sapien
cattttaaagactcgtgtttacagt

SEQ ID NO: 95204 - DNA, 25 bp, Homo sapien
ttaaagactcgtgtttacagttttg

SEQ ID NO: 95205 - DNA, 25 bp, Homo sapien
agaacttttggatactggaggcagt

SEQ ID NO: 95206 - DNA, 25 bp, Homo sapien
tactggaggcagttgcataggtctc

SEQ ID NO: 95207 - DNA, 25 bp, Homo sapien
gaggcagttgcataggtctccctct

SEQ ID NO: 95208 - DNA, 25 bp, Homo sapien
agttgcataggtctccctctctggg

SEQ ID NO: 95209 - DNA, 25 bp, Homo sapien
tcagtccagcccaagactactctgg

SEQ ID NO: 95210 - DNA, 25 bp, Homo sapien
agcccaagactactctgggcagctc

SEQ ID NO: 95211 - DNA, 25 bp, Homo sapien
ggaaaggatttctacagtgttctat

SEQ ID NO: 95212 - DNA, 25 bp, Homo sapien
tctacagtgttctataaaagccaaa

SEQ ID NO: 95213 - DNA, 25 bp, Homo sapien
ggaccgatgtgcctcattgtttagt

SEQ ID NO: 95214 - DNA, 25 bp, Homo sapien
cgatgtgcctcattgtttagtggtg

SEQ ID NO: 95215 - DNA, 25 bp, Homo sapien
ttctggataaagtttggttgtttgc

SEQ ID NO: 95216 - DNA, 25 bp, Homo sapien
tgctggcctctctgacatatgctaa

SEQ ID NO: 95217 - DNA, 25 bp, Homo sapien
tgctaacccccaaatactctgaatt

SEQ ID NO: 95218 - DNA, 25 bp, Homo sapien
gaatttggagtctgactgtgcccaa

SEQ ID NO: 95219 - DNA, 25 bp, Homo sapien
gagtctgactgtgcccaagtgggtc

SEQ ID NO: 95220 - DNA, 25 bp, Homo sapien
tgcccaagtgggtccaagtggctgt

SEQ ID NO: 95221 - DNA, 25 bp, Homo sapien
gggtccaagtggctgtgacatctac

SEQ ID NO: 95222 - DNA, 25 bp, Homo sapien
aagtggctgtgacatctacgtatgg

SEQ ID NO: 95223 - DNA, 25 bp, Homo sapien
tacgtatggctccacacctccaatg

SEQ ID NO: 95224 - DNA, 25 bp, Homo sapien
catgtggccctccagtgtatgagag

SEQ ID NO: 95225 - DNA, 25 bp, Homo sapien
cagtgtatgagagggccctgcctgc

SEQ ID NO: 95226 - DNA, 25 bp, Homo sapien
gggtcatagatcctaagccataaaa

SEQ ID NO: 95227 - DNA, 25 bp, Homo sapien
agctggaccgactcagagctcagca

SEQ ID NO: 95228 - DNA, 25 bp, Homo sapien
ggaccgactcagagctcagcagccg

SEQ ID NO: 95229 - DNA, 25 bp, Homo sapien
gactcagagctcagcagccgcgagc

SEQ ID NO: 95230 - DNA, 25 bp, Homo sapien
cctggagcacggagcttggcgtctg

SEQ ID NO: 95231 - DNA, 25 bp, Homo sapien
acggagcttggcgtctgccggtctc

SEQ ID NO: 95232 - DNA, 25 bp, Homo sapien
gagcttggcgtctgccggtctccat

SEQ ID NO: 95233 - DNA, 25 bp, Homo sapien
gtctccatccccttgttcgggagga

SEQ ID NO: 95234 - DNA, 25 bp, Homo sapien
tccatccccttgttcgggaggacta

SEQ ID NO: 95235 - DNA, 25 bp, Homo sapien
atccccttgttcgggaggactacag

SEQ ID NO: 95236 - DNA, 25 bp, Homo sapien
ttcttatcccgtttgttacattttg

SEQ ID NO: 95237 - DNA, 25 bp, Homo sapien
aataaaggtgtgtgatctggtttgg

SEQ ID NO: 95238 - DNA, 25 bp, Homo sapien
gccaaggtcaaccagtacccttaca

SEQ ID NO: 95239 - DNA, 25 bp, Homo sapien
aggtcaaccagtacccttacatata

SEQ ID NO: 95240 - DNA, 25 bp, Homo sapien
gtacccttacatataaacactggag

SEQ ID NO: 95241 - DNA, 25 bp, Homo sapien
tatactgaagatgccgcacacaaac

SEQ ID NO: 95242 - DNA, 25 bp, Homo sapien
gaagatgccgcacacaaacaatgca

SEQ ID NO: 95243 - DNA, 25 bp, Homo sapien
tgccgcacacaaacaatgcaaacgg

SEQ ID NO: 95244 - DNA, 25 bp, Homo sapien
ggtcgggacaccagtgaaacttgaa

SEQ ID NO: 95245 - DNA, 25 bp, Homo sapien
gggacaccagtgaaacttgaaccgg

SEQ ID NO: 95246 - DNA, 25 bp, Homo sapien
gacaccagtgaaacttgaaccggga

SEQ ID NO: 95247 - DNA, 25 bp, Homo sapien
ccagtgaaacttgaaccgggaagtg

SEQ ID NO: 95248 - DNA, 25 bp, Homo sapien
aagtgggaggacgtagagcagagaa

SEQ ID NO: 95249 - DNA, 25 bp, Homo sapien
tgcccagctccccattcacacacac

SEQ ID NO: 95250 - DNA, 25 bp, Homo sapien
attcacacacaccggcactttcata

SEQ ID NO: 95251 - DNA, 25 bp, Homo sapien
ggcactttcataccctgacctctga

SEQ ID NO: 95252 - DNA, 25 bp, Homo sapien
gcactttcataccctgacctctgac

SEQ ID NO: 95253 - DNA, 25 bp, Homo sapien
ccatccttcccatttcctttgatgt

SEQ ID NO: 95254 - DNA, 25 bp, Homo sapien
catccttcccatttcctttgatgtt

SEQ ID NO: 95255 - DNA, 25 bp, Homo sapien
atccttcccatttcctttgatgtta

SEQ ID NO: 95256 - DNA, 25 bp, Homo sapien
tccttcccatttcctttgatgttat

SEQ ID NO: 95257 - DNA, 25 bp, Homo sapien
ccttcccatttcctttgatgttatt

SEQ ID NO: 95258 - DNA, 25 bp, Homo sapien
cttcccatttcctttgatgttattt

SEQ ID NO: 95259 - DNA, 25 bp, Homo sapien
ttcccatttcctttgatgttatttt

SEQ ID NO: 95260 - DNA, 25 bp, Homo sapien
acttcaaagtattagctgctttttg

SEQ ID NO: 95261 - DNA, 25 bp, Homo sapien
tttgtaggccaaataaacacgtctg

SEQ ID NO: 95262 - DNA, 25 bp, Homo sapien
aataaacacgtctgtgggccagatc

SEQ ID NO: 95263 - DNA, 25 bp, Homo sapien
agatctggcccaggactagagttgc

SEQ ID NO: 95264 - DNA, 25 bp, Homo sapien
tggcccaggactagagttgccagtg

SEQ ID NO: 95265 - DNA, 25 bp, Homo sapien
ttgccagtggcaacttctggcccag

SEQ ID NO: 95266 - DNA, 25 bp, Homo sapien
ctgatgcctgggtacgggagctctg

SEQ ID NO: 95267 - DNA, 25 bp, Homo sapien
gggagcaagcagtgtcctccagtga

SEQ ID NO: 95268 - DNA, 25 bp, Homo sapien
gtgtcctccagtgaaggaaatcctg

SEQ ID NO: 95269 - DNA, 25 bp, Homo sapien
atcctggactcgcaggcagaagttt

SEQ ID NO: 95270 - DNA, 25 bp, Homo sapien
tcgcaggcagaagttttgcctctta

SEQ ID NO: 95271 - DNA, 25 bp, Homo sapien
gagctgcattgactaccagatttat

SEQ ID NO: 95272 - DNA, 25 bp, Homo sapien
gctgcattgactaccagatttattt

SEQ ID NO: 95273 - DNA, 25 bp, Homo sapien
tgcattgactaccagatttattttt

SEQ ID NO: 95274 - DNA, 25 bp, Homo sapien
cattgactaccagatttatttttta

SEQ ID NO: 95275 - DNA, 25 bp, Homo sapien
gttggccacaacattatgattattc

SEQ ID NO: 95276 - DNA, 25 bp, Homo sapien
ggccacaacattatgattattcctt

SEQ ID NO: 95277 - DNA, 25 bp, Homo sapien
atgattattccttgtctgtacttta

SEQ ID NO: 95278 - DNA, 25 bp, Homo sapien
gattattccttgtctgtactttagt

SEQ ID NO: 95279 - DNA, 25 bp, Homo sapien
attattccttgtctgtactttagta

SEQ ID NO: 95280 - DNA, 25 bp, Homo sapien
tattccttgtctgtactttagtatt

SEQ ID NO: 95281 - DNA, 25 bp, Homo sapien
ttgtctgtactttagtatttttcac

SEQ ID NO: 95282 - DNA, 25 bp, Homo sapien
gctcccataatcctcccatgttgtg

SEQ ID NO: 95283 - DNA, 25 bp, Homo sapien
ttctcatgctgttcatgatcccatt

SEQ ID NO: 95284 - DNA, 25 bp, Homo sapien
atgctgttcatgatcccattcatgt

SEQ ID NO: 95285 - DNA, 25 bp, Homo sapien
gttcatgatcccattcatgtgagaa

SEQ ID NO: 95286 - DNA, 25 bp, Homo sapien
gatcccattcatgtgagaaagaccc

SEQ ID NO: 95287 - DNA, 25 bp, Homo sapien
gtgagaaagacccatgtgatcatga

SEQ ID NO: 95288 - DNA, 25 bp, Homo sapien
ccatgtgatcatgaatgggtctcac

SEQ ID NO: 95289 - DNA, 25 bp, Homo sapien
gtgatcatgaatgggtctcacaaga

SEQ ID NO: 95290 - DNA, 25 bp, Homo sapien
tctgcctgctgccattcacaaagga

SEQ ID NO: 95291 - DNA, 25 bp, Homo sapien
gcctgctgccattcacaaaggatgt

SEQ ID NO: 95292 - DNA, 25 bp, Homo sapien
gctgccattcacaaaggatgtgact

SEQ ID NO: 95293 - DNA, 25 bp, Homo sapien
gctctcagcaggcagtgagtgtcac

SEQ ID NO: 95294 - DNA, 25 bp, Homo sapien
acacctgttaatccatcttgagcag

SEQ ID NO: 95295 - DNA, 25 bp, Homo sapien
catcttgagcaggacagtactatac

SEQ ID NO: 95296 - DNA, 25 bp, Homo sapien
ttatattttcttatagccacgttga

SEQ ID NO: 95297 - DNA, 25 bp, Homo sapien
tttcttatagccacgttgaagtaaa

SEQ ID NO: 95298 - DNA, 25 bp, Homo sapien
caggtacagtgttttttaccagctt

SEQ ID NO: 95299 - DNA, 25 bp, Homo sapien
gtgttttttaccagctttatagaag

SEQ ID NO: 95300 - DNA, 25 bp, Homo sapien
gaatacaatttgatgggtctgacta

SEQ ID NO: 95301 - DNA, 25 bp, Homo sapien
gatgggtctgactatatgcacacac

SEQ ID NO: 95302 - DNA, 25 bp, Homo sapien
tatgcacacacctttgataccatca

SEQ ID NO: 95303 - DNA, 25 bp, Homo sapien
acacctttgataccatcaccacaat

SEQ ID NO: 95304 - DNA, 25 bp, Homo sapien
tttgctttgttgatctgagccttct

SEQ ID NO: 95305 - DNA, 25 bp, Homo sapien
gatctgagccttctatgaaagttta

SEQ ID NO: 95306 - DNA, 25 bp, Homo sapien
gtaacgcattcatgaatttccagtg

SEQ ID NO: 95307 - DNA, 25 bp, Homo sapien
attatgccgctttcaatccaacgtt

SEQ ID NO: 95308 - DNA, 25 bp, Homo sapien
aatccaacgttctcacactggaaga

SEQ ID NO: 95309 - DNA, 25 bp, Homo sapien
gtttctaatcagatgcaacggccca

SEQ ID NO: 95310 - DNA, 25 bp, Homo sapien
taatcagatgcaacggcccaaattc

SEQ ID NO: 95311 - DNA, 25 bp, Homo sapien
ggcccaaattcttgatctgcagctt

SEQ ID NO: 95312 - DNA, 25 bp, Homo sapien
caatatgatagggaacaggtgctga

SEQ ID NO: 95313 - DNA, 25 bp, Homo sapien
tgatgggcccaagagtgacaagcat

SEQ ID NO: 95314 - DNA, 25 bp, Homo sapien
agagtgacaagcatacacaactact

SEQ ID NO: 95315 - DNA, 25 bp, Homo sapien
tgatcaaagtccgaacagataccaa

SEQ ID NO: 95316 - DNA, 25 bp, Homo sapien
tcaaagtccgaacagataccaaatt

SEQ ID NO: 95317 - DNA, 25 bp, Homo sapien
aagtccgaacagataccaaattaga

SEQ ID NO: 95318 - DNA, 25 bp, Homo sapien
tccgaacagataccaaattagactt

SEQ ID NO: 95319 - DNA, 25 bp, Homo sapien
gataccaaattagacttcaacctag

SEQ ID NO: 95320 - DNA, 25 bp, Homo sapien
taccaaattagacttcaacctagaa

SEQ ID NO: 95321 - DNA, 25 bp, Homo sapien
attagacttcaacctagaaaagagc

SEQ ID NO: 95322 - DNA, 25 bp, Homo sapien
gacttcaacctagaaaagagcagag

SEQ ID NO: 95323 - DNA, 25 bp, Homo sapien
ttcaacctagaaaagagcagagtaa

SEQ ID NO: 95324 - DNA, 25 bp, Homo sapien
gagcagagtaaaagaattgtattca

SEQ ID NO: 95325 - DNA, 25 bp, Homo sapien
ttcattgaacgaaaagaagctgctg

SEQ ID NO: 95326 - DNA, 25 bp, Homo sapien
tatacttgcaacagggccatatggt

SEQ ID NO: 95327 - DNA, 25 bp, Homo sapien
gcaacagggccatatggtctgcaaa

SEQ ID NO: 95328 - DNA, 25 bp, Homo sapien
aacagggccatatggtctgcaaagt

SEQ ID NO: 95329 - DNA, 25 bp, Homo sapien
gaaatggattggtcttcaccttatt

SEQ ID NO: 95330 - DNA, 25 bp, Homo sapien
atggattggtcttcaccttattctc

SEQ ID NO: 95331 - DNA, 25 bp, Homo sapien
ggattggtcttcaccttattctctc

SEQ ID NO: 95332 - DNA, 25 bp, Homo sapien
ttggtcttcaccttattctctcctg

SEQ ID NO: 95333 - DNA, 25 bp, Homo sapien
accttattctctcctgcacaaaata

SEQ ID NO: 95334 - DNA, 25 bp, Homo sapien
taggaatttaggctgtgatcacact

SEQ ID NO: 95335 - DNA, 25 bp, Homo sapien
ttaggctgtgatcacactgtgacca

SEQ ID NO: 95336 - DNA, 25 bp, Homo sapien
ctgtgatcacactgtgaccacacca

SEQ ID NO: 95337 - DNA, 25 bp, Homo sapien
aggtgaccggcgactgagggcctga

SEQ ID NO: 95338 - DNA, 25 bp, Homo sapien
aaggccaaggacacccaacacaatt

SEQ ID NO: 95339 - DNA, 25 bp, Homo sapien
gccaaggacacccaacacaattttt

SEQ ID NO: 95340 - DNA, 25 bp, Homo sapien
ggacacccaacacaatttttgccat

SEQ ID NO: 95341 - DNA, 25 bp, Homo sapien
acaatttttgccatacagccccagg

SEQ ID NO: 95342 - DNA, 25 bp, Homo sapien
tcctgcaggctaggacactggtgca

SEQ ID NO: 95343 - DNA, 25 bp, Homo sapien
ttctctaaggaatcaatatttcaat

SEQ ID NO: 95344 - DNA, 25 bp, Homo sapien
tatgttgagtgtgtgtccaatgcta

SEQ ID NO: 95345 - DNA, 25 bp, Homo sapien
gttgagtgtgtgtccaatgctatga

SEQ ID NO: 95346 - DNA, 25 bp, Homo sapien
gagtgtgtgtccaatgctatgaaat

SEQ ID NO: 95347 - DNA, 25 bp, Homo sapien
gtgtgtccaatgctatgaaattaaa

SEQ ID NO: 95348 - DNA, 25 bp, Homo sapien
aaatgtactgagcatctattcatgt

SEQ ID NO: 95349 - DNA, 25 bp, Homo sapien
gagcatctattcatgtggcaggccc

SEQ ID NO: 95350 - DNA, 25 bp, Homo sapien
catctattcatgtggcaggcccctg

SEQ ID NO: 95351 - DNA, 25 bp, Homo sapien
taggccctagggatccaactggctg

SEQ ID NO: 95352 - DNA, 25 bp, Homo sapien
tagggatccaactggctgtctgcct

SEQ ID NO: 95353 - DNA, 25 bp, Homo sapien
aactggctgtctgcctctagaactc

SEQ ID NO: 95354 - DNA, 25 bp, Homo sapien
atctctctgcgtatttctccctgaa

SEQ ID NO: 95355 - DNA, 25 bp, Homo sapien
ctctgcgtatttctccctgaaatgg

SEQ ID NO: 95356 - DNA, 25 bp, Homo sapien
aggaggtgccctgtgtgtccgtctc

SEQ ID NO: 95357 - DNA, 25 bp, Homo sapien
gtgtgtccgtctctcgaagttctgc

SEQ ID NO: 95358 - DNA, 25 bp, Homo sapien
tcgaagttctgcctctctgtgccca

SEQ ID NO: 95359 - DNA, 25 bp, Homo sapien
aactcatgactgcttccgctgccag

SEQ ID NO: 95360 - DNA, 25 bp, Homo sapien
tgactgcttccgctgccagaaggtt

SEQ ID NO: 95361 - DNA, 25 bp, Homo sapien
gagggcaatcgcttcctggtgctga

SEQ ID NO: 95362 - DNA, 25 bp, Homo sapien
gcaatcgcttcctggtgctgagctc

SEQ ID NO: 95363 - DNA, 25 bp, Homo sapien
ctgggacatctagagaatgccatct

SEQ ID NO: 95364 - DNA, 25 bp, Homo sapien
gagaatgccatcttgcaaaccctac

SEQ ID NO: 95365 - DNA, 25 bp, Homo sapien
ttgcaaaccctactctggactgagt

SEQ ID NO: 95366 - DNA, 25 bp, Homo sapien
tggactgagtagctgaccccttctt

SEQ ID NO: 95367 - DNA, 25 bp, Homo sapien
actagaggcaaggtgtcccctgatc

SEQ ID NO: 95368 - DNA, 25 bp, Homo sapien
agaggcaaggtgtcccctgatccct

SEQ ID NO: 95369 - DNA, 25 bp, Homo sapien
gcaaggtgtcccctgatcccttctt

SEQ ID NO: 95370 - DNA, 25 bp, Homo sapien
gacagagtcttgagctggaagcgta

SEQ ID NO: 95371 - DNA, 25 bp, Homo sapien
ctgagctgtgtgtgactatcctttt

SEQ ID NO: 95372 - DNA, 25 bp, Homo sapien
gtgtgtgactatccttttgctatgg

SEQ ID NO: 95373 - DNA, 25 bp, Homo sapien
gctatggatgtgttcaagcagatct

SEQ ID NO: 95374 - DNA, 25 bp, Homo sapien
aagcagatctgatgtcctcgcctgt

SEQ ID NO: 95375 - DNA, 25 bp, Homo sapien
cagcgggacccctgtttcctctttg

SEQ ID NO: 95376 - DNA, 25 bp, Homo sapien
caggccttctttatgtcacctaaaa

SEQ ID NO: 95377 - DNA, 25 bp, Homo sapien
tttaacctgaccgtagtacctaatg

SEQ ID NO: 95378 - DNA, 25 bp, Homo sapien
gtagtacctaatgtaataccgcatg

SEQ ID NO: 95379 - DNA, 25 bp, Homo sapien
gtaataccgcatgttaaactcacag

SEQ ID NO: 95380 - DNA, 25 bp, Homo sapien
aactcacagaaggtttttcttggag

SEQ ID NO: 95381 - DNA, 25 bp, Homo sapien
tccaggcggctcagtgctgcctgcg

SEQ ID NO: 95382 - DNA, 25 bp, Homo sapien
agtgctgcctgcggcccagctaagg

SEQ ID NO: 95383 - DNA, 25 bp, Homo sapien
caggcggctgctagttgtggccctt

SEQ ID NO: 95384 - DNA, 25 bp, Homo sapien
ggcggctgctagttgtggcccttcc

SEQ ID NO: 95385 - DNA, 25 bp, Homo sapien
aaggagaggcctgcagggctcgacc

SEQ ID NO: 95386 - DNA, 25 bp, Homo sapien
cctgcagggctcgaccctgtgggtt

SEQ ID NO: 95387 - DNA, 25 bp, Homo sapien
gtttctgtccccagggagcagactg

SEQ ID NO: 95388 - DNA, 25 bp, Homo sapien
ctgtccccagggagcagactgtgcg

SEQ ID NO: 95389 - DNA, 25 bp, Homo sapien
tccccagggagcagactgtgcggca

SEQ ID NO: 95390 - DNA, 25 bp, Homo sapien
cagggagcagactgtgcggcaccca

SEQ ID NO: 95391 - DNA, 25 bp, Homo sapien
tgtgcggcacccaggcccagtggca

SEQ ID NO: 95392 - DNA, 25 bp, Homo sapien
tgctctaagcccaggatctctttcc

SEQ ID NO: 95393 - DNA, 25 bp, Homo sapien
cagccctcgcctctgcgagaatgaa

SEQ ID NO: 95394 - DNA, 25 bp, Homo sapien
tcgcctctgcgagaatgaacatatt

SEQ ID NO: 95395 - DNA, 25 bp, Homo sapien
ctctgcgagaatgaacatatttgat

SEQ ID NO: 95396 - DNA, 25 bp, Homo sapien
ttaacaagttagaaaattcagctcc

SEQ ID NO: 95397 - DNA, 25 bp, Homo sapien
aaattcagctcctttctgtcctgga

SEQ ID NO: 95398 - DNA, 25 bp, Homo sapien
ttctgtcctggagctagcaaagact

SEQ ID NO: 95399 - DNA, 25 bp, Homo sapien
tgatgcctccgaaggggctctgagt

SEQ ID NO: 95400 - DNA, 25 bp, Homo sapien
gttttgctctctgtcaggtgtgata

SEQ ID NO: 95401 - DNA, 25 bp, Homo sapien
gctctctgtcaggtgtgataaaatg

SEQ ID NO: 95402 - DNA, 25 bp, Homo sapien
tgataaaatgttgaaccctccccac

SEQ ID NO: 95403 - DNA, 25 bp, Homo sapien
gactgggaacagaactcggtgtccc

SEQ ID NO: 95404 - DNA, 25 bp, Homo sapien
tgggaacagaactcggtgtccccac

SEQ ID NO: 95405 - DNA, 25 bp, Homo sapien
gctgtcttttctttgccatctctgc

SEQ ID NO: 95406 - DNA, 25 bp, Homo sapien
atctctgctccaaccgggatgggag

SEQ ID NO: 95407 - DNA, 25 bp, Homo sapien
tgggagccgggcaaactggccgcgg

SEQ ID NO: 95408 - DNA, 25 bp, Homo sapien
atggccggctttcaggagctccata

SEQ ID NO: 95409 - DNA, 25 bp, Homo sapien
ggctttcaggagctccatacacacg

SEQ ID NO: 95410 - DNA, 25 bp, Homo sapien
tttcaggagctccatacacacgctg

SEQ ID NO: 95411 - DNA, 25 bp, Homo sapien
aggagctccatacacacgctgcctt

SEQ ID NO: 95412 - DNA, 25 bp, Homo sapien
gtacccaccacacaacatccaagtg

SEQ ID NO: 95413 - DNA, 25 bp, Homo sapien
aagtggcctccgtcactacctggct

SEQ ID NO: 95414 - DNA, 25 bp, Homo sapien
cacggacctcggacctccaggcggc

SEQ ID NO: 95415 - DNA, 25 bp, Homo sapien
caggcggctgctagttgtggccctt

SEQ ID NO: 95416 - DNA, 25 bp, Homo sapien
aggcggctgctagttgtggcccttc

SEQ ID NO: 95417 - DNA, 25 bp, Homo sapien
ggcggctgctagttgtggcccttcc

SEQ ID NO: 95418 - DNA, 25 bp, Homo sapien
gaaggagaggcctgcagggctcgac

SEQ ID NO: 95419 - DNA, 25 bp, Homo sapien
aaggagaggcctgcagggctcgacc

SEQ ID NO: 95420 - DNA, 25 bp, Homo sapien
aggagaggcctgcagggctcgaccc

SEQ ID NO: 95421 - DNA, 25 bp, Homo sapien
ggagaggcctgcagggctcgaccct

SEQ ID NO: 95422 - DNA, 25 bp, Homo sapien
gagaggcctgcagggctcgaccctg

SEQ ID NO: 95423 - DNA, 25 bp, Homo sapien
agaggcctgcagggctcgaccctgt

SEQ ID NO: 95424 - DNA, 25 bp, Homo sapien
cctgcagggctcgaccctgtgggtt

SEQ ID NO: 95425 - DNA, 25 bp, Homo sapien
gatactgatatattctcgtcatttg

SEQ ID NO: 95426 - DNA, 25 bp, Homo sapien
tattctcgtcatttgttcttttatg

SEQ ID NO: 95427 - DNA, 25 bp, Homo sapien
aatgttgactgcctatttaaagaaa

SEQ ID NO: 95428 - DNA, 25 bp, Homo sapien
gaaaagaatgaacgctgtgcatcaa

SEQ ID NO: 95429 - DNA, 25 bp, Homo sapien
caaagtgtttgtatgttcgtagcta

SEQ ID NO: 95430 - DNA, 25 bp, Homo sapien
gtagctacatacgtaccacagtatt

SEQ ID NO: 95431 - DNA, 25 bp, Homo sapien
cacagtattttggatgctttagtct

SEQ ID NO: 95432 - DNA, 25 bp, Homo sapien
ggatgctttagtctacaatgaaact

SEQ ID NO: 95433 - DNA, 25 bp, Homo sapien
gaaactttcaattaattctgtcttg

SEQ ID NO: 95434 - DNA, 25 bp, Homo sapien
gaaacaggattcatgtgtatctctt

SEQ ID NO: 95435 - DNA, 25 bp, Homo sapien
gtgtatctctttaccatgcacaaaa

SEQ ID NO: 95436 - DNA, 25 bp, Homo sapien
ggaactacactagagctggccaggc

SEQ ID NO: 95437 - DNA, 25 bp, Homo sapien
actacactagagctggccaggcctt

SEQ ID NO: 95438 - DNA, 25 bp, Homo sapien
ctagagctggccaggccttcactat

SEQ ID NO: 95439 - DNA, 25 bp, Homo sapien
tctcctaaaaggagccctccgatgt

SEQ ID NO: 95440 - DNA, 25 bp, Homo sapien
taaaaggagccctccgatgtcttct

SEQ ID NO: 95441 - DNA, 25 bp, Homo sapien
gtcttctttgtcttcgttcacatcc

SEQ ID NO: 95442 - DNA, 25 bp, Homo sapien
ttctttgtcttcgttcacatcctct

SEQ ID NO: 95443 - DNA, 25 bp, Homo sapien
tttcaccagcctaaggcctggctga

SEQ ID NO: 95444 - DNA, 25 bp, Homo sapien
taacttgcaggccacgtgacataac

SEQ ID NO: 95445 - DNA, 25 bp, Homo sapien
aggccacgtgacataaccacccaaa

SEQ ID NO: 95446 - DNA, 25 bp, Homo sapien
ataaccacccaaagagccagttgct

SEQ ID NO: 95447 - DNA, 25 bp, Homo sapien
agggggccagctctgccagcgagcc

SEQ ID NO: 95448 - DNA, 25 bp, Homo sapien
gtttccagccatctcgccctgccag

SEQ ID NO: 95449 - DNA, 25 bp, Homo sapien
agcccagcaccactgggaatcatgg

SEQ ID NO: 95450 - DNA, 25 bp, Homo sapien
gcccagcaccactgggaatcatggt

SEQ ID NO: 95451 - DNA, 25 bp, Homo sapien
cagcaccactgggaatcatggtgaa

SEQ ID NO: 95452 - DNA, 25 bp, Homo sapien
accactgggaatcatggtgaagctg

SEQ ID NO: 95453 - DNA, 25 bp, Homo sapien
catggtgaagctgatgcagcgttgc

SEQ ID NO: 95454 - DNA, 25 bp, Homo sapien
atggtgaagctgatgcagcgttgcc

SEQ ID NO: 95455 - DNA, 25 bp, Homo sapien
gaagctgatgcagcgttgccgaggg

SEQ ID NO: 95456 - DNA, 25 bp, Homo sapien
gggatgcccacggccgttcatcatc

SEQ ID NO: 95457 - DNA, 25 bp, Homo sapien
cgccgccctttaacacagtctggat

SEQ ID NO: 95458 - DNA, 25 bp, Homo sapien
atcttaactttatggaagggcctct

SEQ ID NO: 95459 - DNA, 25 bp, Homo sapien
ggaagggcctctattttacatcata

SEQ ID NO: 95460 - DNA, 25 bp, Homo sapien
aaagttgctgctcttgcacttgctg

SEQ ID NO: 95461 - DNA, 25 bp, Homo sapien
gctcttgcacttgctggaatgtaca

SEQ ID NO: 95462 - DNA, 25 bp, Homo sapien
ttggccctatgtacctaatctgaaa

SEQ ID NO: 95463 - DNA, 25 bp, Homo sapien
aactaaatatcgttctgtcagggcc

SEQ ID NO: 95464 - DNA, 25 bp, Homo sapien
gtgtcttggtgaacctggatccgag

SEQ ID NO: 95465 - DNA, 25 bp, Homo sapien
acctggatccgagtccatgagtttg

SEQ ID NO: 95466 - DNA, 25 bp, Homo sapien
ggactacagttcatcacagggttca

SEQ ID NO: 95467 - DNA, 25 bp, Homo sapien
tcagcagagtacaagaccactgtct

SEQ ID NO: 95468 - DNA, 25 bp, Homo sapien
gaccactgtctaattttgacttcat

SEQ ID NO: 95469 - DNA, 25 bp, Homo sapien
ttccttgggcccgtcagagtctttt

SEQ ID NO: 95470 - DNA, 25 bp, Homo sapien
ggcccgtcagagtcttttgtggtgc

SEQ ID NO: 95471 - DNA, 25 bp, Homo sapien
cagagtcttttgtggtgctgtgctt

SEQ ID NO: 95472 - DNA, 25 bp, Homo sapien
ggcaggatccaagcagatcagccca

SEQ ID NO: 95473 - DNA, 25 bp, Homo sapien
gatccaagcagatcagcccagccta

SEQ ID NO: 95474 - DNA, 25 bp, Homo sapien
ctagcccagctcaggcaggccatgg

SEQ ID NO: 95475 - DNA, 25 bp, Homo sapien
ggccatggccgctcaagggaaagac

SEQ ID NO: 95476 - DNA, 25 bp, Homo sapien
gctcaagggaaagactgccccagaa

SEQ ID NO: 95477 - DNA, 25 bp, Homo sapien
agactgggaaggaggccacattcct

SEQ ID NO: 95478 - DNA, 25 bp, Homo sapien
cccagcgatggtcttcagcaataaa

SEQ ID NO: 95479 - DNA, 25 bp, Homo sapien
cagcaataaaagttgtgtgacctaa

SEQ ID NO: 95480 - DNA, 25 bp, Homo sapien
acccactgtgtttctggtgccaagg

SEQ ID NO: 95481 - DNA, 25 bp, Homo sapien
tccctaccagggactcggaggaagg

SEQ ID NO: 95482 - DNA, 25 bp, Homo sapien
ggagatatttccaggcttacgaccc

SEQ ID NO: 95483 - DNA, 25 bp, Homo sapien
gcttacgaccctgggctcacgggta

SEQ ID NO: 95484 - DNA, 25 bp, Homo sapien
tgggctcacgggtacctatttatat

SEQ ID NO: 95485 - DNA, 25 bp, Homo sapien
gtacctatttatatgctcagtgcag

SEQ ID NO: 95486 - DNA, 25 bp, Homo sapien
agtgcagagcactgtggatgtgcca

SEQ ID NO: 95487 - DNA, 25 bp, Homo sapien
gggtagccctgttcaagagcaattt

SEQ ID NO: 95488 - DNA, 25 bp, Homo sapien
gttcaagagcaatttctgccctttg

SEQ ID NO: 95489 - DNA, 25 bp, Homo sapien
gtgactttcctagataacactgctt

SEQ ID NO: 95490 - DNA, 25 bp, Homo sapien
gataacactgctttctcataataaa

SEQ ID NO: 95491 - DNA, 25 bp, Homo sapien
ggcaccatggctactaccggggctc

SEQ ID NO: 95492 - DNA, 25 bp, Homo sapien
ggctccgactacgacgaggccgatg

SEQ ID NO: 95493 - DNA, 25 bp, Homo sapien
ctccgactacgacgaggccgatggc

SEQ ID NO: 95494 - DNA, 25 bp, Homo sapien
gacgaggccgatggcccgggcagcg

SEQ ID NO: 95495 - DNA, 25 bp, Homo sapien
gtacgacacgcgtcctcgggcgcca

SEQ ID NO: 95496 - DNA, 25 bp, Homo sapien
caacggctactacccggcgcacgga

SEQ ID NO: 95497 - DNA, 25 bp, Homo sapien
actacccggcgcacggactggccag

SEQ ID NO: 95498 - DNA, 25 bp, Homo sapien
tccaggaagggcctgcacgaaccct

SEQ ID NO: 95499 - DNA, 25 bp, Homo sapien
ggaagggcctgcacgaaccctacag

SEQ ID NO: 95500 - DNA, 25 bp, Homo sapien
gggcctgcacgaaccctacagcgag

SEQ ID NO: 95501 - DNA, 25 bp, Homo sapien
cctgcacgaaccctacagcgagagt

SEQ ID NO: 95502 - DNA, 25 bp, Homo sapien
tatggatatgaccagggacagtatg

SEQ ID NO: 95503 - DNA, 25 bp, Homo sapien
aagtacttacattccagtagccagt

SEQ ID NO: 95504 - DNA, 25 bp, Homo sapien
gtagccagtatctattagcagccat

SEQ ID NO: 95505 - DNA, 25 bp, Homo sapien
attagcagccatattgtcacctcag

SEQ ID NO: 95506 - DNA, 25 bp, Homo sapien
cagccatattgtcacctcagcactg

SEQ ID NO: 95507 - DNA, 25 bp, Homo sapien
agcactgtggacacctccctgtgaa

SEQ ID NO: 95508 - DNA, 25 bp, Homo sapien
gtggacacctccctgtgaagagatc

SEQ ID NO: 95509 - DNA, 25 bp, Homo sapien
tgtgaagagatccttccattccatc

SEQ ID NO: 95510 - DNA, 25 bp, Homo sapien
atccttccattccatctagtttttg

SEQ ID NO: 95511 - DNA, 25 bp, Homo sapien
aaccttgtggataagtggctgtttc

SEQ ID NO: 95512 - DNA, 25 bp, Homo sapien
tgtttcatcagtaagcagcctttgt

SEQ ID NO: 95513 - DNA, 25 bp, Homo sapien
gctcctgctgactccccttatggat

SEQ ID NO: 95514 - DNA, 25 bp, Homo sapien
tctttacccttccatcactatattg

SEQ ID NO: 95515 - DNA, 25 bp, Homo sapien
tacccttccatcactatattgattc

SEQ ID NO: 95516 - DNA, 25 bp, Homo sapien
ctcacttcgtctctacagaatgttc

SEQ ID NO: 95517 - DNA, 25 bp, Homo sapien
tacagaatgttcacagcaaaacacg

SEQ ID NO: 95518 - DNA, 25 bp, Homo sapien
cgtttggtctgtttttagattcttg

SEQ ID NO: 95519 - DNA, 25 bp, Homo sapien
ggtctgtttttagattcttgaagaa

SEQ ID NO: 95520 - DNA, 25 bp, Homo sapien
agaattcaatagtctttcaagatgt

SEQ ID NO: 95521 - DNA, 25 bp, Homo sapien
aatgtgtttaaagctgggaacctgt

SEQ ID NO: 95522 - DNA, 25 bp, Homo sapien
acctgttgggagttcacaagtgctg

SEQ ID NO: 95523 - DNA, 25 bp, Homo sapien
tgttgggagttcacaagtgctgcat

SEQ ID NO: 95524 - DNA, 25 bp, Homo sapien
ggcactttcataccctgacctctga

SEQ ID NO: 95525 - DNA, 25 bp, Homo sapien
tcacctacagctgggatgtacctgg

SEQ ID NO: 95526 - DNA, 25 bp, Homo sapien
acctacagctgggatgtacctggag

SEQ ID NO: 95527 - DNA, 25 bp, Homo sapien
cctacagctgggatgtacctggaga

SEQ ID NO: 95528 - DNA, 25 bp, Homo sapien
ctacagctgggatgtacctggagag

SEQ ID NO: 95529 - DNA, 25 bp, Homo sapien
cagctgggatgtacctggagagata

SEQ ID NO: 95530 - DNA, 25 bp, Homo sapien
gggtagttctccctactgcccaggc

SEQ ID NO: 95531 - DNA, 25 bp, Homo sapien
tgcccaggctggaatccaagagtgg

SEQ ID NO: 95532 - DNA, 25 bp, Homo sapien
gggaagaggccctcttctctaccct

SEQ ID NO: 95533 - DNA, 25 bp, Homo sapien
tctaccctccttcatgattcctgac

SEQ ID NO: 95534 - DNA, 25 bp, Homo sapien
atccttcccatttcctttgatgtta

SEQ ID NO: 95535 - DNA, 25 bp, Homo sapien
gggactgtgatctcctatcgctgct

SEQ ID NO: 95536 - DNA, 25 bp, Homo sapien
tatcgctgctttcccggatttaaac

SEQ ID NO: 95537 - DNA, 25 bp, Homo sapien
atgggtctgcgtatcttgagtgctt

SEQ ID NO: 95538 - DNA, 25 bp, Homo sapien
acaaaaccttatctggtcgtccagc

SEQ ID NO: 95539 - DNA, 25 bp, Homo sapien
gaagacctgaacatcttttccctgt

SEQ ID NO: 95540 - DNA, 25 bp, Homo sapien
tatttcccacacatcaggttggcag

SEQ ID NO: 95541 - DNA, 25 bp, Homo sapien
aggttggcagctgctgtgctttatt

SEQ ID NO: 95542 - DNA, 25 bp, Homo sapien
gtgctttatttttgccctgtgttaa

SEQ ID NO: 95543 - DNA, 25 bp, Homo sapien
ttttgccctgtgttaaagtcctctc

SEQ ID NO: 95544 - DNA, 25 bp, Homo sapien
accaccacatctctgttctaaatgt

SEQ ID NO: 95545 - DNA, 25 bp, Homo sapien
gttctaaatgttgttctcctgcaat

SEQ ID NO: 95546 - DNA, 25 bp, Homo sapien
attccctaaacaatatggtgtagca

SEQ ID NO: 95547 - DNA, 25 bp, Homo sapien
atacaggaaggtgtgcgtaggttac

SEQ ID NO: 95548 - DNA, 25 bp, Homo sapien
ggttacgtgcaaacgctatgccatt

SEQ ID NO: 95549 - DNA, 25 bp, Homo sapien
acgctatgccattgcccatcaggga

SEQ ID NO: 95550 - DNA, 25 bp, Homo sapien
catcctcagatgtcggtgtctgagg

SEQ ID NO: 95551 - DNA, 25 bp, Homo sapien
aggttgcagtcctggaacccatccc

SEQ ID NO: 95552 - DNA, 25 bp, Homo sapien
ccatggatactgaggcatagctgta

SEQ ID NO: 95553 - DNA, 25 bp, Homo sapien
gcatagctgtactgtgtgttttcac

SEQ ID NO: 95554 - DNA, 25 bp, Homo sapien
ttttcactttgctttcagaactacg

SEQ ID NO: 95555 - DNA, 25 bp, Homo sapien
ctttgctttcagaactacgacttga

SEQ ID NO: 95556 - DNA, 25 bp, Homo sapien
acgacttgaatgtgatcgattacaa

SEQ ID NO: 95557 - DNA, 25 bp, Homo sapien
gccaaggtcaaccagtacccttaca

SEQ ID NO: 95558 - DNA, 25 bp, Homo sapien
aggtcaaccagtacccttacatata

SEQ ID NO: 95559 - DNA, 25 bp, Homo sapien
gtacccttacatataaacactggag

SEQ ID NO: 95560 - DNA, 25 bp, Homo sapien
gggcgctggccttttatactgaaga

SEQ ID NO: 95561 - DNA, 25 bp, Homo sapien
tatactgaagatgccgcacacaaac

SEQ ID NO: 95562 - DNA, 25 bp, Homo sapien
gaagatgccgcacacaaacaatgca

SEQ ID NO: 95563 - DNA, 25 bp, Homo sapien
tgccgcacacaaacaatgcaaacgg

SEQ ID NO: 95564 - DNA, 25 bp, Homo sapien
ggtcgggacaccagtgaaacttgaa

SEQ ID NO: 95565 - DNA, 25 bp, Homo sapien
gacaccagtgaaacttgaaccggga

SEQ ID NO: 95566 - DNA, 25 bp, Homo sapien
ccagtgaaacttgaaccgggaagtg

SEQ ID NO: 95567 - DNA, 25 bp, Homo sapien
aagtgggaggacgtagagcagagaa

SEQ ID NO: 95568 - DNA, 25 bp, Homo sapien
tcacctacagctgggatgtacctgg

SEQ ID NO: 95569 - DNA, 25 bp, Homo sapien
cacctacagctgggatgtacctgga

SEQ ID NO: 95570 - DNA, 25 bp, Homo sapien
acctacagctgggatgtacctggag

SEQ ID NO: 95571 - DNA, 25 bp, Homo sapien
cctacagctgggatgtacctggaga

SEQ ID NO: 95572 - DNA, 25 bp, Homo sapien
ctacagctgggatgtacctggagag

SEQ ID NO: 95573 - DNA, 25 bp, Homo sapien
ccaggctggaatccaagagtgggga

SEQ ID NO: 95574 - DNA, 25 bp, Homo sapien
aggctggaatccaagagtggggagt

SEQ ID NO: 95575 - DNA, 25 bp, Homo sapien
gaggccctcttctctaccctccttc

SEQ ID NO: 95576 - DNA, 25 bp, Homo sapien
aggccctcttctctaccctccttca

SEQ ID NO: 95577 - DNA, 25 bp, Homo sapien
tctaccctccttcatgattcctgac

SEQ ID NO: 95578 - DNA, 25 bp, Homo sapien
gcacccgggtcacaccaagcactgt

SEQ ID NO: 95579 - DNA, 25 bp, Homo sapien
actgtcagctctgtgatcagcagct

SEQ ID NO: 95580 - DNA, 25 bp, Homo sapien
tgtcagctctgtgatcagcagctgc

SEQ ID NO: 95581 - DNA, 25 bp, Homo sapien
agctctgtgatcagcagctgcccgg

SEQ ID NO: 95582 - DNA, 25 bp, Homo sapien
gctctgtgatcagcagctgcccggg

SEQ ID NO: 95583 - DNA, 25 bp, Homo sapien
tgctctacctcaacctggagtcctg

SEQ ID NO: 95584 - DNA, 25 bp, Homo sapien
aacctggagtcctgccgctgccttc

SEQ ID NO: 95585 - DNA, 25 bp, Homo sapien
gcctggaggaagtccagtggtgtct

SEQ ID NO: 95586 - DNA, 25 bp, Homo sapien
gcagccacagacctgggacacctca

SEQ ID NO: 95587 - DNA, 25 bp, Homo sapien
ccctccacctttgcccaatttcaga

SEQ ID NO: 95588 - DNA, 25 bp, Homo sapien
agatatttgagcattttgttaaaat

SEQ ID NO: 95589 - DNA, 25 bp, Homo sapien
cgctggttcggcaagccatcccctt

SEQ ID NO: 95590 - DNA, 25 bp, Homo sapien
gctggttcggcaagccatccccttt

SEQ ID NO: 95591 - DNA, 25 bp, Homo sapien
ctggttcggcaagccatcccctttg

SEQ ID NO: 95592 - DNA, 25 bp, Homo sapien
tggttcggcaagccatcccctttgc

SEQ ID NO: 95593 - DNA, 25 bp, Homo sapien
ccatcccctttgcttttacaataca

SEQ ID NO: 95594 - DNA, 25 bp, Homo sapien
catcccctttgcttttacaatacag

SEQ ID NO: 95595 - DNA, 25 bp, Homo sapien
cccctttgcttttacaatacagtgt

SEQ ID NO: 95596 - DNA, 25 bp, Homo sapien
ccctttgcttttacaatacagtgtg

SEQ ID NO: 95597 - DNA, 25 bp, Homo sapien
tttgcttttacaatacagtgtgaaa

SEQ ID NO: 95598 - DNA, 25 bp, Homo sapien
ttgcttttacaatacagtgtgaaag

SEQ ID NO: 95599 - DNA, 25 bp, Homo sapien
cttcgccttcctctttttaagctgt

SEQ ID NO: 95600 - DNA, 25 bp, Homo sapien
gaagttcttgattcatttttaccat

SEQ ID NO: 95601 - DNA, 25 bp, Homo sapien
catttttaccattctttccataggt

SEQ ID NO: 95602 - DNA, 25 bp, Homo sapien
accattctttccataggtagaagag

SEQ ID NO: 95603 - DNA, 25 bp, Homo sapien
ttctgttaaattaccctatcctttg

SEQ ID NO: 95604 - DNA, 25 bp, Homo sapien
taaattaccctatcctttgttctct

SEQ ID NO: 95605 - DNA, 25 bp, Homo sapien
ccctatcctttgttctctactgttt

SEQ ID NO: 95606 - DNA, 25 bp, Homo sapien
ttctttgtaatgtatgactacgaga

SEQ ID NO: 95607 - DNA, 25 bp, Homo sapien
gactacgagagtgatactttgctga

SEQ ID NO: 95608 - DNA, 25 bp, Homo sapien
tactttgctgaaaagtctttcccct

SEQ ID NO: 95609 - DNA, 25 bp, Homo sapien
tcccctattgtttatctattgtcag

SEQ ID NO: 95610 - DNA, 25 bp, Homo sapien
gctcctgagaagacagcattttcca

SEQ ID NO: 95611 - DNA, 25 bp, Homo sapien
gcattttccacaggaggctgtttcc

SEQ ID NO: 95612 - DNA, 25 bp, Homo sapien
tttcctcccctggtggatttaagag

SEQ ID NO: 95613 - DNA, 25 bp, Homo sapien
agagacggtcctttctggatacaga

SEQ ID NO: 95614 - DNA, 25 bp, Homo sapien
atgaaacaacggtgacctctccagg

SEQ ID NO: 95615 - DNA, 25 bp, Homo sapien
acttctgtacggtggcaaaacgatg

SEQ ID NO: 95616 - DNA, 25 bp, Homo sapien
aacgatgacatgtaaccttgctgtt

SEQ ID NO: 95617 - DNA, 25 bp, Homo sapien
tgtaaccttgctgtttattgtactt

SEQ ID NO: 95618 - DNA, 25 bp, Homo sapien
gtatattatttcctcttcaaagtct

SEQ ID NO: 95619 - DNA, 25 bp, Homo sapien
actctatcctctgcactgttaatag

SEQ ID NO: 95620 - DNA, 25 bp, Homo sapien
gtaaatattcagctttttgctaact

SEQ ID NO: 95621 - DNA, 25 bp, Homo sapien
gaagggctgggtccgtctgagtggg

SEQ ID NO: 95622 - DNA, 25 bp, Homo sapien
agtgggactttgcacctctgctgat

SEQ ID NO: 95623 - DNA, 25 bp, Homo sapien
tggaggcttggctgctcttccagcg

SEQ ID NO: 95624 - DNA, 25 bp, Homo sapien
gaaggtcgcccttgcgcgcaaggtt

SEQ ID NO: 95625 - DNA, 25 bp, Homo sapien
cttgcgcgcaaggttttagctttca

SEQ ID NO: 95626 - DNA, 25 bp, Homo sapien
gcgcgcaaggttttagctttcagca

SEQ ID NO: 95627 - DNA, 25 bp, Homo sapien
agctttcagcaactgaggtaacctt

SEQ ID NO: 95628 - DNA, 25 bp, Homo sapien
gcaactgaggtaaccttagggacag

SEQ ID NO: 95629 - DNA, 25 bp, Homo sapien
gaggtgtgggccgatctaacccctt

SEQ ID NO: 95630 - DNA, 25 bp, Homo sapien
ctctactgctggactgtggagggtc

SEQ ID NO: 95631 - DNA, 25 bp, Homo sapien
actgctggactgtggagggtcacca

SEQ ID NO: 95632 - DNA, 25 bp, Homo sapien
ctgtaagtgctcaagttaaagaaag

SEQ ID NO: 95633 - DNA, 25 bp, Homo sapien
tgtaagtgctcaagttaaagaaaga

SEQ ID NO: 95634 - DNA, 25 bp, Homo sapien
gtaagtgctcaagttaaagaaagag

SEQ ID NO: 95635 - DNA, 25 bp, Homo sapien
gtgctcaagttaaagaaagagtcgg

SEQ ID NO: 95636 - DNA, 25 bp, Homo sapien
tgctcaagttaaagaaagagtcggc

SEQ ID NO: 95637 - DNA, 25 bp, Homo sapien
gctcaagttaaagaaagagtcggcc

SEQ ID NO: 95638 - DNA, 25 bp, Homo sapien
ctcaagttaaagaaagagtcggccg

SEQ ID NO: 95639 - DNA, 25 bp, Homo sapien
tcaagttaaagaaagagtcggccgg

SEQ ID NO: 95640 - DNA, 25 bp, Homo sapien
gtcttcaatttgtttctgtagctac

SEQ ID NO: 95641 - DNA, 25 bp, Homo sapien
gtttctgtagctactgtgaacccaa

SEQ ID NO: 95642 - DNA, 25 bp, Homo sapien
aaaggaggttctcatgcccagggtc

SEQ ID NO: 95643 - DNA, 25 bp, Homo sapien
tcatgcccagggtccacagtgacca

SEQ ID NO: 95644 - DNA, 25 bp, Homo sapien
gtgaccagccagcaagtctctggta

SEQ ID NO: 95645 - DNA, 25 bp, Homo sapien
tttttagccaaagcaaattctccta

SEQ ID NO: 95646 - DNA, 25 bp, Homo sapien
aattctcctattaacacttagcagg

SEQ ID NO: 95647 - DNA, 25 bp, Homo sapien
tgtttatatcgacactctgggctgc

SEQ ID NO: 95648 - DNA, 25 bp, Homo sapien
tgcctctcctattcaggtattggga

SEQ ID NO: 95649 - DNA, 25 bp, Homo sapien
tgttcctttctttccagcctgactg

SEQ ID NO: 95650 - DNA, 25 bp, Homo sapien
gactgcaactcacatttcgaaacat

SEQ ID NO: 95651 - DNA, 25 bp, Homo sapien
atggtatttgagtgtgcaagaaaat

SEQ ID NO: 95652 - DNA, 25 bp, Homo sapien
ttacttttataaggaagcagctgtc

SEQ ID NO: 95653 - DNA, 25 bp, Homo sapien
acttttataaggaagcagctgtcta

SEQ ID NO: 95654 - DNA, 25 bp, Homo sapien
ttttataaggaagcagctgtctaaa

SEQ ID NO: 95655 - DNA, 25 bp, Homo sapien
aaggaagcagctgtctaaaatgcag

SEQ ID NO: 95656 - DNA, 25 bp, Homo sapien
aggaagcagctgtctaaaatgcagt

SEQ ID NO: 95657 - DNA, 25 bp, Homo sapien
ggaagcagctgtctaaaatgcagtg

SEQ ID NO: 95658 - DNA, 25 bp, Homo sapien
ttaaacagagttttagtattgctat

SEQ ID NO: 95659 - DNA, 25 bp, Homo sapien
aacagagttttagtattgctattaa

SEQ ID NO: 95660 - DNA, 25 bp, Homo sapien
aagaaacttggctgcttaaaataag

SEQ ID NO: 95661 - DNA, 25 bp, Homo sapien
agaaacttggctgcttaaaataagc

SEQ ID NO: 95662 - DNA, 25 bp, Homo sapien
tgtacgtgcattgtgctctctcatg

SEQ ID NO: 95663 - DNA, 25 bp, Homo sapien
attgtgctctctcatggtctgtata

SEQ ID NO: 95664 - DNA, 25 bp, Homo sapien
tgtgctctctcatggtctgtataga

SEQ ID NO: 95665 - DNA, 25 bp, Homo sapien
tgctctctcatggtctgtatagagt

SEQ ID NO: 95666 - DNA, 25 bp, Homo sapien
tacttggtaatatagaggagatgac

SEQ ID NO: 95667 - DNA, 25 bp, Homo sapien
aggagatgaccaaatcagtgctggg

SEQ ID NO: 95668 - DNA, 25 bp, Homo sapien
tctgcttctcataggactatctcca

SEQ ID NO: 95669 - DNA, 25 bp, Homo sapien
gcttctcataggactatctccacca

SEQ ID NO: 95670 - DNA, 25 bp, Homo sapien
ttctcaataatttcaaccacaatca

SEQ ID NO: 95671 - DNA, 25 bp, Homo sapien
cagtgacatttatatcatgtgttat

SEQ ID NO: 95672 - DNA, 25 bp, Homo sapien
gttatatctgtagtattctatagta

SEQ ID NO: 95673 - DNA, 25 bp, Homo sapien
cgcgacagtgccacctgttgggcat

SEQ ID NO: 95674 - DNA, 25 bp, Homo sapien
tgttgggcatcataaatgcccctgc

SEQ ID NO: 95675 - DNA, 25 bp, Homo sapien
ggaagtggagccaccctgcctctgc

SEQ ID NO: 95676 - DNA, 25 bp, Homo sapien
gggaccatctcgaaccaccagcgtg

SEQ ID NO: 95677 - DNA, 25 bp, Homo sapien
atctcgaaccaccagcgtggagaag

SEQ ID NO: 95678 - DNA, 25 bp, Homo sapien
gaaccaccagcgtggagaagcagaa

SEQ ID NO: 95679 - DNA, 25 bp, Homo sapien
agaagcaaaagcactcgccaggctg

SEQ ID NO: 95680 - DNA, 25 bp, Homo sapien
aaaagcactcgccaggctgcagcct

SEQ ID NO: 95681 - DNA, 25 bp, Homo sapien
atttgtgcccatcctgttgtgacca

SEQ ID NO: 95682 - DNA, 25 bp, Homo sapien
catcctgttgtgaccaaccccgttt

SEQ ID NO: 95683 - DNA, 25 bp, Homo sapien
aggaaggagcgcgacagtgccacct

SEQ ID NO: 95684 - DNA, 25 bp, Homo sapien
ggaacttttaggctctgaagatcat

SEQ ID NO: 95685 - DNA, 25 bp, Homo sapien
gaagatcatgtggaccagagcaaat

SEQ ID NO: 95686 - DNA, 25 bp, Homo sapien
gtttgtgtcacaattcattgccaga

SEQ ID NO: 95687 - DNA, 25 bp, Homo sapien
attgccagacttcattggaatgctt

SEQ ID NO: 95688 - DNA, 25 bp, Homo sapien
tggaatgctttgtttgatgatgtat

SEQ ID NO: 95689 - DNA, 25 bp, Homo sapien
gatgatgtatgttcattctcagctt

SEQ ID NO: 95690 - DNA, 25 bp, Homo sapien
gttcattctcagctttattttcaga

SEQ ID NO: 95691 - DNA, 25 bp, Homo sapien
ttattttcagatgcttaactgggca

SEQ ID NO: 95692 - DNA, 25 bp, Homo sapien
ttaactgggcaatgaagtctaactt

SEQ ID NO: 95693 - DNA, 25 bp, Homo sapien
acttcaggttgaactttctcatgtt

SEQ ID NO: 95694 - DNA, 25 bp, Homo sapien
ttctcatgtttaatctcaggctaaa

SEQ ID NO: 95695 - DNA, 25 bp, Homo sapien
atcagcagcccctgagcggagaaga

SEQ ID NO: 95696 - DNA, 25 bp, Homo sapien
tgaggccagtgatggttcaggctcc

SEQ ID NO: 95697 - DNA, 25 bp, Homo sapien
aggccagtgatggttcaggctcctg

SEQ ID NO: 95698 - DNA, 25 bp, Homo sapien
cctgggaagatgcagctttgctgac

SEQ ID NO: 95699 - DNA, 25 bp, Homo sapien
tgcagctttgctgacggaggccaac

SEQ ID NO: 95700 - DNA, 25 bp, Homo sapien
gctttgctgacggaggccaacctgc

SEQ ID NO: 95701 - DNA, 25 bp, Homo sapien
gctgacggaggccaacctgcctgct

SEQ ID NO: 95702 - DNA, 25 bp, Homo sapien
gagactctgggcagctctgaacctg

SEQ ID NO: 95703 - DNA, 25 bp, Homo sapien
ccacctgctctagttcctgaagaaa

SEQ ID NO: 95704 - DNA, 25 bp, Homo sapien
acctgctctagttcctgaagaaaag

SEQ ID NO: 95705 - DNA, 25 bp, Homo sapien
gaaaaggggcagactcctcacattc

SEQ ID NO: 95706 - DNA, 25 bp, Homo sapien
gagagatgctgtatctggaactgac

SEQ ID NO: 95707 - DNA, 25 bp, Homo sapien
gctgtatctggaactgactgcaagg

SEQ ID NO: 95708 - DNA, 25 bp, Homo sapien
atctggaactgactgcaagggatgc

SEQ ID NO: 95709 - DNA, 25 bp, Homo sapien
gatgcagtgtgcgagcaggtcttca

SEQ ID NO: 95710 - DNA, 25 bp, Homo sapien
cagtgtgcgagcaggtcttcaggaa

SEQ ID NO: 95711 - DNA, 25 bp, Homo sapien
tcttcaggaaggtcagatagccgga

SEQ ID NO: 95712 - DNA, 25 bp, Homo sapien
gtcagatagccggagaggagccaag

SEQ ID NO: 95713 - DNA, 25 bp, Homo sapien
agcaccagctcacagacgctcttgt

SEQ ID NO: 95714 - DNA, 25 bp, Homo sapien
agctcacagacgctcttgttgtgcc

SEQ ID NO: 95715 - DNA, 25 bp, Homo sapien
agattgtgccaggtcagctgtccct

SEQ ID NO: 95716 - DNA, 25 bp, Homo sapien
tcacactccactgcccaatagtgac

SEQ ID NO: 95717 - DNA, 25 bp, Homo sapien
agcccggcggaagctacagtctcta

SEQ ID NO: 95718 - DNA, 25 bp, Homo sapien
ggcggaagctacagtctctaccctg

SEQ ID NO: 95719 - DNA, 25 bp, Homo sapien
gaagctacagtctctaccctgagct

SEQ ID NO: 95720 - DNA, 25 bp, Homo sapien
gtgcgcagagcgctccacgcgtatt

SEQ ID NO: 95721 - DNA, 25 bp, Homo sapien
gcagagcgctccacgcgtattcacg

SEQ ID NO: 95722 - DNA, 25 bp, Homo sapien
cagcggttgggctcaggccacaacg

SEQ ID NO: 95723 - DNA, 25 bp, Homo sapien
ttgggctcaggccacaacggcctga

SEQ ID NO: 95724 - DNA, 25 bp, Homo sapien
cacaacggcctgagattgccccggg

SEQ ID NO: 95725 - DNA, 25 bp, Homo sapien
caacccgtcggctatgcctggaggc

SEQ ID NO: 95726 - DNA, 25 bp, Homo sapien
tggaggccgggtccccgatgtcgct

SEQ ID NO: 95727 - DNA, 25 bp, Homo sapien
ctaccccctgttgcgaagacggtga

SEQ ID NO: 95728 - DNA, 25 bp, Homo sapien
tcccaaagtgctgttggcatcttaa

SEQ ID NO: 95729 - DNA, 25 bp, Homo sapien
aaaataattgtctcacctgctaatg

SEQ ID NO: 95730 - DNA, 25 bp, Homo sapien
ttgtctcacctgctaatgaataaac

SEQ ID NO: 95731 - DNA, 25 bp, Homo sapien
taaacataaagccattgatttttct

SEQ ID NO: 95732 - DNA, 25 bp, Homo sapien
attctcataagccatatttctttgc

SEQ ID NO: 95733 - DNA, 25 bp, Homo sapien
atttctttgcatgtcaaccatgttg

SEQ ID NO: 95734 - DNA, 25 bp, Homo sapien
gttgtaattacatagttgcaggaat

SEQ ID NO: 95735 - DNA, 25 bp, Homo sapien
gttgcaggaattcacaagcaggtgt

SEQ ID NO: 95736 - DNA, 25 bp, Homo sapien
acaagcaggtgttaagtcactgtga

SEQ ID NO: 95737 - DNA, 25 bp, Homo sapien
tgaggagacagccacccacagtgag

SEQ ID NO: 95738 - DNA, 25 bp, Homo sapien
agacagccacccacagtgagaactg

SEQ ID NO: 95739 - DNA, 25 bp, Homo sapien
agcaaccagcctctgtttcatctgg

SEQ ID NO: 95740 - DNA, 25 bp, Homo sapien
caaccagcctctgtttcatctggga

SEQ ID NO: 95741 - DNA, 25 bp, Homo sapien
gcctctgtttcatctgggagcccct

SEQ ID NO: 95742 - DNA, 25 bp, Homo sapien
gggtctgtcacccgtctgagccgca

SEQ ID NO: 95743 - DNA, 25 bp, Homo sapien
gaagagcctccctttctttgcgtct

SEQ ID NO: 95744 - DNA, 25 bp, Homo sapien
ttctttgcgtctccctttctttaat

SEQ ID NO: 95745 - DNA, 25 bp, Homo sapien
tgcgtctccctttctttaattaaca

SEQ ID NO: 95746 - DNA, 25 bp, Homo sapien
taataaattcttactgacgacttgt

SEQ ID NO: 95747 - DNA, 25 bp, Homo sapien
ttcttactgacgacttgtaacttag

SEQ ID NO: 95748 - DNA, 25 bp, Homo sapien
gacgacttgtaacttagtcatattt

SEQ ID NO: 95749 - DNA, 25 bp, Homo sapien
catattttatacttgtagcctttaa

SEQ ID NO: 95750 - DNA, 25 bp, Homo sapien
gctgctggtggccataaacagtact

SEQ ID NO: 95751 - DNA, 25 bp, Homo sapien
aaacagtacttccttgactcacatg

SEQ ID NO: 95752 - DNA, 25 bp, Homo sapien
atgctgcccgttcagatctgcgaga

SEQ ID NO: 95753 - DNA, 25 bp, Homo sapien
gatctgcgagaagtgcagcctgccc

SEQ ID NO: 95754 - DNA, 25 bp, Homo sapien
tctcccgtagcctcagaagagtgca

SEQ ID NO: 95755 - DNA, 25 bp, Homo sapien
gaagagtgcagtactggtccacaga

SEQ ID NO: 95756 - DNA, 25 bp, Homo sapien
aaggcttcaggacctgcttggtcag

SEQ ID NO: 95757 - DNA, 25 bp, Homo sapien
gcttggtcagctgcaggttgtaaat

SEQ ID NO: 95758 - DNA, 25 bp, Homo sapien
aatagtgtacgatactagcatctgg

SEQ ID NO: 95759 - DNA, 25 bp, Homo sapien
atttattttgcagcgagcacatgag

SEQ ID NO: 95760 - DNA, 25 bp, Homo sapien
gaggaagctgagtctttcaccaata

SEQ ID NO: 95761 - DNA, 25 bp, Homo sapien
ttgtcccagcgatggtgcctgctta

SEQ ID NO: 95762 - DNA, 25 bp, Homo sapien
gatggtgcctgcttagcttcccgtc

SEQ ID NO: 95763 - DNA, 25 bp, Homo sapien
ggcaggtggacaagggcccatgaaa

SEQ ID NO: 95764 - DNA, 25 bp, Homo sapien
ggcccatgaaaaaatacaggtgtct

SEQ ID NO: 95765 - DNA, 25 bp, Homo sapien
atacaggtgtctagactgccaggga

SEQ ID NO: 95766 - DNA, 25 bp, Homo sapien
tgtctagactgccagggagaccctg

SEQ ID NO: 95767 - DNA, 25 bp, Homo sapien
tggccccccagtagtgtgtcctggg

SEQ ID NO: 95768 - DNA, 25 bp, Homo sapien
gggacttcctcagagcgagaaacct

SEQ ID NO: 95769 - DNA, 25 bp, Homo sapien
aatgtcttcaagacttttctctccc

SEQ ID NO: 95770 - DNA, 25 bp, Homo sapien
cttgccacccaaatgttagaaaaat

SEQ ID NO: 95771 - DNA, 25 bp, Homo sapien
aaatagctgtgaacagagagcgctt

SEQ ID NO: 95772 - DNA, 25 bp, Homo sapien
tttaaggacagactgcatctccgag

SEQ ID NO: 95773 - DNA, 25 bp, Homo sapien
atctccgaggctatacacctgaagg

SEQ ID NO: 95774 - DNA, 25 bp, Homo sapien
tgaaggaacagttttgaccgtccgg

SEQ ID NO: 95775 - DNA, 25 bp, Homo sapien
cccctctcttgccatatattgttaa

SEQ ID NO: 95776 - DNA, 25 bp, Homo sapien
gttaacatcaaaggacagcgcatca

SEQ ID NO: 95777 - DNA, 25 bp, Homo sapien
gcgcatcaagaaaagtgtggcctat

SEQ ID NO: 95778 - DNA, 25 bp, Homo sapien
gcctataaaaccaagaagcctcctt

SEQ ID NO: 95779 - DNA, 25 bp, Homo sapien
ctccttcccttatgtacaacgtgag

SEQ ID NO: 95780 - DNA, 25 bp, Homo sapien
atgtatgagaccgaccttgttcact

SEQ ID NO: 95781 - DNA, 25 bp, Homo sapien
cgaccttgttcactccagatattaa

SEQ ID NO: 95782 - DNA, 25 bp, Homo sapien
aacgcataaataaagctcccattct

SEQ ID NO: 95783 - DNA, 25 bp, Homo sapien
agcgaggctgacgatgactcctgtt

SEQ ID NO: 95784 - DNA, 25 bp, Homo sapien
aggctgacgatgactcctgttttca

SEQ ID NO: 95785 - DNA, 25 bp, Homo sapien
gctgacgatgactcctgttttcacg

SEQ ID NO: 95786 - DNA, 25 bp, Homo sapien
tgacgatgactcctgttttcacgct

SEQ ID NO: 95787 - DNA, 25 bp, Homo sapien
acgatgactcctgttttcacgctga

SEQ ID NO: 95788 - DNA, 25 bp, Homo sapien
gatgactcctgttttcacgctgaga

SEQ ID NO: 95789 - DNA, 25 bp, Homo sapien
tgactcctgttttcacgctgagaga

SEQ ID NO: 95790 - DNA, 25 bp, Homo sapien
actcctgttttcacgctgagagacc

SEQ ID NO: 95791 - DNA, 25 bp, Homo sapien
tgttttcacgctgagagaccccact

SEQ ID NO: 95792 - DNA, 25 bp, Homo sapien
gttttcacgctgagagaccccactc

SEQ ID NO: 95793 - DNA, 25 bp, Homo sapien
gattaaagtacaacaattagcaggg

SEQ ID NO: 95794 - DNA, 25 bp, Homo sapien
ggacaatataccttgaatcactagt

SEQ ID NO: 95795 - DNA, 25 bp, Homo sapien
gaatcactagttgatatgtcaatga

SEQ ID NO: 95796 - DNA, 25 bp, Homo sapien
gtcagtgttacacatcattggttaa

SEQ ID NO: 95797 - DNA, 25 bp, Homo sapien
tttatagcacaatgtacctcttccc

SEQ ID NO: 95798 - DNA, 25 bp, Homo sapien
gataagagtcttctattcccaacca

SEQ ID NO: 95799 - DNA, 25 bp, Homo sapien
agagtcttctattcccaaccaagat

SEQ ID NO: 95800 - DNA, 25 bp, Homo sapien
tattcccaaccaagatcattatatg

SEQ ID NO: 95801 - DNA, 25 bp, Homo sapien
atatgattagctcttgtgtttcttt

SEQ ID NO: 95802 - DNA, 25 bp, Homo sapien
gtgtttctttgattccaaatttctt

SEQ ID NO: 95803 - DNA, 25 bp, Homo sapien
cttcacttgttatttcagactactg

SEQ ID NO: 95804 - DNA, 25 bp, Homo sapien
cacaacaagtttggatgtgtttaac

SEQ ID NO: 95805 - DNA, 25 bp, Homo sapien
ctcaggaggccgagattagagaatc

SEQ ID NO: 95806 - DNA, 25 bp, Homo sapien
ggaggccgagattagagaatcactt

SEQ ID NO: 95807 - DNA, 25 bp, Homo sapien
ggccgagattagagaatcacttgaa

SEQ ID NO: 95808 - DNA, 25 bp, Homo sapien
gccgagattagagaatcacttgaat

SEQ ID NO: 95809 - DNA, 25 bp, Homo sapien
agattagagaatcacttgaatgtgg

SEQ ID NO: 95810 - DNA, 25 bp, Homo sapien
gattagagaatcacttgaatgtggg

SEQ ID NO: 95811 - DNA, 25 bp, Homo sapien
attagagaatcacttgaatgtggga

SEQ ID NO: 95812 - DNA, 25 bp, Homo sapien
ttagagaatcacttgaatgtgggag

SEQ ID NO: 95813 - DNA, 25 bp, Homo sapien
tagagaatcacttgaatgtgggagt

SEQ ID NO: 95814 - DNA, 25 bp, Homo sapien
gaatgtgggagtcggaggttgtaat

SEQ ID NO: 95815 - DNA, 25 bp, Homo sapien
atgtgggagtcggaggttgtaatga

SEQ ID NO: 95816 - DNA, 25 bp, Homo sapien
agctggaacgagagctggccgagca

SEQ ID NO: 95817 - DNA, 25 bp, Homo sapien
cccctgaggtagtgcaggcccacgg

SEQ ID NO: 95818 - DNA, 25 bp, Homo sapien
acatccctgaggttggcgactgtct

SEQ ID NO: 95819 - DNA, 25 bp, Homo sapien
atccctgaggttggcgactgtctac

SEQ ID NO: 95820 - DNA, 25 bp, Homo sapien
ctgaggttggcgactgtctacactc

SEQ ID NO: 95821 - DNA, 25 bp, Homo sapien
gaggttggcgactgtctacactcct

SEQ ID NO: 95822 - DNA, 25 bp, Homo sapien
ggttggcgactgtctacactcctcc

SEQ ID NO: 95823 - DNA, 25 bp, Homo sapien
gggaagcgttgactactgtccccta

SEQ ID NO: 95824 - DNA, 25 bp, Homo sapien
agcgttgactactgtcccctacctt

SEQ ID NO: 95825 - DNA, 25 bp, Homo sapien
ctaccttggaccatcccgcgtaggg

SEQ ID NO: 95826 - DNA, 25 bp, Homo sapien
agctcccctcagtgctgctgtcagt

SEQ ID NO: 95827 - DNA, 25 bp, Homo sapien
tgtgtcccttgagccttcgggtctt

SEQ ID NO: 95828 - DNA, 25 bp, Homo sapien
gtcttcacttcccacttggacatca

SEQ ID NO: 95829 - DNA, 25 bp, Homo sapien
acttggacatcactgctggacattc

SEQ ID NO: 95830 - DNA, 25 bp, Homo sapien
gctggacattcccatcgagatgaca

SEQ ID NO: 95831 - DNA, 25 bp, Homo sapien
tcgagatgacacctgggttccaatc

SEQ ID NO: 95832 - DNA, 25 bp, Homo sapien
accgtcaagtccctttgctctcgga

SEQ ID NO: 95833 - DNA, 25 bp, Homo sapien
ctttgctctcggaccctgggtttct

SEQ ID NO: 95834 - DNA, 25 bp, Homo sapien
accctgggtttctcatcctttaatg

SEQ ID NO: 95835 - DNA, 25 bp, Homo sapien
catcctttaatgaggtgggttcaga

SEQ ID NO: 95836 - DNA, 25 bp, Homo sapien
ctggcactggcttctcaatgggagg

SEQ ID NO: 95837 - DNA, 25 bp, Homo sapien
gcagagaaactgaagtgttagacac

SEQ ID NO: 95838 - DNA, 25 bp, Homo sapien
acgcaggcgtcctgaaggcctcggc

SEQ ID NO: 95839 - DNA, 25 bp, Homo sapien
gtcctgaaggcctcggcggaaaccg

SEQ ID NO: 95840 - DNA, 25 bp, Homo sapien
tcctgaaggcctcggcggaaaccgt

SEQ ID NO: 95841 - DNA, 25 bp, Homo sapien
gcctcgctctgggagtactagggcc

SEQ ID NO: 95842 - DNA, 25 bp, Homo sapien
cctcgctctgggagtactagggccg

SEQ ID NO: 95843 - DNA, 25 bp, Homo sapien
tctgggagtactagggccggcccgt

SEQ ID NO: 95844 - DNA, 25 bp, Homo sapien
gtaagtgtcatttgtataactctaa

SEQ ID NO: 95845 - DNA, 25 bp, Homo sapien
ttgtataactctaaacgcccatgat

SEQ ID NO: 95846 - DNA, 25 bp, Homo sapien
aacgcccatgatagtagcttcaaac

SEQ ID NO: 95847 - DNA, 25 bp, Homo sapien
gtagcttcaaactggaaatagcgaa

SEQ ID NO: 95848 - DNA, 25 bp, Homo sapien
tagcgaaataaaataactcagtctg

SEQ ID NO: 95849 - DNA, 25 bp, Homo sapien
gaggcagctaacgtcaaattcttga

SEQ ID NO: 95850 - DNA, 25 bp, Homo sapien
aattcttgaatacaaaactttgcct

SEQ ID NO: 95851 - DNA, 25 bp, Homo sapien
aaactttgcctgttgtacatagcct

SEQ ID NO: 95852 - DNA, 25 bp, Homo sapien
ttgcctgttgtacatagcctataca

SEQ ID NO: 95853 - DNA, 25 bp, Homo sapien
atacaaaatgctgggttgagccttt

SEQ ID NO: 95854 - DNA, 25 bp, Homo sapien
aaatttcttttgtagcaatctagga

SEQ ID NO: 95855 - DNA, 25 bp, Homo sapien
gcaatctaggaaactgtattttgga

SEQ ID NO: 95856 - DNA, 25 bp, Homo sapien
gacttcaaatttgacaccccagtgg

SEQ ID NO: 95857 - DNA, 25 bp, Homo sapien
tttgacaccccagtggacaaactac

SEQ ID NO: 95858 - DNA, 25 bp, Homo sapien
ggacaaactaccacagctataaatt

SEQ ID NO: 95859 - DNA, 25 bp, Homo sapien
taccacagctataaattgaggcagc

SEQ ID NO: 95860 - DNA, 25 bp, Homo sapien
tgctgtgtcgtgaaactgtgaccat

SEQ ID NO: 95861 - DNA, 25 bp, Homo sapien
tgtgaccatcactcagtccaaacaa

SEQ ID NO: 95862 - DNA, 25 bp, Homo sapien
aaacaagtgagtggccctcgaggcc

SEQ ID NO: 95863 - DNA, 25 bp, Homo sapien
cctcgaggccacagttatgcaactt

SEQ ID NO: 95864 - DNA, 25 bp, Homo sapien
gcaactttcagtgtgtgtcataacg

SEQ ID NO: 95865 - DNA, 25 bp, Homo sapien
gtgtcataacgacgtcactgctttt

SEQ ID NO: 95866 - DNA, 25 bp, Homo sapien
ccaggagtcctggaagctacgcgga

SEQ ID NO: 95867 - DNA, 25 bp, Homo sapien
gctacgcggacttgcagaggtttta

SEQ ID NO: 95868 - DNA, 25 bp, Homo sapien
attttttggccttagaatctgcaga

SEQ ID NO: 95869 - DNA, 25 bp, Homo sapien
gaaattaggaggcaccgagcccagc

SEQ ID NO: 95870 - DNA, 25 bp, Homo sapien
cggattgcgtttgccttagcggata

SEQ ID NO: 95871 - DNA, 25 bp, Homo sapien
acatcacatgagacaattttgcttc

SEQ ID NO: 95872 - DNA, 25 bp, Homo sapien
gagacaattttgcttcactttgcct

SEQ ID NO: 95873 - DNA, 25 bp, Homo sapien
cttcactttgccttctggttattta

SEQ ID NO: 95874 - DNA, 25 bp, Homo sapien
ctggttatttatggtttctgtctga

SEQ ID NO: 95875 - DNA, 25 bp, Homo sapien
gtttctgtctgaattattctgccta

SEQ ID NO: 95876 - DNA, 25 bp, Homo sapien
tattctgcctacgttctctttaaaa

SEQ ID NO: 95877 - DNA, 25 bp, Homo sapien
gcctacgttctctttaaaagctgtt

SEQ ID NO: 95878 - DNA, 25 bp, Homo sapien
aaaagctgttgtacgtactacggag

SEQ ID NO: 95879 - DNA, 25 bp, Homo sapien
gtacgtactacggagaaactcatca

SEQ ID NO: 95880 - DNA, 25 bp, Homo sapien
actcatcatttttatacaggacact

SEQ ID NO: 95881 - DNA, 25 bp, Homo sapien
tacaggacactaatgggaagaccaa

SEQ ID NO: 95882 - DNA, 25 bp, Homo sapien
tcaccaataaataatctgcacttcc

SEQ ID NO: 95883 - DNA, 25 bp, Homo sapien
ataatctgcacttccagagctcggg

SEQ ID NO: 95884 - DNA, 25 bp, Homo sapien
acagcctccatccttagctttggcg

SEQ ID NO: 95885 - DNA, 25 bp, Homo sapien
catccttagctttggcgccctggac

SEQ ID NO: 95886 - DNA, 25 bp, Homo sapien
gtcttttctcactgctttgactctg

SEQ ID NO: 95887 - DNA, 25 bp, Homo sapien
actgctttgactctgccggactttg

SEQ ID NO: 95888 - DNA, 25 bp, Homo sapien
gttgggtctgaacaccccaacatcc

SEQ ID NO: 95889 - DNA, 25 bp, Homo sapien
agactgtctgcccatacacctgtct

SEQ ID NO: 95890 - DNA, 25 bp, Homo sapien
ctgcctggcttgtctgttcctatat

SEQ ID NO: 95891 - DNA, 25 bp, Homo sapien
ctggcttgtctgttcctatattagt

SEQ ID NO: 95892 - DNA, 25 bp, Homo sapien
ttgtctgttcctatattagtttcct

SEQ ID NO: 95893 - DNA, 25 bp, Homo sapien
tggccaacatctcactgcaattcta

SEQ ID NO: 95894 - DNA, 25 bp, Homo sapien
atcagttgaattccctggatagtcc

SEQ ID NO: 95895 - DNA, 25 bp, Homo sapien
ggatagtccaagctttgtggatccc

SEQ ID NO: 95896 - DNA, 25 bp, Homo sapien
gatccctccaccagaacaactggat

SEQ ID NO: 95897 - DNA, 25 bp, Homo sapien
ggatcccagtacctgaatcctgaat

SEQ ID NO: 95898 - DNA, 25 bp, Homo sapien
acctgaatcctgaatcttagactct

SEQ ID NO: 95899 - DNA, 25 bp, Homo sapien
ttagactcttatacttcaaacactg

SEQ ID NO: 95900 - DNA, 25 bp, Homo sapien
gatcacgggaacagccggctcagca

SEQ ID NO: 95901 - DNA, 25 bp, Homo sapien
agcagctcctgagttcctaatgctc

SEQ ID NO: 95902 - DNA, 25 bp, Homo sapien
gggtaattcgtcacatggcaacagc

SEQ ID NO: 95903 - DNA, 25 bp, Homo sapien
atggcaacagctggctaatacatat

SEQ ID NO: 95904 - DNA, 25 bp, Homo sapien
cgcaagatgactgtcaacggcgctc

SEQ ID NO: 95905 - DNA, 25 bp, Homo sapien
gcaagatgactgtcaacggcgctcc

SEQ ID NO: 95906 - DNA, 25 bp, Homo sapien
caagatgactgtcaacggcgctccc

SEQ ID NO: 95907 - DNA, 25 bp, Homo sapien
aagatgactgtcaacggcgctcccg

SEQ ID NO: 95908 - DNA, 25 bp, Homo sapien
agatgactgtcaacggcgctcccgt

SEQ ID NO: 95909 - DNA, 25 bp, Homo sapien
gatgactgtcaacggcgctcccgtg

SEQ ID NO: 95910 - DNA, 25 bp, Homo sapien
gtgccccccttaacttgaggccagg

SEQ ID NO: 95911 - DNA, 25 bp, Homo sapien
ttcgacagccagtggggccaccaca

SEQ ID NO: 95912 - DNA, 25 bp, Homo sapien
tggggccaccacagctgccaacggg

SEQ ID NO: 95913 - DNA, 25 bp, Homo sapien
ccaacgggggtagcttgaactgcct

SEQ ID NO: 95914 - DNA, 25 bp, Homo sapien
acgggggtagcttgaactgcctgca

SEQ ID NO: 95915 - DNA, 25 bp, Homo sapien
gatgagctttaatctccgagcctgt

SEQ ID NO: 95916 - DNA, 25 bp, Homo sapien
tccgagcctgtctcagtagagtact

SEQ ID NO: 95917 - DNA, 25 bp, Homo sapien
cagtagagtactggctccttttata

SEQ ID NO: 95918 - DNA, 25 bp, Homo sapien
gttaccagctttacttttgtgataa

SEQ ID NO: 95919 - DNA, 25 bp, Homo sapien
gatgttgtattttacactcttaagt

SEQ ID NO: 95920 - DNA, 25 bp, Homo sapien
gtcttaaccacagtcagaattatct

SEQ ID NO: 95921 - DNA, 25 bp, Homo sapien
gaatggtgacaaaaagctctctgaa

SEQ ID NO: 95922 - DNA, 25 bp, Homo sapien
gagattctggaaaacccggacttgt

SEQ ID NO: 95923 - DNA, 25 bp, Homo sapien
ccggacttgtttctcaccagtgaag

SEQ ID NO: 95924 - DNA, 25 bp, Homo sapien
cacagattatggcagacagctccat

SEQ ID NO: 95925 - DNA, 25 bp, Homo sapien
acagctccatgatgactatttctat

SEQ ID NO: 95926 - DNA, 25 bp, Homo sapien
gctgcccccttgtacagaatcgaac

SEQ ID NO: 95927 - DNA, 25 bp, Homo sapien
ccccttgtacagaatcgaactctgc

SEQ ID NO: 95928 - DNA, 25 bp, Homo sapien
ttgtacagaatcgaactctgcactt

SEQ ID NO: 95929 - DNA, 25 bp, Homo sapien
gtacagaatcgaactctgcacttct

SEQ ID NO: 95930 - DNA, 25 bp, Homo sapien
acagaatcgaactctgcacttctct

SEQ ID NO: 95931 - DNA, 25 bp, Homo sapien
cagaatcgaactctgcacttctctc

SEQ ID NO: 95932 - DNA, 25 bp, Homo sapien
acttctctctcctttacgagacgaa

SEQ ID NO: 95933 - DNA, 25 bp, Homo sapien
cttctctctcctttacgagacgaaa

SEQ ID NO: 95934 - DNA, 25 bp, Homo sapien
ttctctctcctttacgagacgaaaa

SEQ ID NO: 95935 - DNA, 25 bp, Homo sapien
ctctctcctttacgagacgaaaagg

SEQ ID NO: 95936 - DNA, 25 bp, Homo sapien
agcaaaccagaatcttatttatatt

SEQ ID NO: 95937 - DNA, 25 bp, Homo sapien
ggcccaggtcctctactgtgaagga

SEQ ID NO: 95938 - DNA, 25 bp, Homo sapien
aggtcctctactgtgaaggagcagg

SEQ ID NO: 95939 - DNA, 25 bp, Homo sapien
ggtggaaggctctttgccttgtcca

SEQ ID NO: 95940 - DNA, 25 bp, Homo sapien
tttgccttgtccaccagggctcagc

SEQ ID NO: 95941 - DNA, 25 bp, Homo sapien
agcgggcagggagagccagtcctgt

SEQ ID NO: 95942 - DNA, 25 bp, Homo sapien
agtcctgtcggctgggcccttggac

SEQ ID NO: 95943 - DNA, 25 bp, Homo sapien
ctgggcccttggacggctgtcagtt

SEQ ID NO: 95944 - DNA, 25 bp, Homo sapien
ggacggctgtcagttttgcacatga

SEQ ID NO: 95945 - DNA, 25 bp, Homo sapien
gttttgcacatgatgttcctattgt

SEQ ID NO: 95946 - DNA, 25 bp, Homo sapien
gatgttcctattgtaactctcagag

SEQ ID NO: 95947 - DNA, 25 bp, Homo sapien
taactctcagagaccttaaaaagaa

SEQ ID NO: 95948 - DNA, 25 bp, Homo sapien
tcaccaataaataatctgcacttcc

SEQ ID NO: 95949 - DNA, 25 bp, Homo sapien
caccaataaataatctgcacttcca

SEQ ID NO: 95950 - DNA, 25 bp, Homo sapien
accaataaataatctgcacttccag

SEQ ID NO: 95951 - DNA, 25 bp, Homo sapien
ccaataaataatctgcacttccaga

SEQ ID NO: 95952 - DNA, 25 bp, Homo sapien
caataaataatctgcacttccagag

SEQ ID NO: 95953 - DNA, 25 bp, Homo sapien
accccaacatccctgaatctccacc

SEQ ID NO: 95954 - DNA, 25 bp, Homo sapien
aacatccctgaatctccacccacct

SEQ ID NO: 95955 - DNA, 25 bp, Homo sapien
acatccctgaatctccacccacctc

SEQ ID NO: 95956 - DNA, 25 bp, Homo sapien
ctgccctccagactgtctgcccata

SEQ ID NO: 95957 - DNA, 25 bp, Homo sapien
tgccctccagactgtctgcccatac

SEQ ID NO: 95958 - DNA, 25 bp, Homo sapien
gccctccagactgtctgcccataca

SEQ ID NO: 95959 - DNA, 25 bp, Homo sapien
tgcgtaagctgcagcactgtcgaga

SEQ ID NO: 95960 - DNA, 25 bp, Homo sapien
agcactgtcgagaagagctgaacca

SEQ ID NO: 95961 - DNA, 25 bp, Homo sapien
cctcccagaaggcaatgtgggcgat

SEQ ID NO: 95962 - DNA, 25 bp, Homo sapien
tgatggtggtgattgctgcagcact

SEQ ID NO: 95963 - DNA, 25 bp, Homo sapien
agtgttcctggccaataaagacaac

SEQ ID NO: 95964 - DNA, 25 bp, Homo sapien
gacaacctgatgatctgaataattt

SEQ ID NO: 95965 - DNA, 25 bp, Homo sapien
atcagaagcaagcaactcagcgaaa

SEQ ID NO: 95966 - DNA, 25 bp, Homo sapien
actcagaaggtttgggtacattaca

SEQ ID NO: 95967 - DNA, 25 bp, Homo sapien
acattacagcttgggttttccaact

SEQ ID NO: 95968 - DNA, 25 bp, Homo sapien
gttttccaactgacttaggatttct

SEQ ID NO: 95969 - DNA, 25 bp, Homo sapien
actgacttaggatttctgacttttt

SEQ ID NO: 95970 - DNA, 25 bp, Homo sapien
gctggctgggcaaaagggctcctca

SEQ ID NO: 95971 - DNA, 25 bp, Homo sapien
ctggctgggcaaaagggctcctcac

SEQ ID NO: 95972 - DNA, 25 bp, Homo sapien
tggctgggcaaaagggctcctcact

SEQ ID NO: 95973 - DNA, 25 bp, Homo sapien
ggctgggcaaaagggctcctcactt

SEQ ID NO: 95974 - DNA, 25 bp, Homo sapien
gctgggcaaaagggctcctcacttc

SEQ ID NO: 95975 - DNA, 25 bp, Homo sapien
ctgggcaaaagggctcctcacttcc

SEQ ID NO: 95976 - DNA, 25 bp, Homo sapien
agaggcgcccctcacttccccgatg

SEQ ID NO: 95977 - DNA, 25 bp, Homo sapien
gaggcgcccctcacttccccgatgg

SEQ ID NO: 95978 - DNA, 25 bp, Homo sapien
aggcgcccctcacttccccgatggg

SEQ ID NO: 95979 - DNA, 25 bp, Homo sapien
ctcacttccccgatggggcggctgg

SEQ ID NO: 95980 - DNA, 25 bp, Homo sapien
tcacttccccgatggggcggctggc

SEQ ID NO: 95981 - DNA, 25 bp, Homo sapien
tgcctctgaggatatttctggctgt

SEQ ID NO: 95982 - DNA, 25 bp, Homo sapien
gcctctgaggatatttctggctgtc

SEQ ID NO: 95983 - DNA, 25 bp, Homo sapien
cctctgaggatatttctggctgtcg

SEQ ID NO: 95984 - DNA, 25 bp, Homo sapien
ctctgaggatatttctggctgtcgc

SEQ ID NO: 95985 - DNA, 25 bp, Homo sapien
tctgaggatatttctggctgtcgcc

SEQ ID NO: 95986 - DNA, 25 bp, Homo sapien
ctgaggatatttctggctgtcgcca

SEQ ID NO: 95987 - DNA, 25 bp, Homo sapien
ctggctgtcgccaactccatggctt

SEQ ID NO: 95988 - DNA, 25 bp, Homo sapien
tggctgtcgccaactccatggcttt

SEQ ID NO: 95989 - DNA, 25 bp, Homo sapien
ggctgtcgccaactccatggctttc

SEQ ID NO: 95990 - DNA, 25 bp, Homo sapien
gctgtcgccaactccatggctttcc

SEQ ID NO: 95991 - DNA, 25 bp, Homo sapien
tgtcgccaactccatggctttccag

SEQ ID NO: 95992 - DNA, 25 bp, Homo sapien
gctgcttttagatggaggctaccta

SEQ ID NO: 95993 - DNA, 25 bp, Homo sapien
ggaggctacctacaaagaacaacat

SEQ ID NO: 95994 - DNA, 25 bp, Homo sapien
tgacagaaggtcatcccaggaaagg

SEQ ID NO: 95995 - DNA, 25 bp, Homo sapien
gagagaactcttagggcaagatgaa

SEQ ID NO: 95996 - DNA, 25 bp, Homo sapien
aattgtcataggagggaagcttcaa

SEQ ID NO: 95997 - DNA, 25 bp, Homo sapien
gtcatgaaaccaatcaacagccaag

SEQ ID NO: 95998 - DNA, 25 bp, Homo sapien
agccaagtcagcaagcaatcaggta

SEQ ID NO: 95999 - DNA, 25 bp, Homo sapien
aggtaatgatgtgcgagtcccctca

SEQ ID NO: 96000 - DNA, 25 bp, Homo sapien
gtgcgagtcccctcaggttatagaa

SEQ ID NO: 96001 - DNA, 25 bp, Homo sapien
agtcccctcaggttatagaaattat

SEQ ID NO: 96002 - DNA, 25 bp, Homo sapien
tgtctttttgtgtaatggactgggc

SEQ ID NO: 96003 - DNA, 25 bp, Homo sapien
catgaatgacttttatccgggaatc

SEQ ID NO: 96004 - DNA, 25 bp, Homo sapien
atgaatgacttttatccgggaatct

SEQ ID NO: 96005 - DNA, 25 bp, Homo sapien
atccgggaatcttgacggtgacctg

SEQ ID NO: 96006 - DNA, 25 bp, Homo sapien
tccgggaatcttgacggtgacctgg

SEQ ID NO: 96007 - DNA, 25 bp, Homo sapien
tgacctggaaggcagatggtacccc

SEQ ID NO: 96008 - DNA, 25 bp, Homo sapien
ccccatcacccagggcgtggagatg

SEQ ID NO: 96009 - DNA, 25 bp, Homo sapien
cccatcacccagggcgtggagatga

SEQ ID NO: 96010 - DNA, 25 bp, Homo sapien
ccatcacccagggcgtggagatgac

SEQ ID NO: 96011 - DNA, 25 bp, Homo sapien
cgtggagatgaccacgccctccaaa

SEQ ID NO: 96012 - DNA, 25 bp, Homo sapien
tggagatgaccacgccctccaaaca

SEQ ID NO: 96013 - DNA, 25 bp, Homo sapien
aatgttcataggttcccagccccga

SEQ ID NO: 96014 - DNA, 25 bp, Homo sapien
aatcgccttccatggtttttaaatg

SEQ ID NO: 96015 - DNA, 25 bp, Homo sapien
gtttcccctttgtgagggtgtcaag

SEQ ID NO: 96016 - DNA, 25 bp, Homo sapien
gagggtgtcaagtagcctcaccggc

SEQ ID NO: 96017 - DNA, 25 bp, Homo sapien
ctcaccggcctgtctggaggagcag

SEQ ID NO: 96018 - DNA, 25 bp, Homo sapien
gagcagctggctctgctctgagaaa

SEQ ID NO: 96019 - DNA, 25 bp, Homo sapien
tctgctctgagaaactctggcaagt

SEQ ID NO: 96020 - DNA, 25 bp, Homo sapien
ctggcaagtggacgccattctcttg

SEQ ID NO: 96021 - DNA, 25 bp, Homo sapien
tctcttgcccttaggattcactgct

SEQ ID NO: 96022 - DNA, 25 bp, Homo sapien
taggattcactgctctctcctacag

SEQ ID NO: 96023 - DNA, 25 bp, Homo sapien
gaccttgggtggtaaagctgtactt

SEQ ID NO: 96024 - DNA, 25 bp, Homo sapien
gggaggaaccatgcaaatcgccttc

SEQ ID NO: 96025 - DNA, 25 bp, Homo sapien
gcagtccctccggagaggatctgga

SEQ ID NO: 96026 - DNA, 25 bp, Homo sapien
cagtccctccggagaggatctggac

SEQ ID NO: 96027 - DNA, 25 bp, Homo sapien
agtccctccggagaggatctggact

SEQ ID NO: 96028 - DNA, 25 bp, Homo sapien
gtccctccggagaggatctggactg

SEQ ID NO: 96029 - DNA, 25 bp, Homo sapien
tccctccggagaggatctggactgg

SEQ ID NO: 96030 - DNA, 25 bp, Homo sapien
ccctccggagaggatctggactggc

SEQ ID NO: 96031 - DNA, 25 bp, Homo sapien
cctccggagaggatctggactggct

SEQ ID NO: 96032 - DNA, 25 bp, Homo sapien
ctccggagaggatctggactggctg

SEQ ID NO: 96033 - DNA, 25 bp, Homo sapien
tccggagaggatctggactggctgg

SEQ ID NO: 96034 - DNA, 25 bp, Homo sapien
cggagaggatctggactggctggga

SEQ ID NO: 96035 - DNA, 25 bp, Homo sapien
ggagaggatctggactggctgggag

SEQ ID NO: 96036 - DNA, 25 bp, Homo sapien
gaagctccagaaagaggcaagctct

SEQ ID NO: 96037 - DNA, 25 bp, Homo sapien
tttagccattcacagaagccctggg

SEQ ID NO: 96038 - DNA, 25 bp, Homo sapien
ccctgggcatcacggagcacaagct

SEQ ID NO: 96039 - DNA, 25 bp, Homo sapien
agcacaagctccatagtgtcagcct

SEQ ID NO: 96040 - DNA, 25 bp, Homo sapien
atagtgtcagccttccggcagggcc

SEQ ID NO: 96041 - DNA, 25 bp, Homo sapien
tgtctgcagagacgccacctggcgt

SEQ ID NO: 96042 - DNA, 25 bp, Homo sapien
acgccacctggcgttctgagttttt

SEQ ID NO: 96043 - DNA, 25 bp, Homo sapien
ggcgttctgagtttttcccaggaag

SEQ ID NO: 96044 - DNA, 25 bp, Homo sapien
gattcatggttttgactcttttccc

SEQ ID NO: 96045 - DNA, 25 bp, Homo sapien
catggttttgactcttttcccagcc

SEQ ID NO: 96046 - DNA, 25 bp, Homo sapien
agccccacaggaagacttcagcaac

SEQ ID NO: 96047 - DNA, 25 bp, Homo sapien
gaccgggggtgtccagaaatatcct

SEQ ID NO: 96048 - DNA, 25 bp, Homo sapien
taactcagccgaggtgggaaatggt

SEQ ID NO: 96049 - DNA, 25 bp, Homo sapien
caaagcacagagcacagaaatgagg

SEQ ID NO: 96050 - DNA, 25 bp, Homo sapien
cagagcacagaaatgaggccgttta

SEQ ID NO: 96051 - DNA, 25 bp, Homo sapien
ggccgtttacatggcgagtctccgt

SEQ ID NO: 96052 - DNA, 25 bp, Homo sapien
gtttacatggcgagtctccgtgctg

SEQ ID NO: 96053 - DNA, 25 bp, Homo sapien
acatggcgagtctccgtgctggtgt

SEQ ID NO: 96054 - DNA, 25 bp, Homo sapien
ggcgagtctccgtgctggtgtttaa

SEQ ID NO: 96055 - DNA, 25 bp, Homo sapien
gagtctccgtgctggtgtttaagtc

SEQ ID NO: 96056 - DNA, 25 bp, Homo sapien
gtctccgtgctggtgtttaagtcat

SEQ ID NO: 96057 - DNA, 25 bp, Homo sapien
ctccgtgctggtgtttaagtcatta

SEQ ID NO: 96058 - DNA, 25 bp, Homo sapien
gggcctgaagacctctctactgaga

SEQ ID NO: 96059 - DNA, 25 bp, Homo sapien
gaagacctctctactgagacatata

SEQ ID NO: 96060 - DNA, 25 bp, Homo sapien
ggatgtgcctaaagaatgctttcca

SEQ ID NO: 96061 - DNA, 25 bp, Homo sapien
ctaaagaatgctttccagaaccaca

SEQ ID NO: 96062 - DNA, 25 bp, Homo sapien
caccaagaaacaggtgggccccaag

SEQ ID NO: 96063 - DNA, 25 bp, Homo sapien
gggccccaaggccaggatcctaaag

SEQ ID NO: 96064 - DNA, 25 bp, Homo sapien
ggatcctaaagcacaccaggaagat

SEQ ID NO: 96065 - DNA, 25 bp, Homo sapien
taaagatgcttatacttttcctcaa

SEQ ID NO: 96066 - DNA, 25 bp, Homo sapien
agaagagccaggaataccagcaatt

SEQ ID NO: 96067 - DNA, 25 bp, Homo sapien
ccagcaattctgaatgagagtcatc

SEQ ID NO: 96068 - DNA, 25 bp, Homo sapien
gttttaacaatgctcaaccataaag

SEQ ID NO: 96069 - DNA, 25 bp, Homo sapien
ttagcaaatttttgattctccattt

SEQ ID NO: 96070 - DNA, 25 bp, Homo sapien
attttccaaaagtaagagactccag

SEQ ID NO: 96071 - DNA, 25 bp, Homo sapien
agcatggccttctgtttgccccgca

SEQ ID NO: 96072 - DNA, 25 bp, Homo sapien
tgtttgccccgcagtaaagtaactt

SEQ ID NO: 96073 - DNA, 25 bp, Homo sapien
tgccccgcagtaaagtaacttccat

SEQ ID NO: 96074 - DNA, 25 bp, Homo sapien
gacaacagaccgttttccatttcat

SEQ ID NO: 96075 - DNA, 25 bp, Homo sapien
atctgtattttatctccgtgactcc

SEQ ID NO: 96076 - DNA, 25 bp, Homo sapien
tgtattttatctccgtgactccaac

SEQ ID NO: 96077 - DNA, 25 bp, Homo sapien
tatctccgtgactccaacttgtggg

SEQ ID NO: 96078 - DNA, 25 bp, Homo sapien
actccaacttgtgggtttgttctgt

SEQ ID NO: 96079 - DNA, 25 bp, Homo sapien
gttctgtttttccatgagaataaaa

SEQ ID NO: 96080 - DNA, 25 bp, Homo sapien
ttgtcgtacctcacgcaatttaacc

SEQ ID NO: 96081 - DNA, 25 bp, Homo sapien
aatttaaccgcttgcttgcggacca

SEQ ID NO: 96082 - DNA, 25 bp, Homo sapien
gaccacttgacgcaattcgttttgt

SEQ ID NO: 96083 - DNA, 25 bp, Homo sapien
atcaaactcatcgtggtccaatgct

SEQ ID NO: 96084 - DNA, 25 bp, Homo sapien
agacatcagcgactgttgggccgta

SEQ ID NO: 96085 - DNA, 25 bp, Homo sapien
gccgtattttcgctccaaagtgtga

SEQ ID NO: 96086 - DNA, 25 bp, Homo sapien
gtgtgaatcagctgcaagcggtctt

SEQ ID NO: 96087 - DNA, 25 bp, Homo sapien
caagcggtcttcaatgcgtaacaat

SEQ ID NO: 96088 - DNA, 25 bp, Homo sapien
tgcgtaacaattccgattcgtcata

SEQ ID NO: 96089 - DNA, 25 bp, Homo sapien
agttaacgcgccgatttgttcatcc

SEQ ID NO: 96090 - DNA, 25 bp, Homo sapien
ggccaacttcttgcaccgtataata

SEQ ID NO: 96091 - DNA, 25 bp, Homo sapien
tcgccggctccctaatatttagggc

SEQ ID NO: 96092 - DNA, 25 bp, Homo sapien
gggcaataagcagcattggcctgga

SEQ ID NO: 96093 - DNA, 25 bp, Homo sapien
attggcctggagtgccagagcgtca

SEQ ID NO: 96094 - DNA, 25 bp, Homo sapien
tggagtgccagagcgtcacctccag

SEQ ID NO: 96095 - DNA, 25 bp, Homo sapien
gtcaccggctgcacttgtggctccg

SEQ ID NO: 96096 - DNA, 25 bp, Homo sapien
tgcacttgtggctccgcctgtggct

SEQ ID NO: 96097 - DNA, 25 bp, Homo sapien
atgtgcgcgccgagaccacatgtca

SEQ ID NO: 96098 - DNA, 25 bp, Homo sapien
gagaccacatgtcactgccagtgcg

SEQ ID NO: 96099 - DNA, 25 bp, Homo sapien
atgtcactgccagtgcgcgggcatg

SEQ ID NO: 96100 - DNA, 25 bp, Homo sapien
gcatggactggaccggagcgcgctg

SEQ ID NO: 96101 - DNA, 25 bp, Homo sapien
ctgtcgtgtgcagccctgaggtcgc

SEQ ID NO: 96102 - DNA, 25 bp, Homo sapien
tctccctctccaagcatctgtaagt

SEQ ID NO: 96103 - DNA, 25 bp, Homo sapien
tccctctccaagcatctgtaagttg

SEQ ID NO: 96104 - DNA, 25 bp, Homo sapien
tctccaagcatctgtaagttgcact

SEQ ID NO: 96105 - DNA, 25 bp, Homo sapien
tccaagcatctgtaagttgcactca

SEQ ID NO: 96106 - DNA, 25 bp, Homo sapien
aagcatctgtaagttgcactcagga

SEQ ID NO: 96107 - DNA, 25 bp, Homo sapien
gcatctgtaagttgcactcaggagg

SEQ ID NO: 96108 - DNA, 25 bp, Homo sapien
tgtaagttgcactcaggagggttta

SEQ ID NO: 96109 - DNA, 25 bp, Homo sapien
taagttgcactcaggagggtttagg

SEQ ID NO: 96110 - DNA, 25 bp, Homo sapien
ggcaggctggtctcgtgatagtgag

SEQ ID NO: 96111 - DNA, 25 bp, Homo sapien
tccaccatggccagaaacgtgcctg

SEQ ID NO: 96112 - DNA, 25 bp, Homo sapien
caccatggccagaaacgtgcctgct

SEQ ID NO: 96113 - DNA, 25 bp, Homo sapien
tccctctccaagcatctgtaagttg

SEQ ID NO: 96114 - DNA, 25 bp, Homo sapien
tctccaagcatctgtaagttgcact

SEQ ID NO: 96115 - DNA, 25 bp, Homo sapien
aagcatctgtaagttgcactcagga

SEQ ID NO: 96116 - DNA, 25 bp, Homo sapien
gcatctgtaagttgcactcaggagg

SEQ ID NO: 96117 - DNA, 25 bp, Homo sapien
tgtaagttgcactcaggagggttta

SEQ ID NO: 96118 - DNA, 25 bp, Homo sapien
taagttgcactcaggagggtttagg

SEQ ID NO: 96119 - DNA, 25 bp, Homo sapien
ggcaggctggtctcgtgatagtgag

SEQ ID NO: 96120 - DNA, 25 bp, Homo sapien
gtgctcatgggatctggttgtttag

SEQ ID NO: 96121 - DNA, 25 bp, Homo sapien
tttagaagcatgcagcacctcctgc

SEQ ID NO: 96122 - DNA, 25 bp, Homo sapien
tccaccatggccagaaacgtgcctg

SEQ ID NO: 96123 - DNA, 25 bp, Homo sapien
caccatggccagaaacgtgcctgct

SEQ ID NO: 96124 - DNA, 25 bp, Homo sapien
aagcacttgtactgtagccgagaag

SEQ ID NO: 96125 - DNA, 25 bp, Homo sapien
gtactgtagccgagaagaccaccat

SEQ ID NO: 96126 - DNA, 25 bp, Homo sapien
agaagaccaccatcatgcacataaa

SEQ ID NO: 96127 - DNA, 25 bp, Homo sapien
gaccaccatcatgcacataaaagga

SEQ ID NO: 96128 - DNA, 25 bp, Homo sapien
taaaaggagcttttcagcagccacc

SEQ ID NO: 96129 - DNA, 25 bp, Homo sapien
aaaggagcttttcagcagccaccct

SEQ ID NO: 96130 - DNA, 25 bp, Homo sapien
gcagcatctgcccacgaacagatgc

SEQ ID NO: 96131 - DNA, 25 bp, Homo sapien
tttgcaaaccccagcagtgaacttc

SEQ ID NO: 96132 - DNA, 25 bp, Homo sapien
cagcagtgaacttccctctctgtct

SEQ ID NO: 96133 - DNA, 25 bp, Homo sapien
aaagctaaaccaaatcattttatgg

SEQ ID NO: 96134 - DNA, 25 bp, Homo sapien
aatcattttatggtatgcagaggat

SEQ ID NO: 96135 - DNA, 25 bp, Homo sapien
ctgttagagctgaggtacgccatct

SEQ ID NO: 96136 - DNA, 25 bp, Homo sapien
tgaggtacgccatctccggagggtc

SEQ ID NO: 96137 - DNA, 25 bp, Homo sapien
ggagggtcctgtgtcaccgcttgat

SEQ ID NO: 96138 - DNA, 25 bp, Homo sapien
tgtgtcaccgcttgatgctaaaccc

SEQ ID NO: 96139 - DNA, 25 bp, Homo sapien
gatgctaaaccctcagcatgtgcag

SEQ ID NO: 96140 - DNA, 25 bp, Homo sapien
tcagcatgtgcagctcctttttgac

SEQ ID NO: 96141 - DNA, 25 bp, Homo sapien
tttttgacaatgaagttctccctga

SEQ ID NO: 96142 - DNA, 25 bp, Homo sapien
aagttctccctgatcacatgacaat

SEQ ID NO: 96143 - DNA, 25 bp, Homo sapien
atgaagcagatatggctctcccgct

SEQ ID NO: 96144 - DNA, 25 bp, Homo sapien
atggctctcccgctggttcggcaag

SEQ ID NO: 96145 - DNA, 25 bp, Homo sapien
atgtgaaatgaactgcagctttatt

SEQ ID NO: 96146 - DNA, 25 bp, Homo sapien
ttgtactgtttataagccttcaaac

SEQ ID NO: 96147 - DNA, 25 bp, Homo sapien
taagccttcaaacagtagttttaca

SEQ ID NO: 96148 - DNA, 25 bp, Homo sapien
acaatcatgctattcttacacttgc

SEQ ID NO: 96149 - DNA, 25 bp, Homo sapien
cttacacttgctattttatacttca

SEQ ID NO: 96150 - DNA, 25 bp, Homo sapien
tttgttatgctcaggaatctcttgt

SEQ ID NO: 96151 - DNA, 25 bp, Homo sapien
gctcaggaatctcttgtatatttta

SEQ ID NO: 96152 - DNA, 25 bp, Homo sapien
atttttaaatagtatctgtctccaa

SEQ ID NO: 96153 - DNA, 25 bp, Homo sapien
atctgtctccaatttatatcaagaa

SEQ ID NO: 96154 - DNA, 25 bp, Homo sapien
gaggaagcagcttgtttctaaacaa

SEQ ID NO: 96155 - DNA, 25 bp, Homo sapien
caaatagtgttatccttttacaatt

SEQ ID NO: 96156 - DNA, 25 bp, Homo sapien
taactgcacatcaattttatagact

SEQ ID NO: 96157 - DNA, 25 bp, Homo sapien
ccgtccgaggcctgcaggagacgtt

SEQ ID NO: 96158 - DNA, 25 bp, Homo sapien
atcggtggtcctgtgggacgtctct

SEQ ID NO: 96159 - DNA, 25 bp, Homo sapien
gtcctgtgggacgtctctgagcaga

SEQ ID NO: 96160 - DNA, 25 bp, Homo sapien
agcagaaggtgtgcagccgcatcgc

SEQ ID NO: 96161 - DNA, 25 bp, Homo sapien
agccgcatcgcctgccatgaggagc

SEQ ID NO: 96162 - DNA, 25 bp, Homo sapien
gaggaccagcaagtcatggcccaag

SEQ ID NO: 96163 - DNA, 25 bp, Homo sapien
atggcccaaggaccatggagtcccc

SEQ ID NO: 96164 - DNA, 25 bp, Homo sapien
gtcttcatgaggttggtatttcctt

SEQ ID NO: 96165 - DNA, 25 bp, Homo sapien
gtatttccttttgtggagtgcctca

SEQ ID NO: 96166 - DNA, 25 bp, Homo sapien
ttccttttgtggagtgcctcatcac

SEQ ID NO: 96167 - DNA, 25 bp, Homo sapien
gcctcatcacaggacggtgactctg

SEQ ID NO: 96168 - DNA, 25 bp, Homo sapien
cagtttctgcagaggattttgtgat

SEQ ID NO: 96169 - DNA, 25 bp, Homo sapien
gtctttgttatcaagcatttatgca

SEQ ID NO: 96170 - DNA, 25 bp, Homo sapien
gcatttatgcatgggaatccgctct

SEQ ID NO: 96171 - DNA, 25 bp, Homo sapien
atgggaatccgctcttcatggcctt

SEQ ID NO: 96172 - DNA, 25 bp, Homo sapien
ctctgtttgttttagtctttttgat

SEQ ID NO: 96173 - DNA, 25 bp, Homo sapien
caagtgactccattttaactctgac

SEQ ID NO: 96174 - DNA, 25 bp, Homo sapien
actttcacagctgtcaccagaatgc

SEQ ID NO: 96175 - DNA, 25 bp, Homo sapien
tgtcaccagaatgctccctgagaac

SEQ ID NO: 96176 - DNA, 25 bp, Homo sapien
tgagaactaccattctttccctttc

SEQ ID NO: 96177 - DNA, 25 bp, Homo sapien
atatttcatcagaacctcaccacta

SEQ ID NO: 96178 - DNA, 25 bp, Homo sapien
agaacctcaccactatcataaaaga

SEQ ID NO: 96179 - DNA, 25 bp, Homo sapien
ggctcggccgacaacgtcactgtga

SEQ ID NO: 96180 - DNA, 25 bp, Homo sapien
tcggccgacaacgtcactgtgatgg

SEQ ID NO: 96181 - DNA, 25 bp, Homo sapien
cggccgacaacgtcactgtgatggt

SEQ ID NO: 96182 - DNA, 25 bp, Homo sapien
gccgacaacgtcactgtgatggtgg

SEQ ID NO: 96183 - DNA, 25 bp, Homo sapien
gacaacgtcactgtgatggtggtgc

SEQ ID NO: 96184 - DNA, 25 bp, Homo sapien
acaacgtcactgtgatggtggtgcg

SEQ ID NO: 96185 - DNA, 25 bp, Homo sapien
cgtcactgtgatggtggtgcggata

SEQ ID NO: 96186 - DNA, 25 bp, Homo sapien
gatggtggtgcggatagggcactga

SEQ ID NO: 96187 - DNA, 25 bp, Homo sapien
gcgcggccaggagcacgcatggtat

SEQ ID NO: 96188 - DNA, 25 bp, Homo sapien
gcacgcatggtattgacttaaaagg

SEQ ID NO: 96189 - DNA, 25 bp, Homo sapien
cacgcatggtattgacttaaaaggt

SEQ ID NO: 96190 - DNA, 25 bp, Homo sapien
cgtttagcgccgcaggcgctattaa

SEQ ID NO: 96191 - DNA, 25 bp, Homo sapien
gccgcaggcgctattaacttgactt

SEQ ID NO: 96192 - DNA, 25 bp, Homo sapien
gcaggcgctattaacttgacttaca

SEQ ID NO: 96193 - DNA, 25 bp, Homo sapien
aggcgctattaacttgacttacaat

SEQ ID NO: 96194 - DNA, 25 bp, Homo sapien
gctattaacttgacttacaatacaa

SEQ ID NO: 96195 - DNA, 25 bp, Homo sapien
aaaggatttaatgcatcattccata

SEQ ID NO: 96196 - DNA, 25 bp, Homo sapien
ggatttaatgcatcattccataaat

SEQ ID NO: 96197 - DNA, 25 bp, Homo sapien
tttgccgttcaaaatttctagagaa

SEQ ID NO: 96198 - DNA, 25 bp, Homo sapien
gagaattttacactccttatattat

SEQ ID NO: 96199 - DNA, 25 bp, Homo sapien
tacactccttatattattaggaaag

SEQ ID NO: 96200 - DNA, 25 bp, Homo sapien
ataacgttgttattgtggagaatgt

SEQ ID NO: 96201 - DNA, 25 bp, Homo sapien
gcttgttttgttgtctgtgtctgtc

SEQ ID NO: 96202 - DNA, 25 bp, Homo sapien
gtctgtctgaataacctgcgtgtct

SEQ ID NO: 96203 - DNA, 25 bp, Homo sapien
taccttgacagaatcatgggacttt

SEQ ID NO: 96204 - DNA, 25 bp, Homo sapien
aggacagaggcctctgtcgcactaa

SEQ ID NO: 96205 - DNA, 25 bp, Homo sapien
cactaacgctctcgtggttgctcga

SEQ ID NO: 96206 - DNA, 25 bp, Homo sapien
ggttgctcgactgttgtatctgtga

SEQ ID NO: 96207 - DNA, 25 bp, Homo sapien
tccgactaaggactctgggctggca

SEQ ID NO: 96208 - DNA, 25 bp, Homo sapien
gcagggccttctgccgggaaagcta

SEQ ID NO: 96209 - DNA, 25 bp, Homo sapien
gaaacactaggttcttcctgtacat

SEQ ID NO: 96210 - DNA, 25 bp, Homo sapien
aggttcttcctgtacatacgtgtat

SEQ ID NO: 96211 - DNA, 25 bp, Homo sapien
gaacagtgagatggccgtttctgac

SEQ ID NO: 96212 - DNA, 25 bp, Homo sapien
ttctataattagcgttcttcacccc

SEQ ID NO: 96213 - DNA, 25 bp, Homo sapien
gagaggattaggtacttaggagcaa

SEQ ID NO: 96214 - DNA, 25 bp, Homo sapien
ggattaggtacttaggagcaaagaa

SEQ ID NO: 96215 - DNA, 25 bp, Homo sapien
aacttttgagatgatccctaacata

SEQ ID NO: 96216 - DNA, 25 bp, Homo sapien
actacttgcttttacaatgtgttag

SEQ ID NO: 96217 - DNA, 25 bp, Homo sapien
atgtgttagcagaaaccagtgggtt

SEQ ID NO: 96218 - DNA, 25 bp, Homo sapien
gaaaccagtgggttataatgtagaa

SEQ ID NO: 96219 - DNA, 25 bp, Homo sapien
agtggtaattcatcttggtttgcta

SEQ ID NO: 96220 - DNA, 25 bp, Homo sapien
ggtaattcatcttggtttgctatgt

SEQ ID NO: 96221 - DNA, 25 bp, Homo sapien
attcatcttggtttgctatgttaaa

SEQ ID NO: 96222 - DNA, 25 bp, Homo sapien
atcttggtttgctatgttaaaactg

SEQ ID NO: 96223 - DNA, 25 bp, Homo sapien
gacaacagccaatttatagtgcaat

SEQ ID NO: 96224 - DNA, 25 bp, Homo sapien
gactatttgaagcacaacctaatgg

SEQ ID NO: 96225 - DNA, 25 bp, Homo sapien
ggaaaattgtagagaccttgcttta

SEQ ID NO: 96226 - DNA, 25 bp, Homo sapien
gtagagaccttgctttaacattatc

SEQ ID NO: 96227 - DNA, 25 bp, Homo sapien
atctccagttaattaagtgttcatg

SEQ ID NO: 96228 - DNA, 25 bp, Homo sapien
aagtgttcatgtggtgcttggaaac

SEQ ID NO: 96229 - DNA, 25 bp, Homo sapien
tgtggtgcttggaaactgttgtttt

SEQ ID NO: 96230 - DNA, 25 bp, Homo sapien
gttttcctgaacatctaaagtgtgt

SEQ ID NO: 96231 - DNA, 25 bp, Homo sapien
tctaaagtgtgtagactgcattctt

SEQ ID NO: 96232 - DNA, 25 bp, Homo sapien
tttattcttgtaatgtgaccttttc

SEQ ID NO: 96233 - DNA, 25 bp, Homo sapien
aatgtgaccttttcactgtgcaaag

SEQ ID NO: 96234 - DNA, 25 bp, Homo sapien
aaagacatggcaaccgttcagtggt

SEQ ID NO: 96235 - DNA, 25 bp, Homo sapien
gacatggcaaccgttcagtggtact

SEQ ID NO: 96236 - DNA, 25 bp, Homo sapien
atggcaaccgttcagtggtacttaa

SEQ ID NO: 96237 - DNA, 25 bp, Homo sapien
gcaaccgttcagtggtacttaagta

SEQ ID NO: 96238 - DNA, 25 bp, Homo sapien
cgttcagtggtacttaagtattcaa

SEQ ID NO: 96239 - DNA, 25 bp, Homo sapien
aaatatacaactacagattctctga

SEQ ID NO: 96240 - DNA, 25 bp, Homo sapien
attctctgacagaaaccagcacggg

SEQ ID NO: 96241 - DNA, 25 bp, Homo sapien
agcacggggtcttcaccttcattca

SEQ ID NO: 96242 - DNA, 25 bp, Homo sapien
agaacagcatctcagtggtgatttc

SEQ ID NO: 96243 - DNA, 25 bp, Homo sapien
acagcatctcagtggtgatttccaa

SEQ ID NO: 96244 - DNA, 25 bp, Homo sapien
ggtgatttccaaaccaagcctttgt

SEQ ID NO: 96245 - DNA, 25 bp, Homo sapien
gcacccgggtcacaccaagcactgt

SEQ ID NO: 96246 - DNA, 25 bp, Homo sapien
actgtcagctctgtgatcagcagct

SEQ ID NO: 96247 - DNA, 25 bp, Homo sapien
tgtcagctctgtgatcagcagctgc

SEQ ID NO: 96248 - DNA, 25 bp, Homo sapien
agctctgtgatcagcagctgcccgg

SEQ ID NO: 96249 - DNA, 25 bp, Homo sapien
tgctctacctcaacctggagtcctg

SEQ ID NO: 96250 - DNA, 25 bp, Homo sapien
gcctggaggaagtccagtggtgtct

SEQ ID NO: 96251 - DNA, 25 bp, Homo sapien
aagtccagtggtgtctggagcagct

SEQ ID NO: 96252 - DNA, 25 bp, Homo sapien
gctaggcagccacagacctgggaca

SEQ ID NO: 96253 - DNA, 25 bp, Homo sapien
cacagacctgggacacctcagccag

SEQ ID NO: 96254 - DNA, 25 bp, Homo sapien
tccacctttgcccaatttcagatat

SEQ ID NO: 96255 - DNA, 25 bp, Homo sapien
agatatttgagcattttgttaaaat

SEQ ID NO: 96256 - DNA, 25 bp, Homo sapien
attgatttactctgctgtataatac

SEQ ID NO: 96257 - DNA, 25 bp, Homo sapien
ttgatttactctgctgtataatact

SEQ ID NO: 96258 - DNA, 25 bp, Homo sapien
gatttactctgctgtataatacttt

SEQ ID NO: 96259 - DNA, 25 bp, Homo sapien
tttactctgctgtataatactttcc

SEQ ID NO: 96260 - DNA, 25 bp, Homo sapien
tactctgctgtataatactttccat

SEQ ID NO: 96261 - DNA, 25 bp, Homo sapien
actctgctgtataatactttccatt

SEQ ID NO: 96262 - DNA, 25 bp, Homo sapien
gctgtataatactttccattttcta

SEQ ID NO: 96263 - DNA, 25 bp, Homo sapien
tgtataatactttccattttctaga

SEQ ID NO: 96264 - DNA, 25 bp, Homo sapien
gtataatactttccattttctagaa

SEQ ID NO: 96265 - DNA, 25 bp, Homo sapien
ataatactttccattttctagaatt

SEQ ID NO: 96266 - DNA, 25 bp, Homo sapien
taatactttccattttctagaattt

SEQ ID NO: 96267 - DNA, 25 bp, Homo sapien
cttcctggagagatgctacaatgca

SEQ ID NO: 96268 - DNA, 25 bp, Homo sapien
caatgcaatatacagcgctccatcc

SEQ ID NO: 96269 - DNA, 25 bp, Homo sapien
ggaagctgctgtgatgagactagat

SEQ ID NO: 96270 - DNA, 25 bp, Homo sapien
gagactagatgagccttcaacacac

SEQ ID NO: 96271 - DNA, 25 bp, Homo sapien
gatgagccttcaacacactcagaaa

SEQ ID NO: 96272 - DNA, 25 bp, Homo sapien
cagctcctacctgtgtttctaggag

SEQ ID NO: 96273 - DNA, 25 bp, Homo sapien
aagagagggaactaattgcccgtga

SEQ ID NO: 96274 - DNA, 25 bp, Homo sapien
attgcccgtgaagacgccagtggaa

SEQ ID NO: 96275 - DNA, 25 bp, Homo sapien
gaaggatcagcctcattctaagcaa

SEQ ID NO: 96276 - DNA, 25 bp, Homo sapien
gtattagtgatactcttactgcctt

SEQ ID NO: 96277 - DNA, 25 bp, Homo sapien
tactgccttatcttaaccaaggact

SEQ ID NO: 96278 - DNA, 25 bp, Homo sapien
ttacacttctgtagataaaaactgt

SEQ ID NO: 96279 - DNA, 25 bp, Homo sapien
aaaactgtattatacacatgcatat

SEQ ID NO: 96280 - DNA, 25 bp, Homo sapien
atatatatgaatgcttaggtggtaa

SEQ ID NO: 96281 - DNA, 25 bp, Homo sapien
gaaatgactgcattatattaagact

SEQ ID NO: 96282 - DNA, 25 bp, Homo sapien
attaagactaatggctacttttcaa

SEQ ID NO: 96283 - DNA, 25 bp, Homo sapien
agtggagtatgtaaggtgcttgcaa

SEQ ID NO: 96284 - DNA, 25 bp, Homo sapien
aaggtgcttgcaatgtaatatttct

SEQ ID NO: 96285 - DNA, 25 bp, Homo sapien
gcttgcaatgtaatatttcttggcc

SEQ ID NO: 96286 - DNA, 25 bp, Homo sapien
atatttcttggcctatgtggtgttt

SEQ ID NO: 96287 - DNA, 25 bp, Homo sapien
ctttgtgataaatcagtaagctgta

SEQ ID NO: 96288 - DNA, 25 bp, Homo sapien
cagtaagctgtagttctttgttttt

SEQ ID NO: 96289 - DNA, 25 bp, Homo sapien
ctgtaagtgctcaagttaaagaaag

SEQ ID NO: 96290 - DNA, 25 bp, Homo sapien
tgtaagtgctcaagttaaagaaaga

SEQ ID NO: 96291 - DNA, 25 bp, Homo sapien
gtaagtgctcaagttaaagaaagag

SEQ ID NO: 96292 - DNA, 25 bp, Homo sapien
taagtgctcaagttaaagaaagagt

SEQ ID NO: 96293 - DNA, 25 bp, Homo sapien
aagtgctcaagttaaagaaagagtc

SEQ ID NO: 96294 - DNA, 25 bp, Homo sapien
gtgctcaagttaaagaaagagtcgg

SEQ ID NO: 96295 - DNA, 25 bp, Homo sapien
tgctcaagttaaagaaagagtcggc

SEQ ID NO: 96296 - DNA, 25 bp, Homo sapien
gctcaagttaaagaaagagtcggcc

SEQ ID NO: 96297 - DNA, 25 bp, Homo sapien
ctcaagttaaagaaagagtcggccg

SEQ ID NO: 96298 - DNA, 25 bp, Homo sapien
tcaagttaaagaaagagtcggccgg

SEQ ID NO: 96299 - DNA, 25 bp, Homo sapien
ttaaagaaagagtcggccgggcgcg

SEQ ID NO: 96300 - DNA, 25 bp, Homo sapien
agctggaccgactcagagctcagca

SEQ ID NO: 96301 - DNA, 25 bp, Homo sapien
ggaccgactcagagctcagcagccg

SEQ ID NO: 96302 - DNA, 25 bp, Homo sapien
gactcagagctcagcagccgcgagc

SEQ ID NO: 96303 - DNA, 25 bp, Homo sapien
acggagcttggcgtctgccggtctc

SEQ ID NO: 96304 - DNA, 25 bp, Homo sapien
gagcttggcgtctgccggtctccat

SEQ ID NO: 96305 - DNA, 25 bp, Homo sapien
gtctccatccccttgttcgggagga

SEQ ID NO: 96306 - DNA, 25 bp, Homo sapien
tccatccccttgttcgggaggacta

SEQ ID NO: 96307 - DNA, 25 bp, Homo sapien
gactgcggggctttttaaatgcttc

SEQ ID NO: 96308 - DNA, 25 bp, Homo sapien
ttttaaatgcttccctggactgcgg

SEQ ID NO: 96309 - DNA, 25 bp, Homo sapien
ttcttatcccgtttgttacattttg

SEQ ID NO: 96310 - DNA, 25 bp, Homo sapien
aataaaggtgtgtgatctggtttgg

SEQ ID NO: 96311 - DNA, 25 bp, Homo sapien
tgtgtttctcttgattccgtgacac

SEQ ID NO: 96312 - DNA, 25 bp, Homo sapien
gattccgtgacacccggtttattag

SEQ ID NO: 96313 - DNA, 25 bp, Homo sapien
aagtgtgacaccttttctgggcaag

SEQ ID NO: 96314 - DNA, 25 bp, Homo sapien
gtgacaccttttctgggcaaggaac

SEQ ID NO: 96315 - DNA, 25 bp, Homo sapien
tgggcaaggaacagcccctttaagg

SEQ ID NO: 96316 - DNA, 25 bp, Homo sapien
ggaacagcccctttaaggagcaaat

SEQ ID NO: 96317 - DNA, 25 bp, Homo sapien
atgaggcaatctgattagcttcaca

SEQ ID NO: 96318 - DNA, 25 bp, Homo sapien
aatctgattagcttcacagactgag

SEQ ID NO: 96319 - DNA, 25 bp, Homo sapien
aatatccagatgtaaaccccaaact

SEQ ID NO: 96320 - DNA, 25 bp, Homo sapien
aaagcacagattgtttacctgttgt

SEQ ID NO: 96321 - DNA, 25 bp, Homo sapien
gtttacctgttgtggattttagatg

SEQ ID NO: 96322 - DNA, 25 bp, Homo sapien
gatcaagcggtgctgattcacgaga

SEQ ID NO: 96323 - DNA, 25 bp, Homo sapien
acgagagtggaagcctccagagctt

SEQ ID NO: 96324 - DNA, 25 bp, Homo sapien
gggctttctggctgctcttcattga

SEQ ID NO: 96325 - DNA, 25 bp, Homo sapien
attgacctgtgtgttcccagcacac

SEQ ID NO: 96326 - DNA, 25 bp, Homo sapien
gaacagcgcccctaacggagatttg

SEQ ID NO: 96327 - DNA, 25 bp, Homo sapien
aacggagatttgttcagcgactgaa

SEQ ID NO: 96328 - DNA, 25 bp, Homo sapien
gttcagcgactgaatatacacctgt

SEQ ID NO: 96329 - DNA, 25 bp, Homo sapien
atacacctgtaaacgagtagcatgt

SEQ ID NO: 96330 - DNA, 25 bp, Homo sapien
ggttctgtattatataccaccgttc

SEQ ID NO: 96331 - DNA, 25 bp, Homo sapien
ataccaccgttctgactgctttttt

SEQ ID NO: 96332 - DNA, 25 bp, Homo sapien
tcacttatagcttggaaattgtctt

SEQ ID NO: 96333 - DNA, 25 bp, Homo sapien
cccctgtaaatagtccttggatatt

SEQ ID NO: 96334 - DNA, 25 bp, Homo sapien
atagtccttggatattaccgtctgg

SEQ ID NO: 96335 - DNA, 25 bp, Homo sapien
gtccttggatattaccgtctggttg

SEQ ID NO: 96336 - DNA, 25 bp, Homo sapien
ggatattaccgtctggttgtcgtct

SEQ ID NO: 96337 - DNA, 25 bp, Homo sapien
taccgtctggttgtcgtctgtcatc

SEQ ID NO: 96338 - DNA, 25 bp, Homo sapien
tggttgtcgtctgtcatctcctcct

SEQ ID NO: 96339 - DNA, 25 bp, Homo sapien
ggaagccaaagcttactttgtagaa

SEQ ID NO: 96340 - DNA, 25 bp, Homo sapien
tacccgaaggacttaggtgctttgt

SEQ ID NO: 96341 - DNA, 25 bp, Homo sapien
aggacttaggtgctttgtgtactta

SEQ ID NO: 96342 - DNA, 25 bp, Homo sapien
aggtgctttgtgtacttaaccccag

SEQ ID NO: 96343 - DNA, 25 bp, Homo sapien
tgctttgtgtacttaaccccaggac

SEQ ID NO: 96344 - DNA, 25 bp, Homo sapien
tttttcccatcgttcttttgagaga

SEQ ID NO: 96345 - DNA, 25 bp, Homo sapien
gactgatgatcttgaaaagcccatt

SEQ ID NO: 96346 - DNA, 25 bp, Homo sapien
catttctgattgcacgttgactgga

SEQ ID NO: 96347 - DNA, 25 bp, Homo sapien
gattgcacgttgactggaattcttt

SEQ ID NO: 96348 - DNA, 25 bp, Homo sapien
gtgtctgtggactagcgatgctgtt

SEQ ID NO: 96349 - DNA, 25 bp, Homo sapien
tgaagattcgggactggctcatatc

SEQ ID NO: 96350 - DNA, 25 bp, Homo sapien
ggactggctcatatctttttatcta

SEQ ID NO: 96351 - DNA, 25 bp, Homo sapien
ctgtattctcgaagcaattctgcca

SEQ ID NO: 96352 - DNA, 25 bp, Homo sapien
caattctgccacttgatcgtattca

SEQ ID NO: 96353 - DNA, 25 bp, Homo sapien
gccctggtaggctcctttagaagga

SEQ ID NO: 96354 - DNA, 25 bp, Homo sapien
ttagaaggaccatttctgttcctag

SEQ ID NO: 96355 - DNA, 25 bp, Homo sapien
attgacctgtgtgttcccagcacac

SEQ ID NO: 96356 - DNA, 25 bp, Homo sapien
gacctgtgtgttcccagcacacgaa

SEQ ID NO: 96357 - DNA, 25 bp, Homo sapien
gtgtgttcccagcacacgaacagcg

SEQ ID NO: 96358 - DNA, 25 bp, Homo sapien
gaacagcgcccctaacggagatttg

SEQ ID NO: 96359 - DNA, 25 bp, Homo sapien
acagcgcccctaacggagatttgtt

SEQ ID NO: 96360 - DNA, 25 bp, Homo sapien
gcgcccctaacggagatttgttcag

SEQ ID NO: 96361 - DNA, 25 bp, Homo sapien
aacggagatttgttcagcgactgaa

SEQ ID NO: 96362 - DNA, 25 bp, Homo sapien
gttcagcgactgaatatacacctgt

SEQ ID NO: 96363 - DNA, 25 bp, Homo sapien
agcgactgaatatacacctgtaaac

SEQ ID NO: 96364 - DNA, 25 bp, Homo sapien
atacacctgtaaacgagtagcatgt

SEQ ID NO: 96365 - DNA, 25 bp, Homo sapien
aacgagtagcatgtatacattgatt

SEQ ID NO: 96366 - DNA, 25 bp, Homo sapien
atatacagagactagcaccttgaat

SEQ ID NO: 96367 - DNA, 25 bp, Homo sapien
tacagagactagcaccttgaatatg

SEQ ID NO: 96368 - DNA, 25 bp, Homo sapien
gactagcaccttgaatatgccagaa

SEQ ID NO: 96369 - DNA, 25 bp, Homo sapien
tatgccagaaattgaattaccatct

SEQ ID NO: 96370 - DNA, 25 bp, Homo sapien
gaattaccatctgtattagaactta

SEQ ID NO: 96371 - DNA, 25 bp, Homo sapien
tgtattagaacttaagactcagcct

SEQ ID NO: 96372 - DNA, 25 bp, Homo sapien
gaacttaagactcagcctaaattta

SEQ ID NO: 96373 - DNA, 25 bp, Homo sapien
gactcagcctaaatttacagttact

SEQ ID NO: 96374 - DNA, 25 bp, Homo sapien
gaaaatgggcagtcagaattaggga

SEQ ID NO: 96375 - DNA, 25 bp, Homo sapien
ggcagtcagaattagggactagaat

SEQ ID NO: 96376 - DNA, 25 bp, Homo sapien
tgtatatgagaaacccccactctac

SEQ ID NO: 96377 - DNA, 25 bp, Homo sapien
gtaccaggacgccaacattcccttt

SEQ ID NO: 96378 - DNA, 25 bp, Homo sapien
gttctgcggagcaggttacctggta

SEQ ID NO: 96379 - DNA, 25 bp, Homo sapien
ttacctggtatatttcacaaggccc

SEQ ID NO: 96380 - DNA, 25 bp, Homo sapien
cacaaggcccatgacaatgcatcgg

SEQ ID NO: 96381 - DNA, 25 bp, Homo sapien
atgcatcgggcggtgtctcccacag

SEQ ID NO: 96382 - DNA, 25 bp, Homo sapien
agcctactccgaggtgagtcaggga

SEQ ID NO: 96383 - DNA, 25 bp, Homo sapien
agggagatgcagaagccgctctacg

SEQ ID NO: 96384 - DNA, 25 bp, Homo sapien
agacctgggaaggaccactgagttt

SEQ ID NO: 96385 - DNA, 25 bp, Homo sapien
gagtttgcttttggacagtgcattt

SEQ ID NO: 96386 - DNA, 25 bp, Homo sapien
acagtgcatttcagttcttcagtaa

SEQ ID NO: 96387 - DNA, 25 bp, Homo sapien
gttcttcagtaaactcccattataa

SEQ ID NO: 96388 - DNA, 25 bp, Homo sapien
gaagaaccgagattccagctagagg

SEQ ID NO: 96389 - DNA, 25 bp, Homo sapien
tgtggcgcccaaagctggcaggtca

SEQ ID NO: 96390 - DNA, 25 bp, Homo sapien
agctggcaggtcaggcaagcagcct

SEQ ID NO: 96391 - DNA, 25 bp, Homo sapien
agggagctggcttcccaaggacaag

SEQ ID NO: 96392 - DNA, 25 bp, Homo sapien
aattgtagtcacctttgcacttgct

SEQ ID NO: 96393 - DNA, 25 bp, Homo sapien
gcacttgctgaatctgtctttgttt

SEQ ID NO: 96394 - DNA, 25 bp, Homo sapien
gtttctgcactaattaatgcacatt

SEQ ID NO: 96395 - DNA, 25 bp, Homo sapien
atgcacattgagttttgtcaggttt

SEQ ID NO: 96396 - DNA, 25 bp, Homo sapien
caagggcaaggaccctctggcttac

SEQ ID NO: 96397 - DNA, 25 bp, Homo sapien
taccctccaagcgactctgtagttt

SEQ ID NO: 96398 - DNA, 25 bp, Homo sapien
gcgactctgtagttttcccagattt

SEQ ID NO: 96399 - DNA, 25 bp, Homo sapien
aggacaaccctcttcatcactggtg

SEQ ID NO: 96400 - DNA, 25 bp, Homo sapien
atcactggtggctgagctttttccc

SEQ ID NO: 96401 - DNA, 25 bp, Homo sapien
gctttttcccagcaggaatgggtcc

SEQ ID NO: 96402 - DNA, 25 bp, Homo sapien
gaatgggtcctcgaatcatcgtgcc

SEQ ID NO: 96403 - DNA, 25 bp, Homo sapien
tcatcgtgcctctttcacagaaagg

SEQ ID NO: 96404 - DNA, 25 bp, Homo sapien
acagaaaggacgttgtggtggcctc

SEQ ID NO: 96405 - DNA, 25 bp, Homo sapien
aggcatgcccaacagtaactgtcag

SEQ ID NO: 96406 - DNA, 25 bp, Homo sapien
ctcctttcatgtacttggcctgaga

SEQ ID NO: 96407 - DNA, 25 bp, Homo sapien
atgtacttggcctgagactgacctc

SEQ ID NO: 96408 - DNA, 25 bp, Homo sapien
ggtccaaatgccctagtcacatggc

SEQ ID NO: 96409 - DNA, 25 bp, Homo sapien
tagtcacatggcagacccacggcct

SEQ ID NO: 96410 - DNA, 25 bp, Homo sapien
tgctgggccgctgggtctctctttg

SEQ ID NO: 96411 - DNA, 25 bp, Homo sapien
tctctctttgtggacttgtacctgg

SEQ ID NO: 96412 - DNA, 25 bp, Homo sapien
gaggaactccagtccgtcccggcat

SEQ ID NO: 96413 - DNA, 25 bp, Homo sapien
gcatccatggcagcccgcggttagg

SEQ ID NO: 96414 - DNA, 25 bp, Homo sapien
tgcgccagggtttgctgatgttgtc

SEQ ID NO: 96415 - DNA, 25 bp, Homo sapien
agggtttgctgatgttgtcttgtgc

SEQ ID NO: 96416 - DNA, 25 bp, Homo sapien
acccactgtcccagaaaagcctgat

SEQ ID NO: 96417 - DNA, 25 bp, Homo sapien
aagcctgatcctgtagtttatgtag

SEQ ID NO: 96418 - DNA, 25 bp, Homo sapien
atgtagaatgccacatctgcgtcct

SEQ ID NO: 96419 - DNA, 25 bp, Homo sapien
gaatgccacatctgcgtcctcaaga

SEQ ID NO: 96420 - DNA, 25 bp, Homo sapien
aagacctgtttcatccatttgggaa

SEQ ID NO: 96421 - DNA, 25 bp, Homo sapien
aaccctgtcctgaaaattctactgc

SEQ ID NO: 96422 - DNA, 25 bp, Homo sapien
aaaattctactgctttgatggctgg

SEQ ID NO: 96423 - DNA, 25 bp, Homo sapien
aggacgcgtggattctactcaagcc

SEQ ID NO: 96424 - DNA, 25 bp, Homo sapien
tactcaagcctccaagtagtggcat

SEQ ID NO: 96425 - DNA, 25 bp, Homo sapien
gtggcatatcagtcttggagctcct

SEQ ID NO: 96426 - DNA, 25 bp, Homo sapien
tcttggagctcctagctggtgatac

SEQ ID NO: 96427 - DNA, 25 bp, Homo sapien
gacttgggacagcagggccaatttt

SEQ ID NO: 96428 - DNA, 25 bp, Homo sapien
aagtgcctaggctgctaactcactg

SEQ ID NO: 96429 - DNA, 25 bp, Homo sapien
gctaactcactgactagaacttaat

SEQ ID NO: 96430 - DNA, 25 bp, Homo sapien
gaacttaatctggtactttacagtt

SEQ ID NO: 96431 - DNA, 25 bp, Homo sapien
tacagttttgcaccaactctgccaa

SEQ ID NO: 96432 - DNA, 25 bp, Homo sapien
gtaataatgtgaatcatggtttttc

SEQ ID NO: 96433 - DNA, 25 bp, Homo sapien
taatttaatcttccatggattttgg

SEQ ID NO: 96434 - DNA, 25 bp, Homo sapien
ataaagccttggatgtatatgtcat

SEQ ID NO: 96435 - DNA, 25 bp, Homo sapien
gccttggatgtatatgtcatctcag

SEQ ID NO: 96436 - DNA, 25 bp, Homo sapien
gggtattgtataagtccttgcaaga

SEQ ID NO: 96437 - DNA, 25 bp, Homo sapien
gtataagtccttgcaagaatcagtg

SEQ ID NO: 96438 - DNA, 25 bp, Homo sapien
aagtccttgcaagaatcagtgcaaa

SEQ ID NO: 96439 - DNA, 25 bp, Homo sapien
gaatcagtgcaaagatttgctttaa

SEQ ID NO: 96440 - DNA, 25 bp, Homo sapien
aattgttaagatatgatgtccctat

SEQ ID NO: 96441 - DNA, 25 bp, Homo sapien
gatatgatgtccctatggaagcata

SEQ ID NO: 96442 - DNA, 25 bp, Homo sapien
gatgtccctatggaagcatattgtt

SEQ ID NO: 96443 - DNA, 25 bp, Homo sapien
ccctgttagccaggaagttctcaat

SEQ ID NO: 96444 - DNA, 25 bp, Homo sapien
actgctcctggcttgaattttctta

SEQ ID NO: 96445 - DNA, 25 bp, Homo sapien
gctcctggcttgaattttcttataa

SEQ ID NO: 96446 - DNA, 25 bp, Homo sapien
gcttgaattttcttataatcccatg

SEQ ID NO: 96447 - DNA, 25 bp, Homo sapien
aatctatcacctttgtattcacctg

SEQ ID NO: 96448 - DNA, 25 bp, Homo sapien
agtttttctctatgcagacaaccat

SEQ ID NO: 96449 - DNA, 25 bp, Homo sapien
ctctatgcagacaaccattgattta

SEQ ID NO: 96450 - DNA, 25 bp, Homo sapien
attgatttactctgctgtataatac

SEQ ID NO: 96451 - DNA, 25 bp, Homo sapien
tactctgctgtataatactttccat

SEQ ID NO: 96452 - DNA, 25 bp, Homo sapien
gctgtataatactttccattttcta

SEQ ID NO: 96453 - DNA, 25 bp, Homo sapien
taatactttccattttctagaattt

SEQ ID NO: 96454 - DNA, 25 bp, Homo sapien
agaggctccacaggcttacgctgct

SEQ ID NO: 96455 - DNA, 25 bp, Homo sapien
aggcttacgctgctctcctgacagc

SEQ ID NO: 96456 - DNA, 25 bp, Homo sapien
acgcgaccctcggtgcagagtgcag

SEQ ID NO: 96457 - DNA, 25 bp, Homo sapien
acctcagtccctctttgggaggtga

SEQ ID NO: 96458 - DNA, 25 bp, Homo sapien
ctctttgggaggtgatgttcccatt

SEQ ID NO: 96459 - DNA, 25 bp, Homo sapien
ctcaccttcaactgtctgtcttaga

SEQ ID NO: 96460 - DNA, 25 bp, Homo sapien
tctgtcttagaattcccctctggag

SEQ ID NO: 96461 - DNA, 25 bp, Homo sapien
agaattcccctctggagggctatgg

SEQ ID NO: 96462 - DNA, 25 bp, Homo sapien
gagggctatggcctccctatgcttt

SEQ ID NO: 96463 - DNA, 25 bp, Homo sapien
gggatgtccccaatgctgtacctgg

SEQ ID NO: 96464 - DNA, 25 bp, Homo sapien
tgtacctggctgaccccggattaaa

SEQ ID NO: 96465 - DNA, 25 bp, Homo sapien
gtgtgtcctgtcagaccgtggcaaa

SEQ ID NO: 96466 - DNA, 25 bp, Homo sapien
gtcagaccgtggcaaagctccagat

SEQ ID NO: 96467 - DNA, 25 bp, Homo sapien
gatccccaagcaggcaactttgttc

SEQ ID NO: 96468 - DNA, 25 bp, Homo sapien
cctttcaatgaagcaactctcggag

SEQ ID NO: 96469 - DNA, 25 bp, Homo sapien
aactctcggagcttccaggaatgga

SEQ ID NO: 96470 - DNA, 25 bp, Homo sapien
atccaagagctccagaaactaatga

SEQ ID NO: 96471 - DNA, 25 bp, Homo sapien
aataagcaacattcctaagtggtaa

SEQ ID NO: 96472 - DNA, 25 bp, Homo sapien
ccaaggatcctgtcctagagaaagc

SEQ ID NO: 96473 - DNA, 25 bp, Homo sapien
agcaatagttcaagtccctacctgt

SEQ ID NO: 96474 - DNA, 25 bp, Homo sapien
tacctgtgccaccagcatgttaact

SEQ ID NO: 96475 - DNA, 25 bp, Homo sapien
gcatgttaactatgacattgggact

SEQ ID NO: 96476 - DNA, 25 bp, Homo sapien
tgtggatcagtttgattactatgta

SEQ ID NO: 96477 - DNA, 25 bp, Homo sapien
gtggatcagtttgattactatgtac

SEQ ID NO: 96478 - DNA, 25 bp, Homo sapien
tggatcagtttgattactatgtaca

SEQ ID NO: 96479 - DNA, 25 bp, Homo sapien
ggatcagtttgattactatgtacat

SEQ ID NO: 96480 - DNA, 25 bp, Homo sapien
gatcagtttgattactatgtacatt

SEQ ID NO: 96481 - DNA, 25 bp, Homo sapien
atcagtttgattactatgtacattt

SEQ ID NO: 96482 - DNA, 25 bp, Homo sapien
cagtttgattactatgtacatttaa

SEQ ID NO: 96483 - DNA, 25 bp, Homo sapien
ctatgtacatttaaaaggtagcagc

SEQ ID NO: 96484 - DNA, 25 bp, Homo sapien
atgtacatttaaaaggtagcagcaa

SEQ ID NO: 96485 - DNA, 25 bp, Homo sapien
tgtacatttaaaaggtagcagcaag

SEQ ID NO: 96486 - DNA, 25 bp, Homo sapien
aaggtagcagcaagccaggtatggt

SEQ ID NO: 96487 - DNA, 25 bp, Homo sapien
gacaaatgggcctgccaaactgtac

SEQ ID NO: 96488 - DNA, 25 bp, Homo sapien
tgtacagtttcttccccaagagctg

SEQ ID NO: 96489 - DNA, 25 bp, Homo sapien
ccccaagagctgttaggtatcaaaa

SEQ ID NO: 96490 - DNA, 25 bp, Homo sapien
ctccgtgcttttctggttgagatca

SEQ ID NO: 96491 - DNA, 25 bp, Homo sapien
gcttttctggttgagatcatgtcat

SEQ ID NO: 96492 - DNA, 25 bp, Homo sapien
atgtcattgatgaactgccaaagtc

SEQ ID NO: 96493 - DNA, 25 bp, Homo sapien
agactttgtgtttacatctgcattt

SEQ ID NO: 96494 - DNA, 25 bp, Homo sapien
gtgtttacatctgcatttctacatg

SEQ ID NO: 96495 - DNA, 25 bp, Homo sapien
gagacaatttaaggcctgcactctt

SEQ ID NO: 96496 - DNA, 25 bp, Homo sapien
ggcctgcactcttatttcactaaag

SEQ ID NO: 96497 - DNA, 25 bp, Homo sapien
aatgtcagcacatgttgctaatgac

SEQ ID NO: 96498 - DNA, 25 bp, Homo sapien
accaccctgccattgagtctggagg

SEQ ID NO: 96499 - DNA, 25 bp, Homo sapien
tctggagggccctgttggagccttt

SEQ ID NO: 96500 - DNA, 25 bp, Homo sapien
ctgttggagcctttggacctatagc

SEQ ID NO: 96501 - DNA, 25 bp, Homo sapien
tggacctatagctcaaggccagaaa

SEQ ID NO: 96502 - DNA, 25 bp, Homo sapien
gcttagattgtactataaccactac

SEQ ID NO: 96503 - DNA, 25 bp, Homo sapien
taaccactacttatgaactcaggga

SEQ ID NO: 96504 - DNA, 25 bp, Homo sapien
tcagggactatgagggactattcag

SEQ ID NO: 96505 - DNA, 25 bp, Homo sapien
gggctatgaatctgagcctttgttt

SEQ ID NO: 96506 - DNA, 25 bp, Homo sapien
ggagatgatgtaaaccgccttgcaa

SEQ ID NO: 96507 - DNA, 25 bp, Homo sapien
aaaccgccttgcaagattgtagagt

SEQ ID NO: 96508 - DNA, 25 bp, Homo sapien
ggcctggcacaaagggtgcactgta

SEQ ID NO: 96509 - DNA, 25 bp, Homo sapien
agtgagtctcccagatacgttgcat

SEQ ID NO: 96510 - DNA, 25 bp, Homo sapien
gatacgttgcattgtgccaacatca

SEQ ID NO: 96511 - DNA, 25 bp, Homo sapien
gccaacatcagcattatctcggaca

SEQ ID NO: 96512 - DNA, 25 bp, Homo sapien
gcattatctcggacacatcttgtga

SEQ ID NO: 96513 - DNA, 25 bp, Homo sapien
ttgtgacaagagctacccagggcgc

SEQ ID NO: 96514 - DNA, 25 bp, Homo sapien
agggcgcctgacaaacaccatggtg

SEQ ID NO: 96515 - DNA, 25 bp, Homo sapien
ggtgacgtcccttgtgacaacacca

SEQ ID NO: 96516 - DNA, 25 bp, Homo sapien
ccaagcctggtgtctataccaaagt

SEQ ID NO: 96517 - DNA, 25 bp, Homo sapien
tgtctataccaaagtctgccactac

SEQ ID NO: 96518 - DNA, 25 bp, Homo sapien
accaaagtctgccactacttggagt

SEQ ID NO: 96519 - DNA, 25 bp, Homo sapien
actacttggagtggatcagggaaac

SEQ ID NO: 96520 - DNA, 25 bp, Homo sapien
agcgggcacgggagaagcgggcaca

SEQ ID NO: 96521 - DNA, 25 bp, Homo sapien
ggcacaggcagatgcccgccagact

SEQ ID NO: 96522 - DNA, 25 bp, Homo sapien
agatgcccgccagactctgaaggag

SEQ ID NO: 96523 - DNA, 25 bp, Homo sapien
ggagcatgtgcaggactttgccatg

SEQ ID NO: 96524 - DNA, 25 bp, Homo sapien
gtgcaggactttgccatgcagctga

SEQ ID NO: 96525 - DNA, 25 bp, Homo sapien
aggactttgccatgcagctgagcag

SEQ ID NO: 96526 - DNA, 25 bp, Homo sapien
gtgccataataaagcggattctaga

SEQ ID NO: 96527 - DNA, 25 bp, Homo sapien
gcaggcctgcaagcggcgggagcag

SEQ ID NO: 96528 - DNA, 25 bp, Homo sapien
agcggctgcggttgagactgaccaa

SEQ ID NO: 96529 - DNA, 25 bp, Homo sapien
tgcggttgagactgaccaagctgca

SEQ ID NO: 96530 - DNA, 25 bp, Homo sapien
gttgagactgaccaagctgcagcag

SEQ ID NO: 96531 - DNA, 25 bp, Homo sapien
ctgcttccatagattggcattttta

SEQ ID NO: 96532 - DNA, 25 bp, Homo sapien
gcatttttagctattactatgactt

SEQ ID NO: 96533 - DNA, 25 bp, Homo sapien
gcaaaactgcttaaacatcccattt

SEQ ID NO: 96534 - DNA, 25 bp, Homo sapien
aacatcccattttgacacttgtctt

SEQ ID NO: 96535 - DNA, 25 bp, Homo sapien
gacacttgtcttgcagttagtttga

SEQ ID NO: 96536 - DNA, 25 bp, Homo sapien
gtagttaatgattccaaattggttt

SEQ ID NO: 96537 - DNA, 25 bp, Homo sapien
aaattggtttagttgggccatctca

SEQ ID NO: 96538 - DNA, 25 bp, Homo sapien
ttagttgggccatctcattcttcac

SEQ ID NO: 96539 - DNA, 25 bp, Homo sapien
atctcattcttcacttcctgtaaac

SEQ ID NO: 96540 - DNA, 25 bp, Homo sapien
cttcctgtaaaccactccatagatt

SEQ ID NO: 96541 - DNA, 25 bp, Homo sapien
accactccatagatttgtctttctt

SEQ ID NO: 96542 - DNA, 25 bp, Homo sapien
gaatccaacgaggtgaatgagacga

SEQ ID NO: 96543 - DNA, 25 bp, Homo sapien
aatccaacgaggtgaatgagacgat

SEQ ID NO: 96544 - DNA, 25 bp, Homo sapien
atccaacgaggtgaatgagacgatg

SEQ ID NO: 96545 - DNA, 25 bp, Homo sapien
tccaacgaggtgaatgagacgatgc

SEQ ID NO: 96546 - DNA, 25 bp, Homo sapien
ccaacgaggtgaatgagacgatgcc

SEQ ID NO: 96547 - DNA, 25 bp, Homo sapien
caacgaggtgaatgagacgatgccg

SEQ ID NO: 96548 - DNA, 25 bp, Homo sapien
acgaggtgaatgagacgatgccgga

SEQ ID NO: 96549 - DNA, 25 bp, Homo sapien
cgaggtgaatgagacgatgccggag

SEQ ID NO: 96550 - DNA, 25 bp, Homo sapien
gaggtgaatgagacgatgccggaga

SEQ ID NO: 96551 - DNA, 25 bp, Homo sapien
gtgaatccaacgaggtgaatgagac

SEQ ID NO: 96552 - DNA, 25 bp, Homo sapien
tgaatccaacgaggtgaatgagacg

SEQ ID NO: 96553 - DNA, 25 bp, Homo sapien
tccaagatcattcatgtaagaagtt

SEQ ID NO: 96554 - DNA, 25 bp, Homo sapien
ccaagatcattcatgtaagaagttt

SEQ ID NO: 96555 - DNA, 25 bp, Homo sapien
gatcattcatgtaagaagtttagag

SEQ ID NO: 96556 - DNA, 25 bp, Homo sapien
aatgataaacgaaaagaacagcaat

SEQ ID NO: 96557 - DNA, 25 bp, Homo sapien
gaacagcaatagtaaaggatctttt

SEQ ID NO: 96558 - DNA, 25 bp, Homo sapien
aacagcaatagtaaaggatcttttc

SEQ ID NO: 96559 - DNA, 25 bp, Homo sapien
cagcaatagtaaaggatcttttctt

SEQ ID NO: 96560 - DNA, 25 bp, Homo sapien
gcaatagtaaaggatcttttctttg

SEQ ID NO: 96561 - DNA, 25 bp, Homo sapien
caatagtaaaggatcttttctttgt

SEQ ID NO: 96562 - DNA, 25 bp, Homo sapien
cttttctttgtttcagtaagatgaa

SEQ ID NO: 96563 - DNA, 25 bp, Homo sapien
ctttgtttcagtaagatgaagaggc

SEQ ID NO: 96564 - DNA, 25 bp, Homo sapien
aaggcatgaagacttttttccctgc

SEQ ID NO: 96565 - DNA, 25 bp, Homo sapien
gagtgtcataagttattgttttgca

SEQ ID NO: 96566 - DNA, 25 bp, Homo sapien
gttttgcatatctactgcatgccaa

SEQ ID NO: 96567 - DNA, 25 bp, Homo sapien
taatttagccctcacagccactggg

SEQ ID NO: 96568 - DNA, 25 bp, Homo sapien
cctcacagccactgggtcaagatgt

SEQ ID NO: 96569 - DNA, 25 bp, Homo sapien
gggtcaagatgtccaattttccaga

SEQ ID NO: 96570 - DNA, 25 bp, Homo sapien
aagatgtccaattttccagagtaag

SEQ ID NO: 96571 - DNA, 25 bp, Homo sapien
gaggagtcaaattcaaatacaggtt

SEQ ID NO: 96572 - DNA, 25 bp, Homo sapien
atgacttgatcgaggcaggcttttc

SEQ ID NO: 96573 - DNA, 25 bp, Homo sapien
aggcttttccagcatcactgtcctg

SEQ ID NO: 96574 - DNA, 25 bp, Homo sapien
tgtcctggttccatctctgctatat

SEQ ID NO: 96575 - DNA, 25 bp, Homo sapien
gatgtccagctttaacgaagccatg

SEQ ID NO: 96576 - DNA, 25 bp, Homo sapien
ccatgactcagatcagggagctgga

SEQ ID NO: 96577 - DNA, 25 bp, Homo sapien
gagatcatacagcaaggaccagact

SEQ ID NO: 96578 - DNA, 25 bp, Homo sapien
gactggcttgagctctctgagatga

SEQ ID NO: 96579 - DNA, 25 bp, Homo sapien
tgagatgaccgagcagccagactat

SEQ ID NO: 96580 - DNA, 25 bp, Homo sapien
agccagactatgacctggagacctt

SEQ ID NO: 96581 - DNA, 25 bp, Homo sapien
aacaaagcggaatctgctctggccc

SEQ ID NO: 96582 - DNA, 25 bp, Homo sapien
aagcatttctcagccctgcgagatg

SEQ ID NO: 96583 - DNA, 25 bp, Homo sapien
tcagccctgcgagatgtcatcaagg

SEQ ID NO: 96584 - DNA, 25 bp, Homo sapien
gcctggccatgcagctggaagagca

SEQ ID NO: 96585 - DNA, 25 bp, Homo sapien
aagcagcaagaaacggccccagtga

SEQ ID NO: 96586 - DNA, 25 bp, Homo sapien
tactcccctggctggaaatgctttt

SEQ ID NO: 96587 - DNA, 25 bp, Homo sapien
gtgttgtgcctacttaattctgata

SEQ ID NO: 96588 - DNA, 25 bp, Homo sapien
atacttaggaggcttacttctttgg

SEQ ID NO: 96589 - DNA, 25 bp, Homo sapien
tgtgagttgagccttcaggccagct

SEQ ID NO: 96590 - DNA, 25 bp, Homo sapien
ttcaggccagctgggtttagcccga

SEQ ID NO: 96591 - DNA, 25 bp, Homo sapien
tagcccgaggctggtcttagatgca

SEQ ID NO: 96592 - DNA, 25 bp, Homo sapien
gtcttagatgcagcgactgtttcag

SEQ ID NO: 96593 - DNA, 25 bp, Homo sapien
gtgggattctcgctccttcatttca

SEQ ID NO: 96594 - DNA, 25 bp, Homo sapien
cttcatttcaggttactcgttcttc

SEQ ID NO: 96595 - DNA, 25 bp, Homo sapien
tactcgttcttcagcaagttggcaa

SEQ ID NO: 96596 - DNA, 25 bp, Homo sapien
atgctggtgagtgccacgttactcc

SEQ ID NO: 96597 - DNA, 25 bp, Homo sapien
gtgaagagtattaacctgtgtgctg

SEQ ID NO: 96598 - DNA, 25 bp, Homo sapien
aagagtattaacctgtgtgctgtac

SEQ ID NO: 96599 - DNA, 25 bp, Homo sapien
gtattaacctgtgtgctgtactttt

SEQ ID NO: 96600 - DNA, 25 bp, Homo sapien
attaacctgtgtgctgtacttttac

SEQ ID NO: 96601 - DNA, 25 bp, Homo sapien
aacctgtgtgctgtacttttacact

SEQ ID NO: 96602 - DNA, 25 bp, Homo sapien
tgtgtgctgtacttttacactcctt

SEQ ID NO: 96603 - DNA, 25 bp, Homo sapien
cctttgtcttggaactgtcttattt

SEQ ID NO: 96604 - DNA, 25 bp, Homo sapien
tttgtcttggaactgtcttattttt

SEQ ID NO: 96605 - DNA, 25 bp, Homo sapien
ctgtaaatgtctattgccgtaaatt

SEQ ID NO: 96606 - DNA, 25 bp, Homo sapien
gtaaatgtctattgccgtaaattgt

SEQ ID NO: 96607 - DNA, 25 bp, Homo sapien
atgtctattgccgtaaattgttaat

SEQ ID NO: 96608 - DNA, 25 bp, Homo sapien
ccgcatccgcgaaggcttttaatgg

SEQ ID NO: 96609 - DNA, 25 bp, Homo sapien
atccgcgaaggcttttaatgggagg

SEQ ID NO: 96610 - DNA, 25 bp, Homo sapien
gggcgtcaaagctcaaaactgtttt

SEQ ID NO: 96611 - DNA, 25 bp, Homo sapien
gcgtcaaagctcaaaactgttttcc

SEQ ID NO: 96612 - DNA, 25 bp, Homo sapien
tcaaagctcaaaactgttttcctct

SEQ ID NO: 96613 - DNA, 25 bp, Homo sapien
agttgtaaatgccacttcatgaggg

SEQ ID NO: 96614 - DNA, 25 bp, Homo sapien
ctgcatgcttctggctggagcacct

SEQ ID NO: 96615 - DNA, 25 bp, Homo sapien
gggattgggttgtgggcagtcccca

SEQ ID NO: 96616 - DNA, 25 bp, Homo sapien
atggccgcctggagaagccgctggg

SEQ ID NO: 96617 - DNA, 25 bp, Homo sapien
gcacactgtatgtacctataataaa

SEQ ID NO: 96618 - DNA, 25 bp, Homo sapien
tatgtacctataataaaccctttgg

SEQ ID NO: 96619 - DNA, 25 bp, Homo sapien
acacctggcgagtagtagctgtcaa

SEQ ID NO: 96620 - DNA, 25 bp, Homo sapien
cctggcgagtagtagctgtcaataa

SEQ ID NO: 96621 - DNA, 25 bp, Homo sapien
gcgagtagtagctgtcaataaatct

SEQ ID NO: 96622 - DNA, 25 bp, Homo sapien
agctgtcaataaatctatggtaaac

SEQ ID NO: 96623 - DNA, 25 bp, Homo sapien
catggaaagggccagctgcagactt

SEQ ID NO: 96624 - DNA, 25 bp, Homo sapien
aagggccagctgcagactttgagcc

SEQ ID NO: 96625 - DNA, 25 bp, Homo sapien
actttgagccagaaatgcaaacggg

SEQ ID NO: 96626 - DNA, 25 bp, Homo sapien
aaatgcaaacgggaggcctctggga

SEQ ID NO: 96627 - DNA, 25 bp, Homo sapien
gaggcctctgggactcagtcagagc

SEQ ID NO: 96628 - DNA, 25 bp, Homo sapien
tctgggactcagtcagagcgctttg

SEQ ID NO: 96629 - DNA, 25 bp, Homo sapien
ggactcagtcagagcgctttggctg

SEQ ID NO: 96630 - DNA, 25 bp, Homo sapien
gagagagaacttttgcacatgccat

SEQ ID NO: 96631 - DNA, 25 bp, Homo sapien
gcacatgccatgttttcgtggcaaa

SEQ ID NO: 96632 - DNA, 25 bp, Homo sapien
gtttcaagtaccttatgagggcggt

SEQ ID NO: 96633 - DNA, 25 bp, Homo sapien
tgagggcggttacctagttttgaat

SEQ ID NO: 96634 - DNA, 25 bp, Homo sapien
gggtgtacaaaatcctatctagagt

SEQ ID NO: 96635 - DNA, 25 bp, Homo sapien
tactcgttggatgtattttcttttc

SEQ ID NO: 96636 - DNA, 25 bp, Homo sapien
ttcttttccgaaatgtacccatagg

SEQ ID NO: 96637 - DNA, 25 bp, Homo sapien
ggacacataaccttattcctggtct

SEQ ID NO: 96638 - DNA, 25 bp, Homo sapien
atttctcggttttataccaagcagc

SEQ ID NO: 96639 - DNA, 25 bp, Homo sapien
taccaagcagcagtgttcggaagac

SEQ ID NO: 96640 - DNA, 25 bp, Homo sapien
gttcggaagaccatgttagtgctac

SEQ ID NO: 96641 - DNA, 25 bp, Homo sapien
atatgttgacaattaacttcaaagt

SEQ ID NO: 96642 - DNA, 25 bp, Homo sapien
acttcaaagtattagctgctttttg

SEQ ID NO: 96643 - DNA, 25 bp, Homo sapien
tttgtaggccaaataaacacgtctg

SEQ ID NO: 96644 - DNA, 25 bp, Homo sapien
aataaacacgtctgtgggccagatc

SEQ ID NO: 96645 - DNA, 25 bp, Homo sapien
agatctggcccaggactagagttgc

SEQ ID NO: 96646 - DNA, 25 bp, Homo sapien
tggcccaggactagagttgccagtg

SEQ ID NO: 96647 - DNA, 25 bp, Homo sapien
ttgccagtggcaacttctggcccag

SEQ ID NO: 96648 - DNA, 25 bp, Homo sapien
gagtgggagctgatgcctgggtacg

SEQ ID NO: 96649 - DNA, 25 bp, Homo sapien
ctgatgcctgggtacgggagctctg

SEQ ID NO: 96650 - DNA, 25 bp, Homo sapien
atcctggactcgcaggcagaagttt

SEQ ID NO: 96651 - DNA, 25 bp, Homo sapien
tcgcaggcagaagttttgcctctta

SEQ ID NO: 96652 - DNA, 25 bp, Homo sapien
ttcagagaggcccagtaagaggtat

SEQ ID NO: 96653 - DNA, 25 bp, Homo sapien
cagagaggcccagtaagaggtatct

SEQ ID NO: 96654 - DNA, 25 bp, Homo sapien
gagaggcccagtaagaggtatctcc

SEQ ID NO: 96655 - DNA, 25 bp, Homo sapien
agaggcccagtaagaggtatctcca

SEQ ID NO: 96656 - DNA, 25 bp, Homo sapien
gaggcccagtaagaggtatctccat

SEQ ID NO: 96657 - DNA, 25 bp, Homo sapien
aggcccagtaagaggtatctccatc

SEQ ID NO: 96658 - DNA, 25 bp, Homo sapien
ggcccagtaagaggtatctccatca

SEQ ID NO: 96659 - DNA, 25 bp, Homo sapien
gcccagtaagaggtatctccatcaa

SEQ ID NO: 96660 - DNA, 25 bp, Homo sapien
cccagtaagaggtatctccatcaag

SEQ ID NO: 96661 - DNA, 25 bp, Homo sapien
cagtaagaggtatctccatcaagct

SEQ ID NO: 96662 - DNA, 25 bp, Homo sapien
agtaagaggtatctccatcaagctg

SEQ ID NO: 96663 - DNA, 25 bp, Homo sapien
gagaatgaggaattccaggttgtta

SEQ ID NO: 96664 - DNA, 25 bp, Homo sapien
tccaggttgttatgtgaattctcac

SEQ ID NO: 96665 - DNA, 25 bp, Homo sapien
caatttgtaaatgtcggcttgccat

SEQ ID NO: 96666 - DNA, 25 bp, Homo sapien
aaatgtcggcttgccattcagcttt

SEQ ID NO: 96667 - DNA, 25 bp, Homo sapien
cggcttgccattcagcttttttgtt

SEQ ID NO: 96668 - DNA, 25 bp, Homo sapien
tcatgtgggtcaaacaaactatgtt

SEQ ID NO: 96669 - DNA, 25 bp, Homo sapien
gctagtagcttattgcctctggcca

SEQ ID NO: 96670 - DNA, 25 bp, Homo sapien
cctctggccagtggtgtgctaacaa

SEQ ID NO: 96671 - DNA, 25 bp, Homo sapien
gccagtggtgtgctaacaaaagttt

SEQ ID NO: 96672 - DNA, 25 bp, Homo sapien
caaaagtttaaccagcagctctcca

SEQ ID NO: 96673 - DNA, 25 bp, Homo sapien
taaccagcagctctccaacaaaaaa

SEQ ID NO: 96674 - DNA, 25 bp, Homo sapien
cgcagcggagacaaggaccttccct

SEQ ID NO: 96675 - DNA, 25 bp, Homo sapien
ggagacaaggaccttccctcgttgg

SEQ ID NO: 96676 - DNA, 25 bp, Homo sapien
gacaaggaccttccctcgttggccg

SEQ ID NO: 96677 - DNA, 25 bp, Homo sapien
aggcccagttgctggccctaagttg

SEQ ID NO: 96678 - DNA, 25 bp, Homo sapien
cagttgctggccctaagttgtaccc

SEQ ID NO: 96679 - DNA, 25 bp, Homo sapien
tgctggccctaagttgtaccccaaa

SEQ ID NO: 96680 - DNA, 25 bp, Homo sapien
taagttgtaccccaaactctacaca

SEQ ID NO: 96681 - DNA, 25 bp, Homo sapien
tgtaccccaaactctacacagacat

SEQ ID NO: 96682 - DNA, 25 bp, Homo sapien
cacacactcacacgtggagggcaag

SEQ ID NO: 96683 - DNA, 25 bp, Homo sapien
tggagggcaaggtccaccagcacat

SEQ ID NO: 96684 - DNA, 25 bp, Homo sapien
agggcaaggtccaccagcacatcca

SEQ ID NO: 96685 - DNA, 25 bp, Homo sapien
ataatcagagaatcttatgctatga

SEQ ID NO: 96686 - DNA, 25 bp, Homo sapien
cttatgctatgattgttatatgtga

SEQ ID NO: 96687 - DNA, 25 bp, Homo sapien
gcattatagatgctcttgaaatgtt

SEQ ID NO: 96688 - DNA, 25 bp, Homo sapien
taaaatcacatcagcactggaaaat

SEQ ID NO: 96689 - DNA, 25 bp, Homo sapien
actcctaaatgtccaaaaagaacat

SEQ ID NO: 96690 - DNA, 25 bp, Homo sapien
gaacatgagatttatggtgcttgaa

SEQ ID NO: 96691 - DNA, 25 bp, Homo sapien
ggtgcttgaaatgttgctaaacgta

SEQ ID NO: 96692 - DNA, 25 bp, Homo sapien
gttgctaaacgtaaatttgtatcta

SEQ ID NO: 96693 - DNA, 25 bp, Homo sapien
acgtaaatttgtatctattctgaaa

SEQ ID NO: 96694 - DNA, 25 bp, Homo sapien
tataaattaacctacctggccaggc

SEQ ID NO: 96695 - DNA, 25 bp, Homo sapien
aaattaacctacctggccaggcaca

SEQ ID NO: 96696 - DNA, 25 bp, Homo sapien
ggtcctcaccatgtctgtgagctct

SEQ ID NO: 96697 - DNA, 25 bp, Homo sapien
accatgtctgtgagctctgcaacaa

SEQ ID NO: 96698 - DNA, 25 bp, Homo sapien
tgagctctgcaacaaaggtactggt

SEQ ID NO: 96699 - DNA, 25 bp, Homo sapien
aaggtactggtgaggtttgtccaat

SEQ ID NO: 96700 - DNA, 25 bp, Homo sapien
tactggtgaggtttgtccaatggcg

SEQ ID NO: 96701 - DNA, 25 bp, Homo sapien
gtgcctgtgagctctcagccacttc

SEQ ID NO: 96702 - DNA, 25 bp, Homo sapien
aaccctggtgagctccaagttggtt

SEQ ID NO: 96703 - DNA, 25 bp, Homo sapien
aatggagtagagtcccttggtacaa

SEQ ID NO: 96704 - DNA, 25 bp, Homo sapien
ggagtagagtcccttggtacaagct

SEQ ID NO: 96705 - DNA, 25 bp, Homo sapien
agagtcccttggtacaagctcctct

SEQ ID NO: 96706 - DNA, 25 bp, Homo sapien
tatttccctaccaaccaaggagcct

SEQ ID NO: 96707 - DNA, 25 bp, Homo sapien
gctatccatctacgtgtattacaga

SEQ ID NO: 96708 - DNA, 25 bp, Homo sapien
cgtgtattacagacattctgctcag

SEQ ID NO: 96709 - DNA, 25 bp, Homo sapien
gagagttttgtgtacagcttgggaa

SEQ ID NO: 96710 - DNA, 25 bp, Homo sapien
gttgattgtaaacccacagtatcta

SEQ ID NO: 96711 - DNA, 25 bp, Homo sapien
acagtatctagcagcgttgtgccaa

SEQ ID NO: 96712 - DNA, 25 bp, Homo sapien
gttgtgccaaattgcccttgtgttt

SEQ ID NO: 96713 - DNA, 25 bp, Homo sapien
ttgtgtttctctccacccaaaatat

SEQ ID NO: 96714 - DNA, 25 bp, Homo sapien
tttctctccacccaaaatatcacag

SEQ ID NO: 96715 - DNA, 25 bp, Homo sapien
cacatttggttcatccgtgtgctgt

SEQ ID NO: 96716 - DNA, 25 bp, Homo sapien
cgtgtgctgttcttttgggttctga

SEQ ID NO: 96717 - DNA, 25 bp, Homo sapien
ttgccatgtttgcttgtatgaccaa

SEQ ID NO: 96718 - DNA, 25 bp, Homo sapien
accaggccgatttccagggcttcac

SEQ ID NO: 96719 - DNA, 25 bp, Homo sapien
aggccgatttccagggcttcaccta

SEQ ID NO: 96720 - DNA, 25 bp, Homo sapien
atttccagggcttcacctacgtgaa

SEQ ID NO: 96721 - DNA, 25 bp, Homo sapien
ttccagggcttcacctacgtgaacc

SEQ ID NO: 96722 - DNA, 25 bp, Homo sapien
cacctacgtgaaccccgacttcgtg

SEQ ID NO: 96723 - DNA, 25 bp, Homo sapien
gcctgtgcccgtcatgtaatctcac

SEQ ID NO: 96724 - DNA, 25 bp, Homo sapien
ccctgtcccattctagatcctgcac

SEQ ID NO: 96725 - DNA, 25 bp, Homo sapien
gcgggttctagacgcccctcccaag

SEQ ID NO: 96726 - DNA, 25 bp, Homo sapien
tcccaagcgttcctggccttctgaa

SEQ ID NO: 96727 - DNA, 25 bp, Homo sapien
ttcctggccttctgaactccataca

SEQ ID NO: 96728 - DNA, 25 bp, Homo sapien
tggccttctgaactccatacagcct

SEQ ID NO: 96729 - DNA, 25 bp, Homo sapien
aaacctcctacagtttctgaagaat

SEQ ID NO: 96730 - DNA, 25 bp, Homo sapien
aagaatctgaagtggccatcaagcc

SEQ ID NO: 96731 - DNA, 25 bp, Homo sapien
gaagtggccatcaagcccagcaaag

SEQ ID NO: 96732 - DNA, 25 bp, Homo sapien
gagactctaaacagatgagcacaga

SEQ ID NO: 96733 - DNA, 25 bp, Homo sapien
tgagcacagagccaggcctcttaga

SEQ ID NO: 96734 - DNA, 25 bp, Homo sapien
gaaagtgggactgagccgcaccatt

SEQ ID NO: 96735 - DNA, 25 bp, Homo sapien
gactgagccgcaccattgagatgga

SEQ ID NO: 96736 - DNA, 25 bp, Homo sapien
tggaggaagcatccgtctattccca

SEQ ID NO: 96737 - DNA, 25 bp, Homo sapien
tccgtctattcccaagtggtcttca

SEQ ID NO: 96738 - DNA, 25 bp, Homo sapien
agtggtcttcaagcaccagtgtaat

SEQ ID NO: 96739 - DNA, 25 bp, Homo sapien
accagtgtaataaagctctcaaaag

SEQ ID NO: 96740 - DNA, 25 bp, Homo sapien
gcctggccacccacgaggatgctag

SEQ ID NO: 96741 - DNA, 25 bp, Homo sapien
cacgaggatgctaggccagccaaga

SEQ ID NO: 96742 - DNA, 25 bp, Homo sapien
aagcatggaacccaggccgagtaaa

SEQ ID NO: 96743 - DNA, 25 bp, Homo sapien
acccaggccgagtaaacttggccat

SEQ ID NO: 96744 - DNA, 25 bp, Homo sapien
caggcctccgggtctcactggacgg

SEQ ID NO: 96745 - DNA, 25 bp, Homo sapien
cctccgggtctcactggacggcagg

SEQ ID NO: 96746 - DNA, 25 bp, Homo sapien
gaggctggccactacgggagctcaa

SEQ ID NO: 96747 - DNA, 25 bp, Homo sapien
ggccactacgggagctcaataaaca

SEQ ID NO: 96748 - DNA, 25 bp, Homo sapien
tcaggacagtggactccctacctag

SEQ ID NO: 96749 - DNA, 25 bp, Homo sapien
gtggactccctacctagtggagaca

SEQ ID NO: 96750 - DNA, 25 bp, Homo sapien
ccctacctagtggagacagcactgt

SEQ ID NO: 96751 - DNA, 25 bp, Homo sapien
ctgaggtgggtggatgccgaggtga

SEQ ID NO: 96752 - DNA, 25 bp, Homo sapien
tgaggtgggtggatgccgaggtgag

SEQ ID NO: 96753 - DNA, 25 bp, Homo sapien
gaggtgggtggatgccgaggtgagt

SEQ ID NO: 96754 - DNA, 25 bp, Homo sapien
aggtgggtggatgccgaggtgagtg

SEQ ID NO: 96755 - DNA, 25 bp, Homo sapien
ggtgggtggatgccgaggtgagtgg

SEQ ID NO: 96756 - DNA, 25 bp, Homo sapien
gtgggtggatgccgaggtgagtgga

SEQ ID NO: 96757 - DNA, 25 bp, Homo sapien
tgggtggatgccgaggtgagtggat

SEQ ID NO: 96758 - DNA, 25 bp, Homo sapien
gggtggatgccgaggtgagtggatc

SEQ ID NO: 96759 - DNA, 25 bp, Homo sapien
ggtggatgccgaggtgagtggatca

SEQ ID NO: 96760 - DNA, 25 bp, Homo sapien
ggaacccattccattctattgcatt

SEQ ID NO: 96761 - DNA, 25 bp, Homo sapien
tattgcattcccaccaggtatcata

SEQ ID NO: 96762 - DNA, 25 bp, Homo sapien
cataaactgaaagctctcctggaaa

SEQ ID NO: 96763 - DNA, 25 bp, Homo sapien
taaatgtgggcttttctgggcaaac

SEQ ID NO: 96764 - DNA, 25 bp, Homo sapien
tttctgggcaaaccttcgagctgct

SEQ ID NO: 96765 - DNA, 25 bp, Homo sapien
aatgttaatgtattagccaccagag

SEQ ID NO: 96766 - DNA, 25 bp, Homo sapien
gaactgcagacattcacagagttaa

SEQ ID NO: 96767 - DNA, 25 bp, Homo sapien
gaagagtctcgaggttctacaatct

SEQ ID NO: 96768 - DNA, 25 bp, Homo sapien
gaggttctacaatctctctgatgag

SEQ ID NO: 96769 - DNA, 25 bp, Homo sapien
tgtctataaaatcccacagtccttg

SEQ ID NO: 96770 - DNA, 25 bp, Homo sapien
gggaccacatacactgttgggatgt

SEQ ID NO: 96771 - DNA, 25 bp, Homo sapien
gttgctgatatatatttggtttgtt

SEQ ID NO: 96772 - DNA, 25 bp, Homo sapien
aaaccatttttgaatgtccaaacat

SEQ ID NO: 96773 - DNA, 25 bp, Homo sapien
gaatgtccaaacatctgatttaaag

SEQ ID NO: 96774 - DNA, 25 bp, Homo sapien
ttatctttctgaccaaaggagcaag

SEQ ID NO: 96775 - DNA, 25 bp, Homo sapien
ttctgaccaaaggagcaagaggtat

SEQ ID NO: 96776 - DNA, 25 bp, Homo sapien
gaggtataatggatatggcattcat

SEQ ID NO: 96777 - DNA, 25 bp, Homo sapien
tatggcattcattaaaatctttact

SEQ ID NO: 96778 - DNA, 25 bp, Homo sapien
aacagtaatatttacagcatcagta

SEQ ID NO: 96779 - DNA, 25 bp, Homo sapien
tttaagtggtacttctaaatcataa

SEQ ID NO: 96780 - DNA, 25 bp, Homo sapien
agacctttaaaatcttgtggtgttg

SEQ ID NO: 96781 - DNA, 25 bp, Homo sapien
aatcttgtggtgttgaacaatgtta

SEQ ID NO: 96782 - DNA, 25 bp, Homo sapien
gaacgaacaaggttgccacagtgca

SEQ ID NO: 96783 - DNA, 25 bp, Homo sapien
ttgccacagtgcatggacccaattg

SEQ ID NO: 96784 - DNA, 25 bp, Homo sapien
gacccaattgtgtttgcctgttgac

SEQ ID NO: 96785 - DNA, 25 bp, Homo sapien
tgttgacgtgccatcagtgcgtgat

SEQ ID NO: 96786 - DNA, 25 bp, Homo sapien
ggtatgacatacacacaccagagca

SEQ ID NO: 96787 - DNA, 25 bp, Homo sapien
agagcaaccgccacaccagatatcg

SEQ ID NO: 96788 - DNA, 25 bp, Homo sapien
tatcgacagagtggtcttctctgcc

SEQ ID NO: 96789 - DNA, 25 bp, Homo sapien
tacatccattatccctttgccttta

SEQ ID NO: 96790 - DNA, 25 bp, Homo sapien
ctttgcctttaaccctgacattcag

SEQ ID NO: 96791 - DNA, 25 bp, Homo sapien
gacattcagtcttaacacattttat

SEQ ID NO: 96792 - DNA, 25 bp, Homo sapien
gaatgtcaagggtccacttgctatt

SEQ ID NO: 96793 - DNA, 25 bp, Homo sapien
agcagttaaattgtgcgctgtattt

SEQ ID NO: 96794 - DNA, 25 bp, Homo sapien
aaattgtgcgctgtattttgcagat

SEQ ID NO: 96795 - DNA, 25 bp, Homo sapien
gtgcgctgtattttgcagattatgg

SEQ ID NO: 96796 - DNA, 25 bp, Homo sapien
gggattcaaattctagtaataggct

SEQ ID NO: 96797 - DNA, 25 bp, Homo sapien
gtaacaacgacctagaaaagtgaga

SEQ ID NO: 96798 - DNA, 25 bp, Homo sapien
tctcatttaccatcatgtatccagt

SEQ ID NO: 96799 - DNA, 25 bp, Homo sapien
ttaccatcatgtatccagtagtgga

SEQ ID NO: 96800 - DNA, 25 bp, Homo sapien
aattcattttgatggcttctatttt

SEQ ID NO: 96801 - DNA, 25 bp, Homo sapien
gcttctatttttggccaaatgagaa

SEQ ID NO: 96802 - DNA, 25 bp, Homo sapien
taagccagtgcctgagactgtcaga

SEQ ID NO: 96803 - DNA, 25 bp, Homo sapien
cctgagactgtcagaagttgacctt

SEQ ID NO: 96804 - DNA, 25 bp, Homo sapien
cttctccatctattttgtttaagat

SEQ ID NO: 96805 - DNA, 25 bp, Homo sapien
gatttctatgatgatcagatgctga

SEQ ID NO: 96806 - DNA, 25 bp, Homo sapien
gaaatgatttttctccatctgttga

SEQ ID NO: 96807 - DNA, 25 bp, Homo sapien
tgatttttctccatctgttgagatg

SEQ ID NO: 96808 - DNA, 25 bp, Homo sapien
gaaccatccttgcatgccagaagta

SEQ ID NO: 96809 - DNA, 25 bp, Homo sapien
gccagaagtaaatggcacttgcata

SEQ ID NO: 96810 - DNA, 25 bp, Homo sapien
atggcacttgcatatctacaatcct

SEQ ID NO: 96811 - DNA, 25 bp, Homo sapien
aatccttttatatatcctcttgaat

SEQ ID NO: 96812 - DNA, 25 bp, Homo sapien
ttatatatcctcttgaatacagttt

SEQ ID NO: 96813 - DNA, 25 bp, Homo sapien
atacagttttctagtacaagtggtc

SEQ ID NO: 96814 - DNA, 25 bp, Homo sapien
ctagtacaagtggtcttcaagaagc

SEQ ID NO: 96815 - DNA, 25 bp, Homo sapien
atagcaaaatatatgtgactgaaat

SEQ ID NO: 96816 - DNA, 25 bp, Homo sapien
tttgtttccatttatagtggatcaa

SEQ ID NO: 96817 - DNA, 25 bp, Homo sapien
gcacccggcccagaataagaatact

SEQ ID NO: 96818 - DNA, 25 bp, Homo sapien
acccggcccagaataagaatactgt

SEQ ID NO: 96819 - DNA, 25 bp, Homo sapien
ggcccagaataagaatactgtcttg

SEQ ID NO: 96820 - DNA, 25 bp, Homo sapien
gaatactgtcttggaaatctagact

SEQ ID NO: 96821 - DNA, 25 bp, Homo sapien
gtcttggaaatctagacttagtcaa

SEQ ID NO: 96822 - DNA, 25 bp, Homo sapien
tctagacttagtcaagggatcttat

SEQ ID NO: 96823 - DNA, 25 bp, Homo sapien
cttagtcaagggatcttatgttttc

SEQ ID NO: 96824 - DNA, 25 bp, Homo sapien
agtcaagggatcttatgttttctat

SEQ ID NO: 96825 - DNA, 25 bp, Homo sapien
aaatatgtaatgatttcacctttaa

SEQ ID NO: 96826 - DNA, 25 bp, Homo sapien
tgtgtgacctcaatgtgtcacctcc

SEQ ID NO: 96827 - DNA, 25 bp, Homo sapien
aatgtgtcacctcctttctagtttc

SEQ ID NO: 96828 - DNA, 25 bp, Homo sapien
ggttagagtgtatctttatggcaaa

SEQ ID NO: 96829 - DNA, 25 bp, Homo sapien
ttatggcaaaacttctcagagcttc

SEQ ID NO: 96830 - DNA, 25 bp, Homo sapien
taatatgcccggtgctgtggaaatc

SEQ ID NO: 96831 - DNA, 25 bp, Homo sapien
ggagaatagcattacctgtgacagt

SEQ ID NO: 96832 - DNA, 25 bp, Homo sapien
ttacctgtgacagttcccaaatctg

SEQ ID NO: 96833 - DNA, 25 bp, Homo sapien
agttcccaaatctgtttggtcacaa

SEQ ID NO: 96834 - DNA, 25 bp, Homo sapien
tccacagaatgtcttgcaagtcgta

SEQ ID NO: 96835 - DNA, 25 bp, Homo sapien
gtcttgcaagtcgtactggtttttg

SEQ ID NO: 96836 - DNA, 25 bp, Homo sapien
ggaaattctgtattagatcttttga

SEQ ID NO: 96837 - DNA, 25 bp, Homo sapien
gtaacaggccggaaaattgtgctct

SEQ ID NO: 96838 - DNA, 25 bp, Homo sapien
gccggaaaattgtgctctagaagaa

SEQ ID NO: 96839 - DNA, 25 bp, Homo sapien
agactgaaacaggaaaggccataaa

SEQ ID NO: 96840 - DNA, 25 bp, Homo sapien
aaggccataaaatatctggttcata

SEQ ID NO: 96841 - DNA, 25 bp, Homo sapien
atatctggttcatatcacctgttgg

SEQ ID NO: 96842 - DNA, 25 bp, Homo sapien
atcacctgttggacatttccttttg

SEQ ID NO: 96843 - DNA, 25 bp, Homo sapien
ggacatttccttttggattcatgct

SEQ ID NO: 96844 - DNA, 25 bp, Homo sapien
ttccttttggattcatgctttctgg

SEQ ID NO: 96845 - DNA, 25 bp, Homo sapien
tggattcatgctttctggaaggttt

SEQ ID NO: 96846 - DNA, 25 bp, Homo sapien
taagaggattcagggttaagcacca

SEQ ID NO: 96847 - DNA, 25 bp, Homo sapien
tcagggttaagcaccaactaaatta

SEQ ID NO: 96848 - DNA, 25 bp, Homo sapien
acaagtcttttgtggaggtcaatga

SEQ ID NO: 96849 - DNA, 25 bp, Homo sapien
cgccacagctgccatcatgatgatg

SEQ ID NO: 96850 - DNA, 25 bp, Homo sapien
catcatgatgatgcggtgtgccaga

SEQ ID NO: 96851 - DNA, 25 bp, Homo sapien
atgatgcggtgtgccagattcgtcc

SEQ ID NO: 96852 - DNA, 25 bp, Homo sapien
aagaccaacgggattctcttctgcg

SEQ ID NO: 96853 - DNA, 25 bp, Homo sapien
ttttcctctccgtgaggacagggca

SEQ ID NO: 96854 - DNA, 25 bp, Homo sapien
ggcagtcttggtgtgcagcccctct

SEQ ID NO: 96855 - DNA, 25 bp, Homo sapien
gtgtgcctgcaacccaagtggcctt

SEQ ID NO: 96856 - DNA, 25 bp, Homo sapien
caagtggccttatccgtgcagtggt

SEQ ID NO: 96857 - DNA, 25 bp, Homo sapien
ttatccgtgcagtggtggcagttca

SEQ ID NO: 96858 - DNA, 25 bp, Homo sapien
gcagtggtggcagttcagaaataaa

SEQ ID NO: 96859 - DNA, 25 bp, Homo sapien
aaaccatatcaagcactgacatgac

SEQ ID NO: 96860 - DNA, 25 bp, Homo sapien
agcactgacatgacactggaggaaa

SEQ ID NO: 96861 - DNA, 25 bp, Homo sapien
gctcattagagcttttcaggttttg

SEQ ID NO: 96862 - DNA, 25 bp, Homo sapien
gagcttttcaggttttggattttcg

SEQ ID NO: 96863 - DNA, 25 bp, Homo sapien
ttcggatttgggatacttgactagt

SEQ ID NO: 96864 - DNA, 25 bp, Homo sapien
agtctaaaagacttctggtcccaag

SEQ ID NO: 96865 - DNA, 25 bp, Homo sapien
agggatacccaacctgtaataatgg

SEQ ID NO: 96866 - DNA, 25 bp, Homo sapien
gaggctgttggttaatcttggcaca

SEQ ID NO: 96867 - DNA, 25 bp, Homo sapien
tggcacaagtttaattacaggtttt

SEQ ID NO: 96868 - DNA, 25 bp, Homo sapien
tttcctgtttcttaagtacagtcaa

SEQ ID NO: 96869 - DNA, 25 bp, Homo sapien
gtcaaacataaacttactggaggaa

SEQ ID NO: 96870 - DNA, 25 bp, Homo sapien
aggcagcagcagaagtggtcctgac

SEQ ID NO: 96871 - DNA, 25 bp, Homo sapien
agaagtggtcctgacccagatgccc

SEQ ID NO: 96872 - DNA, 25 bp, Homo sapien
gatgccctgacagcttttcctggtg

SEQ ID NO: 96873 - DNA, 25 bp, Homo sapien
gcttttcctggtgtgattttggaag

SEQ ID NO: 96874 - DNA, 25 bp, Homo sapien
gtgtgattttggaagttaacccttg

SEQ ID NO: 96875 - DNA, 25 bp, Homo sapien
ttaacccttgaacagaatgggtttg

SEQ ID NO: 96876 - DNA, 25 bp, Homo sapien
gtttgaactgcgcagcttcacttaa

SEQ ID NO: 96877 - DNA, 25 bp, Homo sapien
aactgcgcagcttcacttaaatgca

SEQ ID NO: 96878 - DNA, 25 bp, Homo sapien
gcttcacttaaatgcatggattttc

SEQ ID NO: 96879 - DNA, 25 bp, Homo sapien
tcctctcagcctactcaatgcaaag

SEQ ID NO: 96880 - DNA, 25 bp, Homo sapien
tcagcctactcaatgcaaagaagac

SEQ ID NO: 96881 - DNA, 25 bp, Homo sapien
tcatttctcaccaaagagtatgcct

SEQ ID NO: 96882 - DNA, 25 bp, Homo sapien
ttctcaccaaagagtatgcctggga

SEQ ID NO: 96883 - DNA, 25 bp, Homo sapien
caaagagtatgcctgggagcctcca

SEQ ID NO: 96884 - DNA, 25 bp, Homo sapien
atgctattactacttcttatcaaaa

SEQ ID NO: 96885 - DNA, 25 bp, Homo sapien
ttatcaaaaatctgtaatgccctgt

SEQ ID NO: 96886 - DNA, 25 bp, Homo sapien
atctgtaatgccctgtgatttttat

SEQ ID NO: 96887 - DNA, 25 bp, Homo sapien
tctgtaatgccctgtgatttttatg

SEQ ID NO: 96888 - DNA, 25 bp, Homo sapien
tttatgatacttcttcaatacaaag

SEQ ID NO: 96889 - DNA, 25 bp, Homo sapien
gatacttcttcaatacaaagtgtta

SEQ ID NO: 96890 - DNA, 25 bp, Homo sapien
caaagtgttaatatgtgtcatcagt

SEQ ID NO: 96891 - DNA, 25 bp, Homo sapien
gtgtcatcagtataataacaaccaa

SEQ ID NO: 96892 - DNA, 25 bp, Homo sapien
taggagactttaatcccggtttcag

SEQ ID NO: 96893 - DNA, 25 bp, Homo sapien
ttaatcccggtttcagaagctgcag

SEQ ID NO: 96894 - DNA, 25 bp, Homo sapien
gaagctgcagctggtctgtttccag

SEQ ID NO: 96895 - DNA, 25 bp, Homo sapien
gtctgtttccaggtcagaaaccatt

SEQ ID NO: 96896 - DNA, 25 bp, Homo sapien
gaaaccattgttcagaagacctccc

SEQ ID NO: 96897 - DNA, 25 bp, Homo sapien
cagaagacctccctgtgagagagtt

SEQ ID NO: 96898 - DNA, 25 bp, Homo sapien
gagagagttgctcctcagggtccct

SEQ ID NO: 96899 - DNA, 25 bp, Homo sapien
ggaccaaagaacactcgaaaagagc

SEQ ID NO: 96900 - DNA, 25 bp, Homo sapien
gaaaagagcacttcacacagacaag

SEQ ID NO: 96901 - DNA, 25 bp, Homo sapien
agtggctaagtgtccattatttacc

SEQ ID NO: 96902 - DNA, 25 bp, Homo sapien
gtgtccattatttaccttgaacaat

SEQ ID NO: 96903 - DNA, 25 bp, Homo sapien
gccttaacctatgcttgtgaaaatg

SEQ ID NO: 96904 - DNA, 25 bp, Homo sapien
ggatgttgcagatgttttacttcaa

SEQ ID NO: 96905 - DNA, 25 bp, Homo sapien
tgcagatgttttacttcaagcaggg

SEQ ID NO: 96906 - DNA, 25 bp, Homo sapien
gctgatttagacaagcaggaggaca

SEQ ID NO: 96907 - DNA, 25 bp, Homo sapien
gacatgaagactattttggagggca

SEQ ID NO: 96908 - DNA, 25 bp, Homo sapien
ggagggcatagatccggccaagcat

SEQ ID NO: 96909 - DNA, 25 bp, Homo sapien
tgagggtggcctttgatgcttgtaa

SEQ ID NO: 96910 - DNA, 25 bp, Homo sapien
gatgcttgtaagctactacgtaaag

SEQ ID NO: 96911 - DNA, 25 bp, Homo sapien
gatgttgtaggtaaccagaactctg

SEQ ID NO: 96912 - DNA, 25 bp, Homo sapien
cagaactctggatatctgaattcca

SEQ ID NO: 96913 - DNA, 25 bp, Homo sapien
atctgaattccagccaagaagttcc

SEQ ID NO: 96914 - DNA, 25 bp, Homo sapien
ccagcccctcttaaacaggtagaga

SEQ ID NO: 96915 - DNA, 25 bp, Homo sapien
gcccctcttaaacaggtagagagct

SEQ ID NO: 96916 - DNA, 25 bp, Homo sapien
aaggtgcgtcggagtggcagatgca

SEQ ID NO: 96917 - DNA, 25 bp, Homo sapien
gatgcaggaaatgagctgtctatta

SEQ ID NO: 96918 - DNA, 25 bp, Homo sapien
aaatgagctgtctattagccttgcc

SEQ ID NO: 96919 - DNA, 25 bp, Homo sapien
atgagctgtctattagccttgcctg

SEQ ID NO: 96920 - DNA, 25 bp, Homo sapien
tgagctgtctattagccttgcctgc

SEQ ID NO: 96921 - DNA, 25 bp, Homo sapien
gagctgtctattagccttgcctgcc

SEQ ID NO: 96922 - DNA, 25 bp, Homo sapien
aggtaggcagaaatcctcactgcca

SEQ ID NO: 96923 - DNA, 25 bp, Homo sapien
taggcagaaatcctcactgccagcc

SEQ ID NO: 96924 - DNA, 25 bp, Homo sapien
tgccagcccctcttaaacaggtaga

SEQ ID NO: 96925 - DNA, 25 bp, Homo sapien
gagtgggacagaagtcacggccccc

SEQ ID NO: 96926 - DNA, 25 bp, Homo sapien
gagccacagacaggtaatagcccta

SEQ ID NO: 96927 - DNA, 25 bp, Homo sapien
gtaatagccctagccattggtgcac

SEQ ID NO: 96928 - DNA, 25 bp, Homo sapien
gccctagccattggtgcacaggatg

SEQ ID NO: 96929 - DNA, 25 bp, Homo sapien
gggatgctactgatgggaatgatta

SEQ ID NO: 96930 - DNA, 25 bp, Homo sapien
gaatgattaagggagctgctgttta

SEQ ID NO: 96931 - DNA, 25 bp, Homo sapien
ctgtttaggtggtgctggtttatgt

SEQ ID NO: 96932 - DNA, 25 bp, Homo sapien
gtgctggtttatgttctaggaactc

SEQ ID NO: 96933 - DNA, 25 bp, Homo sapien
gcactttgtaaacaccctcttgctt

SEQ ID NO: 96934 - DNA, 25 bp, Homo sapien
tgtaaacaccctcttgcttaatcct

SEQ ID NO: 96935 - DNA, 25 bp, Homo sapien
aaggagcacattaaaattctcagag

SEQ ID NO: 96936 - DNA, 25 bp, Homo sapien
aagccttcaacaagtcctcaattct

SEQ ID NO: 96937 - DNA, 25 bp, Homo sapien
caacaagtcctcaattcttaccaga

SEQ ID NO: 96938 - DNA, 25 bp, Homo sapien
caagtcctcaattcttaccagacat

SEQ ID NO: 96939 - DNA, 25 bp, Homo sapien
gacataagataattctggctgggtg

SEQ ID NO: 96940 - DNA, 25 bp, Homo sapien
cataagataattctggctgggtgcg

SEQ ID NO: 96941 - DNA, 25 bp, Homo sapien
tgagacgggtgaattacatgaggtt

SEQ ID NO: 96942 - DNA, 25 bp, Homo sapien
gagacgggtgaattacatgaggttg

SEQ ID NO: 96943 - DNA, 25 bp, Homo sapien
agacgggtgaattacatgaggttgg

SEQ ID NO: 96944 - DNA, 25 bp, Homo sapien
gacgggtgaattacatgaggttggg

SEQ ID NO: 96945 - DNA, 25 bp, Homo sapien
acgggtgaattacatgaggttggga

SEQ ID NO: 96946 - DNA, 25 bp, Homo sapien
gtgaattacatgaggttgggagttc

SEQ ID NO: 96947 - DNA, 25 bp, Homo sapien
tttttcattagacccttatacttca

SEQ ID NO: 96948 - DNA, 25 bp, Homo sapien
gacccttatacttcaagagaacaca

SEQ ID NO: 96949 - DNA, 25 bp, Homo sapien
gagaacacactcagtgcttgttttt

SEQ ID NO: 96950 - DNA, 25 bp, Homo sapien
ctacctcttaaaattccatttgctt

SEQ ID NO: 96951 - DNA, 25 bp, Homo sapien
gcttttatggttagacatgcttgac

SEQ ID NO: 96952 - DNA, 25 bp, Homo sapien
catgcttgaccaaaaatgttcagaa

SEQ ID NO: 96953 - DNA, 25 bp, Homo sapien
gaagaaaatatgtacctggtcccta

SEQ ID NO: 96954 - DNA, 25 bp, Homo sapien
tgtacctggtccctaattaagctgc

SEQ ID NO: 96955 - DNA, 25 bp, Homo sapien
cctggtccctaattaagctgcgtta

SEQ ID NO: 96956 - DNA, 25 bp, Homo sapien
taagctgcgttaaatttggtagaag

SEQ ID NO: 96957 - DNA, 25 bp, Homo sapien
aagcatttaaatggtctatcttcag

SEQ ID NO: 96958 - DNA, 25 bp, Homo sapien
taatggagagagagtaaccctccac

SEQ ID NO: 96959 - DNA, 25 bp, Homo sapien
atggagagagagtaaccctccacag

SEQ ID NO: 96960 - DNA, 25 bp, Homo sapien
tggagagagagtaaccctccacaga

SEQ ID NO: 96961 - DNA, 25 bp, Homo sapien
ggagagagagtaaccctccacagaa

SEQ ID NO: 96962 - DNA, 25 bp, Homo sapien
gagagagagtaaccctccacagaat

SEQ ID NO: 96963 - DNA, 25 bp, Homo sapien
gagagagtaaccctccacagaatgt

SEQ ID NO: 96964 - DNA, 25 bp, Homo sapien
agagagtaaccctccacagaatgtc

SEQ ID NO: 96965 - DNA, 25 bp, Homo sapien
gagagtaaccctccacagaatgtct

SEQ ID NO: 96966 - DNA, 25 bp, Homo sapien
gagtaaccctccacagaatgtctga

SEQ ID NO: 96967 - DNA, 25 bp, Homo sapien
agtaaccctccacagaatgtctgaa

SEQ ID NO: 96968 - DNA, 25 bp, Homo sapien
gtaaccctccacagaatgtctgaat

SEQ ID NO: 96969 - DNA, 25 bp, Homo sapien
gggctcctctaacatctcaggtttt

SEQ ID NO: 96970 - DNA, 25 bp, Homo sapien
atctcaggtttttatcttgtcttaa

SEQ ID NO: 96971 - DNA, 25 bp, Homo sapien
ttccctgccaaaggtgactgtgttt

SEQ ID NO: 96972 - DNA, 25 bp, Homo sapien
aggtgactgtgttttctgccgccga

SEQ ID NO: 96973 - DNA, 25 bp, Homo sapien
actgtgttttctgccgccgaaggag

SEQ ID NO: 96974 - DNA, 25 bp, Homo sapien
ttttctgccgccgaaggagggcccg

SEQ ID NO: 96975 - DNA, 25 bp, Homo sapien
ggtccctccaggctcagtgtggctt

SEQ ID NO: 96976 - DNA, 25 bp, Homo sapien
ttttctgaaactcctgtgtcccggg

SEQ ID NO: 96977 - DNA, 25 bp, Homo sapien
aaggatatgccggattctgcctggg

SEQ ID NO: 96978 - DNA, 25 bp, Homo sapien
tctaggagaccccaaatttgacacc

SEQ ID NO: 96979 - DNA, 25 bp, Homo sapien
gagaccccaaatttgacaccacaga

SEQ ID NO: 96980 - DNA, 25 bp, Homo sapien
gagacctgtcgctgatgagatgaag

SEQ ID NO: 96981 - DNA, 25 bp, Homo sapien
gatcgagcagccttcttctttggga

SEQ ID NO: 96982 - DNA, 25 bp, Homo sapien
ttcttctttgggacccctcgatatc

SEQ ID NO: 96983 - DNA, 25 bp, Homo sapien
gatatcccatggaatgctcgcacgt

SEQ ID NO: 96984 - DNA, 25 bp, Homo sapien
atgctcgcacgttctcaaagactga

SEQ ID NO: 96985 - DNA, 25 bp, Homo sapien
taccccttccttgctgtggttagta

SEQ ID NO: 96986 - DNA, 25 bp, Homo sapien
gctgtggttagtatcttgttctgtg

SEQ ID NO: 96987 - DNA, 25 bp, Homo sapien
atcttgttctgtgattggttagcaa

SEQ ID NO: 96988 - DNA, 25 bp, Homo sapien
gttagcaatgttgactacccacgta

SEQ ID NO: 96989 - DNA, 25 bp, Homo sapien
acccacgtagtgaatcttttgtctg

SEQ ID NO: 96990 - DNA, 25 bp, Homo sapien
cgtagtgaatcttttgtctgcaatt

SEQ ID NO: 96991 - DNA, 25 bp, Homo sapien
aaaatatgcctttttgaagcacgta

SEQ ID NO: 96992 - DNA, 25 bp, Homo sapien
tatgcctttttgaagcacgtacatt

SEQ ID NO: 96993 - DNA, 25 bp, Homo sapien
gcctttttgaagcacgtacattttg

SEQ ID NO: 96994 - DNA, 25 bp, Homo sapien
ttttgaagcacgtacattttgtaac

SEQ ID NO: 96995 - DNA, 25 bp, Homo sapien
gaagcacgtacattttgtaacaaag

SEQ ID NO: 96996 - DNA, 25 bp, Homo sapien
gatttaatgttttcagcccatctcc

SEQ ID NO: 96997 - DNA, 25 bp, Homo sapien
ttaatgttttcagcccatctccttt

SEQ ID NO: 96998 - DNA, 25 bp, Homo sapien
gcccatctcctttcatatttctggg

SEQ ID NO: 96999 - DNA, 25 bp, Homo sapien
tcctttcatatttctgggagacaga

SEQ ID NO: 97000 - DNA, 25 bp, Homo sapien
gaaaacatgtttccctacacctctt

SEQ ID NO: 97001 - DNA, 25 bp, Homo sapien
acatgtttccctacacctcttgctt

SEQ ID NO: 97002 - DNA, 25 bp, Homo sapien
tgatcaaagtccgaacagataccaa

SEQ ID NO: 97003 - DNA, 25 bp, Homo sapien
aagtccgaacagataccaaattaga

SEQ ID NO: 97004 - DNA, 25 bp, Homo sapien
gataccaaattagacttcaacctag

SEQ ID NO: 97005 - DNA, 25 bp, Homo sapien
gacttcaacctagaaaagagcagag

SEQ ID NO: 97006 - DNA, 25 bp, Homo sapien
ttcattgaacgaaaagaagctgctg

SEQ ID NO: 97007 - DNA, 25 bp, Homo sapien
gaaatagtggcattgcatgcccagc

SEQ ID NO: 97008 - DNA, 25 bp, Homo sapien
attgcatgcccagcaagatcgggcc

SEQ ID NO: 97009 - DNA, 25 bp, Homo sapien
aagatcgggcccttacccagacaga

SEQ ID NO: 97010 - DNA, 25 bp, Homo sapien
ttacccagacagacaggaagatcga

SEQ ID NO: 97011 - DNA, 25 bp, Homo sapien
agatcgaaactgaggttgctggcct

SEQ ID NO: 97012 - DNA, 25 bp, Homo sapien
ttgctggcctcaaaaccatgcttga

SEQ ID NO: 97013 - DNA, 25 bp, Homo sapien
tcctcctaaccaagccggatatggt

SEQ ID NO: 97014 - DNA, 25 bp, Homo sapien
aaccaagccggatatggtatggcaa

SEQ ID NO: 97015 - DNA, 25 bp, Homo sapien
gtatggcaagttaccaaacacagtg

SEQ ID NO: 97016 - DNA, 25 bp, Homo sapien
caaacacagtgagccgggactctaa

SEQ ID NO: 97017 - DNA, 25 bp, Homo sapien
aattgtaattcatgataggcttcga

SEQ ID NO: 97018 - DNA, 25 bp, Homo sapien
gataggcttcgatttcctgtgacac

SEQ ID NO: 97019 - DNA, 25 bp, Homo sapien
gcttcgatttcctgtgacactctga

SEQ ID NO: 97020 - DNA, 25 bp, Homo sapien
gtttggaacctttagcacagatttg

SEQ ID NO: 97021 - DNA, 25 bp, Homo sapien
tttggtgaaggacacgtgtcttcta

SEQ ID NO: 97022 - DNA, 25 bp, Homo sapien
gacacgtgtcttctagttctgcctt

SEQ ID NO: 97023 - DNA, 25 bp, Homo sapien
ttaagtttttgttcatgatggatat

SEQ ID NO: 97024 - DNA, 25 bp, Homo sapien
gaccgctacggcgtggagtgctgag

SEQ ID NO: 97025 - DNA, 25 bp, Homo sapien
gagtgctgagggactctgcctccaa

SEQ ID NO: 97026 - DNA, 25 bp, Homo sapien
tgctgagggactctgcctccaacgt

SEQ ID NO: 97027 - DNA, 25 bp, Homo sapien
aagagcacagactctagagactgtc

SEQ ID NO: 97028 - DNA, 25 bp, Homo sapien
tagagactgtcagagctgaccccag

SEQ ID NO: 97029 - DNA, 25 bp, Homo sapien
gactgtcagagctgaccccagctaa

SEQ ID NO: 97030 - DNA, 25 bp, Homo sapien
agctgaccccagctaaggcatggca

SEQ ID NO: 97031 - DNA, 25 bp, Homo sapien
taaggcatggcaccgcttctgtcct

SEQ ID NO: 97032 - DNA, 25 bp, Homo sapien
gcatggcaccgcttctgtcctttct

SEQ ID NO: 97033 - DNA, 25 bp, Homo sapien
gtgttgagtgacaggaggctgctta

SEQ ID NO: 97034 - DNA, 25 bp, Homo sapien
ctgcttagccacatgggaggtgctc

SEQ ID NO: 97035 - DNA, 25 bp, Homo sapien
gtgttactcacattccatgtcacag

SEQ ID NO: 97036 - DNA, 25 bp, Homo sapien
tgtcacagaacatatcagcctcaag

SEQ ID NO: 97037 - DNA, 25 bp, Homo sapien
cagcctcaagaaggatttggtggag

SEQ ID NO: 97038 - DNA, 25 bp, Homo sapien
gtggaggtggatttaccactggttt

SEQ ID NO: 97039 - DNA, 25 bp, Homo sapien
tggatttaccactggttttacaaag

SEQ ID NO: 97040 - DNA, 25 bp, Homo sapien
caaaggaccgtgtaaagtcattgaa

SEQ ID NO: 97041 - DNA, 25 bp, Homo sapien
acatcaatgacctgatctgtccttc

SEQ ID NO: 97042 - DNA, 25 bp, Homo sapien
ccagtttttattgtctttgtgtcca

SEQ ID NO: 97043 - DNA, 25 bp, Homo sapien
tttgtgtccaaagtaaactaggtga

SEQ ID NO: 97044 - DNA, 25 bp, Homo sapien
agtaaactaggtgacttatttgtat

SEQ ID NO: 97045 - DNA, 25 bp, Homo sapien
ttttgccacatgagacagtaataaa

SEQ ID NO: 97046 - DNA, 25 bp, Homo sapien
ttgagaacagaaatagtggcattgc

SEQ ID NO: 97047 - DNA, 25 bp, Homo sapien
gagaacagaaatagtggcattgcat

SEQ ID NO: 97048 - DNA, 25 bp, Homo sapien
gaacagaaatagtggcattgcatgc

SEQ ID NO: 97049 - DNA, 25 bp, Homo sapien
gaaatagtggcattgcatgcccagc

SEQ ID NO: 97050 - DNA, 25 bp, Homo sapien
gcaagatcgggcccttacccagaca

SEQ ID NO: 97051 - DNA, 25 bp, Homo sapien
acaggaagatcgaaactgaggttgc

SEQ ID NO: 97052 - DNA, 25 bp, Homo sapien
aggaagatcgaaactgaggttgctg

SEQ ID NO: 97053 - DNA, 25 bp, Homo sapien
gaagatcgaaactgaggttgctggc

SEQ ID NO: 97054 - DNA, 25 bp, Homo sapien
aagatcgaaactgaggttgctggcc

SEQ ID NO: 97055 - DNA, 25 bp, Homo sapien
agatcgaaactgaggttgctggcct

SEQ ID NO: 97056 - DNA, 25 bp, Homo sapien
gatcgaaactgaggttgctggcctc

SEQ ID NO: 97057 - DNA, 25 bp, Homo sapien
gggcctgagccgtcccctgtaagat

SEQ ID NO: 97058 - DNA, 25 bp, Homo sapien
agccgtcccctgtaagatgcgggaa

SEQ ID NO: 97059 - DNA, 25 bp, Homo sapien
taagatgcgggaagtgtcagctccc

SEQ ID NO: 97060 - DNA, 25 bp, Homo sapien
gaagtgtcagctcccggcgtggcgg

SEQ ID NO: 97061 - DNA, 25 bp, Homo sapien
ggcgcgcatggtccgccagggctgt

SEQ ID NO: 97062 - DNA, 25 bp, Homo sapien
gggccgtggcgcattttccgactgt

SEQ ID NO: 97063 - DNA, 25 bp, Homo sapien
gtggcgcattttccgactgtttgtc

SEQ ID NO: 97064 - DNA, 25 bp, Homo sapien
gcattttccgactgtttgtccagct

SEQ ID NO: 97065 - DNA, 25 bp, Homo sapien
tttccgactgtttgtccagctctca

SEQ ID NO: 97066 - DNA, 25 bp, Homo sapien
tgtttgtccagctctcactgccttc

SEQ ID NO: 97067 - DNA, 25 bp, Homo sapien
ccagcccgtggtcaggtagagagtg

SEQ ID NO: 97068 - DNA, 25 bp, Homo sapien
atgagacttactgggtgaggaaatc

SEQ ID NO: 97069 - DNA, 25 bp, Homo sapien
cattgtttaaagatggtcgtgtgtg

SEQ ID NO: 97070 - DNA, 25 bp, Homo sapien
ggaatttattatttaccgttgcttg

SEQ ID NO: 97071 - DNA, 25 bp, Homo sapien
accgttgcttgaaattactgtgtaa

SEQ ID NO: 97072 - DNA, 25 bp, Homo sapien
atgtctgataatgatttgctctttg

SEQ ID NO: 97073 - DNA, 25 bp, Homo sapien
aatgatttgctctttgacaactaaa

SEQ ID NO: 97074 - DNA, 25 bp, Homo sapien
gctctttgacaactaaaattaggac

SEQ ID NO: 97075 - DNA, 25 bp, Homo sapien
ggactgtataagtactagatgcatc

SEQ ID NO: 97076 - DNA, 25 bp, Homo sapien
agtactagatgcatcactgggtgtt

SEQ ID NO: 97077 - DNA, 25 bp, Homo sapien
gcatcactgggtgttgatcttacaa

SEQ ID NO: 97078 - DNA, 25 bp, Homo sapien
cactgggtgttgatcttacaagata

SEQ ID NO: 97079 - DNA, 25 bp, Homo sapien
cttcagccagagcacgtacttgatt

SEQ ID NO: 97080 - DNA, 25 bp, Homo sapien
cgtacttgattcagcaccggaggat

SEQ ID NO: 97081 - DNA, 25 bp, Homo sapien
ttccggcacagttccaacatgtgtc

SEQ ID NO: 97082 - DNA, 25 bp, Homo sapien
aacatgtgtcagcatcagcggattc

SEQ ID NO: 97083 - DNA, 25 bp, Homo sapien
atcagcggattcacctccgggagga

SEQ ID NO: 97084 - DNA, 25 bp, Homo sapien
tccgggaggacttctccatgtaaca

SEQ ID NO: 97085 - DNA, 25 bp, Homo sapien
tccatgtaacagtggcgcggtgtcc

SEQ ID NO: 97086 - DNA, 25 bp, Homo sapien
agggcagagtccagctgagcacttc

SEQ ID NO: 97087 - DNA, 25 bp, Homo sapien
gactctgccctttatgtattatcca

SEQ ID NO: 97088 - DNA, 25 bp, Homo sapien
tatccacacgatgttttcacagagt

SEQ ID NO: 97089 - DNA, 25 bp, Homo sapien
gtgaaaggacgtttctcattaaaca

SEQ ID NO: 97090 - DNA, 25 bp, Homo sapien
taatatgaaaagtacttagctggga

SEQ ID NO: 97091 - DNA, 25 bp, Homo sapien
aatatgaaaagtacttagctgggag

SEQ ID NO: 97092 - DNA, 25 bp, Homo sapien
tatgaaaagtacttagctgggagtg

SEQ ID NO: 97093 - DNA, 25 bp, Homo sapien
tgaaaagtacttagctgggagtggt

SEQ ID NO: 97094 - DNA, 25 bp, Homo sapien
ggagtggtggcaagcgcccttgggt

SEQ ID NO: 97095 - DNA, 25 bp, Homo sapien
gagtggtggcaagcgcccttgggtc

SEQ ID NO: 97096 - DNA, 25 bp, Homo sapien
tggcaagcgcccttgggtccagcta

SEQ ID NO: 97097 - DNA, 25 bp, Homo sapien
ggcaagcgcccttgggtccagctac

SEQ ID NO: 97098 - DNA, 25 bp, Homo sapien
aagcgcccttgggtccagctactca

SEQ ID NO: 97099 - DNA, 25 bp, Homo sapien
agcgcccttgggtccagctactcag

SEQ ID NO: 97100 - DNA, 25 bp, Homo sapien
gcgcccttgggtccagctactcagg

SEQ ID NO: 97101 - DNA, 25 bp, Homo sapien
gaagcttctagaaagatttccatta

SEQ ID NO: 97102 - DNA, 25 bp, Homo sapien
aatgggcatttatgtacctatcaca

SEQ ID NO: 97103 - DNA, 25 bp, Homo sapien
gtacctatcacatagcttaaggcat

SEQ ID NO: 97104 - DNA, 25 bp, Homo sapien
ctgtggaaggcctgagcatttagca

SEQ ID NO: 97105 - DNA, 25 bp, Homo sapien
ggcctgagcatttagcagacacaaa

SEQ ID NO: 97106 - DNA, 25 bp, Homo sapien
tctctaacacctgtatctctgaagg

SEQ ID NO: 97107 - DNA, 25 bp, Homo sapien
cacctgtatctctgaagggttggat

SEQ ID NO: 97108 - DNA, 25 bp, Homo sapien
gggattatgatcttctagttgtgct

SEQ ID NO: 97109 - DNA, 25 bp, Homo sapien
atgatcttctagttgtgctttgaga

SEQ ID NO: 97110 - DNA, 25 bp, Homo sapien
atgttgagtttaatttcccaaattg

SEQ ID NO: 97111 - DNA, 25 bp, Homo sapien
tttcccaaattgtagcagaagcttc

SEQ ID NO: 97112 - DNA, 25 bp, Homo sapien
atggccaagtttaggcactctgctt

SEQ ID NO: 97113 - DNA, 25 bp, Homo sapien
ccaagtttaggcactctgctttttg

SEQ ID NO: 97114 - DNA, 25 bp, Homo sapien
tttgccttacactaatgcttagaaa

SEQ ID NO: 97115 - DNA, 25 bp, Homo sapien
aaagctgtcttttcagtggtgttgc

SEQ ID NO: 97116 - DNA, 25 bp, Homo sapien
gtggccaacctctgctgcaaaggaa

SEQ ID NO: 97117 - DNA, 25 bp, Homo sapien
gcaaaggaatctcttgctgagtcca

SEQ ID NO: 97118 - DNA, 25 bp, Homo sapien
gtccaggccaccaatcaggcaaata

SEQ ID NO: 97119 - DNA, 25 bp, Homo sapien
aaatagcccatacatttgatcgttg

SEQ ID NO: 97120 - DNA, 25 bp, Homo sapien
ttgatcgttgtaaaccatgaagtct

SEQ ID NO: 97121 - DNA, 25 bp, Homo sapien
cttgcaagacgtttttcttctgctg

SEQ ID NO: 97122 - DNA, 25 bp, Homo sapien
gctgtggtatcttgcccttaaaaat

SEQ ID NO: 97123 - DNA, 25 bp, Homo sapien
ttccttgggcccgtcagagtctttt

SEQ ID NO: 97124 - DNA, 25 bp, Homo sapien
ttgggcccgtcagagtcttttgtgg

SEQ ID NO: 97125 - DNA, 25 bp, Homo sapien
ggcccgtcagagtcttttgtggtgc

SEQ ID NO: 97126 - DNA, 25 bp, Homo sapien
cagagtcttttgtggtgctgtgctt

SEQ ID NO: 97127 - DNA, 25 bp, Homo sapien
cagaggcaggatccaagcagatcag

SEQ ID NO: 97128 - DNA, 25 bp, Homo sapien
gcaggatccaagcagatcagcccag

SEQ ID NO: 97129 - DNA, 25 bp, Homo sapien
gatccaagcagatcagcccagccta

SEQ ID NO: 97130 - DNA, 25 bp, Homo sapien
agcaagactgggaaggaggccacat

SEQ ID NO: 97131 - DNA, 25 bp, Homo sapien
agactgggaaggaggccacattcct

SEQ ID NO: 97132 - DNA, 25 bp, Homo sapien
cccagcgatggtcttcagcaataaa

SEQ ID NO: 97133 - DNA, 25 bp, Homo sapien
cagcaataaaagttgtgtgacctaa

SEQ ID NO: 97134 - DNA, 25 bp, Homo sapien
gtaagatgaagaggcctgagcagtt

SEQ ID NO: 97135 - DNA, 25 bp, Homo sapien
gatgaagaggcctgagcagtttcgt

SEQ ID NO: 97136 - DNA, 25 bp, Homo sapien
atgaagaggcctgagcagtttcgtg

SEQ ID NO: 97137 - DNA, 25 bp, Homo sapien
agaggcctgagcagtttcgtggagg

SEQ ID NO: 97138 - DNA, 25 bp, Homo sapien
aaaagctggcactgcattctctctc

SEQ ID NO: 97139 - DNA, 25 bp, Homo sapien
aagctggcactgcattctctctctg

SEQ ID NO: 97140 - DNA, 25 bp, Homo sapien
ctggcactgcattctctctctgtag

SEQ ID NO: 97141 - DNA, 25 bp, Homo sapien
gcactgcattctctctctgtagcag

SEQ ID NO: 97142 - DNA, 25 bp, Homo sapien
agcaggacagaactgtctaaagaca

SEQ ID NO: 97143 - DNA, 25 bp, Homo sapien
tgtctaaagacaagacccctttggc

SEQ ID NO: 97144 - DNA, 25 bp, Homo sapien
tctaaagacaagacccctttggcca

SEQ ID NO: 97145 - DNA, 25 bp, Homo sapien
atctcccagaggcatttggtctgta

SEQ ID NO: 97146 - DNA, 25 bp, Homo sapien
aggcatttggtctgtatctttgctc

SEQ ID NO: 97147 - DNA, 25 bp, Homo sapien
ctgtatctttgctcaactgctaatt

SEQ ID NO: 97148 - DNA, 25 bp, Homo sapien
gctcaactgctaatttctcttggct

SEQ ID NO: 97149 - DNA, 25 bp, Homo sapien
caaccacccctaaagctcagttttg

SEQ ID NO: 97150 - DNA, 25 bp, Homo sapien
gagtgtatttatagcttctctgctg

SEQ ID NO: 97151 - DNA, 25 bp, Homo sapien
gccttctagagggatgatagatcat

SEQ ID NO: 97152 - DNA, 25 bp, Homo sapien
ttaattgtacctgaatcaacctttc

SEQ ID NO: 97153 - DNA, 25 bp, Homo sapien
atcaacctttcagcctaggacgaag

SEQ ID NO: 97154 - DNA, 25 bp, Homo sapien
taggacgaagtctaggcccaagtca

SEQ ID NO: 97155 - DNA, 25 bp, Homo sapien
tgagaattgtgtgctgaaccagtaa

SEQ ID NO: 97156 - DNA, 25 bp, Homo sapien
ccacagtgctcaggagacccgtggg

SEQ ID NO: 97157 - DNA, 25 bp, Homo sapien
gtctggaccctgtggcccagccaaa

SEQ ID NO: 97158 - DNA, 25 bp, Homo sapien
gccaaaggctaccagacagccacaa

SEQ ID NO: 97159 - DNA, 25 bp, Homo sapien
actggctcttcacagtggaccccag

SEQ ID NO: 97160 - DNA, 25 bp, Homo sapien
acggcccagcagacatgcgagcttc

SEQ ID NO: 97161 - DNA, 25 bp, Homo sapien
agacatgcgagcttccagagtgcaa

SEQ ID NO: 97162 - DNA, 25 bp, Homo sapien
gcgagcttccagagtgcaatctatg

SEQ ID NO: 97163 - DNA, 25 bp, Homo sapien
gtgcaatctatgtgatgtcttccaa

SEQ ID NO: 97164 - DNA, 25 bp, Homo sapien
atctatgtgatgtcttccaacgtta

SEQ ID NO: 97165 - DNA, 25 bp, Homo sapien
gtgatgtcttccaacgttaataaat

SEQ ID NO: 97166 - DNA, 25 bp, Homo sapien
cgttaataaatcacacagcctccca

SEQ ID NO: 97167 - DNA, 25 bp, Homo sapien
gtagaagttcccttgcagatttttt

SEQ ID NO: 97168 - DNA, 25 bp, Homo sapien
atcagtgacatgtaatgagcaattc

SEQ ID NO: 97169 - DNA, 25 bp, Homo sapien
gagcaattcacagatgagcgcaggc

SEQ ID NO: 97170 - DNA, 25 bp, Homo sapien
cagatgagcgcaggcagagctctgt

SEQ ID NO: 97171 - DNA, 25 bp, Homo sapien
agagctctgtgtgccgtgtacatat

SEQ ID NO: 97172 - DNA, 25 bp, Homo sapien
gccgtgtacatatggaccgtgctat

SEQ ID NO: 97173 - DNA, 25 bp, Homo sapien
gaccgtgctatgatgtgtctcacat

SEQ ID NO: 97174 - DNA, 25 bp, Homo sapien
tgtgtctcacattggatgatattcc

SEQ ID NO: 97175 - DNA, 25 bp, Homo sapien
attggatgatattccactttgggaa

SEQ ID NO: 97176 - DNA, 25 bp, Homo sapien
actcaccatggttttgatttgtctt

SEQ ID NO: 97177 - DNA, 25 bp, Homo sapien
ggttttgatttgtcttatattcgtt

SEQ ID NO: 97178 - DNA, 25 bp, Homo sapien
gtttatactctatactggatgaagt

SEQ ID NO: 97179 - DNA, 25 bp, Homo sapien
ttaactgtatcaagcaggaacaagc

SEQ ID NO: 97180 - DNA, 25 bp, Homo sapien
ggaacaagctcgtaaatcccaagag

SEQ ID NO: 97181 - DNA, 25 bp, Homo sapien
aaatcccaagagttacagagtcaga

SEQ ID NO: 97182 - DNA, 25 bp, Homo sapien
gagttacagagtcagattagtcaat

SEQ ID NO: 97183 - DNA, 25 bp, Homo sapien
ttagtcaatgtaataatgccctgga

SEQ ID NO: 97184 - DNA, 25 bp, Homo sapien
gtaataatgccctggagaactctga

SEQ ID NO: 97185 - DNA, 25 bp, Homo sapien
gccctggagaactctgaagaactat

SEQ ID NO: 97186 - DNA, 25 bp, Homo sapien
agaatttgcaacaaggtcattagat

SEQ ID NO: 97187 - DNA, 25 bp, Homo sapien
ggtcattagatataaaggaacctga

SEQ ID NO: 97188 - DNA, 25 bp, Homo sapien
actgcattaatacacttaacaaggg

SEQ ID NO: 97189 - DNA, 25 bp, Homo sapien
aaggcccggtggttgacatctgtgt

SEQ ID NO: 97190 - DNA, 25 bp, Homo sapien
atctgtgtggtttgttagatgagac

SEQ ID NO: 97191 - DNA, 25 bp, Homo sapien
atctgattccagttaagctataaac

SEQ ID NO: 97192 - DNA, 25 bp, Homo sapien
ggattttcttgtagccctatagttc

SEQ ID NO: 97193 - DNA, 25 bp, Homo sapien
cttgtagccctatagttctgtgact

SEQ ID NO: 97194 - DNA, 25 bp, Homo sapien
ctgtgacttcatttgctatacgctt

SEQ ID NO: 97195 - DNA, 25 bp, Homo sapien
tgctatacgctttaaatgtgttgag

SEQ ID NO: 97196 - DNA, 25 bp, Homo sapien
atgtgttgagcagcctatgaaccta

SEQ ID NO: 97197 - DNA, 25 bp, Homo sapien
gaacctaaagacatactgcagtttg

SEQ ID NO: 97198 - DNA, 25 bp, Homo sapien
gacatactgcagtttgttcataaat

SEQ ID NO: 97199 - DNA, 25 bp, Homo sapien
actaaacagtggattcctctcgtgt

SEQ ID NO: 97200 - DNA, 25 bp, Homo sapien
atggagtccggcctaacctcggcaa

SEQ ID NO: 97201 - DNA, 25 bp, Homo sapien
cctaacctcggcaattcaggctgtt

SEQ ID NO: 97202 - DNA, 25 bp, Homo sapien
ttcaggctgttgaaagcacctcaga

SEQ ID NO: 97203 - DNA, 25 bp, Homo sapien
gcacctcagaggatgggcagaccat

SEQ ID NO: 97204 - DNA, 25 bp, Homo sapien
atgggcagaccatcattgagattga

SEQ ID NO: 97205 - DNA, 25 bp, Homo sapien
tcattgagattgatccagccccgga

SEQ ID NO: 97206 - DNA, 25 bp, Homo sapien
gccccggacccagaagctgaagata

SEQ ID NO: 97207 - DNA, 25 bp, Homo sapien
ctgagggcaaagcagtcatcttgga

SEQ ID NO: 97208 - DNA, 25 bp, Homo sapien
aagcagtcatcttggagacagagct

SEQ ID NO: 97209 - DNA, 25 bp, Homo sapien
aacaccagcatcaagttcacaatgt

SEQ ID NO: 97210 - DNA, 25 bp, Homo sapien
gagattgtggtcttagaggattaac

SEQ ID NO: 97211 - DNA, 25 bp, Homo sapien
ggacctccaggcggctcagtgctgc

SEQ ID NO: 97212 - DNA, 25 bp, Homo sapien
gtttctgtccccagggagcagactg

SEQ ID NO: 97213 - DNA, 25 bp, Homo sapien
tttctgtccccagggagcagactgt

SEQ ID NO: 97214 - DNA, 25 bp, Homo sapien
ttctgtccccagggagcagactgtg

SEQ ID NO: 97215 - DNA, 25 bp, Homo sapien
tctgtccccagggagcagactgtgc

SEQ ID NO: 97216 - DNA, 25 bp, Homo sapien
ctgtccccagggagcagactgtgcg

SEQ ID NO: 97217 - DNA, 25 bp, Homo sapien
tgtccccagggagcagactgtgcgg

SEQ ID NO: 97218 - DNA, 25 bp, Homo sapien
gtccccagggagcagactgtgcggc

SEQ ID NO: 97219 - DNA, 25 bp, Homo sapien
tccccagggagcagactgtgcggca

SEQ ID NO: 97220 - DNA, 25 bp, Homo sapien
aacgaagaacctcctaacattcaat

SEQ ID NO: 97221 - DNA, 25 bp, Homo sapien
gaacctcctaacattcaattttaag

SEQ ID NO: 97222 - DNA, 25 bp, Homo sapien
attcaattttaagtcctactgcatt

SEQ ID NO: 97223 - DNA, 25 bp, Homo sapien
cctactgcattattagtttccataa

SEQ ID NO: 97224 - DNA, 25 bp, Homo sapien
gtttccataattctacaagaatgtt

SEQ ID NO: 97225 - DNA, 25 bp, Homo sapien
gacaaaattaacaaactcagacatg

SEQ ID NO: 97226 - DNA, 25 bp, Homo sapien
actcagacatgttattcatccccaa

SEQ ID NO: 97227 - DNA, 25 bp, Homo sapien
tcagacatgttattcatccccaaca

SEQ ID NO: 97228 - DNA, 25 bp, Homo sapien
gttattcatccccaacatgggtcta

SEQ ID NO: 97229 - DNA, 25 bp, Homo sapien
tccccaacatgggtctattttgtgc

SEQ ID NO: 97230 - DNA, 25 bp, Homo sapien
aacatgggtctattttgtgcttaaa

SEQ ID NO: 97231 - DNA, 25 bp, Homo sapien
gagggagatcttagatagcaagcgc

SEQ ID NO: 97232 - DNA, 25 bp, Homo sapien
agggagatcttagatagcaagcgcg

SEQ ID NO: 97233 - DNA, 25 bp, Homo sapien
ggagatcttagatagcaagcgcgga

SEQ ID NO: 97234 - DNA, 25 bp, Homo sapien
gagatcttagatagcaagcgcggag

SEQ ID NO: 97235 - DNA, 25 bp, Homo sapien
agatcttagatagcaagcgcggagc

SEQ ID NO: 97236 - DNA, 25 bp, Homo sapien
gatcttagatagcaagcgcggagct

SEQ ID NO: 97237 - DNA, 25 bp, Homo sapien
atcttagatagcaagcgcggagctg

SEQ ID NO: 97238 - DNA, 25 bp, Homo sapien
tcttagatagcaagcgcggagctgc

SEQ ID NO: 97239 - DNA, 25 bp, Homo sapien
cttagatagcaagcgcggagctgcg

SEQ ID NO: 97240 - DNA, 25 bp, Homo sapien
atagcaagcgcggagctgcgcagcg

SEQ ID NO: 97241 - DNA, 25 bp, Homo sapien
tagcaagcgcggagctgcgcagcgg

SEQ ID NO: 97242 - DNA, 25 bp, Homo sapien
gttcatgtgtgtaggtggttctgtt

SEQ ID NO: 97243 - DNA, 25 bp, Homo sapien
gaaagcattcattatgtccggagtg

SEQ ID NO: 97244 - DNA, 25 bp, Homo sapien
cattatgtccggagtgtctttttac

SEQ ID NO: 97245 - DNA, 25 bp, Homo sapien
gtgtctttttactcatctgatacag

SEQ ID NO: 97246 - DNA, 25 bp, Homo sapien
gaactcagattcttgaagccaccgt

SEQ ID NO: 97247 - DNA, 25 bp, Homo sapien
gaagccaccgttttcatattgtaat

SEQ ID NO: 97248 - DNA, 25 bp, Homo sapien
tgtaatgttaggtgttctcagaggg

SEQ ID NO: 97249 - DNA, 25 bp, Homo sapien
gggaggtacctttgtctaatcaacg

SEQ ID NO: 97250 - DNA, 25 bp, Homo sapien
tttgtctaatcaacgtttccactta

SEQ ID NO: 97251 - DNA, 25 bp, Homo sapien
caacgtttccacttagatcttttat

SEQ ID NO: 97252 - DNA, 25 bp, Homo sapien
tatttttaataagcaggcccataaa

SEQ ID NO: 97253 - DNA, 25 bp, Homo sapien
gcagtctagaagtaaaagtgacctt

SEQ ID NO: 97254 - DNA, 25 bp, Homo sapien
taaaagtgaccttaagaagactctt

SEQ ID NO: 97255 - DNA, 25 bp, Homo sapien
tacaggcaacaaatgaagcttttct

SEQ ID NO: 97256 - DNA, 25 bp, Homo sapien
gaagcttttctaagggatttttgca

SEQ ID NO: 97257 - DNA, 25 bp, Homo sapien
gatttttgcatcagttcagtcataa

SEQ ID NO: 97258 - DNA, 25 bp, Homo sapien
tcagtcataagaatacttttttcca

SEQ ID NO: 97259 - DNA, 25 bp, Homo sapien
ggtaattaggcaatagcttcactga

SEQ ID NO: 97260 - DNA, 25 bp, Homo sapien
ttaggcaatagcttcactgaaaatg

SEQ ID NO: 97261 - DNA, 25 bp, Homo sapien
gaaaatgacagcttttcattgcatt

SEQ ID NO: 97262 - DNA, 25 bp, Homo sapien
gacagcttttcattgcattatttaa

SEQ ID NO: 97263 - DNA, 25 bp, Homo sapien
atccttatatttggaattgaagtcg

SEQ ID NO: 97264 - DNA, 25 bp, Homo sapien
caagtgtcacgctcgaggtctgaag

SEQ ID NO: 97265 - DNA, 25 bp, Homo sapien
tcacgctcgaggtctgaagatgcta

SEQ ID NO: 97266 - DNA, 25 bp, Homo sapien
gaagatgctagagcgtgtccgaagc

SEQ ID NO: 97267 - DNA, 25 bp, Homo sapien
gttagcctgccaccgtacaccggag

SEQ ID NO: 97268 - DNA, 25 bp, Homo sapien
tgccaccgtacaccggagactgatc

SEQ ID NO: 97269 - DNA, 25 bp, Homo sapien
gtacaccggagactgatctcccctg

SEQ ID NO: 97270 - DNA, 25 bp, Homo sapien
aagtttgaatttgtggccagacctg

SEQ ID NO: 97271 - DNA, 25 bp, Homo sapien
tcaggccttctaggcatgtgtctga

SEQ ID NO: 97272 - DNA, 25 bp, Homo sapien
tctaggcatgtgtctgagggaagtc

SEQ ID NO: 97273 - DNA, 25 bp, Homo sapien
agggaagtctcctgagtgttagaag

SEQ ID NO: 97274 - DNA, 25 bp, Homo sapien
gtctcctgagtgttagaagtgttat

SEQ ID NO: 97275 - DNA, 25 bp, Homo sapien
tcaagaccggttgagttggcccacg

SEQ ID NO: 97276 - DNA, 25 bp, Homo sapien
tgagttggcccacggcgaacacgca

SEQ ID NO: 97277 - DNA, 25 bp, Homo sapien
gggcgtgaccgtgacaagatcagca

SEQ ID NO: 97278 - DNA, 25 bp, Homo sapien
agatcagcaacatcggcaacacggt

SEQ ID NO: 97279 - DNA, 25 bp, Homo sapien
gcaacacggtatttagcctaagcca

SEQ ID NO: 97280 - DNA, 25 bp, Homo sapien
tatttagcctaagccacacgcatca

SEQ ID NO: 97281 - DNA, 25 bp, Homo sapien
acacgcatcacatggagcttcacaa

SEQ ID NO: 97282 - DNA, 25 bp, Homo sapien
aagtatcacattaacggcgtgcgag

SEQ ID NO: 97283 - DNA, 25 bp, Homo sapien
gcgagtgacggcagagattatcaat

SEQ ID NO: 97284 - DNA, 25 bp, Homo sapien
attagaaaaccgaggcaggcgcttt

SEQ ID NO: 97285 - DNA, 25 bp, Homo sapien
gtctggaggactggaatactttgaa

SEQ ID NO: 97286 - DNA, 25 bp, Homo sapien
agcaaagcaatgcactcctgaccaa

SEQ ID NO: 97287 - DNA, 25 bp, Homo sapien
aagcaatgcactcctgaccaagtag

SEQ ID NO: 97288 - DNA, 25 bp, Homo sapien
gcaatgcactcctgaccaagtagat

SEQ ID NO: 97289 - DNA, 25 bp, Homo sapien
gcactcctgaccaagtagattcttt

SEQ ID NO: 97290 - DNA, 25 bp, Homo sapien
ctcctgaccaagtagattcttttaa

SEQ ID NO: 97291 - DNA, 25 bp, Homo sapien
attagagtgcattactttgaatcaa

SEQ ID NO: 97292 - DNA, 25 bp, Homo sapien
agagtgcattactttgaatcaaaaa

SEQ ID NO: 97293 - DNA, 25 bp, Homo sapien
taaagtactaagattgtgctcaata

SEQ ID NO: 97294 - DNA, 25 bp, Homo sapien
actaagattgtgctcaatacacaga

SEQ ID NO: 97295 - DNA, 25 bp, Homo sapien
gtgctcaatacacagaaaagtttca

SEQ ID NO: 97296 - DNA, 25 bp, Homo sapien
tactaatccagcgacaatttgaatc

SEQ ID NO: 97297 - DNA, 25 bp, Homo sapien
gagaaaggacctctccgaccggcca

SEQ ID NO: 97298 - DNA, 25 bp, Homo sapien
actgccggaaagacgaagcccaaat

SEQ ID NO: 97299 - DNA, 25 bp, Homo sapien
tccccaactactaactattccggag

SEQ ID NO: 97300 - DNA, 25 bp, Homo sapien
taactattccggaggcagcaaccat

SEQ ID NO: 97301 - DNA, 25 bp, Homo sapien
gaggcagcaaccatcttactggcgt

SEQ ID NO: 97302 - DNA, 25 bp, Homo sapien
atcttactggcgtcccttcagaaat

SEQ ID NO: 97303 - DNA, 25 bp, Homo sapien
tggcgtcccttcagaaatcaccaga

SEQ ID NO: 97304 - DNA, 25 bp, Homo sapien
aactttgatcaaaccagattcctgg

SEQ ID NO: 97305 - DNA, 25 bp, Homo sapien
gaagacagtctgcttaactggtgaa

SEQ ID NO: 97306 - DNA, 25 bp, Homo sapien
ttatggttctattctctttgaaaac

SEQ ID NO: 97307 - DNA, 25 bp, Homo sapien
atgaaccatgtgaataaaacctttg

SEQ ID NO: 97308 - DNA, 25 bp, Homo sapien
gaagcctcggaagcaatttggaact

SEQ ID NO: 97309 - DNA, 25 bp, Homo sapien
ttggaactcgatcttctcttcctta

SEQ ID NO: 97310 - DNA, 25 bp, Homo sapien
ggaactcgatcttctcttccttaaa

SEQ ID NO: 97311 - DNA, 25 bp, Homo sapien
aaccccaggcggaggaacactcaga

SEQ ID NO: 97312 - DNA, 25 bp, Homo sapien
gaacactcagacagattaaggatac

SEQ ID NO: 97313 - DNA, 25 bp, Homo sapien
aggatactgttgacctgtcactgtt

SEQ ID NO: 97314 - DNA, 25 bp, Homo sapien
cactgtttattatttcagcactaaa

SEQ ID NO: 97315 - DNA, 25 bp, Homo sapien
cagcactaaaactgaggagcctcaa

SEQ ID NO: 97316 - DNA, 25 bp, Homo sapien
taaaactgaggagcctcaactgctg

SEQ ID NO: 97317 - DNA, 25 bp, Homo sapien
tgtgtaaggagcactgcactcccat

SEQ ID NO: 97318 - DNA, 25 bp, Homo sapien
gcactgcactcccataaaaggtttt

SEQ ID NO: 97319 - DNA, 25 bp, Homo sapien
gtttctgtgcttgtaaaaaattctt

SEQ ID NO: 97320 - DNA, 25 bp, Homo sapien
ttctgtgcttgtaaaaaattcttga

SEQ ID NO: 97321 - DNA, 25 bp, Homo sapien
tctgtgcttgtaaaaaattcttgaa

SEQ ID NO: 97322 - DNA, 25 bp, Homo sapien
tgtgcttgtaaaaaattcttgaagt

SEQ ID NO: 97323 - DNA, 25 bp, Homo sapien
gtgcttgtaaaaaattcttgaagtg

SEQ ID NO: 97324 - DNA, 25 bp, Homo sapien
tgtaaaaaattcttgaagtgaggcc

SEQ ID NO: 97325 - DNA, 25 bp, Homo sapien
gtaaaaaattcttgaagtgaggccg

SEQ ID NO: 97326 - DNA, 25 bp, Homo sapien
taaaaaattcttgaagtgaggccgg

SEQ ID NO: 97327 - DNA, 25 bp, Homo sapien
aaattcttgaagtgaggccgggtgc

SEQ ID NO: 97328 - DNA, 25 bp, Homo sapien
aattcttgaagtgaggccgggtgcg

SEQ ID NO: 97329 - DNA, 25 bp, Homo sapien
attcttgaagtgaggccgggtgcgg

SEQ ID NO: 97330 - DNA, 25 bp, Homo sapien
tttgtttccatttatagtggatcaa

SEQ ID NO: 97331 - DNA, 25 bp, Homo sapien
ttaaacatgcagttgctgggtgtat

SEQ ID NO: 97332 - DNA, 25 bp, Homo sapien
gctgggtgtattatttcactcttgt

SEQ ID NO: 97333 - DNA, 25 bp, Homo sapien
tcactcttgtggttttttggcctca

SEQ ID NO: 97334 - DNA, 25 bp, Homo sapien
ctcactctttgtggaccactaaggt

SEQ ID NO: 97335 - DNA, 25 bp, Homo sapien
gcacccggcccagaataagaatact

SEQ ID NO: 97336 - DNA, 25 bp, Homo sapien
ggcccagaataagaatactgtcttg

SEQ ID NO: 97337 - DNA, 25 bp, Homo sapien
tactgtcttggaaatctagacttag

SEQ ID NO: 97338 - DNA, 25 bp, Homo sapien
tctagacttagtcaagggatcttat

SEQ ID NO: 97339 - DNA, 25 bp, Homo sapien
agtcaagggatcttatgttttctat

SEQ ID NO: 97340 - DNA, 25 bp, Homo sapien
aaatatgtaatgatttcacctttaa

SEQ ID NO: 97341 - DNA, 25 bp, Homo sapien
tcccggtagccttgttaaccctcag

SEQ ID NO: 97342 - DNA, 25 bp, Homo sapien
gttaaccctcagaggccttcaagtc

SEQ ID NO: 97343 - DNA, 25 bp, Homo sapien
ttgcccaccattaataagcttagct

SEQ ID NO: 97344 - DNA, 25 bp, Homo sapien
taataagcttagcttctcttgccac

SEQ ID NO: 97345 - DNA, 25 bp, Homo sapien
atgtcagtttgtcactcacccaaac

SEQ ID NO: 97346 - DNA, 25 bp, Homo sapien
tcactcacccaaactgaccaataaa

SEQ ID NO: 97347 - DNA, 25 bp, Homo sapien
gagactacagtaacccgacacgaag

SEQ ID NO: 97348 - DNA, 25 bp, Homo sapien
aacccgacacgaagcagatagcagt

SEQ ID NO: 97349 - DNA, 25 bp, Homo sapien
tgatccagaatcaccaagacctcca

SEQ ID NO: 97350 - DNA, 25 bp, Homo sapien
agccctggatgatgccttttccatc

SEQ ID NO: 97351 - DNA, 25 bp, Homo sapien
atcctggacttattcctgggacgtt

SEQ ID NO: 97352 - DNA, 25 bp, Homo sapien
gtattagcattactctgtccacaga

SEQ ID NO: 97353 - DNA, 25 bp, Homo sapien
gtaacatatttttctcccataacct

SEQ ID NO: 97354 - DNA, 25 bp, Homo sapien
tttctcccataacctagtgaacctg

SEQ ID NO: 97355 - DNA, 25 bp, Homo sapien
acctggaaatacaactttgcttctt

SEQ ID NO: 97356 - DNA, 25 bp, Homo sapien
ttgcttctttatgaaagtaccctgg

SEQ ID NO: 97357 - DNA, 25 bp, Homo sapien
agtaccctgggtctttcatccgtat

SEQ ID NO: 97358 - DNA, 25 bp, Homo sapien
tttcatccgtattcctgacaggagc

SEQ ID NO: 97359 - DNA, 25 bp, Homo sapien
ggagccctgatgtcttaaattctga

SEQ ID NO: 97360 - DNA, 25 bp, Homo sapien
gaaggctcccctgactttatgaagg

SEQ ID NO: 97361 - DNA, 25 bp, Homo sapien
ttttccctcctcttatttgttattg

SEQ ID NO: 97362 - DNA, 25 bp, Homo sapien
gttattgttgccctaagattgtcag

SEQ ID NO: 97363 - DNA, 25 bp, Homo sapien
aattgagggtccaagatcattcatg

SEQ ID NO: 97364 - DNA, 25 bp, Homo sapien
tccaagatcattcatgtaagaagtt

SEQ ID NO: 97365 - DNA, 25 bp, Homo sapien
gatcattcatgtaagaagtttagag

SEQ ID NO: 97366 - DNA, 25 bp, Homo sapien
aatgataaacgaaaagaacagcaat

SEQ ID NO: 97367 - DNA, 25 bp, Homo sapien
gaacagcaatagtaaaggatctttt

SEQ ID NO: 97368 - DNA, 25 bp, Homo sapien
aggatcttttctttgtttcagtaag

SEQ ID NO: 97369 - DNA, 25 bp, Homo sapien
cttttctttgtttcagtaagatgaa

SEQ ID NO: 97370 - DNA, 25 bp, Homo sapien
gatgaagaggcctgagcagtttcgt

SEQ ID NO: 97371 - DNA, 25 bp, Homo sapien
aaaaagctggcactgcattctctct

SEQ ID NO: 97372 - DNA, 25 bp, Homo sapien
tgcattctctctctgtagcaggaca

SEQ ID NO: 97373 - DNA, 25 bp, Homo sapien
tctaaagacaagacccctttggcca

SEQ ID NO: 97374 - DNA, 25 bp, Homo sapien
cgggtgggtcacatgaggttgggaa

SEQ ID NO: 97375 - DNA, 25 bp, Homo sapien
gggtgggtcacatgaggttgggaat

SEQ ID NO: 97376 - DNA, 25 bp, Homo sapien
ggtgggtcacatgaggttgggaatt

SEQ ID NO: 97377 - DNA, 25 bp, Homo sapien
gtgggtcacatgaggttgggaattc

SEQ ID NO: 97378 - DNA, 25 bp, Homo sapien
ttgggaattcgagatcagcgggacc

SEQ ID NO: 97379 - DNA, 25 bp, Homo sapien
tgggaattcgagatcagcgggacca

SEQ ID NO: 97380 - DNA, 25 bp, Homo sapien
gggaattcgagatcagcgggaccaa

SEQ ID NO: 97381 - DNA, 25 bp, Homo sapien
ggaattcgagatcagcgggaccaac

SEQ ID NO: 97382 - DNA, 25 bp, Homo sapien
gaattcgagatcagcgggaccaaca

SEQ ID NO: 97383 - DNA, 25 bp, Homo sapien
aattcgagatcagcgggaccaacat

SEQ ID NO: 97384 - DNA, 25 bp, Homo sapien
cgagatcagcgggaccaacatggtg

SEQ ID NO: 97385 - DNA, 25 bp, Homo sapien
aacacttatgtgctgggctttcttt

SEQ ID NO: 97386 - DNA, 25 bp, Homo sapien
tgtgctgggctttcttttaaatgct

SEQ ID NO: 97387 - DNA, 25 bp, Homo sapien
tgctttccaagtgttaacttgttta

SEQ ID NO: 97388 - DNA, 25 bp, Homo sapien
ttgtttagtcccctttactctgaga

SEQ ID NO: 97389 - DNA, 25 bp, Homo sapien
agtcccctttactctgagataggta

SEQ ID NO: 97390 - DNA, 25 bp, Homo sapien
ccagttttacaaatggctaagctga

SEQ ID NO: 97391 - DNA, 25 bp, Homo sapien
gatgttgaaggatcctacctaaggg

SEQ ID NO: 97392 - DNA, 25 bp, Homo sapien
gcacaactagtaagggagtagagct

SEQ ID NO: 97393 - DNA, 25 bp, Homo sapien
gagtagagctgagattggctccaga

SEQ ID NO: 97394 - DNA, 25 bp, Homo sapien
tttcagccaccattttatgctgcct

SEQ ID NO: 97395 - DNA, 25 bp, Homo sapien
ttcttcagtgtttctatagcagaga

SEQ ID NO: 97396 - DNA, 25 bp, Homo sapien
ggtgtgcctattgagagcgtgtaat

SEQ ID NO: 97397 - DNA, 25 bp, Homo sapien
ctattgagagcgtgtaatggcgttt

SEQ ID NO: 97398 - DNA, 25 bp, Homo sapien
tgcacgtgcgcctgagggtgggcat

SEQ ID NO: 97399 - DNA, 25 bp, Homo sapien
tgggcatgagtcttgccagaatgtg

SEQ ID NO: 97400 - DNA, 25 bp, Homo sapien
agtcttgccagaatgtgagtgtgag

SEQ ID NO: 97401 - DNA, 25 bp, Homo sapien
gtgagagggactgcgtttgcatttt

SEQ ID NO: 97402 - DNA, 25 bp, Homo sapien
gagggactgcgtttgcatttttata

SEQ ID NO: 97403 - DNA, 25 bp, Homo sapien
tagttaaccctttcttgactctgag

SEQ ID NO: 97404 - DNA, 25 bp, Homo sapien
tgactctgagtgctgtgaatttctt

SEQ ID NO: 97405 - DNA, 25 bp, Homo sapien
ctctgagtgctgtgaatttctttac

SEQ ID NO: 97406 - DNA, 25 bp, Homo sapien
agtgctgtgaatttctttactgatt

SEQ ID NO: 97407 - DNA, 25 bp, Homo sapien
tagtagtcatactccctggtgtagt

SEQ ID NO: 97408 - DNA, 25 bp, Homo sapien
ggtgtagtgtattctctaaaagctt

SEQ ID NO: 97409 - DNA, 25 bp, Homo sapien
taaatgtctgcatgcagccagccat

SEQ ID NO: 97410 - DNA, 25 bp, Homo sapien
tgcatgcagccagccatcaaatagt

SEQ ID NO: 97411 - DNA, 25 bp, Homo sapien
atcaaatagtgaatggtctctcttt

SEQ ID NO: 97412 - DNA, 25 bp, Homo sapien
ggagaacatcataacccatgaagga

SEQ ID NO: 97413 - DNA, 25 bp, Homo sapien
taaaagccccaaatggtggtaactg

SEQ ID NO: 97414 - DNA, 25 bp, Homo sapien
aatgctttaagatttggtcacactc

SEQ ID NO: 97415 - DNA, 25 bp, Homo sapien
tcacctaggtgagcgcattgagcca

SEQ ID NO: 97416 - DNA, 25 bp, Homo sapien
agcgcattgagccagtggtgctaaa

SEQ ID NO: 97417 - DNA, 25 bp, Homo sapien
ggtgctaaatgctacatactccaac

SEQ ID NO: 97418 - DNA, 25 bp, Homo sapien
gtcagacatggagaggaaaatcgca

SEQ ID NO: 97419 - DNA, 25 bp, Homo sapien
gaaaatcgcagaattggagacggaa

SEQ ID NO: 97420 - DNA, 25 bp, Homo sapien
acctggagaggcaagtgaacgagca

SEQ ID NO: 97421 - DNA, 25 bp, Homo sapien
aaatgtgaagccactgagaagcggg

SEQ ID NO: 97422 - DNA, 25 bp, Homo sapien
agaagcacaatgaggagattcagtt

SEQ ID NO: 97423 - DNA, 25 bp, Homo sapien
gattcagttcctgaagcgaacaaat

SEQ ID NO: 97424 - DNA, 25 bp, Homo sapien
gaagcgaacaaatcagcagctgaag

SEQ ID NO: 97425 - DNA, 25 bp, Homo sapien
agctgaaggcccaactggaaggcat

SEQ ID NO: 97426 - DNA, 25 bp, Homo sapien
aactggaaggcattattgcaccaaa

SEQ ID NO: 97427 - DNA, 25 bp, Homo sapien
gaagtgataatttccacatgattaa

SEQ ID NO: 97428 - DNA, 25 bp, Homo sapien
agttatttactgtgttcctctggca

SEQ ID NO: 97429 - DNA, 25 bp, Homo sapien
aacggaagagcgaaccaggctagca

SEQ ID NO: 97430 - DNA, 25 bp, Homo sapien
gaaccaggctagcaaaagagctttc

SEQ ID NO: 97431 - DNA, 25 bp, Homo sapien
aaagagctttcttcacttcgagacc

SEQ ID NO: 97432 - DNA, 25 bp, Homo sapien
tcttcacttcgagaccaaagggaac

SEQ ID NO: 97433 - DNA, 25 bp, Homo sapien
atacaaagactgtgatccgcaagtt

SEQ ID NO: 97434 - DNA, 25 bp, Homo sapien
actgtgatccgcaagttgtggaaga

SEQ ID NO: 97435 - DNA, 25 bp, Homo sapien
gatggactgataacatattcgcaat

SEQ ID NO: 97436 - DNA, 25 bp, Homo sapien
tattcgcaataaaatcttgggccaa

SEQ ID NO: 97437 - DNA, 25 bp, Homo sapien
attgatagaacttttggaattccag

SEQ ID NO: 97438 - DNA, 25 bp, Homo sapien
ccagaagactttgactacatagact

SEQ ID NO: 97439 - DNA, 25 bp, Homo sapien
atagactaaaatattccatggtggt

SEQ ID NO: 97440 - DNA, 25 bp, Homo sapien
gggacatgagttctttgctgacctc

SEQ ID NO: 97441 - DNA, 25 bp, Homo sapien
ttgctgacctccctagcggaagaaa

SEQ ID NO: 97442 - DNA, 25 bp, Homo sapien
aagcaaattccttgcagttatgcaa

SEQ ID NO: 97443 - DNA, 25 bp, Homo sapien
gcagttatgcaataggctttaggaa

SEQ ID NO: 97444 - DNA, 25 bp, Homo sapien
aagactgcaaccaacggaaatcaat

SEQ ID NO: 97445 - DNA, 25 bp, Homo sapien
taaactgactttgttttggctgttt

SEQ ID NO: 97446 - DNA, 25 bp, Homo sapien
gttctgtatgtattttagcaatctc

SEQ ID NO: 97447 - DNA, 25 bp, Homo sapien
tagcaatctcatctcacctaactga

SEQ ID NO: 97448 - DNA, 25 bp, Homo sapien
tcacctaactgagatgtgtttcaat

SEQ ID NO: 97449 - DNA, 25 bp, Homo sapien
gagatgtgtttcaattatattcctt

SEQ ID NO: 97450 - DNA, 25 bp, Homo sapien
ttctagggagaaactgtcttccatt

SEQ ID NO: 97451 - DNA, 25 bp, Homo sapien
ggatgagatttaatgcccatatctt

SEQ ID NO: 97452 - DNA, 25 bp, Homo sapien
gatttaatgcccatatcttaccagt

SEQ ID NO: 97453 - DNA, 25 bp, Homo sapien
taatgcccatatcttaccagttcag

SEQ ID NO: 97454 - DNA, 25 bp, Homo sapien
atgcccatatcttaccagttcagtt

SEQ ID NO: 97455 - DNA, 25 bp, Homo sapien
tgcccatatcttaccagttcagtta

SEQ ID NO: 97456 - DNA, 25 bp, Homo sapien
tcagttatctccagagccatttcac

SEQ ID NO: 97457 - DNA, 25 bp, Homo sapien
tccagagccatttcaccctttagag

SEQ ID NO: 97458 - DNA, 25 bp, Homo sapien
agagccatttcaccctttagagtga

SEQ ID NO: 97459 - DNA, 25 bp, Homo sapien
agccatttcaccctttagagtgagt

SEQ ID NO: 97460 - DNA, 25 bp, Homo sapien
ccatttcaccctttagagtgagtca

SEQ ID NO: 97461 - DNA, 25 bp, Homo sapien
gataggaaaatgaagtgtttgctct

SEQ ID NO: 97462 - DNA, 25 bp, Homo sapien
tgtgggaccctccatttcactcagg

SEQ ID NO: 97463 - DNA, 25 bp, Homo sapien
cttgggccttgtgccagttgaagag

SEQ ID NO: 97464 - DNA, 25 bp, Homo sapien
aggtggacagtcctgactcctgcca

SEQ ID NO: 97465 - DNA, 25 bp, Homo sapien
tgactcctgccaagtgagtggagga

SEQ ID NO: 97466 - DNA, 25 bp, Homo sapien
ggcctacgtaggacaggaacctgga

SEQ ID NO: 97467 - DNA, 25 bp, Homo sapien
aggacaggaacctggaatgcagctc

SEQ ID NO: 97468 - DNA, 25 bp, Homo sapien
gccactggtgcgtgtgtcttttgaa

SEQ ID NO: 97469 - DNA, 25 bp, Homo sapien
gtgtgtcttttgaaacaccacctct

SEQ ID NO: 97470 - DNA, 25 bp, Homo sapien
tgaaacaccacctctcacaatttag

SEQ ID NO: 97471 - DNA, 25 bp, Homo sapien
accacctctcacaatttaggcagaa

SEQ ID NO: 97472 - DNA, 25 bp, Homo sapien
taggcagaagctgatatcccagaaa

SEQ ID NO: 97473 - DNA, 25 bp, Homo sapien
cagagtccgtggagcgcgagatcca

SEQ ID NO: 97474 - DNA, 25 bp, Homo sapien
tggagcgcgagatccagtacgtcaa

SEQ ID NO: 97475 - DNA, 25 bp, Homo sapien
agatccagtacgtcaaggacctgct

SEQ ID NO: 97476 - DNA, 25 bp, Homo sapien
gtacgtcaaggacctgctcatcgag

SEQ ID NO: 97477 - DNA, 25 bp, Homo sapien
aaggacctgctcatcgaggtttaca

SEQ ID NO: 97478 - DNA, 25 bp, Homo sapien
tgctcatcgaggtttacaaggcccg

SEQ ID NO: 97479 - DNA, 25 bp, Homo sapien
tcgaggtttacaaggcccggagcca

SEQ ID NO: 97480 - DNA, 25 bp, Homo sapien
gcccggagccagaggacccgtagct

SEQ ID NO: 97481 - DNA, 25 bp, Homo sapien
gccagaggacccgtagctgctagaa

SEQ ID NO: 97482 - DNA, 25 bp, Homo sapien
aggacccgtagctgctagaagggca

SEQ ID NO: 97483 - DNA, 25 bp, Homo sapien
tggtcttcagctctggcgccttcat

SEQ ID NO: 97484 - DNA, 25 bp, Homo sapien
gatttccattaaatgatgcctctgt

SEQ ID NO: 97485 - DNA, 25 bp, Homo sapien
gatgcctctgtttaatacacctggt

SEQ ID NO: 97486 - DNA, 25 bp, Homo sapien
atacacctggtacatttctgaagag

SEQ ID NO: 97487 - DNA, 25 bp, Homo sapien
tgggcaggcccagcttataagttaa

SEQ ID NO: 97488 - DNA, 25 bp, Homo sapien
agttaaagggcatcacagtgagggt

SEQ ID NO: 97489 - DNA, 25 bp, Homo sapien
gaaactaggaccagcttaacttata

SEQ ID NO: 97490 - DNA, 25 bp, Homo sapien
atttccagtcattcagctgtggtta

SEQ ID NO: 97491 - DNA, 25 bp, Homo sapien
aaagcagacttacatgtaaaccgga

SEQ ID NO: 97492 - DNA, 25 bp, Homo sapien
gacttacatgtaaaccggaatcctc

SEQ ID NO: 97493 - DNA, 25 bp, Homo sapien
aaaccggaatcctctctatacaagt

SEQ ID NO: 97494 - DNA, 25 bp, Homo sapien
ggaatcctctctatacaagtttatt

SEQ ID NO: 97495 - DNA, 25 bp, Homo sapien
tccagccttcccctgttgtttttag

SEQ ID NO: 97496 - DNA, 25 bp, Homo sapien
ccctgttgtttttagtctcttgtgc

SEQ ID NO: 97497 - DNA, 25 bp, Homo sapien
agtctcttgtgctgtgcctagtggc

SEQ ID NO: 97498 - DNA, 25 bp, Homo sapien
gacactgccccgtctaggtttttat

SEQ ID NO: 97499 - DNA, 25 bp, Homo sapien
ggtttttataaatgtcttactcaag

SEQ ID NO: 97500 - DNA, 25 bp, Homo sapien
gtcttactcaagttcaaacctccag

SEQ ID NO: 97501 - DNA, 25 bp, Homo sapien
aagttcaaacctccagcctgtgaat

SEQ ID NO: 97502 - DNA, 25 bp, Homo sapien
gcctgtgaatcaactgtgtctcttt

SEQ ID NO: 97503 - DNA, 25 bp, Homo sapien
gtgtctcttttttgacttggtaagc

SEQ ID NO: 97504 - DNA, 25 bp, Homo sapien
ttctcccactgttgtaaataacttt

SEQ ID NO: 97505 - DNA, 25 bp, Homo sapien
tggccaaaccccagatttgtacttt

SEQ ID NO: 97506 - DNA, 25 bp, Homo sapien
gggcacgcactggcttaacagttta

SEQ ID NO: 97507 - DNA, 25 bp, Homo sapien
tataaggctcaaatagtctatacct

SEQ ID NO: 97508 - DNA, 25 bp, Homo sapien
tagtctatacctgaactgctataag

SEQ ID NO: 97509 - DNA, 25 bp, Homo sapien
aactgctataagcaaggtcgatagg

SEQ ID NO: 97510 - DNA, 25 bp, Homo sapien
gaagtggatagattgcttcagcaaa

SEQ ID NO: 97511 - DNA, 25 bp, Homo sapien
agtgaactgtgagatctccaggaca

SEQ ID NO: 97512 - DNA, 25 bp, Homo sapien
acagattggttattgcaggtatcac

SEQ ID NO: 97513 - DNA, 25 bp, Homo sapien
ggtatcacagcctaaagaaattatc

SEQ ID NO: 97514 - DNA, 25 bp, Homo sapien
aatgatttagcagtctccacgtgtg

SEQ ID NO: 97515 - DNA, 25 bp, Homo sapien
tctccacgtgtgttaatgtttcaaa

SEQ ID NO: 97516 - DNA, 25 bp, Homo sapien
gtttcaaacgtgtatcataatgtgt

SEQ ID NO: 97517 - DNA, 25 bp, Homo sapien
tgctctcttttttgagtgccccact

SEQ ID NO: 97518 - DNA, 25 bp, Homo sapien
tctcttttttgagtgccccactcat

SEQ ID NO: 97519 - DNA, 25 bp, Homo sapien
ttttgagtgccccactcattggtgc

SEQ ID NO: 97520 - DNA, 25 bp, Homo sapien
tgagtgccccactcattggtgccct

SEQ ID NO: 97521 - DNA, 25 bp, Homo sapien
agtgccccactcattggtgccctgt

SEQ ID NO: 97522 - DNA, 25 bp, Homo sapien
ccactcattggtgccctgtctgatg

SEQ ID NO: 97523 - DNA, 25 bp, Homo sapien
ctcattggtgccctgtctgatgtgt

SEQ ID NO: 97524 - DNA, 25 bp, Homo sapien
cattggtgccctgtctgatgtgtgg

SEQ ID NO: 97525 - DNA, 25 bp, Homo sapien
tcggcactgtattctttacctgctt

SEQ ID NO: 97526 - DNA, 25 bp, Homo sapien
cactgatgaggatcagcccatgccg

SEQ ID NO: 97527 - DNA, 25 bp, Homo sapien
ctgatgaggatcagcccatgccggg

SEQ ID NO: 97528 - DNA, 25 bp, Homo sapien
gatttccattaaatgatgcctctgt

SEQ ID NO: 97529 - DNA, 25 bp, Homo sapien
atgatgcctctgtttaatacacctg

SEQ ID NO: 97530 - DNA, 25 bp, Homo sapien
gatgcctctgtttaatacacctggt

SEQ ID NO: 97531 - DNA, 25 bp, Homo sapien
gcctctgtttaatacacctggtaca

SEQ ID NO: 97532 - DNA, 25 bp, Homo sapien
atacacctggtacatttctgaagag

SEQ ID NO: 97533 - DNA, 25 bp, Homo sapien
acacctggtacatttctgaagaggg

SEQ ID NO: 97534 - DNA, 25 bp, Homo sapien
gggctttataagcaggctgggcagg

SEQ ID NO: 97535 - DNA, 25 bp, Homo sapien
tgggcaggcccagcttataagttaa

SEQ ID NO: 97536 - DNA, 25 bp, Homo sapien
gcaggcccagcttataagttaaagg

SEQ ID NO: 97537 - DNA, 25 bp, Homo sapien
aagttaaagggcatcacagtgaggg

SEQ ID NO: 97538 - DNA, 25 bp, Homo sapien
gcatcacagtgagggtgtagtagat

SEQ ID NO: 97539 - DNA, 25 bp, Homo sapien
gatttggtgccctgaacttttttat

SEQ ID NO: 97540 - DNA, 25 bp, Homo sapien
taagaaatcagatcccagggtgaga

SEQ ID NO: 97541 - DNA, 25 bp, Homo sapien
tcccagggtgagagtaacaggccat

SEQ ID NO: 97542 - DNA, 25 bp, Homo sapien
gagtaacaggccatttggccaagaa

SEQ ID NO: 97543 - DNA, 25 bp, Homo sapien
tggccaagaaagaaacctgtttgtt

SEQ ID NO: 97544 - DNA, 25 bp, Homo sapien
gaactatgaaaagaccctgtttgtg

SEQ ID NO: 97545 - DNA, 25 bp, Homo sapien
aaggatgtctgcagaactttgttct

SEQ ID NO: 97546 - DNA, 25 bp, Homo sapien
gaatagttcagagtgaaaacctttt

SEQ ID NO: 97547 - DNA, 25 bp, Homo sapien
ccttttgtgatggttgatgtctcag

SEQ ID NO: 97548 - DNA, 25 bp, Homo sapien
gtctcaggaataagctggatctcca

SEQ ID NO: 97549 - DNA, 25 bp, Homo sapien
taagctggatctccaatgttttggg

SEQ ID NO: 97550 - DNA, 25 bp, Homo sapien
ctgctgtgagctgaaatggcgccac

SEQ ID NO: 97551 - DNA, 25 bp, Homo sapien
ggataaattgtagcgtatgcaccat

SEQ ID NO: 97552 - DNA, 25 bp, Homo sapien
aattgtagcgtatgcaccattcatt

SEQ ID NO: 97553 - DNA, 25 bp, Homo sapien
tgtagcgtatgcaccattcattatg

SEQ ID NO: 97554 - DNA, 25 bp, Homo sapien
gcgtatgcaccattcattatgctaa

SEQ ID NO: 97555 - DNA, 25 bp, Homo sapien
gtatgcaccattcattatgctaaga

SEQ ID NO: 97556 - DNA, 25 bp, Homo sapien
gcaccattcattatgctaagacatt

SEQ ID NO: 97557 - DNA, 25 bp, Homo sapien
gtaattatgagaaacgctctactaa

SEQ ID NO: 97558 - DNA, 25 bp, Homo sapien
gagaaacgctctactaatgatttgt

SEQ ID NO: 97559 - DNA, 25 bp, Homo sapien
acgctctactaatgatttgttttta

SEQ ID NO: 97560 - DNA, 25 bp, Homo sapien
tttttctgcttattagacaaatata

SEQ ID NO: 97561 - DNA, 25 bp, Homo sapien
taaaccagaagggtctcgctcacct

SEQ ID NO: 97562 - DNA, 25 bp, Homo sapien
tcccctggcctgttgtggagcacca

SEQ ID NO: 97563 - DNA, 25 bp, Homo sapien
ctggcgtggcactgaggacaccaaa

SEQ ID NO: 97564 - DNA, 25 bp, Homo sapien
ggacaccaaagaggacagtctctgc

SEQ ID NO: 97565 - DNA, 25 bp, Homo sapien
cagtctctgccccaaggatgcttgg

SEQ ID NO: 97566 - DNA, 25 bp, Homo sapien
ggccccgggaagacaccgacaatga

SEQ ID NO: 97567 - DNA, 25 bp, Homo sapien
aatgagaagagttggtcaccctgtc

SEQ ID NO: 97568 - DNA, 25 bp, Homo sapien
agttggtcaccctgtcaccactgaa

SEQ ID NO: 97569 - DNA, 25 bp, Homo sapien
cactgaaccttgatttaacagaggc

SEQ ID NO: 97570 - DNA, 25 bp, Homo sapien
ggcaaaatgcaagtcttccctgaag

SEQ ID NO: 97571 - DNA, 25 bp, Homo sapien
gggtagggaaacttctagtggcaat

SEQ ID NO: 97572 - DNA, 25 bp, Homo sapien
taggctctcagcatgactattttta

SEQ ID NO: 97573 - DNA, 25 bp, Homo sapien
gactatttttagagaccccgtgtct

SEQ ID NO: 97574 - DNA, 25 bp, Homo sapien
tatttttagagaccccgtgtctgtc

SEQ ID NO: 97575 - DNA, 25 bp, Homo sapien
tttttgtgggagactattcctccca

SEQ ID NO: 97576 - DNA, 25 bp, Homo sapien
gggagactattcctcccatctgcaa

SEQ ID NO: 97577 - DNA, 25 bp, Homo sapien
ctcatcccagagaaacaggtcagct

SEQ ID NO: 97578 - DNA, 25 bp, Homo sapien
ggcaggaggcagtcactgaccccga

SEQ ID NO: 97579 - DNA, 25 bp, Homo sapien
ggcagtcactgaccccgagacgttt

SEQ ID NO: 97580 - DNA, 25 bp, Homo sapien
gaccccgagacgtttgcatcctgca

SEQ ID NO: 97581 - DNA, 25 bp, Homo sapien
gctagaggtcctttattaaaagcac

SEQ ID NO: 97582 - DNA, 25 bp, Homo sapien
ttaaaagcacactgttggtttcaaa

SEQ ID NO: 97583 - DNA, 25 bp, Homo sapien
gagtctgcagatctcaccagcctca

SEQ ID NO: 97584 - DNA, 25 bp, Homo sapien
ggtaacattgaacctgatccagtta

SEQ ID NO: 97585 - DNA, 25 bp, Homo sapien
gaacctgatccagttactgaagagt

SEQ ID NO: 97586 - DNA, 25 bp, Homo sapien
ctgaagagtttagaggatccacagt

SEQ ID NO: 97587 - DNA, 25 bp, Homo sapien
cacagtggaagctgtatctcaaaac

SEQ ID NO: 97588 - DNA, 25 bp, Homo sapien
actcagaacgtttggaagaactcag

SEQ ID NO: 97589 - DNA, 25 bp, Homo sapien
gaactcagtaggtaggtttccaggt

SEQ ID NO: 97590 - DNA, 25 bp, Homo sapien
gtaggtaggtttccaggtgatcaaa

SEQ ID NO: 97591 - DNA, 25 bp, Homo sapien
aaagcagcttttcacttaacatcaa

SEQ ID NO: 97592 - DNA, 25 bp, Homo sapien
agaaatccatcatgtcaccttagac

SEQ ID NO: 97593 - DNA, 25 bp, Homo sapien
gtcaccttagacttcaatacttgta

SEQ ID NO: 97594 - DNA, 25 bp, Homo sapien
cttcatgagatgcagaacctccagg

SEQ ID NO: 97595 - DNA, 25 bp, Homo sapien
tcatgagatgcagaacctccaggag

SEQ ID NO: 97596 - DNA, 25 bp, Homo sapien
agcagcccttgcattccttttttgt

SEQ ID NO: 97597 - DNA, 25 bp, Homo sapien
cagcccttgcattccttttttgtac

SEQ ID NO: 97598 - DNA, 25 bp, Homo sapien
tccttttttgtaccagactgatgag

SEQ ID NO: 97599 - DNA, 25 bp, Homo sapien
tgtaccagactgatgagaacaatga

SEQ ID NO: 97600 - DNA, 25 bp, Homo sapien
cagactgatgagaacaatgaggtga

SEQ ID NO: 97601 - DNA, 25 bp, Homo sapien
ttaccctcacagtagcaagcataag

SEQ ID NO: 97602 - DNA, 25 bp, Homo sapien
ctcacagtagcaagcataagacccc

SEQ ID NO: 97603 - DNA, 25 bp, Homo sapien
gatcaccataatctaaaaggccact

SEQ ID NO: 97604 - DNA, 25 bp, Homo sapien
accataatctaaaaggccactaaat

SEQ ID NO: 97605 - DNA, 25 bp, Homo sapien
ccagaagtccggtcaccatccaggg

SEQ ID NO: 97606 - DNA, 25 bp, Homo sapien
ctgatgaggacagaccagctgaaat

SEQ ID NO: 97607 - DNA, 25 bp, Homo sapien
gacagaccagctgaaattgggtgga

SEQ ID NO: 97608 - DNA, 25 bp, Homo sapien
aattgggtggaggaccgttctctgt

SEQ ID NO: 97609 - DNA, 25 bp, Homo sapien
ggaggaccgttctctgtccccaggt

SEQ ID NO: 97610 - DNA, 25 bp, Homo sapien
aggtcctgtctctgcacagaaactt

SEQ ID NO: 97611 - DNA, 25 bp, Homo sapien
cagaaacttgaactccaggatggaa

SEQ ID NO: 97612 - DNA, 25 bp, Homo sapien
tctgctgggactcctttgcatggca

SEQ ID NO: 97613 - DNA, 25 bp, Homo sapien
tgggactcctttgcatggcagggcc

SEQ ID NO: 97614 - DNA, 25 bp, Homo sapien
ctttgcatggcagggcctcatctca

SEQ ID NO: 97615 - DNA, 25 bp, Homo sapien
tcacctctcgcaagagggtctcttt

SEQ ID NO: 97616 - DNA, 25 bp, Homo sapien
atcagttttcctcactggttggata

SEQ ID NO: 97617 - DNA, 25 bp, Homo sapien
ttcctcactggttggatagcctatc

SEQ ID NO: 97618 - DNA, 25 bp, Homo sapien
tggatagcctatcagtttatggaag

SEQ ID NO: 97619 - DNA, 25 bp, Homo sapien
aacttccgtaagttacatccttatg

SEQ ID NO: 97620 - DNA, 25 bp, Homo sapien
tacatccttatggaagctactgaat

SEQ ID NO: 97621 - DNA, 25 bp, Homo sapien
gagaaatagcctcttcactggtatg

SEQ ID NO: 97622 - DNA, 25 bp, Homo sapien
tagcctcttcactggtatgcaaaca

SEQ ID NO: 97623 - DNA, 25 bp, Homo sapien
aacagatttgattttgcatcctatc

SEQ ID NO: 97624 - DNA, 25 bp, Homo sapien
gcaccccaacataggcatacttaag

SEQ ID NO: 97625 - DNA, 25 bp, Homo sapien
gtaatatacatactcctgtgctaac

SEQ ID NO: 97626 - DNA, 25 bp, Homo sapien
actcctgtgctaacatgtatactag

SEQ ID NO: 97627 - DNA, 25 bp, Homo sapien
aggcatgctatgtgttacgtgtttt

SEQ ID NO: 97628 - DNA, 25 bp, Homo sapien
gctatgtgttacgtgttttttccag

SEQ ID NO: 97629 - DNA, 25 bp, Homo sapien
atgtgttacgtgttttttccagtat

SEQ ID NO: 97630 - DNA, 25 bp, Homo sapien
tgttacgtgttttttccagtatgtt

SEQ ID NO: 97631 - DNA, 25 bp, Homo sapien
ttatttgccaccaaaaagtaaatgc

SEQ ID NO: 97632 - DNA, 25 bp, Homo sapien
aagtaaatgcattttcacccattct

SEQ ID NO: 97633 - DNA, 25 bp, Homo sapien
tttcacccattctgtggttcattgt

SEQ ID NO: 97634 - DNA, 25 bp, Homo sapien
cccattctgtggttcattgtagttt

SEQ ID NO: 97635 - DNA, 25 bp, Homo sapien
tctgtggttcattgtagtttaagga

SEQ ID NO: 97636 - DNA, 25 bp, Homo sapien
aggaaaccaagcatatagatgcatt

SEQ ID NO: 97637 - DNA, 25 bp, Homo sapien
tatagatgcattagtgattttgttt

SEQ ID NO: 97638 - DNA, 25 bp, Homo sapien
ggatgttctggcagctgtgtcataa

SEQ ID NO: 97639 - DNA, 25 bp, Homo sapien
atgctgctgggttcattcattcatt

SEQ ID NO: 97640 - DNA, 25 bp, Homo sapien
taaatcccttgccagttaccattaa

SEQ ID NO: 97641 - DNA, 25 bp, Homo sapien
agcttttgtttagggatctttctga

SEQ ID NO: 97642 - DNA, 25 bp, Homo sapien
gtttagggatctttctgatggtctt

SEQ ID NO: 97643 - DNA, 25 bp, Homo sapien
cttagttctaagtcattgttcccat

SEQ ID NO: 97644 - DNA, 25 bp, Homo sapien
tgttcccatcccttttttgtgtgtt

SEQ ID NO: 97645 - DNA, 25 bp, Homo sapien
aatagtgaacttgattcccctgctt

SEQ ID NO: 97646 - DNA, 25 bp, Homo sapien
ctgcttccactaaatccagttgtga

SEQ ID NO: 97647 - DNA, 25 bp, Homo sapien
gttgtgacaaaatctaacgtgacat

SEQ ID NO: 97648 - DNA, 25 bp, Homo sapien
ctaacgtgacatcagatcgaaaggt

SEQ ID NO: 97649 - DNA, 25 bp, Homo sapien
gggtcctgagaggagagtttcctaa

SEQ ID NO: 97650 - DNA, 25 bp, Homo sapien
ggaagaaactcggacttccctcctg

SEQ ID NO: 97651 - DNA, 25 bp, Homo sapien
ggacttccctcctgttatgttcggg

SEQ ID NO: 97652 - DNA, 25 bp, Homo sapien
ctcctgttatgttcgggctcctctg

SEQ ID NO: 97653 - DNA, 25 bp, Homo sapien
aaatgaagggcccattctctgtccc

SEQ ID NO: 97654 - DNA, 25 bp, Homo sapien
gatctgcaaggatgagcctgaacct

SEQ ID NO: 97655 - DNA, 25 bp, Homo sapien
tagaggatcctggttcttaggcctt

SEQ ID NO: 97656 - DNA, 25 bp, Homo sapien
gttcttaggccttcgaatataccac

SEQ ID NO: 97657 - DNA, 25 bp, Homo sapien
tcgaatataccacccgcactctggg

SEQ ID NO: 97658 - DNA, 25 bp, Homo sapien
ctggcttgcagagggcagattgact

SEQ ID NO: 97659 - DNA, 25 bp, Homo sapien
gagggcagattgacttctcagcctc

SEQ ID NO: 97660 - DNA, 25 bp, Homo sapien
cgtgcgtggtctttctcctcctttt

SEQ ID NO: 97661 - DNA, 25 bp, Homo sapien
gcgtggtctttctcctccttttcaa

SEQ ID NO: 97662 - DNA, 25 bp, Homo sapien
tccttttcaaagcaatagccgccgg

SEQ ID NO: 97663 - DNA, 25 bp, Homo sapien
cttttcaaagcaatagccgccgggt

SEQ ID NO: 97664 - DNA, 25 bp, Homo sapien
gccgggtctgcaaagccctgtcaga

SEQ ID NO: 97665 - DNA, 25 bp, Homo sapien
cgggtctgcaaagccctgtcagaca

SEQ ID NO: 97666 - DNA, 25 bp, Homo sapien
aaagccctgtcagacagactgggcc

SEQ ID NO: 97667 - DNA, 25 bp, Homo sapien
ggcccttccaaggtcaagccatgtg

SEQ ID NO: 97668 - DNA, 25 bp, Homo sapien
cttccaaggtcaagccatgtgtctg

SEQ ID NO: 97669 - DNA, 25 bp, Homo sapien
caaggtcaagccatgtgtctgatga

SEQ ID NO: 97670 - DNA, 25 bp, Homo sapien
ggagaggaggatgggtcagccctca

SEQ ID NO: 97671 - DNA, 25 bp, Homo sapien
acctcccactctattcaaagttatc

SEQ ID NO: 97672 - DNA, 25 bp, Homo sapien
ctctattcaaagttatctctctgct

SEQ ID NO: 97673 - DNA, 25 bp, Homo sapien
atgcaactgtttgtgtctcacctat

SEQ ID NO: 97674 - DNA, 25 bp, Homo sapien
gcaactgtttgtgtctcacctatct

SEQ ID NO: 97675 - DNA, 25 bp, Homo sapien
tccccactgaaccaatgttcttctt

SEQ ID NO: 97676 - DNA, 25 bp, Homo sapien
cactgaaccaatgttcttcttacat

SEQ ID NO: 97677 - DNA, 25 bp, Homo sapien
taaaaccaaggtatgccccaaccat

SEQ ID NO: 97678 - DNA, 25 bp, Homo sapien
aaggtatgccccaaccatcttggcc

SEQ ID NO: 97679 - DNA, 25 bp, Homo sapien
aaccatcttggccacatgtcatcag

SEQ ID NO: 97680 - DNA, 25 bp, Homo sapien
gacttcctgagtctgtgtcacagtg

SEQ ID NO: 97681 - DNA, 25 bp, Homo sapien
ttcctgagtctgtgtcacagtgtgt

SEQ ID NO: 97682 - DNA, 25 bp, Homo sapien
aaacttgagaactgctcgaaggcaa

SEQ ID NO: 97683 - DNA, 25 bp, Homo sapien
tgaagcgacttcaaactgttcagca

SEQ ID NO: 97684 - DNA, 25 bp, Homo sapien
aaggtagtcattagggagcaggcac

SEQ ID NO: 97685 - DNA, 25 bp, Homo sapien
ggcactaccactaagatatcccaga

SEQ ID NO: 97686 - DNA, 25 bp, Homo sapien
agaggcaagggcatccactccaatg

SEQ ID NO: 97687 - DNA, 25 bp, Homo sapien
aatgcccacctagtactgtgaagct

SEQ ID NO: 97688 - DNA, 25 bp, Homo sapien
gctggataacaaaagcttgtcacca

SEQ ID NO: 97689 - DNA, 25 bp, Homo sapien
aagaaagaggtggtattcccctcag

SEQ ID NO: 97690 - DNA, 25 bp, Homo sapien
ttcccctcagttcatctttaccaaa

SEQ ID NO: 97691 - DNA, 25 bp, Homo sapien
taccaaagacactctatgtttcatt

SEQ ID NO: 97692 - DNA, 25 bp, Homo sapien
gtttcattaatctcaactggcagca

SEQ ID NO: 97693 - DNA, 25 bp, Homo sapien
tttctcttgagttttgttatgtgtt

SEQ ID NO: 97694 - DNA, 25 bp, Homo sapien
gattgtctggtatatttacagtcct

SEQ ID NO: 97695 - DNA, 25 bp, Homo sapien
tttacagtcctcaaacatggttatt

SEQ ID NO: 97696 - DNA, 25 bp, Homo sapien
aacatggttatttctgtcagtgact

SEQ ID NO: 97697 - DNA, 25 bp, Homo sapien
aacattcggttttaccagccagcag

SEQ ID NO: 97698 - DNA, 25 bp, Homo sapien
accagccagcagtattcttcagtaa

SEQ ID NO: 97699 - DNA, 25 bp, Homo sapien
gtaatcattgaacctcgagtcactg

SEQ ID NO: 97700 - DNA, 25 bp, Homo sapien
ttgaacctcgagtcactgtaaaagt

SEQ ID NO: 97701 - DNA, 25 bp, Homo sapien
tattagttttagatgctggcaccgc

SEQ ID NO: 97702 - DNA, 25 bp, Homo sapien
accgcatgtgctctgtttattctga

SEQ ID NO: 97703 - DNA, 25 bp, Homo sapien
gtgctctgtttattctgattttact

SEQ ID NO: 97704 - DNA, 25 bp, Homo sapien
agtgtgcctcagctttggagttcat

SEQ ID NO: 97705 - DNA, 25 bp, Homo sapien
ggagttcatgcctggagtggttcaa

SEQ ID NO: 97706 - DNA, 25 bp, Homo sapien
gagtggttcaacagtctctggtgca

SEQ ID NO: 97707 - DNA, 25 bp, Homo sapien
aacagtctctggtgcaagtctaata

SEQ ID NO: 97708 - DNA, 25 bp, Homo sapien
gcaagtctaataagagatcaggcat

SEQ ID NO: 97709 - DNA, 25 bp, Homo sapien
ggcatatatatctgttctttgcata

SEQ ID NO: 97710 - DNA, 25 bp, Homo sapien
tatctgttctttgcataatattatg

SEQ ID NO: 97711 - DNA, 25 bp, Homo sapien
attatggtgcccttattgatatatg

SEQ ID NO: 97712 - DNA, 25 bp, Homo sapien
tggtgcccttattgatatatggtaa

SEQ ID NO: 97713 - DNA, 25 bp, Homo sapien
ttaccttttggtttacaaatctatg

SEQ ID NO: 97714 - DNA, 25 bp, Homo sapien
aaatctatgatcaacttattccatt

SEQ ID NO: 97715 - DNA, 25 bp, Homo sapien
gttggaggccaaatgtggcaaacca

SEQ ID NO: 97716 - DNA, 25 bp, Homo sapien
cacccagagcgagcaaacgctgaga

SEQ ID NO: 97717 - DNA, 25 bp, Homo sapien
agcaaacgctgagacctgaaaggac

SEQ ID NO: 97718 - DNA, 25 bp, Homo sapien
atgagaagaggagcccgcttcctgt

SEQ ID NO: 97719 - DNA, 25 bp, Homo sapien
acacggtcaaaagcttaagggacag

SEQ ID NO: 97720 - DNA, 25 bp, Homo sapien
caggttttatggttgcttgtgtaat

SEQ ID NO: 97721 - DNA, 25 bp, Homo sapien
aaagcatgtccttcgtatgtcacag

SEQ ID NO: 97722 - DNA, 25 bp, Homo sapien
tgtccttcgtatgtcacagtttggg

SEQ ID NO: 97723 - DNA, 25 bp, Homo sapien
aacggaagtcttttagtgatggcta

SEQ ID NO: 97724 - DNA, 25 bp, Homo sapien
atggctaatgggtctgggcagcatc

SEQ ID NO: 97725 - DNA, 25 bp, Homo sapien
atccaatatccgttgatttgattgt

SEQ ID NO: 97726 - DNA, 25 bp, Homo sapien
aaggtggaacccatagagtgagcct

SEQ ID NO: 97727 - DNA, 25 bp, Homo sapien
gtggaacccatagagtgagcctcct

SEQ ID NO: 97728 - DNA, 25 bp, Homo sapien
gaacccatagagtgagcctcctgaa

SEQ ID NO: 97729 - DNA, 25 bp, Homo sapien
tgaagacacagagcggttgcctctc

SEQ ID NO: 97730 - DNA, 25 bp, Homo sapien
agacacagagcggttgcctctctca

SEQ ID NO: 97731 - DNA, 25 bp, Homo sapien
cagagcggttgcctctctcattaat

SEQ ID NO: 97732 - DNA, 25 bp, Homo sapien
gagcggttgcctctctcattaatta

SEQ ID NO: 97733 - DNA, 25 bp, Homo sapien
ggacacggcagggatgcctggccct

SEQ ID NO: 97734 - DNA, 25 bp, Homo sapien
atgtccgggcaggacgaactcgccg

SEQ ID NO: 97735 - DNA, 25 bp, Homo sapien
gacgaactcgccgtcggagtcaggg

SEQ ID NO: 97736 - DNA, 25 bp, Homo sapien
ggacccggccgcgagggagcagaga

SEQ ID NO: 97737 - DNA, 25 bp, Homo sapien
aagaaaaatcttaggctaccacatt

SEQ ID NO: 97738 - DNA, 25 bp, Homo sapien
aatcttaggctaccacattctatta

SEQ ID NO: 97739 - DNA, 25 bp, Homo sapien
taggctaccacattctattattgag

SEQ ID NO: 97740 - DNA, 25 bp, Homo sapien
accacattctattattgagagcctg

SEQ ID NO: 97741 - DNA, 25 bp, Homo sapien
ctattattgagagcctgagatgtta

SEQ ID NO: 97742 - DNA, 25 bp, Homo sapien
gcctgagatgttagccatagtggac

SEQ ID NO: 97743 - DNA, 25 bp, Homo sapien
agccatagtggacaaggttccattc

SEQ ID NO: 97744 - DNA, 25 bp, Homo sapien
aacacacattcattctctctttttc

SEQ ID NO: 97745 - DNA, 25 bp, Homo sapien
cacacattcattctctctttttctc

SEQ ID NO: 97746 - DNA, 25 bp, Homo sapien
ttctctctaccattctcaacctgta

SEQ ID NO: 97747 - DNA, 25 bp, Homo sapien
ctctaccattctcaacctgtattgg

SEQ ID NO: 97748 - DNA, 25 bp, Homo sapien
accaattgtcagttctccatgtatt

SEQ ID NO: 97749 - DNA, 25 bp, Homo sapien
tacagtatccagactgctagtcctt

SEQ ID NO: 97750 - DNA, 25 bp, Homo sapien
agactgctagtccttgccagagaca

SEQ ID NO: 97751 - DNA, 25 bp, Homo sapien
tagtccttgccagagacattcttac

SEQ ID NO: 97752 - DNA, 25 bp, Homo sapien
acctctgccctgtgatcatatttta

SEQ ID NO: 97753 - DNA, 25 bp, Homo sapien
tattttatgcttgacagcgaaaaca

SEQ ID NO: 97754 - DNA, 25 bp, Homo sapien
acagcgaaaacaagtgtggcccctt

SEQ ID NO: 97755 - DNA, 25 bp, Homo sapien
tgtggccccttgcaccggttagcta

SEQ ID NO: 97756 - DNA, 25 bp, Homo sapien
tagtgcaatcacctcttccgccaat

SEQ ID NO: 97757 - DNA, 25 bp, Homo sapien
ttccgccaattttttacaaatcttg

SEQ ID NO: 97758 - DNA, 25 bp, Homo sapien
gatcttacacttcatctgaattcag

SEQ ID NO: 97759 - DNA, 25 bp, Homo sapien
gatgtccggctgaaggttcttttag

SEQ ID NO: 97760 - DNA, 25 bp, Homo sapien
agccatcagtgaggcagcagttact

SEQ ID NO: 97761 - DNA, 25 bp, Homo sapien
ggcagcagttacttcaaggatatga

SEQ ID NO: 97762 - DNA, 25 bp, Homo sapien
taacttttttgccttgctacctcat

SEQ ID NO: 97763 - DNA, 25 bp, Homo sapien
tgctacctcatcagagacttcaagg

SEQ ID NO: 97764 - DNA, 25 bp, Homo sapien
gatatcagaggaatgcacgtcagtc

SEQ ID NO: 97765 - DNA, 25 bp, Homo sapien
aatgcacgtcagtcaaaaccctttg

SEQ ID NO: 97766 - DNA, 25 bp, Homo sapien
ctgggtttagtgaacttgcttggca

SEQ ID NO: 97767 - DNA, 25 bp, Homo sapien
ttgcttggcagtgatatttcagctt

SEQ ID NO: 97768 - DNA, 25 bp, Homo sapien
tcagcttggacattttacccttcag

SEQ ID NO: 97769 - DNA, 25 bp, Homo sapien
ttacccttcagtcggcccaagaaat

SEQ ID NO: 97770 - DNA, 25 bp, Homo sapien
tctcctgtccaatgacatgtgtgct

SEQ ID NO: 97771 - DNA, 25 bp, Homo sapien
gtccaatgacatgtgtgctagagct

SEQ ID NO: 97772 - DNA, 25 bp, Homo sapien
tgacatgtgtgctagagcttactct

SEQ ID NO: 97773 - DNA, 25 bp, Homo sapien
atgtgtgctagagcttactctgaga

SEQ ID NO: 97774 - DNA, 25 bp, Homo sapien
tgctagagcttactctgagaaggtg

SEQ ID NO: 97775 - DNA, 25 bp, Homo sapien
aggtgacagagttcatgttgtgtgc

SEQ ID NO: 97776 - DNA, 25 bp, Homo sapien
tgacagagttcatgttgtgtgctgg

SEQ ID NO: 97777 - DNA, 25 bp, Homo sapien
ctctggacaggtggtaaagacactt

SEQ ID NO: 97778 - DNA, 25 bp, Homo sapien
aaggtatcacatcatggggccctga

SEQ ID NO: 97779 - DNA, 25 bp, Homo sapien
atgtgccctgcctgaaaagcctgct

SEQ ID NO: 97780 - DNA, 25 bp, Homo sapien
cctgcctgaaaagcctgctgtgtac

SEQ ID NO: 97781 - DNA, 25 bp, Homo sapien
aaaagtaagaaatgagcccactcaa

SEQ ID NO: 97782 - DNA, 25 bp, Homo sapien
aatgagcccactcaacagcaaagag

SEQ ID NO: 97783 - DNA, 25 bp, Homo sapien
agcaaagagcagctatgctgattaa

SEQ ID NO: 97784 - DNA, 25 bp, Homo sapien
gattcctacgtatcattctacaatg

SEQ ID NO: 97785 - DNA, 25 bp, Homo sapien
tacaatgctctactacatgaaggat

SEQ ID NO: 97786 - DNA, 25 bp, Homo sapien
aggatataaagatcttgctgccctt

SEQ ID NO: 97787 - DNA, 25 bp, Homo sapien
gctgcccttctccatgatggcattc

SEQ ID NO: 97788 - DNA, 25 bp, Homo sapien
atgatggcattcctgttgtctcttc

SEQ ID NO: 97789 - DNA, 25 bp, Homo sapien
cagtcctgtgtgaaggtggagtacc

SEQ ID NO: 97790 - DNA, 25 bp, Homo sapien
taccacagaggccagttgtttttgt

SEQ ID NO: 97791 - DNA, 25 bp, Homo sapien
agaggccagttgtttttgtcacaag

SEQ ID NO: 97792 - DNA, 25 bp, Homo sapien
gaaatggaatactgaagggcccttc

SEQ ID NO: 97793 - DNA, 25 bp, Homo sapien
tgaagggcccttcactgcctttgct

SEQ ID NO: 97794 - DNA, 25 bp, Homo sapien
ctcccatgttatgcccagcgtttga

SEQ ID NO: 97795 - DNA, 25 bp, Homo sapien
tatgcccagcgtttgatgggtagca

SEQ ID NO: 97796 - DNA, 25 bp, Homo sapien
cccctgcattctttctgtattgagt

SEQ ID NO: 97797 - DNA, 25 bp, Homo sapien
gagtatcctttcagtgttattagtg

SEQ ID NO: 97798 - DNA, 25 bp, Homo sapien
ttggtcaccctaaggaaaggaattg

SEQ ID NO: 97799 - DNA, 25 bp, Homo sapien
gaattggcatgtgtatgttcccagt

SEQ ID NO: 97800 - DNA, 25 bp, Homo sapien
gtatgttcccagttcaactcatgga

SEQ ID NO: 97801 - DNA, 25 bp, Homo sapien
caactcatggagatggcagctgttt

SEQ ID NO: 97802 - DNA, 25 bp, Homo sapien
tggcagctgtttaaatgtttttcta

SEQ ID NO: 97803 - DNA, 25 bp, Homo sapien
gacccgcttggcgtagttgcccttg

SEQ ID NO: 97804 - DNA, 25 bp, Homo sapien
cagccctggaagagtgcgttttagc

SEQ ID NO: 97805 - DNA, 25 bp, Homo sapien
agagtgcgttttagccttggcgcga

SEQ ID NO: 97806 - DNA, 25 bp, Homo sapien
tagccttggcgcgagctttgctgcc

SEQ ID NO: 97807 - DNA, 25 bp, Homo sapien
acatccagacgcagtgaagtattta

SEQ ID NO: 97808 - DNA, 25 bp, Homo sapien
gattctagtaaaacgcaagagctaa

SEQ ID NO: 97809 - DNA, 25 bp, Homo sapien
aactcttataatctatattcggcaa

SEQ ID NO: 97810 - DNA, 25 bp, Homo sapien
ctatattcggcaaagtagactgtgc

SEQ ID NO: 97811 - DNA, 25 bp, Homo sapien
tagactgtgctatctcctgaacaca

SEQ ID NO: 97812 - DNA, 25 bp, Homo sapien
tgaacacagatttcagccaatcgaa

SEQ ID NO: 97813 - DNA, 25 bp, Homo sapien
ttcagccaatcgaaaagcaggtgtt

SEQ ID NO: 97814 - DNA, 25 bp, Homo sapien
gaggacggatctagctcctgtatat

SEQ ID NO: 97815 - DNA, 25 bp, Homo sapien
ggacggatctagctcctgtatatat

SEQ ID NO: 97816 - DNA, 25 bp, Homo sapien
ggatctagctcctgtatatatattt

SEQ ID NO: 97817 - DNA, 25 bp, Homo sapien
atattttattgcatgcactgtgacc

SEQ ID NO: 97818 - DNA, 25 bp, Homo sapien
tttattgcatgcactgtgaccttgg

SEQ ID NO: 97819 - DNA, 25 bp, Homo sapien
acctcctgcgatctggctggcttgg

SEQ ID NO: 97820 - DNA, 25 bp, Homo sapien
ggctggcttggatctcgtttttaac

SEQ ID NO: 97821 - DNA, 25 bp, Homo sapien
tggcttggatctcgtttttaacccg

SEQ ID NO: 97822 - DNA, 25 bp, Homo sapien
cagtgcaccgtctgctctgtgaact

SEQ ID NO: 97823 - DNA, 25 bp, Homo sapien
tgcaccgtctgctctgtgaactcct

SEQ ID NO: 97824 - DNA, 25 bp, Homo sapien
ctgtccccctcgttctgtagcgttt

SEQ ID NO: 97825 - DNA, 25 bp, Homo sapien
tgactggcctatttactgtttacag

SEQ ID NO: 97826 - DNA, 25 bp, Homo sapien
ttactgtttacagctggccagtgca

SEQ ID NO: 97827 - DNA, 25 bp, Homo sapien
ctgtttacagctggccagtgcagag

SEQ ID NO: 97828 - DNA, 25 bp, Homo sapien
ttcccacctttaaactgcccagaag

SEQ ID NO: 97829 - DNA, 25 bp, Homo sapien
taaactgcccagaaggcatgcctct

SEQ ID NO: 97830 - DNA, 25 bp, Homo sapien
ggagcagacagggaaatctgcctac

SEQ ID NO: 97831 - DNA, 25 bp, Homo sapien
gacagggaaatctgcctaccaagag

SEQ ID NO: 97832 - DNA, 25 bp, Homo sapien
tgtctttgtgcccacacgtggtggc

SEQ ID NO: 97833 - DNA, 25 bp, Homo sapien
ctttgtgcccacacgtggtggctgg

SEQ ID NO: 97834 - DNA, 25 bp, Homo sapien
ggagtgcctggatggtgcggtggtt

SEQ ID NO: 97835 - DNA, 25 bp, Homo sapien
tggtgcggtggttgatgttaaccta

SEQ ID NO: 97836 - DNA, 25 bp, Homo sapien
tcagaaggtggcatggtcctcaagt

SEQ ID NO: 97837 - DNA, 25 bp, Homo sapien
gttcttagtattttatatcagcaaa

SEQ ID NO: 97838 - DNA, 25 bp, Homo sapien
agaatagaataagtacatgctgctg

SEQ ID NO: 97839 - DNA, 25 bp, Homo sapien
ttaatcacttaacaagcctaacctt

SEQ ID NO: 97840 - DNA, 25 bp, Homo sapien
aagcctaaccttgactcagtgaatg

SEQ ID NO: 97841 - DNA, 25 bp, Homo sapien
gactcagtgaatgcctataaaaata

SEQ ID NO: 97842 - DNA, 25 bp, Homo sapien
ttcatttgtagcttatcattcacgt

SEQ ID NO: 97843 - DNA, 25 bp, Homo sapien
atcattcacgtattgttgtccagca

SEQ ID NO: 97844 - DNA, 25 bp, Homo sapien
attcacgtattgttgtccagcaaac

SEQ ID NO: 97845 - DNA, 25 bp, Homo sapien
cacgtattgttgtccagcaaacatt

SEQ ID NO: 97846 - DNA, 25 bp, Homo sapien
ttgttgtccagcaaacattaaaagc

SEQ ID NO: 97847 - DNA, 25 bp, Homo sapien
tcaggcctggagtcggcccccaaaa

SEQ ID NO: 97848 - DNA, 25 bp, Homo sapien
tcggcccccaaaagtttcacatagg

SEQ ID NO: 97849 - DNA, 25 bp, Homo sapien
aaaagtttcacatagggccaggcag

SEQ ID NO: 97850 - DNA, 25 bp, Homo sapien
gccaggcagcctctgtgtttctttc

SEQ ID NO: 97851 - DNA, 25 bp, Homo sapien
ctttccctggtcctgaactgtggaa

SEQ ID NO: 97852 - DNA, 25 bp, Homo sapien
ggaaatgccattaaactctctctat

SEQ ID NO: 97853 - DNA, 25 bp, Homo sapien
taaactctctctataatgtaactga

SEQ ID NO: 97854 - DNA, 25 bp, Homo sapien
atgtaactgaaactgctggctgggc

SEQ ID NO: 97855 - DNA, 25 bp, Homo sapien
taactgaaactgctggctgggcgca

SEQ ID NO: 97856 - DNA, 25 bp, Homo sapien
gggacatgactgatcccctcagagc

SEQ ID NO: 97857 - DNA, 25 bp, Homo sapien
atgactgatcccctcagagcaggct

SEQ ID NO: 97858 - DNA, 25 bp, Homo sapien
gaccctaaacagaatcctcactatg

SEQ ID NO: 97859 - DNA, 25 bp, Homo sapien
tcctcactatggatgggctcattga

SEQ ID NO: 97860 - DNA, 25 bp, Homo sapien
aggacattaagcatcggcggtatta

SEQ ID NO: 97861 - DNA, 25 bp, Homo sapien
gtattatgagaagccatgccgccgg

SEQ ID NO: 97862 - DNA, 25 bp, Homo sapien
ccgccggcgacagagggaaagctat

SEQ ID NO: 97863 - DNA, 25 bp, Homo sapien
aggtgccggcggatctacaacatgg

SEQ ID NO: 97864 - DNA, 25 bp, Homo sapien
gaaatggctcgcaagatcaacttct

SEQ ID NO: 97865 - DNA, 25 bp, Homo sapien
agtgcgaaaccctcatccagttttc

SEQ ID NO: 97866 - DNA, 25 bp, Homo sapien
ctccatctcttttctttgtacaatc

SEQ ID NO: 97867 - DNA, 25 bp, Homo sapien
ttgtacaatcccatttcctattacc

SEQ ID NO: 97868 - DNA, 25 bp, Homo sapien
atttcctattaccattctctgcaat

SEQ ID NO: 97869 - DNA, 25 bp, Homo sapien
aagtgttctacagagaaggtgctca

SEQ ID NO: 97870 - DNA, 25 bp, Homo sapien
gagaaggtgctcaggccaacagaca

SEQ ID NO: 97871 - DNA, 25 bp, Homo sapien
gacacactcctttagtcgagtttga

SEQ ID NO: 97872 - DNA, 25 bp, Homo sapien
agggaatcggaataaactccagcaa

SEQ ID NO: 97873 - DNA, 25 bp, Homo sapien
aactccagcaaggaaatggccagtt

SEQ ID NO: 97874 - DNA, 25 bp, Homo sapien
gccagttaagtagtgtcttctctct

SEQ ID NO: 97875 - DNA, 25 bp, Homo sapien
gggtctcataaagagcagttttact

SEQ ID NO: 97876 - DNA, 25 bp, Homo sapien
gtatgcttatgctgaacacctttca

SEQ ID NO: 97877 - DNA, 25 bp, Homo sapien
cacctttcatattggagaatcatgc

SEQ ID NO: 97878 - DNA, 25 bp, Homo sapien
gagaatcatgcatttgggtcactaa

SEQ ID NO: 97879 - DNA, 25 bp, Homo sapien
catgcatttgggtcactaattatct

SEQ ID NO: 97880 - DNA, 25 bp, Homo sapien
tgccgctggcatgcctgaggaatgt

SEQ ID NO: 97881 - DNA, 25 bp, Homo sapien
ttggctttgattacacactaagttt

SEQ ID NO: 97882 - DNA, 25 bp, Homo sapien
attagtgaacttatctttgcagctg

SEQ ID NO: 97883 - DNA, 25 bp, Homo sapien
gaacttatctttgcagctgagtact

SEQ ID NO: 97884 - DNA, 25 bp, Homo sapien
gcagctgagtacttaaattcttttt

SEQ ID NO: 97885 - DNA, 25 bp, Homo sapien
gataccctttggattgatcacattg

SEQ ID NO: 97886 - DNA, 25 bp, Homo sapien
tttgacccagtatgtcttgtagaca

SEQ ID NO: 97887 - DNA, 25 bp, Homo sapien
agacacgttagttataatcaccttg

SEQ ID NO: 97888 - DNA, 25 bp, Homo sapien
agttataatcaccttgtatctctaa

SEQ ID NO: 97889 - DNA, 25 bp, Homo sapien
ggtgtgatatgaaccagtccattca

SEQ ID NO: 97890 - DNA, 25 bp, Homo sapien
gaaccagtccattcacattggaaaa

SEQ ID NO: 97891 - DNA, 25 bp, Homo sapien
tagcttattctcaaagctactttcc

SEQ ID NO: 97892 - DNA, 25 bp, Homo sapien
agcttattctcaaagctactttccc

SEQ ID NO: 97893 - DNA, 25 bp, Homo sapien
gcttattctcaaagctactttccca

SEQ ID NO: 97894 - DNA, 25 bp, Homo sapien
tactttcccattcttgaaattggat

SEQ ID NO: 97895 - DNA, 25 bp, Homo sapien
actttcccattcttgaaattggatg

SEQ ID NO: 97896 - DNA, 25 bp, Homo sapien
ctttcccattcttgaaattggatga

SEQ ID NO: 97897 - DNA, 25 bp, Homo sapien
tagattgttttaggcagactttaag

SEQ ID NO: 97898 - DNA, 25 bp, Homo sapien
agattgttttaggcagactttaagt

SEQ ID NO: 97899 - DNA, 25 bp, Homo sapien
gattgttttaggcagactttaagta

SEQ ID NO: 97900 - DNA, 25 bp, Homo sapien
gtctcctcacatgggtgtctgtggt

SEQ ID NO: 97901 - DNA, 25 bp, Homo sapien
ggttctctcctgtgtaaatgtcacg

SEQ ID NO: 97902 - DNA, 25 bp, Homo sapien
acccctgtttcatgtgggcactaac

SEQ ID NO: 97903 - DNA, 25 bp, Homo sapien
tgtgggcactaacacgtgtgcgttc

SEQ ID NO: 97904 - DNA, 25 bp, Homo sapien
aacacgtgtgcgttcctggcgggca

SEQ ID NO: 97905 - DNA, 25 bp, Homo sapien
ggcggctgctctgtcatgagaatgt

SEQ ID NO: 97906 - DNA, 25 bp, Homo sapien
gtcatgagaatgtacggcccgtgga

SEQ ID NO: 97907 - DNA, 25 bp, Homo sapien
atgtacggcccgtggatgattaacg

SEQ ID NO: 97908 - DNA, 25 bp, Homo sapien
tgattaacgggcctttttcacttag

SEQ ID NO: 97909 - DNA, 25 bp, Homo sapien
gggcctttttcacttagaagctgca

SEQ ID NO: 97910 - DNA, 25 bp, Homo sapien
agaagctgcacattatggagcatta

SEQ ID NO: 97911 - DNA, 25 bp, Homo sapien
ggtggatgataccatttcctgaccc

SEQ ID NO: 97912 - DNA, 25 bp, Homo sapien
ccgttttccagcatgtgttctgtta

SEQ ID NO: 97913 - DNA, 25 bp, Homo sapien
gatttttatccatgggttcctacgc

SEQ ID NO: 97914 - DNA, 25 bp, Homo sapien
gggttcctacgccttgtcattggaa

SEQ ID NO: 97915 - DNA, 25 bp, Homo sapien
tggaaacactgcctttgtcttactg

SEQ ID NO: 97916 - DNA, 25 bp, Homo sapien
tgtcttactggcaagttctggagct

SEQ ID NO: 97917 - DNA, 25 bp, Homo sapien
ttctggagctcttgtgtcattgtta

SEQ ID NO: 97918 - DNA, 25 bp, Homo sapien
agaaatccctgtcttgcttactgta

SEQ ID NO: 97919 - DNA, 25 bp, Homo sapien
ctgttgctgttaaaattgctcatga

SEQ ID NO: 97920 - DNA, 25 bp, Homo sapien
attgctcatgatttcgacgtattta

SEQ ID NO: 97921 - DNA, 25 bp, Homo sapien
gagactatgatggaccagccctgag

SEQ ID NO: 97922 - DNA, 25 bp, Homo sapien
aatcattgctcttcctggactttgt

SEQ ID NO: 97923 - DNA, 25 bp, Homo sapien
gctcttcctggactttgtagaaatc

SEQ ID NO: 97924 - DNA, 25 bp, Homo sapien
atcagtctcaagtgcttcaagagtc

SEQ ID NO: 97925 - DNA, 25 bp, Homo sapien
tgcttcaagagtctggctcctgcta

SEQ ID NO: 97926 - DNA, 25 bp, Homo sapien
gctcctgctacttttatctgtcagg

SEQ ID NO: 97927 - DNA, 25 bp, Homo sapien
atctgtcaggtagcacataaggttt

SEQ ID NO: 97928 - DNA, 25 bp, Homo sapien
gcacataaggtttgcagggtttata

SEQ ID NO: 97929 - DNA, 25 bp, Homo sapien
atccccgtggttcatctgatataat

SEQ ID NO: 97930 - DNA, 25 bp, Homo sapien
ataattagtgttccctgtgaattcc

SEQ ID NO: 97931 - DNA, 25 bp, Homo sapien
cccctctatgggaaggatgccttta

SEQ ID NO: 97932 - DNA, 25 bp, Homo sapien
aaggatgcctttactctttatcagt

SEQ ID NO: 97933 - DNA, 25 bp, Homo sapien
tgtgttcatcgatggacccctggct

SEQ ID NO: 97934 - DNA, 25 bp, Homo sapien
gttcatcgatggacccctggctctg

SEQ ID NO: 97935 - DNA, 25 bp, Homo sapien
ggcagatggaatacccttcttccgc

SEQ ID NO: 97936 - DNA, 25 bp, Homo sapien
agatggaatacccttcttccgctct

SEQ ID NO: 97937 - DNA, 25 bp, Homo sapien
atggaatacccttcttccgctctgc

SEQ ID NO: 97938 - DNA, 25 bp, Homo sapien
ttcttccgctctgccaatggggtga

SEQ ID NO: 97939 - DNA, 25 bp, Homo sapien
gccaatggggtgattctgactccag

SEQ ID NO: 97940 - DNA, 25 bp, Homo sapien
ttcctccttcccaagtacttcaagg

SEQ ID NO: 97941 - DNA, 25 bp, Homo sapien
ctccttcccaagtacttcaaggagg

SEQ ID NO: 97942 - DNA, 25 bp, Homo sapien
aagcacagctccagagaaaggagga

SEQ ID NO: 97943 - DNA, 25 bp, Homo sapien
aaggaggaggatccaacaataaaat

SEQ ID NO: 97944 - DNA, 25 bp, Homo sapien
ttcttggatggattcctgccattca

SEQ ID NO: 97945 - DNA, 25 bp, Homo sapien
ggattcctgccattcactgataaga

SEQ ID NO: 97946 - DNA, 25 bp, Homo sapien
ttcactgataagaatggctcacctt

SEQ ID NO: 97947 - DNA, 25 bp, Homo sapien
gaatggctcaccttgcctaaagtat

SEQ ID NO: 97948 - DNA, 25 bp, Homo sapien
ggctcaccttgcctaaagtatatga

SEQ ID NO: 97949 - DNA, 25 bp, Homo sapien
agagtgtgctttatgtcgagctcct

SEQ ID NO: 97950 - DNA, 25 bp, Homo sapien
ttatgtcgagctcctgcttgcttgc

SEQ ID NO: 97951 - DNA, 25 bp, Homo sapien
aattttggtacaggctaggcagaat

SEQ ID NO: 97952 - DNA, 25 bp, Homo sapien
ttggtacaggctaggcagaatgtgc

SEQ ID NO: 97953 - DNA, 25 bp, Homo sapien
gaatgtgcctagatgatcagctcct

SEQ ID NO: 97954 - DNA, 25 bp, Homo sapien
tagatgatcagctcctagtaaaaac

SEQ ID NO: 97955 - DNA, 25 bp, Homo sapien
cccaaaggatactgactgtaataca

SEQ ID NO: 97956 - DNA, 25 bp, Homo sapien
gtaatacaattaccaattcacaatg

SEQ ID NO: 97957 - DNA, 25 bp, Homo sapien
gttaattttatactgtccacctatc

SEQ ID NO: 97958 - DNA, 25 bp, Homo sapien
aattttatactgtccacctatctat

SEQ ID NO: 97959 - DNA, 25 bp, Homo sapien
atactgtccacctatctatatattc

SEQ ID NO: 97960 - DNA, 25 bp, Homo sapien
gtccacctatctatatattcttcta

SEQ ID NO: 97961 - DNA, 25 bp, Homo sapien
acctatctatatattcttctactga

SEQ ID NO: 97962 - DNA, 25 bp, Homo sapien
attttgatatctttggctttccggt

SEQ ID NO: 97963 - DNA, 25 bp, Homo sapien
atatctttggctttccggtatctat

SEQ ID NO: 97964 - DNA, 25 bp, Homo sapien
taagaacacataacactactgaatt

SEQ ID NO: 97965 - DNA, 25 bp, Homo sapien
taacaaaggccacaatttaattaat

SEQ ID NO: 97966 - DNA, 25 bp, Homo sapien
gaaagtaccctagacttagaagcag

SEQ ID NO: 97967 - DNA, 25 bp, Homo sapien
gcagtaatactggtttctagttcta

SEQ ID NO: 97968 - DNA, 25 bp, Homo sapien
ctagttctatttctgacactgcctc

SEQ ID NO: 97969 - DNA, 25 bp, Homo sapien
tgcctccctgtgtggtcttgagcaa

SEQ ID NO: 97970 - DNA, 25 bp, Homo sapien
aagtcacttcacttttctgtgcttt

SEQ ID NO: 97971 - DNA, 25 bp, Homo sapien
acttcacttttctgtgctttggctt

SEQ ID NO: 97972 - DNA, 25 bp, Homo sapien
tttggcttcctctactctaaaaatg

SEQ ID NO: 97973 - DNA, 25 bp, Homo sapien
tatctatctgatctactgtgtaatg

SEQ ID NO: 97974 - DNA, 25 bp, Homo sapien
gtgtaatgcttctctctgtgcctca

SEQ ID NO: 97975 - DNA, 25 bp, Homo sapien
agcttcctgatctgcaaaattggtt

SEQ ID NO: 97976 - DNA, 25 bp, Homo sapien
gttgtgaggatttgcctaaatatat

SEQ ID NO: 97977 - DNA, 25 bp, Homo sapien
tgccccgtttcttgccccagtgtgg

SEQ ID NO: 97978 - DNA, 25 bp, Homo sapien
tggtttgcattgtctccttccacaa

SEQ ID NO: 97979 - DNA, 25 bp, Homo sapien
ttccacaatgactgctttgtttgga

SEQ ID NO: 97980 - DNA, 25 bp, Homo sapien
gactgctttgtttggatgcctcagc

SEQ ID NO: 97981 - DNA, 25 bp, Homo sapien
ccaggtcagctgttactttctttca

SEQ ID NO: 97982 - DNA, 25 bp, Homo sapien
gatgtttatttgcaaacaaccattt

SEQ ID NO: 97983 - DNA, 25 bp, Homo sapien
aagcacaagcgtgtttctagagaac

SEQ ID NO: 97984 - DNA, 25 bp, Homo sapien
gaatctcaagattctacttggtggt

SEQ ID NO: 97985 - DNA, 25 bp, Homo sapien
attctacttggtggtttgcttgctc

SEQ ID NO: 97986 - DNA, 25 bp, Homo sapien
tggtggtttgcttgctctacgttac

SEQ ID NO: 97987 - DNA, 25 bp, Homo sapien
cataaaagctatgacacgagaatca

SEQ ID NO: 97988 - DNA, 25 bp, Homo sapien
tctgctttctgggttgcaacctcag

SEQ ID NO: 97989 - DNA, 25 bp, Homo sapien
tgctttctgggttgcaacctcagcc

SEQ ID NO: 97990 - DNA, 25 bp, Homo sapien
aatgaactggagatagggttctcat

SEQ ID NO: 97991 - DNA, 25 bp, Homo sapien
tggagatagggttctcatattgttt

SEQ ID NO: 97992 - DNA, 25 bp, Homo sapien
aaaatgtaacactacaccgtggagt

SEQ ID NO: 97993 - DNA, 25 bp, Homo sapien
atgtaacactacaccgtggagtcct

SEQ ID NO: 97994 - DNA, 25 bp, Homo sapien
taacactacaccgtggagtcctctt

SEQ ID NO: 97995 - DNA, 25 bp, Homo sapien
acactacaccgtggagtcctcttgt

SEQ ID NO: 97996 - DNA, 25 bp, Homo sapien
actacaccgtggagtcctcttgtgt

SEQ ID NO: 97997 - DNA, 25 bp, Homo sapien
aacaacttgtgtttatagagtactt

SEQ ID NO: 97998 - DNA, 25 bp, Homo sapien
caacttgtgtttatagagtactttt

SEQ ID NO: 97999 - DNA, 25 bp, Homo sapien
atgcccagctggatgattaagttct

SEQ ID NO: 98000 - DNA, 25 bp, Homo sapien
tgcccagctggatgattaagttctt

SEQ ID NO: 98001 - DNA, 25 bp, Homo sapien
gcccagctggatgattaagttcttt

SEQ ID NO: 98002 - DNA, 25 bp, Homo sapien
cccagctggatgattaagttcttta

SEQ ID NO: 98003 - DNA, 25 bp, Homo sapien
ccagctggatgattaagttctttat

SEQ ID NO: 98004 - DNA, 25 bp, Homo sapien
cagctggatgattaagttctttata

SEQ ID NO: 98005 - DNA, 25 bp, Homo sapien
ctggatgattaagttctttatagca

SEQ ID NO: 98006 - DNA, 25 bp, Homo sapien
ggatgattaagttctttatagcatt

SEQ ID NO: 98007 - DNA, 25 bp, Homo sapien
tatagcattttactcttgtataaat

SEQ ID NO: 98008 - DNA, 25 bp, Homo sapien
actcttgtataaattgctgaagtaa

SEQ ID NO: 98009 - DNA, 25 bp, Homo sapien
gctgaagtaaaaaatcttagtatca

SEQ ID NO: 98010 - DNA, 25 bp, Homo sapien
aagaaggaatgacgtgcccctgcga

SEQ ID NO: 98011 - DNA, 25 bp, Homo sapien
atgacgtgcccctgcgaatcaggga

SEQ ID NO: 98012 - DNA, 25 bp, Homo sapien
ctgcgaatcagggaccaacaggaga

SEQ ID NO: 98013 - DNA, 25 bp, Homo sapien
gggaccaacaggagagagctcttga

SEQ ID NO: 98014 - DNA, 25 bp, Homo sapien
agagctcttgagtgggctagtgact

SEQ ID NO: 98015 - DNA, 25 bp, Homo sapien
ctctgctctaggatttgggttgaaa

SEQ ID NO: 98016 - DNA, 25 bp, Homo sapien
gagttgccacaggagctaacacgct

SEQ ID NO: 98017 - DNA, 25 bp, Homo sapien
tccaggctcattcattttcatgctc

SEQ ID NO: 98018 - DNA, 25 bp, Homo sapien
ttcattttcatgctccattgccaga

SEQ ID NO: 98019 - DNA, 25 bp, Homo sapien
ttcatgctccattgccagactcttg

SEQ ID NO: 98020 - DNA, 25 bp, Homo sapien
ctcttgctgggagcccgtccagaat

SEQ ID NO: 98021 - DNA, 25 bp, Homo sapien
gaaacagattgttctacagatgaat

SEQ ID NO: 98022 - DNA, 25 bp, Homo sapien
gtaagccagttacagtttgccttaa

SEQ ID NO: 98023 - DNA, 25 bp, Homo sapien
gtttgccttaactcatagacatcaa

SEQ ID NO: 98024 - DNA, 25 bp, Homo sapien
acatcaatcagagagtgtcacagat

SEQ ID NO: 98025 - DNA, 25 bp, Homo sapien
gagtgtcacagatttaaccttgatc

SEQ ID NO: 98026 - DNA, 25 bp, Homo sapien
aagacaagttgtacccagagtatgt

SEQ ID NO: 98027 - DNA, 25 bp, Homo sapien
aatgtactggtttcttcctctaaga

SEQ ID NO: 98028 - DNA, 25 bp, Homo sapien
gaactgccttatgtttgggcatgta

SEQ ID NO: 98029 - DNA, 25 bp, Homo sapien
gggcatgtaactccaaaatactagg

SEQ ID NO: 98030 - DNA, 25 bp, Homo sapien
tactaggtagtataaggctttctca

SEQ ID NO: 98031 - DNA, 25 bp, Homo sapien
agtataaggctttctcaatcagtgc

SEQ ID NO: 98032 - DNA, 25 bp, Homo sapien
tagatttatccagccgagcttagga

SEQ ID NO: 98033 - DNA, 25 bp, Homo sapien
agccgagcttaggaattcgcttcca

SEQ ID NO: 98034 - DNA, 25 bp, Homo sapien
cccctggtctgaactagttgagaga

SEQ ID NO: 98035 - DNA, 25 bp, Homo sapien
gttttgaacagtcgtaaccgtggct

SEQ ID NO: 98036 - DNA, 25 bp, Homo sapien
acagtcgtaaccgtggctggtgttt

SEQ ID NO: 98037 - DNA, 25 bp, Homo sapien
gttgacataaaggattaagaccgca

SEQ ID NO: 98038 - DNA, 25 bp, Homo sapien
aagaccgcaaattgtccttcatggg

SEQ ID NO: 98039 - DNA, 25 bp, Homo sapien
aattgtccttcatgggtagagtcag

SEQ ID NO: 98040 - DNA, 25 bp, Homo sapien
tcatttctcaaaaaccacagtcctc

SEQ ID NO: 98041 - DNA, 25 bp, Homo sapien
agtcctcaccacagtttattgattt

SEQ ID NO: 98042 - DNA, 25 bp, Homo sapien
tcaaattgtctggtactattggaac

SEQ ID NO: 98043 - DNA, 25 bp, Homo sapien
atttgatgccaactttatgtgtaaa

SEQ ID NO: 98044 - DNA, 25 bp, Homo sapien
agaagctaactcctgccaacatcgt

SEQ ID NO: 98045 - DNA, 25 bp, Homo sapien
tcctgccaacatcgtggctgaatga

SEQ ID NO: 98046 - DNA, 25 bp, Homo sapien
gaacagctgggactatgcttaaccc

SEQ ID NO: 98047 - DNA, 25 bp, Homo sapien
gcttaacccattcccagcttataaa

SEQ ID NO: 98048 - DNA, 25 bp, Homo sapien
gcagctgcagtgaagcatcaggtga

SEQ ID NO: 98049 - DNA, 25 bp, Homo sapien
tgagtctgatatgggctgtctgttc

SEQ ID NO: 98050 - DNA, 25 bp, Homo sapien
tttgaatcttgcctgtcctttccaa

SEQ ID NO: 98051 - DNA, 25 bp, Homo sapien
ttgcctgtcctttccaagtggagtc

SEQ ID NO: 98052 - DNA, 25 bp, Homo sapien
agtggagtcttgtgcctaagtgcta

SEQ ID NO: 98053 - DNA, 25 bp, Homo sapien
ttgtgcctaagtgctagagcccact

SEQ ID NO: 98054 - DNA, 25 bp, Homo sapien
aaaaatccttcagaattctaagatg

SEQ ID NO: 98055 - DNA, 25 bp, Homo sapien
gtaatatactgtggacacaacttgc

SEQ ID NO: 98056 - DNA, 25 bp, Homo sapien
ggacacaacttgcttctgcctcatc

SEQ ID NO: 98057 - DNA, 25 bp, Homo sapien
atcctgccttagtgtgcaatctcat

SEQ ID NO: 98058 - DNA, 25 bp, Homo sapien
gtgcaatctcatttgactatacgat

SEQ ID NO: 98059 - DNA, 25 bp, Homo sapien
aagtttgcacagtcttacttctgta

SEQ ID NO: 98060 - DNA, 25 bp, Homo sapien
tacttctgtagaacactggccatag

SEQ ID NO: 98061 - DNA, 25 bp, Homo sapien
gaacactggccataggaaatgctgt

SEQ ID NO: 98062 - DNA, 25 bp, Homo sapien
tttttgtactggactttaccttgat

SEQ ID NO: 98063 - DNA, 25 bp, Homo sapien
tactggactttaccttgatatatgt

SEQ ID NO: 98064 - DNA, 25 bp, Homo sapien
cataggacatatgtacttgtggaac

SEQ ID NO: 98065 - DNA, 25 bp, Homo sapien
actcctgtaatggagagtcacagct

SEQ ID NO: 98066 - DNA, 25 bp, Homo sapien
gtcacagctccttccttataagtga

SEQ ID NO: 98067 - DNA, 25 bp, Homo sapien
gctccttccttataagtgaactcat

SEQ ID NO: 98068 - DNA, 25 bp, Homo sapien
gaagaaaaccctactagtgccgtga

SEQ ID NO: 98069 - DNA, 25 bp, Homo sapien
aaaccctactagtgccgtgactatg

SEQ ID NO: 98070 - DNA, 25 bp, Homo sapien
gtgccgtgactatggaaatgccttt

SEQ ID NO: 98071 - DNA, 25 bp, Homo sapien
tgactatggaaatgccttttgtggc

SEQ ID NO: 98072 - DNA, 25 bp, Homo sapien
gccttttgtggcaactcagacttca

SEQ ID NO: 98073 - DNA, 25 bp, Homo sapien
ttgtggcaactcagacttcattaaa

SEQ ID NO: 98074 - DNA, 25 bp, Homo sapien
acatcagtgtgtttctagccaattg

SEQ ID NO: 98075 - DNA, 25 bp, Homo sapien
cagtgtgtttctagccaattggaac

SEQ ID NO: 98076 - DNA, 25 bp, Homo sapien
gaggtaagaagatacagctacagaa

SEQ ID NO: 98077 - DNA, 25 bp, Homo sapien
cagaaaatagttgcgtgtatgggag

SEQ ID NO: 98078 - DNA, 25 bp, Homo sapien
gcgtgtatgggagaacagtcattgt

SEQ ID NO: 98079 - DNA, 25 bp, Homo sapien
gagaacagtcattgtaattgggtag

SEQ ID NO: 98080 - DNA, 25 bp, Homo sapien
gcttttcagaaattaccgaatgtgt

SEQ ID NO: 98081 - DNA, 25 bp, Homo sapien
aatttagctgtgttttagacagcat

SEQ ID NO: 98082 - DNA, 25 bp, Homo sapien
gtgttttagacagcattagaatata

SEQ ID NO: 98083 - DNA, 25 bp, Homo sapien
cagcattagaatatattgttcagca

SEQ ID NO: 98084 - DNA, 25 bp, Homo sapien
atgaatattttgtgaatctttctta

SEQ ID NO: 98085 - DNA, 25 bp, Homo sapien
gtgaatctttcttaaaagctcaaat

SEQ ID NO: 98086 - DNA, 25 bp, Homo sapien
agctcaaatttgtagacttctaaat

SEQ ID NO: 98087 - DNA, 25 bp, Homo sapien
aaagttggacatgtgtgtggctcaa

SEQ ID NO: 98088 - DNA, 25 bp, Homo sapien
tgtgtggctcaacagttttctcggg

SEQ ID NO: 98089 - DNA, 25 bp, Homo sapien
agttcagtgaccttttggtggccac

SEQ ID NO: 98090 - DNA, 25 bp, Homo sapien
tgagttcttgcaggtggcgacttca

SEQ ID NO: 98091 - DNA, 25 bp, Homo sapien
tggcgacttcatctgcaaggtcact

SEQ ID NO: 98092 - DNA, 25 bp, Homo sapien
tgcaaggtcacttacatagccccac

SEQ ID NO: 98093 - DNA, 25 bp, Homo sapien
cactcagctgcttcggaaagcgtga

SEQ ID NO: 98094 - DNA, 25 bp, Homo sapien
aagcgtgacgaagcagtagtcctca

SEQ ID NO: 98095 - DNA, 25 bp, Homo sapien
gcagtagtcctcagtgtgtgtgtaa

SEQ ID NO: 98096 - DNA, 25 bp, Homo sapien
gtggtagcagggaccatgcttcatt

SEQ ID NO: 98097 - DNA, 25 bp, Homo sapien
gggcctggtatgcagtaagatcaat

SEQ ID NO: 98098 - DNA, 25 bp, Homo sapien
ccagctgagccacagttatcaggag

SEQ ID NO: 98099 - DNA, 25 bp, Homo sapien
agccacagttatcaggagaggagtc

SEQ ID NO: 98100 - DNA, 25 bp, Homo sapien
ggagtccagctcagaagatgattct

SEQ ID NO: 98101 - DNA, 25 bp, Homo sapien
gatgattctgacctgtttgttaaca

SEQ ID NO: 98102 - DNA, 25 bp, Homo sapien
ttgttaacacaaaccgcagacagta

SEQ ID NO: 98103 - DNA, 25 bp, Homo sapien
cacaaaccgcagacagtatcatgag

SEQ ID NO: 98104 - DNA, 25 bp, Homo sapien
aattctccacttgctcagggactgg

SEQ ID NO: 98105 - DNA, 25 bp, Homo sapien
gggcttggacattcccagggtgctc

SEQ ID NO: 98106 - DNA, 25 bp, Homo sapien
acatcttcacccctgcatgaggaca

SEQ ID NO: 98107 - DNA, 25 bp, Homo sapien
tgaactgatcttttgattcagagaa

SEQ ID NO: 98108 - DNA, 25 bp, Homo sapien
tcagagaattaaacccctggtgggt

SEQ ID NO: 98109 - DNA, 25 bp, Homo sapien
ctcttcaggaggtttggcttggcat

SEQ ID NO: 98110 - DNA, 25 bp, Homo sapien
tcttcaggaggtttggcttggcatg

SEQ ID NO: 98111 - DNA, 25 bp, Homo sapien
cttcaggaggtttggcttggcatga

SEQ ID NO: 98112 - DNA, 25 bp, Homo sapien
aggaggtttggcttggcatgaaaat

SEQ ID NO: 98113 - DNA, 25 bp, Homo sapien
gaggtttggcttggcatgaaaatac

SEQ ID NO: 98114 - DNA, 25 bp, Homo sapien
gtttggcttggcatgaaaatacttc

SEQ ID NO: 98115 - DNA, 25 bp, Homo sapien
ggcttggcatgaaaatacttcattc

SEQ ID NO: 98116 - DNA, 25 bp, Homo sapien
tacttcattcagagtatgggcaaat

SEQ ID NO: 98117 - DNA, 25 bp, Homo sapien
agagtatgggcaaatgcttctggaa

SEQ ID NO: 98118 - DNA, 25 bp, Homo sapien
cctgaagagagagaacgtgtgtgtg

SEQ ID NO: 98119 - DNA, 25 bp, Homo sapien
ccctgtggcacgttatgcttcagaa

SEQ ID NO: 98120 - DNA, 25 bp, Homo sapien
gaatcgtatatattcatctgagata

SEQ ID NO: 98121 - DNA, 25 bp, Homo sapien
attatggaccctggatggcaatttg

SEQ ID NO: 98122 - DNA, 25 bp, Homo sapien
atggaccctggatggcaatttgctt

SEQ ID NO: 98123 - DNA, 25 bp, Homo sapien
gaccctggatggcaatttgcttgat

SEQ ID NO: 98124 - DNA, 25 bp, Homo sapien
ggcaatttgcttgatagcatctgat

SEQ ID NO: 98125 - DNA, 25 bp, Homo sapien
tgatagcatctgatttgcagactca

SEQ ID NO: 98126 - DNA, 25 bp, Homo sapien
atttgcagactcataatttgatttt

SEQ ID NO: 98127 - DNA, 25 bp, Homo sapien
gtgaatagacatatcagtgaacagt

SEQ ID NO: 98128 - DNA, 25 bp, Homo sapien
gacatatcagtgaacagttaactat

SEQ ID NO: 98129 - DNA, 25 bp, Homo sapien
ttttttaagattcagacctcagtta

SEQ ID NO: 98130 - DNA, 25 bp, Homo sapien
taagattcagacctcagttatataa

SEQ ID NO: 98131 - DNA, 25 bp, Homo sapien
ttaaacagtatgctcctgaatgaca

SEQ ID NO: 98132 - DNA, 25 bp, Homo sapien
tatgctcctgaatgacaagtgggtc

SEQ ID NO: 98133 - DNA, 25 bp, Homo sapien
gggaagtttatagctataagcacct

SEQ ID NO: 98134 - DNA, 25 bp, Homo sapien
gtttatagctataagcacctacatc

SEQ ID NO: 98135 - DNA, 25 bp, Homo sapien
atagctataagcacctacatcaaaa

SEQ ID NO: 98136 - DNA, 25 bp, Homo sapien
gctataagcacctacatcaaaaaag

SEQ ID NO: 98137 - DNA, 25 bp, Homo sapien
agcacctacatcaaaaaagaagaaa

SEQ ID NO: 98138 - DNA, 25 bp, Homo sapien
aataatctaaccatgaatcttatag

SEQ ID NO: 98139 - DNA, 25 bp, Homo sapien
gaatcttatagaactagagaactaa

SEQ ID NO: 98140 - DNA, 25 bp, Homo sapien
gagaactaagagcaaacaaaatcca

SEQ ID NO: 98141 - DNA, 25 bp, Homo sapien
gcaaacaaaatccaaagttactaga

SEQ ID NO: 98142 - DNA, 25 bp, Homo sapien
aaatctaatgttgtctttttaatgt

SEQ ID NO: 98143 - DNA, 25 bp, Homo sapien
ctttttaatgttagtgatccacctg

SEQ ID NO: 98144 - DNA, 25 bp, Homo sapien
gattacaggcttgaaagtctaactt

SEQ ID NO: 98145 - DNA, 25 bp, Homo sapien
atttgatacatataattcttttggc

SEQ ID NO: 98146 - DNA, 25 bp, Homo sapien
aaattttgcactgctcaattctgtt

SEQ ID NO: 98147 - DNA, 25 bp, Homo sapien
gcactgctcaattctgtttttcgtt

SEQ ID NO: 98148 - DNA, 25 bp, Homo sapien
aattctgtttttcgtttgcattgtc

SEQ ID NO: 98149 - DNA, 25 bp, Homo sapien
gtttttcgtttgcattgtctttaat

SEQ ID NO: 98150 - DNA, 25 bp, Homo sapien
attacctttacatattatcatgtct

SEQ ID NO: 98151 - DNA, 25 bp, Homo sapien
tcatgtctatttttgatgactcatc

SEQ ID NO: 98152 - DNA, 25 bp, Homo sapien
gatgactcatcaattttgtctatta

SEQ ID NO: 98153 - DNA, 25 bp, Homo sapien
gatgcagcggatgaactcctgcgcg

SEQ ID NO: 98154 - DNA, 25 bp, Homo sapien
atgcagcggatgaactcctgcgcgg

SEQ ID NO: 98155 - DNA, 25 bp, Homo sapien
agcggatgaactcctgcgcgggtgc

SEQ ID NO: 98156 - DNA, 25 bp, Homo sapien
tcctgcgcgggtgctgtgtatggga

SEQ ID NO: 98157 - DNA, 25 bp, Homo sapien
tgcgcgggtgctgtgtatgggagcc

SEQ ID NO: 98158 - DNA, 25 bp, Homo sapien
gaaaacaagctcatcaattccacgc

SEQ ID NO: 98159 - DNA, 25 bp, Homo sapien
aaacaagctcatcaattccacgcag

SEQ ID NO: 98160 - DNA, 25 bp, Homo sapien
aacaagctcatcaattccacgcagc

SEQ ID NO: 98161 - DNA, 25 bp, Homo sapien
tcatcaattccacgcagcccagcgg

SEQ ID NO: 98162 - DNA, 25 bp, Homo sapien
aggactcagaggcaaaggcgggcga

SEQ ID NO: 98163 - DNA, 25 bp, Homo sapien
ctcagaggcaaaggcgggcgagtag

SEQ ID NO: 98164 - DNA, 25 bp, Homo sapien
agagcatgaccttaagggttacagg

SEQ ID NO: 98165 - DNA, 25 bp, Homo sapien
ggcttcagactccagctacagcgag

SEQ ID NO: 98166 - DNA, 25 bp, Homo sapien
cgagcctgccccttttcttcaaggg

SEQ ID NO: 98167 - DNA, 25 bp, Homo sapien
aagggactgtcttgagggctccaaa

SEQ ID NO: 98168 - DNA, 25 bp, Homo sapien
gagggctccaaagtatagctaacta

SEQ ID NO: 98169 - DNA, 25 bp, Homo sapien
tagctaactagtcacctgggtgctg

SEQ ID NO: 98170 - DNA, 25 bp, Homo sapien
ctgggtgctgtgctgaaagtcccat

SEQ ID NO: 98171 - DNA, 25 bp, Homo sapien
agtcccatgggagaactcaaagcgt

SEQ ID NO: 98172 - DNA, 25 bp, Homo sapien
aagcgtgcattatcacagcctgagg

SEQ ID NO: 98173 - DNA, 25 bp, Homo sapien
agaactaccaacagttttgcacgaa

SEQ ID NO: 98174 - DNA, 25 bp, Homo sapien
gttttgcacgaacaatgtcttttaa

SEQ ID NO: 98175 - DNA, 25 bp, Homo sapien
gtggattgcgggtgcggctgcccag

SEQ ID NO: 98176 - DNA, 25 bp, Homo sapien
cccagcgtggggttttcagagacag

SEQ ID NO: 98177 - DNA, 25 bp, Homo sapien
gctgcggctgtctgaagcccctagt

SEQ ID NO: 98178 - DNA, 25 bp, Homo sapien
tgtctgaagcccctagtcagatggg

SEQ ID NO: 98179 - DNA, 25 bp, Homo sapien
cccctcgctgttgtgtgtgtgataa

SEQ ID NO: 98180 - DNA, 25 bp, Homo sapien
ctcgctgttgtgtgtgtgataacta

SEQ ID NO: 98181 - DNA, 25 bp, Homo sapien
gtgtgtgataactagcactaaccct

SEQ ID NO: 98182 - DNA, 25 bp, Homo sapien
taactagcactaaccctaagagggc

SEQ ID NO: 98183 - DNA, 25 bp, Homo sapien
gcactaaccctaagagggccgggag

SEQ ID NO: 98184 - DNA, 25 bp, Homo sapien
gtgggtgactgaccagggctggcag

SEQ ID NO: 98185 - DNA, 25 bp, Homo sapien
tcctgtctctctggcaggagtgcct

SEQ ID NO: 98186 - DNA, 25 bp, Homo sapien
tcagccttctggatccactctggac

SEQ ID NO: 98187 - DNA, 25 bp, Homo sapien
ttctggatccactctggacactcaa

SEQ ID NO: 98188 - DNA, 25 bp, Homo sapien
tggatccactctggacactcaacaa

SEQ ID NO: 98189 - DNA, 25 bp, Homo sapien
gatccactctggacactcaacaaga

SEQ ID NO: 98190 - DNA, 25 bp, Homo sapien
actctggacactcaacaagacctga

SEQ ID NO: 98191 - DNA, 25 bp, Homo sapien
ttttgcctacctggtccttacacta

SEQ ID NO: 98192 - DNA, 25 bp, Homo sapien
tggtccttacactacatcatcatca

SEQ ID NO: 98193 - DNA, 25 bp, Homo sapien
ggtccttacactacatcatcatcat

SEQ ID NO: 98194 - DNA, 25 bp, Homo sapien
acacccagcagagcttctcagtggg

SEQ ID NO: 98195 - DNA, 25 bp, Homo sapien
ttctcagtgggcacagtctcttact

SEQ ID NO: 98196 - DNA, 25 bp, Homo sapien
ctcagtgggcacagtctcttactcc

SEQ ID NO: 98197 - DNA, 25 bp, Homo sapien
taagttctgttatatcataccgcac

SEQ ID NO: 98198 - DNA, 25 bp, Homo sapien
tgttatatcataccgcacattctcc

SEQ ID NO: 98199 - DNA, 25 bp, Homo sapien
gcacattctcctttggctatcagag

SEQ ID NO: 98200 - DNA, 25 bp, Homo sapien
ggctatcagagactctacactggag

SEQ ID NO: 98201 - DNA, 25 bp, Homo sapien
tgagagtgtttaactggacagccca

SEQ ID NO: 98202 - DNA, 25 bp, Homo sapien
ggacagcccagagacctggtatgta

SEQ ID NO: 98203 - DNA, 25 bp, Homo sapien
ggtatgtagtcctaatctgccactg

SEQ ID NO: 98204 - DNA, 25 bp, Homo sapien
tgccttggacaacttgcctacttcc

SEQ ID NO: 98205 - DNA, 25 bp, Homo sapien
tacttccaccaggttatggttcttt

SEQ ID NO: 98206 - DNA, 25 bp, Homo sapien
gaaatcttgtaggagctctgttagc

SEQ ID NO: 98207 - DNA, 25 bp, Homo sapien
gctctaaaatgctacaactctataa

SEQ ID NO: 98208 - DNA, 25 bp, Homo sapien
gaaaccttgctgttggtatttccat

SEQ ID NO: 98209 - DNA, 25 bp, Homo sapien
atttccattttgatacttgagagca

SEQ ID NO: 98210 - DNA, 25 bp, Homo sapien
gtaacagccctaatgatgactggaa

SEQ ID NO: 98211 - DNA, 25 bp, Homo sapien
gagaggttccagagaaatcagtgtt

SEQ ID NO: 98212 - DNA, 25 bp, Homo sapien
aaactgctagcaggagctgtacaat

SEQ ID NO: 98213 - DNA, 25 bp, Homo sapien
ctgtacaatgagaaaaagcgccact

SEQ ID NO: 98214 - DNA, 25 bp, Homo sapien
cgccactcaaaacaactctcttagg

SEQ ID NO: 98215 - DNA, 25 bp, Homo sapien
aactctcttaggtcatttttcaatg

SEQ ID NO: 98216 - DNA, 25 bp, Homo sapien
agcggaagcaccatgatgacctcaa

SEQ ID NO: 98217 - DNA, 25 bp, Homo sapien
atgacctcaacagtggaggcccagc

SEQ ID NO: 98218 - DNA, 25 bp, Homo sapien
gttggacatccctggaaaccttgct

SEQ ID NO: 98219 - DNA, 25 bp, Homo sapien
atgagcatttactgacttcctgtta

SEQ ID NO: 98220 - DNA, 25 bp, Homo sapien
ttactgacttcctgttaaaacttca

SEQ ID NO: 98221 - DNA, 25 bp, Homo sapien
tgcacaaacgtgcagatatctgata

SEQ ID NO: 98222 - DNA, 25 bp, Homo sapien
agatatctgatagccctttccgttg

SEQ ID NO: 98223 - DNA, 25 bp, Homo sapien
ccctttccgttgcactcaagaggaa

SEQ ID NO: 98224 - DNA, 25 bp, Homo sapien
gaagcaagatcattagttgaatcgg

SEQ ID NO: 98225 - DNA, 25 bp, Homo sapien
gttgaatcggtatcatcttcaccaa

SEQ ID NO: 98226 - DNA, 25 bp, Homo sapien
aatcggtatcatcttcaccaaataa

SEQ ID NO: 98227 - DNA, 25 bp, Homo sapien
gaagagcaagtgtggcacttccttg

SEQ ID NO: 98228 - DNA, 25 bp, Homo sapien
gtggcacttccttggcaagtgattg

SEQ ID NO: 98229 - DNA, 25 bp, Homo sapien
agattcccatctctaaggactccaa

SEQ ID NO: 98230 - DNA, 25 bp, Homo sapien
caagctgaggagtagatgggaattt

SEQ ID NO: 98231 - DNA, 25 bp, Homo sapien
gatactatgaacgtatttgacattt

SEQ ID NO: 98232 - DNA, 25 bp, Homo sapien
tgctcactcaacctcgaaagactga

SEQ ID NO: 98233 - DNA, 25 bp, Homo sapien
gggttacagctactgctgccattgc

SEQ ID NO: 98234 - DNA, 25 bp, Homo sapien
catttattcacttttcctaagaagg

SEQ ID NO: 98235 - DNA, 25 bp, Homo sapien
ttttcctaagaaggcacttctgggc

SEQ ID NO: 98236 - DNA, 25 bp, Homo sapien
tgggcctgggtctgaggacatcttt

SEQ ID NO: 98237 - DNA, 25 bp, Homo sapien
acatcttttttgactgggagccttc

SEQ ID NO: 98238 - DNA, 25 bp, Homo sapien
ttttttgactgggagccttcttact

SEQ ID NO: 98239 - DNA, 25 bp, Homo sapien
ggagccttcttactgttgaggttca

SEQ ID NO: 98240 - DNA, 25 bp, Homo sapien
ttgaggttcaacaagctgaggagta

SEQ ID NO: 98241 - DNA, 25 bp, Homo sapien
gagcaaagtgccattgtttgccttt

SEQ ID NO: 98242 - DNA, 25 bp, Homo sapien
gtgccattgtttgcctttaattggg

SEQ ID NO: 98243 - DNA, 25 bp, Homo sapien
aagggaaagagggtacttgccacat

SEQ ID NO: 98244 - DNA, 25 bp, Homo sapien
gtacttgccacatagtttccttttt

SEQ ID NO: 98245 - DNA, 25 bp, Homo sapien
aactgcactttctttatataatcgt

SEQ ID NO: 98246 - DNA, 25 bp, Homo sapien
ataatcgtttgcattttgttacttg

SEQ ID NO: 98247 - DNA, 25 bp, Homo sapien
cttgctaccctgagtactttcagga

SEQ ID NO: 98248 - DNA, 25 bp, Homo sapien
ttgggtataagatctgaacttttca

SEQ ID NO: 98249 - DNA, 25 bp, Homo sapien
gaacttttcatctgcagaggcaaga

SEQ ID NO: 98250 - DNA, 25 bp, Homo sapien
gaagatgatggttgcatgtttctag

SEQ ID NO: 98251 - DNA, 25 bp, Homo sapien
gtttctagtttgtatatgtttccat

SEQ ID NO: 98252 - DNA, 25 bp, Homo sapien
gcagagctgggtttaatgagcattt

SEQ ID NO: 98253 - DNA, 25 bp, Homo sapien
aatattatctcgttcattgtcagca

SEQ ID NO: 98254 - DNA, 25 bp, Homo sapien
tctcgttcattgtcagcaaaactgt

SEQ ID NO: 98255 - DNA, 25 bp, Homo sapien
gagtagggcagttcattcacaggaa

SEQ ID NO: 98256 - DNA, 25 bp, Homo sapien
gaagtaatttaccacaggcgacaca

SEQ ID NO: 98257 - DNA, 25 bp, Homo sapien
aggcgacacagctactctctgatgg

SEQ ID NO: 98258 - DNA, 25 bp, Homo sapien
gggccagaatggaaatccgtaactc

SEQ ID NO: 98259 - DNA, 25 bp, Homo sapien
gaaatccgtaactcggctgtgttct

SEQ ID NO: 98260 - DNA, 25 bp, Homo sapien
taactcggctgtgttctgttcatgt

SEQ ID NO: 98261 - DNA, 25 bp, Homo sapien
atgaatcacaaacagagcaccaaga

SEQ ID NO: 98262 - DNA, 25 bp, Homo sapien
caagaaaaagctttctcagccttca

SEQ ID NO: 98263 - DNA, 25 bp, Homo sapien
tacactccacatcctacagaaaagc

SEQ ID NO: 98264 - DNA, 25 bp, Homo sapien
aaagcattacccattttgcggccaa

SEQ ID NO: 98265 - DNA, 25 bp, Homo sapien
aagttcccgacgagaggctggacct

SEQ ID NO: 98266 - DNA, 25 bp, Homo sapien
ttcatcacattgacttacgccgttg

SEQ ID NO: 98267 - DNA, 25 bp, Homo sapien
tacgccgttgcttttccagactggg

SEQ ID NO: 98268 - DNA, 25 bp, Homo sapien
ggctgacttcgcagtgtgtgccaaa

SEQ ID NO: 98269 - DNA, 25 bp, Homo sapien
gtgtgccaaagagccggtgtctgat

SEQ ID NO: 98270 - DNA, 25 bp, Homo sapien
ggtgtctgataatcccattttcctg

SEQ ID NO: 98271 - DNA, 25 bp, Homo sapien
attttcctgcttatcacctgaactg

SEQ ID NO: 98272 - DNA, 25 bp, Homo sapien
gaactgtgccagtatcacttttagt

SEQ ID NO: 98273 - DNA, 25 bp, Homo sapien
tatgccctgttttctacttctgttg

SEQ ID NO: 98274 - DNA, 25 bp, Homo sapien
tcttttcaacctactttcatactga

SEQ ID NO: 98275 - DNA, 25 bp, Homo sapien
tactttcatactgaagatgcagcaa

SEQ ID NO: 98276 - DNA, 25 bp, Homo sapien
gagatggcctgagaagagagatcaa

SEQ ID NO: 98277 - DNA, 25 bp, Homo sapien
gaggaaagaactcagtgctgcctat

SEQ ID NO: 98278 - DNA, 25 bp, Homo sapien
ctcagtgctgcctattagtagttaa

SEQ ID NO: 98279 - DNA, 25 bp, Homo sapien
gtagttaattctgtcactcaccact

SEQ ID NO: 98280 - DNA, 25 bp, Homo sapien
gttaattctgtcactcaccactaca

SEQ ID NO: 98281 - DNA, 25 bp, Homo sapien
tcctggacttaactctaattctaga

SEQ ID NO: 98282 - DNA, 25 bp, Homo sapien
ttctagagtctctgttactgcttgg

SEQ ID NO: 98283 - DNA, 25 bp, Homo sapien
gtctctgttactgcttgggctatac

SEQ ID NO: 98284 - DNA, 25 bp, Homo sapien
tgggctatacctgggcatactaata

SEQ ID NO: 98285 - DNA, 25 bp, Homo sapien
gtgacatctgcaaatggcaccgagg

SEQ ID NO: 98286 - DNA, 25 bp, Homo sapien
aaatggcaccgaggagggtccaatg

SEQ ID NO: 98287 - DNA, 25 bp, Homo sapien
atgggcggagctacaagcggacctt

SEQ ID NO: 98288 - DNA, 25 bp, Homo sapien
gagctacaagcggaccttttctgag

SEQ ID NO: 98289 - DNA, 25 bp, Homo sapien
caagcggaccttttctgagccaggg

SEQ ID NO: 98290 - DNA, 25 bp, Homo sapien
gatgctgacctctggcaaacggtca

SEQ ID NO: 98291 - DNA, 25 bp, Homo sapien
acctctggcaaacggtcacatttgg

SEQ ID NO: 98292 - DNA, 25 bp, Homo sapien
ggcaaacggtcacatttggagtcca

SEQ ID NO: 98293 - DNA, 25 bp, Homo sapien
atttggagtccagcagcagacccca

SEQ ID NO: 98294 - DNA, 25 bp, Homo sapien
tcccgcccggcatgtgtgttcaggg

SEQ ID NO: 98295 - DNA, 25 bp, Homo sapien
cccggcatgtgtgttcagggactga

SEQ ID NO: 98296 - DNA, 25 bp, Homo sapien
ccacatccctgagaggctgacatgt

SEQ ID NO: 98297 - DNA, 25 bp, Homo sapien
acatccctgagaggctgacatgtgt

SEQ ID NO: 98298 - DNA, 25 bp, Homo sapien
atccctgagaggctgacatgtgttg

SEQ ID NO: 98299 - DNA, 25 bp, Homo sapien
cctgagaggctgacatgtgttgctg

SEQ ID NO: 98300 - DNA, 25 bp, Homo sapien
acatgtgttgctgtgaccacttaat

SEQ ID NO: 98301 - DNA, 25 bp, Homo sapien
tgtgttgctgtgaccacttaattga

SEQ ID NO: 98302 - DNA, 25 bp, Homo sapien
tgctgtgaccacttaattgatccca

SEQ ID NO: 98303 - DNA, 25 bp, Homo sapien
tgtgaccacttaattgatcccagca

SEQ ID NO: 98304 - DNA, 25 bp, Homo sapien
tgaccacttaattgatcccagcact

SEQ ID NO: 98305 - DNA, 25 bp, Homo sapien
gaccacttaattgatcccagcactt

SEQ ID NO: 98306 - DNA, 25 bp, Homo sapien
gttgtggtggcaggctcttgtagtc

SEQ ID NO: 98307 - DNA, 25 bp, Homo sapien
gagtgttgaacaatcccttcttctt

SEQ ID NO: 98308 - DNA, 25 bp, Homo sapien
aatcccttcttcttctcaaactcag

SEQ ID NO: 98309 - DNA, 25 bp, Homo sapien
aaagtcttactgatatcacctccgc

SEQ ID NO: 98310 - DNA, 25 bp, Homo sapien
actgatatcacctccgcatttactt

SEQ ID NO: 98311 - DNA, 25 bp, Homo sapien
gcatttacttcctcataggcctcag

SEQ ID NO: 98312 - DNA, 25 bp, Homo sapien
tacttcctcataggcctcaggatta

SEQ ID NO: 98313 - DNA, 25 bp, Homo sapien
caggattatgtagcttttatttttt

SEQ ID NO: 98314 - DNA, 25 bp, Homo sapien
ttctcctatttctaatagtccatcg

SEQ ID NO: 98315 - DNA, 25 bp, Homo sapien
aatagtccatcgatcttctgcattt

SEQ ID NO: 98316 - DNA, 25 bp, Homo sapien
gtccatcgatcttctgcatttatag

SEQ ID NO: 98317 - DNA, 25 bp, Homo sapien
cgatcttctgcatttataggtttga

SEQ ID NO: 98318 - DNA, 25 bp, Homo sapien
gtgtgagtgccatgcccagctggat

SEQ ID NO: 98319 - DNA, 25 bp, Homo sapien
gtgccatgcccagctggatgattaa

SEQ ID NO: 98320 - DNA, 25 bp, Homo sapien
atgcccagctggatgattaagttct

SEQ ID NO: 98321 - DNA, 25 bp, Homo sapien
tgcccagctggatgattaagttctt

SEQ ID NO: 98322 - DNA, 25 bp, Homo sapien
gcccagctggatgattaagttcttt

SEQ ID NO: 98323 - DNA, 25 bp, Homo sapien
cccagctggatgattaagttcttta

SEQ ID NO: 98324 - DNA, 25 bp, Homo sapien
cagctggatgattaagttctttata

SEQ ID NO: 98325 - DNA, 25 bp, Homo sapien
ggatgattaagttctttatagcatt

SEQ ID NO: 98326 - DNA, 25 bp, Homo sapien
tatagcattttactcttgtataaat

SEQ ID NO: 98327 - DNA, 25 bp, Homo sapien
actcttgtataaattgctgaagtaa

SEQ ID NO: 98328 - DNA, 25 bp, Homo sapien
gctgaagtaaaaaatcttagtatca

SEQ ID NO: 98329 - DNA, 25 bp, Homo sapien
tgctgaagtttctttatccctgtca

SEQ ID NO: 98330 - DNA, 25 bp, Homo sapien
aagtttctttatccctgtcactaat

SEQ ID NO: 98331 - DNA, 25 bp, Homo sapien
ttacctaatttctattatgggactg

SEQ ID NO: 98332 - DNA, 25 bp, Homo sapien
attatgggactgtttgctttgaaag

SEQ ID NO: 98333 - DNA, 25 bp, Homo sapien
ggttgatgagaatttacgtctgcaa

SEQ ID NO: 98334 - DNA, 25 bp, Homo sapien
gagaatttacgtctgcaatctagat

SEQ ID NO: 98335 - DNA, 25 bp, Homo sapien
acgtctgcaatctagatgcatattt

SEQ ID NO: 98336 - DNA, 25 bp, Homo sapien
aatttggtcctacctatatgtgtgt

SEQ ID NO: 98337 - DNA, 25 bp, Homo sapien
aaagttaacttgtcaattgttcaca

SEQ ID NO: 98338 - DNA, 25 bp, Homo sapien
gtcaattgttcacatacccagtaat

SEQ ID NO: 98339 - DNA, 25 bp, Homo sapien
atgaaataaaatggccgtttggatt

SEQ ID NO: 98340 - DNA, 25 bp, Homo sapien
gaatgaatgtcacttgtgtaccgag

SEQ ID NO: 98341 - DNA, 25 bp, Homo sapien
atgtcacttgtgtaccgagagcttg

SEQ ID NO: 98342 - DNA, 25 bp, Homo sapien
cacttgtgtaccgagagcttgaaaa

SEQ ID NO: 98343 - DNA, 25 bp, Homo sapien
gagttcagtttcttcacgatggaag

SEQ ID NO: 98344 - DNA, 25 bp, Homo sapien
gaagttgctaaattctccatggaca

SEQ ID NO: 98345 - DNA, 25 bp, Homo sapien
aggaacgatattctcatcatcatca

SEQ ID NO: 98346 - DNA, 25 bp, Homo sapien
ccaggctctgactgagtttctttca

SEQ ID NO: 98347 - DNA, 25 bp, Homo sapien
tcagttttactgatgttctgggtgg

SEQ ID NO: 98348 - DNA, 25 bp, Homo sapien
cagagtaatcttgactgaatggaga

SEQ ID NO: 98349 - DNA, 25 bp, Homo sapien
agaaagtttctgtgctacccctaca

SEQ ID NO: 98350 - DNA, 25 bp, Homo sapien
tgcctcactgacagaccagcatttt

SEQ ID NO: 98351 - DNA, 25 bp, Homo sapien
ggcgctcaaggcttacccggcagcg

SEQ ID NO: 98352 - DNA, 25 bp, Homo sapien
gcgctcaaggcttacccggcagcgt

SEQ ID NO: 98353 - DNA, 25 bp, Homo sapien
tacccggcagcgtccacgcctgcag

SEQ ID NO: 98354 - DNA, 25 bp, Homo sapien
cgccactcgcgcacgaggctgaggc

SEQ ID NO: 98355 - DNA, 25 bp, Homo sapien
gctgctggatgggagcggcagcagt

SEQ ID NO: 98356 - DNA, 25 bp, Homo sapien
gaggagcaggccgtgaccaccgcgg

SEQ ID NO: 98357 - DNA, 25 bp, Homo sapien
ggcccagatgcaccagccgcccttg

SEQ ID NO: 98358 - DNA, 25 bp, Homo sapien
tcggagacccaggtcgggccagcaa

SEQ ID NO: 98359 - DNA, 25 bp, Homo sapien
gcgggcgggccagaccggaggactt

SEQ ID NO: 98360 - DNA, 25 bp, Homo sapien
ccagaccggaggacttggccatcta

SEQ ID NO: 98361 - DNA, 25 bp, Homo sapien
cagaccggaggacttggccatctag

SEQ ID NO: 98362 - DNA, 25 bp, Homo sapien
gagagtcagcatcatgtcttacgcg

SEQ ID NO: 98363 - DNA, 25 bp, Homo sapien
atgtcttacgcgttgcaagctgaga

SEQ ID NO: 98364 - DNA, 25 bp, Homo sapien
gcaagctgagatgaatcactttcac

SEQ ID NO: 98365 - DNA, 25 bp, Homo sapien
cactttcacagtaaccggatctatg

SEQ ID NO: 98366 - DNA, 25 bp, Homo sapien
gattacaacagtgtcatccgcctgt

SEQ ID NO: 98367 - DNA, 25 bp, Homo sapien
atccgcctgtacctggagcagcaag

SEQ ID NO: 98368 - DNA, 25 bp, Homo sapien
agcagcaagtgcaattttacgaaac

SEQ ID NO: 98369 - DNA, 25 bp, Homo sapien
tcagccgctttccagtgatgtagga

SEQ ID NO: 98370 - DNA, 25 bp, Homo sapien
gatgtaggacagaacgggccttgaa

SEQ ID NO: 98371 - DNA, 25 bp, Homo sapien
ggccttgaagagaatgccgcgtgct

SEQ ID NO: 98372 - DNA, 25 bp, Homo sapien
aatgccgcgtgctttctcctgactt

SEQ ID NO: 98373 - DNA, 25 bp, Homo sapien
tgacctttgcccctaacacgaggaa

SEQ ID NO: 98374 - DNA, 25 bp, Homo sapien
ttgcccctaacacgaggaactcgtt

SEQ ID NO: 98375 - DNA, 25 bp, Homo sapien
gcagcgtagcatgtctgatttgcca

SEQ ID NO: 98376 - DNA, 25 bp, Homo sapien
catgtctgatttgccacctggatga

SEQ ID NO: 98377 - DNA, 25 bp, Homo sapien
gccacctggatgaaggcagacatca

SEQ ID NO: 98378 - DNA, 25 bp, Homo sapien
caacatgggtcagcacgttcagtta

SEQ ID NO: 98379 - DNA, 25 bp, Homo sapien
gtcagcacgttcagttacgggagtg

SEQ ID NO: 98380 - DNA, 25 bp, Homo sapien
gcgttcccaagctgtgcgttctgga

SEQ ID NO: 98381 - DNA, 25 bp, Homo sapien
gtgcgttctggaccagctactgaat

SEQ ID NO: 98382 - DNA, 25 bp, Homo sapien
gaattattaatctcacttagcgaaa

SEQ ID NO: 98383 - DNA, 25 bp, Homo sapien
ctcctgactagcctctcttacagga

SEQ ID NO: 98384 - DNA, 25 bp, Homo sapien
gtgcatgaatgccggcgcctgtcta

SEQ ID NO: 98385 - DNA, 25 bp, Homo sapien
tctggaagttaaagtgaggccactg

SEQ ID NO: 98386 - DNA, 25 bp, Homo sapien
ggagggtctagaggcctgaaatcct

SEQ ID NO: 98387 - DNA, 25 bp, Homo sapien
tagaggcctgaaatcctggttccta

SEQ ID NO: 98388 - DNA, 25 bp, Homo sapien
aggcctgaaatcctggttcctaggg

SEQ ID NO: 98389 - DNA, 25 bp, Homo sapien
gctcagttctggactgtgggtttgt

SEQ ID NO: 98390 - DNA, 25 bp, Homo sapien
agctgagaagactcaagtccccgtc

SEQ ID NO: 98391 - DNA, 25 bp, Homo sapien
tgagaagactcaagtccccgtctgc

SEQ ID NO: 98392 - DNA, 25 bp, Homo sapien
aagtccccgtctgcctggcaggttg

SEQ ID NO: 98393 - DNA, 25 bp, Homo sapien
tgcctggcaggttgttagaaaaatg

SEQ ID NO: 98394 - DNA, 25 bp, Homo sapien
aatggactatccattagagcaactt

SEQ ID NO: 98395 - DNA, 25 bp, Homo sapien
gcaaggacgagcgaagtaggacatc

SEQ ID NO: 98396 - DNA, 25 bp, Homo sapien
cgaagtaggacatcgttcagcggat

SEQ ID NO: 98397 - DNA, 25 bp, Homo sapien
catcgttcagcggatgagaagccga

SEQ ID NO: 98398 - DNA, 25 bp, Homo sapien
gagcgttcgcccagcgttcgctgag

SEQ ID NO: 98399 - DNA, 25 bp, Homo sapien
cccagcgttcgctgagctaaaggat

SEQ ID NO: 98400 - DNA, 25 bp, Homo sapien
gttcgctgagctaaaggatgacgat

SEQ ID NO: 98401 - DNA, 25 bp, Homo sapien
aaggatgacgatgttgcagctggag

SEQ ID NO: 98402 - DNA, 25 bp, Homo sapien
gttggacaactggagagtcttctcg

SEQ ID NO: 98403 - DNA, 25 bp, Homo sapien
actggagagtcttctcgttgttcaa

SEQ ID NO: 98404 - DNA, 25 bp, Homo sapien
gagagtcttctcgttgttcaaagaa

SEQ ID NO: 98405 - DNA, 25 bp, Homo sapien
gaggagggagtcaattagactgtaa

SEQ ID NO: 98406 - DNA, 25 bp, Homo sapien
ttcagggagtccagcatgtagtcat

SEQ ID NO: 98407 - DNA, 25 bp, Homo sapien
gtagtcatggcagccttaggtattt

SEQ ID NO: 98408 - DNA, 25 bp, Homo sapien
taggtatttgagaccgaccaaccct

SEQ ID NO: 98409 - DNA, 25 bp, Homo sapien
aactcatgcagaacttggagcgtga

SEQ ID NO: 98410 - DNA, 25 bp, Homo sapien
agcgtgatgcccagaagtgtgtgaa

SEQ ID NO: 98411 - DNA, 25 bp, Homo sapien
aagtgtgtgaactggtctgtgacca

SEQ ID NO: 98412 - DNA, 25 bp, Homo sapien
gatgagaaccgcatgctgagattgg

SEQ ID NO: 98413 - DNA, 25 bp, Homo sapien
agatttcagtgagcctacatgcaga

SEQ ID NO: 98414 - DNA, 25 bp, Homo sapien
atgcagatgacatggtgacacccgt

SEQ ID NO: 98415 - DNA, 25 bp, Homo sapien
ccagcctgagctgttttcttctggc

SEQ ID NO: 98416 - DNA, 25 bp, Homo sapien
ttcttctggccctcttattacatga

SEQ ID NO: 98417 - DNA, 25 bp, Homo sapien
gtggcagggctaactgcctggccct

SEQ ID NO: 98418 - DNA, 25 bp, Homo sapien
cctggcagcaggttctcctcagggc

SEQ ID NO: 98419 - DNA, 25 bp, Homo sapien
agggcttgggtcttcaacctgtggc

SEQ ID NO: 98420 - DNA, 25 bp, Homo sapien
ttgggtcttcaacctgtggcgacag

SEQ ID NO: 98421 - DNA, 25 bp, Homo sapien
gggtggaccgccatgagcatgaaaa

SEQ ID NO: 98422 - DNA, 25 bp, Homo sapien
gccatgagcatgaaaagacccgaag

SEQ ID NO: 98423 - DNA, 25 bp, Homo sapien
aaagacccgaagcaagttgactctt

SEQ ID NO: 98424 - DNA, 25 bp, Homo sapien
caagttgactcttgcaatgtgcaac

SEQ ID NO: 98425 - DNA, 25 bp, Homo sapien
tgcaatgtgcaactgttatgttctg

SEQ ID NO: 98426 - DNA, 25 bp, Homo sapien
aactgttatgttctgcaaaatgagc

SEQ ID NO: 98427 - DNA, 25 bp, Homo sapien
gagcaacgatgtatcaaattgatgc

SEQ ID NO: 98428 - DNA, 25 bp, Homo sapien
gagtagtatggtatcagttaattcc

SEQ ID NO: 98429 - DNA, 25 bp, Homo sapien
gttaattccagtctgagcttctctg

SEQ ID NO: 98430 - DNA, 25 bp, Homo sapien
tgagcttctctgtcaacttcagttt

SEQ ID NO: 98431 - DNA, 25 bp, Homo sapien
taatagtccaggtttttgtgtgttt

SEQ ID NO: 98432 - DNA, 25 bp, Homo sapien
gtgtttttctttatactgcaaatta

SEQ ID NO: 98433 - DNA, 25 bp, Homo sapien
cactttatagtttgggagacagaat

SEQ ID NO: 98434 - DNA, 25 bp, Homo sapien
gacagaatcaggtcttgaataaaat

SEQ ID NO: 98435 - DNA, 25 bp, Homo sapien
gtaatgagtgctaaatgggcaccat

SEQ ID NO: 98436 - DNA, 25 bp, Homo sapien
atgggcaccattattcgaatcagat

SEQ ID NO: 98437 - DNA, 25 bp, Homo sapien
gataccttttatattctctttccat

SEQ ID NO: 98438 - DNA, 25 bp, Homo sapien
attctctttccataaatacgttgat

SEQ ID NO: 98439 - DNA, 25 bp, Homo sapien
agctgaggagactaagttagccatg

SEQ ID NO: 98440 - DNA, 25 bp, Homo sapien
ggagactaagttagccatgtgggca

SEQ ID NO: 98441 - DNA, 25 bp, Homo sapien
agcatgccaatgtgatcaatcccta

SEQ ID NO: 98442 - DNA, 25 bp, Homo sapien
catgccaatgtgatcaatccctagt

SEQ ID NO: 98443 - DNA, 25 bp, Homo sapien
gtgatcaatccctagtaaaagccct

SEQ ID NO: 98444 - DNA, 25 bp, Homo sapien
gatcaatccctagtaaaagccctgg

SEQ ID NO: 98445 - DNA, 25 bp, Homo sapien
caatccctagtaaaagccctggaca

SEQ ID NO: 98446 - DNA, 25 bp, Homo sapien
gtaaaagccctggacacctaggcat

SEQ ID NO: 98447 - DNA, 25 bp, Homo sapien
aaaagccctggacacctaggcatgg

SEQ ID NO: 98448 - DNA, 25 bp, Homo sapien
gtaataaactgtaactatgagtgca

SEQ ID NO: 98449 - DNA, 25 bp, Homo sapien
taaactgtaactatgagtgcaaaaa

SEQ ID NO: 98450 - DNA, 25 bp, Homo sapien
ggcctggattgacaacatcctccca

SEQ ID NO: 98451 - DNA, 25 bp, Homo sapien
cctggattgacaacatcctcccaga

SEQ ID NO: 98452 - DNA, 25 bp, Homo sapien
tccctcctccctcggttataaagat

SEQ ID NO: 98453 - DNA, 25 bp, Homo sapien
ccctcggttataaagattcccatgg

SEQ ID NO: 98454 - DNA, 25 bp, Homo sapien
gattcccatggaaagtgtccaatca

SEQ ID NO: 98455 - DNA, 25 bp, Homo sapien
tgtccaatcagatccccaaaacggt

SEQ ID NO: 98456 - DNA, 25 bp, Homo sapien
aatcagatccccaaaacggtatcca

SEQ ID NO: 98457 - DNA, 25 bp, Homo sapien
agatccccaaaacggtatccactgc

SEQ ID NO: 98458 - DNA, 25 bp, Homo sapien
caaaacggtatccactgcattgcca

SEQ ID NO: 98459 - DNA, 25 bp, Homo sapien
aagatcttccagttggagttactca

SEQ ID NO: 98460 - DNA, 25 bp, Homo sapien
tcttccagttggagttactcactct

SEQ ID NO: 98461 - DNA, 25 bp, Homo sapien
tgctgcgcctgctcgtgggcctggc

SEQ ID NO: 98462 - DNA, 25 bp, Homo sapien
gggccaggacgacccacagtcccag

SEQ ID NO: 98463 - DNA, 25 bp, Homo sapien
ccagccgtcctcaccagagatggac

SEQ ID NO: 98464 - DNA, 25 bp, Homo sapien
accagggaggacaggatgctgggca

SEQ ID NO: 98465 - DNA, 25 bp, Homo sapien
gggaagccaagtcacgggcaggccg

SEQ ID NO: 98466 - DNA, 25 bp, Homo sapien
acgggcaggccgcagtggttcttgc

SEQ ID NO: 98467 - DNA, 25 bp, Homo sapien
agtggttcttgcgtggcctggtttt

SEQ ID NO: 98468 - DNA, 25 bp, Homo sapien
ttcttgcgtggcctggttttatttt

SEQ ID NO: 98469 - DNA, 25 bp, Homo sapien
tttcattgtgaaatatcatgctctt

SEQ ID NO: 98470 - DNA, 25 bp, Homo sapien
atcatgctcttatttcagtcctcaa

SEQ ID NO: 98471 - DNA, 25 bp, Homo sapien
catgctcttatttcagtcctcaaaa

SEQ ID NO: 98472 - DNA, 25 bp, Homo sapien
gacagtggaagtggtggaatctatc

SEQ ID NO: 98473 - DNA, 25 bp, Homo sapien
tctatcgagaagatttccacggaga

SEQ ID NO: 98474 - DNA, 25 bp, Homo sapien
ttccacggagagcattcagacatat

SEQ ID NO: 98475 - DNA, 25 bp, Homo sapien
cagacatatgaagaaaccgctgtga

SEQ ID NO: 98476 - DNA, 25 bp, Homo sapien
aaaccgctgtgatcgtggagaccat

SEQ ID NO: 98477 - DNA, 25 bp, Homo sapien
agagaagagctcttaaaatgcccag

SEQ ID NO: 98478 - DNA, 25 bp, Homo sapien
aaatgcccaggcttgatgggataaa

SEQ ID NO: 98479 - DNA, 25 bp, Homo sapien
gagggttcctgtttggattagacca

SEQ ID NO: 98480 - DNA, 25 bp, Homo sapien
gattagaccatagttgacccatctg

SEQ ID NO: 98481 - DNA, 25 bp, Homo sapien
tagttgacccatctggcattgccaa

SEQ ID NO: 98482 - DNA, 25 bp, Homo sapien
tggcattgccaacgaagccttcatt

SEQ ID NO: 98483 - DNA, 25 bp, Homo sapien
cccaagggtgtctcatgctacaaga

SEQ ID NO: 98484 - DNA, 25 bp, Homo sapien
aagggtgtctcatgctacaagaaga

SEQ ID NO: 98485 - DNA, 25 bp, Homo sapien
aggcaagagacaggccccagggctt

SEQ ID NO: 98486 - DNA, 25 bp, Homo sapien
cagggcttctggctagaacccgaaa

SEQ ID NO: 98487 - DNA, 25 bp, Homo sapien
ggcttctggctagaacccgaaacaa

SEQ ID NO: 98488 - DNA, 25 bp, Homo sapien
ttctggctagaacccgaaacaaaag

SEQ ID NO: 98489 - DNA, 25 bp, Homo sapien
gctagaacccgaaacaaaaggagct

SEQ ID NO: 98490 - DNA, 25 bp, Homo sapien
gtggcctgagagccatctgtgacct

SEQ ID NO: 98491 - DNA, 25 bp, Homo sapien
cagggtctctgcacagtgaccttca

SEQ ID NO: 98492 - DNA, 25 bp, Homo sapien
tgcacagtgaccttcacagcagttg

SEQ ID NO: 98493 - DNA, 25 bp, Homo sapien
agtgaccttcacagcagttgttgga

SEQ ID NO: 98494 - DNA, 25 bp, Homo sapien
gggaaactacatgaaatatactgtt

SEQ ID NO: 98495 - DNA, 25 bp, Homo sapien
gaaatatactgttacgttcaataaa

SEQ ID NO: 98496 - DNA, 25 bp, Homo sapien
tactgttacgttcaataaacattag

SEQ ID NO: 98497 - DNA, 25 bp, Homo sapien
taaacattagcttctgtatataaaa

SEQ ID NO: 98498 - DNA, 25 bp, Homo sapien
tagtgaggccccagcctacctgcac

SEQ ID NO: 98499 - DNA, 25 bp, Homo sapien
cctgcacctccgtgaggcaactggg

SEQ ID NO: 98500 - DNA, 25 bp, Homo sapien
tgcacctccgtgaggcaactgggcc

SEQ ID NO: 98501 - DNA, 25 bp, Homo sapien
cccgatgattcgtaacaccaccttt

SEQ ID NO: 98502 - DNA, 25 bp, Homo sapien
cgatgattcgtaacaccacctttcg

SEQ ID NO: 98503 - DNA, 25 bp, Homo sapien
gatgattcgtaacaccacctttcgc

SEQ ID NO: 98504 - DNA, 25 bp, Homo sapien
atgattcgtaacaccacctttcgcc

SEQ ID NO: 98505 - DNA, 25 bp, Homo sapien
atgggtaagggtgtttcctcagcac

SEQ ID NO: 98506 - DNA, 25 bp, Homo sapien
gggattatgtctgctgtcatgtctg

SEQ ID NO: 98507 - DNA, 25 bp, Homo sapien
tgtcatgtctgggtctttagggtag

SEQ ID NO: 98508 - DNA, 25 bp, Homo sapien
aggcaggagtctccacaaggcttca

SEQ ID NO: 98509 - DNA, 25 bp, Homo sapien
tcatgtggccccttatagggcaggc

SEQ ID NO: 98510 - DNA, 25 bp, Homo sapien
tgccctctgggaaggtcccttcatg

SEQ ID NO: 98511 - DNA, 25 bp, Homo sapien
gaaggtcccttcatgctggaggcac

SEQ ID NO: 98512 - DNA, 25 bp, Homo sapien
tcatgctggaggcacacagctttaa

SEQ ID NO: 98513 - DNA, 25 bp, Homo sapien
ggttgaagtaggactccttcgtcct

SEQ ID NO: 98514 - DNA, 25 bp, Homo sapien
tccttcgtcctctcactggctttgg

SEQ ID NO: 98515 - DNA, 25 bp, Homo sapien
ggctttggctccctcaataaactgt

SEQ ID NO: 98516 - DNA, 25 bp, Homo sapien
gaaaaagcggtacgatgccttcctg

SEQ ID NO: 98517 - DNA, 25 bp, Homo sapien
aagcggtacgatgccttcctgacct

SEQ ID NO: 98518 - DNA, 25 bp, Homo sapien
gtgccggcactctgggtggactcac

SEQ ID NO: 98519 - DNA, 25 bp, Homo sapien
gcactctgggtggactcacggctgc

SEQ ID NO: 98520 - DNA, 25 bp, Homo sapien
tgctgggccccacgtcaaaggtcaa

SEQ ID NO: 98521 - DNA, 25 bp, Homo sapien
gggccccacgtcaaaggtcaagtga

SEQ ID NO: 98522 - DNA, 25 bp, Homo sapien
tcaagtgagacgtaggtcaagtcct

SEQ ID NO: 98523 - DNA, 25 bp, Homo sapien
ggtctgtcagacaggctgccctaga

SEQ ID NO: 98524 - DNA, 25 bp, Homo sapien
tgtcagacaggctgccctagagccc

SEQ ID NO: 98525 - DNA, 25 bp, Homo sapien
gactgggagcagttccaagaccacc

SEQ ID NO: 98526 - DNA, 25 bp, Homo sapien
gtaaatcttgttcattgtaaatcaa

SEQ ID NO: 98527 - DNA, 25 bp, Homo sapien
tgttccggcttcttcacggctgaca

SEQ ID NO: 98528 - DNA, 25 bp, Homo sapien
tcacggctgacattcggctaacgag

SEQ ID NO: 98529 - DNA, 25 bp, Homo sapien
gctaacgagggattactttggccaa

SEQ ID NO: 98530 - DNA, 25 bp, Homo sapien
ttgggtttgaatctgaatgctatac

SEQ ID NO: 98531 - DNA, 25 bp, Homo sapien
gaatgctatactggatactctgctc

SEQ ID NO: 98532 - DNA, 25 bp, Homo sapien
ggatactctgctccggaaagatgag

SEQ ID NO: 98533 - DNA, 25 bp, Homo sapien
aagatgagctttttattctactact

SEQ ID NO: 98534 - DNA, 25 bp, Homo sapien
ggaattcctctatgaagcctaactc

SEQ ID NO: 98535 - DNA, 25 bp, Homo sapien
gaagcctaactcttgaggtctctaa

SEQ ID NO: 98536 - DNA, 25 bp, Homo sapien
gaggtctctaacataccttgtcata

SEQ ID NO: 98537 - DNA, 25 bp, Homo sapien
agcacagattatacctggatgattc

SEQ ID NO: 98538 - DNA, 25 bp, Homo sapien
atatatctctagaacttaaagctga

SEQ ID NO: 98539 - DNA, 25 bp, Homo sapien
aagctgaaatctgcaaatctgtttg

SEQ ID NO: 98540 - DNA, 25 bp, Homo sapien
tctgcaaatctgtttgtgtgatgaa

SEQ ID NO: 98541 - DNA, 25 bp, Homo sapien
gaaactatcttttctctctgtgaaa

SEQ ID NO: 98542 - DNA, 25 bp, Homo sapien
atgtatcagacatattttcaggatg

SEQ ID NO: 98543 - DNA, 25 bp, Homo sapien
atattttcaggatggtgcgtcagga

SEQ ID NO: 98544 - DNA, 25 bp, Homo sapien
atggtgcgtcaggatatctggcagt

SEQ ID NO: 98545 - DNA, 25 bp, Homo sapien
atctggcagtggatttctaatgctt

SEQ ID NO: 98546 - DNA, 25 bp, Homo sapien
taatgcttttggctgtatgttatgt

SEQ ID NO: 98547 - DNA, 25 bp, Homo sapien
ttactgtaagcttaggagttttcct

SEQ ID NO: 98548 - DNA, 25 bp, Homo sapien
ggagttttcctactattaataaatg

SEQ ID NO: 98549 - DNA, 25 bp, Homo sapien
gagccagtggatttcctgaaacaca

SEQ ID NO: 98550 - DNA, 25 bp, Homo sapien
acacagatttgttaatgcgtttata

SEQ ID NO: 98551 - DNA, 25 bp, Homo sapien
tgatattagtaatgtgcagtgacca

SEQ ID NO: 98552 - DNA, 25 bp, Homo sapien
tgtgcagtgaccatcattgactttc

SEQ ID NO: 98553 - DNA, 25 bp, Homo sapien
gcagtgaccatcattgactttcatg

SEQ ID NO: 98554 - DNA, 25 bp, Homo sapien
gaccatcattgactttcatgataca

SEQ ID NO: 98555 - DNA, 25 bp, Homo sapien
aattcaatcctgtgtatttattcct

SEQ ID NO: 98556 - DNA, 25 bp, Homo sapien
tttattccttcttctgtaatgacca

SEQ ID NO: 98557 - DNA, 25 bp, Homo sapien
ccttcttctgtaatgaccaggaaat

SEQ ID NO: 98558 - DNA, 25 bp, Homo sapien
aatgttaatgacaccatttcttaag

SEQ ID NO: 98559 - DNA, 25 bp, Homo sapien
aataggcgatacaatcatatgattc

SEQ ID NO: 98560 - DNA, 25 bp, Homo sapien
gatgtatgttatgcagagacactct

SEQ ID NO: 98561 - DNA, 25 bp, Homo sapien
tctggtggctgcagagcaataccca

SEQ ID NO: 98562 - DNA, 25 bp, Homo sapien
gagcaatacccaagcctcatttgga

SEQ ID NO: 98563 - DNA, 25 bp, Homo sapien
cctcatttggaaggctcaacatttg

SEQ ID NO: 98564 - DNA, 25 bp, Homo sapien
tgattaatcctcaattcatgtggcc

SEQ ID NO: 98565 - DNA, 25 bp, Homo sapien
aattcatgtggccttacgggatggt

SEQ ID NO: 98566 - DNA, 25 bp, Homo sapien
tgggaccccaattcattcttatctg

SEQ ID NO: 98567 - DNA, 25 bp, Homo sapien
agaagcacatcaaataccagcaccc

SEQ ID NO: 98568 - DNA, 25 bp, Homo sapien
ggaaaacttttgtatccctaagcat

SEQ ID NO: 98569 - DNA, 25 bp, Homo sapien
tgtctgccatgccatgtggaaatac

SEQ ID NO: 98570 - DNA, 25 bp, Homo sapien
catgccatgtggaaatactttattt

SEQ ID NO: 98571 - DNA, 25 bp, Homo sapien
gtttgtgtggcgctcccgacttttg

SEQ ID NO: 98572 - DNA, 25 bp, Homo sapien
tggcgctcccgacttttgtgactga

SEQ ID NO: 98573 - DNA, 25 bp, Homo sapien
gctcccgacttttgtgactgactgg

SEQ ID NO: 98574 - DNA, 25 bp, Homo sapien
tcccgacttttgtgactgactggtg

SEQ ID NO: 98575 - DNA, 25 bp, Homo sapien
gacttttgtgactgactggtgtctt

SEQ ID NO: 98576 - DNA, 25 bp, Homo sapien
ctgactggtgtcttcccatttggac

SEQ ID NO: 98577 - DNA, 25 bp, Homo sapien
ccatttggactgtggcctggccaga

SEQ ID NO: 98578 - DNA, 25 bp, Homo sapien
agagccccttgcatatccccactgt

SEQ ID NO: 98579 - DNA, 25 bp, Homo sapien
tcagcaatggcctgccatgtgctgt

SEQ ID NO: 98580 - DNA, 25 bp, Homo sapien
aatggcctgccatgtgctgttgctg

SEQ ID NO: 98581 - DNA, 25 bp, Homo sapien
gttgctgggatgtttgtattaaaaa

SEQ ID NO: 98582 - DNA, 25 bp, Homo sapien
gttgatgttgatcaaagttccctga

SEQ ID NO: 98583 - DNA, 25 bp, Homo sapien
gttgatcaaagttccctgatataca

SEQ ID NO: 98584 - DNA, 25 bp, Homo sapien
agtcagaaatgtgcctgtatgctct

SEQ ID NO: 98585 - DNA, 25 bp, Homo sapien
cctgtatgctctgggaacctgttta

SEQ ID NO: 98586 - DNA, 25 bp, Homo sapien
gtatgctctgggaacctgtttatcc

SEQ ID NO: 98587 - DNA, 25 bp, Homo sapien
gctctgggaacctgtttatcccaga

SEQ ID NO: 98588 - DNA, 25 bp, Homo sapien
agaaagccctctttttcgcacctca

SEQ ID NO: 98589 - DNA, 25 bp, Homo sapien
tctttttcgcacctcatcaaacaga

SEQ ID NO: 98590 - DNA, 25 bp, Homo sapien
tcgcacctcatcaaacagaacaaat

SEQ ID NO: 98591 - DNA, 25 bp, Homo sapien
agttgcattctaatgtcatcaaaac

SEQ ID NO: 98592 - DNA, 25 bp, Homo sapien
aggtagaaccgtgagctttgttgat

SEQ ID NO: 98593 - DNA, 25 bp, Homo sapien
acctccatcctggacgctgcgggca

SEQ ID NO: 98594 - DNA, 25 bp, Homo sapien
cctagcggacgcgtggccctgagtt

SEQ ID NO: 98595 - DNA, 25 bp, Homo sapien
gtcctctcggccttctgtaatagtt

SEQ ID NO: 98596 - DNA, 25 bp, Homo sapien
cctctcggccttctgtaatagtttt

SEQ ID NO: 98597 - DNA, 25 bp, Homo sapien
atagttttgagatgtctgtccctcc

SEQ ID NO: 98598 - DNA, 25 bp, Homo sapien
agttttgagatgtctgtccctcctc

SEQ ID NO: 98599 - DNA, 25 bp, Homo sapien
ttttgagatgtctgtccctcctccc

SEQ ID NO: 98600 - DNA, 25 bp, Homo sapien
agagacccacccctctccaggttat

SEQ ID NO: 98601 - DNA, 25 bp, Homo sapien
caggttatcccagaaatgacccaac

SEQ ID NO: 98602 - DNA, 25 bp, Homo sapien
gttatcccagaaatgacccaactct

SEQ ID NO: 98603 - DNA, 25 bp, Homo sapien
ttatcccagaaatgacccaactctc

SEQ ID NO: 98604 - DNA, 25 bp, Homo sapien
gagtgaagaaccctttatgccagaa

SEQ ID NO: 98605 - DNA, 25 bp, Homo sapien
gagatgtctacctaggatggcttct

SEQ ID NO: 98606 - DNA, 25 bp, Homo sapien
gatggcttctccagttaatgtcaaa

SEQ ID NO: 98607 - DNA, 25 bp, Homo sapien
ggaacctccagggaccaatattgtg

SEQ ID NO: 98608 - DNA, 25 bp, Homo sapien
gatcttggaatatgcacaccgcctg

SEQ ID NO: 98609 - DNA, 25 bp, Homo sapien
gcctgtctcaggatatcttgtgtga

SEQ ID NO: 98610 - DNA, 25 bp, Homo sapien
atatcttgtgtgatgccttgcagca

SEQ ID NO: 98611 - DNA, 25 bp, Homo sapien
gcagcaatgggcatgcaataacatc

SEQ ID NO: 98612 - DNA, 25 bp, Homo sapien
gtaccatgacattccatacattgag

SEQ ID NO: 98613 - DNA, 25 bp, Homo sapien
ggccttgaggctgtaggatgacaac

SEQ ID NO: 98614 - DNA, 25 bp, Homo sapien
acactttgactgtggaggtgctagt

SEQ ID NO: 98615 - DNA, 25 bp, Homo sapien
agtctggaccttgcatggcttctgg

SEQ ID NO: 98616 - DNA, 25 bp, Homo sapien
gaatctgaaccaaactgacggcatt

SEQ ID NO: 98617 - DNA, 25 bp, Homo sapien
gacggcatttgaagcctttcagcca

SEQ ID NO: 98618 - DNA, 25 bp, Homo sapien
tttcagccagttgcttctgagccag

SEQ ID NO: 98619 - DNA, 25 bp, Homo sapien
ttctgagccagaccagctgtaagct

SEQ ID NO: 98620 - DNA, 25 bp, Homo sapien
gctgtaagctgaaacctcaatgaat

SEQ ID NO: 98621 - DNA, 25 bp, Homo sapien
aagaaaagactccaggccgactcat

SEQ ID NO: 98622 - DNA, 25 bp, Homo sapien
aggccgactcatgatactctgcatt

SEQ ID NO: 98623 - DNA, 25 bp, Homo sapien
gatactctgcatttttcctacatga

SEQ ID NO: 98624 - DNA, 25 bp, Homo sapien
gctggcagcctatgagattgtggac

SEQ ID NO: 98625 - DNA, 25 bp, Homo sapien
aacagaaatgccctcatgcttattt

SEQ ID NO: 98626 - DNA, 25 bp, Homo sapien
ggcttttattagagtcaccaacctt

SEQ ID NO: 98627 - DNA, 25 bp, Homo sapien
gagtcaccaaccttattctccaaaa

SEQ ID NO: 98628 - DNA, 25 bp, Homo sapien
aggactttgacttctcagcagcact

SEQ ID NO: 98629 - DNA, 25 bp, Homo sapien
agcactcagctctggttcttgaaac

SEQ ID NO: 98630 - DNA, 25 bp, Homo sapien
tattcctcctacctcataacaatct

SEQ ID NO: 98631 - DNA, 25 bp, Homo sapien
tctctgagttcttcccagggtccta

SEQ ID NO: 98632 - DNA, 25 bp, Homo sapien
gatgtagtgtagctcaaccctgcta

SEQ ID NO: 98633 - DNA, 25 bp, Homo sapien
aaccctgctacacaaagaatctcct

SEQ ID NO: 98634 - DNA, 25 bp, Homo sapien
aagaatctcctgaaagcctgtaaaa

SEQ ID NO: 98635 - DNA, 25 bp, Homo sapien
tgtccatgcatgttctgtgagtgat

SEQ ID NO: 98636 - DNA, 25 bp, Homo sapien
gcatgttctgtgagtgatctaccaa

SEQ ID NO: 98637 - DNA, 25 bp, Homo sapien
gctgctgcagattgctgatgatttt

SEQ ID NO: 98638 - DNA, 25 bp, Homo sapien
gattttatcgagagtgtggtgacag

SEQ ID NO: 98639 - DNA, 25 bp, Homo sapien
agcagcctgtcagcttgcgcggcat

SEQ ID NO: 98640 - DNA, 25 bp, Homo sapien
atcgcaagtctagcaccctggaggt

SEQ ID NO: 98641 - DNA, 25 bp, Homo sapien
ggaggtgaaagatgtccagctgcat

SEQ ID NO: 98642 - DNA, 25 bp, Homo sapien
gtccagctgcatttagagcgccagt

SEQ ID NO: 98643 - DNA, 25 bp, Homo sapien
gcgccagtggaacatgtggatccca

SEQ ID NO: 98644 - DNA, 25 bp, Homo sapien
atccgaccctacaaaaaagcttgca

SEQ ID NO: 98645 - DNA, 25 bp, Homo sapien
aagcttgcaccacagaagctcacaa

SEQ ID NO: 98646 - DNA, 25 bp, Homo sapien
agagaatggcattgatccggaaaac

SEQ ID NO: 98647 - DNA, 25 bp, Homo sapien
ataacacacggaaaggtcagggaat

SEQ ID NO: 98648 - DNA, 25 bp, Homo sapien
gattatactactacattttggctct

SEQ ID NO: 98649 - DNA, 25 bp, Homo sapien
actacattttggctctactttttct

SEQ ID NO: 98650 - DNA, 25 bp, Homo sapien
attttggctctactttttctatgtt

SEQ ID NO: 98651 - DNA, 25 bp, Homo sapien
ctatgttcagatagatgcacctatt

SEQ ID NO: 98652 - DNA, 25 bp, Homo sapien
gatagatgcacctattggtgtattt

SEQ ID NO: 98653 - DNA, 25 bp, Homo sapien
tatttttcagaatacatccccgttg

SEQ ID NO: 98654 - DNA, 25 bp, Homo sapien
ttcagaatacatccccgttgttaag

SEQ ID NO: 98655 - DNA, 25 bp, Homo sapien
tacatccccgttgttaagcaatgca

SEQ ID NO: 98656 - DNA, 25 bp, Homo sapien
gttaagcaatgcattactgtattat

SEQ ID NO: 98657 - DNA, 25 bp, Homo sapien
atatatggcacattgccgttacttt

SEQ ID NO: 98658 - DNA, 25 bp, Homo sapien
gcacattgccgttacttttaatggc

SEQ ID NO: 98659 - DNA, 25 bp, Homo sapien
aagtaggcactgttaccatctgcat

SEQ ID NO: 98660 - DNA, 25 bp, Homo sapien
atgagcaccctgaggtttagagaga

SEQ ID NO: 98661 - DNA, 25 bp, Homo sapien
ggtaaaaggtgatgccaggtcttga

SEQ ID NO: 98662 - DNA, 25 bp, Homo sapien
caggtcttgaagacaggtccacctt

SEQ ID NO: 98663 - DNA, 25 bp, Homo sapien
ggtccaccttcaaaatctattctct

SEQ ID NO: 98664 - DNA, 25 bp, Homo sapien
tctattctctttaccattatgctcg

SEQ ID NO: 98665 - DNA, 25 bp, Homo sapien
cattatgctcgatggtttgtttgtt

SEQ ID NO: 98666 - DNA, 25 bp, Homo sapien
gtatatgtattatcctctcaactag

SEQ ID NO: 98667 - DNA, 25 bp, Homo sapien
ggaggtgtgacttacaggtctttgt

SEQ ID NO: 98668 - DNA, 25 bp, Homo sapien
aggtctttgtatctcacacagtgcc

SEQ ID NO: 98669 - DNA, 25 bp, Homo sapien
atctcacacagtgccttgctaatag

SEQ ID NO: 98670 - DNA, 25 bp, Homo sapien
gaccgacctgggaaatttccactag

SEQ ID NO: 98671 - DNA, 25 bp, Homo sapien
atttccactagagttttgccctcag

SEQ ID NO: 98672 - DNA, 25 bp, Homo sapien
accaggtggcgcttctgacacggtc

SEQ ID NO: 98673 - DNA, 25 bp, Homo sapien
ggtccacgtgcctggctctgaaggc

SEQ ID NO: 98674 - DNA, 25 bp, Homo sapien
tgaaggcccaactgtcagaccagac

SEQ ID NO: 98675 - DNA, 25 bp, Homo sapien
agaccagacccctcactcatggtgg

SEQ ID NO: 98676 - DNA, 25 bp, Homo sapien
gggagacttgacttcctcgggctct

SEQ ID NO: 98677 - DNA, 25 bp, Homo sapien
ttcctcgggctcttcaggagactga

SEQ ID NO: 98678 - DNA, 25 bp, Homo sapien
gaagacaagtgaaagcgcagcctgt

SEQ ID NO: 98679 - DNA, 25 bp, Homo sapien
gaaagcgcagcctgtacatgactct

SEQ ID NO: 98680 - DNA, 25 bp, Homo sapien
gtacatgactctctgtggtccacgt

SEQ ID NO: 98681 - DNA, 25 bp, Homo sapien
aatactcctctgatgcatttagcct

SEQ ID NO: 98682 - DNA, 25 bp, Homo sapien
tcctctgatgcatttagccttcaac

SEQ ID NO: 98683 - DNA, 25 bp, Homo sapien
accctacctgtcttgctgaagggag

SEQ ID NO: 98684 - DNA, 25 bp, Homo sapien
gttttagtacattataggcccagca

SEQ ID NO: 98685 - DNA, 25 bp, Homo sapien
acattataggcccagcagcttttat

SEQ ID NO: 98686 - DNA, 25 bp, Homo sapien
agcagcttttattcatgtccaccag

SEQ ID NO: 98687 - DNA, 25 bp, Homo sapien
atgtccaccagctagttgcacagag

SEQ ID NO: 98688 - DNA, 25 bp, Homo sapien
accagctagttgcacagagaatcat

SEQ ID NO: 98689 - DNA, 25 bp, Homo sapien
gagaatcatgtgtacctaactaagg

SEQ ID NO: 98690 - DNA, 25 bp, Homo sapien
gatctaggataagtaactcctgttt

SEQ ID NO: 98691 - DNA, 25 bp, Homo sapien
agcctcatttctatttcttcttcat

SEQ ID NO: 98692 - DNA, 25 bp, Homo sapien
ggtactgcaatcacaatgccagatg

SEQ ID NO: 98693 - DNA, 25 bp, Homo sapien
atgccagatggtgtttatgggctat

SEQ ID NO: 98694 - DNA, 25 bp, Homo sapien
gggctatttgtgtaagtaagtggta

SEQ ID NO: 98695 - DNA, 25 bp, Homo sapien
gatgctatgaagtaagtgtgtttgt

SEQ ID NO: 98696 - DNA, 25 bp, Homo sapien
gtttgttttcatcttatggaaactc

SEQ ID NO: 98697 - DNA, 25 bp, Homo sapien
ggaaactcttgatgcatgtgctttt

SEQ ID NO: 98698 - DNA, 25 bp, Homo sapien
atatgatgtcattcaactttgcatt

SEQ ID NO: 98699 - DNA, 25 bp, Homo sapien
atgtattatacctgtcacgcttcta

SEQ ID NO: 98700 - DNA, 25 bp, Homo sapien
atacctgtcacgcttctagttgctt

SEQ ID NO: 98701 - DNA, 25 bp, Homo sapien
acgcttctagttgcttcaaccattt

SEQ ID NO: 98702 - DNA, 25 bp, Homo sapien
tcaaccattttataaccatttttgt

SEQ ID NO: 98703 - DNA, 25 bp, Homo sapien
tttaaagtgcactaaaatgaccttt

SEQ ID NO: 98704 - DNA, 25 bp, Homo sapien
gtaactatgcacatatcagctctat

SEQ ID NO: 98705 - DNA, 25 bp, Homo sapien
gcacatatcagctctattttcctac

SEQ ID NO: 98706 - DNA, 25 bp, Homo sapien
catatcagctctattttcctacatc

SEQ ID NO: 98707 - DNA, 25 bp, Homo sapien
atcagctctattttcctacatctac

SEQ ID NO: 98708 - DNA, 25 bp, Homo sapien
gctctattttcctacatctacttta

SEQ ID NO: 98709 - DNA, 25 bp, Homo sapien
tctattttcctacatctactttata

SEQ ID NO: 98710 - DNA, 25 bp, Homo sapien
aacactgttgtttaagcatgtttaa

SEQ ID NO: 98711 - DNA, 25 bp, Homo sapien
gcatgtttaaatcaaggtattccaa

SEQ ID NO: 98712 - DNA, 25 bp, Homo sapien
atcaaggtattccaaatctcttcta

SEQ ID NO: 98713 - DNA, 25 bp, Homo sapien
aaatctcttctaacacaagtaggaa

SEQ ID NO: 98714 - DNA, 25 bp, Homo sapien
atcctccccttgagagtcatcagaa

SEQ ID NO: 98715 - DNA, 25 bp, Homo sapien
tcctccccttgagagtcatcagaaa

SEQ ID NO: 98716 - DNA, 25 bp, Homo sapien
cctccccttgagagtcatcagaaaa

SEQ ID NO: 98717 - DNA, 25 bp, Homo sapien
ctccccttgagagtcatcagaaaaa

SEQ ID NO: 98718 - DNA, 25 bp, Homo sapien
tccccttgagagtcatcagaaaaat

SEQ ID NO: 98719 - DNA, 25 bp, Homo sapien
ccccttgagagtcatcagaaaaata

SEQ ID NO: 98720 - DNA, 25 bp, Homo sapien
gagagtcatcagaaaaatacattag

SEQ ID NO: 98721 - DNA, 25 bp, Homo sapien
gagtcatcagaaaaatacattagga

SEQ ID NO: 98722 - DNA, 25 bp, Homo sapien
aataaaagcacaaggcagggcagtg

SEQ ID NO: 98723 - DNA, 25 bp, Homo sapien
aaagcacaaggcagggcagtgctca

SEQ ID NO: 98724 - DNA, 25 bp, Homo sapien
aagcacaaggcagggcagtgctcac

SEQ ID NO: 98725 - DNA, 25 bp, Homo sapien
tgttgtgtggattttgtttagttgt

SEQ ID NO: 98726 - DNA, 25 bp, Homo sapien
atgtctggcacattgcaatcctcaa

SEQ ID NO: 98727 - DNA, 25 bp, Homo sapien
attgcaatcctcaaacatgtggtta

SEQ ID NO: 98728 - DNA, 25 bp, Homo sapien
gttgtattggcataatcagtgactt

SEQ ID NO: 98729 - DNA, 25 bp, Homo sapien
cagtgacttgtacattcagcaatag

SEQ ID NO: 98730 - DNA, 25 bp, Homo sapien
cattcagcaatagcatttgagcaag

SEQ ID NO: 98731 - DNA, 25 bp, Homo sapien
cagcaagcaatattttcagttaata

SEQ ID NO: 98732 - DNA, 25 bp, Homo sapien
tgtaaagattgaacctcaagtcact

SEQ ID NO: 98733 - DNA, 25 bp, Homo sapien
ctcaagtcactgtagctttagtaat

SEQ ID NO: 98734 - DNA, 25 bp, Homo sapien
tagtttagatgctagcactgcatgt

SEQ ID NO: 98735 - DNA, 25 bp, Homo sapien
atgctagcactgcatgtgctgtgca

SEQ ID NO: 98736 - DNA, 25 bp, Homo sapien
gggtttggctccactggtggcacac

SEQ ID NO: 98737 - DNA, 25 bp, Homo sapien
gcacacgtggcctccgtggtatgga

SEQ ID NO: 98738 - DNA, 25 bp, Homo sapien
tccgtggtatggacctggtggcttc

SEQ ID NO: 98739 - DNA, 25 bp, Homo sapien
actgtggcctctgtggtatggacct

SEQ ID NO: 98740 - DNA, 25 bp, Homo sapien
gtatggacctggtggcttctccatc

SEQ ID NO: 98741 - DNA, 25 bp, Homo sapien
ttctccatcctacccaaggtaacag

SEQ ID NO: 98742 - DNA, 25 bp, Homo sapien
aggtaacagtgtcttgcttcatccc

SEQ ID NO: 98743 - DNA, 25 bp, Homo sapien
atcccactgactgctgggagagagc

SEQ ID NO: 98744 - DNA, 25 bp, Homo sapien
gttttgtctttcgtagcagggaaag

SEQ ID NO: 98745 - DNA, 25 bp, Homo sapien
ggccaagccaaggacaggagcaagt

SEQ ID NO: 98746 - DNA, 25 bp, Homo sapien
caagtgtgccctcattttgtttcta

SEQ ID NO: 98747 - DNA, 25 bp, Homo sapien
tgaactgtattttgcattttgtcta

SEQ ID NO: 98748 - DNA, 25 bp, Homo sapien
tttgcattttgtctacttgtaagtg

SEQ ID NO: 98749 - DNA, 25 bp, Homo sapien
atactgtcaattttccttgtttgaa

SEQ ID NO: 98750 - DNA, 25 bp, Homo sapien
gaattgtaacactacacggtgtaca

SEQ ID NO: 98751 - DNA, 25 bp, Homo sapien
acggtgtacatttccagagccttgt

SEQ ID NO: 98752 - DNA, 25 bp, Homo sapien
atttccaatgaacttttttgcaagc

SEQ ID NO: 98753 - DNA, 25 bp, Homo sapien
ttgcaagcacacttgtaaccatatg

SEQ ID NO: 98754 - DNA, 25 bp, Homo sapien
aacctgtgtatgcttatgcctgggc

SEQ ID NO: 98755 - DNA, 25 bp, Homo sapien
tgcctgggcaactattttttgtaac

SEQ ID NO: 98756 - DNA, 25 bp, Homo sapien
gtaactcttgtgtagattgtctcta

SEQ ID NO: 98757 - DNA, 25 bp, Homo sapien
aacaatgtgtgatctttattttgaa

SEQ ID NO: 98758 - DNA, 25 bp, Homo sapien
atgcagctgcttctccaatggcttt

SEQ ID NO: 98759 - DNA, 25 bp, Homo sapien
aaagcagacccagcatacaaacaag

SEQ ID NO: 98760 - DNA, 25 bp, Homo sapien
aacaagagctgagccacctttgctg

SEQ ID NO: 98761 - DNA, 25 bp, Homo sapien
gctgtcttgtctcctgggacgagaa

SEQ ID NO: 98762 - DNA, 25 bp, Homo sapien
gaaggactcatccagcaaagttgcc

SEQ ID NO: 98763 - DNA, 25 bp, Homo sapien
gcaaagttgcctgggattcaaaata

SEQ ID NO: 98764 - DNA, 25 bp, Homo sapien
aaggcattgcagaccgcacaggtgt

SEQ ID NO: 98765 - DNA, 25 bp, Homo sapien
tgtgctgcagggactgatccacaga

SEQ ID NO: 98766 - DNA, 25 bp, Homo sapien
gaatgcagcatcaatcgcagacctg

SEQ ID NO: 98767 - DNA, 25 bp, Homo sapien
gccctgcctcagttggaaaaccttt

SEQ ID NO: 98768 - DNA, 25 bp, Homo sapien
ttttcaggccctcagtctaaaaaat

SEQ ID NO: 98769 - DNA, 25 bp, Homo sapien
gtggtcaacttctggaacactcgct

SEQ ID NO: 98770 - DNA, 25 bp, Homo sapien
gaacactcgctgtagctttattgtt

SEQ ID NO: 98771 - DNA, 25 bp, Homo sapien
gcatgtgtatggtgggcctctgtaa

SEQ ID NO: 98772 - DNA, 25 bp, Homo sapien
gtgggcctctgtaaccttgaaatgt

SEQ ID NO: 98773 - DNA, 25 bp, Homo sapien
atgtgaccaattgttgactaccaaa

SEQ ID NO: 98774 - DNA, 25 bp, Homo sapien
cgctccactgtggtccagaaaagga

SEQ ID NO: 98775 - DNA, 25 bp, Homo sapien
aaaggaggcctttcgatgtctgaga

SEQ ID NO: 98776 - DNA, 25 bp, Homo sapien
atgtctgagaaagaggccccacgct

SEQ ID NO: 98777 - DNA, 25 bp, Homo sapien
acgctgtagagtcccgaaagcccag

SEQ ID NO: 98778 - DNA, 25 bp, Homo sapien
gttcctggagtctctagggtgcttc

SEQ ID NO: 98779 - DNA, 25 bp, Homo sapien
agggtgcttcttccagagtctgtct

SEQ ID NO: 98780 - DNA, 25 bp, Homo sapien
gtgctgccacaaaggatgcctccac

SEQ ID NO: 98781 - DNA, 25 bp, Homo sapien
tgctgccacaaaggatgcctccaca

SEQ ID NO: 98782 - DNA, 25 bp, Homo sapien
gctgccacaaaggatgcctccacac

SEQ ID NO: 98783 - DNA, 25 bp, Homo sapien
ctgccacaaaggatgcctccacacc

SEQ ID NO: 98784 - DNA, 25 bp, Homo sapien
tgccacaaaggatgcctccacacct

SEQ ID NO: 98785 - DNA, 25 bp, Homo sapien
gccacaaaggatgcctccacaccta

SEQ ID NO: 98786 - DNA, 25 bp, Homo sapien
ccacaaaggatgcctccacacctac

SEQ ID NO: 98787 - DNA, 25 bp, Homo sapien
cacaaaggatgcctccacacctacc

SEQ ID NO: 98788 - DNA, 25 bp, Homo sapien
acacctaccactacccgtgtgccag

SEQ ID NO: 98789 - DNA, 25 bp, Homo sapien
tttttttggcgtgggaatgtcctgg

SEQ ID NO: 98790 - DNA, 25 bp, Homo sapien
tgggaatgtcctggagtgtgaacaa

SEQ ID NO: 98791 - DNA, 25 bp, Homo sapien
aaaagttccctatgacttgaagatg

SEQ ID NO: 98792 - DNA, 25 bp, Homo sapien
gttccctatgacttgaagatgttag

SEQ ID NO: 98793 - DNA, 25 bp, Homo sapien
aataatgtaacctagctcttaagca

SEQ ID NO: 98794 - DNA, 25 bp, Homo sapien
taatgtaacctagctcttaagcatt

SEQ ID NO: 98795 - DNA, 25 bp, Homo sapien
gcattaatactggagtttttgtcat

SEQ ID NO: 98796 - DNA, 25 bp, Homo sapien
gtttttgtcattgacatcagatgtc

SEQ ID NO: 98797 - DNA, 25 bp, Homo sapien
gacatcagatgtctttaatacaatg

SEQ ID NO: 98798 - DNA, 25 bp, Homo sapien
gagtggtaaatattttgtgggctac

SEQ ID NO: 98799 - DNA, 25 bp, Homo sapien
taaatattttgtgggctactgaagg

SEQ ID NO: 98800 - DNA, 25 bp, Homo sapien
agcgatgcaggtacgagcccgccca

SEQ ID NO: 98801 - DNA, 25 bp, Homo sapien
atgcaggtacgagcccgcccaggaa

SEQ ID NO: 98802 - DNA, 25 bp, Homo sapien
caggagggcattggagcccatccaa

SEQ ID NO: 98803 - DNA, 25 bp, Homo sapien
tggagcccatccaagcagtccaggg

SEQ ID NO: 98804 - DNA, 25 bp, Homo sapien
tctcttgccccagcaattcttttat

SEQ ID NO: 98805 - DNA, 25 bp, Homo sapien
aattcttttatccttctgtctgcct

SEQ ID NO: 98806 - DNA, 25 bp, Homo sapien
ttcttttatccttctgtctgcctag

SEQ ID NO: 98807 - DNA, 25 bp, Homo sapien
gtctgcctagacctctgctgggcaa

SEQ ID NO: 98808 - DNA, 25 bp, Homo sapien
cctagacctctgctgggcaatgcca

SEQ ID NO: 98809 - DNA, 25 bp, Homo sapien
tgaggcattccccaggcacctgctt

SEQ ID NO: 98810 - DNA, 25 bp, Homo sapien
acctgcttgaggagtgcccagagca

SEQ ID NO: 98811 - DNA, 25 bp, Homo sapien
gcacaagtgagaatttcagaccaca

SEQ ID NO: 98812 - DNA, 25 bp, Homo sapien
ttcagaccacaagggtttaaggagc

SEQ ID NO: 98813 - DNA, 25 bp, Homo sapien
agcagtgctctcttctctcaaagct

SEQ ID NO: 98814 - DNA, 25 bp, Homo sapien
tctctcaaagctcagaacggtctct

SEQ ID NO: 98815 - DNA, 25 bp, Homo sapien
agctcagaacggtctctggatccat

SEQ ID NO: 98816 - DNA, 25 bp, Homo sapien
gaacggtctctggatccatggtatc

SEQ ID NO: 98817 - DNA, 25 bp, Homo sapien
ggtctctggatccatggtatcgtac

SEQ ID NO: 98818 - DNA, 25 bp, Homo sapien
tggatccatggtatcgtacacccag

SEQ ID NO: 98819 - DNA, 25 bp, Homo sapien
gatccatggtatcgtacacccagtg

SEQ ID NO: 98820 - DNA, 25 bp, Homo sapien
cacccagtgtggatattaacattct

SEQ ID NO: 98821 - DNA, 25 bp, Homo sapien
gtggatattaacattctttaatgca

SEQ ID NO: 98822 - DNA, 25 bp, Homo sapien
catgaaatatgggaaagttgctgct

SEQ ID NO: 98823 - DNA, 25 bp, Homo sapien
aagttgctgctattgattcagggtc

SEQ ID NO: 98824 - DNA, 25 bp, Homo sapien
tgattcagggtctgtcttggaggca

SEQ ID NO: 98825 - DNA, 25 bp, Homo sapien
gtctgtcttggaggcagaggaccct

SEQ ID NO: 98826 - DNA, 25 bp, Homo sapien
aggacccttggtggatagttggtca

SEQ ID NO: 98827 - DNA, 25 bp, Homo sapien
aacctgtcccagtttatcaggaacg

SEQ ID NO: 98828 - DNA, 25 bp, Homo sapien
agtttatcaggaacgcaggcctggg

SEQ ID NO: 98829 - DNA, 25 bp, Homo sapien
gggccagatttcatgttgaccctgg

SEQ ID NO: 98830 - DNA, 25 bp, Homo sapien
gatgctgtgaatttctcctgcagga

SEQ ID NO: 98831 - DNA, 25 bp, Homo sapien
tcctgcaggagagacatcattgaat

SEQ ID NO: 98832 - DNA, 25 bp, Homo sapien
tttttcaactgtatcagtagcacag

SEQ ID NO: 98833 - DNA, 25 bp, Homo sapien
aacactgtgtttgcaaatggagatt

SEQ ID NO: 98834 - DNA, 25 bp, Homo sapien
acactgtgtttgcaaatggagattc

SEQ ID NO: 98835 - DNA, 25 bp, Homo sapien
gggtagttggcttggccttctcttt

SEQ ID NO: 98836 - DNA, 25 bp, Homo sapien
gttggcttggccttctctttggtga

SEQ ID NO: 98837 - DNA, 25 bp, Homo sapien
tggcttggccttctctttggtgatc

SEQ ID NO: 98838 - DNA, 25 bp, Homo sapien
cttggccttctctttggtgatccca

SEQ ID NO: 98839 - DNA, 25 bp, Homo sapien
tggccttctctttggtgatcccacc

SEQ ID NO: 98840 - DNA, 25 bp, Homo sapien
agccatttgcattgctggcccagcg

SEQ ID NO: 98841 - DNA, 25 bp, Homo sapien
gtggaggactcaggaactgcccggg

SEQ ID NO: 98842 - DNA, 25 bp, Homo sapien
ttgacttcccgggatgggtccttgc

SEQ ID NO: 98843 - DNA, 25 bp, Homo sapien
atgggtccttgcttctcagctgtgt

SEQ ID NO: 98844 - DNA, 25 bp, Homo sapien
ctgtggcagtcatggctagaactca

SEQ ID NO: 98845 - DNA, 25 bp, Homo sapien
tgcatcagaaagaaaccagttcagt

SEQ ID NO: 98846 - DNA, 25 bp, Homo sapien
aacaccattatctaacttcatgaac

SEQ ID NO: 98847 - DNA, 25 bp, Homo sapien
tgaatcaaatctttttgtttggcca

SEQ ID NO: 98848 - DNA, 25 bp, Homo sapien
gtaatacattccagtctacactttg

SEQ ID NO: 98849 - DNA, 25 bp, Homo sapien
attccagtctacactttgtttttgt

SEQ ID NO: 98850 - DNA, 25 bp, Homo sapien
tgtttttgtattgttgctcctgaac

SEQ ID NO: 98851 - DNA, 25 bp, Homo sapien
gctcctgaacaacctgtttcaaatt

SEQ ID NO: 98852 - DNA, 25 bp, Homo sapien
ttcaaattggttttaaggcgaccag

SEQ ID NO: 98853 - DNA, 25 bp, Homo sapien
taaggcgaccagttttcgttgtatt

SEQ ID NO: 98854 - DNA, 25 bp, Homo sapien
ccagttttcgttgtattgttgttca

SEQ ID NO: 98855 - DNA, 25 bp, Homo sapien
acaggctcttgaagatcaaaatgca

SEQ ID NO: 98856 - DNA, 25 bp, Homo sapien
caaaatgcaaagagagctattacct

SEQ ID NO: 98857 - DNA, 25 bp, Homo sapien
gggacttactcctaggagaaagaag

SEQ ID NO: 98858 - DNA, 25 bp, Homo sapien
gattgatcgcaatcccagagtgaaa

SEQ ID NO: 98859 - DNA, 25 bp, Homo sapien
atcgcaatcccagagtgaaacacag

SEQ ID NO: 98860 - DNA, 25 bp, Homo sapien
gaggccaggttcgtgaagttcgtaa

SEQ ID NO: 98861 - DNA, 25 bp, Homo sapien
agttcgtaaagaagagcaacgttat

SEQ ID NO: 98862 - DNA, 25 bp, Homo sapien
gcaacgttatagtggtgaattatct

SEQ ID NO: 98863 - DNA, 25 bp, Homo sapien
gaattatctggcattcgtgcaggag

SEQ ID NO: 98864 - DNA, 25 bp, Homo sapien
atctggcattcgtgcaggagttaaa

SEQ ID NO: 98865 - DNA, 25 bp, Homo sapien
gcttaaatgaagtttttgcttagca

SEQ ID NO: 98866 - DNA, 25 bp, Homo sapien
tcacttgagacaaatctatgccact

SEQ ID NO: 98867 - DNA, 25 bp, Homo sapien
acttgagacaaatctatgccactca

SEQ ID NO: 98868 - DNA, 25 bp, Homo sapien
ttgagacaaatctatgccactcaga

SEQ ID NO: 98869 - DNA, 25 bp, Homo sapien
gagacaaatctatgccactcagaat

SEQ ID NO: 98870 - DNA, 25 bp, Homo sapien
agacaaatctatgccactcagaatc

SEQ ID NO: 98871 - DNA, 25 bp, Homo sapien
caaatctatgccactcagaatctcc

SEQ ID NO: 98872 - DNA, 25 bp, Homo sapien
aatctatgccactcagaatctcctt

SEQ ID NO: 98873 - DNA, 25 bp, Homo sapien
atctatgccactcagaatctccttc

SEQ ID NO: 98874 - DNA, 25 bp, Homo sapien
tctatgccactcagaatctccttct

SEQ ID NO: 98875 - DNA, 25 bp, Homo sapien
tatgccactcagaatctccttcttt

SEQ ID NO: 98876 - DNA, 25 bp, Homo sapien
atgccactcagaatctccttctttc

SEQ ID NO: 98877 - DNA, 25 bp, Homo sapien
gacactcaaaaacacaaaggccgga

SEQ ID NO: 98878 - DNA, 25 bp, Homo sapien
gagatgccaatttcgaacctcggtc

SEQ ID NO: 98879 - DNA, 25 bp, Homo sapien
aacctcggtcgcaggagttgcatca

SEQ ID NO: 98880 - DNA, 25 bp, Homo sapien
gcatcagtgtggcaaatagtttcca

SEQ ID NO: 98881 - DNA, 25 bp, Homo sapien
aatagtttccaaagccagtctgatg

SEQ ID NO: 98882 - DNA, 25 bp, Homo sapien
aatgggatccccacattgttgagtg

SEQ ID NO: 98883 - DNA, 25 bp, Homo sapien
gagtggcactgaacaagcagaccaa

SEQ ID NO: 98884 - DNA, 25 bp, Homo sapien
tggtgacttagaattaactcgtgct

SEQ ID NO: 98885 - DNA, 25 bp, Homo sapien
cccctttcttattgcaagacggctt

SEQ ID NO: 98886 - DNA, 25 bp, Homo sapien
aagacggcttctcgcacatgaactg

SEQ ID NO: 98887 - DNA, 25 bp, Homo sapien
gcatccttctcattctgtcggaaat

SEQ ID NO: 98888 - DNA, 25 bp, Homo sapien
ggactgccagaaaccaaatcacatg

SEQ ID NO: 98889 - DNA, 25 bp, Homo sapien
ggagaagggctgtcacttcctgcac

SEQ ID NO: 98890 - DNA, 25 bp, Homo sapien
tcacttcctgcacatcttggcctgt

SEQ ID NO: 98891 - DNA, 25 bp, Homo sapien
atcttggcctgtgctcgcctgagca

SEQ ID NO: 98892 - DNA, 25 bp, Homo sapien
ggaggaccagagtgacattgtcagc

SEQ ID NO: 98893 - DNA, 25 bp, Homo sapien
ttgtcagcacaatggagcactacta

SEQ ID NO: 98894 - DNA, 25 bp, Homo sapien
gagcactactacacagcgttctgag

SEQ ID NO: 98895 - DNA, 25 bp, Homo sapien
agcgttctgagcagagacacgcaga

SEQ ID NO: 98896 - DNA, 25 bp, Homo sapien
acacgcagaccagctgaggaggaca

SEQ ID NO: 98897 - DNA, 25 bp, Homo sapien
aggacaaagataaggtggcattcac

SEQ ID NO: 98898 - DNA, 25 bp, Homo sapien
gctctgactttcagcatcatgcagg

SEQ ID NO: 98899 - DNA, 25 bp, Homo sapien
gcgcctggcttatactttcttaata

SEQ ID NO: 98900 - DNA, 25 bp, Homo sapien
gtgatggtccagagcaacagttctt

SEQ ID NO: 98901 - DNA, 25 bp, Homo sapien
gcaacagttcttcaagtgtactctg

SEQ ID NO: 98902 - DNA, 25 bp, Homo sapien
aagtgtactctgtaggcttctggga

SEQ ID NO: 98903 - DNA, 25 bp, Homo sapien
tctgtaggcttctgggaggtccctt

SEQ ID NO: 98904 - DNA, 25 bp, Homo sapien
gtgtccacaaagtcaaagctatttt

SEQ ID NO: 98905 - DNA, 25 bp, Homo sapien
ttgccttttgaattctcattatctt

SEQ ID NO: 98906 - DNA, 25 bp, Homo sapien
aaaattgtattgtggagttttccag

SEQ ID NO: 98907 - DNA, 25 bp, Homo sapien
gagttttccagaggccgtgtgacat

SEQ ID NO: 98908 - DNA, 25 bp, Homo sapien
gaggccgtgtgacatgtgattacat

SEQ ID NO: 98909 - DNA, 25 bp, Homo sapien
gtgacatgtgattacatcatctttc

SEQ ID NO: 98910 - DNA, 25 bp, Homo sapien
acgcgcaccgccgtgtgacagtggc

SEQ ID NO: 98911 - DNA, 25 bp, Homo sapien
ccgtgtgacagtggccgggctccct

SEQ ID NO: 98912 - DNA, 25 bp, Homo sapien
cgcccttccagctgaggacaggctg

SEQ ID NO: 98913 - DNA, 25 bp, Homo sapien
agctgaggacaggctggcgcctcca

SEQ ID NO: 98914 - DNA, 25 bp, Homo sapien
gggcgacagcgcatgcaggaacggg

SEQ ID NO: 98915 - DNA, 25 bp, Homo sapien
tgctgtgtgtggtctcagaggctct

SEQ ID NO: 98916 - DNA, 25 bp, Homo sapien
ctgtgtgtggtctcagaggctctgc

SEQ ID NO: 98917 - DNA, 25 bp, Homo sapien
gtgtgtggtctcagaggctctgctt

SEQ ID NO: 98918 - DNA, 25 bp, Homo sapien
gaggctctgcttccttaggttacaa

SEQ ID NO: 98919 - DNA, 25 bp, Homo sapien
ggctctgcttccttaggttacaaaa

SEQ ID NO: 98920 - DNA, 25 bp, Homo sapien
tctgcttccttaggttacaaaacaa

SEQ ID NO: 98921 - DNA, 25 bp, Homo sapien
gctgacttcctaggcgccattgggt

SEQ ID NO: 98922 - DNA, 25 bp, Homo sapien
cattgggtctggaaccgggatcctg

SEQ ID NO: 98923 - DNA, 25 bp, Homo sapien
ggaaccgggatcctgctcgcagtca

SEQ ID NO: 98924 - DNA, 25 bp, Homo sapien
tcgcagtcacaatcatctaccagta

SEQ ID NO: 98925 - DNA, 25 bp, Homo sapien
ctaccagtactttgagatcttcgtt

SEQ ID NO: 98926 - DNA, 25 bp, Homo sapien
gagatcttcgttaaggagcaaagcg

SEQ ID NO: 98927 - DNA, 25 bp, Homo sapien
gtctcccggacaggttgaggaagct

SEQ ID NO: 98928 - DNA, 25 bp, Homo sapien
tgaggaagctgctccagaagcgcct

SEQ ID NO: 98929 - DNA, 25 bp, Homo sapien
ggagctctcatcatggcgcgtgctg

SEQ ID NO: 98930 - DNA, 25 bp, Homo sapien
gctgctgcggcatatggacttttaa

SEQ ID NO: 98931 - DNA, 25 bp, Homo sapien
tttcgtattctttcattccactgtg

SEQ ID NO: 98932 - DNA, 25 bp, Homo sapien
tgccgtcgacactcgtctcagaagc

SEQ ID NO: 98933 - DNA, 25 bp, Homo sapien
aagcccctttcccagaagaggctgg

SEQ ID NO: 98934 - DNA, 25 bp, Homo sapien
gaggctggtcttcaagaagtctcgt

SEQ ID NO: 98935 - DNA, 25 bp, Homo sapien
tcaagaagtctcgtttctttgcccc

SEQ ID NO: 98936 - DNA, 25 bp, Homo sapien
ttctttgcccctgaagtcagtttca

SEQ ID NO: 98937 - DNA, 25 bp, Homo sapien
ggatgtgaaatttttccgtgtagag

SEQ ID NO: 98938 - DNA, 25 bp, Homo sapien
ttccgtgtagaggttacagcctttt

SEQ ID NO: 98939 - DNA, 25 bp, Homo sapien
agccttttatgctgttgagctccca

SEQ ID NO: 98940 - DNA, 25 bp, Homo sapien
ctgttgagctcccaggtaccaaaaa

SEQ ID NO: 98941 - DNA, 25 bp, Homo sapien
aaaaagcttggccaacgcttgccag

SEQ ID NO: 98942 - DNA, 25 bp, Homo sapien
agctgcaggtggcatctgccacgaa

SEQ ID NO: 98943 - DNA, 25 bp, Homo sapien
tcaggcctggagtcggcccccaaaa

SEQ ID NO: 98944 - DNA, 25 bp, Homo sapien
tcggcccccaaaagtttcacatagg

SEQ ID NO: 98945 - DNA, 25 bp, Homo sapien
ctttccctggtcctgaactgtggaa

SEQ ID NO: 98946 - DNA, 25 bp, Homo sapien
ggaaatgccattaaactctctctat

SEQ ID NO: 98947 - DNA, 25 bp, Homo sapien
taaactctctctataatgtaactga

SEQ ID NO: 98948 - DNA, 25 bp, Homo sapien
atgtaactgaaactgctggctgggc

SEQ ID NO: 98949 - DNA, 25 bp, Homo sapien
taactgaaactgctggctgggcgca

SEQ ID NO: 98950 - DNA, 25 bp, Homo sapien
gggacatgactgatcccctcagagc

SEQ ID NO: 98951 - DNA, 25 bp, Homo sapien
gacatgactgatcccctcagagcag

SEQ ID NO: 98952 - DNA, 25 bp, Homo sapien
atgactgatcccctcagagcaggct

SEQ ID NO: 98953 - DNA, 25 bp, Homo sapien
tgactgatcccctcagagcaggctc

SEQ ID NO: 98954 - DNA, 25 bp, Homo sapien
ggtgtaaagggcctgctctcttttt

SEQ ID NO: 98955 - DNA, 25 bp, Homo sapien
tgctctcttttttgagtgccccact

SEQ ID NO: 98956 - DNA, 25 bp, Homo sapien
ttttgagtgccccactcattggtgc

SEQ ID NO: 98957 - DNA, 25 bp, Homo sapien
ccactcattggtgccctgtctgatg

SEQ ID NO: 98958 - DNA, 25 bp, Homo sapien
ctcattggtgccctgtctgatgtgt

SEQ ID NO: 98959 - DNA, 25 bp, Homo sapien
cattggtgccctgtctgatgtgtgg

SEQ ID NO: 98960 - DNA, 25 bp, Homo sapien
tttctcctcggcactgtattcttta

SEQ ID NO: 98961 - DNA, 25 bp, Homo sapien
tcggcactgtattctttacctgctt

SEQ ID NO: 98962 - DNA, 25 bp, Homo sapien
gcttcccaatcccactgatgaggat

SEQ ID NO: 98963 - DNA, 25 bp, Homo sapien
ctgatgaggatcagcccatgccggg

SEQ ID NO: 98964 - DNA, 25 bp, Homo sapien
gtcccagctacctgtggcaggagaa

SEQ ID NO: 98965 - DNA, 25 bp, Homo sapien
aacagtggcatctcataaaccatca

SEQ ID NO: 98966 - DNA, 25 bp, Homo sapien
tcataaaccatcagccctctaggag

SEQ ID NO: 98967 - DNA, 25 bp, Homo sapien
tctaggagtcccagcagttggctta

SEQ ID NO: 98968 - DNA, 25 bp, Homo sapien
cccagcagttggcttaagagactaa

SEQ ID NO: 98969 - DNA, 25 bp, Homo sapien
agagactaatttcaagcccttggga

SEQ ID NO: 98970 - DNA, 25 bp, Homo sapien
caagcccttgggagttggaagtcct

SEQ ID NO: 98971 - DNA, 25 bp, Homo sapien
gagttggaagtcctgcaggtcccct

SEQ ID NO: 98972 - DNA, 25 bp, Homo sapien
gaagtcctgcaggtccccttgtggg

SEQ ID NO: 98973 - DNA, 25 bp, Homo sapien
agcagttgctgagacgaagatgagt

SEQ ID NO: 98974 - DNA, 25 bp, Homo sapien
cgaagatgagtggacctgtgtgtca

SEQ ID NO: 98975 - DNA, 25 bp, Homo sapien
ggacctgtgtgtcagcctaaccctt

SEQ ID NO: 98976 - DNA, 25 bp, Homo sapien
atgagtccaggccaagcaaatgaga

SEQ ID NO: 98977 - DNA, 25 bp, Homo sapien
ggccatgcctttcactttgtagggt

SEQ ID NO: 98978 - DNA, 25 bp, Homo sapien
gattactgagagtcaggctagacct

SEQ ID NO: 98979 - DNA, 25 bp, Homo sapien
aggctagacctgtgtttagaggagc

SEQ ID NO: 98980 - DNA, 25 bp, Homo sapien
ttagaggagcagttttcacagtgac

SEQ ID NO: 98981 - DNA, 25 bp, Homo sapien
acagtgactaccatttccacccaat

SEQ ID NO: 98982 - DNA, 25 bp, Homo sapien
atttccacccaatgagaggctccta

SEQ ID NO: 98983 - DNA, 25 bp, Homo sapien
atgagaggctcctatttcccatcat

SEQ ID NO: 98984 - DNA, 25 bp, Homo sapien
cctagggaggcctccatctggaaat

SEQ ID NO: 98985 - DNA, 25 bp, Homo sapien
gaagaggctagaatcatctttccta

SEQ ID NO: 98986 - DNA, 25 bp, Homo sapien
atctttcctagtgatcctgacattt

SEQ ID NO: 98987 - DNA, 25 bp, Homo sapien
gatggtatatctgtcaagaatgtaa

SEQ ID NO: 98988 - DNA, 25 bp, Homo sapien
aagttttctttcaagtactgcaatc

SEQ ID NO: 98989 - DNA, 25 bp, Homo sapien
gtactgcaatcaacttaattgcgat

SEQ ID NO: 98990 - DNA, 25 bp, Homo sapien
ctgtctgtaatctggagtaataaga

SEQ ID NO: 98991 - DNA, 25 bp, Homo sapien
aataagataagtcatgtttccttcc

SEQ ID NO: 98992 - DNA, 25 bp, Homo sapien
agataagtcatgtttccttcctccc

SEQ ID NO: 98993 - DNA, 25 bp, Homo sapien
caatttcctaaatctcttaccttat

SEQ ID NO: 98994 - DNA, 25 bp, Homo sapien
aatctcttaccttatctatccatag

SEQ ID NO: 98995 - DNA, 25 bp, Homo sapien
tgagcctgaatgctactgtatttta

SEQ ID NO: 98996 - DNA, 25 bp, Homo sapien
gagcctgaatgctactgtattttac

SEQ ID NO: 98997 - DNA, 25 bp, Homo sapien
aactatttgtattcttgccatttta

SEQ ID NO: 98998 - DNA, 25 bp, Homo sapien
aaactatttgcgactcacccacaat

SEQ ID NO: 98999 - DNA, 25 bp, Homo sapien
aaatcctgcagatgcctcctgatgg

SEQ ID NO: 99000 - DNA, 25 bp, Homo sapien
tgcagatgcctcctgatgggacata

SEQ ID NO: 99001 - DNA, 25 bp, Homo sapien
gatgcctcctgatgggacatagccc

SEQ ID NO: 99002 - DNA, 25 bp, Homo sapien
tcctgatgggacatagccctaactc

SEQ ID NO: 99003 - DNA, 25 bp, Homo sapien
tagccctaactccttaacaactgta

SEQ ID NO: 99004 - DNA, 25 bp, Homo sapien
taactccttaacaactgtagcaaga

SEQ ID NO: 99005 - DNA, 25 bp, Homo sapien
aactgtagcaagaactgcacggtac

SEQ ID NO: 99006 - DNA, 25 bp, Homo sapien
agcaagaactgcacggtacaaaccc

SEQ ID NO: 99007 - DNA, 25 bp, Homo sapien
aaattgtgcccttgtaccgatgcag

SEQ ID NO: 99008 - DNA, 25 bp, Homo sapien
tgtgcccttgtaccgatgcagctct

SEQ ID NO: 99009 - DNA, 25 bp, Homo sapien
ctcagtgaagatatgcgtgcacgca

SEQ ID NO: 99010 - DNA, 25 bp, Homo sapien
cagtgaagatatgcgtgcacgcaca

SEQ ID NO: 99011 - DNA, 25 bp, Homo sapien
gaagatatgcgtgcacgcacagaca

SEQ ID NO: 99012 - DNA, 25 bp, Homo sapien
agatatgcgtgcacgcacagacaga

SEQ ID NO: 99013 - DNA, 25 bp, Homo sapien
tatgcgtgcacgcacagacagacag

SEQ ID NO: 99014 - DNA, 25 bp, Homo sapien
gcgtgcacgcacagacagacagaca

SEQ ID NO: 99015 - DNA, 25 bp, Homo sapien
aaaatgatgtcccaaaagtattata

SEQ ID NO: 99016 - DNA, 25 bp, Homo sapien
tgatgtcccaaaagtattataatag

SEQ ID NO: 99017 - DNA, 25 bp, Homo sapien
agaagtgataaagtctccagatgca

SEQ ID NO: 99018 - DNA, 25 bp, Homo sapien
aagtgataaagtctccagatgcagt

SEQ ID NO: 99019 - DNA, 25 bp, Homo sapien
gctcacactgtaatcacagtgactc

SEQ ID NO: 99020 - DNA, 25 bp, Homo sapien
tgcacactttgctccttacatctag

SEQ ID NO: 99021 - DNA, 25 bp, Homo sapien
taggcccagctgaacccaggttagg

SEQ ID NO: 99022 - DNA, 25 bp, Homo sapien
gatcagaagggctgcgtgtagcacc

SEQ ID NO: 99023 - DNA, 25 bp, Homo sapien
gtagcacccttatggtcttgcagaa

SEQ ID NO: 99024 - DNA, 25 bp, Homo sapien
caagaaacccgacggcttccatatt

SEQ ID NO: 99025 - DNA, 25 bp, Homo sapien
gcttccatattttctgaccctacaa

SEQ ID NO: 99026 - DNA, 25 bp, Homo sapien
aacaggtccctaatactgatgtgga

SEQ ID NO: 99027 - DNA, 25 bp, Homo sapien
gaatcatctggcctgagcctaccat

SEQ ID NO: 99028 - DNA, 25 bp, Homo sapien
gcctgagcctaccatgaggctgttt

SEQ ID NO: 99029 - DNA, 25 bp, Homo sapien
ggcagaaaagcaacaactcgctccc

SEQ ID NO: 99030 - DNA, 25 bp, Homo sapien
tccccttcccatgtatcagtgaaaa

SEQ ID NO: 99031 - DNA, 25 bp, Homo sapien
gtgagtaaccatacagcttccacca

SEQ ID NO: 99032 - DNA, 25 bp, Homo sapien
acagcttccaccatgacacctgaat

SEQ ID NO: 99033 - DNA, 25 bp, Homo sapien
aaaccaaactgaatgtgacctgaaa

SEQ ID NO: 99034 - DNA, 25 bp, Homo sapien
gaacatatctgcaatacccaagcca

SEQ ID NO: 99035 - DNA, 25 bp, Homo sapien
agttctgctctatcttactgctatg

SEQ ID NO: 99036 - DNA, 25 bp, Homo sapien
ttcacttcttcaaagcaggacctat

SEQ ID NO: 99037 - DNA, 25 bp, Homo sapien
gcaggacctatttggagcattacga

SEQ ID NO: 99038 - DNA, 25 bp, Homo sapien
gagcattacgatccacgattattga

SEQ ID NO: 99039 - DNA, 25 bp, Homo sapien
ttccgaagacggctttcaagacaag

SEQ ID NO: 99040 - DNA, 25 bp, Homo sapien
atttgcatgacagcatccaactcca

SEQ ID NO: 99041 - DNA, 25 bp, Homo sapien
tccaactccatgcaaaatcctttgt

SEQ ID NO: 99042 - DNA, 25 bp, Homo sapien
ggtgaaagctcagcataccatgtat

SEQ ID NO: 99043 - DNA, 25 bp, Homo sapien
aatgatgtgtccacacacgtacccg

SEQ ID NO: 99044 - DNA, 25 bp, Homo sapien
gtgtctcttctgcatttctgtgtca

SEQ ID NO: 99045 - DNA, 25 bp, Homo sapien
catttctgtgtcatggttctgtttc

SEQ ID NO: 99046 - DNA, 25 bp, Homo sapien
ttctgtttcttaatcacgtgcggcg

SEQ ID NO: 99047 - DNA, 25 bp, Homo sapien
cggcggtgtctaagtggtgttacca

SEQ ID NO: 99048 - DNA, 25 bp, Homo sapien
ggtgttaccagtgtacgcgcagtga

SEQ ID NO: 99049 - DNA, 25 bp, Homo sapien
cagtgtacgcgcagtgaccttggat

SEQ ID NO: 99050 - DNA, 25 bp, Homo sapien
gtgaccttggatgacagtggctctt

SEQ ID NO: 99051 - DNA, 25 bp, Homo sapien
gatgacagtggctctttctcacagc

SEQ ID NO: 99052 - DNA, 25 bp, Homo sapien
gaaacagctttctctgtacatatgc

SEQ ID NO: 99053 - DNA, 25 bp, Homo sapien
ttctcttaataagcccacatataaa

SEQ ID NO: 99054 - DNA, 25 bp, Homo sapien
tttcttccagaaaaattctccttga

SEQ ID NO: 99055 - DNA, 25 bp, Homo sapien
tccagaaaaattctccttgaggaaa

SEQ ID NO: 99056 - DNA, 25 bp, Homo sapien
gaatcacttaataccgtatcttcta

SEQ ID NO: 99057 - DNA, 25 bp, Homo sapien
cttaataccgtatcttctaaatttg

SEQ ID NO: 99058 - DNA, 25 bp, Homo sapien
ataccgtatcttctaaatttgaaat

SEQ ID NO: 99059 - DNA, 25 bp, Homo sapien
ttttctttgaatttagcaacctaga

SEQ ID NO: 99060 - DNA, 25 bp, Homo sapien
acacatttctttgaatttaggtgat

SEQ ID NO: 99061 - DNA, 25 bp, Homo sapien
aggtgatacctaaatccttcttatg

SEQ ID NO: 99062 - DNA, 25 bp, Homo sapien
gtgatacctaaatccttcttatgtt

SEQ ID NO: 99063 - DNA, 25 bp, Homo sapien
ccttcttatgtttctaaattttgtg

SEQ ID NO: 99064 - DNA, 25 bp, Homo sapien
gtgccagagataaatggcccagaat

SEQ ID NO: 99065 - DNA, 25 bp, Homo sapien
ataaatggcccagaatatgttgatt

SEQ ID NO: 99066 - DNA, 25 bp, Homo sapien
aatggcccagaatatgttgattctt

SEQ ID NO: 99067 - DNA, 25 bp, Homo sapien
aagtagagggcttaaatgcatgttt

SEQ ID NO: 99068 - DNA, 25 bp, Homo sapien
aaatgcatgtttggttttgccgatg

SEQ ID NO: 99069 - DNA, 25 bp, Homo sapien
atgcatgtttggttttgccgatgct

SEQ ID NO: 99070 - DNA, 25 bp, Homo sapien
gaaaattgctaaaaattgctgtcca

SEQ ID NO: 99071 - DNA, 25 bp, Homo sapien
attgctaaaaattgctgtccaatag

SEQ ID NO: 99072 - DNA, 25 bp, Homo sapien
tgctaaaaattgctgtccaatagaa

SEQ ID NO: 99073 - DNA, 25 bp, Homo sapien
agaaatttatgagcccatatgtaat

SEQ ID NO: 99074 - DNA, 25 bp, Homo sapien
gagcccatatgtaatataaactttt

SEQ ID NO: 99075 - DNA, 25 bp, Homo sapien
agcatactcagcgtggccgttcggg

SEQ ID NO: 99076 - DNA, 25 bp, Homo sapien
aggcggaaaaagatgagcgcgctct

SEQ ID NO: 99077 - DNA, 25 bp, Homo sapien
atgagcgcgctctgaagcaggagat

SEQ ID NO: 99078 - DNA, 25 bp, Homo sapien
gcgctctgaagcaggagattcacga

SEQ ID NO: 99079 - DNA, 25 bp, Homo sapien
agattcacgagctgcgagggcgcct

SEQ ID NO: 99080 - DNA, 25 bp, Homo sapien
gcccgtgccgcctgaagagctgcag

SEQ ID NO: 99081 - DNA, 25 bp, Homo sapien
gggtgaccggatcgaatctctcagc

SEQ ID NO: 99082 - DNA, 25 bp, Homo sapien
gatcgaatctctcagcgaccaggtg

SEQ ID NO: 99083 - DNA, 25 bp, Homo sapien
aggctaggtgcctgctcctgtgagg

SEQ ID NO: 99084 - DNA, 25 bp, Homo sapien
tgtgaggacaacagcctgggcctcg

SEQ ID NO: 99085 - DNA, 25 bp, Homo sapien
gggcctcggcgtcaatcatcgataa

SEQ ID NO: 99086 - DNA, 25 bp, Homo sapien
tttcctccagtcagaaagatggcaa

SEQ ID NO: 99087 - DNA, 25 bp, Homo sapien
accaaatcacttgctccaggtgttg

SEQ ID NO: 99088 - DNA, 25 bp, Homo sapien
caggtgttgactcctcttcaaaatc

SEQ ID NO: 99089 - DNA, 25 bp, Homo sapien
gttaaatctccaaagcctcaaatag

SEQ ID NO: 99090 - DNA, 25 bp, Homo sapien
gcctcaaataggttttcttcctaga

SEQ ID NO: 99091 - DNA, 25 bp, Homo sapien
gcaggattggtctgtaaggcactca

SEQ ID NO: 99092 - DNA, 25 bp, Homo sapien
taaggcactcagtcttctacatcat

SEQ ID NO: 99093 - DNA, 25 bp, Homo sapien
tcttctacatcatgggtcagcagat

SEQ ID NO: 99094 - DNA, 25 bp, Homo sapien
ggtcagcagattacagcccttgggt

SEQ ID NO: 99095 - DNA, 25 bp, Homo sapien
acagcccttgggttaaatccagcca

SEQ ID NO: 99096 - DNA, 25 bp, Homo sapien
tgggttaaatccagccacctgcttg

SEQ ID NO: 99097 - DNA, 25 bp, Homo sapien
tgaaaggaccttttgtcacagcact

SEQ ID NO: 99098 - DNA, 25 bp, Homo sapien
gagacatttttgtaggatgcctgac

SEQ ID NO: 99099 - DNA, 25 bp, Homo sapien
gatgcctgacgaggtgtagcctttt

SEQ ID NO: 99100 - DNA, 25 bp, Homo sapien
gaggtgtagccttttatcttgtttc

SEQ ID NO: 99101 - DNA, 25 bp, Homo sapien
gtagccttttatcttgtttccggat

SEQ ID NO: 99102 - DNA, 25 bp, Homo sapien
gccttttatcttgtttccggatgca

SEQ ID NO: 99103 - DNA, 25 bp, Homo sapien
tttatcttgtttccggatgcatatt

SEQ ID NO: 99104 - DNA, 25 bp, Homo sapien
gtttccggatgcatatttattacga

SEQ ID NO: 99105 - DNA, 25 bp, Homo sapien
gcatatttattacgagtactctggt

SEQ ID NO: 99106 - DNA, 25 bp, Homo sapien
ttacgagtactctggttaaatattg

SEQ ID NO: 99107 - DNA, 25 bp, Homo sapien
atgctgtagtttttagtattttgtc

SEQ ID NO: 99108 - DNA, 25 bp, Homo sapien
gttttgttgtagatgctaacgtgtc

SEQ ID NO: 99109 - DNA, 25 bp, Homo sapien
gatgctaacgtgtcagaatccttta

SEQ ID NO: 99110 - DNA, 25 bp, Homo sapien
gctaacgtgtcagaatcctttacat

SEQ ID NO: 99111 - DNA, 25 bp, Homo sapien
gtcagaatcctttacattcaacttt

SEQ ID NO: 99112 - DNA, 25 bp, Homo sapien
agcattttcagtcttgtagtgtgtg

SEQ ID NO: 99113 - DNA, 25 bp, Homo sapien
tttcagtcttgtagtgtgtgcttac

SEQ ID NO: 99114 - DNA, 25 bp, Homo sapien
gtagtgtgtgcttacagtaactaat

SEQ ID NO: 99115 - DNA, 25 bp, Homo sapien
gtgcttacagtaactaattttgttg

SEQ ID NO: 99116 - DNA, 25 bp, Homo sapien
gaaaatggtttcaagttattcaaat

SEQ ID NO: 99117 - DNA, 25 bp, Homo sapien
gttattcaaatttgtacaggactgt

SEQ ID NO: 99118 - DNA, 25 bp, Homo sapien
gatttgttgacagcaaaatgttgaa

SEQ ID NO: 99119 - DNA, 25 bp, Homo sapien
gaggacggatctagctcctgtatat

SEQ ID NO: 99120 - DNA, 25 bp, Homo sapien
ggatctagctcctgtatatatattt

SEQ ID NO: 99121 - DNA, 25 bp, Homo sapien
atattttattgcatgcactgtgacc

SEQ ID NO: 99122 - DNA, 25 bp, Homo sapien
tttattgcatgcactgtgaccttgg

SEQ ID NO: 99123 - DNA, 25 bp, Homo sapien
acctcctgcgatctggctggcttgg

SEQ ID NO: 99124 - DNA, 25 bp, Homo sapien
ggctggcttggatctcgtttttaac

SEQ ID NO: 99125 - DNA, 25 bp, Homo sapien
tggcttggatctcgtttttaacccg

SEQ ID NO: 99126 - DNA, 25 bp, Homo sapien
acctgccctatagttatggcctgtg

SEQ ID NO: 99127 - DNA, 25 bp, Homo sapien
gttctgctctcctggtcccagtgca

SEQ ID NO: 99128 - DNA, 25 bp, Homo sapien
cagtgcaccgtctgctctgtgaact

SEQ ID NO: 99129 - DNA, 25 bp, Homo sapien
tgcaccgtctgctctgtgaactcct

SEQ ID NO: 99130 - DNA, 25 bp, Homo sapien
tgactggcctatttactgtttacag

SEQ ID NO: 99131 - DNA, 25 bp, Homo sapien
ttactgtttacagctggccagtgca

SEQ ID NO: 99132 - DNA, 25 bp, Homo sapien
ctgtttacagctggccagtgcagag

SEQ ID NO: 99133 - DNA, 25 bp, Homo sapien
cagtgcagagctgctgctcttttac

SEQ ID NO: 99134 - DNA, 25 bp, Homo sapien
ttcccacctttaaactgcccagaag

SEQ ID NO: 99135 - DNA, 25 bp, Homo sapien
taaactgcccagaaggcatgcctct

SEQ ID NO: 99136 - DNA, 25 bp, Homo sapien
gcatgcctctcccacaggaagaggg

SEQ ID NO: 99137 - DNA, 25 bp, Homo sapien
gacagggaaatctgcctaccaagag

SEQ ID NO: 99138 - DNA, 25 bp, Homo sapien
gtctttgtgcccacacgtggtggct

SEQ ID NO: 99139 - DNA, 25 bp, Homo sapien
atggtgcggtggttgatgttaacct

SEQ ID NO: 99140 - DNA, 25 bp, Homo sapien
gttgatgttaacctagtgtgtgtgt

SEQ ID NO: 99141 - DNA, 25 bp, Homo sapien
cctaggcatgggtgagctactctgg

SEQ ID NO: 99142 - DNA, 25 bp, Homo sapien
ggtgagctactctggttggtaatac

SEQ ID NO: 99143 - DNA, 25 bp, Homo sapien
ggttggtaatactctgtgcacacat

SEQ ID NO: 99144 - DNA, 25 bp, Homo sapien
ctctgtgcacacatcattgtagcca

SEQ ID NO: 99145 - DNA, 25 bp, Homo sapien
tgcacacatcattgtagccacacat

SEQ ID NO: 99146 - DNA, 25 bp, Homo sapien
tgaagactctgccaggagaggataa

SEQ ID NO: 99147 - DNA, 25 bp, Homo sapien
gataattggaagttctcttggacct

SEQ ID NO: 99148 - DNA, 25 bp, Homo sapien
gaagttctcttggaccttaccttat

SEQ ID NO: 99149 - DNA, 25 bp, Homo sapien
ttggaccttaccttatgtgcctttc

SEQ ID NO: 99150 - DNA, 25 bp, Homo sapien
ttatgtgcctttcttcattgctgat

SEQ ID NO: 99151 - DNA, 25 bp, Homo sapien
gtgcctttcttcattgctgatttta

SEQ ID NO: 99152 - DNA, 25 bp, Homo sapien
gccttcacaaggaccgcccggtgga

SEQ ID NO: 99153 - DNA, 25 bp, Homo sapien
aggaccgcccggtggagccgctgga

SEQ ID NO: 99154 - DNA, 25 bp, Homo sapien
tggacctggccgtgttctgggtgga

SEQ ID NO: 99155 - DNA, 25 bp, Homo sapien
tgatgaggcacaagggcgcgccaca

SEQ ID NO: 99156 - DNA, 25 bp, Homo sapien
tggtaccagtaccattccttggacg

SEQ ID NO: 99157 - DNA, 25 bp, Homo sapien
ccagtaccattccttggacgtgatt

SEQ ID NO: 99158 - DNA, 25 bp, Homo sapien
tccttggacgtgattggtttcctct

SEQ ID NO: 99159 - DNA, 25 bp, Homo sapien
ttcctcttggccgtcgtgctgacag

SEQ ID NO: 99160 - DNA, 25 bp, Homo sapien
gtcgtgctgacagtggccttcatca

SEQ ID NO: 99161 - DNA, 25 bp, Homo sapien
gcgagttaagaaagcccacaaatcc

SEQ ID NO: 99162 - DNA, 25 bp, Homo sapien
agcccacaaatccaagacccattga

SEQ ID NO: 99163 - DNA, 25 bp, Homo sapien
actgagcctttttggtgctccctca

SEQ ID NO: 99164 - DNA, 25 bp, Homo sapien
ctttttggtgctccctcagaggaac

SEQ ID NO: 99165 - DNA, 25 bp, Homo sapien
aggaaccacacttctgtggccatct

SEQ ID NO: 99166 - DNA, 25 bp, Homo sapien
gtggccatctcacgtgaaagacatt

SEQ ID NO: 99167 - DNA, 25 bp, Homo sapien
gaaagacattgcctcagctactgaa

SEQ ID NO: 99168 - DNA, 25 bp, Homo sapien
ctcagctactgaaggtggccacctc

SEQ ID NO: 99169 - DNA, 25 bp, Homo sapien
ccacctccactctaaatgacatttt

SEQ ID NO: 99170 - DNA, 25 bp, Homo sapien
taaaaaactgcttctaatccttcct

SEQ ID NO: 99171 - DNA, 25 bp, Homo sapien
taatccttcctttgctaaatctcac

SEQ ID NO: 99172 - DNA, 25 bp, Homo sapien
aaaacgaaggtgactcactttgctt

SEQ ID NO: 99173 - DNA, 25 bp, Homo sapien
cactttgctttttcagtccattaaa

SEQ ID NO: 99174 - DNA, 25 bp, Homo sapien
tactaccatagaatgggccccaaga

SEQ ID NO: 99175 - DNA, 25 bp, Homo sapien
tgggccccaagatgcatgattaagt

SEQ ID NO: 99176 - DNA, 25 bp, Homo sapien
aagcccatggtatcctaatgtttgg

SEQ ID NO: 99177 - DNA, 25 bp, Homo sapien
gtgcatatgttttcacacagacgta

SEQ ID NO: 99178 - DNA, 25 bp, Homo sapien
gttttcacacagacgtatacacgtg

SEQ ID NO: 99179 - DNA, 25 bp, Homo sapien
acgtgtatatcatatgtccacctgc

SEQ ID NO: 99180 - DNA, 25 bp, Homo sapien
atgtccacctgcatatgcctaggat

SEQ ID NO: 99181 - DNA, 25 bp, Homo sapien
gcctaggatgtctctgggaggatat

SEQ ID NO: 99182 - DNA, 25 bp, Homo sapien
ggaggatatctagcagcccggcagc

SEQ ID NO: 99183 - DNA, 25 bp, Homo sapien
ggcagcctgaattgcctctgggaag

SEQ ID NO: 99184 - DNA, 25 bp, Homo sapien
gggtgggaatgacttttcaatgtac

SEQ ID NO: 99185 - DNA, 25 bp, Homo sapien
gaacatcacccaccgaggccggtcg

SEQ ID NO: 99186 - DNA, 25 bp, Homo sapien
atcacccaccgaggccggtcgcggg

SEQ ID NO: 99187 - DNA, 25 bp, Homo sapien
taggggcagcaaacaaacatggaac

SEQ ID NO: 99188 - DNA, 25 bp, Homo sapien
caaacatggaacatgtatccctatg

SEQ ID NO: 99189 - DNA, 25 bp, Homo sapien
aacatggaacatgtatccctatgtt

SEQ ID NO: 99190 - DNA, 25 bp, Homo sapien
acatggaacatgtatccctatgtta

SEQ ID NO: 99191 - DNA, 25 bp, Homo sapien
catggaacatgtatccctatgttac

SEQ ID NO: 99192 - DNA, 25 bp, Homo sapien
atggaacatgtatccctatgttaca

SEQ ID NO: 99193 - DNA, 25 bp, Homo sapien
tggaacatgtatccctatgttacaa

SEQ ID NO: 99194 - DNA, 25 bp, Homo sapien
gaacatgtatccctatgttacaaac

SEQ ID NO: 99195 - DNA, 25 bp, Homo sapien
aacatgtatccctatgttacaaacc

SEQ ID NO: 99196 - DNA, 25 bp, Homo sapien
atattcccaataagactttagaagt

SEQ ID NO: 99197 - DNA, 25 bp, Homo sapien
gtctgtttttcataattgctcttta

SEQ ID NO: 99198 - DNA, 25 bp, Homo sapien
cataattgctctttatattgtgtgt

SEQ ID NO: 99199 - DNA, 25 bp, Homo sapien
tatattgtgtgttatctgacaagat

SEQ ID NO: 99200 - DNA, 25 bp, Homo sapien
taagaaacatgggaattgcagaaat

SEQ ID NO: 99201 - DNA, 25 bp, Homo sapien
tgcagtgcagcagtaattatggtgc

SEQ ID NO: 99202 - DNA, 25 bp, Homo sapien
aattatggtgcactttttcgctatt

SEQ ID NO: 99203 - DNA, 25 bp, Homo sapien
atggtgcactttttcgctatttaag

SEQ ID NO: 99204 - DNA, 25 bp, Homo sapien
gcactttttcgctatttaagttgga

SEQ ID NO: 99205 - DNA, 25 bp, Homo sapien
agttggatatttctctacattcctg

SEQ ID NO: 99206 - DNA, 25 bp, Homo sapien
aaaatgcaggcagtgttttcacaaa

SEQ ID NO: 99207 - DNA, 25 bp, Homo sapien
ttcttaacctggatgaactgtctgg

SEQ ID NO: 99208 - DNA, 25 bp, Homo sapien
ggatgaactgtctggaattacataa

SEQ ID NO: 99209 - DNA, 25 bp, Homo sapien
aaaaatcatcaagactcaggagaat

SEQ ID NO: 99210 - DNA, 25 bp, Homo sapien
catcaagactcaggagaatggcaaa

SEQ ID NO: 99211 - DNA, 25 bp, Homo sapien
aacagtaaagtgttacaggagctga

SEQ ID NO: 99212 - DNA, 25 bp, Homo sapien
ctgaaggataaagtagctggtataa

SEQ ID NO: 99213 - DNA, 25 bp, Homo sapien
gaacctaaccgatctgaaagcgccg

SEQ ID NO: 99214 - DNA, 25 bp, Homo sapien
taaccgatctgaaagcgccgaagaa

SEQ ID NO: 99215 - DNA, 25 bp, Homo sapien
gaaagcgccgaagaacacaatacaa

SEQ ID NO: 99216 - DNA, 25 bp, Homo sapien
agcgccgaagaacacaatacaagaa

SEQ ID NO: 99217 - DNA, 25 bp, Homo sapien
aaaaaacctgaggaacgaatctcag

SEQ ID NO: 99218 - DNA, 25 bp, Homo sapien
atttacctgagttttcatccttgag

SEQ ID NO: 99219 - DNA, 25 bp, Homo sapien
catccttgaggaggtgaagtagtca

SEQ ID NO: 99220 - DNA, 25 bp, Homo sapien
aagtagtcaggaccatgaagtcaga

SEQ ID NO: 99221 - DNA, 25 bp, Homo sapien
ttcctcctctttcctggaagaagta

SEQ ID NO: 99222 - DNA, 25 bp, Homo sapien
tggaagaagtattcagtttcctttt

SEQ ID NO: 99223 - DNA, 25 bp, Homo sapien
tttctctggtaactcctcctttata

SEQ ID NO: 99224 - DNA, 25 bp, Homo sapien
tggtaactcctcctttatactattc

SEQ ID NO: 99225 - DNA, 25 bp, Homo sapien
agggcatcaccttcccagtgggaaa

SEQ ID NO: 99226 - DNA, 25 bp, Homo sapien
aggtgttaagttaggagcttctact

SEQ ID NO: 99227 - DNA, 25 bp, Homo sapien
gttaggagcttctactgtacaatca

SEQ ID NO: 99228 - DNA, 25 bp, Homo sapien
gcttctactgtacaatcagaacttg

SEQ ID NO: 99229 - DNA, 25 bp, Homo sapien
ggaaaatacaggtcatgaagttcct

SEQ ID NO: 99230 - DNA, 25 bp, Homo sapien
ttttctgttaaaaacctatgctggt

SEQ ID NO: 99231 - DNA, 25 bp, Homo sapien
cctatgctggtttgctttggatcac

SEQ ID NO: 99232 - DNA, 25 bp, Homo sapien
ttgctttggatcacaccctggtgaa

SEQ ID NO: 99233 - DNA, 25 bp, Homo sapien
tgaaccccgggtgctaagaatgaaa

SEQ ID NO: 99234 - DNA, 25 bp, Homo sapien
tgaaaataaccttggtgagttgtac

SEQ ID NO: 99235 - DNA, 25 bp, Homo sapien
acatgtgaagatagacttgctttct

SEQ ID NO: 99236 - DNA, 25 bp, Homo sapien
gtagtagtactgttgctgaataata

SEQ ID NO: 99237 - DNA, 25 bp, Homo sapien
aagtattagggcttcagagtccaat

SEQ ID NO: 99238 - DNA, 25 bp, Homo sapien
gggcttcagagtccaattttgctta

SEQ ID NO: 99239 - DNA, 25 bp, Homo sapien
gagtccaattttgcttatttatggt

SEQ ID NO: 99240 - DNA, 25 bp, Homo sapien
ctgaaaaaattgtgccgacccctgc

SEQ ID NO: 99241 - DNA, 25 bp, Homo sapien
tggaagagcacagtacctccatgca

SEQ ID NO: 99242 - DNA, 25 bp, Homo sapien
tacctccatgcattggtgtggcgaa

SEQ ID NO: 99243 - DNA, 25 bp, Homo sapien
gggattgccgctctaaaacatgttt

SEQ ID NO: 99244 - DNA, 25 bp, Homo sapien
aagccttcgtgacttctctctagtg

SEQ ID NO: 99245 - DNA, 25 bp, Homo sapien
tctagtgccttcgtgccctgtgttg

SEQ ID NO: 99246 - DNA, 25 bp, Homo sapien
tgttgcccactgaattgccctgtaa

SEQ ID NO: 99247 - DNA, 25 bp, Homo sapien
gaattgccctgtaacacctaagtgt

SEQ ID NO: 99248 - DNA, 25 bp, Homo sapien
taagggatagcttttcagccctcaa

SEQ ID NO: 99249 - DNA, 25 bp, Homo sapien
agccctcaaggttatcaggagcatt

SEQ ID NO: 99250 - DNA, 25 bp, Homo sapien
caggagcatttgtatcactgctata

SEQ ID NO: 99251 - DNA, 25 bp, Homo sapien
gaaatcttaggactgacatcccttt

SEQ ID NO: 99252 - DNA, 25 bp, Homo sapien
gacatccctttactcaggcaaacag

SEQ ID NO: 99253 - DNA, 25 bp, Homo sapien
ggcaaacagaagttccaaccccaga

SEQ ID NO: 99254 - DNA, 25 bp, Homo sapien
acagcactggagttggccaccacct

SEQ ID NO: 99255 - DNA, 25 bp, Homo sapien
tacttgctgtctgaaaaaacacctg

SEQ ID NO: 99256 - DNA, 25 bp, Homo sapien
aaaacacctgactagtacagctgag

SEQ ID NO: 99257 - DNA, 25 bp, Homo sapien
gtacagctgagatcttggcttctca

SEQ ID NO: 99258 - DNA, 25 bp, Homo sapien
gatcttggcttctcaacagggcaaa

SEQ ID NO: 99259 - DNA, 25 bp, Homo sapien
gcaaagataccaggcctgctgctga

SEQ ID NO: 99260 - DNA, 25 bp, Homo sapien
tgaggtcactgccacttctcacatg

SEQ ID NO: 99261 - DNA, 25 bp, Homo sapien
ctcacatgctgcttaagggagcaca

SEQ ID NO: 99262 - DNA, 25 bp, Homo sapien
gcttattctcaaagctactttccca

SEQ ID NO: 99263 - DNA, 25 bp, Homo sapien
tactttcccattcttgaaattggat

SEQ ID NO: 99264 - DNA, 25 bp, Homo sapien
actttcccattcttgaaattggatg

SEQ ID NO: 99265 - DNA, 25 bp, Homo sapien
ctttcccattcttgaaattggatga

SEQ ID NO: 99266 - DNA, 25 bp, Homo sapien
gctttttaggtatgtgccagagata

SEQ ID NO: 99267 - DNA, 25 bp, Homo sapien
atgtgccagagataaatggcccaga

SEQ ID NO: 99268 - DNA, 25 bp, Homo sapien
atggcccagaatatgttgattcttt

SEQ ID NO: 99269 - DNA, 25 bp, Homo sapien
tagattgttttaggcagactttaag

SEQ ID NO: 99270 - DNA, 25 bp, Homo sapien
gattgttttaggcagactttaagta

SEQ ID NO: 99271 - DNA, 25 bp, Homo sapien
aaatgcatgtttggttttgccgatg

SEQ ID NO: 99272 - DNA, 25 bp, Homo sapien
tttgccgatgcttcactatcttttt

SEQ ID NO: 99273 - DNA, 25 bp, Homo sapien
aagtatctctactttcctgatgttg

SEQ ID NO: 99274 - DNA, 25 bp, Homo sapien
ttcctgatgttgataatagtaatgg

SEQ ID NO: 99275 - DNA, 25 bp, Homo sapien
ttctagaaggatgaacagttctccc

SEQ ID NO: 99276 - DNA, 25 bp, Homo sapien
aggatgaacagttctcccttcaact

SEQ ID NO: 99277 - DNA, 25 bp, Homo sapien
gaacagttctcccttcaactgtata

SEQ ID NO: 99278 - DNA, 25 bp, Homo sapien
tctcccttcaactgtataccgtgtg

SEQ ID NO: 99279 - DNA, 25 bp, Homo sapien
ttcaactgtataccgtgtgctccag

SEQ ID NO: 99280 - DNA, 25 bp, Homo sapien
aactgtataccgtgtgctccagtgt

SEQ ID NO: 99281 - DNA, 25 bp, Homo sapien
ataccgtgtgctccagtgttttctt

SEQ ID NO: 99282 - DNA, 25 bp, Homo sapien
gtgtgctccagtgttttcttgtgtt

SEQ ID NO: 99283 - DNA, 25 bp, Homo sapien
gatggtaatcttttctgaggtttag

SEQ ID NO: 99284 - DNA, 25 bp, Homo sapien
agggaaacgatccttattgcctcac

SEQ ID NO: 99285 - DNA, 25 bp, Homo sapien
accatttcccacgtgaagtctgtat

SEQ ID NO: 99286 - DNA, 25 bp, Homo sapien
gaagtctgtattgacattctcatag

SEQ ID NO: 99287 - DNA, 25 bp, Homo sapien
gacattctcatagacctgggatatt

SEQ ID NO: 99288 - DNA, 25 bp, Homo sapien
gtgtctgcagcacatagtccaatta

SEQ ID NO: 99289 - DNA, 25 bp, Homo sapien
tattttcatgttatctactgacagg

SEQ ID NO: 99290 - DNA, 25 bp, Homo sapien
tactgacaggtctatttgtctccct

SEQ ID NO: 99291 - DNA, 25 bp, Homo sapien
ttgtctccctgttacactgtgagct

SEQ ID NO: 99292 - DNA, 25 bp, Homo sapien
gtgagctccgtgagggcagaaacaa

SEQ ID NO: 99293 - DNA, 25 bp, Homo sapien
caatgttagtattttcactgctgtg

SEQ ID NO: 99294 - DNA, 25 bp, Homo sapien
gcccggcacacagcaggcatataat

SEQ ID NO: 99295 - DNA, 25 bp, Homo sapien
gaaaaatgtcttgaaacaaatgata

SEQ ID NO: 99296 - DNA, 25 bp, Homo sapien
gggaagtttatagctataagcacct

SEQ ID NO: 99297 - DNA, 25 bp, Homo sapien
gaagtttatagctataagcacctac

SEQ ID NO: 99298 - DNA, 25 bp, Homo sapien
gtttatagctataagcacctacatc

SEQ ID NO: 99299 - DNA, 25 bp, Homo sapien
atagctataagcacctacatcaaaa

SEQ ID NO: 99300 - DNA, 25 bp, Homo sapien
gctataagcacctacatcaaaaaag

SEQ ID NO: 99301 - DNA, 25 bp, Homo sapien
agcacctacatcaaaaaagaagaaa

SEQ ID NO: 99302 - DNA, 25 bp, Homo sapien
aataatctaaccatgaatcttatag

SEQ ID NO: 99303 - DNA, 25 bp, Homo sapien
gaatcttatagaactagagaactaa

SEQ ID NO: 99304 - DNA, 25 bp, Homo sapien
gagaactaagagcaaacaaaatcca

SEQ ID NO: 99305 - DNA, 25 bp, Homo sapien
gcaaacaaaatccaaagttactaga

SEQ ID NO: 99306 - DNA, 25 bp, Homo sapien
taaatctcattgtttccagttagca

SEQ ID NO: 99307 - DNA, 25 bp, Homo sapien
gtttccagttagcaatatcatacct

SEQ ID NO: 99308 - DNA, 25 bp, Homo sapien
tcatacctattaaagctgttcattg

SEQ ID NO: 99309 - DNA, 25 bp, Homo sapien
aaagctgttcattgtaacaaaattc

SEQ ID NO: 99310 - DNA, 25 bp, Homo sapien
aaattcaatcaaaaaggcagctagg

SEQ ID NO: 99311 - DNA, 25 bp, Homo sapien
aaggcagctaggtcagaaggaaaca

SEQ ID NO: 99312 - DNA, 25 bp, Homo sapien
gaaggaaacataccactctcatggt

SEQ ID NO: 99313 - DNA, 25 bp, Homo sapien
acataccactctcatggttcatagt

SEQ ID NO: 99314 - DNA, 25 bp, Homo sapien
gtattcactgtatgtatgctaggga

SEQ ID NO: 99315 - DNA, 25 bp, Homo sapien
gggaaaagacttgctccagtctcct

SEQ ID NO: 99316 - DNA, 25 bp, Homo sapien
accactgctgcatatatttgttttt

SEQ ID NO: 99317 - DNA, 25 bp, Homo sapien
tttctctcactacaagtcaagcttg

SEQ ID NO: 99318 - DNA, 25 bp, Homo sapien
tacaagtcaagcttgggctctcaaa

SEQ ID NO: 99319 - DNA, 25 bp, Homo sapien
aagcttgggctctcaaagccctgcg

SEQ ID NO: 99320 - DNA, 25 bp, Homo sapien
aaagccctgcgcctgttaccacgga

SEQ ID NO: 99321 - DNA, 25 bp, Homo sapien
tgttaccacggatgcccacagggcc

SEQ ID NO: 99322 - DNA, 25 bp, Homo sapien
ggcctgggcagttgctgtggcgaca

SEQ ID NO: 99323 - DNA, 25 bp, Homo sapien
ctgtggcgacaggaagagctaatct

SEQ ID NO: 99324 - DNA, 25 bp, Homo sapien
gaagagctaatcttcagagagctca

SEQ ID NO: 99325 - DNA, 25 bp, Homo sapien
agctcagactctctaatgatgctga

SEQ ID NO: 99326 - DNA, 25 bp, Homo sapien
aaggagcaaaggctgagtcagaaac

SEQ ID NO: 99327 - DNA, 25 bp, Homo sapien
aggctgagtcagaaacacacttaag

SEQ ID NO: 99328 - DNA, 25 bp, Homo sapien
gttgcacattgctttgttgcctcct

SEQ ID NO: 99329 - DNA, 25 bp, Homo sapien
actctttattcatctaagggtctgg

SEQ ID NO: 99330 - DNA, 25 bp, Homo sapien
ggtgttccgtgtttttcgctatcca

SEQ ID NO: 99331 - DNA, 25 bp, Homo sapien
tttttcgctatccatgacgcagtga

SEQ ID NO: 99332 - DNA, 25 bp, Homo sapien
atgacgcagtgagtgcagcacgaca

SEQ ID NO: 99333 - DNA, 25 bp, Homo sapien
gcatggacccttgacccttaatagt

SEQ ID NO: 99334 - DNA, 25 bp, Homo sapien
ttaatagtccactgaccccggagaa

SEQ ID NO: 99335 - DNA, 25 bp, Homo sapien
accccggagaagattaggatggcct

SEQ ID NO: 99336 - DNA, 25 bp, Homo sapien
gagagatgaacctggatcctacgtt

SEQ ID NO: 99337 - DNA, 25 bp, Homo sapien
ggatcctacgttccttggaatgtac

SEQ ID NO: 99338 - DNA, 25 bp, Homo sapien
atgtacccatctgaatcaaatgcaa

SEQ ID NO: 99339 - DNA, 25 bp, Homo sapien
acgcgcaccgccgtgtgacagtggc

SEQ ID NO: 99340 - DNA, 25 bp, Homo sapien
accgccgtgtgacagtggccgggct

SEQ ID NO: 99341 - DNA, 25 bp, Homo sapien
ccgtgtgacagtggccgggctccct

SEQ ID NO: 99342 - DNA, 25 bp, Homo sapien
agctgaggacaggctggcgcctcca

SEQ ID NO: 99343 - DNA, 25 bp, Homo sapien
gggcgacagcgcatgcaggaacggg

SEQ ID NO: 99344 - DNA, 25 bp, Homo sapien
tgctgtgtgtggtctcagaggctct

SEQ ID NO: 99345 - DNA, 25 bp, Homo sapien
ctgtgtgtggtctcagaggctctgc

SEQ ID NO: 99346 - DNA, 25 bp, Homo sapien
gtgtgtggtctcagaggctctgctt

SEQ ID NO: 99347 - DNA, 25 bp, Homo sapien
tgtgtggtctcagaggctctgcttc

SEQ ID NO: 99348 - DNA, 25 bp, Homo sapien
ctctgcttccttaggttacaaaaca

SEQ ID NO: 99349 - DNA, 25 bp, Homo sapien
tctgcttccttaggttacaaaacaa

SEQ ID NO: 99350 - DNA, 25 bp, Homo sapien
tgctgcgcctgctcgtgggcctggc

SEQ ID NO: 99351 - DNA, 25 bp, Homo sapien
gggccaggacgacccacagtcccag

SEQ ID NO: 99352 - DNA, 25 bp, Homo sapien
ccagccgtcctcaccagagatggac

SEQ ID NO: 99353 - DNA, 25 bp, Homo sapien
accagggaggacaggatgctgggca

SEQ ID NO: 99354 - DNA, 25 bp, Homo sapien
gggaagccaagtcacgggcaggccg

SEQ ID NO: 99355 - DNA, 25 bp, Homo sapien
acgggcaggccgcagtggttcttgc

SEQ ID NO: 99356 - DNA, 25 bp, Homo sapien
agtggttcttgcgtggcctggtttt

SEQ ID NO: 99357 - DNA, 25 bp, Homo sapien
tggttcttgcgtggcctggttttat

SEQ ID NO: 99358 - DNA, 25 bp, Homo sapien
ttcttgcgtggcctggttttatttt

SEQ ID NO: 99359 - DNA, 25 bp, Homo sapien
tttcattgtgaaatatcatgctctt

SEQ ID NO: 99360 - DNA, 25 bp, Homo sapien
cattgtgaaatatcatgctcttatt

SEQ ID NO: 99361 - DNA, 25 bp, Homo sapien
ggaatctctggaaaactatcagaag

SEQ ID NO: 99362 - DNA, 25 bp, Homo sapien
aaagtttgacaccttgatacccact

SEQ ID NO: 99363 - DNA, 25 bp, Homo sapien
ttctggccacggtgccatacctgtt

SEQ ID NO: 99364 - DNA, 25 bp, Homo sapien
cacggtgccatacctgtttcttcct

SEQ ID NO: 99365 - DNA, 25 bp, Homo sapien
acagttctagacctttgtgatagaa

SEQ ID NO: 99366 - DNA, 25 bp, Homo sapien
aaaatgctctctgtactctagtctc

SEQ ID NO: 99367 - DNA, 25 bp, Homo sapien
atgctctctgtactctagtctcctg

SEQ ID NO: 99368 - DNA, 25 bp, Homo sapien
tctgcaagtagtttagtaggaatga

SEQ ID NO: 99369 - DNA, 25 bp, Homo sapien
aagtggaagtccaggcttggattgc

SEQ ID NO: 99370 - DNA, 25 bp, Homo sapien
gcttggattgcctaactacactgct

SEQ ID NO: 99371 - DNA, 25 bp, Homo sapien
gattgcctaactacactgctaaaaa

SEQ ID NO: 99372 - DNA, 25 bp, Homo sapien
gtaggagcatgtgttctttagggcc

SEQ ID NO: 99373 - DNA, 25 bp, Homo sapien
gcatgtgttctttagggccttgtaa

SEQ ID NO: 99374 - DNA, 25 bp, Homo sapien
ccttgtaaggctgtttccttttgca

SEQ ID NO: 99375 - DNA, 25 bp, Homo sapien
aggctgtttccttttgcatctggaa

SEQ ID NO: 99376 - DNA, 25 bp, Homo sapien
cttttgcatctggaactgactatat

SEQ ID NO: 99377 - DNA, 25 bp, Homo sapien
tcaattttgcatatagaggagccaa

SEQ ID NO: 99378 - DNA, 25 bp, Homo sapien
agaggagccaaagagagatttcagc

SEQ ID NO: 99379 - DNA, 25 bp, Homo sapien
aagagagatttcagctctgtatttg

SEQ ID NO: 99380 - DNA, 25 bp, Homo sapien
tttgatcttgaatcacttgacagtg

SEQ ID NO: 99381 - DNA, 25 bp, Homo sapien
gaatcacttgacagtgtttgtttga

SEQ ID NO: 99382 - DNA, 25 bp, Homo sapien
gaaagagcagtatgccacttcttaa

SEQ ID NO: 99383 - DNA, 25 bp, Homo sapien
accttctgccagatatcgtgacgtg

SEQ ID NO: 99384 - DNA, 25 bp, Homo sapien
atcgtgacgtgcgtgcagagcagca

SEQ ID NO: 99385 - DNA, 25 bp, Homo sapien
agtgaagacacgtgcattcctgcct

SEQ ID NO: 99386 - DNA, 25 bp, Homo sapien
gccttccgtgaaggagtgcccagtt

SEQ ID NO: 99387 - DNA, 25 bp, Homo sapien
aggagcctgatggagccctgcctgt

SEQ ID NO: 99388 - DNA, 25 bp, Homo sapien
gcctgtcgaggctgtatgcctatgg

SEQ ID NO: 99389 - DNA, 25 bp, Homo sapien
atggaaccttgtgggcttttctaga

SEQ ID NO: 99390 - DNA, 25 bp, Homo sapien
agagaaaactcaacagctgtttccc

SEQ ID NO: 99391 - DNA, 25 bp, Homo sapien
agccttaatgctggattgtctgtac

SEQ ID NO: 99392 - DNA, 25 bp, Homo sapien
gtctgtacaagattaactatccatt

SEQ ID NO: 99393 - DNA, 25 bp, Homo sapien
actatccattgtggcttatctatgc

SEQ ID NO: 99394 - DNA, 25 bp, Homo sapien
atgattaattctgcccaatagggta

SEQ ID NO: 99395 - DNA, 25 bp, Homo sapien
tatacagagacatgtcctgggtgac

SEQ ID NO: 99396 - DNA, 25 bp, Homo sapien
acatgggatgtgactttcgggtgtc

SEQ ID NO: 99397 - DNA, 25 bp, Homo sapien
acttccttactttagcgggctgcaa

SEQ ID NO: 99398 - DNA, 25 bp, Homo sapien
tgcaatgccgccgatatgatggctg

SEQ ID NO: 99399 - DNA, 25 bp, Homo sapien
gggagctctggcagccatacggcac

SEQ ID NO: 99400 - DNA, 25 bp, Homo sapien
atacggcaccatgaagtagcggcaa

SEQ ID NO: 99401 - DNA, 25 bp, Homo sapien
gtagcggcaatgtttgagcggcaca

SEQ ID NO: 99402 - DNA, 25 bp, Homo sapien
agagtctggatctctgatgatcaca

SEQ ID NO: 99403 - DNA, 25 bp, Homo sapien
gatcacagagccatcctaacaaacg

SEQ ID NO: 99404 - DNA, 25 bp, Homo sapien
atatcaccgacctccttatgtgaga

SEQ ID NO: 99405 - DNA, 25 bp, Homo sapien
aacactgtgtttgcaaatggagatt

SEQ ID NO: 99406 - DNA, 25 bp, Homo sapien
acactgtgtttgcaaatggagattc

SEQ ID NO: 99407 - DNA, 25 bp, Homo sapien
gggtagttggcttggccttctcttt

SEQ ID NO: 99408 - DNA, 25 bp, Homo sapien
agttggcttggccttctctttggtg

SEQ ID NO: 99409 - DNA, 25 bp, Homo sapien
ttggcttggccttctctttggtgat

SEQ ID NO: 99410 - DNA, 25 bp, Homo sapien
ggcttggccttctctttggtgatcc

SEQ ID NO: 99411 - DNA, 25 bp, Homo sapien
ttggccttctctttggtgatcccac

SEQ ID NO: 99412 - DNA, 25 bp, Homo sapien
tggccttctctttggtgatcccacc

SEQ ID NO: 99413 - DNA, 25 bp, Homo sapien
agccatttgcattgctggcccagcg

SEQ ID NO: 99414 - DNA, 25 bp, Homo sapien
gcggtggaggactcaggaactgccc

SEQ ID NO: 99415 - DNA, 25 bp, Homo sapien
gtggaggactcaggaactgcccggg

SEQ ID NO: 99416 - DNA, 25 bp, Homo sapien
agtgggtttgctgcacattgactgg

SEQ ID NO: 99417 - DNA, 25 bp, Homo sapien
acgtgtggggacttgtctagaccag

SEQ ID NO: 99418 - DNA, 25 bp, Homo sapien
ttgtctagaccagaatgaaagggac

SEQ ID NO: 99419 - DNA, 25 bp, Homo sapien
gattctgggctggacacggttgtgg

SEQ ID NO: 99420 - DNA, 25 bp, Homo sapien
tggacacggttgtggatccagagaa

SEQ ID NO: 99421 - DNA, 25 bp, Homo sapien
gatccagagaagaggcctagtctcc

SEQ ID NO: 99422 - DNA, 25 bp, Homo sapien
gaagaggcctagtctccaataaatc

SEQ ID NO: 99423 - DNA, 25 bp, Homo sapien
aggcctagtctccaataaatcttag

SEQ ID NO: 99424 - DNA, 25 bp, Homo sapien
gggtagactcttctgcctactgaag

SEQ ID NO: 99425 - DNA, 25 bp, Homo sapien
gactcttctgcctactgaagtgggt

SEQ ID NO: 99426 - DNA, 25 bp, Homo sapien
ttctgcctactgaagtgggtttgct

SEQ ID NO: 99427 - DNA, 25 bp, Homo sapien
ggagtttgacatgaagccagtctgt

SEQ ID NO: 99428 - DNA, 25 bp, Homo sapien
gccagtctgtaagaagtgctatgag

SEQ ID NO: 99429 - DNA, 25 bp, Homo sapien
gctatgagaaatttccattggagct

SEQ ID NO: 99430 - DNA, 25 bp, Homo sapien
acttaagaaactagctgagacctta

SEQ ID NO: 99431 - DNA, 25 bp, Homo sapien
ttttcttttctatgcaagataagag

SEQ ID NO: 99432 - DNA, 25 bp, Homo sapien
gagattaccaacattacttgtcttg

SEQ ID NO: 99433 - DNA, 25 bp, Homo sapien
acattacttgtcttgatctacccat

SEQ ID NO: 99434 - DNA, 25 bp, Homo sapien
cttgtcttgatctacccatatttaa

SEQ ID NO: 99435 - DNA, 25 bp, Homo sapien
ttaaagctatatctcaaagcagttg

SEQ ID NO: 99436 - DNA, 25 bp, Homo sapien
caaagcagttgagagaagaggacct

SEQ ID NO: 99437 - DNA, 25 bp, Homo sapien
aacactcaagaataagtttgtggag

SEQ ID NO: 99438 - DNA, 25 bp, Homo sapien
ggagaaacaacagaccagatcttta

SEQ ID NO: 99439 - DNA, 25 bp, Homo sapien
gatctttactcacaactcatgctag

SEQ ID NO: 99440 - DNA, 25 bp, Homo sapien
aactcatgctaggaggccagtccta

SEQ ID NO: 99441 - DNA, 25 bp, Homo sapien
cagtcctagcatcaccttatgttga

SEQ ID NO: 99442 - DNA, 25 bp, Homo sapien
aatcttaccaatagtctgtgtcaac

SEQ ID NO: 99443 - DNA, 25 bp, Homo sapien
catgatttcttcctgaagcctacag

SEQ ID NO: 99444 - DNA, 25 bp, Homo sapien
gaattacttgttcacgaattgcata

SEQ ID NO: 99445 - DNA, 25 bp, Homo sapien
ataaagctgcacaggattcccatct

SEQ ID NO: 99446 - DNA, 25 bp, Homo sapien
aggattcccatctaccctgatgatg

SEQ ID NO: 99447 - DNA, 25 bp, Homo sapien
agcagacatcattcaatccaaccag

SEQ ID NO: 99448 - DNA, 25 bp, Homo sapien
aatccaaccagaatctcgctctgca

SEQ ID NO: 99449 - DNA, 25 bp, Homo sapien
agtgcggcggtcttcgggaggggcg

SEQ ID NO: 99450 - DNA, 25 bp, Homo sapien
tgcggcggtcttcgggaggggcggt

SEQ ID NO: 99451 - DNA, 25 bp, Homo sapien
ggcggtccaacggagagacgccggc

SEQ ID NO: 99452 - DNA, 25 bp, Homo sapien
cgtggacatcggggcagctgacctc

SEQ ID NO: 99453 - DNA, 25 bp, Homo sapien
tggacatcggggcagctgacctcgc

SEQ ID NO: 99454 - DNA, 25 bp, Homo sapien
ggacatcggggcagctgacctcgcc

SEQ ID NO: 99455 - DNA, 25 bp, Homo sapien
gacatcggggcagctgacctcgccc

SEQ ID NO: 99456 - DNA, 25 bp, Homo sapien
acatcggggcagctgacctcgccca

SEQ ID NO: 99457 - DNA, 25 bp, Homo sapien
atcggggcagctgacctcgcccacg

SEQ ID NO: 99458 - DNA, 25 bp, Homo sapien
tcggggcagctgacctcgcccacgc

SEQ ID NO: 99459 - DNA, 25 bp, Homo sapien
cggggcagctgacctcgcccacgcc

SEQ ID NO: 99460 - DNA, 25 bp, Homo sapien
gaacatccatgatagcagtcttctg

SEQ ID NO: 99461 - DNA, 25 bp, Homo sapien
gcagtcttctgtaaatcgaactttt

SEQ ID NO: 99462 - DNA, 25 bp, Homo sapien
aattctctgaaggaaccaagtagga

SEQ ID NO: 99463 - DNA, 25 bp, Homo sapien
gtaggatattcttacatcatgactt

SEQ ID NO: 99464 - DNA, 25 bp, Homo sapien
ataatgaagggctgtgtgtaaacac

SEQ ID NO: 99465 - DNA, 25 bp, Homo sapien
gtgtgtaaacactgaccctgtctca

SEQ ID NO: 99466 - DNA, 25 bp, Homo sapien
ctgaccctgtctcaattctaacaag

SEQ ID NO: 99467 - DNA, 25 bp, Homo sapien
caagcattttagacatgagtttaca

SEQ ID NO: 99468 - DNA, 25 bp, Homo sapien
cggcaaatgggttcagatcgagatc

SEQ ID NO: 99469 - DNA, 25 bp, Homo sapien
agatcgagatcttcagtcctctgct

SEQ ID NO: 99470 - DNA, 25 bp, Homo sapien
agatcttcagtcctctgcttcatct

SEQ ID NO: 99471 - DNA, 25 bp, Homo sapien
agaccaccatcgtgagctttggcta

SEQ ID NO: 99472 - DNA, 25 bp, Homo sapien
agctttggctactccctgtatgcag

SEQ ID NO: 99473 - DNA, 25 bp, Homo sapien
ctggattggtgctgtgctgtgcctc

SEQ ID NO: 99474 - DNA, 25 bp, Homo sapien
tgtcatcctctgctgcgctggagat

SEQ ID NO: 99475 - DNA, 25 bp, Homo sapien
agatgcccaggcctttggtgaaaac

SEQ ID NO: 99476 - DNA, 25 bp, Homo sapien
gtttctactacactgcgggctctag

SEQ ID NO: 99477 - DNA, 25 bp, Homo sapien
tagctccccgactcatgcgaagagt

SEQ ID NO: 99478 - DNA, 25 bp, Homo sapien
tcatgcgaagagtgcccacgtataa

SEQ ID NO: 99479 - DNA, 25 bp, Homo sapien
ccacgtataagagggctgcccggct

SEQ ID NO: 99480 - DNA, 25 bp, Homo sapien
ggctgcccacagaggtgctgtagat

SEQ ID NO: 99481 - DNA, 25 bp, Homo sapien
ctaggtttgctcgtcacagtgtggg

SEQ ID NO: 99482 - DNA, 25 bp, Homo sapien
ctcctggttactgtgaagcctgttg

SEQ ID NO: 99483 - DNA, 25 bp, Homo sapien
aagcctgttggtttgctgctgtcgt

SEQ ID NO: 99484 - DNA, 25 bp, Homo sapien
gctgtcgtttttgaggagggcccat

SEQ ID NO: 99485 - DNA, 25 bp, Homo sapien
gaacctgggaacaaacctcacttga

SEQ ID NO: 99486 - DNA, 25 bp, Homo sapien
ctcacttgagctgtgcctagacaat

SEQ ID NO: 99487 - DNA, 25 bp, Homo sapien
aatgtgaattcctgtgttgctaaca

SEQ ID NO: 99488 - DNA, 25 bp, Homo sapien
agaagtggcctgtaagctcctgtgc

SEQ ID NO: 99489 - DNA, 25 bp, Homo sapien
tcctgtgctccggagggaagcattt

SEQ ID NO: 99490 - DNA, 25 bp, Homo sapien
agcatttcctggtaggctttgattt

SEQ ID NO: 99491 - DNA, 25 bp, Homo sapien
caatctactcatgatgtgttatgca

SEQ ID NO: 99492 - DNA, 25 bp, Homo sapien
acatggatttgtgttcaccttaaat

SEQ ID NO: 99493 - DNA, 25 bp, Homo sapien
aatgtcagggttcaaggtaaatgtt

SEQ ID NO: 99494 - DNA, 25 bp, Homo sapien
gatatgggctgattcccttgaaaaa

SEQ ID NO: 99495 - DNA, 25 bp, Homo sapien
aatcaggctgagataatagcttcca

SEQ ID NO: 99496 - DNA, 25 bp, Homo sapien
gagataatagcttccaatttgggtt

SEQ ID NO: 99497 - DNA, 25 bp, Homo sapien
gttttggaaaactcgtgtatcacaa

SEQ ID NO: 99498 - DNA, 25 bp, Homo sapien
acattatttgtcattccagtgctag

SEQ ID NO: 99499 - DNA, 25 bp, Homo sapien
tgtcattccagtgctagtagttttt

SEQ ID NO: 99500 - DNA, 25 bp, Homo sapien
gtgctagtagttttttacagaacac

SEQ ID NO: 99501 - DNA, 25 bp, Homo sapien
tgcagtgaaagacaaaagtcccatt

SEQ ID NO: 99502 - DNA, 25 bp, Homo sapien
aagtcccatttgtcgtagagtttat

SEQ ID NO: 99503 - DNA, 25 bp, Homo sapien
tagagtttatgtccttctaaggcag

SEQ ID NO: 99504 - DNA, 25 bp, Homo sapien
agagcctatagccagaactcagaaa

SEQ ID NO: 99505 - DNA, 25 bp, Homo sapien
gcacttatgttctcattctatggcc

SEQ ID NO: 99506 - DNA, 25 bp, Homo sapien
attctatggccattgtgttgcctct

SEQ ID NO: 99507 - DNA, 25 bp, Homo sapien
attgtgttgcctctgttactgtttg

SEQ ID NO: 99508 - DNA, 25 bp, Homo sapien
taaaaacatcttcatgtgggctggg

SEQ ID NO: 99509 - DNA, 25 bp, Homo sapien
gaaactggtgtctgctctggtgtga

SEQ ID NO: 99510 - DNA, 25 bp, Homo sapien
tgtctgctctggtgtgatctgaaaa

SEQ ID NO: 99511 - DNA, 25 bp, Homo sapien
atctgaaaaggcgtcttcactgctt

SEQ ID NO: 99512 - DNA, 25 bp, Homo sapien
gtcttcactgctttatctcatgatg

SEQ ID NO: 99513 - DNA, 25 bp, Homo sapien
gctttatctcatgatgcttgcttgt

SEQ ID NO: 99514 - DNA, 25 bp, Homo sapien
gatgcttgcttgtaaaacttgattt

SEQ ID NO: 99515 - DNA, 25 bp, Homo sapien
gtaatgcgaattctgagaggcctct

SEQ ID NO: 99516 - DNA, 25 bp, Homo sapien
ctgtttctcagcttttgggtggtat

SEQ ID NO: 99517 - DNA, 25 bp, Homo sapien
tttgggtggtattcagagaggtcta

SEQ ID NO: 99518 - DNA, 25 bp, Homo sapien
agaggtctagtaacacttggtgtca

SEQ ID NO: 99519 - DNA, 25 bp, Homo sapien
agtaacacttggtgtcacctggctg

SEQ ID NO: 99520 - DNA, 25 bp, Homo sapien
aggctccggtgaccgcaaagctaag

SEQ ID NO: 99521 - DNA, 25 bp, Homo sapien
agctaagtgctctgtagggcacctc

SEQ ID NO: 99522 - DNA, 25 bp, Homo sapien
cctctggtgcacatgatccatggag

SEQ ID NO: 99523 - DNA, 25 bp, Homo sapien
gatccatggagtcagagtcagagct

SEQ ID NO: 99524 - DNA, 25 bp, Homo sapien
agagctctcgtctgacaagtgcttt

SEQ ID NO: 99525 - DNA, 25 bp, Homo sapien
ctgacaagtgcttttgctttctttc

SEQ ID NO: 99526 - DNA, 25 bp, Homo sapien
gacacctgaaattgctggtctcact

SEQ ID NO: 99527 - DNA, 25 bp, Homo sapien
aaattgctggtctcactcctagtca

SEQ ID NO: 99528 - DNA, 25 bp, Homo sapien
tcactcctagtcaggctctggagat

SEQ ID NO: 99529 - DNA, 25 bp, Homo sapien
tgtcaaggcctgaacgtgatgggct

SEQ ID NO: 99530 - DNA, 25 bp, Homo sapien
cgtgatgggctgtgatcttgtcgaa

SEQ ID NO: 99531 - DNA, 25 bp, Homo sapien
ttgtcgaagtttcaccaccgtatga

SEQ ID NO: 99532 - DNA, 25 bp, Homo sapien
caccgtatgatctttctgggaacac

SEQ ID NO: 99533 - DNA, 25 bp, Homo sapien
tggcggctaacctgctgtttgagat

SEQ ID NO: 99534 - DNA, 25 bp, Homo sapien
tttgagatgctatgtgctctcccca

SEQ ID NO: 99535 - DNA, 25 bp, Homo sapien
gtgctctccccaaagtgacaaccgt

SEQ ID NO: 99536 - DNA, 25 bp, Homo sapien
gattgcgtcgctgacaagttctcaa

SEQ ID NO: 99537 - DNA, 25 bp, Homo sapien
ttctgctttcaccaagagagtgttt

SEQ ID NO: 99538 - DNA, 25 bp, Homo sapien
gagagtgtttcttcactcaactcag

SEQ ID NO: 99539 - DNA, 25 bp, Homo sapien
ttcactcaactcaggtggcatttgg

SEQ ID NO: 99540 - DNA, 25 bp, Homo sapien
atctcaaaggccaggaattccgttg

SEQ ID NO: 99541 - DNA, 25 bp, Homo sapien
aattccgttgacttgttggctgcca

SEQ ID NO: 99542 - DNA, 25 bp, Homo sapien
ccgttgacttgttggctgccagtag

SEQ ID NO: 99543 - DNA, 25 bp, Homo sapien
gaagacccactgaagctgggcagga

SEQ ID NO: 99544 - DNA, 25 bp, Homo sapien
caggacacaggcgagctcaggtgat

SEQ ID NO: 99545 - DNA, 25 bp, Homo sapien
tgatgccggccaccagcaatgcctg

SEQ ID NO: 99546 - DNA, 25 bp, Homo sapien
aatgcctggcctggtagctccgctt

SEQ ID NO: 99547 - DNA, 25 bp, Homo sapien
tggtagctccgcttctgctttcacc

SEQ ID NO: 99548 - DNA, 25 bp, Homo sapien
agcccccaactccaacaggattatt

SEQ ID NO: 99549 - DNA, 25 bp, Homo sapien
aggaggagttacagatgcagccaca

SEQ ID NO: 99550 - DNA, 25 bp, Homo sapien
gcagccacagattgatcatctgcct

SEQ ID NO: 99551 - DNA, 25 bp, Homo sapien
agattgatcatctgccttaacgtga

SEQ ID NO: 99552 - DNA, 25 bp, Homo sapien
tctgccttaacgtgatcggagatgc

SEQ ID NO: 99553 - DNA, 25 bp, Homo sapien
ttgtaatctactgtccagctgaaag

SEQ ID NO: 99554 - DNA, 25 bp, Homo sapien
tactgtccagctgaaagcactcatg

SEQ ID NO: 99555 - DNA, 25 bp, Homo sapien
gaaagcactcatgttacgaggaaga

SEQ ID NO: 99556 - DNA, 25 bp, Homo sapien
aactacaagtgatgttcaaatctat

SEQ ID NO: 99557 - DNA, 25 bp, Homo sapien
ttgggtcatttttatgtacctttgg

SEQ ID NO: 99558 - DNA, 25 bp, Homo sapien
gtacctttgggttcaggcattattt

SEQ ID NO: 99559 - DNA, 25 bp, Homo sapien
gaatactgcactggcagcgagctgc

SEQ ID NO: 99560 - DNA, 25 bp, Homo sapien
gtcgacagagaccaacaggagcccc

SEQ ID NO: 99561 - DNA, 25 bp, Homo sapien
aggagccccaaacatgtattcctct

SEQ ID NO: 99562 - DNA, 25 bp, Homo sapien
aaacatgtattcctcttcactattg

SEQ ID NO: 99563 - DNA, 25 bp, Homo sapien
tattcctcttcactattggcctgga

SEQ ID NO: 99564 - DNA, 25 bp, Homo sapien
tattggcctggacatctccacatag

SEQ ID NO: 99565 - DNA, 25 bp, Homo sapien
acatctccacataggcagtcatata

SEQ ID NO: 99566 - DNA, 25 bp, Homo sapien
aatatcattcaagggatttgggtat

SEQ ID NO: 99567 - DNA, 25 bp, Homo sapien
ttgggtatccagtagacttttagtt

SEQ ID NO: 99568 - DNA, 25 bp, Homo sapien
caaaactgactttgtactctcaagt

SEQ ID NO: 99569 - DNA, 25 bp, Homo sapien
gtactctcaagtagacctttcgtag

SEQ ID NO: 99570 - DNA, 25 bp, Homo sapien
atcctccccttgagagtcatcagaa

SEQ ID NO: 99571 - DNA, 25 bp, Homo sapien
tcctccccttgagagtcatcagaaa

SEQ ID NO: 99572 - DNA, 25 bp, Homo sapien
cctccccttgagagtcatcagaaaa

SEQ ID NO: 99573 - DNA, 25 bp, Homo sapien
ctccccttgagagtcatcagaaaaa

SEQ ID NO: 99574 - DNA, 25 bp, Homo sapien
tccccttgagagtcatcagaaaaat

SEQ ID NO: 99575 - DNA, 25 bp, Homo sapien
cccttgagagtcatcagaaaaatac

SEQ ID NO: 99576 - DNA, 25 bp, Homo sapien
gagtcatcagaaaaatacattagga

SEQ ID NO: 99577 - DNA, 25 bp, Homo sapien
aataaaagcacaaggcagggcagtg

SEQ ID NO: 99578 - DNA, 25 bp, Homo sapien
aaagcacaaggcagggcagtgctca

SEQ ID NO: 99579 - DNA, 25 bp, Homo sapien
aagcacaaggcagggcagtgctcac

SEQ ID NO: 99580 - DNA, 25 bp, Homo sapien
acaaggcagggcagtgctcacgcct

SEQ ID NO: 99581 - DNA, 25 bp, Homo sapien
ggatgagatttaatgcccatatctt

SEQ ID NO: 99582 - DNA, 25 bp, Homo sapien
gatttaatgcccatatcttaccagt

SEQ ID NO: 99583 - DNA, 25 bp, Homo sapien
taatgcccatatcttaccagttcag

SEQ ID NO: 99584 - DNA, 25 bp, Homo sapien
tgcccatatcttaccagttcagtta

SEQ ID NO: 99585 - DNA, 25 bp, Homo sapien
tcagttatctccagagccatttcac

SEQ ID NO: 99586 - DNA, 25 bp, Homo sapien
tccagagccatttcaccctttagag

SEQ ID NO: 99587 - DNA, 25 bp, Homo sapien
agagccatttcaccctttagagtga

SEQ ID NO: 99588 - DNA, 25 bp, Homo sapien
ccatttcaccctttagagtgagtca

SEQ ID NO: 99589 - DNA, 25 bp, Homo sapien
ggtttattatccagtctgccttacc

SEQ ID NO: 99590 - DNA, 25 bp, Homo sapien
gccttacccttaatctgttcacaga

SEQ ID NO: 99591 - DNA, 25 bp, Homo sapien
gataggaaaatgaagtgtttgctct

SEQ ID NO: 99592 - DNA, 25 bp, Homo sapien
ggagctggaggcgcatgcgcatccg

SEQ ID NO: 99593 - DNA, 25 bp, Homo sapien
gagctggaggcgcatgcgcatccgc

SEQ ID NO: 99594 - DNA, 25 bp, Homo sapien
agctggaggcgcatgcgcatccgcg

SEQ ID NO: 99595 - DNA, 25 bp, Homo sapien
gctggaggcgcatgcgcatccgcga

SEQ ID NO: 99596 - DNA, 25 bp, Homo sapien
ctggaggcgcatgcgcatccgcgat

SEQ ID NO: 99597 - DNA, 25 bp, Homo sapien
tggaggcgcatgcgcatccgcgatt

SEQ ID NO: 99598 - DNA, 25 bp, Homo sapien
ggaggcgcatgcgcatccgcgattc

SEQ ID NO: 99599 - DNA, 25 bp, Homo sapien
gaggcgcatgcgcatccgcgattcc

SEQ ID NO: 99600 - DNA, 25 bp, Homo sapien
aggcgcatgcgcatccgcgattccc

SEQ ID NO: 99601 - DNA, 25 bp, Homo sapien
aataaaaaatgctgcagtgagtggc

SEQ ID NO: 99602 - DNA, 25 bp, Homo sapien
agtatgactgtaaaggacaatgcaa

SEQ ID NO: 99603 - DNA, 25 bp, Homo sapien
ggacaatgcaagtaaaccaacttaa

SEQ ID NO: 99604 - DNA, 25 bp, Homo sapien
tcctactttttcttagttgttatct

SEQ ID NO: 99605 - DNA, 25 bp, Homo sapien
actttttcttagttgttatctatat

SEQ ID NO: 99606 - DNA, 25 bp, Homo sapien
acattttatgtacttctcatttcct

SEQ ID NO: 99607 - DNA, 25 bp, Homo sapien
acttctcatttcctagtacaggttg

SEQ ID NO: 99608 - DNA, 25 bp, Homo sapien
tctcatttcctagtacaggttgagt

SEQ ID NO: 99609 - DNA, 25 bp, Homo sapien
gagtatcccttatttgaagtgcttg

SEQ ID NO: 99610 - DNA, 25 bp, Homo sapien
ccttatttgaagtgcttgggaccaa

SEQ ID NO: 99611 - DNA, 25 bp, Homo sapien
tttgaagtgcttgggaccaaaagtg

SEQ ID NO: 99612 - DNA, 25 bp, Homo sapien
acttccaccccgacgaggcggagag

SEQ ID NO: 99613 - DNA, 25 bp, Homo sapien
agagcgatgaggacaacgacgtcgt

SEQ ID NO: 99614 - DNA, 25 bp, Homo sapien
gcgatgaggacaacgacgtcgtcat

SEQ ID NO: 99615 - DNA, 25 bp, Homo sapien
gaggacaacgacgtcgtcatcgagg

SEQ ID NO: 99616 - DNA, 25 bp, Homo sapien
gacaacgacgtcgtcatcgagggca

SEQ ID NO: 99617 - DNA, 25 bp, Homo sapien
aacgacgtcgtcatcgagggcacac

SEQ ID NO: 99618 - DNA, 25 bp, Homo sapien
acgacgtcgtcatcgagggcacact

SEQ ID NO: 99619 - DNA, 25 bp, Homo sapien
gacgtcgtcatcgagggcacactgg

SEQ ID NO: 99620 - DNA, 25 bp, Homo sapien
cgtcgtcatcgagggcacactggag

SEQ ID NO: 99621 - DNA, 25 bp, Homo sapien
agggcacactggagcctgcacgtcc

SEQ ID NO: 99622 - DNA, 25 bp, Homo sapien
tctcccgggtcaatggcgcgggcct

SEQ ID NO: 99623 - DNA, 25 bp, Homo sapien
ggaggctactaccactattcctact

SEQ ID NO: 99624 - DNA, 25 bp, Homo sapien
tactaccactattcctactcggtgg

SEQ ID NO: 99625 - DNA, 25 bp, Homo sapien
cactattcctactcggtggtgaggg

SEQ ID NO: 99626 - DNA, 25 bp, Homo sapien
aggctgcagatctggtaccgcaggt

SEQ ID NO: 99627 - DNA, 25 bp, Homo sapien
tgcagatctggtaccgcaggtagcg

SEQ ID NO: 99628 - DNA, 25 bp, Homo sapien
atctggtaccgcaggtagcgccgcc

SEQ ID NO: 99629 - DNA, 25 bp, Homo sapien
cagcctgcttgtgtcccgtgaggtt

SEQ ID NO: 99630 - DNA, 25 bp, Homo sapien
tgcttgtgtcccgtgaggttgtcaa

SEQ ID NO: 99631 - DNA, 25 bp, Homo sapien
cttgtgtcccgtgaggttgtcaata

SEQ ID NO: 99632 - DNA, 25 bp, Homo sapien
gtgtcccgtgaggttgtcaataaac

SEQ ID NO: 99633 - DNA, 25 bp, Homo sapien
aggttgtcaataaacctgccctcgg

SEQ ID NO: 99634 - DNA, 25 bp, Homo sapien
atccagttataatcaggcctcaacg

SEQ ID NO: 99635 - DNA, 25 bp, Homo sapien
tataatcaggcctcaacgttctgtc

SEQ ID NO: 99636 - DNA, 25 bp, Homo sapien
aatcaggcctcaacgttctgtcagg

SEQ ID NO: 99637 - DNA, 25 bp, Homo sapien
aggcctcaacgttctgtcaggtatt

SEQ ID NO: 99638 - DNA, 25 bp, Homo sapien
gcctcaacgttctgtcaggtattaa

SEQ ID NO: 99639 - DNA, 25 bp, Homo sapien
cgttctgtcaggtattaatatggtt

SEQ ID NO: 99640 - DNA, 25 bp, Homo sapien
ggttagaattgttcttacaactggt

SEQ ID NO: 99641 - DNA, 25 bp, Homo sapien
tacaactggtaattatagtcaatag

SEQ ID NO: 99642 - DNA, 25 bp, Homo sapien
gtactgacaaatttttgtgaactta

SEQ ID NO: 99643 - DNA, 25 bp, Homo sapien
gaaagttgttgtataatcatatcat

SEQ ID NO: 99644 - DNA, 25 bp, Homo sapien
aaaatactacattagggctgggcat

SEQ ID NO: 99645 - DNA, 25 bp, Homo sapien
cacttattggcctctcagttgtaca

SEQ ID NO: 99646 - DNA, 25 bp, Homo sapien
ctctcagttgtacaccgctttggaa

SEQ ID NO: 99647 - DNA, 25 bp, Homo sapien
gtacaccgctttggaaacagccttc

SEQ ID NO: 99648 - DNA, 25 bp, Homo sapien
tttggaaacagccttcatcccattg

SEQ ID NO: 99649 - DNA, 25 bp, Homo sapien
ttcatcccattgtgcgtgttgtcat

SEQ ID NO: 99650 - DNA, 25 bp, Homo sapien
cattgtgcgtgttgtcatgggtgac

SEQ ID NO: 99651 - DNA, 25 bp, Homo sapien
atgggtgacatctacctgctgctgc

SEQ ID NO: 99652 - DNA, 25 bp, Homo sapien
atcccatcatctatggtgccaaaac

SEQ ID NO: 99653 - DNA, 25 bp, Homo sapien
ccaaacagatcagaacacgggtgct

SEQ ID NO: 99654 - DNA, 25 bp, Homo sapien
acgggtgctggctatgttcaagatc

SEQ ID NO: 99655 - DNA, 25 bp, Homo sapien
agatcagctgtgacaaggacttgca

SEQ ID NO: 99656 - DNA, 25 bp, Homo sapien
taatttaaaactaggcataaacagc

SEQ ID NO: 99657 - DNA, 25 bp, Homo sapien
atttaaaactaggcataaacagcca

SEQ ID NO: 99658 - DNA, 25 bp, Homo sapien
tttaaaactaggcataaacagccag

SEQ ID NO: 99659 - DNA, 25 bp, Homo sapien
ttaaaactaggcataaacagccagg

SEQ ID NO: 99660 - DNA, 25 bp, Homo sapien
taaaactaggcataaacagccaggc

SEQ ID NO: 99661 - DNA, 25 bp, Homo sapien
aaaactaggcataaacagccaggca

SEQ ID NO: 99662 - DNA, 25 bp, Homo sapien
aaactaggcataaacagccaggcat

SEQ ID NO: 99663 - DNA, 25 bp, Homo sapien
aactaggcataaacagccaggcatg

SEQ ID NO: 99664 - DNA, 25 bp, Homo sapien
actaggcataaacagccaggcatgg

SEQ ID NO: 99665 - DNA, 25 bp, Homo sapien
tgcctgggccgcagaagtgatcagc

SEQ ID NO: 99666 - DNA, 25 bp, Homo sapien
gcctgggccgcagaagtgatcagca

SEQ ID NO: 99667 - DNA, 25 bp, Homo sapien
cctgggccgcagaagtgatcagcaa

SEQ ID NO: 99668 - DNA, 25 bp, Homo sapien
ctgggccgcagaagtgatcagcaat

SEQ ID NO: 99669 - DNA, 25 bp, Homo sapien
tgggccgcagaagtgatcagcaatg

SEQ ID NO: 99670 - DNA, 25 bp, Homo sapien
ccagagactcacaggccatggtgcg

SEQ ID NO: 99671 - DNA, 25 bp, Homo sapien
cagagactcacaggccatggtgcgg

SEQ ID NO: 99672 - DNA, 25 bp, Homo sapien
agagactcacaggccatggtgcgga

SEQ ID NO: 99673 - DNA, 25 bp, Homo sapien
gagactcacaggccatggtgcggag

SEQ ID NO: 99674 - DNA, 25 bp, Homo sapien
ggttatgtggtctatgttccaaaca

SEQ ID NO: 99675 - DNA, 25 bp, Homo sapien
gttccaaacaaaccacatgatcttg

SEQ ID NO: 99676 - DNA, 25 bp, Homo sapien
catgatcttgcctgtgtcacaatgt

SEQ ID NO: 99677 - DNA, 25 bp, Homo sapien
gtaacaagactctagctgggtcccc

SEQ ID NO: 99678 - DNA, 25 bp, Homo sapien
ggtcccctggtgatgagtttcagca

SEQ ID NO: 99679 - DNA, 25 bp, Homo sapien
aaaacagtttaaatctctaccacag

SEQ ID NO: 99680 - DNA, 25 bp, Homo sapien
taccacagcctcacaagcaaatgct

SEQ ID NO: 99681 - DNA, 25 bp, Homo sapien
ggaacatacatgtaaaaagccagca

SEQ ID NO: 99682 - DNA, 25 bp, Homo sapien
aaagccagcaaactatcttcaaact

SEQ ID NO: 99683 - DNA, 25 bp, Homo sapien
tatcttcaaactcttccgtccttaa

SEQ ID NO: 99684 - DNA, 25 bp, Homo sapien
ttccgtccttaatgtcttccatggc

SEQ ID NO: 99685 - DNA, 25 bp, Homo sapien
aggatcacaggctcgggtcgctgca

SEQ ID NO: 99686 - DNA, 25 bp, Homo sapien
tcgctgcagacgctttcagtgggtt

SEQ ID NO: 99687 - DNA, 25 bp, Homo sapien
tttcagtgggttgacggcagccgct

SEQ ID NO: 99688 - DNA, 25 bp, Homo sapien
acggcagccgctggaactttgcgta

SEQ ID NO: 99689 - DNA, 25 bp, Homo sapien
gaactttgcgtactgggctgctcac

SEQ ID NO: 99690 - DNA, 25 bp, Homo sapien
ctgcgtggccctgtgtacccgagga

SEQ ID NO: 99691 - DNA, 25 bp, Homo sapien
gaggctactggcgtcgagcccactg

SEQ ID NO: 99692 - DNA, 25 bp, Homo sapien
gcgtcgagcccactgcctcagaaga

SEQ ID NO: 99693 - DNA, 25 bp, Homo sapien
gcctcagaagacttcctttcatctg

SEQ ID NO: 99694 - DNA, 25 bp, Homo sapien
tttcatctgttcctactgagctggt

SEQ ID NO: 99695 - DNA, 25 bp, Homo sapien
tccacctccctgcaataaaatgggt

SEQ ID NO: 99696 - DNA, 25 bp, Homo sapien
aattttactcttttatacatgtgat

SEQ ID NO: 99697 - DNA, 25 bp, Homo sapien
agagtttcatccaacattcttgttc

SEQ ID NO: 99698 - DNA, 25 bp, Homo sapien
gtttcatccaacattcttgttctgc

SEQ ID NO: 99699 - DNA, 25 bp, Homo sapien
catccaacattcttgttctgcaggt

SEQ ID NO: 99700 - DNA, 25 bp, Homo sapien
ccaacattcttgttctgcaggttgc

SEQ ID NO: 99701 - DNA, 25 bp, Homo sapien
ctgcaggttgcttttataaagaagg

SEQ ID NO: 99702 - DNA, 25 bp, Homo sapien
aagaaggtgaactattttcatgtaa

SEQ ID NO: 99703 - DNA, 25 bp, Homo sapien
gaaaaatgaaattgtattcccattt

SEQ ID NO: 99704 - DNA, 25 bp, Homo sapien
atgtttatttcagaagggcagtttt

SEQ ID NO: 99705 - DNA, 25 bp, Homo sapien
cagttttgattatatgtgaatacac

SEQ ID NO: 99706 - DNA, 25 bp, Homo sapien
gtgaatacacaaattttactggatt

SEQ ID NO: 99707 - DNA, 25 bp, Homo sapien
tgttcggtccaggacctaaaatcct

SEQ ID NO: 99708 - DNA, 25 bp, Homo sapien
ggacctaaaatcctgggatgctgaa

SEQ ID NO: 99709 - DNA, 25 bp, Homo sapien
aatcctgggatgctgaaatcccttg

SEQ ID NO: 99710 - DNA, 25 bp, Homo sapien
cctgggatgctgaaatcccttgaat

SEQ ID NO: 99711 - DNA, 25 bp, Homo sapien
atgctgaaatcccttgaataaaatg

SEQ ID NO: 99712 - DNA, 25 bp, Homo sapien
aatcccttgaataaaatggtatagc

SEQ ID NO: 99713 - DNA, 25 bp, Homo sapien
taacctacatatatcctcctatgta

SEQ ID NO: 99714 - DNA, 25 bp, Homo sapien
acatatatcctcctatgtactttaa

SEQ ID NO: 99715 - DNA, 25 bp, Homo sapien
tgtcagggaagaactcaaaggattt

SEQ ID NO: 99716 - DNA, 25 bp, Homo sapien
ggatttggggcctgattatataatt

SEQ ID NO: 99717 - DNA, 25 bp, Homo sapien
taatttattacagttgtcccttggt

SEQ ID NO: 99718 - DNA, 25 bp, Homo sapien
gaaggcagtcccagatgagcctcta

SEQ ID NO: 99719 - DNA, 25 bp, Homo sapien
agtcccagatgagcctctattttca

SEQ ID NO: 99720 - DNA, 25 bp, Homo sapien
agatgagcctctattttcatcagct

SEQ ID NO: 99721 - DNA, 25 bp, Homo sapien
ttctctctccccttgaacttggtaa

SEQ ID NO: 99722 - DNA, 25 bp, Homo sapien
atggttctcccgtggcccctaggtg

SEQ ID NO: 99723 - DNA, 25 bp, Homo sapien
tggcccctaggtggatgaggccaaa

SEQ ID NO: 99724 - DNA, 25 bp, Homo sapien
gatgaggccaaagtcaaatccaagg

SEQ ID NO: 99725 - DNA, 25 bp, Homo sapien
ggccaaagtcaaatccaaggctgag

SEQ ID NO: 99726 - DNA, 25 bp, Homo sapien
aaggctgagacagtcgtgcgactcc

SEQ ID NO: 99727 - DNA, 25 bp, Homo sapien
ccccagagcgtgacccggagcaggt

SEQ ID NO: 99728 - DNA, 25 bp, Homo sapien
ggccgcaacggctcagtgacagcaa

SEQ ID NO: 99729 - DNA, 25 bp, Homo sapien
tttcccttgaacttggttagaattg

SEQ ID NO: 99730 - DNA, 25 bp, Homo sapien
aattgtgctactgtgaacgctgatc

SEQ ID NO: 99731 - DNA, 25 bp, Homo sapien
gaacgctgatcctgcatatggaagt

SEQ ID NO: 99732 - DNA, 25 bp, Homo sapien
atatggaagtcccactttggtgaca

SEQ ID NO: 99733 - DNA, 25 bp, Homo sapien
gttgtgcccacttcctggagtgaga

SEQ ID NO: 99734 - DNA, 25 bp, Homo sapien
agacagctcctggtgtgtagaattc

SEQ ID NO: 99735 - DNA, 25 bp, Homo sapien
ggtgtgtagaattcccggagcgtcc

SEQ ID NO: 99736 - DNA, 25 bp, Homo sapien
cggagcgtccgtggttcagagtaaa

SEQ ID NO: 99737 - DNA, 25 bp, Homo sapien
agatctgtgcatgcttttcctctgc

SEQ ID NO: 99738 - DNA, 25 bp, Homo sapien
tttcctctgcagcaattggctcgtt

SEQ ID NO: 99739 - DNA, 25 bp, Homo sapien
tttgttctcttttgataggatcctg

SEQ ID NO: 99740 - DNA, 25 bp, Homo sapien
gcatctgcagtcacgggcgcggtac

SEQ ID NO: 99741 - DNA, 25 bp, Homo sapien
cacgggcgcggtacaccagcgagat

SEQ ID NO: 99742 - DNA, 25 bp, Homo sapien
cagcgagatgcggagtgagctacta

SEQ ID NO: 99743 - DNA, 25 bp, Homo sapien
tgagctactaggcacggactctgca

SEQ ID NO: 99744 - DNA, 25 bp, Homo sapien
ggactctgcagagcctgagatggac

SEQ ID NO: 99745 - DNA, 25 bp, Homo sapien
cagcacacgcagaagtcagtcaact

SEQ ID NO: 99746 - DNA, 25 bp, Homo sapien
agtcagtcaactggctgctctgggc

SEQ ID NO: 99747 - DNA, 25 bp, Homo sapien
tgctctgggccatgctcattatcgt

SEQ ID NO: 99748 - DNA, 25 bp, Homo sapien
tgctcattatcgtctgcttcatctt

SEQ ID NO: 99749 - DNA, 25 bp, Homo sapien
atcttcattagcatgatcctcttca

SEQ ID NO: 99750 - DNA, 25 bp, Homo sapien
atcctcttcattcgaatcatgccta

SEQ ID NO: 99751 - DNA, 25 bp, Homo sapien
tgttcggtccaggacctaaaatcct

SEQ ID NO: 99752 - DNA, 25 bp, Homo sapien
aggacctaaaatcctgggatgctga

SEQ ID NO: 99753 - DNA, 25 bp, Homo sapien
gacctaaaatcctgggatgctgaaa

SEQ ID NO: 99754 - DNA, 25 bp, Homo sapien
aatcctgggatgctgaaatcccttg

SEQ ID NO: 99755 - DNA, 25 bp, Homo sapien
cctgggatgctgaaatcccttgaat

SEQ ID NO: 99756 - DNA, 25 bp, Homo sapien
ggatgctgaaatcccttgaataaaa

SEQ ID NO: 99757 - DNA, 25 bp, Homo sapien
gctgaaatcccttgaataaaatggt

SEQ ID NO: 99758 - DNA, 25 bp, Homo sapien
aatcccttgaataaaatggtatagc

SEQ ID NO: 99759 - DNA, 25 bp, Homo sapien
taacctacatatatcctcctatgta

SEQ ID NO: 99760 - DNA, 25 bp, Homo sapien
acatatatcctcctatgtactttaa

SEQ ID NO: 99761 - DNA, 25 bp, Homo sapien
ggatttggggcctgattatataatt

SEQ ID NO: 99762 - DNA, 25 bp, Homo sapien
ttagttgatctcttgtacttggaaa

SEQ ID NO: 99763 - DNA, 25 bp, Homo sapien
cctaaagaacagagtggagtggata

SEQ ID NO: 99764 - DNA, 25 bp, Homo sapien
gataaaataatcgtgcctaatgtca

SEQ ID NO: 99765 - DNA, 25 bp, Homo sapien
gtgcctaatgtcaaaactttactgg

SEQ ID NO: 99766 - DNA, 25 bp, Homo sapien
gtcaaaactttactggtttgagaag

SEQ ID NO: 99767 - DNA, 25 bp, Homo sapien
ggacttataccaataggacttacta

SEQ ID NO: 99768 - DNA, 25 bp, Homo sapien
aaggatctcctctcacagtggtaat

SEQ ID NO: 99769 - DNA, 25 bp, Homo sapien
gatctcctctcacagtggtaatgaa

SEQ ID NO: 99770 - DNA, 25 bp, Homo sapien
cctctcacagtggtaatgaaacatt

SEQ ID NO: 99771 - DNA, 25 bp, Homo sapien
gaaatttacaatttatgtgcttata

SEQ ID NO: 99772 - DNA, 25 bp, Homo sapien
caataaactgatgcatataatggct

SEQ ID NO: 99773 - DNA, 25 bp, Homo sapien
cacaagcttcgggtggacccggtca

SEQ ID NO: 99774 - DNA, 25 bp, Homo sapien
gagttcacccctgcggtgcacgcct

SEQ ID NO: 99775 - DNA, 25 bp, Homo sapien
gctggagcctcggtggccatgcttc

SEQ ID NO: 99776 - DNA, 25 bp, Homo sapien
tggagcctcggtggccatgcttctt

SEQ ID NO: 99777 - DNA, 25 bp, Homo sapien
agcctcggtggccatgcttcttgcc

SEQ ID NO: 99778 - DNA, 25 bp, Homo sapien
ggtggccatgcttcttgccccttgg

SEQ ID NO: 99779 - DNA, 25 bp, Homo sapien
gtggccatgcttcttgccccttggg

SEQ ID NO: 99780 - DNA, 25 bp, Homo sapien
tggccatgcttcttgccccttgggc

SEQ ID NO: 99781 - DNA, 25 bp, Homo sapien
tcctgcacccgtacccccgtggtct

SEQ ID NO: 99782 - DNA, 25 bp, Homo sapien
tgcacccgtacccccgtggtctttg

SEQ ID NO: 99783 - DNA, 25 bp, Homo sapien
taaagtctgagtgggcggcaaaaaa

SEQ ID NO: 99784 - DNA, 25 bp, Homo sapien
gttatgcaacattacacttgatttg

SEQ ID NO: 99785 - DNA, 25 bp, Homo sapien
gctgctttaaatttagagtacatcc

SEQ ID NO: 99786 - DNA, 25 bp, Homo sapien
gagtacatcccaaatttatccagtc

SEQ ID NO: 99787 - DNA, 25 bp, Homo sapien
gtacatcccaaatttatccagtcat

SEQ ID NO: 99788 - DNA, 25 bp, Homo sapien
catcccaaatttatccagtcatcag

SEQ ID NO: 99789 - DNA, 25 bp, Homo sapien
cccaaatttatccagtcatcagaaa

SEQ ID NO: 99790 - DNA, 25 bp, Homo sapien
tatccagtcatcagaaaatttaaag

SEQ ID NO: 99791 - DNA, 25 bp, Homo sapien
taaagtagttcgtatgttaaagcaa

SEQ ID NO: 99792 - DNA, 25 bp, Homo sapien
gtagttcgtatgttaaagcaaagta

SEQ ID NO: 99793 - DNA, 25 bp, Homo sapien
atataataaaggatgctgatgttac

SEQ ID NO: 99794 - DNA, 25 bp, Homo sapien
gaatggtctgtagtttttatatttg

SEQ ID NO: 99795 - DNA, 25 bp, Homo sapien
ttcctttcatattacagttgttttg

SEQ ID NO: 99796 - DNA, 25 bp, Homo sapien
gttgttttgcaagcaatttccacat

SEQ ID NO: 99797 - DNA, 25 bp, Homo sapien
ttgcaagcaatttccacatttatag

SEQ ID NO: 99798 - DNA, 25 bp, Homo sapien
tccacatttataggtgtaacaaaag

SEQ ID NO: 99799 - DNA, 25 bp, Homo sapien
ctcaggtataactaaaaacattcca

SEQ ID NO: 99800 - DNA, 25 bp, Homo sapien
ggcataaggacttgcattattgcat

SEQ ID NO: 99801 - DNA, 25 bp, Homo sapien
cattattgcattagggagcgggtca

SEQ ID NO: 99802 - DNA, 25 bp, Homo sapien
attgcattagggagcgggtcatgct

SEQ ID NO: 99803 - DNA, 25 bp, Homo sapien
aagcctgtgtagagtaccaaattat

SEQ ID NO: 99804 - DNA, 25 bp, Homo sapien
gaaagagatgcataaccattctgtc

SEQ ID NO: 99805 - DNA, 25 bp, Homo sapien
gatgcataaccattctgtcaatatt

SEQ ID NO: 99806 - DNA, 25 bp, Homo sapien
ccatctgtctttaggagctctcatt

SEQ ID NO: 99807 - DNA, 25 bp, Homo sapien
ttaggagctctcattatctcggtct

SEQ ID NO: 99808 - DNA, 25 bp, Homo sapien
attatctcggtctctggttcctaat

SEQ ID NO: 99809 - DNA, 25 bp, Homo sapien
cggtctctggttcctaatcctattt

SEQ ID NO: 99810 - DNA, 25 bp, Homo sapien
ttggaatctaggaaaactctgagct

SEQ ID NO: 99811 - DNA, 25 bp, Homo sapien
aactctgagctactgcatttaggca

SEQ ID NO: 99812 - DNA, 25 bp, Homo sapien
atttaggcaggcactttaataccaa

SEQ ID NO: 99813 - DNA, 25 bp, Homo sapien
caaactgtaacatgtctcaactgta

SEQ ID NO: 99814 - DNA, 25 bp, Homo sapien
atgtctcaactgtatacaactcaaa

SEQ ID NO: 99815 - DNA, 25 bp, Homo sapien
acaactcaaaatacaccagctcatt

SEQ ID NO: 99816 - DNA, 25 bp, Homo sapien
accagctcatttggctgctcagtct

SEQ ID NO: 99817 - DNA, 25 bp, Homo sapien
agatcacttaagtccgagagatcga

SEQ ID NO: 99818 - DNA, 25 bp, Homo sapien
gatcacttaagtccgagagatcgag

SEQ ID NO: 99819 - DNA, 25 bp, Homo sapien
atcacttaagtccgagagatcgagg

SEQ ID NO: 99820 - DNA, 25 bp, Homo sapien
tcacttaagtccgagagatcgaggc

SEQ ID NO: 99821 - DNA, 25 bp, Homo sapien
cacttaagtccgagagatcgaggct

SEQ ID NO: 99822 - DNA, 25 bp, Homo sapien
acttaagtccgagagatcgaggctt

SEQ ID NO: 99823 - DNA, 25 bp, Homo sapien
aggcttcagtgagatatggctgaga

SEQ ID NO: 99824 - DNA, 25 bp, Homo sapien
ggcttcagtgagatatggctgagac

SEQ ID NO: 99825 - DNA, 25 bp, Homo sapien
tcgtatttgacttacattctggaaa

SEQ ID NO: 99826 - DNA, 25 bp, Homo sapien
agaattccatcatggacctgaccca

SEQ ID NO: 99827 - DNA, 25 bp, Homo sapien
atggacctgacccaactgatacagc

SEQ ID NO: 99828 - DNA, 25 bp, Homo sapien
ggagagcaagcccaagatgtagcaa

SEQ ID NO: 99829 - DNA, 25 bp, Homo sapien
gatgtagcaagcagtccacctgaga

SEQ ID NO: 99830 - DNA, 25 bp, Homo sapien
tccacctgagagctccttccagaaa

SEQ ID NO: 99831 - DNA, 25 bp, Homo sapien
ttccagaaactagcacccagtgaat

SEQ ID NO: 99832 - DNA, 25 bp, Homo sapien
gtatactctattgagggatcgagat

SEQ ID NO: 99833 - DNA, 25 bp, Homo sapien
gggatcgagatgagctttaaaaact

SEQ ID NO: 99834 - DNA, 25 bp, Homo sapien
aaacagtttgtaagcctttcaacag

SEQ ID NO: 99835 - DNA, 25 bp, Homo sapien
agcagcatcaacctacgtggtggaa

SEQ ID NO: 99836 - DNA, 25 bp, Homo sapien
ggacattgtgtcagattaccagtta

SEQ ID NO: 99837 - DNA, 25 bp, Homo sapien
gtgtcagattaccagttataggaac

SEQ ID NO: 99838 - DNA, 25 bp, Homo sapien
cagttataggaacaattctcttttc

SEQ ID NO: 99839 - DNA, 25 bp, Homo sapien
aatcttgttttaccctatacatcca

SEQ ID NO: 99840 - DNA, 25 bp, Homo sapien
cttgttttaccctatacatccacag

SEQ ID NO: 99841 - DNA, 25 bp, Homo sapien
tacatccacagggttttgacacttg

SEQ ID NO: 99842 - DNA, 25 bp, Homo sapien
ggttttgacacttgttgtccagttg

SEQ ID NO: 99843 - DNA, 25 bp, Homo sapien
gacacttgttgtccagttgaaaaaa

SEQ ID NO: 99844 - DNA, 25 bp, Homo sapien
aaaggttgtgtagctgtgtcatgta

SEQ ID NO: 99845 - DNA, 25 bp, Homo sapien
gtagctgtgtcatgtatataccttt

SEQ ID NO: 99846 - DNA, 25 bp, Homo sapien
tgtatatacctttttgtgtcaaaag

SEQ ID NO: 99847 - DNA, 25 bp, Homo sapien
tttcttatttgacgtgtactttact

SEQ ID NO: 99848 - DNA, 25 bp, Homo sapien
tgacgtgtactttacttgtcctaag

SEQ ID NO: 99849 - DNA, 25 bp, Homo sapien
gaagtacacagtctgcagccactga

SEQ ID NO: 99850 - DNA, 25 bp, Homo sapien
agtctgcagccactgaaatcaggaa

SEQ ID NO: 99851 - DNA, 25 bp, Homo sapien
tcgagatgtcagaagtaaatgctct

SEQ ID NO: 99852 - DNA, 25 bp, Homo sapien
aatgcaccgtgtttaaattcttaat

SEQ ID NO: 99853 - DNA, 25 bp, Homo sapien
tagtcatcctaagtataccatttat

SEQ ID NO: 99854 - DNA, 25 bp, Homo sapien
ataaggaatgtgctcctagccactg

SEQ ID NO: 99855 - DNA, 25 bp, Homo sapien
aatgtgctcctagccactgtcttct

SEQ ID NO: 99856 - DNA, 25 bp, Homo sapien
ttctcctttccaggcatgactgaaa

SEQ ID NO: 99857 - DNA, 25 bp, Homo sapien
gaaatctaatcactggaaaccatgt

SEQ ID NO: 99858 - DNA, 25 bp, Homo sapien
ctggaattacaaatgtgctgggtgt

SEQ ID NO: 99859 - DNA, 25 bp, Homo sapien
tggaattacaaatgtgctgggtgtg

SEQ ID NO: 99860 - DNA, 25 bp, Homo sapien
aatgaaatagagactgggaaaacca

SEQ ID NO: 99861 - DNA, 25 bp, Homo sapien
acaaacctttagctaaacatatcag

SEQ ID NO: 99862 - DNA, 25 bp, Homo sapien
aaacctttagctaaacatatcaggg

SEQ ID NO: 99863 - DNA, 25 bp, Homo sapien
aacctttagctaaacatatcagggt

SEQ ID NO: 99864 - DNA, 25 bp, Homo sapien
cctttagctaaacatatcagggtaa

SEQ ID NO: 99865 - DNA, 25 bp, Homo sapien
ttagctaaacatatcagggtaaaaa

SEQ ID NO: 99866 - DNA, 25 bp, Homo sapien
gctaaacatatcagggtaaaaagag

SEQ ID NO: 99867 - DNA, 25 bp, Homo sapien
gagaaaacattcaaattactggaat

SEQ ID NO: 99868 - DNA, 25 bp, Homo sapien
aaacattcaaattactggaattaca

SEQ ID NO: 99869 - DNA, 25 bp, Homo sapien
gggcaaggtgagagttaaggatctt

SEQ ID NO: 99870 - DNA, 25 bp, Homo sapien
ggcaaggtgagagttaaggatcttg

SEQ ID NO: 99871 - DNA, 25 bp, Homo sapien
gcaaggtgagagttaaggatcttgg

SEQ ID NO: 99872 - DNA, 25 bp, Homo sapien
caaggtgagagttaaggatcttggg

SEQ ID NO: 99873 - DNA, 25 bp, Homo sapien
gatcttggggaggtggccgggtgca

SEQ ID NO: 99874 - DNA, 25 bp, Homo sapien
atcttggggaggtggccgggtgcag

SEQ ID NO: 99875 - DNA, 25 bp, Homo sapien
aggcgggcggatcagaccatcctgg

SEQ ID NO: 99876 - DNA, 25 bp, Homo sapien
ggcgggcggatcagaccatcctggc

SEQ ID NO: 99877 - DNA, 25 bp, Homo sapien
aaggacatggacaaggtcgagacat

SEQ ID NO: 99878 - DNA, 25 bp, Homo sapien
aggacatggacaaggtcgagacatt

SEQ ID NO: 99879 - DNA, 25 bp, Homo sapien
ggacatggacaaggtcgagacattc

SEQ ID NO: 99880 - DNA, 25 bp, Homo sapien
gacatggacaaggtcgagacattcc

SEQ ID NO: 99881 - DNA, 25 bp, Homo sapien
acatggacaaggtcgagacattcct

SEQ ID NO: 99882 - DNA, 25 bp, Homo sapien
catggacaaggtcgagacattcctg

SEQ ID NO: 99883 - DNA, 25 bp, Homo sapien
atggacaaggtcgagacattcctgc

SEQ ID NO: 99884 - DNA, 25 bp, Homo sapien
tggacaaggtcgagacattcctgcg

SEQ ID NO: 99885 - DNA, 25 bp, Homo sapien
ggacaaggtcgagacattcctgcgc

SEQ ID NO: 99886 - DNA, 25 bp, Homo sapien
gacaaggtcgagacattcctgcgca

SEQ ID NO: 99887 - DNA, 25 bp, Homo sapien
acaaggtcgagacattcctgcgcat

SEQ ID NO: 99888 - DNA, 25 bp, Homo sapien
atttcatttcagaaacgtgaaagaa

SEQ ID NO: 99889 - DNA, 25 bp, Homo sapien
gaaatcacataggagataagcctca

SEQ ID NO: 99890 - DNA, 25 bp, Homo sapien
atcacataggagataagcctcatga

SEQ ID NO: 99891 - DNA, 25 bp, Homo sapien
gataagcctcatgaatgcaaacaca

SEQ ID NO: 99892 - DNA, 25 bp, Homo sapien
aagcctcatgaatgcaaacacatgg

SEQ ID NO: 99893 - DNA, 25 bp, Homo sapien
tgaatatggttatcccctaaccata

SEQ ID NO: 99894 - DNA, 25 bp, Homo sapien
ggttatcccctaaccatatgcaggg

SEQ ID NO: 99895 - DNA, 25 bp, Homo sapien
atcctcctgcatcccataaatcatg

SEQ ID NO: 99896 - DNA, 25 bp, Homo sapien
tcctgcatcccataaatcatgccta

SEQ ID NO: 99897 - DNA, 25 bp, Homo sapien
gcatcccataaatcatgcctagatt

SEQ ID NO: 99898 - DNA, 25 bp, Homo sapien
cccataaatcatgcctagattactt

SEQ ID NO: 99899 - DNA, 25 bp, Homo sapien
ataaaccctgagaagaactacggag

SEQ ID NO: 99900 - DNA, 25 bp, Homo sapien
ttttcaccctgcctttccacaggaa

SEQ ID NO: 99901 - DNA, 25 bp, Homo sapien
acaggaagcactcacaggcaccaca

SEQ ID NO: 99902 - DNA, 25 bp, Homo sapien
ggcaccacacacgtatcatgtaact

SEQ ID NO: 99903 - DNA, 25 bp, Homo sapien
gggcatttacctcaggcatctgcac

SEQ ID NO: 99904 - DNA, 25 bp, Homo sapien
cctccgagcccggtggagaatgcag

SEQ ID NO: 99905 - DNA, 25 bp, Homo sapien
gctgctgtagtctcaggtaatgaag

SEQ ID NO: 99906 - DNA, 25 bp, Homo sapien
tcaggtaatgaaggcacagcacagc

SEQ ID NO: 99907 - DNA, 25 bp, Homo sapien
agcacagcagtactccacattgttt

SEQ ID NO: 99908 - DNA, 25 bp, Homo sapien
ccacattgtttcctatttggacata

SEQ ID NO: 99909 - DNA, 25 bp, Homo sapien
gacatagacttcatttcctttcagt

SEQ ID NO: 99910 - DNA, 25 bp, Homo sapien
aagagcaaggacaccacggccaaga

SEQ ID NO: 99911 - DNA, 25 bp, Homo sapien
tgagcccggagcacgtcgaggtcta

SEQ ID NO: 99912 - DNA, 25 bp, Homo sapien
gtcgaggtctacgagaggacccatg

SEQ ID NO: 99913 - DNA, 25 bp, Homo sapien
aggacccatggccagtctcactata

SEQ ID NO: 99914 - DNA, 25 bp, Homo sapien
agtctcactataggcgcagacactg

SEQ ID NO: 99915 - DNA, 25 bp, Homo sapien
gcagacactgctctcgaaggaggct

SEQ ID NO: 99916 - DNA, 25 bp, Homo sapien
gaaggaggctgcaccggatccacag

SEQ ID NO: 99917 - DNA, 25 bp, Homo sapien
agcatcgctcctgcagaaggcgcaa

SEQ ID NO: 99918 - DNA, 25 bp, Homo sapien
gaaggcgcaaaagacgctcctgcag

SEQ ID NO: 99919 - DNA, 25 bp, Homo sapien
agacgctcctgcaggcaccggagga

SEQ ID NO: 99920 - DNA, 25 bp, Homo sapien
agaaggcactaagcttcctgggccc

SEQ ID NO: 99921 - DNA, 25 bp, Homo sapien
ttttttactctgaagtgattccagt

SEQ ID NO: 99922 - DNA, 25 bp, Homo sapien
gaagtgattccagtcatatgtgtgt

SEQ ID NO: 99923 - DNA, 25 bp, Homo sapien
gattccagtcatatgtgtgtgtaac

SEQ ID NO: 99924 - DNA, 25 bp, Homo sapien
gtgtgtgtaactgcatcctatgaga

SEQ ID NO: 99925 - DNA, 25 bp, Homo sapien
tgtaactgcatcctatgagaagagc

SEQ ID NO: 99926 - DNA, 25 bp, Homo sapien
gcacaaatattgctgttccatgttc

SEQ ID NO: 99927 - DNA, 25 bp, Homo sapien
tgttccatgttctccactttcattt

SEQ ID NO: 99928 - DNA, 25 bp, Homo sapien
ttccatgttctccactttcattttc

SEQ ID NO: 99929 - DNA, 25 bp, Homo sapien
cactttcattttccactacaaatga

SEQ ID NO: 99930 - DNA, 25 bp, Homo sapien
ggttattgtgggaaactgagctaaa

SEQ ID NO: 99931 - DNA, 25 bp, Homo sapien
gagctaaaggagttagcatctttat

SEQ ID NO: 99932 - DNA, 25 bp, Homo sapien
atggtggttcccagaggtggtgact

SEQ ID NO: 99933 - DNA, 25 bp, Homo sapien
gtggtgactgagatcctaaaccgtt

SEQ ID NO: 99934 - DNA, 25 bp, Homo sapien
actgagatcctaaaccgttctgggt

SEQ ID NO: 99935 - DNA, 25 bp, Homo sapien
caactgctgcgtgagcagacacctt

SEQ ID NO: 99936 - DNA, 25 bp, Homo sapien
tgcgtgagcagacaccttcacagct

SEQ ID NO: 99937 - DNA, 25 bp, Homo sapien
gtattttcatttacatcaatcagct

SEQ ID NO: 99938 - DNA, 25 bp, Homo sapien
tttacatcaatcagctttattttct

SEQ ID NO: 99939 - DNA, 25 bp, Homo sapien
aactggatcagtcatattcattggt

SEQ ID NO: 99940 - DNA, 25 bp, Homo sapien
tattcattggtttgtgacctactct

SEQ ID NO: 99941 - DNA, 25 bp, Homo sapien
tggtttgtgacctactcttatctcc

SEQ ID NO: 99942 - DNA, 25 bp, Homo sapien
actcttatctccgtgggtggctctc

SEQ ID NO: 99943 - DNA, 25 bp, Homo sapien
ttagaaacaagaccacttatactgt

SEQ ID NO: 99944 - DNA, 25 bp, Homo sapien
accacttatactgtctgtctgaggc

SEQ ID NO: 99945 - DNA, 25 bp, Homo sapien
agataacagcagcatctcgaccagc

SEQ ID NO: 99946 - DNA, 25 bp, Homo sapien
cgaccagcctctgccttaaaggaaa

SEQ ID NO: 99947 - DNA, 25 bp, Homo sapien
tctttattaatcacgtatggttcac

SEQ ID NO: 99948 - DNA, 25 bp, Homo sapien
cacgtatggttcacagataattctt

SEQ ID NO: 99949 - DNA, 25 bp, Homo sapien
aacctcctagagaagcacaactgtc

SEQ ID NO: 99950 - DNA, 25 bp, Homo sapien
gcacaactgtcaagagtcttgtaca

SEQ ID NO: 99951 - DNA, 25 bp, Homo sapien
gagtcttgtacacacaacttcagct

SEQ ID NO: 99952 - DNA, 25 bp, Homo sapien
cttgtacacacaacttcagctttgc

SEQ ID NO: 99953 - DNA, 25 bp, Homo sapien
gtggtacaatttgtttgtttacact

SEQ ID NO: 99954 - DNA, 25 bp, Homo sapien
gacacagaaattaaatggctcacct

SEQ ID NO: 99955 - DNA, 25 bp, Homo sapien
aaattaaatggctcacctagtctga

SEQ ID NO: 99956 - DNA, 25 bp, Homo sapien
aatggctcacctagtctgagtgaaa

SEQ ID NO: 99957 - DNA, 25 bp, Homo sapien
acttggatgcctatgttgtaatacc

SEQ ID NO: 99958 - DNA, 25 bp, Homo sapien
gcctatgttgtaataccataaagtg

SEQ ID NO: 99959 - DNA, 25 bp, Homo sapien
gctgtgaggcaaatagagtttaagt

SEQ ID NO: 99960 - DNA, 25 bp, Homo sapien
gtgaatttctcaaggtattacagta

SEQ ID NO: 99961 - DNA, 25 bp, Homo sapien
taaaaaccaaatccttatgtgcctg

SEQ ID NO: 99962 - DNA, 25 bp, Homo sapien
aaccaaatccttatgtgcctggaaa

SEQ ID NO: 99963 - DNA, 25 bp, Homo sapien
tccttatgtgcctggaaataaacac

SEQ ID NO: 99964 - DNA, 25 bp, Homo sapien
ataaacacataaaggatctgacttg

SEQ ID NO: 99965 - DNA, 25 bp, Homo sapien
agtggctcccagcagtcggcgagcg

SEQ ID NO: 99966 - DNA, 25 bp, Homo sapien
ggcgagcgcggctgaggcttccggg

SEQ ID NO: 99967 - DNA, 25 bp, Homo sapien
tgcccccgggccttgatgggagctt

SEQ ID NO: 99968 - DNA, 25 bp, Homo sapien
agcttcagcggctcggagcgctcat

SEQ ID NO: 99969 - DNA, 25 bp, Homo sapien
ggctggacaccagcggctccacagg

SEQ ID NO: 99970 - DNA, 25 bp, Homo sapien
agccgcccggactctggtatcagaa

SEQ ID NO: 99971 - DNA, 25 bp, Homo sapien
gactctggtatcagaaccggctgca

SEQ ID NO: 99972 - DNA, 25 bp, Homo sapien
ctggtatcagaaccggctgcagact

SEQ ID NO: 99973 - DNA, 25 bp, Homo sapien
tgcggacgccactcctgcggcagag

SEQ ID NO: 99974 - DNA, 25 bp, Homo sapien
actcctgcggcagagacccgagtgg

SEQ ID NO: 99975 - DNA, 25 bp, Homo sapien
ggcagagacccgagtggctcccagc

SEQ ID NO: 99976 - DNA, 25 bp, Homo sapien
agttgagattagagggaaagcattt

SEQ ID NO: 99977 - DNA, 25 bp, Homo sapien
aagcattttctatatcaattgtgtt

SEQ ID NO: 99978 - DNA, 25 bp, Homo sapien
tttcaagaaggttatttagctagct

SEQ ID NO: 99979 - DNA, 25 bp, Homo sapien
atttagctagcttagtgttgaacta

SEQ ID NO: 99980 - DNA, 25 bp, Homo sapien
aaacaaggcaaggtctaatgctgtt

SEQ ID NO: 99981 - DNA, 25 bp, Homo sapien
ggcaaggtctaatgctgttttgaga

SEQ ID NO: 99982 - DNA, 25 bp, Homo sapien
ctaatgctgttttgagattctgaaa

SEQ ID NO: 99983 - DNA, 25 bp, Homo sapien
ttgtgacagttacgcaaatcagctt

SEQ ID NO: 99984 - DNA, 25 bp, Homo sapien
gttacgcaaatcagcttgaattcca

SEQ ID NO: 99985 - DNA, 25 bp, Homo sapien
aatcagcttgaattccatatgtccc

SEQ ID NO: 99986 - DNA, 25 bp, Homo sapien
ttatcataaagccacaaatgtatta

SEQ ID NO: 99987 - DNA, 25 bp, Homo sapien
gagagagaactgtctcgccttcgcc

SEQ ID NO: 99988 - DNA, 25 bp, Homo sapien
gagagaactgtctcgccttcgccgg

SEQ ID NO: 99989 - DNA, 25 bp, Homo sapien
ttcgccggctttaccagggtcatct

SEQ ID NO: 99990 - DNA, 25 bp, Homo sapien
gctttaccagggtcatctccaagaa

SEQ ID NO: 99991 - DNA, 25 bp, Homo sapien
ttaccagggtcatctccaagaagag

SEQ ID NO: 99992 - DNA, 25 bp, Homo sapien
atctccaagaagagagtggcccccc

SEQ ID NO: 99993 - DNA, 25 bp, Homo sapien
ccacctgagtcaatgcccaagatgc

SEQ ID NO: 99994 - DNA, 25 bp, Homo sapien
atgccccctagaacaccagcggaag

SEQ ID NO: 99995 - DNA, 25 bp, Homo sapien
actgggcagacaggccctcagagtg

SEQ ID NO: 99996 - DNA, 25 bp, Homo sapien
aggccctcagagtgctctgtaggag

SEQ ID NO: 99997 - DNA, 25 bp, Homo sapien
ctctgtaggagctgtagactgggaa

SEQ ID NO: 99998 - DNA, 25 bp, Homo sapien
aatgctccacaactagttgaaactg

SEQ ID NO: 99999 - DNA, 25 bp, Homo sapien
gctccacaactagttgaaactggaa

SEQ ID NO: 100000 - DNA, 25 bp, Homo sapien
gaagttcctagatgatttaaagctg

SEQ ID NO: 100001 - DNA, 25 bp, Homo sapien
gttcctagatgatttaaagctgtaa

SEQ ID NO: 100002 - DNA, 25 bp, Homo sapien
gaatcataagaaaacttgctgctac

SEQ ID NO: 100003 - DNA, 25 bp, Homo sapien
gaaaacttgctgctacagacatcaa

SEQ ID NO: 100004 - DNA, 25 bp, Homo sapien
cttgctgctacagacatcaaaaagg

SEQ ID NO: 100005 - DNA, 25 bp, Homo sapien
gaatgttaccatccctcatgctaat

SEQ ID NO: 100006 - DNA, 25 bp, Homo sapien
ttaccatccctcatgctaatccttt

SEQ ID NO: 100007 - DNA, 25 bp, Homo sapien
atccctcatgctaatccttttcatt

SEQ ID NO: 100008 - DNA, 25 bp, Homo sapien
ccctcatgctaatccttttcatttt

SEQ ID NO: 100009 - DNA, 25 bp, Homo sapien
ccaccctctacagccgaacccagac

SEQ ID NO: 100010 - DNA, 25 bp, Homo sapien
cccagggctgagttaaaggagaaat

SEQ ID NO: 100011 - DNA, 25 bp, Homo sapien
cttctgcaaggcccagggcttcaca

SEQ ID NO: 100012 - DNA, 25 bp, Homo sapien
ataagtgcatgacggaacaatagga

SEQ ID NO: 100013 - DNA, 25 bp, Homo sapien
aagtgcatgacggaacaataggact

SEQ ID NO: 100014 - DNA, 25 bp, Homo sapien
agtgcatgacggaacaataggactc

SEQ ID NO: 100015 - DNA, 25 bp, Homo sapien
gtgcatgacggaacaataggactcc

SEQ ID NO: 100016 - DNA, 25 bp, Homo sapien
tgcatgacggaacaataggactccc

SEQ ID NO: 100017 - DNA, 25 bp, Homo sapien
gcatgacggaacaataggactcccc

SEQ ID NO: 100018 - DNA, 25 bp, Homo sapien
catgacggaacaataggactcccca

SEQ ID NO: 100019 - DNA, 25 bp, Homo sapien
atgacggaacaataggactccccag

SEQ ID NO: 100020 - DNA, 25 bp, Homo sapien
aacaagatgtcaagagcatcactgt

SEQ ID NO: 100021 - DNA, 25 bp, Homo sapien
acaagatgtcaagagcatcactgtt

SEQ ID NO: 100022 - DNA, 25 bp, Homo sapien
caagatgtcaagagcatcactgttg

SEQ ID NO: 100023 - DNA, 25 bp, Homo sapien
aagatgtcaagagcatcactgttgt

SEQ ID NO: 100024 - DNA, 25 bp, Homo sapien
agatgtcaagagcatcactgttgtt

SEQ ID NO: 100025 - DNA, 25 bp, Homo sapien
gatgtcaagagcatcactgttgtta

SEQ ID NO: 100026 - DNA, 25 bp, Homo sapien
atgtcaagagcatcactgttgttat

SEQ ID NO: 100027 - DNA, 25 bp, Homo sapien
tgtcaagagcatcactgttgttatt

SEQ ID NO: 100028 - DNA, 25 bp, Homo sapien
acaagtgcttgtttagcggagaatt

SEQ ID NO: 100029 - DNA, 25 bp, Homo sapien
atataactcaattttcacaaccaca

SEQ ID NO: 100030 - DNA, 25 bp, Homo sapien
caattttcacaaccacatttaccaa

SEQ ID NO: 100031 - DNA, 25 bp, Homo sapien
aaattcatcataatgtctgttcaac

SEQ ID NO: 100032 - DNA, 25 bp, Homo sapien
gtctgttcaacattatcttatttgg

SEQ ID NO: 100033 - DNA, 25 bp, Homo sapien
agggcacgcttgtcttctcaggtat

SEQ ID NO: 100034 - DNA, 25 bp, Homo sapien
gtcttctcaggtatcttccccagca

SEQ ID NO: 100035 - DNA, 25 bp, Homo sapien
cagcattgctcccttacttagtatg

SEQ ID NO: 100036 - DNA, 25 bp, Homo sapien
tgctcccttacttagtatgccaaat

SEQ ID NO: 100037 - DNA, 25 bp, Homo sapien
tagtatgccaaatgtcttgaccaat

SEQ ID NO: 100038 - DNA, 25 bp, Homo sapien
gaccaatatcaaaaacaagtgcttg

SEQ ID NO: 100039 - DNA, 25 bp, Homo sapien
gtttgacacaaactcgcacaaccat

SEQ ID NO: 100040 - DNA, 25 bp, Homo sapien
gcacaaccatgacgcactgctcaag

SEQ ID NO: 100041 - DNA, 25 bp, Homo sapien
gtgcccgagtagcatcctgtgaccc

SEQ ID NO: 100042 - DNA, 25 bp, Homo sapien
tgcccgagtagcatcctgtgacccc

SEQ ID NO: 100043 - DNA, 25 bp, Homo sapien
gcccgagtagcatcctgtgacccct

SEQ ID NO: 100044 - DNA, 25 bp, Homo sapien
cccgagtagcatcctgtgacccctc

SEQ ID NO: 100045 - DNA, 25 bp, Homo sapien
ccgagtagcatcctgtgacccctcc

SEQ ID NO: 100046 - DNA, 25 bp, Homo sapien
cgagtagcatcctgtgacccctccc

SEQ ID NO: 100047 - DNA, 25 bp, Homo sapien
cctggccctgaaggtgccactccag

SEQ ID NO: 100048 - DNA, 25 bp, Homo sapien
ggccctgaaggtgccactccagtgc

SEQ ID NO: 100049 - DNA, 25 bp, Homo sapien
gccctgaaggtgccactccagtgcc

SEQ ID NO: 100050 - DNA, 25 bp, Homo sapien
gatcatggagatgagtgaccccaca

SEQ ID NO: 100051 - DNA, 25 bp, Homo sapien
atgagtgaccccacagtggaagagg

SEQ ID NO: 100052 - DNA, 25 bp, Homo sapien
tgaaagcagcccaggaacaagccct

SEQ ID NO: 100053 - DNA, 25 bp, Homo sapien
gagacagatgactgaggcccaccct

SEQ ID NO: 100054 - DNA, 25 bp, Homo sapien
agccactttccccaagcaggtagat

SEQ ID NO: 100055 - DNA, 25 bp, Homo sapien
gcaggtagatagcaaatttcccctt

SEQ ID NO: 100056 - DNA, 25 bp, Homo sapien
atttccccttagaggtagttagcat

SEQ ID NO: 100057 - DNA, 25 bp, Homo sapien
gttagcatggattatattttcacta

SEQ ID NO: 100058 - DNA, 25 bp, Homo sapien
tttcactatgtgcttcctgtcccca

SEQ ID NO: 100059 - DNA, 25 bp, Homo sapien
gaaaaggaaggcaactgcttcaaat

SEQ ID NO: 100060 - DNA, 25 bp, Homo sapien
ggcaactgcttcaaataaaattcct

SEQ ID NO: 100061 - DNA, 25 bp, Homo sapien
ataaaaacctgtagtctgggcaaca

SEQ ID NO: 100062 - DNA, 25 bp, Homo sapien
taaaaacctgtagtctgggcaacat

SEQ ID NO: 100063 - DNA, 25 bp, Homo sapien
aaaaacctgtagtctgggcaacatc

SEQ ID NO: 100064 - DNA, 25 bp, Homo sapien
aaaacctgtagtctgggcaacatcg

SEQ ID NO: 100065 - DNA, 25 bp, Homo sapien
aaacctgtagtctgggcaacatcgg

SEQ ID NO: 100066 - DNA, 25 bp, Homo sapien
aacctgtagtctgggcaacatcggg

SEQ ID NO: 100067 - DNA, 25 bp, Homo sapien
acctgtagtctgggcaacatcggga

SEQ ID NO: 100068 - DNA, 25 bp, Homo sapien
tgtagtctgggcaacatcgggagac

SEQ ID NO: 100069 - DNA, 25 bp, Homo sapien
cttgagcctggaagtccgaggcttc

SEQ ID NO: 100070 - DNA, 25 bp, Homo sapien
ttgagcctggaagtccgaggcttca

SEQ ID NO: 100071 - DNA, 25 bp, Homo sapien
tgagcctggaagtccgaggcttcag

SEQ ID NO: 100072 - DNA, 25 bp, Homo sapien
ttatagtacctatctttaaagtata

SEQ ID NO: 100073 - DNA, 25 bp, Homo sapien
atgtaaatggtatgtttcaataatt

SEQ ID NO: 100074 - DNA, 25 bp, Homo sapien
gaactctgaaacaatctacatatac

SEQ ID NO: 100075 - DNA, 25 bp, Homo sapien
caatctacatatacttattacccag

SEQ ID NO: 100076 - DNA, 25 bp, Homo sapien
tacatatacttattacccagtacag

SEQ ID NO: 100077 - DNA, 25 bp, Homo sapien
ggtgaataaacttttatgtttccat

SEQ ID NO: 100078 - DNA, 25 bp, Homo sapien
tgtttccatttcaaagaccagggtg

SEQ ID NO: 100079 - DNA, 25 bp, Homo sapien
ccatttcaaagaccagggtggagag

SEQ ID NO: 100080 - DNA, 25 bp, Homo sapien
aagagactaagtatatgcttcaagt

SEQ ID NO: 100081 - DNA, 25 bp, Homo sapien
gactaagtatatgcttcaagtttta

SEQ ID NO: 100082 - DNA, 25 bp, Homo sapien
aatattccaagtttgtgggaatggg

SEQ ID NO: 100083 - DNA, 25 bp, Homo sapien
tgatagttacaacccatgctagaat

SEQ ID NO: 100084 - DNA, 25 bp, Homo sapien
gctagaatggaaattcctcacacct

SEQ ID NO: 100085 - DNA, 25 bp, Homo sapien
tggaaattcctcacaccttgcacct

SEQ ID NO: 100086 - DNA, 25 bp, Homo sapien
ttgcaccttccctacttttctgaat

SEQ ID NO: 100087 - DNA, 25 bp, Homo sapien
ccttccctacttttctgaattgcta

SEQ ID NO: 100088 - DNA, 25 bp, Homo sapien
ttctgaattgctatgactactcctt

SEQ ID NO: 100089 - DNA, 25 bp, Homo sapien
attgctatgactactccttgttgga

SEQ ID NO: 100090 - DNA, 25 bp, Homo sapien
taaaaaataacaaacgactctctca

SEQ ID NO: 100091 - DNA, 25 bp, Homo sapien
atcacaataacagtttgtatgccaa

SEQ ID NO: 100092 - DNA, 25 bp, Homo sapien
gtatgccaaaaacttgattatcctt

SEQ ID NO: 100093 - DNA, 25 bp, Homo sapien
ataatcacattatcaaagccccatc

SEQ ID NO: 100094 - DNA, 25 bp, Homo sapien
gcgcagatctgattttcacatctct

SEQ ID NO: 100095 - DNA, 25 bp, Homo sapien
tggacattgagcctccaggcaccat

SEQ ID NO: 100096 - DNA, 25 bp, Homo sapien
ccaggcaccatgttgaggagagatg

SEQ ID NO: 100097 - DNA, 25 bp, Homo sapien
agatgaaaaccagggcggtagaact

SEQ ID NO: 100098 - DNA, 25 bp, Homo sapien
gctgcagggcgcaccagagaaccca

SEQ ID NO: 100099 - DNA, 25 bp, Homo sapien
gcgcaccagagaacccagccagagg

SEQ ID NO: 100100 - DNA, 25 bp, Homo sapien
gtgagtaccagtggtgttgcttcca

SEQ ID NO: 100101 - DNA, 25 bp, Homo sapien
taccagtggtgttgcttccaccctg

SEQ ID NO: 100102 - DNA, 25 bp, Homo sapien
gaactcaaggacattgcaaccctgc

SEQ ID NO: 100103 - DNA, 25 bp, Homo sapien
aaggacattgcaaccctgcccggcg

SEQ ID NO: 100104 - DNA, 25 bp, Homo sapien
tgcccggcgcagatctgattttcac

SEQ ID NO: 100105 - DNA, 25 bp, Homo sapien
gaagatatttgtagtaatgcctgga

SEQ ID NO: 100106 - DNA, 25 bp, Homo sapien
gtaatgcctggaaacttggtgcttt

SEQ ID NO: 100107 - DNA, 25 bp, Homo sapien
gcctggaaacttggtgctttaaatt

SEQ ID NO: 100108 - DNA, 25 bp, Homo sapien
aaattaaggtactcctctgctgctg

SEQ ID NO: 100109 - DNA, 25 bp, Homo sapien
tctgctgctgtagaatggattccac

SEQ ID NO: 100110 - DNA, 25 bp, Homo sapien
ctgtagaatggattccacacagtgg

SEQ ID NO: 100111 - DNA, 25 bp, Homo sapien
tatgtttagattcccatttgttaag

SEQ ID NO: 100112 - DNA, 25 bp, Homo sapien
gggaattatgaacttactgtgtact

SEQ ID NO: 100113 - DNA, 25 bp, Homo sapien
gaacttactgtgtactacctgcatt

SEQ ID NO: 100114 - DNA, 25 bp, Homo sapien
actgtgtactacctgcatttgtgct

SEQ ID NO: 100115 - DNA, 25 bp, Homo sapien
tacaaggattcgtttagctaattca

SEQ ID NO: 100116 - DNA, 25 bp, Homo sapien
atcctaaactggctgtgagactcta

SEQ ID NO: 100117 - DNA, 25 bp, Homo sapien
tgagactctatttcggaccctgcaa

SEQ ID NO: 100118 - DNA, 25 bp, Homo sapien
tgcaactcctattagtatcgcctgg

SEQ ID NO: 100119 - DNA, 25 bp, Homo sapien
agaaatgccatcttcacccagaaac

SEQ ID NO: 100120 - DNA, 25 bp, Homo sapien
atactgaagccactcaagactcggg

SEQ ID NO: 100121 - DNA, 25 bp, Homo sapien
aagactcgggccctgaaggattcat

SEQ ID NO: 100122 - DNA, 25 bp, Homo sapien
tttctgttgaaaatcctgggccttc

SEQ ID NO: 100123 - DNA, 25 bp, Homo sapien
aaatcctgggccttcttgctgttgt

SEQ ID NO: 100124 - DNA, 25 bp, Homo sapien
tttttgccaacttcaatggtcctag

SEQ ID NO: 100125 - DNA, 25 bp, Homo sapien
aatggtcctagtcagcataatgctt

SEQ ID NO: 100126 - DNA, 25 bp, Homo sapien
gggctttattatcttgtcagtcact

SEQ ID NO: 100127 - DNA, 25 bp, Homo sapien
gaaccatcgagttgatggaacccct

SEQ ID NO: 100128 - DNA, 25 bp, Homo sapien
ggaaccccttgatgaagaaatctct

SEQ ID NO: 100129 - DNA, 25 bp, Homo sapien
ttggaagagtaaccgccaaggccac

SEQ ID NO: 100130 - DNA, 25 bp, Homo sapien
aaggccaccatcttgtgtacatctt

SEQ ID NO: 100131 - DNA, 25 bp, Homo sapien
tcttgtgtacatcttatgtccagtt

SEQ ID NO: 100132 - DNA, 25 bp, Homo sapien
atcttggactttacaatgaagctgt

SEQ ID NO: 100133 - DNA, 25 bp, Homo sapien
gaaaattatccatgacttccctcag

SEQ ID NO: 100134 - DNA, 25 bp, Homo sapien
gacttccctcagttttatcctttag

SEQ ID NO: 100135 - DNA, 25 bp, Homo sapien
atcctttagggattgtgcaacatga

SEQ ID NO: 100136 - DNA, 25 bp, Homo sapien
gtgcaacatgattgatcttgatgga

SEQ ID NO: 100137 - DNA, 25 bp, Homo sapien
cttgatggattttcatacgattgta

SEQ ID NO: 100138 - DNA, 25 bp, Homo sapien
ggatgcagcacagactcagccttgg

SEQ ID NO: 100139 - DNA, 25 bp, Homo sapien
agcacagactcagccttggcctgga

SEQ ID NO: 100140 - DNA, 25 bp, Homo sapien
tggagcacatgcttactggtggcct

SEQ ID NO: 100141 - DNA, 25 bp, Homo sapien
ttactggtggcctcagtttaccttc

SEQ ID NO: 100142 - DNA, 25 bp, Homo sapien
gtttaccttccccagatcctagatt

SEQ ID NO: 100143 - DNA, 25 bp, Homo sapien
ttccccagatcctagattctggatg

SEQ ID NO: 100144 - DNA, 25 bp, Homo sapien
ttctggatgtgaggaagagatccct

SEQ ID NO: 100145 - DNA, 25 bp, Homo sapien
ggcctggccttctgagcagcagatt

SEQ ID NO: 100146 - DNA, 25 bp, Homo sapien
gcagcagattagttccaaagcaggt

SEQ ID NO: 100147 - DNA, 25 bp, Homo sapien
gattagttccaaagcaggtggcccc

SEQ ID NO: 100148 - DNA, 25 bp, Homo sapien
atgagatcattgcaccatgtcagac

SEQ ID NO: 100149 - DNA, 25 bp, Homo sapien
aactgcgacgctctcactgacgcgt

SEQ ID NO: 100150 - DNA, 25 bp, Homo sapien
actgacgcgtgcttacatgtgcttc

SEQ ID NO: 100151 - DNA, 25 bp, Homo sapien
ttacatgtgcttctcacttccggag

SEQ ID NO: 100152 - DNA, 25 bp, Homo sapien
tctcacttccggagcacaggcaggt

SEQ ID NO: 100153 - DNA, 25 bp, Homo sapien
gaatggatgcccatgatgcaactgg

SEQ ID NO: 100154 - DNA, 25 bp, Homo sapien
gcagcccttgctttttgcttgctct

SEQ ID NO: 100155 - DNA, 25 bp, Homo sapien
ttgctctcccacagaaacctttgtc

SEQ ID NO: 100156 - DNA, 25 bp, Homo sapien
gaaacctttgtccttgcaactttat

SEQ ID NO: 100157 - DNA, 25 bp, Homo sapien
gcaactttatcctttgtcccgattg

SEQ ID NO: 100158 - DNA, 25 bp, Homo sapien
gtcccgattgggtcccagatacaca

SEQ ID NO: 100159 - DNA, 25 bp, Homo sapien
aattgccttgatggagtgatggttt

SEQ ID NO: 100160 - DNA, 25 bp, Homo sapien
tagatcagattttgctaaatggaaa

SEQ ID NO: 100161 - DNA, 25 bp, Homo sapien
taatataacaatgctggttcctgga

SEQ ID NO: 100162 - DNA, 25 bp, Homo sapien
gaaggacctgaagtgtgaatgagtt

SEQ ID NO: 100163 - DNA, 25 bp, Homo sapien
gtgtgaatgagtttccttgacttac

SEQ ID NO: 100164 - DNA, 25 bp, Homo sapien
gaatgagtttccttgacttacacta

SEQ ID NO: 100165 - DNA, 25 bp, Homo sapien
tgagtttccttgacttacactagat

SEQ ID NO: 100166 - DNA, 25 bp, Homo sapien
gtttccttgacttacactagatttt

SEQ ID NO: 100167 - DNA, 25 bp, Homo sapien
tccttgacttacactagattttgtt

SEQ ID NO: 100168 - DNA, 25 bp, Homo sapien
ttttgttttggcttataatgacaag

SEQ ID NO: 100169 - DNA, 25 bp, Homo sapien
tgtttaaatcccataaagctaagtt

SEQ ID NO: 100170 - DNA, 25 bp, Homo sapien
tgaagatgtgtacccatttttgtaa

SEQ ID NO: 100171 - DNA, 25 bp, Homo sapien
agaagaggagtcactaagccctaac

SEQ ID NO: 100172 - DNA, 25 bp, Homo sapien
agccctaacagcttgtccaaagatt

SEQ ID NO: 100173 - DNA, 25 bp, Homo sapien
ggtttagggctattttatattcaga

SEQ ID NO: 100174 - DNA, 25 bp, Homo sapien
gggctattttatattcagagttctg

SEQ ID NO: 100175 - DNA, 25 bp, Homo sapien
cagagttctgaataattactttgaa

SEQ ID NO: 100176 - DNA, 25 bp, Homo sapien
aatacatctactaggctgttagcca

SEQ ID NO: 100177 - DNA, 25 bp, Homo sapien
ggctgttagccaaagcatcaccatt

SEQ ID NO: 100178 - DNA, 25 bp, Homo sapien
gccaaagcatcaccattacaagtcc

SEQ ID NO: 100179 - DNA, 25 bp, Homo sapien
gcatcaccattacaagtccatgaat

SEQ ID NO: 100180 - DNA, 25 bp, Homo sapien
gggattgtgaagatttactgacatc

SEQ ID NO: 100181 - DNA, 25 bp, Homo sapien
actgacatcaaaagttcttctggaa

SEQ ID NO: 100182 - DNA, 25 bp, Homo sapien
gtggcggactactccgactcggaga

SEQ ID NO: 100183 - DNA, 25 bp, Homo sapien
gagagtgagtgagcgatccccatcc

SEQ ID NO: 100184 - DNA, 25 bp, Homo sapien
agcgatccccatcctggagactgga

SEQ ID NO: 100185 - DNA, 25 bp, Homo sapien
agactggacccgctctagaggcccg

SEQ ID NO: 100186 - DNA, 25 bp, Homo sapien
ctagaggcccggacacacccaggag

SEQ ID NO: 100187 - DNA, 25 bp, Homo sapien
gccttcctgcaaccgtggagttatt

SEQ ID NO: 100188 - DNA, 25 bp, Homo sapien
cctgcaaccgtggagttatttattt

SEQ ID NO: 100189 - DNA, 25 bp, Homo sapien
ggtgtttgtgccttgtgagactccg

SEQ ID NO: 100190 - DNA, 25 bp, Homo sapien
gtgccttgtgagactccgtacatta

SEQ ID NO: 100191 - DNA, 25 bp, Homo sapien
gtgagactccgtacattaaagacct

SEQ ID NO: 100192 - DNA, 25 bp, Homo sapien
tccgtacattaaagacctgtctctt

SEQ ID NO: 100193 - DNA, 25 bp, Homo sapien
gaagtgttctttgatattacagttc

SEQ ID NO: 100194 - DNA, 25 bp, Homo sapien
aaatgacctgcgaattaccctaatt

SEQ ID NO: 100195 - DNA, 25 bp, Homo sapien
ggatcttaaagctttgagcacctgc

SEQ ID NO: 100196 - DNA, 25 bp, Homo sapien
gagcacctgccattttgccttgcat

SEQ ID NO: 100197 - DNA, 25 bp, Homo sapien
gcatcgtttccctcgtcatgcattt

SEQ ID NO: 100198 - DNA, 25 bp, Homo sapien
atgcatttccacatatccacaaaca

SEQ ID NO: 100199 - DNA, 25 bp, Homo sapien
aaacacagaacgactttagacaagc

SEQ ID NO: 100200 - DNA, 25 bp, Homo sapien
gacaagcacatgttacacctgtgtt

SEQ ID NO: 100201 - DNA, 25 bp, Homo sapien
agcagtcattcttgacggctccagt

SEQ ID NO: 100202 - DNA, 25 bp, Homo sapien
ttcttgacggctccagtttttattt

SEQ ID NO: 100203 - DNA, 25 bp, Homo sapien
tctcttttataaacccagtgaactc

SEQ ID NO: 100204 - DNA, 25 bp, Homo sapien
gatgatgtctttgtgggtatgtgcc

SEQ ID NO: 100205 - DNA, 25 bp, Homo sapien
tgagccctatgcaccatgctggctt

SEQ ID NO: 100206 - DNA, 25 bp, Homo sapien
ggcttcaagacatttggaatccggc

SEQ ID NO: 100207 - DNA, 25 bp, Homo sapien
agacatttggaatccggcggcccct

SEQ ID NO: 100208 - DNA, 25 bp, Homo sapien
cccttagacccctgcctgtataggg

SEQ ID NO: 100209 - DNA, 25 bp, Homo sapien
ctcgagatgtggaccatgtgggcac

SEQ ID NO: 100210 - DNA, 25 bp, Homo sapien
ccatgtgggcactggtgacagatga

SEQ ID NO: 100211 - DNA, 25 bp, Homo sapien
gctcaagtgtgcagctggccccata

SEQ ID NO: 100212 - DNA, 25 bp, Homo sapien
ataccccagcgctgaagggtgggtt

SEQ ID NO: 100213 - DNA, 25 bp, Homo sapien
tgggcaacagcctgagagtggactc

SEQ ID NO: 100214 - DNA, 25 bp, Homo sapien
catggaagatgctgaactcttcccc

SEQ ID NO: 100215 - DNA, 25 bp, Homo sapien
tgttccccagggtgatatgctgatt

SEQ ID NO: 100216 - DNA, 25 bp, Homo sapien
gatatgctgattttcattgtgcaca

SEQ ID NO: 100217 - DNA, 25 bp, Homo sapien
attgtgcacatggactgaatcacat

SEQ ID NO: 100218 - DNA, 25 bp, Homo sapien
aatcacatagattctcctccgtcag

SEQ ID NO: 100219 - DNA, 25 bp, Homo sapien
ctccgtcagtaaccgtgcgattata

SEQ ID NO: 100220 - DNA, 25 bp, Homo sapien
gtaaccgtgcgattatacaaattat

SEQ ID NO: 100221 - DNA, 25 bp, Homo sapien
gtcttccaaagtatggaacactcca

SEQ ID NO: 100222 - DNA, 25 bp, Homo sapien
ggaacactccaatcagaaaaaggtt

SEQ ID NO: 100223 - DNA, 25 bp, Homo sapien
aaggttatcattggtcgttgagtta

SEQ ID NO: 100224 - DNA, 25 bp, Homo sapien
ggaagaacttaagcatatactgtgt

SEQ ID NO: 100225 - DNA, 25 bp, Homo sapien
aacagtgccatacatttctaaaatc

SEQ ID NO: 100226 - DNA, 25 bp, Homo sapien
taacaattactgtcaggtgtcatca

SEQ ID NO: 100227 - DNA, 25 bp, Homo sapien
aacaattactgtcaggtgtcatcac

SEQ ID NO: 100228 - DNA, 25 bp, Homo sapien
acaattactgtcaggtgtcatcact

SEQ ID NO: 100229 - DNA, 25 bp, Homo sapien
ctgcttctgagaggcaatgtgaaag

SEQ ID NO: 100230 - DNA, 25 bp, Homo sapien
cttctgagaggcaatgtgaaagagg

SEQ ID NO: 100231 - DNA, 25 bp, Homo sapien
tatagaaattttggtacagtgtaca

SEQ ID NO: 100232 - DNA, 25 bp, Homo sapien
ggtacagtgtacattgaaaaccatg

SEQ ID NO: 100233 - DNA, 25 bp, Homo sapien
acagtgtacattgaaaaccatgtaa

SEQ ID NO: 100234 - DNA, 25 bp, Homo sapien
gaagtgtctaacaaatggcattgaa

SEQ ID NO: 100235 - DNA, 25 bp, Homo sapien
gtgtctaacaaatggcattgaagtg

SEQ ID NO: 100236 - DNA, 25 bp, Homo sapien
ctaacaaatggcattgaagtgtctt

SEQ ID NO: 100237 - DNA, 25 bp, Homo sapien
accgtggcctgggattccatctgga

SEQ ID NO: 100238 - DNA, 25 bp, Homo sapien
gtggcctgggattccatctggagct

SEQ ID NO: 100239 - DNA, 25 bp, Homo sapien
gcctgggattccatctggagctgtc

SEQ ID NO: 100240 - DNA, 25 bp, Homo sapien
tgggattccatctggagctgtccgc

SEQ ID NO: 100241 - DNA, 25 bp, Homo sapien
gattccatctggagctgtccgcagg

SEQ ID NO: 100242 - DNA, 25 bp, Homo sapien
ttccatctggagctgtccgcaggca

SEQ ID NO: 100243 - DNA, 25 bp, Homo sapien
atctggagctgtccgcaggcaccag

SEQ ID NO: 100244 - DNA, 25 bp, Homo sapien
cacgctcactgcctggcttggaaaa

SEQ ID NO: 100245 - DNA, 25 bp, Homo sapien
cgctcactgcctggcttggaaaagt

SEQ ID NO: 100246 - DNA, 25 bp, Homo sapien
tcactgcctggcttggaaaagttaa

SEQ ID NO: 100247 - DNA, 25 bp, Homo sapien
cactgcctggcttggaaaagttaag

SEQ ID NO: 100248 - DNA, 25 bp, Homo sapien
ctgcgcctggccttgatgtgtgaat

SEQ ID NO: 100249 - DNA, 25 bp, Homo sapien
tgcgcctggccttgatgtgtgaata

SEQ ID NO: 100250 - DNA, 25 bp, Homo sapien
gcgcctggccttgatgtgtgaatat

SEQ ID NO: 100251 - DNA, 25 bp, Homo sapien
atgtgtgaatatttgagaggtcata

SEQ ID NO: 100252 - DNA, 25 bp, Homo sapien
tgtgtgaatatttgagaggtcataa

SEQ ID NO: 100253 - DNA, 25 bp, Homo sapien
gtgaatatttgagaggtcataagca

SEQ ID NO: 100254 - DNA, 25 bp, Homo sapien
gaatatttgagaggtcataagcagt

SEQ ID NO: 100255 - DNA, 25 bp, Homo sapien
aatatttgagaggtcataagcagtg

SEQ ID NO: 100256 - DNA, 25 bp, Homo sapien
atatttgagaggtcataagcagtgg

SEQ ID NO: 100257 - DNA, 25 bp, Homo sapien
tatttgagaggtcataagcagtggt

SEQ ID NO: 100258 - DNA, 25 bp, Homo sapien
atttgagaggtcataagcagtggtt

SEQ ID NO: 100259 - DNA, 25 bp, Homo sapien
ttgaagcaatgacaagcactttact

SEQ ID NO: 100260 - DNA, 25 bp, Homo sapien
agcaatgacaagcactttactttca

SEQ ID NO: 100261 - DNA, 25 bp, Homo sapien
tgtggaacctcttttggaggacgtt

SEQ ID NO: 100262 - DNA, 25 bp, Homo sapien
ttttttaagagtgtgtgatgtgtgt

SEQ ID NO: 100263 - DNA, 25 bp, Homo sapien
ttgtagatttcttgacagtgctgta

SEQ ID NO: 100264 - DNA, 25 bp, Homo sapien
gtagatttcttgacagtgctgtaat

SEQ ID NO: 100265 - DNA, 25 bp, Homo sapien
gatttcttgacagtgctgtaataca

SEQ ID NO: 100266 - DNA, 25 bp, Homo sapien
gctgtaatacagacggcaatgcaat

SEQ ID NO: 100267 - DNA, 25 bp, Homo sapien
gacggcaatgcaatagcctatttaa

SEQ ID NO: 100268 - DNA, 25 bp, Homo sapien
actacgtgatctgattgagatgtac

SEQ ID NO: 100269 - DNA, 25 bp, Homo sapien
ccaaatgattagttgatgtatgttt

SEQ ID NO: 100270 - DNA, 25 bp, Homo sapien
gttatccatgatgttgaacatggga

SEQ ID NO: 100271 - DNA, 25 bp, Homo sapien
gaggcatttttaatggaccaaattt

SEQ ID NO: 100272 - DNA, 25 bp, Homo sapien
aagttctgtatactgttttgaatga

SEQ ID NO: 100273 - DNA, 25 bp, Homo sapien
ctttatttgcagctattctggatgt

SEQ ID NO: 100274 - DNA, 25 bp, Homo sapien
tttgcagctattctggatgtcagtt

SEQ ID NO: 100275 - DNA, 25 bp, Homo sapien
attttattgcttgctaattgtgcct

SEQ ID NO: 100276 - DNA, 25 bp, Homo sapien
attgcttgctaattgtgcctttccg

SEQ ID NO: 100277 - DNA, 25 bp, Homo sapien
taattgtgcctttccgttgctaaat

SEQ ID NO: 100278 - DNA, 25 bp, Homo sapien
ttgtgcctttccgttgctaaattaa

SEQ ID NO: 100279 - DNA, 25 bp, Homo sapien
gtgcctttccgttgctaaattaaga

SEQ ID NO: 100280 - DNA, 25 bp, Homo sapien
gaaatgctatgtgtactgtgatgta

SEQ ID NO: 100281 - DNA, 25 bp, Homo sapien
agactggcccatccatcttatgagg

SEQ ID NO: 100282 - DNA, 25 bp, Homo sapien
actggcccatccatcttatgaggat

SEQ ID NO: 100283 - DNA, 25 bp, Homo sapien
tggcccatccatcttatgaggatcc

SEQ ID NO: 100284 - DNA, 25 bp, Homo sapien
gcccatccatcttatgaggatccca

SEQ ID NO: 100285 - DNA, 25 bp, Homo sapien
tccatcttatgaggatcccagccag

SEQ ID NO: 100286 - DNA, 25 bp, Homo sapien
atcttatgaggatcccagccagggc

SEQ ID NO: 100287 - DNA, 25 bp, Homo sapien
tcttatgaggatcccagccagggct

SEQ ID NO: 100288 - DNA, 25 bp, Homo sapien
ggctggctatgggagtctgagtgtg

SEQ ID NO: 100289 - DNA, 25 bp, Homo sapien
gagtctgagtgtgcacaagcagtga

SEQ ID NO: 100290 - DNA, 25 bp, Homo sapien
gtctgagtgtgcacaagcagtgaaa

SEQ ID NO: 100291 - DNA, 25 bp, Homo sapien
acaagcagtgaaagaggatccagcc

SEQ ID NO: 100292 - DNA, 25 bp, Homo sapien
ggtgagttgcacttggtgttccaat

SEQ ID NO: 100293 - DNA, 25 bp, Homo sapien
gtgttccaatgcacccatttgttgg

SEQ ID NO: 100294 - DNA, 25 bp, Homo sapien
gcaatatgggttcacattctgctaa

SEQ ID NO: 100295 - DNA, 25 bp, Homo sapien
attctgctaaataacacttgcctgg

SEQ ID NO: 100296 - DNA, 25 bp, Homo sapien
ataacacttgcctgggtatttcctg

SEQ ID NO: 100297 - DNA, 25 bp, Homo sapien
gggtatttcctgctgattctaactc

SEQ ID NO: 100298 - DNA, 25 bp, Homo sapien
gctgattctaactcataatagcaaa

SEQ ID NO: 100299 - DNA, 25 bp, Homo sapien
tattataaatcctaaacctggcttt

SEQ ID NO: 100300 - DNA, 25 bp, Homo sapien
agggcaattttgtgttctaccagca

SEQ ID NO: 100301 - DNA, 25 bp, Homo sapien
gtgttctaccagcaagttaagattt

SEQ ID NO: 100302 - DNA, 25 bp, Homo sapien
gatttattctccctaactgtattca

SEQ ID NO: 100303 - DNA, 25 bp, Homo sapien
acagagctgtttgaccagatggcca

SEQ ID NO: 100304 - DNA, 25 bp, Homo sapien
gctgtttgaccagatggccaggcct

SEQ ID NO: 100305 - DNA, 25 bp, Homo sapien
gggcgctcatgtggatcatgctcat

SEQ ID NO: 100306 - DNA, 25 bp, Homo sapien
tgtggatcatgctcatcctggtcgg

SEQ ID NO: 100307 - DNA, 25 bp, Homo sapien
atgctcatcctggtcggcctgggat

SEQ ID NO: 100308 - DNA, 25 bp, Homo sapien
cggcctgggatttccctttatcatg

SEQ ID NO: 100309 - DNA, 25 bp, Homo sapien
ctatgtccctttccttggtgtctgt

SEQ ID NO: 100310 - DNA, 25 bp, Homo sapien
gagaccaaaggcaagaccttccaag

SEQ ID NO: 100311 - DNA, 25 bp, Homo sapien
ggcaagaccttccaagagatctcca

SEQ ID NO: 100312 - DNA, 25 bp, Homo sapien
gatctccaaggaattacacagactc

SEQ ID NO: 100313 - DNA, 25 bp, Homo sapien
aattacacagactcaacttccccag

SEQ ID NO: 100314 - DNA, 25 bp, Homo sapien
ggacagaatggctttattccctcta

SEQ ID NO: 100315 - DNA, 25 bp, Homo sapien
ggctttattccctctaatgaagtga

SEQ ID NO: 100316 - DNA, 25 bp, Homo sapien
gaagtgagcttagcagccatagcaa

SEQ ID NO: 100317 - DNA, 25 bp, Homo sapien
tagcaagcagctcaaacacggaatt

SEQ ID NO: 100318 - DNA, 25 bp, Homo sapien
gaatttgaaacacatgctccagatc

SEQ ID NO: 100319 - DNA, 25 bp, Homo sapien
gctacccacagcagattgaaccaag

SEQ ID NO: 100320 - DNA, 25 bp, Homo sapien
tgaaccaagctttgagccagaggat

SEQ ID NO: 100321 - DNA, 25 bp, Homo sapien
gcagattccaaaagctgttcctaat

SEQ ID NO: 100322 - DNA, 25 bp, Homo sapien
gctgttcctaatactgagagcctgg

SEQ ID NO: 100323 - DNA, 25 bp, Homo sapien
tactgagagcctggagtcattaaca

SEQ ID NO: 100324 - DNA, 25 bp, Homo sapien
gagctaagctttgagtctggacaga

SEQ ID NO: 100325 - DNA, 25 bp, Homo sapien
gtagcttagcaatataacatggaca

SEQ ID NO: 100326 - DNA, 25 bp, Homo sapien
ggacatgtcgtcagtttggtaaata

SEQ ID NO: 100327 - DNA, 25 bp, Homo sapien
tattgtattgcatcgttacttaaat

SEQ ID NO: 100328 - DNA, 25 bp, Homo sapien
acttaaatgcttgtatagggtctta

SEQ ID NO: 100329 - DNA, 25 bp, Homo sapien
tatagggtcttattgtatgagtaca

SEQ ID NO: 100330 - DNA, 25 bp, Homo sapien
gtatgagtacattgcaatttgttca

SEQ ID NO: 100331 - DNA, 25 bp, Homo sapien
gcaatttgttcaattccctgttctt

SEQ ID NO: 100332 - DNA, 25 bp, Homo sapien
aattccctgttcttgaacttttatg

SEQ ID NO: 100333 - DNA, 25 bp, Homo sapien
ggaattttatgcagtgttgtgatta

SEQ ID NO: 100334 - DNA, 25 bp, Homo sapien
tttaactacatttgcttttaagtct

SEQ ID NO: 100335 - DNA, 25 bp, Homo sapien
ttaagtctttattttctgatctcag

SEQ ID NO: 100336 - DNA, 25 bp, Homo sapien
atcacaatactccttcttccttcag

SEQ ID NO: 100337 - DNA, 25 bp, Homo sapien
ttcttccttcaggtccctgggtgaa

SEQ ID NO: 100338 - DNA, 25 bp, Homo sapien
cttcaggtccctgggtgaaggcttt

SEQ ID NO: 100339 - DNA, 25 bp, Homo sapien
tgccccgttggatgccctgactggg

SEQ ID NO: 100340 - DNA, 25 bp, Homo sapien
actgagcaggctgttccgggccttt

SEQ ID NO: 100341 - DNA, 25 bp, Homo sapien
tgttccgggcctttggctttgcatc

SEQ ID NO: 100342 - DNA, 25 bp, Homo sapien
agtgtcctgtcagggaccagatgtg

SEQ ID NO: 100343 - DNA, 25 bp, Homo sapien
agggaccagatgtgtcctgcctcat

SEQ ID NO: 100344 - DNA, 25 bp, Homo sapien
gatgtgtcctgcctcatccctagct

SEQ ID NO: 100345 - DNA, 25 bp, Homo sapien
gggattctggttgcaataaaacatg

SEQ ID NO: 100346 - DNA, 25 bp, Homo sapien
gttgcaataaaacatgctgctgctg

SEQ ID NO: 100347 - DNA, 25 bp, Homo sapien
ggagattctcaatcacttgacattc

SEQ ID NO: 100348 - DNA, 25 bp, Homo sapien
tgacattccaaacactgctgattct

SEQ ID NO: 100349 - DNA, 25 bp, Homo sapien
gctgtcctttgagccagggttggtc

SEQ ID NO: 100350 - DNA, 25 bp, Homo sapien
tttgagccagggttggtcagaacct

SEQ ID NO: 100351 - DNA, 25 bp, Homo sapien
ggtcagaacctgtaataatcctgtt

SEQ ID NO: 100352 - DNA, 25 bp, Homo sapien
gtaataatcctgtttgtcctccaaa

SEQ ID NO: 100353 - DNA, 25 bp, Homo sapien
taatcctgtttgtcctccaaatcac

SEQ ID NO: 100354 - DNA, 25 bp, Homo sapien
gtgtccctaacgaacaatctcattg

SEQ ID NO: 100355 - DNA, 25 bp, Homo sapien
aatctcattggtaggcgggttccca

SEQ ID NO: 100356 - DNA, 25 bp, Homo sapien
attggtaggcgggttcccacagatc

SEQ ID NO: 100357 - DNA, 25 bp, Homo sapien
gggttcccacagatcttcagatcta

SEQ ID NO: 100358 - DNA, 25 bp, Homo sapien
ctggaattacaaatgtgctgggtgt

SEQ ID NO: 100359 - DNA, 25 bp, Homo sapien
tggaattacaaatgtgctgggtgtg

SEQ ID NO: 100360 - DNA, 25 bp, Homo sapien
gtaatcccaacacctgggtgtggtg

SEQ ID NO: 100361 - DNA, 25 bp, Homo sapien
caatatgacaagacctcatctatcc

SEQ ID NO: 100362 - DNA, 25 bp, Homo sapien
aatgaaatagagactgggaaaacca

SEQ ID NO: 100363 - DNA, 25 bp, Homo sapien
aagctggttctttggaaagatcaac

SEQ ID NO: 100364 - DNA, 25 bp, Homo sapien
caaacctttagctaaacatatcagg

SEQ ID NO: 100365 - DNA, 25 bp, Homo sapien
aacctttagctaaacatatcagggt

SEQ ID NO: 100366 - DNA, 25 bp, Homo sapien
cctttagctaaacatatcagggtaa

SEQ ID NO: 100367 - DNA, 25 bp, Homo sapien
tagctaaacatatcagggtaaaaag

SEQ ID NO: 100368 - DNA, 25 bp, Homo sapien
gagaaaacattcaaattactggaat

SEQ ID NO: 100369 - DNA, 25 bp, Homo sapien
gaaacagtaaatgttctcgcttcag

SEQ ID NO: 100370 - DNA, 25 bp, Homo sapien
tctcgcttcagaacttaattcatct

SEQ ID NO: 100371 - DNA, 25 bp, Homo sapien
taattcatctaatccctcctgtttg

SEQ ID NO: 100372 - DNA, 25 bp, Homo sapien
atctaatccctcctgtttgtctcaa

SEQ ID NO: 100373 - DNA, 25 bp, Homo sapien
ttttagtctctatcttcaggttatt

SEQ ID NO: 100374 - DNA, 25 bp, Homo sapien
gttattatcacttaaaaacctgcga

SEQ ID NO: 100375 - DNA, 25 bp, Homo sapien
aaacctgcgaaagctgtcaactttt

SEQ ID NO: 100376 - DNA, 25 bp, Homo sapien
gtcaacttttgtggttgtagcaagt

SEQ ID NO: 100377 - DNA, 25 bp, Homo sapien
aatcctctaatgtaagtctagctac

SEQ ID NO: 100378 - DNA, 25 bp, Homo sapien
aagtctagctacctatccaatacta

SEQ ID NO: 100379 - DNA, 25 bp, Homo sapien
aagtattaaatgcactatctgctgt

SEQ ID NO: 100380 - DNA, 25 bp, Homo sapien
ccaattttattggactaaatagtca

SEQ ID NO: 100381 - DNA, 25 bp, Homo sapien
ggactaaatagtcaaaacaatgttt

SEQ ID NO: 100382 - DNA, 25 bp, Homo sapien
tgcttttgctccctaagtgccccag

SEQ ID NO: 100383 - DNA, 25 bp, Homo sapien
gcttttgctccctaagtgccccaga

SEQ ID NO: 100384 - DNA, 25 bp, Homo sapien
tttgctccctaagtgccccagaatt

SEQ ID NO: 100385 - DNA, 25 bp, Homo sapien
ttgctccctaagtgccccagaattg

SEQ ID NO: 100386 - DNA, 25 bp, Homo sapien
aagtgccccagaattgggaaactat

SEQ ID NO: 100387 - DNA, 25 bp, Homo sapien
gaaactattcaggagtattcatatg

SEQ ID NO: 100388 - DNA, 25 bp, Homo sapien
actattcaggagtattcatatgttt

SEQ ID NO: 100389 - DNA, 25 bp, Homo sapien
ggtaataaagttatctgcacaagtg

SEQ ID NO: 100390 - DNA, 25 bp, Homo sapien
gtaataaagttatctgcacaagtgc

SEQ ID NO: 100391 - DNA, 25 bp, Homo sapien
acgactttggcgagtgctgctgcgc

SEQ ID NO: 100392 - DNA, 25 bp, Homo sapien
atccgcaccggcatgcgggagcgct

SEQ ID NO: 100393 - DNA, 25 bp, Homo sapien
tgcgggagcgctaccacatccaggg

SEQ ID NO: 100394 - DNA, 25 bp, Homo sapien
acatccagggctccgtcgggcacga

SEQ ID NO: 100395 - DNA, 25 bp, Homo sapien
gactgggcggccctcaccttttgtc

SEQ ID NO: 100396 - DNA, 25 bp, Homo sapien
gccctctgccagatggcgcgggaac

SEQ ID NO: 100397 - DNA, 25 bp, Homo sapien
gcgggaactgaagatccgagagtaa

SEQ ID NO: 100398 - DNA, 25 bp, Homo sapien
gatccgagagtaaggaagttccctg

SEQ ID NO: 100399 - DNA, 25 bp, Homo sapien
gagagtaaggaagttccctgtcttc

SEQ ID NO: 100400 - DNA, 25 bp, Homo sapien
actcctgggagggactgcctcacca

SEQ ID NO: 100401 - DNA, 25 bp, Homo sapien
gctgccagaaatacacccacaataa

SEQ ID NO: 100402 - DNA, 25 bp, Homo sapien
cagttctgaatctgtaacacttaca

SEQ ID NO: 100403 - DNA, 25 bp, Homo sapien
aacccagagcagcttgatgagtttt

SEQ ID NO: 100404 - DNA, 25 bp, Homo sapien
cagagcagcttgatgagtttttgtt

SEQ ID NO: 100405 - DNA, 25 bp, Homo sapien
gagtttttgtttctgcttcgttcct

SEQ ID NO: 100406 - DNA, 25 bp, Homo sapien
gtttctgcttcgttcctgggagtca

SEQ ID NO: 100407 - DNA, 25 bp, Homo sapien
tgcttcgttcctgggagtcagtaga

SEQ ID NO: 100408 - DNA, 25 bp, Homo sapien
gggagtcagtagaaacagcagttgt

SEQ ID NO: 100409 - DNA, 25 bp, Homo sapien
gcagttgtatgtggttatgttagtc

SEQ ID NO: 100410 - DNA, 25 bp, Homo sapien
ggttatgttagtctcaagatactta

SEQ ID NO: 100411 - DNA, 25 bp, Homo sapien
acttaatttgttgaccttacttcag

SEQ ID NO: 100412 - DNA, 25 bp, Homo sapien
tttgttgaccttacttcagaaaaat

SEQ ID NO: 100413 - DNA, 25 bp, Homo sapien
cttgctccgtgatgtctttcacaca

SEQ ID NO: 100414 - DNA, 25 bp, Homo sapien
ttattaaccagaacctacgcaccta

SEQ ID NO: 100415 - DNA, 25 bp, Homo sapien
agaacctacgcacctacgtgaggag

SEQ ID NO: 100416 - DNA, 25 bp, Homo sapien
acctacgtgaggagcttagccagaa

SEQ ID NO: 100417 - DNA, 25 bp, Homo sapien
agaaatgggatggactgaacggaca

SEQ ID NO: 100418 - DNA, 25 bp, Homo sapien
gaacggacagttccagaagtgtgac

SEQ ID NO: 100419 - DNA, 25 bp, Homo sapien
tccagaagtgtgactggctaaagct

SEQ ID NO: 100420 - DNA, 25 bp, Homo sapien
agctgtatagctgcttccagtgtag

SEQ ID NO: 100421 - DNA, 25 bp, Homo sapien
agtgtagacggagccctggcatgtc

SEQ ID NO: 100422 - DNA, 25 bp, Homo sapien
tggcatgtcaacagcgttcctagag

SEQ ID NO: 100423 - DNA, 25 bp, Homo sapien
ggaagatagctgtgacttctatttt

SEQ ID NO: 100424 - DNA, 25 bp, Homo sapien
tcacatttatgtggcttgtttatcc

SEQ ID NO: 100425 - DNA, 25 bp, Homo sapien
ggcttgtttatccttagctcacaga

SEQ ID NO: 100426 - DNA, 25 bp, Homo sapien
ggtaataatgacactcctagacttt

SEQ ID NO: 100427 - DNA, 25 bp, Homo sapien
gacactcctagactttgggatcaaa

SEQ ID NO: 100428 - DNA, 25 bp, Homo sapien
taacttagggccaagtcttgggtct

SEQ ID NO: 100429 - DNA, 25 bp, Homo sapien
gttcacaacctagggcaagttactc

SEQ ID NO: 100430 - DNA, 25 bp, Homo sapien
agttactctgcctttctaagactca

SEQ ID NO: 100431 - DNA, 25 bp, Homo sapien
aagactcacttacatcttctgtgaa

SEQ ID NO: 100432 - DNA, 25 bp, Homo sapien
ataattgtaccaacctcatagagtt

SEQ ID NO: 100433 - DNA, 25 bp, Homo sapien
cctcatagagtttggtgtcaactaa

SEQ ID NO: 100434 - DNA, 25 bp, Homo sapien
atgtggactaaatatctgtcatata

SEQ ID NO: 100435 - DNA, 25 bp, Homo sapien
acaaaccagggcaagctaaacgctt

SEQ ID NO: 100436 - DNA, 25 bp, Homo sapien
gcaagctaaacgctttgggaagcaa

SEQ ID NO: 100437 - DNA, 25 bp, Homo sapien
tttgggaagcaatgtcatggtctct

SEQ ID NO: 100438 - DNA, 25 bp, Homo sapien
gaagcaatgtcatggtctctgcagc

SEQ ID NO: 100439 - DNA, 25 bp, Homo sapien
tcgctgagcctttctgaatctgtgt

SEQ ID NO: 100440 - DNA, 25 bp, Homo sapien
gctgagcctttctgaatctgtgtca

SEQ ID NO: 100441 - DNA, 25 bp, Homo sapien
gagcctttctgaatctgtgtcatcg

SEQ ID NO: 100442 - DNA, 25 bp, Homo sapien
ttctgaatctgtgtcatcgcctgta

SEQ ID NO: 100443 - DNA, 25 bp, Homo sapien
ctgaatctgtgtcatcgcctgtaac

SEQ ID NO: 100444 - DNA, 25 bp, Homo sapien
gggaccagtaaacataagttcctca

SEQ ID NO: 100445 - DNA, 25 bp, Homo sapien
cagtaaacataagttcctcaggaga

SEQ ID NO: 100446 - DNA, 25 bp, Homo sapien
taccagggagcgatgggaaaatcct

SEQ ID NO: 100447 - DNA, 25 bp, Homo sapien
gaaaatcctttgatgggttgggcat

SEQ ID NO: 100448 - DNA, 25 bp, Homo sapien
ggttgggcatcaacggctgatccct

SEQ ID NO: 100449 - DNA, 25 bp, Homo sapien
ggctgatcccttatccaacatggtt

SEQ ID NO: 100450 - DNA, 25 bp, Homo sapien
gatcccttatccaacatggttctaa

SEQ ID NO: 100451 - DNA, 25 bp, Homo sapien
atggttctaaccttcagtactaaag

SEQ ID NO: 100452 - DNA, 25 bp, Homo sapien
agtcttatggtgcaaacttttcttg

SEQ ID NO: 100453 - DNA, 25 bp, Homo sapien
tggtgcaaacttttcttggaacaaa

SEQ ID NO: 100454 - DNA, 25 bp, Homo sapien
gaacaagagtatccacaaaataggt

SEQ ID NO: 100455 - DNA, 25 bp, Homo sapien
taggttggcactgactatatctctg

SEQ ID NO: 100456 - DNA, 25 bp, Homo sapien
gactatatctctgcttgactgtgaa

SEQ ID NO: 100457 - DNA, 25 bp, Homo sapien
ttgagtggtttcactttgcctgcgt

SEQ ID NO: 100458 - DNA, 25 bp, Homo sapien
agtggtttcactttgcctgcgtgga

SEQ ID NO: 100459 - DNA, 25 bp, Homo sapien
tttcactttgcctgcgtggacctta

SEQ ID NO: 100460 - DNA, 25 bp, Homo sapien
ttgcctgcgtggaccttaccacgaa

SEQ ID NO: 100461 - DNA, 25 bp, Homo sapien
tgcgtggaccttaccacgaaaccca

SEQ ID NO: 100462 - DNA, 25 bp, Homo sapien
ataaaaacctgtagtctgggcaaca

SEQ ID NO: 100463 - DNA, 25 bp, Homo sapien
aaaacctgtagtctgggcaacatcg

SEQ ID NO: 100464 - DNA, 25 bp, Homo sapien
aacctgtagtctgggcaacatcggg

SEQ ID NO: 100465 - DNA, 25 bp, Homo sapien
tgtagtctgggcaacatcgggagac

SEQ ID NO: 100466 - DNA, 25 bp, Homo sapien
cttgagcctggaagtccgaggcttc

SEQ ID NO: 100467 - DNA, 25 bp, Homo sapien
tgagcctggaagtccgaggcttcag

SEQ ID NO: 100468 - DNA, 25 bp, Homo sapien
agatctgtaaagcatgactttcaag

SEQ ID NO: 100469 - DNA, 25 bp, Homo sapien
gcatgactttcaaggatggttctta

SEQ ID NO: 100470 - DNA, 25 bp, Homo sapien
gtaaagtgttgggtcttcctccagg

SEQ ID NO: 100471 - DNA, 25 bp, Homo sapien
gcatgggaccccacccggagctggt

SEQ ID NO: 100472 - DNA, 25 bp, Homo sapien
ctggtgtggccattccccgaagtgc

SEQ ID NO: 100473 - DNA, 25 bp, Homo sapien
cgaagtgccactggcccatggatgg

SEQ ID NO: 100474 - DNA, 25 bp, Homo sapien
cttccaggatctgtgtcatttccca

SEQ ID NO: 100475 - DNA, 25 bp, Homo sapien
gggcacaggctggagtattcttagt

SEQ ID NO: 100476 - DNA, 25 bp, Homo sapien
gtattcttagttctactggttctac

SEQ ID NO: 100477 - DNA, 25 bp, Homo sapien
gttctactggttctacactgtgagg

SEQ ID NO: 100478 - DNA, 25 bp, Homo sapien
tacactgtgaggtggcaatgggatt

SEQ ID NO: 100479 - DNA, 25 bp, Homo sapien
gagtggtttcactttgcctgcgtgg

SEQ ID NO: 100480 - DNA, 25 bp, Homo sapien
agtggtttcactttgcctgcgtgga

SEQ ID NO: 100481 - DNA, 25 bp, Homo sapien
tttcactttgcctgcgtggacctta

SEQ ID NO: 100482 - DNA, 25 bp, Homo sapien
ttcactttgcctgcgtggaccttac

SEQ ID NO: 100483 - DNA, 25 bp, Homo sapien
tcactttgcctgcgtggaccttacc

SEQ ID NO: 100484 - DNA, 25 bp, Homo sapien
actttgcctgcgtggaccttaccac

SEQ ID NO: 100485 - DNA, 25 bp, Homo sapien
tttgcctgcgtggaccttaccacga

SEQ ID NO: 100486 - DNA, 25 bp, Homo sapien
ttgcctgcgtggaccttaccacgaa

SEQ ID NO: 100487 - DNA, 25 bp, Homo sapien
tgcctgcgtggaccttaccacgaaa

SEQ ID NO: 100488 - DNA, 25 bp, Homo sapien
gcctgcgtggaccttaccacgaaac

SEQ ID NO: 100489 - DNA, 25 bp, Homo sapien
tgcgtggaccttaccacgaaaccca

SEQ ID NO: 100490 - DNA, 25 bp, Homo sapien
catgggtttccttattgaaaaatca

SEQ ID NO: 100491 - DNA, 25 bp, Homo sapien
ggtttccttattgaaaaatcagtgt

SEQ ID NO: 100492 - DNA, 25 bp, Homo sapien
gtattagtcataaaacaccatcatt

SEQ ID NO: 100493 - DNA, 25 bp, Homo sapien
gtcataaaacaccatcattaagaat

SEQ ID NO: 100494 - DNA, 25 bp, Homo sapien
tttcagatgcagttttcaaattata

SEQ ID NO: 100495 - DNA, 25 bp, Homo sapien
gcagttttcaaattataatctcatt

SEQ ID NO: 100496 - DNA, 25 bp, Homo sapien
catttcaatttataacgttctcagt

SEQ ID NO: 100497 - DNA, 25 bp, Homo sapien
aatttataacgttctcagtcctttg

SEQ ID NO: 100498 - DNA, 25 bp, Homo sapien
tttataacgttctcagtcctttgtt

SEQ ID NO: 100499 - DNA, 25 bp, Homo sapien
aacgttctcagtcctttgttataat

SEQ ID NO: 100500 - DNA, 25 bp, Homo sapien
tcagtcctttgttataattttcctt

SEQ ID NO: 100501 - DNA, 25 bp, Homo sapien
tactgaccagctcccgttgggccag

SEQ ID NO: 100502 - DNA, 25 bp, Homo sapien
gagcacaggctccagcaatatgtct

SEQ ID NO: 100503 - DNA, 25 bp, Homo sapien
ggctccagcaatatgtctgcattga

SEQ ID NO: 100504 - DNA, 25 bp, Homo sapien
atatgtctgcattgaaaagaaccaa

SEQ ID NO: 100505 - DNA, 25 bp, Homo sapien
tcatacacatgggaggaaaacctta

SEQ ID NO: 100506 - DNA, 25 bp, Homo sapien
aaccttatatactgagcattgtgca

SEQ ID NO: 100507 - DNA, 25 bp, Homo sapien
gcattgtgcaggactgatagctctt

SEQ ID NO: 100508 - DNA, 25 bp, Homo sapien
gatagctcttctttattgacttaaa

SEQ ID NO: 100509 - DNA, 25 bp, Homo sapien
attcttgtgaagtttccccagcacc

SEQ ID NO: 100510 - DNA, 25 bp, Homo sapien
gtgacttctctgataaagcgtctga

SEQ ID NO: 100511 - DNA, 25 bp, Homo sapien
aaagcgtctgatctaatcccagcac

SEQ ID NO: 100512 - DNA, 25 bp, Homo sapien
agtatagaaaaagcgcattgaacag

SEQ ID NO: 100513 - DNA, 25 bp, Homo sapien
gtatagaaaaagcgcattgaacagt

SEQ ID NO: 100514 - DNA, 25 bp, Homo sapien
atagaaaaagcgcattgaacagtcc

SEQ ID NO: 100515 - DNA, 25 bp, Homo sapien
tagaaaaagcgcattgaacagtcct

SEQ ID NO: 100516 - DNA, 25 bp, Homo sapien
tgaacagtcctgggcactacatgta

SEQ ID NO: 100517 - DNA, 25 bp, Homo sapien
gaacagtcctgggcactacatgtaa

SEQ ID NO: 100518 - DNA, 25 bp, Homo sapien
aacagtcctgggcactacatgtaaa

SEQ ID NO: 100519 - DNA, 25 bp, Homo sapien
acagtcctgggcactacatgtaaat

SEQ ID NO: 100520 - DNA, 25 bp, Homo sapien
cagtcctgggcactacatgtaaatt

SEQ ID NO: 100521 - DNA, 25 bp, Homo sapien
agtcctgggcactacatgtaaatta

SEQ ID NO: 100522 - DNA, 25 bp, Homo sapien
gtcctgggcactacatgtaaattaa

SEQ ID NO: 100523 - DNA, 25 bp, Homo sapien
ccaccaacaggaccaaggaccgaga

SEQ ID NO: 100524 - DNA, 25 bp, Homo sapien
ggaccaaggaccgagacacagacat

SEQ ID NO: 100525 - DNA, 25 bp, Homo sapien
agacacagacatggaaggacttcag

SEQ ID NO: 100526 - DNA, 25 bp, Homo sapien
aggacttcagataccatcttattct

SEQ ID NO: 100527 - DNA, 25 bp, Homo sapien
atcttattctagagacgtagctgac

SEQ ID NO: 100528 - DNA, 25 bp, Homo sapien
ctagagacgtagctgaccaaaaagt

SEQ ID NO: 100529 - DNA, 25 bp, Homo sapien
gggctgggtctgcaaattaataaat

SEQ ID NO: 100530 - DNA, 25 bp, Homo sapien
ctgcctgtgggttccggtgtggtgc

SEQ ID NO: 100531 - DNA, 25 bp, Homo sapien
gtggtgcagtcgctggcctaccacc

SEQ ID NO: 100532 - DNA, 25 bp, Homo sapien
atgggaggcagcgtccagtgctggc

SEQ ID NO: 100533 - DNA, 25 bp, Homo sapien
ccagtgctggcgagaggaggcctat

SEQ ID NO: 100534 - DNA, 25 bp, Homo sapien
ttgtcaaatcatggccaaatcgcag

SEQ ID NO: 100535 - DNA, 25 bp, Homo sapien
tcaaatcatggccaaatcgcagtga

SEQ ID NO: 100536 - DNA, 25 bp, Homo sapien
tcatggccaaatcgcagtgatagtt

SEQ ID NO: 100537 - DNA, 25 bp, Homo sapien
tggccaaatcgcagtgatagttgac

SEQ ID NO: 100538 - DNA, 25 bp, Homo sapien
cgcagtgatagttgactttggatac

SEQ ID NO: 100539 - DNA, 25 bp, Homo sapien
gttgactttggatacaaggtttggc

SEQ ID NO: 100540 - DNA, 25 bp, Homo sapien
gactttggatacaaggtttggcaaa

SEQ ID NO: 100541 - DNA, 25 bp, Homo sapien
gttgtgtgcaacaaacatacccttt

SEQ ID NO: 100542 - DNA, 25 bp, Homo sapien
tgtgtgcaacaaacataccctttat

SEQ ID NO: 100543 - DNA, 25 bp, Homo sapien
gcaacaaacataccctttatctctg

SEQ ID NO: 100544 - DNA, 25 bp, Homo sapien
acaaacataccctttatctctgtaa

SEQ ID NO: 100545 - DNA, 25 bp, Homo sapien
aaataggaggcttaaaattgactgc

SEQ ID NO: 100546 - DNA, 25 bp, Homo sapien
ataggaggcttaaaattgactgcca

SEQ ID NO: 100547 - DNA, 25 bp, Homo sapien
taggaggcttaaaattgactgccag

SEQ ID NO: 100548 - DNA, 25 bp, Homo sapien
ggaggcttaaaattgactgccaggc

SEQ ID NO: 100549 - DNA, 25 bp, Homo sapien
gaggcttaaaattgactgccaggct

SEQ ID NO: 100550 - DNA, 25 bp, Homo sapien
aggcttaaaattgactgccaggctg

SEQ ID NO: 100551 - DNA, 25 bp, Homo sapien
ggcttaaaattgactgccaggctgg

SEQ ID NO: 100552 - DNA, 25 bp, Homo sapien
gcttaaaattgactgccaggctggg

SEQ ID NO: 100553 - DNA, 25 bp, Homo sapien
cttaaaattgactgccaggctgggt

SEQ ID NO: 100554 - DNA, 25 bp, Homo sapien
ttaaaattgactgccaggctgggtg

SEQ ID NO: 100555 - DNA, 25 bp, Homo sapien
aaaattgactgccaggctgggtgca

SEQ ID NO: 100556 - DNA, 25 bp, Homo sapien
tttacatccatttcacatgtaagag

SEQ ID NO: 100557 - DNA, 25 bp, Homo sapien
acatccatttcacatgtaagagaca

SEQ ID NO: 100558 - DNA, 25 bp, Homo sapien
aaaagtctagattggtcttgatatt

SEQ ID NO: 100559 - DNA, 25 bp, Homo sapien
agtagcattaagaaaggtaacaatc

SEQ ID NO: 100560 - DNA, 25 bp, Homo sapien
aacaatcttcattctacagatgaac

SEQ ID NO: 100561 - DNA, 25 bp, Homo sapien
tcattctacagatgaactcattgaa

SEQ ID NO: 100562 - DNA, 25 bp, Homo sapien
gatgaactcattgaaacaatttagg

SEQ ID NO: 100563 - DNA, 25 bp, Homo sapien
gcgtgcgtttcagtgtttaagaagg

SEQ ID NO: 100564 - DNA, 25 bp, Homo sapien
gtgcgtttcagtgtttaagaaggct

SEQ ID NO: 100565 - DNA, 25 bp, Homo sapien
cgtttcagtgtttaagaaggcttga

SEQ ID NO: 100566 - DNA, 25 bp, Homo sapien
tcagtgtttaagaaggcttgataaa

SEQ ID NO: 100567 - DNA, 25 bp, Homo sapien
aagacttagatgcaccctggatggg

SEQ ID NO: 100568 - DNA, 25 bp, Homo sapien
tgggaattcagaatcttcagagatc

SEQ ID NO: 100569 - DNA, 25 bp, Homo sapien
gaatcttcagagatcagagtccagt

SEQ ID NO: 100570 - DNA, 25 bp, Homo sapien
cttcagagatcagagtccagtaaaa

SEQ ID NO: 100571 - DNA, 25 bp, Homo sapien
gctctgtagcaggactttctagccc

SEQ ID NO: 100572 - DNA, 25 bp, Homo sapien
gtagcaggactttctagcccagagt

SEQ ID NO: 100573 - DNA, 25 bp, Homo sapien
caggactttctagcccagagttgaa

SEQ ID NO: 100574 - DNA, 25 bp, Homo sapien
ttctagcccagagttgaaagtcaga

SEQ ID NO: 100575 - DNA, 25 bp, Homo sapien
ccagagttgaaagtcagacctgctg

SEQ ID NO: 100576 - DNA, 25 bp, Homo sapien
agcagctaacaaaatctctaaaagg

SEQ ID NO: 100577 - DNA, 25 bp, Homo sapien
ggttactaagcttatgaaaacaatg

SEQ ID NO: 100578 - DNA, 25 bp, Homo sapien
aagaaacgagccagtgactgaaaca

SEQ ID NO: 100579 - DNA, 25 bp, Homo sapien
acctgttgacagaccttccactttc

SEQ ID NO: 100580 - DNA, 25 bp, Homo sapien
tgttgacagaccttccactttctct

SEQ ID NO: 100581 - DNA, 25 bp, Homo sapien
gttgacagaccttccactttctctt

SEQ ID NO: 100582 - DNA, 25 bp, Homo sapien
aacagtcaactcacacaaagaatgg

SEQ ID NO: 100583 - DNA, 25 bp, Homo sapien
gtcaactcacacaaagaatggaaaa

SEQ ID NO: 100584 - DNA, 25 bp, Homo sapien
ctgagttaaattaagcaaatacctt

SEQ ID NO: 100585 - DNA, 25 bp, Homo sapien
taagcaaataccttttacaagtgaa

SEQ ID NO: 100586 - DNA, 25 bp, Homo sapien
tttcttctgccgtcaataaaaccat

SEQ ID NO: 100587 - DNA, 25 bp, Homo sapien
ttcttctgccgtcaataaaaccatt

SEQ ID NO: 100588 - DNA, 25 bp, Homo sapien
cttctgccgtcaataaaaccattgt

SEQ ID NO: 100589 - DNA, 25 bp, Homo sapien
aactaagttcaatgctttggaaaga

SEQ ID NO: 100590 - DNA, 25 bp, Homo sapien
ggaaatcaaatgtgatgcattagga

SEQ ID NO: 100591 - DNA, 25 bp, Homo sapien
gcattaggaatgtaacttatgtgaa

SEQ ID NO: 100592 - DNA, 25 bp, Homo sapien
aaaagagtctgtgaaatcccagggt

SEQ ID NO: 100593 - DNA, 25 bp, Homo sapien
tgtgaaatcccagggtgtggcctca

SEQ ID NO: 100594 - DNA, 25 bp, Homo sapien
gaaatcccagggtgtggcctcacgc

SEQ ID NO: 100595 - DNA, 25 bp, Homo sapien
gggtgtggcctcacgctcaaagaaa

SEQ ID NO: 100596 - DNA, 25 bp, Homo sapien
tgtggcctcacgctcaaagaaaagg

SEQ ID NO: 100597 - DNA, 25 bp, Homo sapien
acgctcaaagaaaaggccttggcct

SEQ ID NO: 100598 - DNA, 25 bp, Homo sapien
ttggccttacaacacatcaccagag

SEQ ID NO: 100599 - DNA, 25 bp, Homo sapien
cttacaacacatcaccagagtggtg

SEQ ID NO: 100600 - DNA, 25 bp, Homo sapien
ggaaacaagaatcccaagggcccag

SEQ ID NO: 100601 - DNA, 25 bp, Homo sapien
ccaggaaaaccccatcttgatgcat

SEQ ID NO: 100602 - DNA, 25 bp, Homo sapien
tgatgcatgagttcccagataccct

SEQ ID NO: 100603 - DNA, 25 bp, Homo sapien
ctcttctggctttcacaggctgagc

SEQ ID NO: 100604 - DNA, 25 bp, Homo sapien
ggttttcctgtggaaggtctgagct

SEQ ID NO: 100605 - DNA, 25 bp, Homo sapien
ggaaggtctgagctctccccagaag

SEQ ID NO: 100606 - DNA, 25 bp, Homo sapien
agaaggcacttcctgtctgatgtcc

SEQ ID NO: 100607 - DNA, 25 bp, Homo sapien
ctgtctgatgtccaggatgtcacat

SEQ ID NO: 100608 - DNA, 25 bp, Homo sapien
atgtcacatgttcccttacccctgt

SEQ ID NO: 100609 - DNA, 25 bp, Homo sapien
ttacccctgtacctgtgaaggattg

SEQ ID NO: 100610 - DNA, 25 bp, Homo sapien
aggattggcagtgcttgtgcctgac

SEQ ID NO: 100611 - DNA, 25 bp, Homo sapien
ctcaactctaaattcaacaagatgt

SEQ ID NO: 100612 - DNA, 25 bp, Homo sapien
attcaacaagatgtgcaaaccggac

SEQ ID NO: 100613 - DNA, 25 bp, Homo sapien
atgtgcaaaccggacatgcaggtga

SEQ ID NO: 100614 - DNA, 25 bp, Homo sapien
gcaaaccggacatgcaggtgaatat

SEQ ID NO: 100615 - DNA, 25 bp, Homo sapien
ccggacatgcaggtgaatattttaa

SEQ ID NO: 100616 - DNA, 25 bp, Homo sapien
aataggttactataaggttctcaat

SEQ ID NO: 100617 - DNA, 25 bp, Homo sapien
actataaggttctcaattaaattct

SEQ ID NO: 100618 - DNA, 25 bp, Homo sapien
aattctttaatctgtccagtcccag

SEQ ID NO: 100619 - DNA, 25 bp, Homo sapien
tccagtcccagtttctcttattaat

SEQ ID NO: 100620 - DNA, 25 bp, Homo sapien
ccagtcccagtttctcttattaata

SEQ ID NO: 100621 - DNA, 25 bp, Homo sapien
tgtcactcatttgtagtaaaactta

SEQ ID NO: 100622 - DNA, 25 bp, Homo sapien
ccctgggcctgaagcgctactgctg

SEQ ID NO: 100623 - DNA, 25 bp, Homo sapien
atgctgctggcccacgtggacctga

SEQ ID NO: 100624 - DNA, 25 bp, Homo sapien
tggcccacgtggacctgatcgagaa

SEQ ID NO: 100625 - DNA, 25 bp, Homo sapien
agaagctgctcaattatgcacccct

SEQ ID NO: 100626 - DNA, 25 bp, Homo sapien
tgctcaattatgcacccctggagaa

SEQ ID NO: 100627 - DNA, 25 bp, Homo sapien
attatgcacccctggagaagtgacc

SEQ ID NO: 100628 - DNA, 25 bp, Homo sapien
ccgctgtgctgaccatgggccctga

SEQ ID NO: 100629 - DNA, 25 bp, Homo sapien
gcatccgggagctggcgtaatgcct

SEQ ID NO: 100630 - DNA, 25 bp, Homo sapien
agctggcgtaatgcctggccgcagt

SEQ ID NO: 100631 - DNA, 25 bp, Homo sapien
gcctggccgcagtgtgtgtgtatcc

SEQ ID NO: 100632 - DNA, 25 bp, Homo sapien
gtgtgtgtatcccataccccactct

SEQ ID NO: 100633 - DNA, 25 bp, Homo sapien
ggacacctgaaattgaattccagtt

SEQ ID NO: 100634 - DNA, 25 bp, Homo sapien
gaattccagttgtgtcgcttactac

SEQ ID NO: 100635 - DNA, 25 bp, Homo sapien
gcttactacctgtgcgactttaggt

SEQ ID NO: 100636 - DNA, 25 bp, Homo sapien
gcgactttaggtctggcacttaact

SEQ ID NO: 100637 - DNA, 25 bp, Homo sapien
gtctggcacttaactcatctgagtc

SEQ ID NO: 100638 - DNA, 25 bp, Homo sapien
tggtcaccacaataatcagctcgca

SEQ ID NO: 100639 - DNA, 25 bp, Homo sapien
aatcagctcgcagtctaacagaaca

SEQ ID NO: 100640 - DNA, 25 bp, Homo sapien
agaacaacctgtcaccactagaatc

SEQ ID NO: 100641 - DNA, 25 bp, Homo sapien
gaatcccacttgttggccttttata

SEQ ID NO: 100642 - DNA, 25 bp, Homo sapien
tccttaactcatagcaaccactgtg

SEQ ID NO: 100643 - DNA, 25 bp, Homo sapien
gcaaccactgtgtgttcactatctt

SEQ ID NO: 100644 - DNA, 25 bp, Homo sapien
ttcttcatcctccacggttcactag

SEQ ID NO: 100645 - DNA, 25 bp, Homo sapien
gttcactagctcctacctgaagagg

SEQ ID NO: 100646 - DNA, 25 bp, Homo sapien
gggccatttgacctgacatgtcagg

SEQ ID NO: 100647 - DNA, 25 bp, Homo sapien
caggaaagccctaaactgaatgttt

SEQ ID NO: 100648 - DNA, 25 bp, Homo sapien
aaactgaatgtttgcgcctgggctg

SEQ ID NO: 100649 - DNA, 25 bp, Homo sapien
gcatgaccaggctgcgtggacgtta

SEQ ID NO: 100650 - DNA, 25 bp, Homo sapien
tgcgtggacgttatactgtcttccc

SEQ ID NO: 100651 - DNA, 25 bp, Homo sapien
gagggaggcctcacaaaccacagga

SEQ ID NO: 100652 - DNA, 25 bp, Homo sapien
caaaccacaggacgctgcaacgggt

SEQ ID NO: 100653 - DNA, 25 bp, Homo sapien
acaggacgctgcaacgggtcaggct

SEQ ID NO: 100654 - DNA, 25 bp, Homo sapien
gggcccggcgtgctcatcatctctg

SEQ ID NO: 100655 - DNA, 25 bp, Homo sapien
gagccaaattgtaggcctccgacca

SEQ ID NO: 100656 - DNA, 25 bp, Homo sapien
aattgtaggcctccgaccagagggc

SEQ ID NO: 100657 - DNA, 25 bp, Homo sapien
gaaccaagggtagctctggctctct

SEQ ID NO: 100658 - DNA, 25 bp, Homo sapien
aggtggacgtcctttccagcatacc

SEQ ID NO: 100659 - DNA, 25 bp, Homo sapien
ctttccagcataccagggcttatgg

SEQ ID NO: 100660 - DNA, 25 bp, Homo sapien
ataccagggcttatggaggcaaaat

SEQ ID NO: 100661 - DNA, 25 bp, Homo sapien
gtgggaactccctactgttgtcctt

SEQ ID NO: 100662 - DNA, 25 bp, Homo sapien
tactgttgtcctttccttgggcaga

SEQ ID NO: 100663 - DNA, 25 bp, Homo sapien
ccttgggcagacaccatatactttt

SEQ ID NO: 100664 - DNA, 25 bp, Homo sapien
gacaccatatactttttagctccta

SEQ ID NO: 100665 - DNA, 25 bp, Homo sapien
tagctcctagcagtgtttatcccgt

SEQ ID NO: 100666 - DNA, 25 bp, Homo sapien
cacacattcatgtcgtgagttgcta

SEQ ID NO: 100667 - DNA, 25 bp, Homo sapien
cacattcatgtcgtgagttgctaag

SEQ ID NO: 100668 - DNA, 25 bp, Homo sapien
cattcatgtcgtgagttgctaagga

SEQ ID NO: 100669 - DNA, 25 bp, Homo sapien
ttcatgtcgtgagttgctaaggata

SEQ ID NO: 100670 - DNA, 25 bp, Homo sapien
catgtcgtgagttgctaaggatagc

SEQ ID NO: 100671 - DNA, 25 bp, Homo sapien
aaggatagcagacaagttcacccaa

SEQ ID NO: 100672 - DNA, 25 bp, Homo sapien
ggatagcagacaagttcacccaaca

SEQ ID NO: 100673 - DNA, 25 bp, Homo sapien
gatagcagacaagttcacccaacat

SEQ ID NO: 100674 - DNA, 25 bp, Homo sapien
tagcagacaagttcacccaacataa

SEQ ID NO: 100675 - DNA, 25 bp, Homo sapien
gcagacaagttcacccaacataact

SEQ ID NO: 100676 - DNA, 25 bp, Homo sapien
ttcacccaacataactttcaagagg

SEQ ID NO: 100677 - DNA, 25 bp, Homo sapien
cagatctgttatctagctgagttca

SEQ ID NO: 100678 - DNA, 25 bp, Homo sapien
gatctgttatctagctgagttcatt

SEQ ID NO: 100679 - DNA, 25 bp, Homo sapien
tctgttatctagctgagttcatttc

SEQ ID NO: 100680 - DNA, 25 bp, Homo sapien
gttatctagctgagttcatttcatc

SEQ ID NO: 100681 - DNA, 25 bp, Homo sapien
tatctagctgagttcatttcatctc

SEQ ID NO: 100682 - DNA, 25 bp, Homo sapien
atctagctgagttcatttcatctct

SEQ ID NO: 100683 - DNA, 25 bp, Homo sapien
ctagctgagttcatttcatctctcc

SEQ ID NO: 100684 - DNA, 25 bp, Homo sapien
tagctgagttcatttcatctctccc

SEQ ID NO: 100685 - DNA, 25 bp, Homo sapien
tctcccttttttatatcaagtttga

SEQ ID NO: 100686 - DNA, 25 bp, Homo sapien
atcaagtttgaatttgggataattt

SEQ ID NO: 100687 - DNA, 25 bp, Homo sapien
tacagtattattcctcaaaataaca

SEQ ID NO: 100688 - DNA, 25 bp, Homo sapien
taattatagttctgttaccaagaat

SEQ ID NO: 100689 - DNA, 25 bp, Homo sapien
gattacaaatattacctccagggtt

SEQ ID NO: 100690 - DNA, 25 bp, Homo sapien
acctccagggttcaatagaaatcct

SEQ ID NO: 100691 - DNA, 25 bp, Homo sapien
aatagaaatcctcaatttagggtga

SEQ ID NO: 100692 - DNA, 25 bp, Homo sapien
tcaatttagggtgaggagacttttt

SEQ ID NO: 100693 - DNA, 25 bp, Homo sapien
catagtgggaatcaggattgtgctt

SEQ ID NO: 100694 - DNA, 25 bp, Homo sapien
gattgtgctttattgagcctgcagt

SEQ ID NO: 100695 - DNA, 25 bp, Homo sapien
tgagcctgcagttacattgaattgt

SEQ ID NO: 100696 - DNA, 25 bp, Homo sapien
aattgtaggtgtttcgtgtgctgct

SEQ ID NO: 100697 - DNA, 25 bp, Homo sapien
ttcgtgtgctgctaaggtatgctta

SEQ ID NO: 100698 - DNA, 25 bp, Homo sapien
aaggtatgcttatttgagtttatca

SEQ ID NO: 100699 - DNA, 25 bp, Homo sapien
aattcttccacagaaccagtttggg

SEQ ID NO: 100700 - DNA, 25 bp, Homo sapien
tgggcagtaggaactcaggcttctg

SEQ ID NO: 100701 - DNA, 25 bp, Homo sapien
tcaggcttctggtctgcagtggagc

SEQ ID NO: 100702 - DNA, 25 bp, Homo sapien
tgcagtggagcctgttcgcctctaa

SEQ ID NO: 100703 - DNA, 25 bp, Homo sapien
gttcgcctctaatagccagtttaca

SEQ ID NO: 100704 - DNA, 25 bp, Homo sapien
tagccagtttacagcacttgcctta

SEQ ID NO: 100705 - DNA, 25 bp, Homo sapien
acttgccttagcctgtttcacagac

SEQ ID NO: 100706 - DNA, 25 bp, Homo sapien
ctgtttcacagacttgtccacttac

SEQ ID NO: 100707 - DNA, 25 bp, Homo sapien
acttgtccacttaccttgtcactaa

SEQ ID NO: 100708 - DNA, 25 bp, Homo sapien
tgggctgtgagtgatcctttgatac

SEQ ID NO: 100709 - DNA, 25 bp, Homo sapien
gtgatcctttgatacttcaccaagg

SEQ ID NO: 100710 - DNA, 25 bp, Homo sapien
gtccttgtgtgcgagtcacctgggc

SEQ ID NO: 100711 - DNA, 25 bp, Homo sapien
ttgtgtgcgagtcacctgggctcct

SEQ ID NO: 100712 - DNA, 25 bp, Homo sapien
gggaaaggtagactcaccctctgcc

SEQ ID NO: 100713 - DNA, 25 bp, Homo sapien
cccactcttccacagagtgagcagg

SEQ ID NO: 100714 - DNA, 25 bp, Homo sapien
ccccagctctctagttgggaagaag

SEQ ID NO: 100715 - DNA, 25 bp, Homo sapien
gttgggaagaagtgcagccctccct

SEQ ID NO: 100716 - DNA, 25 bp, Homo sapien
gtgcctctcagagggcagtgctgtt

SEQ ID NO: 100717 - DNA, 25 bp, Homo sapien
agagggcagtgctgttcctggacat

SEQ ID NO: 100718 - DNA, 25 bp, Homo sapien
gggcagtgctgttcctggacatgaa

SEQ ID NO: 100719 - DNA, 25 bp, Homo sapien
tgttcctggacatgaagccgcacaa

SEQ ID NO: 100720 - DNA, 25 bp, Homo sapien
gaagccgcacaaggaacgttttatt

SEQ ID NO: 100721 - DNA, 25 bp, Homo sapien
tctctggcttcctgaaagcttcacc

SEQ ID NO: 100722 - DNA, 25 bp, Homo sapien
tcttccctcgtttatatctcaactg

SEQ ID NO: 100723 - DNA, 25 bp, Homo sapien
actgtaagggcattttcaagcttct

SEQ ID NO: 100724 - DNA, 25 bp, Homo sapien
tcaagcttctgttcatggaatgagc

SEQ ID NO: 100725 - DNA, 25 bp, Homo sapien
gaatgagcaactcagactgtctgga

SEQ ID NO: 100726 - DNA, 25 bp, Homo sapien
actcagactgtctggagcttgctga

SEQ ID NO: 100727 - DNA, 25 bp, Homo sapien
ttgctgagtacaaacacaccaccac

SEQ ID NO: 100728 - DNA, 25 bp, Homo sapien
gtttcagaactttccttaggacttg

SEQ ID NO: 100729 - DNA, 25 bp, Homo sapien
ctttccttaggacttgggcaaaatg

SEQ ID NO: 100730 - DNA, 25 bp, Homo sapien
gtggtggtaactcttaagtgctttt

SEQ ID NO: 100731 - DNA, 25 bp, Homo sapien
aactcttaagtgcttttggtatctc

SEQ ID NO: 100732 - DNA, 25 bp, Homo sapien
tacaacctagtccatctcacttctg

SEQ ID NO: 100733 - DNA, 25 bp, Homo sapien
ctggtgctacctgagttggacagaa

SEQ ID NO: 100734 - DNA, 25 bp, Homo sapien
gacagaattctagctcatggttgct

SEQ ID NO: 100735 - DNA, 25 bp, Homo sapien
ggaaagctaggcctctgatcataga

SEQ ID NO: 100736 - DNA, 25 bp, Homo sapien
aagcagatagcttcagtcccagtct

SEQ ID NO: 100737 - DNA, 25 bp, Homo sapien
ttcagtcccagtctaggcctagata

SEQ ID NO: 100738 - DNA, 25 bp, Homo sapien
gataaatgactcttattaccacaac

SEQ ID NO: 100739 - DNA, 25 bp, Homo sapien
tattttccaatttcctttctcacat

SEQ ID NO: 100740 - DNA, 25 bp, Homo sapien
ttctcacatactgtacacaggtagt

SEQ ID NO: 100741 - DNA, 25 bp, Homo sapien
ttcaatgtgaatccaaagcttgtct

SEQ ID NO: 100742 - DNA, 25 bp, Homo sapien
aaagcttgtctggttctctgaaaat

SEQ ID NO: 100743 - DNA, 25 bp, Homo sapien
tgtggacaactcgaataagtttgac

SEQ ID NO: 100744 - DNA, 25 bp, Homo sapien
tggacaactcgaataagtttgactt

SEQ ID NO: 100745 - DNA, 25 bp, Homo sapien
gacaactcgaataagtttgacttgt

SEQ ID NO: 100746 - DNA, 25 bp, Homo sapien
caactcgaataagtttgacttgtgt

SEQ ID NO: 100747 - DNA, 25 bp, Homo sapien
actcgaataagtttgacttgtgttt

SEQ ID NO: 100748 - DNA, 25 bp, Homo sapien
taaccaccagatcattccttctgta

SEQ ID NO: 100749 - DNA, 25 bp, Homo sapien
aaccaccagatcattccttctgtag

SEQ ID NO: 100750 - DNA, 25 bp, Homo sapien
accaccagatcattccttctgtagc

SEQ ID NO: 100751 - DNA, 25 bp, Homo sapien
ccaccagatcattccttctgtagct

SEQ ID NO: 100752 - DNA, 25 bp, Homo sapien
caccagatcattccttctgtagctc

SEQ ID NO: 100753 - DNA, 25 bp, Homo sapien
accagatcattccttctgtagctca

SEQ ID NO: 100754 - DNA, 25 bp, Homo sapien
aaatgtttgggatatgtttgttgac

SEQ ID NO: 100755 - DNA, 25 bp, Homo sapien
acttcagttttcagatatatggatc

SEQ ID NO: 100756 - DNA, 25 bp, Homo sapien
gattaatcttcattggtttctcaaa

SEQ ID NO: 100757 - DNA, 25 bp, Homo sapien
ggtttctcaaattcaggttgaaata

SEQ ID NO: 100758 - DNA, 25 bp, Homo sapien
atgagtcattgtagacatctataaa

SEQ ID NO: 100759 - DNA, 25 bp, Homo sapien
taaaagggcctgtacccaaaggatg

SEQ ID NO: 100760 - DNA, 25 bp, Homo sapien
caaaggatgccagaatactagtatt

SEQ ID NO: 100761 - DNA, 25 bp, Homo sapien
tttttatttatcgtaaacatccacg

SEQ ID NO: 100762 - DNA, 25 bp, Homo sapien
aaacatccacgagtgctgttgcact

SEQ ID NO: 100763 - DNA, 25 bp, Homo sapien
gctgttgcactaccatctatttgtt

SEQ ID NO: 100764 - DNA, 25 bp, Homo sapien
gcactaccatctatttgttgtaaat

SEQ ID NO: 100765 - DNA, 25 bp, Homo sapien
attgaggtaatatctgaggtggcat

SEQ ID NO: 100766 - DNA, 25 bp, Homo sapien
atctgaggtggcataatttaaaaat

SEQ ID NO: 100767 - DNA, 25 bp, Homo sapien
ttcatatatactgtcttatttctag

SEQ ID NO: 100768 - DNA, 25 bp, Homo sapien
ctgtcttatttctagatttgtttaa

SEQ ID NO: 100769 - DNA, 25 bp, Homo sapien
aactaatggataaagctagcataaa

SEQ ID NO: 100770 - DNA, 25 bp, Homo sapien
gttaccttatatattaatctactct

SEQ ID NO: 100771 - DNA, 25 bp, Homo sapien
attaatctactcttgattctgctaa

SEQ ID NO: 100772 - DNA, 25 bp, Homo sapien
tctactcttgattctgctaattatt

SEQ ID NO: 100773 - DNA, 25 bp, Homo sapien
gattctgctaattattaccaacaaa

SEQ ID NO: 100774 - DNA, 25 bp, Homo sapien
ccaacaaaattgtattcatgacatt

SEQ ID NO: 100775 - DNA, 25 bp, Homo sapien
gacattttattaatcctctgtgaat

SEQ ID NO: 100776 - DNA, 25 bp, Homo sapien
aatcggaatgtttgttgtatgcctt

SEQ ID NO: 100777 - DNA, 25 bp, Homo sapien
tttcacttatatgtgcatgtccata

SEQ ID NO: 100778 - DNA, 25 bp, Homo sapien
gtgcatgtccatatatgttaatttt

SEQ ID NO: 100779 - DNA, 25 bp, Homo sapien
attttcattgtagcaaagctaatgg

SEQ ID NO: 100780 - DNA, 25 bp, Homo sapien
taaagctaatgctctagttgaaaga

SEQ ID NO: 100781 - DNA, 25 bp, Homo sapien
ggaaaactcctgaaatcctagaatg

SEQ ID NO: 100782 - DNA, 25 bp, Homo sapien
gtcttgttatttttagctgactgta

SEQ ID NO: 100783 - DNA, 25 bp, Homo sapien
gaacagtctttgtgtattgtgctta

SEQ ID NO: 100784 - DNA, 25 bp, Homo sapien
atttcatccttgtcatgctcaaaat

SEQ ID NO: 100785 - DNA, 25 bp, Homo sapien
gctcaaaattttgttacatgcttgt

SEQ ID NO: 100786 - DNA, 25 bp, Homo sapien
gttacatgcttgttattcagagtat

SEQ ID NO: 100787 - DNA, 25 bp, Homo sapien
accacatatgtcacctttccaagag

SEQ ID NO: 100788 - DNA, 25 bp, Homo sapien
cacctttccaagagggactgaaact

SEQ ID NO: 100789 - DNA, 25 bp, Homo sapien
gggactgaaactgggctgacccttt

SEQ ID NO: 100790 - DNA, 25 bp, Homo sapien
ctgggctgacccttttgatttccaa

SEQ ID NO: 100791 - DNA, 25 bp, Homo sapien
tttgatttccaaactcagcgttttg

SEQ ID NO: 100792 - DNA, 25 bp, Homo sapien
tcagcgttttggtgtaaggcggcca

SEQ ID NO: 100793 - DNA, 25 bp, Homo sapien
agaaggatgcggagcccagcactgt

SEQ ID NO: 100794 - DNA, 25 bp, Homo sapien
aaaaacattgatgcgctggcttggg

SEQ ID NO: 100795 - DNA, 25 bp, Homo sapien
aacatctttcacactaagttcagac

SEQ ID NO: 100796 - DNA, 25 bp, Homo sapien
gaaaccaatcttcagatgctctgta

SEQ ID NO: 100797 - DNA, 25 bp, Homo sapien
tcagatgctctgtaaaccacataat

SEQ ID NO: 100798 - DNA, 25 bp, Homo sapien
gaagttgtgccgctcaatcacagac

SEQ ID NO: 100799 - DNA, 25 bp, Homo sapien
agttgtgccgctcaatcacagacac

SEQ ID NO: 100800 - DNA, 25 bp, Homo sapien
gttacacacaagaacatttcaggaa

SEQ ID NO: 100801 - DNA, 25 bp, Homo sapien
tttttgtttctcttctatgtcaata

SEQ ID NO: 100802 - DNA, 25 bp, Homo sapien
gtttctcttctatgtcaatacttag

SEQ ID NO: 100803 - DNA, 25 bp, Homo sapien
ctatgtcaatacttagtgtttctca

SEQ ID NO: 100804 - DNA, 25 bp, Homo sapien
atacttagtgtttctcattttgagg

SEQ ID NO: 100805 - DNA, 25 bp, Homo sapien
tagtgtttctcattttgaggacttt

SEQ ID NO: 100806 - DNA, 25 bp, Homo sapien
tctcctgtatctttgttttagtttc

SEQ ID NO: 100807 - DNA, 25 bp, Homo sapien
ttaatgtgccaaaaatttgtacatg

SEQ ID NO: 100808 - DNA, 25 bp, Homo sapien
gtatgaaaatgtcctcttcttcaaa

SEQ ID NO: 100809 - DNA, 25 bp, Homo sapien
atgttccgccaatggtcccggcttg

SEQ ID NO: 100810 - DNA, 25 bp, Homo sapien
gttccgccaatggtcccggcttgta

SEQ ID NO: 100811 - DNA, 25 bp, Homo sapien
caatggtcccggcttgtacctcatc

SEQ ID NO: 100812 - DNA, 25 bp, Homo sapien
ttgtacctcatccatggtcccaatt

SEQ ID NO: 100813 - DNA, 25 bp, Homo sapien
gtacctcatccatggtcccaatttg

SEQ ID NO: 100814 - DNA, 25 bp, Homo sapien
gcccttccgcaaccccagaatgtga

SEQ ID NO: 100815 - DNA, 25 bp, Homo sapien
ccagaatgtgaccagtctcctgggc

SEQ ID NO: 100816 - DNA, 25 bp, Homo sapien
agtctcctgggctgcactcactgag

SEQ ID NO: 100817 - DNA, 25 bp, Homo sapien
tctcctgggctgcactcactgaggg

SEQ ID NO: 100818 - DNA, 25 bp, Homo sapien
cccacctcctagttcctcataataa

SEQ ID NO: 100819 - DNA, 25 bp, Homo sapien
gcttcttcgcttctcactgaggggc

SEQ ID NO: 100820 - DNA, 25 bp, Homo sapien
aaataggaggcttaaaattgactgc

SEQ ID NO: 100821 - DNA, 25 bp, Homo sapien
aataggaggcttaaaattgactgcc

SEQ ID NO: 100822 - DNA, 25 bp, Homo sapien
ataggaggcttaaaattgactgcca

SEQ ID NO: 100823 - DNA, 25 bp, Homo sapien
taggaggcttaaaattgactgccag

SEQ ID NO: 100824 - DNA, 25 bp, Homo sapien
aggaggcttaaaattgactgccagg

SEQ ID NO: 100825 - DNA, 25 bp, Homo sapien
ggaggcttaaaattgactgccaggc

SEQ ID NO: 100826 - DNA, 25 bp, Homo sapien
gaggcttaaaattgactgccaggct

SEQ ID NO: 100827 - DNA, 25 bp, Homo sapien
aggcttaaaattgactgccaggctg

SEQ ID NO: 100828 - DNA, 25 bp, Homo sapien
ggcttaaaattgactgccaggctgg

SEQ ID NO: 100829 - DNA, 25 bp, Homo sapien
gcttaaaattgactgccaggctggg

SEQ ID NO: 100830 - DNA, 25 bp, Homo sapien
cttaaaattgactgccaggctgggt

SEQ ID NO: 100831 - DNA, 25 bp, Homo sapien
ggatgccatgtttcgtgccttcaag

SEQ ID NO: 100832 - DNA, 25 bp, Homo sapien
tagagatggcctgattcaagtgtct

SEQ ID NO: 100833 - DNA, 25 bp, Homo sapien
gcagttgaccatgtattcctgaagt

SEQ ID NO: 100834 - DNA, 25 bp, Homo sapien
gagaagtcaagatcctccctggagg

SEQ ID NO: 100835 - DNA, 25 bp, Homo sapien
gaggacaggactgaaaaccttgcca

SEQ ID NO: 100836 - DNA, 25 bp, Homo sapien
aaaccttgccaagctgtacacagtt

SEQ ID NO: 100837 - DNA, 25 bp, Homo sapien
gctgtacacagttgctgataccctg

SEQ ID NO: 100838 - DNA, 25 bp, Homo sapien
tgataccctgtgcaacagctctcat

SEQ ID NO: 100839 - DNA, 25 bp, Homo sapien
aagctctttcacaaccctacatatt

SEQ ID NO: 100840 - DNA, 25 bp, Homo sapien
tatttctgatcatgtgctgcctttt

SEQ ID NO: 100841 - DNA, 25 bp, Homo sapien
atgtgctgccttttactgctgaatt

SEQ ID NO: 100842 - DNA, 25 bp, Homo sapien
tcgaagtgctccagcagtactaccc

SEQ ID NO: 100843 - DNA, 25 bp, Homo sapien
tagcagtgggcccatgtcgcttgaa

SEQ ID NO: 100844 - DNA, 25 bp, Homo sapien
gggcccatgtcgcttgaatattatt

SEQ ID NO: 100845 - DNA, 25 bp, Homo sapien
tttgatttgaccaccaagatgtaat

SEQ ID NO: 100846 - DNA, 25 bp, Homo sapien
gatgattctattccattttgaaaag

SEQ ID NO: 100847 - DNA, 25 bp, Homo sapien
gtctgagaaagtgtacaggtctaat

SEQ ID NO: 100848 - DNA, 25 bp, Homo sapien
ggacagagccatgcgattgattgtt

SEQ ID NO: 100849 - DNA, 25 bp, Homo sapien
gattgattgttcatcttccctctct

SEQ ID NO: 100850 - DNA, 25 bp, Homo sapien
aaaggacactggcaatatccccagc

SEQ ID NO: 100851 - DNA, 25 bp, Homo sapien
tctctcctgattggaattctttgaa

SEQ ID NO: 100852 - DNA, 25 bp, Homo sapien
ttctttgaaccctcgaagtgctcca

SEQ ID NO: 100853 - DNA, 25 bp, Homo sapien
gtcatttccaatatggtaggtgtca

SEQ ID NO: 100854 - DNA, 25 bp, Homo sapien
gagtggttgtagaagtctccctaaa

SEQ ID NO: 100855 - DNA, 25 bp, Homo sapien
gttgtagaagtctccctaaatcaga

SEQ ID NO: 100856 - DNA, 25 bp, Homo sapien
atcagacatgtcaagcaatcagcca

SEQ ID NO: 100857 - DNA, 25 bp, Homo sapien
tgtcaagcaatcagccaacgtggtg

SEQ ID NO: 100858 - DNA, 25 bp, Homo sapien
gccaacgtggtgtatttctcattca

SEQ ID NO: 100859 - DNA, 25 bp, Homo sapien
cgtggtgtatttctcattcaatatt

SEQ ID NO: 100860 - DNA, 25 bp, Homo sapien
gagataaagacatcgtgcagagata

SEQ ID NO: 100861 - DNA, 25 bp, Homo sapien
gtagcaactcttgagttcatttttt

SEQ ID NO: 100862 - DNA, 25 bp, Homo sapien
tttcccactgtagcaaaattaatgc

SEQ ID NO: 100863 - DNA, 25 bp, Homo sapien
gaaataaattgctcattcctccaaa

SEQ ID NO: 100864 - DNA, 25 bp, Homo sapien
tgagttaagctgaagtgatgtgtta

SEQ ID NO: 100865 - DNA, 25 bp, Homo sapien
aagctgaagtgatgtgttaatatgg

SEQ ID NO: 100866 - DNA, 25 bp, Homo sapien
gtgatgtgttaatatggggcccata

SEQ ID NO: 100867 - DNA, 25 bp, Homo sapien
ataaacccagctataacaaaattgt

SEQ ID NO: 100868 - DNA, 25 bp, Homo sapien
tatgatgtttagtgtggtgttggtt

SEQ ID NO: 100869 - DNA, 25 bp, Homo sapien
gtgtggtgttggttagtaatcttta

SEQ ID NO: 100870 - DNA, 25 bp, Homo sapien
tggtgttggttagtaatctttattt

SEQ ID NO: 100871 - DNA, 25 bp, Homo sapien
atataatttaaaactgtcggcagta

SEQ ID NO: 100872 - DNA, 25 bp, Homo sapien
aactgtcggcagtatcaatagtaca

SEQ ID NO: 100873 - DNA, 25 bp, Homo sapien
ctgtcggcagtatcaatagtacaaa

SEQ ID NO: 100874 - DNA, 25 bp, Homo sapien
gtcggcagtatcaatagtacaaaaa

SEQ ID NO: 100875 - DNA, 25 bp, Homo sapien
aactgtgtctcccttgtcttaggat

SEQ ID NO: 100876 - DNA, 25 bp, Homo sapien
gtctcccttgtcttaggatattctg

SEQ ID NO: 100877 - DNA, 25 bp, Homo sapien
ctgtagattgattgcagatttctta

SEQ ID NO: 100878 - DNA, 25 bp, Homo sapien
ctgaaatgatctttacactgtaatt

SEQ ID NO: 100879 - DNA, 25 bp, Homo sapien
acactgtaattctcagcatactgat

SEQ ID NO: 100880 - DNA, 25 bp, Homo sapien
ttatacttgacttaactttattgca

SEQ ID NO: 100881 - DNA, 25 bp, Homo sapien
atgtgaattaattgcactgctaagt

SEQ ID NO: 100882 - DNA, 25 bp, Homo sapien
gtaacttttatttgttgctattcac

SEQ ID NO: 100883 - DNA, 25 bp, Homo sapien
ttgaattttttcctgtataggcaat

SEQ ID NO: 100884 - DNA, 25 bp, Homo sapien
ttgacaccttttacagatcttactg

SEQ ID NO: 100885 - DNA, 25 bp, Homo sapien
gatcttactgtagctttttccatat

SEQ ID NO: 100886 - DNA, 25 bp, Homo sapien
gcaaacatcaggacacttctggaga

SEQ ID NO: 100887 - DNA, 25 bp, Homo sapien
aggactcccaagtcatctactcttc

SEQ ID NO: 100888 - DNA, 25 bp, Homo sapien
aaatcataacacttggaggaatcag

SEQ ID NO: 100889 - DNA, 25 bp, Homo sapien
cagaagggaagatcaacagcaagga

SEQ ID NO: 100890 - DNA, 25 bp, Homo sapien
gggcatcattaagacttgctataaa

SEQ ID NO: 100891 - DNA, 25 bp, Homo sapien
aatgcttgaggcttatcacctgcca

SEQ ID NO: 100892 - DNA, 25 bp, Homo sapien
gaggcttatcacctgccacagccag

SEQ ID NO: 100893 - DNA, 25 bp, Homo sapien
cagccagaacgtgcctcaggaggca

SEQ ID NO: 100894 - DNA, 25 bp, Homo sapien
ttcttctccaatatcttcttttacc

SEQ ID NO: 100895 - DNA, 25 bp, Homo sapien
atattcattgaactgctgctacatc

SEQ ID NO: 100896 - DNA, 25 bp, Homo sapien
actgctgctacatccagacactgtg

SEQ ID NO: 100897 - DNA, 25 bp, Homo sapien
cattcatgtatatttattcctggaa

SEQ ID NO: 100898 - DNA, 25 bp, Homo sapien
attcctggaattatttgcctgttaa

SEQ ID NO: 100899 - DNA, 25 bp, Homo sapien
aaacagtgtctttcatgttctctcc

SEQ ID NO: 100900 - DNA, 25 bp, Homo sapien
atgttctctccccagattgtaaact

SEQ ID NO: 100901 - DNA, 25 bp, Homo sapien
gtaaactctgtaagaagctgcttgt

SEQ ID NO: 100902 - DNA, 25 bp, Homo sapien
cttgtatctgtatcccttgttgaaa

SEQ ID NO: 100903 - DNA, 25 bp, Homo sapien
gtatcccttgttgaaactctgaaaa

SEQ ID NO: 100904 - DNA, 25 bp, Homo sapien
ggatctttggctaggtggatgacta

SEQ ID NO: 100905 - DNA, 25 bp, Homo sapien
tggatgactagttttattcaaagcc

SEQ ID NO: 100906 - DNA, 25 bp, Homo sapien
tcaaagccctttcagttacaaccac

SEQ ID NO: 100907 - DNA, 25 bp, Homo sapien
aaccaccccactatggaatcagtat

SEQ ID NO: 100908 - DNA, 25 bp, Homo sapien
ataaacacattaaaggctgggcgcg

SEQ ID NO: 100909 - DNA, 25 bp, Homo sapien
taaacacattaaaggctgggcgcgg

SEQ ID NO: 100910 - DNA, 25 bp, Homo sapien
aaacacattaaaggctgggcgcggt

SEQ ID NO: 100911 - DNA, 25 bp, Homo sapien
aggccgagacgggtgtataacgagg

SEQ ID NO: 100912 - DNA, 25 bp, Homo sapien
ggccgagacgggtgtataacgaggt

SEQ ID NO: 100913 - DNA, 25 bp, Homo sapien
gccgagacgggtgtataacgaggtc

SEQ ID NO: 100914 - DNA, 25 bp, Homo sapien
ccgagacgggtgtataacgaggtca

SEQ ID NO: 100915 - DNA, 25 bp, Homo sapien
cgagacgggtgtataacgaggtcag

SEQ ID NO: 100916 - DNA, 25 bp, Homo sapien
gagacgggtgtataacgaggtcagg

SEQ ID NO: 100917 - DNA, 25 bp, Homo sapien
agacgggtgtataacgaggtcagga

SEQ ID NO: 100918 - DNA, 25 bp, Homo sapien
acgggtgtataacgaggtcaggaga

SEQ ID NO: 100919 - DNA, 25 bp, Homo sapien
acgtcgattcttgccagggtgacag

SEQ ID NO: 100920 - DNA, 25 bp, Homo sapien
ctggctgtgccaaagcttacagacc

SEQ ID NO: 100921 - DNA, 25 bp, Homo sapien
gtgccaaagcttacagaccaggagt

SEQ ID NO: 100922 - DNA, 25 bp, Homo sapien
acagaccaggagtgtacgggaatgt

SEQ ID NO: 100923 - DNA, 25 bp, Homo sapien
tgatggtattcacggactggattta

SEQ ID NO: 100924 - DNA, 25 bp, Homo sapien
tcacggactggatttatcgacaaat

SEQ ID NO: 100925 - DNA, 25 bp, Homo sapien
acggctaatccacatggtcttcgtc

SEQ ID NO: 100926 - DNA, 25 bp, Homo sapien
taatccacatggtcttcgtccttga

SEQ ID NO: 100927 - DNA, 25 bp, Homo sapien
ttcgtccttgacgtcgttttacaag

SEQ ID NO: 100928 - DNA, 25 bp, Homo sapien
tttgcttccccgtgcatgatttact

SEQ ID NO: 100929 - DNA, 25 bp, Homo sapien
gattcagaggtcacttcatttttat

SEQ ID NO: 100930 - DNA, 25 bp, Homo sapien
cagatgcaagtcacacgtgtgctat

SEQ ID NO: 100931 - DNA, 25 bp, Homo sapien
cgtgtgctattgatgtggattttaa

SEQ ID NO: 100932 - DNA, 25 bp, Homo sapien
ttcctctggaacaaacgtgggataa

SEQ ID NO: 100933 - DNA, 25 bp, Homo sapien
gggataaatctatctgagcccaaac

SEQ ID NO: 100934 - DNA, 25 bp, Homo sapien
gtataatttttgtagcagcgacact

SEQ ID NO: 100935 - DNA, 25 bp, Homo sapien
tttgtagcagcgacactgtggaaga

SEQ ID NO: 100936 - DNA, 25 bp, Homo sapien
gaaaacgtcttgcaatctctttacc

SEQ ID NO: 100937 - DNA, 25 bp, Homo sapien
tgcaatctctttacccttgttaaaa

SEQ ID NO: 100938 - DNA, 25 bp, Homo sapien
cttgttaaaaacgtggtgcggctat

SEQ ID NO: 100939 - DNA, 25 bp, Homo sapien
acgtggtgcggctattgcggtaata

SEQ ID NO: 100940 - DNA, 25 bp, Homo sapien
gcggctattgcggtaataaaatctt

SEQ ID NO: 100941 - DNA, 25 bp, Homo sapien
accctggggcagaagattgttaacg

SEQ ID NO: 100942 - DNA, 25 bp, Homo sapien
gggcagaagattgttaacgccgggc

SEQ ID NO: 100943 - DNA, 25 bp, Homo sapien
ttaggaggctaaggagctcaagacc

SEQ ID NO: 100944 - DNA, 25 bp, Homo sapien
ggaggctaaggagctcaagaccacc

SEQ ID NO: 100945 - DNA, 25 bp, Homo sapien
agctcaagaccaccataggaacata

SEQ ID NO: 100946 - DNA, 25 bp, Homo sapien
gaccaccataggaacatagcaagat

SEQ ID NO: 100947 - DNA, 25 bp, Homo sapien
aagatccctgtttccacaaaaatat

SEQ ID NO: 100948 - DNA, 25 bp, Homo sapien
gatccctgtttccacaaaaatattg

SEQ ID NO: 100949 - DNA, 25 bp, Homo sapien
tccctgtttccacaaaaatattgaa

SEQ ID NO: 100950 - DNA, 25 bp, Homo sapien
aatattgaacaattagccgggagta

SEQ ID NO: 100951 - DNA, 25 bp, Homo sapien
tattgaacaattagccgggagtagt

SEQ ID NO: 100952 - DNA, 25 bp, Homo sapien
aactacgagttttaggccaaatctg

SEQ ID NO: 100953 - DNA, 25 bp, Homo sapien
agatgactatgtttgggactgaagt

SEQ ID NO: 100954 - DNA, 25 bp, Homo sapien
agttagaactctcatcacatgtttg

SEQ ID NO: 100955 - DNA, 25 bp, Homo sapien
atgtttgactcaaattgtggagcaa

SEQ ID NO: 100956 - DNA, 25 bp, Homo sapien
agaatctttttgatgtcgatgttca

SEQ ID NO: 100957 - DNA, 25 bp, Homo sapien
gatgttcaactatttttggcaccat

SEQ ID NO: 100958 - DNA, 25 bp, Homo sapien
ctatttttggcaccatagtagaaca

SEQ ID NO: 100959 - DNA, 25 bp, Homo sapien
gtagaacatggttgctttctatttt

SEQ ID NO: 100960 - DNA, 25 bp, Homo sapien
tttcttgggtatggaggtttcttga

SEQ ID NO: 100961 - DNA, 25 bp, Homo sapien
ggtttcttgaagacctagaacatag

SEQ ID NO: 100962 - DNA, 25 bp, Homo sapien
gacctagaacatagaagaatgccta

SEQ ID NO: 100963 - DNA, 25 bp, Homo sapien
ttcctttggcacaagggaccggact

SEQ ID NO: 100964 - DNA, 25 bp, Homo sapien
agggaccggacttgcaatgtcacct

SEQ ID NO: 100965 - DNA, 25 bp, Homo sapien
aatgtcacctcccacggcatcgatg

SEQ ID NO: 100966 - DNA, 25 bp, Homo sapien
ggcatcgatggctgcgatctgctct

SEQ ID NO: 100967 - DNA, 25 bp, Homo sapien
gaaaaatgccactgcatcttccact

SEQ ID NO: 100968 - DNA, 25 bp, Homo sapien
gctacgtcagctgccaggagtgtat

SEQ ID NO: 100969 - DNA, 25 bp, Homo sapien
agtgtattcgcatctacgacgtgca

SEQ ID NO: 100970 - DNA, 25 bp, Homo sapien
tgcacacctgcaagtagggcaccag

SEQ ID NO: 100971 - DNA, 25 bp, Homo sapien
gctcttcaagccacccacggagagg

SEQ ID NO: 100972 - DNA, 25 bp, Homo sapien
agggacctggtctactacgagaact

SEQ ID NO: 100973 - DNA, 25 bp, Homo sapien
cagagacgggttcctttggcacaag

SEQ ID NO: 100974 - DNA, 25 bp, Homo sapien
gtattccccgtccatctggagaaaa

SEQ ID NO: 100975 - DNA, 25 bp, Homo sapien
aaacaagagtggactgcaatcattc

SEQ ID NO: 100976 - DNA, 25 bp, Homo sapien
tgcaatcattccaaattcccagcta

SEQ ID NO: 100977 - DNA, 25 bp, Homo sapien
ttcccagctaattgtcattccatac

SEQ ID NO: 100978 - DNA, 25 bp, Homo sapien
ataccctcacaatgtccctcgaagt

SEQ ID NO: 100979 - DNA, 25 bp, Homo sapien
aatgtccctcgaagttggagtgcca

SEQ ID NO: 100980 - DNA, 25 bp, Homo sapien
gtgccaaactgtatcttacaccaag

SEQ ID NO: 100981 - DNA, 25 bp, Homo sapien
aatattgttctgcttactgctatag

SEQ ID NO: 100982 - DNA, 25 bp, Homo sapien
tactgctatagctctcatcggtgtc

SEQ ID NO: 100983 - DNA, 25 bp, Homo sapien
tctcatcggtgtctgtgttttcatc

SEQ ID NO: 100984 - DNA, 25 bp, Homo sapien
ctgtgttttcatcttggcaataatt

SEQ ID NO: 100985 - DNA, 25 bp, Homo sapien
ctcaactgccccacagaggatggtg

SEQ ID NO: 100986 - DNA, 25 bp, Homo sapien
tgttcactcgagtctccgccttcat

SEQ ID NO: 100987 - DNA, 25 bp, Homo sapien
gactggattgaggagaccatagcaa

SEQ ID NO: 100988 - DNA, 25 bp, Homo sapien
ctggattgaggagaccatagcaagc

SEQ ID NO: 100989 - DNA, 25 bp, Homo sapien
tggattgaggagaccatagcaagcc

SEQ ID NO: 100990 - DNA, 25 bp, Homo sapien
ggattgaggagaccatagcaagcca

SEQ ID NO: 100991 - DNA, 25 bp, Homo sapien
gattgaggagaccatagcaagccac

SEQ ID NO: 100992 - DNA, 25 bp, Homo sapien
attgaggagaccatagcaagccact

SEQ ID NO: 100993 - DNA, 25 bp, Homo sapien
ttgaggagaccatagcaagccacta

SEQ ID NO: 100994 - DNA, 25 bp, Homo sapien
tgaggagaccatagcaagccactag

SEQ ID NO: 100995 - DNA, 25 bp, Homo sapien
gaggagaccatagcaagccactaga

SEQ ID NO: 100996 - DNA, 25 bp, Homo sapien
aaagtatataattcaatggttgtca

SEQ ID NO: 100997 - DNA, 25 bp, Homo sapien
atggttgtcagtatattcacaatgt

SEQ ID NO: 100998 - DNA, 25 bp, Homo sapien
cacaatgttgtgtccactgtttaat

SEQ ID NO: 100999 - DNA, 25 bp, Homo sapien
gttgtgtccactgtttaattccaga

SEQ ID NO: 101000 - DNA, 25 bp, Homo sapien
gtgtccactgtttaattccagagaa

SEQ ID NO: 101001 - DNA, 25 bp, Homo sapien
tccagagaatttttatcacccaaat

SEQ ID NO: 101002 - DNA, 25 bp, Homo sapien
gagaatttttatcacccaaataaga

SEQ ID NO: 101003 - DNA, 25 bp, Homo sapien
aaagcaccaattagcagtctcttcc

SEQ ID NO: 101004 - DNA, 25 bp, Homo sapien
aattagcagtctcttcccattttcg

SEQ ID NO: 101005 - DNA, 25 bp, Homo sapien
actaatctgccttctatctctatgg

SEQ ID NO: 101006 - DNA, 25 bp, Homo sapien
taatctgccttctatctctatggat

SEQ ID NO: 101007 - DNA, 25 bp, Homo sapien
gatgatatctaaattgaaccaagtg

SEQ ID NO: 101008 - DNA, 25 bp, Homo sapien
agtgtttttacatgacaagttctct

SEQ ID NO: 101009 - DNA, 25 bp, Homo sapien
gaggatggttctacagttgggattt

SEQ ID NO: 101010 - DNA, 25 bp, Homo sapien
ttctacagttgggattttggccatc

SEQ ID NO: 101011 - DNA, 25 bp, Homo sapien
acagttgggattttggccatcatca

SEQ ID NO: 101012 - DNA, 25 bp, Homo sapien
ggattttggccatcatcaaccaaga

SEQ ID NO: 101013 - DNA, 25 bp, Homo sapien
aaattcatttagtgtgtagtttctg

SEQ ID NO: 101014 - DNA, 25 bp, Homo sapien
tttagtgtgtagtttctgaaagcaa

SEQ ID NO: 101015 - DNA, 25 bp, Homo sapien
gtttctgaaagcaaactgatttatt

SEQ ID NO: 101016 - DNA, 25 bp, Homo sapien
aaaagaccataatatttgctgttaa

SEQ ID NO: 101017 - DNA, 25 bp, Homo sapien
aaataaacgagtgcctttcctactg

SEQ ID NO: 101018 - DNA, 25 bp, Homo sapien
aatgcatcattttattgtactagtt

SEQ ID NO: 101019 - DNA, 25 bp, Homo sapien
tgtactagttcttaggcttgtcctt

SEQ ID NO: 101020 - DNA, 25 bp, Homo sapien
tagttcttaggcttgtccttatttt

SEQ ID NO: 101021 - DNA, 25 bp, Homo sapien
tctaagtgattgtggtttttctcgt

SEQ ID NO: 101022 - DNA, 25 bp, Homo sapien
tgattgtggtttttctcgtggtttt

SEQ ID NO: 101023 - DNA, 25 bp, Homo sapien
gaaaggctgttgatgcttattctct

SEQ ID NO: 101024 - DNA, 25 bp, Homo sapien
gttgatgcttattctctgtaactaa

SEQ ID NO: 101025 - DNA, 25 bp, Homo sapien
aagttttcactcaattgaattgcta

SEQ ID NO: 101026 - DNA, 25 bp, Homo sapien
tcaattgaattgctagtgttaactg

SEQ ID NO: 101027 - DNA, 25 bp, Homo sapien
gttaactgaattttgtctagacacc

SEQ ID NO: 101028 - DNA, 25 bp, Homo sapien
gtctagacaccatttctgttgatga

SEQ ID NO: 101029 - DNA, 25 bp, Homo sapien
ggaacccatatagtcaactcttgat

SEQ ID NO: 101030 - DNA, 25 bp, Homo sapien
actcttgattatccacgtgtggatt

SEQ ID NO: 101031 - DNA, 25 bp, Homo sapien
gtggattatccaccatgccaggaag

SEQ ID NO: 101032 - DNA, 25 bp, Homo sapien
atgccaggaagacccataactggtt

SEQ ID NO: 101033 - DNA, 25 bp, Homo sapien
gagggaatgacttctttgcatagtg

SEQ ID NO: 101034 - DNA, 25 bp, Homo sapien
gcatagtgagtgacttgggccttca

SEQ ID NO: 101035 - DNA, 25 bp, Homo sapien
tgacttgggccttcacaaacagggt

SEQ ID NO: 101036 - DNA, 25 bp, Homo sapien
caggcagaggcctctaaatctcagg

SEQ ID NO: 101037 - DNA, 25 bp, Homo sapien
ctctaaatctcagggcaaacatggt

SEQ ID NO: 101038 - DNA, 25 bp, Homo sapien
acatggtgaatctatctctccggag

SEQ ID NO: 101039 - DNA, 25 bp, Homo sapien
tctctccggagataatttcatacag

SEQ ID NO: 101040 - DNA, 25 bp, Homo sapien
tcagtagagctctgctcaaagaaga

SEQ ID NO: 101041 - DNA, 25 bp, Homo sapien
aggatctatgtgctgacctcagaag

SEQ ID NO: 101042 - DNA, 25 bp, Homo sapien
tgctgacctcagaagatgtatatgt

SEQ ID NO: 101043 - DNA, 25 bp, Homo sapien
tgtgtatttacataaccgtttcctt

SEQ ID NO: 101044 - DNA, 25 bp, Homo sapien
accgtttccttcttgtcactgaaat

SEQ ID NO: 101045 - DNA, 25 bp, Homo sapien
gaccttaatttgtatcctgactgac

SEQ ID NO: 101046 - DNA, 25 bp, Homo sapien
ttgtatcctgactgactcaacccag

SEQ ID NO: 101047 - DNA, 25 bp, Homo sapien
cccagcagagcataaattgacttga

SEQ ID NO: 101048 - DNA, 25 bp, Homo sapien
attgacttgagagccttacctttga

SEQ ID NO: 101049 - DNA, 25 bp, Homo sapien
gagccttacctttgatgtctgaaat

SEQ ID NO: 101050 - DNA, 25 bp, Homo sapien
gatctttgctactggagtcctttaa

SEQ ID NO: 101051 - DNA, 25 bp, Homo sapien
gaaacctcaagacagatttattatt

SEQ ID NO: 101052 - DNA, 25 bp, Homo sapien
aaacctcaagacagatttattattc

SEQ ID NO: 101053 - DNA, 25 bp, Homo sapien
aacctcaagacagatttattattct

SEQ ID NO: 101054 - DNA, 25 bp, Homo sapien
acctcaagacagatttattattctt

SEQ ID NO: 101055 - DNA, 25 bp, Homo sapien
cctcaagacagatttattattctta

SEQ ID NO: 101056 - DNA, 25 bp, Homo sapien
ctcaagacagatttattattcttaa

SEQ ID NO: 101057 - DNA, 25 bp, Homo sapien
tcaagacagatttattattcttaaa

SEQ ID NO: 101058 - DNA, 25 bp, Homo sapien
caagacagatttattattcttaaat

SEQ ID NO: 101059 - DNA, 25 bp, Homo sapien
aagacagatttattattcttaaatg

SEQ ID NO: 101060 - DNA, 25 bp, Homo sapien
ttctttactatggaaaaccacattg

SEQ ID NO: 101061 - DNA, 25 bp, Homo sapien
gtcatttgtgacatcatctatatta

SEQ ID NO: 101062 - DNA, 25 bp, Homo sapien
tagttatttgtcacttacttggaaa

SEQ ID NO: 101063 - DNA, 25 bp, Homo sapien
aaatgatgctgttaggtcctggtat

SEQ ID NO: 101064 - DNA, 25 bp, Homo sapien
tgttaggtcctggtattaaaaatct

SEQ ID NO: 101065 - DNA, 25 bp, Homo sapien
gttggtttatgtgctgaaatgtctt

SEQ ID NO: 101066 - DNA, 25 bp, Homo sapien
aactactatttacttcatttcggat

SEQ ID NO: 101067 - DNA, 25 bp, Homo sapien
tcatttcggatcctgtttaacaaag

SEQ ID NO: 101068 - DNA, 25 bp, Homo sapien
gatacttgagacatccatttgtttt

SEQ ID NO: 101069 - DNA, 25 bp, Homo sapien
gtatggatatggaaatgcttgccct

SEQ ID NO: 101070 - DNA, 25 bp, Homo sapien
ttgccctaataaaagcctacatata

SEQ ID NO: 101071 - DNA, 25 bp, Homo sapien
gaacatttttcctgaaggtctgtct

SEQ ID NO: 101072 - DNA, 25 bp, Homo sapien
tttcctgaaggtctgtctctgtaca

SEQ ID NO: 101073 - DNA, 25 bp, Homo sapien
gaaggtctgtctctgtacaattcag

SEQ ID NO: 101074 - DNA, 25 bp, Homo sapien
gtacaattcagaagcacatgccttt

SEQ ID NO: 101075 - DNA, 25 bp, Homo sapien
gaagcacatgcctttagctcagaag

SEQ ID NO: 101076 - DNA, 25 bp, Homo sapien
cagcatggtgatgggaagagttcct

SEQ ID NO: 101077 - DNA, 25 bp, Homo sapien
agagttcctcttagaaatacagcag

SEQ ID NO: 101078 - DNA, 25 bp, Homo sapien
aatacagcaggtccggaaccaagac

SEQ ID NO: 101079 - DNA, 25 bp, Homo sapien
aaccaagactccaaagttccattgg

SEQ ID NO: 101080 - DNA, 25 bp, Homo sapien
actgtgtagccccatctactaaaac

SEQ ID NO: 101081 - DNA, 25 bp, Homo sapien
caaaacctttgtagaccagtcattt

SEQ ID NO: 101082 - DNA, 25 bp, Homo sapien
tcaatcacagacacctgcacccaca

SEQ ID NO: 101083 - DNA, 25 bp, Homo sapien
caatcacagacacctgcacccacaa

SEQ ID NO: 101084 - DNA, 25 bp, Homo sapien
cagacacctgcacccacaacatact

SEQ ID NO: 101085 - DNA, 25 bp, Homo sapien
agacacctgcacccacaacatactt

SEQ ID NO: 101086 - DNA, 25 bp, Homo sapien
gacacctgcacccacaacatacttc

SEQ ID NO: 101087 - DNA, 25 bp, Homo sapien
acacctgcacccacaacatacttct

SEQ ID NO: 101088 - DNA, 25 bp, Homo sapien
cacctgcacccacaacatacttctg

SEQ ID NO: 101089 - DNA, 25 bp, Homo sapien
ctgcacccacaacatacttctgtta

SEQ ID NO: 101090 - DNA, 25 bp, Homo sapien
tgcacccacaacatacttctgttac

SEQ ID NO: 101091 - DNA, 25 bp, Homo sapien
gcacccacaacatacttctgttaca

SEQ ID NO: 101092 - DNA, 25 bp, Homo sapien
cacccacaacatacttctgttacac

SEQ ID NO: 101093 - DNA, 25 bp, Homo sapien
ggtgccatattgctttgtataagtt

SEQ ID NO: 101094 - DNA, 25 bp, Homo sapien
ttttccatcaaggatttgtgtctgc

SEQ ID NO: 101095 - DNA, 25 bp, Homo sapien
aggatttgtgtctgctttgtgtgct

SEQ ID NO: 101096 - DNA, 25 bp, Homo sapien
aataattatgtcttgctgaagttct

SEQ ID NO: 101097 - DNA, 25 bp, Homo sapien
gttcttctgcttattgaattcctct

SEQ ID NO: 101098 - DNA, 25 bp, Homo sapien
gaattcctctactgaagttccttac

SEQ ID NO: 101099 - DNA, 25 bp, Homo sapien
gaagttccttacttattcaaataag

SEQ ID NO: 101100 - DNA, 25 bp, Homo sapien
ggaggtacttagtcaattgagcagc

SEQ ID NO: 101101 - DNA, 25 bp, Homo sapien
aattgagcagctaattggctaaaag

SEQ ID NO: 101102 - DNA, 25 bp, Homo sapien
ggctaaaagtgtcttgagcacaaga

SEQ ID NO: 101103 - DNA, 25 bp, Homo sapien
actgagtatctcttgtccattgtta

SEQ ID NO: 101104 - DNA, 25 bp, Homo sapien
gtttaagtcttatgtggtggttaag

SEQ ID NO: 101105 - DNA, 25 bp, Homo sapien
aagtcttatgtggtggttaagatct

SEQ ID NO: 101106 - DNA, 25 bp, Homo sapien
cttatgtggtggttaagatcttaaa

SEQ ID NO: 101107 - DNA, 25 bp, Homo sapien
tgtggtggttaagatcttaaaggac

SEQ ID NO: 101108 - DNA, 25 bp, Homo sapien
ctttccagtataggcacttcctgaa

SEQ ID NO: 101109 - DNA, 25 bp, Homo sapien
ttccagtataggcacttcctgaaaa

SEQ ID NO: 101110 - DNA, 25 bp, Homo sapien
tccagtataggcacttcctgaaaaa

SEQ ID NO: 101111 - DNA, 25 bp, Homo sapien
cagtataggcacttcctgaaaaacc

SEQ ID NO: 101112 - DNA, 25 bp, Homo sapien
gtataggcacttcctgaaaaacctt

SEQ ID NO: 101113 - DNA, 25 bp, Homo sapien
ataggcacttcctgaaaaacctttg

SEQ ID NO: 101114 - DNA, 25 bp, Homo sapien
taggcacttcctgaaaaacctttgt

SEQ ID NO: 101115 - DNA, 25 bp, Homo sapien
tcactgagcaccacattctctagct

SEQ ID NO: 101116 - DNA, 25 bp, Homo sapien
accacattctctagcttcttgttga

SEQ ID NO: 101117 - DNA, 25 bp, Homo sapien
ctagcttcttgttgaggctggaact

SEQ ID NO: 101118 - DNA, 25 bp, Homo sapien
tcccttaattttcccatctcaaaat

SEQ ID NO: 101119 - DNA, 25 bp, Homo sapien
aaattatatctgtacctgggtcatc

SEQ ID NO: 101120 - DNA, 25 bp, Homo sapien
atatctgtacctgggtcatccagct

SEQ ID NO: 101121 - DNA, 25 bp, Homo sapien
tcatccagctccttcttgggtgtgg

SEQ ID NO: 101122 - DNA, 25 bp, Homo sapien
gagttttctttgatagtttctgcct

SEQ ID NO: 101123 - DNA, 25 bp, Homo sapien
tttgatagtttctgcctcactcatc

SEQ ID NO: 101124 - DNA, 25 bp, Homo sapien
ctggccagaacatctcactgatact

SEQ ID NO: 101125 - DNA, 25 bp, Homo sapien
catctcactgatactcgaattcttt

SEQ ID NO: 101126 - DNA, 25 bp, Homo sapien
ttcctgtgctctaggtgggctaagt

SEQ ID NO: 101127 - DNA, 25 bp, Homo sapien
tgtgctctaggtgggctaagtgcct

SEQ ID NO: 101128 - DNA, 25 bp, Homo sapien
gggctaagtgcctccctagaggact

SEQ ID NO: 101129 - DNA, 25 bp, Homo sapien
tccctagaggactccatggctgaga

SEQ ID NO: 101130 - DNA, 25 bp, Homo sapien
actccatggctgagaggctcctggg

SEQ ID NO: 101131 - DNA, 25 bp, Homo sapien
tgggccagtcccagatgaagcctat

SEQ ID NO: 101132 - DNA, 25 bp, Homo sapien
gatgaagcctatgggagtcaggacc

SEQ ID NO: 101133 - DNA, 25 bp, Homo sapien
aaggttggagttggtctaggacatt

SEQ ID NO: 101134 - DNA, 25 bp, Homo sapien
gagttggtctaggacattggtttta

SEQ ID NO: 101135 - DNA, 25 bp, Homo sapien
agttctgtgaactggtccaaggagg

SEQ ID NO: 101136 - DNA, 25 bp, Homo sapien
ctggtccaaggaggttctgttatta

SEQ ID NO: 101137 - DNA, 25 bp, Homo sapien
tttattccattttaagcacttacac

SEQ ID NO: 101138 - DNA, 25 bp, Homo sapien
gcacttacacagttagtcatggaga

SEQ ID NO: 101139 - DNA, 25 bp, Homo sapien
gtcatggagagtaacaggcctgctg

SEQ ID NO: 101140 - DNA, 25 bp, Homo sapien
aacaggcctgctggtgaaacaggtc

SEQ ID NO: 101141 - DNA, 25 bp, Homo sapien
acaggtcacccaaaatggagatggc

SEQ ID NO: 101142 - DNA, 25 bp, Homo sapien
atggagatggcatcaaactagtggt

SEQ ID NO: 101143 - DNA, 25 bp, Homo sapien
aaagcaactcttatcaaggattaat

SEQ ID NO: 101144 - DNA, 25 bp, Homo sapien
aatacaagttattgattcactcttc

SEQ ID NO: 101145 - DNA, 25 bp, Homo sapien
caacttgacagtctacctgtggtat

SEQ ID NO: 101146 - DNA, 25 bp, Homo sapien
agtctacctgtggtataactgtcag

SEQ ID NO: 101147 - DNA, 25 bp, Homo sapien
taaaaacatacatctttacaacttg

SEQ ID NO: 101148 - DNA, 25 bp, Homo sapien
ttcttaggcggtataaatgcagttc

SEQ ID NO: 101149 - DNA, 25 bp, Homo sapien
taaatgcagttctgatcactggatt

SEQ ID NO: 101150 - DNA, 25 bp, Homo sapien
cactggattggactgaagatggcaa

SEQ ID NO: 101151 - DNA, 25 bp, Homo sapien
aaaatcgaacaggacaatgggtaga

SEQ ID NO: 101152 - DNA, 25 bp, Homo sapien
gggtagatggagctacatttaccaa

SEQ ID NO: 101153 - DNA, 25 bp, Homo sapien
acatttaccaaatcgtttggcatga

SEQ ID NO: 101154 - DNA, 25 bp, Homo sapien
tgaaggatgtgcctacctcagcgat

SEQ ID NO: 101155 - DNA, 25 bp, Homo sapien
atgtgcctacctcagcgatgatggt

SEQ ID NO: 101156 - DNA, 25 bp, Homo sapien
tcagcgatgatggtgcagcaacagc

SEQ ID NO: 101157 - DNA, 25 bp, Homo sapien
gcaacagctagatgttacaccgaaa

SEQ ID NO: 101158 - DNA, 25 bp, Homo sapien
ttaagtgtaaaaccagcaaagtact

SEQ ID NO: 101159 - DNA, 25 bp, Homo sapien
agttccagcacatcatgtactgcga

SEQ ID NO: 101160 - DNA, 25 bp, Homo sapien
cacatcatgtactgcgagaatttcg

SEQ ID NO: 101161 - DNA, 25 bp, Homo sapien
gagaatttcgcaccaggcaccacca

SEQ ID NO: 101162 - DNA, 25 bp, Homo sapien
ccccggtcagtcaaggtcagaggct

SEQ ID NO: 101163 - DNA, 25 bp, Homo sapien
gggttcctaccccacagtcattcag

SEQ ID NO: 101164 - DNA, 25 bp, Homo sapien
attcagcagcagaatgccacgagcc

SEQ ID NO: 101165 - DNA, 25 bp, Homo sapien
agaatgccacgagccaaagagccgc

SEQ ID NO: 101166 - DNA, 25 bp, Homo sapien
acgagccaaagagccgccaaaaacg

SEQ ID NO: 101167 - DNA, 25 bp, Homo sapien
gaccaaaaggaagtattacctgcgg

SEQ ID NO: 101168 - DNA, 25 bp, Homo sapien
gtgaccattaaacaggagcagaact

SEQ ID NO: 101169 - DNA, 25 bp, Homo sapien
gaacttggaccagacctacttggat

SEQ ID NO: 101170 - DNA, 25 bp, Homo sapien
tgcagaaagatttagctacagtatt

SEQ ID NO: 101171 - DNA, 25 bp, Homo sapien
ttttttcatgactacacagctttat

SEQ ID NO: 101172 - DNA, 25 bp, Homo sapien
ctacacagctttataacatcccaac

SEQ ID NO: 101173 - DNA, 25 bp, Homo sapien
ataacatcccaacatgctgattatt

SEQ ID NO: 101174 - DNA, 25 bp, Homo sapien
gctgattattatacaactgatacct

SEQ ID NO: 101175 - DNA, 25 bp, Homo sapien
acaactgataccttgttaactgtat

SEQ ID NO: 101176 - DNA, 25 bp, Homo sapien
actgtatatatctaggctgtttcca

SEQ ID NO: 101177 - DNA, 25 bp, Homo sapien
ggctgtttccaatcttacagctaaa

SEQ ID NO: 101178 - DNA, 25 bp, Homo sapien
tgggtcaaggacacgtacattttta

SEQ ID NO: 101179 - DNA, 25 bp, Homo sapien
agaggtttgcagtctgtgaccaact

SEQ ID NO: 101180 - DNA, 25 bp, Homo sapien
gtctgtgaccaactttgaagccaaa

SEQ ID NO: 101181 - DNA, 25 bp, Homo sapien
tgtgcagccggagggtcctaagaat

SEQ ID NO: 101182 - DNA, 25 bp, Homo sapien
ggtcctaagaatggctcccggagct

SEQ ID NO: 101183 - DNA, 25 bp, Homo sapien
ggagctaactgagggcccagccttt

SEQ ID NO: 101184 - DNA, 25 bp, Homo sapien
ttttttctgcatgatccaggagcac

SEQ ID NO: 101185 - DNA, 25 bp, Homo sapien
catgatccaggagcacataccacaa

SEQ ID NO: 101186 - DNA, 25 bp, Homo sapien
gggctgacatgatgaccaagaacct

SEQ ID NO: 101187 - DNA, 25 bp, Homo sapien
gaacctggcaggaaagaccccgacg

SEQ ID NO: 101188 - DNA, 25 bp, Homo sapien
cgacggacctggtgcagctctggca

SEQ ID NO: 101189 - DNA, 25 bp, Homo sapien
agctctggcaggctgatacccggca

SEQ ID NO: 101190 - DNA, 25 bp, Homo sapien
acgccctggagcatcctgagccggg

SEQ ID NO: 101191 - DNA, 25 bp, Homo sapien
gatagtgggcgagagacccctcagc

SEQ ID NO: 101192 - DNA, 25 bp, Homo sapien
ggactgggttcgctctcagctctgc

SEQ ID NO: 101193 - DNA, 25 bp, Homo sapien
gactgggttcgctctcagctctgca

SEQ ID NO: 101194 - DNA, 25 bp, Homo sapien
ggtgtctggaggcatgttcccctca

SEQ ID NO: 101195 - DNA, 25 bp, Homo sapien
gtgtctggaggcatgttcccctcac

SEQ ID NO: 101196 - DNA, 25 bp, Homo sapien
gggtctcagggaggccgggtgtgac

SEQ ID NO: 101197 - DNA, 25 bp, Homo sapien
ttctcatggtgctatcctggtgcta

SEQ ID NO: 101198 - DNA, 25 bp, Homo sapien
tctcatggtgctatcctggtgctat

SEQ ID NO: 101199 - DNA, 25 bp, Homo sapien
ctcatggtgctatcctggtgctatt

SEQ ID NO: 101200 - DNA, 25 bp, Homo sapien
tcatggtgctatcctggtgctattg

SEQ ID NO: 101201 - DNA, 25 bp, Homo sapien
catggtgctatcctggtgctattgg

SEQ ID NO: 101202 - DNA, 25 bp, Homo sapien
atggtgctatcctggtgctattggg

SEQ ID NO: 101203 - DNA, 25 bp, Homo sapien
cggccagtcagatgtttctcatcct

SEQ ID NO: 101204 - DNA, 25 bp, Homo sapien
aaacttgctgcctgactaaagatta

SEQ ID NO: 101205 - DNA, 25 bp, Homo sapien
aattaattctaccatcttgcaataa

SEQ ID NO: 101206 - DNA, 25 bp, Homo sapien
ttctaccatcttgcaataaagtgac

SEQ ID NO: 101207 - DNA, 25 bp, Homo sapien
aacagttgactgactaaatggaaac

SEQ ID NO: 101208 - DNA, 25 bp, Homo sapien
actagtctatttgacaaagtctttc

SEQ ID NO: 101209 - DNA, 25 bp, Homo sapien
tgacaaagtctttctgtgttggtgt

SEQ ID NO: 101210 - DNA, 25 bp, Homo sapien
aaaagtttgtttcatatagtgagag

SEQ ID NO: 101211 - DNA, 25 bp, Homo sapien
gagaacgaaatctctatcggccagt

SEQ ID NO: 101212 - DNA, 25 bp, Homo sapien
acgaaatctctatcggccagtcaga

SEQ ID NO: 101213 - DNA, 25 bp, Homo sapien
ctatcggccagtcagatgtttctca

SEQ ID NO: 101214 - DNA, 25 bp, Homo sapien
gggtggggccgtgcctcacttttat

SEQ ID NO: 101215 - DNA, 25 bp, Homo sapien
ttttatttattgctggttttcctgg

SEQ ID NO: 101216 - DNA, 25 bp, Homo sapien
ggagctgtgtcccttagcctttcag

SEQ ID NO: 101217 - DNA, 25 bp, Homo sapien
gctgtgtcccttagcctttcagagg

SEQ ID NO: 101218 - DNA, 25 bp, Homo sapien
tcccttagcctttcagaggcttggt

SEQ ID NO: 101219 - DNA, 25 bp, Homo sapien
ttcagaggcttggtgttcagggccc

SEQ ID NO: 101220 - DNA, 25 bp, Homo sapien
actcccctcttgctgcgtgttgatt

SEQ ID NO: 101221 - DNA, 25 bp, Homo sapien
ccctcttgctgcgtgttgatttgga

SEQ ID NO: 101222 - DNA, 25 bp, Homo sapien
tgctgcgtgttgatttggaggcact

SEQ ID NO: 101223 - DNA, 25 bp, Homo sapien
ttgatttggaggcactgcagtccag

SEQ ID NO: 101224 - DNA, 25 bp, Homo sapien
agtccaggccgagtcctcagtgcgg

SEQ ID NO: 101225 - DNA, 25 bp, Homo sapien
acattttaagtctctctggtgctaa

SEQ ID NO: 101226 - DNA, 25 bp, Homo sapien
agtctctctggtgctaagaattggc

SEQ ID NO: 101227 - DNA, 25 bp, Homo sapien
aagaattggcactttatagcctggt

SEQ ID NO: 101228 - DNA, 25 bp, Homo sapien
actttatagcctggtgcctttactt

SEQ ID NO: 101229 - DNA, 25 bp, Homo sapien
ttgagagaacctactgctagtccca

SEQ ID NO: 101230 - DNA, 25 bp, Homo sapien
gctagtcccaggaaacacacttgga

SEQ ID NO: 101231 - DNA, 25 bp, Homo sapien
tttgcccagtgatgctatagttgtc

SEQ ID NO: 101232 - DNA, 25 bp, Homo sapien
agttgtcatattgtccaaagttcat

SEQ ID NO: 101233 - DNA, 25 bp, Homo sapien
aagctgaggagcttgtcctgtgtat

SEQ ID NO: 101234 - DNA, 25 bp, Homo sapien
agcttgtcctgtgtatgtgaatgca

SEQ ID NO: 101235 - DNA, 25 bp, Homo sapien
gcacacatgtgcacttagttcaaat

SEQ ID NO: 101236 - DNA, 25 bp, Homo sapien
caatgctcattgtacatcacagaac

SEQ ID NO: 101237 - DNA, 25 bp, Homo sapien
gatgagtgtgagaaagcttacttct

SEQ ID NO: 101238 - DNA, 25 bp, Homo sapien
gcttacttctatatgtcttgccttg

SEQ ID NO: 101239 - DNA, 25 bp, Homo sapien
acttctatatgtcttgccttgttaa

SEQ ID NO: 101240 - DNA, 25 bp, Homo sapien
atgtcttgccttgttaaacataaga

SEQ ID NO: 101241 - DNA, 25 bp, Homo sapien
aaatccttccacagcaagtcacagc

SEQ ID NO: 101242 - DNA, 25 bp, Homo sapien
agcaagtcacagcttaagtcctagt

SEQ ID NO: 101243 - DNA, 25 bp, Homo sapien
gcttaagtcctagtgaacatgtgca

SEQ ID NO: 101244 - DNA, 25 bp, Homo sapien
taagtcctagtgaacatgtgcaggg

SEQ ID NO: 101245 - DNA, 25 bp, Homo sapien
agccctgttaatatggtaactgtgg

SEQ ID NO: 101246 - DNA, 25 bp, Homo sapien
ttaatatggtaactgtggcaatggt

SEQ ID NO: 101247 - DNA, 25 bp, Homo sapien
agaggcgcgcttcgagggaatatgc

SEQ ID NO: 101248 - DNA, 25 bp, Homo sapien
ggaatatgcgaagctgccgcgtgct

SEQ ID NO: 101249 - DNA, 25 bp, Homo sapien
atatgcgaagctgccgcgtgctgct

SEQ ID NO: 101250 - DNA, 25 bp, Homo sapien
gaagctgccgcgtgctgctgcacat

SEQ ID NO: 101251 - DNA, 25 bp, Homo sapien
tgctgctgcacatgcgctttttccc

SEQ ID NO: 101252 - DNA, 25 bp, Homo sapien
gggagtccgcagttgcccttgttcg

SEQ ID NO: 101253 - DNA, 25 bp, Homo sapien
agttgcccttgttcggaatccacgt

SEQ ID NO: 101254 - DNA, 25 bp, Homo sapien
tgttcggaatccacgttccccgcga

SEQ ID NO: 101255 - DNA, 25 bp, Homo sapien
caggccccgagagggcgagaccaga

SEQ ID NO: 101256 - DNA, 25 bp, Homo sapien
gaactctcagcctctgcgcggaggg

SEQ ID NO: 101257 - DNA, 25 bp, Homo sapien
gccgtgggtgccaggttcccggttg

SEQ ID NO: 101258 - DNA, 25 bp, Homo sapien
agctggcattcctccaggtggcaaa

SEQ ID NO: 101259 - DNA, 25 bp, Homo sapien
tggcaaatggcgactctatactctc

SEQ ID NO: 101260 - DNA, 25 bp, Homo sapien
gccccagggctggatggattagaaa

SEQ ID NO: 101261 - DNA, 25 bp, Homo sapien
atccctatttttcttgtatcgatgt

SEQ ID NO: 101262 - DNA, 25 bp, Homo sapien
tcttgtatcgatgtagagactctat

SEQ ID NO: 101263 - DNA, 25 bp, Homo sapien
agactctattttctcccaaagacac

SEQ ID NO: 101264 - DNA, 25 bp, Homo sapien
tttgcagctgtttgaagtttgtata

SEQ ID NO: 101265 - DNA, 25 bp, Homo sapien
agtttgtatattttccgtactgcag

SEQ ID NO: 101266 - DNA, 25 bp, Homo sapien
ttccgtactgcagagcttacacaaa

SEQ ID NO: 101267 - DNA, 25 bp, Homo sapien
gttcgagttttcttatcttgtgttt

SEQ ID NO: 101268 - DNA, 25 bp, Homo sapien
gtttagaggttgttttttgcagatc

SEQ ID NO: 101269 - DNA, 25 bp, Homo sapien
aggcctctacttctaaacactaatg

SEQ ID NO: 101270 - DNA, 25 bp, Homo sapien
aatggagcccaaaagaagaacctgt

SEQ ID NO: 101271 - DNA, 25 bp, Homo sapien
agaacctgtttcagcacatagtcaa

SEQ ID NO: 101272 - DNA, 25 bp, Homo sapien
gcacatagtcaaagaaccaactgat

SEQ ID NO: 101273 - DNA, 25 bp, Homo sapien
gaaccaactgataatcatcatcata

SEQ ID NO: 101274 - DNA, 25 bp, Homo sapien
gtctcagactaaattttattatggc

SEQ ID NO: 101275 - DNA, 25 bp, Homo sapien
tattatggcagtgtttcatgcattc

SEQ ID NO: 101276 - DNA, 25 bp, Homo sapien
tcatgcattcaaagaagtgtggtga

SEQ ID NO: 101277 - DNA, 25 bp, Homo sapien
caattcaagtgttcatcccacagct

SEQ ID NO: 101278 - DNA, 25 bp, Homo sapien
aagtgttcatcccacagctttgtta

SEQ ID NO: 101279 - DNA, 25 bp, Homo sapien
gttcatcccacagctttgttaaatt

SEQ ID NO: 101280 - DNA, 25 bp, Homo sapien
atttcaaatatctttcaggctgctg

SEQ ID NO: 101281 - DNA, 25 bp, Homo sapien
gaagaatgtggaggcttagacaaaa

SEQ ID NO: 101282 - DNA, 25 bp, Homo sapien
aattgaagctctacaaaaccatgaa

SEQ ID NO: 101283 - DNA, 25 bp, Homo sapien
atgagtctgtgtataaggcttcgtt

SEQ ID NO: 101284 - DNA, 25 bp, Homo sapien
aaggcttcgttaagcttaattgaga

SEQ ID NO: 101285 - DNA, 25 bp, Homo sapien
gagaagtatttctctgtagaggaag

SEQ ID NO: 101286 - DNA, 25 bp, Homo sapien
gaggaagatcaaaacgttgtaccag

SEQ ID NO: 101287 - DNA, 25 bp, Homo sapien
acgttgtaccagaaactacctctga

SEQ ID NO: 101288 - DNA, 25 bp, Homo sapien
cagaaactacctctgaaggctacac

SEQ ID NO: 101289 - DNA, 25 bp, Homo sapien
aaggctacactttccaagttcagga

SEQ ID NO: 101290 - DNA, 25 bp, Homo sapien
ggacctttaacttttagatcatgta

SEQ ID NO: 101291 - DNA, 25 bp, Homo sapien
taacatgatatctggtgtccttcag

SEQ ID NO: 101292 - DNA, 25 bp, Homo sapien
acatgatatctggtgtccttcagag

SEQ ID NO: 101293 - DNA, 25 bp, Homo sapien
atgatatctggtgtccttcagagat

SEQ ID NO: 101294 - DNA, 25 bp, Homo sapien
gatatctggtgtccttcagagatac

SEQ ID NO: 101295 - DNA, 25 bp, Homo sapien
atatctggtgtccttcagagatact

SEQ ID NO: 101296 - DNA, 25 bp, Homo sapien
atctggtgtccttcagagatactgc

SEQ ID NO: 101297 - DNA, 25 bp, Homo sapien
ctggtgtccttcagagatactgcag

SEQ ID NO: 101298 - DNA, 25 bp, Homo sapien
accactgcaataaagaaatagggag

SEQ ID NO: 101299 - DNA, 25 bp, Homo sapien
cagtcagaagacacaaaacattaat

SEQ ID NO: 101300 - DNA, 25 bp, Homo sapien
gaagacacaaaacattaatcgatta

SEQ ID NO: 101301 - DNA, 25 bp, Homo sapien
aatcgattaagtttgtcatattcta

SEQ ID NO: 101302 - DNA, 25 bp, Homo sapien
agatctataaggtcacatgctttta

SEQ ID NO: 101303 - DNA, 25 bp, Homo sapien
gtagcaagttaaacttcactcttga

SEQ ID NO: 101304 - DNA, 25 bp, Homo sapien
gttaaacttcactcttgaattcttt

SEQ ID NO: 101305 - DNA, 25 bp, Homo sapien
taggattgtctttaaacagccattc

SEQ ID NO: 101306 - DNA, 25 bp, Homo sapien
tagaactgtgtatttgattgggaat

SEQ ID NO: 101307 - DNA, 25 bp, Homo sapien
gggaatggtgcttttgccaacttaa

SEQ ID NO: 101308 - DNA, 25 bp, Homo sapien
ggtgcttttgccaacttaaaaggat

SEQ ID NO: 101309 - DNA, 25 bp, Homo sapien
gtaacggagatatacacaaatttta

SEQ ID NO: 101310 - DNA, 25 bp, Homo sapien
atgtgtgatcacaagactaaagata

SEQ ID NO: 101311 - DNA, 25 bp, Homo sapien
aagattattcaacacctctcacatc

SEQ ID NO: 101312 - DNA, 25 bp, Homo sapien
cacctctcacatcttacagatctat

SEQ ID NO: 101313 - DNA, 25 bp, Homo sapien
acgatggatccgtgacagcactttc

SEQ ID NO: 101314 - DNA, 25 bp, Homo sapien
agcactttcctgttgcactgaaact

SEQ ID NO: 101315 - DNA, 25 bp, Homo sapien
tgcactgaaactcttggccatgtag

SEQ ID NO: 101316 - DNA, 25 bp, Homo sapien
ttagaagcctgaaccgttacaaaag

SEQ ID NO: 101317 - DNA, 25 bp, Homo sapien
aaagaagagctcactatggtcaaaa

SEQ ID NO: 101318 - DNA, 25 bp, Homo sapien
gatggctttcaggacttgtttttta

SEQ ID NO: 101319 - DNA, 25 bp, Homo sapien
ttgttttttatcctgcctcacagtt

SEQ ID NO: 101320 - DNA, 25 bp, Homo sapien
tcctgcctcacagttgttaaagtct

SEQ ID NO: 101321 - DNA, 25 bp, Homo sapien
aaagtctgttccaaggcatcacctt

SEQ ID NO: 101322 - DNA, 25 bp, Homo sapien
ttctctacccaacaaccctgtgtaa

SEQ ID NO: 101323 - DNA, 25 bp, Homo sapien
caaccctgtgtaacaactaaagtag

SEQ ID NO: 101324 - DNA, 25 bp, Homo sapien
taaaaggcctctacttctaaacact

SEQ ID NO: 101325 - DNA, 25 bp, Homo sapien
aggcctctacttctaaacactaatg

SEQ ID NO: 101326 - DNA, 25 bp, Homo sapien
ggcctctacttctaaacactaatgg

SEQ ID NO: 101327 - DNA, 25 bp, Homo sapien
taaacactaatggagcccaaaagaa

SEQ ID NO: 101328 - DNA, 25 bp, Homo sapien
aaagaagaacctgtttcagcacata

SEQ ID NO: 101329 - DNA, 25 bp, Homo sapien
gaagaacctgtttcagcacatagtc

SEQ ID NO: 101330 - DNA, 25 bp, Homo sapien
gaacctgtttcagcacatagtcaaa

SEQ ID NO: 101331 - DNA, 25 bp, Homo sapien
acctgtttcagcacatagtcaaaga

SEQ ID NO: 101332 - DNA, 25 bp, Homo sapien
gtttcagcacatagtcaaagaacca

SEQ ID NO: 101333 - DNA, 25 bp, Homo sapien
gcacatagtcaaagaaccaactgat

SEQ ID NO: 101334 - DNA, 25 bp, Homo sapien
caaagaaccaactgataatcatcat

SEQ ID NO: 101335 - DNA, 25 bp, Homo sapien
aggcagtaaccatgcccgcatagat

SEQ ID NO: 101336 - DNA, 25 bp, Homo sapien
gcatagatgccacggaaggtccctc

SEQ ID NO: 101337 - DNA, 25 bp, Homo sapien
aaggtccctcagacatccccgattg

SEQ ID NO: 101338 - DNA, 25 bp, Homo sapien
gacatccccgattgaaagaaccaga

SEQ ID NO: 101339 - DNA, 25 bp, Homo sapien
gaaccagagaggctctgagaaacct

SEQ ID NO: 101340 - DNA, 25 bp, Homo sapien
gaaacctcgggaaacttagatcatc

SEQ ID NO: 101341 - DNA, 25 bp, Homo sapien
tagatcatcagtcaccgaaggtcct

SEQ ID NO: 101342 - DNA, 25 bp, Homo sapien
gaaggtcctacagggccacaactgc

SEQ ID NO: 101343 - DNA, 25 bp, Homo sapien
aaatgtcctgccttttaacgtagat

SEQ ID NO: 101344 - DNA, 25 bp, Homo sapien
tttaacgtagatatatgccttcccc

SEQ ID NO: 101345 - DNA, 25 bp, Homo sapien
cccactaccgtaaatgtccatttat

SEQ ID NO: 101346 - DNA, 25 bp, Homo sapien
gcttcgtcaagtgccggcagtgcca

SEQ ID NO: 101347 - DNA, 25 bp, Homo sapien
gccagcggctcgtggagttgcacac

SEQ ID NO: 101348 - DNA, 25 bp, Homo sapien
tcgtggagttgcacacgtgccgatg

SEQ ID NO: 101349 - DNA, 25 bp, Homo sapien
tggtgccacgcaacgcacagttcaa

SEQ ID NO: 101350 - DNA, 25 bp, Homo sapien
agttcaagccgcacacagatgagga

SEQ ID NO: 101351 - DNA, 25 bp, Homo sapien
tggtgtacttggagcctagccccga

SEQ ID NO: 101352 - DNA, 25 bp, Homo sapien
ccccgacttctgtgagcaggacatg

SEQ ID NO: 101353 - DNA, 25 bp, Homo sapien
ggccgcacatgcaacaagacgtcca

SEQ ID NO: 101354 - DNA, 25 bp, Homo sapien
gcaacaagacgtccaaggccatcga

SEQ ID NO: 101355 - DNA, 25 bp, Homo sapien
tccaaggccatcgacggctgtgagc

SEQ ID NO: 101356 - DNA, 25 bp, Homo sapien
aacgctgcagctgcaaattccactg

SEQ ID NO: 101357 - DNA, 25 bp, Homo sapien
gcgattataatctccaactttattt

SEQ ID NO: 101358 - DNA, 25 bp, Homo sapien
gaatgtacctctattagtttcaatt

SEQ ID NO: 101359 - DNA, 25 bp, Homo sapien
acataactggtttgactctgtccaa

SEQ ID NO: 101360 - DNA, 25 bp, Homo sapien
tgactctgtccaactctgtatttag

SEQ ID NO: 101361 - DNA, 25 bp, Homo sapien
taggccatttgttacagtttcttca

SEQ ID NO: 101362 - DNA, 25 bp, Homo sapien
gttacagtttcttcatgcattactt

SEQ ID NO: 101363 - DNA, 25 bp, Homo sapien
aaactgtaccttttgcgatttcaca

SEQ ID NO: 101364 - DNA, 25 bp, Homo sapien
ttgcgatttcacagttggcacttct

SEQ ID NO: 101365 - DNA, 25 bp, Homo sapien
cagttggcacttctgccatgagcag

SEQ ID NO: 101366 - DNA, 25 bp, Homo sapien
aactgatgcgacttgttttgctgct

SEQ ID NO: 101367 - DNA, 25 bp, Homo sapien
gttttgctgcttggtagcactttaa

SEQ ID NO: 101368 - DNA, 25 bp, Homo sapien
ccacgggcatgactttatttttgtt

SEQ ID NO: 101369 - DNA, 25 bp, Homo sapien
ggcatgactttatttttgttgggct

SEQ ID NO: 101370 - DNA, 25 bp, Homo sapien
ttttttccctgcttaaggagaggtg

SEQ ID NO: 101371 - DNA, 25 bp, Homo sapien
tccctgcttaaggagaggtgtcttt

SEQ ID NO: 101372 - DNA, 25 bp, Homo sapien
aggtgtcttttttggatatgagcta

SEQ ID NO: 101373 - DNA, 25 bp, Homo sapien
aattgttcacccaaatgattctctt

SEQ ID NO: 101374 - DNA, 25 bp, Homo sapien
gttcacccaaatgattctcttataa

SEQ ID NO: 101375 - DNA, 25 bp, Homo sapien
aatgattctcttataaactatttgt

SEQ ID NO: 101376 - DNA, 25 bp, Homo sapien
actatttgtaaatgtcacttattca

SEQ ID NO: 101377 - DNA, 25 bp, Homo sapien
acttattcattagtgtttgacataa

SEQ ID NO: 101378 - DNA, 25 bp, Homo sapien
ttgaatcaatcctttcattacgaaa

SEQ ID NO: 101379 - DNA, 25 bp, Homo sapien
gaccacattcaaggaagaaccttct

SEQ ID NO: 101380 - DNA, 25 bp, Homo sapien
accacattcaaggaagaaccttctg

SEQ ID NO: 101381 - DNA, 25 bp, Homo sapien
ccacattcaaggaagaaccttctgc

SEQ ID NO: 101382 - DNA, 25 bp, Homo sapien
gaaaagctttcccacttggctctta

SEQ ID NO: 101383 - DNA, 25 bp, Homo sapien
aaaagctttcccacttggctcttat

SEQ ID NO: 101384 - DNA, 25 bp, Homo sapien
aaagctttcccacttggctcttatt

SEQ ID NO: 101385 - DNA, 25 bp, Homo sapien
aagctttcccacttggctcttattc

SEQ ID NO: 101386 - DNA, 25 bp, Homo sapien
agctttcccacttggctcttattct

SEQ ID NO: 101387 - DNA, 25 bp, Homo sapien
gctttcccacttggctcttattctt

SEQ ID NO: 101388 - DNA, 25 bp, Homo sapien
tccttagcaaagagaccctggcctc

SEQ ID NO: 101389 - DNA, 25 bp, Homo sapien
ggaatagaagattccgtggccttgg

SEQ ID NO: 101390 - DNA, 25 bp, Homo sapien
gagagacactctccatgaacacttc

SEQ ID NO: 101391 - DNA, 25 bp, Homo sapien
ttcccagggtaagtgcccacgaaag

SEQ ID NO: 101392 - DNA, 25 bp, Homo sapien
taagtgcccacgaaagcccagtcca

SEQ ID NO: 101393 - DNA, 25 bp, Homo sapien
cagtccactcttcgcctcggtaata

SEQ ID NO: 101394 - DNA, 25 bp, Homo sapien
tcggtaatacctgtctgatgccaca

SEQ ID NO: 101395 - DNA, 25 bp, Homo sapien
ttattctcccctaacccagggcaat

SEQ ID NO: 101396 - DNA, 25 bp, Homo sapien
ctaacccagggcaatgtcagctatt

SEQ ID NO: 101397 - DNA, 25 bp, Homo sapien
gggcaatgtcagctattggcagtaa

SEQ ID NO: 101398 - DNA, 25 bp, Homo sapien
ttggcagtaaagtggcgctacaaac

SEQ ID NO: 101399 - DNA, 25 bp, Homo sapien
ttagatcatcagtcaccgaaggtcc

SEQ ID NO: 101400 - DNA, 25 bp, Homo sapien
tagatcatcagtcaccgaaggtcct

SEQ ID NO: 101401 - DNA, 25 bp, Homo sapien
gatcatcagtcaccgaaggtcctac

SEQ ID NO: 101402 - DNA, 25 bp, Homo sapien
tcatcagtcaccgaaggtcctacag

SEQ ID NO: 101403 - DNA, 25 bp, Homo sapien
atcagtcaccgaaggtcctacaggg

SEQ ID NO: 101404 - DNA, 25 bp, Homo sapien
agtcaccgaaggtcctacagggcca

SEQ ID NO: 101405 - DNA, 25 bp, Homo sapien
gaaggtcctacagggccacaactgc

SEQ ID NO: 101406 - DNA, 25 bp, Homo sapien
aaatgtcctgccttttaacgtagat

SEQ ID NO: 101407 - DNA, 25 bp, Homo sapien
aatgtcctgccttttaacgtagata

SEQ ID NO: 101408 - DNA, 25 bp, Homo sapien
tgtcctgccttttaacgtagatata

SEQ ID NO: 101409 - DNA, 25 bp, Homo sapien
cccactaccgtaaatgtccatttat

SEQ ID NO: 101410 - DNA, 25 bp, Homo sapien
tgtgttttgtttctcatcagttaac

SEQ ID NO: 101411 - DNA, 25 bp, Homo sapien
gtttctcatcagttaacataatttt

SEQ ID NO: 101412 - DNA, 25 bp, Homo sapien
acataatttttgtctattcatttaa

SEQ ID NO: 101413 - DNA, 25 bp, Homo sapien
taaaaatttgttggatccctagact

SEQ ID NO: 101414 - DNA, 25 bp, Homo sapien
aaatttgttggatccctagactaag

SEQ ID NO: 101415 - DNA, 25 bp, Homo sapien
tgttggatccctagactaagttgaa

SEQ ID NO: 101416 - DNA, 25 bp, Homo sapien
ggatccctagactaagttgaaatgt

SEQ ID NO: 101417 - DNA, 25 bp, Homo sapien
gaaatgtatttctaatagtaggcaa

SEQ ID NO: 101418 - DNA, 25 bp, Homo sapien
catgtagttgtttaattgttctcta

SEQ ID NO: 101419 - DNA, 25 bp, Homo sapien
tgttctctaattaatggaccaatga

SEQ ID NO: 101420 - DNA, 25 bp, Homo sapien
gtgtgtattctacctttttatggga

SEQ ID NO: 101421 - DNA, 25 bp, Homo sapien
tacaaaataattagccgggtgttgg

SEQ ID NO: 101422 - DNA, 25 bp, Homo sapien
tttaaaactaggcataaacagccag

SEQ ID NO: 101423 - DNA, 25 bp, Homo sapien
ttaaaactaggcataaacagccagg

SEQ ID NO: 101424 - DNA, 25 bp, Homo sapien
taaaactaggcataaacagccaggc

SEQ ID NO: 101425 - DNA, 25 bp, Homo sapien
aaaactaggcataaacagccaggca

SEQ ID NO: 101426 - DNA, 25 bp, Homo sapien
aaactaggcataaacagccaggcat

SEQ ID NO: 101427 - DNA, 25 bp, Homo sapien
aactaggcataaacagccaggcatg

SEQ ID NO: 101428 - DNA, 25 bp, Homo sapien
actaggcataaacagccaggcatgg

SEQ ID NO: 101429 - DNA, 25 bp, Homo sapien
ctaggcataaacagccaggcatggt

SEQ ID NO: 101430 - DNA, 25 bp, Homo sapien
taggcataaacagccaggcatggtg

SEQ ID NO: 101431 - DNA, 25 bp, Homo sapien
aggcataaacagccaggcatggtga

SEQ ID NO: 101432 - DNA, 25 bp, Homo sapien
ggagattatattggttctgcctctg

SEQ ID NO: 101433 - DNA, 25 bp, Homo sapien
attatattggttctgcctctggcat

SEQ ID NO: 101434 - DNA, 25 bp, Homo sapien
tgcctctggcatgctggtagactag

SEQ ID NO: 101435 - DNA, 25 bp, Homo sapien
gtagactagggccatcctaacttat

SEQ ID NO: 101436 - DNA, 25 bp, Homo sapien
ggccatcctaacttattattttcca

SEQ ID NO: 101437 - DNA, 25 bp, Homo sapien
attttccagaggttctcctccagac

SEQ ID NO: 101438 - DNA, 25 bp, Homo sapien
tcctccagacaagacctgcagtaag

SEQ ID NO: 101439 - DNA, 25 bp, Homo sapien
gagttatattctacctctctctcaa

SEQ ID NO: 101440 - DNA, 25 bp, Homo sapien
atttgtgtggcttttattgtagaac

SEQ ID NO: 101441 - DNA, 25 bp, Homo sapien
acttagcatagtgttctgttgttta

SEQ ID NO: 101442 - DNA, 25 bp, Homo sapien
catagtgttctgttgtttacatgaa

SEQ ID NO: 101443 - DNA, 25 bp, Homo sapien
ggatgtctaggaatgttttgtttat

SEQ ID NO: 101444 - DNA, 25 bp, Homo sapien
acttaatgagtatgacaggtgtttc

SEQ ID NO: 101445 - DNA, 25 bp, Homo sapien
gtgtttcatttggttgtgtggcaag

SEQ ID NO: 101446 - DNA, 25 bp, Homo sapien
ttgtgtggcaagtgtccttggatat

SEQ ID NO: 101447 - DNA, 25 bp, Homo sapien
actgctgggattattggatggtgta

SEQ ID NO: 101448 - DNA, 25 bp, Homo sapien
gatggtgtagtttttctgcttccaa

SEQ ID NO: 101449 - DNA, 25 bp, Homo sapien
atttatttctgcattagccatggaa

SEQ ID NO: 101450 - DNA, 25 bp, Homo sapien
tagccatggaaggacagcaactttt

SEQ ID NO: 101451 - DNA, 25 bp, Homo sapien
cttttagtagcatatccttgcgctt

SEQ ID NO: 101452 - DNA, 25 bp, Homo sapien
tatggagtctttgccctgatttccg

SEQ ID NO: 101453 - DNA, 25 bp, Homo sapien
ctttgccctgatttccgtcttttga

SEQ ID NO: 101454 - DNA, 25 bp, Homo sapien
gtacgagagcttagcgcgactccat

SEQ ID NO: 101455 - DNA, 25 bp, Homo sapien
cgactccattcaaactactacaaac

SEQ ID NO: 101456 - DNA, 25 bp, Homo sapien
agagacaccagcttcagtggcctgt

SEQ ID NO: 101457 - DNA, 25 bp, Homo sapien
cagtggcctgtcgttggaagagtac

SEQ ID NO: 101458 - DNA, 25 bp, Homo sapien
agagtacaagctgatcctgtccaca

SEQ ID NO: 101459 - DNA, 25 bp, Homo sapien
gtccacagacaccttggaagagctt

SEQ ID NO: 101460 - DNA, 25 bp, Homo sapien
ccccaagggtcctgaggaggatcat

SEQ ID NO: 101461 - DNA, 25 bp, Homo sapien
tgagctcaggccttacctcgtgcac

SEQ ID NO: 101462 - DNA, 25 bp, Homo sapien
acatacctaggtgtggagtcttgta

SEQ ID NO: 101463 - DNA, 25 bp, Homo sapien
ggagtcttgtacattgccatcgtca

SEQ ID NO: 101464 - DNA, 25 bp, Homo sapien
gccatcgtcaataaaactgccccag

SEQ ID NO: 101465 - DNA, 25 bp, Homo sapien
gtgcctgtgcttgaaggttgctgta

SEQ ID NO: 101466 - DNA, 25 bp, Homo sapien
ttgctgtagagcatctgacccctta

SEQ ID NO: 101467 - DNA, 25 bp, Homo sapien
tgaccccttattaccaccttaagca

SEQ ID NO: 101468 - DNA, 25 bp, Homo sapien
gtatatgccatgcattaccatgcac

SEQ ID NO: 101469 - DNA, 25 bp, Homo sapien
taccatgcactaattcaatcacagg

SEQ ID NO: 101470 - DNA, 25 bp, Homo sapien
caatcacaggtgtttctatctagat

SEQ ID NO: 101471 - DNA, 25 bp, Homo sapien
gacatatctttgtatggtaccagtt

SEQ ID NO: 101472 - DNA, 25 bp, Homo sapien
ccagttagttttgccgtggatcaga

SEQ ID NO: 101473 - DNA, 25 bp, Homo sapien
tttgccgtggatcagatggtttata

SEQ ID NO: 101474 - DNA, 25 bp, Homo sapien
atttgaaagcccgtctattcctatg

SEQ ID NO: 101475 - DNA, 25 bp, Homo sapien
cccgtctattcctatgctcaataaa

SEQ ID NO: 101476 - DNA, 25 bp, Homo sapien
actatgacggccaggagcaggacga

SEQ ID NO: 101477 - DNA, 25 bp, Homo sapien
aggagcaggacgagctcagctttaa

SEQ ID NO: 101478 - DNA, 25 bp, Homo sapien
gctttaaggccggagacgaactcac

SEQ ID NO: 101479 - DNA, 25 bp, Homo sapien
aaggccggagacgaactcaccaagc

SEQ ID NO: 101480 - DNA, 25 bp, Homo sapien
tggacagcgggcagctgggcctcta

SEQ ID NO: 101481 - DNA, 25 bp, Homo sapien
caactacgtggaggctatctagagg

SEQ ID NO: 101482 - DNA, 25 bp, Homo sapien
tacgtggaggctatctagaggcccc

SEQ ID NO: 101483 - DNA, 25 bp, Homo sapien
ctcgccatagagttccagacatatt

SEQ ID NO: 101484 - DNA, 25 bp, Homo sapien
tagagttccagacatattttccgat

SEQ ID NO: 101485 - DNA, 25 bp, Homo sapien
agttccagacatattttccgatcaa

SEQ ID NO: 101486 - DNA, 25 bp, Homo sapien
tattttccgatcaagcttttatttt

SEQ ID NO: 101487 - DNA, 25 bp, Homo sapien
gctctcggacttgaactctactgta

SEQ ID NO: 101488 - DNA, 25 bp, Homo sapien
gctgtacaggacgattcactgccat

SEQ ID NO: 101489 - DNA, 25 bp, Homo sapien
attcactgccatgccagtcaggcgg

SEQ ID NO: 101490 - DNA, 25 bp, Homo sapien
agtcaggcgggcttgccatgttctg

SEQ ID NO: 101491 - DNA, 25 bp, Homo sapien
atgttctgtgaatctcgagtgagcg

SEQ ID NO: 101492 - DNA, 25 bp, Homo sapien
gaatctcgagtgagcggtgccaccc

SEQ ID NO: 101493 - DNA, 25 bp, Homo sapien
acggtcgcagccagacgtgagcttg

SEQ ID NO: 101494 - DNA, 25 bp, Homo sapien
cagacgtgagcttggcattgaagtt

SEQ ID NO: 101495 - DNA, 25 bp, Homo sapien
attgaagttgcaaagcggcccctgg

SEQ ID NO: 101496 - DNA, 25 bp, Homo sapien
tcgccgtcgctgtccagggccgtgt

SEQ ID NO: 101497 - DNA, 25 bp, Homo sapien
ggctgtaaagctgtaggaccctttt

SEQ ID NO: 101498 - DNA, 25 bp, Homo sapien
gccgttgggacgaggccaataccga

SEQ ID NO: 101499 - DNA, 25 bp, Homo sapien
gggacgaggccaataccgagaagca

SEQ ID NO: 101500 - DNA, 25 bp, Homo sapien
aggccaataccgagaagcagcggct

SEQ ID NO: 101501 - DNA, 25 bp, Homo sapien
aaggaggcggatgcctacacgccac

SEQ ID NO: 101502 - DNA, 25 bp, Homo sapien
cggatgcctacacgccactgtggtt

SEQ ID NO: 101503 - DNA, 25 bp, Homo sapien
gaagaggctggatccgctgaccggg

SEQ ID NO: 101504 - DNA, 25 bp, Homo sapien
gcctgtgtgtacaagggcggctact

SEQ ID NO: 101505 - DNA, 25 bp, Homo sapien
acaagggcggctactgggaggccaa

SEQ ID NO: 101506 - DNA, 25 bp, Homo sapien
ccaaggagaagcaagactggcatat

SEQ ID NO: 101507 - DNA, 25 bp, Homo sapien
aagactggcatatgtgccccaacat

SEQ ID NO: 101508 - DNA, 25 bp, Homo sapien
catatgtgccccaacatcttctgag

SEQ ID NO: 101509 - DNA, 25 bp, Homo sapien
cagaggccctctgagatcatgtgag

SEQ ID NO: 101510 - DNA, 25 bp, Homo sapien
agatcatgtgagtcctccatggcaa

SEQ ID NO: 101511 - DNA, 25 bp, Homo sapien
gtcctccatggcaaggaagcagttc

SEQ ID NO: 101512 - DNA, 25 bp, Homo sapien
gggagagtcaggttccagctagtta

SEQ ID NO: 101513 - DNA, 25 bp, Homo sapien
gttccagctagttagggctgccagc

SEQ ID NO: 101514 - DNA, 25 bp, Homo sapien
agcctagggctttgtgcctacacct

SEQ ID NO: 101515 - DNA, 25 bp, Homo sapien
tcactaagcccatggagaggtcaca

SEQ ID NO: 101516 - DNA, 25 bp, Homo sapien
gtgcacgggcagatgggccccaaaa

SEQ ID NO: 101517 - DNA, 25 bp, Homo sapien
gcgaaggtcggtaaagtgctaagct

SEQ ID NO: 101518 - DNA, 25 bp, Homo sapien
tgctaagctgttgtctgcactcttt

SEQ ID NO: 101519 - DNA, 25 bp, Homo sapien
gttgtctgcactctttcatcataaa

SEQ ID NO: 101520 - DNA, 25 bp, Homo sapien
gctgtccctgtgcatcctttgatta

SEQ ID NO: 101521 - DNA, 25 bp, Homo sapien
tgtgcatcctttgattactctcatg

SEQ ID NO: 101522 - DNA, 25 bp, Homo sapien
ttgattactctcatgctgcatttac

SEQ ID NO: 101523 - DNA, 25 bp, Homo sapien
ctcatgctgcatttactgtttacat

SEQ ID NO: 101524 - DNA, 25 bp, Homo sapien
ggtttgtaaacattattgcctgaga

SEQ ID NO: 101525 - DNA, 25 bp, Homo sapien
atttattcagaacgcatacggcatg

SEQ ID NO: 101526 - DNA, 25 bp, Homo sapien
gcatacggcatgttaatgactctga

SEQ ID NO: 101527 - DNA, 25 bp, Homo sapien
taatgactctgatggtgtcctcctc

SEQ ID NO: 101528 - DNA, 25 bp, Homo sapien
tctgatggtgtcctcctctgggcag

SEQ ID NO: 101529 - DNA, 25 bp, Homo sapien
tgggcagctgtataggatcatcatg

SEQ ID NO: 101530 - DNA, 25 bp, Homo sapien
ataggatcatcatgtggttacaaaa

SEQ ID NO: 101531 - DNA, 25 bp, Homo sapien
tccgcagtcctaacagggtgagaaa

SEQ ID NO: 101532 - DNA, 25 bp, Homo sapien
gtcctaacagggtgagaaagcacaa

SEQ ID NO: 101533 - DNA, 25 bp, Homo sapien
ccagctcggctgaggcctgaggaga

SEQ ID NO: 101534 - DNA, 25 bp, Homo sapien
gaagttttgtttcgttcttgggctg

SEQ ID NO: 101535 - DNA, 25 bp, Homo sapien
aacagtgagggcaacaagctgtccc

SEQ ID NO: 101536 - DNA, 25 bp, Homo sapien
gggcaacaagctgtccctcagggac

SEQ ID NO: 101537 - DNA, 25 bp, Homo sapien
gggcttgctttattaagtgagctct

SEQ ID NO: 101538 - DNA, 25 bp, Homo sapien
cttgctttattaagtgagctcttgg

SEQ ID NO: 101539 - DNA, 25 bp, Homo sapien
acagagggccctggtttggcagaga

SEQ ID NO: 101540 - DNA, 25 bp, Homo sapien
gcaagggagggctttagaacatctg

SEQ ID NO: 101541 - DNA, 25 bp, Homo sapien
gagggctttagaacatctgagaaat

SEQ ID NO: 101542 - DNA, 25 bp, Homo sapien
gggaagtggacactcattgacccac

SEQ ID NO: 101543 - DNA, 25 bp, Homo sapien
gtggacactcattgacccactgctg

SEQ ID NO: 101544 - DNA, 25 bp, Homo sapien
tgctgtaccttctgcatctcactca

SEQ ID NO: 101545 - DNA, 25 bp, Homo sapien
tcactcaccgttcactggctttttc

SEQ ID NO: 101546 - DNA, 25 bp, Homo sapien
ttcactggctttttctcttctagca

SEQ ID NO: 101547 - DNA, 25 bp, Homo sapien
tttttctcttctagcaggtgtctcc

SEQ ID NO: 101548 - DNA, 25 bp, Homo sapien
tcccaagtacaaatagagtgacccg

SEQ ID NO: 101549 - DNA, 25 bp, Homo sapien
gagtgacccgtaaaatccaggattt

SEQ ID NO: 101550 - DNA, 25 bp, Homo sapien
gttttttgctacaatcttgacccct

SEQ ID NO: 101551 - DNA, 25 bp, Homo sapien
ttttgctacaatcttgacccctttg

SEQ ID NO: 101552 - DNA, 25 bp, Homo sapien
ctacaatcttgacccctttgctaca

SEQ ID NO: 101553 - DNA, 25 bp, Homo sapien
cggatcaataggtcaggaaatccag

SEQ ID NO: 101554 - DNA, 25 bp, Homo sapien
ggatcaataggtcaggaaatccaga

SEQ ID NO: 101555 - DNA, 25 bp, Homo sapien
gatcaataggtcaggaaatccagac

SEQ ID NO: 101556 - DNA, 25 bp, Homo sapien
atcaataggtcaggaaatccagacc

SEQ ID NO: 101557 - DNA, 25 bp, Homo sapien
tcaataggtcaggaaatccagaccg

SEQ ID NO: 101558 - DNA, 25 bp, Homo sapien
caataggtcaggaaatccagaccgt

SEQ ID NO: 101559 - DNA, 25 bp, Homo sapien
aataggtcaggaaatccagaccgtc

SEQ ID NO: 101560 - DNA, 25 bp, Homo sapien
ataggtcaggaaatccagaccgtcc

SEQ ID NO: 101561 - DNA, 25 bp, Homo sapien
taggtcaggaaatccagaccgtcct

SEQ ID NO: 101562 - DNA, 25 bp, Homo sapien
cgggcgttgtggcgggcacctggag

SEQ ID NO: 101563 - DNA, 25 bp, Homo sapien
cgttgtggcgggcacctggagtccc

SEQ ID NO: 101564 - DNA, 25 bp, Homo sapien
ttccacttccgtttctagtactatt

SEQ ID NO: 101565 - DNA, 25 bp, Homo sapien
gggtggcctaatacctaggaagatg

SEQ ID NO: 101566 - DNA, 25 bp, Homo sapien
ggaagatgttgctattcacgttagt

SEQ ID NO: 101567 - DNA, 25 bp, Homo sapien
gctattcacgttagtaaacagccta

SEQ ID NO: 101568 - DNA, 25 bp, Homo sapien
gaaactcttaggtttactgctacat

SEQ ID NO: 101569 - DNA, 25 bp, Homo sapien
ggtttactgctacatccatttgttt

SEQ ID NO: 101570 - DNA, 25 bp, Homo sapien
gctacatccatttgtttggagaggt

SEQ ID NO: 101571 - DNA, 25 bp, Homo sapien
gagaggtaactgttgtctgtgcctt

SEQ ID NO: 101572 - DNA, 25 bp, Homo sapien
aactgttgtctgtgcctttttgaaa

SEQ ID NO: 101573 - DNA, 25 bp, Homo sapien
tgttgtctgtgcctttttgaaaaac

SEQ ID NO: 101574 - DNA, 25 bp, Homo sapien
ttttctcagggaccacacctcttct

SEQ ID NO: 101575 - DNA, 25 bp, Homo sapien
gtgtgggcgctcgtccacaaacact

SEQ ID NO: 101576 - DNA, 25 bp, Homo sapien
acaaacactccgtggctgagaggca

SEQ ID NO: 101577 - DNA, 25 bp, Homo sapien
gagaggcagcggatccaggcagcga

SEQ ID NO: 101578 - DNA, 25 bp, Homo sapien
accaccccggaggacacgtggatga

SEQ ID NO: 101579 - DNA, 25 bp, Homo sapien
gagatcactgagctgcccctcaagg

SEQ ID NO: 101580 - DNA, 25 bp, Homo sapien
atgctgcctccgtggctccaaggtg

SEQ ID NO: 101581 - DNA, 25 bp, Homo sapien
ctccgtggctccaaggtgagggtca

SEQ ID NO: 101582 - DNA, 25 bp, Homo sapien
ggtgagggtcatcttcacgagcaaa

SEQ ID NO: 101583 - DNA, 25 bp, Homo sapien
ggtcatcttcacgagcaaagagaac

SEQ ID NO: 101584 - DNA, 25 bp, Homo sapien
gagaaccaataaagtgacaacgaac

SEQ ID NO: 101585 - DNA, 25 bp, Homo sapien
agtgacaacgaacgtctgaggcttc

SEQ ID NO: 101586 - DNA, 25 bp, Homo sapien
ttgtgcttccctttacctaaactgt

SEQ ID NO: 101587 - DNA, 25 bp, Homo sapien
ccccttgtgccacacattgcattat

SEQ ID NO: 101588 - DNA, 25 bp, Homo sapien
cttgtgccacacattgcattattaa

SEQ ID NO: 101589 - DNA, 25 bp, Homo sapien
gtgccacacattgcattattaaatg

SEQ ID NO: 101590 - DNA, 25 bp, Homo sapien
atgaccacattcaaggaagaacctt

SEQ ID NO: 101591 - DNA, 25 bp, Homo sapien
tcaaggaagaaccttctgccccagc

SEQ ID NO: 101592 - DNA, 25 bp, Homo sapien
gaaaagctttcccacttggctctta

SEQ ID NO: 101593 - DNA, 25 bp, Homo sapien
aaagctttcccacttggctcttatt

SEQ ID NO: 101594 - DNA, 25 bp, Homo sapien
gctttcccacttggctcttattctt

SEQ ID NO: 101595 - DNA, 25 bp, Homo sapien
attcttccacaagagctttgtcagg

SEQ ID NO: 101596 - DNA, 25 bp, Homo sapien
agctttgtcaggaccaggttgttac

SEQ ID NO: 101597 - DNA, 25 bp, Homo sapien
atagattcatttattagcatttgta

SEQ ID NO: 101598 - DNA, 25 bp, Homo sapien
aacattagtttttttccagcatcag

SEQ ID NO: 101599 - DNA, 25 bp, Homo sapien
tttccagcatcagcaattgctactc

SEQ ID NO: 101600 - DNA, 25 bp, Homo sapien
attgctactcaattgtcaaacacag

SEQ ID NO: 101601 - DNA, 25 bp, Homo sapien
gtcaaacacagcttgcaatatacat

SEQ ID NO: 101602 - DNA, 25 bp, Homo sapien
atatacatagaaacgtctgtgctca

SEQ ID NO: 101603 - DNA, 25 bp, Homo sapien
acgtctgtgctcaaggatttataga

SEQ ID NO: 101604 - DNA, 25 bp, Homo sapien
aatgcttcattaaactgagtgaaac

SEQ ID NO: 101605 - DNA, 25 bp, Homo sapien
gtgaaactggttaagtggcatgtaa

SEQ ID NO: 101606 - DNA, 25 bp, Homo sapien
gtggcatgtaatagtaagtgctcaa

SEQ ID NO: 101607 - DNA, 25 bp, Homo sapien
gtaagtgctcaattaacattggttg

SEQ ID NO: 101608 - DNA, 25 bp, Homo sapien
tggtacaatgcctgtgcacattcta

SEQ ID NO: 101609 - DNA, 25 bp, Homo sapien
tgcctgtgcacattctaacctaaat

SEQ ID NO: 101610 - DNA, 25 bp, Homo sapien
agtatggtacagaggaggccattac

SEQ ID NO: 101611 - DNA, 25 bp, Homo sapien
ggaggccattacagaagcaagcacc

SEQ ID NO: 101612 - DNA, 25 bp, Homo sapien
attttctgggccgaatacagaggcg

SEQ ID NO: 101613 - DNA, 25 bp, Homo sapien
tacagaggcgggtcatactccttaa

SEQ ID NO: 101614 - DNA, 25 bp, Homo sapien
ggcgggtcatactccttaagagcag

SEQ ID NO: 101615 - DNA, 25 bp, Homo sapien
ctccttaagagcagttcagatgatg

SEQ ID NO: 101616 - DNA, 25 bp, Homo sapien
gatgatgatcaagcctattgactga

SEQ ID NO: 101617 - DNA, 25 bp, Homo sapien
gacacagaactttgtacttttcagc

SEQ ID NO: 101618 - DNA, 25 bp, Homo sapien
tacttggcacaatttatttctacac

SEQ ID NO: 101619 - DNA, 25 bp, Homo sapien
gaggccgtgtgatggaagcaaaatc

SEQ ID NO: 101620 - DNA, 25 bp, Homo sapien
ctgctgcctttgaataaggaggaac

SEQ ID NO: 101621 - DNA, 25 bp, Homo sapien
gaacgtgagccaacagatccaagaa

SEQ ID NO: 101622 - DNA, 25 bp, Homo sapien
gatccaagaactgaagctctaggca

SEQ ID NO: 101623 - DNA, 25 bp, Homo sapien
aggaaactgatcttcccttcgagcc

SEQ ID NO: 101624 - DNA, 25 bp, Homo sapien
ttcccttcgagcctccggagggagt

SEQ ID NO: 101625 - DNA, 25 bp, Homo sapien
tccggagggagtgtagccctgccaa

SEQ ID NO: 101626 - DNA, 25 bp, Homo sapien
tattttagccccataacagtcattt

SEQ ID NO: 101627 - DNA, 25 bp, Homo sapien
tagccccataacagtcatttcagac

SEQ ID NO: 101628 - DNA, 25 bp, Homo sapien
ccataacagtcatttcagacttgtg

SEQ ID NO: 101629 - DNA, 25 bp, Homo sapien
gagacttcagagaaagaggccgtgt

SEQ ID NO: 101630 - DNA, 25 bp, Homo sapien
tttgcagcttttgcagacgggcaag

SEQ ID NO: 101631 - DNA, 25 bp, Homo sapien
ttgcagcttttgcagacgggcaaga

SEQ ID NO: 101632 - DNA, 25 bp, Homo sapien
tgcagcttttgcagacgggcaagaa

SEQ ID NO: 101633 - DNA, 25 bp, Homo sapien
cagcttttgcagacgggcaagaagc

SEQ ID NO: 101634 - DNA, 25 bp, Homo sapien
tttgcagacgggcaagaagctgctt

SEQ ID NO: 101635 - DNA, 25 bp, Homo sapien
gggaactcctgccacaacagaataa

SEQ ID NO: 101636 - DNA, 25 bp, Homo sapien
ggaactcctgccacaacagaataaa

SEQ ID NO: 101637 - DNA, 25 bp, Homo sapien
gaactcctgccacaacagaataaag

SEQ ID NO: 101638 - DNA, 25 bp, Homo sapien
aactcctgccacaacagaataaagc

SEQ ID NO: 101639 - DNA, 25 bp, Homo sapien
gccacaacagaataaagcagcctga

SEQ ID NO: 101640 - DNA, 25 bp, Homo sapien
cacaacagaataaagcagcctgatt

SEQ ID NO: 101641 - DNA, 25 bp, Homo sapien
tctgtttactatcgctgagatcatt

SEQ ID NO: 101642 - DNA, 25 bp, Homo sapien
tgtttactatcgctgagatcattat

SEQ ID NO: 101643 - DNA, 25 bp, Homo sapien
gtttactatcgctgagatcattatc

SEQ ID NO: 101644 - DNA, 25 bp, Homo sapien
tttactatcgctgagatcattatca

SEQ ID NO: 101645 - DNA, 25 bp, Homo sapien
ttactatcgctgagatcattatcag

SEQ ID NO: 101646 - DNA, 25 bp, Homo sapien
tactatcgctgagatcattatcaga

SEQ ID NO: 101647 - DNA, 25 bp, Homo sapien
ttatcagaaaatagtctggccgggc

SEQ ID NO: 101648 - DNA, 25 bp, Homo sapien
tggccgggcatggtgtaatcctaac

SEQ ID NO: 101649 - DNA, 25 bp, Homo sapien
ggccgggcatggtgtaatcctaaca

SEQ ID NO: 101650 - DNA, 25 bp, Homo sapien
gccgggcatggtgtaatcctaacac

SEQ ID NO: 101651 - DNA, 25 bp, Homo sapien
ccgggcatggtgtaatcctaacact

SEQ ID NO: 101652 - DNA, 25 bp, Homo sapien
gctgctgttgtatgggacattccta

SEQ ID NO: 101653 - DNA, 25 bp, Homo sapien
gtatgggacattcctatgttttaga

SEQ ID NO: 101654 - DNA, 25 bp, Homo sapien
cattcctatgttttagagttgcagt

SEQ ID NO: 101655 - DNA, 25 bp, Homo sapien
gcagtaaaactttgatgataacctc

SEQ ID NO: 101656 - DNA, 25 bp, Homo sapien
gataacctcaataatagcaaagtgg

SEQ ID NO: 101657 - DNA, 25 bp, Homo sapien
gaccttctctctcttacaatttaat

SEQ ID NO: 101658 - DNA, 25 bp, Homo sapien
taggcagtaatttcgctgtataaca

SEQ ID NO: 101659 - DNA, 25 bp, Homo sapien
atttcgctgtataacaagcatagac

SEQ ID NO: 101660 - DNA, 25 bp, Homo sapien
gacaaatgagtgtccctgcactaag

SEQ ID NO: 101661 - DNA, 25 bp, Homo sapien
tgtccctgcactaagaagaatcact

SEQ ID NO: 101662 - DNA, 25 bp, Homo sapien
gtgttagctgctgttgtatgggaca

SEQ ID NO: 101663 - DNA, 25 bp, Homo sapien
aagcctattgactgaagagagacac

SEQ ID NO: 101664 - DNA, 25 bp, Homo sapien
gcctattgactgaagagagacactc

SEQ ID NO: 101665 - DNA, 25 bp, Homo sapien
tattgactgaagagagacactcgcc

SEQ ID NO: 101666 - DNA, 25 bp, Homo sapien
ttgactgaagagagacactcgccaa

SEQ ID NO: 101667 - DNA, 25 bp, Homo sapien
tgactgaagagagacactcgccaat

SEQ ID NO: 101668 - DNA, 25 bp, Homo sapien
gactgaagagagacactcgccaatt

SEQ ID NO: 101669 - DNA, 25 bp, Homo sapien
actgaagagagacactcgccaattt

SEQ ID NO: 101670 - DNA, 25 bp, Homo sapien
ctgaagagagacactcgccaattta

SEQ ID NO: 101671 - DNA, 25 bp, Homo sapien
gaagagagacactcgccaatttaaa

SEQ ID NO: 101672 - DNA, 25 bp, Homo sapien
aagagagacactcgccaatttaaat

SEQ ID NO: 101673 - DNA, 25 bp, Homo sapien
gagagacactcgccaatttaaatga

SEQ ID NO: 101674 - DNA, 25 bp, Homo sapien
gccggtcaggtagacagagtcgaca

SEQ ID NO: 101675 - DNA, 25 bp, Homo sapien
gagtcgacaaggaagtcgctcagga

SEQ ID NO: 101676 - DNA, 25 bp, Homo sapien
cgctcaggaagtcgacaagatggta

SEQ ID NO: 101677 - DNA, 25 bp, Homo sapien
gggccacaaacggagttttgactga

SEQ ID NO: 101678 - DNA, 25 bp, Homo sapien
aatctaccagtgtgagcttgcctat

SEQ ID NO: 101679 - DNA, 25 bp, Homo sapien
tgtgagcttgcctatttctgcctaa

SEQ ID NO: 101680 - DNA, 25 bp, Homo sapien
gcctatttctgcctaatcatgtaca

SEQ ID NO: 101681 - DNA, 25 bp, Homo sapien
aatcatgtacattatccaccaaaaa

SEQ ID NO: 101682 - DNA, 25 bp, Homo sapien
aattaggtcatcatagttgaggtat

SEQ ID NO: 101683 - DNA, 25 bp, Homo sapien
tgaggtatgtgtctgctatttgcaa

SEQ ID NO: 101684 - DNA, 25 bp, Homo sapien
tgcaaagaagttggtcgtatttttt

SEQ ID NO: 101685 - DNA, 25 bp, Homo sapien
gcacatcttgtctaattttcacaca

SEQ ID NO: 101686 - DNA, 25 bp, Homo sapien
attttcacacatagtcttgatgaca

SEQ ID NO: 101687 - DNA, 25 bp, Homo sapien
tgatgcttctgtcaggtcccactaa

SEQ ID NO: 101688 - DNA, 25 bp, Homo sapien
cttctgtcaggtcccactaattatt

SEQ ID NO: 101689 - DNA, 25 bp, Homo sapien
gtcaggtcccactaattattagaat

SEQ ID NO: 101690 - DNA, 25 bp, Homo sapien
agatttttcatttggtgtgtaagaa

SEQ ID NO: 101691 - DNA, 25 bp, Homo sapien
attctttgtatgattgtagtttctg

SEQ ID NO: 101692 - DNA, 25 bp, Homo sapien
tatgattgtagtttctgtaaatgac

SEQ ID NO: 101693 - DNA, 25 bp, Homo sapien
aatgacactttctatgctgaagtct

SEQ ID NO: 101694 - DNA, 25 bp, Homo sapien
actttctatgctgaagtctttttgt

SEQ ID NO: 101695 - DNA, 25 bp, Homo sapien
gtataattgtgttgattctttttaa

SEQ ID NO: 101696 - DNA, 25 bp, Homo sapien
ggccatcagtatttattgcctccgt

SEQ ID NO: 101697 - DNA, 25 bp, Homo sapien
gccatcagtatttattgcctccgtc

SEQ ID NO: 101698 - DNA, 25 bp, Homo sapien
ccatcagtatttattgcctccgtcc

SEQ ID NO: 101699 - DNA, 25 bp, Homo sapien
catcagtatttattgcctccgtccg

SEQ ID NO: 101700 - DNA, 25 bp, Homo sapien
atcagtatttattgcctccgtccgt

SEQ ID NO: 101701 - DNA, 25 bp, Homo sapien
tcagtatttattgcctccgtccgtg

SEQ ID NO: 101702 - DNA, 25 bp, Homo sapien
agtatttattgcctccgtccgtgcc

SEQ ID NO: 101703 - DNA, 25 bp, Homo sapien
tatttattgcctccgtccgtgccgt

SEQ ID NO: 101704 - DNA, 25 bp, Homo sapien
acaaacaagggaccaagtgcacaca

SEQ ID NO: 101705 - DNA, 25 bp, Homo sapien
aaacaagggaccaagtgcacacatt

SEQ ID NO: 101706 - DNA, 25 bp, Homo sapien
aacaagggaccaagtgcacacattg

SEQ ID NO: 101707 - DNA, 25 bp, Homo sapien
aatggacaagggacagttgctgttc

SEQ ID NO: 101708 - DNA, 25 bp, Homo sapien
tgctgttctcatgttccaagtctga

SEQ ID NO: 101709 - DNA, 25 bp, Homo sapien
tctgagagcaacagaccctcatcat

SEQ ID NO: 101710 - DNA, 25 bp, Homo sapien
cctcatcatctgtgcctggaagagt

SEQ ID NO: 101711 - DNA, 25 bp, Homo sapien
aagagttcactgtcattgagcagca

SEQ ID NO: 101712 - DNA, 25 bp, Homo sapien
cattgagcagcacagcctgagtgct

SEQ ID NO: 101713 - DNA, 25 bp, Homo sapien
ccttattccactgccttatttgaca

SEQ ID NO: 101714 - DNA, 25 bp, Homo sapien
tgctgctcaccttactgccctggga

SEQ ID NO: 101715 - DNA, 25 bp, Homo sapien
agtctccttggagggcctggaactc

SEQ ID NO: 101716 - DNA, 25 bp, Homo sapien
tggaactctgagtcctcctatgaac

SEQ ID NO: 101717 - DNA, 25 bp, Homo sapien
ctcctatgaacctctgtagcctaaa

SEQ ID NO: 101718 - DNA, 25 bp, Homo sapien
gatgaattgtggtgaacttgagtct

SEQ ID NO: 101719 - DNA, 25 bp, Homo sapien
acttgagtctaatgattggtcctgc

SEQ ID NO: 101720 - DNA, 25 bp, Homo sapien
taatgattggtcctgctcctttaaa

SEQ ID NO: 101721 - DNA, 25 bp, Homo sapien
ggtcctgctcctttaaaatacttgt

SEQ ID NO: 101722 - DNA, 25 bp, Homo sapien
aatacttgtttgacattgctaaagg

SEQ ID NO: 101723 - DNA, 25 bp, Homo sapien
gattgtacaagtcccataaactcag

SEQ ID NO: 101724 - DNA, 25 bp, Homo sapien
tatattcaaatatcctcacttgaga

SEQ ID NO: 101725 - DNA, 25 bp, Homo sapien
tcacttgagaaggtgtcctcctttc

SEQ ID NO: 101726 - DNA, 25 bp, Homo sapien
tcctttcctctcttacttctgaaat

SEQ ID NO: 101727 - DNA, 25 bp, Homo sapien
ttattctgagagtattatccaacat

SEQ ID NO: 101728 - DNA, 25 bp, Homo sapien
gtaagactacagcaatattttctaa

SEQ ID NO: 101729 - DNA, 25 bp, Homo sapien
atattctatttttgtgcctggagcc

SEQ ID NO: 101730 - DNA, 25 bp, Homo sapien
ctatttttgtgcctggagccatgtg

SEQ ID NO: 101731 - DNA, 25 bp, Homo sapien
tttttgtgcctggagccatgtgaaa

SEQ ID NO: 101732 - DNA, 25 bp, Homo sapien
tactgttaagtttctttgtatgaac

SEQ ID NO: 101733 - DNA, 25 bp, Homo sapien
gtatgaactgtgttgttagtactca

SEQ ID NO: 101734 - DNA, 25 bp, Homo sapien
gaactgtgttgttagtactcagata

SEQ ID NO: 101735 - DNA, 25 bp, Homo sapien
gtactcagatagtttagctttgtat

SEQ ID NO: 101736 - DNA, 25 bp, Homo sapien
atgtgtgatatgtgttctttgaagg

SEQ ID NO: 101737 - DNA, 25 bp, Homo sapien
aacatttatagtcactttttagtgc

SEQ ID NO: 101738 - DNA, 25 bp, Homo sapien
tagtcactttttagtgcacacattt

SEQ ID NO: 101739 - DNA, 25 bp, Homo sapien
ttccagactttcgttaataaaatat

SEQ ID NO: 101740 - DNA, 25 bp, Homo sapien
gtgggttgtaataatcaagggcttc

SEQ ID NO: 101741 - DNA, 25 bp, Homo sapien
tgtaataatcaagggcttcattcct

SEQ ID NO: 101742 - DNA, 25 bp, Homo sapien
agacagttttgaatctaggttaata

SEQ ID NO: 101743 - DNA, 25 bp, Homo sapien
aatgtcctgtgaacactaattattt

SEQ ID NO: 101744 - DNA, 25 bp, Homo sapien
aaatgtgttaatactgtgcctttga

SEQ ID NO: 101745 - DNA, 25 bp, Homo sapien
tgtgcctttgatttgttagctttaa

SEQ ID NO: 101746 - DNA, 25 bp, Homo sapien
gtttaagacttttacactgccagta

SEQ ID NO: 101747 - DNA, 25 bp, Homo sapien
gacttttacactgccagtattccac

SEQ ID NO: 101748 - DNA, 25 bp, Homo sapien
ttacactgccagtattccacatttg

SEQ ID NO: 101749 - DNA, 25 bp, Homo sapien
actgccagtattccacatttggtga

SEQ ID NO: 101750 - DNA, 25 bp, Homo sapien
cagtattccacatttggtgaaatta

SEQ ID NO: 101751 - DNA, 25 bp, Homo sapien
gtgtactctcaaagaccaaaactat

SEQ ID NO: 101752 - DNA, 25 bp, Homo sapien
aaaactattggccacttttgtatgt

SEQ ID NO: 101753 - DNA, 25 bp, Homo sapien
gccacttttgtatgttgccagcata

SEQ ID NO: 101754 - DNA, 25 bp, Homo sapien
gccagcatattttgaacttgtacct

SEQ ID NO: 101755 - DNA, 25 bp, Homo sapien
gcatattttgaacttgtaccttttt

SEQ ID NO: 101756 - DNA, 25 bp, Homo sapien
ttttatactagcaacactacaaagg

SEQ ID NO: 101757 - DNA, 25 bp, Homo sapien
gatctgtgccataaaatttcagtgt

SEQ ID NO: 101758 - DNA, 25 bp, Homo sapien
atttcagtgtaataagacttcttca

SEQ ID NO: 101759 - DNA, 25 bp, Homo sapien
gacttcttcaatacatcttccaata

SEQ ID NO: 101760 - DNA, 25 bp, Homo sapien
gggtgcttctttgtgacagtatttt

SEQ ID NO: 101761 - DNA, 25 bp, Homo sapien
tacatagtgtggttgttgatacctt

SEQ ID NO: 101762 - DNA, 25 bp, Homo sapien
gttattgttatgtatcacttgctaa

SEQ ID NO: 101763 - DNA, 25 bp, Homo sapien
gaactatggctatgaccaaagcttc

SEQ ID NO: 101764 - DNA, 25 bp, Homo sapien
gaccaaagcttctattttgccaaaa

SEQ ID NO: 101765 - DNA, 25 bp, Homo sapien
aaatggccttaagtgtattcctgac

SEQ ID NO: 101766 - DNA, 25 bp, Homo sapien
gccttaagtgtattcctgacagtta

SEQ ID NO: 101767 - DNA, 25 bp, Homo sapien
attcagaaacgtgccaaatggaact

SEQ ID NO: 101768 - DNA, 25 bp, Homo sapien
ctcaaggtgccccttcagaattaaa

SEQ ID NO: 101769 - DNA, 25 bp, Homo sapien
cactactgactctcgctgtatttaa

SEQ ID NO: 101770 - DNA, 25 bp, Homo sapien
ctcgctgtatttaagatgctggtga

SEQ ID NO: 101771 - DNA, 25 bp, Homo sapien
gatgctggtgaagagcttttgctct

SEQ ID NO: 101772 - DNA, 25 bp, Homo sapien
ttttgctcttgcattagatttgaag

SEQ ID NO: 101773 - DNA, 25 bp, Homo sapien
atgttgatgcccagggtcactcttg

SEQ ID NO: 101774 - DNA, 25 bp, Homo sapien
tgatgcccagggtcactcttgctac

SEQ ID NO: 101775 - DNA, 25 bp, Homo sapien
cacctggttttgactaatcctgctt

SEQ ID NO: 101776 - DNA, 25 bp, Homo sapien
tggttttgactaatcctgcttccct

SEQ ID NO: 101777 - DNA, 25 bp, Homo sapien
gactaatcctgcttccctctctggg

SEQ ID NO: 101778 - DNA, 25 bp, Homo sapien
tctttaaagaacttctgcgggtcag

SEQ ID NO: 101779 - DNA, 25 bp, Homo sapien
gaacttctgcgggtcagactctgaa

SEQ ID NO: 101780 - DNA, 25 bp, Homo sapien
ggtcagactctgaagccgagttgct

SEQ ID NO: 101781 - DNA, 25 bp, Homo sapien
actctgaagccgagttgctgtgggc

SEQ ID NO: 101782 - DNA, 25 bp, Homo sapien
gtgcccggaagcagagcgccacact

SEQ ID NO: 101783 - DNA, 25 bp, Homo sapien
agagcgccacactcgctgcttaagc

SEQ ID NO: 101784 - DNA, 25 bp, Homo sapien
aaagaaaacaaaccattgcttatgc

SEQ ID NO: 101785 - DNA, 25 bp, Homo sapien
gcttatgctgttatatactagagaa

SEQ ID NO: 101786 - DNA, 25 bp, Homo sapien
aacttgacagatgaaggactttagt

SEQ ID NO: 101787 - DNA, 25 bp, Homo sapien
ggactttagttgaacttcatattgt

SEQ ID NO: 101788 - DNA, 25 bp, Homo sapien
gttgtcaagtaaaaagcgctatatc

SEQ ID NO: 101789 - DNA, 25 bp, Homo sapien
gactttatgaacagttattctatca

SEQ ID NO: 101790 - DNA, 25 bp, Homo sapien
taaacctgcccagaaattaccttgg

SEQ ID NO: 101791 - DNA, 25 bp, Homo sapien
ttaccttggtatctgaagtttccct

SEQ ID NO: 101792 - DNA, 25 bp, Homo sapien
gtctcctcctctaattaagcttgtt

SEQ ID NO: 101793 - DNA, 25 bp, Homo sapien
aagcttgttatttgtcatgcaccag

SEQ ID NO: 101794 - DNA, 25 bp, Homo sapien
tttgtcatgcaccagcattggagat

SEQ ID NO: 101795 - DNA, 25 bp, Homo sapien
cttttagtgatagctcatcctgtgc

SEQ ID NO: 101796 - DNA, 25 bp, Homo sapien
tttagtgatagctcatcctgtgctc

SEQ ID NO: 101797 - DNA, 25 bp, Homo sapien
ttagtgatagctcatcctgtgctca

SEQ ID NO: 101798 - DNA, 25 bp, Homo sapien
acactggccaaaggccctatcagtg

SEQ ID NO: 101799 - DNA, 25 bp, Homo sapien
tggccaaaggccctatcagtgtttt

SEQ ID NO: 101800 - DNA, 25 bp, Homo sapien
gccaaaggccctatcagtgttttga

SEQ ID NO: 101801 - DNA, 25 bp, Homo sapien
ccaaaggccctatcagtgttttgaa

SEQ ID NO: 101802 - DNA, 25 bp, Homo sapien
aaaggccctatcagtgttttgaatg

SEQ ID NO: 101803 - DNA, 25 bp, Homo sapien
aaggccctatcagtgttttgaatgt

SEQ ID NO: 101804 - DNA, 25 bp, Homo sapien
gaaggcgttcagaagaaagttatcc

SEQ ID NO: 101805 - DNA, 25 bp, Homo sapien
aagaaagttatccttaatttgtcat

SEQ ID NO: 101806 - DNA, 25 bp, Homo sapien
cacttagaattgctcccccttcatt

SEQ ID NO: 101807 - DNA, 25 bp, Homo sapien
gaattgctcccccttcattctgatg

SEQ ID NO: 101808 - DNA, 25 bp, Homo sapien
gggaacaaggataatgactttgcat

SEQ ID NO: 101809 - DNA, 25 bp, Homo sapien
aggataatgactttgcatctgcacc

SEQ ID NO: 101810 - DNA, 25 bp, Homo sapien
gataatgactttgcatctgcacctg

SEQ ID NO: 101811 - DNA, 25 bp, Homo sapien
ctgcctctgctcttggaaaactagg

SEQ ID NO: 101812 - DNA, 25 bp, Homo sapien
gcctctgctcttggaaaactaggaa

SEQ ID NO: 101813 - DNA, 25 bp, Homo sapien
gctctaggtttcttctcccaaaggg

SEQ ID NO: 101814 - DNA, 25 bp, Homo sapien
gggacccaaggctgtgacacttacc

SEQ ID NO: 101815 - DNA, 25 bp, Homo sapien
gacccaaggctgtgacacttacctc

SEQ ID NO: 101816 - DNA, 25 bp, Homo sapien
catccagcacccttcagctgtgtgt

SEQ ID NO: 101817 - DNA, 25 bp, Homo sapien
agtcactctgccgaaggcgctgacg

SEQ ID NO: 101818 - DNA, 25 bp, Homo sapien
gtcactctgccgaaggcgctgacgg

SEQ ID NO: 101819 - DNA, 25 bp, Homo sapien
tcactctgccgaaggcgctgacggc

SEQ ID NO: 101820 - DNA, 25 bp, Homo sapien
actctgccgaaggcgctgacggcat

SEQ ID NO: 101821 - DNA, 25 bp, Homo sapien
cgaaggcgctgacggcatcgcggcc

SEQ ID NO: 101822 - DNA, 25 bp, Homo sapien
aggcgctgacggcatcgcggccgga

SEQ ID NO: 101823 - DNA, 25 bp, Homo sapien
gcgctgacggcatcgcggccggaac

SEQ ID NO: 101824 - DNA, 25 bp, Homo sapien
atcgcggccggaacctctgggcccg

SEQ ID NO: 101825 - DNA, 25 bp, Homo sapien
aaacttcgctggaaatgagtagcca

SEQ ID NO: 101826 - DNA, 25 bp, Homo sapien
aacttcgctggaaatgagtagccag

SEQ ID NO: 101827 - DNA, 25 bp, Homo sapien
gctggaaatgagtagccaggaagtt

SEQ ID NO: 101828 - DNA, 25 bp, Homo sapien
gaataggtaggtagctagtcacact

SEQ ID NO: 101829 - DNA, 25 bp, Homo sapien
gctagtcacacttttcagaccaatt

SEQ ID NO: 101830 - DNA, 25 bp, Homo sapien
ctgtctatgcacaaaattcccgtgg

SEQ ID NO: 101831 - DNA, 25 bp, Homo sapien
attcccgtgggcctagatggagata

SEQ ID NO: 101832 - DNA, 25 bp, Homo sapien
ttttcttctcagctttatgaagaga

SEQ ID NO: 101833 - DNA, 25 bp, Homo sapien
gaaactgtctaggattcagctgaac

SEQ ID NO: 101834 - DNA, 25 bp, Homo sapien
ttcagctgaaccaccaggaacctgg

SEQ ID NO: 101835 - DNA, 25 bp, Homo sapien
aggaacctggcaacatcacgattta

SEQ ID NO: 101836 - DNA, 25 bp, Homo sapien
acatcacgatttaagctaaggttgg

SEQ ID NO: 101837 - DNA, 25 bp, Homo sapien
ctaaggttgggaggctaacgagtct

SEQ ID NO: 101838 - DNA, 25 bp, Homo sapien
taacgagtctacctccctctttgta

SEQ ID NO: 101839 - DNA, 25 bp, Homo sapien
taattaacagcatcctcttccacgc

SEQ ID NO: 101840 - DNA, 25 bp, Homo sapien
aattaacagcatcctcttccacgct

SEQ ID NO: 101841 - DNA, 25 bp, Homo sapien
agcatcctcttccacgctcagaagt

SEQ ID NO: 101842 - DNA, 25 bp, Homo sapien
catcctcttccacgctcagaagtgt

SEQ ID NO: 101843 - DNA, 25 bp, Homo sapien
tcctcttccacgctcagaagtgttc

SEQ ID NO: 101844 - DNA, 25 bp, Homo sapien
ctcttccacgctcagaagtgttctg

SEQ ID NO: 101845 - DNA, 25 bp, Homo sapien
ggccaacatggcgaattcccgttct

SEQ ID NO: 101846 - DNA, 25 bp, Homo sapien
caacatggcgaattcccgttctcta

SEQ ID NO: 101847 - DNA, 25 bp, Homo sapien
aacatggcgaattcccgttctctac

SEQ ID NO: 101848 - DNA, 25 bp, Homo sapien
acatggcgaattcccgttctctact

SEQ ID NO: 101849 - DNA, 25 bp, Homo sapien
atggcgaattcccgttctctactaa

SEQ ID NO: 101850 - DNA, 25 bp, Homo sapien
gagtaagttaaaccttggactagca

SEQ ID NO: 101851 - DNA, 25 bp, Homo sapien
accttggactagcaagtagaagcct

SEQ ID NO: 101852 - DNA, 25 bp, Homo sapien
tcctcctccacaactgaatatttat

SEQ ID NO: 101853 - DNA, 25 bp, Homo sapien
ggagatacttgatggcgcgaatgtc

SEQ ID NO: 101854 - DNA, 25 bp, Homo sapien
acttgatggcgcgaatgtccgtttt

SEQ ID NO: 101855 - DNA, 25 bp, Homo sapien
atggcgcgaatgtccgttttctctc

SEQ ID NO: 101856 - DNA, 25 bp, Homo sapien
gcaggcagcacctggtaggcacagt

SEQ ID NO: 101857 - DNA, 25 bp, Homo sapien
acctggtaggcacagtgctttgccc

SEQ ID NO: 101858 - DNA, 25 bp, Homo sapien
agtcttggggcctcagtgcttgcaa

SEQ ID NO: 101859 - DNA, 25 bp, Homo sapien
agtgcttgcaacagccggccttggg

SEQ ID NO: 101860 - DNA, 25 bp, Homo sapien
gcaacagccggccttgggcaaataa

SEQ ID NO: 101861 - DNA, 25 bp, Homo sapien
gagttgggcttaatgcaaagatcct

SEQ ID NO: 101862 - DNA, 25 bp, Homo sapien
gtagtttagaactctgatcaggtac

SEQ ID NO: 101863 - DNA, 25 bp, Homo sapien
gaactctgatcaggtactacatcaa

SEQ ID NO: 101864 - DNA, 25 bp, Homo sapien
gatcaggtactacatcaaccaaaag

SEQ ID NO: 101865 - DNA, 25 bp, Homo sapien
aattccttttagcaacctgagcaat

SEQ ID NO: 101866 - DNA, 25 bp, Homo sapien
gcaacctgagcaatcttattctcgt

SEQ ID NO: 101867 - DNA, 25 bp, Homo sapien
gagcaatcttattctcgtaacaata

SEQ ID NO: 101868 - DNA, 25 bp, Homo sapien
aatagtagtaatttgggacattgca

SEQ ID NO: 101869 - DNA, 25 bp, Homo sapien
gtttatcatgttgtaaagtagcatc

SEQ ID NO: 101870 - DNA, 25 bp, Homo sapien
gtagcatcagttgtatcctttcatt

SEQ ID NO: 101871 - DNA, 25 bp, Homo sapien
gcatcagttgtatcctttcattaaa

SEQ ID NO: 101872 - DNA, 25 bp, Homo sapien
aagtatcactaagctcgctttcttg

SEQ ID NO: 101873 - DNA, 25 bp, Homo sapien
agtatcactaagctcgctttcttgc

SEQ ID NO: 101874 - DNA, 25 bp, Homo sapien
tatcactaagctcgctttcttgctg

SEQ ID NO: 101875 - DNA, 25 bp, Homo sapien
tcactaagctcgctttcttgctgtc

SEQ ID NO: 101876 - DNA, 25 bp, Homo sapien
actaagctcgctttcttgctgtcca

SEQ ID NO: 101877 - DNA, 25 bp, Homo sapien
taagctcgctttcttgctgtccaat

SEQ ID NO: 101878 - DNA, 25 bp, Homo sapien
agctcgctttcttgctgtccaattt

SEQ ID NO: 101879 - DNA, 25 bp, Homo sapien
tcgctttcttgctgtccaatttcta

SEQ ID NO: 101880 - DNA, 25 bp, Homo sapien
gctttcttgctgtccaatttctatt

SEQ ID NO: 101881 - DNA, 25 bp, Homo sapien
ttcttgctgtccaatttctattaaa

SEQ ID NO: 101882 - DNA, 25 bp, Homo sapien
ttccctaagtccaactactaaactg

SEQ ID NO: 101883 - DNA, 25 bp, Homo sapien
cacagagttgaaggatggacagtct

SEQ ID NO: 101884 - DNA, 25 bp, Homo sapien
tggacagtctatggtctggcaactc

SEQ ID NO: 101885 - DNA, 25 bp, Homo sapien
agtctatggtctggcaactctcctc

SEQ ID NO: 101886 - DNA, 25 bp, Homo sapien
cagtcacagccattgtagcaaagat

SEQ ID NO: 101887 - DNA, 25 bp, Homo sapien
gtagcaaagatacttctgcacgtca

SEQ ID NO: 101888 - DNA, 25 bp, Homo sapien
aaagatacttctgcacgtcacattc

SEQ ID NO: 101889 - DNA, 25 bp, Homo sapien
tacttctgcacgtcacattcaaatc

SEQ ID NO: 101890 - DNA, 25 bp, Homo sapien
gtcacattcaaatcccatcgtgttc

SEQ ID NO: 101891 - DNA, 25 bp, Homo sapien
gagcattttttacaagccttccact

SEQ ID NO: 101892 - DNA, 25 bp, Homo sapien
tttacaagccttccacttcaatttc

SEQ ID NO: 101893 - DNA, 25 bp, Homo sapien
acaagccttccacttcaatttccat

SEQ ID NO: 101894 - DNA, 25 bp, Homo sapien
tgagcagagggtccagcctcaagat

SEQ ID NO: 101895 - DNA, 25 bp, Homo sapien
agcgaggtggacattcatctgtttc

SEQ ID NO: 101896 - DNA, 25 bp, Homo sapien
tcatctgtttccactgagtctgagt

SEQ ID NO: 101897 - DNA, 25 bp, Homo sapien
agtcttcaagttttcactccagcta

SEQ ID NO: 101898 - DNA, 25 bp, Homo sapien
attgggatcagcatcgactccttca

SEQ ID NO: 101899 - DNA, 25 bp, Homo sapien
atcctcctggaaatcatcaagcaag

SEQ ID NO: 101900 - DNA, 25 bp, Homo sapien
tgagtttgagaacactgtgcacaag

SEQ ID NO: 101901 - DNA, 25 bp, Homo sapien
aagtggatttccatcaccgaggccc

SEQ ID NO: 101902 - DNA, 25 bp, Homo sapien
ttcttccactgttgtctgaacccca

SEQ ID NO: 101903 - DNA, 25 bp, Homo sapien
ctctatgctttccttggagccaaat

SEQ ID NO: 101904 - DNA, 25 bp, Homo sapien
aaatttaaaacctctgcccagcacg

SEQ ID NO: 101905 - DNA, 25 bp, Homo sapien
gagccattggcgtggcccacaaacc

SEQ ID NO: 101906 - DNA, 25 bp, Homo sapien
ggattcaccatccagactgcagatt

SEQ ID NO: 101907 - DNA, 25 bp, Homo sapien
gaaactgtgcacgtttttgtccctt

SEQ ID NO: 101908 - DNA, 25 bp, Homo sapien
gtcccttcagttgccttatgttgaa

SEQ ID NO: 101909 - DNA, 25 bp, Homo sapien
atatttatctgtaccttctttgcta

SEQ ID NO: 101910 - DNA, 25 bp, Homo sapien
atctgtaccttctttgctacttaaa

SEQ ID NO: 101911 - DNA, 25 bp, Homo sapien
atatgctcacagtttgtagtcatgt

SEQ ID NO: 101912 - DNA, 25 bp, Homo sapien
gtagtcatgtagaaaaggccagtat

SEQ ID NO: 101913 - DNA, 25 bp, Homo sapien
atgtagtagacttaaagaccccact

SEQ ID NO: 101914 - DNA, 25 bp, Homo sapien
ttaaagaccccactcgaccatgaga

SEQ ID NO: 101915 - DNA, 25 bp, Homo sapien
gaccatgagactttctctttgtcaa

SEQ ID NO: 101916 - DNA, 25 bp, Homo sapien
aagaccaatgtctatgtgatcacaa

SEQ ID NO: 101917 - DNA, 25 bp, Homo sapien
tgtgatcacaaacccagacctccag

SEQ ID NO: 101918 - DNA, 25 bp, Homo sapien
aaaaaatgcaaccagcaggcctgca

SEQ ID NO: 101919 - DNA, 25 bp, Homo sapien
aggcctgcaagaaaagtgccgattt

SEQ ID NO: 101920 - DNA, 25 bp, Homo sapien
ccgatttactttgcactaaggacaa

SEQ ID NO: 101921 - DNA, 25 bp, Homo sapien
tcagccagtttctgccagacactga

SEQ ID NO: 101922 - DNA, 25 bp, Homo sapien
tgccagacactgaaagccatgaaga

SEQ ID NO: 101923 - DNA, 25 bp, Homo sapien
gaagaaatgttctgtgcccaccgtg

SEQ ID NO: 101924 - DNA, 25 bp, Homo sapien
accgtgagggctgagtgctgcttct

SEQ ID NO: 101925 - DNA, 25 bp, Homo sapien
atcacacacacccaaaggcaaagaa

SEQ ID NO: 101926 - DNA, 25 bp, Homo sapien
ggcaacggttgctccaaaagtcaaa

SEQ ID NO: 101927 - DNA, 25 bp, Homo sapien
ggtgacggtaaatgggcttgatact

SEQ ID NO: 101928 - DNA, 25 bp, Homo sapien
gggcttgatactgtgagagtgccta

SEQ ID NO: 101929 - DNA, 25 bp, Homo sapien
gagagtgcctatgtctgtcgtgaac

SEQ ID NO: 101930 - DNA, 25 bp, Homo sapien
tctgtcgtgaactttgagaagccca

SEQ ID NO: 101931 - DNA, 25 bp, Homo sapien
gagaagcccaagaccaaaagatata

SEQ ID NO: 101932 - DNA, 25 bp, Homo sapien
aaagatataagtactggttagccca

SEQ ID NO: 101933 - DNA, 25 bp, Homo sapien
tggttagcccagcaagctgccaagg

SEQ ID NO: 101934 - DNA, 25 bp, Homo sapien
agcaagctgccaaggctatggcccc

SEQ ID NO: 101935 - DNA, 25 bp, Homo sapien
gcagcaaagcagaatcgggagcagt

SEQ ID NO: 101936 - DNA, 25 bp, Homo sapien
aaatgtgcaagcaccctgatctcac

SEQ ID NO: 101937 - DNA, 25 bp, Homo sapien
ctcccagctctgaccaaatacagaa

SEQ ID NO: 101938 - DNA, 25 bp, Homo sapien
attgtattaactctcatgcttcagc

SEQ ID NO: 101939 - DNA, 25 bp, Homo sapien
tcatgcttcagctcttggatttgtt

SEQ ID NO: 101940 - DNA, 25 bp, Homo sapien
gctcttggatttgttgtttctaact

SEQ ID NO: 101941 - DNA, 25 bp, Homo sapien
gttgtttctaactaacatgtcatgt

SEQ ID NO: 101942 - DNA, 25 bp, Homo sapien
atgtcatgtacaccaaacattttat

SEQ ID NO: 101943 - DNA, 25 bp, Homo sapien
agacccaaaatcctggcatattgcc

SEQ ID NO: 101944 - DNA, 25 bp, Homo sapien
atattgccaggtctgtggatttgcc

SEQ ID NO: 101945 - DNA, 25 bp, Homo sapien
aaaaataggcatttccacagtacta

SEQ ID NO: 101946 - DNA, 25 bp, Homo sapien
ggcatttccacagtactattaagag

SEQ ID NO: 101947 - DNA, 25 bp, Homo sapien
tttttcttctgtacaactggtcaga

SEQ ID NO: 101948 - DNA, 25 bp, Homo sapien
ctgtacaactggtcagatttcaata

SEQ ID NO: 101949 - DNA, 25 bp, Homo sapien
tttttaccatctggatacagcctgg

SEQ ID NO: 101950 - DNA, 25 bp, Homo sapien
tacagcctggtgtaagcagacgtcc

SEQ ID NO: 101951 - DNA, 25 bp, Homo sapien
gtgtaagcagacgtccattaccacc

SEQ ID NO: 101952 - DNA, 25 bp, Homo sapien
cccacattttcaggtgtctacatca

SEQ ID NO: 101953 - DNA, 25 bp, Homo sapien
gtgtctacatcagccttagtcatta

SEQ ID NO: 101954 - DNA, 25 bp, Homo sapien
taaatcgacctttaagaattcctgg

SEQ ID NO: 101955 - DNA, 25 bp, Homo sapien
gggtggactttgcaaacacattcta

SEQ ID NO: 101956 - DNA, 25 bp, Homo sapien
cacattctacaacctgatggttttt

SEQ ID NO: 101957 - DNA, 25 bp, Homo sapien
tttttactgctcaaactgtcaccat

SEQ ID NO: 101958 - DNA, 25 bp, Homo sapien
aactgtcaccatcatcttttgcaat

SEQ ID NO: 101959 - DNA, 25 bp, Homo sapien
aatgtgttgctcactgttgtcaata

SEQ ID NO: 101960 - DNA, 25 bp, Homo sapien
tggagccttgggaacccctcggcca

SEQ ID NO: 101961 - DNA, 25 bp, Homo sapien
ttgggaacccctcggccaagcacag

SEQ ID NO: 101962 - DNA, 25 bp, Homo sapien
gccggagcacggtcagggtcttctt

SEQ ID NO: 101963 - DNA, 25 bp, Homo sapien
agcacggtcagggtcttcttgcgac

SEQ ID NO: 101964 - DNA, 25 bp, Homo sapien
gtcagggtcttcttgcgacccggcc

SEQ ID NO: 101965 - DNA, 25 bp, Homo sapien
acccgggccgcgtgtgagcgcactt

SEQ ID NO: 101966 - DNA, 25 bp, Homo sapien
ggccgcgtgtgagcgcactttgcac

SEQ ID NO: 101967 - DNA, 25 bp, Homo sapien
tgtgagcgcactttgcacctcctat

SEQ ID NO: 101968 - DNA, 25 bp, Homo sapien
agggtccgccgagagccacgatttt

SEQ ID NO: 101969 - DNA, 25 bp, Homo sapien
gccgagagccacgattttttacaga

SEQ ID NO: 101970 - DNA, 25 bp, Homo sapien
gagagccacgattttttacagaaaa

SEQ ID NO: 101971 - DNA, 25 bp, Homo sapien
tgaaggcaccatcaagctacagagc

SEQ ID NO: 101972 - DNA, 25 bp, Homo sapien
agccctaagtgtaagaactctctca

SEQ ID NO: 101973 - DNA, 25 bp, Homo sapien
tctctcaaaaccactcatttgccat

SEQ ID NO: 101974 - DNA, 25 bp, Homo sapien
actcatttgccatcactgactcaaa

SEQ ID NO: 101975 - DNA, 25 bp, Homo sapien
agccctcctcttggtcatcagagaa

SEQ ID NO: 101976 - DNA, 25 bp, Homo sapien
gaagacacaagccacagggctattt

SEQ ID NO: 101977 - DNA, 25 bp, Homo sapien
aggcaattttccttcagtcttgaag

SEQ ID NO: 101978 - DNA, 25 bp, Homo sapien
agtcttgaagacttttcaccctggg

SEQ ID NO: 101979 - DNA, 25 bp, Homo sapien
tgggctgcttgaacacttttcagat

SEQ ID NO: 101980 - DNA, 25 bp, Homo sapien
aacaacttaacctctacctcagcgt

SEQ ID NO: 101981 - DNA, 25 bp, Homo sapien
gtcttcctcacaggtgcagctcaga

SEQ ID NO: 101982 - DNA, 25 bp, Homo sapien
tgctaccgagatcgcccgcatgagg

SEQ ID NO: 101983 - DNA, 25 bp, Homo sapien
atcgcccgcatgaggtgctgctgtg

SEQ ID NO: 101984 - DNA, 25 bp, Homo sapien
tgctgctgtgctcggacctggtcaa

SEQ ID NO: 101985 - DNA, 25 bp, Homo sapien
gctgaggagcagacatcattccctg

SEQ ID NO: 101986 - DNA, 25 bp, Homo sapien
agacatcattccctgccctggcagt

SEQ ID NO: 101987 - DNA, 25 bp, Homo sapien
ggcagtgacttggagccctgaagaa

SEQ ID NO: 101988 - DNA, 25 bp, Homo sapien
agaagggaccaatcatgggaccaca

SEQ ID NO: 101989 - DNA, 25 bp, Homo sapien
aatcatgggaccacagccactgtgc

SEQ ID NO: 101990 - DNA, 25 bp, Homo sapien
gggctgccacgtgtttaggaaacaa

SEQ ID NO: 101991 - DNA, 25 bp, Homo sapien
gaaacaaagtatgcgctactgtctg

SEQ ID NO: 101992 - DNA, 25 bp, Homo sapien
gtatgcgctactgtctgaaaacaaa

SEQ ID NO: 101993 - DNA, 25 bp, Homo sapien
ctaggccttcaggactctagaatgt

SEQ ID NO: 101994 - DNA, 25 bp, Homo sapien
gactctagaatgtccatatttattt

SEQ ID NO: 101995 - DNA, 25 bp, Homo sapien
atttttatgttcttggctttgtgtt

SEQ ID NO: 101996 - DNA, 25 bp, Homo sapien
tgttcttggctttgtgttttaggaa

SEQ ID NO: 101997 - DNA, 25 bp, Homo sapien
gggaaaatccactatgacatctaag

SEQ ID NO: 101998 - DNA, 25 bp, Homo sapien
gacatctaagttttgtgtacagaga

SEQ ID NO: 101999 - DNA, 25 bp, Homo sapien
gatatttttgcaactatttccacct

SEQ ID NO: 102000 - DNA, 25 bp, Homo sapien
gagtctctttacctaatggtctcta

SEQ ID NO: 102001 - DNA, 25 bp, Homo sapien
aatggtctctacctaatggacctcc

SEQ ID NO: 102002 - DNA, 25 bp, Homo sapien
taatggacctccgtggccaaaaagt

SEQ ID NO: 102003 - DNA, 25 bp, Homo sapien
gacctccgtggccaaaaagtaccat

SEQ ID NO: 102004 - DNA, 25 bp, Homo sapien
gtagtcaacatctgtaactcttaca

SEQ ID NO: 102005 - DNA, 25 bp, Homo sapien
gtaactcttacatgagtgtccagag

SEQ ID NO: 102006 - DNA, 25 bp, Homo sapien
gtgtccagaggcactcatgggaaaa

SEQ ID NO: 102007 - DNA, 25 bp, Homo sapien
ttctttgtacacaccagagacccat

SEQ ID NO: 102008 - DNA, 25 bp, Homo sapien
gagacccatctgaggtcatctgatt

SEQ ID NO: 102009 - DNA, 25 bp, Homo sapien
ggtcatctgattataaggccatgtt

SEQ ID NO: 102010 - DNA, 25 bp, Homo sapien
tgcctttgtgtgtattggcgatcat

SEQ ID NO: 102011 - DNA, 25 bp, Homo sapien
gtgtattggcgatcatttgtaatgc

SEQ ID NO: 102012 - DNA, 25 bp, Homo sapien
gtaatgctcttacacttcgtcttta

SEQ ID NO: 102013 - DNA, 25 bp, Homo sapien
tacacttcgtctttaatgttctttt

SEQ ID NO: 102014 - DNA, 25 bp, Homo sapien
gagttaggacctctcagttcataaa

SEQ ID NO: 102015 - DNA, 25 bp, Homo sapien
gaaggacaagagctcataaccgtaa

SEQ ID NO: 102016 - DNA, 25 bp, Homo sapien
ggacaagagctcataaccgtaataa

SEQ ID NO: 102017 - DNA, 25 bp, Homo sapien
gagctcataaccgtaataaaagccc

SEQ ID NO: 102018 - DNA, 25 bp, Homo sapien
cacctcctttggttatgataaacca

SEQ ID NO: 102019 - DNA, 25 bp, Homo sapien
aaaccacatgtgctagtggatctac

SEQ ID NO: 102020 - DNA, 25 bp, Homo sapien
cacatgtgctagtggatctacttgt

SEQ ID NO: 102021 - DNA, 25 bp, Homo sapien
tgtgctagtggatctacttgtggat

SEQ ID NO: 102022 - DNA, 25 bp, Homo sapien
gatctacttgtggatgatagcggta

SEQ ID NO: 102023 - DNA, 25 bp, Homo sapien
gatgatagcggtaaagagtccttga

SEQ ID NO: 102024 - DNA, 25 bp, Homo sapien
agcggtaaagagtccttgattggtt

SEQ ID NO: 102025 - DNA, 25 bp, Homo sapien
agagtccttgattggttatagacca

SEQ ID NO: 102026 - DNA, 25 bp, Homo sapien
tccctgtgaaagtctcggatccttt

SEQ ID NO: 102027 - DNA, 25 bp, Homo sapien
tcggatcctttgtggtatggttcca

SEQ ID NO: 102028 - DNA, 25 bp, Homo sapien
ggttccaggaatctgatgtttccca

SEQ ID NO: 102029 - DNA, 25 bp, Homo sapien
ttcccagcagtcttcttgaagatga

SEQ ID NO: 102030 - DNA, 25 bp, Homo sapien
gaagatgatcaaagcacctcactaa

SEQ ID NO: 102031 - DNA, 25 bp, Homo sapien
gagcatatgtttctctgccgtagaa

SEQ ID NO: 102032 - DNA, 25 bp, Homo sapien
gattaagctgtttcttgtccggatt

SEQ ID NO: 102033 - DNA, 25 bp, Homo sapien
agctgtttcttgtccggattcttct

SEQ ID NO: 102034 - DNA, 25 bp, Homo sapien
ggattcttctctcattgacttctaa

SEQ ID NO: 102035 - DNA, 25 bp, Homo sapien
gacttctaagaagcctctactcttg

SEQ ID NO: 102036 - DNA, 25 bp, Homo sapien
agaagcctctactcttgagtctctt

SEQ ID NO: 102037 - DNA, 25 bp, Homo sapien
tgttctttctgtgacctcccagtat

SEQ ID NO: 102038 - DNA, 25 bp, Homo sapien
tcccagtatccacatctcagcatgg

SEQ ID NO: 102039 - DNA, 25 bp, Homo sapien
agcatggccctctgtcagctggctg

SEQ ID NO: 102040 - DNA, 25 bp, Homo sapien
agctggctgctcatgactggccgag

SEQ ID NO: 102041 - DNA, 25 bp, Homo sapien
gactggccgaggttaagctgtgttt

SEQ ID NO: 102042 - DNA, 25 bp, Homo sapien
gtttgtgtctgacagaagcgcccat

SEQ ID NO: 102043 - DNA, 25 bp, Homo sapien
gaagcgcccatctgatatgacccca

SEQ ID NO: 102044 - DNA, 25 bp, Homo sapien
gaccccagttcagattcatagcttg

SEQ ID NO: 102045 - DNA, 25 bp, Homo sapien
gattcatagcttgcagtttcatggg

SEQ ID NO: 102046 - DNA, 25 bp, Homo sapien
agctgttctgaaggtctggttggtt

SEQ ID NO: 102047 - DNA, 25 bp, Homo sapien
tgcccgggaatgtttcaggtctggt

SEQ ID NO: 102048 - DNA, 25 bp, Homo sapien
ccccactggctcttcttaattagaa

SEQ ID NO: 102049 - DNA, 25 bp, Homo sapien
agaagtgaccagttcacctctgtgt

SEQ ID NO: 102050 - DNA, 25 bp, Homo sapien
cacctctgtgtccttttgaaacatc

SEQ ID NO: 102051 - DNA, 25 bp, Homo sapien
aaacatcagcagtagggtccattcc

SEQ ID NO: 102052 - DNA, 25 bp, Homo sapien
caagattgtcagttaccgttagtga

SEQ ID NO: 102053 - DNA, 25 bp, Homo sapien
ccgttagtgacgtcaggccctgtaa

SEQ ID NO: 102054 - DNA, 25 bp, Homo sapien
tgtaacctgtgtcctgtctggcgca

SEQ ID NO: 102055 - DNA, 25 bp, Homo sapien
gcagttgctcacattcaccaaagtt

SEQ ID NO: 102056 - DNA, 25 bp, Homo sapien
ttgttttcatgatcctgatggccaa

SEQ ID NO: 102057 - DNA, 25 bp, Homo sapien
ccccaaggattttcacacacggaag

SEQ ID NO: 102058 - DNA, 25 bp, Homo sapien
gatcatcattttatggtgccttgaa

SEQ ID NO: 102059 - DNA, 25 bp, Homo sapien
ttatgcagtgaatctcagtttgaac

SEQ ID NO: 102060 - DNA, 25 bp, Homo sapien
agcaacaattaagtgacccccgtca

SEQ ID NO: 102061 - DNA, 25 bp, Homo sapien
cgaccccagcatcaaaaaaccaatg

SEQ ID NO: 102062 - DNA, 25 bp, Homo sapien
aaaaccaatgattttgctgcagact

SEQ ID NO: 102063 - DNA, 25 bp, Homo sapien
gccagttagaggctttcaaagctgt

SEQ ID NO: 102064 - DNA, 25 bp, Homo sapien
caaaacgttgatcactttagcaggt

SEQ ID NO: 102065 - DNA, 25 bp, Homo sapien
acgttgatcactttagcaggttgca

SEQ ID NO: 102066 - DNA, 25 bp, Homo sapien
cactttagcaggttgcagcttggag

SEQ ID NO: 102067 - DNA, 25 bp, Homo sapien
agcgtggaggtcctgcctagattcc

SEQ ID NO: 102068 - DNA, 25 bp, Homo sapien
aggtcctgcctagattccaggaagt

SEQ ID NO: 102069 - DNA, 25 bp, Homo sapien
attccaggaagtccagggcgatact

SEQ ID NO: 102070 - DNA, 25 bp, Homo sapien
atcagtgtgtcctatgcccatgtgg

SEQ ID NO: 102071 - DNA, 25 bp, Homo sapien
atgcccatgtggtagctgctgtgct

SEQ ID NO: 102072 - DNA, 25 bp, Homo sapien
gtggtagctgctgtgctgcaaatcc

SEQ ID NO: 102073 - DNA, 25 bp, Homo sapien
tgtgctgcaaatccgctctgctgag

SEQ ID NO: 102074 - DNA, 25 bp, Homo sapien
aaatccgctctgctgagggcagaaa

SEQ ID NO: 102075 - DNA, 25 bp, Homo sapien
ggcatcttctatgggacaggtgtct

SEQ ID NO: 102076 - DNA, 25 bp, Homo sapien
tgggttcagtggaatcttcagacaa

SEQ ID NO: 102077 - DNA, 25 bp, Homo sapien
gttttcatgactgtgatcaacccca

SEQ ID NO: 102078 - DNA, 25 bp, Homo sapien
tgactgtgatcaaccccatgctgaa

SEQ ID NO: 102079 - DNA, 25 bp, Homo sapien
gaaatactgatgttcagggcgctct

SEQ ID NO: 102080 - DNA, 25 bp, Homo sapien
agggcgctctgtgtcagctacttgt

SEQ ID NO: 102081 - DNA, 25 bp, Homo sapien
agcagcagcattaacccttttctct

SEQ ID NO: 102082 - DNA, 25 bp, Homo sapien
ccttttctctacatcctgctgagtg

SEQ ID NO: 102083 - DNA, 25 bp, Homo sapien
ggaaatttccagaaacgtctgcctc

SEQ ID NO: 102084 - DNA, 25 bp, Homo sapien
gaaacgtctgcctcaaatccaaaga

SEQ ID NO: 102085 - DNA, 25 bp, Homo sapien
tttaggaaagtacatggatcaccat

SEQ ID NO: 102086 - DNA, 25 bp, Homo sapien
ggatcaccatgagtctagacatgat

SEQ ID NO: 102087 - DNA, 25 bp, Homo sapien
gacatgattgtctatcttactggta

SEQ ID NO: 102088 - DNA, 25 bp, Homo sapien
aggtgtaccgatatgtttatgccca

SEQ ID NO: 102089 - DNA, 25 bp, Homo sapien
gtttatgcccattcttcttgtgtac

SEQ ID NO: 102090 - DNA, 25 bp, Homo sapien
gcccattcttcttgtgtacttgtga

SEQ ID NO: 102091 - DNA, 25 bp, Homo sapien
gtacttgtgactcttagcagcatgg

SEQ ID NO: 102092 - DNA, 25 bp, Homo sapien
ttagtgcaatctgggccagtatttt

SEQ ID NO: 102093 - DNA, 25 bp, Homo sapien
gtggtaatttatccttcctaactct

SEQ ID NO: 102094 - DNA, 25 bp, Homo sapien
atccttcctaactctttaatcctga

SEQ ID NO: 102095 - DNA, 25 bp, Homo sapien
tgatggttggaaatggcctagaatt

SEQ ID NO: 102096 - DNA, 25 bp, Homo sapien
gcctagaattaggttactctgttca

SEQ ID NO: 102097 - DNA, 25 bp, Homo sapien
ggttactctgttcacaatgctcatt

SEQ ID NO: 102098 - DNA, 25 bp, Homo sapien
tgctcattgttagcatgcaattggt

SEQ ID NO: 102099 - DNA, 25 bp, Homo sapien
gcatgcaattggtatttgacttgga

SEQ ID NO: 102100 - DNA, 25 bp, Homo sapien
tattttttgaacccctaggcttcag

SEQ ID NO: 102101 - DNA, 25 bp, Homo sapien
taggcttcaggaaaactgctctttt

SEQ ID NO: 102102 - DNA, 25 bp, Homo sapien
agcgatgacattttctaatgtgcag

SEQ ID NO: 102103 - DNA, 25 bp, Homo sapien
ggaaaatcacctacaggagatgtaa

SEQ ID NO: 102104 - DNA, 25 bp, Homo sapien
aggagatgtaaacaacttgagttgc

SEQ ID NO: 102105 - DNA, 25 bp, Homo sapien
cttgagttgctctaaaatgtttgga

SEQ ID NO: 102106 - DNA, 25 bp, Homo sapien
ggaaaagagctgcttttgcattatg

SEQ ID NO: 102107 - DNA, 25 bp, Homo sapien
ttgttgaagcaataacctagccagc

SEQ ID NO: 102108 - DNA, 25 bp, Homo sapien
taacctagccagctgttgcattagc

SEQ ID NO: 102109 - DNA, 25 bp, Homo sapien
gttgcattagctaaagcagcctctt

SEQ ID NO: 102110 - DNA, 25 bp, Homo sapien
aagcagcctcttgcaatggtaggaa

SEQ ID NO: 102111 - DNA, 25 bp, Homo sapien
catgagtgtatgtctatatcctgaa

SEQ ID NO: 102112 - DNA, 25 bp, Homo sapien
ttagcagtctgtggcatattaatca

SEQ ID NO: 102113 - DNA, 25 bp, Homo sapien
tttcttacaccctggaaatctttct

SEQ ID NO: 102114 - DNA, 25 bp, Homo sapien
aataggatcaccagtgttggagaat

SEQ ID NO: 102115 - DNA, 25 bp, Homo sapien
cctgttaggaagtgtttggatcata

SEQ ID NO: 102116 - DNA, 25 bp, Homo sapien
gtttggatcataggaacatctgtca

SEQ ID NO: 102117 - DNA, 25 bp, Homo sapien
ggaacatctgtcataaatggcttgg

SEQ ID NO: 102118 - DNA, 25 bp, Homo sapien
ttcttgctctatattagttcacttg

SEQ ID NO: 102119 - DNA, 25 bp, Homo sapien
aagctggttgttgggaactcctgcc

SEQ ID NO: 102120 - DNA, 25 bp, Homo sapien
gttgggaactcctgccctatctgtt

SEQ ID NO: 102121 - DNA, 25 bp, Homo sapien
tgccctctctcgtcatgtgacatgc

SEQ ID NO: 102122 - DNA, 25 bp, Homo sapien
gccttcccaggagccaagcagatgt

SEQ ID NO: 102123 - DNA, 25 bp, Homo sapien
ggagccaagcagatgtcagtaccat

SEQ ID NO: 102124 - DNA, 25 bp, Homo sapien
gatgtcagtaccatgcttgtacagc

SEQ ID NO: 102125 - DNA, 25 bp, Homo sapien
aagaagcgggcagtgagcctgcccc

SEQ ID NO: 102126 - DNA, 25 bp, Homo sapien
gcccctgaacaggagagcaccgaag

SEQ ID NO: 102127 - DNA, 25 bp, Homo sapien
ccctgaacaggagagcaccgaagct

SEQ ID NO: 102128 - DNA, 25 bp, Homo sapien
ctgaacaggagagcaccgaagctac

SEQ ID NO: 102129 - DNA, 25 bp, Homo sapien
gaacaggagagcaccgaagctacac

SEQ ID NO: 102130 - DNA, 25 bp, Homo sapien
aggagagcaccgaagctacacctgc

SEQ ID NO: 102131 - DNA, 25 bp, Homo sapien
ctacacctgcagaataggcatggtt

SEQ ID NO: 102132 - DNA, 25 bp, Homo sapien
acacctgcagaataggcatggtttt

SEQ ID NO: 102133 - DNA, 25 bp, Homo sapien
acctgcagaataggcatggttttgg

SEQ ID NO: 102134 - DNA, 25 bp, Homo sapien
gtaccagaagtagatactataaatc

SEQ ID NO: 102135 - DNA, 25 bp, Homo sapien
gttatttttctggataatgtttaag

SEQ ID NO: 102136 - DNA, 25 bp, Homo sapien
aagggagatcatacctaccggctca

SEQ ID NO: 102137 - DNA, 25 bp, Homo sapien
atacctaccggctcattagtgttgt

SEQ ID NO: 102138 - DNA, 25 bp, Homo sapien
attagtgttgtcagccatcttggga

SEQ ID NO: 102139 - DNA, 25 bp, Homo sapien
aaagtcaggccattatatctgtgat

SEQ ID NO: 102140 - DNA, 25 bp, Homo sapien
tatctgtgatgcctatgactttgag

SEQ ID NO: 102141 - DNA, 25 bp, Homo sapien
gaaacagatctggttcacttacgat

SEQ ID NO: 102142 - DNA, 25 bp, Homo sapien
ggttcacttacgatgatatgcgggt

SEQ ID NO: 102143 - DNA, 25 bp, Homo sapien
atatgcgggtgttaggtatccagga

SEQ ID NO: 102144 - DNA, 25 bp, Homo sapien
ataggcgttgcactgggtacatctt

SEQ ID NO: 102145 - DNA, 25 bp, Homo sapien
gcactgggtacatcttcttttacat

SEQ ID NO: 102146 - DNA, 25 bp, Homo sapien
gagaatgcccagcttaatagcaagg

SEQ ID NO: 102147 - DNA, 25 bp, Homo sapien
atcagtggcttctatgtgggccggc

SEQ ID NO: 102148 - DNA, 25 bp, Homo sapien
cggctcatggttcggctgaccaaga

SEQ ID NO: 102149 - DNA, 25 bp, Homo sapien
aagagccgggacctgttcgtctcta

SEQ ID NO: 102150 - DNA, 25 bp, Homo sapien
ctgttcgtctctacgagctggaaaa

SEQ ID NO: 102151 - DNA, 25 bp, Homo sapien
ggaaaaccatgaggcagtctccacc

SEQ ID NO: 102152 - DNA, 25 bp, Homo sapien
atgaggcagtctccaccttgatgga

SEQ ID NO: 102153 - DNA, 25 bp, Homo sapien
agaactaccgcagcaggtgggcgta

SEQ ID NO: 102154 - DNA, 25 bp, Homo sapien
gtacggactgcttggcgcatggcac

SEQ ID NO: 102155 - DNA, 25 bp, Homo sapien
acccgcctggcaagtgctagaacta

SEQ ID NO: 102156 - DNA, 25 bp, Homo sapien
agaactaatgctattcttctggaat

SEQ ID NO: 102157 - DNA, 25 bp, Homo sapien
tggtggctagaaatgcaacttgtat

SEQ ID NO: 102158 - DNA, 25 bp, Homo sapien
atgagtgtatgaatttgtcacatgt

SEQ ID NO: 102159 - DNA, 25 bp, Homo sapien
tgtcacatgtatcacccccaaaaaa

SEQ ID NO: 102160 - DNA, 25 bp, Homo sapien
aaatgagacgagacatgtcgaccaa

SEQ ID NO: 102161 - DNA, 25 bp, Homo sapien
gacgagacatgtcgaccaaaaggaa

SEQ ID NO: 102162 - DNA, 25 bp, Homo sapien
accaaaaggaatgtgtgggtcttgt

SEQ ID NO: 102163 - DNA, 25 bp, Homo sapien
gtgtgggtcttgtttggatcctgac

SEQ ID NO: 102164 - DNA, 25 bp, Homo sapien
gtgggtcttgtttggatcctgactc

SEQ ID NO: 102165 - DNA, 25 bp, Homo sapien
ggatcctgactcaaattaagaaaaa

SEQ ID NO: 102166 - DNA, 25 bp, Homo sapien
gttgtgtgttttggatataagtgat

SEQ ID NO: 102167 - DNA, 25 bp, Homo sapien
gtgatagtttattgtagtgatgttt

SEQ ID NO: 102168 - DNA, 25 bp, Homo sapien
ggatattcactttcagcgcttatac

SEQ ID NO: 102169 - DNA, 25 bp, Homo sapien
atgtccagcctctataaaaacattt

SEQ ID NO: 102170 - DNA, 25 bp, Homo sapien
tgtccagcctctataaaaacattta

SEQ ID NO: 102171 - DNA, 25 bp, Homo sapien
gtggtggatgccctagagtcccact

SEQ ID NO: 102172 - DNA, 25 bp, Homo sapien
ggtggatgccctagagtcccactga

SEQ ID NO: 102173 - DNA, 25 bp, Homo sapien
tggatgccctagagtcccactgact

SEQ ID NO: 102174 - DNA, 25 bp, Homo sapien
gatgccctagagtcccactgacttg

SEQ ID NO: 102175 - DNA, 25 bp, Homo sapien
atgccctagagtcccactgacttgg

SEQ ID NO: 102176 - DNA, 25 bp, Homo sapien
gccctagagtcccactgacttggga

SEQ ID NO: 102177 - DNA, 25 bp, Homo sapien
ccctagagtcccactgacttgggag

SEQ ID NO: 102178 - DNA, 25 bp, Homo sapien
aatgagccatggttgctgcagtgag

SEQ ID NO: 102179 - DNA, 25 bp, Homo sapien
gagccatggttgctgcagtgagctg

SEQ ID NO: 102180 - DNA, 25 bp, Homo sapien
agctagggtcctagattgtgccgaa

SEQ ID NO: 102181 - DNA, 25 bp, Homo sapien
gctagggtcctagattgtgccgaag

SEQ ID NO: 102182 - DNA, 25 bp, Homo sapien
ctagggtcctagattgtgccgaagc

SEQ ID NO: 102183 - DNA, 25 bp, Homo sapien
tagggtcctagattgtgccgaagct

SEQ ID NO: 102184 - DNA, 25 bp, Homo sapien
agggtcctagattgtgccgaagctt

SEQ ID NO: 102185 - DNA, 25 bp, Homo sapien
gggtcctagattgtgccgaagcttc

SEQ ID NO: 102186 - DNA, 25 bp, Homo sapien
ggtcctagattgtgccgaagcttca

SEQ ID NO: 102187 - DNA, 25 bp, Homo sapien
gtcctagattgtgccgaagcttcat

SEQ ID NO: 102188 - DNA, 25 bp, Homo sapien
ctagattgtgccgaagcttcatgag

SEQ ID NO: 102189 - DNA, 25 bp, Homo sapien
gagcccaggccgttgtttcctagtc

SEQ ID NO: 102190 - DNA, 25 bp, Homo sapien
agcccaggccgttgtttcctagtct

SEQ ID NO: 102191 - DNA, 25 bp, Homo sapien
acaggcactgtgcaaacaatgaaaa

SEQ ID NO: 102192 - DNA, 25 bp, Homo sapien
gcaaacaatgaaaagccccttcact

SEQ ID NO: 102193 - DNA, 25 bp, Homo sapien
tgcacagcttacactgtcaggattc

SEQ ID NO: 102194 - DNA, 25 bp, Homo sapien
cagcttacactgtcaggattcagtt

SEQ ID NO: 102195 - DNA, 25 bp, Homo sapien
tacactgtcaggattcagttgcaga

SEQ ID NO: 102196 - DNA, 25 bp, Homo sapien
gtcaggattcagttgcagattaaag

SEQ ID NO: 102197 - DNA, 25 bp, Homo sapien
tcagttgcagattaaagaacccatc

SEQ ID NO: 102198 - DNA, 25 bp, Homo sapien
agaacccatctggaatggtttacag

SEQ ID NO: 102199 - DNA, 25 bp, Homo sapien
acccatctggaatggtttacagaga

SEQ ID NO: 102200 - DNA, 25 bp, Homo sapien
agaggacatcagaagagctggagat

SEQ ID NO: 102201 - DNA, 25 bp, Homo sapien
tgcgcttccaaaagcaaatgataat

SEQ ID NO: 102202 - DNA, 25 bp, Homo sapien
aggcagaggtcgcatcactgcaatc

SEQ ID NO: 102203 - DNA, 25 bp, Homo sapien
ggcagaggtcgcatcactgcaatcc

SEQ ID NO: 102204 - DNA, 25 bp, Homo sapien
agaggtcgcatcactgcaatccagc

SEQ ID NO: 102205 - DNA, 25 bp, Homo sapien
aactggcagcccgtgcagtgcgtaa

SEQ ID NO: 102206 - DNA, 25 bp, Homo sapien
gcagcccgtgcagtgcgtaagaatg

SEQ ID NO: 102207 - DNA, 25 bp, Homo sapien
cagcccgtgcagtgcgtaagaatgt

SEQ ID NO: 102208 - DNA, 25 bp, Homo sapien
agcccgtgcagtgcgtaagaatgtg

SEQ ID NO: 102209 - DNA, 25 bp, Homo sapien
cccgtgcagtgcgtaagaatgtggc

SEQ ID NO: 102210 - DNA, 25 bp, Homo sapien
ccgtgcagtgcgtaagaatgtggcc

SEQ ID NO: 102211 - DNA, 25 bp, Homo sapien
cagtgcgtaagaatgtggccgggta

SEQ ID NO: 102212 - DNA, 25 bp, Homo sapien
gcgtaagaatgtggccgggtacagt

SEQ ID NO: 102213 - DNA, 25 bp, Homo sapien
tatctaatatcctcctaagagtttt

SEQ ID NO: 102214 - DNA, 25 bp, Homo sapien
atcctcctaagagttttactagtgc

SEQ ID NO: 102215 - DNA, 25 bp, Homo sapien
gagttttactagtgcttttttgagg

SEQ ID NO: 102216 - DNA, 25 bp, Homo sapien
ggaattacagggaagctcctggaat

SEQ ID NO: 102217 - DNA, 25 bp, Homo sapien
gaagctcctggaattgtacatggat

SEQ ID NO: 102218 - DNA, 25 bp, Homo sapien
gtacatggatatctttatccctagg

SEQ ID NO: 102219 - DNA, 25 bp, Homo sapien
tgggcacccctaattctttatggaa

SEQ ID NO: 102220 - DNA, 25 bp, Homo sapien
cacccctaattctttatggaagtgt

SEQ ID NO: 102221 - DNA, 25 bp, Homo sapien
gtggttctactctaagatttcaaaa

SEQ ID NO: 102222 - DNA, 25 bp, Homo sapien
taaaatcatacatgttcccgcctgc

SEQ ID NO: 102223 - DNA, 25 bp, Homo sapien
atgttcccgcctgcaaatatattgt

SEQ ID NO: 102224 - DNA, 25 bp, Homo sapien
gactgaaccacgtaattaatatcca

SEQ ID NO: 102225 - DNA, 25 bp, Homo sapien
ttaatatccaaggtcccttccggct

SEQ ID NO: 102226 - DNA, 25 bp, Homo sapien
ttccggctctaaaaggctatgattc

SEQ ID NO: 102227 - DNA, 25 bp, Homo sapien
gaaagatgtggccaatcagattgag

SEQ ID NO: 102228 - DNA, 25 bp, Homo sapien
gattgagtcatccaggcataccttt

SEQ ID NO: 102229 - DNA, 25 bp, Homo sapien
ggcatacctttttagcttctgtttg

SEQ ID NO: 102230 - DNA, 25 bp, Homo sapien
agcttctgtttgtggagttgtctcc

SEQ ID NO: 102231 - DNA, 25 bp, Homo sapien
ataagaggagatgtgccttcccaat

SEQ ID NO: 102232 - DNA, 25 bp, Homo sapien
tgtgccttcccaataactctttttt

SEQ ID NO: 102233 - DNA, 25 bp, Homo sapien
cattttccagatggcgaggtcacag

SEQ ID NO: 102234 - DNA, 25 bp, Homo sapien
gagagatgtggccacctagcctttc

SEQ ID NO: 102235 - DNA, 25 bp, Homo sapien
ataggtgtccaagtagtcacactga

SEQ ID NO: 102236 - DNA, 25 bp, Homo sapien
cactgagactttaactggtaaccca

SEQ ID NO: 102237 - DNA, 25 bp, Homo sapien
ctgtggcgtcagtcgcagtgctctg

SEQ ID NO: 102238 - DNA, 25 bp, Homo sapien
agtgctctggccaacactatagcag

SEQ ID NO: 102239 - DNA, 25 bp, Homo sapien
atagcagggcttattcttctccctc

SEQ ID NO: 102240 - DNA, 25 bp, Homo sapien
attcttctccctcatgtgtagtgaa

SEQ ID NO: 102241 - DNA, 25 bp, Homo sapien
tgaaacaaaatgtaacaccttgggt

SEQ ID NO: 102242 - DNA, 25 bp, Homo sapien
accttgggttcattcagttccattc

SEQ ID NO: 102243 - DNA, 25 bp, Homo sapien
tacctgtgtcaatataattccctga

SEQ ID NO: 102244 - DNA, 25 bp, Homo sapien
aattccctgatttggaggcagctct

SEQ ID NO: 102245 - DNA, 25 bp, Homo sapien
tttggaggcagctctcctcattttc

SEQ ID NO: 102246 - DNA, 25 bp, Homo sapien
atctgattcctttcaattccagaaa

SEQ ID NO: 102247 - DNA, 25 bp, Homo sapien
agaaagaccttactcttctctctga

SEQ ID NO: 102248 - DNA, 25 bp, Homo sapien
tctgaggacgccaaaatacaaattt

SEQ ID NO: 102249 - DNA, 25 bp, Homo sapien
gccgatttaccttgaaactgagcct

SEQ ID NO: 102250 - DNA, 25 bp, Homo sapien
gaaactgagcctttgcaagcattga

SEQ ID NO: 102251 - DNA, 25 bp, Homo sapien
agcattgaagcccacgctctgagtc

SEQ ID NO: 102252 - DNA, 25 bp, Homo sapien
gctctgagtctcagcgccgacgaga

SEQ ID NO: 102253 - DNA, 25 bp, Homo sapien
gccgacgagaccatggaagagccat

SEQ ID NO: 102254 - DNA, 25 bp, Homo sapien
gaagagccatctgtccttctcagga

SEQ ID NO: 102255 - DNA, 25 bp, Homo sapien
ttctcaggacactcacttcctgtat

SEQ ID NO: 102256 - DNA, 25 bp, Homo sapien
gtatcccaccgtcctgcaaattgca

SEQ ID NO: 102257 - DNA, 25 bp, Homo sapien
tccagcgcaggtgcttcaagacagg

SEQ ID NO: 102258 - DNA, 25 bp, Homo sapien
gacaggaagtctaagcagccaccgt

SEQ ID NO: 102259 - DNA, 25 bp, Homo sapien
agcagccaccgtttcggtgtatatg

SEQ ID NO: 102260 - DNA, 25 bp, Homo sapien
accgtttcggtgtatatgctcatta

SEQ ID NO: 102261 - DNA, 25 bp, Homo sapien
cggtgtatatgctcattatcctaat

SEQ ID NO: 102262 - DNA, 25 bp, Homo sapien
gctcattatcctaattatgcagcag

SEQ ID NO: 102263 - DNA, 25 bp, Homo sapien
tcctaattatgcagcagcaacagcg

SEQ ID NO: 102264 - DNA, 25 bp, Homo sapien
agcaacagcgcctaagagtatcttt

SEQ ID NO: 102265 - DNA, 25 bp, Homo sapien
gcgcctaagagtatcttttcaaatt

SEQ ID NO: 102266 - DNA, 25 bp, Homo sapien
ctgaagtcacatgaagacccagata

SEQ ID NO: 102267 - DNA, 25 bp, Homo sapien
gacccagatactaacatatggtgat

SEQ ID NO: 102268 - DNA, 25 bp, Homo sapien
gacgttcagctagatttgttcccat

SEQ ID NO: 102269 - DNA, 25 bp, Homo sapien
ttgttcccatttccgttgtgttaat

SEQ ID NO: 102270 - DNA, 25 bp, Homo sapien
ttaattcaaagctcatgctccccta

SEQ ID NO: 102271 - DNA, 25 bp, Homo sapien
ctcccctacggtacaggctgaggta

SEQ ID NO: 102272 - DNA, 25 bp, Homo sapien
tggcggtgcatatcattaactaaca

SEQ ID NO: 102273 - DNA, 25 bp, Homo sapien
acactccaaacaaaggtgagcttgc

SEQ ID NO: 102274 - DNA, 25 bp, Homo sapien
ttgcccaggacttggcatttccaaa

SEQ ID NO: 102275 - DNA, 25 bp, Homo sapien
gtttttagatatgaacacctactgt

SEQ ID NO: 102276 - DNA, 25 bp, Homo sapien
cctactgtgagttctgctacaaagc

SEQ ID NO: 102277 - DNA, 25 bp, Homo sapien
gaatttgtctcaactatgcaatttg

SEQ ID NO: 102278 - DNA, 25 bp, Homo sapien
gtatgtgcagcatgttacatttact

SEQ ID NO: 102279 - DNA, 25 bp, Homo sapien
agtgatatacttaggcaggtggctg

SEQ ID NO: 102280 - DNA, 25 bp, Homo sapien
agctggctatggcagcaacccatga

SEQ ID NO: 102281 - DNA, 25 bp, Homo sapien
ggctatggcagcaacccatgaaagt

SEQ ID NO: 102282 - DNA, 25 bp, Homo sapien
ggcagcaacccatgaaagtgagtga

SEQ ID NO: 102283 - DNA, 25 bp, Homo sapien
acccatgaaagtgagtgataacaac

SEQ ID NO: 102284 - DNA, 25 bp, Homo sapien
acaacatttattgtttcctgtggcg

SEQ ID NO: 102285 - DNA, 25 bp, Homo sapien
gcgttgctttgctttgctattgact

SEQ ID NO: 102286 - DNA, 25 bp, Homo sapien
cgttgctttgctttgctattgactg

SEQ ID NO: 102287 - DNA, 25 bp, Homo sapien
tattgactggtagcacttgtagctt

SEQ ID NO: 102288 - DNA, 25 bp, Homo sapien
gactggtagcacttgtagctttaaa

SEQ ID NO: 102289 - DNA, 25 bp, Homo sapien
ggtagcacttgtagctttaaataaa

SEQ ID NO: 102290 - DNA, 25 bp, Homo sapien
ttggccttcacgctgtggaagcagc

SEQ ID NO: 102291 - DNA, 25 bp, Homo sapien
tggaagcagccaaggcacttcctca

SEQ ID NO: 102292 - DNA, 25 bp, Homo sapien
gcagcccaagtcatgactcagacca

SEQ ID NO: 102293 - DNA, 25 bp, Homo sapien
aagtcatgactcagaccaggtccca

SEQ ID NO: 102294 - DNA, 25 bp, Homo sapien
atgactcagaccaggtcccacactg

SEQ ID NO: 102295 - DNA, 25 bp, Homo sapien
tgagctgcccacactcgagagccag

SEQ ID NO: 102296 - DNA, 25 bp, Homo sapien
acactcgagagccagatatttttgt

SEQ ID NO: 102297 - DNA, 25 bp, Homo sapien
ttatgcctttggctattatgaaaga

SEQ ID NO: 102298 - DNA, 25 bp, Homo sapien
gcctttggctattatgaaagaggtt

SEQ ID NO: 102299 - DNA, 25 bp, Homo sapien
gaaagaggttagtgtgttccctgca

SEQ ID NO: 102300 - DNA, 25 bp, Homo sapien
gttccctgcaataaacttgttcctg

SEQ ID NO: 102301 - DNA, 25 bp, Homo sapien
cctcatgcccaagggtttgttagat

SEQ ID NO: 102302 - DNA, 25 bp, Homo sapien
atgcccaagggtttgttagatggcc

SEQ ID NO: 102303 - DNA, 25 bp, Homo sapien
cccaagggtttgttagatggcctct

SEQ ID NO: 102304 - DNA, 25 bp, Homo sapien
agggtttgttagatggcctctgact

SEQ ID NO: 102305 - DNA, 25 bp, Homo sapien
actctgtgggattcaacttgacttt

SEQ ID NO: 102306 - DNA, 25 bp, Homo sapien
tgggattcaacttgacttttttgcc

SEQ ID NO: 102307 - DNA, 25 bp, Homo sapien
acttttttgccccaggaggctctgt

SEQ ID NO: 102308 - DNA, 25 bp, Homo sapien
tttttgccccaggaggctctgtctg

SEQ ID NO: 102309 - DNA, 25 bp, Homo sapien
ctgtctggaaacaggcttagcttta

SEQ ID NO: 102310 - DNA, 25 bp, Homo sapien
aaacaggcttagctttagtgctggg

SEQ ID NO: 102311 - DNA, 25 bp, Homo sapien
tgagctctttgcctccaacctgctt

SEQ ID NO: 102312 - DNA, 25 bp, Homo sapien
cactacctgcacgagcaagtcaaga

SEQ ID NO: 102313 - DNA, 25 bp, Homo sapien
cctgcacgagcaagtcaagaccatc

SEQ ID NO: 102314 - DNA, 25 bp, Homo sapien
gcacgagcaagtcaagaccatcaaa

SEQ ID NO: 102315 - DNA, 25 bp, Homo sapien
aacctgcgcaagatttgttccccgg

SEQ ID NO: 102316 - DNA, 25 bp, Homo sapien
tgcgcaagatttgttccccggaagc

SEQ ID NO: 102317 - DNA, 25 bp, Homo sapien
gcaagatttgttccccggaagccgg

SEQ ID NO: 102318 - DNA, 25 bp, Homo sapien
ttgttccccggaagccggcctggct

SEQ ID NO: 102319 - DNA, 25 bp, Homo sapien
ctgggcggccgcgtcaaagagactt

SEQ ID NO: 102320 - DNA, 25 bp, Homo sapien
gcgtcaaagagacttgagcccagat

SEQ ID NO: 102321 - DNA, 25 bp, Homo sapien
ctttcagttttaccattgttagcaa

SEQ ID NO: 102322 - DNA, 25 bp, Homo sapien
cattgttagcaaaaaagttatctgg

SEQ ID NO: 102323 - DNA, 25 bp, Homo sapien
aagtagctcagttacagagaagcaa

SEQ ID NO: 102324 - DNA, 25 bp, Homo sapien
gaagcaaatcgagttatttcccaca

SEQ ID NO: 102325 - DNA, 25 bp, Homo sapien
ttcccacataaaaagtttcccagat

SEQ ID NO: 102326 - DNA, 25 bp, Homo sapien
aagtttcccagattctaagaattgc

SEQ ID NO: 102327 - DNA, 25 bp, Homo sapien
gaattgcagtatcctgtaccctaaa

SEQ ID NO: 102328 - DNA, 25 bp, Homo sapien
ttttcaaggtgactcctgttgtcgt

SEQ ID NO: 102329 - DNA, 25 bp, Homo sapien
actcctgttgtcgtctgttgataac

SEQ ID NO: 102330 - DNA, 25 bp, Homo sapien
aacattttcgggattatcgattgca

SEQ ID NO: 102331 - DNA, 25 bp, Homo sapien
ttatgctgtgtgctgaattactatg

SEQ ID NO: 102332 - DNA, 25 bp, Homo sapien
gtgctgaattactatgccatgtgct

SEQ ID NO: 102333 - DNA, 25 bp, Homo sapien
atgccatgtgctattttagtgtttg

SEQ ID NO: 102334 - DNA, 25 bp, Homo sapien
gctcctcctcacgccacaaatctgg

SEQ ID NO: 102335 - DNA, 25 bp, Homo sapien
tcctcctcacgccacaaatctggtg

SEQ ID NO: 102336 - DNA, 25 bp, Homo sapien
cctcctcacgccacaaatctggtgc

SEQ ID NO: 102337 - DNA, 25 bp, Homo sapien
ctcctcacgccacaaatctggtgcc

SEQ ID NO: 102338 - DNA, 25 bp, Homo sapien
tcctcacgccacaaatctggtgcct

SEQ ID NO: 102339 - DNA, 25 bp, Homo sapien
cctcacgccacaaatctggtgcctc

SEQ ID NO: 102340 - DNA, 25 bp, Homo sapien
ctcacgccacaaatctggtgcctct

SEQ ID NO: 102341 - DNA, 25 bp, Homo sapien
tcacgccacaaatctggtgcctctc

SEQ ID NO: 102342 - DNA, 25 bp, Homo sapien
cacgccacaaatctggtgcctctct

SEQ ID NO: 102343 - DNA, 25 bp, Homo sapien
acgccacaaatctggtgcctctctc

SEQ ID NO: 102344 - DNA, 25 bp, Homo sapien
cgccacaaatctggtgcctctctct

SEQ ID NO: 102345 - DNA, 25 bp, Homo sapien
tggaccccgactctgtggacgagat

SEQ ID NO: 102346 - DNA, 25 bp, Homo sapien
actctgtggacgagatcgcctgcca

SEQ ID NO: 102347 - DNA, 25 bp, Homo sapien
ctggatgcgggtgccagcctctgca

SEQ ID NO: 102348 - DNA, 25 bp, Homo sapien
ggaccacagacgtggccatgctggt

SEQ ID NO: 102349 - DNA, 25 bp, Homo sapien
tggtcaccatgttcggctggttcgc

SEQ ID NO: 102350 - DNA, 25 bp, Homo sapien
gctggttcgccatggtgatcgccta

SEQ ID NO: 102351 - DNA, 25 bp, Homo sapien
atggtgatcgcctacgtcgtgtact

SEQ ID NO: 102352 - DNA, 25 bp, Homo sapien
tacgtcgtgtactatgtgcgccaca

SEQ ID NO: 102353 - DNA, 25 bp, Homo sapien
cgtgtactatgtgcgccacaaccag

SEQ ID NO: 102354 - DNA, 25 bp, Homo sapien
aggatgcccggaggcacctggagta

SEQ ID NO: 102355 - DNA, 25 bp, Homo sapien
tggagtacctgaagtctctgcccag

SEQ ID NO: 102356 - DNA, 25 bp, Homo sapien
gcattggttaagtttattttgctaa

SEQ ID NO: 102357 - DNA, 25 bp, Homo sapien
tacttccctaagtcactttccttat

SEQ ID NO: 102358 - DNA, 25 bp, Homo sapien
agtcactttccttatgtatcatcta

SEQ ID NO: 102359 - DNA, 25 bp, Homo sapien
cactttccttatgtatcatctaata

SEQ ID NO: 102360 - DNA, 25 bp, Homo sapien
gggtgtttgagtattcagatttcat

SEQ ID NO: 102361 - DNA, 25 bp, Homo sapien
ttcagatttcataaaacacttcctt

SEQ ID NO: 102362 - DNA, 25 bp, Homo sapien
cacttccttggaatatagctgcatt

SEQ ID NO: 102363 - DNA, 25 bp, Homo sapien
ggaatatagctgcattaacttggaa

SEQ ID NO: 102364 - DNA, 25 bp, Homo sapien
gctgcattaacttggaaagaagcct

SEQ ID NO: 102365 - DNA, 25 bp, Homo sapien
aagaagcctgttgggccagaagaca

SEQ ID NO: 102366 - DNA, 25 bp, Homo sapien
aactccaactggcaaaaaagcaagc

SEQ ID NO: 102367 - DNA, 25 bp, Homo sapien
aacacggccatccaagagatcttta

SEQ ID NO: 102368 - DNA, 25 bp, Homo sapien
tctttaatagggtctctgagcattt

SEQ ID NO: 102369 - DNA, 25 bp, Homo sapien
ttaatagggtctctgagcatttctc

SEQ ID NO: 102370 - DNA, 25 bp, Homo sapien
tctcagccatgttcaaaaggaaagc

SEQ ID NO: 102371 - DNA, 25 bp, Homo sapien
gaaagcttttgtgcactggtacacc

SEQ ID NO: 102372 - DNA, 25 bp, Homo sapien
ttttgtgcactggtacaccagcgaa

SEQ ID NO: 102373 - DNA, 25 bp, Homo sapien
gtacaccagcgaagggatggacata

SEQ ID NO: 102374 - DNA, 25 bp, Homo sapien
aacatccatgatttggtatccgagt

SEQ ID NO: 102375 - DNA, 25 bp, Homo sapien
gtatccgagtaccaacaatttcaag

SEQ ID NO: 102376 - DNA, 25 bp, Homo sapien
gtaccaacaatttcaagatgccaaa

SEQ ID NO: 102377 - DNA, 25 bp, Homo sapien
agatgccaaagcagttctagaggaa

SEQ ID NO: 102378 - DNA, 25 bp, Homo sapien
gggttagggtctctaattgcaaagt

SEQ ID NO: 102379 - DNA, 25 bp, Homo sapien
gaaagttgcctctgtgtctgagaaa

SEQ ID NO: 102380 - DNA, 25 bp, Homo sapien
aaagtatcttagttgttggctgctc

SEQ ID NO: 102381 - DNA, 25 bp, Homo sapien
gctgctccagaggtatctttgtcaa

SEQ ID NO: 102382 - DNA, 25 bp, Homo sapien
tctttgtcaaaagcttctggttcaa

SEQ ID NO: 102383 - DNA, 25 bp, Homo sapien
gcttctggttcaatatcagccactg

SEQ ID NO: 102384 - DNA, 25 bp, Homo sapien
atcagccactgagcagataaccctg

SEQ ID NO: 102385 - DNA, 25 bp, Homo sapien
gataaccctgcttatttggtgtggt

SEQ ID NO: 102386 - DNA, 25 bp, Homo sapien
gtggttaaatcaactagcttctgct

SEQ ID NO: 102387 - DNA, 25 bp, Homo sapien
agcttctgctaatagccccaatttg

SEQ ID NO: 102388 - DNA, 25 bp, Homo sapien
tgcttgaatgggaaaactctctcat

SEQ ID NO: 102389 - DNA, 25 bp, Homo sapien
cgccgatggaacgttggtagtccta

SEQ ID NO: 102390 - DNA, 25 bp, Homo sapien
ttggtagtcctaagtctgttttcct

SEQ ID NO: 102391 - DNA, 25 bp, Homo sapien
ctgttttcctgctgcatttcttgta

SEQ ID NO: 102392 - DNA, 25 bp, Homo sapien
tgcatttcttgtactggcctcagtg

SEQ ID NO: 102393 - DNA, 25 bp, Homo sapien
ggacatgtttccagctctcagtttc

SEQ ID NO: 102394 - DNA, 25 bp, Homo sapien
agtttctgtaatgcggtggttctca

SEQ ID NO: 102395 - DNA, 25 bp, Homo sapien
aatgcagatgcttggactcttctcc

SEQ ID NO: 102396 - DNA, 25 bp, Homo sapien
aattgtcgggcatggagctcaagca

SEQ ID NO: 102397 - DNA, 25 bp, Homo sapien
gcaaggacagtgacgctgttccggc

SEQ ID NO: 102398 - DNA, 25 bp, Homo sapien
gttccggcctcagtcacactgatag

SEQ ID NO: 102399 - DNA, 25 bp, Homo sapien
gcaagattctgttcagtcattctct

SEQ ID NO: 102400 - DNA, 25 bp, Homo sapien
ttgtgtcacttgatactgttccctc

SEQ ID NO: 102401 - DNA, 25 bp, Homo sapien
tactgttccctcatcaattccatgt

SEQ ID NO: 102402 - DNA, 25 bp, Homo sapien
aattccatgtccaacatctttttga

SEQ ID NO: 102403 - DNA, 25 bp, Homo sapien
aaagtcaaacacatctatcctcgct

SEQ ID NO: 102404 - DNA, 25 bp, Homo sapien
tatcctcgcttcttaggacttcttt

SEQ ID NO: 102405 - DNA, 25 bp, Homo sapien
agatatcatcttgtcttaatccaaa

SEQ ID NO: 102406 - DNA, 25 bp, Homo sapien
ccaaaactctttagtcagtgacctt

SEQ ID NO: 102407 - DNA, 25 bp, Homo sapien
agtgaccttctcagggcagctttca

SEQ ID NO: 102408 - DNA, 25 bp, Homo sapien
agctttcacatccttgtttctcaat

SEQ ID NO: 102409 - DNA, 25 bp, Homo sapien
ataaaagagagccatgatcttcccc

SEQ ID NO: 102410 - DNA, 25 bp, Homo sapien
gctggacatacatactgatggctgt

SEQ ID NO: 102411 - DNA, 25 bp, Homo sapien
gtggcagaacaaactccaccctaat

SEQ ID NO: 102412 - DNA, 25 bp, Homo sapien
gaacaaactccaccctaatgtgggt

SEQ ID NO: 102413 - DNA, 25 bp, Homo sapien
tccagtctgttgaaggcctgaatgt

SEQ ID NO: 102414 - DNA, 25 bp, Homo sapien
gggctgggacataagtttttctgct

SEQ ID NO: 102415 - DNA, 25 bp, Homo sapien
ttttctgctttcagacgcaaactga

SEQ ID NO: 102416 - DNA, 25 bp, Homo sapien
aaaaatggctcttcttgggtcttga

SEQ ID NO: 102417 - DNA, 25 bp, Homo sapien
ttgggtcttgagcttgctggcatat

SEQ ID NO: 102418 - DNA, 25 bp, Homo sapien
gagcttgctggcatatggactgaaa

SEQ ID NO: 102419 - DNA, 25 bp, Homo sapien
aagaaactatgctattggatctcct

SEQ ID NO: 102420 - DNA, 25 bp, Homo sapien
gatcttgagatatgtcagcctctac

SEQ ID NO: 102421 - DNA, 25 bp, Homo sapien
agatatgtcagcctctacagtcaca

SEQ ID NO: 102422 - DNA, 25 bp, Homo sapien
ggaggatgccttgtctcggtcagct

SEQ ID NO: 102423 - DNA, 25 bp, Homo sapien
aggatgccttgtctcggtcagctca

SEQ ID NO: 102424 - DNA, 25 bp, Homo sapien
gatgccttgtctcggtcagctcatt

SEQ ID NO: 102425 - DNA, 25 bp, Homo sapien
ccttgtctcggtcagctcattcctg

SEQ ID NO: 102426 - DNA, 25 bp, Homo sapien
tttctctttcaccacgtgtgaactg

SEQ ID NO: 102427 - DNA, 25 bp, Homo sapien
tctttcaccacgtgtgaactgtggg

SEQ ID NO: 102428 - DNA, 25 bp, Homo sapien
ccacgtggcttggttcccagggaca

SEQ ID NO: 102429 - DNA, 25 bp, Homo sapien
acgtggcttggttcccagggacagt

SEQ ID NO: 102430 - DNA, 25 bp, Homo sapien
ttggttcccagggacagtcagggcc

SEQ ID NO: 102431 - DNA, 25 bp, Homo sapien
gagaagacaataaagtcgctccgca

SEQ ID NO: 102432 - DNA, 25 bp, Homo sapien
aagacaataaagtcgctccgcagct

SEQ ID NO: 102433 - DNA, 25 bp, Homo sapien
ggtgtgacctgcttgctagagaact

SEQ ID NO: 102434 - DNA, 25 bp, Homo sapien
gctagagaactgtgaacatgtggct

SEQ ID NO: 102435 - DNA, 25 bp, Homo sapien
gagtgactgctgctccatattagct

SEQ ID NO: 102436 - DNA, 25 bp, Homo sapien
gctccatattagcttccagagggtg

SEQ ID NO: 102437 - DNA, 25 bp, Homo sapien
gtgagggacagaatatttccttcat

SEQ ID NO: 102438 - DNA, 25 bp, Homo sapien
atttccttcataatggtcatgggtg

SEQ ID NO: 102439 - DNA, 25 bp, Homo sapien
catgggtgaatgctttctgctgtaa

SEQ ID NO: 102440 - DNA, 25 bp, Homo sapien
gaatcagcatagtgggatgcccagc

SEQ ID NO: 102441 - DNA, 25 bp, Homo sapien
tgggatgcccagcaggcacaaacca

SEQ ID NO: 102442 - DNA, 25 bp, Homo sapien
acaaaccatgggtccagggagtctc

SEQ ID NO: 102443 - DNA, 25 bp, Homo sapien
gggaacttctatcagtatcaataac

SEQ ID NO: 102444 - DNA, 25 bp, Homo sapien
ttattcccgaattttcccagtctct

SEQ ID NO: 102445 - DNA, 25 bp, Homo sapien
ttcccagtctcttaaacagaaaaat

SEQ ID NO: 102446 - DNA, 25 bp, Homo sapien
ccaactcacacagcataagcaatgt

SEQ ID NO: 102447 - DNA, 25 bp, Homo sapien
actcacacagcataagcaatgtttg

SEQ ID NO: 102448 - DNA, 25 bp, Homo sapien
acacagcataagcaatgtttgacag

SEQ ID NO: 102449 - DNA, 25 bp, Homo sapien
tgacagcaatataatgccgttgtaa

SEQ ID NO: 102450 - DNA, 25 bp, Homo sapien
acagcaatataatgccgttgtaaac

SEQ ID NO: 102451 - DNA, 25 bp, Homo sapien
gtatctgttctggtaaccatgtaca

SEQ ID NO: 102452 - DNA, 25 bp, Homo sapien
atctgttctggtaaccatgtacaga

SEQ ID NO: 102453 - DNA, 25 bp, Homo sapien
ctggtaaccatgtacagaatgtgaa

SEQ ID NO: 102454 - DNA, 25 bp, Homo sapien
tgtacagaatgtgaaactgtcttat

SEQ ID NO: 102455 - DNA, 25 bp, Homo sapien
ctgacatcccacctaattttaatct

SEQ ID NO: 102456 - DNA, 25 bp, Homo sapien
caaatttatgagtttaatcacttca

SEQ ID NO: 102457 - DNA, 25 bp, Homo sapien
gagtttaatcacttcaaatatgaat

SEQ ID NO: 102458 - DNA, 25 bp, Homo sapien
aaaaatgagagcttgcttacttcta

SEQ ID NO: 102459 - DNA, 25 bp, Homo sapien
tgagagcttgcttacttctaaaaat

SEQ ID NO: 102460 - DNA, 25 bp, Homo sapien
gagcttgcttacttctaaaaattga

SEQ ID NO: 102461 - DNA, 25 bp, Homo sapien
tgcttacttctaaaaattgaggtta

SEQ ID NO: 102462 - DNA, 25 bp, Homo sapien
agatatagctagtgtctgaacgaca

SEQ ID NO: 102463 - DNA, 25 bp, Homo sapien
gctagtgtctgaacgacactcctta

SEQ ID NO: 102464 - DNA, 25 bp, Homo sapien
tgtctgaacgacactccttaaagta

SEQ ID NO: 102465 - DNA, 25 bp, Homo sapien
ctgaacgacactccttaaagtaagt

SEQ ID NO: 102466 - DNA, 25 bp, Homo sapien
atctatgtttctctttctgcttctc

SEQ ID NO: 102467 - DNA, 25 bp, Homo sapien
tctttctgcttctctactttacact

SEQ ID NO: 102468 - DNA, 25 bp, Homo sapien
tttacactccagtttccatcctttt

SEQ ID NO: 102469 - DNA, 25 bp, Homo sapien
atccttttcagccaactggactgaa

SEQ ID NO: 102470 - DNA, 25 bp, Homo sapien
atgaggttgcttgatacccagcctt

SEQ ID NO: 102471 - DNA, 25 bp, Homo sapien
ccagccttggttctgtgccaagcat

SEQ ID NO: 102472 - DNA, 25 bp, Homo sapien
gtgccaagcattactgcaggatctc

SEQ ID NO: 102473 - DNA, 25 bp, Homo sapien
tgcaggatctccagccagttcagca

SEQ ID NO: 102474 - DNA, 25 bp, Homo sapien
gccagttcagcacgtttacctagga

SEQ ID NO: 102475 - DNA, 25 bp, Homo sapien
cgtttacctaggacagctggatctg

SEQ ID NO: 102476 - DNA, 25 bp, Homo sapien
gggctcatccagaaagagctttatt

SEQ ID NO: 102477 - DNA, 25 bp, Homo sapien
agcggcaagcccaagaagcccggga

SEQ ID NO: 102478 - DNA, 25 bp, Homo sapien
aagcccgggactcctgagaacaata

SEQ ID NO: 102479 - DNA, 25 bp, Homo sapien
aataaggagtatgccaaggtgtccg

SEQ ID NO: 102480 - DNA, 25 bp, Homo sapien
aacaacatcctggtgttggtgccag

SEQ ID NO: 102481 - DNA, 25 bp, Homo sapien
gttggtgccagatccacatgctaaa

SEQ ID NO: 102482 - DNA, 25 bp, Homo sapien
catgctaaaaacgtggcttgctttg

SEQ ID NO: 102483 - DNA, 25 bp, Homo sapien
aaagaggccccaccatcacttgaac

SEQ ID NO: 102484 - DNA, 25 bp, Homo sapien
ggccaacttcactgcaacatcaagc

SEQ ID NO: 102485 - DNA, 25 bp, Homo sapien
caacatcaagcaagtgcaggctcca

SEQ ID NO: 102486 - DNA, 25 bp, Homo sapien
gattacctggatcccgcatgtttta

SEQ ID NO: 102487 - DNA, 25 bp, Homo sapien
atgttttacacactcctttcactga

SEQ ID NO: 102488 - DNA, 25 bp, Homo sapien
ttgttgaaaacctccttctgctggg

SEQ ID NO: 102489 - DNA, 25 bp, Homo sapien
gggatcctgataagatggcacctta

SEQ ID NO: 102490 - DNA, 25 bp, Homo sapien
gatggcaccttaaaactagccaaat

SEQ ID NO: 102491 - DNA, 25 bp, Homo sapien
gaatcctaacaatcttctgaactcc

SEQ ID NO: 102492 - DNA, 25 bp, Homo sapien
tcttctgaactccagtacctataac

SEQ ID NO: 102493 - DNA, 25 bp, Homo sapien
gtacctataactgggcttgcaacct

SEQ ID NO: 102494 - DNA, 25 bp, Homo sapien
ctctcatcacacagccacataaatt

SEQ ID NO: 102495 - DNA, 25 bp, Homo sapien
cagccacataaattccctaggaagt

SEQ ID NO: 102496 - DNA, 25 bp, Homo sapien
aatttttcctagacctggttgtcag

SEQ ID NO: 102497 - DNA, 25 bp, Homo sapien
ttcctagacctggttgtcagccaaa

SEQ ID NO: 102498 - DNA, 25 bp, Homo sapien
ctggttgtcagccaaagtcctacaa

SEQ ID NO: 102499 - DNA, 25 bp, Homo sapien
acgattggagcccttaagatgcacg

SEQ ID NO: 102500 - DNA, 25 bp, Homo sapien
gattggagcccttaagatgcacgat

SEQ ID NO: 102501 - DNA, 25 bp, Homo sapien
ggagcccttaagatgcacgatggaa

SEQ ID NO: 102502 - DNA, 25 bp, Homo sapien
gcccttaagatgcacgatggaattg

SEQ ID NO: 102503 - DNA, 25 bp, Homo sapien
aggacctggagataaacgctggagc

SEQ ID NO: 102504 - DNA, 25 bp, Homo sapien
aaacgctggagcaatctccttggaa

SEQ ID NO: 102505 - DNA, 25 bp, Homo sapien
gctggagcaatctccttggaaggat

SEQ ID NO: 102506 - DNA, 25 bp, Homo sapien
ggagcaatctccttggaaggattca

SEQ ID NO: 102507 - DNA, 25 bp, Homo sapien
tccttggaaggattcagcacgagta

SEQ ID NO: 102508 - DNA, 25 bp, Homo sapien
aggattcagcacgagtagatggtaa

SEQ ID NO: 102509 - DNA, 25 bp, Homo sapien
ataagtaggtttccaattggctatt

SEQ ID NO: 102510 - DNA, 25 bp, Homo sapien
gattttagctataaagtgcttgacc

SEQ ID NO: 102511 - DNA, 25 bp, Homo sapien
gtgcttgaccagtaatgtggttgta

SEQ ID NO: 102512 - DNA, 25 bp, Homo sapien
gtaattttgtgtatgttcccccaca

SEQ ID NO: 102513 - DNA, 25 bp, Homo sapien
caggaggttgaggttcactattaac

SEQ ID NO: 102514 - DNA, 25 bp, Homo sapien
gaggttcactattaacaaatgtcat

SEQ ID NO: 102515 - DNA, 25 bp, Homo sapien
tatctcatagaggtacagtgccaat

SEQ ID NO: 102516 - DNA, 25 bp, Homo sapien
aggtacagtgccaatagatattcaa

SEQ ID NO: 102517 - DNA, 25 bp, Homo sapien
caaatgttgcatgttgaccagaggg

SEQ ID NO: 102518 - DNA, 25 bp, Homo sapien
ccttagagaaagattttgacctggc

SEQ ID NO: 102519 - DNA, 25 bp, Homo sapien
agattttgacctggctttagataaa

SEQ ID NO: 102520 - DNA, 25 bp, Homo sapien
cctggctttagataaaactgtggca

SEQ ID NO: 102521 - DNA, 25 bp, Homo sapien
tccgctggatctgctagcgccgccg

SEQ ID NO: 102522 - DNA, 25 bp, Homo sapien
gggccccgcagtcgagggtcgtgag

SEQ ID NO: 102523 - DNA, 25 bp, Homo sapien
cgcagtcgagggtcgtgagcccacc

SEQ ID NO: 102524 - DNA, 25 bp, Homo sapien
agtcgagggtcgtgagcccaccccg

SEQ ID NO: 102525 - DNA, 25 bp, Homo sapien
tcgagggtcgtgagcccaccccgtc

SEQ ID NO: 102526 - DNA, 25 bp, Homo sapien
caccccgtccatggtgctaagcggg

SEQ ID NO: 102527 - DNA, 25 bp, Homo sapien
gtccatggtgctaagcgggcccggg

SEQ ID NO: 102528 - DNA, 25 bp, Homo sapien
ccatggtgctaagcgggcccgggtc

SEQ ID NO: 102529 - DNA, 25 bp, Homo sapien
tggtgctaagcgggcccgggtccca

SEQ ID NO: 102530 - DNA, 25 bp, Homo sapien
agcaccgctgctcactcggacgacg

SEQ ID NO: 102531 - DNA, 25 bp, Homo sapien
tgctcactcggacgacgccctgggc

SEQ ID NO: 102532 - DNA, 25 bp, Homo sapien
tttctcaaagcggtgaccactcagg

SEQ ID NO: 102533 - DNA, 25 bp, Homo sapien
aaatctgagggatggccagtgcact

SEQ ID NO: 102534 - DNA, 25 bp, Homo sapien
gatggccagtgcactccaatgatgg

SEQ ID NO: 102535 - DNA, 25 bp, Homo sapien
ccaatgatgggacaggcctaacaac

SEQ ID NO: 102536 - DNA, 25 bp, Homo sapien
tttcagctggttcacctctttgttc

SEQ ID NO: 102537 - DNA, 25 bp, Homo sapien
gttctctagactcttaagtactgac

SEQ ID NO: 102538 - DNA, 25 bp, Homo sapien
gactcttaagtactgactgctttga

SEQ ID NO: 102539 - DNA, 25 bp, Homo sapien
gactgctttgacttttgtgattatg

SEQ ID NO: 102540 - DNA, 25 bp, Homo sapien
ggtgatgtgtagtcagtgtaccaat

SEQ ID NO: 102541 - DNA, 25 bp, Homo sapien
gtgtaccaatatgttcacaacctag

SEQ ID NO: 102542 - DNA, 25 bp, Homo sapien
atgttcacaacctaggatcatgata

SEQ ID NO: 102543 - DNA, 25 bp, Homo sapien
gcattcctgcgggtgagagccgtcc

SEQ ID NO: 102544 - DNA, 25 bp, Homo sapien
ctccatggagggacccatagggcta

SEQ ID NO: 102545 - DNA, 25 bp, Homo sapien
catagggctagacactttgaggcaa

SEQ ID NO: 102546 - DNA, 25 bp, Homo sapien
gaggctctgcctaatgtgaatttat

SEQ ID NO: 102547 - DNA, 25 bp, Homo sapien
cctgaggagcccaagtgacaaggga

SEQ ID NO: 102548 - DNA, 25 bp, Homo sapien
tgacaagggacaactgacgccgtct

SEQ ID NO: 102549 - DNA, 25 bp, Homo sapien
tgacgccgtctctgtgagcaccgag

SEQ ID NO: 102550 - DNA, 25 bp, Homo sapien
ctgtgagcaccgaggctttttggcc

SEQ ID NO: 102551 - DNA, 25 bp, Homo sapien
ggcctcagcaccttcgaagtggttc

SEQ ID NO: 102552 - DNA, 25 bp, Homo sapien
tcgaagtggttccttggcagactgc

SEQ ID NO: 102553 - DNA, 25 bp, Homo sapien
ggcagactgcctttcctggaagagg

SEQ ID NO: 102554 - DNA, 25 bp, Homo sapien
ttactactgttgacagtttccgcag

SEQ ID NO: 102555 - DNA, 25 bp, Homo sapien
gacagtttccgcagaaatcctattt

SEQ ID NO: 102556 - DNA, 25 bp, Homo sapien
gaaatcctatttcagtggaccaaca

SEQ ID NO: 102557 - DNA, 25 bp, Homo sapien
ggcatggcagcaaatgccaacattt

SEQ ID NO: 102558 - DNA, 25 bp, Homo sapien
gccaacattttgtggaatagcagca

SEQ ID NO: 102559 - DNA, 25 bp, Homo sapien
cccttctcctgaatcagcagggatg

SEQ ID NO: 102560 - DNA, 25 bp, Homo sapien
agttatgaattactccttccagtag

SEQ ID NO: 102561 - DNA, 25 bp, Homo sapien
attgtacatttctacagaacctgtg

SEQ ID NO: 102562 - DNA, 25 bp, Homo sapien
gaacctgtgattattctcgcatgat

SEQ ID NO: 102563 - DNA, 25 bp, Homo sapien
ttctcgcatgataaggatggtactt

SEQ ID NO: 102564 - DNA, 25 bp, Homo sapien
cttgcatatggtgaattactactgt

SEQ ID NO: 102565 - DNA, 25 bp, Homo sapien
ggaacaattctagtttacacatgtg

SEQ ID NO: 102566 - DNA, 25 bp, Homo sapien
ttacacatgtgagaagagttgctgg

SEQ ID NO: 102567 - DNA, 25 bp, Homo sapien
caaatcatcagactcccatggaaga

SEQ ID NO: 102568 - DNA, 25 bp, Homo sapien
gacccagatgaattattgtttaagt

SEQ ID NO: 102569 - DNA, 25 bp, Homo sapien
gtttaagtagagcatttccttttat

SEQ ID NO: 102570 - DNA, 25 bp, Homo sapien
actctttttgacctgccctacatca

SEQ ID NO: 102571 - DNA, 25 bp, Homo sapien
tacatcagaagtcaccgagctccca

SEQ ID NO: 102572 - DNA, 25 bp, Homo sapien
cagccagtgtggaggccaaaggata

SEQ ID NO: 102573 - DNA, 25 bp, Homo sapien
gagtttcagcttatgccagcactgg

SEQ ID NO: 102574 - DNA, 25 bp, Homo sapien
ccagcactggtcagcatgctcaaga

SEQ ID NO: 102575 - DNA, 25 bp, Homo sapien
atgctcaagagtgctaatttaggtc

SEQ ID NO: 102576 - DNA, 25 bp, Homo sapien
aaagtgcatataaatttttgttcat

SEQ ID NO: 102577 - DNA, 25 bp, Homo sapien
gttcatttagaactgagtattctgg

SEQ ID NO: 102578 - DNA, 25 bp, Homo sapien
gaactgagtattctggagaaaacca

SEQ ID NO: 102579 - DNA, 25 bp, Homo sapien
tggagaaaaccaatggtcagcactt

SEQ ID NO: 102580 - DNA, 25 bp, Homo sapien
aatggtcagcacttttggtttgagt

SEQ ID NO: 102581 - DNA, 25 bp, Homo sapien
tttggtttgagttatctgagattgt

SEQ ID NO: 102582 - DNA, 25 bp, Homo sapien
agttatctgagattgtattttcaaa

SEQ ID NO: 102583 - DNA, 25 bp, Homo sapien
ttggtgtttttatcttgtcaaagac

SEQ ID NO: 102584 - DNA, 25 bp, Homo sapien
ttattccgttctaaaatattggaga

SEQ ID NO: 102585 - DNA, 25 bp, Homo sapien
gaaatattttggtaagcctctctta

SEQ ID NO: 102586 - DNA, 25 bp, Homo sapien
tttggtaagcctctcttactcctgt

SEQ ID NO: 102587 - DNA, 25 bp, Homo sapien
gtacatcatgatgaccctgaccagc

SEQ ID NO: 102588 - DNA, 25 bp, Homo sapien
acatcatgatgaccctgaccagctg

SEQ ID NO: 102589 - DNA, 25 bp, Homo sapien
gagcatgaccagcaagtggccagct

SEQ ID NO: 102590 - DNA, 25 bp, Homo sapien
atgaccagcaagtggccagctgtgt

SEQ ID NO: 102591 - DNA, 25 bp, Homo sapien
tggccagctgtgtgggtcaagatca

SEQ ID NO: 102592 - DNA, 25 bp, Homo sapien
gctgtgtgggtcaagatcagctcca

SEQ ID NO: 102593 - DNA, 25 bp, Homo sapien
aagatcagctccagctgggtctgcc

SEQ ID NO: 102594 - DNA, 25 bp, Homo sapien
ggacccttgtggctccacttgtcct

SEQ ID NO: 102595 - DNA, 25 bp, Homo sapien
ttgtcctcaccagtcgggacttcag

SEQ ID NO: 102596 - DNA, 25 bp, Homo sapien
gggacttcagctgaacctctgagtg

SEQ ID NO: 102597 - DNA, 25 bp, Homo sapien
gaacctctgagtgccaaggacacca

SEQ ID NO: 102598 - DNA, 25 bp, Homo sapien
acatatttgataggaggctacggga

SEQ ID NO: 102599 - DNA, 25 bp, Homo sapien
gacctgaaactgtttgttctctccc

SEQ ID NO: 102600 - DNA, 25 bp, Homo sapien
tgtttgttctctcccactagaatta

SEQ ID NO: 102601 - DNA, 25 bp, Homo sapien
gttctctcccactagaattaaatgg

SEQ ID NO: 102602 - DNA, 25 bp, Homo sapien
ggatgtttagactggctacttgccc

SEQ ID NO: 102603 - DNA, 25 bp, Homo sapien
tggctacttgccctaaaccagcact

SEQ ID NO: 102604 - DNA, 25 bp, Homo sapien
aaccagcacttggtgatgtctactg

SEQ ID NO: 102605 - DNA, 25 bp, Homo sapien
cacttggtgatgtctactgggtgga

SEQ ID NO: 102606 - DNA, 25 bp, Homo sapien
tgcttctctgaccattctttttgac

SEQ ID NO: 102607 - DNA, 25 bp, Homo sapien
tctgaccattctttttgactgtaat

SEQ ID NO: 102608 - DNA, 25 bp, Homo sapien
gtaatgaatcctccacagttggtca

SEQ ID NO: 102609 - DNA, 25 bp, Homo sapien
agcaggaacgcctcggacctgagtg

SEQ ID NO: 102610 - DNA, 25 bp, Homo sapien
acctgagtgctctccatattgtggg

SEQ ID NO: 102611 - DNA, 25 bp, Homo sapien
aagtctggatgggagcttgccaagt

SEQ ID NO: 102612 - DNA, 25 bp, Homo sapien
agcttgccaagtccctttttaggct

SEQ ID NO: 102613 - DNA, 25 bp, Homo sapien
taggaagcatttcgaacctgcgcaa

SEQ ID NO: 102614 - DNA, 25 bp, Homo sapien
ttcgaacctgcgcaacagaccaaag

SEQ ID NO: 102615 - DNA, 25 bp, Homo sapien
caaagaacatccgtgtacccagtac

SEQ ID NO: 102616 - DNA, 25 bp, Homo sapien
ctgccccatcctgagttcttttgaa

SEQ ID NO: 102617 - DNA, 25 bp, Homo sapien
aagctgatctcaggcatcggattat

SEQ ID NO: 102618 - DNA, 25 bp, Homo sapien
caggcatcggattatttcttctgta

SEQ ID NO: 102619 - DNA, 25 bp, Homo sapien
atatttcagaatgtatctctccaag

SEQ ID NO: 102620 - DNA, 25 bp, Homo sapien
ggctatggagtaagcattcttcaac

SEQ ID NO: 102621 - DNA, 25 bp, Homo sapien
gcattcttcaaccaatggaacagtt

SEQ ID NO: 102622 - DNA, 25 bp, Homo sapien
ggaacagttttttatcgtagcagaa

SEQ ID NO: 102623 - DNA, 25 bp, Homo sapien
tatcgtagcagaagaagctctcaac

SEQ ID NO: 102624 - DNA, 25 bp, Homo sapien
gctctcaacaaaagggcttcttcag

SEQ ID NO: 102625 - DNA, 25 bp, Homo sapien
acaaaagggcttcttcaggagataa

SEQ ID NO: 102626 - DNA, 25 bp, Homo sapien
gatgataaaatgctcttcaaagtaa

SEQ ID NO: 102627 - DNA, 25 bp, Homo sapien
tagtcacaagttaaagcgtctgaat

SEQ ID NO: 102628 - DNA, 25 bp, Homo sapien
gcgtctgaattgatgttaaagtttt

SEQ ID NO: 102629 - DNA, 25 bp, Homo sapien
aatacatgattctcataccccactg

SEQ ID NO: 102630 - DNA, 25 bp, Homo sapien
tcataccccactgaaatggtagttt

SEQ ID NO: 102631 - DNA, 25 bp, Homo sapien
actgccattggcaggacgtgcatca

SEQ ID NO: 102632 - DNA, 25 bp, Homo sapien
ttggcaggacgtgcatcacggacct

SEQ ID NO: 102633 - DNA, 25 bp, Homo sapien
tcacggacctccagctgactgtggg

SEQ ID NO: 102634 - DNA, 25 bp, Homo sapien
gctgtgttagccttagtggccattt

SEQ ID NO: 102635 - DNA, 25 bp, Homo sapien
gtgttagccttagtggccattttca

SEQ ID NO: 102636 - DNA, 25 bp, Homo sapien
agccttagtggccattttcataatg

SEQ ID NO: 102637 - DNA, 25 bp, Homo sapien
ttagtggccattttcataatgtctc

SEQ ID NO: 102638 - DNA, 25 bp, Homo sapien
tttcataatgtctctaaacaagcga

SEQ ID NO: 102639 - DNA, 25 bp, Homo sapien
gtctctaaacaagcgacactctagt

SEQ ID NO: 102640 - DNA, 25 bp, Homo sapien
aacaagcgacactctagtggtgatg

SEQ ID NO: 102641 - DNA, 25 bp, Homo sapien
gacactctagtggtgatgggaatag

SEQ ID NO: 102642 - DNA, 25 bp, Homo sapien
gccaggaaccaagagcactcatggt

SEQ ID NO: 102643 - DNA, 25 bp, Homo sapien
agagcactcatggttcactctctgg

SEQ ID NO: 102644 - DNA, 25 bp, Homo sapien
cactctctggtctaggactgatggg

SEQ ID NO: 102645 - DNA, 25 bp, Homo sapien
cccaggcctgtgttcgtgagtcggc

SEQ ID NO: 102646 - DNA, 25 bp, Homo sapien
tgtgttcgtgagtcggcctgccatg

SEQ ID NO: 102647 - DNA, 25 bp, Homo sapien
gagtcggcctgccatgtttccatgt

SEQ ID NO: 102648 - DNA, 25 bp, Homo sapien
atgtgccatttcttaccccttgtag

SEQ ID NO: 102649 - DNA, 25 bp, Homo sapien
atttcttaccccttgtaggcaatgg

SEQ ID NO: 102650 - DNA, 25 bp, Homo sapien
ttaccccttgtaggcaatggcaaag

SEQ ID NO: 102651 - DNA, 25 bp, Homo sapien
aagaatgtggtcaggctgtagcctc

SEQ ID NO: 102652 - DNA, 25 bp, Homo sapien
cagcagacagttttatggaaacttg

SEQ ID NO: 102653 - DNA, 25 bp, Homo sapien
ctccatctccagcaagtctcctggc

SEQ ID NO: 102654 - DNA, 25 bp, Homo sapien
tcctccacttgcagcgagacggcag

SEQ ID NO: 102655 - DNA, 25 bp, Homo sapien
cacttgcagcgagacggcagcacag

SEQ ID NO: 102656 - DNA, 25 bp, Homo sapien
cttgcagcgagacggcagcacagac

SEQ ID NO: 102657 - DNA, 25 bp, Homo sapien
cgagacggcagcacagacccctgga

SEQ ID NO: 102658 - DNA, 25 bp, Homo sapien
agacggcagcacagacccctggagg

SEQ ID NO: 102659 - DNA, 25 bp, Homo sapien
gacggcagcacagacccctggaggt

SEQ ID NO: 102660 - DNA, 25 bp, Homo sapien
agcacagacccctggaggtccaggg

SEQ ID NO: 102661 - DNA, 25 bp, Homo sapien
aggcagggtccaaacctgagtgagg

SEQ ID NO: 102662 - DNA, 25 bp, Homo sapien
cagggtccaaacctgagtgagggcc

SEQ ID NO: 102663 - DNA, 25 bp, Homo sapien
tgccttggtcccttgcctgggaaga

SEQ ID NO: 102664 - DNA, 25 bp, Homo sapien
ggaggttattaaagatctaagtgag

SEQ ID NO: 102665 - DNA, 25 bp, Homo sapien
gggtgaggcccgagcgctcacactt

SEQ ID NO: 102666 - DNA, 25 bp, Homo sapien
gagcgctcacacttcgtgtagggcg

SEQ ID NO: 102667 - DNA, 25 bp, Homo sapien
gctcacacttcgtgtagggcgggca

SEQ ID NO: 102668 - DNA, 25 bp, Homo sapien
ctcacacttcgtgtagggcgggcag

SEQ ID NO: 102669 - DNA, 25 bp, Homo sapien
tgacctcttgcagggcagtggcctt

SEQ ID NO: 102670 - DNA, 25 bp, Homo sapien
ctgccctgcgcagtatttattgcta

SEQ ID NO: 102671 - DNA, 25 bp, Homo sapien
attgctaaattattgtccaggaggg

SEQ ID NO: 102672 - DNA, 25 bp, Homo sapien
tggccccccgggtatttattgctgt

SEQ ID NO: 102673 - DNA, 25 bp, Homo sapien
tgtttgtgatatataaggttttctt

SEQ ID NO: 102674 - DNA, 25 bp, Homo sapien
tttgtatatgatcaataaacctttt

SEQ ID NO: 102675 - DNA, 25 bp, Homo sapien
gaaacatctcgcagttattagataa

SEQ ID NO: 102676 - DNA, 25 bp, Homo sapien
ttattagataaagggctggaccagg

SEQ ID NO: 102677 - DNA, 25 bp, Homo sapien
tggaccaggcatctgaacatgagct

SEQ ID NO: 102678 - DNA, 25 bp, Homo sapien
aggcatctgaacatgagctgactac

SEQ ID NO: 102679 - DNA, 25 bp, Homo sapien
catctgaacatgagctgactactag

SEQ ID NO: 102680 - DNA, 25 bp, Homo sapien
gaacatgagctgactactagctcta

SEQ ID NO: 102681 - DNA, 25 bp, Homo sapien
agctgactactagctctaatcaggt

SEQ ID NO: 102682 - DNA, 25 bp, Homo sapien
gactactagctctaatcaggttttt

SEQ ID NO: 102683 - DNA, 25 bp, Homo sapien
agctctaatcaggtttttataggaa

SEQ ID NO: 102684 - DNA, 25 bp, Homo sapien
tctcacgttttgaagtatcactata

SEQ ID NO: 102685 - DNA, 25 bp, Homo sapien
cacgttttgaagtatcactatacaa

SEQ ID NO: 102686 - DNA, 25 bp, Homo sapien
ttatcatttgacaaatacctaggta

SEQ ID NO: 102687 - DNA, 25 bp, Homo sapien
acctaggtataactggaattttcat

SEQ ID NO: 102688 - DNA, 25 bp, Homo sapien
gaattttcatgtttgaagttctaat

SEQ ID NO: 102689 - DNA, 25 bp, Homo sapien
gatctacagttgtatcttgattcta

SEQ ID NO: 102690 - DNA, 25 bp, Homo sapien
gtatcttgattctatgttgtctgga

SEQ ID NO: 102691 - DNA, 25 bp, Homo sapien
cttgattctatgttgtctggaaaaa

SEQ ID NO: 102692 - DNA, 25 bp, Homo sapien
ttgttaaatgtcagtttatccatct

SEQ ID NO: 102693 - DNA, 25 bp, Homo sapien
cagtttatccatcttatccttctca

SEQ ID NO: 102694 - DNA, 25 bp, Homo sapien
ccttctcagcaggtacctatatgat

SEQ ID NO: 102695 - DNA, 25 bp, Homo sapien
cagcaggtacctatatgataatata

SEQ ID NO: 102696 - DNA, 25 bp, Homo sapien
tatatagctgtgaaactcatctaaa

SEQ ID NO: 102697 - DNA, 25 bp, Homo sapien
ttctctttttcttataccttgtgaa

SEQ ID NO: 102698 - DNA, 25 bp, Homo sapien
tcttataccttgtgaatcatgtgcc

SEQ ID NO: 102699 - DNA, 25 bp, Homo sapien
aagttgctgcaaatgattaagaatc

SEQ ID NO: 102700 - DNA, 25 bp, Homo sapien
agaatcttcacaactatgttttctt

SEQ ID NO: 102701 - DNA, 25 bp, Homo sapien
gttttcttttcaatatactcatgat

SEQ ID NO: 102702 - DNA, 25 bp, Homo sapien
tactcatgattcttgtatcctgctt

SEQ ID NO: 102703 - DNA, 25 bp, Homo sapien
atgattcttgtatcctgcttccttc

SEQ ID NO: 102704 - DNA, 25 bp, Homo sapien
tgcttccttcttttaatgatcactt

SEQ ID NO: 102705 - DNA, 25 bp, Homo sapien
atcactttgggttatctccctataa

SEQ ID NO: 102706 - DNA, 25 bp, Homo sapien
gggttatctccctataaccagggat

SEQ ID NO: 102707 - DNA, 25 bp, Homo sapien
tataaccagggatcttacctatata

SEQ ID NO: 102708 - DNA, 25 bp, Homo sapien
acctctgtcattctgcacatcaagc

SEQ ID NO: 102709 - DNA, 25 bp, Homo sapien
acatcaagcagaacgtccccatcat

SEQ ID NO: 102710 - DNA, 25 bp, Homo sapien
atcatccgtgacaacctggcttcca

SEQ ID NO: 102711 - DNA, 25 bp, Homo sapien
acacgcaagtacttcactcagttct

SEQ ID NO: 102712 - DNA, 25 bp, Homo sapien
gtacttcactcagttctgcgttaaa

SEQ ID NO: 102713 - DNA, 25 bp, Homo sapien
aaatttgcaaactccttcattccca

SEQ ID NO: 102714 - DNA, 25 bp, Homo sapien
cacctcttcaagtgcaagccaatta

SEQ ID NO: 102715 - DNA, 25 bp, Homo sapien
tggacgtagtatcaggcatttgcct

SEQ ID NO: 102716 - DNA, 25 bp, Homo sapien
aagcacatattcttctagtccagat

SEQ ID NO: 102717 - DNA, 25 bp, Homo sapien
tagtccagatctacttggcaggaat

SEQ ID NO: 102718 - DNA, 25 bp, Homo sapien
aaattgatgatgtcccctgtttggg

SEQ ID NO: 102719 - DNA, 25 bp, Homo sapien
tttggtttaagaggcctgatggaag

SEQ ID NO: 102720 - DNA, 25 bp, Homo sapien
ggcctgatggaagcaaatctaagct

SEQ ID NO: 102721 - DNA, 25 bp, Homo sapien
aaatctaagctttacatttcacagc

SEQ ID NO: 102722 - DNA, 25 bp, Homo sapien
ttacatttcacagctacagaaagga

SEQ ID NO: 102723 - DNA, 25 bp, Homo sapien
gtgttatctaaatttaccttattag

SEQ ID NO: 102724 - DNA, 25 bp, Homo sapien
ttaccttattagtgttaccaaatgt

SEQ ID NO: 102725 - DNA, 25 bp, Homo sapien
taccaaatgtaagtgccatgagagt

SEQ ID NO: 102726 - DNA, 25 bp, Homo sapien
aacttaatattctcactgaatcatg

SEQ ID NO: 102727 - DNA, 25 bp, Homo sapien
gaatgtgtatttgtaggtagtactc

SEQ ID NO: 102728 - DNA, 25 bp, Homo sapien
ggtagtactctaaatagatctcatt

SEQ ID NO: 102729 - DNA, 25 bp, Homo sapien
ttacaacaattaaccatgatgaagt

SEQ ID NO: 102730 - DNA, 25 bp, Homo sapien
agagagggccaagactgcagacctt

SEQ ID NO: 102731 - DNA, 25 bp, Homo sapien
ggaacacctggctctgcaagttttg

SEQ ID NO: 102732 - DNA, 25 bp, Homo sapien
tgcaagttttgtgccttagcggaaa

SEQ ID NO: 102733 - DNA, 25 bp, Homo sapien
ccttagcggaaagaggcgacatctc

SEQ ID NO: 102734 - DNA, 25 bp, Homo sapien
aggcgacatctctggcaagttggga

SEQ ID NO: 102735 - DNA, 25 bp, Homo sapien
acatctctggcaagttgggagtaca

SEQ ID NO: 102736 - DNA, 25 bp, Homo sapien
aagtagcgaaggagtgccatctggt

SEQ ID NO: 102737 - DNA, 25 bp, Homo sapien
aggagtgccatctggtggatccttc

SEQ ID NO: 102738 - DNA, 25 bp, Homo sapien
tctggtggatccttctggtagtgac

SEQ ID NO: 102739 - DNA, 25 bp, Homo sapien
ttctggtagtgacactcagacctgg

SEQ ID NO: 102740 - DNA, 25 bp, Homo sapien
gggccttgagacaatttacttgact

SEQ ID NO: 102741 - DNA, 25 bp, Homo sapien
accctattccttgcctttgtaggag

SEQ ID NO: 102742 - DNA, 25 bp, Homo sapien
cctattccttgcctttgtaggagtc

SEQ ID NO: 102743 - DNA, 25 bp, Homo sapien
ctattccttgcctttgtaggagtca

SEQ ID NO: 102744 - DNA, 25 bp, Homo sapien
tattccttgcctttgtaggagtcaa

SEQ ID NO: 102745 - DNA, 25 bp, Homo sapien
attccttgcctttgtaggagtcaaa

SEQ ID NO: 102746 - DNA, 25 bp, Homo sapien
ttccttgcctttgtaggagtcaaaa

SEQ ID NO: 102747 - DNA, 25 bp, Homo sapien
tccttgcctttgtaggagtcaaaat

SEQ ID NO: 102748 - DNA, 25 bp, Homo sapien
ccttgcctttgtaggagtcaaaata

SEQ ID NO: 102749 - DNA, 25 bp, Homo sapien
ttgcctttgtaggagtcaaaataaa

SEQ ID NO: 102750 - DNA, 25 bp, Homo sapien
catgtgttctcattgctccaaaata

SEQ ID NO: 102751 - DNA, 25 bp, Homo sapien
atgtgttctcattgctccaaaataa

SEQ ID NO: 102752 - DNA, 25 bp, Homo sapien
accagttaatgttttgtagaccctg

SEQ ID NO: 102753 - DNA, 25 bp, Homo sapien
ccagttaatgttttgtagaccctgg

SEQ ID NO: 102754 - DNA, 25 bp, Homo sapien
cagttaatgttttgtagaccctggg

SEQ ID NO: 102755 - DNA, 25 bp, Homo sapien
tcagcaaagtaccaaaattttaaag

SEQ ID NO: 102756 - DNA, 25 bp, Homo sapien
gcaaagtaccaaaattttaaagcat

SEQ ID NO: 102757 - DNA, 25 bp, Homo sapien
ctgtggaatagctcaaaatgtccat

SEQ ID NO: 102758 - DNA, 25 bp, Homo sapien
tgtggaatagctcaaaatgtccatt

SEQ ID NO: 102759 - DNA, 25 bp, Homo sapien
ctgagcaaggaaacatggtttggat

SEQ ID NO: 102760 - DNA, 25 bp, Homo sapien
agcaaggaaacatggtttggattat

SEQ ID NO: 102761 - DNA, 25 bp, Homo sapien
gcaaggaaacatggtttggattata

SEQ ID NO: 102762 - DNA, 25 bp, Homo sapien
ggaaacatggtttggattataaaat

SEQ ID NO: 102763 - DNA, 25 bp, Homo sapien
ttcgcctcgggtttatttattgact

SEQ ID NO: 102764 - DNA, 25 bp, Homo sapien
gcctcgggtttatttattgactgtc

SEQ ID NO: 102765 - DNA, 25 bp, Homo sapien
ctcgggtttatttattgactgtctt

SEQ ID NO: 102766 - DNA, 25 bp, Homo sapien
tttccccctgtcctcgacagaagag

SEQ ID NO: 102767 - DNA, 25 bp, Homo sapien
gggaggtgagaagcccgtctcctca

SEQ ID NO: 102768 - DNA, 25 bp, Homo sapien
gtgagaagcccgtctcctcagtgag

SEQ ID NO: 102769 - DNA, 25 bp, Homo sapien
gaagcccgtctcctcagtgagccag

SEQ ID NO: 102770 - DNA, 25 bp, Homo sapien
gggccgcgcgcgctgtgtccagagt

SEQ ID NO: 102771 - DNA, 25 bp, Homo sapien
tgtccagagtcctcgggcctcctgg

SEQ ID NO: 102772 - DNA, 25 bp, Homo sapien
gcctcctgggtctgggacgtgcctc

SEQ ID NO: 102773 - DNA, 25 bp, Homo sapien
gacgtgcctctcctactgtgtagga

SEQ ID NO: 102774 - DNA, 25 bp, Homo sapien
tgcttgtcttactattcctgcttga

SEQ ID NO: 102775 - DNA, 25 bp, Homo sapien
gagatacactactttggtcagaaac

SEQ ID NO: 102776 - DNA, 25 bp, Homo sapien
aattttcaccatttcatgcttctgt

SEQ ID NO: 102777 - DNA, 25 bp, Homo sapien
ttcatgcttctgtgctggcctcttg

SEQ ID NO: 102778 - DNA, 25 bp, Homo sapien
tggcctcttgctcgtatgattttac

SEQ ID NO: 102779 - DNA, 25 bp, Homo sapien
gattctggaacttttcaaagcctga

SEQ ID NO: 102780 - DNA, 25 bp, Homo sapien
agcctgactctcttcttgaaacagt

SEQ ID NO: 102781 - DNA, 25 bp, Homo sapien
gtggagcatcatacagagtttactt

SEQ ID NO: 102782 - DNA, 25 bp, Homo sapien
ttagacttcagtcttcagagcccca

SEQ ID NO: 102783 - DNA, 25 bp, Homo sapien
ctcaggtggctgactgttcttggga

SEQ ID NO: 102784 - DNA, 25 bp, Homo sapien
aaagatctatgaccctgcttgtctt

SEQ ID NO: 102785 - DNA, 25 bp, Homo sapien
gtttattaactgtcttcagtcttgg

SEQ ID NO: 102786 - DNA, 25 bp, Homo sapien
tcttcagtcttggattacatcaagt

SEQ ID NO: 102787 - DNA, 25 bp, Homo sapien
gacactgtgaagtcagcgttaacca

SEQ ID NO: 102788 - DNA, 25 bp, Homo sapien
gcgttaaccatgtgcatacaactta

SEQ ID NO: 102789 - DNA, 25 bp, Homo sapien
ttcatgcttatatagtttcaacttt

SEQ ID NO: 102790 - DNA, 25 bp, Homo sapien
agtttcaacttttatcttcatagta

SEQ ID NO: 102791 - DNA, 25 bp, Homo sapien
gtaatttctcatctactcataatac

SEQ ID NO: 102792 - DNA, 25 bp, Homo sapien
aagtcatgctgttttgtgtgctctc

SEQ ID NO: 102793 - DNA, 25 bp, Homo sapien
tgtgctctcttgctaaagaccgcag

SEQ ID NO: 102794 - DNA, 25 bp, Homo sapien
aagaccgcagagaccatacctgttg

SEQ ID NO: 102795 - DNA, 25 bp, Homo sapien
gaccatacctgttgtcaaagagggt

SEQ ID NO: 102796 - DNA, 25 bp, Homo sapien
gcatatcatcaaggagtatgcagag

SEQ ID NO: 102797 - DNA, 25 bp, Homo sapien
tatgcagagaacatcggggacggcc

SEQ ID NO: 102798 - DNA, 25 bp, Homo sapien
atgcagagaacatcggggacggccg

SEQ ID NO: 102799 - DNA, 25 bp, Homo sapien
gagaacatcggggacggccggagcc

SEQ ID NO: 102800 - DNA, 25 bp, Homo sapien
gcaccttggccctgcgcatcatgga

SEQ ID NO: 102801 - DNA, 25 bp, Homo sapien
catcatggactctctcagcttccct

SEQ ID NO: 102802 - DNA, 25 bp, Homo sapien
atcatggactctctcagcttccctc

SEQ ID NO: 102803 - DNA, 25 bp, Homo sapien
ccctcccaggatcagtttctacaca

SEQ ID NO: 102804 - DNA, 25 bp, Homo sapien
aggaagcactgagattcgggtgcca

SEQ ID NO: 102805 - DNA, 25 bp, Homo sapien
aagcactgagattcgggtgccaggt

SEQ ID NO: 102806 - DNA, 25 bp, Homo sapien
gattcgggtgccaggtggccggcaa

SEQ ID NO: 102807 - DNA, 25 bp, Homo sapien
gccggcaagaagtgtggcctgcagg

SEQ ID NO: 102808 - DNA, 25 bp, Homo sapien
gcctgcagggctttgatggcatcgt

SEQ ID NO: 102809 - DNA, 25 bp, Homo sapien
gctttgatggcatcgtgtgagagca

SEQ ID NO: 102810 - DNA, 25 bp, Homo sapien
tgtgagagcaggtgccggctcctca

SEQ ID NO: 102811 - DNA, 25 bp, Homo sapien
cacaccatggagactaccattgcgg

SEQ ID NO: 102812 - DNA, 25 bp, Homo sapien
tggagactaccattgcggctgcatc

SEQ ID NO: 102813 - DNA, 25 bp, Homo sapien
taccattgcggctgcatcgccttct

SEQ ID NO: 102814 - DNA, 25 bp, Homo sapien
tggcgtccaggttgccctgttcagg

SEQ ID NO: 102815 - DNA, 25 bp, Homo sapien
gaggacacgcgcaggcccagggtca

SEQ ID NO: 102816 - DNA, 25 bp, Homo sapien
gggtcagggctgagcttccctccag

SEQ ID NO: 102817 - DNA, 25 bp, Homo sapien
gagcttccctccagtgcagtaacga

SEQ ID NO: 102818 - DNA, 25 bp, Homo sapien
ttccctccagtgcagtaacgaggat

SEQ ID NO: 102819 - DNA, 25 bp, Homo sapien
agtgcagtaacgaggattccgtcca

SEQ ID NO: 102820 - DNA, 25 bp, Homo sapien
agtaacgaggattccgtccaggctc

SEQ ID NO: 102821 - DNA, 25 bp, Homo sapien
aggattccgtccaggctcccatgag

SEQ ID NO: 102822 - DNA, 25 bp, Homo sapien
gggctgagacagagggcgttggcaa

SEQ ID NO: 102823 - DNA, 25 bp, Homo sapien
gacagagggcgttggcaaggatgct

SEQ ID NO: 102824 - DNA, 25 bp, Homo sapien
ttcaggctgtgacccctctgtcttt

SEQ ID NO: 102825 - DNA, 25 bp, Homo sapien
aggctgtgacccctctgtctttgca

SEQ ID NO: 102826 - DNA, 25 bp, Homo sapien
taatttttatttggaagggagcagt

SEQ ID NO: 102827 - DNA, 25 bp, Homo sapien
atttttatttggaagggagcagtat

SEQ ID NO: 102828 - DNA, 25 bp, Homo sapien
tatttggaagggagcagtataaagc

SEQ ID NO: 102829 - DNA, 25 bp, Homo sapien
aagggagcagtataaagcttatttg

SEQ ID NO: 102830 - DNA, 25 bp, Homo sapien
ggagcagtataaagcttatttgtat

SEQ ID NO: 102831 - DNA, 25 bp, Homo sapien
tatttagtagtgtatctcatagata

SEQ ID NO: 102832 - DNA, 25 bp, Homo sapien
tatctcatagatacagacaaggcaa

SEQ ID NO: 102833 - DNA, 25 bp, Homo sapien
catagatacagacaaggcaagagat

SEQ ID NO: 102834 - DNA, 25 bp, Homo sapien
caaggcaagagatgataagctgttt

SEQ ID NO: 102835 - DNA, 25 bp, Homo sapien
aaggcaagagatgataagctgttta

SEQ ID NO: 102836 - DNA, 25 bp, Homo sapien
gatactatatacgttttgtatatca

SEQ ID NO: 102837 - DNA, 25 bp, Homo sapien
attagcgtcacgtggcattttaagt

SEQ ID NO: 102838 - DNA, 25 bp, Homo sapien
ttaagtgaatactcccaacccttga

SEQ ID NO: 102839 - DNA, 25 bp, Homo sapien
aacccttgagctcatcacaatggca

SEQ ID NO: 102840 - DNA, 25 bp, Homo sapien
cacaatggcaacagaaggtggctac

SEQ ID NO: 102841 - DNA, 25 bp, Homo sapien
ggctacaaaattatcagtcgtacag

SEQ ID NO: 102842 - DNA, 25 bp, Homo sapien
aaattatcagtcgtacagtatgtac

SEQ ID NO: 102843 - DNA, 25 bp, Homo sapien
gatttcatactgcatctttatctgt

SEQ ID NO: 102844 - DNA, 25 bp, Homo sapien
tcatactgcatctttatctgtttac

SEQ ID NO: 102845 - DNA, 25 bp, Homo sapien
tctctggactgtgaatggcgtcacg

SEQ ID NO: 102846 - DNA, 25 bp, Homo sapien
atggcgtcacgtagtctgtgtgcaa

SEQ ID NO: 102847 - DNA, 25 bp, Homo sapien
gtcacgtagtctgtgtgcaaattgt

SEQ ID NO: 102848 - DNA, 25 bp, Homo sapien
tagctttgtgtttactttttggctg

SEQ ID NO: 102849 - DNA, 25 bp, Homo sapien
gtgtttactttttggctggagcgga

SEQ ID NO: 102850 - DNA, 25 bp, Homo sapien
ttactttttggctggagcggagatg

SEQ ID NO: 102851 - DNA, 25 bp, Homo sapien
tgttgtgttctgttgaaggtgccat

SEQ ID NO: 102852 - DNA, 25 bp, Homo sapien
gtgttctgttgaaggtgccatttta

SEQ ID NO: 102853 - DNA, 25 bp, Homo sapien
gttctgttgaaggtgccattttaaa

SEQ ID NO: 102854 - DNA, 25 bp, Homo sapien
ttttgtagatgaacttgagctctgt

SEQ ID NO: 102855 - DNA, 25 bp, Homo sapien
ttgagctctgtaacttacacctgga

SEQ ID NO: 102856 - DNA, 25 bp, Homo sapien
gagctctgtaacttacacctggaat

SEQ ID NO: 102857 - DNA, 25 bp, Homo sapien
tgtaacttacacctggaatgttagg

SEQ ID NO: 102858 - DNA, 25 bp, Homo sapien
gaatgttaggatcgtgcggccgcgg

SEQ ID NO: 102859 - DNA, 25 bp, Homo sapien
agtgactaccccaggtacctttgct

SEQ ID NO: 102860 - DNA, 25 bp, Homo sapien
caggtacctttgctgctgatttggg

SEQ ID NO: 102861 - DNA, 25 bp, Homo sapien
tgctgatttgggtgtcttgtttaaa

SEQ ID NO: 102862 - DNA, 25 bp, Homo sapien
aaatcaggtgggtgggaatctcttg

SEQ ID NO: 102863 - DNA, 25 bp, Homo sapien
tagagggagtatgcccaagtcttgg

SEQ ID NO: 102864 - DNA, 25 bp, Homo sapien
aagtcttggagtcttggttcctgtt

SEQ ID NO: 102865 - DNA, 25 bp, Homo sapien
agtcttggttcctgttcgcggtgtt

SEQ ID NO: 102866 - DNA, 25 bp, Homo sapien
tcctgttcgcggtgtttatgggtta

SEQ ID NO: 102867 - DNA, 25 bp, Homo sapien
gtttatgggttatttccctctccat

SEQ ID NO: 102868 - DNA, 25 bp, Homo sapien
tcccattcccagtgttcaaaatctc

SEQ ID NO: 102869 - DNA, 25 bp, Homo sapien
gtgttcaaaatctcagtgactaccc

SEQ ID NO: 102870 - DNA, 25 bp, Homo sapien
ggcaggaacatggatcctatctgga

SEQ ID NO: 102871 - DNA, 25 bp, Homo sapien
tggatcctatctggaggactggcca

SEQ ID NO: 102872 - DNA, 25 bp, Homo sapien
ggactggccagcatggcctgatcag

SEQ ID NO: 102873 - DNA, 25 bp, Homo sapien
ggatgtggccagagaaggcccaccc

SEQ ID NO: 102874 - DNA, 25 bp, Homo sapien
gcgagcagcgctttccttgcagaat

SEQ ID NO: 102875 - DNA, 25 bp, Homo sapien
tccttgcagaattcatggcagggag

SEQ ID NO: 102876 - DNA, 25 bp, Homo sapien
ggaccaaggccctgagctcgaacat

SEQ ID NO: 102877 - DNA, 25 bp, Homo sapien
ccctttggcagcaccgatggaggat

SEQ ID NO: 102878 - DNA, 25 bp, Homo sapien
gttacttcaatcaagaacctgtatt

SEQ ID NO: 102879 - DNA, 25 bp, Homo sapien
aacctgtattggttgaggtgacacc

SEQ ID NO: 102880 - DNA, 25 bp, Homo sapien
gaggtgacaccatctgttgtaacag

SEQ ID NO: 102881 - DNA, 25 bp, Homo sapien
aggatcctgggctcagaatctcgag

SEQ ID NO: 102882 - DNA, 25 bp, Homo sapien
ggctcagaatctcgagaaccgcctg

SEQ ID NO: 102883 - DNA, 25 bp, Homo sapien
gcctgctcctaacaattcagcaagt

SEQ ID NO: 102884 - DNA, 25 bp, Homo sapien
tgttagtccccaaatccttacttat

SEQ ID NO: 102885 - DNA, 25 bp, Homo sapien
tagaccctctctaaagactgttcca

SEQ ID NO: 102886 - DNA, 25 bp, Homo sapien
ttaacatgtcctgattctgcatccg

SEQ ID NO: 102887 - DNA, 25 bp, Homo sapien
attctgcatccgtgggttttgtgaa

SEQ ID NO: 102888 - DNA, 25 bp, Homo sapien
ttttgtgaaagagagctagctggcg

SEQ ID NO: 102889 - DNA, 25 bp, Homo sapien
agggaagtggcacctcactagcatt

SEQ ID NO: 102890 - DNA, 25 bp, Homo sapien
cactagcatttatcacttttttcct

SEQ ID NO: 102891 - DNA, 25 bp, Homo sapien
taaaaccagactctgttctgaaaat

SEQ ID NO: 102892 - DNA, 25 bp, Homo sapien
gcaagtctttggtctccctgagaag

SEQ ID NO: 102893 - DNA, 25 bp, Homo sapien
tttggtctccctgagaagccatgtc

SEQ ID NO: 102894 - DNA, 25 bp, Homo sapien
tgagaagccatgtccctcgtgctgt

SEQ ID NO: 102895 - DNA, 25 bp, Homo sapien
atgtccctcgtgctgtctcttgcct

SEQ ID NO: 102896 - DNA, 25 bp, Homo sapien
tgccctccagcttgtatttaagtcc

SEQ ID NO: 102897 - DNA, 25 bp, Homo sapien
agcttgtatttaagtccctgggctg

SEQ ID NO: 102898 - DNA, 25 bp, Homo sapien
tcccaggttcccctctggtgtcatg

SEQ ID NO: 102899 - DNA, 25 bp, Homo sapien
tggtgtcatgtcaggcattttgcaa

SEQ ID NO: 102900 - DNA, 25 bp, Homo sapien
ggcattttgcaaggaaaagccactt

SEQ ID NO: 102901 - DNA, 25 bp, Homo sapien
ataaatttccattggccctcgggtg

SEQ ID NO: 102902 - DNA, 25 bp, Homo sapien
ttccattggccctcgggtgagctga

SEQ ID NO: 102903 - DNA, 25 bp, Homo sapien
aggcagaggtcgcatcactgcaatc

SEQ ID NO: 102904 - DNA, 25 bp, Homo sapien
ggcagaggtcgcatcactgcaatcc

SEQ ID NO: 102905 - DNA, 25 bp, Homo sapien
gcagcccgtgcagtgcgtaagaatg

SEQ ID NO: 102906 - DNA, 25 bp, Homo sapien
cagcccgtgcagtgcgtaagaatgt

SEQ ID NO: 102907 - DNA, 25 bp, Homo sapien
agcccgtgcagtgcgtaagaatgtg

SEQ ID NO: 102908 - DNA, 25 bp, Homo sapien
cccgtgcagtgcgtaagaatgtggc

SEQ ID NO: 102909 - DNA, 25 bp, Homo sapien
ccgtgcagtgcgtaagaatgtggcc

SEQ ID NO: 102910 - DNA, 25 bp, Homo sapien
cagtgcgtaagaatgtggccgggta

SEQ ID NO: 102911 - DNA, 25 bp, Homo sapien
agtgcgtaagaatgtggccgggtac

SEQ ID NO: 102912 - DNA, 25 bp, Homo sapien
gtgcgtaagaatgtggccgggtaca

SEQ ID NO: 102913 - DNA, 25 bp, Homo sapien
gcgtaagaatgtggccgggtacagt

SEQ ID NO: 102914 - DNA, 25 bp, Homo sapien
gtttgccttttaggctgtcaaaaca

SEQ ID NO: 102915 - DNA, 25 bp, Homo sapien
gccttttaggctgtcaaaacaaaca

SEQ ID NO: 102916 - DNA, 25 bp, Homo sapien
accagaacctgggagatagcttctc

SEQ ID NO: 102917 - DNA, 25 bp, Homo sapien
aacctgggagatagcttctcagcaa

SEQ ID NO: 102918 - DNA, 25 bp, Homo sapien
tagcttctcagcaaggaaaagtcac

SEQ ID NO: 102919 - DNA, 25 bp, Homo sapien
taataatgcagggttgctcctcggg

SEQ ID NO: 102920 - DNA, 25 bp, Homo sapien
gtaaactcaataacattacttgtat

SEQ ID NO: 102921 - DNA, 25 bp, Homo sapien
tacttgtataatggtgctggccatg

SEQ ID NO: 102922 - DNA, 25 bp, Homo sapien
gtataatggtgctggccatgttgtt

SEQ ID NO: 102923 - DNA, 25 bp, Homo sapien
tgttgttttaatcagttgcctcttt

SEQ ID NO: 102924 - DNA, 25 bp, Homo sapien
tgttttaatcagttgcctcttttta

SEQ ID NO: 102925 - DNA, 25 bp, Homo sapien
tgccgatcgcctatgtgacagcaaa

SEQ ID NO: 102926 - DNA, 25 bp, Homo sapien
ctcatggagttagccaagagccagg

SEQ ID NO: 102927 - DNA, 25 bp, Homo sapien
gactctcaagatttatgaaggtgcc

SEQ ID NO: 102928 - DNA, 25 bp, Homo sapien
atgaaggtgcctaccatgttctcca

SEQ ID NO: 102929 - DNA, 25 bp, Homo sapien
atgttctccacaaggagcttcctga

SEQ ID NO: 102930 - DNA, 25 bp, Homo sapien
ttcctgaagtcaccaactccgtctt

SEQ ID NO: 102931 - DNA, 25 bp, Homo sapien
ccaactccgtcttccatgaaataaa

SEQ ID NO: 102932 - DNA, 25 bp, Homo sapien
ataaacatgtgggtctctcaaagga

SEQ ID NO: 102933 - DNA, 25 bp, Homo sapien
tctctcaaaggacagccacggcagg

SEQ ID NO: 102934 - DNA, 25 bp, Homo sapien
accctgaatgcattggccggtgccc

SEQ ID NO: 102935 - DNA, 25 bp, Homo sapien
gatggcttctcagatatggcttgca

SEQ ID NO: 102936 - DNA, 25 bp, Homo sapien
tttcagtttatcatcgttgactctt

SEQ ID NO: 102937 - DNA, 25 bp, Homo sapien
tatcatcgttgactctttgcaaagg

SEQ ID NO: 102938 - DNA, 25 bp, Homo sapien
agatgttttggattaaccggctgca

SEQ ID NO: 102939 - DNA, 25 bp, Homo sapien
ggattaaccggctgcagagggtcaa

SEQ ID NO: 102940 - DNA, 25 bp, Homo sapien
agagggtcaaggcttctgcttagtt

SEQ ID NO: 102941 - DNA, 25 bp, Homo sapien
gggtcaaggcttctgcttagttttt

SEQ ID NO: 102942 - DNA, 25 bp, Homo sapien
tagttttttctagttagtgtttgag

SEQ ID NO: 102943 - DNA, 25 bp, Homo sapien
tatacatttcttactgccgattgct

SEQ ID NO: 102944 - DNA, 25 bp, Homo sapien
tactgccgattgcttattacttaat

SEQ ID NO: 102945 - DNA, 25 bp, Homo sapien
tacttaattgttcatgttttcagag

SEQ ID NO: 102946 - DNA, 25 bp, Homo sapien
cagagttcttgcctattaaaatttt

SEQ ID NO: 102947 - DNA, 25 bp, Homo sapien
ttgaggctcggcttggctcaacatg

SEQ ID NO: 102948 - DNA, 25 bp, Homo sapien
cggcttggctcaacatggcttaaca

SEQ ID NO: 102949 - DNA, 25 bp, Homo sapien
acatggcttaacacagcgggtgcac

SEQ ID NO: 102950 - DNA, 25 bp, Homo sapien
cagcgggtgcactggcacccagaga

SEQ ID NO: 102951 - DNA, 25 bp, Homo sapien
aagagaaccagagctgtccttcttg

SEQ ID NO: 102952 - DNA, 25 bp, Homo sapien
cagagctgtccttcttgtaggtgga

SEQ ID NO: 102953 - DNA, 25 bp, Homo sapien
gggagccacagcacggctcgcactg

SEQ ID NO: 102954 - DNA, 25 bp, Homo sapien
agcacggctcgcactggtgcccaga

SEQ ID NO: 102955 - DNA, 25 bp, Homo sapien
cagaaagagtgaagctgttgaccct

SEQ ID NO: 102956 - DNA, 25 bp, Homo sapien
agagccccagcaaacagccgagata

SEQ ID NO: 102957 - DNA, 25 bp, Homo sapien
aacagccgagataaaggtgagcagt

SEQ ID NO: 102958 - DNA, 25 bp, Homo sapien
atctgctacatcatggccgagatct

SEQ ID NO: 102959 - DNA, 25 bp, Homo sapien
tcatggccgagatctgcaatgccaa

SEQ ID NO: 102960 - DNA, 25 bp, Homo sapien
cgagatctgcaatgccaatgtcccc

SEQ ID NO: 102961 - DNA, 25 bp, Homo sapien
cagattcgccagagggttcaccaga

SEQ ID NO: 102962 - DNA, 25 bp, Homo sapien
agattcgccagagggttcaccagat

SEQ ID NO: 102963 - DNA, 25 bp, Homo sapien
gggttcaccagatcctaaacatgcg

SEQ ID NO: 102964 - DNA, 25 bp, Homo sapien
taaacatgcgaggaagctccatcaa

SEQ ID NO: 102965 - DNA, 25 bp, Homo sapien
gaagctccatcaaaattgtcaggca

SEQ ID NO: 102966 - DNA, 25 bp, Homo sapien
tcccaggatcagtttctacacagct

SEQ ID NO: 102967 - DNA, 25 bp, Homo sapien
ggatcagtttctacacagctctgtg

SEQ ID NO: 102968 - DNA, 25 bp, Homo sapien
gtttctacacagctctgtgtggctt

SEQ ID NO: 102969 - DNA, 25 bp, Homo sapien
ttttcctaagtcatcaaaatgtata

SEQ ID NO: 102970 - DNA, 25 bp, Homo sapien
gataacagtcttgcatgtttatcat

SEQ ID NO: 102971 - DNA, 25 bp, Homo sapien
taacagtcttgcatgtttatcatgt

SEQ ID NO: 102972 - DNA, 25 bp, Homo sapien
atttaatattccatcctgcccaacc

SEQ ID NO: 102973 - DNA, 25 bp, Homo sapien
tttatgatgcattgcacaccctctg

SEQ ID NO: 102974 - DNA, 25 bp, Homo sapien
ttatgatgcattgcacaccctctgg

SEQ ID NO: 102975 - DNA, 25 bp, Homo sapien
tatgatgcattgcacaccctctggg

SEQ ID NO: 102976 - DNA, 25 bp, Homo sapien
tctggttggtgtcttacaagtgagc

SEQ ID NO: 102977 - DNA, 25 bp, Homo sapien
ctggttggtgtcttacaagtgagct

SEQ ID NO: 102978 - DNA, 25 bp, Homo sapien
agctgacaccattttttattctgtg

SEQ ID NO: 102979 - DNA, 25 bp, Homo sapien
gctgacaccattttttattctgtgt

SEQ ID NO: 102980 - DNA, 25 bp, Homo sapien
gtcttttgtgctacagtttcgtagc

SEQ ID NO: 102981 - DNA, 25 bp, Homo sapien
tacagtttcgtagcatgagtttaaa

SEQ ID NO: 102982 - DNA, 25 bp, Homo sapien
gatatccaggcttaccaaagtatta

SEQ ID NO: 102983 - DNA, 25 bp, Homo sapien
atatgtgatcagctttcaaagcatt

SEQ ID NO: 102984 - DNA, 25 bp, Homo sapien
caaagcatttacaagtgctgcaagt

SEQ ID NO: 102985 - DNA, 25 bp, Homo sapien
acaagtgctgcaagttagtgaaaca

SEQ ID NO: 102986 - DNA, 25 bp, Homo sapien
gttagtgaaacagctgtctccgtaa

SEQ ID NO: 102987 - DNA, 25 bp, Homo sapien
tgaaacagctgtctccgtaaatgga

SEQ ID NO: 102988 - DNA, 25 bp, Homo sapien
ggaatgcccttctggttctggcaca

SEQ ID NO: 102989 - DNA, 25 bp, Homo sapien
ttctggttctggcacattggaaagc

SEQ ID NO: 102990 - DNA, 25 bp, Homo sapien
ggcacattggaaagcacactcagaa

SEQ ID NO: 102991 - DNA, 25 bp, Homo sapien
gagcctccaggtgggcaagaccctt

SEQ ID NO: 102992 - DNA, 25 bp, Homo sapien
caggtgggcaagacccttggaaatt

SEQ ID NO: 102993 - DNA, 25 bp, Homo sapien
gcaagacccttggaaattgctgaag

SEQ ID NO: 102994 - DNA, 25 bp, Homo sapien
agcggaagaagtgtgtcatctgcca

SEQ ID NO: 102995 - DNA, 25 bp, Homo sapien
gtcatctgccaggaccagagcaaga

SEQ ID NO: 102996 - DNA, 25 bp, Homo sapien
gccaggaccagagcaagacagtgtt

SEQ ID NO: 102997 - DNA, 25 bp, Homo sapien
gcaagacagtgttgctcctgccctg

SEQ ID NO: 102998 - DNA, 25 bp, Homo sapien
gtgcctgtgccaggcctgcactgaa

SEQ ID NO: 102999 - DNA, 25 bp, Homo sapien
ccaggcctgcactgaaatcctgatg

SEQ ID NO: 103000 - DNA, 25 bp, Homo sapien
agaccctcaatgtctacctctgaag

SEQ ID NO: 103001 - DNA, 25 bp, Homo sapien
aatgtctacctctgaagcctccttc

SEQ ID NO: 103002 - DNA, 25 bp, Homo sapien
agactttatcttatttcctatatgt

SEQ ID NO: 103003 - DNA, 25 bp, Homo sapien
atatgtttgtggtttcagtcctgat

SEQ ID NO: 103004 - DNA, 25 bp, Homo sapien
atgtttgtggtttcagtcctgatgt

SEQ ID NO: 103005 - DNA, 25 bp, Homo sapien
ttgtggtttcagtcctgatgtataa

SEQ ID NO: 103006 - DNA, 25 bp, Homo sapien
cctgatgtataatttgaccctagtt

SEQ ID NO: 103007 - DNA, 25 bp, Homo sapien
gatgtataatttgaccctagttaga

SEQ ID NO: 103008 - DNA, 25 bp, Homo sapien
gaccctagttagaatggttatctga

SEQ ID NO: 103009 - DNA, 25 bp, Homo sapien
gaatggttatctgaggaagtggcct

SEQ ID NO: 103010 - DNA, 25 bp, Homo sapien
tgaggaagtggcctgtacgatttct

SEQ ID NO: 103011 - DNA, 25 bp, Homo sapien
gaagtggcctgtacgatttctgctt

SEQ ID NO: 103012 - DNA, 25 bp, Homo sapien
ggcctgtacgatttctgctttttta

SEQ ID NO: 103013 - DNA, 25 bp, Homo sapien
agctaatgtcaggaccctcagcggt

SEQ ID NO: 103014 - DNA, 25 bp, Homo sapien
gtcaggaccctcagcggtggagcct

SEQ ID NO: 103015 - DNA, 25 bp, Homo sapien
gggacccagctgctcttggacaagt

SEQ ID NO: 103016 - DNA, 25 bp, Homo sapien
agctgctcttggacaagtggctgag

SEQ ID NO: 103017 - DNA, 25 bp, Homo sapien
acaagtggctgagctcctatctggc

SEQ ID NO: 103018 - DNA, 25 bp, Homo sapien
ttgtgtgtatttctaactgattgta

SEQ ID NO: 103019 - DNA, 25 bp, Homo sapien
cctgttgtgagatgaacctcctgta

SEQ ID NO: 103020 - DNA, 25 bp, Homo sapien
gtgagatgaacctcctgtaacttct

SEQ ID NO: 103021 - DNA, 25 bp, Homo sapien
gaacctcctgtaacttctatctgtt

SEQ ID NO: 103022 - DNA, 25 bp, Homo sapien
tcctgtaacttctatctgttctttt

SEQ ID NO: 103023 - DNA, 25 bp, Homo sapien
tctgttcttttttgaggctcaggga

SEQ ID NO: 103024 - DNA, 25 bp, Homo sapien
tgggtgtgccccagaagtaagcttt

SEQ ID NO: 103025 - DNA, 25 bp, Homo sapien
ggtgtgccccagaagtaagctttgc

SEQ ID NO: 103026 - DNA, 25 bp, Homo sapien
tgccccagaagtaagctttgcatct

SEQ ID NO: 103027 - DNA, 25 bp, Homo sapien
ccccagaagtaagctttgcatctct

SEQ ID NO: 103028 - DNA, 25 bp, Homo sapien
tgccgccccaggaaggctcggaagc

SEQ ID NO: 103029 - DNA, 25 bp, Homo sapien
cagctccagtgggaccttgtaaaat

SEQ ID NO: 103030 - DNA, 25 bp, Homo sapien
ggaccttgtaaaatgctccctgtca

SEQ ID NO: 103031 - DNA, 25 bp, Homo sapien
gaccttgtaaaatgctccctgtcag

SEQ ID NO: 103032 - DNA, 25 bp, Homo sapien
cagtaagggagagttttgcctcctt

SEQ ID NO: 103033 - DNA, 25 bp, Homo sapien
tttgcctccttacacagtggccttt

SEQ ID NO: 103034 - DNA, 25 bp, Homo sapien
gcctccttacacagtggcctttgct

SEQ ID NO: 103035 - DNA, 25 bp, Homo sapien
agacagatccaaaccttggccctaa

SEQ ID NO: 103036 - DNA, 25 bp, Homo sapien
accttggccctaaaaaatgtgtgct

SEQ ID NO: 103037 - DNA, 25 bp, Homo sapien
aaacttttcattcaatctgatgcta

SEQ ID NO: 103038 - DNA, 25 bp, Homo sapien
ctgatgctatttacaccatgctgtg

SEQ ID NO: 103039 - DNA, 25 bp, Homo sapien
agtcacaccaataaataaccttcat

SEQ ID NO: 103040 - DNA, 25 bp, Homo sapien
ttgatttaccttaagagttgtgtga

SEQ ID NO: 103041 - DNA, 25 bp, Homo sapien
agttgtgtgatcatctactcttgct

SEQ ID NO: 103042 - DNA, 25 bp, Homo sapien
gatcatctactcttgctgagcaagt

SEQ ID NO: 103043 - DNA, 25 bp, Homo sapien
aagttcaaaggctggcatgcttgga

SEQ ID NO: 103044 - DNA, 25 bp, Homo sapien
gatggctctgatatttaagtgctgc

SEQ ID NO: 103045 - DNA, 25 bp, Homo sapien
atatttaagtgctgccaagtggcta

SEQ ID NO: 103046 - DNA, 25 bp, Homo sapien
ccccgctggaacagggtgcgcatgc

SEQ ID NO: 103047 - DNA, 25 bp, Homo sapien
cccttctgagggacaatgtctgcta

SEQ ID NO: 103048 - DNA, 25 bp, Homo sapien
agggacaatgtctgctactcaagaa

SEQ ID NO: 103049 - DNA, 25 bp, Homo sapien
gtctgctactcaagaacaccttgga

SEQ ID NO: 103050 - DNA, 25 bp, Homo sapien
acaccttggaagctgtatcactgac

SEQ ID NO: 103051 - DNA, 25 bp, Homo sapien
cagtgcttccagagttcctcctgca

SEQ ID NO: 103052 - DNA, 25 bp, Homo sapien
gagtaggaggcccactcacaagccc

SEQ ID NO: 103053 - DNA, 25 bp, Homo sapien
tggtccctccaacatgcatggacag

SEQ ID NO: 103054 - DNA, 25 bp, Homo sapien
gggacagtgggactaacttcagtac

SEQ ID NO: 103055 - DNA, 25 bp, Homo sapien
gactaacttcagtacccttggcctg

SEQ ID NO: 103056 - DNA, 25 bp, Homo sapien
ttggcctgcacagtagcaatgctgg

SEQ ID NO: 103057 - DNA, 25 bp, Homo sapien
aagcggcagcagagacgtcgctgga

SEQ ID NO: 103058 - DNA, 25 bp, Homo sapien
ggaacatggccctggctatcttcat

SEQ ID NO: 103059 - DNA, 25 bp, Homo sapien
tggctatcttcatcccggtcctcat

SEQ ID NO: 103060 - DNA, 25 bp, Homo sapien
catcatctccttactgctgggagga

SEQ ID NO: 103061 - DNA, 25 bp, Homo sapien
tactgctgggaggagcctacattta

SEQ ID NO: 103062 - DNA, 25 bp, Homo sapien
gggaggagcctacatttacatcaca

SEQ ID NO: 103063 - DNA, 25 bp, Homo sapien
atcacaagatgtcgctactattcca

SEQ ID NO: 103064 - DNA, 25 bp, Homo sapien
aagatgtcgctactattccaacctc

SEQ ID NO: 103065 - DNA, 25 bp, Homo sapien
tacagccagatcaccgtggaaaccg

SEQ ID NO: 103066 - DNA, 25 bp, Homo sapien
tggaaaccgagtttgacaaccccat

SEQ ID NO: 103067 - DNA, 25 bp, Homo sapien
ttgacaaccccatttacgagacagg

SEQ ID NO: 103068 - DNA, 25 bp, Homo sapien
tacaatagtgtctcaggaggaggac

SEQ ID NO: 103069 - DNA, 25 bp, Homo sapien
gatgggcccgctagaaggagttcct

SEQ ID NO: 103070 - DNA, 25 bp, Homo sapien
gggcccgctagaaggagttcctcta

SEQ ID NO: 103071 - DNA, 25 bp, Homo sapien
ctagaagctgtggagtcggtcgtca

SEQ ID NO: 103072 - DNA, 25 bp, Homo sapien
tcggtcgtcaccgtggagccagagc

SEQ ID NO: 103073 - DNA, 25 bp, Homo sapien
gccagagccctcacagtgaagtgga

SEQ ID NO: 103074 - DNA, 25 bp, Homo sapien
gccctcacagtgaagtggagtcaga

SEQ ID NO: 103075 - DNA, 25 bp, Homo sapien
ggagtcagatcctagattcgtctga

SEQ ID NO: 103076 - DNA, 25 bp, Homo sapien
agattcgtctgattttatccagaga

SEQ ID NO: 103077 - DNA, 25 bp, Homo sapien
gtctatggcaagcaatgtatatttt

SEQ ID NO: 103078 - DNA, 25 bp, Homo sapien
tattgcacagatgaaccttttattt

SEQ ID NO: 103079 - DNA, 25 bp, Homo sapien
ttgctttctccaagcttggaactgt

SEQ ID NO: 103080 - DNA, 25 bp, Homo sapien
ctccaagcttggaactgttttgaaa

SEQ ID NO: 103081 - DNA, 25 bp, Homo sapien
ggaactgttttgaaagataacacag

SEQ ID NO: 103082 - DNA, 25 bp, Homo sapien
aaagggagagccacctggtacttgt

SEQ ID NO: 103083 - DNA, 25 bp, Homo sapien
agggagagccacctggtacttgtcc

SEQ ID NO: 103084 - DNA, 25 bp, Homo sapien
ggagagccacctggtacttgtccac

SEQ ID NO: 103085 - DNA, 25 bp, Homo sapien
tgcctcctctgttctgaaattccat

SEQ ID NO: 103086 - DNA, 25 bp, Homo sapien
ctcagcttaggggaatgcacctttt

SEQ ID NO: 103087 - DNA, 25 bp, Homo sapien
tttgcatgtttttactgatcattcg

SEQ ID NO: 103088 - DNA, 25 bp, Homo sapien
gcatgtttttactgatcattcgata

SEQ ID NO: 103089 - DNA, 25 bp, Homo sapien
ttactgatcattcgatatgctaacc

SEQ ID NO: 103090 - DNA, 25 bp, Homo sapien
agcagcatcctctttgtaatcacag

SEQ ID NO: 103091 - DNA, 25 bp, Homo sapien
aatcacagggcagggatcagagttt

SEQ ID NO: 103092 - DNA, 25 bp, Homo sapien
gaaaaattttggtgagttctgcaca

SEQ ID NO: 103093 - DNA, 25 bp, Homo sapien
atttcccctggttcaggctgggcat

SEQ ID NO: 103094 - DNA, 25 bp, Homo sapien
tgggcatggaccagccttcagatgg

SEQ ID NO: 103095 - DNA, 25 bp, Homo sapien
ggaccagccttcagatggcagaagt

SEQ ID NO: 103096 - DNA, 25 bp, Homo sapien
ggcagaagtggaagatgagcctact

SEQ ID NO: 103097 - DNA, 25 bp, Homo sapien
agcctacttgtgagcgatgtgactt

SEQ ID NO: 103098 - DNA, 25 bp, Homo sapien
tataagacatttaagaggccctttt

SEQ ID NO: 103099 - DNA, 25 bp, Homo sapien
ggccctttttcatatactgactcac

SEQ ID NO: 103100 - DNA, 25 bp, Homo sapien
gactcactgatgaatcagcatttgc

SEQ ID NO: 103101 - DNA, 25 bp, Homo sapien
tcatcatccccagccttgatggagg

SEQ ID NO: 103102 - DNA, 25 bp, Homo sapien
tccccagccttgatggaggagggag

SEQ ID NO: 103103 - DNA, 25 bp, Homo sapien
atggaggagggagggcttcaggacg

SEQ ID NO: 103104 - DNA, 25 bp, Homo sapien
gggagggcttcaggacggggcgtca

SEQ ID NO: 103105 - DNA, 25 bp, Homo sapien
ggagtcggaggctccccggcagaca

SEQ ID NO: 103106 - DNA, 25 bp, Homo sapien
gagtcggaggctccccggcagacac

SEQ ID NO: 103107 - DNA, 25 bp, Homo sapien
cttgttcccttgaggtgcctcctct

SEQ ID NO: 103108 - DNA, 25 bp, Homo sapien
ttgttcccttgaggtgcctcctctc

SEQ ID NO: 103109 - DNA, 25 bp, Homo sapien
gtgtggacagtatctggaagttctg

SEQ ID NO: 103110 - DNA, 25 bp, Homo sapien
tgtggacagtatctggaagttctgg

SEQ ID NO: 103111 - DNA, 25 bp, Homo sapien
ctggaagttctgggattcaggttgt

SEQ ID NO: 103112 - DNA, 25 bp, Homo sapien
ttcacagacactgaggacacgcgca

SEQ ID NO: 103113 - DNA, 25 bp, Homo sapien
gaggacacgcgcaggcccagggtca

SEQ ID NO: 103114 - DNA, 25 bp, Homo sapien
gggtcagggctgagcttccctccag

SEQ ID NO: 103115 - DNA, 25 bp, Homo sapien
gagcttccctccagtgcagtaacga

SEQ ID NO: 103116 - DNA, 25 bp, Homo sapien
agtgcagtaacgaggattccgtcca

SEQ ID NO: 103117 - DNA, 25 bp, Homo sapien
agtaacgaggattccgtccaggctc

SEQ ID NO: 103118 - DNA, 25 bp, Homo sapien
aggattccgtccaggctcccatgag

SEQ ID NO: 103119 - DNA, 25 bp, Homo sapien
gggctgagacagagggcgttggcaa

SEQ ID NO: 103120 - DNA, 25 bp, Homo sapien
gttggcaaggatgctgctcttcagg

SEQ ID NO: 103121 - DNA, 25 bp, Homo sapien
ttcaggctgtgacccctctgtcttt

SEQ ID NO: 103122 - DNA, 25 bp, Homo sapien
aggctgtgacccctctgtctttgca

SEQ ID NO: 103123 - DNA, 25 bp, Homo sapien
gtggtacgtctactgtaaaacccat

SEQ ID NO: 103124 - DNA, 25 bp, Homo sapien
tgtaaaacccatccgaggcacaagc

SEQ ID NO: 103125 - DNA, 25 bp, Homo sapien
aaacccatccgaggcacaagcagag

SEQ ID NO: 103126 - DNA, 25 bp, Homo sapien
agagtcacgcacatactcgtcatcg

SEQ ID NO: 103127 - DNA, 25 bp, Homo sapien
acatactcgtcatcgcatcacttgg

SEQ ID NO: 103128 - DNA, 25 bp, Homo sapien
tcgtcatcgcatcacttgggagaat

SEQ ID NO: 103129 - DNA, 25 bp, Homo sapien
ctaaaagttacccatcacgtttcag

SEQ ID NO: 103130 - DNA, 25 bp, Homo sapien
aagttacccatcacgtttcagtgta

SEQ ID NO: 103131 - DNA, 25 bp, Homo sapien
tacccatcacgtttcagtgtaaatg

SEQ ID NO: 103132 - DNA, 25 bp, Homo sapien
agacattgcgttatcttatttccaa

SEQ ID NO: 103133 - DNA, 25 bp, Homo sapien
tgcgttatcttatttccaaaacgtt

SEQ ID NO: 103134 - DNA, 25 bp, Homo sapien
taaacctgtgcattgatatgatcac

SEQ ID NO: 103135 - DNA, 25 bp, Homo sapien
aacagaaactctcatacgccattat

SEQ ID NO: 103136 - DNA, 25 bp, Homo sapien
tctcatacgccattattacaagtgt

SEQ ID NO: 103137 - DNA, 25 bp, Homo sapien
tacaagtgtaaattggttcaacctt

SEQ ID NO: 103138 - DNA, 25 bp, Homo sapien
tggttcaaccttttcgtcttaattg

SEQ ID NO: 103139 - DNA, 25 bp, Homo sapien
ttcgtcttaattgacacattgtaat

SEQ ID NO: 103140 - DNA, 25 bp, Homo sapien
atatttatggaagcacagtttgata

SEQ ID NO: 103141 - DNA, 25 bp, Homo sapien
catacatggtatataacgatcaaat

SEQ ID NO: 103142 - DNA, 25 bp, Homo sapien
ggatatttaatgtacccatcatctc

SEQ ID NO: 103143 - DNA, 25 bp, Homo sapien
atgtacccatcatctcatgcattta

SEQ ID NO: 103144 - DNA, 25 bp, Homo sapien
gtacccatcatctcatgcatttatc

SEQ ID NO: 103145 - DNA, 25 bp, Homo sapien
caaggaagtccttggcctaaagcct

SEQ ID NO: 103146 - DNA, 25 bp, Homo sapien
gaagtccttggcctaaagccttggt

SEQ ID NO: 103147 - DNA, 25 bp, Homo sapien
tggcctaaagccttggttctcaaac

SEQ ID NO: 103148 - DNA, 25 bp, Homo sapien
taaagccttggttctcaaactgggt

SEQ ID NO: 103149 - DNA, 25 bp, Homo sapien
ttggttctcaaactgggttccttgg

SEQ ID NO: 103150 - DNA, 25 bp, Homo sapien
tctcaaactgggttccttgggacct

SEQ ID NO: 103151 - DNA, 25 bp, Homo sapien
gttccaggaggcacgtagggtacct

SEQ ID NO: 103152 - DNA, 25 bp, Homo sapien
cgtagggtaccttgcagggtcctag

SEQ ID NO: 103153 - DNA, 25 bp, Homo sapien
gagggatcccaggaactgtgggcac

SEQ ID NO: 103154 - DNA, 25 bp, Homo sapien
tgtgggcacccattttctgtgtctc

SEQ ID NO: 103155 - DNA, 25 bp, Homo sapien
ccactcctagtttgtcatggataat

SEQ ID NO: 103156 - DNA, 25 bp, Homo sapien
gaaaatatctcagtcttttggtctg

SEQ ID NO: 103157 - DNA, 25 bp, Homo sapien
aatatctcagtcttttggtctgaat

SEQ ID NO: 103158 - DNA, 25 bp, Homo sapien
tcttttggtctgaatttgttttcct

SEQ ID NO: 103159 - DNA, 25 bp, Homo sapien
tcctttggttagattcttaaagtag

SEQ ID NO: 103160 - DNA, 25 bp, Homo sapien
gagataaagaataaccctgtccaaa

SEQ ID NO: 103161 - DNA, 25 bp, Homo sapien
aaccaaagggacagattttgacagc

SEQ ID NO: 103162 - DNA, 25 bp, Homo sapien
agcagtcttcattgttgttccatat

SEQ ID NO: 103163 - DNA, 25 bp, Homo sapien
gtcttcattgttgttccatatgagt

SEQ ID NO: 103164 - DNA, 25 bp, Homo sapien
tgttgttccatatgagtgttttcta

SEQ ID NO: 103165 - DNA, 25 bp, Homo sapien
gttccatatgagtgttttctaaacc

SEQ ID NO: 103166 - DNA, 25 bp, Homo sapien
gagtgttttctaaacctaacagatg

SEQ ID NO: 103167 - DNA, 25 bp, Homo sapien
atttatgcctttggccatagacagg

SEQ ID NO: 103168 - DNA, 25 bp, Homo sapien
atgcctttggccatagacaggactg

SEQ ID NO: 103169 - DNA, 25 bp, Homo sapien
ggccatagacaggactggaatccca

SEQ ID NO: 103170 - DNA, 25 bp, Homo sapien
atcgagttctgggagtaaggccacc

SEQ ID NO: 103171 - DNA, 25 bp, Homo sapien
gttctgggagtaaggccacctcatt

SEQ ID NO: 103172 - DNA, 25 bp, Homo sapien
gagtaaggccacctcattgaagcaa

SEQ ID NO: 103173 - DNA, 25 bp, Homo sapien
aaggccacctcattgaagcaaggag

SEQ ID NO: 103174 - DNA, 25 bp, Homo sapien
ggcagagaggatggcccacttcctt

SEQ ID NO: 103175 - DNA, 25 bp, Homo sapien
gagaggatggcccacttccttatct

SEQ ID NO: 103176 - DNA, 25 bp, Homo sapien
aggatggcccacttccttatctcct

SEQ ID NO: 103177 - DNA, 25 bp, Homo sapien
ggatacaggagccactgtcttcggg

SEQ ID NO: 103178 - DNA, 25 bp, Homo sapien
ggactccactcttcgcttatgtttg

SEQ ID NO: 103179 - DNA, 25 bp, Homo sapien
cactcttcgcttatgtttgcttttt

SEQ ID NO: 103180 - DNA, 25 bp, Homo sapien
ttccaacctgtacccacgcttcaaa

SEQ ID NO: 103181 - DNA, 25 bp, Homo sapien
acgcttcaaaatccctgctccagtc

SEQ ID NO: 103182 - DNA, 25 bp, Homo sapien
ctgagctcattctcaggccacactg

SEQ ID NO: 103183 - DNA, 25 bp, Homo sapien
gagctcattctcaggccacactgca

SEQ ID NO: 103184 - DNA, 25 bp, Homo sapien
aaaaagactgtgaatccactccacc

SEQ ID NO: 103185 - DNA, 25 bp, Homo sapien
aaagactgtgaatccactccaccca

SEQ ID NO: 103186 - DNA, 25 bp, Homo sapien
acccacgccttgtgttgcatgctgg

SEQ ID NO: 103187 - DNA, 25 bp, Homo sapien
acgccttgtgttgcatgctgggcat

SEQ ID NO: 103188 - DNA, 25 bp, Homo sapien
gcatgctgggcatgccgttccctgc

SEQ ID NO: 103189 - DNA, 25 bp, Homo sapien
agatgggcactgtggccgcccatgt

SEQ ID NO: 103190 - DNA, 25 bp, Homo sapien
ggccgcccatgtgccttatggtgtg

SEQ ID NO: 103191 - DNA, 25 bp, Homo sapien
ttatggtgtggcacagacaccccgg

SEQ ID NO: 103192 - DNA, 25 bp, Homo sapien
tggagtgcccaattcgtacctactt

SEQ ID NO: 103193 - DNA, 25 bp, Homo sapien
gtacctacttggtgacagcacgcag

SEQ ID NO: 103194 - DNA, 25 bp, Homo sapien
agcacgcagtgcagccagttccggg

SEQ ID NO: 103195 - DNA, 25 bp, Homo sapien
gggctctcaagaccctgcgcagctg

SEQ ID NO: 103196 - DNA, 25 bp, Homo sapien
gagacagatgaagccttgttccttg

SEQ ID NO: 103197 - DNA, 25 bp, Homo sapien
ttgttccttgctggagcgcccaagg

SEQ ID NO: 103198 - DNA, 25 bp, Homo sapien
agaagatccgcccacacatcttctt

SEQ ID NO: 103199 - DNA, 25 bp, Homo sapien
gatgaccagatgttccatgtggctg

SEQ ID NO: 103200 - DNA, 25 bp, Homo sapien
gaccaagatctgagagattcaaggc

SEQ ID NO: 103201 - DNA, 25 bp, Homo sapien
agagattcaaggcaacaagcagcac

SEQ ID NO: 103202 - DNA, 25 bp, Homo sapien
acaagcagcacaagccttcatacat

SEQ ID NO: 103203 - DNA, 25 bp, Homo sapien
gcacaagccttcatacataattcat

SEQ ID NO: 103204 - DNA, 25 bp, Homo sapien
gtaaataagttcctgtctcttgcca

SEQ ID NO: 103205 - DNA, 25 bp, Homo sapien
aagttcctgtctcttgccaacaaga

SEQ ID NO: 103206 - DNA, 25 bp, Homo sapien
cttgccaacaagaggttaccagtga

SEQ ID NO: 103207 - DNA, 25 bp, Homo sapien
ttaccagtgaaaagagctgctgtcc

SEQ ID NO: 103208 - DNA, 25 bp, Homo sapien
aagagctgctgtccagtttttgaat

SEQ ID NO: 103209 - DNA, 25 bp, Homo sapien
gctgctgtccagtttttgaataatg

SEQ ID NO: 103210 - DNA, 25 bp, Homo sapien
gctgtccagtttttgaataatgctt

SEQ ID NO: 103211 - DNA, 25 bp, Homo sapien
agggcaacggcagctatgggacccc

SEQ ID NO: 103212 - DNA, 25 bp, Homo sapien
gcaacggcagctatgggaccccaca

SEQ ID NO: 103213 - DNA, 25 bp, Homo sapien
tatgggaccccacacatacagggaa

SEQ ID NO: 103214 - DNA, 25 bp, Homo sapien
atacagggaagccccgtcttcgtgg

SEQ ID NO: 103215 - DNA, 25 bp, Homo sapien
gtggagcccatgagcaactccgggc

SEQ ID NO: 103216 - DNA, 25 bp, Homo sapien
gagcccatgagcaactccgggccag

SEQ ID NO: 103217 - DNA, 25 bp, Homo sapien
ggccagccctctttggtctaactca

SEQ ID NO: 103218 - DNA, 25 bp, Homo sapien
tgcctcgggcgccatggactatggg

SEQ ID NO: 103219 - DNA, 25 bp, Homo sapien
ccaccatccttctcagggaagaatt

SEQ ID NO: 103220 - DNA, 25 bp, Homo sapien
gaagaattcaggaagcacccaagct

SEQ ID NO: 103221 - DNA, 25 bp, Homo sapien
aattcaggaagcacccaagctcacc

SEQ ID NO: 103222 - DNA, 25 bp, Homo sapien
ccctcctacccagtggtgccagaat

SEQ ID NO: 103223 - DNA, 25 bp, Homo sapien
ccacaggaccagagaagcatcagga

SEQ ID NO: 103224 - DNA, 25 bp, Homo sapien
ggaccagagaagcatcaggagccca

SEQ ID NO: 103225 - DNA, 25 bp, Homo sapien
ccagagaagcatcaggagcccagct

SEQ ID NO: 103226 - DNA, 25 bp, Homo sapien
gcagggaggccatgtgctcagcctg

SEQ ID NO: 103227 - DNA, 25 bp, Homo sapien
agcctggccacgttgccgttacagt

SEQ ID NO: 103228 - DNA, 25 bp, Homo sapien
ggccacgttgccgttacagtctgct

SEQ ID NO: 103229 - DNA, 25 bp, Homo sapien
cagccaggcagggtcgtgtgtgggt

SEQ ID NO: 103230 - DNA, 25 bp, Homo sapien
tgctgccctgactttggcatatgcc

SEQ ID NO: 103231 - DNA, 25 bp, Homo sapien
tgccctgactttggcatatgccagc

SEQ ID NO: 103232 - DNA, 25 bp, Homo sapien
gactttggcatatgccagcctgttc

SEQ ID NO: 103233 - DNA, 25 bp, Homo sapien
gaggttcatagtgtggcctgacata

SEQ ID NO: 103234 - DNA, 25 bp, Homo sapien
gacatagtctaagggttctctcctg

SEQ ID NO: 103235 - DNA, 25 bp, Homo sapien
ggttctctcctgtagtatgcatctc

SEQ ID NO: 103236 - DNA, 25 bp, Homo sapien
gtatgcatctcctgcaggcaagtat

SEQ ID NO: 103237 - DNA, 25 bp, Homo sapien
gaaggacagtacactatccaggatt

SEQ ID NO: 103238 - DNA, 25 bp, Homo sapien
atccaggattcatttattgttcagg

SEQ ID NO: 103239 - DNA, 25 bp, Homo sapien
attgttcaggtgtcttttctaaagt

SEQ ID NO: 103240 - DNA, 25 bp, Homo sapien
aactacaggtcagtggtgtctttct

SEQ ID NO: 103241 - DNA, 25 bp, Homo sapien
gtcagtggtgtctttcttatctatt

SEQ ID NO: 103242 - DNA, 25 bp, Homo sapien
attatcacaaacatcccagttgcct

SEQ ID NO: 103243 - DNA, 25 bp, Homo sapien
cccagttgcctccatctaaaaattt

SEQ ID NO: 103244 - DNA, 25 bp, Homo sapien
cccgagcctcctcgacgagcgccac

SEQ ID NO: 103245 - DNA, 25 bp, Homo sapien
cgagcctcctcgacgagcgccaccc

SEQ ID NO: 103246 - DNA, 25 bp, Homo sapien
gcacccagtcccatcagccctcact

SEQ ID NO: 103247 - DNA, 25 bp, Homo sapien
ccagtcccatcagccctcactcact

SEQ ID NO: 103248 - DNA, 25 bp, Homo sapien
ctcactcactcttggcacctcctct

SEQ ID NO: 103249 - DNA, 25 bp, Homo sapien
tgcccgggctcccactttggtggca

SEQ ID NO: 103250 - DNA, 25 bp, Homo sapien
ctttggtggcacttgaggagcgctt

SEQ ID NO: 103251 - DNA, 25 bp, Homo sapien
tttggtggcacttgaggagcgcttc

SEQ ID NO: 103252 - DNA, 25 bp, Homo sapien
ttggtggcacttgaggagcgcttca

SEQ ID NO: 103253 - DNA, 25 bp, Homo sapien
acttgaggagcgcttcagcccaccg

SEQ ID NO: 103254 - DNA, 25 bp, Homo sapien
cggctccctcagcttccacactgtg

SEQ ID NO: 103255 - DNA, 25 bp, Homo sapien
aagcccaagagatccaacaattgaa

SEQ ID NO: 103256 - DNA, 25 bp, Homo sapien
tgaaacgaaaagaaaagtccacaga

SEQ ID NO: 103257 - DNA, 25 bp, Homo sapien
tccacagaaacatccgatcaagaac

SEQ ID NO: 103258 - DNA, 25 bp, Homo sapien
gaaacatccgatcaagaacctgggc

SEQ ID NO: 103259 - DNA, 25 bp, Homo sapien
acatccgatcaagaacctgggctat

SEQ ID NO: 103260 - DNA, 25 bp, Homo sapien
atccgatcaagaacctgggctatga

SEQ ID NO: 103261 - DNA, 25 bp, Homo sapien
gatcaagaacctgggctatgaattt

SEQ ID NO: 103262 - DNA, 25 bp, Homo sapien
aagaacctgggctatgaatttccaa

SEQ ID NO: 103263 - DNA, 25 bp, Homo sapien
gaacctgggctatgaatttccaatc

SEQ ID NO: 103264 - DNA, 25 bp, Homo sapien
ctgggctatgaatttccaatcttca

SEQ ID NO: 103265 - DNA, 25 bp, Homo sapien
caatcttcaacaacctgttaggaaa

SEQ ID NO: 103266 - DNA, 25 bp, Homo sapien
tactgttcatggcaggtacgctgga

SEQ ID NO: 103267 - DNA, 25 bp, Homo sapien
tcatggcaggtacgctggagtaaat

SEQ ID NO: 103268 - DNA, 25 bp, Homo sapien
gtaaatgaaatatcaggacctcccc

SEQ ID NO: 103269 - DNA, 25 bp, Homo sapien
ttattccaccattgaaagtctctgt

SEQ ID NO: 103270 - DNA, 25 bp, Homo sapien
gtctctgtgatatacgtcttgatgt

SEQ ID NO: 103271 - DNA, 25 bp, Homo sapien
gtttgttctttgacaaaacacttca

SEQ ID NO: 103272 - DNA, 25 bp, Homo sapien
aaaacacttcatttatcactcagtt

SEQ ID NO: 103273 - DNA, 25 bp, Homo sapien
tcactcagtttagttacctgttaaa

SEQ ID NO: 103274 - DNA, 25 bp, Homo sapien
caatgttttaatatcagtgctatga

SEQ ID NO: 103275 - DNA, 25 bp, Homo sapien
cagtgctatgaattccacaaaccca

SEQ ID NO: 103276 - DNA, 25 bp, Homo sapien
gaattccacaaacccaattaaatga

SEQ ID NO: 103277 - DNA, 25 bp, Homo sapien
cgcggtgcgcaggagggaggccttc

SEQ ID NO: 103278 - DNA, 25 bp, Homo sapien
gccttcgaggccataaaggcggccg

SEQ ID NO: 103279 - DNA, 25 bp, Homo sapien
ttcgaggccataaaggcggccgcca

SEQ ID NO: 103280 - DNA, 25 bp, Homo sapien
taaaggcggccgccacttccaagtt

SEQ ID NO: 103281 - DNA, 25 bp, Homo sapien
aagttccccccgcatagattcattg

SEQ ID NO: 103282 - DNA, 25 bp, Homo sapien
catagattcattgcggaccagctcg

SEQ ID NO: 103283 - DNA, 25 bp, Homo sapien
attcattgcggaccagctcgaccat

SEQ ID NO: 103284 - DNA, 25 bp, Homo sapien
gaccagctcgaccatctcaatgtca

SEQ ID NO: 103285 - DNA, 25 bp, Homo sapien
gcattcccggccgtcagtggatcgg

SEQ ID NO: 103286 - DNA, 25 bp, Homo sapien
ttcccggccgtcagtggatcgggaa

SEQ ID NO: 103287 - DNA, 25 bp, Homo sapien
agtggatcgggaagcaccggcggcc

SEQ ID NO: 103288 - DNA, 25 bp, Homo sapien
atgatactgattagactttgagcca

SEQ ID NO: 103289 - DNA, 25 bp, Homo sapien
ggcaaactccgggacttctaaagat

SEQ ID NO: 103290 - DNA, 25 bp, Homo sapien
gaagctgacttgaaaggcatccttg

SEQ ID NO: 103291 - DNA, 25 bp, Homo sapien
gaaaggcatccttggtactaagtga

SEQ ID NO: 103292 - DNA, 25 bp, Homo sapien
gcatccttggtactaagtgaagctt

SEQ ID NO: 103293 - DNA, 25 bp, Homo sapien
ggtactaagtgaagcttattcagaa

SEQ ID NO: 103294 - DNA, 25 bp, Homo sapien
aactgcttgtagatatcatttttgc

SEQ ID NO: 103295 - DNA, 25 bp, Homo sapien
agatatcatttttgcagtgtatgtt

SEQ ID NO: 103296 - DNA, 25 bp, Homo sapien
gttggagctgtaatggttgcaatta

SEQ ID NO: 103297 - DNA, 25 bp, Homo sapien
gtaatggttgcaattatgtttctta

SEQ ID NO: 103298 - DNA, 25 bp, Homo sapien
aagcaaaaagcgtagtttctgattt

SEQ ID NO: 103299 - DNA, 25 bp, Homo sapien
agatggcaccagctgctccggatgt

SEQ ID NO: 103300 - DNA, 25 bp, Homo sapien
gatggcaccagctgctccggatgtg

SEQ ID NO: 103301 - DNA, 25 bp, Homo sapien
atggcaccagctgctccggatgtgc

SEQ ID NO: 103302 - DNA, 25 bp, Homo sapien
tcggttcccaggtttgagctctgca

SEQ ID NO: 103303 - DNA, 25 bp, Homo sapien
cggttcccaggtttgagctctgcag

SEQ ID NO: 103304 - DNA, 25 bp, Homo sapien
aagtcagaccaaaggaagaactcag

SEQ ID NO: 103305 - DNA, 25 bp, Homo sapien
gtcagaccaaaggaagaactcagaa

SEQ ID NO: 103306 - DNA, 25 bp, Homo sapien
aagaactcagaaatgtcttgtttat

SEQ ID NO: 103307 - DNA, 25 bp, Homo sapien
tgtgaccaagcagcctctcccttca

SEQ ID NO: 103308 - DNA, 25 bp, Homo sapien
atttttcacactgtaaatttcttgt

SEQ ID NO: 103309 - DNA, 25 bp, Homo sapien
tttcacactgtaaatttcttgtaca

SEQ ID NO: 103310 - DNA, 25 bp, Homo sapien
ttgtgcctttttaagaaacatttca

SEQ ID NO: 103311 - DNA, 25 bp, Homo sapien
gaaacatttcatggctctgatcttc

SEQ ID NO: 103312 - DNA, 25 bp, Homo sapien
acatttcatggctctgatcttcagt

SEQ ID NO: 103313 - DNA, 25 bp, Homo sapien
tcatggctctgatcttcagtgctaa

SEQ ID NO: 103314 - DNA, 25 bp, Homo sapien
ggctctgatcttcagtgctaaaaga

SEQ ID NO: 103315 - DNA, 25 bp, Homo sapien
ttgtatgtactttccactttctcac

SEQ ID NO: 103316 - DNA, 25 bp, Homo sapien
tatgtactttccactttctcacagt

SEQ ID NO: 103317 - DNA, 25 bp, Homo sapien
gtactttccactttctcacagtgtt

SEQ ID NO: 103318 - DNA, 25 bp, Homo sapien
ttctcacagtgttttcatacccaat

SEQ ID NO: 103319 - DNA, 25 bp, Homo sapien
agtgttttcatacccaatatctcat

SEQ ID NO: 103320 - DNA, 25 bp, Homo sapien
gttttcatacccaatatctcatttt

SEQ ID NO: 103321 - DNA, 25 bp, Homo sapien
cccgagcctcctcgacgagcgccac

SEQ ID NO: 103322 - DNA, 25 bp, Homo sapien
ccgagcctcctcgacgagcgccacc

SEQ ID NO: 103323 - DNA, 25 bp, Homo sapien
cgagcctcctcgacgagcgccaccc

SEQ ID NO: 103324 - DNA, 25 bp, Homo sapien
agcctcctcgacgagcgccaccccc

SEQ ID NO: 103325 - DNA, 25 bp, Homo sapien
gcctcctcgacgagcgccaccccct

SEQ ID NO: 103326 - DNA, 25 bp, Homo sapien
cctcctcgacgagcgccaccccctg

SEQ ID NO: 103327 - DNA, 25 bp, Homo sapien
gcacccagtcccatcagccctcact

SEQ ID NO: 103328 - DNA, 25 bp, Homo sapien
cacccagtcccatcagccctcactc

SEQ ID NO: 103329 - DNA, 25 bp, Homo sapien
acccagtcccatcagccctcactca

SEQ ID NO: 103330 - DNA, 25 bp, Homo sapien
cccagtcccatcagccctcactcac

SEQ ID NO: 103331 - DNA, 25 bp, Homo sapien
ccagtcccatcagccctcactcact

SEQ ID NO: 103332 - DNA, 25 bp, Homo sapien
accctgggccgcatgcactattact

SEQ ID NO: 103333 - DNA, 25 bp, Homo sapien
ccctgggccgcatgcactattactg

SEQ ID NO: 103334 - DNA, 25 bp, Homo sapien
acatgagctcagagctaccccacac

SEQ ID NO: 103335 - DNA, 25 bp, Homo sapien
agagctaccccacaccttcggactg

SEQ ID NO: 103336 - DNA, 25 bp, Homo sapien
ctcccaggtgctactgggcgtggac

SEQ ID NO: 103337 - DNA, 25 bp, Homo sapien
ccaggtgctactgggcgtggaccgc

SEQ ID NO: 103338 - DNA, 25 bp, Homo sapien
gtgctactgggcgtggaccgccacc

SEQ ID NO: 103339 - DNA, 25 bp, Homo sapien
cagtcctgccagaagaccccggggg

SEQ ID NO: 103340 - DNA, 25 bp, Homo sapien
gggggcagcatgcagggtccccact

SEQ ID NO: 103341 - DNA, 25 bp, Homo sapien
gaagaggtgaagtgaccaaatgaaa

SEQ ID NO: 103342 - DNA, 25 bp, Homo sapien
gaagtgaccaaatgaaagaaagctg

SEQ ID NO: 103343 - DNA, 25 bp, Homo sapien
acaacttcttaaagataagcctgag

SEQ ID NO: 103344 - DNA, 25 bp, Homo sapien
gataagcctgagcatgtaggtgtaa

SEQ ID NO: 103345 - DNA, 25 bp, Homo sapien
gtgtaaaagttggtgtccgaaccag

SEQ ID NO: 103346 - DNA, 25 bp, Homo sapien
tggagtcagagtattcatcgaaaag

SEQ ID NO: 103347 - DNA, 25 bp, Homo sapien
gaaagcacagctaacacttttagga

SEQ ID NO: 103348 - DNA, 25 bp, Homo sapien
acacttttaggaacagaaatggact

SEQ ID NO: 103349 - DNA, 25 bp, Homo sapien
gttgaagacaaattatccagtgagt

SEQ ID NO: 103350 - DNA, 25 bp, Homo sapien
aattatccagtgagtttgtgttcaa

SEQ ID NO: 103351 - DNA, 25 bp, Homo sapien
gagtttgtgttcaataacccaaaca

SEQ ID NO: 103352 - DNA, 25 bp, Homo sapien
aaacatcaaagggacttgtggctgt

SEQ ID NO: 103353 - DNA, 25 bp, Homo sapien
cttgtggctgtggagaaagctttaa

SEQ ID NO: 103354 - DNA, 25 bp, Homo sapien
tgcacctcatgtcagatcagcactg

SEQ ID NO: 103355 - DNA, 25 bp, Homo sapien
acctcatgtcagatcagcactgcat

SEQ ID NO: 103356 - DNA, 25 bp, Homo sapien
tcatgtcagatcagcactgcattag

SEQ ID NO: 103357 - DNA, 25 bp, Homo sapien
acgcacgcgcgcaagggatccaggc

SEQ ID NO: 103358 - DNA, 25 bp, Homo sapien
caggctgcgcgctcctcatgacaat

SEQ ID NO: 103359 - DNA, 25 bp, Homo sapien
actgccctagaaggcaaatcgccta

SEQ ID NO: 103360 - DNA, 25 bp, Homo sapien
ggcaaatcgcctacgttacacagtg

SEQ ID NO: 103361 - DNA, 25 bp, Homo sapien
aaatcgcctacgttacacagtgtac

SEQ ID NO: 103362 - DNA, 25 bp, Homo sapien
atcgcctacgttacacagtgtacca

SEQ ID NO: 103363 - DNA, 25 bp, Homo sapien
gttacacagtgtaccatgtggcaaa

SEQ ID NO: 103364 - DNA, 25 bp, Homo sapien
atgtggcaaacacgcacatgtaccc

SEQ ID NO: 103365 - DNA, 25 bp, Homo sapien
agaggaatctaatacaatatttgta

SEQ ID NO: 103366 - DNA, 25 bp, Homo sapien
ggtcagaagacgatggaactgtcct

SEQ ID NO: 103367 - DNA, 25 bp, Homo sapien
atggaactgtcctgggttagtatag

SEQ ID NO: 103368 - DNA, 25 bp, Homo sapien
gaactgtcctgggttagtatagtaa

SEQ ID NO: 103369 - DNA, 25 bp, Homo sapien
gtcctgggttagtatagtaatctta

SEQ ID NO: 103370 - DNA, 25 bp, Homo sapien
tagtaatcttacagtaggatcctta

SEQ ID NO: 103371 - DNA, 25 bp, Homo sapien
gtgggagcagtgatacgctaacatt

SEQ ID NO: 103372 - DNA, 25 bp, Homo sapien
gcagtgatacgctaacattcattac

SEQ ID NO: 103373 - DNA, 25 bp, Homo sapien
gatacgctaacattcattacattct

SEQ ID NO: 103374 - DNA, 25 bp, Homo sapien
gctaacattcattacattctgcagt

SEQ ID NO: 103375 - DNA, 25 bp, Homo sapien
attacattctgcagtaatgaatctg

SEQ ID NO: 103376 - DNA, 25 bp, Homo sapien
gtgtgtcttgtgttgtcttcgtctg

SEQ ID NO: 103377 - DNA, 25 bp, Homo sapien
tgtgtcttgtgttgtcttcgtctgt

SEQ ID NO: 103378 - DNA, 25 bp, Homo sapien
tgtcttgtgttgtcttcgtctgtgc

SEQ ID NO: 103379 - DNA, 25 bp, Homo sapien
atcctgcagatgagcaccgtgtcca

SEQ ID NO: 103380 - DNA, 25 bp, Homo sapien
tcctgcagatgagcaccgtgtccag

SEQ ID NO: 103381 - DNA, 25 bp, Homo sapien
cctgcagatgagcaccgtgtccagt

SEQ ID NO: 103382 - DNA, 25 bp, Homo sapien
accgtgtccagtgccacagcacaag

SEQ ID NO: 103383 - DNA, 25 bp, Homo sapien
agtgccacagcacaaggcgcctccc

SEQ ID NO: 103384 - DNA, 25 bp, Homo sapien
agcctggactgtggcagccacggca

SEQ ID NO: 103385 - DNA, 25 bp, Homo sapien
ctggactgtggcagccacggcagaa

SEQ ID NO: 103386 - DNA, 25 bp, Homo sapien
gttctgtggttaaatctacaaatta

SEQ ID NO: 103387 - DNA, 25 bp, Homo sapien
aaaaccagatagatgggttgacatc

SEQ ID NO: 103388 - DNA, 25 bp, Homo sapien
aaccagatagatgggttgacatcag

SEQ ID NO: 103389 - DNA, 25 bp, Homo sapien
ccagatagatgggttgacatcagtt

SEQ ID NO: 103390 - DNA, 25 bp, Homo sapien
gatagatgggttgacatcagtttat

SEQ ID NO: 103391 - DNA, 25 bp, Homo sapien
agatgggttgacatcagtttattcc

SEQ ID NO: 103392 - DNA, 25 bp, Homo sapien
gatgggttgacatcagtttattcca

SEQ ID NO: 103393 - DNA, 25 bp, Homo sapien
atgggttgacatcagtttattccag

SEQ ID NO: 103394 - DNA, 25 bp, Homo sapien
tgggttgacatcagtttattccagc

SEQ ID NO: 103395 - DNA, 25 bp, Homo sapien
ttcaaaatctaccttgtcaagtaaa

SEQ ID NO: 103396 - DNA, 25 bp, Homo sapien
tcaaaatctaccttgtcaagtaaaa

SEQ ID NO: 103397 - DNA, 25 bp, Homo sapien
ccaggtaatggttagaaatattctg

SEQ ID NO: 103398 - DNA, 25 bp, Homo sapien
cactttaatctgaaacctgcaacaa

SEQ ID NO: 103399 - DNA, 25 bp, Homo sapien
agactagccaacacctggccatgaa

SEQ ID NO: 103400 - DNA, 25 bp, Homo sapien
aaacttgccccttcactgatctgga

SEQ ID NO: 103401 - DNA, 25 bp, Homo sapien
tggactcacctctggagcctatggc

SEQ ID NO: 103402 - DNA, 25 bp, Homo sapien
ggctttaagcaagcactactgcact

SEQ ID NO: 103403 - DNA, 25 bp, Homo sapien
gcactttacagaattaccccactgg

SEQ ID NO: 103404 - DNA, 25 bp, Homo sapien
cagaattaccccactggatcctgga

SEQ ID NO: 103405 - DNA, 25 bp, Homo sapien
ggatcctggacccacagaattcctt

SEQ ID NO: 103406 - DNA, 25 bp, Homo sapien
agaattccttcaggatccttcttgc

SEQ ID NO: 103407 - DNA, 25 bp, Homo sapien
ccttcttgctgccagactgaaagca

SEQ ID NO: 103408 - DNA, 25 bp, Homo sapien
tatttcccctcaagttttctaagtg

SEQ ID NO: 103409 - DNA, 25 bp, Homo sapien
gtttggtttgaagtgaactgtgact

SEQ ID NO: 103410 - DNA, 25 bp, Homo sapien
gtgacttttttgaatattgcagggt

SEQ ID NO: 103411 - DNA, 25 bp, Homo sapien
aatattgcagggttcagtctagatt

SEQ ID NO: 103412 - DNA, 25 bp, Homo sapien
tcagaatctgcacaacctttgaaaa

SEQ ID NO: 103413 - DNA, 25 bp, Homo sapien
aacaaagactttccacagaatgcca

SEQ ID NO: 103414 - DNA, 25 bp, Homo sapien
aagactttccacagaatgccataag

SEQ ID NO: 103415 - DNA, 25 bp, Homo sapien
agaatgccataagacaacgctctct

SEQ ID NO: 103416 - DNA, 25 bp, Homo sapien
agacaacgctctctgggtccatcat

SEQ ID NO: 103417 - DNA, 25 bp, Homo sapien
aacgctctctgggtccatcattggc

SEQ ID NO: 103418 - DNA, 25 bp, Homo sapien
atcattggccacagataaatcctag

SEQ ID NO: 103419 - DNA, 25 bp, Homo sapien
ggccacagataaatcctagttaaat

SEQ ID NO: 103420 - DNA, 25 bp, Homo sapien
tatctctcactctggacccagggct

SEQ ID NO: 103421 - DNA, 25 bp, Homo sapien
tcactctggacccagggctgacatc

SEQ ID NO: 103422 - DNA, 25 bp, Homo sapien
tgaaggaggcgctctctgaggaaat

SEQ ID NO: 103423 - DNA, 25 bp, Homo sapien
aggaggcgctctctgaggaaatcaa

SEQ ID NO: 103424 - DNA, 25 bp, Homo sapien
aggcgctctctgaggaaatcaagaa

SEQ ID NO: 103425 - DNA, 25 bp, Homo sapien
aatcaagaaagctcaaaggaccggc

SEQ ID NO: 103426 - DNA, 25 bp, Homo sapien
ttgctgtctgttctcggcaccccgg

SEQ ID NO: 103427 - DNA, 25 bp, Homo sapien
ttggcaggcgatacggcagctctgt

SEQ ID NO: 103428 - DNA, 25 bp, Homo sapien
ccttggccagcatgtggagtggagg

SEQ ID NO: 103429 - DNA, 25 bp, Homo sapien
atgctgcccctgtggttggaacatc

SEQ ID NO: 103430 - DNA, 25 bp, Homo sapien
gctgcccctgtggttggaacatcct

SEQ ID NO: 103431 - DNA, 25 bp, Homo sapien
aggtgggctcctggtgacgggtgtc

SEQ ID NO: 103432 - DNA, 25 bp, Homo sapien
tcctggtgacgggtgtccaagaagc

SEQ ID NO: 103433 - DNA, 25 bp, Homo sapien
tgacgggtgtccaagaagcggtttc

SEQ ID NO: 103434 - DNA, 25 bp, Homo sapien
gggtgtccaagaagcggtttccttg

SEQ ID NO: 103435 - DNA, 25 bp, Homo sapien
caagaagcggtttccttgggagctt

SEQ ID NO: 103436 - DNA, 25 bp, Homo sapien
agaagcggtttccttgggagcttct

SEQ ID NO: 103437 - DNA, 25 bp, Homo sapien
cggtttccttgggagcttctgcctc

SEQ ID NO: 103438 - DNA, 25 bp, Homo sapien
tttccttgggagcttctgcctccgt

SEQ ID NO: 103439 - DNA, 25 bp, Homo sapien
gggcaccgattagtctactaacagc

SEQ ID NO: 103440 - DNA, 25 bp, Homo sapien
attagtctactaacagccagaggtc

SEQ ID NO: 103441 - DNA, 25 bp, Homo sapien
agtctactaacagccagaggtccat

SEQ ID NO: 103442 - DNA, 25 bp, Homo sapien
agacaacgtggaaacatgcggcaca

SEQ ID NO: 103443 - DNA, 25 bp, Homo sapien
aacatgcggcacagatgatcttggg

SEQ ID NO: 103444 - DNA, 25 bp, Homo sapien
gagacacctagatatccaaaaaagc

SEQ ID NO: 103445 - DNA, 25 bp, Homo sapien
aaaagcctcttcagaaaaactcatc

SEQ ID NO: 103446 - DNA, 25 bp, Homo sapien
gaaaaactcatctgttccttttgga

SEQ ID NO: 103447 - DNA, 25 bp, Homo sapien
aactcatctgttccttttggatcaa

SEQ ID NO: 103448 - DNA, 25 bp, Homo sapien
tttggatcaaaagcagatactgtaa

SEQ ID NO: 103449 - DNA, 25 bp, Homo sapien
gatactgtaacaactgtctgagctt

SEQ ID NO: 103450 - DNA, 25 bp, Homo sapien
aactgtctgagcttgatgtagtgga

SEQ ID NO: 103451 - DNA, 25 bp, Homo sapien
cttgatgtagtggagtttactgtat

SEQ ID NO: 103452 - DNA, 25 bp, Homo sapien
actgtatgtgtagttctgcagagct

SEQ ID NO: 103453 - DNA, 25 bp, Homo sapien
cttgtagctgacatttggcaaaagc

SEQ ID NO: 103454 - DNA, 25 bp, Homo sapien
gtagctgacatttggcaaaagcgtc

SEQ ID NO: 103455 - DNA, 25 bp, Homo sapien
gctgacatttggcaaaagcgtcact

SEQ ID NO: 103456 - DNA, 25 bp, Homo sapien
acatttggcaaaagcgtcactgaaa

SEQ ID NO: 103457 - DNA, 25 bp, Homo sapien
tttggcaaaagcgtcactgaaaggc

SEQ ID NO: 103458 - DNA, 25 bp, Homo sapien
attttatcctgtggccctgaagcac

SEQ ID NO: 103459 - DNA, 25 bp, Homo sapien
tatcctgtggccctgaagcacaaaa

SEQ ID NO: 103460 - DNA, 25 bp, Homo sapien
atcctgtggccctgaagcacaaaat

SEQ ID NO: 103461 - DNA, 25 bp, Homo sapien
tcctgtggccctgaagcacaaaata

SEQ ID NO: 103462 - DNA, 25 bp, Homo sapien
ctgtggccctgaagcacaaaataaa

SEQ ID NO: 103463 - DNA, 25 bp, Homo sapien
ggccctgaagcacaaaataaaaatt

SEQ ID NO: 103464 - DNA, 25 bp, Homo sapien
ccatggttgttgttagggatagtac

SEQ ID NO: 103465 - DNA, 25 bp, Homo sapien
gggatagtactaagcatttcagttc

SEQ ID NO: 103466 - DNA, 25 bp, Homo sapien
aagcatttcagttccaggagaataa

SEQ ID NO: 103467 - DNA, 25 bp, Homo sapien
aaaagcatgcattctagcacaacaa

SEQ ID NO: 103468 - DNA, 25 bp, Homo sapien
gcatgcattctagcacaacaagatg

SEQ ID NO: 103469 - DNA, 25 bp, Homo sapien
atacaaaagtggctccttcccatgt

SEQ ID NO: 103470 - DNA, 25 bp, Homo sapien
tccacacccaaactgtttctgattg

SEQ ID NO: 103471 - DNA, 25 bp, Homo sapien
ctgattggcttttagctttttgttg

SEQ ID NO: 103472 - DNA, 25 bp, Homo sapien
aacacttgtatttggaggctcttct

SEQ ID NO: 103473 - DNA, 25 bp, Homo sapien
cttgtatttggaggctcttctgtga

SEQ ID NO: 103474 - DNA, 25 bp, Homo sapien
ctgtgattttgagaagtatactctt

SEQ ID NO: 103475 - DNA, 25 bp, Homo sapien
tcctgtttaggatctgatagtctat

SEQ ID NO: 103476 - DNA, 25 bp, Homo sapien
atagtctatgcctttgtctccgagt

SEQ ID NO: 103477 - DNA, 25 bp, Homo sapien
gtctccgagtactgcagaactgaca

SEQ ID NO: 103478 - DNA, 25 bp, Homo sapien
cggctggtgttggtcagatgcacct

SEQ ID NO: 103479 - DNA, 25 bp, Homo sapien
gtgcagatccaagggctgtggtaaa

SEQ ID NO: 103480 - DNA, 25 bp, Homo sapien
aacgggagagcttgtgtttttgaag

SEQ ID NO: 103481 - DNA, 25 bp, Homo sapien
gagtttgtacagacatcctgtcttc

SEQ ID NO: 103482 - DNA, 25 bp, Homo sapien
cttcccagagaaggtggacactctt

SEQ ID NO: 103483 - DNA, 25 bp, Homo sapien
gtggacactcttgggctcattgtaa

SEQ ID NO: 103484 - DNA, 25 bp, Homo sapien
gggctcattgtaaagtgcctgctgc

SEQ ID NO: 103485 - DNA, 25 bp, Homo sapien
agtgcctgctgcatcaataaagctc

SEQ ID NO: 103486 - DNA, 25 bp, Homo sapien
ctgcacctggtgttgcgcctgcgag

SEQ ID NO: 103487 - DNA, 25 bp, Homo sapien
tgcgcctgcgaggtggcattattga

SEQ ID NO: 103488 - DNA, 25 bp, Homo sapien
gcttgcccagaaatacaactgcgac

SEQ ID NO: 103489 - DNA, 25 bp, Homo sapien
atacaactgcgacaagatgatctgc

SEQ ID NO: 103490 - DNA, 25 bp, Homo sapien
atgatctgccgcaagtgctatgctc

SEQ ID NO: 103491 - DNA, 25 bp, Homo sapien
tcgtgctgtcaactgccgcaagaag

SEQ ID NO: 103492 - DNA, 25 bp, Homo sapien
aagtgtggtcacaccaacaacctgc

SEQ ID NO: 103493 - DNA, 25 bp, Homo sapien
caacaacctgcgtcccaagaagaag

SEQ ID NO: 103494 - DNA, 25 bp, Homo sapien
tggttctttccttgaagggcagcct

SEQ ID NO: 103495 - DNA, 25 bp, Homo sapien
cgtggccctggagcctcaataaagt

SEQ ID NO: 103496 - DNA, 25 bp, Homo sapien
gagcctcaataaagtgtccctttca

SEQ ID NO: 103497 - DNA, 25 bp, Homo sapien
atcatcctctacaaccgggttcagg

SEQ ID NO: 103498 - DNA, 25 bp, Homo sapien
ggaagtcccactggagcggccctag

SEQ ID NO: 103499 - DNA, 25 bp, Homo sapien
actcccgccgctctgaaaataataa

SEQ ID NO: 103500 - DNA, 25 bp, Homo sapien
gagccagtgccgagttctatgtcca

SEQ ID NO: 103501 - DNA, 25 bp, Homo sapien
gagttctatgtccagtgcagcctga

SEQ ID NO: 103502 - DNA, 25 bp, Homo sapien
agtgcagcctgacttctgagcaggt

SEQ ID NO: 103503 - DNA, 25 bp, Homo sapien
tctgagcaggtgaggaagcactacc

SEQ ID NO: 103504 - DNA, 25 bp, Homo sapien
gacccgaggcccacgagtctacagg

SEQ ID NO: 103505 - DNA, 25 bp, Homo sapien
aatcttctttgtggagacacagaac

SEQ ID NO: 103506 - DNA, 25 bp, Homo sapien
agaacgtgcggagattgcccgagac

SEQ ID NO: 103507 - DNA, 25 bp, Homo sapien
ggagatgtgggctgaactctgcccc

SEQ ID NO: 103508 - DNA, 25 bp, Homo sapien
ctaaagtttccgtgggttctgtcat

SEQ ID NO: 103509 - DNA, 25 bp, Homo sapien
gtgggttctgtcatgtaacacgaca

SEQ ID NO: 103510 - DNA, 25 bp, Homo sapien
taacacgacatgctccaccgtcagg

SEQ ID NO: 103511 - DNA, 25 bp, Homo sapien
agcagagtgcctgagtttagggtca

SEQ ID NO: 103512 - DNA, 25 bp, Homo sapien
gtgcctgagtttagggtcaaggaca

SEQ ID NO: 103513 - DNA, 25 bp, Homo sapien
caaggacaaaaaacctcaggcctgg

SEQ ID NO: 103514 - DNA, 25 bp, Homo sapien
caagtgtctgtatatcctatggtct

SEQ ID NO: 103515 - DNA, 25 bp, Homo sapien
tgtatatcctatggtcttctccatc

SEQ ID NO: 103516 - DNA, 25 bp, Homo sapien
ttgtcctgctcccttttaagccagg

SEQ ID NO: 103517 - DNA, 25 bp, Homo sapien
gctcccttttaagccaggttacatt

SEQ ID NO: 103518 - DNA, 25 bp, Homo sapien
taagccaggttacattctaaaaatt

SEQ ID NO: 103519 - DNA, 25 bp, Homo sapien
ttttaagattaagcatgatcttgtg

SEQ ID NO: 103520 - DNA, 25 bp, Homo sapien
tttaagattaagcatgatcttgtgt

SEQ ID NO: 103521 - DNA, 25 bp, Homo sapien
ttaagattaagcatgatcttgtgta

SEQ ID NO: 103522 - DNA, 25 bp, Homo sapien
taagattaagcatgatcttgtgtat

SEQ ID NO: 103523 - DNA, 25 bp, Homo sapien
tactgtttatataactagaactaaa

SEQ ID NO: 103524 - DNA, 25 bp, Homo sapien
actgtttatataactagaactaaat

SEQ ID NO: 103525 - DNA, 25 bp, Homo sapien
tttattcatttcctaattttaagat

SEQ ID NO: 103526 - DNA, 25 bp, Homo sapien
ttattcatttcctaattttaagatt

SEQ ID NO: 103527 - DNA, 25 bp, Homo sapien
tattcatttcctaattttaagatta

SEQ ID NO: 103528 - DNA, 25 bp, Homo sapien
gataaatatttcctacgtctgttca

SEQ ID NO: 103529 - DNA, 25 bp, Homo sapien
aatatttcctacgtctgttcactga

SEQ ID NO: 103530 - DNA, 25 bp, Homo sapien
ttcctacgtctgttcactgaaataa

SEQ ID NO: 103531 - DNA, 25 bp, Homo sapien
tgaaataattaccaaccccttagca

SEQ ID NO: 103532 - DNA, 25 bp, Homo sapien
ttaccaaccccttagcaataagcac

SEQ ID NO: 103533 - DNA, 25 bp, Homo sapien
aaccccttagcaataagcactcctt

SEQ ID NO: 103534 - DNA, 25 bp, Homo sapien
aataagcactccttgcagagaggtt

SEQ ID NO: 103535 - DNA, 25 bp, Homo sapien
tattctctaaataccattcccttct

SEQ ID NO: 103536 - DNA, 25 bp, Homo sapien
aaggttgcttttcttgtaggaactg

SEQ ID NO: 103537 - DNA, 25 bp, Homo sapien
gcttttcttgtaggaactgtgtctt

SEQ ID NO: 103538 - DNA, 25 bp, Homo sapien
ggaactgtgtctttgagttactaat

SEQ ID NO: 103539 - DNA, 25 bp, Homo sapien
gattcttgtaagtttgagttccaca

SEQ ID NO: 103540 - DNA, 25 bp, Homo sapien
gtttgagttccacaagggctaattt

SEQ ID NO: 103541 - DNA, 25 bp, Homo sapien
tttgggtgatttgttgattggcaat

SEQ ID NO: 103542 - DNA, 25 bp, Homo sapien
gacttaacaactttatcctattcta

SEQ ID NO: 103543 - DNA, 25 bp, Homo sapien
tatcctattctacaagtcagtaaag

SEQ ID NO: 103544 - DNA, 25 bp, Homo sapien
aggaacaattggtactcacctcagt

SEQ ID NO: 103545 - DNA, 25 bp, Homo sapien
aattggtactcacctcagtgctgca

SEQ ID NO: 103546 - DNA, 25 bp, Homo sapien
tcagtgctgcactcaactatggaaa

SEQ ID NO: 103547 - DNA, 25 bp, Homo sapien
aagaggcagagtttgcttgcccaat

SEQ ID NO: 103548 - DNA, 25 bp, Homo sapien
tgcttgcccaattgccaaactaaag

SEQ ID NO: 103549 - DNA, 25 bp, Homo sapien
aaagacatcagttcattggtcaaat

SEQ ID NO: 103550 - DNA, 25 bp, Homo sapien
agcgcttgccatgtgcacgatgagt

SEQ ID NO: 103551 - DNA, 25 bp, Homo sapien
tgcacgatgagttcaggacggcagc

SEQ ID NO: 103552 - DNA, 25 bp, Homo sapien
gacggcagcggtggaaggccctttt

SEQ ID NO: 103553 - DNA, 25 bp, Homo sapien
tttgtcaccttggacatggaagact

SEQ ID NO: 103554 - DNA, 25 bp, Homo sapien
atggaagactgtggctacaacattc

SEQ ID NO: 103555 - DNA, 25 bp, Homo sapien
gatgagtcaaccctcatgaccatag

SEQ ID NO: 103556 - DNA, 25 bp, Homo sapien
aaccctcatgaccatagcctatgtc

SEQ ID NO: 103557 - DNA, 25 bp, Homo sapien
ccatagcctatgtcatggctgccat

SEQ ID NO: 103558 - DNA, 25 bp, Homo sapien
atgctgccactctgcctcatggtgt

SEQ ID NO: 103559 - DNA, 25 bp, Homo sapien
cctcatggtgtgtcagtggcgctgc

SEQ ID NO: 103560 - DNA, 25 bp, Homo sapien
gcctgcgccagcagcatgatgactt

SEQ ID NO: 103561 - DNA, 25 bp, Homo sapien
caggtagaaacgtgggttaagctct

SEQ ID NO: 103562 - DNA, 25 bp, Homo sapien
tagaaacgtgggttaagctcttcct

SEQ ID NO: 103563 - DNA, 25 bp, Homo sapien
agaaacgtgggttaagctcttcctg

SEQ ID NO: 103564 - DNA, 25 bp, Homo sapien
gaaacgtgggttaagctcttcctgc

SEQ ID NO: 103565 - DNA, 25 bp, Homo sapien
agctcttcctgccccgttcagcttc

SEQ ID NO: 103566 - DNA, 25 bp, Homo sapien
gctcttcctgccccgttcagcttca

SEQ ID NO: 103567 - DNA, 25 bp, Homo sapien
tcttcctgccccgttcagcttcact

SEQ ID NO: 103568 - DNA, 25 bp, Homo sapien
cttcctgccccgttcagcttcactc

SEQ ID NO: 103569 - DNA, 25 bp, Homo sapien
ttcctgccccgttcagcttcactcc

SEQ ID NO: 103570 - DNA, 25 bp, Homo sapien
cctgccccgttcagcttcactccca

SEQ ID NO: 103571 - DNA, 25 bp, Homo sapien
ctgccccgttcagcttcactcccac

SEQ ID NO: 103572 - DNA, 25 bp, Homo sapien
ataagtcagataaatgtcagtttca

SEQ ID NO: 103573 - DNA, 25 bp, Homo sapien
gaagtttcacacaatacctgctaat

SEQ ID NO: 103574 - DNA, 25 bp, Homo sapien
atacctgctaatggtgtgatgtcat

SEQ ID NO: 103575 - DNA, 25 bp, Homo sapien
taatggtgtgatgtcatttttcccc

SEQ ID NO: 103576 - DNA, 25 bp, Homo sapien
gatatttcagaaacccatagcaatt

SEQ ID NO: 103577 - DNA, 25 bp, Homo sapien
cagaaacccatagcaattcagtgat

SEQ ID NO: 103578 - DNA, 25 bp, Homo sapien
ttttctttttgtagtagctcagtca

SEQ ID NO: 103579 - DNA, 25 bp, Homo sapien
gtagctcagtcaaaacaggtaacag

SEQ ID NO: 103580 - DNA, 25 bp, Homo sapien
acaggtaacagcagattaatcatag

SEQ ID NO: 103581 - DNA, 25 bp, Homo sapien
aatcatagaaaatgttgcttccaca

SEQ ID NO: 103582 - DNA, 25 bp, Homo sapien
gaaaatgttgcttccacattaacaa

SEQ ID NO: 103583 - DNA, 25 bp, Homo sapien
acccagtgagggtgcatttgaacac

SEQ ID NO: 103584 - DNA, 25 bp, Homo sapien
tttaagctctgctttgtgttagagc

SEQ ID NO: 103585 - DNA, 25 bp, Homo sapien
tgtgttagagcttgtgactgccaaa

SEQ ID NO: 103586 - DNA, 25 bp, Homo sapien
gccaaaaattttgtgcacagtgata

SEQ ID NO: 103587 - DNA, 25 bp, Homo sapien
atgactgttttaggatcttaagggt

SEQ ID NO: 103588 - DNA, 25 bp, Homo sapien
gtatgtttagaatatatgcccaacg

SEQ ID NO: 103589 - DNA, 25 bp, Homo sapien
tatgcccaacgaggcaggaccatgt

SEQ ID NO: 103590 - DNA, 25 bp, Homo sapien
ggcaggaccatgtggatagattcca

SEQ ID NO: 103591 - DNA, 25 bp, Homo sapien
agattccatttgtttccttgacctg

SEQ ID NO: 103592 - DNA, 25 bp, Homo sapien
tttgtttccttgacctgatgtaata

SEQ ID NO: 103593 - DNA, 25 bp, Homo sapien
ctgataaaagccgtgcagtgcccgg

SEQ ID NO: 103594 - DNA, 25 bp, Homo sapien
gtggtggctggcatgcccaatactc

SEQ ID NO: 103595 - DNA, 25 bp, Homo sapien
tggcatgcccaatactcttgcccat

SEQ ID NO: 103596 - DNA, 25 bp, Homo sapien
atcctcgcttgctgccctaggatgt

SEQ ID NO: 103597 - DNA, 25 bp, Homo sapien
ccctaggatgtcctctgttctgagt

SEQ ID NO: 103598 - DNA, 25 bp, Homo sapien
tgttctgagtcagcggccacgttca

SEQ ID NO: 103599 - DNA, 25 bp, Homo sapien
gagtcagcggccacgttcagtcaca

SEQ ID NO: 103600 - DNA, 25 bp, Homo sapien
gttcagtcacacagccctgcttggc

SEQ ID NO: 103601 - DNA, 25 bp, Homo sapien
tcagaggggccctttttctgtacta

SEQ ID NO: 103602 - DNA, 25 bp, Homo sapien
tgtactactgtagtcagctgggaat

SEQ ID NO: 103603 - DNA, 25 bp, Homo sapien
gggaaggtgcatcccaacacagcct

SEQ ID NO: 103604 - DNA, 25 bp, Homo sapien
gtgcatcccaacacagcctgtggat

SEQ ID NO: 103605 - DNA, 25 bp, Homo sapien
cttgaaccctgagaggcaggtggta

SEQ ID NO: 103606 - DNA, 25 bp, Homo sapien
ttgaaccctgagaggcaggtggtag

SEQ ID NO: 103607 - DNA, 25 bp, Homo sapien
aaccctgagaggcaggtggtaggcc

SEQ ID NO: 103608 - DNA, 25 bp, Homo sapien
ccctgagaggcaggtggtaggccat

SEQ ID NO: 103609 - DNA, 25 bp, Homo sapien
caggtggtaggccatggccacaatc

SEQ ID NO: 103610 - DNA, 25 bp, Homo sapien
aggtggtaggccatggccacaatcc

SEQ ID NO: 103611 - DNA, 25 bp, Homo sapien
ggtggtaggccatggccacaatccc

SEQ ID NO: 103612 - DNA, 25 bp, Homo sapien
gtggtaggccatggccacaatcccc

SEQ ID NO: 103613 - DNA, 25 bp, Homo sapien
ggtaggccatggccacaatccccag

SEQ ID NO: 103614 - DNA, 25 bp, Homo sapien
taggccatggccacaatccccagct

SEQ ID NO: 103615 - DNA, 25 bp, Homo sapien
ggccatggccacaatccccagctga

SEQ ID NO: 103616 - DNA, 25 bp, Homo sapien
gtgcggagattcaacactgccaatg

SEQ ID NO: 103617 - DNA, 25 bp, Homo sapien
cactgccaatgatgataacgttact

SEQ ID NO: 103618 - DNA, 25 bp, Homo sapien
taacgttactcaggtgcgggcattc

SEQ ID NO: 103619 - DNA, 25 bp, Homo sapien
gaaagcggtcaagaacttcactgag

SEQ ID NO: 103620 - DNA, 25 bp, Homo sapien
aagaacttcactgaggtccaccctg

SEQ ID NO: 103621 - DNA, 25 bp, Homo sapien
cactgaggtccaccctgactacggg

SEQ ID NO: 103622 - DNA, 25 bp, Homo sapien
gactacgggagccacatccaggctc

SEQ ID NO: 103623 - DNA, 25 bp, Homo sapien
atccaggctcttctggacaagtaca

SEQ ID NO: 103624 - DNA, 25 bp, Homo sapien
tctggacaagtacaatgctgagaag

SEQ ID NO: 103625 - DNA, 25 bp, Homo sapien
tgctgagaagcctaagaatgcgatt

SEQ ID NO: 103626 - DNA, 25 bp, Homo sapien
aagaatgcgattcacacctttgtgc

SEQ ID NO: 103627 - DNA, 25 bp, Homo sapien
tgagggcaccccaagagttcatgac

SEQ ID NO: 103628 - DNA, 25 bp, Homo sapien
aagagttcatgacttcccattcgga

SEQ ID NO: 103629 - DNA, 25 bp, Homo sapien
atgacttcccattcggaggcaggct

SEQ ID NO: 103630 - DNA, 25 bp, Homo sapien
gaggcaggctccaggattgtattaa

SEQ ID NO: 103631 - DNA, 25 bp, Homo sapien
gtattaaacccaaacaagccagtag

SEQ ID NO: 103632 - DNA, 25 bp, Homo sapien
agagggaatatccttccacttcaca

SEQ ID NO: 103633 - DNA, 25 bp, Homo sapien
gtgtaaagaccccattcgaactgta

SEQ ID NO: 103634 - DNA, 25 bp, Homo sapien
cattcgaactgtaggccttggagat

SEQ ID NO: 103635 - DNA, 25 bp, Homo sapien
ggagatgccatttcagccgaaggac

SEQ ID NO: 103636 - DNA, 25 bp, Homo sapien
gaaggactcttctattcggaagtac

SEQ ID NO: 103637 - DNA, 25 bp, Homo sapien
ggaagtacaccctcactattaggaa

SEQ ID NO: 103638 - DNA, 25 bp, Homo sapien
caaggtcagcgtaggtaaggatgca

SEQ ID NO: 103639 - DNA, 25 bp, Homo sapien
ggtcagcgtaggtaaggatgcaact

SEQ ID NO: 103640 - DNA, 25 bp, Homo sapien
aggatgcaactgaaggtcctgggct

SEQ ID NO: 103641 - DNA, 25 bp, Homo sapien
actgaaggtcctgggctgcacctat

SEQ ID NO: 103642 - DNA, 25 bp, Homo sapien
aaggtcctgggctgcacctatgctc

SEQ ID NO: 103643 - DNA, 25 bp, Homo sapien
gggctgcacctatgctctccaggca

SEQ ID NO: 103644 - DNA, 25 bp, Homo sapien
tcccactttctacagatcctacact

SEQ ID NO: 103645 - DNA, 25 bp, Homo sapien
ggaagacgtgaagttaggaatgaca

SEQ ID NO: 103646 - DNA, 25 bp, Homo sapien
ctgcccacaaagaggtggtacctac

SEQ ID NO: 103647 - DNA, 25 bp, Homo sapien
caaagaggtggtacctactctccta

SEQ ID NO: 103648 - DNA, 25 bp, Homo sapien
tacctactctcctacttcaggaggg

SEQ ID NO: 103649 - DNA, 25 bp, Homo sapien
gccccatcaatcccattgcataggt

SEQ ID NO: 103650 - DNA, 25 bp, Homo sapien
acgtgtgaccactggcattcatttg

SEQ ID NO: 103651 - DNA, 25 bp, Homo sapien
gagggatggcccagcctgtaagata

SEQ ID NO: 103652 - DNA, 25 bp, Homo sapien
gatggcccagcctgtaagatactgt

SEQ ID NO: 103653 - DNA, 25 bp, Homo sapien
ggcccagcctgtaagatactgtata

SEQ ID NO: 103654 - DNA, 25 bp, Homo sapien
actgtatatgcgctgctgtagatac

SEQ ID NO: 103655 - DNA, 25 bp, Homo sapien
tatatgcgctgctgtagataccgga

SEQ ID NO: 103656 - DNA, 25 bp, Homo sapien
tatgcgctgctgtagataccggaat

SEQ ID NO: 103657 - DNA, 25 bp, Homo sapien
gcgctgctgtagataccggaatgaa

SEQ ID NO: 103658 - DNA, 25 bp, Homo sapien
tgtagataccggaatgaattttctg

SEQ ID NO: 103659 - DNA, 25 bp, Homo sapien
ttttctgtacatgtttggttaattt

SEQ ID NO: 103660 - DNA, 25 bp, Homo sapien
gaatatcactgctgacactctggag

SEQ ID NO: 103661 - DNA, 25 bp, Homo sapien
actgctgacactctggagcactgga

SEQ ID NO: 103662 - DNA, 25 bp, Homo sapien
ggaacctgtcaaagtccagagcatt

SEQ ID NO: 103663 - DNA, 25 bp, Homo sapien
aaagtccagagcattgtgtgcactg

SEQ ID NO: 103664 - DNA, 25 bp, Homo sapien
attgtgtgcactggccggcgtcaat

SEQ ID NO: 103665 - DNA, 25 bp, Homo sapien
tggccggcgtcaatggcacccagac

SEQ ID NO: 103666 - DNA, 25 bp, Homo sapien
aatggcacccagaccccgtcttagt

SEQ ID NO: 103667 - DNA, 25 bp, Homo sapien
tagtccactgcatccagtcatgtga

SEQ ID NO: 103668 - DNA, 25 bp, Homo sapien
aagaaggtcattccatttgctgctg

SEQ ID NO: 103669 - DNA, 25 bp, Homo sapien
ctgtgacctggatgagtgcacctgc

SEQ ID NO: 103670 - DNA, 25 bp, Homo sapien
ctggatgagtgcacctgccgggacc

SEQ ID NO: 103671 - DNA, 25 bp, Homo sapien
gatcttgtgcaaaccctgagttgtt

SEQ ID NO: 103672 - DNA, 25 bp, Homo sapien
atgataatcacacctgcatttgctg

SEQ ID NO: 103673 - DNA, 25 bp, Homo sapien
tcacacctgcatttgctgaacttaa

SEQ ID NO: 103674 - DNA, 25 bp, Homo sapien
tgaacttaaacagcaggacgagaat

SEQ ID NO: 103675 - DNA, 25 bp, Homo sapien
aggacgagaataacgctagcaggaa

SEQ ID NO: 103676 - DNA, 25 bp, Homo sapien
acgctagcaggaatcaggcgattga

SEQ ID NO: 103677 - DNA, 25 bp, Homo sapien
ctcgagaaaagtattgctgtggctg

SEQ ID NO: 103678 - DNA, 25 bp, Homo sapien
gcctgtcccggcatcacagataaaa

SEQ ID NO: 103679 - DNA, 25 bp, Homo sapien
aaaagtgttcagcagacgaatcccc

SEQ ID NO: 103680 - DNA, 25 bp, Homo sapien
agaaacttattattggcttctgttt

SEQ ID NO: 103681 - DNA, 25 bp, Homo sapien
aacctacgtcaagattaacaatgct

SEQ ID NO: 103682 - DNA, 25 bp, Homo sapien
attctaagaccagattctctaatgt

SEQ ID NO: 103683 - DNA, 25 bp, Homo sapien
taatgtttctgggtgtgcaatagag

SEQ ID NO: 103684 - DNA, 25 bp, Homo sapien
gatcacatctttgtttcttcatgta

SEQ ID NO: 103685 - DNA, 25 bp, Homo sapien
gtttcttcatgtacgatagctatcc

SEQ ID NO: 103686 - DNA, 25 bp, Homo sapien
tacgatagctatccctacagaagat

SEQ ID NO: 103687 - DNA, 25 bp, Homo sapien
ggttttactatttttgccttatcat

SEQ ID NO: 103688 - DNA, 25 bp, Homo sapien
agaactagtctgttaatgatcatat

SEQ ID NO: 103689 - DNA, 25 bp, Homo sapien
tgactcccattgtggaattccctag

SEQ ID NO: 103690 - DNA, 25 bp, Homo sapien
cattgtggaattccctagcaattta

SEQ ID NO: 103691 - DNA, 25 bp, Homo sapien
aattcaagcttactgtattagtcat

SEQ ID NO: 103692 - DNA, 25 bp, Homo sapien
attagtcatttttagcccataatta

SEQ ID NO: 103693 - DNA, 25 bp, Homo sapien
atgtctatttttctaccgggaatat

SEQ ID NO: 103694 - DNA, 25 bp, Homo sapien
tgtctatttttctaccgggaatatt

SEQ ID NO: 103695 - DNA, 25 bp, Homo sapien
tttctaccgggaatattttagagat

SEQ ID NO: 103696 - DNA, 25 bp, Homo sapien
ttctaccgggaatattttagagatt

SEQ ID NO: 103697 - DNA, 25 bp, Homo sapien
ctaccgggaatattttagagattgg

SEQ ID NO: 103698 - DNA, 25 bp, Homo sapien
ctgcgtgggccgcattcctggtccc

SEQ ID NO: 103699 - DNA, 25 bp, Homo sapien
tttgaccccacacagcgtcattgcg

SEQ ID NO: 103700 - DNA, 25 bp, Homo sapien
tcattgcgggtcatggggagcccct

SEQ ID NO: 103701 - DNA, 25 bp, Homo sapien
tgcagaaaccgcctctgtggctgca

SEQ ID NO: 103702 - DNA, 25 bp, Homo sapien
gcagaaaccgcctctgtggctgcat

SEQ ID NO: 103703 - DNA, 25 bp, Homo sapien
cagaaaccgcctctgtggctgcatt

SEQ ID NO: 103704 - DNA, 25 bp, Homo sapien
tgggataatgaagagctgcctgttt

SEQ ID NO: 103705 - DNA, 25 bp, Homo sapien
gaccttgtgaaccactcatttttat

SEQ ID NO: 103706 - DNA, 25 bp, Homo sapien
gtgaaccactcatttttatgcaagt

SEQ ID NO: 103707 - DNA, 25 bp, Homo sapien
caagtggcatccctaaaacctgaga

SEQ ID NO: 103708 - DNA, 25 bp, Homo sapien
aaacacagtgagaggtctgaaggct

SEQ ID NO: 103709 - DNA, 25 bp, Homo sapien
tgaaggctggcttctgaagaatccc

SEQ ID NO: 103710 - DNA, 25 bp, Homo sapien
tgaagaatccctgatgtcttattgg

SEQ ID NO: 103711 - DNA, 25 bp, Homo sapien
ttggaacaaccactgagctacggag

SEQ ID NO: 103712 - DNA, 25 bp, Homo sapien
aaccactgagctacggagagctctg

SEQ ID NO: 103713 - DNA, 25 bp, Homo sapien
agctctgctgtgatgggctaggcac

SEQ ID NO: 103714 - DNA, 25 bp, Homo sapien
ggctaggcactttatatctgtgtga

SEQ ID NO: 103715 - DNA, 25 bp, Homo sapien
aaacctggtctaagtgcaaggcaca

SEQ ID NO: 103716 - DNA, 25 bp, Homo sapien
tgcaaggcacacttacagcgagttt

SEQ ID NO: 103717 - DNA, 25 bp, Homo sapien
cagcgagttttactttcggttgtat

SEQ ID NO: 103718 - DNA, 25 bp, Homo sapien
ttatttaacttgttgccgtttgaag

SEQ ID NO: 103719 - DNA, 25 bp, Homo sapien
atttccaaaatgtatgctcaacaat

SEQ ID NO: 103720 - DNA, 25 bp, Homo sapien
tattctagtgttctctctttgtttg

SEQ ID NO: 103721 - DNA, 25 bp, Homo sapien
gtgttctctctttgtttggcatata

SEQ ID NO: 103722 - DNA, 25 bp, Homo sapien
tgtttggcatataatcatgcaccaa

SEQ ID NO: 103723 - DNA, 25 bp, Homo sapien
atcatgcaccaaactttttatttct

SEQ ID NO: 103724 - DNA, 25 bp, Homo sapien
tttatttcctaaatgccatactatg

SEQ ID NO: 103725 - DNA, 25 bp, Homo sapien
aagtcttaagtgtgtttgcagctca

SEQ ID NO: 103726 - DNA, 25 bp, Homo sapien
ggagcaggagtgactccccaccgag

SEQ ID NO: 103727 - DNA, 25 bp, Homo sapien
agcgctccctacaaaggctctgaga

SEQ ID NO: 103728 - DNA, 25 bp, Homo sapien
gggctcccggaagtccaaggactgc

SEQ ID NO: 103729 - DNA, 25 bp, Homo sapien
gaagtccaaggactgcaagtacccc

SEQ ID NO: 103730 - DNA, 25 bp, Homo sapien
agaagccacacaagtctcggagccg

SEQ ID NO: 103731 - DNA, 25 bp, Homo sapien
acaagtctcggagccggagttcttc

SEQ ID NO: 103732 - DNA, 25 bp, Homo sapien
ggagttcttcccgttctcgaagcag

SEQ ID NO: 103733 - DNA, 25 bp, Homo sapien
cgttctcgaagcaggtcacgggagc

SEQ ID NO: 103734 - DNA, 25 bp, Homo sapien
attactacagagatcagcgacgaga

SEQ ID NO: 103735 - DNA, 25 bp, Homo sapien
cgagagcgctcgaggtcgtatgaac

SEQ ID NO: 103736 - DNA, 25 bp, Homo sapien
gtatgaacgcacaggccgtcgctat

SEQ ID NO: 103737 - DNA, 25 bp, Homo sapien
aggcgtcaccttcatgttttatacc

SEQ ID NO: 103738 - DNA, 25 bp, Homo sapien
gtcaccttcatgttttataccactg

SEQ ID NO: 103739 - DNA, 25 bp, Homo sapien
ataccactgttatggtgtgggagac

SEQ ID NO: 103740 - DNA, 25 bp, Homo sapien
ttatggtgtgggagacatgtcttaa

SEQ ID NO: 103741 - DNA, 25 bp, Homo sapien
agacatgtcttaatgttctttcaga

SEQ ID NO: 103742 - DNA, 25 bp, Homo sapien
tctttcagattatgtacctctacta

SEQ ID NO: 103743 - DNA, 25 bp, Homo sapien
gattatgtacctctactattttgta

SEQ ID NO: 103744 - DNA, 25 bp, Homo sapien
aaggagcctacttagagcagaagaa

SEQ ID NO: 103745 - DNA, 25 bp, Homo sapien
agcaaacaccaagatgcctttttaa

SEQ ID NO: 103746 - DNA, 25 bp, Homo sapien
tttcttactttattgtggatcctat

SEQ ID NO: 103747 - DNA, 25 bp, Homo sapien
attgtggatcctatcaggcgtcacc

SEQ ID NO: 103748 - DNA, 25 bp, Homo sapien
ggacttgggcattccagcaatgaca

SEQ ID NO: 103749 - DNA, 25 bp, Homo sapien
gctgcaaccagctggatgtctgtta

SEQ ID NO: 103750 - DNA, 25 bp, Homo sapien
gtctgttatgacacttgcggtgcca

SEQ ID NO: 103751 - DNA, 25 bp, Homo sapien
cggtgccaacaaatatcgctgtgat

SEQ ID NO: 103752 - DNA, 25 bp, Homo sapien
cgctgtgatgcaaaattccgatggt

SEQ ID NO: 103753 - DNA, 25 bp, Homo sapien
tccgatggtgtctccactcgatctg

SEQ ID NO: 103754 - DNA, 25 bp, Homo sapien
gatctgctctgaccttaagcggagt

SEQ ID NO: 103755 - DNA, 25 bp, Homo sapien
tgattccctggttgacactgtgttc

SEQ ID NO: 103756 - DNA, 25 bp, Homo sapien
ttcaacaccgtgtggaccttgggct

SEQ ID NO: 103757 - DNA, 25 bp, Homo sapien
tgccgcccctttatgaatagtcagc

SEQ ID NO: 103758 - DNA, 25 bp, Homo sapien
tagtcagcgggcagcttgcatctgt

SEQ ID NO: 103759 - DNA, 25 bp, Homo sapien
cacttatttcaggtaatagcttggg

SEQ ID NO: 103760 - DNA, 25 bp, Homo sapien
ccccaacaaatcttctaagtgcatt

SEQ ID NO: 103761 - DNA, 25 bp, Homo sapien
gtgcatttttgatcactttgataac

SEQ ID NO: 103762 - DNA, 25 bp, Homo sapien
ttgataacttcttaggtgatttgcc

SEQ ID NO: 103763 - DNA, 25 bp, Homo sapien
ggtgatttgcctgttttgtcttaaa

SEQ ID NO: 103764 - DNA, 25 bp, Homo sapien
ttacatattagactttctctcccct

SEQ ID NO: 103765 - DNA, 25 bp, Homo sapien
ttagactttctctcccctggaagca

SEQ ID NO: 103766 - DNA, 25 bp, Homo sapien
ccctggaagcactgggttgaacttg

SEQ ID NO: 103767 - DNA, 25 bp, Homo sapien
gcactgggttgaacttgctaaagta

SEQ ID NO: 103768 - DNA, 25 bp, Homo sapien
aaatcatactttagaatctcttcag

SEQ ID NO: 103769 - DNA, 25 bp, Homo sapien
atctcttcagggaatgtgacataca

SEQ ID NO: 103770 - DNA, 25 bp, Homo sapien
atctgtccgtggaaaatttcagtcc

SEQ ID NO: 103771 - DNA, 25 bp, Homo sapien
gtccagaagaattgaccttgaccat

SEQ ID NO: 103772 - DNA, 25 bp, Homo sapien
gaccttgaccattaataaagacact

SEQ ID NO: 103773 - DNA, 25 bp, Homo sapien
actggcagagagatcttcccataat

SEQ ID NO: 103774 - DNA, 25 bp, Homo sapien
gatcttcccataataaagcaatctg

SEQ ID NO: 103775 - DNA, 25 bp, Homo sapien
aagcaatctgattcagcatcactaa

SEQ ID NO: 103776 - DNA, 25 bp, Homo sapien
gattcagcatcactaaaccgataat

SEQ ID NO: 103777 - DNA, 25 bp, Homo sapien
gagcagcatttttaattttcacaaa

SEQ ID NO: 103778 - DNA, 25 bp, Homo sapien
aaatgtctcagttttcagctatacc

SEQ ID NO: 103779 - DNA, 25 bp, Homo sapien
taaaccgtggtctcatgtaacacat

SEQ ID NO: 103780 - DNA, 25 bp, Homo sapien
acaattcatgcctttcatagtttat

SEQ ID NO: 103781 - DNA, 25 bp, Homo sapien
tttttcaccagtcaggttaagcaga

SEQ ID NO: 103782 - DNA, 25 bp, Homo sapien
gttaagcagacacgagattccctcc

SEQ ID NO: 103783 - DNA, 25 bp, Homo sapien
attccctcctgatccatttacagga

SEQ ID NO: 103784 - DNA, 25 bp, Homo sapien
agaaatccccaggttgccaaggctt

SEQ ID NO: 103785 - DNA, 25 bp, Homo sapien
aacaacatttcaagcctgttctcca

SEQ ID NO: 103786 - DNA, 25 bp, Homo sapien
aagcctgttctccatatctgaaact

SEQ ID NO: 103787 - DNA, 25 bp, Homo sapien
ggaggaatacagcttccagagtgaa

SEQ ID NO: 103788 - DNA, 25 bp, Homo sapien
aaggaacactaagctctaccagcag

SEQ ID NO: 103789 - DNA, 25 bp, Homo sapien
agctgagccactatcatccagagat

SEQ ID NO: 103790 - DNA, 25 bp, Homo sapien
tcatccagagatcctgcagttcttc

SEQ ID NO: 103791 - DNA, 25 bp, Homo sapien
gcagttcttctacgcaaataaaatt

SEQ ID NO: 103792 - DNA, 25 bp, Homo sapien
tggcagttactgaggcaaaattttc

SEQ ID NO: 103793 - DNA, 25 bp, Homo sapien
tgaggcaaaattttccgctcctttg

SEQ ID NO: 103794 - DNA, 25 bp, Homo sapien
aaattttccgctcctttgtattctg

SEQ ID NO: 103795 - DNA, 25 bp, Homo sapien
ggatctacatggatgttctgttctc

SEQ ID NO: 103796 - DNA, 25 bp, Homo sapien
ggatgttctgttctctgaactgtct

SEQ ID NO: 103797 - DNA, 25 bp, Homo sapien
gaactgtctggatgaaccggtcaac

SEQ ID NO: 103798 - DNA, 25 bp, Homo sapien
ggatgaaccggtcaacggcactcat

SEQ ID NO: 103799 - DNA, 25 bp, Homo sapien
aacggcactcatcataccttagttt

SEQ ID NO: 103800 - DNA, 25 bp, Homo sapien
atcataccttagtttttaaatctgc

SEQ ID NO: 103801 - DNA, 25 bp, Homo sapien
aatctgcattgtggtcataatctgt

SEQ ID NO: 103802 - DNA, 25 bp, Homo sapien
cattgtggtcataatctgttattta

SEQ ID NO: 103803 - DNA, 25 bp, Homo sapien
gggtcaggcaaacttctgtttcagt

SEQ ID NO: 103804 - DNA, 25 bp, Homo sapien
gtttcagtataaaattcatcatgca

SEQ ID NO: 103805 - DNA, 25 bp, Homo sapien
atcatgcaggcttctgagtgaaata

SEQ ID NO: 103806 - DNA, 25 bp, Homo sapien
gaatgatttgaaaccactactgtat

SEQ ID NO: 103807 - DNA, 25 bp, Homo sapien
gaaaccactactgtattgcctggat

SEQ ID NO: 103808 - DNA, 25 bp, Homo sapien
tgtattgcctggatacacacacaca

SEQ ID NO: 103809 - DNA, 25 bp, Homo sapien
caggtttcctggcatgttctaaact

SEQ ID NO: 103810 - DNA, 25 bp, Homo sapien
ctggcatgttctaaactgttttttc

SEQ ID NO: 103811 - DNA, 25 bp, Homo sapien
taaattacatttatctgcacagatg

SEQ ID NO: 103812 - DNA, 25 bp, Homo sapien
gatgttgaaaatcctgttaaaccct

SEQ ID NO: 103813 - DNA, 25 bp, Homo sapien
tcctgttaaacccttgtcaaggatt

SEQ ID NO: 103814 - DNA, 25 bp, Homo sapien
ggcgaccgccctccgcgaaaatagt

SEQ ID NO: 103815 - DNA, 25 bp, Homo sapien
gtttaatgtgaacttgtagctgtaa

SEQ ID NO: 103816 - DNA, 25 bp, Homo sapien
acttgtagctgtaaaacgctgtcaa

SEQ ID NO: 103817 - DNA, 25 bp, Homo sapien
aatgcctagtttttagtaatctgta

SEQ ID NO: 103818 - DNA, 25 bp, Homo sapien
tccccagcccttcacattttttatg

SEQ ID NO: 103819 - DNA, 25 bp, Homo sapien
tcacattttttatgggcattgacaa

SEQ ID NO: 103820 - DNA, 25 bp, Homo sapien
gtgtatattatttggcagtttggta

SEQ ID NO: 103821 - DNA, 25 bp, Homo sapien
cagtttggtatttgcggcgtcagtc

SEQ ID NO: 103822 - DNA, 25 bp, Homo sapien
gtatttgcggcgtcagtctttttct

SEQ ID NO: 103823 - DNA, 25 bp, Homo sapien
gtcagtctttttctgttgtaactta

SEQ ID NO: 103824 - DNA, 25 bp, Homo sapien
gtaacttatgtagatatttggctta

SEQ ID NO: 103825 - DNA, 25 bp, Homo sapien
tttgtgtgtgtctaataaccaggaa

SEQ ID NO: 103826 - DNA, 25 bp, Homo sapien
gtgtgtgtctaataaccaggaaaaa

SEQ ID NO: 103827 - DNA, 25 bp, Homo sapien
tttcagaaactgtcaaatgtaccat

SEQ ID NO: 103828 - DNA, 25 bp, Homo sapien
aatgtaccatatttgtattaagagt

SEQ ID NO: 103829 - DNA, 25 bp, Homo sapien
gttgggaatttttgtacaatgaatt

SEQ ID NO: 103830 - DNA, 25 bp, Homo sapien
tatggtgacatatttacgcttgtga

SEQ ID NO: 103831 - DNA, 25 bp, Homo sapien
gacatatttacgcttgtgatcaaat

SEQ ID NO: 103832 - DNA, 25 bp, Homo sapien
ttcttaaatcatatttgctatgcag

SEQ ID NO: 103833 - DNA, 25 bp, Homo sapien
atttgctatgcagctgaagatgata

SEQ ID NO: 103834 - DNA, 25 bp, Homo sapien
gctatgcagctgaagatgatatttt

SEQ ID NO: 103835 - DNA, 25 bp, Homo sapien
gagttgataaacatttccatcttca

SEQ ID NO: 103836 - DNA, 25 bp, Homo sapien
gaaacacagcagtctagggggccat

SEQ ID NO: 103837 - DNA, 25 bp, Homo sapien
aaacacagcagtctagggggccatg

SEQ ID NO: 103838 - DNA, 25 bp, Homo sapien
acacagcagtctagggggccatgat

SEQ ID NO: 103839 - DNA, 25 bp, Homo sapien
cacagcagtctagggggccatgatc

SEQ ID NO: 103840 - DNA, 25 bp, Homo sapien
gtctagggggccatgatctaatcat

SEQ ID NO: 103841 - DNA, 25 bp, Homo sapien
tctagggggccatgatctaatcatc

SEQ ID NO: 103842 - DNA, 25 bp, Homo sapien
ctagggggccatgatctaatcatcc

SEQ ID NO: 103843 - DNA, 25 bp, Homo sapien
tagggggccatgatctaatcatcca

SEQ ID NO: 103844 - DNA, 25 bp, Homo sapien
agggggccatgatctaatcatccat

SEQ ID NO: 103845 - DNA, 25 bp, Homo sapien
gggccatgatctaatcatccattgg

SEQ ID NO: 103846 - DNA, 25 bp, Homo sapien
ggccatgatctaatcatccattggg

SEQ ID NO: 103847 - DNA, 25 bp, Homo sapien
tggctgtgagatgtgtagcacccag

SEQ ID NO: 103848 - DNA, 25 bp, Homo sapien
ggctgtgagatgtgtagcacccaga

SEQ ID NO: 103849 - DNA, 25 bp, Homo sapien
acctagcagccaccagaggttacaa

SEQ ID NO: 103850 - DNA, 25 bp, Homo sapien
cctagcagccaccagaggttacaag

SEQ ID NO: 103851 - DNA, 25 bp, Homo sapien
tagcagccaccagaggttacaaggg

SEQ ID NO: 103852 - DNA, 25 bp, Homo sapien
caaggggagagtggcccttccctca

SEQ ID NO: 103853 - DNA, 25 bp, Homo sapien
tcacaagtccgacatctccaggccc

SEQ ID NO: 103854 - DNA, 25 bp, Homo sapien
gaactccggggacctctactgactg

SEQ ID NO: 103855 - DNA, 25 bp, Homo sapien
tactgactgcttgctgggacagtca

SEQ ID NO: 103856 - DNA, 25 bp, Homo sapien
tgactgcttgctgggacagtcacca

SEQ ID NO: 103857 - DNA, 25 bp, Homo sapien
tgaaaccattaaagacccttaagag

SEQ ID NO: 103858 - DNA, 25 bp, Homo sapien
acggaggctgtggatctgatcacca

SEQ ID NO: 103859 - DNA, 25 bp, Homo sapien
gtgctgtgctctacaagacttttgt

SEQ ID NO: 103860 - DNA, 25 bp, Homo sapien
aagacttttgtccacgtggttcctg

SEQ ID NO: 103861 - DNA, 25 bp, Homo sapien
ttttgtccacgtggttcctgccaag

SEQ ID NO: 103862 - DNA, 25 bp, Homo sapien
ggcaccttcaaactggtagctatgc

SEQ ID NO: 103863 - DNA, 25 bp, Homo sapien
ggtagctatgctttgatgtcctgtt

SEQ ID NO: 103864 - DNA, 25 bp, Homo sapien
atggtgataccagaagtcaagggtt

SEQ ID NO: 103865 - DNA, 25 bp, Homo sapien
aggtctgcttgatggtgactctgca

SEQ ID NO: 103866 - DNA, 25 bp, Homo sapien
ttgatggtgactctgcaggagactc

SEQ ID NO: 103867 - DNA, 25 bp, Homo sapien
gagactctgaagtgactgctgggaa

SEQ ID NO: 103868 - DNA, 25 bp, Homo sapien
gtgactgctgggaaaccctttggga

SEQ ID NO: 103869 - DNA, 25 bp, Homo sapien
tgaccgggactgacccgccttcggg

SEQ ID NO: 103870 - DNA, 25 bp, Homo sapien
tcccagctctgagaggtcgccaaag

SEQ ID NO: 103871 - DNA, 25 bp, Homo sapien
gaggtcgccaaagcctgcagcctgg

SEQ ID NO: 103872 - DNA, 25 bp, Homo sapien
ccccgaggagcctaataaagatctc

SEQ ID NO: 103873 - DNA, 25 bp, Homo sapien
aataaagatctcgttgtggcaaaaa

SEQ ID NO: 103874 - DNA, 25 bp, Homo sapien
aggacaaggtggaccggctgatcat

SEQ ID NO: 103875 - DNA, 25 bp, Homo sapien
aggtggaccggctgatcatctgcgt

SEQ ID NO: 103876 - DNA, 25 bp, Homo sapien
tgatcatctgcgtgttcctcgagaa

SEQ ID NO: 103877 - DNA, 25 bp, Homo sapien
atctgcgtgttcctcgagaaggacg

SEQ ID NO: 103878 - DNA, 25 bp, Homo sapien
gagaaggacgaggacatctaccgga

SEQ ID NO: 103879 - DNA, 25 bp, Homo sapien
acgaggacatctaccggagccggct

SEQ ID NO: 103880 - DNA, 25 bp, Homo sapien
gtgtgcctagattgatcggtataag

SEQ ID NO: 103881 - DNA, 25 bp, Homo sapien
tgatcggtataaggctcactctccc

SEQ ID NO: 103882 - DNA, 25 bp, Homo sapien
caaagtggttgatcgttggaacgag

SEQ ID NO: 103883 - DNA, 25 bp, Homo sapien
gggccatgttcggagtgtatgacaa

SEQ ID NO: 103884 - DNA, 25 bp, Homo sapien
gacaacatcgggatcctgggaaact

SEQ ID NO: 103885 - DNA, 25 bp, Homo sapien
aaaagcaccccaaagaactgatcag

SEQ ID NO: 103886 - DNA, 25 bp, Homo sapien
gaattgcaacgttgtatccgaaaga

SEQ ID NO: 103887 - DNA, 25 bp, Homo sapien
gaatgttcgctgatgacctgcacaa

SEQ ID NO: 103888 - DNA, 25 bp, Homo sapien
gatgacctgcacaaccttaataaac

SEQ ID NO: 103889 - DNA, 25 bp, Homo sapien
taataaacgcatccgctatctctac

SEQ ID NO: 103890 - DNA, 25 bp, Homo sapien
tacaaacactttaaccgacatggga

SEQ ID NO: 103891 - DNA, 25 bp, Homo sapien
cttgaggaaggatccagagccagaa

SEQ ID NO: 103892 - DNA, 25 bp, Homo sapien
agagccagaagatgaggttccagac

SEQ ID NO: 103893 - DNA, 25 bp, Homo sapien
aagatgaggttccagacgtcaaact

SEQ ID NO: 103894 - DNA, 25 bp, Homo sapien
gactgcacagggaatgaagcgctct

SEQ ID NO: 103895 - DNA, 25 bp, Homo sapien
ctaatttgaagagagccgccacgta

SEQ ID NO: 103896 - DNA, 25 bp, Homo sapien
agagagccgccacgtaacctctctg

SEQ ID NO: 103897 - DNA, 25 bp, Homo sapien
tgtgctgccctgcacctaggagaga

SEQ ID NO: 103898 - DNA, 25 bp, Homo sapien
gctgccctgcacctaggagagactc

SEQ ID NO: 103899 - DNA, 25 bp, Homo sapien
agcccctcacagcttgggatgttac

SEQ ID NO: 103900 - DNA, 25 bp, Homo sapien
acagcttgggatgttaccttgcctt

SEQ ID NO: 103901 - DNA, 25 bp, Homo sapien
ggatgttaccttgccttttgtttgt

SEQ ID NO: 103902 - DNA, 25 bp, Homo sapien
gggctgctcttggaaatgaagtctt

SEQ ID NO: 103903 - DNA, 25 bp, Homo sapien
ttaagtactgaataactcccctggg

SEQ ID NO: 103904 - DNA, 25 bp, Homo sapien
tttgccatagctcagaccacttctc

SEQ ID NO: 103905 - DNA, 25 bp, Homo sapien
agaccacttctcatcgttcagggat

SEQ ID NO: 103906 - DNA, 25 bp, Homo sapien
gttcagggatggactgcaaccttaa

SEQ ID NO: 103907 - DNA, 25 bp, Homo sapien
caaccttaatttacttgccggagtg

SEQ ID NO: 103908 - DNA, 25 bp, Homo sapien
cttgccggagtgtacattctagtgt

SEQ ID NO: 103909 - DNA, 25 bp, Homo sapien
tctagtgtggtgtatactggtggct

SEQ ID NO: 103910 - DNA, 25 bp, Homo sapien
atgcttgtgtttttcggaagtgtga

SEQ ID NO: 103911 - DNA, 25 bp, Homo sapien
aagtgtgatgcttctctttgactgc

SEQ ID NO: 103912 - DNA, 25 bp, Homo sapien
ttctctttgactgccaaactctttt

SEQ ID NO: 103913 - DNA, 25 bp, Homo sapien
cggccccgcccatgaggactaggag

SEQ ID NO: 103914 - DNA, 25 bp, Homo sapien
atgaggactaggagcccagccttgc

SEQ ID NO: 103915 - DNA, 25 bp, Homo sapien
taggagcccagccttgcgccgcatt

SEQ ID NO: 103916 - DNA, 25 bp, Homo sapien
agccttgcgccgcattcgcactggg

SEQ ID NO: 103917 - DNA, 25 bp, Homo sapien
tggaggcagcgctggtcgtcacctg

SEQ ID NO: 103918 - DNA, 25 bp, Homo sapien
tggtcgtcacctgggcggccagagg

SEQ ID NO: 103919 - DNA, 25 bp, Homo sapien
aggctgggatctgcgaagttgaacc

SEQ ID NO: 103920 - DNA, 25 bp, Homo sapien
ggatctgcgaagttgaacccagaac

SEQ ID NO: 103921 - DNA, 25 bp, Homo sapien
tgcgaagttgaacccagaactagga

SEQ ID NO: 103922 - DNA, 25 bp, Homo sapien
aagttgaacccagaactaggagtgg

SEQ ID NO: 103923 - DNA, 25 bp, Homo sapien
gtggacggagccaaaggccgtgcct

SEQ ID NO: 103924 - DNA, 25 bp, Homo sapien
agagacgcccctgctaacgggaatg

SEQ ID NO: 103925 - DNA, 25 bp, Homo sapien
gagacgcccctgctaacgggaatgc

SEQ ID NO: 103926 - DNA, 25 bp, Homo sapien
agacgcccctgctaacgggaatgct

SEQ ID NO: 103927 - DNA, 25 bp, Homo sapien
gacgcccctgctaacgggaatgcta

SEQ ID NO: 103928 - DNA, 25 bp, Homo sapien
acgcccctgctaacgggaatgctaa

SEQ ID NO: 103929 - DNA, 25 bp, Homo sapien
gcccctgctaacgggaatgctaatg

SEQ ID NO: 103930 - DNA, 25 bp, Homo sapien
taacgggaatgctaatgaggaaaat

SEQ ID NO: 103931 - DNA, 25 bp, Homo sapien
gcaggaggctgacaatgaggtagac

SEQ ID NO: 103932 - DNA, 25 bp, Homo sapien
ggaggctgacaatgaggtagacgaa

SEQ ID NO: 103933 - DNA, 25 bp, Homo sapien
gacgatgtcgataccaagaagcaga

SEQ ID NO: 103934 - DNA, 25 bp, Homo sapien
gaaaatggaagagacgcccctgcta

SEQ ID NO: 103935 - DNA, 25 bp, Homo sapien
tcgaggactactcggaggacatgaa

SEQ ID NO: 103936 - DNA, 25 bp, Homo sapien
acatgaaggactgtcaggcatgcca

SEQ ID NO: 103937 - DNA, 25 bp, Homo sapien
aggactgtcaggcatgccagggccc

SEQ ID NO: 103938 - DNA, 25 bp, Homo sapien
agggcccctcagactgactgctcag

SEQ ID NO: 103939 - DNA, 25 bp, Homo sapien
aactggggcatgaacaggacctgca

SEQ ID NO: 103940 - DNA, 25 bp, Homo sapien
aggactttgcctaccccagctgtgt

SEQ ID NO: 103941 - DNA, 25 bp, Homo sapien
ttgcctaccccagctgtgttataaa

SEQ ID NO: 103942 - DNA, 25 bp, Homo sapien
ctaccccagctgtgttataaaccag

SEQ ID NO: 103943 - DNA, 25 bp, Homo sapien
ctcccatctgactacagccagggtg

SEQ ID NO: 103944 - DNA, 25 bp, Homo sapien
gggactcagcgggtataaagctagt

SEQ ID NO: 103945 - DNA, 25 bp, Homo sapien
ctcagcgggtataaagctagtgtga

SEQ ID NO: 103946 - DNA, 25 bp, Homo sapien
caacctcccctgtgggtgtcactgg

SEQ ID NO: 103947 - DNA, 25 bp, Homo sapien
cccctgtgggtgtcactggccagat

SEQ ID NO: 103948 - DNA, 25 bp, Homo sapien
atgtcatgagggaagcaggccttgt

SEQ ID NO: 103949 - DNA, 25 bp, Homo sapien
gaagcaggccttgtgagtggacact

SEQ ID NO: 103950 - DNA, 25 bp, Homo sapien
ggccttgtgagtggacactgaccat

SEQ ID NO: 103951 - DNA, 25 bp, Homo sapien
tggacactgaccatgagtccctggg

SEQ ID NO: 103952 - DNA, 25 bp, Homo sapien
caggcatcgtgtgccatgttgcact

SEQ ID NO: 103953 - DNA, 25 bp, Homo sapien
atcgtgtgccatgttgcacttctgc

SEQ ID NO: 103954 - DNA, 25 bp, Homo sapien
ccatgttgcacttctgcccaggcag

SEQ ID NO: 103955 - DNA, 25 bp, Homo sapien
ggtgggtgggtaccatgggtgccca

SEQ ID NO: 103956 - DNA, 25 bp, Homo sapien
gggccccaaagcactgcaggccaag

SEQ ID NO: 103957 - DNA, 25 bp, Homo sapien
ccatggttgttgttagggatagtac

SEQ ID NO: 103958 - DNA, 25 bp, Homo sapien
gggatagtactaagcatttcagttc

SEQ ID NO: 103959 - DNA, 25 bp, Homo sapien
aagcatttcagttccaggagaataa

SEQ ID NO: 103960 - DNA, 25 bp, Homo sapien
aaaagcatgcattctagcacaacaa

SEQ ID NO: 103961 - DNA, 25 bp, Homo sapien
gcatgcattctagcacaacaagatg

SEQ ID NO: 103962 - DNA, 25 bp, Homo sapien
gcattctagcacaacaagatgaaat

SEQ ID NO: 103963 - DNA, 25 bp, Homo sapien
tcctccacacccaaactgtttctga

SEQ ID NO: 103964 - DNA, 25 bp, Homo sapien
aacacttgtatttggaggctcttct

SEQ ID NO: 103965 - DNA, 25 bp, Homo sapien
acacttgtatttggaggctcttctg

SEQ ID NO: 103966 - DNA, 25 bp, Homo sapien
cttgtatttggaggctcttctgtga

SEQ ID NO: 103967 - DNA, 25 bp, Homo sapien
ctgtgattttgagaagtatactctt

SEQ ID NO: 103968 - DNA, 25 bp, Homo sapien
cggccggacctcagcaataaggcgg

SEQ ID NO: 103969 - DNA, 25 bp, Homo sapien
ggccggacctcagcaataaggcggc

SEQ ID NO: 103970 - DNA, 25 bp, Homo sapien
gccggacctcagcaataaggcggcc

SEQ ID NO: 103971 - DNA, 25 bp, Homo sapien
ccggacctcagcaataaggcggccc

SEQ ID NO: 103972 - DNA, 25 bp, Homo sapien
cggacctcagcaataaggcggcccc

SEQ ID NO: 103973 - DNA, 25 bp, Homo sapien
gacctcagcaataaggcggcccccg

SEQ ID NO: 103974 - DNA, 25 bp, Homo sapien
cctcagcaataaggcggcccccgga

SEQ ID NO: 103975 - DNA, 25 bp, Homo sapien
ggctgtggacgatgtacaggcaaca

SEQ ID NO: 103976 - DNA, 25 bp, Homo sapien
gctgtggacgatgtacaggcaacag

SEQ ID NO: 103977 - DNA, 25 bp, Homo sapien
ctgtggacgatgtacaggcaacaga

SEQ ID NO: 103978 - DNA, 25 bp, Homo sapien
gcaagaagaaaatacgtgaaaacgg

SEQ ID NO: 103979 - DNA, 25 bp, Homo sapien
attttctcctccgtcctaagagtat

SEQ ID NO: 103980 - DNA, 25 bp, Homo sapien
tccgtcctaagagtatctgccagag

SEQ ID NO: 103981 - DNA, 25 bp, Homo sapien
aagagtatctgccagaggccagcac

SEQ ID NO: 103982 - DNA, 25 bp, Homo sapien
gtatctgccagaggccagcacaaag

SEQ ID NO: 103983 - DNA, 25 bp, Homo sapien
agaggccagcacaaagccttttcca

SEQ ID NO: 103984 - DNA, 25 bp, Homo sapien
gtcagcttgttctatggcactggcc

SEQ ID NO: 103985 - DNA, 25 bp, Homo sapien
atctcagttctgcagttacaccacc

SEQ ID NO: 103986 - DNA, 25 bp, Homo sapien
agttctgcagttacaccaccttcta

SEQ ID NO: 103987 - DNA, 25 bp, Homo sapien
aagtctggcagcctcggtgatgtac

SEQ ID NO: 103988 - DNA, 25 bp, Homo sapien
cctcctcagggcaacgtctctcaaa

SEQ ID NO: 103989 - DNA, 25 bp, Homo sapien
gaggggaccattgctaagctctcat

SEQ ID NO: 103990 - DNA, 25 bp, Homo sapien
atgtaattggcttccttctgtttaa

SEQ ID NO: 103991 - DNA, 25 bp, Homo sapien
caggtcctgcagaatactccacaag

SEQ ID NO: 103992 - DNA, 25 bp, Homo sapien
agaatactccacaaggctctgtcca

SEQ ID NO: 103993 - DNA, 25 bp, Homo sapien
ttgtgcctcccattttatggtggta

SEQ ID NO: 103994 - DNA, 25 bp, Homo sapien
ttttctatggacctgtgggcttcac

SEQ ID NO: 103995 - DNA, 25 bp, Homo sapien
tgggcttcacatatattcgtcctgc

SEQ ID NO: 103996 - DNA, 25 bp, Homo sapien
ttcagccacctccatgattcaggac

SEQ ID NO: 103997 - DNA, 25 bp, Homo sapien
attcaggaccggataatggccatca

SEQ ID NO: 103998 - DNA, 25 bp, Homo sapien
atggccatcatgtatagcgccgtca

SEQ ID NO: 103999 - DNA, 25 bp, Homo sapien
tcacccctgtactgaatccactaat

SEQ ID NO: 104000 - DNA, 25 bp, Homo sapien
tccactaatctacacccttaggaac

SEQ ID NO: 104001 - DNA, 25 bp, Homo sapien
caacgagaacctcctggcctgggtg

SEQ ID NO: 104002 - DNA, 25 bp, Homo sapien
gtgacaggcgcctttgagctctaca

SEQ ID NO: 104003 - DNA, 25 bp, Homo sapien
tgagctctacatgtgttacagcccc

SEQ ID NO: 104004 - DNA, 25 bp, Homo sapien
gaccaaggcgtcagccgtcagtgcc

SEQ ID NO: 104005 - DNA, 25 bp, Homo sapien
cgtcagtgccatccataagctgatg

SEQ ID NO: 104006 - DNA, 25 bp, Homo sapien
taagctgatgcgctggatccgcaaa

SEQ ID NO: 104007 - DNA, 25 bp, Homo sapien
gaggaagaccgcctcttcattctca

SEQ ID NO: 104008 - DNA, 25 bp, Homo sapien
acgcccctcacctattgatgggaat

SEQ ID NO: 104009 - DNA, 25 bp, Homo sapien
atgtgtgcgggctcagccttcctgg

SEQ ID NO: 104010 - DNA, 25 bp, Homo sapien
gtgtgggaagccataggagcctcca

SEQ ID NO: 104011 - DNA, 25 bp, Homo sapien
gactgtgggttggtgaatgcattaa

SEQ ID NO: 104012 - DNA, 25 bp, Homo sapien
tgcacatttagattggtccctaatt

SEQ ID NO: 104013 - DNA, 25 bp, Homo sapien
ttggtccctaattatgtgtgtctat

SEQ ID NO: 104014 - DNA, 25 bp, Homo sapien
gagagacatgtatttgcaccaaagg

SEQ ID NO: 104015 - DNA, 25 bp, Homo sapien
tatgatctacttacgcaatgtgcaa

SEQ ID NO: 104016 - DNA, 25 bp, Homo sapien
tggatggcagaaggattgttcttcc

SEQ ID NO: 104017 - DNA, 25 bp, Homo sapien
ccttgtttgtttgtaccagaactct

SEQ ID NO: 104018 - DNA, 25 bp, Homo sapien
gtttgtaccagaactcttcattgtt

SEQ ID NO: 104019 - DNA, 25 bp, Homo sapien
tacattttagccttggtgccatttt

SEQ ID NO: 104020 - DNA, 25 bp, Homo sapien
gaagctttatttgtctcacttactt

SEQ ID NO: 104021 - DNA, 25 bp, Homo sapien
tatttgtctcacttacttttttggt

SEQ ID NO: 104022 - DNA, 25 bp, Homo sapien
aatccatctgtgaagcatattgtat

SEQ ID NO: 104023 - DNA, 25 bp, Homo sapien
aaatgagcctcatccctttatgcaa

SEQ ID NO: 104024 - DNA, 25 bp, Homo sapien
gcctcatccctttatgcaacacata

SEQ ID NO: 104025 - DNA, 25 bp, Homo sapien
atgcaacacataaccttactgaggg

SEQ ID NO: 104026 - DNA, 25 bp, Homo sapien
caacacataaccttactgagggagg

SEQ ID NO: 104027 - DNA, 25 bp, Homo sapien
ctcttcactgtgtacaagttcactt

SEQ ID NO: 104028 - DNA, 25 bp, Homo sapien
acaagttcacttgttgtcttgaaca

SEQ ID NO: 104029 - DNA, 25 bp, Homo sapien
cttgttgtcttgaacactgtctcaa

SEQ ID NO: 104030 - DNA, 25 bp, Homo sapien
ttgaacactgtctcaaatacctgct

SEQ ID NO: 104031 - DNA, 25 bp, Homo sapien
agaagctggcctttccatagagagg

SEQ ID NO: 104032 - DNA, 25 bp, Homo sapien
ctttccatagagaggccctggagtc

SEQ ID NO: 104033 - DNA, 25 bp, Homo sapien
tctattatgatctcgttttgacaat

SEQ ID NO: 104034 - DNA, 25 bp, Homo sapien
ttccctttgtttagtgaaccttctg

SEQ ID NO: 104035 - DNA, 25 bp, Homo sapien
gtgaaccttctgatatattggatat

SEQ ID NO: 104036 - DNA, 25 bp, Homo sapien
ccatgaatgcagaagtgtgctattt

SEQ ID NO: 104037 - DNA, 25 bp, Homo sapien
gtgtgctatttatgtaatcatgaac

SEQ ID NO: 104038 - DNA, 25 bp, Homo sapien
tcattcattcaacatgtgttaaaac

SEQ ID NO: 104039 - DNA, 25 bp, Homo sapien
aaaactattatgtaacaggcatcat

SEQ ID NO: 104040 - DNA, 25 bp, Homo sapien
taacaggcatcatgttaggccttgg

SEQ ID NO: 104041 - DNA, 25 bp, Homo sapien
ggtgaacaacatgattcctgctctt

SEQ ID NO: 104042 - DNA, 25 bp, Homo sapien
gaacaacatgattcctgctcttaag

SEQ ID NO: 104043 - DNA, 25 bp, Homo sapien
gattcctgctcttaagttgcttaca

SEQ ID NO: 104044 - DNA, 25 bp, Homo sapien
gttgcttacaaagatcatggatgaa

SEQ ID NO: 104045 - DNA, 25 bp, Homo sapien
tcatttttaaatgctcagcctcaag

SEQ ID NO: 104046 - DNA, 25 bp, Homo sapien
cagcctcaagtgcaggcatttttga

SEQ ID NO: 104047 - DNA, 25 bp, Homo sapien
gcatttttgagtggcctgattacat

SEQ ID NO: 104048 - DNA, 25 bp, Homo sapien
tgattacatattcctcccacagcaa

SEQ ID NO: 104049 - DNA, 25 bp, Homo sapien
cacagcaagtccgtatcctggaagt

SEQ ID NO: 104050 - DNA, 25 bp, Homo sapien
ccgtatcctggaagtgttattttat

SEQ ID NO: 104051 - DNA, 25 bp, Homo sapien
tatgtcagagattgcatcatccttc

SEQ ID NO: 104052 - DNA, 25 bp, Homo sapien
atcatccttctgcttgtttacaact

SEQ ID NO: 104053 - DNA, 25 bp, Homo sapien
gcttgtttacaactatgatcttcta

SEQ ID NO: 104054 - DNA, 25 bp, Homo sapien
atcttctatgaaatggtggtaccaa

SEQ ID NO: 104055 - DNA, 25 bp, Homo sapien
aacagcttttatccccattcttaga

SEQ ID NO: 104056 - DNA, 25 bp, Homo sapien
taagaagcccattcctcggattagc

SEQ ID NO: 104057 - DNA, 25 bp, Homo sapien
attcctcggattagccaggctgaag

SEQ ID NO: 104058 - DNA, 25 bp, Homo sapien
gaccagcagcttctaggacacctac

SEQ ID NO: 104059 - DNA, 25 bp, Homo sapien
aggacacctactccttgtggccaag

SEQ ID NO: 104060 - DNA, 25 bp, Homo sapien
gagatggataccgacttgtgatcaa

SEQ ID NO: 104061 - DNA, 25 bp, Homo sapien
gacttgtgatcaacgatgggaagct

SEQ ID NO: 104062 - DNA, 25 bp, Homo sapien
gaagctgggtgcacaatctgtgtat

SEQ ID NO: 104063 - DNA, 25 bp, Homo sapien
tccagtggcctccaggttgaacctg

SEQ ID NO: 104064 - DNA, 25 bp, Homo sapien
caggttgaacctgccaactgattaa

SEQ ID NO: 104065 - DNA, 25 bp, Homo sapien
gattaaaggacaccagactctggat

SEQ ID NO: 104066 - DNA, 25 bp, Homo sapien
aaaatggaccctgtgatgctaataa

SEQ ID NO: 104067 - DNA, 25 bp, Homo sapien
ggagagagccctgaatcctttaact

SEQ ID NO: 104068 - DNA, 25 bp, Homo sapien
gccatcttaggcctggaagttagag

SEQ ID NO: 104069 - DNA, 25 bp, Homo sapien
ggcttctgggactgtgtcaagttga

SEQ ID NO: 104070 - DNA, 25 bp, Homo sapien
gtcatttaatttcagatcctagctc

SEQ ID NO: 104071 - DNA, 25 bp, Homo sapien
agatcctagctcatcatcagtgaag

SEQ ID NO: 104072 - DNA, 25 bp, Homo sapien
catcatcagtgaagtccagcctact

SEQ ID NO: 104073 - DNA, 25 bp, Homo sapien
agtccagcctacttacttgtaacta

SEQ ID NO: 104074 - DNA, 25 bp, Homo sapien
ttctaaaagttttcatcgccttggt

SEQ ID NO: 104075 - DNA, 25 bp, Homo sapien
tcatcgccttggtaaagctccagaa

SEQ ID NO: 104076 - DNA, 25 bp, Homo sapien
aatgctagtgactgcacaatattgt

SEQ ID NO: 104077 - DNA, 25 bp, Homo sapien
acaatattgtgactgtacttaatgc

SEQ ID NO: 104078 - DNA, 25 bp, Homo sapien
gcgtgcacctgccacgtgcggaacc

SEQ ID NO: 104079 - DNA, 25 bp, Homo sapien
gtgcggaacccactgtccgcctgct

SEQ ID NO: 104080 - DNA, 25 bp, Homo sapien
tgtccgcctgctccatcatgtagta

SEQ ID NO: 104081 - DNA, 25 bp, Homo sapien
gtccgcctgctccatcatgtagtag

SEQ ID NO: 104082 - DNA, 25 bp, Homo sapien
ccgcctgctccatcatgtagtagcg

SEQ ID NO: 104083 - DNA, 25 bp, Homo sapien
gcctgctccatcatgtagtagcgcc

SEQ ID NO: 104084 - DNA, 25 bp, Homo sapien
cctgctccatcatgtagtagcgcct

SEQ ID NO: 104085 - DNA, 25 bp, Homo sapien
atcatgtagtagcgcctgcctgccc

SEQ ID NO: 104086 - DNA, 25 bp, Homo sapien
ctgagcctcgctcgctgcttcttca

SEQ ID NO: 104087 - DNA, 25 bp, Homo sapien
accccgagtggcattgtcgctgcag

SEQ ID NO: 104088 - DNA, 25 bp, Homo sapien
ccgagtggcattgtcgctgcagcca

SEQ ID NO: 104089 - DNA, 25 bp, Homo sapien
gggcccgtccggcttgggctgtcgg

SEQ ID NO: 104090 - DNA, 25 bp, Homo sapien
cgggcttccggcattgagctgagtt

SEQ ID NO: 104091 - DNA, 25 bp, Homo sapien
gcttccggcattgagctgagttggc

SEQ ID NO: 104092 - DNA, 25 bp, Homo sapien
ggcattgagctgagttggcctcgcc

SEQ ID NO: 104093 - DNA, 25 bp, Homo sapien
ttgagctgagttggcctcgcccgga

SEQ ID NO: 104094 - DNA, 25 bp, Homo sapien
ggcctcgcccggaccattaggcgga

SEQ ID NO: 104095 - DNA, 25 bp, Homo sapien
gaccattaggcggactgcggcgtca

SEQ ID NO: 104096 - DNA, 25 bp, Homo sapien
accattaggcggactgcggcgtcag

SEQ ID NO: 104097 - DNA, 25 bp, Homo sapien
cgcgtgctgcgctcagttctttgtt

SEQ ID NO: 104098 - DNA, 25 bp, Homo sapien
tgctgcgctcagttctttgttggat

SEQ ID NO: 104099 - DNA, 25 bp, Homo sapien
ctgcgctcagttctttgttggattt

SEQ ID NO: 104100 - DNA, 25 bp, Homo sapien
ctgaaactggagaaattatgactat

SEQ ID NO: 104101 - DNA, 25 bp, Homo sapien
aaatctgaatgtgtatggactaaaa

SEQ ID NO: 104102 - DNA, 25 bp, Homo sapien
attgctgagtaaactgcttaacttc

SEQ ID NO: 104103 - DNA, 25 bp, Homo sapien
gtaaactgcttaacttcaaagatag

SEQ ID NO: 104104 - DNA, 25 bp, Homo sapien
ttttgattcggaagactaagtctgg

SEQ ID NO: 104105 - DNA, 25 bp, Homo sapien
gactaagtctggagctagacattat

SEQ ID NO: 104106 - DNA, 25 bp, Homo sapien
gacattataatgctatcaaagaagt

SEQ ID NO: 104107 - DNA, 25 bp, Homo sapien
aagaagttgatctctgttttgacta

SEQ ID NO: 104108 - DNA, 25 bp, Homo sapien
tgatctctgttttgactaaactaga

SEQ ID NO: 104109 - DNA, 25 bp, Homo sapien
gattggatgagtttattcttttcta

SEQ ID NO: 104110 - DNA, 25 bp, Homo sapien
aagcagaatggtttaactttgtact

SEQ ID NO: 104111 - DNA, 25 bp, Homo sapien
tgagggcttgtgttcccagcagaca

SEQ ID NO: 104112 - DNA, 25 bp, Homo sapien
ttgtgttcccagcagacatctgacg

SEQ ID NO: 104113 - DNA, 25 bp, Homo sapien
gacatctgacgtagagacctgcgaa

SEQ ID NO: 104114 - DNA, 25 bp, Homo sapien
gacctgcgaatggatctgagatgag

SEQ ID NO: 104115 - DNA, 25 bp, Homo sapien
tgggatgctttttccctccggcaca

SEQ ID NO: 104116 - DNA, 25 bp, Homo sapien
acgcgctttctcacgggcttgattc

SEQ ID NO: 104117 - DNA, 25 bp, Homo sapien
ggcttgattcctgcctacagattgg

SEQ ID NO: 104118 - DNA, 25 bp, Homo sapien
ggttccgggatatttgttgagcgtt

SEQ ID NO: 104119 - DNA, 25 bp, Homo sapien
aaatgtagtagacgagaatccagat

SEQ ID NO: 104120 - DNA, 25 bp, Homo sapien
agaatccagatgagacacttgtcgc

SEQ ID NO: 104121 - DNA, 25 bp, Homo sapien
agatgagacacttgtcgcaaacatt

SEQ ID NO: 104122 - DNA, 25 bp, Homo sapien
aaaatctattggctctcgtgggtct

SEQ ID NO: 104123 - DNA, 25 bp, Homo sapien
tattggctctcgtgggtctcttcat

SEQ ID NO: 104124 - DNA, 25 bp, Homo sapien
gtgggtctcttcatctcagaaatgc

SEQ ID NO: 104125 - DNA, 25 bp, Homo sapien
ttcatctcagaaatgccaatcaggt

SEQ ID NO: 104126 - DNA, 25 bp, Homo sapien
atgccaatcaggtcaaggtttgcta

SEQ ID NO: 104127 - DNA, 25 bp, Homo sapien
ggtcaaggtttgctacattttgtat

SEQ ID NO: 104128 - DNA, 25 bp, Homo sapien
ttctcccaaaggtatattaactata

SEQ ID NO: 104129 - DNA, 25 bp, Homo sapien
gaatgataaagctgcgaaccgtggc

SEQ ID NO: 104130 - DNA, 25 bp, Homo sapien
ataaagctgcgaaccgtggcacacg

SEQ ID NO: 104131 - DNA, 25 bp, Homo sapien
gtggcacacgctcatagttctagct

SEQ ID NO: 104132 - DNA, 25 bp, Homo sapien
acacgctcatagttctagctgcttg

SEQ ID NO: 104133 - DNA, 25 bp, Homo sapien
gcagtcttctttaagttatgacaaa

SEQ ID NO: 104134 - DNA, 25 bp, Homo sapien
tgatgctctgactttataaaacccc

SEQ ID NO: 104135 - DNA, 25 bp, Homo sapien
aaggatctgaagtccatccccatag

SEQ ID NO: 104136 - DNA, 25 bp, Homo sapien
gaagtccatccccataggtggaaac

SEQ ID NO: 104137 - DNA, 25 bp, Homo sapien
ggagaacctctaattcagtcatgtc

SEQ ID NO: 104138 - DNA, 25 bp, Homo sapien
tcagtcatgtctttccacagatggg

SEQ ID NO: 104139 - DNA, 25 bp, Homo sapien
agctcagatagcttagtggatttgc

SEQ ID NO: 104140 - DNA, 25 bp, Homo sapien
gtggatttgctcaatgacgcacagt

SEQ ID NO: 104141 - DNA, 25 bp, Homo sapien
atgacgcacagttcattcattgcag

SEQ ID NO: 104142 - DNA, 25 bp, Homo sapien
agacctagccttacgatccaggatc

SEQ ID NO: 104143 - DNA, 25 bp, Homo sapien
aggatctcttcctacagcaatgcac

SEQ ID NO: 104144 - DNA, 25 bp, Homo sapien
agggtgagcacgcttgttggtttca

SEQ ID NO: 104145 - DNA, 25 bp, Homo sapien
atgcactttctgcttgcattgccgt

SEQ ID NO: 104146 - DNA, 25 bp, Homo sapien
actttctgcttgcattgccgtatct

SEQ ID NO: 104147 - DNA, 25 bp, Homo sapien
ttctgcttgcattgccgtatctgtg

SEQ ID NO: 104148 - DNA, 25 bp, Homo sapien
gcttgcattgccgtatctgtgcgtt

SEQ ID NO: 104149 - DNA, 25 bp, Homo sapien
tgcattgccgtatctgtgcgttcct

SEQ ID NO: 104150 - DNA, 25 bp, Homo sapien
ttgccgtatctgtgcgttccttcat

SEQ ID NO: 104151 - DNA, 25 bp, Homo sapien
cgtatctgtgcgttccttcatcctg

SEQ ID NO: 104152 - DNA, 25 bp, Homo sapien
cctggctttatggaacaccatgttt

SEQ ID NO: 104153 - DNA, 25 bp, Homo sapien
ggctttatggaacaccatgttttta

SEQ ID NO: 104154 - DNA, 25 bp, Homo sapien
tggaacaccatgtttttagcatgtt

SEQ ID NO: 104155 - DNA, 25 bp, Homo sapien
acctcagtgttcctaagtgctgata

SEQ ID NO: 104156 - DNA, 25 bp, Homo sapien
cctcagtgttcctaagtgctgatat

SEQ ID NO: 104157 - DNA, 25 bp, Homo sapien
cagtgttcctaagtgctgatattac

SEQ ID NO: 104158 - DNA, 25 bp, Homo sapien
gtgtctggttgctttcatgttgaat

SEQ ID NO: 104159 - DNA, 25 bp, Homo sapien
gtctggttgctttcatgttgaatgc

SEQ ID NO: 104160 - DNA, 25 bp, Homo sapien
ctggttgctttcatgttgaatgcta

SEQ ID NO: 104161 - DNA, 25 bp, Homo sapien
ggttgctttcatgttgaatgctatt

SEQ ID NO: 104162 - DNA, 25 bp, Homo sapien
gctttcatgttgaatgctatttttg

SEQ ID NO: 104163 - DNA, 25 bp, Homo sapien
tgctgtagtcttcccgagtcctcat

SEQ ID NO: 104164 - DNA, 25 bp, Homo sapien
ttcctactgcttccgtctatcaaaa

SEQ ID NO: 104165 - DNA, 25 bp, Homo sapien
actgcttccgtctatcaaaaagccc

SEQ ID NO: 104166 - DNA, 25 bp, Homo sapien
tggacctcaccaagtacatcgggat

SEQ ID NO: 104167 - DNA, 25 bp, Homo sapien
gggttcctcatactgctagaatcca

SEQ ID NO: 104168 - DNA, 25 bp, Homo sapien
agaatccacatctagccctgagcag

SEQ ID NO: 104169 - DNA, 25 bp, Homo sapien
tgagcagcatttccacgggtgtttc

SEQ ID NO: 104170 - DNA, 25 bp, Homo sapien
ccacgggtgtttcttcagaggacag

SEQ ID NO: 104171 - DNA, 25 bp, Homo sapien
tctcttgacctggatcagctcttac

SEQ ID NO: 104172 - DNA, 25 bp, Homo sapien
acaggagtatatcacggtcccagcc

SEQ ID NO: 104173 - DNA, 25 bp, Homo sapien
ggtcccagcctattttgcaagacac

SEQ ID NO: 104174 - DNA, 25 bp, Homo sapien
tttgttgagttttgtccacttcctg

SEQ ID NO: 104175 - DNA, 25 bp, Homo sapien
acttcctgccatggagtgagcttta

SEQ ID NO: 104176 - DNA, 25 bp, Homo sapien
tttagaaccatactaccatctccag

SEQ ID NO: 104177 - DNA, 25 bp, Homo sapien
tggagacagggagccccttctttct

SEQ ID NO: 104178 - DNA, 25 bp, Homo sapien
ttgtcacctactgtgataataaagc

SEQ ID NO: 104179 - DNA, 25 bp, Homo sapien
ataaagcagtgagtgctgagctctc

SEQ ID NO: 104180 - DNA, 25 bp, Homo sapien
acagcttcctggtggttggcccaca

SEQ ID NO: 104181 - DNA, 25 bp, Homo sapien
ttcctggtggttggcccacaggcac

SEQ ID NO: 104182 - DNA, 25 bp, Homo sapien
cacaggcactggaccccgtggtcag

SEQ ID NO: 104183 - DNA, 25 bp, Homo sapien
gaccccgtggtcagggattctgtac

SEQ ID NO: 104184 - DNA, 25 bp, Homo sapien
cgtggtcagggattctgtacctaaa

SEQ ID NO: 104185 - DNA, 25 bp, Homo sapien
gggattctgtacctaaagaacacat

SEQ ID NO: 104186 - DNA, 25 bp, Homo sapien
ttgactgcctagagggctcaactcc

SEQ ID NO: 104187 - DNA, 25 bp, Homo sapien
gggccctaggccatggagaaaacct

SEQ ID NO: 104188 - DNA, 25 bp, Homo sapien
aagaaagcaaggctaacggtgagca

SEQ ID NO: 104189 - DNA, 25 bp, Homo sapien
agaaagcaaggctaacggtgagcag

SEQ ID NO: 104190 - DNA, 25 bp, Homo sapien
gaaagcaaggctaacggtgagcagt

SEQ ID NO: 104191 - DNA, 25 bp, Homo sapien
aaagcaaggctaacggtgagcagtg

SEQ ID NO: 104192 - DNA, 25 bp, Homo sapien
aagcaaggctaacggtgagcagtgg

SEQ ID NO: 104193 - DNA, 25 bp, Homo sapien
caaggctaacggtgagcagtggcta

SEQ ID NO: 104194 - DNA, 25 bp, Homo sapien
aaggctaacggtgagcagtggctaa

SEQ ID NO: 104195 - DNA, 25 bp, Homo sapien
aggctaacggtgagcagtggctaaa

SEQ ID NO: 104196 - DNA, 25 bp, Homo sapien
cccaaatgtagtctgccttgaaaag

SEQ ID NO: 104197 - DNA, 25 bp, Homo sapien
aatgtagtctgccttgaaaagtctt

SEQ ID NO: 104198 - DNA, 25 bp, Homo sapien
atgtagtctgccttgaaaagtcttt

SEQ ID NO: 104199 - DNA, 25 bp, Homo sapien
agtctgccttgaaaagtctttcagc

SEQ ID NO: 104200 - DNA, 25 bp, Homo sapien
tgcaggaagtgggagtgtttttatt

SEQ ID NO: 104201 - DNA, 25 bp, Homo sapien
gtgggagtgtttttattgttagcta

SEQ ID NO: 104202 - DNA, 25 bp, Homo sapien
attgttagctaattgctgtgactgc

SEQ ID NO: 104203 - DNA, 25 bp, Homo sapien
tagctaattgctgtgactgcaggaa

SEQ ID NO: 104204 - DNA, 25 bp, Homo sapien
tgggagtgtttctgttgttggctaa

SEQ ID NO: 104205 - DNA, 25 bp, Homo sapien
gagtgtttctgttgttggctaattg

SEQ ID NO: 104206 - DNA, 25 bp, Homo sapien
gctaattgaagttattaggctcagc

SEQ ID NO: 104207 - DNA, 25 bp, Homo sapien
acttcgacctgagccacggctctgc

SEQ ID NO: 104208 - DNA, 25 bp, Homo sapien
tcgacctgagccacggctctgccca

SEQ ID NO: 104209 - DNA, 25 bp, Homo sapien
gttaagggccacggcaagaaggtgg

SEQ ID NO: 104210 - DNA, 25 bp, Homo sapien
acgtggacgacatgcccaacgcgct

SEQ ID NO: 104211 - DNA, 25 bp, Homo sapien
cgtggacgacatgcccaacgcgctg

SEQ ID NO: 104212 - DNA, 25 bp, Homo sapien
gacctgcacgcgcacaagcttcggg

SEQ ID NO: 104213 - DNA, 25 bp, Homo sapien
acctgcacgcgcacaagcttcgggt

SEQ ID NO: 104214 - DNA, 25 bp, Homo sapien
ctgcacgcgcacaagcttcgggtgg

SEQ ID NO: 104215 - DNA, 25 bp, Homo sapien
tgcacgcgcacaagcttcgggtgga

SEQ ID NO: 104216 - DNA, 25 bp, Homo sapien
gcacgcgcacaagcttcgggtggac

SEQ ID NO: 104217 - DNA, 25 bp, Homo sapien
ccgagttcacccctgcggtgcacgc

SEQ ID NO: 104218 - DNA, 25 bp, Homo sapien
ccgcgcccagcctataaaattgatt

SEQ ID NO: 104219 - DNA, 25 bp, Homo sapien
agaacatttaccgatgctggaccca

SEQ ID NO: 104220 - DNA, 25 bp, Homo sapien
atttaccgatgctggacccaccttc

SEQ ID NO: 104221 - DNA, 25 bp, Homo sapien
accttcagggtccactttctaggtg

SEQ ID NO: 104222 - DNA, 25 bp, Homo sapien
agggtccactttctaggtggccaca

SEQ ID NO: 104223 - DNA, 25 bp, Homo sapien
cactttctaggtggccacagtgcct

SEQ ID NO: 104224 - DNA, 25 bp, Homo sapien
gagtttgcaactctgcttttggagt

SEQ ID NO: 104225 - DNA, 25 bp, Homo sapien
ctctgcttttggagttaaacatgtt

SEQ ID NO: 104226 - DNA, 25 bp, Homo sapien
gttttaggagtcctgggattctgat

SEQ ID NO: 104227 - DNA, 25 bp, Homo sapien
gagtcctgggattctgattgatgct

SEQ ID NO: 104228 - DNA, 25 bp, Homo sapien
gggattctgattgatgctattgtca

SEQ ID NO: 104229 - DNA, 25 bp, Homo sapien
ccagctttcagattcacacgggagg

SEQ ID NO: 104230 - DNA, 25 bp, Homo sapien
tttcagattcacacgggaggcagct

SEQ ID NO: 104231 - DNA, 25 bp, Homo sapien
attcacacgggaggcagctcaggac

SEQ ID NO: 104232 - DNA, 25 bp, Homo sapien
tccccgcaggcgctgtgctagagat

SEQ ID NO: 104233 - DNA, 25 bp, Homo sapien
aggtaccgctgcagctagaatccaa

SEQ ID NO: 104234 - DNA, 25 bp, Homo sapien
tagaatccaaatctgccctaggtcc

SEQ ID NO: 104235 - DNA, 25 bp, Homo sapien
gccctaggtccaaaaaatggtgtct

SEQ ID NO: 104236 - DNA, 25 bp, Homo sapien
aaatggtgtctatatcaagatcgta

SEQ ID NO: 104237 - DNA, 25 bp, Homo sapien
atatcaagatcgtatcccgctgaca

SEQ ID NO: 104238 - DNA, 25 bp, Homo sapien
gatcgtatcccgctgacacagaagg

SEQ ID NO: 104239 - DNA, 25 bp, Homo sapien
ccgctgacacagaaggctgccgggt

SEQ ID NO: 104240 - DNA, 25 bp, Homo sapien
ttagtctgcgatgatgactcttctg

SEQ ID NO: 104241 - DNA, 25 bp, Homo sapien
gatgatgactcttctgggttgactt

SEQ ID NO: 104242 - DNA, 25 bp, Homo sapien
tcttctgggttgacttttccagttc

SEQ ID NO: 104243 - DNA, 25 bp, Homo sapien
ttttccagttcattatgcagccctc

SEQ ID NO: 104244 - DNA, 25 bp, Homo sapien
ttagcagacaccaatgagaacctca

SEQ ID NO: 104245 - DNA, 25 bp, Homo sapien
acagagaggctcatcaagcaggctg

SEQ ID NO: 104246 - DNA, 25 bp, Homo sapien
aactgggtgttacttcctgttccat

SEQ ID NO: 104247 - DNA, 25 bp, Homo sapien
gttccatgggtaccccatagtgttt

SEQ ID NO: 104248 - DNA, 25 bp, Homo sapien
aaacaccgggctgtggttcaggaga

SEQ ID NO: 104249 - DNA, 25 bp, Homo sapien
ggttcaggagaatttcacatatgct

SEQ ID NO: 104250 - DNA, 25 bp, Homo sapien
aagatggagaaagaacctgcccttt

SEQ ID NO: 104251 - DNA, 25 bp, Homo sapien
gacatctacaactaatctttcccat

SEQ ID NO: 104252 - DNA, 25 bp, Homo sapien
atctttcccatcaactctgtgtgaa

SEQ ID NO: 104253 - DNA, 25 bp, Homo sapien
actctgtgtgaaggcaggttgcaac

SEQ ID NO: 104254 - DNA, 25 bp, Homo sapien
gaaacctaaagaagcatcatcccct

SEQ ID NO: 104255 - DNA, 25 bp, Homo sapien
ataaatcaaggctcaaggcttcccc

SEQ ID NO: 104256 - DNA, 25 bp, Homo sapien
ggcttccccagcaaagattagggaa

SEQ ID NO: 104257 - DNA, 25 bp, Homo sapien
ggaaagagacttgaccccaggactg

SEQ ID NO: 104258 - DNA, 25 bp, Homo sapien
gagacttgaccccaggactgtacta

SEQ ID NO: 104259 - DNA, 25 bp, Homo sapien
ggactgtactacgactcttaagaga

SEQ ID NO: 104260 - DNA, 25 bp, Homo sapien
cgactcttaagagaacactgcacag

SEQ ID NO: 104261 - DNA, 25 bp, Homo sapien
ccccactggtataaatacatctctc

SEQ ID NO: 104262 - DNA, 25 bp, Homo sapien
tgcctttgcctcacataaactgtac

SEQ ID NO: 104263 - DNA, 25 bp, Homo sapien
tgcctcacataaactgtacagtatt

SEQ ID NO: 104264 - DNA, 25 bp, Homo sapien
ttcattaaaagcctctttcataaaa

SEQ ID NO: 104265 - DNA, 25 bp, Homo sapien
ctgctcggagtcacctgttggaatg

SEQ ID NO: 104266 - DNA, 25 bp, Homo sapien
ggaatggactaaaaggacccttgtg

SEQ ID NO: 104267 - DNA, 25 bp, Homo sapien
acccttgtgtgggaacaggtgctcc

SEQ ID NO: 104268 - DNA, 25 bp, Homo sapien
tgtgggaacaggtgctccccaaaca

SEQ ID NO: 104269 - DNA, 25 bp, Homo sapien
gggcaggactcatcaggacctccct

SEQ ID NO: 104270 - DNA, 25 bp, Homo sapien
tggacccctgcagggcaggcagctt

SEQ ID NO: 104271 - DNA, 25 bp, Homo sapien
tgggcccgagcccaagcatttggct

SEQ ID NO: 104272 - DNA, 25 bp, Homo sapien
ccgagcccaagcatttggctctgct

SEQ ID NO: 104273 - DNA, 25 bp, Homo sapien
atcctggaaatatgatgtactccaa

SEQ ID NO: 104274 - DNA, 25 bp, Homo sapien
tgtactccaacattcatcgcagctg

SEQ ID NO: 104275 - DNA, 25 bp, Homo sapien
ttcatcgcagctggtgggtgtacac

SEQ ID NO: 104276 - DNA, 25 bp, Homo sapien
tgggtgtacacactgctgtttacct

SEQ ID NO: 104277 - DNA, 25 bp, Homo sapien
tgctgtttaccttggcgaggccttt

SEQ ID NO: 104278 - DNA, 25 bp, Homo sapien
ggcgaggcctttcaccaagtccatg

SEQ ID NO: 104279 - DNA, 25 bp, Homo sapien
ggaaaactggacttcagtcgcctct

SEQ ID NO: 104280 - DNA, 25 bp, Homo sapien
gtcgcctctctccaacaaaaaacga

SEQ ID NO: 104281 - DNA, 25 bp, Homo sapien
aaaacgactattgggcgatgctggc

SEQ ID NO: 104282 - DNA, 25 bp, Homo sapien
ctattgggcgatgctggcttataac

SEQ ID NO: 104283 - DNA, 25 bp, Homo sapien
ggcgatgctggcttataacaggtcc

SEQ ID NO: 104284 - DNA, 25 bp, Homo sapien
gtcgagtcagctgaaagaacacttt

SEQ ID NO: 104285 - DNA, 25 bp, Homo sapien
agaacactttgcacagttcggccat

SEQ ID NO: 104286 - DNA, 25 bp, Homo sapien
gttcggccatgtcagaaggtgcatt

SEQ ID NO: 104287 - DNA, 25 bp, Homo sapien
gtcagaaggtgcattttaccttttg

SEQ ID NO: 104288 - DNA, 25 bp, Homo sapien
cttttgacaaggagactggctttca

SEQ ID NO: 104289 - DNA, 25 bp, Homo sapien
agactggctttcacagaggtttggg

SEQ ID NO: 104290 - DNA, 25 bp, Homo sapien
aggacttcggaatgcactacaacag

SEQ ID NO: 104291 - DNA, 25 bp, Homo sapien
gcgtagaagtatcaatcagccggtt

SEQ ID NO: 104292 - DNA, 25 bp, Homo sapien
aatcagccggttgcttttgtgagaa

SEQ ID NO: 104293 - DNA, 25 bp, Homo sapien
gaagaattccttggactgcggcgtc

SEQ ID NO: 104294 - DNA, 25 bp, Homo sapien
gactgcggcgtcgagtcagctgaaa

SEQ ID NO: 104295 - DNA, 25 bp, Homo sapien
catgctcatcggctgtgagtgagac

SEQ ID NO: 104296 - DNA, 25 bp, Homo sapien
tgtgagtgagacctcatgccacggc

SEQ ID NO: 104297 - DNA, 25 bp, Homo sapien
gagacctcatgccacggcctaactt

SEQ ID NO: 104298 - DNA, 25 bp, Homo sapien
ggcctaacttcatgctctggtctta

SEQ ID NO: 104299 - DNA, 25 bp, Homo sapien
atgctctggtcttacccgtgaaatt

SEQ ID NO: 104300 - DNA, 25 bp, Homo sapien
ggtcttacccgtgaaattttatgtg

SEQ ID NO: 104301 - DNA, 25 bp, Homo sapien
gtgtagttttgtactgagatagaac

SEQ ID NO: 104302 - DNA, 25 bp, Homo sapien
gagatagaacataacacatagcaac

SEQ ID NO: 104303 - DNA, 25 bp, Homo sapien
tagcaacaattcatgcagtacactg

SEQ ID NO: 104304 - DNA, 25 bp, Homo sapien
attcatgcagtacactgatcctaag

SEQ ID NO: 104305 - DNA, 25 bp, Homo sapien
actgatcctaagtgtgcagcacaat

SEQ ID NO: 104306 - DNA, 25 bp, Homo sapien
agaatgtaaagagacgcccttcaca

SEQ ID NO: 104307 - DNA, 25 bp, Homo sapien
aatgtaaagagacgcccttcacatg

SEQ ID NO: 104308 - DNA, 25 bp, Homo sapien
taaagagacgcccttcacatgttga

SEQ ID NO: 104309 - DNA, 25 bp, Homo sapien
aaagagacgcccttcacatgttgag

SEQ ID NO: 104310 - DNA, 25 bp, Homo sapien
aagagacgcccttcacatgttgaga

SEQ ID NO: 104311 - DNA, 25 bp, Homo sapien
agagacgcccttcacatgttgagaa

SEQ ID NO: 104312 - DNA, 25 bp, Homo sapien
gagacgcccttcacatgttgagaaa

SEQ ID NO: 104313 - DNA, 25 bp, Homo sapien
agacgcccttcacatgttgagaaat

SEQ ID NO: 104314 - DNA, 25 bp, Homo sapien
gacgcccttcacatgttgagaaatg

SEQ ID NO: 104315 - DNA, 25 bp, Homo sapien
gcccttcacatgttgagaaatggta

SEQ ID NO: 104316 - DNA, 25 bp, Homo sapien
cagtgcagttcggttctcaggggga

SEQ ID NO: 104317 - DNA, 25 bp, Homo sapien
agctgtgctgagaacgaagtcaaaa

SEQ ID NO: 104318 - DNA, 25 bp, Homo sapien
aagcaatgaatacctgtggatctca

SEQ ID NO: 104319 - DNA, 25 bp, Homo sapien
ggatctcatcttactgtagtgtcta

SEQ ID NO: 104320 - DNA, 25 bp, Homo sapien
ctgtagtgtctatgttctatggaac

SEQ ID NO: 104321 - DNA, 25 bp, Homo sapien
tggaactattatctacatgtacctg

SEQ ID NO: 104322 - DNA, 25 bp, Homo sapien
tgcaaccaggtaacagggcttccaa

SEQ ID NO: 104323 - DNA, 25 bp, Homo sapien
ttttacaccgtcatcactccaagtc

SEQ ID NO: 104324 - DNA, 25 bp, Homo sapien
caacccgctcatttacaccttaaga

SEQ ID NO: 104325 - DNA, 25 bp, Homo sapien
ataaggacatgaaggatgccctgaa

SEQ ID NO: 104326 - DNA, 25 bp, Homo sapien
aggatgccctgaagaaactgatgag

SEQ ID NO: 104327 - DNA, 25 bp, Homo sapien
aaactgatgagatttcaccacaaat

SEQ ID NO: 104328 - DNA, 25 bp, Homo sapien
tctttgtttttagcttccactttgg

SEQ ID NO: 104329 - DNA, 25 bp, Homo sapien
gggaacatgtcaaagcacacattga

SEQ ID NO: 104330 - DNA, 25 bp, Homo sapien
gcacacattgagaagtcccatgagt

SEQ ID NO: 104331 - DNA, 25 bp, Homo sapien
agagatgttggaaagcccttgaact

SEQ ID NO: 104332 - DNA, 25 bp, Homo sapien
gaaagcccttgaacttggtcgttag

SEQ ID NO: 104333 - DNA, 25 bp, Homo sapien
tggtcgttaggaaacatccacactg

SEQ ID NO: 104334 - DNA, 25 bp, Homo sapien
taggaaacatccacactgaagagga

SEQ ID NO: 104335 - DNA, 25 bp, Homo sapien
ggaacctgactgtatggaaggtcaa

SEQ ID NO: 104336 - DNA, 25 bp, Homo sapien
aaggctgtattaatttacatgcaaa

SEQ ID NO: 104337 - DNA, 25 bp, Homo sapien
aaagtcacactagaggaatgccata

SEQ ID NO: 104338 - DNA, 25 bp, Homo sapien
atgccatatcagaatgcttttggta

SEQ ID NO: 104339 - DNA, 25 bp, Homo sapien
ggaggagtcatttcatgattaagaa

SEQ ID NO: 104340 - DNA, 25 bp, Homo sapien
tgtattgttcattaagctagcttcc

SEQ ID NO: 104341 - DNA, 25 bp, Homo sapien
aagctagcttcctagttccgattag

SEQ ID NO: 104342 - DNA, 25 bp, Homo sapien
agcttcctagttccgattagactaa

SEQ ID NO: 104343 - DNA, 25 bp, Homo sapien
gttccgattagactaaggagactaa

SEQ ID NO: 104344 - DNA, 25 bp, Homo sapien
aagcctagagagtcaatgttagaac

SEQ ID NO: 104345 - DNA, 25 bp, Homo sapien
gaaggcttagtagctcagtctttaa

SEQ ID NO: 104346 - DNA, 25 bp, Homo sapien
gctcagtctttaacaagggctagaa

SEQ ID NO: 104347 - DNA, 25 bp, Homo sapien
atctgatatggaaggatagcagctt

SEQ ID NO: 104348 - DNA, 25 bp, Homo sapien
ggatagcagcttctaattttcaatc

SEQ ID NO: 104349 - DNA, 25 bp, Homo sapien
agcttctaattttcaatcatctgtt

SEQ ID NO: 104350 - DNA, 25 bp, Homo sapien
ggctgggctcctggggttgtcccgg

SEQ ID NO: 104351 - DNA, 25 bp, Homo sapien
ggacccacagccaagaggagtcaga

SEQ ID NO: 104352 - DNA, 25 bp, Homo sapien
gacccacagccaagaggagtcagag

SEQ ID NO: 104353 - DNA, 25 bp, Homo sapien
acccacagccaagaggagtcagaga

SEQ ID NO: 104354 - DNA, 25 bp, Homo sapien
ggtgggggtcctcaagactgtggga

SEQ ID NO: 104355 - DNA, 25 bp, Homo sapien
gggtctgtggcagagccgcgagccc

SEQ ID NO: 104356 - DNA, 25 bp, Homo sapien
ggtctgtggcagagccgcgagcccc

SEQ ID NO: 104357 - DNA, 25 bp, Homo sapien
gtgcagagggagaattcggtggcct

SEQ ID NO: 104358 - DNA, 25 bp, Homo sapien
agggagaattcggtggcctcagatg

SEQ ID NO: 104359 - DNA, 25 bp, Homo sapien
ggagaattcggtggcctcagatgga

SEQ ID NO: 104360 - DNA, 25 bp, Homo sapien
attcggtggcctcagatggagggct

SEQ ID NO: 104361 - DNA, 25 bp, Homo sapien
tctgggctgttgaccacagttgcaa

SEQ ID NO: 104362 - DNA, 25 bp, Homo sapien
acagttgcaagtactgcccagggca

SEQ ID NO: 104363 - DNA, 25 bp, Homo sapien
agggcacacattctaatcttctgta

SEQ ID NO: 104364 - DNA, 25 bp, Homo sapien
aaatacctgcttctaattttcggca

SEQ ID NO: 104365 - DNA, 25 bp, Homo sapien
aatatgcttctcatcagccattacc

SEQ ID NO: 104366 - DNA, 25 bp, Homo sapien
attaccacaagctacatacccttac

SEQ ID NO: 104367 - DNA, 25 bp, Homo sapien
catacccttaccttcctaatcgatt

SEQ ID NO: 104368 - DNA, 25 bp, Homo sapien
tttgtgcctccagaagttccttggg

SEQ ID NO: 104369 - DNA, 25 bp, Homo sapien
aagttccttgggtttatgctccatg

SEQ ID NO: 104370 - DNA, 25 bp, Homo sapien
atgctccatggcaccaagaatcctt

SEQ ID NO: 104371 - DNA, 25 bp, Homo sapien
aagaatcctttcatccaggacactg

SEQ ID NO: 104372 - DNA, 25 bp, Homo sapien
gggtcaccctgcaggttcccataaa

SEQ ID NO: 104373 - DNA, 25 bp, Homo sapien
cctgcaggttcccataaaaacgatt

SEQ ID NO: 104374 - DNA, 25 bp, Homo sapien
gaagccaacttctgcacgggcattg

SEQ ID NO: 104375 - DNA, 25 bp, Homo sapien
ttctgcacgggcattgaactgctcg

SEQ ID NO: 104376 - DNA, 25 bp, Homo sapien
cacgggcattgaactgctcgtgacg

SEQ ID NO: 104377 - DNA, 25 bp, Homo sapien
gtacgggtgcaaggccagtcggagc

SEQ ID NO: 104378 - DNA, 25 bp, Homo sapien
atatcccttcctgatttctctcatt

SEQ ID NO: 104379 - DNA, 25 bp, Homo sapien
cccaaactccaacctgtatcagatg

SEQ ID NO: 104380 - DNA, 25 bp, Homo sapien
actccaacctgtatcagatgcagcc

SEQ ID NO: 104381 - DNA, 25 bp, Homo sapien
taagcccagttagcaaggtgccggg

SEQ ID NO: 104382 - DNA, 25 bp, Homo sapien
agttagcaaggtgccgggtcaccct

SEQ ID NO: 104383 - DNA, 25 bp, Homo sapien
ctgacgatcacttacatttgtgtta

SEQ ID NO: 104384 - DNA, 25 bp, Homo sapien
tacatttgtgttatgctgattagca

SEQ ID NO: 104385 - DNA, 25 bp, Homo sapien
atgctgattagcagatatccacaaa

SEQ ID NO: 104386 - DNA, 25 bp, Homo sapien
agatatccacaaacatagctatgaa

SEQ ID NO: 104387 - DNA, 25 bp, Homo sapien
catagctatgaagttctgactggga

SEQ ID NO: 104388 - DNA, 25 bp, Homo sapien
gttctgactgggataaccttgctgt

SEQ ID NO: 104389 - DNA, 25 bp, Homo sapien
ttgcagtcttgctattgctgtttgt

SEQ ID NO: 104390 - DNA, 25 bp, Homo sapien
gtcttgctattgctgtttgtctatt

SEQ ID NO: 104391 - DNA, 25 bp, Homo sapien
tgtttgtctattttgcagtcttgct

SEQ ID NO: 104392 - DNA, 25 bp, Homo sapien
gcagtcttgctaaatttgtttgttc

SEQ ID NO: 104393 - DNA, 25 bp, Homo sapien
gtcttgctaaatttgtttgttcttg

SEQ ID NO: 104394 - DNA, 25 bp, Homo sapien
aatggacatattccactggcagatc

SEQ ID NO: 104395 - DNA, 25 bp, Homo sapien
actggcagatcatggatgggaacct

SEQ ID NO: 104396 - DNA, 25 bp, Homo sapien
ggaacctgacaggaaacatccggga

SEQ ID NO: 104397 - DNA, 25 bp, Homo sapien
gaaacatccgggagttcctgcccat

SEQ ID NO: 104398 - DNA, 25 bp, Homo sapien
agttcctgcccattgttgggcatgt

SEQ ID NO: 104399 - DNA, 25 bp, Homo sapien
cggagagctgaatttcccctatctg

SEQ ID NO: 104400 - DNA, 25 bp, Homo sapien
tgaatttcccctatctgtttcaact

SEQ ID NO: 104401 - DNA, 25 bp, Homo sapien
atctgtttcaactgctggaagatga

SEQ ID NO: 104402 - DNA, 25 bp, Homo sapien
gaaggctacaaaggcttcgtgggct

SEQ ID NO: 104403 - DNA, 25 bp, Homo sapien
agagggcttgagttggctacgttca

SEQ ID NO: 104404 - DNA, 25 bp, Homo sapien
agttggctacgttcatactgggata

SEQ ID NO: 104405 - DNA, 25 bp, Homo sapien
cctgaagttaatagggagacccctg

SEQ ID NO: 104406 - DNA, 25 bp, Homo sapien
cctgcttcctaaacttacacatttg

SEQ ID NO: 104407 - DNA, 25 bp, Homo sapien
gcttcctaaacttacacatttgtgg

SEQ ID NO: 104408 - DNA, 25 bp, Homo sapien
acatttgtggtgtacctttgtcgta

SEQ ID NO: 104409 - DNA, 25 bp, Homo sapien
tgtggtgtacctttgtcgtaaacgt

SEQ ID NO: 104410 - DNA, 25 bp, Homo sapien
tgtcgtaaacgttttgatgttacct

SEQ ID NO: 104411 - DNA, 25 bp, Homo sapien
gatgttacctatttcttgtgggtct

SEQ ID NO: 104412 - DNA, 25 bp, Homo sapien
cctatttcttgtgggtctcctatta

SEQ ID NO: 104413 - DNA, 25 bp, Homo sapien
taccagcttctaaatgaatgttgtt

SEQ ID NO: 104414 - DNA, 25 bp, Homo sapien
gtttctgtcagcaggagagttttac

SEQ ID NO: 104415 - DNA, 25 bp, Homo sapien
gaaggatgctcattatatattgtga

SEQ ID NO: 104416 - DNA, 25 bp, Homo sapien
cctgcttttctttccccatagaaag

SEQ ID NO: 104417 - DNA, 25 bp, Homo sapien
ctgcttttctttccccatagaaagt

SEQ ID NO: 104418 - DNA, 25 bp, Homo sapien
ccttgaagtagcacagtccgtcctt

SEQ ID NO: 104419 - DNA, 25 bp, Homo sapien
ttgaagtagcacagtccgtccttgc

SEQ ID NO: 104420 - DNA, 25 bp, Homo sapien
gaagtagcacagtccgtccttgcat

SEQ ID NO: 104421 - DNA, 25 bp, Homo sapien
aagtagcacagtccgtccttgcatg

SEQ ID NO: 104422 - DNA, 25 bp, Homo sapien
gtagcacagtccgtccttgcatgtg

SEQ ID NO: 104423 - DNA, 25 bp, Homo sapien
agcacagtccgtccttgcatgtgca

SEQ ID NO: 104424 - DNA, 25 bp, Homo sapien
ctcccaccttctactgggcataatt

SEQ ID NO: 104425 - DNA, 25 bp, Homo sapien
tcccaccttctactgggcataatta

SEQ ID NO: 104426 - DNA, 25 bp, Homo sapien
atcttaatcatatatggaaatgtgc

SEQ ID NO: 104427 - DNA, 25 bp, Homo sapien
aaacagctgctgatgctacagtccc

SEQ ID NO: 104428 - DNA, 25 bp, Homo sapien
gctgatgctacagtccctggagtga

SEQ ID NO: 104429 - DNA, 25 bp, Homo sapien
tgctacagtccctggagtgagggca

SEQ ID NO: 104430 - DNA, 25 bp, Homo sapien
tgcctaggaggaagggacccagctg

SEQ ID NO: 104431 - DNA, 25 bp, Homo sapien
ctgggtctgggccacaagggaggag

SEQ ID NO: 104432 - DNA, 25 bp, Homo sapien
aggccaccgtgtgtgtcccgagtaa

SEQ ID NO: 104433 - DNA, 25 bp, Homo sapien
gtgtgtgtcccgagtaaccgtgccg

SEQ ID NO: 104434 - DNA, 25 bp, Homo sapien
agtaaccgtgccgttgtcgtgtgat

SEQ ID NO: 104435 - DNA, 25 bp, Homo sapien
ataagcgtctgtgcgtggagtcccc

SEQ ID NO: 104436 - DNA, 25 bp, Homo sapien
gtctgtgcgtggagtccccaataaa

SEQ ID NO: 104437 - DNA, 25 bp, Homo sapien
tgtgcgtggagtccccaataaacct

SEQ ID NO: 104438 - DNA, 25 bp, Homo sapien
tggatgggctggatgccccttgcca

SEQ ID NO: 104439 - DNA, 25 bp, Homo sapien
ggatgggctggatgccccttgccaa

SEQ ID NO: 104440 - DNA, 25 bp, Homo sapien
gatgggctggatgccccttgccaat

SEQ ID NO: 104441 - DNA, 25 bp, Homo sapien
atgggctggatgccccttgccaatt

SEQ ID NO: 104442 - DNA, 25 bp, Homo sapien
tgggctggatgccccttgccaattg

SEQ ID NO: 104443 - DNA, 25 bp, Homo sapien
ggctggatgccccttgccaattggg

SEQ ID NO: 104444 - DNA, 25 bp, Homo sapien
gctggatgccccttgccaattgggg

SEQ ID NO: 104445 - DNA, 25 bp, Homo sapien
gatgccccttgccaattggggccag

SEQ ID NO: 104446 - DNA, 25 bp, Homo sapien
atgccccttgccaattggggccaga

SEQ ID NO: 104447 - DNA, 25 bp, Homo sapien
tgccccttgccaattggggccagat

SEQ ID NO: 104448 - DNA, 25 bp, Homo sapien
cccttgccaattggggccagatggc

SEQ ID NO: 104449 - DNA, 25 bp, Homo sapien
cattcgcatgacagatggacggaca

SEQ ID NO: 104450 - DNA, 25 bp, Homo sapien
atggacggacactggtcggctgctt

SEQ ID NO: 104451 - DNA, 25 bp, Homo sapien
tctgcactgaccgtgactgcaatgt

SEQ ID NO: 104452 - DNA, 25 bp, Homo sapien
gactgcaatgtcatcctgggctcgg

SEQ ID NO: 104453 - DNA, 25 bp, Homo sapien
tgggctcggcgcaggagttcctcaa

SEQ ID NO: 104454 - DNA, 25 bp, Homo sapien
atggtacccggacaccacatcgttt

SEQ ID NO: 104455 - DNA, 25 bp, Homo sapien
cacatcgtttccattgaggtgcaga

SEQ ID NO: 104456 - DNA, 25 bp, Homo sapien
tctgaccgggcctccgtatctctga

SEQ ID NO: 104457 - DNA, 25 bp, Homo sapien
gtatctctgaccacgatggcgctta

SEQ ID NO: 104458 - DNA, 25 bp, Homo sapien
gcgcttacctttcagacttcattaa

SEQ ID NO: 104459 - DNA, 25 bp, Homo sapien
gacttcattaaacttatgaccgaaa

SEQ ID NO: 104460 - DNA, 25 bp, Homo sapien
gtttgtttagcctggttttgccctg

SEQ ID NO: 104461 - DNA, 25 bp, Homo sapien
ttttgccctgcctctaattatagtg

SEQ ID NO: 104462 - DNA, 25 bp, Homo sapien
aattatagtggcagcatgccggtgt

SEQ ID NO: 104463 - DNA, 25 bp, Homo sapien
gcatgccggtgtaaaatcgttcccc

SEQ ID NO: 104464 - DNA, 25 bp, Homo sapien
aaagtcagcctcactcagcagaagc

SEQ ID NO: 104465 - DNA, 25 bp, Homo sapien
gcagaagcaatgtactgagtcctgt

SEQ ID NO: 104466 - DNA, 25 bp, Homo sapien
tgtggactcaatagccagccttcct

SEQ ID NO: 104467 - DNA, 25 bp, Homo sapien
atagccagccttcctggaatcttgg

SEQ ID NO: 104468 - DNA, 25 bp, Homo sapien
gaatcttggccgtccaggttatgga

SEQ ID NO: 104469 - DNA, 25 bp, Homo sapien
agttagttgacctcttagttgcctc

SEQ ID NO: 104470 - DNA, 25 bp, Homo sapien
gacctcttagttgcctcaagtgttg

SEQ ID NO: 104471 - DNA, 25 bp, Homo sapien
gaacagctattaacccccaaggaat

SEQ ID NO: 104472 - DNA, 25 bp, Homo sapien
gaattattggttcctcaagtgcgtt

SEQ ID NO: 104473 - DNA, 25 bp, Homo sapien
caagtgcgttttgggagctgctgcc

SEQ ID NO: 104474 - DNA, 25 bp, Homo sapien
tttgggagctgctgccagagagcta

SEQ ID NO: 104475 - DNA, 25 bp, Homo sapien
ctgctgccagagagctaaagggcct

SEQ ID NO: 104476 - DNA, 25 bp, Homo sapien
tgcacacgccacagcccgaggaaag

SEQ ID NO: 104477 - DNA, 25 bp, Homo sapien
aaagtgctggccaccgcccgtgggc

SEQ ID NO: 104478 - DNA, 25 bp, Homo sapien
ccggactccgtgtgacctaataggt

SEQ ID NO: 104479 - DNA, 25 bp, Homo sapien
taataggtcgtttccaagtcacccg

SEQ ID NO: 104480 - DNA, 25 bp, Homo sapien
aagtcacccgttttggatgtgcatt

SEQ ID NO: 104481 - DNA, 25 bp, Homo sapien
tgtgcatttcatgtgacaatacaga

SEQ ID NO: 104482 - DNA, 25 bp, Homo sapien
gtgataatcaaaccatgtcaagatt

SEQ ID NO: 104483 - DNA, 25 bp, Homo sapien
gattattagttcagactctagcctg

SEQ ID NO: 104484 - DNA, 25 bp, Homo sapien
gttcagactctagcctgttaatttt

SEQ ID NO: 104485 - DNA, 25 bp, Homo sapien
agttgatttctgaagctacctgatt

SEQ ID NO: 104486 - DNA, 25 bp, Homo sapien
ctgaagctacctgatttattctatt

SEQ ID NO: 104487 - DNA, 25 bp, Homo sapien
aattgtaagcttgcaaactcaaaat

SEQ ID NO: 104488 - DNA, 25 bp, Homo sapien
aattggcagatttacctctcatgtt

SEQ ID NO: 104489 - DNA, 25 bp, Homo sapien
acctctcatgttttaatgtgtcaaa

SEQ ID NO: 104490 - DNA, 25 bp, Homo sapien
gagcaaagtataacaggtgccttca

SEQ ID NO: 104491 - DNA, 25 bp, Homo sapien
ggtgccttcacttttgagacttagt

SEQ ID NO: 104492 - DNA, 25 bp, Homo sapien
tcacttttgagacttagtgccttaa

SEQ ID NO: 104493 - DNA, 25 bp, Homo sapien
gctatttttgaggttcgtgcctgtt

SEQ ID NO: 104494 - DNA, 25 bp, Homo sapien
aggttcgtgcctgttgtagaccaca

SEQ ID NO: 104495 - DNA, 25 bp, Homo sapien
gtgcctgttgtagaccacagtcaca

SEQ ID NO: 104496 - DNA, 25 bp, Homo sapien
gttgtagaccacagtcacacactgc

SEQ ID NO: 104497 - DNA, 25 bp, Homo sapien
acagtcacacactgctgtagtcttc

SEQ ID NO: 104498 - DNA, 25 bp, Homo sapien
agtcacacactgctgtagtcttccc

SEQ ID NO: 104499 - DNA, 25 bp, Homo sapien
gctgtgggattctgcactggtgctt

SEQ ID NO: 104500 - DNA, 25 bp, Homo sapien
tgcactggtgctttggattccctga

SEQ ID NO: 104501 - DNA, 25 bp, Homo sapien
actggtgctttggattccctgatat

SEQ ID NO: 104502 - DNA, 25 bp, Homo sapien
gctttggattccctgatatgttcct

SEQ ID NO: 104503 - DNA, 25 bp, Homo sapien
gattccctgatatgttccttcaaat

SEQ ID NO: 104504 - DNA, 25 bp, Homo sapien
tattttcactggctaaattctttat

SEQ ID NO: 104505 - DNA, 25 bp, Homo sapien
tgctagaagacattttggcagaaat

SEQ ID NO: 104506 - DNA, 25 bp, Homo sapien
ggcagaaataagtctataacactat

SEQ ID NO: 104507 - DNA, 25 bp, Homo sapien
taacactatttttgtcacatatctt

SEQ ID NO: 104508 - DNA, 25 bp, Homo sapien
ttttgtcacatatctttttcttgga

SEQ ID NO: 104509 - DNA, 25 bp, Homo sapien
aatttatccaactatagacatctta

SEQ ID NO: 104510 - DNA, 25 bp, Homo sapien
tagacatcttaaaccctacaaattg

SEQ ID NO: 104511 - DNA, 25 bp, Homo sapien
aaaatgactaatactgggggtgctc

SEQ ID NO: 104512 - DNA, 25 bp, Homo sapien
gctcaatatgcatatagtgtttttc

SEQ ID NO: 104513 - DNA, 25 bp, Homo sapien
agaaacctgttcttaatgttggcat

SEQ ID NO: 104514 - DNA, 25 bp, Homo sapien
aacctgttcttaatgttggcatgtc

SEQ ID NO: 104515 - DNA, 25 bp, Homo sapien
gacacattgtgaatcccatatttgg

SEQ ID NO: 104516 - DNA, 25 bp, Homo sapien
gaatcccatatttggtgaacacaga

SEQ ID NO: 104517 - DNA, 25 bp, Homo sapien
tgtatatattcctctgtattctggg

SEQ ID NO: 104518 - DNA, 25 bp, Homo sapien
ggagctttgaccttggagctttgta

SEQ ID NO: 104519 - DNA, 25 bp, Homo sapien
gaccttggagctttgtacagcttga

SEQ ID NO: 104520 - DNA, 25 bp, Homo sapien
gctttgtacagcttgagaaaacatt

SEQ ID NO: 104521 - DNA, 25 bp, Homo sapien
attttattatttgccggtgcctcaa

SEQ ID NO: 104522 - DNA, 25 bp, Homo sapien
tattatttgccggtgcctcaacaaa

SEQ ID NO: 104523 - DNA, 25 bp, Homo sapien
tgccggtgcctcaacaaatggaaat

SEQ ID NO: 104524 - DNA, 25 bp, Homo sapien
aatgaaagtacttcacctgcaagat

SEQ ID NO: 104525 - DNA, 25 bp, Homo sapien
gatgcacaataattttcaactctgt

SEQ ID NO: 104526 - DNA, 25 bp, Homo sapien
agactcccctgggttgggattcaag

SEQ ID NO: 104527 - DNA, 25 bp, Homo sapien
ggtgagcccatgtgctggagaaaat

SEQ ID NO: 104528 - DNA, 25 bp, Homo sapien
aaatacacactcattggtctccttg

SEQ ID NO: 104529 - DNA, 25 bp, Homo sapien
ctcattggtctccttgctttgaaag

SEQ ID NO: 104530 - DNA, 25 bp, Homo sapien
gataaaacgtccctctgggaggaag

SEQ ID NO: 104531 - DNA, 25 bp, Homo sapien
agaacaatggccacgttgccggaga

SEQ ID NO: 104532 - DNA, 25 bp, Homo sapien
cacgttgccggagagcagatgctcg

SEQ ID NO: 104533 - DNA, 25 bp, Homo sapien
agatgctcgaagatgggccccacaa

SEQ ID NO: 104534 - DNA, 25 bp, Homo sapien
aacgccaacagagggcagcgcttgc

SEQ ID NO: 104535 - DNA, 25 bp, Homo sapien
ttctcccgaggcagggcgtagccag

SEQ ID NO: 104536 - DNA, 25 bp, Homo sapien
tagccagcatgcaggtgcagggccc

SEQ ID NO: 104537 - DNA, 25 bp, Homo sapien
tgttaatttctgaggtttgggactt

SEQ ID NO: 104538 - DNA, 25 bp, Homo sapien
tttctgaggtttgggactttgtggt

SEQ ID NO: 104539 - DNA, 25 bp, Homo sapien
gattgcatatcaggacattggttat

SEQ ID NO: 104540 - DNA, 25 bp, Homo sapien
caggacattggttattttatgcttt

SEQ ID NO: 104541 - DNA, 25 bp, Homo sapien
gatataaccatgatcagagtgccat

SEQ ID NO: 104542 - DNA, 25 bp, Homo sapien
catgatcagagtgccatggccacta

SEQ ID NO: 104543 - DNA, 25 bp, Homo sapien
cactgtttgctctcctgcaaatcaa

SEQ ID NO: 104544 - DNA, 25 bp, Homo sapien
tgctctcctgcaaatcaactgcttt

SEQ ID NO: 104545 - DNA, 25 bp, Homo sapien
gttttgagtgttagctactgccttt

SEQ ID NO: 104546 - DNA, 25 bp, Homo sapien
gtgttagctactgcctttctagata

SEQ ID NO: 104547 - DNA, 25 bp, Homo sapien
gcctttctagatattagtcatttgg

SEQ ID NO: 104548 - DNA, 25 bp, Homo sapien
gtttcctagccgctacatctgttac

SEQ ID NO: 104549 - DNA, 25 bp, Homo sapien
tagccgctacatctgttacttttgt

SEQ ID NO: 104550 - DNA, 25 bp, Homo sapien
gccgctacatctgttacttttgttg

SEQ ID NO: 104551 - DNA, 25 bp, Homo sapien
gctacatctgttacttttgttggtg

SEQ ID NO: 104552 - DNA, 25 bp, Homo sapien
catctgttacttttgttggtgttat

SEQ ID NO: 104553 - DNA, 25 bp, Homo sapien
ttacttttgttggtgttatgggaat

SEQ ID NO: 104554 - DNA, 25 bp, Homo sapien
ggtgttatgggaatgagatcctact

SEQ ID NO: 104555 - DNA, 25 bp, Homo sapien
tgagatcctactactatggaaaatt

SEQ ID NO: 104556 - DNA, 25 bp, Homo sapien
cctactactatggaaaattcatgcc

SEQ ID NO: 104557 - DNA, 25 bp, Homo sapien
ccaaagttggagttcgtatgttgat

SEQ ID NO: 104558 - DNA, 25 bp, Homo sapien
gagttcgtatgttgatgacatctga

SEQ ID NO: 104559 - DNA, 25 bp, Homo sapien
gaagagaacctgactcaagtgggca

SEQ ID NO: 104560 - DNA, 25 bp, Homo sapien
acctgactcaagtgggcagtatcct

SEQ ID NO: 104561 - DNA, 25 bp, Homo sapien
caagtgggcagtatcctgggaaatc

SEQ ID NO: 104562 - DNA, 25 bp, Homo sapien
gtatcctgggaaatctaaaagacat

SEQ ID NO: 104563 - DNA, 25 bp, Homo sapien
gagattgatgctcaaaatccacaaa

SEQ ID NO: 104564 - DNA, 25 bp, Homo sapien
tgacaccaacagagatcgtattgat

SEQ ID NO: 104565 - DNA, 25 bp, Homo sapien
gatcgtattgatattgccaatgcca

SEQ ID NO: 104566 - DNA, 25 bp, Homo sapien
gatattgccaatgccagagcaaaga

SEQ ID NO: 104567 - DNA, 25 bp, Homo sapien
gaaactcattgacagctaaagctac

SEQ ID NO: 104568 - DNA, 25 bp, Homo sapien
aagctactgctgttcttctttatca

SEQ ID NO: 104569 - DNA, 25 bp, Homo sapien
gctgttcttctttatcatttattca

SEQ ID NO: 104570 - DNA, 25 bp, Homo sapien
ctgggcaagctaagaaagcctgctg

SEQ ID NO: 104571 - DNA, 25 bp, Homo sapien
ggcaagctaagaaagcctgctgctc

SEQ ID NO: 104572 - DNA, 25 bp, Homo sapien
gaaattcatacccaacaagccctag

SEQ ID NO: 104573 - DNA, 25 bp, Homo sapien
aaattcatacccaacaagccctagc

SEQ ID NO: 104574 - DNA, 25 bp, Homo sapien
taaccaccataaatgctaagggagt

SEQ ID NO: 104575 - DNA, 25 bp, Homo sapien
tgctaagggagtttccttgcctggt

SEQ ID NO: 104576 - DNA, 25 bp, Homo sapien
ttccttgcctggttttctgaaacca

SEQ ID NO: 104577 - DNA, 25 bp, Homo sapien
gcctggttttctgaaaccatttttg

SEQ ID NO: 104578 - DNA, 25 bp, Homo sapien
gccctgctctctcagaaagcttcat

SEQ ID NO: 104579 - DNA, 25 bp, Homo sapien
gctctctcagaaagcttcattatat

SEQ ID NO: 104580 - DNA, 25 bp, Homo sapien
gaaagcttcattatatgagcaataa

SEQ ID NO: 104581 - DNA, 25 bp, Homo sapien
ctgtatagtcagcttgtggaagcat

SEQ ID NO: 104582 - DNA, 25 bp, Homo sapien
ttgagtaacaacaagggcccagttt

SEQ ID NO: 104583 - DNA, 25 bp, Homo sapien
acaagggcccagtttttcatgaaca

SEQ ID NO: 104584 - DNA, 25 bp, Homo sapien
tttcatgaacatggctactggagca

SEQ ID NO: 104585 - DNA, 25 bp, Homo sapien
acatggctactggagcaagtcagat

SEQ ID NO: 104586 - DNA, 25 bp, Homo sapien
gcaagtcagattaggcaagctcatg

SEQ ID NO: 104587 - DNA, 25 bp, Homo sapien
tcatggccacatgaagaagatacat

SEQ ID NO: 104588 - DNA, 25 bp, Homo sapien
gaagatacattgtcccgagatgctg

SEQ ID NO: 104589 - DNA, 25 bp, Homo sapien
tcccgagatgctgactgtttaaatt

SEQ ID NO: 104590 - DNA, 25 bp, Homo sapien
tgtttaaatttttgccagagtttct

SEQ ID NO: 104591 - DNA, 25 bp, Homo sapien
ttgctcagaccctgttttcatgttg

SEQ ID NO: 104592 - DNA, 25 bp, Homo sapien
tatctactcaattatgactcaaggc

SEQ ID NO: 104593 - DNA, 25 bp, Homo sapien
atctactcaattatgactcaaggct

SEQ ID NO: 104594 - DNA, 25 bp, Homo sapien
gaatgtaaagagaccaccttcactt

SEQ ID NO: 104595 - DNA, 25 bp, Homo sapien
gagaccaccttcacttgttgagaaa

SEQ ID NO: 104596 - DNA, 25 bp, Homo sapien
gaccaccttcacttgttgagaaatg

SEQ ID NO: 104597 - DNA, 25 bp, Homo sapien
caccttcacttgttgagaaatggta

SEQ ID NO: 104598 - DNA, 25 bp, Homo sapien
cagtgcagttccgttctcgggggaa

SEQ ID NO: 104599 - DNA, 25 bp, Homo sapien
gaaagcccatccgtactaccaggag

SEQ ID NO: 104600 - DNA, 25 bp, Homo sapien
gactggatccgcaaagtagacactt

SEQ ID NO: 104601 - DNA, 25 bp, Homo sapien
gacacttggtctcatgaagccactg

SEQ ID NO: 104602 - DNA, 25 bp, Homo sapien
tccttggtttacctccatcattaaa

SEQ ID NO: 104603 - DNA, 25 bp, Homo sapien
agcttgcgcaggagctgtagctgcc

SEQ ID NO: 104604 - DNA, 25 bp, Homo sapien
ccccactggacgtttgcaaaacact

SEQ ID NO: 104605 - DNA, 25 bp, Homo sapien
cacccaggagtccttggctttgaac

SEQ ID NO: 104606 - DNA, 25 bp, Homo sapien
tttgaactcacacattacaggacat

SEQ ID NO: 104607 - DNA, 25 bp, Homo sapien
acacattacaggacatatcacaggc

SEQ ID NO: 104608 - DNA, 25 bp, Homo sapien
atggctagtgccttcaggacggtat

SEQ ID NO: 104609 - DNA, 25 bp, Homo sapien
gtgccttcaggacggtatatcaagt

SEQ ID NO: 104610 - DNA, 25 bp, Homo sapien
gtgcaggccagagtaatttaccaga

SEQ ID NO: 104611 - DNA, 25 bp, Homo sapien
gagtaatttaccagatcccctccac

SEQ ID NO: 104612 - DNA, 25 bp, Homo sapien
agccatcgcatggtctgtgtatgag

SEQ ID NO: 104613 - DNA, 25 bp, Homo sapien
gagttcttcaaatacctaatcacta

SEQ ID NO: 104614 - DNA, 25 bp, Homo sapien
aatggttgggcaatgtgcggcaaac

SEQ ID NO: 104615 - DNA, 25 bp, Homo sapien
aaacaaagggactgctgtgttccag

SEQ ID NO: 104616 - DNA, 25 bp, Homo sapien
tgttccagctgacagacgtgctaat

SEQ ID NO: 104617 - DNA, 25 bp, Homo sapien
gacgtgctaattatcctgttttctg

SEQ ID NO: 104618 - DNA, 25 bp, Homo sapien
cctgttttctgtgtccagacaaaga

SEQ ID NO: 104619 - DNA, 25 bp, Homo sapien
gaatttcaacagtaacagcaacaac

SEQ ID NO: 104620 - DNA, 25 bp, Homo sapien
atgactactgcttcgatgtcttcga

SEQ ID NO: 104621 - DNA, 25 bp, Homo sapien
ttcgatgtcttcgatggctcctacc

SEQ ID NO: 104622 - DNA, 25 bp, Homo sapien
ctggcccaattggtctcaggtaatt

SEQ ID NO: 104623 - DNA, 25 bp, Homo sapien
attggtctcaggtaattggtatgtg

SEQ ID NO: 104624 - DNA, 25 bp, Homo sapien
tctaaacgacgttggaatttgcaag

SEQ ID NO: 104625 - DNA, 25 bp, Homo sapien
ttcctcctgaacatggaccgattgg

SEQ ID NO: 104626 - DNA, 25 bp, Homo sapien
ctcctgaacatggaccgattgggca

SEQ ID NO: 104627 - DNA, 25 bp, Homo sapien
cctgaacatggaccgattgggcata

SEQ ID NO: 104628 - DNA, 25 bp, Homo sapien
gaacatggaccgattgggcatagca

SEQ ID NO: 104629 - DNA, 25 bp, Homo sapien
catggaccgattgggcatagcagat

SEQ ID NO: 104630 - DNA, 25 bp, Homo sapien
atggcatgttgcagacaggagtcac

SEQ ID NO: 104631 - DNA, 25 bp, Homo sapien
ggcatgttgcagacaggagtcactg

SEQ ID NO: 104632 - DNA, 25 bp, Homo sapien
catgttgcagacaggagtcactgta

SEQ ID NO: 104633 - DNA, 25 bp, Homo sapien
gttgcagacaggagtcactgtaggt

SEQ ID NO: 104634 - DNA, 25 bp, Homo sapien
cagacaggagtcactgtaggttcaa

SEQ ID NO: 104635 - DNA, 25 bp, Homo sapien
acaggagtcactgtaggttcaaagg

SEQ ID NO: 104636 - DNA, 25 bp, Homo sapien
gttgagatgtttcagcttgaagaac

SEQ ID NO: 104637 - DNA, 25 bp, Homo sapien
gaataaattttctgctcacgatgag

SEQ ID NO: 104638 - DNA, 25 bp, Homo sapien
tctgctcacgatgagtttagtgtgt

SEQ ID NO: 104639 - DNA, 25 bp, Homo sapien
gtgtaaagtttagagacatctgact

SEQ ID NO: 104640 - DNA, 25 bp, Homo sapien
gagacatctgactttgatagctaaa

SEQ ID NO: 104641 - DNA, 25 bp, Homo sapien
taaaccaaaccctattgaagaattg

SEQ ID NO: 104642 - DNA, 25 bp, Homo sapien
gaattgaatatatgctacttcaaga

SEQ ID NO: 104643 - DNA, 25 bp, Homo sapien
caagaaactaaattgatctcgtaga

SEQ ID NO: 104644 - DNA, 25 bp, Homo sapien
aattgatctcgtagaattatcttaa

SEQ ID NO: 104645 - DNA, 25 bp, Homo sapien
aaatcagatgtcagcataagcgatg

SEQ ID NO: 104646 - DNA, 25 bp, Homo sapien
gcataagcgatggataatacctaat

SEQ ID NO: 104647 - DNA, 25 bp, Homo sapien
gggcattatccatctttgcactatc

SEQ ID NO: 104648 - DNA, 25 bp, Homo sapien
cactatctgtaatgccttttctcac

SEQ ID NO: 104649 - DNA, 25 bp, Homo sapien
atctgtaatgccttttctcacctgt

SEQ ID NO: 104650 - DNA, 25 bp, Homo sapien
tttctcacctgtcatctcacatttt

SEQ ID NO: 104651 - DNA, 25 bp, Homo sapien
tgaacattcgacctccattacggag

SEQ ID NO: 104652 - DNA, 25 bp, Homo sapien
acggagagtttcctatgtttcactg

SEQ ID NO: 104653 - DNA, 25 bp, Homo sapien
agagtttcctatgtttcactgtgca

SEQ ID NO: 104654 - DNA, 25 bp, Homo sapien
tctccatactctgtaacagttgcat

SEQ ID NO: 104655 - DNA, 25 bp, Homo sapien
gtaacagttgcattgactgtcacat

SEQ ID NO: 104656 - DNA, 25 bp, Homo sapien
gactgtcacataatgctcatactta

SEQ ID NO: 104657 - DNA, 25 bp, Homo sapien
aatgctcatacttatctaatgtaga

SEQ ID NO: 104658 - DNA, 25 bp, Homo sapien
cggagcaggtgcaggctcgactaca

SEQ ID NO: 104659 - DNA, 25 bp, Homo sapien
tgcaggctcgactacagctcgtgga

SEQ ID NO: 104660 - DNA, 25 bp, Homo sapien
tacagctcgtggactcggccggcag

SEQ ID NO: 104661 - DNA, 25 bp, Homo sapien
ggcgatgcgaagttactggtgattc

SEQ ID NO: 104662 - DNA, 25 bp, Homo sapien
tggtgattctctgcatttctcccag

SEQ ID NO: 104663 - DNA, 25 bp, Homo sapien
agaggcacctggcacagacgttgca

SEQ ID NO: 104664 - DNA, 25 bp, Homo sapien
gtttcgggatccgagctcggcaagt

SEQ ID NO: 104665 - DNA, 25 bp, Homo sapien
atccgagctcggcaagtccagcgag

SEQ ID NO: 104666 - DNA, 25 bp, Homo sapien
tccagcgaggccctgcccgaaagaa

SEQ ID NO: 104667 - DNA, 25 bp, Homo sapien
aggaggccggattgaatgcattaac

SEQ ID NO: 104668 - DNA, 25 bp, Homo sapien
tgtgtttcttgtccttgctttataa

SEQ ID NO: 104669 - DNA, 25 bp, Homo sapien
cactatctgtaatgccttttctcac

SEQ ID NO: 104670 - DNA, 25 bp, Homo sapien
actatctgtaatgccttttctcacc

SEQ ID NO: 104671 - DNA, 25 bp, Homo sapien
ctatctgtaatgccttttctcacct

SEQ ID NO: 104672 - DNA, 25 bp, Homo sapien
tatctgtaatgccttttctcacctg

SEQ ID NO: 104673 - DNA, 25 bp, Homo sapien
atctgtaatgccttttctcacctgt

SEQ ID NO: 104674 - DNA, 25 bp, Homo sapien
tctgtaatgccttttctcacctgtc

SEQ ID NO: 104675 - DNA, 25 bp, Homo sapien
ctgtaatgccttttctcacctgtca

SEQ ID NO: 104676 - DNA, 25 bp, Homo sapien
cattacggagagtttcctatgtttc

SEQ ID NO: 104677 - DNA, 25 bp, Homo sapien
attacggagagtttcctatgtttca

SEQ ID NO: 104678 - DNA, 25 bp, Homo sapien
acgtctacggtctgacagttatatt

SEQ ID NO: 104679 - DNA, 25 bp, Homo sapien
gttatattagtcagctgccacttcc

SEQ ID NO: 104680 - DNA, 25 bp, Homo sapien
gccacttcccagaagcctacataat

SEQ ID NO: 104681 - DNA, 25 bp, Homo sapien
gaagcctacataattatttgctcta

SEQ ID NO: 104682 - DNA, 25 bp, Homo sapien
tatttgctctatgaagacgttctga

SEQ ID NO: 104683 - DNA, 25 bp, Homo sapien
gacgttctgaggatgtatgaagttc

SEQ ID NO: 104684 - DNA, 25 bp, Homo sapien
agttccagaactggcagctattcaa

SEQ ID NO: 104685 - DNA, 25 bp, Homo sapien
aactggcagctattcaagatggata

SEQ ID NO: 104686 - DNA, 25 bp, Homo sapien
gaaactacttaacacagctaatttt

SEQ ID NO: 104687 - DNA, 25 bp, Homo sapien
tttttctctgaaaaatcatcgagac

SEQ ID NO: 104688 - DNA, 25 bp, Homo sapien
gacaaaagagccacagagtacaagt

SEQ ID NO: 104689 - DNA, 25 bp, Homo sapien
tcacgaaccgaaaaaccaaagctat

SEQ ID NO: 104690 - DNA, 25 bp, Homo sapien
gctatatggtaagaggctgtgcaac

SEQ ID NO: 104691 - DNA, 25 bp, Homo sapien
taagaggctgtgcaaccgcctcaat

SEQ ID NO: 104692 - DNA, 25 bp, Homo sapien
gcaaccgcctcaatgtgccaacatg

SEQ ID NO: 104693 - DNA, 25 bp, Homo sapien
tgccaacatgcccacctgggtgacg

SEQ ID NO: 104694 - DNA, 25 bp, Homo sapien
tgggtgacgccttcagcatgaacca

SEQ ID NO: 104695 - DNA, 25 bp, Homo sapien
atgaaccacattgatgtctcctgct

SEQ ID NO: 104696 - DNA, 25 bp, Homo sapien
cattgatgtctcctgctgtactaaa

SEQ ID NO: 104697 - DNA, 25 bp, Homo sapien
gtctcctgctgtactaaaagtggct

SEQ ID NO: 104698 - DNA, 25 bp, Homo sapien
tactaaaagtggctgtaaccaccca

SEQ ID NO: 104699 - DNA, 25 bp, Homo sapien
taaccacccagacctggatgtccag

SEQ ID NO: 104700 - DNA, 25 bp, Homo sapien
aagggagaaaaggtgacctctccat

SEQ ID NO: 104701 - DNA, 25 bp, Homo sapien
catcccagcatgtaccttgtttgat

SEQ ID NO: 104702 - DNA, 25 bp, Homo sapien
cagcatgtaccttgtttgattcttc

SEQ ID NO: 104703 - DNA, 25 bp, Homo sapien
tttgctgttcagcttgtgtgattcc

SEQ ID NO: 104704 - DNA, 25 bp, Homo sapien
tgtgtgattccatttgacacttaat

SEQ ID NO: 104705 - DNA, 25 bp, Homo sapien
acacttaatctttctccatcctgtg

SEQ ID NO: 104706 - DNA, 25 bp, Homo sapien
tgtgctccaaaaacatactgatgcc

SEQ ID NO: 104707 - DNA, 25 bp, Homo sapien
acatactgatgcctgatttaaggaa

SEQ ID NO: 104708 - DNA, 25 bp, Homo sapien
gatttaaggaatcaggtcttcagag

SEQ ID NO: 104709 - DNA, 25 bp, Homo sapien
atgaagaaggctgtactgccagata

SEQ ID NO: 104710 - DNA, 25 bp, Homo sapien
gatataagggcactgcctggcatag

SEQ ID NO: 104711 - DNA, 25 bp, Homo sapien
gttgcatttgtggaagttagttttc

SEQ ID NO: 104712 - DNA, 25 bp, Homo sapien
ttaatcaacctaattacatcaggat

SEQ ID NO: 104713 - DNA, 25 bp, Homo sapien
aagagacattaagagttcctgaaat

SEQ ID NO: 104714 - DNA, 25 bp, Homo sapien
gagttcctgaaatttatatctggca

SEQ ID NO: 104715 - DNA, 25 bp, Homo sapien
tctggcataccgataggcttatatt

SEQ ID NO: 104716 - DNA, 25 bp, Homo sapien
ggcttatattcaaaacatcttagtc

SEQ ID NO: 104717 - DNA, 25 bp, Homo sapien
aaacatcttagtcatacgaccataa

SEQ ID NO: 104718 - DNA, 25 bp, Homo sapien
gtcactaaatagtttgcagtacgtt

SEQ ID NO: 104719 - DNA, 25 bp, Homo sapien
gtttgcagtacgtttctaatataag

SEQ ID NO: 104720 - DNA, 25 bp, Homo sapien
tataagtgtaggtgggtatcaaaac

SEQ ID NO: 104721 - DNA, 25 bp, Homo sapien
aacaagacaaatgctgttcagggaa

SEQ ID NO: 104722 - DNA, 25 bp, Homo sapien
ggagagaaaccttttctagcgcggc

SEQ ID NO: 104723 - DNA, 25 bp, Homo sapien
gagagaaaccttttctagcgcggcc

SEQ ID NO: 104724 - DNA, 25 bp, Homo sapien
agagaaaccttttctagcgcggcct

SEQ ID NO: 104725 - DNA, 25 bp, Homo sapien
gagaaaccttttctagcgcggcctg

SEQ ID NO: 104726 - DNA, 25 bp, Homo sapien
agaaaccttttctagcgcggcctgg

SEQ ID NO: 104727 - DNA, 25 bp, Homo sapien
gaaaccttttctagcgcggcctggg

SEQ ID NO: 104728 - DNA, 25 bp, Homo sapien
aaccttttctagcgcggcctgggat

SEQ ID NO: 104729 - DNA, 25 bp, Homo sapien
accttttctagcgcggcctgggatg

SEQ ID NO: 104730 - DNA, 25 bp, Homo sapien
aacaagccagctaaaggtggactat

SEQ ID NO: 104731 - DNA, 25 bp, Homo sapien
gtggactatagtgcagacccagcaa

SEQ ID NO: 104732 - DNA, 25 bp, Homo sapien
taaaacccctcatcactacaaattc

SEQ ID NO: 104733 - DNA, 25 bp, Homo sapien
atcactacaaattcagagggcatct

SEQ ID NO: 104734 - DNA, 25 bp, Homo sapien
gagggcatctcatcaccctaagggc

SEQ ID NO: 104735 - DNA, 25 bp, Homo sapien
gcccaacgaaagatctttaccttct

SEQ ID NO: 104736 - DNA, 25 bp, Homo sapien
gatctttaccttctaacatcagttt

SEQ ID NO: 104737 - DNA, 25 bp, Homo sapien
gtgtttgctccatcaaattcagaca

SEQ ID NO: 104738 - DNA, 25 bp, Homo sapien
gctccatcaaattcagacaccagta

SEQ ID NO: 104739 - DNA, 25 bp, Homo sapien
aaactatattatgcccattgtctgg

SEQ ID NO: 104740 - DNA, 25 bp, Homo sapien
gcccattgtctggttctattttaat

SEQ ID NO: 104741 - DNA, 25 bp, Homo sapien
gtacattgctatatcttcagtcctt

SEQ ID NO: 104742 - DNA, 25 bp, Homo sapien
ttggagcaagtggacctaacaagtt

SEQ ID NO: 104743 - DNA, 25 bp, Homo sapien
atttggatccatgttcctcttgtga

SEQ ID NO: 104744 - DNA, 25 bp, Homo sapien
tcttgtgaccctgagtcttcatgca

SEQ ID NO: 104745 - DNA, 25 bp, Homo sapien
gcaaggagatctgaagctgaacaat

SEQ ID NO: 104746 - DNA, 25 bp, Homo sapien
atggccgtggattgtaatacacact

SEQ ID NO: 104747 - DNA, 25 bp, Homo sapien
acacactgaaattctgactttctga

SEQ ID NO: 104748 - DNA, 25 bp, Homo sapien
tcctttcctcatgcacaaaacataa

SEQ ID NO: 104749 - DNA, 25 bp, Homo sapien
agtggcgagtttacaagctgtggat

SEQ ID NO: 104750 - DNA, 25 bp, Homo sapien
gctgtggatgggtttccatagtctt

SEQ ID NO: 104751 - DNA, 25 bp, Homo sapien
atagtcttcctttctgtacattgct

SEQ ID NO: 104752 - DNA, 25 bp, Homo sapien
tcaaggcttagaacatggggattat

SEQ ID NO: 104753 - DNA, 25 bp, Homo sapien
caaggcttagaacatggggattata

SEQ ID NO: 104754 - DNA, 25 bp, Homo sapien
gggattatagagaaattcttgaaaa

SEQ ID NO: 104755 - DNA, 25 bp, Homo sapien
ggagttggaaactaagttggatgat

SEQ ID NO: 104756 - DNA, 25 bp, Homo sapien
gttggaaactaagttggatgatgat

SEQ ID NO: 104757 - DNA, 25 bp, Homo sapien
gttggatgatgatagggtgtggtta

SEQ ID NO: 104758 - DNA, 25 bp, Homo sapien
tggatgatgatagggtgtggttaaa

SEQ ID NO: 104759 - DNA, 25 bp, Homo sapien
gatgatgatagggtgtggttaaatg

SEQ ID NO: 104760 - DNA, 25 bp, Homo sapien
tgatgatagggtgtggttaaatgga

SEQ ID NO: 104761 - DNA, 25 bp, Homo sapien
tgatagggtgtggttaaatggagat

SEQ ID NO: 104762 - DNA, 25 bp, Homo sapien
tagggtgtggttaaatggagatgaa

SEQ ID NO: 104763 - DNA, 25 bp, Homo sapien
ggactaggccagtgttgggcacctc

SEQ ID NO: 104764 - DNA, 25 bp, Homo sapien
gaggaggcctgactggttcattacc

SEQ ID NO: 104765 - DNA, 25 bp, Homo sapien
tcccctactcagactgagcagcagt

SEQ ID NO: 104766 - DNA, 25 bp, Homo sapien
gagcagcagtcccagataaccaagc

SEQ ID NO: 104767 - DNA, 25 bp, Homo sapien
ccaacatcgcagacattaggaagct

SEQ ID NO: 104768 - DNA, 25 bp, Homo sapien
gagatcatgggtttgacctctgccc

SEQ ID NO: 104769 - DNA, 25 bp, Homo sapien
catgggtttgacctctgcccacatg

SEQ ID NO: 104770 - DNA, 25 bp, Homo sapien
atggagtcagcctcagccctgtctg

SEQ ID NO: 104771 - DNA, 25 bp, Homo sapien
tgtctgtactgctcgtccagctaaa

SEQ ID NO: 104772 - DNA, 25 bp, Homo sapien
tcgtccagctaaacgagcctggaat

SEQ ID NO: 104773 - DNA, 25 bp, Homo sapien
cgagcctggaataaacatgcagttt

SEQ ID NO: 104774 - DNA, 25 bp, Homo sapien
atgaagattccagttttcacagtag

SEQ ID NO: 104775 - DNA, 25 bp, Homo sapien
gttgcatcttatttaatgactctga

SEQ ID NO: 104776 - DNA, 25 bp, Homo sapien
tgactctgatacattgcaagcactc

SEQ ID NO: 104777 - DNA, 25 bp, Homo sapien
gaaactgtccttttgacaactctct

SEQ ID NO: 104778 - DNA, 25 bp, Homo sapien
aataaagtatcaccggcttgtgtat

SEQ ID NO: 104779 - DNA, 25 bp, Homo sapien
gaaaggaggtattcgaacttctgga

SEQ ID NO: 104780 - DNA, 25 bp, Homo sapien
gaacttctggaaatgggagtgctca

SEQ ID NO: 104781 - DNA, 25 bp, Homo sapien
gggagtgctcagtctgtgcaagtca

SEQ ID NO: 104782 - DNA, 25 bp, Homo sapien
gtcagaatccttgaaactgggcctt

SEQ ID NO: 104783 - DNA, 25 bp, Homo sapien
aaactgggccttttctaagtctgtg

SEQ ID NO: 104784 - DNA, 25 bp, Homo sapien
agtctgtgtcctaatgaagattcca

SEQ ID NO: 104785 - DNA, 25 bp, Homo sapien
gtgctttccgcgtacagaagtgctt

SEQ ID NO: 104786 - DNA, 25 bp, Homo sapien
ttccgcgtacagaagtgcttgcccg

SEQ ID NO: 104787 - DNA, 25 bp, Homo sapien
aggactcctgagaactgtgctggtg

SEQ ID NO: 104788 - DNA, 25 bp, Homo sapien
ctcctgagaactgtgctggtggaga

SEQ ID NO: 104789 - DNA, 25 bp, Homo sapien
cctagagccggcgagcgtttgagaa

SEQ ID NO: 104790 - DNA, 25 bp, Homo sapien
agaagagggcatggcgctggagtga

SEQ ID NO: 104791 - DNA, 25 bp, Homo sapien
gagatgggatttggcgtctcgtttt

SEQ ID NO: 104792 - DNA, 25 bp, Homo sapien
tttggcgtctcgtttttggctaatt

SEQ ID NO: 104793 - DNA, 25 bp, Homo sapien
cgtctcgtttttggctaattgattg

SEQ ID NO: 104794 - DNA, 25 bp, Homo sapien
aattgattgtcattggctttttcca

SEQ ID NO: 104795 - DNA, 25 bp, Homo sapien
ttgtcattggctttttccataaagt

SEQ ID NO: 104796 - DNA, 25 bp, Homo sapien
gaatgccgacacttccagaatgtat

SEQ ID NO: 104797 - DNA, 25 bp, Homo sapien
tagaaatagtccctgtcctggcctg

SEQ ID NO: 104798 - DNA, 25 bp, Homo sapien
accctgtctgtattttctcggaggt

SEQ ID NO: 104799 - DNA, 25 bp, Homo sapien
cttcccaggaaggtctttgtatgtc

SEQ ID NO: 104800 - DNA, 25 bp, Homo sapien
ttgtatgtcgaatccagtgcactca

SEQ ID NO: 104801 - DNA, 25 bp, Homo sapien
atccagtgcactcaagtttggccaa

SEQ ID NO: 104802 - DNA, 25 bp, Homo sapien
aagtttggccaagggactccacagc

SEQ ID NO: 104803 - DNA, 25 bp, Homo sapien
tgcctcaaggtttatgtcactcctc

SEQ ID NO: 104804 - DNA, 25 bp, Homo sapien
ctctgctgggctgttcattgtcatt

SEQ ID NO: 104805 - DNA, 25 bp, Homo sapien
gttcattgtcattgctgtgttcagg

SEQ ID NO: 104806 - DNA, 25 bp, Homo sapien
gctgtgttcagggacctttggaaat

SEQ ID NO: 104807 - DNA, 25 bp, Homo sapien
cgttccgggcggcttcaagagagag

SEQ ID NO: 104808 - DNA, 25 bp, Homo sapien
agcggagcaagtgtcccgggccctt

SEQ ID NO: 104809 - DNA, 25 bp, Homo sapien
cggagcaagtgtcccgggcccttca

SEQ ID NO: 104810 - DNA, 25 bp, Homo sapien
ttcagccagccctggatagctactt

SEQ ID NO: 104811 - DNA, 25 bp, Homo sapien
gccagccctggatagctacttccat

SEQ ID NO: 104812 - DNA, 25 bp, Homo sapien
tggatagctacttccatcccccggg

SEQ ID NO: 104813 - DNA, 25 bp, Homo sapien
gacgggacttaaataaaggcagacg

SEQ ID NO: 104814 - DNA, 25 bp, Homo sapien
aaggcagacgctgtttttctaccca

SEQ ID NO: 104815 - DNA, 25 bp, Homo sapien
gcagacgctgtttttctacccatgt

SEQ ID NO: 104816 - DNA, 25 bp, Homo sapien
agacgctgtttttctacccatgtgg

SEQ ID NO: 104817 - DNA, 25 bp, Homo sapien
tgtttttctacccatgtggcccaaa

SEQ ID NO: 104818 - DNA, 25 bp, Homo sapien
gggcagagacactcctcactttcca

SEQ ID NO: 104819 - DNA, 25 bp, Homo sapien
agagacactcctcactttccagact

SEQ ID NO: 104820 - DNA, 25 bp, Homo sapien
gagacactcctcactttccagactg

SEQ ID NO: 104821 - DNA, 25 bp, Homo sapien
agacactcctcactttccagactgg

SEQ ID NO: 104822 - DNA, 25 bp, Homo sapien
gacactcctcactttccagactggg

SEQ ID NO: 104823 - DNA, 25 bp, Homo sapien
acactcctcactttccagactgggc

SEQ ID NO: 104824 - DNA, 25 bp, Homo sapien
cactcctcactttccagactgggca

SEQ ID NO: 104825 - DNA, 25 bp, Homo sapien
actcctcactttccagactgggcag

SEQ ID NO: 104826 - DNA, 25 bp, Homo sapien
ctcactttccagactgggcagccag

SEQ ID NO: 104827 - DNA, 25 bp, Homo sapien
tcactttccagactgggcagccagg

SEQ ID NO: 104828 - DNA, 25 bp, Homo sapien
actttccagactgggcagccaggca

SEQ ID NO: 104829 - DNA, 25 bp, Homo sapien
gatattgatttggaccctgaaacag

SEQ ID NO: 104830 - DNA, 25 bp, Homo sapien
ggattattctaaacagatcaccatc

SEQ ID NO: 104831 - DNA, 25 bp, Homo sapien
gatcaccatccatcttcaagaagct

SEQ ID NO: 104832 - DNA, 25 bp, Homo sapien
gaagctactttgaaagtctggccag

SEQ ID NO: 104833 - DNA, 25 bp, Homo sapien
aaagtctggccagtgtctattcagg

SEQ ID NO: 104834 - DNA, 25 bp, Homo sapien
tctattcaggcccactgggagttag

SEQ ID NO: 104835 - DNA, 25 bp, Homo sapien
ggcccactgggagttaggaagtata

SEQ ID NO: 104836 - DNA, 25 bp, Homo sapien
gtaagccaagagaagtcagcccctg

SEQ ID NO: 104837 - DNA, 25 bp, Homo sapien
gcccctgcccagaagatctgaaact

SEQ ID NO: 104838 - DNA, 25 bp, Homo sapien
attttcagccttaattctcatcatg

SEQ ID NO: 104839 - DNA, 25 bp, Homo sapien
aatcatgcatgtctgtttactttag

SEQ ID NO: 104840 - DNA, 25 bp, Homo sapien
gtacaagaaaaactcaattgggcat

SEQ ID NO: 104841 - DNA, 25 bp, Homo sapien
actcaattgggcatttaatctgtat

SEQ ID NO: 104842 - DNA, 25 bp, Homo sapien
gggcatttaatctgtatgacataaa

SEQ ID NO: 104843 - DNA, 25 bp, Homo sapien
taaagatggctacatcactaaagag

SEQ ID NO: 104844 - DNA, 25 bp, Homo sapien
acatcactaaagaggaaatgcttga

SEQ ID NO: 104845 - DNA, 25 bp, Homo sapien
gggtaaatgtacatatcctgtcctc

SEQ ID NO: 104846 - DNA, 25 bp, Homo sapien
gtaaatgtacatatcctgtcctcaa

SEQ ID NO: 104847 - DNA, 25 bp, Homo sapien
tatcctgtcctcaaagaagatgctc

SEQ ID NO: 104848 - DNA, 25 bp, Homo sapien
gatgctcccagacaacacgttgaaa

SEQ ID NO: 104849 - DNA, 25 bp, Homo sapien
gctcccagacaacacgttgaaacat

SEQ ID NO: 104850 - DNA, 25 bp, Homo sapien
tgaaaacataatgcgctccatgcag

SEQ ID NO: 104851 - DNA, 25 bp, Homo sapien
acatgtgtgttgtcatatttggctt

SEQ ID NO: 104852 - DNA, 25 bp, Homo sapien
tttgctatatactttaacttcattg

SEQ ID NO: 104853 - DNA, 25 bp, Homo sapien
gtatagtttctttggtgtatcttaa

SEQ ID NO: 104854 - DNA, 25 bp, Homo sapien
tggtgtatcttaaaacctatttttg

SEQ ID NO: 104855 - DNA, 25 bp, Homo sapien
aacaaacttggcttgataatcattt

SEQ ID NO: 104856 - DNA, 25 bp, Homo sapien
tgataatcatttgggcagcttgggt

SEQ ID NO: 104857 - DNA, 25 bp, Homo sapien
ggcagcttgggtaagtacgcaactt

SEQ ID NO: 104858 - DNA, 25 bp, Homo sapien
tacgcaacttacttttccaccaaag

SEQ ID NO: 104859 - DNA, 25 bp, Homo sapien
ttccaccaaagaactgtcagcagct

SEQ ID NO: 104860 - DNA, 25 bp, Homo sapien
ctgcttttctgtgatgtatgtatcc

SEQ ID NO: 104861 - DNA, 25 bp, Homo sapien
gtatgtatcctgttgacttttccag

SEQ ID NO: 104862 - DNA, 25 bp, Homo sapien
acttgccacgtgtgctgcgtaagaa

SEQ ID NO: 104863 - DNA, 25 bp, Homo sapien
cgtgtgctgcgtaagaagggacccc

SEQ ID NO: 104864 - DNA, 25 bp, Homo sapien
acccagtgagtcaacataggctcat

SEQ ID NO: 104865 - DNA, 25 bp, Homo sapien
cataggctcatgtcaagtttgaaaa

SEQ ID NO: 104866 - DNA, 25 bp, Homo sapien
aattcaggtacacacgtaggctcgt

SEQ ID NO: 104867 - DNA, 25 bp, Homo sapien
gtaggctcgttcagttgctcaccac

SEQ ID NO: 104868 - DNA, 25 bp, Homo sapien
cagatgaaagtgctctttgttggaa

SEQ ID NO: 104869 - DNA, 25 bp, Homo sapien
tttgttggaaacagcttcctcctca

SEQ ID NO: 104870 - DNA, 25 bp, Homo sapien
acaaccctgcaattttgggccagaa

SEQ ID NO: 104871 - DNA, 25 bp, Homo sapien
ctcagaggctctgaagtgcctccag

SEQ ID NO: 104872 - DNA, 25 bp, Homo sapien
gattcaggcacttgccacgtgtgct

SEQ ID NO: 104873 - DNA, 25 bp, Homo sapien
ggactctccgtcatgggcgtgtgct

SEQ ID NO: 104874 - DNA, 25 bp, Homo sapien
catgggcgtgtgcttgttgattcca

SEQ ID NO: 104875 - DNA, 25 bp, Homo sapien
tgattccaggactggctactgcgta

SEQ ID NO: 104876 - DNA, 25 bp, Homo sapien
tggctactgcgtacatccacaggtt

SEQ ID NO: 104877 - DNA, 25 bp, Homo sapien
gtacatccacaggttcactaacggg

SEQ ID NO: 104878 - DNA, 25 bp, Homo sapien
tcattttgggtatcactggagtctg

SEQ ID NO: 104879 - DNA, 25 bp, Homo sapien
agataggcgcatctctggagttgat

SEQ ID NO: 104880 - DNA, 25 bp, Homo sapien
gcatctctggagttgatcgttacta

SEQ ID NO: 104881 - DNA, 25 bp, Homo sapien
gatcgttactatgtgtcaaagggtt

SEQ ID NO: 104882 - DNA, 25 bp, Homo sapien
gccatctacccctgctagaaggtta

SEQ ID NO: 104883 - DNA, 25 bp, Homo sapien
gttacagtgtattatgtagcatgca

SEQ ID NO: 104884 - DNA, 25 bp, Homo sapien
tataggctggctggtgaaaggttca

SEQ ID NO: 104885 - DNA, 25 bp, Homo sapien
gctggtgaaaggttcacgtggccca

SEQ ID NO: 104886 - DNA, 25 bp, Homo sapien
ggctgaacttcattgcctagctttg

SEQ ID NO: 104887 - DNA, 25 bp, Homo sapien
tcattgcctagctttggatgtgctt

SEQ ID NO: 104888 - DNA, 25 bp, Homo sapien
ggatgtgctttctgccataaagact

SEQ ID NO: 104889 - DNA, 25 bp, Homo sapien
tttttgttcgttctgagccttcaag

SEQ ID NO: 104890 - DNA, 25 bp, Homo sapien
tgttcgttctgagccttcaaggaat

SEQ ID NO: 104891 - DNA, 25 bp, Homo sapien
gttttttacaactggaatatgctcc

SEQ ID NO: 104892 - DNA, 25 bp, Homo sapien
actggaatatgctcctgtgtgtgtt

SEQ ID NO: 104893 - DNA, 25 bp, Homo sapien
aaagagtttgacctcagagctccag

SEQ ID NO: 104894 - DNA, 25 bp, Homo sapien
agagctccaggatcatcagtaaatt

SEQ ID NO: 104895 - DNA, 25 bp, Homo sapien
tttattaatttgcagacccagcccc

SEQ ID NO: 104896 - DNA, 25 bp, Homo sapien
ttattaatttgcagacccagcccct

SEQ ID NO: 104897 - DNA, 25 bp, Homo sapien
ggtgcccgaccagacgaggctgtct

SEQ ID NO: 104898 - DNA, 25 bp, Homo sapien
gtgcccgaccagacgaggctgtctc

SEQ ID NO: 104899 - DNA, 25 bp, Homo sapien
gtcttccccctgcttgtggctgaaa

SEQ ID NO: 104900 - DNA, 25 bp, Homo sapien
gtggctgaaacctttgcccagaaga

SEQ ID NO: 104901 - DNA, 25 bp, Homo sapien
atgccttcatgcatgagaagaacga

SEQ ID NO: 104902 - DNA, 25 bp, Homo sapien
tcatgcatgagaagaacgaggactg

SEQ ID NO: 104903 - DNA, 25 bp, Homo sapien
agaacgaggactgagcggctgcggt

SEQ ID NO: 104904 - DNA, 25 bp, Homo sapien
ggctgcggtcccaggaaggtcttac

SEQ ID NO: 104905 - DNA, 25 bp, Homo sapien
gctgcggtcccaggaaggtcttacc

SEQ ID NO: 104906 - DNA, 25 bp, Homo sapien
tcctgcacgcactgctgcacagtga

SEQ ID NO: 104907 - DNA, 25 bp, Homo sapien
acctcacggtccacaacatcgccta

SEQ ID NO: 104908 - DNA, 25 bp, Homo sapien
ctgcagctcatgagcgccgtccgca

SEQ ID NO: 104909 - DNA, 25 bp, Homo sapien
gcgccgtccgcaccagcatcgtgga

SEQ ID NO: 104910 - DNA, 25 bp, Homo sapien
aagcgcttcccggacttcgtgcggg

SEQ ID NO: 104911 - DNA, 25 bp, Homo sapien
cccggacttcgtgcgggacttcatg

SEQ ID NO: 104912 - DNA, 25 bp, Homo sapien
cgggacttcatgggcgccatgtacg

SEQ ID NO: 104913 - DNA, 25 bp, Homo sapien
cactgacgctctggcctctgtggga

SEQ ID NO: 104914 - DNA, 25 bp, Homo sapien
tgacgctctggcctctgtgggaatc

SEQ ID NO: 104915 - DNA, 25 bp, Homo sapien
acgctctggcctctgtgggaatcac

SEQ ID NO: 104916 - DNA, 25 bp, Homo sapien
ggctgacctggcattgggagaggga

SEQ ID NO: 104917 - DNA, 25 bp, Homo sapien
aagggcagggccaagaccgggcttg

SEQ ID NO: 104918 - DNA, 25 bp, Homo sapien
agggcagggccaagaccgggcttgg

SEQ ID NO: 104919 - DNA, 25 bp, Homo sapien
gggcagggccaagaccgggcttggg

SEQ ID NO: 104920 - DNA, 25 bp, Homo sapien
ggcagggccaagaccgggcttggga

SEQ ID NO: 104921 - DNA, 25 bp, Homo sapien
gcagggccaagaccgggcttgggag

SEQ ID NO: 104922 - DNA, 25 bp, Homo sapien
cagggccaagaccgggcttgggaga

SEQ ID NO: 104923 - DNA, 25 bp, Homo sapien
agggccaagaccgggcttgggagag

SEQ ID NO: 104924 - DNA, 25 bp, Homo sapien
gggagaggggcgcagctaagactgg

SEQ ID NO: 104925 - DNA, 25 bp, Homo sapien
ggagaggggcgcagctaagactggg

SEQ ID NO: 104926 - DNA, 25 bp, Homo sapien
gggcgcagctaagactgggggcagg

SEQ ID NO: 104927 - DNA, 25 bp, Homo sapien
gagaccaccttcacttgttgagaaa

SEQ ID NO: 104928 - DNA, 25 bp, Homo sapien
agaccaccttcacttgttgagaaat

SEQ ID NO: 104929 - DNA, 25 bp, Homo sapien
gaccaccttcacttgttgagaaatg

SEQ ID NO: 104930 - DNA, 25 bp, Homo sapien
accaccttcacttgttgagaaatgg

SEQ ID NO: 104931 - DNA, 25 bp, Homo sapien
ccaccttcacttgttgagaaatggt

SEQ ID NO: 104932 - DNA, 25 bp, Homo sapien
caccttcacttgttgagaaatggta

SEQ ID NO: 104933 - DNA, 25 bp, Homo sapien
cagtgcagttccgttctcgggggaa

SEQ ID NO: 104934 - DNA, 25 bp, Homo sapien
gtgcagttccgttctcgggggaaag

SEQ ID NO: 104935 - DNA, 25 bp, Homo sapien
tgcagttccgttctcgggggaaagc

SEQ ID NO: 104936 - DNA, 25 bp, Homo sapien
aatgttaccaactgctgagattttt

SEQ ID NO: 104937 - DNA, 25 bp, Homo sapien
ccaactgctgagatttttatgtatt

SEQ ID NO: 104938 - DNA, 25 bp, Homo sapien
actttgtaacaactgctattgtaat

SEQ ID NO: 104939 - DNA, 25 bp, Homo sapien
aactgctattgtaataagtgtcatc

SEQ ID NO: 104940 - DNA, 25 bp, Homo sapien
aagtgtcatcttgtgggcattatac

SEQ ID NO: 104941 - DNA, 25 bp, Homo sapien
gaagagtcaactgttcagatgtaag

SEQ ID NO: 104942 - DNA, 25 bp, Homo sapien
agagtaatttatcctagtggtaatg

SEQ ID NO: 104943 - DNA, 25 bp, Homo sapien
tatcctagtggtaatggttatatgt

SEQ ID NO: 104944 - DNA, 25 bp, Homo sapien
attaatgtctcaaagctgtgcagtc

SEQ ID NO: 104945 - DNA, 25 bp, Homo sapien
gtctcaaagctgtgcagtcttttgt

SEQ ID NO: 104946 - DNA, 25 bp, Homo sapien
gtgcagtcttttgttactgggacac

SEQ ID NO: 104947 - DNA, 25 bp, Homo sapien
ggaccaagtccttacactccttatt

SEQ ID NO: 104948 - DNA, 25 bp, Homo sapien
agtccttacactccttattgggcga

SEQ ID NO: 104949 - DNA, 25 bp, Homo sapien
tacactccttattgggcgatcaaga

SEQ ID NO: 104950 - DNA, 25 bp, Homo sapien
tgggcgatcaagacggtgcttacct

SEQ ID NO: 104951 - DNA, 25 bp, Homo sapien
caagacggtgcttacctgttccgaa

SEQ ID NO: 104952 - DNA, 25 bp, Homo sapien
acctgttccgaactttcctggagag

SEQ ID NO: 104953 - DNA, 25 bp, Homo sapien
ttccgaactttcctggagagggaga

SEQ ID NO: 104954 - DNA, 25 bp, Homo sapien
gaaatgcgtggataccttagacttc

SEQ ID NO: 104955 - DNA, 25 bp, Homo sapien
ggataccttagacttctggtttgcc

SEQ ID NO: 104956 - DNA, 25 bp, Homo sapien
tgaacctgaaggataccaaaacttt

SEQ ID NO: 104957 - DNA, 25 bp, Homo sapien
gataccaaaactttacgagtagcca

SEQ ID NO: 104958 - DNA, 25 bp, Homo sapien
gatgcctttgatctggaattggaca

SEQ ID NO: 104959 - DNA, 25 bp, Homo sapien
attggacatttctctgtcagagcac

SEQ ID NO: 104960 - DNA, 25 bp, Homo sapien
agaggaggctcatatcacctcttcc

SEQ ID NO: 104961 - DNA, 25 bp, Homo sapien
ctacttggcccagctgcttggagga

SEQ ID NO: 104962 - DNA, 25 bp, Homo sapien
agctgcttggaggaccgaccccatg

SEQ ID NO: 104963 - DNA, 25 bp, Homo sapien
gaccgaccccatggctgagaatatg

SEQ ID NO: 104964 - DNA, 25 bp, Homo sapien
tatgacggcaagaggaacagagttt

SEQ ID NO: 104965 - DNA, 25 bp, Homo sapien
gaacagagtttgctccaagtgggaa

SEQ ID NO: 104966 - DNA, 25 bp, Homo sapien
gaaagggtcccaagcagtccagaga

SEQ ID NO: 104967 - DNA, 25 bp, Homo sapien
agaagatgtctgtgtggctttccct

SEQ ID NO: 104968 - DNA, 25 bp, Homo sapien
aatggcgtggtctttgttgtgaaaa

SEQ ID NO: 104969 - DNA, 25 bp, Homo sapien
gagagcatttttgcacatgtatcgt

SEQ ID NO: 104970 - DNA, 25 bp, Homo sapien
ttgcacatgtatcgtggcagatgta

SEQ ID NO: 104971 - DNA, 25 bp, Homo sapien
agatgtaggccagaggctcttcttt

SEQ ID NO: 104972 - DNA, 25 bp, Homo sapien
tttatccatcctatggccaacctat

SEQ ID NO: 104973 - DNA, 25 bp, Homo sapien
tcctatggccaacctatgaatgtat

SEQ ID NO: 104974 - DNA, 25 bp, Homo sapien
acacgtttaatgagattttgccagc

SEQ ID NO: 104975 - DNA, 25 bp, Homo sapien
ttgccagcaatcaaagccttcaggg

SEQ ID NO: 104976 - DNA, 25 bp, Homo sapien
aaaatgtccctagctctttactaca

SEQ ID NO: 104977 - DNA, 25 bp, Homo sapien
agctctttactacatcagatcaagg

SEQ ID NO: 104978 - DNA, 25 bp, Homo sapien
aaggactctggataattggcataac

SEQ ID NO: 104979 - DNA, 25 bp, Homo sapien
aacatcctggaatagctgaaacaga

SEQ ID NO: 104980 - DNA, 25 bp, Homo sapien
gctgaagccagtcctggagcccata

SEQ ID NO: 104981 - DNA, 25 bp, Homo sapien
atacctcacccctgcctggtgagga

SEQ ID NO: 104982 - DNA, 25 bp, Homo sapien
tgaggatgtcttgttcctgagggag

SEQ ID NO: 104983 - DNA, 25 bp, Homo sapien
gcctccagctgttgaagggtagcgc

SEQ ID NO: 104984 - DNA, 25 bp, Homo sapien
ctgttgaagggtagcgctggccctt

SEQ ID NO: 104985 - DNA, 25 bp, Homo sapien
ggaggctggcactagctgacagctt

SEQ ID NO: 104986 - DNA, 25 bp, Homo sapien
ggcactagctgacagcttttcctct

SEQ ID NO: 104987 - DNA, 25 bp, Homo sapien
tctgcacctgcgctctggtgacttg

SEQ ID NO: 104988 - DNA, 25 bp, Homo sapien
gtggacgcctctgccttcacttgaa

SEQ ID NO: 104989 - DNA, 25 bp, Homo sapien
cctctgccttcacttgaacacaaat

SEQ ID NO: 104990 - DNA, 25 bp, Homo sapien
ttcacttgaacacaaatgtgcttcc

SEQ ID NO: 104991 - DNA, 25 bp, Homo sapien
acgatcccacgaaactacaccatga

SEQ ID NO: 104992 - DNA, 25 bp, Homo sapien
cgatcccacgaaactacaccatgag

SEQ ID NO: 104993 - DNA, 25 bp, Homo sapien
acgaaactacaccatgagcttcctg

SEQ ID NO: 104994 - DNA, 25 bp, Homo sapien
cgaaactacaccatgagcttcctgc

SEQ ID NO: 104995 - DNA, 25 bp, Homo sapien
gaaactacaccatgagcttcctgcc

SEQ ID NO: 104996 - DNA, 25 bp, Homo sapien
aaactacaccatgagcttcctgccc

SEQ ID NO: 104997 - DNA, 25 bp, Homo sapien
aactacaccatgagcttcctgcccc

SEQ ID NO: 104998 - DNA, 25 bp, Homo sapien
actacaccatgagcttcctgccccg

SEQ ID NO: 104999 - DNA, 25 bp, Homo sapien
ctacaccatgagcttcctgccccgc

SEQ ID NO: 105000 - DNA, 25 bp, Homo sapien
tacaccatgagcttcctgccccgct

SEQ ID NO: 105001 - DNA, 25 bp, Homo sapien
tcccagtgctggagagggtgggctg

SEQ ID NO: 105002 - DNA, 25 bp, Homo sapien
ctggagagggtgggctgagggactg

SEQ ID NO: 105003 - DNA, 25 bp, Homo sapien
gggccagcacggaccacccaaggcc

SEQ ID NO: 105004 - DNA, 25 bp, Homo sapien
ctcgctgccattctctgggctggaa

SEQ ID NO: 105005 - DNA, 25 bp, Homo sapien
tcgctgccattctctgggctggaat

SEQ ID NO: 105006 - DNA, 25 bp, Homo sapien
cattctctgggctggaatgtgaagc

SEQ ID NO: 105007 - DNA, 25 bp, Homo sapien
ggaatgtgaagcctcagtcactcta

SEQ ID NO: 105008 - DNA, 25 bp, Homo sapien
gaatgtgaagcctcagtcactctaa

SEQ ID NO: 105009 - DNA, 25 bp, Homo sapien
aatgtgaagcctcagtcactctaaa

SEQ ID NO: 105010 - DNA, 25 bp, Homo sapien
atgtgaagcctcagtcactctaaat

SEQ ID NO: 105011 - DNA, 25 bp, Homo sapien
gttagatattctagatttacattaa

SEQ ID NO: 105012 - DNA, 25 bp, Homo sapien
ttgtggggatcctttgctcttactc

SEQ ID NO: 105013 - DNA, 25 bp, Homo sapien
tctttattttgttgtacgggcctag

SEQ ID NO: 105014 - DNA, 25 bp, Homo sapien
ttattttgttgtacgggcctaggtg

SEQ ID NO: 105015 - DNA, 25 bp, Homo sapien
ttgtacgggcctaggtgtgtacctt

SEQ ID NO: 105016 - DNA, 25 bp, Homo sapien
tacgggcctaggtgtgtaccttact

SEQ ID NO: 105017 - DNA, 25 bp, Homo sapien
ggcctaggtgtgtaccttacttctg

SEQ ID NO: 105018 - DNA, 25 bp, Homo sapien
aggtgtgtaccttacttctgctgca

SEQ ID NO: 105019 - DNA, 25 bp, Homo sapien
gtgtgtaccttacttctgctgcaac

SEQ ID NO: 105020 - DNA, 25 bp, Homo sapien
tgtgtaccttacttctgctgcaacc

SEQ ID NO: 105021 - DNA, 25 bp, Homo sapien
tacttctgctgcaacccacaactca

SEQ ID NO: 105022 - DNA, 25 bp, Homo sapien
aagagggctctgaaaatgtccttca

SEQ ID NO: 105023 - DNA, 25 bp, Homo sapien
gaaactatatttcctcatgtgctga

SEQ ID NO: 105024 - DNA, 25 bp, Homo sapien
atatttcctcatgtgctgatttgtc

SEQ ID NO: 105025 - DNA, 25 bp, Homo sapien
tttcctcatgtgctgatttgtctta

SEQ ID NO: 105026 - DNA, 25 bp, Homo sapien
ctcatgtgctgatttgtcttatttt

SEQ ID NO: 105027 - DNA, 25 bp, Homo sapien
tttttttcatactttcccactggtg

SEQ ID NO: 105028 - DNA, 25 bp, Homo sapien
gatatttctgtattactagggaggc

SEQ ID NO: 105029 - DNA, 25 bp, Homo sapien
ttactagggaggcatttacagtcct

SEQ ID NO: 105030 - DNA, 25 bp, Homo sapien
ggaggcatttacagtcctctaatgt

SEQ ID NO: 105031 - DNA, 25 bp, Homo sapien
ggcatttacagtcctctaatgttga

SEQ ID NO: 105032 - DNA, 25 bp, Homo sapien
tacagtcctctaatgttgattaata

SEQ ID NO: 105033 - DNA, 25 bp, Homo sapien
gatgattttatgttatgtggatttc

SEQ ID NO: 105034 - DNA, 25 bp, Homo sapien
taagagatcccattccccatccata

SEQ ID NO: 105035 - DNA, 25 bp, Homo sapien
tccatagatgggactcctaagaggt

SEQ ID NO: 105036 - DNA, 25 bp, Homo sapien
ggaggagaatctatgcctattccaa

SEQ ID NO: 105037 - DNA, 25 bp, Homo sapien
gcctattccaactattgatacatca

SEQ ID NO: 105038 - DNA, 25 bp, Homo sapien
atcacgcaaaaagagactacccagt

SEQ ID NO: 105039 - DNA, 25 bp, Homo sapien
gagactacccagtaaagaactacca

SEQ ID NO: 105040 - DNA, 25 bp, Homo sapien
attcatcatctccagttccagcaaa

SEQ ID NO: 105041 - DNA, 25 bp, Homo sapien
gttccagcaaacaacatccgtgtca

SEQ ID NO: 105042 - DNA, 25 bp, Homo sapien
acatccgtgtcatcaaaaattccat

SEQ ID NO: 105043 - DNA, 25 bp, Homo sapien
aaattccattcgactgacccttaat

SEQ ID NO: 105044 - DNA, 25 bp, Homo sapien
gacccttaatcggtaaaagcagtgc

SEQ ID NO: 105045 - DNA, 25 bp, Homo sapien
accaaacagctgctcaatggggtaa

SEQ ID NO: 105046 - DNA, 25 bp, Homo sapien
ggtaagctggctggcaagtacagac

SEQ ID NO: 105047 - DNA, 25 bp, Homo sapien
agctggctggcaagtacagaccaga

SEQ ID NO: 105048 - DNA, 25 bp, Homo sapien
aagcaaaggagacatccccactaag

SEQ ID NO: 105049 - DNA, 25 bp, Homo sapien
taagagatcacctgtccttttaatg

SEQ ID NO: 105050 - DNA, 25 bp, Homo sapien
gggttaacgctgtcaccaccttagt

SEQ ID NO: 105051 - DNA, 25 bp, Homo sapien
gttaacgctgtcaccaccttagtgg

SEQ ID NO: 105052 - DNA, 25 bp, Homo sapien
gaaggatcagctggtgatgactgca

SEQ ID NO: 105053 - DNA, 25 bp, Homo sapien
gactgcacaggacagagatcccatt

SEQ ID NO: 105054 - DNA, 25 bp, Homo sapien
gagatcccattgagttggttgtctt

SEQ ID NO: 105055 - DNA, 25 bp, Homo sapien
gggttccttactgcattatctaatg

SEQ ID NO: 105056 - DNA, 25 bp, Homo sapien
gagaaggcagcacatcacaacctgt

SEQ ID NO: 105057 - DNA, 25 bp, Homo sapien
gaaggcagcacatcacaacctgtca

SEQ ID NO: 105058 - DNA, 25 bp, Homo sapien
gcacatcacaacctgtcacattgaa

SEQ ID NO: 105059 - DNA, 25 bp, Homo sapien
atcacaacctgtcacattgaaatag

SEQ ID NO: 105060 - DNA, 25 bp, Homo sapien
cacaacctgtcacattgaaataggc

SEQ ID NO: 105061 - DNA, 25 bp, Homo sapien
ctcattctgctatttcaccttccgt

SEQ ID NO: 105062 - DNA, 25 bp, Homo sapien
atttcaccttccgtcctgagcagag

SEQ ID NO: 105063 - DNA, 25 bp, Homo sapien
ctgagcagagcctgaattacgtttt

SEQ ID NO: 105064 - DNA, 25 bp, Homo sapien
gagcagagcctgaattacgtttttg

SEQ ID NO: 105065 - DNA, 25 bp, Homo sapien
gcagagcctgaattacgtttttggg

SEQ ID NO: 105066 - DNA, 25 bp, Homo sapien
gcctgaattacgtttttgggcaatt

SEQ ID NO: 105067 - DNA, 25 bp, Homo sapien
cacagagacagatgaactttgggca

SEQ ID NO: 105068 - DNA, 25 bp, Homo sapien
actttgggcatccttggaggcagct

SEQ ID NO: 105069 - DNA, 25 bp, Homo sapien
aggcagctgccaagcggaagctctc

SEQ ID NO: 105070 - DNA, 25 bp, Homo sapien
ttggagcagccccaaggagctctcc

SEQ ID NO: 105071 - DNA, 25 bp, Homo sapien
caaggagctctccaaacgagacgga

SEQ ID NO: 105072 - DNA, 25 bp, Homo sapien
gaagaagcggcctgggtccaccagc

SEQ ID NO: 105073 - DNA, 25 bp, Homo sapien
ttcaaagcctctactagcctcctgt

SEQ ID NO: 105074 - DNA, 25 bp, Homo sapien
actagcctcctgtggcttggacaga

SEQ ID NO: 105075 - DNA, 25 bp, Homo sapien
atgagccccaagagcctcaagaacc

SEQ ID NO: 105076 - DNA, 25 bp, Homo sapien
gagcctcaagaacccaacaaggtgc

SEQ ID NO: 105077 - DNA, 25 bp, Homo sapien
aaggtgcccctagaagacacagaga

SEQ ID NO: 105078 - DNA, 25 bp, Homo sapien
gggttccaactcagatgcctttcaa

SEQ ID NO: 105079 - DNA, 25 bp, Homo sapien
tccaactcagatgcctttcaactgg

SEQ ID NO: 105080 - DNA, 25 bp, Homo sapien
ggcctctgatgctagcctgtggtca

SEQ ID NO: 105081 - DNA, 25 bp, Homo sapien
atgctagcctgtggtcagatgtgga

SEQ ID NO: 105082 - DNA, 25 bp, Homo sapien
ggaggcccagggaatagaccctcaa

SEQ ID NO: 105083 - DNA, 25 bp, Homo sapien
ggcccagggaatagaccctcaagag

SEQ ID NO: 105084 - DNA, 25 bp, Homo sapien
gagacaggagagactccgaactcca

SEQ ID NO: 105085 - DNA, 25 bp, Homo sapien
gagagactccgaactccatcagcag

SEQ ID NO: 105086 - DNA, 25 bp, Homo sapien
gactccgaactccatcagcagagaa

SEQ ID NO: 105087 - DNA, 25 bp, Homo sapien
cgaactccatcagcagagaagacct

SEQ ID NO: 105088 - DNA, 25 bp, Homo sapien
atatacccccttcaccagcaaaggt

SEQ ID NO: 105089 - DNA, 25 bp, Homo sapien
gagaagctgagaagcagactgctga

SEQ ID NO: 105090 - DNA, 25 bp, Homo sapien
ctgaatttaaattatctgctgtaag

SEQ ID NO: 105091 - DNA, 25 bp, Homo sapien
ctgctgtaagagagagtttggacta

SEQ ID NO: 105092 - DNA, 25 bp, Homo sapien
gagagtttggactaccttcttgact

SEQ ID NO: 105093 - DNA, 25 bp, Homo sapien
tttggactaccttcttgactttgtt

SEQ ID NO: 105094 - DNA, 25 bp, Homo sapien
ggactaccttcttgactttgttgat

SEQ ID NO: 105095 - DNA, 25 bp, Homo sapien
accttcttgactttgttgatgccac

SEQ ID NO: 105096 - DNA, 25 bp, Homo sapien
ttgactttgttgatgccacacctga

SEQ ID NO: 105097 - DNA, 25 bp, Homo sapien
gactttgttgatgccacacctgagt

SEQ ID NO: 105098 - DNA, 25 bp, Homo sapien
gttgatgccacacctgagtttcaga

SEQ ID NO: 105099 - DNA, 25 bp, Homo sapien
gccacacctgagtttcagagattcc

SEQ ID NO: 105100 - DNA, 25 bp, Homo sapien
gggcagatagtttggctgctcctgt

SEQ ID NO: 105101 - DNA, 25 bp, Homo sapien
tgtcacctgcaattctcccttatca

SEQ ID NO: 105102 - DNA, 25 bp, Homo sapien
agggatattttctctgacttgtcaa

SEQ ID NO: 105103 - DNA, 25 bp, Homo sapien
tgacttgtcaatccacatcttccca

SEQ ID NO: 105104 - DNA, 25 bp, Homo sapien
ttcccattccctcaagatccaatga

SEQ ID NO: 105105 - DNA, 25 bp, Homo sapien
aagatccaatgaacatccaacctcc

SEQ ID NO: 105106 - DNA, 25 bp, Homo sapien
gaacatccaacctccattaaagaga

SEQ ID NO: 105107 - DNA, 25 bp, Homo sapien
gggtcacttcctaaatatatctgct

SEQ ID NO: 105108 - DNA, 25 bp, Homo sapien
gtatcacttgtattgaccaccacat

SEQ ID NO: 105109 - DNA, 25 bp, Homo sapien
gaccaccacatatgctaatacctat

SEQ ID NO: 105110 - DNA, 25 bp, Homo sapien
tacctatctactgctgagttgtcag

SEQ ID NO: 105111 - DNA, 25 bp, Homo sapien
tgtcagtgtcagatctagaaggcct

SEQ ID NO: 105112 - DNA, 25 bp, Homo sapien
gaaggcctgatggacagtgcacagt

SEQ ID NO: 105113 - DNA, 25 bp, Homo sapien
atgaatcaccatcttcaggcagggt

SEQ ID NO: 105114 - DNA, 25 bp, Homo sapien
actgaatcagatgccagtagtgata

SEQ ID NO: 105115 - DNA, 25 bp, Homo sapien
gaggatgtatctgcagttgttgcac

SEQ ID NO: 105116 - DNA, 25 bp, Homo sapien
gcagttgttgcacagcactccttga

SEQ ID NO: 105117 - DNA, 25 bp, Homo sapien
actccttgacccaacagagactttt

SEQ ID NO: 105118 - DNA, 25 bp, Homo sapien
cagagacttttggtttctaatgcaa

SEQ ID NO: 105119 - DNA, 25 bp, Homo sapien
taatgcaaaccagacagtacccgat

SEQ ID NO: 105120 - DNA, 25 bp, Homo sapien
cagacagtacccgatcgatcagatc

SEQ ID NO: 105121 - DNA, 25 bp, Homo sapien
tcgatcagatcgatcgggaactgat

SEQ ID NO: 105122 - DNA, 25 bp, Homo sapien
caagtgtttgtcttagatgattaag

SEQ ID NO: 105123 - DNA, 25 bp, Homo sapien
gactatatctagatcatgtctgatt

SEQ ID NO: 105124 - DNA, 25 bp, Homo sapien
tatctagatcatgtctgatttttta

SEQ ID NO: 105125 - DNA, 25 bp, Homo sapien
gtgacttctccagccctggtctgaa

SEQ ID NO: 105126 - DNA, 25 bp, Homo sapien
ctatttattagctgcaagaatgcac

SEQ ID NO: 105127 - DNA, 25 bp, Homo sapien
attagctgcaagaatgcactttaga

SEQ ID NO: 105128 - DNA, 25 bp, Homo sapien
tgcaagaatgcactttagaactatt

SEQ ID NO: 105129 - DNA, 25 bp, Homo sapien
ctttagaactatttgacaattcaga

SEQ ID NO: 105130 - DNA, 25 bp, Homo sapien
aaatgactggccaataataaccatt

SEQ ID NO: 105131 - DNA, 25 bp, Homo sapien
gactggccaataataaccattttag

SEQ ID NO: 105132 - DNA, 25 bp, Homo sapien
ggccaataataaccattttaggaag

SEQ ID NO: 105133 - DNA, 25 bp, Homo sapien
ggagaggtggttagagggaacagaa

SEQ ID NO: 105134 - DNA, 25 bp, Homo sapien
cttgatgatgtccttcagagctgtg

SEQ ID NO: 105135 - DNA, 25 bp, Homo sapien
ttgatgatgtccttcagagctgtga

SEQ ID NO: 105136 - DNA, 25 bp, Homo sapien
tgatgatgtccttcagagctgtgat

SEQ ID NO: 105137 - DNA, 25 bp, Homo sapien
atgatgtccttcagagctgtgatga

SEQ ID NO: 105138 - DNA, 25 bp, Homo sapien
ccttcagagctgtgatgagaggaag

SEQ ID NO: 105139 - DNA, 25 bp, Homo sapien
aagggaaaccttacagtatgctaca

SEQ ID NO: 105140 - DNA, 25 bp, Homo sapien
agggaaaccttacagtatgctacaa

SEQ ID NO: 105141 - DNA, 25 bp, Homo sapien
gggaaaccttacagtatgctacaaa

SEQ ID NO: 105142 - DNA, 25 bp, Homo sapien
ggaaaccttacagtatgctacaaag

SEQ ID NO: 105143 - DNA, 25 bp, Homo sapien
gaaaccttacagtatgctacaaaga

SEQ ID NO: 105144 - DNA, 25 bp, Homo sapien
ttttggccctgcagcatgtcatgct

SEQ ID NO: 105145 - DNA, 25 bp, Homo sapien
tgtcatgctcccagaatttcagctt

SEQ ID NO: 105146 - DNA, 25 bp, Homo sapien
tcagcttcagcttaactgacagacg

SEQ ID NO: 105147 - DNA, 25 bp, Homo sapien
gcttcagcttaactgacagacgtta

SEQ ID NO: 105148 - DNA, 25 bp, Homo sapien
actgacagacgttaaagctttctgg

SEQ ID NO: 105149 - DNA, 25 bp, Homo sapien
gacgttaaagctttctggttagatt

SEQ ID NO: 105150 - DNA, 25 bp, Homo sapien
gatcatgtcttttccatgtgtacct

SEQ ID NO: 105151 - DNA, 25 bp, Homo sapien
tcatgtcttttccatgtgtacctgt

SEQ ID NO: 105152 - DNA, 25 bp, Homo sapien
gtcttttccatgtgtacctgtaata

SEQ ID NO: 105153 - DNA, 25 bp, Homo sapien
catgtgtacctgtaatatttttcca

SEQ ID NO: 105154 - DNA, 25 bp, Homo sapien
atttttccatcatatctcaaagtaa

SEQ ID NO: 105155 - DNA, 25 bp, Homo sapien
ggacagtgtcttattcatctctgtg

SEQ ID NO: 105156 - DNA, 25 bp, Homo sapien
gacagtgtcttattcatctctgtgt

SEQ ID NO: 105157 - DNA, 25 bp, Homo sapien
cagtgtcttattcatctctgtgttc

SEQ ID NO: 105158 - DNA, 25 bp, Homo sapien
agtgtcttattcatctctgtgttct

SEQ ID NO: 105159 - DNA, 25 bp, Homo sapien
gtgtcttattcatctctgtgttctt

SEQ ID NO: 105160 - DNA, 25 bp, Homo sapien
gtcttattcatctctgtgttcttag

SEQ ID NO: 105161 - DNA, 25 bp, Homo sapien
cttattcatctctgtgttcttagtg

SEQ ID NO: 105162 - DNA, 25 bp, Homo sapien
ttattcatctctgtgttcttagtgc

SEQ ID NO: 105163 - DNA, 25 bp, Homo sapien
gtgtgttgatctgaaatgccccaga

SEQ ID NO: 105164 - DNA, 25 bp, Homo sapien
gtgttgatctgaaatgccccagacc

SEQ ID NO: 105165 - DNA, 25 bp, Homo sapien
gttgatctgaaatgccccagaccaa

SEQ ID NO: 105166 - DNA, 25 bp, Homo sapien
gaggagaacctgtgcgtgaccagcc

SEQ ID NO: 105167 - DNA, 25 bp, Homo sapien
gaagtcctgcaatttggatccctgc

SEQ ID NO: 105168 - DNA, 25 bp, Homo sapien
gaagcagtatcgactcagcatggaa

SEQ ID NO: 105169 - DNA, 25 bp, Homo sapien
agcatggaacgcctgcaacgttctt

SEQ ID NO: 105170 - DNA, 25 bp, Homo sapien
gcaacgttctttgttaggcaaccaa

SEQ ID NO: 105171 - DNA, 25 bp, Homo sapien
taggcaaccaagaggcctggcttct

SEQ ID NO: 105172 - DNA, 25 bp, Homo sapien
aactagctctgtggcctagggcgag

SEQ ID NO: 105173 - DNA, 25 bp, Homo sapien
gaggtgtctgccctttatgtttcca

SEQ ID NO: 105174 - DNA, 25 bp, Homo sapien
gaactggttgtacctgatgatctga

SEQ ID NO: 105175 - DNA, 25 bp, Homo sapien
atgatctgagatcccatgacttgct

SEQ ID NO: 105176 - DNA, 25 bp, Homo sapien
atgacttgctcacatgtcccatgat

SEQ ID NO: 105177 - DNA, 25 bp, Homo sapien
tggcactgccacgtatagcactgca

SEQ ID NO: 105178 - DNA, 25 bp, Homo sapien
gccacgtatagcactgcagccttgg

SEQ ID NO: 105179 - DNA, 25 bp, Homo sapien
gaaagttatttaaactcatgggctt

SEQ ID NO: 105180 - DNA, 25 bp, Homo sapien
ctcatgggcttcagtttcaacatct

SEQ ID NO: 105181 - DNA, 25 bp, Homo sapien
catgggcttcagtttcaacatctgt

SEQ ID NO: 105182 - DNA, 25 bp, Homo sapien
aatgggcatgttaacattgcctacc

SEQ ID NO: 105183 - DNA, 25 bp, Homo sapien
ggcatgttaacattgcctacctcat

SEQ ID NO: 105184 - DNA, 25 bp, Homo sapien
aagcaactttaaaaagtgcctggca

SEQ ID NO: 105185 - DNA, 25 bp, Homo sapien
tgcctggcacttagttattgttaag

SEQ ID NO: 105186 - DNA, 25 bp, Homo sapien
tgttaagtaagtgtctgcagatgca

SEQ ID NO: 105187 - DNA, 25 bp, Homo sapien
agtgtctgcagatgcaagtttggaa

SEQ ID NO: 105188 - DNA, 25 bp, Homo sapien
gatgctcgcccaggagtgaggctcc

SEQ ID NO: 105189 - DNA, 25 bp, Homo sapien
caggagtgaggctccccgcctgtgt

SEQ ID NO: 105190 - DNA, 25 bp, Homo sapien
tggctgcgctctgagccttcagggc

SEQ ID NO: 105191 - DNA, 25 bp, Homo sapien
tgctgcttttgtgctgggactctcc

SEQ ID NO: 105192 - DNA, 25 bp, Homo sapien
gctgcttttgtgctgggactctccg

SEQ ID NO: 105193 - DNA, 25 bp, Homo sapien
tgcttttgtgctgggactctccggg

SEQ ID NO: 105194 - DNA, 25 bp, Homo sapien
ctctctgccttcagaccttgggcag

SEQ ID NO: 105195 - DNA, 25 bp, Homo sapien
ctgccttcagaccttgggcagaagg

SEQ ID NO: 105196 - DNA, 25 bp, Homo sapien
gccttcagaccttgggcagaaggag

SEQ ID NO: 105197 - DNA, 25 bp, Homo sapien
ctgcagtggaatgagggccccttaa

SEQ ID NO: 105198 - DNA, 25 bp, Homo sapien
atgagggccccttaaccccgcattg

SEQ ID NO: 105199 - DNA, 25 bp, Homo sapien
ggcatgtatgccgtaagcagttccc

SEQ ID NO: 105200 - DNA, 25 bp, Homo sapien
atgtatgccgtaagcagttcccaac

SEQ ID NO: 105201 - DNA, 25 bp, Homo sapien
ttcctttcacactttggataagtaa

SEQ ID NO: 105202 - DNA, 25 bp, Homo sapien
gataagtaagatgtgtgaccctgca

SEQ ID NO: 105203 - DNA, 25 bp, Homo sapien
taagatgtgtgaccctgcaaggaat

SEQ ID NO: 105204 - DNA, 25 bp, Homo sapien
gtgtgaccctgcaaggaataacaaa

SEQ ID NO: 105205 - DNA, 25 bp, Homo sapien
aaattattctgcttatatattctta

SEQ ID NO: 105206 - DNA, 25 bp, Homo sapien
gaggatacattaatgtctcagtgat

SEQ ID NO: 105207 - DNA, 25 bp, Homo sapien
atgtctcagtgattgtcattcatct

SEQ ID NO: 105208 - DNA, 25 bp, Homo sapien
gattgtcattcatctttcacagcgc

SEQ ID NO: 105209 - DNA, 25 bp, Homo sapien
attcatctttcacagcgcccagcaa

SEQ ID NO: 105210 - DNA, 25 bp, Homo sapien
ggaagcggccaagaatgtcattctc

SEQ ID NO: 105211 - DNA, 25 bp, Homo sapien
atcctgagattggacccataccctg

SEQ ID NO: 105212 - DNA, 25 bp, Homo sapien
tgagattggacccataccctgtctc

SEQ ID NO: 105213 - DNA, 25 bp, Homo sapien
ccaaccctgccttgaagcaattcaa

SEQ ID NO: 105214 - DNA, 25 bp, Homo sapien
ccccagaccatcttgggttggaatt

SEQ ID NO: 105215 - DNA, 25 bp, Homo sapien
catcttgggttggaattgagtggcc

SEQ ID NO: 105216 - DNA, 25 bp, Homo sapien
gggtcatggattccaggccacaaat

SEQ ID NO: 105217 - DNA, 25 bp, Homo sapien
ggattccaggccacaaattccaggc

SEQ ID NO: 105218 - DNA, 25 bp, Homo sapien
ccacaaattccaggcctagttcagt

SEQ ID NO: 105219 - DNA, 25 bp, Homo sapien
aattccaggcctagttcagtttggg

SEQ ID NO: 105220 - DNA, 25 bp, Homo sapien
caggccagcccttgacattaaaaaa

SEQ ID NO: 105221 - DNA, 25 bp, Homo sapien
acttgagtaatgtgccgacacctcc

SEQ ID NO: 105222 - DNA, 25 bp, Homo sapien
ggagatatatctgagatactccaga

SEQ ID NO: 105223 - DNA, 25 bp, Homo sapien
gatactccagaattccgagtataag

SEQ ID NO: 105224 - DNA, 25 bp, Homo sapien
gaattccgagtataagtgatcttgc

SEQ ID NO: 105225 - DNA, 25 bp, Homo sapien
gtgatcttgcagagtttttgcatgt

SEQ ID NO: 105226 - DNA, 25 bp, Homo sapien
aaaagcaaacagcactgaaaggttg

SEQ ID NO: 105227 - DNA, 25 bp, Homo sapien
gaaaggttgtagtagaactcagtta

SEQ ID NO: 105228 - DNA, 25 bp, Homo sapien
agaactcagttatatggtggttact

SEQ ID NO: 105229 - DNA, 25 bp, Homo sapien
ggtggttactcatgacttaaaatac

SEQ ID NO: 105230 - DNA, 25 bp, Homo sapien
ggttactcatgacttaaaatacgtg

SEQ ID NO: 105231 - DNA, 25 bp, Homo sapien
atacgtgtatatgcacatagaaatc

SEQ ID NO: 105232 - DNA, 25 bp, Homo sapien
ggacgaggtggtggtgcctctggac

SEQ ID NO: 105233 - DNA, 25 bp, Homo sapien
cgctgcgatggccaccagcagggtt

SEQ ID NO: 105234 - DNA, 25 bp, Homo sapien
ggttacccccgcaagtggaggactg

SEQ ID NO: 105235 - DNA, 25 bp, Homo sapien
aagtggaggactgatgacgccccgc

SEQ ID NO: 105236 - DNA, 25 bp, Homo sapien
ggaggactgatgacgccccgctcta

SEQ ID NO: 105237 - DNA, 25 bp, Homo sapien
tgacgccccgctctagggactgcag

SEQ ID NO: 105238 - DNA, 25 bp, Homo sapien
actcatttctagtccagccgcattt

SEQ ID NO: 105239 - DNA, 25 bp, Homo sapien
agccgcatttcagcagtgccttctg

SEQ ID NO: 105240 - DNA, 25 bp, Homo sapien
ccgcatttcagcagtgccttctggg

SEQ ID NO: 105241 - DNA, 25 bp, Homo sapien
ctttggccccagaggcgagggacca

SEQ ID NO: 105242 - DNA, 25 bp, Homo sapien
aggcgagggaccagtggaggtgcca

SEQ ID NO: 105243 - DNA, 25 bp, Homo sapien
tggccaatgggagctgctttcctga

SEQ ID NO: 105244 - DNA, 25 bp, Homo sapien
gctgctttcctgagggactcgaaat

SEQ ID NO: 105245 - DNA, 25 bp, Homo sapien
tgagggactcgaaattctccggcgg

SEQ ID NO: 105246 - DNA, 25 bp, Homo sapien
gactcgaaattctccggcgggtggt

SEQ ID NO: 105247 - DNA, 25 bp, Homo sapien
ccggctgggtctgtaccaaaggtgt

SEQ ID NO: 105248 - DNA, 25 bp, Homo sapien
aggaaagaagacaccgaccacggcg

SEQ ID NO: 105249 - DNA, 25 bp, Homo sapien
accgaccacggcgaagcaatagagg

SEQ ID NO: 105250 - DNA, 25 bp, Homo sapien
agaggctggctgattgtgaccgaaa

SEQ ID NO: 105251 - DNA, 25 bp, Homo sapien
gtgaccgaaaccagagggttgtcca

SEQ ID NO: 105252 - DNA, 25 bp, Homo sapien
agagggttgtccaccccgggcatct

SEQ ID NO: 105253 - DNA, 25 bp, Homo sapien
caactgtaaaataatcgctaaggat

SEQ ID NO: 105254 - DNA, 25 bp, Homo sapien
ggatgaatctacaaccattactcgg

SEQ ID NO: 105255 - DNA, 25 bp, Homo sapien
tacaaccattactcggtcatccagg

SEQ ID NO: 105256 - DNA, 25 bp, Homo sapien
attactcggtcatccagggcaatct

SEQ ID NO: 105257 - DNA, 25 bp, Homo sapien
ctcggtcatccagggcaatctgtgg

SEQ ID NO: 105258 - DNA, 25 bp, Homo sapien
caatctgtgggtaaactgtgtcctt

SEQ ID NO: 105259 - DNA, 25 bp, Homo sapien
gtgggtaaactgtgtccttcgttat

SEQ ID NO: 105260 - DNA, 25 bp, Homo sapien
aaactgtgtccttcgttatgtctgt

SEQ ID NO: 105261 - DNA, 25 bp, Homo sapien
gtgtccttcgttatgtctgttaata

SEQ ID NO: 105262 - DNA, 25 bp, Homo sapien
cttcgttatgtctgttaatactgca

SEQ ID NO: 105263 - DNA, 25 bp, Homo sapien
gaagcatataggtatctagtaagaa

SEQ ID NO: 105264 - DNA, 25 bp, Homo sapien
caacactctaggaaggccgaggcag

SEQ ID NO: 105265 - DNA, 25 bp, Homo sapien
attttctcctccgtcctaagagtat

SEQ ID NO: 105266 - DNA, 25 bp, Homo sapien
ttctcctccgtcctaagagtatctg

SEQ ID NO: 105267 - DNA, 25 bp, Homo sapien
tccgtcctaagagtatctgccagag

SEQ ID NO: 105268 - DNA, 25 bp, Homo sapien
gtcctaagagtatctgccagaggcc

SEQ ID NO: 105269 - DNA, 25 bp, Homo sapien
agagtatctgccagaggccagcaca

SEQ ID NO: 105270 - DNA, 25 bp, Homo sapien
gtatctgccagaggccagcacaaag

SEQ ID NO: 105271 - DNA, 25 bp, Homo sapien
agaggccagcacaaagccttttcca

SEQ ID NO: 105272 - DNA, 25 bp, Homo sapien
atctcagttctgcagttacaccacc

SEQ ID NO: 105273 - DNA, 25 bp, Homo sapien
agttctgcagttacaccaccttcta

SEQ ID NO: 105274 - DNA, 25 bp, Homo sapien
cctcctcagggcaacgtctctcaaa

SEQ ID NO: 105275 - DNA, 25 bp, Homo sapien
gaggggaccattgctaagctctcat

SEQ ID NO: 105276 - DNA, 25 bp, Homo sapien
tatggtgccattgcccgggctgtac

SEQ ID NO: 105277 - DNA, 25 bp, Homo sapien
cattgcccgggctgtactgagcatg

SEQ ID NO: 105278 - DNA, 25 bp, Homo sapien
tgcccgggctgtactgagcatgcaa

SEQ ID NO: 105279 - DNA, 25 bp, Homo sapien
ccgggctgtactgagcatgcaatca

SEQ ID NO: 105280 - DNA, 25 bp, Homo sapien
ggctgtactgagcatgcaatcaacc

SEQ ID NO: 105281 - DNA, 25 bp, Homo sapien
ttaggacatgtggagcccatcttat

SEQ ID NO: 105282 - DNA, 25 bp, Homo sapien
aggacatgtggagcccatcttatgg

SEQ ID NO: 105283 - DNA, 25 bp, Homo sapien
tttttcattccagtcatgtgcatgt

SEQ ID NO: 105284 - DNA, 25 bp, Homo sapien
tttcattccagtcatgtgcatgtat

SEQ ID NO: 105285 - DNA, 25 bp, Homo sapien
attccagtcatgtgcatgtatctcc

SEQ ID NO: 105286 - DNA, 25 bp, Homo sapien
cagtcatgtgcatgtatctccagcc

SEQ ID NO: 105287 - DNA, 25 bp, Homo sapien
ttgcctttaaccttttctgcagtga

SEQ ID NO: 105288 - DNA, 25 bp, Homo sapien
taaccttttctgcagtgatctaaga

SEQ ID NO: 105289 - DNA, 25 bp, Homo sapien
tgcagtgatctaagaagccagattc

SEQ ID NO: 105290 - DNA, 25 bp, Homo sapien
ccagattcatctgcacaaatacgtg

SEQ ID NO: 105291 - DNA, 25 bp, Homo sapien
gcacaaatacgtggtggtctacttt

SEQ ID NO: 105292 - DNA, 25 bp, Homo sapien
cgtggtggtctactttagagagatt

SEQ ID NO: 105293 - DNA, 25 bp, Homo sapien
aagacgattacaatgctctcagtgt

SEQ ID NO: 105294 - DNA, 25 bp, Homo sapien
attacaatgctctcagtgtctgccc

SEQ ID NO: 105295 - DNA, 25 bp, Homo sapien
gccactgctttctgtgcagaacttc

SEQ ID NO: 105296 - DNA, 25 bp, Homo sapien
ctgtgcagaacttctccatgtcaag

SEQ ID NO: 105297 - DNA, 25 bp, Homo sapien
aaaagatcacaagcctgccacgatg

SEQ ID NO: 105298 - DNA, 25 bp, Homo sapien
cacctagtgcatgaggcacagggca

SEQ ID NO: 105299 - DNA, 25 bp, Homo sapien
cctagtgcatgaggcacagggcaga

SEQ ID NO: 105300 - DNA, 25 bp, Homo sapien
ttttgttgacaaataccattctgaa

SEQ ID NO: 105301 - DNA, 25 bp, Homo sapien
ttgttgacaaataccattctgaagg

SEQ ID NO: 105302 - DNA, 25 bp, Homo sapien
tgttgacaaataccattctgaagga

SEQ ID NO: 105303 - DNA, 25 bp, Homo sapien
atggcccaaaatagttctcccccag

SEQ ID NO: 105304 - DNA, 25 bp, Homo sapien
atagttctcccccaggaaagaatgc

SEQ ID NO: 105305 - DNA, 25 bp, Homo sapien
gttctcccccaggaaagaatgcagt

SEQ ID NO: 105306 - DNA, 25 bp, Homo sapien
ccccaggaaagaatgcagtggtata

SEQ ID NO: 105307 - DNA, 25 bp, Homo sapien
gaatgcagtggtataaatccttttc

SEQ ID NO: 105308 - DNA, 25 bp, Homo sapien
aatgcagtggtataaatccttttcc

SEQ ID NO: 105309 - DNA, 25 bp, Homo sapien
tcttgttcttgaaacattgcaacca

SEQ ID NO: 105310 - DNA, 25 bp, Homo sapien
attgcaaccaaaaaggtcagcacaa

SEQ ID NO: 105311 - DNA, 25 bp, Homo sapien
agcacaaaggccttcacctacgtga

SEQ ID NO: 105312 - DNA, 25 bp, Homo sapien
tcacctacgtgaagacctcctggta

SEQ ID NO: 105313 - DNA, 25 bp, Homo sapien
aagacctcctggtaggatctgtcca

SEQ ID NO: 105314 - DNA, 25 bp, Homo sapien
tcctggtaggatctgtccatgggat

SEQ ID NO: 105315 - DNA, 25 bp, Homo sapien
gggtcatgacaccagctaccaattt

SEQ ID NO: 105316 - DNA, 25 bp, Homo sapien
aatgggtgctagtggtaattgcttt

SEQ ID NO: 105317 - DNA, 25 bp, Homo sapien
gtaattgctttgtggcttagtaaac

SEQ ID NO: 105318 - DNA, 25 bp, Homo sapien
ggcttagtaaactactctgtggatg

SEQ ID NO: 105319 - DNA, 25 bp, Homo sapien
gatgatttccaaacattcaaagcca

SEQ ID NO: 105320 - DNA, 25 bp, Homo sapien
gttaaatcgtatgttttcgcctctt

SEQ ID NO: 105321 - DNA, 25 bp, Homo sapien
gtgatcaccaataggacatcttcag

SEQ ID NO: 105322 - DNA, 25 bp, Homo sapien
acatcttcaggcatattggcaggat

SEQ ID NO: 105323 - DNA, 25 bp, Homo sapien
cctattgtaaggctgtactttcgtg

SEQ ID NO: 105324 - DNA, 25 bp, Homo sapien
gtactttcgtgatttaatgacctga

SEQ ID NO: 105325 - DNA, 25 bp, Homo sapien
ggtttggtcataatgcttctgctgt

SEQ ID NO: 105326 - DNA, 25 bp, Homo sapien
ttctgctgtttttgtaggtttatct

SEQ ID NO: 105327 - DNA, 25 bp, Homo sapien
ttatctgatcgttttcctttgctac

SEQ ID NO: 105328 - DNA, 25 bp, Homo sapien
cctttgctactgctaatggaactga

SEQ ID NO: 105329 - DNA, 25 bp, Homo sapien
aatagcctttccttactgttgtttg

SEQ ID NO: 105330 - DNA, 25 bp, Homo sapien
tactgttgtttggttctgtgaatgc

SEQ ID NO: 105331 - DNA, 25 bp, Homo sapien
ggaggtcctggctcggtttgctata

SEQ ID NO: 105332 - DNA, 25 bp, Homo sapien
ctggctcggtttgctatatagggaa

SEQ ID NO: 105333 - DNA, 25 bp, Homo sapien
ggaacatcgaaattgtatacaaaga

SEQ ID NO: 105334 - DNA, 25 bp, Homo sapien
tacaaagacgcttcctaaagtacca

SEQ ID NO: 105335 - DNA, 25 bp, Homo sapien
aagtaccaactttatatcatatgtt

SEQ ID NO: 105336 - DNA, 25 bp, Homo sapien
gtttttcttgacttaattcatgaag

SEQ ID NO: 105337 - DNA, 25 bp, Homo sapien
tgaagtatcattttttgactgagtc

SEQ ID NO: 105338 - DNA, 25 bp, Homo sapien
gactgagtctccatttacttcattc

SEQ ID NO: 105339 - DNA, 25 bp, Homo sapien
gagtctccatttacttcattcttaa

SEQ ID NO: 105340 - DNA, 25 bp, Homo sapien
ttcttaatgattattgtcatccctt

SEQ ID NO: 105341 - DNA, 25 bp, Homo sapien
ttgtcatccctttaaatctgtgcct

SEQ ID NO: 105342 - DNA, 25 bp, Homo sapien
cgaactgcctaccacatcaccatca

SEQ ID NO: 105343 - DNA, 25 bp, Homo sapien
tccactctgtctctgagggagtcga

SEQ ID NO: 105344 - DNA, 25 bp, Homo sapien
cactctgtctctgagggagtcgact

SEQ ID NO: 105345 - DNA, 25 bp, Homo sapien
gtctctgagggagtcgacttctact

SEQ ID NO: 105346 - DNA, 25 bp, Homo sapien
tctctgagggagtcgacttctactc

SEQ ID NO: 105347 - DNA, 25 bp, Homo sapien
ctgagggagtcgacttctactccga

SEQ ID NO: 105348 - DNA, 25 bp, Homo sapien
gagggagtcgacttctactccgagc

SEQ ID NO: 105349 - DNA, 25 bp, Homo sapien
gggagtcgacttctactccgagctg

SEQ ID NO: 105350 - DNA, 25 bp, Homo sapien
acttctactccgagctgcggaacaa

SEQ ID NO: 105351 - DNA, 25 bp, Homo sapien
ctactccgagctgcggaacaaggga

SEQ ID NO: 105352 - DNA, 25 bp, Homo sapien
gaaagaagcagttaggtcatctgta

SEQ ID NO: 105353 - DNA, 25 bp, Homo sapien
gtgttgccacagtagaactgtctgt

SEQ ID NO: 105354 - DNA, 25 bp, Homo sapien
aactgtctgtgaacagagagaccct

SEQ ID NO: 105355 - DNA, 25 bp, Homo sapien
acccttgtgggtccatgctaacaaa

SEQ ID NO: 105356 - DNA, 25 bp, Homo sapien
aagtctgtctttcctgaaccatgtg

SEQ ID NO: 105357 - DNA, 25 bp, Homo sapien
gaaccatgtggataactttacagaa

SEQ ID NO: 105358 - DNA, 25 bp, Homo sapien
gaaatggactggagctcatctgcaa

SEQ ID NO: 105359 - DNA, 25 bp, Homo sapien
gctcatctgcaaaaggcctcttgta

SEQ ID NO: 105360 - DNA, 25 bp, Homo sapien
ggcctcttgtaaagactggttttct

SEQ ID NO: 105361 - DNA, 25 bp, Homo sapien
gactggttttctgccaatgaccaaa

SEQ ID NO: 105362 - DNA, 25 bp, Homo sapien
aacagccaagattttcctcttgtga

SEQ ID NO: 105363 - DNA, 25 bp, Homo sapien
aatattgtttctgcattcattttta

SEQ ID NO: 105364 - DNA, 25 bp, Homo sapien
attttagaggaactctcaagtgtct

SEQ ID NO: 105365 - DNA, 25 bp, Homo sapien
ttagaggaactctcaagtgtcttag

SEQ ID NO: 105366 - DNA, 25 bp, Homo sapien
gaggaactctcaagtgtcttagggt

SEQ ID NO: 105367 - DNA, 25 bp, Homo sapien
ggaactctcaagtgtcttagggtag

SEQ ID NO: 105368 - DNA, 25 bp, Homo sapien
gaactctcaagtgtcttagggtaga

SEQ ID NO: 105369 - DNA, 25 bp, Homo sapien
actctcaagtgtcttagggtagaaa

SEQ ID NO: 105370 - DNA, 25 bp, Homo sapien
ctcaagtgtcttagggtagaaagta

SEQ ID NO: 105371 - DNA, 25 bp, Homo sapien
aaaaagttgcttcttatgagttgct

SEQ ID NO: 105372 - DNA, 25 bp, Homo sapien
ttatgagttgctaaaggaaggcttc

SEQ ID NO: 105373 - DNA, 25 bp, Homo sapien
gagttgctaaaggaaggcttctgtg

SEQ ID NO: 105374 - DNA, 25 bp, Homo sapien
aaaggaaggcttctgtgtcaatgcc

SEQ ID NO: 105375 - DNA, 25 bp, Homo sapien
actgcatccagccatataaccgtat

SEQ ID NO: 105376 - DNA, 25 bp, Homo sapien
tgcatccagccatataaccgtattc

SEQ ID NO: 105377 - DNA, 25 bp, Homo sapien
gcatccagccatataaccgtattct

SEQ ID NO: 105378 - DNA, 25 bp, Homo sapien
tccagccatataaccgtattctaaa

SEQ ID NO: 105379 - DNA, 25 bp, Homo sapien
gccatataaccgtattctaaataag

SEQ ID NO: 105380 - DNA, 25 bp, Homo sapien
aatggttggcttgtgtgatggtttt

SEQ ID NO: 105381 - DNA, 25 bp, Homo sapien
gatggttttgtgtaatgagctagag

SEQ ID NO: 105382 - DNA, 25 bp, Homo sapien
ggttttgtgtaatgagctagagata

SEQ ID NO: 105383 - DNA, 25 bp, Homo sapien
aatattttaagtgtcttctgtggta

SEQ ID NO: 105384 - DNA, 25 bp, Homo sapien
aagtgtcttctgtggtatatgtggg

SEQ ID NO: 105385 - DNA, 25 bp, Homo sapien
gtatatgtgggagggccattaagga

SEQ ID NO: 105386 - DNA, 25 bp, Homo sapien
gggagaggtggttagagggaacaga

SEQ ID NO: 105387 - DNA, 25 bp, Homo sapien
ggagaggtggttagagggaacagaa

SEQ ID NO: 105388 - DNA, 25 bp, Homo sapien
gagaggtggttagagggaacagaag

SEQ ID NO: 105389 - DNA, 25 bp, Homo sapien
cttgatgatgtccttcagagctgtg

SEQ ID NO: 105390 - DNA, 25 bp, Homo sapien
aagggaaaccttacagtatgctaca

SEQ ID NO: 105391 - DNA, 25 bp, Homo sapien
agggaaaccttacagtatgctacaa

SEQ ID NO: 105392 - DNA, 25 bp, Homo sapien
gggaaaccttacagtatgctacaaa

SEQ ID NO: 105393 - DNA, 25 bp, Homo sapien
ggaaaccttacagtatgctacaaag

SEQ ID NO: 105394 - DNA, 25 bp, Homo sapien
gaaaccttacagtatgctacaaaga

SEQ ID NO: 105395 - DNA, 25 bp, Homo sapien
gacagctgaggaaacgtctctccca

SEQ ID NO: 105396 - DNA, 25 bp, Homo sapien
cactgtttgtactctcaccttcatt

SEQ ID NO: 105397 - DNA, 25 bp, Homo sapien
tcaattcagtctaggaaaccatgct

SEQ ID NO: 105398 - DNA, 25 bp, Homo sapien
aaaccatgctgtttctctatcaaga

SEQ ID NO: 105399 - DNA, 25 bp, Homo sapien
aagagggactccctagggcacatgc

SEQ ID NO: 105400 - DNA, 25 bp, Homo sapien
agggcacatgcatcagcacatatgt

SEQ ID NO: 105401 - DNA, 25 bp, Homo sapien
acatatgtgggcatccagcctctgg

SEQ ID NO: 105402 - DNA, 25 bp, Homo sapien
acacacattcgtgtgctctgctgca

SEQ ID NO: 105403 - DNA, 25 bp, Homo sapien
ctgctgcatgtgagcttgtgggtta

SEQ ID NO: 105404 - DNA, 25 bp, Homo sapien
gacattcaatcttcactctttcaat

SEQ ID NO: 105405 - DNA, 25 bp, Homo sapien
actctttcaattgtgcattcattta

SEQ ID NO: 105406 - DNA, 25 bp, Homo sapien
gaagtgtgaaactgtcaggaagaca

SEQ ID NO: 105407 - DNA, 25 bp, Homo sapien
acagatgaaatgatttgcctgaggc

SEQ ID NO: 105408 - DNA, 25 bp, Homo sapien
ttgcctgaggccgtatcatcaaaca

SEQ ID NO: 105409 - DNA, 25 bp, Homo sapien
gcctgaggccgtatcatcaaacaag

SEQ ID NO: 105410 - DNA, 25 bp, Homo sapien
gaggccgtatcatcaaacaagaaat

SEQ ID NO: 105411 - DNA, 25 bp, Homo sapien
ggccgtatcatcaaacaagaaattc

SEQ ID NO: 105412 - DNA, 25 bp, Homo sapien
gaaattcatattcacctttctggaa

SEQ ID NO: 105413 - DNA, 25 bp, Homo sapien
attcacctttctggaattcttagga

SEQ ID NO: 105414 - DNA, 25 bp, Homo sapien
ctttctggaattcttaggataatga

SEQ ID NO: 105415 - DNA, 25 bp, Homo sapien
aggataatgattacatgtgttcaat

SEQ ID NO: 105416 - DNA, 25 bp, Homo sapien
gattacatgtgttcaattgttaaaa

SEQ ID NO: 105417 - DNA, 25 bp, Homo sapien
tggctggtctttactgcagggcagc

SEQ ID NO: 105418 - DNA, 25 bp, Homo sapien
cagctgtctgtctttacactgcatg

SEQ ID NO: 105419 - DNA, 25 bp, Homo sapien
actgaagtgccgaagtggcccgtgc

SEQ ID NO: 105420 - DNA, 25 bp, Homo sapien
gagaccccgactttagtttgggctg

SEQ ID NO: 105421 - DNA, 25 bp, Homo sapien
tagtttgggctgttccacgcttggc

SEQ ID NO: 105422 - DNA, 25 bp, Homo sapien
attgccgcctgggacttaacctgct

SEQ ID NO: 105423 - DNA, 25 bp, Homo sapien
gacttaacctgctcaggcgggcctt

SEQ ID NO: 105424 - DNA, 25 bp, Homo sapien
gccttcgcccagctgcaaataggga

SEQ ID NO: 105425 - DNA, 25 bp, Homo sapien
gatgcgttagagactgttcccaaag

SEQ ID NO: 105426 - DNA, 25 bp, Homo sapien
ttcccaaagcttgttgggctcctta

SEQ ID NO: 105427 - DNA, 25 bp, Homo sapien
gggctccttaaatggcatgtacaat

SEQ ID NO: 105428 - DNA, 25 bp, Homo sapien
ttggtcaatctaaatgcattcattc

SEQ ID NO: 105429 - DNA, 25 bp, Homo sapien
ggtaagttaacttgtcaacggcatg

SEQ ID NO: 105430 - DNA, 25 bp, Homo sapien
gtcaacggcatggtttaatcccttc

SEQ ID NO: 105431 - DNA, 25 bp, Homo sapien
ggcatggtttaatcccttctttaca

SEQ ID NO: 105432 - DNA, 25 bp, Homo sapien
ttaatcccttctttacacttgtgta

SEQ ID NO: 105433 - DNA, 25 bp, Homo sapien
cttgtgtaaatttcagttactggtc

SEQ ID NO: 105434 - DNA, 25 bp, Homo sapien
gttactggtcatagaaggctttcaa

SEQ ID NO: 105435 - DNA, 25 bp, Homo sapien
ggctttcaatgttgagtggcctttt

SEQ ID NO: 105436 - DNA, 25 bp, Homo sapien
gttgagtggccttttattaacatgt

SEQ ID NO: 105437 - DNA, 25 bp, Homo sapien
tattaacatgtttatggtactgcat

SEQ ID NO: 105438 - DNA, 25 bp, Homo sapien
ggtactgcatagatacgggtattta

SEQ ID NO: 105439 - DNA, 25 bp, Homo sapien
caggctgctgcacgcatcaatagtt

SEQ ID NO: 105440 - DNA, 25 bp, Homo sapien
aggctgctgcacgcatcaatagttc

SEQ ID NO: 105441 - DNA, 25 bp, Homo sapien
ggctgctgcacgcatcaatagttca

SEQ ID NO: 105442 - DNA, 25 bp, Homo sapien
gctgctgcacgcatcaatagttcat

SEQ ID NO: 105443 - DNA, 25 bp, Homo sapien
ctgctgcacgcatcaatagttcatt

SEQ ID NO: 105444 - DNA, 25 bp, Homo sapien
tgctgcacgcatcaatagttcattc

SEQ ID NO: 105445 - DNA, 25 bp, Homo sapien
caatagttcattcctggctgggcgc

SEQ ID NO: 105446 - DNA, 25 bp, Homo sapien
aatagttcattcctggctgggcgcg

SEQ ID NO: 105447 - DNA, 25 bp, Homo sapien
atagttcattcctggctgggcgcgg

SEQ ID NO: 105448 - DNA, 25 bp, Homo sapien
tagttcattcctggctgggcgcggt

SEQ ID NO: 105449 - DNA, 25 bp, Homo sapien
ttagccgggcaccatggcatgtgcc

SEQ ID NO: 105450 - DNA, 25 bp, Homo sapien
atatttcaaatcacggagacctctc

SEQ ID NO: 105451 - DNA, 25 bp, Homo sapien
atcacggagacctctctttacagga

SEQ ID NO: 105452 - DNA, 25 bp, Homo sapien
tctctttacaggaggcctcatcggg

SEQ ID NO: 105453 - DNA, 25 bp, Homo sapien
tcttcacctacgtcctgttctggac

SEQ ID NO: 105454 - DNA, 25 bp, Homo sapien
tggacgttcctctacggcatggtgc

SEQ ID NO: 105455 - DNA, 25 bp, Homo sapien
cggcatggtgcacgtctactgaaat

SEQ ID NO: 105456 - DNA, 25 bp, Homo sapien
gactgtggccagcaattaacaccat

SEQ ID NO: 105457 - DNA, 25 bp, Homo sapien
ttaacaccatgtagacttccttagt

SEQ ID NO: 105458 - DNA, 25 bp, Homo sapien
tgtagacttccttagttcttaagtg

SEQ ID NO: 105459 - DNA, 25 bp, Homo sapien
aagtggttgaattcgctgcttgttc

SEQ ID NO: 105460 - DNA, 25 bp, Homo sapien
attcgctgcttgttctgtaacgtta

SEQ ID NO: 105461 - DNA, 25 bp, Homo sapien
atttattaattatgttgtggcagac

SEQ ID NO: 105462 - DNA, 25 bp, Homo sapien
ttattaattatgttgtggcagacaa

SEQ ID NO: 105463 - DNA, 25 bp, Homo sapien
tattaattatgttgtggcagacaat

SEQ ID NO: 105464 - DNA, 25 bp, Homo sapien
ttaattatgttgtggcagacaatat

SEQ ID NO: 105465 - DNA, 25 bp, Homo sapien
attatgttgtggcagacaatatgct

SEQ ID NO: 105466 - DNA, 25 bp, Homo sapien
ttatgttgtggcagacaatatgctg

SEQ ID NO: 105467 - DNA, 25 bp, Homo sapien
tatgttgtggcagacaatatgctga

SEQ ID NO: 105468 - DNA, 25 bp, Homo sapien
atgttgtggcagacaatatgctgaa

SEQ ID NO: 105469 - DNA, 25 bp, Homo sapien
tgttgtggcagacaatatgctgaac

SEQ ID NO: 105470 - DNA, 25 bp, Homo sapien
gttgtggcagacaatatgctgaaca

SEQ ID NO: 105471 - DNA, 25 bp, Homo sapien
ttgtggcagacaatatgctgaacat

SEQ ID NO: 105472 - DNA, 25 bp, Homo sapien
cgacccgctgggaggtgccagctct

SEQ ID NO: 105473 - DNA, 25 bp, Homo sapien
gcaggcagccctcggccgacgggag

SEQ ID NO: 105474 - DNA, 25 bp, Homo sapien
gccgacgggagtaagccctggtggt

SEQ ID NO: 105475 - DNA, 25 bp, Homo sapien
ctggtggtggtcctacttcacatcg

SEQ ID NO: 105476 - DNA, 25 bp, Homo sapien
tggtcctacttcacatcgctgagca

SEQ ID NO: 105477 - DNA, 25 bp, Homo sapien
cacgctggctgctcaagtactagcc

SEQ ID NO: 105478 - DNA, 25 bp, Homo sapien
tggctgctcaagtactagccccggc

SEQ ID NO: 105479 - DNA, 25 bp, Homo sapien
cgggctcctggctcttgattttgtc

SEQ ID NO: 105480 - DNA, 25 bp, Homo sapien
cacaaagccgctgccattttattaa

SEQ ID NO: 105481 - DNA, 25 bp, Homo sapien
aaagccgctgccattttattaaagt

SEQ ID NO: 105482 - DNA, 25 bp, Homo sapien
gccgctgccattttattaaagtgtt

SEQ ID NO: 105483 - DNA, 25 bp, Homo sapien
tttctctgaaatttccggactattt

SEQ ID NO: 105484 - DNA, 25 bp, Homo sapien
aatctaatgttgtctacctatgcaa

SEQ ID NO: 105485 - DNA, 25 bp, Homo sapien
gtctacctatgcaaagcttttaagt

SEQ ID NO: 105486 - DNA, 25 bp, Homo sapien
gagcagcagtagatgcatcttacat

SEQ ID NO: 105487 - DNA, 25 bp, Homo sapien
gatgcatcttacattgatgagatag

SEQ ID NO: 105488 - DNA, 25 bp, Homo sapien
aagaagccaatgctattgaaaactt

SEQ ID NO: 105489 - DNA, 25 bp, Homo sapien
aaaaaagagagttcctgcgacagag

SEQ ID NO: 105490 - DNA, 25 bp, Homo sapien
agagttcctgcgacagaggtttaca

SEQ ID NO: 105491 - DNA, 25 bp, Homo sapien
gacagaggtttacagtgattgcaaa

SEQ ID NO: 105492 - DNA, 25 bp, Homo sapien
gattgcaaacacattacacagataa

SEQ ID NO: 105493 - DNA, 25 bp, Homo sapien
agatagtccacagctgtcctctctt

SEQ ID NO: 105494 - DNA, 25 bp, Homo sapien
gggccagatggcttacccatgcctg

SEQ ID NO: 105495 - DNA, 25 bp, Homo sapien
agatggcttacccatgcctggctgt

SEQ ID NO: 105496 - DNA, 25 bp, Homo sapien
atggcttacccatgcctggctgttg

SEQ ID NO: 105497 - DNA, 25 bp, Homo sapien
cttacccatgcctggctgttggcaa

SEQ ID NO: 105498 - DNA, 25 bp, Homo sapien
cctggctgttggcaaaagtgatgaa

SEQ ID NO: 105499 - DNA, 25 bp, Homo sapien
ggctgttggcaaaagtgatgaatct

SEQ ID NO: 105500 - DNA, 25 bp, Homo sapien
aaagtgatgaatctaacctttcaag

SEQ ID NO: 105501 - DNA, 25 bp, Homo sapien
aacctttcaagcatgaagttgtgta

SEQ ID NO: 105502 - DNA, 25 bp, Homo sapien
agttgtgtatataagggtccatttt

SEQ ID NO: 105503 - DNA, 25 bp, Homo sapien
gtgtatataagggtccatttttaat

SEQ ID NO: 105504 - DNA, 25 bp, Homo sapien
atagttgaaaactgaattgcagatt

SEQ ID NO: 105505 - DNA, 25 bp, Homo sapien
tattgtcaaatgtctctatggattc

SEQ ID NO: 105506 - DNA, 25 bp, Homo sapien
aatgtctctatggattctgacagag

SEQ ID NO: 105507 - DNA, 25 bp, Homo sapien
gttattcttttggttgtcagtttca

SEQ ID NO: 105508 - DNA, 25 bp, Homo sapien
ggttgtcagtttcattttaacgagt

SEQ ID NO: 105509 - DNA, 25 bp, Homo sapien
tttcattttaacgagtgtaactagt

SEQ ID NO: 105510 - DNA, 25 bp, Homo sapien
gtaactagtaacattttattctttg

SEQ ID NO: 105511 - DNA, 25 bp, Homo sapien
acagtacatgattgtgtattgtgac

SEQ ID NO: 105512 - DNA, 25 bp, Homo sapien
gtgtattgtgacatgaatgctgtca

SEQ ID NO: 105513 - DNA, 25 bp, Homo sapien
gatggcattgtgaagcctgttactt

SEQ ID NO: 105514 - DNA, 25 bp, Homo sapien
aagcctgttactttgtgtcacttcc

SEQ ID NO: 105515 - DNA, 25 bp, Homo sapien
tgtcacttcctgataaataagaggt

SEQ ID NO: 105516 - DNA, 25 bp, Homo sapien
tcccatctcttatctccttgatata

SEQ ID NO: 105517 - DNA, 25 bp, Homo sapien
tgtgctgtgggctggcactcgatac

SEQ ID NO: 105518 - DNA, 25 bp, Homo sapien
tggcactcgatacctctggcaagag

SEQ ID NO: 105519 - DNA, 25 bp, Homo sapien
agaggatgatcatctacctcactga

SEQ ID NO: 105520 - DNA, 25 bp, Homo sapien
aggcatcgcatggacgttctctggt

SEQ ID NO: 105521 - DNA, 25 bp, Homo sapien
gacgttctctggtctgtagtggaga

SEQ ID NO: 105522 - DNA, 25 bp, Homo sapien
gacaagcagttaacctagcaccatc

SEQ ID NO: 105523 - DNA, 25 bp, Homo sapien
tgcagaagccattagcagacctttg

SEQ ID NO: 105524 - DNA, 25 bp, Homo sapien
ttagcagacctttgggccagggcag

SEQ ID NO: 105525 - DNA, 25 bp, Homo sapien
gcagcctccctataattttcttcat

SEQ ID NO: 105526 - DNA, 25 bp, Homo sapien
tcttcatctcttgctaatctctata

SEQ ID NO: 105527 - DNA, 25 bp, Homo sapien
atatgctaaaatttcttggagagtg

SEQ ID NO: 105528 - DNA, 25 bp, Homo sapien
gagagtgttaatcttttctgtgact

SEQ ID NO: 105529 - DNA, 25 bp, Homo sapien
tatatttgtcacaggccattgtaaa

SEQ ID NO: 105530 - DNA, 25 bp, Homo sapien
tttgtcacaggccattgtaaatacc

SEQ ID NO: 105531 - DNA, 25 bp, Homo sapien
aataccaagtatattgtgtctgcca

SEQ ID NO: 105532 - DNA, 25 bp, Homo sapien
accaagtatattgtgtctgccataa

SEQ ID NO: 105533 - DNA, 25 bp, Homo sapien
aagtatattgtgtctgccataattt

SEQ ID NO: 105534 - DNA, 25 bp, Homo sapien
aaatacattcattgtcttcagtcat

SEQ ID NO: 105535 - DNA, 25 bp, Homo sapien
attcattgtcttcagtcatacagca

SEQ ID NO: 105536 - DNA, 25 bp, Homo sapien
cattgtcttcagtcatacagcaaga

SEQ ID NO: 105537 - DNA, 25 bp, Homo sapien
cagcaagacacatgagacatagatt

SEQ ID NO: 105538 - DNA, 25 bp, Homo sapien
tcattcctaacctaaccttagagtc

SEQ ID NO: 105539 - DNA, 25 bp, Homo sapien
acattccttacccattagtctcaga

SEQ ID NO: 105540 - DNA, 25 bp, Homo sapien
attccttacccattagtctcagaaa

SEQ ID NO: 105541 - DNA, 25 bp, Homo sapien
ccttacccattagtctcagaaattg

SEQ ID NO: 105542 - DNA, 25 bp, Homo sapien
tacccattagtctcagaaattgtct

SEQ ID NO: 105543 - DNA, 25 bp, Homo sapien
gaaattgtcttaagcaacagcccca

SEQ ID NO: 105544 - DNA, 25 bp, Homo sapien
aattgtcttaagcaacagccccaaa

SEQ ID NO: 105545 - DNA, 25 bp, Homo sapien
ttgtcttaagcaacagccccaaatg

SEQ ID NO: 105546 - DNA, 25 bp, Homo sapien
gtcttaagcaacagccccaaatgct

SEQ ID NO: 105547 - DNA, 25 bp, Homo sapien
taagcaacagccccaaatgctggct

SEQ ID NO: 105548 - DNA, 25 bp, Homo sapien
agagctctgccaaaggccccgcagt

SEQ ID NO: 105549 - DNA, 25 bp, Homo sapien
agatcatgaggaaccgcaagcgcgt

SEQ ID NO: 105550 - DNA, 25 bp, Homo sapien
ccgcaagcgcgtgaaggagatcaat

SEQ ID NO: 105551 - DNA, 25 bp, Homo sapien
gagatcaatcagtacatcgaccaca

SEQ ID NO: 105552 - DNA, 25 bp, Homo sapien
atcgaccacatgcagagcgaactgg

SEQ ID NO: 105553 - DNA, 25 bp, Homo sapien
gagcgaactggacaacctggaatgt

SEQ ID NO: 105554 - DNA, 25 bp, Homo sapien
aatgtggcgacatcctagactagat

SEQ ID NO: 105555 - DNA, 25 bp, Homo sapien
tagactagatgaatgtcagccacag

SEQ ID NO: 105556 - DNA, 25 bp, Homo sapien
gagcttcttcaaaacatagcaccag

SEQ ID NO: 105557 - DNA, 25 bp, Homo sapien
gagaaggaagtgcacacgcctcacc

SEQ ID NO: 105558 - DNA, 25 bp, Homo sapien
gcacctctagagagttgctgggcat

SEQ ID NO: 105559 - DNA, 25 bp, Homo sapien
ttgctgggcatctctcaaccgcgat

SEQ ID NO: 105560 - DNA, 25 bp, Homo sapien
ttcccatccagctctacgtgatttg

SEQ ID NO: 105561 - DNA, 25 bp, Homo sapien
agctctacgtgatttggctgcactt

SEQ ID NO: 105562 - DNA, 25 bp, Homo sapien
tggctgcacttgaacactgattgtc

SEQ ID NO: 105563 - DNA, 25 bp, Homo sapien
actgattgtccatttacagccctca

SEQ ID NO: 105564 - DNA, 25 bp, Homo sapien
cagcaatgtgccttctaaatggcat

SEQ ID NO: 105565 - DNA, 25 bp, Homo sapien
gtgctgcagcgcttgttaatggtca

SEQ ID NO: 105566 - DNA, 25 bp, Homo sapien
aatggtcacaataaatgccacttca

SEQ ID NO: 105567 - DNA, 25 bp, Homo sapien
tgccacttcaccaaggaagtctcag

SEQ ID NO: 105568 - DNA, 25 bp, Homo sapien
ggaaaatggcactatccgtgtacga

SEQ ID NO: 105569 - DNA, 25 bp, Homo sapien
ggcactatccgtgtacgaatcgaat

SEQ ID NO: 105570 - DNA, 25 bp, Homo sapien
atcaaagatttgtcacatccctaat

SEQ ID NO: 105571 - DNA, 25 bp, Homo sapien
aagactgacaccttgggcctgagct

SEQ ID NO: 105572 - DNA, 25 bp, Homo sapien
gcagcagcaacttcgagggccttct

SEQ ID NO: 105573 - DNA, 25 bp, Homo sapien
acttcgagggccttctctggagcca

SEQ ID NO: 105574 - DNA, 25 bp, Homo sapien
gggcagctgcatgggctcaaaactg

SEQ ID NO: 105575 - DNA, 25 bp, Homo sapien
atgggctcaaaactggcctgcagct

SEQ ID NO: 105576 - DNA, 25 bp, Homo sapien
ggcctgcagctcttctgatggccat

SEQ ID NO: 105577 - DNA, 25 bp, Homo sapien
tctgatggccatccctggtgcaagt

SEQ ID NO: 105578 - DNA, 25 bp, Homo sapien
aagtgttcatccagccgtgccaggg

SEQ ID NO: 105579 - DNA, 25 bp, Homo sapien
tgatgctccctgagacaacctggga

SEQ ID NO: 105580 - DNA, 25 bp, Homo sapien
tggatcagccacatcaactcagttg

SEQ ID NO: 105581 - DNA, 25 bp, Homo sapien
atcaactcagttgtccaccacaggg

SEQ ID NO: 105582 - DNA, 25 bp, Homo sapien
accgctcacgcccaaagaagaacaa

SEQ ID NO: 105583 - DNA, 25 bp, Homo sapien
agaagaacaactcgcgcatgatcct

SEQ ID NO: 105584 - DNA, 25 bp, Homo sapien
gcgcatgatcctgcgcaagggcagc

SEQ ID NO: 105585 - DNA, 25 bp, Homo sapien
gcttcgggctgcacgcgcagccaga

SEQ ID NO: 105586 - DNA, 25 bp, Homo sapien
agagttcctgcggaagcgcaaccac

SEQ ID NO: 105587 - DNA, 25 bp, Homo sapien
aaccacctgcgcagaaccatgtcag

SEQ ID NO: 105588 - DNA, 25 bp, Homo sapien
acctgcgcagaaccatgtcagtgca

SEQ ID NO: 105589 - DNA, 25 bp, Homo sapien
agagccagcccgagtcggacaaaga

SEQ ID NO: 105590 - DNA, 25 bp, Homo sapien
agcccgagtcggacaaagaccacga

SEQ ID NO: 105591 - DNA, 25 bp, Homo sapien
tcggacaaagaccacgagcggccgc

SEQ ID NO: 105592 - DNA, 25 bp, Homo sapien
cccaagttcgagtcggtgccctgag

SEQ ID NO: 105593 - DNA, 25 bp, Homo sapien
gtgcctttttggagatgtaactttt

SEQ ID NO: 105594 - DNA, 25 bp, Homo sapien
agtttgttaacctgacatctctgcc

SEQ ID NO: 105595 - DNA, 25 bp, Homo sapien
gacatctctgccagtctagtttctg

SEQ ID NO: 105596 - DNA, 25 bp, Homo sapien
agtctagtttctgggcaggtttcct

SEQ ID NO: 105597 - DNA, 25 bp, Homo sapien
gcaggtttcctgtgtcagtattccc

SEQ ID NO: 105598 - DNA, 25 bp, Homo sapien
cctcctctttgcattaatcaaggta

SEQ ID NO: 105599 - DNA, 25 bp, Homo sapien
gtttgtatgtccaatttacttgcat

SEQ ID NO: 105600 - DNA, 25 bp, Homo sapien
atgtaaaccattgctgtgccattca

SEQ ID NO: 105601 - DNA, 25 bp, Homo sapien
gctgtgccattcaatgtttgatgca

SEQ ID NO: 105602 - DNA, 25 bp, Homo sapien
gcataattggaccttgaatcgataa

SEQ ID NO: 105603 - DNA, 25 bp, Homo sapien
gcttttgatctgtaatgcttttata

SEQ ID NO: 105604 - DNA, 25 bp, Homo sapien
ggacccacagccaagaggagtcaga

SEQ ID NO: 105605 - DNA, 25 bp, Homo sapien
gacccacagccaagaggagtcagag

SEQ ID NO: 105606 - DNA, 25 bp, Homo sapien
acccacagccaagaggagtcagaga

SEQ ID NO: 105607 - DNA, 25 bp, Homo sapien
gtcctcaagactgtgggagaccctg

SEQ ID NO: 105608 - DNA, 25 bp, Homo sapien
aagactgtgggagaccctggctgct

SEQ ID NO: 105609 - DNA, 25 bp, Homo sapien
gagaccctggctgctgagcagagaa

SEQ ID NO: 105610 - DNA, 25 bp, Homo sapien
gaacacatggatgcagcaccaataa

SEQ ID NO: 105611 - DNA, 25 bp, Homo sapien
gggtctgtggcagagccgcgagccc

SEQ ID NO: 105612 - DNA, 25 bp, Homo sapien
gtgcagagggagaattcggtggcct

SEQ ID NO: 105613 - DNA, 25 bp, Homo sapien
ggagaattcggtggcctcagatgga

SEQ ID NO: 105614 - DNA, 25 bp, Homo sapien
attcggtggcctcagatggagggct

SEQ ID NO: 105615 - DNA, 25 bp, Homo sapien
agcacccctgctgtgtggttcatct

SEQ ID NO: 105616 - DNA, 25 bp, Homo sapien
gcacccctgctgtgtggttcatctt

SEQ ID NO: 105617 - DNA, 25 bp, Homo sapien
cctgcccacccctgaaagactggcc

SEQ ID NO: 105618 - DNA, 25 bp, Homo sapien
gtctccacgtggtgtatggatctgt

SEQ ID NO: 105619 - DNA, 25 bp, Homo sapien
tctccacgtggtgtatggatctgtg

SEQ ID NO: 105620 - DNA, 25 bp, Homo sapien
acgtggtgtatggatctgtggtcat

SEQ ID NO: 105621 - DNA, 25 bp, Homo sapien
gtcattgtccctctgcagaataaag

SEQ ID NO: 105622 - DNA, 25 bp, Homo sapien
cattgtccctctgcagaataaagat

SEQ ID NO: 105623 - DNA, 25 bp, Homo sapien
ttgtccctctgcagaataaagattg

SEQ ID NO: 105624 - DNA, 25 bp, Homo sapien
gtccctctgcagaataaagattgct

SEQ ID NO: 105625 - DNA, 25 bp, Homo sapien
gaataaagattgctcaggcctgcct

SEQ ID NO: 105626 - DNA, 25 bp, Homo sapien
ggagttttcactcttatcgcccagg

SEQ ID NO: 105627 - DNA, 25 bp, Homo sapien
gcaatggcgcaaccttgctggtcac

SEQ ID NO: 105628 - DNA, 25 bp, Homo sapien
caatggcgcaaccttgctggtcact

SEQ ID NO: 105629 - DNA, 25 bp, Homo sapien
aatggcgcaaccttgctggtcactg

SEQ ID NO: 105630 - DNA, 25 bp, Homo sapien
atggcgcaaccttgctggtcactgc

SEQ ID NO: 105631 - DNA, 25 bp, Homo sapien
tggcgcaaccttgctggtcactgca

SEQ ID NO: 105632 - DNA, 25 bp, Homo sapien
ggcgcaaccttgctggtcactgcaa

SEQ ID NO: 105633 - DNA, 25 bp, Homo sapien
gcgcaaccttgctggtcactgcaac

SEQ ID NO: 105634 - DNA, 25 bp, Homo sapien
cgcctcgactcctgatatcaagtga

SEQ ID NO: 105635 - DNA, 25 bp, Homo sapien
gcctcgactcctgatatcaagtgat

SEQ ID NO: 105636 - DNA, 25 bp, Homo sapien
cctcgactcctgatatcaagtgatc

SEQ ID NO: 105637 - DNA, 25 bp, Homo sapien
accttcctgcccaggggacgtggcg

SEQ ID NO: 105638 - DNA, 25 bp, Homo sapien
gtggcgctgtcggtgtttggaggct

SEQ ID NO: 105639 - DNA, 25 bp, Homo sapien
tttggcgccccatgggccctcagcg

SEQ ID NO: 105640 - DNA, 25 bp, Homo sapien
agcccttgctctacctggccggtag

SEQ ID NO: 105641 - DNA, 25 bp, Homo sapien
gcccttgctctacctggccggtagg

SEQ ID NO: 105642 - DNA, 25 bp, Homo sapien
gctgctggcgcctaggttgtgttga

SEQ ID NO: 105643 - DNA, 25 bp, Homo sapien
gctggcgcctaggttgtgttgagag

SEQ ID NO: 105644 - DNA, 25 bp, Homo sapien
cgtgcagcacctgtcaccttttcta

SEQ ID NO: 105645 - DNA, 25 bp, Homo sapien
ctagaaataaaatcaccctgactgt

SEQ ID NO: 105646 - DNA, 25 bp, Homo sapien
agaaataaaatcaccctgactgtgg

SEQ ID NO: 105647 - DNA, 25 bp, Homo sapien
gaaataaaatcaccctgactgtggg

SEQ ID NO: 105648 - DNA, 25 bp, Homo sapien
cagcaacccctgcattccttttttt

SEQ ID NO: 105649 - DNA, 25 bp, Homo sapien
tttttaccgggctgacgagaatgat

SEQ ID NO: 105650 - DNA, 25 bp, Homo sapien
ttttaccgggctgacgagaatgatg

SEQ ID NO: 105651 - DNA, 25 bp, Homo sapien
tttaccgggctgacgagaatgatga

SEQ ID NO: 105652 - DNA, 25 bp, Homo sapien
ctgacgagaatgatgaggtgaagat

SEQ ID NO: 105653 - DNA, 25 bp, Homo sapien
catatccctaccatcccttctcagt

SEQ ID NO: 105654 - DNA, 25 bp, Homo sapien
ttacccttacagtagcaagcataga

SEQ ID NO: 105655 - DNA, 25 bp, Homo sapien
tacccttacagtagcaagcatagac

SEQ ID NO: 105656 - DNA, 25 bp, Homo sapien
acccttacagtagcaagcatagacc

SEQ ID NO: 105657 - DNA, 25 bp, Homo sapien
ccttacagtagcaagcatagacccc

SEQ ID NO: 105658 - DNA, 25 bp, Homo sapien
aagcatagacccctgtctaacgggg

SEQ ID NO: 105659 - DNA, 25 bp, Homo sapien
gcctttggaggccagtagagcacac

SEQ ID NO: 105660 - DNA, 25 bp, Homo sapien
gaggccagtagagcacacagggtat

SEQ ID NO: 105661 - DNA, 25 bp, Homo sapien
ggccagtagagcacacagggtatcc

SEQ ID NO: 105662 - DNA, 25 bp, Homo sapien
aacacaaggtgtccaacatctttga

SEQ ID NO: 105663 - DNA, 25 bp, Homo sapien
caaggtgtccaacatctttgatgat

SEQ ID NO: 105664 - DNA, 25 bp, Homo sapien
ggtgtccaacatctttgatgatccc

SEQ ID NO: 105665 - DNA, 25 bp, Homo sapien
tttgatgatcccctgaatgcctttg

SEQ ID NO: 105666 - DNA, 25 bp, Homo sapien
tgatgatcccctgaatgcctttgga

SEQ ID NO: 105667 - DNA, 25 bp, Homo sapien
atgatcccctgaatgcctttggagg

SEQ ID NO: 105668 - DNA, 25 bp, Homo sapien
gatcccctgaatgcctttggaggcc

SEQ ID NO: 105669 - DNA, 25 bp, Homo sapien
ccctgaatgcctttggaggccagta

SEQ ID NO: 105670 - DNA, 25 bp, Homo sapien
gtactttttgaaagggatatatcat

SEQ ID NO: 105671 - DNA, 25 bp, Homo sapien
tactttttgaaagggatatatcata

SEQ ID NO: 105672 - DNA, 25 bp, Homo sapien
actttttgaaagggatatatcatag

SEQ ID NO: 105673 - DNA, 25 bp, Homo sapien
ctttttgaaagggatatatcatagt

SEQ ID NO: 105674 - DNA, 25 bp, Homo sapien
tttttgaaagggatatatcatagta

SEQ ID NO: 105675 - DNA, 25 bp, Homo sapien
ttttgaaagggatatatcatagtaa

SEQ ID NO: 105676 - DNA, 25 bp, Homo sapien
tttgaaagggatatatcatagtaat

SEQ ID NO: 105677 - DNA, 25 bp, Homo sapien
ttgaaagggatatatcatagtaatt

SEQ ID NO: 105678 - DNA, 25 bp, Homo sapien
tgaaagggatatatcatagtaattt

SEQ ID NO: 105679 - DNA, 25 bp, Homo sapien
agatgctcaaaaacctccgtaacac

SEQ ID NO: 105680 - DNA, 25 bp, Homo sapien
aacctccgtaacaccaactatgatg

SEQ ID NO: 105681 - DNA, 25 bp, Homo sapien
cgtaacaccaactatgatgtctttg

SEQ ID NO: 105682 - DNA, 25 bp, Homo sapien
gggctgggaattgagtacaccttcc

SEQ ID NO: 105683 - DNA, 25 bp, Homo sapien
tctgtattaccgaagagcccaccgc

SEQ ID NO: 105684 - DNA, 25 bp, Homo sapien
caccgccgattcgtgaccaagaagg

SEQ ID NO: 105685 - DNA, 25 bp, Homo sapien
gaaggctctgtgcattcgggttttc

SEQ ID NO: 105686 - DNA, 25 bp, Homo sapien
gtgcattcgggttttccaggagact

SEQ ID NO: 105687 - DNA, 25 bp, Homo sapien
tcgggttttccaggagactcaaaag

SEQ ID NO: 105688 - DNA, 25 bp, Homo sapien
aaagcggaggaacccagacagccct

SEQ ID NO: 105689 - DNA, 25 bp, Homo sapien
tgccaaagccataccaaagacactc

SEQ ID NO: 105690 - DNA, 25 bp, Homo sapien
accaaacagctgctcaatggggtaa

SEQ ID NO: 105691 - DNA, 25 bp, Homo sapien
ggtaagctggctggcaagtacagac

SEQ ID NO: 105692 - DNA, 25 bp, Homo sapien
agctggctggcaagtacagaccaga

SEQ ID NO: 105693 - DNA, 25 bp, Homo sapien
aaagcaaaggagacatccccactaa

SEQ ID NO: 105694 - DNA, 25 bp, Homo sapien
aagcaaaggagacatccccactaag

SEQ ID NO: 105695 - DNA, 25 bp, Homo sapien
gggttaacgctgtcaccaccttagt

SEQ ID NO: 105696 - DNA, 25 bp, Homo sapien
ggttaacgctgtcaccaccttagtg

SEQ ID NO: 105697 - DNA, 25 bp, Homo sapien
gttaacgctgtcaccaccttagtgg

SEQ ID NO: 105698 - DNA, 25 bp, Homo sapien
tgactgcacaggacagagatcccat

SEQ ID NO: 105699 - DNA, 25 bp, Homo sapien
gactgcacaggacagagatcccatt

SEQ ID NO: 105700 - DNA, 25 bp, Homo sapien
actgcacaggacagagatcccattg

SEQ ID NO: 105701 - DNA, 25 bp, Homo sapien
ccactcatctgggagttcacgggag

SEQ ID NO: 105702 - DNA, 25 bp, Homo sapien
tgcatgtgccaactacgtcttatct

SEQ ID NO: 105703 - DNA, 25 bp, Homo sapien
atctccccagggaatgctccagcaa

SEQ ID NO: 105704 - DNA, 25 bp, Homo sapien
ggaagtgttttcacacccactaggt

SEQ ID NO: 105705 - DNA, 25 bp, Homo sapien
taggtatttgaggacactgcccaac

SEQ ID NO: 105706 - DNA, 25 bp, Homo sapien
aaccccaggtctaagtccagtctgt

SEQ ID NO: 105707 - DNA, 25 bp, Homo sapien
aagtccagtctgtctttgtaagcat

SEQ ID NO: 105708 - DNA, 25 bp, Homo sapien
aaatatggttcccacgtggcagctt

SEQ ID NO: 105709 - DNA, 25 bp, Homo sapien
gggacctaatatagccccacaggac

SEQ ID NO: 105710 - DNA, 25 bp, Homo sapien
acaggactatgtgattggcccacac

SEQ ID NO: 105711 - DNA, 25 bp, Homo sapien
gattggcccacacaaggtttcccaa

SEQ ID NO: 105712 - DNA, 25 bp, Homo sapien
gaaaccaacaccgttttggccagat

SEQ ID NO: 105713 - DNA, 25 bp, Homo sapien
tttccctggaagttcaactggaaca

SEQ ID NO: 105714 - DNA, 25 bp, Homo sapien
actggaacaacttcgaccattctct

SEQ ID NO: 105715 - DNA, 25 bp, Homo sapien
cattctctcacctataagccaattg

SEQ ID NO: 105716 - DNA, 25 bp, Homo sapien
tataagccaattgccgttaactgtg

SEQ ID NO: 105717 - DNA, 25 bp, Homo sapien
gccgttaactgtgaacatacttgtt

SEQ ID NO: 105718 - DNA, 25 bp, Homo sapien
aagccaatttggagacctagacatt

SEQ ID NO: 105719 - DNA, 25 bp, Homo sapien
agacctagacattcagctcactgct

SEQ ID NO: 105720 - DNA, 25 bp, Homo sapien
cagctcactgcttaactcaacatta

SEQ ID NO: 105721 - DNA, 25 bp, Homo sapien
atgattctgttttgccctatatgtt

SEQ ID NO: 105722 - DNA, 25 bp, Homo sapien
tgccctatatgttcaccgttgtatt

SEQ ID NO: 105723 - DNA, 25 bp, Homo sapien
acctgctggtgtcagcccagacctt

SEQ ID NO: 105724 - DNA, 25 bp, Homo sapien
tattatggaataaacctggcgtcag

SEQ ID NO: 105725 - DNA, 25 bp, Homo sapien
acctggcgtcagcatttataatcct

SEQ ID NO: 105726 - DNA, 25 bp, Homo sapien
tttataatcctggtgctcatgggca

SEQ ID NO: 105727 - DNA, 25 bp, Homo sapien
acctgggcattcttagctgcgggag

SEQ ID NO: 105728 - DNA, 25 bp, Homo sapien
tgcctgctctgccaagacaagaact

SEQ ID NO: 105729 - DNA, 25 bp, Homo sapien
gaactttcttctttacaaccagcgc

SEQ ID NO: 105730 - DNA, 25 bp, Homo sapien
aaccagcgctccagataacctcagg

SEQ ID NO: 105731 - DNA, 25 bp, Homo sapien
aaaccgcagactacatctttagagg

SEQ ID NO: 105732 - DNA, 25 bp, Homo sapien
gaggaagcacaactgtgcctttttc

SEQ ID NO: 105733 - DNA, 25 bp, Homo sapien
tgtgcctttttctgaaaatcccttt

SEQ ID NO: 105734 - DNA, 25 bp, Homo sapien
gaacatggattattagaactcaagg

SEQ ID NO: 105735 - DNA, 25 bp, Homo sapien
actcaaggttttcattgacaatata

SEQ ID NO: 105736 - DNA, 25 bp, Homo sapien
gactctagtgtttcatcttcataat

SEQ ID NO: 105737 - DNA, 25 bp, Homo sapien
gtgtttcatcttcataattaatcat

SEQ ID NO: 105738 - DNA, 25 bp, Homo sapien
gtttgaaggatttctgagtgactca

SEQ ID NO: 105739 - DNA, 25 bp, Homo sapien
ggatttctgagtgactcagcagcct

SEQ ID NO: 105740 - DNA, 25 bp, Homo sapien
gactcagcagcctgttaaagaagga

SEQ ID NO: 105741 - DNA, 25 bp, Homo sapien
aatcaagtgtattgctggttctgct

SEQ ID NO: 105742 - DNA, 25 bp, Homo sapien
tgtattgctggttctgctgcagtat

SEQ ID NO: 105743 - DNA, 25 bp, Homo sapien
ctgctgcagtatgtagtcgaagaat

SEQ ID NO: 105744 - DNA, 25 bp, Homo sapien
tagtaaattgcttctgagggtctga

SEQ ID NO: 105745 - DNA, 25 bp, Homo sapien
ttttgctcggcagcttggatcctag

SEQ ID NO: 105746 - DNA, 25 bp, Homo sapien
ttgctcggcagcttggatcctagca

SEQ ID NO: 105747 - DNA, 25 bp, Homo sapien
gctcggcagcttggatcctagcatg

SEQ ID NO: 105748 - DNA, 25 bp, Homo sapien
tcggcagcttggatcctagcatgac

SEQ ID NO: 105749 - DNA, 25 bp, Homo sapien
ggcagcttggatcctagcatgacta

SEQ ID NO: 105750 - DNA, 25 bp, Homo sapien
gcagcttggatcctagcatgactat

SEQ ID NO: 105751 - DNA, 25 bp, Homo sapien
agcttggatcctagcatgactatac

SEQ ID NO: 105752 - DNA, 25 bp, Homo sapien
tggatcctagcatgactatacattg

SEQ ID NO: 105753 - DNA, 25 bp, Homo sapien
gatcctagcatgactatacattgtg

SEQ ID NO: 105754 - DNA, 25 bp, Homo sapien
ctagcatgactatacattgtgacat

SEQ ID NO: 105755 - DNA, 25 bp, Homo sapien
gcatgactatacattgtgacatggt

SEQ ID NO: 105756 - DNA, 25 bp, Homo sapien
cctgtcttagatgtcaagctgaaaa

SEQ ID NO: 105757 - DNA, 25 bp, Homo sapien
gagaatgtaatcattccttccacaa

SEQ ID NO: 105758 - DNA, 25 bp, Homo sapien
ttccacaactgctgcatgtccctgt

SEQ ID NO: 105759 - DNA, 25 bp, Homo sapien
aactgctgcatgtccctgtgggtga

SEQ ID NO: 105760 - DNA, 25 bp, Homo sapien
gctgcatgtccctgtgggtgaaaca

SEQ ID NO: 105761 - DNA, 25 bp, Homo sapien
tgaaacagaacaatcgctgccctct

SEQ ID NO: 105762 - DNA, 25 bp, Homo sapien
aaacagaacaatcgctgccctctct

SEQ ID NO: 105763 - DNA, 25 bp, Homo sapien
agcaggactgggtggtccaaagaat

SEQ ID NO: 105764 - DNA, 25 bp, Homo sapien
ggtggtccaaagaatcggcaaatga

SEQ ID NO: 105765 - DNA, 25 bp, Homo sapien
gttagaaggcttcttagcgcagttg

SEQ ID NO: 105766 - DNA, 25 bp, Homo sapien
gcttcttagcgcagttgttcagagc

SEQ ID NO: 105767 - DNA, 25 bp, Homo sapien
tggtggcatcttcacacacaagacc

SEQ ID NO: 105768 - DNA, 25 bp, Homo sapien
acaagaccctacttcccaagtggct

SEQ ID NO: 105769 - DNA, 25 bp, Homo sapien
gttctttctcacatatcagcctaga

SEQ ID NO: 105770 - DNA, 25 bp, Homo sapien
tagacaacttacttacctcctactg

SEQ ID NO: 105771 - DNA, 25 bp, Homo sapien
tacttacctcctactgagtaatcat

SEQ ID NO: 105772 - DNA, 25 bp, Homo sapien
ctgagtaatcatatctgtgacataa

SEQ ID NO: 105773 - DNA, 25 bp, Homo sapien
aaacaataacaatccaccagaaagg

SEQ ID NO: 105774 - DNA, 25 bp, Homo sapien
gaggaaagggtacccatctgcctgc

SEQ ID NO: 105775 - DNA, 25 bp, Homo sapien
agcaagtcactattcataaacaact

SEQ ID NO: 105776 - DNA, 25 bp, Homo sapien
ctacagacagacctcaagcttatga

SEQ ID NO: 105777 - DNA, 25 bp, Homo sapien
cctcaagcttatgacaggtagcaat

SEQ ID NO: 105778 - DNA, 25 bp, Homo sapien
taaagtgcttgctaaggacgcatgg

SEQ ID NO: 105779 - DNA, 25 bp, Homo sapien
aaatggacattttctggcttgtcat

SEQ ID NO: 105780 - DNA, 25 bp, Homo sapien
cattttctggcttgtcattctgtac

SEQ ID NO: 105781 - DNA, 25 bp, Homo sapien
tctggcttgtcattctgtacactga

SEQ ID NO: 105782 - DNA, 25 bp, Homo sapien
attctgtacactgaccttaggcatg

SEQ ID NO: 105783 - DNA, 25 bp, Homo sapien
actgaccttaggcatggagaaaatt

SEQ ID NO: 105784 - DNA, 25 bp, Homo sapien
tacttgttaaactctagttcttaag

SEQ ID NO: 105785 - DNA, 25 bp, Homo sapien
ctagttcttaagttgttagccaagt

SEQ ID NO: 105786 - DNA, 25 bp, Homo sapien
gttagccaagtaaatatcattgttg

SEQ ID NO: 105787 - DNA, 25 bp, Homo sapien
ttgagtttttgcaccttccccaaag

SEQ ID NO: 105788 - DNA, 25 bp, Homo sapien
tgcaccttccccaaagacggtgttt

SEQ ID NO: 105789 - DNA, 25 bp, Homo sapien
aaatggacattttctggcttgtcat

SEQ ID NO: 105790 - DNA, 25 bp, Homo sapien
cattttctggcttgtcattctgtac

SEQ ID NO: 105791 - DNA, 25 bp, Homo sapien
tctggcttgtcattctgtacactga

SEQ ID NO: 105792 - DNA, 25 bp, Homo sapien
cattctgtacactgaccttaggcat

SEQ ID NO: 105793 - DNA, 25 bp, Homo sapien
ttctgtacactgaccttaggcatgg

SEQ ID NO: 105794 - DNA, 25 bp, Homo sapien
gtacactgaccttaggcatggagaa

SEQ ID NO: 105795 - DNA, 25 bp, Homo sapien
actgaccttaggcatggagaaaatt

SEQ ID NO: 105796 - DNA, 25 bp, Homo sapien
aggcatggagaaaattacttgttaa

SEQ ID NO: 105797 - DNA, 25 bp, Homo sapien
tacttgttaaactctagttcttaag

SEQ ID NO: 105798 - DNA, 25 bp, Homo sapien
ctagttcttaagttgttagccaagt

SEQ ID NO: 105799 - DNA, 25 bp, Homo sapien
gttagccaagtaaatatcattgttg

SEQ ID NO: 105800 - DNA, 25 bp, Homo sapien
gtcctccagtattccgtctgtagca

SEQ ID NO: 105801 - DNA, 25 bp, Homo sapien
gtattccgtctgtagcaggagctag

SEQ ID NO: 105802 - DNA, 25 bp, Homo sapien
gcctcagctccaagacaagaatgaa

SEQ ID NO: 105803 - DNA, 25 bp, Homo sapien
gaatgaacctggctgtgtcagtcat

SEQ ID NO: 105804 - DNA, 25 bp, Homo sapien
ggctgtgtcagtcattttgtctttt

SEQ ID NO: 105805 - DNA, 25 bp, Homo sapien
tgtcagtcattttgtcttttccttt

SEQ ID NO: 105806 - DNA, 25 bp, Homo sapien
ttgccacattggcagagatgggacc

SEQ ID NO: 105807 - DNA, 25 bp, Homo sapien
ctgtatgtttgaattctttcagtag

SEQ ID NO: 105808 - DNA, 25 bp, Homo sapien
ctttcagtagctgttgatgctggtt

SEQ ID NO: 105809 - DNA, 25 bp, Homo sapien
gacaggtttgagtcaaattgtactt

SEQ ID NO: 105810 - DNA, 25 bp, Homo sapien
gtactttgctccattgttaattgag

SEQ ID NO: 105811 - DNA, 25 bp, Homo sapien
ccttgctggtgcagacgaagcggcg

SEQ ID NO: 105812 - DNA, 25 bp, Homo sapien
cttgctggtgcagacgaagcggcgg

SEQ ID NO: 105813 - DNA, 25 bp, Homo sapien
ttgctggtgcagacgaagcggcggg

SEQ ID NO: 105814 - DNA, 25 bp, Homo sapien
gctggtgcagacgaagcggcgggct

SEQ ID NO: 105815 - DNA, 25 bp, Homo sapien
ctggtgcagacgaagcggcgggctc

SEQ ID NO: 105816 - DNA, 25 bp, Homo sapien
tggtgcagacgaagcggcgggctct

SEQ ID NO: 105817 - DNA, 25 bp, Homo sapien
ggtgcagacgaagcggcgggctctg

SEQ ID NO: 105818 - DNA, 25 bp, Homo sapien
agacgaagcggcgggctctggagaa

SEQ ID NO: 105819 - DNA, 25 bp, Homo sapien
gccaggaacagattttgcagttggt

SEQ ID NO: 105820 - DNA, 25 bp, Homo sapien
ccaggaacagattttgcagttggtg

SEQ ID NO: 105821 - DNA, 25 bp, Homo sapien
tttgcagttggtggggtctcaataa

SEQ ID NO: 105822 - DNA, 25 bp, Homo sapien
gaggccggcaacaaacgacagtatc

SEQ ID NO: 105823 - DNA, 25 bp, Homo sapien
ggccggcaacaaacgacagtatctc

SEQ ID NO: 105824 - DNA, 25 bp, Homo sapien
ggcaacaaacgacagtatctcggat

SEQ ID NO: 105825 - DNA, 25 bp, Homo sapien
caaacgacagtatctcggattcctt

SEQ ID NO: 105826 - DNA, 25 bp, Homo sapien
acgacagtatctcggattccttttt

SEQ ID NO: 105827 - DNA, 25 bp, Homo sapien
gacagtatctcggattccttttttt

SEQ ID NO: 105828 - DNA, 25 bp, Homo sapien
gtttcacttcatgctctgaatactg

SEQ ID NO: 105829 - DNA, 25 bp, Homo sapien
tcacttcatgctctgaatactgaat

SEQ ID NO: 105830 - DNA, 25 bp, Homo sapien
tcatgctctgaatactgaataacca

SEQ ID NO: 105831 - DNA, 25 bp, Homo sapien
tactgaataaccatgaatgactgaa

SEQ ID NO: 105832 - DNA, 25 bp, Homo sapien
taaccatgaatgactgaatagttta

SEQ ID NO: 105833 - DNA, 25 bp, Homo sapien
atgtgtgttcatctactgccaagta

SEQ ID NO: 105834 - DNA, 25 bp, Homo sapien
acttgaaagtaacagcagtgcctac

SEQ ID NO: 105835 - DNA, 25 bp, Homo sapien
cagtgcctacactacttaagtatgg

SEQ ID NO: 105836 - DNA, 25 bp, Homo sapien
gtatggaacacctcaaaaactggta

SEQ ID NO: 105837 - DNA, 25 bp, Homo sapien
actggtagaatctgagtgtcttcag

SEQ ID NO: 105838 - DNA, 25 bp, Homo sapien
gtgtcttcaggccaacctggtggaa

SEQ ID NO: 105839 - DNA, 25 bp, Homo sapien
gatggcaatcatgtcttgatgtcct

SEQ ID NO: 105840 - DNA, 25 bp, Homo sapien
gtcttgatgtcctgatttgttctag

SEQ ID NO: 105841 - DNA, 25 bp, Homo sapien
gtcctgatttgttctagtatcaata

SEQ ID NO: 105842 - DNA, 25 bp, Homo sapien
caataaactgtatacttgctttgaa

SEQ ID NO: 105843 - DNA, 25 bp, Homo sapien
tacttgctttgaattcatgttagca

SEQ ID NO: 105844 - DNA, 25 bp, Homo sapien
tcctggcctgagtttgagtgtcctg

SEQ ID NO: 105845 - DNA, 25 bp, Homo sapien
agtgtcctggttgtaagctcctttc

SEQ ID NO: 105846 - DNA, 25 bp, Homo sapien
ttctgcttcagttgctgtcagggca

SEQ ID NO: 105847 - DNA, 25 bp, Homo sapien
agcagttccagttctgtaagtctca

SEQ ID NO: 105848 - DNA, 25 bp, Homo sapien
agttctgtaagtctcactttgttca

SEQ ID NO: 105849 - DNA, 25 bp, Homo sapien
gttcagctgccacaatagacatcat

SEQ ID NO: 105850 - DNA, 25 bp, Homo sapien
aatagacatcatcgtttggccctct

SEQ ID NO: 105851 - DNA, 25 bp, Homo sapien
ttggccctctctgttagcagcacat

SEQ ID NO: 105852 - DNA, 25 bp, Homo sapien
gttagcagcacattcaaccatttgt

SEQ ID NO: 105853 - DNA, 25 bp, Homo sapien
gcacattcaaccatttgttttcagt

SEQ ID NO: 105854 - DNA, 25 bp, Homo sapien
tttggttgtgcctagaatggctttg

SEQ ID NO: 105855 - DNA, 25 bp, Homo sapien
atgacttctgtccaacagtgccaaa

SEQ ID NO: 105856 - DNA, 25 bp, Homo sapien
gaagaaatctttatacagtgcaata

SEQ ID NO: 105857 - DNA, 25 bp, Homo sapien
gcaataagtttattcaacaacccgg

SEQ ID NO: 105858 - DNA, 25 bp, Homo sapien
aaatgcaacctgcaacatttcgttg

SEQ ID NO: 105859 - DNA, 25 bp, Homo sapien
acatttcgttgtgttttgagcagaa

SEQ ID NO: 105860 - DNA, 25 bp, Homo sapien
gcagaatgagtgttcagcttgggaa

SEQ ID NO: 105861 - DNA, 25 bp, Homo sapien
aaaatgggagtcttgctaacatacc

SEQ ID NO: 105862 - DNA, 25 bp, Homo sapien
ttgctaacataccacgtgtgagaga

SEQ ID NO: 105863 - DNA, 25 bp, Homo sapien
atcccttcaggattaccagagttga

SEQ ID NO: 105864 - DNA, 25 bp, Homo sapien
attaccagagttgaaatacctccag

SEQ ID NO: 105865 - DNA, 25 bp, Homo sapien
atcttccttcattctaattcaattg

SEQ ID NO: 105866 - DNA, 25 bp, Homo sapien
gaagatggctcccaaggttcctagg

SEQ ID NO: 105867 - DNA, 25 bp, Homo sapien
ggttcctaggcattgcaggaccttg

SEQ ID NO: 105868 - DNA, 25 bp, Homo sapien
aggaccttgggcacatctgctggtg

SEQ ID NO: 105869 - DNA, 25 bp, Homo sapien
gagtggaaggaaaccgctgccttta

SEQ ID NO: 105870 - DNA, 25 bp, Homo sapien
aaccgctgcctttatcttgaagtca

SEQ ID NO: 105871 - DNA, 25 bp, Homo sapien
gggttccccacacagggcactgact

SEQ ID NO: 105872 - DNA, 25 bp, Homo sapien
ggcactgactgatagcttacactga

SEQ ID NO: 105873 - DNA, 25 bp, Homo sapien
actgaggactgtggcgactctgcag

SEQ ID NO: 105874 - DNA, 25 bp, Homo sapien
tgcagagtcactcacaccgttcgta

SEQ ID NO: 105875 - DNA, 25 bp, Homo sapien
gttcgtacgcccaggacagctggtt

SEQ ID NO: 105876 - DNA, 25 bp, Homo sapien
gacagctggttcgtggtttttacat

SEQ ID NO: 105877 - DNA, 25 bp, Homo sapien
actgtgggttgaaaactctagctaa

SEQ ID NO: 105878 - DNA, 25 bp, Homo sapien
aaatcttaacatgcattcctactat

SEQ ID NO: 105879 - DNA, 25 bp, Homo sapien
gtttcaattcaatcttctgaacggc

SEQ ID NO: 105880 - DNA, 25 bp, Homo sapien
aacggcataagtcctattttagcct

SEQ ID NO: 105881 - DNA, 25 bp, Homo sapien
tattttagccttacctcctgcattt

SEQ ID NO: 105882 - DNA, 25 bp, Homo sapien
tcctgcatttgcaatacgtaatact

SEQ ID NO: 105883 - DNA, 25 bp, Homo sapien
atcagtgggcacagttcttcagcta

SEQ ID NO: 105884 - DNA, 25 bp, Homo sapien
gttcttcagctacattgagaccctg

SEQ ID NO: 105885 - DNA, 25 bp, Homo sapien
atattctgactcgacatcttgtccc

SEQ ID NO: 105886 - DNA, 25 bp, Homo sapien
tcttgtccccaatccttccaaaaat

SEQ ID NO: 105887 - DNA, 25 bp, Homo sapien
gtgatttgtgctaccatttactcgt

SEQ ID NO: 105888 - DNA, 25 bp, Homo sapien
gccccttgctccgtaaaagtatcaa

SEQ ID NO: 105889 - DNA, 25 bp, Homo sapien
aaatactttctccttggtatctcaa

SEQ ID NO: 105890 - DNA, 25 bp, Homo sapien
cttggtatctcaaggaggtttctga

SEQ ID NO: 105891 - DNA, 25 bp, Homo sapien
agtcttgagacggaggctggccatc

SEQ ID NO: 105892 - DNA, 25 bp, Homo sapien
atccattcagccctgagcgtgctga

SEQ ID NO: 105893 - DNA, 25 bp, Homo sapien
ctctctgaaggcctccatggagcaa

SEQ ID NO: 105894 - DNA, 25 bp, Homo sapien
atggagcaaacggagccacctcggg

SEQ ID NO: 105895 - DNA, 25 bp, Homo sapien
gagccacctcgggaaagagtttaat

SEQ ID NO: 105896 - DNA, 25 bp, Homo sapien
tggaatatttttgtacccgatgttt

SEQ ID NO: 105897 - DNA, 25 bp, Homo sapien
gtacccgatgtttacagatgctgtt

SEQ ID NO: 105898 - DNA, 25 bp, Homo sapien
acagatgctgttgggaagttatcaa

SEQ ID NO: 105899 - DNA, 25 bp, Homo sapien
gaaagcttatggaatccctgataac

SEQ ID NO: 105900 - DNA, 25 bp, Homo sapien
tggaatccctgataactaaacatct

SEQ ID NO: 105901 - DNA, 25 bp, Homo sapien
ctttgccagcattaactgttgtttt

SEQ ID NO: 105902 - DNA, 25 bp, Homo sapien
aagatggctccaaaaggatcggcat

SEQ ID NO: 105903 - DNA, 25 bp, Homo sapien
caaaaggatcggcatggtcattcac

SEQ ID NO: 105904 - DNA, 25 bp, Homo sapien
ggatcggcatggtcattcaccaagt

SEQ ID NO: 105905 - DNA, 25 bp, Homo sapien
cggcatggtcattcaccaagtggaa

SEQ ID NO: 105906 - DNA, 25 bp, Homo sapien
gatttggtgaaaaagtcctaactgt

SEQ ID NO: 105907 - DNA, 25 bp, Homo sapien
actgttagggtaaaatttggcacat

SEQ ID NO: 105908 - DNA, 25 bp, Homo sapien
aaatttggcacatgtgtggaaacaa

SEQ ID NO: 105909 - DNA, 25 bp, Homo sapien
gcaaaaaatgttgcctttcagtgta

SEQ ID NO: 105910 - DNA, 25 bp, Homo sapien
aaagcttatcaatagatgtcatcat

SEQ ID NO: 105911 - DNA, 25 bp, Homo sapien
gatgtcatcatatgtgtaggcagaa

SEQ ID NO: 105912 - DNA, 25 bp, Homo sapien
gtgtaggcagaaataagctttgttc

SEQ ID NO: 105913 - DNA, 25 bp, Homo sapien
taagctttgttctatatctcttcta

SEQ ID NO: 105914 - DNA, 25 bp, Homo sapien
gttctatatctcttctaagacagtt

SEQ ID NO: 105915 - DNA, 25 bp, Homo sapien
aatatttacagtatcagcctttgat

SEQ ID NO: 105916 - DNA, 25 bp, Homo sapien
agcctttgattatagatgtgatcat

SEQ ID NO: 105917 - DNA, 25 bp, Homo sapien
cttatctgctgatgtttatctttaa

SEQ ID NO: 105918 - DNA, 25 bp, Homo sapien
atcttgctagtgtgaatatatctta

SEQ ID NO: 105919 - DNA, 25 bp, Homo sapien
atcttagaacaaaaggtatcctctt

SEQ ID NO: 105920 - DNA, 25 bp, Homo sapien
ggtatcctcttgaaaattagtttgt

SEQ ID NO: 105921 - DNA, 25 bp, Homo sapien
aaatactcaatgttattggactaaa

SEQ ID NO: 105922 - DNA, 25 bp, Homo sapien
aacatttccttttgctctctatctg

SEQ ID NO: 105923 - DNA, 25 bp, Homo sapien
acatttccttttgctctctatctga

SEQ ID NO: 105924 - DNA, 25 bp, Homo sapien
catttccttttgctctctatctgag

SEQ ID NO: 105925 - DNA, 25 bp, Homo sapien
atttccttttgctctctatctgagt

SEQ ID NO: 105926 - DNA, 25 bp, Homo sapien
ttccttttgctctctatctgagtgc

SEQ ID NO: 105927 - DNA, 25 bp, Homo sapien
tccttttgctctctatctgagtgcc

SEQ ID NO: 105928 - DNA, 25 bp, Homo sapien
ccttttgctctctatctgagtgccc

SEQ ID NO: 105929 - DNA, 25 bp, Homo sapien
ttttgctctctatctgagtgcccca

SEQ ID NO: 105930 - DNA, 25 bp, Homo sapien
tgctctctatctgagtgccccagaa

SEQ ID NO: 105931 - DNA, 25 bp, Homo sapien
tctctatctgagtgccccagaattg

SEQ ID NO: 105932 - DNA, 25 bp, Homo sapien
aattcatacaaagtattgtcctcaa

SEQ ID NO: 105933 - DNA, 25 bp, Homo sapien
attgtcctcaaataagtcttcctta

SEQ ID NO: 105934 - DNA, 25 bp, Homo sapien
aagtcttccttagctaaatgcaatt

SEQ ID NO: 105935 - DNA, 25 bp, Homo sapien
aattattcaaagatcctagggcact

SEQ ID NO: 105936 - DNA, 25 bp, Homo sapien
gatcctagggcacttctagtttcac

SEQ ID NO: 105937 - DNA, 25 bp, Homo sapien
tagggcacttctagtttcacgtaaa

SEQ ID NO: 105938 - DNA, 25 bp, Homo sapien
ggcacttctagtttcacgtaaatat

SEQ ID NO: 105939 - DNA, 25 bp, Homo sapien
tattcatattaggtggttctcttca

SEQ ID NO: 105940 - DNA, 25 bp, Homo sapien
catattaggtggttctcttcatcca

SEQ ID NO: 105941 - DNA, 25 bp, Homo sapien
cttcatccatttgttttcacactga

SEQ ID NO: 105942 - DNA, 25 bp, Homo sapien
attaacagcagtctaatctagtgac

SEQ ID NO: 105943 - DNA, 25 bp, Homo sapien
gagacgcccttcacatgttgagaaa

SEQ ID NO: 105944 - DNA, 25 bp, Homo sapien
gaagtgtgaaactgtcaggaagaca

SEQ ID NO: 105945 - DNA, 25 bp, Homo sapien
acagatgaaatgatttgcctgaggc

SEQ ID NO: 105946 - DNA, 25 bp, Homo sapien
ttgcctgaggccgtatcatcaaaca

SEQ ID NO: 105947 - DNA, 25 bp, Homo sapien
gcctgaggccgtatcatcaaacaag

SEQ ID NO: 105948 - DNA, 25 bp, Homo sapien
gaggccgtatcatcaaacaagaaat

SEQ ID NO: 105949 - DNA, 25 bp, Homo sapien
gaaattcatattcacctttctggaa

SEQ ID NO: 105950 - DNA, 25 bp, Homo sapien
attcacctttctggaattcttagga

SEQ ID NO: 105951 - DNA, 25 bp, Homo sapien
ctttctggaattcttaggataatga

SEQ ID NO: 105952 - DNA, 25 bp, Homo sapien
aggataatgattacatgtgttcaat

SEQ ID NO: 105953 - DNA, 25 bp, Homo sapien
gattacatgtgttcaattgttaaaa

SEQ ID NO: 105954 - DNA, 25 bp, Homo sapien
gaaaacaaaccaacaatggaacata

SEQ ID NO: 105955 - DNA, 25 bp, Homo sapien
tctgtaaaataaatccaagcatggt

SEQ ID NO: 105956 - DNA, 25 bp, Homo sapien
aatccaagcatggttagaaaatttg

SEQ ID NO: 105957 - DNA, 25 bp, Homo sapien
ggaaatctaagataaatcacttcaa

SEQ ID NO: 105958 - DNA, 25 bp, Homo sapien
gataaatcacttcaaaaccaagcaa

SEQ ID NO: 105959 - DNA, 25 bp, Homo sapien
aaatgaagttgatcaaatctgcttt

SEQ ID NO: 105960 - DNA, 25 bp, Homo sapien
gcttttcaaagtttatcaataccct

SEQ ID NO: 105961 - DNA, 25 bp, Homo sapien
tttgaaagaagacccatcttaaagc

SEQ ID NO: 105962 - DNA, 25 bp, Homo sapien
catcttaaagctaagtttacccaag

SEQ ID NO: 105963 - DNA, 25 bp, Homo sapien
agtttacccaagtactttcagcaag

SEQ ID NO: 105964 - DNA, 25 bp, Homo sapien
acccaagtactttcagcaagcagaa

SEQ ID NO: 105965 - DNA, 25 bp, Homo sapien
tttctctttttcattcatataccat

SEQ ID NO: 105966 - DNA, 25 bp, Homo sapien
taccattttatgagttctgtataat

SEQ ID NO: 105967 - DNA, 25 bp, Homo sapien
gagatttatttaataggacttcctt

SEQ ID NO: 105968 - DNA, 25 bp, Homo sapien
aggacttcctttgaaagctgtataa

SEQ ID NO: 105969 - DNA, 25 bp, Homo sapien
gtataatagtgtttctcgggcttct

SEQ ID NO: 105970 - DNA, 25 bp, Homo sapien
ctcgggcttctgtctctatgagaga

SEQ ID NO: 105971 - DNA, 25 bp, Homo sapien
gatagcttattactctgatactctt

SEQ ID NO: 105972 - DNA, 25 bp, Homo sapien
actctgatactctttaatcttttac

SEQ ID NO: 105973 - DNA, 25 bp, Homo sapien
aatcttttacaaaggcaagttgcca

SEQ ID NO: 105974 - DNA, 25 bp, Homo sapien
aggcaagttgccacttgtcattttt

SEQ ID NO: 105975 - DNA, 25 bp, Homo sapien
gagaacttctagtgtatggatttaa

SEQ ID NO: 105976 - DNA, 25 bp, Homo sapien
tattgtccaagccaacagcaaaggg

SEQ ID NO: 105977 - DNA, 25 bp, Homo sapien
aaatttgggccatcttagctacatt

SEQ ID NO: 105978 - DNA, 25 bp, Homo sapien
ttgggccatcttagctacattaaat

SEQ ID NO: 105979 - DNA, 25 bp, Homo sapien
gctacattaaatggctacacagtcc

SEQ ID NO: 105980 - DNA, 25 bp, Homo sapien
ggctacacagtccatgtcataaatg

SEQ ID NO: 105981 - DNA, 25 bp, Homo sapien
gttaatggtggtctatgtatttgga

SEQ ID NO: 105982 - DNA, 25 bp, Homo sapien
taagcaagcagagaccataaaagag

SEQ ID NO: 105983 - DNA, 25 bp, Homo sapien
taaaagaggcactaatgacataaac

SEQ ID NO: 105984 - DNA, 25 bp, Homo sapien
tgacataaacattcaaccttcctta

SEQ ID NO: 105985 - DNA, 25 bp, Homo sapien
cattcaaccttccttacaaactttg

SEQ ID NO: 105986 - DNA, 25 bp, Homo sapien
atggtggttgcccagttttttgttg

SEQ ID NO: 105987 - DNA, 25 bp, Homo sapien
gggccctttccataggaactgccct

SEQ ID NO: 105988 - DNA, 25 bp, Homo sapien
cctttccataggaactgcccttgga

SEQ ID NO: 105989 - DNA, 25 bp, Homo sapien
tttccataggaactgcccttggaga

SEQ ID NO: 105990 - DNA, 25 bp, Homo sapien
tccataggaactgcccttggagata

SEQ ID NO: 105991 - DNA, 25 bp, Homo sapien
ataggaactgcccttggagatagca

SEQ ID NO: 105992 - DNA, 25 bp, Homo sapien
aggaactgcccttggagatagcaga

SEQ ID NO: 105993 - DNA, 25 bp, Homo sapien
gaactgcccttggagatagcagagt

SEQ ID NO: 105994 - DNA, 25 bp, Homo sapien
actgcccttggagatagcagagtgt

SEQ ID NO: 105995 - DNA, 25 bp, Homo sapien
cccttggagatagcagagtgtggct

SEQ ID NO: 105996 - DNA, 25 bp, Homo sapien
agagtgtggctgcccctccttgctc

SEQ ID NO: 105997 - DNA, 25 bp, Homo sapien
ccctcactcttacccaagactctgg

SEQ ID NO: 105998 - DNA, 25 bp, Homo sapien
cagcttttttgaattctaatacata

SEQ ID NO: 105999 - DNA, 25 bp, Homo sapien
tacataggtgtatatttggtattag

SEQ ID NO: 106000 - DNA, 25 bp, Homo sapien
ttcttttcaacttataacactgtat

SEQ ID NO: 106001 - DNA, 25 bp, Homo sapien
cactgtatacagttatttctaaagc

SEQ ID NO: 106002 - DNA, 25 bp, Homo sapien
ataatcacagttccctgttatacag

SEQ ID NO: 106003 - DNA, 25 bp, Homo sapien
tcacagttccctgttatacagataa

SEQ ID NO: 106004 - DNA, 25 bp, Homo sapien
tacagataatgttctcactacccat

SEQ ID NO: 106005 - DNA, 25 bp, Homo sapien
atgttctcactacccataatatgta

SEQ ID NO: 106006 - DNA, 25 bp, Homo sapien
ttctccttagccgtagtatgcatac

SEQ ID NO: 106007 - DNA, 25 bp, Homo sapien
agccgtagtatgcatacacctatcc

SEQ ID NO: 106008 - DNA, 25 bp, Homo sapien
ttataattcatgtggtagttaccta

SEQ ID NO: 106009 - DNA, 25 bp, Homo sapien
tgttccccacgtatggatatagtag

SEQ ID NO: 106010 - DNA, 25 bp, Homo sapien
ccccacgtatggatatagtagagat

SEQ ID NO: 106011 - DNA, 25 bp, Homo sapien
gattttgagttttcccttgtagtgt

SEQ ID NO: 106012 - DNA, 25 bp, Homo sapien
tgagttttcccttgtagtgtaaaga

SEQ ID NO: 106013 - DNA, 25 bp, Homo sapien
gaatgatcactttctgtaacaataa

SEQ ID NO: 106014 - DNA, 25 bp, Homo sapien
caataacaagaccactttttaagat

SEQ ID NO: 106015 - DNA, 25 bp, Homo sapien
tttcttccatagctaatcttccttc

SEQ ID NO: 106016 - DNA, 25 bp, Homo sapien
gctaatcttccttctaatagttttt

SEQ ID NO: 106017 - DNA, 25 bp, Homo sapien
tgctttgcaaagctttcccctcata

SEQ ID NO: 106018 - DNA, 25 bp, Homo sapien
ctcatagcctgtacctgttatcaat

SEQ ID NO: 106019 - DNA, 25 bp, Homo sapien
agcctgtacctgttatcaatataaa

SEQ ID NO: 106020 - DNA, 25 bp, Homo sapien
ggagactgtggtatgcatcacaaga

SEQ ID NO: 106021 - DNA, 25 bp, Homo sapien
gtatgcatcacaagaaaacctgtag

SEQ ID NO: 106022 - DNA, 25 bp, Homo sapien
aagaaaacctgtagaccatccactc

SEQ ID NO: 106023 - DNA, 25 bp, Homo sapien
tagaccatccactcagagtgcccaa

SEQ ID NO: 106024 - DNA, 25 bp, Homo sapien
agtgcccaaattgagtcactcttaa

SEQ ID NO: 106025 - DNA, 25 bp, Homo sapien
gaaactctaactatcagtgaaaagt

SEQ ID NO: 106026 - DNA, 25 bp, Homo sapien
gtttactgtggtagccatttcccca

SEQ ID NO: 106027 - DNA, 25 bp, Homo sapien
tggtagccatttccccacctagaaa

SEQ ID NO: 106028 - DNA, 25 bp, Homo sapien
atattagggaccatgaactctgtaa

SEQ ID NO: 106029 - DNA, 25 bp, Homo sapien
atcacagttacaaaagcgacagtct

SEQ ID NO: 106030 - DNA, 25 bp, Homo sapien
aaagcgacagtcttctatttttgat

SEQ ID NO: 106031 - DNA, 25 bp, Homo sapien
gatgagtacagttacagtcaaatac

SEQ ID NO: 106032 - DNA, 25 bp, Homo sapien
tactgtagttagacaaattcttttt

SEQ ID NO: 106033 - DNA, 25 bp, Homo sapien
atgagttaaacgtctcttcctgtgc

SEQ ID NO: 106034 - DNA, 25 bp, Homo sapien
taaacgtctcttcctgtgcagtttc

SEQ ID NO: 106035 - DNA, 25 bp, Homo sapien
cttcctgtgcagtttcatattagtg

SEQ ID NO: 106036 - DNA, 25 bp, Homo sapien
gcagtttcatattagtggtgttttc

SEQ ID NO: 106037 - DNA, 25 bp, Homo sapien
ggtgttttcagtgtaggtatcttaa

SEQ ID NO: 106038 - DNA, 25 bp, Homo sapien
tatcttaatatcagcttatcgtggt

SEQ ID NO: 106039 - DNA, 25 bp, Homo sapien
atcagcttatcgtggtttttggtta

SEQ ID NO: 106040 - DNA, 25 bp, Homo sapien
tcgtggtttttggttatgtattata

SEQ ID NO: 106041 - DNA, 25 bp, Homo sapien
attctgtctgtatactttatgtcaa

SEQ ID NO: 106042 - DNA, 25 bp, Homo sapien
gtgggcataggcagcgagatatcca

SEQ ID NO: 106043 - DNA, 25 bp, Homo sapien
gatatccagtggtaacagttgtctg

SEQ ID NO: 106044 - DNA, 25 bp, Homo sapien
aacagttgtctgtgctaataattgg

SEQ ID NO: 106045 - DNA, 25 bp, Homo sapien
ataattggagcccacacagaccagc

SEQ ID NO: 106046 - DNA, 25 bp, Homo sapien
cacacagaccagcaacttgttgaat

SEQ ID NO: 106047 - DNA, 25 bp, Homo sapien
gttgaatgccagttttgaccacaga

SEQ ID NO: 106048 - DNA, 25 bp, Homo sapien
attcgagacctgatgtttggactga

SEQ ID NO: 106049 - DNA, 25 bp, Homo sapien
gtttggactgaggtacctgtacttc

SEQ ID NO: 106050 - DNA, 25 bp, Homo sapien
gtacctgtacttcttgggtgtgaca

SEQ ID NO: 106051 - DNA, 25 bp, Homo sapien
caccggctgttgctggctttcagag

SEQ ID NO: 106052 - DNA, 25 bp, Homo sapien
ttctcattgaccagggtttgttctt

SEQ ID NO: 106053 - DNA, 25 bp, Homo sapien
tctcagagccaccagacgtgcaggt

SEQ ID NO: 106054 - DNA, 25 bp, Homo sapien
caggtgggacagtggttccagctcc

SEQ ID NO: 106055 - DNA, 25 bp, Homo sapien
tgtcagcgtccctcccaggtgctag

SEQ ID NO: 106056 - DNA, 25 bp, Homo sapien
aggtgctagccctggcaggcacagc

SEQ ID NO: 106057 - DNA, 25 bp, Homo sapien
ggaaatgctcttgatgagaggctcg

SEQ ID NO: 106058 - DNA, 25 bp, Homo sapien
tttaaagaagcccaaagcgtgtgct

SEQ ID NO: 106059 - DNA, 25 bp, Homo sapien
agcccaaagcgtgtgcttatccaag

SEQ ID NO: 106060 - DNA, 25 bp, Homo sapien
tattcctgacttcacggcttgcatg

SEQ ID NO: 106061 - DNA, 25 bp, Homo sapien
gacttcacggcttgcatgtttgatt

SEQ ID NO: 106062 - DNA, 25 bp, Homo sapien
tctaagagaaaagaggctgcctgct

SEQ ID NO: 106063 - DNA, 25 bp, Homo sapien
ctgggtgtctgtggaaatgagatta

SEQ ID NO: 106064 - DNA, 25 bp, Homo sapien
ccagggacagaagcaggagtaagtt

SEQ ID NO: 106065 - DNA, 25 bp, Homo sapien
gcaggagtaagtttctcatcccatg

SEQ ID NO: 106066 - DNA, 25 bp, Homo sapien
atcccatgggcgaccagggccatct

SEQ ID NO: 106067 - DNA, 25 bp, Homo sapien
acagggagctggcaatgccctacct

SEQ ID NO: 106068 - DNA, 25 bp, Homo sapien
tggcaatgccctacctgcctgttct

SEQ ID NO: 106069 - DNA, 25 bp, Homo sapien
gaaacaggctctgagatttcacagg

SEQ ID NO: 106070 - DNA, 25 bp, Homo sapien
agatttcacaggtcttgcccaaagt

SEQ ID NO: 106071 - DNA, 25 bp, Homo sapien
aaacacagtgtttcctgagtagcag

SEQ ID NO: 106072 - DNA, 25 bp, Homo sapien
gtgtttcctgagtagcagtgattgt

SEQ ID NO: 106073 - DNA, 25 bp, Homo sapien
cagtgattgttatgccttgctattt

SEQ ID NO: 106074 - DNA, 25 bp, Homo sapien
tctattttcgtataacattgtcaag

SEQ ID NO: 106075 - DNA, 25 bp, Homo sapien
gagcctgtatgctaaggtgaagaag

SEQ ID NO: 106076 - DNA, 25 bp, Homo sapien
gaagaagaaagactccctgcacggc

SEQ ID NO: 106077 - DNA, 25 bp, Homo sapien
aagaagaaagactccctgcacggca

SEQ ID NO: 106078 - DNA, 25 bp, Homo sapien
agaagaaagactccctgcacggcag

SEQ ID NO: 106079 - DNA, 25 bp, Homo sapien
aagaaagactccctgcacggcagca

SEQ ID NO: 106080 - DNA, 25 bp, Homo sapien
agaaagactccctgcacggcagcac

SEQ ID NO: 106081 - DNA, 25 bp, Homo sapien
ggctgttaatgccacacgtcctaca

SEQ ID NO: 106082 - DNA, 25 bp, Homo sapien
tgttaatgccacacgtcctacactg

SEQ ID NO: 106083 - DNA, 25 bp, Homo sapien
gttaatgccacacgtcctacactgt

SEQ ID NO: 106084 - DNA, 25 bp, Homo sapien
aatgccacacgtcctacactgtcgg

SEQ ID NO: 106085 - DNA, 25 bp, Homo sapien
caaccacgtggaacacacgctttct

SEQ ID NO: 106086 - DNA, 25 bp, Homo sapien
gatggtgtgcttattgtagatctgc

SEQ ID NO: 106087 - DNA, 25 bp, Homo sapien
aaccaccaccgaataaaataagcag

SEQ ID NO: 106088 - DNA, 25 bp, Homo sapien
gtgatatgcctgtgtctcttagaga

SEQ ID NO: 106089 - DNA, 25 bp, Homo sapien
gtctcttagagatgcgctagttttt

SEQ ID NO: 106090 - DNA, 25 bp, Homo sapien
agagatgcgctagtttttatggaac

SEQ ID NO: 106091 - DNA, 25 bp, Homo sapien
atggaactagcaaaagatctgatct

SEQ ID NO: 106092 - DNA, 25 bp, Homo sapien
ttaaagcttcctaatctattttgtt

SEQ ID NO: 106093 - DNA, 25 bp, Homo sapien
aatctattttgttggcgtcattcct

SEQ ID NO: 106094 - DNA, 25 bp, Homo sapien
gcgtcattcctctgctgaattttta

SEQ ID NO: 106095 - DNA, 25 bp, Homo sapien
tgttcactctggcttacctgttaat

SEQ ID NO: 106096 - DNA, 25 bp, Homo sapien
cactctggcttacctgttaatggaa

SEQ ID NO: 106097 - DNA, 25 bp, Homo sapien
gggtacatacgtcctctgccctaag

SEQ ID NO: 106098 - DNA, 25 bp, Homo sapien
acgtcctctgccctaaggcaatttt

SEQ ID NO: 106099 - DNA, 25 bp, Homo sapien
cattttgaggcctaaaaatcatagg

SEQ ID NO: 106100 - DNA, 25 bp, Homo sapien
aggaaactgcccctgagctcacaca

SEQ ID NO: 106101 - DNA, 25 bp, Homo sapien
actgcccctgagctcacacatattt

SEQ ID NO: 106102 - DNA, 25 bp, Homo sapien
atatttccaatggagctcacacata

SEQ ID NO: 106103 - DNA, 25 bp, Homo sapien
agggaatccatggattacctaagcc

SEQ ID NO: 106104 - DNA, 25 bp, Homo sapien
cctccagttcggctaagaaactcta

SEQ ID NO: 106105 - DNA, 25 bp, Homo sapien
gttcggctaagaaactctagtctat

SEQ ID NO: 106106 - DNA, 25 bp, Homo sapien
gaaactctagtctatatatcaagtt

SEQ ID NO: 106107 - DNA, 25 bp, Homo sapien
agaaatttcccttccatttatggat

SEQ ID NO: 106108 - DNA, 25 bp, Homo sapien
gtctaagatgtgttccttggttgta

SEQ ID NO: 106109 - DNA, 25 bp, Homo sapien
atgtgttccttggttgtataaagca

SEQ ID NO: 106110 - DNA, 25 bp, Homo sapien
gcaaaagtagccatcattcctttat

SEQ ID NO: 106111 - DNA, 25 bp, Homo sapien
gtgtagttcaatagtctaatcaagt

SEQ ID NO: 106112 - DNA, 25 bp, Homo sapien
ggaatctgagaaagccctctaggaa

SEQ ID NO: 106113 - DNA, 25 bp, Homo sapien
aaagccctctaggaaagggtatgat

SEQ ID NO: 106114 - DNA, 25 bp, Homo sapien
aagctttatatacctctttactgag

SEQ ID NO: 106115 - DNA, 25 bp, Homo sapien
atatacctctttactgagcagtagg

SEQ ID NO: 106116 - DNA, 25 bp, Homo sapien
gcagtaggtaggctcacttctcttt

SEQ ID NO: 106117 - DNA, 25 bp, Homo sapien
gctcacttctctttcccttcaaaat

SEQ ID NO: 106118 - DNA, 25 bp, Homo sapien
ttcccttcaaaatgcttttcatagg

SEQ ID NO: 106119 - DNA, 25 bp, Homo sapien
atccctagagtgtagggtgggccta

SEQ ID NO: 106120 - DNA, 25 bp, Homo sapien
tagggtgggcctaagactgcgcttc

SEQ ID NO: 106121 - DNA, 25 bp, Homo sapien
gggcctaagactgcgcttctaacaa

SEQ ID NO: 106122 - DNA, 25 bp, Homo sapien
tgcgcttctaacaagtctcccagtt

SEQ ID NO: 106123 - DNA, 25 bp, Homo sapien
taacaagtctcccagttgctgctgc

SEQ ID NO: 106124 - DNA, 25 bp, Homo sapien
tgttggtgctggttccgggaccaca

SEQ ID NO: 106125 - DNA, 25 bp, Homo sapien
gctggttccgggaccacattatgag

SEQ ID NO: 106126 - DNA, 25 bp, Homo sapien
ccgggaccacattatgagaaccact

SEQ ID NO: 106127 - DNA, 25 bp, Homo sapien
gggagccttatttctgtaaacctag

SEQ ID NO: 106128 - DNA, 25 bp, Homo sapien
cctaggcctcaaaggtgcctggtga

SEQ ID NO: 106129 - DNA, 25 bp, Homo sapien
ggcctcaaaggtgcctggtgatagt

SEQ ID NO: 106130 - DNA, 25 bp, Homo sapien
tagtcttcagtgctaccgcatcaac

SEQ ID NO: 106131 - DNA, 25 bp, Homo sapien
tcttcagtgctaccgcatcaacctg

SEQ ID NO: 106132 - DNA, 25 bp, Homo sapien
agtgctaccgcatcaacctgcagat

SEQ ID NO: 106133 - DNA, 25 bp, Homo sapien
tcccatgcccgctcttgagtatctt

SEQ ID NO: 106134 - DNA, 25 bp, Homo sapien
cttgagtatcttccccaccctatta

SEQ ID NO: 106135 - DNA, 25 bp, Homo sapien
aggccaggcactctgtagtcttcag

SEQ ID NO: 106136 - DNA, 25 bp, Homo sapien
gccaggcactctgtagtcttcagtg

SEQ ID NO: 106137 - DNA, 25 bp, Homo sapien
aggcactctgtagtcttcagtgcta

SEQ ID NO: 106138 - DNA, 25 bp, Homo sapien
cactctgtagtcttcagtgctaccg

SEQ ID NO: 106139 - DNA, 25 bp, Homo sapien
tctgtagtcttcagtgctaccgcat

SEQ ID NO: 106140 - DNA, 25 bp, Homo sapien
tgtagtcttcagtgctaccgcatca

SEQ ID NO: 106141 - DNA, 25 bp, Homo sapien
gatgctcgcccaggagtgaggctcc

SEQ ID NO: 106142 - DNA, 25 bp, Homo sapien
caggagtgaggctccccgcctgtgt

SEQ ID NO: 106143 - DNA, 25 bp, Homo sapien
ccctggctgcgctctgagccttcag

SEQ ID NO: 106144 - DNA, 25 bp, Homo sapien
tctgagccttcagggccaccgcccg

SEQ ID NO: 106145 - DNA, 25 bp, Homo sapien
tgctgcttttgtgctgggactctcc

SEQ ID NO: 106146 - DNA, 25 bp, Homo sapien
gctgcttttgtgctgggactctccg

SEQ ID NO: 106147 - DNA, 25 bp, Homo sapien
tgcttttgtgctgggactctccggg

SEQ ID NO: 106148 - DNA, 25 bp, Homo sapien
ctctctgccttcagaccttgggcag

SEQ ID NO: 106149 - DNA, 25 bp, Homo sapien
tctgccttcagaccttgggcagaag

SEQ ID NO: 106150 - DNA, 25 bp, Homo sapien
tgccttcagaccttgggcagaagga

SEQ ID NO: 106151 - DNA, 25 bp, Homo sapien
ccttcagaccttgggcagaaggagg

SEQ ID NO: 106152 - DNA, 25 bp, Homo sapien
ttcaagtaagtcattttaaccgaat

SEQ ID NO: 106153 - DNA, 25 bp, Homo sapien
aagtcattttaaccgaatgttcatt

SEQ ID NO: 106154 - DNA, 25 bp, Homo sapien
gagcaatcagtattattggaccaaa

SEQ ID NO: 106155 - DNA, 25 bp, Homo sapien
gttttcaccttgacgctcttctttt

SEQ ID NO: 106156 - DNA, 25 bp, Homo sapien
ccttgacgctcttcttttcattatt

SEQ ID NO: 106157 - DNA, 25 bp, Homo sapien
atttctaatgctacaagaatgctgt

SEQ ID NO: 106158 - DNA, 25 bp, Homo sapien
gaatgctgtaaagtgtcttctaaaa

SEQ ID NO: 106159 - DNA, 25 bp, Homo sapien
gtcttctaaaatgatgtagcctgac

SEQ ID NO: 106160 - DNA, 25 bp, Homo sapien
aaaactaggtagtattgtgcactga

SEQ ID NO: 106161 - DNA, 25 bp, Homo sapien
gtattgtgcactgatttgaccattg

SEQ ID NO: 106162 - DNA, 25 bp, Homo sapien
atttgaccattgtgaaatcctttct

SEQ ID NO: 106163 - DNA, 25 bp, Homo sapien
attgcatgcctgagtcgtaagtgtc

SEQ ID NO: 106164 - DNA, 25 bp, Homo sapien
gtcaggatgctgaatatcacctctt

SEQ ID NO: 106165 - DNA, 25 bp, Homo sapien
tcacctcttgcaacaaatctagctt

SEQ ID NO: 106166 - DNA, 25 bp, Homo sapien
atctagctttatgagtaccgtcacg

SEQ ID NO: 106167 - DNA, 25 bp, Homo sapien
taccgtcacgtttcctgttgaagat

SEQ ID NO: 106168 - DNA, 25 bp, Homo sapien
tgtcagtgtcccaagtattcatttt

SEQ ID NO: 106169 - DNA, 25 bp, Homo sapien
gttggttgacttctttgtggtatgc

SEQ ID NO: 106170 - DNA, 25 bp, Homo sapien
ggtatgcttcgatatatttttcctt

SEQ ID NO: 106171 - DNA, 25 bp, Homo sapien
ttataggtgattgcctcatcgtatc

SEQ ID NO: 106172 - DNA, 25 bp, Homo sapien
tcatcgtatcttaaggttgtccgta

SEQ ID NO: 106173 - DNA, 25 bp, Homo sapien
ggttgtccgtattggtttgattgat

SEQ ID NO: 106174 - DNA, 25 bp, Homo sapien
ggtgaatgccaaaaactgccgctcc

SEQ ID NO: 106175 - DNA, 25 bp, Homo sapien
gctccttgatgcaccacgttaagaa

SEQ ID NO: 106176 - DNA, 25 bp, Homo sapien
atcgcagaattagcagccctgtcac

SEQ ID NO: 106177 - DNA, 25 bp, Homo sapien
gtcacaagacgagctcacgagtatt

SEQ ID NO: 106178 - DNA, 25 bp, Homo sapien
gccaaacagctttatgatttcattc

SEQ ID NO: 106179 - DNA, 25 bp, Homo sapien
tgatttcattcacacctcttttgca

SEQ ID NO: 106180 - DNA, 25 bp, Homo sapien
cagtgatggctgttttcttatccca

SEQ ID NO: 106181 - DNA, 25 bp, Homo sapien
ttatcccatgcctgtacttttcagc

SEQ ID NO: 106182 - DNA, 25 bp, Homo sapien
gctccttgccagacatcataggtca

SEQ ID NO: 106183 - DNA, 25 bp, Homo sapien
attggtttgctatttcattcttttc

SEQ ID NO: 106184 - DNA, 25 bp, Homo sapien
cattcttttccaatgctcttaatga

SEQ ID NO: 106185 - DNA, 25 bp, Homo sapien
agccatttggaagctttggttatga

SEQ ID NO: 106186 - DNA, 25 bp, Homo sapien
gctttggttatgaaacatgtggagt

SEQ ID NO: 106187 - DNA, 25 bp, Homo sapien
catgtggagtgtattaagtgcagct

SEQ ID NO: 106188 - DNA, 25 bp, Homo sapien
taagtgcagcttgacattatgtttt

SEQ ID NO: 106189 - DNA, 25 bp, Homo sapien
gctttttatcgctaaatgacttgca

SEQ ID NO: 106190 - DNA, 25 bp, Homo sapien
gtgactcgagtgtttaaatgcctgt

SEQ ID NO: 106191 - DNA, 25 bp, Homo sapien
gagtgtttaaatgcctgtgtacaac

SEQ ID NO: 106192 - DNA, 25 bp, Homo sapien
atgcctgtgtacaacaatgctttga

SEQ ID NO: 106193 - DNA, 25 bp, Homo sapien
aggtatgagttatcagctctatgtc

SEQ ID NO: 106194 - DNA, 25 bp, Homo sapien
gagttatcagctctatgtcaattga

SEQ ID NO: 106195 - DNA, 25 bp, Homo sapien
gctctatgtcaattgatatttctgt

SEQ ID NO: 106196 - DNA, 25 bp, Homo sapien
aagccagccaggatgtggcgtcaca

SEQ ID NO: 106197 - DNA, 25 bp, Homo sapien
aggatgtggcgtcacagcccttctc

SEQ ID NO: 106198 - DNA, 25 bp, Homo sapien
ggcgccctgacgcagggctacatct

SEQ ID NO: 106199 - DNA, 25 bp, Homo sapien
tgagccagccttcccagatgagcca

SEQ ID NO: 106200 - DNA, 25 bp, Homo sapien
tgtcccaggacagttaccttggtga

SEQ ID NO: 106201 - DNA, 25 bp, Homo sapien
ttaccttggtgacgagtttaaatca

SEQ ID NO: 106202 - DNA, 25 bp, Homo sapien
aatcacaaatcgacgtggcgctctc

SEQ ID NO: 106203 - DNA, 25 bp, Homo sapien
tggcgctctcacaggactccacgta

SEQ ID NO: 106204 - DNA, 25 bp, Homo sapien
aggactccacgtaccagggagagcg

SEQ ID NO: 106205 - DNA, 25 bp, Homo sapien
gagagcgggcttaccagcatggcgg

SEQ ID NO: 106206 - DNA, 25 bp, Homo sapien
gagctaagcaacgtggcttagtcca

SEQ ID NO: 106207 - DNA, 25 bp, Homo sapien
tgccactcttgctgtgaaattgaag

SEQ ID NO: 106208 - DNA, 25 bp, Homo sapien
gaaagcaactcaatttggtttatgc

SEQ ID NO: 106209 - DNA, 25 bp, Homo sapien
atgcacagtgtaatatttctccaag

SEQ ID NO: 106210 - DNA, 25 bp, Homo sapien
aagtatcatccaaaattccccacag

SEQ ID NO: 106211 - DNA, 25 bp, Homo sapien
agacaaggctttcgtcctcattagg

SEQ ID NO: 106212 - DNA, 25 bp, Homo sapien
tcattaggtgttggcctcagcctaa

SEQ ID NO: 106213 - DNA, 25 bp, Homo sapien
agcctaaccctctaggactgttcta

SEQ ID NO: 106214 - DNA, 25 bp, Homo sapien
ggactgttctattaaattgctgcca

SEQ ID NO: 106215 - DNA, 25 bp, Homo sapien
attgctgccagaattttacatccag

SEQ ID NO: 106216 - DNA, 25 bp, Homo sapien
agttacctccactttctagaacata

SEQ ID NO: 106217 - DNA, 25 bp, Homo sapien
gaaaccaatttctacttcatactga

SEQ ID NO: 106218 - DNA, 25 bp, Homo sapien
atctactgcatttagggagtattct

SEQ ID NO: 106219 - DNA, 25 bp, Homo sapien
aagctagttgaatacttgaaccata

SEQ ID NO: 106220 - DNA, 25 bp, Homo sapien
aatgtccagtaagatcactgtttag

SEQ ID NO: 106221 - DNA, 25 bp, Homo sapien
gatttgccatagagtacactgcctg

SEQ ID NO: 106222 - DNA, 25 bp, Homo sapien
tacactgcctgccttaagtgaggaa

SEQ ID NO: 106223 - DNA, 25 bp, Homo sapien
caaagtgctattacgaagttcaaga

SEQ ID NO: 106224 - DNA, 25 bp, Homo sapien
acagagtaatcttgttggttcacca

SEQ ID NO: 106225 - DNA, 25 bp, Homo sapien
tgttggttcaccattgagaccgtga

SEQ ID NO: 106226 - DNA, 25 bp, Homo sapien
cattgagaccgtgaagatactttgt

SEQ ID NO: 106227 - DNA, 25 bp, Homo sapien
gatactttgtattgtcctattagtg

SEQ ID NO: 106228 - DNA, 25 bp, Homo sapien
gcatctttgatgtgttgttcttggc

SEQ ID NO: 106229 - DNA, 25 bp, Homo sapien
cctttgaaccagtgtacagtcgcca

SEQ ID NO: 106230 - DNA, 25 bp, Homo sapien
gaaccagtgtacagtcgccagatag

SEQ ID NO: 106231 - DNA, 25 bp, Homo sapien
tcgccagatagggaccggtgaacac

SEQ ID NO: 106232 - DNA, 25 bp, Homo sapien
ggtgaacacctgattccaaacatgt

SEQ ID NO: 106233 - DNA, 25 bp, Homo sapien
ggtcttgtcctctttttatgtggtt

SEQ ID NO: 106234 - DNA, 25 bp, Homo sapien
tgtggtttaattgccaagtgtctaa

SEQ ID NO: 106235 - DNA, 25 bp, Homo sapien
gtgtctaaagcttaatatgccgtgc

SEQ ID NO: 106236 - DNA, 25 bp, Homo sapien
gcttaatatgccgtgctatgtaaat

SEQ ID NO: 106237 - DNA, 25 bp, Homo sapien
acaactgtcatattttgatgtcaac

SEQ ID NO: 106238 - DNA, 25 bp, Homo sapien
ggataaaatggtacccggccaacat

SEQ ID NO: 106239 - DNA, 25 bp, Homo sapien
gccaacatcaagtgactttatagct

SEQ ID NO: 106240 - DNA, 25 bp, Homo sapien
ttctccacggcgctgtacggcgaga

SEQ ID NO: 106241 - DNA, 25 bp, Homo sapien
gctgtacggcgagagtgacctctaa

SEQ ID NO: 106242 - DNA, 25 bp, Homo sapien
ggcgagagtgacctctaatccaccc

SEQ ID NO: 106243 - DNA, 25 bp, Homo sapien
gtgcgccgtgcccacagatgtgaaa

SEQ ID NO: 106244 - DNA, 25 bp, Homo sapien
gcgccgtgcccacagatgtgaaatg

SEQ ID NO: 106245 - DNA, 25 bp, Homo sapien
gacgtcagcctgtacaggctcccag

SEQ ID NO: 106246 - DNA, 25 bp, Homo sapien
atgctattgaaattgcgctgaatcg

SEQ ID NO: 106247 - DNA, 25 bp, Homo sapien
gaaattgcgctgaatcgtatgcttt

SEQ ID NO: 106248 - DNA, 25 bp, Homo sapien
tgcgctgaatcgtatgctttttcct

SEQ ID NO: 106249 - DNA, 25 bp, Homo sapien
gctgaatcgtatgctttttcctttt

SEQ ID NO: 106250 - DNA, 25 bp, Homo sapien
tgaatcgtatgctttttccttttga

SEQ ID NO: 106251 - DNA, 25 bp, Homo sapien
gaaatggcacaaacaccttaagcaa

SEQ ID NO: 106252 - DNA, 25 bp, Homo sapien
caccttaagcaatatattttcctag

SEQ ID NO: 106253 - DNA, 25 bp, Homo sapien
attgttttcaatctagaacttttct

SEQ ID NO: 106254 - DNA, 25 bp, Homo sapien
gaacttttctattaactaccatgtc

SEQ ID NO: 106255 - DNA, 25 bp, Homo sapien
accatgtcttaaaatcaagtctata

SEQ ID NO: 106256 - DNA, 25 bp, Homo sapien
acctgtgttaatgctttgttaatgc

SEQ ID NO: 106257 - DNA, 25 bp, Homo sapien
aatgctttgttaatgcttttcccac

SEQ ID NO: 106258 - DNA, 25 bp, Homo sapien
tttgttaatgcttttcccactctca

SEQ ID NO: 106259 - DNA, 25 bp, Homo sapien
cttttcccactctcatttgttaatg

SEQ ID NO: 106260 - DNA, 25 bp, Homo sapien
ggatttgcattttgagctttatctc

SEQ ID NO: 106261 - DNA, 25 bp, Homo sapien
gagctttatctctaaatgtgacatg

SEQ ID NO: 106262 - DNA, 25 bp, Homo sapien
tttgtcagacacacatattctttct

SEQ ID NO: 106263 - DNA, 25 bp, Homo sapien
acatattctttctcccaatccatgc

SEQ ID NO: 106264 - DNA, 25 bp, Homo sapien
aatccatgccttccctattcattct

SEQ ID NO: 106265 - DNA, 25 bp, Homo sapien
atgccttccctattcattctctgtc

SEQ ID NO: 106266 - DNA, 25 bp, Homo sapien
ctctgtccagagttttttgctaaag

SEQ ID NO: 106267 - DNA, 25 bp, Homo sapien
tgtccagagttttttgctaaagata

SEQ ID NO: 106268 - DNA, 25 bp, Homo sapien
atgatacatcaagtagtggaagtgt

SEQ ID NO: 106269 - DNA, 25 bp, Homo sapien
agagctacaccttctaccatgaggc

SEQ ID NO: 106270 - DNA, 25 bp, Homo sapien
aactagggagaatgaattatttaca

SEQ ID NO: 106271 - DNA, 25 bp, Homo sapien
aattaatagctttgggattatttat

SEQ ID NO: 106272 - DNA, 25 bp, Homo sapien
gagacaaaatctcgctcttgttgcc

SEQ ID NO: 106273 - DNA, 25 bp, Homo sapien
gaatgatgatactctgcactggaag

SEQ ID NO: 106274 - DNA, 25 bp, Homo sapien
ctgcactggaagaagtacgacatct

SEQ ID NO: 106275 - DNA, 25 bp, Homo sapien
gtacgacatctatgagaagcaaacc

SEQ ID NO: 106276 - DNA, 25 bp, Homo sapien
ggaaaccgactctgtagtgctgata

SEQ ID NO: 106277 - DNA, 25 bp, Homo sapien
gtagtgctgatagaaaacctgaaga

SEQ ID NO: 106278 - DNA, 25 bp, Homo sapien
ttatttttaccttcactgtgacctt

SEQ ID NO: 106279 - DNA, 25 bp, Homo sapien
gagaagattcttcccattctccatt

SEQ ID NO: 106280 - DNA, 25 bp, Homo sapien
cattctccatttgttatctgggaac

SEQ ID NO: 106281 - DNA, 25 bp, Homo sapien
ggaaactgaaactactgcaccattt

SEQ ID NO: 106282 - DNA, 25 bp, Homo sapien
gcaccatttaaaaacaggcagctca

SEQ ID NO: 106283 - DNA, 25 bp, Homo sapien
gccacaggtctttatgttgagtcgc

SEQ ID NO: 106284 - DNA, 25 bp, Homo sapien
gatagctatctaacaactaattact

SEQ ID NO: 106285 - DNA, 25 bp, Homo sapien
gtagaatttattttaactatgacct

SEQ ID NO: 106286 - DNA, 25 bp, Homo sapien
taactatgacctttaattgaaaata

SEQ ID NO: 106287 - DNA, 25 bp, Homo sapien
aatatcagacatgttttggaaaagt

SEQ ID NO: 106288 - DNA, 25 bp, Homo sapien
aggaaactaccccagaatctaatgt

SEQ ID NO: 106289 - DNA, 25 bp, Homo sapien
cccagaatctaatgtagttcgctat

SEQ ID NO: 106290 - DNA, 25 bp, Homo sapien
gtagttcgctattaataacaatgca

SEQ ID NO: 106291 - DNA, 25 bp, Homo sapien
atattgcaaatacatgtttcctcat

SEQ ID NO: 106292 - DNA, 25 bp, Homo sapien
acatgtttcctcatgaaatctaagt

SEQ ID NO: 106293 - DNA, 25 bp, Homo sapien
aatagtgtcactgttacatttcccc

SEQ ID NO: 106294 - DNA, 25 bp, Homo sapien
ttacatttcccccaagaagttcaat

SEQ ID NO: 106295 - DNA, 25 bp, Homo sapien
gagagttctcggagccatttgtaca

SEQ ID NO: 106296 - DNA, 25 bp, Homo sapien
ggagccatttgtacatttcatcact

SEQ ID NO: 106297 - DNA, 25 bp, Homo sapien
acatttcatcactcagtgtatgcga

SEQ ID NO: 106298 - DNA, 25 bp, Homo sapien
cagtgtatgcgaaaacagccaaaag

SEQ ID NO: 106299 - DNA, 25 bp, Homo sapien
aagaaaggccagcacctgaagaatt

SEQ ID NO: 106300 - DNA, 25 bp, Homo sapien
cctgaagaattgatgggccacccgt

SEQ ID NO: 106301 - DNA, 25 bp, Homo sapien
gaattgatgggccacccgttcatcg

SEQ ID NO: 106302 - DNA, 25 bp, Homo sapien
acccgttcatcgtgcagttcaatga

SEQ ID NO: 106303 - DNA, 25 bp, Homo sapien
agttcaatgatggaaatgccgccgt

SEQ ID NO: 106304 - DNA, 25 bp, Homo sapien
aaatgccgccgtggtgtccatgtgg

SEQ ID NO: 106305 - DNA, 25 bp, Homo sapien
gtccatgtgggtgtgccgggcgctg

SEQ ID NO: 106306 - DNA, 25 bp, Homo sapien
gcctccacttggagggctaccacgg

SEQ ID NO: 106307 - DNA, 25 bp, Homo sapien
cttggagggctaccacggcaccgca

SEQ ID NO: 106308 - DNA, 25 bp, Homo sapien
gggactccatgagctaccacagcgg

SEQ ID NO: 106309 - DNA, 25 bp, Homo sapien
tgagctaccacagcggcagtgtctt

SEQ ID NO: 106310 - DNA, 25 bp, Homo sapien
agtgtcttctctgcccgtgatcggg

SEQ ID NO: 106311 - DNA, 25 bp, Homo sapien
aacagcttgctcatctcctgcgctg

SEQ ID NO: 106312 - DNA, 25 bp, Homo sapien
gcctggtggtacaggaactgccact

SEQ ID NO: 106313 - DNA, 25 bp, Homo sapien
ggtacaggaactgccactacgccaa

SEQ ID NO: 106314 - DNA, 25 bp, Homo sapien
acctcaacgggctctacgggagcac

SEQ ID NO: 106315 - DNA, 25 bp, Homo sapien
gctctacgggagcacagtggaccat

SEQ ID NO: 106316 - DNA, 25 bp, Homo sapien
cacagtggaccatcagggagtgagc

SEQ ID NO: 106317 - DNA, 25 bp, Homo sapien
aatccatgccttccctattcattct

SEQ ID NO: 106318 - DNA, 25 bp, Homo sapien
catgccttccctattcattctctgt

SEQ ID NO: 106319 - DNA, 25 bp, Homo sapien
atgccttccctattcattctctgtc

SEQ ID NO: 106320 - DNA, 25 bp, Homo sapien
tgccttccctattcattctctgtcc

SEQ ID NO: 106321 - DNA, 25 bp, Homo sapien
gccttccctattcattctctgtcca

SEQ ID NO: 106322 - DNA, 25 bp, Homo sapien
tattaatgatacatcaagtagtgga

SEQ ID NO: 106323 - DNA, 25 bp, Homo sapien
attaatgatacatcaagtagtggaa

SEQ ID NO: 106324 - DNA, 25 bp, Homo sapien
taatgatacatcaagtagtggaagt

SEQ ID NO: 106325 - DNA, 25 bp, Homo sapien
aatgatacatcaagtagtggaagtg

SEQ ID NO: 106326 - DNA, 25 bp, Homo sapien
atgatacatcaagtagtggaagtgt

SEQ ID NO: 106327 - DNA, 25 bp, Homo sapien
tgatacatcaagtagtggaagtgtt

SEQ ID NO: 106328 - DNA, 25 bp, Homo sapien
ggacatcctcctcacatgaatgtca

SEQ ID NO: 106329 - DNA, 25 bp, Homo sapien
tcctcacatgaatgtcaacccacaa

SEQ ID NO: 106330 - DNA, 25 bp, Homo sapien
tgaatgtcaacccacaacaaccagc

SEQ ID NO: 106331 - DNA, 25 bp, Homo sapien
aacccacaacaaccagcataagcaa

SEQ ID NO: 106332 - DNA, 25 bp, Homo sapien
tgagttctgattcacccacgaaggt

SEQ ID NO: 106333 - DNA, 25 bp, Homo sapien
acccacgaaggttacatttatgctg

SEQ ID NO: 106334 - DNA, 25 bp, Homo sapien
ggttacatttatgctgaatacattt

SEQ ID NO: 106335 - DNA, 25 bp, Homo sapien
tactgtatgtatatgattgctactc

SEQ ID NO: 106336 - DNA, 25 bp, Homo sapien
gattgctactctaaaggtttggata

SEQ ID NO: 106337 - DNA, 25 bp, Homo sapien
gaattgttggcatgatgacatttca

SEQ ID NO: 106338 - DNA, 25 bp, Homo sapien
tgccttttttggaaggactaacaga

SEQ ID NO: 106339 - DNA, 25 bp, Homo sapien
gaatgtcaaaagtaccttctgtcca

SEQ ID NO: 106340 - DNA, 25 bp, Homo sapien
tgtcaaaagtaccttctgtccacac

SEQ ID NO: 106341 - DNA, 25 bp, Homo sapien
aaaagtaccttctgtccacacacac

SEQ ID NO: 106342 - DNA, 25 bp, Homo sapien
aatctgcatgtattggttggtggtc

SEQ ID NO: 106343 - DNA, 25 bp, Homo sapien
catgtattggttggtggtcctgtcc

SEQ ID NO: 106344 - DNA, 25 bp, Homo sapien
tattggttggtggtcctgtccccta

SEQ ID NO: 106345 - DNA, 25 bp, Homo sapien
tggttggtggtcctgtcccctaaag

SEQ ID NO: 106346 - DNA, 25 bp, Homo sapien
tggtggtcctgtcccctaaagatca

SEQ ID NO: 106347 - DNA, 25 bp, Homo sapien
gtcctgtcccctaaagatcaagcta

SEQ ID NO: 106348 - DNA, 25 bp, Homo sapien
gtcccctaaagatcaagctacacat

SEQ ID NO: 106349 - DNA, 25 bp, Homo sapien
agatcaagctacacatcagttttac

SEQ ID NO: 106350 - DNA, 25 bp, Homo sapien
ctgtgcacgtggttgtcgctgagac

SEQ ID NO: 106351 - DNA, 25 bp, Homo sapien
tcgctgagaccgactaccagagttt

SEQ ID NO: 106352 - DNA, 25 bp, Homo sapien
actaccagagtttcgctgtcctgta

SEQ ID NO: 106353 - DNA, 25 bp, Homo sapien
agtttcgctgtcctgtacctggagc

SEQ ID NO: 106354 - DNA, 25 bp, Homo sapien
ggcagctgtcagtgaagctctacgc

SEQ ID NO: 106355 - DNA, 25 bp, Homo sapien
tccctgtgagcgactcggtcctgag

SEQ ID NO: 106356 - DNA, 25 bp, Homo sapien
actcggtcctgagtgggtttgagca

SEQ ID NO: 106357 - DNA, 25 bp, Homo sapien
aggaggcccacctgactgaggacca

SEQ ID NO: 106358 - DNA, 25 bp, Homo sapien
gactgaggaccagatcttctacttc

SEQ ID NO: 106359 - DNA, 25 bp, Homo sapien
caagtacggcttctgcgaggctgca

SEQ ID NO: 106360 - DNA, 25 bp, Homo sapien
agaccagttccacgtcctggacgaa

SEQ ID NO: 106361 - DNA, 25 bp, Homo sapien
ctgttgagggcagggagtcggcaga

SEQ ID NO: 106362 - DNA, 25 bp, Homo sapien
agggcagggagtcggcagagagaga

SEQ ID NO: 106363 - DNA, 25 bp, Homo sapien
ggcttcatacctgggtgatgagatg

SEQ ID NO: 106364 - DNA, 25 bp, Homo sapien
cttcatacctgggtgatgagatgat

SEQ ID NO: 106365 - DNA, 25 bp, Homo sapien
tcatacctgggtgatgagatgatct

SEQ ID NO: 106366 - DNA, 25 bp, Homo sapien
catacctgggtgatgagatgatctg

SEQ ID NO: 106367 - DNA, 25 bp, Homo sapien
aacagggagactatagtcaacagca

SEQ ID NO: 106368 - DNA, 25 bp, Homo sapien
cagggagactatagtcaacagcaat

SEQ ID NO: 106369 - DNA, 25 bp, Homo sapien
gggagactatagtcaacagcaattt

SEQ ID NO: 106370 - DNA, 25 bp, Homo sapien
gagactatagtcaacagcaatttaa

SEQ ID NO: 106371 - DNA, 25 bp, Homo sapien
ctatagtcaacagcaatttaattgt

SEQ ID NO: 106372 - DNA, 25 bp, Homo sapien
agctagaatgctgcctatattttaa

SEQ ID NO: 106373 - DNA, 25 bp, Homo sapien
ggatttggatctcacaagacacctt

SEQ ID NO: 106374 - DNA, 25 bp, Homo sapien
ggatctcacaagacaccttaggcct

SEQ ID NO: 106375 - DNA, 25 bp, Homo sapien
gttgttcagattctttgccccagtt

SEQ ID NO: 106376 - DNA, 25 bp, Homo sapien
ctttgccccagttctaatctagtga

SEQ ID NO: 106377 - DNA, 25 bp, Homo sapien
gttctaatctagtgacaaaggcata

SEQ ID NO: 106378 - DNA, 25 bp, Homo sapien
aaaggcatagaattctcctcccaca

SEQ ID NO: 106379 - DNA, 25 bp, Homo sapien
tttcaaggtgttaattagttccagt

SEQ ID NO: 106380 - DNA, 25 bp, Homo sapien
ttttgtcgttttccccatgtccgat

SEQ ID NO: 106381 - DNA, 25 bp, Homo sapien
ttccccatgtccgatgcttatattg

SEQ ID NO: 106382 - DNA, 25 bp, Homo sapien
ccgatgcttatattggatgatttct

SEQ ID NO: 106383 - DNA, 25 bp, Homo sapien
tcctctgagatgaagcaacctatcc

SEQ ID NO: 106384 - DNA, 25 bp, Homo sapien
gaagcaacctatccagttctatgga

SEQ ID NO: 106385 - DNA, 25 bp, Homo sapien
atctttcagaaagaccatcattggg

SEQ ID NO: 106386 - DNA, 25 bp, Homo sapien
accatcattgggtagggcaaactga

SEQ ID NO: 106387 - DNA, 25 bp, Homo sapien
aggagagacaccctatctgtgcggc

SEQ ID NO: 106388 - DNA, 25 bp, Homo sapien
acaccctatctgtgcggccagtgtg

SEQ ID NO: 106389 - DNA, 25 bp, Homo sapien
aaagcttcacccagagagggagtct

SEQ ID NO: 106390 - DNA, 25 bp, Homo sapien
tggctgtgcaccagcgaagctgctc

SEQ ID NO: 106391 - DNA, 25 bp, Homo sapien
accagcgaagctgctcacagaggct

SEQ ID NO: 106392 - DNA, 25 bp, Homo sapien
tgctcacagaggctcaccctttgac

SEQ ID NO: 106393 - DNA, 25 bp, Homo sapien
ccctttgaccactttcctgaagaga

SEQ ID NO: 106394 - DNA, 25 bp, Homo sapien
tttaaagggactcaaggtgcctgcc

SEQ ID NO: 106395 - DNA, 25 bp, Homo sapien
tgcctgccacttcctcagcgaagaa

SEQ ID NO: 106396 - DNA, 25 bp, Homo sapien
cctcagcgaagaagtctgtgttcct

SEQ ID NO: 106397 - DNA, 25 bp, Homo sapien
cagtggcgatcatcccttcacaatc

SEQ ID NO: 106398 - DNA, 25 bp, Homo sapien
ttcacaatcccagagtggcaggcgg

SEQ ID NO: 106399 - DNA, 25 bp, Homo sapien
gcaggcgggaccagccccatggtct

SEQ ID NO: 106400 - DNA, 25 bp, Homo sapien
tgtcacctgggtccgtgccagcaca

SEQ ID NO: 106401 - DNA, 25 bp, Homo sapien
gtgccagcacaatctgccaaagttc

SEQ ID NO: 106402 - DNA, 25 bp, Homo sapien
gccaaagttctagagaccctgttcc

SEQ ID NO: 106403 - DNA, 25 bp, Homo sapien
acctcacatgcttcttctgtgtgta

SEQ ID NO: 106404 - DNA, 25 bp, Homo sapien
gagcaatttaaactcccagttgttt

SEQ ID NO: 106405 - DNA, 25 bp, Homo sapien
gcagtatatccgcttagcccagcct

SEQ ID NO: 106406 - DNA, 25 bp, Homo sapien
agtatatccgcttagcccagcctgt

SEQ ID NO: 106407 - DNA, 25 bp, Homo sapien
tatatccgcttagcccagcctgtat

SEQ ID NO: 106408 - DNA, 25 bp, Homo sapien
tccgcttagcccagcctgtatcagg

SEQ ID NO: 106409 - DNA, 25 bp, Homo sapien
gcctgtatcaggcactcaagttgtg

SEQ ID NO: 106410 - DNA, 25 bp, Homo sapien
ctgtatcaggcactcaagttgtgca

SEQ ID NO: 106411 - DNA, 25 bp, Homo sapien
gtatcaggcactcaagttgtgcagg

SEQ ID NO: 106412 - DNA, 25 bp, Homo sapien
atcaggcactcaagttgtgcaggga

SEQ ID NO: 106413 - DNA, 25 bp, Homo sapien
caggcactcaagttgtgcagggaca

SEQ ID NO: 106414 - DNA, 25 bp, Homo sapien
actcaagttgtgcagggacagatcc

SEQ ID NO: 106415 - DNA, 25 bp, Homo sapien
tcaagttgtgcagggacagatccag

SEQ ID NO: 106416 - DNA, 25 bp, Homo sapien
aggatcgcgagggaagccaagggag

SEQ ID NO: 106417 - DNA, 25 bp, Homo sapien
ggctctgggaagaggctgacgttat

SEQ ID NO: 106418 - DNA, 25 bp, Homo sapien
tgacgttatggtggcttcagcttca

SEQ ID NO: 106419 - DNA, 25 bp, Homo sapien
tggtggcttcagcttcactaggaat

SEQ ID NO: 106420 - DNA, 25 bp, Homo sapien
gtggcttcagcttcactaggaatgg

SEQ ID NO: 106421 - DNA, 25 bp, Homo sapien
ggcttcagcttcactaggaatggga

SEQ ID NO: 106422 - DNA, 25 bp, Homo sapien
tcagcttcactaggaatgggacaca

SEQ ID NO: 106423 - DNA, 25 bp, Homo sapien
ttcactaggaatgggacacagggtc

SEQ ID NO: 106424 - DNA, 25 bp, Homo sapien
ctgggtgggtcaggtagggcacagg

SEQ ID NO: 106425 - DNA, 25 bp, Homo sapien
agcagacctcagagcgctgcccaga

SEQ ID NO: 106426 - DNA, 25 bp, Homo sapien
acctcagagcgctgcccagatggaa

SEQ ID NO: 106427 - DNA, 25 bp, Homo sapien
ccagcggttctcaaacggtacacag

SEQ ID NO: 106428 - DNA, 25 bp, Homo sapien
aacggtacacagactattgacatca

SEQ ID NO: 106429 - DNA, 25 bp, Homo sapien
gactattgacatcagcatcacctag

SEQ ID NO: 106430 - DNA, 25 bp, Homo sapien
aatgcaaattctcaagccgcatccc

SEQ ID NO: 106431 - DNA, 25 bp, Homo sapien
gcatcccagacttgctgaatcggaa

SEQ ID NO: 106432 - DNA, 25 bp, Homo sapien
ggttgggacccagcaagggcactta

SEQ ID NO: 106433 - DNA, 25 bp, Homo sapien
gggacccagcaagggcacttaacaa

SEQ ID NO: 106434 - DNA, 25 bp, Homo sapien
ccccgtttctgattaatgctaaatg

SEQ ID NO: 106435 - DNA, 25 bp, Homo sapien
gttctatttctatcccaaactaagc

SEQ ID NO: 106436 - DNA, 25 bp, Homo sapien
tctatcccaaactaagctatgtgaa

SEQ ID NO: 106437 - DNA, 25 bp, Homo sapien
gaatatttgtcgatatttccatcat

SEQ ID NO: 106438 - DNA, 25 bp, Homo sapien
gcatgcccttctccgagttggcagg

SEQ ID NO: 106439 - DNA, 25 bp, Homo sapien
tggtggtccgctgcattcagcgcct

SEQ ID NO: 106440 - DNA, 25 bp, Homo sapien
tgcattcagcgcctggctgagatgt

SEQ ID NO: 106441 - DNA, 25 bp, Homo sapien
tggctgagatgtgtcgctcactgcg

SEQ ID NO: 106442 - DNA, 25 bp, Homo sapien
cagcccgcctggtaggagagcctgt

SEQ ID NO: 106443 - DNA, 25 bp, Homo sapien
aagatggagacagcggctaccttgc

SEQ ID NO: 106444 - DNA, 25 bp, Homo sapien
ggctaccttgctacggcgggacatc

SEQ ID NO: 106445 - DNA, 25 bp, Homo sapien
gcgggacatcgtatttgcggccagc

SEQ ID NO: 106446 - DNA, 25 bp, Homo sapien
gacatcgtatttgcggccagcctct

SEQ ID NO: 106447 - DNA, 25 bp, Homo sapien
tacacccagtgaatgccccatgtaa

SEQ ID NO: 106448 - DNA, 25 bp, Homo sapien
cagtgaatgccccatgtaaaaacat

SEQ ID NO: 106449 - DNA, 25 bp, Homo sapien
tggaccgacctagatttgaacgtgt

SEQ ID NO: 106450 - DNA, 25 bp, Homo sapien
gatttgaacgtgttcttggcccatg

SEQ ID NO: 106451 - DNA, 25 bp, Homo sapien
gtgttcttggcccatgctcagacat

SEQ ID NO: 106452 - DNA, 25 bp, Homo sapien
tctgtctgaaatctgcctcctgtgc

SEQ ID NO: 106453 - DNA, 25 bp, Homo sapien
aatccatgcttcactcatgcaaact

SEQ ID NO: 106454 - DNA, 25 bp, Homo sapien
gcttcactcatgcaaactgctttat

SEQ ID NO: 106455 - DNA, 25 bp, Homo sapien
ttattttccctacttgcagcgccaa

SEQ ID NO: 106456 - DNA, 25 bp, Homo sapien
tgcagcgccaagtggccactggcat

SEQ ID NO: 106457 - DNA, 25 bp, Homo sapien
ggcatcgcagcttcctgtctgttta

SEQ ID NO: 106458 - DNA, 25 bp, Homo sapien
attgcaccattttcaatttggagca

SEQ ID NO: 106459 - DNA, 25 bp, Homo sapien
ctaaatgctcatacacagttaaata

SEQ ID NO: 106460 - DNA, 25 bp, Homo sapien
gagcgctgcgggaagacactgaccc

SEQ ID NO: 106461 - DNA, 25 bp, Homo sapien
acaagccctgctatggaatcctctt

SEQ ID NO: 106462 - DNA, 25 bp, Homo sapien
atcctcttcggacccaagggagtga

SEQ ID NO: 106463 - DNA, 25 bp, Homo sapien
gacccaagggagtgaacaccggtgc

SEQ ID NO: 106464 - DNA, 25 bp, Homo sapien
aacaccggtgcggtgggcagctaca

SEQ ID NO: 106465 - DNA, 25 bp, Homo sapien
gggcagctacatctatgaccgggac

SEQ ID NO: 106466 - DNA, 25 bp, Homo sapien
tctatgaccgggaccccgaaggcaa

SEQ ID NO: 106467 - DNA, 25 bp, Homo sapien
gaaggcaaggtccagccctaggcta

SEQ ID NO: 106468 - DNA, 25 bp, Homo sapien
tacagcggctctcatgatgtgggct

SEQ ID NO: 106469 - DNA, 25 bp, Homo sapien
atgatgtgggctcacctgcgcccca

SEQ ID NO: 106470 - DNA, 25 bp, Homo sapien
gggagagtgctagccgcccagtcct

SEQ ID NO: 106471 - DNA, 25 bp, Homo sapien
taggagaggattccggacgtaacct

SEQ ID NO: 106472 - DNA, 25 bp, Homo sapien
aggattccggacgtaacctgagcgc

SEQ ID NO: 106473 - DNA, 25 bp, Homo sapien
gttaccttgaacttgagggacctgt

SEQ ID NO: 106474 - DNA, 25 bp, Homo sapien
ttgagggacctgttctccaccttca

SEQ ID NO: 106475 - DNA, 25 bp, Homo sapien
gcagcctccaggctcaagtggacaa

SEQ ID NO: 106476 - DNA, 25 bp, Homo sapien
aagtggacaacaaacacaggcccca

SEQ ID NO: 106477 - DNA, 25 bp, Homo sapien
tggacccggccaacatcacgctgga

SEQ ID NO: 106478 - DNA, 25 bp, Homo sapien
acatcacgctggaacccatggaaat

SEQ ID NO: 106479 - DNA, 25 bp, Homo sapien
atggaaatccgcactttcctggcct

SEQ ID NO: 106480 - DNA, 25 bp, Homo sapien
cctggcctcagttcaatggaaggag

SEQ ID NO: 106481 - DNA, 25 bp, Homo sapien
aggtctgctgggatgggccctccaa

SEQ ID NO: 106482 - DNA, 25 bp, Homo sapien
gaaattagtgcctgttttcttgcaa

SEQ ID NO: 106483 - DNA, 25 bp, Homo sapien
gtgcctgttttcttgcaaatttagc

SEQ ID NO: 106484 - DNA, 25 bp, Homo sapien
ttgcaaatttagcacttggaacatt

SEQ ID NO: 106485 - DNA, 25 bp, Homo sapien
atttagcacttggaacatttaaaga

SEQ ID NO: 106486 - DNA, 25 bp, Homo sapien
aagaaaggtctatgctgtcatatgg

SEQ ID NO: 106487 - DNA, 25 bp, Homo sapien
tttattgggaactatcctcctggcc

SEQ ID NO: 106488 - DNA, 25 bp, Homo sapien
attgggaactatcctcctggcccca

SEQ ID NO: 106489 - DNA, 25 bp, Homo sapien
gaatgaggaacctgtattcctcttc

SEQ ID NO: 106490 - DNA, 25 bp, Homo sapien
attcctcttcttcgtgataatataa

SEQ ID NO: 106491 - DNA, 25 bp, Homo sapien
tgagcttcccttggacactaactct

SEQ ID NO: 106492 - DNA, 25 bp, Homo sapien
taactcttcccagatgatgacaatg

SEQ ID NO: 106493 - DNA, 25 bp, Homo sapien
ttctccccacgttagcaaggacaat

SEQ ID NO: 106494 - DNA, 25 bp, Homo sapien
gcaaggacaatgcttctctgccatt

SEQ ID NO: 106495 - DNA, 25 bp, Homo sapien
gacaatgcttctctgccattattac

SEQ ID NO: 106496 - DNA, 25 bp, Homo sapien
ctctgccattattacaactagttag

SEQ ID NO: 106497 - DNA, 25 bp, Homo sapien
aactagttagtttgcatggagaatc

SEQ ID NO: 106498 - DNA, 25 bp, Homo sapien
gaagtcattcttgcttagaatcata

SEQ ID NO: 106499 - DNA, 25 bp, Homo sapien
gaaacatcatgcaatcttttagtca

SEQ ID NO: 106500 - DNA, 25 bp, Homo sapien
cttttagtcagatgtgcgcttcacc

SEQ ID NO: 106501 - DNA, 25 bp, Homo sapien
agatgtgcgcttcaccttatgctat

SEQ ID NO: 106502 - DNA, 25 bp, Homo sapien
atttttatctttaattgacacacaa

SEQ ID NO: 106503 - DNA, 25 bp, Homo sapien
ttatggagtatagtgtggtgttttc

SEQ ID NO: 106504 - DNA, 25 bp, Homo sapien
aatgcatatctttgctccactttca

SEQ ID NO: 106505 - DNA, 25 bp, Homo sapien
gccaggctggagcaaggtacctttt

SEQ ID NO: 106506 - DNA, 25 bp, Homo sapien
gtaccttttcttaggatcttgggag

SEQ ID NO: 106507 - DNA, 25 bp, Homo sapien
tgggagggaatggatgcccctctct

SEQ ID NO: 106508 - DNA, 25 bp, Homo sapien
ctctgcatgatcttgttgaggcatt

SEQ ID NO: 106509 - DNA, 25 bp, Homo sapien
tgaggcatttagctgccatgcacct

SEQ ID NO: 106510 - DNA, 25 bp, Homo sapien
agccatctcaagaggcatcttctac

SEQ ID NO: 106511 - DNA, 25 bp, Homo sapien
aagaggcatcttctacatgttttgt

SEQ ID NO: 106512 - DNA, 25 bp, Homo sapien
gaaaagccgatatttgccattcttc

SEQ ID NO: 106513 - DNA, 25 bp, Homo sapien
tgccattcttcctatatcctggaat

SEQ ID NO: 106514 - DNA, 25 bp, Homo sapien
atcctggaatatatcttgcatcctg

SEQ ID NO: 106515 - DNA, 25 bp, Homo sapien
tccttcccaacctctcttgcaaaaa

SEQ ID NO: 106516 - DNA, 25 bp, Homo sapien
gaaatgggtttctgctaatgaattg

SEQ ID NO: 106517 - DNA, 25 bp, Homo sapien
gatgtgtattaatgttagttcaacc

SEQ ID NO: 106518 - DNA, 25 bp, Homo sapien
caaccatatatttatactgtctggg

SEQ ID NO: 106519 - DNA, 25 bp, Homo sapien
tgtggttatagttctgtgggagaaa

SEQ ID NO: 106520 - DNA, 25 bp, Homo sapien
ataattttgtcagtgttcaccagct

SEQ ID NO: 106521 - DNA, 25 bp, Homo sapien
gtcagtgttcaccagcttgtaaaaa

SEQ ID NO: 106522 - DNA, 25 bp, Homo sapien
gtgttcaccagcttgtaaaaactta

SEQ ID NO: 106523 - DNA, 25 bp, Homo sapien
accagcttgtaaaaacttagtgcga

SEQ ID NO: 106524 - DNA, 25 bp, Homo sapien
acttagtgcgagagctgaaacatct

SEQ ID NO: 106525 - DNA, 25 bp, Homo sapien
gtgcgagagctgaaacatctaaata

SEQ ID NO: 106526 - DNA, 25 bp, Homo sapien
agcactccggtcagtgccggaaagt

SEQ ID NO: 106527 - DNA, 25 bp, Homo sapien
ggtcagtgccggaaagtcttttggt

SEQ ID NO: 106528 - DNA, 25 bp, Homo sapien
ccggaaagtcttttggtggctgagt

SEQ ID NO: 106529 - DNA, 25 bp, Homo sapien
agtggtgcctctgtcaacctagcaa

SEQ ID NO: 106530 - DNA, 25 bp, Homo sapien
gtgcctctgtcaacctagcaagaga

SEQ ID NO: 106531 - DNA, 25 bp, Homo sapien
ctagcaagagattaagccaagcatg

SEQ ID NO: 106532 - DNA, 25 bp, Homo sapien
agctagttggtggagttaggacctt

SEQ ID NO: 106533 - DNA, 25 bp, Homo sapien
gagttaggaccttggtggagttatt

SEQ ID NO: 106534 - DNA, 25 bp, Homo sapien
atctttctaagcctctgattccttg

SEQ ID NO: 106535 - DNA, 25 bp, Homo sapien
gaatcctaaaacaggcatcccttgg

SEQ ID NO: 106536 - DNA, 25 bp, Homo sapien
attgcaggttcagttgaaggcaaca

SEQ ID NO: 106537 - DNA, 25 bp, Homo sapien
acttttgatccccactttctgaggg

SEQ ID NO: 106538 - DNA, 25 bp, Homo sapien
actttctgagggtgccctgctggaa

SEQ ID NO: 106539 - DNA, 25 bp, Homo sapien
gtgccctgctggaagataaccctgt

SEQ ID NO: 106540 - DNA, 25 bp, Homo sapien
gataaccctgtttgtaattgtgccg

SEQ ID NO: 106541 - DNA, 25 bp, Homo sapien
taattgtgccggttcttggaccctt

SEQ ID NO: 106542 - DNA, 25 bp, Homo sapien
ttggacccttggttgccttgatcat

SEQ ID NO: 106543 - DNA, 25 bp, Homo sapien
ttggttgccttgatcatctgctaca

SEQ ID NO: 106544 - DNA, 25 bp, Homo sapien
atctgctacaactggctacatcgaa

SEQ ID NO: 106545 - DNA, 25 bp, Homo sapien
gctacaactggctacatcgaagact

SEQ ID NO: 106546 - DNA, 25 bp, Homo sapien
tacatcgaagactagcagggcaatt

SEQ ID NO: 106547 - DNA, 25 bp, Homo sapien
cgaagactagcagggcaattccttg

SEQ ID NO: 106548 - DNA, 25 bp, Homo sapien
tctttgagcaacagccacgctggct

SEQ ID NO: 106549 - DNA, 25 bp, Homo sapien
tgctctaccacgaacttgtcttgac

SEQ ID NO: 106550 - DNA, 25 bp, Homo sapien
cgaacttgtcttgaccaccaaagag

SEQ ID NO: 106551 - DNA, 25 bp, Homo sapien
aagagttcatgagacaggtactgga

SEQ ID NO: 106552 - DNA, 25 bp, Homo sapien
tggagattgagagcagttggcttct

SEQ ID NO: 106553 - DNA, 25 bp, Homo sapien
gaggtggctccccattattataagg

SEQ ID NO: 106554 - DNA, 25 bp, Homo sapien
ggctccccattattataaggccaag

SEQ ID NO: 106555 - DNA, 25 bp, Homo sapien
aggagctagaagatccccatgctaa

SEQ ID NO: 106556 - DNA, 25 bp, Homo sapien
gatccccatgctaagaaaatgccca

SEQ ID NO: 106557 - DNA, 25 bp, Homo sapien
gcaaaacacgagaagagctagggta

SEQ ID NO: 106558 - DNA, 25 bp, Homo sapien
gctccttttccttctatacattatt

SEQ ID NO: 106559 - DNA, 25 bp, Homo sapien
ggtagtagtttttctgtaacacaga

SEQ ID NO: 106560 - DNA, 25 bp, Homo sapien
agtaccttgactttgttcacagcat

SEQ ID NO: 106561 - DNA, 25 bp, Homo sapien
tgactttgttcacagcatgtagggt

SEQ ID NO: 106562 - DNA, 25 bp, Homo sapien
gcatgtagggtgatgagcactcaca

SEQ ID NO: 106563 - DNA, 25 bp, Homo sapien
gagcactcacaattgttgactaaaa

SEQ ID NO: 106564 - DNA, 25 bp, Homo sapien
aatggttgagtgcaaatccatagca

SEQ ID NO: 106565 - DNA, 25 bp, Homo sapien
tgcaaatccatagcacaagataaat

SEQ ID NO: 106566 - DNA, 25 bp, Homo sapien
aattgagctagttaaggcaaatcag

SEQ ID NO: 106567 - DNA, 25 bp, Homo sapien
aaggcaaatcaggtaaaatagtcat

SEQ ID NO: 106568 - DNA, 25 bp, Homo sapien
aatagtcatgattctatgtaatgta

SEQ ID NO: 106569 - DNA, 25 bp, Homo sapien
aatgttcatgatttcaagatgttat

SEQ ID NO: 106570 - DNA, 25 bp, Homo sapien
ctctgacgctgacatgtagtaaaag

SEQ ID NO: 106571 - DNA, 25 bp, Homo sapien
gaagagtgcatgtgcgtttagcata

SEQ ID NO: 106572 - DNA, 25 bp, Homo sapien
gggcagctttcagtcagtgcagcaa

SEQ ID NO: 106573 - DNA, 25 bp, Homo sapien
tttcagtcagtgcagcaagggcatg

SEQ ID NO: 106574 - DNA, 25 bp, Homo sapien
caagggcatgtagttgttcagagat

SEQ ID NO: 106575 - DNA, 25 bp, Homo sapien
gagatggtgctggaacgactgattt

SEQ ID NO: 106576 - DNA, 25 bp, Homo sapien
tgctggaacgactgatttggagaaa

SEQ ID NO: 106577 - DNA, 25 bp, Homo sapien
ccttcttcacaccatctgctaaaat

SEQ ID NO: 106578 - DNA, 25 bp, Homo sapien
aaaataaacctcagatgggctcaag

SEQ ID NO: 106579 - DNA, 25 bp, Homo sapien
cctcagatgggctcaagagttaaat

SEQ ID NO: 106580 - DNA, 25 bp, Homo sapien
aaccaagttcataatgaagctgtca

SEQ ID NO: 106581 - DNA, 25 bp, Homo sapien
attcaaattttatctccagatggaa

SEQ ID NO: 106582 - DNA, 25 bp, Homo sapien
aacctccacatgttcacctattaat

SEQ ID NO: 106583 - DNA, 25 bp, Homo sapien
aatggatcatcaggcctgttttaga

SEQ ID NO: 106584 - DNA, 25 bp, Homo sapien
ggcctgttttagatatcccttactc

SEQ ID NO: 106585 - DNA, 25 bp, Homo sapien
gatatcccttactccagagggcctt

SEQ ID NO: 106586 - DNA, 25 bp, Homo sapien
agggccttccctgacttacaagtgg

SEQ ID NO: 106587 - DNA, 25 bp, Homo sapien
aagcagtctcttcctggtctgaact

SEQ ID NO: 106588 - DNA, 25 bp, Homo sapien
cgccacattttagccgtactttgct

SEQ ID NO: 106589 - DNA, 25 bp, Homo sapien
cttcattgcagttatttagatcccc

SEQ ID NO: 106590 - DNA, 25 bp, Homo sapien
ctaatttttcagctccttcaatgca

SEQ ID NO: 106591 - DNA, 25 bp, Homo sapien
tttcagctccttcaatgcaaagtac

SEQ ID NO: 106592 - DNA, 25 bp, Homo sapien
tcatggccctcggaggtccagctgg

SEQ ID NO: 106593 - DNA, 25 bp, Homo sapien
tgcctccgggcagcaaggtttacac

SEQ ID NO: 106594 - DNA, 25 bp, Homo sapien
gcaaggtttacactgcggaacgcaa

SEQ ID NO: 106595 - DNA, 25 bp, Homo sapien
aacgcaaaggcagctaagatagaaa

SEQ ID NO: 106596 - DNA, 25 bp, Homo sapien
taagatagaaagctggactgaccaa

SEQ ID NO: 106597 - DNA, 25 bp, Homo sapien
aaagctggactgaccaaagactgca

SEQ ID NO: 106598 - DNA, 25 bp, Homo sapien
ttcccagaccaggaaaggcttggct

SEQ ID NO: 106599 - DNA, 25 bp, Homo sapien
gggcccgaacaggacttgttagaga

SEQ ID NO: 106600 - DNA, 25 bp, Homo sapien
acttgttagagagcctgtcaccaga

SEQ ID NO: 106601 - DNA, 25 bp, Homo sapien
tagagagcctgtcaccagagcttct

SEQ ID NO: 106602 - DNA, 25 bp, Homo sapien
cagagcttctctgggctgaatgtat

SEQ ID NO: 106603 - DNA, 25 bp, Homo sapien
ggatgcagaacatgagtattcatac

SEQ ID NO: 106604 - DNA, 25 bp, Homo sapien
gtattcatacgaagaccaccagcgg

SEQ ID NO: 106605 - DNA, 25 bp, Homo sapien
tcatacgaagaccaccagcggctat

SEQ ID NO: 106606 - DNA, 25 bp, Homo sapien
atgcaggtggtctgagctcggccta

SEQ ID NO: 106607 - DNA, 25 bp, Homo sapien
gttgtgaagaagatcgagacacgtg

SEQ ID NO: 106608 - DNA, 25 bp, Homo sapien
aagaagatcgagacacgtgatggga

SEQ ID NO: 106609 - DNA, 25 bp, Homo sapien
agatcgagacacgtgatgggaagct

SEQ ID NO: 106610 - DNA, 25 bp, Homo sapien
gaagctggtgtctgagtcctctgac

SEQ ID NO: 106611 - DNA, 25 bp, Homo sapien
gcccaagtgaacagctgcggcagcc

SEQ ID NO: 106612 - DNA, 25 bp, Homo sapien
caagtgaacagctgcggcagcccct

SEQ ID NO: 106613 - DNA, 25 bp, Homo sapien
aagtgaacagctgcggcagcccctc

SEQ ID NO: 106614 - DNA, 25 bp, Homo sapien
tgattccctcgctggaatccaacct

SEQ ID NO: 106615 - DNA, 25 bp, Homo sapien
ctcgctggaatccaacctgttgata

SEQ ID NO: 106616 - DNA, 25 bp, Homo sapien
atccaacctgttgataagtgatggg

SEQ ID NO: 106617 - DNA, 25 bp, Homo sapien
gtttagaagtagcaaagagcaccca

SEQ ID NO: 106618 - DNA, 25 bp, Homo sapien
gtagcaaagagcacccacattcaaa

SEQ ID NO: 106619 - DNA, 25 bp, Homo sapien
gagcacccacattcaaaagtcacag

SEQ ID NO: 106620 - DNA, 25 bp, Homo sapien
gaactgaaacgtgaggtatctttga

SEQ ID NO: 106621 - DNA, 25 bp, Homo sapien
ggtatctttgatgtgtatggttggt

SEQ ID NO: 106622 - DNA, 25 bp, Homo sapien
attatatttttgttatctgggcaaa

SEQ ID NO: 106623 - DNA, 25 bp, Homo sapien
gttatctgggcaaagtagaagtcaa

SEQ ID NO: 106624 - DNA, 25 bp, Homo sapien
ttctgatttttgcacaagttttagt

SEQ ID NO: 106625 - DNA, 25 bp, Homo sapien
cccaaagatagacaggtcctgattt

SEQ ID NO: 106626 - DNA, 25 bp, Homo sapien
ggtcctgatttctagaacccgtgac

SEQ ID NO: 106627 - DNA, 25 bp, Homo sapien
gaacccgtgactgttactttataca

SEQ ID NO: 106628 - DNA, 25 bp, Homo sapien
gatgtgattaaagctaaggacctta

SEQ ID NO: 106629 - DNA, 25 bp, Homo sapien
ggaccttaagacagagtatcctggg

SEQ ID NO: 106630 - DNA, 25 bp, Homo sapien
gggggtcctaaatgtaatcacgagt

SEQ ID NO: 106631 - DNA, 25 bp, Homo sapien
gagcaaatcaattctagtcatatat

SEQ ID NO: 106632 - DNA, 25 bp, Homo sapien
ctagtcatatattaaacatccacaa

SEQ ID NO: 106633 - DNA, 25 bp, Homo sapien
agatatttttatcccaagaatgcaa

SEQ ID NO: 106634 - DNA, 25 bp, Homo sapien
ttatcccaagaatgcaagatttcag

SEQ ID NO: 106635 - DNA, 25 bp, Homo sapien
aaatctgttgataaatccatcacta

SEQ ID NO: 106636 - DNA, 25 bp, Homo sapien
gaacctttaaaggatgcaggcatgg

SEQ ID NO: 106637 - DNA, 25 bp, Homo sapien
gatgcaggcatggagcagctcaccc

SEQ ID NO: 106638 - DNA, 25 bp, Homo sapien
ggttgtggcaggcatcttcaccagc

SEQ ID NO: 106639 - DNA, 25 bp, Homo sapien
ttgtggcaggcatcttcaccagcag

SEQ ID NO: 106640 - DNA, 25 bp, Homo sapien
gtggcaggcatcttcaccagcagcc

SEQ ID NO: 106641 - DNA, 25 bp, Homo sapien
cctcaccccatcacagggatttttt

SEQ ID NO: 106642 - DNA, 25 bp, Homo sapien
ttttttctgcctttcctaatccact

SEQ ID NO: 106643 - DNA, 25 bp, Homo sapien
tttctgcctttcctaatccactcag

SEQ ID NO: 106644 - DNA, 25 bp, Homo sapien
actcagctctggctggaagtgctta

SEQ ID NO: 106645 - DNA, 25 bp, Homo sapien
tcagctctggctggaagtgcttaaa

SEQ ID NO: 106646 - DNA, 25 bp, Homo sapien
gctctggctggaagtgcttaaaata

SEQ ID NO: 106647 - DNA, 25 bp, Homo sapien
tttgctgtgaggctgtcctgtacat

SEQ ID NO: 106648 - DNA, 25 bp, Homo sapien
gtcctgtacattgtgggatgttcag

SEQ ID NO: 106649 - DNA, 25 bp, Homo sapien
ttgcctcaatgccagtaacgcgtct

SEQ ID NO: 106650 - DNA, 25 bp, Homo sapien
gcgtcttcctgagtggtgccaaaca

SEQ ID NO: 106651 - DNA, 25 bp, Homo sapien
aaaggttctcaggtgttgccaaata

SEQ ID NO: 106652 - DNA, 25 bp, Homo sapien
gtataaaactttcctcgcctgacaa

SEQ ID NO: 106653 - DNA, 25 bp, Homo sapien
caaccactggtctgtagggattttt

SEQ ID NO: 106654 - DNA, 25 bp, Homo sapien
gggatttttggctacacacaaacca

SEQ ID NO: 106655 - DNA, 25 bp, Homo sapien
cacacaaaccagtatcgctcataga

SEQ ID NO: 106656 - DNA, 25 bp, Homo sapien
atcgctcatagatcagcaaaccggg

SEQ ID NO: 106657 - DNA, 25 bp, Homo sapien
ggcctactagagtctgaacagctgt

SEQ ID NO: 106658 - DNA, 25 bp, Homo sapien
gggctcacatggttaacctctaact

SEQ ID NO: 106659 - DNA, 25 bp, Homo sapien
aatcttaatgagcattctccaccca

SEQ ID NO: 106660 - DNA, 25 bp, Homo sapien
aacccattcataggattatcgccac

SEQ ID NO: 106661 - DNA, 25 bp, Homo sapien
ttcataggattatcgccaccatcac

SEQ ID NO: 106662 - DNA, 25 bp, Homo sapien
catcacctctttcaattgccacttt

SEQ ID NO: 106663 - DNA, 25 bp, Homo sapien
caattgccactttctcttcttttga

SEQ ID NO: 106664 - DNA, 25 bp, Homo sapien
aatcctcatcttcgccaacaagcag

SEQ ID NO: 106665 - DNA, 25 bp, Homo sapien
aggacctgcccgatgccatgaaacc

SEQ ID NO: 106666 - DNA, 25 bp, Homo sapien
atgaaaccccacgagatccaggaga

SEQ ID NO: 106667 - DNA, 25 bp, Homo sapien
gcctgacccggattcgggacaggaa

SEQ ID NO: 106668 - DNA, 25 bp, Homo sapien
attcgggacaggaactggtatgtgc

SEQ ID NO: 106669 - DNA, 25 bp, Homo sapien
gcctctgctctcctgggagacaaag

SEQ ID NO: 106670 - DNA, 25 bp, Homo sapien
cctctgctctcctgggagacaaagc

SEQ ID NO: 106671 - DNA, 25 bp, Homo sapien
acggtgaaaccccttatctatgcgc

SEQ ID NO: 106672 - DNA, 25 bp, Homo sapien
cggtgaaaccccttatctatgcgcc

SEQ ID NO: 106673 - DNA, 25 bp, Homo sapien
ggtgaaaccccttatctatgcgcct

SEQ ID NO: 106674 - DNA, 25 bp, Homo sapien
gtgaaaccccttatctatgcgcctg

SEQ ID NO: 106675 - DNA, 25 bp, Homo sapien
tgaaaccccttatctatgcgcctgt

SEQ ID NO: 106676 - DNA, 25 bp, Homo sapien
gaaaccccttatctatgcgcctgta

SEQ ID NO: 106677 - DNA, 25 bp, Homo sapien
aaaccccttatctatgcgcctgtag

SEQ ID NO: 106678 - DNA, 25 bp, Homo sapien
aaccccttatctatgcgcctgtagt

SEQ ID NO: 106679 - DNA, 25 bp, Homo sapien
accccttatctatgcgcctgtagtc

SEQ ID NO: 106680 - DNA, 25 bp, Homo sapien
gttcaccttggtcgtcctgatgttt

SEQ ID NO: 106681 - DNA, 25 bp, Homo sapien
ggtcgtcctgatgttttacctcaga

SEQ ID NO: 106682 - DNA, 25 bp, Homo sapien
tgatgttttacctcagactccacct

SEQ ID NO: 106683 - DNA, 25 bp, Homo sapien
gactccacctttggaggaaatcagt

SEQ ID NO: 106684 - DNA, 25 bp, Homo sapien
ggaaatcagtgagggctcgcctatt

SEQ ID NO: 106685 - DNA, 25 bp, Homo sapien
tcagtgagggctcgcctattcctga

SEQ ID NO: 106686 - DNA, 25 bp, Homo sapien
ccagtttctcacctctagttggaga

SEQ ID NO: 106687 - DNA, 25 bp, Homo sapien
ttggagagactttgcaaatgctaac

SEQ ID NO: 106688 - DNA, 25 bp, Homo sapien
aaatgctaactacaagtacaacctt

SEQ ID NO: 106689 - DNA, 25 bp, Homo sapien
gtacaaccttggaaaagcttgaagt

SEQ ID NO: 106690 - DNA, 25 bp, Homo sapien
gcttgaagttgcagagtcagagttc

SEQ ID NO: 106691 - DNA, 25 bp, Homo sapien
gccactagggaaagtaagttgcact

SEQ ID NO: 106692 - DNA, 25 bp, Homo sapien
gttgcactcatgtaagtatcaaact

SEQ ID NO: 106693 - DNA, 25 bp, Homo sapien
aaggaggccttgtgcatttcaagtt

SEQ ID NO: 106694 - DNA, 25 bp, Homo sapien
tcaagtttgcaaagtacctgtgtac

SEQ ID NO: 106695 - DNA, 25 bp, Homo sapien
atgtgtggagacctactgtacagta

SEQ ID NO: 106696 - DNA, 25 bp, Homo sapien
tgtacagtagttttgcccctttaat

SEQ ID NO: 106697 - DNA, 25 bp, Homo sapien
gggcacattcatcttaaatcttata

SEQ ID NO: 106698 - DNA, 25 bp, Homo sapien
aatcttatagtatttatccacccaa

SEQ ID NO: 106699 - DNA, 25 bp, Homo sapien
caaaccccagactgagatactgctc

SEQ ID NO: 106700 - DNA, 25 bp, Homo sapien
agctgccagtccgtgattttaattg

SEQ ID NO: 106701 - DNA, 25 bp, Homo sapien
tgaaataatctacctgatgctaaat

SEQ ID NO: 106702 - DNA, 25 bp, Homo sapien
ctgcacttcatcatcggcaatggca

SEQ ID NO: 106703 - DNA, 25 bp, Homo sapien
catcggcaatggcatcctgcggcca

SEQ ID NO: 106704 - DNA, 25 bp, Homo sapien
atcggcaatggcatcctgcggccag

SEQ ID NO: 106705 - DNA, 25 bp, Homo sapien
tcggcaatggcatcctgcggccagc

SEQ ID NO: 106706 - DNA, 25 bp, Homo sapien
cggcaatggcatcctgcggccagca

SEQ ID NO: 106707 - DNA, 25 bp, Homo sapien
ggcaatggcatcctgcggccagcac

SEQ ID NO: 106708 - DNA, 25 bp, Homo sapien
gcaatggcatcctgcggccagcact

SEQ ID NO: 106709 - DNA, 25 bp, Homo sapien
caatggcatcctgcggccagcactc

SEQ ID NO: 106710 - DNA, 25 bp, Homo sapien
aatggcatcctgcggccagcactcc

SEQ ID NO: 106711 - DNA, 25 bp, Homo sapien
atggcatcctgcggccagcactccg

SEQ ID NO: 106712 - DNA, 25 bp, Homo sapien
tggcatcctgcggccagcactccgg

SEQ ID NO: 106713 - DNA, 25 bp, Homo sapien
attgttgcaaagtgctgtttttgcc

SEQ ID NO: 106714 - DNA, 25 bp, Homo sapien
tgttgcaaagtgctgtttttgcctt

SEQ ID NO: 106715 - DNA, 25 bp, Homo sapien
gttgcaaagtgctgtttttgcctta

SEQ ID NO: 106716 - DNA, 25 bp, Homo sapien
ttgcaaagtgctgtttttgccttaa

SEQ ID NO: 106717 - DNA, 25 bp, Homo sapien
aaaggtattgagattgtgcaaatgc

SEQ ID NO: 106718 - DNA, 25 bp, Homo sapien
ttgtgcaaatgctgggcacgcttgg

SEQ ID NO: 106719 - DNA, 25 bp, Homo sapien
tgtgcaaatgctgggcacgcttggc

SEQ ID NO: 106720 - DNA, 25 bp, Homo sapien
caaatgctgggcacgcttggcatga

SEQ ID NO: 106721 - DNA, 25 bp, Homo sapien
tgctgggcacgcttggcatgagata

SEQ ID NO: 106722 - DNA, 25 bp, Homo sapien
gctgggcacgcttggcatgagataa

SEQ ID NO: 106723 - DNA, 25 bp, Homo sapien
ctgggcacgcttggcatgagataat

SEQ ID NO: 106724 - DNA, 25 bp, Homo sapien
gattgcttcaagctttggtcagaca

SEQ ID NO: 106725 - DNA, 25 bp, Homo sapien
gcttcaagctttggtcagacaagag

SEQ ID NO: 106726 - DNA, 25 bp, Homo sapien
ggagggcatattgtctatgaccaac

SEQ ID NO: 106727 - DNA, 25 bp, Homo sapien
attgtctatgaccaacttcctactc

SEQ ID NO: 106728 - DNA, 25 bp, Homo sapien
tactcccagttcaccagatgaatca

SEQ ID NO: 106729 - DNA, 25 bp, Homo sapien
gaaaatcaagcacgtgtgagaattt

SEQ ID NO: 106730 - DNA, 25 bp, Homo sapien
gagaatttaggagacactgtgcact

SEQ ID NO: 106731 - DNA, 25 bp, Homo sapien
atgtttcacaacaggcattccagaa

SEQ ID NO: 106732 - DNA, 25 bp, Homo sapien
cattccagaattatgaggcattgag

SEQ ID NO: 106733 - DNA, 25 bp, Homo sapien
aagactacagctaacctggcagtag

SEQ ID NO: 106734 - DNA, 25 bp, Homo sapien
acctggcagtagatgtgattgcttc

SEQ ID NO: 106735 - DNA, 25 bp, Homo sapien
cagatcttcaggttctatgcgcaat

SEQ ID NO: 106736 - DNA, 25 bp, Homo sapien
tatgcgcaatagatggaaaccaaac

SEQ ID NO: 106737 - DNA, 25 bp, Homo sapien
gcagcaaggtactagggagatcccc

SEQ ID NO: 106738 - DNA, 25 bp, Homo sapien
tgcaggatgacaactcccctggcac

SEQ ID NO: 106739 - DNA, 25 bp, Homo sapien
tggcaccctgacactacgacagggt

SEQ ID NO: 106740 - DNA, 25 bp, Homo sapien
tacgacagggtaagcggccttcacc

SEQ ID NO: 106741 - DNA, 25 bp, Homo sapien
ggccttcacccctaagtgaaaatgt

SEQ ID NO: 106742 - DNA, 25 bp, Homo sapien
gaaggagccattcttggaactggac

SEQ ID NO: 106743 - DNA, 25 bp, Homo sapien
ggaactggacgacttctgaaaactg

SEQ ID NO: 106744 - DNA, 25 bp, Homo sapien
gagcaaggccaggaccatgacaagg

SEQ ID NO: 106745 - DNA, 25 bp, Homo sapien
aaaatcagcactttcccttggtgga

SEQ ID NO: 106746 - DNA, 25 bp, Homo sapien
agcctgctgaccatggaggagatcc

SEQ ID NO: 106747 - DNA, 25 bp, Homo sapien
cgcagatcaaggagcgcaagtgcct

SEQ ID NO: 106748 - DNA, 25 bp, Homo sapien
agcgcaagtgcctgctcctcaagat

SEQ ID NO: 106749 - DNA, 25 bp, Homo sapien
gctcctcaagatccgcggtgggaaa

SEQ ID NO: 106750 - DNA, 25 bp, Homo sapien
tccgcggtgggaaacagttcatttt

SEQ ID NO: 106751 - DNA, 25 bp, Homo sapien
acagttcattttgcagtgcgatagc

SEQ ID NO: 106752 - DNA, 25 bp, Homo sapien
ttttgcagtgcgatagcgaccctga

SEQ ID NO: 106753 - DNA, 25 bp, Homo sapien
cagtgcgatagcgaccctgagctgg

SEQ ID NO: 106754 - DNA, 25 bp, Homo sapien
cagcgggtgcccaagatgaagaaca

SEQ ID NO: 106755 - DNA, 25 bp, Homo sapien
aagatgaagaacaagccgcgctcgc

SEQ ID NO: 106756 - DNA, 25 bp, Homo sapien
agctgagcaaggtgccgctggtcca

SEQ ID NO: 106757 - DNA, 25 bp, Homo sapien
gcctgcgcgtggacaagaccgtcta

SEQ ID NO: 106758 - DNA, 25 bp, Homo sapien
gacaagaccgtctacatggtgggca

SEQ ID NO: 106759 - DNA, 25 bp, Homo sapien
gaccgtctacatggtgggcagctat

SEQ ID NO: 106760 - DNA, 25 bp, Homo sapien
tacatggtgggcagctatggcccga

SEQ ID NO: 106761 - DNA, 25 bp, Homo sapien
gctatggcccgagcgcccaggagta

SEQ ID NO: 106762 - DNA, 25 bp, Homo sapien
agtatgagtttgtgactccggtgga

SEQ ID NO: 106763 - DNA, 25 bp, Homo sapien
gcccctatctggtggtgtccctctt

SEQ ID NO: 106764 - DNA, 25 bp, Homo sapien
tggtggtgtccctcttcaccgacga

SEQ ID NO: 106765 - DNA, 25 bp, Homo sapien
tcaccgacgatgacaggacgcacca

SEQ ID NO: 106766 - DNA, 25 bp, Homo sapien
gacgatgacaggacgcaccacctgt

SEQ ID NO: 106767 - DNA, 25 bp, Homo sapien
acctccctcagttgttgcacaggga

SEQ ID NO: 106768 - DNA, 25 bp, Homo sapien
cagggagatgggacccttgtgccac

SEQ ID NO: 106769 - DNA, 25 bp, Homo sapien
agatgggacccttgtgccacctggg

SEQ ID NO: 106770 - DNA, 25 bp, Homo sapien
agctgaaatactgtcactagtggta

SEQ ID NO: 106771 - DNA, 25 bp, Homo sapien
actagtggtagtgacttgcttttcc

SEQ ID NO: 106772 - DNA, 25 bp, Homo sapien
ggtagtgacttgcttttcctgtgca

SEQ ID NO: 106773 - DNA, 25 bp, Homo sapien
tgtgcacacatgtagcccatcagga

SEQ ID NO: 106774 - DNA, 25 bp, Homo sapien
tcaggacagcgagccgacgggtcac

SEQ ID NO: 106775 - DNA, 25 bp, Homo sapien
ccgtgtgaacggtgatgaatgttga

SEQ ID NO: 106776 - DNA, 25 bp, Homo sapien
gaatgttgaaaatgcgtctcagaga

SEQ ID NO: 106777 - DNA, 25 bp, Homo sapien
gcgtctcagagaggtattcacatga

SEQ ID NO: 106778 - DNA, 25 bp, Homo sapien
agaggtattcacatgaactttgtat

SEQ ID NO: 106779 - DNA, 25 bp, Homo sapien
cctgggtgccaagcactgcgtgaag

SEQ ID NO: 106780 - DNA, 25 bp, Homo sapien
gtcgaagctcacgtggaccagaaaa

SEQ ID NO: 106781 - DNA, 25 bp, Homo sapien
aacaaggtggtcacgaccccagcct

SEQ ID NO: 106782 - DNA, 25 bp, Homo sapien
ttcatgtgcgagacggcactccact

SEQ ID NO: 106783 - DNA, 25 bp, Homo sapien
gcactccactacatccatgatggga

SEQ ID NO: 106784 - DNA, 25 bp, Homo sapien
cactggaaagtgacgcgcatggacg

SEQ ID NO: 106785 - DNA, 25 bp, Homo sapien
agctaggcgccaggacttggcctca

SEQ ID NO: 106786 - DNA, 25 bp, Homo sapien
ctgaggagctgtcggctgctttcca

SEQ ID NO: 106787 - DNA, 25 bp, Homo sapien
ctgctttccatccagctgggagtct

SEQ ID NO: 106788 - DNA, 25 bp, Homo sapien
ctgggagtctggcaggccctttttt

SEQ ID NO: 106789 - DNA, 25 bp, Homo sapien
tttttctttgccgaaacctgcaggc

SEQ ID NO: 106790 - DNA, 25 bp, Homo sapien
ggatctaaggcacaatatttgtcac

SEQ ID NO: 106791 - DNA, 25 bp, Homo sapien
gcacaatatttgtcactgttctatt

SEQ ID NO: 106792 - DNA, 25 bp, Homo sapien
gtcactgttctattagactttttac

SEQ ID NO: 106793 - DNA, 25 bp, Homo sapien
ataatggtgtaatggttctcctggg

SEQ ID NO: 106794 - DNA, 25 bp, Homo sapien
gggctgtcacattttataggtcaga

SEQ ID NO: 106795 - DNA, 25 bp, Homo sapien
ataggtcagagtgtgacttcttaat

SEQ ID NO: 106796 - DNA, 25 bp, Homo sapien
gtgtgacttcttaatatggtgctga

SEQ ID NO: 106797 - DNA, 25 bp, Homo sapien
tatggtgctgatgtttttgtgtcaa

SEQ ID NO: 106798 - DNA, 25 bp, Homo sapien
gctgatgtttttgtgtcaatggctt

SEQ ID NO: 106799 - DNA, 25 bp, Homo sapien
gtcaatggcttgaaactggcaagat

SEQ ID NO: 106800 - DNA, 25 bp, Homo sapien
gcaagattaacaaaattaggccggg

SEQ ID NO: 106801 - DNA, 25 bp, Homo sapien
atccaccaagattacacgacgcaga

SEQ ID NO: 106802 - DNA, 25 bp, Homo sapien
acgacgcagaacttgatccgcatgg

SEQ ID NO: 106803 - DNA, 25 bp, Homo sapien
aacttgatccgcatggccgtggcag

SEQ ID NO: 106804 - DNA, 25 bp, Homo sapien
gctctcttggccatactggttgaaa

SEQ ID NO: 106805 - DNA, 25 bp, Homo sapien
attggcacagccatacggcactgaa

SEQ ID NO: 106806 - DNA, 25 bp, Homo sapien
agccatacggcactgaacaaggaag

SEQ ID NO: 106807 - DNA, 25 bp, Homo sapien
aacaaggaagcctcggcagatgtgg

SEQ ID NO: 106808 - DNA, 25 bp, Homo sapien
tgtggctgaaccgagctggagccaa

SEQ ID NO: 106809 - DNA, 25 bp, Homo sapien
gagccaacagatgtgtcagccagga

SEQ ID NO: 106810 - DNA, 25 bp, Homo sapien
gtgtcagccaggattgacctttgca

SEQ ID NO: 106811 - DNA, 25 bp, Homo sapien
gattgacctttgcacgaacaccaag

SEQ ID NO: 106812 - DNA, 25 bp, Homo sapien
gaataatggtgtaatggttctcctg

SEQ ID NO: 106813 - DNA, 25 bp, Homo sapien
aataatggtgtaatggttctcctgg

SEQ ID NO: 106814 - DNA, 25 bp, Homo sapien
ataatggtgtaatggttctcctggg

SEQ ID NO: 106815 - DNA, 25 bp, Homo sapien
tgtaatggttctcctggggctgtca

SEQ ID NO: 106816 - DNA, 25 bp, Homo sapien
tttataggtcagagtgtgacttctt

SEQ ID NO: 106817 - DNA, 25 bp, Homo sapien
tataggtcagagtgtgacttcttaa

SEQ ID NO: 106818 - DNA, 25 bp, Homo sapien
ataggtcagagtgtgacttcttaat

SEQ ID NO: 106819 - DNA, 25 bp, Homo sapien
aggtcagagtgtgacttcttaatat

SEQ ID NO: 106820 - DNA, 25 bp, Homo sapien
gtcagagtgtgacttcttaatatgg

SEQ ID NO: 106821 - DNA, 25 bp, Homo sapien
tcagagtgtgacttcttaatatggt

SEQ ID NO: 106822 - DNA, 25 bp, Homo sapien
cagagtgtgacttcttaatatggtg

SEQ ID NO: 106823 - DNA, 25 bp, Homo sapien
atttttaagcctcatacttgctcat

SEQ ID NO: 106824 - DNA, 25 bp, Homo sapien
atacttgctcattctacagcttttt

SEQ ID NO: 106825 - DNA, 25 bp, Homo sapien
cagcttttttcactcattattgtat

SEQ ID NO: 106826 - DNA, 25 bp, Homo sapien
gtataattatatctgaagctctcgt

SEQ ID NO: 106827 - DNA, 25 bp, Homo sapien
gctctcgttcattaattttagtcct

SEQ ID NO: 106828 - DNA, 25 bp, Homo sapien
taccataatttatctgttctccagt

SEQ ID NO: 106829 - DNA, 25 bp, Homo sapien
tgttctccagtccagttgaaggcat

SEQ ID NO: 106830 - DNA, 25 bp, Homo sapien
gcatgaagttgttgccagtttctgt

SEQ ID NO: 106831 - DNA, 25 bp, Homo sapien
ggaacattcttctgcattgggctac

SEQ ID NO: 106832 - DNA, 25 bp, Homo sapien
tgggctactcgcgtgttacctaaga

SEQ ID NO: 106833 - DNA, 25 bp, Homo sapien
tttagccttatagacattgccaaat

SEQ ID NO: 106834 - DNA, 25 bp, Homo sapien
atgccctgtgtagatcatcattcag

SEQ ID NO: 106835 - DNA, 25 bp, Homo sapien
tgccctgtgtagatcatcattcagt

SEQ ID NO: 106836 - DNA, 25 bp, Homo sapien
cctgtgtagatcatcattcagtgcc

SEQ ID NO: 106837 - DNA, 25 bp, Homo sapien
ctgtgtagatcatcattcagtgcca

SEQ ID NO: 106838 - DNA, 25 bp, Homo sapien
gtgtagatcatcattcagtgccaca

SEQ ID NO: 106839 - DNA, 25 bp, Homo sapien
gcatgcctggccagtggatccttaa

SEQ ID NO: 106840 - DNA, 25 bp, Homo sapien
catgcctggccagtggatccttaat

SEQ ID NO: 106841 - DNA, 25 bp, Homo sapien
atgcctggccagtggatccttaatt

SEQ ID NO: 106842 - DNA, 25 bp, Homo sapien
tgcctggccagtggatccttaattg

SEQ ID NO: 106843 - DNA, 25 bp, Homo sapien
cagtggatccttaattgtagccttt

SEQ ID NO: 106844 - DNA, 25 bp, Homo sapien
tgtagcctttgaaggatgccctgtg

SEQ ID NO: 106845 - DNA, 25 bp, Homo sapien
gaatttgtaatgctcaatccccttg

SEQ ID NO: 106846 - DNA, 25 bp, Homo sapien
atttgtaatgctcaatccccttggg

SEQ ID NO: 106847 - DNA, 25 bp, Homo sapien
tttgtaatgctcaatccccttgggt

SEQ ID NO: 106848 - DNA, 25 bp, Homo sapien
tgtaatgctcaatccccttgggttt

SEQ ID NO: 106849 - DNA, 25 bp, Homo sapien
gtaatgctcaatccccttgggtttc

SEQ ID NO: 106850 - DNA, 25 bp, Homo sapien
atgctcaatccccttgggtttctcc

SEQ ID NO: 106851 - DNA, 25 bp, Homo sapien
cagagagagaggacctttcctcctt

SEQ ID NO: 106852 - DNA, 25 bp, Homo sapien
gagagagaggacctttcctccttgt

SEQ ID NO: 106853 - DNA, 25 bp, Homo sapien
agagaggacctttcctccttgttca

SEQ ID NO: 106854 - DNA, 25 bp, Homo sapien
agaggacctttcctccttgttcagt

SEQ ID NO: 106855 - DNA, 25 bp, Homo sapien
taaacctgaggatttaacaaatgta

SEQ ID NO: 106856 - DNA, 25 bp, Homo sapien
aagcctgcccaagcagtctactgaa

SEQ ID NO: 106857 - DNA, 25 bp, Homo sapien
caagcagtctactgaatccagcctt

SEQ ID NO: 106858 - DNA, 25 bp, Homo sapien
atccagccttccagcaagagattgt

SEQ ID NO: 106859 - DNA, 25 bp, Homo sapien
agcaagagattgtttttcaaggaca

SEQ ID NO: 106860 - DNA, 25 bp, Homo sapien
ggacaaggactttgatttatttctg

SEQ ID NO: 106861 - DNA, 25 bp, Homo sapien
tcatgaacctgatctgtgacccgga

SEQ ID NO: 106862 - DNA, 25 bp, Homo sapien
gtgacccggacctaaccaaggtgag

SEQ ID NO: 106863 - DNA, 25 bp, Homo sapien
caaggtgagccgatgcctggagcat

SEQ ID NO: 106864 - DNA, 25 bp, Homo sapien
tggagcatgccctgactgctcgaca

SEQ ID NO: 106865 - DNA, 25 bp, Homo sapien
acagcccaggttgggatgccaagct

SEQ ID NO: 106866 - DNA, 25 bp, Homo sapien
ttgggatgccaagctgctctggctg

SEQ ID NO: 106867 - DNA, 25 bp, Homo sapien
aagctgctttagaagtaacaatgaa

SEQ ID NO: 106868 - DNA, 25 bp, Homo sapien
gttgttgttcaaacgggattcacag

SEQ ID NO: 106869 - DNA, 25 bp, Homo sapien
gttcaaacgggattcacagagtatt

SEQ ID NO: 106870 - DNA, 25 bp, Homo sapien
aacgggattcacagagtatttgaaa

SEQ ID NO: 106871 - DNA, 25 bp, Homo sapien
ataacagtaaatgtgcccagcctct

SEQ ID NO: 106872 - DNA, 25 bp, Homo sapien
aacagtaaatgtgcccagcctcttg

SEQ ID NO: 106873 - DNA, 25 bp, Homo sapien
tggccccagaactgtacagtattgt

SEQ ID NO: 106874 - DNA, 25 bp, Homo sapien
gtggctgcacttgctctaagagtag

SEQ ID NO: 106875 - DNA, 25 bp, Homo sapien
gctgcacttgctctaagagtagttg

SEQ ID NO: 106876 - DNA, 25 bp, Homo sapien
gagtagttgatgttgcattttcctt

SEQ ID NO: 106877 - DNA, 25 bp, Homo sapien
gatgttgcattttccttattgttaa

SEQ ID NO: 106878 - DNA, 25 bp, Homo sapien
ttatcagtccaaagggcatgggttt

SEQ ID NO: 106879 - DNA, 25 bp, Homo sapien
aagggcatgggttttattatatata

SEQ ID NO: 106880 - DNA, 25 bp, Homo sapien
attgcatttaatttattgaggcttt

SEQ ID NO: 106881 - DNA, 25 bp, Homo sapien
ggctttaaaacttatcctccatgaa

SEQ ID NO: 106882 - DNA, 25 bp, Homo sapien
aaacttatcctccatgaatatcagt

SEQ ID NO: 106883 - DNA, 25 bp, Homo sapien
aagctttgtgcagattctttacccc

SEQ ID NO: 106884 - DNA, 25 bp, Homo sapien
tgggagccccaattcgatcccctgt

SEQ ID NO: 106885 - DNA, 25 bp, Homo sapien
gatcccctgtcacgtgtgggcaatg

SEQ ID NO: 106886 - DNA, 25 bp, Homo sapien
cctgtcacgtgtgggcaatgttccc

SEQ ID NO: 106887 - DNA, 25 bp, Homo sapien
aatgtcattgttcttgtgaacccaa

SEQ ID NO: 106888 - DNA, 25 bp, Homo sapien
ttgtgaacccaaagtgtgactcatt

SEQ ID NO: 106889 - DNA, 25 bp, Homo sapien
ggtcgctgctgtgatacataggagg

SEQ ID NO: 106890 - DNA, 25 bp, Homo sapien
ctgtgatacataggaggaagagctc

SEQ ID NO: 106891 - DNA, 25 bp, Homo sapien
ggctgcaggagccctgcaccctgag

SEQ ID NO: 106892 - DNA, 25 bp, Homo sapien
gctgcaggagccctgcaccctgaga

SEQ ID NO: 106893 - DNA, 25 bp, Homo sapien
ctgcaggagccctgcaccctgagat

SEQ ID NO: 106894 - DNA, 25 bp, Homo sapien
tgcaggagccctgcaccctgagatg

SEQ ID NO: 106895 - DNA, 25 bp, Homo sapien
gcaggagccctgcaccctgagatgg

SEQ ID NO: 106896 - DNA, 25 bp, Homo sapien
caggagccctgcaccctgagatgga

SEQ ID NO: 106897 - DNA, 25 bp, Homo sapien
aggagccctgcaccctgagatggaa

SEQ ID NO: 106898 - DNA, 25 bp, Homo sapien
acttgggcatcgtttctggcccagc

SEQ ID NO: 106899 - DNA, 25 bp, Homo sapien
cttgggcatcgtttctggcccagct

SEQ ID NO: 106900 - DNA, 25 bp, Homo sapien
aaggccgccttctcgaaagatgagt

SEQ ID NO: 106901 - DNA, 25 bp, Homo sapien
atgagtccaaggagcccatcgtgga

SEQ ID NO: 106902 - DNA, 25 bp, Homo sapien
agcccatcgtggaggttcgaacgga

SEQ ID NO: 106903 - DNA, 25 bp, Homo sapien
ggagaggaccccaaaccatgatgga

SEQ ID NO: 106904 - DNA, 25 bp, Homo sapien
ggaaacacacagagcccaacgagac

SEQ ID NO: 106905 - DNA, 25 bp, Homo sapien
ccgtagaagcaaagccagagtgcca

SEQ ID NO: 106906 - DNA, 25 bp, Homo sapien
ccagagtgccaggagacagaaacga

SEQ ID NO: 106907 - DNA, 25 bp, Homo sapien
agaaacgaagccagcgccagccgaa

SEQ ID NO: 106908 - DNA, 25 bp, Homo sapien
aagccagcgccagccgaagtcaaga

SEQ ID NO: 106909 - DNA, 25 bp, Homo sapien
gaagtcaagacggtccccaatgacg

SEQ ID NO: 106910 - DNA, 25 bp, Homo sapien
caatgacgccacacagacaaaggag

SEQ ID NO: 106911 - DNA, 25 bp, Homo sapien
aattcaacatcgctttatgataaac

SEQ ID NO: 106912 - DNA, 25 bp, Homo sapien
gctttatgataaacactctcaacaa

SEQ ID NO: 106913 - DNA, 25 bp, Homo sapien
actagacatagaaggaacataactc

SEQ ID NO: 106914 - DNA, 25 bp, Homo sapien
acaaagaccatatacagccaaccca

SEQ ID NO: 106915 - DNA, 25 bp, Homo sapien
aagaccatatacagccaacccacag

SEQ ID NO: 106916 - DNA, 25 bp, Homo sapien
atatacagccaacccacagctaaca

SEQ ID NO: 106917 - DNA, 25 bp, Homo sapien
agtaaagttgaacgcctttgctcca

SEQ ID NO: 106918 - DNA, 25 bp, Homo sapien
aagttgaacgcctttgctccaagaa

SEQ ID NO: 106919 - DNA, 25 bp, Homo sapien
gaacgcctttgctccaagaactgaa

SEQ ID NO: 106920 - DNA, 25 bp, Homo sapien
gacaaggattctcactttcaccatt

SEQ ID NO: 106921 - DNA, 25 bp, Homo sapien
aggattctcactttcaccattccta

SEQ ID NO: 106922 - DNA, 25 bp, Homo sapien
gtgcagacagaggatgagtaccagt

SEQ ID NO: 106923 - DNA, 25 bp, Homo sapien
ggatgagtaccagttctgttaccag

SEQ ID NO: 106924 - DNA, 25 bp, Homo sapien
gtaccagttctgttaccaggcggca

SEQ ID NO: 106925 - DNA, 25 bp, Homo sapien
agttctgttaccaggcggcactgga

SEQ ID NO: 106926 - DNA, 25 bp, Homo sapien
gttaccaggcggcactggagtacct

SEQ ID NO: 106927 - DNA, 25 bp, Homo sapien
caggcggcactggagtacctcggaa

SEQ ID NO: 106928 - DNA, 25 bp, Homo sapien
tgaccactatgcaacctaaagccat

SEQ ID NO: 106929 - DNA, 25 bp, Homo sapien
tatgcaacctaaagccatggtcccc

SEQ ID NO: 106930 - DNA, 25 bp, Homo sapien
gggcggacctcctgaggcctggacc

SEQ ID NO: 106931 - DNA, 25 bp, Homo sapien
tttctgcaccatttccgaggacgac

SEQ ID NO: 106932 - DNA, 25 bp, Homo sapien
tctgcaccatttccgaggacgacgc

SEQ ID NO: 106933 - DNA, 25 bp, Homo sapien
acatttgcatgtactcctatacctc

SEQ ID NO: 106934 - DNA, 25 bp, Homo sapien
ttcctctaccataaagttacacctc

SEQ ID NO: 106935 - DNA, 25 bp, Homo sapien
tccccagcctaattctgagctaaac

SEQ ID NO: 106936 - DNA, 25 bp, Homo sapien
ttctccaagtttctgtcagccttta

SEQ ID NO: 106937 - DNA, 25 bp, Homo sapien
gtcagcctttaaagggctcagcagt

SEQ ID NO: 106938 - DNA, 25 bp, Homo sapien
aagttattctgacatctgcgtttga

SEQ ID NO: 106939 - DNA, 25 bp, Homo sapien
tctgcgtttgagaaatgcgtgacca

SEQ ID NO: 106940 - DNA, 25 bp, Homo sapien
atgcgtgaccattacttcctgaatt

SEQ ID NO: 106941 - DNA, 25 bp, Homo sapien
aatttgggaatctttgacctgcgtc

SEQ ID NO: 106942 - DNA, 25 bp, Homo sapien
gacctgcgtcctgatttaagaccat

SEQ ID NO: 106943 - DNA, 25 bp, Homo sapien
atttaagaccatcctgaaagctcag

SEQ ID NO: 106944 - DNA, 25 bp, Homo sapien
gtggattacctatacttatgttcgt

SEQ ID NO: 106945 - DNA, 25 bp, Homo sapien
cctatacttatgttcgttttgatac

SEQ ID NO: 106946 - DNA, 25 bp, Homo sapien
tagcttctcattataaggtgattca

SEQ ID NO: 106947 - DNA, 25 bp, Homo sapien
tcatgctttagtgaattcttcatag

SEQ ID NO: 106948 - DNA, 25 bp, Homo sapien
gtacattttaatagaaagccagggt

SEQ ID NO: 106949 - DNA, 25 bp, Homo sapien
gccagggttttaaggaatttcacat

SEQ ID NO: 106950 - DNA, 25 bp, Homo sapien
tttcacatgtataaggtggctccat

SEQ ID NO: 106951 - DNA, 25 bp, Homo sapien
aggtggctccatagctttatttgta

SEQ ID NO: 106952 - DNA, 25 bp, Homo sapien
gctttatttgtaagtaggctggata

SEQ ID NO: 106953 - DNA, 25 bp, Homo sapien
gtaggctggataaatggtgcttaaa

SEQ ID NO: 106954 - DNA, 25 bp, Homo sapien
aatggtaatgtactccacttcttcc

SEQ ID NO: 106955 - DNA, 25 bp, Homo sapien
gaaatgcccttcatcagggatgagc

SEQ ID NO: 106956 - DNA, 25 bp, Homo sapien
aatgcccttcatcagggatgagcag

SEQ ID NO: 106957 - DNA, 25 bp, Homo sapien
gctctactccggcttgcccggtgat

SEQ ID NO: 106958 - DNA, 25 bp, Homo sapien
ttgcccggtgattcgtctgccctga

SEQ ID NO: 106959 - DNA, 25 bp, Homo sapien
ggtgattcgtctgccctgacccatg

SEQ ID NO: 106960 - DNA, 25 bp, Homo sapien
cagaaggtgtccaggtggcctgtca

SEQ ID NO: 106961 - DNA, 25 bp, Homo sapien
aggtgtccaggtggcctgtcatgaa

SEQ ID NO: 106962 - DNA, 25 bp, Homo sapien
tccaggtggcctgtcatgaatccag

SEQ ID NO: 106963 - DNA, 25 bp, Homo sapien
ggtggcctgtcatgaatccagctaa

SEQ ID NO: 106964 - DNA, 25 bp, Homo sapien
ggcctgtcatgaatccagctaaatc

SEQ ID NO: 106965 - DNA, 25 bp, Homo sapien
gaatccagctaaatcaagatggcag

SEQ ID NO: 106966 - DNA, 25 bp, Homo sapien
ccttcttaaccattctactgtgtca

SEQ ID NO: 106967 - DNA, 25 bp, Homo sapien
taaccattctactgtgtcacctttg

SEQ ID NO: 106968 - DNA, 25 bp, Homo sapien
actgtgtcacctttgccattgagga

SEQ ID NO: 106969 - DNA, 25 bp, Homo sapien
cctttgccattgaggaaaaatattc

SEQ ID NO: 106970 - DNA, 25 bp, Homo sapien
tcttgcatttttggtatcttcataa

SEQ ID NO: 106971 - DNA, 25 bp, Homo sapien
ggtatcttcataatctttagtcatc

SEQ ID NO: 106972 - DNA, 25 bp, Homo sapien
tttagtcatcgaatcccagtggagg

SEQ ID NO: 106973 - DNA, 25 bp, Homo sapien
tttacttgccctgaacatacacatg

SEQ ID NO: 106974 - DNA, 25 bp, Homo sapien
catgctgggccattgtgattgaagt

SEQ ID NO: 106975 - DNA, 25 bp, Homo sapien
gattgaagtcttctaactctgtctc

SEQ ID NO: 106976 - DNA, 25 bp, Homo sapien
gaagtcttctaactctgtctcagtt

SEQ ID NO: 106977 - DNA, 25 bp, Homo sapien
tatgggcaaccctaaggtgaaggct

SEQ ID NO: 106978 - DNA, 25 bp, Homo sapien
atgggcaaccctaaggtgaaggctc

SEQ ID NO: 106979 - DNA, 25 bp, Homo sapien
tgggcaaccctaaggtgaaggctca

SEQ ID NO: 106980 - DNA, 25 bp, Homo sapien
gggcaaccctaaggtgaaggctcat

SEQ ID NO: 106981 - DNA, 25 bp, Homo sapien
ggcaaccctaaggtgaaggctcatg

SEQ ID NO: 106982 - DNA, 25 bp, Homo sapien
gcaaccctaaggtgaaggctcatgg

SEQ ID NO: 106983 - DNA, 25 bp, Homo sapien
aaccctaaggtgaaggctcatggca

SEQ ID NO: 106984 - DNA, 25 bp, Homo sapien
accctaaggtgaaggctcatggcaa

SEQ ID NO: 106985 - DNA, 25 bp, Homo sapien
ctaaggtgaaggctcatggcaagaa

SEQ ID NO: 106986 - DNA, 25 bp, Homo sapien
ggtgcctttagtgatggcctggctc

SEQ ID NO: 106987 - DNA, 25 bp, Homo sapien
gtgcctttagtgatggcctggctca

SEQ ID NO: 106988 - DNA, 25 bp, Homo sapien
tgccggcctggatccgagcccgtgt

SEQ ID NO: 106989 - DNA, 25 bp, Homo sapien
ggcctggatccgagcccgtgtggag

SEQ ID NO: 106990 - DNA, 25 bp, Homo sapien
cccgtgtggaggtcaaagctacctt

SEQ ID NO: 106991 - DNA, 25 bp, Homo sapien
ccgtgtggaggtcaaagctaccttt

SEQ ID NO: 106992 - DNA, 25 bp, Homo sapien
cgtgtggaggtcaaagctacctttg

SEQ ID NO: 106993 - DNA, 25 bp, Homo sapien
tgtggaggtcaaagctacctttggc

SEQ ID NO: 106994 - DNA, 25 bp, Homo sapien
gtggaggtcaaagctacctttggcc

SEQ ID NO: 106995 - DNA, 25 bp, Homo sapien
tggaggtcaaagctacctttggccc

SEQ ID NO: 106996 - DNA, 25 bp, Homo sapien
gaggtcaaagctacctttggccccg

SEQ ID NO: 106997 - DNA, 25 bp, Homo sapien
tttggccccgccattgctgctgtgc

SEQ ID NO: 106998 - DNA, 25 bp, Homo sapien
gccccgccattgctgctgtgcagaa

SEQ ID NO: 106999 - DNA, 25 bp, Homo sapien
caaaatcaacttaagggtaggctca

SEQ ID NO: 107000 - DNA, 25 bp, Homo sapien
gtaggctcaaaacagggttgttgtt

SEQ ID NO: 107001 - DNA, 25 bp, Homo sapien
gtttctccttgttgtgattttcacc

SEQ ID NO: 107002 - DNA, 25 bp, Homo sapien
atgtaccttcacaccaatagattgg

SEQ ID NO: 107003 - DNA, 25 bp, Homo sapien
caccaatagattgggcactgtggaa

SEQ ID NO: 107004 - DNA, 25 bp, Homo sapien
aaatcactcaaattgttctctaata

SEQ ID NO: 107005 - DNA, 25 bp, Homo sapien
gtaaaattacactttgaactactag

SEQ ID NO: 107006 - DNA, 25 bp, Homo sapien
attgtgctggaaatggacacagtct

SEQ ID NO: 107007 - DNA, 25 bp, Homo sapien
gacacagtctaacaaattccaaatt

SEQ ID NO: 107008 - DNA, 25 bp, Homo sapien
aacaaattccaaattctcacagaag

SEQ ID NO: 107009 - DNA, 25 bp, Homo sapien
aattgaatttccatgagttacactg

SEQ ID NO: 107010 - DNA, 25 bp, Homo sapien
tgctgtctccccactaggatcattc

SEQ ID NO: 107011 - DNA, 25 bp, Homo sapien
tgcacctgaccaagggaccaatgag

SEQ ID NO: 107012 - DNA, 25 bp, Homo sapien
caagggaccaatgaggcagaggctt

SEQ ID NO: 107013 - DNA, 25 bp, Homo sapien
cattccaggtcaccagatccaagga

SEQ ID NO: 107014 - DNA, 25 bp, Homo sapien
aggtcaccagatccaaggagcgctt

SEQ ID NO: 107015 - DNA, 25 bp, Homo sapien
accagatccaaggagcgcttgagga

SEQ ID NO: 107016 - DNA, 25 bp, Homo sapien
gagcgcttgaggagctctgggtaca

SEQ ID NO: 107017 - DNA, 25 bp, Homo sapien
agctctgggtacagggcagcaaccc

SEQ ID NO: 107018 - DNA, 25 bp, Homo sapien
tgggtacagggcagcaacccagagc

SEQ ID NO: 107019 - DNA, 25 bp, Homo sapien
ggccctcccgggacatctggatgct

SEQ ID NO: 107020 - DNA, 25 bp, Homo sapien
ccgggacatctggatgctgggcata

SEQ ID NO: 107021 - DNA, 25 bp, Homo sapien
attcccactattatgtcttctctga

SEQ ID NO: 107022 - DNA, 25 bp, Homo sapien
ttcccattcactcaatatcccataa

SEQ ID NO: 107023 - DNA, 25 bp, Homo sapien
tatcccataagcatccaaactccat

SEQ ID NO: 107024 - DNA, 25 bp, Homo sapien
taagcatccaaactccattaaggag

SEQ ID NO: 107025 - DNA, 25 bp, Homo sapien
taaggagagttgttcaggtcactgc

SEQ ID NO: 107026 - DNA, 25 bp, Homo sapien
ttcaggtcactgcacaaatatatct

SEQ ID NO: 107027 - DNA, 25 bp, Homo sapien
tatatctgcaattattcatactctg

SEQ ID NO: 107028 - DNA, 25 bp, Homo sapien
ttattcatactctgtaacacttgta

SEQ ID NO: 107029 - DNA, 25 bp, Homo sapien
gtaacacttgtattaattgctgcat

SEQ ID NO: 107030 - DNA, 25 bp, Homo sapien
tgctgcatatgctaatacttttcta

SEQ ID NO: 107031 - DNA, 25 bp, Homo sapien
gctaatacttttctaatgctgactt

SEQ ID NO: 107032 - DNA, 25 bp, Homo sapien
agagacccacgcaggcgaggacgtg

SEQ ID NO: 107033 - DNA, 25 bp, Homo sapien
gcaggcgaggacgtggcggtgttcg

SEQ ID NO: 107034 - DNA, 25 bp, Homo sapien
aggcgcacctggttcacggcgtgca

SEQ ID NO: 107035 - DNA, 25 bp, Homo sapien
cgcacctggttcacggcgtgcagga

SEQ ID NO: 107036 - DNA, 25 bp, Homo sapien
ggttcacggcgtgcaggagcagacc

SEQ ID NO: 107037 - DNA, 25 bp, Homo sapien
gcaggagcagaccttcatagcgcac

SEQ ID NO: 107038 - DNA, 25 bp, Homo sapien
aggagcagaccttcatagcgcacgt

SEQ ID NO: 107039 - DNA, 25 bp, Homo sapien
gagcagaccttcatagcgcacgtca

SEQ ID NO: 107040 - DNA, 25 bp, Homo sapien
cagaccttcatagcgcacgtcatgg

SEQ ID NO: 107041 - DNA, 25 bp, Homo sapien
accttcatagcgcacgtcatggcct

SEQ ID NO: 107042 - DNA, 25 bp, Homo sapien
atagcgcacgtcatggccttcgccg

SEQ ID NO: 107043 - DNA, 25 bp, Homo sapien
gaaagctggtttgttcctgaccctg

SEQ ID NO: 107044 - DNA, 25 bp, Homo sapien
gaccctgcagggatatttaaactca

SEQ ID NO: 107045 - DNA, 25 bp, Homo sapien
aggaaaacctctatagcagctccct

SEQ ID NO: 107046 - DNA, 25 bp, Homo sapien
ccacctccccaatgctgattgtgtt

SEQ ID NO: 107047 - DNA, 25 bp, Homo sapien
atgctgattgtgtttcatgggaaat

SEQ ID NO: 107048 - DNA, 25 bp, Homo sapien
tgtggcacataaggcacctgggctg

SEQ ID NO: 107049 - DNA, 25 bp, Homo sapien
gctggaatccagatgccagatattc

SEQ ID NO: 107050 - DNA, 25 bp, Homo sapien
gatattcggagcattttctgcagga

SEQ ID NO: 107051 - DNA, 25 bp, Homo sapien
gaagctaaattactccactggaatg

SEQ ID NO: 107052 - DNA, 25 bp, Homo sapien
gacataaaccttgggacttccctag

SEQ ID NO: 107053 - DNA, 25 bp, Homo sapien
ttccctagtgttcacaacgacttat

SEQ ID NO: 107054 - DNA, 25 bp, Homo sapien
atgaacagatttaccatcccgaaga

SEQ ID NO: 107055 - DNA, 25 bp, Homo sapien
tcccgaagaaccaactcctacaaat

SEQ ID NO: 107056 - DNA, 25 bp, Homo sapien
ttgagatcattattctcccctgact

SEQ ID NO: 107057 - DNA, 25 bp, Homo sapien
cctgactctcctgtttgggcatgtc

SEQ ID NO: 107058 - DNA, 25 bp, Homo sapien
ggcatgtcttattcagttccagctc

SEQ ID NO: 107059 - DNA, 25 bp, Homo sapien
agttccagctcatgacgccctgtag

SEQ ID NO: 107060 - DNA, 25 bp, Homo sapien
gtagcatacccctaggtaccaactt

SEQ ID NO: 107061 - DNA, 25 bp, Homo sapien
caacttccacagcagtctcgtaaat

SEQ ID NO: 107062 - DNA, 25 bp, Homo sapien
tctcgtaaattctcctgttcacatt

SEQ ID NO: 107063 - DNA, 25 bp, Homo sapien
aataatgtgacttctgaggccctta

SEQ ID NO: 107064 - DNA, 25 bp, Homo sapien
tctgaggcccttatgtagcctgtga

SEQ ID NO: 107065 - DNA, 25 bp, Homo sapien
gtgcagatgctgcaggacgccatca

SEQ ID NO: 107066 - DNA, 25 bp, Homo sapien
gatgctgcaggacgccatcagcaag

SEQ ID NO: 107067 - DNA, 25 bp, Homo sapien
gacgccatcagcaagatggacccca

SEQ ID NO: 107068 - DNA, 25 bp, Homo sapien
aagtaccacatgcagcgctgcattg

SEQ ID NO: 107069 - DNA, 25 bp, Homo sapien
tgggtccccaactctaaggccagcg

SEQ ID NO: 107070 - DNA, 25 bp, Homo sapien
agctgttcccaagacgggcgatgag

SEQ ID NO: 107071 - DNA, 25 bp, Homo sapien
aggatgtcagtgtgtgacctgcccc

SEQ ID NO: 107072 - DNA, 25 bp, Homo sapien
gtcagtgtgtgacctgccccagcta

SEQ ID NO: 107073 - DNA, 25 bp, Homo sapien
tgaggaactccagaagtgcttcgat

SEQ ID NO: 107074 - DNA, 25 bp, Homo sapien
gaactccagaagtgcttcgatgtga

SEQ ID NO: 107075 - DNA, 25 bp, Homo sapien
ttcgatgtgaaggacgtgcagatgc

SEQ ID NO: 107076 - DNA, 25 bp, Homo sapien
attttcaaattctctcttgtcacct

SEQ ID NO: 107077 - DNA, 25 bp, Homo sapien
aattctctcttgtcaccttaaaata

SEQ ID NO: 107078 - DNA, 25 bp, Homo sapien
gttagccaacataattaagctgtat

SEQ ID NO: 107079 - DNA, 25 bp, Homo sapien
ttcccataactggttgacctcggag

SEQ ID NO: 107080 - DNA, 25 bp, Homo sapien
gttgacctcggagttggatcctaca

SEQ ID NO: 107081 - DNA, 25 bp, Homo sapien
ggagttggatcctacagtgtatcaa

SEQ ID NO: 107082 - DNA, 25 bp, Homo sapien
gtgtatcaacaaaaggagccaagca

SEQ ID NO: 107083 - DNA, 25 bp, Homo sapien
aattgagcagcatgattataagcca

SEQ ID NO: 107084 - DNA, 25 bp, Homo sapien
gcatgattataagccaaacccacaa

SEQ ID NO: 107085 - DNA, 25 bp, Homo sapien
gccaaacccacaatccatcaaagtg

SEQ ID NO: 107086 - DNA, 25 bp, Homo sapien
taatggcatgtattccaagtacaga

SEQ ID NO: 107087 - DNA, 25 bp, Homo sapien
ttgtggcatggattgctgtgctcac

SEQ ID NO: 107088 - DNA, 25 bp, Homo sapien
tggcatggattgctgtgctcactgc

SEQ ID NO: 107089 - DNA, 25 bp, Homo sapien
tgctcactgctgtaaaaggtgacct

SEQ ID NO: 107090 - DNA, 25 bp, Homo sapien
aggtgacctagtgtactgggcagct

SEQ ID NO: 107091 - DNA, 25 bp, Homo sapien
gtactgggcagctggtggcggtgca

SEQ ID NO: 107092 - DNA, 25 bp, Homo sapien
tttagttatttcttggaccttgaca

SEQ ID NO: 107093 - DNA, 25 bp, Homo sapien
gttatttcttggaccttgacagtat

SEQ ID NO: 107094 - DNA, 25 bp, Homo sapien
tttcttggaccttgacagtatctaa

SEQ ID NO: 107095 - DNA, 25 bp, Homo sapien
ggaccttgacagtatctaatgactc

SEQ ID NO: 107096 - DNA, 25 bp, Homo sapien
atctaatgactcctcctgaaaatgc

SEQ ID NO: 107097 - DNA, 25 bp, Homo sapien
aatgactcctcctgaaaatgctgca

SEQ ID NO: 107098 - DNA, 25 bp, Homo sapien
gaggccgtgtccaaagactttgcgt

SEQ ID NO: 107099 - DNA, 25 bp, Homo sapien
gaaaactcacagatgggcaaggcct

SEQ ID NO: 107100 - DNA, 25 bp, Homo sapien
caaggcctttggcttggcgagattt

SEQ ID NO: 107101 - DNA, 25 bp, Homo sapien
ggtgctaatccaggacagcattaca

SEQ ID NO: 107102 - DNA, 25 bp, Homo sapien
attacacgccacaactccagtgttc

SEQ ID NO: 107103 - DNA, 25 bp, Homo sapien
tctggctgtcagtcgtgttgcttac

SEQ ID NO: 107104 - DNA, 25 bp, Homo sapien
tgttgcttacggtttctttgttact

SEQ ID NO: 107105 - DNA, 25 bp, Homo sapien
ttaggtagtagaatctcagcacttt

SEQ ID NO: 107106 - DNA, 25 bp, Homo sapien
tgtttcatattctcagatgggctga

SEQ ID NO: 107107 - DNA, 25 bp, Homo sapien
ttggcacatccgtaccatcggtcag

SEQ ID NO: 107108 - DNA, 25 bp, Homo sapien
gtaccatcggtcagcagggccactg

SEQ ID NO: 107109 - DNA, 25 bp, Homo sapien
catctctttgaaacatctggtaatt

SEQ ID NO: 107110 - DNA, 25 bp, Homo sapien
ggtaatttgaattctagtgctcatt

SEQ ID NO: 107111 - DNA, 25 bp, Homo sapien
gttttcattgtgctgatttttggtg

SEQ ID NO: 107112 - DNA, 25 bp, Homo sapien
gctgatttttggtgatcaagcctca

SEQ ID NO: 107113 - DNA, 25 bp, Homo sapien
ttacgtgtgcacagagaggtcacct

SEQ ID NO: 107114 - DNA, 25 bp, Homo sapien
gtgtgcacagagaggtcaccttttt

SEQ ID NO: 107115 - DNA, 25 bp, Homo sapien
ttcaggacattgcattttcaggctt

SEQ ID NO: 107116 - DNA, 25 bp, Homo sapien
taagatcgaccaatgcaagtgttca

SEQ ID NO: 107117 - DNA, 25 bp, Homo sapien
gcaagtgttcataatgactttccaa

SEQ ID NO: 107118 - DNA, 25 bp, Homo sapien
ataatgactttccaattggccctga

SEQ ID NO: 107119 - DNA, 25 bp, Homo sapien
gttctagcatgtgattacttcactc

SEQ ID NO: 107120 - DNA, 25 bp, Homo sapien
aggtcctttctcctgatagtcacct

SEQ ID NO: 107121 - DNA, 25 bp, Homo sapien
gatagtcacctgctggttgttgcca

SEQ ID NO: 107122 - DNA, 25 bp, Homo sapien
gttgccaggttgcagctgctcttgc

SEQ ID NO: 107123 - DNA, 25 bp, Homo sapien
gctgctcttgcatctgggccagaag

SEQ ID NO: 107124 - DNA, 25 bp, Homo sapien
tgcaggctggctgttggcccctctg

SEQ ID NO: 107125 - DNA, 25 bp, Homo sapien
gctgtcctgcagtagaaggtgccgt

SEQ ID NO: 107126 - DNA, 25 bp, Homo sapien
ccgtgagcaggctttgggaacactg

SEQ ID NO: 107127 - DNA, 25 bp, Homo sapien
acgccccgtgtctggatgcacagat

SEQ ID NO: 107128 - DNA, 25 bp, Homo sapien
tggatgcacagatgccatggcctgt

SEQ ID NO: 107129 - DNA, 25 bp, Homo sapien
gggtgctagacacccggcaccattc

SEQ ID NO: 107130 - DNA, 25 bp, Homo sapien
tctcttttcttctcaggatttaaaa

SEQ ID NO: 107131 - DNA, 25 bp, Homo sapien
gggagacacagaacctaccacagcc

SEQ ID NO: 107132 - DNA, 25 bp, Homo sapien
gacacagaacctaccacagccaggg

SEQ ID NO: 107133 - DNA, 25 bp, Homo sapien
ctcttgcctgactctagacactaac

SEQ ID NO: 107134 - DNA, 25 bp, Homo sapien
gcctgactctagacactaacttagt

SEQ ID NO: 107135 - DNA, 25 bp, Homo sapien
gacactaacttagttccaggttcgg

SEQ ID NO: 107136 - DNA, 25 bp, Homo sapien
ctgttggtgctcctgtttccaatag

SEQ ID NO: 107137 - DNA, 25 bp, Homo sapien
tgtttccaatagcttaggtcccatg

SEQ ID NO: 107138 - DNA, 25 bp, Homo sapien
ccaatagcttaggtcccatggtggg

SEQ ID NO: 107139 - DNA, 25 bp, Homo sapien
gtccaggccagttccagattctaaa

SEQ ID NO: 107140 - DNA, 25 bp, Homo sapien
ggccagttccagattctaaactgat

SEQ ID NO: 107141 - DNA, 25 bp, Homo sapien
attgtcaaaacagtgaggaaacatt

SEQ ID NO: 107142 - DNA, 25 bp, Homo sapien
atctgaatttatttggctacactaa

SEQ ID NO: 107143 - DNA, 25 bp, Homo sapien
gaatgcagtatatttagttttccat

SEQ ID NO: 107144 - DNA, 25 bp, Homo sapien
tttccatttgcatgatgtttgtgtg

SEQ ID NO: 107145 - DNA, 25 bp, Homo sapien
atgatgtttgtgtgctatagatgat

SEQ ID NO: 107146 - DNA, 25 bp, Homo sapien
gactgttttcagctctttttatatt

SEQ ID NO: 107147 - DNA, 25 bp, Homo sapien
tttcagctctttttatattgtacat

SEQ ID NO: 107148 - DNA, 25 bp, Homo sapien
atagtcttttatgtaatttactggc

SEQ ID NO: 107149 - DNA, 25 bp, Homo sapien
actggcatatgttttgtagactgtt

SEQ ID NO: 107150 - DNA, 25 bp, Homo sapien
ttttgtagactgtttaatgactgga

SEQ ID NO: 107151 - DNA, 25 bp, Homo sapien
aatgactggatatcttccttcaact

SEQ ID NO: 107152 - DNA, 25 bp, Homo sapien
actggatatcttccttcaacttttg

SEQ ID NO: 107153 - DNA, 25 bp, Homo sapien
ttgagccccaaagatggtggctgca

SEQ ID NO: 107154 - DNA, 25 bp, Homo sapien
tatagcgacttgaataggaaaccat

SEQ ID NO: 107155 - DNA, 25 bp, Homo sapien
taggaaaccatagtatttcattgtt

SEQ ID NO: 107156 - DNA, 25 bp, Homo sapien
gaaacttttatatacgtatcggtca

SEQ ID NO: 107157 - DNA, 25 bp, Homo sapien
tatacgtatcggtcatttctatttc

SEQ ID NO: 107158 - DNA, 25 bp, Homo sapien
gagaactgccaaatgttgccctagt

SEQ ID NO: 107159 - DNA, 25 bp, Homo sapien
ctgccaaatgttgccctagtagcca

SEQ ID NO: 107160 - DNA, 25 bp, Homo sapien
gttgccctagtagccaaaaatatca

SEQ ID NO: 107161 - DNA, 25 bp, Homo sapien
aatatcaggttgctattctgccttt

SEQ ID NO: 107162 - DNA, 25 bp, Homo sapien
atcaggttgctattctgccttttca

SEQ ID NO: 107163 - DNA, 25 bp, Homo sapien
ttgctattctgccttttcagtttga

SEQ ID NO: 107164 - DNA, 25 bp, Homo sapien
gatatactatcttcttgatgtgcag

SEQ ID NO: 107165 - DNA, 25 bp, Homo sapien
gtgcagttttatttagttagctagt

SEQ ID NO: 107166 - DNA, 25 bp, Homo sapien
tgttgaggacttttgcatctatgct

SEQ ID NO: 107167 - DNA, 25 bp, Homo sapien
atgctcatcagggatagtggtctgc

SEQ ID NO: 107168 - DNA, 25 bp, Homo sapien
gggatagtggtctgcagttttcttt

SEQ ID NO: 107169 - DNA, 25 bp, Homo sapien
gggaagatttcctcaattgtttgtt

SEQ ID NO: 107170 - DNA, 25 bp, Homo sapien
ttccaaacttgtagccttgtcttct

SEQ ID NO: 107171 - DNA, 25 bp, Homo sapien
ttgtcttctccctcaggaatgccaa

SEQ ID NO: 107172 - DNA, 25 bp, Homo sapien
ggtttggccttttcacataatctca

SEQ ID NO: 107173 - DNA, 25 bp, Homo sapien
catatttcttagagactttgtccac

SEQ ID NO: 107174 - DNA, 25 bp, Homo sapien
gactttgtccacttcttttgattat

SEQ ID NO: 107175 - DNA, 25 bp, Homo sapien
ttcgcctagaactggccgaaatgaa

SEQ ID NO: 107176 - DNA, 25 bp, Homo sapien
agagaagtatgaagctattgtagaa

SEQ ID NO: 107177 - DNA, 25 bp, Homo sapien
gcaaagcttgctcagtatgaaccac

SEQ ID NO: 107178 - DNA, 25 bp, Homo sapien
ttgctcagtatgaaccacctcagga

SEQ ID NO: 107179 - DNA, 25 bp, Homo sapien
tcagtatgaaccacctcaggaggag

SEQ ID NO: 107180 - DNA, 25 bp, Homo sapien
gaaccacctcaggaggagaagcgtg

SEQ ID NO: 107181 - DNA, 25 bp, Homo sapien
gagaagcgtgctgaataggattctt

SEQ ID NO: 107182 - DNA, 25 bp, Homo sapien
aatggttttgtatgacttgaatagt

SEQ ID NO: 107183 - DNA, 25 bp, Homo sapien
gaacagatgctatagaactctttta

SEQ ID NO: 107184 - DNA, 25 bp, Homo sapien
gtttaattcacctatcacactctgt

SEQ ID NO: 107185 - DNA, 25 bp, Homo sapien
ttcacctatcacactctgttaaaaa

SEQ ID NO: 107186 - DNA, 25 bp, Homo sapien
tacctttcttggatttttgtaccag

SEQ ID NO: 107187 - DNA, 25 bp, Homo sapien
ttttgtaccagagatgtgctaaact

SEQ ID NO: 107188 - DNA, 25 bp, Homo sapien
gagaaagtttccatcttattctttt

SEQ ID NO: 107189 - DNA, 25 bp, Homo sapien
tagactgctcctgcagagtttggaa

SEQ ID NO: 107190 - DNA, 25 bp, Homo sapien
gcaaagccggcctaaccaagaaaag

SEQ ID NO: 107191 - DNA, 25 bp, Homo sapien
ccaagaaaagtcaaggcccttcatg

SEQ ID NO: 107192 - DNA, 25 bp, Homo sapien
ggcacagaaaacaccctcgtggagt

SEQ ID NO: 107193 - DNA, 25 bp, Homo sapien
aacaccctcgtggagtacactaatt

SEQ ID NO: 107194 - DNA, 25 bp, Homo sapien
cactaatttgaactggactggtctc

SEQ ID NO: 107195 - DNA, 25 bp, Homo sapien
gactggtctcagtgtgagcacttgg

SEQ ID NO: 107196 - DNA, 25 bp, Homo sapien
taaacacatatacaaccccaccgtg

SEQ ID NO: 107197 - DNA, 25 bp, Homo sapien
gaagaagtcacctccagttaaggca

SEQ ID NO: 107198 - DNA, 25 bp, Homo sapien
aagtcacctccagttaaggcagtcc

SEQ ID NO: 107199 - DNA, 25 bp, Homo sapien
aaagggattctgtgggccagctgca

SEQ ID NO: 107200 - DNA, 25 bp, Homo sapien
tgtgggccagctgcaactatatcgc

SEQ ID NO: 107201 - DNA, 25 bp, Homo sapien
agctgcaactatatcgccacccaga

SEQ ID NO: 107202 - DNA, 25 bp, Homo sapien
agaccgttcgcagccagcattcttg

SEQ ID NO: 107203 - DNA, 25 bp, Homo sapien
ttcgcagccagcattcttggatgca

SEQ ID NO: 107204 - DNA, 25 bp, Homo sapien
cattcttggatgcaattgaccgacg

SEQ ID NO: 107205 - DNA, 25 bp, Homo sapien
cttggatgcaattgaccgacgggaa

SEQ ID NO: 107206 - DNA, 25 bp, Homo sapien
gaccgacgggaagacacattttatg

SEQ ID NO: 107207 - DNA, 25 bp, Homo sapien
attttatgttgtctctttccgaagg

SEQ ID NO: 107208 - DNA, 25 bp, Homo sapien
tgggccaccgggtactccaggacca

SEQ ID NO: 107209 - DNA, 25 bp, Homo sapien
tccaggaccaattggagttccaggc

SEQ ID NO: 107210 - DNA, 25 bp, Homo sapien
gagttccaggcccagcgggaccaaa

SEQ ID NO: 107211 - DNA, 25 bp, Homo sapien
gcagcaaaggagaccctgggatgac

SEQ ID NO: 107212 - DNA, 25 bp, Homo sapien
gatgacaggaccaacgggagcagct

SEQ ID NO: 107213 - DNA, 25 bp, Homo sapien
accaacgggagcagctgggcttcct

SEQ ID NO: 107214 - DNA, 25 bp, Homo sapien
ttcctggtttacatggaccacccgg

SEQ ID NO: 107215 - DNA, 25 bp, Homo sapien
gaagaaaggctctagagggcctaaa

SEQ ID NO: 107216 - DNA, 25 bp, Homo sapien
aaggagcgcctggattagatgcccc

SEQ ID NO: 107217 - DNA, 25 bp, Homo sapien
atggcttaccagtccaaggctgctg

SEQ ID NO: 107218 - DNA, 25 bp, Homo sapien
ctgctggaacaagtgatgcctctaa

SEQ ID NO: 107219 - DNA, 25 bp, Homo sapien
tcagttgtcgccctcacgagaggaa

SEQ ID NO: 107220 - DNA, 25 bp, Homo sapien
aggagctcttagttacccttttgtg

SEQ ID NO: 107221 - DNA, 25 bp, Homo sapien
tgttctcagcatagagctttctccg

SEQ ID NO: 107222 - DNA, 25 bp, Homo sapien
atagagctttctccgcagcatcctg

SEQ ID NO: 107223 - DNA, 25 bp, Homo sapien
agcatcctgcctgcgtggactggct

SEQ ID NO: 107224 - DNA, 25 bp, Homo sapien
actggctgctaatggagagctccct

SEQ ID NO: 107225 - DNA, 25 bp, Homo sapien
gagacggagcctttagtacagctat

SEQ ID NO: 107226 - DNA, 25 bp, Homo sapien
gtacagctatctgctggctctaaac

SEQ ID NO: 107227 - DNA, 25 bp, Homo sapien
gctctaaaccttctacgcctttggg

SEQ ID NO: 107228 - DNA, 25 bp, Homo sapien
gggccgagcactgaatgtcttgtac

SEQ ID NO: 107229 - DNA, 25 bp, Homo sapien
aatgtttctgagacctctttctact

SEQ ID NO: 107230 - DNA, 25 bp, Homo sapien
ttaggctctcaacatgactatagag

SEQ ID NO: 107231 - DNA, 25 bp, Homo sapien
ggctctcaacatgactatagagacc

SEQ ID NO: 107232 - DNA, 25 bp, Homo sapien
tctcaacatgactatagagaccccg

SEQ ID NO: 107233 - DNA, 25 bp, Homo sapien
tgctgactgcgcctgtcttctccct

SEQ ID NO: 107234 - DNA, 25 bp, Homo sapien
tctccctctgaccccagagaaaggg

SEQ ID NO: 107235 - DNA, 25 bp, Homo sapien
gtcagctgggatcttctgccaccat

SEQ ID NO: 107236 - DNA, 25 bp, Homo sapien
agctgggatcttctgccaccatcag

SEQ ID NO: 107237 - DNA, 25 bp, Homo sapien
gggatcttctgccaccatcagggac

SEQ ID NO: 107238 - DNA, 25 bp, Homo sapien
gatcttctgccaccatcagggacaa

SEQ ID NO: 107239 - DNA, 25 bp, Homo sapien
atcttctgccaccatcagggacaaa

SEQ ID NO: 107240 - DNA, 25 bp, Homo sapien
tcttctgccaccatcagggacaaac

SEQ ID NO: 107241 - DNA, 25 bp, Homo sapien
tccaggaccaattggagttccaggc

SEQ ID NO: 107242 - DNA, 25 bp, Homo sapien
ccaggaccaattggagttccaggcc

SEQ ID NO: 107243 - DNA, 25 bp, Homo sapien
caggcccagcgggaccaaagggcga

SEQ ID NO: 107244 - DNA, 25 bp, Homo sapien
gcagcaaaggagaccctgggatgac

SEQ ID NO: 107245 - DNA, 25 bp, Homo sapien
ggagaccctgggatgacaggaccaa

SEQ ID NO: 107246 - DNA, 25 bp, Homo sapien
gaccctgggatgacaggaccaacgg

SEQ ID NO: 107247 - DNA, 25 bp, Homo sapien
gatgacaggaccaacgggagcagct

SEQ ID NO: 107248 - DNA, 25 bp, Homo sapien
accaacgggagcagctgggcttcct

SEQ ID NO: 107249 - DNA, 25 bp, Homo sapien
caaggagcgcctggattagatgccc

SEQ ID NO: 107250 - DNA, 25 bp, Homo sapien
aaggagcgcctggattagatgcccc

SEQ ID NO: 107251 - DNA, 25 bp, Homo sapien
gagcgcctggattagatgccccctg

SEQ ID NO: 107252 - DNA, 25 bp, Homo sapien
acagccacagccaagtacaagtgca

SEQ ID NO: 107253 - DNA, 25 bp, Homo sapien
gtgtgtcagtgactgcacattggtt

SEQ ID NO: 107254 - DNA, 25 bp, Homo sapien
ctgcacattggtttctgttctctgg

SEQ ID NO: 107255 - DNA, 25 bp, Homo sapien
tttctgttctctggctatttgcaaa

SEQ ID NO: 107256 - DNA, 25 bp, Homo sapien
tctctggctatttgcaaaacctctc

SEQ ID NO: 107257 - DNA, 25 bp, Homo sapien
tccactcacacccatagcgggagag

SEQ ID NO: 107258 - DNA, 25 bp, Homo sapien
agcgggagagacctcatgcagattt

SEQ ID NO: 107259 - DNA, 25 bp, Homo sapien
ggagtaagaattcaatgcagcagct

SEQ ID NO: 107260 - DNA, 25 bp, Homo sapien
aatgcagcagcttaatttttctgta

SEQ ID NO: 107261 - DNA, 25 bp, Homo sapien
cagcttaatttttctgtattgcagt

SEQ ID NO: 107262 - DNA, 25 bp, Homo sapien
aggcttcttgtgtgttaaacttgat

SEQ ID NO: 107263 - DNA, 25 bp, Homo sapien
actaggagtattgagctacgcatca

SEQ ID NO: 107264 - DNA, 25 bp, Homo sapien
agaccattcctgtgatcatttcccc

SEQ ID NO: 107265 - DNA, 25 bp, Homo sapien
tcaagaccatatcagcttctctggg

SEQ ID NO: 107266 - DNA, 25 bp, Homo sapien
gggtcaagactgacaatcccgtgta

SEQ ID NO: 107267 - DNA, 25 bp, Homo sapien
gacaatcccgtgtaaggtgtttctg

SEQ ID NO: 107268 - DNA, 25 bp, Homo sapien
taaggtgtttctgggaaccggcaca

SEQ ID NO: 107269 - DNA, 25 bp, Homo sapien
acacccttaaccaccatgctgtggt

SEQ ID NO: 107270 - DNA, 25 bp, Homo sapien
accatgctgtggtggacggccaatg

SEQ ID NO: 107271 - DNA, 25 bp, Homo sapien
gtggtggacggccaatgacacccac

SEQ ID NO: 107272 - DNA, 25 bp, Homo sapien
atgacacccacatagagagcgccta

SEQ ID NO: 107273 - DNA, 25 bp, Homo sapien
atagagagcgcctacccgggaggcc

SEQ ID NO: 107274 - DNA, 25 bp, Homo sapien
gcggccgcaagaaacgcattccgta

SEQ ID NO: 107275 - DNA, 25 bp, Homo sapien
aagaaacgcattccgtacagcaagg

SEQ ID NO: 107276 - DNA, 25 bp, Homo sapien
gggagtatgcggctaacaagttcat

SEQ ID NO: 107277 - DNA, 25 bp, Homo sapien
ggctaacaagttcatcaccaaggac

SEQ ID NO: 107278 - DNA, 25 bp, Homo sapien
atcaccaaggacaagaggcgcaaga

SEQ ID NO: 107279 - DNA, 25 bp, Homo sapien
aagaggcgcaagatctcggcagcca

SEQ ID NO: 107280 - DNA, 25 bp, Homo sapien
tctcggagcgccagattaccatctg

SEQ ID NO: 107281 - DNA, 25 bp, Homo sapien
agaagaaggttctcgccaaggtgaa

SEQ ID NO: 107282 - DNA, 25 bp, Homo sapien
aggtgaagaacagcgctacccctta

SEQ ID NO: 107283 - DNA, 25 bp, Homo sapien
agaacagcgctaccccttaagagat

SEQ ID NO: 107284 - DNA, 25 bp, Homo sapien
cgctaccccttaagagatctccttg

SEQ ID NO: 107285 - DNA, 25 bp, Homo sapien
ttcatttagtatagtccatcgattg

SEQ ID NO: 107286 - DNA, 25 bp, Homo sapien
gtccatcgattgtatatccgtcctt

SEQ ID NO: 107287 - DNA, 25 bp, Homo sapien
ttgtatatccgtccttttgatggcc

SEQ ID NO: 107288 - DNA, 25 bp, Homo sapien
atccgtccttttgatggccttttga

SEQ ID NO: 107289 - DNA, 25 bp, Homo sapien
gatggccttttgagttgtttcccat

SEQ ID NO: 107290 - DNA, 25 bp, Homo sapien
tttgagttgtttcccatttgcggtt

SEQ ID NO: 107291 - DNA, 25 bp, Homo sapien
agttgtttcccatttgcggttatga

SEQ ID NO: 107292 - DNA, 25 bp, Homo sapien
tatgtgctcatttttgtcgggcttc

SEQ ID NO: 107293 - DNA, 25 bp, Homo sapien
tttttgtcgggcttctgtccttcaa

SEQ ID NO: 107294 - DNA, 25 bp, Homo sapien
cttctgtccttcaatgtactgtctg

SEQ ID NO: 107295 - DNA, 25 bp, Homo sapien
gtactgtctgacattcgttcatgtt

SEQ ID NO: 107296 - DNA, 25 bp, Homo sapien
agtgatcatttcacacccttttgtg

SEQ ID NO: 107297 - DNA, 25 bp, Homo sapien
cacccttttgtgagacggctggaaa

SEQ ID NO: 107298 - DNA, 25 bp, Homo sapien
tttccaattccaaaattccatccct

SEQ ID NO: 107299 - DNA, 25 bp, Homo sapien
attccatccctaagaattcccagat

SEQ ID NO: 107300 - DNA, 25 bp, Homo sapien
aagaattcccagatagtcccagcag

SEQ ID NO: 107301 - DNA, 25 bp, Homo sapien
tggcacctcctcaccttaatttttt

SEQ ID NO: 107302 - DNA, 25 bp, Homo sapien
tatggctctttaaggtgaccgccac

SEQ ID NO: 107303 - DNA, 25 bp, Homo sapien
gtgaccgccaccttggtcctagtgt

SEQ ID NO: 107304 - DNA, 25 bp, Homo sapien
gtcctagtgtctattccctggaatt

SEQ ID NO: 107305 - DNA, 25 bp, Homo sapien
gaattcaccctctcatgtttcccta

SEQ ID NO: 107306 - DNA, 25 bp, Homo sapien
tgtttccctactaacatcccaataa

SEQ ID NO: 107307 - DNA, 25 bp, Homo sapien
tcctgaattctatctgctgggcttt

SEQ ID NO: 107308 - DNA, 25 bp, Homo sapien
ccatggcaccttcagactttgcttc

SEQ ID NO: 107309 - DNA, 25 bp, Homo sapien
actttgcttcccattgtggctccta

SEQ ID NO: 107310 - DNA, 25 bp, Homo sapien
attgtggctcctatctgtgttttga

SEQ ID NO: 107311 - DNA, 25 bp, Homo sapien
ctgtgttttgaatggtgttgtatgc

SEQ ID NO: 107312 - DNA, 25 bp, Homo sapien
gtgttgtatgccttaaatctgtgat

SEQ ID NO: 107313 - DNA, 25 bp, Homo sapien
tgtgatgatcctcatatggcccagt

SEQ ID NO: 107314 - DNA, 25 bp, Homo sapien
atatggcccagtgtcaagttgtgct

SEQ ID NO: 107315 - DNA, 25 bp, Homo sapien
agttgtgcttgtttacacgcatctc

SEQ ID NO: 107316 - DNA, 25 bp, Homo sapien
cttgtttacacgcatctctgtgcca

SEQ ID NO: 107317 - DNA, 25 bp, Homo sapien
cagccacacaaaccgtttacttact

SEQ ID NO: 107318 - DNA, 25 bp, Homo sapien
aatggaactcgtggactctttcctg

SEQ ID NO: 107319 - DNA, 25 bp, Homo sapien
tggaactcgtggactctttcctgga

SEQ ID NO: 107320 - DNA, 25 bp, Homo sapien
gaactcgtggactctttcctggacc

SEQ ID NO: 107321 - DNA, 25 bp, Homo sapien
actcgtggactctttcctggaccct

SEQ ID NO: 107322 - DNA, 25 bp, Homo sapien
gtggactctttcctggaccctcacg

SEQ ID NO: 107323 - DNA, 25 bp, Homo sapien
ggaccctcacgcaggaccctaggag

SEQ ID NO: 107324 - DNA, 25 bp, Homo sapien
gaacatcagacacaggctccctgcc

SEQ ID NO: 107325 - DNA, 25 bp, Homo sapien
acctccagcctggatattctccttc

SEQ ID NO: 107326 - DNA, 25 bp, Homo sapien
ctcctactggacagtatacgctctt

SEQ ID NO: 107327 - DNA, 25 bp, Homo sapien
tactggacagtatacgctcttccct

SEQ ID NO: 107328 - DNA, 25 bp, Homo sapien
ggacagtatacgctcttccctcttc

SEQ ID NO: 107329 - DNA, 25 bp, Homo sapien
tcctcaacatcttccgaagaaagaa

SEQ ID NO: 107330 - DNA, 25 bp, Homo sapien
ttctaatggcaagtctgtgtcatgg

SEQ ID NO: 107331 - DNA, 25 bp, Homo sapien
tggcaagtctgtgtcatggtctgaa

SEQ ID NO: 107332 - DNA, 25 bp, Homo sapien
caagtctgtgtcatggtctgaacca

SEQ ID NO: 107333 - DNA, 25 bp, Homo sapien
aaccaggtggaggacaggtgcccaa

SEQ ID NO: 107334 - DNA, 25 bp, Homo sapien
gacaggtgcccaagggacagcatat

SEQ ID NO: 107335 - DNA, 25 bp, Homo sapien
agggacagcatatgtggcaccgcct

SEQ ID NO: 107336 - DNA, 25 bp, Homo sapien
agcatatgtggcaccgcctctctgt

SEQ ID NO: 107337 - DNA, 25 bp, Homo sapien
gcctctctgtgcacgtgaagaccaa

SEQ ID NO: 107338 - DNA, 25 bp, Homo sapien
tgaagaccaatgagacggcctgcaa

SEQ ID NO: 107339 - DNA, 25 bp, Homo sapien
atgagacggcctgcaaccaaacagc

SEQ ID NO: 107340 - DNA, 25 bp, Homo sapien
cgtgcaaatcggagacccggaaact

SEQ ID NO: 107341 - DNA, 25 bp, Homo sapien
atcggagacccggaaactgatcagg

SEQ ID NO: 107342 - DNA, 25 bp, Homo sapien
ggaaactgatcagggcagctgctct

SEQ ID NO: 107343 - DNA, 25 bp, Homo sapien
gatcagggcagctgctctgtgacat

SEQ ID NO: 107344 - DNA, 25 bp, Homo sapien
agcttgaggctggagcccttgaaag

SEQ ID NO: 107345 - DNA, 25 bp, Homo sapien
aggctggagcccttgaaaggtgaaa

SEQ ID NO: 107346 - DNA, 25 bp, Homo sapien
ccagaactcttttcttagaagggag

SEQ ID NO: 107347 - DNA, 25 bp, Homo sapien
tcttttcttagaagggagaggctgc

SEQ ID NO: 107348 - DNA, 25 bp, Homo sapien
ttttgctcccaatccctatttgaga

SEQ ID NO: 107349 - DNA, 25 bp, Homo sapien
tgctcccaatccctatttgagaaac

SEQ ID NO: 107350 - DNA, 25 bp, Homo sapien
aatccctatttgagaaacactgccc

SEQ ID NO: 107351 - DNA, 25 bp, Homo sapien
gcaagctaaataagcatcttcccac

SEQ ID NO: 107352 - DNA, 25 bp, Homo sapien
atgacccagcctatggtttgccata

SEQ ID NO: 107353 - DNA, 25 bp, Homo sapien
tatggtttgccatactccctctttt

SEQ ID NO: 107354 - DNA, 25 bp, Homo sapien
tttctccgttttttcattaattgtg

SEQ ID NO: 107355 - DNA, 25 bp, Homo sapien
tgcatcaccctttcatgtcagtgct

SEQ ID NO: 107356 - DNA, 25 bp, Homo sapien
tcatgtcagtgctctccaaacctgc

SEQ ID NO: 107357 - DNA, 25 bp, Homo sapien
ttgcacccctctagtcgaaatattt

SEQ ID NO: 107358 - DNA, 25 bp, Homo sapien
gtcgaaatattttgtgcttacccca

SEQ ID NO: 107359 - DNA, 25 bp, Homo sapien
gcttaccccaatatatgtgtgtgac

SEQ ID NO: 107360 - DNA, 25 bp, Homo sapien
gtgtgtgactattgaactctattcg

SEQ ID NO: 107361 - DNA, 25 bp, Homo sapien
ctctattcgtagactgcttgtacta

SEQ ID NO: 107362 - DNA, 25 bp, Homo sapien
aggtacaggtgctcacctcgctcag

SEQ ID NO: 107363 - DNA, 25 bp, Homo sapien
acctcgctcaggagaaacctcggct

SEQ ID NO: 107364 - DNA, 25 bp, Homo sapien
tcgctcaggagaaacctcggcttct

SEQ ID NO: 107365 - DNA, 25 bp, Homo sapien
ctcaggagaaacctcggcttctggg

SEQ ID NO: 107366 - DNA, 25 bp, Homo sapien
ccccaggagcaggaacatgccatgt

SEQ ID NO: 107367 - DNA, 25 bp, Homo sapien
caggagcaggaacatgccatgtagt

SEQ ID NO: 107368 - DNA, 25 bp, Homo sapien
ggaacatgccatgtagtgggcgccc

SEQ ID NO: 107369 - DNA, 25 bp, Homo sapien
aacatgccatgtagtgggcgccctg

SEQ ID NO: 107370 - DNA, 25 bp, Homo sapien
catgccatgtagtgggcgccctgcc

SEQ ID NO: 107371 - DNA, 25 bp, Homo sapien
atgtagtgggcgccctgcccgtctt

SEQ ID NO: 107372 - DNA, 25 bp, Homo sapien
ctggagtgcagggaacatggaggag

SEQ ID NO: 107373 - DNA, 25 bp, Homo sapien
gtttgtttggatcggttatctctct

SEQ ID NO: 107374 - DNA, 25 bp, Homo sapien
tcggttatctctcttcagcagtcaa

SEQ ID NO: 107375 - DNA, 25 bp, Homo sapien
aacccactagtctacacactgttca

SEQ ID NO: 107376 - DNA, 25 bp, Homo sapien
cactgttcaacaagacctataggtc

SEQ ID NO: 107377 - DNA, 25 bp, Homo sapien
gtcagccttttcacggtatattcag

SEQ ID NO: 107378 - DNA, 25 bp, Homo sapien
gtgaacacaataccggctttggcct

SEQ ID NO: 107379 - DNA, 25 bp, Homo sapien
ggctttggcctacaagtctagccaa

SEQ ID NO: 107380 - DNA, 25 bp, Homo sapien
gtctagccaacttcaaatgggacaa

SEQ ID NO: 107381 - DNA, 25 bp, Homo sapien
aagcaagatgccaagacaacagata

SEQ ID NO: 107382 - DNA, 25 bp, Homo sapien
aatgactgctcaatggttgctctag

SEQ ID NO: 107383 - DNA, 25 bp, Homo sapien
tggttgctctaggaaagcagcattc

SEQ ID NO: 107384 - DNA, 25 bp, Homo sapien
aaaggacctggtagtgcttattcac

SEQ ID NO: 107385 - DNA, 25 bp, Homo sapien
tagtgcttattcaccactgctggtg

SEQ ID NO: 107386 - DNA, 25 bp, Homo sapien
tgctggtgcttcacacctcaggaaa

SEQ ID NO: 107387 - DNA, 25 bp, Homo sapien
gaaaatattgccatctccactatgc

SEQ ID NO: 107388 - DNA, 25 bp, Homo sapien
cactatgcacacagactccaagagg

SEQ ID NO: 107389 - DNA, 25 bp, Homo sapien
aggtctttaagattggctcgtataa

SEQ ID NO: 107390 - DNA, 25 bp, Homo sapien
gattggctcgtataacaacaggtat

SEQ ID NO: 107391 - DNA, 25 bp, Homo sapien
gataatgctgaagctcttcttgaat

SEQ ID NO: 107392 - DNA, 25 bp, Homo sapien
cttcttgaatgggagctggacaggt

SEQ ID NO: 107393 - DNA, 25 bp, Homo sapien
caaaaatagcaactttatacccact

SEQ ID NO: 107394 - DNA, 25 bp, Homo sapien
ccacttttcctttaggctaagactg

SEQ ID NO: 107395 - DNA, 25 bp, Homo sapien
gccttgctccgaaccttcagctttt

SEQ ID NO: 107396 - DNA, 25 bp, Homo sapien
ttgcttcatggcctacacgttcgag

SEQ ID NO: 107397 - DNA, 25 bp, Homo sapien
ttcatggcctacacgttcgagagag

SEQ ID NO: 107398 - DNA, 25 bp, Homo sapien
ggcctacacgttcgagagagagtct

SEQ ID NO: 107399 - DNA, 25 bp, Homo sapien
cacgttcgagagagagtcttcggga

SEQ ID NO: 107400 - DNA, 25 bp, Homo sapien
ggtaggaaccgtagactcgctcatc

SEQ ID NO: 107401 - DNA, 25 bp, Homo sapien
aggaaccgtagactcgctcatctcg

SEQ ID NO: 107402 - DNA, 25 bp, Homo sapien
gggtttgtccgcatgttgtaatcgt

SEQ ID NO: 107403 - DNA, 25 bp, Homo sapien
gtccgcatgttgtaatcgtgcaaat

SEQ ID NO: 107404 - DNA, 25 bp, Homo sapien
aatcgtgcaaataaacgctcactcc

SEQ ID NO: 107405 - DNA, 25 bp, Homo sapien
gaattagcggtgtatttcttgaagt

SEQ ID NO: 107406 - DNA, 25 bp, Homo sapien
gctgtcctccactgggctaattcta

SEQ ID NO: 107407 - DNA, 25 bp, Homo sapien
actgggctaattctacacccctgtg

SEQ ID NO: 107408 - DNA, 25 bp, Homo sapien
ccatgagtcagagaggcttgcccca

SEQ ID NO: 107409 - DNA, 25 bp, Homo sapien
tcagatgttcgacgccccctaaggt

SEQ ID NO: 107410 - DNA, 25 bp, Homo sapien
agctctgggtgcaggatagcagtcc

SEQ ID NO: 107411 - DNA, 25 bp, Homo sapien
ggatagcagtccagagtccatgccc

SEQ ID NO: 107412 - DNA, 25 bp, Homo sapien
agtccagagtccatgccccgctagg

SEQ ID NO: 107413 - DNA, 25 bp, Homo sapien
ccccgctaggccatctgggtgctgg

SEQ ID NO: 107414 - DNA, 25 bp, Homo sapien
gtgctgggcatggatttctcagcaa

SEQ ID NO: 107415 - DNA, 25 bp, Homo sapien
ttctcagcaaggaagactcattacc

SEQ ID NO: 107416 - DNA, 25 bp, Homo sapien
caaggaagactcattaccttccctc

SEQ ID NO: 107417 - DNA, 25 bp, Homo sapien
gataaggccattttaggtggctcac

SEQ ID NO: 107418 - DNA, 25 bp, Homo sapien
ggtggctcactttctcattaagata

SEQ ID NO: 107419 - DNA, 25 bp, Homo sapien
tatagaaccactttttgtagattag

SEQ ID NO: 107420 - DNA, 25 bp, Homo sapien
atgctacctatttgtgtcacctttt

SEQ ID NO: 107421 - DNA, 25 bp, Homo sapien
gtgtcaccttttgctgaactcacag

SEQ ID NO: 107422 - DNA, 25 bp, Homo sapien
gaactcacagttagacaatccatgg

SEQ ID NO: 107423 - DNA, 25 bp, Homo sapien
agacaatccatggtttaatgcacat

SEQ ID NO: 107424 - DNA, 25 bp, Homo sapien
aaggttactgtaaactgtgttatgt

SEQ ID NO: 107425 - DNA, 25 bp, Homo sapien
ctgtgttatgttggtgcttctgtga

SEQ ID NO: 107426 - DNA, 25 bp, Homo sapien
ttaagttgtggtttcatcatgagtc

SEQ ID NO: 107427 - DNA, 25 bp, Homo sapien
atgagtcttaatgttctttgttgat

SEQ ID NO: 107428 - DNA, 25 bp, Homo sapien
tgctgtccaagttttatactaagat

SEQ ID NO: 107429 - DNA, 25 bp, Homo sapien
taagatatcttacctgtttgttatt

SEQ ID NO: 107430 - DNA, 25 bp, Homo sapien
tatcttacctgtttgttattaacca

SEQ ID NO: 107431 - DNA, 25 bp, Homo sapien
aaggctactgttagctaattgtcac

SEQ ID NO: 107432 - DNA, 25 bp, Homo sapien
gttagctaattgtcacagagaagga

SEQ ID NO: 107433 - DNA, 25 bp, Homo sapien
agtgaatttgaaatccttgacttta

SEQ ID NO: 107434 - DNA, 25 bp, Homo sapien
tttatgtgctacagccagttccatc

SEQ ID NO: 107435 - DNA, 25 bp, Homo sapien
agccagttccatctctgtttgtaaa

SEQ ID NO: 107436 - DNA, 25 bp, Homo sapien
gtaaattcttactttccattccata

SEQ ID NO: 107437 - DNA, 25 bp, Homo sapien
ccattccatatcatattctgttccc

SEQ ID NO: 107438 - DNA, 25 bp, Homo sapien
tcatattctgttccctataacctct

SEQ ID NO: 107439 - DNA, 25 bp, Homo sapien
catgcagacgcattcggccttcaag

SEQ ID NO: 107440 - DNA, 25 bp, Homo sapien
gacgcattcggccttcaagcacttc

SEQ ID NO: 107441 - DNA, 25 bp, Homo sapien
acttccagtgcaagcgctgcaagaa

SEQ ID NO: 107442 - DNA, 25 bp, Homo sapien
gctgcaagaagagcttcgcgctcaa

SEQ ID NO: 107443 - DNA, 25 bp, Homo sapien
aagagcttcgcgctcaagtcctatc

SEQ ID NO: 107444 - DNA, 25 bp, Homo sapien
gctcaagtcctatctcaacaagcac

SEQ ID NO: 107445 - DNA, 25 bp, Homo sapien
tcaacaagcactacgagtcggcctg

SEQ ID NO: 107446 - DNA, 25 bp, Homo sapien
tacgagtcggcctgcttcaagggcg

SEQ ID NO: 107447 - DNA, 25 bp, Homo sapien
agccaggtcggctctcagcaatacg

SEQ ID NO: 107448 - DNA, 25 bp, Homo sapien
ccagggaagtcttcgctggcgtccg

SEQ ID NO: 107449 - DNA, 25 bp, Homo sapien
ctgcgcgcgcacatgcagacgcatt

SEQ ID NO: 107450 - DNA, 25 bp, Homo sapien
tacttttttacatgttggggggcag

SEQ ID NO: 107451 - DNA, 25 bp, Homo sapien
ggtaaagccatgttttgacttggtg

SEQ ID NO: 107452 - DNA, 25 bp, Homo sapien
aagccatgttttgacttggtgaaaa

SEQ ID NO: 107453 - DNA, 25 bp, Homo sapien
gccatgttttgacttggtgaaaatg

SEQ ID NO: 107454 - DNA, 25 bp, Homo sapien
gggttgtcaaacagcccattaagct

SEQ ID NO: 107455 - DNA, 25 bp, Homo sapien
ggttgtcaaacagcccattaagctc

SEQ ID NO: 107456 - DNA, 25 bp, Homo sapien
tgtcaaacagcccattaagctccct

SEQ ID NO: 107457 - DNA, 25 bp, Homo sapien
acagcccattaagctccctggtatt

SEQ ID NO: 107458 - DNA, 25 bp, Homo sapien
agcccattaagctccctggtatttc

SEQ ID NO: 107459 - DNA, 25 bp, Homo sapien
gcccattaagctccctggtatttca

SEQ ID NO: 107460 - DNA, 25 bp, Homo sapien
cattaagctccctggtatttcacct

SEQ ID NO: 107461 - DNA, 25 bp, Homo sapien
gtgtgtgtacctgttgtatgtccta

SEQ ID NO: 107462 - DNA, 25 bp, Homo sapien
gtacctgttgtatgtcctaaactta

SEQ ID NO: 107463 - DNA, 25 bp, Homo sapien
ggtaaagccatgttttgacttggtg

SEQ ID NO: 107464 - DNA, 25 bp, Homo sapien
aagccatgttttgacttggtgaaaa

SEQ ID NO: 107465 - DNA, 25 bp, Homo sapien
gggttgtcaaacagcccattaagct

SEQ ID NO: 107466 - DNA, 25 bp, Homo sapien
tgtcaaacagcccattaagctccct

SEQ ID NO: 107467 - DNA, 25 bp, Homo sapien
acagcccattaagctccctggtatt

SEQ ID NO: 107468 - DNA, 25 bp, Homo sapien
cattaagctccctggtatttcacct

SEQ ID NO: 107469 - DNA, 25 bp, Homo sapien
tggtatttcaccttcctgtccatct

SEQ ID NO: 107470 - DNA, 25 bp, Homo sapien
tttgaaagggtgcttgtacaatttg

SEQ ID NO: 107471 - DNA, 25 bp, Homo sapien
gagttatctcttattctgaattaaa

SEQ ID NO: 107472 - DNA, 25 bp, Homo sapien
aatgatccctcagtctgagaggtta

SEQ ID NO: 107473 - DNA, 25 bp, Homo sapien
gaatgatcatctgtaatctgagggt

SEQ ID NO: 107474 - DNA, 25 bp, Homo sapien
taatctgagggttaatttctaggca

SEQ ID NO: 107475 - DNA, 25 bp, Homo sapien
tggaaaattcacagagtttcaccct

SEQ ID NO: 107476 - DNA, 25 bp, Homo sapien
gagtttcacccttaagctgtagaga

SEQ ID NO: 107477 - DNA, 25 bp, Homo sapien
taagctgtagagagtgggtcacatt

SEQ ID NO: 107478 - DNA, 25 bp, Homo sapien
acatttgttagccacggaaacatag

SEQ ID NO: 107479 - DNA, 25 bp, Homo sapien
catagaaacatacacaaggccagaa

SEQ ID NO: 107480 - DNA, 25 bp, Homo sapien
aaggagctcaactaaaagtggcata

SEQ ID NO: 107481 - DNA, 25 bp, Homo sapien
agtggcatagagaatacacatataa

SEQ ID NO: 107482 - DNA, 25 bp, Homo sapien
tatttgtcatatgctcctagagagg

SEQ ID NO: 107483 - DNA, 25 bp, Homo sapien
agctgtcttcagcaacattattagt

SEQ ID NO: 107484 - DNA, 25 bp, Homo sapien
atccctttcaagttatgttttgtct

SEQ ID NO: 107485 - DNA, 25 bp, Homo sapien
tcttttttactccattttccctcat

SEQ ID NO: 107486 - DNA, 25 bp, Homo sapien
cattttccctcatcactgttattat

SEQ ID NO: 107487 - DNA, 25 bp, Homo sapien
ctcatcactgttattatttggactt

SEQ ID NO: 107488 - DNA, 25 bp, Homo sapien
gaacacagagtatgggcacggctat

SEQ ID NO: 107489 - DNA, 25 bp, Homo sapien
atgggcacggctatgctaacttgac

SEQ ID NO: 107490 - DNA, 25 bp, Homo sapien
gcacggctatgctaacttgacaaaa

SEQ ID NO: 107491 - DNA, 25 bp, Homo sapien
gacaaaaatgactgatgcaacaatc

SEQ ID NO: 107492 - DNA, 25 bp, Homo sapien
gcaacaatcgagttattagcatttc

SEQ ID NO: 107493 - DNA, 25 bp, Homo sapien
aattgatacaatgcttgactacaaa

SEQ ID NO: 107494 - DNA, 25 bp, Homo sapien
tctgtgtgtgtacctgttgtatgtc

SEQ ID NO: 107495 - DNA, 25 bp, Homo sapien
tgtgtgtgtacctgttgtatgtcct

SEQ ID NO: 107496 - DNA, 25 bp, Homo sapien
gtgtgtgtacctgttgtatgtccta

SEQ ID NO: 107497 - DNA, 25 bp, Homo sapien
tgtgtgtacctgttgtatgtcctaa

SEQ ID NO: 107498 - DNA, 25 bp, Homo sapien
tttgaaagggtgcttgtacaatttg

SEQ ID NO: 107499 - DNA, 25 bp, Homo sapien
tatattttattgaagagttatctct

SEQ ID NO: 107500 - DNA, 25 bp, Homo sapien
attgaagagttatctcttattctga

SEQ ID NO: 107501 - DNA, 25 bp, Homo sapien
ttgaagagttatctcttattctgaa

SEQ ID NO: 107502 - DNA, 25 bp, Homo sapien
tgaagagttatctcttattctgaat

SEQ ID NO: 107503 - DNA, 25 bp, Homo sapien
gagttatctcttattctgaattaaa

SEQ ID NO: 107504 - DNA, 25 bp, Homo sapien
ttctgaattaaattaagcatttgtt

SEQ ID NO: 107505 - DNA, 25 bp, Homo sapien
catgactgcccgctgctgtgacctg

SEQ ID NO: 107506 - DNA, 25 bp, Homo sapien
ggagaaattaaccttcatcaatgat

SEQ ID NO: 107507 - DNA, 25 bp, Homo sapien
tcatcaatgatctgtgtggtccccg

SEQ ID NO: 107508 - DNA, 25 bp, Homo sapien
gatctgtgtggtccccgacgtaaca

SEQ ID NO: 107509 - DNA, 25 bp, Homo sapien
cgacgtaacatctggcgagaccctg

SEQ ID NO: 107510 - DNA, 25 bp, Homo sapien
cctctgctgttacctgagtcctggg

SEQ ID NO: 107511 - DNA, 25 bp, Homo sapien
caactgcttcaacatcaattatctg

SEQ ID NO: 107512 - DNA, 25 bp, Homo sapien
caattatctgaggaacgtggctcta

SEQ ID NO: 107513 - DNA, 25 bp, Homo sapien
aacgtggctctagtgtctggagaca

SEQ ID NO: 107514 - DNA, 25 bp, Homo sapien
gtctggagacactgagaacgccaag

SEQ ID NO: 107515 - DNA, 25 bp, Homo sapien
aggaacaaatatcagctccacctct

SEQ ID NO: 107516 - DNA, 25 bp, Homo sapien
ggacattcgcaacaaagtcatgaac

SEQ ID NO: 107517 - DNA, 25 bp, Homo sapien
gcaacaaagtcatgaactccagcaa

SEQ ID NO: 107518 - DNA, 25 bp, Homo sapien
tgaactccagcaaccagctctgcga

SEQ ID NO: 107519 - DNA, 25 bp, Homo sapien
agcaaccagctctgcgagcagctca

SEQ ID NO: 107520 - DNA, 25 bp, Homo sapien
agcaccacggccctgcaggaaatgg

SEQ ID NO: 107521 - DNA, 25 bp, Homo sapien
ggccctgcaggaaatggtgcaccaa

SEQ ID NO: 107522 - DNA, 25 bp, Homo sapien
atggtgcaccaagtgacagaccttt

SEQ ID NO: 107523 - DNA, 25 bp, Homo sapien
gacagacctttctagaaatgcccag

SEQ ID NO: 107524 - DNA, 25 bp, Homo sapien
gaaatgcccagctgttcaagcgctc

SEQ ID NO: 107525 - DNA, 25 bp, Homo sapien
ctgttcaagcgctctttgctggaga

SEQ ID NO: 107526 - DNA, 25 bp, Homo sapien
gctggagatggcaacgttctgagaa

SEQ ID NO: 107527 - DNA, 25 bp, Homo sapien
gaccatcgccctcatgttagcatgc

SEQ ID NO: 107528 - DNA, 25 bp, Homo sapien
ttagcatgccccagaatgccaacta

SEQ ID NO: 107529 - DNA, 25 bp, Homo sapien
agaatgccaactaaactcctccctt

SEQ ID NO: 107530 - DNA, 25 bp, Homo sapien
ttccttcctaatttcccttcttgca

SEQ ID NO: 107531 - DNA, 25 bp, Homo sapien
tccttcctataacttgatgcatgtg

SEQ ID NO: 107532 - DNA, 25 bp, Homo sapien
tttgggctggtattggtggctttcc

SEQ ID NO: 107533 - DNA, 25 bp, Homo sapien
tattggtggctttccttgtggcaga

SEQ ID NO: 107534 - DNA, 25 bp, Homo sapien
ttccttgtggcagaggatgtctcaa

SEQ ID NO: 107535 - DNA, 25 bp, Homo sapien
aggatgtctcaaacttcagatggga

SEQ ID NO: 107536 - DNA, 25 bp, Homo sapien
agagagcaggactcacaggttggaa

SEQ ID NO: 107537 - DNA, 25 bp, Homo sapien
ataccagaaaatgagggccgctttg

SEQ ID NO: 107538 - DNA, 25 bp, Homo sapien
agaggaaaaagctaccaatcatact

SEQ ID NO: 107539 - DNA, 25 bp, Homo sapien
gaaaaagctaccaatcatactcttg

SEQ ID NO: 107540 - DNA, 25 bp, Homo sapien
tcatactcttgatatccgtctggct

SEQ ID NO: 107541 - DNA, 25 bp, Homo sapien
atactcttgatatccgtctggctgt

SEQ ID NO: 107542 - DNA, 25 bp, Homo sapien
tcttgatatccgtctggctgtgtga

SEQ ID NO: 107543 - DNA, 25 bp, Homo sapien
gtctggctgtgtgaggcacccctac

SEQ ID NO: 107544 - DNA, 25 bp, Homo sapien
gctgtgtgaggcacccctacctcat

SEQ ID NO: 107545 - DNA, 25 bp, Homo sapien
tgtcttgggattgatgaactgtgga

SEQ ID NO: 107546 - DNA, 25 bp, Homo sapien
tgcatggaagatgcctgggctgtct

SEQ ID NO: 107547 - DNA, 25 bp, Homo sapien
tggaagatgcctgggctgtctttgc

SEQ ID NO: 107548 - DNA, 25 bp, Homo sapien
gtaaatagagccattggatctttat

SEQ ID NO: 107549 - DNA, 25 bp, Homo sapien
ttcaccctctgtcagtctagagggc

SEQ ID NO: 107550 - DNA, 25 bp, Homo sapien
gtgtcacctaaatgctagagctcgc

SEQ ID NO: 107551 - DNA, 25 bp, Homo sapien
tagagctcgctgatcagcctcgact

SEQ ID NO: 107552 - DNA, 25 bp, Homo sapien
tgatcagcctcgactgtgccttcta

SEQ ID NO: 107553 - DNA, 25 bp, Homo sapien
tcgactgtgccttctagttgccagc

SEQ ID NO: 107554 - DNA, 25 bp, Homo sapien
tagttgccagccatctgttgtttgc

SEQ ID NO: 107555 - DNA, 25 bp, Homo sapien
ggaaggtgccactcccactgtcctt

SEQ ID NO: 107556 - DNA, 25 bp, Homo sapien
tcccactgtcctttcctaataaaat

SEQ ID NO: 107557 - DNA, 25 bp, Homo sapien
gaggaaattgcatcgcattgtctga

SEQ ID NO: 107558 - DNA, 25 bp, Homo sapien
gcatcgcattgtctgagtaggtgtc

SEQ ID NO: 107559 - DNA, 25 bp, Homo sapien
tgagtaggtgtcattctattctggg

SEQ ID NO: 107560 - DNA, 25 bp, Homo sapien
gggagactttgatgtcagcagttgc

SEQ ID NO: 107561 - DNA, 25 bp, Homo sapien
gagactttgatgtcagcagttgctg

SEQ ID NO: 107562 - DNA, 25 bp, Homo sapien
tgatgtcagcagttgctggtaaaat

SEQ ID NO: 107563 - DNA, 25 bp, Homo sapien
tcaagagccttaaaacatcattcct

SEQ ID NO: 107564 - DNA, 25 bp, Homo sapien
gagccttaaaacatcattccttttt

SEQ ID NO: 107565 - DNA, 25 bp, Homo sapien
gtatgtgtttagaattgaaggtttt

SEQ ID NO: 107566 - DNA, 25 bp, Homo sapien
tgatagcattgtaagcgtatggctt

SEQ ID NO: 107567 - DNA, 25 bp, Homo sapien
gcattgtaagcgtatggctttattt

SEQ ID NO: 107568 - DNA, 25 bp, Homo sapien
ctcttctcattacttgttgcctata

SEQ ID NO: 107569 - DNA, 25 bp, Homo sapien
tctcattacttgttgcctataagcc

SEQ ID NO: 107570 - DNA, 25 bp, Homo sapien
attacttgttgcctataagccaaaa

SEQ ID NO: 107571 - DNA, 25 bp, Homo sapien
accgagcagtcggatgtgaggttca

SEQ ID NO: 107572 - DNA, 25 bp, Homo sapien
gatgtgaggttcagcagtgccgtgt

SEQ ID NO: 107573 - DNA, 25 bp, Homo sapien
gtgcacctcctgcagcggacgcagc

SEQ ID NO: 107574 - DNA, 25 bp, Homo sapien
gggccgctccctgcaagcagtcttt

SEQ ID NO: 107575 - DNA, 25 bp, Homo sapien
tcacgggccacattgtcaacctcgc

SEQ ID NO: 107576 - DNA, 25 bp, Homo sapien
catctacagctttctcggggagacc

SEQ ID NO: 107577 - DNA, 25 bp, Homo sapien
tttctcggggagaccttcagggaca

SEQ ID NO: 107578 - DNA, 25 bp, Homo sapien
acaagctgaggctgtacattgagca

SEQ ID NO: 107579 - DNA, 25 bp, Homo sapien
agctgaggctgtacattgagcagaa

SEQ ID NO: 107580 - DNA, 25 bp, Homo sapien
tgaggctgtacattgagcagaaaac

SEQ ID NO: 107581 - DNA, 25 bp, Homo sapien
aatttgccggccctgaaccgcttct

SEQ ID NO: 107582 - DNA, 25 bp, Homo sapien
ggtgggtgtgctgttgccttccctc

SEQ ID NO: 107583 - DNA, 25 bp, Homo sapien
tctcctcggttcctgatgccttgag

SEQ ID NO: 107584 - DNA, 25 bp, Homo sapien
tcctcggttcctgatgccttgaggg

SEQ ID NO: 107585 - DNA, 25 bp, Homo sapien
gtgtttcagactggcggcaccgttg

SEQ ID NO: 107586 - DNA, 25 bp, Homo sapien
cagactggcggcaccgttgtggccc

SEQ ID NO: 107587 - DNA, 25 bp, Homo sapien
ctggcggcaccgttgtggccctgca

SEQ ID NO: 107588 - DNA, 25 bp, Homo sapien
ccggagatctgaggtgctctggtct

SEQ ID NO: 107589 - DNA, 25 bp, Homo sapien
tggtctgtgggtcagtcctctttcc

SEQ ID NO: 107590 - DNA, 25 bp, Homo sapien
tgtgggtcagtcctctttccttgtc

SEQ ID NO: 107591 - DNA, 25 bp, Homo sapien
tttccttgtcccaggatggagctga

SEQ ID NO: 107592 - DNA, 25 bp, Homo sapien
cttgtcccaggatggagctgatcca

SEQ ID NO: 107593 - DNA, 25 bp, Homo sapien
gactgaaccaagaagataatctcca

SEQ ID NO: 107594 - DNA, 25 bp, Homo sapien
atctccaaaggtccacgatgggctt

SEQ ID NO: 107595 - DNA, 25 bp, Homo sapien
tccaaaggtccacgatgggcttttc

SEQ ID NO: 107596 - DNA, 25 bp, Homo sapien
tgggcttttccaacagctccacctt

SEQ ID NO: 107597 - DNA, 25 bp, Homo sapien
caccttacttcttctcatactattt

SEQ ID NO: 107598 - DNA, 25 bp, Homo sapien
aacagcaacttgtgttcctaacagg

SEQ ID NO: 107599 - DNA, 25 bp, Homo sapien
caggaattttcattgttctataaca

SEQ ID NO: 107600 - DNA, 25 bp, Homo sapien
gcgattattattttagagcatctca

SEQ ID NO: 107601 - DNA, 25 bp, Homo sapien
tcatttataatgtagcagctcataa

SEQ ID NO: 107602 - DNA, 25 bp, Homo sapien
attaaatcggatacttctggagact

SEQ ID NO: 107603 - DNA, 25 bp, Homo sapien
ggagactatgaaatcacactcttaa

SEQ ID NO: 107604 - DNA, 25 bp, Homo sapien
aggtttttcagcttctaccctatcg

SEQ ID NO: 107605 - DNA, 25 bp, Homo sapien
tatcgttcattctcagctctcaggg

SEQ ID NO: 107606 - DNA, 25 bp, Homo sapien
gccagagaagccagggctccaacat

SEQ ID NO: 107607 - DNA, 25 bp, Homo sapien
gggctccaacatgaacacttcttgt

SEQ ID NO: 107608 - DNA, 25 bp, Homo sapien
actgtcatgaccagtgtttcagtca

SEQ ID NO: 107609 - DNA, 25 bp, Homo sapien
gtttcagtcagttctttcaggttgc

SEQ ID NO: 107610 - DNA, 25 bp, Homo sapien
tcaggttgcctgacttacctcattt

SEQ ID NO: 107611 - DNA, 25 bp, Homo sapien
ttctctcatttcctgtaagcaacca

SEQ ID NO: 107612 - DNA, 25 bp, Homo sapien
gcatataagacctctgtatctgcct

SEQ ID NO: 107613 - DNA, 25 bp, Homo sapien
ttgttcaccttcaactgcttctaat

SEQ ID NO: 107614 - DNA, 25 bp, Homo sapien
aactgcttctaattcttcctcaatt

SEQ ID NO: 107615 - DNA, 25 bp, Homo sapien
gagcagaataccgaaggcagacggt

SEQ ID NO: 107616 - DNA, 25 bp, Homo sapien
ggcagacggtaacaagtactccttg

SEQ ID NO: 107617 - DNA, 25 bp, Homo sapien
gtactccttgctggattgaacttca

SEQ ID NO: 107618 - DNA, 25 bp, Homo sapien
ttgaacttcatctgaatggacctct

SEQ ID NO: 107619 - DNA, 25 bp, Homo sapien
atggacctctacagtggttggacaa

SEQ ID NO: 107620 - DNA, 25 bp, Homo sapien
cagtggttggacaaagtattaactc

SEQ ID NO: 107621 - DNA, 25 bp, Homo sapien
gtattaactcagatgggatcccctt

SEQ ID NO: 107622 - DNA, 25 bp, Homo sapien
agatgggatccccttcagtgcgttg

SEQ ID NO: 107623 - DNA, 25 bp, Homo sapien
cagtgcgttgctcaagcatgtcata

SEQ ID NO: 107624 - DNA, 25 bp, Homo sapien
gcatgtcataaagcttcaccaatca

SEQ ID NO: 107625 - DNA, 25 bp, Homo sapien
gcttcaccaatcaagtcccatggaa

SEQ ID NO: 107626 - DNA, 25 bp, Homo sapien
ttctcttttctgcacttaatacctg

SEQ ID NO: 107627 - DNA, 25 bp, Homo sapien
tacctgacagtatgaccgatctctg

SEQ ID NO: 107628 - DNA, 25 bp, Homo sapien
gctggcggtagatttgtgatgtcac

SEQ ID NO: 107629 - DNA, 25 bp, Homo sapien
gtgatgtcacagtgcaaactgcagt

SEQ ID NO: 107630 - DNA, 25 bp, Homo sapien
cagtgactgtaaattggcctggcgt

SEQ ID NO: 107631 - DNA, 25 bp, Homo sapien
ggcctggcgtgtataaacgttttca

SEQ ID NO: 107632 - DNA, 25 bp, Homo sapien
aaacctttattccatgtgctttgct

SEQ ID NO: 107633 - DNA, 25 bp, Homo sapien
gtgctttgcttcattctgtacatag

SEQ ID NO: 107634 - DNA, 25 bp, Homo sapien
gtacatagctctttggctcgtgaac

SEQ ID NO: 107635 - DNA, 25 bp, Homo sapien
ggctcgtgaacctaattgtaaactt

SEQ ID NO: 107636 - DNA, 25 bp, Homo sapien
gggactgatgttctgtttcttgtaa

SEQ ID NO: 107637 - DNA, 25 bp, Homo sapien
ttggggtgctcctccagtttaattc

SEQ ID NO: 107638 - DNA, 25 bp, Homo sapien
taattcctggtttgagggacacctc

SEQ ID NO: 107639 - DNA, 25 bp, Homo sapien
ttcctggtttgagggacacctctaa

SEQ ID NO: 107640 - DNA, 25 bp, Homo sapien
ttgagggacacctctaacatctcgg

SEQ ID NO: 107641 - DNA, 25 bp, Homo sapien
tgtcctcgtctccacttttaggatt

SEQ ID NO: 107642 - DNA, 25 bp, Homo sapien
gtctccacttttaggattccttagg

SEQ ID NO: 107643 - DNA, 25 bp, Homo sapien
taggattccttaggattcccactgc

SEQ ID NO: 107644 - DNA, 25 bp, Homo sapien
ggattccttaggattcccactgccc

SEQ ID NO: 107645 - DNA, 25 bp, Homo sapien
tgccctcccgtttggccatgggtgc

SEQ ID NO: 107646 - DNA, 25 bp, Homo sapien
gtctcagtgtccctggatccttttt

SEQ ID NO: 107647 - DNA, 25 bp, Homo sapien
cagtgtccctggatcctttttcctt

SEQ ID NO: 107648 - DNA, 25 bp, Homo sapien
gggcctgtggctaagtaaaccatac

SEQ ID NO: 107649 - DNA, 25 bp, Homo sapien
gcctgtggctaagtaaaccatacct

SEQ ID NO: 107650 - DNA, 25 bp, Homo sapien
tggctaagtaaaccatacctaacct

SEQ ID NO: 107651 - DNA, 25 bp, Homo sapien
catacctaacctaccccagtgtggg

SEQ ID NO: 107652 - DNA, 25 bp, Homo sapien
taacctaccccagtgtgggtgtggg

SEQ ID NO: 107653 - DNA, 25 bp, Homo sapien
tgggtgtgggcctctgaatataacc

SEQ ID NO: 107654 - DNA, 25 bp, Homo sapien
ggtgtgggcctctgaatataaccca

SEQ ID NO: 107655 - DNA, 25 bp, Homo sapien
tgaatataacccacacccagcgtag

SEQ ID NO: 107656 - DNA, 25 bp, Homo sapien
aatataacccacacccagcgtaggg

SEQ ID NO: 107657 - DNA, 25 bp, Homo sapien
cacttcccatgctggatgggcagaa

SEQ ID NO: 107658 - DNA, 25 bp, Homo sapien
ggatgggcagaagacattgcttatt

SEQ ID NO: 107659 - DNA, 25 bp, Homo sapien
aatgacatttcatccatgtccactg

SEQ ID NO: 107660 - DNA, 25 bp, Homo sapien
atttcatccatgtccactgagcaga

SEQ ID NO: 107661 - DNA, 25 bp, Homo sapien
atgtccactgagcagacgctggcct

SEQ ID NO: 107662 - DNA, 25 bp, Homo sapien
gacacagacagcagtcttgatgcct

SEQ ID NO: 107663 - DNA, 25 bp, Homo sapien
agcagtcttgatgcctcgacgggac

SEQ ID NO: 107664 - DNA, 25 bp, Homo sapien
gacgggaccccttgaaggctgtcga

SEQ ID NO: 107665 - DNA, 25 bp, Homo sapien
accccttgaaggctgtcgatgatag

SEQ ID NO: 107666 - DNA, 25 bp, Homo sapien
aaggctgtcgatgataggttagaaa

SEQ ID NO: 107667 - DNA, 25 bp, Homo sapien
tagaaatagcaaacctgtcagcatt

SEQ ID NO: 107668 - DNA, 25 bp, Homo sapien
gtcagcattgaaggaactctcacct

SEQ ID NO: 107669 - DNA, 25 bp, Homo sapien
acctccgtgggcctgaaatgcttgg

SEQ ID NO: 107670 - DNA, 25 bp, Homo sapien
aatggcagagcactgctgtatctgt

SEQ ID NO: 107671 - DNA, 25 bp, Homo sapien
actgctgtatctgttttatggtcta

SEQ ID NO: 107672 - DNA, 25 bp, Homo sapien
ggtctacatagttaaaatcttctca

SEQ ID NO: 107673 - DNA, 25 bp, Homo sapien
atcttctcagagagcctaaattcta

SEQ ID NO: 107674 - DNA, 25 bp, Homo sapien
ctaatcttcatatttactgttctct

SEQ ID NO: 107675 - DNA, 25 bp, Homo sapien
ggtgcaagtaaccagccagaacatg

SEQ ID NO: 107676 - DNA, 25 bp, Homo sapien
agaacatgggctgccaaatctcaga

SEQ ID NO: 107677 - DNA, 25 bp, Homo sapien
aaatctcagacaacccctgtggaaa

SEQ ID NO: 107678 - DNA, 25 bp, Homo sapien
acaacccctgtggaaacactcatta

SEQ ID NO: 107679 - DNA, 25 bp, Homo sapien
aaagaaccccagaggtcaccaacat

SEQ ID NO: 107680 - DNA, 25 bp, Homo sapien
ggtcaccaacatgtttatatcttga

SEQ ID NO: 107681 - DNA, 25 bp, Homo sapien
tgtgctggttgccacatcttagcaa

SEQ ID NO: 107682 - DNA, 25 bp, Homo sapien
gttgccacatcttagcaagcaccaa

SEQ ID NO: 107683 - DNA, 25 bp, Homo sapien
aaatccaatgcttctgcatactgtg

SEQ ID NO: 107684 - DNA, 25 bp, Homo sapien
gcttctgcatactgtgttatgttac

SEQ ID NO: 107685 - DNA, 25 bp, Homo sapien
gttacagtccagttttgtgtgcttt

SEQ ID NO: 107686 - DNA, 25 bp, Homo sapien
gtgtgctttactacacagtttggtt

SEQ ID NO: 107687 - DNA, 25 bp, Homo sapien
acaggacttctgtgcattgtaaaca

SEQ ID NO: 107688 - DNA, 25 bp, Homo sapien
ggttaaatacctgtgttcagattgt

SEQ ID NO: 107689 - DNA, 25 bp, Homo sapien
gattgtaagatctagtccggacttg

SEQ ID NO: 107690 - DNA, 25 bp, Homo sapien
tctagtccggacttgctgtgtatat

SEQ ID NO: 107691 - DNA, 25 bp, Homo sapien
cccctttgtattatagtcatgcggt

SEQ ID NO: 107692 - DNA, 25 bp, Homo sapien
ctcaaggagaaccagatatcggtgc

SEQ ID NO: 107693 - DNA, 25 bp, Homo sapien
agaaccagatatcggtgcgggcggc

SEQ ID NO: 107694 - DNA, 25 bp, Homo sapien
gaagttgtggccgtgcgccaggagc

SEQ ID NO: 107695 - DNA, 25 bp, Homo sapien
aggagctgtcccactaccgcgccgt

SEQ ID NO: 107696 - DNA, 25 bp, Homo sapien
cgtgctgtcccgataccaggcccag

SEQ ID NO: 107697 - DNA, 25 bp, Homo sapien
ggagctctcctccgccttgctgaga

SEQ ID NO: 107698 - DNA, 25 bp, Homo sapien
gccttgctgagacttacgccctgtt

SEQ ID NO: 107699 - DNA, 25 bp, Homo sapien
tgctgagacttacgccctgttccct

SEQ ID NO: 107700 - DNA, 25 bp, Homo sapien
ctgggtgccccagggacgtgataat

SEQ ID NO: 107701 - DNA, 25 bp, Homo sapien
ggtgccccagggacgtgataatgca

SEQ ID NO: 107702 - DNA, 25 bp, Homo sapien
tgccccagggacgtgataatgcaga

SEQ ID NO: 107703 - DNA, 25 bp, Homo sapien
gtcttagagacatcaagtatggtag

SEQ ID NO: 107704 - DNA, 25 bp, Homo sapien
tggaactctactcaacccattgttg

SEQ ID NO: 107705 - DNA, 25 bp, Homo sapien
gaagaaatctttctccctcaactga

SEQ ID NO: 107706 - DNA, 25 bp, Homo sapien
aaatctttctccctcaactgaaggg

SEQ ID NO: 107707 - DNA, 25 bp, Homo sapien
acccagaggtggatgttatgaacag

SEQ ID NO: 107708 - DNA, 25 bp, Homo sapien
gatgttatgaacagctgtgtctgcc

SEQ ID NO: 107709 - DNA, 25 bp, Homo sapien
gtgtctgccaaacacatttaccctt

SEQ ID NO: 107710 - DNA, 25 bp, Homo sapien
ggccccactttgaagggcaagaaat

SEQ ID NO: 107711 - DNA, 25 bp, Homo sapien
gcaagaaatggcgtctgctctggtg

SEQ ID NO: 107712 - DNA, 25 bp, Homo sapien
gcgtctgctctggtggcttaagtga

SEQ ID NO: 107713 - DNA, 25 bp, Homo sapien
aagtgagcagaacaggtagtattac

SEQ ID NO: 107714 - DNA, 25 bp, Homo sapien
tggcttcaagcacctctgttcatag

SEQ ID NO: 107715 - DNA, 25 bp, Homo sapien
acctctgttcatagagcgtctctga

SEQ ID NO: 107716 - DNA, 25 bp, Homo sapien
cgtctctgaaattgagtctcggtca

SEQ ID NO: 107717 - DNA, 25 bp, Homo sapien
gtctcggtcatgacttatcccgaag

SEQ ID NO: 107718 - DNA, 25 bp, Homo sapien
tatcccgaagtagagcaatgtgttt

SEQ ID NO: 107719 - DNA, 25 bp, Homo sapien
gtagagcaatgtgtttcctctcatt

SEQ ID NO: 107720 - DNA, 25 bp, Homo sapien
gtgtttcctctcattgtagtttcag

SEQ ID NO: 107721 - DNA, 25 bp, Homo sapien
gtagtttcaggactttgtcagtaca

SEQ ID NO: 107722 - DNA, 25 bp, Homo sapien
ggactttgtcagtacaagctctgcc

SEQ ID NO: 107723 - DNA, 25 bp, Homo sapien
tatactcatatcctgaaaagatgtg

SEQ ID NO: 107724 - DNA, 25 bp, Homo sapien
gtttgaaataaaagtgatccctata

SEQ ID NO: 107725 - DNA, 25 bp, Homo sapien
tttgcatcggaaatcagctctacag

SEQ ID NO: 107726 - DNA, 25 bp, Homo sapien
agctctacagttcaggaggaatgtt

SEQ ID NO: 107727 - DNA, 25 bp, Homo sapien
gaatgtttcttgaacctagaggctc

SEQ ID NO: 107728 - DNA, 25 bp, Homo sapien
gaacctagaggctcctatatcaaga

SEQ ID NO: 107729 - DNA, 25 bp, Homo sapien
gctcctatatcaagagtatgtggtt

SEQ ID NO: 107730 - DNA, 25 bp, Homo sapien
gtggttatgacacaccatttcctca

SEQ ID NO: 107731 - DNA, 25 bp, Homo sapien
acaccatttcctcacatttttgaac

SEQ ID NO: 107732 - DNA, 25 bp, Homo sapien
atttttgaaccattctacatcccag

SEQ ID NO: 107733 - DNA, 25 bp, Homo sapien
ttctacatcccagacaaatggaagt

SEQ ID NO: 107734 - DNA, 25 bp, Homo sapien
ggaagtgttatgatgcccttcgaaa

SEQ ID NO: 107735 - DNA, 25 bp, Homo sapien
gatgcccttcgaaaaatgatcaact

SEQ ID NO: 107736 - DNA, 25 bp, Homo sapien
acacggctcacgcttacctcaacca

SEQ ID NO: 107737 - DNA, 25 bp, Homo sapien
caaccatcctggctgcggcgtctgt

SEQ ID NO: 107738 - DNA, 25 bp, Homo sapien
ggctgcggcgtctgtctgaaccacg

SEQ ID NO: 107739 - DNA, 25 bp, Homo sapien
ctgcggcgtctgtctgaaccacgcg

SEQ ID NO: 107740 - DNA, 25 bp, Homo sapien
tctgtctgaaccacgcgggggcctt

SEQ ID NO: 107741 - DNA, 25 bp, Homo sapien
ggcaagggcacaagtcctggatgtt

SEQ ID NO: 107742 - DNA, 25 bp, Homo sapien
gatgttgtgtgtatcgagaggccaa

SEQ ID NO: 107743 - DNA, 25 bp, Homo sapien
gggcacagcggagtctgtcctgtga

SEQ ID NO: 107744 - DNA, 25 bp, Homo sapien
gacgcgcaagtctgagggtctgggc

SEQ ID NO: 107745 - DNA, 25 bp, Homo sapien
tgtgcatttctggttgcaccgcggc

SEQ ID NO: 107746 - DNA, 25 bp, Homo sapien
ccagcaccaacatgtaaccggcatg

SEQ ID NO: 107747 - DNA, 25 bp, Homo sapien
gggctctgatgagtctctcatcgct

SEQ ID NO: 107748 - DNA, 25 bp, Homo sapien
ggctctgatgagtctctcatcgctt

SEQ ID NO: 107749 - DNA, 25 bp, Homo sapien
gctctgatgagtctctcatcgcttg

SEQ ID NO: 107750 - DNA, 25 bp, Homo sapien
ctctgatgagtctctcatcgcttgt

SEQ ID NO: 107751 - DNA, 25 bp, Homo sapien
tctgatgagtctctcatcgcttgta

SEQ ID NO: 107752 - DNA, 25 bp, Homo sapien
ctgatgagtctctcatcgcttgtaa

SEQ ID NO: 107753 - DNA, 25 bp, Homo sapien
tgatgagtctctcatcgcttgtaaa

SEQ ID NO: 107754 - DNA, 25 bp, Homo sapien
gatgagtctctcatcgcttgtaaag

SEQ ID NO: 107755 - DNA, 25 bp, Homo sapien
atgagtctctcatcgcttgtaaagc

SEQ ID NO: 107756 - DNA, 25 bp, Homo sapien
agtctctcatcgcttgtaaagcctg

SEQ ID NO: 107757 - DNA, 25 bp, Homo sapien
gtctctcatcgcttgtaaagcctga

SEQ ID NO: 107758 - DNA, 25 bp, Homo sapien
aatcaaatggatacgctggcagcaa

SEQ ID NO: 107759 - DNA, 25 bp, Homo sapien
aagacctgagtccattacgttgaga

SEQ ID NO: 107760 - DNA, 25 bp, Homo sapien
cattacgttgagaagggacctgctg

SEQ ID NO: 107761 - DNA, 25 bp, Homo sapien
agggacctgctgattgctttgattc

SEQ ID NO: 107762 - DNA, 25 bp, Homo sapien
cctggcaagtgctccctggttgtga

SEQ ID NO: 107763 - DNA, 25 bp, Homo sapien
gggcagttgggcacacacagtgtaa

SEQ ID NO: 107764 - DNA, 25 bp, Homo sapien
gtgtaagagcaattcagagccgtta

SEQ ID NO: 107765 - DNA, 25 bp, Homo sapien
ttcagagccgttagtcctgcactag

SEQ ID NO: 107766 - DNA, 25 bp, Homo sapien
gcactagccctcaagctgctggcaa

SEQ ID NO: 107767 - DNA, 25 bp, Homo sapien
tagagaaggtcgaagggccctgcca

SEQ ID NO: 107768 - DNA, 25 bp, Homo sapien
gccagagatcccttcaattctaaag

SEQ ID NO: 107769 - DNA, 25 bp, Homo sapien
atatgggcggaagtacttccctcag

SEQ ID NO: 107770 - DNA, 25 bp, Homo sapien
cttccctcaggcctatgcaaaaaga

SEQ ID NO: 107771 - DNA, 25 bp, Homo sapien
aaaagaggatccgtgctgtctcctt

SEQ ID NO: 107772 - DNA, 25 bp, Homo sapien
agggagggctgacccagattccctt

SEQ ID NO: 107773 - DNA, 25 bp, Homo sapien
gattcccttccggtgcgtgtgaagc

SEQ ID NO: 107774 - DNA, 25 bp, Homo sapien
cttccggtgcgtgtgaagccacgga

SEQ ID NO: 107775 - DNA, 25 bp, Homo sapien
acggaaggcttggtcccatcggaag

SEQ ID NO: 107776 - DNA, 25 bp, Homo sapien
cacagccgccggaagtggctccgtg

SEQ ID NO: 107777 - DNA, 25 bp, Homo sapien
aggcgcctgcgctaagtcgcgagcc

SEQ ID NO: 107778 - DNA, 25 bp, Homo sapien
taagtcgcgagccaggtttaaccgt

SEQ ID NO: 107779 - DNA, 25 bp, Homo sapien
gagccaggtttaaccgttgcgtcac

SEQ ID NO: 107780 - DNA, 25 bp, Homo sapien
ctctgttacctgcattgtgtgacag

SEQ ID NO: 107781 - DNA, 25 bp, Homo sapien
gtgtgacagcaagatccgttccaag

SEQ ID NO: 107782 - DNA, 25 bp, Homo sapien
agtgatcactgtcctatcaccctat

SEQ ID NO: 107783 - DNA, 25 bp, Homo sapien
tatcaccctatacctagcactgtga

SEQ ID NO: 107784 - DNA, 25 bp, Homo sapien
gacaccacccctaaatcactttgag

SEQ ID NO: 107785 - DNA, 25 bp, Homo sapien
taccattccttctttaaacactctt

SEQ ID NO: 107786 - DNA, 25 bp, Homo sapien
aaccaggctcctgtgatagagttct

SEQ ID NO: 107787 - DNA, 25 bp, Homo sapien
gatagagttcttttaagcccaagat

SEQ ID NO: 107788 - DNA, 25 bp, Homo sapien
ttggttggcgccttgattacttttt

SEQ ID NO: 107789 - DNA, 25 bp, Homo sapien
tgattactttttgttgtcccactct

SEQ ID NO: 107790 - DNA, 25 bp, Homo sapien
tttttgttgtcccactctctgttac

SEQ ID NO: 107791 - DNA, 25 bp, Homo sapien
gacgagattcggaaagcttttgctt

SEQ ID NO: 107792 - DNA, 25 bp, Homo sapien
gaaagcttttgcttcgcctcccttc

SEQ ID NO: 107793 - DNA, 25 bp, Homo sapien
gtctcctcctcagtcatagagcaat

SEQ ID NO: 107794 - DNA, 25 bp, Homo sapien
atagagcaattgtttttcgtccgtt

SEQ ID NO: 107795 - DNA, 25 bp, Homo sapien
gagcaattgtttttcgtccgtttgg

SEQ ID NO: 107796 - DNA, 25 bp, Homo sapien
cgggatatgttactgtccggcagca

SEQ ID NO: 107797 - DNA, 25 bp, Homo sapien
tccggcagcagttttaactggccgt

SEQ ID NO: 107798 - DNA, 25 bp, Homo sapien
aactggccgtatatggcaattcaat

SEQ ID NO: 107799 - DNA, 25 bp, Homo sapien
caaaagactggtttgtttgcttaat

SEQ ID NO: 107800 - DNA, 25 bp, Homo sapien
gtttgcttaatttccttctgttaag

SEQ ID NO: 107801 - DNA, 25 bp, Homo sapien
aaggatgttacaagtttgctaaaag

SEQ ID NO: 107802 - DNA, 25 bp, Homo sapien
ccccgtgaggactaatccagataca

SEQ ID NO: 107803 - DNA, 25 bp, Homo sapien
ggtggtgaccaatgcattaccttct

SEQ ID NO: 107804 - DNA, 25 bp, Homo sapien
accaatgcattaccttctgttcctt

SEQ ID NO: 107805 - DNA, 25 bp, Homo sapien
ctgttccttatgatattctcattat

SEQ ID NO: 107806 - DNA, 25 bp, Homo sapien
tgactgaaagaagacacgagcgaat

SEQ ID NO: 107807 - DNA, 25 bp, Homo sapien
aacttgattgttgagacgccttgct

SEQ ID NO: 107808 - DNA, 25 bp, Homo sapien
agacgccttgctagaggtagagttt

SEQ ID NO: 107809 - DNA, 25 bp, Homo sapien
gatcatagaattgtgctggtcatac

SEQ ID NO: 107810 - DNA, 25 bp, Homo sapien
tgtgctggtcatacatttgtggtct

SEQ ID NO: 107811 - DNA, 25 bp, Homo sapien
tacatttgtggtctgactccttggg

SEQ ID NO: 107812 - DNA, 25 bp, Homo sapien
tttccccggagtacctattgtagat

SEQ ID NO: 107813 - DNA, 25 bp, Homo sapien
atgtgtagagtgtatgtagccagga

SEQ ID NO: 107814 - DNA, 25 bp, Homo sapien
agaagcctctgtggcctttggtgac

SEQ ID NO: 107815 - DNA, 25 bp, Homo sapien
tctgtggcctttggtgacctcacca

SEQ ID NO: 107816 - DNA, 25 bp, Homo sapien
tggtccactgccttttcatatgtgt

SEQ ID NO: 107817 - DNA, 25 bp, Homo sapien
tcatatgtgttgtttctggagacag

SEQ ID NO: 107818 - DNA, 25 bp, Homo sapien
aggaagagcagtggagccttgccca

SEQ ID NO: 107819 - DNA, 25 bp, Homo sapien
cagtggagccttgcccacagggctg

SEQ ID NO: 107820 - DNA, 25 bp, Homo sapien
cacagggctgctgcttcatgcgaga

SEQ ID NO: 107821 - DNA, 25 bp, Homo sapien
ctgctgcttcatgcgagagggagat

SEQ ID NO: 107822 - DNA, 25 bp, Homo sapien
gagccaatttgtgtgagtggtttgt

SEQ ID NO: 107823 - DNA, 25 bp, Homo sapien
cagatacatagtttcattggtcatt

SEQ ID NO: 107824 - DNA, 25 bp, Homo sapien
tgaagtggctggttacatccggcaa

SEQ ID NO: 107825 - DNA, 25 bp, Homo sapien
gttacatccggcaagcgggtgactc

SEQ ID NO: 107826 - DNA, 25 bp, Homo sapien
cgggtgactcccatcaggtaattat

SEQ ID NO: 107827 - DNA, 25 bp, Homo sapien
tcccatcaggtaattattcgaggtg

SEQ ID NO: 107828 - DNA, 25 bp, Homo sapien
attcgaggtggaggacatattttac

SEQ ID NO: 107829 - DNA, 25 bp, Homo sapien
acatattttaccctatgaccagcct

SEQ ID NO: 107830 - DNA, 25 bp, Homo sapien
gagagcttttgacatgattaatcga

SEQ ID NO: 107831 - DNA, 25 bp, Homo sapien
aggatgggatccttatgttggataa

SEQ ID NO: 107832 - DNA, 25 bp, Homo sapien
tatgttggataaactaccttcccga

SEQ ID NO: 107833 - DNA, 25 bp, Homo sapien
taccttcccgaaagagaacatcaga

SEQ ID NO: 107834 - DNA, 25 bp, Homo sapien
catcagaggttttcattgctgaaaa

SEQ ID NO: 107835 - DNA, 25 bp, Homo sapien
gtgtttctctcctgaggcaaagccc

SEQ ID NO: 107836 - DNA, 25 bp, Homo sapien
aaagcccaacacacctgtcttttgt

SEQ ID NO: 107837 - DNA, 25 bp, Homo sapien
tgtcttttgtccacttctccagcaa

SEQ ID NO: 107838 - DNA, 25 bp, Homo sapien
ttgtccacttctccagcaaattaga

SEQ ID NO: 107839 - DNA, 25 bp, Homo sapien
gcaaattagatttgtctctgggaat

SEQ ID NO: 107840 - DNA, 25 bp, Homo sapien
ttgtctctgggaatgtgtttgtaac

SEQ ID NO: 107841 - DNA, 25 bp, Homo sapien
gtgtttgtaacataccaacctactg

SEQ ID NO: 107842 - DNA, 25 bp, Homo sapien
tgtaacataccaacctactgcagac

SEQ ID NO: 107843 - DNA, 25 bp, Homo sapien
ggagctcccatgttgaatttgtttg

SEQ ID NO: 107844 - DNA, 25 bp, Homo sapien
aaactatttcttggcgacctttgag

SEQ ID NO: 107845 - DNA, 25 bp, Homo sapien
tcttggcgacctttgagagatttca

SEQ ID NO: 107846 - DNA, 25 bp, Homo sapien
ttatttaaccagttacttccacctg

SEQ ID NO: 107847 - DNA, 25 bp, Homo sapien
acttccacctggacatacgatagga

SEQ ID NO: 107848 - DNA, 25 bp, Homo sapien
aaattgatcttaataactctccctt

SEQ ID NO: 107849 - DNA, 25 bp, Homo sapien
tcccttcatatcttttcacctattt

SEQ ID NO: 107850 - DNA, 25 bp, Homo sapien
tttcacctatttccagtccttatca

SEQ ID NO: 107851 - DNA, 25 bp, Homo sapien
atttccagtccttatcatagttgat

SEQ ID NO: 107852 - DNA, 25 bp, Homo sapien
gttgataaaaacctcagactcatcc

SEQ ID NO: 107853 - DNA, 25 bp, Homo sapien
ctcagactcatccagaaagctatat

SEQ ID NO: 107854 - DNA, 25 bp, Homo sapien
aaatggtatacaatttgccagctgt

SEQ ID NO: 107855 - DNA, 25 bp, Homo sapien
ttgccagctgttactgaaccttcta

SEQ ID NO: 107856 - DNA, 25 bp, Homo sapien
tgaaccttctatgcataactttttt

SEQ ID NO: 107857 - DNA, 25 bp, Homo sapien
gaggtattgtcttcagtatgactag

SEQ ID NO: 107858 - DNA, 25 bp, Homo sapien
gtatgactagaagatcgcactgaaa

SEQ ID NO: 107859 - DNA, 25 bp, Homo sapien
atgactagaagatcgcactgaaagc

SEQ ID NO: 107860 - DNA, 25 bp, Homo sapien
caagactccttagaactgtcctcag

SEQ ID NO: 107861 - DNA, 25 bp, Homo sapien
taaagaagccttcagcaaagctgcc

SEQ ID NO: 107862 - DNA, 25 bp, Homo sapien
aagaagccttcagcaaagctgccca

SEQ ID NO: 107863 - DNA, 25 bp, Homo sapien
gcaaagctgcccagcaaacaaaagg

SEQ ID NO: 107864 - DNA, 25 bp, Homo sapien
agtggtgcatgtgattgacgttgac

SEQ ID NO: 107865 - DNA, 25 bp, Homo sapien
tggtgcatgtgattgacgttgaccg

SEQ ID NO: 107866 - DNA, 25 bp, Homo sapien
gggaaagaccaatctggagaggtat

SEQ ID NO: 107867 - DNA, 25 bp, Homo sapien
atctggagaggtattgtcttcagta

SEQ ID NO: 107868 - DNA, 25 bp, Homo sapien
atcatctacatatttgtccacttca

SEQ ID NO: 107869 - DNA, 25 bp, Homo sapien
tgtccacttcactctgaacaacatg

SEQ ID NO: 107870 - DNA, 25 bp, Homo sapien
gaacaacatgtgtcgccttctgtaa

SEQ ID NO: 107871 - DNA, 25 bp, Homo sapien
gtgtcgccttctgtaaaaccttatt

SEQ ID NO: 107872 - DNA, 25 bp, Homo sapien
aaaaccttattcttggagtatgtca

SEQ ID NO: 107873 - DNA, 25 bp, Homo sapien
tgtgtgtcctttgtgcacctacata

SEQ ID NO: 107874 - DNA, 25 bp, Homo sapien
aatattcgctgcaattcacacttcc

SEQ ID NO: 107875 - DNA, 25 bp, Homo sapien
cacttcccagtcatctgtcgtaata

SEQ ID NO: 107876 - DNA, 25 bp, Homo sapien
tgtcgtaatagccatttcatccaaa

SEQ ID NO: 107877 - DNA, 25 bp, Homo sapien
aagtgcccatagaagaactcccaca

SEQ ID NO: 107878 - DNA, 25 bp, Homo sapien
ttttttcctcacaggagcggaagaa

SEQ ID NO: 107879 - DNA, 25 bp, Homo sapien
gggcagctgcttatggcaccagtag

SEQ ID NO: 107880 - DNA, 25 bp, Homo sapien
ggcaccagtagctatacagctcaag

SEQ ID NO: 107881 - DNA, 25 bp, Homo sapien
gctcaagaatatggtgctggcactt

SEQ ID NO: 107882 - DNA, 25 bp, Homo sapien
tggtgctggcacttatggagctagt

SEQ ID NO: 107883 - DNA, 25 bp, Homo sapien
tatggagctagtagcaccacctcaa

SEQ ID NO: 107884 - DNA, 25 bp, Homo sapien
gtagcaccacctcaactgggagaag

SEQ ID NO: 107885 - DNA, 25 bp, Homo sapien
agaagttcacagagctctagccagc

SEQ ID NO: 107886 - DNA, 25 bp, Homo sapien
gctctagccagcagtttagtgggat

SEQ ID NO: 107887 - DNA, 25 bp, Homo sapien
gcagccacagccactgatgtcacaa

SEQ ID NO: 107888 - DNA, 25 bp, Homo sapien
gatgtcacaacagtttgcacagcct

SEQ ID NO: 107889 - DNA, 25 bp, Homo sapien
accactcaagtggtagtgactccag

SEQ ID NO: 107890 - DNA, 25 bp, Homo sapien
gttcagacttctgggattcgaaccc

SEQ ID NO: 107891 - DNA, 25 bp, Homo sapien
gagaaagctctccactctgaaagat

SEQ ID NO: 107892 - DNA, 25 bp, Homo sapien
agatgaaagttctcgggcctggaca

SEQ ID NO: 107893 - DNA, 25 bp, Homo sapien
gggcctggacagaatctagtattaa

SEQ ID NO: 107894 - DNA, 25 bp, Homo sapien
cacgtagggcgatatttattttcca

SEQ ID NO: 107895 - DNA, 25 bp, Homo sapien
agcctggctccttggagattgctca

SEQ ID NO: 107896 - DNA, 25 bp, Homo sapien
gattgctcagatcagccagtactgc

SEQ ID NO: 107897 - DNA, 25 bp, Homo sapien
agtactgcaacctcgtgtcctttgt

SEQ ID NO: 107898 - DNA, 25 bp, Homo sapien
tttgtcctcttctacctcagtgctg

SEQ ID NO: 107899 - DNA, 25 bp, Homo sapien
accccattctgtacaacatcatgtc

SEQ ID NO: 107900 - DNA, 25 bp, Homo sapien
catcatgtccaagaagtaccgggtg

SEQ ID NO: 107901 - DNA, 25 bp, Homo sapien
ttccagagcctgcacaacgggctgc

SEQ ID NO: 107902 - DNA, 25 bp, Homo sapien
tcctgcacatgttggagtgatggtg

SEQ ID NO: 107903 - DNA, 25 bp, Homo sapien
agtgatggtgcctccagcaaccgct

SEQ ID NO: 107904 - DNA, 25 bp, Homo sapien
tgtccctgagtcatgtgggcttgaa

SEQ ID NO: 107905 - DNA, 25 bp, Homo sapien
gtgggcttgaatcctgactttcact

SEQ ID NO: 107906 - DNA, 25 bp, Homo sapien
gactttcactcagagcaggtggttt

SEQ ID NO: 107907 - DNA, 25 bp, Homo sapien
agggtttccactagacattacttga

SEQ ID NO: 107908 - DNA, 25 bp, Homo sapien
tacttgaaaggccagattactcagc

SEQ ID NO: 107909 - DNA, 25 bp, Homo sapien
attactcagcagatctcccatgttg

SEQ ID NO: 107910 - DNA, 25 bp, Homo sapien
agatctcccatgttggctcaacaat

SEQ ID NO: 107911 - DNA, 25 bp, Homo sapien
tgttggctcaacaattctttgtttt

SEQ ID NO: 107912 - DNA, 25 bp, Homo sapien
aggagcagagcttcgtagcgcatgt

SEQ ID NO: 107913 - DNA, 25 bp, Homo sapien
agcagagcttcgtagcgcatgtcat

SEQ ID NO: 107914 - DNA, 25 bp, Homo sapien
cagagcttcgtagcgcatgtcatgg

SEQ ID NO: 107915 - DNA, 25 bp, Homo sapien
agcttcgtagcgcatgtcatggcct

SEQ ID NO: 107916 - DNA, 25 bp, Homo sapien
gtagcgcatgtcatggccttcgctg

SEQ ID NO: 107917 - DNA, 25 bp, Homo sapien
gcatgtcatggccttcgctgcctgt

SEQ ID NO: 107918 - DNA, 25 bp, Homo sapien
tgtcatggccttcgctgcctgtctg

SEQ ID NO: 107919 - DNA, 25 bp, Homo sapien
gttgccgcgtcgctgccactgctgg

SEQ ID NO: 107920 - DNA, 25 bp, Homo sapien
tgagtgccccactccggagttatcc

SEQ ID NO: 107921 - DNA, 25 bp, Homo sapien
gaacacacacaggtgtcctgccgtt

SEQ ID NO: 107922 - DNA, 25 bp, Homo sapien
acacacaggtgtcctgccgttggac

SEQ ID NO: 107923 - DNA, 25 bp, Homo sapien
ttgcctttccagcttaattatttta

SEQ ID NO: 107924 - DNA, 25 bp, Homo sapien
tgcctttccagcttaattattttaa

SEQ ID NO: 107925 - DNA, 25 bp, Homo sapien
gcctttccagcttaattattttaag

SEQ ID NO: 107926 - DNA, 25 bp, Homo sapien
tttaaggaacaaatgaaaactctgg

SEQ ID NO: 107927 - DNA, 25 bp, Homo sapien
aaggaacaaatgaaaactctgggct

SEQ ID NO: 107928 - DNA, 25 bp, Homo sapien
aggaacaaatgaaaactctgggctg

SEQ ID NO: 107929 - DNA, 25 bp, Homo sapien
gaacaaatgaaaactctgggctggg

SEQ ID NO: 107930 - DNA, 25 bp, Homo sapien
acaaatgaaaactctgggctgggtg

SEQ ID NO: 107931 - DNA, 25 bp, Homo sapien
ggttgcattcaactgagatcatacc

SEQ ID NO: 107932 - DNA, 25 bp, Homo sapien
gttgcattcaactgagatcatacca

SEQ ID NO: 107933 - DNA, 25 bp, Homo sapien
ttgcattcaactgagatcataccac

SEQ ID NO: 107934 - DNA, 25 bp, Homo sapien
ggtcgctgctgtgatacataggagg

SEQ ID NO: 107935 - DNA, 25 bp, Homo sapien
ctgtgatacataggaggaagagctc

SEQ ID NO: 107936 - DNA, 25 bp, Homo sapien
gctgcaggagccctgcaccctgaga

SEQ ID NO: 107937 - DNA, 25 bp, Homo sapien
tgcaggagccctgcaccctgagatg

SEQ ID NO: 107938 - DNA, 25 bp, Homo sapien
caggagccctgcaccctgagatgga

SEQ ID NO: 107939 - DNA, 25 bp, Homo sapien
aggagccctgcaccctgagatggaa

SEQ ID NO: 107940 - DNA, 25 bp, Homo sapien
ccctgcaccctgagatggaagccgt

SEQ ID NO: 107941 - DNA, 25 bp, Homo sapien
acttgggcatcgtttctggcccagc

SEQ ID NO: 107942 - DNA, 25 bp, Homo sapien
cttgggcatcgtttctggcccagct

SEQ ID NO: 107943 - DNA, 25 bp, Homo sapien
tgggcatcgtttctggcccagctgt

SEQ ID NO: 107944 - DNA, 25 bp, Homo sapien
gggcatcgtttctggcccagctgtc

SEQ ID NO: 107945 - DNA, 25 bp, Homo sapien
gatgtatttttcttgctgttcagtg

SEQ ID NO: 107946 - DNA, 25 bp, Homo sapien
gttcagtgctttttccttttcatct

SEQ ID NO: 107947 - DNA, 25 bp, Homo sapien
ttttcatctgttgttctgtggtcac

SEQ ID NO: 107948 - DNA, 25 bp, Homo sapien
gtcacagtgaccttagctacatagc

SEQ ID NO: 107949 - DNA, 25 bp, Homo sapien
agctacatagcagactttcccaaat

SEQ ID NO: 107950 - DNA, 25 bp, Homo sapien
acagttgttacttagcaagacctga

SEQ ID NO: 107951 - DNA, 25 bp, Homo sapien
atatgtctgcaggtttctccttgaa

SEQ ID NO: 107952 - DNA, 25 bp, Homo sapien
ttcaccctccgttgacagtatatgt

SEQ ID NO: 107953 - DNA, 25 bp, Homo sapien
cagtatatgtcatgcctcactttct

SEQ ID NO: 107954 - DNA, 25 bp, Homo sapien
tcactttcttctagctgagctttaa

SEQ ID NO: 107955 - DNA, 25 bp, Homo sapien
attgtcagatcgttcattgcctttc

SEQ ID NO: 107956 - DNA, 25 bp, Homo sapien
cccaaatgctgctgtggttcaacca

SEQ ID NO: 107957 - DNA, 25 bp, Homo sapien
ggttcaaccaggcaagatcatccgg

SEQ ID NO: 107958 - DNA, 25 bp, Homo sapien
tcatccggtgaaagaaccagtccct

SEQ ID NO: 107959 - DNA, 25 bp, Homo sapien
ttctcctttcctggagctggtttag

SEQ ID NO: 107960 - DNA, 25 bp, Homo sapien
agctagactgccttgaggctgctgt

SEQ ID NO: 107961 - DNA, 25 bp, Homo sapien
tgaggctgctgtcctttcacagcca

SEQ ID NO: 107962 - DNA, 25 bp, Homo sapien
tgtcctttcacagccatggagtaga

SEQ ID NO: 107963 - DNA, 25 bp, Homo sapien
gagtagaggcctaagttgacactgc

SEQ ID NO: 107964 - DNA, 25 bp, Homo sapien
ctaagttgacactgccctgggcaga

SEQ ID NO: 107965 - DNA, 25 bp, Homo sapien
agacaagacaggagctgtcgcccca

SEQ ID NO: 107966 - DNA, 25 bp, Homo sapien
tgtactgctgctgcgacctgatgct

SEQ ID NO: 107967 - DNA, 25 bp, Homo sapien
aacgaactgaactaggcctggtgga

SEQ ID NO: 107968 - DNA, 25 bp, Homo sapien
cgaactgaactaggcctggtggaag

SEQ ID NO: 107969 - DNA, 25 bp, Homo sapien
ggaaggaggcgcactttcctcctgg

SEQ ID NO: 107970 - DNA, 25 bp, Homo sapien
gcactttcctcctggcagaatgcta

SEQ ID NO: 107971 - DNA, 25 bp, Homo sapien
ggcagaatgctagctctgagccagt

SEQ ID NO: 107972 - DNA, 25 bp, Homo sapien
aatgctagctctgagccagttcagt

SEQ ID NO: 107973 - DNA, 25 bp, Homo sapien
tagctctgagccagttcagtacctg

SEQ ID NO: 107974 - DNA, 25 bp, Homo sapien
tgagccagttcagtacctggaggag

SEQ ID NO: 107975 - DNA, 25 bp, Homo sapien
ccgagtgagagcgtgctccagcctg

SEQ ID NO: 107976 - DNA, 25 bp, Homo sapien
ggctcccacaggcagctttaaccat

SEQ ID NO: 107977 - DNA, 25 bp, Homo sapien
cccacaggcagctttaaccattaaa

SEQ ID NO: 107978 - DNA, 25 bp, Homo sapien
gaaataccgacctaagatgcgatta

SEQ ID NO: 107979 - DNA, 25 bp, Homo sapien
atgcgattacgcttcagagatacca

SEQ ID NO: 107980 - DNA, 25 bp, Homo sapien
acgcttcagagataccaatgggcat

SEQ ID NO: 107981 - DNA, 25 bp, Homo sapien
ccaatgggcattgctgtgttcagta

SEQ ID NO: 107982 - DNA, 25 bp, Homo sapien
ggaaatgtaaacgaaggctgacttg

SEQ ID NO: 107983 - DNA, 25 bp, Homo sapien
gctgacttgattgtgccatttagag

SEQ ID NO: 107984 - DNA, 25 bp, Homo sapien
attgtgccatttagagggaactctt

SEQ ID NO: 107985 - DNA, 25 bp, Homo sapien
gaactcttggtacctggaaatgtga

SEQ ID NO: 107986 - DNA, 25 bp, Homo sapien
gaatctggaatattacctgtgtcat

SEQ ID NO: 107987 - DNA, 25 bp, Homo sapien
attacctgtgtcatcaaagtagtga

SEQ ID NO: 107988 - DNA, 25 bp, Homo sapien
gatggattcagtactcctcaaccac

SEQ ID NO: 107989 - DNA, 25 bp, Homo sapien
gtggccaccgtctgtgaagtggctt

SEQ ID NO: 107990 - DNA, 25 bp, Homo sapien
gaagtggctttacgcttcaggaagc

SEQ ID NO: 107991 - DNA, 25 bp, Homo sapien
acacgcatgtgcacagaatcgccaa

SEQ ID NO: 107992 - DNA, 25 bp, Homo sapien
acagaatcgccaacaggctgaggtg

SEQ ID NO: 107993 - DNA, 25 bp, Homo sapien
ggtggaccaagaaggcaaccaagtc

SEQ ID NO: 107994 - DNA, 25 bp, Homo sapien
cctagggagctgtggcacgagatca

SEQ ID NO: 107995 - DNA, 25 bp, Homo sapien
ctgtggcacgagatcaatggactct

SEQ ID NO: 107996 - DNA, 25 bp, Homo sapien
tcttggtgggcttcggccagcagac

SEQ ID NO: 107997 - DNA, 25 bp, Homo sapien
tcggccagcagacctgtctgcctgt

SEQ ID NO: 107998 - DNA, 25 bp, Homo sapien
cagggtctctgatggccgcatggct

SEQ ID NO: 107999 - DNA, 25 bp, Homo sapien
ctgatggccgcatggctctggccga

SEQ ID NO: 108000 - DNA, 25 bp, Homo sapien
gactttacctacaacagttccattg

SEQ ID NO: 108001 - DNA, 25 bp, Homo sapien
agttccattgtcagcacagcctagg

SEQ ID NO: 108002 - DNA, 25 bp, Homo sapien
attgtcagcacagcctaggagggtc

SEQ ID NO: 108003 - DNA, 25 bp, Homo sapien
ggagggtcagattcctgtattaatt

SEQ ID NO: 108004 - DNA, 25 bp, Homo sapien
taattactcttagtggagatgccag

SEQ ID NO: 108005 - DNA, 25 bp, Homo sapien
ggagatgccagatatcccatacaga

SEQ ID NO: 108006 - DNA, 25 bp, Homo sapien
atatcccatacagaattagcagaga

SEQ ID NO: 108007 - DNA, 25 bp, Homo sapien
gaaaatacacacaggcttctattca

SEQ ID NO: 108008 - DNA, 25 bp, Homo sapien
caggcttctattcaaattttcttta

SEQ ID NO: 108009 - DNA, 25 bp, Homo sapien
aatcagacactgcaggtttgtatat

SEQ ID NO: 108010 - DNA, 25 bp, Homo sapien
aaagggcaaactgggctgatgtaaa

SEQ ID NO: 108011 - DNA, 25 bp, Homo sapien
tggtcctcctcaatgccactgtgga

SEQ ID NO: 108012 - DNA, 25 bp, Homo sapien
gtggaatccaccagcgctgtctgcc

SEQ ID NO: 108013 - DNA, 25 bp, Homo sapien
ctgccagagccgaacatcttatatc

SEQ ID NO: 108014 - DNA, 25 bp, Homo sapien
gttttgagtttgtgcctgtggtatc

SEQ ID NO: 108015 - DNA, 25 bp, Homo sapien
tgcctgtggtatctctctccaaaaa

SEQ ID NO: 108016 - DNA, 25 bp, Homo sapien
cagtcagtttgaacagattcggaaa

SEQ ID NO: 108017 - DNA, 25 bp, Homo sapien
ttcggaaaagcccagattgcacatt

SEQ ID NO: 108018 - DNA, 25 bp, Homo sapien
cattttactgtgcagattctgagaa

SEQ ID NO: 108019 - DNA, 25 bp, Homo sapien
aaacagcaactcgaggagaagtaca

SEQ ID NO: 108020 - DNA, 25 bp, Homo sapien
gaactgaggacacttttattacaac

SEQ ID NO: 108021 - DNA, 25 bp, Homo sapien
caacagagcaatgtctgatcacagg

SEQ ID NO: 108022 - DNA, 25 bp, Homo sapien
ggtgggtgtgctgttgccttccctc

SEQ ID NO: 108023 - DNA, 25 bp, Homo sapien
tctcctcggttcctgatgccttgag

SEQ ID NO: 108024 - DNA, 25 bp, Homo sapien
gtgtttcagactggcggcaccgttg

SEQ ID NO: 108025 - DNA, 25 bp, Homo sapien
ttgtggccctgcagccggagatctg

SEQ ID NO: 108026 - DNA, 25 bp, Homo sapien
ccggagatctgaggtgctctggtct

SEQ ID NO: 108027 - DNA, 25 bp, Homo sapien
tggtctgtgggtcagtcctctttcc

SEQ ID NO: 108028 - DNA, 25 bp, Homo sapien
tgtgggtcagtcctctttccttgtc

SEQ ID NO: 108029 - DNA, 25 bp, Homo sapien
tttccttgtcccaggatggagctga

SEQ ID NO: 108030 - DNA, 25 bp, Homo sapien
ggagctgatccagtaacctcggaga

SEQ ID NO: 108031 - DNA, 25 bp, Homo sapien
cagtaacctcggagacgggaccctg

SEQ ID NO: 108032 - DNA, 25 bp, Homo sapien
gaagcctgggtgtcaagtgcctgca

SEQ ID NO: 108033 - DNA, 25 bp, Homo sapien
cagctactccagaaaatagggttat

SEQ ID NO: 108034 - DNA, 25 bp, Homo sapien
atagggttatgtgtgtcattcatga

SEQ ID NO: 108035 - DNA, 25 bp, Homo sapien
gtgtgtcattcatgaatctctataa

SEQ ID NO: 108036 - DNA, 25 bp, Homo sapien
gacaaggataattcagtcatgaacc

SEQ ID NO: 108037 - DNA, 25 bp, Homo sapien
tttctggatgctcctccacataaat

SEQ ID NO: 108038 - DNA, 25 bp, Homo sapien
ggatgctcctccacataaataattg

SEQ ID NO: 108039 - DNA, 25 bp, Homo sapien
ccattatcttcattctgcaagggaa

SEQ ID NO: 108040 - DNA, 25 bp, Homo sapien
atcttcattctgcaagggaaaggga

SEQ ID NO: 108041 - DNA, 25 bp, Homo sapien
gcagtggtgggtgtctgaaacctca

SEQ ID NO: 108042 - DNA, 25 bp, Homo sapien
gtggtgggtgtctgaaacctcagaa

SEQ ID NO: 108043 - DNA, 25 bp, Homo sapien
gaaacctcagaaacataacgttgaa

SEQ ID NO: 108044 - DNA, 25 bp, Homo sapien
tcatatatttgaagtggagccatat

SEQ ID NO: 108045 - DNA, 25 bp, Homo sapien
gagccatatgaatgtcagtagttta

SEQ ID NO: 108046 - DNA, 25 bp, Homo sapien
gaatgtcagtagtttatacttctct

SEQ ID NO: 108047 - DNA, 25 bp, Homo sapien
agtttatacttctctattatctcaa

SEQ ID NO: 108048 - DNA, 25 bp, Homo sapien
cttctctattatctcaaactactgg

SEQ ID NO: 108049 - DNA, 25 bp, Homo sapien
tattatctcaaactactggcaattt

SEQ ID NO: 108050 - DNA, 25 bp, Homo sapien
aactactggcaatttgtaaagaaat

SEQ ID NO: 108051 - DNA, 25 bp, Homo sapien
gtgattgcagcttttcaatgttagc

SEQ ID NO: 108052 - DNA, 25 bp, Homo sapien
ttcaatgttagccacagtgtatttt

SEQ ID NO: 108053 - DNA, 25 bp, Homo sapien
gttagccacagtgtattttttcact

SEQ ID NO: 108054 - DNA, 25 bp, Homo sapien
ttttcacttgtactaaaattgtatc

SEQ ID NO: 108055 - DNA, 25 bp, Homo sapien
ttctgtggccccaagatccagactg

SEQ ID NO: 108056 - DNA, 25 bp, Homo sapien
aagatccagactggcctggatgcca

SEQ ID NO: 108057 - DNA, 25 bp, Homo sapien
ggctccctcgtcctaagcagcattg

SEQ ID NO: 108058 - DNA, 25 bp, Homo sapien
ctaagcagcattgcctcggctggct

SEQ ID NO: 108059 - DNA, 25 bp, Homo sapien
gggtagtctgtcttcgctttgcttc

SEQ ID NO: 108060 - DNA, 25 bp, Homo sapien
ctgtcttcgctttgcttcccttttt

SEQ ID NO: 108061 - DNA, 25 bp, Homo sapien
ctttccaccttctcacatggaatga

SEQ ID NO: 108062 - DNA, 25 bp, Homo sapien
accttctcacatggaatgagggttt

SEQ ID NO: 108063 - DNA, 25 bp, Homo sapien
agcagccaggagagcttagggtctc

SEQ ID NO: 108064 - DNA, 25 bp, Homo sapien
gagcttagggtctcagggtgtccca

SEQ ID NO: 108065 - DNA, 25 bp, Homo sapien
ggtctcagggtgtcccagaccccga

SEQ ID NO: 108066 - DNA, 25 bp, Homo sapien
caccaaagatccctgacaagcagtt

SEQ ID NO: 108067 - DNA, 25 bp, Homo sapien
gatccctgacaagcagttagatgaa

SEQ ID NO: 108068 - DNA, 25 bp, Homo sapien
gaaagggaacacacaatagaagagt

SEQ ID NO: 108069 - DNA, 25 bp, Homo sapien
agttatggacttggaggagagaacc

SEQ ID NO: 108070 - DNA, 25 bp, Homo sapien
ggtgcagcagtgatcaatggctctc

SEQ ID NO: 108071 - DNA, 25 bp, Homo sapien
cagcagtgatcaatggctctcagca

SEQ ID NO: 108072 - DNA, 25 bp, Homo sapien
tgtcttcaatgtcaacagatccgac

SEQ ID NO: 108073 - DNA, 25 bp, Homo sapien
atgtcaacagatccgactttggcct

SEQ ID NO: 108074 - DNA, 25 bp, Homo sapien
gactttggcctctgatacagacagc

SEQ ID NO: 108075 - DNA, 25 bp, Homo sapien
ggcctctgatacagacagcagtcta

SEQ ID NO: 108076 - DNA, 25 bp, Homo sapien
acagacagcagtctagaagcagcag

SEQ ID NO: 108077 - DNA, 25 bp, Homo sapien
attttcttgttgaacagcagcttca

SEQ ID NO: 108078 - DNA, 25 bp, Homo sapien
gaacagcagcttcaatgcaaacaca

SEQ ID NO: 108079 - DNA, 25 bp, Homo sapien
atgcttccagcattggtattttggc

SEQ ID NO: 108080 - DNA, 25 bp, Homo sapien
gcattggtattttggctaaggtaaa

SEQ ID NO: 108081 - DNA, 25 bp, Homo sapien
ggctaaggtaaatctacaaatcact

SEQ ID NO: 108082 - DNA, 25 bp, Homo sapien
ttcggagatgtaacagggttctaaa

SEQ ID NO: 108083 - DNA, 25 bp, Homo sapien
gggacctgttgatcctaacacctgc

SEQ ID NO: 108084 - DNA, 25 bp, Homo sapien
ttgatcctaacacctgccattaatt

SEQ ID NO: 108085 - DNA, 25 bp, Homo sapien
cctgccattaattcagtaatcacat

SEQ ID NO: 108086 - DNA, 25 bp, Homo sapien
gtaatcacatactgatggcttctca

SEQ ID NO: 108087 - DNA, 25 bp, Homo sapien
acatactgatggcttctcaggcctg

SEQ ID NO: 108088 - DNA, 25 bp, Homo sapien
gagacgaacgcccagcgctttggaa

SEQ ID NO: 108089 - DNA, 25 bp, Homo sapien
gcgctttggaaaccacatccgcaaa

SEQ ID NO: 108090 - DNA, 25 bp, Homo sapien
aaagccctgctggacattgctgatc

SEQ ID NO: 108091 - DNA, 25 bp, Homo sapien
ggacattgctgatcttttccaagtt

SEQ ID NO: 108092 - DNA, 25 bp, Homo sapien
acagctgaagcccttaggtacctgt

SEQ ID NO: 108093 - DNA, 25 bp, Homo sapien
tacctgtgttttgtttgggaactcg

SEQ ID NO: 108094 - DNA, 25 bp, Homo sapien
cccagctcagaccacagaggtggca

SEQ ID NO: 108095 - DNA, 25 bp, Homo sapien
gctggaagactgttcatgagggact

SEQ ID NO: 108096 - DNA, 25 bp, Homo sapien
ctgttcatgagggacttgtgtgacc

SEQ ID NO: 108097 - DNA, 25 bp, Homo sapien
gactctgctgagtgacgtaggctct

SEQ ID NO: 108098 - DNA, 25 bp, Homo sapien
gacgtaggctctgagatagctgtcc

SEQ ID NO: 108099 - DNA, 25 bp, Homo sapien
gggcctcctgttcgcgacaagcccg

SEQ ID NO: 108100 - DNA, 25 bp, Homo sapien
caggatctcgctgtaggtcaggccc

SEQ ID NO: 108101 - DNA, 25 bp, Homo sapien
aggatctcgctgtaggtcaggcccg

SEQ ID NO: 108102 - DNA, 25 bp, Homo sapien
gatctcgctgtaggtcaggcccgcg

SEQ ID NO: 108103 - DNA, 25 bp, Homo sapien
tcgctgtaggtcaggcccgcgcagc

SEQ ID NO: 108104 - DNA, 25 bp, Homo sapien
tcgcggaggtgtccgaggcgacgca

SEQ ID NO: 108105 - DNA, 25 bp, Homo sapien
aggcgacgcacctcgagggtgtccg

SEQ ID NO: 108106 - DNA, 25 bp, Homo sapien
ggacgcgctggaaagcaaacaggaa

SEQ ID NO: 108107 - DNA, 25 bp, Homo sapien
gaagattcccggagggaaactgtga

SEQ ID NO: 108108 - DNA, 25 bp, Homo sapien
aactgtgaatgcttctgatttagca

SEQ ID NO: 108109 - DNA, 25 bp, Homo sapien
tgaatgcttctgatttagcaatgct

SEQ ID NO: 108110 - DNA, 25 bp, Homo sapien
tttgtggaaggcctcagctacaacc

SEQ ID NO: 108111 - DNA, 25 bp, Homo sapien
agctacaacctgaacaccatgcagt

SEQ ID NO: 108112 - DNA, 25 bp, Homo sapien
tgaacaccatgcagtatcccagcca

SEQ ID NO: 108113 - DNA, 25 bp, Homo sapien
accatgcagtatcccagccagcagt

SEQ ID NO: 108114 - DNA, 25 bp, Homo sapien
agccagcagttccagcccgtggtgc

SEQ ID NO: 108115 - DNA, 25 bp, Homo sapien
gtggtgctggccaactgaccatcta

SEQ ID NO: 108116 - DNA, 25 bp, Homo sapien
caggagcacccaagaccacagaaaa

SEQ ID NO: 108117 - DNA, 25 bp, Homo sapien
tgtacaacggtggtggctcacccag

SEQ ID NO: 108118 - DNA, 25 bp, Homo sapien
agcctcttctttgatgcggccgatg

SEQ ID NO: 108119 - DNA, 25 bp, Homo sapien
accccaggcccgtttggaggcagtg

SEQ ID NO: 108120 - DNA, 25 bp, Homo sapien
tttgacatggcccaggtatttggag

SEQ ID NO: 108121 - DNA, 25 bp, Homo sapien
agttctcaagctcagagacgaacgc

SEQ ID NO: 108122 - DNA, 25 bp, Homo sapien
tcaagctcagagacgaacgcccagc

SEQ ID NO: 108123 - DNA, 25 bp, Homo sapien
gagacgaacgcccagcgctttggaa

SEQ ID NO: 108124 - DNA, 25 bp, Homo sapien
agcgctttggaaaccacatccgcaa

SEQ ID NO: 108125 - DNA, 25 bp, Homo sapien
ttggaaaccacatccgcaaagccct

SEQ ID NO: 108126 - DNA, 25 bp, Homo sapien
gcaaagccctgctggacattgctga

SEQ ID NO: 108127 - DNA, 25 bp, Homo sapien
aaagccctgctggacattgctgatc

SEQ ID NO: 108128 - DNA, 25 bp, Homo sapien
cctgctggacattgctgatcttttc

SEQ ID NO: 108129 - DNA, 25 bp, Homo sapien
gctggacattgctgatcttttccaa

SEQ ID NO: 108130 - DNA, 25 bp, Homo sapien
tggacattgctgatcttttccaagt

SEQ ID NO: 108131 - DNA, 25 bp, Homo sapien
aagttcccaaggcctacagctgaag

SEQ ID NO: 108132 - DNA, 25 bp, Homo sapien
ccgagcccgaagagcactcggtgag

SEQ ID NO: 108133 - DNA, 25 bp, Homo sapien
gagcactcggtgaggatctgcatga

SEQ ID NO: 108134 - DNA, 25 bp, Homo sapien
actcggtgaggatctgcatgagccc

SEQ ID NO: 108135 - DNA, 25 bp, Homo sapien
gagagcagatcctgtcggtgaagat

SEQ ID NO: 108136 - DNA, 25 bp, Homo sapien
agcagatcctgtcggtgaagatgcc

SEQ ID NO: 108137 - DNA, 25 bp, Homo sapien
gcgcgcagttccagcaggtgtgtcc

SEQ ID NO: 108138 - DNA, 25 bp, Homo sapien
ccccacggctcaagagaagatgctt

SEQ ID NO: 108139 - DNA, 25 bp, Homo sapien
gaagatgcttttccgtagtcgtgac

SEQ ID NO: 108140 - DNA, 25 bp, Homo sapien
atgcttttccgtagtcgtgacctca

SEQ ID NO: 108141 - DNA, 25 bp, Homo sapien
gtagtcgtgacctcagtggctgcag

SEQ ID NO: 108142 - DNA, 25 bp, Homo sapien
cgtgacctcagtggctgcagctctg

SEQ ID NO: 108143 - DNA, 25 bp, Homo sapien
tgtgtagacgcactctcaaaaactg

SEQ ID NO: 108144 - DNA, 25 bp, Homo sapien
aaaactgcacggacatacaaaatca

SEQ ID NO: 108145 - DNA, 25 bp, Homo sapien
caatcttttcctttgatcttgtggc

SEQ ID NO: 108146 - DNA, 25 bp, Homo sapien
tcctttgatcttgtggctaaaccag

SEQ ID NO: 108147 - DNA, 25 bp, Homo sapien
gtggctaaaccagcatttctgtgtt

SEQ ID NO: 108148 - DNA, 25 bp, Homo sapien
ccagcatttctgtgtttgagagatt

SEQ ID NO: 108149 - DNA, 25 bp, Homo sapien
gagatttcctgttaggtgcttcgtc

SEQ ID NO: 108150 - DNA, 25 bp, Homo sapien
taggtgcttcgtctgaaagtgaact

SEQ ID NO: 108151 - DNA, 25 bp, Homo sapien
tctaagagcttggtgtagggcaatt

SEQ ID NO: 108152 - DNA, 25 bp, Homo sapien
gggcaattggaataatgtcctgtta

SEQ ID NO: 108153 - DNA, 25 bp, Homo sapien
aaacagacatttagcaatgctgaca

SEQ ID NO: 108154 - DNA, 25 bp, Homo sapien
gtttattgcttggatttctagtgag

SEQ ID NO: 108155 - DNA, 25 bp, Homo sapien
ggatttctagtgagagctgttgaat

SEQ ID NO: 108156 - DNA, 25 bp, Homo sapien
ggtgatgtcaaatgtttctagggtt

SEQ ID NO: 108157 - DNA, 25 bp, Homo sapien
aattgattatttatgctataggtga

SEQ ID NO: 108158 - DNA, 25 bp, Homo sapien
gctataggtgatattctctttgaat

SEQ ID NO: 108159 - DNA, 25 bp, Homo sapien
ttctctttgaataaacctataatag

SEQ ID NO: 108160 - DNA, 25 bp, Homo sapien
ataggaaatagcagaccacataaac

SEQ ID NO: 108161 - DNA, 25 bp, Homo sapien
gcagaccacataaacatctttgtaa

SEQ ID NO: 108162 - DNA, 25 bp, Homo sapien
atatcaaacctaatacatttcttgt

SEQ ID NO: 108163 - DNA, 25 bp, Homo sapien
atttcttgtccagtgataaaacaac

SEQ ID NO: 108164 - DNA, 25 bp, Homo sapien
ataaacatggctttaatttttactg

SEQ ID NO: 108165 - DNA, 25 bp, Homo sapien
ttctgctgtttactctctgcttact

SEQ ID NO: 108166 - DNA, 25 bp, Homo sapien
gcttacttttgtctgagatggcctc

SEQ ID NO: 108167 - DNA, 25 bp, Homo sapien
atggcctcaggtggtaactttctca

SEQ ID NO: 108168 - DNA, 25 bp, Homo sapien
gtggtaactttctcacaggccttgg

SEQ ID NO: 108169 - DNA, 25 bp, Homo sapien
ggccttggccacagatctgatcatt

SEQ ID NO: 108170 - DNA, 25 bp, Homo sapien
gagggcaatgtctctattctgcctg

SEQ ID NO: 108171 - DNA, 25 bp, Homo sapien
aattcaaggcacctgttacagaggg

SEQ ID NO: 108172 - DNA, 25 bp, Homo sapien
aaggccaagtgctgcaagtgagctg

SEQ ID NO: 108173 - DNA, 25 bp, Homo sapien
gttcctgaaatcctgagtgttgcct

SEQ ID NO: 108174 - DNA, 25 bp, Homo sapien
agtcgccatgagaacttcctacctt

SEQ ID NO: 108175 - DNA, 25 bp, Homo sapien
agaacttcctaccttctgctgttta

SEQ ID NO: 108176 - DNA, 25 bp, Homo sapien
gaaggaggaccgctcctcactcatc

SEQ ID NO: 108177 - DNA, 25 bp, Homo sapien
ctgctgaagaactcgaactggatac

SEQ ID NO: 108178 - DNA, 25 bp, Homo sapien
gaactcgaactggatactcagctga

SEQ ID NO: 108179 - DNA, 25 bp, Homo sapien
tgacaggaccagaaatgcccatcgg

SEQ ID NO: 108180 - DNA, 25 bp, Homo sapien
atgcccatcggcaatgtctacaagg

SEQ ID NO: 108181 - DNA, 25 bp, Homo sapien
caaggagaaagccagagtcatcact

SEQ ID NO: 108182 - DNA, 25 bp, Homo sapien
agccagagtcatcactgagtaggag

SEQ ID NO: 108183 - DNA, 25 bp, Homo sapien
aaacttccaggccttgttagtctct

SEQ ID NO: 108184 - DNA, 25 bp, Homo sapien
gttagtctctgtatggcccatgcaa

SEQ ID NO: 108185 - DNA, 25 bp, Homo sapien
gtatggcccatgcaaatgcccagct

SEQ ID NO: 108186 - DNA, 25 bp, Homo sapien
aaatgcccagctcttcggcatatag

SEQ ID NO: 108187 - DNA, 25 bp, Homo sapien
gcccagtggctgctaataccttgga

SEQ ID NO: 108188 - DNA, 25 bp, Homo sapien
aataccttggactttggacagaatg

SEQ ID NO: 108189 - DNA, 25 bp, Homo sapien
atggagctatggacgttaatttgac

SEQ ID NO: 108190 - DNA, 25 bp, Homo sapien
ttaatttgaccgtctactccaatcc

SEQ ID NO: 108191 - DNA, 25 bp, Homo sapien
gagactggcatagctggacatccaa

SEQ ID NO: 108192 - DNA, 25 bp, Homo sapien
ggacatccaacataccaattttctg

SEQ ID NO: 108193 - DNA, 25 bp, Homo sapien
ttttctgctaatacaggtcctgcac

SEQ ID NO: 108194 - DNA, 25 bp, Homo sapien
ggtcctgcacattacatgactgaag

SEQ ID NO: 108195 - DNA, 25 bp, Homo sapien
ccccatgacaggagtttgtgtgcaa

SEQ ID NO: 108196 - DNA, 25 bp, Homo sapien
aacagagtcctgtagctagctcgtg

SEQ ID NO: 108197 - DNA, 25 bp, Homo sapien
gctagctcgtgactacattgaaact

SEQ ID NO: 108198 - DNA, 25 bp, Homo sapien
gaacctttaaaggatgcaggcatgg

SEQ ID NO: 108199 - DNA, 25 bp, Homo sapien
gatgcaggcatggagcagctcaccc

SEQ ID NO: 108200 - DNA, 25 bp, Homo sapien
aacatcgcaggctgatggtgcttta

SEQ ID NO: 108201 - DNA, 25 bp, Homo sapien
gatggtgctttaggctggagctatt

SEQ ID NO: 108202 - DNA, 25 bp, Homo sapien
ggttgtggcaggcatcttcaccagc

SEQ ID NO: 108203 - DNA, 25 bp, Homo sapien
tgtggcaggcatcttcaccagcagc

SEQ ID NO: 108204 - DNA, 25 bp, Homo sapien
cctcaccccatcacagggatttttt

SEQ ID NO: 108205 - DNA, 25 bp, Homo sapien
ttttttctgcctttcctaatccact

SEQ ID NO: 108206 - DNA, 25 bp, Homo sapien
tttctgcctttcctaatccactcag

SEQ ID NO: 108207 - DNA, 25 bp, Homo sapien
actcagctctggctggaagtgctta

SEQ ID NO: 108208 - DNA, 25 bp, Homo sapien
gctctggctggaagtgcttaaaata

SEQ ID NO: 108209 - DNA, 25 bp, Homo sapien
tggattgggcagaatcctgggcccc

SEQ ID NO: 108210 - DNA, 25 bp, Homo sapien
cactcccccaggattgtgcaatagt

SEQ ID NO: 108211 - DNA, 25 bp, Homo sapien
gtgcaatagtcagagtgtccctttt

SEQ ID NO: 108212 - DNA, 25 bp, Homo sapien
atagtcagagtgtccctttttgcag

SEQ ID NO: 108213 - DNA, 25 bp, Homo sapien
gtcagagtgtccctttttgcaggga

SEQ ID NO: 108214 - DNA, 25 bp, Homo sapien
ctttttgcagggactgggccatggt

SEQ ID NO: 108215 - DNA, 25 bp, Homo sapien
ccatgcaagtgctgtttgggcagga

SEQ ID NO: 108216 - DNA, 25 bp, Homo sapien
caagtgctgtttgggcaggagtcac

SEQ ID NO: 108217 - DNA, 25 bp, Homo sapien
accatgcaagggtgacatcgacaac

SEQ ID NO: 108218 - DNA, 25 bp, Homo sapien
gacatcgacaaccacgtaccaagcc

SEQ ID NO: 108219 - DNA, 25 bp, Homo sapien
ccactctgctgcctgtacagaagaa

SEQ ID NO: 108220 - DNA, 25 bp, Homo sapien
gcatcatttaaccatagacaatttg

SEQ ID NO: 108221 - DNA, 25 bp, Homo sapien
gccaggatctaggaaccacctaatg

SEQ ID NO: 108222 - DNA, 25 bp, Homo sapien
atctaggaaccacctaatggtaggt

SEQ ID NO: 108223 - DNA, 25 bp, Homo sapien
atttacttgcaagtactaggaattc

SEQ ID NO: 108224 - DNA, 25 bp, Homo sapien
gcaaaaagactaaagccctattaag

SEQ ID NO: 108225 - DNA, 25 bp, Homo sapien
gccctattaaggaagttattgcttt

SEQ ID NO: 108226 - DNA, 25 bp, Homo sapien
ttcaaatattctcttatcccggtcc

SEQ ID NO: 108227 - DNA, 25 bp, Homo sapien
atattctcttatcccggtccaaaag

SEQ ID NO: 108228 - DNA, 25 bp, Homo sapien
tcccggtccaaaaggattaagcgat

SEQ ID NO: 108229 - DNA, 25 bp, Homo sapien
ggagatgtatttacatacacctgga

SEQ ID NO: 108230 - DNA, 25 bp, Homo sapien
tttacatacacctggaaacctgtgc

SEQ ID NO: 108231 - DNA, 25 bp, Homo sapien
ggtgaatttaaagactcactctcca

SEQ ID NO: 108232 - DNA, 25 bp, Homo sapien
gactcactctccataaatgctacga

SEQ ID NO: 108233 - DNA, 25 bp, Homo sapien
aatgctacgaatattaaacacttca

SEQ ID NO: 108234 - DNA, 25 bp, Homo sapien
aaacacttcaaaaactgcacctcca

SEQ ID NO: 108235 - DNA, 25 bp, Homo sapien
tcaaaaactgcacctccatcagtgg

SEQ ID NO: 108236 - DNA, 25 bp, Homo sapien
atcagtggcgatctccacatcctgc

SEQ ID NO: 108237 - DNA, 25 bp, Homo sapien
cacatcctgccggtggcatttaggg

SEQ ID NO: 108238 - DNA, 25 bp, Homo sapien
catttaggggtgactccttcacaca

SEQ ID NO: 108239 - DNA, 25 bp, Homo sapien
cctctggatccacaggaactggata

SEQ ID NO: 108240 - DNA, 25 bp, Homo sapien
gatccacaggaactggatattctga

SEQ ID NO: 108241 - DNA, 25 bp, Homo sapien
tggatattctgaaaaccgtaaagga

SEQ ID NO: 108242 - DNA, 25 bp, Homo sapien
tgtcaaaaatcgtactaatgcttat

SEQ ID NO: 108243 - DNA, 25 bp, Homo sapien
aaggttttcttgcataaatactgga

SEQ ID NO: 108244 - DNA, 25 bp, Homo sapien
aatactggaaattgcacatggtaca

SEQ ID NO: 108245 - DNA, 25 bp, Homo sapien
gcacatggtacaaattttttcttca

SEQ ID NO: 108246 - DNA, 25 bp, Homo sapien
attttttcttcattactgtacaggg

SEQ ID NO: 108247 - DNA, 25 bp, Homo sapien
ctgaaagttactgaagtgccttctg

SEQ ID NO: 108248 - DNA, 25 bp, Homo sapien
gaagtgccttctgaatcaaggattt

SEQ ID NO: 108249 - DNA, 25 bp, Homo sapien
tcaaggatttaattaaggccacaat

SEQ ID NO: 108250 - DNA, 25 bp, Homo sapien
tacctttttaatactcagtgttctg

SEQ ID NO: 108251 - DNA, 25 bp, Homo sapien
aaacttgatattcccgtatggtgca

SEQ ID NO: 108252 - DNA, 25 bp, Homo sapien
tatggtgcatatttgatacaggtac

SEQ ID NO: 108253 - DNA, 25 bp, Homo sapien
tatcaaacacggacccatagacagc

SEQ ID NO: 108254 - DNA, 25 bp, Homo sapien
tacggaaaatccgacaagccttcag

SEQ ID NO: 108255 - DNA, 25 bp, Homo sapien
tgtccaaactgtcgtgcaaacccag

SEQ ID NO: 108256 - DNA, 25 bp, Homo sapien
aaacccagtgagacagaccgccaaa

SEQ ID NO: 108257 - DNA, 25 bp, Homo sapien
gaccgccaaataaacggactcagtg

SEQ ID NO: 108258 - DNA, 25 bp, Homo sapien
gactcagtggacactcagaccagct

SEQ ID NO: 108259 - DNA, 25 bp, Homo sapien
agaccctgggtctagaaagcggctc

SEQ ID NO: 108260 - DNA, 25 bp, Homo sapien
tctagaaagcggctcctgaaggtcc

SEQ ID NO: 108261 - DNA, 25 bp, Homo sapien
gaaggtcccttattgtggctgatat

SEQ ID NO: 108262 - DNA, 25 bp, Homo sapien
gtggctgatattaactgtcaatggt

SEQ ID NO: 108263 - DNA, 25 bp, Homo sapien
actgtcaatggttatgggtcctata

SEQ ID NO: 108264 - DNA, 25 bp, Homo sapien
tgccctgtagagttcctagattacc

SEQ ID NO: 108265 - DNA, 25 bp, Homo sapien
gagttcctagattacctcactggga

SEQ ID NO: 108266 - DNA, 25 bp, Homo sapien
gaatagcattgtgcgtgtccggaaa

SEQ ID NO: 108267 - DNA, 25 bp, Homo sapien
gtgcgtgtccggaaaagggctccat

SEQ ID NO: 108268 - DNA, 25 bp, Homo sapien
gaaaagggctccatttggttccagc

SEQ ID NO: 108269 - DNA, 25 bp, Homo sapien
tccagtggatccaagtactctctct

SEQ ID NO: 108270 - DNA, 25 bp, Homo sapien
atccaagtactctctctcctaaaga

SEQ ID NO: 108271 - DNA, 25 bp, Homo sapien
ttgcccttaggccagtacacagaat

SEQ ID NO: 108272 - DNA, 25 bp, Homo sapien
tggcagacgctttctgggacctgcc

SEQ ID NO: 108273 - DNA, 25 bp, Homo sapien
tgggacctgcccaagatatgtattc

SEQ ID NO: 108274 - DNA, 25 bp, Homo sapien
gtattctctgacactcttatttggt

SEQ ID NO: 108275 - DNA, 25 bp, Homo sapien
gctgaccactgagtctgccatgaag

SEQ ID NO: 108276 - DNA, 25 bp, Homo sapien
ctgagtctgccatgaagaagataga

SEQ ID NO: 108277 - DNA, 25 bp, Homo sapien
acacttgtgttcattgtggatgtta

SEQ ID NO: 108278 - DNA, 25 bp, Homo sapien
gaagaagctgtatgacattgatgtg

SEQ ID NO: 108279 - DNA, 25 bp, Homo sapien
ggtcaacaccctgattcggcctgat

SEQ ID NO: 108280 - DNA, 25 bp, Homo sapien
aacaccctgattcggcctgatggag

SEQ ID NO: 108281 - DNA, 25 bp, Homo sapien
ccctgattcggcctgatggagagaa

SEQ ID NO: 108282 - DNA, 25 bp, Homo sapien
cctgattcggcctgatggagagaag

SEQ ID NO: 108283 - DNA, 25 bp, Homo sapien
gattacgatgctttggatgttgcca

SEQ ID NO: 108284 - DNA, 25 bp, Homo sapien
gatcatctaaactgagtccagctgc

SEQ ID NO: 108285 - DNA, 25 bp, Homo sapien
aactgagtccagctgcctaattctg

SEQ ID NO: 108286 - DNA, 25 bp, Homo sapien
gattatagacatgaatccccacacc

SEQ ID NO: 108287 - DNA, 25 bp, Homo sapien
tatagacatgaatccccacacccgg

SEQ ID NO: 108288 - DNA, 25 bp, Homo sapien
tattttaagctttgtgagccacatg

SEQ ID NO: 108289 - DNA, 25 bp, Homo sapien
tttaagctttgtgagccacatggtc

SEQ ID NO: 108290 - DNA, 25 bp, Homo sapien
taagctttgtgagccacatggtctc

SEQ ID NO: 108291 - DNA, 25 bp, Homo sapien
tgtgagccacatggtctctgtcaca

SEQ ID NO: 108292 - DNA, 25 bp, Homo sapien
tcacaactattcagctctgctattg

SEQ ID NO: 108293 - DNA, 25 bp, Homo sapien
aactattcagctctgctattgtaat

SEQ ID NO: 108294 - DNA, 25 bp, Homo sapien
gctattgtaatacaaaagcagctgt

SEQ ID NO: 108295 - DNA, 25 bp, Homo sapien
aagcagctgtggacagtatgtaaat

SEQ ID NO: 108296 - DNA, 25 bp, Homo sapien
cagctgtggacagtatgtaaatgaa

SEQ ID NO: 108297 - DNA, 25 bp, Homo sapien
tgaggcttccaaggtaaagatcctt

SEQ ID NO: 108298 - DNA, 25 bp, Homo sapien
gaggcttccaaggtaaagatccttc

SEQ ID NO: 108299 - DNA, 25 bp, Homo sapien
aggcttccaaggtaaagatccttca

SEQ ID NO: 108300 - DNA, 25 bp, Homo sapien
ggcttccaaggtaaagatccttcaa

SEQ ID NO: 108301 - DNA, 25 bp, Homo sapien
gcttccaaggtaaagatccttcaaa

SEQ ID NO: 108302 - DNA, 25 bp, Homo sapien
cttccaaggtaaagatccttcaaat

SEQ ID NO: 108303 - DNA, 25 bp, Homo sapien
ttccaaggtaaagatccttcaaata

SEQ ID NO: 108304 - DNA, 25 bp, Homo sapien
tccaaggtaaagatccttcaaataa

SEQ ID NO: 108305 - DNA, 25 bp, Homo sapien
acacggctcacgcttacctcaacca

SEQ ID NO: 108306 - DNA, 25 bp, Homo sapien
ggctcacgcttacctcaaccatcct

SEQ ID NO: 108307 - DNA, 25 bp, Homo sapien
caaccatcctggctgcggcgtctgt

SEQ ID NO: 108308 - DNA, 25 bp, Homo sapien
aaccatcctggctgcggcgtctgtc

SEQ ID NO: 108309 - DNA, 25 bp, Homo sapien
ggctgcggcgtctgtctgaaccacg

SEQ ID NO: 108310 - DNA, 25 bp, Homo sapien
ctgcggcgtctgtctgaaccacgcg

SEQ ID NO: 108311 - DNA, 25 bp, Homo sapien
gcggcgtctgtctgaaccacgcggg

SEQ ID NO: 108312 - DNA, 25 bp, Homo sapien
tctgtctgaaccacgcgggggcctt

SEQ ID NO: 108313 - DNA, 25 bp, Homo sapien
gggcacagcggagtctgtcctgtga

SEQ ID NO: 108314 - DNA, 25 bp, Homo sapien
gacgcgcaagtctgagggtctgggc

SEQ ID NO: 108315 - DNA, 25 bp, Homo sapien
gcgcaagtctgagggtctgggcggc

SEQ ID NO: 108316 - DNA, 25 bp, Homo sapien
gcttcctccgtgcagttttctgcaa

SEQ ID NO: 108317 - DNA, 25 bp, Homo sapien
aacttttcctttgtccatcgaggtg

SEQ ID NO: 108318 - DNA, 25 bp, Homo sapien
ttttcctttgtccatcgaggtgttt

SEQ ID NO: 108319 - DNA, 25 bp, Homo sapien
ttcctttgtccatcgaggtgtttca

SEQ ID NO: 108320 - DNA, 25 bp, Homo sapien
ctttgtccatcgaggtgtttcataa

SEQ ID NO: 108321 - DNA, 25 bp, Homo sapien
ttgtccatcgaggtgtttcataagt

SEQ ID NO: 108322 - DNA, 25 bp, Homo sapien
gtccatcgaggtgtttcataagttt

SEQ ID NO: 108323 - DNA, 25 bp, Homo sapien
ccatcgaggtgtttcataagttttt

SEQ ID NO: 108324 - DNA, 25 bp, Homo sapien
tcgaggtgtttcataagttttttgg

SEQ ID NO: 108325 - DNA, 25 bp, Homo sapien
tttggtgtgttttctgggtcgtcta

SEQ ID NO: 108326 - DNA, 25 bp, Homo sapien
ggtgtgttttctgggtcgtctatgt

SEQ ID NO: 108327 - DNA, 25 bp, Homo sapien
tgctgtctccccactaggatcattc

SEQ ID NO: 108328 - DNA, 25 bp, Homo sapien
tgcacctgaccaagggaccaatgag

SEQ ID NO: 108329 - DNA, 25 bp, Homo sapien
caagggaccaatgaggcagaggctt

SEQ ID NO: 108330 - DNA, 25 bp, Homo sapien
ccaatgaggcagaggcttgccccaa

SEQ ID NO: 108331 - DNA, 25 bp, Homo sapien
cattccaggtcaccagatccaagga

SEQ ID NO: 108332 - DNA, 25 bp, Homo sapien
ggtcaccagatccaaggagcgcttg

SEQ ID NO: 108333 - DNA, 25 bp, Homo sapien
atccaaggagcgcttgaggagctct

SEQ ID NO: 108334 - DNA, 25 bp, Homo sapien
agctctgggtacagggcagcaaccc

SEQ ID NO: 108335 - DNA, 25 bp, Homo sapien
tgggtacagggcagcaacccagagc

SEQ ID NO: 108336 - DNA, 25 bp, Homo sapien
tcccgggacatctggatgctgggca

SEQ ID NO: 108337 - DNA, 25 bp, Homo sapien
tcaaggtctccattctcctaggaga

SEQ ID NO: 108338 - DNA, 25 bp, Homo sapien
tggtatgatccttctgaagcagaag

SEQ ID NO: 108339 - DNA, 25 bp, Homo sapien
atcatcgtcgtctgtcaatgatgtg

SEQ ID NO: 108340 - DNA, 25 bp, Homo sapien
tcatcgtcgtctgtcaatgatgtgt

SEQ ID NO: 108341 - DNA, 25 bp, Homo sapien
catcgtcgtctgtcaatgatgtgtc

SEQ ID NO: 108342 - DNA, 25 bp, Homo sapien
atcgtcgtctgtcaatgatgtgtct

SEQ ID NO: 108343 - DNA, 25 bp, Homo sapien
tcgtcgtctgtcaatgatgtgtctt

SEQ ID NO: 108344 - DNA, 25 bp, Homo sapien
cgtcgtctgtcaatgatgtgtcttc

SEQ ID NO: 108345 - DNA, 25 bp, Homo sapien
gtctgtcaatgatgtgtcttcaatg

SEQ ID NO: 108346 - DNA, 25 bp, Homo sapien
gtcaatgatgtgtcttcaatgtcaa

SEQ ID NO: 108347 - DNA, 25 bp, Homo sapien
tctggtatgatccttctgaagcaga

SEQ ID NO: 108348 - DNA, 25 bp, Homo sapien
ctggtatgatccttctgaagcagaa

SEQ ID NO: 108349 - DNA, 25 bp, Homo sapien
ccttatcatccgtcaaaggagtcgg

SEQ ID NO: 108350 - DNA, 25 bp, Homo sapien
aaaggagtcggaaagggcttctgca

SEQ ID NO: 108351 - DNA, 25 bp, Homo sapien
aaggagtcggaaagggcttctgcac

SEQ ID NO: 108352 - DNA, 25 bp, Homo sapien
ctcctgagactgttttaactaagac

SEQ ID NO: 108353 - DNA, 25 bp, Homo sapien
tcctgagactgttttaactaagact

SEQ ID NO: 108354 - DNA, 25 bp, Homo sapien
cctgagactgttttaactaagactg

SEQ ID NO: 108355 - DNA, 25 bp, Homo sapien
ctgagactgttttaactaagactgg

SEQ ID NO: 108356 - DNA, 25 bp, Homo sapien
gagactgttttaactaagactggtt

SEQ ID NO: 108357 - DNA, 25 bp, Homo sapien
taagactggttatcactcttctgtg

SEQ ID NO: 108358 - DNA, 25 bp, Homo sapien
actcttctgtgatgcctgcttgtcc

SEQ ID NO: 108359 - DNA, 25 bp, Homo sapien
ggcgctggctgtgactctgcttcct

SEQ ID NO: 108360 - DNA, 25 bp, Homo sapien
ttctgactgctgattctcccgttca

SEQ ID NO: 108361 - DNA, 25 bp, Homo sapien
tctcccgttcacgttgcctaataaa

SEQ ID NO: 108362 - DNA, 25 bp, Homo sapien
aacatccttcaagaactctgggctg

SEQ ID NO: 108363 - DNA, 25 bp, Homo sapien
gaactctgggctgctacccagaaat

SEQ ID NO: 108364 - DNA, 25 bp, Homo sapien
atcattttacccttggctcaatcct

SEQ ID NO: 108365 - DNA, 25 bp, Homo sapien
ttggctcaatcctctaagctaaccc

SEQ ID NO: 108366 - DNA, 25 bp, Homo sapien
gagccttcagtcttgaatttctaaa

SEQ ID NO: 108367 - DNA, 25 bp, Homo sapien
agaggccatggcagaataatctttg

SEQ ID NO: 108368 - DNA, 25 bp, Homo sapien
ggcagccaaacccatgaggcaatgt

SEQ ID NO: 108369 - DNA, 25 bp, Homo sapien
gaggtcccaggcagagaatcatact

SEQ ID NO: 108370 - DNA, 25 bp, Homo sapien
cttagcaaagttttacctgtgcgtt

SEQ ID NO: 108371 - DNA, 25 bp, Homo sapien
ttcaccttcagtacctacaggatgc

SEQ ID NO: 108372 - DNA, 25 bp, Homo sapien
agtacctacaggatgcactgggtcc

SEQ ID NO: 108373 - DNA, 25 bp, Homo sapien
tacctacaggatgcactgggtccgc

SEQ ID NO: 108374 - DNA, 25 bp, Homo sapien
ggctggtgtgggtctcacgtattaa

SEQ ID NO: 108375 - DNA, 25 bp, Homo sapien
ggtgtgggtctcacgtattaatagt

SEQ ID NO: 108376 - DNA, 25 bp, Homo sapien
acgtattaatagtgatgggagtagc

SEQ ID NO: 108377 - DNA, 25 bp, Homo sapien
gggagtagcacagactacgcggact

SEQ ID NO: 108378 - DNA, 25 bp, Homo sapien
agtagcacagactacgcggactccg

SEQ ID NO: 108379 - DNA, 25 bp, Homo sapien
acagactacgcggactccgtggagg

SEQ ID NO: 108380 - DNA, 25 bp, Homo sapien
attactgtgcaagatccaattacta

SEQ ID NO: 108381 - DNA, 25 bp, Homo sapien
ctgtgcaagatccaattactacttt

SEQ ID NO: 108382 - DNA, 25 bp, Homo sapien
cagggaccatgaggcccctacatgt

SEQ ID NO: 108383 - DNA, 25 bp, Homo sapien
atgtccgcaccacctcggatggagg

SEQ ID NO: 108384 - DNA, 25 bp, Homo sapien
gcaccacctcggatggaggttactc

SEQ ID NO: 108385 - DNA, 25 bp, Homo sapien
cctcggatggaggttactctttcaa

SEQ ID NO: 108386 - DNA, 25 bp, Homo sapien
ggatggaggttactctttcaagtat

SEQ ID NO: 108387 - DNA, 25 bp, Homo sapien
gaggttactctttcaagtatgagac

SEQ ID NO: 108388 - DNA, 25 bp, Homo sapien
tttcaagtatgagacagtgcccaac

SEQ ID NO: 108389 - DNA, 25 bp, Homo sapien
agtatgagacagtgcccaaccttct

SEQ ID NO: 108390 - DNA, 25 bp, Homo sapien
aaccttctcacgcagcactgtgctt

SEQ ID NO: 108391 - DNA, 25 bp, Homo sapien
tctcacgcagcactgtgcttgtatc

SEQ ID NO: 108392 - DNA, 25 bp, Homo sapien
ttccttcttaatcccatggctggtg

SEQ ID NO: 108393 - DNA, 25 bp, Homo sapien
tgatctgtattgactaatacaccag

SEQ ID NO: 108394 - DNA, 25 bp, Homo sapien
gtattgactaatacaccagtccaca

SEQ ID NO: 108395 - DNA, 25 bp, Homo sapien
tgactaatacaccagtccacacttc

SEQ ID NO: 108396 - DNA, 25 bp, Homo sapien
gactaatacaccagtccacacttct

SEQ ID NO: 108397 - DNA, 25 bp, Homo sapien
taatacaccagtccacacttctatg

SEQ ID NO: 108398 - DNA, 25 bp, Homo sapien
aatacaccagtccacacttctatga

SEQ ID NO: 108399 - DNA, 25 bp, Homo sapien
atacaccagtccacacttctatgac

SEQ ID NO: 108400 - DNA, 25 bp, Homo sapien
acaccagtccacacttctatgactt

SEQ ID NO: 108401 - DNA, 25 bp, Homo sapien
accagtccacacttctatgacttct

SEQ ID NO: 108402 - DNA, 25 bp, Homo sapien
cagtccacacttctatgacttctgc

SEQ ID NO: 108403 - DNA, 25 bp, Homo sapien
agtccacacttctatgacttctgcc

SEQ ID NO: 108404 - DNA, 25 bp, Homo sapien
gaaaacttagtttgtgaattgattt

SEQ ID NO: 108405 - DNA, 25 bp, Homo sapien
ttgattttgaggagtggtttttctt

SEQ ID NO: 108406 - DNA, 25 bp, Homo sapien
tcttggacacttaattctgttctga

SEQ ID NO: 108407 - DNA, 25 bp, Homo sapien
taatttatcagattgcttttgtgca

SEQ ID NO: 108408 - DNA, 25 bp, Homo sapien
gcttttgtgcattggataacaccac

SEQ ID NO: 108409 - DNA, 25 bp, Homo sapien
ggataacaccaccattcacaagtta

SEQ ID NO: 108410 - DNA, 25 bp, Homo sapien
accaccattcacaagttaagattct

SEQ ID NO: 108411 - DNA, 25 bp, Homo sapien
gattcttcaaagaggcacagagcca

SEQ ID NO: 108412 - DNA, 25 bp, Homo sapien
aagaggcacagagccaaattggtag

SEQ ID NO: 108413 - DNA, 25 bp, Homo sapien
ttactttaacatgcccatattttac

SEQ ID NO: 108414 - DNA, 25 bp, Homo sapien
taacatgcccatattttacttggaa

SEQ ID NO: 108415 - DNA, 25 bp, Homo sapien
acgtcatgttgatgggcgacttcaa

SEQ ID NO: 108416 - DNA, 25 bp, Homo sapien
ttgatgggcgacttcaatgcgggct

SEQ ID NO: 108417 - DNA, 25 bp, Homo sapien
gctgcagctatgtgagaccctccca

SEQ ID NO: 108418 - DNA, 25 bp, Homo sapien
agtggtcatccatccgcctgtggac

SEQ ID NO: 108419 - DNA, 25 bp, Homo sapien
ttccagtggctgatccccgacagcg

SEQ ID NO: 108420 - DNA, 25 bp, Homo sapien
gatgctgctccgaggcgccgttgtt

SEQ ID NO: 108421 - DNA, 25 bp, Homo sapien
ttaacttccaggctgcctatggcct

SEQ ID NO: 108422 - DNA, 25 bp, Homo sapien
tgcctatggcctgagtgaccaactg

SEQ ID NO: 108423 - DNA, 25 bp, Homo sapien
tgagtgaccaactggcccaagccat

SEQ ID NO: 108424 - DNA, 25 bp, Homo sapien
aagccatcagtgaccactatccagt

SEQ ID NO: 108425 - DNA, 25 bp, Homo sapien
cactatccagtggaggtgatgctga

SEQ ID NO: 108426 - DNA, 25 bp, Homo sapien
tgaagcccatcctgcacacttactg

SEQ ID NO: 108427 - DNA, 25 bp, Homo sapien
tcctgcacacttactggatgctttg

SEQ ID NO: 108428 - DNA, 25 bp, Homo sapien
cacttactggatgctttggactcaa

SEQ ID NO: 108429 - DNA, 25 bp, Homo sapien
ggatgctttggactcaacaggacat

SEQ ID NO: 108430 - DNA, 25 bp, Homo sapien
gactcaacaggacatatgtggcctt

SEQ ID NO: 108431 - DNA, 25 bp, Homo sapien
caacaggacatatgtggccttgaag

SEQ ID NO: 108432 - DNA, 25 bp, Homo sapien
tggccttgaagggaagacaaaactg

SEQ ID NO: 108433 - DNA, 25 bp, Homo sapien
gacaaaactggatgttctttcttgt

SEQ ID NO: 108434 - DNA, 25 bp, Homo sapien
ctttcttgttggatagaacctttgt

SEQ ID NO: 108435 - DNA, 25 bp, Homo sapien
atgttggtaacttttgcttcctcta

SEQ ID NO: 108436 - DNA, 25 bp, Homo sapien
tgcttcctctacctgaacaaagaga

SEQ ID NO: 108437 - DNA, 25 bp, Homo sapien
aaataaccgactgcacctgctgtct

SEQ ID NO: 108438 - DNA, 25 bp, Homo sapien
cttcagctcttcttgacatcaaggc

SEQ ID NO: 108439 - DNA, 25 bp, Homo sapien
gctcttcttgacatcaaggctcttc

SEQ ID NO: 108440 - DNA, 25 bp, Homo sapien
taacagataatagcaacttgggaaa

SEQ ID NO: 108441 - DNA, 25 bp, Homo sapien
cttgggaaatgcttatgttacaggt

SEQ ID NO: 108442 - DNA, 25 bp, Homo sapien
tatgttacaggttaccgttgagaac

SEQ ID NO: 108443 - DNA, 25 bp, Homo sapien
ggttaccgttgagaacaatcatcta

SEQ ID NO: 108444 - DNA, 25 bp, Homo sapien
ccgttgagaacaatcatctaaatct

SEQ ID NO: 108445 - DNA, 25 bp, Homo sapien
atagactaacctctaccagcacatt

SEQ ID NO: 108446 - DNA, 25 bp, Homo sapien
taacctctaccagcacattaaaagt

SEQ ID NO: 108447 - DNA, 25 bp, Homo sapien
ttaaaagtgattgtttctgggtgat

SEQ ID NO: 108448 - DNA, 25 bp, Homo sapien
ggccgtcgccttgatgtatcgccta

SEQ ID NO: 108449 - DNA, 25 bp, Homo sapien
gtatcgcctatacatggcagaggac

SEQ ID NO: 108450 - DNA, 25 bp, Homo sapien
tggcagaggactgaacacctcctca

SEQ ID NO: 108451 - DNA, 25 bp, Homo sapien
gaacacctcctcagaagtcagcgca

SEQ ID NO: 108452 - DNA, 25 bp, Homo sapien
agcctgctttggacacgggagaaaa

SEQ ID NO: 108453 - DNA, 25 bp, Homo sapien
aagccattgctaactacttcaactg

SEQ ID NO: 108454 - DNA, 25 bp, Homo sapien
tctttttcttccgacattagaaaca

SEQ ID NO: 108455 - DNA, 25 bp, Homo sapien
aaagaactgtcctttctgcgctcaa

SEQ ID NO: 108456 - DNA, 25 bp, Homo sapien
tcctttctgcgctcaaatttttcga

SEQ ID NO: 108457 - DNA, 25 bp, Homo sapien
gctcaaatttttcgagtgtgccttt

SEQ ID NO: 108458 - DNA, 25 bp, Homo sapien
tttttcgagtgtgcctttttattca

SEQ ID NO: 108459 - DNA, 25 bp, Homo sapien
aaggaactcgtctctctatccaatg

SEQ ID NO: 108460 - DNA, 25 bp, Homo sapien
actcgtctctctatccaatgggaga

SEQ ID NO: 108461 - DNA, 25 bp, Homo sapien
gagaaaccagtgtctgcttttccaa

SEQ ID NO: 108462 - DNA, 25 bp, Homo sapien
cagtgtctgcttttccaatccattg

SEQ ID NO: 108463 - DNA, 25 bp, Homo sapien
tttccaatccattgctttgattatg

SEQ ID NO: 108464 - DNA, 25 bp, Homo sapien
gaaaaattgatgaccaatgcattca

SEQ ID NO: 108465 - DNA, 25 bp, Homo sapien
gatgatctttctaagtacgatgttc

SEQ ID NO: 108466 - DNA, 25 bp, Homo sapien
tacgatgttcaagtgagagcagcag

SEQ ID NO: 108467 - DNA, 25 bp, Homo sapien
cagtgagctccatgtgcagagaggc

SEQ ID NO: 108468 - DNA, 25 bp, Homo sapien
tccatgtgcagagaggcagggctct

SEQ ID NO: 108469 - DNA, 25 bp, Homo sapien
tgagtggagccaacctatttatgtg

SEQ ID NO: 108470 - DNA, 25 bp, Homo sapien
agccacatcgcctgagattgacaac

SEQ ID NO: 108471 - DNA, 25 bp, Homo sapien
tgagattgacaacgccctacagcaa

SEQ ID NO: 108472 - DNA, 25 bp, Homo sapien
gacaacgccctacagcaagacggaa

SEQ ID NO: 108473 - DNA, 25 bp, Homo sapien
gcaagacggaaacctccctttacag

SEQ ID NO: 108474 - DNA, 25 bp, Homo sapien
tttacagcaccaccttgcgattctg

SEQ ID NO: 108475 - DNA, 25 bp, Homo sapien
tgcgattctgcagccacaaagttga

SEQ ID NO: 108476 - DNA, 25 bp, Homo sapien
caaagttgagacttctgaacgtggc

SEQ ID NO: 108477 - DNA, 25 bp, Homo sapien
tctgttcccttactgtttcacgtgt

SEQ ID NO: 108478 - DNA, 25 bp, Homo sapien
actgtttcacgtgtacctgtgtcat

SEQ ID NO: 108479 - DNA, 25 bp, Homo sapien
gtgtcatctttcttgtttcatcgta

SEQ ID NO: 108480 - DNA, 25 bp, Homo sapien
actacaagcggatggttaaacaatt

SEQ ID NO: 108481 - DNA, 25 bp, Homo sapien
cttcagctcttcttgacatcaaggc

SEQ ID NO: 108482 - DNA, 25 bp, Homo sapien
gctcttcttgacatcaaggctcttc

SEQ ID NO: 108483 - DNA, 25 bp, Homo sapien
atcaaggctcttccgttccacatcc

SEQ ID NO: 108484 - DNA, 25 bp, Homo sapien
taacagataatagcaacttgggaaa

SEQ ID NO: 108485 - DNA, 25 bp, Homo sapien
cttgggaaatgcttatgttacaggt

SEQ ID NO: 108486 - DNA, 25 bp, Homo sapien
gggaaatgcttatgttacaggttac

SEQ ID NO: 108487 - DNA, 25 bp, Homo sapien
atagactaacctctaccagcacatt

SEQ ID NO: 108488 - DNA, 25 bp, Homo sapien
gactaacctctaccagcacattaaa

SEQ ID NO: 108489 - DNA, 25 bp, Homo sapien
taacctctaccagcacattaaaagt

SEQ ID NO: 108490 - DNA, 25 bp, Homo sapien
acctctaccagcacattaaaagtga

SEQ ID NO: 108491 - DNA, 25 bp, Homo sapien
ttaaaagtgattgtttctgggtgat

SEQ ID NO: 108492 - DNA, 25 bp, Homo sapien
tgccttggcaaaaaagcacaagcga

SEQ ID NO: 108493 - DNA, 25 bp, Homo sapien
ttggcaaaaaagcacaagcgaaccc

SEQ ID NO: 108494 - DNA, 25 bp, Homo sapien
gcaaaaaagcacaagcgaaccccag

SEQ ID NO: 108495 - DNA, 25 bp, Homo sapien
caaaaaagcacaagcgaaccccagc

SEQ ID NO: 108496 - DNA, 25 bp, Homo sapien
aaagcacaagcgaaccccagccctg

SEQ ID NO: 108497 - DNA, 25 bp, Homo sapien
aatgagcagcgcatcagacagaacg

SEQ ID NO: 108498 - DNA, 25 bp, Homo sapien
atgagcagcgcatcagacagaacgt

SEQ ID NO: 108499 - DNA, 25 bp, Homo sapien
tgagcagcgcatcagacagaacgtg

SEQ ID NO: 108500 - DNA, 25 bp, Homo sapien
gagcagcgcatcagacagaacgtgc

SEQ ID NO: 108501 - DNA, 25 bp, Homo sapien
gcagcgcatcagacagaacgtgcag

SEQ ID NO: 108502 - DNA, 25 bp, Homo sapien
agcgcatcagacagaacgtgcaggt

SEQ ID NO: 108503 - DNA, 25 bp, Homo sapien
ggccgtcgccttgatgtatcgccta

SEQ ID NO: 108504 - DNA, 25 bp, Homo sapien
gatgtatcgcctatacatggcagag

SEQ ID NO: 108505 - DNA, 25 bp, Homo sapien
atgtatcgcctatacatggcagagg

SEQ ID NO: 108506 - DNA, 25 bp, Homo sapien
gtatcgcctatacatggcagaggac

SEQ ID NO: 108507 - DNA, 25 bp, Homo sapien
tatcgcctatacatggcagaggact

SEQ ID NO: 108508 - DNA, 25 bp, Homo sapien
tcgcctatacatggcagaggactga

SEQ ID NO: 108509 - DNA, 25 bp, Homo sapien
gcctatacatggcagaggactgaac

SEQ ID NO: 108510 - DNA, 25 bp, Homo sapien
atacatggcagaggactgaacacct

SEQ ID NO: 108511 - DNA, 25 bp, Homo sapien
tggcagaggactgaacacctcctca

SEQ ID NO: 108512 - DNA, 25 bp, Homo sapien
gaacacctcctcagaagtcagcgca

SEQ ID NO: 108513 - DNA, 25 bp, Homo sapien
acacctcctcagaagtcagcgcagg

SEQ ID NO: 108514 - DNA, 25 bp, Homo sapien
ctgccgactcctgggttgagctgtt

SEQ ID NO: 108515 - DNA, 25 bp, Homo sapien
actcctgggttgagctgttgcctca

SEQ ID NO: 108516 - DNA, 25 bp, Homo sapien
tgggttgagctgttgcctcagtccc

SEQ ID NO: 108517 - DNA, 25 bp, Homo sapien
aacagatgcttttctgtctctgcct

SEQ ID NO: 108518 - DNA, 25 bp, Homo sapien
ccccatatggtcatagcccagatca

SEQ ID NO: 108519 - DNA, 25 bp, Homo sapien
ggtcatagcccagatcagctcctaa

SEQ ID NO: 108520 - DNA, 25 bp, Homo sapien
ctgcctcttctgtgggtgacccagg

SEQ ID NO: 108521 - DNA, 25 bp, Homo sapien
ggtgacccaggtccttgtttgctgt

SEQ ID NO: 108522 - DNA, 25 bp, Homo sapien
cagggatcctggtttcaatgacggt

SEQ ID NO: 108523 - DNA, 25 bp, Homo sapien
tcctggtttcaatgacggttggaaa

SEQ ID NO: 108524 - DNA, 25 bp, Homo sapien
gagagtattgggtagatattttttc

SEQ ID NO: 108525 - DNA, 25 bp, Homo sapien
aaaccgctcctctaaggatgtgcct

SEQ ID NO: 108526 - DNA, 25 bp, Homo sapien
gatgtgcctcttaccatcaaggatc

SEQ ID NO: 108527 - DNA, 25 bp, Homo sapien
gtgcctcttaccatcaaggatcctg

SEQ ID NO: 108528 - DNA, 25 bp, Homo sapien
accatcaaggatcctgctgtgggct

SEQ ID NO: 108529 - DNA, 25 bp, Homo sapien
tggagacaatctcacctggctactc

SEQ ID NO: 108530 - DNA, 25 bp, Homo sapien
gacaatctcacctggctactccatt

SEQ ID NO: 108531 - DNA, 25 bp, Homo sapien
gacagagtcagctcacacgctgtct

SEQ ID NO: 108532 - DNA, 25 bp, Homo sapien
agctcacacgctgtctgtgactaaa

SEQ ID NO: 108533 - DNA, 25 bp, Homo sapien
acgctgtctgtgactaaagagggca

SEQ ID NO: 108534 - DNA, 25 bp, Homo sapien
tacagcgacgtaagcccaggggcaa

SEQ ID NO: 108535 - DNA, 25 bp, Homo sapien
ttgggtgactcactttcccctctag

SEQ ID NO: 108536 - DNA, 25 bp, Homo sapien
aaagcttctctgctccagttatttt

SEQ ID NO: 108537 - DNA, 25 bp, Homo sapien
ataaagtgcctgtatcttgtaaaac

SEQ ID NO: 108538 - DNA, 25 bp, Homo sapien
gtgcctgtatcttgtaaaacttcat

SEQ ID NO: 108539 - DNA, 25 bp, Homo sapien
gcctgtatcttgtaaaacttcattt

SEQ ID NO: 108540 - DNA, 25 bp, Homo sapien
gtatcttgtaaaacttcatttgttt

SEQ ID NO: 108541 - DNA, 25 bp, Homo sapien
tcttttggttcagagaagttcattt

SEQ ID NO: 108542 - DNA, 25 bp, Homo sapien
ggttcagagaagttcatttatgttc

SEQ ID NO: 108543 - DNA, 25 bp, Homo sapien
catttatgttcaaagacgtttattc

SEQ ID NO: 108544 - DNA, 25 bp, Homo sapien
gttcaaagacgtttattcatgttca

SEQ ID NO: 108545 - DNA, 25 bp, Homo sapien
aaagacgtttattcatgttcaacag

SEQ ID NO: 108546 - DNA, 25 bp, Homo sapien
agacgtttattcatgttcaacagga

SEQ ID NO: 108547 - DNA, 25 bp, Homo sapien
gtgacattgggacaacactttccct

SEQ ID NO: 108548 - DNA, 25 bp, Homo sapien
ctcagtttccctctgtatacaagga

SEQ ID NO: 108549 - DNA, 25 bp, Homo sapien
tgtatacaaggatcagattcttgct

SEQ ID NO: 108550 - DNA, 25 bp, Homo sapien
caagaactcctgaaatcatatagaa

SEQ ID NO: 108551 - DNA, 25 bp, Homo sapien
gtgggccctgtcattcgtggttgat

SEQ ID NO: 108552 - DNA, 25 bp, Homo sapien
gccctgtcattcgtggttgatttca

SEQ ID NO: 108553 - DNA, 25 bp, Homo sapien
tcgtggttgatttcaatacactcaa

SEQ ID NO: 108554 - DNA, 25 bp, Homo sapien
atacactcaagtgccattcatcctt

SEQ ID NO: 108555 - DNA, 25 bp, Homo sapien
gaaatggcccatttaatgattgatt

SEQ ID NO: 108556 - DNA, 25 bp, Homo sapien
tagttataatctgatgggcctggct

SEQ ID NO: 108557 - DNA, 25 bp, Homo sapien
ggaagaagggaagccttttgcaaat

SEQ ID NO: 108558 - DNA, 25 bp, Homo sapien
tttatacctcttattgtttcaaatt

SEQ ID NO: 108559 - DNA, 25 bp, Homo sapien
gtttcaaattctctatcctttctaa

SEQ ID NO: 108560 - DNA, 25 bp, Homo sapien
agtactaaaattgcattctttttct

SEQ ID NO: 108561 - DNA, 25 bp, Homo sapien
ttttctgttaaacaggctgcttcct

SEQ ID NO: 108562 - DNA, 25 bp, Homo sapien
gcttccttgggattactacagtttc

SEQ ID NO: 108563 - DNA, 25 bp, Homo sapien
tttcctatccttaacgcttctgtgg

SEQ ID NO: 108564 - DNA, 25 bp, Homo sapien
aacgcttctgtggatgaaaactgcc

SEQ ID NO: 108565 - DNA, 25 bp, Homo sapien
aatgtgcttgtagattagagacttc

SEQ ID NO: 108566 - DNA, 25 bp, Homo sapien
agagacttctattgtacctcaaata

SEQ ID NO: 108567 - DNA, 25 bp, Homo sapien
tattgtacctcaaatagtgatcttt

SEQ ID NO: 108568 - DNA, 25 bp, Homo sapien
agtgatcttttttagactagaatta

SEQ ID NO: 108569 - DNA, 25 bp, Homo sapien
atttcaatgttagcctcaatttctg

SEQ ID NO: 108570 - DNA, 25 bp, Homo sapien
gttagcctcaatttctgaacaccat

SEQ ID NO: 108571 - DNA, 25 bp, Homo sapien
ttctgaacaccataggtagaatgta

SEQ ID NO: 108572 - DNA, 25 bp, Homo sapien
aatgtaaagcttgtctgatcgttca

SEQ ID NO: 108573 - DNA, 25 bp, Homo sapien
gtaaagcttgtctgatcgttcaaag

SEQ ID NO: 108574 - DNA, 25 bp, Homo sapien
cttgtctgatcgttcaaagcatgaa

SEQ ID NO: 108575 - DNA, 25 bp, Homo sapien
ggatacttatatggaaattctgctc

SEQ ID NO: 108576 - DNA, 25 bp, Homo sapien
ttatatggaaattctgctcagatag

SEQ ID NO: 108577 - DNA, 25 bp, Homo sapien
gctcagatagaatgacagtccgtca

SEQ ID NO: 108578 - DNA, 25 bp, Homo sapien
gacagtccgtcaaaacagattgttt

SEQ ID NO: 108579 - DNA, 25 bp, Homo sapien
gtccgtcaaaacagattgtttgcaa

SEQ ID NO: 108580 - DNA, 25 bp, Homo sapien
gaacaagtccctgattttgtcacct

SEQ ID NO: 108581 - DNA, 25 bp, Homo sapien
tgattttgtcaccttcctttaccaa

SEQ ID NO: 108582 - DNA, 25 bp, Homo sapien
ataactagaggaattgcagcaagga

SEQ ID NO: 108583 - DNA, 25 bp, Homo sapien
ttgcagcaaggagttatggattaaa

SEQ ID NO: 108584 - DNA, 25 bp, Homo sapien
tggctaaactagcagatgttcctgg

SEQ ID NO: 108585 - DNA, 25 bp, Homo sapien
aagaaagcagctcacaagtcaaaag

SEQ ID NO: 108586 - DNA, 25 bp, Homo sapien
aagagactcaagtattttgcaaagt

SEQ ID NO: 108587 - DNA, 25 bp, Homo sapien
gttatggacgatgcataatgcacaa

SEQ ID NO: 108588 - DNA, 25 bp, Homo sapien
gcacaagacctgcagaagtggacag

SEQ ID NO: 108589 - DNA, 25 bp, Homo sapien
agtggacagaggagttcaacatgga

SEQ ID NO: 108590 - DNA, 25 bp, Homo sapien
gaaacacagacttctcttcttcatt

SEQ ID NO: 108591 - DNA, 25 bp, Homo sapien
tttcctatccttaacgcttctgtgg

SEQ ID NO: 108592 - DNA, 25 bp, Homo sapien
ttcctatccttaacgcttctgtgga

SEQ ID NO: 108593 - DNA, 25 bp, Homo sapien
tcctatccttaacgcttctgtggat

SEQ ID NO: 108594 - DNA, 25 bp, Homo sapien
ctatccttaacgcttctgtggatga

SEQ ID NO: 108595 - DNA, 25 bp, Homo sapien
tatccttaacgcttctgtggatgaa

SEQ ID NO: 108596 - DNA, 25 bp, Homo sapien
atccttaacgcttctgtggatgaaa

SEQ ID NO: 108597 - DNA, 25 bp, Homo sapien
ccttaacgcttctgtggatgaaaac

SEQ ID NO: 108598 - DNA, 25 bp, Homo sapien
cttaacgcttctgtggatgaaaact

SEQ ID NO: 108599 - DNA, 25 bp, Homo sapien
taacgcttctgtggatgaaaactgc

SEQ ID NO: 108600 - DNA, 25 bp, Homo sapien
aacgcttctgtggatgaaaactgcc

SEQ ID NO: 108601 - DNA, 25 bp, Homo sapien
acgcttctgtggatgaaaactgcca

SEQ ID NO: 108602 - DNA, 25 bp, Homo sapien
ggtgctatactcttgaccctcacac

SEQ ID NO: 108603 - DNA, 25 bp, Homo sapien
gtgctatactcttgaccctcacacc

SEQ ID NO: 108604 - DNA, 25 bp, Homo sapien
tgctatactcttgaccctcacaccc

SEQ ID NO: 108605 - DNA, 25 bp, Homo sapien
gctatactcttgaccctcacacccg

SEQ ID NO: 108606 - DNA, 25 bp, Homo sapien
ctatactcttgaccctcacacccgc

SEQ ID NO: 108607 - DNA, 25 bp, Homo sapien
atactcttgaccctcacacccgctg

SEQ ID NO: 108608 - DNA, 25 bp, Homo sapien
acacccgctgggagtactgtgcaat

SEQ ID NO: 108609 - DNA, 25 bp, Homo sapien
cacccgctgggagtactgtgcaatt

SEQ ID NO: 108610 - DNA, 25 bp, Homo sapien
acccgctgggagtactgtgcaatta

SEQ ID NO: 108611 - DNA, 25 bp, Homo sapien
cccgctgggagtactgtgcaattaa

SEQ ID NO: 108612 - DNA, 25 bp, Homo sapien
ccgctgggagtactgtgcaattaaa

SEQ ID NO: 108613 - DNA, 25 bp, Homo sapien
tttattttttcgcatcagtattaat

SEQ ID NO: 108614 - DNA, 25 bp, Homo sapien
catcagtattaatgtttttgcatac

SEQ ID NO: 108615 - DNA, 25 bp, Homo sapien
tgcatactttgcatctttattcaaa

SEQ ID NO: 108616 - DNA, 25 bp, Homo sapien
actttctttgtcaatctatggacat

SEQ ID NO: 108617 - DNA, 25 bp, Homo sapien
tttgtcaatctatggacatgcccat

SEQ ID NO: 108618 - DNA, 25 bp, Homo sapien
ggacatgcccatatatgaaggagat

SEQ ID NO: 108619 - DNA, 25 bp, Homo sapien
atgggtgggtcaaaaagggatatca

SEQ ID NO: 108620 - DNA, 25 bp, Homo sapien
gaagtggtgcataacattgccaaaa

SEQ ID NO: 108621 - DNA, 25 bp, Homo sapien
acattgccaaaatagtgtgccacta

SEQ ID NO: 108622 - DNA, 25 bp, Homo sapien
atagtgtgccactagaaatggtgta

SEQ ID NO: 108623 - DNA, 25 bp, Homo sapien
gaaatggtgtaaaggctgtcttttt

SEQ ID NO: 108624 - DNA, 25 bp, Homo sapien
gagtttggagccgactgcaagtaca

SEQ ID NO: 108625 - DNA, 25 bp, Homo sapien
gactgcaagtacaagtttgagaact

SEQ ID NO: 108626 - DNA, 25 bp, Homo sapien
gggcacaggcaccaaagtccgccaa

SEQ ID NO: 108627 - DNA, 25 bp, Homo sapien
aaagtccgccaaggcaccctgaaga

SEQ ID NO: 108628 - DNA, 25 bp, Homo sapien
aaggcaccctgaagaaggcgcgcta

SEQ ID NO: 108629 - DNA, 25 bp, Homo sapien
aagaaggcgcgctacaatgctcagt

SEQ ID NO: 108630 - DNA, 25 bp, Homo sapien
gaaggcgcgctacaatgctcagtgc

SEQ ID NO: 108631 - DNA, 25 bp, Homo sapien
gcgctacaatgctcagtgccaggag

SEQ ID NO: 108632 - DNA, 25 bp, Homo sapien
agtgccaggagaccatccgcgtcac

SEQ ID NO: 108633 - DNA, 25 bp, Homo sapien
ggactagacgccaagcctggatgcc

SEQ ID NO: 108634 - DNA, 25 bp, Homo sapien
actagacgccaagcctggatgccaa

SEQ ID NO: 108635 - DNA, 25 bp, Homo sapien
acaggacctgctggacacgctggag

SEQ ID NO: 108636 - DNA, 25 bp, Homo sapien
gacacgctggaggacaatcgagagt

SEQ ID NO: 108637 - DNA, 25 bp, Homo sapien
acaatcgagagtggtaccagagcaa

SEQ ID NO: 108638 - DNA, 25 bp, Homo sapien
agagtggtaccagagcaagatcccc

SEQ ID NO: 108639 - DNA, 25 bp, Homo sapien
gggacgggcctgacagattccagtt

SEQ ID NO: 108640 - DNA, 25 bp, Homo sapien
ggcctgacagattccagtttgaact

SEQ ID NO: 108641 - DNA, 25 bp, Homo sapien
gggaagagacagctttagccaaaga

SEQ ID NO: 108642 - DNA, 25 bp, Homo sapien
gacagctttagccaaagaggccttg

SEQ ID NO: 108643 - DNA, 25 bp, Homo sapien
aggccttggagttgcctgacactga

SEQ ID NO: 108644 - DNA, 25 bp, Homo sapien
tgacactgaactcctgtcccctgaa

SEQ ID NO: 108645 - DNA, 25 bp, Homo sapien
ggacttacccctcgacaaccagagg

SEQ ID NO: 108646 - DNA, 25 bp, Homo sapien
atgttaattatgcagtgtttccctc

SEQ ID NO: 108647 - DNA, 25 bp, Homo sapien
tttgttaatatttcttcgtgatgac

SEQ ID NO: 108648 - DNA, 25 bp, Homo sapien
ttcttcgtgatgacatatcacatgt

SEQ ID NO: 108649 - DNA, 25 bp, Homo sapien
gacatatcacatgtcagccactgtg

SEQ ID NO: 108650 - DNA, 25 bp, Homo sapien
ctgtgatagaggctgaggaatccaa

SEQ ID NO: 108651 - DNA, 25 bp, Homo sapien
gctgaggaatccaagaaaatggcca

SEQ ID NO: 108652 - DNA, 25 bp, Homo sapien
aaatggccagtaagatcaatgtgac

SEQ ID NO: 108653 - DNA, 25 bp, Homo sapien
aagatcaatgtgacggcagggaaat

SEQ ID NO: 108654 - DNA, 25 bp, Homo sapien
aatgtgacggcagggaaatgtatgt

SEQ ID NO: 108655 - DNA, 25 bp, Homo sapien
atgtgtgtctattttgtaactgtaa

SEQ ID NO: 108656 - DNA, 25 bp, Homo sapien
ctttcttgtaagatactgccttgtt

SEQ ID NO: 108657 - DNA, 25 bp, Homo sapien
gttacagaatacctatatgctaata

SEQ ID NO: 108658 - DNA, 25 bp, Homo sapien
ataaaatggctttccgatacccaga

SEQ ID NO: 108659 - DNA, 25 bp, Homo sapien
ggctttccgatacccagaacctgaa

SEQ ID NO: 108660 - DNA, 25 bp, Homo sapien
acccagaacctgaagacaaggccaa

SEQ ID NO: 108661 - DNA, 25 bp, Homo sapien
gagtgaatatgattccctgctgcca

SEQ ID NO: 108662 - DNA, 25 bp, Homo sapien
attccctgctgccagatgtgtatga

SEQ ID NO: 108663 - DNA, 25 bp, Homo sapien
atggccagaatctgcatcaagccct

SEQ ID NO: 108664 - DNA, 25 bp, Homo sapien
catcaagccctcctgtgataacaga

SEQ ID NO: 108665 - DNA, 25 bp, Homo sapien
agaatagaagcactcccctgataaa

SEQ ID NO: 108666 - DNA, 25 bp, Homo sapien
gaagcactcccctgataaatacttt

SEQ ID NO: 108667 - DNA, 25 bp, Homo sapien
aaatactttctgtgctccagggaac

SEQ ID NO: 108668 - DNA, 25 bp, Homo sapien
atcaagatcgctgcctctctaaagg

SEQ ID NO: 108669 - DNA, 25 bp, Homo sapien
atcgctgcctctctaaagggcatat

SEQ ID NO: 108670 - DNA, 25 bp, Homo sapien
atggcatctgccacagcagaatgga

SEQ ID NO: 108671 - DNA, 25 bp, Homo sapien
ctgccacagcagaatggagcggtgt

SEQ ID NO: 108672 - DNA, 25 bp, Homo sapien
tgtgaggaaggtcccttttcctctg

SEQ ID NO: 108673 - DNA, 25 bp, Homo sapien
tttaatcccctttctacagtgagtc

SEQ ID NO: 108674 - DNA, 25 bp, Homo sapien
ctttctacagtgagtccactaccct

SEQ ID NO: 108675 - DNA, 25 bp, Homo sapien
ccactaccctcactgaaaatcattt

SEQ ID NO: 108676 - DNA, 25 bp, Homo sapien
tgtaccacttacattttaggctggg

SEQ ID NO: 108677 - DNA, 25 bp, Homo sapien
gcaagcagccctgacctaagggaga

SEQ ID NO: 108678 - DNA, 25 bp, Homo sapien
tgagttggacagttcttgatagccc

SEQ ID NO: 108679 - DNA, 25 bp, Homo sapien
taaacattagcccaaaggacttctt

SEQ ID NO: 108680 - DNA, 25 bp, Homo sapien
ccttcaattgggagatacctttggt

SEQ ID NO: 108681 - DNA, 25 bp, Homo sapien
gagatacctttggtctgctcctgca

SEQ ID NO: 108682 - DNA, 25 bp, Homo sapien
ggtctgctcctgcaccaaagccata

SEQ ID NO: 108683 - DNA, 25 bp, Homo sapien
tgggtggaagtcagttggcctccct

SEQ ID NO: 108684 - DNA, 25 bp, Homo sapien
agttggcctccctggttctgcagag

SEQ ID NO: 108685 - DNA, 25 bp, Homo sapien
cgaggaggcgagactagaactgcac

SEQ ID NO: 108686 - DNA, 25 bp, Homo sapien
ttccctgatgtctgcagccatggct

SEQ ID NO: 108687 - DNA, 25 bp, Homo sapien
atgtctgcagccatggctttgcagc

SEQ ID NO: 108688 - DNA, 25 bp, Homo sapien
gatgctgggattcttgcctgtatga

SEQ ID NO: 108689 - DNA, 25 bp, Homo sapien
atcaagtattcatttattgcccgaa

SEQ ID NO: 108690 - DNA, 25 bp, Homo sapien
tcagacttgatcagggactaacacc

SEQ ID NO: 108691 - DNA, 25 bp, Homo sapien
tctgaggcctttagcctctgaatga

SEQ ID NO: 108692 - DNA, 25 bp, Homo sapien
ggcctttagcctctgaatgatacca

SEQ ID NO: 108693 - DNA, 25 bp, Homo sapien
tttagcctctgaatgataccactgg

SEQ ID NO: 108694 - DNA, 25 bp, Homo sapien
cctctgaatgataccactggctttc

SEQ ID NO: 108695 - DNA, 25 bp, Homo sapien
tggctttcctgcttctctatcctgc

SEQ ID NO: 108696 - DNA, 25 bp, Homo sapien
tgcttctctatcctgcagtcggcag

SEQ ID NO: 108697 - DNA, 25 bp, Homo sapien
ttctctatcctgcagtcggcagatc

SEQ ID NO: 108698 - DNA, 25 bp, Homo sapien
ctatcctgcagtcggcagatcatgg

SEQ ID NO: 108699 - DNA, 25 bp, Homo sapien
gatcatgggacttcttcactccaaa

SEQ ID NO: 108700 - DNA, 25 bp, Homo sapien
ttcactccaaaattgtgtgagccaa

SEQ ID NO: 108701 - DNA, 25 bp, Homo sapien
ttcctgtggtgatttaatgttccta

SEQ ID NO: 108702 - DNA, 25 bp, Homo sapien
acacagatgaagctgacctggttct

SEQ ID NO: 108703 - DNA, 25 bp, Homo sapien
gatgaagctgacctggttcttgcaa

SEQ ID NO: 108704 - DNA, 25 bp, Homo sapien
aagctgacctggttcttgcaaaaga

SEQ ID NO: 108705 - DNA, 25 bp, Homo sapien
gacctggttcttgcaaaagaagcta

SEQ ID NO: 108706 - DNA, 25 bp, Homo sapien
gaaatgtccacaaattgtgatagca

SEQ ID NO: 108707 - DNA, 25 bp, Homo sapien
gaagagagactgacatggcatgcat

SEQ ID NO: 108708 - DNA, 25 bp, Homo sapien
agagactgacatggcatgcatatcc

SEQ ID NO: 108709 - DNA, 25 bp, Homo sapien
gcatgcatatcctgaggatgcggaa

SEQ ID NO: 108710 - DNA, 25 bp, Homo sapien
aggaggggatggtctctgtcatttc

SEQ ID NO: 108711 - DNA, 25 bp, Homo sapien
ctttgtacataatacatttacctcc

SEQ ID NO: 108712 - DNA, 25 bp, Homo sapien
gaggagacacggaacaccaaggccc

SEQ ID NO: 108713 - DNA, 25 bp, Homo sapien
aggcccacgcacagactgacagaat

SEQ ID NO: 108714 - DNA, 25 bp, Homo sapien
tgacagaatgaacctgcagaccctg

SEQ ID NO: 108715 - DNA, 25 bp, Homo sapien
gaatgaacctgcagaccctgcgcgg

SEQ ID NO: 108716 - DNA, 25 bp, Homo sapien
agagcgaggccaagcagtcttccct

SEQ ID NO: 108717 - DNA, 25 bp, Homo sapien
tggcctggttgtccttgcagctgta

SEQ ID NO: 108718 - DNA, 25 bp, Homo sapien
ggttgtccttgcagctgtagtcact

SEQ ID NO: 108719 - DNA, 25 bp, Homo sapien
ttgcagctgtagtcactggagctgc

SEQ ID NO: 108720 - DNA, 25 bp, Homo sapien
cggtcgctgctgtgctgtggagaaa

SEQ ID NO: 108721 - DNA, 25 bp, Homo sapien
gactgagtggcaagtccctttgtga

SEQ ID NO: 108722 - DNA, 25 bp, Homo sapien
tgagtggcaagtccctttgtgactt

SEQ ID NO: 108723 - DNA, 25 bp, Homo sapien
gcaaaaaagcacaagcgaaccccag

SEQ ID NO: 108724 - DNA, 25 bp, Homo sapien
atgagcagcgcatcagacagaacgt

SEQ ID NO: 108725 - DNA, 25 bp, Homo sapien
gaacgtgcaggtgtttgaattccag

SEQ ID NO: 108726 - DNA, 25 bp, Homo sapien
tgaattccagttgacttcagaggag

SEQ ID NO: 108727 - DNA, 25 bp, Homo sapien
tttgacccttgatatttttgctggc

SEQ ID NO: 108728 - DNA, 25 bp, Homo sapien
cccccctaattatccattttctgat

SEQ ID NO: 108729 - DNA, 25 bp, Homo sapien
tgaatattaacatagagggtgttgc

SEQ ID NO: 108730 - DNA, 25 bp, Homo sapien
agggtgttgcacgacatctagcaga

SEQ ID NO: 108731 - DNA, 25 bp, Homo sapien
gggtgttgcacgacatctagcagaa

SEQ ID NO: 108732 - DNA, 25 bp, Homo sapien
ggtgttgcacgacatctagcagaag

SEQ ID NO: 108733 - DNA, 25 bp, Homo sapien
gtgttgcacgacatctagcagaagg

SEQ ID NO: 108734 - DNA, 25 bp, Homo sapien
aaacttttgcaatcttaagcagaga

SEQ ID NO: 108735 - DNA, 25 bp, Homo sapien
atagcaatatgagacacaggtggac

SEQ ID NO: 108736 - DNA, 25 bp, Homo sapien
acaggtggacgtagagttggccttt

SEQ ID NO: 108737 - DNA, 25 bp, Homo sapien
gagttggcctttttacaggcaaaga

SEQ ID NO: 108738 - DNA, 25 bp, Homo sapien
ttttacaggcaaagaggcgaattgt

SEQ ID NO: 108739 - DNA, 25 bp, Homo sapien
gaaggattgtaacatggaccatcca

SEQ ID NO: 108740 - DNA, 25 bp, Homo sapien
ggaccatccaaatttatggccgtat

SEQ ID NO: 108741 - DNA, 25 bp, Homo sapien
atggccgtatcaaatggtagctgaa

SEQ ID NO: 108742 - DNA, 25 bp, Homo sapien
aactatatttgagcactggtctctc

SEQ ID NO: 108743 - DNA, 25 bp, Homo sapien
agcactggtctctcttggaattaga

SEQ ID NO: 108744 - DNA, 25 bp, Homo sapien
aatgagcatctcaaatgttttctgc

SEQ ID NO: 108745 - DNA, 25 bp, Homo sapien
tgacctctgccccagataggtggtg

SEQ ID NO: 108746 - DNA, 25 bp, Homo sapien
cccagataggtggtgccagtggctt

SEQ ID NO: 108747 - DNA, 25 bp, Homo sapien
ggtgccagtggcttattaattccga

SEQ ID NO: 108748 - DNA, 25 bp, Homo sapien
gtggcttattaattccgatactagt

SEQ ID NO: 108749 - DNA, 25 bp, Homo sapien
attccgatactagtttgctttgctg

SEQ ID NO: 108750 - DNA, 25 bp, Homo sapien
gatactagtttgctttgctgaccaa

SEQ ID NO: 108751 - DNA, 25 bp, Homo sapien
gtttgctttgctgaccaaatgcctg

SEQ ID NO: 108752 - DNA, 25 bp, Homo sapien
tttgctgaccaaatgcctggtacca

SEQ ID NO: 108753 - DNA, 25 bp, Homo sapien
gggctctgtatatagctatgaagaa

SEQ ID NO: 108754 - DNA, 25 bp, Homo sapien
aaatctgagtatatatttacatgtc

SEQ ID NO: 108755 - DNA, 25 bp, Homo sapien
gtcgttaccagagatttacccatcg

SEQ ID NO: 108756 - DNA, 25 bp, Homo sapien
ctgaggttcccaggagcagcaaagg

SEQ ID NO: 108757 - DNA, 25 bp, Homo sapien
gcctgctgagctctggttaggttac

SEQ ID NO: 108758 - DNA, 25 bp, Homo sapien
gctgagctctggttaggttacagct

SEQ ID NO: 108759 - DNA, 25 bp, Homo sapien
agctctggttaggttacagctggag

SEQ ID NO: 108760 - DNA, 25 bp, Homo sapien
acagctggaggtgtgtatatataca

SEQ ID NO: 108761 - DNA, 25 bp, Homo sapien
tatatatatggctttccaataacca

SEQ ID NO: 108762 - DNA, 25 bp, Homo sapien
tggctttccaataaccacctaaatt

SEQ ID NO: 108763 - DNA, 25 bp, Homo sapien
ggttccttctaagtggtagaacttg

SEQ ID NO: 108764 - DNA, 25 bp, Homo sapien
accttccttcttcatactttgctct

SEQ ID NO: 108765 - DNA, 25 bp, Homo sapien
tgctctttttcttaaatactcatta

SEQ ID NO: 108766 - DNA, 25 bp, Homo sapien
atactcattaatgtgcatatatcat

SEQ ID NO: 108767 - DNA, 25 bp, Homo sapien
cggtttgccacatcggccgagggca

SEQ ID NO: 108768 - DNA, 25 bp, Homo sapien
gtgggtgttaggtactggctaaccg

SEQ ID NO: 108769 - DNA, 25 bp, Homo sapien
ggtggagatgcctgtctacaccagt

SEQ ID NO: 108770 - DNA, 25 bp, Homo sapien
agatgcctgtctacaccagtcctgt

SEQ ID NO: 108771 - DNA, 25 bp, Homo sapien
aggactccccttctgtggtctggag

SEQ ID NO: 108772 - DNA, 25 bp, Homo sapien
ttctgtggtctggaggttctaggct

SEQ ID NO: 108773 - DNA, 25 bp, Homo sapien
gtctggaggttctaggctggcctgg

SEQ ID NO: 108774 - DNA, 25 bp, Homo sapien
gcctgggctcttaaagggaggattt

SEQ ID NO: 108775 - DNA, 25 bp, Homo sapien
agggaggattttgcaggctgtcctc

SEQ ID NO: 108776 - DNA, 25 bp, Homo sapien
gagcacgccgagtgaccgcaggacc

SEQ ID NO: 108777 - DNA, 25 bp, Homo sapien
gtgaccgcaggacctgaacgccgct

SEQ ID NO: 108778 - DNA, 25 bp, Homo sapien
ggaagaggagacacggaacaccaag

SEQ ID NO: 108779 - DNA, 25 bp, Homo sapien
gaggagacacggaacaccaaggccc

SEQ ID NO: 108780 - DNA, 25 bp, Homo sapien
gagacacggaacaccaaggcccacg

SEQ ID NO: 108781 - DNA, 25 bp, Homo sapien
cagactgacagaatgaacctgcaga

SEQ ID NO: 108782 - DNA, 25 bp, Homo sapien
tgacagaatgaacctgcagaccctg

SEQ ID NO: 108783 - DNA, 25 bp, Homo sapien
tggcctggttgtccttgcagctgta

SEQ ID NO: 108784 - DNA, 25 bp, Homo sapien
gcctggttgtccttgcagctgtagt

SEQ ID NO: 108785 - DNA, 25 bp, Homo sapien
tggttgtccttgcagctgtagtcac

SEQ ID NO: 108786 - DNA, 25 bp, Homo sapien
ggttgtccttgcagctgtagtcact

SEQ ID NO: 108787 - DNA, 25 bp, Homo sapien
ttgcagctgtagtcactggagctgc

SEQ ID NO: 108788 - DNA, 25 bp, Homo sapien
cagctgtagtcactggagctgcggt

SEQ ID NO: 108789 - DNA, 25 bp, Homo sapien
ttcaatccaagtgggaggacgcaat

SEQ ID NO: 108790 - DNA, 25 bp, Homo sapien
gaggacgcaattcctttggcgctaa

SEQ ID NO: 108791 - DNA, 25 bp, Homo sapien
aaagatggcaactgaacaaggaaga

SEQ ID NO: 108792 - DNA, 25 bp, Homo sapien
cggcccttattcaaggatcttgctg

SEQ ID NO: 108793 - DNA, 25 bp, Homo sapien
ttattcaaggatcttgctgcctttg

SEQ ID NO: 108794 - DNA, 25 bp, Homo sapien
ttgctgcctttgacaaatcccatga

SEQ ID NO: 108795 - DNA, 25 bp, Homo sapien
aaatcccatgatcaagctgtccgaa

SEQ ID NO: 108796 - DNA, 25 bp, Homo sapien
tgatcaagctgtccgaacctaccaa

SEQ ID NO: 108797 - DNA, 25 bp, Homo sapien
gtccgaacctaccaagagcacaaag

SEQ ID NO: 108798 - DNA, 25 bp, Homo sapien
aaagcaagcatgcatcccgtgactg

SEQ ID NO: 108799 - DNA, 25 bp, Homo sapien
catcccgtgactgcaatgctggtgg

SEQ ID NO: 108800 - DNA, 25 bp, Homo sapien
taatgttaattatgcagtgtttccc

SEQ ID NO: 108801 - DNA, 25 bp, Homo sapien
atgttaattatgcagtgtttccctc

SEQ ID NO: 108802 - DNA, 25 bp, Homo sapien
tttgttaatatttcttcgtgatgac

SEQ ID NO: 108803 - DNA, 25 bp, Homo sapien
ttcttcgtgatgacatatcacatgt

SEQ ID NO: 108804 - DNA, 25 bp, Homo sapien
gacatatcacatgtcagccactgtg

SEQ ID NO: 108805 - DNA, 25 bp, Homo sapien
ctgtgatagaggctgaggaatccaa

SEQ ID NO: 108806 - DNA, 25 bp, Homo sapien
tgatagaggctgaggaatccaagaa

SEQ ID NO: 108807 - DNA, 25 bp, Homo sapien
gaaaatggccagtaagatcaatgtg

SEQ ID NO: 108808 - DNA, 25 bp, Homo sapien
atggccagtaagatcaatgtgacgg

SEQ ID NO: 108809 - DNA, 25 bp, Homo sapien
aagatcaatgtgacggcagggaaat

SEQ ID NO: 108810 - DNA, 25 bp, Homo sapien
aatgtgacggcagggaaatgtatgt

SEQ ID NO: 108811 - DNA, 25 bp, Homo sapien
aatgatctgttttgaaggcaaaatt

SEQ ID NO: 108812 - DNA, 25 bp, Homo sapien
tgatctgttttgaaggcaaaattgc

SEQ ID NO: 108813 - DNA, 25 bp, Homo sapien
gatctgttttgaaggcaaaattgca

SEQ ID NO: 108814 - DNA, 25 bp, Homo sapien
atctgttttgaaggcaaaattgcaa

SEQ ID NO: 108815 - DNA, 25 bp, Homo sapien
aaggcaaaattgcaaatcttgaaat

SEQ ID NO: 108816 - DNA, 25 bp, Homo sapien
aggcaaaattgcaaatcttgaaatt

SEQ ID NO: 108817 - DNA, 25 bp, Homo sapien
ggcaaaattgcaaatcttgaaatta

SEQ ID NO: 108818 - DNA, 25 bp, Homo sapien
gcaaaattgcaaatcttgaaattaa

SEQ ID NO: 108819 - DNA, 25 bp, Homo sapien
taaaaaacaactatggatcagaata

SEQ ID NO: 108820 - DNA, 25 bp, Homo sapien
aaaaacaactatggatcagaatagc

SEQ ID NO: 108821 - DNA, 25 bp, Homo sapien
actttttgttatcagtcaatatttt

SEQ ID NO: 108822 - DNA, 25 bp, Homo sapien
ttaatatataactttgccaggtacc

SEQ ID NO: 108823 - DNA, 25 bp, Homo sapien
taatatataactttgccaggtacca

SEQ ID NO: 108824 - DNA, 25 bp, Homo sapien
aatatataactttgccaggtaccac

SEQ ID NO: 108825 - DNA, 25 bp, Homo sapien
atatataactttgccaggtaccacg

SEQ ID NO: 108826 - DNA, 25 bp, Homo sapien
atataactttgccaggtaccacggc

SEQ ID NO: 108827 - DNA, 25 bp, Homo sapien
tataactttgccaggtaccacggct

SEQ ID NO: 108828 - DNA, 25 bp, Homo sapien
ataactttgccaggtaccacggctc

SEQ ID NO: 108829 - DNA, 25 bp, Homo sapien
taactttgccaggtaccacggctca

SEQ ID NO: 108830 - DNA, 25 bp, Homo sapien
aactttgccaggtaccacggctcac

SEQ ID NO: 108831 - DNA, 25 bp, Homo sapien
actttgccaggtaccacggctcacg

SEQ ID NO: 108832 - DNA, 25 bp, Homo sapien
caggtaccacggctcacgcctgtat

SEQ ID NO: 108833 - DNA, 25 bp, Homo sapien
attgaccactttgattcttgcttgt

SEQ ID NO: 108834 - DNA, 25 bp, Homo sapien
cttgcttgtttgtctcagttatagg

SEQ ID NO: 108835 - DNA, 25 bp, Homo sapien
agttttgtacatggtgcctcttgtt

SEQ ID NO: 108836 - DNA, 25 bp, Homo sapien
cttcatggccttttctgttgagaaa

SEQ ID NO: 108837 - DNA, 25 bp, Homo sapien
gtgtattaacagtgcatgcttttac

SEQ ID NO: 108838 - DNA, 25 bp, Homo sapien
aatgtggtgccaaatccctgtttgc

SEQ ID NO: 108839 - DNA, 25 bp, Homo sapien
ttgccatcgtttttactgtaccgat

SEQ ID NO: 108840 - DNA, 25 bp, Homo sapien
gtagtaatccttagccagtatgttc

SEQ ID NO: 108841 - DNA, 25 bp, Homo sapien
agccagtatgttcttttgctgaaac

SEQ ID NO: 108842 - DNA, 25 bp, Homo sapien
gaaactgttgcattttgggactttt

SEQ ID NO: 108843 - DNA, 25 bp, Homo sapien
tttccactttgtcatgtgtacattt

SEQ ID NO: 108844 - DNA, 25 bp, Homo sapien
tgaccccagggcacaggagctacct

SEQ ID NO: 108845 - DNA, 25 bp, Homo sapien
ggagctacctgtgtggacaggacta

SEQ ID NO: 108846 - DNA, 25 bp, Homo sapien
tggacaggactaacactcagaagcc

SEQ ID NO: 108847 - DNA, 25 bp, Homo sapien
taacactcagaagcctgggtgcctg

SEQ ID NO: 108848 - DNA, 25 bp, Homo sapien
ctgagggcagttcgcagccaccctg

SEQ ID NO: 108849 - DNA, 25 bp, Homo sapien
agggacaaaggagcctgtgaaccca

SEQ ID NO: 108850 - DNA, 25 bp, Homo sapien
ctgtgaacccaggacaagcatggtc

SEQ ID NO: 108851 - DNA, 25 bp, Homo sapien
gacaagcatggtcccacatccctgg

SEQ ID NO: 108852 - DNA, 25 bp, Homo sapien
agaacctggccttcagtgtaccgcg

SEQ ID NO: 108853 - DNA, 25 bp, Homo sapien
agtgtaccgcgtctaccctgggatt

SEQ ID NO: 108854 - DNA, 25 bp, Homo sapien
cgcgtctaccctgggattcaggaaa

SEQ ID NO: 108855 - DNA, 25 bp, Homo sapien
aagctagtgatcaacagtggcaatg

SEQ ID NO: 108856 - DNA, 25 bp, Homo sapien
agtgatcaacagtggcaatggagct

SEQ ID NO: 108857 - DNA, 25 bp, Homo sapien
gaaagccaagtggactcaacggaga

SEQ ID NO: 108858 - DNA, 25 bp, Homo sapien
gtggactcaacggagaggccagcaa

SEQ ID NO: 108859 - DNA, 25 bp, Homo sapien
agaggccagcaagtctcaggaaatg

SEQ ID NO: 108860 - DNA, 25 bp, Homo sapien
aggaaatggtgcatttggtgaacaa

SEQ ID NO: 108861 - DNA, 25 bp, Homo sapien
gtgaacaaggagtcgtcagaaactc

SEQ ID NO: 108862 - DNA, 25 bp, Homo sapien
agtcgtcagaaactccagaccagtt

SEQ ID NO: 108863 - DNA, 25 bp, Homo sapien
actccagaccagtttatgacagctg

SEQ ID NO: 108864 - DNA, 25 bp, Homo sapien
tgacagctgatgagacaaggaacct

SEQ ID NO: 108865 - DNA, 25 bp, Homo sapien
aggaacctgcagaatgtggacatga

SEQ ID NO: 108866 - DNA, 25 bp, Homo sapien
aaataggtttgattcttgttagagg

SEQ ID NO: 108867 - DNA, 25 bp, Homo sapien
gagggtttttgttctggaagccata

SEQ ID NO: 108868 - DNA, 25 bp, Homo sapien
tggaagccatatttgatagtatact

SEQ ID NO: 108869 - DNA, 25 bp, Homo sapien
ttgatagtatactttgtcttcactg

SEQ ID NO: 108870 - DNA, 25 bp, Homo sapien
tgtcttcactggtcttattttggga

SEQ ID NO: 108871 - DNA, 25 bp, Homo sapien
ctggtcttattttgggaggcactct

SEQ ID NO: 108872 - DNA, 25 bp, Homo sapien
gtaaagccaagtatgtttgtacagt

SEQ ID NO: 108873 - DNA, 25 bp, Homo sapien
gtttgtacagtatgttttacatgta

SEQ ID NO: 108874 - DNA, 25 bp, Homo sapien
ccatcccaacttcctttaattattg

SEQ ID NO: 108875 - DNA, 25 bp, Homo sapien
ttgctgttatcaatcatttctagat

SEQ ID NO: 108876 - DNA, 25 bp, Homo sapien
aactgactaaacttacatcagggaa

SEQ ID NO: 108877 - DNA, 25 bp, Homo sapien
aaattttctatgcttattgtacttg

SEQ ID NO: 108878 - DNA, 25 bp, Homo sapien
gcttattgtacttgttatcaacacg

SEQ ID NO: 108879 - DNA, 25 bp, Homo sapien
acacgtttgtatcagagttgctttt

SEQ ID NO: 108880 - DNA, 25 bp, Homo sapien
gtatcagagttgcttttctaatctt

SEQ ID NO: 108881 - DNA, 25 bp, Homo sapien
aaattgcttattctaggtctgtaat

SEQ ID NO: 108882 - DNA, 25 bp, Homo sapien
taatttattaactggctactgggaa

SEQ ID NO: 108883 - DNA, 25 bp, Homo sapien
attacttattttctggatctatctg

SEQ ID NO: 108884 - DNA, 25 bp, Homo sapien
attatcatactaccggctacatcaa

SEQ ID NO: 108885 - DNA, 25 bp, Homo sapien
accggctacatcaaatcagtccttt

SEQ ID NO: 108886 - DNA, 25 bp, Homo sapien
tcagtcctttgattccatttggtga

SEQ ID NO: 108887 - DNA, 25 bp, Homo sapien
atttggtgaccatctgtttgagaat

SEQ ID NO: 108888 - DNA, 25 bp, Homo sapien
aatggtttcatatctctattgtgac

SEQ ID NO: 108889 - DNA, 25 bp, Homo sapien
gactaattttctctcggtctactgc

SEQ ID NO: 108890 - DNA, 25 bp, Homo sapien
ggtctactgccttttcaatcaggaa

SEQ ID NO: 108891 - DNA, 25 bp, Homo sapien
ttgccatgaagccagtgaagttttt

SEQ ID NO: 108892 - DNA, 25 bp, Homo sapien
aagtgtctaggcttctcattagtgc

SEQ ID NO: 108893 - DNA, 25 bp, Homo sapien
tctcattagtgccaactctcctaga

SEQ ID NO: 108894 - DNA, 25 bp, Homo sapien
tctcctagacctggtgcctgttttt

SEQ ID NO: 108895 - DNA, 25 bp, Homo sapien
gttttgtttctacttctatccattt

SEQ ID NO: 108896 - DNA, 25 bp, Homo sapien
gaaataattatcacactcacaagct

SEQ ID NO: 108897 - DNA, 25 bp, Homo sapien
tgtctctttcatccagttttcctca

SEQ ID NO: 108898 - DNA, 25 bp, Homo sapien
cagttttcctcaagggtaacatctt

SEQ ID NO: 108899 - DNA, 25 bp, Homo sapien
aatattttgtcactgatcctgcaaa

SEQ ID NO: 108900 - DNA, 25 bp, Homo sapien
gtcactgatcctgcaaatggacatc

SEQ ID NO: 108901 - DNA, 25 bp, Homo sapien
atggacatcattttagcacactagc

SEQ ID NO: 108902 - DNA, 25 bp, Homo sapien
gcacactagcggtttatattttaag

SEQ ID NO: 108903 - DNA, 25 bp, Homo sapien
ttaaggaccttcattctctgttctg

SEQ ID NO: 108904 - DNA, 25 bp, Homo sapien
attctctgttctgcacctcttctgg

SEQ ID NO: 108905 - DNA, 25 bp, Homo sapien
actcagttgcaacttacgcttggca

SEQ ID NO: 108906 - DNA, 25 bp, Homo sapien
caacttacgcttggcatcttcagaa

SEQ ID NO: 108907 - DNA, 25 bp, Homo sapien
gcttggcatcttcagaatgcttttc

SEQ ID NO: 108908 - DNA, 25 bp, Homo sapien
attttttgctgtcataatcgcctca

SEQ ID NO: 108909 - DNA, 25 bp, Homo sapien
tgctgtcataatcgcctcataaaga

SEQ ID NO: 108910 - DNA, 25 bp, Homo sapien
atgactgaagcccaacatagcttga

SEQ ID NO: 108911 - DNA, 25 bp, Homo sapien
agcccaacatagcttgagcttccag

SEQ ID NO: 108912 - DNA, 25 bp, Homo sapien
atagcttgagcttccagaaacggtg

SEQ ID NO: 108913 - DNA, 25 bp, Homo sapien
agcttgagcttccagaaacggtgct

SEQ ID NO: 108914 - DNA, 25 bp, Homo sapien
tgagcttccagaaacggtgctcccc

SEQ ID NO: 108915 - DNA, 25 bp, Homo sapien
accagcttgtggctaacagtccctg

SEQ ID NO: 108916 - DNA, 25 bp, Homo sapien
gtggctaacagtccctgtggccgtc

SEQ ID NO: 108917 - DNA, 25 bp, Homo sapien
ccctgtggccgtccctgtgaagatg

SEQ ID NO: 108918 - DNA, 25 bp, Homo sapien
gtgaagatgacattagcattgcccc

SEQ ID NO: 108919 - DNA, 25 bp, Homo sapien
agatgacattagcattgcccccaac

SEQ ID NO: 108920 - DNA, 25 bp, Homo sapien
gttgcgtaagcatagcctggctttc

SEQ ID NO: 108921 - DNA, 25 bp, Homo sapien
gtttcagtgcactaatatgtaagac

SEQ ID NO: 108922 - DNA, 25 bp, Homo sapien
ctacttattgtagcatcctggaata

SEQ ID NO: 108923 - DNA, 25 bp, Homo sapien
gtagcatcctggaatatctccgtca

SEQ ID NO: 108924 - DNA, 25 bp, Homo sapien
atctccgtcaactcatattttcatg

SEQ ID NO: 108925 - DNA, 25 bp, Homo sapien
gtcaactcatattttcatgctgttc

SEQ ID NO: 108926 - DNA, 25 bp, Homo sapien
tcatgaaagattcaatgcccctgaa

SEQ ID NO: 108927 - DNA, 25 bp, Homo sapien
atgcccctgaatttaaatagctttt

SEQ ID NO: 108928 - DNA, 25 bp, Homo sapien
gttgaattttacatggctggagcta

SEQ ID NO: 108929 - DNA, 25 bp, Homo sapien
catggctggagctagaatttgatat

SEQ ID NO: 108930 - DNA, 25 bp, Homo sapien
tgaagcacagtgatcaagttatttt

SEQ ID NO: 108931 - DNA, 25 bp, Homo sapien
ggaaacaagtcagtcattcagatat

SEQ ID NO: 108932 - DNA, 25 bp, Homo sapien
tgggaggttgtcagagcagaaatca

SEQ ID NO: 108933 - DNA, 25 bp, Homo sapien
gggaggttgtcagagcagaaatcat

SEQ ID NO: 108934 - DNA, 25 bp, Homo sapien
ggaggttgtcagagcagaaatcatg

SEQ ID NO: 108935 - DNA, 25 bp, Homo sapien
gaggttgtcagagcagaaatcatga

SEQ ID NO: 108936 - DNA, 25 bp, Homo sapien
aggttgtcagagcagaaatcatgag

SEQ ID NO: 108937 - DNA, 25 bp, Homo sapien
ggttgtcagagcagaaatcatgaga

SEQ ID NO: 108938 - DNA, 25 bp, Homo sapien
gttgtcagagcagaaatcatgagat

SEQ ID NO: 108939 - DNA, 25 bp, Homo sapien
ttgtcagagcagaaatcatgagatc

SEQ ID NO: 108940 - DNA, 25 bp, Homo sapien
accctccccgaggacggagatgagg

SEQ ID NO: 108941 - DNA, 25 bp, Homo sapien
tgaggagtagtcagcgtgatgccaa

SEQ ID NO: 108942 - DNA, 25 bp, Homo sapien
gtgatgccaaaacgcgtcttcttaa

SEQ ID NO: 108943 - DNA, 25 bp, Homo sapien
aaacgcgtcttcttaatccaattct

SEQ ID NO: 108944 - DNA, 25 bp, Homo sapien
aattctgaatgtttcgtgtgggctt

SEQ ID NO: 108945 - DNA, 25 bp, Homo sapien
gtgtgggcttaataccatgtctatt

SEQ ID NO: 108946 - DNA, 25 bp, Homo sapien
aaacctccaaatttttcagcagaag

SEQ ID NO: 108947 - DNA, 25 bp, Homo sapien
gaagcactctgcgtcgctgagctga

SEQ ID NO: 108948 - DNA, 25 bp, Homo sapien
tgaggtcggctctgcgatccatacg

SEQ ID NO: 108949 - DNA, 25 bp, Homo sapien
gcacgtgctgtgacgatggctgaac

SEQ ID NO: 108950 - DNA, 25 bp, Homo sapien
tggctgaacggaaagtgtacactgt

SEQ ID NO: 108951 - DNA, 25 bp, Homo sapien
gccggttcttacctcttaggtgaag

SEQ ID NO: 108952 - DNA, 25 bp, Homo sapien
agaattgctgtgcaaggctcaccct

SEQ ID NO: 108953 - DNA, 25 bp, Homo sapien
cctctctctgtcaacactggaataa

SEQ ID NO: 108954 - DNA, 25 bp, Homo sapien
actggaataaactttgccttttctg

SEQ ID NO: 108955 - DNA, 25 bp, Homo sapien
gcaagcctgatgtggccgtgtacga

SEQ ID NO: 108956 - DNA, 25 bp, Homo sapien
gatggctcctggtccgagtggtttc

SEQ ID NO: 108957 - DNA, 25 bp, Homo sapien
cagagagccgtgtgtcccagggaaa

SEQ ID NO: 108958 - DNA, 25 bp, Homo sapien
tctgagaaggcctgagccgtgacct

SEQ ID NO: 108959 - DNA, 25 bp, Homo sapien
gacctcttctgcttactgtaactgc

SEQ ID NO: 108960 - DNA, 25 bp, Homo sapien
cttactgtaactgcggccggtttag

SEQ ID NO: 108961 - DNA, 25 bp, Homo sapien
gtttagtgaccccatgacttacagc

SEQ ID NO: 108962 - DNA, 25 bp, Homo sapien
gatcacctctggctttgtctctagc

SEQ ID NO: 108963 - DNA, 25 bp, Homo sapien
gcctcccctgtagacgtggtcaaga

SEQ ID NO: 108964 - DNA, 25 bp, Homo sapien
agacgagatacatgaactctgccct

SEQ ID NO: 108965 - DNA, 25 bp, Homo sapien
tgccctgggccagtacagtagcgct

SEQ ID NO: 108966 - DNA, 25 bp, Homo sapien
agtacagtagcgctggccactgtgc

SEQ ID NO: 108967 - DNA, 25 bp, Homo sapien
actgtgcccttaccatgctccagaa

SEQ ID NO: 108968 - DNA, 25 bp, Homo sapien
cccgagccttctacaaagggttcat

SEQ ID NO: 108969 - DNA, 25 bp, Homo sapien
tacaaagggttcatgccctcctttc

SEQ ID NO: 108970 - DNA, 25 bp, Homo sapien
ttctccgcttgggttcctggaacgt

SEQ ID NO: 108971 - DNA, 25 bp, Homo sapien
gagcagctgaaacgagccctcatgg

SEQ ID NO: 108972 - DNA, 25 bp, Homo sapien
atggctgcctgcacttcccgagagg

SEQ ID NO: 108973 - DNA, 25 bp, Homo sapien
aagattcaagagtattctcacttct

SEQ ID NO: 108974 - DNA, 25 bp, Homo sapien
aagagtattctcacttctgggttat

SEQ ID NO: 108975 - DNA, 25 bp, Homo sapien
agtattctcacttctgggttatcag

SEQ ID NO: 108976 - DNA, 25 bp, Homo sapien
attctcacttctgggttatcagcat

SEQ ID NO: 108977 - DNA, 25 bp, Homo sapien
acttctgggttatcagcataaactg

SEQ ID NO: 108978 - DNA, 25 bp, Homo sapien
gcataaactggaatgtagtgtcaga

SEQ ID NO: 108979 - DNA, 25 bp, Homo sapien
tagtgtcagaggatactgtggcttg

SEQ ID NO: 108980 - DNA, 25 bp, Homo sapien
aagaccaaggaataacattctgtag

SEQ ID NO: 108981 - DNA, 25 bp, Homo sapien
gaataacattctgtagttcctaaaa

SEQ ID NO: 108982 - DNA, 25 bp, Homo sapien
tctgtagttcctaaaaatactgact

SEQ ID NO: 108983 - DNA, 25 bp, Homo sapien
ttattcttttatggaacacttcagc

SEQ ID NO: 108984 - DNA, 25 bp, Homo sapien
agactggcggtggaccaggtggagc

SEQ ID NO: 108985 - DNA, 25 bp, Homo sapien
ccaggtggagccgaacgtgtaaaca

SEQ ID NO: 108986 - DNA, 25 bp, Homo sapien
gagccgaacgtgtaaacaggcattc

SEQ ID NO: 108987 - DNA, 25 bp, Homo sapien
gaacgtgtaaacaggcattcttggt

SEQ ID NO: 108988 - DNA, 25 bp, Homo sapien
gtaaacaggcattcttggttcgctc

SEQ ID NO: 108989 - DNA, 25 bp, Homo sapien
aaacaggcattcttggttcgctctg

SEQ ID NO: 108990 - DNA, 25 bp, Homo sapien
aggcattcttggttcgctctgtgac

SEQ ID NO: 108991 - DNA, 25 bp, Homo sapien
attcttggttcgctctgtgacccca

SEQ ID NO: 108992 - DNA, 25 bp, Homo sapien
tcttggttcgctctgtgaccccaga

SEQ ID NO: 108993 - DNA, 25 bp, Homo sapien
acggcttcgcacttcctgcacgtca

SEQ ID NO: 108994 - DNA, 25 bp, Homo sapien
gtcacctctgggactcgccgcggct

SEQ ID NO: 108995 - DNA, 25 bp, Homo sapien
attgcggtcctccagctcatctttc

SEQ ID NO: 108996 - DNA, 25 bp, Homo sapien
ttgcggtcctccagctcatctttca

SEQ ID NO: 108997 - DNA, 25 bp, Homo sapien
cctcctccttggctttaattatgct

SEQ ID NO: 108998 - DNA, 25 bp, Homo sapien
tcctccttggctttaattatgctaa

SEQ ID NO: 108999 - DNA, 25 bp, Homo sapien
cctccttggctttaattatgctaat

SEQ ID NO: 109000 - DNA, 25 bp, Homo sapien
tccttggctttaattatgctaatgt

SEQ ID NO: 109001 - DNA, 25 bp, Homo sapien
agcaccctgacgctgagcaaagcag

SEQ ID NO: 109002 - DNA, 25 bp, Homo sapien
gcaccctgacgctgagcaaagcaga

SEQ ID NO: 109003 - DNA, 25 bp, Homo sapien
accctgacgctgagcaaagcagact

SEQ ID NO: 109004 - DNA, 25 bp, Homo sapien
tgacgctgagcaaagcagactacga

SEQ ID NO: 109005 - DNA, 25 bp, Homo sapien
acgctgagcaaagcagactacgaga

SEQ ID NO: 109006 - DNA, 25 bp, Homo sapien
gcccaaatcctagacaaagccacag

SEQ ID NO: 109007 - DNA, 25 bp, Homo sapien
gtatatgcgaaggaaaaaccacaca

SEQ ID NO: 109008 - DNA, 25 bp, Homo sapien
aaccacacacaccagcaagatattg

SEQ ID NO: 109009 - DNA, 25 bp, Homo sapien
accagcaagatattgacgacctcaa

SEQ ID NO: 109010 - DNA, 25 bp, Homo sapien
gatattgacgacctcaagcggcaga

SEQ ID NO: 109011 - DNA, 25 bp, Homo sapien
gacctcaagcggcagaatgctcttc

SEQ ID NO: 109012 - DNA, 25 bp, Homo sapien
gcagaatgctcttctggagcagcaa

SEQ ID NO: 109013 - DNA, 25 bp, Homo sapien
agaaggcgaggtcaagtgcccaact

SEQ ID NO: 109014 - DNA, 25 bp, Homo sapien
gcgaggtcaagtgcccaactgcaga

SEQ ID NO: 109015 - DNA, 25 bp, Homo sapien
caagtgcccaactgcagaccaacta

SEQ ID NO: 109016 - DNA, 25 bp, Homo sapien
gaagaagctccggatggaggccagc

SEQ ID NO: 109017 - DNA, 25 bp, Homo sapien
tttctagggtttgtactcaggagtc

SEQ ID NO: 109018 - DNA, 25 bp, Homo sapien
ggtttgtactcaggagtctgactcc

SEQ ID NO: 109019 - DNA, 25 bp, Homo sapien
ctgactcctgggttctagggtatga

SEQ ID NO: 109020 - DNA, 25 bp, Homo sapien
gttctagggtatgaagatctttcta

SEQ ID NO: 109021 - DNA, 25 bp, Homo sapien
atattgttctagtttacgtgcccac

SEQ ID NO: 109022 - DNA, 25 bp, Homo sapien
ttacgtgcccaccagcagtaaaaca

SEQ ID NO: 109023 - DNA, 25 bp, Homo sapien
cagtaaaacagaattcccttgcctt

SEQ ID NO: 109024 - DNA, 25 bp, Homo sapien
catccttggcagacatttcactttt

SEQ ID NO: 109025 - DNA, 25 bp, Homo sapien
agacatttcacttttgccagtctgg

SEQ ID NO: 109026 - DNA, 25 bp, Homo sapien
agctaattaccaaggagattgagca

SEQ ID NO: 109027 - DNA, 25 bp, Homo sapien
ttgtctcctgtgaagtgtctatcat

SEQ ID NO: 109028 - DNA, 25 bp, Homo sapien
gtctgtccacagacttctgccctgg

SEQ ID NO: 109029 - DNA, 25 bp, Homo sapien
tggctcttccccatctaggcctggg

SEQ ID NO: 109030 - DNA, 25 bp, Homo sapien
cccatctaggcctgggcaggaacat

SEQ ID NO: 109031 - DNA, 25 bp, Homo sapien
aggcctgggcaggaacatatattat

SEQ ID NO: 109032 - DNA, 25 bp, Homo sapien
gcctgggtttttgtacaaaaatgtg

SEQ ID NO: 109033 - DNA, 25 bp, Homo sapien
atgtgagaaacctttgtgagacaga

SEQ ID NO: 109034 - DNA, 25 bp, Homo sapien
ggacatctgtgccttatttatactt

SEQ ID NO: 109035 - DNA, 25 bp, Homo sapien
catctgtgccttatttatacttatt

SEQ ID NO: 109036 - DNA, 25 bp, Homo sapien
atacttatttatttcaggagcaggg

SEQ ID NO: 109037 - DNA, 25 bp, Homo sapien
ggtcccggattcttgggtctccaag

SEQ ID NO: 109038 - DNA, 25 bp, Homo sapien
attcttgggtctccaagaagtctgt

SEQ ID NO: 109039 - DNA, 25 bp, Homo sapien
aggctcccacgacctggagacggcg

SEQ ID NO: 109040 - DNA, 25 bp, Homo sapien
tgcgccgggagaactacctctcgga

SEQ ID NO: 109041 - DNA, 25 bp, Homo sapien
gccgggagaactacctctcggagag

SEQ ID NO: 109042 - DNA, 25 bp, Homo sapien
tacctctcggagaggaggttctttg

SEQ ID NO: 109043 - DNA, 25 bp, Homo sapien
agaggaggttctttgaggaggagca

SEQ ID NO: 109044 - DNA, 25 bp, Homo sapien
tcacacccactgagagcatcatgtc

SEQ ID NO: 109045 - DNA, 25 bp, Homo sapien
acccactgagagcatcatgtccctg

SEQ ID NO: 109046 - DNA, 25 bp, Homo sapien
cactgagagcatcatgtccctgggc

SEQ ID NO: 109047 - DNA, 25 bp, Homo sapien
gagagcatcatgtccctgggcacgc

SEQ ID NO: 109048 - DNA, 25 bp, Homo sapien
agcatcatgtccctgggcacgcact

SEQ ID NO: 109049 - DNA, 25 bp, Homo sapien
gcttctccgagttcaccggcttctc

SEQ ID NO: 109050 - DNA, 25 bp, Homo sapien
gaagtttatcacagatgtctctaat

SEQ ID NO: 109051 - DNA, 25 bp, Homo sapien
agatgtctctaatctctatagctga

SEQ ID NO: 109052 - DNA, 25 bp, Homo sapien
taatctctatagctgatccctacct

SEQ ID NO: 109053 - DNA, 25 bp, Homo sapien
tcgctgtctttgtacccagcctgca

SEQ ID NO: 109054 - DNA, 25 bp, Homo sapien
agcctgcattctgtttcgatctgtc

SEQ ID NO: 109055 - DNA, 25 bp, Homo sapien
gatctgtcttttagcagtccataca

SEQ ID NO: 109056 - DNA, 25 bp, Homo sapien
ttagcagtccatacaatcatttttc

SEQ ID NO: 109057 - DNA, 25 bp, Homo sapien
aatcatttttctacatgctggccct

SEQ ID NO: 109058 - DNA, 25 bp, Homo sapien
atgcgagacataacatgggctctca

SEQ ID NO: 109059 - DNA, 25 bp, Homo sapien
gggctctcaactgatggtgaacttc

SEQ ID NO: 109060 - DNA, 25 bp, Homo sapien
ggtgaacttcttctggtgagtgaca

SEQ ID NO: 109061 - DNA, 25 bp, Homo sapien
cccaaggcacagcatatacagcatg

SEQ ID NO: 109062 - DNA, 25 bp, Homo sapien
agcatatacagcatggtcgcccctt

SEQ ID NO: 109063 - DNA, 25 bp, Homo sapien
gaacaaagagaggagccagcctccc

SEQ ID NO: 109064 - DNA, 25 bp, Homo sapien
gcagggtgggcttccgttctccaga

SEQ ID NO: 109065 - DNA, 25 bp, Homo sapien
ccgttctccagatctgtttgctctt

SEQ ID NO: 109066 - DNA, 25 bp, Homo sapien
gtttgctcttaacaggcagaacatg

SEQ ID NO: 109067 - DNA, 25 bp, Homo sapien
atgggagaatccttattcctggtta

SEQ ID NO: 109068 - DNA, 25 bp, Homo sapien
attcctggttaatcactatgcatat

SEQ ID NO: 109069 - DNA, 25 bp, Homo sapien
aagaaagcgtaagcctctgcaattt

SEQ ID NO: 109070 - DNA, 25 bp, Homo sapien
gcctctgcaattttaacttctcaaa

SEQ ID NO: 109071 - DNA, 25 bp, Homo sapien
ggatgtctctgaaaagaatcacttt

SEQ ID NO: 109072 - DNA, 25 bp, Homo sapien
tattactgtctacagcataatagtt

SEQ ID NO: 109073 - DNA, 25 bp, Homo sapien
tactgtctacagcataatagttacc

SEQ ID NO: 109074 - DNA, 25 bp, Homo sapien
actgtctacagcataatagttaccc

SEQ ID NO: 109075 - DNA, 25 bp, Homo sapien
ctgtctacagcataatagttaccct

SEQ ID NO: 109076 - DNA, 25 bp, Homo sapien
tgtctacagcataatagttaccctt

SEQ ID NO: 109077 - DNA, 25 bp, Homo sapien
gtctacagcataatagttacccttg

SEQ ID NO: 109078 - DNA, 25 bp, Homo sapien
tctacagcataatagttacccttgg

SEQ ID NO: 109079 - DNA, 25 bp, Homo sapien
cagcataatagttacccttggacgt

SEQ ID NO: 109080 - DNA, 25 bp, Homo sapien
gcataatagttacccttggacgttc

SEQ ID NO: 109081 - DNA, 25 bp, Homo sapien
gcattagaaatgatttagcctggta

SEQ ID NO: 109082 - DNA, 25 bp, Homo sapien
attagaaatgatttagcctggtatc

SEQ ID NO: 109083 - DNA, 25 bp, Homo sapien
tgactccacagcctagcggtcaggc

SEQ ID NO: 109084 - DNA, 25 bp, Homo sapien
gactccacagcctagcggtcaggcc

SEQ ID NO: 109085 - DNA, 25 bp, Homo sapien
actccacagcctagcggtcaggccg

SEQ ID NO: 109086 - DNA, 25 bp, Homo sapien
ctccacagcctagcggtcaggccgt

SEQ ID NO: 109087 - DNA, 25 bp, Homo sapien
tccacagcctagcggtcaggccgtg

SEQ ID NO: 109088 - DNA, 25 bp, Homo sapien
cacagcctagcggtcaggccgtgtt

SEQ ID NO: 109089 - DNA, 25 bp, Homo sapien
acagcctagcggtcaggccgtgttt

SEQ ID NO: 109090 - DNA, 25 bp, Homo sapien
cagcctagcggtcaggccgtgtttg

SEQ ID NO: 109091 - DNA, 25 bp, Homo sapien
agcctagcggtcaggccgtgtttgc

SEQ ID NO: 109092 - DNA, 25 bp, Homo sapien
gcctagcggtcaggccgtgtttgcc

SEQ ID NO: 109093 - DNA, 25 bp, Homo sapien
cctagcggtcaggccgtgtttgcct

SEQ ID NO: 109094 - DNA, 25 bp, Homo sapien
gcctccatatttatgcctggaagga

SEQ ID NO: 109095 - DNA, 25 bp, Homo sapien
atgcctggaaggaaagaggcctatg

SEQ ID NO: 109096 - DNA, 25 bp, Homo sapien
ttgagaaattctagttcagcacctg

SEQ ID NO: 109097 - DNA, 25 bp, Homo sapien
gagaaattctagttcagcacctggt

SEQ ID NO: 109098 - DNA, 25 bp, Homo sapien
agaaattctagttcagcacctggtc

SEQ ID NO: 109099 - DNA, 25 bp, Homo sapien
gaaattctagttcagcacctggtca

SEQ ID NO: 109100 - DNA, 25 bp, Homo sapien
aaattctagttcagcacctggtcac

SEQ ID NO: 109101 - DNA, 25 bp, Homo sapien
aattctagttcagcacctggtcaca

SEQ ID NO: 109102 - DNA, 25 bp, Homo sapien
attctagttcagcacctggtcacaa

SEQ ID NO: 109103 - DNA, 25 bp, Homo sapien
ttctagttcagcacctggtcacaaa

SEQ ID NO: 109104 - DNA, 25 bp, Homo sapien
tctagttcagcacctggtcacaaat

SEQ ID NO: 109105 - DNA, 25 bp, Homo sapien
tgctgcttgggaacagagcctccta

SEQ ID NO: 109106 - DNA, 25 bp, Homo sapien
gctgcttgggaacagagcctcctag

SEQ ID NO: 109107 - DNA, 25 bp, Homo sapien
cagagcctcctagaaaaattttcca

SEQ ID NO: 109108 - DNA, 25 bp, Homo sapien
aattttccactgaactttaccagca

SEQ ID NO: 109109 - DNA, 25 bp, Homo sapien
cagcaactgaataacctggaagcat

SEQ ID NO: 109110 - DNA, 25 bp, Homo sapien
agcaactgaataacctggaagcatg

SEQ ID NO: 109111 - DNA, 25 bp, Homo sapien
gcaactgaataacctggaagcatgt

SEQ ID NO: 109112 - DNA, 25 bp, Homo sapien
caactgaataacctggaagcatgtg

SEQ ID NO: 109113 - DNA, 25 bp, Homo sapien
aactgaataacctggaagcatgtgt

SEQ ID NO: 109114 - DNA, 25 bp, Homo sapien
actgaataacctggaagcatgtgtg

SEQ ID NO: 109115 - DNA, 25 bp, Homo sapien
ataacctggaagcatgtgtgataca

SEQ ID NO: 109116 - DNA, 25 bp, Homo sapien
agaatagcatgaaccagcctgggcc

SEQ ID NO: 109117 - DNA, 25 bp, Homo sapien
tgagctcggtcgcacactcacttct

SEQ ID NO: 109118 - DNA, 25 bp, Homo sapien
acactcacttctcttccttgggatc

SEQ ID NO: 109119 - DNA, 25 bp, Homo sapien
ccttgggatccctaagaccgtggag

SEQ ID NO: 109120 - DNA, 25 bp, Homo sapien
atccctaagaccgtggaggagagag

SEQ ID NO: 109121 - DNA, 25 bp, Homo sapien
gagaccaaatgtcacgttttgtttt

SEQ ID NO: 109122 - DNA, 25 bp, Homo sapien
tgtgccaacctattttgaagtacca

SEQ ID NO: 109123 - DNA, 25 bp, Homo sapien
gaagtaccaccaaaaaagctgtatt

SEQ ID NO: 109124 - DNA, 25 bp, Homo sapien
aaaggttttgagcatgggttcatcc

SEQ ID NO: 109125 - DNA, 25 bp, Homo sapien
gagcatgggttcatcctattctttc

SEQ ID NO: 109126 - DNA, 25 bp, Homo sapien
gggttcatcctattctttcgaaaga

SEQ ID NO: 109127 - DNA, 25 bp, Homo sapien
agctcttgcgtccatggacactgtg

SEQ ID NO: 109128 - DNA, 25 bp, Homo sapien
tccatggacactgtgccctgagctg

SEQ ID NO: 109129 - DNA, 25 bp, Homo sapien
gtaccttgtggtatctgactctggc

SEQ ID NO: 109130 - DNA, 25 bp, Homo sapien
taccttgtggtatctgactctggca

SEQ ID NO: 109131 - DNA, 25 bp, Homo sapien
tgactctggcatctcaactgactac

SEQ ID NO: 109132 - DNA, 25 bp, Homo sapien
actctggcatctcaactgactacag

SEQ ID NO: 109133 - DNA, 25 bp, Homo sapien
tctggcatctcaactgactacagct

SEQ ID NO: 109134 - DNA, 25 bp, Homo sapien
tggcatctcaactgactacagctca

SEQ ID NO: 109135 - DNA, 25 bp, Homo sapien
catctcaactgactacagctcaggg

SEQ ID NO: 109136 - DNA, 25 bp, Homo sapien
acccttatgagaacagccttatccc

SEQ ID NO: 109137 - DNA, 25 bp, Homo sapien
tgctcttaggacaccaggctgcaga

SEQ ID NO: 109138 - DNA, 25 bp, Homo sapien
gggccgctgacttctttcacaagta

SEQ ID NO: 109139 - DNA, 25 bp, Homo sapien
tcacaagtactatctgttcccctgt

SEQ ID NO: 109140 - DNA, 25 bp, Homo sapien
agcaaagtgctggattgtccttgga

SEQ ID NO: 109141 - DNA, 25 bp, Homo sapien
agtgctggattgtccttggaggaaa

SEQ ID NO: 109142 - DNA, 25 bp, Homo sapien
gaatacatgcgtgtacctcacttta

SEQ ID NO: 109143 - DNA, 25 bp, Homo sapien
gcgtgtacctcactttacataagaa

SEQ ID NO: 109144 - DNA, 25 bp, Homo sapien
tgtattcctgaaaagctgcatttaa

SEQ ID NO: 109145 - DNA, 25 bp, Homo sapien
gcatttaaatcaagtcccaaattca

SEQ ID NO: 109146 - DNA, 25 bp, Homo sapien
gaaaccctatggagaatttatccct

SEQ ID NO: 109147 - DNA, 25 bp, Homo sapien
gagaatttatccctttacaatgtga

SEQ ID NO: 109148 - DNA, 25 bp, Homo sapien
gtgaatagtcatctcctaatttgtt

SEQ ID NO: 109149 - DNA, 25 bp, Homo sapien
tacctgttatcagtagtgcctttac

SEQ ID NO: 109150 - DNA, 25 bp, Homo sapien
gttatcagtagtgcctttacttcag

SEQ ID NO: 109151 - DNA, 25 bp, Homo sapien
gtagtgcctttacttcaggcttgat

SEQ ID NO: 109152 - DNA, 25 bp, Homo sapien
caggcttgataatacttaggtgtga

SEQ ID NO: 109153 - DNA, 25 bp, Homo sapien
tataatctatatgctgcacccactt

SEQ ID NO: 109154 - DNA, 25 bp, Homo sapien
atatgctgcacccacttaatctact

SEQ ID NO: 109155 - DNA, 25 bp, Homo sapien
gcacccacttaatctactgtggtgt

SEQ ID NO: 109156 - DNA, 25 bp, Homo sapien
acttaatctactgtggtgttttgtt

SEQ ID NO: 109157 - DNA, 25 bp, Homo sapien
ttgcataatttcagcttctatatat

SEQ ID NO: 109158 - DNA, 25 bp, Homo sapien
atttcagcttctatatattgtatgt

SEQ ID NO: 109159 - DNA, 25 bp, Homo sapien
aaaaacatacacaatgtgtctttct

SEQ ID NO: 109160 - DNA, 25 bp, Homo sapien
tttacagactgagtgacagtactca

SEQ ID NO: 109161 - DNA, 25 bp, Homo sapien
ttacagactgagtgacagtactcag

SEQ ID NO: 109162 - DNA, 25 bp, Homo sapien
acagactgagtgacagtactcagta

SEQ ID NO: 109163 - DNA, 25 bp, Homo sapien
gagtgacagtactcagtatatctga

SEQ ID NO: 109164 - DNA, 25 bp, Homo sapien
agtgacagtactcagtatatctgag

SEQ ID NO: 109165 - DNA, 25 bp, Homo sapien
gtgacagtactcagtatatctgaga

SEQ ID NO: 109166 - DNA, 25 bp, Homo sapien
tgacagtactcagtatatctgagat

SEQ ID NO: 109167 - DNA, 25 bp, Homo sapien
gacagtactcagtatatctgagata

SEQ ID NO: 109168 - DNA, 25 bp, Homo sapien
acagtactcagtatatctgagataa

SEQ ID NO: 109169 - DNA, 25 bp, Homo sapien
tatatctgagataaactctataatg

SEQ ID NO: 109170 - DNA, 25 bp, Homo sapien
taaactctataatgttttggataaa

SEQ ID NO: 109171 - DNA, 25 bp, Homo sapien
tgtaccttgtggtatctgactctgg

SEQ ID NO: 109172 - DNA, 25 bp, Homo sapien
gtaccttgtggtatctgactctggc

SEQ ID NO: 109173 - DNA, 25 bp, Homo sapien
taccttgtggtatctgactctggca

SEQ ID NO: 109174 - DNA, 25 bp, Homo sapien
tgactctggcatctcaactgactac

SEQ ID NO: 109175 - DNA, 25 bp, Homo sapien
gactctggcatctcaactgactaca

SEQ ID NO: 109176 - DNA, 25 bp, Homo sapien
actctggcatctcaactgactacag

SEQ ID NO: 109177 - DNA, 25 bp, Homo sapien
tctggcatctcaactgactacagct

SEQ ID NO: 109178 - DNA, 25 bp, Homo sapien
tggcatctcaactgactacagctca

SEQ ID NO: 109179 - DNA, 25 bp, Homo sapien
ggcatctcaactgactacagctcag

SEQ ID NO: 109180 - DNA, 25 bp, Homo sapien
gcatctcaactgactacagctcagg

SEQ ID NO: 109181 - DNA, 25 bp, Homo sapien
catctcaactgactacagctcaggg

SEQ ID NO: 109182 - DNA, 25 bp, Homo sapien
gatgctatatgatacaactgtggcc

SEQ ID NO: 109183 - DNA, 25 bp, Homo sapien
ggaaaggagctcacgcccagagact

SEQ ID NO: 109184 - DNA, 25 bp, Homo sapien
cagagactgggctgctctcccggag

SEQ ID NO: 109185 - DNA, 25 bp, Homo sapien
gaaggtctggcaaagtcaggctcag

SEQ ID NO: 109186 - DNA, 25 bp, Homo sapien
tgctgcagacctcggtgtggacaca

SEQ ID NO: 109187 - DNA, 25 bp, Homo sapien
tgtggacacacgctgcatagagctc

SEQ ID NO: 109188 - DNA, 25 bp, Homo sapien
acgctgcatagagctctccttgaaa

SEQ ID NO: 109189 - DNA, 25 bp, Homo sapien
tagagctctccttgaaaacagaggg

SEQ ID NO: 109190 - DNA, 25 bp, Homo sapien
gggtctcaagacattctgcctacct

SEQ ID NO: 109191 - DNA, 25 bp, Homo sapien
agacattctgcctacctattagctt

SEQ ID NO: 109192 - DNA, 25 bp, Homo sapien
ttgagaagtttgtcttgcaatgtat

SEQ ID NO: 109193 - DNA, 25 bp, Homo sapien
actagggtggagaccgccaccgaga

SEQ ID NO: 109194 - DNA, 25 bp, Homo sapien
gagaccgcctggatctccttggtga

SEQ ID NO: 109195 - DNA, 25 bp, Homo sapien
tgaccgctctgcatctagtgctggg

SEQ ID NO: 109196 - DNA, 25 bp, Homo sapien
gcagtttcctgcacactacaggtac

SEQ ID NO: 109197 - DNA, 25 bp, Homo sapien
agactggcggtggaccaggtggagc

SEQ ID NO: 109198 - DNA, 25 bp, Homo sapien
ccaggtggagccgaacgtgtaaaca

SEQ ID NO: 109199 - DNA, 25 bp, Homo sapien
gagccgaacgtgtaaacaggcattc

SEQ ID NO: 109200 - DNA, 25 bp, Homo sapien
gtaaacaggcattcttggttcgctc

SEQ ID NO: 109201 - DNA, 25 bp, Homo sapien
aaacaggcattcttggttcgctctg

SEQ ID NO: 109202 - DNA, 25 bp, Homo sapien
aggcattcttggttcgctctgtgac

SEQ ID NO: 109203 - DNA, 25 bp, Homo sapien
tcttggttcgctctgtgaccccaga

SEQ ID NO: 109204 - DNA, 25 bp, Homo sapien
tttctcttcctcataagcttctaaa

SEQ ID NO: 109205 - DNA, 25 bp, Homo sapien
agcttctaaattaatctctgccttt

SEQ ID NO: 109206 - DNA, 25 bp, Homo sapien
tctaaattaatctctgccttttctg

SEQ ID NO: 109207 - DNA, 25 bp, Homo sapien
tgccttttctgacctcatataacac

SEQ ID NO: 109208 - DNA, 25 bp, Homo sapien
tttctgacctcatataacacattat

SEQ ID NO: 109209 - DNA, 25 bp, Homo sapien
acacattatgtaggtttcttatcac

SEQ ID NO: 109210 - DNA, 25 bp, Homo sapien
ttatgtaggtttcttatcactttct

SEQ ID NO: 109211 - DNA, 25 bp, Homo sapien
atatttaaaataccttcagcctaag

SEQ ID NO: 109212 - DNA, 25 bp, Homo sapien
taccttcagcctaaggcacaaggat

SEQ ID NO: 109213 - DNA, 25 bp, Homo sapien
cacaacacaggtctaaactcagcat

SEQ ID NO: 109214 - DNA, 25 bp, Homo sapien
acacaggtctaaactcagcatgctt

SEQ ID NO: 109215 - DNA, 25 bp, Homo sapien
atctatggacaatatgactgttcga

SEQ ID NO: 109216 - DNA, 25 bp, Homo sapien
atatgactgttcgagtgcctgaaac

SEQ ID NO: 109217 - DNA, 25 bp, Homo sapien
tgcctgaaacagtggctgatgccag

SEQ ID NO: 109218 - DNA, 25 bp, Homo sapien
ggctgatgccagacaatccattgat

SEQ ID NO: 109219 - DNA, 25 bp, Homo sapien
aatccattgatgtgggcaagacctc

SEQ ID NO: 109220 - DNA, 25 bp, Homo sapien
gggcaagacctcctgaactagaaca

SEQ ID NO: 109221 - DNA, 25 bp, Homo sapien
gagaacatggatgagtggacttcat

SEQ ID NO: 109222 - DNA, 25 bp, Homo sapien
gtggacttcatattatgactagctt

SEQ ID NO: 109223 - DNA, 25 bp, Homo sapien
gctttactattttaattcaccttgc

SEQ ID NO: 109224 - DNA, 25 bp, Homo sapien
caccttgcataactactgaattttg

SEQ ID NO: 109225 - DNA, 25 bp, Homo sapien
aattttgtcattcttgaaagtatgc

SEQ ID NO: 109226 - DNA, 25 bp, Homo sapien
acggatgccgctggtgctcaggaag

SEQ ID NO: 109227 - DNA, 25 bp, Homo sapien
tgccgctggtgctcaggaagagcta

SEQ ID NO: 109228 - DNA, 25 bp, Homo sapien
gccgctggtgctcaggaagagctag

SEQ ID NO: 109229 - DNA, 25 bp, Homo sapien
aaggcaggactcacgactgagagag

SEQ ID NO: 109230 - DNA, 25 bp, Homo sapien
aggcaggactcacgactgagagaga

SEQ ID NO: 109231 - DNA, 25 bp, Homo sapien
ggcaggactcacgactgagagagag

SEQ ID NO: 109232 - DNA, 25 bp, Homo sapien
gcaggactcacgactgagagagaga

SEQ ID NO: 109233 - DNA, 25 bp, Homo sapien
caggactcacgactgagagagagag

SEQ ID NO: 109234 - DNA, 25 bp, Homo sapien
aggactcacgactgagagagagagg

SEQ ID NO: 109235 - DNA, 25 bp, Homo sapien
ggactcacgactgagagagagagga

SEQ ID NO: 109236 - DNA, 25 bp, Homo sapien
gactcacgactgagagagagaggag

SEQ ID NO: 109237 - DNA, 25 bp, Homo sapien
aaaaaagcaatccaacccactgcag

SEQ ID NO: 109238 - DNA, 25 bp, Homo sapien
aaagcaatccaacccactgcagaag

SEQ ID NO: 109239 - DNA, 25 bp, Homo sapien
agcaatccaacccactgcagaagct

SEQ ID NO: 109240 - DNA, 25 bp, Homo sapien
tccaacccactgcagaagctctttt

SEQ ID NO: 109241 - DNA, 25 bp, Homo sapien
gctctttttgagcacttggtggcat

SEQ ID NO: 109242 - DNA, 25 bp, Homo sapien
gctcaggaaccccttctgttctctg

SEQ ID NO: 109243 - DNA, 25 bp, Homo sapien
gaactcaacagaggacattggctca

SEQ ID NO: 109244 - DNA, 25 bp, Homo sapien
gaggacattggctcacgcactgtga

SEQ ID NO: 109245 - DNA, 25 bp, Homo sapien
agattttgtttttatacttgcaact

SEQ ID NO: 109246 - DNA, 25 bp, Homo sapien
gtttttatacttgcaactggtgaat

SEQ ID NO: 109247 - DNA, 25 bp, Homo sapien
atacttgcaactggtgaattatttt

SEQ ID NO: 109248 - DNA, 25 bp, Homo sapien
gagaagatttatgtcagcacacact

SEQ ID NO: 109249 - DNA, 25 bp, Homo sapien
agcacacacttacagagcacaaatg

SEQ ID NO: 109250 - DNA, 25 bp, Homo sapien
tgcagtatataggtgctggatgtat

SEQ ID NO: 109251 - DNA, 25 bp, Homo sapien
gtattgattttaaatggatgtccca

SEQ ID NO: 109252 - DNA, 25 bp, Homo sapien
atggatgtcccaatgcacctagaaa

SEQ ID NO: 109253 - DNA, 25 bp, Homo sapien
caatgcacctagaaaattggtctct

SEQ ID NO: 109254 - DNA, 25 bp, Homo sapien
tagctatttgctaaatgctgttctt

SEQ ID NO: 109255 - DNA, 25 bp, Homo sapien
ttgctaaatgctgttcttacacata

SEQ ID NO: 109256 - DNA, 25 bp, Homo sapien
taatttcttaattttcaccgagcag

SEQ ID NO: 109257 - DNA, 25 bp, Homo sapien
aattttcaccgagcagaggtggaaa

SEQ ID NO: 109258 - DNA, 25 bp, Homo sapien
tacttttgctttcagggaaaatggt

SEQ ID NO: 109259 - DNA, 25 bp, Homo sapien
gtattagggaacttttaattgacat

SEQ ID NO: 109260 - DNA, 25 bp, Homo sapien
gagatgctaaagtcagacattggaa

SEQ ID NO: 109261 - DNA, 25 bp, Homo sapien
gtcagacattggaattggaagaact

SEQ ID NO: 109262 - DNA, 25 bp, Homo sapien
taaagtgtgattcgatcgtcaagac

SEQ ID NO: 109263 - DNA, 25 bp, Homo sapien
tgattcgatcgtcaagacatcactt

SEQ ID NO: 109264 - DNA, 25 bp, Homo sapien
gatcgtcaagacatcacttggattt

SEQ ID NO: 109265 - DNA, 25 bp, Homo sapien
agacatcacttggatttcttaatct

SEQ ID NO: 109266 - DNA, 25 bp, Homo sapien
catcacttggatttcttaatcttaa

SEQ ID NO: 109267 - DNA, 25 bp, Homo sapien
tgaggtgctgcattctagaacttca

SEQ ID NO: 109268 - DNA, 25 bp, Homo sapien
ccttcttaaaccaccagtggttcat

SEQ ID NO: 109269 - DNA, 25 bp, Homo sapien
tttaaggttttttcatcaagagaag

SEQ ID NO: 109270 - DNA, 25 bp, Homo sapien
atatagcaggcacgtccgggtcctc

SEQ ID NO: 109271 - DNA, 25 bp, Homo sapien
tgtccttccactcaacagtcatcaa

SEQ ID NO: 109272 - DNA, 25 bp, Homo sapien
agtcatcaaccactaccgcatgcgg

SEQ ID NO: 109273 - DNA, 25 bp, Homo sapien
tttgccaacctcaaatcgtgctgtg

SEQ ID NO: 109274 - DNA, 25 bp, Homo sapien
aacctcaaatcgtgctgtgtgccca

SEQ ID NO: 109275 - DNA, 25 bp, Homo sapien
gtgcccaccaagctgagacccatgt

SEQ ID NO: 109276 - DNA, 25 bp, Homo sapien
gagacccatgtccatgttgtactat

SEQ ID NO: 109277 - DNA, 25 bp, Homo sapien
catgttgtactatgatgatggtcaa

SEQ ID NO: 109278 - DNA, 25 bp, Homo sapien
gacattcagaacatgatcgtggagg

SEQ ID NO: 109279 - DNA, 25 bp, Homo sapien
gggtgctcatagagttgcccagccc

SEQ ID NO: 109280 - DNA, 25 bp, Homo sapien
agttgtccagagaagacagtggcaa

SEQ ID NO: 109281 - DNA, 25 bp, Homo sapien
agcggactgggctgtaacagcttcc

SEQ ID NO: 109282 - DNA, 25 bp, Homo sapien
ctgggcctagggacagactgcaaga

SEQ ID NO: 109283 - DNA, 25 bp, Homo sapien
tagggacagactgcaagaggctcct

SEQ ID NO: 109284 - DNA, 25 bp, Homo sapien
gtgtcatcttgttgccatggagttg

SEQ ID NO: 109285 - DNA, 25 bp, Homo sapien
catcttgttgccatggagttgtgat

SEQ ID NO: 109286 - DNA, 25 bp, Homo sapien
gagttgtgatcatcccatctaagct

SEQ ID NO: 109287 - DNA, 25 bp, Homo sapien
gatcatcccatctaagctgcagctt

SEQ ID NO: 109288 - DNA, 25 bp, Homo sapien
gctgcagcttcctgtcaacacttct

SEQ ID NO: 109289 - DNA, 25 bp, Homo sapien
caacacttctcacatcttatgctaa

SEQ ID NO: 109290 - DNA, 25 bp, Homo sapien
ttctcacatcttatgctaactgtag

SEQ ID NO: 109291 - DNA, 25 bp, Homo sapien
tctcccaccccatgcattaaatttt

SEQ ID NO: 109292 - DNA, 25 bp, Homo sapien
tcagagagcatgctaaagcccgtgt

SEQ ID NO: 109293 - DNA, 25 bp, Homo sapien
atgctaaagcccgtgtggaccatgg

SEQ ID NO: 109294 - DNA, 25 bp, Homo sapien
tgagatcattacacagtccccaggc

SEQ ID NO: 109295 - DNA, 25 bp, Homo sapien
aatgtctcctcgtctggaagcatca

SEQ ID NO: 109296 - DNA, 25 bp, Homo sapien
ggaagcatcaacctgctcgaatctc

SEQ ID NO: 109297 - DNA, 25 bp, Homo sapien
gaatctcctcagcttgccactttgg

SEQ ID NO: 109298 - DNA, 25 bp, Homo sapien
gccactttggctgaggatgtcactg

SEQ ID NO: 109299 - DNA, 25 bp, Homo sapien
tgcactcgctaagcagggcttgtga

SEQ ID NO: 109300 - DNA, 25 bp, Homo sapien
gcagggcttgtgaatatttctcatt

SEQ ID NO: 109301 - DNA, 25 bp, Homo sapien
atttaggcatgagctcttggcagga

SEQ ID NO: 109302 - DNA, 25 bp, Homo sapien
gggctctgagcagttgttatatcat

SEQ ID NO: 109303 - DNA, 25 bp, Homo sapien
aatgggcagccggagaacaactaca

SEQ ID NO: 109304 - DNA, 25 bp, Homo sapien
tgggcagccggagaacaactacaag

SEQ ID NO: 109305 - DNA, 25 bp, Homo sapien
ggcagccggagaacaactacaagac

SEQ ID NO: 109306 - DNA, 25 bp, Homo sapien
ggagaacaactacaagaccacgcct

SEQ ID NO: 109307 - DNA, 25 bp, Homo sapien
gagaacaactacaagaccacgcctc

SEQ ID NO: 109308 - DNA, 25 bp, Homo sapien
aagaccacgcctcccgtgctggact

SEQ ID NO: 109309 - DNA, 25 bp, Homo sapien
tgctggactccgacggctccttctt

SEQ ID NO: 109310 - DNA, 25 bp, Homo sapien
gaacgtcttctcatgctccgtgatg

SEQ ID NO: 109311 - DNA, 25 bp, Homo sapien
acgtcttctcatgctccgtgatgca

SEQ ID NO: 109312 - DNA, 25 bp, Homo sapien
tcttctcatgctccgtgatgcatga

SEQ ID NO: 109313 - DNA, 25 bp, Homo sapien
ctcatgctccgtgatgcatgaggct

SEQ ID NO: 109314 - DNA, 25 bp, Homo sapien
acagcatgaactcagagcattgttt

SEQ ID NO: 109315 - DNA, 25 bp, Homo sapien
tcagagcattgttttagggttggag

SEQ ID NO: 109316 - DNA, 25 bp, Homo sapien
gttggaggaggaacacgctttcttt

SEQ ID NO: 109317 - DNA, 25 bp, Homo sapien
gaacacgctttctttacatcactag

SEQ ID NO: 109318 - DNA, 25 bp, Homo sapien
acatcactagtgtagactcaaaaga

SEQ ID NO: 109319 - DNA, 25 bp, Homo sapien
gactcaaaagatatgcaagtgtcaa

SEQ ID NO: 109320 - DNA, 25 bp, Homo sapien
aagagactgtgtgttactgaagaac

SEQ ID NO: 109321 - DNA, 25 bp, Homo sapien
aataccacgcattgaaatgcccagt

SEQ ID NO: 109322 - DNA, 25 bp, Homo sapien
ttgaaatgcccagttcagactgaat

SEQ ID NO: 109323 - DNA, 25 bp, Homo sapien
cagactgaataattcctgctgcagc

SEQ ID NO: 109324 - DNA, 25 bp, Homo sapien
tgctgcagcaaggaaagtacctact

SEQ ID NO: 109325 - DNA, 25 bp, Homo sapien
tagtgtgcaaagcaaactttatttt

SEQ ID NO: 109326 - DNA, 25 bp, Homo sapien
tattttcacttcagactagtaggac

SEQ ID NO: 109327 - DNA, 25 bp, Homo sapien
gactagtaggactgaatagtgccaa

SEQ ID NO: 109328 - DNA, 25 bp, Homo sapien
gaatagtgccaaattgcccctgaat

SEQ ID NO: 109329 - DNA, 25 bp, Homo sapien
atagtgccaaattgcccctgaatca

SEQ ID NO: 109330 - DNA, 25 bp, Homo sapien
gccaaattgcccctgaatcataaaa

SEQ ID NO: 109331 - DNA, 25 bp, Homo sapien
gcccctgaatcataaaaggttcttt

SEQ ID NO: 109332 - DNA, 25 bp, Homo sapien
gttgacaataaaaactcttgccttt

SEQ ID NO: 109333 - DNA, 25 bp, Homo sapien
aaaactcttgcctttttcatagtat

SEQ ID NO: 109334 - DNA, 25 bp, Homo sapien
actcttgcctttttcatagtattag

SEQ ID NO: 109335 - DNA, 25 bp, Homo sapien
atttacctatagcaacatttcaaat

SEQ ID NO: 109336 - DNA, 25 bp, Homo sapien
ctttggtgttgggtatgctgttcat

SEQ ID NO: 109337 - DNA, 25 bp, Homo sapien
gttcatgacaactggataggctgca

SEQ ID NO: 109338 - DNA, 25 bp, Homo sapien
gataggctgcaatgtctcttcctac

SEQ ID NO: 109339 - DNA, 25 bp, Homo sapien
gcaatgcccgggagtttctccaatg

SEQ ID NO: 109340 - DNA, 25 bp, Homo sapien
ccaatgtgtggagaaggccttagaa

SEQ ID NO: 109341 - DNA, 25 bp, Homo sapien
agaagacatgtttgatgccttagaa

SEQ ID NO: 109342 - DNA, 25 bp, Homo sapien
gaaggcaaatccatcaaaagttaac

SEQ ID NO: 109343 - DNA, 25 bp, Homo sapien
caaaagttaacttctgggcagatga

SEQ ID NO: 109344 - DNA, 25 bp, Homo sapien
atgaaaagctaccatcacttcctca

SEQ ID NO: 109345 - DNA, 25 bp, Homo sapien
taccatcacttcctcatcatgaaaa

SEQ ID NO: 109346 - DNA, 25 bp, Homo sapien
atcatgaaaactgggaggccgggca

SEQ ID NO: 109347 - DNA, 25 bp, Homo sapien
aggacattcgcaatctggaggacat

SEQ ID NO: 109348 - DNA, 25 bp, Homo sapien
gaggacatcaggaagaccttaccat

SEQ ID NO: 109349 - DNA, 25 bp, Homo sapien
aagaccttaccatctggctgcttca

SEQ ID NO: 109350 - DNA, 25 bp, Homo sapien
ttcaacaccccgtccattgaaaagc

SEQ ID NO: 109351 - DNA, 25 bp, Homo sapien
gtccattgaaaagccctagtgtctt

SEQ ID NO: 109352 - DNA, 25 bp, Homo sapien
ctagtgtctttagggctggaaggca

SEQ ID NO: 109353 - DNA, 25 bp, Homo sapien
tggaaggcagcatccctctgacagg

SEQ ID NO: 109354 - DNA, 25 bp, Homo sapien
cagttgtgaggccacagagtgcctt

SEQ ID NO: 109355 - DNA, 25 bp, Homo sapien
gagtgccttgacacaaagattacat

SEQ ID NO: 109356 - DNA, 25 bp, Homo sapien
ccatcactgtccttttgaaccagga

SEQ ID NO: 109357 - DNA, 25 bp, Homo sapien
aattaaacatcctgaatcgggaaca

SEQ ID NO: 109358 - DNA, 25 bp, Homo sapien
tcaccacacggactgagactgattt

SEQ ID NO: 109359 - DNA, 25 bp, Homo sapien
gggccagcccagtgtcagaacagga

SEQ ID NO: 109360 - DNA, 25 bp, Homo sapien
gcccagtgtcagaacaggactctgt

SEQ ID NO: 109361 - DNA, 25 bp, Homo sapien
gtgtcagaacaggactctgtcccca

SEQ ID NO: 109362 - DNA, 25 bp, Homo sapien
caggctcagggactcaacaatcaca

SEQ ID NO: 109363 - DNA, 25 bp, Homo sapien
cacggactgagactgatttgattaa

SEQ ID NO: 109364 - DNA, 25 bp, Homo sapien
gactcaacaatcacatattgtggat

SEQ ID NO: 109365 - DNA, 25 bp, Homo sapien
tcacatattgtggatgagacagaca

SEQ ID NO: 109366 - DNA, 25 bp, Homo sapien
aagcaccagagtgtaatggccctca

SEQ ID NO: 109367 - DNA, 25 bp, Homo sapien
ccagagtgtaatggccctcagagca

SEQ ID NO: 109368 - DNA, 25 bp, Homo sapien
tgatgaccctcctgagcccgcagga

SEQ ID NO: 109369 - DNA, 25 bp, Homo sapien
accactgcgaccacaagaaggatga

SEQ ID NO: 109370 - DNA, 25 bp, Homo sapien
gcgaccacaagaaggatgattcaac

SEQ ID NO: 109371 - DNA, 25 bp, Homo sapien
gatgattcaacaggttttcctgaag

SEQ ID NO: 109372 - DNA, 25 bp, Homo sapien
tgaaaaaccattttgctgtcccttt

SEQ ID NO: 109373 - DNA, 25 bp, Homo sapien
ttcacccttttctgtttgctaagtg

SEQ ID NO: 109374 - DNA, 25 bp, Homo sapien
cacccttttctgtttgctaagtgag

SEQ ID NO: 109375 - DNA, 25 bp, Homo sapien
aaataacactgtactgcaataaggg

SEQ ID NO: 109376 - DNA, 25 bp, Homo sapien
aaccctgtctaatgaaacctgtgtc

SEQ ID NO: 109377 - DNA, 25 bp, Homo sapien
cctgtctaatgaaacctgtgtctct

SEQ ID NO: 109378 - DNA, 25 bp, Homo sapien
tgtgtctctgagagtagagtcactg

SEQ ID NO: 109379 - DNA, 25 bp, Homo sapien
gagtagagtcactggaacactaatg

SEQ ID NO: 109380 - DNA, 25 bp, Homo sapien
ggagcccctcatgctgagatggaag

SEQ ID NO: 109381 - DNA, 25 bp, Homo sapien
gctgagatggaagcagtcttccctg

SEQ ID NO: 109382 - DNA, 25 bp, Homo sapien
tggcctggttgtccttgcagctgta

SEQ ID NO: 109383 - DNA, 25 bp, Homo sapien
ctggttgtccttgcagctgtagtca

SEQ ID NO: 109384 - DNA, 25 bp, Homo sapien
ggttgtccttgcagctgtagtcact

SEQ ID NO: 109385 - DNA, 25 bp, Homo sapien
ttgcagctgtagtcactggagctgc

SEQ ID NO: 109386 - DNA, 25 bp, Homo sapien
cggtcgctgctgtgctgtggagaaa

SEQ ID NO: 109387 - DNA, 25 bp, Homo sapien
ctcaggctgcaatgtgaaacagctg

SEQ ID NO: 109388 - DNA, 25 bp, Homo sapien
gactgagtggcaagtatttgttcat

SEQ ID NO: 109389 - DNA, 25 bp, Homo sapien
ctgagtggcaagtatttgttcatgc

SEQ ID NO: 109390 - DNA, 25 bp, Homo sapien
agtggcaagtatttgttcatgcctt

SEQ ID NO: 109391 - DNA, 25 bp, Homo sapien
atgaccctcctgagcccgcaggagg

SEQ ID NO: 109392 - DNA, 25 bp, Homo sapien
tcaccacacggactgagactgattt

SEQ ID NO: 109393 - DNA, 25 bp, Homo sapien
accacacggactgagactgatttga

SEQ ID NO: 109394 - DNA, 25 bp, Homo sapien
cacacggactgagactgatttgatt

SEQ ID NO: 109395 - DNA, 25 bp, Homo sapien
acggactgagactgatttgattaaa

SEQ ID NO: 109396 - DNA, 25 bp, Homo sapien
aaagcaccagagtgtaatggccctc

SEQ ID NO: 109397 - DNA, 25 bp, Homo sapien
agcaccagagtgtaatggccctcag

SEQ ID NO: 109398 - DNA, 25 bp, Homo sapien
gcaccagagtgtaatggccctcaga

SEQ ID NO: 109399 - DNA, 25 bp, Homo sapien
ccagagtgtaatggccctcagagca

SEQ ID NO: 109400 - DNA, 25 bp, Homo sapien
cagggctggtcctggggttccacac

SEQ ID NO: 109401 - DNA, 25 bp, Homo sapien
tgatgaccctcctgagcccgcagga

SEQ ID NO: 109402 - DNA, 25 bp, Homo sapien
aaccatgggtaaggacggactcact

SEQ ID NO: 109403 - DNA, 25 bp, Homo sapien
gtaaggacggactcacttctctttt

SEQ ID NO: 109404 - DNA, 25 bp, Homo sapien
tcacttctctttttagttgaggcct

SEQ ID NO: 109405 - DNA, 25 bp, Homo sapien
gttgaggccttctagttaccacatt

SEQ ID NO: 109406 - DNA, 25 bp, Homo sapien
ttaccacattactctgcctctgtat

SEQ ID NO: 109407 - DNA, 25 bp, Homo sapien
actctgcctctgtatataggtggtt

SEQ ID NO: 109408 - DNA, 25 bp, Homo sapien
ttcccttcatactccttttaagcag

SEQ ID NO: 109409 - DNA, 25 bp, Homo sapien
agttatggtggtggtctcatgaaga

SEQ ID NO: 109410 - DNA, 25 bp, Homo sapien
aaaagaccttttggcccaatctctg

SEQ ID NO: 109411 - DNA, 25 bp, Homo sapien
atctctgccatatcagtgaaccttt

SEQ ID NO: 109412 - DNA, 25 bp, Homo sapien
tcacttcactgttctctacttgcaa

SEQ ID NO: 109413 - DNA, 25 bp, Homo sapien
tctcctcttacctgggcagagtgtt

SEQ ID NO: 109414 - DNA, 25 bp, Homo sapien
tcttacctgggcagagtgttgtctc

SEQ ID NO: 109415 - DNA, 25 bp, Homo sapien
ttacctgggcagagtgttgtctctc

SEQ ID NO: 109416 - DNA, 25 bp, Homo sapien
tgggcagagtgttgtctctccccaa

SEQ ID NO: 109417 - DNA, 25 bp, Homo sapien
ggcagagtgttgtctctccccaaat

SEQ ID NO: 109418 - DNA, 25 bp, Homo sapien
agagtgttgtctctccccaaattta

SEQ ID NO: 109419 - DNA, 25 bp, Homo sapien
agtgttgtctctccccaaatttata

SEQ ID NO: 109420 - DNA, 25 bp, Homo sapien
actaaaatgcattccattcctctga

SEQ ID NO: 109421 - DNA, 25 bp, Homo sapien
aatgcattccattcctctgaaagca

SEQ ID NO: 109422 - DNA, 25 bp, Homo sapien
atgcattccattcctctgaaagcaa

SEQ ID NO: 109423 - DNA, 25 bp, Homo sapien
gcattccattcctctgaaagcaaaa

SEQ ID NO: 109424 - DNA, 25 bp, Homo sapien
cgcaaggcgaagaccagtactatct

SEQ ID NO: 109425 - DNA, 25 bp, Homo sapien
gcgaagaccagtactatctgcgggt

SEQ ID NO: 109426 - DNA, 25 bp, Homo sapien
tactatctgcgggtcaccacggtgg

SEQ ID NO: 109427 - DNA, 25 bp, Homo sapien
tatctgcgggtcaccacggtggctt

SEQ ID NO: 109428 - DNA, 25 bp, Homo sapien
acggtggcttcccacacttctgact

SEQ ID NO: 109429 - DNA, 25 bp, Homo sapien
acacttctgactcggacgttccttc

SEQ ID NO: 109430 - DNA, 25 bp, Homo sapien
acgttccttccggtgtcactgaggt

SEQ ID NO: 109431 - DNA, 25 bp, Homo sapien
tttgactctgatcccatcactgtga

SEQ ID NO: 109432 - DNA, 25 bp, Homo sapien
atcactgtgacggtccctgtagaag

SEQ ID NO: 109433 - DNA, 25 bp, Homo sapien
tgacggtccctgtagaagtctccag

SEQ ID NO: 109434 - DNA, 25 bp, Homo sapien
gaagtctccaggaagaaccctaaat

SEQ ID NO: 109435 - DNA, 25 bp, Homo sapien
gctggactttgggctacatgctgaa

SEQ ID NO: 109436 - DNA, 25 bp, Homo sapien
gaccaacatgatcccagctgagcaa

SEQ ID NO: 109437 - DNA, 25 bp, Homo sapien
agctgagcaaccattgtccacacct

SEQ ID NO: 109438 - DNA, 25 bp, Homo sapien
tccacctatgtcttcctcatggttc

SEQ ID NO: 109439 - DNA, 25 bp, Homo sapien
atggttctattctccctggtccttt

SEQ ID NO: 109440 - DNA, 25 bp, Homo sapien
tttcacagtggccatcataggcttg

SEQ ID NO: 109441 - DNA, 25 bp, Homo sapien
atcataggcttgcttatctttcaca

SEQ ID NO: 109442 - DNA, 25 bp, Homo sapien
ctttcacaagccttcatatttctgg

SEQ ID NO: 109443 - DNA, 25 bp, Homo sapien
aagcagctgaaatatgctggctgga

SEQ ID NO: 109444 - DNA, 25 bp, Homo sapien
attttcctccatcgcagtgttcaag

SEQ ID NO: 109445 - DNA, 25 bp, Homo sapien
atcgcagtgttcaaggccatccttc

SEQ ID NO: 109446 - DNA, 25 bp, Homo sapien
aaagcttctctgctccagttatttt

SEQ ID NO: 109447 - DNA, 25 bp, Homo sapien
ataaagtgcctgtatcttgtaaaac

SEQ ID NO: 109448 - DNA, 25 bp, Homo sapien
gtgcctgtatcttgtaaaacttcat

SEQ ID NO: 109449 - DNA, 25 bp, Homo sapien
ctgtatcttgtaaaacttcatttgt

SEQ ID NO: 109450 - DNA, 25 bp, Homo sapien
tcttttggttcagagaagttcattt

SEQ ID NO: 109451 - DNA, 25 bp, Homo sapien
ggttcagagaagttcatttatgttc

SEQ ID NO: 109452 - DNA, 25 bp, Homo sapien
gagaagttcatttatgttcaaagac

SEQ ID NO: 109453 - DNA, 25 bp, Homo sapien
gttcaaagacgtttattcatgttca

SEQ ID NO: 109454 - DNA, 25 bp, Homo sapien
agacgtttattcatgttcaacagga

SEQ ID NO: 109455 - DNA, 25 bp, Homo sapien
aagtgtacgtgaatgctcgctgtct

SEQ ID NO: 109456 - DNA, 25 bp, Homo sapien
atgctcgctgtctgatagggttcca

SEQ ID NO: 109457 - DNA, 25 bp, Homo sapien
gaatgacaaaagatagcacatgtga

SEQ ID NO: 109458 - DNA, 25 bp, Homo sapien
aaagtaagctactgtggctacattc

SEQ ID NO: 109459 - DNA, 25 bp, Homo sapien
gtaagctactgtggctacattcatg

SEQ ID NO: 109460 - DNA, 25 bp, Homo sapien
agctactgtggctacattcatgtca

SEQ ID NO: 109461 - DNA, 25 bp, Homo sapien
tactgtggctacattcatgtcagac

SEQ ID NO: 109462 - DNA, 25 bp, Homo sapien
ctgtggctacattcatgtcagacaa

SEQ ID NO: 109463 - DNA, 25 bp, Homo sapien
tcagacaaagtaaatttcagagtag

SEQ ID NO: 109464 - DNA, 25 bp, Homo sapien
ttcagagtagagaatattaccagta

SEQ ID NO: 109465 - DNA, 25 bp, Homo sapien
aagacataatcctaaacctaataca

SEQ ID NO: 109466 - DNA, 25 bp, Homo sapien
atcctaaacctaatacaacagttca

SEQ ID NO: 109467 - DNA, 25 bp, Homo sapien
caacagttcaaaataaatgcagcaa

SEQ ID NO: 109468 - DNA, 25 bp, Homo sapien
tgcttcacggaatctaacccaccgg

SEQ ID NO: 109469 - DNA, 25 bp, Homo sapien
aaagtctctggtccctgccatggag

SEQ ID NO: 109470 - DNA, 25 bp, Homo sapien
catggagacctgacagagtctcagt

SEQ ID NO: 109471 - DNA, 25 bp, Homo sapien
ggagacctgacagagtctcagtcat

SEQ ID NO: 109472 - DNA, 25 bp, Homo sapien
gacctgacagagtctcagtcatgac

SEQ ID NO: 109473 - DNA, 25 bp, Homo sapien
tgacagagtctcagtcatgactgca

SEQ ID NO: 109474 - DNA, 25 bp, Homo sapien
agagtctcagtcatgactgcaacaa

SEQ ID NO: 109475 - DNA, 25 bp, Homo sapien
agtcatgactgcaacaactgagaca

SEQ ID NO: 109476 - DNA, 25 bp, Homo sapien
gtcatgactgcaacaactgagacac

SEQ ID NO: 109477 - DNA, 25 bp, Homo sapien
atgactgcaacaactgagacactga

SEQ ID NO: 109478 - DNA, 25 bp, Homo sapien
actgcaacaactgagacactgagaa

SEQ ID NO: 109479 - DNA, 25 bp, Homo sapien
gtggagatggctgaagtccgacaca

SEQ ID NO: 109480 - DNA, 25 bp, Homo sapien
gatggctgaagtccgacacagcacg

SEQ ID NO: 109481 - DNA, 25 bp, Homo sapien
tgaagtccgacacagcacgagcgtc

SEQ ID NO: 109482 - DNA, 25 bp, Homo sapien
gtccgacacagcacgagcgtccaga

SEQ ID NO: 109483 - DNA, 25 bp, Homo sapien
tagaaaacccgcttgtgactagcag

SEQ ID NO: 109484 - DNA, 25 bp, Homo sapien
aaaacccgcttgtgactagcagtcc

SEQ ID NO: 109485 - DNA, 25 bp, Homo sapien
cgcttgtgactagcagtccctgtgg

SEQ ID NO: 109486 - DNA, 25 bp, Homo sapien
ttgtgactagcagtccctgtggctg

SEQ ID NO: 109487 - DNA, 25 bp, Homo sapien
tccctgtggctgttcctgtgaggat

SEQ ID NO: 109488 - DNA, 25 bp, Homo sapien
ggctgttcctgtgaggatgacgtta

SEQ ID NO: 109489 - DNA, 25 bp, Homo sapien
tgttcctgtgaggatgacgttagca

SEQ ID NO: 109490 - DNA, 25 bp, Homo sapien
gaagctaacagtcattacggtcaca

SEQ ID NO: 109491 - DNA, 25 bp, Homo sapien
gagcctctgaactcagacgtgcagt

SEQ ID NO: 109492 - DNA, 25 bp, Homo sapien
ggaagttcaagtgtcctcagctgag

SEQ ID NO: 109493 - DNA, 25 bp, Homo sapien
gtgtcctcagctgagtctcacaaag

SEQ ID NO: 109494 - DNA, 25 bp, Homo sapien
gtgaagtccggaaagctgtccctga

SEQ ID NO: 109495 - DNA, 25 bp, Homo sapien
gctgtccctgatgccgtggaaagca

SEQ ID NO: 109496 - DNA, 25 bp, Homo sapien
gatactctagaacggaaggctccct

SEQ ID NO: 109497 - DNA, 25 bp, Homo sapien
gaaggctcccttgatggaacttaga

SEQ ID NO: 109498 - DNA, 25 bp, Homo sapien
agacagcaaggccagatgcacatcc

SEQ ID NO: 109499 - DNA, 25 bp, Homo sapien
tgcacatccctggaaggacatccat

SEQ ID NO: 109500 - DNA, 25 bp, Homo sapien
gaaggacatccatgttccgagaaga

SEQ ID NO: 109501 - DNA, 25 bp, Homo sapien
aaacagagtgctaatttagttctca

SEQ ID NO: 109502 - DNA, 25 bp, Homo sapien
aatttagttctcagctcttctgact

SEQ ID NO: 109503 - DNA, 25 bp, Homo sapien
tagttctcagctcttctgacttaag

SEQ ID NO: 109504 - DNA, 25 bp, Homo sapien
tcttctgacttaagtgtgcaaaata

SEQ ID NO: 109505 - DNA, 25 bp, Homo sapien
gacttaagtgtgcaaaatattttta

SEQ ID NO: 109506 - DNA, 25 bp, Homo sapien
ttttgtgaagactgggaagtgactt

SEQ ID NO: 109507 - DNA, 25 bp, Homo sapien
actgggaagtgacttagcagatgct

SEQ ID NO: 109508 - DNA, 25 bp, Homo sapien
ttagcagatgctggtcatgtgtttg

SEQ ID NO: 109509 - DNA, 25 bp, Homo sapien
aacttcctgcaggtaaacagttctt

SEQ ID NO: 109510 - DNA, 25 bp, Homo sapien
cttcctgcaggtaaacagttcttgt

SEQ ID NO: 109511 - DNA, 25 bp, Homo sapien
ctgcaggtaaacagttcttgtgtgg

SEQ ID NO: 109512 - DNA, 25 bp, Homo sapien
gaggtgaaaatgctttcttggccag

SEQ ID NO: 109513 - DNA, 25 bp, Homo sapien
gctttcttggccagggtagtaagaa

SEQ ID NO: 109514 - DNA, 25 bp, Homo sapien
atgcagggactgtaaaaccaccttt

SEQ ID NO: 109515 - DNA, 25 bp, Homo sapien
ctgcttcaatgtctagttcctgtat

SEQ ID NO: 109516 - DNA, 25 bp, Homo sapien
tcctgtatagctttgttcattgcat

SEQ ID NO: 109517 - DNA, 25 bp, Homo sapien
aaatgtactactgagcttcactgag

SEQ ID NO: 109518 - DNA, 25 bp, Homo sapien
ctgagcttcactgagttacgctgtg

SEQ ID NO: 109519 - DNA, 25 bp, Homo sapien
gagttacgctgtgaaactttcaaat

SEQ ID NO: 109520 - DNA, 25 bp, Homo sapien
aactttcaaatccttcttcagtcag

SEQ ID NO: 109521 - DNA, 25 bp, Homo sapien
ttcttcagtcagttccaatgaggtg

SEQ ID NO: 109522 - DNA, 25 bp, Homo sapien
aaaagctttagctgtctcctgtttt

SEQ ID NO: 109523 - DNA, 25 bp, Homo sapien
gtatcaagtccctgaatggaagtat

SEQ ID NO: 109524 - DNA, 25 bp, Homo sapien
gaagtatgacgttgggtccctctga

SEQ ID NO: 109525 - DNA, 25 bp, Homo sapien
gggtccctctgaagtttaattctga

SEQ ID NO: 109526 - DNA, 25 bp, Homo sapien
gaagtttaattctgagttctcatta

SEQ ID NO: 109527 - DNA, 25 bp, Homo sapien
agaaatttgctttcattgttttatt

SEQ ID NO: 109528 - DNA, 25 bp, Homo sapien
ggtggtcatcaaaatagctacaaac

SEQ ID NO: 109529 - DNA, 25 bp, Homo sapien
tattccatttgcaacttatccccaa

SEQ ID NO: 109530 - DNA, 25 bp, Homo sapien
caggtggtgaagcagtattttccaa

SEQ ID NO: 109531 - DNA, 25 bp, Homo sapien
gtattttccaatttgaagattcatt

SEQ ID NO: 109532 - DNA, 25 bp, Homo sapien
ctgctaatagcagttcaaactaaat

SEQ ID NO: 109533 - DNA, 25 bp, Homo sapien
aattttttgtatcaagtccctgaat

SEQ ID NO: 109534 - DNA, 25 bp, Homo sapien
ttaatatataactttgccaggtacc

SEQ ID NO: 109535 - DNA, 25 bp, Homo sapien
aatatataactttgccaggtaccac

SEQ ID NO: 109536 - DNA, 25 bp, Homo sapien
atatataactttgccaggtaccacg

SEQ ID NO: 109537 - DNA, 25 bp, Homo sapien
atataactttgccaggtaccacggc

SEQ ID NO: 109538 - DNA, 25 bp, Homo sapien
tataactttgccaggtaccacggct

SEQ ID NO: 109539 - DNA, 25 bp, Homo sapien
ataactttgccaggtaccacggctc

SEQ ID NO: 109540 - DNA, 25 bp, Homo sapien
taactttgccaggtaccacggctca

SEQ ID NO: 109541 - DNA, 25 bp, Homo sapien
aactttgccaggtaccacggctcac

SEQ ID NO: 109542 - DNA, 25 bp, Homo sapien
actttgccaggtaccacggctcacg

SEQ ID NO: 109543 - DNA, 25 bp, Homo sapien
caggtaccacggctcacgcctgtat

SEQ ID NO: 109544 - DNA, 25 bp, Homo sapien
gtggcagttgcagggagctaagatc

SEQ ID NO: 109545 - DNA, 25 bp, Homo sapien
gccgaaggaccagctggtggcttta

SEQ ID NO: 109546 - DNA, 25 bp, Homo sapien
aaggaccagctggtggctttatggt

SEQ ID NO: 109547 - DNA, 25 bp, Homo sapien
cagctggtggctttatggtggtggc

SEQ ID NO: 109548 - DNA, 25 bp, Homo sapien
tggcttcaggcctgacactgggccc

SEQ ID NO: 109549 - DNA, 25 bp, Homo sapien
caggtactgcccatctctaccaagg

SEQ ID NO: 109550 - DNA, 25 bp, Homo sapien
tctctaccaaggcctgggccctgtg

SEQ ID NO: 109551 - DNA, 25 bp, Homo sapien
tgctgtcagggcctgttagccacct

SEQ ID NO: 109552 - DNA, 25 bp, Homo sapien
tgtcagggcctgttagccacctcat

SEQ ID NO: 109553 - DNA, 25 bp, Homo sapien
tcagggcctgttagccacctcatgc

SEQ ID NO: 109554 - DNA, 25 bp, Homo sapien
agcactactgtggtggctccgctca

SEQ ID NO: 109555 - DNA, 25 bp, Homo sapien
ggcacagagcatggcctccagagga

SEQ ID NO: 109556 - DNA, 25 bp, Homo sapien
ctttcaaggtggaaggtggccagtt

SEQ ID NO: 109557 - DNA, 25 bp, Homo sapien
gtctgctggacgagaacagcacgct

SEQ ID NO: 109558 - DNA, 25 bp, Homo sapien
acgctgatccccatcgctgtgggtg

SEQ ID NO: 109559 - DNA, 25 bp, Homo sapien
atcgcctacctcgtcggcaggaaga

SEQ ID NO: 109560 - DNA, 25 bp, Homo sapien
ggaagaggagtcacgcaggctacca

SEQ ID NO: 109561 - DNA, 25 bp, Homo sapien
tcacgcaggctaccagactatctag

SEQ ID NO: 109562 - DNA, 25 bp, Homo sapien
agactatctagcctggtgcacgcag

SEQ ID NO: 109563 - DNA, 25 bp, Homo sapien
tagcctggtgcacgcaggcacagca

SEQ ID NO: 109564 - DNA, 25 bp, Homo sapien
acgcggaggagcacgtccgtgtcac

SEQ ID NO: 109565 - DNA, 25 bp, Homo sapien
gtccgtgtcacgaaggcgttttcag

SEQ ID NO: 109566 - DNA, 25 bp, Homo sapien
aggcgttttcagtcaatatattcaa

SEQ ID NO: 109567 - DNA, 25 bp, Homo sapien
cttaccgactggctgagagtgaatg

SEQ ID NO: 109568 - DNA, 25 bp, Homo sapien
gatgaagacactataagccggtttt

SEQ ID NO: 109569 - DNA, 25 bp, Homo sapien
ataagccggtttttggctgaagatt

SEQ ID NO: 109570 - DNA, 25 bp, Homo sapien
atacactattggatgttctctacta

SEQ ID NO: 109571 - DNA, 25 bp, Homo sapien
gatgttctctactatgttacacgtg

SEQ ID NO: 109572 - DNA, 25 bp, Homo sapien
gttacacgtgatgacttaaaatgct

SEQ ID NO: 109573 - DNA, 25 bp, Homo sapien
cacactgtggaaggctatcattgac

SEQ ID NO: 109574 - DNA, 25 bp, Homo sapien
ttgactttcgaaacaaacagacttg

SEQ ID NO: 109575 - DNA, 25 bp, Homo sapien
cagacttgactgttgctcaatctaa

SEQ ID NO: 109576 - DNA, 25 bp, Homo sapien
gttgctcaatctaatcttcgatgga

SEQ ID NO: 109577 - DNA, 25 bp, Homo sapien
ttaatacagagctgatcttcttggg

SEQ ID NO: 109578 - DNA, 25 bp, Homo sapien
tccagctgagcccagtgtctatgcc

SEQ ID NO: 109579 - DNA, 25 bp, Homo sapien
ccagctgagcccagtgtctatgcca

SEQ ID NO: 109580 - DNA, 25 bp, Homo sapien
agctgagcccagtgtctatgccact

SEQ ID NO: 109581 - DNA, 25 bp, Homo sapien
gctgagcccagtgtctatgccactc

SEQ ID NO: 109582 - DNA, 25 bp, Homo sapien
ctgagcccagtgtctatgccactct

SEQ ID NO: 109583 - DNA, 25 bp, Homo sapien
tgagcccagtgtctatgccactctg

SEQ ID NO: 109584 - DNA, 25 bp, Homo sapien
gagcccagtgtctatgccactctgg

SEQ ID NO: 109585 - DNA, 25 bp, Homo sapien
agcccagtgtctatgccactctggc

SEQ ID NO: 109586 - DNA, 25 bp, Homo sapien
ccagtgtctatgccactctggccat

SEQ ID NO: 109587 - DNA, 25 bp, Homo sapien
gccatccactaatccaggggggacc

SEQ ID NO: 109588 - DNA, 25 bp, Homo sapien
tccactaatccaggggggacccaga

SEQ ID NO: 109589 - DNA, 25 bp, Homo sapien
ccttcttcatcacacacatcctgaa

SEQ ID NO: 109590 - DNA, 25 bp, Homo sapien
gcaacatcccgcctgtcctgtacag

SEQ ID NO: 109591 - DNA, 25 bp, Homo sapien
tgtacagcgccttcacgtggctggg

SEQ ID NO: 109592 - DNA, 25 bp, Homo sapien
acagcgccttcacgtggctgggcta

SEQ ID NO: 109593 - DNA, 25 bp, Homo sapien
agcgccttcacgtggctgggctatg

SEQ ID NO: 109594 - DNA, 25 bp, Homo sapien
ccttcacgtggctgggctatgtcaa

SEQ ID NO: 109595 - DNA, 25 bp, Homo sapien
tgggctatgtcaacagcgccgtgaa

SEQ ID NO: 109596 - DNA, 25 bp, Homo sapien
ggctatgtcaacagcgccgtgaacc

SEQ ID NO: 109597 - DNA, 25 bp, Homo sapien
atgtcaacagcgccgtgaaccccat

SEQ ID NO: 109598 - DNA, 25 bp, Homo sapien
accttcaacattgagttccgcaagg

SEQ ID NO: 109599 - DNA, 25 bp, Homo sapien
cttcaacattgagttccgcaaggcc

SEQ ID NO: 109600 - DNA, 25 bp, Homo sapien
aactggattgcagactgttcttact

SEQ ID NO: 109601 - DNA, 25 bp, Homo sapien
gcagactgttcttactgtaactact

SEQ ID NO: 109602 - DNA, 25 bp, Homo sapien
tcctgattaggaatatgaccatttg

SEQ ID NO: 109603 - DNA, 25 bp, Homo sapien
atgaccatttgactgttcaatgatt

SEQ ID NO: 109604 - DNA, 25 bp, Homo sapien
ttgtatttacagtttccagagtttg

SEQ ID NO: 109605 - DNA, 25 bp, Homo sapien
tttacagtttccagagtttgtcatt

SEQ ID NO: 109606 - DNA, 25 bp, Homo sapien
aaaaatactctgctatttctcttgc

SEQ ID NO: 109607 - DNA, 25 bp, Homo sapien
aatgatctattgctcatcagcttta

SEQ ID NO: 109608 - DNA, 25 bp, Homo sapien
taaacatacgacttattttgttgaa

SEQ ID NO: 109609 - DNA, 25 bp, Homo sapien
gtcaaagactgtatttagatctcat

SEQ ID NO: 109610 - DNA, 25 bp, Homo sapien
tgtatttagatctcataatgctttg

SEQ ID NO: 109611 - DNA, 25 bp, Homo sapien
gggccaagactattagccgacgtat

SEQ ID NO: 109612 - DNA, 25 bp, Homo sapien
gccaagactattagccgacgtatta

SEQ ID NO: 109613 - DNA, 25 bp, Homo sapien
ccaagactattagccgacgtattac

SEQ ID NO: 109614 - DNA, 25 bp, Homo sapien
agactattagccgacgtattactat

SEQ ID NO: 109615 - DNA, 25 bp, Homo sapien
gactattagccgacgtattactatg

SEQ ID NO: 109616 - DNA, 25 bp, Homo sapien
ctattagccgacgtattactatggt

SEQ ID NO: 109617 - DNA, 25 bp, Homo sapien
attagccgacgtattactatggttc

SEQ ID NO: 109618 - DNA, 25 bp, Homo sapien
ttagccgacgtattactatggttcg

SEQ ID NO: 109619 - DNA, 25 bp, Homo sapien
agccgacgtattactatggttcggg

SEQ ID NO: 109620 - DNA, 25 bp, Homo sapien
gggagttatccgagtttgactactg

SEQ ID NO: 109621 - DNA, 25 bp, Homo sapien
ggagttatccgagtttgactactgg

SEQ ID NO: 109622 - DNA, 25 bp, Homo sapien
gtttggcacccaaatggcgtcagcc

SEQ ID NO: 109623 - DNA, 25 bp, Homo sapien
ttggcacccaaatggcgtcagcctc

SEQ ID NO: 109624 - DNA, 25 bp, Homo sapien
ccaaatggcgtcagcctctccaggt

SEQ ID NO: 109625 - DNA, 25 bp, Homo sapien
ttgcctcccctcctgtcttttattt

SEQ ID NO: 109626 - DNA, 25 bp, Homo sapien
gaagctggggttgtcattgagaaat

SEQ ID NO: 109627 - DNA, 25 bp, Homo sapien
gaacagtgaacaagctaccactcgt

SEQ ID NO: 109628 - DNA, 25 bp, Homo sapien
gtgaacaagctaccactcgtaaggc

SEQ ID NO: 109629 - DNA, 25 bp, Homo sapien
gaacaagctaccactcgtaaggcaa

SEQ ID NO: 109630 - DNA, 25 bp, Homo sapien
acaagctaccactcgtaaggcaaac

SEQ ID NO: 109631 - DNA, 25 bp, Homo sapien
agctaccactcgtaaggcaaactgt

SEQ ID NO: 109632 - DNA, 25 bp, Homo sapien
taccactcgtaaggcaaactgtatt

SEQ ID NO: 109633 - DNA, 25 bp, Homo sapien
agcaaggagcctgtcttccggctca

SEQ ID NO: 109634 - DNA, 25 bp, Homo sapien
ttccggctcagtgtggccactaatg

SEQ ID NO: 109635 - DNA, 25 bp, Homo sapien
agtgtggccactaatgtgtccgcca

SEQ ID NO: 109636 - DNA, 25 bp, Homo sapien
agcaagatcactgggttcctgaagc

SEQ ID NO: 109637 - DNA, 25 bp, Homo sapien
gttggactattcaatgcagagctgt

SEQ ID NO: 109638 - DNA, 25 bp, Homo sapien
tgcagagctgttggaagcgctcctc

SEQ ID NO: 109639 - DNA, 25 bp, Homo sapien
tggaagcgctcctcaactattacat

SEQ ID NO: 109640 - DNA, 25 bp, Homo sapien
caatgataagttggccgaaggcttc

SEQ ID NO: 109641 - DNA, 25 bp, Homo sapien
tgaagcgtgttcagctctacgacct

SEQ ID NO: 109642 - DNA, 25 bp, Homo sapien
acgaccttgggctgcagatccataa

SEQ ID NO: 109643 - DNA, 25 bp, Homo sapien
tgcagatccataaggacttcctgtt

SEQ ID NO: 109644 - DNA, 25 bp, Homo sapien
ggaggacactttgtgatttccatta

SEQ ID NO: 109645 - DNA, 25 bp, Homo sapien
gatttccattaaggccaactgcatt

SEQ ID NO: 109646 - DNA, 25 bp, Homo sapien
gtgtttgcctccgaagtgaaaaaga

SEQ ID NO: 109647 - DNA, 25 bp, Homo sapien
aggagaacatgaagccgcaggagca

SEQ ID NO: 109648 - DNA, 25 bp, Homo sapien
gaagccgcaggagcagttgaccctt

SEQ ID NO: 109649 - DNA, 25 bp, Homo sapien
caggagcagttgacccttgagccat

SEQ ID NO: 109650 - DNA, 25 bp, Homo sapien
gacccttgagccatatgaaagagac

SEQ ID NO: 109651 - DNA, 25 bp, Homo sapien
tgaaagagaccatgccgtggtcgtg

SEQ ID NO: 109652 - DNA, 25 bp, Homo sapien
gtcgtgggagtgtacaggccacccc

SEQ ID NO: 109653 - DNA, 25 bp, Homo sapien
gaactgaagttcagcgctgtcagga

SEQ ID NO: 109654 - DNA, 25 bp, Homo sapien
cagcgctgtcaggattgcgagagat

SEQ ID NO: 109655 - DNA, 25 bp, Homo sapien
gttaatggctccgttttcagcattg

SEQ ID NO: 109656 - DNA, 25 bp, Homo sapien
aatggctccgttttcagcattgcaa

SEQ ID NO: 109657 - DNA, 25 bp, Homo sapien
ggctccgttttcagcattgcaaata

SEQ ID NO: 109658 - DNA, 25 bp, Homo sapien
tgcaaataacaatctcagctactgg

SEQ ID NO: 109659 - DNA, 25 bp, Homo sapien
agttcttatatgtgcaacaaagagc

SEQ ID NO: 109660 - DNA, 25 bp, Homo sapien
caaagagcagactgtttcagtgtct

SEQ ID NO: 109661 - DNA, 25 bp, Homo sapien
actgtttcagtgtctggagcatttc

SEQ ID NO: 109662 - DNA, 25 bp, Homo sapien
ggagcatttcagataaatacctttg

SEQ ID NO: 109663 - DNA, 25 bp, Homo sapien
atacctttgatctaagggttcagcc

SEQ ID NO: 109664 - DNA, 25 bp, Homo sapien
taagggttcagcctttcaatgtgac

SEQ ID NO: 109665 - DNA, 25 bp, Homo sapien
gtgacacaaggaaagtattctacag

SEQ ID NO: 109666 - DNA, 25 bp, Homo sapien
gggaaatgagaaatgcagccagcat

SEQ ID NO: 109667 - DNA, 25 bp, Homo sapien
cagccagcatcatcgagggaaggtg

SEQ ID NO: 109668 - DNA, 25 bp, Homo sapien
ggtggcccacttgtttgtgagcaac

SEQ ID NO: 109669 - DNA, 25 bp, Homo sapien
gaatggttcttggtgtcattgttcc

SEQ ID NO: 109670 - DNA, 25 bp, Homo sapien
tcattgttcctggtcgtggatgtgc

SEQ ID NO: 109671 - DNA, 25 bp, Homo sapien
ctggtcgtggatgtgccattccaaa

SEQ ID NO: 109672 - DNA, 25 bp, Homo sapien
gtgccattccaaatcgtcctggtat

SEQ ID NO: 109673 - DNA, 25 bp, Homo sapien
gtcctggtatttttgtccgagtagc

SEQ ID NO: 109674 - DNA, 25 bp, Homo sapien
tttttgtccgagtagcatattatgc

SEQ ID NO: 109675 - DNA, 25 bp, Homo sapien
atataaggtaccacagtcatagctg

SEQ ID NO: 109676 - DNA, 25 bp, Homo sapien
agtcatagctgaagtaagtgtgtct

SEQ ID NO: 109677 - DNA, 25 bp, Homo sapien
atgactgaagcccaacatagcttga

SEQ ID NO: 109678 - DNA, 25 bp, Homo sapien
ctgaagcccaacatagcttgagctt

SEQ ID NO: 109679 - DNA, 25 bp, Homo sapien
agcccaacatagcttgagcttccag

SEQ ID NO: 109680 - DNA, 25 bp, Homo sapien
gcccaacatagcttgagcttccaga

SEQ ID NO: 109681 - DNA, 25 bp, Homo sapien
atagcttgagcttccagaaacggtg

SEQ ID NO: 109682 - DNA, 25 bp, Homo sapien
agcttgagcttccagaaacggtgct

SEQ ID NO: 109683 - DNA, 25 bp, Homo sapien
tgagcttccagaaacggtgctcccc

SEQ ID NO: 109684 - DNA, 25 bp, Homo sapien
gtggctaacagtccctgtggccgtc

SEQ ID NO: 109685 - DNA, 25 bp, Homo sapien
ccctgtggccgtccctgtgaagatg

SEQ ID NO: 109686 - DNA, 25 bp, Homo sapien
gtgaagatgacattagcattgcccc

SEQ ID NO: 109687 - DNA, 25 bp, Homo sapien
agatgacattagcattgcccccaac

SEQ ID NO: 109688 - DNA, 25 bp, Homo sapien
gataaaccgtttttaacacatagcg

SEQ ID NO: 109689 - DNA, 25 bp, Homo sapien
accgtttttaacacatagcgccgtg

SEQ ID NO: 109690 - DNA, 25 bp, Homo sapien
cgtttttaacacatagcgccgtgct

SEQ ID NO: 109691 - DNA, 25 bp, Homo sapien
gtttttaacacatagcgccgtgctg

SEQ ID NO: 109692 - DNA, 25 bp, Homo sapien
tttttaacacatagcgccgtgctgt

SEQ ID NO: 109693 - DNA, 25 bp, Homo sapien
ttttaacacatagcgccgtgctgta

SEQ ID NO: 109694 - DNA, 25 bp, Homo sapien
acacatagcgccgtgctgtaaataa

SEQ ID NO: 109695 - DNA, 25 bp, Homo sapien
acatagcgccgtgctgtaaataagc

SEQ ID NO: 109696 - DNA, 25 bp, Homo sapien
atagcgccgtgctgtaaataagccc

SEQ ID NO: 109697 - DNA, 25 bp, Homo sapien
agcgccgtgctgtaaataagcccag

SEQ ID NO: 109698 - DNA, 25 bp, Homo sapien
gcgccgtgctgtaaataagcccagt

SEQ ID NO: 109699 - DNA, 25 bp, Homo sapien
gggccccagcagaagcaactacgag

SEQ ID NO: 109700 - DNA, 25 bp, Homo sapien
ggccccagcagaagcaactacgaga

SEQ ID NO: 109701 - DNA, 25 bp, Homo sapien
gccccagcagaagcaactacgagag

SEQ ID NO: 109702 - DNA, 25 bp, Homo sapien
ccagcagaagcaactacgagaggtt

SEQ ID NO: 109703 - DNA, 25 bp, Homo sapien
gcagaagcaactacgagaggttcct

SEQ ID NO: 109704 - DNA, 25 bp, Homo sapien
gaagcaactacgagaggttcctgcc

SEQ ID NO: 109705 - DNA, 25 bp, Homo sapien
ggacaaggaccacgcccgctacctg

SEQ ID NO: 109706 - DNA, 25 bp, Homo sapien
gctacctgagctactttcgctggcg

SEQ ID NO: 109707 - DNA, 25 bp, Homo sapien
acctgagctactttcgctggcggga

SEQ ID NO: 109708 - DNA, 25 bp, Homo sapien
agctactttcgctggcgggagacgc

SEQ ID NO: 109709 - DNA, 25 bp, Homo sapien
tggcgggagacgctgcggcctcgct

SEQ ID NO: 109710 - DNA, 25 bp, Homo sapien
actcagcgtgagttaccctgggaaa

SEQ ID NO: 109711 - DNA, 25 bp, Homo sapien
gaaatggttcatataggacacacat

SEQ ID NO: 109712 - DNA, 25 bp, Homo sapien
taggacacacatagataccttcaag

SEQ ID NO: 109713 - DNA, 25 bp, Homo sapien
caagggtgtttgtagagttgtttct

SEQ ID NO: 109714 - DNA, 25 bp, Homo sapien
actcagaatatacccatccatgcac

SEQ ID NO: 109715 - DNA, 25 bp, Homo sapien
atgcaccccaccagcaatacaaaga

SEQ ID NO: 109716 - DNA, 25 bp, Homo sapien
cagcaatacaaagaccccaaacaaa

SEQ ID NO: 109717 - DNA, 25 bp, Homo sapien
ttactatattcttaccctacgcatg

SEQ ID NO: 109718 - DNA, 25 bp, Homo sapien
atattcttaccctacgcatggcttc

SEQ ID NO: 109719 - DNA, 25 bp, Homo sapien
tcctcttcttgacgcttttcataat

SEQ ID NO: 109720 - DNA, 25 bp, Homo sapien
gattgaggtggtatgcttgaaagta

SEQ ID NO: 109721 - DNA, 25 bp, Homo sapien
tgtttccttcctctgcagatgtagc

SEQ ID NO: 109722 - DNA, 25 bp, Homo sapien
tctgcagatgtagctgctttcctaa

SEQ ID NO: 109723 - DNA, 25 bp, Homo sapien
tgctttcctaaatctgtctgtcttt

SEQ ID NO: 109724 - DNA, 25 bp, Homo sapien
gtctgtctttctttaggttagctgt

SEQ ID NO: 109725 - DNA, 25 bp, Homo sapien
aggttagctgtatgtctgtaaaagt

SEQ ID NO: 109726 - DNA, 25 bp, Homo sapien
gttcaattaaattactccatcagac

SEQ ID NO: 109727 - DNA, 25 bp, Homo sapien
acacttgtctgtcttgcaatgtaga

SEQ ID NO: 109728 - DNA, 25 bp, Homo sapien
gtagaagcagctttgtagcaccttg

SEQ ID NO: 109729 - DNA, 25 bp, Homo sapien
cagctttgtagcaccttgttttgag

SEQ ID NO: 109730 - DNA, 25 bp, Homo sapien
agcaccttgttttgaggtttgctgc

SEQ ID NO: 109731 - DNA, 25 bp, Homo sapien
gcactttgtgcattctgaacatgaa

SEQ ID NO: 109732 - DNA, 25 bp, Homo sapien
atgatggttttatctgttgtgtgaa

SEQ ID NO: 109733 - DNA, 25 bp, Homo sapien
gttgtgtgaagtggttcacccttga

SEQ ID NO: 109734 - DNA, 25 bp, Homo sapien
ttgaggaccaggagcctccatatcc

SEQ ID NO: 109735 - DNA, 25 bp, Homo sapien
gagcctccatatcctgactgaaaac

SEQ ID NO: 109736 - DNA, 25 bp, Homo sapien
ccttgagttctcctgtctccagata

SEQ ID NO: 109737 - DNA, 25 bp, Homo sapien
aaatgaccttgacttttctgccttg

SEQ ID NO: 109738 - DNA, 25 bp, Homo sapien
ttctgccttgtgaattcgtagtcca

SEQ ID NO: 109739 - DNA, 25 bp, Homo sapien
gaattcgtagtccaatcagctgaaa

SEQ ID NO: 109740 - DNA, 25 bp, Homo sapien
aatcacttgggagggacgcatagaa

SEQ ID NO: 109741 - DNA, 25 bp, Homo sapien
gaaggagctctaggaacacagtgcc

SEQ ID NO: 109742 - DNA, 25 bp, Homo sapien
cagtgccagtgcagaagtttctcca

SEQ ID NO: 109743 - DNA, 25 bp, Homo sapien
aaagacgcagcagctatctgccagc

SEQ ID NO: 109744 - DNA, 25 bp, Homo sapien
gccaagtgctggtgtccatattgtg

SEQ ID NO: 109745 - DNA, 25 bp, Homo sapien
gtccatattgtgatgcctggttatt

SEQ ID NO: 109746 - DNA, 25 bp, Homo sapien
gatgcctggttattacagcccagag

SEQ ID NO: 109747 - DNA, 25 bp, Homo sapien
cagcccagagagcatgggacttctt

SEQ ID NO: 109748 - DNA, 25 bp, Homo sapien
acttcttgacccagcgaccagtgat

SEQ ID NO: 109749 - DNA, 25 bp, Homo sapien
gtgatgggcgagttattttcttctt

SEQ ID NO: 109750 - DNA, 25 bp, Homo sapien
tttcttcttaccctggcaaaagatg

SEQ ID NO: 109751 - DNA, 25 bp, Homo sapien
agatgacgatcgctggcactactga

SEQ ID NO: 109752 - DNA, 25 bp, Homo sapien
ggcactactgatactccaactgatg

SEQ ID NO: 109753 - DNA, 25 bp, Homo sapien
acaccatccaattccttcagaagaa

SEQ ID NO: 109754 - DNA, 25 bp, Homo sapien
gctgcctcgggacagactggtctta

SEQ ID NO: 109755 - DNA, 25 bp, Homo sapien
gcctcgggacagactggtcttaggc

SEQ ID NO: 109756 - DNA, 25 bp, Homo sapien
atgttgaagtcggacgcaacagaga

SEQ ID NO: 109757 - DNA, 25 bp, Homo sapien
ctgcacgcaggatggtcccttgtat

SEQ ID NO: 109758 - DNA, 25 bp, Homo sapien
acgcaggatggtcccttgtatgtca

SEQ ID NO: 109759 - DNA, 25 bp, Homo sapien
aggatggtcccttgtatgtcatcgt

SEQ ID NO: 109760 - DNA, 25 bp, Homo sapien
atggtcccttgtatgtcatcgtgga

SEQ ID NO: 109761 - DNA, 25 bp, Homo sapien
gtcccttgtatgtcatcgtggagta

SEQ ID NO: 109762 - DNA, 25 bp, Homo sapien
gtatgtcatcgtggagtatgcctcc

SEQ ID NO: 109763 - DNA, 25 bp, Homo sapien
tgtcatcgtggagtatgcctccaag

SEQ ID NO: 109764 - DNA, 25 bp, Homo sapien
catcgtggagtatgcctccaagggc

SEQ ID NO: 109765 - DNA, 25 bp, Homo sapien
ttactgtgcgagagtgtcgatattt

SEQ ID NO: 109766 - DNA, 25 bp, Homo sapien
ctgtgcgagagtgtcgatatttgga

SEQ ID NO: 109767 - DNA, 25 bp, Homo sapien
gagtgtcgatatttggagtggttca

SEQ ID NO: 109768 - DNA, 25 bp, Homo sapien
gtgtcgatatttggagtggttcaac

SEQ ID NO: 109769 - DNA, 25 bp, Homo sapien
gtcgatatttggagtggttcaacat

SEQ ID NO: 109770 - DNA, 25 bp, Homo sapien
gatatttggagtggttcaacattac

SEQ ID NO: 109771 - DNA, 25 bp, Homo sapien
atttggagtggttcaacattactac

SEQ ID NO: 109772 - DNA, 25 bp, Homo sapien
ttggagtggttcaacattactacta

SEQ ID NO: 109773 - DNA, 25 bp, Homo sapien
ggagtggttcaacattactactact

SEQ ID NO: 109774 - DNA, 25 bp, Homo sapien
gagtggttcaacattactactacta

SEQ ID NO: 109775 - DNA, 25 bp, Homo sapien
gtggttcaacattactactactact

SEQ ID NO: 109776 - DNA, 25 bp, Homo sapien
ctttttactcaccaccttagagcaa

SEQ ID NO: 109777 - DNA, 25 bp, Homo sapien
accaccttagagcaacctctgtatt

SEQ ID NO: 109778 - DNA, 25 bp, Homo sapien
gagcaacctctgtattagtttttga

SEQ ID NO: 109779 - DNA, 25 bp, Homo sapien
tgtgatcagtagtcaagttggactt

SEQ ID NO: 109780 - DNA, 25 bp, Homo sapien
gttggacttgttttaacgttctgct

SEQ ID NO: 109781 - DNA, 25 bp, Homo sapien
taacgttctgctgcttgagttgcct

SEQ ID NO: 109782 - DNA, 25 bp, Homo sapien
gctgcttgagttgcctgatgctcag

SEQ ID NO: 109783 - DNA, 25 bp, Homo sapien
agagctttttggtttggattactat

SEQ ID NO: 109784 - DNA, 25 bp, Homo sapien
ttgcaaagggaacttggtctggctt

SEQ ID NO: 109785 - DNA, 25 bp, Homo sapien
ggaacttggtctggcttagatgtcc

SEQ ID NO: 109786 - DNA, 25 bp, Homo sapien
taacacttctagatcttagttcaga

SEQ ID NO: 109787 - DNA, 25 bp, Homo sapien
aaattcaacagtcatgagcagagct

SEQ ID NO: 109788 - DNA, 25 bp, Homo sapien
gttgagtacctccttattcatggaa

SEQ ID NO: 109789 - DNA, 25 bp, Homo sapien
gcagatgataacgttcactttcagc

SEQ ID NO: 109790 - DNA, 25 bp, Homo sapien
agtcagctcagatctccaaagccct

SEQ ID NO: 109791 - DNA, 25 bp, Homo sapien
ccaaagccctggtcgatgttggagt

SEQ ID NO: 109792 - DNA, 25 bp, Homo sapien
cctggtcgatgttggagtggatttc

SEQ ID NO: 109793 - DNA, 25 bp, Homo sapien
aagaccatggaatagctagcagcac

SEQ ID NO: 109794 - DNA, 25 bp, Homo sapien
aatagctagcagcacagcacaccaa

SEQ ID NO: 109795 - DNA, 25 bp, Homo sapien
tatatatacccacatgagccacttc

SEQ ID NO: 109796 - DNA, 25 bp, Homo sapien
gagccacttcataaaacaatgtttc

SEQ ID NO: 109797 - DNA, 25 bp, Homo sapien
tttctctttaccttagcacctcaaa

SEQ ID NO: 109798 - DNA, 25 bp, Homo sapien
tcaagatggatatttcttccccaag

SEQ ID NO: 109799 - DNA, 25 bp, Homo sapien
gatggatatttcttccccaaggatt

SEQ ID NO: 109800 - DNA, 25 bp, Homo sapien
ttccccaaggatttcaagatgaatt

SEQ ID NO: 109801 - DNA, 25 bp, Homo sapien
atcaagatagtgtgctttattctgt

SEQ ID NO: 109802 - DNA, 25 bp, Homo sapien
gatagtgtgctttattctgttgtat

SEQ ID NO: 109803 - DNA, 25 bp, Homo sapien
tatactgtaagccaaactgaaataa

SEQ ID NO: 109804 - DNA, 25 bp, Homo sapien
gccaaactgaaataacatttgctgt

SEQ ID NO: 109805 - DNA, 25 bp, Homo sapien
acatttgctgttttataggtttgaa

SEQ ID NO: 109806 - DNA, 25 bp, Homo sapien
tttgctgatgaagagatatgtttaa

SEQ ID NO: 109807 - DNA, 25 bp, Homo sapien
ttgttttgtttagttacaggacaat

SEQ ID NO: 109808 - DNA, 25 bp, Homo sapien
acaggacaataatgaaatggagttt

SEQ ID NO: 109809 - DNA, 25 bp, Homo sapien
gcaattacagcagagccactgagat

SEQ ID NO: 109810 - DNA, 25 bp, Homo sapien
agaagacacagaccggtttcaaggg

SEQ ID NO: 109811 - DNA, 25 bp, Homo sapien
ggcccctcgtgtgtaaggacgtagc

SEQ ID NO: 109812 - DNA, 25 bp, Homo sapien
aggacgtagcccaaggtattctctc

SEQ ID NO: 109813 - DNA, 25 bp, Homo sapien
caaggtattctctcctatggaaata

SEQ ID NO: 109814 - DNA, 25 bp, Homo sapien
aagggacacctccaggagtctacat

SEQ ID NO: 109815 - DNA, 25 bp, Homo sapien
tacatcaaggtctcacacttcctgc

SEQ ID NO: 109816 - DNA, 25 bp, Homo sapien
gagaacaatgaagcgcctctaacag

SEQ ID NO: 109817 - DNA, 25 bp, Homo sapien
gaagcgcctctaacagcaggcatga

SEQ ID NO: 109818 - DNA, 25 bp, Homo sapien
gcaggcatgagactaaccttcctct

SEQ ID NO: 109819 - DNA, 25 bp, Homo sapien
acagaggcaagaatccccaagggtg

SEQ ID NO: 109820 - DNA, 25 bp, Homo sapien
ttgatgacactgatgccgaagatga

SEQ ID NO: 109821 - DNA, 25 bp, Homo sapien
cactgatgccgaagatgatgctcct

SEQ ID NO: 109822 - DNA, 25 bp, Homo sapien
tacaaaacgtaactccagtcctcca

SEQ ID NO: 109823 - DNA, 25 bp, Homo sapien
aatgctgttgacagtggaattcacc

SEQ ID NO: 109824 - DNA, 25 bp, Homo sapien
gaaatgaacaagtctgctacctctt

SEQ ID NO: 109825 - DNA, 25 bp, Homo sapien
aggaagcccactacatagtttggaa

SEQ ID NO: 109826 - DNA, 25 bp, Homo sapien
acatcactctgattgtaagctgaat

SEQ ID NO: 109827 - DNA, 25 bp, Homo sapien
atgttaacacactagctgcattgta

SEQ ID NO: 109828 - DNA, 25 bp, Homo sapien
aaactgggtcttttcacatattgtg

SEQ ID NO: 109829 - DNA, 25 bp, Homo sapien
ttgtgatggacaagctagtattctt

SEQ ID NO: 109830 - DNA, 25 bp, Homo sapien
gtattcttgtctttggacttcaaca

SEQ ID NO: 109831 - DNA, 25 bp, Homo sapien
acaactccttccctagttcaagagg

SEQ ID NO: 109832 - DNA, 25 bp, Homo sapien
ggacacaatgtaggaagtcttttcc

SEQ ID NO: 109833 - DNA, 25 bp, Homo sapien
atgtaggaagtcttttccacatggc

SEQ ID NO: 109834 - DNA, 25 bp, Homo sapien
tttgggcagagcgatggagtcctta

SEQ ID NO: 109835 - DNA, 25 bp, Homo sapien
gcgatggagtccttagtatcagtca

SEQ ID NO: 109836 - DNA, 25 bp, Homo sapien
gagtccttagtatcagtcatgacag

SEQ ID NO: 109837 - DNA, 25 bp, Homo sapien
aatgttttacaactcctgattcccg

SEQ ID NO: 109838 - DNA, 25 bp, Homo sapien
tcctgattcccgcatggtttttata

SEQ ID NO: 109839 - DNA, 25 bp, Homo sapien
ttcccgcatggtttttataatattc

SEQ ID NO: 109840 - DNA, 25 bp, Homo sapien
actgtagatttcagtagtttctaag

SEQ ID NO: 109841 - DNA, 25 bp, Homo sapien
gtagtttctaagtctgttattgttt

SEQ ID NO: 109842 - DNA, 25 bp, Homo sapien
tgggtgggtcaggacaaaggcctct

SEQ ID NO: 109843 - DNA, 25 bp, Homo sapien
agaagtggcttcttagcttcctcca

SEQ ID NO: 109844 - DNA, 25 bp, Homo sapien
gaagtggcttcttagcttcctccag

SEQ ID NO: 109845 - DNA, 25 bp, Homo sapien
aagtggcttcttagcttcctccagg

SEQ ID NO: 109846 - DNA, 25 bp, Homo sapien
gtggcttcttagcttcctccaggag

SEQ ID NO: 109847 - DNA, 25 bp, Homo sapien
gagaaccagctataagtcctgagaa

SEQ ID NO: 109848 - DNA, 25 bp, Homo sapien
gaaccagctataagtcctgagaaga

SEQ ID NO: 109849 - DNA, 25 bp, Homo sapien
accagctataagtcctgagaagaca

SEQ ID NO: 109850 - DNA, 25 bp, Homo sapien
taagtcctgagaagacactggtgtc

SEQ ID NO: 109851 - DNA, 25 bp, Homo sapien
agtcctgagaagacactggtgtctg

SEQ ID NO: 109852 - DNA, 25 bp, Homo sapien
gagacctcgacagcctgccctaggc

SEQ ID NO: 109853 - DNA, 25 bp, Homo sapien
ttaaggccacggagcgacagcgggc

SEQ ID NO: 109854 - DNA, 25 bp, Homo sapien
gggaggtccatctcagaacacccca

SEQ ID NO: 109855 - DNA, 25 bp, Homo sapien
tcagaacaccccagccttgagctta

SEQ ID NO: 109856 - DNA, 25 bp, Homo sapien
gaacaccccagccttgagcttagct

SEQ ID NO: 109857 - DNA, 25 bp, Homo sapien
accccagccttgagcttagctgcag

SEQ ID NO: 109858 - DNA, 25 bp, Homo sapien
ccttgagcttagctgcaggcccagg

SEQ ID NO: 109859 - DNA, 25 bp, Homo sapien
ctctgctctgctcccgggctaggag

SEQ ID NO: 109860 - DNA, 25 bp, Homo sapien
aggtggccctctgtctgggcgaaca

SEQ ID NO: 109861 - DNA, 25 bp, Homo sapien
tcaccgcccgccgtgcaagagtcga

SEQ ID NO: 109862 - DNA, 25 bp, Homo sapien
tgcaagagtcgagccggcagagcaa

SEQ ID NO: 109863 - DNA, 25 bp, Homo sapien
ttacagcgtccctgtgtatgttgga

SEQ ID NO: 109864 - DNA, 25 bp, Homo sapien
tcctcagtatccacacataaacggc

SEQ ID NO: 109865 - DNA, 25 bp, Homo sapien
gtatccacacataaacggcagtgtt

SEQ ID NO: 109866 - DNA, 25 bp, Homo sapien
aatgactgtgtctgcctgtccccaa

SEQ ID NO: 109867 - DNA, 25 bp, Homo sapien
tgtccccaaacaggacagcactggg

SEQ ID NO: 109868 - DNA, 25 bp, Homo sapien
cagcactgggaacctagctacactg

SEQ ID NO: 109869 - DNA, 25 bp, Homo sapien
tgggaacctagctacactgagcagg

SEQ ID NO: 109870 - DNA, 25 bp, Homo sapien
ctagctacactgagcagggagacca

SEQ ID NO: 109871 - DNA, 25 bp, Homo sapien
ccagagcttgttgtctccacttgta

SEQ ID NO: 109872 - DNA, 25 bp, Homo sapien
cttgtatatatggatcagaggagta

SEQ ID NO: 109873 - DNA, 25 bp, Homo sapien
gttgaaaacttgtaatcttccccag

SEQ ID NO: 109874 - DNA, 25 bp, Homo sapien
gaaaacttgtaatcttccccaggag

SEQ ID NO: 109875 - DNA, 25 bp, Homo sapien
atccaggtaccagacacgcggcata

SEQ ID NO: 109876 - DNA, 25 bp, Homo sapien
tccaggtaccagacacgcggcatag

SEQ ID NO: 109877 - DNA, 25 bp, Homo sapien
ccaggtaccagacacgcggcatagc

SEQ ID NO: 109878 - DNA, 25 bp, Homo sapien
aggtaccagacacgcggcatagcgg

SEQ ID NO: 109879 - DNA, 25 bp, Homo sapien
ggtaccagacacgcggcatagcggc

SEQ ID NO: 109880 - DNA, 25 bp, Homo sapien
gtaccagacacgcggcatagcggct

SEQ ID NO: 109881 - DNA, 25 bp, Homo sapien
accagacacgcggcatagcggcttg

SEQ ID NO: 109882 - DNA, 25 bp, Homo sapien
cagacacgcggcatagcggcttggt

SEQ ID NO: 109883 - DNA, 25 bp, Homo sapien
ttaaggccacggagcgacagcgggc

SEQ ID NO: 109884 - DNA, 25 bp, Homo sapien
gggaggtccatctcagaacacccca

SEQ ID NO: 109885 - DNA, 25 bp, Homo sapien
ggaggtccatctcagaacaccccag

SEQ ID NO: 109886 - DNA, 25 bp, Homo sapien
tcagaacaccccagccttgagctta

SEQ ID NO: 109887 - DNA, 25 bp, Homo sapien
gaacaccccagccttgagcttagct

SEQ ID NO: 109888 - DNA, 25 bp, Homo sapien
accccagccttgagcttagctgcag

SEQ ID NO: 109889 - DNA, 25 bp, Homo sapien
ccagccttgagcttagctgcaggcc

SEQ ID NO: 109890 - DNA, 25 bp, Homo sapien
ccttgagcttagctgcaggcccagg

SEQ ID NO: 109891 - DNA, 25 bp, Homo sapien
cctctgctctgctcccgggctagga

SEQ ID NO: 109892 - DNA, 25 bp, Homo sapien
tcaccgcccgccgtgcaagagtcga

SEQ ID NO: 109893 - DNA, 25 bp, Homo sapien
tgcaagagtcgagccggcagagcaa

SEQ ID NO: 109894 - DNA, 25 bp, Homo sapien
aactgcacacacgacctgtacatga

SEQ ID NO: 109895 - DNA, 25 bp, Homo sapien
gcacacacgacctgtacatgatcat

SEQ ID NO: 109896 - DNA, 25 bp, Homo sapien
acacgacctgtacatgatcatgcgg

SEQ ID NO: 109897 - DNA, 25 bp, Homo sapien
gacctgtacatgatcatgcgggagt

SEQ ID NO: 109898 - DNA, 25 bp, Homo sapien
atcatgcgggagtgctggcatgccg

SEQ ID NO: 109899 - DNA, 25 bp, Homo sapien
gtggaggacctggaccgtgtcctta

SEQ ID NO: 109900 - DNA, 25 bp, Homo sapien
gacctggaccgtgtccttaccgtga

SEQ ID NO: 109901 - DNA, 25 bp, Homo sapien
tggaccgtgtccttaccgtgacgtc

SEQ ID NO: 109902 - DNA, 25 bp, Homo sapien
ttaccgtgacgtccaccgacgagta

SEQ ID NO: 109903 - DNA, 25 bp, Homo sapien
tgacgtccaccgacgagtacctgga

SEQ ID NO: 109904 - DNA, 25 bp, Homo sapien
tcgcggacgtgaagggccactggtc

SEQ ID NO: 109905 - DNA, 25 bp, Homo sapien
atcgtgggaacccttgtctgtggca

SEQ ID NO: 109906 - DNA, 25 bp, Homo sapien
ttgtctgtggcatcgtcctcggctt

SEQ ID NO: 109907 - DNA, 25 bp, Homo sapien
ggttccttaggatacagcggctgtt

SEQ ID NO: 109908 - DNA, 25 bp, Homo sapien
gatacagcggctgttcccgccagtt

SEQ ID NO: 109909 - DNA, 25 bp, Homo sapien
ccgccagttccacagatcaaagaca

SEQ ID NO: 109910 - DNA, 25 bp, Homo sapien
agacgagatgggaccgcagcgtcac

SEQ ID NO: 109911 - DNA, 25 bp, Homo sapien
gcgtcaccaccggtgtggctggaat

SEQ ID NO: 109912 - DNA, 25 bp, Homo sapien
tggctggaatctgtatcccactcct

SEQ ID NO: 109913 - DNA, 25 bp, Homo sapien
tggaatctgtatcccactcctgggc

SEQ ID NO: 109914 - DNA, 25 bp, Homo sapien
agagtcatctctgtgagctccatca

SEQ ID NO: 109915 - DNA, 25 bp, Homo sapien
gtcatctctgtgagctccatcagga

SEQ ID NO: 109916 - DNA, 25 bp, Homo sapien
ggttccttaggatacagcggctgtt

SEQ ID NO: 109917 - DNA, 25 bp, Homo sapien
gttccttaggatacagcggctgttc

SEQ ID NO: 109918 - DNA, 25 bp, Homo sapien
ttccttaggatacagcggctgttcc

SEQ ID NO: 109919 - DNA, 25 bp, Homo sapien
aggatacagcggctgttcccgccag

SEQ ID NO: 109920 - DNA, 25 bp, Homo sapien
gatacagcggctgttcccgccagtt

SEQ ID NO: 109921 - DNA, 25 bp, Homo sapien
ttcccgccagttccacagatcaaag

SEQ ID NO: 109922 - DNA, 25 bp, Homo sapien
ccgccagttccacagatcaaagaca

SEQ ID NO: 109923 - DNA, 25 bp, Homo sapien
gccagttccacagatcaaagacaaa

SEQ ID NO: 109924 - DNA, 25 bp, Homo sapien
gttccacagatcaaagacaaactga

SEQ ID NO: 109925 - DNA, 25 bp, Homo sapien
aactgaatgataaccatgaggtgga

SEQ ID NO: 109926 - DNA, 25 bp, Homo sapien
ataaccatgaggtggaagacgagat

SEQ ID NO: 109927 - DNA, 25 bp, Homo sapien
aaaaaagcaatccaacccactgcag

SEQ ID NO: 109928 - DNA, 25 bp, Homo sapien
aaagcaatccaacccactgcagaag

SEQ ID NO: 109929 - DNA, 25 bp, Homo sapien
agcaatccaacccactgcagaagct

SEQ ID NO: 109930 - DNA, 25 bp, Homo sapien
gctcaggaaccccttctgttctctg

SEQ ID NO: 109931 - DNA, 25 bp, Homo sapien
gagaactcaacagaggacattggct

SEQ ID NO: 109932 - DNA, 25 bp, Homo sapien
gaactcaacagaggacattggctca

SEQ ID NO: 109933 - DNA, 25 bp, Homo sapien
agattttgtttttatacttgcaact

SEQ ID NO: 109934 - DNA, 25 bp, Homo sapien
ttgtttttatacttgcaactggtga

SEQ ID NO: 109935 - DNA, 25 bp, Homo sapien
gtttttatacttgcaactggtgaat

SEQ ID NO: 109936 - DNA, 25 bp, Homo sapien
tttatacttgcaactggtgaattat

SEQ ID NO: 109937 - DNA, 25 bp, Homo sapien
atacttgcaactggtgaattatttt

SEQ ID NO: 109938 - DNA, 25 bp, Homo sapien
ctaccccataggagttagaagttag

SEQ ID NO: 109939 - DNA, 25 bp, Homo sapien
tagggtttaggcatcattttgagaa

SEQ ID NO: 109940 - DNA, 25 bp, Homo sapien
ttttgagaatgctgacactttttca

SEQ ID NO: 109941 - DNA, 25 bp, Homo sapien
tgagggcatgggtaaaaatatttct

SEQ ID NO: 109942 - DNA, 25 bp, Homo sapien
atttcaggttatatccaatagtaga

SEQ ID NO: 109943 - DNA, 25 bp, Homo sapien
tatccaatagtagagttggcttttt

SEQ ID NO: 109944 - DNA, 25 bp, Homo sapien
tcatagtgggtggatttgttgccat

SEQ ID NO: 109945 - DNA, 25 bp, Homo sapien
gatttgttgccatgtgcaccttggg

SEQ ID NO: 109946 - DNA, 25 bp, Homo sapien
gggttttgtaatgacagtgctaaaa

SEQ ID NO: 109947 - DNA, 25 bp, Homo sapien
tttttttatgatttgtctctgtcac

SEQ ID NO: 109948 - DNA, 25 bp, Homo sapien
tcacccttgtccttgagtgctcttg

SEQ ID NO: 109949 - DNA, 25 bp, Homo sapien
gggattggttatcacttttctgtaa

SEQ ID NO: 109950 - DNA, 25 bp, Homo sapien
ggattggttatcacttttctgtaac

SEQ ID NO: 109951 - DNA, 25 bp, Homo sapien
gattggttatcacttttctgtaacg

SEQ ID NO: 109952 - DNA, 25 bp, Homo sapien
attggttatcacttttctgtaacgc

SEQ ID NO: 109953 - DNA, 25 bp, Homo sapien
ttggttatcacttttctgtaacgcc

SEQ ID NO: 109954 - DNA, 25 bp, Homo sapien
tggttatcacttttctgtaacgcct

SEQ ID NO: 109955 - DNA, 25 bp, Homo sapien
ggttatcacttttctgtaacgcctg

SEQ ID NO: 109956 - DNA, 25 bp, Homo sapien
gttatcacttttctgtaacgcctgc

SEQ ID NO: 109957 - DNA, 25 bp, Homo sapien
tttctgtaacgcctgcttgtccctg

SEQ ID NO: 109958 - DNA, 25 bp, Homo sapien
ggctttgcatagattccctgagcag

SEQ ID NO: 109959 - DNA, 25 bp, Homo sapien
ttccctgagcaggattttaatcttt

SEQ ID NO: 109960 - DNA, 25 bp, Homo sapien
gactggttcaaatgttgttctcttc

SEQ ID NO: 109961 - DNA, 25 bp, Homo sapien
cagtgatgtcactagggcagggaca

SEQ ID NO: 109962 - DNA, 25 bp, Homo sapien
gggcatggctgggaacccaagtcca

SEQ ID NO: 109963 - DNA, 25 bp, Homo sapien
gggaacccaagtccaagcataccaa

SEQ ID NO: 109964 - DNA, 25 bp, Homo sapien
aacacgaccaggctactgtcagctc

SEQ ID NO: 109965 - DNA, 25 bp, Homo sapien
ctcccctcggagaaaactgtgcagt

SEQ ID NO: 109966 - DNA, 25 bp, Homo sapien
aaaactgtgcagtctgcgtgtgaac

SEQ ID NO: 109967 - DNA, 25 bp, Homo sapien
tgcagtctgcgtgtgaacagctctt

SEQ ID NO: 109968 - DNA, 25 bp, Homo sapien
tgtgaacagctcttctcctttagag

SEQ ID NO: 109969 - DNA, 25 bp, Homo sapien
tccgtcaaaggagtcggaaagggct

SEQ ID NO: 109970 - DNA, 25 bp, Homo sapien
tcaaaggagtcggaaagggcttctg

SEQ ID NO: 109971 - DNA, 25 bp, Homo sapien
caaaggagtcggaaagggcttctgc

SEQ ID NO: 109972 - DNA, 25 bp, Homo sapien
aaaggagtcggaaagggcttctgca

SEQ ID NO: 109973 - DNA, 25 bp, Homo sapien
aaggagtcggaaagggcttctgcac

SEQ ID NO: 109974 - DNA, 25 bp, Homo sapien
ctcctgagactgttttaactaagac

SEQ ID NO: 109975 - DNA, 25 bp, Homo sapien
tcctgagactgttttaactaagact

SEQ ID NO: 109976 - DNA, 25 bp, Homo sapien
cctgagactgttttaactaagactg

SEQ ID NO: 109977 - DNA, 25 bp, Homo sapien
ctgagactgttttaactaagactgg

SEQ ID NO: 109978 - DNA, 25 bp, Homo sapien
tgagactgttttaactaagactggt

SEQ ID NO: 109979 - DNA, 25 bp, Homo sapien
gagactgttttaactaagactggtt

SEQ ID NO: 109980 - DNA, 25 bp, Homo sapien
ggctttgcatagattccctgagcag

SEQ ID NO: 109981 - DNA, 25 bp, Homo sapien
tttgcatagattccctgagcaggat

SEQ ID NO: 109982 - DNA, 25 bp, Homo sapien
ttccctgagcaggattttaatcttt

SEQ ID NO: 109983 - DNA, 25 bp, Homo sapien
actggactggttcaaatgttgttct

SEQ ID NO: 109984 - DNA, 25 bp, Homo sapien
gactggttcaaatgttgttctcttc

SEQ ID NO: 109985 - DNA, 25 bp, Homo sapien
cagtgatgtcactagggcagggaca

SEQ ID NO: 109986 - DNA, 25 bp, Homo sapien
tgtcactagggcagggacaggataa

SEQ ID NO: 109987 - DNA, 25 bp, Homo sapien
cagggcatggctgggaacccaagtc

SEQ ID NO: 109988 - DNA, 25 bp, Homo sapien
ggctgggaacccaagtccaagcata

SEQ ID NO: 109989 - DNA, 25 bp, Homo sapien
gaacccaagtccaagcataccaaca

SEQ ID NO: 109990 - DNA, 25 bp, Homo sapien
gctactgtcagctcccctcggagaa

SEQ ID NO: 109991 - DNA, 25 bp, Homo sapien
caggtcgcagcagagaaggcaatta

SEQ ID NO: 109992 - DNA, 25 bp, Homo sapien
aacttcgattgagtctgaaacagca

SEQ ID NO: 109993 - DNA, 25 bp, Homo sapien
aacagcagcttctgaggaaaccttg

SEQ ID NO: 109994 - DNA, 25 bp, Homo sapien
tgaggaaaccttgttcaacgcgtcc

SEQ ID NO: 109995 - DNA, 25 bp, Homo sapien
aaaccttgttcaacgcgtcccagcg

SEQ ID NO: 109996 - DNA, 25 bp, Homo sapien
gtcccagcgcatcagcgagttagag

SEQ ID NO: 109997 - DNA, 25 bp, Homo sapien
gcgcatcagcgagttagagaggaat

SEQ ID NO: 109998 - DNA, 25 bp, Homo sapien
gcggaaagctgcccaaaactccggg

SEQ ID NO: 109999 - DNA, 25 bp, Homo sapien
agtatatactgtgaagcaaagtgca

SEQ ID NO: 110000 - DNA, 25 bp, Homo sapien
gaagactttagatggtgaacttgat

SEQ ID NO: 110001 - DNA, 25 bp, Homo sapien
gaaaaggcccaggtcgcagcagaga

SEQ ID NO: 110002 - DNA, 25 bp, Homo sapien
gcattggtcaccaaggtatttacag

SEQ ID NO: 110003 - DNA, 25 bp, Homo sapien
ggtatttacagacttctatcatggg

SEQ ID NO: 110004 - DNA, 25 bp, Homo sapien
ctgagggagaccgagttcgctaaat

SEQ ID NO: 110005 - DNA, 25 bp, Homo sapien
gaccgagttcgctaaatattataaa

SEQ ID NO: 110006 - DNA, 25 bp, Homo sapien
ttataaataggtcttgccgtcctcc

SEQ ID NO: 110007 - DNA, 25 bp, Homo sapien
taaataggtcttgccgtcctcctgc

SEQ ID NO: 110008 - DNA, 25 bp, Homo sapien
gcccctcggcacagtcagtggagca

SEQ ID NO: 110009 - DNA, 25 bp, Homo sapien
agtcagtggagcacgtcagcctcgg

SEQ ID NO: 110010 - DNA, 25 bp, Homo sapien
agcacgtcagcctcggtttacagtt

SEQ ID NO: 110011 - DNA, 25 bp, Homo sapien
agcctcggtttacagttctctgaaa

SEQ ID NO: 110012 - DNA, 25 bp, Homo sapien
accaacaccaagtatatctccaaag

SEQ ID NO: 110013 - DNA, 25 bp, Homo sapien
tgggaggttgtcagagcagaaatca

SEQ ID NO: 110014 - DNA, 25 bp, Homo sapien
gggaggttgtcagagcagaaatcat

SEQ ID NO: 110015 - DNA, 25 bp, Homo sapien
ggaggttgtcagagcagaaatcatg

SEQ ID NO: 110016 - DNA, 25 bp, Homo sapien
gaggttgtcagagcagaaatcatga

SEQ ID NO: 110017 - DNA, 25 bp, Homo sapien
aggttgtcagagcagaaatcatgag

SEQ ID NO: 110018 - DNA, 25 bp, Homo sapien
ggttgtcagagcagaaatcatgaga

SEQ ID NO: 110019 - DNA, 25 bp, Homo sapien
gttgtcagagcagaaatcatgagat

SEQ ID NO: 110020 - DNA, 25 bp, Homo sapien
ttgtcagagcagaaatcatgagatc

SEQ ID NO: 110021 - DNA, 25 bp, Homo sapien
aacagtggtggcacaaactatgcag

SEQ ID NO: 110022 - DNA, 25 bp, Homo sapien
agtggtggcacaaactatgcagaga

SEQ ID NO: 110023 - DNA, 25 bp, Homo sapien
tactgtgcgagagcctcatattgtg

SEQ ID NO: 110024 - DNA, 25 bp, Homo sapien
ctgtgcgagagcctcatattgtggt

SEQ ID NO: 110025 - DNA, 25 bp, Homo sapien
tgtgcgagagcctcatattgtggtt

SEQ ID NO: 110026 - DNA, 25 bp, Homo sapien
tgcgagagcctcatattgtggttat

SEQ ID NO: 110027 - DNA, 25 bp, Homo sapien
atattgtggttatgactgctattac

SEQ ID NO: 110028 - DNA, 25 bp, Homo sapien
ttgtggttatgactgctattacttc

SEQ ID NO: 110029 - DNA, 25 bp, Homo sapien
gtggttatgactgctattacttctt

SEQ ID NO: 110030 - DNA, 25 bp, Homo sapien
ggttatgactgctattacttctttg

SEQ ID NO: 110031 - DNA, 25 bp, Homo sapien
ttatgactgctattacttctttgac

SEQ ID NO: 110032 - DNA, 25 bp, Homo sapien
gagaactataatttcctgccacata

SEQ ID NO: 110033 - DNA, 25 bp, Homo sapien
actataatttcctgccacatagccc

SEQ ID NO: 110034 - DNA, 25 bp, Homo sapien
catagcccctccaagaaagattctg

SEQ ID NO: 110035 - DNA, 25 bp, Homo sapien
atagcccctccaagaaagattctga

SEQ ID NO: 110036 - DNA, 25 bp, Homo sapien
gtggaacaaaagtcagtcgtacatt

SEQ ID NO: 110037 - DNA, 25 bp, Homo sapien
caaaagtcagtcgtacattcagcta

SEQ ID NO: 110038 - DNA, 25 bp, Homo sapien
aagtcagtcgtacattcagctacat

SEQ ID NO: 110039 - DNA, 25 bp, Homo sapien
gtcagtcgtacattcagctacatca

SEQ ID NO: 110040 - DNA, 25 bp, Homo sapien
gtcgtacattcagctacatcaagaa

SEQ ID NO: 110041 - DNA, 25 bp, Homo sapien
gtacattcagctacatcaagaataa

SEQ ID NO: 110042 - DNA, 25 bp, Homo sapien
taaaatgtctagcagcaagaagagc

SEQ ID NO: 110043 - DNA, 25 bp, Homo sapien
tccccaacaacataaaaacagccgt

SEQ ID NO: 110044 - DNA, 25 bp, Homo sapien
accttcactgggaacaacacagccg

SEQ ID NO: 110045 - DNA, 25 bp, Homo sapien
tgggaacaacacagccgtccaggaa

SEQ ID NO: 110046 - DNA, 25 bp, Homo sapien
aacacagccgtccaggaactcaagc

SEQ ID NO: 110047 - DNA, 25 bp, Homo sapien
acagccgtccaggaactcaagcggg

SEQ ID NO: 110048 - DNA, 25 bp, Homo sapien
gtccaggaactcaagcgggtctcag

SEQ ID NO: 110049 - DNA, 25 bp, Homo sapien
tccaggaactcaagcgggtctcaga

SEQ ID NO: 110050 - DNA, 25 bp, Homo sapien
gaactcaagcgggtctcagagcagt

SEQ ID NO: 110051 - DNA, 25 bp, Homo sapien
actcaagcgggtctcagagcagttt

SEQ ID NO: 110052 - DNA, 25 bp, Homo sapien
caagcgggtctcagagcagtttaca

SEQ ID NO: 110053 - DNA, 25 bp, Homo sapien
atgccacggccgagggagaaggagt

SEQ ID NO: 110054 - DNA, 25 bp, Homo sapien
gactctgttctgattagggagttct

SEQ ID NO: 110055 - DNA, 25 bp, Homo sapien
gggagttctgggaaatcgttcattc

SEQ ID NO: 110056 - DNA, 25 bp, Homo sapien
gaaatcgttcattcatttacagatg

SEQ ID NO: 110057 - DNA, 25 bp, Homo sapien
agactcttcttgcagtttacaacgg

SEQ ID NO: 110058 - DNA, 25 bp, Homo sapien
tacaacgggcacagacagagcacct

SEQ ID NO: 110059 - DNA, 25 bp, Homo sapien
aaaaatggcccagacacagaaaggt

SEQ ID NO: 110060 - DNA, 25 bp, Homo sapien
aggttacctacatctcatacttgct

SEQ ID NO: 110061 - DNA, 25 bp, Homo sapien
tctcatacttgctttaatgtgcttt

SEQ ID NO: 110062 - DNA, 25 bp, Homo sapien
aatgtgcttttacttccggaatact

SEQ ID NO: 110063 - DNA, 25 bp, Homo sapien
ttacttccggaatactcaagcaaag

SEQ ID NO: 110064 - DNA, 25 bp, Homo sapien
aaggccatcacgtatgccaaaggat

SEQ ID NO: 110065 - DNA, 25 bp, Homo sapien
aatgtgaaactgctccatgaacccc

SEQ ID NO: 110066 - DNA, 25 bp, Homo sapien
ctgctccatgaaccccaaagaatta

SEQ ID NO: 110067 - DNA, 25 bp, Homo sapien
gaaccccaaagaattatgcacatag

SEQ ID NO: 110068 - DNA, 25 bp, Homo sapien
gaattatgcacatagatgcgatcat

SEQ ID NO: 110069 - DNA, 25 bp, Homo sapien
gatgcgatcattaagatgcgaagcc

SEQ ID NO: 110070 - DNA, 25 bp, Homo sapien
atgcgaagccatcgagttaccacct

SEQ ID NO: 110071 - DNA, 25 bp, Homo sapien
aagccatcgagttaccacctggcat

SEQ ID NO: 110072 - DNA, 25 bp, Homo sapien
ccacctggcatgcttaaactgtaaa

SEQ ID NO: 110073 - DNA, 25 bp, Homo sapien
aagagtgggtcaaagtaaactgaat

SEQ ID NO: 110074 - DNA, 25 bp, Homo sapien
tggaaaatccaaagttatgcagaaa

SEQ ID NO: 110075 - DNA, 25 bp, Homo sapien
ttgataaattaggcctcccgaccct

SEQ ID NO: 110076 - DNA, 25 bp, Homo sapien
gctgtgtaagtaagcatggtagaat

SEQ ID NO: 110077 - DNA, 25 bp, Homo sapien
aagcatggtagaattgtttggagac

SEQ ID NO: 110078 - DNA, 25 bp, Homo sapien
agcatggtagaattgtttggagaca

SEQ ID NO: 110079 - DNA, 25 bp, Homo sapien
gcatggtagaattgtttggagacat

SEQ ID NO: 110080 - DNA, 25 bp, Homo sapien
catggtagaattgtttggagacata

SEQ ID NO: 110081 - DNA, 25 bp, Homo sapien
ggtagaattgtttggagacatatat

SEQ ID NO: 110082 - DNA, 25 bp, Homo sapien
gtttggagacatatatagtgatcct

SEQ ID NO: 110083 - DNA, 25 bp, Homo sapien
ttggagacatatatagtgatccttg

SEQ ID NO: 110084 - DNA, 25 bp, Homo sapien
ggagacatatatagtgatccttggt

SEQ ID NO: 110085 - DNA, 25 bp, Homo sapien
ggaaagtcacatcgatcaagaatat

SEQ ID NO: 110086 - DNA, 25 bp, Homo sapien
cacatcgatcaagaatattttttat

SEQ ID NO: 110087 - DNA, 25 bp, Homo sapien
agcttttagggcttacaggaaatgg

SEQ ID NO: 110088 - DNA, 25 bp, Homo sapien
gcagggacttgaggagcctcttcta

SEQ ID NO: 110089 - DNA, 25 bp, Homo sapien
ttctaccaggcatcacattcaccaa

SEQ ID NO: 110090 - DNA, 25 bp, Homo sapien
ctcttcttcctgagttatgctcatg

SEQ ID NO: 110091 - DNA, 25 bp, Homo sapien
atgctcatgtgaggtgcaattccta

SEQ ID NO: 110092 - DNA, 25 bp, Homo sapien
gaggtgcaattcctacagaccagaa

SEQ ID NO: 110093 - DNA, 25 bp, Homo sapien
acagaccagaagctgcccgagaaca

SEQ ID NO: 110094 - DNA, 25 bp, Homo sapien
agctgcccgagaacaagtccaaatt

SEQ ID NO: 110095 - DNA, 25 bp, Homo sapien
cctcagtttagggtcaatggtgcaa

SEQ ID NO: 110096 - DNA, 25 bp, Homo sapien
tccacccaattccacgatgaacaga

SEQ ID NO: 110097 - DNA, 25 bp, Homo sapien
agaggcatggactcctgccgactct

SEQ ID NO: 110098 - DNA, 25 bp, Homo sapien
tgcaggtggcccggcctgaggttcc

SEQ ID NO: 110099 - DNA, 25 bp, Homo sapien
gttcccaggagcagcaaaggggcct

SEQ ID NO: 110100 - DNA, 25 bp, Homo sapien
gcctgctgagctctggttaggttac

SEQ ID NO: 110101 - DNA, 25 bp, Homo sapien
cctgctgagctctggttaggttaca

SEQ ID NO: 110102 - DNA, 25 bp, Homo sapien
ctgctgagctctggttaggttacag

SEQ ID NO: 110103 - DNA, 25 bp, Homo sapien
gctgagctctggttaggttacagct

SEQ ID NO: 110104 - DNA, 25 bp, Homo sapien
tgagctctggttaggttacagctgg

SEQ ID NO: 110105 - DNA, 25 bp, Homo sapien
agctctggttaggttacagctggag

SEQ ID NO: 110106 - DNA, 25 bp, Homo sapien
accttccttcttcatactttgctct

SEQ ID NO: 110107 - DNA, 25 bp, Homo sapien
tttcttaaatactcattaatgtgca

SEQ ID NO: 110108 - DNA, 25 bp, Homo sapien
atactcattaatgtgcatatatcat

SEQ ID NO: 110109 - DNA, 25 bp, Homo sapien
aagtgatgcctctaaccttggattg

SEQ ID NO: 110110 - DNA, 25 bp, Homo sapien
atgcctctaaccttggattggcctg

SEQ ID NO: 110111 - DNA, 25 bp, Homo sapien
taaccttggattggcctgtgtgtgt

SEQ ID NO: 110112 - DNA, 25 bp, Homo sapien
gccagaagtatgatgcatcttacag

SEQ ID NO: 110113 - DNA, 25 bp, Homo sapien
gtatgatgcatcttacagattatta

SEQ ID NO: 110114 - DNA, 25 bp, Homo sapien
gatgttttgtataagcctatgtctc

SEQ ID NO: 110115 - DNA, 25 bp, Homo sapien
gtataagcctatgtctctaatacat

SEQ ID NO: 110116 - DNA, 25 bp, Homo sapien
ttttttgtttggtcgtaatgtctgc

SEQ ID NO: 110117 - DNA, 25 bp, Homo sapien
gtttggtcgtaatgtctgcatgata

SEQ ID NO: 110118 - DNA, 25 bp, Homo sapien
atgtctgcatgatatttgtgcacat

SEQ ID NO: 110119 - DNA, 25 bp, Homo sapien
tgtgcacatttattaagtatcgaag

SEQ ID NO: 110120 - DNA, 25 bp, Homo sapien
tttatacctcttattgtttcaaatt

SEQ ID NO: 110121 - DNA, 25 bp, Homo sapien
gtttcaaattctctatcctttctaa

SEQ ID NO: 110122 - DNA, 25 bp, Homo sapien
ttcaaattctctatcctttctaagt

SEQ ID NO: 110123 - DNA, 25 bp, Homo sapien
agtactaaaattgcattctttttct

SEQ ID NO: 110124 - DNA, 25 bp, Homo sapien
ttttctgttaaacaggctgcttcct

SEQ ID NO: 110125 - DNA, 25 bp, Homo sapien
tataaggttggctatggaaggagta

SEQ ID NO: 110126 - DNA, 25 bp, Homo sapien
gcaaatgtgcttgtagattagagac

SEQ ID NO: 110127 - DNA, 25 bp, Homo sapien
atgtgcttgtagattagagacttct

SEQ ID NO: 110128 - DNA, 25 bp, Homo sapien
agagacttctattgtacctcaaata

SEQ ID NO: 110129 - DNA, 25 bp, Homo sapien
tattgtacctcaaatagtgatcttt

SEQ ID NO: 110130 - DNA, 25 bp, Homo sapien
agtgatcttttttagactagaatta

SEQ ID NO: 110131 - DNA, 25 bp, Homo sapien
gctcttcagttcgtgtgtggagaca

SEQ ID NO: 110132 - DNA, 25 bp, Homo sapien
ttttatttcaacaagcccacagggt

SEQ ID NO: 110133 - DNA, 25 bp, Homo sapien
acagggtatggctccagcagtcgga

SEQ ID NO: 110134 - DNA, 25 bp, Homo sapien
tccagcagtcggagggcgcctcaga

SEQ ID NO: 110135 - DNA, 25 bp, Homo sapien
atcgtggatgagtgctgcttccgga

SEQ ID NO: 110136 - DNA, 25 bp, Homo sapien
ctgcttccggagctgtgatctaagg

SEQ ID NO: 110137 - DNA, 25 bp, Homo sapien
ggctggagatgtattgcgcacccct

SEQ ID NO: 110138 - DNA, 25 bp, Homo sapien
aagcctgccaagtcagctcgctctg

SEQ ID NO: 110139 - DNA, 25 bp, Homo sapien
cgacatgcccaagacccagaaggaa

SEQ ID NO: 110140 - DNA, 25 bp, Homo sapien
agacccagaaggaagtacatttgaa

SEQ ID NO: 110141 - DNA, 25 bp, Homo sapien
ggatgtaggaagaccctcctgagga

SEQ ID NO: 110142 - DNA, 25 bp, Homo sapien
gagtgtcagagacagtcttcctgcc

SEQ ID NO: 110143 - DNA, 25 bp, Homo sapien
gagacagtcttcctgcccagggaag

SEQ ID NO: 110144 - DNA, 25 bp, Homo sapien
cagggaagaccaccttttccgcaag

SEQ ID NO: 110145 - DNA, 25 bp, Homo sapien
ttcctgccctcaactgaggacgttt

SEQ ID NO: 110146 - DNA, 25 bp, Homo sapien
ctgaggacgtttacgactgcagggt

SEQ ID NO: 110147 - DNA, 25 bp, Homo sapien
gagcctcttctcaagcactgggagt

SEQ ID NO: 110148 - DNA, 25 bp, Homo sapien
tgggagtttgatgctccaagccctc

SEQ ID NO: 110149 - DNA, 25 bp, Homo sapien
actacagagaacgtggtgtgtgccc

SEQ ID NO: 110150 - DNA, 25 bp, Homo sapien
gggcatcattattgggaccatcttc

SEQ ID NO: 110151 - DNA, 25 bp, Homo sapien
atcttcatcatcaagggattgcgca

SEQ ID NO: 110152 - DNA, 25 bp, Homo sapien
aaaagcaatgcagcagaacgcaggg

SEQ ID NO: 110153 - DNA, 25 bp, Homo sapien
ttccatggccctcattaatgacact

SEQ ID NO: 110154 - DNA, 25 bp, Homo sapien
taatgacacttgtccccaaatccga

SEQ ID NO: 110155 - DNA, 25 bp, Homo sapien
ccaaatccgaacctcctctgtgaag

SEQ ID NO: 110156 - DNA, 25 bp, Homo sapien
tgaagcattcgagacagaaccttgt

SEQ ID NO: 110157 - DNA, 25 bp, Homo sapien
agaaccttgttatttctcagacttt

SEQ ID NO: 110158 - DNA, 25 bp, Homo sapien
aaaggccaaacctctgttcagtgta

SEQ ID NO: 110159 - DNA, 25 bp, Homo sapien
gtaaatagttactccagtgccaaca

SEQ ID NO: 110160 - DNA, 25 bp, Homo sapien
ccagtgccaacaatcctagtgcttt

SEQ ID NO: 110161 - DNA, 25 bp, Homo sapien
cctatgtgattttaactctgtcttc

SEQ ID NO: 110162 - DNA, 25 bp, Homo sapien
ttttccaaaagtggcctctttgtct

SEQ ID NO: 110163 - DNA, 25 bp, Homo sapien
aagtggcctctttgtctaaaacaat

SEQ ID NO: 110164 - DNA, 25 bp, Homo sapien
accagctggtggctttatggtggtg

SEQ ID NO: 110165 - DNA, 25 bp, Homo sapien
ctggtggctttatggtggtggctgg

SEQ ID NO: 110166 - DNA, 25 bp, Homo sapien
tggcttcaggcctgacactgggccc

SEQ ID NO: 110167 - DNA, 25 bp, Homo sapien
tctctaccaaggcctgggccctgtg

SEQ ID NO: 110168 - DNA, 25 bp, Homo sapien
tgctgtcagggcctgttagccacct

SEQ ID NO: 110169 - DNA, 25 bp, Homo sapien
tgtcagggcctgttagccacctcat

SEQ ID NO: 110170 - DNA, 25 bp, Homo sapien
gtcagggcctgttagccacctcatg

SEQ ID NO: 110171 - DNA, 25 bp, Homo sapien
tcagggcctgttagccacctcatgc

SEQ ID NO: 110172 - DNA, 25 bp, Homo sapien
agggcctgttagccacctcatgcct

SEQ ID NO: 110173 - DNA, 25 bp, Homo sapien
ttccctggacccctactgggctcac

SEQ ID NO: 110174 - DNA, 25 bp, Homo sapien
ctactgggctcacccacgggctcct

SEQ ID NO: 110175 - DNA, 25 bp, Homo sapien
ggagcaccgtgatggagaggacaga

SEQ ID NO: 110176 - DNA, 25 bp, Homo sapien
cttctttctggactggcgttcacct

SEQ ID NO: 110177 - DNA, 25 bp, Homo sapien
ttctttctggactggcgttcacctc

SEQ ID NO: 110178 - DNA, 25 bp, Homo sapien
ttctggactggcgttcacctccctg

SEQ ID NO: 110179 - DNA, 25 bp, Homo sapien
gggtcagagcactccctaatttatg

SEQ ID NO: 110180 - DNA, 25 bp, Homo sapien
ggtcagagcactccctaatttatgt

SEQ ID NO: 110181 - DNA, 25 bp, Homo sapien
tcagagcactccctaatttatgtgc

SEQ ID NO: 110182 - DNA, 25 bp, Homo sapien
gagcactccctaatttatgtgctat

SEQ ID NO: 110183 - DNA, 25 bp, Homo sapien
gcactccctaatttatgtgctatat

SEQ ID NO: 110184 - DNA, 25 bp, Homo sapien
actccctaatttatgtgctatataa

SEQ ID NO: 110185 - DNA, 25 bp, Homo sapien
gtcagatgtacatagagatctattt

SEQ ID NO: 110186 - DNA, 25 bp, Homo sapien
gcctcagtgtcccagagtgctgata

SEQ ID NO: 110187 - DNA, 25 bp, Homo sapien
agtgtcccagagtgctgatattaca

SEQ ID NO: 110188 - DNA, 25 bp, Homo sapien
gtgtctggttcctttcacgttgaac

SEQ ID NO: 110189 - DNA, 25 bp, Homo sapien
gtctggttcctttcacgttgaacgc

SEQ ID NO: 110190 - DNA, 25 bp, Homo sapien
tggttcctttcacgttgaacgctat

SEQ ID NO: 110191 - DNA, 25 bp, Homo sapien
gttcctttcacgttgaacgctattt

SEQ ID NO: 110192 - DNA, 25 bp, Homo sapien
cctttcacgttgaacgctatttttg

SEQ ID NO: 110193 - DNA, 25 bp, Homo sapien
ctcctactgtttccctctatcaaaa

SEQ ID NO: 110194 - DNA, 25 bp, Homo sapien
actgtttccctctatcaaaaagcct

SEQ ID NO: 110195 - DNA, 25 bp, Homo sapien
tgtttccctctatcaaaaagcctcc

SEQ ID NO: 110196 - DNA, 25 bp, Homo sapien
tttccctctatcaaaaagcctcctt

SEQ ID NO: 110197 - DNA, 25 bp, Homo sapien
tgatctgtattgactaatacaccag

SEQ ID NO: 110198 - DNA, 25 bp, Homo sapien
gtattgactaatacaccagtccaca

SEQ ID NO: 110199 - DNA, 25 bp, Homo sapien
tgactaatacaccagtccacacttc

SEQ ID NO: 110200 - DNA, 25 bp, Homo sapien
taatacaccagtccacacttctatg

SEQ ID NO: 110201 - DNA, 25 bp, Homo sapien
aatacaccagtccacacttctatga

SEQ ID NO: 110202 - DNA, 25 bp, Homo sapien
atacaccagtccacacttctatgac

SEQ ID NO: 110203 - DNA, 25 bp, Homo sapien
acaccagtccacacttctatgactt

SEQ ID NO: 110204 - DNA, 25 bp, Homo sapien
accagtccacacttctatgacttct

SEQ ID NO: 110205 - DNA, 25 bp, Homo sapien
agtccacacttctatgacttctgcc

SEQ ID NO: 110206 - DNA, 25 bp, Homo sapien
acacttctatgacttctgccatttc

SEQ ID NO: 110207 - DNA, 25 bp, Homo sapien
ttctatgacttctgccatttcaaag

SEQ ID NO: 110208 - DNA, 25 bp, Homo sapien
tggacatctcgtaggacccagccag

SEQ ID NO: 110209 - DNA, 25 bp, Homo sapien
agccagtctcatccagcaggttggg

SEQ ID NO: 110210 - DNA, 25 bp, Homo sapien
atccagcaggttgggttctagggct

SEQ ID NO: 110211 - DNA, 25 bp, Homo sapien
gttctagggctgaaccaggcgccag

SEQ ID NO: 110212 - DNA, 25 bp, Homo sapien
caggcgccaggctccagaggacgaa

SEQ ID NO: 110213 - DNA, 25 bp, Homo sapien
gaggacgaagggactctgttgcccc

SEQ ID NO: 110214 - DNA, 25 bp, Homo sapien
aaacccaggaccaagctgtgcctgg

SEQ ID NO: 110215 - DNA, 25 bp, Homo sapien
ctgtgcctgggctccaaggacagga

SEQ ID NO: 110216 - DNA, 25 bp, Homo sapien
ggctccaaggacaggaacactggtc

SEQ ID NO: 110217 - DNA, 25 bp, Homo sapien
acactcacccctaagtgggctggga

SEQ ID NO: 110218 - DNA, 25 bp, Homo sapien
gaacgctaagacacaggctccagta

SEQ ID NO: 110219 - DNA, 25 bp, Homo sapien
actctcaggctgcgtgcagcgacag

SEQ ID NO: 110220 - DNA, 25 bp, Homo sapien
caggctgcgtgcagcgacagtgccc

SEQ ID NO: 110221 - DNA, 25 bp, Homo sapien
gcctggctgtcctagcagttgtggt

SEQ ID NO: 110222 - DNA, 25 bp, Homo sapien
ctggctgtcctagcagttgtggtca

SEQ ID NO: 110223 - DNA, 25 bp, Homo sapien
tggctgtcctagcagttgtggtcat

SEQ ID NO: 110224 - DNA, 25 bp, Homo sapien
ggctgtcctagcagttgtggtcatc

SEQ ID NO: 110225 - DNA, 25 bp, Homo sapien
ctgtcctagcagttgtggtcatcgg

SEQ ID NO: 110226 - DNA, 25 bp, Homo sapien
gtcctagcagttgtggtcatcggag

SEQ ID NO: 110227 - DNA, 25 bp, Homo sapien
cctagcagttgtggtcatcggagct

SEQ ID NO: 110228 - DNA, 25 bp, Homo sapien
tagcagttgtggtcatcggagctgt

SEQ ID NO: 110229 - DNA, 25 bp, Homo sapien
cagttgtggtcatcggagctgtggt

SEQ ID NO: 110230 - DNA, 25 bp, Homo sapien
tgcaaagccaagacccttctgcagc

SEQ ID NO: 110231 - DNA, 25 bp, Homo sapien
gaagacaccatgctttagagatcca

SEQ ID NO: 110232 - DNA, 25 bp, Homo sapien
accgcagcgtacttggcacttcagt

SEQ ID NO: 110233 - DNA, 25 bp, Homo sapien
gcgtacttggcacttcagtttcaaa

SEQ ID NO: 110234 - DNA, 25 bp, Homo sapien
tcagtttcaaacacgtagtccttta

SEQ ID NO: 110235 - DNA, 25 bp, Homo sapien
gtagtcctttaaaacttgatccgat

SEQ ID NO: 110236 - DNA, 25 bp, Homo sapien
aacttgatccgatagctttaatgcg

SEQ ID NO: 110237 - DNA, 25 bp, Homo sapien
gatagctttaatgcggccggtcctc

SEQ ID NO: 110238 - DNA, 25 bp, Homo sapien
cggtcctctctcagtcaggaaaatt

SEQ ID NO: 110239 - DNA, 25 bp, Homo sapien
ggaaaattgcacagaccgacagtcg

SEQ ID NO: 110240 - DNA, 25 bp, Homo sapien
acagaccgacagtcgtgaggatggc

SEQ ID NO: 110241 - DNA, 25 bp, Homo sapien
tattactgtctacagcataatagtt

SEQ ID NO: 110242 - DNA, 25 bp, Homo sapien
tactgtctacagcataatagttacc

SEQ ID NO: 110243 - DNA, 25 bp, Homo sapien
actgtctacagcataatagttaccc

SEQ ID NO: 110244 - DNA, 25 bp, Homo sapien
ctgtctacagcataatagttaccct

SEQ ID NO: 110245 - DNA, 25 bp, Homo sapien
tgtctacagcataatagttaccctt

SEQ ID NO: 110246 - DNA, 25 bp, Homo sapien
gtctacagcataatagttacccttg

SEQ ID NO: 110247 - DNA, 25 bp, Homo sapien
tctacagcataatagttacccttgg

SEQ ID NO: 110248 - DNA, 25 bp, Homo sapien
agggcattagaaatgatttagcctg

SEQ ID NO: 110249 - DNA, 25 bp, Homo sapien
gcattagaaatgatttagcctggta

SEQ ID NO: 110250 - DNA, 25 bp, Homo sapien
cattagaaatgatttagcctggtat

SEQ ID NO: 110251 - DNA, 25 bp, Homo sapien
attagaaatgatttagcctggtatc

SEQ ID NO: 110252 - DNA, 25 bp, Homo sapien
tccatggaggaggtgtcccaagctt

SEQ ID NO: 110253 - DNA, 25 bp, Homo sapien
gaggaggtgtcccaagctttgaata

SEQ ID NO: 110254 - DNA, 25 bp, Homo sapien
gaggtgtcccaagctttgaataccc

SEQ ID NO: 110255 - DNA, 25 bp, Homo sapien
gaagaaaccccaagcagcattcagc

SEQ ID NO: 110256 - DNA, 25 bp, Homo sapien
gaaaccccaagcagcattcagcaca

SEQ ID NO: 110257 - DNA, 25 bp, Homo sapien
agcagcattcagcacaccccaaggg

SEQ ID NO: 110258 - DNA, 25 bp, Homo sapien
agcattcagcacaccccaagggaca

SEQ ID NO: 110259 - DNA, 25 bp, Homo sapien
agggacaaccccatcatatgacatg

SEQ ID NO: 110260 - DNA, 25 bp, Homo sapien
gacaaccccatcatatgacatgcca

SEQ ID NO: 110261 - DNA, 25 bp, Homo sapien
ctccatgcccaacctaagattgtgt

SEQ ID NO: 110262 - DNA, 25 bp, Homo sapien
gcccaacctaagattgtgtgggttt

SEQ ID NO: 110263 - DNA, 25 bp, Homo sapien
gaaccctaaatttatggagaccgtg

SEQ ID NO: 110264 - DNA, 25 bp, Homo sapien
ccctaaatttatggagaccgtggcg

SEQ ID NO: 110265 - DNA, 25 bp, Homo sapien
ctaaatttatggagaccgtggcgga

SEQ ID NO: 110266 - DNA, 25 bp, Homo sapien
taaatttatggagaccgtggcggag

SEQ ID NO: 110267 - DNA, 25 bp, Homo sapien
aaatttatggagaccgtggcggaga

SEQ ID NO: 110268 - DNA, 25 bp, Homo sapien
agaccgtggcggagaaagcgctgca

SEQ ID NO: 110269 - DNA, 25 bp, Homo sapien
gcaggaataccgcaaaaagcaccgg

SEQ ID NO: 110270 - DNA, 25 bp, Homo sapien
caggaataccgcaaaaagcaccggg

SEQ ID NO: 110271 - DNA, 25 bp, Homo sapien
aaaagcaccgggaggagtgagatgt

SEQ ID NO: 110272 - DNA, 25 bp, Homo sapien
ttgcttttgcacctacgggggcatc

SEQ ID NO: 110273 - DNA, 25 bp, Homo sapien
tacgggggcatctgagtccagctcc

SEQ ID NO: 110274 - DNA, 25 bp, Homo sapien
tgaaggcaaagcacgaaatgttatt

SEQ ID NO: 110275 - DNA, 25 bp, Homo sapien
ggcaaagcacgaaatgttatttttt

SEQ ID NO: 110276 - DNA, 25 bp, Homo sapien
gcatcctccacaatagcagacagtg

SEQ ID NO: 110277 - DNA, 25 bp, Homo sapien
tcctccacaatagcagacagtgttt

SEQ ID NO: 110278 - DNA, 25 bp, Homo sapien
tccacaatagcagacagtgttttct

SEQ ID NO: 110279 - DNA, 25 bp, Homo sapien
acaatagcagacagtgttttctggg

SEQ ID NO: 110280 - DNA, 25 bp, Homo sapien
atacagggcattttggtccaagttg

SEQ ID NO: 110281 - DNA, 25 bp, Homo sapien
cagggcattttggtccaagttgtgc

SEQ ID NO: 110282 - DNA, 25 bp, Homo sapien
gggcattttggtccaagttgtgctt

SEQ ID NO: 110283 - DNA, 25 bp, Homo sapien
cattttggtccaagttgtgcttatc

SEQ ID NO: 110284 - DNA, 25 bp, Homo sapien
ttggtccaagttgtgcttatcccat

SEQ ID NO: 110285 - DNA, 25 bp, Homo sapien
attaattcgtatgccagctcacctt

SEQ ID NO: 110286 - DNA, 25 bp, Homo sapien
agctcacctttttatgatctgccat

SEQ ID NO: 110287 - DNA, 25 bp, Homo sapien
aagactcatgtttctgctatgacca

SEQ ID NO: 110288 - DNA, 25 bp, Homo sapien
gtttctgctatgaccatgacacgat

SEQ ID NO: 110289 - DNA, 25 bp, Homo sapien
atgaccatgacacgatttaaatctt

SEQ ID NO: 110290 - DNA, 25 bp, Homo sapien
ttaatcaacattgtattcagctctt

SEQ ID NO: 110291 - DNA, 25 bp, Homo sapien
attcagctcttaaggcactagtccc

SEQ ID NO: 110292 - DNA, 25 bp, Homo sapien
tcccttacagaggaccatgctgact

SEQ ID NO: 110293 - DNA, 25 bp, Homo sapien
ggaccatgctgactgatccattatc

SEQ ID NO: 110294 - DNA, 25 bp, Homo sapien
gctgactgatccattatctatttaa

SEQ ID NO: 110295 - DNA, 25 bp, Homo sapien
atgtgcacctttgcacagtggttaa

SEQ ID NO: 110296 - DNA, 25 bp, Homo sapien
cttactgtgtcatcaaatgtgcggt

SEQ ID NO: 110297 - DNA, 25 bp, Homo sapien
aaatgtgcggttaagattctctggg

SEQ ID NO: 110298 - DNA, 25 bp, Homo sapien
gattctctgggatattgatactgtt

SEQ ID NO: 110299 - DNA, 25 bp, Homo sapien
gagatctgagagacctggctttggc

SEQ ID NO: 110300 - DNA, 25 bp, Homo sapien
gcagatgtcattccatatcaccttt

SEQ ID NO: 110301 - DNA, 25 bp, Homo sapien
atgaaagtctcattctatcctctct

SEQ ID NO: 110302 - DNA, 25 bp, Homo sapien
gttaatagttacgtctctcctgatg

SEQ ID NO: 110303 - DNA, 25 bp, Homo sapien
acgtctctcctgatgtagcacttaa

SEQ ID NO: 110304 - DNA, 25 bp, Homo sapien
gtagcacttaagcttcatttagtta

SEQ ID NO: 110305 - DNA, 25 bp, Homo sapien
gcacacatttgcatccacatattag

SEQ ID NO: 110306 - DNA, 25 bp, Homo sapien
taagtagctgcaaactatctattcc

SEQ ID NO: 110307 - DNA, 25 bp, Homo sapien
tataattcctatatcctgtgactgt

SEQ ID NO: 110308 - DNA, 25 bp, Homo sapien
attcctatatcctgtgactgtctca

SEQ ID NO: 110309 - DNA, 25 bp, Homo sapien
gactgtctcacttaatcctttgttt

SEQ ID NO: 110310 - DNA, 25 bp, Homo sapien
ctcacttaatcctttgttttctgac

SEQ ID NO: 110311 - DNA, 25 bp, Homo sapien
gttttctgactaattaggcaaggct

SEQ ID NO: 110312 - DNA, 25 bp, Homo sapien
ggcaaggctatgtgattacaaggct

SEQ ID NO: 110313 - DNA, 25 bp, Homo sapien
gtgattacaaggctttatctcaggg

SEQ ID NO: 110314 - DNA, 25 bp, Homo sapien
gggccaactaggcagccaacctaag

SEQ ID NO: 110315 - DNA, 25 bp, Homo sapien
gcagccaacctaagcaagatcccat

SEQ ID NO: 110316 - DNA, 25 bp, Homo sapien
agatcccatgggttgtgtgtttatt

SEQ ID NO: 110317 - DNA, 25 bp, Homo sapien
gtttatttcacttgatgatacaatg

SEQ ID NO: 110318 - DNA, 25 bp, Homo sapien
ttcaccggccactatatgcactggg

SEQ ID NO: 110319 - DNA, 25 bp, Homo sapien
aacagtggtggcacaaactatgcag

SEQ ID NO: 110320 - DNA, 25 bp, Homo sapien
agtggtggcacaaactatgcagaga

SEQ ID NO: 110321 - DNA, 25 bp, Homo sapien
gtggcacaaactatgcagagaagtt

SEQ ID NO: 110322 - DNA, 25 bp, Homo sapien
tactgtgcgagagcctcatattgtg

SEQ ID NO: 110323 - DNA, 25 bp, Homo sapien
ctgtgcgagagcctcatattgtggt

SEQ ID NO: 110324 - DNA, 25 bp, Homo sapien
tgcgagagcctcatattgtggttat

SEQ ID NO: 110325 - DNA, 25 bp, Homo sapien
atattgtggttatgactgctattac

SEQ ID NO: 110326 - DNA, 25 bp, Homo sapien
gtggttatgactgctattacttctt

SEQ ID NO: 110327 - DNA, 25 bp, Homo sapien
ggttatgactgctattacttctttg

SEQ ID NO: 110328 - DNA, 25 bp, Homo sapien
ttatgactgctattacttctttgac

SEQ ID NO: 110329 - DNA, 25 bp, Homo sapien
cactaagggcgactaccagaaagcg

SEQ ID NO: 110330 - DNA, 25 bp, Homo sapien
taagggcgactaccagaaagcgctg

SEQ ID NO: 110331 - DNA, 25 bp, Homo sapien
agggcgactaccagaaagcgctgct

SEQ ID NO: 110332 - DNA, 25 bp, Homo sapien
ggcgactaccagaaagcgctgctgt

SEQ ID NO: 110333 - DNA, 25 bp, Homo sapien
ggtggagctgactgaagcccgacac

SEQ ID NO: 110334 - DNA, 25 bp, Homo sapien
tgactgaagcccgacacagcctgag

SEQ ID NO: 110335 - DNA, 25 bp, Homo sapien
tgaagcccgacacagcctgagcgtc

SEQ ID NO: 110336 - DNA, 25 bp, Homo sapien
gcgtccagaaatggtgctcaccatg

SEQ ID NO: 110337 - DNA, 25 bp, Homo sapien
atggtgctcaccatgcttccagcta

SEQ ID NO: 110338 - DNA, 25 bp, Homo sapien
cagctaacaggtctactaaacatac

SEQ ID NO: 110339 - DNA, 25 bp, Homo sapien
agctaacaggtctactaaacataca

SEQ ID NO: 110340 - DNA, 25 bp, Homo sapien
agcagcacaggcagaagcactttga

SEQ ID NO: 110341 - DNA, 25 bp, Homo sapien
cactttgagaagaggcggaacccgg

SEQ ID NO: 110342 - DNA, 25 bp, Homo sapien
ggcctgatccagtcggcctggagat

SEQ ID NO: 110343 - DNA, 25 bp, Homo sapien
ggcctggagattctacgccaccaac

SEQ ID NO: 110344 - DNA, 25 bp, Homo sapien
acagacctgcactccacgtggcagt

SEQ ID NO: 110345 - DNA, 25 bp, Homo sapien
tccacgtggcagtactacgagcgaa

SEQ ID NO: 110346 - DNA, 25 bp, Homo sapien
agtactacgagcgaacggtcaccgt

SEQ ID NO: 110347 - DNA, 25 bp, Homo sapien
agcgaacggtcaccgtgcccatgta

SEQ ID NO: 110348 - DNA, 25 bp, Homo sapien
catgtacaggtaccgccgccgggca

SEQ ID NO: 110349 - DNA, 25 bp, Homo sapien
ctgccaccaagcaactgtttcattt

SEQ ID NO: 110350 - DNA, 25 bp, Homo sapien
caccaagcaactgtttcatttttta

SEQ ID NO: 110351 - DNA, 25 bp, Homo sapien
acctggaggctgacgttgccaaacc

SEQ ID NO: 110352 - DNA, 25 bp, Homo sapien
tgacgttgccaaaccagccagggaa

SEQ ID NO: 110353 - DNA, 25 bp, Homo sapien
gttgccaaaccagccagggaaccaa

SEQ ID NO: 110354 - DNA, 25 bp, Homo sapien
gaaccaacctgggaagtggccagaa

SEQ ID NO: 110355 - DNA, 25 bp, Homo sapien
gggtccaagaactcttgtgcctccg

SEQ ID NO: 110356 - DNA, 25 bp, Homo sapien
caagaactcttgtgcctccgtccat

SEQ ID NO: 110357 - DNA, 25 bp, Homo sapien
atcaccatgtgggttttgaagaccc

SEQ ID NO: 110358 - DNA, 25 bp, Homo sapien
gtgggttttgaagaccctcgactgc

SEQ ID NO: 110359 - DNA, 25 bp, Homo sapien
gttttgaagaccctcgactgcctcc

SEQ ID NO: 110360 - DNA, 25 bp, Homo sapien
atgctccgaagcctgatcttccagg

SEQ ID NO: 110361 - DNA, 25 bp, Homo sapien
tccgaagcctgatcttccagggtgg

SEQ ID NO: 110362 - DNA, 25 bp, Homo sapien
gaaacagtagaagtcatctcagaaa

SEQ ID NO: 110363 - DNA, 25 bp, Homo sapien
agtcatctcagaaatgtttgacctc

SEQ ID NO: 110364 - DNA, 25 bp, Homo sapien
tggagctgtacaagcagggcctgcg

SEQ ID NO: 110365 - DNA, 25 bp, Homo sapien
aagggccccttgaccatgatggcca

SEQ ID NO: 110366 - DNA, 25 bp, Homo sapien
gatggccagccactacaaacagcac

SEQ ID NO: 110367 - DNA, 25 bp, Homo sapien
ggaaacttcctgtgcaacccagatt

SEQ ID NO: 110368 - DNA, 25 bp, Homo sapien
acttcctgtgcaacccagattatca

SEQ ID NO: 110369 - DNA, 25 bp, Homo sapien
gcaacccagattatcacctttgaaa

SEQ ID NO: 110370 - DNA, 25 bp, Homo sapien
agattatcacctttgaaagtttcaa

SEQ ID NO: 110371 - DNA, 25 bp, Homo sapien
tgaaggactttctgcttgtcatccc

SEQ ID NO: 110372 - DNA, 25 bp, Homo sapien
ttctgcttgtcatcccctttgactg

SEQ ID NO: 110373 - DNA, 25 bp, Homo sapien
ctgggccttattatccatcacagga

SEQ ID NO: 110374 - DNA, 25 bp, Homo sapien
tgggccttattatccatcacaggag

SEQ ID NO: 110375 - DNA, 25 bp, Homo sapien
gggccttattatccatcacaggagt

SEQ ID NO: 110376 - DNA, 25 bp, Homo sapien
ggccttattatccatcacaggagtc

SEQ ID NO: 110377 - DNA, 25 bp, Homo sapien
gccttattatccatcacaggagtca

SEQ ID NO: 110378 - DNA, 25 bp, Homo sapien
cttattatccatcacaggagtcaga

SEQ ID NO: 110379 - DNA, 25 bp, Homo sapien
tattatccatcacaggagtcagaaa

SEQ ID NO: 110380 - DNA, 25 bp, Homo sapien
acaggagtcagaaagggctcctgca

SEQ ID NO: 110381 - DNA, 25 bp, Homo sapien
gcactgactcctgagactattttaa

SEQ ID NO: 110382 - DNA, 25 bp, Homo sapien
ctgagactattttaactgggattgg

SEQ ID NO: 110383 - DNA, 25 bp, Homo sapien
aactgggattggttatcacttttct

SEQ ID NO: 110384 - DNA, 25 bp, Homo sapien
cactttgagaagaggcggaacccgg

SEQ ID NO: 110385 - DNA, 25 bp, Homo sapien
gagaagaggcggaacccggcagcag

SEQ ID NO: 110386 - DNA, 25 bp, Homo sapien
acagacctgcactccacgtggcagt

SEQ ID NO: 110387 - DNA, 25 bp, Homo sapien
tgcactccacgtggcagtactacga

SEQ ID NO: 110388 - DNA, 25 bp, Homo sapien
actccacgtggcagtactacgagcg

SEQ ID NO: 110389 - DNA, 25 bp, Homo sapien
tccacgtggcagtactacgagcgaa

SEQ ID NO: 110390 - DNA, 25 bp, Homo sapien
tggcagtactacgagcgaacggtca

SEQ ID NO: 110391 - DNA, 25 bp, Homo sapien
gcagtactacgagcgaacggtcacc

SEQ ID NO: 110392 - DNA, 25 bp, Homo sapien
agtactacgagcgaacggtcaccgt

SEQ ID NO: 110393 - DNA, 25 bp, Homo sapien
tactacgagcgaacggtcaccgtgc

SEQ ID NO: 110394 - DNA, 25 bp, Homo sapien
agcgaacggtcaccgtgcccatgta

SEQ ID NO: 110395 - DNA, 25 bp, Homo sapien
attactgtgcggccgccccaagaca

SEQ ID NO: 110396 - DNA, 25 bp, Homo sapien
ttactgtgcggccgccccaagacat

SEQ ID NO: 110397 - DNA, 25 bp, Homo sapien
gtgcggccgccccaagacatgcggg

SEQ ID NO: 110398 - DNA, 25 bp, Homo sapien
tgcggccgccccaagacatgcgggg

SEQ ID NO: 110399 - DNA, 25 bp, Homo sapien
gcggccgccccaagacatgcgggga

SEQ ID NO: 110400 - DNA, 25 bp, Homo sapien
aagacatgcggggagtcccccctat

SEQ ID NO: 110401 - DNA, 25 bp, Homo sapien
agacatgcggggagtcccccctatg

SEQ ID NO: 110402 - DNA, 25 bp, Homo sapien
gggagtcccccctatgactactggg

SEQ ID NO: 110403 - DNA, 25 bp, Homo sapien
ggagtcccccctatgactactgggg

SEQ ID NO: 110404 - DNA, 25 bp, Homo sapien
gagtcccccctatgactactggggc

SEQ ID NO: 110405 - DNA, 25 bp, Homo sapien
gtcccccctatgactactggggcca

SEQ ID NO: 110406 - DNA, 25 bp, Homo sapien
gttaggcaccttaagaccaagccat

SEQ ID NO: 110407 - DNA, 25 bp, Homo sapien
gcaccttaagaccaagccatcggat

SEQ ID NO: 110408 - DNA, 25 bp, Homo sapien
ccaagccatcggatgaggagatgct

SEQ ID NO: 110409 - DNA, 25 bp, Homo sapien
tcatctatggccactacaaacaagc

SEQ ID NO: 110410 - DNA, 25 bp, Homo sapien
gcaactgtgggcgacataaatacag

SEQ ID NO: 110411 - DNA, 25 bp, Homo sapien
acataaatacagaacggcccgggat

SEQ ID NO: 110412 - DNA, 25 bp, Homo sapien
gaacggcccgggatgttggacttca

SEQ ID NO: 110413 - DNA, 25 bp, Homo sapien
atgttggacttcacgggcaaggcca

SEQ ID NO: 110414 - DNA, 25 bp, Homo sapien
atgcctggaatgagctgaaagggac

SEQ ID NO: 110415 - DNA, 25 bp, Homo sapien
atgccatgaaagcttacatcaacaa

SEQ ID NO: 110416 - DNA, 25 bp, Homo sapien
agctgcagaggaggttaggcacctt

SEQ ID NO: 110417 - DNA, 25 bp, Homo sapien
agcacctatggcatgagctgggtcc

SEQ ID NO: 110418 - DNA, 25 bp, Homo sapien
gtagtggtggtagcacatattacgc

SEQ ID NO: 110419 - DNA, 25 bp, Homo sapien
tggtagcacatattacgcagactcc

SEQ ID NO: 110420 - DNA, 25 bp, Homo sapien
ggccgtctattactgtgcggccgcc

SEQ ID NO: 110421 - DNA, 25 bp, Homo sapien
attactgtgcggccgccccaagaca

SEQ ID NO: 110422 - DNA, 25 bp, Homo sapien
ttactgtgcggccgccccaagacat

SEQ ID NO: 110423 - DNA, 25 bp, Homo sapien
gtgcggccgccccaagacatgcggg

SEQ ID NO: 110424 - DNA, 25 bp, Homo sapien
gcggccgccccaagacatgcgggga

SEQ ID NO: 110425 - DNA, 25 bp, Homo sapien
gggagtcccccctatgactactggg

SEQ ID NO: 110426 - DNA, 25 bp, Homo sapien
gagtcccccctatgactactggggc

SEQ ID NO: 110427 - DNA, 25 bp, Homo sapien
tggattcacctttagcacctatggc

SEQ ID NO: 110428 - DNA, 25 bp, Homo sapien
tgatggacgcgagtgaggctcagct

SEQ ID NO: 110429 - DNA, 25 bp, Homo sapien
gcgtgacagcttcccaagttgctgg

SEQ ID NO: 110430 - DNA, 25 bp, Homo sapien
gacagcttcccaagttgctggcctg

SEQ ID NO: 110431 - DNA, 25 bp, Homo sapien
gcttcccaagttgctggcctgcaag

SEQ ID NO: 110432 - DNA, 25 bp, Homo sapien
agcaggaagcggcacgactcgggac

SEQ ID NO: 110433 - DNA, 25 bp, Homo sapien
gactcgggactactgcgcaccgcaa

SEQ ID NO: 110434 - DNA, 25 bp, Homo sapien
actgcgcaccgcaagctatgtgatg

SEQ ID NO: 110435 - DNA, 25 bp, Homo sapien
gcaccgcaagctatgtgatgcgcat

SEQ ID NO: 110436 - DNA, 25 bp, Homo sapien
tttgagcgggacgagggctgctcca

SEQ ID NO: 110437 - DNA, 25 bp, Homo sapien
gaaggcggcaaatctgcaaaggcca

SEQ ID NO: 110438 - DNA, 25 bp, Homo sapien
ggcaaatctgcaaaggccagggacc

SEQ ID NO: 110439 - DNA, 25 bp, Homo sapien
cccgcttggcttcttctttaggatt

SEQ ID NO: 110440 - DNA, 25 bp, Homo sapien
gattgtgatggttcgttctgtttac

SEQ ID NO: 110441 - DNA, 25 bp, Homo sapien
atggttcgttctgtttacatcagtt

SEQ ID NO: 110442 - DNA, 25 bp, Homo sapien
atcagttttaacgagaggtatgcct

SEQ ID NO: 110443 - DNA, 25 bp, Homo sapien
gagaggtatgcctgtactcgcttgt

SEQ ID NO: 110444 - DNA, 25 bp, Homo sapien
tgcctgtactcgcttgtgcagaaaa

SEQ ID NO: 110445 - DNA, 25 bp, Homo sapien
acattgttccagattcaatcgactg

SEQ ID NO: 110446 - DNA, 25 bp, Homo sapien
aatcgactgggtttatgtcccttca

SEQ ID NO: 110447 - DNA, 25 bp, Homo sapien
gggtttatgtcccttcacatagttt

SEQ ID NO: 110448 - DNA, 25 bp, Homo sapien
gtaacagacattgttttgccaacat

SEQ ID NO: 110449 - DNA, 25 bp, Homo sapien
tgcctatttcagtggcacgtcatct

SEQ ID NO: 110450 - DNA, 25 bp, Homo sapien
cctgcgggaagcttatgacgcctgt

SEQ ID NO: 110451 - DNA, 25 bp, Homo sapien
atgacgcctgtgtgaaagctctggt

SEQ ID NO: 110452 - DNA, 25 bp, Homo sapien
tggtctccctgaggagctaccatct

SEQ ID NO: 110453 - DNA, 25 bp, Homo sapien
ggagctaccatctgcaaatcgtgac

SEQ ID NO: 110454 - DNA, 25 bp, Homo sapien
aaatcgtgactaagtacatcctgat

SEQ ID NO: 110455 - DNA, 25 bp, Homo sapien
gtacatcctgattcctgcaagccag

SEQ ID NO: 110456 - DNA, 25 bp, Homo sapien
tgcaagccagcagccaaaggagaat

SEQ ID NO: 110457 - DNA, 25 bp, Homo sapien
gacctctgaagacccttcaaaactg

SEQ ID NO: 110458 - DNA, 25 bp, Homo sapien
ggaactggaggcactgatttaatga

SEQ ID NO: 110459 - DNA, 25 bp, Homo sapien
agtacaactgagaaatcccttttga

SEQ ID NO: 110460 - DNA, 25 bp, Homo sapien
gttaatgtaacccaacaagagcaca

SEQ ID NO: 110461 - DNA, 25 bp, Homo sapien
tctgggttcaccttcagtgcctccg

SEQ ID NO: 110462 - DNA, 25 bp, Homo sapien
tcagtgcctccgctgtgcactgggt

SEQ ID NO: 110463 - DNA, 25 bp, Homo sapien
aaagctaacagttacgcgacagcat

SEQ ID NO: 110464 - DNA, 25 bp, Homo sapien
acagttacgcgacagcatatgctgc

SEQ ID NO: 110465 - DNA, 25 bp, Homo sapien
agcatatgctgcgtcggtgaaaggc

SEQ ID NO: 110466 - DNA, 25 bp, Homo sapien
ggtgaaaggcaggttcaccatctcc

SEQ ID NO: 110467 - DNA, 25 bp, Homo sapien
gatgattcaaagaacacggcgtatc

SEQ ID NO: 110468 - DNA, 25 bp, Homo sapien
attcaaagaacacggcgtatctgca

SEQ ID NO: 110469 - DNA, 25 bp, Homo sapien
gccgtgtattactgtactggacacc

SEQ ID NO: 110470 - DNA, 25 bp, Homo sapien
gtattactgtactggacaccaaccc

SEQ ID NO: 110471 - DNA, 25 bp, Homo sapien
ggacaccaacccctgactacggtga

SEQ ID NO: 110472 - DNA, 25 bp, Homo sapien
aagcaaagattctgctggttctgtt

SEQ ID NO: 110473 - DNA, 25 bp, Homo sapien
tgctggttctgtttcaccccatcaa

SEQ ID NO: 110474 - DNA, 25 bp, Homo sapien
taccaaaaactttcgcagagatttc

SEQ ID NO: 110475 - DNA, 25 bp, Homo sapien
agagatttcttcattctgctgagca

SEQ ID NO: 110476 - DNA, 25 bp, Homo sapien
cattctgctgagcaagtgtggctgc

SEQ ID NO: 110477 - DNA, 25 bp, Homo sapien
aatgcaagcccaaatttataggaca

SEQ ID NO: 110478 - DNA, 25 bp, Homo sapien
agaaacttcatccactgtccacaac

SEQ ID NO: 110479 - DNA, 25 bp, Homo sapien
catccaaggaatggccactgctctt

SEQ ID NO: 110480 - DNA, 25 bp, Homo sapien
agagtcaccaatggttccacttaca

SEQ ID NO: 110481 - DNA, 25 bp, Homo sapien
tggttccacttacatacttgtccct

SEQ ID NO: 110482 - DNA, 25 bp, Homo sapien
ttgtccctctaagtcatttagccca

SEQ ID NO: 110483 - DNA, 25 bp, Homo sapien
aggcctgactctcagcagctatggt

SEQ ID NO: 110484 - DNA, 25 bp, Homo sapien
gactctcagcagctatggtaggaac

SEQ ID NO: 110485 - DNA, 25 bp, Homo sapien
ttggcagcccgggtcatctgtacct

SEQ ID NO: 110486 - DNA, 25 bp, Homo sapien
ctccctcaggccgaaggaggagtca

SEQ ID NO: 110487 - DNA, 25 bp, Homo sapien
ctgaactattagagctgcctgtgcc

SEQ ID NO: 110488 - DNA, 25 bp, Homo sapien
cagctatggttctctcgcaagggaa

SEQ ID NO: 110489 - DNA, 25 bp, Homo sapien
tggttctctcgcaagggaagtcctt

SEQ ID NO: 110490 - DNA, 25 bp, Homo sapien
gggaagtccttgcaagctaattctt

SEQ ID NO: 110491 - DNA, 25 bp, Homo sapien
agctaattctttgacctgttgggag

SEQ ID NO: 110492 - DNA, 25 bp, Homo sapien
gggatgtaccagcatctcccagttc

SEQ ID NO: 110493 - DNA, 25 bp, Homo sapien
accagcatctcccagttcataatca

SEQ ID NO: 110494 - DNA, 25 bp, Homo sapien
aactgcttttgtacctagctaggct

SEQ ID NO: 110495 - DNA, 25 bp, Homo sapien
aaatcataaagccttcatcactccc

SEQ ID NO: 110496 - DNA, 25 bp, Homo sapien
ggtcggagcatcagaacaagcgtct

SEQ ID NO: 110497 - DNA, 25 bp, Homo sapien
aagcgtctagactccttgggaccgt

SEQ ID NO: 110498 - DNA, 25 bp, Homo sapien
gaccgtgagttcctagagcttggct

SEQ ID NO: 110499 - DNA, 25 bp, Homo sapien
ggtctaggctgttctgtgcctccaa

SEQ ID NO: 110500 - DNA, 25 bp, Homo sapien
gcctccaaggactgtctggcaatga

SEQ ID NO: 110501 - DNA, 25 bp, Homo sapien
ggcaatgacttgtattggccaccaa

SEQ ID NO: 110502 - DNA, 25 bp, Homo sapien
attggccaccaactgtagatgtata

SEQ ID NO: 110503 - DNA, 25 bp, Homo sapien
atatatggtgcccttctgatgctaa

SEQ ID NO: 110504 - DNA, 25 bp, Homo sapien
gatgctaagactccagaccttttgt

SEQ ID NO: 110505 - DNA, 25 bp, Homo sapien
gcaatcaactttggatgtttcacta

SEQ ID NO: 110506 - DNA, 25 bp, Homo sapien
gtgtggtcctttggaatcctcctat

SEQ ID NO: 110507 - DNA, 25 bp, Homo sapien
ggaatcctcctatacgaaattgtca

SEQ ID NO: 110508 - DNA, 25 bp, Homo sapien
tacccagggagaactaatgccgacg

SEQ ID NO: 110509 - DNA, 25 bp, Homo sapien
taatgccgacgtgatgaccgccctg

SEQ ID NO: 110510 - DNA, 25 bp, Homo sapien
aggatgccccgtgtggagaactgcc

SEQ ID NO: 110511 - DNA, 25 bp, Homo sapien
actgcccagatgagctctatgacat

SEQ ID NO: 110512 - DNA, 25 bp, Homo sapien
gaagagagaccaacgtttgactact

SEQ ID NO: 110513 - DNA, 25 bp, Homo sapien
gtttgactacttacagagcgtcctg

SEQ ID NO: 110514 - DNA, 25 bp, Homo sapien
gagcgtcctggatgatttctacaca

SEQ ID NO: 110515 - DNA, 25 bp, Homo sapien
tgatttctacacagccacggaaggg

SEQ ID NO: 110516 - DNA, 25 bp, Homo sapien
tgcttccggacaacttccccagata

SEQ ID NO: 110517 - DNA, 25 bp, Homo sapien
ttccccagataccccgtgggcaagt

SEQ ID NO: 110518 - DNA, 25 bp, Homo sapien
cgtgggcaagttcttccaatatgac

SEQ ID NO: 110519 - DNA, 25 bp, Homo sapien
gcaagttcttccaatatgacacctg

SEQ ID NO: 110520 - DNA, 25 bp, Homo sapien
atgacacctggaagcagtccaccca

SEQ ID NO: 110521 - DNA, 25 bp, Homo sapien
tcacgtgctcgccaaggagctcgag

SEQ ID NO: 110522 - DNA, 25 bp, Homo sapien
agctcgaggcgttcagggaggccaa

SEQ ID NO: 110523 - DNA, 25 bp, Homo sapien
ccagagatggccagcaatcggaagt

SEQ ID NO: 110524 - DNA, 25 bp, Homo sapien
ggccagcaatcggaagtgagcaaaa

SEQ ID NO: 110525 - DNA, 25 bp, Homo sapien
gtgagcaaaactgccgcaagtctgc

SEQ ID NO: 110526 - DNA, 25 bp, Homo sapien
gcaaaactgccgcaagtctgcagcc

SEQ ID NO: 110527 - DNA, 25 bp, Homo sapien
tttggtgagcacctatttcggttcg

SEQ ID NO: 110528 - DNA, 25 bp, Homo sapien
gcacctatttcggttcgagaaactt

SEQ ID NO: 110529 - DNA, 25 bp, Homo sapien
agaaacttcatttatctcctataat

SEQ ID NO: 110530 - DNA, 25 bp, Homo sapien
ttatctcctataattggcaaactta

SEQ ID NO: 110531 - DNA, 25 bp, Homo sapien
gcagaaacttacattccaaccttag

SEQ ID NO: 110532 - DNA, 25 bp, Homo sapien
caaccttagagactcatagtgagca

SEQ ID NO: 110533 - DNA, 25 bp, Homo sapien
gagcacaaggaaagttttgccctga

SEQ ID NO: 110534 - DNA, 25 bp, Homo sapien
gttttgccctgagattcatggttat

SEQ ID NO: 110535 - DNA, 25 bp, Homo sapien
catggttatggctgggtaccaccaa

SEQ ID NO: 110536 - DNA, 25 bp, Homo sapien
tggctgggtaccaccaaatagaaga

SEQ ID NO: 110537 - DNA, 25 bp, Homo sapien
gagatgtgtttctttgttgaacttt

SEQ ID NO: 110538 - DNA, 25 bp, Homo sapien
ggagactctggctcagcgttgtttc

SEQ ID NO: 110539 - DNA, 25 bp, Homo sapien
tctgcctcatctctgtacgaatttg

SEQ ID NO: 110540 - DNA, 25 bp, Homo sapien
tacgaatttgggtcccagccttgtt

SEQ ID NO: 110541 - DNA, 25 bp, Homo sapien
cagccttgttgggttgtcagccatg

SEQ ID NO: 110542 - DNA, 25 bp, Homo sapien
acatggatttcaacccctggagaaa

SEQ ID NO: 110543 - DNA, 25 bp, Homo sapien
aaaacgatgtacttgttcagcagtc

SEQ ID NO: 110544 - DNA, 25 bp, Homo sapien
ttgttcagcagtcgagagcccaggc

SEQ ID NO: 110545 - DNA, 25 bp, Homo sapien
gcctgctgcgggttctctaagggaa

SEQ ID NO: 110546 - DNA, 25 bp, Homo sapien
gagactcaatgaagtcggatctcga

SEQ ID NO: 110547 - DNA, 25 bp, Homo sapien
tacttgacagcgttgggagggaact

SEQ ID NO: 110548 - DNA, 25 bp, Homo sapien
gaactgctgatgagccctgtggtgt

SEQ ID NO: 110549 - DNA, 25 bp, Homo sapien
gaagacccactgaggaattccgtag

SEQ ID NO: 110550 - DNA, 25 bp, Homo sapien
gaattccgtaggtcttgttccacga

SEQ ID NO: 110551 - DNA, 25 bp, Homo sapien
gtaggtcttgttccacgaccggagt

SEQ ID NO: 110552 - DNA, 25 bp, Homo sapien
acgaccggagtgctggctctcacag

SEQ ID NO: 110553 - DNA, 25 bp, Homo sapien
gctctcacagtgaattttgatgcat

SEQ ID NO: 110554 - DNA, 25 bp, Homo sapien
taagattctgatgccagactgttaa

SEQ ID NO: 110555 - DNA, 25 bp, Homo sapien
aaacaggcgctggttctgaagcacc

SEQ ID NO: 110556 - DNA, 25 bp, Homo sapien
gcgctggttctgaagcaccatggaa

SEQ ID NO: 110557 - DNA, 25 bp, Homo sapien
gcaccatggaaacagattgatgcag

SEQ ID NO: 110558 - DNA, 25 bp, Homo sapien
gaagggagactgggcccactgattt

SEQ ID NO: 110559 - DNA, 25 bp, Homo sapien
cccaccatgtgtgctgttttcagat

SEQ ID NO: 110560 - DNA, 25 bp, Homo sapien
ttgagccaccgggtgaccggcttac

SEQ ID NO: 110561 - DNA, 25 bp, Homo sapien
cgggtgaccggcttacagggatatt

SEQ ID NO: 110562 - DNA, 25 bp, Homo sapien
tgaccggcttacagggatattttta

SEQ ID NO: 110563 - DNA, 25 bp, Homo sapien
gatatttttaatcccgttatggact

SEQ ID NO: 110564 - DNA, 25 bp, Homo sapien
ttaatcccgttatggactctgtctc

SEQ ID NO: 110565 - DNA, 25 bp, Homo sapien
tcccgttatggactctgtctccagg

SEQ ID NO: 110566 - DNA, 25 bp, Homo sapien
tatccacccctgctcattggtggat

SEQ ID NO: 110567 - DNA, 25 bp, Homo sapien
gcctgctagggaaaaactactcctc

SEQ ID NO: 110568 - DNA, 25 bp, Homo sapien
gggaaaaactactcctcattatcat

SEQ ID NO: 110569 - DNA, 25 bp, Homo sapien
tgtatcccctctacctggcatgtgc

SEQ ID NO: 110570 - DNA, 25 bp, Homo sapien
tacctggcatgtgcttgtcaagttc

SEQ ID NO: 110571 - DNA, 25 bp, Homo sapien
aaaacttttcaccagcctttgagag

SEQ ID NO: 110572 - DNA, 25 bp, Homo sapien
aaacttttcaccagcctttgagaga

SEQ ID NO: 110573 - DNA, 25 bp, Homo sapien
aacttttcaccagcctttgagagac

SEQ ID NO: 110574 - DNA, 25 bp, Homo sapien
acttttcaccagcctttgagagact

SEQ ID NO: 110575 - DNA, 25 bp, Homo sapien
cttttcaccagcctttgagagacta

SEQ ID NO: 110576 - DNA, 25 bp, Homo sapien
ttttcaccagcctttgagagactag

SEQ ID NO: 110577 - DNA, 25 bp, Homo sapien
tttcaccagcctttgagagactaga

SEQ ID NO: 110578 - DNA, 25 bp, Homo sapien
cccatcctttgtccctgctgtcccc

SEQ ID NO: 110579 - DNA, 25 bp, Homo sapien
ccatcctttgtccctgctgtccccc

SEQ ID NO: 110580 - DNA, 25 bp, Homo sapien
catcctttgtccctgctgtccccca

SEQ ID NO: 110581 - DNA, 25 bp, Homo sapien
atcctttgtccctgctgtcccccac

SEQ ID NO: 110582 - DNA, 25 bp, Homo sapien
tacctggcagggatcagccctacag

SEQ ID NO: 110583 - DNA, 25 bp, Homo sapien
gcagtgggtggcactcccagtgact

SEQ ID NO: 110584 - DNA, 25 bp, Homo sapien
gtggcactcccagtgactgtcggta

SEQ ID NO: 110585 - DNA, 25 bp, Homo sapien
agtgactgtcggtacatactcaccc

SEQ ID NO: 110586 - DNA, 25 bp, Homo sapien
cagccagagagtcccctcaatgaga

SEQ ID NO: 110587 - DNA, 25 bp, Homo sapien
gagagtcccctcaatgagacacaga

SEQ ID NO: 110588 - DNA, 25 bp, Homo sapien
cacacagtagctgttagcccacagg

SEQ ID NO: 110589 - DNA, 25 bp, Homo sapien
cagtagctgttagcccacaggcaga

SEQ ID NO: 110590 - DNA, 25 bp, Homo sapien
ccatttggccggctctggtggccac

SEQ ID NO: 110591 - DNA, 25 bp, Homo sapien
actgagctggctgactaagccccgt

SEQ ID NO: 110592 - DNA, 25 bp, Homo sapien
agctggctgactaagccccgtctga

SEQ ID NO: 110593 - DNA, 25 bp, Homo sapien
ataagaagtagtggctggagactct

SEQ ID NO: 110594 - DNA, 25 bp, Homo sapien
tctgcctcatctctgtacgaatttg

SEQ ID NO: 110595 - DNA, 25 bp, Homo sapien
catctctgtacgaatttgggtccca

SEQ ID NO: 110596 - DNA, 25 bp, Homo sapien
tctgtacgaatttgggtcccagcct

SEQ ID NO: 110597 - DNA, 25 bp, Homo sapien
acgaatttgggtcccagccttgttg

SEQ ID NO: 110598 - DNA, 25 bp, Homo sapien
gggtcccagccttgttgggttgtca

SEQ ID NO: 110599 - DNA, 25 bp, Homo sapien
cagccttgttgggttgtcagccatg

SEQ ID NO: 110600 - DNA, 25 bp, Homo sapien
tgttgggttgtcagccatggacatg

SEQ ID NO: 110601 - DNA, 25 bp, Homo sapien
gttgtcagccatggacatggatttc

SEQ ID NO: 110602 - DNA, 25 bp, Homo sapien
acatggatttcaacccctggagaaa

SEQ ID NO: 110603 - DNA, 25 bp, Homo sapien
gatttcaacccctggagaaaacgat

SEQ ID NO: 110604 - DNA, 25 bp, Homo sapien
ggtgagcagcgtcaacactgtggcc

SEQ ID NO: 110605 - DNA, 25 bp, Homo sapien
gaggcggagaacatcgcggtcacct

SEQ ID NO: 110606 - DNA, 25 bp, Homo sapien
ggtgcgcaaggaggacttgaggcca

SEQ ID NO: 110607 - DNA, 25 bp, Homo sapien
catctgccccccaacaggagggtga

SEQ ID NO: 110608 - DNA, 25 bp, Homo sapien
ggctacaggccagcgtggatgacct

SEQ ID NO: 110609 - DNA, 25 bp, Homo sapien
gtggatgacctgaagagcgctcctc

SEQ ID NO: 110610 - DNA, 25 bp, Homo sapien
ctgaagagcgctcctctgccttgga

SEQ ID NO: 110611 - DNA, 25 bp, Homo sapien
cctagcacaaggagtgcccgccttg

SEQ ID NO: 110612 - DNA, 25 bp, Homo sapien
ggagtgcccgccttgagtgacatgc

SEQ ID NO: 110613 - DNA, 25 bp, Homo sapien
gccttgagtgacatgcgggtgccca

SEQ ID NO: 110614 - DNA, 25 bp, Homo sapien
gtgacatgcgggtgcccacgctcct

SEQ ID NO: 110615 - DNA, 25 bp, Homo sapien
aaggtacttttggagctggccttct

SEQ ID NO: 110616 - DNA, 25 bp, Homo sapien
acttttggagctggccttctcaagg

SEQ ID NO: 110617 - DNA, 25 bp, Homo sapien
gcccagctccctgtgattgagaata

SEQ ID NO: 110618 - DNA, 25 bp, Homo sapien
cagctccctgtgattgagaataaag

SEQ ID NO: 110619 - DNA, 25 bp, Homo sapien
gagaataaagtgtgcaatcgctatg

SEQ ID NO: 110620 - DNA, 25 bp, Homo sapien
gtgtgcaatcgctatgagtttctga

SEQ ID NO: 110621 - DNA, 25 bp, Homo sapien
gtgcaatcgctatgagtttctgaat

SEQ ID NO: 110622 - DNA, 25 bp, Homo sapien
aatcgctatgagtttctgaatggaa

SEQ ID NO: 110623 - DNA, 25 bp, Homo sapien
gaatggaagagtccaatccaccgaa

SEQ ID NO: 110624 - DNA, 25 bp, Homo sapien
gaagagtccaatccaccgaactctg

SEQ ID NO: 110625 - DNA, 25 bp, Homo sapien
actctgtgctgggcatttggccgga

SEQ ID NO: 110626 - DNA, 25 bp, Homo sapien
tggagtggccactggcacttgcctg

SEQ ID NO: 110627 - DNA, 25 bp, Homo sapien
ggccactggcacttgcctgctgctt

SEQ ID NO: 110628 - DNA, 25 bp, Homo sapien
tctctcctggagtctgaagcctgca

SEQ ID NO: 110629 - DNA, 25 bp, Homo sapien
ctggagtctgaagcctgcaggtccg

SEQ ID NO: 110630 - DNA, 25 bp, Homo sapien
ttcgggattccctggtgggcctcga

SEQ ID NO: 110631 - DNA, 25 bp, Homo sapien
tggtgggcctcgacgtcccttggat

SEQ ID NO: 110632 - DNA, 25 bp, Homo sapien
tcgacgtcccttggatcagaggtca

SEQ ID NO: 110633 - DNA, 25 bp, Homo sapien
gacgtcccttggatcagaggtcatc

SEQ ID NO: 110634 - DNA, 25 bp, Homo sapien
gtcccttggatcagaggtcatccct

SEQ ID NO: 110635 - DNA, 25 bp, Homo sapien
cttggatcagaggtcatcccttcct

SEQ ID NO: 110636 - DNA, 25 bp, Homo sapien
acagggagaagttgagcaggtatca

SEQ ID NO: 110637 - DNA, 25 bp, Homo sapien
ggctccgactacgacgaggccgatg

SEQ ID NO: 110638 - DNA, 25 bp, Homo sapien
ctccgactacgacgaggccgatggc

SEQ ID NO: 110639 - DNA, 25 bp, Homo sapien
gtacgacacgcgtcctcgggcgcca

SEQ ID NO: 110640 - DNA, 25 bp, Homo sapien
caacggctactacccggcgcacgga

SEQ ID NO: 110641 - DNA, 25 bp, Homo sapien
tccaggaagggcctgcacgaaccct

SEQ ID NO: 110642 - DNA, 25 bp, Homo sapien
ggaagggcctgcacgaaccctacag

SEQ ID NO: 110643 - DNA, 25 bp, Homo sapien
tgcacgaaccctacagcgagagtga

SEQ ID NO: 110644 - DNA, 25 bp, Homo sapien
gaaccctacagcgagagtgacgatg

SEQ ID NO: 110645 - DNA, 25 bp, Homo sapien
ccctacagcgagagtgacgatgatt

SEQ ID NO: 110646 - DNA, 25 bp, Homo sapien
gtgacgatgattggtgctaagcccg

SEQ ID NO: 110647 - DNA, 25 bp, Homo sapien
acgatgattggtgctaagcccgggc

SEQ ID NO: 110648 - DNA, 25 bp, Homo sapien
tggctgggtttcttagtcgttggtt

SEQ ID NO: 110649 - DNA, 25 bp, Homo sapien
ggtggttcacagttctaatgtaagc

SEQ ID NO: 110650 - DNA, 25 bp, Homo sapien
taatgtaagcactctattctccaag

SEQ ID NO: 110651 - DNA, 25 bp, Homo sapien
actctattctccaagttgtgctttg

SEQ ID NO: 110652 - DNA, 25 bp, Homo sapien
gggacaatcattctttgaacattag

SEQ ID NO: 110653 - DNA, 25 bp, Homo sapien
ggaaggcagttcaagctgttgaaaa

SEQ ID NO: 110654 - DNA, 25 bp, Homo sapien
ttttaaagacctacctgacgtcatg

SEQ ID NO: 110655 - DNA, 25 bp, Homo sapien
gacctacctgacgtcatgtggacag

SEQ ID NO: 110656 - DNA, 25 bp, Homo sapien
acgtcatgtggacagtgcacgtgcc

SEQ ID NO: 110657 - DNA, 25 bp, Homo sapien
acgtgccttacgctacatcttgttt

SEQ ID NO: 110658 - DNA, 25 bp, Homo sapien
acgctacatcttgttttctaggaag

SEQ ID NO: 110659 - DNA, 25 bp, Homo sapien
aagcagggtcgctgctgcttctagg

SEQ ID NO: 110660 - DNA, 25 bp, Homo sapien
gagcggcaccccagttatgttggca

SEQ ID NO: 110661 - DNA, 25 bp, Homo sapien
accccagttatgttggcaggtccct

SEQ ID NO: 110662 - DNA, 25 bp, Homo sapien
ttggcaggtccctgcccctgctaat

SEQ ID NO: 110663 - DNA, 25 bp, Homo sapien
tgctaatgcctctgctttgcctctt

SEQ ID NO: 110664 - DNA, 25 bp, Homo sapien
tgctttgcctcttgcagaagcacaa

SEQ ID NO: 110665 - DNA, 25 bp, Homo sapien
gttgagctccggctgagtccagccc

SEQ ID NO: 110666 - DNA, 25 bp, Homo sapien
gagtccagccctcatgagcaacaac

SEQ ID NO: 110667 - DNA, 25 bp, Homo sapien
tgagcaacaaccctttggccactat

SEQ ID NO: 110668 - DNA, 25 bp, Homo sapien
tggccactatccaaggtgcgtgctg

SEQ ID NO: 110669 - DNA, 25 bp, Homo sapien
atccaaggtgcgtgctgcctcatgt

SEQ ID NO: 110670 - DNA, 25 bp, Homo sapien
aatgccctactcttatttacactga

SEQ ID NO: 110671 - DNA, 25 bp, Homo sapien
tgccctactcttatttacactgatg

SEQ ID NO: 110672 - DNA, 25 bp, Homo sapien
gccctactcttatttacactgatgg

SEQ ID NO: 110673 - DNA, 25 bp, Homo sapien
atctcttcgtgctatccccacacca

SEQ ID NO: 110674 - DNA, 25 bp, Homo sapien
accaccactcttaagtctctcttag

SEQ ID NO: 110675 - DNA, 25 bp, Homo sapien
caccactcttaagtctctcttagag

SEQ ID NO: 110676 - DNA, 25 bp, Homo sapien
accactcttaagtctctcttagagt

SEQ ID NO: 110677 - DNA, 25 bp, Homo sapien
tactggcagggcatcctcctatact

SEQ ID NO: 110678 - DNA, 25 bp, Homo sapien
actggcagggcatcctcctatactt

SEQ ID NO: 110679 - DNA, 25 bp, Homo sapien
gcagggcatcctcctatacttccat

SEQ ID NO: 110680 - DNA, 25 bp, Homo sapien
gttcccaatcttatgccaccctcta

SEQ ID NO: 110681 - DNA, 25 bp, Homo sapien
actgtgtaacattgctgggcttcct

SEQ ID NO: 110682 - DNA, 25 bp, Homo sapien
acattgctgggcttcctaggcagaa

SEQ ID NO: 110683 - DNA, 25 bp, Homo sapien
gggcttcctaggcagaaattcatat

SEQ ID NO: 110684 - DNA, 25 bp, Homo sapien
aattcatataaactgtgatactcac

SEQ ID NO: 110685 - DNA, 25 bp, Homo sapien
gtgatactcacattccttgaagcta

SEQ ID NO: 110686 - DNA, 25 bp, Homo sapien
tcacattccttgaagctatgagcat

SEQ ID NO: 110687 - DNA, 25 bp, Homo sapien
agctatgagcatttaaaaactgttt

SEQ ID NO: 110688 - DNA, 25 bp, Homo sapien
aaaactgtttacagccaccataggg

SEQ ID NO: 110689 - DNA, 25 bp, Homo sapien
tttttatccccaaattgttgctatt

SEQ ID NO: 110690 - DNA, 25 bp, Homo sapien
gttgctattttttaggatctgaaac

SEQ ID NO: 110691 - DNA, 25 bp, Homo sapien
gttgtcaaagcaccaacaggacatt

SEQ ID NO: 110692 - DNA, 25 bp, Homo sapien
agaacagtcgagcagtgaggacact

SEQ ID NO: 110693 - DNA, 25 bp, Homo sapien
gtgaggacactgatgctgcatttga

SEQ ID NO: 110694 - DNA, 25 bp, Homo sapien
gaactcacagttattacctcaggaa

SEQ ID NO: 110695 - DNA, 25 bp, Homo sapien
gcctcctggaggtttttagaaatgt

SEQ ID NO: 110696 - DNA, 25 bp, Homo sapien
gagaacttaactcttgactgccaag

SEQ ID NO: 110697 - DNA, 25 bp, Homo sapien
ctgccaaggtttccaagtgagtgat

SEQ ID NO: 110698 - DNA, 25 bp, Homo sapien
ggtttccaagtgagtgatgccagcc

SEQ ID NO: 110699 - DNA, 25 bp, Homo sapien
gtgatgccagccagcattatttatt

SEQ ID NO: 110700 - DNA, 25 bp, Homo sapien
ttatttccaagatttcctctgttgg

SEQ ID NO: 110701 - DNA, 25 bp, Homo sapien
agatttcctctgttggatcatttga

SEQ ID NO: 110702 - DNA, 25 bp, Homo sapien
atttgaacccacttgttaattgcaa

SEQ ID NO: 110703 - DNA, 25 bp, Homo sapien
gccaacaatgggtctgttctccaag

SEQ ID NO: 110704 - DNA, 25 bp, Homo sapien
ctcagtgtatgatgggaagctgctc

SEQ ID NO: 110705 - DNA, 25 bp, Homo sapien
acttgagctggatacactggtggat

SEQ ID NO: 110706 - DNA, 25 bp, Homo sapien
atttatctattgatccttcctcggg

SEQ ID NO: 110707 - DNA, 25 bp, Homo sapien
atcctaatggccagaagctcttcgt

SEQ ID NO: 110708 - DNA, 25 bp, Homo sapien
gaagctcttcgtgtatgacccgaac

SEQ ID NO: 110709 - DNA, 25 bp, Homo sapien
gaacaatcctccctcgtcagaggtt

SEQ ID NO: 110710 - DNA, 25 bp, Homo sapien
tcgtcagaggttctccgcatccaga

SEQ ID NO: 110711 - DNA, 25 bp, Homo sapien
ctccgcatccagaacattctatctg

SEQ ID NO: 110712 - DNA, 25 bp, Homo sapien
attctatctgagaagcctacagtga

SEQ ID NO: 110713 - DNA, 25 bp, Homo sapien
cagtgactacagtttatgccaacaa

SEQ ID NO: 110714 - DNA, 25 bp, Homo sapien
atgattaaatcgtttcattttctaa

SEQ ID NO: 110715 - DNA, 25 bp, Homo sapien
acttcaggatgataacaccctatgc

SEQ ID NO: 110716 - DNA, 25 bp, Homo sapien
aggatgataacaccctatgcccatt

SEQ ID NO: 110717 - DNA, 25 bp, Homo sapien
atgataacaccctatgcccattgtc

SEQ ID NO: 110718 - DNA, 25 bp, Homo sapien
ccctatgcccattgtcctgatctga

SEQ ID NO: 110719 - DNA, 25 bp, Homo sapien
tgtcctgatctgaaaattcttggaa

SEQ ID NO: 110720 - DNA, 25 bp, Homo sapien
tctgaaaattcttggaaattgttcc

SEQ ID NO: 110721 - DNA, 25 bp, Homo sapien
ggaaattgttccatgtgattaacat

SEQ ID NO: 110722 - DNA, 25 bp, Homo sapien
gtgattaacatggaactgcctctac

SEQ ID NO: 110723 - DNA, 25 bp, Homo sapien
attaacatggaactgcctctactta

SEQ ID NO: 110724 - DNA, 25 bp, Homo sapien
acatggaactgcctctacttaatca

SEQ ID NO: 110725 - DNA, 25 bp, Homo sapien
ctgttgaggaggacttgggttcagg

SEQ ID NO: 110726 - DNA, 25 bp, Homo sapien
gggcggctgtaggaaggaactggtt

SEQ ID NO: 110727 - DNA, 25 bp, Homo sapien
gggaccagaggctctgcactgctcc

SEQ ID NO: 110728 - DNA, 25 bp, Homo sapien
cagaggctctgcactgctcctagga

SEQ ID NO: 110729 - DNA, 25 bp, Homo sapien
agaggctctgcactgctcctaggac

SEQ ID NO: 110730 - DNA, 25 bp, Homo sapien
aggctctgcactgctcctaggacag

SEQ ID NO: 110731 - DNA, 25 bp, Homo sapien
tctgcactgctcctaggacagctca

SEQ ID NO: 110732 - DNA, 25 bp, Homo sapien
tgcactgctcctaggacagctcatc

SEQ ID NO: 110733 - DNA, 25 bp, Homo sapien
actgctcctaggacagctcatctgt

SEQ ID NO: 110734 - DNA, 25 bp, Homo sapien
tgctcctaggacagctcatctgtaa

SEQ ID NO: 110735 - DNA, 25 bp, Homo sapien
gctcctaggacagctcatctgtaat

SEQ ID NO: 110736 - DNA, 25 bp, Homo sapien
ttccgtagctctctctatgaaggtt

SEQ ID NO: 110737 - DNA, 25 bp, Homo sapien
gaaaagcctgaatctcgaacctcca

SEQ ID NO: 110738 - DNA, 25 bp, Homo sapien
gaacctccatccataacttcatggc

SEQ ID NO: 110739 - DNA, 25 bp, Homo sapien
ttcatggctcatcctgaattccgga

SEQ ID NO: 110740 - DNA, 25 bp, Homo sapien
aattccggatcgaagattcccagcc

SEQ ID NO: 110741 - DNA, 25 bp, Homo sapien
cctcattgatgacaccgacctggaa

SEQ ID NO: 110742 - DNA, 25 bp, Homo sapien
ctggaagaagatgccgcgctcaagc

SEQ ID NO: 110743 - DNA, 25 bp, Homo sapien
aagcagaactcgagcccgccgtcat

SEQ ID NO: 110744 - DNA, 25 bp, Homo sapien
tgggatcaacctgacgaccgacaca

SEQ ID NO: 110745 - DNA, 25 bp, Homo sapien
gacgaccgacacaagcaaatcagct

SEQ ID NO: 110746 - DNA, 25 bp, Homo sapien
caagcaaatcagctacctcttcaag

SEQ ID NO: 110747 - DNA, 25 bp, Homo sapien
tcccactggggcatcggtctaaagc

SEQ ID NO: 110748 - DNA, 25 bp, Homo sapien
cccactggggcatcggtctaaagct

SEQ ID NO: 110749 - DNA, 25 bp, Homo sapien
ccactggggcatcggtctaaagctt

SEQ ID NO: 110750 - DNA, 25 bp, Homo sapien
actggggcatcggtctaaagctttg

SEQ ID NO: 110751 - DNA, 25 bp, Homo sapien
ctggggcatcggtctaaagctttgg

SEQ ID NO: 110752 - DNA, 25 bp, Homo sapien
tggggcatcggtctaaagctttggg

SEQ ID NO: 110753 - DNA, 25 bp, Homo sapien
gggcatcggtctaaagctttggggg

SEQ ID NO: 110754 - DNA, 25 bp, Homo sapien
ggcatcggtctaaagctttggggga

SEQ ID NO: 110755 - DNA, 25 bp, Homo sapien
catcggtctaaagctttgggggagt

SEQ ID NO: 110756 - DNA, 25 bp, Homo sapien
atcggtctaaagctttgggggagtg

SEQ ID NO: 110757 - DNA, 25 bp, Homo sapien
tcggtctaaagctttgggggagtgg

SEQ ID NO: 110758 - DNA, 25 bp, Homo sapien
agaacgatgatcgtcacctctgtgc

SEQ ID NO: 110759 - DNA, 25 bp, Homo sapien
ctgagttctccctgttgtctcaaag

SEQ ID NO: 110760 - DNA, 25 bp, Homo sapien
tgttgtctcaaagcggtacccatcc

SEQ ID NO: 110761 - DNA, 25 bp, Homo sapien
aatccacgctgtcttctgttgcagg

SEQ ID NO: 110762 - DNA, 25 bp, Homo sapien
ttctgttgcaggactaacctttgag

SEQ ID NO: 110763 - DNA, 25 bp, Homo sapien
tgtgaagtcattgcctgctcaagaa

SEQ ID NO: 110764 - DNA, 25 bp, Homo sapien
tccccaatgccttggagccataagg

SEQ ID NO: 110765 - DNA, 25 bp, Homo sapien
aggccagccagttctagctctctat

SEQ ID NO: 110766 - DNA, 25 bp, Homo sapien
tcaactgactcatacctgtttccgg

SEQ ID NO: 110767 - DNA, 25 bp, Homo sapien
tgtttccggctgcatcactatgtgc

SEQ ID NO: 110768 - DNA, 25 bp, Homo sapien
atgtgccccacagagaacgatgatc

SEQ ID NO: 110769 - DNA, 25 bp, Homo sapien
tggatgggctttttctcctccgtga

SEQ ID NO: 110770 - DNA, 25 bp, Homo sapien
tccgtgacagccagagtaatccaaa

SEQ ID NO: 110771 - DNA, 25 bp, Homo sapien
actcacactgtgtcatcaccagaaa

SEQ ID NO: 110772 - DNA, 25 bp, Homo sapien
ttccagatcttaccttgcgaggacg

SEQ ID NO: 110773 - DNA, 25 bp, Homo sapien
aggacgacgggcagacgttcttcag

SEQ ID NO: 110774 - DNA, 25 bp, Homo sapien
ggaacaccaaattctctgacctgat

SEQ ID NO: 110775 - DNA, 25 bp, Homo sapien
gacctgatccagctggttgactttt

SEQ ID NO: 110776 - DNA, 25 bp, Homo sapien
ggttgacttttaccagctgaacaaa

SEQ ID NO: 110777 - DNA, 25 bp, Homo sapien
aaggagtcctgccttgcaaactcaa

SEQ ID NO: 110778 - DNA, 25 bp, Homo sapien
actgcatccgagtggccttatgacc

SEQ ID NO: 110779 - DNA, 25 bp, Homo sapien
atgtcctctcggctgaagactggag

SEQ ID NO: 110780 - DNA, 25 bp, Homo sapien
taattacagggctcgtccaactggt

SEQ ID NO: 110781 - DNA, 25 bp, Homo sapien
gtcacacatgccagagattgctcag

SEQ ID NO: 110782 - DNA, 25 bp, Homo sapien
aaaatgaattccatgttcttgaagg

SEQ ID NO: 110783 - DNA, 25 bp, Homo sapien
ggaaagactgtaactatgtacattc

SEQ ID NO: 110784 - DNA, 25 bp, Homo sapien
gtacattcatgatgttcctttggtg

SEQ ID NO: 110785 - DNA, 25 bp, Homo sapien
catgatgttcctttggtgtgtggtt

SEQ ID NO: 110786 - DNA, 25 bp, Homo sapien
gtgtggtttctgtgagtaacaggta

SEQ ID NO: 110787 - DNA, 25 bp, Homo sapien
acaggtagatgtcatttctggaaat

SEQ ID NO: 110788 - DNA, 25 bp, Homo sapien
ggtatgtttatgtctatacattgtt

SEQ ID NO: 110789 - DNA, 25 bp, Homo sapien
gggtttacttgctttgtatcacata

SEQ ID NO: 110790 - DNA, 25 bp, Homo sapien
gctttgtatcacatagcaataacat

SEQ ID NO: 110791 - DNA, 25 bp, Homo sapien
aagccctgaggctgtacgcccggcg

SEQ ID NO: 110792 - DNA, 25 bp, Homo sapien
gccctacatgttcccaaggatgcta

SEQ ID NO: 110793 - DNA, 25 bp, Homo sapien
gctaatgaaaatcaccgacctccgg

SEQ ID NO: 110794 - DNA, 25 bp, Homo sapien
ctgaaagggccattactctgaagat

SEQ ID NO: 110795 - DNA, 25 bp, Homo sapien
gatggagattccaggcccgatgcct

SEQ ID NO: 110796 - DNA, 25 bp, Homo sapien
gatgcctcccttaatccgagagatg

SEQ ID NO: 110797 - DNA, 25 bp, Homo sapien
tcccttaatccgagagatgctggag

SEQ ID NO: 110798 - DNA, 25 bp, Homo sapien
gctggagaaccctgaaatgtttgag

SEQ ID NO: 110799 - DNA, 25 bp, Homo sapien
tgtttgaggatgactcctcgcagcc

SEQ ID NO: 110800 - DNA, 25 bp, Homo sapien
accccaatgcctctagcgaggatga

SEQ ID NO: 110801 - DNA, 25 bp, Homo sapien
gcctctagcgaggatgaggttcctg

SEQ ID NO: 110802 - DNA, 25 bp, Homo sapien
ggatcatctgcgacaacacaggcat

SEQ ID NO: 110803 - DNA, 25 bp, Homo sapien
atcaccaccgtgtctaagaacaaca

SEQ ID NO: 110804 - DNA, 25 bp, Homo sapien
aacatcttcatgtccaactcatatc

SEQ ID NO: 110805 - DNA, 25 bp, Homo sapien
atatccccgggactttgtcaactgc

SEQ ID NO: 110806 - DNA, 25 bp, Homo sapien
tttgtcaactgcagtacacttcctg

SEQ ID NO: 110807 - DNA, 25 bp, Homo sapien
agtacacttcctgcattgaacctgg

SEQ ID NO: 110808 - DNA, 25 bp, Homo sapien
gcttcctggagggaagcctcctaga

SEQ ID NO: 110809 - DNA, 25 bp, Homo sapien
tatatctgggctggccagttggaac

SEQ ID NO: 110810 - DNA, 25 bp, Homo sapien
cagttggaaccacggagatctcctt

SEQ ID NO: 110811 - DNA, 25 bp, Homo sapien
ggagatctccttgccctagatgagc

SEQ ID NO: 110812 - DNA, 25 bp, Homo sapien
gactagacgttcatttgtgtgctca

SEQ ID NO: 110813 - DNA, 25 bp, Homo sapien
ggacatgatgatccaggttggccct

SEQ ID NO: 110814 - DNA, 25 bp, Homo sapien
gacatgatgatccaggttggccctg

SEQ ID NO: 110815 - DNA, 25 bp, Homo sapien
acatgatgatccaggttggccctga

SEQ ID NO: 110816 - DNA, 25 bp, Homo sapien
atgatgatccaggttggccctgaaa

SEQ ID NO: 110817 - DNA, 25 bp, Homo sapien
tgatgatccaggttggccctgaaac

SEQ ID NO: 110818 - DNA, 25 bp, Homo sapien
gatgatccaggttggccctgaaaca

SEQ ID NO: 110819 - DNA, 25 bp, Homo sapien
tccaggttggccctgaaacaggaat

SEQ ID NO: 110820 - DNA, 25 bp, Homo sapien
caggttggccctgaaacaggaatgg

SEQ ID NO: 110821 - DNA, 25 bp, Homo sapien
aaggagagccaggagcatttaaaaa

SEQ ID NO: 110822 - DNA, 25 bp, Homo sapien
gagagccaggagcatttaaaaatca

SEQ ID NO: 110823 - DNA, 25 bp, Homo sapien
aaatcagcatctgggccaggcaaga

SEQ ID NO: 110824 - DNA, 25 bp, Homo sapien
gctccaaatctggtaacctcagaca

SEQ ID NO: 110825 - DNA, 25 bp, Homo sapien
ctccaaatctggtaacctcagacac

SEQ ID NO: 110826 - DNA, 25 bp, Homo sapien
caaatctggtaacctcagacacctg

SEQ ID NO: 110827 - DNA, 25 bp, Homo sapien
aaatctggtaacctcagacacctgc

SEQ ID NO: 110828 - DNA, 25 bp, Homo sapien
tctggtaacctcagacacctgcaca

SEQ ID NO: 110829 - DNA, 25 bp, Homo sapien
ctggtaacctcagacacctgcacat

SEQ ID NO: 110830 - DNA, 25 bp, Homo sapien
tggtaacctcagacacctgcacatt

SEQ ID NO: 110831 - DNA, 25 bp, Homo sapien
ggtaacctcagacacctgcacattc

SEQ ID NO: 110832 - DNA, 25 bp, Homo sapien
gtaacctcagacacctgcacattct

SEQ ID NO: 110833 - DNA, 25 bp, Homo sapien
taacctcagacacctgcacattctg

SEQ ID NO: 110834 - DNA, 25 bp, Homo sapien
acctcagacacctgcacattctgat

SEQ ID NO: 110835 - DNA, 25 bp, Homo sapien
ggaggactgtgtgatctccatcctg

SEQ ID NO: 110836 - DNA, 25 bp, Homo sapien
gagagaggagctacagattccgttc

SEQ ID NO: 110837 - DNA, 25 bp, Homo sapien
acagattccgttcagtgtggcctga

SEQ ID NO: 110838 - DNA, 25 bp, Homo sapien
tgtggcctgaaaacaccatgtgtgc

SEQ ID NO: 110839 - DNA, 25 bp, Homo sapien
accatgtgtgccaagttccagttca

SEQ ID NO: 110840 - DNA, 25 bp, Homo sapien
tccagttcacgccaacacatgtggg

SEQ ID NO: 110841 - DNA, 25 bp, Homo sapien
ggctccagagactcactgtggaagt

SEQ ID NO: 110842 - DNA, 25 bp, Homo sapien
ggactgcaacatgttccagaaccta

SEQ ID NO: 110843 - DNA, 25 bp, Homo sapien
tataaaagcgtcaccgtggtagccc

SEQ ID NO: 110844 - DNA, 25 bp, Homo sapien
ggtagcccctgaactatcagcttaa

SEQ ID NO: 110845 - DNA, 25 bp, Homo sapien
ttaaacttccagctctatcaccact

SEQ ID NO: 110846 - DNA, 25 bp, Homo sapien
gccaaaagctagacagatccccgtt

SEQ ID NO: 110847 - DNA, 25 bp, Homo sapien
aaaagctagacagatccccgttcct

SEQ ID NO: 110848 - DNA, 25 bp, Homo sapien
agctagacagatccccgttcctgac

SEQ ID NO: 110849 - DNA, 25 bp, Homo sapien
tccaacacaaggctccaagacctag

SEQ ID NO: 110850 - DNA, 25 bp, Homo sapien
caaggctccaagacctaggctcatg

SEQ ID NO: 110851 - DNA, 25 bp, Homo sapien
acctaggctcatggacgagatggga

SEQ ID NO: 110852 - DNA, 25 bp, Homo sapien
gagaagggataaccctacacccaga

SEQ ID NO: 110853 - DNA, 25 bp, Homo sapien
agaccccaggctggacatgctgact

SEQ ID NO: 110854 - DNA, 25 bp, Homo sapien
accccaggctggacatgctgactgt

SEQ ID NO: 110855 - DNA, 25 bp, Homo sapien
aagagccaatgttttccacccatcc

SEQ ID NO: 110856 - DNA, 25 bp, Homo sapien
ccaggaagtggccaaaagctagaca

SEQ ID NO: 110857 - DNA, 25 bp, Homo sapien
gaggctctggctaaattcatgctgc

SEQ ID NO: 110858 - DNA, 25 bp, Homo sapien
tcatgctgcttagatgacatctgtc

SEQ ID NO: 110859 - DNA, 25 bp, Homo sapien
catctgtctaggaatcatgtgccaa

SEQ ID NO: 110860 - DNA, 25 bp, Homo sapien
gttgggaggccatttgtgtttatat

SEQ ID NO: 110861 - DNA, 25 bp, Homo sapien
aaaaatgcttgcttcaaccccatga

SEQ ID NO: 110862 - DNA, 25 bp, Homo sapien
gcttcaaccccatgagactcgatag

SEQ ID NO: 110863 - DNA, 25 bp, Homo sapien
gactcgatagtggtggtgaacagaa

SEQ ID NO: 110864 - DNA, 25 bp, Homo sapien
gtcattggtggcagagtggattctt

SEQ ID NO: 110865 - DNA, 25 bp, Homo sapien
gagtggattcttgaacaaactggaa

SEQ ID NO: 110866 - DNA, 25 bp, Homo sapien
ggaaagtacgttatgatagtgtccc

SEQ ID NO: 110867 - DNA, 25 bp, Homo sapien
cacttgcacccatgtgtagtcaggt

SEQ ID NO: 110868 - DNA, 25 bp, Homo sapien
cccaaggcagtacagcagaattaat

SEQ ID NO: 110869 - DNA, 25 bp, Homo sapien
gcagaattaattacagggctcgtcc

SEQ ID NO: 110870 - DNA, 25 bp, Homo sapien
gaattaattacagggctcgtccaac

SEQ ID NO: 110871 - DNA, 25 bp, Homo sapien
taattacagggctcgtccaactggt

SEQ ID NO: 110872 - DNA, 25 bp, Homo sapien
attacagggctcgtccaactggtcc

SEQ ID NO: 110873 - DNA, 25 bp, Homo sapien
tggtccctcagtcacacatgccaga

SEQ ID NO: 110874 - DNA, 25 bp, Homo sapien
tccctcagtcacacatgccagagat

SEQ ID NO: 110875 - DNA, 25 bp, Homo sapien
tcagtcacacatgccagagattgct

SEQ ID NO: 110876 - DNA, 25 bp, Homo sapien
gtcacacatgccagagattgctcag

SEQ ID NO: 110877 - DNA, 25 bp, Homo sapien
acacatgccagagattgctcaggaa

SEQ ID NO: 110878 - DNA, 25 bp, Homo sapien
catgccagagattgctcaggaagca

SEQ ID NO: 110879 - DNA, 25 bp, Homo sapien
tctgaacctcttatgacggttttgt

SEQ ID NO: 110880 - DNA, 25 bp, Homo sapien
ctcttatgacggttttgtaaatact

SEQ ID NO: 110881 - DNA, 25 bp, Homo sapien
aatactgttcgacatagtgacggaa

SEQ ID NO: 110882 - DNA, 25 bp, Homo sapien
tcgacatagtgacggaagcaaatat

SEQ ID NO: 110883 - DNA, 25 bp, Homo sapien
gggtgtccgtgtaattgacaacgtg

SEQ ID NO: 110884 - DNA, 25 bp, Homo sapien
attgacaacgtgaaaacttacaggt

SEQ ID NO: 110885 - DNA, 25 bp, Homo sapien
tttctttctatgaatgtacaagggt

SEQ ID NO: 110886 - DNA, 25 bp, Homo sapien
gttttgttaccacaccacttacaca

SEQ ID NO: 110887 - DNA, 25 bp, Homo sapien
accacttacacactctttttgattg

SEQ ID NO: 110888 - DNA, 25 bp, Homo sapien
ttttgattgaactatcccagatggt

SEQ ID NO: 110889 - DNA, 25 bp, Homo sapien
tatcccagatggttatgttttacat

SEQ ID NO: 110890 - DNA, 25 bp, Homo sapien
catccttcagtttaaaggtacattg

SEQ ID NO: 110891 - DNA, 25 bp, Homo sapien
aaggtacattgtacagtctgtagtt

SEQ ID NO: 110892 - DNA, 25 bp, Homo sapien
acagtctgtagttaggaggtatagc

SEQ ID NO: 110893 - DNA, 25 bp, Homo sapien
aggtatagcctatagcttatgttaa

SEQ ID NO: 110894 - DNA, 25 bp, Homo sapien
acagatgttacaggattttgtgttt

SEQ ID NO: 110895 - DNA, 25 bp, Homo sapien
gcatgagtaattaattccagatctt

SEQ ID NO: 110896 - DNA, 25 bp, Homo sapien
ttaattccagatcttttgtattcac

SEQ ID NO: 110897 - DNA, 25 bp, Homo sapien
gtattcacttctgtattttatgttt

SEQ ID NO: 110898 - DNA, 25 bp, Homo sapien
gggtgcttttagttgtgtggcattt

SEQ ID NO: 110899 - DNA, 25 bp, Homo sapien
gtggcatttgtattcattgatcttt

SEQ ID NO: 110900 - DNA, 25 bp, Homo sapien
tcattgatctttcagtcatgtaagt

SEQ ID NO: 110901 - DNA, 25 bp, Homo sapien
gcaagcgcagggaggcccgttccaa

SEQ ID NO: 110902 - DNA, 25 bp, Homo sapien
caagcgcagggaggcccgttccaag

SEQ ID NO: 110903 - DNA, 25 bp, Homo sapien
agggaggcccgttccaagccagctc

SEQ ID NO: 110904 - DNA, 25 bp, Homo sapien
taccacctgtactacggcgcctcgg

SEQ ID NO: 110905 - DNA, 25 bp, Homo sapien
gctcctaccagttctccatggtggg

SEQ ID NO: 110906 - DNA, 25 bp, Homo sapien
cctaccagttctccatggtgggcgg

SEQ ID NO: 110907 - DNA, 25 bp, Homo sapien
accagttctccatggtgggcggcga

SEQ ID NO: 110908 - DNA, 25 bp, Homo sapien
agcctcccgaaccagagcgacgtgg

SEQ ID NO: 110909 - DNA, 25 bp, Homo sapien
tcccgaaccagagcgacgtggtgga

SEQ ID NO: 110910 - DNA, 25 bp, Homo sapien
cagagcgacgtggtggaggccgagg

SEQ ID NO: 110911 - DNA, 25 bp, Homo sapien
gaggccgagggcagccacagcaact

SEQ ID NO: 110912 - DNA, 25 bp, Homo sapien
tagttcctccggtagcttttcagat

SEQ ID NO: 110913 - DNA, 25 bp, Homo sapien
gtagcttttcagatgctgaccttgc

SEQ ID NO: 110914 - DNA, 25 bp, Homo sapien
ttcagatgctgaccttgcggatggc

SEQ ID NO: 110915 - DNA, 25 bp, Homo sapien
tgaccttgcggatggcgtttcaggt

SEQ ID NO: 110916 - DNA, 25 bp, Homo sapien
gccccaggcgtgatccccgggattg

SEQ ID NO: 110917 - DNA, 25 bp, Homo sapien
tggctggagccatctctagcttcat

SEQ ID NO: 110918 - DNA, 25 bp, Homo sapien
gagccatctctagcttcattgctta

SEQ ID NO: 110919 - DNA, 25 bp, Homo sapien
tctagcttcattgcttaccagaaaa

SEQ ID NO: 110920 - DNA, 25 bp, Homo sapien
ttaccagaaaaagaagctatgcttc

SEQ ID NO: 110921 - DNA, 25 bp, Homo sapien
gacatggagagccaccggaatgcca

SEQ ID NO: 110922 - DNA, 25 bp, Homo sapien
gagccaccggaatgccaacgcagag

SEQ ID NO: 110923 - DNA, 25 bp, Homo sapien
catggaaaccagacagagtctcatt

SEQ ID NO: 110924 - DNA, 25 bp, Homo sapien
gacagagtctcattaatggctgcca

SEQ ID NO: 110925 - DNA, 25 bp, Homo sapien
acagagtctcattaatggctgccac

SEQ ID NO: 110926 - DNA, 25 bp, Homo sapien
taatggctgccacaatagagacact

SEQ ID NO: 110927 - DNA, 25 bp, Homo sapien
aatggctgccacaatagagacactg

SEQ ID NO: 110928 - DNA, 25 bp, Homo sapien
atggctgccacaatagagacactga

SEQ ID NO: 110929 - DNA, 25 bp, Homo sapien
tggctgccacaatagagacactgag

SEQ ID NO: 110930 - DNA, 25 bp, Homo sapien
ggctgccacaatagagacactgaga

SEQ ID NO: 110931 - DNA, 25 bp, Homo sapien
gctgccacaatagagacactgagaa

SEQ ID NO: 110932 - DNA, 25 bp, Homo sapien
ctgccacaatagagacactgagaaa

SEQ ID NO: 110933 - DNA, 25 bp, Homo sapien
tgccacaatagagacactgagaaaa

SEQ ID NO: 110934 - DNA, 25 bp, Homo sapien
gagactggactgagactttgtgaga

SEQ ID NO: 110935 - DNA, 25 bp, Homo sapien
aagtggtggacttgctttgtgaaga

SEQ ID NO: 110936 - DNA, 25 bp, Homo sapien
gacttgctttgtgaagagacagttc

SEQ ID NO: 110937 - DNA, 25 bp, Homo sapien
ctttgtgaagagacagttcatgaac

SEQ ID NO: 110938 - DNA, 25 bp, Homo sapien
cagttcatgaacaagagtctttcag

SEQ ID NO: 110939 - DNA, 25 bp, Homo sapien
gatgtacacaatcttttgcctttat

SEQ ID NO: 110940 - DNA, 25 bp, Homo sapien
acacaatcttttgcctttatttcgt

SEQ ID NO: 110941 - DNA, 25 bp, Homo sapien
gagagaagagcatgtctttacttga

SEQ ID NO: 110942 - DNA, 25 bp, Homo sapien
agagcatgtctttacttgaaaaact

SEQ ID NO: 110943 - DNA, 25 bp, Homo sapien
tctttacttgaaaaactcttgatca

SEQ ID NO: 110944 - DNA, 25 bp, Homo sapien
cttgatcaagaatttgggtgggaga

SEQ ID NO: 110945 - DNA, 25 bp, Homo sapien
gaggaaacaacacccaagatgaatt

SEQ ID NO: 110946 - DNA, 25 bp, Homo sapien
attatttttgagactgtcaggaagt

SEQ ID NO: 110947 - DNA, 25 bp, Homo sapien
ttgcctgattgagaagcacaactga

SEQ ID NO: 110948 - DNA, 25 bp, Homo sapien
gcacaactgaaaccagtagccgctg

SEQ ID NO: 110949 - DNA, 25 bp, Homo sapien
gggtgttaatggtagcattcttctt

SEQ ID NO: 110950 - DNA, 25 bp, Homo sapien
ggtagcattcttcttttggcaatac

SEQ ID NO: 110951 - DNA, 25 bp, Homo sapien
gcattcttcttttggcaatacattt

SEQ ID NO: 110952 - DNA, 25 bp, Homo sapien
tttggcaatacatttgatttgttca

SEQ ID NO: 110953 - DNA, 25 bp, Homo sapien
gaattataactagacatctgctgtt

SEQ ID NO: 110954 - DNA, 25 bp, Homo sapien
tagacatctgctgttatcaccatag

SEQ ID NO: 110955 - DNA, 25 bp, Homo sapien
atcaccatagttttgtttaatttgc

SEQ ID NO: 110956 - DNA, 25 bp, Homo sapien
gcaagcgcagggaggcccgttccaa

SEQ ID NO: 110957 - DNA, 25 bp, Homo sapien
caagcgcagggaggcccgttccaag

SEQ ID NO: 110958 - DNA, 25 bp, Homo sapien
aagcgcagggaggcccgttccaagc

SEQ ID NO: 110959 - DNA, 25 bp, Homo sapien
cagggaggcccgttccaagccagct

SEQ ID NO: 110960 - DNA, 25 bp, Homo sapien
agggaggcccgttccaagccagctc

SEQ ID NO: 110961 - DNA, 25 bp, Homo sapien
gggaggcccgttccaagccagctcg

SEQ ID NO: 110962 - DNA, 25 bp, Homo sapien
ggaggcccgttccaagccagctcgc

SEQ ID NO: 110963 - DNA, 25 bp, Homo sapien
gttccaagccagctcgccctcctac

SEQ ID NO: 110964 - DNA, 25 bp, Homo sapien
tcctaccacctgtactacggcgcct

SEQ ID NO: 110965 - DNA, 25 bp, Homo sapien
taccacctgtactacggcgcctcgg

SEQ ID NO: 110966 - DNA, 25 bp, Homo sapien
accacctgtactacggcgcctcggc

SEQ ID NO: 110967 - DNA, 25 bp, Homo sapien
ggctgcatcgaagagcaccttctgt

SEQ ID NO: 110968 - DNA, 25 bp, Homo sapien
gctgcatcgaagagcaccttctgtc

SEQ ID NO: 110969 - DNA, 25 bp, Homo sapien
tgcatcgaagagcaccttctgtcct

SEQ ID NO: 110970 - DNA, 25 bp, Homo sapien
gcatcgaagagcaccttctgtcctg

SEQ ID NO: 110971 - DNA, 25 bp, Homo sapien
catcgaagagcaccttctgtcctgg

SEQ ID NO: 110972 - DNA, 25 bp, Homo sapien
atcgaagagcaccttctgtcctggt

SEQ ID NO: 110973 - DNA, 25 bp, Homo sapien
tcgaagagcaccttctgtcctggtc

SEQ ID NO: 110974 - DNA, 25 bp, Homo sapien
cgaagagcaccttctgtcctggtcc

SEQ ID NO: 110975 - DNA, 25 bp, Homo sapien
gaagagcaccttctgtcctggtccc

SEQ ID NO: 110976 - DNA, 25 bp, Homo sapien
aagagcaccttctgtcctggtccca

SEQ ID NO: 110977 - DNA, 25 bp, Homo sapien
agagcaccttctgtcctggtcccag

SEQ ID NO: 110978 - DNA, 25 bp, Homo sapien
gactgcagtggagcggcgaattccc

SEQ ID NO: 110979 - DNA, 25 bp, Homo sapien
tggagcggcgaattccctgtggcct

SEQ ID NO: 110980 - DNA, 25 bp, Homo sapien
agtggtcgaggctagtggagtccca

SEQ ID NO: 110981 - DNA, 25 bp, Homo sapien
ggagtcccagggaccgctggctgct

SEQ ID NO: 110982 - DNA, 25 bp, Homo sapien
tgctctgcctgagcatcagggaggg

SEQ ID NO: 110983 - DNA, 25 bp, Homo sapien
aaagaccaagctgggtttgcacatc

SEQ ID NO: 110984 - DNA, 25 bp, Homo sapien
aagctgggtttgcacatctgtctgc

SEQ ID NO: 110985 - DNA, 25 bp, Homo sapien
gtttgcacatctgtctgcaggctgt

SEQ ID NO: 110986 - DNA, 25 bp, Homo sapien
gggtatgggcaagaaatgactgtaa

SEQ ID NO: 110987 - DNA, 25 bp, Homo sapien
tatttcagccccacattatttatag

SEQ ID NO: 110988 - DNA, 25 bp, Homo sapien
tcagccccacattatttatagaaaa

SEQ ID NO: 110989 - DNA, 25 bp, Homo sapien
gatgtaaatccgtttttggctcctc

SEQ ID NO: 110990 - DNA, 25 bp, Homo sapien
tttggctcctcgctcggcagctgta

SEQ ID NO: 110991 - DNA, 25 bp, Homo sapien
ggcagctgtacctcttattaaccca

SEQ ID NO: 110992 - DNA, 25 bp, Homo sapien
tattaacccagctggacttggacct

SEQ ID NO: 110993 - DNA, 25 bp, Homo sapien
atcttcttctgaaacccatctcaga

SEQ ID NO: 110994 - DNA, 25 bp, Homo sapien
catctcagatgttttgcccacattt

SEQ ID NO: 110995 - DNA, 25 bp, Homo sapien
ttacacctttgccagcgttacctga

SEQ ID NO: 110996 - DNA, 25 bp, Homo sapien
agcgttacctgacaacagtgctggg

SEQ ID NO: 110997 - DNA, 25 bp, Homo sapien
ggttgtgctgaaagaccttttaaag

SEQ ID NO: 110998 - DNA, 25 bp, Homo sapien
agccagagacaatctagcactttaa

SEQ ID NO: 110999 - DNA, 25 bp, Homo sapien
gtactttatcacaaagtggcctttg

SEQ ID NO: 111000 - DNA, 25 bp, Homo sapien
gaaatctgttgctatgggcccttca

SEQ ID NO: 111001 - DNA, 25 bp, Homo sapien
aacatgcccacagatcaactggaat

SEQ ID NO: 111002 - DNA, 25 bp, Homo sapien
gatggtacagctgtgtggtgcttct

SEQ ID NO: 111003 - DNA, 25 bp, Homo sapien
tgaaggagctttcatcattcaccct

SEQ ID NO: 111004 - DNA, 25 bp, Homo sapien
atcattcacccttggcacaggtgtc

SEQ ID NO: 111005 - DNA, 25 bp, Homo sapien
caggtgtccacccaattgtggttgt

SEQ ID NO: 111006 - DNA, 25 bp, Homo sapien
attgtggttgtgcagccagatgcct

SEQ ID NO: 111007 - DNA, 25 bp, Homo sapien
gccagatgcctggacagaggacaat

SEQ ID NO: 111008 - DNA, 25 bp, Homo sapien
caatggcttccatgcaattgggcag

SEQ ID NO: 111009 - DNA, 25 bp, Homo sapien
aattgggcagatgtgtgaggcacct

SEQ ID NO: 111010 - DNA, 25 bp, Homo sapien
ttggacagtgtagcactctaccagt

SEQ ID NO: 111011 - DNA, 25 bp, Homo sapien
ttcccgtaaggctgttacgataggt

SEQ ID NO: 111012 - DNA, 25 bp, Homo sapien
gttacgataggtccttttatctcct

SEQ ID NO: 111013 - DNA, 25 bp, Homo sapien
tggatgcgaggccttctttgaccct

SEQ ID NO: 111014 - DNA, 25 bp, Homo sapien
gacccttggccacagagtatggaag

SEQ ID NO: 111015 - DNA, 25 bp, Homo sapien
tatggaagtagctccgcagaggcgt

SEQ ID NO: 111016 - DNA, 25 bp, Homo sapien
tccgcagaggcgtgggctcgattcc

SEQ ID NO: 111017 - DNA, 25 bp, Homo sapien
ggctcgattcctcagggccacgtta

SEQ ID NO: 111018 - DNA, 25 bp, Homo sapien
cacgttaccacagacctgtttgttt

SEQ ID NO: 111019 - DNA, 25 bp, Homo sapien
tgctgttgttcgtggagtctcatgg

SEQ ID NO: 111020 - DNA, 25 bp, Homo sapien
gagtctcatgggattgtctggtttc

SEQ ID NO: 111021 - DNA, 25 bp, Homo sapien
gattgtctggtttccttacagggcc

SEQ ID NO: 111022 - DNA, 25 bp, Homo sapien
gccaggtgacccctgcgatctggat

SEQ ID NO: 111023 - DNA, 25 bp, Homo sapien
caggtgacccctgcgatctggatgt

SEQ ID NO: 111024 - DNA, 25 bp, Homo sapien
ggtgacccctgcgatctggatgttt

SEQ ID NO: 111025 - DNA, 25 bp, Homo sapien
gtgacccctgcgatctggatgtttc

SEQ ID NO: 111026 - DNA, 25 bp, Homo sapien
tgacccctgcgatctggatgtttcc

SEQ ID NO: 111027 - DNA, 25 bp, Homo sapien
gacccctgcgatctggatgtttccg

SEQ ID NO: 111028 - DNA, 25 bp, Homo sapien
acccctgcgatctggatgtttccgc

SEQ ID NO: 111029 - DNA, 25 bp, Homo sapien
ctgcgatctggatgtttccgctctg

SEQ ID NO: 111030 - DNA, 25 bp, Homo sapien
gcgatctggatgtttccgctctgtt

SEQ ID NO: 111031 - DNA, 25 bp, Homo sapien
gatctggatgtttccgctctgttcc

SEQ ID NO: 111032 - DNA, 25 bp, Homo sapien
atctggatgtttccgctctgttcct

SEQ ID NO: 111033 - DNA, 25 bp, Homo sapien
aactgctcttcacgaagtgactcca

SEQ ID NO: 111034 - DNA, 25 bp, Homo sapien
gaagtgactccaagaccatgacaga

SEQ ID NO: 111035 - DNA, 25 bp, Homo sapien
actccaagaccatgacagagagctt

SEQ ID NO: 111036 - DNA, 25 bp, Homo sapien
aatgtgctctcctaggccacagggc

SEQ ID NO: 111037 - DNA, 25 bp, Homo sapien
tgcctcccttcatgcatggaaattc

SEQ ID NO: 111038 - DNA, 25 bp, Homo sapien
ggaaattcccttcatctggaaccat

SEQ ID NO: 111039 - DNA, 25 bp, Homo sapien
attcccttcatctggaaccatcaga

SEQ ID NO: 111040 - DNA, 25 bp, Homo sapien
tggaaccatcagaaacaccctcaca

SEQ ID NO: 111041 - DNA, 25 bp, Homo sapien
tgggacttgcaaaaagggtcagtat

SEQ ID NO: 111042 - DNA, 25 bp, Homo sapien
tgggttagggaaaacattccatcct

SEQ ID NO: 111043 - DNA, 25 bp, Homo sapien
gaaaacattccatccttgagtcaaa

SEQ ID NO: 111044 - DNA, 25 bp, Homo sapien
gatgatctggtgatttcatttcagt

SEQ ID NO: 111045 - DNA, 25 bp, Homo sapien
tttcagttaatgctatgtgtccttg

SEQ ID NO: 111046 - DNA, 25 bp, Homo sapien
gttaatgctatgtgtccttgactat

SEQ ID NO: 111047 - DNA, 25 bp, Homo sapien
gctatgtgtccttgactattttatt

SEQ ID NO: 111048 - DNA, 25 bp, Homo sapien
tattttattaaactctcacctccca

SEQ ID NO: 111049 - DNA, 25 bp, Homo sapien
tcacctcccatgttgctcaaagaac

SEQ ID NO: 111050 - DNA, 25 bp, Homo sapien
tcccatgttgctcaaagaaccatat

SEQ ID NO: 111051 - DNA, 25 bp, Homo sapien
aaacagctgttatacccattaatgg

SEQ ID NO: 111052 - DNA, 25 bp, Homo sapien
tacccattaatggttcacctcgaac

SEQ ID NO: 111053 - DNA, 25 bp, Homo sapien
taatggttcacctcgaacacccagg

SEQ ID NO: 111054 - DNA, 25 bp, Homo sapien
gaacacccaggcgaggtcagaacag

SEQ ID NO: 111055 - DNA, 25 bp, Homo sapien
acttcctgagaacctttataatgac

SEQ ID NO: 111056 - DNA, 25 bp, Homo sapien
ctttataatgacaggatgtttcgca

SEQ ID NO: 111057 - DNA, 25 bp, Homo sapien
ggatgtttcgcattaagagggcact

SEQ ID NO: 111058 - DNA, 25 bp, Homo sapien
gtttcgcattaagagggcactggac

SEQ ID NO: 111059 - DNA, 25 bp, Homo sapien
ggcactggacctgaacttgaagcat

SEQ ID NO: 111060 - DNA, 25 bp, Homo sapien
aagcatcagatcttgcctaaagagc

SEQ ID NO: 111061 - DNA, 25 bp, Homo sapien
gatcttgcctaaagagcagtggacc

SEQ ID NO: 111062 - DNA, 25 bp, Homo sapien
gcctaaagagcagtggaccaaatat

SEQ ID NO: 111063 - DNA, 25 bp, Homo sapien
aaatttctaccttgaaccgtatctg

SEQ ID NO: 111064 - DNA, 25 bp, Homo sapien
ttctaccttgaaccgtatctgaaag

SEQ ID NO: 111065 - DNA, 25 bp, Homo sapien
accgtatctgaaagaggttattcgg

SEQ ID NO: 111066 - DNA, 25 bp, Homo sapien
ggaagcatcggcaccacttccaata

SEQ ID NO: 111067 - DNA, 25 bp, Homo sapien
acttccaatacgacagccgaactct

SEQ ID NO: 111068 - DNA, 25 bp, Homo sapien
acagccgaactctgggccatacaaa

SEQ ID NO: 111069 - DNA, 25 bp, Homo sapien
aagcttttcccatgatctccaaacg

SEQ ID NO: 111070 - DNA, 25 bp, Homo sapien
aaacggccagagcacctgcgtatga

SEQ ID NO: 111071 - DNA, 25 bp, Homo sapien
gagcacctgcgtatgaatctatgac

SEQ ID NO: 111072 - DNA, 25 bp, Homo sapien
gaatctatgacagagcaatgctttt

SEQ ID NO: 111073 - DNA, 25 bp, Homo sapien
agggagatgtgtgagcatcctgcaa

SEQ ID NO: 111074 - DNA, 25 bp, Homo sapien
catcctgcaaggtgaaacaagactc

SEQ ID NO: 111075 - DNA, 25 bp, Homo sapien
cagtttcagagagtcaatgtcatta

SEQ ID NO: 111076 - DNA, 25 bp, Homo sapien
ttacatagaacacttcggacacagg

SEQ ID NO: 111077 - DNA, 25 bp, Homo sapien
ctccattcctggaaggtcttgaaga

SEQ ID NO: 111078 - DNA, 25 bp, Homo sapien
gagaaaggcacagcctgctcaacct

SEQ ID NO: 111079 - DNA, 25 bp, Homo sapien
tgctcaacctgctgatgaacctgca

SEQ ID NO: 111080 - DNA, 25 bp, Homo sapien
ggaacattaagtgataagccagtct

SEQ ID NO: 111081 - DNA, 25 bp, Homo sapien
gataagccagtctatatatgtatta

SEQ ID NO: 111082 - DNA, 25 bp, Homo sapien
tgtaagaatacaggcaccacatact

SEQ ID NO: 111083 - DNA, 25 bp, Homo sapien
aggcaccacatactgatgacaataa

SEQ ID NO: 111084 - DNA, 25 bp, Homo sapien
agacgcttcctgcagaacaggacct

SEQ ID NO: 111085 - DNA, 25 bp, Homo sapien
gaacaggacctgactacaaagaatg

SEQ ID NO: 111086 - DNA, 25 bp, Homo sapien
ctgactacaaagaatgtttccattg

SEQ ID NO: 111087 - DNA, 25 bp, Homo sapien
gtttccattggaattgttggtaaag

SEQ ID NO: 111088 - DNA, 25 bp, Homo sapien
ctgaaccctccaaatttgtctaaga

SEQ ID NO: 111089 - DNA, 25 bp, Homo sapien
tgaaccctccaaatttgtctaagaa

SEQ ID NO: 111090 - DNA, 25 bp, Homo sapien
cctccaaatttgtctaagaacttcg

SEQ ID NO: 111091 - DNA, 25 bp, Homo sapien
tccaaatttgtctaagaacttcgaa

SEQ ID NO: 111092 - DNA, 25 bp, Homo sapien
aaactttaacaaacaggctgatatc

SEQ ID NO: 111093 - DNA, 25 bp, Homo sapien
acaaacaggctgatatcttcataat

SEQ ID NO: 111094 - DNA, 25 bp, Homo sapien
aaacaggctgatatcttcataatat

SEQ ID NO: 111095 - DNA, 25 bp, Homo sapien
atattcccagcctagaccaagcagg

SEQ ID NO: 111096 - DNA, 25 bp, Homo sapien
gcctagaccaagcaggaagaacatt

SEQ ID NO: 111097 - DNA, 25 bp, Homo sapien
ttctacattgatggaatttttctct

SEQ ID NO: 111098 - DNA, 25 bp, Homo sapien
gaatttttctcttttaatctatcta

SEQ ID NO: 111099 - DNA, 25 bp, Homo sapien
tatcacagatgattcttgacaagaa

SEQ ID NO: 111100 - DNA, 25 bp, Homo sapien
gagggtgtcctgattattttcgatg

SEQ ID NO: 111101 - DNA, 25 bp, Homo sapien
attttcgatgaacccccagtagata

SEQ ID NO: 111102 - DNA, 25 bp, Homo sapien
ataaaacttacgaagctgctctgga

SEQ ID NO: 111103 - DNA, 25 bp, Homo sapien
acatgagcaaagtagtggattccct

SEQ ID NO: 111104 - DNA, 25 bp, Homo sapien
gtagtggattccctctacaacaaag

SEQ ID NO: 111105 - DNA, 25 bp, Homo sapien
tacaacaaagccaagaaactgacat

SEQ ID NO: 111106 - DNA, 25 bp, Homo sapien
agagttggatctgtagcggtccttt

SEQ ID NO: 111107 - DNA, 25 bp, Homo sapien
gatctgtagcggtcctttggagagt

SEQ ID NO: 111108 - DNA, 25 bp, Homo sapien
gggaaaatgctaggagattcttttt

SEQ ID NO: 111109 - DNA, 25 bp, Homo sapien
tttgttctacttttcgctcggaaag

SEQ ID NO: 111110 - DNA, 25 bp, Homo sapien
ctgttatcagtggaacctatcttgg

SEQ ID NO: 111111 - DNA, 25 bp, Homo sapien
ggaacctatcttggtttggattaca

SEQ ID NO: 111112 - DNA, 25 bp, Homo sapien
aaaatggaggtgaaggcggcatcat

SEQ ID NO: 111113 - DNA, 25 bp, Homo sapien
ggcggcatcattatcaatatgtcat

SEQ ID NO: 111114 - DNA, 25 bp, Homo sapien
gattgccaatggattgataacactc

SEQ ID NO: 111115 - DNA, 25 bp, Homo sapien
gataacactcattgaagatgatgct

SEQ ID NO: 111116 - DNA, 25 bp, Homo sapien
gatgatgctttaaatggtgctatta

SEQ ID NO: 111117 - DNA, 25 bp, Homo sapien
atggtgctattatgaagatcacaac

SEQ ID NO: 111118 - DNA, 25 bp, Homo sapien
gatcacaacttctaagggaattcat

SEQ ID NO: 111119 - DNA, 25 bp, Homo sapien
ttcaagactatgatacaactccatt

SEQ ID NO: 111120 - DNA, 25 bp, Homo sapien
atgatacaactccatttcaagcaaa

SEQ ID NO: 111121 - DNA, 25 bp, Homo sapien
agcgtctactagaaaaatctcagag

SEQ ID NO: 111122 - DNA, 25 bp, Homo sapien
aatctcagagggtagaagccatcat

SEQ ID NO: 111123 - DNA, 25 bp, Homo sapien
gagggtagaagccatcattgcatct

SEQ ID NO: 111124 - DNA, 25 bp, Homo sapien
gaagccatcattgcatctatgcagg

SEQ ID NO: 111125 - DNA, 25 bp, Homo sapien
catctatgcaggctactggtgcaga

SEQ ID NO: 111126 - DNA, 25 bp, Homo sapien
gaggaagcacagttacaagaaatag

SEQ ID NO: 111127 - DNA, 25 bp, Homo sapien
gagatgatcacagctcctgaacgtc

SEQ ID NO: 111128 - DNA, 25 bp, Homo sapien
agctcctgaacgtcagcagctagag

SEQ ID NO: 111129 - DNA, 25 bp, Homo sapien
agcagctagagaccctgaaacgtaa

SEQ ID NO: 111130 - DNA, 25 bp, Homo sapien
gaccctgaaacgtaatgtcaacaag

SEQ ID NO: 111131 - DNA, 25 bp, Homo sapien
atgtcaacaagttggatgccagtga

SEQ ID NO: 111132 - DNA, 25 bp, Homo sapien
ccagataatatattaggcactactg

SEQ ID NO: 111133 - DNA, 25 bp, Homo sapien
ggcactactgattttttagttaaat

SEQ ID NO: 111134 - DNA, 25 bp, Homo sapien
gttaaattgatgcactacacttttg

SEQ ID NO: 111135 - DNA, 25 bp, Homo sapien
gatgcactacacttttgatgtttga

SEQ ID NO: 111136 - DNA, 25 bp, Homo sapien
aattgccaaatacctaggcccattg

SEQ ID NO: 111137 - DNA, 25 bp, Homo sapien
aatacctaggcccattgctgacgat

SEQ ID NO: 111138 - DNA, 25 bp, Homo sapien
taggcccattgctgacgattagttc

SEQ ID NO: 111139 - DNA, 25 bp, Homo sapien
gcccattgctgacgattagttctaa

SEQ ID NO: 111140 - DNA, 25 bp, Homo sapien
gctgacgattagttctaaaatctta

SEQ ID NO: 111141 - DNA, 25 bp, Homo sapien
ttccctacttcctctgcaaaaagat

SEQ ID NO: 111142 - DNA, 25 bp, Homo sapien
gtttgtaaaggcattctataagcta

SEQ ID NO: 111143 - DNA, 25 bp, Homo sapien
tcttctaagagtcccatctgctatg

SEQ ID NO: 111144 - DNA, 25 bp, Homo sapien
tgcccagccacattaactaacttta

SEQ ID NO: 111145 - DNA, 25 bp, Homo sapien
actttaatcttagtttatgcatcat

SEQ ID NO: 111146 - DNA, 25 bp, Homo sapien
aattgatttctattgttgagctgca

SEQ ID NO: 111147 - DNA, 25 bp, Homo sapien
ccttcaactcttcgtacattcaatg

SEQ ID NO: 111148 - DNA, 25 bp, Homo sapien
cattcaatgcatggatcaatcagtg

SEQ ID NO: 111149 - DNA, 25 bp, Homo sapien
aatcagtgtgattagctttctcagc

SEQ ID NO: 111150 - DNA, 25 bp, Homo sapien
gctttctcagcagacattgtgccat

SEQ ID NO: 111151 - DNA, 25 bp, Homo sapien
attgtgccatatgtatcaaatgaca

SEQ ID NO: 111152 - DNA, 25 bp, Homo sapien
attgaatggttttgctcagcaccac

SEQ ID NO: 111153 - DNA, 25 bp, Homo sapien
ttgctcagcaccaccttttaatata

SEQ ID NO: 111154 - DNA, 25 bp, Homo sapien
tttcactccagctaacacagatgta

SEQ ID NO: 111155 - DNA, 25 bp, Homo sapien
ttcactccagctaacacagatgtaa

SEQ ID NO: 111156 - DNA, 25 bp, Homo sapien
tcactccagctaacacagatgtaaa

SEQ ID NO: 111157 - DNA, 25 bp, Homo sapien
cactccagctaacacagatgtaaaa

SEQ ID NO: 111158 - DNA, 25 bp, Homo sapien
actccagctaacacagatgtaaaag

SEQ ID NO: 111159 - DNA, 25 bp, Homo sapien
tccagctaacacagatgtaaaagac

SEQ ID NO: 111160 - DNA, 25 bp, Homo sapien
gctaacacagatgtaaaagactttt

SEQ ID NO: 111161 - DNA, 25 bp, Homo sapien
taacacagatgtaaaagactttttt

SEQ ID NO: 111162 - DNA, 25 bp, Homo sapien
tataaaagactgaccaatattgtac

SEQ ID NO: 111163 - DNA, 25 bp, Homo sapien
ataaaagactgaccaatattgtaca

SEQ ID NO: 111164 - DNA, 25 bp, Homo sapien
aagactgaccaatattgtacagttt

SEQ ID NO: 111165 - DNA, 25 bp, Homo sapien
tgttcacagacctggcatccgtcga

SEQ ID NO: 111166 - DNA, 25 bp, Homo sapien
atccgtcgacaactccgagtttcag

SEQ ID NO: 111167 - DNA, 25 bp, Homo sapien
gcagctgctgaaccagggcatacct

SEQ ID NO: 111168 - DNA, 25 bp, Homo sapien
catgctgatggagtaccctgaggct

SEQ ID NO: 111169 - DNA, 25 bp, Homo sapien
gtaccctgaggctataactcgccta

SEQ ID NO: 111170 - DNA, 25 bp, Homo sapien
gaggctataactcgcctagtgacag

SEQ ID NO: 111171 - DNA, 25 bp, Homo sapien
ccaatggcctcctttcaggagatga

SEQ ID NO: 111172 - DNA, 25 bp, Homo sapien
agatgaagacttctcctccattgcg

SEQ ID NO: 111173 - DNA, 25 bp, Homo sapien
cattgcggacatggacttctcagcc

SEQ ID NO: 111174 - DNA, 25 bp, Homo sapien
gacatggacttctcagccctgctga

SEQ ID NO: 111175 - DNA, 25 bp, Homo sapien
cctgctgagtcagatcagctcctaa

SEQ ID NO: 111176 - DNA, 25 bp, Homo sapien
ggaggttttctgtctcaactggtct

SEQ ID NO: 111177 - DNA, 25 bp, Homo sapien
aactggtctctgacaagcctctgac

SEQ ID NO: 111178 - DNA, 25 bp, Homo sapien
agcctctgactgaatgtatccgtgc

SEQ ID NO: 111179 - DNA, 25 bp, Homo sapien
gaatgtatccgtgctggccactatg

SEQ ID NO: 111180 - DNA, 25 bp, Homo sapien
tggccactatgcagcaagcatcata

SEQ ID NO: 111181 - DNA, 25 bp, Homo sapien
taattagacggactggctgcacctt

SEQ ID NO: 111182 - DNA, 25 bp, Homo sapien
gctgcacctttcctgagaagccaga

SEQ ID NO: 111183 - DNA, 25 bp, Homo sapien
gagaagccagacttccactgatgga

SEQ ID NO: 111184 - DNA, 25 bp, Homo sapien
agcgaatcgtgatcttcacccaagg

SEQ ID NO: 111185 - DNA, 25 bp, Homo sapien
gagatgacactataatggctacaga

SEQ ID NO: 111186 - DNA, 25 bp, Homo sapien
ctgcttttgctgtcttggatcaaga

SEQ ID NO: 111187 - DNA, 25 bp, Homo sapien
taaccttaccagttcaaagtttgag

SEQ ID NO: 111188 - DNA, 25 bp, Homo sapien
cttaccagttcaaagtttgaggaat

SEQ ID NO: 111189 - DNA, 25 bp, Homo sapien
gtttgaggaatttatgactaggcat

SEQ ID NO: 111190 - DNA, 25 bp, Homo sapien
gaggaatttatgactaggcatcagg

SEQ ID NO: 111191 - DNA, 25 bp, Homo sapien
gaatttatgactaggcatcaggtac

SEQ ID NO: 111192 - DNA, 25 bp, Homo sapien
tttatgactaggcatcaggtacatg

SEQ ID NO: 111193 - DNA, 25 bp, Homo sapien
ttatgactaggcatcaggtacatga

SEQ ID NO: 111194 - DNA, 25 bp, Homo sapien
atgactaggcatcaggtacatgaaa

SEQ ID NO: 111195 - DNA, 25 bp, Homo sapien
gactaggcatcaggtacatgaaaaa

SEQ ID NO: 111196 - DNA, 25 bp, Homo sapien
ctaggcatcaggtacatgaaaaaga

SEQ ID NO: 111197 - DNA, 25 bp, Homo sapien
agaagaattcaaggctttgaaaacg

SEQ ID NO: 111198 - DNA, 25 bp, Homo sapien
tcctgttttgaagtgctattacctt

SEQ ID NO: 111199 - DNA, 25 bp, Homo sapien
gaagtgctattacctttctcagtta

SEQ ID NO: 111200 - DNA, 25 bp, Homo sapien
gctattacctttctcagttaccaga

SEQ ID NO: 111201 - DNA, 25 bp, Homo sapien
tcagttaccagaatcttgctgctaa

SEQ ID NO: 111202 - DNA, 25 bp, Homo sapien
tgctgctaaagttgcaagtgattga

SEQ ID NO: 111203 - DNA, 25 bp, Homo sapien
aaatgtgtatttatagtccctccta

SEQ ID NO: 111204 - DNA, 25 bp, Homo sapien
ttatagtccctcctatcaaacaatt

SEQ ID NO: 111205 - DNA, 25 bp, Homo sapien
aattacagagcacaatgattgtcat

SEQ ID NO: 111206 - DNA, 25 bp, Homo sapien
atttactctctattattgggcataa

SEQ ID NO: 111207 - DNA, 25 bp, Homo sapien
gggcataaaggtggcttctgctcca

SEQ ID NO: 111208 - DNA, 25 bp, Homo sapien
cagaactctatccactgtatttcca

SEQ ID NO: 111209 - DNA, 25 bp, Homo sapien
ttgctttacatcgtctactctggaa

SEQ ID NO: 111210 - DNA, 25 bp, Homo sapien
gggcagtatctttccagcaacaggg

SEQ ID NO: 111211 - DNA, 25 bp, Homo sapien
agctgttggaagacgaccttttgat

SEQ ID NO: 111212 - DNA, 25 bp, Homo sapien
atggcaacacttcttgcatacctgg

SEQ ID NO: 111213 - DNA, 25 bp, Homo sapien
ggtcctccagagcacaaacctgtgg

SEQ ID NO: 111214 - DNA, 25 bp, Homo sapien
tgtggcagatacacactggtccagc

SEQ ID NO: 111215 - DNA, 25 bp, Homo sapien
aaagcaactttgatgcagcacgcag

SEQ ID NO: 111216 - DNA, 25 bp, Homo sapien
gcagcacgcaggtttttccttgata

SEQ ID NO: 111217 - DNA, 25 bp, Homo sapien
gatatagcatctgattgtcctacaa

SEQ ID NO: 111218 - DNA, 25 bp, Homo sapien
gattgtcctacaagtgatgcagtaa

SEQ ID NO: 111219 - DNA, 25 bp, Homo sapien
gcagtaaatcatagtctttccttca

SEQ ID NO: 111220 - DNA, 25 bp, Homo sapien
ctttcctcatttcctagacgtacgt

SEQ ID NO: 111221 - DNA, 25 bp, Homo sapien
tcctcatttcctagacgtacgtcaa

SEQ ID NO: 111222 - DNA, 25 bp, Homo sapien
ctagacgtacgtcaactgtatgtac

SEQ ID NO: 111223 - DNA, 25 bp, Homo sapien
tgtatgtacataccggggctcctct

SEQ ID NO: 111224 - DNA, 25 bp, Homo sapien
ggctcctctcctaacatatatgtat

SEQ ID NO: 111225 - DNA, 25 bp, Homo sapien
tacatatattgtgtggtttcccctt

SEQ ID NO: 111226 - DNA, 25 bp, Homo sapien
catatattgtgtggtttcccctttc

SEQ ID NO: 111227 - DNA, 25 bp, Homo sapien
gaaataataccccaacagatgagcg

SEQ ID NO: 111228 - DNA, 25 bp, Homo sapien
ataccccaacagatgagcgaaaatg

SEQ ID NO: 111229 - DNA, 25 bp, Homo sapien
ggaaaaaggacattggccccgcagt

SEQ ID NO: 111230 - DNA, 25 bp, Homo sapien
aaaaaggacattggccccgcagtgc

SEQ ID NO: 111231 - DNA, 25 bp, Homo sapien
cagtgcaatgcgcagccctatagca

SEQ ID NO: 111232 - DNA, 25 bp, Homo sapien
gcagccctatagcacctctgtggga

SEQ ID NO: 111233 - DNA, 25 bp, Homo sapien
acctctgtgggagtcctcgatgcag

SEQ ID NO: 111234 - DNA, 25 bp, Homo sapien
ggagtcctcgatgcagctgctgtag

SEQ ID NO: 111235 - DNA, 25 bp, Homo sapien
tgcagctgctgtagatccagaagag

SEQ ID NO: 111236 - DNA, 25 bp, Homo sapien
gctgctgtagatccagaagagcaaa

SEQ ID NO: 111237 - DNA, 25 bp, Homo sapien
gaggccccagctacaaagtagcaca

SEQ ID NO: 111238 - DNA, 25 bp, Homo sapien
caaagtagcacagggatggtgctga

SEQ ID NO: 111239 - DNA, 25 bp, Homo sapien
attcagggtggccacaccatacagg

SEQ ID NO: 111240 - DNA, 25 bp, Homo sapien
ggacatctaccactgaaggagccct

SEQ ID NO: 111241 - DNA, 25 bp, Homo sapien
atctaccactgaaggagccctgggt

SEQ ID NO: 111242 - DNA, 25 bp, Homo sapien
ctcaaacccagcttggcagctctaa

SEQ ID NO: 111243 - DNA, 25 bp, Homo sapien
tcaaacccagcttggcagctctaat

SEQ ID NO: 111244 - DNA, 25 bp, Homo sapien
caaacccagcttggcagctctaatg

SEQ ID NO: 111245 - DNA, 25 bp, Homo sapien
aaacccagcttggcagctctaatgt

SEQ ID NO: 111246 - DNA, 25 bp, Homo sapien
aacccagcttggcagctctaatgta

SEQ ID NO: 111247 - DNA, 25 bp, Homo sapien
acccagcttggcagctctaatgtac

SEQ ID NO: 111248 - DNA, 25 bp, Homo sapien
ccagcttggcagctctaatgtacca

SEQ ID NO: 111249 - DNA, 25 bp, Homo sapien
cagcttggcagctctaatgtaccag

SEQ ID NO: 111250 - DNA, 25 bp, Homo sapien
agcttggcagctctaatgtaccagc

SEQ ID NO: 111251 - DNA, 25 bp, Homo sapien
gcttggcagctctaatgtaccagca

SEQ ID NO: 111252 - DNA, 25 bp, Homo sapien
cttggcagctctaatgtaccagcag

SEQ ID NO: 111253 - DNA, 25 bp, Homo sapien
tcaaacccagcttggcagctctaat

SEQ ID NO: 111254 - DNA, 25 bp, Homo sapien
caaacccagcttggcagctctaatg

SEQ ID NO: 111255 - DNA, 25 bp, Homo sapien
aacccagcttggcagctctaatgta

SEQ ID NO: 111256 - DNA, 25 bp, Homo sapien
acccagcttggcagctctaatgtac

SEQ ID NO: 111257 - DNA, 25 bp, Homo sapien
cagcttggcagctctaatgtaccag

SEQ ID NO: 111258 - DNA, 25 bp, Homo sapien
agcttggcagctctaatgtaccagc

SEQ ID NO: 111259 - DNA, 25 bp, Homo sapien
gcttggcagctctaatgtaccagca

SEQ ID NO: 111260 - DNA, 25 bp, Homo sapien
cttggcagctctaatgtaccagcag

SEQ ID NO: 111261 - DNA, 25 bp, Homo sapien
gagtctccatcttagagcatcactc

SEQ ID NO: 111262 - DNA, 25 bp, Homo sapien
gtctccatcttagagcatcactctt

SEQ ID NO: 111263 - DNA, 25 bp, Homo sapien
tccatcttagagcatcactcttcct

SEQ ID NO: 111264 - DNA, 25 bp, Homo sapien
aactgtgtccagcaaaggagtgcct

SEQ ID NO: 111265 - DNA, 25 bp, Homo sapien
agggcagagtctgtcagcatcttcc

SEQ ID NO: 111266 - DNA, 25 bp, Homo sapien
gggagggcatgttgcatcaccccac

SEQ ID NO: 111267 - DNA, 25 bp, Homo sapien
tgcatcaccccactgtggacaggag

SEQ ID NO: 111268 - DNA, 25 bp, Homo sapien
aggagcccatttacagagctgctga

SEQ ID NO: 111269 - DNA, 25 bp, Homo sapien
ttgggtccctgctgtgggcagacac

SEQ ID NO: 111270 - DNA, 25 bp, Homo sapien
cagacaccgtgcagcagcgggataa

SEQ ID NO: 111271 - DNA, 25 bp, Homo sapien
gaatagcaaggtgctcacaccccat

SEQ ID NO: 111272 - DNA, 25 bp, Homo sapien
ccattggtggactacgcgggacgtc

SEQ ID NO: 111273 - DNA, 25 bp, Homo sapien
atgtcgcgctcagcatgcatccttt

SEQ ID NO: 111274 - DNA, 25 bp, Homo sapien
agcatgcatcctttgcactgtcgat

SEQ ID NO: 111275 - DNA, 25 bp, Homo sapien
ataggcaggagaggcttatgtggca

SEQ ID NO: 111276 - DNA, 25 bp, Homo sapien
gcttatgtggcagcacaagccaggt

SEQ ID NO: 111277 - DNA, 25 bp, Homo sapien
ttatgtggcagcacaagccaggtgg

SEQ ID NO: 111278 - DNA, 25 bp, Homo sapien
aacatttgtaagtaatccaagtagg

SEQ ID NO: 111279 - DNA, 25 bp, Homo sapien
ggcaccaaaagtaacatggcaccca

SEQ ID NO: 111280 - DNA, 25 bp, Homo sapien
gaaatatgagtgtgaactctgagta

SEQ ID NO: 111281 - DNA, 25 bp, Homo sapien
ctctgagtagagtatgaaacaccac

SEQ ID NO: 111282 - DNA, 25 bp, Homo sapien
gtatgaaacaccacagaaagtctta

SEQ ID NO: 111283 - DNA, 25 bp, Homo sapien
gaaacaccacagaaagtcttagaaa

SEQ ID NO: 111284 - DNA, 25 bp, Homo sapien
gaaagtcttagaaatagctctggag

SEQ ID NO: 111285 - DNA, 25 bp, Homo sapien
cttagaaatagctctggagtggctc

SEQ ID NO: 111286 - DNA, 25 bp, Homo sapien
aatgactatgaaacagctgacggcg

SEQ ID NO: 111287 - DNA, 25 bp, Homo sapien
gactatgaaacagctgacggcggct

SEQ ID NO: 111288 - DNA, 25 bp, Homo sapien
atgaaacagctgacggcggctacat

SEQ ID NO: 111289 - DNA, 25 bp, Homo sapien
ctgacggcggctacatgactctgaa

SEQ ID NO: 111290 - DNA, 25 bp, Homo sapien
gacggcggctacatgactctgaacc

SEQ ID NO: 111291 - DNA, 25 bp, Homo sapien
ggctacatgactctgaaccccaggg

SEQ ID NO: 111292 - DNA, 25 bp, Homo sapien
cagggcacctactgacgatgataaa

SEQ ID NO: 111293 - DNA, 25 bp, Homo sapien
ggcacctactgacgatgataaaaac

SEQ ID NO: 111294 - DNA, 25 bp, Homo sapien
gataaaaacatctacctgactcttc

SEQ ID NO: 111295 - DNA, 25 bp, Homo sapien
ctcccaacgaccatgtcaacagtaa

SEQ ID NO: 111296 - DNA, 25 bp, Homo sapien
aacgaccatgtcaacagtaataact

SEQ ID NO: 111297 - DNA, 25 bp, Homo sapien
gccaaaagctagacagatccccgtt

SEQ ID NO: 111298 - DNA, 25 bp, Homo sapien
aagctagacagatccccgttcctga

SEQ ID NO: 111299 - DNA, 25 bp, Homo sapien
tccaacacaaggctccaagacctag

SEQ ID NO: 111300 - DNA, 25 bp, Homo sapien
caaggctccaagacctaggctcatg

SEQ ID NO: 111301 - DNA, 25 bp, Homo sapien
acctaggctcatggacgagatggga

SEQ ID NO: 111302 - DNA, 25 bp, Homo sapien
gagaagggataaccctacacccaga

SEQ ID NO: 111303 - DNA, 25 bp, Homo sapien
gaccccaggctggacatgctgactg

SEQ ID NO: 111304 - DNA, 25 bp, Homo sapien
tttctagcctatttacctgcaggct

SEQ ID NO: 111305 - DNA, 25 bp, Homo sapien
aagagccaatgttttccacccatcc

SEQ ID NO: 111306 - DNA, 25 bp, Homo sapien
cgtgaggtcccaggaagtggccaaa

SEQ ID NO: 111307 - DNA, 25 bp, Homo sapien
ccaggaagtggccaaaagctagaca

SEQ ID NO: 111308 - DNA, 25 bp, Homo sapien
tagtactcgatggactaagtaatat

SEQ ID NO: 111309 - DNA, 25 bp, Homo sapien
gaggcagaaaccataggcaatctta

SEQ ID NO: 111310 - DNA, 25 bp, Homo sapien
agacatctacaaattggcctatgag

SEQ ID NO: 111311 - DNA, 25 bp, Homo sapien
attggcctatgagatcattgatcag

SEQ ID NO: 111312 - DNA, 25 bp, Homo sapien
attgatcagttcttctcttcagatg

SEQ ID NO: 111313 - DNA, 25 bp, Homo sapien
gatattgatgaagaccctagccttg

SEQ ID NO: 111314 - DNA, 25 bp, Homo sapien
cctagccttgttccagaggcaattc

SEQ ID NO: 111315 - DNA, 25 bp, Homo sapien
ccagaggcaattcaaggcggaacat

SEQ ID NO: 111316 - DNA, 25 bp, Homo sapien
ggcggaacatttggtttcaattcat

SEQ ID NO: 111317 - DNA, 25 bp, Homo sapien
gtttcaattcatctgccaatgtacc

SEQ ID NO: 111318 - DNA, 25 bp, Homo sapien
tgtaccaacagaagggttccagttt

SEQ ID NO: 111319 - DNA, 25 bp, Homo sapien
gtacaagcagtctgttcaaggagca

SEQ ID NO: 111320 - DNA, 25 bp, Homo sapien
gttcaaggagcagggacaagttaca

SEQ ID NO: 111321 - DNA, 25 bp, Homo sapien
aatgttctccaagcagcaatccaaa

SEQ ID NO: 111322 - DNA, 25 bp, Homo sapien
caaaagagtctcaaggatccttcaa

SEQ ID NO: 111323 - DNA, 25 bp, Homo sapien
aggatgataacaccctatgcccatt

SEQ ID NO: 111324 - DNA, 25 bp, Homo sapien
ccctatgcccattgtcctgatctga

SEQ ID NO: 111325 - DNA, 25 bp, Homo sapien
acatggaactgcctctacttaatca

SEQ ID NO: 111326 - DNA, 25 bp, Homo sapien
gtgttataatgtgtttagccctttc

SEQ ID NO: 111327 - DNA, 25 bp, Homo sapien
tagccctttcttgttgctgtatgtt

SEQ ID NO: 111328 - DNA, 25 bp, Homo sapien
gctgtatgtttagatgctttccaat

SEQ ID NO: 111329 - DNA, 25 bp, Homo sapien
tgtttagatgctttccaatcttttg

SEQ ID NO: 111330 - DNA, 25 bp, Homo sapien
atacctcactcgctcagctataaga

SEQ ID NO: 111331 - DNA, 25 bp, Homo sapien
tatcaatttctgtctcatcttaata

SEQ ID NO: 111332 - DNA, 25 bp, Homo sapien
ttggctgccagctttttatctttct

SEQ ID NO: 111333 - DNA, 25 bp, Homo sapien
aatatgtctcttgctgatctgtatc

SEQ ID NO: 111334 - DNA, 25 bp, Homo sapien
atcatcgtgatgcttctctgaagtt

SEQ ID NO: 111335 - DNA, 25 bp, Homo sapien
tctgaagttctgctacaacctctag

SEQ ID NO: 111336 - DNA, 25 bp, Homo sapien
tacaacctctagatctgcagcttgc

SEQ ID NO: 111337 - DNA, 25 bp, Homo sapien
tgcagcttgccacatcagcttaaaa

SEQ ID NO: 111338 - DNA, 25 bp, Homo sapien
ttatctttctctcgaccacttaaaa

SEQ ID NO: 111339 - DNA, 25 bp, Homo sapien
agacttcctgtcctgctggtatcat

SEQ ID NO: 111340 - DNA, 25 bp, Homo sapien
ggagaaagtccaatacctcactcgc

SEQ ID NO: 111341 - DNA, 25 bp, Homo sapien
actttctgtgtctgggtaccctctg

SEQ ID NO: 111342 - DNA, 25 bp, Homo sapien
gggtaccctctgagtaggcctataa

SEQ ID NO: 111343 - DNA, 25 bp, Homo sapien
aggcctataattcctaccttgactg

SEQ ID NO: 111344 - DNA, 25 bp, Homo sapien
ctaccttgactgtgtgcatcatttg

SEQ ID NO: 111345 - DNA, 25 bp, Homo sapien
gtaagctagcagatctatgtggtga

SEQ ID NO: 111346 - DNA, 25 bp, Homo sapien
aaaatgcacaggagcttggtagact

SEQ ID NO: 111347 - DNA, 25 bp, Homo sapien
agagagagctcctttcgccatgttt

SEQ ID NO: 111348 - DNA, 25 bp, Homo sapien
gccatgttttaccagtctgctgtta

SEQ ID NO: 111349 - DNA, 25 bp, Homo sapien
gtctgctgttataacctcttaggtt

SEQ ID NO: 111350 - DNA, 25 bp, Homo sapien
tatcctttaatttccagccttttag

SEQ ID NO: 111351 - DNA, 25 bp, Homo sapien
tccagccttttaggttagtttctgt

SEQ ID NO: 111352 - DNA, 25 bp, Homo sapien
tcttccctaaagttcatccggtata

SEQ ID NO: 111353 - DNA, 25 bp, Homo sapien
aagttcatccggtatatctatgtta

SEQ ID NO: 111354 - DNA, 25 bp, Homo sapien
atccggtatatctatgttaacctca

SEQ ID NO: 111355 - DNA, 25 bp, Homo sapien
ctatgttaacctcaagatggactga

SEQ ID NO: 111356 - DNA, 25 bp, Homo sapien
gatggactgagttctgtatggcaga

SEQ ID NO: 111357 - DNA, 25 bp, Homo sapien
ggcagaactattgctgttctctccc

SEQ ID NO: 111358 - DNA, 25 bp, Homo sapien
tgaattgtgtgatggcattgttgcc

SEQ ID NO: 111359 - DNA, 25 bp, Homo sapien
ctttgggcattccttccccagagag

SEQ ID NO: 111360 - DNA, 25 bp, Homo sapien
ggaaattataaatctctatcacata

SEQ ID NO: 111361 - DNA, 25 bp, Homo sapien
taagttgcctttagttttggtcctg

SEQ ID NO: 111362 - DNA, 25 bp, Homo sapien
ttgcctttagttttggtcctgattt

SEQ ID NO: 111363 - DNA, 25 bp, Homo sapien
gctgcagctcttcgtgaaggacccg

SEQ ID NO: 111364 - DNA, 25 bp, Homo sapien
agctcttcgtgaaggacccggcgct

SEQ ID NO: 111365 - DNA, 25 bp, Homo sapien
actgtggctgtacccgctggctatg

SEQ ID NO: 111366 - DNA, 25 bp, Homo sapien
tacccgctggctatgactggagaga

SEQ ID NO: 111367 - DNA, 25 bp, Homo sapien
ggagagacatcgtcagctacgtcat

SEQ ID NO: 111368 - DNA, 25 bp, Homo sapien
gtcagctacgtcatagaccacttcg

SEQ ID NO: 111369 - DNA, 25 bp, Homo sapien
tagaccacttcgacattgagatcat

SEQ ID NO: 111370 - DNA, 25 bp, Homo sapien
acattgagatcatgggtggccttgg

SEQ ID NO: 111371 - DNA, 25 bp, Homo sapien
aaggtgctgcggatcggcctgctgg

SEQ ID NO: 111372 - DNA, 25 bp, Homo sapien
atgccacccgcgagaatgtggaccg

SEQ ID NO: 111373 - DNA, 25 bp, Homo sapien
acccgcgagaatgtggaccgcgtga

SEQ ID NO: 111374 - DNA, 25 bp, Homo sapien
aatgaagaactgcatgtggcttctc

SEQ ID NO: 111375 - DNA, 25 bp, Homo sapien
gaagaactgcatgtggcttctctgt

SEQ ID NO: 111376 - DNA, 25 bp, Homo sapien
gaaaagccatctcaggttggcggca

SEQ ID NO: 111377 - DNA, 25 bp, Homo sapien
aagccatctcaggttggcggcagac

SEQ ID NO: 111378 - DNA, 25 bp, Homo sapien
ccatctcaggttggcggcagacaca

SEQ ID NO: 111379 - DNA, 25 bp, Homo sapien
tcaggttggcggcagacacattgtc

SEQ ID NO: 111380 - DNA, 25 bp, Homo sapien
aggttggcggcagacacattgtcat

SEQ ID NO: 111381 - DNA, 25 bp, Homo sapien
agcagcggctctggtcctcggagct

SEQ ID NO: 111382 - DNA, 25 bp, Homo sapien
tggtcctcggagctggttcctctct

SEQ ID NO: 111383 - DNA, 25 bp, Homo sapien
taagggcagccctccatggtcctgt

SEQ ID NO: 111384 - DNA, 25 bp, Homo sapien
tctgaagtgtgtccatcctgacctg

SEQ ID NO: 111385 - DNA, 25 bp, Homo sapien
gccggcgcttcttggatgaactaga

SEQ ID NO: 111386 - DNA, 25 bp, Homo sapien
actagatgcggttcagatggactga

SEQ ID NO: 111387 - DNA, 25 bp, Homo sapien
gatggactgagcttggatgcttctg

SEQ ID NO: 111388 - DNA, 25 bp, Homo sapien
caagctgaagctttgggttctgact

SEQ ID NO: 111389 - DNA, 25 bp, Homo sapien
tttgggttctgactgacccacccta

SEQ ID NO: 111390 - DNA, 25 bp, Homo sapien
tgctgaacagagagcccagtgtgac

SEQ ID NO: 111391 - DNA, 25 bp, Homo sapien
gagcccagtgtgactagggatcctg

SEQ ID NO: 111392 - DNA, 25 bp, Homo sapien
ctagggatcctgagttttctgggac

SEQ ID NO: 111393 - DNA, 25 bp, Homo sapien
gggacaattccagctttaatcaata

SEQ ID NO: 111394 - DNA, 25 bp, Homo sapien
atgagactttttacgcctttataag

SEQ ID NO: 111395 - DNA, 25 bp, Homo sapien
tgtgctggtgagtgaagccatcaaa

SEQ ID NO: 111396 - DNA, 25 bp, Homo sapien
aaagccaaggtgctggactgttact

SEQ ID NO: 111397 - DNA, 25 bp, Homo sapien
gactgttactgacttggatcccaaa

SEQ ID NO: 111398 - DNA, 25 bp, Homo sapien
tttggagctcttgggtcagagaaaa

SEQ ID NO: 111399 - DNA, 25 bp, Homo sapien
gctctcgctgccctgtggacaggat

SEQ ID NO: 111400 - DNA, 25 bp, Homo sapien
aggacagagggcacatgaacagctt

SEQ ID NO: 111401 - DNA, 25 bp, Homo sapien
gcacatgaacagcttgccagggatg

SEQ ID NO: 111402 - DNA, 25 bp, Homo sapien
aacagcacttttcctcttctagatg

SEQ ID NO: 111403 - DNA, 25 bp, Homo sapien
tcttctagatggaccccagcattta

SEQ ID NO: 111404 - DNA, 25 bp, Homo sapien
tggaccccagcatttaagtgacctt

SEQ ID NO: 111405 - DNA, 25 bp, Homo sapien
agtgaccttctgatcttgggaaaac

SEQ ID NO: 111406 - DNA, 25 bp, Homo sapien
tgggaaaacagcgtcttccttcttt

SEQ ID NO: 111407 - DNA, 25 bp, Homo sapien
taagccgttcttattgaccaattcc

SEQ ID NO: 111408 - DNA, 25 bp, Homo sapien
attgaccaattcctgacacttgatt

SEQ ID NO: 111409 - DNA, 25 bp, Homo sapien
acacttgattgtctcctaatgcttt

SEQ ID NO: 111410 - DNA, 25 bp, Homo sapien
tgtctcctaatgctttatccatcac

SEQ ID NO: 111411 - DNA, 25 bp, Homo sapien
taatgctttatccatcaccacctgg

SEQ ID NO: 111412 - DNA, 25 bp, Homo sapien
ggcaccagccacataatgttccaga

SEQ ID NO: 111413 - DNA, 25 bp, Homo sapien
cccagacgtggagtggagtgattct

SEQ ID NO: 111414 - DNA, 25 bp, Homo sapien
ggagtgattctcttgacgtttacat

SEQ ID NO: 111415 - DNA, 25 bp, Homo sapien
acgtttacatatatctctgtgtctc

SEQ ID NO: 111416 - DNA, 25 bp, Homo sapien
gtctctccatcattccaaagctaaa

SEQ ID NO: 111417 - DNA, 25 bp, Homo sapien
aaactcttcgggagacatgttgaga

SEQ ID NO: 111418 - DNA, 25 bp, Homo sapien
aaatataagtcaagaaaatgcccca

SEQ ID NO: 111419 - DNA, 25 bp, Homo sapien
agaaaatgccccagggcccgcacac

SEQ ID NO: 111420 - DNA, 25 bp, Homo sapien
tctataccctacacgttataaaaga

SEQ ID NO: 111421 - DNA, 25 bp, Homo sapien
gtgaatgaagaagtaaccagacaat

SEQ ID NO: 111422 - DNA, 25 bp, Homo sapien
gtaaccagacaattctacgtattct

SEQ ID NO: 111423 - DNA, 25 bp, Homo sapien
atgagtcagtacaagcaagttcacc

SEQ ID NO: 111424 - DNA, 25 bp, Homo sapien
agtacaagcaagttcacctgacctc

SEQ ID NO: 111425 - DNA, 25 bp, Homo sapien
aagcaagttcacctgacctctcagc

SEQ ID NO: 111426 - DNA, 25 bp, Homo sapien
tgacctctcagctgggaccgctgtc

SEQ ID NO: 111427 - DNA, 25 bp, Homo sapien
gctgggaccgctgtcagcatcatga

SEQ ID NO: 111428 - DNA, 25 bp, Homo sapien
ctggctgggatggctctgatatagc

SEQ ID NO: 111429 - DNA, 25 bp, Homo sapien
agctggcccggcttaatccccagta

SEQ ID NO: 111430 - DNA, 25 bp, Homo sapien
taatccccagtatcccatgttccga

SEQ ID NO: 111431 - DNA, 25 bp, Homo sapien
cccctgtgtactcgatggagacaga

SEQ ID NO: 111432 - DNA, 25 bp, Homo sapien
gctgaggacatccagcttctgaaga

SEQ ID NO: 111433 - DNA, 25 bp, Homo sapien
gcttctgaagaggactgtggagact

SEQ ID NO: 111434 - DNA, 25 bp, Homo sapien
gagactgaggctgttcagatgctaa

SEQ ID NO: 111435 - DNA, 25 bp, Homo sapien
tcggagctgccccaggacgtgtaca

SEQ ID NO: 111436 - DNA, 25 bp, Homo sapien
ggacgtgtacaccatcaaggcactg

SEQ ID NO: 111437 - DNA, 25 bp, Homo sapien
atcaaggcactggaggcgcacaagc

SEQ ID NO: 111438 - DNA, 25 bp, Homo sapien
cacaagcgggcggaagagttcctaa

SEQ ID NO: 111439 - DNA, 25 bp, Homo sapien
agagttcctaactgccagccaggag

SEQ ID NO: 111440 - DNA, 25 bp, Homo sapien
taaaccagaccgtgttgaaccgagc

SEQ ID NO: 111441 - DNA, 25 bp, Homo sapien
tgaaccgagcggacgctttggctaa

SEQ ID NO: 111442 - DNA, 25 bp, Homo sapien
gctttggctaaagacccgaaaatgt

SEQ ID NO: 111443 - DNA, 25 bp, Homo sapien
aaaatgttgcggagccagtctcagc

SEQ ID NO: 111444 - DNA, 25 bp, Homo sapien
ggagccagtctcagctagacctgtg

SEQ ID NO: 111445 - DNA, 25 bp, Homo sapien
tagacctgtgcaaagactctcccta

SEQ ID NO: 111446 - DNA, 25 bp, Homo sapien
aagactctccctatgaattgaagaa

SEQ ID NO: 111447 - DNA, 25 bp, Homo sapien
ggtatgtccgacatttaacgcgggc

SEQ ID NO: 111448 - DNA, 25 bp, Homo sapien
tggccttggcagttatttttccatc

SEQ ID NO: 111449 - DNA, 25 bp, Homo sapien
tatttttccatcaccgagagagaga

SEQ ID NO: 111450 - DNA, 25 bp, Homo sapien
ctacccctcctattcagaagtttat

SEQ ID NO: 111451 - DNA, 25 bp, Homo sapien
gtgtcatctcttctctggaggtcaa

SEQ ID NO: 111452 - DNA, 25 bp, Homo sapien
gtcatctcttctctggaggtcaatg

SEQ ID NO: 111453 - DNA, 25 bp, Homo sapien
catctcttctctggaggtcaatggt

SEQ ID NO: 111454 - DNA, 25 bp, Homo sapien
tgagcaagggccttggaatccttga

SEQ ID NO: 111455 - DNA, 25 bp, Homo sapien
ggaatccttgagaatcacatttatg

SEQ ID NO: 111456 - DNA, 25 bp, Homo sapien
cacatttatgtgcttatgattacgg

SEQ ID NO: 111457 - DNA, 25 bp, Homo sapien
accttgttgaatctcagattcccca

SEQ ID NO: 111458 - DNA, 25 bp, Homo sapien
ttgttgaatctcagattccccattt

SEQ ID NO: 111459 - DNA, 25 bp, Homo sapien
gaaatactgtatgtgaagtgcctgg

SEQ ID NO: 111460 - DNA, 25 bp, Homo sapien
acagtgtctggtacatttgtgttta

SEQ ID NO: 111461 - DNA, 25 bp, Homo sapien
gtgtctggtacatttgtgtttaata

SEQ ID NO: 111462 - DNA, 25 bp, Homo sapien
aactgccaaccctggacactgcatt

SEQ ID NO: 111463 - DNA, 25 bp, Homo sapien
tggacactgcattacagacccgcca

SEQ ID NO: 111464 - DNA, 25 bp, Homo sapien
tgggccctcagtatcacccgaggag

SEQ ID NO: 111465 - DNA, 25 bp, Homo sapien
tcagtatcacccgaggagcaacagt

SEQ ID NO: 111466 - DNA, 25 bp, Homo sapien
agcaacagtgagtcgagcacctctt

SEQ ID NO: 111467 - DNA, 25 bp, Homo sapien
ggaggattactgcaatagtcccaaa

SEQ ID NO: 111468 - DNA, 25 bp, Homo sapien
tagtcccaaaagcaagctgcctcca

SEQ ID NO: 111469 - DNA, 25 bp, Homo sapien
gaacccccaggtgttttcttcagag

SEQ ID NO: 111470 - DNA, 25 bp, Homo sapien
aaacttggagctggccggcacccag

SEQ ID NO: 111471 - DNA, 25 bp, Homo sapien
accgacaacgatgactacgatgaca

SEQ ID NO: 111472 - DNA, 25 bp, Homo sapien
gactacgatgacatcagcgcagcct

SEQ ID NO: 111473 - DNA, 25 bp, Homo sapien
atttactctttctgtgcacgctcta

SEQ ID NO: 111474 - DNA, 25 bp, Homo sapien
tttactctttctgtgcacgctctat

SEQ ID NO: 111475 - DNA, 25 bp, Homo sapien
tactctttctgtgcacgctctatag

SEQ ID NO: 111476 - DNA, 25 bp, Homo sapien
tctttctgtgcacgctctatagcat

SEQ ID NO: 111477 - DNA, 25 bp, Homo sapien
ttctgtgcacgctctatagcatagg

SEQ ID NO: 111478 - DNA, 25 bp, Homo sapien
tgtgcacgctctatagcataggcag

SEQ ID NO: 111479 - DNA, 25 bp, Homo sapien
gcacgctctatagcataggcaggag

SEQ ID NO: 111480 - DNA, 25 bp, Homo sapien
gcttatgtggcagcacaagccaggt

SEQ ID NO: 111481 - DNA, 25 bp, Homo sapien
aagtaggagatattaaggcaccaaa

SEQ ID NO: 111482 - DNA, 25 bp, Homo sapien
aggacagtttccagttggctgaata

SEQ ID NO: 111483 - DNA, 25 bp, Homo sapien
ggctgaatagtcttttggcactgat

SEQ ID NO: 111484 - DNA, 25 bp, Homo sapien
aatatatttccattgtgaccagcag

SEQ ID NO: 111485 - DNA, 25 bp, Homo sapien
aagagctgtattttaagtatttaga

SEQ ID NO: 111486 - DNA, 25 bp, Homo sapien
agacagttctttgttagctggtttc

SEQ ID NO: 111487 - DNA, 25 bp, Homo sapien
gttctttgttagctggtttctagtt

SEQ ID NO: 111488 - DNA, 25 bp, Homo sapien
tagctggtttctagttggttatcta

SEQ ID NO: 111489 - DNA, 25 bp, Homo sapien
gttatctagttaccaatgctgcagt

SEQ ID NO: 111490 - DNA, 25 bp, Homo sapien
atctagttaccaatgctgcagtcct

SEQ ID NO: 111491 - DNA, 25 bp, Homo sapien
agttaccaatgctgcagtcctgcag

SEQ ID NO: 111492 - DNA, 25 bp, Homo sapien
agtcctgcagtcacctatacattat

SEQ ID NO: 111493 - DNA, 25 bp, Homo sapien
tgcagtcacctatacattatttaaa

SEQ ID NO: 111494 - DNA, 25 bp, Homo sapien
ttaactgttaaatgcgctacccacc

SEQ ID NO: 111495 - DNA, 25 bp, Homo sapien
aactctgagtggcaccaatgatgct

SEQ ID NO: 111496 - DNA, 25 bp, Homo sapien
gatgctgaagactgctgcctgtctg

SEQ ID NO: 111497 - DNA, 25 bp, Homo sapien
agaaacccatccctgggtacatcgt

SEQ ID NO: 111498 - DNA, 25 bp, Homo sapien
ggtacatcgtgaggaacttccacta

SEQ ID NO: 111499 - DNA, 25 bp, Homo sapien
ttccactaccttctcatcaaggatg

SEQ ID NO: 111500 - DNA, 25 bp, Homo sapien
ggtgcctgctgtagtgttcaccaca

SEQ ID NO: 111501 - DNA, 25 bp, Homo sapien
gggtagaacgcatcatccagagact

SEQ ID NO: 111502 - DNA, 25 bp, Homo sapien
gaggacctcagccaagatgaagcgc

SEQ ID NO: 111503 - DNA, 25 bp, Homo sapien
atgaagcgccgcagcagttaaccta

SEQ ID NO: 111504 - DNA, 25 bp, Homo sapien
gcagttaacctatgaccgtgcagag

SEQ ID NO: 111505 - DNA, 25 bp, Homo sapien
cccgagtccgagtcaagcattgtga

SEQ ID NO: 111506 - DNA, 25 bp, Homo sapien
aggatatacttagctacattttcag

SEQ ID NO: 111507 - DNA, 25 bp, Homo sapien
ttagctacattttcagtcagtatga

SEQ ID NO: 111508 - DNA, 25 bp, Homo sapien
gtcagtatgaacttcctgatacaaa

SEQ ID NO: 111509 - DNA, 25 bp, Homo sapien
gaacttcctgatacaaatgtaggga

SEQ ID NO: 111510 - DNA, 25 bp, Homo sapien
ttctcaccaactttcttatgtgtgt

SEQ ID NO: 111511 - DNA, 25 bp, Homo sapien
ccaactttcttatgtgtgttctttt

SEQ ID NO: 111512 - DNA, 25 bp, Homo sapien
acagttcaatctcaataagacctcg

SEQ ID NO: 111513 - DNA, 25 bp, Homo sapien
ataagacctcgcattatgtatgaat

SEQ ID NO: 111514 - DNA, 25 bp, Homo sapien
gaatgttattcactgactagattta

SEQ ID NO: 111515 - DNA, 25 bp, Homo sapien
actgactagatttattcataccatg

SEQ ID NO: 111516 - DNA, 25 bp, Homo sapien
gatttattcataccatgagacaaca

SEQ ID NO: 111517 - DNA, 25 bp, Homo sapien
acgcctgttcccagcaagtgctgaa

SEQ ID NO: 111518 - DNA, 25 bp, Homo sapien
gtgctgaaactcactagaccgtctg

SEQ ID NO: 111519 - DNA, 25 bp, Homo sapien
agaccgtctgcctgtttcgaaatgg

SEQ ID NO: 111520 - DNA, 25 bp, Homo sapien
aaagccgtgcgtgcgcgttatttat

SEQ ID NO: 111521 - DNA, 25 bp, Homo sapien
gggagcacactttgcaaagccacag

SEQ ID NO: 111522 - DNA, 25 bp, Homo sapien
tgcaaagccacagcgtttctggttt

SEQ ID NO: 111523 - DNA, 25 bp, Homo sapien
cagcgtttctggttttgggtgtaca

SEQ ID NO: 111524 - DNA, 25 bp, Homo sapien
tacagtcttgtgtgcctggcgagaa

SEQ ID NO: 111525 - DNA, 25 bp, Homo sapien
aagtcatttcatgtttctgtctggg

SEQ ID NO: 111526 - DNA, 25 bp, Homo sapien
atgtgggttgagaccagcactctgt

SEQ ID NO: 111527 - DNA, 25 bp, Homo sapien
cagcactctgtgaaaccttgaaatg

SEQ ID NO: 111528 - DNA, 25 bp, Homo sapien
tttcagccaattccactgatcctgt

SEQ ID NO: 111529 - DNA, 25 bp, Homo sapien
tcagccaattccactgatcctgtga

SEQ ID NO: 111530 - DNA, 25 bp, Homo sapien
cagccaattccactgatcctgtgaa

SEQ ID NO: 111531 - DNA, 25 bp, Homo sapien
agccaattccactgatcctgtgaag

SEQ ID NO: 111532 - DNA, 25 bp, Homo sapien
gccaattccactgatcctgtgaagg

SEQ ID NO: 111533 - DNA, 25 bp, Homo sapien
caattccactgatcctgtgaaggct

SEQ ID NO: 111534 - DNA, 25 bp, Homo sapien
aattccactgatcctgtgaaggctg

SEQ ID NO: 111535 - DNA, 25 bp, Homo sapien
attccactgatcctgtgaaggctgc

SEQ ID NO: 111536 - DNA, 25 bp, Homo sapien
ttccactgatcctgtgaaggctgcc

SEQ ID NO: 111537 - DNA, 25 bp, Homo sapien
cactgatcctgtgaaggctgcccaa

SEQ ID NO: 111538 - DNA, 25 bp, Homo sapien
actgatcctgtgaaggctgcccaat

SEQ ID NO: 111539 - DNA, 25 bp, Homo sapien
tgatgtccctatgccttatgcaaag

SEQ ID NO: 111540 - DNA, 25 bp, Homo sapien
aggacaactctatacctcaggtcaa

SEQ ID NO: 111541 - DNA, 25 bp, Homo sapien
aaatatgcgtaccattagaccaatg

SEQ ID NO: 111542 - DNA, 25 bp, Homo sapien
gaaaccatagaagccagtgtcatga

SEQ ID NO: 111543 - DNA, 25 bp, Homo sapien
caaatcatcttgtaactgtggaagg

SEQ ID NO: 111544 - DNA, 25 bp, Homo sapien
ctggccacagtttggagtaggagct

SEQ ID NO: 111545 - DNA, 25 bp, Homo sapien
ggagctgaaatctgtgccaggatca

SEQ ID NO: 111546 - DNA, 25 bp, Homo sapien
aaggtcctgcgttcaatttcctgga

SEQ ID NO: 111547 - DNA, 25 bp, Homo sapien
aatttcctggatgctcctgctgttc

SEQ ID NO: 111548 - DNA, 25 bp, Homo sapien
ctgctgttcgtgtcactggtgctga

SEQ ID NO: 111549 - DNA, 25 bp, Homo sapien
gtgtcactggtgctgatgtccctat

SEQ ID NO: 111550 - DNA, 25 bp, Homo sapien
tgggcatggtagcttgcacctctgt

SEQ ID NO: 111551 - DNA, 25 bp, Homo sapien
atggtagcttgcacctctgtcctag

SEQ ID NO: 111552 - DNA, 25 bp, Homo sapien
cacctctgtcctagctactgtggag

SEQ ID NO: 111553 - DNA, 25 bp, Homo sapien
atcagactccttgcctgagagagag

SEQ ID NO: 111554 - DNA, 25 bp, Homo sapien
cagactccttgcctgagagagagaa

SEQ ID NO: 111555 - DNA, 25 bp, Homo sapien
gagagaattatgatgctgctttgcc

SEQ ID NO: 111556 - DNA, 25 bp, Homo sapien
ttatgatgctgctttgcctttgctg

SEQ ID NO: 111557 - DNA, 25 bp, Homo sapien
atgctgctttgcctttgctgcaata

SEQ ID NO: 111558 - DNA, 25 bp, Homo sapien
gcctttgctgcaatatttaccagaa

SEQ ID NO: 111559 - DNA, 25 bp, Homo sapien
aaattagccataactttctcaggag

SEQ ID NO: 111560 - DNA, 25 bp, Homo sapien
ccataactttctcaggaggattgct

SEQ ID NO: 111561 - DNA, 25 bp, Homo sapien
tgatcctcacacttcagtatagcat

SEQ ID NO: 111562 - DNA, 25 bp, Homo sapien
cacttcagtatagcattggttcccc

SEQ ID NO: 111563 - DNA, 25 bp, Homo sapien
ccctgaccactttggagcactgttc

SEQ ID NO: 111564 - DNA, 25 bp, Homo sapien
ttctgggactccaggtcttgaggag

SEQ ID NO: 111565 - DNA, 25 bp, Homo sapien
actccaggtcttgaggagagagaca

SEQ ID NO: 111566 - DNA, 25 bp, Homo sapien
gagagaatggatcctcataggtcag

SEQ ID NO: 111567 - DNA, 25 bp, Homo sapien
atggatcctcataggtcagggagtg

SEQ ID NO: 111568 - DNA, 25 bp, Homo sapien
gcaaatgagccttaagaaatggttt

SEQ ID NO: 111569 - DNA, 25 bp, Homo sapien
gccacaggggattcttaggattttt

SEQ ID NO: 111570 - DNA, 25 bp, Homo sapien
ttaggatttttctacattctgtata

SEQ ID NO: 111571 - DNA, 25 bp, Homo sapien
ctgtatatttcttctcaaacctcca

SEQ ID NO: 111572 - DNA, 25 bp, Homo sapien
gccagctacaatcccatggtgctca

SEQ ID NO: 111573 - DNA, 25 bp, Homo sapien
agctacaatcccatggtgctcattc

SEQ ID NO: 111574 - DNA, 25 bp, Homo sapien
tacaatcccatggtgctcattcaaa

SEQ ID NO: 111575 - DNA, 25 bp, Homo sapien
caatcccatggtgctcattcaaaag

SEQ ID NO: 111576 - DNA, 25 bp, Homo sapien
gggtgtcgctccagacctatgatga

SEQ ID NO: 111577 - DNA, 25 bp, Homo sapien
ggtgtcgctccagacctatgatgac

SEQ ID NO: 111578 - DNA, 25 bp, Homo sapien
cctatgatgacttgttagccaaaga

SEQ ID NO: 111579 - DNA, 25 bp, Homo sapien
gatgacttgttagccaaagactgcc

SEQ ID NO: 111580 - DNA, 25 bp, Homo sapien
gacttgttagccaaagactgccact

SEQ ID NO: 111581 - DNA, 25 bp, Homo sapien
tgttagccaaagactgccactgcat

SEQ ID NO: 111582 - DNA, 25 bp, Homo sapien
tagccaaagactgccactgcatatg

SEQ ID NO: 111583 - DNA, 25 bp, Homo sapien
tcctccctgggacaatagtgtgcat

SEQ ID NO: 111584 - DNA, 25 bp, Homo sapien
gacaatagtgtgcatgccacccggg

SEQ ID NO: 111585 - DNA, 25 bp, Homo sapien
gcaggtagcctgtgtgtttgacaaa

SEQ ID NO: 111586 - DNA, 25 bp, Homo sapien
tgacaaacagcagctggcagcgctg

SEQ ID NO: 111587 - DNA, 25 bp, Homo sapien
acccgacatcaaagctggcgtgtga

SEQ ID NO: 111588 - DNA, 25 bp, Homo sapien
tcaaagctggcgtgtgacctttcca

SEQ ID NO: 111589 - DNA, 25 bp, Homo sapien
gtgacctttccagccatgcgatatt

SEQ ID NO: 111590 - DNA, 25 bp, Homo sapien
agccatgcgatattccccttggaag

SEQ ID NO: 111591 - DNA, 25 bp, Homo sapien
gatattccccttggaagatgcttcc

SEQ ID NO: 111592 - DNA, 25 bp, Homo sapien
aagatgcttccccaggctataaatt

SEQ ID NO: 111593 - DNA, 25 bp, Homo sapien
ccaggctataaatttgttctcacaa

SEQ ID NO: 111594 - DNA, 25 bp, Homo sapien
cagaaccaggctgaattccgcatgg

SEQ ID NO: 111595 - DNA, 25 bp, Homo sapien
agaaccaggctgaattccgcatggg

SEQ ID NO: 111596 - DNA, 25 bp, Homo sapien
gaaccaggctgaattccgcatgggt

SEQ ID NO: 111597 - DNA, 25 bp, Homo sapien
agctcgtggtctcagcatccctagg

SEQ ID NO: 111598 - DNA, 25 bp, Homo sapien
tcgtggtctcagcatccctaggcca

SEQ ID NO: 111599 - DNA, 25 bp, Homo sapien
gtggtctcagcatccctaggccaac

SEQ ID NO: 111600 - DNA, 25 bp, Homo sapien
tccctaggccaacacccccaggatt

SEQ ID NO: 111601 - DNA, 25 bp, Homo sapien
tctcatccgcatgggtgtggctggc

SEQ ID NO: 111602 - DNA, 25 bp, Homo sapien
cagagaagcctacaagatgcagccg

SEQ ID NO: 111603 - DNA, 25 bp, Homo sapien
gaagcctacaagatgcagccgggag

SEQ ID NO: 111604 - DNA, 25 bp, Homo sapien
ctacaagatgcagccgggaggtgaa

SEQ ID NO: 111605 - DNA, 25 bp, Homo sapien
agattattttatctggtatggtgct

SEQ ID NO: 111606 - DNA, 25 bp, Homo sapien
tatctggtatggtgctaatatttta

SEQ ID NO: 111607 - DNA, 25 bp, Homo sapien
gcaacttaacttaaaattgctaacg

SEQ ID NO: 111608 - DNA, 25 bp, Homo sapien
gagttgtgattgaaagtatgttgta

SEQ ID NO: 111609 - DNA, 25 bp, Homo sapien
aagtatgttgtatatggtattgtga

SEQ ID NO: 111610 - DNA, 25 bp, Homo sapien
attgtgagatgatttgtacttggaa

SEQ ID NO: 111611 - DNA, 25 bp, Homo sapien
ttgtacttggaagcattcacaaagt

SEQ ID NO: 111612 - DNA, 25 bp, Homo sapien
ggaagcattcacaaagtagcaccaa

SEQ ID NO: 111613 - DNA, 25 bp, Homo sapien
gcattcacaaagtagcaccaaataa

SEQ ID NO: 111614 - DNA, 25 bp, Homo sapien
aattacactttattctttaatgtca

SEQ ID NO: 111615 - DNA, 25 bp, Homo sapien
caatctacttttaaccaatattcaa

SEQ ID NO: 111616 - DNA, 25 bp, Homo sapien
agatcaggccgttgctgagctcaac

SEQ ID NO: 111617 - DNA, 25 bp, Homo sapien
tcaacgggacccaggtggagtctgt

SEQ ID NO: 111618 - DNA, 25 bp, Homo sapien
gagtctgtacagctcaaagtcaaca

SEQ ID NO: 111619 - DNA, 25 bp, Homo sapien
atagcccgaaaacagcccatgctgg

SEQ ID NO: 111620 - DNA, 25 bp, Homo sapien
gccgctactggcaagtctgtctggg

SEQ ID NO: 111621 - DNA, 25 bp, Homo sapien
ctgtccagaacagccctaagggttg

SEQ ID NO: 111622 - DNA, 25 bp, Homo sapien
gttgccaccgggacaagaggaccca

SEQ ID NO: 111623 - DNA, 25 bp, Homo sapien
gaggacccagattgtctacagtgat

SEQ ID NO: 111624 - DNA, 25 bp, Homo sapien
ggaaaaccttgtggatggcttctag

SEQ ID NO: 111625 - DNA, 25 bp, Homo sapien
agagctggattccttgtgcctcata

SEQ ID NO: 111626 - DNA, 25 bp, Homo sapien
aactgtgccttcgtcacctatgaaa

SEQ ID NO: 111627 - DNA, 25 bp, Homo sapien
gttatgtactggatgctacagactt

SEQ ID NO: 111628 - DNA, 25 bp, Homo sapien
gctacagacttataacagcatagtg

SEQ ID NO: 111629 - DNA, 25 bp, Homo sapien
gtgaatggtaagactagtgcaaaac

SEQ ID NO: 111630 - DNA, 25 bp, Homo sapien
taaagaccattattgctaccaaatc

SEQ ID NO: 111631 - DNA, 25 bp, Homo sapien
tgctaccaaatcaatgtgactattt

SEQ ID NO: 111632 - DNA, 25 bp, Homo sapien
gtgactatttcatatgcattttgcc

SEQ ID NO: 111633 - DNA, 25 bp, Homo sapien
atcattagtgatcagctagctacct

SEQ ID NO: 111634 - DNA, 25 bp, Homo sapien
tgatcagctagctaccttctacttt

SEQ ID NO: 111635 - DNA, 25 bp, Homo sapien
catttttcaagtggattgttctctt

SEQ ID NO: 111636 - DNA, 25 bp, Homo sapien
gtatataacctgttgtctaaatttt

SEQ ID NO: 111637 - DNA, 25 bp, Homo sapien
taataaaccattctcctatatgaaa

SEQ ID NO: 111638 - DNA, 25 bp, Homo sapien
gtctccatcaacactgcgccgggta

SEQ ID NO: 111639 - DNA, 25 bp, Homo sapien
acactgcgccgggtaccatggacgg

SEQ ID NO: 111640 - DNA, 25 bp, Homo sapien
cgggtaccatggacggccccgtcag

SEQ ID NO: 111641 - DNA, 25 bp, Homo sapien
ctgtgcaccccatgagtagtgccca

SEQ ID NO: 111642 - DNA, 25 bp, Homo sapien
tgagtagtgcccacttgaggctggc

SEQ ID NO: 111643 - DNA, 25 bp, Homo sapien
ccctgacctcacctttgcaaagtta

SEQ ID NO: 111644 - DNA, 25 bp, Homo sapien
gacctcacctttgcaaagttacaga

SEQ ID NO: 111645 - DNA, 25 bp, Homo sapien
aagttacagatgcaccccaacattg

SEQ ID NO: 111646 - DNA, 25 bp, Homo sapien
gttacagatgcaccccaacattgag

SEQ ID NO: 111647 - DNA, 25 bp, Homo sapien
ccccgtgaatgcttacctgtgagat

SEQ ID NO: 111648 - DNA, 25 bp, Homo sapien
gaatgcttacctgtgagataaccac

SEQ ID NO: 111649 - DNA, 25 bp, Homo sapien
gcccagtatgcagctgatctccgta

SEQ ID NO: 111650 - DNA, 25 bp, Homo sapien
agtatgcagctgatctccgtagata

SEQ ID NO: 111651 - DNA, 25 bp, Homo sapien
tgcagctgatctccgtagatacatc

SEQ ID NO: 111652 - DNA, 25 bp, Homo sapien
acatgctgaccaggcctaggtatgg

SEQ ID NO: 111653 - DNA, 25 bp, Homo sapien
gctgaccaggcctaggtatgggaaa

SEQ ID NO: 111654 - DNA, 25 bp, Homo sapien
gcctaggtatgggaaaagacacaaa

SEQ ID NO: 111655 - DNA, 25 bp, Homo sapien
cgcatgctgctatccccagggagct

SEQ ID NO: 111656 - DNA, 25 bp, Homo sapien
tgctgctatccccagggagctcagc

SEQ ID NO: 111657 - DNA, 25 bp, Homo sapien
acctgcgtggctctgttactacagc

SEQ ID NO: 111658 - DNA, 25 bp, Homo sapien
tggctctgttactacagccactgct

SEQ ID NO: 111659 - DNA, 25 bp, Homo sapien
ctctgttactacagccactgctggg

SEQ ID NO: 111660 - DNA, 25 bp, Homo sapien
agggcagggactcgcgcccacggca

SEQ ID NO: 111661 - DNA, 25 bp, Homo sapien
gatgataaagatgaggcttgcggct

SEQ ID NO: 111662 - DNA, 25 bp, Homo sapien
tgataaagatgaggcttgcggctgt

SEQ ID NO: 111663 - DNA, 25 bp, Homo sapien
aagatgaggcttgcggctgtggccc

SEQ ID NO: 111664 - DNA, 25 bp, Homo sapien
aggcttgcggctgtggcccgctggt

SEQ ID NO: 111665 - DNA, 25 bp, Homo sapien
tggcccgctggtgggctgagccaca

SEQ ID NO: 111666 - DNA, 25 bp, Homo sapien
ggctgagccacaaggcccccgatgg

SEQ ID NO: 111667 - DNA, 25 bp, Homo sapien
gggtcagcactgtactccgttgctg

SEQ ID NO: 111668 - DNA, 25 bp, Homo sapien
gtcagcactgtactccgttgctgtt

SEQ ID NO: 111669 - DNA, 25 bp, Homo sapien
tcagcactgtactccgttgctgttt

SEQ ID NO: 111670 - DNA, 25 bp, Homo sapien
gcactgtactccgttgctgtttttt

SEQ ID NO: 111671 - DNA, 25 bp, Homo sapien
atacaatttctcactttgcatttag

SEQ ID NO: 111672 - DNA, 25 bp, Homo sapien
aatttctcactttgcatttagtcaa

SEQ ID NO: 111673 - DNA, 25 bp, Homo sapien
ttctcactttgcatttagtcaaaag

SEQ ID NO: 111674 - DNA, 25 bp, Homo sapien
gaacatgaaatgcttctttctcagt

SEQ ID NO: 111675 - DNA, 25 bp, Homo sapien
atgaaatgcttctttctcagtttat

SEQ ID NO: 111676 - DNA, 25 bp, Homo sapien
tgcttctttctcagtttattggttg

SEQ ID NO: 111677 - DNA, 25 bp, Homo sapien
cagtttattggttgaatgtgtatct

SEQ ID NO: 111678 - DNA, 25 bp, Homo sapien
gtgtatctatttgagtctggaaata

SEQ ID NO: 111679 - DNA, 25 bp, Homo sapien
taattagtttagtttgtggcttcat

SEQ ID NO: 111680 - DNA, 25 bp, Homo sapien
tagtttagtttgtggcttcatggaa

SEQ ID NO: 111681 - DNA, 25 bp, Homo sapien
agtttgtggcttcatggaaactccc

SEQ ID NO: 111682 - DNA, 25 bp, Homo sapien
ttttgggtctttgaacccttgcttg

SEQ ID NO: 111683 - DNA, 25 bp, Homo sapien
cccttgcttgcaataggtgtgcgtc

SEQ ID NO: 111684 - DNA, 25 bp, Homo sapien
aggtgtgcgtcagaagcacccagga

SEQ ID NO: 111685 - DNA, 25 bp, Homo sapien
gcacccaggacttccatttgctttg

SEQ ID NO: 111686 - DNA, 25 bp, Homo sapien
aggacttccatttgctttgtcccgg

SEQ ID NO: 111687 - DNA, 25 bp, Homo sapien
gaacaagttggcctgcactggtgtt

SEQ ID NO: 111688 - DNA, 25 bp, Homo sapien
tggcctgcactggtgttttgttgtg

SEQ ID NO: 111689 - DNA, 25 bp, Homo sapien
gtaggacataccagcttagatttta

SEQ ID NO: 111690 - DNA, 25 bp, Homo sapien
gaaatgttcttgcagttaagggtta

SEQ ID NO: 111691 - DNA, 25 bp, Homo sapien
aagggttagtttacaatcagccaca

SEQ ID NO: 111692 - DNA, 25 bp, Homo sapien
tacaatcagccacattctaggtagg

SEQ ID NO: 111693 - DNA, 25 bp, Homo sapien
aaaggttcaggtaggcgctggctga

SEQ ID NO: 111694 - DNA, 25 bp, Homo sapien
gctgctgaagagacaatgaccacca

SEQ ID NO: 111695 - DNA, 25 bp, Homo sapien
tgaagagacaatgaccaccagcccg

SEQ ID NO: 111696 - DNA, 25 bp, Homo sapien
aagagacaatgaccaccagcccggg

SEQ ID NO: 111697 - DNA, 25 bp, Homo sapien
attacctctcatgcaccatcgtagg

SEQ ID NO: 111698 - DNA, 25 bp, Homo sapien
tctcatgcaccatcgtagggatcat

SEQ ID NO: 111699 - DNA, 25 bp, Homo sapien
caccatcgtagggatcatagttcta

SEQ ID NO: 111700 - DNA, 25 bp, Homo sapien
gggatcatagttctaattgtgcttc

SEQ ID NO: 111701 - DNA, 25 bp, Homo sapien
atagttctaattgtgcttctgattg

SEQ ID NO: 111702 - DNA, 25 bp, Homo sapien
gtttgaaagacttcactgtggaaga

SEQ ID NO: 111703 - DNA, 25 bp, Homo sapien
aagacttcactgtggaagaaattcc

SEQ ID NO: 111704 - DNA, 25 bp, Homo sapien
ccattgcaagcttcgtgaagaagta

SEQ ID NO: 111705 - DNA, 25 bp, Homo sapien
gaagaagtacaacacatatgcctat

SEQ ID NO: 111706 - DNA, 25 bp, Homo sapien
atatgcctatgtaggcctgactgag

SEQ ID NO: 111707 - DNA, 25 bp, Homo sapien
agccctggagacttccgctactcag

SEQ ID NO: 111708 - DNA, 25 bp, Homo sapien
ggacccctgtaaactacaccaactg

SEQ ID NO: 111709 - DNA, 25 bp, Homo sapien
taaactacaccaactggtaccgagg

SEQ ID NO: 111710 - DNA, 25 bp, Homo sapien
aaaagagcagtgtgtggagatgtac

SEQ ID NO: 111711 - DNA, 25 bp, Homo sapien
gatgtacacagatgggcagtggaat

SEQ ID NO: 111712 - DNA, 25 bp, Homo sapien
atgacaggaactgcctgtactcccg

SEQ ID NO: 111713 - DNA, 25 bp, Homo sapien
tgtactcccgactgaccatctgtga

SEQ ID NO: 111714 - DNA, 25 bp, Homo sapien
ctgagaggcatttaggccatgggac

SEQ ID NO: 111715 - DNA, 25 bp, Homo sapien
gggtaatctataacacatcataagg

SEQ ID NO: 111716 - DNA, 25 bp, Homo sapien
aagaattaagaggatgctgggctct

SEQ ID NO: 111717 - DNA, 25 bp, Homo sapien
gattctatttaattgaaactctctg

SEQ ID NO: 111718 - DNA, 25 bp, Homo sapien
aagcaataactttgtctcgttcctg

SEQ ID NO: 111719 - DNA, 25 bp, Homo sapien
aataactttgtctcgttcctgttgg

SEQ ID NO: 111720 - DNA, 25 bp, Homo sapien
tttgtctcgttcctgttgggctgaa

SEQ ID NO: 111721 - DNA, 25 bp, Homo sapien
ttcctgttgggctgaaccctaaggt

SEQ ID NO: 111722 - DNA, 25 bp, Homo sapien
tgaaccctaaggtgagtgtgcagta

SEQ ID NO: 111723 - DNA, 25 bp, Homo sapien
gatttggaattgaactctctgcctg

SEQ ID NO: 111724 - DNA, 25 bp, Homo sapien
ttggaattgaactctctgcctgtaa

SEQ ID NO: 111725 - DNA, 25 bp, Homo sapien
ccccaaataattgttgtgtgtatga

SEQ ID NO: 111726 - DNA, 25 bp, Homo sapien
ctgggatgcctgtcttgagtagact

SEQ ID NO: 111727 - DNA, 25 bp, Homo sapien
gtcttgagtagacttggacccaaaa

SEQ ID NO: 111728 - DNA, 25 bp, Homo sapien
tgagtagacttggacccaaaaaatc

SEQ ID NO: 111729 - DNA, 25 bp, Homo sapien
tggacccaaaaaatcatctcacctt

SEQ ID NO: 111730 - DNA, 25 bp, Homo sapien
aaaaatcatctcaccttgagcccac

SEQ ID NO: 111731 - DNA, 25 bp, Homo sapien
cccaccccattgtctaatctgtaga

SEQ ID NO: 111732 - DNA, 25 bp, Homo sapien
ccctgggaggccagctaggaagcaa

SEQ ID NO: 111733 - DNA, 25 bp, Homo sapien
gtgggatctcagacccagtagctgc

SEQ ID NO: 111734 - DNA, 25 bp, Homo sapien
gctgaaccacagaaatcacagtcaa

SEQ ID NO: 111735 - DNA, 25 bp, Homo sapien
cacagtcaatggatccacaaggcct

SEQ ID NO: 111736 - DNA, 25 bp, Homo sapien
atggatccacaaggcctgaggagca

SEQ ID NO: 111737 - DNA, 25 bp, Homo sapien
aagtgaccatgtgcatcggcgcgtg

SEQ ID NO: 111738 - DNA, 25 bp, Homo sapien
catgcacgcgcagatcaagacgagc

SEQ ID NO: 111739 - DNA, 25 bp, Homo sapien
tgcacgcgcagatcaagacgagcct

SEQ ID NO: 111740 - DNA, 25 bp, Homo sapien
gcacgcgcagatcaagacgagcctg

SEQ ID NO: 111741 - DNA, 25 bp, Homo sapien
gcgcagatcaagacgagcctgcacc

SEQ ID NO: 111742 - DNA, 25 bp, Homo sapien
atcaagacgagcctgcaccgcctga

SEQ ID NO: 111743 - DNA, 25 bp, Homo sapien
aagacgagcctgcaccgcctgaagc

SEQ ID NO: 111744 - DNA, 25 bp, Homo sapien
aatcccatggtgctcattcaaaaga

SEQ ID NO: 111745 - DNA, 25 bp, Homo sapien
gctcattcaaaagaccgacaccggg

SEQ ID NO: 111746 - DNA, 25 bp, Homo sapien
gggtgtcgctccagacctatgatga

SEQ ID NO: 111747 - DNA, 25 bp, Homo sapien
gccaaagactgccactgcatatgaa

SEQ ID NO: 111748 - DNA, 25 bp, Homo sapien
actgctgtcagccaagtcatggttg

SEQ ID NO: 111749 - DNA, 25 bp, Homo sapien
taaccatgtaggttcttgggaggga

SEQ ID NO: 111750 - DNA, 25 bp, Homo sapien
agcagggaatattttagaaccacaa

SEQ ID NO: 111751 - DNA, 25 bp, Homo sapien
tttagaaccacaagagatcagcagt

SEQ ID NO: 111752 - DNA, 25 bp, Homo sapien
gcagtggcaggacccttaggaatct

SEQ ID NO: 111753 - DNA, 25 bp, Homo sapien
aggaatctagtacaaccttgttgct

SEQ ID NO: 111754 - DNA, 25 bp, Homo sapien
ccttgttgctttaggtgagtcacac

SEQ ID NO: 111755 - DNA, 25 bp, Homo sapien
gttaatggcagcattcagaacttca

SEQ ID NO: 111756 - DNA, 25 bp, Homo sapien
gaacttcaagttctcttgatttctt

SEQ ID NO: 111757 - DNA, 25 bp, Homo sapien
ttgatttctttgttcccactgtccc

SEQ ID NO: 111758 - DNA, 25 bp, Homo sapien
aagaaactagtatctctggcctcct

SEQ ID NO: 111759 - DNA, 25 bp, Homo sapien
taaaggctccagtgtggtggcctat

SEQ ID NO: 111760 - DNA, 25 bp, Homo sapien
ggtggcctatgaaggacaatcctgg

SEQ ID NO: 111761 - DNA, 25 bp, Homo sapien
aaggacaatcctggcacgactactg

SEQ ID NO: 111762 - DNA, 25 bp, Homo sapien
acgactactgcttccactgcaaaaa

SEQ ID NO: 111763 - DNA, 25 bp, Homo sapien
gcttccactgcaaaaaatgctccgt

SEQ ID NO: 111764 - DNA, 25 bp, Homo sapien
aaaatgctccgtgaatctggccaac

SEQ ID NO: 111765 - DNA, 25 bp, Homo sapien
gaatctggccaacaagcgctttgtt

SEQ ID NO: 111766 - DNA, 25 bp, Homo sapien
caacaagcgctttgttttccaccag

SEQ ID NO: 111767 - DNA, 25 bp, Homo sapien
ggagcaagtgtattgtcccgactgt

SEQ ID NO: 111768 - DNA, 25 bp, Homo sapien
tgtattgtcccgactgtgccaaaaa

SEQ ID NO: 111769 - DNA, 25 bp, Homo sapien
tgtcccgactgtgccaaaaagctgt

SEQ ID NO: 111770 - DNA, 25 bp, Homo sapien
gtagcaaattaactttacatccttt

SEQ ID NO: 111771 - DNA, 25 bp, Homo sapien
tttcctacttgttatggttgtttgg

SEQ ID NO: 111772 - DNA, 25 bp, Homo sapien
ttgtttggaccgataagtgtgctta

SEQ ID NO: 111773 - DNA, 25 bp, Homo sapien
aagtgtgcttaatcctgaggcaaag

SEQ ID NO: 111774 - DNA, 25 bp, Homo sapien
gttgtaagtttttgattctactctt

SEQ ID NO: 111775 - DNA, 25 bp, Homo sapien
gattctactcttatatgctggactg

SEQ ID NO: 111776 - DNA, 25 bp, Homo sapien
gctggactgcattcacacatggcat

SEQ ID NO: 111777 - DNA, 25 bp, Homo sapien
aagtcaggttctttacaaatggtat

SEQ ID NO: 111778 - DNA, 25 bp, Homo sapien
atactggattgtgtttgtgccatat

SEQ ID NO: 111779 - DNA, 25 bp, Homo sapien
gtgtttgtgccatatttgtgccatt

SEQ ID NO: 111780 - DNA, 25 bp, Homo sapien
gttgcaacacattcatttggataag

SEQ ID NO: 111781 - DNA, 25 bp, Homo sapien
acccagagctgttcctgctttgagt

SEQ ID NO: 111782 - DNA, 25 bp, Homo sapien
agctgttcctgctttgagtttccct

SEQ ID NO: 111783 - DNA, 25 bp, Homo sapien
gagtttccctagagctgtgcggcca

SEQ ID NO: 111784 - DNA, 25 bp, Homo sapien
tgtgcggccagatagctgttcctga

SEQ ID NO: 111785 - DNA, 25 bp, Homo sapien
tgttcctgagttgcaagcacgatgg

SEQ ID NO: 111786 - DNA, 25 bp, Homo sapien
caagcacgatggagatttggacact

SEQ ID NO: 111787 - DNA, 25 bp, Homo sapien
aggctgtctgtgtccaggaaactta

SEQ ID NO: 111788 - DNA, 25 bp, Homo sapien
aaacttaattccctggtgactagag

SEQ ID NO: 111789 - DNA, 25 bp, Homo sapien
ggtgactagagctttgcctggtgat

SEQ ID NO: 111790 - DNA, 25 bp, Homo sapien
gatgaggagtattttgtggcataat

SEQ ID NO: 111791 - DNA, 25 bp, Homo sapien
attttccttcttacgtgaactgtat

SEQ ID NO: 111792 - DNA, 25 bp, Homo sapien
gctgtgatttatctgctgaaagctc

SEQ ID NO: 111793 - DNA, 25 bp, Homo sapien
tttatctgctgaaagctcagctggg

SEQ ID NO: 111794 - DNA, 25 bp, Homo sapien
ggttgtgcaagctagggacccattc

SEQ ID NO: 111795 - DNA, 25 bp, Homo sapien
gtgcaagctagggacccattcctgt

SEQ ID NO: 111796 - DNA, 25 bp, Homo sapien
aagctagggacccattcctgtgtaa

SEQ ID NO: 111797 - DNA, 25 bp, Homo sapien
ctagggacccattcctgtgtaatac

SEQ ID NO: 111798 - DNA, 25 bp, Homo sapien
gggacccattcctgtgtaatacaat

SEQ ID NO: 111799 - DNA, 25 bp, Homo sapien
gtaatacaatgtctgcaccaatgct

SEQ ID NO: 111800 - DNA, 25 bp, Homo sapien
acaatgtctgcaccaatgctaataa

SEQ ID NO: 111801 - DNA, 25 bp, Homo sapien
tgcaccaatgctaataaagtcctat

SEQ ID NO: 111802 - DNA, 25 bp, Homo sapien
tgctaataaagtcctattctctttt

SEQ ID NO: 111803 - DNA, 25 bp, Homo sapien
gaacttctaggcacatcgtgttatg

SEQ ID NO: 111804 - DNA, 25 bp, Homo sapien
aggcacatcgtgttatgaatatttt

SEQ ID NO: 111805 - DNA, 25 bp, Homo sapien
ttttcaccaagatgacataggacat

SEQ ID NO: 111806 - DNA, 25 bp, Homo sapien
atgacataggacatcttgcagaatg

SEQ ID NO: 111807 - DNA, 25 bp, Homo sapien
gcagaatgtcataggcaagttttac

SEQ ID NO: 111808 - DNA, 25 bp, Homo sapien
taggcaagttttacagacgagagaa

SEQ ID NO: 111809 - DNA, 25 bp, Homo sapien
atggttcttttatcacactacggag

SEQ ID NO: 111810 - DNA, 25 bp, Homo sapien
cactacggagtcgatggttcagttt

SEQ ID NO: 111811 - DNA, 25 bp, Homo sapien
tgaagtgtaacaggccttcagtaaa

SEQ ID NO: 111812 - DNA, 25 bp, Homo sapien
ttcccctctacctgctcaaagaaaa

SEQ ID NO: 111813 - DNA, 25 bp, Homo sapien
gcatatttaccacaagaacttctag

SEQ ID NO: 111814 - DNA, 25 bp, Homo sapien
agcatatgcaggaagcggcaggaat

SEQ ID NO: 111815 - DNA, 25 bp, Homo sapien
caggaataaggaaaagcagcctcct

SEQ ID NO: 111816 - DNA, 25 bp, Homo sapien
tgactttcctcgcttggtggtttga

SEQ ID NO: 111817 - DNA, 25 bp, Homo sapien
cgcttggtggtttgagtggacctcc

SEQ ID NO: 111818 - DNA, 25 bp, Homo sapien
cgggcccctcataggagaggaagct

SEQ ID NO: 111819 - DNA, 25 bp, Homo sapien
aagctcgggaggtggccaggcggca

SEQ ID NO: 111820 - DNA, 25 bp, Homo sapien
agcaatccgcgcgccgggacagaat

SEQ ID NO: 111821 - DNA, 25 bp, Homo sapien
agaatgccctgcaggaacttcttct

SEQ ID NO: 111822 - DNA, 25 bp, Homo sapien
tggaagaccttctcctcctgcaaat

SEQ ID NO: 111823 - DNA, 25 bp, Homo sapien
ctgcaaataaaacctcacccatgaa

SEQ ID NO: 111824 - DNA, 25 bp, Homo sapien
accggccgagacagcgagcatatgc

SEQ ID NO: 111825 - DNA, 25 bp, Homo sapien
gggtgctgagcttcggcacgtcctt

SEQ ID NO: 111826 - DNA, 25 bp, Homo sapien
gcacgtccttgccaccctgggagag

SEQ ID NO: 111827 - DNA, 25 bp, Homo sapien
gaagtggagcagctgttagctgggc

SEQ ID NO: 111828 - DNA, 25 bp, Homo sapien
ctgcatcaattatgaagcctttgtc

SEQ ID NO: 111829 - DNA, 25 bp, Homo sapien
ttatgaagcctttgtcaagcacatc

SEQ ID NO: 111830 - DNA, 25 bp, Homo sapien
cagggtgaagcagagtcttccaggt

SEQ ID NO: 111831 - DNA, 25 bp, Homo sapien
ttggctttagccataccagggtgag

SEQ ID NO: 111832 - DNA, 25 bp, Homo sapien
tttagccataccagggtgagttaaa

SEQ ID NO: 111833 - DNA, 25 bp, Homo sapien
gagatggagtcctcgacttatcacc

SEQ ID NO: 111834 - DNA, 25 bp, Homo sapien
atggagtcctcgacttatcaccaca

SEQ ID NO: 111835 - DNA, 25 bp, Homo sapien
ggccctccctgttaataaacagctc

SEQ ID NO: 111836 - DNA, 25 bp, Homo sapien
gttcatttctgtgtattttctaaac

SEQ ID NO: 111837 - DNA, 25 bp, Homo sapien
ttctaaacagctttacacccttggt

SEQ ID NO: 111838 - DNA, 25 bp, Homo sapien
tacacccttggtgccttggagcaaa

SEQ ID NO: 111839 - DNA, 25 bp, Homo sapien
ggtgccttggagcaaacatgttttt

SEQ ID NO: 111840 - DNA, 25 bp, Homo sapien
ttttgaaccttgtcatttttgtgaa

SEQ ID NO: 111841 - DNA, 25 bp, Homo sapien
gattccttctctcatcaacgggaaa

SEQ ID NO: 111842 - DNA, 25 bp, Homo sapien
gaaagtacttcctctgagagtgcga

SEQ ID NO: 111843 - DNA, 25 bp, Homo sapien
gagagtgcgagtgcaccatgctcac

SEQ ID NO: 111844 - DNA, 25 bp, Homo sapien
atgctcactgttgctgcgtgggaga

SEQ ID NO: 111845 - DNA, 25 bp, Homo sapien
gggagagtcacaagccactggcaag

SEQ ID NO: 111846 - DNA, 25 bp, Homo sapien
agcaagtggtatagtctgtgaagca

SEQ ID NO: 111847 - DNA, 25 bp, Homo sapien
gagcactctgaatttgttgttggtt

SEQ ID NO: 111848 - DNA, 25 bp, Homo sapien
tgttggttttatttctggctcccga

SEQ ID NO: 111849 - DNA, 25 bp, Homo sapien
tttctggctcccgagtaagcatgaa

SEQ ID NO: 111850 - DNA, 25 bp, Homo sapien
cagaatttcttcacttgactccagg

SEQ ID NO: 111851 - DNA, 25 bp, Homo sapien
gactccaggagttcagttggaagca

SEQ ID NO: 111852 - DNA, 25 bp, Homo sapien
aacagtacaatagcccacaagaagt

SEQ ID NO: 111853 - DNA, 25 bp, Homo sapien
aacgaggttccgatatcatcattgt

SEQ ID NO: 111854 - DNA, 25 bp, Homo sapien
tctcagcagctgatcgtctggaagc

SEQ ID NO: 111855 - DNA, 25 bp, Homo sapien
cttgggaagcgtatttgagtagact

SEQ ID NO: 111856 - DNA, 25 bp, Homo sapien
gtagacttggtgtttgagtgcttca

SEQ ID NO: 111857 - DNA, 25 bp, Homo sapien
gtttgagtgcttcagatacattttt

SEQ ID NO: 111858 - DNA, 25 bp, Homo sapien
gcctgtgcccatatggtcatccaaa

SEQ ID NO: 111859 - DNA, 25 bp, Homo sapien
tggactggcccagcgtaaatgaccc

SEQ ID NO: 111860 - DNA, 25 bp, Homo sapien
gtaaatgaccccactgcagcagaaa

SEQ ID NO: 111861 - DNA, 25 bp, Homo sapien
aacacacgaggagcatgcagcgaat

SEQ ID NO: 111862 - DNA, 25 bp, Homo sapien
gcagcgaattcagaaagaggtcttt

SEQ ID NO: 111863 - DNA, 25 bp, Homo sapien
ggaaaccgaaactgacttgctcacc

SEQ ID NO: 111864 - DNA, 25 bp, Homo sapien
gaaactgacttgctcacctggaaca

SEQ ID NO: 111865 - DNA, 25 bp, Homo sapien
ttctccagaccccagaactagaaac

SEQ ID NO: 111866 - DNA, 25 bp, Homo sapien
actagcagctttggcctccatattg

SEQ ID NO: 111867 - DNA, 25 bp, Homo sapien
gcctccatattgctctcatttcaag

SEQ ID NO: 111868 - DNA, 25 bp, Homo sapien
tttcaagcagatctgcttttctgca

SEQ ID NO: 111869 - DNA, 25 bp, Homo sapien
gacagagtctcattaatggctgcca

SEQ ID NO: 111870 - DNA, 25 bp, Homo sapien
acagagtctcattaatggctgccac

SEQ ID NO: 111871 - DNA, 25 bp, Homo sapien
ttaatggctgccacaatagagacac

SEQ ID NO: 111872 - DNA, 25 bp, Homo sapien
taatggctgccacaatagagacact

SEQ ID NO: 111873 - DNA, 25 bp, Homo sapien
aatggctgccacaatagagacactg

SEQ ID NO: 111874 - DNA, 25 bp, Homo sapien
atggctgccacaatagagacactga

SEQ ID NO: 111875 - DNA, 25 bp, Homo sapien
tggctgccacaatagagacactgag

SEQ ID NO: 111876 - DNA, 25 bp, Homo sapien
ggctgccacaatagagacactgaga

SEQ ID NO: 111877 - DNA, 25 bp, Homo sapien
gctgccacaatagagacactgagaa

SEQ ID NO: 111878 - DNA, 25 bp, Homo sapien
ctgccacaatagagacactgagaaa

SEQ ID NO: 111879 - DNA, 25 bp, Homo sapien
tgccacaatagagacactgagaaaa

SEQ ID NO: 111880 - DNA, 25 bp, Homo sapien
acgagctccgagacagtgacagtgt

SEQ ID NO: 111881 - DNA, 25 bp, Homo sapien
gggcgtggagacatccttccgcaaa

SEQ ID NO: 111882 - DNA, 25 bp, Homo sapien
ttccgcaaactcagctttaccgagt

SEQ ID NO: 111883 - DNA, 25 bp, Homo sapien
tttaccgagtctctgaccagtggtg

SEQ ID NO: 111884 - DNA, 25 bp, Homo sapien
gtggtgcctcactgctaactctcaa

SEQ ID NO: 111885 - DNA, 25 bp, Homo sapien
actctcaacaaaatgccccatgatt

SEQ ID NO: 111886 - DNA, 25 bp, Homo sapien
tgattatgggcaggaaggacctcta

SEQ ID NO: 111887 - DNA, 25 bp, Homo sapien
aatttagcctgctgacaatttccca

SEQ ID NO: 111888 - DNA, 25 bp, Homo sapien
tgacaatttcccacaccgtgtaaac

SEQ ID NO: 111889 - DNA, 25 bp, Homo sapien
aagccctaaaattcactgcgttgtc

SEQ ID NO: 111890 - DNA, 25 bp, Homo sapien
aaattcactgcgttgtccacaagac

SEQ ID NO: 111891 - DNA, 25 bp, Homo sapien
ccatgatgctgcagccgggcccgca

SEQ ID NO: 111892 - DNA, 25 bp, Homo sapien
ggcccgcagctctacgacgtgatgg

SEQ ID NO: 111893 - DNA, 25 bp, Homo sapien
gcccgcagctctacgacgtgatgga

SEQ ID NO: 111894 - DNA, 25 bp, Homo sapien
gtgatggacgcggtcccagcgcggc

SEQ ID NO: 111895 - DNA, 25 bp, Homo sapien
gctggaaggagttcgtgcgcacgct

SEQ ID NO: 111896 - DNA, 25 bp, Homo sapien
tgcgcgaggcagagatcgaagccgt

SEQ ID NO: 111897 - DNA, 25 bp, Homo sapien
atcgaagccgtggaggtggagatcg

SEQ ID NO: 111898 - DNA, 25 bp, Homo sapien
cttccgagaccagcagtacgagatg

SEQ ID NO: 111899 - DNA, 25 bp, Homo sapien
ccgagaccagcagtacgagatgctc

SEQ ID NO: 111900 - DNA, 25 bp, Homo sapien
tcggagccgtttacgcggccctgga

SEQ ID NO: 111901 - DNA, 25 bp, Homo sapien
ccgtttacgcggccctggagcgcat

SEQ ID NO: 111902 - DNA, 25 bp, Homo sapien
cctaggcactaggatctctctgtgg

SEQ ID NO: 111903 - DNA, 25 bp, Homo sapien
aggcactaggatctctctgtggctt

SEQ ID NO: 111904 - DNA, 25 bp, Homo sapien
tgctgggtggtgtcacctctttctc

SEQ ID NO: 111905 - DNA, 25 bp, Homo sapien
tcacctctttctctgctttcagaga

SEQ ID NO: 111906 - DNA, 25 bp, Homo sapien
gcctttcctcagagtgcttcccaaa

SEQ ID NO: 111907 - DNA, 25 bp, Homo sapien
cttcccaaactgaggtcccatggca

SEQ ID NO: 111908 - DNA, 25 bp, Homo sapien
aaactgaggtcccatggcacactgt

SEQ ID NO: 111909 - DNA, 25 bp, Homo sapien
ggcacactgtcctgggaggcgttca

SEQ ID NO: 111910 - DNA, 25 bp, Homo sapien
acactgtcctgggaggcgttcagag

SEQ ID NO: 111911 - DNA, 25 bp, Homo sapien
gcgttcagagggttccatgatggac

SEQ ID NO: 111912 - DNA, 25 bp, Homo sapien
cagagggttccatgatggactaggt

SEQ ID NO: 111913 - DNA, 25 bp, Homo sapien
ggtctacaggcagatctccggtgta

SEQ ID NO: 111914 - DNA, 25 bp, Homo sapien
acaggcagatctccggtgtacacaa

SEQ ID NO: 111915 - DNA, 25 bp, Homo sapien
agatctccggtgtacacaagctcca

SEQ ID NO: 111916 - DNA, 25 bp, Homo sapien
gtgtacacaagctccagcagaccaa

SEQ ID NO: 111917 - DNA, 25 bp, Homo sapien
agcagaccaagttccggcagcagcc

SEQ ID NO: 111918 - DNA, 25 bp, Homo sapien
gcagcagcccaatgccgggaaaaag

SEQ ID NO: 111919 - DNA, 25 bp, Homo sapien
cgggaaaaagcaagaccacaccatt

SEQ ID NO: 111920 - DNA, 25 bp, Homo sapien
aagcaagaccacaccattgtggaca

SEQ ID NO: 111921 - DNA, 25 bp, Homo sapien
attgtggacacagtgctgatggcgc

SEQ ID NO: 111922 - DNA, 25 bp, Homo sapien
tggacgtacgggtgcccctctttat

SEQ ID NO: 111923 - DNA, 25 bp, Homo sapien
gggtgcccctctttatccggcctga

SEQ ID NO: 111924 - DNA, 25 bp, Homo sapien
gcagaccttccagacctccccagtg

SEQ ID NO: 111925 - DNA, 25 bp, Homo sapien
cagaccttccagacctccccagtga

SEQ ID NO: 111926 - DNA, 25 bp, Homo sapien
agaccttccagacctccccagtgac

SEQ ID NO: 111927 - DNA, 25 bp, Homo sapien
gaccttccagacctccccagtgaca

SEQ ID NO: 111928 - DNA, 25 bp, Homo sapien
accttccagacctccccagtgacag

SEQ ID NO: 111929 - DNA, 25 bp, Homo sapien
ccttccagacctccccagtgacagc

SEQ ID NO: 111930 - DNA, 25 bp, Homo sapien
cttccagacctccccagtgacagcc

SEQ ID NO: 111931 - DNA, 25 bp, Homo sapien
agtgacagcctccccagtcatctag

SEQ ID NO: 111932 - DNA, 25 bp, Homo sapien
gtgacagcctccccagtcatctagg

SEQ ID NO: 111933 - DNA, 25 bp, Homo sapien
agcccgggagcctgctggaccccag

SEQ ID NO: 111934 - DNA, 25 bp, Homo sapien
tcctcccagctggaaagctagggca

SEQ ID NO: 111935 - DNA, 25 bp, Homo sapien
gaaagctagggcaggtctccccaga

SEQ ID NO: 111936 - DNA, 25 bp, Homo sapien
cctgtcctgcctgtaaggggataca

SEQ ID NO: 111937 - DNA, 25 bp, Homo sapien
atacagagaagctccccgtctctgc

SEQ ID NO: 111938 - DNA, 25 bp, Homo sapien
gggtgcccttagtttggacatgctg

SEQ ID NO: 111939 - DNA, 25 bp, Homo sapien
gcccttagtttggacatgctgggta

SEQ ID NO: 111940 - DNA, 25 bp, Homo sapien
ggacatgctgggtagcaggactcca

SEQ ID NO: 111941 - DNA, 25 bp, Homo sapien
agcaggactccagggcgtgcacggt

SEQ ID NO: 111942 - DNA, 25 bp, Homo sapien
tgcacggtgagcagatgaggcccca

SEQ ID NO: 111943 - DNA, 25 bp, Homo sapien
agggggccatccttctcaatacagc

SEQ ID NO: 111944 - DNA, 25 bp, Homo sapien
ggagtcccagactcacgcaccctgg

SEQ ID NO: 111945 - DNA, 25 bp, Homo sapien
gagtcccagactcacgcaccctggg

SEQ ID NO: 111946 - DNA, 25 bp, Homo sapien
agtcccagactcacgcaccctgggc

SEQ ID NO: 111947 - DNA, 25 bp, Homo sapien
gtcccagactcacgcaccctgggcc

SEQ ID NO: 111948 - DNA, 25 bp, Homo sapien
tcccagactcacgcaccctgggcca

SEQ ID NO: 111949 - DNA, 25 bp, Homo sapien
cccagactcacgcaccctgggccac

SEQ ID NO: 111950 - DNA, 25 bp, Homo sapien
ccagactcacgcaccctgggccaca

SEQ ID NO: 111951 - DNA, 25 bp, Homo sapien
cagactcacgcaccctgggccacag

SEQ ID NO: 111952 - DNA, 25 bp, Homo sapien
agactcacgcaccctgggccacagg

SEQ ID NO: 111953 - DNA, 25 bp, Homo sapien
gactcacgcaccctgggccacaggg

SEQ ID NO: 111954 - DNA, 25 bp, Homo sapien
aaatgcatcaagatataggtgtcct

SEQ ID NO: 111955 - DNA, 25 bp, Homo sapien
ataggtgtccttgcattaccaacaa

SEQ ID NO: 111956 - DNA, 25 bp, Homo sapien
gtccttgcattaccaacaatccata

SEQ ID NO: 111957 - DNA, 25 bp, Homo sapien
ttacaaagccgcataccaaaagtag

SEQ ID NO: 111958 - DNA, 25 bp, Homo sapien
actaaagtttgagctgtcacagatg

SEQ ID NO: 111959 - DNA, 25 bp, Homo sapien
gtcacagatggtaggtcatttccaa

SEQ ID NO: 111960 - DNA, 25 bp, Homo sapien
atttccaaacttggcctggtgggag

SEQ ID NO: 111961 - DNA, 25 bp, Homo sapien
tgggaggaaaaatggcctgcagata

SEQ ID NO: 111962 - DNA, 25 bp, Homo sapien
gcagatagccaggtgacagactgtt

SEQ ID NO: 111963 - DNA, 25 bp, Homo sapien
gtgacagactgttacctgaggtttg

SEQ ID NO: 111964 - DNA, 25 bp, Homo sapien
gtgggacttaataaactgctatgag

SEQ ID NO: 111965 - DNA, 25 bp, Homo sapien
gaacacaggagattccagtctactt

SEQ ID NO: 111966 - DNA, 25 bp, Homo sapien
gattccagtctacttgagttagcat

SEQ ID NO: 111967 - DNA, 25 bp, Homo sapien
gttagcataatacagaagtcccctc

SEQ ID NO: 111968 - DNA, 25 bp, Homo sapien
tacagaagtcccctctactttaact

SEQ ID NO: 111969 - DNA, 25 bp, Homo sapien
aaagtaacctgaactaatctgatgt

SEQ ID NO: 111970 - DNA, 25 bp, Homo sapien
ctgtttccttgttccaatttgacaa

SEQ ID NO: 111971 - DNA, 25 bp, Homo sapien
gttccaatttgacaaaacccactgt

SEQ ID NO: 111972 - DNA, 25 bp, Homo sapien
tgttcttgtattgtattgcccaggg

SEQ ID NO: 111973 - DNA, 25 bp, Homo sapien
gggagctatcactgtacttgtagag

SEQ ID NO: 111974 - DNA, 25 bp, Homo sapien
tacttgtagagtggtgctgctttaa

SEQ ID NO: 111975 - DNA, 25 bp, Homo sapien
gagtggtgctgctttaattcataaa

SEQ ID NO: 111976 - DNA, 25 bp, Homo sapien
taagaccatgtaagggtatgttttt

SEQ ID NO: 111977 - DNA, 25 bp, Homo sapien
gtttgagtaacccacagaacatctg

SEQ ID NO: 111978 - DNA, 25 bp, Homo sapien
gaacatctgtgatctttctacagca

SEQ ID NO: 111979 - DNA, 25 bp, Homo sapien
ctgtgatctttctacagcagcttca

SEQ ID NO: 111980 - DNA, 25 bp, Homo sapien
agcagcttcagttttgtgccaacat

SEQ ID NO: 111981 - DNA, 25 bp, Homo sapien
agttttgtgccaacattccatgtat

SEQ ID NO: 111982 - DNA, 25 bp, Homo sapien
aaaactgatcttaagagcagactta

SEQ ID NO: 111983 - DNA, 25 bp, Homo sapien
gacttaaagtagctttgtacgcctt

SEQ ID NO: 111984 - DNA, 25 bp, Homo sapien
gctttgtacgccttaatgttcattt

SEQ ID NO: 111985 - DNA, 25 bp, Homo sapien
gagatactgtattatcagaccagga

SEQ ID NO: 111986 - DNA, 25 bp, Homo sapien
cagaccaggaggcattgctgtgaaa

SEQ ID NO: 111987 - DNA, 25 bp, Homo sapien
ggtttcttgctctccagagcccaaa

SEQ ID NO: 111988 - DNA, 25 bp, Homo sapien
ctctccagagcccaaagggacaaat

SEQ ID NO: 111989 - DNA, 25 bp, Homo sapien
aagtagggcaactcggtcctgcgat

SEQ ID NO: 111990 - DNA, 25 bp, Homo sapien
ggcaactcggtcctgcgattattaa

SEQ ID NO: 111991 - DNA, 25 bp, Homo sapien
ctcggtcctgcgattattaatccca

SEQ ID NO: 111992 - DNA, 25 bp, Homo sapien
ttattaatcccactccccacttatt

SEQ ID NO: 111993 - DNA, 25 bp, Homo sapien
ccacttattctagggcacacaaaca

SEQ ID NO: 111994 - DNA, 25 bp, Homo sapien
tagggcacacaaacactattttact

SEQ ID NO: 111995 - DNA, 25 bp, Homo sapien
acggcagaacagatttggttagttt

SEQ ID NO: 111996 - DNA, 25 bp, Homo sapien
aaatctatattcctgtatttttatt

SEQ ID NO: 111997 - DNA, 25 bp, Homo sapien
aataccaagttcatttgacttttat

SEQ ID NO: 111998 - DNA, 25 bp, Homo sapien
gccgagacagcgagcatatgcagga

SEQ ID NO: 111999 - DNA, 25 bp, Homo sapien
agcatatgcaggaagcggcaggaat

SEQ ID NO: 112000 - DNA, 25 bp, Homo sapien
caggaataaggaaaagcagcctcct

SEQ ID NO: 112001 - DNA, 25 bp, Homo sapien
tgactttcctcgcttggtggtttga

SEQ ID NO: 112002 - DNA, 25 bp, Homo sapien
ttcctcgcttggtggtttgagtgga

SEQ ID NO: 112003 - DNA, 25 bp, Homo sapien
cgcttggtggtttgagtggacctcc

SEQ ID NO: 112004 - DNA, 25 bp, Homo sapien
cgggcccctcataggagaggaagct

SEQ ID NO: 112005 - DNA, 25 bp, Homo sapien
aagctcgggaggtggccaggcggca

SEQ ID NO: 112006 - DNA, 25 bp, Homo sapien
agcaatccgcgcgccgggacagaat

SEQ ID NO: 112007 - DNA, 25 bp, Homo sapien
ctgcaaataaaacctcacccatgaa

SEQ ID NO: 112008 - DNA, 25 bp, Homo sapien
accggccgagacagcgagcatatgc

SEQ ID NO: 112009 - DNA, 25 bp, Homo sapien
gagaatctgctgtctttataatggg

SEQ ID NO: 112010 - DNA, 25 bp, Homo sapien
cggagtgtctaatctatcgtgtcaa

SEQ ID NO: 112011 - DNA, 25 bp, Homo sapien
atctatcgtgtcaaccccaaatttt

SEQ ID NO: 112012 - DNA, 25 bp, Homo sapien
cccaaatttttacgtatgagatcct

SEQ ID NO: 112013 - DNA, 25 bp, Homo sapien
atgagatcctttagtccacccaatg

SEQ ID NO: 112014 - DNA, 25 bp, Homo sapien
tagtccacccaatggctgacagtaa

SEQ ID NO: 112015 - DNA, 25 bp, Homo sapien
agcatctttaacacaactctttgtt

SEQ ID NO: 112016 - DNA, 25 bp, Homo sapien
gttcaaatgtactatggtctctttt

SEQ ID NO: 112017 - DNA, 25 bp, Homo sapien
agactcctagactcacttgttctca

SEQ ID NO: 112018 - DNA, 25 bp, Homo sapien
cacttgttctcactgtctgttttaa

SEQ ID NO: 112019 - DNA, 25 bp, Homo sapien
taatttaacccaggcatgcaatgct

SEQ ID NO: 112020 - DNA, 25 bp, Homo sapien
aatttggccaggaacagctcctttt

SEQ ID NO: 112021 - DNA, 25 bp, Homo sapien
ggaatcctgcagtgtatagtatggt

SEQ ID NO: 112022 - DNA, 25 bp, Homo sapien
gcacatgaatggcagcagtggtcac

SEQ ID NO: 112023 - DNA, 25 bp, Homo sapien
gcagcagtggtcacatgggacagat

SEQ ID NO: 112024 - DNA, 25 bp, Homo sapien
agatgaacatgaaccccatgcccat

SEQ ID NO: 112025 - DNA, 25 bp, Homo sapien
catgtctggcatgcctatgggtcct

SEQ ID NO: 112026 - DNA, 25 bp, Homo sapien
tgggtcctgatcagaaatactgctg

SEQ ID NO: 112027 - DNA, 25 bp, Homo sapien
atactgctgacatctctgcaccagg

SEQ ID NO: 112028 - DNA, 25 bp, Homo sapien
tctgcaccaggacctcttaaggaaa

SEQ ID NO: 112029 - DNA, 25 bp, Homo sapien
ggaaaccactgtacaaatgacactg

SEQ ID NO: 112030 - DNA, 25 bp, Homo sapien
gacactgcactaggattattgggaa

SEQ ID NO: 112031 - DNA, 25 bp, Homo sapien
tccccagcgtagtcaagggtggaca

SEQ ID NO: 112032 - DNA, 25 bp, Homo sapien
agtcaagggtggacactgcacgctc

SEQ ID NO: 112033 - DNA, 25 bp, Homo sapien
actgcacgctctggcatgatgggat

SEQ ID NO: 112034 - DNA, 25 bp, Homo sapien
tggcgaccgggcaagctttcttcct

SEQ ID NO: 112035 - DNA, 25 bp, Homo sapien
aagctttcttcctcgagatgctctg

SEQ ID NO: 112036 - DNA, 25 bp, Homo sapien
ctcgagatgctctgctgcttgagag

SEQ ID NO: 112037 - DNA, 25 bp, Homo sapien
tctgctgcttgagagctattgcttt

SEQ ID NO: 112038 - DNA, 25 bp, Homo sapien
gagagctattgctttgttaagatat

SEQ ID NO: 112039 - DNA, 25 bp, Homo sapien
tgtctttctgtaaggtggacttcca

SEQ ID NO: 112040 - DNA, 25 bp, Homo sapien
gattgaaagtcctagggtgattcta

SEQ ID NO: 112041 - DNA, 25 bp, Homo sapien
gggtgattctatttctgctgtgatt

SEQ ID NO: 112042 - DNA, 25 bp, Homo sapien
ctgcacattggtcattgtgaatatt

SEQ ID NO: 112043 - DNA, 25 bp, Homo sapien
ttttgccaaggctaatccaattatt

SEQ ID NO: 112044 - DNA, 25 bp, Homo sapien
tgccaaggctaatccaattattatt

SEQ ID NO: 112045 - DNA, 25 bp, Homo sapien
tgtaaatgtatcttggtgctgctga

SEQ ID NO: 112046 - DNA, 25 bp, Homo sapien
aaatgtatcttggtgctgctgaatt

SEQ ID NO: 112047 - DNA, 25 bp, Homo sapien
atgtatcttggtgctgctgaatttc

SEQ ID NO: 112048 - DNA, 25 bp, Homo sapien
gtaacataatgcactttagatatac

SEQ ID NO: 112049 - DNA, 25 bp, Homo sapien
tcaagtatgttgataaatgacacaa

SEQ ID NO: 112050 - DNA, 25 bp, Homo sapien
atgacacaatgaagtgtctctattt

SEQ ID NO: 112051 - DNA, 25 bp, Homo sapien
gattttcctttgtgcatgtaaaaat

SEQ ID NO: 112052 - DNA, 25 bp, Homo sapien
tttcctttgtgcatgtaaaaataac

SEQ ID NO: 112053 - DNA, 25 bp, Homo sapien
ggagcccctcatgctgagatggaag

SEQ ID NO: 112054 - DNA, 25 bp, Homo sapien
gctgagatggaagcagtcttccctg

SEQ ID NO: 112055 - DNA, 25 bp, Homo sapien
tggcctggttgtccttgcagctgta

SEQ ID NO: 112056 - DNA, 25 bp, Homo sapien
ctggttgtccttgcagctgtagtca

SEQ ID NO: 112057 - DNA, 25 bp, Homo sapien
ggttgtccttgcagctgtagtcact

SEQ ID NO: 112058 - DNA, 25 bp, Homo sapien
ttgcagctgtagtcactggagctgc

SEQ ID NO: 112059 - DNA, 25 bp, Homo sapien
cggtcgctgctgtgctgtggagaaa

SEQ ID NO: 112060 - DNA, 25 bp, Homo sapien
ctcacggcttgtaaattgtgaaaca

SEQ ID NO: 112061 - DNA, 25 bp, Homo sapien
ttgtgaaacagctgccctgtgtggg

SEQ ID NO: 112062 - DNA, 25 bp, Homo sapien
gactgagtggcaagtccctttgtga

SEQ ID NO: 112063 - DNA, 25 bp, Homo sapien
tgagtggcaagtccctttgtgactt

SEQ ID NO: 112064 - DNA, 25 bp, Homo sapien
ctggcctggtttcctcgagaggcac

SEQ ID NO: 112065 - DNA, 25 bp, Homo sapien
acactcctatggtcacagacttctg

SEQ ID NO: 112066 - DNA, 25 bp, Homo sapien
atggtcacagacttctggcctagga

SEQ ID NO: 112067 - DNA, 25 bp, Homo sapien
gtcacagacttctggcctaggaccc

SEQ ID NO: 112068 - DNA, 25 bp, Homo sapien
aggacccctcgccttcaggagaatc

SEQ ID NO: 112069 - DNA, 25 bp, Homo sapien
gccttcaggagaatctacacgcatg

SEQ ID NO: 112070 - DNA, 25 bp, Homo sapien
gatggagctgatccagtaacctcgg

SEQ ID NO: 112071 - DNA, 25 bp, Homo sapien
gagctgatccagtaacctcggagac

SEQ ID NO: 112072 - DNA, 25 bp, Homo sapien
cagtaacctcggagacgggaccctg

SEQ ID NO: 112073 - DNA, 25 bp, Homo sapien
ctcggagacgggaccctgcccagag

SEQ ID NO: 112074 - DNA, 25 bp, Homo sapien
gaagcctgggtgtcaagtgcctgca

SEQ ID NO: 112075 - DNA, 25 bp, Homo sapien
tgagacaagaaagaaaacgcccact

SEQ ID NO: 112076 - DNA, 25 bp, Homo sapien
gaaaacgcccactcctggatcttca

SEQ ID NO: 112077 - DNA, 25 bp, Homo sapien
tcctggatcttcacattgaactcaa

SEQ ID NO: 112078 - DNA, 25 bp, Homo sapien
gaactcaatggctacatgtatgatt

SEQ ID NO: 112079 - DNA, 25 bp, Homo sapien
atgattggaacagcagagtttctgc

SEQ ID NO: 112080 - DNA, 25 bp, Homo sapien
agcagagtttctgccaaggagaaat

SEQ ID NO: 112081 - DNA, 25 bp, Homo sapien
gaaatattatgtctggctgcagcac

SEQ ID NO: 112082 - DNA, 25 bp, Homo sapien
tggctgcagcacactctgagaaaga

SEQ ID NO: 112083 - DNA, 25 bp, Homo sapien
gagaaagaaacttatcctctcctac

SEQ ID NO: 112084 - DNA, 25 bp, Homo sapien
taagaaaccaaaaggctgggcgtag

SEQ ID NO: 112085 - DNA, 25 bp, Homo sapien
catggtaaacgctgtccctagtaaa

SEQ ID NO: 112086 - DNA, 25 bp, Homo sapien
aatgccctactcttatttacactga

SEQ ID NO: 112087 - DNA, 25 bp, Homo sapien
gccctactcttatttacactgatgg

SEQ ID NO: 112088 - DNA, 25 bp, Homo sapien
ctactcttatttacactgatggttt

SEQ ID NO: 112089 - DNA, 25 bp, Homo sapien
accaccactcttaagtctctcttag

SEQ ID NO: 112090 - DNA, 25 bp, Homo sapien
caccactcttaagtctctcttagag

SEQ ID NO: 112091 - DNA, 25 bp, Homo sapien
accactcttaagtctctcttagagt

SEQ ID NO: 112092 - DNA, 25 bp, Homo sapien
atctttactggcagggcatcctcct

SEQ ID NO: 112093 - DNA, 25 bp, Homo sapien
tactggcagggcatcctcctatact

SEQ ID NO: 112094 - DNA, 25 bp, Homo sapien
gcagggcatcctcctatacttccat

SEQ ID NO: 112095 - DNA, 25 bp, Homo sapien
tcctcctatacttccatcctgatga

SEQ ID NO: 112096 - DNA, 25 bp, Homo sapien
gttcccaatcttatgccaccctcta

SEQ ID NO: 112097 - DNA, 25 bp, Homo sapien
tgtccaaggccccagactaaggacg

SEQ ID NO: 112098 - DNA, 25 bp, Homo sapien
ccccagactaaggacggcagcgaag

SEQ ID NO: 112099 - DNA, 25 bp, Homo sapien
aggacggcagcgaagcagagctccc

SEQ ID NO: 112100 - DNA, 25 bp, Homo sapien
aagcagagctccctcgttggtgcag

SEQ ID NO: 112101 - DNA, 25 bp, Homo sapien
agagctccctcgttggtgcagaggt

SEQ ID NO: 112102 - DNA, 25 bp, Homo sapien
ctcgttggtgcagaggttccctaag

SEQ ID NO: 112103 - DNA, 25 bp, Homo sapien
gttggtgcagaggttccctaagctc

SEQ ID NO: 112104 - DNA, 25 bp, Homo sapien
tgcagaggttccctaagctcctggg

SEQ ID NO: 112105 - DNA, 25 bp, Homo sapien
aagctcctgggcattcgtaagaact

SEQ ID NO: 112106 - DNA, 25 bp, Homo sapien
gcattcgtaagaactgagctcccag

SEQ ID NO: 112107 - DNA, 25 bp, Homo sapien
gtaagaactgagctcccagctcttc

SEQ ID NO: 112108 - DNA, 25 bp, Homo sapien
acgctgtggcatcctgagtgctttg

SEQ ID NO: 112109 - DNA, 25 bp, Homo sapien
agtgctttgtgtgccgggaatgctt

SEQ ID NO: 112110 - DNA, 25 bp, Homo sapien
gggaatgcttcacgccattcgtgaa

SEQ ID NO: 112111 - DNA, 25 bp, Homo sapien
attcgtgaacggcagcttcttcgag

SEQ ID NO: 112112 - DNA, 25 bp, Homo sapien
agcttcttcgagcacgacgggcagc

SEQ ID NO: 112113 - DNA, 25 bp, Homo sapien
tactgtgaggtgcactaccacgagc

SEQ ID NO: 112114 - DNA, 25 bp, Homo sapien
gttctggctgccagaagcccatcac

SEQ ID NO: 112115 - DNA, 25 bp, Homo sapien
tggccaagaagttccaccccgagca

SEQ ID NO: 112116 - DNA, 25 bp, Homo sapien
aagcagctcaacaagggcaccttca

SEQ ID NO: 112117 - DNA, 25 bp, Homo sapien
ggcaccttcaaggagcagaacgaca

SEQ ID NO: 112118 - DNA, 25 bp, Homo sapien
gacaagccttactgtcagaactgct

SEQ ID NO: 112119 - DNA, 25 bp, Homo sapien
tggactggaagctccctccgcggtc

SEQ ID NO: 112120 - DNA, 25 bp, Homo sapien
ctccctccgcggtcggattctggag

SEQ ID NO: 112121 - DNA, 25 bp, Homo sapien
ttggcctgcagtaagcggtgctgac

SEQ ID NO: 112122 - DNA, 25 bp, Homo sapien
tggccacagaggtcaggcctcctga

SEQ ID NO: 112123 - DNA, 25 bp, Homo sapien
ggtcaggcctcctgaaaacagcact

SEQ ID NO: 112124 - DNA, 25 bp, Homo sapien
aacccaccgtgattcatcttctgaa

SEQ ID NO: 112125 - DNA, 25 bp, Homo sapien
ccaccgtgattcatcttctgaagct

SEQ ID NO: 112126 - DNA, 25 bp, Homo sapien
atcttctgaagctgggagtgaaact

SEQ ID NO: 112127 - DNA, 25 bp, Homo sapien
agtgaaactgggtcagctgtaacct

SEQ ID NO: 112128 - DNA, 25 bp, Homo sapien
aactgggtcagctgtaacctgttcc

SEQ ID NO: 112129 - DNA, 25 bp, Homo sapien
gggtcagctgtaacctgttcctatt

SEQ ID NO: 112130 - DNA, 25 bp, Homo sapien
catgcacgcgcagatcaagacgagc

SEQ ID NO: 112131 - DNA, 25 bp, Homo sapien
atgcacgcgcagatcaagacgagcc

SEQ ID NO: 112132 - DNA, 25 bp, Homo sapien
tgcacgcgcagatcaagacgagcct

SEQ ID NO: 112133 - DNA, 25 bp, Homo sapien
gcacgcgcagatcaagacgagcctg

SEQ ID NO: 112134 - DNA, 25 bp, Homo sapien
cacgcgcagatcaagacgagcctgc

SEQ ID NO: 112135 - DNA, 25 bp, Homo sapien
acgcgcagatcaagacgagcctgca

SEQ ID NO: 112136 - DNA, 25 bp, Homo sapien
gcgcagatcaagacgagcctgcacc

SEQ ID NO: 112137 - DNA, 25 bp, Homo sapien
cgcagatcaagacgagcctgcaccg

SEQ ID NO: 112138 - DNA, 25 bp, Homo sapien
atcaagacgagcctgcaccgcctga

SEQ ID NO: 112139 - DNA, 25 bp, Homo sapien
tcaagacgagcctgcaccgcctgaa

SEQ ID NO: 112140 - DNA, 25 bp, Homo sapien
aagacgagcctgcaccgcctgaagc

SEQ ID NO: 112141 - DNA, 25 bp, Homo sapien
aaggggccccgatgtgcacagctgc

SEQ ID NO: 112142 - DNA, 25 bp, Homo sapien
gtggcccgtccttggtgagtgcaca

SEQ ID NO: 112143 - DNA, 25 bp, Homo sapien
ccgtccttggtgagtgcacacactg

SEQ ID NO: 112144 - DNA, 25 bp, Homo sapien
ttggtgagtgcacacactgcgcgca

SEQ ID NO: 112145 - DNA, 25 bp, Homo sapien
gtgagtgcacacactgcgcgcacac

SEQ ID NO: 112146 - DNA, 25 bp, Homo sapien
cacgtgtctgtgctgtagatactgt

SEQ ID NO: 112147 - DNA, 25 bp, Homo sapien
gtctgtgctgtagatactgtatcaa

SEQ ID NO: 112148 - DNA, 25 bp, Homo sapien
agatactgtatcaaagtcccagcgt

SEQ ID NO: 112149 - DNA, 25 bp, Homo sapien
agtcccagcgtttagatggttaaca

SEQ ID NO: 112150 - DNA, 25 bp, Homo sapien
cccagcgtttagatggttaacatag

SEQ ID NO: 112151 - DNA, 25 bp, Homo sapien
cttctgtgtaaatgctgcttatttt

SEQ ID NO: 112152 - DNA, 25 bp, Homo sapien
taagctgatgcctggctaaaccgct

SEQ ID NO: 112153 - DNA, 25 bp, Homo sapien
tgcctggctaaaccgctttaatgtt

SEQ ID NO: 112154 - DNA, 25 bp, Homo sapien
tggaagtagaaactagctttacggg

SEQ ID NO: 112155 - DNA, 25 bp, Homo sapien
agaggttggccattagctttcgtca

SEQ ID NO: 112156 - DNA, 25 bp, Homo sapien
ggccattagctttcgtcatgctgtt

SEQ ID NO: 112157 - DNA, 25 bp, Homo sapien
ttcgtcatgctgttcaaagttttta

SEQ ID NO: 112158 - DNA, 25 bp, Homo sapien
tcggtttttaaaagactgacagtgt

SEQ ID NO: 112159 - DNA, 25 bp, Homo sapien
gttgctatgaaacagtccagccatt

SEQ ID NO: 112160 - DNA, 25 bp, Homo sapien
tatttttgttatctctcttctcaca

SEQ ID NO: 112161 - DNA, 25 bp, Homo sapien
gttatctctcttctcacaattatgc

SEQ ID NO: 112162 - DNA, 25 bp, Homo sapien
tctcacaattatgctccactggata

SEQ ID NO: 112163 - DNA, 25 bp, Homo sapien
agacaaagtggaactaagcctgctc

SEQ ID NO: 112164 - DNA, 25 bp, Homo sapien
ggaactaagcctgctccagtgtttc

SEQ ID NO: 112165 - DNA, 25 bp, Homo sapien
ccagtgtttcctcatcattgattat

SEQ ID NO: 112166 - DNA, 25 bp, Homo sapien
gctgtggatagcttgcattaattgt

SEQ ID NO: 112167 - DNA, 25 bp, Homo sapien
catcattggtagcttttatatgcaa

SEQ ID NO: 112168 - DNA, 25 bp, Homo sapien
gatgtatggtgtttttacactacaa

SEQ ID NO: 112169 - DNA, 25 bp, Homo sapien
acactacaaagaagtcccccatgtg

SEQ ID NO: 112170 - DNA, 25 bp, Homo sapien
ccccatgtggatatttcttatacta

SEQ ID NO: 112171 - DNA, 25 bp, Homo sapien
atactaattgtatcataaagccgtt

SEQ ID NO: 112172 - DNA, 25 bp, Homo sapien
cataaagccgtttattcttccttgt

SEQ ID NO: 112173 - DNA, 25 bp, Homo sapien
tcttccttgtaagaatcctttacta

SEQ ID NO: 112174 - DNA, 25 bp, Homo sapien
gggcctttgcccatggcaaggtcag

SEQ ID NO: 112175 - DNA, 25 bp, Homo sapien
atggcaaggtcagtgtggagtatac

SEQ ID NO: 112176 - DNA, 25 bp, Homo sapien
gatggtgtccatcagtaactacccc

SEQ ID NO: 112177 - DNA, 25 bp, Homo sapien
ttgacagtagtagaacctgttctga

SEQ ID NO: 112178 - DNA, 25 bp, Homo sapien
gaacctgttctgaaaccagaaactg

SEQ ID NO: 112179 - DNA, 25 bp, Homo sapien
aaccagaaactgttgatgtcacatc

SEQ ID NO: 112180 - DNA, 25 bp, Homo sapien
tgatgtcacatcctttgaccctggt

SEQ ID NO: 112181 - DNA, 25 bp, Homo sapien
gaccctggtctgagctgactgctgg

SEQ ID NO: 112182 - DNA, 25 bp, Homo sapien
agctgactgctggaagatgatcttt

SEQ ID NO: 112183 - DNA, 25 bp, Homo sapien
tgatctttctgcactgagactgtgg

SEQ ID NO: 112184 - DNA, 25 bp, Homo sapien
tctttctgcactgagactgtggagt

SEQ ID NO: 112185 - DNA, 25 bp, Homo sapien
caaccatccacccaagggaaatgga

SEQ ID NO: 112186 - DNA, 25 bp, Homo sapien
tggaaggcaagaaacacgaaggatc

SEQ ID NO: 112187 - DNA, 25 bp, Homo sapien
aacacgaaggatcatgtggtaactg

SEQ ID NO: 112188 - DNA, 25 bp, Homo sapien
agagccagctgtggggtccagactt

SEQ ID NO: 112189 - DNA, 25 bp, Homo sapien
agtattaccaccagactgactccag

SEQ ID NO: 112190 - DNA, 25 bp, Homo sapien
tattaccaccagactgactccagga

SEQ ID NO: 112191 - DNA, 25 bp, Homo sapien
ttaccaccagactgactccaggact

SEQ ID NO: 112192 - DNA, 25 bp, Homo sapien
accagactgactccaggactcactg

SEQ ID NO: 112193 - DNA, 25 bp, Homo sapien
acagaggtgacaaatgtgagggaca

SEQ ID NO: 112194 - DNA, 25 bp, Homo sapien
actggggcctttcttctccttgtag

SEQ ID NO: 112195 - DNA, 25 bp, Homo sapien
cttctccttgtaggggtctctcaga

SEQ ID NO: 112196 - DNA, 25 bp, Homo sapien
cagaaatttggcattgatcttaaac

SEQ ID NO: 112197 - DNA, 25 bp, Homo sapien
ttggcattgatcttaaactggaaca

SEQ ID NO: 112198 - DNA, 25 bp, Homo sapien
ttatttgaaaatgcatcacatgatg

SEQ ID NO: 112199 - DNA, 25 bp, Homo sapien
gtagcttataagagggcatatacag

SEQ ID NO: 112200 - DNA, 25 bp, Homo sapien
cagtgaagagtaagttttccctcct

SEQ ID NO: 112201 - DNA, 25 bp, Homo sapien
tgaagagtaagttttccctcctact

SEQ ID NO: 112202 - DNA, 25 bp, Homo sapien
gtaagttttccctcctactctcgat

SEQ ID NO: 112203 - DNA, 25 bp, Homo sapien
tactctcgatcttccagaagctgta

SEQ ID NO: 112204 - DNA, 25 bp, Homo sapien
ctctcgatcttccagaagctgtact

SEQ ID NO: 112205 - DNA, 25 bp, Homo sapien
gaagctgtacttttaccagtttctt

SEQ ID NO: 112206 - DNA, 25 bp, Homo sapien
ttgttttgcaaaagtgtatggtagg

SEQ ID NO: 112207 - DNA, 25 bp, Homo sapien
aaaagctctgtattgagaagggtca

SEQ ID NO: 112208 - DNA, 25 bp, Homo sapien
agctctgtattgagaagggtcatat

SEQ ID NO: 112209 - DNA, 25 bp, Homo sapien
agggtcatatttgctttctaggagg

SEQ ID NO: 112210 - DNA, 25 bp, Homo sapien
gtcatatttgctttctaggaggttt

SEQ ID NO: 112211 - DNA, 25 bp, Homo sapien
tgctttctaggaggtttgttgtttt

SEQ ID NO: 112212 - DNA, 25 bp, Homo sapien
gtagcccctctcaaaaggagtcttt

SEQ ID NO: 112213 - DNA, 25 bp, Homo sapien
gaatttgaagctgaaacctctttaa

SEQ ID NO: 112214 - DNA, 25 bp, Homo sapien
tgaagctgaaacctctttaaatctt

SEQ ID NO: 112215 - DNA, 25 bp, Homo sapien
gaaacctctttaaatcttcagaatg

SEQ ID NO: 112216 - DNA, 25 bp, Homo sapien
gggcgcaagccccaaatggaaaact

SEQ ID NO: 112217 - DNA, 25 bp, Homo sapien
gcaagccccaaatggaaaactgttt

SEQ ID NO: 112218 - DNA, 25 bp, Homo sapien
agagacccggcatggtccagacgaa

SEQ ID NO: 112219 - DNA, 25 bp, Homo sapien
catggtccagacgaaggagcagttt

SEQ ID NO: 112220 - DNA, 25 bp, Homo sapien
ggagcagtttgagttcgcgctgaca

SEQ ID NO: 112221 - DNA, 25 bp, Homo sapien
tgagttcgcgctgacagccgtggct

SEQ ID NO: 112222 - DNA, 25 bp, Homo sapien
tggctgaggaggtgaacgccatcct

SEQ ID NO: 112223 - DNA, 25 bp, Homo sapien
accccacggatgttgtcaggaatca

SEQ ID NO: 112224 - DNA, 25 bp, Homo sapien
tcatgatctgactttaattgtgtgt

SEQ ID NO: 112225 - DNA, 25 bp, Homo sapien
gtgtcttctattataactgcatagt

SEQ ID NO: 112226 - DNA, 25 bp, Homo sapien
actgcatagtaatagggcccttagc

SEQ ID NO: 112227 - DNA, 25 bp, Homo sapien
ttagctctcccgtagtcagcgcagt

SEQ ID NO: 112228 - DNA, 25 bp, Homo sapien
tagtcagcgcagtttagcagttaaa

SEQ ID NO: 112229 - DNA, 25 bp, Homo sapien
tgctgggttctcagttccagttccc

SEQ ID NO: 112230 - DNA, 25 bp, Homo sapien
agttccagttcccatcctttgattg

SEQ ID NO: 112231 - DNA, 25 bp, Homo sapien
ttccagttcccatcctttgattgat

SEQ ID NO: 112232 - DNA, 25 bp, Homo sapien
ccagttcccatcctttgattgatca

SEQ ID NO: 112233 - DNA, 25 bp, Homo sapien
agttcccatcctttgattgatcact

SEQ ID NO: 112234 - DNA, 25 bp, Homo sapien
ttcccatcctttgattgatcactct

SEQ ID NO: 112235 - DNA, 25 bp, Homo sapien
atcctttgattgatcactctccctg

SEQ ID NO: 112236 - DNA, 25 bp, Homo sapien
tttgattgatcactctccctgacat

SEQ ID NO: 112237 - DNA, 25 bp, Homo sapien
gattgatcactctccctgacatcca

SEQ ID NO: 112238 - DNA, 25 bp, Homo sapien
ctgacatccacctgtatgactttgt

SEQ ID NO: 112239 - DNA, 25 bp, Homo sapien
ctttgtcaccaaatgctgtcttctc

SEQ ID NO: 112240 - DNA, 25 bp, Homo sapien
gaagtttaacgaagccctccgtgag

SEQ ID NO: 112241 - DNA, 25 bp, Homo sapien
gaaaaccaaagtgaactggctggcc

SEQ ID NO: 112242 - DNA, 25 bp, Homo sapien
tggctggcccacaacgtgtccaaag

SEQ ID NO: 112243 - DNA, 25 bp, Homo sapien
tggcccacaacgtgtccaaagacaa

SEQ ID NO: 112244 - DNA, 25 bp, Homo sapien
agacaacaggcagtagtggctcctc

SEQ ID NO: 112245 - DNA, 25 bp, Homo sapien
aacaggcagtagtggctcctcccag

SEQ ID NO: 112246 - DNA, 25 bp, Homo sapien
gaccaagcacattggtcctaaaggg

SEQ ID NO: 112247 - DNA, 25 bp, Homo sapien
gcacctaacgggaaagaaccgacat

SEQ ID NO: 112248 - DNA, 25 bp, Homo sapien
aacgggaaagaaccgacatggctgc

SEQ ID NO: 112249 - DNA, 25 bp, Homo sapien
tgccttttgtttacactggttattt

SEQ ID NO: 112250 - DNA, 25 bp, Homo sapien
tttacactggttatttatttatgac

SEQ ID NO: 112251 - DNA, 25 bp, Homo sapien
cattgtttaggaagactggctggaa

SEQ ID NO: 112252 - DNA, 25 bp, Homo sapien
gactggctggaaacttattttaatc

SEQ ID NO: 112253 - DNA, 25 bp, Homo sapien
ttaatcacacccatgacaaactctc

SEQ ID NO: 112254 - DNA, 25 bp, Homo sapien
gacaaactctccagatctgtttacc

SEQ ID NO: 112255 - DNA, 25 bp, Homo sapien
gatctgtttaccatcattcaggaaa

SEQ ID NO: 112256 - DNA, 25 bp, Homo sapien
aaagcaatctggacggttcaagact

SEQ ID NO: 112257 - DNA, 25 bp, Homo sapien
ggttcaagactgagcaactccctga

SEQ ID NO: 112258 - DNA, 25 bp, Homo sapien
gagcaactccctgaatttttataca

SEQ ID NO: 112259 - DNA, 25 bp, Homo sapien
acacaaacaaatgtctgctgctcta

SEQ ID NO: 112260 - DNA, 25 bp, Homo sapien
gacaatctcaaatccaagcagcctt

SEQ ID NO: 112261 - DNA, 25 bp, Homo sapien
gcagccttctttattatctaccatg

SEQ ID NO: 112262 - DNA, 25 bp, Homo sapien
ctgcacattggtcattgtgaatatt

SEQ ID NO: 112263 - DNA, 25 bp, Homo sapien
ttttgccaaggctaatccaattatt

SEQ ID NO: 112264 - DNA, 25 bp, Homo sapien
tgccaaggctaatccaattattatt

SEQ ID NO: 112265 - DNA, 25 bp, Homo sapien
gtccattgatgtatttattttgtaa

SEQ ID NO: 112266 - DNA, 25 bp, Homo sapien
gtaaatgtatcttggtgctgctgaa

SEQ ID NO: 112267 - DNA, 25 bp, Homo sapien
atgtatcttggtgctgctgaatttc

SEQ ID NO: 112268 - DNA, 25 bp, Homo sapien
cttggtgctgctgaatttctatatt

SEQ ID NO: 112269 - DNA, 25 bp, Homo sapien
gtaacataatgcactttagatatac

SEQ ID NO: 112270 - DNA, 25 bp, Homo sapien
acaatgaagtgtctctattttgtgg

SEQ ID NO: 112271 - DNA, 25 bp, Homo sapien
gaatgcctaaatataattatccaaa

SEQ ID NO: 112272 - DNA, 25 bp, Homo sapien
gattttcctttgtgcatgtaaaaat

SEQ ID NO: 112273 - DNA, 25 bp, Homo sapien
atgcagcttcaactgcagcatctag

SEQ ID NO: 112274 - DNA, 25 bp, Homo sapien
gaatgctttcaagggtaaccagatt

SEQ ID NO: 112275 - DNA, 25 bp, Homo sapien
aatcatagcagcacttttcacagca

SEQ ID NO: 112276 - DNA, 25 bp, Homo sapien
tttcacagcatcagcagtcatctca

SEQ ID NO: 112277 - DNA, 25 bp, Homo sapien
gcagtcatctcactagttatgttca

SEQ ID NO: 112278 - DNA, 25 bp, Homo sapien
gtacatggactatatcgcacaacag

SEQ ID NO: 112279 - DNA, 25 bp, Homo sapien
caggtgctagttttgagaaggccca

SEQ ID NO: 112280 - DNA, 25 bp, Homo sapien
gaaggcccaacaggagtttgcaaca

SEQ ID NO: 112281 - DNA, 25 bp, Homo sapien
gagtttgcaacaggtgtgatgtcca

SEQ ID NO: 112282 - DNA, 25 bp, Homo sapien
gtgatgtccaacaaaactgtccaga

SEQ ID NO: 112283 - DNA, 25 bp, Homo sapien
gtccagaccgcagctgcaaatgcag

SEQ ID NO: 112284 - DNA, 25 bp, Homo sapien
tgaaccatgtgtggcaaacttgcag

SEQ ID NO: 112285 - DNA, 25 bp, Homo sapien
taacggactgcttttagttaaattg

SEQ ID NO: 112286 - DNA, 25 bp, Homo sapien
aagtcagctcttgtcaaaaggtcta

SEQ ID NO: 112287 - DNA, 25 bp, Homo sapien
ccgcctcaatcctaaaagcatgtca

SEQ ID NO: 112288 - DNA, 25 bp, Homo sapien
gtcaacaatccacatcagatgccat

SEQ ID NO: 112289 - DNA, 25 bp, Homo sapien
gatgccataaatatgaactgcagga

SEQ ID NO: 112290 - DNA, 25 bp, Homo sapien
gaactgcaggataaaatggtacaat

SEQ ID NO: 112291 - DNA, 25 bp, Homo sapien
aatggtacaatcttagtgaatggga

SEQ ID NO: 112292 - DNA, 25 bp, Homo sapien
aaaagagtttgctgtccttcttaga

SEQ ID NO: 112293 - DNA, 25 bp, Homo sapien
tgctgtccttcttagaatgttctaa

SEQ ID NO: 112294 - DNA, 25 bp, Homo sapien
ctaaaatgtcaaggcagttgcttgt

SEQ ID NO: 112295 - DNA, 25 bp, Homo sapien
tcaaaaattagtccctgcttccagg

SEQ ID NO: 112296 - DNA, 25 bp, Homo sapien
tgcttccaggcctgaagtcttctcc

SEQ ID NO: 112297 - DNA, 25 bp, Homo sapien
ggcctgaagtcttctcctccatgaa

SEQ ID NO: 112298 - DNA, 25 bp, Homo sapien
gtgggccattagatttggaggctac

SEQ ID NO: 112299 - DNA, 25 bp, Homo sapien
gccattagatttggaggctacctca

SEQ ID NO: 112300 - DNA, 25 bp, Homo sapien
tagatttggaggctacctcacctgg

SEQ ID NO: 112301 - DNA, 25 bp, Homo sapien
atttggaggctacctcacctgggca

SEQ ID NO: 112302 - DNA, 25 bp, Homo sapien
ttggaggctacctcacctgggcagg

SEQ ID NO: 112303 - DNA, 25 bp, Homo sapien
gctacctcacctgggcagggatgat

SEQ ID NO: 112304 - DNA, 25 bp, Homo sapien
ggaaaatccagaactcaaatgagcc

SEQ ID NO: 112305 - DNA, 25 bp, Homo sapien
ccagaactcaaatgagccccttcat

SEQ ID NO: 112306 - DNA, 25 bp, Homo sapien
cacgtgggacacagcacggaggaca

SEQ ID NO: 112307 - DNA, 25 bp, Homo sapien
cacagcacggaggacagtgactgat

SEQ ID NO: 112308 - DNA, 25 bp, Homo sapien
tggaggaatagggagattcaccgtt

SEQ ID NO: 112309 - DNA, 25 bp, Homo sapien
gggcagtgcaaaaagtgtgtaatta

SEQ ID NO: 112310 - DNA, 25 bp, Homo sapien
gggtaagactaccagacactttata

SEQ ID NO: 112311 - DNA, 25 bp, Homo sapien
gactaccagacactttatatatatc

SEQ ID NO: 112312 - DNA, 25 bp, Homo sapien
agacttaccattaactatttctatg

SEQ ID NO: 112313 - DNA, 25 bp, Homo sapien
cattaactatttctatgtgtgcaat

SEQ ID NO: 112314 - DNA, 25 bp, Homo sapien
gtgtgcaatttagtgttgtgtaacc

SEQ ID NO: 112315 - DNA, 25 bp, Homo sapien
ttgtgtaaccatcacactatccatt

SEQ ID NO: 112316 - DNA, 25 bp, Homo sapien
accatattaaacctctgtacccaat

SEQ ID NO: 112317 - DNA, 25 bp, Homo sapien
tcaagccactcacctacgacgacta

SEQ ID NO: 112318 - DNA, 25 bp, Homo sapien
tgcccatctacgtcatctataagtt

SEQ ID NO: 112319 - DNA, 25 bp, Homo sapien
gcccatctacgtcatctataagttc

SEQ ID NO: 112320 - DNA, 25 bp, Homo sapien
atctacgtcatctataagttcctca

SEQ ID NO: 112321 - DNA, 25 bp, Homo sapien
acgtcatctataagttcctcagcac

SEQ ID NO: 112322 - DNA, 25 bp, Homo sapien
cgtcatctataagttcctcagcacg

SEQ ID NO: 112323 - DNA, 25 bp, Homo sapien
atcagacagttccagttgcaacact

SEQ ID NO: 112324 - DNA, 25 bp, Homo sapien
gacagttccagttgcaacactggct

SEQ ID NO: 112325 - DNA, 25 bp, Homo sapien
agttccagttgcaacactggctggc

SEQ ID NO: 112326 - DNA, 25 bp, Homo sapien
ttccagttgcaacactggctggcca

SEQ ID NO: 112327 - DNA, 25 bp, Homo sapien
ggagaaggaggaacccccatgccaa

SEQ ID NO: 112328 - DNA, 25 bp, Homo sapien
gactcagccccaactaatgacacgg

SEQ ID NO: 112329 - DNA, 25 bp, Homo sapien
aatgacacggctgccaattctgctt

SEQ ID NO: 112330 - DNA, 25 bp, Homo sapien
ctgcttcacctcctgcagagactga

SEQ ID NO: 112331 - DNA, 25 bp, Homo sapien
tttcaactggttgcccttctgggca

SEQ ID NO: 112332 - DNA, 25 bp, Homo sapien
tctgggcaccgtctggctcaaagag

SEQ ID NO: 112333 - DNA, 25 bp, Homo sapien
gagatgttgttctatggcaagtaca

SEQ ID NO: 112334 - DNA, 25 bp, Homo sapien
tggttaacccaacgagctccctggc

SEQ ID NO: 112335 - DNA, 25 bp, Homo sapien
catgctttacgtctttgtgggccaa

SEQ ID NO: 112336 - DNA, 25 bp, Homo sapien
tttgtgggccaagacttccgagaga

SEQ ID NO: 112337 - DNA, 25 bp, Homo sapien
gccaagacttccgagagagactgat

SEQ ID NO: 112338 - DNA, 25 bp, Homo sapien
gagggccctgtctgaggactcagcc

SEQ ID NO: 112339 - DNA, 25 bp, Homo sapien
tttgagagactagactgaccccacc

SEQ ID NO: 112340 - DNA, 25 bp, Homo sapien
cttccttcagtgagcagaatcactg

SEQ ID NO: 112341 - DNA, 25 bp, Homo sapien
gcagaatcactgtggtcagtctcct

SEQ ID NO: 112342 - DNA, 25 bp, Homo sapien
ctgtcccagcttcagttcatgaata

SEQ ID NO: 112343 - DNA, 25 bp, Homo sapien
cagttcatgaatactcctgttcctc

SEQ ID NO: 112344 - DNA, 25 bp, Homo sapien
tcatgaatactcctgttcctccagt

SEQ ID NO: 112345 - DNA, 25 bp, Homo sapien
tgttcctccagtttcccatcctttg

SEQ ID NO: 112346 - DNA, 25 bp, Homo sapien
gggagcctggtatacatgcggcttc

SEQ ID NO: 112347 - DNA, 25 bp, Homo sapien
gtatacatgcggcttcattgccaat

SEQ ID NO: 112348 - DNA, 25 bp, Homo sapien
tgcggcttcattgccaataaatttc

SEQ ID NO: 112349 - DNA, 25 bp, Homo sapien
aaatttcatgcactttaaagtcctg

SEQ ID NO: 112350 - DNA, 25 bp, Homo sapien
aagctattatgcaagctggtaccag

SEQ ID NO: 112351 - DNA, 25 bp, Homo sapien
aggacaggcccctgtacttgtcatc

SEQ ID NO: 112352 - DNA, 25 bp, Homo sapien
ccctgtacttgtcatctatggtaaa

SEQ ID NO: 112353 - DNA, 25 bp, Homo sapien
tatggtaaaaacaaccggccctcag

SEQ ID NO: 112354 - DNA, 25 bp, Homo sapien
ccgggacagcagtggtaaccatgtg

SEQ ID NO: 112355 - DNA, 25 bp, Homo sapien
gacagcagtggtaaccatgtggtat

SEQ ID NO: 112356 - DNA, 25 bp, Homo sapien
agtggtaaccatgtggtattcggcg

SEQ ID NO: 112357 - DNA, 25 bp, Homo sapien
tgaccgtcctaggtgcggccgcaga

SEQ ID NO: 112358 - DNA, 25 bp, Homo sapien
gaccgtcctaggtgcggccgcagaa

SEQ ID NO: 112359 - DNA, 25 bp, Homo sapien
aggtgcggccgcagaacaaaaactc

SEQ ID NO: 112360 - DNA, 25 bp, Homo sapien
gcagaacaaaaactcatctcagaag

SEQ ID NO: 112361 - DNA, 25 bp, Homo sapien
gaagtttctatcagctctgatgcct

SEQ ID NO: 112362 - DNA, 25 bp, Homo sapien
tcttccctttccgagataacgtaga

SEQ ID NO: 112363 - DNA, 25 bp, Homo sapien
ggtgtggcgtacattgcggctccct

SEQ ID NO: 112364 - DNA, 25 bp, Homo sapien
tccggttctgctgctgacaaagttg

SEQ ID NO: 112365 - DNA, 25 bp, Homo sapien
aaagttgtgattgaggcctgcgacg

SEQ ID NO: 112366 - DNA, 25 bp, Homo sapien
ggcctgcgacgaactgggaatcatc

SEQ ID NO: 112367 - DNA, 25 bp, Homo sapien
tgggaatcatcctcgctcatacgaa

SEQ ID NO: 112368 - DNA, 25 bp, Homo sapien
ttcggctcttccaccactgatttta

SEQ ID NO: 112369 - DNA, 25 bp, Homo sapien
ccactgattttaccacacactgttt

SEQ ID NO: 112370 - DNA, 25 bp, Homo sapien
tggcttgcttatgtgtaggtgaaca

SEQ ID NO: 112371 - DNA, 25 bp, Homo sapien
gaacagtcacgcctgaaactttgag

SEQ ID NO: 112372 - DNA, 25 bp, Homo sapien
gaatcttcaaacaatgacgactgtt

SEQ ID NO: 112373 - DNA, 25 bp, Homo sapien
aatcttcaaacaatgacgactgtta

SEQ ID NO: 112374 - DNA, 25 bp, Homo sapien
cttcaaacaatgacgactgttacct

SEQ ID NO: 112375 - DNA, 25 bp, Homo sapien
ttcaaacaatgacgactgttacctt

SEQ ID NO: 112376 - DNA, 25 bp, Homo sapien
aacaatgacgactgttacctttttg

SEQ ID NO: 112377 - DNA, 25 bp, Homo sapien
acaatgacgactgttacctttttgc

SEQ ID NO: 112378 - DNA, 25 bp, Homo sapien
caatgacgactgttacctttttgca

SEQ ID NO: 112379 - DNA, 25 bp, Homo sapien
aatgacgactgttacctttttgcac

SEQ ID NO: 112380 - DNA, 25 bp, Homo sapien
atgacgactgttacctttttgcact

SEQ ID NO: 112381 - DNA, 25 bp, Homo sapien
tgacgactgttacctttttgcactg

SEQ ID NO: 112382 - DNA, 25 bp, Homo sapien
gacgactgttacctttttgcactgt

SEQ ID NO: 112383 - DNA, 25 bp, Homo sapien
aggacgaggatcaggtgcacatcat

SEQ ID NO: 112384 - DNA, 25 bp, Homo sapien
atagagcatgaccaactgtccttct

SEQ ID NO: 112385 - DNA, 25 bp, Homo sapien
ttctcctcgatcacagaccaggcag

SEQ ID NO: 112386 - DNA, 25 bp, Homo sapien
aatgagccttttgtggccacccagt

SEQ ID NO: 112387 - DNA, 25 bp, Homo sapien
acccagtcatctgcctgcgtggatg

SEQ ID NO: 112388 - DNA, 25 bp, Homo sapien
gtggatggccctgcaaaccattgag

SEQ ID NO: 112389 - DNA, 25 bp, Homo sapien
cagagagctctataagattgggatc

SEQ ID NO: 112390 - DNA, 25 bp, Homo sapien
gattgggatcacgtgttacctgcta

SEQ ID NO: 112391 - DNA, 25 bp, Homo sapien
tgttacctgctacttggccttattg

SEQ ID NO: 112392 - DNA, 25 bp, Homo sapien
ggccttattgccatgttggtagttc

SEQ ID NO: 112393 - DNA, 25 bp, Homo sapien
ggtagttctggaaaccttctgtgaa

SEQ ID NO: 112394 - DNA, 25 bp, Homo sapien
tggagtggccactggcacttgcctg

SEQ ID NO: 112395 - DNA, 25 bp, Homo sapien
agtggccactggcacttgcctgctg

SEQ ID NO: 112396 - DNA, 25 bp, Homo sapien
ttgcctgctgcttggagtgccccaa

SEQ ID NO: 112397 - DNA, 25 bp, Homo sapien
agtgccccaaggaggtggctgttaa

SEQ ID NO: 112398 - DNA, 25 bp, Homo sapien
tctctcctggagtctgaagcctgca

SEQ ID NO: 112399 - DNA, 25 bp, Homo sapien
ctggagtctgaagcctgcaggtccg

SEQ ID NO: 112400 - DNA, 25 bp, Homo sapien
ttcgggattccctggtgggcctcga

SEQ ID NO: 112401 - DNA, 25 bp, Homo sapien
tggtgggcctcgacgtcccttggat

SEQ ID NO: 112402 - DNA, 25 bp, Homo sapien
gacgtcccttggatcagaggtcatc

SEQ ID NO: 112403 - DNA, 25 bp, Homo sapien
cttggatcagaggtcatcccttcct

SEQ ID NO: 112404 - DNA, 25 bp, Homo sapien
acagggagaagttgagcaggtatca

SEQ ID NO: 112405 - DNA, 25 bp, Homo sapien
aactattattaggccgggtgcggtg

SEQ ID NO: 112406 - DNA, 25 bp, Homo sapien
ttgcagtgagcctcgatcctgtcac

SEQ ID NO: 112407 - DNA, 25 bp, Homo sapien
cagtgagcctcgatcctgtcactgc

SEQ ID NO: 112408 - DNA, 25 bp, Homo sapien
agtgagcctcgatcctgtcactgca

SEQ ID NO: 112409 - DNA, 25 bp, Homo sapien
gtgagcctcgatcctgtcactgcac

SEQ ID NO: 112410 - DNA, 25 bp, Homo sapien
tgagcctcgatcctgtcactgcact

SEQ ID NO: 112411 - DNA, 25 bp, Homo sapien
gagcctcgatcctgtcactgcactc

SEQ ID NO: 112412 - DNA, 25 bp, Homo sapien
agcctcgatcctgtcactgcactcc

SEQ ID NO: 112413 - DNA, 25 bp, Homo sapien
gcctcgatcctgtcactgcactcca

SEQ ID NO: 112414 - DNA, 25 bp, Homo sapien
aggatgataatcttgagcactataa

SEQ ID NO: 112415 - DNA, 25 bp, Homo sapien
gaattcaactgtgatggcaagagca

SEQ ID NO: 112416 - DNA, 25 bp, Homo sapien
aatgtagactatcttctcatccacg

SEQ ID NO: 112417 - DNA, 25 bp, Homo sapien
tcttctcatccacggaacagcagat

SEQ ID NO: 112418 - DNA, 25 bp, Homo sapien
gcacagattgctaaagctctggtta

SEQ ID NO: 112419 - DNA, 25 bp, Homo sapien
gctctggttaatgcacaagtggatt

SEQ ID NO: 112420 - DNA, 25 bp, Homo sapien
ccaggcaatgtggtactctgaccag

SEQ ID NO: 112421 - DNA, 25 bp, Homo sapien
tactctgaccagaaccacggcttat

SEQ ID NO: 112422 - DNA, 25 bp, Homo sapien
agaaccacggcttatccggcctgtc

SEQ ID NO: 112423 - DNA, 25 bp, Homo sapien
acgaaccacttatacacccacatga

SEQ ID NO: 112424 - DNA, 25 bp, Homo sapien
gcagtgtttctctttgtcagactaa

SEQ ID NO: 112425 - DNA, 25 bp, Homo sapien
gttttctctaacttctcaagtccct

SEQ ID NO: 112426 - DNA, 25 bp, Homo sapien
taacttctcaagtcccttgttttgt

SEQ ID NO: 112427 - DNA, 25 bp, Homo sapien
cttctcaagtcccttgttttgtgtt

SEQ ID NO: 112428 - DNA, 25 bp, Homo sapien
ttttcttgccaggtagataaaactg

SEQ ID NO: 112429 - DNA, 25 bp, Homo sapien
gattctgttgcatagactagtccta

SEQ ID NO: 112430 - DNA, 25 bp, Homo sapien
gttgcatagactagtcctatggaaa

SEQ ID NO: 112431 - DNA, 25 bp, Homo sapien
tcctatggaaaaaaccaaagcttcg

SEQ ID NO: 112432 - DNA, 25 bp, Homo sapien
caaagcttcgttagaatgtctgcct

SEQ ID NO: 112433 - DNA, 25 bp, Homo sapien
gcttcgttagaatgtctgccttact

SEQ ID NO: 112434 - DNA, 25 bp, Homo sapien
gttagaatgtctgccttactggttt

SEQ ID NO: 112435 - DNA, 25 bp, Homo sapien
agaatgtctgccttactggtttccc

SEQ ID NO: 112436 - DNA, 25 bp, Homo sapien
aagaatatcccgtggtccccaggag

SEQ ID NO: 112437 - DNA, 25 bp, Homo sapien
agcaccgtgaggcaaaaagtggcct

SEQ ID NO: 112438 - DNA, 25 bp, Homo sapien
gcaaaaagtggcctccaaccacagt

SEQ ID NO: 112439 - DNA, 25 bp, Homo sapien
aaccacagtcctttcagcagcgagt

SEQ ID NO: 112440 - DNA, 25 bp, Homo sapien
agtcctttcagcagcgagtctcgag

SEQ ID NO: 112441 - DNA, 25 bp, Homo sapien
agcagcgagtctcgagctctctcca

SEQ ID NO: 112442 - DNA, 25 bp, Homo sapien
gtgtgagaatggtgtttccggcccc

SEQ ID NO: 112443 - DNA, 25 bp, Homo sapien
tgagaatggtgtttccggcccctcc

SEQ ID NO: 112444 - DNA, 25 bp, Homo sapien
actgccccaggagcatagccaaatt

SEQ ID NO: 112445 - DNA, 25 bp, Homo sapien
caggagcatagccaaatttaccatt

SEQ ID NO: 112446 - DNA, 25 bp, Homo sapien
gccaaatttaccattgtaccaagag

SEQ ID NO: 112447 - DNA, 25 bp, Homo sapien
ggactcttatttattcccattgctc

SEQ ID NO: 112448 - DNA, 25 bp, Homo sapien
tgctctagggctttcggtttcccct

SEQ ID NO: 112449 - DNA, 25 bp, Homo sapien
cttcttccggtaggccgcgtagagg

SEQ ID NO: 112450 - DNA, 25 bp, Homo sapien
catgcaccgggtaggtttccgcggt

SEQ ID NO: 112451 - DNA, 25 bp, Homo sapien
tctgcttcgccctgtgctgtgttct

SEQ ID NO: 112452 - DNA, 25 bp, Homo sapien
tgctgtgttctccagctttgtagca

SEQ ID NO: 112453 - DNA, 25 bp, Homo sapien
tgttctccagctttgtagcagcagc

SEQ ID NO: 112454 - DNA, 25 bp, Homo sapien
agcagccttgacaaacccaggcgca

SEQ ID NO: 112455 - DNA, 25 bp, Homo sapien
ccaggcgcactgtaccaaggcaatg

SEQ ID NO: 112456 - DNA, 25 bp, Homo sapien
atgtaacttttgattttcggtcaat

SEQ ID NO: 112457 - DNA, 25 bp, Homo sapien
tgattttcggtcaatttaagttctt

SEQ ID NO: 112458 - DNA, 25 bp, Homo sapien
atcccagctcacttgcttaggttgt

SEQ ID NO: 112459 - DNA, 25 bp, Homo sapien
cttaggttgtcttgagcttattgct

SEQ ID NO: 112460 - DNA, 25 bp, Homo sapien
agttcgtggcaaagtctggaagcaa

SEQ ID NO: 112461 - DNA, 25 bp, Homo sapien
agcaaagaatatctagccctctgtt

SEQ ID NO: 112462 - DNA, 25 bp, Homo sapien
agccctctgttcaacaccaaacaat

SEQ ID NO: 112463 - DNA, 25 bp, Homo sapien
aatacacaatggaactagagcggct

SEQ ID NO: 112464 - DNA, 25 bp, Homo sapien
tagagcggctctatctacagatgtg

SEQ ID NO: 112465 - DNA, 25 bp, Homo sapien
gggagcattatgcagctggcaacaa

SEQ ID NO: 112466 - DNA, 25 bp, Homo sapien
atgcagctggcaacaaacctgacca

SEQ ID NO: 112467 - DNA, 25 bp, Homo sapien
aaacctgaccacatgattaagcctg

SEQ ID NO: 112468 - DNA, 25 bp, Homo sapien
taagcctgttgaagtcactgagtca

SEQ ID NO: 112469 - DNA, 25 bp, Homo sapien
aggggacatgatgatccaggttggc

SEQ ID NO: 112470 - DNA, 25 bp, Homo sapien
ggggacatgatgatccaggttggcc

SEQ ID NO: 112471 - DNA, 25 bp, Homo sapien
ggacatgatgatccaggttggccct

SEQ ID NO: 112472 - DNA, 25 bp, Homo sapien
gacatgatgatccaggttggccctg

SEQ ID NO: 112473 - DNA, 25 bp, Homo sapien
acatgatgatccaggttggccctga

SEQ ID NO: 112474 - DNA, 25 bp, Homo sapien
atgatgatccaggttggccctgaaa

SEQ ID NO: 112475 - DNA, 25 bp, Homo sapien
tgatgatccaggttggccctgaaac

SEQ ID NO: 112476 - DNA, 25 bp, Homo sapien
gatgatccaggttggccctgaaaca

SEQ ID NO: 112477 - DNA, 25 bp, Homo sapien
gtggaagaataccagcttccttatc

SEQ ID NO: 112478 - DNA, 25 bp, Homo sapien
ttccttatcatgacctagtgcccag

SEQ ID NO: 112479 - DNA, 25 bp, Homo sapien
tagtgcccagtgacccctcttatga

SEQ ID NO: 112480 - DNA, 25 bp, Homo sapien
gtgtgcatcaagaagttacgcccct

SEQ ID NO: 112481 - DNA, 25 bp, Homo sapien
attcccaaaccggtggagcagtgat

SEQ ID NO: 112482 - DNA, 25 bp, Homo sapien
gcagtgatgagtgtctaaggcagat

SEQ ID NO: 112483 - DNA, 25 bp, Homo sapien
gaatgctgggctcacaatcctgcat

SEQ ID NO: 112484 - DNA, 25 bp, Homo sapien
aatcctgcatcaaggctgacagccc

SEQ ID NO: 112485 - DNA, 25 bp, Homo sapien
cagccctgcgggttaagaaaacact

SEQ ID NO: 112486 - DNA, 25 bp, Homo sapien
acttgccaaaatgtcagagtcccag

SEQ ID NO: 112487 - DNA, 25 bp, Homo sapien
gagtcccaggacattaaactctgat

SEQ ID NO: 112488 - DNA, 25 bp, Homo sapien
gtctcccattctcatatgtagccct

SEQ ID NO: 112489 - DNA, 25 bp, Homo sapien
atatgtagccctcatgataatctgg

SEQ ID NO: 112490 - DNA, 25 bp, Homo sapien
gataatctgggcatctcgtgccagg

SEQ ID NO: 112491 - DNA, 25 bp, Homo sapien
aggctaccccttcatggtgactaac

SEQ ID NO: 112492 - DNA, 25 bp, Homo sapien
acatgaaagtccacgcttttgggaa

SEQ ID NO: 112493 - DNA, 25 bp, Homo sapien
gcagctgattttgtcactgtcttca

SEQ ID NO: 112494 - DNA, 25 bp, Homo sapien
tcacaactcgtgctgggcttgtaga

SEQ ID NO: 112495 - DNA, 25 bp, Homo sapien
ggcttgtagaccactgtcctggctg

SEQ ID NO: 112496 - DNA, 25 bp, Homo sapien
tgcctgataccctgcttggtcaaat

SEQ ID NO: 112497 - DNA, 25 bp, Homo sapien
tgcttggtcaaatcccggctgcttc

SEQ ID NO: 112498 - DNA, 25 bp, Homo sapien
gaaattccttcccactcatgttgtt

SEQ ID NO: 112499 - DNA, 25 bp, Homo sapien
gtcctcaagtcatgcccgaatttag

SEQ ID NO: 112500 - DNA, 25 bp, Homo sapien
tgcccgaatttagatgctggtcatt

SEQ ID NO: 112501 - DNA, 25 bp, Homo sapien
aaaaacccagcccacatgactagca

SEQ ID NO: 112502 - DNA, 25 bp, Homo sapien
cacatgactagcacgctgagctctg

SEQ ID NO: 112503 - DNA, 25 bp, Homo sapien
tggaggagggttgcagctcccacct

SEQ ID NO: 112504 - DNA, 25 bp, Homo sapien
cacctcagtttagtttttaattcag

SEQ ID NO: 112505 - DNA, 25 bp, Homo sapien
gcatcgttaccagagcgccttctgg

SEQ ID NO: 112506 - DNA, 25 bp, Homo sapien
tggtcctagccacgccctgtatgac

SEQ ID NO: 112507 - DNA, 25 bp, Homo sapien
acgccctgtatgaccgcgcaaatat

SEQ ID NO: 112508 - DNA, 25 bp, Homo sapien
tatgaccgcgcaaatatccccaaag

SEQ ID NO: 112509 - DNA, 25 bp, Homo sapien
caaagcttttgggtcctcaagtcat

SEQ ID NO: 112510 - DNA, 25 bp, Homo sapien
gaatgtgcttttagacggtctcaat

SEQ ID NO: 112511 - DNA, 25 bp, Homo sapien
gacggtctcaatctaaaagcacttc

SEQ ID NO: 112512 - DNA, 25 bp, Homo sapien
aaagggcaaccagcttgggtgctac

SEQ ID NO: 112513 - DNA, 25 bp, Homo sapien
aaccagcttgggtgctacctcagtg

SEQ ID NO: 112514 - DNA, 25 bp, Homo sapien
gcttgggtgctacctcagtgttgta

SEQ ID NO: 112515 - DNA, 25 bp, Homo sapien
cagtgttgtagtttctgatacttta

SEQ ID NO: 112516 - DNA, 25 bp, Homo sapien
gatactttatgtctttgctcaccct

SEQ ID NO: 112517 - DNA, 25 bp, Homo sapien
cctcatccccaaactacttgaaaag

SEQ ID NO: 112518 - DNA, 25 bp, Homo sapien
aaaagggcatttggcaccactctct

SEQ ID NO: 112519 - DNA, 25 bp, Homo sapien
tttggcaccactctctgaaacaaca

SEQ ID NO: 112520 - DNA, 25 bp, Homo sapien
acaacacagtcactctagcaaggcc

SEQ ID NO: 112521 - DNA, 25 bp, Homo sapien
cacgtgggacacagcacggaggaca

SEQ ID NO: 112522 - DNA, 25 bp, Homo sapien
cacagcacggaggacagtgactgat

SEQ ID NO: 112523 - DNA, 25 bp, Homo sapien
tggaggaatagggagattcaccgtt

SEQ ID NO: 112524 - DNA, 25 bp, Homo sapien
gggtaagactaccagacactttata

SEQ ID NO: 112525 - DNA, 25 bp, Homo sapien
agacttaccattaactatttctatg

SEQ ID NO: 112526 - DNA, 25 bp, Homo sapien
cattaactatttctatgtgtgcaat

SEQ ID NO: 112527 - DNA, 25 bp, Homo sapien
gtgtgcaatttagtgttgtgtaacc

SEQ ID NO: 112528 - DNA, 25 bp, Homo sapien
ttgtgtaaccatcacactatccatt

SEQ ID NO: 112529 - DNA, 25 bp, Homo sapien
cagaactttttcctcttaccatatt

SEQ ID NO: 112530 - DNA, 25 bp, Homo sapien
accatattaaacctctgtacccaat

SEQ ID NO: 112531 - DNA, 25 bp, Homo sapien
taaacagtaactctcactccttctt

SEQ ID NO: 112532 - DNA, 25 bp, Homo sapien
tctgaagtcagccttggtttggctt

SEQ ID NO: 112533 - DNA, 25 bp, Homo sapien
ttggtttggcttcctattctcaaga

SEQ ID NO: 112534 - DNA, 25 bp, Homo sapien
gtttggcttcctattctcaagaggt

SEQ ID NO: 112535 - DNA, 25 bp, Homo sapien
ggcttcctattctcaagaggtttgt

SEQ ID NO: 112536 - DNA, 25 bp, Homo sapien
gaagatttaatctcagattccttat

SEQ ID NO: 112537 - DNA, 25 bp, Homo sapien
tacatggtccattgctactcttgct

SEQ ID NO: 112538 - DNA, 25 bp, Homo sapien
atggtccattgctactcttgctgca

SEQ ID NO: 112539 - DNA, 25 bp, Homo sapien
ttgctactcttgctgcacttatgta

SEQ ID NO: 112540 - DNA, 25 bp, Homo sapien
actcttgctgcacttatgtaaacaa

SEQ ID NO: 112541 - DNA, 25 bp, Homo sapien
gcacttatgtaaacaatcagaccac

SEQ ID NO: 112542 - DNA, 25 bp, Homo sapien
atcagaccacatttgaagaaactcc

SEQ ID NO: 112543 - DNA, 25 bp, Homo sapien
ggcattagccctcacattagatcta

SEQ ID NO: 112544 - DNA, 25 bp, Homo sapien
gatctagttactgtggtatggctaa

SEQ ID NO: 112545 - DNA, 25 bp, Homo sapien
gtatggctaatacctgtcaacattt

SEQ ID NO: 112546 - DNA, 25 bp, Homo sapien
atttggaggcaatcctaccttgctt

SEQ ID NO: 112547 - DNA, 25 bp, Homo sapien
taccttgcttttgcttctagagctt

SEQ ID NO: 112548 - DNA, 25 bp, Homo sapien
gcttctagagcttagcatatctgat

SEQ ID NO: 112549 - DNA, 25 bp, Homo sapien
gcatatctgattgttgtcaggccat

SEQ ID NO: 112550 - DNA, 25 bp, Homo sapien
gttgtcaggccatattatcaatgtt

SEQ ID NO: 112551 - DNA, 25 bp, Homo sapien
tttggtactataaaagctttctgcc

SEQ ID NO: 112552 - DNA, 25 bp, Homo sapien
atgtgccaatcaatagcacccctac

SEQ ID NO: 112553 - DNA, 25 bp, Homo sapien
acacacctagccagctgtcaagggc

SEQ ID NO: 112554 - DNA, 25 bp, Homo sapien
tgtcagtgcccgcttcggtcactgg

SEQ ID NO: 112555 - DNA, 25 bp, Homo sapien
gcttcggtcactggcacaagaacaa

SEQ ID NO: 112556 - DNA, 25 bp, Homo sapien
ctggcacaagaacaaggctggcgta

SEQ ID NO: 112557 - DNA, 25 bp, Homo sapien
aagaacaaggctggcgtagaagccc

SEQ ID NO: 112558 - DNA, 25 bp, Homo sapien
ccggctcatcgtgtatgtcatgggc

SEQ ID NO: 112559 - DNA, 25 bp, Homo sapien
tcatcgtgtatgtcatgggcggtgt

SEQ ID NO: 112560 - DNA, 25 bp, Homo sapien
ccatgtcagagatgagggccgccta

SEQ ID NO: 112561 - DNA, 25 bp, Homo sapien
tgtcagagatgagggccgcctacga

SEQ ID NO: 112562 - DNA, 25 bp, Homo sapien
gtgaccagggccaccgagggaagtg

SEQ ID NO: 112563 - DNA, 25 bp, Homo sapien
atgacctgaaggcactggacaagaa

SEQ ID NO: 112564 - DNA, 25 bp, Homo sapien
aagctggaggacattgccctgccct

SEQ ID NO: 112565 - DNA, 25 bp, Homo sapien
gcagaccttccagacctccccagtg

SEQ ID NO: 112566 - DNA, 25 bp, Homo sapien
cagaccttccagacctccccagtga

SEQ ID NO: 112567 - DNA, 25 bp, Homo sapien
agaccttccagacctccccagtgac

SEQ ID NO: 112568 - DNA, 25 bp, Homo sapien
gaccttccagacctccccagtgaca

SEQ ID NO: 112569 - DNA, 25 bp, Homo sapien
accttccagacctccccagtgacag

SEQ ID NO: 112570 - DNA, 25 bp, Homo sapien
ccttccagacctccccagtgacagc

SEQ ID NO: 112571 - DNA, 25 bp, Homo sapien
cttccagacctccccagtgacagcc

SEQ ID NO: 112572 - DNA, 25 bp, Homo sapien
agtgacagcctccccagtcatctag

SEQ ID NO: 112573 - DNA, 25 bp, Homo sapien
gtgacagcctccccagtcatctagg

SEQ ID NO: 112574 - DNA, 25 bp, Homo sapien
aatcaattcaattgtcgcatcattc

SEQ ID NO: 112575 - DNA, 25 bp, Homo sapien
gtcgcatcattcatggttctttaat

SEQ ID NO: 112576 - DNA, 25 bp, Homo sapien
ggttctttaatattgatgctcagtg

SEQ ID NO: 112577 - DNA, 25 bp, Homo sapien
atgctcagtgcattggccttagaat

SEQ ID NO: 112578 - DNA, 25 bp, Homo sapien
attggccttagaatatcccagcctc

SEQ ID NO: 112579 - DNA, 25 bp, Homo sapien
ccagcctctcttctggtttggtgag

SEQ ID NO: 112580 - DNA, 25 bp, Homo sapien
agcatggtagaattgtttggagaca

SEQ ID NO: 112581 - DNA, 25 bp, Homo sapien
ggagacatatatagtgatccttggt

SEQ ID NO: 112582 - DNA, 25 bp, Homo sapien
ccttggtcactggtgtttcaaacat

SEQ ID NO: 112583 - DNA, 25 bp, Homo sapien
gtcactggtgtttcaaacattctgg

SEQ ID NO: 112584 - DNA, 25 bp, Homo sapien
ggaaagtcacatcgatcaagaatat

SEQ ID NO: 112585 - DNA, 25 bp, Homo sapien
tgtctttctgttctcttatctcttt

SEQ ID NO: 112586 - DNA, 25 bp, Homo sapien
gtccccggctgcttgtactcttggc

SEQ ID NO: 112587 - DNA, 25 bp, Homo sapien
tctgtgtctcctttctggctcttgc

SEQ ID NO: 112588 - DNA, 25 bp, Homo sapien
tgtgtctcctttctggctcttgcct

SEQ ID NO: 112589 - DNA, 25 bp, Homo sapien
ctcagctcctcctgctttcttgggt

SEQ ID NO: 112590 - DNA, 25 bp, Homo sapien
gctttcttgggtcccaccagtgtca

SEQ ID NO: 112591 - DNA, 25 bp, Homo sapien
ttgggtcccaccagtgtcacttttc

SEQ ID NO: 112592 - DNA, 25 bp, Homo sapien
tgtcacttttctgccgttttctttc

SEQ ID NO: 112593 - DNA, 25 bp, Homo sapien
gcttcattctcgtccagccattgct

SEQ ID NO: 112594 - DNA, 25 bp, Homo sapien
cccagttcaccaaaccttacatgtt

SEQ ID NO: 112595 - DNA, 25 bp, Homo sapien
gttcaccaaaccttacatgttgcaa

SEQ ID NO: 112596 - DNA, 25 bp, Homo sapien
atgttccagttataggccttgccag

SEQ ID NO: 112597 - DNA, 25 bp, Homo sapien
atggctgtgccctcttgatgtggtg

SEQ ID NO: 112598 - DNA, 25 bp, Homo sapien
tgtgccctcttgatgtggtgaggca

SEQ ID NO: 112599 - DNA, 25 bp, Homo sapien
ggctttgtttatagcttgcgcattc

SEQ ID NO: 112600 - DNA, 25 bp, Homo sapien
atagcttgcgcattctcatggagaa

SEQ ID NO: 112601 - DNA, 25 bp, Homo sapien
tcatggagaagttatcagacactct

SEQ ID NO: 112602 - DNA, 25 bp, Homo sapien
tatcagacactctggctggtttgga

SEQ ID NO: 112603 - DNA, 25 bp, Homo sapien
tggtttggaatgcttcttctcaggc

SEQ ID NO: 112604 - DNA, 25 bp, Homo sapien
cttcttctcaggcatgaacatgtac

SEQ ID NO: 112605 - DNA, 25 bp, Homo sapien
gaacactcatgctgaaagcccaagt

SEQ ID NO: 112606 - DNA, 25 bp, Homo sapien
ttcctccatctccaagaatgctgaa

SEQ ID NO: 112607 - DNA, 25 bp, Homo sapien
gaggtagaaaatcaattcaattgtc

SEQ ID NO: 112608 - DNA, 25 bp, Homo sapien
gaaaatcaattcaattgtcgcatca

SEQ ID NO: 112609 - DNA, 25 bp, Homo sapien
aatcaattcaattgtcgcatcattc

SEQ ID NO: 112610 - DNA, 25 bp, Homo sapien
atcattcatggttctttaatattga

SEQ ID NO: 112611 - DNA, 25 bp, Homo sapien
tcatggttctttaatattgatgctc

SEQ ID NO: 112612 - DNA, 25 bp, Homo sapien
catggttctttaatattgatgctca

SEQ ID NO: 112613 - DNA, 25 bp, Homo sapien
atggttctttaatattgatgctcag

SEQ ID NO: 112614 - DNA, 25 bp, Homo sapien
tggttctttaatattgatgctcagt

SEQ ID NO: 112615 - DNA, 25 bp, Homo sapien
ggttctttaatattgatgctcagtg

SEQ ID NO: 112616 - DNA, 25 bp, Homo sapien
gttctttaatattgatgctcagtgc

SEQ ID NO: 112617 - DNA, 25 bp, Homo sapien
ttctttaatattgatgctcagtgca

SEQ ID NO: 112618 - DNA, 25 bp, Homo sapien
aaagagccgcgtcccggcaagtccg

SEQ ID NO: 112619 - DNA, 25 bp, Homo sapien
aagtccggcggaattcaccagtgtt

SEQ ID NO: 112620 - DNA, 25 bp, Homo sapien
aattcaccagtgttcctgaagctgc

SEQ ID NO: 112621 - DNA, 25 bp, Homo sapien
tgctgtgtcctctagttgagtttct

SEQ ID NO: 112622 - DNA, 25 bp, Homo sapien
agttgagtttctggcgcccctgcct

SEQ ID NO: 112623 - DNA, 25 bp, Homo sapien
tgcccgcatgtgtgcctggccgcag

SEQ ID NO: 112624 - DNA, 25 bp, Homo sapien
tgccgagccaccatgcttgcctgaa

SEQ ID NO: 112625 - DNA, 25 bp, Homo sapien
gagccaccatgcttgcctgaagctt

SEQ ID NO: 112626 - DNA, 25 bp, Homo sapien
aagggtcctcttttcctggcagctg

SEQ ID NO: 112627 - DNA, 25 bp, Homo sapien
ctgccccgcagacggtctgtgtgct

SEQ ID NO: 112628 - DNA, 25 bp, Homo sapien
gcagacggtctgtgtgctgtttgaa

SEQ ID NO: 112629 - DNA, 25 bp, Homo sapien
gtggacgcggcgctttgcaaaacca

SEQ ID NO: 112630 - DNA, 25 bp, Homo sapien
gacgcggcgctttgcaaaaccaaaa

SEQ ID NO: 112631 - DNA, 25 bp, Homo sapien
cgcggcgctttgcaaaaccaaaaag

SEQ ID NO: 112632 - DNA, 25 bp, Homo sapien
aagacacagtgctgccgcgacgcgc

SEQ ID NO: 112633 - DNA, 25 bp, Homo sapien
agtgctgccgcgacgcgctattgag

SEQ ID NO: 112634 - DNA, 25 bp, Homo sapien
cgcgacgcgctattgagagggagga

SEQ ID NO: 112635 - DNA, 25 bp, Homo sapien
agggaggagggccagctgcagctgt

SEQ ID NO: 112636 - DNA, 25 bp, Homo sapien
tgcagctgtgttcccgtcataggga

SEQ ID NO: 112637 - DNA, 25 bp, Homo sapien
agctgtgttcccgtcatagggagag

SEQ ID NO: 112638 - DNA, 25 bp, Homo sapien
gtgttcccgtcatagggagagctga

SEQ ID NO: 112639 - DNA, 25 bp, Homo sapien
atagggagagctgagactccccgcc

SEQ ID NO: 112640 - DNA, 25 bp, Homo sapien
catacgctggacgagtcggaccgag

SEQ ID NO: 112641 - DNA, 25 bp, Homo sapien
agcagaagaacttcccgtgcgcgcg

SEQ ID NO: 112642 - DNA, 25 bp, Homo sapien
gaagaacttcccgtgcgcgcggatc

SEQ ID NO: 112643 - DNA, 25 bp, Homo sapien
gcggatcctcgctccgttgcacggg

SEQ ID NO: 112644 - DNA, 25 bp, Homo sapien
ttgcacgggcgccttaagttattgg

SEQ ID NO: 112645 - DNA, 25 bp, Homo sapien
gggcgccttaagttattggactatc

SEQ ID NO: 112646 - DNA, 25 bp, Homo sapien
attggactatctaatatctatgtat

SEQ ID NO: 112647 - DNA, 25 bp, Homo sapien
ctatgtatttatttcgctggttctt

SEQ ID NO: 112648 - DNA, 25 bp, Homo sapien
ttcgctggttctttgtagtcacata

SEQ ID NO: 112649 - DNA, 25 bp, Homo sapien
gtagtcacatattttatagtcttaa

SEQ ID NO: 112650 - DNA, 25 bp, Homo sapien
atagtcttaatatcttgtttttgca

SEQ ID NO: 112651 - DNA, 25 bp, Homo sapien
gatgatgctgtttctcaccattctg

SEQ ID NO: 112652 - DNA, 25 bp, Homo sapien
tgtttctcaccattctgggacttgg

SEQ ID NO: 112653 - DNA, 25 bp, Homo sapien
tctgggacttggtagtgctgtgtca

SEQ ID NO: 112654 - DNA, 25 bp, Homo sapien
gtgctgtgtcactcacaatctgtgg

SEQ ID NO: 112655 - DNA, 25 bp, Homo sapien
aaacaaggttccagaggatcgtgtt

SEQ ID NO: 112656 - DNA, 25 bp, Homo sapien
aacatatattcagctacttacagtg

SEQ ID NO: 112657 - DNA, 25 bp, Homo sapien
attcagctacttacagtgagttgga

SEQ ID NO: 112658 - DNA, 25 bp, Homo sapien
atgtctcctcccattgatttataag

SEQ ID NO: 112659 - DNA, 25 bp, Homo sapien
gaatcacgtgtccagaacactctga

SEQ ID NO: 112660 - DNA, 25 bp, Homo sapien
gaacactctgattcacagccaagga

SEQ ID NO: 112661 - DNA, 25 bp, Homo sapien
ctgattcacagccaaggatccagaa

SEQ ID NO: 112662 - DNA, 25 bp, Homo sapien
aaattagtattttctctgacatctc

SEQ ID NO: 112663 - DNA, 25 bp, Homo sapien
aattagtattttctctgacatctca

SEQ ID NO: 112664 - DNA, 25 bp, Homo sapien
tctctgacatctcatgacattgtct

SEQ ID NO: 112665 - DNA, 25 bp, Homo sapien
ctctgacatctcatgacattgtctt

SEQ ID NO: 112666 - DNA, 25 bp, Homo sapien
ctgacatctcatgacattgtcttta

SEQ ID NO: 112667 - DNA, 25 bp, Homo sapien
gacatctcatgacattgtctttatc

SEQ ID NO: 112668 - DNA, 25 bp, Homo sapien
acatctcatgacattgtctttatca

SEQ ID NO: 112669 - DNA, 25 bp, Homo sapien
tcatgacattgtctttatcatcctt

SEQ ID NO: 112670 - DNA, 25 bp, Homo sapien
catgacattgtctttatcatccttt

SEQ ID NO: 112671 - DNA, 25 bp, Homo sapien
atgacattgtctttatcatcctttc

SEQ ID NO: 112672 - DNA, 25 bp, Homo sapien
tgacattgtctttatcatcctttcc

SEQ ID NO: 112673 - DNA, 25 bp, Homo sapien
tgcctgacccactgttgcagaatga

SEQ ID NO: 112674 - DNA, 25 bp, Homo sapien
gttgcagaatgaagtcacctcgccc

SEQ ID NO: 112675 - DNA, 25 bp, Homo sapien
tgtcctgctcagcttgggccagtga

SEQ ID NO: 112676 - DNA, 25 bp, Homo sapien
agcttgggccagtgacaatctgcaa

SEQ ID NO: 112677 - DNA, 25 bp, Homo sapien
ggccagtgacaatctgcaaggctga

SEQ ID NO: 112678 - DNA, 25 bp, Homo sapien
gtgacaatctgcaaggctgaacaac

SEQ ID NO: 112679 - DNA, 25 bp, Homo sapien
tgcaaggctgaacaacagcccctgg

SEQ ID NO: 112680 - DNA, 25 bp, Homo sapien
cagtgttagagcagggctggtcata

SEQ ID NO: 112681 - DNA, 25 bp, Homo sapien
agagcagggctggtcataccctctg

SEQ ID NO: 112682 - DNA, 25 bp, Homo sapien
gctggtcataccctctggagttcag

SEQ ID NO: 112683 - DNA, 25 bp, Homo sapien
aagaggtaggaccagtgcttttttg

SEQ ID NO: 112684 - DNA, 25 bp, Homo sapien
gggctgagcatccatcactcctgtg

SEQ ID NO: 112685 - DNA, 25 bp, Homo sapien
tgagcatccatcactcctgtgcctg

SEQ ID NO: 112686 - DNA, 25 bp, Homo sapien
gcctaggtgggttgggcctgagaac

SEQ ID NO: 112687 - DNA, 25 bp, Homo sapien
ccagggcacgggtgtggtgtctgct

SEQ ID NO: 112688 - DNA, 25 bp, Homo sapien
tgtctgctgggctggagataagact

SEQ ID NO: 112689 - DNA, 25 bp, Homo sapien
gccgggctgggatgtcatctcctgc

SEQ ID NO: 112690 - DNA, 25 bp, Homo sapien
gctgggatgtcatctcctgccgggc

SEQ ID NO: 112691 - DNA, 25 bp, Homo sapien
gggatgtcatctcctgccgggcggg

SEQ ID NO: 112692 - DNA, 25 bp, Homo sapien
tctgcccctggaagagtcccctgtg

SEQ ID NO: 112693 - DNA, 25 bp, Homo sapien
tgcccctggaagagtcccctgtggg

SEQ ID NO: 112694 - DNA, 25 bp, Homo sapien
aagttccctaacatctccagctcct

SEQ ID NO: 112695 - DNA, 25 bp, Homo sapien
gttctcaggagggtaagaactccag

SEQ ID NO: 112696 - DNA, 25 bp, Homo sapien
gaccaataacctaattgtctattcc

SEQ ID NO: 112697 - DNA, 25 bp, Homo sapien
gtccccatccttattagctctactg

SEQ ID NO: 112698 - DNA, 25 bp, Homo sapien
cccatccttattagctctactggaa

SEQ ID NO: 112699 - DNA, 25 bp, Homo sapien
catccttattagctctactggaatt

SEQ ID NO: 112700 - DNA, 25 bp, Homo sapien
gcagaagttactaagtattaagtat

SEQ ID NO: 112701 - DNA, 25 bp, Homo sapien
gtattaagtagtaatctgtcagtta

SEQ ID NO: 112702 - DNA, 25 bp, Homo sapien
taagtagtaatctgtcagttattaa

SEQ ID NO: 112703 - DNA, 25 bp, Homo sapien
gaaaggtcattaaaccagatcatgt

SEQ ID NO: 112704 - DNA, 25 bp, Homo sapien
aaccagatcatgttcctttttttgt

SEQ ID NO: 112705 - DNA, 25 bp, Homo sapien
tttttttgtaatcaaggtgactaag

SEQ ID NO: 112706 - DNA, 25 bp, Homo sapien
atcaggatctgggagtggcttccta

SEQ ID NO: 112707 - DNA, 25 bp, Homo sapien
tctgggagtggcttcctaacggaaa

SEQ ID NO: 112708 - DNA, 25 bp, Homo sapien
ggaacaggattaccaactagtagac

SEQ ID NO: 112709 - DNA, 25 bp, Homo sapien
gtgatgctttccatgacaaccttag

SEQ ID NO: 112710 - DNA, 25 bp, Homo sapien
gacaaccttaggtctcttgacagga

SEQ ID NO: 112711 - DNA, 25 bp, Homo sapien
aggtctcttgacaggaatctgccct

SEQ ID NO: 112712 - DNA, 25 bp, Homo sapien
aggaatctgccctcagacagccagg

SEQ ID NO: 112713 - DNA, 25 bp, Homo sapien
acagccaggacttgggtcaacatgg

SEQ ID NO: 112714 - DNA, 25 bp, Homo sapien
agaggattttcccaccttgacacca

SEQ ID NO: 112715 - DNA, 25 bp, Homo sapien
gacaccaggcaatgtagttagcata

SEQ ID NO: 112716 - DNA, 25 bp, Homo sapien
gcatattttatgtaccatggttata

SEQ ID NO: 112717 - DNA, 25 bp, Homo sapien
caaagaaatccggagaagctgccag

SEQ ID NO: 112718 - DNA, 25 bp, Homo sapien
agcaaacaatattgtctcccttcca

SEQ ID NO: 112719 - DNA, 25 bp, Homo sapien
gtctcccttccagcaataagtggta

SEQ ID NO: 112720 - DNA, 25 bp, Homo sapien
gaagtcaccaaggttcttgaccgtg

SEQ ID NO: 112721 - DNA, 25 bp, Homo sapien
ttcttgaccgtgaatctggagccgt

SEQ ID NO: 112722 - DNA, 25 bp, Homo sapien
aatctggagccgtttgagttcacaa

SEQ ID NO: 112723 - DNA, 25 bp, Homo sapien
gagttcacaagagtctctacttggg

SEQ ID NO: 112724 - DNA, 25 bp, Homo sapien
tgctcacgtggctcgactatagaaa

SEQ ID NO: 112725 - DNA, 25 bp, Homo sapien
agaaaactccactgactgtcgggct

SEQ ID NO: 112726 - DNA, 25 bp, Homo sapien
gagcttgctgtgcttcaaactacta

SEQ ID NO: 112727 - DNA, 25 bp, Homo sapien
tactactggaccttattttggaact

SEQ ID NO: 112728 - DNA, 25 bp, Homo sapien
ggtggttcagtcactgcttgttgac

SEQ ID NO: 112729 - DNA, 25 bp, Homo sapien
gcttgttgacatcaacatggcaatt

SEQ ID NO: 112730 - DNA, 25 bp, Homo sapien
atggcaattgcactcatgtggactg

SEQ ID NO: 112731 - DNA, 25 bp, Homo sapien
actcatgtggactgggaccgtgcga

SEQ ID NO: 112732 - DNA, 25 bp, Homo sapien
ttagtcgggtgccaggacaatgaaa

SEQ ID NO: 112733 - DNA, 25 bp, Homo sapien
tgtggctgacgaatttgtttctaca

SEQ ID NO: 112734 - DNA, 25 bp, Homo sapien
gctgacgaatttgtttctacagaaa

SEQ ID NO: 112735 - DNA, 25 bp, Homo sapien
gggacaactgcggtgatgatgtaaa

SEQ ID NO: 112736 - DNA, 25 bp, Homo sapien
gatgtaaaaaccttcccataaaatg

SEQ ID NO: 112737 - DNA, 25 bp, Homo sapien
gctggtgacgttcagcctttgtcaa

SEQ ID NO: 112738 - DNA, 25 bp, Homo sapien
gacgttcagcctttgtcaataaacc

SEQ ID NO: 112739 - DNA, 25 bp, Homo sapien
gtttctgaaattggatggctggcta

SEQ ID NO: 112740 - DNA, 25 bp, Homo sapien
ggatggctggctaatagacactgaa

SEQ ID NO: 112741 - DNA, 25 bp, Homo sapien
agacactgaatcacccggagtgctt

SEQ ID NO: 112742 - DNA, 25 bp, Homo sapien
tcacccggagtgcttatcttaaaat

SEQ ID NO: 112743 - DNA, 25 bp, Homo sapien
aattgcagatttagggagcctgcca

SEQ ID NO: 112744 - DNA, 25 bp, Homo sapien
gagcctgccaatttaacagtctcat

SEQ ID NO: 112745 - DNA, 25 bp, Homo sapien
gtctcatcagtgatctttcaacagt

SEQ ID NO: 112746 - DNA, 25 bp, Homo sapien
aaaggtgctttaaggttgccctctg

SEQ ID NO: 112747 - DNA, 25 bp, Homo sapien
ttaaggttgccctctgccgatactg

SEQ ID NO: 112748 - DNA, 25 bp, Homo sapien
gccgatactgtttgtctttctactg

SEQ ID NO: 112749 - DNA, 25 bp, Homo sapien
tttctactgtttcatcccctaactt

SEQ ID NO: 112750 - DNA, 25 bp, Homo sapien
gtttgtccaggacaccctgaaagga

SEQ ID NO: 112751 - DNA, 25 bp, Homo sapien
ggtgtgacagaaatccggatgagat

SEQ ID NO: 112752 - DNA, 25 bp, Homo sapien
attcatcaggcggattgaggacaat

SEQ ID NO: 112753 - DNA, 25 bp, Homo sapien
tgaggacaatcttccagctggagag

SEQ ID NO: 112754 - DNA, 25 bp, Homo sapien
gaggaataaccatccctacaactcg

SEQ ID NO: 112755 - DNA, 25 bp, Homo sapien
tacaactcgaggatagccatcagga

SEQ ID NO: 112756 - DNA, 25 bp, Homo sapien
gcactgttggaatcagcaggcctct

SEQ ID NO: 112757 - DNA, 25 bp, Homo sapien
ttggaatcagcaggcctctgtgctc

SEQ ID NO: 112758 - DNA, 25 bp, Homo sapien
cctccagaactcagtgactcttgaa

SEQ ID NO: 112759 - DNA, 25 bp, Homo sapien
cagtgactcttgaacatggatgtta

SEQ ID NO: 112760 - DNA, 25 bp, Homo sapien
ttataacctgtttccattctccatt

SEQ ID NO: 112761 - DNA, 25 bp, Homo sapien
gaaggatgtaaaaccctgctgcata

SEQ ID NO: 112762 - DNA, 25 bp, Homo sapien
ggatcaaatagtcctcaactttcta

SEQ ID NO: 112763 - DNA, 25 bp, Homo sapien
aagggagcagctatttgccatctac

SEQ ID NO: 112764 - DNA, 25 bp, Homo sapien
tatttgccatctaccctccagaata

SEQ ID NO: 112765 - DNA, 25 bp, Homo sapien
gaaatcttatcattcaccatctacc

SEQ ID NO: 112766 - DNA, 25 bp, Homo sapien
gaaatcttatcattcgccatctacc

SEQ ID NO: 112767 - DNA, 25 bp, Homo sapien
attcgccatctaccctgtagaataa

SEQ ID NO: 112768 - DNA, 25 bp, Homo sapien
gaaatcttatcattcaccgtctacc

SEQ ID NO: 112769 - DNA, 25 bp, Homo sapien
caccgtctaccctctagagtaaaca

SEQ ID NO: 112770 - DNA, 25 bp, Homo sapien
aaatcttatcattcaccatctaccc

SEQ ID NO: 112771 - DNA, 25 bp, Homo sapien
attcaccatctaccctctagaataa

SEQ ID NO: 112772 - DNA, 25 bp, Homo sapien
ggaagattctccgttcaatgtccag

SEQ ID NO: 112773 - DNA, 25 bp, Homo sapien
tctccgttcaatgtccagaaaagtg

SEQ ID NO: 112774 - DNA, 25 bp, Homo sapien
aaaagtgacaaccaacaagctgctg

SEQ ID NO: 112775 - DNA, 25 bp, Homo sapien
aagctgctgctttccattatcatct

SEQ ID NO: 112776 - DNA, 25 bp, Homo sapien
attatcatcttactggagctcgcca

SEQ ID NO: 112777 - DNA, 25 bp, Homo sapien
atcttactggagctcgccatcctgg

SEQ ID NO: 112778 - DNA, 25 bp, Homo sapien
tcctgggaggcctggtttactacaa

SEQ ID NO: 112779 - DNA, 25 bp, Homo sapien
ggaggcctggtttactacaaattct

SEQ ID NO: 112780 - DNA, 25 bp, Homo sapien
actacaaattctttcgcagccattg

SEQ ID NO: 112781 - DNA, 25 bp, Homo sapien
tctttcgcagccattgaacttctat

SEQ ID NO: 112782 - DNA, 25 bp, Homo sapien
ctttgaccttgtgaatgcatgatgt

SEQ ID NO: 112783 - DNA, 25 bp, Homo sapien
ggctgggcttcctgacaagcttgtg

SEQ ID NO: 112784 - DNA, 25 bp, Homo sapien
ctgacaagcttgtggctcgtggcaa

SEQ ID NO: 112785 - DNA, 25 bp, Homo sapien
gctcgtggcaaggaggtctcagact

SEQ ID NO: 112786 - DNA, 25 bp, Homo sapien
gtctcagacttgatccgcagtggaa

SEQ ID NO: 112787 - DNA, 25 bp, Homo sapien
gtggaaaacccatcaagcctgtcaa

SEQ ID NO: 112788 - DNA, 25 bp, Homo sapien
aagcctgtcaaggatttgctaaaga

SEQ ID NO: 112789 - DNA, 25 bp, Homo sapien
gatcctaacctggacttgaacgttt

SEQ ID NO: 112790 - DNA, 25 bp, Homo sapien
gacttgaacgttttcatgagccagg

SEQ ID NO: 112791 - DNA, 25 bp, Homo sapien
atgagccaggaagtgctgcctgctg

SEQ ID NO: 112792 - DNA, 25 bp, Homo sapien
agcatcctctgagagtccttccagt

SEQ ID NO: 112793 - DNA, 25 bp, Homo sapien
tgagactccggtgggctgccatgcc

SEQ ID NO: 112794 - DNA, 25 bp, Homo sapien
aacccctggatctatgcatctttca

SEQ ID NO: 112795 - DNA, 25 bp, Homo sapien
cctggatctatgcatctttcagcag

SEQ ID NO: 112796 - DNA, 25 bp, Homo sapien
agcagcgtgtcctcagagctgcgaa

SEQ ID NO: 112797 - DNA, 25 bp, Homo sapien
agctgcgaagcttgctctgctgtgc

SEQ ID NO: 112798 - DNA, 25 bp, Homo sapien
ggccaaggacacttcatcgtgagga

SEQ ID NO: 112799 - DNA, 25 bp, Homo sapien
gacacttcatcgtgaggagctgttg

SEQ ID NO: 112800 - DNA, 25 bp, Homo sapien
gtgggacccggaggcacctctggaa

SEQ ID NO: 112801 - DNA, 25 bp, Homo sapien
gggcgccctttgtgctactcatgtt

SEQ ID NO: 112802 - DNA, 25 bp, Homo sapien
ttgtgctactcatgttgctggccag

SEQ ID NO: 112803 - DNA, 25 bp, Homo sapien
tactcatgttgctggccagcctcaa

SEQ ID NO: 112804 - DNA, 25 bp, Homo sapien
tgcaccaacccctggatctatgcat

SEQ ID NO: 112805 - DNA, 25 bp, Homo sapien
tgtgttaccgatgccagaagccact

SEQ ID NO: 112806 - DNA, 25 bp, Homo sapien
taccgatgccagaagccactgggtc

SEQ ID NO: 112807 - DNA, 25 bp, Homo sapien
gaaaggaaagaaccttctcactctc

SEQ ID NO: 112808 - DNA, 25 bp, Homo sapien
tctccccagcctttttataagggct

SEQ ID NO: 112809 - DNA, 25 bp, Homo sapien
acctgtgagggctctgtcctcatca

SEQ ID NO: 112810 - DNA, 25 bp, Homo sapien
ctcatcacttaatcacctcctaaag

SEQ ID NO: 112811 - DNA, 25 bp, Homo sapien
taaaggccccacttcttactactat

SEQ ID NO: 112812 - DNA, 25 bp, Homo sapien
tcttactactatcacattgaccatt

SEQ ID NO: 112813 - DNA, 25 bp, Homo sapien
aagtttcaacatacaacttttcatg

SEQ ID NO: 112814 - DNA, 25 bp, Homo sapien
attcagaccatacgtagcacctgct

SEQ ID NO: 112815 - DNA, 25 bp, Homo sapien
gtagcacctgctgaagaacatcttg

SEQ ID NO: 112816 - DNA, 25 bp, Homo sapien
tattggttactagggctgccacagc

SEQ ID NO: 112817 - DNA, 25 bp, Homo sapien
tagggctgccacagcaatgtaccac

SEQ ID NO: 112818 - DNA, 25 bp, Homo sapien
gcaatgtaccacaaaccgagtgaca

SEQ ID NO: 112819 - DNA, 25 bp, Homo sapien
gaggtctgagaacaaggtgttatca

SEQ ID NO: 112820 - DNA, 25 bp, Homo sapien
gtgttatcagggttggtcccttcta

SEQ ID NO: 112821 - DNA, 25 bp, Homo sapien
tatcagggttggtcccttctaaggc

SEQ ID NO: 112822 - DNA, 25 bp, Homo sapien
cttctaaggcctctcttgttggctt

SEQ ID NO: 112823 - DNA, 25 bp, Homo sapien
tgtctcctccttgtgtcttcacatg

SEQ ID NO: 112824 - DNA, 25 bp, Homo sapien
ttcctctgagtgtgtttgtgtccta

SEQ ID NO: 112825 - DNA, 25 bp, Homo sapien
tgagtgtgtttgtgtcctaatcttc

SEQ ID NO: 112826 - DNA, 25 bp, Homo sapien
ggattagggcctccccatgacctaa

SEQ ID NO: 112827 - DNA, 25 bp, Homo sapien
tagggtggaggtcactgcactacca

SEQ ID NO: 112828 - DNA, 25 bp, Homo sapien
acccacctctggaagactggctgtg

SEQ ID NO: 112829 - DNA, 25 bp, Homo sapien
actggctgtgaaaagtcaggtggca

SEQ ID NO: 112830 - DNA, 25 bp, Homo sapien
tttcctgtttcttggctctagaaga

SEQ ID NO: 112831 - DNA, 25 bp, Homo sapien
ttcttggctctagaagatcagcact

SEQ ID NO: 112832 - DNA, 25 bp, Homo sapien
gaagatcagcactgcactgttagct

SEQ ID NO: 112833 - DNA, 25 bp, Homo sapien
cactgttagctgagagtgcgggcaa

SEQ ID NO: 112834 - DNA, 25 bp, Homo sapien
gtgcgggcaagacataaactgtcca

SEQ ID NO: 112835 - DNA, 25 bp, Homo sapien
cagagtttgaaggttctcggaaaga

SEQ ID NO: 112836 - DNA, 25 bp, Homo sapien
ttctcggaaagaccggagggcttct

SEQ ID NO: 112837 - DNA, 25 bp, Homo sapien
accggagggcttctccccacagaag

SEQ ID NO: 112838 - DNA, 25 bp, Homo sapien
gaacgttacaagacttcatgcaaga

SEQ ID NO: 112839 - DNA, 25 bp, Homo sapien
tgctgtcatgacaccgctcgagtga

SEQ ID NO: 112840 - DNA, 25 bp, Homo sapien
gagtgaccttgaccttgaccaagtc

SEQ ID NO: 112841 - DNA, 25 bp, Homo sapien
ttgaccaagtcttgtccttgtttag

SEQ ID NO: 112842 - DNA, 25 bp, Homo sapien
ggactgatttttcctattaggctag

SEQ ID NO: 112843 - DNA, 25 bp, Homo sapien
gctagggtttggacctgatgttctc

SEQ ID NO: 112844 - DNA, 25 bp, Homo sapien
acctgatgttctcaagatgtctaga

SEQ ID NO: 112845 - DNA, 25 bp, Homo sapien
gctggccttgtggaatagatggttt

SEQ ID NO: 112846 - DNA, 25 bp, Homo sapien
atggttttgcattccagccaagtgt

SEQ ID NO: 112847 - DNA, 25 bp, Homo sapien
agccaagtgtgctgtaaactgtata

SEQ ID NO: 112848 - DNA, 25 bp, Homo sapien
tgtaatatgaatcccagcttttgag

SEQ ID NO: 112849 - DNA, 25 bp, Homo sapien
gggttcctactgtgtgcagctacta

SEQ ID NO: 112850 - DNA, 25 bp, Homo sapien
aactctggcccaaacaccaatggct

SEQ ID NO: 112851 - DNA, 25 bp, Homo sapien
ctctcagttcttcctgacatgtgac

SEQ ID NO: 112852 - DNA, 25 bp, Homo sapien
gacatgtgacaagacagactggctg

SEQ ID NO: 112853 - DNA, 25 bp, Homo sapien
tttggagaggtcaccgaaggcctag

SEQ ID NO: 112854 - DNA, 25 bp, Homo sapien
gtcaccgaaggcctagatgtcttgc

SEQ ID NO: 112855 - DNA, 25 bp, Homo sapien
aggcctagatgtcttgcggcaaatt

SEQ ID NO: 112856 - DNA, 25 bp, Homo sapien
gaagagtcagcaattaccagccagc

SEQ ID NO: 112857 - DNA, 25 bp, Homo sapien
aattaccagccagccgaggtcctgg

SEQ ID NO: 112858 - DNA, 25 bp, Homo sapien
tggaagctgacgtagagctcgtgcc

SEQ ID NO: 112859 - DNA, 25 bp, Homo sapien
gccgtggacgtcatctgcagggaca

SEQ ID NO: 112860 - DNA, 25 bp, Homo sapien
aactctggcccaaacaccaatggct

SEQ ID NO: 112861 - DNA, 25 bp, Homo sapien
ctctcagttcttcctgacatgtgac

SEQ ID NO: 112862 - DNA, 25 bp, Homo sapien
tctcagttcttcctgacatgtgaca

SEQ ID NO: 112863 - DNA, 25 bp, Homo sapien
tttggagaggtcaccgaaggcctag

SEQ ID NO: 112864 - DNA, 25 bp, Homo sapien
gagaggtcaccgaaggcctagatgt

SEQ ID NO: 112865 - DNA, 25 bp, Homo sapien
gaggtcaccgaaggcctagatgtct

SEQ ID NO: 112866 - DNA, 25 bp, Homo sapien
gtcaccgaaggcctagatgtcttgc

SEQ ID NO: 112867 - DNA, 25 bp, Homo sapien
caccgaaggcctagatgtcttgcgg

SEQ ID NO: 112868 - DNA, 25 bp, Homo sapien
gaaggcctagatgtcttgcggcaaa

SEQ ID NO: 112869 - DNA, 25 bp, Homo sapien
aggcctagatgtcttgcggcaaatt

SEQ ID NO: 112870 - DNA, 25 bp, Homo sapien
cctagatgtcttgcggcaaattgag

SEQ ID NO: 112871 - DNA, 25 bp, Homo sapien
cgaggtcttggccaggacataacaa

SEQ ID NO: 112872 - DNA, 25 bp, Homo sapien
gccaggacataacaagctgtggtct

SEQ ID NO: 112873 - DNA, 25 bp, Homo sapien
gtcctggacccagctttgctaggtc

SEQ ID NO: 112874 - DNA, 25 bp, Homo sapien
acccagctttgctaggtctccttgg

SEQ ID NO: 112875 - DNA, 25 bp, Homo sapien
caggcctgggcctcaaaatggagat

SEQ ID NO: 112876 - DNA, 25 bp, Homo sapien
aatggagatggatcccaggtcttgt

SEQ ID NO: 112877 - DNA, 25 bp, Homo sapien
caggtcttgtgggaccctgggatgt

SEQ ID NO: 112878 - DNA, 25 bp, Homo sapien
gggactttactatctagcaccccag

SEQ ID NO: 112879 - DNA, 25 bp, Homo sapien
tttactatctagcaccccagtaggc

SEQ ID NO: 112880 - DNA, 25 bp, Homo sapien
tagcaccccagtaggcctgtcctgg

SEQ ID NO: 112881 - DNA, 25 bp, Homo sapien
gcccagcccaggagcgctatttatt

SEQ ID NO: 112882 - DNA, 25 bp, Homo sapien
gggacacgtatgacctcagaaacac

SEQ ID NO: 112883 - DNA, 25 bp, Homo sapien
cttggtggaagaagtcgcctttgat

SEQ ID NO: 112884 - DNA, 25 bp, Homo sapien
gaagtcgcctttgatcttcactata

SEQ ID NO: 112885 - DNA, 25 bp, Homo sapien
ctatatattgggtgatgttcagtat

SEQ ID NO: 112886 - DNA, 25 bp, Homo sapien
attaagactgttaaatcagccagag

SEQ ID NO: 112887 - DNA, 25 bp, Homo sapien
gccagagttggtgttcaagtttaca

SEQ ID NO: 112888 - DNA, 25 bp, Homo sapien
gggaaagctgttctgtcaactgtaa

SEQ ID NO: 112889 - DNA, 25 bp, Homo sapien
gttctgtcaactgtaattgttcaaa

SEQ ID NO: 112890 - DNA, 25 bp, Homo sapien
gttcaaagatgttgtttttcatttc

SEQ ID NO: 112891 - DNA, 25 bp, Homo sapien
gtttttcatttcatctatctcaatt

SEQ ID NO: 112892 - DNA, 25 bp, Homo sapien
atctatctcaattcttataatcatg

SEQ ID NO: 112893 - DNA, 25 bp, Homo sapien
gttcccggcagtgtgactgtttaca

SEQ ID NO: 112894 - DNA, 25 bp, Homo sapien
gattctgattgcttcagagtggctg

SEQ ID NO: 112895 - DNA, 25 bp, Homo sapien
gagtggctggtctattttgtttcct

SEQ ID NO: 112896 - DNA, 25 bp, Homo sapien
taggaaattgctggttgcctgtccc

SEQ ID NO: 112897 - DNA, 25 bp, Homo sapien
gcctgtccccacgtgatgataaatg

SEQ ID NO: 112898 - DNA, 25 bp, Homo sapien
tgttgccctcttctggatatcgttt

SEQ ID NO: 112899 - DNA, 25 bp, Homo sapien
ggatatcgtttctctaccttacgac

SEQ ID NO: 112900 - DNA, 25 bp, Homo sapien
aaacgcccgtcctatagagtgtctg

SEQ ID NO: 112901 - DNA, 25 bp, Homo sapien
agtgtctgattggatcctctgtcgc

SEQ ID NO: 112902 - DNA, 25 bp, Homo sapien
tcctctgtcgcgtattctgatggtg

SEQ ID NO: 112903 - DNA, 25 bp, Homo sapien
gcctgctggtttgacgtggagctat

SEQ ID NO: 112904 - DNA, 25 bp, Homo sapien
cgcacggaccttgggcctcagcctg

SEQ ID NO: 112905 - DNA, 25 bp, Homo sapien
ccccagcctcagtggactggagggt

SEQ ID NO: 112906 - DNA, 25 bp, Homo sapien
actggagggtggtcctgccattgcc

SEQ ID NO: 112907 - DNA, 25 bp, Homo sapien
gagggtggtcctgccattgcccaga

SEQ ID NO: 112908 - DNA, 25 bp, Homo sapien
tggtcctgccattgcccagaaatca

SEQ ID NO: 112909 - DNA, 25 bp, Homo sapien
ggtcctgccattgcccagaaatcag

SEQ ID NO: 112910 - DNA, 25 bp, Homo sapien
tgccattgcccagaaatcagcccca

SEQ ID NO: 112911 - DNA, 25 bp, Homo sapien
gaaatcagccccagccccggtgagc

SEQ ID NO: 112912 - DNA, 25 bp, Homo sapien
tgcccaccaggtactgggggcctgt

SEQ ID NO: 112913 - DNA, 25 bp, Homo sapien
gacccagagatgtgagagagagtca

SEQ ID NO: 112914 - DNA, 25 bp, Homo sapien
agagagcgagcgagcgcgcggcagc

SEQ ID NO: 112915 - DNA, 25 bp, Homo sapien
tttttagcttctctcctccccatgt

SEQ ID NO: 112916 - DNA, 25 bp, Homo sapien
ccaactcctaagagggactacccat

SEQ ID NO: 112917 - DNA, 25 bp, Homo sapien
ctaagagggactacccatgagagtg

SEQ ID NO: 112918 - DNA, 25 bp, Homo sapien
gggacagttccgttcttgaagtgtc

SEQ ID NO: 112919 - DNA, 25 bp, Homo sapien
gttccgttcttgaagtgtcagtgtt

SEQ ID NO: 112920 - DNA, 25 bp, Homo sapien
gggaatatctgtggcctatgaggcc

SEQ ID NO: 112921 - DNA, 25 bp, Homo sapien
ctatgaggcccatctcaggtttggg

SEQ ID NO: 112922 - DNA, 25 bp, Homo sapien
cccagtccctatgatcagtgttgga

SEQ ID NO: 112923 - DNA, 25 bp, Homo sapien
cctatgatcagtgttggagtacccc

SEQ ID NO: 112924 - DNA, 25 bp, Homo sapien
ggagtacccccctgggagagcctag

SEQ ID NO: 112925 - DNA, 25 bp, Homo sapien
tcttttaactacctttgaataggtg

SEQ ID NO: 112926 - DNA, 25 bp, Homo sapien
tgggaccctggttattgatgtggcc

SEQ ID NO: 112927 - DNA, 25 bp, Homo sapien
gaccctggttattgatgtggccctg

SEQ ID NO: 112928 - DNA, 25 bp, Homo sapien
tggttattgatgtggccctggctgc

SEQ ID NO: 112929 - DNA, 25 bp, Homo sapien
ttgatgtggccctggctgccggcac

SEQ ID NO: 112930 - DNA, 25 bp, Homo sapien
acggcccgtggctgttgacgcacct

SEQ ID NO: 112931 - DNA, 25 bp, Homo sapien
gctgttgacgcacctgtggttgtta

SEQ ID NO: 112932 - DNA, 25 bp, Homo sapien
ttgacgcacctgtggttgttagtgg

SEQ ID NO: 112933 - DNA, 25 bp, Homo sapien
aaggccggcaggtcaacctcgcgct

SEQ ID NO: 112934 - DNA, 25 bp, Homo sapien
gtcaacctcgcgcttgctggccagt

SEQ ID NO: 112935 - DNA, 25 bp, Homo sapien
cggcggcagtattgaagctcgtgac

SEQ ID NO: 112936 - DNA, 25 bp, Homo sapien
gaagctcgtgacaagtgccttcaca

SEQ ID NO: 112937 - DNA, 25 bp, Homo sapien
ctcccgcacggaccttgggcctcag

SEQ ID NO: 112938 - DNA, 25 bp, Homo sapien
tcccgcacggaccttgggcctcagc

SEQ ID NO: 112939 - DNA, 25 bp, Homo sapien
cgcacggaccttgggcctcagcctg

SEQ ID NO: 112940 - DNA, 25 bp, Homo sapien
gcacggaccttgggcctcagcctgc

SEQ ID NO: 112941 - DNA, 25 bp, Homo sapien
cacggaccttgggcctcagcctgcc

SEQ ID NO: 112942 - DNA, 25 bp, Homo sapien
actggagggtggtcctgccattgcc

SEQ ID NO: 112943 - DNA, 25 bp, Homo sapien
ctggagggtggtcctgccattgccc

SEQ ID NO: 112944 - DNA, 25 bp, Homo sapien
tggagggtggtcctgccattgccca

SEQ ID NO: 112945 - DNA, 25 bp, Homo sapien
ggagggtggtcctgccattgcccag

SEQ ID NO: 112946 - DNA, 25 bp, Homo sapien
aaatcagccccagccccggtgagcc

SEQ ID NO: 112947 - DNA, 25 bp, Homo sapien
tgcccaccaggtactgggggcctgt

SEQ ID NO: 112948 - DNA, 25 bp, Homo sapien
gtatcgcagtgttgggtaagacttt

SEQ ID NO: 112949 - DNA, 25 bp, Homo sapien
gggtaagactttgaacaagcttgtt

SEQ ID NO: 112950 - DNA, 25 bp, Homo sapien
gaacaagcttgttctcaggctttga

SEQ ID NO: 112951 - DNA, 25 bp, Homo sapien
agcttgttctcaggctttgataagt

SEQ ID NO: 112952 - DNA, 25 bp, Homo sapien
ctttgataagtagtgctgtttgcca

SEQ ID NO: 112953 - DNA, 25 bp, Homo sapien
aagtagtgctgtttgccagctgtat

SEQ ID NO: 112954 - DNA, 25 bp, Homo sapien
gtttgccagctgtatattatcccta

SEQ ID NO: 112955 - DNA, 25 bp, Homo sapien
gccagctgtatattatccctaaaaa

SEQ ID NO: 112956 - DNA, 25 bp, Homo sapien
atggtacatattttgacatgcatat

SEQ ID NO: 112957 - DNA, 25 bp, Homo sapien
catatacatatttgcatcctgacta

SEQ ID NO: 112958 - DNA, 25 bp, Homo sapien
atttgcatcctgactaggctgccca

SEQ ID NO: 112959 - DNA, 25 bp, Homo sapien
gaaagctgagacgtctaggaacaca

SEQ ID NO: 112960 - DNA, 25 bp, Homo sapien
gagacgtctaggaacacaccagaga

SEQ ID NO: 112961 - DNA, 25 bp, Homo sapien
gagcttctgagggatgcaggtggct

SEQ ID NO: 112962 - DNA, 25 bp, Homo sapien
cccttcaatacccagggcctggtgg

SEQ ID NO: 112963 - DNA, 25 bp, Homo sapien
gaggaccgcaggtgaccgtctttgt

SEQ ID NO: 112964 - DNA, 25 bp, Homo sapien
caggtgaccgtctttgttgaatgct

SEQ ID NO: 112965 - DNA, 25 bp, Homo sapien
cgtctttgttgaatgctgaggccgg

SEQ ID NO: 112966 - DNA, 25 bp, Homo sapien
tgggcacatggagttgtcgtgtttc

SEQ ID NO: 112967 - DNA, 25 bp, Homo sapien
acatggagttgtcgtgtttcccttc

SEQ ID NO: 112968 - DNA, 25 bp, Homo sapien
ggagttgtcgtgtttcccttcactt

SEQ ID NO: 112969 - DNA, 25 bp, Homo sapien
cagtgacttgttcagtaaattccaa

SEQ ID NO: 112970 - DNA, 25 bp, Homo sapien
gaactctgcgttccaaaacaaatga

SEQ ID NO: 112971 - DNA, 25 bp, Homo sapien
aatatggctttattcaactgggccc

SEQ ID NO: 112972 - DNA, 25 bp, Homo sapien
ggctttattcaactgggcccagttt

SEQ ID NO: 112973 - DNA, 25 bp, Homo sapien
gcccagtttccattgtccctttgga

SEQ ID NO: 112974 - DNA, 25 bp, Homo sapien
gaagatttatgagaggcagtaccca

SEQ ID NO: 112975 - DNA, 25 bp, Homo sapien
gaggcagtacccattatctgttgga

SEQ ID NO: 112976 - DNA, 25 bp, Homo sapien
gtacccattatctgttggaagtttg

SEQ ID NO: 112977 - DNA, 25 bp, Homo sapien
gtgtcttcttgattgaaattctgct

SEQ ID NO: 112978 - DNA, 25 bp, Homo sapien
aataccttatttgataatacgttca

SEQ ID NO: 112979 - DNA, 25 bp, Homo sapien
aatagctattataagctgcctgtat

SEQ ID NO: 112980 - DNA, 25 bp, Homo sapien
tataagctgcctgtatttattatct

SEQ ID NO: 112981 - DNA, 25 bp, Homo sapien
gaatgtgacctgaacacagccctga

SEQ ID NO: 112982 - DNA, 25 bp, Homo sapien
gtgacctgaacacagccctgaagac

SEQ ID NO: 112983 - DNA, 25 bp, Homo sapien
actggaagtctgaagcgagccctgc

SEQ ID NO: 112984 - DNA, 25 bp, Homo sapien
aagtctgaagcgagccctgcacaat

SEQ ID NO: 112985 - DNA, 25 bp, Homo sapien
agccctgcacaatgccgaatgccag

SEQ ID NO: 112986 - DNA, 25 bp, Homo sapien
tgccgaatgccagaagactgtcacc

SEQ ID NO: 112987 - DNA, 25 bp, Homo sapien
aagccctgtggcaaactgaccaagc

SEQ ID NO: 112988 - DNA, 25 bp, Homo sapien
tggcaaactgaccaagcccaaacct

SEQ ID NO: 112989 - DNA, 25 bp, Homo sapien
agcccaaacctcaagcagaatctaa

SEQ ID NO: 112990 - DNA, 25 bp, Homo sapien
gctggattaaaagatgtcacctgtg

SEQ ID NO: 112991 - DNA, 25 bp, Homo sapien
aaaaggacatcagcaaacaggatca

SEQ ID NO: 112992 - DNA, 25 bp, Homo sapien
aaagagcaggcacgcatttccatat

SEQ ID NO: 112993 - DNA, 25 bp, Homo sapien
agcccagcagatcctacacacattt

SEQ ID NO: 112994 - DNA, 25 bp, Homo sapien
agcagatcctacacacattttcaca

SEQ ID NO: 112995 - DNA, 25 bp, Homo sapien
gcagatcctacacacattttcacaa

SEQ ID NO: 112996 - DNA, 25 bp, Homo sapien
agatcctacacacattttcacaaac

SEQ ID NO: 112997 - DNA, 25 bp, Homo sapien
ttttcacaaactaaccccagaacag

SEQ ID NO: 112998 - DNA, 25 bp, Homo sapien
ttcacaaactaaccccagaacaggc

SEQ ID NO: 112999 - DNA, 25 bp, Homo sapien
aaactaaccccagaacaggctgcaa

SEQ ID NO: 113000 - DNA, 25 bp, Homo sapien
taaccccagaacaggctgcaaacct

SEQ ID NO: 113001 - DNA, 25 bp, Homo sapien
ccccagaacaggctgcaaacctata

SEQ ID NO: 113002 - DNA, 25 bp, Homo sapien
agaacaggctgcaaacctataccaa

SEQ ID NO: 113003 - DNA, 25 bp, Homo sapien
tacgaagagcagaatcgaggcatct

SEQ ID NO: 113004 - DNA, 25 bp, Homo sapien
cgaggcatctacatgttccgaataa

SEQ ID NO: 113005 - DNA, 25 bp, Homo sapien
gattgatgctacgttgaccggcggc

SEQ ID NO: 113006 - DNA, 25 bp, Homo sapien
ggccctgccaggtacattaaccatt

SEQ ID NO: 113007 - DNA, 25 bp, Homo sapien
aggtacattaaccattcctgtgccc

SEQ ID NO: 113008 - DNA, 25 bp, Homo sapien
cccctaactgtgtggccgaagtcgt

SEQ ID NO: 113009 - DNA, 25 bp, Homo sapien
ggccgaagtcgtgacatttgacaaa

SEQ ID NO: 113010 - DNA, 25 bp, Homo sapien
gacaaaatcatcatcatctccagcc

SEQ ID NO: 113011 - DNA, 25 bp, Homo sapien
cagccggcgaatccccaaaggagag

SEQ ID NO: 113012 - DNA, 25 bp, Homo sapien
aggagctaacctatgactatcagtt

SEQ ID NO: 113013 - DNA, 25 bp, Homo sapien
tgtggagcctggaattgtcggaaat

SEQ ID NO: 113014 - DNA, 25 bp, Homo sapien
ctctagcggaccagacgagtggaga

SEQ ID NO: 113015 - DNA, 25 bp, Homo sapien
gacgagtggagatcagagccctctc

SEQ ID NO: 113016 - DNA, 25 bp, Homo sapien
caccctgtgcagaaatgagagaaga

SEQ ID NO: 113017 - DNA, 25 bp, Homo sapien
gaagacagtgctagagtctatgaaa

SEQ ID NO: 113018 - DNA, 25 bp, Homo sapien
gtctatgaaaacgtgggcctgatgc

SEQ ID NO: 113019 - DNA, 25 bp, Homo sapien
aacgtgggcctgatgcaacagcaga

SEQ ID NO: 113020 - DNA, 25 bp, Homo sapien
aaacctgccaaaacttcagcacaga

SEQ ID NO: 113021 - DNA, 25 bp, Homo sapien
aatagatgtggactttcaccctctc

SEQ ID NO: 113022 - DNA, 25 bp, Homo sapien
cagaatttggatttggaaggcttgc

SEQ ID NO: 113023 - DNA, 25 bp, Homo sapien
aaggcttgcaatgtggttgactacc

SEQ ID NO: 113024 - DNA, 25 bp, Homo sapien
tggttgactaccttttgataagcaa

SEQ ID NO: 113025 - DNA, 25 bp, Homo sapien
tataatcttttatacagtgtcttac

SEQ ID NO: 113026 - DNA, 25 bp, Homo sapien
gcaatatgtgatgtggcaaatctct

SEQ ID NO: 113027 - DNA, 25 bp, Homo sapien
atgtggcaaatctctattaggaaat

SEQ ID NO: 113028 - DNA, 25 bp, Homo sapien
atattctgtaatcttcagacctaga

SEQ ID NO: 113029 - DNA, 25 bp, Homo sapien
gtaatcttcagacctagaataatac

SEQ ID NO: 113030 - DNA, 25 bp, Homo sapien
aatactagtcttataataggtttgt

SEQ ID NO: 113031 - DNA, 25 bp, Homo sapien
aggtttgtgactttcctaaatcaat

SEQ ID NO: 113032 - DNA, 25 bp, Homo sapien
gtgactttcctaaatcaattctatt

SEQ ID NO: 113033 - DNA, 25 bp, Homo sapien
aattctattacgtgcaatacttcaa

SEQ ID NO: 113034 - DNA, 25 bp, Homo sapien
gtgcaatacttcaatacttcattta

SEQ ID NO: 113035 - DNA, 25 bp, Homo sapien
gtgttcagtacaattataagctgtt

SEQ ID NO: 113036 - DNA, 25 bp, Homo sapien
tcaaattttggcacgatgaattatt

SEQ ID NO: 113037 - DNA, 25 bp, Homo sapien
tttggcacgatgaattatttttgtt

SEQ ID NO: 113038 - DNA, 25 bp, Homo sapien
tttgtttctctttgcagagagccaa

SEQ ID NO: 113039 - DNA, 25 bp, Homo sapien
gggctgatgggaactgcaacgtcat

SEQ ID NO: 113040 - DNA, 25 bp, Homo sapien
gctgatgggaactgcaacgtcatta

SEQ ID NO: 113041 - DNA, 25 bp, Homo sapien
gggaactgcaacgtcattaagtcaa

SEQ ID NO: 113042 - DNA, 25 bp, Homo sapien
gaactgcaacgtcattaagtcaaaa

SEQ ID NO: 113043 - DNA, 25 bp, Homo sapien
gactggtcagtcacaagaacttcaa

SEQ ID NO: 113044 - DNA, 25 bp, Homo sapien
ggtcagtcacaagaacttcaacctg

SEQ ID NO: 113045 - DNA, 25 bp, Homo sapien
ccctctctgcacctgctcaagaaaa

SEQ ID NO: 113046 - DNA, 25 bp, Homo sapien
ctcctgggtgttcattcattttgtt

SEQ ID NO: 113047 - DNA, 25 bp, Homo sapien
tccaacacctcctgtgagtttcttg

SEQ ID NO: 113048 - DNA, 25 bp, Homo sapien
caacacctcctgtgagtttcttggt

SEQ ID NO: 113049 - DNA, 25 bp, Homo sapien
aacacctcctgtgagtttcttggtc

SEQ ID NO: 113050 - DNA, 25 bp, Homo sapien
acacctcctgtgagtttcttggtct

SEQ ID NO: 113051 - DNA, 25 bp, Homo sapien
cacctcctgtgagtttcttggtctg

SEQ ID NO: 113052 - DNA, 25 bp, Homo sapien
acctcctgtgagtttcttggtctga

SEQ ID NO: 113053 - DNA, 25 bp, Homo sapien
cctcctgtgagtttcttggtctgaa

SEQ ID NO: 113054 - DNA, 25 bp, Homo sapien
ctcctgtgagtttcttggtctgaaa

SEQ ID NO: 113055 - DNA, 25 bp, Homo sapien
tcctgtgagtttcttggtctgaaat

SEQ ID NO: 113056 - DNA, 25 bp, Homo sapien
atattgttgtgtctggtaatgaaag

SEQ ID NO: 113057 - DNA, 25 bp, Homo sapien
attgttgtgtctggtaatgaaagta

SEQ ID NO: 113058 - DNA, 25 bp, Homo sapien
gcaatgaacaggtgggaacgtgacc

SEQ ID NO: 113059 - DNA, 25 bp, Homo sapien
aggtgggaacgtgacctggctccaa

SEQ ID NO: 113060 - DNA, 25 bp, Homo sapien
gtgggaacgtgacctggctccaact

SEQ ID NO: 113061 - DNA, 25 bp, Homo sapien
ggaacgtgacctggctccaactcta

SEQ ID NO: 113062 - DNA, 25 bp, Homo sapien
aacgtgacctggctccaactctaac

SEQ ID NO: 113063 - DNA, 25 bp, Homo sapien
aactctaacctccttcctgatcctg

SEQ ID NO: 113064 - DNA, 25 bp, Homo sapien
atcctgaccccaactccatttctgt

SEQ ID NO: 113065 - DNA, 25 bp, Homo sapien
tgtctctgctcagtcatggctccaa

SEQ ID NO: 113066 - DNA, 25 bp, Homo sapien
tcatggctccaaccccaattcaagt

SEQ ID NO: 113067 - DNA, 25 bp, Homo sapien
gctccaaccccaattcaagttctaa

SEQ ID NO: 113068 - DNA, 25 bp, Homo sapien
tcaagttctaaacccaactccaaag

SEQ ID NO: 113069 - DNA, 25 bp, Homo sapien
gctgaagactctggctggccacgaa

SEQ ID NO: 113070 - DNA, 25 bp, Homo sapien
atgggcctagatatttcttccgatg

SEQ ID NO: 113071 - DNA, 25 bp, Homo sapien
gatatttcttccgatgggcagctca

SEQ ID NO: 113072 - DNA, 25 bp, Homo sapien
cgatgggcagctcatagccacttgc

SEQ ID NO: 113073 - DNA, 25 bp, Homo sapien
gccacttgctcatatgacaggacct

SEQ ID NO: 113074 - DNA, 25 bp, Homo sapien
gaccttcaagctgtggatggctgaa

SEQ ID NO: 113075 - DNA, 25 bp, Homo sapien
aaggacttgaacctcaagctctctc

SEQ ID NO: 113076 - DNA, 25 bp, Homo sapien
ggagctgttttcctcaaacgagaag

SEQ ID NO: 113077 - DNA, 25 bp, Homo sapien
agttctatcatgttttctgccaatt

SEQ ID NO: 113078 - DNA, 25 bp, Homo sapien
caattaccatgcatagaccctcagt

SEQ ID NO: 113079 - DNA, 25 bp, Homo sapien
gaccctcagtagaattggatttcca

SEQ ID NO: 113080 - DNA, 25 bp, Homo sapien
aggtctgtagagacatttgcttaca

SEQ ID NO: 113081 - DNA, 25 bp, Homo sapien
atttgcttacaaactggtagacaga

SEQ ID NO: 113082 - DNA, 25 bp, Homo sapien
tagacagaatgtagcttagtggaat

SEQ ID NO: 113083 - DNA, 25 bp, Homo sapien
gtagcttagtggaattcttaaatta

SEQ ID NO: 113084 - DNA, 25 bp, Homo sapien
gggaatgtattcacaggaagacggt

SEQ ID NO: 113085 - DNA, 25 bp, Homo sapien
aggaagacggtgattcttgccccta

SEQ ID NO: 113086 - DNA, 25 bp, Homo sapien
gattcttgcccctaattcataattg

SEQ ID NO: 113087 - DNA, 25 bp, Homo sapien
caagcataaaactcacatcttaatg

SEQ ID NO: 113088 - DNA, 25 bp, Homo sapien
gaagatgtatctaccagtgtcattc

SEQ ID NO: 113089 - DNA, 25 bp, Homo sapien
taccagtgtcattcaattagcagat

SEQ ID NO: 113090 - DNA, 25 bp, Homo sapien
gaatgtctgctatatgcttttggta

SEQ ID NO: 113091 - DNA, 25 bp, Homo sapien
cccctccctgctgtaaaatttattg

SEQ ID NO: 113092 - DNA, 25 bp, Homo sapien
acaaagtctctttgagccagtgaaa

SEQ ID NO: 113093 - DNA, 25 bp, Homo sapien
gccagtgaaacacgatgggtttttt

SEQ ID NO: 113094 - DNA, 25 bp, Homo sapien
ttgtttgcctgatcacttgctccaa

SEQ ID NO: 113095 - DNA, 25 bp, Homo sapien
acttgctccaaccagcagcattaaa

SEQ ID NO: 113096 - DNA, 25 bp, Homo sapien
ttggataaacttgcatcgtcagctt

SEQ ID NO: 113097 - DNA, 25 bp, Homo sapien
gtcagcttcctaaaaccctggaggt

SEQ ID NO: 113098 - DNA, 25 bp, Homo sapien
tttcccgtgggctcgttcaagaact

SEQ ID NO: 113099 - DNA, 25 bp, Homo sapien
caagaactttccagctgttgtttaa

SEQ ID NO: 113100 - DNA, 25 bp, Homo sapien
agagctagcttgttcagcctgtggc

SEQ ID NO: 113101 - DNA, 25 bp, Homo sapien
ggccccggactgctttgaatgtgct

SEQ ID NO: 113102 - DNA, 25 bp, Homo sapien
cagggtgcaggagcgcctcgttctc

SEQ ID NO: 113103 - DNA, 25 bp, Homo sapien
tgcaggagcgcctcgttctctgggt

SEQ ID NO: 113104 - DNA, 25 bp, Homo sapien
tcgttctctgggtggccggcttgct

SEQ ID NO: 113105 - DNA, 25 bp, Homo sapien
ttgggctgtcttaccataacaccgt

SEQ ID NO: 113106 - DNA, 25 bp, Homo sapien
tgggctgtcttaccataacaccgtc

SEQ ID NO: 113107 - DNA, 25 bp, Homo sapien
gtcttaccataacaccgtcccaggg

SEQ ID NO: 113108 - DNA, 25 bp, Homo sapien
cctgggcagtgctcctccgtgtgga

SEQ ID NO: 113109 - DNA, 25 bp, Homo sapien
agtgctcctccgtgtggactgtgcc

SEQ ID NO: 113110 - DNA, 25 bp, Homo sapien
tgctcctccgtgtggactgtgcctc

SEQ ID NO: 113111 - DNA, 25 bp, Homo sapien
gatctttctgggagctgcgccggac

SEQ ID NO: 113112 - DNA, 25 bp, Homo sapien
ctttctgggagctgcgccggacaga

SEQ ID NO: 113113 - DNA, 25 bp, Homo sapien
gacagaagactgtgtcatgggtcat

SEQ ID NO: 113114 - DNA, 25 bp, Homo sapien
actgtgtcatgggtcatggcccctc

SEQ ID NO: 113115 - DNA, 25 bp, Homo sapien
tccgcacacctacaggtttgccaaa

SEQ ID NO: 113116 - DNA, 25 bp, Homo sapien
gaaaagcctggctctgttaggcacc

SEQ ID NO: 113117 - DNA, 25 bp, Homo sapien
ctggctctgttaggcacccaggagc

SEQ ID NO: 113118 - DNA, 25 bp, Homo sapien
caggtcggcgggtgttcccaggaag

SEQ ID NO: 113119 - DNA, 25 bp, Homo sapien
gaggaagtaaatctgcaaccctggg

SEQ ID NO: 113120 - DNA, 25 bp, Homo sapien
ggaggaccccaactcacctgggaat

SEQ ID NO: 113121 - DNA, 25 bp, Homo sapien
cacctgggaatgaggcaaattgcat

SEQ ID NO: 113122 - DNA, 25 bp, Homo sapien
aaattgcatttgcttgctccctatg

SEQ ID NO: 113123 - DNA, 25 bp, Homo sapien
tgctccctatggaatcacccagagg

SEQ ID NO: 113124 - DNA, 25 bp, Homo sapien
aacgaaagtcggcatctctgtgctt

SEQ ID NO: 113125 - DNA, 25 bp, Homo sapien
ttctcagaaatccagcctgcttcag

SEQ ID NO: 113126 - DNA, 25 bp, Homo sapien
gcctgcttcagcttcaaaacacaga

SEQ ID NO: 113127 - DNA, 25 bp, Homo sapien
ggattttatgagctccagtcaacaa

SEQ ID NO: 113128 - DNA, 25 bp, Homo sapien
attttactggattggactctcttac

SEQ ID NO: 113129 - DNA, 25 bp, Homo sapien
gactctcttacagtgaggagcacac

SEQ ID NO: 113130 - DNA, 25 bp, Homo sapien
agcacaccgcctggttgtgggagaa

SEQ ID NO: 113131 - DNA, 25 bp, Homo sapien
agaatggctctgcactctcccagta

SEQ ID NO: 113132 - DNA, 25 bp, Homo sapien
ctcccagtatctatttccatcattt

SEQ ID NO: 113133 - DNA, 25 bp, Homo sapien
gaactgcatagcgtataatccaaat

SEQ ID NO: 113134 - DNA, 25 bp, Homo sapien
gaaatgctttagatgaatcctgtga

SEQ ID NO: 113135 - DNA, 25 bp, Homo sapien
gagttatgtgaaatcctagctaaag

SEQ ID NO: 113136 - DNA, 25 bp, Homo sapien
ggagatacattggaagatcccttca

SEQ ID NO: 113137 - DNA, 25 bp, Homo sapien
tggaagatcccttcaaagcaaacac

SEQ ID NO: 113138 - DNA, 25 bp, Homo sapien
gaaaatgactcaccaacaaatgtac

SEQ ID NO: 113139 - DNA, 25 bp, Homo sapien
gactcaccaacaaatgtacagcaat

SEQ ID NO: 113140 - DNA, 25 bp, Homo sapien
agaacttgatggaatgcttttattt

SEQ ID NO: 113141 - DNA, 25 bp, Homo sapien
ttaagggaccctgcaggagtttcac

SEQ ID NO: 113142 - DNA, 25 bp, Homo sapien
ggaccctgcaggagtttcacacgag

SEQ ID NO: 113143 - DNA, 25 bp, Homo sapien
ccctgcaggagtttcacacgagagt

SEQ ID NO: 113144 - DNA, 25 bp, Homo sapien
ggtgtaaaagtgcatcacacaggta

SEQ ID NO: 113145 - DNA, 25 bp, Homo sapien
gtgcatcacacaggtattgcttttt

SEQ ID NO: 113146 - DNA, 25 bp, Homo sapien
ggggcgttgtgcaggactttatttt

SEQ ID NO: 113147 - DNA, 25 bp, Homo sapien
ctgggtgagcccgaaggatgacctt

SEQ ID NO: 113148 - DNA, 25 bp, Homo sapien
gttttataagattctccacggcttc

SEQ ID NO: 113149 - DNA, 25 bp, Homo sapien
taagattctccacggcttcaaagac

SEQ ID NO: 113150 - DNA, 25 bp, Homo sapien
gattctccacggcttcaaagaccaa

SEQ ID NO: 113151 - DNA, 25 bp, Homo sapien
tctccacggcttcaaagaccaagtt

SEQ ID NO: 113152 - DNA, 25 bp, Homo sapien
ccacggcttcaaagaccaagttggg

SEQ ID NO: 113153 - DNA, 25 bp, Homo sapien
gaagataactggcagcagttctctg

SEQ ID NO: 113154 - DNA, 25 bp, Homo sapien
ataactggcagcagttctctgagca

SEQ ID NO: 113155 - DNA, 25 bp, Homo sapien
agcaattcccgccgctgctcaagga

SEQ ID NO: 113156 - DNA, 25 bp, Homo sapien
tcaaggagaggctggcggctttcta

SEQ ID NO: 113157 - DNA, 25 bp, Homo sapien
gatgctgttccccagggtacccagg

SEQ ID NO: 113158 - DNA, 25 bp, Homo sapien
atgctgttccccagggtacccaggt

SEQ ID NO: 113159 - DNA, 25 bp, Homo sapien
tgctgttccccagggtacccaggtt

SEQ ID NO: 113160 - DNA, 25 bp, Homo sapien
ccagggtacccaggttcaagtcaag

SEQ ID NO: 113161 - DNA, 25 bp, Homo sapien
cagggtacccaggttcaagtcaagc

SEQ ID NO: 113162 - DNA, 25 bp, Homo sapien
ggttcaagtcaagccccaagcagca

SEQ ID NO: 113163 - DNA, 25 bp, Homo sapien
gttcaagtcaagccccaagcagcaa

SEQ ID NO: 113164 - DNA, 25 bp, Homo sapien
caagtcaagccccaagcagcaagtt

SEQ ID NO: 113165 - DNA, 25 bp, Homo sapien
aagtcaagccccaagcagcaagttt

SEQ ID NO: 113166 - DNA, 25 bp, Homo sapien
agtcaagccccaagcagcaagtttc

SEQ ID NO: 113167 - DNA, 25 bp, Homo sapien
gtcaagccccaagcagcaagtttct

SEQ ID NO: 113168 - DNA, 25 bp, Homo sapien
gacagtgtggttcatctgatcgact

SEQ ID NO: 113169 - DNA, 25 bp, Homo sapien
ggttcatctgatcgactactatgtt

SEQ ID NO: 113170 - DNA, 25 bp, Homo sapien
gactactatgttcagatgtgcaagg

SEQ ID NO: 113171 - DNA, 25 bp, Homo sapien
ataagcggacaggtccagaagcccc

SEQ ID NO: 113172 - DNA, 25 bp, Homo sapien
ggaacggcactgttcacctttatct

SEQ ID NO: 113173 - DNA, 25 bp, Homo sapien
tgttcacctttatctgaccaaaccg

SEQ ID NO: 113174 - DNA, 25 bp, Homo sapien
tatctgaccaaaccgctctacacgt

SEQ ID NO: 113175 - DNA, 25 bp, Homo sapien
atctctgcagcatctctgtaggctc

SEQ ID NO: 113176 - DNA, 25 bp, Homo sapien
ttaacaaatgtaccggtgccatctg

SEQ ID NO: 113177 - DNA, 25 bp, Homo sapien
aaattccaggtataaatgtttctct

SEQ ID NO: 113178 - DNA, 25 bp, Homo sapien
ttaaacatgtctcacatagagtatc

SEQ ID NO: 113179 - DNA, 25 bp, Homo sapien
tcaagactgtggcaaccatcaccgc

SEQ ID NO: 113180 - DNA, 25 bp, Homo sapien
agacttcacggcctttaccaccgtg

SEQ ID NO: 113181 - DNA, 25 bp, Homo sapien
tttaccaccgtggatgactggctca

SEQ ID NO: 113182 - DNA, 25 bp, Homo sapien
atgactggctcagcgccatcaaaat

SEQ ID NO: 113183 - DNA, 25 bp, Homo sapien
agcgccatcaaaatggtccagtaca

SEQ ID NO: 113184 - DNA, 25 bp, Homo sapien
tccagctggtcacccagatgacatc

SEQ ID NO: 113185 - DNA, 25 bp, Homo sapien
tgacatcagaagacctcctgagaat

SEQ ID NO: 113186 - DNA, 25 bp, Homo sapien
gaataggcatcaccttggcaggcca

SEQ ID NO: 113187 - DNA, 25 bp, Homo sapien
atcaccttggcaggccatcagaaga

SEQ ID NO: 113188 - DNA, 25 bp, Homo sapien
gtccagataagtcagtcaccaacgg

SEQ ID NO: 113189 - DNA, 25 bp, Homo sapien
gtcagtcaccaacggcaatggcatg

SEQ ID NO: 113190 - DNA, 25 bp, Homo sapien
cagatggacactgaggctgctgcat

SEQ ID NO: 113191 - DNA, 25 bp, Homo sapien
acactcagcagaaggagactcagga

SEQ ID NO: 113192 - DNA, 25 bp, Homo sapien
actcagcagaaggagactcaggact

SEQ ID NO: 113193 - DNA, 25 bp, Homo sapien
gcagaaggagactcaggactgctga

SEQ ID NO: 113194 - DNA, 25 bp, Homo sapien
actgctgaaggcacgggagctgccc

SEQ ID NO: 113195 - DNA, 25 bp, Homo sapien
gtggacaccagtgaaccccagtcag

SEQ ID NO: 113196 - DNA, 25 bp, Homo sapien
tggacccctaacacagaccatgagg

SEQ ID NO: 113197 - DNA, 25 bp, Homo sapien
ggacccctaacacagaccatgagga

SEQ ID NO: 113198 - DNA, 25 bp, Homo sapien
gacccctaacacagaccatgaggag

SEQ ID NO: 113199 - DNA, 25 bp, Homo sapien
ctaacacagaccatgaggagacgct

SEQ ID NO: 113200 - DNA, 25 bp, Homo sapien
acacagaccatgaggagacgctggg

SEQ ID NO: 113201 - DNA, 25 bp, Homo sapien
aacttcgtgttctgtatctcctcag

SEQ ID NO: 113202 - DNA, 25 bp, Homo sapien
atctcctcagccatgtatcttaaat

SEQ ID NO: 113203 - DNA, 25 bp, Homo sapien
gggcagactttgcacttactgcagt

SEQ ID NO: 113204 - DNA, 25 bp, Homo sapien
tttcctccaactgtctaaaattaga

SEQ ID NO: 113205 - DNA, 25 bp, Homo sapien
tggcaatacagctgcttttgctctg

SEQ ID NO: 113206 - DNA, 25 bp, Homo sapien
gctctgagctacaatcatggctttt

SEQ ID NO: 113207 - DNA, 25 bp, Homo sapien
atggcttttcatgttacttaccaag

SEQ ID NO: 113208 - DNA, 25 bp, Homo sapien
gttacttaccaagtggtgtttctgg

SEQ ID NO: 113209 - DNA, 25 bp, Homo sapien
ttctggttaggaatcacagctgtaa

SEQ ID NO: 113210 - DNA, 25 bp, Homo sapien
gatttcagttcatcacacttcttca

SEQ ID NO: 113211 - DNA, 25 bp, Homo sapien
acttcttcatgatgttgcccctaaa

SEQ ID NO: 113212 - DNA, 25 bp, Homo sapien
cctgaggtcatcggcgtggcccaag

SEQ ID NO: 113213 - DNA, 25 bp, Homo sapien
atcggcgtggcccaaggccggcagg

SEQ ID NO: 113214 - DNA, 25 bp, Homo sapien
tccagcgatctctccactgtgcttt

SEQ ID NO: 113215 - DNA, 25 bp, Homo sapien
agcgatctctccactgtgctttcag

SEQ ID NO: 113216 - DNA, 25 bp, Homo sapien
gcgatctctccactgtgctttcaga

SEQ ID NO: 113217 - DNA, 25 bp, Homo sapien
tccactgtgctttcagaagtgccct

SEQ ID NO: 113218 - DNA, 25 bp, Homo sapien
actgtgctttcagaagtgcccttcc

SEQ ID NO: 113219 - DNA, 25 bp, Homo sapien
tgctgcgaagttctcccatcctggg

SEQ ID NO: 113220 - DNA, 25 bp, Homo sapien
gctgcgaagttctcccatcctggga

SEQ ID NO: 113221 - DNA, 25 bp, Homo sapien
gcgaagttctcccatcctgggacgg

SEQ ID NO: 113222 - DNA, 25 bp, Homo sapien
gaagttctcccatcctgggacggcg

SEQ ID NO: 113223 - DNA, 25 bp, Homo sapien
ccaagtactcagctgcagattgccc

SEQ ID NO: 113224 - DNA, 25 bp, Homo sapien
gcagattgcccactttcatttttaa

SEQ ID NO: 113225 - DNA, 25 bp, Homo sapien
aaagtactcctgatggtgaactggc

SEQ ID NO: 113226 - DNA, 25 bp, Homo sapien
ggtgaactggcgttaccatcaattt

SEQ ID NO: 113227 - DNA, 25 bp, Homo sapien
ctggcgttaccatcaattttcagtt

SEQ ID NO: 113228 - DNA, 25 bp, Homo sapien
attttcagtttatctgaccggcctc

SEQ ID NO: 113229 - DNA, 25 bp, Homo sapien
gcctccctgtgccagaggaaacagt

SEQ ID NO: 113230 - DNA, 25 bp, Homo sapien
aggagtcccagcagatgtccacagc

SEQ ID NO: 113231 - DNA, 25 bp, Homo sapien
caagctgggcctgcggaacagtgtc

SEQ ID NO: 113232 - DNA, 25 bp, Homo sapien
atctcagatttctgtcagcagatga

SEQ ID NO: 113233 - DNA, 25 bp, Homo sapien
gcagatgactgataaatgtactact

SEQ ID NO: 113234 - DNA, 25 bp, Homo sapien
gcctgtgcttcgaagaactctgatc

SEQ ID NO: 113235 - DNA, 25 bp, Homo sapien
ggtaagacgtaaatgtttcaacact

SEQ ID NO: 113236 - DNA, 25 bp, Homo sapien
ctttactaaaagcttatttctgtca

SEQ ID NO: 113237 - DNA, 25 bp, Homo sapien
aaagcttatttctgtcaatatcata

SEQ ID NO: 113238 - DNA, 25 bp, Homo sapien
gtagaaatcatccatatgtttatac

SEQ ID NO: 113239 - DNA, 25 bp, Homo sapien
gtctgtgtagtattcaactgacttc

SEQ ID NO: 113240 - DNA, 25 bp, Homo sapien
gtagtattcaactgacttcataata

SEQ ID NO: 113241 - DNA, 25 bp, Homo sapien
tatattcatatactgttaatgcaca

SEQ ID NO: 113242 - DNA, 25 bp, Homo sapien
gttaatgcacatttggttatttcca

SEQ ID NO: 113243 - DNA, 25 bp, Homo sapien
ttatttccagttttgcttttcatgg

SEQ ID NO: 113244 - DNA, 25 bp, Homo sapien
ggaaacccatgcttctataaatgtt

SEQ ID NO: 113245 - DNA, 25 bp, Homo sapien
ttccagcagcccagtaaactgcggg

SEQ ID NO: 113246 - DNA, 25 bp, Homo sapien
taaactgcgggcgaagagatctacc

SEQ ID NO: 113247 - DNA, 25 bp, Homo sapien
gggcgaagagatctacccgtctccc

SEQ ID NO: 113248 - DNA, 25 bp, Homo sapien
agttaccattgagcctgtcatcgca

SEQ ID NO: 113249 - DNA, 25 bp, Homo sapien
tgagcctgtcatcgcaagcatttga

SEQ ID NO: 113250 - DNA, 25 bp, Homo sapien
agacttgcttgtcttgggcctgtca

SEQ ID NO: 113251 - DNA, 25 bp, Homo sapien
tgtcacctcctgaaaggctgcttta

SEQ ID NO: 113252 - DNA, 25 bp, Homo sapien
ctgaaaggctgctttagctgtggat

SEQ ID NO: 113253 - DNA, 25 bp, Homo sapien
ccttgattaagggagagagcgccta

SEQ ID NO: 113254 - DNA, 25 bp, Homo sapien
ctgtagggctgggtctatgttgcaa

SEQ ID NO: 113255 - DNA, 25 bp, Homo sapien
tctatgttgcaagccctatatccta

SEQ ID NO: 113256 - DNA, 25 bp, Homo sapien
aggaaaccattctcaacgcattcaa

SEQ ID NO: 113257 - DNA, 25 bp, Homo sapien
attctcaacgcattcaaagtgtttg

SEQ ID NO: 113258 - DNA, 25 bp, Homo sapien
ttcaaagtgtttgaccctgaaggca

SEQ ID NO: 113259 - DNA, 25 bp, Homo sapien
gctgaaggctgattacgttcgggaa

SEQ ID NO: 113260 - DNA, 25 bp, Homo sapien
attacgttcgggaaatgctgaccac

SEQ ID NO: 113261 - DNA, 25 bp, Homo sapien
ttcgggaaatgctgaccacgcaggc

SEQ ID NO: 113262 - DNA, 25 bp, Homo sapien
ccacgcaggcggagaggttttccaa

SEQ ID NO: 113263 - DNA, 25 bp, Homo sapien
tttccaaggaggaggttgaccagat

SEQ ID NO: 113264 - DNA, 25 bp, Homo sapien
cccctgacgtgactggcaacttgga

SEQ ID NO: 113265 - DNA, 25 bp, Homo sapien
acgtgactggcaacttggactacaa

SEQ ID NO: 113266 - DNA, 25 bp, Homo sapien
acaagaacctggtgcacatcatcac

SEQ ID NO: 113267 - DNA, 25 bp, Homo sapien
gggctggtaaagcaacacccaccca

SEQ ID NO: 113268 - DNA, 25 bp, Homo sapien
acttctcacactggccttaagaggc

SEQ ID NO: 113269 - DNA, 25 bp, Homo sapien
tgggtccctcctgctatcagctgtg

SEQ ID NO: 113270 - DNA, 25 bp, Homo sapien
tcctgctatcagctgtgctgggcaa

SEQ ID NO: 113271 - DNA, 25 bp, Homo sapien
gctatcagctgtgctgggcaacagc

SEQ ID NO: 113272 - DNA, 25 bp, Homo sapien
gggcaacagcaccagaaaggtgtct

SEQ ID NO: 113273 - DNA, 25 bp, Homo sapien
aaaggtgtctgagtgacaccccacc

SEQ ID NO: 113274 - DNA, 25 bp, Homo sapien
tgtctgagtgacaccccacctaaag

SEQ ID NO: 113275 - DNA, 25 bp, Homo sapien
gagtgacaccccacctaaagcctgt

SEQ ID NO: 113276 - DNA, 25 bp, Homo sapien
taaagcctgtctcaagccctgctgg

SEQ ID NO: 113277 - DNA, 25 bp, Homo sapien
tctctggcgcatcacctgattggag

SEQ ID NO: 113278 - DNA, 25 bp, Homo sapien
gccagcactgtgaaagccatagcta

SEQ ID NO: 113279 - DNA, 25 bp, Homo sapien
aagccatagctattgtcattccctg

SEQ ID NO: 113280 - DNA, 25 bp, Homo sapien
tcattccctgcatcttggccttatg

SEQ ID NO: 113281 - DNA, 25 bp, Homo sapien
atcttggccttatgcctccttgtat

SEQ ID NO: 113282 - DNA, 25 bp, Homo sapien
gcctccttgtattggtttacactgt

SEQ ID NO: 113283 - DNA, 25 bp, Homo sapien
gtttacactgtgttccagttcaaga

SEQ ID NO: 113284 - DNA, 25 bp, Homo sapien
actgtactgtaaacgctctatgcaa

SEQ ID NO: 113285 - DNA, 25 bp, Homo sapien
ctttcttttgcaggagtttgtggta

SEQ ID NO: 113286 - DNA, 25 bp, Homo sapien
aagagctgttatgctgtttcctagc

SEQ ID NO: 113287 - DNA, 25 bp, Homo sapien
gtttcctagctaggagcaggcttgt

SEQ ID NO: 113288 - DNA, 25 bp, Homo sapien
gagcaggcttgtggcagcctgattc

SEQ ID NO: 113289 - DNA, 25 bp, Homo sapien
aagccggccagggaagtactgctgt

SEQ ID NO: 113290 - DNA, 25 bp, Homo sapien
agtactgctgtgtgtacctgcccga

SEQ ID NO: 113291 - DNA, 25 bp, Homo sapien
tggcctcaccatccgagacatgctg

SEQ ID NO: 113292 - DNA, 25 bp, Homo sapien
tgtgagaaacgaggcctctctctac

SEQ ID NO: 113293 - DNA, 25 bp, Homo sapien
atcaaggtctacctggtgggcaatg

SEQ ID NO: 113294 - DNA, 25 bp, Homo sapien
gcaatgaacaggtgggaacgtgacc

SEQ ID NO: 113295 - DNA, 25 bp, Homo sapien
ggtgggaacgtgacctggctccaac

SEQ ID NO: 113296 - DNA, 25 bp, Homo sapien
aacgtgacctggctccaactctaac

SEQ ID NO: 113297 - DNA, 25 bp, Homo sapien
tgtctctgctcagtcatggctccaa

SEQ ID NO: 113298 - DNA, 25 bp, Homo sapien
gctccaaccccaattcaagttctaa

SEQ ID NO: 113299 - DNA, 25 bp, Homo sapien
tcaagttctaaacccaactccaaag

SEQ ID NO: 113300 - DNA, 25 bp, Homo sapien
caatagctagctgcgagcgacaggc

SEQ ID NO: 113301 - DNA, 25 bp, Homo sapien
gacatctgtcttaggctccagtgga

SEQ ID NO: 113302 - DNA, 25 bp, Homo sapien
ctaaggcttgagtgcaggtacccgt

SEQ ID NO: 113303 - DNA, 25 bp, Homo sapien
aggtacccgtgttcctagagcacag

SEQ ID NO: 113304 - DNA, 25 bp, Homo sapien
ctagagcacaggacgctgtctgcgg

SEQ ID NO: 113305 - DNA, 25 bp, Homo sapien
agctccagcctgaactcaaggactg

SEQ ID NO: 113306 - DNA, 25 bp, Homo sapien
aggactgttaagaccactccactga

SEQ ID NO: 113307 - DNA, 25 bp, Homo sapien
ctccactgatccctaaagctgttga

SEQ ID NO: 113308 - DNA, 25 bp, Homo sapien
aagctgttgatgacaagttgattca

SEQ ID NO: 113309 - DNA, 25 bp, Homo sapien
taaaacttctgtacatgcattctca

SEQ ID NO: 113310 - DNA, 25 bp, Homo sapien
tgcattctcagactcatcttttttg

SEQ ID NO: 113311 - DNA, 25 bp, Homo sapien
tgactgctgcacctcctacatctca

SEQ ID NO: 113312 - DNA, 25 bp, Homo sapien
tacatctcacaaagcatcccgtgtt

SEQ ID NO: 113313 - DNA, 25 bp, Homo sapien
atcccgtgttcactcatgaaaagtt

SEQ ID NO: 113314 - DNA, 25 bp, Homo sapien
aagttattttgaaacgagcagcgag

SEQ ID NO: 113315 - DNA, 25 bp, Homo sapien
gcaagtctgtgccaaacccagtggt

SEQ ID NO: 113316 - DNA, 25 bp, Homo sapien
tgtgccaaacccagtggtccgggag

SEQ ID NO: 113317 - DNA, 25 bp, Homo sapien
caaacccagtggtccgggagttcag

SEQ ID NO: 113318 - DNA, 25 bp, Homo sapien
ggattgcatgaaaaagctgaagccc

SEQ ID NO: 113319 - DNA, 25 bp, Homo sapien
gaaaaagctgaagccctactcaata

SEQ ID NO: 113320 - DNA, 25 bp, Homo sapien
aagctgaagccctactcaatataat

SEQ ID NO: 113321 - DNA, 25 bp, Homo sapien
gaagccctactcaatataataataa

SEQ ID NO: 113322 - DNA, 25 bp, Homo sapien
gaaggtggatgaaacagtgctagat

SEQ ID NO: 113323 - DNA, 25 bp, Homo sapien
aaattgtccaggagacgtcatttga

SEQ ID NO: 113324 - DNA, 25 bp, Homo sapien
aatcccatgacaaatcgttctacag

SEQ ID NO: 113325 - DNA, 25 bp, Homo sapien
aaatcgttctacagtttccaaatct

SEQ ID NO: 113326 - DNA, 25 bp, Homo sapien
aaatctatcttggaccagtcaattt

SEQ ID NO: 113327 - DNA, 25 bp, Homo sapien
cagtcaatttcctccttcatgagaa

SEQ ID NO: 113328 - DNA, 25 bp, Homo sapien
ggattggaaaaaccacttcactgtt

SEQ ID NO: 113329 - DNA, 25 bp, Homo sapien
aaaccacttcactgttgcccagaat

SEQ ID NO: 113330 - DNA, 25 bp, Homo sapien
tgttgcccagaatgagaggtttgat

SEQ ID NO: 113331 - DNA, 25 bp, Homo sapien
ggaaggaacctccataaacttctgc

SEQ ID NO: 113332 - DNA, 25 bp, Homo sapien
taaacttctgcatggaactctgagc

SEQ ID NO: 113333 - DNA, 25 bp, Homo sapien
atcaaaaaggtgttcttcagagaca

SEQ ID NO: 113334 - DNA, 25 bp, Homo sapien
ggtgttcttcagagacattttatct

SEQ ID NO: 113335 - DNA, 25 bp, Homo sapien
tttcctactattatgttcattaaca

SEQ ID NO: 113336 - DNA, 25 bp, Homo sapien
aacaaacttctttatcacatgtatc

SEQ ID NO: 113337 - DNA, 25 bp, Homo sapien
gtatcttctacgtgtaaaacatttc

SEQ ID NO: 113338 - DNA, 25 bp, Homo sapien
atgaatttcttcatttgctcttgca

SEQ ID NO: 113339 - DNA, 25 bp, Homo sapien
atttgctcttgcatctacattgcta

SEQ ID NO: 113340 - DNA, 25 bp, Homo sapien
tgctcttgcatctacattgctataa

SEQ ID NO: 113341 - DNA, 25 bp, Homo sapien
tttgagatgttttttccttacaatg

SEQ ID NO: 113342 - DNA, 25 bp, Homo sapien
gttttttccttacaatgtgaactca

SEQ ID NO: 113343 - DNA, 25 bp, Homo sapien
caatgtgaactcatcgtgatcttgg

SEQ ID NO: 113344 - DNA, 25 bp, Homo sapien
gtcctcaccaaagtcctacaggaag

SEQ ID NO: 113345 - DNA, 25 bp, Homo sapien
tgcccggacacatgggcttctcggg

SEQ ID NO: 113346 - DNA, 25 bp, Homo sapien
gggacttccagtccttcgtcaaaga

SEQ ID NO: 113347 - DNA, 25 bp, Homo sapien
agtccttcgtcaaagactgccttac

SEQ ID NO: 113348 - DNA, 25 bp, Homo sapien
tcgtcaaagactgccttactaaaga

SEQ ID NO: 113349 - DNA, 25 bp, Homo sapien
agatcacaggaagagaccaaagtat

SEQ ID NO: 113350 - DNA, 25 bp, Homo sapien
gtataataagctacttgaacacagc

SEQ ID NO: 113351 - DNA, 25 bp, Homo sapien
gaacacagcttcatcaagcgctacg

SEQ ID NO: 113352 - DNA, 25 bp, Homo sapien
tcaagcgctacgagacgctggaggt

SEQ ID NO: 113353 - DNA, 25 bp, Homo sapien
acgtggcgtcctggttcaaggatgt

SEQ ID NO: 113354 - DNA, 25 bp, Homo sapien
cctggttcaaggatgtcatggcgaa

SEQ ID NO: 113355 - DNA, 25 bp, Homo sapien
aattcagatccacaattccacttgg

SEQ ID NO: 113356 - DNA, 25 bp, Homo sapien
gatccacaattccacttggagcaca

SEQ ID NO: 113357 - DNA, 25 bp, Homo sapien
acttggagcacagaggcccagtgtc

SEQ ID NO: 113358 - DNA, 25 bp, Homo sapien
atgcaagtttggtttctatccagaa

SEQ ID NO: 113359 - DNA, 25 bp, Homo sapien
ggatgatgactgaatcttggattat

SEQ ID NO: 113360 - DNA, 25 bp, Homo sapien
gtacagactaggttccagttttctc

SEQ ID NO: 113361 - DNA, 25 bp, Homo sapien
taggttccagttttctcctaacacg

SEQ ID NO: 113362 - DNA, 25 bp, Homo sapien
agttttctcctaacacgtgccaagc

SEQ ID NO: 113363 - DNA, 25 bp, Homo sapien
aagcccaggagcagttcttccctat

SEQ ID NO: 113364 - DNA, 25 bp, Homo sapien
ggagcagttcttccctatggataca

SEQ ID NO: 113365 - DNA, 25 bp, Homo sapien
ttccctatggatacagattttcttt

SEQ ID NO: 113366 - DNA, 25 bp, Homo sapien
aaaggttggcaacattgtacaagtc

SEQ ID NO: 113367 - DNA, 25 bp, Homo sapien
attgtacaagtcacccagccagaag

SEQ ID NO: 113368 - DNA, 25 bp, Homo sapien
acccagccagaaggaatgcacagta

SEQ ID NO: 113369 - DNA, 25 bp, Homo sapien
ggaatgcacagtactgtttcaaatc

SEQ ID NO: 113370 - DNA, 25 bp, Homo sapien
gagatactgttgttacttctgcatg

SEQ ID NO: 113371 - DNA, 25 bp, Homo sapien
tgttgttacttctgcatgttcattg

SEQ ID NO: 113372 - DNA, 25 bp, Homo sapien
gttcattgcaaacagaaggttcctt

SEQ ID NO: 113373 - DNA, 25 bp, Homo sapien
ttgagcacccggaaacggtcacgag

SEQ ID NO: 113374 - DNA, 25 bp, Homo sapien
gaaacggtcacgagacccagaggaa

SEQ ID NO: 113375 - DNA, 25 bp, Homo sapien
gctacaatacggctaatctttcatt

SEQ ID NO: 113376 - DNA, 25 bp, Homo sapien
cggctaatctttcattgggaccgaa

SEQ ID NO: 113377 - DNA, 25 bp, Homo sapien
aagaagaagcgctccaaggccaagg

SEQ ID NO: 113378 - DNA, 25 bp, Homo sapien
agaagcgctccaaggccaaggcgga

SEQ ID NO: 113379 - DNA, 25 bp, Homo sapien
aaggcggagcgagaggcgtcccctg

SEQ ID NO: 113380 - DNA, 25 bp, Homo sapien
atgatcggctgcgacaacgacgagt

SEQ ID NO: 113381 - DNA, 25 bp, Homo sapien
gcgacaacgacgagtgccccatcga

SEQ ID NO: 113382 - DNA, 25 bp, Homo sapien
gagtggttccacttctcgtgcgtgg

SEQ ID NO: 113383 - DNA, 25 bp, Homo sapien
gggctcaatcataaacccaagggca

SEQ ID NO: 113384 - DNA, 25 bp, Homo sapien
cccaagggcaagtggtactgtccca

SEQ ID NO: 113385 - DNA, 25 bp, Homo sapien
gggagaacgagaagaccatggacaa

SEQ ID NO: 113386 - DNA, 25 bp, Homo sapien
gaagaccatggacaaagccctggag

SEQ ID NO: 113387 - DNA, 25 bp, Homo sapien
tccaaaaaagagagggcttacaaca

SEQ ID NO: 113388 - DNA, 25 bp, Homo sapien
tggcaggaccatcactcccttcgag

SEQ ID NO: 113389 - DNA, 25 bp, Homo sapien
ggcaggaccatcactcccttcgagt

SEQ ID NO: 113390 - DNA, 25 bp, Homo sapien
atcactcccttcgagtccccatggc

SEQ ID NO: 113391 - DNA, 25 bp, Homo sapien
atggcccgggccatgtccatcccta

SEQ ID NO: 113392 - DNA, 25 bp, Homo sapien
tacatcacccacacggatcagcttc

SEQ ID NO: 113393 - DNA, 25 bp, Homo sapien
ccacacggatcagcttccacagcat

SEQ ID NO: 113394 - DNA, 25 bp, Homo sapien
acagcatcaagcagacggccgctgt

SEQ ID NO: 113395 - DNA, 25 bp, Homo sapien
agcatcaagcagacggccgctgtgt

SEQ ID NO: 113396 - DNA, 25 bp, Homo sapien
agcagacggccgctgtgtgacccct

SEQ ID NO: 113397 - DNA, 25 bp, Homo sapien
agacggccgctgtgtgacccctcgg

SEQ ID NO: 113398 - DNA, 25 bp, Homo sapien
ggactgcaagggacagggatgagtg

SEQ ID NO: 113399 - DNA, 25 bp, Homo sapien
tttactttgaaactggaagatactg

SEQ ID NO: 113400 - DNA, 25 bp, Homo sapien
actgaaaattggttgtatgaggatg

SEQ ID NO: 113401 - DNA, 25 bp, Homo sapien
ggatggagaagaccagccaaagcaa

SEQ ID NO: 113402 - DNA, 25 bp, Homo sapien
agaccagccaaagcaagtttatgtt

SEQ ID NO: 113403 - DNA, 25 bp, Homo sapien
gtttatgttgataagttggctgaat

SEQ ID NO: 113404 - DNA, 25 bp, Homo sapien
ctaggtcaacctattaagatacgtt

SEQ ID NO: 113405 - DNA, 25 bp, Homo sapien
attaagatacgtttccaggaatctg

SEQ ID NO: 113406 - DNA, 25 bp, Homo sapien
tccaggaatctgaagaacgaccaaa

SEQ ID NO: 113407 - DNA, 25 bp, Homo sapien
gtatgatcatttggatgctgctgac

SEQ ID NO: 113408 - DNA, 25 bp, Homo sapien
catttggatgctgctgacatgacaa

SEQ ID NO: 113409 - DNA, 25 bp, Homo sapien
gctgctgacatgacaaaggtagaaa

SEQ ID NO: 113410 - DNA, 25 bp, Homo sapien
ggaactgtgtttgggagcctcatca

SEQ ID NO: 113411 - DNA, 25 bp, Homo sapien
caggaacccttctctgaagcaacag

SEQ ID NO: 113412 - DNA, 25 bp, Homo sapien
tgaagcaacagctcttctcctacgc

SEQ ID NO: 113413 - DNA, 25 bp, Homo sapien
attctgggctttgccctctcggagg

SEQ ID NO: 113414 - DNA, 25 bp, Homo sapien
tttgtctgatggtagcctttctcat

SEQ ID NO: 113415 - DNA, 25 bp, Homo sapien
tctttgccatgtgaaggagccgtct

SEQ ID NO: 113416 - DNA, 25 bp, Homo sapien
ttgccatgtgaaggagccgtctcca

SEQ ID NO: 113417 - DNA, 25 bp, Homo sapien
tcccatagttctcccgcgtctggtt

SEQ ID NO: 113418 - DNA, 25 bp, Homo sapien
ccgcgtctggttggccccgtgtgtt

SEQ ID NO: 113419 - DNA, 25 bp, Homo sapien
tggccccgtgtgttccttttcctat

SEQ ID NO: 113420 - DNA, 25 bp, Homo sapien
aacgtggttggctcagggtttgaca

SEQ ID NO: 113421 - DNA, 25 bp, Homo sapien
gttgcgaatccctcctgagggagat

SEQ ID NO: 113422 - DNA, 25 bp, Homo sapien
acccttcgaccaggagtcaaattga

SEQ ID NO: 113423 - DNA, 25 bp, Homo sapien
agtcaaattgactttatcagcttta

SEQ ID NO: 113424 - DNA, 25 bp, Homo sapien
gactttatcagctttaatcgatggg

SEQ ID NO: 113425 - DNA, 25 bp, Homo sapien
gctttaatcgatgggaagaacttca

SEQ ID NO: 113426 - DNA, 25 bp, Homo sapien
agaacttcagtgcaggaggtcacaa

SEQ ID NO: 113427 - DNA, 25 bp, Homo sapien
caaggttggcttgggatttgaactg

SEQ ID NO: 113428 - DNA, 25 bp, Homo sapien
gtggtttgaggaaagcatcagattt

SEQ ID NO: 113429 - DNA, 25 bp, Homo sapien
gaagagaaatgaacccactatgttt

SEQ ID NO: 113430 - DNA, 25 bp, Homo sapien
tgaacccactatgttttggccttaa

SEQ ID NO: 113431 - DNA, 25 bp, Homo sapien
taatcctccccacactgaagtctag

SEQ ID NO: 113432 - DNA, 25 bp, Homo sapien
gtgaaggagccgtctccacctccca

SEQ ID NO: 113433 - DNA, 25 bp, Homo sapien
ggagccgtctccacctcccatagtt

SEQ ID NO: 113434 - DNA, 25 bp, Homo sapien
tcccatagttctcccgcgtctggtt

SEQ ID NO: 113435 - DNA, 25 bp, Homo sapien
ccatagttctcccgcgtctggttgg

SEQ ID NO: 113436 - DNA, 25 bp, Homo sapien
atagttctcccgcgtctggttggcc

SEQ ID NO: 113437 - DNA, 25 bp, Homo sapien
tcccgcgtctggttggccccgtgtg

SEQ ID NO: 113438 - DNA, 25 bp, Homo sapien
ccgcgtctggttggccccgtgtgtt

SEQ ID NO: 113439 - DNA, 25 bp, Homo sapien
tctggttggccccgtgtgttccttt

SEQ ID NO: 113440 - DNA, 25 bp, Homo sapien
cttttcctatacctccccaggcagc

SEQ ID NO: 113441 - DNA, 25 bp, Homo sapien
aacgtggttggctcagggtttgaca

SEQ ID NO: 113442 - DNA, 25 bp, Homo sapien
cgtggttggctcagggtttgacaga

SEQ ID NO: 113443 - DNA, 25 bp, Homo sapien
gtgcaagaggttggcagcttcgatt

SEQ ID NO: 113444 - DNA, 25 bp, Homo sapien
caagaggttggcagcttcgattgaa

SEQ ID NO: 113445 - DNA, 25 bp, Homo sapien
gttggcagcttcgattgaagcacat

SEQ ID NO: 113446 - DNA, 25 bp, Homo sapien
gattgaagcacatcgaccggcgaca

SEQ ID NO: 113447 - DNA, 25 bp, Homo sapien
gaagcacatcgaccggcgacagcag

SEQ ID NO: 113448 - DNA, 25 bp, Homo sapien
accggcgacagcagccaggagtcat

SEQ ID NO: 113449 - DNA, 25 bp, Homo sapien
acagcagccaggagtcatgagcgac

SEQ ID NO: 113450 - DNA, 25 bp, Homo sapien
tcatgagcgacagcggcgagcagaa

SEQ ID NO: 113451 - DNA, 25 bp, Homo sapien
acagcggcgagcagaactacggcga

SEQ ID NO: 113452 - DNA, 25 bp, Homo sapien
gcggagcctccttaaggaaggtgca

SEQ ID NO: 113453 - DNA, 25 bp, Homo sapien
gagcctccttaaggaaggtgcaaga

SEQ ID NO: 113454 - DNA, 25 bp, Homo sapien
gtcaatctctccactgaggcaattt

SEQ ID NO: 113455 - DNA, 25 bp, Homo sapien
gacttcatatacctgattcctctag

SEQ ID NO: 113456 - DNA, 25 bp, Homo sapien
acctgattcctctagaaggctgtct

SEQ ID NO: 113457 - DNA, 25 bp, Homo sapien
gaaggctgtctaacataccacatga

SEQ ID NO: 113458 - DNA, 25 bp, Homo sapien
atggtatccatctatctctgttcta

SEQ ID NO: 113459 - DNA, 25 bp, Homo sapien
tatctctgttctattgaatgccttg

SEQ ID NO: 113460 - DNA, 25 bp, Homo sapien
gaatgccttgttaacagccaacact

SEQ ID NO: 113461 - DNA, 25 bp, Homo sapien
gagaatttgttttcaggtctgacac

SEQ ID NO: 113462 - DNA, 25 bp, Homo sapien
aggtctgacacctttcagtctcttt

SEQ ID NO: 113463 - DNA, 25 bp, Homo sapien
aattcatgtctgtatttcaggagca

SEQ ID NO: 113464 - DNA, 25 bp, Homo sapien
atttcaggagcaaactcttcaggct

SEQ ID NO: 113465 - DNA, 25 bp, Homo sapien
ggggcaactgaatctgctttgcagc

SEQ ID NO: 113466 - DNA, 25 bp, Homo sapien
gctttgcagcaaagtcacccttaca

SEQ ID NO: 113467 - DNA, 25 bp, Homo sapien
tttgcagcaaagtcacccttacaaa

SEQ ID NO: 113468 - DNA, 25 bp, Homo sapien
cagctgtgattctcctgataattca

SEQ ID NO: 113469 - DNA, 25 bp, Homo sapien
gctgtgattctcctgataattcaag

SEQ ID NO: 113470 - DNA, 25 bp, Homo sapien
gtgattctcctgataattcaaggga

SEQ ID NO: 113471 - DNA, 25 bp, Homo sapien
tcctgataattcaagggagctcaaa

SEQ ID NO: 113472 - DNA, 25 bp, Homo sapien
aattcaagggagctcaaagtcacaa

SEQ ID NO: 113473 - DNA, 25 bp, Homo sapien
aattggtttgaagatgtaattgctc

SEQ ID NO: 113474 - DNA, 25 bp, Homo sapien
agatgtaattgctctagtttggatt

SEQ ID NO: 113475 - DNA, 25 bp, Homo sapien
atgtaattgctctagtttggattaa

SEQ ID NO: 113476 - DNA, 25 bp, Homo sapien
aaatttgcaactcactgattctcta

SEQ ID NO: 113477 - DNA, 25 bp, Homo sapien
tcactgattctctacatgctctttt

SEQ ID NO: 113478 - DNA, 25 bp, Homo sapien
attctctacatgctctttttctgtg

SEQ ID NO: 113479 - DNA, 25 bp, Homo sapien
gctctttttctgtgataactctgca

SEQ ID NO: 113480 - DNA, 25 bp, Homo sapien
ttctgtgataactctgcaaaggcct

SEQ ID NO: 113481 - DNA, 25 bp, Homo sapien
gagggagagactaaccttgagtcag

SEQ ID NO: 113482 - DNA, 25 bp, Homo sapien
actaaccttgagtcagaaaacagag

SEQ ID NO: 113483 - DNA, 25 bp, Homo sapien
tttgcttcaaattcaaggccttcca

SEQ ID NO: 113484 - DNA, 25 bp, Homo sapien
gcttcaaattcaaggccttccaacg

SEQ ID NO: 113485 - DNA, 25 bp, Homo sapien
ggactctgatcccatattcttaaca

SEQ ID NO: 113486 - DNA, 25 bp, Homo sapien
agatctttactcttgagaaatgaat

SEQ ID NO: 113487 - DNA, 25 bp, Homo sapien
tttccaggcaaacctgtatgtggga

SEQ ID NO: 113488 - DNA, 25 bp, Homo sapien
acctgtatgtgggactggtggtcat

SEQ ID NO: 113489 - DNA, 25 bp, Homo sapien
caactcattattgaaaaggccgaac

SEQ ID NO: 113490 - DNA, 25 bp, Homo sapien
aaggccgaacatggagatcaagatt

SEQ ID NO: 113491 - DNA, 25 bp, Homo sapien
gatcaagattatatctggcactgca

SEQ ID NO: 113492 - DNA, 25 bp, Homo sapien
atctggcactgcattgatctcttct

SEQ ID NO: 113493 - DNA, 25 bp, Homo sapien
cttagatttcattactgtcttcaga

SEQ ID NO: 113494 - DNA, 25 bp, Homo sapien
gaaaactcatgatgatcctggccat

SEQ ID NO: 113495 - DNA, 25 bp, Homo sapien
aaatgaagtgaccatccagcctttc

SEQ ID NO: 113496 - DNA, 25 bp, Homo sapien
atttcctttttgcacacattacagg

SEQ ID NO: 113497 - DNA, 25 bp, Homo sapien
gcacacattacaggtggtgtgttct

SEQ ID NO: 113498 - DNA, 25 bp, Homo sapien
ctcctcttccttcttatataatgct

SEQ ID NO: 113499 - DNA, 25 bp, Homo sapien
aatgctagtatattctcaaaattgc

SEQ ID NO: 113500 - DNA, 25 bp, Homo sapien
aataatcatggctaatgttccaata

SEQ ID NO: 113501 - DNA, 25 bp, Homo sapien
gttccaataatgaggtctttgtgca

SEQ ID NO: 113502 - DNA, 25 bp, Homo sapien
ggtctttgtgcatttagttccgcat

SEQ ID NO: 113503 - DNA, 25 bp, Homo sapien
ttagttccgcatatgatggtttttt

SEQ ID NO: 113504 - DNA, 25 bp, Homo sapien
gagtatatgtgtcttaatgcagtca

SEQ ID NO: 113505 - DNA, 25 bp, Homo sapien
gtgtcttaatgcagtcagattgtaa

SEQ ID NO: 113506 - DNA, 25 bp, Homo sapien
ctgttttgtccaatattggtagtac

SEQ ID NO: 113507 - DNA, 25 bp, Homo sapien
ttggtagtacttttttgcctcttat

SEQ ID NO: 113508 - DNA, 25 bp, Homo sapien
ttttttgcctcttatgattcctcta

SEQ ID NO: 113509 - DNA, 25 bp, Homo sapien
tgcacctggtgctccgtctcagagg

SEQ ID NO: 113510 - DNA, 25 bp, Homo sapien
gcacctggtgctccgtctcagaggt

SEQ ID NO: 113511 - DNA, 25 bp, Homo sapien
acctggtgctccgtctcagaggtgg

SEQ ID NO: 113512 - DNA, 25 bp, Homo sapien
tgctccgtctcagaggtgggatgca

SEQ ID NO: 113513 - DNA, 25 bp, Homo sapien
caccatcgagaatgtcaaggcaaag

SEQ ID NO: 113514 - DNA, 25 bp, Homo sapien
atcgagaatgtcaaggcaaagatcc

SEQ ID NO: 113515 - DNA, 25 bp, Homo sapien
aacagctggaagatggacgcaccct

SEQ ID NO: 113516 - DNA, 25 bp, Homo sapien
acagctggaagatggacgcaccctg

SEQ ID NO: 113517 - DNA, 25 bp, Homo sapien
cagctggaagatggacgcaccctgt

SEQ ID NO: 113518 - DNA, 25 bp, Homo sapien
agctggaagatggacgcaccctgtc

SEQ ID NO: 113519 - DNA, 25 bp, Homo sapien
aaagagtccactctgcacttggtcc

SEQ ID NO: 113520 - DNA, 25 bp, Homo sapien
ggcgttggctccgaagacttagcga

SEQ ID NO: 113521 - DNA, 25 bp, Homo sapien
gttggctccgaagacttagcgacgc

SEQ ID NO: 113522 - DNA, 25 bp, Homo sapien
ttagcgacgccactggcggcacctt

SEQ ID NO: 113523 - DNA, 25 bp, Homo sapien
tgcgcccagtgatgtttccacggtg

SEQ ID NO: 113524 - DNA, 25 bp, Homo sapien
tttccacggtgcctgtacacagccg

SEQ ID NO: 113525 - DNA, 25 bp, Homo sapien
acggtgcctgtacacagccgagcag

SEQ ID NO: 113526 - DNA, 25 bp, Homo sapien
cacagccgagcagcatttccgttga

SEQ ID NO: 113527 - DNA, 25 bp, Homo sapien
gttgaaggacttgcatccccattgc

SEQ ID NO: 113528 - DNA, 25 bp, Homo sapien
gggaggcgccgcatgccttgtaccc

SEQ ID NO: 113529 - DNA, 25 bp, Homo sapien
ggttttctccgcaggttgaacatgg

SEQ ID NO: 113530 - DNA, 25 bp, Homo sapien
aagcaaacttgtatggaattcaaaa

SEQ ID NO: 113531 - DNA, 25 bp, Homo sapien
ctgcagctggaatacccagtacagt

SEQ ID NO: 113532 - DNA, 25 bp, Homo sapien
tggaatacccagtacagttctgctt

SEQ ID NO: 113533 - DNA, 25 bp, Homo sapien
gaatacccagtacagttctgcttac

SEQ ID NO: 113534 - DNA, 25 bp, Homo sapien
tacccagtacagttctgcttactac

SEQ ID NO: 113535 - DNA, 25 bp, Homo sapien
acccagtacagttctgcttactaca

SEQ ID NO: 113536 - DNA, 25 bp, Homo sapien
ccagtacagttctgcttactacact

SEQ ID NO: 113537 - DNA, 25 bp, Homo sapien
gtacagttctgcttactacacttca

SEQ ID NO: 113538 - DNA, 25 bp, Homo sapien
acagttctgcttactacacttcaag

SEQ ID NO: 113539 - DNA, 25 bp, Homo sapien
cagttctgcttactacacttcaaga

SEQ ID NO: 113540 - DNA, 25 bp, Homo sapien
ctgcttactacacttcaagaaagat

SEQ ID NO: 113541 - DNA, 25 bp, Homo sapien
ttactacacttcaagaaagatctga

SEQ ID NO: 113542 - DNA, 25 bp, Homo sapien
gcacaagggaagtacattgctatag

SEQ ID NO: 113543 - DNA, 25 bp, Homo sapien
tacaactgtggaaaccaaggagcct

SEQ ID NO: 113544 - DNA, 25 bp, Homo sapien
ggaaatcagaccagctttggagctc

SEQ ID NO: 113545 - DNA, 25 bp, Homo sapien
cagctttggagctcttggaaccaat

SEQ ID NO: 113546 - DNA, 25 bp, Homo sapien
aatttgttagcatcagtgacctcct

SEQ ID NO: 113547 - DNA, 25 bp, Homo sapien
gtgacctcctggtaccaaaagactt

SEQ ID NO: 113548 - DNA, 25 bp, Homo sapien
agatctttatttcccgcacatatga

SEQ ID NO: 113549 - DNA, 25 bp, Homo sapien
ttatttcccgcacatatgatgccac

SEQ ID NO: 113550 - DNA, 25 bp, Homo sapien
atgatgccaccactcattttgagac

SEQ ID NO: 113551 - DNA, 25 bp, Homo sapien
ttttgagacaacgtgtgatgacatt

SEQ ID NO: 113552 - DNA, 25 bp, Homo sapien
gacaggatcagagtttgactttgag

SEQ ID NO: 113553 - DNA, 25 bp, Homo sapien
aggcaggcattcctgaagggaacta

SEQ ID NO: 113554 - DNA, 25 bp, Homo sapien
tcctgaagggaactagaggtgttac

SEQ ID NO: 113555 - DNA, 25 bp, Homo sapien
ggacccttacgtgagaaatagctga

SEQ ID NO: 113556 - DNA, 25 bp, Homo sapien
aaatagctgaaaagggcactcccaa

SEQ ID NO: 113557 - DNA, 25 bp, Homo sapien
tgaaaagggcactcccaaccctggg

SEQ ID NO: 113558 - DNA, 25 bp, Homo sapien
tgctgcccagtgcaaaccacttctc

SEQ ID NO: 113559 - DNA, 25 bp, Homo sapien
ccagggtgagcagggtcaagcctct

SEQ ID NO: 113560 - DNA, 25 bp, Homo sapien
agggtgagcagggtcaagcctctta

SEQ ID NO: 113561 - DNA, 25 bp, Homo sapien
ggtgagcagggtcaagcctcttatt

SEQ ID NO: 113562 - DNA, 25 bp, Homo sapien
tcaagcctcttattccaggagaagg

SEQ ID NO: 113563 - DNA, 25 bp, Homo sapien
caagcctcttattccaggagaaggg

SEQ ID NO: 113564 - DNA, 25 bp, Homo sapien
aatgattaagtaagtgccttctgaa

SEQ ID NO: 113565 - DNA, 25 bp, Homo sapien
agtaagtgccttctgaaactgctgc

SEQ ID NO: 113566 - DNA, 25 bp, Homo sapien
gcagtttctctttgggggtattggt

SEQ ID NO: 113567 - DNA, 25 bp, Homo sapien
ggtattggtagccattcagtatttt

SEQ ID NO: 113568 - DNA, 25 bp, Homo sapien
aattctgttgacattaaatgatatc

SEQ ID NO: 113569 - DNA, 25 bp, Homo sapien
aaatgatatcagcagtccagaagtc

SEQ ID NO: 113570 - DNA, 25 bp, Homo sapien
tgatatcagcagtccagaagtcttg

SEQ ID NO: 113571 - DNA, 25 bp, Homo sapien
atatcagcagtccagaagtcttggc

SEQ ID NO: 113572 - DNA, 25 bp, Homo sapien
tcagcagtccagaagtcttggcaaa

SEQ ID NO: 113573 - DNA, 25 bp, Homo sapien
agcagtccagaagtcttggcaaaat

SEQ ID NO: 113574 - DNA, 25 bp, Homo sapien
gtccagaagtcttggcaaaatgtaa

SEQ ID NO: 113575 - DNA, 25 bp, Homo sapien
ggccaccgagagtgtcgttaaaaat

SEQ ID NO: 113576 - DNA, 25 bp, Homo sapien
aagtgcgacttttgaaatgtttgga

SEQ ID NO: 113577 - DNA, 25 bp, Homo sapien
ggaaggtttatttctcatgcacatt

SEQ ID NO: 113578 - DNA, 25 bp, Homo sapien
tatttctcatgcacattccagggaa

SEQ ID NO: 113579 - DNA, 25 bp, Homo sapien
aaggccgtgggagaactcgatccta

SEQ ID NO: 113580 - DNA, 25 bp, Homo sapien
agaactcgatcctagcctgtgtcag

SEQ ID NO: 113581 - DNA, 25 bp, Homo sapien
gcctgtgtcagctggatgtgtttac

SEQ ID NO: 113582 - DNA, 25 bp, Homo sapien
tttacgtggagaggcgtggccactt

SEQ ID NO: 113583 - DNA, 25 bp, Homo sapien
tggccactttttaggtcacctgaag

SEQ ID NO: 113584 - DNA, 25 bp, Homo sapien
ggtcacctgaagcagtttagccttt

SEQ ID NO: 113585 - DNA, 25 bp, Homo sapien
agcctttggatagaggaacctgcct

SEQ ID NO: 113586 - DNA, 25 bp, Homo sapien
tctcaaaatcagacctggtcaactg

SEQ ID NO: 113587 - DNA, 25 bp, Homo sapien
atcagacctggtcaactggttcaag

SEQ ID NO: 113588 - DNA, 25 bp, Homo sapien
cagacctggtcaactggttcaaggc

SEQ ID NO: 113589 - DNA, 25 bp, Homo sapien
gagggccaggaagtaaaatgctcag

SEQ ID NO: 113590 - DNA, 25 bp, Homo sapien
ggaagtaaaatgctcagcgttcatg

SEQ ID NO: 113591 - DNA, 25 bp, Homo sapien
ccccttctagtgaggattcaaattc

SEQ ID NO: 113592 - DNA, 25 bp, Homo sapien
aggattcaaattcttcttgtgaagt

SEQ ID NO: 113593 - DNA, 25 bp, Homo sapien
tcttgtgaagtgatgcagctgacct

SEQ ID NO: 113594 - DNA, 25 bp, Homo sapien
cagggctttcacaacaacactcaac

SEQ ID NO: 113595 - DNA, 25 bp, Homo sapien
ggctttcacaacaacactcaacctt

SEQ ID NO: 113596 - DNA, 25 bp, Homo sapien
ttctcccctaccataaaatagtcaa

SEQ ID NO: 113597 - DNA, 25 bp, Homo sapien
gtagtgaaggccacttgaagctgga

SEQ ID NO: 113598 - DNA, 25 bp, Homo sapien
catgttatagatccttttgttgctg

SEQ ID NO: 113599 - DNA, 25 bp, Homo sapien
gatccttttgttgctgagagagtgg

SEQ ID NO: 113600 - DNA, 25 bp, Homo sapien
gagagtggaacataggtcctagaca

SEQ ID NO: 113601 - DNA, 25 bp, Homo sapien
agacagggtgaagagttctggcaca

SEQ ID NO: 113602 - DNA, 25 bp, Homo sapien
gttctggcacattttagctgctact

SEQ ID NO: 113603 - DNA, 25 bp, Homo sapien
ttagctgctactttgagacctcggt

SEQ ID NO: 113604 - DNA, 25 bp, Homo sapien
gagacctcggtgatgttacctggtg

SEQ ID NO: 113605 - DNA, 25 bp, Homo sapien
atgttacctggtgtggtcatcccat

SEQ ID NO: 113606 - DNA, 25 bp, Homo sapien
catcccatcttgtcctgttttaagg

SEQ ID NO: 113607 - DNA, 25 bp, Homo sapien
ggcagagtttatcccaatgacttct

SEQ ID NO: 113608 - DNA, 25 bp, Homo sapien
agatgtgacagcaaagcgcatgagc

SEQ ID NO: 113609 - DNA, 25 bp, Homo sapien
caaagcgcatgagctgccatgctgt

SEQ ID NO: 113610 - DNA, 25 bp, Homo sapien
cattcagcgatgcaagactttggac

SEQ ID NO: 113611 - DNA, 25 bp, Homo sapien
gcaagactttggactgctacgatcc

SEQ ID NO: 113612 - DNA, 25 bp, Homo sapien
ggactgctacgatccaacattagac

SEQ ID NO: 113613 - DNA, 25 bp, Homo sapien
ttagacgtgtggaacagcatcacca

SEQ ID NO: 113614 - DNA, 25 bp, Homo sapien
gtactcgctgattcctactgcattt

SEQ ID NO: 113615 - DNA, 25 bp, Homo sapien
ctggaaacatctgccttcttaaatg

SEQ ID NO: 113616 - DNA, 25 bp, Homo sapien
gccttcttaaatgcagtacattcta

SEQ ID NO: 113617 - DNA, 25 bp, Homo sapien
tgagcatgagctcactccatcactc

SEQ ID NO: 113618 - DNA, 25 bp, Homo sapien
gctcactccatcactcgatgagata

SEQ ID NO: 113619 - DNA, 25 bp, Homo sapien
ggaacaaagcgccagtgaactctga

SEQ ID NO: 113620 - DNA, 25 bp, Homo sapien
aagcgccagtgaactctgactgtat

SEQ ID NO: 113621 - DNA, 25 bp, Homo sapien
actctgactgtatgagatgttaaat

SEQ ID NO: 113622 - DNA, 25 bp, Homo sapien
gttaaaagcaaacacttacagaatt

SEQ ID NO: 113623 - DNA, 25 bp, Homo sapien
gaagaggtatctgtttaacatttcc

SEQ ID NO: 113624 - DNA, 25 bp, Homo sapien
gtttaacatttcctcagtcaagttc

SEQ ID NO: 113625 - DNA, 25 bp, Homo sapien
atttcctcagtcaagttcagagtct

SEQ ID NO: 113626 - DNA, 25 bp, Homo sapien
ctcagtcaagttcagagtcttcaga

SEQ ID NO: 113627 - DNA, 25 bp, Homo sapien
tcttcagagacttcgtaattaaagg

SEQ ID NO: 113628 - DNA, 25 bp, Homo sapien
gaacagagtgagagacatcatcaag

SEQ ID NO: 113629 - DNA, 25 bp, Homo sapien
gagagacatcatcaagtggagagaa

SEQ ID NO: 113630 - DNA, 25 bp, Homo sapien
atacattttcaacagatccagtcaa

SEQ ID NO: 113631 - DNA, 25 bp, Homo sapien
tcaacagatccagtcaattttccaa

SEQ ID NO: 113632 - DNA, 25 bp, Homo sapien
gcaaatccatggtgaaatatgtact

SEQ ID NO: 113633 - DNA, 25 bp, Homo sapien
aaatatgtactgacttgttccaaag

SEQ ID NO: 113634 - DNA, 25 bp, Homo sapien
tgttccaaaggtctctgtctccaag

SEQ ID NO: 113635 - DNA, 25 bp, Homo sapien
aggtctctgtctccaagttcatcag

SEQ ID NO: 113636 - DNA, 25 bp, Homo sapien
agttcatcagcagaaagctccgtaa

SEQ ID NO: 113637 - DNA, 25 bp, Homo sapien
atgactgtacacatcaaccttcaga

SEQ ID NO: 113638 - DNA, 25 bp, Homo sapien
caaccttcagaggaaactacttcaa

SEQ ID NO: 113639 - DNA, 25 bp, Homo sapien
gggagaaatcaagccatcattggga

SEQ ID NO: 113640 - DNA, 25 bp, Homo sapien
caagccatcattgggagatactagt

SEQ ID NO: 113641 - DNA, 25 bp, Homo sapien
gaatgctctgcagaaatatcccaac

SEQ ID NO: 113642 - DNA, 25 bp, Homo sapien
agaaatatcccaactgtcctacaga

SEQ ID NO: 113643 - DNA, 25 bp, Homo sapien
aactgtcctacagatgtgaggcagt

SEQ ID NO: 113644 - DNA, 25 bp, Homo sapien
gaggcagtgggcaacatcctcacta

SEQ ID NO: 113645 - DNA, 25 bp, Homo sapien
aacatcctcactaagctggttatga

SEQ ID NO: 113646 - DNA, 25 bp, Homo sapien
cagtgacttcaactttggcatttca

SEQ ID NO: 113647 - DNA, 25 bp, Homo sapien
ggcatttcattcatacttctgtaga

SEQ ID NO: 113648 - DNA, 25 bp, Homo sapien
gaaaactattgtccattaacatgat

SEQ ID NO: 113649 - DNA, 25 bp, Homo sapien
gtatttatgtgagacttgcccatct

SEQ ID NO: 113650 - DNA, 25 bp, Homo sapien
catctactgtcttggctgtgtcttg

SEQ ID NO: 113651 - DNA, 25 bp, Homo sapien
ttgccttttaatcatgaacagttac

SEQ ID NO: 113652 - DNA, 25 bp, Homo sapien
cagcaagtttctgagatctattgca

SEQ ID NO: 113653 - DNA, 25 bp, Homo sapien
aagtttctgagatctattgcatagt

SEQ ID NO: 113654 - DNA, 25 bp, Homo sapien
ctgagatctattgcatagtgtggtg

SEQ ID NO: 113655 - DNA, 25 bp, Homo sapien
caaatgtctcaccataaaaaacgtt

SEQ ID NO: 113656 - DNA, 25 bp, Homo sapien
aaacgttaaacaaggtgatggatat

SEQ ID NO: 113657 - DNA, 25 bp, Homo sapien
ggatatgttaagcttgacttagtcg

SEQ ID NO: 113658 - DNA, 25 bp, Homo sapien
gttaagcttgacttagtcgttccat

SEQ ID NO: 113659 - DNA, 25 bp, Homo sapien
cttgacttagtcgttccatattgta

SEQ ID NO: 113660 - DNA, 25 bp, Homo sapien
gacttagtcgttccatattgtatac

SEQ ID NO: 113661 - DNA, 25 bp, Homo sapien
cttagtcgttccatattgtatacat

SEQ ID NO: 113662 - DNA, 25 bp, Homo sapien
gtcgttccatattgtatacatatat

SEQ ID NO: 113663 - DNA, 25 bp, Homo sapien
ggtcgccaccgggtcattaaatgtg

SEQ ID NO: 113664 - DNA, 25 bp, Homo sapien
ggtcattaaatgtggagcaggcgaa

SEQ ID NO: 113665 - DNA, 25 bp, Homo sapien
aaggcaggagaactcattagcgaga

SEQ ID NO: 113666 - DNA, 25 bp, Homo sapien
gcgagaagaagtaccgtcagcatcc

SEQ ID NO: 113667 - DNA, 25 bp, Homo sapien
taccgtcagcatccagatgctttga

SEQ ID NO: 113668 - DNA, 25 bp, Homo sapien
ccagatgctttgaagtttaccagta

SEQ ID NO: 113669 - DNA, 25 bp, Homo sapien
tttaccagtattaaagacactccgg

SEQ ID NO: 113670 - DNA, 25 bp, Homo sapien
attaaagacactccggagatggtcc

SEQ ID NO: 113671 - DNA, 25 bp, Homo sapien
gatggtccaggccagaattagttat

SEQ ID NO: 113672 - DNA, 25 bp, Homo sapien
gaattagttatacccaagcagtgga

SEQ ID NO: 113673 - DNA, 25 bp, Homo sapien
cccaagcagtggatagattatacag

SEQ ID NO: 113674 - DNA, 25 bp, Homo sapien
tattttgcttacatgtgctttttaa

SEQ ID NO: 113675 - DNA, 25 bp, Homo sapien
ggagactaaactttatacttcattt

SEQ ID NO: 113676 - DNA, 25 bp, Homo sapien
aatatgaagccatgtctcactgttt

SEQ ID NO: 113677 - DNA, 25 bp, Homo sapien
gaagccatgtctcactgtttaaata

SEQ ID NO: 113678 - DNA, 25 bp, Homo sapien
gccatgtctcactgtttaaataaaa

SEQ ID NO: 113679 - DNA, 25 bp, Homo sapien
acatttcatgtcaggattgcaagca

SEQ ID NO: 113680 - DNA, 25 bp, Homo sapien
ggattgcaagcattagctatcacag

SEQ ID NO: 113681 - DNA, 25 bp, Homo sapien
gcaagcattagctatcacagcaaag

SEQ ID NO: 113682 - DNA, 25 bp, Homo sapien
agctatcacagcaaaggattcctag

SEQ ID NO: 113683 - DNA, 25 bp, Homo sapien
gcaaaggattcctagcctattctta

SEQ ID NO: 113684 - DNA, 25 bp, Homo sapien
gattcctagcctattcttacttact

SEQ ID NO: 113685 - DNA, 25 bp, Homo sapien
gcccataaataattgctggaaaatt

SEQ ID NO: 113686 - DNA, 25 bp, Homo sapien
gtagaaaacatatagtcagtgaagt

SEQ ID NO: 113687 - DNA, 25 bp, Homo sapien
gagattcagaatgataacctctttt

SEQ ID NO: 113688 - DNA, 25 bp, Homo sapien
gaatgataacctcttttagagaaca

SEQ ID NO: 113689 - DNA, 25 bp, Homo sapien
aagctagatgactttgaaatgctat

SEQ ID NO: 113690 - DNA, 25 bp, Homo sapien
gaaatgctatactgtcctgcttgta

SEQ ID NO: 113691 - DNA, 25 bp, Homo sapien
atgctatactgtcctgcttgtacaa

SEQ ID NO: 113692 - DNA, 25 bp, Homo sapien
tatactgtcctgcttgtacaacatg

SEQ ID NO: 113693 - DNA, 25 bp, Homo sapien
actgtcctgcttgtacaacatggtt

SEQ ID NO: 113694 - DNA, 25 bp, Homo sapien
tcctgcttgtacaacatggtttggg

SEQ ID NO: 113695 - DNA, 25 bp, Homo sapien
aatctatatcgctagtaaattgtaa

SEQ ID NO: 113696 - DNA, 25 bp, Homo sapien
agagcataaggacgaaggtccgact

SEQ ID NO: 113697 - DNA, 25 bp, Homo sapien
ataaggacgaaggtccgactgccgc

SEQ ID NO: 113698 - DNA, 25 bp, Homo sapien
taaggacgaaggtccgactgccgcc

SEQ ID NO: 113699 - DNA, 25 bp, Homo sapien
gacgaaggtccgactgccgccgcag

SEQ ID NO: 113700 - DNA, 25 bp, Homo sapien
cggacaaggccgacgaggaggacga

SEQ ID NO: 113701 - DNA, 25 bp, Homo sapien
ctctctgcaccggacagtcggaaaa

SEQ ID NO: 113702 - DNA, 25 bp, Homo sapien
tctctgcaccggacagtcggaaaag

SEQ ID NO: 113703 - DNA, 25 bp, Homo sapien
tctgcaccggacagtcggaaaagcg

SEQ ID NO: 113704 - DNA, 25 bp, Homo sapien
gcaccggacagtcggaaaagcgtct

SEQ ID NO: 113705 - DNA, 25 bp, Homo sapien
acagtcggaaaagcgtctttaagag

SEQ ID NO: 113706 - DNA, 25 bp, Homo sapien
ggaaaagcgtctttaagagactcac

SEQ ID NO: 113707 - DNA, 25 bp, Homo sapien
gattgacaaagtaagggccttgatt

SEQ ID NO: 113708 - DNA, 25 bp, Homo sapien
gccttgattaggaccaaattctcgt

SEQ ID NO: 113709 - DNA, 25 bp, Homo sapien
aaattctcgtgtgttgctatggtct

SEQ ID NO: 113710 - DNA, 25 bp, Homo sapien
ctcgtgtgttgctatggtctttatt

SEQ ID NO: 113711 - DNA, 25 bp, Homo sapien
tgctatggtctttatttaggacaac

SEQ ID NO: 113712 - DNA, 25 bp, Homo sapien
ttaggacaacaattaacaatgcagt

SEQ ID NO: 113713 - DNA, 25 bp, Homo sapien
taacaatgcagtggcccattcttgt

SEQ ID NO: 113714 - DNA, 25 bp, Homo sapien
ccattcttgtcactctacacatatg

SEQ ID NO: 113715 - DNA, 25 bp, Homo sapien
tctacacatatgactatacgggaca

SEQ ID NO: 113716 - DNA, 25 bp, Homo sapien
gatggaggaatttctgttgagctga

SEQ ID NO: 113717 - DNA, 25 bp, Homo sapien
atttctgttgagctgaaatgcacct

SEQ ID NO: 113718 - DNA, 25 bp, Homo sapien
ccggcctgggttggagggagcggat

SEQ ID NO: 113719 - DNA, 25 bp, Homo sapien
cccctggttgttgtagcagcttaac

SEQ ID NO: 113720 - DNA, 25 bp, Homo sapien
ccctggttgttgtagcagcttaact

SEQ ID NO: 113721 - DNA, 25 bp, Homo sapien
ggttgttgtagcagcttaactgtat

SEQ ID NO: 113722 - DNA, 25 bp, Homo sapien
gttgtagcagcttaactgtatctgg

SEQ ID NO: 113723 - DNA, 25 bp, Homo sapien
ttaactgtatctggagccaggacct

SEQ ID NO: 113724 - DNA, 25 bp, Homo sapien
ctcctacctcttcatgtttacatat

SEQ ID NO: 113725 - DNA, 25 bp, Homo sapien
tcatgtttacatatacccagtatct

SEQ ID NO: 113726 - DNA, 25 bp, Homo sapien
atatacccagtatctttgcacaaac

SEQ ID NO: 113727 - DNA, 25 bp, Homo sapien
atacccagtatctttgcacaaacca

SEQ ID NO: 113728 - DNA, 25 bp, Homo sapien
cccagtatctttgcacaaaccaggg

SEQ ID NO: 113729 - DNA, 25 bp, Homo sapien
gaagaacctcatcaggcgactacag

SEQ ID NO: 113730 - DNA, 25 bp, Homo sapien
acagaagtatcctgtgcgggtgact

SEQ ID NO: 113731 - DNA, 25 bp, Homo sapien
tgcccggctttatacaggctgccac

SEQ ID NO: 113732 - DNA, 25 bp, Homo sapien
ggctgccacagctatgacgagatct

SEQ ID NO: 113733 - DNA, 25 bp, Homo sapien
acgagatctgctgcaagacaggcat

SEQ ID NO: 113734 - DNA, 25 bp, Homo sapien
gcatgagctaccatgagctggatga

SEQ ID NO: 113735 - DNA, 25 bp, Homo sapien
atgagcggcttgaaaatgaccccaa

SEQ ID NO: 113736 - DNA, 25 bp, Homo sapien
gaaaatgaccccaacatcatcatct

SEQ ID NO: 113737 - DNA, 25 bp, Homo sapien
gacacattgctgtgggtagtccctc

SEQ ID NO: 113738 - DNA, 25 bp, Homo sapien
tgtgggtagtccctcctactaggag

SEQ ID NO: 113739 - DNA, 25 bp, Homo sapien
aggaggcttgtcatactgtctagag

SEQ ID NO: 113740 - DNA, 25 bp, Homo sapien
tacagcgcagaacccagatgagctg

SEQ ID NO: 113741 - DNA, 25 bp, Homo sapien
agaacccagatgagctggacctgtc

SEQ ID NO: 113742 - DNA, 25 bp, Homo sapien
aacccagatgagctggacctgtccg

SEQ ID NO: 113743 - DNA, 25 bp, Homo sapien
ccagatgagctggacctgtccgcgg

SEQ ID NO: 113744 - DNA, 25 bp, Homo sapien
gacctgtccgcgggagacatcctgg

SEQ ID NO: 113745 - DNA, 25 bp, Homo sapien
acatcctggaggtgatcctggaagg

SEQ ID NO: 113746 - DNA, 25 bp, Homo sapien
gaacgggcagcgtggcttcgtccct

SEQ ID NO: 113747 - DNA, 25 bp, Homo sapien
agcgtggcttcgtccctggttccta

SEQ ID NO: 113748 - DNA, 25 bp, Homo sapien
tcgtccctggttcctacctggagaa

SEQ ID NO: 113749 - DNA, 25 bp, Homo sapien
gtccccaccttgctagggcccagaa

SEQ ID NO: 113750 - DNA, 25 bp, Homo sapien
agccccgagagggagcctgtcgtct

SEQ ID NO: 113751 - DNA, 25 bp, Homo sapien
gtacatcccattgtcatgttgcaga

SEQ ID NO: 113752 - DNA, 25 bp, Homo sapien
ttgtcatgttgcagaagatcccttc

SEQ ID NO: 113753 - DNA, 25 bp, Homo sapien
aagatcccttctatgcctagtttat

SEQ ID NO: 113754 - DNA, 25 bp, Homo sapien
atagaagggtgttgtatttcatcaa

SEQ ID NO: 113755 - DNA, 25 bp, Homo sapien
tcatcaatgttttctctgcagcaat

SEQ ID NO: 113756 - DNA, 25 bp, Homo sapien
aatcacgtgcttattcattttactg

SEQ ID NO: 113757 - DNA, 25 bp, Homo sapien
actgttacagcatattacactgatt

SEQ ID NO: 113758 - DNA, 25 bp, Homo sapien
tatgttgaaccacccatgcattttg

SEQ ID NO: 113759 - DNA, 25 bp, Homo sapien
aatctcaaagggtgatagtttacaa

SEQ ID NO: 113760 - DNA, 25 bp, Homo sapien
gtttacaatcctttgattatacagt

SEQ ID NO: 113761 - DNA, 25 bp, Homo sapien
cagtattgctgctagtattttgcta

SEQ ID NO: 113762 - DNA, 25 bp, Homo sapien
agctgcactgggttcctctatcgga

SEQ ID NO: 113763 - DNA, 25 bp, Homo sapien
tgcactgggttcctctatcggaaca

SEQ ID NO: 113764 - DNA, 25 bp, Homo sapien
agcagttgttggaggtctgatgaca

SEQ ID NO: 113765 - DNA, 25 bp, Homo sapien
caattcacccatttggttctatgat

SEQ ID NO: 113766 - DNA, 25 bp, Homo sapien
cacccatttggttctatgattattg

SEQ ID NO: 113767 - DNA, 25 bp, Homo sapien
gttctatgattattgggagcattgc

SEQ ID NO: 113768 - DNA, 25 bp, Homo sapien
ggagcattgcaggaatggtctctgt

SEQ ID NO: 113769 - DNA, 25 bp, Homo sapien
cattgcaggaatggtctctgtgctt

SEQ ID NO: 113770 - DNA, 25 bp, Homo sapien
caggaatggtctctgtgcttggata

SEQ ID NO: 113771 - DNA, 25 bp, Homo sapien
tgtgcttggatacaagttcctgact

SEQ ID NO: 113772 - DNA, 25 bp, Homo sapien
atgcaggcagctgcactgggttcct

SEQ ID NO: 113773 - DNA, 25 bp, Homo sapien
tcccctttaggagcgttttcagatt

SEQ ID NO: 113774 - DNA, 25 bp, Homo sapien
gacctgaatcccatattgagatctc

SEQ ID NO: 113775 - DNA, 25 bp, Homo sapien
tgagatctcgagtagaatccttggt

SEQ ID NO: 113776 - DNA, 25 bp, Homo sapien
aatccttggtgtggtttctggtgtc

SEQ ID NO: 113777 - DNA, 25 bp, Homo sapien
tgtcccctcattctactaatgtgat

SEQ ID NO: 113778 - DNA, 25 bp, Homo sapien
tgtgatgctttcattatgtccctgt

SEQ ID NO: 113779 - DNA, 25 bp, Homo sapien
cattatgtccctgtggattagaata

SEQ ID NO: 113780 - DNA, 25 bp, Homo sapien
gaatagtgtcagttatttcttaagt

SEQ ID NO: 113781 - DNA, 25 bp, Homo sapien
tttcttaagtaactcagtacccaga

SEQ ID NO: 113782 - DNA, 25 bp, Homo sapien
gtgattcagagccacagtctaactg

SEQ ID NO: 113783 - DNA, 25 bp, Homo sapien
agagccacagtctaactgagcacct

SEQ ID NO: 113784 - DNA, 25 bp, Homo sapien
gcagtaccatcccactgatatcacg

SEQ ID NO: 113785 - DNA, 25 bp, Homo sapien
agtaccatcccactgatatcacggg

SEQ ID NO: 113786 - DNA, 25 bp, Homo sapien
gtaccatcccactgatatcacgggc

SEQ ID NO: 113787 - DNA, 25 bp, Homo sapien
atcccactgatatcacgggcccgct

SEQ ID NO: 113788 - DNA, 25 bp, Homo sapien
cagatccctcggtcagcaccgtggt

SEQ ID NO: 113789 - DNA, 25 bp, Homo sapien
tcagcaccgtggtgtgaggcccccg

SEQ ID NO: 113790 - DNA, 25 bp, Homo sapien
agttagcccggccaaggacactgat

SEQ ID NO: 113791 - DNA, 25 bp, Homo sapien
ttagcccggccaaggacactgatgg

SEQ ID NO: 113792 - DNA, 25 bp, Homo sapien
gcccggccaaggacactgatgggtc

SEQ ID NO: 113793 - DNA, 25 bp, Homo sapien
ccaaggacactgatgggtcctgctg

SEQ ID NO: 113794 - DNA, 25 bp, Homo sapien
gaccaaggtgcggaccggagcggct

SEQ ID NO: 113795 - DNA, 25 bp, Homo sapien
attggtatagtatctacagagtgta

SEQ ID NO: 113796 - DNA, 25 bp, Homo sapien
aaactaaccacaaagctttacatct

SEQ ID NO: 113797 - DNA, 25 bp, Homo sapien
aagctttacatcttcattttgactg

SEQ ID NO: 113798 - DNA, 25 bp, Homo sapien
tcttcattttgactgttccatagca

SEQ ID NO: 113799 - DNA, 25 bp, Homo sapien
ccatagcagaataaagcacttgaaa

SEQ ID NO: 113800 - DNA, 25 bp, Homo sapien
ccctttcacacatggattattataa

SEQ ID NO: 113801 - DNA, 25 bp, Homo sapien
attataagtttcaatcctggtatct

SEQ ID NO: 113802 - DNA, 25 bp, Homo sapien
atctgtgcttgatttttatcagttt

SEQ ID NO: 113803 - DNA, 25 bp, Homo sapien
aatcccacattgtaaagtttgtaca

SEQ ID NO: 113804 - DNA, 25 bp, Homo sapien
ttgtacaatttgtcctgaagctttg

SEQ ID NO: 113805 - DNA, 25 bp, Homo sapien
tttgtgtttggctgcacctgcataa

SEQ ID NO: 113806 - DNA, 25 bp, Homo sapien
gatgctgttccccagggtacccagg

SEQ ID NO: 113807 - DNA, 25 bp, Homo sapien
tgctgttccccagggtacccaggtt

SEQ ID NO: 113808 - DNA, 25 bp, Homo sapien
ccagggtacccaggttcaagtcaag

SEQ ID NO: 113809 - DNA, 25 bp, Homo sapien
cagggtacccaggttcaagtcaagc

SEQ ID NO: 113810 - DNA, 25 bp, Homo sapien
caagtcaagccccaagcagcaagtt

SEQ ID NO: 113811 - DNA, 25 bp, Homo sapien
aagtcaagccccaagcagcaagttt

SEQ ID NO: 113812 - DNA, 25 bp, Homo sapien
agtcaagccccaagcagcaagtttc

SEQ ID NO: 113813 - DNA, 25 bp, Homo sapien
gtcaagccccaagcagcaagtttct

SEQ ID NO: 113814 - DNA, 25 bp, Homo sapien
gatctattgcatagtgtggtggcta

SEQ ID NO: 113815 - DNA, 25 bp, Homo sapien
atatcgtatatctccaaactgctaa

SEQ ID NO: 113816 - DNA, 25 bp, Homo sapien
cttgacttagtcgttccatattgta

SEQ ID NO: 113817 - DNA, 25 bp, Homo sapien
tttaaatcccacattgtaaagtttg

SEQ ID NO: 113818 - DNA, 25 bp, Homo sapien
taaatcccacattgtaaagtttgta

SEQ ID NO: 113819 - DNA, 25 bp, Homo sapien
aatcccacattgtaaagtttgtaca

SEQ ID NO: 113820 - DNA, 25 bp, Homo sapien
atcccacattgtaaagtttgtacaa

SEQ ID NO: 113821 - DNA, 25 bp, Homo sapien
gtaaagtttgtacaatttgtcctga

SEQ ID NO: 113822 - DNA, 25 bp, Homo sapien
aagtttgtacaatttgtcctgaagc

SEQ ID NO: 113823 - DNA, 25 bp, Homo sapien
agtttgtacaatttgtcctgaagct

SEQ ID NO: 113824 - DNA, 25 bp, Homo sapien
gtttgtacaatttgtcctgaagctt

SEQ ID NO: 113825 - DNA, 25 bp, Homo sapien
ttgtacaatttgtcctgaagctttg

SEQ ID NO: 113826 - DNA, 25 bp, Homo sapien
tgtacaatttgtcctgaagctttgt

SEQ ID NO: 113827 - DNA, 25 bp, Homo sapien
tttgtgtttggctgcacctgcataa

SEQ ID NO: 113828 - DNA, 25 bp, Homo sapien
gaaaagtgtgaagtcaccagtaccc

SEQ ID NO: 113829 - DNA, 25 bp, Homo sapien
gaagtcaccagtacccatggtgcat

SEQ ID NO: 113830 - DNA, 25 bp, Homo sapien
tcaccagtacccatggtgcatcttt

SEQ ID NO: 113831 - DNA, 25 bp, Homo sapien
aatgattaagtaagtgccttctgaa

SEQ ID NO: 113832 - DNA, 25 bp, Homo sapien
agtaagtgccttctgaaactgctgc

SEQ ID NO: 113833 - DNA, 25 bp, Homo sapien
ggtattggtagccattcagtatttt

SEQ ID NO: 113834 - DNA, 25 bp, Homo sapien
cattaaatgatatcagcagtccaga

SEQ ID NO: 113835 - DNA, 25 bp, Homo sapien
tgatatcagcagtccagaagtcttg

SEQ ID NO: 113836 - DNA, 25 bp, Homo sapien
atcagcagtccagaagtcttggcaa

SEQ ID NO: 113837 - DNA, 25 bp, Homo sapien
agcagtccagaagtcttggcaaaat

SEQ ID NO: 113838 - DNA, 25 bp, Homo sapien
gtccagaagtcttggcaaaatgtaa

SEQ ID NO: 113839 - DNA, 25 bp, Homo sapien
ggcatcactgaacaaacatttcctg

SEQ ID NO: 113840 - DNA, 25 bp, Homo sapien
acatttcctgatgggaactcctgcg

SEQ ID NO: 113841 - DNA, 25 bp, Homo sapien
cctgatgggaactcctgcggcagag

SEQ ID NO: 113842 - DNA, 25 bp, Homo sapien
gggaagtgaactacccagggcagcc

SEQ ID NO: 113843 - DNA, 25 bp, Homo sapien
cagcccctttgtggcccaggataat

SEQ ID NO: 113844 - DNA, 25 bp, Homo sapien
gtggcccaggataatcaacactgtt

SEQ ID NO: 113845 - DNA, 25 bp, Homo sapien
ggataatcaacactgttctctctgt

SEQ ID NO: 113846 - DNA, 25 bp, Homo sapien
tcaacactgttctctctgtaccatg

SEQ ID NO: 113847 - DNA, 25 bp, Homo sapien
tttattattgtaatttcagtttgcc

SEQ ID NO: 113848 - DNA, 25 bp, Homo sapien
agtttgcctctactggagaatctca

SEQ ID NO: 113849 - DNA, 25 bp, Homo sapien
gcctctactggagaatctcagcagg

SEQ ID NO: 113850 - DNA, 25 bp, Homo sapien
aaaggttctgattgagggctccatc

SEQ ID NO: 113851 - DNA, 25 bp, Homo sapien
aactctgtccgggtcagcattgctg

SEQ ID NO: 113852 - DNA, 25 bp, Homo sapien
gatcgagaagattttgtgccacaag

SEQ ID NO: 113853 - DNA, 25 bp, Homo sapien
tgtgccacaagttcatgcgcttcat

SEQ ID NO: 113854 - DNA, 25 bp, Homo sapien
atgcgcttcatgatgatgcgagcag

SEQ ID NO: 113855 - DNA, 25 bp, Homo sapien
gcagagaacttctttatccttcgaa

SEQ ID NO: 113856 - DNA, 25 bp, Homo sapien
tatccttcgaaggaagcctgtggag

SEQ ID NO: 113857 - DNA, 25 bp, Homo sapien
atatcagctttctgatcaccaactt

SEQ ID NO: 113858 - DNA, 25 bp, Homo sapien
tcaccaacttccacacagagcagat

SEQ ID NO: 113859 - DNA, 25 bp, Homo sapien
tggactttgtgatccacttcatgga

SEQ ID NO: 113860 - DNA, 25 bp, Homo sapien
tgaagctgtcagtcaatgcccgtgc

SEQ ID NO: 113861 - DNA, 25 bp, Homo sapien
tgcctgctgcattacatgcctcagg

SEQ ID NO: 113862 - DNA, 25 bp, Homo sapien
cagtgcagagcctcccctggagtgg

SEQ ID NO: 113863 - DNA, 25 bp, Homo sapien
ttctcagagcctctctgccgaggtc

SEQ ID NO: 113864 - DNA, 25 bp, Homo sapien
cccctgcaggcaaatctcacaagga

SEQ ID NO: 113865 - DNA, 25 bp, Homo sapien
gcaggcaaatctcacaaggaaggga

SEQ ID NO: 113866 - DNA, 25 bp, Homo sapien
gaggatggcttcctactggtagccc

SEQ ID NO: 113867 - DNA, 25 bp, Homo sapien
tactggtagcccctctgtcattttg

SEQ ID NO: 113868 - DNA, 25 bp, Homo sapien
agcccctctgtcattttgcaggaca

SEQ ID NO: 113869 - DNA, 25 bp, Homo sapien
tttgcaggacagatactcaggctag

SEQ ID NO: 113870 - DNA, 25 bp, Homo sapien
ggacagatactcaggctagatatga

SEQ ID NO: 113871 - DNA, 25 bp, Homo sapien
gctccccatctgtgtccaaataaaa

SEQ ID NO: 113872 - DNA, 25 bp, Homo sapien
ttgaaaagtgtgaagtcaccagtac

SEQ ID NO: 113873 - DNA, 25 bp, Homo sapien
tgaaaagtgtgaagtcaccagtacc

SEQ ID NO: 113874 - DNA, 25 bp, Homo sapien
gaaaagtgtgaagtcaccagtaccc

SEQ ID NO: 113875 - DNA, 25 bp, Homo sapien
gaagtcaccagtacccatggtgcat

SEQ ID NO: 113876 - DNA, 25 bp, Homo sapien
aagtcaccagtacccatggtgcatc

SEQ ID NO: 113877 - DNA, 25 bp, Homo sapien
agtcaccagtacccatggtgcatct

SEQ ID NO: 113878 - DNA, 25 bp, Homo sapien
gtcaccagtacccatggtgcatctt

SEQ ID NO: 113879 - DNA, 25 bp, Homo sapien
tcaccagtacccatggtgcatcttt

SEQ ID NO: 113880 - DNA, 25 bp, Homo sapien
atagaggaaatgttggtgttgtact

SEQ ID NO: 113881 - DNA, 25 bp, Homo sapien
aaaggtgatcgaattgcacagctca

SEQ ID NO: 113882 - DNA, 25 bp, Homo sapien
ggtgatcgaattgcacagctcattt

SEQ ID NO: 113883 - DNA, 25 bp, Homo sapien
gaattgcacagctcatttgcgaacg

SEQ ID NO: 113884 - DNA, 25 bp, Homo sapien
gcacagctcatttgcgaacggattt

SEQ ID NO: 113885 - DNA, 25 bp, Homo sapien
agctcatttgcgaacggatttttta

SEQ ID NO: 113886 - DNA, 25 bp, Homo sapien
tgcgaacggattttttatccagaaa

SEQ ID NO: 113887 - DNA, 25 bp, Homo sapien
aaatagaagaagttcaagccttgga

SEQ ID NO: 113888 - DNA, 25 bp, Homo sapien
tggttccactggaaagaattaaaat

SEQ ID NO: 113889 - DNA, 25 bp, Homo sapien
ttggtgttttgcacttctgtaaact

SEQ ID NO: 113890 - DNA, 25 bp, Homo sapien
tgcacttctgtaaacttactagctt

SEQ ID NO: 113891 - DNA, 25 bp, Homo sapien
ggtggactggagcaattcttcttct

SEQ ID NO: 113892 - DNA, 25 bp, Homo sapien
tcttctgcaacctcagggtctggcg

SEQ ID NO: 113893 - DNA, 25 bp, Homo sapien
aaagagctggctgtacaccctggat

SEQ ID NO: 113894 - DNA, 25 bp, Homo sapien
acctgttcctactcgggcctgagct

SEQ ID NO: 113895 - DNA, 25 bp, Homo sapien
tcccgaagctgcaccacactggaga

SEQ ID NO: 113896 - DNA, 25 bp, Homo sapien
ggagaactacaacttcgagctctac

SEQ ID NO: 113897 - DNA, 25 bp, Homo sapien
ttcgagctctacgatggccttaagc

SEQ ID NO: 113898 - DNA, 25 bp, Homo sapien
tacgatggccttaagcacaaggtca

SEQ ID NO: 113899 - DNA, 25 bp, Homo sapien
gcacaaggtcaagatgaaccaccaa

SEQ ID NO: 113900 - DNA, 25 bp, Homo sapien
tgaaccaccaaaagtgctgctccga

SEQ ID NO: 113901 - DNA, 25 bp, Homo sapien
accaaaagtgctgctccgaggcatg

SEQ ID NO: 113902 - DNA, 25 bp, Homo sapien
tccgcaatcccaacatttcgatgct

SEQ ID NO: 113903 - DNA, 25 bp, Homo sapien
aacatttcgatgctcctagggcgca

SEQ ID NO: 113904 - DNA, 25 bp, Homo sapien
tttcgatgctcctagggcgcaaccg

SEQ ID NO: 113905 - DNA, 25 bp, Homo sapien
caaccgcgaggagggctaccggact

SEQ ID NO: 113906 - DNA, 25 bp, Homo sapien
taccggactaggaatgtggacgctt

SEQ ID NO: 113907 - DNA, 25 bp, Homo sapien
aatgtggacgctttcctgcccagcc

SEQ ID NO: 113908 - DNA, 25 bp, Homo sapien
ccagggcccgggtctgcaagccaga

SEQ ID NO: 113909 - DNA, 25 bp, Homo sapien
cgcagtcgccttcgaaaccgctatg

SEQ ID NO: 113910 - DNA, 25 bp, Homo sapien
tcgaaaccgctatgccaaccggctg

SEQ ID NO: 113911 - DNA, 25 bp, Homo sapien
gggcctgcaacaggatgtcctcttc

SEQ ID NO: 113912 - DNA, 25 bp, Homo sapien
aacaggatgtcctcttccaacccgg

SEQ ID NO: 113913 - DNA, 25 bp, Homo sapien
atcatcgtgtacacggaacttccaa

SEQ ID NO: 113914 - DNA, 25 bp, Homo sapien
gccctgatccaaagttgtctcctgc

SEQ ID NO: 113915 - DNA, 25 bp, Homo sapien
ctgatccaaagttgtctcctgccca

SEQ ID NO: 113916 - DNA, 25 bp, Homo sapien
acatatgcacagttgaatcactgcg

SEQ ID NO: 113917 - DNA, 25 bp, Homo sapien
catatgcacagttgaatcactgcgt

SEQ ID NO: 113918 - DNA, 25 bp, Homo sapien
atatgcacagttgaatcactgcgtt

SEQ ID NO: 113919 - DNA, 25 bp, Homo sapien
ccaacagatatcatcgtgtacacgg

SEQ ID NO: 113920 - DNA, 25 bp, Homo sapien
caacagatatcatcgtgtacacgga

SEQ ID NO: 113921 - DNA, 25 bp, Homo sapien
aacagatatcatcgtgtacacggaa

SEQ ID NO: 113922 - DNA, 25 bp, Homo sapien
acagatatcatcgtgtacacggaac

SEQ ID NO: 113923 - DNA, 25 bp, Homo sapien
gatatcatcgtgtacacggaacttc

SEQ ID NO: 113924 - DNA, 25 bp, Homo sapien
ggtctacgttcaagacatcctgcag

SEQ ID NO: 113925 - DNA, 25 bp, Homo sapien
aaagagctggccgacgaggtgttca

SEQ ID NO: 113926 - DNA, 25 bp, Homo sapien
gacgaggtgttcagcgtgctccacg

SEQ ID NO: 113927 - DNA, 25 bp, Homo sapien
gggagcagggccacatctatgtttg

SEQ ID NO: 113928 - DNA, 25 bp, Homo sapien
atctatgtttgtggcgatgtgcgca

SEQ ID NO: 113929 - DNA, 25 bp, Homo sapien
atggctcgggatgtggctaccactt

SEQ ID NO: 113930 - DNA, 25 bp, Homo sapien
ggttgaggattacttcttccagctc

SEQ ID NO: 113931 - DNA, 25 bp, Homo sapien
gagccagaaacgttatcatgaggat

SEQ ID NO: 113932 - DNA, 25 bp, Homo sapien
catgaggatatcttcggtgcggtct

SEQ ID NO: 113933 - DNA, 25 bp, Homo sapien
gtgcggtcttttcctatggagtgaa

SEQ ID NO: 113934 - DNA, 25 bp, Homo sapien
ggcaacgccttggaggagcccaaag

SEQ ID NO: 113935 - DNA, 25 bp, Homo sapien
tcttccattatccacgagattgata

SEQ ID NO: 113936 - DNA, 25 bp, Homo sapien
tattttgggcaataaaccctacagc

SEQ ID NO: 113937 - DNA, 25 bp, Homo sapien
aaccctacagcaaaaaggactacag

SEQ ID NO: 113938 - DNA, 25 bp, Homo sapien
gtggctgaaggacaagatcctcagt

SEQ ID NO: 113939 - DNA, 25 bp, Homo sapien
agggccggcgccagcaagccaagct

SEQ ID NO: 113940 - DNA, 25 bp, Homo sapien
cagctggccatagcctggtgcctga

SEQ ID NO: 113941 - DNA, 25 bp, Homo sapien
ccatagcctggtgcctgaggaatga

SEQ ID NO: 113942 - DNA, 25 bp, Homo sapien
aatgagggagtcagctccgtgctcc

SEQ ID NO: 113943 - DNA, 25 bp, Homo sapien
cctccaatgcggaccagctcatgga

SEQ ID NO: 113944 - DNA, 25 bp, Homo sapien
gggcaatacaggtccttccgaaact

SEQ ID NO: 113945 - DNA, 25 bp, Homo sapien
caatacaggtccttccgaaactgtc

SEQ ID NO: 113946 - DNA, 25 bp, Homo sapien
ttttgtctctctcctgatcttacta

SEQ ID NO: 113947 - DNA, 25 bp, Homo sapien
gtctctctcctgatcttactaaatc

SEQ ID NO: 113948 - DNA, 25 bp, Homo sapien
gatcttactaaatccatatttcata

SEQ ID NO: 113949 - DNA, 25 bp, Homo sapien
gatgcttgatacacaaaaggaactc

SEQ ID NO: 113950 - DNA, 25 bp, Homo sapien
gaactctggagagaaaactacagct

SEQ ID NO: 113951 - DNA, 25 bp, Homo sapien
gaaaactacagcttcagtctgtaca

SEQ ID NO: 113952 - DNA, 25 bp, Homo sapien
acagcttcagtctgtacagatcaaa

SEQ ID NO: 113953 - DNA, 25 bp, Homo sapien
gatcttgatgcagggtttcttaacc

SEQ ID NO: 113954 - DNA, 25 bp, Homo sapien
gcagtctatgcacaacactatattt

SEQ ID NO: 113955 - DNA, 25 bp, Homo sapien
tgcacaacactatatttccatgtaa

SEQ ID NO: 113956 - DNA, 25 bp, Homo sapien
tatttcagccctatttgtattattt

SEQ ID NO: 113957 - DNA, 25 bp, Homo sapien
gtgggtgtgggtacctgtattccca

SEQ ID NO: 113958 - DNA, 25 bp, Homo sapien
ttcagggtcatagcatgctgtgatt

SEQ ID NO: 113959 - DNA, 25 bp, Homo sapien
gcatgctgtgattgtgcctacgaat

SEQ ID NO: 113960 - DNA, 25 bp, Homo sapien
catgctgtgattgtgcctacgaata

SEQ ID NO: 113961 - DNA, 25 bp, Homo sapien
atgctgtgattgtgcctacgaatag

SEQ ID NO: 113962 - DNA, 25 bp, Homo sapien
ctgtgattgtgcctacgaatagcca

SEQ ID NO: 113963 - DNA, 25 bp, Homo sapien
gtgattgtgcctacgaatagccact

SEQ ID NO: 113964 - DNA, 25 bp, Homo sapien
tgtgcctacgaatagccactgcata

SEQ ID NO: 113965 - DNA, 25 bp, Homo sapien
gtgcctacgaatagccactgcatac

SEQ ID NO: 113966 - DNA, 25 bp, Homo sapien
cctacgaatagccactgcataccaa

SEQ ID NO: 113967 - DNA, 25 bp, Homo sapien
tacgaatagccactgcataccaacc

SEQ ID NO: 113968 - DNA, 25 bp, Homo sapien
ggtaagacgtaaatgtttcaacact

SEQ ID NO: 113969 - DNA, 25 bp, Homo sapien
ctttactaaaagcttatttctgtca

SEQ ID NO: 113970 - DNA, 25 bp, Homo sapien
aaagcttatttctgtcaatatcata

SEQ ID NO: 113971 - DNA, 25 bp, Homo sapien
tatttgtagaaatcatccatatgtt

SEQ ID NO: 113972 - DNA, 25 bp, Homo sapien
gaaatcatccatatgtttatacata

SEQ ID NO: 113973 - DNA, 25 bp, Homo sapien
catatatttttaagtctgtgtagta

SEQ ID NO: 113974 - DNA, 25 bp, Homo sapien
gtctgtgtagtattcaactgacttc

SEQ ID NO: 113975 - DNA, 25 bp, Homo sapien
gtagtattcaactgacttcataata

SEQ ID NO: 113976 - DNA, 25 bp, Homo sapien
tatattcatatactgttaatgcaca

SEQ ID NO: 113977 - DNA, 25 bp, Homo sapien
gttaatgcacatttggttatttcca

SEQ ID NO: 113978 - DNA, 25 bp, Homo sapien
ttatttccagttttgcttttcatgg

SEQ ID NO: 113979 - DNA, 25 bp, Homo sapien
ttgggtccctgaacactgtcattca

SEQ ID NO: 113980 - DNA, 25 bp, Homo sapien
ctgaacactgtcattcacccaataa

SEQ ID NO: 113981 - DNA, 25 bp, Homo sapien
aataaattactatttgaccccagag

SEQ ID NO: 113982 - DNA, 25 bp, Homo sapien
aattactatttgaccccagagtggg

SEQ ID NO: 113983 - DNA, 25 bp, Homo sapien
tcccaggaggctgagcctgattgtc

SEQ ID NO: 113984 - DNA, 25 bp, Homo sapien
ccaggaggctgagcctgattgtcct

SEQ ID NO: 113985 - DNA, 25 bp, Homo sapien
attgtcctgagaaatgggaaggatc

SEQ ID NO: 113986 - DNA, 25 bp, Homo sapien
ggaaggatcagatatgactcctcct

SEQ ID NO: 113987 - DNA, 25 bp, Homo sapien
gatcagatatgactcctccttggca

SEQ ID NO: 113988 - DNA, 25 bp, Homo sapien
agatatgactcctccttggcaactg

SEQ ID NO: 113989 - DNA, 25 bp, Homo sapien
ttggcaactgccctttcctgccagg

SEQ ID NO: 113990 - DNA, 25 bp, Homo sapien
catcccagaggaacataggcatcat

SEQ ID NO: 113991 - DNA, 25 bp, Homo sapien
aggcatcatgtgtctggatgaagct

SEQ ID NO: 113992 - DNA, 25 bp, Homo sapien
agaggatccaaccatgagctcttcc

SEQ ID NO: 113993 - DNA, 25 bp, Homo sapien
cctccatgtaggagctgggcctagg

SEQ ID NO: 113994 - DNA, 25 bp, Homo sapien
tgggcctagggacctgttgaactct

SEQ ID NO: 113995 - DNA, 25 bp, Homo sapien
agggacctgttgaactctctcagct

SEQ ID NO: 113996 - DNA, 25 bp, Homo sapien
ggacacctcaggcactgggacagtt

SEQ ID NO: 113997 - DNA, 25 bp, Homo sapien
tcaggcactgggacagttgggcatt

SEQ ID NO: 113998 - DNA, 25 bp, Homo sapien
tttggaggcccgtgtgtgaattcct

SEQ ID NO: 113999 - DNA, 25 bp, Homo sapien
gtgtgtgaattcctgctcctcatgc

SEQ ID NO: 114000 - DNA, 25 bp, Homo sapien
ctcatgctggagtgcctcccatttc

SEQ ID NO: 114001 - DNA, 25 bp, Homo sapien
gtacaccctgatggaaacacctagt

SEQ ID NO: 114002 - DNA, 25 bp, Homo sapien
acacctagttgtgatggactcagca

SEQ ID NO: 114003 - DNA, 25 bp, Homo sapien
gatggactcagcagcggccaggcca

SEQ ID NO: 114004 - DNA, 25 bp, Homo sapien
aggccatcttccaagagtccttata

SEQ ID NO: 114005 - DNA, 25 bp, Homo sapien
aagagtccttatacacaagatttgt

SEQ ID NO: 114006 - DNA, 25 bp, Homo sapien
caagatttgtaaccgttgctttggg

SEQ ID NO: 114007 - DNA, 25 bp, Homo sapien
gggcccagggacagatttcacactg

SEQ ID NO: 114008 - DNA, 25 bp, Homo sapien
gggttcattaatacatgcgagatac

SEQ ID NO: 114009 - DNA, 25 bp, Homo sapien
gcgagatacacaatttccttggacg

SEQ ID NO: 114010 - DNA, 25 bp, Homo sapien
aggtctagtcagagcgtcgtacacc

SEQ ID NO: 114011 - DNA, 25 bp, Homo sapien
agagcgtcgtacaccctgatggaaa

SEQ ID NO: 114012 - DNA, 25 bp, Homo sapien
gaaggatgtaaaaccctgctgcata

SEQ ID NO: 114013 - DNA, 25 bp, Homo sapien
aatatttggagggaggatcctgaaa

SEQ ID NO: 114014 - DNA, 25 bp, Homo sapien
tcctgaaaaacatgagggatcaaat

SEQ ID NO: 114015 - DNA, 25 bp, Homo sapien
ggatcaaatagtcctcaactttcta

SEQ ID NO: 114016 - DNA, 25 bp, Homo sapien
agtcctcaactttctaggacaaagg

SEQ ID NO: 114017 - DNA, 25 bp, Homo sapien
caaagggagcagctatttgccatct

SEQ ID NO: 114018 - DNA, 25 bp, Homo sapien
agggagcagctatttgccatctacc

SEQ ID NO: 114019 - DNA, 25 bp, Homo sapien
ggagcagctatttgccatctaccct

SEQ ID NO: 114020 - DNA, 25 bp, Homo sapien
tatttgccatctaccctccagaata

SEQ ID NO: 114021 - DNA, 25 bp, Homo sapien
tcaccgtctaccctctagagtaaac

SEQ ID NO: 114022 - DNA, 25 bp, Homo sapien
gtctaccctctagagtaaacaaatc

SEQ ID NO: 114023 - DNA, 25 bp, Homo sapien
caggccaagctattcttttaaagta

SEQ ID NO: 114024 - DNA, 25 bp, Homo sapien
agcttcctgacgacatgaaataatt

SEQ ID NO: 114025 - DNA, 25 bp, Homo sapien
agttacattaggctttgctatatcc

SEQ ID NO: 114026 - DNA, 25 bp, Homo sapien
atatccccaggccaaatagcatgtg

SEQ ID NO: 114027 - DNA, 25 bp, Homo sapien
tgtgacacaggacagccatagtata

SEQ ID NO: 114028 - DNA, 25 bp, Homo sapien
cagccatagtatagtgtgtcactcg

SEQ ID NO: 114029 - DNA, 25 bp, Homo sapien
gtcactcgtggttggtgtcctttca

SEQ ID NO: 114030 - DNA, 25 bp, Homo sapien
tggttggtgtcctttcatgcttctg

SEQ ID NO: 114031 - DNA, 25 bp, Homo sapien
tttcatgcttctgccctgtcaaagg

SEQ ID NO: 114032 - DNA, 25 bp, Homo sapien
tgccctgtcaaaggtccctatttga

SEQ ID NO: 114033 - DNA, 25 bp, Homo sapien
aaggtccctatttgaaatgtgttat

SEQ ID NO: 114034 - DNA, 25 bp, Homo sapien
ctttgctcaaaaaacgtgaagctga

SEQ ID NO: 114035 - DNA, 25 bp, Homo sapien
aatgatggttgctaacaaaccagat

SEQ ID NO: 114036 - DNA, 25 bp, Homo sapien
gaacagatatctaaaacgattcgaa

SEQ ID NO: 114037 - DNA, 25 bp, Homo sapien
ggattttaaaaccgttatcatcaag

SEQ ID NO: 114038 - DNA, 25 bp, Homo sapien
caagtacttagaatcactagttcaa

SEQ ID NO: 114039 - DNA, 25 bp, Homo sapien
gaatcactagttcaaacacaacaac

SEQ ID NO: 114040 - DNA, 25 bp, Homo sapien
caaacacaacaacagctgataaaat

SEQ ID NO: 114041 - DNA, 25 bp, Homo sapien
aatactgggaagcattcctacctga

SEQ ID NO: 114042 - DNA, 25 bp, Homo sapien
tgggaagcattcctacctgaagcca

SEQ ID NO: 114043 - DNA, 25 bp, Homo sapien
gaagcattcctacctgaagccaaag

SEQ ID NO: 114044 - DNA, 25 bp, Homo sapien
agcattcctacctgaagccaaagcc

SEQ ID NO: 114045 - DNA, 25 bp, Homo sapien
gacttaaggaacagcttggcgctca

SEQ ID NO: 114046 - DNA, 25 bp, Homo sapien
ttggcgctcaacaagaaccagtgaa

SEQ ID NO: 114047 - DNA, 25 bp, Homo sapien
ggaatcagaagcttttttgcctcag

SEQ ID NO: 114048 - DNA, 25 bp, Homo sapien
tttttgcctcagagcatacctgaag

SEQ ID NO: 114049 - DNA, 25 bp, Homo sapien
aagcccctaggaatctgcctgataa

SEQ ID NO: 114050 - DNA, 25 bp, Homo sapien
gaatctgcctgataatcgattgcat

SEQ ID NO: 114051 - DNA, 25 bp, Homo sapien
gcaatgagacagaaaacgcccactc

SEQ ID NO: 114052 - DNA, 25 bp, Homo sapien
gaaaacgcccactcctggatcttca

SEQ ID NO: 114053 - DNA, 25 bp, Homo sapien
tcctggatcttcacattgaactcaa

SEQ ID NO: 114054 - DNA, 25 bp, Homo sapien
gaactcaatggctacatgtatgatt

SEQ ID NO: 114055 - DNA, 25 bp, Homo sapien
agcagagtttctgccaaggagaaat

SEQ ID NO: 114056 - DNA, 25 bp, Homo sapien
caagcccagaaagtgataagtgcag

SEQ ID NO: 114057 - DNA, 25 bp, Homo sapien
tctgcccacagtctttccgtgtgat

SEQ ID NO: 114058 - DNA, 25 bp, Homo sapien
agtctttccgtgtgattgtctttga

SEQ ID NO: 114059 - DNA, 25 bp, Homo sapien
attgtctttgaatctgaatcagcca

SEQ ID NO: 114060 - DNA, 25 bp, Homo sapien
ttgaatctgaatcagccagtctcag

SEQ ID NO: 114061 - DNA, 25 bp, Homo sapien
agccagtctcagatgccccaaagtt

SEQ ID NO: 114062 - DNA, 25 bp, Homo sapien
gatgccccaaagtttcggttcctat

SEQ ID NO: 114063 - DNA, 25 bp, Homo sapien
caaagtttcggttcctatgagcccg

SEQ ID NO: 114064 - DNA, 25 bp, Homo sapien
gggcatgatctgatccccaagacat

SEQ ID NO: 114065 - DNA, 25 bp, Homo sapien
atctgatccccaagacatgtggagg

SEQ ID NO: 114066 - DNA, 25 bp, Homo sapien
aaaaggaaaccacagtgagcctgag

SEQ ID NO: 114067 - DNA, 25 bp, Homo sapien
agcccagcagatcctacacacattt

SEQ ID NO: 114068 - DNA, 25 bp, Homo sapien
agcagatcctacacacattttcaca

SEQ ID NO: 114069 - DNA, 25 bp, Homo sapien
gcagatcctacacacattttcacaa

SEQ ID NO: 114070 - DNA, 25 bp, Homo sapien
agatcctacacacattttcacaaac

SEQ ID NO: 114071 - DNA, 25 bp, Homo sapien
ttttcacaaactaaccccagaacag

SEQ ID NO: 114072 - DNA, 25 bp, Homo sapien
ttcacaaactaaccccagaacaggc

SEQ ID NO: 114073 - DNA, 25 bp, Homo sapien
aaactaaccccagaacaggctgcaa

SEQ ID NO: 114074 - DNA, 25 bp, Homo sapien
aactaaccccagaacaggctgcaaa

SEQ ID NO: 114075 - DNA, 25 bp, Homo sapien
taaccccagaacaggctgcaaacct

SEQ ID NO: 114076 - DNA, 25 bp, Homo sapien
ccccagaacaggctgcaaacctata

SEQ ID NO: 114077 - DNA, 25 bp, Homo sapien
agaacaggctgcaaacctataccaa

SEQ ID NO: 114078 - DNA, 25 bp, Homo sapien
attttttgtatatcctcccaatctt

SEQ ID NO: 114079 - DNA, 25 bp, Homo sapien
cccaatcttttgacttatgcacata

SEQ ID NO: 114080 - DNA, 25 bp, Homo sapien
gagatcatatggaatgtactatttt

SEQ ID NO: 114081 - DNA, 25 bp, Homo sapien
atgtattatcaaccttttccctctc

SEQ ID NO: 114082 - DNA, 25 bp, Homo sapien
gaatgactgcatagtattcacttta

SEQ ID NO: 114083 - DNA, 25 bp, Homo sapien
taattcatttcacagtcttctattg

SEQ ID NO: 114084 - DNA, 25 bp, Homo sapien
agtcttctattgttggaccacttac

SEQ ID NO: 114085 - DNA, 25 bp, Homo sapien
tggaccacttacattgtaccaaatg

SEQ ID NO: 114086 - DNA, 25 bp, Homo sapien
aatattttactgctggtcactcatg

SEQ ID NO: 114087 - DNA, 25 bp, Homo sapien
actgctggtcactcatggaatcctg

SEQ ID NO: 114088 - DNA, 25 bp, Homo sapien
cactcatggaatcctgcagctttaa

SEQ ID NO: 114089 - DNA, 25 bp, Homo sapien
tcccgagctcggtgacttccactgt

SEQ ID NO: 114090 - DNA, 25 bp, Homo sapien
tgacttccactgtcgcggtgtagtt

SEQ ID NO: 114091 - DNA, 25 bp, Homo sapien
tccactgtcgcggtgtagttgtcca

SEQ ID NO: 114092 - DNA, 25 bp, Homo sapien
actgtcgcggtgtagttgtccacct

SEQ ID NO: 114093 - DNA, 25 bp, Homo sapien
gtgtagttgtccacctcgcaggagc

SEQ ID NO: 114094 - DNA, 25 bp, Homo sapien
tagttgtccacctcgcaggagccgc

SEQ ID NO: 114095 - DNA, 25 bp, Homo sapien
tgcctcatactgagatccaaccctt

SEQ ID NO: 114096 - DNA, 25 bp, Homo sapien
aaagccaaacccacctgtgtagaag

SEQ ID NO: 114097 - DNA, 25 bp, Homo sapien
gccaaacccacctgtgtagaagtga

SEQ ID NO: 114098 - DNA, 25 bp, Homo sapien
aacccacctgtgtagaagtgatgcc

SEQ ID NO: 114099 - DNA, 25 bp, Homo sapien
ccacctgtgtagaagtgatgccttt

SEQ ID NO: 114100 - DNA, 25 bp, Homo sapien
agtgctttcacgttcttacttgttg

SEQ ID NO: 114101 - DNA, 25 bp, Homo sapien
acattcatgcatttctaggctagag

SEQ ID NO: 114102 - DNA, 25 bp, Homo sapien
gagaaccttctagatttgatgctta

SEQ ID NO: 114103 - DNA, 25 bp, Homo sapien
gatttgatgcttacaactattctgt

SEQ ID NO: 114104 - DNA, 25 bp, Homo sapien
tgagaacatttctgtctctagaagt

SEQ ID NO: 114105 - DNA, 25 bp, Homo sapien
gtctctagaagttatctgtctgtat

SEQ ID NO: 114106 - DNA, 25 bp, Homo sapien
ctgtctgtattgatctttatgctat

SEQ ID NO: 114107 - DNA, 25 bp, Homo sapien
gctatattactatctgtggttacag

SEQ ID NO: 114108 - DNA, 25 bp, Homo sapien
gtggttacagtggagacattgacat

SEQ ID NO: 114109 - DNA, 25 bp, Homo sapien
acattattactggagtcaagccctt

SEQ ID NO: 114110 - DNA, 25 bp, Homo sapien
ggagtcaagcccttataagtcaaaa

SEQ ID NO: 114111 - DNA, 25 bp, Homo sapien
gcaagcccctaggaatctgcctgat

SEQ ID NO: 114112 - DNA, 25 bp, Homo sapien
aagcccctaggaatctgcctgataa

SEQ ID NO: 114113 - DNA, 25 bp, Homo sapien
agcccctaggaatctgcctgataat

SEQ ID NO: 114114 - DNA, 25 bp, Homo sapien
gcccctaggaatctgcctgataatc

SEQ ID NO: 114115 - DNA, 25 bp, Homo sapien
ccctaggaatctgcctgataatcga

SEQ ID NO: 114116 - DNA, 25 bp, Homo sapien
ctaggaatctgcctgataatcgatt

SEQ ID NO: 114117 - DNA, 25 bp, Homo sapien
aggaatctgcctgataatcgattgc

SEQ ID NO: 114118 - DNA, 25 bp, Homo sapien
gaatctgcctgataatcgattgcat

SEQ ID NO: 114119 - DNA, 25 bp, Homo sapien
atctgcctgataatcgattgcattg

SEQ ID NO: 114120 - DNA, 25 bp, Homo sapien
ctgcctgataatcgattgcattggc

SEQ ID NO: 114121 - DNA, 25 bp, Homo sapien
atcgattgcattggcaatgagacag

SEQ ID NO: 114122 - DNA, 25 bp, Homo sapien
ggatgcaacctctgacgttctgcgc

SEQ ID NO: 114123 - DNA, 25 bp, Homo sapien
atgcaacctctgacgttctgcgcct

SEQ ID NO: 114124 - DNA, 25 bp, Homo sapien
tgagatttcacaagcaatgcgagtt

SEQ ID NO: 114125 - DNA, 25 bp, Homo sapien
taggctctgtgacggcatagttttc

SEQ ID NO: 114126 - DNA, 25 bp, Homo sapien
gctctgtgacggcatagttttcagt

SEQ ID NO: 114127 - DNA, 25 bp, Homo sapien
gacggcatagttttcagtagcttta

SEQ ID NO: 114128 - DNA, 25 bp, Homo sapien
atagttttcagtagctttatcacaa

SEQ ID NO: 114129 - DNA, 25 bp, Homo sapien
agtagctttatcacaatattcacaa

SEQ ID NO: 114130 - DNA, 25 bp, Homo sapien
gctttatcacaatattcacaatgga

SEQ ID NO: 114131 - DNA, 25 bp, Homo sapien
ggagaattatatgacatggtagcag

SEQ ID NO: 114132 - DNA, 25 bp, Homo sapien
gacatggtagcagaaataggccctt

SEQ ID NO: 114133 - DNA, 25 bp, Homo sapien
aagattgcagcaagatcatgtgcat

SEQ ID NO: 114134 - DNA, 25 bp, Homo sapien
gatcatgtgcatatcatcccattgt

SEQ ID NO: 114135 - DNA, 25 bp, Homo sapien
atcatcccattgtaaagcgacttca

SEQ ID NO: 114136 - DNA, 25 bp, Homo sapien
tgtgtgctgtcgcttgtcgacaaca

SEQ ID NO: 114137 - DNA, 25 bp, Homo sapien
gtcgcttgtcgacaacagctttttg

SEQ ID NO: 114138 - DNA, 25 bp, Homo sapien
ttcctcaatgaggagtgttgctcat

SEQ ID NO: 114139 - DNA, 25 bp, Homo sapien
gtgttgctcatttgtgagccttcat

SEQ ID NO: 114140 - DNA, 25 bp, Homo sapien
gagccttcattaactcgaagtgaaa

SEQ ID NO: 114141 - DNA, 25 bp, Homo sapien
tatcctgttagaataggctgcatct

SEQ ID NO: 114142 - DNA, 25 bp, Homo sapien
gttagaataggctgcatctttttaa

SEQ ID NO: 114143 - DNA, 25 bp, Homo sapien
caaaacaactctggcttttgagatg

SEQ ID NO: 114144 - DNA, 25 bp, Homo sapien
gaataaaggcctgcgtgtgtctgtg

SEQ ID NO: 114145 - DNA, 25 bp, Homo sapien
attacgagaatctgcaggagctgaa

SEQ ID NO: 114146 - DNA, 25 bp, Homo sapien
tctgcaggagctgaactgagggcct

SEQ ID NO: 114147 - DNA, 25 bp, Homo sapien
gaggccgagtctgtcctggaaccag

SEQ ID NO: 114148 - DNA, 25 bp, Homo sapien
agtctgtcctggaaccaggcttgcc

SEQ ID NO: 114149 - DNA, 25 bp, Homo sapien
agctgggcagctggaagtggctctg

SEQ ID NO: 114150 - DNA, 25 bp, Homo sapien
ccagcctgacaacagcctgagaaat

SEQ ID NO: 114151 - DNA, 25 bp, Homo sapien
tgcaccttctgacgcagcctgagaa

SEQ ID NO: 114152 - DNA, 25 bp, Homo sapien
ttctgacgcagcctgagaatgacct

SEQ ID NO: 114153 - DNA, 25 bp, Homo sapien
agcctgagaatgacctgccctggcc

SEQ ID NO: 114154 - DNA, 25 bp, Homo sapien
agccctactctgtgtaatagaataa

SEQ ID NO: 114155 - DNA, 25 bp, Homo sapien
acgaatactaagaacccaggaagct

SEQ ID NO: 114156 - DNA, 25 bp, Homo sapien
gaacccaggaagctatcatacaaat

SEQ ID NO: 114157 - DNA, 25 bp, Homo sapien
agtaatgctcagctgcagactgaat

SEQ ID NO: 114158 - DNA, 25 bp, Homo sapien
ctcagctgcagactgaattagtaga

SEQ ID NO: 114159 - DNA, 25 bp, Homo sapien
aaaacatgttcttgccacaaaagaa

SEQ ID NO: 114160 - DNA, 25 bp, Homo sapien
ggctaatagagcacaaatacatcag

SEQ ID NO: 114161 - DNA, 25 bp, Homo sapien
aatctgatatcaacactttcatata

SEQ ID NO: 114162 - DNA, 25 bp, Homo sapien
tcaacactttcatatatatggcata

SEQ ID NO: 114163 - DNA, 25 bp, Homo sapien
catggacaatatttagaacccaaat

SEQ ID NO: 114164 - DNA, 25 bp, Homo sapien
acccaaattttggagtgcttgggca

SEQ ID NO: 114165 - DNA, 25 bp, Homo sapien
gtgcttgggcagaaagttgtaaagt

SEQ ID NO: 114166 - DNA, 25 bp, Homo sapien
tggaaaacctttttgtcaacactct

SEQ ID NO: 114167 - DNA, 25 bp, Homo sapien
ggaaaacctttttgtcaacactctg

SEQ ID NO: 114168 - DNA, 25 bp, Homo sapien
gaaaacctttttgtcaacactctgt

SEQ ID NO: 114169 - DNA, 25 bp, Homo sapien
aaacctttttgtcaacactctgtat

SEQ ID NO: 114170 - DNA, 25 bp, Homo sapien
tttttgtcaacactctgtatctagt

SEQ ID NO: 114171 - DNA, 25 bp, Homo sapien
gagccagcagtgacaacccactcgg

SEQ ID NO: 114172 - DNA, 25 bp, Homo sapien
agccagcagtgacaacccactcggg

SEQ ID NO: 114173 - DNA, 25 bp, Homo sapien
gccagcagtgacaacccactcgggt

SEQ ID NO: 114174 - DNA, 25 bp, Homo sapien
cttccacaccgggatgctttgtttg

SEQ ID NO: 114175 - DNA, 25 bp, Homo sapien
ttccacaccgggatgctttgtttgt

SEQ ID NO: 114176 - DNA, 25 bp, Homo sapien
tccacaccgggatgctttgtttgtt

SEQ ID NO: 114177 - DNA, 25 bp, Homo sapien
aagagcgggtactgaacgtgcccct

SEQ ID NO: 114178 - DNA, 25 bp, Homo sapien
agagcgggtactgaacgtgcccctg

SEQ ID NO: 114179 - DNA, 25 bp, Homo sapien
gactgtgagcaatggtgggaagatt

SEQ ID NO: 114180 - DNA, 25 bp, Homo sapien
ctggacttcagggtttaacaagtgc

SEQ ID NO: 114181 - DNA, 25 bp, Homo sapien
cttcagggtttaacaagtgcgcagt

SEQ ID NO: 114182 - DNA, 25 bp, Homo sapien
tcagggtttaacaagtgcgcagtgg

SEQ ID NO: 114183 - DNA, 25 bp, Homo sapien
ggacacctgcctctacgagtgctcc

SEQ ID NO: 114184 - DNA, 25 bp, Homo sapien
tctacgagtgctcccccaacttggg

SEQ ID NO: 114185 - DNA, 25 bp, Homo sapien
tggatccagcaggtggatcagagct

SEQ ID NO: 114186 - DNA, 25 bp, Homo sapien
gcaggtggatcagagctggcgcaaa

SEQ ID NO: 114187 - DNA, 25 bp, Homo sapien
ctggcgcaaagagcgggtactgaac

SEQ ID NO: 114188 - DNA, 25 bp, Homo sapien
aaggacatggacaaggtcgagacat

SEQ ID NO: 114189 - DNA, 25 bp, Homo sapien
aggacatggacaaggtcgagacatt

SEQ ID NO: 114190 - DNA, 25 bp, Homo sapien
ggacatggacaaggtcgagacattc

SEQ ID NO: 114191 - DNA, 25 bp, Homo sapien
gacatggacaaggtcgagacattcc

SEQ ID NO: 114192 - DNA, 25 bp, Homo sapien
acatggacaaggtcgagacattcct

SEQ ID NO: 114193 - DNA, 25 bp, Homo sapien
catggacaaggtcgagacattcctg

SEQ ID NO: 114194 - DNA, 25 bp, Homo sapien
atggacaaggtcgagacattcctgc

SEQ ID NO: 114195 - DNA, 25 bp, Homo sapien
tggacaaggtcgagacattcctgcg

SEQ ID NO: 114196 - DNA, 25 bp, Homo sapien
ggacaaggtcgagacattcctgcgc

SEQ ID NO: 114197 - DNA, 25 bp, Homo sapien
gacaaggtcgagacattcctgcgca

SEQ ID NO: 114198 - DNA, 25 bp, Homo sapien
acaaggtcgagacattcctgcgcat

SEQ ID NO: 114199 - DNA, 25 bp, Homo sapien
aaatatttcattttgatggaggtga

SEQ ID NO: 114200 - DNA, 25 bp, Homo sapien
aagtaaacaattccgtggcaactag

SEQ ID NO: 114201 - DNA, 25 bp, Homo sapien
attccgtggcaactagatatcatga

SEQ ID NO: 114202 - DNA, 25 bp, Homo sapien
agatatcatgatgtgcaaccagcat

SEQ ID NO: 114203 - DNA, 25 bp, Homo sapien
atgtgcaaccagcatctctgtctag

SEQ ID NO: 114204 - DNA, 25 bp, Homo sapien
caaccagcatctctgtctagttcca

SEQ ID NO: 114205 - DNA, 25 bp, Homo sapien
ccaaaagcaagacccataaccatta

SEQ ID NO: 114206 - DNA, 25 bp, Homo sapien
ataaccattatgcaagtgttcctat

SEQ ID NO: 114207 - DNA, 25 bp, Homo sapien
tggaaacccaccaatctactttgtt

SEQ ID NO: 114208 - DNA, 25 bp, Homo sapien
acccaccaatctactttgttgctat

SEQ ID NO: 114209 - DNA, 25 bp, Homo sapien
ctttgttgctatggctttacctatt

SEQ ID NO: 114210 - DNA, 25 bp, Homo sapien
ggcccggctggacattttgaagatt

SEQ ID NO: 114211 - DNA, 25 bp, Homo sapien
cattctcggaagatgaacctgaccc

SEQ ID NO: 114212 - DNA, 25 bp, Homo sapien
aagctggcatgtatgccctgcgaga

SEQ ID NO: 114213 - DNA, 25 bp, Homo sapien
tgtatgccctgcgagaacggcgagt

SEQ ID NO: 114214 - DNA, 25 bp, Homo sapien
tgcgagaacggcgagtccatgtcac

SEQ ID NO: 114215 - DNA, 25 bp, Homo sapien
tgtcactcaggaggactttgagatg

SEQ ID NO: 114216 - DNA, 25 bp, Homo sapien
gaggactttgagatggcagtagcca

SEQ ID NO: 114217 - DNA, 25 bp, Homo sapien
cagtagccaaggtcatgcagaagga

SEQ ID NO: 114218 - DNA, 25 bp, Homo sapien
ttatggaagtgagtggacagccttt

SEQ ID NO: 114219 - DNA, 25 bp, Homo sapien
tggacagcctttgtgtgtatctctc

SEQ ID NO: 114220 - DNA, 25 bp, Homo sapien
gcctttgtgtgtatctctccaataa

SEQ ID NO: 114221 - DNA, 25 bp, Homo sapien
gcagaaggagatgctcagggctcct

SEQ ID NO: 114222 - DNA, 25 bp, Homo sapien
agggcccaggcagctttgactgctt

SEQ ID NO: 114223 - DNA, 25 bp, Homo sapien
gctttgactgctttccaagttttca

SEQ ID NO: 114224 - DNA, 25 bp, Homo sapien
gctttccaagttttcattaatccag

SEQ ID NO: 114225 - DNA, 25 bp, Homo sapien
ggatgaacatggtcaccatctaact

SEQ ID NO: 114226 - DNA, 25 bp, Homo sapien
tcaggaattgtagtctgagggcgta

SEQ ID NO: 114227 - DNA, 25 bp, Homo sapien
gagggcgtagacaatttcatataat

SEQ ID NO: 114228 - DNA, 25 bp, Homo sapien
ataaatatcctttatcttctgtcag

SEQ ID NO: 114229 - DNA, 25 bp, Homo sapien
tctgtcagcatttatgggatgttta

SEQ ID NO: 114230 - DNA, 25 bp, Homo sapien
aaggcataatagtttcttcctgaaa

SEQ ID NO: 114231 - DNA, 25 bp, Homo sapien
ttcctgaaaaccattgctcttgcat

SEQ ID NO: 114232 - DNA, 25 bp, Homo sapien
acttgttgtaaaaatgatggtttgt

SEQ ID NO: 114233 - DNA, 25 bp, Homo sapien
gggtcaaacatcaaatgtaatattg

SEQ ID NO: 114234 - DNA, 25 bp, Homo sapien
tatatagcccagaaactataataac

SEQ ID NO: 114235 - DNA, 25 bp, Homo sapien
gaatttatattaccataaagtcctt

SEQ ID NO: 114236 - DNA, 25 bp, Homo sapien
atttattattgtaatctcgaggaaa

SEQ ID NO: 114237 - DNA, 25 bp, Homo sapien
taatctcgaggaaatttacttaaag

SEQ ID NO: 114238 - DNA, 25 bp, Homo sapien
agaatcgaagccaagtttaccacct

SEQ ID NO: 114239 - DNA, 25 bp, Homo sapien
aagtttaccacctgtgaactagagg

SEQ ID NO: 114240 - DNA, 25 bp, Homo sapien
gtttaccacctgtgaactagaggaa

SEQ ID NO: 114241 - DNA, 25 bp, Homo sapien
ttaccacctgtgaactagaggaagt

SEQ ID NO: 114242 - DNA, 25 bp, Homo sapien
ccacctgtgaactagaggaagtata

SEQ ID NO: 114243 - DNA, 25 bp, Homo sapien
ttgcccgaaggacctctgaagtacg

SEQ ID NO: 114244 - DNA, 25 bp, Homo sapien
gtacaggtgctgtgagacctaccct

SEQ ID NO: 114245 - DNA, 25 bp, Homo sapien
gagacctaccctattcagaattaaa

SEQ ID NO: 114246 - DNA, 25 bp, Homo sapien
aaatttcctcccatcacgaagctaa

SEQ ID NO: 114247 - DNA, 25 bp, Homo sapien
tacgtatttagcacctctgaggctt

SEQ ID NO: 114248 - DNA, 25 bp, Homo sapien
tgaggctttgccatggagaccattt

SEQ ID NO: 114249 - DNA, 25 bp, Homo sapien
gagaccatttctgtagggctaagga

SEQ ID NO: 114250 - DNA, 25 bp, Homo sapien
catttagacgtggtgactgactttc

SEQ ID NO: 114251 - DNA, 25 bp, Homo sapien
actgactttcatttggacttggcga

SEQ ID NO: 114252 - DNA, 25 bp, Homo sapien
gtatctgagaaacacctcggctgtg

SEQ ID NO: 114253 - DNA, 25 bp, Homo sapien
tggtctctctgctttaaatcctaac

SEQ ID NO: 114254 - DNA, 25 bp, Homo sapien
ccgccctgcgggtgaacaaagcagc

SEQ ID NO: 114255 - DNA, 25 bp, Homo sapien
aacaaagcagccacgaggtgcaaca

SEQ ID NO: 114256 - DNA, 25 bp, Homo sapien
acgaggtgcaacaaggtcctctgtc

SEQ ID NO: 114257 - DNA, 25 bp, Homo sapien
aaggtcctctgtcagtcacagccac

SEQ ID NO: 114258 - DNA, 25 bp, Homo sapien
agtcattcgttctgtggagggacaa

SEQ ID NO: 114259 - DNA, 25 bp, Homo sapien
ttctgtggagggacaagtggactca

SEQ ID NO: 114260 - DNA, 25 bp, Homo sapien
tcagggcagcgccaggctgaccaca

SEQ ID NO: 114261 - DNA, 25 bp, Homo sapien
acctgcctcaggactgcgacgaaac

SEQ ID NO: 114262 - DNA, 25 bp, Homo sapien
ctcaggactgcgacgaaaccggtgg

SEQ ID NO: 114263 - DNA, 25 bp, Homo sapien
ggctggttctgtaattgtgtgtgat

SEQ ID NO: 114264 - DNA, 25 bp, Homo sapien
gtgaagccaattcagacaggcaaat

SEQ ID NO: 114265 - DNA, 25 bp, Homo sapien
ctgggctgatgaatttgttttcatc

SEQ ID NO: 114266 - DNA, 25 bp, Homo sapien
aaaatactagcctagctggtcattt

SEQ ID NO: 114267 - DNA, 25 bp, Homo sapien
agctggtcatttctttgtaaggtag

SEQ ID NO: 114268 - DNA, 25 bp, Homo sapien
gtcatttctttgtaaggtagttagc

SEQ ID NO: 114269 - DNA, 25 bp, Homo sapien
gtagttagcaattttaagtctttct

SEQ ID NO: 114270 - DNA, 25 bp, Homo sapien
tagcaattttaagtctttctttggt

SEQ ID NO: 114271 - DNA, 25 bp, Homo sapien
taggtaagacacttttttactgctt

SEQ ID NO: 114272 - DNA, 25 bp, Homo sapien
tctgtcttgttttgagaccatgatg

SEQ ID NO: 114273 - DNA, 25 bp, Homo sapien
catgatggttacacttttggttcct

SEQ ID NO: 114274 - DNA, 25 bp, Homo sapien
tgatggttacacttttggttcctaa

SEQ ID NO: 114275 - DNA, 25 bp, Homo sapien
gtcacaaaggtaatggattgcacat

SEQ ID NO: 114276 - DNA, 25 bp, Homo sapien
gaagcgagggctgtgcacagttcac

SEQ ID NO: 114277 - DNA, 25 bp, Homo sapien
gggctgtgcacagttcaccgagaag

SEQ ID NO: 114278 - DNA, 25 bp, Homo sapien
gagaagctgacttcttctggagcct

SEQ ID NO: 114279 - DNA, 25 bp, Homo sapien
ctgacttcttctggagcctgtgtac

SEQ ID NO: 114280 - DNA, 25 bp, Homo sapien
gagcctgtgtactgcggacatgtcc

SEQ ID NO: 114281 - DNA, 25 bp, Homo sapien
tactgcggacatgtccctgctggag

SEQ ID NO: 114282 - DNA, 25 bp, Homo sapien
tgagacaagaaagaaaacgcccact

SEQ ID NO: 114283 - DNA, 25 bp, Homo sapien
gaaaacgcccactcctggatcttca

SEQ ID NO: 114284 - DNA, 25 bp, Homo sapien
tcctggatcttcacattgaactcaa

SEQ ID NO: 114285 - DNA, 25 bp, Homo sapien
gaactcaatggctacatgtatgatt

SEQ ID NO: 114286 - DNA, 25 bp, Homo sapien
atgtatgattctttagagcacactg

SEQ ID NO: 114287 - DNA, 25 bp, Homo sapien
cgtcaggcatgcgagtaacaagggc

SEQ ID NO: 114288 - DNA, 25 bp, Homo sapien
atggaacatctgctcaacatgaagt

SEQ ID NO: 114289 - DNA, 25 bp, Homo sapien
acatctgctcaacatgaagtgcaaa

SEQ ID NO: 114290 - DNA, 25 bp, Homo sapien
aagtgcaaaaatgtggtcccagtgt

SEQ ID NO: 114291 - DNA, 25 bp, Homo sapien
ggtcccagtgtatgacctgctgctg

SEQ ID NO: 114292 - DNA, 25 bp, Homo sapien
ggagatgctgaatgcccacgtgctt

SEQ ID NO: 114293 - DNA, 25 bp, Homo sapien
atgcccacgtgcttcgcgggtgcaa

SEQ ID NO: 114294 - DNA, 25 bp, Homo sapien
cgcgggtgcaagtcctccatcacgg

SEQ ID NO: 114295 - DNA, 25 bp, Homo sapien
agcccggcagaggacagtaaaagca

SEQ ID NO: 114296 - DNA, 25 bp, Homo sapien
gtaaaagcaaagagggctcccagaa

SEQ ID NO: 114297 - DNA, 25 bp, Homo sapien
tcagtgacgcctggccctgaggtga

SEQ ID NO: 114298 - DNA, 25 bp, Homo sapien
gtgtgtactgcactttacagtttgc

SEQ ID NO: 114299 - DNA, 25 bp, Homo sapien
acagtttgcaaagctcttccatacc

SEQ ID NO: 114300 - DNA, 25 bp, Homo sapien
actctctcaccgaagcctaattgag

SEQ ID NO: 114301 - DNA, 25 bp, Homo sapien
taattgaggctcttggaaggagtca

SEQ ID NO: 114302 - DNA, 25 bp, Homo sapien
ggagtcaggcaaggattgtgcttcc

SEQ ID NO: 114303 - DNA, 25 bp, Homo sapien
gcttcccccattatacaggtgacaa

SEQ ID NO: 114304 - DNA, 25 bp, Homo sapien
gtccgtggtagagccgggacccaat

SEQ ID NO: 114305 - DNA, 25 bp, Homo sapien
tctcctccctgttggtgctgttctt

SEQ ID NO: 114306 - DNA, 25 bp, Homo sapien
tgttggtgctgttcttcctgcccaa

SEQ ID NO: 114307 - DNA, 25 bp, Homo sapien
aggagcctgggcacttactccccgt

SEQ ID NO: 114308 - DNA, 25 bp, Homo sapien
tgggcacttactccccgtttttgct

SEQ ID NO: 114309 - DNA, 25 bp, Homo sapien
taatgctcacctttatcacctcatt

SEQ ID NO: 114310 - DNA, 25 bp, Homo sapien
tcattctgaaccctttcgctggctt

SEQ ID NO: 114311 - DNA, 25 bp, Homo sapien
ggctttccagcttagaatgcatctc

SEQ ID NO: 114312 - DNA, 25 bp, Homo sapien
catattattatcctcctgttctgaa

SEQ ID NO: 114313 - DNA, 25 bp, Homo sapien
tagtttcaagagtctaaaccccaga

SEQ ID NO: 114314 - DNA, 25 bp, Homo sapien
aaccccagattcttcagcttgatcc

SEQ ID NO: 114315 - DNA, 25 bp, Homo sapien
gtctgagcttctttagctaggctaa

SEQ ID NO: 114316 - DNA, 25 bp, Homo sapien
gctaggctaaaacaccttggcttgt

SEQ ID NO: 114317 - DNA, 25 bp, Homo sapien
ttggcttgttattgcctctactttg

SEQ ID NO: 114318 - DNA, 25 bp, Homo sapien
tgataatgctcacttggtcctacct

SEQ ID NO: 114319 - DNA, 25 bp, Homo sapien
tcacttggtcctacctattatcctt

SEQ ID NO: 114320 - DNA, 25 bp, Homo sapien
gaagcgagggctgtgcacagttcac

SEQ ID NO: 114321 - DNA, 25 bp, Homo sapien
aagcgagggctgtgcacagttcacc

SEQ ID NO: 114322 - DNA, 25 bp, Homo sapien
cgagggctgtgcacagttcaccgag

SEQ ID NO: 114323 - DNA, 25 bp, Homo sapien
agggctgtgcacagttcaccgagaa

SEQ ID NO: 114324 - DNA, 25 bp, Homo sapien
gggctgtgcacagttcaccgagaag

SEQ ID NO: 114325 - DNA, 25 bp, Homo sapien
tggagcctgtgtactgcggacatgt

SEQ ID NO: 114326 - DNA, 25 bp, Homo sapien
gagcctgtgtactgcggacatgtcc

SEQ ID NO: 114327 - DNA, 25 bp, Homo sapien
agcctgtgtactgcggacatgtccc

SEQ ID NO: 114328 - DNA, 25 bp, Homo sapien
tgtgtactgcggacatgtccctgct

SEQ ID NO: 114329 - DNA, 25 bp, Homo sapien
tgtactgcggacatgtccctgctgg

SEQ ID NO: 114330 - DNA, 25 bp, Homo sapien
tactgcggacatgtccctgctggag

SEQ ID NO: 114331 - DNA, 25 bp, Homo sapien
acattattctgttttcactgcgtat

SEQ ID NO: 114332 - DNA, 25 bp, Homo sapien
gttttcactgcgtatccttggtaag

SEQ ID NO: 114333 - DNA, 25 bp, Homo sapien
gcgtatccttggtaagccctgtgga

SEQ ID NO: 114334 - DNA, 25 bp, Homo sapien
ttggtaagccctgtggactggttcc

SEQ ID NO: 114335 - DNA, 25 bp, Homo sapien
agagataagggctctctcgggccat

SEQ ID NO: 114336 - DNA, 25 bp, Homo sapien
ataagggctctctcgggccatgcta

SEQ ID NO: 114337 - DNA, 25 bp, Homo sapien
catgctacccggtatgactgggtaa

SEQ ID NO: 114338 - DNA, 25 bp, Homo sapien
aatgaggacagactgtggacacccc

SEQ ID NO: 114339 - DNA, 25 bp, Homo sapien
ccatctacctgagtctgattcttta

SEQ ID NO: 114340 - DNA, 25 bp, Homo sapien
gtctgattctttagcagcagagact

SEQ ID NO: 114341 - DNA, 25 bp, Homo sapien
ggaaaggtttgtggctccttgcagc

SEQ ID NO: 114342 - DNA, 25 bp, Homo sapien
actagctgcccaacggatgaatcaa

SEQ ID NO: 114343 - DNA, 25 bp, Homo sapien
acggatgaatcaacgccttggcaga

SEQ ID NO: 114344 - DNA, 25 bp, Homo sapien
aacgccttggcagagttttccagca

SEQ ID NO: 114345 - DNA, 25 bp, Homo sapien
ttggcagagttttccagcagggcct

SEQ ID NO: 114346 - DNA, 25 bp, Homo sapien
tgaggagttagcctggaacattcca

SEQ ID NO: 114347 - DNA, 25 bp, Homo sapien
ccagcgtgggcattattgtcctgtt

SEQ ID NO: 114348 - DNA, 25 bp, Homo sapien
attgtcctgttgcaagttcagggca

SEQ ID NO: 114349 - DNA, 25 bp, Homo sapien
gttcagggcaaaaccaggaatccag

SEQ ID NO: 114350 - DNA, 25 bp, Homo sapien
caggaatccagttttgtcgatccaa

SEQ ID NO: 114351 - DNA, 25 bp, Homo sapien
ccagttttgtcgatccaattgagaa

SEQ ID NO: 114352 - DNA, 25 bp, Homo sapien
gaacaactacttgtggcatgcattg

SEQ ID NO: 114353 - DNA, 25 bp, Homo sapien
cccatcttgcaggacgacattgaag

SEQ ID NO: 114354 - DNA, 25 bp, Homo sapien
catcttgcaggacgacattgaagat

SEQ ID NO: 114355 - DNA, 25 bp, Homo sapien
tgtaaaagactttctagtgtacaag

SEQ ID NO: 114356 - DNA, 25 bp, Homo sapien
ctagtgtacaagacaccattgtgtc

SEQ ID NO: 114357 - DNA, 25 bp, Homo sapien
gacaccattgtgtccaactgtatat

SEQ ID NO: 114358 - DNA, 25 bp, Homo sapien
attgtgtccaactgtatatagctgc

SEQ ID NO: 114359 - DNA, 25 bp, Homo sapien
gtgtccaactgtatatagctgccaa

SEQ ID NO: 114360 - DNA, 25 bp, Homo sapien
gtccaactgtatatagctgccaatt

SEQ ID NO: 114361 - DNA, 25 bp, Homo sapien
ctgtatatagctgccaattagtttt

SEQ ID NO: 114362 - DNA, 25 bp, Homo sapien
ttgtttttactttgtcctttgctat

SEQ ID NO: 114363 - DNA, 25 bp, Homo sapien
tttttactttgtcctttgctatctg

SEQ ID NO: 114364 - DNA, 25 bp, Homo sapien
tttcaagaacaaatcttctctcagg

SEQ ID NO: 114365 - DNA, 25 bp, Homo sapien
ttctctcaggaaaattgcctttctc

SEQ ID NO: 114366 - DNA, 25 bp, Homo sapien
tttactgtggaatatgtgctggaaa

SEQ ID NO: 114367 - DNA, 25 bp, Homo sapien
gcaacaacactttactacctaacgg

SEQ ID NO: 114368 - DNA, 25 bp, Homo sapien
actacctaacggatagcatttgtaa

SEQ ID NO: 114369 - DNA, 25 bp, Homo sapien
atactctaggtatctgtaaacactc

SEQ ID NO: 114370 - DNA, 25 bp, Homo sapien
gtaaacactctgatgaagtctgtat

SEQ ID NO: 114371 - DNA, 25 bp, Homo sapien
tagtgtgactaacccacaggcaggt

SEQ ID NO: 114372 - DNA, 25 bp, Homo sapien
cacaggcaggttggtttacattaat

SEQ ID NO: 114373 - DNA, 25 bp, Homo sapien
gaatgggatgtcctatggaaaccta

SEQ ID NO: 114374 - DNA, 25 bp, Homo sapien
gtcctatggaaacctatttcaccag

SEQ ID NO: 114375 - DNA, 25 bp, Homo sapien
gcacgagcccgtgcggaggcggtgc

SEQ ID NO: 114376 - DNA, 25 bp, Homo sapien
gagcccgtgcggaggcggtgcggag

SEQ ID NO: 114377 - DNA, 25 bp, Homo sapien
actacggcgagcgggttaatgttga

SEQ ID NO: 114378 - DNA, 25 bp, Homo sapien
ctacggcgagcgggttaatgttgaa

SEQ ID NO: 114379 - DNA, 25 bp, Homo sapien
tacggcgagcgggttaatgttgaag

SEQ ID NO: 114380 - DNA, 25 bp, Homo sapien
cggcgagcgggttaatgttgaagaa

SEQ ID NO: 114381 - DNA, 25 bp, Homo sapien
gagcgggttaatgttgaagaaggaa

SEQ ID NO: 114382 - DNA, 25 bp, Homo sapien
gaagaaggaaaatgcggaagtcgtc

SEQ ID NO: 114383 - DNA, 25 bp, Homo sapien
aagaaggaaaatgcggaagtcgtca

SEQ ID NO: 114384 - DNA, 25 bp, Homo sapien
aggaaaatgcggaagtcgtcatttg

SEQ ID NO: 114385 - DNA, 25 bp, Homo sapien
ggaaaatgcggaagtcgtcatttga

SEQ ID NO: 114386 - DNA, 25 bp, Homo sapien
gtctatcgccacctgaaggacctag

SEQ ID NO: 114387 - DNA, 25 bp, Homo sapien
tctatcgccacctgaaggacctaga

SEQ ID NO: 114388 - DNA, 25 bp, Homo sapien
ctatcgccacctgaaggacctagag

SEQ ID NO: 114389 - DNA, 25 bp, Homo sapien
tatcgccacctgaaggacctagagg

SEQ ID NO: 114390 - DNA, 25 bp, Homo sapien
atcgccacctgaaggacctagagga

SEQ ID NO: 114391 - DNA, 25 bp, Homo sapien
tcgccacctgaaggacctagaggaa

SEQ ID NO: 114392 - DNA, 25 bp, Homo sapien
cttcaatcagtcctacagcaagttt

SEQ ID NO: 114393 - DNA, 25 bp, Homo sapien
ttcaatcagtcctacagcaagtttg

SEQ ID NO: 114394 - DNA, 25 bp, Homo sapien
ctgtggcttctagcccgggtggcat

SEQ ID NO: 114395 - DNA, 25 bp, Homo sapien
tctagcccgggtggcatccctgtga

SEQ ID NO: 114396 - DNA, 25 bp, Homo sapien
cccactgcctctcctggtcgtggaa

SEQ ID NO: 114397 - DNA, 25 bp, Homo sapien
tttggatgtctttgctgcagtcttc

SEQ ID NO: 114398 - DNA, 25 bp, Homo sapien
tggatgtctttgctgcagtcttctc

SEQ ID NO: 114399 - DNA, 25 bp, Homo sapien
aggtttgagtccctccaaagggcag

SEQ ID NO: 114400 - DNA, 25 bp, Homo sapien
cagtgggtggaggaccgggagcttt

SEQ ID NO: 114401 - DNA, 25 bp, Homo sapien
gagctttgggtgaccagccactcaa

SEQ ID NO: 114402 - DNA, 25 bp, Homo sapien
agccactcaaaggaactttctggtc

SEQ ID NO: 114403 - DNA, 25 bp, Homo sapien
caaaggaactttctggtcccttcag

SEQ ID NO: 114404 - DNA, 25 bp, Homo sapien
aggaactttctggtcccttcagtat

SEQ ID NO: 114405 - DNA, 25 bp, Homo sapien
tttctggtcccttcagtatcttcaa

SEQ ID NO: 114406 - DNA, 25 bp, Homo sapien
agtatcttcaaggtttggaaactgc

SEQ ID NO: 114407 - DNA, 25 bp, Homo sapien
ggtttggaaactgcaaatgtcccct

SEQ ID NO: 114408 - DNA, 25 bp, Homo sapien
taacgttgaacagtcctgtatcaaa

SEQ ID NO: 114409 - DNA, 25 bp, Homo sapien
ttgaacagtcctgtatcaaaactga

SEQ ID NO: 114410 - DNA, 25 bp, Homo sapien
agatggtttgaaacagcttcacaag

SEQ ID NO: 114411 - DNA, 25 bp, Homo sapien
aaacagcttcacaaggcagaacagt

SEQ ID NO: 114412 - DNA, 25 bp, Homo sapien
gcttcacaaggcagaacagtatcaa

SEQ ID NO: 114413 - DNA, 25 bp, Homo sapien
agaagaatcggaagatgcttgtgat

SEQ ID NO: 114414 - DNA, 25 bp, Homo sapien
tcatcattgtgctcattgttgtcct

SEQ ID NO: 114415 - DNA, 25 bp, Homo sapien
tcattgttgtcctcgttggcgtgaa

SEQ ID NO: 114416 - DNA, 25 bp, Homo sapien
gttgtcctcgttggcgtgaagtctc

SEQ ID NO: 114417 - DNA, 25 bp, Homo sapien
tcctcgttggcgtgaagtctcgata

SEQ ID NO: 114418 - DNA, 25 bp, Homo sapien
tggcgtgaagtctcgataagtggca

SEQ ID NO: 114419 - DNA, 25 bp, Homo sapien
tagggagttgtctaattggtataaa

SEQ ID NO: 114420 - DNA, 25 bp, Homo sapien
gtatgcaagatgaattagctctaaa

SEQ ID NO: 114421 - DNA, 25 bp, Homo sapien
gaattagctctaaagatcagctgta

SEQ ID NO: 114422 - DNA, 25 bp, Homo sapien
gtatagcagagttcgtataatgaac

SEQ ID NO: 114423 - DNA, 25 bp, Homo sapien
aatactgtattatgcacttaacatt

SEQ ID NO: 114424 - DNA, 25 bp, Homo sapien
cattttgttaagagggtacctctca

SEQ ID NO: 114425 - DNA, 25 bp, Homo sapien
agtgttcttaccatatacatataca

SEQ ID NO: 114426 - DNA, 25 bp, Homo sapien
tatacatatacacaaggaagctttt

SEQ ID NO: 114427 - DNA, 25 bp, Homo sapien
atatacacaaggaagcttttggagg

SEQ ID NO: 114428 - DNA, 25 bp, Homo sapien
gacaggtatgtgactatgtctaaac

SEQ ID NO: 114429 - DNA, 25 bp, Homo sapien
gtgactatgtctaaactcatcaaat

SEQ ID NO: 114430 - DNA, 25 bp, Homo sapien
gatattgggattttgctagctctct

SEQ ID NO: 114431 - DNA, 25 bp, Homo sapien
attgggattttgctagctctctaaa

SEQ ID NO: 114432 - DNA, 25 bp, Homo sapien
ggattttgctagctctctaaagtaa

SEQ ID NO: 114433 - DNA, 25 bp, Homo sapien
gctagctctctaaagtaaataggat

SEQ ID NO: 114434 - DNA, 25 bp, Homo sapien
gtgcattaagcagttataacatggg

SEQ ID NO: 114435 - DNA, 25 bp, Homo sapien
aacatgggaatgatttgttcatgaa

SEQ ID NO: 114436 - DNA, 25 bp, Homo sapien
aaaggttgaaagtctgtacttacag

SEQ ID NO: 114437 - DNA, 25 bp, Homo sapien
ttacagaacttttgagttcacagtg

SEQ ID NO: 114438 - DNA, 25 bp, Homo sapien
taatttctttataactgtcagtttc

SEQ ID NO: 114439 - DNA, 25 bp, Homo sapien
cagtttcttttgtgactattatgtt

SEQ ID NO: 114440 - DNA, 25 bp, Homo sapien
tttgtgactattatgttacctattt

SEQ ID NO: 114441 - DNA, 25 bp, Homo sapien
agaaacagaagcagtgttccatttt

SEQ ID NO: 114442 - DNA, 25 bp, Homo sapien
ttttcttcctcaccaatgacattct

SEQ ID NO: 114443 - DNA, 25 bp, Homo sapien
tcctcaccaatgacattcttttctt

SEQ ID NO: 114444 - DNA, 25 bp, Homo sapien
tcctttcgtactcctccctgagagt

SEQ ID NO: 114445 - DNA, 25 bp, Homo sapien
acactcgtttccctttgctcatgac

SEQ ID NO: 114446 - DNA, 25 bp, Homo sapien
ctttgctcatgactcctgtagggaa

SEQ ID NO: 114447 - DNA, 25 bp, Homo sapien
atgactcctgtagggaagtttcttc

SEQ ID NO: 114448 - DNA, 25 bp, Homo sapien
tcaaacaaaacccagctcctgagtc

SEQ ID NO: 114449 - DNA, 25 bp, Homo sapien
agctcctgagtctccagatgttgtt

SEQ ID NO: 114450 - DNA, 25 bp, Homo sapien
gatgttgttctgtcagttgccaaag

SEQ ID NO: 114451 - DNA, 25 bp, Homo sapien
gggatccaaccaattcaattaatgt

SEQ ID NO: 114452 - DNA, 25 bp, Homo sapien
taagtgatcgtgtgagtcgtcgtta

SEQ ID NO: 114453 - DNA, 25 bp, Homo sapien
gtgagtcgtcgttaaatgcctgtct

SEQ ID NO: 114454 - DNA, 25 bp, Homo sapien
atcatgggctcctcgaggacaggga

SEQ ID NO: 114455 - DNA, 25 bp, Homo sapien
gcatagggacctaaggcccactgga

SEQ ID NO: 114456 - DNA, 25 bp, Homo sapien
taaggcccactggagggcgctcatc

SEQ ID NO: 114457 - DNA, 25 bp, Homo sapien
gggcgctcatcaagtagctgctgga

SEQ ID NO: 114458 - DNA, 25 bp, Homo sapien
tagctgctggatgttgacgaaggaa

SEQ ID NO: 114459 - DNA, 25 bp, Homo sapien
agctcagggatctccgagtcaggac

SEQ ID NO: 114460 - DNA, 25 bp, Homo sapien
gagtcaggacggtcggccagaccca

SEQ ID NO: 114461 - DNA, 25 bp, Homo sapien
gtaacgggtctaatcgtgtaggaat

SEQ ID NO: 114462 - DNA, 25 bp, Homo sapien
gctgtattccagtgcttccaaaaaa

SEQ ID NO: 114463 - DNA, 25 bp, Homo sapien
cacgactctgttggaagtgggcacg

SEQ ID NO: 114464 - DNA, 25 bp, Homo sapien
gggcacggctgctgcgacccacagt

SEQ ID NO: 114465 - DNA, 25 bp, Homo sapien
acagtccagttcttcctggtggcct

SEQ ID NO: 114466 - DNA, 25 bp, Homo sapien
tggcctttgccctctacgtgggcta

SEQ ID NO: 114467 - DNA, 25 bp, Homo sapien
tacacccgcgtgtctgattacaaac

SEQ ID NO: 114468 - DNA, 25 bp, Homo sapien
tggctgccctcactgtctgctacat

SEQ ID NO: 114469 - DNA, 25 bp, Homo sapien
ctgctacatctcagacttcttcaaa

SEQ ID NO: 114470 - DNA, 25 bp, Homo sapien
cccacagcactgtctgaaggaggag

SEQ ID NO: 114471 - DNA, 25 bp, Homo sapien
ggaacggaagcccagcctgtcactg

SEQ ID NO: 114472 - DNA, 25 bp, Homo sapien
tcactgacgttgaccctgggcgagg

SEQ ID NO: 114473 - DNA, 25 bp, Homo sapien
gaggctgaccacaaccactatggat

SEQ ID NO: 114474 - DNA, 25 bp, Homo sapien
ctacatcagacctccctggcttggg

SEQ ID NO: 114475 - DNA, 25 bp, Homo sapien
tacatcagacctccctggcttgggc

SEQ ID NO: 114476 - DNA, 25 bp, Homo sapien
taagcccaagaccagcgctcaccac

SEQ ID NO: 114477 - DNA, 25 bp, Homo sapien
ctggcctggccaactctcctgtgga

SEQ ID NO: 114478 - DNA, 25 bp, Homo sapien
ggcctggccaactctcctgtggaca

SEQ ID NO: 114479 - DNA, 25 bp, Homo sapien
tggccaactctcctgtggacatgtc

SEQ ID NO: 114480 - DNA, 25 bp, Homo sapien
ggccaactctcctgtggacatgtcg

SEQ ID NO: 114481 - DNA, 25 bp, Homo sapien
gccaactctcctgtggacatgtcgg

SEQ ID NO: 114482 - DNA, 25 bp, Homo sapien
ccaactctcctgtggacatgtcggg

SEQ ID NO: 114483 - DNA, 25 bp, Homo sapien
gggtgacctcgctggaggcactggc

SEQ ID NO: 114484 - DNA, 25 bp, Homo sapien
gacctcgctggaggcactggccccg

SEQ ID NO: 114485 - DNA, 25 bp, Homo sapien
aagacactgtgtgggtagggcactg

SEQ ID NO: 114486 - DNA, 25 bp, Homo sapien
gtgggtagggcactgagctgctgca

SEQ ID NO: 114487 - DNA, 25 bp, Homo sapien
gctgctgcagtttcacagggaaggc

SEQ ID NO: 114488 - DNA, 25 bp, Homo sapien
gggaaggctgcacctatcaatcaat

SEQ ID NO: 114489 - DNA, 25 bp, Homo sapien
aggctgcacctatcaatcaatcaat

SEQ ID NO: 114490 - DNA, 25 bp, Homo sapien
ccaagacacagttccctgagggaag

SEQ ID NO: 114491 - DNA, 25 bp, Homo sapien
aaaggcctaagggtgtactctctgt

SEQ ID NO: 114492 - DNA, 25 bp, Homo sapien
ggcctaagggtgtactctctgtata

SEQ ID NO: 114493 - DNA, 25 bp, Homo sapien
aagggtgtactctctgtatagcccc

SEQ ID NO: 114494 - DNA, 25 bp, Homo sapien
tgtactctctgtatagccccgctat

SEQ ID NO: 114495 - DNA, 25 bp, Homo sapien
tatagccccgctatgggaaaataaa

SEQ ID NO: 114496 - DNA, 25 bp, Homo sapien
ttgttgctgctggctcttgccgcgg

SEQ ID NO: 114497 - DNA, 25 bp, Homo sapien
gatagctccgtctcaccaggctctt

SEQ ID NO: 114498 - DNA, 25 bp, Homo sapien
tctcaccaggctcttatagttctca

SEQ ID NO: 114499 - DNA, 25 bp, Homo sapien
caggctcttatagttctcattcttc

SEQ ID NO: 114500 - DNA, 25 bp, Homo sapien
ggtagtaatagaggacgcactcagc

SEQ ID NO: 114501 - DNA, 25 bp, Homo sapien
gtcttcctctccaggaatgatgcga

SEQ ID NO: 114502 - DNA, 25 bp, Homo sapien
tcctctccaggaatgatgcgatcag

SEQ ID NO: 114503 - DNA, 25 bp, Homo sapien
aatgatgcgatcaggccaaagttct

SEQ ID NO: 114504 - DNA, 25 bp, Homo sapien
caaagttcttgggatgctgcatgaa

SEQ ID NO: 114505 - DNA, 25 bp, Homo sapien
gatgctgcatgaacttctcccggaa

SEQ ID NO: 114506 - DNA, 25 bp, Homo sapien
gcatgaacttctcccggaaggtctc

SEQ ID NO: 114507 - DNA, 25 bp, Homo sapien
agaccccacactccatggagtctgg

SEQ ID NO: 114508 - DNA, 25 bp, Homo sapien
gaccccacactccatggagtctgga

SEQ ID NO: 114509 - DNA, 25 bp, Homo sapien
accccacactccatggagtctggaa

SEQ ID NO: 114510 - DNA, 25 bp, Homo sapien
cccacactccatggagtctggaatg

SEQ ID NO: 114511 - DNA, 25 bp, Homo sapien
ccacactccatggagtctggaatgc

SEQ ID NO: 114512 - DNA, 25 bp, Homo sapien
acactccatggagtctggaatgcat

SEQ ID NO: 114513 - DNA, 25 bp, Homo sapien
cactccatggagtctggaatgcatg

SEQ ID NO: 114514 - DNA, 25 bp, Homo sapien
actccatggagtctggaatgcatgg

SEQ ID NO: 114515 - DNA, 25 bp, Homo sapien
agtctggaatgcatgggagctgccc

SEQ ID NO: 114516 - DNA, 25 bp, Homo sapien
cagtggacaccattggaccccaccc

SEQ ID NO: 114517 - DNA, 25 bp, Homo sapien
cacccagcctggatctaccccagga

SEQ ID NO: 114518 - DNA, 25 bp, Homo sapien
tcacaacctgtgagagcccttcaaa

SEQ ID NO: 114519 - DNA, 25 bp, Homo sapien
gagagcccttcaaacaccaaagttc

SEQ ID NO: 114520 - DNA, 25 bp, Homo sapien
ttcaaacaccaaagttccccatgac

SEQ ID NO: 114521 - DNA, 25 bp, Homo sapien
catcccgtttaacccatgacatgca

SEQ ID NO: 114522 - DNA, 25 bp, Homo sapien
agtcccacgacatccctgtagctgt

SEQ ID NO: 114523 - DNA, 25 bp, Homo sapien
gtagctgtccctcttcagatattcc

SEQ ID NO: 114524 - DNA, 25 bp, Homo sapien
tccctcttcagatattccctatgaa

SEQ ID NO: 114525 - DNA, 25 bp, Homo sapien
gatattccctatgaaatagccacaa

SEQ ID NO: 114526 - DNA, 25 bp, Homo sapien
atgaaatagccacaacctctgatcc

SEQ ID NO: 114527 - DNA, 25 bp, Homo sapien
aacctctgatccttgctgttgttgg

SEQ ID NO: 114528 - DNA, 25 bp, Homo sapien
tgatccttgctgttgttggagaaga

SEQ ID NO: 114529 - DNA, 25 bp, Homo sapien
ctgggccaactttgcgagaaatggg

SEQ ID NO: 114530 - DNA, 25 bp, Homo sapien
atggcgagggtctgccacactggcc

SEQ ID NO: 114531 - DNA, 25 bp, Homo sapien
acactggccgctgttcgaccaggag

SEQ ID NO: 114532 - DNA, 25 bp, Homo sapien
ctgttcgaccaggaggagcaatacc

SEQ ID NO: 114533 - DNA, 25 bp, Homo sapien
tacctgcagctgaacctacagcctg

SEQ ID NO: 114534 - DNA, 25 bp, Homo sapien
aggcccacaggctccagttctggaa

SEQ ID NO: 114535 - DNA, 25 bp, Homo sapien
agttctggaagaaggcgctgcccca

SEQ ID NO: 114536 - DNA, 25 bp, Homo sapien
aaggcgctgccccaaaagatccagg

SEQ ID NO: 114537 - DNA, 25 bp, Homo sapien
atccaggagctcgaggagcctgaag

SEQ ID NO: 114538 - DNA, 25 bp, Homo sapien
tcgaggagcctgaagagagacacac

SEQ ID NO: 114539 - DNA, 25 bp, Homo sapien
gacacacagagctgtagctccctgt

SEQ ID NO: 114540 - DNA, 25 bp, Homo sapien
ctcattgccgtgtccaatcattatg

SEQ ID NO: 114541 - DNA, 25 bp, Homo sapien
gtgtccaatcattatggagccatgg

SEQ ID NO: 114542 - DNA, 25 bp, Homo sapien
ttggccactacactgcatatgcgaa

SEQ ID NO: 114543 - DNA, 25 bp, Homo sapien
tgatgatagcaacgtgtccctggcc

SEQ ID NO: 114544 - DNA, 25 bp, Homo sapien
gtgtccctggcctctgaggatcaga

SEQ ID NO: 114545 - DNA, 25 bp, Homo sapien
gatcagatagtgactaaagcagctt

SEQ ID NO: 114546 - DNA, 25 bp, Homo sapien
atgtgctattttaccaacgtcgaga

SEQ ID NO: 114547 - DNA, 25 bp, Homo sapien
taccaacgtcgagatgatgaatttt

SEQ ID NO: 114548 - DNA, 25 bp, Homo sapien
aagacaccttcacttagcagttctg

SEQ ID NO: 114549 - DNA, 25 bp, Homo sapien
tggagggacacgaccaagcagctct

SEQ ID NO: 114550 - DNA, 25 bp, Homo sapien
gaggcttgcagcatggacaccaact

SEQ ID NO: 114551 - DNA, 25 bp, Homo sapien
gaagttgtaaagatccgggattcct

SEQ ID NO: 114552 - DNA, 25 bp, Homo sapien
atccgggattccttcagtaaccaga

SEQ ID NO: 114553 - DNA, 25 bp, Homo sapien
gaacactgaaaccaaagacaccaaa

SEQ ID NO: 114554 - DNA, 25 bp, Homo sapien
gacaccaaatctaggtgatcactga

SEQ ID NO: 114555 - DNA, 25 bp, Homo sapien
tgatcactgaagcaacgcaaccgct

SEQ ID NO: 114556 - DNA, 25 bp, Homo sapien
accaccatggtgtttgtttctagaa

SEQ ID NO: 114557 - DNA, 25 bp, Homo sapien
agaacttttgccagtccttgaagaa

SEQ ID NO: 114558 - DNA, 25 bp, Homo sapien
gaatgggttctgtgtctaatcctga

SEQ ID NO: 114559 - DNA, 25 bp, Homo sapien
ggttctgtgtctaatcctgaaacaa

SEQ ID NO: 114560 - DNA, 25 bp, Homo sapien
aagctgcttcctgtttgttgagggt

SEQ ID NO: 114561 - DNA, 25 bp, Homo sapien
cctgtttgttgagggtctgtattca

SEQ ID NO: 114562 - DNA, 25 bp, Homo sapien
agactttctgggaccttgatggagt

SEQ ID NO: 114563 - DNA, 25 bp, Homo sapien
ggccccgggctgagcactgtgaggc

SEQ ID NO: 114564 - DNA, 25 bp, Homo sapien
actgtgaggcctggatgtgaagact

SEQ ID NO: 114565 - DNA, 25 bp, Homo sapien
cagtgctgctgcttcagtggaagag

SEQ ID NO: 114566 - DNA, 25 bp, Homo sapien
gctgctgcttcagtggaagagatga

SEQ ID NO: 114567 - DNA, 25 bp, Homo sapien
gaatgaaaatccctaccttcagaga

SEQ ID NO: 114568 - DNA, 25 bp, Homo sapien
gaaaatccctaccttcagagactct

SEQ ID NO: 114569 - DNA, 25 bp, Homo sapien
aatccctaccttcagagactctagc

SEQ ID NO: 114570 - DNA, 25 bp, Homo sapien
tccccagggccacttgttgagaagt

SEQ ID NO: 114571 - DNA, 25 bp, Homo sapien
gggccacttgttgagaagtctgagc

SEQ ID NO: 114572 - DNA, 25 bp, Homo sapien
gagaagtctgagcactttatgtaaa

SEQ ID NO: 114573 - DNA, 25 bp, Homo sapien
tgcctgtgtgcgagtctgagtcaga

SEQ ID NO: 114574 - DNA, 25 bp, Homo sapien
agatttggagatgtctctgtgtgtt

SEQ ID NO: 114575 - DNA, 25 bp, Homo sapien
tgtatctgtgggtctccatcctcca

SEQ ID NO: 114576 - DNA, 25 bp, Homo sapien
gggctcagccaggtgctgtgacacc

SEQ ID NO: 114577 - DNA, 25 bp, Homo sapien
cttctgaatgaagccttctgacctg

SEQ ID NO: 114578 - DNA, 25 bp, Homo sapien
ggtgaggacacattgccccatgaga

SEQ ID NO: 114579 - DNA, 25 bp, Homo sapien
attgccccatgagacagtcccagaa

SEQ ID NO: 114580 - DNA, 25 bp, Homo sapien
agtcccagaacacggcagctgctgg

SEQ ID NO: 114581 - DNA, 25 bp, Homo sapien
agctgctggctgtgacaatggtttc

SEQ ID NO: 114582 - DNA, 25 bp, Homo sapien
ggtttcaccatccttagaccaaggg

SEQ ID NO: 114583 - DNA, 25 bp, Homo sapien
agaccaagggatgggacctgatgac

SEQ ID NO: 114584 - DNA, 25 bp, Homo sapien
ttggaaatcctctaggaggctcctc

SEQ ID NO: 114585 - DNA, 25 bp, Homo sapien
aggaggctcctcctcgcatggcctg

SEQ ID NO: 114586 - DNA, 25 bp, Homo sapien
gcagcagccccgagttgtttcctcg

SEQ ID NO: 114587 - DNA, 25 bp, Homo sapien
gagttgtttcctcgctgatcgattt

SEQ ID NO: 114588 - DNA, 25 bp, Homo sapien
tgatcgatttctttcctccaggtag

SEQ ID NO: 114589 - DNA, 25 bp, Homo sapien
gatttctttcctccaggtagagttt

SEQ ID NO: 114590 - DNA, 25 bp, Homo sapien
ctccaggtagagttttctttgctta

SEQ ID NO: 114591 - DNA, 25 bp, Homo sapien
gtagagttttctttgcttatgttga

SEQ ID NO: 114592 - DNA, 25 bp, Homo sapien
ttgcttatgttgaattccattgcct

SEQ ID NO: 114593 - DNA, 25 bp, Homo sapien
acagaagtgatgttggaatcgtttc

SEQ ID NO: 114594 - DNA, 25 bp, Homo sapien
ggaatcgtttcttttgtttgtctga

SEQ ID NO: 114595 - DNA, 25 bp, Homo sapien
attggtatagtatctacagagtgta

SEQ ID NO: 114596 - DNA, 25 bp, Homo sapien
aaactaaccacaaagctttacatct

SEQ ID NO: 114597 - DNA, 25 bp, Homo sapien
aagctttacatcttcattttgactg

SEQ ID NO: 114598 - DNA, 25 bp, Homo sapien
acatcttcattttgactgttccata

SEQ ID NO: 114599 - DNA, 25 bp, Homo sapien
tcttcattttgactgttccatagca

SEQ ID NO: 114600 - DNA, 25 bp, Homo sapien
cattttgactgttccatagcagaat

SEQ ID NO: 114601 - DNA, 25 bp, Homo sapien
ccatagcagaataaagcacttgaaa

SEQ ID NO: 114602 - DNA, 25 bp, Homo sapien
cacttgaaaggaaacaagactccct

SEQ ID NO: 114603 - DNA, 25 bp, Homo sapien
ccctttcacacatggattattataa

SEQ ID NO: 114604 - DNA, 25 bp, Homo sapien
attataagtttcaatcctggtatct

SEQ ID NO: 114605 - DNA, 25 bp, Homo sapien
atctgtgcttgatttttatcagttt

SEQ ID NO: 114606 - DNA, 25 bp, Homo sapien
ctgggaccttgatggagtggggaac

SEQ ID NO: 114607 - DNA, 25 bp, Homo sapien
gaacaagcagtagagtgggactggg

SEQ ID NO: 114608 - DNA, 25 bp, Homo sapien
ccagcgaagctcattcccttacccc

SEQ ID NO: 114609 - DNA, 25 bp, Homo sapien
tgctgcttcagtggaagagatgaag

SEQ ID NO: 114610 - DNA, 25 bp, Homo sapien
gaatgaaaatccctaccttcagaga

SEQ ID NO: 114611 - DNA, 25 bp, Homo sapien
aatgaaaatccctaccttcagagac

SEQ ID NO: 114612 - DNA, 25 bp, Homo sapien
atgaaaatccctaccttcagagact

SEQ ID NO: 114613 - DNA, 25 bp, Homo sapien
tgaaaatccctaccttcagagactc

SEQ ID NO: 114614 - DNA, 25 bp, Homo sapien
gaaaatccctaccttcagagactct

SEQ ID NO: 114615 - DNA, 25 bp, Homo sapien
taccttcagagactctagcccagcc

SEQ ID NO: 114616 - DNA, 25 bp, Homo sapien
tagcccagcccaacaccatctcttc

SEQ ID NO: 114617 - DNA, 25 bp, Homo sapien
acgtgcgaggccatgacgccagcat

SEQ ID NO: 114618 - DNA, 25 bp, Homo sapien
atgacgccagcatctacgtgtgcag

SEQ ID NO: 114619 - DNA, 25 bp, Homo sapien
cagcatctacgtgtgcagagtggag

SEQ ID NO: 114620 - DNA, 25 bp, Homo sapien
tgggccttggtgtcgggacagggaa

SEQ ID NO: 114621 - DNA, 25 bp, Homo sapien
atgggactcggctggtggtggagaa

SEQ ID NO: 114622 - DNA, 25 bp, Homo sapien
gggctggtacagtcctcctccttcg

SEQ ID NO: 114623 - DNA, 25 bp, Homo sapien
cttcgggctggattctatgctgtca

SEQ ID NO: 114624 - DNA, 25 bp, Homo sapien
gattctatgctgtcagctttctctc

SEQ ID NO: 114625 - DNA, 25 bp, Homo sapien
gctttctctctgtggccgtgggcag

SEQ ID NO: 114626 - DNA, 25 bp, Homo sapien
tggccgtgggcagcaccgtctatta

SEQ ID NO: 114627 - DNA, 25 bp, Homo sapien
agcaccgtctattaccagggcaaat

SEQ ID NO: 114628 - DNA, 25 bp, Homo sapien
gggcagctttcccatggtgctgctc

SEQ ID NO: 114629 - DNA, 25 bp, Homo sapien
tggtgctgctccaaccatcagataa

SEQ ID NO: 114630 - DNA, 25 bp, Homo sapien
atcagataaatgaccctccccaagc

SEQ ID NO: 114631 - DNA, 25 bp, Homo sapien
gcaccatgtcagtgtcgtacaatct

SEQ ID NO: 114632 - DNA, 25 bp, Homo sapien
gtcagtgtcgtacaatctaccaacc

SEQ ID NO: 114633 - DNA, 25 bp, Homo sapien
aatctaccaaccaaccagtgctgaa

SEQ ID NO: 114634 - DNA, 25 bp, Homo sapien
gagattttagaaccttgtaacatac

SEQ ID NO: 114635 - DNA, 25 bp, Homo sapien
aagagcttatatggcagcttccttt

SEQ ID NO: 114636 - DNA, 25 bp, Homo sapien
ttgctttagaagcacaagctgtaaa

SEQ ID NO: 114637 - DNA, 25 bp, Homo sapien
agctgtaaatctaaaaggcactttt

SEQ ID NO: 114638 - DNA, 25 bp, Homo sapien
aagatcatggaaggctttatgtgaa

SEQ ID NO: 114639 - DNA, 25 bp, Homo sapien
ctatgttcagaacttcatctgccac

SEQ ID NO: 114640 - DNA, 25 bp, Homo sapien
ttttttctaaggagtaacttgcaag

SEQ ID NO: 114641 - DNA, 25 bp, Homo sapien
gtaacttgcaagttttcagtacaaa

SEQ ID NO: 114642 - DNA, 25 bp, Homo sapien
agtacaaatctgtgctacactggat

SEQ ID NO: 114643 - DNA, 25 bp, Homo sapien
tctgtgctacactggataaaaatct

SEQ ID NO: 114644 - DNA, 25 bp, Homo sapien
atttatgaattttacttgcacctta

SEQ ID NO: 114645 - DNA, 25 bp, Homo sapien
ttacttgcaccttatagttcatagc

SEQ ID NO: 114646 - DNA, 25 bp, Homo sapien
gcaccttatagttcatagcaattaa

SEQ ID NO: 114647 - DNA, 25 bp, Homo sapien
aactgatttgtagtgattcattgtt

SEQ ID NO: 114648 - DNA, 25 bp, Homo sapien
ataccaatgacttccatattttaaa

SEQ ID NO: 114649 - DNA, 25 bp, Homo sapien
caactttatgttgcaggaaaccctt

SEQ ID NO: 114650 - DNA, 25 bp, Homo sapien
agcagcaggcgcagcaccaggcgca

SEQ ID NO: 114651 - DNA, 25 bp, Homo sapien
gcagcgcaggccagtctccggacct

SEQ ID NO: 114652 - DNA, 25 bp, Homo sapien
gctgcagggccaggtatccagcctg

SEQ ID NO: 114653 - DNA, 25 bp, Homo sapien
tgcagggccaggtatccagcctgtc

SEQ ID NO: 114654 - DNA, 25 bp, Homo sapien
agggccaggtatccagcctgtccca

SEQ ID NO: 114655 - DNA, 25 bp, Homo sapien
tcgggctcggactacggcaccatgt

SEQ ID NO: 114656 - DNA, 25 bp, Homo sapien
tcggactacggcaccatgtcctgct

SEQ ID NO: 114657 - DNA, 25 bp, Homo sapien
atgtcctgctccaccttgctatacg

SEQ ID NO: 114658 - DNA, 25 bp, Homo sapien
tgctccaccttgctatacggtcgga

SEQ ID NO: 114659 - DNA, 25 bp, Homo sapien
caccttgctatacggtcggacctgg

SEQ ID NO: 114660 - DNA, 25 bp, Homo sapien
cttgctatacggtcggacctggtga

SEQ ID NO: 114661 - DNA, 25 bp, Homo sapien
gagtaaactgctatcctggtatcga

SEQ ID NO: 114662 - DNA, 25 bp, Homo sapien
actgctatcctggtatcgatattag

SEQ ID NO: 114663 - DNA, 25 bp, Homo sapien
gcgtgcaaaactgaaaaggtcccat

SEQ ID NO: 114664 - DNA, 25 bp, Homo sapien
aaggtcccatagagaatcacagttt

SEQ ID NO: 114665 - DNA, 25 bp, Homo sapien
gaatcacagtttctaatggcgaaaa

SEQ ID NO: 114666 - DNA, 25 bp, Homo sapien
aatctgctggaatagatagaccaca

SEQ ID NO: 114667 - DNA, 25 bp, Homo sapien
agaccacattggatgatttaacatt

SEQ ID NO: 114668 - DNA, 25 bp, Homo sapien
ggtgtttaacttaatatctccagca

SEQ ID NO: 114669 - DNA, 25 bp, Homo sapien
aatatctccagcacttaccagggta

SEQ ID NO: 114670 - DNA, 25 bp, Homo sapien
cttaccagggtactagacacagaat

SEQ ID NO: 114671 - DNA, 25 bp, Homo sapien
atgaaaatgcgaagaggctgggcac

SEQ ID NO: 114672 - DNA, 25 bp, Homo sapien
agtgagacccatctcacaaaataat

SEQ ID NO: 114673 - DNA, 25 bp, Homo sapien
gtgagacccatctcacaaaataata

SEQ ID NO: 114674 - DNA, 25 bp, Homo sapien
tgagacccatctcacaaaataataa

SEQ ID NO: 114675 - DNA, 25 bp, Homo sapien
atctcacaaaataataataggctgg

SEQ ID NO: 114676 - DNA, 25 bp, Homo sapien
tctcacaaaataataataggctggg

SEQ ID NO: 114677 - DNA, 25 bp, Homo sapien
ctcacaaaataataataggctgggt

SEQ ID NO: 114678 - DNA, 25 bp, Homo sapien
tcacaaaataataataggctgggtg

SEQ ID NO: 114679 - DNA, 25 bp, Homo sapien
cacaaaataataataggctgggtgt

SEQ ID NO: 114680 - DNA, 25 bp, Homo sapien
acaaaataataataggctgggtgtg

SEQ ID NO: 114681 - DNA, 25 bp, Homo sapien
caaaataataataggctgggtgtgg

SEQ ID NO: 114682 - DNA, 25 bp, Homo sapien
aatcagctggggggcgtggtggtgt

SEQ ID NO: 114683 - DNA, 25 bp, Homo sapien
ggagactgggcaagactcttacgcc

SEQ ID NO: 114684 - DNA, 25 bp, Homo sapien
gccccacactgcaatttggtcttgt

SEQ ID NO: 114685 - DNA, 25 bp, Homo sapien
aatttggtcttgttgccgtatccat

SEQ ID NO: 114686 - DNA, 25 bp, Homo sapien
tgccgtatccatttatgtgggcctt

SEQ ID NO: 114687 - DNA, 25 bp, Homo sapien
ggcctttctcgagtttctgattata

SEQ ID NO: 114688 - DNA, 25 bp, Homo sapien
actggagcgatgtgttgactggact

SEQ ID NO: 114689 - DNA, 25 bp, Homo sapien
gactggactcattcagggagctctg

SEQ ID NO: 114690 - DNA, 25 bp, Homo sapien
gggagctctggttgcaatattagtt

SEQ ID NO: 114691 - DNA, 25 bp, Homo sapien
ggaggactctcatacaactctgcat

SEQ ID NO: 114692 - DNA, 25 bp, Homo sapien
caactgggaatcactatccgagcaa

SEQ ID NO: 114693 - DNA, 25 bp, Homo sapien
atccgagcaatcaccagccttgaaa

SEQ ID NO: 114694 - DNA, 25 bp, Homo sapien
gttttggttgctggcgcttgtgtat

SEQ ID NO: 114695 - DNA, 25 bp, Homo sapien
aagagcagctcctttggactattcc

SEQ ID NO: 114696 - DNA, 25 bp, Homo sapien
cagctcctttggactattcctggga

SEQ ID NO: 114697 - DNA, 25 bp, Homo sapien
cctttggactattcctgggaggact

SEQ ID NO: 114698 - DNA, 25 bp, Homo sapien
ttggactattcctgggaggactctg

SEQ ID NO: 114699 - DNA, 25 bp, Homo sapien
tgatgcagggcgtctgttgctcccc

SEQ ID NO: 114700 - DNA, 25 bp, Homo sapien
agggcgtctgttgctcccctgggtc

SEQ ID NO: 114701 - DNA, 25 bp, Homo sapien
tgctcgctgacatctggggctttga

SEQ ID NO: 114702 - DNA, 25 bp, Homo sapien
taatctacttttgctaagatgcatt

SEQ ID NO: 114703 - DNA, 25 bp, Homo sapien
atttcccttgcctcataggcttctg

SEQ ID NO: 114704 - DNA, 25 bp, Homo sapien
ttcccttgcctcataggcttctggg

SEQ ID NO: 114705 - DNA, 25 bp, Homo sapien
atgcagctccatggaattgcccagc

SEQ ID NO: 114706 - DNA, 25 bp, Homo sapien
catggaattgcccagccagtcacag

SEQ ID NO: 114707 - DNA, 25 bp, Homo sapien
cagtcacagcagtagctctggctac

SEQ ID NO: 114708 - DNA, 25 bp, Homo sapien
tactgcctctctgcaaacggaaaag

SEQ ID NO: 114709 - DNA, 25 bp, Homo sapien
aaaggataattgagccccaggacat

SEQ ID NO: 114710 - DNA, 25 bp, Homo sapien
attgagccccaggacattctgagac

SEQ ID NO: 114711 - DNA, 25 bp, Homo sapien
gcaagtatagctcttacctttatta

SEQ ID NO: 114712 - DNA, 25 bp, Homo sapien
tcttttatttctaggctgtacagtc

SEQ ID NO: 114713 - DNA, 25 bp, Homo sapien
ctgtacagtctgatgcatgattttt

SEQ ID NO: 114714 - DNA, 25 bp, Homo sapien
catactcttgtgaatttggatcttt

SEQ ID NO: 114715 - DNA, 25 bp, Homo sapien
ggatctttttactttgagcgatata

SEQ ID NO: 114716 - DNA, 25 bp, Homo sapien
ggaattagtctgtcccagctagagg

SEQ ID NO: 114717 - DNA, 25 bp, Homo sapien
ggagcagctgcttttgaggagaaaa

SEQ ID NO: 114718 - DNA, 25 bp, Homo sapien
gcagctgcttttgaggagaaaatat

SEQ ID NO: 114719 - DNA, 25 bp, Homo sapien
aaatatatagctttggacacgagga

SEQ ID NO: 114720 - DNA, 25 bp, Homo sapien
atagctttggacacgaggaagatct

SEQ ID NO: 114721 - DNA, 25 bp, Homo sapien
gctttggacacgaggaagatctaga

SEQ ID NO: 114722 - DNA, 25 bp, Homo sapien
ggacacgaggaagatctagaaaatt

SEQ ID NO: 114723 - DNA, 25 bp, Homo sapien
ctttctcatcgaagtaatgtaccct

SEQ ID NO: 114724 - DNA, 25 bp, Homo sapien
ctcatcgaagtaatgtacccttttt

SEQ ID NO: 114725 - DNA, 25 bp, Homo sapien
ttcattggtgagagcccaggccatt

SEQ ID NO: 114726 - DNA, 25 bp, Homo sapien
ttggtgagagcccaggccattaaca

SEQ ID NO: 114727 - DNA, 25 bp, Homo sapien
tttgggacccagagtagcggattct

SEQ ID NO: 114728 - DNA, 25 bp, Homo sapien
tagcggattctctggttttggatca

SEQ ID NO: 114729 - DNA, 25 bp, Homo sapien
tttggatcaggcacaggagggttca

SEQ ID NO: 114730 - DNA, 25 bp, Homo sapien
ggagggttcagctttgggtcaaata

SEQ ID NO: 114731 - DNA, 25 bp, Homo sapien
gggtcaaataactcgtctgtccagg

SEQ ID NO: 114732 - DNA, 25 bp, Homo sapien
aactcgtctgtccagggttttggtg

SEQ ID NO: 114733 - DNA, 25 bp, Homo sapien
gggcgtgtcagcaggcctttcgatc

SEQ ID NO: 114734 - DNA, 25 bp, Homo sapien
gcttcttccccgagaaatgctggag

SEQ ID NO: 114735 - DNA, 25 bp, Homo sapien
gctggagcaggctgttcagaccgac

SEQ ID NO: 114736 - DNA, 25 bp, Homo sapien
tgttcagaccgacgttgccatcaaa

SEQ ID NO: 114737 - DNA, 25 bp, Homo sapien
ttgccatcaaaacacatacacccag

SEQ ID NO: 114738 - DNA, 25 bp, Homo sapien
caggtctgcagctccaggtacatat

SEQ ID NO: 114739 - DNA, 25 bp, Homo sapien
tgcagctccaggtacatatcacgcg

SEQ ID NO: 114740 - DNA, 25 bp, Homo sapien
acatatcacgcgcacagcctggcag

SEQ ID NO: 114741 - DNA, 25 bp, Homo sapien
cagtgactgccgtcagctccgactg

SEQ ID NO: 114742 - DNA, 25 bp, Homo sapien
gtcagctccgactgccgctgagaag

SEQ ID NO: 114743 - DNA, 25 bp, Homo sapien
actgccgctgagaagggttgatcct

SEQ ID NO: 114744 - DNA, 25 bp, Homo sapien
tgagaagggttgatcctgcatctgg

SEQ ID NO: 114745 - DNA, 25 bp, Homo sapien
gcatctgggtttgtttacagcaatt

SEQ ID NO: 114746 - DNA, 25 bp, Homo sapien
tgtttacagcaattcctggactcgg

SEQ ID NO: 114747 - DNA, 25 bp, Homo sapien
tattttggtcacagggtggttttgg

SEQ ID NO: 114748 - DNA, 25 bp, Homo sapien
ttaatgacaatgaagtgacactttg

SEQ ID NO: 114749 - DNA, 25 bp, Homo sapien
gaagttggctaatctcataaatgct

SEQ ID NO: 114750 - DNA, 25 bp, Homo sapien
ggctaatctcataaatgctgaagaa

SEQ ID NO: 114751 - DNA, 25 bp, Homo sapien
gctgaagaacggagggatgtatcat

SEQ ID NO: 114752 - DNA, 25 bp, Homo sapien
gatgtatcattgaaggactgcatgc

SEQ ID NO: 114753 - DNA, 25 bp, Homo sapien
tgcatgcggcgactgttctataact

SEQ ID NO: 114754 - DNA, 25 bp, Homo sapien
gcggcgactgttctataactttgat

SEQ ID NO: 114755 - DNA, 25 bp, Homo sapien
gcgactgttctataactttgataaa

SEQ ID NO: 114756 - DNA, 25 bp, Homo sapien
taaaaattacaaggactggcagtct

SEQ ID NO: 114757 - DNA, 25 bp, Homo sapien
aaggactggcagtctgctgtagagt

SEQ ID NO: 114758 - DNA, 25 bp, Homo sapien
ggcagtctgctgtagagtgtatcgc

SEQ ID NO: 114759 - DNA, 25 bp, Homo sapien
tgctgtagagtgtatcgcagtgttg

SEQ ID NO: 114760 - DNA, 25 bp, Homo sapien
acactgatggtggaagagcgggaac

SEQ ID NO: 114761 - DNA, 25 bp, Homo sapien
aagagcgggaacgagagattcgcca

SEQ ID NO: 114762 - DNA, 25 bp, Homo sapien
agcgggaacgagagattcgccagat

SEQ ID NO: 114763 - DNA, 25 bp, Homo sapien
catttctgacctgaatgaaatattc

SEQ ID NO: 114764 - DNA, 25 bp, Homo sapien
gaatgaaatattcagggacttaggg

SEQ ID NO: 114765 - DNA, 25 bp, Homo sapien
gacttaggggcgatgattgtagaac

SEQ ID NO: 114766 - DNA, 25 bp, Homo sapien
ggcgatgattgtagaacagggtaca

SEQ ID NO: 114767 - DNA, 25 bp, Homo sapien
tccttgacagaattgactataacgt

SEQ ID NO: 114768 - DNA, 25 bp, Homo sapien
gacagaattgactataacgttgaac

SEQ ID NO: 114769 - DNA, 25 bp, Homo sapien
cagaattgactataacgttgaacag

SEQ ID NO: 114770 - DNA, 25 bp, Homo sapien
gaattgactataacgttgaacagtc

SEQ ID NO: 114771 - DNA, 25 bp, Homo sapien
gaactctccttaacaatctcaacta

SEQ ID NO: 114772 - DNA, 25 bp, Homo sapien
taacaatctcaactaccctattttt

SEQ ID NO: 114773 - DNA, 25 bp, Homo sapien
ggtgccacaggctgacaactgcagt

SEQ ID NO: 114774 - DNA, 25 bp, Homo sapien
gacaactgcagtctccagtttagaa

SEQ ID NO: 114775 - DNA, 25 bp, Homo sapien
tggtgacatgtcagctgcccactga

SEQ ID NO: 114776 - DNA, 25 bp, Homo sapien
gctgcccactgatactcctttggaa

SEQ ID NO: 114777 - DNA, 25 bp, Homo sapien
ctttggaaaatggtgcgctgtggat

SEQ ID NO: 114778 - DNA, 25 bp, Homo sapien
atggtgcgctgtggatcaagacact

SEQ ID NO: 114779 - DNA, 25 bp, Homo sapien
caagacactttggtatgatgcatat

SEQ ID NO: 114780 - DNA, 25 bp, Homo sapien
tgtgatctgagcctccatcattgtc

SEQ ID NO: 114781 - DNA, 25 bp, Homo sapien
gtcctccacaaacatattttcatat

SEQ ID NO: 114782 - DNA, 25 bp, Homo sapien
gtggactttgatgagttcctggtca

SEQ ID NO: 114783 - DNA, 25 bp, Homo sapien
ttcctggtcatgatggttcggtgca

SEQ ID NO: 114784 - DNA, 25 bp, Homo sapien
gttcggtgcatgaaggacgacagca

SEQ ID NO: 114785 - DNA, 25 bp, Homo sapien
gggaaatctgaggagctgtctgacc

SEQ ID NO: 114786 - DNA, 25 bp, Homo sapien
tgtctgacctcttccgcatgtttga

SEQ ID NO: 114787 - DNA, 25 bp, Homo sapien
aaatgctgatggctacatcgacctg

SEQ ID NO: 114788 - DNA, 25 bp, Homo sapien
aatgctgcaggctacaggcgagacc

SEQ ID NO: 114789 - DNA, 25 bp, Homo sapien
ggcgagaccatcacggaggacgaca

SEQ ID NO: 114790 - DNA, 25 bp, Homo sapien
gaggacgacatcgaggagctcatga

SEQ ID NO: 114791 - DNA, 25 bp, Homo sapien
gacggccgcatcgactatgatgagt

SEQ ID NO: 114792 - DNA, 25 bp, Homo sapien
atgatgagttcctggagttcatgaa

SEQ ID NO: 114793 - DNA, 25 bp, Homo sapien
tgggacctcgcacggcagacagcat

SEQ ID NO: 114794 - DNA, 25 bp, Homo sapien
gaagaagtggccatcctggatgaca

SEQ ID NO: 114795 - DNA, 25 bp, Homo sapien
gatgacaacttggtcaagggtcctg

SEQ ID NO: 114796 - DNA, 25 bp, Homo sapien
aagggtcctgaagaactccccactg

SEQ ID NO: 114797 - DNA, 25 bp, Homo sapien
gaagaactccccactggaaacaaga

SEQ ID NO: 114798 - DNA, 25 bp, Homo sapien
tgcccaccaatgaggatcgtctgtt

SEQ ID NO: 114799 - DNA, 25 bp, Homo sapien
atgaggatcgtctgtttttcttggg

SEQ ID NO: 114800 - DNA, 25 bp, Homo sapien
tcttggaccccctgtgttggacatg

SEQ ID NO: 114801 - DNA, 25 bp, Homo sapien
gaccagcaggagacaaacctctgag

SEQ ID NO: 114802 - DNA, 25 bp, Homo sapien
aaacctctgaggacagggccagccg

SEQ ID NO: 114803 - DNA, 25 bp, Homo sapien
ggaacctcaggatgggccaaaccca

SEQ ID NO: 114804 - DNA, 25 bp, Homo sapien
tttcatcttggcacatagccccagt

SEQ ID NO: 114805 - DNA, 25 bp, Homo sapien
tgctggccacacctatcagaaggtt

SEQ ID NO: 114806 - DNA, 25 bp, Homo sapien
tatcagaaggtttcagtgtttccct

SEQ ID NO: 114807 - DNA, 25 bp, Homo sapien
agtgtttccctgtggtttaatgtgg

SEQ ID NO: 114808 - DNA, 25 bp, Homo sapien
ggagtgtatccatgaagctgagagt

SEQ ID NO: 114809 - DNA, 25 bp, Homo sapien
atggtacaggtatgatgacaggatt

SEQ ID NO: 114810 - DNA, 25 bp, Homo sapien
caggattatctgatttgtacacaaa

SEQ ID NO: 114811 - DNA, 25 bp, Homo sapien
gattgttttcagactataattttcc

SEQ ID NO: 114812 - DNA, 25 bp, Homo sapien
gactataattttccttgagccgtaa

SEQ ID NO: 114813 - DNA, 25 bp, Homo sapien
tttccttgagccgtaaaaatgtggt

SEQ ID NO: 114814 - DNA, 25 bp, Homo sapien
aatgtggtagtgttcttaacactct

SEQ ID NO: 114815 - DNA, 25 bp, Homo sapien
tttcatcttggcacatagccccagt

SEQ ID NO: 114816 - DNA, 25 bp, Homo sapien
aaactgctggccacacctatcagaa

SEQ ID NO: 114817 - DNA, 25 bp, Homo sapien
gctggccacacctatcagaaggttt

SEQ ID NO: 114818 - DNA, 25 bp, Homo sapien
ggccacacctatcagaaggtttcag

SEQ ID NO: 114819 - DNA, 25 bp, Homo sapien
tatcagaaggtttcagtgtttccct

SEQ ID NO: 114820 - DNA, 25 bp, Homo sapien
agtgtttccctgtggtttaatgtgg

SEQ ID NO: 114821 - DNA, 25 bp, Homo sapien
ccctgtggtttaatgtggagtgtat

SEQ ID NO: 114822 - DNA, 25 bp, Homo sapien
atgtggagtgtatccatgaagctga

SEQ ID NO: 114823 - DNA, 25 bp, Homo sapien
gaagctgagagtactacagaaaaag

SEQ ID NO: 114824 - DNA, 25 bp, Homo sapien
aatcattaattttaccagatagcag

SEQ ID NO: 114825 - DNA, 25 bp, Homo sapien
ccagatagcagttttgatggtacag

SEQ ID NO: 114826 - DNA, 25 bp, Homo sapien
atactcatcagagcagctagctctt

SEQ ID NO: 114827 - DNA, 25 bp, Homo sapien
tactcatcagagcagctagctcttt

SEQ ID NO: 114828 - DNA, 25 bp, Homo sapien
actcatcagagcagctagctctttg

SEQ ID NO: 114829 - DNA, 25 bp, Homo sapien
tcatcagagcagctagctctttggt

SEQ ID NO: 114830 - DNA, 25 bp, Homo sapien
catcagagcagctagctctttggtc

SEQ ID NO: 114831 - DNA, 25 bp, Homo sapien
atcagagcagctagctctttggtct

SEQ ID NO: 114832 - DNA, 25 bp, Homo sapien
tcagagcagctagctctttggtcta

SEQ ID NO: 114833 - DNA, 25 bp, Homo sapien
cagagcagctagctctttggtctat

SEQ ID NO: 114834 - DNA, 25 bp, Homo sapien
agagcagctagctctttggtctatt

SEQ ID NO: 114835 - DNA, 25 bp, Homo sapien
gagcagctagctctttggtctattt

SEQ ID NO: 114836 - DNA, 25 bp, Homo sapien
agcagctagctctttggtctatttt

SEQ ID NO: 114837 - DNA, 25 bp, Homo sapien
ctagaggacgtcatgcatgaagatg

SEQ ID NO: 114838 - DNA, 25 bp, Homo sapien
ggacgtcatgcatgaagatgctgtg

SEQ ID NO: 114839 - DNA, 25 bp, Homo sapien
gaacacgtatgatgttgtctaccta

SEQ ID NO: 114840 - DNA, 25 bp, Homo sapien
acacgtatgatgttgtctacctaaa

SEQ ID NO: 114841 - DNA, 25 bp, Homo sapien
acgtatgatgttgtctacctaaagg

SEQ ID NO: 114842 - DNA, 25 bp, Homo sapien
tatgatgttgtctacctaaaggtgg

SEQ ID NO: 114843 - DNA, 25 bp, Homo sapien
atgatgttgtctacctaaaggtggc

SEQ ID NO: 114844 - DNA, 25 bp, Homo sapien
aagcccagcaatgcctacctgagtg

SEQ ID NO: 114845 - DNA, 25 bp, Homo sapien
ccagcaatgcctacctgagtgacag

SEQ ID NO: 114846 - DNA, 25 bp, Homo sapien
cagcaatgcctacctgagtgacagc

SEQ ID NO: 114847 - DNA, 25 bp, Homo sapien
gtgacagctatgctcccccagacat

SEQ ID NO: 114848 - DNA, 25 bp, Homo sapien
tgctggctgagggttctgctgtcct

SEQ ID NO: 114849 - DNA, 25 bp, Homo sapien
accattgccaccagcatgcgggatt

SEQ ID NO: 114850 - DNA, 25 bp, Homo sapien
agcatgcgggattccctcattgaca

SEQ ID NO: 114851 - DNA, 25 bp, Homo sapien
tgcgggattccctcattgacagcct

SEQ ID NO: 114852 - DNA, 25 bp, Homo sapien
tcattgacagcctcacctgagtcac

SEQ ID NO: 114853 - DNA, 25 bp, Homo sapien
tcacctgagtcaccttccaagttgt

SEQ ID NO: 114854 - DNA, 25 bp, Homo sapien
tgagtcaccttccaagttgttccat

SEQ ID NO: 114855 - DNA, 25 bp, Homo sapien
caccttccaagttgttccatgggct

SEQ ID NO: 114856 - DNA, 25 bp, Homo sapien
agttgttccatgggctcctggctct

SEQ ID NO: 114857 - DNA, 25 bp, Homo sapien
ttttccacctgtgcttatcgcctgg

SEQ ID NO: 114858 - DNA, 25 bp, Homo sapien
gcttatcgcctggatctatcattac

SEQ ID NO: 114859 - DNA, 25 bp, Homo sapien
acgatgccaactttgcagatgcaag

SEQ ID NO: 114860 - DNA, 25 bp, Homo sapien
cgatgccaactttgcagatgcaaga

SEQ ID NO: 114861 - DNA, 25 bp, Homo sapien
gatgccaactttgcagatgcaagaa

SEQ ID NO: 114862 - DNA, 25 bp, Homo sapien
tgcagatgcaagaatgaagacactg

SEQ ID NO: 114863 - DNA, 25 bp, Homo sapien
gcagatgcaagaatgaagacactgt

SEQ ID NO: 114864 - DNA, 25 bp, Homo sapien
cagatgcaagaatgaagacactgtg

SEQ ID NO: 114865 - DNA, 25 bp, Homo sapien
agatgcaagaatgaagacactgtgt

SEQ ID NO: 114866 - DNA, 25 bp, Homo sapien
gatgcaagaatgaagacactgtgtg

SEQ ID NO: 114867 - DNA, 25 bp, Homo sapien
aggtgtttccctcccagatgatgac

SEQ ID NO: 114868 - DNA, 25 bp, Homo sapien
ccgaatgaggtgtggcagtagctct

SEQ ID NO: 114869 - DNA, 25 bp, Homo sapien
tgtggcagtagctctgtggacccag

SEQ ID NO: 114870 - DNA, 25 bp, Homo sapien
acccagtttctgtgaataggctgag

SEQ ID NO: 114871 - DNA, 25 bp, Homo sapien
aataggctgagctttgtgaggaaca

SEQ ID NO: 114872 - DNA, 25 bp, Homo sapien
agctttgtgaggaacagatgcagga

SEQ ID NO: 114873 - DNA, 25 bp, Homo sapien
acagatgcaggaatggacttggctc

SEQ ID NO: 114874 - DNA, 25 bp, Homo sapien
gcaggaatggacttggctctgtaaa

SEQ ID NO: 114875 - DNA, 25 bp, Homo sapien
aatggacttggctctgtaaaggatg

SEQ ID NO: 114876 - DNA, 25 bp, Homo sapien
gggaacctcacttcgtggtggtcca

SEQ ID NO: 114877 - DNA, 25 bp, Homo sapien
tggtggtccactgcacaggctacat

SEQ ID NO: 114878 - DNA, 25 bp, Homo sapien
aatcggaaaaccctaccatcaccat

SEQ ID NO: 114879 - DNA, 25 bp, Homo sapien
atcactgcattactgggttccttga

SEQ ID NO: 114880 - DNA, 25 bp, Homo sapien
actgggttccttgaatagctgctgt

SEQ ID NO: 114881 - DNA, 25 bp, Homo sapien
gaatagctgctgtaatccctggata

SEQ ID NO: 114882 - DNA, 25 bp, Homo sapien
atacatgttttttagtggccatctc

SEQ ID NO: 114883 - DNA, 25 bp, Homo sapien
ggccatctccttcaagactgtgttc

SEQ ID NO: 114884 - DNA, 25 bp, Homo sapien
agactgtgttcaaagcttcccatgc

SEQ ID NO: 114885 - DNA, 25 bp, Homo sapien
acgggtatgtggaaggactcgccta

SEQ ID NO: 114886 - DNA, 25 bp, Homo sapien
aaggactcgcctaaatcttccaagt

SEQ ID NO: 114887 - DNA, 25 bp, Homo sapien
cttccaagtccatcaaattcattcc

SEQ ID NO: 114888 - DNA, 25 bp, Homo sapien
atgtccgtctggaccgaatcggaaa

SEQ ID NO: 114889 - DNA, 25 bp, Homo sapien
cagcacctttctagcgtgagctgta

SEQ ID NO: 114890 - DNA, 25 bp, Homo sapien
gtgctttatactgaacgtggttgat

SEQ ID NO: 114891 - DNA, 25 bp, Homo sapien
ggcgtaagggttatcgttaagcaca

SEQ ID NO: 114892 - DNA, 25 bp, Homo sapien
tatcgttaagcacaagacacagaat

SEQ ID NO: 114893 - DNA, 25 bp, Homo sapien
gggacggcttctcacgctttgttta

SEQ ID NO: 114894 - DNA, 25 bp, Homo sapien
tctcacgctttgtttactctcttca

SEQ ID NO: 114895 - DNA, 25 bp, Homo sapien
tttactctcttcatccgttgtgact

SEQ ID NO: 114896 - DNA, 25 bp, Homo sapien
atccgttgtgactctaggcttcagg

SEQ ID NO: 114897 - DNA, 25 bp, Homo sapien
gactctaggcttcaggttgcattgg

SEQ ID NO: 114898 - DNA, 25 bp, Homo sapien
gggttcctctgtacagcaagatgtt

SEQ ID NO: 114899 - DNA, 25 bp, Homo sapien
gccttttgttaatgcattgttgtaa

SEQ ID NO: 114900 - DNA, 25 bp, Homo sapien
aatcatcgataagaagcctctacag

SEQ ID NO: 114901 - DNA, 25 bp, Homo sapien
ataagaagcctctacagcacccctg

SEQ ID NO: 114902 - DNA, 25 bp, Homo sapien
tgccccctaatttatacagaaaccg

SEQ ID NO: 114903 - DNA, 25 bp, Homo sapien
tacagaaaccggacccactaatcct

SEQ ID NO: 114904 - DNA, 25 bp, Homo sapien
ggacccactaatcctctgggattgg

SEQ ID NO: 114905 - DNA, 25 bp, Homo sapien
atcctctgggattggccgactgtga

SEQ ID NO: 114906 - DNA, 25 bp, Homo sapien
tgcagataaggctatcagccaccaa

SEQ ID NO: 114907 - DNA, 25 bp, Homo sapien
gctatcagccaccaaagagcaatga

SEQ ID NO: 114908 - DNA, 25 bp, Homo sapien
gttgcctgggcaagaactgcttcaa

SEQ ID NO: 114909 - DNA, 25 bp, Homo sapien
aagaactgcttcaattccttaacaa

SEQ ID NO: 114910 - DNA, 25 bp, Homo sapien
attccttaacaaatgcaaccaccaa

SEQ ID NO: 114911 - DNA, 25 bp, Homo sapien
ttttctttgctttcccatcatctca

SEQ ID NO: 114912 - DNA, 25 bp, Homo sapien
gctttcccatcatctcaagtatttc

SEQ ID NO: 114913 - DNA, 25 bp, Homo sapien
gtatttccaaaagaactgctcagat

SEQ ID NO: 114914 - DNA, 25 bp, Homo sapien
gggacagtgtcagtaactatcagag

SEQ ID NO: 114915 - DNA, 25 bp, Homo sapien
actatcagaggtttgtgcttgctaa

SEQ ID NO: 114916 - DNA, 25 bp, Homo sapien
aggtttgtgcttgctaatgctccat

SEQ ID NO: 114917 - DNA, 25 bp, Homo sapien
gtgcttgctaatgctccatagagag

SEQ ID NO: 114918 - DNA, 25 bp, Homo sapien
tccatagagagtttgtgaatttccc

SEQ ID NO: 114919 - DNA, 25 bp, Homo sapien
gtgacaaactaacaagaccatcctg

SEQ ID NO: 114920 - DNA, 25 bp, Homo sapien
aagaccatcctgtccacatttgaat

SEQ ID NO: 114921 - DNA, 25 bp, Homo sapien
atcctgtccacatttgaatcagatt

SEQ ID NO: 114922 - DNA, 25 bp, Homo sapien
ttgccaatggactaggctggcggat

SEQ ID NO: 114923 - DNA, 25 bp, Homo sapien
gcaggaggaatcttggtccttatca

SEQ ID NO: 114924 - DNA, 25 bp, Homo sapien
tactttgtagtggtttatgtccggg

SEQ ID NO: 114925 - DNA, 25 bp, Homo sapien
tttatgtccgggacctagggcatgt

SEQ ID NO: 114926 - DNA, 25 bp, Homo sapien
tggcattatatgtggtggctgctgt

SEQ ID NO: 114927 - DNA, 25 bp, Homo sapien
gctgctgtggtcagcgtggcttatc

SEQ ID NO: 114928 - DNA, 25 bp, Homo sapien
ggtcagcgtggcttatctgggcttt

SEQ ID NO: 114929 - DNA, 25 bp, Homo sapien
ttatctgggctttgtgttctacttg

SEQ ID NO: 114930 - DNA, 25 bp, Homo sapien
tgttctacttgggttggcaatgttt

SEQ ID NO: 114931 - DNA, 25 bp, Homo sapien
gtttgattgcactgggcatgtcctt

SEQ ID NO: 114932 - DNA, 25 bp, Homo sapien
atgtccttcctggactgtgggcata

SEQ ID NO: 114933 - DNA, 25 bp, Homo sapien
tgccgagccgagagcattggatcct

SEQ ID NO: 114934 - DNA, 25 bp, Homo sapien
gatcctccccgactgtggctagttg

SEQ ID NO: 114935 - DNA, 25 bp, Homo sapien
actgtggctagttgtctgtccggtg

SEQ ID NO: 114936 - DNA, 25 bp, Homo sapien
gaaaaagtcggaatctctgcaatct

SEQ ID NO: 114937 - DNA, 25 bp, Homo sapien
gaatctctgcaatctgtgtcatgga

SEQ ID NO: 114938 - DNA, 25 bp, Homo sapien
gtgtcatggactgtactattgtaag

SEQ ID NO: 114939 - DNA, 25 bp, Homo sapien
gggtcccagaccctgatcaggaaat

SEQ ID NO: 114940 - DNA, 25 bp, Homo sapien
aatgagcctcatgtgtgtcgttaac

SEQ ID NO: 114941 - DNA, 25 bp, Homo sapien
atgtattcagtgtttatttcctcaa

SEQ ID NO: 114942 - DNA, 25 bp, Homo sapien
gtaggaaatctctccaagtggaaac

SEQ ID NO: 114943 - DNA, 25 bp, Homo sapien
agtggaaacgtgctaactttttctg

SEQ ID NO: 114944 - DNA, 25 bp, Homo sapien
gataagcaccagtgaagaagttcta

SEQ ID NO: 114945 - DNA, 25 bp, Homo sapien
gttctaacttttagcatgctgcaca

SEQ ID NO: 114946 - DNA, 25 bp, Homo sapien
gaaactggtataacatgccttcagt

SEQ ID NO: 114947 - DNA, 25 bp, Homo sapien
gtatactaacactccatatgctcag

SEQ ID NO: 114948 - DNA, 25 bp, Homo sapien
tagtaaaaatccctcattccagcct

SEQ ID NO: 114949 - DNA, 25 bp, Homo sapien
atataaatagctccttcctgctgtt

SEQ ID NO: 114950 - DNA, 25 bp, Homo sapien
cttcctgctgttttaatgtgggtgc

SEQ ID NO: 114951 - DNA, 25 bp, Homo sapien
taatgtgggtgcacactatagcctc

SEQ ID NO: 114952 - DNA, 25 bp, Homo sapien
actatagcctcacaacctggttaat

SEQ ID NO: 114953 - DNA, 25 bp, Homo sapien
tagcctcacaacctggttaatccag

SEQ ID NO: 114954 - DNA, 25 bp, Homo sapien
acaacctggttaatccagtgtaatc

SEQ ID NO: 114955 - DNA, 25 bp, Homo sapien
gggtgtccaggctcccatccatggc

SEQ ID NO: 114956 - DNA, 25 bp, Homo sapien
tttcccacacctttgttcctcaata

SEQ ID NO: 114957 - DNA, 25 bp, Homo sapien
ttcctcaataactgggggctggact

SEQ ID NO: 114958 - DNA, 25 bp, Homo sapien
aactgggggctggactgaagcctcc

SEQ ID NO: 114959 - DNA, 25 bp, Homo sapien
gactgaagcctcctgcaggtacctt

SEQ ID NO: 114960 - DNA, 25 bp, Homo sapien
aaacaacacctctcaacctcctatt

SEQ ID NO: 114961 - DNA, 25 bp, Homo sapien
aacctcctattgcttttcagcctgt

SEQ ID NO: 114962 - DNA, 25 bp, Homo sapien
tttcagcctgtgtgcgtgtggtgca

SEQ ID NO: 114963 - DNA, 25 bp, Homo sapien
cgtgtggtgcaggaaataaaggatc

SEQ ID NO: 114964 - DNA, 25 bp, Homo sapien
gaaataaaggatctataccctcctg

SEQ ID NO: 114965 - DNA, 25 bp, Homo sapien
taaaggatctataccctcctggaaa

SEQ ID NO: 114966 - DNA, 25 bp, Homo sapien
tgactattaatgattgataagcacc

SEQ ID NO: 114967 - DNA, 25 bp, Homo sapien
gataagcaccagtgaagaagttcta

SEQ ID NO: 114968 - DNA, 25 bp, Homo sapien
aagttctaacttttagcatgctgca

SEQ ID NO: 114969 - DNA, 25 bp, Homo sapien
gttctaacttttagcatgctgcaca

SEQ ID NO: 114970 - DNA, 25 bp, Homo sapien
ctaacttttagcatgctgcacagaa

SEQ ID NO: 114971 - DNA, 25 bp, Homo sapien
acttttagcatgctgcacagaaact

SEQ ID NO: 114972 - DNA, 25 bp, Homo sapien
gctgcacagaaactggtataacatg

SEQ ID NO: 114973 - DNA, 25 bp, Homo sapien
cagaaactggtataacatgccttca

SEQ ID NO: 114974 - DNA, 25 bp, Homo sapien
aaactggtataacatgccttcagta

SEQ ID NO: 114975 - DNA, 25 bp, Homo sapien
gctttagtaaaaatccctcattcca

SEQ ID NO: 114976 - DNA, 25 bp, Homo sapien
tagtaaaaatccctcattccagcct

SEQ ID NO: 114977 - DNA, 25 bp, Homo sapien
actaattgactttagaaagctgaca

SEQ ID NO: 114978 - DNA, 25 bp, Homo sapien
agctgacattgccaaaaaggataca

SEQ ID NO: 114979 - DNA, 25 bp, Homo sapien
aaaggatacataatgggccactgaa

SEQ ID NO: 114980 - DNA, 25 bp, Homo sapien
cataatgggccactgaaatctgtca

SEQ ID NO: 114981 - DNA, 25 bp, Homo sapien
gggccactgaaatctgtcaagagta

SEQ ID NO: 114982 - DNA, 25 bp, Homo sapien
atctgtcaagagtagttatataatt

SEQ ID NO: 114983 - DNA, 25 bp, Homo sapien
aacaggtgtttttccacaagtgccg

SEQ ID NO: 114984 - DNA, 25 bp, Homo sapien
gtgtttttccacaagtgccgcaaat

SEQ ID NO: 114985 - DNA, 25 bp, Homo sapien
acaagtgccgcaaattgtacctttt

SEQ ID NO: 114986 - DNA, 25 bp, Homo sapien
aaagttattagtggtttatcagcaa

SEQ ID NO: 114987 - DNA, 25 bp, Homo sapien
ggtttatcagcaaaaaagtccaatt

SEQ ID NO: 114988 - DNA, 25 bp, Homo sapien
attatagctctctacatcacggtaa

SEQ ID NO: 114989 - DNA, 25 bp, Homo sapien
atcacggtaatcatgcctatgccta

SEQ ID NO: 114990 - DNA, 25 bp, Homo sapien
agaatggctgagctaacaatacaca

SEQ ID NO: 114991 - DNA, 25 bp, Homo sapien
ctaacaatacacattctggaaacat

SEQ ID NO: 114992 - DNA, 25 bp, Homo sapien
ttctggaaacataacactctacatt

SEQ ID NO: 114993 - DNA, 25 bp, Homo sapien
gtttgttacctgctgaaatcaatgt

SEQ ID NO: 114994 - DNA, 25 bp, Homo sapien
gctgaaatcaatgtaactcaacttg

SEQ ID NO: 114995 - DNA, 25 bp, Homo sapien
tcaacttgacagacacttatacaga

SEQ ID NO: 114996 - DNA, 25 bp, Homo sapien
gtttaacacaactgaactctaagaa

SEQ ID NO: 114997 - DNA, 25 bp, Homo sapien
atcaaccattaatctctcattttca

SEQ ID NO: 114998 - DNA, 25 bp, Homo sapien
ctcattttcatctgcaaattgaagc

SEQ ID NO: 114999 - DNA, 25 bp, Homo sapien
ggtgctgattactatgattacggac

SEQ ID NO: 115000 - DNA, 25 bp, Homo sapien
ctatgattacggacatggactcagt

SEQ ID NO: 115001 - DNA, 25 bp, Homo sapien
tggactcagtgaggagacttatgat

SEQ ID NO: 115002 - DNA, 25 bp, Homo sapien
acttatgattcctacgggcaagaag

SEQ ID NO: 115003 - DNA, 25 bp, Homo sapien
tacgggcaagaagagtggactaact

SEQ ID NO: 115004 - DNA, 25 bp, Homo sapien
gactaactcaagacacaaggcacct

SEQ ID NO: 115005 - DNA, 25 bp, Homo sapien
aaggcaccttcagcgaggacagcaa

SEQ ID NO: 115006 - DNA, 25 bp, Homo sapien
acagagaccagccatatggcagata

SEQ ID NO: 115007 - DNA, 25 bp, Homo sapien
atggcagatactgattgtactgtct

SEQ ID NO: 115008 - DNA, 25 bp, Homo sapien
gtgaaatagccaatctccaccagtc

SEQ ID NO: 115009 - DNA, 25 bp, Homo sapien
tccaccagtcctgtatactgttcaa

SEQ ID NO: 115010 - DNA, 25 bp, Homo sapien
ttactgcagctcatatacaaccagg

SEQ ID NO: 115011 - DNA, 25 bp, Homo sapien
tactgcagctcatatacaaccagga

SEQ ID NO: 115012 - DNA, 25 bp, Homo sapien
actgcagctcatatacaaccaggag

SEQ ID NO: 115013 - DNA, 25 bp, Homo sapien
ctgcagctcatatacaaccaggagc

SEQ ID NO: 115014 - DNA, 25 bp, Homo sapien
tgcagctcatatacaaccaggagca

SEQ ID NO: 115015 - DNA, 25 bp, Homo sapien
caaccaggagcactcgagttttcgg

SEQ ID NO: 115016 - DNA, 25 bp, Homo sapien
aaccaggagcactcgagttttcggc

SEQ ID NO: 115017 - DNA, 25 bp, Homo sapien
accaggagcactcgagttttcggcg

SEQ ID NO: 115018 - DNA, 25 bp, Homo sapien
ccaggagcactcgagttttcggcgg

SEQ ID NO: 115019 - DNA, 25 bp, Homo sapien
caggagcactcgagttttcggcgga

SEQ ID NO: 115020 - DNA, 25 bp, Homo sapien
ggagcactcgagttttcggcggagg

SEQ ID NO: 115021 - DNA, 25 bp, Homo sapien
ctcttccatgttctgccctttccca

SEQ ID NO: 115022 - DNA, 25 bp, Homo sapien
tcttccatgttctgccctttcccac

SEQ ID NO: 115023 - DNA, 25 bp, Homo sapien
cttccatgttctgccctttcccaca

SEQ ID NO: 115024 - DNA, 25 bp, Homo sapien
ccatgttctgccctttcccacacct

SEQ ID NO: 115025 - DNA, 25 bp, Homo sapien
gtgtgcgtgtggtgcaggaaataaa

SEQ ID NO: 115026 - DNA, 25 bp, Homo sapien
tgtgcgtgtggtgcaggaaataaag

SEQ ID NO: 115027 - DNA, 25 bp, Homo sapien
gtgcgtgtggtgcaggaaataaagg

SEQ ID NO: 115028 - DNA, 25 bp, Homo sapien
gcaggaaataaaggatctataccct

SEQ ID NO: 115029 - DNA, 25 bp, Homo sapien
caggaaataaaggatctataccctc

SEQ ID NO: 115030 - DNA, 25 bp, Homo sapien
ggaaataaaggatctataccctcct

SEQ ID NO: 115031 - DNA, 25 bp, Homo sapien
gaaataaaggatctataccctcctg

SEQ ID NO: 115032 - DNA, 25 bp, Homo sapien
aaacagattcctgccagggagactc

SEQ ID NO: 115033 - DNA, 25 bp, Homo sapien
gtctgttccctccaaggccgcatga

SEQ ID NO: 115034 - DNA, 25 bp, Homo sapien
aggccgcatgactttgactggaatt

SEQ ID NO: 115035 - DNA, 25 bp, Homo sapien
gtggatgtgccctgaaggacaagcc

SEQ ID NO: 115036 - DNA, 25 bp, Homo sapien
gccctgaaggacaagccaggcgtct

SEQ ID NO: 115037 - DNA, 25 bp, Homo sapien
caggcgtctacacgagagtctcaca

SEQ ID NO: 115038 - DNA, 25 bp, Homo sapien
agagtctcacacttcttaccctgga

SEQ ID NO: 115039 - DNA, 25 bp, Homo sapien
acacttcttaccctggatccgcagt

SEQ ID NO: 115040 - DNA, 25 bp, Homo sapien
ggatccgcagtcacaccaaggaaga

SEQ ID NO: 115041 - DNA, 25 bp, Homo sapien
caccaaggaagagaatggcctggcc

SEQ ID NO: 115042 - DNA, 25 bp, Homo sapien
gaaacgggcaccacccgctttcttg

SEQ ID NO: 115043 - DNA, 25 bp, Homo sapien
gggatttcaattataaactgtgctt

SEQ ID NO: 115044 - DNA, 25 bp, Homo sapien
aactgtgcttatgagaacactgcgt

SEQ ID NO: 115045 - DNA, 25 bp, Homo sapien
gaacactgcgtttgactactttcca

SEQ ID NO: 115046 - DNA, 25 bp, Homo sapien
gtttgactactttccatggtaccaa

SEQ ID NO: 115047 - DNA, 25 bp, Homo sapien
catggtaccaacaattccctgggaa

SEQ ID NO: 115048 - DNA, 25 bp, Homo sapien
ggaaaggccctgcattattgatagc

SEQ ID NO: 115049 - DNA, 25 bp, Homo sapien
attattgatagccatacgtccagat

SEQ ID NO: 115050 - DNA, 25 bp, Homo sapien
gccatacgtccagatgtgagtgaaa

SEQ ID NO: 115051 - DNA, 25 bp, Homo sapien
tctccttcaataaaagtgccaagca

SEQ ID NO: 115052 - DNA, 25 bp, Homo sapien
gtgccaagcagttctcattgcatat

SEQ ID NO: 115053 - DNA, 25 bp, Homo sapien
tctcattgcatatcatggattccca

SEQ ID NO: 115054 - DNA, 25 bp, Homo sapien
cccacagcgccaagacagaggagca

SEQ ID NO: 115055 - DNA, 25 bp, Homo sapien
cacagcgccaagacagaggagcaca

SEQ ID NO: 115056 - DNA, 25 bp, Homo sapien
ctttcttcttcttcagcgagattcc

SEQ ID NO: 115057 - DNA, 25 bp, Homo sapien
tttcttcttcttcagcgagattcct

SEQ ID NO: 115058 - DNA, 25 bp, Homo sapien
tcttcttcttcagcgagattcctga

SEQ ID NO: 115059 - DNA, 25 bp, Homo sapien
ttcttcttcagcgagattcctgagc

SEQ ID NO: 115060 - DNA, 25 bp, Homo sapien
ttcttcagcgagattcctgagccgt

SEQ ID NO: 115061 - DNA, 25 bp, Homo sapien
ttcagcgagattcctgagccgttct

SEQ ID NO: 115062 - DNA, 25 bp, Homo sapien
cagcgagattcctgagccgttctat

SEQ ID NO: 115063 - DNA, 25 bp, Homo sapien
agcgagattcctgagccgttctatc

SEQ ID NO: 115064 - DNA, 25 bp, Homo sapien
gcgagattcctgagccgttctatcc

SEQ ID NO: 115065 - DNA, 25 bp, Homo sapien
cagactggcagtttcaaggatgcaa

SEQ ID NO: 115066 - DNA, 25 bp, Homo sapien
aatcaaactgactcatgaagcattt

SEQ ID NO: 115067 - DNA, 25 bp, Homo sapien
aagcatttgggccagtgcactgttt

SEQ ID NO: 115068 - DNA, 25 bp, Homo sapien
cagtgcactgtttacttccatctgt

SEQ ID NO: 115069 - DNA, 25 bp, Homo sapien
atctgtttgcagacacatttgtgcc

SEQ ID NO: 115070 - DNA, 25 bp, Homo sapien
ttgtgcccggcgtttgggagccctt

SEQ ID NO: 115071 - DNA, 25 bp, Homo sapien
gggagccctttgtatcaatgttctg

SEQ ID NO: 115072 - DNA, 25 bp, Homo sapien
caatgttctgacaagggtccctata

SEQ ID NO: 115073 - DNA, 25 bp, Homo sapien
tctgacaagggtccctataacctta

SEQ ID NO: 115074 - DNA, 25 bp, Homo sapien
tactcgaaaccggtttgggatggat

SEQ ID NO: 115075 - DNA, 25 bp, Homo sapien
gggcttctgtgctattgctgggatt

SEQ ID NO: 115076 - DNA, 25 bp, Homo sapien
gatgaactcaacacagagattctga

SEQ ID NO: 115077 - DNA, 25 bp, Homo sapien
cttagcagatcaggagttacaactc

SEQ ID NO: 115078 - DNA, 25 bp, Homo sapien
ggagttacaactcaatcatctaaag

SEQ ID NO: 115079 - DNA, 25 bp, Homo sapien
atcatctaaagaactccattaccag

SEQ ID NO: 115080 - DNA, 25 bp, Homo sapien
accagttattttggtgctgcaggta

SEQ ID NO: 115081 - DNA, 25 bp, Homo sapien
gcatgtggcgaaaaataccgagttt

SEQ ID NO: 115082 - DNA, 25 bp, Homo sapien
gagttttggcacgtcgggtgacact

SEQ ID NO: 115083 - DNA, 25 bp, Homo sapien
gcacgtcgggtgacacttgatggaa

SEQ ID NO: 115084 - DNA, 25 bp, Homo sapien
ggagcaactgcatcctgactgtagg

SEQ ID NO: 115085 - DNA, 25 bp, Homo sapien
tgaacattatgttcactgcactctg

SEQ ID NO: 115086 - DNA, 25 bp, Homo sapien
ctgtaggtacagttcaaagccctaa

SEQ ID NO: 115087 - DNA, 25 bp, Homo sapien
cagggcctggctgtttaagttcctt

SEQ ID NO: 115088 - DNA, 25 bp, Homo sapien
taaactcatgccagatcttcttgcg

SEQ ID NO: 115089 - DNA, 25 bp, Homo sapien
agatcttcttgcgtgctctatattt

SEQ ID NO: 115090 - DNA, 25 bp, Homo sapien
gcgtgctctatatttcattaagtgt

SEQ ID NO: 115091 - DNA, 25 bp, Homo sapien
gcagtaggcctgtcactattttaca

SEQ ID NO: 115092 - DNA, 25 bp, Homo sapien
ggattttcttacatatgtgatcaga

SEQ ID NO: 115093 - DNA, 25 bp, Homo sapien
tgtgatcagaaaagcctactgttat

SEQ ID NO: 115094 - DNA, 25 bp, Homo sapien
atgtagaattctggctgtatttccc

SEQ ID NO: 115095 - DNA, 25 bp, Homo sapien
gtatttcccagtattcagtagctat

SEQ ID NO: 115096 - DNA, 25 bp, Homo sapien
atggaaatcttcctgactgtgccag

SEQ ID NO: 115097 - DNA, 25 bp, Homo sapien
actgtgccagtcattaatcccatta

SEQ ID NO: 115098 - DNA, 25 bp, Homo sapien
gtgtctgaatctccctggctccatg

SEQ ID NO: 115099 - DNA, 25 bp, Homo sapien
tgaagaccagctgtgaatacgtgag

SEQ ID NO: 115100 - DNA, 25 bp, Homo sapien
gtgaatacgtgagcctctaccacca

SEQ ID NO: 115101 - DNA, 25 bp, Homo sapien
agcctgccgccatgatggaggacag

SEQ ID NO: 115102 - DNA, 25 bp, Homo sapien
aggacagtgattcagatgactacat

SEQ ID NO: 115103 - DNA, 25 bp, Homo sapien
atgactacatcaatgttcctgcctg

SEQ ID NO: 115104 - DNA, 25 bp, Homo sapien
acatcaatgttcctgcctgacaact

SEQ ID NO: 115105 - DNA, 25 bp, Homo sapien
ctcggactgtggtgccaaggagtct

SEQ ID NO: 115106 - DNA, 25 bp, Homo sapien
ggtgccaaggagtctcatctatctg

SEQ ID NO: 115107 - DNA, 25 bp, Homo sapien
tatctgctgatgtccaatacctgct

SEQ ID NO: 115108 - DNA, 25 bp, Homo sapien
tcatgtgttctcagagccctcatca

SEQ ID NO: 115109 - DNA, 25 bp, Homo sapien
aatgagtttgcatttgtgcttgaga

SEQ ID NO: 115110 - DNA, 25 bp, Homo sapien
gagaaaatttggctcaagtccattt

SEQ ID NO: 115111 - DNA, 25 bp, Homo sapien
ttggctcaagtccatttggctgtag

SEQ ID NO: 115112 - DNA, 25 bp, Homo sapien
tggctgtagtgtcaacgatgtttcc

SEQ ID NO: 115113 - DNA, 25 bp, Homo sapien
gtcaacgatgtttccagtagtgttt

SEQ ID NO: 115114 - DNA, 25 bp, Homo sapien
cagtagtgtttagatttggtgtctt

SEQ ID NO: 115115 - DNA, 25 bp, Homo sapien
aaaccaagtgtgtctttaatatctt

SEQ ID NO: 115116 - DNA, 25 bp, Homo sapien
gaataactttgtatgttaccaactt

SEQ ID NO: 115117 - DNA, 25 bp, Homo sapien
gtatgttaccaacttaaattgctag

SEQ ID NO: 115118 - DNA, 25 bp, Homo sapien
ggtaaattgatacacaactgctatt

SEQ ID NO: 115119 - DNA, 25 bp, Homo sapien
ccattttggctacttgtattcttta

SEQ ID NO: 115120 - DNA, 25 bp, Homo sapien
aagccaccaagaccctagggatcat

SEQ ID NO: 115121 - DNA, 25 bp, Homo sapien
gatcattttgggagcctttattgtg

SEQ ID NO: 115122 - DNA, 25 bp, Homo sapien
cctttattgtgtgttggctaccctt

SEQ ID NO: 115123 - DNA, 25 bp, Homo sapien
atcatctccctagtgatgcctatct

SEQ ID NO: 115124 - DNA, 25 bp, Homo sapien
atctgcaaagatgcctgctggttcc

SEQ ID NO: 115125 - DNA, 25 bp, Homo sapien
cacctagccatctttgacttcttca

SEQ ID NO: 115126 - DNA, 25 bp, Homo sapien
tcaaccccataatctataccatgtc

SEQ ID NO: 115127 - DNA, 25 bp, Homo sapien
aactgatacgttttaagtgcacaag

SEQ ID NO: 115128 - DNA, 25 bp, Homo sapien
caaagtgcgagtctccgacgccctg

SEQ ID NO: 115129 - DNA, 25 bp, Homo sapien
agaagaaactcatggccgctaggga

SEQ ID NO: 115130 - DNA, 25 bp, Homo sapien
tagggagcgcaaagccaccaagacc

SEQ ID NO: 115131 - DNA, 25 bp, Homo sapien
agatatttcaccaagaattgcagag

SEQ ID NO: 115132 - DNA, 25 bp, Homo sapien
tgaattttatgatgccaccgtggag

SEQ ID NO: 115133 - DNA, 25 bp, Homo sapien
agaaagggtctagaatgctgatctc

SEQ ID NO: 115134 - DNA, 25 bp, Homo sapien
agctggagacctaggcagtctgcaa

SEQ ID NO: 115135 - DNA, 25 bp, Homo sapien
ggagtcagctggaagctatggctat

SEQ ID NO: 115136 - DNA, 25 bp, Homo sapien
atggctatgtattatgtgacatcgc

SEQ ID NO: 115137 - DNA, 25 bp, Homo sapien
gtgacatcgcttgttcctaagtgaa

SEQ ID NO: 115138 - DNA, 25 bp, Homo sapien
tggatatcccaaccttctggaccag

SEQ ID NO: 115139 - DNA, 25 bp, Homo sapien
ccttctggaccagtaggtttcatgg

SEQ ID NO: 115140 - DNA, 25 bp, Homo sapien
ggtttcatggttacgacctggtagt

SEQ ID NO: 115141 - DNA, 25 bp, Homo sapien
tacgacctggtagtgagaacatttt

SEQ ID NO: 115142 - DNA, 25 bp, Homo sapien
atctggaatccatcaaaaccttgct

SEQ ID NO: 115143 - DNA, 25 bp, Homo sapien
aaaccttgctaataataatcaacat

SEQ ID NO: 115144 - DNA, 25 bp, Homo sapien
atataaaaatatcgtgttccagcac

SEQ ID NO: 115145 - DNA, 25 bp, Homo sapien
aaaaatatcgtgttccagcactttg

SEQ ID NO: 115146 - DNA, 25 bp, Homo sapien
aaaatatcgtgttccagcactttgg

SEQ ID NO: 115147 - DNA, 25 bp, Homo sapien
gaccatgctgggaaccctgtctcta

SEQ ID NO: 115148 - DNA, 25 bp, Homo sapien
gaaaaattttttgtcattagccaag

SEQ ID NO: 115149 - DNA, 25 bp, Homo sapien
attttttgtcattagccaagttcag

SEQ ID NO: 115150 - DNA, 25 bp, Homo sapien
tttttgtcattagccaagttcagtg

SEQ ID NO: 115151 - DNA, 25 bp, Homo sapien
tttgtcattagccaagttcagtggc

SEQ ID NO: 115152 - DNA, 25 bp, Homo sapien
tgtcattagccaagttcagtggcat

SEQ ID NO: 115153 - DNA, 25 bp, Homo sapien
ctgtaggcttctgtctcatggtaat

SEQ ID NO: 115154 - DNA, 25 bp, Homo sapien
tcatggtaattactgggcctggcct

SEQ ID NO: 115155 - DNA, 25 bp, Homo sapien
ctggcctctgtaagcctgtgtatgt

SEQ ID NO: 115156 - DNA, 25 bp, Homo sapien
gttatcaatactgtttcttcctgtg

SEQ ID NO: 115157 - DNA, 25 bp, Homo sapien
gtttcttcctgtgagttccattatt

SEQ ID NO: 115158 - DNA, 25 bp, Homo sapien
attatttctatctcttatgggcaaa

SEQ ID NO: 115159 - DNA, 25 bp, Homo sapien
cattgtgggtaattggtgctggcta

SEQ ID NO: 115160 - DNA, 25 bp, Homo sapien
gctggctaacattgcatggtcggat

SEQ ID NO: 115161 - DNA, 25 bp, Homo sapien
gatagagaagtccagctgtgagtct

SEQ ID NO: 115162 - DNA, 25 bp, Homo sapien
cacagtggagccttcggctggaagt

SEQ ID NO: 115163 - DNA, 25 bp, Homo sapien
ggctggaagtccatgggccaccctg

SEQ ID NO: 115164 - DNA, 25 bp, Homo sapien
ggcttgggccagagctcaacagcta

SEQ ID NO: 115165 - DNA, 25 bp, Homo sapien
gagctcaacagctactcaactggag

SEQ ID NO: 115166 - DNA, 25 bp, Homo sapien
acagacaggaagatggtaggtttat

SEQ ID NO: 115167 - DNA, 25 bp, Homo sapien
gtaggtttatgccttctgtggccag

SEQ ID NO: 115168 - DNA, 25 bp, Homo sapien
agagtcttggactcatggaaataga

SEQ ID NO: 115169 - DNA, 25 bp, Homo sapien
gcattcacaaggcacaccagtgcaa

SEQ ID NO: 115170 - DNA, 25 bp, Homo sapien
ggcacaccagtgcaagcagatgaca

SEQ ID NO: 115171 - DNA, 25 bp, Homo sapien
ggtgcagaaggcaatcttaaaacag

SEQ ID NO: 115172 - DNA, 25 bp, Homo sapien
gtgcaggaggtaccttaactcaccc

SEQ ID NO: 115173 - DNA, 25 bp, Homo sapien
acccctcagcaaatacctatgtcaa

SEQ ID NO: 115174 - DNA, 25 bp, Homo sapien
gtataagttaccatttactctataa

SEQ ID NO: 115175 - DNA, 25 bp, Homo sapien
ataatgataaccagaacttgctgga

SEQ ID NO: 115176 - DNA, 25 bp, Homo sapien
gaacttgctggaaatgtgcctacaa

SEQ ID NO: 115177 - DNA, 25 bp, Homo sapien
ttgctggaaatgtgcctacaatggc

SEQ ID NO: 115178 - DNA, 25 bp, Homo sapien
gaaatgtgcctacaatggccttgta

SEQ ID NO: 115179 - DNA, 25 bp, Homo sapien
atgtgcctacaatggccttgtaaca

SEQ ID NO: 115180 - DNA, 25 bp, Homo sapien
gcctacaatggccttgtaacagcca

SEQ ID NO: 115181 - DNA, 25 bp, Homo sapien
ggccttgtaacagccattgttccca

SEQ ID NO: 115182 - DNA, 25 bp, Homo sapien
attgttcccaacagcatcacttagg

SEQ ID NO: 115183 - DNA, 25 bp, Homo sapien
ttgttcccaacagcatcacttaggg

SEQ ID NO: 115184 - DNA, 25 bp, Homo sapien
gaagtatttttgaacctgttgtctg

SEQ ID NO: 115185 - DNA, 25 bp, Homo sapien
tgaacctgttgtctggttttgaaaa

SEQ ID NO: 115186 - DNA, 25 bp, Homo sapien
gaatataagccatctcctgtcaata

SEQ ID NO: 115187 - DNA, 25 bp, Homo sapien
ctcctgtcaatactctcactagaag

SEQ ID NO: 115188 - DNA, 25 bp, Homo sapien
gagaagtttacctgtaggctataaa

SEQ ID NO: 115189 - DNA, 25 bp, Homo sapien
tataaaggagcaacagcaaagttct

SEQ ID NO: 115190 - DNA, 25 bp, Homo sapien
gcaaaacgtttaatcacaaagaggg

SEQ ID NO: 115191 - DNA, 25 bp, Homo sapien
agagacaaagctttgcctgccactt

SEQ ID NO: 115192 - DNA, 25 bp, Homo sapien
gcctttagtgatactgttagcctga

SEQ ID NO: 115193 - DNA, 25 bp, Homo sapien
gatactgttagcctgattctactgt

SEQ ID NO: 115194 - DNA, 25 bp, Homo sapien
gttagcctgattctactgtacaatg

SEQ ID NO: 115195 - DNA, 25 bp, Homo sapien
gtagaaacatccttgttacttgcat

SEQ ID NO: 115196 - DNA, 25 bp, Homo sapien
ttgttacttgcatgtctaacccctt

SEQ ID NO: 115197 - DNA, 25 bp, Homo sapien
gttctatccctgtaagtgcgcagac

SEQ ID NO: 115198 - DNA, 25 bp, Homo sapien
taagtgcgcagacaccacctcctgg

SEQ ID NO: 115199 - DNA, 25 bp, Homo sapien
tggtcctcagaaccctgaatgcaac

SEQ ID NO: 115200 - DNA, 25 bp, Homo sapien
gaaccctgaatgcaacttctgtgcc

SEQ ID NO: 115201 - DNA, 25 bp, Homo sapien
cctgaatgcaacttctgtgccttgc

SEQ ID NO: 115202 - DNA, 25 bp, Homo sapien
aaatttaatagtgccaaggaagcct

SEQ ID NO: 115203 - DNA, 25 bp, Homo sapien
tgagcgatgccttccctctgtgctg

SEQ ID NO: 115204 - DNA, 25 bp, Homo sapien
tccctctgtgctgtgaaactgtcta

SEQ ID NO: 115205 - DNA, 25 bp, Homo sapien
gaaactgtctatgcactacattctg

SEQ ID NO: 115206 - DNA, 25 bp, Homo sapien
tatgcactacattctgctagctcct

SEQ ID NO: 115207 - DNA, 25 bp, Homo sapien
ctagctcctcttcaagtaaacgcca

SEQ ID NO: 115208 - DNA, 25 bp, Homo sapien
gctgggtataccattatttcaagta

SEQ ID NO: 115209 - DNA, 25 bp, Homo sapien
gacgtgtatgatatataagctgaac

SEQ ID NO: 115210 - DNA, 25 bp, Homo sapien
gaacacattttctatagcccttaat

SEQ ID NO: 115211 - DNA, 25 bp, Homo sapien
tatagcccttaatttagttgtgtta

SEQ ID NO: 115212 - DNA, 25 bp, Homo sapien
caaggtgatgtatcaacagcttttt

SEQ ID NO: 115213 - DNA, 25 bp, Homo sapien
attgtatgaattgagctttttgccc

SEQ ID NO: 115214 - DNA, 25 bp, Homo sapien
gaattgagctttttgcccacagatt

SEQ ID NO: 115215 - DNA, 25 bp, Homo sapien
agctttttgcccacagattcttgat

SEQ ID NO: 115216 - DNA, 25 bp, Homo sapien
ttttgcccacagattcttgatttgt

SEQ ID NO: 115217 - DNA, 25 bp, Homo sapien
cttgatttgtagttgtttggcagga

SEQ ID NO: 115218 - DNA, 25 bp, Homo sapien
gtttggcaggatttttctttgtgat

SEQ ID NO: 115219 - DNA, 25 bp, Homo sapien
aaactgtttcagagcttcttcccta

SEQ ID NO: 115220 - DNA, 25 bp, Homo sapien
agagcttcttccctaagccataaac

SEQ ID NO: 115221 - DNA, 25 bp, Homo sapien
ctaagccataaactgtctcacctaa

SEQ ID NO: 115222 - DNA, 25 bp, Homo sapien
aactgtctcacctaaacaagataga

SEQ ID NO: 115223 - DNA, 25 bp, Homo sapien
atttctccacctggcagaaaagtaa

SEQ ID NO: 115224 - DNA, 25 bp, Homo sapien
agaaaagtaactgccaagtaagatt

SEQ ID NO: 115225 - DNA, 25 bp, Homo sapien
catttctggagtatatttctcataa

SEQ ID NO: 115226 - DNA, 25 bp, Homo sapien
ctcataattctgcagagacttccag

SEQ ID NO: 115227 - DNA, 25 bp, Homo sapien
gagacttccagtttattgcatatat

SEQ ID NO: 115228 - DNA, 25 bp, Homo sapien
gtatatattatgcagtttctctaag

SEQ ID NO: 115229 - DNA, 25 bp, Homo sapien
atgcagtttctctaagtggaaaaac

SEQ ID NO: 115230 - DNA, 25 bp, Homo sapien
tggagaggtaagttttccctaggag

SEQ ID NO: 115231 - DNA, 25 bp, Homo sapien
ttccctaggagattctatcttctta

SEQ ID NO: 115232 - DNA, 25 bp, Homo sapien
atcttcttaaaactgatgttctgca

SEQ ID NO: 115233 - DNA, 25 bp, Homo sapien
gtttctcagttggacctatataaca

SEQ ID NO: 115234 - DNA, 25 bp, Homo sapien
atataacatagcagtgtcttttctc

SEQ ID NO: 115235 - DNA, 25 bp, Homo sapien
gtgtcttttctctggatgccacgag

SEQ ID NO: 115236 - DNA, 25 bp, Homo sapien
ggatgccacgagtaccaagttttta

SEQ ID NO: 115237 - DNA, 25 bp, Homo sapien
accaagtttttagaagtagagccat

SEQ ID NO: 115238 - DNA, 25 bp, Homo sapien
agagccatccgtctatatagcaaga

SEQ ID NO: 115239 - DNA, 25 bp, Homo sapien
cagaggaaagaaaccaattgccctt

SEQ ID NO: 115240 - DNA, 25 bp, Homo sapien
ataaaggaggctactctggtaaggg

SEQ ID NO: 115241 - DNA, 25 bp, Homo sapien
acctggtttgttgaggatatcaatc

SEQ ID NO: 115242 - DNA, 25 bp, Homo sapien
tcaatcgagtacaagcagaggactt

SEQ ID NO: 115243 - DNA, 25 bp, Homo sapien
ggacttgctttatgggaaacctgat

SEQ ID NO: 115244 - DNA, 25 bp, Homo sapien
ctgatggtgcattcttaattcgtga

SEQ ID NO: 115245 - DNA, 25 bp, Homo sapien
gaaaggatgctatgcttgctctgtg

SEQ ID NO: 115246 - DNA, 25 bp, Homo sapien
tatgcttgctctgtggtggccgatg

SEQ ID NO: 115247 - DNA, 25 bp, Homo sapien
gaagcactgtgtgatctacagcact

SEQ ID NO: 115248 - DNA, 25 bp, Homo sapien
tatggctttgcagagccctacaacc

SEQ ID NO: 115249 - DNA, 25 bp, Homo sapien
gagctagtgctccattaccagcaga

SEQ ID NO: 115250 - DNA, 25 bp, Homo sapien
agcagacatccttggttcagcacaa

SEQ ID NO: 115251 - DNA, 25 bp, Homo sapien
aacgactccctcaacgtcaggcttg

SEQ ID NO: 115252 - DNA, 25 bp, Homo sapien
cgccctgccaatcccgatgaaattg

SEQ ID NO: 115253 - DNA, 25 bp, Homo sapien
gatgaaaatctgaaagcggctgata

SEQ ID NO: 115254 - DNA, 25 bp, Homo sapien
gaaagcggctgatactgaccccaca

SEQ ID NO: 115255 - DNA, 25 bp, Homo sapien
gccttatgattctctgctcgtgttt

SEQ ID NO: 115256 - DNA, 25 bp, Homo sapien
attctctgctcgtgtttgactatga

SEQ ID NO: 115257 - DNA, 25 bp, Homo sapien
tgactatgaaggaagcggttccgaa

SEQ ID NO: 115258 - DNA, 25 bp, Homo sapien
agcggttccgaagctgctagtctga

SEQ ID NO: 115259 - DNA, 25 bp, Homo sapien
gaagctgctagtctgagctccctga

SEQ ID NO: 115260 - DNA, 25 bp, Homo sapien
gagtcagacaaagaccaggactatg

SEQ ID NO: 115261 - DNA, 25 bp, Homo sapien
caggactatgactacttgaacgaat

SEQ ID NO: 115262 - DNA, 25 bp, Homo sapien
gctggctgacatgtacggaggcggc

SEQ ID NO: 115263 - DNA, 25 bp, Homo sapien
gactcatcataaatgtggtgctgct

SEQ ID NO: 115264 - DNA, 25 bp, Homo sapien
ggtgctgctattcgacaaaccagtt

SEQ ID NO: 115265 - DNA, 25 bp, Homo sapien
gacaaaccagttttagcagggatag

SEQ ID NO: 115266 - DNA, 25 bp, Homo sapien
gcagggatagcagcattcttatagc

SEQ ID NO: 115267 - DNA, 25 bp, Homo sapien
cttatagctgtttgtgatgatgcca

SEQ ID NO: 115268 - DNA, 25 bp, Homo sapien
atgatgccagtatttggcgctggga

SEQ ID NO: 115269 - DNA, 25 bp, Homo sapien
ttggcgctgggatcgacttcgataa

SEQ ID NO: 115270 - DNA, 25 bp, Homo sapien
agagtgtgtttgttgtctgtgtaaa

SEQ ID NO: 115271 - DNA, 25 bp, Homo sapien
taagggcacgtagagcatttagagt

SEQ ID NO: 115272 - DNA, 25 bp, Homo sapien
gcatttagagttgtctttcagcatt

SEQ ID NO: 115273 - DNA, 25 bp, Homo sapien
cagcattcaatcaggctgagctgaa

SEQ ID NO: 115274 - DNA, 25 bp, Homo sapien
agcacggtccctcttggaattggat

SEQ ID NO: 115275 - DNA, 25 bp, Homo sapien
gtccctcttggaattggattcgcca

SEQ ID NO: 115276 - DNA, 25 bp, Homo sapien
tttcttgctgctaaatcaccgagcc

SEQ ID NO: 115277 - DNA, 25 bp, Homo sapien
gctaaatcaccgagcccggaagatt

SEQ ID NO: 115278 - DNA, 25 bp, Homo sapien
ccgagcccggaagattagagagttt

SEQ ID NO: 115279 - DNA, 25 bp, Homo sapien
atttctgggattcctgtagacacac

SEQ ID NO: 115280 - DNA, 25 bp, Homo sapien
gatcgatacagaaaccacgctgccg

SEQ ID NO: 115281 - DNA, 25 bp, Homo sapien
acaccatcaccatcgacagaacagt

SEQ ID NO: 115282 - DNA, 25 bp, Homo sapien
gacagaacagtccttaatccagaaa

SEQ ID NO: 115283 - DNA, 25 bp, Homo sapien
agaggagactctgcgcagagcactt

SEQ ID NO: 115284 - DNA, 25 bp, Homo sapien
tctgcgcagagcactttgggtccgg

SEQ ID NO: 115285 - DNA, 25 bp, Homo sapien
gcagaggtgttttagatgggtcctc

SEQ ID NO: 115286 - DNA, 25 bp, Homo sapien
gagacacctccatggggtgacattt

SEQ ID NO: 115287 - DNA, 25 bp, Homo sapien
gggaactgaaccagccctgctagga

SEQ ID NO: 115288 - DNA, 25 bp, Homo sapien
actgaaccagccctgctaggactgg

SEQ ID NO: 115289 - DNA, 25 bp, Homo sapien
aaccagccctgctaggactggcatg

SEQ ID NO: 115290 - DNA, 25 bp, Homo sapien
ggagctcggccagtgcagaggcctg

SEQ ID NO: 115291 - DNA, 25 bp, Homo sapien
agtggtgacgtatgcctggagtcca

SEQ ID NO: 115292 - DNA, 25 bp, Homo sapien
gtgacgtatgcctggagtccaccta

SEQ ID NO: 115293 - DNA, 25 bp, Homo sapien
tgacgtatgcctggagtccacctac

SEQ ID NO: 115294 - DNA, 25 bp, Homo sapien
gtatgcctggagtccacctacctgg

SEQ ID NO: 115295 - DNA, 25 bp, Homo sapien
tgcctggagtccacctacctgggag

SEQ ID NO: 115296 - DNA, 25 bp, Homo sapien
gaccaccaaggagtatatgcagtgt

SEQ ID NO: 115297 - DNA, 25 bp, Homo sapien
tatgcagtgtgtgaccgctgtggac

SEQ ID NO: 115298 - DNA, 25 bp, Homo sapien
ggagctgggccccatgttctatagc

SEQ ID NO: 115299 - DNA, 25 bp, Homo sapien
gggccccatgttctatagcgtgaaa

SEQ ID NO: 115300 - DNA, 25 bp, Homo sapien
atagcgtgaaacaggcgggcaagtc

SEQ ID NO: 115301 - DNA, 25 bp, Homo sapien
aagtcacggcaggagaaccgtcgtc

SEQ ID NO: 115302 - DNA, 25 bp, Homo sapien
gcaggagaaccgtcgtcgggccaaa

SEQ ID NO: 115303 - DNA, 25 bp, Homo sapien
aagaggaagcctctgccatggagga

SEQ ID NO: 115304 - DNA, 25 bp, Homo sapien
tgggcagtgtcaggtctacgaagat

SEQ ID NO: 115305 - DNA, 25 bp, Homo sapien
ggtctacgaagatctacactccagg

SEQ ID NO: 115306 - DNA, 25 bp, Homo sapien
tacactccaggccggaaagagcaag

SEQ ID NO: 115307 - DNA, 25 bp, Homo sapien
catggattatttgttacttgtctaa

SEQ ID NO: 115308 - DNA, 25 bp, Homo sapien
gttacttgtctaagatgcaatttga

SEQ ID NO: 115309 - DNA, 25 bp, Homo sapien
ataccctttacccaccagagacagt

SEQ ID NO: 115310 - DNA, 25 bp, Homo sapien
ttacccaccagagacagtacagaat

SEQ ID NO: 115311 - DNA, 25 bp, Homo sapien
accagagacagtacagaatccctgc

SEQ ID NO: 115312 - DNA, 25 bp, Homo sapien
agtacagaatccctgccctaaaatc

SEQ ID NO: 115313 - DNA, 25 bp, Homo sapien
ctgccctaaaatcccaggcttaatt

SEQ ID NO: 115314 - DNA, 25 bp, Homo sapien
atcccaggcttaattgccctacaaa

SEQ ID NO: 115315 - DNA, 25 bp, Homo sapien
ccaggcttaattgccctacaaaggg

SEQ ID NO: 115316 - DNA, 25 bp, Homo sapien
gcttaattgccctacaaagggttat

SEQ ID NO: 115317 - DNA, 25 bp, Homo sapien
aaaactccattattaggattacatt

SEQ ID NO: 115318 - DNA, 25 bp, Homo sapien
tttctaacgtgtatgtttctggtgg

SEQ ID NO: 115319 - DNA, 25 bp, Homo sapien
ctaacgtgtatgtttctggtggaaa

SEQ ID NO: 115320 - DNA, 25 bp, Homo sapien
ggtggaaaccaagttcaccctggct

SEQ ID NO: 115321 - DNA, 25 bp, Homo sapien
gctgggagcatctctgatgaggcat

SEQ ID NO: 115322 - DNA, 25 bp, Homo sapien
tctctgatgaggcatgctggcgact

SEQ ID NO: 115323 - DNA, 25 bp, Homo sapien
tggccaagccgggaaagcctctaac

SEQ ID NO: 115324 - DNA, 25 bp, Homo sapien
gggaaagcctctaacttgcctttgc

SEQ ID NO: 115325 - DNA, 25 bp, Homo sapien
agcctctaacttgcctttgctgctg

SEQ ID NO: 115326 - DNA, 25 bp, Homo sapien
tctctgcctttccatttgttagatg

SEQ ID NO: 115327 - DNA, 25 bp, Homo sapien
ctgtctctgagttactgggtggaaa

SEQ ID NO: 115328 - DNA, 25 bp, Homo sapien
gttactgggtggaaataagcttata

SEQ ID NO: 115329 - DNA, 25 bp, Homo sapien
ggaaagctttgtttgcttcctacaa

SEQ ID NO: 115330 - DNA, 25 bp, Homo sapien
gtttgcttcctacaaatacatgctt

SEQ ID NO: 115331 - DNA, 25 bp, Homo sapien
atgcttattccttaagggatgtgtt

SEQ ID NO: 115332 - DNA, 25 bp, Homo sapien
acaagaaacttgtctatgtacctta

SEQ ID NO: 115333 - DNA, 25 bp, Homo sapien
gagtctttgtgtccctgtacagtag

SEQ ID NO: 115334 - DNA, 25 bp, Homo sapien
acagtagtctgacgtatttcccctt

SEQ ID NO: 115335 - DNA, 25 bp, Homo sapien
tagtctgacgtatttccccttctgt

SEQ ID NO: 115336 - DNA, 25 bp, Homo sapien
ttctgtcccctagtaagcccagttg

SEQ ID NO: 115337 - DNA, 25 bp, Homo sapien
gtaagcccagttgctgtatctgaac

SEQ ID NO: 115338 - DNA, 25 bp, Homo sapien
ttgtaatatactctaaacctgttat

SEQ ID NO: 115339 - DNA, 25 bp, Homo sapien
taataaacgagatgcagaacccttg

SEQ ID NO: 115340 - DNA, 25 bp, Homo sapien
gaaaaaccctctaaaccatggcact

SEQ ID NO: 115341 - DNA, 25 bp, Homo sapien
accctctaaaccatggcacttgatg

SEQ ID NO: 115342 - DNA, 25 bp, Homo sapien
ccatggcacttgatgtgatgtggca

SEQ ID NO: 115343 - DNA, 25 bp, Homo sapien
gctgcagtcacgtgtaaacaggatt

SEQ ID NO: 115344 - DNA, 25 bp, Homo sapien
aatggactatgcacacttttaattt

SEQ ID NO: 115345 - DNA, 25 bp, Homo sapien
ctatgcacacttttaattttgtcag

SEQ ID NO: 115346 - DNA, 25 bp, Homo sapien
taattttgtcagattcacacatgcc

SEQ ID NO: 115347 - DNA, 25 bp, Homo sapien
ttcacacatgccactatgagctttc

SEQ ID NO: 115348 - DNA, 25 bp, Homo sapien
atgccactatgagctttcagactcc

SEQ ID NO: 115349 - DNA, 25 bp, Homo sapien
atgagctttcagactccagctgtga

SEQ ID NO: 115350 - DNA, 25 bp, Homo sapien
agctttcagactccagctgtgaaga

SEQ ID NO: 115351 - DNA, 25 bp, Homo sapien
agtgagactccgttgtctttaaagg

SEQ ID NO: 115352 - DNA, 25 bp, Homo sapien
gactccgttgtctttaaaggccaat

SEQ ID NO: 115353 - DNA, 25 bp, Homo sapien
gttgtctttaaaggccaatcccata

SEQ ID NO: 115354 - DNA, 25 bp, Homo sapien
tttaaaggccaatcccatagcaaat

SEQ ID NO: 115355 - DNA, 25 bp, Homo sapien
aggccaatcccatagcaaatgacag

SEQ ID NO: 115356 - DNA, 25 bp, Homo sapien
gcaaatgacagagactcacttgagt

SEQ ID NO: 115357 - DNA, 25 bp, Homo sapien
gactcacttgagtaagaaaggtttt

SEQ ID NO: 115358 - DNA, 25 bp, Homo sapien
tttttgacaagaaaacccacagaag

SEQ ID NO: 115359 - DNA, 25 bp, Homo sapien
gaagaagaggtaagctgtggatata

SEQ ID NO: 115360 - DNA, 25 bp, Homo sapien
taagaaaggcactacaatctgtatt

SEQ ID NO: 115361 - DNA, 25 bp, Homo sapien
aatctgtatttaaatctaattgcac

SEQ ID NO: 115362 - DNA, 25 bp, Homo sapien
ttattaacactttggaatacttaca

SEQ ID NO: 115363 - DNA, 25 bp, Homo sapien
ttatttttgattgcctgataaccag

SEQ ID NO: 115364 - DNA, 25 bp, Homo sapien
ttgcctgataaccagtttcaatgat

SEQ ID NO: 115365 - DNA, 25 bp, Homo sapien
gaagagaaccgttttaatctggatt

SEQ ID NO: 115366 - DNA, 25 bp, Homo sapien
ggattttgttttgtcacacctggaa

SEQ ID NO: 115367 - DNA, 25 bp, Homo sapien
ttttgttttgtcacacctggaaaat

SEQ ID NO: 115368 - DNA, 25 bp, Homo sapien
ggaaaatactttgcaaatatgttct

SEQ ID NO: 115369 - DNA, 25 bp, Homo sapien
ttttatgatcacatggttcactacc

SEQ ID NO: 115370 - DNA, 25 bp, Homo sapien
tggttcactaccaaatgaccctcaa

SEQ ID NO: 115371 - DNA, 25 bp, Homo sapien
aaatgaccctcaaataagccagatg

SEQ ID NO: 115372 - DNA, 25 bp, Homo sapien
ttgaagaaaaaggtcacccagttct

SEQ ID NO: 115373 - DNA, 25 bp, Homo sapien
gggactcatctttgaacacaacacg

SEQ ID NO: 115374 - DNA, 25 bp, Homo sapien
tgaacacaacacgaagaatctcctt

SEQ ID NO: 115375 - DNA, 25 bp, Homo sapien
aagaatctccttcatcgccaaacag

SEQ ID NO: 115376 - DNA, 25 bp, Homo sapien
tcagagatagatgctttgtttccaa

SEQ ID NO: 115377 - DNA, 25 bp, Homo sapien
ctttgtttccaatcgagcatgctat

SEQ ID NO: 115378 - DNA, 25 bp, Homo sapien
gagcatgctattccagtgtactgaa

SEQ ID NO: 115379 - DNA, 25 bp, Homo sapien
gaacatactgtatacctcgtgttag

SEQ ID NO: 115380 - DNA, 25 bp, Homo sapien
gaagagatgaagacactggcatttc

SEQ ID NO: 115381 - DNA, 25 bp, Homo sapien
ttgtaatagcttcatgtacagcatg

SEQ ID NO: 115382 - DNA, 25 bp, Homo sapien
cagcatgctgcttggtgaacaatca

SEQ ID NO: 115383 - DNA, 25 bp, Homo sapien
attcttcgatatttctgtagcttga

SEQ ID NO: 115384 - DNA, 25 bp, Homo sapien
catggattatttgttacttgtctaa

SEQ ID NO: 115385 - DNA, 25 bp, Homo sapien
atttgttacttgtctaagatgcaat

SEQ ID NO: 115386 - DNA, 25 bp, Homo sapien
acttgtctaagatgcaatttgattt

SEQ ID NO: 115387 - DNA, 25 bp, Homo sapien
ataccctttacccaccagagacagt

SEQ ID NO: 115388 - DNA, 25 bp, Homo sapien
cctttacccaccagagacagtacag

SEQ ID NO: 115389 - DNA, 25 bp, Homo sapien
ttacccaccagagacagtacagaat

SEQ ID NO: 115390 - DNA, 25 bp, Homo sapien
ccagagacagtacagaatccctgcc

SEQ ID NO: 115391 - DNA, 25 bp, Homo sapien
atcccaggcttaattgccctacaaa

SEQ ID NO: 115392 - DNA, 25 bp, Homo sapien
ccaggcttaattgccctacaaaggg

SEQ ID NO: 115393 - DNA, 25 bp, Homo sapien
gcttaattgccctacaaagggttat

SEQ ID NO: 115394 - DNA, 25 bp, Homo sapien
aaaactccattattaggattacatt

SEQ ID NO: 115395 - DNA, 25 bp, Homo sapien
gtgaggacacctgagggcctcccgt

SEQ ID NO: 115396 - DNA, 25 bp, Homo sapien
tgagggcctcccgtgtggccagcat

SEQ ID NO: 115397 - DNA, 25 bp, Homo sapien
tcccgtgtggccagcattgctgttg

SEQ ID NO: 115398 - DNA, 25 bp, Homo sapien
attgctgttgctgacttattgccca

SEQ ID NO: 115399 - DNA, 25 bp, Homo sapien
gttgctgacttattgcccaatgagg

SEQ ID NO: 115400 - DNA, 25 bp, Homo sapien
taggggctgctatccactctggaaa

SEQ ID NO: 115401 - DNA, 25 bp, Homo sapien
gatgagtgtaatctggtacccagga

SEQ ID NO: 115402 - DNA, 25 bp, Homo sapien
gtacccaggatctatagggtcccag

SEQ ID NO: 115403 - DNA, 25 bp, Homo sapien
tcccagagacggacattccttacct

SEQ ID NO: 115404 - DNA, 25 bp, Homo sapien
tccttacctcaaatgctgcctgata

SEQ ID NO: 115405 - DNA, 25 bp, Homo sapien
ctgcctgataaactggctctcttta

SEQ ID NO: 115406 - DNA, 25 bp, Homo sapien
tagatgtgaacaaaacccggaaaat

SEQ ID NO: 115407 - DNA, 25 bp, Homo sapien
ctcatcagagaagggtacatcacta

SEQ ID NO: 115408 - DNA, 25 bp, Homo sapien
gggtacatcactaaaggctaaggct

SEQ ID NO: 115409 - DNA, 25 bp, Homo sapien
aaggctaaggcttcaagagcttggg

SEQ ID NO: 115410 - DNA, 25 bp, Homo sapien
gaatgtggtgggtcaaaggacaata

SEQ ID NO: 115411 - DNA, 25 bp, Homo sapien
gggcattctggagagttgtttttca

SEQ ID NO: 115412 - DNA, 25 bp, Homo sapien
gagagttgtttttcagctgaattct

SEQ ID NO: 115413 - DNA, 25 bp, Homo sapien
gaaaccttaagttgtattgtctact

SEQ ID NO: 115414 - DNA, 25 bp, Homo sapien
catcctgctttaaaacactcctgtt

SEQ ID NO: 115415 - DNA, 25 bp, Homo sapien
acactcctgttgttggtattatgct

SEQ ID NO: 115416 - DNA, 25 bp, Homo sapien
gttgttggtattatgctgcagagtt

SEQ ID NO: 115417 - DNA, 25 bp, Homo sapien
agactacatactgtttgattccctc

SEQ ID NO: 115418 - DNA, 25 bp, Homo sapien
gtttgattccctctatatgatattc

SEQ ID NO: 115419 - DNA, 25 bp, Homo sapien
tgattccctctatatgatattctag

SEQ ID NO: 115420 - DNA, 25 bp, Homo sapien
gaaacagtgagtgatcacctagggt

SEQ ID NO: 115421 - DNA, 25 bp, Homo sapien
gagtgatcacctagggttgaagaca

SEQ ID NO: 115422 - DNA, 25 bp, Homo sapien
ggagatgttccttatattgatggcg

SEQ ID NO: 115423 - DNA, 25 bp, Homo sapien
ccttatattgatggcggtggtggtt

SEQ ID NO: 115424 - DNA, 25 bp, Homo sapien
ggtggttacacaactgcacttttat

SEQ ID NO: 115425 - DNA, 25 bp, Homo sapien
acacaactgcacttttatcaaaact

SEQ ID NO: 115426 - DNA, 25 bp, Homo sapien
atcaaaacttacctaactgctactt

SEQ ID NO: 115427 - DNA, 25 bp, Homo sapien
aactgctacttaaaataggtgtatt

SEQ ID NO: 115428 - DNA, 25 bp, Homo sapien
tggtgagcacgactgaaaatgtagc

SEQ ID NO: 115429 - DNA, 25 bp, Homo sapien
aaatgtagctgtttatatctgggac

SEQ ID NO: 115430 - DNA, 25 bp, Homo sapien
gctgtttatatctgggacaacctcc

SEQ ID NO: 115431 - DNA, 25 bp, Homo sapien
ggacaacctccagaaagttcttcct

SEQ ID NO: 115432 - DNA, 25 bp, Homo sapien
ggttagcattgcacaaagcccagtt

SEQ ID NO: 115433 - DNA, 25 bp, Homo sapien
caaagcccagtttctttctgtgttt

SEQ ID NO: 115434 - DNA, 25 bp, Homo sapien
gattttgatccccttggaatattaa

SEQ ID NO: 115435 - DNA, 25 bp, Homo sapien
tattaagaggtcaacacgtgattgt

SEQ ID NO: 115436 - DNA, 25 bp, Homo sapien
cacgtgattgttgtacgtacacatt

SEQ ID NO: 115437 - DNA, 25 bp, Homo sapien
gtacacattgtgctctggagtgcct

SEQ ID NO: 115438 - DNA, 25 bp, Homo sapien
gtgctctggagtgcctatttattga

SEQ ID NO: 115439 - DNA, 25 bp, Homo sapien
gatcaccaagaaacagaaagccacg

SEQ ID NO: 115440 - DNA, 25 bp, Homo sapien
cttaagagcttgatctgtgatttct

SEQ ID NO: 115441 - DNA, 25 bp, Homo sapien
tcccctgcaagagtggtcctaggag

SEQ ID NO: 115442 - DNA, 25 bp, Homo sapien
gaggacctggcacaccttaggttga

SEQ ID NO: 115443 - DNA, 25 bp, Homo sapien
gcacaccttaggttgacattcagaa

SEQ ID NO: 115444 - DNA, 25 bp, Homo sapien
acttcaagacatcaccatcagcagg

SEQ ID NO: 115445 - DNA, 25 bp, Homo sapien
atcagcaggctccagttgaacacta

SEQ ID NO: 115446 - DNA, 25 bp, Homo sapien
ggctccagttgaacactagtctgtg

SEQ ID NO: 115447 - DNA, 25 bp, Homo sapien
gtgtaactttaaacatctagcagta

SEQ ID NO: 115448 - DNA, 25 bp, Homo sapien
ttgcagttgtgatataaaggaccct

SEQ ID NO: 115449 - DNA, 25 bp, Homo sapien
tataaaggaccctgtttctgtagaa

SEQ ID NO: 115450 - DNA, 25 bp, Homo sapien
ccaggtggactgtggcagatcaata

SEQ ID NO: 115451 - DNA, 25 bp, Homo sapien
caggacagcactgccagagatgcct

SEQ ID NO: 115452 - DNA, 25 bp, Homo sapien
agatgcctgggtgtgccacagacct

SEQ ID NO: 115453 - DNA, 25 bp, Homo sapien
ttcctacttggcctgtaatcacctg

SEQ ID NO: 115454 - DNA, 25 bp, Homo sapien
taatcacctgtgcagccttttgtgg

SEQ ID NO: 115455 - DNA, 25 bp, Homo sapien
tgtgcagccttttgtgggccttcaa

SEQ ID NO: 115456 - DNA, 25 bp, Homo sapien
gtgggccttcaaaactctgtcaaga

SEQ ID NO: 115457 - DNA, 25 bp, Homo sapien
tagagaagaaatcagcggaccacga

SEQ ID NO: 115458 - DNA, 25 bp, Homo sapien
gcggaccacgatttcaagacttgtt

SEQ ID NO: 115459 - DNA, 25 bp, Homo sapien
gaactgcaaagagacggactcctgt

SEQ ID NO: 115460 - DNA, 25 bp, Homo sapien
acggactcctgttcacctaggtgag

SEQ ID NO: 115461 - DNA, 25 bp, Homo sapien
tgcagacgctggtccacttcatcaa

SEQ ID NO: 115462 - DNA, 25 bp, Homo sapien
tggtccacttcatcaacccggaaac

SEQ ID NO: 115463 - DNA, 25 bp, Homo sapien
tcatcaacccggaaacggtgcccaa

SEQ ID NO: 115464 - DNA, 25 bp, Homo sapien
gaaacggtgcccaagccctgctgtg

SEQ ID NO: 115465 - DNA, 25 bp, Homo sapien
atctccgtcctctacttcgatgaca

SEQ ID NO: 115466 - DNA, 25 bp, Homo sapien
tctacttcgatgacagctccaacgt

SEQ ID NO: 115467 - DNA, 25 bp, Homo sapien
agctccaacgtcatcctgaagaaat

SEQ ID NO: 115468 - DNA, 25 bp, Homo sapien
tacagaaacatggtggtccgggcct

SEQ ID NO: 115469 - DNA, 25 bp, Homo sapien
cagaaacatggtggtccgggcctgt

SEQ ID NO: 115470 - DNA, 25 bp, Homo sapien
tgccactagctcctccgagaattca

SEQ ID NO: 115471 - DNA, 25 bp, Homo sapien
tcctccgagaattcagaccctttgg

SEQ ID NO: 115472 - DNA, 25 bp, Homo sapien
ggactctgcttaccctgatggctgc

SEQ ID NO: 115473 - DNA, 25 bp, Homo sapien
tgatggctgctcagcaccacagagt

SEQ ID NO: 115474 - DNA, 25 bp, Homo sapien
agcaccacagagtgcttgggctgag

SEQ ID NO: 115475 - DNA, 25 bp, Homo sapien
ggactgactgttggaacccgtgcat

SEQ ID NO: 115476 - DNA, 25 bp, Homo sapien
ttggaacccgtgcatgtagctgccg

SEQ ID NO: 115477 - DNA, 25 bp, Homo sapien
gtagctgccgggtcatcagcaagaa

SEQ ID NO: 115478 - DNA, 25 bp, Homo sapien
ggaagagtccaagcctgaataataa

SEQ ID NO: 115479 - DNA, 25 bp, Homo sapien
tgaataataacaccccacagcctct

SEQ ID NO: 115480 - DNA, 25 bp, Homo sapien
tctgcggagccagtgtgccattctc

SEQ ID NO: 115481 - DNA, 25 bp, Homo sapien
agtgtgccattctctgcacatgggc

SEQ ID NO: 115482 - DNA, 25 bp, Homo sapien
tctccactgaagctgacttagccgg

SEQ ID NO: 115483 - DNA, 25 bp, Homo sapien
gcagcctaatggtgaacgggattac

SEQ ID NO: 115484 - DNA, 25 bp, Homo sapien
gaacgggattacaacatagcaaata

SEQ ID NO: 115485 - DNA, 25 bp, Homo sapien
cagaagatgattggtttatttccct

SEQ ID NO: 115486 - DNA, 25 bp, Homo sapien
tgattttttgctcccttcaaagatt

SEQ ID NO: 115487 - DNA, 25 bp, Homo sapien
tttttgctcccttcaaagatttctg

SEQ ID NO: 115488 - DNA, 25 bp, Homo sapien
gtattctacagtttaatcaaattac

SEQ ID NO: 115489 - DNA, 25 bp, Homo sapien
acttttgatctggtatttatctgcc

SEQ ID NO: 115490 - DNA, 25 bp, Homo sapien
attcactaataatagactggtgctg

SEQ ID NO: 115491 - DNA, 25 bp, Homo sapien
gactggtgctgtaactcaagcatca

SEQ ID NO: 115492 - DNA, 25 bp, Homo sapien
agcatcaattcagctcttcttttgg

SEQ ID NO: 115493 - DNA, 25 bp, Homo sapien
attcagctcttcttttggaatgaaa

SEQ ID NO: 115494 - DNA, 25 bp, Homo sapien
acagacagtgagtgctaaaggcccc

SEQ ID NO: 115495 - DNA, 25 bp, Homo sapien
aaacggatgagacttcagtgagtac

SEQ ID NO: 115496 - DNA, 25 bp, Homo sapien
gagacttcagtgagtactggacaaa

SEQ ID NO: 115497 - DNA, 25 bp, Homo sapien
ctggaagactcctcatgctagttat

SEQ ID NO: 115498 - DNA, 25 bp, Homo sapien
gactcctcatgctagttatcatacc

SEQ ID NO: 115499 - DNA, 25 bp, Homo sapien
gctagttatcatacctcagtactgt

SEQ ID NO: 115500 - DNA, 25 bp, Homo sapien
catacctcagtactgtggctcttga

SEQ ID NO: 115501 - DNA, 25 bp, Homo sapien
gtggctcttgagctttgaagtactt

SEQ ID NO: 115502 - DNA, 25 bp, Homo sapien
attgtaaccttcttatttgtatgga

SEQ ID NO: 115503 - DNA, 25 bp, Homo sapien
gtatggaatgcgcttattttttgaa

SEQ ID NO: 115504 - DNA, 25 bp, Homo sapien
tttgaaaggatattaggccggatgt

SEQ ID NO: 115505 - DNA, 25 bp, Homo sapien
aacacattaagtactggtccaatat

SEQ ID NO: 115506 - DNA, 25 bp, Homo sapien
gtactggtccaatatggctgaatga

SEQ ID NO: 115507 - DNA, 25 bp, Homo sapien
gggacaagagcctgttcacattctg

SEQ ID NO: 115508 - DNA, 25 bp, Homo sapien
acattctgaagatgctggagtcact

SEQ ID NO: 115509 - DNA, 25 bp, Homo sapien
tgctggagtcacttgcactttataa

SEQ ID NO: 115510 - DNA, 25 bp, Homo sapien
agtggtccacgaggatttccaggtc

SEQ ID NO: 115511 - DNA, 25 bp, Homo sapien
ggatttccaggtccaataggtcctc

SEQ ID NO: 115512 - DNA, 25 bp, Homo sapien
gtcctccgggtcttaaaggtgatcg

SEQ ID NO: 115513 - DNA, 25 bp, Homo sapien
gagcaattggctttcctggaagtcg

SEQ ID NO: 115514 - DNA, 25 bp, Homo sapien
ctttcctggaagtcgaggactccca

SEQ ID NO: 115515 - DNA, 25 bp, Homo sapien
gaggactcccaggatatgccggaag

SEQ ID NO: 115516 - DNA, 25 bp, Homo sapien
aggaaagcgtaagcaggaagacctc

SEQ ID NO: 115517 - DNA, 25 bp, Homo sapien
ggaagacctcttaatggcatagcac

SEQ ID NO: 115518 - DNA, 25 bp, Homo sapien
aaatgactcctagttgtgtttggaa

SEQ ID NO: 115519 - DNA, 25 bp, Homo sapien
ggaaggtcatgttctttcagcttat

SEQ ID NO: 115520 - DNA, 25 bp, Homo sapien
cagcttatggcatttcctagagttt

SEQ ID NO: 115521 - DNA, 25 bp, Homo sapien
aaaattgtgtgctctcttcttcacg

SEQ ID NO: 115522 - DNA, 25 bp, Homo sapien
cttcttcacgtaggctcctgttaaa

SEQ ID NO: 115523 - DNA, 25 bp, Homo sapien
taggctcctgttaaaaacaaagtgc

SEQ ID NO: 115524 - DNA, 25 bp, Homo sapien
gtgcagtcagattctaagccctgtt

SEQ ID NO: 115525 - DNA, 25 bp, Homo sapien
taagccctgttcagagacttcgcgg

SEQ ID NO: 115526 - DNA, 25 bp, Homo sapien
ctgttcagagacttcgcggatcaca

SEQ ID NO: 115527 - DNA, 25 bp, Homo sapien
ctgtggtccagctgagatctgcaag

SEQ ID NO: 115528 - DNA, 25 bp, Homo sapien
gtggtccagctgagatctgcaagat

SEQ ID NO: 115529 - DNA, 25 bp, Homo sapien
tggtccagctgagatctgcaagatt

SEQ ID NO: 115530 - DNA, 25 bp, Homo sapien
gtccagctgagatctgcaagattgt

SEQ ID NO: 115531 - DNA, 25 bp, Homo sapien
ccagctgagatctgcaagattgtaa

SEQ ID NO: 115532 - DNA, 25 bp, Homo sapien
gatctgcaagattgtaagacagcct

SEQ ID NO: 115533 - DNA, 25 bp, Homo sapien
tctgcaagattgtaagacagcctgt

SEQ ID NO: 115534 - DNA, 25 bp, Homo sapien
caagattgtaagacagcctgtgctc

SEQ ID NO: 115535 - DNA, 25 bp, Homo sapien
agattgtaagacagcctgtgctccc

SEQ ID NO: 115536 - DNA, 25 bp, Homo sapien
gattgtaagacagcctgtgctccct

SEQ ID NO: 115537 - DNA, 25 bp, Homo sapien
ttgtaagacagcctgtgctccctcg

SEQ ID NO: 115538 - DNA, 25 bp, Homo sapien
agaatttatcctaatggcctttata

SEQ ID NO: 115539 - DNA, 25 bp, Homo sapien
ggcctttataggaccaatgctgatt

SEQ ID NO: 115540 - DNA, 25 bp, Homo sapien
aaggcagttcctattatgtggtgaa

SEQ ID NO: 115541 - DNA, 25 bp, Homo sapien
gttcctattatgtggtgaaattttg

SEQ ID NO: 115542 - DNA, 25 bp, Homo sapien
aaaacagtcaccacctagaactggg

SEQ ID NO: 115543 - DNA, 25 bp, Homo sapien
gtcaccacctagaactgggtattct

SEQ ID NO: 115544 - DNA, 25 bp, Homo sapien
accacctagaactgggtattctttg

SEQ ID NO: 115545 - DNA, 25 bp, Homo sapien
actgggtattctttgtacattgtca

SEQ ID NO: 115546 - DNA, 25 bp, Homo sapien
tacattgtcagatatctttcaaagt

SEQ ID NO: 115547 - DNA, 25 bp, Homo sapien
ttaagattgtcatcttgtacagcaa

SEQ ID NO: 115548 - DNA, 25 bp, Homo sapien
atgttggtatattacttccttatta

SEQ ID NO: 115549 - DNA, 25 bp, Homo sapien
ctgtgtggggtcttcttcgggcctc

SEQ ID NO: 115550 - DNA, 25 bp, Homo sapien
actccagactctctgcatcaggtct

SEQ ID NO: 115551 - DNA, 25 bp, Homo sapien
aacaccacgtcctgccgcgcaggtt

SEQ ID NO: 115552 - DNA, 25 bp, Homo sapien
gcgcaggttcttccccgcgcggagg

SEQ ID NO: 115553 - DNA, 25 bp, Homo sapien
agcgcgcagggtgggcggcttacca

SEQ ID NO: 115554 - DNA, 25 bp, Homo sapien
gggcggcttaccatagcaagtgatc

SEQ ID NO: 115555 - DNA, 25 bp, Homo sapien
gcggcttaccatagcaagtgatcct

SEQ ID NO: 115556 - DNA, 25 bp, Homo sapien
ttaccatagcaagtgatcctgcgat

SEQ ID NO: 115557 - DNA, 25 bp, Homo sapien
agcaagtgatcctgcgatagggaac

SEQ ID NO: 115558 - DNA, 25 bp, Homo sapien
tgatcctgcgatagggaacgcgccc

SEQ ID NO: 115559 - DNA, 25 bp, Homo sapien
tgcgatagggaacgcgcccttgccc

SEQ ID NO: 115560 - DNA, 25 bp, Homo sapien
gtactggtccaatatggctgaatga

SEQ ID NO: 115561 - DNA, 25 bp, Homo sapien
gtccaatatggctgaatgaagtgtt

SEQ ID NO: 115562 - DNA, 25 bp, Homo sapien
tatggctgaatgaagtgttttgttt

SEQ ID NO: 115563 - DNA, 25 bp, Homo sapien
gttttgggagagaatcatctattga

SEQ ID NO: 115564 - DNA, 25 bp, Homo sapien
gggagagaatcatctattgaagaat

SEQ ID NO: 115565 - DNA, 25 bp, Homo sapien
gggacaagagcctgttcacattctg

SEQ ID NO: 115566 - DNA, 25 bp, Homo sapien
ggacaagagcctgttcacattctga

SEQ ID NO: 115567 - DNA, 25 bp, Homo sapien
acattctgaagatgctggagtcact

SEQ ID NO: 115568 - DNA, 25 bp, Homo sapien
gaagatgctggagtcacttgcactt

SEQ ID NO: 115569 - DNA, 25 bp, Homo sapien
gatgctggagtcacttgcactttat

SEQ ID NO: 115570 - DNA, 25 bp, Homo sapien
tgctggagtcacttgcactttataa

SEQ ID NO: 115571 - DNA, 25 bp, Homo sapien
gagatctatctcaccgacgaagact

SEQ ID NO: 115572 - DNA, 25 bp, Homo sapien
gaagacttcgagtttgcactagaca

SEQ ID NO: 115573 - DNA, 25 bp, Homo sapien
gtttgcactagacatgacgagggat

SEQ ID NO: 115574 - DNA, 25 bp, Homo sapien
agggatgaatacaacgccctgcccg

SEQ ID NO: 115575 - DNA, 25 bp, Homo sapien
gcccgcctggaagcaggtgaacctg

SEQ ID NO: 115576 - DNA, 25 bp, Homo sapien
agaggagcctcacggtcacgtccaa

SEQ ID NO: 115577 - DNA, 25 bp, Homo sapien
acaacaccactgcaccagggaaatg

SEQ ID NO: 115578 - DNA, 25 bp, Homo sapien
tatttttggactggtgtttttcaca

SEQ ID NO: 115579 - DNA, 25 bp, Homo sapien
ttttcaatcagagttttcagaacct

SEQ ID NO: 115580 - DNA, 25 bp, Homo sapien
taaagatactgcttgtcccggagtt

SEQ ID NO: 115581 - DNA, 25 bp, Homo sapien
tgtcccggagttgtgtattttgtaa

SEQ ID NO: 115582 - DNA, 25 bp, Homo sapien
gagctgaaacagtatgacaacaaaa

SEQ ID NO: 115583 - DNA, 25 bp, Homo sapien
ctgggtcttcatgagacagagaaca

SEQ ID NO: 115584 - DNA, 25 bp, Homo sapien
agttttcctaatgcctacaacactg

SEQ ID NO: 115585 - DNA, 25 bp, Homo sapien
taatgcctacaacactgccatggct

SEQ ID NO: 115586 - DNA, 25 bp, Homo sapien
gcctacaacactgccatggctgtgt

SEQ ID NO: 115587 - DNA, 25 bp, Homo sapien
tgtgtgtaacagcatctcaaaccct

SEQ ID NO: 115588 - DNA, 25 bp, Homo sapien
tctcaaaccctgtcaccaaggagat

SEQ ID NO: 115589 - DNA, 25 bp, Homo sapien
gctgtttgagttcatcgacagatgt

SEQ ID NO: 115590 - DNA, 25 bp, Homo sapien
tcatcgacagatgtactgcagcttc

SEQ ID NO: 115591 - DNA, 25 bp, Homo sapien
gaagcgaaaacatcatctggaccct

SEQ ID NO: 115592 - DNA, 25 bp, Homo sapien
tggaccctgacacggagctcatgcc

SEQ ID NO: 115593 - DNA, 25 bp, Homo sapien
ccacagcgtctgctggaacaggcag

SEQ ID NO: 115594 - DNA, 25 bp, Homo sapien
gttccagtgaatgacgctgactccg

SEQ ID NO: 115595 - DNA, 25 bp, Homo sapien
agtgaatgacgctgactccgctgac

SEQ ID NO: 115596 - DNA, 25 bp, Homo sapien
aatgacgctgactccgctgacatca

SEQ ID NO: 115597 - DNA, 25 bp, Homo sapien
gctgacatcagcaccttgctggatg

SEQ ID NO: 115598 - DNA, 25 bp, Homo sapien
ttgctggatgcctcggcaacactgg

SEQ ID NO: 115599 - DNA, 25 bp, Homo sapien
ggatgcctcggcaacactggaagaa

SEQ ID NO: 115600 - DNA, 25 bp, Homo sapien
caacactggaagaaggacatgcaaa

SEQ ID NO: 115601 - DNA, 25 bp, Homo sapien
tggtgggctccgaaaagctctttta

SEQ ID NO: 115602 - DNA, 25 bp, Homo sapien
gggctccgaaaagctcttttatgaa

SEQ ID NO: 115603 - DNA, 25 bp, Homo sapien
agaagatgaggcaggctctgctacg

SEQ ID NO: 115604 - DNA, 25 bp, Homo sapien
ttgtgcatatggcaacgttcatgtt

SEQ ID NO: 115605 - DNA, 25 bp, Homo sapien
tatggcaacgttcatgttcatctca

SEQ ID NO: 115606 - DNA, 25 bp, Homo sapien
gttcatctcaggtggcatttgcagg

SEQ ID NO: 115607 - DNA, 25 bp, Homo sapien
ctcaggtggcatttgcaggtgacca

SEQ ID NO: 115608 - DNA, 25 bp, Homo sapien
tgcaggtgaccagaatgaggcacat

SEQ ID NO: 115609 - DNA, 25 bp, Homo sapien
gttatatttcaaccacacctaaatt

SEQ ID NO: 115610 - DNA, 25 bp, Homo sapien
aaattcagtggacatttgttctggg

SEQ ID NO: 115611 - DNA, 25 bp, Homo sapien
ttgctctgctcatctacacatataa

SEQ ID NO: 115612 - DNA, 25 bp, Homo sapien
cacagtaagataggttctgctttct

SEQ ID NO: 115613 - DNA, 25 bp, Homo sapien
taggttctgctttctgatacatctg

SEQ ID NO: 115614 - DNA, 25 bp, Homo sapien
tacatctgtcagtgagtcagaggca

SEQ ID NO: 115615 - DNA, 25 bp, Homo sapien
tgtgtacagttcttcacgctatgat

SEQ ID NO: 115616 - DNA, 25 bp, Homo sapien
gtacagttcttcacgctatgatgat

SEQ ID NO: 115617 - DNA, 25 bp, Homo sapien
gttcttcacgctatgatgattatga

SEQ ID NO: 115618 - DNA, 25 bp, Homo sapien
atgattatgacagatacagacgttc

SEQ ID NO: 115619 - DNA, 25 bp, Homo sapien
gatacagacgttctagaagccgaag

SEQ ID NO: 115620 - DNA, 25 bp, Homo sapien
gacgttctagaagccgaagttatga

SEQ ID NO: 115621 - DNA, 25 bp, Homo sapien
atagaagatcgtatagtcctagaaa

SEQ ID NO: 115622 - DNA, 25 bp, Homo sapien
tagaccgactggaagaccacggcgt

SEQ ID NO: 115623 - DNA, 25 bp, Homo sapien
gactggaagaccacggcgtagcaga

SEQ ID NO: 115624 - DNA, 25 bp, Homo sapien
agaccacggcgtagcagaagccatt

SEQ ID NO: 115625 - DNA, 25 bp, Homo sapien
cacggcgtagcagaagccattccga

SEQ ID NO: 115626 - DNA, 25 bp, Homo sapien
gtgaaccaaatgacagaagcctgcc

SEQ ID NO: 115627 - DNA, 25 bp, Homo sapien
atgacagaagcctgccttaaccagt

SEQ ID NO: 115628 - DNA, 25 bp, Homo sapien
ttaaccagtcgctagatgcccttct

SEQ ID NO: 115629 - DNA, 25 bp, Homo sapien
atgcccttctgtccagggacttgat

SEQ ID NO: 115630 - DNA, 25 bp, Homo sapien
gaacttgttagtaccaagcctacaa

SEQ ID NO: 115631 - DNA, 25 bp, Homo sapien
gtaccaagcctacaaggacctcaaa

SEQ ID NO: 115632 - DNA, 25 bp, Homo sapien
ggacctcaaaagtcagacaattact

SEQ ID NO: 115633 - DNA, 25 bp, Homo sapien
agacaattactagacactactgaca

SEQ ID NO: 115634 - DNA, 25 bp, Homo sapien
tgggtcttcagccttacccggaaat

SEQ ID NO: 115635 - DNA, 25 bp, Homo sapien
cagccttacccggaaatacttgtgg

SEQ ID NO: 115636 - DNA, 25 bp, Homo sapien
gtggtttctagatcaccatctttaa

SEQ ID NO: 115637 - DNA, 25 bp, Homo sapien
accgcgaactgctgcgcctggagag

SEQ ID NO: 115638 - DNA, 25 bp, Homo sapien
ggagagccgcatccgcgacgtacac

SEQ ID NO: 115639 - DNA, 25 bp, Homo sapien
gacgtacacgagctcttcttgcaga

SEQ ID NO: 115640 - DNA, 25 bp, Homo sapien
tacacgagctcttcttgcagatggc

SEQ ID NO: 115641 - DNA, 25 bp, Homo sapien
gctcttcttgcagatggcggtgctg

SEQ ID NO: 115642 - DNA, 25 bp, Homo sapien
agaagcaggccgacaccctgaacgt

SEQ ID NO: 115643 - DNA, 25 bp, Homo sapien
acaccctgaacgtcatcgagctcaa

SEQ ID NO: 115644 - DNA, 25 bp, Homo sapien
gaacgtcatcgagctcaacgtacaa

SEQ ID NO: 115645 - DNA, 25 bp, Homo sapien
gagctcaacgtacaaaagacggtcg

SEQ ID NO: 115646 - DNA, 25 bp, Homo sapien
aagacggtcgactacaccggccagg

SEQ ID NO: 115647 - DNA, 25 bp, Homo sapien
catcccaaaccatggagcgcgctgg

SEQ ID NO: 115648 - DNA, 25 bp, Homo sapien
catgctggcgactggatggataatc

SEQ ID NO: 115649 - DNA, 25 bp, Homo sapien
tgctggcgactggatggataatcct

SEQ ID NO: 115650 - DNA, 25 bp, Homo sapien
ctggcgactggatggataatcctgt

SEQ ID NO: 115651 - DNA, 25 bp, Homo sapien
gactggatggataatcctgtgcatc

SEQ ID NO: 115652 - DNA, 25 bp, Homo sapien
ggatggataatcctgtgcatcacca

SEQ ID NO: 115653 - DNA, 25 bp, Homo sapien
tggataatcctgtgcatcaccattg

SEQ ID NO: 115654 - DNA, 25 bp, Homo sapien
gataatcctgtgcatcaccattgtg

SEQ ID NO: 115655 - DNA, 25 bp, Homo sapien
taatcctgtgcatcaccattgtgtc

SEQ ID NO: 115656 - DNA, 25 bp, Homo sapien
atcctgtgcatcaccattgtgtcct

SEQ ID NO: 115657 - DNA, 25 bp, Homo sapien
tgtgcatcaccattgtgtcctgtgc

SEQ ID NO: 115658 - DNA, 25 bp, Homo sapien
tgcatcaccattgtgtcctgtgctc

SEQ ID NO: 115659 - DNA, 25 bp, Homo sapien
gaaggacttaaggacagcatgtctg

SEQ ID NO: 115660 - DNA, 25 bp, Homo sapien
ttatcttgaaactgaccaaacgctt

SEQ ID NO: 115661 - DNA, 25 bp, Homo sapien
gaaactgaccaaacgcttattgtgt

SEQ ID NO: 115662 - DNA, 25 bp, Homo sapien
gaccaaacgcttattgtgtaagata

SEQ ID NO: 115663 - DNA, 25 bp, Homo sapien
accagttgaatcattgaggatccaa

SEQ ID NO: 115664 - DNA, 25 bp, Homo sapien
gttggctacggctttgaaggagcaa

SEQ ID NO: 115665 - DNA, 25 bp, Homo sapien
aaggagcaaattcgaataacagcaa

SEQ ID NO: 115666 - DNA, 25 bp, Homo sapien
aataacagcaagtattggctcgtca

SEQ ID NO: 115667 - DNA, 25 bp, Homo sapien
tattggctcgtcaaaaacagctggg

SEQ ID NO: 115668 - DNA, 25 bp, Homo sapien
gggctcgaatggctatgtaaaaata

SEQ ID NO: 115669 - DNA, 25 bp, Homo sapien
gaacaaccactgtggaatcgccaca

SEQ ID NO: 115670 - DNA, 25 bp, Homo sapien
ctgtatgccctaggcctgtgccaaa

SEQ ID NO: 115671 - DNA, 25 bp, Homo sapien
aaagtggccagagattgggctgcct

SEQ ID NO: 115672 - DNA, 25 bp, Homo sapien
gctgcctgtgatacccatcagccca

SEQ ID NO: 115673 - DNA, 25 bp, Homo sapien
ggccggcccagataggtctgcctct

SEQ ID NO: 115674 - DNA, 25 bp, Homo sapien
gcccagataggtctgcctctgcctt

SEQ ID NO: 115675 - DNA, 25 bp, Homo sapien
gtccctgatactgggctctgtcctg

SEQ ID NO: 115676 - DNA, 25 bp, Homo sapien
ggctctgtcctgcagacacctcttt

SEQ ID NO: 115677 - DNA, 25 bp, Homo sapien
gacacctctttcagaaacgcccaag

SEQ ID NO: 115678 - DNA, 25 bp, Homo sapien
tggtcaaccctcaaacattccggac

SEQ ID NO: 115679 - DNA, 25 bp, Homo sapien
tccggactcccctcataacaataga

SEQ ID NO: 115680 - DNA, 25 bp, Homo sapien
gactcccctcataacaatagacaca

SEQ ID NO: 115681 - DNA, 25 bp, Homo sapien
tctctaagcctatacgtttctgtgg

SEQ ID NO: 115682 - DNA, 25 bp, Homo sapien
aagcctatacgtttctgtggagtaa

SEQ ID NO: 115683 - DNA, 25 bp, Homo sapien
cgtttctgtggagtaaatattggga

SEQ ID NO: 115684 - DNA, 25 bp, Homo sapien
gggttggacatctctagtgtagctg

SEQ ID NO: 115685 - DNA, 25 bp, Homo sapien
ggacatctctagtgtagctgccaca

SEQ ID NO: 115686 - DNA, 25 bp, Homo sapien
atctctagtgtagctgccacattga

SEQ ID NO: 115687 - DNA, 25 bp, Homo sapien
gtgtagctgccacattgatttttct

SEQ ID NO: 115688 - DNA, 25 bp, Homo sapien
gctgccacattgatttttctataat

SEQ ID NO: 115689 - DNA, 25 bp, Homo sapien
tacactaatatatggacctagcttg

SEQ ID NO: 115690 - DNA, 25 bp, Homo sapien
tatggacctagcttgaggcaatttt

SEQ ID NO: 115691 - DNA, 25 bp, Homo sapien
cctagcttgaggcaattttaatccc

SEQ ID NO: 115692 - DNA, 25 bp, Homo sapien
gttagaggtattttcactgaacaag

SEQ ID NO: 115693 - DNA, 25 bp, Homo sapien
gaacaaggtcaattggttacctcag

SEQ ID NO: 115694 - DNA, 25 bp, Homo sapien
ggttacctcagtattacagccaata

SEQ ID NO: 115695 - DNA, 25 bp, Homo sapien
tacagccaatatagtccaagggacc

SEQ ID NO: 115696 - DNA, 25 bp, Homo sapien
caagggaccatttctccccgagtct

SEQ ID NO: 115697 - DNA, 25 bp, Homo sapien
cccgagtctcttacactttattgtg

SEQ ID NO: 115698 - DNA, 25 bp, Homo sapien
acactttattgtgcgatgtccacgt

SEQ ID NO: 115699 - DNA, 25 bp, Homo sapien
gatgtccacgtttttgtgactcttc

SEQ ID NO: 115700 - DNA, 25 bp, Homo sapien
gtttttgtgactcttcaagctgttg

SEQ ID NO: 115701 - DNA, 25 bp, Homo sapien
aggtgggacgaatgcacttgcttcc

SEQ ID NO: 115702 - DNA, 25 bp, Homo sapien
tgcacttgcttcctgtggcaataaa

SEQ ID NO: 115703 - DNA, 25 bp, Homo sapien
gaaagcaaacctacgtctggacaag

SEQ ID NO: 115704 - DNA, 25 bp, Homo sapien
ggacaagatcaaaacacccaagctt

SEQ ID NO: 115705 - DNA, 25 bp, Homo sapien
caaaacacccaagcttgatgtcaat

SEQ ID NO: 115706 - DNA, 25 bp, Homo sapien
atgtcaattaactctgatgatgtcg

SEQ ID NO: 115707 - DNA, 25 bp, Homo sapien
gatgatgtcgaaaaacagtcctgtg

SEQ ID NO: 115708 - DNA, 25 bp, Homo sapien
ctgtgactcaactcaagccttggta

SEQ ID NO: 115709 - DNA, 25 bp, Homo sapien
caagccttggtaacctttaccagct

SEQ ID NO: 115710 - DNA, 25 bp, Homo sapien
agctccagcatcacttatgacctgc

SEQ ID NO: 115711 - DNA, 25 bp, Homo sapien
gtgccatcaccagcttatccagtga

SEQ ID NO: 115712 - DNA, 25 bp, Homo sapien
agtgactgagagctgccatctttcc

SEQ ID NO: 115713 - DNA, 25 bp, Homo sapien
gcatttgtcccatgtctctaattaa

SEQ ID NO: 115714 - DNA, 25 bp, Homo sapien
ttccttctttcttgggcaatatcct

SEQ ID NO: 115715 - DNA, 25 bp, Homo sapien
ggcaatatccttcactttactacag

SEQ ID NO: 115716 - DNA, 25 bp, Homo sapien
aaggatacacttctaaccacatttt

SEQ ID NO: 115717 - DNA, 25 bp, Homo sapien
ctgttgtccagtccaactccacagt

SEQ ID NO: 115718 - DNA, 25 bp, Homo sapien
agtccaactccacagtcactcttaa

SEQ ID NO: 115719 - DNA, 25 bp, Homo sapien
taaaacttctctctgtttgcctgcc

SEQ ID NO: 115720 - DNA, 25 bp, Homo sapien
gcctgcctccaacagtacttttaac

SEQ ID NO: 115721 - DNA, 25 bp, Homo sapien
gaaaggagcagtggtgtcgttcacc

SEQ ID NO: 115722 - DNA, 25 bp, Homo sapien
gtggtgtcgttcaccgtgagagtct

SEQ ID NO: 115723 - DNA, 25 bp, Homo sapien
gtgagagtctgcatagaactcagca

SEQ ID NO: 115724 - DNA, 25 bp, Homo sapien
tgcatagaactcagcagtgtgccct

SEQ ID NO: 115725 - DNA, 25 bp, Homo sapien
actgcttcatgaacaaacgcttccg

SEQ ID NO: 115726 - DNA, 25 bp, Homo sapien
ttcatgaacaaacgcttccgcctcg

SEQ ID NO: 115727 - DNA, 25 bp, Homo sapien
aaacgcttccgcctcggcttcatgg

SEQ ID NO: 115728 - DNA, 25 bp, Homo sapien
aaggcgggaccacaggagcctctct

SEQ ID NO: 115729 - DNA, 25 bp, Homo sapien
gagcctctctgtccaggttctcgta

SEQ ID NO: 115730 - DNA, 25 bp, Homo sapien
tgtccaggttctcgtacagccatat

SEQ ID NO: 115731 - DNA, 25 bp, Homo sapien
tccaggttctcgtacagccatatga

SEQ ID NO: 115732 - DNA, 25 bp, Homo sapien
ggttctcgtacagccatatgagtgc

SEQ ID NO: 115733 - DNA, 25 bp, Homo sapien
cgtacagccatatgagtgcctcggt

SEQ ID NO: 115734 - DNA, 25 bp, Homo sapien
tacagccatatgagtgcctcggtgc

SEQ ID NO: 115735 - DNA, 25 bp, Homo sapien
gcctcggtgccaccccagtgagatg

SEQ ID NO: 115736 - DNA, 25 bp, Homo sapien
gcaagcccatgtcagggcgatcctg

SEQ ID NO: 115737 - DNA, 25 bp, Homo sapien
catgtcagggcgatcctggttcaaa

SEQ ID NO: 115738 - DNA, 25 bp, Homo sapien
cagggcgatcctggttcaaatgtgc

SEQ ID NO: 115739 - DNA, 25 bp, Homo sapien
gatcctggttcaaatgtgccatttc

SEQ ID NO: 115740 - DNA, 25 bp, Homo sapien
tggttcaaatgtgccatttcccggg

SEQ ID NO: 115741 - DNA, 25 bp, Homo sapien
aaatgtgccatttcccgggttgatg

SEQ ID NO: 115742 - DNA, 25 bp, Homo sapien
atttcccgggttgatgctgccacac

SEQ ID NO: 115743 - DNA, 25 bp, Homo sapien
atgctgccacactttgtagagagtt

SEQ ID NO: 115744 - DNA, 25 bp, Homo sapien
gccacactttgtagagagtttagca

SEQ ID NO: 115745 - DNA, 25 bp, Homo sapien
gagagtttagcaacacagtgtgctt

SEQ ID NO: 115746 - DNA, 25 bp, Homo sapien
ttagcaacacagtgtgcttagtcag

SEQ ID NO: 115747 - DNA, 25 bp, Homo sapien
ggaatattgaatcccagcagcggag

SEQ ID NO: 115748 - DNA, 25 bp, Homo sapien
agcagcggaggcatcaccactactt

SEQ ID NO: 115749 - DNA, 25 bp, Homo sapien
actacttctgttcctggaagtccag

SEQ ID NO: 115750 - DNA, 25 bp, Homo sapien
tggtgtctttgatcaaacttgcgta

SEQ ID NO: 115751 - DNA, 25 bp, Homo sapien
tagccaatagtacaggtttcatctt

SEQ ID NO: 115752 - DNA, 25 bp, Homo sapien
cattcctgcaactatgggtcacatc

SEQ ID NO: 115753 - DNA, 25 bp, Homo sapien
atgggtcacatctctctgtcagaga

SEQ ID NO: 115754 - DNA, 25 bp, Homo sapien
agcacaaatgacactgttagtccag

SEQ ID NO: 115755 - DNA, 25 bp, Homo sapien
gacagcactgctgatgagttacatg

SEQ ID NO: 115756 - DNA, 25 bp, Homo sapien
ttacatgtaaagcacgaacctcctg

SEQ ID NO: 115757 - DNA, 25 bp, Homo sapien
taaagcacgaacctcctgatacagc

SEQ ID NO: 115758 - DNA, 25 bp, Homo sapien
gcagcatcgacatggtagactcgcc

SEQ ID NO: 115759 - DNA, 25 bp, Homo sapien
acgctagctgacgaggtgtctgcct

SEQ ID NO: 115760 - DNA, 25 bp, Homo sapien
aaatctgagaagcttgacttcaagg

SEQ ID NO: 115761 - DNA, 25 bp, Homo sapien
gacttcaaggacagagtccagtcga

SEQ ID NO: 115762 - DNA, 25 bp, Homo sapien
gagtccagtcgaagattgggtccct

SEQ ID NO: 115763 - DNA, 25 bp, Homo sapien
attgggtccctggacaatatcaccc

SEQ ID NO: 115764 - DNA, 25 bp, Homo sapien
tcacccacgtccctggcggaggaaa

SEQ ID NO: 115765 - DNA, 25 bp, Homo sapien
acaagctgaccttccgcgagaacgc

SEQ ID NO: 115766 - DNA, 25 bp, Homo sapien
gaacgccaaagccaagacagaccac

SEQ ID NO: 115767 - DNA, 25 bp, Homo sapien
gatcgtgtacaagtcgccagtggtg

SEQ ID NO: 115768 - DNA, 25 bp, Homo sapien
acgtctccacggcatctcagcaatg

SEQ ID NO: 115769 - DNA, 25 bp, Homo sapien
tcaggattttcagagctttgggcac

SEQ ID NO: 115770 - DNA, 25 bp, Homo sapien
agagctttgggcactcccaataatg

SEQ ID NO: 115771 - DNA, 25 bp, Homo sapien
actcccaataatgaagtgtggccag

SEQ ID NO: 115772 - DNA, 25 bp, Homo sapien
gtggccagaagtggaatctttacag

SEQ ID NO: 115773 - DNA, 25 bp, Homo sapien
ggaaaccaggaagcctagcatccca

SEQ ID NO: 115774 - DNA, 25 bp, Homo sapien
gaagcctagcatcccatgtcaaaaa

SEQ ID NO: 115775 - DNA, 25 bp, Homo sapien
aatggcttggatttgctctcgaaaa

SEQ ID NO: 115776 - DNA, 25 bp, Homo sapien
gctctcgaaaatgttaatctatgat

SEQ ID NO: 115777 - DNA, 25 bp, Homo sapien
atctatgatccagccaaacgaattt

SEQ ID NO: 115778 - DNA, 25 bp, Homo sapien
aaacgaatttctggcaaaatggcac

SEQ ID NO: 115779 - DNA, 25 bp, Homo sapien
ggcactgaatcatccatattttaat

SEQ ID NO: 115780 - DNA, 25 bp, Homo sapien
gggaccacatagtctctgttggcat

SEQ ID NO: 115781 - DNA, 25 bp, Homo sapien
acatagtctctgttggcatttcttt

SEQ ID NO: 115782 - DNA, 25 bp, Homo sapien
ttctttgtggtgtctgtctggacat

SEQ ID NO: 115783 - DNA, 25 bp, Homo sapien
gtctgtctggacatgcttcctaaaa

SEQ ID NO: 115784 - DNA, 25 bp, Homo sapien
atgcttcctaaaaacagaccatttt

SEQ ID NO: 115785 - DNA, 25 bp, Homo sapien
acttgcatcagttttggtctgcctt

SEQ ID NO: 115786 - DNA, 25 bp, Homo sapien
ttttggtctgccttatgagttctgt

SEQ ID NO: 115787 - DNA, 25 bp, Homo sapien
gtgtaacacactgatggttttaatg

SEQ ID NO: 115788 - DNA, 25 bp, Homo sapien
gttttaatgtatcttttccacttat

SEQ ID NO: 115789 - DNA, 25 bp, Homo sapien
tatatttatgcttctgtgtcatgat

SEQ ID NO: 115790 - DNA, 25 bp, Homo sapien
gttgtaaccagtagtattcacatta

SEQ ID NO: 115791 - DNA, 25 bp, Homo sapien
cacatggacagaggcttggaccgag

SEQ ID NO: 115792 - DNA, 25 bp, Homo sapien
tggaccgaggcctggtcacagcagc

SEQ ID NO: 115793 - DNA, 25 bp, Homo sapien
gtcacagcagcgagcatccagggtt

SEQ ID NO: 115794 - DNA, 25 bp, Homo sapien
agcatccagggtttgcagggacgat

SEQ ID NO: 115795 - DNA, 25 bp, Homo sapien
agggacgatgttacagactctgttt

SEQ ID NO: 115796 - DNA, 25 bp, Homo sapien
tttctgcctggcgtttcacttgtgt

SEQ ID NO: 115797 - DNA, 25 bp, Homo sapien
tttcacttgtgtctgctcctagcct

SEQ ID NO: 115798 - DNA, 25 bp, Homo sapien
agcacagacatctgctccatcagac

SEQ ID NO: 115799 - DNA, 25 bp, Homo sapien
atcagacctcttccattttgcacag

SEQ ID NO: 115800 - DNA, 25 bp, Homo sapien
gtgaatgttcactttctgttctcca

SEQ ID NO: 115801 - DNA, 25 bp, Homo sapien
tcactgttctgtttccacgggatgg

SEQ ID NO: 115802 - DNA, 25 bp, Homo sapien
attcatagcttatccttcagagcaa

SEQ ID NO: 115803 - DNA, 25 bp, Homo sapien
gcttatccttcagagcaatgacctg

SEQ ID NO: 115804 - DNA, 25 bp, Homo sapien
gcaatatcaaacatcagctaaccga

SEQ ID NO: 115805 - DNA, 25 bp, Homo sapien
gaaagagctttctgtcaaggaccgt

SEQ ID NO: 115806 - DNA, 25 bp, Homo sapien
ttctgtcaaggaccgtatcagggta

SEQ ID NO: 115807 - DNA, 25 bp, Homo sapien
tatcagggtaatgtgcttggtttgc

SEQ ID NO: 115808 - DNA, 25 bp, Homo sapien
gttattgccttaattctaattttat

SEQ ID NO: 115809 - DNA, 25 bp, Homo sapien
tttgttctctacatacaatcaatgt

SEQ ID NO: 115810 - DNA, 25 bp, Homo sapien
caatgtaaagccatatcacaatgat

SEQ ID NO: 115811 - DNA, 25 bp, Homo sapien
tgcaatgtttgtaaaccttcattct

SEQ ID NO: 115812 - DNA, 25 bp, Homo sapien
accttcattcttactagtttcattc

SEQ ID NO: 115813 - DNA, 25 bp, Homo sapien
ccctgtagttgacaattctgcatgt

SEQ ID NO: 115814 - DNA, 25 bp, Homo sapien
aattctgcatgtactagtcctctag

SEQ ID NO: 115815 - DNA, 25 bp, Homo sapien
aagcaacttgatggaaggatctctc

SEQ ID NO: 115816 - DNA, 25 bp, Homo sapien
aaggatctctccacagggcttgttt

SEQ ID NO: 115817 - DNA, 25 bp, Homo sapien
tccacagggcttgttttccaaagaa

SEQ ID NO: 115818 - DNA, 25 bp, Homo sapien
gagcaaagttaaaagcctacctaag

SEQ ID NO: 115819 - DNA, 25 bp, Homo sapien
aagcctacctaagcatatcgtaaag

SEQ ID NO: 115820 - DNA, 25 bp, Homo sapien
gcatatcgtaaagctgttcaaaaat

SEQ ID NO: 115821 - DNA, 25 bp, Homo sapien
aaataactcagacccagtcttgtgg

SEQ ID NO: 115822 - DNA, 25 bp, Homo sapien
cagacccagtcttgtggatggaaat

SEQ ID NO: 115823 - DNA, 25 bp, Homo sapien
gaaatgtagtgctcgagtcacattc

SEQ ID NO: 115824 - DNA, 25 bp, Homo sapien
tgttccttcatctccgaggccgaga

SEQ ID NO: 115825 - DNA, 25 bp, Homo sapien
aggccgagagcctctgccagaactg

SEQ ID NO: 115826 - DNA, 25 bp, Homo sapien
gcggtaccagaatgcgagatggact

SEQ ID NO: 115827 - DNA, 25 bp, Homo sapien
gagatggactggtgatcccattggt

SEQ ID NO: 115828 - DNA, 25 bp, Homo sapien
atcccattggtggagctgtcagcaa

SEQ ID NO: 115829 - DNA, 25 bp, Homo sapien
aagcaggtggcatttcatatcccat

SEQ ID NO: 115830 - DNA, 25 bp, Homo sapien
ggtggcatttcatatcccatttgaa

SEQ ID NO: 115831 - DNA, 25 bp, Homo sapien
ttcatatcccatttgaagtggtgga

SEQ ID NO: 115832 - DNA, 25 bp, Homo sapien
gaaagtttacccaccagtgcctgag

SEQ ID NO: 115833 - DNA, 25 bp, Homo sapien
gctacagctccgaattgctttttgg

SEQ ID NO: 115834 - DNA, 25 bp, Homo sapien
tgctttttggagcttccctgagaat

SEQ ID NO: 115835 - DNA, 25 bp, Homo sapien
ttaaaggtgtcttcatcacagactc

SEQ ID NO: 115836 - DNA, 25 bp, Homo sapien
ttcatcacagactccctcaagcaag

SEQ ID NO: 115837 - DNA, 25 bp, Homo sapien
cagactccctcaagcaagctgtggg

SEQ ID NO: 115838 - DNA, 25 bp, Homo sapien
gcaatgtcttctctaacaagcagga

SEQ ID NO: 115839 - DNA, 25 bp, Homo sapien
taacaagcaggacccacttgagcgc

SEQ ID NO: 115840 - DNA, 25 bp, Homo sapien
aagttctctgagctcacctacctcg

SEQ ID NO: 115841 - DNA, 25 bp, Homo sapien
acctacctcgatgcattctggcgtg

SEQ ID NO: 115842 - DNA, 25 bp, Homo sapien
atgcattctggcgtgactacatcaa

SEQ ID NO: 115843 - DNA, 25 bp, Homo sapien
ggcgtgactacatcaatggctcttt

SEQ ID NO: 115844 - DNA, 25 bp, Homo sapien
aatggctctttattagaggcactta

SEQ ID NO: 115845 - DNA, 25 bp, Homo sapien
gaggcacttaaaggtgtcttcatca

SEQ ID NO: 115846 - DNA, 25 bp, Homo sapien
gggctaactggccccaggcggaggg

SEQ ID NO: 115847 - DNA, 25 bp, Homo sapien
cttggagcagagacggcagccccat

SEQ ID NO: 115848 - DNA, 25 bp, Homo sapien
gagcagagacggcagccccatcctt

SEQ ID NO: 115849 - DNA, 25 bp, Homo sapien
gcagcaccagcctgagccacagtgg

SEQ ID NO: 115850 - DNA, 25 bp, Homo sapien
cagcctgagccacagtggggcccat

SEQ ID NO: 115851 - DNA, 25 bp, Homo sapien
cagctggctgggtcgcccctcctcg

SEQ ID NO: 115852 - DNA, 25 bp, Homo sapien
gggcgcctgcgctcctctgcagcct

SEQ ID NO: 115853 - DNA, 25 bp, Homo sapien
ctgcgctcctctgcagcctgagctc

SEQ ID NO: 115854 - DNA, 25 bp, Homo sapien
tgcagcctgagctccaccctcccct

SEQ ID NO: 115855 - DNA, 25 bp, Homo sapien
accctcccctcttcttgcggcaccg

SEQ ID NO: 115856 - DNA, 25 bp, Homo sapien
cacggccgtccctgacttcccagct

SEQ ID NO: 115857 - DNA, 25 bp, Homo sapien
gatccaggagcagctgcgtgacgtc

SEQ ID NO: 115858 - DNA, 25 bp, Homo sapien
agcagctgcgtgacgtcatgttcta

SEQ ID NO: 115859 - DNA, 25 bp, Homo sapien
tgcgtgacgtcatgttctacctgga

SEQ ID NO: 115860 - DNA, 25 bp, Homo sapien
aagatcaaccatctgcctgccgaga

SEQ ID NO: 115861 - DNA, 25 bp, Homo sapien
gagggacagatcaacatcgccatgg

SEQ ID NO: 115862 - DNA, 25 bp, Homo sapien
ggacagatcaacatcgccatggcct

SEQ ID NO: 115863 - DNA, 25 bp, Homo sapien
cctccaggaagggccgcagcaagag

SEQ ID NO: 115864 - DNA, 25 bp, Homo sapien
gtgaccttcagagcaacagacatcc

SEQ ID NO: 115865 - DNA, 25 bp, Homo sapien
tgttctccctgacactgtgagagtg

SEQ ID NO: 115866 - DNA, 25 bp, Homo sapien
ctgtgagagtgtgctgggaccttca

SEQ ID NO: 115867 - DNA, 25 bp, Homo sapien
gagtgtgctgggaccttcagctaaa

SEQ ID NO: 115868 - DNA, 25 bp, Homo sapien
agggactactgatgttctgtgatac

SEQ ID NO: 115869 - DNA, 25 bp, Homo sapien
atacatcaggtttcagcacacaact

SEQ ID NO: 115870 - DNA, 25 bp, Homo sapien
ggtttcagcacacaacttacatttc

SEQ ID NO: 115871 - DNA, 25 bp, Homo sapien
aacttacatttctttgcctccaaat

SEQ ID NO: 115872 - DNA, 25 bp, Homo sapien
tatgatgttcatactttccctcttg

SEQ ID NO: 115873 - DNA, 25 bp, Homo sapien
tccctcttgtttgaaagtttctaat

SEQ ID NO: 115874 - DNA, 25 bp, Homo sapien
tcattaaatttagctggtaccaggt

SEQ ID NO: 115875 - DNA, 25 bp, Homo sapien
ggtaccaggttgatatgacttgtca

SEQ ID NO: 115876 - DNA, 25 bp, Homo sapien
gacttgtcaatattatggtcaactt

SEQ ID NO: 115877 - DNA, 25 bp, Homo sapien
taagtcttagttttcgtttgtgcct

SEQ ID NO: 115878 - DNA, 25 bp, Homo sapien
gttttcgtttgtgcctttgattaat

SEQ ID NO: 115879 - DNA, 25 bp, Homo sapien
tgcagccctggagacccggcaccat

SEQ ID NO: 115880 - DNA, 25 bp, Homo sapien
gcagccctggagacccggcaccatc

SEQ ID NO: 115881 - DNA, 25 bp, Homo sapien
cagccctggagacccggcaccatca

SEQ ID NO: 115882 - DNA, 25 bp, Homo sapien
agccctggagacccggcaccatcac

SEQ ID NO: 115883 - DNA, 25 bp, Homo sapien
gccctggagacccggcaccatcaca

SEQ ID NO: 115884 - DNA, 25 bp, Homo sapien
ccctggagacccggcaccatcacac

SEQ ID NO: 115885 - DNA, 25 bp, Homo sapien
cctggagacccggcaccatcacacc

SEQ ID NO: 115886 - DNA, 25 bp, Homo sapien
ctggagacccggcaccatcacaccc

SEQ ID NO: 115887 - DNA, 25 bp, Homo sapien
tggagacccggcaccatcacaccca

SEQ ID NO: 115888 - DNA, 25 bp, Homo sapien
cagctggctgggtcgcccctcctcg

SEQ ID NO: 115889 - DNA, 25 bp, Homo sapien
agctggctgggtcgcccctcctcgg

SEQ ID NO: 115890 - DNA, 25 bp, Homo sapien
tggctgggtcgcccctcctcgggcg

SEQ ID NO: 115891 - DNA, 25 bp, Homo sapien
gctgggtcgcccctcctcgggcgcc

SEQ ID NO: 115892 - DNA, 25 bp, Homo sapien
gggcgcctgcgctcctctgcagcct

SEQ ID NO: 115893 - DNA, 25 bp, Homo sapien
tgcagcctgagctccaccctcccct

SEQ ID NO: 115894 - DNA, 25 bp, Homo sapien
cctcccctcttcttgcggcaccgcc

SEQ ID NO: 115895 - DNA, 25 bp, Homo sapien
ctcccctcttcttgcggcaccgccc

SEQ ID NO: 115896 - DNA, 25 bp, Homo sapien
cttgaccccacacgccggggctggc

SEQ ID NO: 115897 - DNA, 25 bp, Homo sapien
gaccccacacgccggggctggccct

SEQ ID NO: 115898 - DNA, 25 bp, Homo sapien
cacggccgtccctgacttcccagct

SEQ ID NO: 115899 - DNA, 25 bp, Homo sapien
gggaaatagggtgcaacgcccatag

SEQ ID NO: 115900 - DNA, 25 bp, Homo sapien
ggaaatagggtgcaacgcccatagc

SEQ ID NO: 115901 - DNA, 25 bp, Homo sapien
gaaatagggtgcaacgcccatagcc

SEQ ID NO: 115902 - DNA, 25 bp, Homo sapien
aaatagggtgcaacgcccatagcct

SEQ ID NO: 115903 - DNA, 25 bp, Homo sapien
aatagggtgcaacgcccatagcctt

SEQ ID NO: 115904 - DNA, 25 bp, Homo sapien
atagggtgcaacgcccatagccttg

SEQ ID NO: 115905 - DNA, 25 bp, Homo sapien
tagggtgcaacgcccatagccttgg

SEQ ID NO: 115906 - DNA, 25 bp, Homo sapien
agggtgcaacgcccatagccttggg

SEQ ID NO: 115907 - DNA, 25 bp, Homo sapien
gagtgattcagcacacaggcgcagc

SEQ ID NO: 115908 - DNA, 25 bp, Homo sapien
ggagtaatatccttcaccttcagtg

SEQ ID NO: 115909 - DNA, 25 bp, Homo sapien
ttcaccttcagtgtgtaaccaagca

SEQ ID NO: 115910 - DNA, 25 bp, Homo sapien
gtaaccaagcacaaaaacagtatca

SEQ ID NO: 115911 - DNA, 25 bp, Homo sapien
gaatctgtgaatggttttccgttta

SEQ ID NO: 115912 - DNA, 25 bp, Homo sapien
gaatggttttccgtttactgtgatg

SEQ ID NO: 115913 - DNA, 25 bp, Homo sapien
tccgtttactgtgatgtgctactgt

SEQ ID NO: 115914 - DNA, 25 bp, Homo sapien
gtgctactgtaaatatacctcttta

SEQ ID NO: 115915 - DNA, 25 bp, Homo sapien
taattacttctggtctctttggtga

SEQ ID NO: 115916 - DNA, 25 bp, Homo sapien
ctggtctctttggtgacctgtttaa

SEQ ID NO: 115917 - DNA, 25 bp, Homo sapien
tggtgacctgtttaaatttgtgtac

SEQ ID NO: 115918 - DNA, 25 bp, Homo sapien
tctctttgtgccacctgcagaaagt

SEQ ID NO: 115919 - DNA, 25 bp, Homo sapien
aagcattatctcatcctgccgagcg

SEQ ID NO: 115920 - DNA, 25 bp, Homo sapien
tctcatcctgccgagcgaggaggag

SEQ ID NO: 115921 - DNA, 25 bp, Homo sapien
aggagggtcgcctgtacttcagcat

SEQ ID NO: 115922 - DNA, 25 bp, Homo sapien
gtcgcctgtacttcagcatggatga

SEQ ID NO: 115923 - DNA, 25 bp, Homo sapien
atggatgatggccagacccgcttca

SEQ ID NO: 115924 - DNA, 25 bp, Homo sapien
tggagttccaccagctgaaccgcgg

SEQ ID NO: 115925 - DNA, 25 bp, Homo sapien
tgaaccgcggcatcctgccgtgctt

SEQ ID NO: 115926 - DNA, 25 bp, Homo sapien
tgccgtgcttgctgcgccattgctg

SEQ ID NO: 115927 - DNA, 25 bp, Homo sapien
tgaccaggccgtggactggctcatg

SEQ ID NO: 115928 - DNA, 25 bp, Homo sapien
gtggactggctcatgcctcagcccg

SEQ ID NO: 115929 - DNA, 25 bp, Homo sapien
tagggtctcctgtagggcttatgac

SEQ ID NO: 115930 - DNA, 25 bp, Homo sapien
gggcttatgactgtgaatccttgat

SEQ ID NO: 115931 - DNA, 25 bp, Homo sapien
catgattttatgtgacgattcctag

SEQ ID NO: 115932 - DNA, 25 bp, Homo sapien
tgtgacgattcctaggagtccctgc

SEQ ID NO: 115933 - DNA, 25 bp, Homo sapien
ttctcctcggacctctgtgaatatt

SEQ ID NO: 115934 - DNA, 25 bp, Homo sapien
ctcggacctctgtgaatatttattc

SEQ ID NO: 115935 - DNA, 25 bp, Homo sapien
tattctatttatggttcccgggaag

SEQ ID NO: 115936 - DNA, 25 bp, Homo sapien
tgggcattttctgcctatgctggaa

SEQ ID NO: 115937 - DNA, 25 bp, Homo sapien
ttctgcctatgctggaatagctccc

SEQ ID NO: 115938 - DNA, 25 bp, Homo sapien
tatgctggaatagctccctcttctg

SEQ ID NO: 115939 - DNA, 25 bp, Homo sapien
tccctcttctggtcctggctcaggg

SEQ ID NO: 115940 - DNA, 25 bp, Homo sapien
gttctcatgtgtgtactattctatc

SEQ ID NO: 115941 - DNA, 25 bp, Homo sapien
ggttttcaaaccagtgggcacacag

SEQ ID NO: 115942 - DNA, 25 bp, Homo sapien
tccagcaccaatctctccatgtttt

SEQ ID NO: 115943 - DNA, 25 bp, Homo sapien
aatctctccatgttttccacagctc

SEQ ID NO: 115944 - DNA, 25 bp, Homo sapien
agccaacccaaatagcgcctgctat

SEQ ID NO: 115945 - DNA, 25 bp, Homo sapien
tgtccctctcttagtgttctttaat

SEQ ID NO: 115946 - DNA, 25 bp, Homo sapien
gttctttaatcagataactgcctgg

SEQ ID NO: 115947 - DNA, 25 bp, Homo sapien
aactgcctggaagcctttcatttta

SEQ ID NO: 115948 - DNA, 25 bp, Homo sapien
tggaagcctttcattttacacgccc

SEQ ID NO: 115949 - DNA, 25 bp, Homo sapien
attttacacgccctgaagcagtctt

SEQ ID NO: 115950 - DNA, 25 bp, Homo sapien
gcagtcttctttgctagttgaatta

SEQ ID NO: 115951 - DNA, 25 bp, Homo sapien
aatgcaggaagttcccaccttgact

SEQ ID NO: 115952 - DNA, 25 bp, Homo sapien
ccaccttgactatcccaaagattct

SEQ ID NO: 115953 - DNA, 25 bp, Homo sapien
aagcatttcattgtaatcagaccca

SEQ ID NO: 115954 - DNA, 25 bp, Homo sapien
ttccttactgaaaccctctacaaag

SEQ ID NO: 115955 - DNA, 25 bp, Homo sapien
caaaggcattagtcctatcttgtaa

SEQ ID NO: 115956 - DNA, 25 bp, Homo sapien
tatcttgtaaggtatctattcggac

SEQ ID NO: 115957 - DNA, 25 bp, Homo sapien
tattcggacagataacagaggcttc

SEQ ID NO: 115958 - DNA, 25 bp, Homo sapien
cagaggcttcctttcattacagtat

SEQ ID NO: 115959 - DNA, 25 bp, Homo sapien
tgtggaatattactgctgccctgat

SEQ ID NO: 115960 - DNA, 25 bp, Homo sapien
ctgctgccctgatgaagaagttcct

SEQ ID NO: 115961 - DNA, 25 bp, Homo sapien
tcctgaatctgagtcttgagtatga

SEQ ID NO: 115962 - DNA, 25 bp, Homo sapien
gaatacctgcagcttcaatgtcatt

SEQ ID NO: 115963 - DNA, 25 bp, Homo sapien
taatcgctgccccatgaagctgagc

SEQ ID NO: 115964 - DNA, 25 bp, Homo sapien
gtgatctacctgcacacttgcagca

SEQ ID NO: 115965 - DNA, 25 bp, Homo sapien
acttgcagcatgactgccccaagcg

SEQ ID NO: 115966 - DNA, 25 bp, Homo sapien
aagcggcgcctcaagtgcgagtttt

SEQ ID NO: 115967 - DNA, 25 bp, Homo sapien
tgcgagttttgtggctgtgacttca

SEQ ID NO: 115968 - DNA, 25 bp, Homo sapien
atgagagttctctgggctttggtta

SEQ ID NO: 115969 - DNA, 25 bp, Homo sapien
ctctgggctttggttatcccaagtt

SEQ ID NO: 115970 - DNA, 25 bp, Homo sapien
tcccaccaggacattcgaaagcgaa

SEQ ID NO: 115971 - DNA, 25 bp, Homo sapien
aagcgaaactatgtgcgggatgatg

SEQ ID NO: 115972 - DNA, 25 bp, Homo sapien
atgatgcagtcttcatccgtgctgc

SEQ ID NO: 115973 - DNA, 25 bp, Homo sapien
ttctgcagcagggttctgggatgtt

SEQ ID NO: 115974 - DNA, 25 bp, Homo sapien
gttttcagtggtcaaaatactctgt

SEQ ID NO: 115975 - DNA, 25 bp, Homo sapien
aatactctgtttagagcaagggctc

SEQ ID NO: 115976 - DNA, 25 bp, Homo sapien
gagcaagggctcagaaaacagaaat

SEQ ID NO: 115977 - DNA, 25 bp, Homo sapien
aaatactgtcatggaggtgctgaac

SEQ ID NO: 115978 - DNA, 25 bp, Homo sapien
tcatggaggtgctgaacacagggaa

SEQ ID NO: 115979 - DNA, 25 bp, Homo sapien
ggaaggtctggtacatattgggaat

SEQ ID NO: 115980 - DNA, 25 bp, Homo sapien
gggaattatgagcagaacaaatact

SEQ ID NO: 115981 - DNA, 25 bp, Homo sapien
caaagtataaagtgtagccatgtct

SEQ ID NO: 115982 - DNA, 25 bp, Homo sapien
gtgtagccatgtctagacaccatgt

SEQ ID NO: 115983 - DNA, 25 bp, Homo sapien
gtctagacaccatgttgtatcagaa

SEQ ID NO: 115984 - DNA, 25 bp, Homo sapien
gctgtaccctttaagatatccatct

SEQ ID NO: 115985 - DNA, 25 bp, Homo sapien
ttaaccctaatctttcacttgaaag

SEQ ID NO: 115986 - DNA, 25 bp, Homo sapien
gtataaaaagtttcacaggtcaata

SEQ ID NO: 115987 - DNA, 25 bp, Homo sapien
tttcacaggtcaataaacttagagg

SEQ ID NO: 115988 - DNA, 25 bp, Homo sapien
ataatcaagattttagggcttttat

SEQ ID NO: 115989 - DNA, 25 bp, Homo sapien
taatcattagttttagaggcattgt

SEQ ID NO: 115990 - DNA, 25 bp, Homo sapien
tagtttagtgtgtgtgcagagtcca

SEQ ID NO: 115991 - DNA, 25 bp, Homo sapien
tagtgtgtgtgcagagtccatttcc

SEQ ID NO: 115992 - DNA, 25 bp, Homo sapien
tgtgtgtgcagagtccatttcccac

SEQ ID NO: 115993 - DNA, 25 bp, Homo sapien
tgtgtgcagagtccatttcccacat

SEQ ID NO: 115994 - DNA, 25 bp, Homo sapien
tgcagagtccatttcccacatcttt

SEQ ID NO: 115995 - DNA, 25 bp, Homo sapien
gaaacatcaatccatcagaggcttt

SEQ ID NO: 115996 - DNA, 25 bp, Homo sapien
aacagcagtatttgaggtggcctga

SEQ ID NO: 115997 - DNA, 25 bp, Homo sapien
gtggcctgaggatctccaggatgtt

SEQ ID NO: 115998 - DNA, 25 bp, Homo sapien
ggatctccaggatgttggctggttt

SEQ ID NO: 115999 - DNA, 25 bp, Homo sapien
ggctggtttcttcataaactctctc

SEQ ID NO: 116000 - DNA, 25 bp, Homo sapien
ataacattccgttgcaaactgtagc

SEQ ID NO: 116001 - DNA, 25 bp, Homo sapien
aaactgtagcaaccatctcctaatc

SEQ ID NO: 116002 - DNA, 25 bp, Homo sapien
ggagcaatttccaacttatctcaag

SEQ ID NO: 116003 - DNA, 25 bp, Homo sapien
aagccacaaataactcttcactttg

SEQ ID NO: 116004 - DNA, 25 bp, Homo sapien
ctcttcactttgtatttgcaccaag

SEQ ID NO: 116005 - DNA, 25 bp, Homo sapien
gtatttgcaccaagttatcattttg

SEQ ID NO: 116006 - DNA, 25 bp, Homo sapien
gtgctgtacgccgacatcaagatgg

SEQ ID NO: 116007 - DNA, 25 bp, Homo sapien
gtgtggttaagttcgagtcgccaga

SEQ ID NO: 116008 - DNA, 25 bp, Homo sapien
ccgagagagcctgccggatgatgaa

SEQ ID NO: 116009 - DNA, 25 bp, Homo sapien
gccggatgatgaatggcatgaagct

SEQ ID NO: 116010 - DNA, 25 bp, Homo sapien
catgaagctgagtggccgagagatt

SEQ ID NO: 116011 - DNA, 25 bp, Homo sapien
gtggccgagagattgacgttcgaat

SEQ ID NO: 116012 - DNA, 25 bp, Homo sapien
gacgttcgaattgatagaaacgctt

SEQ ID NO: 116013 - DNA, 25 bp, Homo sapien
agaaacgcttaagcagttgcctttt

SEQ ID NO: 116014 - DNA, 25 bp, Homo sapien
ttgccttttttaaacatcgatacga

SEQ ID NO: 116015 - DNA, 25 bp, Homo sapien
atcgatacgagacctctgaatttgt

SEQ ID NO: 116016 - DNA, 25 bp, Homo sapien
attttaatttgttggctggatgtat

SEQ ID NO: 116017 - DNA, 25 bp, Homo sapien
agaccacatctctactagaacttaa

SEQ ID NO: 116018 - DNA, 25 bp, Homo sapien
gaccacatctctactagaacttaaa

SEQ ID NO: 116019 - DNA, 25 bp, Homo sapien
tagccaggcacggtgataaatgcct

SEQ ID NO: 116020 - DNA, 25 bp, Homo sapien
cacggtgataaatgcctgtagtccc

SEQ ID NO: 116021 - DNA, 25 bp, Homo sapien
gtcccagccactgaagccagaggat

SEQ ID NO: 116022 - DNA, 25 bp, Homo sapien
ggatcgattgaaccagggagatcat

SEQ ID NO: 116023 - DNA, 25 bp, Homo sapien
ttgaaccagggagatcatggtcaca

SEQ ID NO: 116024 - DNA, 25 bp, Homo sapien
gagatcatggtcacagtgaactatg

SEQ ID NO: 116025 - DNA, 25 bp, Homo sapien
gtgaactatgattacgccaacctgg

SEQ ID NO: 116026 - DNA, 25 bp, Homo sapien
gattacgccaacctgggtcacatag

SEQ ID NO: 116027 - DNA, 25 bp, Homo sapien
attacgccaacctgggtcacatagc

SEQ ID NO: 116028 - DNA, 25 bp, Homo sapien
tacgagcagctgaccgtgcccagga

SEQ ID NO: 116029 - DNA, 25 bp, Homo sapien
ggccacctcctaaaaggcccagaga

SEQ ID NO: 116030 - DNA, 25 bp, Homo sapien
ggcccagagagaagagccccactct

SEQ ID NO: 116031 - DNA, 25 bp, Homo sapien
cagagagaagagccccactctcaga

SEQ ID NO: 116032 - DNA, 25 bp, Homo sapien
tctcagaggccccaataccccatgg

SEQ ID NO: 116033 - DNA, 25 bp, Homo sapien
aataccccatggaccatgctgtctg

SEQ ID NO: 116034 - DNA, 25 bp, Homo sapien
ataccccatggaccatgctgtctgg

SEQ ID NO: 116035 - DNA, 25 bp, Homo sapien
ccatggaccatgctgtctggcacag

SEQ ID NO: 116036 - DNA, 25 bp, Homo sapien
atggaccatgctgtctggcacagcc

SEQ ID NO: 116037 - DNA, 25 bp, Homo sapien
tctggcacagcctgcacttgggggc

SEQ ID NO: 116038 - DNA, 25 bp, Homo sapien
cagcctgcacttgggggctcagcaa

SEQ ID NO: 116039 - DNA, 25 bp, Homo sapien
tcacactaacagttctcttctctat

SEQ ID NO: 116040 - DNA, 25 bp, Homo sapien
agttctcttctctatatgcctggtc

SEQ ID NO: 116041 - DNA, 25 bp, Homo sapien
atatgcctggtccatacacactaac

SEQ ID NO: 116042 - DNA, 25 bp, Homo sapien
gtaagtacacactctatttggtagt

SEQ ID NO: 116043 - DNA, 25 bp, Homo sapien
gaaatcttttctcatcccaatggat

SEQ ID NO: 116044 - DNA, 25 bp, Homo sapien
ggattgtcttataaatctcctggga

SEQ ID NO: 116045 - DNA, 25 bp, Homo sapien
taaatctcctgggatgcacactatc

SEQ ID NO: 116046 - DNA, 25 bp, Homo sapien
gatgcacactatccacttttgggaa

SEQ ID NO: 116047 - DNA, 25 bp, Homo sapien
cacttttgggaataacactgtagac

SEQ ID NO: 116048 - DNA, 25 bp, Homo sapien
gtagaccagggatagcaaataggct

SEQ ID NO: 116049 - DNA, 25 bp, Homo sapien
gaattctgagacctagtgcatgata

SEQ ID NO: 116050 - DNA, 25 bp, Homo sapien
aaacattgaccaggcagtgactgca

SEQ ID NO: 116051 - DNA, 25 bp, Homo sapien
tgactgcagccctggagacccggca

SEQ ID NO: 116052 - DNA, 25 bp, Homo sapien
gccatcgtccgcacggctggtggct

SEQ ID NO: 116053 - DNA, 25 bp, Homo sapien
tggctgggcagctgcctcggactcc

SEQ ID NO: 116054 - DNA, 25 bp, Homo sapien
cagctgcctcggactccaggaaagg

SEQ ID NO: 116055 - DNA, 25 bp, Homo sapien
agcctgccggctactgagtgctcca

SEQ ID NO: 116056 - DNA, 25 bp, Homo sapien
cggctactgagtgctccaggaggac

SEQ ID NO: 116057 - DNA, 25 bp, Homo sapien
ctgagtgctccaggaggacaaggct

SEQ ID NO: 116058 - DNA, 25 bp, Homo sapien
ggacaaggctgacaagcaatccagg

SEQ ID NO: 116059 - DNA, 25 bp, Homo sapien
agatactcaccaggaccaggaaggg

SEQ ID NO: 116060 - DNA, 25 bp, Homo sapien
gcagcacaataaatgaggccactgt

SEQ ID NO: 116061 - DNA, 25 bp, Homo sapien
ccccacagcagacctcaagtagaaa

SEQ ID NO: 116062 - DNA, 25 bp, Homo sapien
aaattgcccaatttttaccagctgg

SEQ ID NO: 116063 - DNA, 25 bp, Homo sapien
accagctggagggacacccttgggt

SEQ ID NO: 116064 - DNA, 25 bp, Homo sapien
ggtttttgtacgaagctatttaatg

SEQ ID NO: 116065 - DNA, 25 bp, Homo sapien
agctatttaatgagcctgtgtcttg

SEQ ID NO: 116066 - DNA, 25 bp, Homo sapien
tggaccatcacctggtgtctgtagg

SEQ ID NO: 116067 - DNA, 25 bp, Homo sapien
gtgtctgtaggtggacccggtctcc

SEQ ID NO: 116068 - DNA, 25 bp, Homo sapien
gtctcccacaggtgacatcaacctg

SEQ ID NO: 116069 - DNA, 25 bp, Homo sapien
caacctgagggtggcgtctttagag

SEQ ID NO: 116070 - DNA, 25 bp, Homo sapien
gtctttagagacaggcacatgggca

SEQ ID NO: 116071 - DNA, 25 bp, Homo sapien
tgttcccttcgcctctactgcgagg

SEQ ID NO: 116072 - DNA, 25 bp, Homo sapien
actgtggcttcacctccgagtctta

SEQ ID NO: 116073 - DNA, 25 bp, Homo sapien
ctgtggcttcacctccgagtcttac

SEQ ID NO: 116074 - DNA, 25 bp, Homo sapien
tgtggcttcacctccgagtcttacc

SEQ ID NO: 116075 - DNA, 25 bp, Homo sapien
gtggcttcacctccgagtcttacca

SEQ ID NO: 116076 - DNA, 25 bp, Homo sapien
ttcacctccgagtcttaccagcaag

SEQ ID NO: 116077 - DNA, 25 bp, Homo sapien
tcacctccgagtcttaccagcaagg

SEQ ID NO: 116078 - DNA, 25 bp, Homo sapien
cacctccgagtcttaccagcaaggg

SEQ ID NO: 116079 - DNA, 25 bp, Homo sapien
ctccgagtcttaccagcaaggggtc

SEQ ID NO: 116080 - DNA, 25 bp, Homo sapien
gtgctggtcagtgccctcgtgctga

SEQ ID NO: 116081 - DNA, 25 bp, Homo sapien
tggtcagtgccctcgtgctgatggc

SEQ ID NO: 116082 - DNA, 25 bp, Homo sapien
ggtcagtgccctcgtgctgatggcc

SEQ ID NO: 116083 - DNA, 25 bp, Homo sapien
ggaaaagattgctattgtcgtactc

SEQ ID NO: 116084 - DNA, 25 bp, Homo sapien
aaagattgctattgtcgtactcacc

SEQ ID NO: 116085 - DNA, 25 bp, Homo sapien
agattgctattgtcgtactcacctc

SEQ ID NO: 116086 - DNA, 25 bp, Homo sapien
ttgctattgtcgtactcacctccga

SEQ ID NO: 116087 - DNA, 25 bp, Homo sapien
tattgtcgtactcacctccgacgta

SEQ ID NO: 116088 - DNA, 25 bp, Homo sapien
ttgtcgtactcacctccgacgtact

SEQ ID NO: 116089 - DNA, 25 bp, Homo sapien
gtttgataccatttggctccttttt

SEQ ID NO: 116090 - DNA, 25 bp, Homo sapien
tttgataccatttggctcctttttt

SEQ ID NO: 116091 - DNA, 25 bp, Homo sapien
ttggcagaacagtcactgtccttgt

SEQ ID NO: 116092 - DNA, 25 bp, Homo sapien
aacagtcactgtccttgtaaagttt

SEQ ID NO: 116093 - DNA, 25 bp, Homo sapien
cagtcactgtccttgtaaagttttt

SEQ ID NO: 116094 - DNA, 25 bp, Homo sapien
ttaatttggtgcctgcaactttctt

SEQ ID NO: 116095 - DNA, 25 bp, Homo sapien
cttcctgggctatcacattataatg

SEQ ID NO: 116096 - DNA, 25 bp, Homo sapien
cacattataatgctcttggcctctt

SEQ ID NO: 116097 - DNA, 25 bp, Homo sapien
aatgctcttggcctcttttttgctg

SEQ ID NO: 116098 - DNA, 25 bp, Homo sapien
ggccaagtaccaatgttggctgtta

SEQ ID NO: 116099 - DNA, 25 bp, Homo sapien
ttggctgttagaagggattctgttc

SEQ ID NO: 116100 - DNA, 25 bp, Homo sapien
tttaagttgtgtggtcagtaggtgc

SEQ ID NO: 116101 - DNA, 25 bp, Homo sapien
cggtgtctagggtagtgaatcctgt

SEQ ID NO: 116102 - DNA, 25 bp, Homo sapien
gaatcctgtaagttcaaatttatga

SEQ ID NO: 116103 - DNA, 25 bp, Homo sapien
tgattaggtgacgagttgacattga

SEQ ID NO: 116104 - DNA, 25 bp, Homo sapien
gacattgagattgtccttttcccct

SEQ ID NO: 116105 - DNA, 25 bp, Homo sapien
atgcaaataaccattgtcataagaa

SEQ ID NO: 116106 - DNA, 25 bp, Homo sapien
gaatgtttatgaatagtttccaaat

SEQ ID NO: 116107 - DNA, 25 bp, Homo sapien
gtttccaaattatggcaaattcatg

SEQ ID NO: 116108 - DNA, 25 bp, Homo sapien
tatggcaaattcatgtagagagaga

SEQ ID NO: 116109 - DNA, 25 bp, Homo sapien
agtctactttacctaagggctgtca

SEQ ID NO: 116110 - DNA, 25 bp, Homo sapien
gtctactttacctaagggctgtcag

SEQ ID NO: 116111 - DNA, 25 bp, Homo sapien
tactttacctaagggctgtcagata

SEQ ID NO: 116112 - DNA, 25 bp, Homo sapien
ttacctaagggctgtcagatataag

SEQ ID NO: 116113 - DNA, 25 bp, Homo sapien
agggctgtcagatataagtaactta

SEQ ID NO: 116114 - DNA, 25 bp, Homo sapien
ggctgtcagatataagtaacttaaa

SEQ ID NO: 116115 - DNA, 25 bp, Homo sapien
aatatgaaaagaatcggcaatgttt

SEQ ID NO: 116116 - DNA, 25 bp, Homo sapien
gaggagcctgtttttgtgagagact

SEQ ID NO: 116117 - DNA, 25 bp, Homo sapien
gtgagagacttttgccttcgtaatg

SEQ ID NO: 116118 - DNA, 25 bp, Homo sapien
gccttcgtaatgttaaccgtttcag

SEQ ID NO: 116119 - DNA, 25 bp, Homo sapien
gtttcaggaccacgtttatagcttc

SEQ ID NO: 116120 - DNA, 25 bp, Homo sapien
cacgtttatagcttcaggacctggc

SEQ ID NO: 116121 - DNA, 25 bp, Homo sapien
aggacctggctacgtaattatactt

SEQ ID NO: 116122 - DNA, 25 bp, Homo sapien
ggccaattttagtcttgctgtttct

SEQ ID NO: 116123 - DNA, 25 bp, Homo sapien
agtcttgctgtttcttgatgctcac

SEQ ID NO: 116124 - DNA, 25 bp, Homo sapien
ttgatgctcacctctatattagttt

SEQ ID NO: 116125 - DNA, 25 bp, Homo sapien
aaatgacctcagatctttgcaccag

SEQ ID NO: 116126 - DNA, 25 bp, Homo sapien
ctttgcaccagatactcatcatata

SEQ ID NO: 116127 - DNA, 25 bp, Homo sapien
agaccacatctctactagaacttaa

SEQ ID NO: 116128 - DNA, 25 bp, Homo sapien
gaccacatctctactagaacttaaa

SEQ ID NO: 116129 - DNA, 25 bp, Homo sapien
ccacatctctactagaacttaaaaa

SEQ ID NO: 116130 - DNA, 25 bp, Homo sapien
tagccaggcacggtgataaatgcct

SEQ ID NO: 116131 - DNA, 25 bp, Homo sapien
aggatcgattgaaccagggagatca

SEQ ID NO: 116132 - DNA, 25 bp, Homo sapien
atcgattgaaccagggagatcatgg

SEQ ID NO: 116133 - DNA, 25 bp, Homo sapien
ttgaaccagggagatcatggtcaca

SEQ ID NO: 116134 - DNA, 25 bp, Homo sapien
gagatcatggtcacagtgaactatg

SEQ ID NO: 116135 - DNA, 25 bp, Homo sapien
gatcatggtcacagtgaactatgat

SEQ ID NO: 116136 - DNA, 25 bp, Homo sapien
gattacgccaacctgggtcacatag

SEQ ID NO: 116137 - DNA, 25 bp, Homo sapien
attacgccaacctgggtcacatagc

SEQ ID NO: 116138 - DNA, 25 bp, Homo sapien
accagcggaatttatgcgtatgatt

SEQ ID NO: 116139 - DNA, 25 bp, Homo sapien
atgcgtatgattggcaatgacaaac

SEQ ID NO: 116140 - DNA, 25 bp, Homo sapien
acaaggacagatgatcgtgttccat

SEQ ID NO: 116141 - DNA, 25 bp, Homo sapien
gatgatcgtgttccatttgatagaa

SEQ ID NO: 116142 - DNA, 25 bp, Homo sapien
ccaagaccagatggatgcccagatg

SEQ ID NO: 116143 - DNA, 25 bp, Homo sapien
ggatgcccagatgagatctatatga

SEQ ID NO: 116144 - DNA, 25 bp, Homo sapien
aataatgtaaatcaacgcccctcct

SEQ ID NO: 116145 - DNA, 25 bp, Homo sapien
ctcctttagggatctagctcttcga

SEQ ID NO: 116146 - DNA, 25 bp, Homo sapien
ggatctagctcttcgagtggatcaa

SEQ ID NO: 116147 - DNA, 25 bp, Homo sapien
taagggataacatggctggatgaaa

SEQ ID NO: 116148 - DNA, 25 bp, Homo sapien
aatgaccttcattctgagaccaaag

SEQ ID NO: 116149 - DNA, 25 bp, Homo sapien
tgtgcgttctgcatagaattcaaac

SEQ ID NO: 116150 - DNA, 25 bp, Homo sapien
aacgagattcacccagcgcgaggag

SEQ ID NO: 116151 - DNA, 25 bp, Homo sapien
aagaaacagcagttcctgggaacca

SEQ ID NO: 116152 - DNA, 25 bp, Homo sapien
agttcctgggaaccacaattatggg

SEQ ID NO: 116153 - DNA, 25 bp, Homo sapien
gggtgtgatctgagtgcctcaagat

SEQ ID NO: 116154 - DNA, 25 bp, Homo sapien
gagtgcctcaagatggttttcaaaa

SEQ ID NO: 116155 - DNA, 25 bp, Homo sapien
gtatacgtgtcaacacagctggctg

SEQ ID NO: 116156 - DNA, 25 bp, Homo sapien
cacagctggctggatgattgggact

SEQ ID NO: 116157 - DNA, 25 bp, Homo sapien
tggatgattgggactttaaaacgac

SEQ ID NO: 116158 - DNA, 25 bp, Homo sapien
accctctttcaggtggattcagaga

SEQ ID NO: 116159 - DNA, 25 bp, Homo sapien
gagacctgtcctgtatataacagca

SEQ ID NO: 116160 - DNA, 25 bp, Homo sapien
aatggataccagaattttatttttg

SEQ ID NO: 116161 - DNA, 25 bp, Homo sapien
tatgttcatagtacttttcctcttg

SEQ ID NO: 116162 - DNA, 25 bp, Homo sapien
tttcctcttgtctactccagacagt

SEQ ID NO: 116163 - DNA, 25 bp, Homo sapien
gtctactccagacagttattccata

SEQ ID NO: 116164 - DNA, 25 bp, Homo sapien
gacagttattccataaagcatttgt

SEQ ID NO: 116165 - DNA, 25 bp, Homo sapien
aaatgttttgttgaagtatatggct

SEQ ID NO: 116166 - DNA, 25 bp, Homo sapien
gtatatggctatcatgactaagtgc

SEQ ID NO: 116167 - DNA, 25 bp, Homo sapien
ggctatcatgactaagtgctagaat

SEQ ID NO: 116168 - DNA, 25 bp, Homo sapien
aatttatagttacaggcggtgtcct

SEQ ID NO: 116169 - DNA, 25 bp, Homo sapien
tacaggcggtgtccttttaaatgtg

SEQ ID NO: 116170 - DNA, 25 bp, Homo sapien
aactggacctgtattatcctgaata

SEQ ID NO: 116171 - DNA, 25 bp, Homo sapien
gaaagagcaaaggttcctgtaaatt

SEQ ID NO: 116172 - DNA, 25 bp, Homo sapien
ttagggctagatttgagctgcttgt

SEQ ID NO: 116173 - DNA, 25 bp, Homo sapien
gagctgcttgtaagtcacaggtttt

SEQ ID NO: 116174 - DNA, 25 bp, Homo sapien
gtcacaggttttccagatgtctgcc

SEQ ID NO: 116175 - DNA, 25 bp, Homo sapien
caggttttccagatgtctgccaaca

SEQ ID NO: 116176 - DNA, 25 bp, Homo sapien
gatgtctgccaacaagaaatgactc

SEQ ID NO: 116177 - DNA, 25 bp, Homo sapien
agaaatgactcatactgtgatgata

SEQ ID NO: 116178 - DNA, 25 bp, Homo sapien
gctttgccttgtggacaatgtgggt

SEQ ID NO: 116179 - DNA, 25 bp, Homo sapien
ccttgtggacaatgtgggtttttga

SEQ ID NO: 116180 - DNA, 25 bp, Homo sapien
atgtgtggcatatacttatttcttg

SEQ ID NO: 116181 - DNA, 25 bp, Homo sapien
ggcatatacttatttcttgagagaa

SEQ ID NO: 116182 - DNA, 25 bp, Homo sapien
cgtctcggagaaccagtcgctgctg

SEQ ID NO: 116183 - DNA, 25 bp, Homo sapien
ctcggagaaccagtcgctgctgcgg

SEQ ID NO: 116184 - DNA, 25 bp, Homo sapien
tgtggccatgtccatggccctgcac

SEQ ID NO: 116185 - DNA, 25 bp, Homo sapien
tcattttccaggtgaccccactgag

SEQ ID NO: 116186 - DNA, 25 bp, Homo sapien
attttccaggtgaccccactgagcg

SEQ ID NO: 116187 - DNA, 25 bp, Homo sapien
gggtggtggtgctccagatatctct

SEQ ID NO: 116188 - DNA, 25 bp, Homo sapien
gtggtggtgctccagatatctctgc

SEQ ID NO: 116189 - DNA, 25 bp, Homo sapien
tggtgctccagatatctctgcctgt

SEQ ID NO: 116190 - DNA, 25 bp, Homo sapien
tgctccagatatctctgcctgtcat

SEQ ID NO: 116191 - DNA, 25 bp, Homo sapien
agatatctctgcctgtcatcctgct

SEQ ID NO: 116192 - DNA, 25 bp, Homo sapien
atatctctgcctgtcatcctgctgg

SEQ ID NO: 116193 - DNA, 25 bp, Homo sapien
tttgcctgttcatttgccatggaga

SEQ ID NO: 116194 - DNA, 25 bp, Homo sapien
ttgcctgttcatttgccatggagag

SEQ ID NO: 116195 - DNA, 25 bp, Homo sapien
tgcctgttcatttgccatggagagg

SEQ ID NO: 116196 - DNA, 25 bp, Homo sapien
gcctgttcatttgccatggagaggg

SEQ ID NO: 116197 - DNA, 25 bp, Homo sapien
ctgttcatttgccatggagagggct

SEQ ID NO: 116198 - DNA, 25 bp, Homo sapien
tgttcatttgccatggagagggctg

SEQ ID NO: 116199 - DNA, 25 bp, Homo sapien
ttcatttgccatggagagggctggg

SEQ ID NO: 116200 - DNA, 25 bp, Homo sapien
catttgccatggagagggctgggaa

SEQ ID NO: 116201 - DNA, 25 bp, Homo sapien
ttgccatggagagggctgggaatcc

SEQ ID NO: 116202 - DNA, 25 bp, Homo sapien
agagggctgggaatccaggtgcggt

SEQ ID NO: 116203 - DNA, 25 bp, Homo sapien
gggctgggaatccaggtgcggtggc

SEQ ID NO: 116204 - DNA, 25 bp, Homo sapien
attaaatatatgacctctctgcctt

SEQ ID NO: 116205 - DNA, 25 bp, Homo sapien
atatatgacctctctgccttatttt

SEQ ID NO: 116206 - DNA, 25 bp, Homo sapien
gacctctctgccttattttagaact

SEQ ID NO: 116207 - DNA, 25 bp, Homo sapien
tctgccttattttagaacttactac

SEQ ID NO: 116208 - DNA, 25 bp, Homo sapien
gaacttactacatttcaataaaact

SEQ ID NO: 116209 - DNA, 25 bp, Homo sapien
ttaaaaaatccagacattgcctatg

SEQ ID NO: 116210 - DNA, 25 bp, Homo sapien
tataatcggcccttaaagaggcagg

SEQ ID NO: 116211 - DNA, 25 bp, Homo sapien
ctcatttctacttcagggcctcttg

SEQ ID NO: 116212 - DNA, 25 bp, Homo sapien
ctacttcagggcctcttgaaacttc

SEQ ID NO: 116213 - DNA, 25 bp, Homo sapien
gaaacttcagataatgagagcagcc

SEQ ID NO: 116214 - DNA, 25 bp, Homo sapien
gagagcagccaaccctgcaagtcag

SEQ ID NO: 116215 - DNA, 25 bp, Homo sapien
ttgtattgtggtgcagaactggatt

SEQ ID NO: 116216 - DNA, 25 bp, Homo sapien
attgtggtgcagaactggattttct

SEQ ID NO: 116217 - DNA, 25 bp, Homo sapien
aatccacagttttaaaggcaataat

SEQ ID NO: 116218 - DNA, 25 bp, Homo sapien
ttcttttacatattttgctgtgcaa

SEQ ID NO: 116219 - DNA, 25 bp, Homo sapien
gttttatatcttgagttactaacta

SEQ ID NO: 116220 - DNA, 25 bp, Homo sapien
gagttactaactaaccacgcgtgtt

SEQ ID NO: 116221 - DNA, 25 bp, Homo sapien
gttactaactaaccacgcgtgttgt

SEQ ID NO: 116222 - DNA, 25 bp, Homo sapien
aactaaccacgcgtgttgttcctat

SEQ ID NO: 116223 - DNA, 25 bp, Homo sapien
taaccacgcgtgttgttcctatgtg

SEQ ID NO: 116224 - DNA, 25 bp, Homo sapien
acgcgtgttgttcctatgtgctttt

SEQ ID NO: 116225 - DNA, 25 bp, Homo sapien
gtgttgttcctatgtgcttttcttt

SEQ ID NO: 116226 - DNA, 25 bp, Homo sapien
atccagaccgacttccgctgctgtg

SEQ ID NO: 116227 - DNA, 25 bp, Homo sapien
gtctccaactacactgactggttcg

SEQ ID NO: 116228 - DNA, 25 bp, Homo sapien
gactggttcgaggtgtacaacgcca

SEQ ID NO: 116229 - DNA, 25 bp, Homo sapien
tgtacaacgccacgcgggtacctga

SEQ ID NO: 116230 - DNA, 25 bp, Homo sapien
ctgctgcttggagttcagtgagagc

SEQ ID NO: 116231 - DNA, 25 bp, Homo sapien
cacctggtggaaggcgccgtgctac

SEQ ID NO: 116232 - DNA, 25 bp, Homo sapien
ggcttcaggagaacctgctggctgt

SEQ ID NO: 116233 - DNA, 25 bp, Homo sapien
gcatctttgggctgtgcacggcgct

SEQ ID NO: 116234 - DNA, 25 bp, Homo sapien
cgctggtgcagatcctgggcctgac

SEQ ID NO: 116235 - DNA, 25 bp, Homo sapien
tgaccttcgccatgaccatgtactg

SEQ ID NO: 116236 - DNA, 25 bp, Homo sapien
accatgtactgccaagtggtcaagg

SEQ ID NO: 116237 - DNA, 25 bp, Homo sapien
aacctagcactaggtcttgtggttt

SEQ ID NO: 116238 - DNA, 25 bp, Homo sapien
aggtcttgtggtttgtctgccttca

SEQ ID NO: 116239 - DNA, 25 bp, Homo sapien
gtttgtctgccttcactggacttgc

SEQ ID NO: 116240 - DNA, 25 bp, Homo sapien
ctggacttgcccagataatcttcct

SEQ ID NO: 116241 - DNA, 25 bp, Homo sapien
tcttcctttttgaggcagctatata

SEQ ID NO: 116242 - DNA, 25 bp, Homo sapien
ggtttctataacaacatctcttact

SEQ ID NO: 116243 - DNA, 25 bp, Homo sapien
catctcttactatttttacttgaaa

SEQ ID NO: 116244 - DNA, 25 bp, Homo sapien
aaatgttttgcgtagcagactgtca

SEQ ID NO: 116245 - DNA, 25 bp, Homo sapien
gcgtagcagactgtcatagccttga

SEQ ID NO: 116246 - DNA, 25 bp, Homo sapien
gactgtcatagccttgaacgccggc

SEQ ID NO: 116247 - DNA, 25 bp, Homo sapien
gggctgttgatttccgcagagctgg

SEQ ID NO: 116248 - DNA, 25 bp, Homo sapien
atcattgtcttggatcagggtaagg

SEQ ID NO: 116249 - DNA, 25 bp, Homo sapien
ttggatcagggtaaggtagccgaac

SEQ ID NO: 116250 - DNA, 25 bp, Homo sapien
gtacccaccatggtttgcttgctaa

SEQ ID NO: 116251 - DNA, 25 bp, Homo sapien
gtttgcttgctaaccctcatagtat

SEQ ID NO: 116252 - DNA, 25 bp, Homo sapien
gctaaccctcatagtatctattcag

SEQ ID NO: 116253 - DNA, 25 bp, Homo sapien
tgtggcatacacagagcagccgtgt

SEQ ID NO: 116254 - DNA, 25 bp, Homo sapien
gcagccgtgtgcagaaccatgataa

SEQ ID NO: 116255 - DNA, 25 bp, Homo sapien
gtgcagaaccatgataaccccaaat

SEQ ID NO: 116256 - DNA, 25 bp, Homo sapien
aaggctgtggaaactgttcgtgcta

SEQ ID NO: 116257 - DNA, 25 bp, Homo sapien
gaaactgttcgtgctaagtcacata

SEQ ID NO: 116258 - DNA, 25 bp, Homo sapien
gttttggactacatatttgcactga

SEQ ID NO: 116259 - DNA, 25 bp, Homo sapien
atatatgtatagtcaccagtgtttg

SEQ ID NO: 116260 - DNA, 25 bp, Homo sapien
tatagtcaccagtgtttgtttaaca

SEQ ID NO: 116261 - DNA, 25 bp, Homo sapien
aacactatggtgtgtccttctgaga

SEQ ID NO: 116262 - DNA, 25 bp, Homo sapien
atggtgtgtccttctgagatgtttt

SEQ ID NO: 116263 - DNA, 25 bp, Homo sapien
gagatgttttccatagttcttgtca

SEQ ID NO: 116264 - DNA, 25 bp, Homo sapien
gttttccatagttcttgtcattaaa

SEQ ID NO: 116265 - DNA, 25 bp, Homo sapien
gttcttgtcattaaatctcatgaag

SEQ ID NO: 116266 - DNA, 25 bp, Homo sapien
atctcatgaaggaatgtgatgccac

SEQ ID NO: 116267 - DNA, 25 bp, Homo sapien
gtgatgccactagagaaggctcaca

SEQ ID NO: 116268 - DNA, 25 bp, Homo sapien
ttagatgacggatttttcaaccgga

SEQ ID NO: 116269 - DNA, 25 bp, Homo sapien
tttcaaccggaaaaggcaaacatga

SEQ ID NO: 116270 - DNA, 25 bp, Homo sapien
gttactactggtgtctatgcaaatt

SEQ ID NO: 116271 - DNA, 25 bp, Homo sapien
ggtgtctatgcaaattggattccat

SEQ ID NO: 116272 - DNA, 25 bp, Homo sapien
gaagttttagctatgttatttacaa

SEQ ID NO: 116273 - DNA, 25 bp, Homo sapien
tatttacaatgcaggattttacaga

SEQ ID NO: 116274 - DNA, 25 bp, Homo sapien
aatagatgctgattcatgcagatgt

SEQ ID NO: 116275 - DNA, 25 bp, Homo sapien
ttcatgcagatgtagtactaagtct

SEQ ID NO: 116276 - DNA, 25 bp, Homo sapien
gaaatactgactactttgatgaaac

SEQ ID NO: 116277 - DNA, 25 bp, Homo sapien
gactactttgatgaaactgctggtt

SEQ ID NO: 116278 - DNA, 25 bp, Homo sapien
aatgtcatgcaaaactccactttca

SEQ ID NO: 116279 - DNA, 25 bp, Homo sapien
aactccactttcaatcttttatatc

SEQ ID NO: 116280 - DNA, 25 bp, Homo sapien
aatcgatacctataacaattagtgt

SEQ ID NO: 116281 - DNA, 25 bp, Homo sapien
agcttctgcccaacgtcacgacagt

SEQ ID NO: 116282 - DNA, 25 bp, Homo sapien
gcttctgcccaacgtcacgacagtg

SEQ ID NO: 116283 - DNA, 25 bp, Homo sapien
ttctgcccaacgtcacgacagtgga

SEQ ID NO: 116284 - DNA, 25 bp, Homo sapien
tctgcccaacgtcacgacagtggag

SEQ ID NO: 116285 - DNA, 25 bp, Homo sapien
ctgcccaacgtcacgacagtggaga

SEQ ID NO: 116286 - DNA, 25 bp, Homo sapien
tgcccaacgtcacgacagtggagag

SEQ ID NO: 116287 - DNA, 25 bp, Homo sapien
gcccaacgtcacgacagtggagaga

SEQ ID NO: 116288 - DNA, 25 bp, Homo sapien
cccaacgtcacgacagtggagagaa

SEQ ID NO: 116289 - DNA, 25 bp, Homo sapien
ccaacgtcacgacagtggagagaaa

SEQ ID NO: 116290 - DNA, 25 bp, Homo sapien
aaattgagattacactggcataaac

SEQ ID NO: 116291 - DNA, 25 bp, Homo sapien
gattacactggcataaactctagtt

SEQ ID NO: 116292 - DNA, 25 bp, Homo sapien
aaactctagtttgcacagttcacag

SEQ ID NO: 116293 - DNA, 25 bp, Homo sapien
ctagtttgcacagttcacagctact

SEQ ID NO: 116294 - DNA, 25 bp, Homo sapien
acagttcacagctactacttgtgca

SEQ ID NO: 116295 - DNA, 25 bp, Homo sapien
gacagcacatcatctaaatcccatt

SEQ ID NO: 116296 - DNA, 25 bp, Homo sapien
cacatcatctaaatcccattccaaa

SEQ ID NO: 116297 - DNA, 25 bp, Homo sapien
gttagctgtgaatttaccctgtaca

SEQ ID NO: 116298 - DNA, 25 bp, Homo sapien
ttaccctgtacagctgtatctctat

SEQ ID NO: 116299 - DNA, 25 bp, Homo sapien
atttttatgaaacgtaccactatgg

SEQ ID NO: 116300 - DNA, 25 bp, Homo sapien
gaaacgtaccactatggataaatta

SEQ ID NO: 116301 - DNA, 25 bp, Homo sapien
aatcattgttaattgctgaggcatg

SEQ ID NO: 116302 - DNA, 25 bp, Homo sapien
gccttattttacctcgagaattgtt

SEQ ID NO: 116303 - DNA, 25 bp, Homo sapien
tacctcgagaattgttaccttaaat

SEQ ID NO: 116304 - DNA, 25 bp, Homo sapien
taaattagtacagcactttcttctt

SEQ ID NO: 116305 - DNA, 25 bp, Homo sapien
cactttcttcttcccatggtgcttt

SEQ ID NO: 116306 - DNA, 25 bp, Homo sapien
ttcttcccatggtgctttcctgttt

SEQ ID NO: 116307 - DNA, 25 bp, Homo sapien
ttcctgtttctcagtctcacatttc

SEQ ID NO: 116308 - DNA, 25 bp, Homo sapien
tgtttctcagtctcacatttctcaa

SEQ ID NO: 116309 - DNA, 25 bp, Homo sapien
tcagtctcacatttctcaacaaggc

SEQ ID NO: 116310 - DNA, 25 bp, Homo sapien
gtctcacatttctcaacaaggcaaa

SEQ ID NO: 116311 - DNA, 25 bp, Homo sapien
aacaaagagcgttgaagttgactct

SEQ ID NO: 116312 - DNA, 25 bp, Homo sapien
gggtaatcaccttaaaatgtcatca

SEQ ID NO: 116313 - DNA, 25 bp, Homo sapien
tagatctactagaaggcagcatcac

SEQ ID NO: 116314 - DNA, 25 bp, Homo sapien
tagaaggcagcatcacattcccatc

SEQ ID NO: 116315 - DNA, 25 bp, Homo sapien
catcacattcccatcttacttatgg

SEQ ID NO: 116316 - DNA, 25 bp, Homo sapien
ttacttatggactcctacccctggt

SEQ ID NO: 116317 - DNA, 25 bp, Homo sapien
tacccctggttcatgtcttatatgc

SEQ ID NO: 116318 - DNA, 25 bp, Homo sapien
catgtcttatatgcctgtaatggtt

SEQ ID NO: 116319 - DNA, 25 bp, Homo sapien
aatggttataaagcctaccttcagg

SEQ ID NO: 116320 - DNA, 25 bp, Homo sapien
taccttcaggaaagctatggttgac

SEQ ID NO: 116321 - DNA, 25 bp, Homo sapien
ggatgggttttaaacatgtccctct

SEQ ID NO: 116322 - DNA, 25 bp, Homo sapien
aaacatgtccctctacaataaatta

SEQ ID NO: 116323 - DNA, 25 bp, Homo sapien
gtactgtggagttttaacattttgt

SEQ ID NO: 116324 - DNA, 25 bp, Homo sapien
gtggagttttaacattttgtcctct

SEQ ID NO: 116325 - DNA, 25 bp, Homo sapien
tttaacattttgtcctcttttcagt

SEQ ID NO: 116326 - DNA, 25 bp, Homo sapien
cctcttttcagtgaaacagagtaaa

SEQ ID NO: 116327 - DNA, 25 bp, Homo sapien
gagtaaaaatattcatctaccatta

SEQ ID NO: 116328 - DNA, 25 bp, Homo sapien
aatattcatctaccattactgttat

SEQ ID NO: 116329 - DNA, 25 bp, Homo sapien
catctaccattactgttatttgctg

SEQ ID NO: 116330 - DNA, 25 bp, Homo sapien
ctaccattactgttatttgctgatt

SEQ ID NO: 116331 - DNA, 25 bp, Homo sapien
tgatggtaatattctatccttatga

SEQ ID NO: 116332 - DNA, 25 bp, Homo sapien
atcttggctttagtaggtatagaag

SEQ ID NO: 116333 - DNA, 25 bp, Homo sapien
agcattatatgctagtagaatctag

SEQ ID NO: 116334 - DNA, 25 bp, Homo sapien
acacctccttgtgataacggacaat

SEQ ID NO: 116335 - DNA, 25 bp, Homo sapien
aaatgagcctgctccaagttttcct

SEQ ID NO: 116336 - DNA, 25 bp, Homo sapien
agtgaggccttttgctggattggtc

SEQ ID NO: 116337 - DNA, 25 bp, Homo sapien
ttggtctgaggaacaattctggctg

SEQ ID NO: 116338 - DNA, 25 bp, Homo sapien
ggtgggaagatggatcacctctaaa

SEQ ID NO: 116339 - DNA, 25 bp, Homo sapien
tcttctaatagctttgtgcagacat

SEQ ID NO: 116340 - DNA, 25 bp, Homo sapien
gcagacatgcggtgccatcaacaaa

SEQ ID NO: 116341 - DNA, 25 bp, Homo sapien
tggtcttcaagcctcaagctgtgaa

SEQ ID NO: 116342 - DNA, 25 bp, Homo sapien
agctgtgaagttcctttacactggg

SEQ ID NO: 116343 - DNA, 25 bp, Homo sapien
agactttgatagatgaccactctgt

SEQ ID NO: 116344 - DNA, 25 bp, Homo sapien
cctcagatctgtcatgtatccctaa

SEQ ID NO: 116345 - DNA, 25 bp, Homo sapien
aatcaatgaaaaagaggccttgttt

SEQ ID NO: 116346 - DNA, 25 bp, Homo sapien
gccttgtttatatatgggtagcttc

SEQ ID NO: 116347 - DNA, 25 bp, Homo sapien
tgggtagcttcacatttaatttata

SEQ ID NO: 116348 - DNA, 25 bp, Homo sapien
aaactgtgagcccataaaacagtat

SEQ ID NO: 116349 - DNA, 25 bp, Homo sapien
gttacaactgtagcaaattttcctt

SEQ ID NO: 116350 - DNA, 25 bp, Homo sapien
aaaatccaggcaatggcattaaaca

SEQ ID NO: 116351 - DNA, 25 bp, Homo sapien
aaacattcttgctatcatttaccat

SEQ ID NO: 116352 - DNA, 25 bp, Homo sapien
tcatttaccatggatttcctacatt

SEQ ID NO: 116353 - DNA, 25 bp, Homo sapien
tttcctacatttctgagatccctgt

SEQ ID NO: 116354 - DNA, 25 bp, Homo sapien
gagatccctgtattcaaaaacaaat

SEQ ID NO: 116355 - DNA, 25 bp, Homo sapien
gacagggttgttaagttgtactata

SEQ ID NO: 116356 - DNA, 25 bp, Homo sapien
gggtgatttaatccagttataagaa

SEQ ID NO: 116357 - DNA, 25 bp, Homo sapien
gaaaattcttaaaaggcccatagca

SEQ ID NO: 116358 - DNA, 25 bp, Homo sapien
aaaaggcccatagcagccagttcaa

SEQ ID NO: 116359 - DNA, 25 bp, Homo sapien
aggcccatagcagccagttcaaaaa

SEQ ID NO: 116360 - DNA, 25 bp, Homo sapien
agcagccagttcaaaaacacccgac

SEQ ID NO: 116361 - DNA, 25 bp, Homo sapien
cagttcaaaaacacccgacgtcatg

SEQ ID NO: 116362 - DNA, 25 bp, Homo sapien
aaacacccgacgtcatgtatttgag

SEQ ID NO: 116363 - DNA, 25 bp, Homo sapien
acccgacgtcatgtatttgagcata

SEQ ID NO: 116364 - DNA, 25 bp, Homo sapien
gacgtcatgtatttgagcatatcag

SEQ ID NO: 116365 - DNA, 25 bp, Homo sapien
agcatatcagtaacccccttaaatt

SEQ ID NO: 116366 - DNA, 25 bp, Homo sapien
tttcactactagattgactaactca

SEQ ID NO: 116367 - DNA, 25 bp, Homo sapien
gaccgagaccgggacaaagaccgag

SEQ ID NO: 116368 - DNA, 25 bp, Homo sapien
gaaaaaatctcatagcatcaagcca

SEQ ID NO: 116369 - DNA, 25 bp, Homo sapien
gcatcaagccagagagttggtccaa

SEQ ID NO: 116370 - DNA, 25 bp, Homo sapien
gagagttggtccaaatcacccatct

SEQ ID NO: 116371 - DNA, 25 bp, Homo sapien
aaatcacccatctcttcagaccagt

SEQ ID NO: 116372 - DNA, 25 bp, Homo sapien
tcagaccagtccttgtctatgacaa

SEQ ID NO: 116373 - DNA, 25 bp, Homo sapien
gacaagtaacacaatcttatctgca

SEQ ID NO: 116374 - DNA, 25 bp, Homo sapien
caatcttatctgcagacagaccctc

SEQ ID NO: 116375 - DNA, 25 bp, Homo sapien
aaggctcagcccagactttatgatt

SEQ ID NO: 116376 - DNA, 25 bp, Homo sapien
gatgatcttatggatgtggccctga

SEQ ID NO: 116377 - DNA, 25 bp, Homo sapien
ggccctgattgggaattaggaacct

SEQ ID NO: 116378 - DNA, 25 bp, Homo sapien
cagcaagtaggatacttctcatgtt

SEQ ID NO: 116379 - DNA, 25 bp, Homo sapien
aatggcttaagaccagcgtctctgt

SEQ ID NO: 116380 - DNA, 25 bp, Homo sapien
gaccagcgtctctgtatgacattgt

SEQ ID NO: 116381 - DNA, 25 bp, Homo sapien
ctgtatgacattgtgtggttgaccc

SEQ ID NO: 116382 - DNA, 25 bp, Homo sapien
tgtgtggttgaccctctgagataac

SEQ ID NO: 116383 - DNA, 25 bp, Homo sapien
gagataactgttttcatctacagaa

SEQ ID NO: 116384 - DNA, 25 bp, Homo sapien
gttttcatctacagaattgcatttt

SEQ ID NO: 116385 - DNA, 25 bp, Homo sapien
tacagaattgcatttttgcttttaa

SEQ ID NO: 116386 - DNA, 25 bp, Homo sapien
tataatggaactaggaatcaccgtt

SEQ ID NO: 116387 - DNA, 25 bp, Homo sapien
agtcattatctgtttggtccttata

SEQ ID NO: 116388 - DNA, 25 bp, Homo sapien
atctgtttggtccttatacagtttt

SEQ ID NO: 116389 - DNA, 25 bp, Homo sapien
accattttcccatcaatgttttatg

SEQ ID NO: 116390 - DNA, 25 bp, Homo sapien
aatgttttatgggtctcaactccta

SEQ ID NO: 116391 - DNA, 25 bp, Homo sapien
ttttatgggtctcaactcctatctc

SEQ ID NO: 116392 - DNA, 25 bp, Homo sapien
tcctatctccaaatataagtaggga

SEQ ID NO: 116393 - DNA, 25 bp, Homo sapien
tcatttctataaagtgaggactctt

SEQ ID NO: 116394 - DNA, 25 bp, Homo sapien
ttcaaaatctaagccattcgcaaga

SEQ ID NO: 116395 - DNA, 25 bp, Homo sapien
ctaagccattcgcaagatgtgaata

SEQ ID NO: 116396 - DNA, 25 bp, Homo sapien
aaatttttcaatgaccccatgggat

SEQ ID NO: 116397 - DNA, 25 bp, Homo sapien
gaccccatgggattacttcaacaaa

SEQ ID NO: 116398 - DNA, 25 bp, Homo sapien
acagagcattagtaacttgtttttt

SEQ ID NO: 116399 - DNA, 25 bp, Homo sapien
cttgttttttgcagtgtaattgggt

SEQ ID NO: 116400 - DNA, 25 bp, Homo sapien
aaggcaattattctttgtaagcggg

SEQ ID NO: 116401 - DNA, 25 bp, Homo sapien
gcaattattctttgtaagcgggaca

SEQ ID NO: 116402 - DNA, 25 bp, Homo sapien
aattattctttgtaagcgggacatt

SEQ ID NO: 116403 - DNA, 25 bp, Homo sapien
tattctttgtaagcgggacatttag

SEQ ID NO: 116404 - DNA, 25 bp, Homo sapien
gtatgtatatttcaaagtaccacac

SEQ ID NO: 116405 - DNA, 25 bp, Homo sapien
atgtatatttcaaagtaccacactg

SEQ ID NO: 116406 - DNA, 25 bp, Homo sapien
agattcatataaccacaactgtgat

SEQ ID NO: 116407 - DNA, 25 bp, Homo sapien
gtgatatatcctaactataaccagt

SEQ ID NO: 116408 - DNA, 25 bp, Homo sapien
atatcctaactataaccagttgttg

SEQ ID NO: 116409 - DNA, 25 bp, Homo sapien
cctaactataaccagttgttgaggg

SEQ ID NO: 116410 - DNA, 25 bp, Homo sapien
tactagaagcagaatgaaaccacat

SEQ ID NO: 116411 - DNA, 25 bp, Homo sapien
acccgtcatggtttcaatacacatt

SEQ ID NO: 116412 - DNA, 25 bp, Homo sapien
gtcatggtttcaatacacattcttc

SEQ ID NO: 116413 - DNA, 25 bp, Homo sapien
tggtttcaatacacattcttctttt

SEQ ID NO: 116414 - DNA, 25 bp, Homo sapien
ggtttcaatacacattcttcttttg

SEQ ID NO: 116415 - DNA, 25 bp, Homo sapien
ttcttcttttgccagcgcttctgaa

SEQ ID NO: 116416 - DNA, 25 bp, Homo sapien
ccctggaagtggagttaggagcttc

SEQ ID NO: 116417 - DNA, 25 bp, Homo sapien
gtggagttaggagcttctaacccgt

SEQ ID NO: 116418 - DNA, 25 bp, Homo sapien
ggagttaggagcttctaacccgtca

SEQ ID NO: 116419 - DNA, 25 bp, Homo sapien
agttaggagcttctaacccgtcatg

SEQ ID NO: 116420 - DNA, 25 bp, Homo sapien
ttaggagcttctaacccgtcatggt

SEQ ID NO: 116421 - DNA, 25 bp, Homo sapien
taggagcttctaacccgtcatggtt

SEQ ID NO: 116422 - DNA, 25 bp, Homo sapien
tctgtccgatctgtgcatgttattt

SEQ ID NO: 116423 - DNA, 25 bp, Homo sapien
gtccgatctgtgcatgttatttttc

SEQ ID NO: 116424 - DNA, 25 bp, Homo sapien
tttctttttccgtgagtcaaagtct

SEQ ID NO: 116425 - DNA, 25 bp, Homo sapien
ttccgtgagtcaaagtctgaccttt

SEQ ID NO: 116426 - DNA, 25 bp, Homo sapien
gtctgacctttattttcaacatctg

SEQ ID NO: 116427 - DNA, 25 bp, Homo sapien
ggtgttaagctatcttttgtaggaa

SEQ ID NO: 116428 - DNA, 25 bp, Homo sapien
gtggggcacactactcagagacatt

SEQ ID NO: 116429 - DNA, 25 bp, Homo sapien
taaaaagacatcctaaaatggtgaa

SEQ ID NO: 116430 - DNA, 25 bp, Homo sapien
aaatggtgaagttgccatgacaata

SEQ ID NO: 116431 - DNA, 25 bp, Homo sapien
ggtcatagaacctggtagtgtcaaa

SEQ ID NO: 116432 - DNA, 25 bp, Homo sapien
gtagtgtcaaatttaaccctttgag

SEQ ID NO: 116433 - DNA, 25 bp, Homo sapien
agctccgtagggtcccagtcaagtg

SEQ ID NO: 116434 - DNA, 25 bp, Homo sapien
ggtcccagtcaagtgctggcagtgt

SEQ ID NO: 116435 - DNA, 25 bp, Homo sapien
tatgtcaccatcacatcccatgttc

SEQ ID NO: 116436 - DNA, 25 bp, Homo sapien
tgttcttaccgcctttgacctttgg

SEQ ID NO: 116437 - DNA, 25 bp, Homo sapien
tgacctttgggaacaggccgaggcc

SEQ ID NO: 116438 - DNA, 25 bp, Homo sapien
aggccgaggccctcacgaggaagaa

SEQ ID NO: 116439 - DNA, 25 bp, Homo sapien
ataaagaattctttgctcggctcag

SEQ ID NO: 116440 - DNA, 25 bp, Homo sapien
acaaatgtgtgcaccttggccctca

SEQ ID NO: 116441 - DNA, 25 bp, Homo sapien
ttggccctcaacagcagtttggtgg

SEQ ID NO: 116442 - DNA, 25 bp, Homo sapien
gtggacctggtgcactatacacgac

SEQ ID NO: 116443 - DNA, 25 bp, Homo sapien
acgacagggttttcagcagctacaa

SEQ ID NO: 116444 - DNA, 25 bp, Homo sapien
gaagcgagggctgtgcacagttcac

SEQ ID NO: 116445 - DNA, 25 bp, Homo sapien
gggctgtgcacagttcaccgagaag

SEQ ID NO: 116446 - DNA, 25 bp, Homo sapien
gagaagctgacttcttctggagcct

SEQ ID NO: 116447 - DNA, 25 bp, Homo sapien
ctgacttcttctggagcctgtgtac

SEQ ID NO: 116448 - DNA, 25 bp, Homo sapien
gagcctgtgtactgcggacatgtcc

SEQ ID NO: 116449 - DNA, 25 bp, Homo sapien
tactgcggacatgtccctgctggag

SEQ ID NO: 116450 - DNA, 25 bp, Homo sapien
gacaattcccggaagtggaattaca

SEQ ID NO: 116451 - DNA, 25 bp, Homo sapien
gagtcaaaggacatgcatttttcaa

SEQ ID NO: 116452 - DNA, 25 bp, Homo sapien
gacatgcatttttcaagcctcggat

SEQ ID NO: 116453 - DNA, 25 bp, Homo sapien
aagcctcggatgcatcttactagat

SEQ ID NO: 116454 - DNA, 25 bp, Homo sapien
ggatgcatcttactagatgtcctat

SEQ ID NO: 116455 - DNA, 25 bp, Homo sapien
tatgattctcatacccaggaactgt

SEQ ID NO: 116456 - DNA, 25 bp, Homo sapien
tctcatacccaggaactgtaaattt

SEQ ID NO: 116457 - DNA, 25 bp, Homo sapien
atatttggccaatagttttcagact

SEQ ID NO: 116458 - DNA, 25 bp, Homo sapien
ggccaatagttttcagacttaaagc

SEQ ID NO: 116459 - DNA, 25 bp, Homo sapien
cagacttaaagcatcatagtccttt

SEQ ID NO: 116460 - DNA, 25 bp, Homo sapien
gcatcatagtccttttatatttgtc

SEQ ID NO: 116461 - DNA, 25 bp, Homo sapien
aagatactctgtaatgtcatgtttg

SEQ ID NO: 116462 - DNA, 25 bp, Homo sapien
gtcatgtttgtactgatagtttaag

SEQ ID NO: 116463 - DNA, 25 bp, Homo sapien
taagaatttaatttcctgtacaact

SEQ ID NO: 116464 - DNA, 25 bp, Homo sapien
atcacttatactaccttttttatag

SEQ ID NO: 116465 - DNA, 25 bp, Homo sapien
tactaccttttttatagcttcaatt

SEQ ID NO: 116466 - DNA, 25 bp, Homo sapien
gatgatgaatttaccgcccagtcca

SEQ ID NO: 116467 - DNA, 25 bp, Homo sapien
aatttaccgcccagtccatcacaat

SEQ ID NO: 116468 - DNA, 25 bp, Homo sapien
tgaccgctatgacagcctgggctta

SEQ ID NO: 116469 - DNA, 25 bp, Homo sapien
gcctgggcttactggagctggacca

SEQ ID NO: 116470 - DNA, 25 bp, Homo sapien
tactggagctggaccagcggaccca

SEQ ID NO: 116471 - DNA, 25 bp, Homo sapien
tctcctactcggctttccgagaaga

SEQ ID NO: 116472 - DNA, 25 bp, Homo sapien
ctcggctttccgagaagagaaagac

SEQ ID NO: 116473 - DNA, 25 bp, Homo sapien
gagaaagacctgctgatgtctttgt

SEQ ID NO: 116474 - DNA, 25 bp, Homo sapien
acctgctgatgtctttgtttgtgtc

SEQ ID NO: 116475 - DNA, 25 bp, Homo sapien
ctttttcttctaatttcattttgct

SEQ ID NO: 116476 - DNA, 25 bp, Homo sapien
ttgctaagtttctcttctttgaaga

SEQ ID NO: 116477 - DNA, 25 bp, Homo sapien
tgtgagtatcagcagtgcccttcag

SEQ ID NO: 116478 - DNA, 25 bp, Homo sapien
agtatcagcagtgcccttcagagtt

SEQ ID NO: 116479 - DNA, 25 bp, Homo sapien
gagtttgactacaatgccactgacc

SEQ ID NO: 116480 - DNA, 25 bp, Homo sapien
acaatgccactgaccatgctgggaa

SEQ ID NO: 116481 - DNA, 25 bp, Homo sapien
tgaccatgctgggaagagtgccaat

SEQ ID NO: 116482 - DNA, 25 bp, Homo sapien
gtgccaatgagaaagccgacagtgc

SEQ ID NO: 116483 - DNA, 25 bp, Homo sapien
aaagccgacagtgctggtgtccgtc

SEQ ID NO: 116484 - DNA, 25 bp, Homo sapien
tcactgtcttctgcatcttgttcct

SEQ ID NO: 116485 - DNA, 25 bp, Homo sapien
aaggcaccagttatcacttttctac

SEQ ID NO: 116486 - DNA, 25 bp, Homo sapien
agttatcacttttctaccatcctag

SEQ ID NO: 116487 - DNA, 25 bp, Homo sapien
taccatcctagtgactttgcttttt

SEQ ID NO: 116488 - DNA, 25 bp, Homo sapien
gacaattcccggaagtggaattaca

SEQ ID NO: 116489 - DNA, 25 bp, Homo sapien
gtggaattacagagtcaaaggacat

SEQ ID NO: 116490 - DNA, 25 bp, Homo sapien
gagtcaaaggacatgcatttttcaa

SEQ ID NO: 116491 - DNA, 25 bp, Homo sapien
ggacatgcatttttcaagcctcgga

SEQ ID NO: 116492 - DNA, 25 bp, Homo sapien
acatgcatttttcaagcctcggatg

SEQ ID NO: 116493 - DNA, 25 bp, Homo sapien
catttttcaagcctcggatgcatct

SEQ ID NO: 116494 - DNA, 25 bp, Homo sapien
tttttcaagcctcggatgcatctta

SEQ ID NO: 116495 - DNA, 25 bp, Homo sapien
ttcaagcctcggatgcatcttacta

SEQ ID NO: 116496 - DNA, 25 bp, Homo sapien
aagcctcggatgcatcttactagat

SEQ ID NO: 116497 - DNA, 25 bp, Homo sapien
gcctcggatgcatcttactagatgt

SEQ ID NO: 116498 - DNA, 25 bp, Homo sapien
gatgcatcttactagatgtcctata

SEQ ID NO: 116499 - DNA, 25 bp, Homo sapien
cgatgatgaatttaccgcccagtcc

SEQ ID NO: 116500 - DNA, 25 bp, Homo sapien
atgatgaatttaccgcccagtccat

SEQ ID NO: 116501 - DNA, 25 bp, Homo sapien
aatttaccgcccagtccatcacaat

SEQ ID NO: 116502 - DNA, 25 bp, Homo sapien
tgaccgctatgacagcctgggctta

SEQ ID NO: 116503 - DNA, 25 bp, Homo sapien
gaccgctatgacagcctgggcttac

SEQ ID NO: 116504 - DNA, 25 bp, Homo sapien
gctatgacagcctgggcttactgga

SEQ ID NO: 116505 - DNA, 25 bp, Homo sapien
acagcctgggcttactggagctgga

SEQ ID NO: 116506 - DNA, 25 bp, Homo sapien
gcctgggcttactggagctggacca

SEQ ID NO: 116507 - DNA, 25 bp, Homo sapien
ctgggcttactggagctggaccagc

SEQ ID NO: 116508 - DNA, 25 bp, Homo sapien
tactggagctggaccagcggaccca

SEQ ID NO: 116509 - DNA, 25 bp, Homo sapien
tggagctggaccagcggacccactt

SEQ ID NO: 116510 - DNA, 25 bp, Homo sapien
aaattgagattacactggcataaac

SEQ ID NO: 116511 - DNA, 25 bp, Homo sapien
gattacactggcataaactctagtt

SEQ ID NO: 116512 - DNA, 25 bp, Homo sapien
aaactctagtttgcacagttcacag

SEQ ID NO: 116513 - DNA, 25 bp, Homo sapien
ctagtttgcacagttcacagctact

SEQ ID NO: 116514 - DNA, 25 bp, Homo sapien
gacagcacatcatctaaatcccatt

SEQ ID NO: 116515 - DNA, 25 bp, Homo sapien
acagcacatcatctaaatcccattc

SEQ ID NO: 116516 - DNA, 25 bp, Homo sapien
gttagctgtgaatttaccctgtaca

SEQ ID NO: 116517 - DNA, 25 bp, Homo sapien
tagctgtgaatttaccctgtacagc

SEQ ID NO: 116518 - DNA, 25 bp, Homo sapien
atttttatgaaacgtaccactatgg

SEQ ID NO: 116519 - DNA, 25 bp, Homo sapien
tttatgaaacgtaccactatggata

SEQ ID NO: 116520 - DNA, 25 bp, Homo sapien
gaaacgtaccactatggataaatta

SEQ ID NO: 116521 - DNA, 25 bp, Homo sapien
ctaaagaggctgaaccggagccgga

SEQ ID NO: 116522 - DNA, 25 bp, Homo sapien
aaccagagccggaactggagccaga

SEQ ID NO: 116523 - DNA, 25 bp, Homo sapien
gagcccgagcccgacttcgaggaaa

SEQ ID NO: 116524 - DNA, 25 bp, Homo sapien
agggacgagtccgaagattcctgaa

SEQ ID NO: 116525 - DNA, 25 bp, Homo sapien
acgagtccgaagattcctgaaggcc

SEQ ID NO: 116526 - DNA, 25 bp, Homo sapien
ggtgccccgcccatgctggatagga

SEQ ID NO: 116527 - DNA, 25 bp, Homo sapien
cgcccatgctggataggacctggga

SEQ ID NO: 116528 - DNA, 25 bp, Homo sapien
gctggagctgaatcggatgccacca

SEQ ID NO: 116529 - DNA, 25 bp, Homo sapien
gaatcggatgccaccaaggctcggt

SEQ ID NO: 116530 - DNA, 25 bp, Homo sapien
ggtccagcccagtaccgctggaagt

SEQ ID NO: 116531 - DNA, 25 bp, Homo sapien
gtaccgctggaagtgaataaactcc

SEQ ID NO: 116532 - DNA, 25 bp, Homo sapien
tgagatcgatacacagaatcgccag

SEQ ID NO: 116533 - DNA, 25 bp, Homo sapien
gaatcgccagatcgacaggatcatg

SEQ ID NO: 116534 - DNA, 25 bp, Homo sapien
gatgaggccaaccaacgtgcaacaa

SEQ ID NO: 116535 - DNA, 25 bp, Homo sapien
gaagtggttaagtgtgcccacccgt

SEQ ID NO: 116536 - DNA, 25 bp, Homo sapien
cctccaaatgctgtcgggcaagata

SEQ ID NO: 116537 - DNA, 25 bp, Homo sapien
tgtcgggcaagatagctccttcatg

SEQ ID NO: 116538 - DNA, 25 bp, Homo sapien
gctccttcatgcttttctcatggta

SEQ ID NO: 116539 - DNA, 25 bp, Homo sapien
tctcatggtattatctagtaggtct

SEQ ID NO: 116540 - DNA, 25 bp, Homo sapien
tagtaggtctgcacacataacacac

SEQ ID NO: 116541 - DNA, 25 bp, Homo sapien
aatgttgtcctgtgtcatctgtcag

SEQ ID NO: 116542 - DNA, 25 bp, Homo sapien
gtcagcttcccaacaatactttgtg

SEQ ID NO: 116543 - DNA, 25 bp, Homo sapien
tatacacaacttcccagtaaatggt

SEQ ID NO: 116544 - DNA, 25 bp, Homo sapien
caacttcccagtaaatggttgtggg

SEQ ID NO: 116545 - DNA, 25 bp, Homo sapien
cagccgtttccctgcagaatcagct

SEQ ID NO: 116546 - DNA, 25 bp, Homo sapien
gaatcagctctgtctcatgtggaag

SEQ ID NO: 116547 - DNA, 25 bp, Homo sapien
cagctctgtctcatgtggaagtgga

SEQ ID NO: 116548 - DNA, 25 bp, Homo sapien
ggaagtggagaatcagccttgcctg

SEQ ID NO: 116549 - DNA, 25 bp, Homo sapien
gccttgcctggcctttaggaacttt

SEQ ID NO: 116550 - DNA, 25 bp, Homo sapien
gcctggcctttaggaacttttgtgg

SEQ ID NO: 116551 - DNA, 25 bp, Homo sapien
ggtggctgcatgttaccgtccccta

SEQ ID NO: 116552 - DNA, 25 bp, Homo sapien
tctccccacgtggagggtggagcag

SEQ ID NO: 116553 - DNA, 25 bp, Homo sapien
aggaagtcaactgctgttcagcctc

SEQ ID NO: 116554 - DNA, 25 bp, Homo sapien
ttaacaatgtcttcaaaggctttgc

SEQ ID NO: 116555 - DNA, 25 bp, Homo sapien
aacaatgtcttcaaaggctttgcta

SEQ ID NO: 116556 - DNA, 25 bp, Homo sapien
aaggctttgctagattagacagtac

SEQ ID NO: 116557 - DNA, 25 bp, Homo sapien
gctttgctagattagacagtacgaa

SEQ ID NO: 116558 - DNA, 25 bp, Homo sapien
gacagtacgaaaaataaacatcaag

SEQ ID NO: 116559 - DNA, 25 bp, Homo sapien
aatgtggaaactatcatgtacaaga

SEQ ID NO: 116560 - DNA, 25 bp, Homo sapien
gaaactatcatgtacaagaaagacc

SEQ ID NO: 116561 - DNA, 25 bp, Homo sapien
agaaagaccatgcaatgttgactct

SEQ ID NO: 116562 - DNA, 25 bp, Homo sapien
gaccatgcaatgttgactctttttt

SEQ ID NO: 116563 - DNA, 25 bp, Homo sapien
tgctctgagtccagtggcgcggtct

SEQ ID NO: 116564 - DNA, 25 bp, Homo sapien
tctgagtccagtggcgcggtctctg

SEQ ID NO: 116565 - DNA, 25 bp, Homo sapien
tgcagccctggagacccggcaccat

SEQ ID NO: 116566 - DNA, 25 bp, Homo sapien
gcagccctggagacccggcaccatc

SEQ ID NO: 116567 - DNA, 25 bp, Homo sapien
cagccctggagacccggcaccatca

SEQ ID NO: 116568 - DNA, 25 bp, Homo sapien
agccctggagacccggcaccatcac

SEQ ID NO: 116569 - DNA, 25 bp, Homo sapien
gccctggagacccggcaccatcaca

SEQ ID NO: 116570 - DNA, 25 bp, Homo sapien
ccctggagacccggcaccatcacac

SEQ ID NO: 116571 - DNA, 25 bp, Homo sapien
cctggagacccggcaccatcacacc

SEQ ID NO: 116572 - DNA, 25 bp, Homo sapien
ctggagacccggcaccatcacaccc

SEQ ID NO: 116573 - DNA, 25 bp, Homo sapien
tggagacccggcaccatcacaccca

SEQ ID NO: 116574 - DNA, 25 bp, Homo sapien
aaagaaagtgctcacccagctcgag

SEQ ID NO: 116575 - DNA, 25 bp, Homo sapien
cagctcgagcagcatcaacaacagc

SEQ ID NO: 116576 - DNA, 25 bp, Homo sapien
cacaaaggttgccaaagtgccagcc

SEQ ID NO: 116577 - DNA, 25 bp, Homo sapien
gtccacatgaaacacacaggcacca

SEQ ID NO: 116578 - DNA, 25 bp, Homo sapien
aaggactgatgaacagttccctcct

SEQ ID NO: 116579 - DNA, 25 bp, Homo sapien
ccttcatcaggtaggaaatggactg

SEQ ID NO: 116580 - DNA, 25 bp, Homo sapien
actgtgagccccatgggaatgccca

SEQ ID NO: 116581 - DNA, 25 bp, Homo sapien
catgggaatgcccatttcttctccc

SEQ ID NO: 116582 - DNA, 25 bp, Homo sapien
cccttaagatcttttgtcagctcag

SEQ ID NO: 116583 - DNA, 25 bp, Homo sapien
tgtcagctcagaaatgtgtttggtt

SEQ ID NO: 116584 - DNA, 25 bp, Homo sapien
gtttgtaaacagatattcagcttca

SEQ ID NO: 116585 - DNA, 25 bp, Homo sapien
ttcaaagagcaatgcatcttctccc

SEQ ID NO: 116586 - DNA, 25 bp, Homo sapien
gatcatcacagaaatcactttcagg

SEQ ID NO: 116587 - DNA, 25 bp, Homo sapien
tcactttcaggcaatgatttacaaa

SEQ ID NO: 116588 - DNA, 25 bp, Homo sapien
gatgatgacaactgtgaactctgac

SEQ ID NO: 116589 - DNA, 25 bp, Homo sapien
gaactctgacataaatttagtgctt

SEQ ID NO: 116590 - DNA, 25 bp, Homo sapien
gtgctttataacgaactgaatcagg

SEQ ID NO: 116591 - DNA, 25 bp, Homo sapien
taaccataggatttaggtcactagg

SEQ ID NO: 116592 - DNA, 25 bp, Homo sapien
taggtcactaggactttggatcaaa

SEQ ID NO: 116593 - DNA, 25 bp, Homo sapien
atggtgcattacgtatttcctgaaa

SEQ ID NO: 116594 - DNA, 25 bp, Homo sapien
gactgtaacatcattgccattccta

SEQ ID NO: 116595 - DNA, 25 bp, Homo sapien
gccattcctactacctgagttttta

SEQ ID NO: 116596 - DNA, 25 bp, Homo sapien
tgacattcacggcagaggcaaggct

SEQ ID NO: 116597 - DNA, 25 bp, Homo sapien
ctccgccatcccacagatgatggat

SEQ ID NO: 116598 - DNA, 25 bp, Homo sapien
gatgatggatcttcagtgggttctc

SEQ ID NO: 116599 - DNA, 25 bp, Homo sapien
atcttcagtgggttctcttgggctc

SEQ ID NO: 116600 - DNA, 25 bp, Homo sapien
agtgggttctcttgggctctaggtc

SEQ ID NO: 116601 - DNA, 25 bp, Homo sapien
ctcttgggctctaggtcctggagaa

SEQ ID NO: 116602 - DNA, 25 bp, Homo sapien
ctctaggtcctggagaatgttgtga

SEQ ID NO: 116603 - DNA, 25 bp, Homo sapien
gaaattatctcattatcgaggccct

SEQ ID NO: 116604 - DNA, 25 bp, Homo sapien
gaggccctgctatgctgtgtgtctg

SEQ ID NO: 116605 - DNA, 25 bp, Homo sapien
tgtctgggcgtgttgtatgtcctgc

SEQ ID NO: 116606 - DNA, 25 bp, Homo sapien
cgtgttgtatgtcctgctgccgatg

SEQ ID NO: 116607 - DNA, 25 bp, Homo sapien
tgcattgctgcagatatttgggata

SEQ ID NO: 116608 - DNA, 25 bp, Homo sapien
cagatatttgggatatgcctggccc

SEQ ID NO: 116609 - DNA, 25 bp, Homo sapien
atgcctggcccagaatttggttagc

SEQ ID NO: 116610 - DNA, 25 bp, Homo sapien
cccagaatttggttagcgatatcga

SEQ ID NO: 116611 - DNA, 25 bp, Homo sapien
tagcgatatcgaagctgtcagggcg

SEQ ID NO: 116612 - DNA, 25 bp, Homo sapien
accgctgctgcaagacactggacag

SEQ ID NO: 116613 - DNA, 25 bp, Homo sapien
actggacagacccagctttcgggac

SEQ ID NO: 116614 - DNA, 25 bp, Homo sapien
cttcgagctgcatggacctaatcac

SEQ ID NO: 116615 - DNA, 25 bp, Homo sapien
atggacctaatcacagatgcagcct

SEQ ID NO: 116616 - DNA, 25 bp, Homo sapien
acagatgcagcctgcagtctcgcct

SEQ ID NO: 116617 - DNA, 25 bp, Homo sapien
gagtgtaaaactgggaaatgctgct

SEQ ID NO: 116618 - DNA, 25 bp, Homo sapien
agaaaagaaagtgctcacccagctc

SEQ ID NO: 116619 - DNA, 25 bp, Homo sapien
aaagaaagtgctcacccagctcgag

SEQ ID NO: 116620 - DNA, 25 bp, Homo sapien
agaaagtgctcacccagctcgagca

SEQ ID NO: 116621 - DNA, 25 bp, Homo sapien
aagtgctcacccagctcgagcagca

SEQ ID NO: 116622 - DNA, 25 bp, Homo sapien
ccagctcgagcagcatcaacaacag

SEQ ID NO: 116623 - DNA, 25 bp, Homo sapien
gcaaacccacaaaggttgccaaagt

SEQ ID NO: 116624 - DNA, 25 bp, Homo sapien
cacaaaggttgccaaagtgccagcc

SEQ ID NO: 116625 - DNA, 25 bp, Homo sapien
acaatgtccacatgaaacacacagg

SEQ ID NO: 116626 - DNA, 25 bp, Homo sapien
gtccacatgaaacacacaggcacca

SEQ ID NO: 116627 - DNA, 25 bp, Homo sapien
aggcaccatcccaggggcacaagga

SEQ ID NO: 116628 - DNA, 25 bp, Homo sapien
aaggactgatgaacagttccctcct

SEQ ID NO: 116629 - DNA, 25 bp, Homo sapien
cagaaaaggcctctcaaacactcac

SEQ ID NO: 116630 - DNA, 25 bp, Homo sapien
tcaaacactcacctcatttggaatg

SEQ ID NO: 116631 - DNA, 25 bp, Homo sapien
cactcacctcatttggaatgaagat

SEQ ID NO: 116632 - DNA, 25 bp, Homo sapien
agatggagactcttttgcctgaagc

SEQ ID NO: 116633 - DNA, 25 bp, Homo sapien
atggagactcttttgcctgaagcaa

SEQ ID NO: 116634 - DNA, 25 bp, Homo sapien
gactcttttgcctgaagcaacgatg

SEQ ID NO: 116635 - DNA, 25 bp, Homo sapien
ttgcctgaagcaacgatggagcagt

SEQ ID NO: 116636 - DNA, 25 bp, Homo sapien
gcaacgatggagcagtgaccctcta

SEQ ID NO: 116637 - DNA, 25 bp, Homo sapien
gatggagcagtgaccctctaatcaa

SEQ ID NO: 116638 - DNA, 25 bp, Homo sapien
agtgaccctctaatcaactcggtgg

SEQ ID NO: 116639 - DNA, 25 bp, Homo sapien
cctctaatcaactcggtggcctaaa

SEQ ID NO: 116640 - DNA, 25 bp, Homo sapien
taacaatgtcttcaaaggctttgct

SEQ ID NO: 116641 - DNA, 25 bp, Homo sapien
aaggctttgctagattagacagtac

SEQ ID NO: 116642 - DNA, 25 bp, Homo sapien
gctttgctagattagacagtacgaa

SEQ ID NO: 116643 - DNA, 25 bp, Homo sapien
aatgtggaaactatcatgtacaaga

SEQ ID NO: 116644 - DNA, 25 bp, Homo sapien
gaaactatcatgtacaagaaagacc

SEQ ID NO: 116645 - DNA, 25 bp, Homo sapien
agaaagaccatgcaatgttgactct

SEQ ID NO: 116646 - DNA, 25 bp, Homo sapien
gaccatgcaatgttgactctttttt

SEQ ID NO: 116647 - DNA, 25 bp, Homo sapien
agagtcttgctctgagtccagtggc

SEQ ID NO: 116648 - DNA, 25 bp, Homo sapien
tgctctgagtccagtggcgcggtct

SEQ ID NO: 116649 - DNA, 25 bp, Homo sapien
tctgagtccagtggcgcggtctctg

SEQ ID NO: 116650 - DNA, 25 bp, Homo sapien
tctcctgcctagacctcctgggtgg

SEQ ID NO: 116651 - DNA, 25 bp, Homo sapien
ggactgtactcttcgcatggactgg

SEQ ID NO: 116652 - DNA, 25 bp, Homo sapien
gactgtactcttcgcatggactggg

SEQ ID NO: 116653 - DNA, 25 bp, Homo sapien
ctgtactcttcgcatggactgggaa

SEQ ID NO: 116654 - DNA, 25 bp, Homo sapien
gtactcttcgcatggactgggaagt

SEQ ID NO: 116655 - DNA, 25 bp, Homo sapien
ctcttcgcatggactgggaagttct

SEQ ID NO: 116656 - DNA, 25 bp, Homo sapien
gactgggaagttcttttaaatcatt

SEQ ID NO: 116657 - DNA, 25 bp, Homo sapien
gggaaaatgtgaatgtgctgcgttt

SEQ ID NO: 116658 - DNA, 25 bp, Homo sapien
aaatgtgaatgtgctgcgttttgtt

SEQ ID NO: 116659 - DNA, 25 bp, Homo sapien
tgtgaatgtgctgcgttttgttttc

SEQ ID NO: 116660 - DNA, 25 bp, Homo sapien
aatgtgctgcgttttgttttcttta

SEQ ID NO: 116661 - DNA, 25 bp, Homo sapien
aatacagctcattacaataaaattg

SEQ ID NO: 116662 - DNA, 25 bp, Homo sapien
ttcctcaataactgggggctggact

SEQ ID NO: 116663 - DNA, 25 bp, Homo sapien
tcctcaataactgggggctggactg

SEQ ID NO: 116664 - DNA, 25 bp, Homo sapien
taactgggggctggactgaagcctc

SEQ ID NO: 116665 - DNA, 25 bp, Homo sapien
aactgggggctggactgaagcctcc

SEQ ID NO: 116666 - DNA, 25 bp, Homo sapien
actgggggctggactgaagcctcct

SEQ ID NO: 116667 - DNA, 25 bp, Homo sapien
ggggctggactgaagcctcctgcag

SEQ ID NO: 116668 - DNA, 25 bp, Homo sapien
cccttcaaacaacacctctcaacct

SEQ ID NO: 116669 - DNA, 25 bp, Homo sapien
ttcaaacaacacctctcaacctcct

SEQ ID NO: 116670 - DNA, 25 bp, Homo sapien
tcaaacaacacctctcaacctccta

SEQ ID NO: 116671 - DNA, 25 bp, Homo sapien
aaacaacacctctcaacctcctatt

SEQ ID NO: 116672 - DNA, 25 bp, Homo sapien
aacaacacctctcaacctcctattg

SEQ ID NO: 116673 - DNA, 25 bp, Homo sapien
gagatcatgggcctgacaatccttg

SEQ ID NO: 116674 - DNA, 25 bp, Homo sapien
atgggcctgacaatccttgcagcag

SEQ ID NO: 116675 - DNA, 25 bp, Homo sapien
aatccttgcagcaggcacatcaatt

SEQ ID NO: 116676 - DNA, 25 bp, Homo sapien
aggcacatcaattcctgacctcatc

SEQ ID NO: 116677 - DNA, 25 bp, Homo sapien
ctgacctcatcaccagtgtgattgt

SEQ ID NO: 116678 - DNA, 25 bp, Homo sapien
tcaccagtgtgattgtcgctcgaaa

SEQ ID NO: 116679 - DNA, 25 bp, Homo sapien
gtcgctcgaaaaggcctgggagaca

SEQ ID NO: 116680 - DNA, 25 bp, Homo sapien
gggagacatggctgtgtcaagctct

SEQ ID NO: 116681 - DNA, 25 bp, Homo sapien
ctgtgtcaagctctgtgggcagtaa

SEQ ID NO: 116682 - DNA, 25 bp, Homo sapien
agctctgtgggcagtaacatatttg

SEQ ID NO: 116683 - DNA, 25 bp, Homo sapien
gtaacatatttgatatcactgtggg

SEQ ID NO: 116684 - DNA, 25 bp, Homo sapien
gtcgtgggctcatttgccaggctca

SEQ ID NO: 116685 - DNA, 25 bp, Homo sapien
cgtgggctcatttgccaggctcagg

SEQ ID NO: 116686 - DNA, 25 bp, Homo sapien
aggctcaggccaggtctggacagct

SEQ ID NO: 116687 - DNA, 25 bp, Homo sapien
caggccaggtctggacagctgtgac

SEQ ID NO: 116688 - DNA, 25 bp, Homo sapien
gactctcctcaagccaggactaccg

SEQ ID NO: 116689 - DNA, 25 bp, Homo sapien
aggactaccgaccagccggctatgg

SEQ ID NO: 116690 - DNA, 25 bp, Homo sapien
cgaccagccggctatgggcacatta

SEQ ID NO: 116691 - DNA, 25 bp, Homo sapien
accagccggctatgggcacattacg

SEQ ID NO: 116692 - DNA, 25 bp, Homo sapien
ggctatgggcacattacgtgaccac

SEQ ID NO: 116693 - DNA, 25 bp, Homo sapien
atgggcacattacgtgaccactggc

SEQ ID NO: 116694 - DNA, 25 bp, Homo sapien
gggcacattacgtgaccactggcct

SEQ ID NO: 116695 - DNA, 25 bp, Homo sapien
ttacctttcattgggcccagcgagg

SEQ ID NO: 116696 - DNA, 25 bp, Homo sapien
gcccagcgagggtagaattcagaat

SEQ ID NO: 116697 - DNA, 25 bp, Homo sapien
gagagttatactcctgcatacatgc

SEQ ID NO: 116698 - DNA, 25 bp, Homo sapien
tctccctctcattgaaaggtttctt

SEQ ID NO: 116699 - DNA, 25 bp, Homo sapien
aaggtttcttagtctagctctgctc

SEQ ID NO: 116700 - DNA, 25 bp, Homo sapien
gtctagctctgctcatgaatgaaca

SEQ ID NO: 116701 - DNA, 25 bp, Homo sapien
aaatggatccttgtcctaacgtcac

SEQ ID NO: 116702 - DNA, 25 bp, Homo sapien
aagtcacattttcaggtatttaagg

SEQ ID NO: 116703 - DNA, 25 bp, Homo sapien
gtttgaagctaataccatcaggctc

SEQ ID NO: 116704 - DNA, 25 bp, Homo sapien
accatcaggctcagagtttacatgc

SEQ ID NO: 116705 - DNA, 25 bp, Homo sapien
tttacatgcatttttacttaggaag

SEQ ID NO: 116706 - DNA, 25 bp, Homo sapien
tctggttaaaggtatagtggatgct

SEQ ID NO: 116707 - DNA, 25 bp, Homo sapien
gatgctatttatgatccaagttttt

SEQ ID NO: 116708 - DNA, 25 bp, Homo sapien
tatgatccaagtttttacatcacat

SEQ ID NO: 116709 - DNA, 25 bp, Homo sapien
tttacatcacatccattgatctgcc

SEQ ID NO: 116710 - DNA, 25 bp, Homo sapien
acatccattgatctgcctatccctt

SEQ ID NO: 116711 - DNA, 25 bp, Homo sapien
cattgatctgcctatcccttctttt

SEQ ID NO: 116712 - DNA, 25 bp, Homo sapien
atacattcagtatactaccaagaag

SEQ ID NO: 116713 - DNA, 25 bp, Homo sapien
tcagtatactaccaagaagcaaagt

SEQ ID NO: 116714 - DNA, 25 bp, Homo sapien
gtgtttcattttgctattggaattt

SEQ ID NO: 116715 - DNA, 25 bp, Homo sapien
gtaacattgtatgataacctgaaat

SEQ ID NO: 116716 - DNA, 25 bp, Homo sapien
tgataacctgaaatgtttacttgtg

SEQ ID NO: 116717 - DNA, 25 bp, Homo sapien
gtaagaccattaccctcgaggtgga

SEQ ID NO: 116718 - DNA, 25 bp, Homo sapien
ttaccctcgaggtggagcccagtga

SEQ ID NO: 116719 - DNA, 25 bp, Homo sapien
acaccatcgagaatgtcaaggcaaa

SEQ ID NO: 116720 - DNA, 25 bp, Homo sapien
atcgagaatgtcaaggcaaagatcc

SEQ ID NO: 116721 - DNA, 25 bp, Homo sapien
taaggaaggcatccctcctgatcag

SEQ ID NO: 116722 - DNA, 25 bp, Homo sapien
tgatcagcagaggttgatctttgct

SEQ ID NO: 116723 - DNA, 25 bp, Homo sapien
aacagctggaagatggacgcaccct

SEQ ID NO: 116724 - DNA, 25 bp, Homo sapien
agctggaagatggacgcaccctgtc

SEQ ID NO: 116725 - DNA, 25 bp, Homo sapien
atggacgcaccctgtctgactacaa

SEQ ID NO: 116726 - DNA, 25 bp, Homo sapien
aaagagtccactctgcacttggtcc

SEQ ID NO: 116727 - DNA, 25 bp, Homo sapien
gttgcattcccaattggtgtttttt

SEQ ID NO: 116728 - DNA, 25 bp, Homo sapien
tgactgcagccctggagacccggca

SEQ ID NO: 116729 - DNA, 25 bp, Homo sapien
gctgtggtgcaagccatcgtccgca

SEQ ID NO: 116730 - DNA, 25 bp, Homo sapien
ccatcgtccgcatggctggtggctg

SEQ ID NO: 116731 - DNA, 25 bp, Homo sapien
tggctgggcagctgcctcggactcc

SEQ ID NO: 116732 - DNA, 25 bp, Homo sapien
cagctgcctcggactccaggaaagg

SEQ ID NO: 116733 - DNA, 25 bp, Homo sapien
tggggaacctgctggctactgattg

SEQ ID NO: 116734 - DNA, 25 bp, Homo sapien
tggctactgattgctccaggcggac

SEQ ID NO: 116735 - DNA, 25 bp, Homo sapien
ggacaaggctgacaagcaatccagg

SEQ ID NO: 116736 - DNA, 25 bp, Homo sapien
gaacaaaatactcaccaggacgagg

SEQ ID NO: 116737 - DNA, 25 bp, Homo sapien
aacaaaatactcaccaggacgagga

SEQ ID NO: 116738 - DNA, 25 bp, Homo sapien
gcagcacaataaatgaggccactgt

SEQ ID NO: 116739 - DNA, 25 bp, Homo sapien
acgcgcacttacacgagaagacatt

SEQ ID NO: 116740 - DNA, 25 bp, Homo sapien
agacattcatggctttgggcagaag

SEQ ID NO: 116741 - DNA, 25 bp, Homo sapien
ggattgtgcagattgtcaactccaa

SEQ ID NO: 116742 - DNA, 25 bp, Homo sapien
gtcaactccaaatctaaagtcaagg

SEQ ID NO: 116743 - DNA, 25 bp, Homo sapien
gtcaaggctttagacctttatccta

SEQ ID NO: 116744 - DNA, 25 bp, Homo sapien
gacctttatcctattgtttattgag

SEQ ID NO: 116745 - DNA, 25 bp, Homo sapien
ggaatgggaggcaaatgcctgctat

SEQ ID NO: 116746 - DNA, 25 bp, Homo sapien
tacacttagctatgttttgcaactc

SEQ ID NO: 116747 - DNA, 25 bp, Homo sapien
gctatgttttgcaactctttttggg

SEQ ID NO: 116748 - DNA, 25 bp, Homo sapien
ttgtatgtcatactccacaatttac

SEQ ID NO: 116749 - DNA, 25 bp, Homo sapien
tatattacagccatcaaacacataa

SEQ ID NO: 116750 - DNA, 25 bp, Homo sapien
gataaccatgctttatatgacaaga

SEQ ID NO: 116751 - DNA, 25 bp, Homo sapien
tatgacaagaccaagaggatattcc

SEQ ID NO: 116752 - DNA, 25 bp, Homo sapien
ggatattcctcaaagcagaaagtga

SEQ ID NO: 116753 - DNA, 25 bp, Homo sapien
gaaatttttgcgcatctgggattgg

SEQ ID NO: 116754 - DNA, 25 bp, Homo sapien
ttgcgcatctgggattggattatat

SEQ ID NO: 116755 - DNA, 25 bp, Homo sapien
ttggattatattgaaccgtgggaaa

SEQ ID NO: 116756 - DNA, 25 bp, Homo sapien
aaatgcctaggaaagtgttgtcaac

SEQ ID NO: 116757 - DNA, 25 bp, Homo sapien
gtaaaagatgccataggagagtttg

SEQ ID NO: 116758 - DNA, 25 bp, Homo sapien
ggttatttaggtcttattgaaatgc

SEQ ID NO: 116759 - DNA, 25 bp, Homo sapien
aatgcagattgctactagaaataaa

SEQ ID NO: 116760 - DNA, 25 bp, Homo sapien
aacatgggaaggtgccactggtaat

SEQ ID NO: 116761 - DNA, 25 bp, Homo sapien
atgcgagaacgttcttactaccggg

SEQ ID NO: 116762 - DNA, 25 bp, Homo sapien
gatcagattggaaaagggacccagg

SEQ ID NO: 116763 - DNA, 25 bp, Homo sapien
acccagggagcaactgcaggagctt

SEQ ID NO: 116764 - DNA, 25 bp, Homo sapien
tgcaggagcttcatctgaactggat

SEQ ID NO: 116765 - DNA, 25 bp, Homo sapien
gcttcatctgaactggatgccagta

SEQ ID NO: 116766 - DNA, 25 bp, Homo sapien
atgccagtaaaactgtgagcagccc

SEQ ID NO: 116767 - DNA, 25 bp, Homo sapien
agtgctgcaacagtatctgcctcta

SEQ ID NO: 116768 - DNA, 25 bp, Homo sapien
gcaacagtatctgcctctacaagta

SEQ ID NO: 116769 - DNA, 25 bp, Homo sapien
gtatctgcctctacaagtaacatca

SEQ ID NO: 116770 - DNA, 25 bp, Homo sapien
aagtaacatcatacccccaagacac

SEQ ID NO: 116771 - DNA, 25 bp, Homo sapien
ggtggctggtgatgagaatattctt

SEQ ID NO: 116772 - DNA, 25 bp, Homo sapien
agtcctaacggcttgacttccgata

SEQ ID NO: 116773 - DNA, 25 bp, Homo sapien
ggcttgacttccgataactcagatg

SEQ ID NO: 116774 - DNA, 25 bp, Homo sapien
agacctttgaatctccgaatgccta

SEQ ID NO: 116775 - DNA, 25 bp, Homo sapien
gaatctccgaatgcctaatttacag

SEQ ID NO: 116776 - DNA, 25 bp, Homo sapien
gacaaccccatcattttgtggtgga

SEQ ID NO: 116777 - DNA, 25 bp, Homo sapien
tgagcagactttaccccagtgaggc

SEQ ID NO: 116778 - DNA, 25 bp, Homo sapien
aagtcccactcatcagagagccttg

SEQ ID NO: 116779 - DNA, 25 bp, Homo sapien
aaagactaccctcattcagctttta

SEQ ID NO: 116780 - DNA, 25 bp, Homo sapien
ccctcattcagcttttaccttagaa

SEQ ID NO: 116781 - DNA, 25 bp, Homo sapien
agatagctgtgatttctctcaccgt

SEQ ID NO: 116782 - DNA, 25 bp, Homo sapien
tctcaccgttctctggaaatggcat

SEQ ID NO: 116783 - DNA, 25 bp, Homo sapien
taaataccagtacttgagggaccaa

SEQ ID NO: 116784 - DNA, 25 bp, Homo sapien
ttgagggaccaatattaccatctta

SEQ ID NO: 116785 - DNA, 25 bp, Homo sapien
attattcagaattatacagacctaa

SEQ ID NO: 116786 - DNA, 25 bp, Homo sapien
acagacctaatatcattttattcac

SEQ ID NO: 116787 - DNA, 25 bp, Homo sapien
ttcacatatgtcttactactttaaa

SEQ ID NO: 116788 - DNA, 25 bp, Homo sapien
tgtcttactactttaaatcctacca

SEQ ID NO: 116789 - DNA, 25 bp, Homo sapien
ctgggcttaagttttacttgaggat

SEQ ID NO: 116790 - DNA, 25 bp, Homo sapien
acttgaggatcatatgaattagcca

SEQ ID NO: 116791 - DNA, 25 bp, Homo sapien
ctgactgttgcctttactcttataa

SEQ ID NO: 116792 - DNA, 25 bp, Homo sapien
tcaataagagaactctcctcttttt

SEQ ID NO: 116793 - DNA, 25 bp, Homo sapien
gtattgttttccagtgtcacttgac

SEQ ID NO: 116794 - DNA, 25 bp, Homo sapien
aacactgagagtgggaaaccattat

SEQ ID NO: 116795 - DNA, 25 bp, Homo sapien
gggaaaccattatgacttcaaacat

SEQ ID NO: 116796 - DNA, 25 bp, Homo sapien
gagaatccatactaaagagcattta

SEQ ID NO: 116797 - DNA, 25 bp, Homo sapien
gtctcactaggcatcaaaaactttt

SEQ ID NO: 116798 - DNA, 25 bp, Homo sapien
gcttaagcttttacccaggcatcaa

SEQ ID NO: 116799 - DNA, 25 bp, Homo sapien
agcttttacccaggcatcaaaaccg

SEQ ID NO: 116800 - DNA, 25 bp, Homo sapien
tacccaggcatcaaaaccggaacat

SEQ ID NO: 116801 - DNA, 25 bp, Homo sapien
gcatcaaaaccggaacatcacaggg

SEQ ID NO: 116802 - DNA, 25 bp, Homo sapien
taagcctttcagtgtaatattcatg

SEQ ID NO: 116803 - DNA, 25 bp, Homo sapien
gtgtaatattcatgattttgtcgtg

SEQ ID NO: 116804 - DNA, 25 bp, Homo sapien
gattttgtcgtgagagatccactca

SEQ ID NO: 116805 - DNA, 25 bp, Homo sapien
tcgatcatatttccccttggacact

SEQ ID NO: 116806 - DNA, 25 bp, Homo sapien
cttggacacttggttagacgccttc

SEQ ID NO: 116807 - DNA, 25 bp, Homo sapien
tagacgccttccaggtcaggatgca

SEQ ID NO: 116808 - DNA, 25 bp, Homo sapien
tcaggatgcacatttctggattgtg

SEQ ID NO: 116809 - DNA, 25 bp, Homo sapien
ctggattgtggttccatgcagggtt

SEQ ID NO: 116810 - DNA, 25 bp, Homo sapien
ccctccaagaccctgtgttcatttg

SEQ ID NO: 116811 - DNA, 25 bp, Homo sapien
gttcatttggtgttcctggaagcag

SEQ ID NO: 116812 - DNA, 25 bp, Homo sapien
aggtgcgacaacatgtgaggcattc

SEQ ID NO: 116813 - DNA, 25 bp, Homo sapien
gggaagctcgacatgtgccacacag

SEQ ID NO: 116814 - DNA, 25 bp, Homo sapien
tgccacacagtgacttggccccaga

SEQ ID NO: 116815 - DNA, 25 bp, Homo sapien
tggccccagacgcatagactgaggt

SEQ ID NO: 116816 - DNA, 25 bp, Homo sapien
gggacagacgcagcaccttcttagc

SEQ ID NO: 116817 - DNA, 25 bp, Homo sapien
gacgcagcaccttcttagcgatcta

SEQ ID NO: 116818 - DNA, 25 bp, Homo sapien
agcaccttcttagcgatctaggcct

SEQ ID NO: 116819 - DNA, 25 bp, Homo sapien
cttcttagcgatctaggcctggcaa

SEQ ID NO: 116820 - DNA, 25 bp, Homo sapien
cttagcgatctaggcctggcaagag

SEQ ID NO: 116821 - DNA, 25 bp, Homo sapien
atctaggcctggcaagagctctggc

SEQ ID NO: 116822 - DNA, 25 bp, Homo sapien
tggcaagagctctggccccaaggcc

SEQ ID NO: 116823 - DNA, 25 bp, Homo sapien
ctggcatatcaccccgcactgtggg

SEQ ID NO: 116824 - DNA, 25 bp, Homo sapien
actagcctggctcaaatattcccca

SEQ ID NO: 116825 - DNA, 25 bp, Homo sapien
aaatattccccagggagactgctgt

SEQ ID NO: 116826 - DNA, 25 bp, Homo sapien
cccacatcccctctggaagagaatg

SEQ ID NO: 116827 - DNA, 25 bp, Homo sapien
aaagtcttccgcttgattttgcaca

SEQ ID NO: 116828 - DNA, 25 bp, Homo sapien
ttgattttgcacaatcccggcgata

SEQ ID NO: 116829 - DNA, 25 bp, Homo sapien
aatcccggcgatactcctggcgata

SEQ ID NO: 116830 - DNA, 25 bp, Homo sapien
gatactcctggcgatactgactaga

SEQ ID NO: 116831 - DNA, 25 bp, Homo sapien
ggagctgttcactttaggatacggg

SEQ ID NO: 116832 - DNA, 25 bp, Homo sapien
atggaagggagcgttcacaccgcca

SEQ ID NO: 116833 - DNA, 25 bp, Homo sapien
aagggagcgttcacaccgccagcct

SEQ ID NO: 116834 - DNA, 25 bp, Homo sapien
cagcctcgggcctgggatttgagga

SEQ ID NO: 116835 - DNA, 25 bp, Homo sapien
tgaggagggccctagacctcctcca

SEQ ID NO: 116836 - DNA, 25 bp, Homo sapien
cttccactttgggttcactttgaat

SEQ ID NO: 116837 - DNA, 25 bp, Homo sapien
gggcagtggctctgatccactcacc

SEQ ID NO: 116838 - DNA, 25 bp, Homo sapien
gcctcctccacgagagaaggacagt

SEQ ID NO: 116839 - DNA, 25 bp, Homo sapien
cgtggccacattacctcagcgggag

SEQ ID NO: 116840 - DNA, 25 bp, Homo sapien
ggcagctaaaatgagcagctcccaa

SEQ ID NO: 116841 - DNA, 25 bp, Homo sapien
aaatgagcagctcccaagaatcact

SEQ ID NO: 116842 - DNA, 25 bp, Homo sapien
caagaatcactgctcgactcccggg

SEQ ID NO: 116843 - DNA, 25 bp, Homo sapien
ggaaacaatccttacgcaaaatctt

SEQ ID NO: 116844 - DNA, 25 bp, Homo sapien
cttacgcaaaatcttacaccctggt

SEQ ID NO: 116845 - DNA, 25 bp, Homo sapien
tacaccctggtataacagacagcat

SEQ ID NO: 116846 - DNA, 25 bp, Homo sapien
cagacagcatgactggacagcggtt

SEQ ID NO: 116847 - DNA, 25 bp, Homo sapien
gactggacagcggttgtaaatacaa

SEQ ID NO: 116848 - DNA, 25 bp, Homo sapien
aacaattcaatcaaagctacctttt

SEQ ID NO: 116849 - DNA, 25 bp, Homo sapien
cttcacagaggaggcgctggaatga

SEQ ID NO: 116850 - DNA, 25 bp, Homo sapien
acatctggtctgtggccacagcacc

SEQ ID NO: 116851 - DNA, 25 bp, Homo sapien
ctgaacgcccctgatcttgtgtgat

SEQ ID NO: 116852 - DNA, 25 bp, Homo sapien
gtgtgatcttggaagctaagcttgg

SEQ ID NO: 116853 - DNA, 25 bp, Homo sapien
cttggaagctaagcttggttgggcc

SEQ ID NO: 116854 - DNA, 25 bp, Homo sapien
ctggccatagaaaacagctgagggt

SEQ ID NO: 116855 - DNA, 25 bp, Homo sapien
ttgctgtgttcctggatcaggccct

SEQ ID NO: 116856 - DNA, 25 bp, Homo sapien
ggccctgcttcagaagggactcctg

SEQ ID NO: 116857 - DNA, 25 bp, Homo sapien
agaagggactcctggaggcccatgt

SEQ ID NO: 116858 - DNA, 25 bp, Homo sapien
tggaggcccatgttccttgatgcaa

SEQ ID NO: 116859 - DNA, 25 bp, Homo sapien
aggcccatgttccttgatgcaacct

SEQ ID NO: 116860 - DNA, 25 bp, Homo sapien
aaaccaaccacaccttgaagcagac

SEQ ID NO: 116861 - DNA, 25 bp, Homo sapien
actctgaagtctgggtcgtgccctg

SEQ ID NO: 116862 - DNA, 25 bp, Homo sapien
tggctccagcacttcgaggtgcctg

SEQ ID NO: 116863 - DNA, 25 bp, Homo sapien
aggtgcctgttctccgttgtcactg

SEQ ID NO: 116864 - DNA, 25 bp, Homo sapien
tcttcagcaagaccacagccatgac

SEQ ID NO: 116865 - DNA, 25 bp, Homo sapien
agccatgacaaacaccaggatgcat

SEQ ID NO: 116866 - DNA, 25 bp, Homo sapien
aaacaccaggatgcatgctccttgt

SEQ ID NO: 116867 - DNA, 25 bp, Homo sapien
tctcaggcctctgacgagtgagcgg

SEQ ID NO: 116868 - DNA, 25 bp, Homo sapien
tgaagtgccactgggtcaccgcagg

SEQ ID NO: 116869 - DNA, 25 bp, Homo sapien
tggaatggcagcatggtagcacctc

SEQ ID NO: 116870 - DNA, 25 bp, Homo sapien
gcagcatggtagcacctcctaacag

SEQ ID NO: 116871 - DNA, 25 bp, Homo sapien
gaagctgagttacccggcacagacg

SEQ ID NO: 116872 - DNA, 25 bp, Homo sapien
cggcacagacgctcaaggctgagta

SEQ ID NO: 116873 - DNA, 25 bp, Homo sapien
ggctgagtagctgagccactgtgcc

SEQ ID NO: 116874 - DNA, 25 bp, Homo sapien
tgggagcctaggtcaggcccctgcc

SEQ ID NO: 116875 - DNA, 25 bp, Homo sapien
ggccggcccctaagcaggaagctca

SEQ ID NO: 116876 - DNA, 25 bp, Homo sapien
aggaagctcaggcagctcctccaga

SEQ ID NO: 116877 - DNA, 25 bp, Homo sapien
aggcagctcctccagacttacttac

SEQ ID NO: 116878 - DNA, 25 bp, Homo sapien
agacttacttactccttcagtgact

SEQ ID NO: 116879 - DNA, 25 bp, Homo sapien
ttactccttcagtgactccgagctg

SEQ ID NO: 116880 - DNA, 25 bp, Homo sapien
gcactccaaggctgtcagggcttct

SEQ ID NO: 116881 - DNA, 25 bp, Homo sapien
ccaaggctgtcagggcttctgtttg

SEQ ID NO: 116882 - DNA, 25 bp, Homo sapien
aggtatgtctgaccacccattccca

SEQ ID NO: 116883 - DNA, 25 bp, Homo sapien
gagctagtgtttcaggtttacttta

SEQ ID NO: 116884 - DNA, 25 bp, Homo sapien
ttggccaagtggaagggtcgattca

SEQ ID NO: 116885 - DNA, 25 bp, Homo sapien
tcagttggttgtgtgcttagaattt

SEQ ID NO: 116886 - DNA, 25 bp, Homo sapien
tttttgacttacatagactatcagc

SEQ ID NO: 116887 - DNA, 25 bp, Homo sapien
tagactatcagctgcttcatgtcac

SEQ ID NO: 116888 - DNA, 25 bp, Homo sapien
catgtcacatctcatgcttctctta

SEQ ID NO: 116889 - DNA, 25 bp, Homo sapien
agttttctcagtgcttccgactgca

SEQ ID NO: 116890 - DNA, 25 bp, Homo sapien
gcttccgactgcatgtttttgtact

SEQ ID NO: 116891 - DNA, 25 bp, Homo sapien
ttgtactatatgaaaagccttcttt

SEQ ID NO: 116892 - DNA, 25 bp, Homo sapien
aagccttctttctagaagactacca

SEQ ID NO: 116893 - DNA, 25 bp, Homo sapien
aactgggataccttggactaagcca

SEQ ID NO: 116894 - DNA, 25 bp, Homo sapien
gactaagccagtctgtatcccaatt

SEQ ID NO: 116895 - DNA, 25 bp, Homo sapien
agtctgtatcccaattcgctagcaa

SEQ ID NO: 116896 - DNA, 25 bp, Homo sapien
attcgctagcaagcctaagtttgtg

SEQ ID NO: 116897 - DNA, 25 bp, Homo sapien
aagctcttctaactgaactttggta

SEQ ID NO: 116898 - DNA, 25 bp, Homo sapien
gaactttggtatgcggttgagcttt

SEQ ID NO: 116899 - DNA, 25 bp, Homo sapien
atgcggttgagctttgtaactattt

SEQ ID NO: 116900 - DNA, 25 bp, Homo sapien
gtaactatttgttctccatgaaaac

SEQ ID NO: 116901 - DNA, 25 bp, Homo sapien
gatgttatctcatgacgtgttgtca

SEQ ID NO: 116902 - DNA, 25 bp, Homo sapien
gtcagtacaaaatgtgtcgcctcca

SEQ ID NO: 116903 - DNA, 25 bp, Homo sapien
aatgtgtcgcctccaattctgttaa

SEQ ID NO: 116904 - DNA, 25 bp, Homo sapien
gctggatgactttggaccacatcgc

SEQ ID NO: 116905 - DNA, 25 bp, Homo sapien
ctttatcctgacatggacccagaac

SEQ ID NO: 116906 - DNA, 25 bp, Homo sapien
gatgctgtgcataaacactcacgtc

SEQ ID NO: 116907 - DNA, 25 bp, Homo sapien
tgtgcataaacactcacgtctgctt

SEQ ID NO: 116908 - DNA, 25 bp, Homo sapien
taaacactcacgtctgcttcgacag

SEQ ID NO: 116909 - DNA, 25 bp, Homo sapien
cacgtctgcttcgacagaactgagt

SEQ ID NO: 116910 - DNA, 25 bp, Homo sapien
agaactgagtgtatacctttaccct

SEQ ID NO: 116911 - DNA, 25 bp, Homo sapien
gagtgtatacctttaccctcaagta

SEQ ID NO: 116912 - DNA, 25 bp, Homo sapien
ttaccctcaagtaccactaacacag

SEQ ID NO: 116913 - DNA, 25 bp, Homo sapien
gtaccactaacacagatgattgatc

SEQ ID NO: 116914 - DNA, 25 bp, Homo sapien
gacagtggccccaaagaaagcccgg

SEQ ID NO: 116915 - DNA, 25 bp, Homo sapien
aattatacgctatgggatactggca

SEQ ID NO: 116916 - DNA, 25 bp, Homo sapien
tacgctatgggatactggcaacagt

SEQ ID NO: 116917 - DNA, 25 bp, Homo sapien
tggcaacagtgcacatatttcataa

SEQ ID NO: 116918 - DNA, 25 bp, Homo sapien
aacagtgcacatatttcataaccaa

SEQ ID NO: 116919 - DNA, 25 bp, Homo sapien
ttagcagcaccggtcttaatttgat

SEQ ID NO: 116920 - DNA, 25 bp, Homo sapien
gcaccggtcttaatttgatgttttt

SEQ ID NO: 116921 - DNA, 25 bp, Homo sapien
ggatatgtgtgtttactgtactttt

SEQ ID NO: 116922 - DNA, 25 bp, Homo sapien
ttgttttgatccgtttgtataaatg

SEQ ID NO: 116923 - DNA, 25 bp, Homo sapien
gatagcaatatcttggacacatttg

SEQ ID NO: 116924 - DNA, 25 bp, Homo sapien
gtatacctagcaatcacttttactt

SEQ ID NO: 116925 - DNA, 25 bp, Homo sapien
ttttactttttgtaattctgtctct

SEQ ID NO: 116926 - DNA, 25 bp, Homo sapien
aggcggcacgaaggcagttccagtc

SEQ ID NO: 116927 - DNA, 25 bp, Homo sapien
acgaaggcagttccagtctcagctg

SEQ ID NO: 116928 - DNA, 25 bp, Homo sapien
tgcagcagctccctgacatcctgaa

SEQ ID NO: 116929 - DNA, 25 bp, Homo sapien
agctggctgagtgccaagaccaact

SEQ ID NO: 116930 - DNA, 25 bp, Homo sapien
gagtgccaagaccaactgcagggct

SEQ ID NO: 116931 - DNA, 25 bp, Homo sapien
caactgcagggctatgagcggaaga

SEQ ID NO: 116932 - DNA, 25 bp, Homo sapien
gctatgagcggaagaacatcgacct

SEQ ID NO: 116933 - DNA, 25 bp, Homo sapien
aacatcgacctcacagccatcatat

SEQ ID NO: 116934 - DNA, 25 bp, Homo sapien
agccatcatatcagacctgcgcagc

SEQ ID NO: 116935 - DNA, 25 bp, Homo sapien
tggcagaaagggtcccacgaactga

SEQ ID NO: 116936 - DNA, 25 bp, Homo sapien
gggcccgcataccaagatgagctgc

SEQ ID NO: 116937 - DNA, 25 bp, Homo sapien
atgggctctttagcttgcatctgag

SEQ ID NO: 116938 - DNA, 25 bp, Homo sapien
ctggtcagcgagcatgtgattgaac

SEQ ID NO: 116939 - DNA, 25 bp, Homo sapien
gcatgtgattgaactgctgaccaaa

SEQ ID NO: 116940 - DNA, 25 bp, Homo sapien
gctgaccaaaatgtaccgggctgtg

SEQ ID NO: 116941 - DNA, 25 bp, Homo sapien
ctggatgccacgcagaggcagctta

SEQ ID NO: 116942 - DNA, 25 bp, Homo sapien
agaggcagcttacagtcaccgtgac

SEQ ID NO: 116943 - DNA, 25 bp, Homo sapien
agtcaccgtgactgagaagttctca

SEQ ID NO: 116944 - DNA, 25 bp, Homo sapien
agaagttctcagtgaggttcaagga

SEQ ID NO: 116945 - DNA, 25 bp, Homo sapien
tggctgtcaaggtcgtccagggccc

SEQ ID NO: 116946 - DNA, 25 bp, Homo sapien
ggtgacaacagcaagctacgctaca

SEQ ID NO: 116947 - DNA, 25 bp, Homo sapien
agtcattgcttggaggtgactgtgc

SEQ ID NO: 116948 - DNA, 25 bp, Homo sapien
caggtctcttcctttgctctgaggt

SEQ ID NO: 116949 - DNA, 25 bp, Homo sapien
ttgctctgaggtcccttcaaggcct

SEQ ID NO: 116950 - DNA, 25 bp, Homo sapien
aggccaaagccccatgtgccttgtc

SEQ ID NO: 116951 - DNA, 25 bp, Homo sapien
agccccatgtgccttgtccagggaa

SEQ ID NO: 116952 - DNA, 25 bp, Homo sapien
atgtgccttgtccagggaactgcct

SEQ ID NO: 116953 - DNA, 25 bp, Homo sapien
agcagagggcgccaccacctgacgg

SEQ ID NO: 116954 - DNA, 25 bp, Homo sapien
agactcacttgccattgccaggaga

SEQ ID NO: 116955 - DNA, 25 bp, Homo sapien
ctcacttgccattgccaggagatgg

SEQ ID NO: 116956 - DNA, 25 bp, Homo sapien
gccaggagatggccccaacaagcac

SEQ ID NO: 116957 - DNA, 25 bp, Homo sapien
agcaccccgcttttgcagcagagga

SEQ ID NO: 116958 - DNA, 25 bp, Homo sapien
gagctgagttggcagaccgggcccc

SEQ ID NO: 116959 - DNA, 25 bp, Homo sapien
cttacgccattattacgacagtacc

SEQ ID NO: 116960 - DNA, 25 bp, Homo sapien
gccattattacgacagtaccattga

SEQ ID NO: 116961 - DNA, 25 bp, Homo sapien
acgacagtaccattgagttgtgcgt

SEQ ID NO: 116962 - DNA, 25 bp, Homo sapien
acagtaccattgagttgtgcgtggg

SEQ ID NO: 116963 - DNA, 25 bp, Homo sapien
actctggaggccctcttgtgtgtaa

SEQ ID NO: 116964 - DNA, 25 bp, Homo sapien
gagcctgcaccaaagtctcaagctt

SEQ ID NO: 116965 - DNA, 25 bp, Homo sapien
aagtctcaagctttgtacactggat

SEQ ID NO: 116966 - DNA, 25 bp, Homo sapien
tctcaagctttgtacactggataaa

SEQ ID NO: 116967 - DNA, 25 bp, Homo sapien
aggaagcaaactaagcccccgctgt

SEQ ID NO: 116968 - DNA, 25 bp, Homo sapien
cccgctgtaatgaaacaccttctct

SEQ ID NO: 116969 - DNA, 25 bp, Homo sapien
tgtaatgaaacaccttctctggagc

SEQ ID NO: 116970 - DNA, 25 bp, Homo sapien
tgcttcctctgcgccagaagaaggc

SEQ ID NO: 116971 - DNA, 25 bp, Homo sapien
tgatggagatccaggtgaacggagg

SEQ ID NO: 116972 - DNA, 25 bp, Homo sapien
ggcaggatgagatgatcgacgtcat

SEQ ID NO: 116973 - DNA, 25 bp, Homo sapien
gtgaccaagggcaaaggctacaaag

SEQ ID NO: 116974 - DNA, 25 bp, Homo sapien
gaccaagggcaaaggctacaaaggg

SEQ ID NO: 116975 - DNA, 25 bp, Homo sapien
gcaaaggctacaaaggggtcaccag

SEQ ID NO: 116976 - DNA, 25 bp, Homo sapien
gggtcaccagtcgttggcacaccaa

SEQ ID NO: 116977 - DNA, 25 bp, Homo sapien
ggtcaccagtcgttggcacaccaag

SEQ ID NO: 116978 - DNA, 25 bp, Homo sapien
tcaccagtcgttggcacaccaagaa

SEQ ID NO: 116979 - DNA, 25 bp, Homo sapien
accagtcgttggcacaccaagaagc

SEQ ID NO: 116980 - DNA, 25 bp, Homo sapien
ccagtcgttggcacaccaagaagct

SEQ ID NO: 116981 - DNA, 25 bp, Homo sapien
agagcgccaggatgaacatggtttc

SEQ ID NO: 116982 - DNA, 25 bp, Homo sapien
gggagttccacaggaaataccggat

SEQ ID NO: 116983 - DNA, 25 bp, Homo sapien
aataccggatcccagctgatgtaga

SEQ ID NO: 116984 - DNA, 25 bp, Homo sapien
tgatgtagaccctctcaccattact

SEQ ID NO: 116985 - DNA, 25 bp, Homo sapien
gtcctcactgtgaatggaccaagga

SEQ ID NO: 116986 - DNA, 25 bp, Homo sapien
gaatggaccaaggaaacaggtctct

SEQ ID NO: 116987 - DNA, 25 bp, Homo sapien
aggtctctggccctgagcgcaccat

SEQ ID NO: 116988 - DNA, 25 bp, Homo sapien
accattcccatcacccgtgaaaaga

SEQ ID NO: 116989 - DNA, 25 bp, Homo sapien
catcacccgtgaaaagaagcctgct

SEQ ID NO: 116990 - DNA, 25 bp, Homo sapien
aaaagatgccctttcttgaattgca

SEQ ID NO: 116991 - DNA, 25 bp, Homo sapien
gaaagtttccccaccagtgaatgaa

SEQ ID NO: 116992 - DNA, 25 bp, Homo sapien
attgtgtgttactatataatgaacg

SEQ ID NO: 116993 - DNA, 25 bp, Homo sapien
ataatgaacgtttcattgcccttgg

SEQ ID NO: 116994 - DNA, 25 bp, Homo sapien
aaacaggtgtataaagtggagacca

SEQ ID NO: 116995 - DNA, 25 bp, Homo sapien
gagaccaaatactttgccagaaact

SEQ ID NO: 116996 - DNA, 25 bp, Homo sapien
ggatggcttaaggaacttgaactca

SEQ ID NO: 116997 - DNA, 25 bp, Homo sapien
gaacttgaactcaaacgagccagaa

SEQ ID NO: 116998 - DNA, 25 bp, Homo sapien
acccaagtgagttattatatgaccg

SEQ ID NO: 116999 - DNA, 25 bp, Homo sapien
ttatatgaccgagaaagtctgcatt

SEQ ID NO: 117000 - DNA, 25 bp, Homo sapien
gaccgagaaagtctgcattaagata

SEQ ID NO: 117001 - DNA, 25 bp, Homo sapien
acatgttatgtatcagctgcctaag

SEQ ID NO: 117002 - DNA, 25 bp, Homo sapien
tgttatgtatcagctgcctaaggaa

SEQ ID NO: 117003 - DNA, 25 bp, Homo sapien
gcctggctgtcctagcagttgtggt

SEQ ID NO: 117004 - DNA, 25 bp, Homo sapien
tggctgtcctagcagttgtggtcat

SEQ ID NO: 117005 - DNA, 25 bp, Homo sapien
ggctgtcctagcagttgtggtcatc

SEQ ID NO: 117006 - DNA, 25 bp, Homo sapien
ctgtcctagcagttgtggtcatcgg

SEQ ID NO: 117007 - DNA, 25 bp, Homo sapien
gtcctagcagttgtggtcatcggag

SEQ ID NO: 117008 - DNA, 25 bp, Homo sapien
cctagcagttgtggtcatcggagct

SEQ ID NO: 117009 - DNA, 25 bp, Homo sapien
tagcagttgtggtcatcggagctgt

SEQ ID NO: 117010 - DNA, 25 bp, Homo sapien
ggtcatcggagctgtggtcgctact

SEQ ID NO: 117011 - DNA, 25 bp, Homo sapien
gtcatcggagctgtggtcgctactg

SEQ ID NO: 117012 - DNA, 25 bp, Homo sapien
tcatcggagctgtggtcgctactgt

SEQ ID NO: 117013 - DNA, 25 bp, Homo sapien
atcggagctgtggtcgctactgtga

SEQ ID NO: 117014 - DNA, 25 bp, Homo sapien
taggatgcctctacatgtatttcat

SEQ ID NO: 117015 - DNA, 25 bp, Homo sapien
tttcattcccctcatcttcaaacat

SEQ ID NO: 117016 - DNA, 25 bp, Homo sapien
attattattcttgaccagacctgaa

SEQ ID NO: 117017 - DNA, 25 bp, Homo sapien
gacctgaatctaagttaccatccct

SEQ ID NO: 117018 - DNA, 25 bp, Homo sapien
gttaccatcccttggaaattctgga

SEQ ID NO: 117019 - DNA, 25 bp, Homo sapien
gagaaggagtctcatgcaccaccta

SEQ ID NO: 117020 - DNA, 25 bp, Homo sapien
tcctgtttctgactttggaatggac

SEQ ID NO: 117021 - DNA, 25 bp, Homo sapien
gaatggactcaggaaaactaggccc

SEQ ID NO: 117022 - DNA, 25 bp, Homo sapien
taggcccctctttaaaccgtgtgat

SEQ ID NO: 117023 - DNA, 25 bp, Homo sapien
aaccgtgtgatgtatttgaatgtct

SEQ ID NO: 117024 - DNA, 25 bp, Homo sapien
gaatgtctgttatttccagccaccc

SEQ ID NO: 117025 - DNA, 25 bp, Homo sapien
tttcaaaacctctggaagccgcggt

SEQ ID NO: 117026 - DNA, 25 bp, Homo sapien
aaacctctggaagccgcggttgaat

SEQ ID NO: 117027 - DNA, 25 bp, Homo sapien
gaagccgcggttgaatgtgccatga

SEQ ID NO: 117028 - DNA, 25 bp, Homo sapien
gcaccatcattgaagctggcgtcat

SEQ ID NO: 117029 - DNA, 25 bp, Homo sapien
attgaagctggcgtcatcggagtct

SEQ ID NO: 117030 - DNA, 25 bp, Homo sapien
agctggcgtcatcggagtctcttgt

SEQ ID NO: 117031 - DNA, 25 bp, Homo sapien
agtctcttgttctgttggcgtgcta

SEQ ID NO: 117032 - DNA, 25 bp, Homo sapien
ttctgttggcgtgctacctggaaga

SEQ ID NO: 117033 - DNA, 25 bp, Homo sapien
tggcgtgctacctggaagatccttc

SEQ ID NO: 117034 - DNA, 25 bp, Homo sapien
tttatgttttaagaacaggctgaca

SEQ ID NO: 117035 - DNA, 25 bp, Homo sapien
ggctgacacgcagcagctacaacaa

SEQ ID NO: 117036 - DNA, 25 bp, Homo sapien
gagccacagtttcttgactggaggc

SEQ ID NO: 117037 - DNA, 25 bp, Homo sapien
cagtttcttgactggaggccatcaa

SEQ ID NO: 117038 - DNA, 25 bp, Homo sapien
ggaggccatcaaccctcttggttga

SEQ ID NO: 117039 - DNA, 25 bp, Homo sapien
cctcttggttgaggccttgttctga

SEQ ID NO: 117040 - DNA, 25 bp, Homo sapien
gagccctgacatgtgcttgggcact

SEQ ID NO: 117041 - DNA, 25 bp, Homo sapien
tgggcttctgaggtggcctcctgcc

SEQ ID NO: 117042 - DNA, 25 bp, Homo sapien
aacaaaggcagttttatatgaaaga

SEQ ID NO: 117043 - DNA, 25 bp, Homo sapien
ggaataatcaggctttttaaatgat

SEQ ID NO: 117044 - DNA, 25 bp, Homo sapien
taaatgatgtaattcccactgtaat

SEQ ID NO: 117045 - DNA, 25 bp, Homo sapien
gtaattcccactgtaatagcatagg

SEQ ID NO: 117046 - DNA, 25 bp, Homo sapien
ccactgtaatagcatagggattttg

SEQ ID NO: 117047 - DNA, 25 bp, Homo sapien
ttctccggcaggtgggcattaacta

SEQ ID NO: 117048 - DNA, 25 bp, Homo sapien
ggctcgcctggaccataagttcgat

SEQ ID NO: 117049 - DNA, 25 bp, Homo sapien
tcgcctggaccataagttcgatctc

SEQ ID NO: 117050 - DNA, 25 bp, Homo sapien
tctccggcaggtgggcattaactac

SEQ ID NO: 117051 - DNA, 25 bp, Homo sapien
ataagttcgatctcatgtatgccaa

SEQ ID NO: 117052 - DNA, 25 bp, Homo sapien
gatctcatgtatgccaagcgggcct

SEQ ID NO: 117053 - DNA, 25 bp, Homo sapien
ctttgtgcactggtacgtgggagaa

SEQ ID NO: 117054 - DNA, 25 bp, Homo sapien
ggcaggtgggcattaactaccagcc

SEQ ID NO: 117055 - DNA, 25 bp, Homo sapien
gggagttctctgaggcccgcgagga

SEQ ID NO: 117056 - DNA, 25 bp, Homo sapien
aggcccgcgaggacctggcagctct

SEQ ID NO: 117057 - DNA, 25 bp, Homo sapien
tggattccgtggaagccgaggctga

SEQ ID NO: 117058 - DNA, 25 bp, Homo sapien
ctcgctcagacactttggcaggatg

SEQ ID NO: 117059 - DNA, 25 bp, Homo sapien
tcgctcagacactttggcaggatgt

SEQ ID NO: 117060 - DNA, 25 bp, Homo sapien
gctcagacactttggcaggatgtct

SEQ ID NO: 117061 - DNA, 25 bp, Homo sapien
gcaggagcgcgtgcaagccgggcag

SEQ ID NO: 117062 - DNA, 25 bp, Homo sapien
tgcaagccgggcaggcggtccacct

SEQ ID NO: 117063 - DNA, 25 bp, Homo sapien
gggagcaccccacctctgtgtgtga

SEQ ID NO: 117064 - DNA, 25 bp, Homo sapien
ccacctctgtgtgtgatgtagcttt

SEQ ID NO: 117065 - DNA, 25 bp, Homo sapien
cacctctgtgtgtgatgtagctttc

SEQ ID NO: 117066 - DNA, 25 bp, Homo sapien
ccatcgaaaaagacaacctctactt

SEQ ID NO: 117067 - DNA, 25 bp, Homo sapien
ggaacctcttactgctttcaataca

SEQ ID NO: 117068 - DNA, 25 bp, Homo sapien
acctcttactgctttcaatacacga

SEQ ID NO: 117069 - DNA, 25 bp, Homo sapien
agagctttacagtgccacgacatgg

SEQ ID NO: 117070 - DNA, 25 bp, Homo sapien
acatggctgggctacgtgaatagcg

SEQ ID NO: 117071 - DNA, 25 bp, Homo sapien
tgaatagcgccctcaaccctgtgat

SEQ ID NO: 117072 - DNA, 25 bp, Homo sapien
gatctataccaccttcaatatcgag

SEQ ID NO: 117073 - DNA, 25 bp, Homo sapien
accaccttcaatatcgagttccgga

SEQ ID NO: 117074 - DNA, 25 bp, Homo sapien
tgccttgggtggaccaggcttccaa

SEQ ID NO: 117075 - DNA, 25 bp, Homo sapien
agaggagaagactcggaattccctg

SEQ ID NO: 117076 - DNA, 25 bp, Homo sapien
agaagaaggcaacccaaatggtggc

SEQ ID NO: 117077 - DNA, 25 bp, Homo sapien
ttgacccatgttctcaatacccact

SEQ ID NO: 117078 - DNA, 25 bp, Homo sapien
ttctcaatacccactgccagacatg

SEQ ID NO: 117079 - DNA, 25 bp, Homo sapien
acgtgtccccagagctttacagtgc

SEQ ID NO: 117080 - DNA, 25 bp, Homo sapien
aagcatgccagcacctaccgagaag

SEQ ID NO: 117081 - DNA, 25 bp, Homo sapien
gcacctaccgagaagctgccacaaa

SEQ ID NO: 117082 - DNA, 25 bp, Homo sapien
acaaaccaggccaagatccacgctg

SEQ ID NO: 117083 - DNA, 25 bp, Homo sapien
aggccaagatccacgctgacgcaga

SEQ ID NO: 117084 - DNA, 25 bp, Homo sapien
agatccacgctgacgcagagcggaa

SEQ ID NO: 117085 - DNA, 25 bp, Homo sapien
gaaggagcagtcctgcgttaactgc

SEQ ID NO: 117086 - DNA, 25 bp, Homo sapien
agtcctgcgttaactgcggccggga

SEQ ID NO: 117087 - DNA, 25 bp, Homo sapien
gccgggaggctatgagcgagtgcac

SEQ ID NO: 117088 - DNA, 25 bp, Homo sapien
tgccacaaggtcaactactgctcca

SEQ ID NO: 117089 - DNA, 25 bp, Homo sapien
ttctgccaacgcaaggactggaagg

SEQ ID NO: 117090 - DNA, 25 bp, Homo sapien
ccaacgcaaggactggaaggatcac

SEQ ID NO: 117091 - DNA, 25 bp, Homo sapien
tgcagcccgcttagtctgatgacga

SEQ ID NO: 117092 - DNA, 25 bp, Homo sapien
cagcccgcttagtctgatgacgagg

SEQ ID NO: 117093 - DNA, 25 bp, Homo sapien
gcccgcttagtctgatgacgaggaa

SEQ ID NO: 117094 - DNA, 25 bp, Homo sapien
tagtctgatgacgaggaagcccgcc

SEQ ID NO: 117095 - DNA, 25 bp, Homo sapien
gtctgatgacgaggaagcccgccag

SEQ ID NO: 117096 - DNA, 25 bp, Homo sapien
tgatgacgaggaagcccgccagaaa

SEQ ID NO: 117097 - DNA, 25 bp, Homo sapien
gatgacgaggaagcccgccagaaag

SEQ ID NO: 117098 - DNA, 25 bp, Homo sapien
gaggaagcccgccagaaagtccaga

SEQ ID NO: 117099 - DNA, 25 bp, Homo sapien
aggaagcccgccagaaagtccagaa

SEQ ID NO: 117100 - DNA, 25 bp, Homo sapien
ccagaagaaggaacgacggacgcaa

SEQ ID NO: 117101 - DNA, 25 bp, Homo sapien
aacgacggacgcaaagcggcgccgc

SEQ ID NO: 117102 - DNA, 25 bp, Homo sapien
tcctgatctataaggcctctagttt

SEQ ID NO: 117103 - DNA, 25 bp, Homo sapien
gatctataaggcctctagtttagcc

SEQ ID NO: 117104 - DNA, 25 bp, Homo sapien
ctataaggcctctagtttagccagt

SEQ ID NO: 117105 - DNA, 25 bp, Homo sapien
taaggcctctagtttagccagtggg

SEQ ID NO: 117106 - DNA, 25 bp, Homo sapien
ccagtggggccccatcaaggttcag

SEQ ID NO: 117107 - DNA, 25 bp, Homo sapien
gccaacaatatagtaattatccgct

SEQ ID NO: 117108 - DNA, 25 bp, Homo sapien
tatagtaattatccgctcactttcg

SEQ ID NO: 117109 - DNA, 25 bp, Homo sapien
tagtaattatccgctcactttcggc

SEQ ID NO: 117110 - DNA, 25 bp, Homo sapien
gctggagatcaaacgtgcggccgca

SEQ ID NO: 117111 - DNA, 25 bp, Homo sapien
tggagatcaaacgtgcggccgcaga

SEQ ID NO: 117112 - DNA, 25 bp, Homo sapien
gagatcaaacgtgcggccgcagaac

SEQ ID NO: 117113 - DNA, 25 bp, Homo sapien
ggtgtcaggagagggctcaattctc

SEQ ID NO: 117114 - DNA, 25 bp, Homo sapien
agagggctcaattctcatttctgcc

SEQ ID NO: 117115 - DNA, 25 bp, Homo sapien
ctggctcatggtagctgggcatgac

SEQ ID NO: 117116 - DNA, 25 bp, Homo sapien
tgggcatgacttgccttcctacata

SEQ ID NO: 117117 - DNA, 25 bp, Homo sapien
atgacttgccttcctacataggttg

SEQ ID NO: 117118 - DNA, 25 bp, Homo sapien
acttgccttcctacataggttgtct

SEQ ID NO: 117119 - DNA, 25 bp, Homo sapien
gccttcctacataggttgtcttcat

SEQ ID NO: 117120 - DNA, 25 bp, Homo sapien
tcctacataggttgtcttcatacat

SEQ ID NO: 117121 - DNA, 25 bp, Homo sapien
ggttgtcttcatacatatgcactgg

SEQ ID NO: 117122 - DNA, 25 bp, Homo sapien
tcatacatatgcactgggaatcaat

SEQ ID NO: 117123 - DNA, 25 bp, Homo sapien
atatgcactgggaatcaataaaagc

SEQ ID NO: 117124 - DNA, 25 bp, Homo sapien
ggatgggagggattaatcctttctt

SEQ ID NO: 117125 - DNA, 25 bp, Homo sapien
gagggattaatcctttctttggtag

SEQ ID NO: 117126 - DNA, 25 bp, Homo sapien
ggattaatcctttctttggtagagc

SEQ ID NO: 117127 - DNA, 25 bp, Homo sapien
attaatcctttctttggtagagcaa

SEQ ID NO: 117128 - DNA, 25 bp, Homo sapien
taatcctttctttggtagagcaagt

SEQ ID NO: 117129 - DNA, 25 bp, Homo sapien
atcctttctttggtagagcaagtta

SEQ ID NO: 117130 - DNA, 25 bp, Homo sapien
ttctttggtagagcaagttacgcac

SEQ ID NO: 117131 - DNA, 25 bp, Homo sapien
tggtagagcaagttacgcacagaac

SEQ ID NO: 117132 - DNA, 25 bp, Homo sapien
gtagagcaagttacgcacagaactt

SEQ ID NO: 117133 - DNA, 25 bp, Homo sapien
gagcaagttacgcacagaactttca

SEQ ID NO: 117134 - DNA, 25 bp, Homo sapien
agttacgcacagaactttcagggca

SEQ ID NO: 117135 - DNA, 25 bp, Homo sapien
gccttcgtgaggaagaccagcatct

SEQ ID NO: 117136 - DNA, 25 bp, Homo sapien
cgaggccacggcttccattgacatg

SEQ ID NO: 117137 - DNA, 25 bp, Homo sapien
ggccacggaaaacatcctccaaaag

SEQ ID NO: 117138 - DNA, 25 bp, Homo sapien
ggtggtgatgacagccttcgcagac

SEQ ID NO: 117139 - DNA, 25 bp, Homo sapien
tgtggtcaccatcgcgcatcgagtg

SEQ ID NO: 117140 - DNA, 25 bp, Homo sapien
cgcatcgagtgcacaccatcctgag

SEQ ID NO: 117141 - DNA, 25 bp, Homo sapien
ccatcctgagtgcagacctggtgat

SEQ ID NO: 117142 - DNA, 25 bp, Homo sapien
cagacctggtgatcgtcctgaagcg

SEQ ID NO: 117143 - DNA, 25 bp, Homo sapien
gggtgccatccttgagttcgataag

SEQ ID NO: 117144 - DNA, 25 bp, Homo sapien
tgctcagccggaaggacagcgtctt

SEQ ID NO: 117145 - DNA, 25 bp, Homo sapien
ttcgtccgtgcagacaagtgacctg

SEQ ID NO: 117146 - DNA, 25 bp, Homo sapien
acatttaacaagaatcacatctctg

SEQ ID NO: 117147 - DNA, 25 bp, Homo sapien
gaatcacatctctgatttcagtgtt

SEQ ID NO: 117148 - DNA, 25 bp, Homo sapien
gatttcagtgtttatgactttatct

SEQ ID NO: 117149 - DNA, 25 bp, Homo sapien
gtttatgactttatctaggagtttg

SEQ ID NO: 117150 - DNA, 25 bp, Homo sapien
gttttagctgaaatgaggagtcaca

SEQ ID NO: 117151 - DNA, 25 bp, Homo sapien
ggaggtgatattttcctcaatggca

SEQ ID NO: 117152 - DNA, 25 bp, Homo sapien
gaaagaatccatgctataggtttat

SEQ ID NO: 117153 - DNA, 25 bp, Homo sapien
ggtttatttccatacctgactctgg

SEQ ID NO: 117154 - DNA, 25 bp, Homo sapien
atttccatacctgactctgggtgtg

SEQ ID NO: 117155 - DNA, 25 bp, Homo sapien
cctgactctgggtgtggtggttaaa

SEQ ID NO: 117156 - DNA, 25 bp, Homo sapien
ctctgggtgtggtggttaaaatact

SEQ ID NO: 117157 - DNA, 25 bp, Homo sapien
ggaattgctagagttcttaatagac

SEQ ID NO: 117158 - DNA, 25 bp, Homo sapien
ttgctagagttcttaatagactggt

SEQ ID NO: 117159 - DNA, 25 bp, Homo sapien
gttcttaatagactggtagagctgg

SEQ ID NO: 117160 - DNA, 25 bp, Homo sapien
gtagagctggctcgaacttgcatag

SEQ ID NO: 117161 - DNA, 25 bp, Homo sapien
gagctggctcgaacttgcataggga

SEQ ID NO: 117162 - DNA, 25 bp, Homo sapien
gctggctcgaacttgcatagggacc

SEQ ID NO: 117163 - DNA, 25 bp, Homo sapien
tggctcgaacttgcatagggacccc

SEQ ID NO: 117164 - DNA, 25 bp, Homo sapien
gctcgaacttgcatagggaccccat

SEQ ID NO: 117165 - DNA, 25 bp, Homo sapien
tcgaacttgcatagggaccccatac

SEQ ID NO: 117166 - DNA, 25 bp, Homo sapien
aacttgcatagggaccccatactac

SEQ ID NO: 117167 - DNA, 25 bp, Homo sapien
catagggaccccatactacttgtca

SEQ ID NO: 117168 - DNA, 25 bp, Homo sapien
agcagccatactctcagttgggtgc

SEQ ID NO: 117169 - DNA, 25 bp, Homo sapien
gcagccatactctcagttgggtgcg

SEQ ID NO: 117170 - DNA, 25 bp, Homo sapien
cagccatactctcagttgggtgcga

SEQ ID NO: 117171 - DNA, 25 bp, Homo sapien
agccatactctcagttgggtgcgac

SEQ ID NO: 117172 - DNA, 25 bp, Homo sapien
gccatactctcagttgggtgcgaca

SEQ ID NO: 117173 - DNA, 25 bp, Homo sapien
ccatactctcagttgggtgcgacag

SEQ ID NO: 117174 - DNA, 25 bp, Homo sapien
catactctcagttgggtgcgacagg

SEQ ID NO: 117175 - DNA, 25 bp, Homo sapien
accttcagcagccatactctcagtt

SEQ ID NO: 117176 - DNA, 25 bp, Homo sapien
ttcagcagccatactctcagttggg

SEQ ID NO: 117177 - DNA, 25 bp, Homo sapien
tcagcagccatactctcagttgggt

SEQ ID NO: 117178 - DNA, 25 bp, Homo sapien
cagcagccatactctcagttgggtg

SEQ ID NO: 117179 - DNA, 25 bp, Homo sapien
aaaaccttgactgcctatggaggaa

SEQ ID NO: 117180 - DNA, 25 bp, Homo sapien
agctggcatagctagtgcagagttc

SEQ ID NO: 117181 - DNA, 25 bp, Homo sapien
atagctagtgcagagttcagatttt

SEQ ID NO: 117182 - DNA, 25 bp, Homo sapien
gctgataatcttttacaccttggga

SEQ ID NO: 117183 - DNA, 25 bp, Homo sapien
ctttaatatccgtacctgaaggctg

SEQ ID NO: 117184 - DNA, 25 bp, Homo sapien
gtacctgaaggctgattcacctaaa

SEQ ID NO: 117185 - DNA, 25 bp, Homo sapien
tcctttctgctcttacacagcattg

SEQ ID NO: 117186 - DNA, 25 bp, Homo sapien
gttttgtccaatcaacacagcctgc

SEQ ID NO: 117187 - DNA, 25 bp, Homo sapien
aacacagcctgcactgaaaggacct

SEQ ID NO: 117188 - DNA, 25 bp, Homo sapien
ggacctgcatagactatgtctgtgc

SEQ ID NO: 117189 - DNA, 25 bp, Homo sapien
gtctgtgcaaagtgcctgagtgtct

SEQ ID NO: 117190 - DNA, 25 bp, Homo sapien
tgccttggagtaaatcacattcaca

SEQ ID NO: 117191 - DNA, 25 bp, Homo sapien
gctacacagagatatcaagtccaag

SEQ ID NO: 117192 - DNA, 25 bp, Homo sapien
agtccaagaatatcttcctcactca

SEQ ID NO: 117193 - DNA, 25 bp, Homo sapien
gaatatcttcctcactcagaatgga

SEQ ID NO: 117194 - DNA, 25 bp, Homo sapien
attgggagactttggatctgcccgt

SEQ ID NO: 117195 - DNA, 25 bp, Homo sapien
gtcttctctccaatccgatggcatt

SEQ ID NO: 117196 - DNA, 25 bp, Homo sapien
atccgatggcatttgcttgtaccta

SEQ ID NO: 117197 - DNA, 25 bp, Homo sapien
gcttgtacctatgtgggaactcctt

SEQ ID NO: 117198 - DNA, 25 bp, Homo sapien
gtgggaactccttattatgtgcctc

SEQ ID NO: 117199 - DNA, 25 bp, Homo sapien
ctccttattatgtgcctccagaaat

SEQ ID NO: 117200 - DNA, 25 bp, Homo sapien
gacatgatacttaattggtttaccc

SEQ ID NO: 117201 - DNA, 25 bp, Homo sapien
gaaagtaataacaagctcagacgaa

SEQ ID NO: 117202 - DNA, 25 bp, Homo sapien
acaagctcagacgaagatggtggtt

SEQ ID NO: 117203 - DNA, 25 bp, Homo sapien
ctcagacgaagatggtggttgtaca

SEQ ID NO: 117204 - DNA, 25 bp, Homo sapien
tggtggttgtacattattcatctag

SEQ ID NO: 117205 - DNA, 25 bp, Homo sapien
ttgaagctagttattaaactggaat

SEQ ID NO: 117206 - DNA, 25 bp, Homo sapien
ctggaatagcagttatatccctgag

SEQ ID NO: 117207 - DNA, 25 bp, Homo sapien
gaatagcagttatatccctgagaat

SEQ ID NO: 117208 - DNA, 25 bp, Homo sapien
tagcagttatatccctgagaatggg

SEQ ID NO: 117209 - DNA, 25 bp, Homo sapien
ggcccttctcttgacattccttttg

SEQ ID NO: 117210 - DNA, 25 bp, Homo sapien
aatcctgagagattaaacagtagta

SEQ ID NO: 117211 - DNA, 25 bp, Homo sapien
aacagtagtagacttgttaagaatg

SEQ ID NO: 117212 - DNA, 25 bp, Homo sapien
tttgttttactgagatgcttttgta

SEQ ID NO: 117213 - DNA, 25 bp, Homo sapien
gtgacagtttagtaattctacagat

SEQ ID NO: 117214 - DNA, 25 bp, Homo sapien
cttaatatttctccatcatggcctt

SEQ ID NO: 117215 - DNA, 25 bp, Homo sapien
catcatggccttttacttcacaatt

SEQ ID NO: 117216 - DNA, 25 bp, Homo sapien
aatctcaaatgttgtttaactgctt

SEQ ID NO: 117217 - DNA, 25 bp, Homo sapien
aactgctttaaattcatatacgtag

SEQ ID NO: 117218 - DNA, 25 bp, Homo sapien
aaatgtgttttcacgggatttatat

SEQ ID NO: 117219 - DNA, 25 bp, Homo sapien
ttgtgaactaaactaagcctacttt

SEQ ID NO: 117220 - DNA, 25 bp, Homo sapien
aagcctactttttgtgacttatttg

SEQ ID NO: 117221 - DNA, 25 bp, Homo sapien
actttttgtgacttatttgtgatgc

SEQ ID NO: 117222 - DNA, 25 bp, Homo sapien
tttgtgatgccttgttgataaatat

SEQ ID NO: 117223 - DNA, 25 bp, Homo sapien
ccacccacctcgtgtatagatttta

SEQ ID NO: 117224 - DNA, 25 bp, Homo sapien
tgttaacattagacctctgccacag

SEQ ID NO: 117225 - DNA, 25 bp, Homo sapien
gccacaggctgggatttctatacat

SEQ ID NO: 117226 - DNA, 25 bp, Homo sapien
ctaggacagcaaacgccaggcggta

SEQ ID NO: 117227 - DNA, 25 bp, Homo sapien
ctctccacggagatcgaggacacga

SEQ ID NO: 117228 - DNA, 25 bp, Homo sapien
aggacacgaagcaaactgcctcttg

SEQ ID NO: 117229 - DNA, 25 bp, Homo sapien
ttttgtgcttcggacacacgcggac

SEQ ID NO: 117230 - DNA, 25 bp, Homo sapien
ccagcaggcgccacggaaatgggca

SEQ ID NO: 117231 - DNA, 25 bp, Homo sapien
atgggcaagcccctgcagtgtaccc

SEQ ID NO: 117232 - DNA, 25 bp, Homo sapien
agtgtacccctgtcataactgtgag

SEQ ID NO: 117233 - DNA, 25 bp, Homo sapien
gctgcagctccggaacaataaatcc

SEQ ID NO: 117234 - DNA, 25 bp, Homo sapien
aacgtcgctgatggagaaagggctc

SEQ ID NO: 117235 - DNA, 25 bp, Homo sapien
gaaggaacggcctgtaccgtgcgct

SEQ ID NO: 117236 - DNA, 25 bp, Homo sapien
gcacaatcgcgtctcttgtgtctca

SEQ ID NO: 117237 - DNA, 25 bp, Homo sapien
ctcttgtgtctcactcacggaaaga

SEQ ID NO: 117238 - DNA, 25 bp, Homo sapien
agaaacaacctgaaggccatcccgt

SEQ ID NO: 117239 - DNA, 25 bp, Homo sapien
gtcggtctgcacgtaaccgtgaaga

SEQ ID NO: 117240 - DNA, 25 bp, Homo sapien
aaccgtgaagacgtgtggccgcgtc

SEQ ID NO: 117241 - DNA, 25 bp, Homo sapien
gcacccggcactgtaggagtcacgt

SEQ ID NO: 117242 - DNA, 25 bp, Homo sapien
gagtcacgtgcagcctttctcaggg

SEQ ID NO: 117243 - DNA, 25 bp, Homo sapien
ggaaacgtttgatgtctgtgtcagc

SEQ ID NO: 117244 - DNA, 25 bp, Homo sapien
ctgtgtcagctgtctttgtagttag

SEQ ID NO: 117245 - DNA, 25 bp, Homo sapien
ctcatttatgacaataataagcgac

SEQ ID NO: 117246 - DNA, 25 bp, Homo sapien
tcatttatgacaataataagcgacc

SEQ ID NO: 117247 - DNA, 25 bp, Homo sapien
catttatgacaataataagcgaccc

SEQ ID NO: 117248 - DNA, 25 bp, Homo sapien
cccaggacagaaggtcgccatctcc

SEQ ID NO: 117249 - DNA, 25 bp, Homo sapien
ccaggacagaaggtcgccatctcct

SEQ ID NO: 117250 - DNA, 25 bp, Homo sapien
caggacagaaggtcgccatctcctg

SEQ ID NO: 117251 - DNA, 25 bp, Homo sapien
aggacagaaggtcgccatctcctgc

SEQ ID NO: 117252 - DNA, 25 bp, Homo sapien
gaaggtcgccatctcctgctctgga

SEQ ID NO: 117253 - DNA, 25 bp, Homo sapien
aaggtcgccatctcctgctctggaa

SEQ ID NO: 117254 - DNA, 25 bp, Homo sapien
aggtcgccatctcctgctctggaag

SEQ ID NO: 117255 - DNA, 25 bp, Homo sapien
taactaatggatacttagggtgatg

SEQ ID NO: 117256 - DNA, 25 bp, Homo sapien
aactaatggatacttagggtgatga

SEQ ID NO: 117257 - DNA, 25 bp, Homo sapien
actaatggatacttagggtgatgaa

SEQ ID NO: 117258 - DNA, 25 bp, Homo sapien
ctaatggatacttagggtgatgaaa

SEQ ID NO: 117259 - DNA, 25 bp, Homo sapien
taatggatacttagggtgatgaaat

SEQ ID NO: 117260 - DNA, 25 bp, Homo sapien
aatggatacttagggtgatgaaata

SEQ ID NO: 117261 - DNA, 25 bp, Homo sapien
tggatacttagggtgatgaaataat

SEQ ID NO: 117262 - DNA, 25 bp, Homo sapien
ccccatgacacacctttatgtatgt

SEQ ID NO: 117263 - DNA, 25 bp, Homo sapien
cccatgacacacctttatgtatgta

SEQ ID NO: 117264 - DNA, 25 bp, Homo sapien
ccatgacacacctttatgtatgtaa

SEQ ID NO: 117265 - DNA, 25 bp, Homo sapien
catgacacacctttatgtatgtaac

SEQ ID NO: 117266 - DNA, 25 bp, Homo sapien
agtgggagcaccaactataacccct

SEQ ID NO: 117267 - DNA, 25 bp, Homo sapien
tattactgtgcgagaacgatttcgg

SEQ ID NO: 117268 - DNA, 25 bp, Homo sapien
attactgtgcgagaacgatttcggg

SEQ ID NO: 117269 - DNA, 25 bp, Homo sapien
ttactgtgcgagaacgatttcgggg

SEQ ID NO: 117270 - DNA, 25 bp, Homo sapien
tgcgagaacgatttcggggggtcga

SEQ ID NO: 117271 - DNA, 25 bp, Homo sapien
ggtcgattacgatttttggagtgga

SEQ ID NO: 117272 - DNA, 25 bp, Homo sapien
gattacgatttttggagtggacccg

SEQ ID NO: 117273 - DNA, 25 bp, Homo sapien
tacgatttttggagtggacccgagg

SEQ ID NO: 117274 - DNA, 25 bp, Homo sapien
gagggggaaattactactactacat

SEQ ID NO: 117275 - DNA, 25 bp, Homo sapien
aattactactactacatggacgtct

SEQ ID NO: 117276 - DNA, 25 bp, Homo sapien
attactactactacatggacgtctg

SEQ ID NO: 117277 - DNA, 25 bp, Homo sapien
ctgaagaaactacagcacgctgcag

SEQ ID NO: 117278 - DNA, 25 bp, Homo sapien
acagcacgctgcagaactggaacaa

SEQ ID NO: 117279 - DNA, 25 bp, Homo sapien
agtaatgttatacaactactgcata

SEQ ID NO: 117280 - DNA, 25 bp, Homo sapien
tactgtcaacaagagattacctgct

SEQ ID NO: 117281 - DNA, 25 bp, Homo sapien
gagattacctgctttactggagaag

SEQ ID NO: 117282 - DNA, 25 bp, Homo sapien
acctgctttactggagaagaatgcc

SEQ ID NO: 117283 - DNA, 25 bp, Homo sapien
gaagaatgccatgcgtgtgtccttg

SEQ ID NO: 117284 - DNA, 25 bp, Homo sapien
aatgccatgcgtgtgtccttggatg

SEQ ID NO: 117285 - DNA, 25 bp, Homo sapien
atgcgtgtgtccttggatgctgcag

SEQ ID NO: 117286 - DNA, 25 bp, Homo sapien
gtgtgtccttggatgctgcaggaaa

SEQ ID NO: 117287 - DNA, 25 bp, Homo sapien
atccattctggaaactgagaagcga

SEQ ID NO: 117288 - DNA, 25 bp, Homo sapien
gtgcagcctcgggattcgtttttaa

SEQ ID NO: 117289 - DNA, 25 bp, Homo sapien
cagcctcgggattcgtttttaatgt

SEQ ID NO: 117290 - DNA, 25 bp, Homo sapien
ctcgggattcgtttttaatgtgtat

SEQ ID NO: 117291 - DNA, 25 bp, Homo sapien
taatgtgtattggatgagttgggtc

SEQ ID NO: 117292 - DNA, 25 bp, Homo sapien
gggtggccaatataaatcaagatgg

SEQ ID NO: 117293 - DNA, 25 bp, Homo sapien
tcaagatggaagtcagaaatggtat

SEQ ID NO: 117294 - DNA, 25 bp, Homo sapien
gaaatggtatctggactctgtgaag

SEQ ID NO: 117295 - DNA, 25 bp, Homo sapien
ctgtgcgagaggagattactacgac

SEQ ID NO: 117296 - DNA, 25 bp, Homo sapien
gcgagaggagattactacgactata

SEQ ID NO: 117297 - DNA, 25 bp, Homo sapien
ctacgactatagtggtaattacatt

SEQ ID NO: 117298 - DNA, 25 bp, Homo sapien
ttacattgatgcttttgatgcctgg

SEQ ID NO: 117299 - DNA, 25 bp, Homo sapien
atgggacctaccagggctggataac

SEQ ID NO: 117300 - DNA, 25 bp, Homo sapien
tgggacctaccagggctggataacc

SEQ ID NO: 117301 - DNA, 25 bp, Homo sapien
acctaccagggctggataaccttgg

SEQ ID NO: 117302 - DNA, 25 bp, Homo sapien
cctaccagggctggataaccttggc

SEQ ID NO: 117303 - DNA, 25 bp, Homo sapien
ctaccagggctggataaccttggct

SEQ ID NO: 117304 - DNA, 25 bp, Homo sapien
taccagggctggataaccttggctg

SEQ ID NO: 117305 - DNA, 25 bp, Homo sapien
accagggctggataaccttggctgt

SEQ ID NO: 117306 - DNA, 25 bp, Homo sapien
ccagggctggataaccttggctgta

SEQ ID NO: 117307 - DNA, 25 bp, Homo sapien
cagggctggataaccttggctgtac

SEQ ID NO: 117308 - DNA, 25 bp, Homo sapien
agggctggataaccttggctgtacc

SEQ ID NO: 117309 - DNA, 25 bp, Homo sapien
gggctggataaccttggctgtaccc

SEQ ID NO: 117310 - DNA, 25 bp, Homo sapien
gggaccctgcggctagagtgggcta

SEQ ID NO: 117311 - DNA, 25 bp, Homo sapien
ctagagtgggctaggccctggcttt

SEQ ID NO: 117312 - DNA, 25 bp, Homo sapien
ggctttgcccgtcagatttgaacga

SEQ ID NO: 117313 - DNA, 25 bp, Homo sapien
tgcccgtcagatttgaacgaatgtg

SEQ ID NO: 117314 - DNA, 25 bp, Homo sapien
aacgaatgtgtgtcccttgagccca

SEQ ID NO: 117315 - DNA, 25 bp, Homo sapien
tagccctttagcctttcaccctgtg

SEQ ID NO: 117316 - DNA, 25 bp, Homo sapien
gagcaaaaatgagccagcaccagcg

SEQ ID NO: 117317 - DNA, 25 bp, Homo sapien
agcaccagcgccttggctttgtgtt

SEQ ID NO: 117318 - DNA, 25 bp, Homo sapien
cgccttggctttgtgttagcatttc

SEQ ID NO: 117319 - DNA, 25 bp, Homo sapien
agcatttcctcctgaagtgttctgt

SEQ ID NO: 117320 - DNA, 25 bp, Homo sapien
atttcctcctgaagtgttctgttgg

SEQ ID NO: 117321 - DNA, 25 bp, Homo sapien
gccctaccctggcaacatcatttaa

SEQ ID NO: 117322 - DNA, 25 bp, Homo sapien
cctaccctggcaacatcatttaacg

SEQ ID NO: 117323 - DNA, 25 bp, Homo sapien
taccctggcaacatcatttaacgac

SEQ ID NO: 117324 - DNA, 25 bp, Homo sapien
ccctggcaacatcatttaacgacgt

SEQ ID NO: 117325 - DNA, 25 bp, Homo sapien
ctggcaacatcatttaacgacgtct

SEQ ID NO: 117326 - DNA, 25 bp, Homo sapien
tggcaacatcatttaacgacgtctc

SEQ ID NO: 117327 - DNA, 25 bp, Homo sapien
gcaacatcatttaacgacgtctccc

SEQ ID NO: 117328 - DNA, 25 bp, Homo sapien
aacatcatttaacgacgtctcccag

SEQ ID NO: 117329 - DNA, 25 bp, Homo sapien
acatcatttaacgacgtctcccagg

SEQ ID NO: 117330 - DNA, 25 bp, Homo sapien
agatccaattccttccccttcgctt

SEQ ID NO: 117331 - DNA, 25 bp, Homo sapien
cttcgcttccgcaggtcggagggcc

SEQ ID NO: 117332 - DNA, 25 bp, Homo sapien
atggatgacacagaacatcctgaag

SEQ ID NO: 117333 - DNA, 25 bp, Homo sapien
aagatggtatcttcattcgccaagt

SEQ ID NO: 117334 - DNA, 25 bp, Homo sapien
ggtatcttcattcgccaagtgacag

SEQ ID NO: 117335 - DNA, 25 bp, Homo sapien
ttcattcgccaagtgacagatgcag

SEQ ID NO: 117336 - DNA, 25 bp, Homo sapien
tcgccaagtgacagatgcagaaaca

SEQ ID NO: 117337 - DNA, 25 bp, Homo sapien
acagatgcagaaacaaaacccaagt

SEQ ID NO: 117338 - DNA, 25 bp, Homo sapien
cttgccttcagtaatgatgggacta

SEQ ID NO: 117339 - DNA, 25 bp, Homo sapien
taatgatgggactacgcttgcaata

SEQ ID NO: 117340 - DNA, 25 bp, Homo sapien
gggactacgcttgcaatagcgtcat

SEQ ID NO: 117341 - DNA, 25 bp, Homo sapien
gcttgcaatagcgtcatcatatatg

SEQ ID NO: 117342 - DNA, 25 bp, Homo sapien
gcaatagcgtcatcatatatgtatg

SEQ ID NO: 117343 - DNA, 25 bp, Homo sapien
gggaccccatcgtttaaggccatgt

SEQ ID NO: 117344 - DNA, 25 bp, Homo sapien
ggccatgtcactagaagcgcagttt

SEQ ID NO: 117345 - DNA, 25 bp, Homo sapien
aaaggcatggtgacccatgaccaga

SEQ ID NO: 117346 - DNA, 25 bp, Homo sapien
gatcctatggttatgtgtgccaggc

SEQ ID NO: 117347 - DNA, 25 bp, Homo sapien
atcaatattggatggcgaggacagc

SEQ ID NO: 117348 - DNA, 25 bp, Homo sapien
gtactggctgcgagtgttcctgaga

SEQ ID NO: 117349 - DNA, 25 bp, Homo sapien
tgggatgacttatgacacttgcaca

SEQ ID NO: 117350 - DNA, 25 bp, Homo sapien
atgacacttgcacagcatggctctg

SEQ ID NO: 117351 - DNA, 25 bp, Homo sapien
atggctctgcctcacaatgatgcag

SEQ ID NO: 117352 - DNA, 25 bp, Homo sapien
ggtgaagaagtgacctgcgacacag

SEQ ID NO: 117353 - DNA, 25 bp, Homo sapien
gcgacacaggaaacgatgggacctc

SEQ ID NO: 117354 - DNA, 25 bp, Homo sapien
gaagccacagactcttacgtggaga

SEQ ID NO: 117355 - DNA, 25 bp, Homo sapien
tggagagtgcactgacctgtaggtc

SEQ ID NO: 117356 - DNA, 25 bp, Homo sapien
tgacctgtaggtcaggaccatcaga

SEQ ID NO: 117357 - DNA, 25 bp, Homo sapien
agagaggcaaggttgccctttcctt

SEQ ID NO: 117358 - DNA, 25 bp, Homo sapien
aatccctcagatcccactaaagtgt

SEQ ID NO: 117359 - DNA, 25 bp, Homo sapien
ggaagggaccaagcgaccaaggata

SEQ ID NO: 117360 - DNA, 25 bp, Homo sapien
aagcgaccaaggataggccatctgg

SEQ ID NO: 117361 - DNA, 25 bp, Homo sapien
tatgcccacatacccacgtttgttc

SEQ ID NO: 117362 - DNA, 25 bp, Homo sapien
tttgttcgcttcctgagtcttttca

SEQ ID NO: 117363 - DNA, 25 bp, Homo sapien
attgctacctctaatagtcctgtct

SEQ ID NO: 117364 - DNA, 25 bp, Homo sapien
tcctcttccgagctgctttgtgggc

SEQ ID NO: 117365 - DNA, 25 bp, Homo sapien
ccttgaatgcatgatactgaatgaa

SEQ ID NO: 117366 - DNA, 25 bp, Homo sapien
cttgaatgcatgatactgaatgaaa

SEQ ID NO: 117367 - DNA, 25 bp, Homo sapien
ttgaatgcatgatactgaatgaaag

SEQ ID NO: 117368 - DNA, 25 bp, Homo sapien
tgaatgcatgatactgaatgaaaga

SEQ ID NO: 117369 - DNA, 25 bp, Homo sapien
gaatgcatgatactgaatgaaagac

SEQ ID NO: 117370 - DNA, 25 bp, Homo sapien
tcagatgcaaaaggtcacatagtgt

SEQ ID NO: 117371 - DNA, 25 bp, Homo sapien
cagatgcaaaaggtcacatagtgta

SEQ ID NO: 117372 - DNA, 25 bp, Homo sapien
agatgcaaaaggtcacatagtgtac

SEQ ID NO: 117373 - DNA, 25 bp, Homo sapien
gatgcaaaaggtcacatagtgtact

SEQ ID NO: 117374 - DNA, 25 bp, Homo sapien
atgcaaaaggtcacatagtgtactg

SEQ ID NO: 117375 - DNA, 25 bp, Homo sapien
gacagttgtcaccagtgtgcaatgg

SEQ ID NO: 117376 - DNA, 25 bp, Homo sapien
ggaggcattatgacaccaccgaaga

SEQ ID NO: 117377 - DNA, 25 bp, Homo sapien
atgacaccaccgaagagcactgaaa

SEQ ID NO: 117378 - DNA, 25 bp, Homo sapien
gaagagcactgaaaaaccaccagga

SEQ ID NO: 117379 - DNA, 25 bp, Homo sapien
gaagtggttaagaaagcctcaggtt

SEQ ID NO: 117380 - DNA, 25 bp, Homo sapien
aaagcctcaggtttggagtgggaca

SEQ ID NO: 117381 - DNA, 25 bp, Homo sapien
gtagattggatggtaccttttgtca

SEQ ID NO: 117382 - DNA, 25 bp, Homo sapien
gatggtaccttttgtcaatgtagta

SEQ ID NO: 117383 - DNA, 25 bp, Homo sapien
aaaagtactagtccagtgaagctga

SEQ ID NO: 117384 - DNA, 25 bp, Homo sapien
gacagacataatatccagacacata

SEQ ID NO: 117385 - DNA, 25 bp, Homo sapien
tacaaactatttggctatgctggag

SEQ ID NO: 117386 - DNA, 25 bp, Homo sapien
aaaagtgatgactggctatttggaa

SEQ ID NO: 117387 - DNA, 25 bp, Homo sapien
ggtgctactgccaactgggtgtatc

SEQ ID NO: 117388 - DNA, 25 bp, Homo sapien
gccaactgggtgtatcataagctct

SEQ ID NO: 117389 - DNA, 25 bp, Homo sapien
gggtgtatcataagctctaagatca

SEQ ID NO: 117390 - DNA, 25 bp, Homo sapien
caagattttgtagagtggacagtca

SEQ ID NO: 117391 - DNA, 25 bp, Homo sapien
gagtggacagtcattacatatgtta

SEQ ID NO: 117392 - DNA, 25 bp, Homo sapien
actttatcctttcagctttacttag

SEQ ID NO: 117393 - DNA, 25 bp, Homo sapien
ttcagctttacttagtgcgatgttt

SEQ ID NO: 117394 - DNA, 25 bp, Homo sapien
gtgcgatgttttagaagcagtcttc

SEQ ID NO: 117395 - DNA, 25 bp, Homo sapien
aaaacactaaccatgcatgtgacat

SEQ ID NO: 117396 - DNA, 25 bp, Homo sapien
catgcatgtgacatattggtgaaca

SEQ ID NO: 117397 - DNA, 25 bp, Homo sapien
gagagccggccgtggaaggagggat

SEQ ID NO: 117398 - DNA, 25 bp, Homo sapien
ggagggatgcgtggttccagccaaa

SEQ ID NO: 117399 - DNA, 25 bp, Homo sapien
ttgagggctaaaaaggtcctgtaag

SEQ ID NO: 117400 - DNA, 25 bp, Homo sapien
tggttatgtgggtgaccctggactc

SEQ ID NO: 117401 - DNA, 25 bp, Homo sapien
ggtgaccctggactcgccactggta

SEQ ID NO: 117402 - DNA, 25 bp, Homo sapien
gcggcggcctaagcctttgccgtga

SEQ ID NO: 117403 - DNA, 25 bp, Homo sapien
cactgagaatgctaatggttgggtt

SEQ ID NO: 117404 - DNA, 25 bp, Homo sapien
ctaatggttgggttgattgtatgtt

SEQ ID NO: 117405 - DNA, 25 bp, Homo sapien
gttgaggatctattactgaccgtat

SEQ ID NO: 117406 - DNA, 25 bp, Homo sapien
gaggatctattactgaccgtatgat

SEQ ID NO: 117407 - DNA, 25 bp, Homo sapien
attactgaccgtatgatgaggccaa

SEQ ID NO: 117408 - DNA, 25 bp, Homo sapien
taacgaatgaccaagggccaaggaa

SEQ ID NO: 117409 - DNA, 25 bp, Homo sapien
gagtgcgctgggacgttgtgtgcaa

SEQ ID NO: 117410 - DNA, 25 bp, Homo sapien
cgttgtgtgcaatagagaggtctcc

SEQ ID NO: 117411 - DNA, 25 bp, Homo sapien
atagagaggtctccacaccagatgt

SEQ ID NO: 117412 - DNA, 25 bp, Homo sapien
ggtctccacaccagatgtcttccag

SEQ ID NO: 117413 - DNA, 25 bp, Homo sapien
cttccagattctgtgcctctggctt

SEQ ID NO: 117414 - DNA, 25 bp, Homo sapien
tgcctctggctttgttgtccagcca

SEQ ID NO: 117415 - DNA, 25 bp, Homo sapien
cagccaggcctgcagtttattttca

SEQ ID NO: 117416 - DNA, 25 bp, Homo sapien
attttcacagtggacagagagagag

SEQ ID NO: 117417 - DNA, 25 bp, Homo sapien
gaggctgcatgtgtgtaccgtgtgt

SEQ ID NO: 117418 - DNA, 25 bp, Homo sapien
ctgctttctttccacagctttcttc

SEQ ID NO: 117419 - DNA, 25 bp, Homo sapien
atagtgatgacgcagcttccagcca

SEQ ID NO: 117420 - DNA, 25 bp, Homo sapien
tagtgatgacgcagcttccagccac

SEQ ID NO: 117421 - DNA, 25 bp, Homo sapien
atgacgcagcttccagccaccctgt

SEQ ID NO: 117422 - DNA, 25 bp, Homo sapien
tactgtcaacactataataactggc

SEQ ID NO: 117423 - DNA, 25 bp, Homo sapien
ctgtcaacactataataactggcct

SEQ ID NO: 117424 - DNA, 25 bp, Homo sapien
gtcaacactataataactggcctcc

SEQ ID NO: 117425 - DNA, 25 bp, Homo sapien
caacactataataactggcctccgt

SEQ ID NO: 117426 - DNA, 25 bp, Homo sapien
acactataataactggcctccgtgg

SEQ ID NO: 117427 - DNA, 25 bp, Homo sapien
actataataactggcctccgtggac

SEQ ID NO: 117428 - DNA, 25 bp, Homo sapien
ataataactggcctccgtggacgtt

SEQ ID NO: 117429 - DNA, 25 bp, Homo sapien
taataactggcctccgtggacgttc

SEQ ID NO: 117430 - DNA, 25 bp, Homo sapien
atatcaagcaggaccctaagatgaa

SEQ ID NO: 117431 - DNA, 25 bp, Homo sapien
tgaagctgagcttttgatgccaggt

SEQ ID NO: 117432 - DNA, 25 bp, Homo sapien
gctgagcttttgatgccaggtgcaa

SEQ ID NO: 117433 - DNA, 25 bp, Homo sapien
ttttgatgccaggtgcaatctactg

SEQ ID NO: 117434 - DNA, 25 bp, Homo sapien
gccaggtgcaatctactggaaatgt

SEQ ID NO: 117435 - DNA, 25 bp, Homo sapien
actggaaatgtagcacttacgtaaa

SEQ ID NO: 117436 - DNA, 25 bp, Homo sapien
ccccacagttttaataagaacagat

SEQ ID NO: 117437 - DNA, 25 bp, Homo sapien
caggaattctaaataaatttcccag

SEQ ID NO: 117438 - DNA, 25 bp, Homo sapien
aaagattattgtgacttcactgtat

SEQ ID NO: 117439 - DNA, 25 bp, Homo sapien
gggacacctgtacattcttccatca

SEQ ID NO: 117440 - DNA, 25 bp, Homo sapien
cctgtacattcttccatcatcactg

SEQ ID NO: 117441 - DNA, 25 bp, Homo sapien
gagagcatagcacatcactacaaca

SEQ ID NO: 117442 - DNA, 25 bp, Homo sapien
acaacaaccagatcaggacgctgat

SEQ ID NO: 117443 - DNA, 25 bp, Homo sapien
ggaggaggaccctgaaaaatacgag

SEQ ID NO: 117444 - DNA, 25 bp, Homo sapien
gagcttgagcaccatgacataggcc

SEQ ID NO: 117445 - DNA, 25 bp, Homo sapien
gacataggcctcgaccatgatgcag

SEQ ID NO: 117446 - DNA, 25 bp, Homo sapien
catgatgcagaattggctccagcct

SEQ ID NO: 117447 - DNA, 25 bp, Homo sapien
agaattggctccagcctatgccgtc

SEQ ID NO: 117448 - DNA, 25 bp, Homo sapien
gcctatgccgtcctgaagagcatta

SEQ ID NO: 117449 - DNA, 25 bp, Homo sapien
aagagcattatccaggccggatgca

SEQ ID NO: 117450 - DNA, 25 bp, Homo sapien
ccggatgcagagtggcgatatattt

SEQ ID NO: 117451 - DNA, 25 bp, Homo sapien
tgtgtccagttttgcctgtctataa

SEQ ID NO: 117452 - DNA, 25 bp, Homo sapien
gggacggatcaaccctaacactggt

SEQ ID NO: 117453 - DNA, 25 bp, Homo sapien
aacactggtggcacaaactctgcac

SEQ ID NO: 117454 - DNA, 25 bp, Homo sapien
aactctgcacagaaatttcagggca

SEQ ID NO: 117455 - DNA, 25 bp, Homo sapien
ggagctcagcaacctgagatctgac

SEQ ID NO: 117456 - DNA, 25 bp, Homo sapien
agctcagcaacctgagatctgacga

SEQ ID NO: 117457 - DNA, 25 bp, Homo sapien
gggctattgtactactagcaactgc

SEQ ID NO: 117458 - DNA, 25 bp, Homo sapien
gctattgtactactagcaactgcaa

SEQ ID NO: 117459 - DNA, 25 bp, Homo sapien
ttgtactactagcaactgcaatctt

SEQ ID NO: 117460 - DNA, 25 bp, Homo sapien
gtactactagcaactgcaatcttaa

SEQ ID NO: 117461 - DNA, 25 bp, Homo sapien
actagcaactgcaatcttaaggata

SEQ ID NO: 117462 - DNA, 25 bp, Homo sapien
tcttaaggatacttttgttatctgg

SEQ ID NO: 117463 - DNA, 25 bp, Homo sapien
ctcccagcaagcatctggccaatcc

SEQ ID NO: 117464 - DNA, 25 bp, Homo sapien
tggccaatcctattcttcccgcgag

SEQ ID NO: 117465 - DNA, 25 bp, Homo sapien
ggccaatcctattcttcccgcgagg

SEQ ID NO: 117466 - DNA, 25 bp, Homo sapien
gccaatcctattcttcccgcgaggt

SEQ ID NO: 117467 - DNA, 25 bp, Homo sapien
caatcctattcttcccgcgaggtct

SEQ ID NO: 117468 - DNA, 25 bp, Homo sapien
aatcctattcttcccgcgaggtctt

SEQ ID NO: 117469 - DNA, 25 bp, Homo sapien
tcctattcttcccgcgaggtcttca

SEQ ID NO: 117470 - DNA, 25 bp, Homo sapien
tattcttcccgcgaggtcttcacct

SEQ ID NO: 117471 - DNA, 25 bp, Homo sapien
gcgaggtcttcacctcctcctcgtc

SEQ ID NO: 117472 - DNA, 25 bp, Homo sapien
tcctggcgcagttcccagctatctc

SEQ ID NO: 117473 - DNA, 25 bp, Homo sapien
gcagttcccagctatctcccctgct

SEQ ID NO: 117474 - DNA, 25 bp, Homo sapien
tataccagtatattcagagtcgctt

SEQ ID NO: 117475 - DNA, 25 bp, Homo sapien
tattcagagtcgcttttatcggtct

SEQ ID NO: 117476 - DNA, 25 bp, Homo sapien
agagtcgcttttatcggtctccaga

SEQ ID NO: 117477 - DNA, 25 bp, Homo sapien
tcgcttttatcggtctccagaggtg

SEQ ID NO: 117478 - DNA, 25 bp, Homo sapien
tttatcggtctccagaggtgctact

SEQ ID NO: 117479 - DNA, 25 bp, Homo sapien
agaggtgctactgggaatgccttat

SEQ ID NO: 117480 - DNA, 25 bp, Homo sapien
tctttgtaaccccaaacgcagtgca

SEQ ID NO: 117481 - DNA, 25 bp, Homo sapien
tgtaaccccaaacgcagtgcaatca

SEQ ID NO: 117482 - DNA, 25 bp, Homo sapien
aacgcagtgcaatcaagatagttga

SEQ ID NO: 117483 - DNA, 25 bp, Homo sapien
gatagttgactttggcagttcttgt

SEQ ID NO: 117484 - DNA, 25 bp, Homo sapien
gactttggcagttcttgtcagttgg

SEQ ID NO: 117485 - DNA, 25 bp, Homo sapien
tatccttttaagaactaccttcttg

SEQ ID NO: 117486 - DNA, 25 bp, Homo sapien
taagaactaccttcttggtagggca

SEQ ID NO: 117487 - DNA, 25 bp, Homo sapien
aagaactaccttcttggtagggcat

SEQ ID NO: 117488 - DNA, 25 bp, Homo sapien
agaactaccttcttggtagggcatg

SEQ ID NO: 117489 - DNA, 25 bp, Homo sapien
gaactaccttcttggtagggcatgg

SEQ ID NO: 117490 - DNA, 25 bp, Homo sapien
aactaccttcttggtagggcatggt

SEQ ID NO: 117491 - DNA, 25 bp, Homo sapien
actaccttcttggtagggcatggtg

SEQ ID NO: 117492 - DNA, 25 bp, Homo sapien
ctaccttcttggtagggcatggtgg

SEQ ID NO: 117493 - DNA, 25 bp, Homo sapien
tgtcagccagtctatgcaaaccctc

SEQ ID NO: 117494 - DNA, 25 bp, Homo sapien
tcctccttgtactcaactagtgcaa

SEQ ID NO: 117495 - DNA, 25 bp, Homo sapien
aactagtgcaaacctgcccgtcatg

SEQ ID NO: 117496 - DNA, 25 bp, Homo sapien
aacctgcccgtcatgggccatgaga

SEQ ID NO: 117497 - DNA, 25 bp, Homo sapien
tgagaagttccccagcgacttggac

SEQ ID NO: 117498 - DNA, 25 bp, Homo sapien
agcgacttggacctggacatgttca

SEQ ID NO: 117499 - DNA, 25 bp, Homo sapien
gacatgttcaatgggagcttggaat

SEQ ID NO: 117500 - DNA, 25 bp, Homo sapien
tggagtccattatccgtagtgaact

SEQ ID NO: 117501 - DNA, 25 bp, Homo sapien
gtgaactcatggatgctgatgggtt

SEQ ID NO: 117502 - DNA, 25 bp, Homo sapien
cctcatctccacacagaatgttgtt

SEQ ID NO: 117503 - DNA, 25 bp, Homo sapien
gaacttcactggtgctaagcaggcc

SEQ ID NO: 117504 - DNA, 25 bp, Homo sapien
cctgtgctctggaaaggctaccaaa

SEQ ID NO: 117505 - DNA, 25 bp, Homo sapien
ctgtgctctggaaaggctaccaaat

SEQ ID NO: 117506 - DNA, 25 bp, Homo sapien
gtgctctggaaaggctaccaaatac

SEQ ID NO: 117507 - DNA, 25 bp, Homo sapien
gctctggaaaggctaccaaatactg

SEQ ID NO: 117508 - DNA, 25 bp, Homo sapien
tctggaaaggctaccaaatactggc

SEQ ID NO: 117509 - DNA, 25 bp, Homo sapien
ggaaaggctaccaaatactggccaa

SEQ ID NO: 117510 - DNA, 25 bp, Homo sapien
aaggctaccaaatactggccaaggt

SEQ ID NO: 117511 - DNA, 25 bp, Homo sapien
ggctaccaaatactggccaaggtca

SEQ ID NO: 117512 - DNA, 25 bp, Homo sapien
ctaccaaatactggccaaggtcagg

SEQ ID NO: 117513 - DNA, 25 bp, Homo sapien
ccaaatactggccaaggtcaggagg

SEQ ID NO: 117514 - DNA, 25 bp, Homo sapien
aaatactggccaaggtcaggaggag

SEQ ID NO: 117515 - DNA, 25 bp, Homo sapien
tgatacattttttaagcttcagttg

SEQ ID NO: 117516 - DNA, 25 bp, Homo sapien
aagcttcagttgcttgtcttctggt

SEQ ID NO: 117517 - DNA, 25 bp, Homo sapien
cagttgcttgtcttctggtactttc

SEQ ID NO: 117518 - DNA, 25 bp, Homo sapien
cttgtcttctggtactttctgttat

SEQ ID NO: 117519 - DNA, 25 bp, Homo sapien
cttctggtactttctgttatgggct

SEQ ID NO: 117520 - DNA, 25 bp, Homo sapien
gtactttctgttatgggcttttggg

SEQ ID NO: 117521 - DNA, 25 bp, Homo sapien
ggagccagaagccaatctacaatct

SEQ ID NO: 117522 - DNA, 25 bp, Homo sapien
gaagccaatctacaatctctttttg

SEQ ID NO: 117523 - DNA, 25 bp, Homo sapien
caatctctttttgtttgccaggaca

SEQ ID NO: 117524 - DNA, 25 bp, Homo sapien
tctctttttgtttgccaggacatgc

SEQ ID NO: 117525 - DNA, 25 bp, Homo sapien
tttgtttgccaggacatgcaataaa

SEQ ID NO: 117526 - DNA, 25 bp, Homo sapien
ttgcaagaaaggatcaaagtgaacg

SEQ ID NO: 117527 - DNA, 25 bp, Homo sapien
gcaagaaaggatcaaagtgaacgga

SEQ ID NO: 117528 - DNA, 25 bp, Homo sapien
aaggatcaaagtgaacggaaaagct

SEQ ID NO: 117529 - DNA, 25 bp, Homo sapien
ggatcaaagtgaacggaaaagctgg

SEQ ID NO: 117530 - DNA, 25 bp, Homo sapien
tcaaagtgaacggaaaagctgggaa

SEQ ID NO: 117531 - DNA, 25 bp, Homo sapien
gtgaacggaaaagctgggaaccttg

SEQ ID NO: 117532 - DNA, 25 bp, Homo sapien
tgaacggaaaagctgggaaccttgg

SEQ ID NO: 117533 - DNA, 25 bp, Homo sapien
ggaaaagctgggaaccttggtggag

SEQ ID NO: 117534 - DNA, 25 bp, Homo sapien
aagagcaagatcaccgtgacatccg

SEQ ID NO: 117535 - DNA, 25 bp, Homo sapien
agagcaagatcaccgtgacatccga

SEQ ID NO: 117536 - DNA, 25 bp, Homo sapien
agcaagatcaccgtgacatccgagg

SEQ ID NO: 117537 - DNA, 25 bp, Homo sapien
ttgtgcggaatgttcatggcagccc

SEQ ID NO: 117538 - DNA, 25 bp, Homo sapien
ttcatggcagccctattcacagtag

SEQ ID NO: 117539 - DNA, 25 bp, Homo sapien
aaaaggataaacacaatatggtcca

SEQ ID NO: 117540 - DNA, 25 bp, Homo sapien
caatatggtccatccatacactgga

SEQ ID NO: 117541 - DNA, 25 bp, Homo sapien
gaatgaagcagtgatccccactaca

SEQ ID NO: 117542 - DNA, 25 bp, Homo sapien
cactacactgtggatgaaccttgaa

SEQ ID NO: 117543 - DNA, 25 bp, Homo sapien
tagtgtactgtccttttatatggaa

SEQ ID NO: 117544 - DNA, 25 bp, Homo sapien
tgtactgtccttttatatggaaatt

SEQ ID NO: 117545 - DNA, 25 bp, Homo sapien
gaaatttccaagaaacagggccaat

SEQ ID NO: 117546 - DNA, 25 bp, Homo sapien
aatttccaagaaacagggccaatct

SEQ ID NO: 117547 - DNA, 25 bp, Homo sapien
ttccaagaaacagggccaatctgaa

SEQ ID NO: 117548 - DNA, 25 bp, Homo sapien
aacacctgaggctttttctggaact

SEQ ID NO: 117549 - DNA, 25 bp, Homo sapien
gaggctttttctggaactgttatag

SEQ ID NO: 117550 - DNA, 25 bp, Homo sapien
gaaaaagaatttgtatcaccttcct

SEQ ID NO: 117551 - DNA, 25 bp, Homo sapien
atttgtatcaccttccttaacacca

SEQ ID NO: 117552 - DNA, 25 bp, Homo sapien
gcactacccactattccagaacgaa

SEQ ID NO: 117553 - DNA, 25 bp, Homo sapien
ctacccactattccagaacgaaagg

SEQ ID NO: 117554 - DNA, 25 bp, Homo sapien
tctgttggaagcatctgaagaaact

SEQ ID NO: 117555 - DNA, 25 bp, Homo sapien
tttaaagctgccagattgcaacaga

SEQ ID NO: 117556 - DNA, 25 bp, Homo sapien
gattgcaacagaaagactaggccct

SEQ ID NO: 117557 - DNA, 25 bp, Homo sapien
aaagactaggccctgtctaggaaat

SEQ ID NO: 117558 - DNA, 25 bp, Homo sapien
aggccctgtctaggaaatgggaatt

SEQ ID NO: 117559 - DNA, 25 bp, Homo sapien
gccctaccctggcaacatcatttaa

SEQ ID NO: 117560 - DNA, 25 bp, Homo sapien
ctaccctggcaacatcatttaacga

SEQ ID NO: 117561 - DNA, 25 bp, Homo sapien
accctggcaacatcatttaacgacg

SEQ ID NO: 117562 - DNA, 25 bp, Homo sapien
ctggcaacatcatttaacgacgtct

SEQ ID NO: 117563 - DNA, 25 bp, Homo sapien
gcaacatcatttaacgacgtctccc

SEQ ID NO: 117564 - DNA, 25 bp, Homo sapien
acatcatttaacgacgtctcccagg

SEQ ID NO: 117565 - DNA, 25 bp, Homo sapien
agatccaattccttccccttcgctt

SEQ ID NO: 117566 - DNA, 25 bp, Homo sapien
cttcgcttccgcaggtcggagggcc

SEQ ID NO: 117567 - DNA, 25 bp, Homo sapien
cagacctgtggtgaggacccctgag

SEQ ID NO: 117568 - DNA, 25 bp, Homo sapien
tcctgggagatctgccaaccacgcc

SEQ ID NO: 117569 - DNA, 25 bp, Homo sapien
acgtcatttgcatacgcactcccga

SEQ ID NO: 117570 - DNA, 25 bp, Homo sapien
gggaggtgctatgggcataaacaac

SEQ ID NO: 117571 - DNA, 25 bp, Homo sapien
ggacctgccactatgatgccggatg

SEQ ID NO: 117572 - DNA, 25 bp, Homo sapien
atgccggatggaactttgggattga

SEQ ID NO: 117573 - DNA, 25 bp, Homo sapien
tggaactttgggattgaccccacca

SEQ ID NO: 117574 - DNA, 25 bp, Homo sapien
actgaacgctttggtcaggctgcta

SEQ ID NO: 117575 - DNA, 25 bp, Homo sapien
gtcaggctgctacaatggaaggaat

SEQ ID NO: 117576 - DNA, 25 bp, Homo sapien
gcaattggtggaactcctcctgcat

SEQ ID NO: 117577 - DNA, 25 bp, Homo sapien
gcattcaaccgtgcagctcctggag

SEQ ID NO: 117578 - DNA, 25 bp, Homo sapien
tttgccccaaacaaacgtcgccgat

SEQ ID NO: 117579 - DNA, 25 bp, Homo sapien
aacgtcgccgatactaataagttgc

SEQ ID NO: 117580 - DNA, 25 bp, Homo sapien
aagttgcagtgtctagtttctcaaa

SEQ ID NO: 117581 - DNA, 25 bp, Homo sapien
gttaatactaaagagcattcagtca

SEQ ID NO: 117582 - DNA, 25 bp, Homo sapien
ttacttttcaagctataatgctatt

SEQ ID NO: 117583 - DNA, 25 bp, Homo sapien
atttttctttaactgaagctctaat

SEQ ID NO: 117584 - DNA, 25 bp, Homo sapien
taactgaagctctaatttaatggga

SEQ ID NO: 117585 - DNA, 25 bp, Homo sapien
gtttgaataccagctttctattttc

SEQ ID NO: 117586 - DNA, 25 bp, Homo sapien
aatcaagcagtttctatttctttaa

SEQ ID NO: 117587 - DNA, 25 bp, Homo sapien
gaagtattgagacagttaccggaga

SEQ ID NO: 117588 - DNA, 25 bp, Homo sapien
gacagttaccggagatacttcttca

SEQ ID NO: 117589 - DNA, 25 bp, Homo sapien
gttaccggagatacttcttcagcta

SEQ ID NO: 117590 - DNA, 25 bp, Homo sapien
cggagatacttcttcagctaattat

SEQ ID NO: 117591 - DNA, 25 bp, Homo sapien
gatacttcttcagctaattatcaag

SEQ ID NO: 117592 - DNA, 25 bp, Homo sapien
cagtaccatgcggtgaagattcctc

SEQ ID NO: 117593 - DNA, 25 bp, Homo sapien
gtaccatgcggtgaagattcctcgg

SEQ ID NO: 117594 - DNA, 25 bp, Homo sapien
ccatgcggtgaagattcctcgggaa

SEQ ID NO: 117595 - DNA, 25 bp, Homo sapien
atgcggtgaagattcctcgggaaga

SEQ ID NO: 117596 - DNA, 25 bp, Homo sapien
ggtgaagattcctcgggaagaccga

SEQ ID NO: 117597 - DNA, 25 bp, Homo sapien
agattcctcgggaagaccgacagca

SEQ ID NO: 117598 - DNA, 25 bp, Homo sapien
ttcctcgggaagaccgacagcagtt

SEQ ID NO: 117599 - DNA, 25 bp, Homo sapien
ggagggcccggatgcacaccccatc

SEQ ID NO: 117600 - DNA, 25 bp, Homo sapien
tcctggctgctgacgggcatcccga

SEQ ID NO: 117601 - DNA, 25 bp, Homo sapien
gggcatcccgagctgggccccgatg

SEQ ID NO: 117602 - DNA, 25 bp, Homo sapien
gctgggccccgatgggcatccaggg

SEQ ID NO: 117603 - DNA, 25 bp, Homo sapien
cctcctcctggagcatttccccacc

SEQ ID NO: 117604 - DNA, 25 bp, Homo sapien
tggagggcggtagctcccaccacgc

SEQ ID NO: 117605 - DNA, 25 bp, Homo sapien
ggagggcggtagctcccaccacgca

SEQ ID NO: 117606 - DNA, 25 bp, Homo sapien
agggcggtagctcccaccacgcaca

SEQ ID NO: 117607 - DNA, 25 bp, Homo sapien
accacgcacacccttacgccatgtc

SEQ ID NO: 117608 - DNA, 25 bp, Homo sapien
gtctctgaggccctacccaccaggg

SEQ ID NO: 117609 - DNA, 25 bp, Homo sapien
ggccgcctcttagccaacagcaatg

SEQ ID NO: 117610 - DNA, 25 bp, Homo sapien
gcctcttagccaacagcaatgccca

SEQ ID NO: 117611 - DNA, 25 bp, Homo sapien
ctcttagccaacagcaatgcccatc

SEQ ID NO: 117612 - DNA, 25 bp, Homo sapien
tcttagccaacagcaatgcccatcc

SEQ ID NO: 117613 - DNA, 25 bp, Homo sapien
agcaatgcccatccaggccccttcc

SEQ ID NO: 117614 - DNA, 25 bp, Homo sapien
cctcctgggagatctgccaaccacg

SEQ ID NO: 117615 - DNA, 25 bp, Homo sapien
tcctgggagatctgccaaccacgcc

SEQ ID NO: 117616 - DNA, 25 bp, Homo sapien
tgggagatctgccaaccacgcccac

SEQ ID NO: 117617 - DNA, 25 bp, Homo sapien
ggagatctgccaaccacgcccacgt

SEQ ID NO: 117618 - DNA, 25 bp, Homo sapien
caaccacgcccacgtcatttgcata

SEQ ID NO: 117619 - DNA, 25 bp, Homo sapien
acgtcatttgcatacgcactcccga

SEQ ID NO: 117620 - DNA, 25 bp, Homo sapien
gtcatttgcatacgcactcccgacc

SEQ ID NO: 117621 - DNA, 25 bp, Homo sapien
tgcatacgcactcccgaccccagaa

SEQ ID NO: 117622 - DNA, 25 bp, Homo sapien
ccagaaacccggattctgcctcccg

SEQ ID NO: 117623 - DNA, 25 bp, Homo sapien
attctgcctcccgacggcggcgtct

SEQ ID NO: 117624 - DNA, 25 bp, Homo sapien
cgggtgcggccctccgcccgcgtct

SEQ ID NO: 117625 - DNA, 25 bp, Homo sapien
agatcgcggactttggttttaacag

SEQ ID NO: 117626 - DNA, 25 bp, Homo sapien
gatcgcggactttggttttaacagg

SEQ ID NO: 117627 - DNA, 25 bp, Homo sapien
tcgcggactttggttttaacaggat

SEQ ID NO: 117628 - DNA, 25 bp, Homo sapien
tctggctcctgtgttgattgagggg

SEQ ID NO: 117629 - DNA, 25 bp, Homo sapien
tggctcctgtgttgattgagggggc

SEQ ID NO: 117630 - DNA, 25 bp, Homo sapien
gggcagtatacagcagggagaactt

SEQ ID NO: 117631 - DNA, 25 bp, Homo sapien
ggcagtatacagcagggagaacttt

SEQ ID NO: 117632 - DNA, 25 bp, Homo sapien
gcagtatacagcagggagaactttg

SEQ ID NO: 117633 - DNA, 25 bp, Homo sapien
cagtatacagcagggagaactttgg

SEQ ID NO: 117634 - DNA, 25 bp, Homo sapien
gagaactttgggaaactcttgaaat

SEQ ID NO: 117635 - DNA, 25 bp, Homo sapien
ttgggaaactcttgaaattattgaa

SEQ ID NO: 117636 - DNA, 25 bp, Homo sapien
gtaataacagtcaagctggaatcga

SEQ ID NO: 117637 - DNA, 25 bp, Homo sapien
gtcaagctggaatcgaggaccaatt

SEQ ID NO: 117638 - DNA, 25 bp, Homo sapien
aggaccaattaattccaatggcaca

SEQ ID NO: 117639 - DNA, 25 bp, Homo sapien
taattccaatggcacagagtagcat

SEQ ID NO: 117640 - DNA, 25 bp, Homo sapien
aatggcacagagtagcattcatgta

SEQ ID NO: 117641 - DNA, 25 bp, Homo sapien
ctttctaaccttcacgattaactgt

SEQ ID NO: 117642 - DNA, 25 bp, Homo sapien
gattaactgtgaaatgtacgtcatt

SEQ ID NO: 117643 - DNA, 25 bp, Homo sapien
gtacgtcatttgtgcaagaccgttt

SEQ ID NO: 117644 - DNA, 25 bp, Homo sapien
tgtgcaagaccgtttgtccacttca

SEQ ID NO: 117645 - DNA, 25 bp, Homo sapien
accgtttgtccacttcattttgtat

SEQ ID NO: 117646 - DNA, 25 bp, Homo sapien
ataatcacagttgtgttcctgacac

SEQ ID NO: 117647 - DNA, 25 bp, Homo sapien
gtatttaacgatcttctgcttctta

SEQ ID NO: 117648 - DNA, 25 bp, Homo sapien
tgcttcttaaccgtaccagttttct

SEQ ID NO: 117649 - DNA, 25 bp, Homo sapien
atccatgatgttttaaagtctccac

SEQ ID NO: 117650 - DNA, 25 bp, Homo sapien
aagtctccacttgctgttatttaca

SEQ ID NO: 117651 - DNA, 25 bp, Homo sapien
agtgcattcagcagcccagtgccgt

SEQ ID NO: 117652 - DNA, 25 bp, Homo sapien
gtgagccctgacagatgccgtattt

SEQ ID NO: 117653 - DNA, 25 bp, Homo sapien
gatgccgtatttctgagtgcttcca

SEQ ID NO: 117654 - DNA, 25 bp, Homo sapien
gagtgcttccatgtgaatgctgccc

SEQ ID NO: 117655 - DNA, 25 bp, Homo sapien
aatgctgccctcctgtagcatgtgt

SEQ ID NO: 117656 - DNA, 25 bp, Homo sapien
ggacatagccactaaccaactagtt

SEQ ID NO: 117657 - DNA, 25 bp, Homo sapien
aactagttacctttggactgcaaca

SEQ ID NO: 117658 - DNA, 25 bp, Homo sapien
gactgaggtgggtcccatctcccca

SEQ ID NO: 117659 - DNA, 25 bp, Homo sapien
ccccagactctgtgaagtgcagttc

SEQ ID NO: 117660 - DNA, 25 bp, Homo sapien
gactctgtgaagtgcagttcttctc

SEQ ID NO: 117661 - DNA, 25 bp, Homo sapien
tctgtgaagtgcagttcttctccac

SEQ ID NO: 117662 - DNA, 25 bp, Homo sapien
tgtgaagtgcagttcttctccacct

SEQ ID NO: 117663 - DNA, 25 bp, Homo sapien
tgaagtgcagttcttctccacctag

SEQ ID NO: 117664 - DNA, 25 bp, Homo sapien
aagtgcagttcttctccacctagga

SEQ ID NO: 117665 - DNA, 25 bp, Homo sapien
tgcagttcttctccacctaggaccg

SEQ ID NO: 117666 - DNA, 25 bp, Homo sapien
tctccacctaggaccgccagcagag

SEQ ID NO: 117667 - DNA, 25 bp, Homo sapien
ttgggaggtgaggcttcccaaccac

SEQ ID NO: 117668 - DNA, 25 bp, Homo sapien
caaccacggaagactactttaaatg

SEQ ID NO: 117669 - DNA, 25 bp, Homo sapien
gaatgaattatttgcacctccataa

SEQ ID NO: 117670 - DNA, 25 bp, Homo sapien
aattattcatcgtgatctcaaatca

SEQ ID NO: 117671 - DNA, 25 bp, Homo sapien
ctaatgttttagtgacccacacaga

SEQ ID NO: 117672 - DNA, 25 bp, Homo sapien
ggtacatctaaggaactcagtgaca

SEQ ID NO: 117673 - DNA, 25 bp, Homo sapien
agatgtcatttgctggcacggtcgc

SEQ ID NO: 117674 - DNA, 25 bp, Homo sapien
gcgccagaggtgatacggaatgaac

SEQ ID NO: 117675 - DNA, 25 bp, Homo sapien
gtgcccatggacaactctacgaggt

SEQ ID NO: 117676 - DNA, 25 bp, Homo sapien
tctacgaggtcttacgagctggcag

SEQ ID NO: 117677 - DNA, 25 bp, Homo sapien
gctggcaggaagatcacacctcgat

SEQ ID NO: 117678 - DNA, 25 bp, Homo sapien
cacacctcgattgctagtagactgg

SEQ ID NO: 117679 - DNA, 25 bp, Homo sapien
gtagactggtccacaggaattgcaa

SEQ ID NO: 117680 - DNA, 25 bp, Homo sapien
cagatgaaacctggtagtaaaatca

SEQ ID NO: 117681 - DNA, 25 bp, Homo sapien
atatttatgctgtatcaagttcacg

SEQ ID NO: 117682 - DNA, 25 bp, Homo sapien
atgctgtatcaagttcacgatcatc

SEQ ID NO: 117683 - DNA, 25 bp, Homo sapien
gtatcaagttcacgatcatcttacg

SEQ ID NO: 117684 - DNA, 25 bp, Homo sapien
aagttcacgatcatcttacgatatc

SEQ ID NO: 117685 - DNA, 25 bp, Homo sapien
ttcacgatcatcttacgatatcaag

SEQ ID NO: 117686 - DNA, 25 bp, Homo sapien
tgtcaccactacctggacagttgca

SEQ ID NO: 117687 - DNA, 25 bp, Homo sapien
accactacctggacagttgcacatg

SEQ ID NO: 117688 - DNA, 25 bp, Homo sapien
ctacctggacagttgcacatgtttt

SEQ ID NO: 117689 - DNA, 25 bp, Homo sapien
gcacatgttttactgggaatatttt

SEQ ID NO: 117690 - DNA, 25 bp, Homo sapien
ctgtatgctctgtgctagtagggtg

SEQ ID NO: 117691 - DNA, 25 bp, Homo sapien
taacgaatgaccaagggccaaggaa

SEQ ID NO: 117692 - DNA, 25 bp, Homo sapien
gtgcgctgggacgttgtgtgcaata

SEQ ID NO: 117693 - DNA, 25 bp, Homo sapien
gcaatagagaggtctccacaccaga

SEQ ID NO: 117694 - DNA, 25 bp, Homo sapien
agagaggtctccacaccagatgtct

SEQ ID NO: 117695 - DNA, 25 bp, Homo sapien
ggtctccacaccagatgtcttccag

SEQ ID NO: 117696 - DNA, 25 bp, Homo sapien
cttccagattctgtgcctctggctt

SEQ ID NO: 117697 - DNA, 25 bp, Homo sapien
tgcctctggctttgttgtccagcca

SEQ ID NO: 117698 - DNA, 25 bp, Homo sapien
ctggctttgttgtccagccaggcct

SEQ ID NO: 117699 - DNA, 25 bp, Homo sapien
attttcacagtggacagagagagag

SEQ ID NO: 117700 - DNA, 25 bp, Homo sapien
gaggctgcatgtgtgtaccgtgtgt

SEQ ID NO: 117701 - DNA, 25 bp, Homo sapien
ctgctttctttccacagctttcttc

SEQ ID NO: 117702 - DNA, 25 bp, Homo sapien
tgactcgggaaagtggtaccgactt

SEQ ID NO: 117703 - DNA, 25 bp, Homo sapien
gaaactgagaagcttatccgagaga

SEQ ID NO: 117704 - DNA, 25 bp, Homo sapien
aactgagaagcttatccgagagaaa

SEQ ID NO: 117705 - DNA, 25 bp, Homo sapien
gaagcttatccgagagaaagatgag

SEQ ID NO: 117706 - DNA, 25 bp, Homo sapien
atccgagagaaagatgaggagctgc

SEQ ID NO: 117707 - DNA, 25 bp, Homo sapien
agaactattaactggctttcagccc

SEQ ID NO: 117708 - DNA, 25 bp, Homo sapien
gctttcagccctggatatttaaatc

SEQ ID NO: 117709 - DNA, 25 bp, Homo sapien
ccctggatatttaaatctcctcctc

SEQ ID NO: 117710 - DNA, 25 bp, Homo sapien
tggatatttaaatctcctcctcttc

SEQ ID NO: 117711 - DNA, 25 bp, Homo sapien
ttcagctactgccacttcgccttac

SEQ ID NO: 117712 - DNA, 25 bp, Homo sapien
ttcgccttacatccctgctgactgc

SEQ ID NO: 117713 - DNA, 25 bp, Homo sapien
tcatccagtccttctgctgtgacaa

SEQ ID NO: 117714 - DNA, 25 bp, Homo sapien
agtccttctgctgtgacaacgacat

SEQ ID NO: 117715 - DNA, 25 bp, Homo sapien
tctgctgtgacaacgacatcaacat

SEQ ID NO: 117716 - DNA, 25 bp, Homo sapien
acatcaacatcgtgcgggtgtcggg

SEQ ID NO: 117717 - DNA, 25 bp, Homo sapien
cggacgcctggaagagccacggctt

SEQ ID NO: 117718 - DNA, 25 bp, Homo sapien
gaggtggccagctactgcgaagaaa

SEQ ID NO: 117719 - DNA, 25 bp, Homo sapien
gccagctactgcgaagaaagccggg

SEQ ID NO: 117720 - DNA, 25 bp, Homo sapien
ggcaacaaccagtgggtcccctaca

SEQ ID NO: 117721 - DNA, 25 bp, Homo sapien
ctacatctctcttcaggaacgctga

SEQ ID NO: 117722 - DNA, 25 bp, Homo sapien
ccttcccagcagcagaatctgttga

SEQ ID NO: 117723 - DNA, 25 bp, Homo sapien
cagcagcagaatctgttgagttgct

SEQ ID NO: 117724 - DNA, 25 bp, Homo sapien
ttgacctgcagtaaaaaaacctttg

SEQ ID NO: 117725 - DNA, 25 bp, Homo sapien
tatgtccattggatactttcctttt

SEQ ID NO: 117726 - DNA, 25 bp, Homo sapien
tgtccattggatactttccttttta

SEQ ID NO: 117727 - DNA, 25 bp, Homo sapien
gtactaatcattgtagtggcctaag

SEQ ID NO: 117728 - DNA, 25 bp, Homo sapien
gtggcctaagtgtgatttaactctt

SEQ ID NO: 117729 - DNA, 25 bp, Homo sapien
aagtgtgatttaactcttgaagtca

SEQ ID NO: 117730 - DNA, 25 bp, Homo sapien
tctccttttcctcatttattcctaa

SEQ ID NO: 117731 - DNA, 25 bp, Homo sapien
attcctaaaggaatctgaccatttt

SEQ ID NO: 117732 - DNA, 25 bp, Homo sapien
ggaatctgaccattttacgtctcta

SEQ ID NO: 117733 - DNA, 25 bp, Homo sapien
atctgaccattttacgtctctacgg

SEQ ID NO: 117734 - DNA, 25 bp, Homo sapien
gaccattttacgtctctacggccca

SEQ ID NO: 117735 - DNA, 25 bp, Homo sapien
gtgtaatgatgtacttattcatgat

SEQ ID NO: 117736 - DNA, 25 bp, Homo sapien
tgatgtacttattcatgatgaactt

SEQ ID NO: 117737 - DNA, 25 bp, Homo sapien
tattgaatggtgattgcctcgttta

SEQ ID NO: 117738 - DNA, 25 bp, Homo sapien
tgaatggtgattgcctcgtttattt

SEQ ID NO: 117739 - DNA, 25 bp, Homo sapien
atggtgattgcctcgtttatttcag

SEQ ID NO: 117740 - DNA, 25 bp, Homo sapien
ggtgattgcctcgtttatttcagag

SEQ ID NO: 117741 - DNA, 25 bp, Homo sapien
gattgcctcgtttatttcagaggac

SEQ ID NO: 117742 - DNA, 25 bp, Homo sapien
ttgcctcgtttatttcagaggacca

SEQ ID NO: 117743 - DNA, 25 bp, Homo sapien
tcgtttatttcagaggaccagtgct

SEQ ID NO: 117744 - DNA, 25 bp, Homo sapien
gtttatttcagaggaccagtgcttt

SEQ ID NO: 117745 - DNA, 25 bp, Homo sapien
atttcagaggaccagtgctttgatt

SEQ ID NO: 117746 - DNA, 25 bp, Homo sapien
gttagtgttgtggtaatgcctgttt

SEQ ID NO: 117747 - DNA, 25 bp, Homo sapien
gtggtaatgcctgttttcatctgta

SEQ ID NO: 117748 - DNA, 25 bp, Homo sapien
gtatgtacacgaggcactacttctg

SEQ ID NO: 117749 - DNA, 25 bp, Homo sapien
acgaggcactacttctgatttattg

SEQ ID NO: 117750 - DNA, 25 bp, Homo sapien
gatttattgcaatgttcagtcctag

SEQ ID NO: 117751 - DNA, 25 bp, Homo sapien
gcaatgttcagtcctagtttttact

SEQ ID NO: 117752 - DNA, 25 bp, Homo sapien
aagcattcagttttgctttcaattt

SEQ ID NO: 117753 - DNA, 25 bp, Homo sapien
caattttatgtaccttagttctgag

SEQ ID NO: 117754 - DNA, 25 bp, Homo sapien
accttagttctgagttagacctgca

SEQ ID NO: 117755 - DNA, 25 bp, Homo sapien
ctgcagatgtgtacagatagttcat

SEQ ID NO: 117756 - DNA, 25 bp, Homo sapien
ttgcacataatcatgctattcagca

SEQ ID NO: 117757 - DNA, 25 bp, Homo sapien
ggatagtgaggcatcgcaatgtaag

SEQ ID NO: 117758 - DNA, 25 bp, Homo sapien
ggcatcgcaatgtaagactcgggat

SEQ ID NO: 117759 - DNA, 25 bp, Homo sapien
gactcgggattagtacacacttgtt

SEQ ID NO: 117760 - DNA, 25 bp, Homo sapien
ggattagtacacacttgttgatgat

SEQ ID NO: 117761 - DNA, 25 bp, Homo sapien
gaaatgtttacagatccccaagcct

SEQ ID NO: 117762 - DNA, 25 bp, Homo sapien
acaccattttggcaagctctatcac

SEQ ID NO: 117763 - DNA, 25 bp, Homo sapien
acatcctacaagacacagtgaccat

SEQ ID NO: 117764 - DNA, 25 bp, Homo sapien
gcaaagccagcttgaaaccttcact

SEQ ID NO: 117765 - DNA, 25 bp, Homo sapien
accttcacttaggaacgtaatcgtg

SEQ ID NO: 117766 - DNA, 25 bp, Homo sapien
taggaacgtaatcgtgtcccctatc

SEQ ID NO: 117767 - DNA, 25 bp, Homo sapien
acgtaatcgtgtcccctatcctact

SEQ ID NO: 117768 - DNA, 25 bp, Homo sapien
tgtctaaccaccagcatgtcgcaaa

SEQ ID NO: 117769 - DNA, 25 bp, Homo sapien
agcatgtcgcaaagcccagtccatc

SEQ ID NO: 117770 - DNA, 25 bp, Homo sapien
gtgccccaaaaagtgggcccatggg

SEQ ID NO: 117771 - DNA, 25 bp, Homo sapien
ggtctctagccgtccttaaagatga

SEQ ID NO: 117772 - DNA, 25 bp, Homo sapien
ttgcccagggccacagagctacatg

SEQ ID NO: 117773 - DNA, 25 bp, Homo sapien
gcaggcagccctggatgtgaatcct

SEQ ID NO: 117774 - DNA, 25 bp, Homo sapien
tgtgaatcctgtgcaaatcctgacc

SEQ ID NO: 117775 - DNA, 25 bp, Homo sapien
caccattgtcagctcagtgacctgg

SEQ ID NO: 117776 - DNA, 25 bp, Homo sapien
gtgacctggatggagcagctgactt

SEQ ID NO: 117777 - DNA, 25 bp, Homo sapien
gagcagctgacttaccagggcctca

SEQ ID NO: 117778 - DNA, 25 bp, Homo sapien
gggcctcagtttcattaactggtga

SEQ ID NO: 117779 - DNA, 25 bp, Homo sapien
ggtttagaaaattcccctgtgcatg

SEQ ID NO: 117780 - DNA, 25 bp, Homo sapien
aattcccctgtgcatggtattacct

SEQ ID NO: 117781 - DNA, 25 bp, Homo sapien
ggtattacctttttcaagctcagat

SEQ ID NO: 117782 - DNA, 25 bp, Homo sapien
aagctcagattcatctaatcctcaa

SEQ ID NO: 117783 - DNA, 25 bp, Homo sapien
ctaatcctcaactgtacatgtgtac

SEQ ID NO: 117784 - DNA, 25 bp, Homo sapien
atgtgtacattcttcacctcctggt

SEQ ID NO: 117785 - DNA, 25 bp, Homo sapien
ctggtgccctatcccgcaaaatggg

SEQ ID NO: 117786 - DNA, 25 bp, Homo sapien
aaatggtcccctgtgtttgtagaga

SEQ ID NO: 117787 - DNA, 25 bp, Homo sapien
gtttgtagagaactcccttatacag

SEQ ID NO: 117788 - DNA, 25 bp, Homo sapien
tacagagttttggttctagttttat

SEQ ID NO: 117789 - DNA, 25 bp, Homo sapien
gtaccttttgagactatgtatttat

SEQ ID NO: 117790 - DNA, 25 bp, Homo sapien
gacagcatgagatatccttcagtgt

SEQ ID NO: 117791 - DNA, 25 bp, Homo sapien
ctcccaagcatcctcatcagataaa

SEQ ID NO: 117792 - DNA, 25 bp, Homo sapien
atcagataaagccaacatgttgcag

SEQ ID NO: 117793 - DNA, 25 bp, Homo sapien
acatgttgcaggaatactccaagtt

SEQ ID NO: 117794 - DNA, 25 bp, Homo sapien
gaatactccaagtttctgcagcagg

SEQ ID NO: 117795 - DNA, 25 bp, Homo sapien
tgcagcaggctttggacagaactag

SEQ ID NO: 117796 - DNA, 25 bp, Homo sapien
gaactagccaaaatgatgcctattt

SEQ ID NO: 117797 - DNA, 25 bp, Homo sapien
gcctatttgaatagcccgagcctta

SEQ ID NO: 117798 - DNA, 25 bp, Homo sapien
tagcccgagccttaactttgtgact

SEQ ID NO: 117799 - DNA, 25 bp, Homo sapien
tttgtgactgataaccagaccctcc

SEQ ID NO: 117800 - DNA, 25 bp, Homo sapien
gacaagcaggtctatgccaccatgc

SEQ ID NO: 117801 - DNA, 25 bp, Homo sapien
gaaattaagcattcatccttcgtat

SEQ ID NO: 117802 - DNA, 25 bp, Homo sapien
attcatccttcgtatcactgcagaa

SEQ ID NO: 117803 - DNA, 25 bp, Homo sapien
gcacagggagggaactcttgacact

SEQ ID NO: 117804 - DNA, 25 bp, Homo sapien
ggaactcttgacactgagccactaa

SEQ ID NO: 117805 - DNA, 25 bp, Homo sapien
aatcttcaaacggactgtgctactg

SEQ ID NO: 117806 - DNA, 25 bp, Homo sapien
actgtgctactgtatttgtctcaaa

SEQ ID NO: 117807 - DNA, 25 bp, Homo sapien
gctaccaagtttgtgcaataagtgg

SEQ ID NO: 117808 - DNA, 25 bp, Homo sapien
ggaagggatgtcatccttcttcaat

SEQ ID NO: 117809 - DNA, 25 bp, Homo sapien
gtcatccttcttcaataaatgctga

SEQ ID NO: 117810 - DNA, 25 bp, Homo sapien
gaatgacattcaagctgattttcta

SEQ ID NO: 117811 - DNA, 25 bp, Homo sapien
aagctgattttctagaccactgaga

SEQ ID NO: 117812 - DNA, 25 bp, Homo sapien
tatccttttaagaactaccttcttg

SEQ ID NO: 117813 - DNA, 25 bp, Homo sapien
taagaactaccttcttggtagggca

SEQ ID NO: 117814 - DNA, 25 bp, Homo sapien
aagaactaccttcttggtagggcat

SEQ ID NO: 117815 - DNA, 25 bp, Homo sapien
agaactaccttcttggtagggcatg

SEQ ID NO: 117816 - DNA, 25 bp, Homo sapien
gaactaccttcttggtagggcatgg

SEQ ID NO: 117817 - DNA, 25 bp, Homo sapien
aactaccttcttggtagggcatggt

SEQ ID NO: 117818 - DNA, 25 bp, Homo sapien
actaccttcttggtagggcatggtg

SEQ ID NO: 117819 - DNA, 25 bp, Homo sapien
ctaccttcttggtagggcatggtgg

SEQ ID NO: 117820 - DNA, 25 bp, Homo sapien
gggccaagagagacattgcctccac

SEQ ID NO: 117821 - DNA, 25 bp, Homo sapien
ttatctgtgaccacacgctgtctct

SEQ ID NO: 117822 - DNA, 25 bp, Homo sapien
tgtgaccacacgctgtctcttgaga

SEQ ID NO: 117823 - DNA, 25 bp, Homo sapien
ttggatacactctctagctttaggg

SEQ ID NO: 117824 - DNA, 25 bp, Homo sapien
ggaaaccaatagtccccatcagcac

SEQ ID NO: 117825 - DNA, 25 bp, Homo sapien
atagtccccatcagcaccatggagg

SEQ ID NO: 117826 - DNA, 25 bp, Homo sapien
ccatcagcaccatggaggcaggctc

SEQ ID NO: 117827 - DNA, 25 bp, Homo sapien
tgcctttgaaattcccccacttggg

SEQ ID NO: 117828 - DNA, 25 bp, Homo sapien
cactcacttttctttattgctgtga

SEQ ID NO: 117829 - DNA, 25 bp, Homo sapien
cacaatgggcaattctgacttctcc

SEQ ID NO: 117830 - DNA, 25 bp, Homo sapien
attctgacttctcccatctagtgga

SEQ ID NO: 117831 - DNA, 25 bp, Homo sapien
atgacattaccctgaatggtcttca

SEQ ID NO: 117832 - DNA, 25 bp, Homo sapien
atggtcttcagaatccattcctgag

SEQ ID NO: 117833 - DNA, 25 bp, Homo sapien
attcctgagatcaccagtagctggt

SEQ ID NO: 117834 - DNA, 25 bp, Homo sapien
gaacatgggttcgagcttagtacat

SEQ ID NO: 117835 - DNA, 25 bp, Homo sapien
gtacatacatgaacaagctgtgctt

SEQ ID NO: 117836 - DNA, 25 bp, Homo sapien
actgtacgagtgtgttcacctttcc

SEQ ID NO: 117837 - DNA, 25 bp, Homo sapien
ctcagggccctcacatgtgaaatgt

SEQ ID NO: 117838 - DNA, 25 bp, Homo sapien
gactagaggatctccagggtcactt

SEQ ID NO: 117839 - DNA, 25 bp, Homo sapien
ccagggtcacttccaatttcattgt

SEQ ID NO: 117840 - DNA, 25 bp, Homo sapien
atactaatcctgtactccatggttg

SEQ ID NO: 117841 - DNA, 25 bp, Homo sapien
gtactccatggttgtcactatgtcc

SEQ ID NO: 117842 - DNA, 25 bp, Homo sapien
acttactaagtgtcaacagccctta

SEQ ID NO: 117843 - DNA, 25 bp, Homo sapien
tactaagtgtcaacagcccttacaa

SEQ ID NO: 117844 - DNA, 25 bp, Homo sapien
taagtgtcaacagcccttacaaaca

SEQ ID NO: 117845 - DNA, 25 bp, Homo sapien
gtgtcaacagcccttacaaacatta

SEQ ID NO: 117846 - DNA, 25 bp, Homo sapien
gtcaacagcccttacaaacattaaa

SEQ ID NO: 117847 - DNA, 25 bp, Homo sapien
aacagcccttacaaacattaaatgt

SEQ ID NO: 117848 - DNA, 25 bp, Homo sapien
gtaaatggtttcaaatggtcagcgt

SEQ ID NO: 117849 - DNA, 25 bp, Homo sapien
aatggtttcaaatggtcagcgttgt

SEQ ID NO: 117850 - DNA, 25 bp, Homo sapien
gtttcaaatggtcagcgttgtttaa

SEQ ID NO: 117851 - DNA, 25 bp, Homo sapien
acgaaaatattgttcatactgatca

SEQ ID NO: 117852 - DNA, 25 bp, Homo sapien
gaattaaatttgtatagagcagagt

SEQ ID NO: 117853 - DNA, 25 bp, Homo sapien
acctggagactgacaacctcatcca

SEQ ID NO: 117854 - DNA, 25 bp, Homo sapien
tggagactgacaacctcatccaggc

SEQ ID NO: 117855 - DNA, 25 bp, Homo sapien
atccgcacccagtttgatacctgca

SEQ ID NO: 117856 - DNA, 25 bp, Homo sapien
gcacccagtttgatacctgcactgt

SEQ ID NO: 117857 - DNA, 25 bp, Homo sapien
ccagtttgatacctgcactgtcctg

SEQ ID NO: 117858 - DNA, 25 bp, Homo sapien
atcgcacaccggcttaacactatca

SEQ ID NO: 117859 - DNA, 25 bp, Homo sapien
gcacaccggcttaacactatcatgg

SEQ ID NO: 117860 - DNA, 25 bp, Homo sapien
acaccggcttaacactatcatggac

SEQ ID NO: 117861 - DNA, 25 bp, Homo sapien
gcttaacactatcatggactacacc

SEQ ID NO: 117862 - DNA, 25 bp, Homo sapien
catggactacaccagggtcctggtc

SEQ ID NO: 117863 - DNA, 25 bp, Homo sapien
atggactacaccagggtcctggtcc

SEQ ID NO: 117864 - DNA, 25 bp, Homo sapien
agaaattgccactcgaagtgcacat

SEQ ID NO: 117865 - DNA, 25 bp, Homo sapien
gggctggcaactcaactgaaaatgc

SEQ ID NO: 117866 - DNA, 25 bp, Homo sapien
gcaactcaactgaaaatgccacatg

SEQ ID NO: 117867 - DNA, 25 bp, Homo sapien
gaaaatgccacatgaaaagcactat

SEQ ID NO: 117868 - DNA, 25 bp, Homo sapien
gccacatgaaaagcactatacatta

SEQ ID NO: 117869 - DNA, 25 bp, Homo sapien
attatgtggaactcctaactacatt

SEQ ID NO: 117870 - DNA, 25 bp, Homo sapien
gtggaactcctaactacatttcacc

SEQ ID NO: 117871 - DNA, 25 bp, Homo sapien
gaactcctaactacatttcaccaga

SEQ ID NO: 117872 - DNA, 25 bp, Homo sapien
actcctaactacatttcaccagaaa

SEQ ID NO: 117873 - DNA, 25 bp, Homo sapien
atttcaccagaaattgccactcgaa

SEQ ID NO: 117874 - DNA, 25 bp, Homo sapien
ttcaccagaaattgccactcgaagt

SEQ ID NO: 117875 - DNA, 25 bp, Homo sapien
cagtgaagttatcctggacaccggc

SEQ ID NO: 117876 - DNA, 25 bp, Homo sapien
ggcaccatccagctctctgctatgg

SEQ ID NO: 117877 - DNA, 25 bp, Homo sapien
caggctagtggctcttcatacagtt

SEQ ID NO: 117878 - DNA, 25 bp, Homo sapien
ccttcttctaaggtagggagtctgt

SEQ ID NO: 117879 - DNA, 25 bp, Homo sapien
ttctaaggtagggagtctgtgatct

SEQ ID NO: 117880 - DNA, 25 bp, Homo sapien
ggtagggagtctgtgatctctttct

SEQ ID NO: 117881 - DNA, 25 bp, Homo sapien
tagggagtctgtgatctctttctgt

SEQ ID NO: 117882 - DNA, 25 bp, Homo sapien
agtctgtgatctctttctgtgtgta

SEQ ID NO: 117883 - DNA, 25 bp, Homo sapien
tctgtgatctctttctgtgtgtatt

SEQ ID NO: 117884 - DNA, 25 bp, Homo sapien
gatctctttctgtgtgtattggtca

SEQ ID NO: 117885 - DNA, 25 bp, Homo sapien
tagaatccattcagctgtagcagca

SEQ ID NO: 117886 - DNA, 25 bp, Homo sapien
tctgcccgcggtgcttgttttttcg

SEQ ID NO: 117887 - DNA, 25 bp, Homo sapien
ttttcgtgtctagagctgatgccag

SEQ ID NO: 117888 - DNA, 25 bp, Homo sapien
gaaccagcaggctcccctttggagt

SEQ ID NO: 117889 - DNA, 25 bp, Homo sapien
tcccctttggagttggagctgtaaa

SEQ ID NO: 117890 - DNA, 25 bp, Homo sapien
agctgtaataactgttccacgcccg

SEQ ID NO: 117891 - DNA, 25 bp, Homo sapien
tttaaccgcattttcagcgcgggtc

SEQ ID NO: 117892 - DNA, 25 bp, Homo sapien
gtccttgtgcgctgaccagaacgtg

SEQ ID NO: 117893 - DNA, 25 bp, Homo sapien
cagaacgtgggcttgttcacactta

SEQ ID NO: 117894 - DNA, 25 bp, Homo sapien
gttcacacttacctgcaatttgaga

SEQ ID NO: 117895 - DNA, 25 bp, Homo sapien
ttggcccttctgctcgtgatgaggt

SEQ ID NO: 117896 - DNA, 25 bp, Homo sapien
tcgtgatgaggttctctgcccgcgg

SEQ ID NO: 117897 - DNA, 25 bp, Homo sapien
ggtggtcttttcaccattggcagaa

SEQ ID NO: 117898 - DNA, 25 bp, Homo sapien
ggtgtagggaattttgcctgccttc

SEQ ID NO: 117899 - DNA, 25 bp, Homo sapien
aaagtgtcagggacgttgcctgagc

SEQ ID NO: 117900 - DNA, 25 bp, Homo sapien
gggacgttgcctgagcccaaatgtg

SEQ ID NO: 117901 - DNA, 25 bp, Homo sapien
ccaaatgtgtagtgtggtctgggca

SEQ ID NO: 117902 - DNA, 25 bp, Homo sapien
ctgggcaggcagacctttaggtttt

SEQ ID NO: 117903 - DNA, 25 bp, Homo sapien
agacctttaggttttgctgcttagt

SEQ ID NO: 117904 - DNA, 25 bp, Homo sapien
ggttttgctgcttagtcctgaggaa

SEQ ID NO: 117905 - DNA, 25 bp, Homo sapien
tagtcctgaggaagtggccactctt

SEQ ID NO: 117906 - DNA, 25 bp, Homo sapien
ccactcttgtggcaggtgtagtatc

SEQ ID NO: 117907 - DNA, 25 bp, Homo sapien
taaaagcccaccctacagaaagtgg

SEQ ID NO: 117908 - DNA, 25 bp, Homo sapien
gtatttcagtaatcggccagggcca

SEQ ID NO: 117909 - DNA, 25 bp, Homo sapien
ggccagggccaacacctggatgtca

SEQ ID NO: 117910 - DNA, 25 bp, Homo sapien
gatgtcagctgccaagaccaaactg

SEQ ID NO: 117911 - DNA, 25 bp, Homo sapien
tgccaagaccaaactgtccagtgga

SEQ ID NO: 117912 - DNA, 25 bp, Homo sapien
tgtccagtggaaaccttaaaggagc

SEQ ID NO: 117913 - DNA, 25 bp, Homo sapien
ggagcaatcaaatccagctttggca

SEQ ID NO: 117914 - DNA, 25 bp, Homo sapien
cttagaacaaggaggattgcccaag

SEQ ID NO: 117915 - DNA, 25 bp, Homo sapien
ggaggattgcccaagaaactaattt

SEQ ID NO: 117916 - DNA, 25 bp, Homo sapien
tttaaagagaacactggacaacatt

SEQ ID NO: 117917 - DNA, 25 bp, Homo sapien
tggacaacattttactactgaggga

SEQ ID NO: 117918 - DNA, 25 bp, Homo sapien
aatgctgtagaagtgagtttgtaaa

SEQ ID NO: 117919 - DNA, 25 bp, Homo sapien
ggtggataattatggaacccagctc

SEQ ID NO: 117920 - DNA, 25 bp, Homo sapien
ggataattatggaacccagctcaat

SEQ ID NO: 117921 - DNA, 25 bp, Homo sapien
aattatggaacccagctcaatgctg

SEQ ID NO: 117922 - DNA, 25 bp, Homo sapien
gctcaatgctgtgaataactccctg

SEQ ID NO: 117923 - DNA, 25 bp, Homo sapien
caatgctgtgaataactccctgact

SEQ ID NO: 117924 - DNA, 25 bp, Homo sapien
aatgctgtgaataactccctgactc

SEQ ID NO: 117925 - DNA, 25 bp, Homo sapien
tgctgtgaataactccctgactccg

SEQ ID NO: 117926 - DNA, 25 bp, Homo sapien
gtgaataactccctgactccgcaat

SEQ ID NO: 117927 - DNA, 25 bp, Homo sapien
aataactccctgactccgcaatcaa

SEQ ID NO: 117928 - DNA, 25 bp, Homo sapien
cctgactccgcaatcaaccaaggtt

SEQ ID NO: 117929 - DNA, 25 bp, Homo sapien
tgactccgcaatcaaccaaggttcc

SEQ ID NO: 117930 - DNA, 25 bp, Homo sapien
acattctctgtcttactgatactgt

SEQ ID NO: 117931 - DNA, 25 bp, Homo sapien
gatactgtaggttcacccatttttt

SEQ ID NO: 117932 - DNA, 25 bp, Homo sapien
tttcctcgcaaataacaagacccac

SEQ ID NO: 117933 - DNA, 25 bp, Homo sapien
gtgactctagctacttaatggttct

SEQ ID NO: 117934 - DNA, 25 bp, Homo sapien
taatggttctgttcttttatatgca

SEQ ID NO: 117935 - DNA, 25 bp, Homo sapien
ttatatgcagcaaacacaccgtcca

SEQ ID NO: 117936 - DNA, 25 bp, Homo sapien
cacaccgtccatttctgaagaggct

SEQ ID NO: 117937 - DNA, 25 bp, Homo sapien
ggcattttccaatgatgttagtgca

SEQ ID NO: 117938 - DNA, 25 bp, Homo sapien
gttagtgcacaaaacgctttaaatt

SEQ ID NO: 117939 - DNA, 25 bp, Homo sapien
atgaggaatttctcgtacccctact

SEQ ID NO: 117940 - DNA, 25 bp, Homo sapien
acccctactgcatggtatcgatttt

SEQ ID NO: 117941 - DNA, 25 bp, Homo sapien
ttgaaaatggaagccctgactgaca

SEQ ID NO: 117942 - DNA, 25 bp, Homo sapien
tgactgacagggaacatggaatgat

SEQ ID NO: 117943 - DNA, 25 bp, Homo sapien
acatggaatgatagaccctgacagc

SEQ ID NO: 117944 - DNA, 25 bp, Homo sapien
tagaccctgacagcggagatgaagc

SEQ ID NO: 117945 - DNA, 25 bp, Homo sapien
agcccagcttaatggaggacattct

SEQ ID NO: 117946 - DNA, 25 bp, Homo sapien
gaggacattctgcagaggaatctct

SEQ ID NO: 117947 - DNA, 25 bp, Homo sapien
ggaatctctgggtgaacccactcaa

SEQ ID NO: 117948 - DNA, 25 bp, Homo sapien
gggtgaacccactcaagccactgtg

SEQ ID NO: 117949 - DNA, 25 bp, Homo sapien
agcccttttcagcccaaggagacat

SEQ ID NO: 117950 - DNA, 25 bp, Homo sapien
gaagactacgagagtgatgggacat

SEQ ID NO: 117951 - DNA, 25 bp, Homo sapien
gagtgatgggacatagaagccagcc

SEQ ID NO: 117952 - DNA, 25 bp, Homo sapien
aacaggataacatagtacctgcttc

SEQ ID NO: 117953 - DNA, 25 bp, Homo sapien
atataatgacttagcccagcggcct

SEQ ID NO: 117954 - DNA, 25 bp, Homo sapien
aatgacttagcccagcggcctgcag

SEQ ID NO: 117955 - DNA, 25 bp, Homo sapien
gatgagcaattattattggcatcat

SEQ ID NO: 117956 - DNA, 25 bp, Homo sapien
attggcatcatgatttctaaagaag

SEQ ID NO: 117957 - DNA, 25 bp, Homo sapien
aagagctttgagttggtatttttct

SEQ ID NO: 117958 - DNA, 25 bp, Homo sapien
ggtatttttctctgtgtataagggt

SEQ ID NO: 117959 - DNA, 25 bp, Homo sapien
tgtgtataagggtaagtccgaactt

SEQ ID NO: 117960 - DNA, 25 bp, Homo sapien
tggaggttacattcacatcagtctg

SEQ ID NO: 117961 - DNA, 25 bp, Homo sapien
gttacattcacatcagtctgtcttc

SEQ ID NO: 117962 - DNA, 25 bp, Homo sapien
tgcggatggcctcagccctgggtgg

SEQ ID NO: 117963 - DNA, 25 bp, Homo sapien
aaccaaagacttagctcacctgcat

SEQ ID NO: 117964 - DNA, 25 bp, Homo sapien
cacctgcattctgactttgtttgga

SEQ ID NO: 117965 - DNA, 25 bp, Homo sapien
gtttggagacacacacttcagcagg

SEQ ID NO: 117966 - DNA, 25 bp, Homo sapien
agacacacacttcagcagggcggcg

SEQ ID NO: 117967 - DNA, 25 bp, Homo sapien
cagggcggcgacttggcaagacaaa

SEQ ID NO: 117968 - DNA, 25 bp, Homo sapien
gagcaggaaaacaccactggatctc

SEQ ID NO: 117969 - DNA, 25 bp, Homo sapien
tggatctcacaccttcaatccatga

SEQ ID NO: 117970 - DNA, 25 bp, Homo sapien
atcctcgctgtgcttggctgtttag

SEQ ID NO: 117971 - DNA, 25 bp, Homo sapien
ggagcatagtgattttgagccattg

SEQ ID NO: 117972 - DNA, 25 bp, Homo sapien
ttgagccattgagcggacatctttt

SEQ ID NO: 117973 - DNA, 25 bp, Homo sapien
gaactttctcatctgttctaccatg

SEQ ID NO: 117974 - DNA, 25 bp, Homo sapien
gttgctgcgttctttcaatgctgac

SEQ ID NO: 117975 - DNA, 25 bp, Homo sapien
caatgctgactggactgtgtttttc

SEQ ID NO: 117976 - DNA, 25 bp, Homo sapien
tgtgtttttcctatgcagtgtcagc

SEQ ID NO: 117977 - DNA, 25 bp, Homo sapien
gtcagctcctctgtctggttgttta

SEQ ID NO: 117978 - DNA, 25 bp, Homo sapien
tggttgtttacctgttcctgttcgt

SEQ ID NO: 117979 - DNA, 25 bp, Homo sapien
ttcctgttcgtgcttgtaatgctca

SEQ ID NO: 117980 - DNA, 25 bp, Homo sapien
ttgtaatgctcacttatgttttctc

SEQ ID NO: 117981 - DNA, 25 bp, Homo sapien
gtataacttgtgattccagggctgt

SEQ ID NO: 117982 - DNA, 25 bp, Homo sapien
tccagggctgtttgtcaacagtata

SEQ ID NO: 117983 - DNA, 25 bp, Homo sapien
caaaagaattgtgcctctcccaagt

SEQ ID NO: 117984 - DNA, 25 bp, Homo sapien
caagtccagtgtgactttatcttct

SEQ ID NO: 117985 - DNA, 25 bp, Homo sapien
aagcagccagccgtgagtgcagacc

SEQ ID NO: 117986 - DNA, 25 bp, Homo sapien
cagtggccctgagcagtagtggcat

SEQ ID NO: 117987 - DNA, 25 bp, Homo sapien
tagtggcatgtgtgtagatcaagtc

SEQ ID NO: 117988 - DNA, 25 bp, Homo sapien
agcgatccatgtaatctgacgtcat

SEQ ID NO: 117989 - DNA, 25 bp, Homo sapien
gacgtcatcttgtctcgaagtctct

SEQ ID NO: 117990 - DNA, 25 bp, Homo sapien
gcccaggccttgaagaatacactgt

SEQ ID NO: 117991 - DNA, 25 bp, Homo sapien
gaatacactgtgacttaagaagcct

SEQ ID NO: 117992 - DNA, 25 bp, Homo sapien
agaagccttaccacgcagtaactaa

SEQ ID NO: 117993 - DNA, 25 bp, Homo sapien
tgactgtattcgaggagtgccgtgt

SEQ ID NO: 117994 - DNA, 25 bp, Homo sapien
agtgccgtgtgttgcatgcagctac

SEQ ID NO: 117995 - DNA, 25 bp, Homo sapien
agctacccgtaggaagacttcgcgc

SEQ ID NO: 117996 - DNA, 25 bp, Homo sapien
gaactcctggccaaggaattcaatt

SEQ ID NO: 117997 - DNA, 25 bp, Homo sapien
attcaattcacttcacattagcaac

SEQ ID NO: 117998 - DNA, 25 bp, Homo sapien
ttagcaacaaagatgggtgccagtt

SEQ ID NO: 117999 - DNA, 25 bp, Homo sapien
gaatctgaggttcccagtagcaatg

SEQ ID NO: 118000 - DNA, 25 bp, Homo sapien
agattcctccctttactcaaagagt

SEQ ID NO: 118001 - DNA, 25 bp, Homo sapien
acagactcggacactggtatcagtt

SEQ ID NO: 118002 - DNA, 25 bp, Homo sapien
gtatcagttctaaccacagtcagga

SEQ ID NO: 118003 - DNA, 25 bp, Homo sapien
gtcaggactccgaaacaacagtagg

SEQ ID NO: 118004 - DNA, 25 bp, Homo sapien
ggtgctgttgtcaacatagttccaa

SEQ ID NO: 118005 - DNA, 25 bp, Homo sapien
catagttccaatggctcctttctga

SEQ ID NO: 118006 - DNA, 25 bp, Homo sapien
ctttctgacctgctttcatgtttta

SEQ ID NO: 118007 - DNA, 25 bp, Homo sapien
gtgacaattctgtttttaatgctat

SEQ ID NO: 118008 - DNA, 25 bp, Homo sapien
atttgaacaagtgggccattagcca

SEQ ID NO: 118009 - DNA, 25 bp, Homo sapien
gggccattagccagatttgtctttt

SEQ ID NO: 118010 - DNA, 25 bp, Homo sapien
gccattagccagatttgtctttttg

SEQ ID NO: 118011 - DNA, 25 bp, Homo sapien
ttataaatcttatgctctcactgtt

SEQ ID NO: 118012 - DNA, 25 bp, Homo sapien
taaatcttatgctctcactgtttgt

SEQ ID NO: 118013 - DNA, 25 bp, Homo sapien
attacaattttatctgtttcctgac

SEQ ID NO: 118014 - DNA, 25 bp, Homo sapien
ttatctgtttcctgacattgtctcc

SEQ ID NO: 118015 - DNA, 25 bp, Homo sapien
ctgtttcctgacattgtctcctata

SEQ ID NO: 118016 - DNA, 25 bp, Homo sapien
tcctgacattgtctcctatatattt

SEQ ID NO: 118017 - DNA, 25 bp, Homo sapien
aatggaaattttgctatcaacaata

SEQ ID NO: 118018 - DNA, 25 bp, Homo sapien
gtgtggttcggctttctgccaagca

SEQ ID NO: 118019 - DNA, 25 bp, Homo sapien
ggttcggctttctgccaagcatcta

SEQ ID NO: 118020 - DNA, 25 bp, Homo sapien
ttctgccaagcatctacctcgtctt

SEQ ID NO: 118021 - DNA, 25 bp, Homo sapien
ctcgtcttcctgatcattctgtatg

SEQ ID NO: 118022 - DNA, 25 bp, Homo sapien
gtcttcctgatcattctgtatgagg

SEQ ID NO: 118023 - DNA, 25 bp, Homo sapien
ctgggaggcgcagcctacgtgaaca

SEQ ID NO: 118024 - DNA, 25 bp, Homo sapien
gaggcgcagcctacgtgaacacctt

SEQ ID NO: 118025 - DNA, 25 bp, Homo sapien
tacgtgaacaccttccacaacatcg

SEQ ID NO: 118026 - DNA, 25 bp, Homo sapien
aacatcgccctggagaccagtgatg

SEQ ID NO: 118027 - DNA, 25 bp, Homo sapien
caccgggagtttgcaatggcggcca

SEQ ID NO: 118028 - DNA, 25 bp, Homo sapien
cgggagtttgcaatggcggccacct

SEQ ID NO: 118029 - DNA, 25 bp, Homo sapien
gggtcccggcgcatggtcacctggg

SEQ ID NO: 118030 - DNA, 25 bp, Homo sapien
ggtgcacacaggtcacacagtgcca

SEQ ID NO: 118031 - DNA, 25 bp, Homo sapien
acaggtcacacagtgccaagaggcc

SEQ ID NO: 118032 - DNA, 25 bp, Homo sapien
tcacacagtgccaagaggccccagg

SEQ ID NO: 118033 - DNA, 25 bp, Homo sapien
agccacgtcagccaagccactttag

SEQ ID NO: 118034 - DNA, 25 bp, Homo sapien
gtcagccaagccactttaggtccat

SEQ ID NO: 118035 - DNA, 25 bp, Homo sapien
cagccaagccactttaggtccattt

SEQ ID NO: 118036 - DNA, 25 bp, Homo sapien
aattttaacagtgctcttccatctt

SEQ ID NO: 118037 - DNA, 25 bp, Homo sapien
tgctcttccatcttgtgcataagcc

SEQ ID NO: 118038 - DNA, 25 bp, Homo sapien
ttccatcttgtgcataagcctgaga

SEQ ID NO: 118039 - DNA, 25 bp, Homo sapien
tcttgtgcataagcctgagatttgg

SEQ ID NO: 118040 - DNA, 25 bp, Homo sapien
gtgatgactcagttgactctggccc

SEQ ID NO: 118041 - DNA, 25 bp, Homo sapien
tcagttgactctggccctgaaggaa

SEQ ID NO: 118042 - DNA, 25 bp, Homo sapien
ggccctgaaggaatgccacagacga

SEQ ID NO: 118043 - DNA, 25 bp, Homo sapien
cgaagtgatggtggtcataccgtat

SEQ ID NO: 118044 - DNA, 25 bp, Homo sapien
gtcataccgtattgcatcgggatct

SEQ ID NO: 118045 - DNA, 25 bp, Homo sapien
aacgtcaagcttggagactttgggc

SEQ ID NO: 118046 - DNA, 25 bp, Homo sapien
gagactttgggctagctagaatatt

SEQ ID NO: 118047 - DNA, 25 bp, Homo sapien
ttgttggcacaccttattacatgtc

SEQ ID NO: 118048 - DNA, 25 bp, Homo sapien
acaccttattacatgtctcctgaac

SEQ ID NO: 118049 - DNA, 25 bp, Homo sapien
tgaacaaatgaatcgcatgtcctac

SEQ ID NO: 118050 - DNA, 25 bp, Homo sapien
agagtttgttcttcgagtgatgact

SEQ ID NO: 118051 - DNA, 25 bp, Homo sapien
acggcaagtggcagaacgtgcactt

SEQ ID NO: 118052 - DNA, 25 bp, Homo sapien
gcaagtggcagaacgtgcacttcca

SEQ ID NO: 118053 - DNA, 25 bp, Homo sapien
agtggcagaacgtgcacttccactg

SEQ ID NO: 118054 - DNA, 25 bp, Homo sapien
tggcagaacgtgcacttccactgct

SEQ ID NO: 118055 - DNA, 25 bp, Homo sapien
tgtggccccgctgcagtgaagagct

SEQ ID NO: 118056 - DNA, 25 bp, Homo sapien
tggccccgctgcagtgaagagctgc

SEQ ID NO: 118057 - DNA, 25 bp, Homo sapien
agagctgcgccctggtttcgccgga

SEQ ID NO: 118058 - DNA, 25 bp, Homo sapien
tgcgccctggtttcgccggacagag

SEQ ID NO: 118059 - DNA, 25 bp, Homo sapien
ggtttcgccggacagagttggtgtt

SEQ ID NO: 118060 - DNA, 25 bp, Homo sapien
gttggtgtttggagcccgactgccc

SEQ ID NO: 118061 - DNA, 25 bp, Homo sapien
tgtttggagcccgactgccctcggg

SEQ ID NO: 118062 - DNA, 25 bp, Homo sapien
atcaatttcttaacatgagctccag

SEQ ID NO: 118063 - DNA, 25 bp, Homo sapien
tgagctccagtttacctaaatgttc

SEQ ID NO: 118064 - DNA, 25 bp, Homo sapien
tacctaaatgttcactgacacaaag

SEQ ID NO: 118065 - DNA, 25 bp, Homo sapien
caaaggatgagattacacctacagt

SEQ ID NO: 118066 - DNA, 25 bp, Homo sapien
gtagtcacatatataagcactgcac

SEQ ID NO: 118067 - DNA, 25 bp, Homo sapien
gcactgcacatgagatatagatccg

SEQ ID NO: 118068 - DNA, 25 bp, Homo sapien
gaattgtcaggagtgcacctctcta

SEQ ID NO: 118069 - DNA, 25 bp, Homo sapien
gcacctctctacttgggaggtacaa

SEQ ID NO: 118070 - DNA, 25 bp, Homo sapien
ggaggtacaattgccatatgatttc

SEQ ID NO: 118071 - DNA, 25 bp, Homo sapien
atgatttctagctgccatggtggtt

SEQ ID NO: 118072 - DNA, 25 bp, Homo sapien
ggagctgtgagccagtattcattta

SEQ ID NO: 118073 - DNA, 25 bp, Homo sapien
gctatcaattttgtggctactcctg

SEQ ID NO: 118074 - DNA, 25 bp, Homo sapien
gtggctactcctgacgaacaaaaca

SEQ ID NO: 118075 - DNA, 25 bp, Homo sapien
caaaacagggatttggacatgttca

SEQ ID NO: 118076 - DNA, 25 bp, Homo sapien
tcaatgcctccaagaatttcaacct

SEQ ID NO: 118077 - DNA, 25 bp, Homo sapien
agaatttcaacctcaacatcacctg

SEQ ID NO: 118078 - DNA, 25 bp, Homo sapien
acctgggctgccagtttctcagctg

SEQ ID NO: 118079 - DNA, 25 bp, Homo sapien
gaagtttgattttcgcaaccaccca

SEQ ID NO: 118080 - DNA, 25 bp, Homo sapien
ttgattttcgcaaccacccaaatat

SEQ ID NO: 118081 - DNA, 25 bp, Homo sapien
atatcactttctttgtttatgtcag

SEQ ID NO: 118082 - DNA, 25 bp, Homo sapien
atgtcagtaatttcacctggcccat

SEQ ID NO: 118083 - DNA, 25 bp, Homo sapien
tttcacctggcccatcaaaattcag

SEQ ID NO: 118084 - DNA, 25 bp, Homo sapien
gcattatttggtgcatctgctcaat

SEQ ID NO: 118085 - DNA, 25 bp, Homo sapien
cacaaggatggctttcatcggctca

SEQ ID NO: 118086 - DNA, 25 bp, Homo sapien
atcggctcaggcagcatcatgatga

SEQ ID NO: 118087 - DNA, 25 bp, Homo sapien
gaaattcgcatgatgtctaccggct

SEQ ID NO: 118088 - DNA, 25 bp, Homo sapien
gcatgatgtctaccggctccaagaa

SEQ ID NO: 118089 - DNA, 25 bp, Homo sapien
aagaagtccctcctaagccatgagt

SEQ ID NO: 118090 - DNA, 25 bp, Homo sapien
aaacacattttgcatatctcccagc

SEQ ID NO: 118091 - DNA, 25 bp, Homo sapien
tatctcccagcataagtaccaagca

SEQ ID NO: 118092 - DNA, 25 bp, Homo sapien
gcaaaattacagttcctcttgggag

SEQ ID NO: 118093 - DNA, 25 bp, Homo sapien
ttcctcttgggagaacactgcatta

SEQ ID NO: 118094 - DNA, 25 bp, Homo sapien
gagagactctcttgcttcttcaaag

SEQ ID NO: 118095 - DNA, 25 bp, Homo sapien
gatgagcatgacagaacgacaagat

SEQ ID NO: 118096 - DNA, 25 bp, Homo sapien
cgacaagatcttgtttacttttgga

SEQ ID NO: 118097 - DNA, 25 bp, Homo sapien
acttttggacatcaagcccatcact

SEQ ID NO: 118098 - DNA, 25 bp, Homo sapien
gaagaaggattccagcctatgccct

SEQ ID NO: 118099 - DNA, 25 bp, Homo sapien
gcctatgccctcaatcacaataaga

SEQ ID NO: 118100 - DNA, 25 bp, Homo sapien
aataagaccaccagatgaccaacat

SEQ ID NO: 118101 - DNA, 25 bp, Homo sapien
tgaccaacatcttcctactgcaaat

SEQ ID NO: 118102 - DNA, 25 bp, Homo sapien
atacttgcatttctcgactttacgt

SEQ ID NO: 118103 - DNA, 25 bp, Homo sapien
ttacgtcccactctattcctctaaa

SEQ ID NO: 118104 - DNA, 25 bp, Homo sapien
acagaaattgttactcgccattaag

SEQ ID NO: 118105 - DNA, 25 bp, Homo sapien
gttactcgccattaagaccaagaat

SEQ ID NO: 118106 - DNA, 25 bp, Homo sapien
tggcccggctggtgtttgtgccact

SEQ ID NO: 118107 - DNA, 25 bp, Homo sapien
tgctgctgtgcaacattaagccccg

SEQ ID NO: 118108 - DNA, 25 bp, Homo sapien
tgtgcaacattaagccccgccgcta

SEQ ID NO: 118109 - DNA, 25 bp, Homo sapien
gctacctgactgtggtcttcgagca

SEQ ID NO: 118110 - DNA, 25 bp, Homo sapien
tgactgtggtcttcgagcacgatgc

SEQ ID NO: 118111 - DNA, 25 bp, Homo sapien
tcttcgagcacgatgcctggttcat

SEQ ID NO: 118112 - DNA, 25 bp, Homo sapien
cgccagcctctgcatgtgcttcggg

SEQ ID NO: 118113 - DNA, 25 bp, Homo sapien
tctgcatgtgcttcgggcccaagaa

SEQ ID NO: 118114 - DNA, 25 bp, Homo sapien
gcagagaccgcaggagccatcatgg

SEQ ID NO: 118115 - DNA, 25 bp, Homo sapien
agccatcatggccttcttcctgtgt

SEQ ID NO: 118116 - DNA, 25 bp, Homo sapien
ttttctccttcctgttccgggcaat

SEQ ID NO: 118117 - DNA, 25 bp, Homo sapien
accatgtcagtggacacgtccgcga

SEQ ID NO: 118118 - DNA, 25 bp, Homo sapien
catgtcagtggacacgtccgcgaac

SEQ ID NO: 118119 - DNA, 25 bp, Homo sapien
atgtcagtggacacgtccgcgaacc

SEQ ID NO: 118120 - DNA, 25 bp, Homo sapien
gtcagtggacacgtccgcgaaccag

SEQ ID NO: 118121 - DNA, 25 bp, Homo sapien
tcagtggacacgtccgcgaaccagt

SEQ ID NO: 118122 - DNA, 25 bp, Homo sapien
cagtggacacgtccgcgaaccagtt

SEQ ID NO: 118123 - DNA, 25 bp, Homo sapien
gtggacacgtccgcgaaccagttct

SEQ ID NO: 118124 - DNA, 25 bp, Homo sapien
attattgtgcgagacgtcgttgggc

SEQ ID NO: 118125 - DNA, 25 bp, Homo sapien
ttattgtgcgagacgtcgttgggct

SEQ ID NO: 118126 - DNA, 25 bp, Homo sapien
attgtgcgagacgtcgttgggctat

SEQ ID NO: 118127 - DNA, 25 bp, Homo sapien
gcgagacgtcgttgggctatggtgg

SEQ ID NO: 118128 - DNA, 25 bp, Homo sapien
aggactagaatatttgcactttatg

SEQ ID NO: 118129 - DNA, 25 bp, Homo sapien
gaatatttgcactttatgagaaaaa

SEQ ID NO: 118130 - DNA, 25 bp, Homo sapien
aaagctggaaatattctcctcaata

SEQ ID NO: 118131 - DNA, 25 bp, Homo sapien
gctggaaatattctcctcaatacag

SEQ ID NO: 118132 - DNA, 25 bp, Homo sapien
tattctcctcaatacagaaggacat

SEQ ID NO: 118133 - DNA, 25 bp, Homo sapien
gagtggctggtcagttaacagatac

SEQ ID NO: 118134 - DNA, 25 bp, Homo sapien
atggcaaaacgcaatactgtaatag

SEQ ID NO: 118135 - DNA, 25 bp, Homo sapien
gcgctggctctgtctcagacataat

SEQ ID NO: 118136 - DNA, 25 bp, Homo sapien
ggctctgtctcagacataattagat

SEQ ID NO: 118137 - DNA, 25 bp, Homo sapien
gaaattgcaaccattcttaaatcta

SEQ ID NO: 118138 - DNA, 25 bp, Homo sapien
tgcaaccattcttaaatctacattg

SEQ ID NO: 118139 - DNA, 25 bp, Homo sapien
gagaagccccccaaggtgcagccag

SEQ ID NO: 118140 - DNA, 25 bp, Homo sapien
gtgcagccaggaggcaaacagcaga

SEQ ID NO: 118141 - DNA, 25 bp, Homo sapien
agcagaaaggacaatgcacccttca

SEQ ID NO: 118142 - DNA, 25 bp, Homo sapien
aaggacaatgcacccttcagagtgg

SEQ ID NO: 118143 - DNA, 25 bp, Homo sapien
gatctgatgatctgaggaggttctg

SEQ ID NO: 118144 - DNA, 25 bp, Homo sapien
aagtgtctgctgagaatatcaaggg

SEQ ID NO: 118145 - DNA, 25 bp, Homo sapien
catgggtcaggtgcaggaagatgtc

SEQ ID NO: 118146 - DNA, 25 bp, Homo sapien
aagatgtctgggtgtctgtagaaga

SEQ ID NO: 118147 - DNA, 25 bp, Homo sapien
ctgggtgtctgtagaagatgcttcc

SEQ ID NO: 118148 - DNA, 25 bp, Homo sapien
tagaagatgcttcctccattaaact

SEQ ID NO: 118149 - DNA, 25 bp, Homo sapien
gaagatgcttcctccattaaactgt

SEQ ID NO: 118150 - DNA, 25 bp, Homo sapien
tgtgtctggtccacacaccacagaa

SEQ ID NO: 118151 - DNA, 25 bp, Homo sapien
gtccacacaccacagaagcttgtat

SEQ ID NO: 118152 - DNA, 25 bp, Homo sapien
acagaagcttgtattatcagtgaat

SEQ ID NO: 118153 - DNA, 25 bp, Homo sapien
gtactacatttgcatgccttttggg

SEQ ID NO: 118154 - DNA, 25 bp, Homo sapien
catgccttttgggtttgccttaatt

SEQ ID NO: 118155 - DNA, 25 bp, Homo sapien
gtttgccttaattcttacctcattt

SEQ ID NO: 118156 - DNA, 25 bp, Homo sapien
ttacctcatttgcatcctatcgatc

SEQ ID NO: 118157 - DNA, 25 bp, Homo sapien
gcatcctatcgatctggaaagagct

SEQ ID NO: 118158 - DNA, 25 bp, Homo sapien
atgtaaaaaccctgctaaatgactt

SEQ ID NO: 118159 - DNA, 25 bp, Homo sapien
ggaagtgtattggtttctgtttgaa

SEQ ID NO: 118160 - DNA, 25 bp, Homo sapien
tcaaaggcttccaatgtggtggcaa

SEQ ID NO: 118161 - DNA, 25 bp, Homo sapien
tactgaatgtcagtcatttccccta

SEQ ID NO: 118162 - DNA, 25 bp, Homo sapien
atgtcagtcatttcccctacttgat

SEQ ID NO: 118163 - DNA, 25 bp, Homo sapien
ctgcaatgccaatatcaagggccat

SEQ ID NO: 118164 - DNA, 25 bp, Homo sapien
caagggccatgtatcaggtttctgt

SEQ ID NO: 118165 - DNA, 25 bp, Homo sapien
caggtttctgtatatgttccactat

SEQ ID NO: 118166 - DNA, 25 bp, Homo sapien
gtatatgttccactataatcttatg

SEQ ID NO: 118167 - DNA, 25 bp, Homo sapien
gggaccatggttttaaatgtggaat

SEQ ID NO: 118168 - DNA, 25 bp, Homo sapien
gtagcatatggctgtgtatcactag

SEQ ID NO: 118169 - DNA, 25 bp, Homo sapien
tatgtagatccaatcactttaccta

SEQ ID NO: 118170 - DNA, 25 bp, Homo sapien
actttacctatacaaaatgactgct

SEQ ID NO: 118171 - DNA, 25 bp, Homo sapien
aatgactgctatggtgggaacacaa

SEQ ID NO: 118172 - DNA, 25 bp, Homo sapien
attacaatcaactcttaagggactt

SEQ ID NO: 118173 - DNA, 25 bp, Homo sapien
agggacttgaataccttcattttat

SEQ ID NO: 118174 - DNA, 25 bp, Homo sapien
aaatacaccgagatatcaaggcagg

SEQ ID NO: 118175 - DNA, 25 bp, Homo sapien
acaccgagatatcaaggcaggaaat

SEQ ID NO: 118176 - DNA, 25 bp, Homo sapien
tattttgctaaatacagaaggacat

SEQ ID NO: 118177 - DNA, 25 bp, Homo sapien
gattttggggtagcaggtcaactta

SEQ ID NO: 118178 - DNA, 25 bp, Homo sapien
gtcaacttacagataccatggccaa

SEQ ID NO: 118179 - DNA, 25 bp, Homo sapien
tacagataccatggccaagcggaat

SEQ ID NO: 118180 - DNA, 25 bp, Homo sapien
catggccaagcggaatacagtgata

SEQ ID NO: 118181 - DNA, 25 bp, Homo sapien
gaatacagtgataggaacaccattt

SEQ ID NO: 118182 - DNA, 25 bp, Homo sapien
agctacaatattacaatcaactctt

SEQ ID NO: 118183 - DNA, 25 bp, Homo sapien
gaaatcaatcatagtggaagcacca

SEQ ID NO: 118184 - DNA, 25 bp, Homo sapien
tcatagtggaagcaccaactacaac

SEQ ID NO: 118185 - DNA, 25 bp, Homo sapien
tgtgcgagaggcaggtattatcatg

SEQ ID NO: 118186 - DNA, 25 bp, Homo sapien
tgcgagaggcaggtattatcatggt

SEQ ID NO: 118187 - DNA, 25 bp, Homo sapien
gcgagaggcaggtattatcatggtt

SEQ ID NO: 118188 - DNA, 25 bp, Homo sapien
cgagaggcaggtattatcatggttc

SEQ ID NO: 118189 - DNA, 25 bp, Homo sapien
gagaggcaggtattatcatggttcg

SEQ ID NO: 118190 - DNA, 25 bp, Homo sapien
agaggcaggtattatcatggttcgg

SEQ ID NO: 118191 - DNA, 25 bp, Homo sapien
gtattatcatggttcggggagacaa

SEQ ID NO: 118192 - DNA, 25 bp, Homo sapien
gggagacaaccactttgactactgg

SEQ ID NO: 118193 - DNA, 25 bp, Homo sapien
ctgctctgtctatggtgggtccttc

SEQ ID NO: 118194 - DNA, 25 bp, Homo sapien
ctgtcagcaatatggtagctcgcct

SEQ ID NO: 118195 - DNA, 25 bp, Homo sapien
gtcagcaatatggtagctcgcctct

SEQ ID NO: 118196 - DNA, 25 bp, Homo sapien
agcaatatggtagctcgcctctcac

SEQ ID NO: 118197 - DNA, 25 bp, Homo sapien
aatatggtagctcgcctctcacttt

SEQ ID NO: 118198 - DNA, 25 bp, Homo sapien
atatggtagctcgcctctcactttc

SEQ ID NO: 118199 - DNA, 25 bp, Homo sapien
ccagtcagagtattagcagcagttt

SEQ ID NO: 118200 - DNA, 25 bp, Homo sapien
cagtcagagtattagcagcagtttc

SEQ ID NO: 118201 - DNA, 25 bp, Homo sapien
gtcagagtattagcagcagtttctt

SEQ ID NO: 118202 - DNA, 25 bp, Homo sapien
tcagagtattagcagcagtttctta

SEQ ID NO: 118203 - DNA, 25 bp, Homo sapien
gagtattagcagcagtttcttagcc

SEQ ID NO: 118204 - DNA, 25 bp, Homo sapien
attagcagcagtttcttagcctggt

SEQ ID NO: 118205 - DNA, 25 bp, Homo sapien
gagtatctattatagtgggaccacc

SEQ ID NO: 118206 - DNA, 25 bp, Homo sapien
gtatctattatagtgggaccacctt

SEQ ID NO: 118207 - DNA, 25 bp, Homo sapien
catatccgtggacacgtccaaaaac

SEQ ID NO: 118208 - DNA, 25 bp, Homo sapien
gtggacacgtccaaaaaccagatct

SEQ ID NO: 118209 - DNA, 25 bp, Homo sapien
ggacacgtccaaaaaccagatctcc

SEQ ID NO: 118210 - DNA, 25 bp, Homo sapien
gtattattgtgcaacactttatcgc

SEQ ID NO: 118211 - DNA, 25 bp, Homo sapien
attgtgcaacactttatcgcacgga

SEQ ID NO: 118212 - DNA, 25 bp, Homo sapien
gtgcaacactttatcgcacggaccc

SEQ ID NO: 118213 - DNA, 25 bp, Homo sapien
gacccccacagtacgatttttggag

SEQ ID NO: 118214 - DNA, 25 bp, Homo sapien
tggctccatcagtaccagtacttac

SEQ ID NO: 118215 - DNA, 25 bp, Homo sapien
ccatcagtaccagtacttactactg

SEQ ID NO: 118216 - DNA, 25 bp, Homo sapien
agatacttgaacgagtccccagtct

SEQ ID NO: 118217 - DNA, 25 bp, Homo sapien
acgagtccccagtctgcgggaggca

SEQ ID NO: 118218 - DNA, 25 bp, Homo sapien
gggtcacacgccacataacagacaa

SEQ ID NO: 118219 - DNA, 25 bp, Homo sapien
cacacacgtgtgtttttctttgcaa

SEQ ID NO: 118220 - DNA, 25 bp, Homo sapien
cgtgtgtttttctttgcaatacttg

SEQ ID NO: 118221 - DNA, 25 bp, Homo sapien
aatacttgaaatattgccactgtgc

SEQ ID NO: 118222 - DNA, 25 bp, Homo sapien
attgccactgtgcttggacttagaa

SEQ ID NO: 118223 - DNA, 25 bp, Homo sapien
tagaagaagaaaatccccgtgactt

SEQ ID NO: 118224 - DNA, 25 bp, Homo sapien
catcaccttgatggctttattctca

SEQ ID NO: 118225 - DNA, 25 bp, Homo sapien
ttcatggccgactggaatcctgagt

SEQ ID NO: 118226 - DNA, 25 bp, Homo sapien
aatcctgagtcctgggaagctggca

SEQ ID NO: 118227 - DNA, 25 bp, Homo sapien
ggaccggcagcctctactgcagagt

SEQ ID NO: 118228 - DNA, 25 bp, Homo sapien
tctactgcagagtgggcatcggttt

SEQ ID NO: 118229 - DNA, 25 bp, Homo sapien
tgggcatcggtttccatctgcagat

SEQ ID NO: 118230 - DNA, 25 bp, Homo sapien
atctgcagatctacccggatggcaa

SEQ ID NO: 118231 - DNA, 25 bp, Homo sapien
gatctacccggatggcaaagtcaat

SEQ ID NO: 118232 - DNA, 25 bp, Homo sapien
tggcaaagtcaatggatcccacgaa

SEQ ID NO: 118233 - DNA, 25 bp, Homo sapien
ggatcccacgaagccaatatgttaa

SEQ ID NO: 118234 - DNA, 25 bp, Homo sapien
gcaagttcagggagcgttttcaaga

SEQ ID NO: 118235 - DNA, 25 bp, Homo sapien
gctataatacctatgcctcagcaat

SEQ ID NO: 118236 - DNA, 25 bp, Homo sapien
gaaaagccaaacgagggtgcagccc

SEQ ID NO: 118237 - DNA, 25 bp, Homo sapien
gggttaaaccccagcatatctctac

SEQ ID NO: 118238 - DNA, 25 bp, Homo sapien
tcgacctgagccacggctctgccca

SEQ ID NO: 118239 - DNA, 25 bp, Homo sapien
gttaagggccacggcaagaaggtgg

SEQ ID NO: 118240 - DNA, 25 bp, Homo sapien
acgtggacgacatgcccaacgcgct

SEQ ID NO: 118241 - DNA, 25 bp, Homo sapien
cgtggacgacatgcccaacgcgctg

SEQ ID NO: 118242 - DNA, 25 bp, Homo sapien
gacctgcacgcgcacaagcttcggg

SEQ ID NO: 118243 - DNA, 25 bp, Homo sapien
acctgcacgcgcacaagcttcgggt

SEQ ID NO: 118244 - DNA, 25 bp, Homo sapien
cctgcacgcgcacaagcttcgggtg

SEQ ID NO: 118245 - DNA, 25 bp, Homo sapien
ctgcacgcgcacaagcttcgggtgg

SEQ ID NO: 118246 - DNA, 25 bp, Homo sapien
tgcacgcgcacaagcttcgggtgga

SEQ ID NO: 118247 - DNA, 25 bp, Homo sapien
gcacgcgcacaagcttcgggtggac

SEQ ID NO: 118248 - DNA, 25 bp, Homo sapien
ccgagttcacccctgcggtgcacgc

SEQ ID NO: 118249 - DNA, 25 bp, Homo sapien
tttgctatgttctaagtccaccttc

SEQ ID NO: 118250 - DNA, 25 bp, Homo sapien
ttgctatgttctaagtccaccttct

SEQ ID NO: 118251 - DNA, 25 bp, Homo sapien
aaccagtatgagatagtgtaaccca

SEQ ID NO: 118252 - DNA, 25 bp, Homo sapien
gtatgagatagtgtaacccaatgta

SEQ ID NO: 118253 - DNA, 25 bp, Homo sapien
gatagtgtaacccaatgtatctgtg

SEQ ID NO: 118254 - DNA, 25 bp, Homo sapien
gtaacccaatgtatctgtgggccta

SEQ ID NO: 118255 - DNA, 25 bp, Homo sapien
caatgtatctgtgggcctattcctc

SEQ ID NO: 118256 - DNA, 25 bp, Homo sapien
gtatctgtgggcctattcctctcta

SEQ ID NO: 118257 - DNA, 25 bp, Homo sapien
gcctattcctctctacctttaagga

SEQ ID NO: 118258 - DNA, 25 bp, Homo sapien
aaaactacaccagtaggttgattca

SEQ ID NO: 118259 - DNA, 25 bp, Homo sapien
acctaaaactacaccaataggctga

SEQ ID NO: 118260 - DNA, 25 bp, Homo sapien
tcccttcttctaaggtagggagtct

SEQ ID NO: 118261 - DNA, 25 bp, Homo sapien
cttcttctaaggtagggagtctgtg

SEQ ID NO: 118262 - DNA, 25 bp, Homo sapien
ttctaaggtagggagtctgtgatct

SEQ ID NO: 118263 - DNA, 25 bp, Homo sapien
aggtagggagtctgtgatctctttc

SEQ ID NO: 118264 - DNA, 25 bp, Homo sapien
gtagggagtctgtgatctctttctg

SEQ ID NO: 118265 - DNA, 25 bp, Homo sapien
tagggagtctgtgatctctttctgt

SEQ ID NO: 118266 - DNA, 25 bp, Homo sapien
agggagtctgtgatctctttctgtg

SEQ ID NO: 118267 - DNA, 25 bp, Homo sapien
ggagtctgtgatctctttctgtgtg

SEQ ID NO: 118268 - DNA, 25 bp, Homo sapien
agtctgtgatctctttctgtgtgta

SEQ ID NO: 118269 - DNA, 25 bp, Homo sapien
gtctgtgatctctttctgtgtgtat

SEQ ID NO: 118270 - DNA, 25 bp, Homo sapien
tctgtgatctctttctgtgtgtatt

SEQ ID NO: 118271 - DNA, 25 bp, Homo sapien
ggatgggagggattaatcctttctt

SEQ ID NO: 118272 - DNA, 25 bp, Homo sapien
gagggattaatcctttctttggtag

SEQ ID NO: 118273 - DNA, 25 bp, Homo sapien
ggattaatcctttctttggtagagc

SEQ ID NO: 118274 - DNA, 25 bp, Homo sapien
taatcctttctttggtagagcaagt

SEQ ID NO: 118275 - DNA, 25 bp, Homo sapien
ttctttggtagagcaagttacgcac

SEQ ID NO: 118276 - DNA, 25 bp, Homo sapien
tggtagagcaagttacgcacagaac

SEQ ID NO: 118277 - DNA, 25 bp, Homo sapien
agttacgcacagaactttcagggca

SEQ ID NO: 118278 - DNA, 25 bp, Homo sapien
gcggacgaatctacgagcacaacgt

SEQ ID NO: 118279 - DNA, 25 bp, Homo sapien
caacgtacatggaactgagcagcct

SEQ ID NO: 118280 - DNA, 25 bp, Homo sapien
gggacgatcttctgactacagtaac

SEQ ID NO: 118281 - DNA, 25 bp, Homo sapien
tgactacagtaacccctttgactac

SEQ ID NO: 118282 - DNA, 25 bp, Homo sapien
tattactgtgcgagaacgatttcgg

SEQ ID NO: 118283 - DNA, 25 bp, Homo sapien
attactgtgcgagaacgatttcggg

SEQ ID NO: 118284 - DNA, 25 bp, Homo sapien
ttactgtgcgagaacgatttcgggg

SEQ ID NO: 118285 - DNA, 25 bp, Homo sapien
tactgtgcgagaacgatttcggggg

SEQ ID NO: 118286 - DNA, 25 bp, Homo sapien
actgtgcgagaacgatttcgggggg

SEQ ID NO: 118287 - DNA, 25 bp, Homo sapien
ctgtgcgagaacgatttcggggggt

SEQ ID NO: 118288 - DNA, 25 bp, Homo sapien
tgtgcgagaacgatttcggggggtc

SEQ ID NO: 118289 - DNA, 25 bp, Homo sapien
gtgcgagaacgatttcggggggtcg

SEQ ID NO: 118290 - DNA, 25 bp, Homo sapien
tgcgagaacgatttcggggggtcga

SEQ ID NO: 118291 - DNA, 25 bp, Homo sapien
taaaccctcgacaggtgttcaacct

SEQ ID NO: 118292 - DNA, 25 bp, Homo sapien
gttcaacctcctaaaggatggtcct

SEQ ID NO: 118293 - DNA, 25 bp, Homo sapien
gatggtcctgagatagggctccgat

SEQ ID NO: 118294 - DNA, 25 bp, Homo sapien
gggctccgattattcaaggatgttc

SEQ ID NO: 118295 - DNA, 25 bp, Homo sapien
aggatgttcctgatagccggatttt

SEQ ID NO: 118296 - DNA, 25 bp, Homo sapien
agacggcacagtaggctggattcta

SEQ ID NO: 118297 - DNA, 25 bp, Homo sapien
ggattctagagaccattgacaaagc

SEQ ID NO: 118298 - DNA, 25 bp, Homo sapien
aagctaacttgccagttttgcctcc

SEQ ID NO: 118299 - DNA, 25 bp, Homo sapien
agttttgcctcctgttgctgtgttg

SEQ ID NO: 118300 - DNA, 25 bp, Homo sapien
ctgggtactggaaatgatctggctc

SEQ ID NO: 118301 - DNA, 25 bp, Homo sapien
atgatctggctcgatgcctaagatg

SEQ ID NO: 118302 - DNA, 25 bp, Homo sapien
aggatctccaagacggatggcgttt

SEQ ID NO: 118303 - DNA, 25 bp, Homo sapien
acggatggcgtttgtgaatggaaat

SEQ ID NO: 118304 - DNA, 25 bp, Homo sapien
atttttctcttccatgccccgtgga

SEQ ID NO: 118305 - DNA, 25 bp, Homo sapien
atgccccgtggatctgccaggatta

SEQ ID NO: 118306 - DNA, 25 bp, Homo sapien
tggatctgccaggattacagtgtcc

SEQ ID NO: 118307 - DNA, 25 bp, Homo sapien
gtgtccaaagaccaatcctcctgta

SEQ ID NO: 118308 - DNA, 25 bp, Homo sapien
ccacagcccgggtgagaagtaaaag

SEQ ID NO: 118309 - DNA, 25 bp, Homo sapien
taaaagctttttgcaggtctgctgc

SEQ ID NO: 118310 - DNA, 25 bp, Homo sapien
aggtctgctgctgtgtagggccctc

SEQ ID NO: 118311 - DNA, 25 bp, Homo sapien
gacaagaaccatcaagttccaacca

SEQ ID NO: 118312 - DNA, 25 bp, Homo sapien
gttccaaccattaaggtccacacca

SEQ ID NO: 118313 - DNA, 25 bp, Homo sapien
agcattctacttgatcttacagtat

SEQ ID NO: 118314 - DNA, 25 bp, Homo sapien
gtgtgtggatgtctacatggttaat

SEQ ID NO: 118315 - DNA, 25 bp, Homo sapien
atggttaatggaaagcactgtgctc

SEQ ID NO: 118316 - DNA, 25 bp, Homo sapien
agcactgtgctctgaagtggatcag

SEQ ID NO: 118317 - DNA, 25 bp, Homo sapien
agtggatcagtctcaagtgtctggt

SEQ ID NO: 118318 - DNA, 25 bp, Homo sapien
gtctcaagtgtctggtaacagcagc

SEQ ID NO: 118319 - DNA, 25 bp, Homo sapien
agcagcagtgcttagaaaattcttt

SEQ ID NO: 118320 - DNA, 25 bp, Homo sapien
gttattatcagaatttgccaaccta

SEQ ID NO: 118321 - DNA, 25 bp, Homo sapien
agaatttgccaacctaaagaatgaa

SEQ ID NO: 118322 - DNA, 25 bp, Homo sapien
aattcataacttggtcatgttcaca

SEQ ID NO: 118323 - DNA, 25 bp, Homo sapien
ggtcatgttcacaacaaaactgtca

SEQ ID NO: 118324 - DNA, 25 bp, Homo sapien
cagatataaatgctgaagaggcccc

SEQ ID NO: 118325 - DNA, 25 bp, Homo sapien
ctgacctggaactagaggagggcct

SEQ ID NO: 118326 - DNA, 25 bp, Homo sapien
tttgaagttccacagcaagatgtga

SEQ ID NO: 118327 - DNA, 25 bp, Homo sapien
gcaagatgtgatcctgccagagtac

SEQ ID NO: 118328 - DNA, 25 bp, Homo sapien
gccagagtactaaacagcttccttc

SEQ ID NO: 118329 - DNA, 25 bp, Homo sapien
ttcagatctggaagccaaacaccgg

SEQ ID NO: 118330 - DNA, 25 bp, Homo sapien
tctggaagccaaacaccggcatttt

SEQ ID NO: 118331 - DNA, 25 bp, Homo sapien
aacaccggcattttatgtactttgt

SEQ ID NO: 118332 - DNA, 25 bp, Homo sapien
ttatgtactttgtccttcagcaaga

SEQ ID NO: 118333 - DNA, 25 bp, Homo sapien
tttgtccttcagcaagaaaggtgtg

SEQ ID NO: 118334 - DNA, 25 bp, Homo sapien
aaaggtgtggaagcatgatatgtac

SEQ ID NO: 118335 - DNA, 25 bp, Homo sapien
cttcagcaatgaattcacctttggg

SEQ ID NO: 118336 - DNA, 25 bp, Homo sapien
ttcagcaatgaattcacctttggga

SEQ ID NO: 118337 - DNA, 25 bp, Homo sapien
cagcaatgaattcacctttgggaac

SEQ ID NO: 118338 - DNA, 25 bp, Homo sapien
acctttgggaacaagctggacacct

SEQ ID NO: 118339 - DNA, 25 bp, Homo sapien
cctttgggaacaagctggacacctt

SEQ ID NO: 118340 - DNA, 25 bp, Homo sapien
agctggacaccttctgtggcagtcc

SEQ ID NO: 118341 - DNA, 25 bp, Homo sapien
gctggacaccttctgtggcagtccc

SEQ ID NO: 118342 - DNA, 25 bp, Homo sapien
ttctgtggcagtcccccttatgctg

SEQ ID NO: 118343 - DNA, 25 bp, Homo sapien
ttatgctgccccagaactcttccag

SEQ ID NO: 118344 - DNA, 25 bp, Homo sapien
cagaactcttccagggcaaaaaata

SEQ ID NO: 118345 - DNA, 25 bp, Homo sapien
agaactcttccagggcaaaaaatat

SEQ ID NO: 118346 - DNA, 25 bp, Homo sapien
gagacggtaaccataccctcttcca

SEQ ID NO: 118347 - DNA, 25 bp, Homo sapien
atgtgaacccacttccgaccggcta

SEQ ID NO: 118348 - DNA, 25 bp, Homo sapien
tccgaccggctatgaagatgagtaa

SEQ ID NO: 118349 - DNA, 25 bp, Homo sapien
gatgagtaaagagaacctggcctcc

SEQ ID NO: 118350 - DNA, 25 bp, Homo sapien
agcactggttttggacccttactct

SEQ ID NO: 118351 - DNA, 25 bp, Homo sapien
tggttttggacccttactctgtgtg

SEQ ID NO: 118352 - DNA, 25 bp, Homo sapien
tgtgtggaccacgaaaaccctttgg

SEQ ID NO: 118353 - DNA, 25 bp, Homo sapien
tggatgctaagctcgtgtctccttt

SEQ ID NO: 118354 - DNA, 25 bp, Homo sapien
ctttcctcagatggcgaccattact

SEQ ID NO: 118355 - DNA, 25 bp, Homo sapien
attactctgatcttccatcccttct

SEQ ID NO: 118356 - DNA, 25 bp, Homo sapien
catcccttctgcttgtaagaggaga

SEQ ID NO: 118357 - DNA, 25 bp, Homo sapien
aggatctccaagacggatggcgttt

SEQ ID NO: 118358 - DNA, 25 bp, Homo sapien
tctccaagacggatggcgtttgtga

SEQ ID NO: 118359 - DNA, 25 bp, Homo sapien
acggatggcgtttgtgaatggaaat

SEQ ID NO: 118360 - DNA, 25 bp, Homo sapien
gcgtttgtgaatggaaatttttctc

SEQ ID NO: 118361 - DNA, 25 bp, Homo sapien
atttttctcttccatgccccgtgga

SEQ ID NO: 118362 - DNA, 25 bp, Homo sapien
cgtggatctgccaggattacagtgt

SEQ ID NO: 118363 - DNA, 25 bp, Homo sapien
tggatctgccaggattacagtgtcc

SEQ ID NO: 118364 - DNA, 25 bp, Homo sapien
caggattacagtgtccaaagaccaa

SEQ ID NO: 118365 - DNA, 25 bp, Homo sapien
tacagtgtccaaagaccaatcctcc

SEQ ID NO: 118366 - DNA, 25 bp, Homo sapien
gtgtccaaagaccaatcctcctgta

SEQ ID NO: 118367 - DNA, 25 bp, Homo sapien
aaagaccaatcctcctgtaccacag

SEQ ID NO: 118368 - DNA, 25 bp, Homo sapien
ggcctcctctttcaaataaggcatg

SEQ ID NO: 118369 - DNA, 25 bp, Homo sapien
ataaggcatggtgggcagcaaagaa

SEQ ID NO: 118370 - DNA, 25 bp, Homo sapien
aatgttgctgtttggtgttaagtga

SEQ ID NO: 118371 - DNA, 25 bp, Homo sapien
tgggtgtgtaatttgtaagtacttt

SEQ ID NO: 118372 - DNA, 25 bp, Homo sapien
agtacttttgtgcatgatctgtccc

SEQ ID NO: 118373 - DNA, 25 bp, Homo sapien
tacttttgtgcatgatctgtccctc

SEQ ID NO: 118374 - DNA, 25 bp, Homo sapien
acccctgcagtcctctgaagagagg

SEQ ID NO: 118375 - DNA, 25 bp, Homo sapien
tgaagagaggccaacagccttcccc

SEQ ID NO: 118376 - DNA, 25 bp, Homo sapien
cttcccctgccttggattctgaagt

SEQ ID NO: 118377 - DNA, 25 bp, Homo sapien
gattctgaagtgttcctgtttgtct

SEQ ID NO: 118378 - DNA, 25 bp, Homo sapien
aagtgttcctgtttgtcttatcctg

SEQ ID NO: 118379 - DNA, 25 bp, Homo sapien
tttgggtcggcttcacatgttgcgg

SEQ ID NO: 118380 - DNA, 25 bp, Homo sapien
ggtcggcttcacatgttgcggataa

SEQ ID NO: 118381 - DNA, 25 bp, Homo sapien
gtcggcttcacatgttgcggataat

SEQ ID NO: 118382 - DNA, 25 bp, Homo sapien
gcttcacatgttgcggataatgaca

SEQ ID NO: 118383 - DNA, 25 bp, Homo sapien
gttgcggataatgacataacacctt

SEQ ID NO: 118384 - DNA, 25 bp, Homo sapien
acataacaccttatcttgtcagtag

SEQ ID NO: 118385 - DNA, 25 bp, Homo sapien
taacaccttatcttgtcagtagatt

SEQ ID NO: 118386 - DNA, 25 bp, Homo sapien
tgtcagtagattttatcgtgctcct

SEQ ID NO: 118387 - DNA, 25 bp, Homo sapien
agtagattttatcgtgctcctgaaa

SEQ ID NO: 118388 - DNA, 25 bp, Homo sapien
agattttatcgtgctcctgaaatca

SEQ ID NO: 118389 - DNA, 25 bp, Homo sapien
gctcctgaaatcattataggtaaaa

SEQ ID NO: 118390 - DNA, 25 bp, Homo sapien
atgggacctaccagggctggataac

SEQ ID NO: 118391 - DNA, 25 bp, Homo sapien
tgggacctaccagggctggataacc

SEQ ID NO: 118392 - DNA, 25 bp, Homo sapien
acctaccagggctggataaccttgg

SEQ ID NO: 118393 - DNA, 25 bp, Homo sapien
cctaccagggctggataaccttggc

SEQ ID NO: 118394 - DNA, 25 bp, Homo sapien
ctaccagggctggataaccttggct

SEQ ID NO: 118395 - DNA, 25 bp, Homo sapien
taccagggctggataaccttggctg

SEQ ID NO: 118396 - DNA, 25 bp, Homo sapien
accagggctggataaccttggctgt

SEQ ID NO: 118397 - DNA, 25 bp, Homo sapien
ccagggctggataaccttggctgta

SEQ ID NO: 118398 - DNA, 25 bp, Homo sapien
cagggctggataaccttggctgtac

SEQ ID NO: 118399 - DNA, 25 bp, Homo sapien
agggctggataaccttggctgtacc

SEQ ID NO: 118400 - DNA, 25 bp, Homo sapien
gggctggataaccttggctgtaccc

SEQ ID NO: 118401 - DNA, 25 bp, Homo sapien
ccctggagattctgagattgaccag

SEQ ID NO: 118402 - DNA, 25 bp, Homo sapien
agctcttccggatctttcggactct

SEQ ID NO: 118403 - DNA, 25 bp, Homo sapien
gtggtgtggccaggagttacttcta

SEQ ID NO: 118404 - DNA, 25 bp, Homo sapien
ggagttacttctatgcctgattaca

SEQ ID NO: 118405 - DNA, 25 bp, Homo sapien
tctatgcctgattacaagccaagtt

SEQ ID NO: 118406 - DNA, 25 bp, Homo sapien
attacaagccaagtttccccaagtg

SEQ ID NO: 118407 - DNA, 25 bp, Homo sapien
aaagttgtacctcccctggatgaag

SEQ ID NO: 118408 - DNA, 25 bp, Homo sapien
gtacctcccctggatgaagatggac

SEQ ID NO: 118409 - DNA, 25 bp, Homo sapien
gatggacggagcttgttatcgcaaa

SEQ ID NO: 118410 - DNA, 25 bp, Homo sapien
gttatcgcaaatgctgcactacgac

SEQ ID NO: 118411 - DNA, 25 bp, Homo sapien
aggatgtgaccaagccagtacccca

SEQ ID NO: 118412 - DNA, 25 bp, Homo sapien
gcagctatttgctgagggacagcga

SEQ ID NO: 118413 - DNA, 25 bp, Homo sapien
tgagggacagcgagagcgtgccagg

SEQ ID NO: 118414 - DNA, 25 bp, Homo sapien
ttcagaagccagatcaaggcattgt

SEQ ID NO: 118415 - DNA, 25 bp, Homo sapien
aaggcattgtaatacctctgcagta

SEQ ID NO: 118416 - DNA, 25 bp, Homo sapien
gtaatacctctgcagtatccagttg

SEQ ID NO: 118417 - DNA, 25 bp, Homo sapien
atacctctgcagtatccagttgaga

SEQ ID NO: 118418 - DNA, 25 bp, Homo sapien
tgcagtatccagttgagaagaagtc

SEQ ID NO: 118419 - DNA, 25 bp, Homo sapien
gaagaagtcctcagctagaagtaca

SEQ ID NO: 118420 - DNA, 25 bp, Homo sapien
aagtcctcagctagaagtacacaag

SEQ ID NO: 118421 - DNA, 25 bp, Homo sapien
gagaagatcctgatgtctgcctgaa

SEQ ID NO: 118422 - DNA, 25 bp, Homo sapien
atgtctgcctgaaagccccatgaag

SEQ ID NO: 118423 - DNA, 25 bp, Homo sapien
caagtacttcattcgagatgagttt

SEQ ID NO: 118424 - DNA, 25 bp, Homo sapien
gtacttcattcgagatgagtttctg

SEQ ID NO: 118425 - DNA, 25 bp, Homo sapien
cattcgagatgagtttctgaggatc

SEQ ID NO: 118426 - DNA, 25 bp, Homo sapien
taccctcatttcacctgcgctgtgg

SEQ ID NO: 118427 - DNA, 25 bp, Homo sapien
atttcacctgcgctgtggacactga

SEQ ID NO: 118428 - DNA, 25 bp, Homo sapien
tttcacctgcgctgtggacactgag

SEQ ID NO: 118429 - DNA, 25 bp, Homo sapien
atcattcagcgcatgcaccttcgtc

SEQ ID NO: 118430 - DNA, 25 bp, Homo sapien
ttcagcgcatgcaccttcgtcagta

SEQ ID NO: 118431 - DNA, 25 bp, Homo sapien
agcgcatgcaccttcgtcagtacga

SEQ ID NO: 118432 - DNA, 25 bp, Homo sapien
atgcaccttcgtcagtacgagctgc

SEQ ID NO: 118433 - DNA, 25 bp, Homo sapien
ccttcgtcagtacgagctgctctaa

SEQ ID NO: 118434 - DNA, 25 bp, Homo sapien
agggtctgctggagacgcctgaaag

SEQ ID NO: 118435 - DNA, 25 bp, Homo sapien
gagacgcctgaaagacagttccatc

SEQ ID NO: 118436 - DNA, 25 bp, Homo sapien
agacgcctgaaagacagttccatct

SEQ ID NO: 118437 - DNA, 25 bp, Homo sapien
tcccgggacattgattggtcctgtc

SEQ ID NO: 118438 - DNA, 25 bp, Homo sapien
cccgggacattgattggtcctgtct

SEQ ID NO: 118439 - DNA, 25 bp, Homo sapien
cctgtcttgggcaggtctagtgagc

SEQ ID NO: 118440 - DNA, 25 bp, Homo sapien
ctgtcttgggcaggtctagtgagct

SEQ ID NO: 118441 - DNA, 25 bp, Homo sapien
tgtcttgggcaggtctagtgagctg

SEQ ID NO: 118442 - DNA, 25 bp, Homo sapien
gtcttgggcaggtctagtgagctgt

SEQ ID NO: 118443 - DNA, 25 bp, Homo sapien
accatggccaattcagtttcacttt

SEQ ID NO: 118444 - DNA, 25 bp, Homo sapien
gggcccaattacttgaagtatccca

SEQ ID NO: 118445 - DNA, 25 bp, Homo sapien
aaatgtaaactgctcgccttattcc

SEQ ID NO: 118446 - DNA, 25 bp, Homo sapien
aaactttttgttcatgtggcaggga

SEQ ID NO: 118447 - DNA, 25 bp, Homo sapien
gtggcagggagcagtacacaactat

SEQ ID NO: 118448 - DNA, 25 bp, Homo sapien
atcgaaaagaacatgggccgcgggt

SEQ ID NO: 118449 - DNA, 25 bp, Homo sapien
tgggccgcgggtaaactagctttgc

SEQ ID NO: 118450 - DNA, 25 bp, Homo sapien
aaactagctttgctctttagatgca

SEQ ID NO: 118451 - DNA, 25 bp, Homo sapien
ctttagatgcaagtggctgaggcca

SEQ ID NO: 118452 - DNA, 25 bp, Homo sapien
ggctgaggccaataggtgcctagta

SEQ ID NO: 118453 - DNA, 25 bp, Homo sapien
ggtgcctagtaaatgttaactgttc

SEQ ID NO: 118454 - DNA, 25 bp, Homo sapien
aatttggctctgagtcgaggcaacc

SEQ ID NO: 118455 - DNA, 25 bp, Homo sapien
gagtcgaggcaacctgcacacaaga

SEQ ID NO: 118456 - DNA, 25 bp, Homo sapien
ggaatgtgcaaggactgagatctgc

SEQ ID NO: 118457 - DNA, 25 bp, Homo sapien
gagatctgcagacttgtgggtaact

SEQ ID NO: 118458 - DNA, 25 bp, Homo sapien
gtgggtaactgatcacagacctcag

SEQ ID NO: 118459 - DNA, 25 bp, Homo sapien
gggtgaccagggtgactcttcaatc

SEQ ID NO: 118460 - DNA, 25 bp, Homo sapien
aatccctatccccatgggctgggta

SEQ ID NO: 118461 - DNA, 25 bp, Homo sapien
ggctgggtacaggatatcctcctac

SEQ ID NO: 118462 - DNA, 25 bp, Homo sapien
tcctaccccatgactgtcttaggga

SEQ ID NO: 118463 - DNA, 25 bp, Homo sapien
ggttcttgactttgtattccttcca

SEQ ID NO: 118464 - DNA, 25 bp, Homo sapien
gactttgtattccttccaatacagc

SEQ ID NO: 118465 - DNA, 25 bp, Homo sapien
aagattcctttcagcaaagagctcc

SEQ ID NO: 118466 - DNA, 25 bp, Homo sapien
aaagagctcctcttataccttaaag

SEQ ID NO: 118467 - DNA, 25 bp, Homo sapien
aagatatgattcagttggtcaactt

SEQ ID NO: 118468 - DNA, 25 bp, Homo sapien
gaacttttcatgtatgatcttgtta

SEQ ID NO: 118469 - DNA, 25 bp, Homo sapien
attaatcacacctgtatgatgctac

SEQ ID NO: 118470 - DNA, 25 bp, Homo sapien
gtatgatgctacaggaaactcctag

SEQ ID NO: 118471 - DNA, 25 bp, Homo sapien
gaaactcctagatacaatgtgtgtg

SEQ ID NO: 118472 - DNA, 25 bp, Homo sapien
tgggaagagtatgggaagctcccct

SEQ ID NO: 118473 - DNA, 25 bp, Homo sapien
caggcctctgtctacattcagtgtc

SEQ ID NO: 118474 - DNA, 25 bp, Homo sapien
cattcagtgtcctaatggattttca

SEQ ID NO: 118475 - DNA, 25 bp, Homo sapien
taatggattttcaaccttttggtca

SEQ ID NO: 118476 - DNA, 25 bp, Homo sapien
tcagttcttaacttttcagggtcta

SEQ ID NO: 118477 - DNA, 25 bp, Homo sapien
taacttttcagggtctacctaactg

SEQ ID NO: 118478 - DNA, 25 bp, Homo sapien
gggtctacctaactgagcctagata

SEQ ID NO: 118479 - DNA, 25 bp, Homo sapien
ctgagcctagatatggaccatttat

SEQ ID NO: 118480 - DNA, 25 bp, Homo sapien
ggaccatttatggatgacaacaatt

SEQ ID NO: 118481 - DNA, 25 bp, Homo sapien
agaaattttctgtcagtgccttatc

SEQ ID NO: 118482 - DNA, 25 bp, Homo sapien
ttctgtcagtgccttatcttatgaa

SEQ ID NO: 118483 - DNA, 25 bp, Homo sapien
cagtgccttatcttatgaagaaaca

SEQ ID NO: 118484 - DNA, 25 bp, Homo sapien
gaagaaacagaactctctagctaat

SEQ ID NO: 118485 - DNA, 25 bp, Homo sapien
cagaactctctagctaatgtgtggt

SEQ ID NO: 118486 - DNA, 25 bp, Homo sapien
tctagctaatgtgtggtttctcctt

SEQ ID NO: 118487 - DNA, 25 bp, Homo sapien
tgagatctaatgacttcagcattgt

SEQ ID NO: 118488 - DNA, 25 bp, Homo sapien
gcttaccaagagattttgaactatc

SEQ ID NO: 118489 - DNA, 25 bp, Homo sapien
gaactatccaattatgactgctatg

SEQ ID NO: 118490 - DNA, 25 bp, Homo sapien
atgactgctatggaaaacccattga

SEQ ID NO: 118491 - DNA, 25 bp, Homo sapien
aacggacttgggaaatctcaggcta

SEQ ID NO: 118492 - DNA, 25 bp, Homo sapien
ccctgcgaaacctgttattccaaca

SEQ ID NO: 118493 - DNA, 25 bp, Homo sapien
gttattccaacagcagcaaagcgaa

SEQ ID NO: 118494 - DNA, 25 bp, Homo sapien
gcaaagcgaattgatctttatgcaa

SEQ ID NO: 118495 - DNA, 25 bp, Homo sapien
ttatgcaagagcattgtttcctttc

SEQ ID NO: 118496 - DNA, 25 bp, Homo sapien
gcttcttgttcttcaatgttatata

SEQ ID NO: 118497 - DNA, 25 bp, Homo sapien
gataaatcttttccatttgtacaaa

SEQ ID NO: 118498 - DNA, 25 bp, Homo sapien
gacatacttctagttgtattctcca

SEQ ID NO: 118499 - DNA, 25 bp, Homo sapien
ctccatactattagactgtgtagtg

SEQ ID NO: 118500 - DNA, 25 bp, Homo sapien
ctgtgtagtgatgtgacttccaagt

SEQ ID NO: 118501 - DNA, 25 bp, Homo sapien
agtagaatttaatctccccattgag

SEQ ID NO: 118502 - DNA, 25 bp, Homo sapien
taatctccccattgagtgtgtcatg

SEQ ID NO: 118503 - DNA, 25 bp, Homo sapien
gtcatggtacaaatcactattcgtt

SEQ ID NO: 118504 - DNA, 25 bp, Homo sapien
caaatcactattcgtttttggtgtt

SEQ ID NO: 118505 - DNA, 25 bp, Homo sapien
gttttttagggatgtgcaatgtgca

SEQ ID NO: 118506 - DNA, 25 bp, Homo sapien
gaaggttctgtgtgcccatttgaaa

SEQ ID NO: 118507 - DNA, 25 bp, Homo sapien
ttctgtgtgcccatttgaaaggagt

SEQ ID NO: 118508 - DNA, 25 bp, Homo sapien
gaggaatacagcagtttgtttttca

SEQ ID NO: 118509 - DNA, 25 bp, Homo sapien
gaagacactcaatttagaacaaact

SEQ ID NO: 118510 - DNA, 25 bp, Homo sapien
actaagccaggtatgcaaatatcgc

SEQ ID NO: 118511 - DNA, 25 bp, Homo sapien
ccaggtatgcaaatatcgctgaata

SEQ ID NO: 118512 - DNA, 25 bp, Homo sapien
atatcttctatttttaggcttctat

SEQ ID NO: 118513 - DNA, 25 bp, Homo sapien
ccactcttcacaggctattttactt

SEQ ID NO: 118514 - DNA, 25 bp, Homo sapien
ttcacaggctattttactttaaagg

SEQ ID NO: 118515 - DNA, 25 bp, Homo sapien
tttattttgctgcacacaatctagc

SEQ ID NO: 118516 - DNA, 25 bp, Homo sapien
gcacacaatctagcaggaatctttt

SEQ ID NO: 118517 - DNA, 25 bp, Homo sapien
agagctgtgtcatccttatgtaggc

SEQ ID NO: 118518 - DNA, 25 bp, Homo sapien
gtgtcatccttatgtaggcaagaga

SEQ ID NO: 118519 - DNA, 25 bp, Homo sapien
taggcaagagatgtttgcttttgtt

SEQ ID NO: 118520 - DNA, 25 bp, Homo sapien
gaaatgacaggctacgtggccacta

SEQ ID NO: 118521 - DNA, 25 bp, Homo sapien
atgacaggctacgtggccactaggt

SEQ ID NO: 118522 - DNA, 25 bp, Homo sapien
ggctacgtggccactaggtggtaca

SEQ ID NO: 118523 - DNA, 25 bp, Homo sapien
tggccactaggtggtacagggctcc

SEQ ID NO: 118524 - DNA, 25 bp, Homo sapien
gattctggattttggactggctcgg

SEQ ID NO: 118525 - DNA, 25 bp, Homo sapien
tctggattttggactggctcggcac

SEQ ID NO: 118526 - DNA, 25 bp, Homo sapien
tggattttggactggctcggcacac

SEQ ID NO: 118527 - DNA, 25 bp, Homo sapien
ttttggactggctcggcacacagat

SEQ ID NO: 118528 - DNA, 25 bp, Homo sapien
gactggctcggcacacagatgatga

SEQ ID NO: 118529 - DNA, 25 bp, Homo sapien
tggctcggcacacagatgatgaaat

SEQ ID NO: 118530 - DNA, 25 bp, Homo sapien
atgatgaaatgacaggctacgtggc

SEQ ID NO: 118531 - DNA, 25 bp, Homo sapien
tggatacataaaatgcacgcaagcc

SEQ ID NO: 118532 - DNA, 25 bp, Homo sapien
aaatgcacgcaagccattatctctc

SEQ ID NO: 118533 - DNA, 25 bp, Homo sapien
gcaagccattatctctccatgggaa

SEQ ID NO: 118534 - DNA, 25 bp, Homo sapien
ctctccatgggaagctaagttataa

SEQ ID NO: 118535 - DNA, 25 bp, Homo sapien
taaaaataggtgcttggtgtacaaa

SEQ ID NO: 118536 - DNA, 25 bp, Homo sapien
aggctttgcacatttctatatgagt

SEQ ID NO: 118537 - DNA, 25 bp, Homo sapien
ctatatgagtgggtttactggtaaa

SEQ ID NO: 118538 - DNA, 25 bp, Homo sapien
caactaattttgtactctcagaatg

SEQ ID NO: 118539 - DNA, 25 bp, Homo sapien
gtactctcagaatgtttgtcatatg

SEQ ID NO: 118540 - DNA, 25 bp, Homo sapien
gtttgtcatatgcttcttgcaatgc

SEQ ID NO: 118541 - DNA, 25 bp, Homo sapien
gcatattttttaatctcaaacgttt

SEQ ID NO: 118542 - DNA, 25 bp, Homo sapien
aggatcatccctatccttggtatac

SEQ ID NO: 118543 - DNA, 25 bp, Homo sapien
gatcatccctatccttggtatacca

SEQ ID NO: 118544 - DNA, 25 bp, Homo sapien
atcatccctatccttggtataccaa

SEQ ID NO: 118545 - DNA, 25 bp, Homo sapien
tcatccctatccttggtataccaaa

SEQ ID NO: 118546 - DNA, 25 bp, Homo sapien
catccctatccttggtataccaaac

SEQ ID NO: 118547 - DNA, 25 bp, Homo sapien
cttggtataccaaactacgcacaga

SEQ ID NO: 118548 - DNA, 25 bp, Homo sapien
gcggacatatctacgagcacagcct

SEQ ID NO: 118549 - DNA, 25 bp, Homo sapien
cggacatatctacgagcacagccta

SEQ ID NO: 118550 - DNA, 25 bp, Homo sapien
attactgtgcgggtgatactagtat

SEQ ID NO: 118551 - DNA, 25 bp, Homo sapien
actgtgcgggtgatactagtattta

SEQ ID NO: 118552 - DNA, 25 bp, Homo sapien
tactagtatttatggtgactactgg

SEQ ID NO: 118553 - DNA, 25 bp, Homo sapien
cgtcattcagaagaaggcgtccaag

SEQ ID NO: 118554 - DNA, 25 bp, Homo sapien
aggtccctcgggagatcctggagct

SEQ ID NO: 118555 - DNA, 25 bp, Homo sapien
gagctggagcatgagtgtctgacaa

SEQ ID NO: 118556 - DNA, 25 bp, Homo sapien
agaagcatcatgtccaatgtccaga

SEQ ID NO: 118557 - DNA, 25 bp, Homo sapien
tgtccaatgtccagatggccagaat

SEQ ID NO: 118558 - DNA, 25 bp, Homo sapien
gtgatagttcagaccaatgccttcc

SEQ ID NO: 118559 - DNA, 25 bp, Homo sapien
aatgccttccactgctcctttatga

SEQ ID NO: 118560 - DNA, 25 bp, Homo sapien
tcctttatgactgcacttctagcca

SEQ ID NO: 118561 - DNA, 25 bp, Homo sapien
ttctagccagtagctctgcacaagt

SEQ ID NO: 118562 - DNA, 25 bp, Homo sapien
gctctgcacaagttagctctgtaga

SEQ ID NO: 118563 - DNA, 25 bp, Homo sapien
gggcttaaatcatgggctatctctc

SEQ ID NO: 118564 - DNA, 25 bp, Homo sapien
tcagcagatcgctcatggctgcaag

SEQ ID NO: 118565 - DNA, 25 bp, Homo sapien
aaattcagctagctcttcaacacgt

SEQ ID NO: 118566 - DNA, 25 bp, Homo sapien
acacgtcctacagaagaatcaccga

SEQ ID NO: 118567 - DNA, 25 bp, Homo sapien
caaagttaatatgcaaggtgtctac

SEQ ID NO: 118568 - DNA, 25 bp, Homo sapien
aggtgtctacattaagagccttatg

SEQ ID NO: 118569 - DNA, 25 bp, Homo sapien
gagccttatgtggacgacatacaga

SEQ ID NO: 118570 - DNA, 25 bp, Homo sapien
aatatacccagacattgtgcgactt

SEQ ID NO: 118571 - DNA, 25 bp, Homo sapien
cagacattgtgcgacttcattttcc

SEQ ID NO: 118572 - DNA, 25 bp, Homo sapien
gacttcattttcctccattatacaa

SEQ ID NO: 118573 - DNA, 25 bp, Homo sapien
tacaaggagttgttcacttcagaat

SEQ ID NO: 118574 - DNA, 25 bp, Homo sapien
gttcacttcagaatttgagccagca

SEQ ID NO: 118575 - DNA, 25 bp, Homo sapien
taaaaactttctgcagagcaggctt

SEQ ID NO: 118576 - DNA, 25 bp, Homo sapien
cagagcaggcttctgcctagagttt

SEQ ID NO: 118577 - DNA, 25 bp, Homo sapien
ggcttctgcctagagtttgacctat

SEQ ID NO: 118578 - DNA, 25 bp, Homo sapien
gtttgacctatccagaagttctttc

SEQ ID NO: 118579 - DNA, 25 bp, Homo sapien
tctttcacctgccaatcagctgtta

SEQ ID NO: 118580 - DNA, 25 bp, Homo sapien
aaacataactgatcagctgccggta

SEQ ID NO: 118581 - DNA, 25 bp, Homo sapien
gctgccggtatgttcatcgtgtgaa

SEQ ID NO: 118582 - DNA, 25 bp, Homo sapien
gttcatcgtgtgaaattgcattcca

SEQ ID NO: 118583 - DNA, 25 bp, Homo sapien
ttgcattccaagtgagctgtgctca

SEQ ID NO: 118584 - DNA, 25 bp, Homo sapien
ggacacagagctgcaagctgcgctg

SEQ ID NO: 118585 - DNA, 25 bp, Homo sapien
gtggaggaccgtcacttacactctg

SEQ ID NO: 118586 - DNA, 25 bp, Homo sapien
ttgcaagaaaggatcaaagtgaacg

SEQ ID NO: 118587 - DNA, 25 bp, Homo sapien
gcaagaaaggatcaaagtgaacgga

SEQ ID NO: 118588 - DNA, 25 bp, Homo sapien
aaggatcaaagtgaacggaaaagct

SEQ ID NO: 118589 - DNA, 25 bp, Homo sapien
ggatcaaagtgaacggaaaagctgg

SEQ ID NO: 118590 - DNA, 25 bp, Homo sapien
tcaaagtgaacggaaaagctgggaa

SEQ ID NO: 118591 - DNA, 25 bp, Homo sapien
gtgaacggaaaagctgggaaccttg

SEQ ID NO: 118592 - DNA, 25 bp, Homo sapien
tgaacggaaaagctgggaaccttgg

SEQ ID NO: 118593 - DNA, 25 bp, Homo sapien
ggaaaagctgggaaccttggtggag

SEQ ID NO: 118594 - DNA, 25 bp, Homo sapien
aagagcaagatcaccgtgacatccg

SEQ ID NO: 118595 - DNA, 25 bp, Homo sapien
agagcaagatcaccgtgacatccga

SEQ ID NO: 118596 - DNA, 25 bp, Homo sapien
agcaagatcaccgtgacatccgagg

SEQ ID NO: 118597 - DNA, 25 bp, Homo sapien
gaatgcattaagtgtggttacccta

SEQ ID NO: 118598 - DNA, 25 bp, Homo sapien
aatgtctgccatttgctgcttaaca

SEQ ID NO: 118599 - DNA, 25 bp, Homo sapien
gcttaacaggctttgtgtcaggttt

SEQ ID NO: 118600 - DNA, 25 bp, Homo sapien
tttcagtgttggcaagctcttggtt

SEQ ID NO: 118601 - DNA, 25 bp, Homo sapien
caagctcttggttctacgtggatga

SEQ ID NO: 118602 - DNA, 25 bp, Homo sapien
ttggttctacgtggatgatttctac

SEQ ID NO: 118603 - DNA, 25 bp, Homo sapien
tttctacgtggatgttctcctgagt

SEQ ID NO: 118604 - DNA, 25 bp, Homo sapien
gatgttctcctgagtccttaattct

SEQ ID NO: 118605 - DNA, 25 bp, Homo sapien
cctgagtccttaattctgcctaaat

SEQ ID NO: 118606 - DNA, 25 bp, Homo sapien
atgatcttaacttcacttccattag

SEQ ID NO: 118607 - DNA, 25 bp, Homo sapien
aggataggattgacatacccaaagt

SEQ ID NO: 118608 - DNA, 25 bp, Homo sapien
ctgtagtgtgatgtgtctgaactaa

SEQ ID NO: 118609 - DNA, 25 bp, Homo sapien
tgtagtgtgatgtgtctgaactaat

SEQ ID NO: 118610 - DNA, 25 bp, Homo sapien
gtagtgtgatgtgtctgaactaata

SEQ ID NO: 118611 - DNA, 25 bp, Homo sapien
tagtgtgatgtgtctgaactaataa

SEQ ID NO: 118612 - DNA, 25 bp, Homo sapien
agtgtgatgtgtctgaactaataaa

SEQ ID NO: 118613 - DNA, 25 bp, Homo sapien
gtgtgatgtgtctgaactaataaag

SEQ ID NO: 118614 - DNA, 25 bp, Homo sapien
tgtgatgtgtctgaactaataaagt

SEQ ID NO: 118615 - DNA, 25 bp, Homo sapien
tggggaggggcaccaacgcctgccc

SEQ ID NO: 118616 - DNA, 25 bp, Homo sapien
gggaggggcaccaacgcctgcccct

SEQ ID NO: 118617 - DNA, 25 bp, Homo sapien
tgtaccacccctgctgttgcctggg

SEQ ID NO: 118618 - DNA, 25 bp, Homo sapien
gtaccacccctgctgttgcctgggc

SEQ ID NO: 118619 - DNA, 25 bp, Homo sapien
ctcacaaggtaccattatatgcaaa

SEQ ID NO: 118620 - DNA, 25 bp, Homo sapien
aactgagcagttaggatgtaaatat

SEQ ID NO: 118621 - DNA, 25 bp, Homo sapien
gcatctcacggcaccttatttttta

SEQ ID NO: 118622 - DNA, 25 bp, Homo sapien
atcacatgcatgttaggaaactcca

SEQ ID NO: 118623 - DNA, 25 bp, Homo sapien
gcatgttaggaaactccaatttctc

SEQ ID NO: 118624 - DNA, 25 bp, Homo sapien
aatttctcttgcatggagactccta

SEQ ID NO: 118625 - DNA, 25 bp, Homo sapien
ggagactcctatttactgcttttac

SEQ ID NO: 118626 - DNA, 25 bp, Homo sapien
gactcctatttactgcttttactaa

SEQ ID NO: 118627 - DNA, 25 bp, Homo sapien
tactaaaccagtacttcgttatgaa

SEQ ID NO: 118628 - DNA, 25 bp, Homo sapien
cgttatgaaaatgccttccacgcaa

SEQ ID NO: 118629 - DNA, 25 bp, Homo sapien
aaatgccttccacgcaaataagaaa

SEQ ID NO: 118630 - DNA, 25 bp, Homo sapien
gggctgcctcgggaacagtaagacc

SEQ ID NO: 118631 - DNA, 25 bp, Homo sapien
gctgcctcgggaacagtaagaccga

SEQ ID NO: 118632 - DNA, 25 bp, Homo sapien
gggaacagtaagaccgaggaccagc

SEQ ID NO: 118633 - DNA, 25 bp, Homo sapien
aacagtaagaccgaggaccagcgca

SEQ ID NO: 118634 - DNA, 25 bp, Homo sapien
acagtaagaccgaggaccagcgcaa

SEQ ID NO: 118635 - DNA, 25 bp, Homo sapien
agtaagaccgaggaccagcgcaacg

SEQ ID NO: 118636 - DNA, 25 bp, Homo sapien
gtaagaccgaggaccagcgcaacga

SEQ ID NO: 118637 - DNA, 25 bp, Homo sapien
taagaccgaggaccagcgcaacgag

SEQ ID NO: 118638 - DNA, 25 bp, Homo sapien
agaccgaggaccagcgcaacgagga

SEQ ID NO: 118639 - DNA, 25 bp, Homo sapien
accagcgcaacgaggagaaggcgca

SEQ ID NO: 118640 - DNA, 25 bp, Homo sapien
gaggagaaggcgcagcgtgaggcca

SEQ ID NO: 118641 - DNA, 25 bp, Homo sapien
gcattatgggtggtttaccatttct

SEQ ID NO: 118642 - DNA, 25 bp, Homo sapien
tgggtggtttaccatttcttgaggt

SEQ ID NO: 118643 - DNA, 25 bp, Homo sapien
atttcttgaggtaaaagcatcacat

SEQ ID NO: 118644 - DNA, 25 bp, Homo sapien
aagcatcacatgaacttgtaaagga

SEQ ID NO: 118645 - DNA, 25 bp, Homo sapien
aatttttaattatatggcttgagtt

SEQ ID NO: 118646 - DNA, 25 bp, Homo sapien
taggcgtaactaattttaactctat

SEQ ID NO: 118647 - DNA, 25 bp, Homo sapien
tggaataatcctaaacatatgaatt

SEQ ID NO: 118648 - DNA, 25 bp, Homo sapien
gaattatgtttgcatgttcacttcc

SEQ ID NO: 118649 - DNA, 25 bp, Homo sapien
gtttgcatgttcacttccaagagcc

SEQ ID NO: 118650 - DNA, 25 bp, Homo sapien
tgcatgttcacttccaagagccttt

SEQ ID NO: 118651 - DNA, 25 bp, Homo sapien
tgaatcatcaagtctttcacattta

SEQ ID NO: 118652 - DNA, 25 bp, Homo sapien
atcacggcaagcaccggccggagga

SEQ ID NO: 118653 - DNA, 25 bp, Homo sapien
gccaccagggcctctaggcaggact

SEQ ID NO: 118654 - DNA, 25 bp, Homo sapien
gcaggactgccatgcagtgaagccc

SEQ ID NO: 118655 - DNA, 25 bp, Homo sapien
tgagctgccactgagtcgggagccc

SEQ ID NO: 118656 - DNA, 25 bp, Homo sapien
ccactgagtcgggagcccagaggaa

SEQ ID NO: 118657 - DNA, 25 bp, Homo sapien
gttttcaggaaagggcctagcttct

SEQ ID NO: 118658 - DNA, 25 bp, Homo sapien
acagagttcactgcctgtgagactt

SEQ ID NO: 118659 - DNA, 25 bp, Homo sapien
actgcctgtgagacttagcaccaag

SEQ ID NO: 118660 - DNA, 25 bp, Homo sapien
ttagcaccaagtgctgaggctggaa

SEQ ID NO: 118661 - DNA, 25 bp, Homo sapien
gaagaaaaacgcacaccagacgggc

SEQ ID NO: 118662 - DNA, 25 bp, Homo sapien
aaaacgcacaccagacgggcaacaa

SEQ ID NO: 118663 - DNA, 25 bp, Homo sapien
tctcacacctccaggttttttaagt

SEQ ID NO: 118664 - DNA, 25 bp, Homo sapien
agggagcgccccacctgctgaggtc

SEQ ID NO: 118665 - DNA, 25 bp, Homo sapien
acctgctgaggtcggtccttttagc

SEQ ID NO: 118666 - DNA, 25 bp, Homo sapien
tgaggtcggtccttttagccctgcc

SEQ ID NO: 118667 - DNA, 25 bp, Homo sapien
catccatcagagaatgcacctttgt

SEQ ID NO: 118668 - DNA, 25 bp, Homo sapien
aatgcacctttgtgtggcaggcagg

SEQ ID NO: 118669 - DNA, 25 bp, Homo sapien
caggcagggcatgggttttagtcct

SEQ ID NO: 118670 - DNA, 25 bp, Homo sapien
agggcatgggttttagtcctggcca

SEQ ID NO: 118671 - DNA, 25 bp, Homo sapien
gggttttagtcctggccaatgacca

SEQ ID NO: 118672 - DNA, 25 bp, Homo sapien
ctggccgagttgtagccccctggag

SEQ ID NO: 118673 - DNA, 25 bp, Homo sapien
cctggagcccaggttccatttttat

SEQ ID NO: 118674 - DNA, 25 bp, Homo sapien
accacaacgagaacatccctatgag

SEQ ID NO: 118675 - DNA, 25 bp, Homo sapien
atccatagccgggtggatgtcatca

SEQ ID NO: 118676 - DNA, 25 bp, Homo sapien
gatgtcatcagacacgtggtgaaga

SEQ ID NO: 118677 - DNA, 25 bp, Homo sapien
gaagaatggtctactctgggatgag

SEQ ID NO: 118678 - DNA, 25 bp, Homo sapien
ataggattccaaacacggctccagc

SEQ ID NO: 118679 - DNA, 25 bp, Homo sapien
cagcgggatcctgacatataccatc

SEQ ID NO: 118680 - DNA, 25 bp, Homo sapien
ataccatcacctgttttggaatcat

SEQ ID NO: 118681 - DNA, 25 bp, Homo sapien
tcacaccacccaactggaagtcatt

SEQ ID NO: 118682 - DNA, 25 bp, Homo sapien
aactggaagtcattcctgatgtgct

SEQ ID NO: 118683 - DNA, 25 bp, Homo sapien
gcagaatgggcctgcgattttgcaa

SEQ ID NO: 118684 - DNA, 25 bp, Homo sapien
gaacccaataggaacaaattctctg

SEQ ID NO: 118685 - DNA, 25 bp, Homo sapien
gttctaaccctttgctgtacacaag

SEQ ID NO: 118686 - DNA, 25 bp, Homo sapien
gaaatgcatctgttacataaatgag

SEQ ID NO: 118687 - DNA, 25 bp, Homo sapien
tatgctgatggagcatgctttttaa

SEQ ID NO: 118688 - DNA, 25 bp, Homo sapien
aatcctttaaaaacactcaccatat

SEQ ID NO: 118689 - DNA, 25 bp, Homo sapien
cactcaccatataaacttgcatttg

SEQ ID NO: 118690 - DNA, 25 bp, Homo sapien
cttttgttaatgtgtagagttctcc

SEQ ID NO: 118691 - DNA, 25 bp, Homo sapien
gtagagttctcctttctcgaaattg

SEQ ID NO: 118692 - DNA, 25 bp, Homo sapien
ctttctcgaaattgccagtgtgtac

SEQ ID NO: 118693 - DNA, 25 bp, Homo sapien
ccagtgtgtacttggcttaactcaa

SEQ ID NO: 118694 - DNA, 25 bp, Homo sapien
tggcttaactcaagaacagtttctt

SEQ ID NO: 118695 - DNA, 25 bp, Homo sapien
ttcttctggattccttatttgattt

SEQ ID NO: 118696 - DNA, 25 bp, Homo sapien
gggagggagcgccccacctgctgag

SEQ ID NO: 118697 - DNA, 25 bp, Homo sapien
tgtgtggcaggcagggcatgggttt

SEQ ID NO: 118698 - DNA, 25 bp, Homo sapien
gtgtggcaggcagggcatgggtttt

SEQ ID NO: 118699 - DNA, 25 bp, Homo sapien
tgtggcaggcagggcatgggtttta

SEQ ID NO: 118700 - DNA, 25 bp, Homo sapien
gtggcaggcagggcatgggttttag

SEQ ID NO: 118701 - DNA, 25 bp, Homo sapien
tggcaggcagggcatgggttttagt

SEQ ID NO: 118702 - DNA, 25 bp, Homo sapien
ggcaggcagggcatgggttttagtc

SEQ ID NO: 118703 - DNA, 25 bp, Homo sapien
gcaggcagggcatgggttttagtcc

SEQ ID NO: 118704 - DNA, 25 bp, Homo sapien
caggcagggcatgggttttagtcct

SEQ ID NO: 118705 - DNA, 25 bp, Homo sapien
cagggcatgggttttagtcctggcc

SEQ ID NO: 118706 - DNA, 25 bp, Homo sapien
agggcatgggttttagtcctggcca

SEQ ID NO: 118707 - DNA, 25 bp, Homo sapien
ggaaaatgccccttccaatcagctg

SEQ ID NO: 118708 - DNA, 25 bp, Homo sapien
tgccttcacaagcagggatcagagc

SEQ ID NO: 118709 - DNA, 25 bp, Homo sapien
agcagggatcagagcaactccccgg

SEQ ID NO: 118710 - DNA, 25 bp, Homo sapien
aggcagatctcacccagcactagga

SEQ ID NO: 118711 - DNA, 25 bp, Homo sapien
cagcactaggacaccaggaggccag

SEQ ID NO: 118712 - DNA, 25 bp, Homo sapien
agggaaagcatctctggctcaccat

SEQ ID NO: 118713 - DNA, 25 bp, Homo sapien
ggctcaccatgtaacatctggcttg

SEQ ID NO: 118714 - DNA, 25 bp, Homo sapien
tggagcaagtgggtgttctgcacac

SEQ ID NO: 118715 - DNA, 25 bp, Homo sapien
agctgcacctcactggatctagtgt

SEQ ID NO: 118716 - DNA, 25 bp, Homo sapien
ggatctagtgttgctgcgagtgacc

SEQ ID NO: 118717 - DNA, 25 bp, Homo sapien
ttcagagcccctctagcagagtggg

SEQ ID NO: 118718 - DNA, 25 bp, Homo sapien
aggtgctccgtgtgctccacaagga

SEQ ID NO: 118719 - DNA, 25 bp, Homo sapien
aaggagccaggccacctctatgttt

SEQ ID NO: 118720 - DNA, 25 bp, Homo sapien
ggacgtggcccacaccctgaagcag

SEQ ID NO: 118721 - DNA, 25 bp, Homo sapien
ggtggctgccaagctgaaattgaat

SEQ ID NO: 118722 - DNA, 25 bp, Homo sapien
caggtcgaggactatttctttcagc

SEQ ID NO: 118723 - DNA, 25 bp, Homo sapien
ctatttctttcagctcaagagccag

SEQ ID NO: 118724 - DNA, 25 bp, Homo sapien
caagagccagaagcgctatcacgaa

SEQ ID NO: 118725 - DNA, 25 bp, Homo sapien
gaagcgctatcacgaagatatcttt

SEQ ID NO: 118726 - DNA, 25 bp, Homo sapien
gatatctttggtgctgtatttcctt

SEQ ID NO: 118727 - DNA, 25 bp, Homo sapien
gctgtatttccttacgaggcgaaga

SEQ ID NO: 118728 - DNA, 25 bp, Homo sapien
cagcctggagatgtcagcgctctga

SEQ ID NO: 118729 - DNA, 25 bp, Homo sapien
tgcagcaccgacgtgtgtgacagcg

SEQ ID NO: 118730 - DNA, 25 bp, Homo sapien
accgacgtgtgtgacagcgactaca

SEQ ID NO: 118731 - DNA, 25 bp, Homo sapien
tgtgtgacagcgactacagcgccag

SEQ ID NO: 118732 - DNA, 25 bp, Homo sapien
gactacagcgccagccgctggaagg

SEQ ID NO: 118733 - DNA, 25 bp, Homo sapien
ctggaaggccagcaagtactacctg

SEQ ID NO: 118734 - DNA, 25 bp, Homo sapien
gtactacctggatttgaactcggac

SEQ ID NO: 118735 - DNA, 25 bp, Homo sapien
atttgaactcggactcagaccccta

SEQ ID NO: 118736 - DNA, 25 bp, Homo sapien
agccagtacctgtcggcggaggaca

SEQ ID NO: 118737 - DNA, 25 bp, Homo sapien
gccaccgagaggagctacttccatc

SEQ ID NO: 118738 - DNA, 25 bp, Homo sapien
gagaggagctacttccatctcttcc

SEQ ID NO: 118739 - DNA, 25 bp, Homo sapien
tctctgtgcccctgtaaatagtttt

SEQ ID NO: 118740 - DNA, 25 bp, Homo sapien
tgaggggccctgaccactgtgagca

SEQ ID NO: 118741 - DNA, 25 bp, Homo sapien
gacaaagctgcctttgccgctgggc

SEQ ID NO: 118742 - DNA, 25 bp, Homo sapien
tgcctttgccgctgggctttccggg

SEQ ID NO: 118743 - DNA, 25 bp, Homo sapien
acaggcggggaagctccacttcaga

SEQ ID NO: 118744 - DNA, 25 bp, Homo sapien
atggctcccattttgaagggaggtc

SEQ ID NO: 118745 - DNA, 25 bp, Homo sapien
aagggaggtctccatgtggtccgag

SEQ ID NO: 118746 - DNA, 25 bp, Homo sapien
gtgagacggccctcgtcctggtgtt

SEQ ID NO: 118747 - DNA, 25 bp, Homo sapien
tcctggtgttcctgatcatcttgaa

SEQ ID NO: 118748 - DNA, 25 bp, Homo sapien
gatcatcttgaaaggttcttctgga

SEQ ID NO: 118749 - DNA, 25 bp, Homo sapien
gaaaggttcttctggaactcctgtc

SEQ ID NO: 118750 - DNA, 25 bp, Homo sapien
tcttctggaactcctgtccccttag

SEQ ID NO: 118751 - DNA, 25 bp, Homo sapien
gtatcacggttacatttatacatac

SEQ ID NO: 118752 - DNA, 25 bp, Homo sapien
ggttacatttatacataccgagtgt

SEQ ID NO: 118753 - DNA, 25 bp, Homo sapien
tacatttatacataccgagtgtccc

SEQ ID NO: 118754 - DNA, 25 bp, Homo sapien
catttatacataccgagtgtcccag

SEQ ID NO: 118755 - DNA, 25 bp, Homo sapien
tttatacataccgagtgtcccagac

SEQ ID NO: 118756 - DNA, 25 bp, Homo sapien
tatacataccgagtgtcccagacag

SEQ ID NO: 118757 - DNA, 25 bp, Homo sapien
agtgtcccagacagaaacaggttct

SEQ ID NO: 118758 - DNA, 25 bp, Homo sapien
gtgtcccagacagaaacaggttctt

SEQ ID NO: 118759 - DNA, 25 bp, Homo sapien
gtcccagacagaaacaggttcttgg

SEQ ID NO: 118760 - DNA, 25 bp, Homo sapien
gacagaaacaggttcttggagtgct

SEQ ID NO: 118761 - DNA, 25 bp, Homo sapien
agaaacaggttcttggagtgctgag

SEQ ID NO: 118762 - DNA, 25 bp, Homo sapien
gggactacgcaagaacaagaccaac

SEQ ID NO: 118763 - DNA, 25 bp, Homo sapien
aagaacaagaccaacatgaattacg

SEQ ID NO: 118764 - DNA, 25 bp, Homo sapien
tcagccgggccttgcggtactacta

SEQ ID NO: 118765 - DNA, 25 bp, Homo sapien
gggccttgcggtactactatgacaa

SEQ ID NO: 118766 - DNA, 25 bp, Homo sapien
atcatccgcaaggtgagcggccaga

SEQ ID NO: 118767 - DNA, 25 bp, Homo sapien
gtgagcggccagaagttcgtctaca

SEQ ID NO: 118768 - DNA, 25 bp, Homo sapien
tctccttccagtttccatccagtgg

SEQ ID NO: 118769 - DNA, 25 bp, Homo sapien
ttccagtttccatccagtggcagcg

SEQ ID NO: 118770 - DNA, 25 bp, Homo sapien
tgcacatcccttctatcagcgtgga

SEQ ID NO: 118771 - DNA, 25 bp, Homo sapien
tctatcagcgtggatggcctctcga

SEQ ID NO: 118772 - DNA, 25 bp, Homo sapien
tatcagcgtggatggcctctcgacc

SEQ ID NO: 118773 - DNA, 25 bp, Homo sapien
tgcctttaaccctcagcctcagagt

SEQ ID NO: 118774 - DNA, 25 bp, Homo sapien
gagtcagatgcaggaatcatggatg

SEQ ID NO: 118775 - DNA, 25 bp, Homo sapien
agtcagatgcaggaatcatggatgc

SEQ ID NO: 118776 - DNA, 25 bp, Homo sapien
gtcagatgcaggaatcatggatgct

SEQ ID NO: 118777 - DNA, 25 bp, Homo sapien
aggaatcatggatgctgccaatttt

SEQ ID NO: 118778 - DNA, 25 bp, Homo sapien
gtgaacggaaaagctgggaaccttg

SEQ ID NO: 118779 - DNA, 25 bp, Homo sapien
gcaagatcaccgtgacatccgaggt

SEQ ID NO: 118780 - DNA, 25 bp, Homo sapien
tgacatccgaggtgcctttctccaa

SEQ ID NO: 118781 - DNA, 25 bp, Homo sapien
atccgaggtgcctttctccaaaagg

SEQ ID NO: 118782 - DNA, 25 bp, Homo sapien
gaggtgcctttctccaaaaggtatt

SEQ ID NO: 118783 - DNA, 25 bp, Homo sapien
gtgcctttctccaaaaggtatttga

SEQ ID NO: 118784 - DNA, 25 bp, Homo sapien
ggttccatcaatggtgagcaccagc

SEQ ID NO: 118785 - DNA, 25 bp, Homo sapien
atggtgagcaccagcctgaatgcag

SEQ ID NO: 118786 - DNA, 25 bp, Homo sapien
gcctgaatgcagaagcgctccagta

SEQ ID NO: 118787 - DNA, 25 bp, Homo sapien
aatgcagaagcgctccagtatctcc

SEQ ID NO: 118788 - DNA, 25 bp, Homo sapien
aagcgctccagtatctccaagggta

SEQ ID NO: 118789 - DNA, 25 bp, Homo sapien
gtatctccaagggtaccttcaggca

SEQ ID NO: 118790 - DNA, 25 bp, Homo sapien
aagggtaccttcaggcagccagtgt

SEQ ID NO: 118791 - DNA, 25 bp, Homo sapien
gtgtgacactgctttaaactgcatt

SEQ ID NO: 118792 - DNA, 25 bp, Homo sapien
gacactgctttaaactgcatttttc

SEQ ID NO: 118793 - DNA, 25 bp, Homo sapien
atgggctaaacccagatggtttcct

SEQ ID NO: 118794 - DNA, 25 bp, Homo sapien
acccagatggtttcctaggaaatca

SEQ ID NO: 118795 - DNA, 25 bp, Homo sapien
aataataagcgaccctcagggattc

SEQ ID NO: 118796 - DNA, 25 bp, Homo sapien
agtctggcacgtcagccaccctggg

SEQ ID NO: 118797 - DNA, 25 bp, Homo sapien
ggcacgtcagccaccctgggcatca

SEQ ID NO: 118798 - DNA, 25 bp, Homo sapien
cagactggggacgaggccgattatt

SEQ ID NO: 118799 - DNA, 25 bp, Homo sapien
acgaggccgattattactgcggaac

SEQ ID NO: 118800 - DNA, 25 bp, Homo sapien
cgaggccgattattactgcggaaca

SEQ ID NO: 118801 - DNA, 25 bp, Homo sapien
gaggccgattattactgcggaacat

SEQ ID NO: 118802 - DNA, 25 bp, Homo sapien
ggccgattattactgcggaacatgg

SEQ ID NO: 118803 - DNA, 25 bp, Homo sapien
ttattactgcggaacatgggatagc

SEQ ID NO: 118804 - DNA, 25 bp, Homo sapien
tattactgcggaacatgggatagca

SEQ ID NO: 118805 - DNA, 25 bp, Homo sapien
actgcggaacatgggatagcagcct

SEQ ID NO: 118806 - DNA, 25 bp, Homo sapien
acctgccaatagctttgtcaatcac

SEQ ID NO: 118807 - DNA, 25 bp, Homo sapien
tttgtcaatcacagccccataggaa

SEQ ID NO: 118808 - DNA, 25 bp, Homo sapien
acagccccataggaacgtctggaat

SEQ ID NO: 118809 - DNA, 25 bp, Homo sapien
gaacgtctggaattgcttgggagtt

SEQ ID NO: 118810 - DNA, 25 bp, Homo sapien
gagagtgccaaagcggagatctgtt

SEQ ID NO: 118811 - DNA, 25 bp, Homo sapien
caaagcggagatctgttcacctggg

SEQ ID NO: 118812 - DNA, 25 bp, Homo sapien
gatcaagatcaaagattctccccat

SEQ ID NO: 118813 - DNA, 25 bp, Homo sapien
ttctccccatctcacagacaaggaa

SEQ ID NO: 118814 - DNA, 25 bp, Homo sapien
gagaattgctcatggctccagaact

SEQ ID NO: 118815 - DNA, 25 bp, Homo sapien
gctccagaactggtggcaagtttct

SEQ ID NO: 118816 - DNA, 25 bp, Homo sapien
gtttctctggactcttaggtttatt

SEQ ID NO: 118817 - DNA, 25 bp, Homo sapien
acgtttggtttccccgtgtggcatg

SEQ ID NO: 118818 - DNA, 25 bp, Homo sapien
tcctactttaaagcatggaacatgc

SEQ ID NO: 118819 - DNA, 25 bp, Homo sapien
catggaacatgcaggtgatttggga

SEQ ID NO: 118820 - DNA, 25 bp, Homo sapien
atttgggaagtgtagaaagacctga

SEQ ID NO: 118821 - DNA, 25 bp, Homo sapien
aaagacctgagaaaacgagcctgtt

SEQ ID NO: 118822 - DNA, 25 bp, Homo sapien
tttcagaggaacatcgtcacaacga

SEQ ID NO: 118823 - DNA, 25 bp, Homo sapien
gtcacaacgaatacttctggaagct

SEQ ID NO: 118824 - DNA, 25 bp, Homo sapien
tacttctggaagcttaacaaaacta

SEQ ID NO: 118825 - DNA, 25 bp, Homo sapien
taacaaaactaaccctgctgtcctt

SEQ ID NO: 118826 - DNA, 25 bp, Homo sapien
gggtttggaaacttgcatgaaaata

SEQ ID NO: 118827 - DNA, 25 bp, Homo sapien
tattttagccccctcagatgttcct

SEQ ID NO: 118828 - DNA, 25 bp, Homo sapien
gctgctgcagacaaaagatcacatt

SEQ ID NO: 118829 - DNA, 25 bp, Homo sapien
agaccagcatccagtggccatcagg

SEQ ID NO: 118830 - DNA, 25 bp, Homo sapien
tggccatcaggtcttgtggcccaaa

SEQ ID NO: 118831 - DNA, 25 bp, Homo sapien
ttgtggcccaaaggctatgcttgcc

SEQ ID NO: 118832 - DNA, 25 bp, Homo sapien
aaaggctatgcttgcctccggctga

SEQ ID NO: 118833 - DNA, 25 bp, Homo sapien
tgcctccggctgagtgcctgggata

SEQ ID NO: 118834 - DNA, 25 bp, Homo sapien
gagtgcctgggataggccttttcta

SEQ ID NO: 118835 - DNA, 25 bp, Homo sapien
tgggataggccttttctatgtctcc

SEQ ID NO: 118836 - DNA, 25 bp, Homo sapien
ttttctatgtctccccaaggctggg

SEQ ID NO: 118837 - DNA, 25 bp, Homo sapien
acctagccatagtctcaaacctgtg

SEQ ID NO: 118838 - DNA, 25 bp, Homo sapien
ggacagataactgatttccgttctt

SEQ ID NO: 118839 - DNA, 25 bp, Homo sapien
agcagccatactctcagttgggtgc

SEQ ID NO: 118840 - DNA, 25 bp, Homo sapien
gcagccatactctcagttgggtgcg

SEQ ID NO: 118841 - DNA, 25 bp, Homo sapien
cagccatactctcagttgggtgcga

SEQ ID NO: 118842 - DNA, 25 bp, Homo sapien
agccatactctcagttgggtgcgac

SEQ ID NO: 118843 - DNA, 25 bp, Homo sapien
gccatactctcagttgggtgcgaca

SEQ ID NO: 118844 - DNA, 25 bp, Homo sapien
catactctcagttgggtgcgacagg

SEQ ID NO: 118845 - DNA, 25 bp, Homo sapien
gggacgatcttctgactacagtaat

SEQ ID NO: 118846 - DNA, 25 bp, Homo sapien
gactacagtaatccctttgactact

SEQ ID NO: 118847 - DNA, 25 bp, Homo sapien
accttcagcagccatactctcagtt

SEQ ID NO: 118848 - DNA, 25 bp, Homo sapien
ttcagcagccatactctcagttggg

SEQ ID NO: 118849 - DNA, 25 bp, Homo sapien
tcagcagccatactctcagttgggt

SEQ ID NO: 118850 - DNA, 25 bp, Homo sapien
aatgagatcaaaccccctattatac

SEQ ID NO: 118851 - DNA, 25 bp, Homo sapien
atacattatgatcttaagccaggaa

SEQ ID NO: 118852 - DNA, 25 bp, Homo sapien
taagccaggaaacatcctactggta

SEQ ID NO: 118853 - DNA, 25 bp, Homo sapien
atcctactggtagatggaacagcat

SEQ ID NO: 118854 - DNA, 25 bp, Homo sapien
ggaacagcatgtggtgaaatcaaaa

SEQ ID NO: 118855 - DNA, 25 bp, Homo sapien
tggtctgtccaagattatggatgat

SEQ ID NO: 118856 - DNA, 25 bp, Homo sapien
gggcaggcacttactggtatttacc

SEQ ID NO: 118857 - DNA, 25 bp, Homo sapien
ggcacttactggtatttacctcctg

SEQ ID NO: 118858 - DNA, 25 bp, Homo sapien
ctggtatttacctcctgagtgtttt

SEQ ID NO: 118859 - DNA, 25 bp, Homo sapien
cagagaaagaagctcggtctattgt

SEQ ID NO: 118860 - DNA, 25 bp, Homo sapien
agaagctcggtctattgtaatgcag

SEQ ID NO: 118861 - DNA, 25 bp, Homo sapien
ggagaggtgagctaacatttgctaa

SEQ ID NO: 118862 - DNA, 25 bp, Homo sapien
atttgctaagcactgaatttgtctc

SEQ ID NO: 118863 - DNA, 25 bp, Homo sapien
gcactgaatttgtctcaggcaccgt

SEQ ID NO: 118864 - DNA, 25 bp, Homo sapien
gaatttgtctcaggcaccgtgcaag

SEQ ID NO: 118865 - DNA, 25 bp, Homo sapien
ggcaccgtgcaaggctctttacaaa

SEQ ID NO: 118866 - DNA, 25 bp, Homo sapien
gtgcaaggctctttacaaacgtgag

SEQ ID NO: 118867 - DNA, 25 bp, Homo sapien
tttacaaacgtgagctccttcgcct

SEQ ID NO: 118868 - DNA, 25 bp, Homo sapien
tttgctcagagcctacgcttggtcc

SEQ ID NO: 118869 - DNA, 25 bp, Homo sapien
agagcctacgcttggtccagaacat

SEQ ID NO: 118870 - DNA, 25 bp, Homo sapien
tggtccagaacatcaaactccaaac

SEQ ID NO: 118871 - DNA, 25 bp, Homo sapien
accctggggacaaacgacatgaaat

SEQ ID NO: 118872 - DNA, 25 bp, Homo sapien
ctgttgcaatgcttaaatgtgaata

SEQ ID NO: 118873 - DNA, 25 bp, Homo sapien
gtttaagattctatatgctgcacta

SEQ ID NO: 118874 - DNA, 25 bp, Homo sapien
gctgcactaacctttggtatccttt

SEQ ID NO: 118875 - DNA, 25 bp, Homo sapien
agtactgataagttcgtctttcaaa

SEQ ID NO: 118876 - DNA, 25 bp, Homo sapien
gttcgtctttcaaagttaatccttg

SEQ ID NO: 118877 - DNA, 25 bp, Homo sapien
ttaatccttgagttcaggccccagt

SEQ ID NO: 118878 - DNA, 25 bp, Homo sapien
cccagtgccggagacgtcgtaaata

SEQ ID NO: 118879 - DNA, 25 bp, Homo sapien
gattttgcctattgtgattatcgct

SEQ ID NO: 118880 - DNA, 25 bp, Homo sapien
tgattatcgctatcactacatcccc

SEQ ID NO: 118881 - DNA, 25 bp, Homo sapien
tcactacatcccctgactaagggaa

SEQ ID NO: 118882 - DNA, 25 bp, Homo sapien
gaaaccatgatgtctgagtaaaact

SEQ ID NO: 118883 - DNA, 25 bp, Homo sapien
caaacactccatattctcacttgta

SEQ ID NO: 118884 - DNA, 25 bp, Homo sapien
acactccatattctcacttgtaagt

SEQ ID NO: 118885 - DNA, 25 bp, Homo sapien
taactaatggatacttagggtgatg

SEQ ID NO: 118886 - DNA, 25 bp, Homo sapien
taatggatacttagggtgatgaaat

SEQ ID NO: 118887 - DNA, 25 bp, Homo sapien
tggatacttagggtgatgaaataat

SEQ ID NO: 118888 - DNA, 25 bp, Homo sapien
ccccatgacacacctttatgtatgt

SEQ ID NO: 118889 - DNA, 25 bp, Homo sapien
cccatgacacacctttatgtatgta

SEQ ID NO: 118890 - DNA, 25 bp, Homo sapien
ccatgacacacctttatgtatgtaa

SEQ ID NO: 118891 - DNA, 25 bp, Homo sapien
catgacacacctttatgtatgtaac

SEQ ID NO: 118892 - DNA, 25 bp, Homo sapien
aaaccagcacttcctgcgcatgtac

SEQ ID NO: 118893 - DNA, 25 bp, Homo sapien
taaaaataacagattggcccatgcc

SEQ ID NO: 118894 - DNA, 25 bp, Homo sapien
agatcgcggactttggttttaacag

SEQ ID NO: 118895 - DNA, 25 bp, Homo sapien
gatcgcggactttggttttaacagg

SEQ ID NO: 118896 - DNA, 25 bp, Homo sapien
tcgcggactttggttttaacaggat

SEQ ID NO: 118897 - DNA, 25 bp, Homo sapien
gttttaacaggatttctctggctcc

SEQ ID NO: 118898 - DNA, 25 bp, Homo sapien
tttaacaggatttctctggctcctg

SEQ ID NO: 118899 - DNA, 25 bp, Homo sapien
ctctggctcctgtgttgattgaggg

SEQ ID NO: 118900 - DNA, 25 bp, Homo sapien
gggcagtatacagcagggagaactt

SEQ ID NO: 118901 - DNA, 25 bp, Homo sapien
ggcagtatacagcagggagaacttt

SEQ ID NO: 118902 - DNA, 25 bp, Homo sapien
cagtatacagcagggagaactttgg

SEQ ID NO: 118903 - DNA, 25 bp, Homo sapien
gagaactttgggaaactcttgaaat

SEQ ID NO: 118904 - DNA, 25 bp, Homo sapien
ttgggaaactcttgaaattattgaa

SEQ ID NO: 118905 - DNA, 25 bp, Homo sapien
gtctgcatggtacgagacacccctt

SEQ ID NO: 118906 - DNA, 25 bp, Homo sapien
gcatacactgccatggtatgtacat

SEQ ID NO: 118907 - DNA, 25 bp, Homo sapien
ggtatgtacatatgcatccacgtgt

SEQ ID NO: 118908 - DNA, 25 bp, Homo sapien
acatatgcatccacgtgtgtgtatg

SEQ ID NO: 118909 - DNA, 25 bp, Homo sapien
gtgtatgtgtagcatgtagctcatt

SEQ ID NO: 118910 - DNA, 25 bp, Homo sapien
gtagcatgtagctcattctgctcag

SEQ ID NO: 118911 - DNA, 25 bp, Homo sapien
tgtagctcattctgctcagcctctg

SEQ ID NO: 118912 - DNA, 25 bp, Homo sapien
attgctgtcactgtcgtcccagatg

SEQ ID NO: 118913 - DNA, 25 bp, Homo sapien
tgtcgtcccagatgtccttgccatg

SEQ ID NO: 118914 - DNA, 25 bp, Homo sapien
agatgtccttgccatggccacagac

SEQ ID NO: 118915 - DNA, 25 bp, Homo sapien
atggccacagacaatctgccgtctc

SEQ ID NO: 118916 - DNA, 25 bp, Homo sapien
cagatgaaacctggtagtaaaatca

SEQ ID NO: 118917 - DNA, 25 bp, Homo sapien
atatttatgctgtatcaagttcacg

SEQ ID NO: 118918 - DNA, 25 bp, Homo sapien
tatgctgtatcaagttcacgatcat

SEQ ID NO: 118919 - DNA, 25 bp, Homo sapien
gctgtatcaagttcacgatcatctt

SEQ ID NO: 118920 - DNA, 25 bp, Homo sapien
gtatcaagttcacgatcatcttacg

SEQ ID NO: 118921 - DNA, 25 bp, Homo sapien
tcaagttcacgatcatcttacgata

SEQ ID NO: 118922 - DNA, 25 bp, Homo sapien
agttcacgatcatcttacgatatca

SEQ ID NO: 118923 - DNA, 25 bp, Homo sapien
ttcacgatcatcttacgatatcaag

SEQ ID NO: 118924 - DNA, 25 bp, Homo sapien
tgtcaccactacctggacagttgca

SEQ ID NO: 118925 - DNA, 25 bp, Homo sapien
accactacctggacagttgcacatg

SEQ ID NO: 118926 - DNA, 25 bp, Homo sapien
ctacctggacagttgcacatgtttt

SEQ ID NO: 118927 - DNA, 25 bp, Homo sapien
cctctcctggctggctgtagataat

SEQ ID NO: 118928 - DNA, 25 bp, Homo sapien
gctggctgtagataatgtggctcac

SEQ ID NO: 118929 - DNA, 25 bp, Homo sapien
aatgtggctcacaccatcaagcagg

SEQ ID NO: 118930 - DNA, 25 bp, Homo sapien
ggctcacaccatcaagcaggcatgg

SEQ ID NO: 118931 - DNA, 25 bp, Homo sapien
gcaggcatgggaggccaatcagcat

SEQ ID NO: 118932 - DNA, 25 bp, Homo sapien
gggaggccaatcagcatgagttgct

SEQ ID NO: 118933 - DNA, 25 bp, Homo sapien
gcatgagttgctgtatcaaaagaat

SEQ ID NO: 118934 - DNA, 25 bp, Homo sapien
gctgtatcaaaagaattggctggaa

SEQ ID NO: 118935 - DNA, 25 bp, Homo sapien
gaagaagaatgtattgcctggctaa

SEQ ID NO: 118936 - DNA, 25 bp, Homo sapien
ttgcctggctaaagagattcctgga

SEQ ID NO: 118937 - DNA, 25 bp, Homo sapien
ttcctggagtatgggaaagacaccc

SEQ ID NO: 118938 - DNA, 25 bp, Homo sapien
ttctacatactaaatctctctcctt

SEQ ID NO: 118939 - DNA, 25 bp, Homo sapien
ctacatactaaatctctctcctttt

SEQ ID NO: 118940 - DNA, 25 bp, Homo sapien
tttattggtgctactgtttatccgt

SEQ ID NO: 118941 - DNA, 25 bp, Homo sapien
cgtctttgtctctagtgcagttttt

SEQ ID NO: 118942 - DNA, 25 bp, Homo sapien
gtctttgtctctagtgcagtttttc

SEQ ID NO: 118943 - DNA, 25 bp, Homo sapien
tttgtctctagtgcagtttttcgag

SEQ ID NO: 118944 - DNA, 25 bp, Homo sapien
ctagtgcagtttttcgagatattcc

SEQ ID NO: 118945 - DNA, 25 bp, Homo sapien
gtgcagtttttcgagatattccgta

SEQ ID NO: 118946 - DNA, 25 bp, Homo sapien
gtttttcgagatattccgtagtaca

SEQ ID NO: 118947 - DNA, 25 bp, Homo sapien
ttttcgagatattccgtagtacata

SEQ ID NO: 118948 - DNA, 25 bp, Homo sapien
gagatattccgtagtacatatttat

SEQ ID NO: 118949 - DNA, 25 bp, Homo sapien
ggaataattatgtatcctggtacca

SEQ ID NO: 118950 - DNA, 25 bp, Homo sapien
tggtaccaacaactcccaggaacag

SEQ ID NO: 118951 - DNA, 25 bp, Homo sapien
ccccaaactcctcatttatgacaat

SEQ ID NO: 118952 - DNA, 25 bp, Homo sapien
catttatgacaataataagcgaccc

SEQ ID NO: 118953 - DNA, 25 bp, Homo sapien
caataataagcgaccctcagggatt

SEQ ID NO: 118954 - DNA, 25 bp, Homo sapien
tgtgttgacgcagccgccctcaata

SEQ ID NO: 118955 - DNA, 25 bp, Homo sapien
acgaggccgattattactgcggaac

SEQ ID NO: 118956 - DNA, 25 bp, Homo sapien
gaacatgggatagcagcctgagaga

SEQ ID NO: 118957 - DNA, 25 bp, Homo sapien
aggacagaaggtcgccatctcctgc

SEQ ID NO: 118958 - DNA, 25 bp, Homo sapien
gaaggtcgccatctcctgctctgga

SEQ ID NO: 118959 - DNA, 25 bp, Homo sapien
aggtcgccatctcctgctctggaag

SEQ ID NO: 118960 - DNA, 25 bp, Homo sapien
ggtaacagttcaacaatccgtggct

SEQ ID NO: 118961 - DNA, 25 bp, Homo sapien
gttcaacaatccgtggctgctcatt

SEQ ID NO: 118962 - DNA, 25 bp, Homo sapien
aacaatccgtggctgctcattcttg

SEQ ID NO: 118963 - DNA, 25 bp, Homo sapien
tggctgctcattcttgcctacttta

SEQ ID NO: 118964 - DNA, 25 bp, Homo sapien
gctcattcttgcctactttactctc

SEQ ID NO: 118965 - DNA, 25 bp, Homo sapien
gcatgcctgttcaattcttttgttt

SEQ ID NO: 118966 - DNA, 25 bp, Homo sapien
ttgaagctaatttgtactactggat

SEQ ID NO: 118967 - DNA, 25 bp, Homo sapien
gtactactggatatctgactggagc

SEQ ID NO: 118968 - DNA, 25 bp, Homo sapien
actggatatctgactggagccacag

SEQ ID NO: 118969 - DNA, 25 bp, Homo sapien
tatctgactggagccacagatacag

SEQ ID NO: 118970 - DNA, 25 bp, Homo sapien
acagaatctgtattgttcttactga

SEQ ID NO: 118971 - DNA, 25 bp, Homo sapien
acccatttgcccaggcagtgggcag

SEQ ID NO: 118972 - DNA, 25 bp, Homo sapien
ggaatatagccaatcccacggccat

SEQ ID NO: 118973 - DNA, 25 bp, Homo sapien
tgtcggcttccaacatgctgcggca

SEQ ID NO: 118974 - DNA, 25 bp, Homo sapien
tgctgcggcatcttaatcttgagta

SEQ ID NO: 118975 - DNA, 25 bp, Homo sapien
gtatcactccagcatgatcgcagat

SEQ ID NO: 118976 - DNA, 25 bp, Homo sapien
gttcgaacctctgacatgggtggct

SEQ ID NO: 118977 - DNA, 25 bp, Homo sapien
tgacatgggtggctatgctacttgc

SEQ ID NO: 118978 - DNA, 25 bp, Homo sapien
atgctacttgccatgacttcactga

SEQ ID NO: 118979 - DNA, 25 bp, Homo sapien
tgacttcactgaggctgtcattgct

SEQ ID NO: 118980 - DNA, 25 bp, Homo sapien
tccctggtgagagctatagtgcaga

SEQ ID NO: 118981 - DNA, 25 bp, Homo sapien
tacgcagtctttgagacgggtgccc

SEQ ID NO: 118982 - DNA, 25 bp, Homo sapien
gagaaaccttacagggtcttgccta

SEQ ID NO: 118983 - DNA, 25 bp, Homo sapien
cttacagggtcttgcctatttgcat

SEQ ID NO: 118984 - DNA, 25 bp, Homo sapien
attgacagaccatggcgatgtaaaa

SEQ ID NO: 118985 - DNA, 25 bp, Homo sapien
aataacagctaccattgcaaaacga

SEQ ID NO: 118986 - DNA, 25 bp, Homo sapien
gaatactgtggtggcggatcacttc

SEQ ID NO: 118987 - DNA, 25 bp, Homo sapien
gaaaatctttcattggcacccctta

SEQ ID NO: 118988 - DNA, 25 bp, Homo sapien
ggtggcggatcacttcaagatattt

SEQ ID NO: 118989 - DNA, 25 bp, Homo sapien
gatatttaccatgttactggaccat

SEQ ID NO: 118990 - DNA, 25 bp, Homo sapien
gttactggaccattatcagaattgc

SEQ ID NO: 118991 - DNA, 25 bp, Homo sapien
tcagaattgcaaatagcctatgtat

SEQ ID NO: 118992 - DNA, 25 bp, Homo sapien
tagcctatgtatgcagagaaacctt

SEQ ID NO: 118993 - DNA, 25 bp, Homo sapien
gaggtgaaggtttcgaccatgccac

SEQ ID NO: 118994 - DNA, 25 bp, Homo sapien
aaggtttcgaccatgccactgtcaa

SEQ ID NO: 118995 - DNA, 25 bp, Homo sapien
ctcttcccattcattacaacaagga

SEQ ID NO: 118996 - DNA, 25 bp, Homo sapien
ttacaacaaggacagcagcctacaa

SEQ ID NO: 118997 - DNA, 25 bp, Homo sapien
tccacactactgtggcctgacaaca

SEQ ID NO: 118998 - DNA, 25 bp, Homo sapien
actactgtggcctgacaacagaact

SEQ ID NO: 118999 - DNA, 25 bp, Homo sapien
tgtggcctgacaacagaactgagag

SEQ ID NO: 119000 - DNA, 25 bp, Homo sapien
aactgagaggagaggattagactct

SEQ ID NO: 119001 - DNA, 25 bp, Homo sapien
gcttgcatgggcaactggatttttg

SEQ ID NO: 119002 - DNA, 25 bp, Homo sapien
gggcaactggatttttgcatgattc

SEQ ID NO: 119003 - DNA, 25 bp, Homo sapien
gcatgattcctttatgattttgctt

SEQ ID NO: 119004 - DNA, 25 bp, Homo sapien
cctgtgcccgcgtgaggcgagagaa

SEQ ID NO: 119005 - DNA, 25 bp, Homo sapien
gggacttgagtctcgaacagcggtt

SEQ ID NO: 119006 - DNA, 25 bp, Homo sapien
acttgagtctcgaacagcggttgtt

SEQ ID NO: 119007 - DNA, 25 bp, Homo sapien
ttgagtctcgaacagcggttgtttt

SEQ ID NO: 119008 - DNA, 25 bp, Homo sapien
gagtctcgaacagcggttgttttta

SEQ ID NO: 119009 - DNA, 25 bp, Homo sapien
tctcgaacagcggttgtttttactt

SEQ ID NO: 119010 - DNA, 25 bp, Homo sapien
actttatttatcttaggccctcagc

SEQ ID NO: 119011 - DNA, 25 bp, Homo sapien
ctttatttatcttaggccctcagct

SEQ ID NO: 119012 - DNA, 25 bp, Homo sapien
ttatttatcttaggccctcagctcc

SEQ ID NO: 119013 - DNA, 25 bp, Homo sapien
tgacgtcctgagcctccctgtgacg

SEQ ID NO: 119014 - DNA, 25 bp, Homo sapien
tccctgtgacgctctggccttctct

SEQ ID NO: 119015 - DNA, 25 bp, Homo sapien
gagaagccccccaaggtgcagccag

SEQ ID NO: 119016 - DNA, 25 bp, Homo sapien
gtgcagccaggaggcaaacagcaga

SEQ ID NO: 119017 - DNA, 25 bp, Homo sapien
agcagaaaggacaatgcacccttca

SEQ ID NO: 119018 - DNA, 25 bp, Homo sapien
gaagtgtctgctgagaatatcaagg

SEQ ID NO: 119019 - DNA, 25 bp, Homo sapien
aagtgtctgctgagaatatcaaggg

SEQ ID NO: 119020 - DNA, 25 bp, Homo sapien
catgggtcaggtgcaggaagatgtc

SEQ ID NO: 119021 - DNA, 25 bp, Homo sapien
aagatgtctgggtgtctgtagaaga

SEQ ID NO: 119022 - DNA, 25 bp, Homo sapien
ctgggtgtctgtagaagatgcttcc

SEQ ID NO: 119023 - DNA, 25 bp, Homo sapien
tagaagatgcttcctccattaaact

SEQ ID NO: 119024 - DNA, 25 bp, Homo sapien
agaagatgcttcctccattaaactg

SEQ ID NO: 119025 - DNA, 25 bp, Homo sapien
gaagatgcttcctccattaaactgt

SEQ ID NO: 119026 - DNA, 25 bp, Homo sapien
aatatcacctcccttcagatgcact

SEQ ID NO: 119027 - DNA, 25 bp, Homo sapien
agactcctgagccagaatcctccat

SEQ ID NO: 119028 - DNA, 25 bp, Homo sapien
tccatctcagatcttccagagcctc

SEQ ID NO: 119029 - DNA, 25 bp, Homo sapien
agagcctcagcggtaacagccggcc

SEQ ID NO: 119030 - DNA, 25 bp, Homo sapien
agcccttggcccacagggcactgag

SEQ ID NO: 119031 - DNA, 25 bp, Homo sapien
cccaactaccgcctgcatgtggatg

SEQ ID NO: 119032 - DNA, 25 bp, Homo sapien
accgcctgcatgtggatggtgtccc

SEQ ID NO: 119033 - DNA, 25 bp, Homo sapien
ggtgtcccccatggtcgctgagact

SEQ ID NO: 119034 - DNA, 25 bp, Homo sapien
tgagactccccttcgaggattgcac

SEQ ID NO: 119035 - DNA, 25 bp, Homo sapien
gaggattgcacccgcccgtcctaag

SEQ ID NO: 119036 - DNA, 25 bp, Homo sapien
cctaagcctccccacaaggcgaggg

SEQ ID NO: 119037 - DNA, 25 bp, Homo sapien
gaaagggtacaacttgcccatcatt

SEQ ID NO: 119038 - DNA, 25 bp, Homo sapien
tacaacttgcccatcatttctctga

SEQ ID NO: 119039 - DNA, 25 bp, Homo sapien
ttgcccatcatttctctgaaccaga

SEQ ID NO: 119040 - DNA, 25 bp, Homo sapien
ctgaaccagagataacactcattat

SEQ ID NO: 119041 - DNA, 25 bp, Homo sapien
agagataacactcattatttttggg

SEQ ID NO: 119042 - DNA, 25 bp, Homo sapien
cgccgactgataaagaaaagcccat

SEQ ID NO: 119043 - DNA, 25 bp, Homo sapien
tgataaagaaaagcccatctgatgt

SEQ ID NO: 119044 - DNA, 25 bp, Homo sapien
atctgatgtaaaacctctcccctca

SEQ ID NO: 119045 - DNA, 25 bp, Homo sapien
tcacctgacacagacgtgcctttaa

SEQ ID NO: 119046 - DNA, 25 bp, Homo sapien
tgacacagacgtgcctttaagttct

SEQ ID NO: 119047 - DNA, 25 bp, Homo sapien
gaaaatccagagacaagtgatcaat

SEQ ID NO: 119048 - DNA, 25 bp, Homo sapien
atatttttcagactcctcaaacttg

SEQ ID NO: 119049 - DNA, 25 bp, Homo sapien
cagactcctcaaacttgactaaatg

SEQ ID NO: 119050 - DNA, 25 bp, Homo sapien
tgactaaatgcagcgatgctcccag

SEQ ID NO: 119051 - DNA, 25 bp, Homo sapien
gagctgggattccatctcgaccctg

SEQ ID NO: 119052 - DNA, 25 bp, Homo sapien
ctgaggcctgagtccttttggattc

SEQ ID NO: 119053 - DNA, 25 bp, Homo sapien
tttggattcttggtacccacattgc

SEQ ID NO: 119054 - DNA, 25 bp, Homo sapien
ggtgttcctgaagacccagggatac

SEQ ID NO: 119055 - DNA, 25 bp, Homo sapien
agacccagggataccctttgtccag

SEQ ID NO: 119056 - DNA, 25 bp, Homo sapien
ctttgtccagccctgtccttggcag

SEQ ID NO: 119057 - DNA, 25 bp, Homo sapien
ggcagctccctttttggtcctgggt

SEQ ID NO: 119058 - DNA, 25 bp, Homo sapien
acagccgccttgcatgtttattgaa

SEQ ID NO: 119059 - DNA, 25 bp, Homo sapien
gtttcatatataagactgctgcagt

SEQ ID NO: 119060 - DNA, 25 bp, Homo sapien
ataagactgctgcagtcacatcaca

SEQ ID NO: 119061 - DNA, 25 bp, Homo sapien
gtcattcccattccttttcgtttag

SEQ ID NO: 119062 - DNA, 25 bp, Homo sapien
agcggtgcagcgtgtgtgccacctc

SEQ ID NO: 119063 - DNA, 25 bp, Homo sapien
gtgtgtgccacctcattattatcta

SEQ ID NO: 119064 - DNA, 25 bp, Homo sapien
gtgccacctcattattatctagcta

SEQ ID NO: 119065 - DNA, 25 bp, Homo sapien
taagcggaacatgtgcttcatctgt

SEQ ID NO: 119066 - DNA, 25 bp, Homo sapien
ataacttcattgtttggacctgcat

SEQ ID NO: 119067 - DNA, 25 bp, Homo sapien
catatttagctgttttggaacgcag

SEQ ID NO: 119068 - DNA, 25 bp, Homo sapien
gctgttttggaacgcagttgattcc

SEQ ID NO: 119069 - DNA, 25 bp, Homo sapien
cgcagttgattccttgagtttcata

SEQ ID NO: 119070 - DNA, 25 bp, Homo sapien
ggatagtgaggcatcgcaatgtaag

SEQ ID NO: 119071 - DNA, 25 bp, Homo sapien
aggcatcgcaatgtaagactcggga

SEQ ID NO: 119072 - DNA, 25 bp, Homo sapien
catcgcaatgtaagactcgggatta

SEQ ID NO: 119073 - DNA, 25 bp, Homo sapien
gtaagactcgggattagtacacact

SEQ ID NO: 119074 - DNA, 25 bp, Homo sapien
gactcgggattagtacacacttgtt

SEQ ID NO: 119075 - DNA, 25 bp, Homo sapien
ggattagtacacacttgttgatgat

SEQ ID NO: 119076 - DNA, 25 bp, Homo sapien
gaaatgtttacagatccccaagcct

SEQ ID NO: 119077 - DNA, 25 bp, Homo sapien
aaatgtttacagatccccaagcctg

SEQ ID NO: 119078 - DNA, 25 bp, Homo sapien
accttcacttaggaacgtaatcgtg

SEQ ID NO: 119079 - DNA, 25 bp, Homo sapien
taggaacgtaatcgtgtcccctatc

SEQ ID NO: 119080 - DNA, 25 bp, Homo sapien
acgtaatcgtgtcccctatcctact

SEQ ID NO: 119081 - DNA, 25 bp, Homo sapien
gggaggtgagctactggaagagaca

SEQ ID NO: 119082 - DNA, 25 bp, Homo sapien
ctggaagagacagggcaagatgcct

SEQ ID NO: 119083 - DNA, 25 bp, Homo sapien
gctaggaggtgagggccttcattaa

SEQ ID NO: 119084 - DNA, 25 bp, Homo sapien
aggtgagggccttcattaattgaga

SEQ ID NO: 119085 - DNA, 25 bp, Homo sapien
atcacgattgaagaagatcccagct

SEQ ID NO: 119086 - DNA, 25 bp, Homo sapien
gatcccagctctttctggctgattt

SEQ ID NO: 119087 - DNA, 25 bp, Homo sapien
tcccagctctttctggctgatttca

SEQ ID NO: 119088 - DNA, 25 bp, Homo sapien
ggctgatttcagtaaggcttctgac

SEQ ID NO: 119089 - DNA, 25 bp, Homo sapien
cagtaaggcttctgacttaagagtc

SEQ ID NO: 119090 - DNA, 25 bp, Homo sapien
ggcttctgacttaagagtctaccta

SEQ ID NO: 119091 - DNA, 25 bp, Homo sapien
taagagtctacctatacatcccttc

SEQ ID NO: 119092 - DNA, 25 bp, Homo sapien
aagatgatcagacaaggcaaagcga

SEQ ID NO: 119093 - DNA, 25 bp, Homo sapien
aggcaaagcgaaattggtcattctc

SEQ ID NO: 119094 - DNA, 25 bp, Homo sapien
attggtcattctcgctaacaactgc

SEQ ID NO: 119095 - DNA, 25 bp, Homo sapien
ctaacaactgcccagctttgaggaa

SEQ ID NO: 119096 - DNA, 25 bp, Homo sapien
ccagctttgaggaaatctgaaatag

SEQ ID NO: 119097 - DNA, 25 bp, Homo sapien
gttggctaaaactggtgtccatcac

SEQ ID NO: 119098 - DNA, 25 bp, Homo sapien
ggtgtccatcactacagtggcaata

SEQ ID NO: 119099 - DNA, 25 bp, Homo sapien
attgaactgggcacagcatgcggaa

SEQ ID NO: 119100 - DNA, 25 bp, Homo sapien
gcacagcatgcggaaaatactacag

SEQ ID NO: 119101 - DNA, 25 bp, Homo sapien
tgcacactggctatcattgatccag

SEQ ID NO: 119102 - DNA, 25 bp, Homo sapien
ctggctatcattgatccaggtgact

SEQ ID NO: 119103 - DNA, 25 bp, Homo sapien
accaagggcaggatcctcaccgtgg

SEQ ID NO: 119104 - DNA, 25 bp, Homo sapien
ggatcctcaccgtggaggaccatta

SEQ ID NO: 119105 - DNA, 25 bp, Homo sapien
ttggtgaggctgtgtccagtgcagt

SEQ ID NO: 119106 - DNA, 25 bp, Homo sapien
gtccagtgcagtagtgggcgagcct

SEQ ID NO: 119107 - DNA, 25 bp, Homo sapien
gtgggcgagcctggcatcactgtca

SEQ ID NO: 119108 - DNA, 25 bp, Homo sapien
tgtcaaaacaatggcagttaaccgg

SEQ ID NO: 119109 - DNA, 25 bp, Homo sapien
caagaagtgggaagccggctgagct

SEQ ID NO: 119110 - DNA, 25 bp, Homo sapien
gctgctgaagatgtttggtatcgac

SEQ ID NO: 119111 - DNA, 25 bp, Homo sapien
ggatgccattgcacaagctgtgagg

SEQ ID NO: 119112 - DNA, 25 bp, Homo sapien
catcaccaaggcctagggcgggtat

SEQ ID NO: 119113 - DNA, 25 bp, Homo sapien
ggtctatacattcctgagattctgg

SEQ ID NO: 119114 - DNA, 25 bp, Homo sapien
gttgattccttgagtttcatatata

SEQ ID NO: 119115 - DNA, 25 bp, Homo sapien
gattccttgagtttcatatataaga

SEQ ID NO: 119116 - DNA, 25 bp, Homo sapien
gagtttcatatataagactgctgca

SEQ ID NO: 119117 - DNA, 25 bp, Homo sapien
gtttcatatataagactgctgcagt

SEQ ID NO: 119118 - DNA, 25 bp, Homo sapien
ttcatatataagactgctgcagtca

SEQ ID NO: 119119 - DNA, 25 bp, Homo sapien
ataagactgctgcagtcacatcaca

SEQ ID NO: 119120 - DNA, 25 bp, Homo sapien
acgcagttgattccttgagtttcat

SEQ ID NO: 119121 - DNA, 25 bp, Homo sapien
cgcagttgattccttgagtttcata

SEQ ID NO: 119122 - DNA, 25 bp, Homo sapien
gcagttgattccttgagtttcatat

SEQ ID NO: 119123 - DNA, 25 bp, Homo sapien
cagttgattccttgagtttcatata

SEQ ID NO: 119124 - DNA, 25 bp, Homo sapien
agttgattccttgagtttcatatat

SEQ ID NO: 119125 - DNA, 25 bp, Homo sapien
aaagtcattcaggagatctgtggta

SEQ ID NO: 119126 - DNA, 25 bp, Homo sapien
ttcaggagatctgtggtaggaactc

SEQ ID NO: 119127 - DNA, 25 bp, Homo sapien
gtaggaactccagcatacttagccc

SEQ ID NO: 119128 - DNA, 25 bp, Homo sapien
aggaactccagcatacttagcccct

SEQ ID NO: 119129 - DNA, 25 bp, Homo sapien
actccagcatacttagcccctgaag

SEQ ID NO: 119130 - DNA, 25 bp, Homo sapien
tagcccctgaagttctccggagcaa

SEQ ID NO: 119131 - DNA, 25 bp, Homo sapien
gctgcttgcatcagcagagccattt

SEQ ID NO: 119132 - DNA, 25 bp, Homo sapien
gactttggatttgcacgcatcattg

SEQ ID NO: 119133 - DNA, 25 bp, Homo sapien
tttggatttgcacgcatcattggtg

SEQ ID NO: 119134 - DNA, 25 bp, Homo sapien
ggatttgcacgcatcattggtgaaa

SEQ ID NO: 119135 - DNA, 25 bp, Homo sapien
ttgcacgcatcattggtgaaaagtc

SEQ ID NO: 119136 - DNA, 25 bp, Homo sapien
gaaatttccaagaaacagggccaat

SEQ ID NO: 119137 - DNA, 25 bp, Homo sapien
aatttccaagaaacagggccaatct

SEQ ID NO: 119138 - DNA, 25 bp, Homo sapien
atttccaagaaacagggccaatctg

SEQ ID NO: 119139 - DNA, 25 bp, Homo sapien
tttccaagaaacagggccaatctga

SEQ ID NO: 119140 - DNA, 25 bp, Homo sapien
ttccaagaaacagggccaatctgaa

SEQ ID NO: 119141 - DNA, 25 bp, Homo sapien
tccaagaaacagggccaatctgaag

SEQ ID NO: 119142 - DNA, 25 bp, Homo sapien
ccaagaaacagggccaatctgaaga

SEQ ID NO: 119143 - DNA, 25 bp, Homo sapien
caagaaacagggccaatctgaagag

SEQ ID NO: 119144 - DNA, 25 bp, Homo sapien
ttggtgaggctgtgtccagtgcagt

SEQ ID NO: 119145 - DNA, 25 bp, Homo sapien
gtgaggctgtgtccagtgcagtagt

SEQ ID NO: 119146 - DNA, 25 bp, Homo sapien
gaggctgtgtccagtgcagtagtgg

SEQ ID NO: 119147 - DNA, 25 bp, Homo sapien
ggctgtgtccagtgcagtagtgggc

SEQ ID NO: 119148 - DNA, 25 bp, Homo sapien
ctgtgtccagtgcagtagtgggcga

SEQ ID NO: 119149 - DNA, 25 bp, Homo sapien
gtccagtgcagtagtgggcgagcct

SEQ ID NO: 119150 - DNA, 25 bp, Homo sapien
agtgggcgagcctggcatcactgtc

SEQ ID NO: 119151 - DNA, 25 bp, Homo sapien
gtgggcgagcctggcatcactgtca

SEQ ID NO: 119152 - DNA, 25 bp, Homo sapien
agctgctgaagatgtttggtatcga

SEQ ID NO: 119153 - DNA, 25 bp, Homo sapien
gctgctgaagatgtttggtatcgac

SEQ ID NO: 119154 - DNA, 25 bp, Homo sapien
attgcacaagctgtgaggggcctca

SEQ ID NO: 119155 - DNA, 25 bp, Homo sapien
ggagctcagcaacctgagatctgac

SEQ ID NO: 119156 - DNA, 25 bp, Homo sapien
agctcagcaacctgagatctgacga

SEQ ID NO: 119157 - DNA, 25 bp, Homo sapien
tattcctgtgcgagagggggctatt

SEQ ID NO: 119158 - DNA, 25 bp, Homo sapien
gggctattgtactactagcaactgc

SEQ ID NO: 119159 - DNA, 25 bp, Homo sapien
gctattgtactactagcaactgcaa

SEQ ID NO: 119160 - DNA, 25 bp, Homo sapien
tattgtactactagcaactgcaatc

SEQ ID NO: 119161 - DNA, 25 bp, Homo sapien
ttgtactactagcaactgcaatctt

SEQ ID NO: 119162 - DNA, 25 bp, Homo sapien
gtactactagcaactgcaatcttaa

SEQ ID NO: 119163 - DNA, 25 bp, Homo sapien
actactagcaactgcaatcttaagg

SEQ ID NO: 119164 - DNA, 25 bp, Homo sapien
actagcaactgcaatcttaaggata

SEQ ID NO: 119165 - DNA, 25 bp, Homo sapien
tcttaaggatacttttgttatctgg

SEQ ID NO: 119166 - DNA, 25 bp, Homo sapien
aaggaagtcttggtgctgacatctg

SEQ ID NO: 119167 - DNA, 25 bp, Homo sapien
tgctgacatctgtgcgtaactctgc

SEQ ID NO: 119168 - DNA, 25 bp, Homo sapien
gtaactctgccacgtgtcacagtga

SEQ ID NO: 119169 - DNA, 25 bp, Homo sapien
gtcacagtgaggatagcgacctgga

SEQ ID NO: 119170 - DNA, 25 bp, Homo sapien
tagatttctcattgtttgggttgga

SEQ ID NO: 119171 - DNA, 25 bp, Homo sapien
gggttggaatacaccattgtttatt

SEQ ID NO: 119172 - DNA, 25 bp, Homo sapien
cagctgttctttgtagtccctttta

SEQ ID NO: 119173 - DNA, 25 bp, Homo sapien
ttttgttcgtgttactgaccagctg

SEQ ID NO: 119174 - DNA, 25 bp, Homo sapien
atgatttctttgctgtggaccttga

SEQ ID NO: 119175 - DNA, 25 bp, Homo sapien
tggaccttgaagcttttctccagga

SEQ ID NO: 119176 - DNA, 25 bp, Homo sapien
ccaggaatttggattactcccagaa

SEQ ID NO: 119177 - DNA, 25 bp, Homo sapien
ctcccagcaagcatctggccaatcc

SEQ ID NO: 119178 - DNA, 25 bp, Homo sapien
tggccaatcctattcttcccgcgag

SEQ ID NO: 119179 - DNA, 25 bp, Homo sapien
ggccaatcctattcttcccgcgagg

SEQ ID NO: 119180 - DNA, 25 bp, Homo sapien
gccaatcctattcttcccgcgaggt

SEQ ID NO: 119181 - DNA, 25 bp, Homo sapien
caatcctattcttcccgcgaggtct

SEQ ID NO: 119182 - DNA, 25 bp, Homo sapien
aatcctattcttcccgcgaggtctt

SEQ ID NO: 119183 - DNA, 25 bp, Homo sapien
tattcttcccgcgaggtcttcacct

SEQ ID NO: 119184 - DNA, 25 bp, Homo sapien
aggagcagagctcatccagcttcag

SEQ ID NO: 119185 - DNA, 25 bp, Homo sapien
cagggccagagctcctagaactgag

SEQ ID NO: 119186 - DNA, 25 bp, Homo sapien
tgaaggcccgggtcaggaccctgct

SEQ ID NO: 119187 - DNA, 25 bp, Homo sapien
tcctggcgcagttcccagctatctc

SEQ ID NO: 119188 - DNA, 25 bp, Homo sapien
ccgagacctgaagcctagtaaccta

SEQ ID NO: 119189 - DNA, 25 bp, Homo sapien
cgagacctgaagcctagtaacctag

SEQ ID NO: 119190 - DNA, 25 bp, Homo sapien
gagacctgaagcctagtaacctagc

SEQ ID NO: 119191 - DNA, 25 bp, Homo sapien
agacctgaagcctagtaacctagct

SEQ ID NO: 119192 - DNA, 25 bp, Homo sapien
gacctgaagcctagtaacctagctg

SEQ ID NO: 119193 - DNA, 25 bp, Homo sapien
acctgaagcctagtaacctagctgt

SEQ ID NO: 119194 - DNA, 25 bp, Homo sapien
cctgaagcctagtaacctagctgtg

SEQ ID NO: 119195 - DNA, 25 bp, Homo sapien
ctgaagcctagtaacctagctgtga

SEQ ID NO: 119196 - DNA, 25 bp, Homo sapien
tgaagcctagtaacctagctgtgaa

SEQ ID NO: 119197 - DNA, 25 bp, Homo sapien
gattggatagcatttcatgcctatg

SEQ ID NO: 119198 - DNA, 25 bp, Homo sapien
catgcctatgttaatatttgtgctt

SEQ ID NO: 119199 - DNA, 25 bp, Homo sapien
tatgtatacgtgatgcctttgtagc

SEQ ID NO: 119200 - DNA, 25 bp, Homo sapien
gtgatgcctttgtagcatactgcta

SEQ ID NO: 119201 - DNA, 25 bp, Homo sapien
aaatgatggttggaagaatgcggct

SEQ ID NO: 119202 - DNA, 25 bp, Homo sapien
aatgcggctcatatttaccaagtct

SEQ ID NO: 119203 - DNA, 25 bp, Homo sapien
ttaccaagtctttctgaacgccttc

SEQ ID NO: 119204 - DNA, 25 bp, Homo sapien
aagtctttctgaacgccttctgcat

SEQ ID NO: 119205 - DNA, 25 bp, Homo sapien
tgaacgccttctgcattcatgcatc

SEQ ID NO: 119206 - DNA, 25 bp, Homo sapien
tcatgcatccatgttctttctagga

SEQ ID NO: 119207 - DNA, 25 bp, Homo sapien
catgttctttctaggattggatagc

SEQ ID NO: 119208 - DNA, 25 bp, Homo sapien
tgtatgagttgtaagtaatcttgcc

SEQ ID NO: 119209 - DNA, 25 bp, Homo sapien
tgatttatcattgatgcctactgaa

SEQ ID NO: 119210 - DNA, 25 bp, Homo sapien
atcattgatgcctactgaaataaaa

SEQ ID NO: 119211 - DNA, 25 bp, Homo sapien
tgcagacaggatccctagcttgttt

SEQ ID NO: 119212 - DNA, 25 bp, Homo sapien
aggatccctagcttgttttctgtca

SEQ ID NO: 119213 - DNA, 25 bp, Homo sapien
atccctagcttgttttctgtcagtc

SEQ ID NO: 119214 - DNA, 25 bp, Homo sapien
cagtcattcattgtaagtagcacat

SEQ ID NO: 119215 - DNA, 25 bp, Homo sapien
gtagcacattgcaacaacaatcatg

SEQ ID NO: 119216 - DNA, 25 bp, Homo sapien
acaatcatgcttatgaccaatacag

SEQ ID NO: 119217 - DNA, 25 bp, Homo sapien
gaccaatacagtcactaggttgtag

SEQ ID NO: 119218 - DNA, 25 bp, Homo sapien
atacagtcactaggttgtagttttt

SEQ ID NO: 119219 - DNA, 25 bp, Homo sapien
ggtacgtggagttctgttccattct

SEQ ID NO: 119220 - DNA, 25 bp, Homo sapien
tgctgatgacaagaccctacgcgta

SEQ ID NO: 119221 - DNA, 25 bp, Homo sapien
agaccctacgcgtatgggattacaa

SEQ ID NO: 119222 - DNA, 25 bp, Homo sapien
aacaagcgatgcatgaagaccctca

SEQ ID NO: 119223 - DNA, 25 bp, Homo sapien
gaagaccctcaatgcgcatgaacac

SEQ ID NO: 119224 - DNA, 25 bp, Homo sapien
gcatgaacactttgttacctccttg

SEQ ID NO: 119225 - DNA, 25 bp, Homo sapien
gttacctccttggatttccacaaga

SEQ ID NO: 119226 - DNA, 25 bp, Homo sapien
atttccacaagacggcaccctatgt

SEQ ID NO: 119227 - DNA, 25 bp, Homo sapien
ctatgtcgtcactggcagcgtagat

SEQ ID NO: 119228 - DNA, 25 bp, Homo sapien
cctcttttcctctggatgcactctg

SEQ ID NO: 119229 - DNA, 25 bp, Homo sapien
gatgataccatggttaccccattga

SEQ ID NO: 119230 - DNA, 25 bp, Homo sapien
gagactaccgacaaagtagcggtgc

SEQ ID NO: 119231 - DNA, 25 bp, Homo sapien
caaagtagcggtgccagcagttcca

SEQ ID NO: 119232 - DNA, 25 bp, Homo sapien
gtagcggtgccagcagttccagctt

SEQ ID NO: 119233 - DNA, 25 bp, Homo sapien
ggtgccagcagttccagcttcagca

SEQ ID NO: 119234 - DNA, 25 bp, Homo sapien
gtggccacggtagcagcagaggatt

SEQ ID NO: 119235 - DNA, 25 bp, Homo sapien
gggtaactgagcctgctttgcagta

SEQ ID NO: 119236 - DNA, 25 bp, Homo sapien
actgagcctgctttgcagtaggtca

SEQ ID NO: 119237 - DNA, 25 bp, Homo sapien
gcctgctttgcagtaggtcaccctg

SEQ ID NO: 119238 - DNA, 25 bp, Homo sapien
tttgcagtaggtcaccctgccaaac

SEQ ID NO: 119239 - DNA, 25 bp, Homo sapien
gtaggtcaccctgccaaacaagcta

SEQ ID NO: 119240 - DNA, 25 bp, Homo sapien
gtcaccctgccaaacaagctaatat

SEQ ID NO: 119241 - DNA, 25 bp, Homo sapien
tcctgcttccttatcaggctgtgtg

SEQ ID NO: 119242 - DNA, 25 bp, Homo sapien
ggctgtgtgttaattctgggccagt

SEQ ID NO: 119243 - DNA, 25 bp, Homo sapien
ttaattctgggccagtctacaccct

SEQ ID NO: 119244 - DNA, 25 bp, Homo sapien
cctggaggatgtgagggcacccctc

SEQ ID NO: 119245 - DNA, 25 bp, Homo sapien
tgagggcacccctcctctgaagatc

SEQ ID NO: 119246 - DNA, 25 bp, Homo sapien
ctgaagatccctgtacacgtggtgt

SEQ ID NO: 119247 - DNA, 25 bp, Homo sapien
tacacgtggtgttgggactggaacc

SEQ ID NO: 119248 - DNA, 25 bp, Homo sapien
gactggaaccattatgcggccccat

SEQ ID NO: 119249 - DNA, 25 bp, Homo sapien
ggccccataggcctcaggagtcatc

SEQ ID NO: 119250 - DNA, 25 bp, Homo sapien
ggtgtcctaagtaaggatctgtgca

SEQ ID NO: 119251 - DNA, 25 bp, Homo sapien
ggatctgtgcagaggacaaataaat

SEQ ID NO: 119252 - DNA, 25 bp, Homo sapien
ctagtttgcaacttcaagggacaag

SEQ ID NO: 119253 - DNA, 25 bp, Homo sapien
caagggacaagtattaatagttcag

SEQ ID NO: 119254 - DNA, 25 bp, Homo sapien
atagttcagtgtatggcgttggttt

SEQ ID NO: 119255 - DNA, 25 bp, Homo sapien
cgttggtttgtgttgagcgtttgca

SEQ ID NO: 119256 - DNA, 25 bp, Homo sapien
tttgtgttgagcgtttgcacggttt

SEQ ID NO: 119257 - DNA, 25 bp, Homo sapien
gcgtttgcacggtttggataatctt

SEQ ID NO: 119258 - DNA, 25 bp, Homo sapien
ggataatcttaaattttgacggaca

SEQ ID NO: 119259 - DNA, 25 bp, Homo sapien
ttttgacggacactgtggagacttt

SEQ ID NO: 119260 - DNA, 25 bp, Homo sapien
gttttgaagctgttgctatttgtat

SEQ ID NO: 119261 - DNA, 25 bp, Homo sapien
gtctgtttatttacgcttttattgg

SEQ ID NO: 119262 - DNA, 25 bp, Homo sapien
gaattacttgtgttacttgccaagc

SEQ ID NO: 119263 - DNA, 25 bp, Homo sapien
acaccaatgagttgtgtcttccctc

SEQ ID NO: 119264 - DNA, 25 bp, Homo sapien
aatgagttgtgtcttccctctgtcc

SEQ ID NO: 119265 - DNA, 25 bp, Homo sapien
actctcagcaccttcactctgaaga

SEQ ID NO: 119266 - DNA, 25 bp, Homo sapien
gcaccttcactctgaagatctgtta

SEQ ID NO: 119267 - DNA, 25 bp, Homo sapien
gatctgttaaaagcacacgagtcgt

SEQ ID NO: 119268 - DNA, 25 bp, Homo sapien
aaaagcacacgagtcgtctcagtcc

SEQ ID NO: 119269 - DNA, 25 bp, Homo sapien
cagtccctcagtgggagctgtttca

SEQ ID NO: 119270 - DNA, 25 bp, Homo sapien
tgggagctgtttcacctggcgtcat

SEQ ID NO: 119271 - DNA, 25 bp, Homo sapien
gtttcacctggcgtcatctagtcag

SEQ ID NO: 119272 - DNA, 25 bp, Homo sapien
ctagtcagccatcttcaataataac

SEQ ID NO: 119273 - DNA, 25 bp, Homo sapien
gaacatttatatccactgaaaccac

SEQ ID NO: 119274 - DNA, 25 bp, Homo sapien
tgtgcgagaggcaggtattatcatg

SEQ ID NO: 119275 - DNA, 25 bp, Homo sapien
tgcgagaggcaggtattatcatggt

SEQ ID NO: 119276 - DNA, 25 bp, Homo sapien
gcgagaggcaggtattatcatggtt

SEQ ID NO: 119277 - DNA, 25 bp, Homo sapien
cgagaggcaggtattatcatggttc

SEQ ID NO: 119278 - DNA, 25 bp, Homo sapien
gagaggcaggtattatcatggttcg

SEQ ID NO: 119279 - DNA, 25 bp, Homo sapien
agaggcaggtattatcatggttcgg

SEQ ID NO: 119280 - DNA, 25 bp, Homo sapien
gaggcaggtattatcatggttcggg

SEQ ID NO: 119281 - DNA, 25 bp, Homo sapien
caggtattatcatggttcggggaga

SEQ ID NO: 119282 - DNA, 25 bp, Homo sapien
ggtattatcatggttcggggagaca

SEQ ID NO: 119283 - DNA, 25 bp, Homo sapien
tattatcatggttcggggagacaac

SEQ ID NO: 119284 - DNA, 25 bp, Homo sapien
gggagacaaccactttgactactgg

SEQ ID NO: 119285 - DNA, 25 bp, Homo sapien
gtgcagaaccacagacggcttcggc

SEQ ID NO: 119286 - DNA, 25 bp, Homo sapien
tgcagaaccacagacggcttcggct

SEQ ID NO: 119287 - DNA, 25 bp, Homo sapien
gcagaaccacagacggcttcggctg

SEQ ID NO: 119288 - DNA, 25 bp, Homo sapien
cagaaccacagacggcttcggctgt

SEQ ID NO: 119289 - DNA, 25 bp, Homo sapien
aaccacagacggcttcggctgtgcc

SEQ ID NO: 119290 - DNA, 25 bp, Homo sapien
accacagacggcttcggctgtgcct

SEQ ID NO: 119291 - DNA, 25 bp, Homo sapien
ccacagacggcttcggctgtgccta

SEQ ID NO: 119292 - DNA, 25 bp, Homo sapien
cacagacggcttcggctgtgcctag

SEQ ID NO: 119293 - DNA, 25 bp, Homo sapien
acagacggcttcggctgtgcctagg

SEQ ID NO: 119294 - DNA, 25 bp, Homo sapien
acggcttcggctgtgcctagggcaa

SEQ ID NO: 119295 - DNA, 25 bp, Homo sapien
cggcttcggctgtgcctagggcaac

SEQ ID NO: 119296 - DNA, 25 bp, Homo sapien
aagtagcccactttattcacagagg

SEQ ID NO: 119297 - DNA, 25 bp, Homo sapien
tattcacagagggatagagctgacc

SEQ ID NO: 119298 - DNA, 25 bp, Homo sapien
tagagctgaccctgcagatccagag

SEQ ID NO: 119299 - DNA, 25 bp, Homo sapien
agatccagagcgacactggtgtcag

SEQ ID NO: 119300 - DNA, 25 bp, Homo sapien
gcgacactggtgtcagagccaccct

SEQ ID NO: 119301 - DNA, 25 bp, Homo sapien
gggataagtaccaggcggccgtgca

SEQ ID NO: 119302 - DNA, 25 bp, Homo sapien
gaggttgagagcttcgcctctctct

SEQ ID NO: 119303 - DNA, 25 bp, Homo sapien
tggcctgcctgacttctaaaggagc

SEQ ID NO: 119304 - DNA, 25 bp, Homo sapien
tgacttctaaaggagcgggcccact

SEQ ID NO: 119305 - DNA, 25 bp, Homo sapien
aaggagcgggcccactctggaccca

SEQ ID NO: 119306 - DNA, 25 bp, Homo sapien
acctgagagatggatgagctgctcc

SEQ ID NO: 119307 - DNA, 25 bp, Homo sapien
ggccaatgttccttagctgcaccag

SEQ ID NO: 119308 - DNA, 25 bp, Homo sapien
ttagctgcaccaggcccgaagctgt

SEQ ID NO: 119309 - DNA, 25 bp, Homo sapien
cgaagctgttcccatgcttgagctt

SEQ ID NO: 119310 - DNA, 25 bp, Homo sapien
tgagtgagcagtttcctacgccgtg

SEQ ID NO: 119311 - DNA, 25 bp, Homo sapien
tacgccgtggatctagcaagccatg

SEQ ID NO: 119312 - DNA, 25 bp, Homo sapien
gcaagccatggagacaggtagcatt

SEQ ID NO: 119313 - DNA, 25 bp, Homo sapien
catttgtaagatgctgcacaggagc

SEQ ID NO: 119314 - DNA, 25 bp, Homo sapien
gcacaggagcagcattatccccaaa

SEQ ID NO: 119315 - DNA, 25 bp, Homo sapien
tacagggtagacacgttttaactga

SEQ ID NO: 119316 - DNA, 25 bp, Homo sapien
actttattcaaagagcagcccgctt

SEQ ID NO: 119317 - DNA, 25 bp, Homo sapien
gcagcccgctttgtgtgactaaaat

SEQ ID NO: 119318 - DNA, 25 bp, Homo sapien
gattgtacagaatcattgcttatga

SEQ ID NO: 119319 - DNA, 25 bp, Homo sapien
attgcttatgacatgatcgctttct

SEQ ID NO: 119320 - DNA, 25 bp, Homo sapien
gacatgatcgctttctacactgtat

SEQ ID NO: 119321 - DNA, 25 bp, Homo sapien
gatcgctttctacactgtattacat

SEQ ID NO: 119322 - DNA, 25 bp, Homo sapien
acttttctttgaaggatgactacag

SEQ ID NO: 119323 - DNA, 25 bp, Homo sapien
caattttctttaaccagtctgaagt

SEQ ID NO: 119324 - DNA, 25 bp, Homo sapien
tctttaaccagtctgaagtttcatt

SEQ ID NO: 119325 - DNA, 25 bp, Homo sapien
ggcatgcctggacaaacccttcttt

SEQ ID NO: 119326 - DNA, 25 bp, Homo sapien
tgcctggacaaacccttcttttaag

SEQ ID NO: 119327 - DNA, 25 bp, Homo sapien
tggacaaacccttcttttaagatgt

SEQ ID NO: 119328 - DNA, 25 bp, Homo sapien
acccttcttttaagatgtgtcttca

SEQ ID NO: 119329 - DNA, 25 bp, Homo sapien
ggaatgtatcattaatgcacctgag

SEQ ID NO: 119330 - DNA, 25 bp, Homo sapien
agaaacagtttcatgtgttcctcca

SEQ ID NO: 119331 - DNA, 25 bp, Homo sapien
ttcctccacctagagtttgtactgg

SEQ ID NO: 119332 - DNA, 25 bp, Homo sapien
gtttgtactggaatgctatttctaa

SEQ ID NO: 119333 - DNA, 25 bp, Homo sapien
gatggagccccacagtcagaatgtt

SEQ ID NO: 119334 - DNA, 25 bp, Homo sapien
gagccccacagtcagaatgttacta

SEQ ID NO: 119335 - DNA, 25 bp, Homo sapien
agcccatcttcctaaaagggaccag

SEQ ID NO: 119336 - DNA, 25 bp, Homo sapien
cagcttatggaaggctcgaccttga

SEQ ID NO: 119337 - DNA, 25 bp, Homo sapien
agttttactgtgaaagtcttcttca

SEQ ID NO: 119338 - DNA, 25 bp, Homo sapien
gaaagtcttcttcagatccccacct

SEQ ID NO: 119339 - DNA, 25 bp, Homo sapien
gcatcattccgaatgtgtcctggaa

SEQ ID NO: 119340 - DNA, 25 bp, Homo sapien
tattttttctgattgtggttcagtt

SEQ ID NO: 119341 - DNA, 25 bp, Homo sapien
gtttaactgaagaatatcctgagat

SEQ ID NO: 119342 - DNA, 25 bp, Homo sapien
tttttaaaaggtatcacttgtgatc

SEQ ID NO: 119343 - DNA, 25 bp, Homo sapien
cacttgtgatcatttatctttctaa

SEQ ID NO: 119344 - DNA, 25 bp, Homo sapien
tctatttttaatactgttccaccaa

SEQ ID NO: 119345 - DNA, 25 bp, Homo sapien
atactgttccaccaaagtgatgcag

SEQ ID NO: 119346 - DNA, 25 bp, Homo sapien
gttccaccaaagtgatgcagtggtt

SEQ ID NO: 119347 - DNA, 25 bp, Homo sapien
agtggttaccatgacaccctaattt

SEQ ID NO: 119348 - DNA, 25 bp, Homo sapien
ggttaccatgacaccctaatttcat

SEQ ID NO: 119349 - DNA, 25 bp, Homo sapien
gacaccctaatttcatgtgtttttg

SEQ ID NO: 119350 - DNA, 25 bp, Homo sapien
gtttcattgtcatttattggcggta

SEQ ID NO: 119351 - DNA, 25 bp, Homo sapien
aaagatgaggtctacactgtccttc

SEQ ID NO: 119352 - DNA, 25 bp, Homo sapien
agatgaggtctacactgtccttcat

SEQ ID NO: 119353 - DNA, 25 bp, Homo sapien
tgaggtctacactgtccttcatggg

SEQ ID NO: 119354 - DNA, 25 bp, Homo sapien
tacactgtccttcatggggattaaa

SEQ ID NO: 119355 - DNA, 25 bp, Homo sapien
aaagctatggttatattagcaccaa

SEQ ID NO: 119356 - DNA, 25 bp, Homo sapien
tagcaccaaacttctacaaaccaag

SEQ ID NO: 119357 - DNA, 25 bp, Homo sapien
caaacttctacaaaccaagctcagg

SEQ ID NO: 119358 - DNA, 25 bp, Homo sapien
ccaaccctagaagggcccaaatgag

SEQ ID NO: 119359 - DNA, 25 bp, Homo sapien
gcccaaatgagagaatggtacttag

SEQ ID NO: 119360 - DNA, 25 bp, Homo sapien
atatatggttttgtcaggtgtgtaa

SEQ ID NO: 119361 - DNA, 25 bp, Homo sapien
gttttgtcaggtgtgtaaatttgca

SEQ ID NO: 119362 - DNA, 25 bp, Homo sapien
tattcgtgtttgaaaaccatgtcat

SEQ ID NO: 119363 - DNA, 25 bp, Homo sapien
ccatgtcatttatttctacatcatg

SEQ ID NO: 119364 - DNA, 25 bp, Homo sapien
gaaatatttctctactactatgctc

SEQ ID NO: 119365 - DNA, 25 bp, Homo sapien
tttctctactactatgctcatgaca

SEQ ID NO: 119366 - DNA, 25 bp, Homo sapien
ttgtgagcaatactgaacatcaata

SEQ ID NO: 119367 - DNA, 25 bp, Homo sapien
tactgaacatcaataatacccttag

SEQ ID NO: 119368 - DNA, 25 bp, Homo sapien
atctttaagcatgctacttttactt

SEQ ID NO: 119369 - DNA, 25 bp, Homo sapien
gctacttttacttggccaatatttt

SEQ ID NO: 119370 - DNA, 25 bp, Homo sapien
atgttaacttttgctgatgtataaa

SEQ ID NO: 119371 - DNA, 25 bp, Homo sapien
gatgtataaaacagactatgcctta

SEQ ID NO: 119372 - DNA, 25 bp, Homo sapien
aacagactatgccttataattgaaa

SEQ ID NO: 119373 - DNA, 25 bp, Homo sapien
ttctcatttctttctaactgtagct

SEQ ID NO: 119374 - DNA, 25 bp, Homo sapien
gtagctatcattactggctgtggat

SEQ ID NO: 119375 - DNA, 25 bp, Homo sapien
tactggctgtggatagcccatagct

SEQ ID NO: 119376 - DNA, 25 bp, Homo sapien
tagcccatagctattttccttgctt

SEQ ID NO: 119377 - DNA, 25 bp, Homo sapien
catagctattttccttgcttttctt

SEQ ID NO: 119378 - DNA, 25 bp, Homo sapien
agtggagaagacattctggtgacca

SEQ ID NO: 119379 - DNA, 25 bp, Homo sapien
gtgaccagacttttgcttacctttt

SEQ ID NO: 119380 - DNA, 25 bp, Homo sapien
cttttgcttaccttttcctattctg

SEQ ID NO: 119381 - DNA, 25 bp, Homo sapien
tttgttttccccacattctatagcc

SEQ ID NO: 119382 - DNA, 25 bp, Homo sapien
tttccccacattctatagccataaa

SEQ ID NO: 119383 - DNA, 25 bp, Homo sapien
gatgagtaaaactggtgggtcttta

SEQ ID NO: 119384 - DNA, 25 bp, Homo sapien
gaccgggatggtttcatccccgagg

SEQ ID NO: 119385 - DNA, 25 bp, Homo sapien
ggtcctcgagtacgactactacggg

SEQ ID NO: 119386 - DNA, 25 bp, Homo sapien
gcacgaggactacgcctaccgcagg

SEQ ID NO: 119387 - DNA, 25 bp, Homo sapien
ggctgctggcagacgagtacacctt

SEQ ID NO: 119388 - DNA, 25 bp, Homo sapien
caccacgacacgatcaagaaggagt

SEQ ID NO: 119389 - DNA, 25 bp, Homo sapien
acacgatcaagaaggagtgcctggc

SEQ ID NO: 119390 - DNA, 25 bp, Homo sapien
gggccgccgctgtgtttgacatgtc

SEQ ID NO: 119391 - DNA, 25 bp, Homo sapien
gtgtttgacatgtcctacttcggga

SEQ ID NO: 119392 - DNA, 25 bp, Homo sapien
tacttcgggaagttctacctggtgg

SEQ ID NO: 119393 - DNA, 25 bp, Homo sapien
ctggatgcaaggaaggctgccgact

SEQ ID NO: 119394 - DNA, 25 bp, Homo sapien
aggaaggctgccgactggctcttct

SEQ ID NO: 119395 - DNA, 25 bp, Homo sapien
gggaaccatttgtgaatgaatattt

SEQ ID NO: 119396 - DNA, 25 bp, Homo sapien
gaatatttggaacttaccaagtcct

SEQ ID NO: 119397 - DNA, 25 bp, Homo sapien
caagtcctaagagacttttggaaga

SEQ ID NO: 119398 - DNA, 25 bp, Homo sapien
gaggatatatatagcatagtaccat

SEQ ID NO: 119399 - DNA, 25 bp, Homo sapien
tatagcatagtaccataccacttat

SEQ ID NO: 119400 - DNA, 25 bp, Homo sapien
gcatagtaccataccacttataaag

SEQ ID NO: 119401 - DNA, 25 bp, Homo sapien
aaagtggaaactcttggaccaagat

SEQ ID NO: 119402 - DNA, 25 bp, Homo sapien
cttggaccaagattaggattaattt

SEQ ID NO: 119403 - DNA, 25 bp, Homo sapien
aatacatgctttaatttgcaattta

SEQ ID NO: 119404 - DNA, 25 bp, Homo sapien
gattgttaccataaattagtgctaa

SEQ ID NO: 119405 - DNA, 25 bp, Homo sapien
ataaattagtgctaatgctgaggag

SEQ ID NO: 119406 - DNA, 25 bp, Homo sapien
gagggagaaaagttcttagcacaaa

SEQ ID NO: 119407 - DNA, 25 bp, Homo sapien
aagttcttagcacaaatgttttaca

SEQ ID NO: 119408 - DNA, 25 bp, Homo sapien
ggcctgacactggtggcactactaa

SEQ ID NO: 119409 - DNA, 25 bp, Homo sapien
gtggcactactaagtgtgtgttttt

SEQ ID NO: 119410 - DNA, 25 bp, Homo sapien
ttaaactggagagacttctgacaac

SEQ ID NO: 119411 - DNA, 25 bp, Homo sapien
gagacttctgacaacagctttgcct

SEQ ID NO: 119412 - DNA, 25 bp, Homo sapien
gacaacagctttgcctctgtattgt

SEQ ID NO: 119413 - DNA, 25 bp, Homo sapien
agctttgcctctgtattgtgtacca

SEQ ID NO: 119414 - DNA, 25 bp, Homo sapien
gcctctgtattgtgtaccagaatat

SEQ ID NO: 119415 - DNA, 25 bp, Homo sapien
tataaatgatacacctctgacccca

SEQ ID NO: 119416 - DNA, 25 bp, Homo sapien
tctgaccccagcgttctgaataaaa

SEQ ID NO: 119417 - DNA, 25 bp, Homo sapien
cctgtgtcactcagcagtgggacag

SEQ ID NO: 119418 - DNA, 25 bp, Homo sapien
cagcagtgggacagcaacctgtaga

SEQ ID NO: 119419 - DNA, 25 bp, Homo sapien
ccagcgagggcgtgtctagcttgat

SEQ ID NO: 119420 - DNA, 25 bp, Homo sapien
ggcgtgtctagcttgatgttggatc

SEQ ID NO: 119421 - DNA, 25 bp, Homo sapien
gtgtctagcttgatgttggatctca

SEQ ID NO: 119422 - DNA, 25 bp, Homo sapien
agcttgatgttggatctcaagagcc

SEQ ID NO: 119423 - DNA, 25 bp, Homo sapien
agagtagaagtctcttccagtttgc

SEQ ID NO: 119424 - DNA, 25 bp, Homo sapien
gtacaacctgaatacccttttctga

SEQ ID NO: 119425 - DNA, 25 bp, Homo sapien
tgaatacccttttctgaccaaagag

SEQ ID NO: 119426 - DNA, 25 bp, Homo sapien
agagaagcaaaatctaccaggtcaa

SEQ ID NO: 119427 - DNA, 25 bp, Homo sapien
atctaccaggtcaaaatagtgccac

SEQ ID NO: 119428 - DNA, 25 bp, Homo sapien
ttcttcctgtacaaccggcagcaga

SEQ ID NO: 119429 - DNA, 25 bp, Homo sapien
gtacaaccggcagcagaagagccca

SEQ ID NO: 119430 - DNA, 25 bp, Homo sapien
gcagaagagcccaccggagacggat

SEQ ID NO: 119431 - DNA, 25 bp, Homo sapien
tcccagcaggcaaagctcccttgtg

SEQ ID NO: 119432 - DNA, 25 bp, Homo sapien
gctcccttgtgcctgaggatatcca

SEQ ID NO: 119433 - DNA, 25 bp, Homo sapien
ctgaggatatccaggttgtccacct

SEQ ID NO: 119434 - DNA, 25 bp, Homo sapien
atccaggttgtccacctggacccag

SEQ ID NO: 119435 - DNA, 25 bp, Homo sapien
tgcagcccccctactatgatctggg

SEQ ID NO: 119436 - DNA, 25 bp, Homo sapien
gtaaggacaaccgaacctcgaggag

SEQ ID NO: 119437 - DNA, 25 bp, Homo sapien
aggacaaccgaacctcgaggagagt

SEQ ID NO: 119438 - DNA, 25 bp, Homo sapien
cgaacctcgaggagagtgcccctag

SEQ ID NO: 119439 - DNA, 25 bp, Homo sapien
tggcctcactgatctacaacttcgt

SEQ ID NO: 119440 - DNA, 25 bp, Homo sapien
tcactgatctacaacttcgtcctgt

SEQ ID NO: 119441 - DNA, 25 bp, Homo sapien
actgatctacaacttcgtcctgttc

SEQ ID NO: 119442 - DNA, 25 bp, Homo sapien
tgatctacaacttcgtcctgttccc

SEQ ID NO: 119443 - DNA, 25 bp, Homo sapien
ctggcgcagcggctggctatcctca

SEQ ID NO: 119444 - DNA, 25 bp, Homo sapien
tggctatcctcacaggcaccgtaga

SEQ ID NO: 119445 - DNA, 25 bp, Homo sapien
atcctcacaggcaccgtagaggtgg

SEQ ID NO: 119446 - DNA, 25 bp, Homo sapien
atcccagccgggttcgggagccgtg

SEQ ID NO: 119447 - DNA, 25 bp, Homo sapien
agagtgtgtgaaacagcctacgcct

SEQ ID NO: 119448 - DNA, 25 bp, Homo sapien
gtgtgtgaaacagcctacgcctggc

SEQ ID NO: 119449 - DNA, 25 bp, Homo sapien
gtgaaacagcctacgcctggccgcg

SEQ ID NO: 119450 - DNA, 25 bp, Homo sapien
gaagggtttttctgaattgtctaga

SEQ ID NO: 119451 - DNA, 25 bp, Homo sapien
tctgaattgtctagatccatgcatt

SEQ ID NO: 119452 - DNA, 25 bp, Homo sapien
tgtctagatccatgcattatttttc

SEQ ID NO: 119453 - DNA, 25 bp, Homo sapien
tagatccatgcattatttttctagc

SEQ ID NO: 119454 - DNA, 25 bp, Homo sapien
tatttttctagcttcctgccttgct

SEQ ID NO: 119455 - DNA, 25 bp, Homo sapien
tgccttgctccctattcactttaca

SEQ ID NO: 119456 - DNA, 25 bp, Homo sapien
gctccctattcactttacactgtga

SEQ ID NO: 119457 - DNA, 25 bp, Homo sapien
gggtgagtcccacttgagcgcttcc

SEQ ID NO: 119458 - DNA, 25 bp, Homo sapien
cacttgagcgcttcctgttgaataa

SEQ ID NO: 119459 - DNA, 25 bp, Homo sapien
gagcgcttcctgttgaataaagcag

SEQ ID NO: 119460 - DNA, 25 bp, Homo sapien
ataaagcaggcacttgacctggctg

SEQ ID NO: 119461 - DNA, 25 bp, Homo sapien
tctcattaaccttgtgaagcaaaag

SEQ ID NO: 119462 - DNA, 25 bp, Homo sapien
gcaaaagccacaaataacagaggaa

SEQ ID NO: 119463 - DNA, 25 bp, Homo sapien
aacagaggaacaacttgaggctgtc

SEQ ID NO: 119464 - DNA, 25 bp, Homo sapien
aggcctgttggagaaatgctgccaa

SEQ ID NO: 119465 - DNA, 25 bp, Homo sapien
tgccaaggccaggaacaggaagtct

SEQ ID NO: 119466 - DNA, 25 bp, Homo sapien
aacaggaagtctgctttgctgaaga

SEQ ID NO: 119467 - DNA, 25 bp, Homo sapien
tgctgaagagggacaaaaactgatt

SEQ ID NO: 119468 - DNA, 25 bp, Homo sapien
caaaaactcgtgctgctttgggagt

SEQ ID NO: 119469 - DNA, 25 bp, Homo sapien
gacaaaacgagtctttcattcggtg

SEQ ID NO: 119470 - DNA, 25 bp, Homo sapien
aacgagtctttcattcggtgtgaac

SEQ ID NO: 119471 - DNA, 25 bp, Homo sapien
tcattcggtgtgaacttttctcttt

SEQ ID NO: 119472 - DNA, 25 bp, Homo sapien
accccgtctctacaataaatagcaa

SEQ ID NO: 119473 - DNA, 25 bp, Homo sapien
ccccgtctctacaataaatagcaaa

SEQ ID NO: 119474 - DNA, 25 bp, Homo sapien
attatcctggcggagttatgcacgc

SEQ ID NO: 119475 - DNA, 25 bp, Homo sapien
ttatcctggcggagttatgcacgct

SEQ ID NO: 119476 - DNA, 25 bp, Homo sapien
tatcctggcggagttatgcacgctt

SEQ ID NO: 119477 - DNA, 25 bp, Homo sapien
atcctggcggagttatgcacgcttg

SEQ ID NO: 119478 - DNA, 25 bp, Homo sapien
tcctggcggagttatgcacgcttgt

SEQ ID NO: 119479 - DNA, 25 bp, Homo sapien
cctggcggagttatgcacgcttgta

SEQ ID NO: 119480 - DNA, 25 bp, Homo sapien
ctggcggagttatgcacgcttgtag

SEQ ID NO: 119481 - DNA, 25 bp, Homo sapien
tggcggagttatgcacgcttgtagt

SEQ ID NO: 119482 - DNA, 25 bp, Homo sapien
ggcggagttatgcacgcttgtagtc

SEQ ID NO: 119483 - DNA, 25 bp, Homo sapien
gatgaatgtggcatagcctcttccc

SEQ ID NO: 119484 - DNA, 25 bp, Homo sapien
gaatgtggcatagcctcttcccagt

SEQ ID NO: 119485 - DNA, 25 bp, Homo sapien
tgtggcatagcctcttcccagttct

SEQ ID NO: 119486 - DNA, 25 bp, Homo sapien
gtggaagataaagcctacaaatatg

SEQ ID NO: 119487 - DNA, 25 bp, Homo sapien
tgacaaggcctttaaaagttctcaa

SEQ ID NO: 119488 - DNA, 25 bp, Homo sapien
gaagaatgtcacaaagcccttaata

SEQ ID NO: 119489 - DNA, 25 bp, Homo sapien
agcccttaataagtcctcaattctt

SEQ ID NO: 119490 - DNA, 25 bp, Homo sapien
gatgtttcatactggagcgaaacta

SEQ ID NO: 119491 - DNA, 25 bp, Homo sapien
gagcgaaactacaatcctgaatgat

SEQ ID NO: 119492 - DNA, 25 bp, Homo sapien
atcctgaatgatgtcacagtgcttt

SEQ ID NO: 119493 - DNA, 25 bp, Homo sapien
aatgatgtcacagtgcttttaacaa

SEQ ID NO: 119494 - DNA, 25 bp, Homo sapien
ccatacttcctgatctgcatctgga

SEQ ID NO: 119495 - DNA, 25 bp, Homo sapien
catacttcctgatctgcatctggaa

SEQ ID NO: 119496 - DNA, 25 bp, Homo sapien
acaggaactgaagtaaacactttag

SEQ ID NO: 119497 - DNA, 25 bp, Homo sapien
aaacactttagttgctttcagggat

SEQ ID NO: 119498 - DNA, 25 bp, Homo sapien
aacactttagttgctttcagggatg

SEQ ID NO: 119499 - DNA, 25 bp, Homo sapien
cactttagttgctttcagggatgac

SEQ ID NO: 119500 - DNA, 25 bp, Homo sapien
actttagttgctttcagggatgaca

SEQ ID NO: 119501 - DNA, 25 bp, Homo sapien
tttagttgctttcagggatgacaca

SEQ ID NO: 119502 - DNA, 25 bp, Homo sapien
tttcagggatgacacaagcacacaa

SEQ ID NO: 119503 - DNA, 25 bp, Homo sapien
tcagggatgacacaagcacacaatg

SEQ ID NO: 119504 - DNA, 25 bp, Homo sapien
gggatgacacaagcacacaatgatt

SEQ ID NO: 119505 - DNA, 25 bp, Homo sapien
ttccagcccgtcaccacggatacag

SEQ ID NO: 119506 - DNA, 25 bp, Homo sapien
ggactcgcagtcaccatggccagct

SEQ ID NO: 119507 - DNA, 25 bp, Homo sapien
catggccagctccatagatcaggga

SEQ ID NO: 119508 - DNA, 25 bp, Homo sapien
gccagctccatagatcagggacact

SEQ ID NO: 119509 - DNA, 25 bp, Homo sapien
gctccatagatcagggacacttggg

SEQ ID NO: 119510 - DNA, 25 bp, Homo sapien
gggaaccccgaacagagtgcaatgc

SEQ ID NO: 119511 - DNA, 25 bp, Homo sapien
aaccccgaacagagtgcaatgctcc

SEQ ID NO: 119512 - DNA, 25 bp, Homo sapien
agagtgcaatgctcccccagctgaa

SEQ ID NO: 119513 - DNA, 25 bp, Homo sapien
gagtgcgctgtccagcgaactgtcc

SEQ ID NO: 119514 - DNA, 25 bp, Homo sapien
gtccagcgaactgtccctggtcggg

SEQ ID NO: 119515 - DNA, 25 bp, Homo sapien
gacaccacgggggacacgctagaga

SEQ ID NO: 119516 - DNA, 25 bp, Homo sapien
aagcaaagccagaactatcacattt

SEQ ID NO: 119517 - DNA, 25 bp, Homo sapien
gaactatcacatttagcttaagaga

SEQ ID NO: 119518 - DNA, 25 bp, Homo sapien
gaggagcctgttttgttgagaagat

SEQ ID NO: 119519 - DNA, 25 bp, Homo sapien
ccccattgatgtttaaccagaaaag

SEQ ID NO: 119520 - DNA, 25 bp, Homo sapien
agtacattgctaaccccaaacaggc

SEQ ID NO: 119521 - DNA, 25 bp, Homo sapien
ggcatgtatcaaaacacctgtggag

SEQ ID NO: 119522 - DNA, 25 bp, Homo sapien
aaacacctgtggagtactttagact

SEQ ID NO: 119523 - DNA, 25 bp, Homo sapien
agtactttagactccaacaaataat

SEQ ID NO: 119524 - DNA, 25 bp, Homo sapien
tgtaactaaaactgctcacacattt

SEQ ID NO: 119525 - DNA, 25 bp, Homo sapien
actgtactttccaaagtcattacta

SEQ ID NO: 119526 - DNA, 25 bp, Homo sapien
gagtaaatcattcttgaacttagag

SEQ ID NO: 119527 - DNA, 25 bp, Homo sapien
tcatagaaattaggctggagaaaga

SEQ ID NO: 119528 - DNA, 25 bp, Homo sapien
aagttactgtggtatctatgagtta

SEQ ID NO: 119529 - DNA, 25 bp, Homo sapien
actgtggtatctatgagttatcatc

SEQ ID NO: 119530 - DNA, 25 bp, Homo sapien
ggtatctatgagttatcatcttagc

SEQ ID NO: 119531 - DNA, 25 bp, Homo sapien
atgagttatcatcttagctgtgtta

SEQ ID NO: 119532 - DNA, 25 bp, Homo sapien
gagttatcatcttagctgtgttaaa

SEQ ID NO: 119533 - DNA, 25 bp, Homo sapien
atcttagctgtgttaaaaatgaatt

SEQ ID NO: 119534 - DNA, 25 bp, Homo sapien
gaatttttactatggcagatatggt

SEQ ID NO: 119535 - DNA, 25 bp, Homo sapien
tggcagatatggtatggatcgtaaa

SEQ ID NO: 119536 - DNA, 25 bp, Homo sapien
gtatggatcgtaaaattttaagcac

SEQ ID NO: 119537 - DNA, 25 bp, Homo sapien
aggtttattaactgaatttcattag

SEQ ID NO: 119538 - DNA, 25 bp, Homo sapien
ggagaacttactatcatcctctaat

SEQ ID NO: 119539 - DNA, 25 bp, Homo sapien
ttttccaattgaactttcacatagc

SEQ ID NO: 119540 - DNA, 25 bp, Homo sapien
ataaaaccatacagtgagccagcct

SEQ ID NO: 119541 - DNA, 25 bp, Homo sapien
agccagccttgcagtaggcagtaga

SEQ ID NO: 119542 - DNA, 25 bp, Homo sapien
ggcagtagactataagcagaagcac

SEQ ID NO: 119543 - DNA, 25 bp, Homo sapien
gaagcacatatgaactggacctgca

SEQ ID NO: 119544 - DNA, 25 bp, Homo sapien
tgaactggacctgcaccaaagctgg

SEQ ID NO: 119545 - DNA, 25 bp, Homo sapien
accaaagctggcaccagggctcgga

SEQ ID NO: 119546 - DNA, 25 bp, Homo sapien
agggctcggaaggtctctgaactca

SEQ ID NO: 119547 - DNA, 25 bp, Homo sapien
tctgaactcagaaggatggcatttt

SEQ ID NO: 119548 - DNA, 25 bp, Homo sapien
gatctgagttattttgctaaacttg

SEQ ID NO: 119549 - DNA, 25 bp, Homo sapien
gagatgatttcagctcattgacatt

SEQ ID NO: 119550 - DNA, 25 bp, Homo sapien
gacatttttaagctgtatccccttg

SEQ ID NO: 119551 - DNA, 25 bp, Homo sapien
tatccccttgtcattccattgagaa

SEQ ID NO: 119552 - DNA, 25 bp, Homo sapien
agaaagctgacaactgggataggga

SEQ ID NO: 119553 - DNA, 25 bp, Homo sapien
gaacttgcctagtaagcactttgtc

SEQ ID NO: 119554 - DNA, 25 bp, Homo sapien
tctgttcactactgcgatagaggaa

SEQ ID NO: 119555 - DNA, 25 bp, Homo sapien
gaggaaatctactccctatcttggg

SEQ ID NO: 119556 - DNA, 25 bp, Homo sapien
atcttgggtccttgaactacagcct

SEQ ID NO: 119557 - DNA, 25 bp, Homo sapien
gggtccttgaactacagcctgctgt

SEQ ID NO: 119558 - DNA, 25 bp, Homo sapien
tgctgtcttacaccagtggagctac

SEQ ID NO: 119559 - DNA, 25 bp, Homo sapien
gtggagctaccctttaaatgtacaa

SEQ ID NO: 119560 - DNA, 25 bp, Homo sapien
aagggaacaaatcactcgacggcat

SEQ ID NO: 119561 - DNA, 25 bp, Homo sapien
tcactcgacggcatggagtcgtaca

SEQ ID NO: 119562 - DNA, 25 bp, Homo sapien
gagtcgtacaatttgccatttggca

SEQ ID NO: 119563 - DNA, 25 bp, Homo sapien
tacagatgcttcagctacttaccca

SEQ ID NO: 119564 - DNA, 25 bp, Homo sapien
atcagcccaacctttgtgggctaca

SEQ ID NO: 119565 - DNA, 25 bp, Homo sapien
gtgggctacacatggaaaggcctca

SEQ ID NO: 119566 - DNA, 25 bp, Homo sapien
agagcgacaacagccggagttcaga

SEQ ID NO: 119567 - DNA, 25 bp, Homo sapien
atgaagactcccaggccacgggata

SEQ ID NO: 119568 - DNA, 25 bp, Homo sapien
acgggatagcctttgctgtgccctg

SEQ ID NO: 119569 - DNA, 25 bp, Homo sapien
ccgcagtgaggcatgtatctgtagt

SEQ ID NO: 119570 - DNA, 25 bp, Homo sapien
gtatctgtagttccttgctgagtaa

SEQ ID NO: 119571 - DNA, 25 bp, Homo sapien
atgcagacctactatgacgaccacc

SEQ ID NO: 119572 - DNA, 25 bp, Homo sapien
agacctactatgacgaccacctgag

SEQ ID NO: 119573 - DNA, 25 bp, Homo sapien
tactatgacgaccacctgagggacc

SEQ ID NO: 119574 - DNA, 25 bp, Homo sapien
tgacgaccacctgagggacctgggt

SEQ ID NO: 119575 - DNA, 25 bp, Homo sapien
tgagggacctgggtccgctcaccaa

SEQ ID NO: 119576 - DNA, 25 bp, Homo sapien
tgggtccgctcaccaaggcctggtt

SEQ ID NO: 119577 - DNA, 25 bp, Homo sapien
aaggcctggttcctcgaatccaaag

SEQ ID NO: 119578 - DNA, 25 bp, Homo sapien
ggttcctcgaatccaaagacagcct

SEQ ID NO: 119579 - DNA, 25 bp, Homo sapien
aagacagcctcttgaagaagaccca

SEQ ID NO: 119580 - DNA, 25 bp, Homo sapien
tcttgaagaagacccacagcctgtg

SEQ ID NO: 119581 - DNA, 25 bp, Homo sapien
tgaagaagacccacagcctgtgccc

SEQ ID NO: 119582 - DNA, 25 bp, Homo sapien
aagacagacaggtttcttgtcaact

SEQ ID NO: 119583 - DNA, 25 bp, Homo sapien
acaggtttcttgtcaacttagtgaa

SEQ ID NO: 119584 - DNA, 25 bp, Homo sapien
tcttgtcaacttagtgaagctgaag

SEQ ID NO: 119585 - DNA, 25 bp, Homo sapien
gaagctgaagcatgaactcacagat

SEQ ID NO: 119586 - DNA, 25 bp, Homo sapien
agctgcagtctttgtttacaaattt

SEQ ID NO: 119587 - DNA, 25 bp, Homo sapien
gtctttgtttacaaatttcgcaaat

SEQ ID NO: 119588 - DNA, 25 bp, Homo sapien
tgtagtggataagtgctgcaaagca

SEQ ID NO: 119589 - DNA, 25 bp, Homo sapien
gagtcctgaagtctgctttaatgaa

SEQ ID NO: 119590 - DNA, 25 bp, Homo sapien
gtctgctttaatgaagagagtccaa

SEQ ID NO: 119591 - DNA, 25 bp, Homo sapien
aattggcaactgaagccagctgctg

SEQ ID NO: 119592 - DNA, 25 bp, Homo sapien
gccagctgctggagatatgtaaaga

SEQ ID NO: 119593 - DNA, 25 bp, Homo sapien
agcctgacaacttttttgccgctgg

SEQ ID NO: 119594 - DNA, 25 bp, Homo sapien
tgacaacttttttgccgctggagag

SEQ ID NO: 119595 - DNA, 25 bp, Homo sapien
acttttttgccgctggagaggactg

SEQ ID NO: 119596 - DNA, 25 bp, Homo sapien
tttttgccgctggagaggactgtgt

SEQ ID NO: 119597 - DNA, 25 bp, Homo sapien
actgtgtggtgatgatctggcacga

SEQ ID NO: 119598 - DNA, 25 bp, Homo sapien
cccttcacgtgtaaaaagggcacag

SEQ ID NO: 119599 - DNA, 25 bp, Homo sapien
accacctacaaacgcagactacaga

SEQ ID NO: 119600 - DNA, 25 bp, Homo sapien
cagactacagaagcggagctcacgg

SEQ ID NO: 119601 - DNA, 25 bp, Homo sapien
tgacgtgcatcccacccagacggtg

SEQ ID NO: 119602 - DNA, 25 bp, Homo sapien
agacggtgtcctcttcttgtcgctt

SEQ ID NO: 119603 - DNA, 25 bp, Homo sapien
cggtgtcctcttcttgtcgcttttt

SEQ ID NO: 119604 - DNA, 25 bp, Homo sapien
ccgagacggccattcagcttatggg

SEQ ID NO: 119605 - DNA, 25 bp, Homo sapien
gatcatgtgcgtgctgtcggtctgc

SEQ ID NO: 119606 - DNA, 25 bp, Homo sapien
gtctccgctcctgataatgatgttg

SEQ ID NO: 119607 - DNA, 25 bp, Homo sapien
atcagacatcagttgagcactgcaa

SEQ ID NO: 119608 - DNA, 25 bp, Homo sapien
gagcactgcaagacacacacggaga

SEQ ID NO: 119609 - DNA, 25 bp, Homo sapien
gaatgcaacttcttcttaatagctg

SEQ ID NO: 119610 - DNA, 25 bp, Homo sapien
ttaatagctgttcgcctggcttcac

SEQ ID NO: 119611 - DNA, 25 bp, Homo sapien
gaaccagatcttggatccttgggtt

SEQ ID NO: 119612 - DNA, 25 bp, Homo sapien
gatccttgggtttacctgctgttaa

SEQ ID NO: 119613 - DNA, 25 bp, Homo sapien
tacctgctgttaagaaagatccttc

SEQ ID NO: 119614 - DNA, 25 bp, Homo sapien
gatccttcttcgaaagttttgccag

SEQ ID NO: 119615 - DNA, 25 bp, Homo sapien
ttcacgtggattttgcttggatctt

SEQ ID NO: 119616 - DNA, 25 bp, Homo sapien
gatcttggcaagaaaccctaatctc

SEQ ID NO: 119617 - DNA, 25 bp, Homo sapien
aacagtggactctctaaaaaatatc

SEQ ID NO: 119618 - DNA, 25 bp, Homo sapien
tcctgacttctaataacattgatgt

SEQ ID NO: 119619 - DNA, 25 bp, Homo sapien
gacggtcacagaccaggtgaactgc

SEQ ID NO: 119620 - DNA, 25 bp, Homo sapien
ggtgaactgccccaagctctcgtaa

SEQ ID NO: 119621 - DNA, 25 bp, Homo sapien
aagctctcgtaaccaggttctacag

SEQ ID NO: 119622 - DNA, 25 bp, Homo sapien
taaccaggttctacagggaggctgc

SEQ ID NO: 119623 - DNA, 25 bp, Homo sapien
actccatgttacttctgcttcgctt

SEQ ID NO: 119624 - DNA, 25 bp, Homo sapien
gaagttgacctaaacatgtaaccat

SEQ ID NO: 119625 - DNA, 25 bp, Homo sapien
taaacatgtaaccatgccctaccct

SEQ ID NO: 119626 - DNA, 25 bp, Homo sapien
atcaccaaggccagggagtggttcc

SEQ ID NO: 119627 - DNA, 25 bp, Homo sapien
aaggccagggagtggttccaccgca

SEQ ID NO: 119628 - DNA, 25 bp, Homo sapien
tggttccaccgcactgtgaagattg

SEQ ID NO: 119629 - DNA, 25 bp, Homo sapien
ctgtgaagattgactcggacctggg

SEQ ID NO: 119630 - DNA, 25 bp, Homo sapien
gggccttcttctacaagtttgagct

SEQ ID NO: 119631 - DNA, 25 bp, Homo sapien
agtttgagctgcagcatggcactga

SEQ ID NO: 119632 - DNA, 25 bp, Homo sapien
aagcgctgtgagagtgcagagcctc

SEQ ID NO: 119633 - DNA, 25 bp, Homo sapien
ctgtgagagtgcagagcctcggcat

SEQ ID NO: 119634 - DNA, 25 bp, Homo sapien
aaggacatcgccaactggcagaaga

SEQ ID NO: 119635 - DNA, 25 bp, Homo sapien
ggccgcatcaagaacaccttctgat

SEQ ID NO: 119636 - DNA, 25 bp, Homo sapien
gaacaccttctgattgagcggttgc

SEQ ID NO: 119637 - DNA, 25 bp, Homo sapien
atatcaagtcttgactccctacttc

SEQ ID NO: 119638 - DNA, 25 bp, Homo sapien
ggtggttatgtttgacagaaggcat

SEQ ID NO: 119639 - DNA, 25 bp, Homo sapien
gacagaaggcattaggttgacaact

SEQ ID NO: 119640 - DNA, 25 bp, Homo sapien
gacaacttgtcatgattttgacggt

SEQ ID NO: 119641 - DNA, 25 bp, Homo sapien
gattttgacggtaagccaccatgat

SEQ ID NO: 119642 - DNA, 25 bp, Homo sapien
aagccaccatgattgtgttctctgc

SEQ ID NO: 119643 - DNA, 25 bp, Homo sapien
accatgattgtgttctctgcctctg

SEQ ID NO: 119644 - DNA, 25 bp, Homo sapien
tctgcctctggttgaccttacaaaa

SEQ ID NO: 119645 - DNA, 25 bp, Homo sapien
aaccattggaactgtgactttgaaa

SEQ ID NO: 119646 - DNA, 25 bp, Homo sapien
aggtgctcttgctaagcttatatgt

SEQ ID NO: 119647 - DNA, 25 bp, Homo sapien
gctaagcttatatgtgcctgttaat

SEQ ID NO: 119648 - DNA, 25 bp, Homo sapien
gggtttcctgcctgacaacccttct

SEQ ID NO: 119649 - DNA, 25 bp, Homo sapien
tgaaactggcccaatttcctaaaag

SEQ ID NO: 119650 - DNA, 25 bp, Homo sapien
gtgcttgagaaacctacatttggac

SEQ ID NO: 119651 - DNA, 25 bp, Homo sapien
gagaaacctacatttggacaatgag

SEQ ID NO: 119652 - DNA, 25 bp, Homo sapien
tcttccttggctcctgctttctttt

SEQ ID NO: 119653 - DNA, 25 bp, Homo sapien
agactatatcaacctacaactttag

SEQ ID NO: 119654 - DNA, 25 bp, Homo sapien
atatcaacctacaactttagtcggg

SEQ ID NO: 119655 - DNA, 25 bp, Homo sapien
tcaacctacaactttagtcgggaag

SEQ ID NO: 119656 - DNA, 25 bp, Homo sapien
gggtggacctgagtttcgtctcctg

SEQ ID NO: 119657 - DNA, 25 bp, Homo sapien
tggacctgagtttcgtctcctgtct

SEQ ID NO: 119658 - DNA, 25 bp, Homo sapien
tgagtttcgtctcctgtctctctgg

SEQ ID NO: 119659 - DNA, 25 bp, Homo sapien
gattatgtccacgaattttgccgat

SEQ ID NO: 119660 - DNA, 25 bp, Homo sapien
tttgccgatatggagctgctgagcc

SEQ ID NO: 119661 - DNA, 25 bp, Homo sapien
agctgctgagccacataccattgct

SEQ ID NO: 119662 - DNA, 25 bp, Homo sapien
gtcatcaaaataatcaccaaacaat

SEQ ID NO: 119663 - DNA, 25 bp, Homo sapien
tacagtggcatgtcacaaacttcag

SEQ ID NO: 119664 - DNA, 25 bp, Homo sapien
gtcacaaacttcagcaactttccag

SEQ ID NO: 119665 - DNA, 25 bp, Homo sapien
aaacttcagcaactttccagttgta

SEQ ID NO: 119666 - DNA, 25 bp, Homo sapien
cagttgtagagtaagcaagcacctt

SEQ ID NO: 119667 - DNA, 25 bp, Homo sapien
gcaagcaccttaagtagtgtgttaa

SEQ ID NO: 119668 - DNA, 25 bp, Homo sapien
cttcgggttgtgctttagtctgtaa

SEQ ID NO: 119669 - DNA, 25 bp, Homo sapien
aaggagagctgctaaattgttttct

SEQ ID NO: 119670 - DNA, 25 bp, Homo sapien
ttctaagttttacccctgtgaggag

SEQ ID NO: 119671 - DNA, 25 bp, Homo sapien
tttacccctgtgaggagtgtgctga

SEQ ID NO: 119672 - DNA, 25 bp, Homo sapien
ggagtgtgctgaagacctaagaaaa

SEQ ID NO: 119673 - DNA, 25 bp, Homo sapien
aaaggctgtgcaggaaccacccaga

SEQ ID NO: 119674 - DNA, 25 bp, Homo sapien
gtgccacctgcacaatgaagtgaac

SEQ ID NO: 119675 - DNA, 25 bp, Homo sapien
cacaatgaagtgaaccgcaagctgg

SEQ ID NO: 119676 - DNA, 25 bp, Homo sapien
gcaagctgggcaagcctgacttcga

SEQ ID NO: 119677 - DNA, 25 bp, Homo sapien
aagcctgacttcgactgctcaaaag

SEQ ID NO: 119678 - DNA, 25 bp, Homo sapien
gacttcgactgctcaaaagtggatg

SEQ ID NO: 119679 - DNA, 25 bp, Homo sapien
ctcaaaagtggatgagcgctggcgc

SEQ ID NO: 119680 - DNA, 25 bp, Homo sapien
gctcatgggacagctagccaggcat

SEQ ID NO: 119681 - DNA, 25 bp, Homo sapien
ggcaagaacagcctacctggacctg

SEQ ID NO: 119682 - DNA, 25 bp, Homo sapien
gcctgatccggaaggatgccatcct

SEQ ID NO: 119683 - DNA, 25 bp, Homo sapien
gatgccatcctgttaactgatgctt

SEQ ID NO: 119684 - DNA, 25 bp, Homo sapien
gatgcttttgacttcaccgatcagt

SEQ ID NO: 119685 - DNA, 25 bp, Homo sapien
agtgtttaaattcagcccttggctg

SEQ ID NO: 119686 - DNA, 25 bp, Homo sapien
agcccttggctgttatgatggaaac

SEQ ID NO: 119687 - DNA, 25 bp, Homo sapien
gatggaaacgtctacgaacgcctgt

SEQ ID NO: 119688 - DNA, 25 bp, Homo sapien
gaacgcctgttccagtgggctcaga

SEQ ID NO: 119689 - DNA, 25 bp, Homo sapien
gtgggctcagaagtcaccaaccaat

SEQ ID NO: 119690 - DNA, 25 bp, Homo sapien
aatactcaggagaaccctgcctatg

SEQ ID NO: 119691 - DNA, 25 bp, Homo sapien
aagcaaccagcaccatcatgtgata

SEQ ID NO: 119692 - DNA, 25 bp, Homo sapien
tgaattcttgtcttgtactaggatc

SEQ ID NO: 119693 - DNA, 25 bp, Homo sapien
tcttgtcttgtactaggatctagca

SEQ ID NO: 119694 - DNA, 25 bp, Homo sapien
ggatctagcatatttcactattctg

SEQ ID NO: 119695 - DNA, 25 bp, Homo sapien
gcatatttcactattctgtggatga

SEQ ID NO: 119696 - DNA, 25 bp, Homo sapien
aaaagcatgactgctttttcctgtc

SEQ ID NO: 119697 - DNA, 25 bp, Homo sapien
tttcctgtctggcatggaatcacgc

SEQ ID NO: 119698 - DNA, 25 bp, Homo sapien
ctggcatggaatcacgcagtcacct

SEQ ID NO: 119699 - DNA, 25 bp, Homo sapien
ttaggtataaccacttagttgacac

SEQ ID NO: 119700 - DNA, 25 bp, Homo sapien
ggtataaccacttagttgacactga

SEQ ID NO: 119701 - DNA, 25 bp, Homo sapien
taaccacttagttgacactgatagt

SEQ ID NO: 119702 - DNA, 25 bp, Homo sapien
gaggaaaatattccatcaagtatct

SEQ ID NO: 119703 - DNA, 25 bp, Homo sapien
tagggcaagggccttctcaatgcct

SEQ ID NO: 119704 - DNA, 25 bp, Homo sapien
agggcaagggccttctcaatgcctc

SEQ ID NO: 119705 - DNA, 25 bp, Homo sapien
gggcaagggccttctcaatgcctcc

SEQ ID NO: 119706 - DNA, 25 bp, Homo sapien
ggcaagggccttctcaatgcctcca

SEQ ID NO: 119707 - DNA, 25 bp, Homo sapien
caagcccaacccaggcggacaaaag

SEQ ID NO: 119708 - DNA, 25 bp, Homo sapien
caacccaggcggacaaaaggcctag

SEQ ID NO: 119709 - DNA, 25 bp, Homo sapien
acccaggcggacaaaaggcctagag

SEQ ID NO: 119710 - DNA, 25 bp, Homo sapien
ccaggcggacaaaaggcctagaggt

SEQ ID NO: 119711 - DNA, 25 bp, Homo sapien
caggcggacaaaaggcctagaggta

SEQ ID NO: 119712 - DNA, 25 bp, Homo sapien
ggacaaaaggcctagaggtaacaat

SEQ ID NO: 119713 - DNA, 25 bp, Homo sapien
gacaaaaggcctagaggtaacaata

SEQ ID NO: 119714 - DNA, 25 bp, Homo sapien
aagtggctccatcctggaaaacttc

SEQ ID NO: 119715 - DNA, 25 bp, Homo sapien
gtggctccatcctggaaaacttcag

SEQ ID NO: 119716 - DNA, 25 bp, Homo sapien
gctccatcctggaaaacttcagtgg

SEQ ID NO: 119717 - DNA, 25 bp, Homo sapien
cgaacccgcggctgtcggagctgtc

SEQ ID NO: 119718 - DNA, 25 bp, Homo sapien
aacccgcggctgtcggagctgtccg

SEQ ID NO: 119719 - DNA, 25 bp, Homo sapien
agctgtccgcgagcgaggtgaccat

SEQ ID NO: 119720 - DNA, 25 bp, Homo sapien
tgtccgcgagcgaggtgaccatgct

SEQ ID NO: 119721 - DNA, 25 bp, Homo sapien
tccgcgagcgaggtgaccatgctga

SEQ ID NO: 119722 - DNA, 25 bp, Homo sapien
agcgaggtgaccatgctgagccagc

SEQ ID NO: 119723 - DNA, 25 bp, Homo sapien
gccagctgcaggagcgccgcgacag

SEQ ID NO: 119724 - DNA, 25 bp, Homo sapien
ggtcagctcggcctacaccgtgagc

SEQ ID NO: 119725 - DNA, 25 bp, Homo sapien
aaggcttttgagtataacatgcaga

SEQ ID NO: 119726 - DNA, 25 bp, Homo sapien
ttcaatgaactggaccaggccggct

SEQ ID NO: 119727 - DNA, 25 bp, Homo sapien
agaccttggaggatgggttccctgt

SEQ ID NO: 119728 - DNA, 25 bp, Homo sapien
atgggttccctgtacacgatgggaa

SEQ ID NO: 119729 - DNA, 25 bp, Homo sapien
gagacatgcgtaaatgccctttcta

SEQ ID NO: 119730 - DNA, 25 bp, Homo sapien
gccctttctacgctgctgaacaaga

SEQ ID NO: 119731 - DNA, 25 bp, Homo sapien
ctgaacaagacaaaggtgccctgga

SEQ ID NO: 119732 - DNA, 25 bp, Homo sapien
agctatggctgtgctgaggaagccc

SEQ ID NO: 119733 - DNA, 25 bp, Homo sapien
tgaggaagcccagcctccagttcat

SEQ ID NO: 119734 - DNA, 25 bp, Homo sapien
tggtgtggccctagctgctggactc

SEQ ID NO: 119735 - DNA, 25 bp, Homo sapien
tgctggactcttggcctggtactac

SEQ ID NO: 119736 - DNA, 25 bp, Homo sapien
atcccatttagtgtgaatattcctt

SEQ ID NO: 119737 - DNA, 25 bp, Homo sapien
tcccatttagtgtgaatattccttt

SEQ ID NO: 119738 - DNA, 25 bp, Homo sapien
gtgaatattcctttattttgctgct

SEQ ID NO: 119739 - DNA, 25 bp, Homo sapien
tattttgctgcttgatgatgagagg

SEQ ID NO: 119740 - DNA, 25 bp, Homo sapien
ttttgctgcttgatgatgagaggga

SEQ ID NO: 119741 - DNA, 25 bp, Homo sapien
ccacagactgtggtgagggctggtt

SEQ ID NO: 119742 - DNA, 25 bp, Homo sapien
agggctggttaatgtagtatggtat

SEQ ID NO: 119743 - DNA, 25 bp, Homo sapien
ggctggttaatgtagtatggtatat

SEQ ID NO: 119744 - DNA, 25 bp, Homo sapien
ggttaatgtagtatggtatatgcac

SEQ ID NO: 119745 - DNA, 25 bp, Homo sapien
atgtagtatggtatatgcacaaaac

SEQ ID NO: 119746 - DNA, 25 bp, Homo sapien
atatgcacaaaactacttttctaaa

SEQ ID NO: 119747 - DNA, 25 bp, Homo sapien
aaatatcctgtctgcctatcagggt

SEQ ID NO: 119748 - DNA, 25 bp, Homo sapien
aatatcctggactggcaggctctga

SEQ ID NO: 119749 - DNA, 25 bp, Homo sapien
tggcaggctctgaactatgaaatca

SEQ ID NO: 119750 - DNA, 25 bp, Homo sapien
gatatgtcatcatcaaacccttggt

SEQ ID NO: 119751 - DNA, 25 bp, Homo sapien
aacccttggtgtgggtctgaggtct

SEQ ID NO: 119752 - DNA, 25 bp, Homo sapien
ggtcttgactcaacgagagcacttg

SEQ ID NO: 119753 - DNA, 25 bp, Homo sapien
gaaatgactgtctaagagatctggt

SEQ ID NO: 119754 - DNA, 25 bp, Homo sapien
gatctggtcaaagcaactggatact

SEQ ID NO: 119755 - DNA, 25 bp, Homo sapien
ggatactagatcttacatctgcagt

SEQ ID NO: 119756 - DNA, 25 bp, Homo sapien
ttacatctgcagtctttcttctttg

SEQ ID NO: 119757 - DNA, 25 bp, Homo sapien
tgaatttcctatctgtatgtctgcc

SEQ ID NO: 119758 - DNA, 25 bp, Homo sapien
agatatagacactaaccttgatagt

SEQ ID NO: 119759 - DNA, 25 bp, Homo sapien
gtgatacgttagagggttcctattc

SEQ ID NO: 119760 - DNA, 25 bp, Homo sapien
gttcctattcttccattgtacgata

SEQ ID NO: 119761 - DNA, 25 bp, Homo sapien
tcttccattgtacgataatgtcttt

SEQ ID NO: 119762 - DNA, 25 bp, Homo sapien
agttgtaagtacacagaggtggtat

SEQ ID NO: 119763 - DNA, 25 bp, Homo sapien
gaggtggtatatttaaacttctgta

SEQ ID NO: 119764 - DNA, 25 bp, Homo sapien
atatagtgttaggtttcacttcttt

SEQ ID NO: 119765 - DNA, 25 bp, Homo sapien
gtgtggtttaaaaatctataggcct

SEQ ID NO: 119766 - DNA, 25 bp, Homo sapien
aaatctataggcctgggaattccga

SEQ ID NO: 119767 - DNA, 25 bp, Homo sapien
gggaattccgatcctagctgcagat

SEQ ID NO: 119768 - DNA, 25 bp, Homo sapien
agctgcagatcgcatcccacaatgc

SEQ ID NO: 119769 - DNA, 25 bp, Homo sapien
gactggccagccgaggacatgtttg

SEQ ID NO: 119770 - DNA, 25 bp, Homo sapien
gccagccgaggacatgtttgaccat

SEQ ID NO: 119771 - DNA, 25 bp, Homo sapien
agccgaggacatgtttgaccatccc

SEQ ID NO: 119772 - DNA, 25 bp, Homo sapien
cgaggacatgtttgaccatcccacc

SEQ ID NO: 119773 - DNA, 25 bp, Homo sapien
gctcatcaagggaaagactaagtca

SEQ ID NO: 119774 - DNA, 25 bp, Homo sapien
gactaagtcagaggagtccctctct

SEQ ID NO: 119775 - DNA, 25 bp, Homo sapien
agaggagtccctctctgaccttaca

SEQ ID NO: 119776 - DNA, 25 bp, Homo sapien
gagtccctctctgaccttacaggtt

SEQ ID NO: 119777 - DNA, 25 bp, Homo sapien
ctcacttttggatgaggtgctgaat

SEQ ID NO: 119778 - DNA, 25 bp, Homo sapien
gatgaggtgctgaatgtaatggata

SEQ ID NO: 119779 - DNA, 25 bp, Homo sapien
aagagaagggcttccggagctgtat

SEQ ID NO: 119780 - DNA, 25 bp, Homo sapien
gccgctctgtggatgagactttgag

SEQ ID NO: 119781 - DNA, 25 bp, Homo sapien
tttgagactagttcaggccttccag

SEQ ID NO: 119782 - DNA, 25 bp, Homo sapien
tagttcaggccttccagttcactga

SEQ ID NO: 119783 - DNA, 25 bp, Homo sapien
ggccttccagttcactgacaaacat

SEQ ID NO: 119784 - DNA, 25 bp, Homo sapien
tggctggaaacctggcagtgatacc

SEQ ID NO: 119785 - DNA, 25 bp, Homo sapien
ggaaacctggcagtgataccatcaa

SEQ ID NO: 119786 - DNA, 25 bp, Homo sapien
tggcagtgataccatcaagcctgat

SEQ ID NO: 119787 - DNA, 25 bp, Homo sapien
agtgataccatcaagcctgatgtcc

SEQ ID NO: 119788 - DNA, 25 bp, Homo sapien
tgagcgctgggctgttttagtgcca

SEQ ID NO: 119789 - DNA, 25 bp, Homo sapien
ctgggctgttttagtgccaggctgc

SEQ ID NO: 119790 - DNA, 25 bp, Homo sapien
attgtggtgtcttacaaggcaggcc

SEQ ID NO: 119791 - DNA, 25 bp, Homo sapien
gcgccaccgccagtcgagctgtgcg

SEQ ID NO: 119792 - DNA, 25 bp, Homo sapien
gagctgtgcgccttccccgagtgga

SEQ ID NO: 119793 - DNA, 25 bp, Homo sapien
ttccccgagtggaaggcgcccggcg

SEQ ID NO: 119794 - DNA, 25 bp, Homo sapien
tcaagctcctgaccgagcccgagag

SEQ ID NO: 119795 - DNA, 25 bp, Homo sapien
gccagcaacggaggctgcgaggccg

SEQ ID NO: 119796 - DNA, 25 bp, Homo sapien
aggccgcggccgacgtggccaacgg

SEQ ID NO: 119797 - DNA, 25 bp, Homo sapien
tggccaacgggcagccgggcttcaa

SEQ ID NO: 119798 - DNA, 25 bp, Homo sapien
ggcagccgggcttcaaaagcaacat

SEQ ID NO: 119799 - DNA, 25 bp, Homo sapien
ttcaaaagcaacatgcccctggcgc

SEQ ID NO: 119800 - DNA, 25 bp, Homo sapien
tgcccctggcgcccgggcagtttta

SEQ ID NO: 119801 - DNA, 25 bp, Homo sapien
ttagggcccccgtgcgcagctttct

SEQ ID NO: 119802 - DNA, 25 bp, Homo sapien
cactgagaaaactgtgattggctct

SEQ ID NO: 119803 - DNA, 25 bp, Homo sapien
ctctgttctgctgcgggaactgaag

SEQ ID NO: 119804 - DNA, 25 bp, Homo sapien
gtaacctgcttacatctggacttta

SEQ ID NO: 119805 - DNA, 25 bp, Homo sapien
tggactttagaatctggcacacaac

SEQ ID NO: 119806 - DNA, 25 bp, Homo sapien
aaaagtgcctggcatccactactgc

SEQ ID NO: 119807 - DNA, 25 bp, Homo sapien
ataatagcccttccatctggcagtg

SEQ ID NO: 119808 - DNA, 25 bp, Homo sapien
gaatacactcttgacattcttgtct

SEQ ID NO: 119809 - DNA, 25 bp, Homo sapien
gacattcttgtctcctgctttagaa

SEQ ID NO: 119810 - DNA, 25 bp, Homo sapien
gtctcctgctttagaatgctagtgt

SEQ ID NO: 119811 - DNA, 25 bp, Homo sapien
gctagtgtgtatctatcatgtatgc

SEQ ID NO: 119812 - DNA, 25 bp, Homo sapien
cctttttgctttgctaaccaaagag

SEQ ID NO: 119813 - DNA, 25 bp, Homo sapien
caacgggacccaggagaccatcctc

SEQ ID NO: 119814 - DNA, 25 bp, Homo sapien
aacgagacgcagattgagtggttcc

SEQ ID NO: 119815 - DNA, 25 bp, Homo sapien
acgcagattgagtggttccgcgctg

SEQ ID NO: 119816 - DNA, 25 bp, Homo sapien
cagattgagtggttccgcgctggca

SEQ ID NO: 119817 - DNA, 25 bp, Homo sapien
tggcagtgccctcaacagaatgaag

SEQ ID NO: 119818 - DNA, 25 bp, Homo sapien
actgcaacagtgagggcagtgcctc

SEQ ID NO: 119819 - DNA, 25 bp, Homo sapien
gccgcgctggcgtcaagttcagctc

SEQ ID NO: 119820 - DNA, 25 bp, Homo sapien
ggcgtcaagttcagctccacgtgtg

SEQ ID NO: 119821 - DNA, 25 bp, Homo sapien
cacgtgtgccatcagtggatccgat

SEQ ID NO: 119822 - DNA, 25 bp, Homo sapien
tgtgccatcagtggatccgatccgt

SEQ ID NO: 119823 - DNA, 25 bp, Homo sapien
ccatcagtggatccgatccgtccag

SEQ ID NO: 119824 - DNA, 25 bp, Homo sapien
acctttgccttggaagttgcatggc

SEQ ID NO: 119825 - DNA, 25 bp, Homo sapien
ccttggaagttgcatggcatcacct

SEQ ID NO: 119826 - DNA, 25 bp, Homo sapien
tccaccatactccatcagttagagc

SEQ ID NO: 119827 - DNA, 25 bp, Homo sapien
agttagagctgacacaaacctgcct

SEQ ID NO: 119828 - DNA, 25 bp, Homo sapien
tgaaaaatacagtttgtcacatgaa

SEQ ID NO: 119829 - DNA, 25 bp, Homo sapien
gtttgtcacatgaaacatttgcaaa

SEQ ID NO: 119830 - DNA, 25 bp, Homo sapien
ggagtacaggtgaagcaccaagctc

SEQ ID NO: 119831 - DNA, 25 bp, Homo sapien
gaagcaccaagctcaaagcgtggac

SEQ ID NO: 119832 - DNA, 25 bp, Homo sapien
caaagcgtggacaggtgtgccgaca

SEQ ID NO: 119833 - DNA, 25 bp, Homo sapien
gtgccgacagaaggaaccagcgtgt

SEQ ID NO: 119834 - DNA, 25 bp, Homo sapien
aaggaaccagcgtgtatatgagggt

SEQ ID NO: 119835 - DNA, 25 bp, Homo sapien
gggaactggtatcctgccaagcctg

SEQ ID NO: 119836 - DNA, 25 bp, Homo sapien
gccaagcctggttgtaatttgtaac

SEQ ID NO: 119837 - DNA, 25 bp, Homo sapien
attttctatttgtgcaaactctgta

SEQ ID NO: 119838 - DNA, 25 bp, Homo sapien
gggaactcaagattcttccagccac

SEQ ID NO: 119839 - DNA, 25 bp, Homo sapien
ccacatgtcacctgtaggtagaagt

SEQ ID NO: 119840 - DNA, 25 bp, Homo sapien
gtagaagtaaactctgcagtgcagc

SEQ ID NO: 119841 - DNA, 25 bp, Homo sapien
tgtggcttcctgcacactggacagg

SEQ ID NO: 119842 - DNA, 25 bp, Homo sapien
ctgcacactggacaggtgactgtat

SEQ ID NO: 119843 - DNA, 25 bp, Homo sapien
gacaggtgactgtatggtagagact

SEQ ID NO: 119844 - DNA, 25 bp, Homo sapien
agactgtgatctgggaactttttgc

SEQ ID NO: 119845 - DNA, 25 bp, Homo sapien
ggaactttttgctgtacaaatctgt

SEQ ID NO: 119846 - DNA, 25 bp, Homo sapien
agcacattccaaactttagcaacag

SEQ ID NO: 119847 - DNA, 25 bp, Homo sapien
gcaacagttatcacactttgtaatt

SEQ ID NO: 119848 - DNA, 25 bp, Homo sapien
aaagtttcacctgtattgaatcaga

SEQ ID NO: 119849 - DNA, 25 bp, Homo sapien
gtgttggctcactacgtagagtcca

SEQ ID NO: 119850 - DNA, 25 bp, Homo sapien
gggacagtcagttttagggttgcct

SEQ ID NO: 119851 - DNA, 25 bp, Homo sapien
agggttgcctgtatccagtaactcg

SEQ ID NO: 119852 - DNA, 25 bp, Homo sapien
ccgtgggtctctgggctgtcagctt

SEQ ID NO: 119853 - DNA, 25 bp, Homo sapien
ttctccatgtgtttgatttctcctc

SEQ ID NO: 119854 - DNA, 25 bp, Homo sapien
tgatttctcctcaggctggtagcaa

SEQ ID NO: 119855 - DNA, 25 bp, Homo sapien
gctggtagcaagttctggatcttat

SEQ ID NO: 119856 - DNA, 25 bp, Homo sapien
ggatcttatacccaacacacagcaa

SEQ ID NO: 119857 - DNA, 25 bp, Homo sapien
cagtaggtacggttccctgcctagg

SEQ ID NO: 119858 - DNA, 25 bp, Homo sapien
gtacggttccctgcctaggagctgg

SEQ ID NO: 119859 - DNA, 25 bp, Homo sapien
ggagggagagatctaatcccttcaa

SEQ ID NO: 119860 - DNA, 25 bp, Homo sapien
ggagagatctaatcccttcaaggaa

SEQ ID NO: 119861 - DNA, 25 bp, Homo sapien
gatctaatcccttcaaggaagtgat

SEQ ID NO: 119862 - DNA, 25 bp, Homo sapien
gaagtgataacactggagtggtaac

SEQ ID NO: 119863 - DNA, 25 bp, Homo sapien
tggtaacaagaggagcaggaagcaa

SEQ ID NO: 119864 - DNA, 25 bp, Homo sapien
agcaggaagcaaggccagccctggt

SEQ ID NO: 119865 - DNA, 25 bp, Homo sapien
ctggttctccatccccatgtgtttc

SEQ ID NO: 119866 - DNA, 25 bp, Homo sapien
atccccatgtgtttcaggtggaaca

SEQ ID NO: 119867 - DNA, 25 bp, Homo sapien
gggcacctctgctgtattgatatca

SEQ ID NO: 119868 - DNA, 25 bp, Homo sapien
taagtaataggcctaaactggattt

SEQ ID NO: 119869 - DNA, 25 bp, Homo sapien
gatttccttattccaaatcctgtct

SEQ ID NO: 119870 - DNA, 25 bp, Homo sapien
gtcttttccccactattccattaga

SEQ ID NO: 119871 - DNA, 25 bp, Homo sapien
actattccattagaccccacaaatg

SEQ ID NO: 119872 - DNA, 25 bp, Homo sapien
cattagaccccacaaatgttagttg

SEQ ID NO: 119873 - DNA, 25 bp, Homo sapien
taatcactgtaaccgggtgcatttt

SEQ ID NO: 119874 - DNA, 25 bp, Homo sapien
ttcagaagatacaatggtcccaggg

SEQ ID NO: 119875 - DNA, 25 bp, Homo sapien
ctgaattaagctttatcagtgtact

SEQ ID NO: 119876 - DNA, 25 bp, Homo sapien
tcagtgtactctttatctgtgttac

SEQ ID NO: 119877 - DNA, 25 bp, Homo sapien
ctttatctgtgttactagtgcctgg

SEQ ID NO: 119878 - DNA, 25 bp, Homo sapien
ctgtgttactagtgcctggtatgta

SEQ ID NO: 119879 - DNA, 25 bp, Homo sapien
ttgtctgctggccacgcaagtgtca

SEQ ID NO: 119880 - DNA, 25 bp, Homo sapien
gtctgctggccacgcaagtgtcaca

SEQ ID NO: 119881 - DNA, 25 bp, Homo sapien
tgctggccacgcaagtgtcacatgc

SEQ ID NO: 119882 - DNA, 25 bp, Homo sapien
tggccacgcaagtgtcacatgcgat

SEQ ID NO: 119883 - DNA, 25 bp, Homo sapien
gccacgcaagtgtcacatgcgatct

SEQ ID NO: 119884 - DNA, 25 bp, Homo sapien
gcaagtgtcacatgcgatctacatt

SEQ ID NO: 119885 - DNA, 25 bp, Homo sapien
caagtgtcacatgcgatctacatta

SEQ ID NO: 119886 - DNA, 25 bp, Homo sapien
agtgtcacatgcgatctacattaat

SEQ ID NO: 119887 - DNA, 25 bp, Homo sapien
gtgtcacatgcgatctacattaata

SEQ ID NO: 119888 - DNA, 25 bp, Homo sapien
gtcacatgcgatctacattaatatc

SEQ ID NO: 119889 - DNA, 25 bp, Homo sapien
catgcgatctacattaatatcaagt

SEQ ID NO: 119890 - DNA, 25 bp, Homo sapien
acgtgcatgtgcaaaagctttgaaa

SEQ ID NO: 119891 - DNA, 25 bp, Homo sapien
aaagcttcgctttgccagtagaatc

SEQ ID NO: 119892 - DNA, 25 bp, Homo sapien
tcgctttgccagtagaatccggaaa

SEQ ID NO: 119893 - DNA, 25 bp, Homo sapien
aaacattcttaatatgtcatcttgt

SEQ ID NO: 119894 - DNA, 25 bp, Homo sapien
gtcatcttgtttgtctttatggctt

SEQ ID NO: 119895 - DNA, 25 bp, Homo sapien
gtctttatggcttatttgcctttat

SEQ ID NO: 119896 - DNA, 25 bp, Homo sapien
atttgcctttatggttgtatctgaa

SEQ ID NO: 119897 - DNA, 25 bp, Homo sapien
atatgacagcatgaggaaacaaatc

SEQ ID NO: 119898 - DNA, 25 bp, Homo sapien
atcattggtgatttattcaccagtt

SEQ ID NO: 119899 - DNA, 25 bp, Homo sapien
caccagtttttattaatacaagtca

SEQ ID NO: 119900 - DNA, 25 bp, Homo sapien
caaatgtgagtctaccatttttaat

SEQ ID NO: 119901 - DNA, 25 bp, Homo sapien
cagtaggtacggttccctgcctagg

SEQ ID NO: 119902 - DNA, 25 bp, Homo sapien
aggtacggttccctgcctaggagct

SEQ ID NO: 119903 - DNA, 25 bp, Homo sapien
gtacggttccctgcctaggagctgg

SEQ ID NO: 119904 - DNA, 25 bp, Homo sapien
ggagggagagatctaatcccttcaa

SEQ ID NO: 119905 - DNA, 25 bp, Homo sapien
ggagagatctaatcccttcaaggaa

SEQ ID NO: 119906 - DNA, 25 bp, Homo sapien
gagagatctaatcccttcaaggaag

SEQ ID NO: 119907 - DNA, 25 bp, Homo sapien
gagatctaatcccttcaaggaagtg
